United States Patent 10,706,955 (BIOINFORMATIC PROCESSES FOR DETERMINATION OF PEPTIDE BINDING) - sequence listing, part 46

SEQ ID NO: 1753089 - protein, 25 aa, Staphylococcus epidermidis
RANRNFRFFQIFTAALQSFSHGTND

SEQ ID NO: 1753090 - protein, 30 aa, Staphylococcus epidermidis
RATNEEKQIFVSKLKALINRAHKQIDEAET

SEQ ID NO: 1753091 - protein, 31 aa, Staphylococcus epidermidis
RATNEEKQIFVSKLKALINRAHKQIDEAETF

SEQ ID NO: 1753092 - protein, 17 aa, Staphylococcus epidermidis
RAYVKFDDQMNQMKVQL

SEQ ID NO: 1753093 - protein, 23 aa, Staphylococcus epidermidis
RDDEFIIYKFGSDSIRVYKTEFE

SEQ ID NO: 1753094 - protein, 23 aa, Staphylococcus epidermidis
RERPIHVKQLKDKVAKIVIQMNT

SEQ ID NO: 1753095 - protein, 22 aa, Staphylococcus epidermidis
RFDIRDPYWKLIKENKRKVKRD

SEQ ID NO: 1753096 - protein, 19 aa, Staphylococcus epidermidis
RFEYPITFVTSIFASIFTS

SEQ ID NO: 1753097 - protein, 30 aa, Staphylococcus epidermidis
RFHNIIYGWCFIILMFALPIYLSYHISDGL

SEQ ID NO: 1753098 - protein, 22 aa, Staphylococcus epidermidis
RFMWKWKLFRIFNKQADISGDY

SEQ ID NO: 1753099 - protein, 22 aa, Staphylococcus epidermidis
RFNKFEWLAIIFALIGVLYMTI

SEQ ID NO: 1753100 - protein, 25 aa, Staphylococcus epidermidis
RFPKSIIFIAPMIVFLFVFGIGTAN

SEQ ID NO: 1753101 - protein, 21 aa, Staphylococcus epidermidis
RFRDLTMRILKSAFLSGLMLE

SEQ ID NO: 1753102 - protein, 22 aa, Staphylococcus epidermidis
RFRDLTMRILKSAFLSGLMLEF

SEQ ID NO: 1753103 - protein, 33 aa, Staphylococcus epidermidis
RFSAYWPFFSDVFIWLPLFLYAIERVLQQRKQG

SEQ ID NO: 1753104 - protein, 22 aa, Staphylococcus epidermidis
RFSIRKYAVGAISIITGVAIFI

SEQ ID NO: 1753105 - protein, 24 aa, Staphylococcus epidermidis
RFSRTIIVLILLVPSALIVFGAYD

SEQ ID NO: 1753106 - protein, 23 aa, Staphylococcus epidermidis
RGNFLTYLIVCTIFIISYVTMII

SEQ ID NO: 1753107 - protein, 23 aa, Staphylococcus epidermidis
RGNFLTYLIVCTIFIISYVTMIL

SEQ ID NO: 1753108 - protein, 23 aa, Staphylococcus epidermidis
RGVKLFYPLPFNIVSPIHFKTGG

SEQ ID NO: 1753109 - protein, 18 aa, Staphylococcus epidermidis
RHLYIFSMAIFLIGSIIA

SEQ ID NO: 1753110 - protein, 20 aa, Staphylococcus epidermidis
RHQFEQLLLIFLDNAMKYDT

SEQ ID NO: 1753111 - protein, 19 aa, Staphylococcus epidermidis
RIALGIGGAVAAVALTRKD

SEQ ID NO: 1753112 - protein, 19 aa, Staphylococcus epidermidis
RIDTGYYNNDPLDKIQKQA

SEQ ID NO: 1753113 - protein, 23 aa, Staphylococcus epidermidis
RIGRSLGIHLILATQKPSGVVDD

SEQ ID NO: 1753114 - protein, 18 aa, Staphylococcus epidermidis
RIIFVVILVPLISYFFRD

SEQ ID NO: 1753115 - protein, 29 aa, Staphylococcus epidermidis
RIIIILIISLILAVVFFFGLKTYQGHKNI

SEQ ID NO: 1753116 - protein, 21 aa, Staphylococcus epidermidis
RIMYIIIIIAVIYFVIRYLMK

SEQ ID NO: 1753117 - protein, 22 aa, Staphylococcus epidermidis
RIQQDWLLFGLLSIITSFSILF

SEQ ID NO: 1753118 - protein, 18 aa, Staphylococcus epidermidis
RISKNGTRYLFFDNMSFT

SEQ ID NO: 1753119 - protein, 17 aa, Staphylococcus epidermidis
RIVVTIFNAIKSFSIKV

SEQ ID NO: 1753120 - protein, 63 aa, Staphylococcus epidermidis
RIVYDKRKIAFISFLLLLTLFVLFSIAIYLLPLFILGNASWTFVLSWLPIHAKWLIASFYIFM

SEQ ID NO: 1753121 - protein, 19 aa, Staphylococcus epidermidis
RIWIAIMFLIGFIAVIALR

SEQ ID NO: 1753122 - protein, 23 aa, Staphylococcus epidermidis
RKEGILFHYLFSKNKQETNERDR

SEQ ID NO: 1753123 - protein, 25 aa, Staphylococcus epidermidis
RKINPLIDFSLFKNRFYTSATLANF

SEQ ID NO: 1753124 - protein, 25 aa, Staphylococcus epidermidis
RKKIILTLFVLPFPIMVWGVMTQGW

SEQ ID NO: 1753125 - protein, 25 aa, Staphylococcus epidermidis
RKLSPIIVILLIGILLYFLFKHDNQ

SEQ ID NO: 1753126 - protein, 17 aa, Staphylococcus epidermidis
RKNEIEKLPFDDNLRKL

SEQ ID NO: 1753127 - protein, 26 aa, Staphylococcus epidermidis
RLIILLIIDSLIVFFSIFVCYEILEP

SEQ ID NO: 1753128 - protein, 33 aa, Staphylococcus epidermidis
RLNQVLALIVLFLLIILPLCLILFKGFAPGESG

SEQ ID NO: 1753129 - protein, 21 aa, Staphylococcus epidermidis
RLPVYALFVGVFFKAYQSLVV

SEQ ID NO: 1753130 - protein, 24 aa, Staphylococcus epidermidis
RLSAFQLLLLVFFSSTFTACSVTM

SEQ ID NO: 1753131 - protein, 18 aa, Staphylococcus epidermidis
RLVIIALVLMIWLSNPFV

SEQ ID NO: 1753132 - protein, 23 aa, Staphylococcus epidermidis
RLVYPVINICVIVLKPITVLLNK

SEQ ID NO: 1753133 - protein, 19 aa, Staphylococcus epidermidis
RMASFSFIFIGILGVLRGF

SEQ ID NO: 1753134 - protein, 18 aa, Staphylococcus epidermidis
RMLNIEQLVFFIVTGILG

SEQ ID NO: 1753135 - protein, 17 aa, Staphylococcus epidermidis
RMVFSTMNVERMNSILF

SEQ ID NO: 1753136 - protein, 21 aa, Staphylococcus epidermidis
RMWNNVIISSIITLTGLIEGV

SEQ ID NO: 1753137 - protein, 22 aa, Staphylococcus epidermidis
RNGMNELIKKGFTFNQVTGAMP

SEQ ID NO: 1753138 - protein, 30 aa, Staphylococcus epidermidis
RNIAYIFTIFLFVLSFILYVIHYFKEQFKG

SEQ ID NO: 1753139 - protein, 26 aa, Staphylococcus epidermidis
RNKSQKWYLIIILNTINIIQFDTYFN

SEQ ID NO: 1753140 - protein, 25 aa, Staphylococcus epidermidis
RNQNNINQFIWNKNGFFKSQNNIEH

SEQ ID NO: 1753141 - protein, 39 aa, Staphylococcus epidermidis
RNTMNKRINFVFGFIVLIFAILVLRLGYLQIAQGSQYKQ

SEQ ID NO: 1753142 - protein, 19 aa, Staphylococcus epidermidis
RPLPIYRKGLLSVLVVVIL

SEQ ID NO: 1753143 - protein, 17 aa, Staphylococcus epidermidis
RPLSIALFVILLATLFI

SEQ ID NO: 1753144 - protein, 29 aa, Staphylococcus epidermidis
RPTGTGNVYTEYWLTRDGTTNTNDFYRGT

SEQ ID NO: 1753145 - protein, 19 aa, Staphylococcus epidermidis
RPVMRPLFTLPGRSTVDNL

SEQ ID NO: 1753146 - protein, 20 aa, Staphylococcus epidermidis
RQINTNDVLTLLQATAKNSN

SEQ ID NO: 1753147 - protein, 19 aa, Staphylococcus epidermidis
RQINTNDVLTLLQATAKSS

SEQ ID NO: 1753148 - protein, 21 aa, Staphylococcus epidermidis
RQIPIKTIKGVKVALLSYTFG

SEQ ID NO: 1753149 - protein, 24 aa, Staphylococcus epidermidis
RQRRYEWFGDIIAQLRADVLLTAH

SEQ ID NO: 1753150 - protein, 42 aa, Staphylococcus epidermidis
RRKKQKRIQYTIITLLILIIVLILLYMVTPLSKISNVNVKGN

SEQ ID NO: 1753151 - protein, 19 aa, Staphylococcus epidermidis
RRLELSRLLLMKPELVIFD

SEQ ID NO: 1753152 - protein, 23 aa, Staphylococcus epidermidis
RRNIFTMIGIIIGIAAVITIMSL

SEQ ID NO: 1753153 - protein, 17 aa, Staphylococcus epidermidis
RRYQWKKEGIRTKNNAS

SEQ ID NO: 1753154 - protein, 36 aa, Staphylococcus epidermidis
RSAGSIWAWLLVLVILPIVGFILYLLLGRQIQRKHI

SEQ ID NO: 1753155 - protein, 27 aa, Staphylococcus epidermidis
RSIIMPLYMMFSILLTYYVSMSIANLI

SEQ ID NO: 1753156 - protein, 18 aa, Staphylococcus epidermidis
RSISAYNKAIKSLETQIT

SEQ ID NO: 1753157 - protein, 21 aa, Staphylococcus epidermidis
RSKVINIKMPQKLINKEKNKT

SEQ ID NO: 1753158 - protein, 21 aa, Staphylococcus epidermidis
RSLLKAYPYMLSGGMLQRMMI

SEQ ID NO: 1753159 - protein, 21 aa, Staphylococcus epidermidis
RSLYIPILIEQLFILIMGQAD

SEQ ID NO: 1753160 - protein, 21 aa, Staphylococcus epidermidis
RSNLLVPLDHKKIPNMKNLDS

SEQ ID NO: 1753161 - protein, 26 aa, Staphylococcus epidermidis
RSVLLWALIIFIFGNGLIAIAPHFAI

SEQ ID NO: 1753162 - protein, 25 aa, Staphylococcus epidermidis
RSVVTPFIPLFIVGISYVFSSAIVA

SEQ ID NO: 1753163 - protein, 24 aa, Staphylococcus epidermidis
RSYSLYLWHFPIISFIHSHYIDGQ

SEQ ID NO: 1753164 - protein, 23 aa, Staphylococcus epidermidis
RSYSLYLWHFPIMSFVHSYFIDG

SEQ ID NO: 1753165 - protein, 17 aa, Staphylococcus epidermidis
RSYSLYLWHFPVISFIH

SEQ ID NO: 1753166 - protein, 23 aa, Staphylococcus epidermidis
RTGKLTYQRFLNGYPTFNKQNFN

SEQ ID NO: 1753167 - protein, 20 aa, Staphylococcus epidermidis
RTIHLIGLTLWLGSLVYLIC

SEQ ID NO: 1753168 - protein, 21 aa, Staphylococcus epidermidis
RTIHLIGLTLWLGSLVYLICY

SEQ ID NO: 1753169 - protein, 27 aa, Staphylococcus epidermidis
RTLHLAGMTLWLGALIYLICYAKTERG

SEQ ID NO: 1753170 - protein, 23 aa, Staphylococcus epidermidis
RTLTWLMAIIVYLTIYTGALVRH

SEQ ID NO: 1753171 - protein, 17 aa, Staphylococcus epidermidis
RTPIFYSLGNTTSDNFL

SEQ ID NO: 1753172 - protein, 30 aa, Staphylococcus epidermidis
RTRVSMFIWLVLLLPLPFLLSNLGVTFVVI

SEQ ID NO: 1753173 - protein, 22 aa, Staphylococcus epidermidis
RTSWICILLIIYPVGLGWYLKT

SEQ ID NO: 1753174 - protein, 22 aa, Staphylococcus epidermidis
RTTTFAILILFVINFNNTADKT

SEQ ID NO: 1753175 - protein, 29 aa, Staphylococcus epidermidis
RTVITFIFSFYLFNYLRLKPAPLFIATIL

SEQ ID NO: 1753176 - protein, 22 aa, Staphylococcus epidermidis
RTYIRLMRNVYLNNPLTSEIKQ

SEQ ID NO: 1753177 - protein, 30 aa, Staphylococcus epidermidis
RVAIFISPLWFIFLFFYYKKYKNNAESLAK

SEQ ID NO: 1753178 - protein, 37 aa, Staphylococcus epidermidis
RVGAFSMVLLILHPVLFIFFIFIFANSWRHTHFSKKV

SEQ ID NO: 1753179 - protein, 25 aa, Staphylococcus epidermidis
RVIRQNIIFSMAVVAFLVVVSLLGL

SEQ ID NO: 1753180 - protein, 20 aa, Staphylococcus epidermidis
RVSPRKVIAPLIKAHKAGLK

SEQ ID NO: 1753181 - protein, 35 aa, Staphylococcus epidermidis
RVVRRRIALFGGILLAIILILLVLLVIQRHSNDQD

SEQ ID NO: 1753182 - protein, 21 aa, Staphylococcus epidermidis
RYGIVILILLVSTLFSLCIGS

SEQ ID NO: 1753183 - protein, 18 aa, Staphylococcus epidermidis
RYGRTLAYVWISDKRMFN

SEQ ID NO: 1753184 - protein, 23 aa, Staphylococcus epidermidis
RYGRTLAYVWLKNGDMLNESLVK

SEQ ID NO: 1753185 - protein, 26 aa, Staphylococcus epidermidis
RYGRTYKGIIPDWEPGKKVHLVGHSM

SEQ ID NO: 1753186 - protein, 17 aa, Staphylococcus epidermidis
RYIHEVEEPDFLIVIYH

SEQ ID NO: 1753187 - protein, 24 aa, Staphylococcus epidermidis
RYKRPVIIFIVPGIIPLVPGGAAY

SEQ ID NO: 1753188 - protein, 18 aa, Staphylococcus epidermidis
RYLFIITIVLFISFILLY

SEQ ID NO: 1753189 - protein, 18 aa, Staphylococcus epidermidis
RYLVYKFRPLKVIATDED

SEQ ID NO: 1753190 - protein, 40 aa, Staphylococcus epidermidis
RYNHAKPPVFLVRFWTLFASFLIGLALMGVLLFNNLGKVH

SEQ ID NO: 1753191 - protein, 37 aa, Staphylococcus epidermidis
RYQANFFAIWFELGVLTFVYVLTAFKIARLGYEVTAQ

SEQ ID NO: 1753192 - protein, 26 aa, Staphylococcus epidermidis
RYSHWLRFVWPVVAFVLIFGGGLLIT

SEQ ID NO: 1753193 - protein, 24 aa, Staphylococcus epidermidis
RYSVPPLFAFITTLFIGILTGLFG

SEQ ID NO: 1753194 - protein, 17 aa, Staphylococcus epidermidis
RYYYPSIFALEEISFML

SEQ ID NO: 1753195 - protein, 21 aa, Staphylococcus epidermidis
RYYYYFSIMFMLIGIIGAFTT

SEQ ID NO: 1753196 - protein, 21 aa, Staphylococcus epidermidis
SAAKLNVQPTDNSFQDFVIDY

SEQ ID NO: 1753197 - protein, 26 aa, Staphylococcus epidermidis
SAALSFIIFLGITQINWFAVIALSLG

SEQ ID NO: 1753198 - protein, 26 aa, Staphylococcus epidermidis
SAALSFIIFLGLTQINWFAVIALSVG

SEQ ID NO: 1753199 - protein, 23 aa, Staphylococcus epidermidis
SAEFVIAIRFLLGIAGALIMPTT

SEQ ID NO: 1753200 - protein, 21 aa, Staphylococcus epidermidis
SAFALIIPILAGFIARSIADK

SEQ ID NO: 1753201 - protein, 27 aa, Staphylococcus epidermidis
SAISVLFAVLAALTLLPALISVFHKRI

SEQ ID NO: 1753202 - protein, 21 aa, Staphylococcus epidermidis
SALKVLFGHALRNALIPIITI

SEQ ID NO: 1753203 - protein, 25 aa, Staphylococcus epidermidis
SALLILLFVFSLFFVKDYMKTNYSF

SEQ ID NO: 1753204 - protein, 21 aa, Staphylococcus epidermidis
SALMLIYLVAKIFQFGSQIIA

SEQ ID NO: 1753205 - protein, 18 aa, Staphylococcus epidermidis
SAMSRFLQAVVSGFFRVV

SEQ ID NO: 1753206 - protein, 26 aa, Staphylococcus epidermidis
SAQAKLAAKALVSKILDDAYEEINEA

SEQ ID NO: 1753207 - protein, 23 aa, Staphylococcus epidermidis
SAQFPFHIWLPKAMAAPTPVSAY

SEQ ID NO: 1753208 - protein, 21 aa, Staphylococcus epidermidis
SARIFLQIILIIVLFPLFYKL

SEQ ID NO: 1753209 - protein, 37 aa, Staphylococcus epidermidis
SASFKWYDFVYFIDTIIYLVILIFKRKWLDNRAFSKK

SEQ ID NO: 1753210 - protein, 36 aa, Staphylococcus epidermidis
SASSTWAWLFVLFILPIIGFILYLFLGRTVSKKKME

SEQ ID NO: 1753211 - protein, 21 aa, Staphylococcus epidermidis
SASTSLRESTSTSTSDSASTS

SEQ ID NO: 1753212 - protein, 112 aa, Staphylococcus epidermidis
SATYDPKTGIATLTPDAYSQKGAISLNTRLDSNRSFRFTGKVNLGNRYEGYSPDGVPGGDGIGFAFSPGPLGQIGKEGAAVGIGGLNNAFGFKLDTYHNTSTPKSDAKAKAD

SEQ ID NO: 1753213 - protein, 29 aa, Staphylococcus epidermidis
SAVAFVLTFIKFPIPFLPPYLTLDFSDVP

SEQ ID NO: 1753214 - protein, 21 aa, Staphylococcus epidermidis
SAWGYWFSAFLGNVAYATLLM

SEQ ID NO: 1753215 - protein, 23 aa, Staphylococcus epidermidis
SAWGYWFSAFLGNVAYATLLMSS

SEQ ID NO: 1753216 - protein, 25 aa, Staphylococcus epidermidis
SCHLTPFLYVILKNALMNIHQSQEE

SEQ ID NO: 1753217 - protein, 43 aa, Staphylococcus epidermidis
SCIGLFILLIIFSLLLYFSFLNHWWPFTSYIFLGLGLLSILNT

SEQ ID NO: 1753218 - protein, 18 aa, Staphylococcus epidermidis
SCITILLLMIYQKDFYKN

SEQ ID NO: 1753219 - protein, 25 aa, Staphylococcus epidermidis
SDANLLIQNILFSIATITAGYHVII

SEQ ID NO: 1753220 - protein, 24 aa, Staphylococcus epidermidis
SDGITKFIYRKISTAQSPIVENNQ

SEQ ID NO: 1753221 - protein, 19 aa, Staphylococcus epidermidis
SDIYSLFRKQNFSGNEYLN

SEQ ID NO: 1753222 - protein, 24 aa, Staphylococcus epidermidis
SDKHFLILLLFIVLMYPIHKVMHL

SEQ ID NO: 1753223 - protein, 39 aa, Staphylococcus epidermidis
SDKVAGYLFYFAVSVGVISFIVWMLIQNDVDFALERLVT

SEQ ID NO: 1753224 - protein, 18 aa, Staphylococcus epidermidis
SDLFDDDGNISLPATGEV

SEQ ID NO: 1753225 - protein, 23 aa, Staphylococcus epidermidis
SDMQKVIILMSLITFIVLVIFKR

SEQ ID NO: 1753226 - protein, 37 aa, Staphylococcus epidermidis
SDNLIILYLFWELTSFSSFLLISFWREKKASIYGAQK

SEQ ID NO: 1753227 - protein, 28 aa, Staphylococcus epidermidis
SDNQVRQLLVHLILIIKRSASEEVEWEA

SEQ ID NO: 1753228 - protein, 27 aa, Staphylococcus epidermidis
SDPPIQSYVFVYILIVTGGRFGEVQKL

SEQ ID NO: 1753229 - protein, 24 aa, Staphylococcus epidermidis
SDSNSASTSLSGSLSTNVSDSTST

SEQ ID NO: 1753230 - protein, 25 aa, Staphylococcus epidermidis
SDSNSASTSLSGSLSTNVSDSTSTS

SEQ ID NO: 1753231 - protein, 25 aa, Staphylococcus epidermidis
SDSNSASTSLSGSLSTSISDSTSTS

SEQ ID NO: 1753232 - protein, 28 aa, Staphylococcus epidermidis
SDSNSASTSLSGSLSTSVSDSTSASTSD

SEQ ID NO: 1753233 - protein, 29 aa, Staphylococcus epidermidis
SEEKILLALLLYRFAYYFVPVLIALVLST

SEQ ID NO: 1753234 - protein, 32 aa, Staphylococcus epidermidis
SEEVKVLMPIKEFTPLAPLLETNYKKATVSIL

SEQ ID NO: 1753235 - protein, 24 aa, Staphylococcus epidermidis
SEINKISVIAIKKPEAIAEIQELA

SEQ ID NO: 1753236 - protein, 17 aa, Staphylococcus epidermidis
SELNNAKSALRADKQEL

SEQ ID NO: 1753237 - protein, 20 aa, Staphylococcus epidermidis
SEMQLWVFLLVSLFGQFFLE

SEQ ID NO: 1753238 - protein, 22 aa, Staphylococcus epidermidis
SEMQLWVFLLVSLFGQFFLENV

SEQ ID NO: 1753239 - protein, 17 aa, Staphylococcus epidermidis
SENPLVICYTNDVVKNF

SEQ ID NO: 1753240 - protein, 30 aa, Staphylococcus epidermidis
SEPVNLNYSSPFMSLLSMPADSSSNNTKNT

SEQ ID NO: 1753241 - protein, 27 aa, Staphylococcus epidermidis
SERGPVKIPGYRYTRMTMSDGITKYIY

SEQ ID NO: 1753242 - protein, 24 aa, Staphylococcus epidermidis
SERPIHVKQLKDKVAKIVIQMNTF

SEQ ID NO: 1753243 - protein, 24 aa, Staphylococcus epidermidis
SESKIFFKLILPLSKRSILSGIMM

SEQ ID NO: 1753244 - protein, 39 aa, Staphylococcus epidermidis
SETFTSQSPINSESQFIGDSLSEDTIVTQSKNTNMLNKT

SEQ ID NO: 1753245 - protein, 20 aa, Staphylococcus epidermidis
SEVYVIKELDILNNAQKAAI

SEQ ID NO: 1753246 - protein, 22 aa, Staphylococcus epidermidis
SFALGWFALLVAVVLLFVSTGD

SEQ ID NO: 1753247 - protein, 17 aa, Staphylococcus epidermidis
SFFLYENYKFIFLNSHS

SEQ ID NO: 1753248 - protein, 26 aa, Staphylococcus epidermidis
SFFTLFLNFIILIVSIILIIFGVPIY

SEQ ID NO: 1753249 - protein, 22 aa, Staphylococcus epidermidis
SFFTNFILILLLIAYLNSKISY

SEQ ID NO: 1753250 - protein, 17 aa, Staphylococcus epidermidis
SFFVLLVCSLMIIFGLK

SEQ ID NO: 1753251 - protein, 23 aa, Staphylococcus epidermidis
SFGFLILYSIIFLSIALLINKKK

SEQ ID NO: 1753252 - protein, 17 aa, Staphylococcus epidermidis
SFGMMLIGEACLFLLNV

SEQ ID NO: 1753253 - protein, 19 aa, Staphylococcus epidermidis
SFHFLLEFLFTMWTMFFLT

SEQ ID NO: 1753254 - protein, 28 aa, Staphylococcus epidermidis
SFIILISLLIILGYLIIIEKLPPHVPIL

SEQ ID NO: 1753255 - protein, 25 aa, Staphylococcus epidermidis
SFIITALLCLLTYSLNTIPIFIILL

SEQ ID NO: 1753256 - protein, 25 aa, Staphylococcus epidermidis
SFILVLFIFLFSWVPNVSHAAEGKS

SEQ ID NO: 1753257 - protein, 35 aa, Staphylococcus epidermidis
SFKVLAETLGQQVVPAIIPLIDKATDLANKFGQLD

SEQ ID NO: 1753258 - protein, 33 aa, Staphylococcus epidermidis
SFLALISMNIRILSGFLFLLAAVVTIPLVFLVV

SEQ ID NO: 1753259 - protein, 21 aa, Staphylococcus epidermidis
SFLLFLGNWIGQIGLNWFVLT

SEQ ID NO: 1753260 - protein, 17 aa, Staphylococcus epidermidis
SFLLFLGNWIGQVGLNW

SEQ ID NO: 1753261 - protein, 17 aa, Staphylococcus epidermidis
SFMIMTCVLIGFIVCGR

SEQ ID NO: 1753262 - protein, 25 aa, Staphylococcus epidermidis
SFMLTGFAFMVTTSLFSHQAHAEGS

SEQ ID NO: 1753263 - protein, 23 aa, Staphylococcus epidermidis
SFNLYFGIFMICVAILLMVRHKI

SEQ ID NO: 1753264 - protein, 46 aa, Staphylococcus epidermidis
SFNNKPLRMMIYLGMFTFSISILYIIYLLINIIISGINIPGYFTTI

SEQ ID NO: 1753265 - protein, 20 aa, Staphylococcus epidermidis
SFRDAVIGIWNSIKNAAIAI

SEQ ID NO: 1753266 - protein, 30 aa, Staphylococcus epidermidis
SFRMNSIMQILTLVSVIFSPLTFIAGVYGM

SEQ ID NO: 1753267 - protein, 20 aa, Staphylococcus epidermidis
SFSIFFLSSFTMTFINIIQF

SEQ ID NO: 1753268 - protein, 30 aa, Staphylococcus epidermidis
SFSIYFYVHQIWLFIVLYAIFQGLFAPAMP

SEQ ID NO: 1753269 - protein, 17 aa, Staphylococcus epidermidis
SFSLAILIFLTSIIFFI

SEQ ID NO: 1753270 - protein, 23 aa, Staphylococcus epidermidis
SFSLAILIFLTSIIFFINNLTIV

SEQ ID NO: 1753271 - protein, 18 aa, Staphylococcus epidermidis
SFSWAIFLLIIQASTIIT

SEQ ID NO: 1753272 - protein, 22 aa, Staphylococcus epidermidis
SFTFFKGIGIIFLLFGILLMNY

SEQ ID NO: 1753273 - protein, 18 aa, Staphylococcus epidermidis
SFTLAWLSLLIAVILLYI

SEQ ID NO: 1753274 - protein, 34 aa, Staphylococcus epidermidis
SFVIPYVIPFIISLINWRGLWIIIGVLSLTTLLM

SEQ ID NO: 1753275 - protein, 39 aa, Staphylococcus epidermidis
SGAPNKRLLGSYASSYIDMIDRIPPVAPKANSITTEDTS

SEQ ID NO: 1753276 - protein, 23 aa, Staphylococcus epidermidis
SGKTYLKHFLWFNGLTGVFAFIL

SEQ ID NO: 1753277 - protein, 21 aa, Staphylococcus epidermidis
SGLFLFIGALILNVTLSMNLK

SEQ ID NO: 1753278 - protein, 18 aa, Staphylococcus epidermidis
SGLFNDDGNISLPATGKI

SEQ ID NO: 1753279 - protein, 29 aa, Staphylococcus epidermidis
SGLFSKRFWPSLKFLLPIIIGMGLAIAIL

SEQ ID NO: 1753280 - protein, 18 aa, Staphylococcus epidermidis
SGLIGSVTNHDIVITLKN

SEQ ID NO: 1753281 - protein, 22 aa, Staphylococcus epidermidis
SGLMLEFISLLGIGLVALEVAL

SEQ ID NO: 1753282 - protein, 24 aa, Staphylococcus epidermidis
SGTGWLMHLLPPVVVGPVIMVIGL

SEQ ID NO: 1753283 - protein, 24 aa, Staphylococcus epidermidis
SHHHDFLHYKLGIANIEKSFKLDY

SEQ ID NO: 1753284 - protein, 26 aa, Staphylococcus epidermidis
SHMSPILLAWIVAAVLRIALGSATVA

SEQ ID NO: 1753285 - protein, 31 aa, Staphylococcus epidermidis
SHRRKYVRKKLWLSIALIGSLQYGGLITSIV

SEQ ID NO: 1753286 - protein, 20 aa, Staphylococcus epidermidis
SIARIFLNNPPILILDEATS

SEQ ID NO: 1753287 - protein, 25 aa, Staphylococcus epidermidis
SIASWRMIFIFLTIITLIVILGILL

SEQ ID NO: 1753288 - protein, 20 aa, Staphylococcus epidermidis
SICIGLIVFIPYILEIFKGG

SEQ ID NO: 1753289 - protein, 21 aa, Staphylococcus epidermidis
SIFIIMMLILNQILAGTVILL

SEQ ID NO: 1753290 - protein, 32 aa, Staphylococcus epidermidis
SIFVAMFCVFLGTYFLFISLSVVILDCLKKIP

SEQ ID NO: 1753291 - protein, 22 aa, Staphylococcus epidermidis
SIIILMLSTFTLFISSSTYANE

SEQ ID NO: 1753292 - protein, 33 aa, Staphylococcus epidermidis
SIILGLLVLMSIVLTYMVWNFTPDLNNVASSEN

SEQ ID NO: 1753293 - protein, 18 aa, Staphylococcus epidermidis
SIILMILTLFEQAVPMSN

SEQ ID NO: 1753294 - protein, 31 aa, Staphylococcus epidermidis
SIILVLLVLMSIVLTYMVWNFSPDLSNIDNT

SEQ ID NO: 1753295 - protein, 20 aa, Staphylococcus epidermidis
SIIMIIASILIIMKHRHLFN

SEQ ID NO: 1753296 - protein, 26 aa, Staphylococcus epidermidis
SIINVFFLYFWIFKVTKTQTKKSAKR

SEQ ID NO: 1753297 - protein, 36 aa, Staphylococcus epidermidis
SIKNAAIAIFGFIKPYIINIWNAIKNSTIAIWNAIK

SEQ ID NO: 1753298 - protein, 21 aa, Staphylococcus epidermidis
SIKVYYIIFLVFHIILATVGG

SEQ ID NO: 1753299 - protein, 37 aa, Staphylococcus epidermidis
SILGSFIALLKLSKIRPLQWIAGIYIEFLRGTPMLVQ

SEQ ID NO: 1753300 - protein, 19 aa, Staphylococcus epidermidis
SILIILIMIAISLGIAKLL

SEQ ID NO: 1753301 - protein, 17 aa, Staphylococcus epidermidis
SILMSIALYFIMVKVMP

SEQ ID NO: 1753302 - protein, 20 aa, Staphylococcus epidermidis
SILSFLYYLVIIAIFISVTS

SEQ ID NO: 1753303 - protein, 20 aa, Staphylococcus epidermidis
SILSFLYYLVILAIFISVTS

SEQ ID NO: 1753304 - protein, 26 aa, Staphylococcus epidermidis
SILYSLLVIHYLGIFYFVYSVNPMNS

SEQ ID NO: 1753305 - protein, 26 aa, Staphylococcus epidermidis
SISKMIWIFIFCFIGNILGGFILFFL

SEQ ID NO: 1753306 - protein, 27 aa, Staphylococcus epidermidis
SISSLPWLFMFFLILSAGAISDKILNS

SEQ ID NO: 1753307 - protein, 36 aa, Staphylococcus epidermidis
SISTYIYVIVTLLIVYIIPKFFKAIPAPLIAIIVLT

SEQ ID NO: 1753308 - protein, 38 aa, Staphylococcus epidermidis
SISTYIYVIVTLLIVYIIPRFFKAIPAPLIAIIVLTAL

SEQ ID NO: 1753309 - protein, 20 aa, Staphylococcus epidermidis
SIVFGLLGYTLFVGAAGMGN

SEQ ID NO: 1753310 - protein, 17 aa, Staphylococcus epidermidis
SIVIFIPGSLWIYYIRF

SEQ ID NO: 1753311 - protein, 25 aa, Staphylococcus epidermidis
SIVSFIFLGLLLIPGSPATLPGPSY

SEQ ID NO: 1753312 - protein, 42 aa, Staphylococcus epidermidis
SIYDWITNWFGWLFLIIVFVLDVFLIFLAFSRYGRFKLGSDE

SEQ ID NO: 1753313 - protein, 20 aa, Staphylococcus epidermidis
SIYDYLLNLIAMFSIFMCLM

SEQ ID NO: 1753314 - protein, 21 aa, Staphylococcus epidermidis
SIYIFIKITLIIYLFSLNLSV

SEQ ID NO: 1753315 - protein, 22 aa, Staphylococcus epidermidis
SKAALVIFMWLPKAYAVLNTEL

SEQ ID NO: 1753316 - protein, 26 aa, Staphylococcus epidermidis
SKAEKLIDSLKFINKAQFTHANDEIM

SEQ ID NO: 1753317 - protein, 22 aa, Staphylococcus epidermidis
SKAFAILYLWLVKLGEAKAQSI

SEQ ID NO: 1753318 - protein, 33 aa, Staphylococcus epidermidis
SKDVLLNVLSWQLIIFCLVMIVLVRPISVLFST

SEQ ID NO: 1753319 - protein, 28 aa, Staphylococcus epidermidis
SKDVLTTTVTGLPSGLSFDQTTNTIIGT

SEQ ID NO: 1753320 - protein, 18 aa, Staphylococcus epidermidis
SKFDARLREKDVANHIVQ

SEQ ID NO: 1753321 - protein, 28 aa, Staphylococcus epidermidis
SKFISAIVVLLLLIGLAFGIYSFVDSSK

SEQ ID NO: 1753322 - protein, 27 aa, Staphylococcus epidermidis
SKIMMPLLFIFLLIIVAKSLTLDGALE

SEQ ID NO: 1753323 - protein, 19 aa, Staphylococcus epidermidis
SKKIWSGSFFGFVKSILSF

SEQ ID NO: 1753324 - protein, 17 aa, Staphylococcus epidermidis
SKKYIFQNIFLYTFFIY

SEQ ID NO: 1753325 - protein, 24 aa, Staphylococcus epidermidis
SKLIPVFYIRRWFDTKTTIASAFL

SEQ ID NO: 1753326 - protein, 31 aa, Staphylococcus epidermidis
SKLYYIFIAIIIIAIILVVMIFYNTRKSPSK

SEQ ID NO: 1753327 - protein, 46 aa, Staphylococcus epidermidis
SKNGVLTFRSSDYLKDLPLSGELKAIVYYNQYVQSNFSKSVPFSSD

SEQ ID NO: 1753328 - protein, 19 aa, Staphylococcus epidermidis
SKNTNMLNKTGKDYDLQEQ

SEQ ID NO: 1753329 - protein, 19 aa, Staphylococcus epidermidis
SKSLKYLLGDSPKSYKEVE

SEQ ID NO: 1753330 - protein, 24 aa, Staphylococcus epidermidis
SKSPILIILLIIISTILLLVCTGF

SEQ ID NO: 1753331 - protein, 19 aa, Staphylococcus epidermidis
SKYKVIIGDLDIPVRSGFS

SEQ ID NO: 1753332 - protein, 20 aa, Staphylococcus epidermidis
SLAILIFLTSIIFFINNLTI

SEQ ID NO: 1753333 - protein, 26 aa, Staphylococcus epidermidis
SLALLGLMIPIFGIGRVPAIIALVVY

SEQ ID NO: 1753334 - protein, 28 aa, Staphylococcus epidermidis
SLALLIFTIIYFLIVLYLCLNPNKMIDR

SEQ ID NO: 1753335 - protein, 23 aa, Staphylococcus epidermidis
SLAVIPVIICLIIFRGNAEKIEQ

SEQ ID NO: 1753336 - protein, 17 aa, Staphylococcus epidermidis
SLDKFKSHYDIFKDFNL

SEQ ID NO: 1753337 - protein, 24 aa, Staphylococcus epidermidis
SLDPEIFYPLIKKLKENNDYVVVN

SEQ ID NO: 1753338 - protein, 19 aa, Staphylococcus epidermidis
SLEILKNNLKYKTPSQPII

SEQ ID NO: 1753339 - protein, 51 aa, Staphylococcus epidermidis
SLEQQKTRVKIYKSGKSWVKASINEIELLKTMGLPFLSKNEIQENVTEKTK

SEQ ID NO: 1753340 - protein, 51 aa, Staphylococcus epidermidis
SLEQQKTRVKLYKSGKSWVKASINEIELLKTMGLPFLSKNEIQENVTEKTK

SEQ ID NO: 1753341 - protein, 25 aa, Staphylococcus epidermidis
SLFAFFLLTVFTITLKTYFSYYVDF

SEQ ID NO: 1753342 - protein, 19 aa, Staphylococcus epidermidis
SLFLCISILFMLFNRNIAI

SEQ ID NO: 1753343 - protein, 19 aa, Staphylococcus epidermidis
SLFLLMTFAIIVSTTFTLL

SEQ ID NO: 1753344 - protein, 20 aa, Staphylococcus epidermidis
SLGLGLYLVQLILKQHNSEL

SEQ ID NO: 1753345 - protein, 20 aa, Staphylococcus epidermidis
SLGLLQYILNPITISLLLLI

SEQ ID NO: 1753346 - protein, 28 aa, Staphylococcus epidermidis
SLGNKFAIFLMVVLVVLGGVYSSAKLKL

SEQ ID NO: 1753347 - protein, 28 aa, Staphylococcus epidermidis
SLGTAAFWTILAILFIGGPYIPNVINGM

SEQ ID NO: 1753348 - protein, 18 aa, Staphylococcus epidermidis
SLHYLIILIILNGLQILL

SEQ ID NO: 1753349 - protein, 28 aa, Staphylococcus epidermidis
SLIAIGFLCIFIFSFIGLTIAAIAFQNI

SEQ ID NO: 1753350 - protein, 28 aa, Staphylococcus epidermidis
SLIIILIIVLAIVGLITFVHTKYGNQAE

SEQ ID NO: 1753351 - protein, 24 aa, Staphylococcus epidermidis
SLIILFILFILKDMEKIWYWLISI

SEQ ID NO: 1753352 - protein, 21 aa, Staphylococcus epidermidis
SLILIGAIPAALLAIIFDLIL

SEQ ID NO: 1753353 - protein, 20 aa, Staphylococcus epidermidis
SLILLLVVVFILLALLIMSF

SEQ ID NO: 1753354 - protein, 20 aa, Staphylococcus epidermidis
SLINPMWFGILFAVIGALLI

SEQ ID NO: 1753355 - protein, 22 aa, Staphylococcus epidermidis
SLIVIILLIFYIYLFSIIAREN

SEQ ID NO: 1753356 - protein, 30 aa, Staphylococcus epidermidis
SLKISFSIILITGLIIWSFIYTGFSIGDLM

SEQ ID NO: 1753357 - protein, 30 aa, Staphylococcus epidermidis
SLKTSFSIILIIALIIWSFIYTGFSIGDLM

SEQ ID NO: 1753358 - protein, 24 aa, Staphylococcus epidermidis
SLKVRFIYTMQLIVAFIAILIPVI

SEQ ID NO: 1753359 - protein, 32 aa, Staphylococcus epidermidis
SLLGQHALVLGLIVLLFIPLTVVLNAQEGVIT

SEQ ID NO: 1753360 - protein, 17 aa, Staphylococcus epidermidis
SLLIFIVYCHYLQRNKQ

SEQ ID NO: 1753361 - protein, 18 aa, Staphylococcus epidermidis
SLLIFIVYCHYLQRNKQN

SEQ ID NO: 1753362 - protein, 19 aa, Staphylococcus epidermidis
SLLIFIVYCHYLQRNKQNY

SEQ ID NO: 1753363 - protein, 28 aa, Staphylococcus epidermidis
SLLILNLISIVILLFLALLSPIYELVEI

SEQ ID NO: 1753364 - protein, 28 aa, Staphylococcus epidermidis
SLLLPLLLIYLILAILFIFIGYQLIAGA

SEQ ID NO: 1753365 - protein, 24 aa, Staphylococcus epidermidis
SLLMLWIGFLIYQFGFHDGRLSWI

SEQ ID NO: 1753366 - protein, 24 aa, Staphylococcus epidermidis
SLLSWVVTLFFIALSFYLVIDASK

SEQ ID NO: 1753367 - protein, 21 aa, Staphylococcus epidermidis
SLMIIFGLKLPLLIAFAVIFA

SEQ ID NO: 1753368 - protein, 30 aa, Staphylococcus epidermidis
SLNKVLFIILLLLIFIINISNFKKLTLLLI

SEQ ID NO: 1753369 - protein, 26 aa, Staphylococcus epidermidis
SLNTIPIFIILLYATFRGILSAVETP

SEQ ID NO: 1753370 - protein, 28 aa, Staphylococcus epidermidis
SLPSFFIGLILLYIFSLKLNILPTSDEG

SEQ ID NO: 1753371 - protein, 28 aa, Staphylococcus epidermidis
SLSKLAINVILASLFIVSLPGIFQQAFD

SEQ ID NO: 1753372 - protein, 25 aa, Staphylococcus epidermidis
SLVFIALVGFLLYLIHTPMYYMVAI

SEQ ID NO: 1753373 - protein, 38 aa, Staphylococcus epidermidis
SLVFKILVIILIVFILLAIVFGIYIFSKVNSLSNAIHN

SEQ ID NO: 1753374 - protein, 22 aa, Staphylococcus epidermidis
SLVNFIIFGFYYFIYSGPGIRG

SEQ ID NO: 1753375 - protein, 29 aa, Staphylococcus epidermidis
SLVSPLVNLLLIFGLLIIAGYGAYRIQND

SEQ ID NO: 1753376 - protein, 19 aa, Staphylococcus epidermidis
SLYLWHFPVISFIHSYFID

SEQ ID NO: 1753377 - protein, 24 aa, Staphylococcus epidermidis
SLYQRWIIIILLICNILGTIYGYD

SEQ ID NO: 1753378 - protein, 24 aa, Staphylococcus epidermidis
SMFTTMFLIIFIYTILVLIYGRFT

SEQ ID NO: 1753379 - protein, 18 aa, Staphylococcus epidermidis
SMILGIVALIILIGSGMI

SEQ ID NO: 1753380 - protein, 18 aa, Staphylococcus epidermidis
SMITSVLLFFAFRTSNNF

SEQ ID NO: 1753381 - protein, 22 aa, Staphylococcus epidermidis
SMLQEFKVTVWYTAPTALRMLM

SEQ ID NO: 1753382 - protein, 19 aa, Staphylococcus epidermidis
SMMFIGMIVLLCVGLILLS

SEQ ID NO: 1753383 - protein, 19 aa, Staphylococcus epidermidis
SMMIPVAIIIAMCFVHLPT

SEQ ID NO: 1753384 - protein, 17 aa, Staphylococcus epidermidis
SMMLIPGSLVFLFGRML

SEQ ID NO: 1753385 - protein, 32 aa, Staphylococcus epidermidis
SMNLKMILLIIIAWLLVFILMKSGLTQVNKLR

SEQ ID NO: 1753386 - protein, 28 aa, Staphylococcus epidermidis
SMPEYWIAILLIYYLGVQWHLVPFVGSD

SEQ ID NO: 1753387 - protein, 28 aa, Staphylococcus epidermidis
SMPEYWLAILFIYYLGVRWQLLPFVGSD

SEQ ID NO: 1753388 - protein, 20 aa, Staphylococcus epidermidis
SMSRLYYKIINAFVEDVQFE

SEQ ID NO: 1753389 - protein, 28 aa, Staphylococcus epidermidis
SNARDVLKSLANQLIRTFEHTPDVTDEE

SEQ ID NO: 1753390 - protein, 23 aa, Staphylococcus epidermidis
SNEKLYVYNWGEYIDPSLIKKFE

SEQ ID NO: 1753391 - protein, 26 aa, Staphylococcus epidermidis
SNEKLYVYNWGEYIDPSLIKKFKKET

SEQ ID NO: 1753392 - protein, 22 aa, Staphylococcus epidermidis
SNFFKKQYWLFGVKKKNRHDIN

SEQ ID NO: 1753393 - protein, 29 aa, Staphylococcus epidermidis
SNHKGHEYMYYWFGLPSDQTPTGPVTFTI

SEQ ID NO: 1753394 - protein, 17 aa, Staphylococcus epidermidis
SNKLNYYIIITLLIFIV

SEQ ID NO: 1753395 - protein, 30 aa, Staphylococcus epidermidis
SNKYTIIILFIFLIVVIIRYLVYKFKPLKV

SEQ ID NO: 1753396 - protein, 36 aa, Staphylococcus epidermidis
SNKYTIIILFIFLVVLIIRYLIYKFKPLKVVATDEE

SEQ ID NO: 1753397 - protein, 30 aa, Staphylococcus epidermidis
SNKYTIIILFVFLIVVIIRYLVYKFRPLKV

SEQ ID NO: 1753398 - protein, 25 aa, Staphylococcus epidermidis
SNNIKLAEPILVIGNPLGTDFKGSV

SEQ ID NO: 1753399 - protein, 26 aa, Staphylococcus epidermidis
SNNKMILFIFRCFVVLLVFVGAVAKT

SEQ ID NO: 1753400 - protein, 18 aa, Staphylococcus epidermidis
SNQLIFIILFCIAYSIFS

SEQ ID NO: 1753401 - protein, 24 aa, Staphylococcus epidermidis
SPFQIIRYFLLPEALGSLILAITT

SEQ ID NO: 1753402 - protein, 20 aa, Staphylococcus epidermidis
SPFVIMTWITLLIPNQLKTL

SEQ ID NO: 1753403 - protein, 44 aa, Staphylococcus epidermidis
SPISIPSILVNPWVQLILSTPVQFIIGWQFYVGAYKNLRNGSAN

SEQ ID NO: 1753404 - protein, 34 aa, Staphylococcus epidermidis
SPITFWYGKYIILIPSSYFKSVIDKRLKYIILHE

SEQ ID NO: 1753405 - protein, 17 aa, Staphylococcus epidermidis
SPLIYFLTTLTCGGYAY

SEQ ID NO: 1753406 - protein, 22 aa, Staphylococcus epidermidis
SPLKLMFRRLLFLLIVGIITSM

SEQ ID NO: 1753407 - protein, 20 aa, Staphylococcus epidermidis
SPLMLLKLAIVWTLVQFFEG

SEQ ID NO: 1753408 - protein, 25 aa, Staphylococcus epidermidis
SPSVIVGPNFYMGIGTPGGNKIPTI

SEQ ID NO: 1753409 - protein, 43 aa, Staphylococcus epidermidis
SQAFVEKFAKYYTPIIMIIAALVAVVPPLFFGASWETWVYQGL

SEQ ID NO: 1753410 - protein, 32 aa, Staphylococcus epidermidis
SQALLILDALVVLSFLLVLPVTNVLYTIVMLF

SEQ ID NO: 1753411 - protein, 40 aa, Staphylococcus epidermidis
SQSTKELLYVALRISLIKVLKPYYPFPIIVDDAFVHFDKH

SEQ ID NO: 1753412 - protein, 27 aa, Staphylococcus epidermidis
SQTISLWKYVFLSIVLIIGIYVIYLIT

SEQ ID NO: 1753413 - protein, 31 aa, Staphylococcus epidermidis
SQVGSYFLFIIIVVFLLYANFLFLKRRGREL

SEQ ID NO: 1753414 - protein, 23 aa, Staphylococcus epidermidis
SQVPWLVIILVSVVAMIVISQTA

SEQ ID NO: 1753415 - protein, 17 aa, Staphylococcus epidermidis
SRFKIIYIAVVGVLLFA

SEQ ID NO: 1753416 - protein, 20 aa, Staphylococcus epidermidis
SRFLQAVVSGFFRVVGAVGN

SEQ ID NO: 1753417 - protein, 20 aa, Staphylococcus epidermidis
SRIDLYFKYNLKKYTSMKIT

SEQ ID NO: 1753418 - protein, 24 aa, Staphylococcus epidermidis
SRIDNLLHELQTTLINRVNATHEI

SEQ ID NO: 1753419 - protein, 23 aa, Staphylococcus epidermidis
SRIVSYLFYVLYTCQFVRLHRRV

SEQ ID NO: 1753420 - protein, 31 aa, Staphylococcus epidermidis
SRLYYIILTIVIIAICVVVVILFNTLKTNRS

SEQ ID NO: 1753421 - protein, 26 aa, Staphylococcus epidermidis
SRRRDFWWPFLINTILSGIIGVIIFS

SEQ ID NO: 1753422 - protein, 22 aa, Staphylococcus epidermidis
SRWIMSIVYIGLGLFIIIENGT

SEQ ID NO: 1753423 - protein, 21 aa, Staphylococcus epidermidis
SSFTMTFINIIQFTVALFIDS

SEQ ID NO: 1753424 - protein, 23 aa, Staphylococcus epidermidis
SSFTMTFINIIQFTVALFIDSRY

SEQ ID NO: 1753425 - protein, 34 aa, Staphylococcus epidermidis
SSGYLKYILLIIIAWLFIFILMKAGLTQVNQLRE

SEQ ID NO: 1753426 - protein, 21 aa, Staphylococcus epidermidis
SSIMIGIFYRKFDARYPKLGE

SEQ ID NO: 1753427 - protein, 20 aa, Staphylococcus epidermidis
SSISFIFFVGVIIGISYLSI

SEQ ID NO: 1753428 - protein, 29 aa, Staphylococcus epidermidis
SSITIMFIMLFLVGWFQGMGWPPSGRVLV

SEQ ID NO: 1753429 - protein, 17 aa, Staphylococcus epidermidis
SSLAILSVVLIVIVLIF

SEQ ID NO: 1753430 - protein, 32 aa, Staphylococcus epidermidis
SSLLPTLVAVFLFAALFLPLLMEYGLLELLGP

SEQ ID NO: 1753431 - protein, 23 aa, Staphylococcus epidermidis
SSLSYIVIMLGIVLTAFGSVFGS

SEQ ID NO: 1753432 - protein, 23 aa, Staphylococcus epidermidis
SSMKYSVNWYYENLNKHLRQDEV

SEQ ID NO: 1753433 - protein, 23 aa, Staphylococcus epidermidis
SSNFFKKQYWLFGVKKKDRHDMN

SEQ ID NO: 1753434 - protein, 25 aa, Staphylococcus epidermidis
SSQMSRRSFLKMLGIGGAGVMIGAS

SEQ ID NO: 1753435 - protein, 17 aa, Staphylococcus epidermidis
SSSLFKAMTKMLAFARN

SEQ ID NO: 1753436 - protein, 20 aa, Staphylococcus epidermidis
SSWKWTLLAVVYPIVTAYIL

SEQ ID NO: 1753437 - protein, 21 aa, Staphylococcus epidermidis
STFFLVTFCLPINLPVAPDQA

SEQ ID NO: 1753438 - protein, 17 aa, Staphylococcus epidermidis
STFITIGYERFMWKWKL

SEQ ID NO: 1753439 - protein, 24 aa, Staphylococcus epidermidis
STLADIFMVIFSILVFSKILKLRD

SEQ ID NO: 1753440 - protein, 20 aa, Staphylococcus epidermidis
STLISLIPRFYDVTAGEINI

SEQ ID NO: 1753441 - protein, 23 aa, Staphylococcus epidermidis
STLTLLINVFTKPASRIVSYLFY

SEQ ID NO: 1753442 - protein, 18 aa, Staphylococcus epidermidis
STMFFFTGLIIGIIPYLL

SEQ ID NO: 1753443 - protein, 48 aa, Staphylococcus epidermidis
STNRVRPEVKVLNSLSGFTMVNGGQVGLLNSVLERTGVFDTGEAKNYQ

SEQ ID NO: 1753444 - protein, 23 aa, Staphylococcus epidermidis
STNSIVGTPTQIGTNTITIESTD

SEQ ID NO: 1753445 - protein, 24 aa, Staphylococcus epidermidis
STPHLLISLILQISLITFIGVALS

SEQ ID NO: 1753446 - protein, 24 aa, Staphylococcus epidermidis
STRTQTFRVLLISALLALGNSLFI

SEQ ID NO: 1753447 - protein, 23 aa, Staphylococcus epidermidis
STTGQDAAQFNGPQGTSVAQPGN

SEQ ID NO: 1753448 - protein, 22 aa, Staphylococcus epidermidis
STVTIIFGITTYFTEKKKYKED

SEQ ID NO: 1753449 - protein, 18 aa, Staphylococcus epidermidis
STWNGLAWIVGAALYLVC

SEQ ID NO: 1753450 - protein, 33 aa, Staphylococcus epidermidis
SVADITWIIRIISMVVIFIPVLATWRGIFQGYK

SEQ ID NO: 1753451 - protein, 17 aa, Staphylococcus epidermidis
SVAYIYSLYAFYMNNFS

SEQ ID NO: 1753452 - protein, 27 aa, Staphylococcus epidermidis
SVCAHKRWLFISSTLIKQTVRSSLIKG

SEQ ID NO: 1753453 - protein, 19 aa, Staphylococcus epidermidis
SVESLKWSYEKYGDLAVAY

SEQ ID NO: 1753454 - protein, 18 aa, Staphylococcus epidermidis
SVESLKWSYETYGDLAVA

SEQ ID NO: 1753455 - protein, 30 aa, Staphylococcus epidermidis
SVFKTIYFIVIFIVILVLLLSYIIGTVMYL

SEQ ID NO: 1753456 - protein, 25 aa, Staphylococcus epidermidis
SVGVISFIVWMLIQNDVDFALERLV

SEQ ID NO: 1753457 - protein, 23 aa, Staphylococcus epidermidis
SVILLIGIYFMPESPRWLLENRS

SEQ ID NO: 1753458 - protein, 30 aa, Staphylococcus epidermidis
SVIYSPFRLILLMVIAIIGMAGWLFYAHQL

SEQ ID NO: 1753459 - protein, 25 aa, Staphylococcus epidermidis
SVKMYYLSSLLFGLALLGVVIHNLV

SEQ ID NO: 1753460 - protein, 29 aa, Staphylococcus epidermidis
SVLALLHDVFIIIAIFSLFRIEVDLTFIA

SEQ ID NO: 1753461 - protein, 24 aa, Staphylococcus epidermidis
SVLFFVDLIIILIFNKVKPSSEFD

SEQ ID NO: 1753462 - protein, 28 aa, Staphylococcus epidermidis
SVLFVKLIFMIDYVLFHLIQHSYFKYQD

SEQ ID NO: 1753463 - protein, 20 aa, Staphylococcus epidermidis
SVLKLYPVYMIKNPIMFVVE

SEQ ID NO: 1753464 - protein, 32 aa, Staphylococcus epidermidis
SVLLTTIILVIAYKLMWFNGHMTFTLTITTMI

SEQ ID NO: 1753465 - protein, 31 aa, Staphylococcus epidermidis
SVNWMYIALMIMILLGLLIKRKSLLRRKSIS

SEQ ID NO: 1753466 - protein, 21 aa, Staphylococcus epidermidis
SVPIRILIFYVGALAVIMSII

SEQ ID NO: 1753467 - protein, 19 aa, Staphylococcus epidermidis
SVPTVMIGLFLGAIYMILA

SEQ ID NO: 1753468 - protein, 19 aa, Staphylococcus epidermidis
SVQPNVIKKPTAINSLTQE

SEQ ID NO: 1753469 - protein, 27 aa, Staphylococcus epidermidis
SVSDGITKFIYRKISTAQSPIVENNQQ

SEQ ID NO: 1753470 - protein, 21 aa, Staphylococcus epidermidis
SVSLITFIQYYFTQETENSIK

SEQ ID NO: 1753471 - protein, 24 aa, Staphylococcus epidermidis
SVTNHDIVITLKNSQTLSSLGYSN

SEQ ID NO: 1753472 - protein, 27 aa, Staphylococcus epidermidis
SVVFAIIYNLWWFFYNIVQVAGIHLEQ

SEQ ID NO: 1753473 - protein, 29 aa, Staphylococcus epidermidis
SVVIAISLLIIILIAVFKPFSDESKYIVN

SEQ ID NO: 1753474 - protein, 28 aa, Staphylococcus epidermidis
SVVLILIFLFLVFHLIRLASKINSQYNK

SEQ ID NO: 1753475 - protein, 25 aa, Staphylococcus epidermidis
SVVSIPLSILIALVALKLSNVSLNI

SEQ ID NO: 1753476 - protein, 26 aa, Staphylococcus epidermidis
SVVVIFLIVGLIGASLSFIKLLKIDP

SEQ ID NO: 1753477 - protein, 25 aa, Staphylococcus epidermidis
SWGPVLWVMLPELFPMRARGAATGI

SEQ ID NO: 1753478 - protein, 19 aa, Staphylococcus epidermidis
SWIGFYPSIETITAQIILI

SEQ ID NO: 1753479 - protein, 17 aa, Staphylococcus epidermidis
SWNALKEKIAEARTIIN

SEQ ID NO: 1753480 - protein, 20 aa, Staphylococcus epidermidis
SWSITLYTLLLTGTIIIFGR

SEQ ID NO: 1753481 - protein, 26 aa, Staphylococcus epidermidis
SWTLILYALLLLFFPIYHLLNKDTPL

SEQ ID NO: 1753482 - protein, 17 aa, Staphylococcus epidermidis
SYAALITMYVIHLIILS

SEQ ID NO: 1753483 - protein, 17 aa, Staphylococcus epidermidis
SYDSGAPNKRLLGSYAS

SEQ ID NO: 1753484 - protein, 17 aa, Staphylococcus epidermidis
SYFIFVKPMKRLQQTTN

SEQ ID NO: 1753485 - protein, 29 aa, Staphylococcus epidermidis
SYFNGAPWLFFFPGLLLGGYALLFQIINK

SEQ ID NO: 1753486 - protein, 26 aa, Staphylococcus epidermidis
SYHIFRIFFILFVIAPLIGYFINIRL

SEQ ID NO: 1753487 - protein, 26 aa, Staphylococcus epidermidis
SYHIFRIFFILFVIAPLIGYFLKYRA

SEQ ID NO: 1753488 - protein, 35 aa, Staphylococcus epidermidis
SYIVLTIFCLIIGLLLFFHKPIISHFIAPHKMEQT

SEQ ID NO: 1753489 - protein, 24 aa, Staphylococcus epidermidis
SYLSGSLPMFLIYLKNANTITYTI

SEQ ID NO: 1753490 - protein, 26 aa, Staphylococcus epidermidis
SYLSGSLPMFLIYLKNANTITYTISM

SEQ ID NO: 1753491 - protein, 34 aa, Staphylococcus epidermidis
SYTIIPTSNLAIKHPLFEYARSFDFIIITEVGLI

SEQ ID NO: 1753492 - protein, 30 aa, Staphylococcus epidermidis
SYVRKRKYNTFKWLGIAMSIIGVLLIACLA

SEQ ID NO: 1753493 - protein, 24 aa, Staphylococcus epidermidis
SYVTMILFYKYLSNSILYSLLVIH

SEQ ID NO: 1753494 - protein, 24 aa, Staphylococcus epidermidis
SYYEAVVLGFYFIYRLIAVHPKDI

SEQ ID NO: 1753495 - protein, 34 aa, Staphylococcus epidermidis
SYYEMNFWAFMSEKWWVIIIIVIIICGTIGQIFS

SEQ ID NO: 1753496 - protein, 18 aa, Staphylococcus epidermidis
SYYFLFCIVIIIALVVSF

SEQ ID NO: 1753497 - protein, 21 aa, Staphylococcus epidermidis
TAAKLNVQPTDNSFQDFVIDY

SEQ ID NO: 1753498 - protein, 20 aa, Staphylococcus epidermidis
TAATSEIYIVKAPQPEQVAT

SEQ ID NO: 1753499 - protein, 21 aa, Staphylococcus epidermidis
TAFSLLIKFLLPNVLNNGKLY

SEQ ID NO: 1753500 - protein, 19 aa, Staphylococcus epidermidis
TAFVMMVLLMSGILTKHYT

SEQ ID NO: 1753501 - protein, 25 aa, Staphylococcus epidermidis
TAIFNYWWMFAISFIFFIIAELLTI

SEQ ID NO: 1753502 - protein, 30 aa, Staphylococcus epidermidis
TAIIMVITAPFIPLFYVIFGLKTRDESKDQ

SEQ ID NO: 1753503 - protein, 20 aa, Staphylococcus epidermidis
TALFSGNEIQFKWGKEYPSN

SEQ ID NO: 1753504 - protein, 31 aa, Staphylococcus epidermidis
TALIMMVTAPFIPMFYIIFGLKTRDESKDQM

SEQ ID NO: 1753505 - protein, 27 aa, Staphylococcus epidermidis
TALKNGVLGIVRALRKGVLSVFNALKK

SEQ ID NO: 1753506 - protein, 17 aa, Staphylococcus epidermidis
TALLLLIPIFISYKEGL

SEQ ID NO: 1753507 - protein, 19 aa, Staphylococcus epidermidis
TAMLPVILMLISTIVQLIT

SEQ ID NO: 1753508 - protein, 25 aa, Staphylococcus epidermidis
TARSQLTLNREPYINHINNESHLNN

SEQ ID NO: 1753509 - protein, 24 aa, Staphylococcus epidermidis
TASKINHQWSLNKVVPGITIEPNS

SEQ ID NO: 1753510 - protein, 22 aa, Staphylococcus epidermidis
TASNVRRFKGYKLYQTVSPDNM

SEQ ID NO: 1753511 - protein, 22 aa, Staphylococcus epidermidis
TATLFLCLSLLLILFNKRNALI

SEQ ID NO: 1753512 - protein, 25 aa, Staphylococcus epidermidis
TCLWFLFCVFIFQYIKLLFSKPKFK

SEQ ID NO: 1753513 - protein, 48 aa, Staphylococcus epidermidis
TDALKAPNYTETSGTPTLKLTNSSQTVIYKFKDVQGPQISVDSQTREV

SEQ ID NO: 1753514 - protein, 36 aa, Staphylococcus epidermidis
TDEAISAMRYIVGKWVPIMGSWRSAFKRAGDYAYAT

SEQ ID NO: 1753515 - protein, 37 aa, Staphylococcus epidermidis
TDENGKYQFDNLDSGNYIIHFEKPEGMTQTTANSGND

SEQ ID NO: 1753516 - protein, 27 aa, Staphylococcus epidermidis
TDNLPRFFVYLLLFMFSMIGIVIANNT

SEQ ID NO: 1753517 - protein, 26 aa, Staphylococcus epidermidis
TEFESSVFPFILRGVSIIGIDSVFTP

SEQ ID NO: 1753518 - protein, 36 aa, Staphylococcus epidermidis
TEFNNYFVSPIALSFDFSKKLLNRPLKADEFEFTLK

SEQ ID NO: 1753519 - protein, 29 aa, Staphylococcus epidermidis
TEFTNYYVNPIALSFDFSKELLGRPLKAD

SEQ ID NO: 1753520 - protein, 25 aa, Staphylococcus epidermidis
TEIIQMSCILLFTNNLHHAITLVSF

SEQ ID NO: 1753521 - protein, 27 aa, Staphylococcus epidermidis
TEKSKDLKLIKVLKDLNKAQLEDVTNK

SEQ ID NO: 1753522 - protein, 24 aa, Staphylococcus epidermidis
TELLPKMNYLWLATGVALLACIFA

SEQ ID NO: 1753523 - protein, 19 aa, Staphylococcus epidermidis
TELSQLTQSTLELNDKMKL

SEQ ID NO: 1753524 - protein, 49 aa, Staphylococcus epidermidis
TEPHNLLFLIVITVLVALAVYLFRFVWVYVLYPYFYLSVSPFQKMISKD

SEQ ID NO: 1753525 - protein, 33 aa, Staphylococcus epidermidis
TEPLEFSFLFVAPLLFFIHAVLDGLAFLTLYLL

SEQ ID NO: 1753526 - protein, 23 aa, Staphylococcus epidermidis
TEPLHVWLWAQLAVFLHVFVDIF

SEQ ID NO: 1753527 - protein, 26 aa, Staphylococcus epidermidis
TFETPEGYTPTLKHSGTNPALDSEGN

SEQ ID NO: 1753528 - protein, 17 aa, Staphylococcus epidermidis
TFFLLVQRQRSEAFYAA

SEQ ID NO: 1753529 - protein, 18 aa, Staphylococcus epidermidis
TFFLLVQRQRSEAFYAAE

SEQ ID NO: 1753530 - protein, 20 aa, Staphylococcus epidermidis
TFHSYHELEFLLVIREDEKD

SEQ ID NO: 1753531 - protein, 22 aa, Staphylococcus epidermidis
TFIFSLVWILFNFYTVYLLIKY

SEQ ID NO: 1753532 - protein, 21 aa, Staphylococcus epidermidis
TFIIPLIIIVLMTLQALLLKN

SEQ ID NO: 1753533 - protein, 32 aa, Staphylococcus epidermidis
TFKNKTWINIISWLLIIILSGLNVYLIIQTFQ

SEQ ID NO: 1753534 - protein, 31 aa, Staphylococcus epidermidis
TFKSDIPLSAKLIIFLVLAIGTIDGPDEIKK

SEQ ID NO: 1753535 - protein, 26 aa, Staphylococcus epidermidis
TFLERFSYFLIIPFLSIYLAQNYHFS

SEQ ID NO: 1753536 - protein, 19 aa, Staphylococcus epidermidis
TFLLWLAIGLVFGSAPPIQ

SEQ ID NO: 1753537 - protein, 19 aa, Staphylococcus epidermidis
TFLTMRTILTLKGYRYIAA

SEQ ID NO: 1753538 - protein, 25 aa, Staphylococcus epidermidis
TFLVHPLLILIFSALAFIVPGAKEA

SEQ ID NO: 1753539 - protein, 28 aa, Staphylococcus epidermidis
TFRLYRHFYYRLFAIITVILIIFTFIPF

SEQ ID NO: 1753540 - protein, 25 aa, Staphylococcus epidermidis
TFSTKLLLILIIAGLAVVALLFSAL

SEQ ID NO: 1753541 - protein, 18 aa, Staphylococcus epidermidis
TFTATYAGKTWTATLSEL

SEQ ID NO: 1753542 - protein, 26 aa, Staphylococcus epidermidis
TFTELMIIISIIYFKNLYIGRLDKPS

SEQ ID NO: 1753543 - protein, 25 aa, Staphylococcus epidermidis
TFTNYLRLIWFVASLGLLAGAMGST

SEQ ID NO: 1753544 - protein, 34 aa, Staphylococcus epidermidis
TFTNYVDQYQNITGSFDLIATPKRETAIKDNQNY

SEQ ID NO: 1753545 - protein, 18 aa, Staphylococcus epidermidis
TGDIFNMFVFFEVFLMSS

SEQ ID NO: 1753546 - protein, 19 aa, Staphylococcus epidermidis
TGFLAFIVIGPVALIIGTG

SEQ ID NO: 1753547 - protein, 33 aa, Staphylococcus epidermidis
TGHSAWRYFMLIFYLVPYVLFGGLMYVILKAYE

SEQ ID NO: 1753548 - protein, 24 aa, Staphylococcus epidermidis
TGIFFIMLFILIKLFMEVHNVFTP

SEQ ID NO: 1753549 - protein, 30 aa, Staphylococcus epidermidis
TGIGSMLLVFMLFALIMTIGSDFMSFLHVD

SEQ ID NO: 1753550 - protein, 17 aa, Staphylococcus epidermidis
TGIIGLFLSFMAGVLWL

SEQ ID NO: 1753551 - protein, 37 aa, Staphylococcus epidermidis
TGIINGADNLTIDSGFYKTPKYSVGDYVWEDTNKDGI

SEQ ID NO: 1753552 - protein, 22 aa, Staphylococcus epidermidis
TGIPNWVLVLILTVITITLVVR

SEQ ID NO: 1753553 - protein, 24 aa, Staphylococcus epidermidis
TGIPQWILVMLLTVITIFLVVKTI

SEQ ID NO: 1753554 - protein, 28 aa, Staphylococcus epidermidis
TGKIVLQPQFLLTNSKIIVFAKKGNSDA

SEQ ID NO: 1753555 - protein, 20 aa, Staphylococcus epidermidis
TGKLTYQRFLNGHPTFNKQN

SEQ ID NO: 1753556 - protein, 17 aa, Staphylococcus epidermidis
TGLLFICFQKSTQQFID

SEQ ID NO: 1753557 - protein, 33 aa, Staphylococcus epidermidis
TGLSVFLFGFIKRLLIPFGLHHIFHAPFWFEFG

SEQ ID NO: 1753558 - protein, 19 aa, Staphylococcus epidermidis
TGNNRVYRVSTYNLTNDEI

SEQ ID NO: 1753559 - protein, 20 aa, Staphylococcus epidermidis
TGNQILRMIELPLSLSVIIG

SEQ ID NO: 1753560 - protein, 24 aa, Staphylococcus epidermidis
TGSFMLFALLMFGFDFLSAAGNAK

SEQ ID NO: 1753561 - protein, 25 aa, Staphylococcus epidermidis
TGSFMLFTLLLFGFNFLSAAGNAKV

SEQ ID NO: 1753562 - protein, 20 aa, Staphylococcus epidermidis
TGVFSLWAWWKNNNFTHAAK

SEQ ID NO: 1753563 - protein, 24 aa, Staphylococcus epidermidis
TGVLLFVTSFLGITFLIAAGCIIY

SEQ ID NO: 1753564 - protein, 24 aa, Staphylococcus epidermidis
TGVLLNFVLVFTTLKIFGYSKDTI

SEQ ID NO: 1753565 - protein, 25 aa, Staphylococcus epidermidis
THAGWLHYLIGMIIAFLVSVVVTLV

SEQ ID NO: 1753566 - protein, 22 aa, Staphylococcus epidermidis
THEKIYVYNWGEYIDPSLIKKF

SEQ ID NO: 1753567 - protein, 33 aa, Staphylococcus epidermidis
THEKSRVLLIIFLILGLIFIGMGYYLAIKPNTA

SEQ ID NO: 1753568 - protein, 49 aa, Staphylococcus epidermidis
THFPNFGGGLIGFYLLKLFIPLISIVGVIIITILLVASSIILLMNLRHR

SEQ ID NO: 1753569 - protein, 43 aa, Staphylococcus epidermidis
THNGNKKTWIIISIVAVIIIALIALFLILKSQLSPEKQASQIA

SEQ ID NO: 1753570 - protein, 17 aa, Staphylococcus epidermidis
THVTFDIPLPLLEPMHM

SEQ ID NO: 1753571 - protein, 22 aa, Staphylococcus epidermidis
TICLFILNLIINPHIFTPSFFS

SEQ ID NO: 1753572 - protein, 20 aa, Staphylococcus epidermidis
TIEEVLGLSQAIYDTKNALN

SEQ ID NO: 1753573 - protein, 18 aa, Staphylococcus epidermidis
TIEKLKSIQLREDKILSS

SEQ ID NO: 1753574 - protein, 18 aa, Staphylococcus epidermidis
TIFFITLVIAILSGLLFL

SEQ ID NO: 1753575 - protein, 26 aa, Staphylococcus epidermidis
TIFVSFLVILFAKFDLFKSAIGICIG

SEQ ID NO: 1753576 - protein, 22 aa, Staphylococcus epidermidis
TIFYFEIGALVASLLWGYISDL

SEQ ID NO: 1753577 - protein, 24 aa, Staphylococcus epidermidis
TIGALIPLLFGQDSSILISKGMAA

SEQ ID NO: 1753578 - protein, 20 aa, Staphylococcus epidermidis
TIGALVPLLFGQDSSILISK

SEQ ID NO: 1753579 - protein, 19 aa, Staphylococcus epidermidis
TIGFGLMLYAFSSAGNLGF

SEQ ID NO: 1753580 - protein, 17 aa, Staphylococcus epidermidis
TIIDFYISIKSASKLRK

SEQ ID NO: 1753581 - protein, 50 aa, Staphylococcus epidermidis
TIIIALSIMFFLDVKLTIAAIFIFPFYILTVYFFFGRLRQLTRVRSQALA

SEQ ID NO: 1753582 - protein, 21 aa, Staphylococcus epidermidis
TIIIIIFVGPGLIFNIGKYIY

SEQ ID NO: 1753583 - protein, 18 aa, Staphylococcus epidermidis
TIIILFFLTNGISIDHTK

SEQ ID NO: 1753584 - protein, 17 aa, Staphylococcus epidermidis
TIISKLDPLPSISFSDT

SEQ ID NO: 1753585 - protein, 20 aa, Staphylococcus epidermidis
TIKSLPETGNVDKSVPLAGV

SEQ ID NO: 1753586 - protein, 20 aa, Staphylococcus epidermidis
TILMYVFWELTSISSFLLIS

SEQ ID NO: 1753587 - protein, 19 aa, Staphylococcus epidermidis
TIMNLFAGLILGLVLAIII

SEQ ID NO: 1753588 - protein, 20 aa, Staphylococcus epidermidis
TIQKSDFTAGRMTNKIKYDS

SEQ ID NO: 1753589 - protein, 18 aa, Staphylococcus epidermidis
TIQSPITFWYGKYIILIP

SEQ ID NO: 1753590 - protein, 19 aa, Staphylococcus epidermidis
TISIPLKIQKGKTAGYTVR

SEQ ID NO: 1753591 - protein, 24 aa, Staphylococcus epidermidis
TISLEAIIGAMTLTDELKANIVSL

SEQ ID NO: 1753592 - protein, 23 aa, Staphylococcus epidermidis
TISLESIIGAMTLTDELKVNIVS

SEQ ID NO: 1753593 - protein, 41 aa, Staphylococcus epidermidis
TITFIVFMILLITKFTQVWPILLFLPFVVSVFIRINTHYKN

SEQ ID NO: 1753594 - protein, 20 aa, Staphylococcus epidermidis
TITFLTLPPKDVFLASVLIG

SEQ ID NO: 1753595 - protein, 28 aa, Staphylococcus epidermidis
TIVFGFFALTFVTPLLRSFIPILGEFNS

SEQ ID NO: 1753596 - protein, 37 aa, Staphylococcus epidermidis
TIVTQSKNTNMLNKTGKDYDLQEQRGYTDSEQHNETQ

SEQ ID NO: 1753597 - protein, 17 aa, Staphylococcus epidermidis
TIWMGMIMLFCSHLLIG

SEQ ID NO: 1753598 - protein, 24 aa, Staphylococcus epidermidis
TIYILVAIMYWVVCFIISIIQGWY

SEQ ID NO: 1753599 - protein, 22 aa, Staphylococcus epidermidis
TIYLLIFIYYFFITSRKLSPLI

SEQ ID NO: 1753600 - protein, 33 aa, Staphylococcus epidermidis
TIYNLNFWVWIPLIIIILCLIFRISTVPSMLIS

SEQ ID NO: 1753601 - protein, 41 aa, Staphylococcus epidermidis
TKGHKLKKSAAKTTALVGGAFTFNMLNNHQAFAASETPITS

SEQ ID NO: 1753602 - protein, 41 aa, Staphylococcus epidermidis
TKGHKLKKSAAKTTALVGGAFTFNMLNNHQALAASETPITS

SEQ ID NO: 1753603 - protein, 26 aa, Staphylococcus epidermidis
TKGLGLAIRFMTGPVGIVITAIGLLV

SEQ ID NO: 1753604 - protein, 33 aa, Staphylococcus epidermidis
TKNKTIEAIHKIKPITIIKPQALNEITNQLDAQ

SEQ ID NO: 1753605 - protein, 33 aa, Staphylococcus epidermidis
TKPKTYKKPNNSEYSYLLNDLGYDATTVKENSD

SEQ ID NO: 1753606 - protein, 25 aa, Staphylococcus epidermidis
TKVLSILYMIPGLYAIPFYFRFLHV

SEQ ID NO: 1753607 - protein, 23 aa, Staphylococcus epidermidis
TLAKVILMIILIAGIIGLKLTTN

SEQ ID NO: 1753608 - protein, 18 aa, Staphylococcus epidermidis
TLASLYFPLIIKNIITEL

SEQ ID NO: 1753609 - protein, 28 aa, Staphylococcus epidermidis
TLEEKAEANRLLQNVLTSASDEIANVVH

SEQ ID NO: 1753610 - protein, 19 aa, Staphylococcus epidermidis
TLEMYRFEYPITFATSIFA

SEQ ID NO: 1753611 - protein, 20 aa, Staphylococcus epidermidis
TLEMYRFEYPITFVTSIFAS

SEQ ID NO: 1753612 - protein, 21 aa, Staphylococcus epidermidis
TLFGILYLLLLVTSAYVLIRM

SEQ ID NO: 1753613 - protein, 25 aa, Staphylococcus epidermidis
TLFGLLYLLLLVTSAYVLIRMFKNK

SEQ ID NO: 1753614 - protein, 25 aa, Staphylococcus epidermidis
TLGFTTLVMQDGFLGGLFGVENTGP

SEQ ID NO: 1753615 - protein, 32 aa, Staphylococcus epidermidis
TLGIYILLFLFYGLFLFLITLLVKSSSLVFSI

SEQ ID NO: 1753616 - protein, 19 aa, Staphylococcus epidermidis
TLHLIIFHIFSIAMSYNPL

SEQ ID NO: 1753617 - protein, 23 aa, Staphylococcus epidermidis
TLIFAIVLALFKGIGLPGGMALV

SEQ ID NO: 1753618 - protein, 17 aa, Staphylococcus epidermidis
TLIGFVFAPFAFLAGVP

SEQ ID NO: 1753619 - protein, 22 aa, Staphylococcus epidermidis
TLILALLPTILKLTSFYLNTAQ

SEQ ID NO: 1753620 - protein, 25 aa, Staphylococcus epidermidis
TLILGMFMFLLLLPLEKVFKLSSYY

SEQ ID NO: 1753621 - protein, 21 aa, Staphylococcus epidermidis
TLILILVIFLSVKMGHLQGFA

SEQ ID NO: 1753622 - protein, 29 aa, Staphylococcus epidermidis
TLINVLPIVIVPLVTERKRIKKHPDVQKV

SEQ ID NO: 1753623 - protein, 27 aa, Staphylococcus epidermidis
TLINVLPIVIVPLVVERKRIKEHPDVR

SEQ ID NO: 1753624 - protein, 26 aa, Staphylococcus epidermidis
TLINYFILYILLAISITLFVPVDLFN

SEQ ID NO: 1753625 - protein, 18 aa, Staphylococcus epidermidis
TLISFIIAIFTAIHLYFV

SEQ ID NO: 1753626 - protein, 23 aa, Staphylococcus epidermidis
TLIVFFGLGFFKFADAHVTLNPN

SEQ ID NO: 1753627 - protein, 26 aa, Staphylococcus epidermidis
TLKGGQPLQVIAIDKAGNKSEATTTN

SEQ ID NO: 1753628 - protein, 19 aa, Staphylococcus epidermidis
TLKVLFGHALRNALIPIIT

SEQ ID NO: 1753629 - protein, 22 aa, Staphylococcus epidermidis
TLLETFFSSSLFKAMTKMLAFA

SEQ ID NO: 1753630 - protein, 23 aa, Staphylococcus epidermidis
TLLLLLFIIIIYIATTLTYYLRD

SEQ ID NO: 1753631 - protein, 18 aa, Staphylococcus epidermidis
TLMLIGIIIIVLWLIIDF

SEQ ID NO: 1753632 - protein, 25 aa, Staphylococcus epidermidis
TLNYYIVYLLLLKLLNVNYLVSHVT

SEQ ID NO: 1753633 - protein, 18 aa, Staphylococcus epidermidis
TLQLLIVPAVIAAILWFF

SEQ ID NO: 1753634 - protein, 26 aa, Staphylococcus epidermidis
TLSICSIFITPLIQKIKQFNIKTKQF

SEQ ID NO: 1753635 - protein, 24 aa, Staphylococcus epidermidis
TLSINTLLIVAVLGAIYLGLLEEA

SEQ ID NO: 1753636 - protein, 20 aa, Staphylococcus epidermidis
TLSKVALLAAFIPIISGMSG

SEQ ID NO: 1753637 - protein, 26 aa, Staphylococcus epidermidis
TLTFHLPLYVLLIAFFINISPVTSIA

SEQ ID NO: 1753638 - protein, 17 aa, Staphylococcus epidermidis
TLTLHLPLYVLLIGFFI

SEQ ID NO: 1753639 - protein, 20 aa, Staphylococcus epidermidis
TLVIAFTFLFIVIAPKSYLI

SEQ ID NO: 1753640 - protein, 18 aa, Staphylococcus epidermidis
TLVILLPTIFILIGVFDK

SEQ ID NO: 1753641 - protein, 24 aa, Staphylococcus epidermidis
TLVIVLVIMTLFLKFAPYGKEGLQ

SEQ ID NO: 1753642 - protein, 23 aa, Staphylococcus epidermidis
TLVVPYMFMWLTKSKRNKAIGRA

SEQ ID NO: 1753643 - protein, 17 aa, Staphylococcus epidermidis
TMCQFIIAIIIIFSVAH

SEQ ID NO: 1753644 - protein, 29 aa, Staphylococcus epidermidis
TMEWAKLGILLSLLFFPNGHILIKLLFAV

SEQ ID NO: 1753645 - protein, 20 aa, Staphylococcus epidermidis
TMGWFMLIGSFLLIAAMFSD

SEQ ID NO: 1753646 - protein, 23 aa, Staphylococcus epidermidis
TMIICVLFIYIMHHDQVYMMIIY

SEQ ID NO: 1753647 - protein, 18 aa, Staphylococcus epidermidis
TMINIPLIWIAGPILAMM

SEQ ID NO: 1753648 - protein, 23 aa, Staphylococcus epidermidis
TMKKLLTRGPALGFNIIFVGMHK

SEQ ID NO: 1753649 - protein, 19 aa, Staphylococcus epidermidis
TMMAFTAYFIVWLTLPHQK

SEQ ID NO: 1753650 - protein, 20 aa, Staphylococcus epidermidis
TMNVVIVCYYGLGVSTLLAE

SEQ ID NO: 1753651 - protein, 19 aa, Staphylococcus epidermidis
TMSDGITKYIYKKVSNNQT

SEQ ID NO: 1753652 - protein, 32 aa, Staphylococcus epidermidis
TMTPIFIVMIAYTVVYLIFALVAFIHSNRVIK

SEQ ID NO: 1753653 - protein, 22 aa, Staphylococcus epidermidis
TMWMFIGFMIFGIVSSLVAAIV

SEQ ID NO: 1753654 - protein, 34 aa, Staphylococcus epidermidis
TNGTDVYNYIIFENNNRLGGTASWKDNRQPDKNI

SEQ ID NO: 1753655 - protein, 17 aa, Staphylococcus epidermidis
TNKFKIKRIIIAIPTLS

SEQ ID NO: 1753656 - protein, 29 aa, Staphylococcus epidermidis
TNLFITLFVFLILIFFLVFTAQKLANIPG

SEQ ID NO: 1753657 - protein, 23 aa, Staphylococcus epidermidis
TNLLFMLIVLFTLSHRQLRKVAG

SEQ ID NO: 1753658 - protein, 23 aa, Staphylococcus epidermidis
TNLLVMFIVLFTLSHRQLRKIAG

SEQ ID NO: 1753659 - protein, 19 aa, Staphylococcus epidermidis
TNLYVLLCYGISLTLLIIF

SEQ ID NO: 1753660 - protein, 30 aa, Staphylococcus epidermidis
TNSLISRFRQLATGAYKYNPFLINQVKNLN

SEQ ID NO: 1753661 - protein, 20 aa, Staphylococcus epidermidis
TNTMLILAIVPLVGLIITTA

SEQ ID NO: 1753662 - protein, 21 aa, Staphylococcus epidermidis
TNYYFVFHIIIYQLELILNKK

SEQ ID NO: 1753663 - protein, 19 aa, Staphylococcus epidermidis
TPDFSKKKNATLKLYDVVD

SEQ ID NO: 1753664 - protein, 27 aa, Staphylococcus epidermidis
TPLSAYAFMIFILLYVPCISTVATIRK

SEQ ID NO: 1753665 - protein, 23 aa, Staphylococcus epidermidis
TPMIVQLFIIFYGIPELGRLITN

SEQ ID NO: 1753666 - protein, 21 aa, Staphylococcus epidermidis
TPMLLGAMIMGPLVGWLMKKV

SEQ ID NO: 1753667 - protein, 23 aa, Staphylococcus epidermidis
TPMLVQVFIVFFGTTAALGLDVS

SEQ ID NO: 1753668 - protein, 51 aa, Staphylococcus epidermidis
TPNEIALFTLLMTLTIIFLVVILTMYPLAKFLHFDLSIVMLIALTVCLIPT

SEQ ID NO: 1753669 - protein, 51 aa, Staphylococcus epidermidis; identical to SEQ ID NO: 1591316

SEQ ID NO: 1753670 - protein, 20 aa, Staphylococcus epidermidis
TPNSHILMGLAAIGASLIGS

SEQ ID NO: 1753671 - protein, 33 aa, Staphylococcus epidermidis
TPPTINEPAGLVHKYYRGDHVEITLPVTDNTGG

SEQ ID NO: 1753672 - protein, 18 aa, Staphylococcus epidermidis
TPVLSIIIWLFYSNHFIN

SEQ ID NO: 1753673 - protein, 19 aa, Staphylococcus epidermidis
TPVLSIIIWLFYSNHFINL

SEQ ID NO: 1753674 - protein, 17 aa, Staphylococcus epidermidis
TPYFYYLKDNPAMPFIV

SEQ ID NO: 1753675 - protein, 17 aa, Staphylococcus epidermidis
TQKLPSLMKYGFSINEK

SEQ ID NO: 1753676 - protein, 26 aa, Staphylococcus epidermidis
TQPILFGLLLLIVVAVPYYSFNALKL

SEQ ID NO: 1753677 - protein, 30 aa, Staphylococcus epidermidis
TQSTLELNDKMKLLRDKLKTLVNPVKASLN

SEQ ID NO: 1753678 - protein, 24 aa, Staphylococcus epidermidis
TREGLALGVYIILTGSRSNAIKSA

SEQ ID NO: 1753679 - protein, 24 aa, Staphylococcus epidermidis
TREGLALGVYIILTGSRSSAVKSS

SEQ ID NO: 1753680 - protein, 20 aa, Staphylococcus epidermidis
TRILPLIINFLGFLISKING

SEQ ID NO: 1753681 - protein, 21 aa, Staphylococcus epidermidis
TRVDINFARSMANGKKYIVTQ

SEQ ID NO: 1753682 - protein, 36 aa, Staphylococcus epidermidis
TRVDINFARSMANGKKYIVTQAVRPTGTGNVYTEYW

SEQ ID NO: 1753683 - protein, 26 aa, Staphylococcus epidermidis
TRVDYIFFAIIIVLAIVGLVRLCSGA

SEQ ID NO: 1753684 - protein, 21 aa, Staphylococcus epidermidis
TRVFTILVLAYLPVLLVSIYF

SEQ ID NO: 1753685 - protein, 24 aa, Staphylococcus epidermidis
TRYNYVIPKEGSNLWFDNMVIPKT

SEQ ID NO: 1753686 - protein, 20 aa, Staphylococcus epidermidis
TSATSEIYIVKAPQPEQVAT

SEQ ID NO: 1753687 - protein, 32 aa, Staphylococcus epidermidis
TSEPVNLNYSSPFMSLLSMPADSSSNNTKNTI

SEQ ID NO: 1753688 - protein, 64 aa, Staphylococcus epidermidis
TSETFTSQSPINSESQFIGDSLSEDTIVTQSKNTNMLNKTGKDYDLQEQRGYTDSEQHNETQSN

SEQ ID NO: 1753689 - protein, 24 aa, Staphylococcus epidermidis
TSFEKWNFVKLAKPLIALSILIVV

SEQ ID NO: 1753690 - protein, 23 aa, Staphylococcus epidermidis
TSFILAFPMAIIWPYIQTGLNSF

SEQ ID NO: 1753691 - protein, 18 aa, Staphylococcus epidermidis
TSIKQRPGMFFKVEGFFY

SEQ ID NO: 1753692 - protein, 29 aa, Staphylococcus epidermidis
TSITLVLTIIFLVLTIFFHHINERNKKEM

SEQ ID NO: 1753693 - protein, 17 aa, Staphylococcus epidermidis
TSKATIITVIDTTAPPA

SEQ ID NO: 1753694 - protein, 22 aa, Staphylococcus epidermidis
TSKILLFMILGTIFLDAYDITI

SEQ ID NO: 1753695 - protein, 22 aa, Staphylococcus epidermidis
TSKRFIQWLNLNNIVPGYYGVN

SEQ ID NO: 1753696 - protein, 18 aa, Staphylococcus epidermidis
TSKRWLIISISIFIIMML

SEQ ID NO: 1753697 - protein, 28 aa, Staphylococcus epidermidis
TSLLRYYFWMTIIIIMLLVGVIAWLFDY

SEQ ID NO: 1753698 - protein, 20 aa, Staphylococcus epidermidis
TSLRESTSTSTSDSASTSTS

SEQ ID NO: 1753699 - protein, 17 aa, Staphylococcus epidermidis
TSNFLKVMFLSSPFVIV

SEQ ID NO: 1753700 - protein, 37 aa, Staphylococcus epidermidis
TSNQSSPTSFANLRTFSRFTVLNTMAAPTTTSTTTTS

SEQ ID NO: 1753701 - protein, 25 aa, Staphylococcus epidermidis
TSPDPQYFIPITASLTTHYRVINKN

SEQ ID NO: 1753702 - protein, 21 aa, Staphylococcus epidermidis
TSPFVMMTWITVLIPGQVKSL

SEQ ID NO: 1753703 - protein, 27 aa, Staphylococcus epidermidis
TSRRGFWWFYLFNALTGVLVFLFLYLL

SEQ ID NO: 1753704 - protein, 33 aa, Staphylococcus epidermidis
TSSVIFNFWLYLILYWLIPILTTFQIIRYWAEM

SEQ ID NO: 1753705 - protein, 22 aa, Staphylococcus epidermidis
TSVAIIGFIIISCFSEAKADSD

SEQ ID NO: 1753706 - protein, 24 aa, Staphylococcus epidermidis
TTAIAGTLLLSGLHAPQAKAESNI

SEQ ID NO: 1753707 - protein, 27 aa, Staphylococcus epidermidis
TTIIVIILLIIGLLFGLKVYGDHHPNN

SEQ ID NO: 1753708 - protein, 35 aa, Staphylococcus epidermidis
TTIMTLIFAIIIYYIILYLLFLISEIVLLPSGFLG

SEQ ID NO: 1753709 - protein, 18 aa, Staphylococcus epidermidis
TTISYVITLLINYTVIIF

SEQ ID NO: 1753710 - protein, 17 aa, Staphylococcus epidermidis
TTIWNTILSIWGQISNF

SEQ ID NO: 1753711 - protein, 18 aa, Staphylococcus epidermidis
TTIWNTILSIWGQISNFI

SEQ ID NO: 1753712 - protein, 34 aa, Staphylococcus epidermidis
TTIYNLNFWVWIPLIIIILCLIFRISTVPSMLIS

SEQ ID NO: 1753713 - protein, 24 aa, Staphylococcus epidermidis
TTKTFLLWMILAAIIGLMFPQQFA

SEQ ID NO: 1753714 - protein, 19 aa, Staphylococcus epidermidis
TTLDTAMHGLRESIKDKND

SEQ ID NO: 1753715 - protein, 23 aa, Staphylococcus epidermidis
TTLILALLPTILKLTSFYLNTVQ

SEQ ID NO: 1753716 - protein, 30 aa, Staphylococcus epidermidis
TTLLNLFHGWPWYAVWLVLLGFGGGMIVPA

SEQ ID NO: 1753717 - protein, 31 aa, Staphylococcus epidermidis
TTSDQWQSLAYTRTPFVKTGTYDVVNPSNWG

SEQ ID NO: 1753718 - protein, 25 aa, Staphylococcus epidermidis
TTSTYLFLFVFGVISIFLLEHNHAF

SEQ ID NO: 1753719 - protein, 25 aa, Staphylococcus epidermidis
TTTISFVISFIVVTYLHVVLGELAP

SEQ ID NO: 1753720 - protein, 22 aa, Staphylococcus epidermidis
TTTLAGALLFTGVGATHNAHAA

SEQ ID NO: 1753721 - protein, 23 aa, Staphylococcus epidermidis
TTVLGIISLFSWGLGYFGQPHII

SEQ ID NO: 1753722 - protein, 24 aa, Staphylococcus epidermidis
TTYLHIMWIYIVRSFGMAFIMMPI

SEQ ID NO: 1753723 - protein, 27 aa, Staphylococcus epidermidis
TVAVLLISIILFFAHSYRFASTVFILS

SEQ ID NO: 1753724 - protein, 19 aa, Staphylococcus epidermidis
TVDKQPLINAKTALQQSLD

SEQ ID NO: 1753725 - protein, 19 aa, Staphylococcus epidermidis
TVFFPLWFPVHADGVISTF

SEQ ID NO: 1753726 - protein, 24 aa, Staphylococcus epidermidis
TVGKSDLFYFNPAGLYESHSFKKL

SEQ ID NO: 1753727 - protein, 26 aa, Staphylococcus epidermidis
TVIGLILLSLTFLPNAWYIASSVVGY

SEQ ID NO: 1753728 - protein, 22 aa, Staphylococcus epidermidis
TVIIPVLFVMEHLFGLTGVVWS

SEQ ID NO: 1753729 - protein, 21 aa, Staphylococcus epidermidis
TVILFFAIGCFKYADAHVTLN

SEQ ID NO: 1753730 - protein, 19 aa, Staphylococcus epidermidis
TVIPVGESTKIVIKYKNKE

SEQ ID NO: 1753731 - protein, 25 aa, Staphylococcus epidermidis
TVIWIVLVIILSFKFLNSLLYLKYL

SEQ ID NO: 1753732 - protein, 21 aa, Staphylococcus epidermidis
TVLIFMPIVWILVGYYVFSPL

SEQ ID NO: 1753733 - protein, 17 aa, Staphylococcus epidermidis
TVLIYLTLLLDFNKIVR

SEQ ID NO: 1753734 - protein, 19 aa, Staphylococcus epidermidis
TVLWIFLFCYIIVASIDFG

SEQ ID NO: 1753735 - protein, 23 aa, Staphylococcus epidermidis
TVLYLILSFLYLMSLIAFYSMEN

SEQ ID NO: 1753736 - protein, 22 aa, Staphylococcus epidermidis
TVMFLLVIIFSLNIIIRFQYTE

SEQ ID NO: 1753737 - protein, 28 aa, Staphylococcus epidermidis
TVPNEWKEFFYKSYKFVDDVPSVLEIVG

SEQ ID NO: 1753738 - protein, 23 aa, Staphylococcus epidermidis
TVQAFIHSILFGFPTKKSKEPRL

SEQ ID NO: 1753739 - protein, 23 aa, Staphylococcus epidermidis
TVQLLPITGIPLPFISYGGSSLW

SEQ ID NO: 1753740 - protein, 24 aa, Staphylococcus epidermidis
TVRSYLIIIGLFAVLMFLLGDNKE

SEQ ID NO: 1753741 - protein, 24 aa, Staphylococcus epidermidis
TVRSYLIILSIFAILMFLLGDKNE

SEQ ID NO: 1753742 - protein, 17 aa, Staphylococcus epidermidis
TVSALMLIYLVAKIFQF

SEQ ID NO: 1753743 - protein, 27 aa, Staphylococcus epidermidis
TVVALIFSFYLFNYLKFKPTSMCIATI

SEQ ID NO: 1753744 - protein, 19 aa, Staphylococcus epidermidis
TVYVILGSVLIKLALNYPL

SEQ ID NO: 1753745 - protein, 32 aa, Staphylococcus epidermidis
TWIGSFIIVLLLFFILLLNFNKIISVLGIVTP

SEQ ID NO: 1753746 - protein, 25 aa, Staphylococcus epidermidis
TWLIVLIIIMFVSLWWDLGNLNDTF

SEQ ID NO: 1753747 - protein, 27 aa, Staphylococcus epidermidis
TWTATLSELGLSPTDSYNFLVTSSQYG

SEQ ID NO: 1753748 - protein, 28 aa, Staphylococcus epidermidis
TYASFLLLTWLVLIFVLLVLAYRRAQVL

SEQ ID NO: 1753749 - protein, 18 aa, Staphylococcus epidermidis
TYDNGTFDILPDNSRNSL

SEQ ID NO: 1753750 - protein, 84 aa, Staphylococcus epidermidis
TYDPKTGIATLTPDAYSQKGAISLNTRLDSNRSFRFIGKVNLGNRYEGYSPDGVAGGDGIGFAFSPGPLGQIGKEGAAVGIGGL

SEQ ID NO: 1753751 - protein, 84 aa, Staphylococcus epidermidis
TYDPKTGIATLTPDAYSQKGAISLNTRLDSNRSFRFTGKVNLGNRYEGYSPDGVVGGDGIGFAFSPGPLGQIGKEGAAVGIGGL

SEQ ID NO: 1753752 - protein, 26 aa, Staphylococcus epidermidis
TYILYSIFCILLIGLLILPETSITPI

SEQ ID NO: 1753753 - protein, 23 aa, Staphylococcus epidermidis
TYKIYLALMAFDQNLLSLNHTEQ

SEQ ID NO: 1753754 - protein, 25 aa, Staphylococcus epidermidis
TYPLQLAFFIILLMSHSLLNKVSLK

SEQ ID NO: 1753755 - protein, 25 aa, Staphylococcus epidermidis
TYSRIMYVIIIIAIIYFVIRYFMKR

SEQ ID NO: 1753756 - protein, 20 aa, Staphylococcus epidermidis
VAAFFMMTNTHFAKADVSDS

SEQ ID NO: 1753757 - protein, 18 aa, Staphylococcus epidermidis
VAAIIGQAKLLDHAMENL

SEQ ID NO: 1753758 - protein, 17 aa, Staphylococcus epidermidis
VAFILLVILVKLILYLI

SEQ ID NO: 1753759 - protein, 38 aa, Staphylococcus epidermidis
VAGIATAILIVMIIISGVLLRKAFLKMDSYVDDLSGHI

SEQ ID NO: 1753760 - protein, 29 aa, Staphylococcus epidermidis
VAGIPIAALGLLAPWIAGAAMALSSVSVV

SEQ ID NO: 1753761 - protein, 35 aa, Staphylococcus epidermidis
VAGIYQDIDVTPGSELVINFISTSPTFTDGVTGAK

SEQ ID NO: 1753762 - protein, 26 aa, Staphylococcus epidermidis
VAGWNLLLFIIFRSISGIVLAGLVSY

SEQ ID NO: 1753763 - protein, 18 aa, Staphylococcus epidermidis
VAIALIALITKFVGKSYS

SEQ ID NO: 1753764 - protein, 26 aa, Staphylococcus epidermidis
VAIPVFIYGFIFIALSERSVKWMFVA

SEQ ID NO: 1753765 - protein, 20 aa, Staphylococcus epidermidis
VANIILPILVTILAIRMGVN

SEQ ID NO: 1753766 - protein, 28 aa, Staphylococcus epidermidis
VANWRILFVLLGILGLVWVMVWAKVFTD

SEQ ID NO: 1753767 - protein, 41 aa, Staphylococcus epidermidis
VAQDELFGLNELNSIFINITQKPTARKAISGMASQLNNSIN

SEQ ID NO: 1753768 - protein, 20 aa, Staphylococcus epidermidis
VAVGASTYRKQFCKRFLEQI

SEQ ID NO: 1753769 - protein, 17 aa, Staphylococcus epidermidis
VAYIVCSISLLIQAPLL

SEQ ID NO: 1753770 - protein, 23 aa, Staphylococcus epidermidis
VAYKIYHHQYNTPDFDKNGITFS

SEQ ID NO: 1753771 - protein, 25 aa, Staphylococcus epidermidis
VCTATAIMILLYSGLKFGENAPQGV

SEQ ID NO: 1753772 - protein, 23 aa, Staphylococcus epidermidis
VDDQIWSNSKFKLALKVQDRQDS

SEQ ID NO: 1753773 - protein, 24 aa, Staphylococcus epidermidis
VDEPLHFQGGLTKRSYFNKDGRVT

SEQ ID NO: 1753774 - protein, 25 aa, Staphylococcus epidermidis
VDIQIMGWLLLVSCLILLISVFIRT

SEQ ID NO: 1753775 - protein, 18 aa, Staphylococcus epidermidis
VDKIKRANGLSSNNIHNG

SEQ ID NO: 1753776 - protein, 28 aa, Staphylococcus epidermidis
VDNLIIIFNIFFVLCLISLFVTVITIIF

SEQ ID NO: 1753777 - protein, 50 aa, Staphylococcus epidermidis
VDSNGITTTGIINGADNLTIDSGFYKTPKYSVGDYVWKDTNKDSIQDDNE

SEQ ID NO: 1753778 - protein, 34 aa, Staphylococcus epidermidis
VDTSLLRYYFWITILIVILIVGLIAWLFDYKFER

SEQ ID NO: 1753779 - protein, 27 aa, Staphylococcus epidermidis
VDTSYTYLIIIYAIRMFAVSLLMMPIN

SEQ ID NO: 1753780 - protein, 19 aa, Staphylococcus epidermidis
VDTTLDLDFPIVEKPQTDT

SEQ ID NO: 1753781 - protein, 22 aa, Staphylococcus epidermidis
VDVMIIFLREGLEVLLIIMTLT

SEQ ID NO: 1753782 - protein, 19 aa, Staphylococcus epidermidis
VDWILVLVISLLALTSVIL

SEQ ID NO: 1753783 - protein, 26 aa, Staphylococcus epidermidis
VEALQNIYLRVYYPPVVIGLTAIVSI

SEQ ID NO: 1753784 - protein, 25 aa, Staphylococcus epidermidis
VEDNLRYRQIIFSHKDDLKTLTAKI

SEQ ID NO: 1753785 - protein, 18 aa, Staphylococcus epidermidis
VEGLPAGVTFDEATNTIS

SEQ ID NO: 1753786 - protein, 26 aa, Staphylococcus epidermidis
VEKFTRFFRMIYLRFKARKNRRKEER

SEQ ID NO: 1753787 - protein, 26 aa, Staphylococcus epidermidis
VEKIIEYFMLPYYLDNKFTIIASILI

SEQ ID NO: 1753788 - protein, 21 aa, Staphylococcus epidermidis
VEKLFKRYTDLVIDQLEDDDF

SEQ ID NO: 1753789 - protein, 31 aa, Staphylococcus epidermidis
VEKNKGIGTIRDIQPLVVKKPTAKSKIESAV

SEQ ID NO: 1753790 - protein, 21 aa, Staphylococcus epidermidis
VEKYKKTPIFYSLGNTTSDDF

SEQ ID NO: 1753791 - protein, 18 aa, Staphylococcus epidermidis
VELPTYRFPSFKTLWRST

SEQ ID NO: 1753792 - protein, 23 aa, Staphylococcus epidermidis
VENIILAFILTRWAWFCRIIRTS

SEQ ID NO: 1753793 - protein, 17 aa, Staphylococcus epidermidis
VERKRIKEHPDVRKATD

SEQ ID NO: 1753794 - protein, 31 aa, Staphylococcus epidermidis
VESPVLFVSIAVFSSLVFNSIIYTCVSMLGN

SEQ ID NO: 1753795 - protein, 24 aa, Staphylococcus epidermidis
VEVDKLNSIVRKKAKALKEIELEA

SEQ ID NO: 1753796 - protein, 25 aa, Staphylococcus epidermidis
VEWVTLILLLFIVIIYIATTLTYYL

SEQ ID NO: 1753797 - protein, 30 aa, Staphylococcus epidermidis
VFCFVISGIYMLILFFKKLRKFITNKAVLY

SEQ ID NO: 1753798 - protein, 24 aa, Staphylococcus epidermidis
VFFAPVLFPLIVWIVGQPPASTYS

SEQ ID NO: 1753799 - protein, 18 aa, Staphylococcus epidermidis
VFFIMQLVGQVPAALWVI

SEQ ID NO: 1753800 - protein, 17 aa, Staphylococcus epidermidis
VFFSFIFGFPVGTLMGL

SEQ ID NO: 1753801 - protein, 27 aa, Staphylococcus epidermidis
VFFSTVLIIFIILLSGLTFLPDLMLGP

SEQ ID NO: 1753802 - protein, 17 aa, Staphylococcus epidermidis
VFILLSLIVSRYLYSVA

SEQ ID NO: 1753803 - protein, 20 aa, Staphylococcus epidermidis
VFILSILLLVVSGVYLIAKY

SEQ ID NO: 1753804 - protein, 17 aa, Staphylococcus epidermidis
VFLAFVTLYYFIRYNKK

SEQ ID NO: 1753805 - protein, 21 aa, Staphylococcus epidermidis
VFLLIMVPFFLIYMLKDHEKF

SEQ ID NO: 1753806 - protein, 24 aa, Staphylococcus epidermidis
VFMVLFSIFVLFRGLGKDYDAAVM

SEQ ID NO: 1753807 - protein, 17 aa, Staphylococcus epidermidis
VFNIFRILQGFSAGIIT

SEQ ID NO: 1753808 - protein, 26 aa, Staphylococcus epidermidis
VFNYWLYLLIILLVSWIGFHLFCISY

SEQ ID NO: 1753809 - protein, 27 aa, Staphylococcus epidermidis
VFRVILIPFFILFALVDFGFGQISILG

SEQ ID NO: 1753810 - protein, 26 aa, Staphylococcus epidermidis
VFRVILIPVFILFALVDFGFGQVSFL

SEQ ID NO: 1753811 - protein, 18 aa, Staphylococcus epidermidis
VFTWISLIVFLVVSYIGV

SEQ ID NO: 1753812 - protein, 26 aa, Staphylococcus epidermidis
VFVSFLILTIFIGGCGFINKEDSKEA

SEQ ID NO: 1753813 - protein, 23 aa, Staphylococcus epidermidis
VGAISIITGVAIFIGGHQAQAAE

SEQ ID NO: 1753814 - protein, 39 aa, Staphylococcus epidermidis
VGASFKWYDFVYFIDTIIYLIILIFKRNWLDTRAFSKKF

SEQ ID NO: 1753815 - protein, 43 aa, Staphylococcus epidermidis
VGAVCLIVLLDWKLTVLILLISPVIFGIIFPLMKKLENTGEIQ

SEQ ID NO: 1753816 - protein, 24 aa, Staphylococcus epidermidis
VGFTLFIFTLLMNLLSQWISKRFR

SEQ ID NO: 1753817 - protein, 25 aa, Staphylococcus epidermidis
VGGALVWLMYLPHWKATEEPEVKLG

SEQ ID NO: 1753818 - protein, 29 aa, Staphylococcus epidermidis
VGGIFTLAGTFIALWFQFRKDDKDKRKDY

SEQ ID NO: 1753819 - protein, 23 aa, Staphylococcus epidermidis
VGGLLLAFYFYRDNPDLKNAFMQ

SEQ ID NO: 1753820 - protein, 27 aa, Staphylococcus epidermidis
VGGMLPFLMLFILSVKFKLLPTRMILI

SEQ ID NO: 1753821 - protein, 23 aa, Staphylococcus epidermidis
VGIDFLAIMGFASAISVLFAVLA

SEQ ID NO: 1753822 - protein, 26 aa, Staphylococcus epidermidis
VGIDYSLFILFRYKEVRKRGLEPIEA

SEQ ID NO: 1753823 - protein, 24 aa, Staphylococcus epidermidis
VGIISLLTFVFDIPNFTLTLAVMI

SEQ ID NO: 1753824 - protein, 26 aa, Staphylococcus epidermidis
VGIVTAFIILLITFGSLIAAGMPIVS

SEQ ID NO: 1753825 - protein, 34 aa, Staphylococcus epidermidis
VGIYLAIILIICSIYLAFILIGSLNGKDMSNSVL

SEQ ID NO: 1753826 - protein, 34 aa, Staphylococcus epidermidis
VGIYLAIILIICSIYLAFILIGSLSGKDMSNSVL

SEQ ID NO: 1753827 - protein, 35 aa, Staphylococcus epidermidis
VGIYLAIILVICSCYLAFILIGSLQGKDMSNSVLD

SEQ ID NO: 1753828 - protein, 25 aa, Staphylococcus epidermidis
VGLGGLIILNLLEKVDLPIEGMMLM

SEQ ID NO: 1753829 - protein, 19 aa, Staphylococcus epidermidis
VGPALLIPLYVQNALGLSA

SEQ ID NO: 1753830 - protein, 24 aa, Staphylococcus epidermidis
VGTSAAYFYSLYEMIQWLTHHVNE

SEQ ID NO: 1753831 - protein, 19 aa, Staphylococcus epidermidis
VGVCLLFISIYLNLAIGSS

SEQ ID NO: 1753832 - protein, 30 aa, Staphylococcus epidermidis
VGVIFLITFLIYLFYSPRLKFDVLENPNKG

SEQ ID NO: 1753833 - protein, 27 aa, Staphylococcus epidermidis
VGVTIIFGAFAFFWFVGIHGPSIVEPA

SEQ ID NO: 1753834 - protein, 19 aa, Staphylococcus epidermidis
VHKLILRYSLWYIKTVKGS

SEQ ID NO: 1753835 - protein, 17 aa, Staphylococcus epidermidis
VHLFLNLNHFKWYIPKL

SEQ ID NO: 1753836 - protein, 24 aa, Staphylococcus epidermidis
VHLTIFLIIRLIQGLAGGGAIVIA

SEQ ID NO: 1753837 - protein, 18 aa, Staphylococcus epidermidis
VHYAVLALIICFMFGFGT

SEQ ID NO: 1753838 - protein, 38 aa, Staphylococcus epidermidis
VIAGIVGWYFWSAWSFVIMAVLIILFVIAAILYVRFGG

SEQ ID NO: 1753839 - protein, 20 aa, Staphylococcus epidermidis
VIALISIYMLSLKMDAYDTR

SEQ ID NO: 1753840 - protein, 24 aa, Staphylococcus epidermidis
VIALLFDWFVIFSSILISVTFNNI

SEQ ID NO: 1753841 - protein, 23 aa, Staphylococcus epidermidis
VIANTAFIFLPALIGWSSMRVFG

SEQ ID NO: 1753842 - protein, 19 aa, Staphylococcus epidermidis
VIAQQSPFSLNVIMNKDNL

SEQ ID NO: 1753843 - protein, 25 aa, Staphylococcus epidermidis
VIERLILALILPLIILMIGMYSFNT

SEQ ID NO: 1753844 - protein, 22 aa, Staphylococcus epidermidis
VIFLHIIGFSFLWIAGKDHHIL

SEQ ID NO: 1753845 - protein, 22 aa, Staphylococcus epidermidis
VIFSLLYFIISIVVGFILWAIF

SEQ ID NO: 1753846 - protein, 17 aa, Staphylococcus epidermidis
VIGFIVLAILLASVIPV

SEQ ID NO: 1753847 - protein, 18 aa, Staphylococcus epidermidis
VIGFVFFDVPIQVLLLIS

SEQ ID NO: 1753848 - protein, 18 aa, Staphylococcus epidermidis
VIGFVFFNVPIQILLLIS

SEQ ID NO: 1753849 - protein, 18 aa, Staphylococcus epidermidis
VIGIFILARKTASSMLSD

SEQ ID NO: 1753850 - protein, 26 aa, Staphylococcus epidermidis
VIGIPKWIQFLFIIIVAMVISASMRV

SEQ ID NO: 1753851 - protein, 17 aa, Staphylococcus epidermidis
VIGPFFALPRLATTSYE

SEQ ID NO: 1753852 - protein, 29 aa, Staphylococcus epidermidis
VIGVGLFVHWIWPDLPIGAAFAIAAILCP

SEQ ID NO: 1753853 - protein, 30 aa, Staphylococcus epidermidis
VIGVGYFIHWIWPDLPMPAAFAIAAILCPT

SEQ ID NO: 1753854 - protein, 18 aa, Staphylococcus epidermidis
VIIIFLAICYIFVNFFYF

SEQ ID NO: 1753855 - protein, 24 aa, Staphylococcus epidermidis
VIIIILVIALFLNQRYMKDRVETE

SEQ ID NO: 1753856 - protein, 29 aa, Staphylococcus epidermidis
VIIQSFLTLLFLLFLILSATGIIQPDLTT

SEQ ID NO: 1753857 - protein, 18 aa, Staphylococcus epidermidis
VIIVILIDVLLRLLEKKL

SEQ ID NO: 1753858 - protein, 17 aa, Staphylococcus epidermidis
VIKFIFDLLYPLTPFEM

SEQ ID NO: 1753859 - protein, 29 aa, Staphylococcus epidermidis
VIKNKYYIIVFVFIFLLSSILNGLSIYLL

SEQ ID NO: 1753860 - protein, 26 aa, Staphylococcus epidermidis
VIKQNFIVIILFLFNIRNFKFDDFGS

SEQ ID NO: 1753861 - protein, 19 aa, Staphylococcus epidermidis
VILAAYHAPATFLAQAVCY

SEQ ID NO: 1753862 - protein, 17 aa, Staphylococcus epidermidis
VILKAAVESPVLFVSIA

SEQ ID NO: 1753863 - protein, 31 aa, Staphylococcus epidermidis
VILKASIESPILFVSVAVFSSLVFNSIIYTS

SEQ ID NO: 1753864 - protein, 20 aa, Staphylococcus epidermidis
VILMVLIPIVFVIPNVFGHN

SEQ ID NO: 1753865 - protein, 24 aa, Staphylococcus epidermidis
VILVVILACFIYMFLEGKLGSLEM

SEQ ID NO: 1753866 - protein, 28 aa, Staphylococcus epidermidis
VIMIIFMAMPFIFGLWNIVVPLQIGARD

SEQ ID NO: 1753867 - protein, 19 aa, Staphylococcus epidermidis
VIMTELEDVYFLGNDRLIH

SEQ ID NO: 1753868 - protein, 17 aa, Staphylococcus epidermidis
VIPILTAILLIFIGKRP

SEQ ID NO: 1753869 - protein, 19 aa, Staphylococcus epidermidis
VIQWFYKEVDWFEAKLKDD

SEQ ID NO: 1753870 - protein, 20 aa, Staphylococcus epidermidis
VIQWFYKEVDWFEAKLKDET

SEQ ID NO: 1753871 - protein, 17 aa, Staphylococcus epidermidis
VITIARGQNYTIGPNLR

SEQ ID NO: 1753872 - protein, 33 aa, Staphylococcus epidermidis
VITIIVLVVIGVLGFWFWNNATSYVTTDNAKVD

SEQ ID NO: 1753873 - protein, 26 aa, Staphylococcus epidermidis
VITIIVVLFITLFYKELFILSFDEEY

SEQ ID NO: 1753874 - protein, 17 aa, Staphylococcus epidermidis
VITLPISAILAGIIYFI

SEQ ID NO: 1753875 - protein, 25 aa, Staphylococcus epidermidis
VIVGLFIIFLFIWMSFRTVQLQCFS

SEQ ID NO: 1753876 - protein, 24 aa, Staphylococcus epidermidis
VIVMIWSAPSFKALFAPKGKLSAL

SEQ ID NO: 1753877 - protein, 21 aa, Staphylococcus epidermidis
VIVSCIIFSIFFLSVNQGAQS

SEQ ID NO: 1753878 - protein, 23 aa, Staphylococcus epidermidis
VIYGMVVLLLVCGCIPKLGALAN

SEQ ID NO: 1753879 - protein, 29 aa, Staphylococcus epidermidis
VIYSPLRLIILMVIAILGMAGWLFYAHQL

SEQ ID NO: 1753880 - protein, 21 aa, Staphylococcus epidermidis
VKALKINNRWKFDSSVSNISI

SEQ ID NO: 1753881 - protein, 36 aa, Staphylococcus epidermidis
VKDADNKTIDSGFYKPTYNLGDYVWEDTNKDGIQDD

SEQ ID NO: 1753882 - protein, 23 aa, Staphylococcus epidermidis
VKEAVLTTDKLLDKIQLKTTVVS

SEQ ID NO: 1753883 - protein, 22 aa, Staphylococcus epidermidis
VKFNINLIKRIVVTIFNAIKSF

SEQ ID NO: 1753884 - protein, 25 aa, Staphylococcus epidermidis
VKGNLLLELAVIFGISALVTSFLRH

SEQ ID NO: 1753885 - protein, 29 aa, Staphylococcus epidermidis
VKIGWLILRVLAVIFVWLTYLKVGPKMIY

SEQ ID NO: 1753886 - protein, 17 aa, Staphylococcus epidermidis
VKILPINILAICVGGLI

SEQ ID NO: 1753887 - protein, 17 aa, Staphylococcus epidermidis
VKMPKKELAPHSPSLIY

SEQ ID NO: 1753888 - protein, 25 aa, Staphylococcus epidermidis
VKRDFWLIPIYVFSYMVLPIILGFL

SEQ ID NO: 1753889 - protein, 19 aa, Staphylococcus epidermidis
VKYPVIMVPIFITAALSGI

SEQ ID NO: 1753890 - protein, 24 aa, Staphylococcus epidermidis
VLAFFFFVFILLFFSNDTRAAIFI

SEQ ID NO: 1753891 - protein, 21 aa, Staphylococcus epidermidis
VLAMLFVIKFLPETRGRSLEE

SEQ ID NO: 1753892 - protein, 19 aa, Staphylococcus epidermidis
VLAYAVLLGLFLLGLITSL

SEQ ID NO: 1753893 - protein, 19 aa, Staphylococcus epidermidis
VLFAWSPFIILTVIVMIWS

SEQ ID NO: 1753894 - protein, 17 aa, Staphylococcus epidermidis
VLFFMLKDGHRFKDYTT

SEQ ID NO: 1753895 - protein, 17 aa, Staphylococcus epidermidis
VLFQSIHLLMDKITIIT

SEQ ID NO: 1753896 - protein, 29 aa, Staphylococcus epidermidis
VLGGISNILWFFVAVIVGSLATMLTILLF

SEQ ID NO: 1753897 - protein, 30 aa, Staphylococcus epidermidis
VLGGPGAVFWMWVIAFIGAASAFMEATLAQ

SEQ ID NO: 1753898 - protein, 19 aa, Staphylococcus epidermidis
VLIAWILYYFVNINLTNYN

SEQ ID NO: 1753899 - protein, 27 aa, Staphylococcus epidermidis
VLIFILIIIIILIVYLFFDVFNMNRFV

SEQ ID NO: 1753900 - protein, 19 aa, Staphylococcus epidermidis
VLIIIAFVISFVALADLID

SEQ ID NO: 1753901 - protein, 17 aa, Staphylococcus epidermidis
VLILVLLNKLYSLALSP

SEQ ID NO: 1753902 - protein, 23 aa, Staphylococcus epidermidis
VLKPLIIVILTLVIIYTVFKKDW

SEQ ID NO: 1753903 - protein, 25 aa, Staphylococcus epidermidis
VLLFLIWTFLQIYLNKKLYPFQITE

SEQ ID NO: 1753904 - protein, 31 aa, Staphylococcus epidermidis
VLLNVLSWQLILFSLVMIILVRPISVLLSTL

SEQ ID NO: 1753905 - protein, 19 aa, Staphylococcus epidermidis
VLMSFLFYFVMKADFMEIG

SEQ ID NO: 1753906 - protein, 17 aa, Staphylococcus epidermidis
VLNIFLQGLSNFKLQFI

SEQ ID NO: 1753907 - protein, 29 aa, Staphylococcus epidermidis
VLSALIFNALIIVLLIPIAMKGVQFKGAS

SEQ ID NO: 1753908 - protein, 23 aa, Staphylococcus epidermidis
VLSIFLFLILSYASLVFLFGANI

SEQ ID NO: 1753909 - protein, 19 aa, Staphylococcus epidermidis
VLSIPVWIGVLFLMYQKYK

SEQ ID NO: 1753910 - protein, 28 aa, Staphylococcus epidermidis
VLSWIGNILHLLYLGFIVLMVSMMGNKD

SEQ ID NO: 1753911 - protein, 28 aa, Staphylococcus epidermidis
VLTAKTEAITLLSAVSPVVEAKPSALSE

SEQ ID NO: 1753912 - protein, 29 aa, Staphylococcus epidermidis
VLVFVPQIVVLFFFISLLEDSGYMARIAV

SEQ ID NO: 1753913 - protein, 18 aa, Staphylococcus epidermidis
VMFEIMLLASFVLVTLGQ

SEQ ID NO: 1753914 - protein, 18 aa, Staphylococcus epidermidis
VMGLIAMVLLVVGIALTS

SEQ ID NO: 1753915 - protein, 18 aa, Staphylococcus epidermidis
VMIGLFLGAIYMILADKY

SEQ ID NO: 1753916 - protein, 17 aa, Staphylococcus epidermidis
VMLVLANGYWTIMMISF

SEQ ID NO: 1753917 - protein, 20 aa, Staphylococcus epidermidis
VMRDIYAHIPGYDKYKINAA

SEQ ID NO: 1753918 - protein, 33 aa, Staphylococcus epidermidis
VMTLVIAIIIYYIILYLLFLIAELVLLPADFLG

SEQ ID NO: 1753919 - protein, 18 aa, Staphylococcus epidermidis
VNDILKDIPVRRIKDKGQ

SEQ ID NO: 1753920 - protein, 21 aa, Staphylococcus epidermidis
VNDLYKYTVRLHPGIADVGGE

SEQ ID NO: 1753921 - protein, 47 aa, Staphylococcus epidermidis
VNEFKQLVVAFFKEHWPKMLIIIGIIVLLLILNAIFTTVNKNDHTND

SEQ ID NO: 1753922 - protein, 27 aa, Staphylococcus epidermidis
VNEIEIPKWLLFFSVLLSIIGSIFQLI

SEQ ID NO: 1753923 - protein, 20 aa, Staphylococcus epidermidis
VNEVYLISHALLETGAAKSE

SEQ ID NO: 1753924 - protein, 24 aa, Staphylococcus epidermidis
VNIDKQLNNLKNSGYSYVSTDALQ

SEQ ID NO: 1753925 - protein, 25 aa, Staphylococcus epidermidis
VNIIIFILIPWLLTLFHINVYALIV

SEQ ID NO: 1753926 - protein, 25 aa, Staphylococcus epidermidis
VNILLLGMFLQKYPITSLLIFISLL

SEQ ID NO: 1753927 - protein, 25 aa, Staphylococcus epidermidis
VNKDNFNEHMNLSGSATYDPKTGIA

SEQ ID NO: 1753928 - protein, 19 aa, Staphylococcus epidermidis
VNKKEALWSINENINGISL

SEQ ID NO: 1753929 - protein, 25 aa, Staphylococcus epidermidis
VNRKLLFIIITFTLSIIIPSSIYSE

SEQ ID NO: 1753930 - protein, 25 aa, Staphylococcus epidermidis
VNRWYDPFWLAWFSSTAYFIHNFEE

SEQ ID NO: 1753931 - protein, 27 aa, Staphylococcus epidermidis
VNTFFHEYLLPQMGLTPKVEELPKEER

SEQ ID NO: 1753932 - protein, 33 aa, Staphylococcus epidermidis
VNVTPSQASEVFTPINPITITATDNSGKVVTHT

SEQ ID NO: 1753933 - protein, 24 aa, Staphylococcus epidermidis
VNWRQLFVSILIYALSQLIVILWQ

SEQ ID NO: 1753934 - protein, 29 aa, Staphylococcus epidermidis
VPALIYYGLKFLNPSYFLVSAFIISAITS

SEQ ID NO: 1753935 - protein, 21 aa, Staphylococcus epidermidis
VPDKWILGLLGLIPIYLGIKV

SEQ ID NO: 1753936 - protein, 22 aa, Staphylococcus epidermidis
VPEKWILGLLGLIPIYLGIKVA

SEQ ID NO: 1753937 - protein, 33 aa, Staphylococcus epidermidis
VPFYKKHSTLLYSTLLIVFGYLSVFVNGDENIV

SEQ ID NO: 1753938 - protein, 24 aa, Staphylococcus epidermidis
VPILLVFTILLFYGKFKGFTWDEI

SEQ ID NO: 1753939 - protein, 30 aa, Staphylococcus epidermidis
VPIVLGLIILLGIAWGVYAFVTNTPKNAYL

SEQ ID NO: 1753940 - protein, 34 aa, Staphylococcus epidermidis
VPKAIKQVFWRILLFYILAIFIIGMLIPYDSKAL

SEQ ID NO: 1753941 - protein, 17 aa, Staphylococcus epidermidis
VPPPWLNGGDLGRDVIN

SEQ ID NO: 1753942 - protein, 24 aa, Staphylococcus epidermidis
VPSDLTDSFAIPKIKDNSGEIIAT

SEQ ID NO: 1753943 - protein, 23 aa, Staphylococcus epidermidis
VPVKHVLLEVVPTTRTTVRGQQF

SEQ ID NO: 1753944 - protein, 27 aa, Staphylococcus epidermidis
VPVQFNMMTLILFGIVLILTSLVGSLF

SEQ ID NO: 1753945 - protein, 26 aa, Staphylococcus epidermidis
VPYGDDWFAYFMRRLAERPQNLSLAF

SEQ ID NO: 1753946 - protein, 17 aa, Staphylococcus epidermidis
VQHPGKVIKKNDKYYFQ

SEQ ID NO: 1753947 - protein, 18 aa, Staphylococcus epidermidis
VQKAPLILITLIPFWCIY

SEQ ID NO: 1753948 - protein, 54 aa, Staphylococcus epidermidis
VQKNNTMIWRAIIPPLVMIALTVIIFLVRPIGVYILLMLGMSTVTIIFGITTYF

SEQ ID NO: 1753949 - protein, 31 aa, Staphylococcus epidermidis
VQKSKFRYIWTSLISFIFFVGVIIGISYLSI

SEQ ID NO: 1753950 - protein, 17 aa, Staphylococcus epidermidis
VQLFPYKVNDHKAEQII

SEQ ID NO: 1753951 - protein, 25 aa, Staphylococcus epidermidis
VQLLSFIIYVIWQVALIMFYYKSRQ

SEQ ID NO: 1753952 - protein, 37 aa, Staphylococcus epidermidis
VQLTRFEKVLYITLITVIAMISIYMLSLKMDAYDTRG

SEQ ID NO: 1753953 - protein, 83 aa, Staphylococcus epidermidis
VQNLTALVNYPGISTPLEVPVKVWVYNFDFPQPIYKIQVGDTFPKGTWVGYYKHLENGEGLPIDGWRFYWNQQSTGTTSDQWQ

SEQ ID NO: 1753954 - protein, 18 aa, Staphylococcus epidermidis
VQPNVIKKPTAINSLTQE

SEQ ID NO: 1753955 - protein, 30 aa, Staphylococcus epidermidis
VQSVFQIVPRWFWFYIILVSIVFPFEIGKE

SEQ ID NO: 1753956 - protein, 25 aa, Staphylococcus epidermidis
VQVAQEKIFGLNDLNSIVINVIQKP

SEQ ID NO: 1753957 - protein, 27 aa, Staphylococcus epidermidis
VRIVLPLIIIIILFTVLYSVAPNVKTK

SEQ ID NO: 1753958 - protein, 23 aa, Staphylococcus epidermidis
VRLTMIGLWLNIIGSLLIIITDF

SEQ ID NO: 1753959 - protein, 20 aa, Staphylococcus epidermidis
VRNIRQEATTLDTAMLGLRK

SEQ ID NO: 1753960 - protein, 22 aa, Staphylococcus epidermidis
VRTILLILAWVNQILAMNHISP

SEQ ID NO: 1753961 - protein, 30 aa, Staphylococcus epidermidis
VRVTITDHDDFSIDNGYFDDDSDSDSDADS

SEQ ID NO: 1753962 - protein, 25 aa, Staphylococcus epidermidis
VSAALKESISLIDSIEIQAHKKLEA

SEQ ID NO: 1753963 - protein, 23 aa, Staphylococcus epidermidis
VSAFIFSYLFSETVIVGLFVNCS

SEQ ID NO: 1753964 - protein, 17 aa, Staphylococcus epidermidis
VSAVLAAPLLMTMFVHL

SEQ ID NO: 1753965 - protein, 60 aa, Staphylococcus epidermidis
VSAVLAAPLLMTMFVHLFGIQIPHIFMNPWFQFVLATPVQFVIGWQFYVGAYKNLRNGSA

SEQ ID NO: 1753966 - protein, 22 aa, Staphylococcus epidermidis
VSCIFGYLLFGLGLGLFATPST

SEQ ID NO: 1753967 - protein, 25 aa, Staphylococcus epidermidis
VSCLILLISVFIRTPNEFRLMILGG

SEQ ID NO: 1753968 - protein, 26 aa, Staphylococcus epidermidis
VSDGITKFIYRKISTAQSPIVENNQQ

SEQ ID NO: 1753969 - protein, 25 aa, Staphylococcus epidermidis
VSLAVLWVLLFVMAYPLFTLWRNDK

SEQ ID NO: 1753970 - protein, 24 aa, Staphylococcus epidermidis
VSLFALFMILFSGIAFFYGLDYDR

SEQ ID NO: 1753971 - protein, 25 aa, Staphylococcus epidermidis
VSLILTCIIFLGFLYQLYSKRINII

SEQ ID NO: 1753972 - protein, 24 aa, Staphylococcus epidermidis
VSLIMIIFLFFINRSKNISYDYIK

SEQ ID NO: 1753973 - protein, 18 aa, Staphylococcus epidermidis
VSLLFPILSDALSTEWVF

SEQ ID NO: 1753974 - protein, 26 aa, Staphylococcus epidermidis
VSMSPIFIVMIIYTVVYFIFAMISFI

SEQ ID NO: 1753975 - protein, 27 aa, Staphylococcus epidermidis
VSNNSNQQFPPRNAQRRKRRRETATNQ

SEQ ID NO: 1753976 - protein, 24 aa, Staphylococcus epidermidis
VSRIWTLIMFLIGFVAVVGLRLAL

SEQ ID NO: 1753977 - protein, 25 aa, Staphylococcus epidermidis
VSSNFFKKQYWLFGVKKMDRHDINE

SEQ ID NO: 1753978 - protein, 22 aa, Staphylococcus epidermidis
VSVMTMLFLSPLHALVITLSML

SEQ ID NO: 1753979 - protein, 25 aa, Staphylococcus epidermidis
VSVSQYFHRILPKIPYKVYVIIFTL

SEQ ID NO: 1753980 - protein, 27 aa, Staphylococcus epidermidis
VTCLWFLFCVFIFQYIKLLFSRPRFKA

SEQ ID NO: 1753981 - protein, 26 aa, Staphylococcus epidermidis
VTEFVMLFPFLIFAIVLNAALGDKIK

SEQ ID NO: 1753982 - protein, 17 aa, Staphylococcus epidermidis
VTGINEIAKVLPATSVK

SEQ ID NO: 1753983 - protein, 20 aa, Staphylococcus epidermidis
VTGVCFLLALFFSPLIEVVT

SEQ ID NO: 1753984 - protein, 24 aa, Staphylococcus epidermidis
VTIILALPLILILAGAFDKLGKDK

SEQ ID NO: 1753985 - protein, 25 aa, Staphylococcus epidermidis
VTIVLVLCIFAIYKWIKAEKRVNEL

SEQ ID NO: 1753986 - protein, 22 aa, Staphylococcus epidermidis
VTLGIGIFATLLTSLILGIKRH

SEQ ID NO: 1753987 - protein, 23 aa, Staphylococcus epidermidis
VTLGIGIFATLLTSLILGIKRHK

SEQ ID NO: 1753988 - protein, 21 aa, Staphylococcus epidermidis
VTLILFIFVANMLGLPFAIVT

SEQ ID NO: 1753989 - protein, 23 aa, Staphylococcus epidermidis
VTLILFIFVANMLGLPFAIVTHD

SEQ ID NO: 1753990 - protein, 24 aa, Staphylococcus epidermidis
VTLLTLLFTVLIGVPLGLLSGYQK

SEQ ID NO: 1753991 - protein, 18 aa, Staphylococcus epidermidis
VTLPVLFITLLGLYFTLI

SEQ ID NO: 1753992 - protein, 21 aa, Staphylococcus epidermidis
VTMIIFYKYLSDSILYSLLVI

SEQ ID NO: 1753993 - protein, 25 aa, Staphylococcus epidermidis
VTMNLIAMILWIIVAVLLFSKKDSR

SEQ ID NO: 1753994 - protein, 23 aa, Staphylococcus epidermidis
VTMVAIIWILLGDPLVHFIHFPL

SEQ ID NO: 1753995 - protein, 24 aa, Staphylococcus epidermidis
VTNKVEGLPAGITFDEATNTISGT

SEQ ID NO: 1753996 - protein, 31 aa, Staphylococcus epidermidis
VTQQLAIDDLKRPWLPPLPEAVYQEDLIETD

SEQ ID NO: 1753997 - protein, 18 aa, Staphylococcus epidermidis
VTSHSRMYTFSKRKAINN

SEQ ID NO: 1753998 - protein, 23 aa, Staphylococcus epidermidis
VTSKDLLEKIQLTGTTKYPENVN

SEQ ID NO: 1753999 - protein, 32 aa, Staphylococcus epidermidis
VTTSHQVFLNWFSHNPAFDYFKNMDSTTVATV

SEQ ID NO: 1754000 - protein, 25 aa, Staphylococcus epidermidis
VTTYITILVFQMITMFLKEYLMNYQ

SEQ ID NO: 1754001 - protein, 30 aa, Staphylococcus epidermidis
VTYFIVIIFQFYLLHWLFSKYLIGLNPIKM

SEQ ID NO: 1754002 - protein, 19 aa, Staphylococcus epidermidis
VVAIAVAIALIALITKFVG

SEQ ID NO: 1754003 - protein, 25 aa, Staphylococcus epidermidis
VVFIAIYSLMYWITSRIYYMIVNSR

SEQ ID NO: 1754004 - protein, 24 aa, Staphylococcus epidermidis
VVFIIFYSMMYWITSRIYYTMING

SEQ ID NO: 1754005 - protein, 19 aa, Staphylococcus epidermidis
VVFIIVLIMFINYLGDIII

SEQ ID NO: 1754006 - protein, 18 aa, Staphylococcus epidermidis
VVFIYSPVAHWVWGGGWI

SEQ ID NO: 1754007 - protein, 24 aa, Staphylococcus epidermidis
VVFSMIAIVTLILVIALNNRETKQ

SEQ ID NO: 1754008 - protein, 18 aa, Staphylococcus epidermidis
VVGIAIVTFIVWIVFVHT

SEQ ID NO: 1754009 - protein, 25 aa, Staphylococcus epidermidis
VVIGFVFFNIPIQILLLISSAYAAL

SEQ ID NO: 1754010 - protein, 44 aa, Staphylococcus epidermidis
VVILMLMLLMISLFMHQPLSILFYLKTLIIVLFYEAGIALLLFK

SEQ ID NO: 1754011 - protein, 20 aa, Staphylococcus epidermidis
VVLGLIAMILLVVGISLTSL

SEQ ID NO: 1754012 - protein, 19 aa, Staphylococcus epidermidis
VVLGVLAPLITFYEPNHID

SEQ ID NO: 1754013 - protein, 21 aa, Staphylococcus epidermidis
VVLIAWILYYFVNIKLTNYNT

SEQ ID NO: 1754014 - protein, 22 aa, Staphylococcus epidermidis
VVLILLTLFLQFDRLIAVLGGV

SEQ ID NO: 1754015 - protein, 40 aa, Staphylococcus epidermidis
VVLSDNFIFLYLFWELTSFSSFLLISFWREKKASIYGAQK

SEQ ID NO: 1754016 - protein, 19 aa, Staphylococcus epidermidis
VVLSLYLLGILVALIVSTI

SEQ ID NO: 1754017 - protein, 25 aa, Staphylococcus epidermidis
VVLVSCMVFLTFFLSVNQSAHSEQT

SEQ ID NO: 1754018 - protein, 18 aa, Staphylococcus epidermidis
VVPILYIFLSIIVALIGG

SEQ ID NO: 1754019 - protein, 26 aa, Staphylococcus epidermidis
VVPWPTLFFGMFFNNLFFWCANQMIV

SEQ ID NO: 1754020 - protein, 32 aa, Staphylococcus epidermidis
VVQLTRFEKILYIALITVIALISIYMLSLKMD

SEQ ID NO: 1754021 - protein, 38 aa, Staphylococcus epidermidis
VVQLTRFEKILYIALITVIALISIYMLSLKMDAYDTRG

SEQ ID NO: 1754022 - protein, 33 aa, Staphylococcus epidermidis
VVRKRIAVFGGILLAAILILIVLLVIQKHSNDQ

SEQ ID NO: 1754023 - protein, 20 aa, Staphylococcus epidermidis
VVTIFNAIKSFSIKVWTALK

SEQ ID NO: 1754024 - protein, 18 aa, Staphylococcus epidermidis
VVTVFLYSLLPIIKNTYT

SEQ ID NO: 1754025 - protein, 24 aa, Staphylococcus epidermidis
VVTYYLIKWLFYLTMKYLKWNISI

SEQ ID NO: 1754026 - protein, 22 aa, Staphylococcus epidermidis
VVVALACFIYMFLEGKLGSFEM

SEQ ID NO: 1754027 - protein, 32 aa, Staphylococcus epidermidis
VVVDLLGTFVWLVVPLLLLEVDLDVLFFAVDV

SEQ ID NO: 1754028 - protein, 27 aa, Staphylococcus epidermidis
VVVIGFIFFNIPIQVLLLISSAYASFI

SEQ ID NO: 1754029 - protein, 17 aa, Staphylococcus epidermidis
VVVVILFNTLKTNRSHS

SEQ ID NO: 1754030 - protein, 26 aa, Staphylococcus epidermidis
VVVYPAFIFLVISFAMLMFSFNGWML

SEQ ID NO: 1754031 - protein, 32 aa, Staphylococcus epidermidis
VVVYPAFIFLVLSFLLLMLSFNGWVLLIAGIA

SEQ ID NO: 1754032 - protein, 43 aa, Staphylococcus epidermidis
VWEIIKKNWKLLVIIPLIFLILSAIFTFFLAKPKYEASTQILV

SEQ ID NO: 1754033 - protein, 26 aa, Staphylococcus epidermidis
VWGVILPVIFISIVGWFYFSGSSFAT

SEQ ID NO: 1754034 - protein, 23 aa, Staphylococcus epidermidis
VWLVTVFAWDLSFLIDGVIGIVG

SEQ ID NO: 1754035 - protein, 17 aa, Staphylococcus epidermidis
VWLYHFLERVLIPTGLH

SEQ ID NO: 1754036 - protein, 26 aa, Staphylococcus epidermidis
VWTIILFFFIIFIVNFIILISSKSRW

SEQ ID NO: 1754037 - protein, 22 aa, Staphylococcus epidermidis
VYAIFLFPLFIKEKKYYEVELM

SEQ ID NO: 1754038 - protein, 33 aa, Staphylococcus epidermidis
VYAYEPLLSMFFFYSAFALPFIFDVGLKSKEFI

SEQ ID NO: 1754039 - protein, 27 aa, Staphylococcus epidermidis
VYGFKIISIRYFLLTVFIVCSIVGVTV

SEQ ID NO: 1754040 - protein, 19 aa, Staphylococcus epidermidis
VYIQPFLVALLFGIGTDYC

SEQ ID NO: 1754041 - protein, 27 aa, Staphylococcus epidermidis
VYLAEDSILYRKVAIKAISIPPSEKEE

SEQ ID NO: 1754042 - protein, 28 aa, Staphylococcus epidermidis
VYNINLIVWIPLIVIVICLLLRVSTVPS

SEQ ID NO: 1754043 - protein, 19 aa, Staphylococcus epidermidis
VYSIKFIMHIFFGKYKPDS

SEQ ID NO: 1754044 - protein, 19 aa, Staphylococcus epidermidis
VYSMPVLALILIAFFSKRT

SEQ ID NO: 1754045 - protein, 25 aa, Staphylococcus epidermidis
VYSNFLIFIITFCLFIVWELKTNHS

SEQ ID NO: 1754046 - protein, 24 aa, Staphylococcus epidermidis
VYTMILFTFFIVVSGCTINQSFGN

SEQ ID NO: 1754047 - protein, 26 aa, Staphylococcus epidermidis
WAGWLLFFGIVFFSGSLYFLALTQVR

SEQ ID NO: 1754048 - protein, 18 aa, Staphylococcus epidermidis
WALYLRLPLQFVLMGIVK

SEQ ID NO: 1754049 - protein, 17 aa, Staphylococcus epidermidis
WCRMMIRQILSNSLKYS

SEQ ID NO: 1754050 - protein, 17 aa, Staphylococcus epidermidis
WDVLGFIILITLRKHLK

SEQ ID NO: 1754051 - protein, 18 aa, Staphylococcus epidermidis
WEDTNKDGIQDDNEKGIS

SEQ ID NO: 1754052 - protein, 17 aa, Staphylococcus epidermidis
WENKLKLESFIRPNSRF

SEQ ID NO: 1754053 - protein, 25 aa, Staphylococcus epidermidis
WETWVYQGLAVLVVGCPCALVISTP

SEQ ID NO: 1754054 - protein, 23 aa, Staphylococcus epidermidis
WEVTNVFFVFFFVGFIGFFPDSA

SEQ ID NO: 1754055 - protein, 18 aa, Staphylococcus epidermidis
WFKFFIGVLLIGLLASII

SEQ ID NO: 1754056 - protein, 17 aa, Staphylococcus epidermidis
WFLGGLLGVIFLTGNLL

SEQ ID NO: 1754057 - protein, 17 aa, Staphylococcus epidermidis
WGATLLSLTLLIRVNRS

SEQ ID NO: 1754058 - protein, 31 aa, Staphylococcus epidermidis
WGDDWTFVIAFIPWMIVIVPYLLFKSNELNI

SEQ ID NO: 1754059 - protein, 24 aa, Staphylococcus epidermidis
WGPIAWAIYVLPALPIGYLVFIKK

SEQ ID NO: 1754060 - protein, 35 aa, Staphylococcus epidermidis
WGTMLVTIATFVVLLALLKKFAWGPLKEVMDKRER

SEQ ID NO: 1754061 - protein, 34 aa, Staphylococcus epidermidis
WGTTIVTLATFVILIILLKKFAWGPLKEVMDKRE

SEQ ID NO: 1754062 - protein, 26 aa, Staphylococcus epidermidis
WGVMTQGWWFPIMASAFLIFTIIIMF

SEQ ID NO: 1754063 - protein, 27 aa, Staphylococcus epidermidis
WGVMTQGWWFPVMASVFLIFTIIIMFI

SEQ ID NO: 1754064 - protein, 18 aa, Staphylococcus epidermidis
WIFLLIIISMKLAKIPFG

SEQ ID NO: 1754065 - protein, 18 aa, Staphylococcus epidermidis
WIKIANEYKLPTFVLGVG

SEQ ID NO: 1754066 - protein, 38 aa, Staphylococcus epidermidis
WITNNLGWYYLILTTVIVFFCIFLIFSPIGKLKLGKPN

SEQ ID NO: 1754067 - protein, 30 aa, Staphylococcus epidermidis
WLIISISIFIIMMIILNLLLPGTGLLLVGL

SEQ ID NO: 1754068 - protein, 19 aa, Staphylococcus epidermidis
WLLLLPGSYLLGIHWRLGY

SEQ ID NO: 1754069 - protein, 19 aa, Staphylococcus epidermidis
WLMVFAIFVINVCYVTFLT

SEQ ID NO: 1754070 - protein, 19 aa, Staphylococcus epidermidis
WLTIIIITVLLLVLALFIA

SEQ ID NO: 1754071 - protein, 17 aa, Staphylococcus epidermidis
WLTIVFVTILLILLALI

SEQ ID NO: 1754072 - protein, 18 aa, Staphylococcus epidermidis
WNAIKKSAVIIWNAIKFA

SEQ ID NO: 1754073 - protein, 25 aa, Staphylococcus epidermidis
WQMSRTLLWIYLIVLICVMFANQPG

SEQ ID NO: 1754074 - protein, 23 aa, Staphylococcus epidermidis
WQSIFWAVLILLVLIGWFTSVIK

SEQ ID NO: 1754075 - protein, 18 aa, Staphylococcus epidermidis
WRILAPLFIVAFVSGSSI

SEQ ID NO: 1754076 - protein, 19 aa, Staphylococcus epidermidis
WSFILAWLSLLIAVILLYI

SEQ ID NO: 1754077 - protein, 18 aa, Staphylococcus epidermidis
WSGSFFGFVKSILSFTRM

SEQ ID NO: 1754078 - protein, 17 aa, Staphylococcus epidermidis
WSIIIRTLHLAGMTLWL

SEQ ID NO: 1754079 - protein, 20 aa, Staphylococcus epidermidis
WSIIMSIALYFIMIKFMPPE

SEQ ID NO: 1754080 - protein, 24 aa, Staphylococcus epidermidis
WSPKALTYLMAFSAGFLLSIGILD

SEQ ID NO: 1754081 - protein, 23 aa, Staphylococcus epidermidis
WSSPSFKGLFLPKGKLSSLVFNF

SEQ ID NO: 1754082 - protein, 17 aa, Staphylococcus epidermidis
WSVTLYTLLLTGTIIIF

SEQ ID NO: 1754083 - protein, 19 aa, Staphylococcus epidermidis
WTHFIISLPVIIGGSFSAF

SEQ ID NO: 1754084 - protein, 32 aa, Staphylococcus epidermidis
WTTPEKAIMGGAWFVRFHYFKNNQLNLYQMRW

SEQ ID NO: 1754085 - protein, 18 aa, Staphylococcus epidermidis
WVASILIIYVSVKLNLLP

SEQ ID NO: 1754086 - protein, 18 aa, Staphylococcus epidermidis
WVFFSSFIILLFPIFFLG

SEQ ID NO: 1754087 - protein, 17 aa, Staphylococcus epidermidis
WVFLLVSLFGQFFLENL

SEQ ID NO: 1754088 - protein, 26 aa, Staphylococcus epidermidis
WVGWRFTFLFIMLVSVVVGLLMMMYL

SEQ ID NO: 1754089 - protein, 20 aa, Staphylococcus epidermidis
WVITLPISAILAAIIYFVIH

SEQ ID NO: 1754090 - protein, 17 aa, Staphylococcus epidermidis
WVKLLESFIILPIVLPP

SEQ ID NO: 1754091 - protein, 18 aa, Staphylococcus epidermidis
WVTINGQDDMTIDSGFYQ

SEQ ID NO: 1754092 - protein, 17 aa, Staphylococcus epidermidis
WVVLGRLLAIVIAVAFW

SEQ ID NO: 1754093 - protein, 20 aa, Staphylococcus epidermidis
YAAGYFKPFWPLAIINVFEE

SEQ ID NO: 1754094 - protein, 17 aa, Staphylococcus epidermidis
YAAPVAGALGYTVEDTS

SEQ ID NO: 1754095 - protein, 19 aa, Staphylococcus epidermidis
YAHIPGYDKYKINAAYSLG

SEQ ID NO: 1754096 - protein, 25 aa, Staphylococcus epidermidis
YAIRSILWEHIIQLKMPFFDKNESG

SEQ ID NO: 1754097 - protein, 25 aa, Staphylococcus epidermidis
YALQLMRDRLPLSELYEGVGILETP

SEQ ID NO: 1754098 - protein, 24 aa, Staphylococcus epidermidis
YAQPSFWFGVFRYLTEGATIILVG

SEQ ID NO: 1754099 - protein, 24 aa, Staphylococcus epidermidis
YATLWNLIFVIPGLIGLFIGFMFA

SEQ ID NO: 1754100 - protein, 19 aa, Staphylococcus epidermidis
YAYSFYLFFDFAGYSLFAI

SEQ ID NO: 1754101 - protein, 18 aa, Staphylococcus epidermidis
YCIVIFPITIILYTRIAR

SEQ ID NO: 1754102 - protein, 24 aa, Staphylococcus epidermidis
YCTPIWFILLGLMYLRYKKADKEA

SEQ ID NO: 1754103 - protein, 24 aa, Staphylococcus epidermidis
YCTPIWFILLGLMYLRYKKANKEA

SEQ ID NO: 1754104 - protein, 18 aa, Staphylococcus epidermidis
YDHEYTTHIELESVIPTI

SEQ ID NO: 1754105 - protein, 17 aa, Staphylococcus epidermidis
YDVLIKQANRLSTLFDD

SEQ ID NO: 1754106 - protein, 17 aa, Staphylococcus epidermidis
YEAGIALLLFKINVLSH

SEQ ID NO: 1754107 - protein, 25 aa, Staphylococcus epidermidis
YFCINLILPIFFLSSIFIMLSIYLP

SEQ ID NO: 1754108 - protein, 26 aa, Staphylococcus epidermidis
YFETSAILITLILFGKYLEARAKSQT

SEQ ID NO: 1754109 - protein, 25 aa, Staphylococcus epidermidis
YFFENAIKFWSTSGSLILILLGDNS

SEQ ID NO: 1754110 - protein, 27 aa, Staphylococcus epidermidis
YFGGQLTLFFWFFKLHYSFGHIINSKI

SEQ ID NO: 1754111 - protein, 17 aa, Staphylococcus epidermidis
YFGSGDFMKEGFYMNNS

SEQ ID NO: 1754112 - protein, 21 aa, Staphylococcus epidermidis
YFHMIWHIFIVIASLLHMVGI

SEQ ID NO: 1754113 - protein, 28 aa, Staphylococcus epidermidis
YFIFDFSLWIFLLFLLVPDISMVGYAVN

SEQ ID NO: 1754114 - protein, 17 aa, Staphylococcus epidermidis
YFILSFVLMVTVPNTIY

SEQ ID NO: 1754115 - protein, 36 aa, Staphylococcus epidermidis
YFKAHRSLFWAFLIVFLLIFIILQIRIFTISEDNIY

SEQ ID NO: 1754116 - protein, 19 aa, Staphylococcus epidermidis
YFNIILFCLCMINLFFTAH

SEQ ID NO: 1754117 - protein, 17 aa, Staphylococcus epidermidis
YFVPVLIALVLSTFEFG

SEQ ID NO: 1754118 - protein, 18 aa, Staphylococcus epidermidis
YFVSKRLTKPLFFYTDWI

SEQ ID NO: 1754119 - protein, 25 aa, Staphylococcus epidermidis
YFVVQFVIALFLIWLPTYLAEQYHV

SEQ ID NO: 1754120 - protein, 22 aa, Staphylococcus epidermidis
YFYLMLFLLTTFIGAFLLYLPY

SEQ ID NO: 1754121 - protein, 17 aa, Staphylococcus epidermidis
YGRTLAYVWLKNGDMFN

SEQ ID NO: 1754122 - protein, 27 aa, Staphylococcus epidermidis
YGVIIYIIILFLFIRIFGEAFFHQIFG

SEQ ID NO: 1754123 - protein, 21 aa, Staphylococcus epidermidis
YGVWFMAAVVCYLIIPKPGIA

SEQ ID NO: 1754124 - protein, 20 aa, Staphylococcus epidermidis
YGYFIIIIMQFFVLSYIIYK

SEQ ID NO: 1754125 - protein, 18 aa, Staphylococcus epidermidis
YHFDSKQFILDKAKKDNK

SEQ ID NO: 1754126 - protein, 40 aa, Staphylococcus epidermidis
YHFNQFQWIGFLSNLLFVPFYSFLLFPSIILFFITSHLIS

SEQ ID NO: 1754127 - protein, 40 aa, Staphylococcus epidermidis
YHFNQFQWIGLLSNFIFVPFYSFILFPSVIIYFILIHIFQ

SEQ ID NO: 1754128 - protein, 23 aa, Staphylococcus epidermidis
YHFQIHSLWYLGMIPWIGACFTA

SEQ ID NO: 1754129 - protein, 28 aa, Staphylococcus epidermidis
YHFVLAMFPMLIFLLTLLGQFITINTDQ

SEQ ID NO: 1754130 - protein, 22 aa, Staphylococcus epidermidis
YHLFKVSLISFMILFIGLELVD

SEQ ID NO: 1754131 - protein, 36 aa, Staphylococcus epidermidis
YHWNVMFYGMFFIGIIAIVIGLFWFKLYQNTTNPKA

SEQ ID NO: 1754132 - protein, 24 aa, Staphylococcus epidermidis
YIAPVYIILWFVFRGKERLKIFDV

SEQ ID NO: 1754133 - protein, 25 aa, Staphylococcus epidermidis
YIFNPTFVVLLSAFYLVILIVAIGN

SEQ ID NO: 1754134 - protein, 22 aa, Staphylococcus epidermidis
YIIFIGKFLIYICYFFIMCLIS

SEQ ID NO: 1754135 - protein, 32 aa, Staphylococcus epidermidis
YIIGILLLISFSYWIRLLQAHPYQLTLNHWYD

SEQ ID NO: 1754136 - protein, 19 aa, Staphylococcus epidermidis
YIIIALLALILMFINVKSS

SEQ ID NO: 1754137 - protein, 34 aa, Staphylococcus epidermidis
YIIPISILIALIVVPILIFTIGKHIYFSYQKHEE

SEQ ID NO: 1754138 - protein, 19 aa, Staphylococcus epidermidis
YIISLVLILLFQVSLLNEN

SEQ ID NO: 1754139 - protein, 20 aa, Staphylococcus epidermidis
YILFLATFLERFSYFLIIPF

SEQ ID NO: 1754140 - protein, 17 aa, Staphylococcus epidermidis
YILIGIMLYFLMSSIGE

SEQ ID NO: 1754141 - protein, 17 aa, Staphylococcus epidermidis
YILIGVMLYFLMSSIGE

SEQ ID NO: 1754142 - protein, 24 aa, Staphylococcus epidermidis
YILTSLYYVFLIIKILGACYLIYL

SEQ ID NO: 1754143 - protein, 27 aa, Staphylococcus epidermidis
YINKNYILMIPLTFIFGATLLLISDVL

SEQ ID NO: 1754144 - protein, 17 aa, Staphylococcus epidermidis
YIPSKFTHEITGTLRKH

SEQ ID NO: 1754145 - protein, 18 aa, Staphylococcus epidermidis
YIPWFKTNKEITIKDLML

SEQ ID NO: 1754146 - protein, 24 aa, Staphylococcus epidermidis
YIQYYLYLLIILGILYLIVPHPFI

SEQ ID NO: 1754147 - protein, 17 aa, Staphylococcus epidermidis
YIRKLTNEDLENAGLSW

SEQ ID NO: 1754148 - protein, 24 aa, Staphylococcus epidermidis
YITRVLYRLTFVGSIFLAAIAILP

SEQ ID NO: 1754149 - protein, 25 aa, Staphylococcus epidermidis
YIVCVYGIFAFLIPATIILFNNFGN

SEQ ID NO: 1754150 - protein, 25 aa, Staphylococcus epidermidis
YIVIALILIGLINVLFSKSRKKAKD

SEQ ID NO: 1754151 - protein, 28 aa, Staphylococcus epidermidis
YIVLSFFLFIFILLFFSKDTRVAIFISP

SEQ ID NO: 1754152 - protein, 17 aa, Staphylococcus epidermidis
YKEVHPIMYFLMALFIL

SEQ ID NO: 1754153 - protein, 40 aa, Staphylococcus epidermidis
YKGQKHTGWLIVLSIIFVLLIAALLYGAYYAYNHYISDEQ

SEQ ID NO: 1754154 - protein, 41 aa, Staphylococcus epidermidis
YKKVKHICVMIFLVFFLIGFIILLSLVFYFQQLTKDASSIS

SEQ ID NO: 1754155 - protein, 26 aa, Staphylococcus epidermidis
YKNVALVFWIISLISLLLMVVISQPH

SEQ ID NO: 1754156 - protein, 39 aa, Staphylococcus epidermidis
YKQEWFIVLSLLFIFPLGLFLMWKFSKWPSIARTIITVA

SEQ ID NO: 1754157 - protein, 38 aa, Staphylococcus epidermidis
YKWMMITTLITFTTILLFCLIIIFFLKDTLRNSELDEA

SEQ ID NO: 1754158 - protein, 19 aa, Staphylococcus epidermidis
YLAYFPLIVIFIIMYPFLI

SEQ ID NO: 1754159 - protein, 18 aa, Staphylococcus epidermidis
YLCMIFIGGIIHNKLWYS

SEQ ID NO: 1754160 - protein, 30 aa, Staphylococcus epidermidis
YLDISTPYALLFFDLIVVLISLTEIPLAKC

SEQ ID NO: 1754161 - protein, 30 aa, Staphylococcus epidermidis
YLDISTPYALLFFDLLVVLISLTQISLDKA

SEQ ID NO: 1754162 - protein, 25 aa, Staphylococcus epidermidis
YLDNWWIVFFIFITQLILSASYEYT

SEQ ID NO: 1754163 - protein, 25 aa, Staphylococcus epidermidis
YLFGELFFMLFNKLVNTHQPQLSDY

SEQ ID NO: 1754164 - protein, 28 aa, Staphylococcus epidermidis
YLFSRFKYIFIPYLLIGLFYSYSESLIT

SEQ ID NO: 1754165 - protein, 21 aa, Staphylococcus epidermidis
YLGLRIFLIVQIIIIIISVIQ

SEQ ID NO: 1754166 - protein, 25 aa, Staphylococcus epidermidis
YLGLVNFCRLVPILLLSVWAGSIAD

SEQ ID NO: 1754167 - protein, 22 aa, Staphylococcus epidermidis
YLGYILVALFLVTWLISTLIWK

SEQ ID NO: 1754168 - protein, 21 aa, Staphylococcus epidermidis
YLIIALFIVLVAFFSINEFTK

SEQ ID NO: 1754169 - protein, 20 aa, Staphylococcus epidermidis
YLIIALPLFIYSCIYIIITE

SEQ ID NO: 1754170 - protein, 17 aa, Staphylococcus epidermidis
YLIPNIIIPILIGNKMF

SEQ ID NO: 1754171 - protein, 31 aa, Staphylococcus epidermidis
YLNFLITLIVMVLFSLLLFQVIFKLGHFSVY

SEQ ID NO: 1754172 - protein, 25 aa, Staphylococcus epidermidis
YLSLIIILFIWILNIVFYFNDFYFE

SEQ ID NO: 1754173 - protein, 26 aa, Staphylococcus epidermidis
YLTIYLLVALMYWVVCFVISIIQGWY

SEQ ID NO: 1754174 - protein, 17 aa, Staphylococcus epidermidis
YLVPYSQLKLYLTYISV

SEQ ID NO: 1754175 - protein, 18 aa, Staphylococcus epidermidis
YLWVLVVLVFLEGLLAAD

SEQ ID NO: 1754176 - protein, 18 aa, Staphylococcus epidermidis
YLYTFPLTVIIGLVIIFL

SEQ ID NO: 1754177 - protein, 28 aa, Staphylococcus epidermidis
YLYTFSVLFFVDLAIVLIFNKIKPSSEY

SEQ ID NO: 1754178 - protein, 25 aa, Staphylococcus epidermidis
YMGIPVFLIFFLYHKLRYKTNMIPL

SEQ ID NO: 1754179 - protein, 23 aa, Staphylococcus epidermidis
YMNYWFPNLPNWIPGIVAVALLM

SEQ ID NO: 1754180 - protein, 29 aa, Staphylococcus epidermidis
YMNYWFPSFPNWLPGVIAVLFLMAANLVS

SEQ ID NO: 1754181 - protein, 21 aa, Staphylococcus epidermidis
YNFWMMGYYYPLFINSEKFFE

SEQ ID NO: 1754182 - protein, 43 aa, Staphylococcus epidermidis
YNGDTKVMTVTYAGQTFTRNLTDWIKNSGGTTFSLSMTASTGG

SEQ ID NO: 1754183 - protein, 25 aa, Staphylococcus epidermidis
YNVHDLLLNLFYKLSHYKWYIPDLS

SEQ ID NO: 1754184 - protein, 32 aa, Staphylococcus epidermidis
YNVKSTHFFSLILIFTILLSTLGQSLNLNQAQ

SEQ ID NO: 1754185 - protein, 20 aa, Staphylococcus epidermidis
YNWDHLDFVGLDDTDYKRDG

SEQ ID NO: 1754186 - protein, 19 aa, Staphylococcus epidermidis
YPYFLNSNGFYEVIPPKSN

SEQ ID NO: 1754187 - protein, 24 aa, Staphylococcus epidermidis
YQGFTKIIIVLIISPIIAFCVGYM

SEQ ID NO: 1754188 - protein, 47 aa, Staphylococcus epidermidis
YQKSWFIILTLLFIFPLGLFLMWRYAHWKIWLKLVVSSVYTIGLVLT

SEQ ID NO: 1754189 - protein, 46 aa, Staphylococcus epidermidis
YQKSWFIILTLLFIFPLGLFLMWRYAHWKNWLKLIVSSVYIISLVL

SEQ ID NO: 1754190 - protein, 23 aa, Staphylococcus epidermidis
YQQEIRIKLTSNEPIKDSEWSVT

SEQ ID NO: 1754191 - protein, 18 aa, Staphylococcus epidermidis
YQSLVVLSLYLLGILVAL

SEQ ID NO: 1754192 - protein, 30 aa, Staphylococcus epidermidis
YRAISVSKMIWIFIFCFIGNILGGFILFFL

SEQ ID NO: 1754193 - protein, 17 aa, Staphylococcus epidermidis
YRFRKIIAPLFASGYSM

SEQ ID NO: 1754194 - protein, 19 aa, Staphylococcus epidermidis
YRISFKTQGAPTARLYYAA

SEQ ID NO: 1754195 - protein, 21 aa, Staphylococcus epidermidis
YRIVLVVIIAILYFGFGIGKG

SEQ ID NO: 1754196 - protein, 17 aa, Staphylococcus epidermidis
YRTIISKLDPLPSISFS

SEQ ID NO: 1754197 - protein, 20 aa, Staphylococcus epidermidis
YSAPNPLGGTLMLQGLKIDE

SEQ ID NO: 1754198 - protein, 21 aa, Staphylococcus epidermidis
YSIPYFFGTVGILYDKEKYPN

SEQ ID NO: 1754199 - protein, 27 aa, Staphylococcus epidermidis
YSLAIPLLIIVLIQVVFMVLFSIFVLF

SEQ ID NO: 1754200 - protein, 50 aa, Staphylococcus epidermidis
YSLIALVLSVFLFFKGKKAFWFIFIGGFLLTFLLYANVVYFRFFSDFLTF

SEQ ID NO: 1754201 - protein, 20 aa, Staphylococcus epidermidis
YSLLVIHYLGIFYFVYSVNP

SEQ ID NO: 1754202 - protein, 26 aa, Staphylococcus epidermidis
YSLTIYMMIIFPIIGLVCALLAKKPV

SEQ ID NO: 1754203 - protein, 17 aa, Staphylococcus epidermidis
YSLYAFYMNNFSSATGH

SEQ ID NO: 1754204 - protein, 31 aa, Staphylococcus epidermidis
YSTSVLMFIYPLAITLILLTLVSPLFNHSTI

SEQ ID NO: 1754205 - protein, 18 aa, Staphylococcus epidermidis
YSYFLNYGLLVISSIFLV

SEQ ID NO: 1754206 - protein, 17 aa, Staphylococcus epidermidis
YSYFLNYGLLVVSSIFL

SEQ ID NO: 1754207 - protein, 23 aa, Staphylococcus epidermidis
YSYRKLFIIGLALFTLGSLVCAI

SEQ ID NO: 1754208 - protein, 17 aa, Staphylococcus epidermidis
YTDLLSEILFFINIVLA

SEQ ID NO: 1754209 - protein, 30 aa, Staphylococcus epidermidis
YTFVAIPVFIYGFIFIALSERSVKWMFVAL

SEQ ID NO: 1754210 - protein, 23 aa, Staphylococcus epidermidis
YTGLFILIGLFAVNWKVAISAII

SEQ ID NO: 1754211 - protein, 24 aa, Staphylococcus epidermidis
YTILIAAIILLGVLIFYSFLIYRR

SEQ ID NO: 1754212 - protein, 18 aa, Staphylococcus epidermidis
YVALFLGMILLAIVAYYE

SEQ ID NO: 1754213 - protein, 29 aa, Staphylococcus epidermidis
YVEPQPFDLNIPFTKSLTGRNLKDGEFHF

SEQ ID NO: 1754214 - protein, 18 aa, Staphylococcus epidermidis
YVFIALFVSVVIGAILGL

SEQ ID NO: 1754215 - protein, 19 aa, Staphylococcus epidermidis
YVIGIFFLIRYIKKWTRSY

SEQ ID NO: 1754216 - protein, 20 aa, Staphylococcus epidermidis
YVIIAILALILMFIKVKPTT

SEQ ID NO: 1754217 - protein, 18 aa, Staphylococcus epidermidis
YVILLGLAFILSFSTLKL

SEQ ID NO: 1754218 - protein, 17 aa, Staphylococcus epidermidis
YVLLVTFISMVFLRPMV

SEQ ID NO: 1754219 - protein, 25 aa, Staphylococcus epidermidis
YVSKNYLVMIPLTFIFGADLLLISD

SEQ ID NO: 1754220 - protein, 19 aa, Staphylococcus epidermidis
YVTLLVLCLLLIDLITRSW

SEQ ID NO: 1754221 - protein, 19 aa, Staphylococcus epidermidis
YVTMVILLFFLFSSYIKYV

SEQ ID NO: 1754222 - protein, 25 aa, Staphylococcus epidermidis
YVVGILLILTFSYWVRLLEAQPNQL

SEQ ID NO: 1754223 - protein, 19 aa, Staphylococcus epidermidis
YVVMLLYTGWLGTHTKSLN

SEQ ID NO: 1754224 - protein, 23 aa, Staphylococcus epidermidis
YVVSFLPVVLYSGSLVFNKMFNV

SEQ ID NO: 1754225 - protein, 18 aa, Staphylococcus epidermidis
YVYFSWLLGLLVGMVIMN

SEQ ID NO: 1754226 - protein, 17 aa, Staphylococcus epidermidis
YVYFSWLLGLLVGMVVM

SEQ ID NO: 1754227 - protein, 17 aa, Staphylococcus epidermidis
YWKLIKENKRKVKRDYE

SEQ ID NO: 1754228 - protein, 19 aa, Staphylococcus epidermidis
YYCINLILPIIVLSGIFIL

SEQ ID NO: 1754229 - protein, 21 aa, Staphylococcus epidermidis
YYGLKFLNPSYLLVSAFIISA

SEQ ID NO: 1754230 - protein, 23 aa, Staphylococcus epidermidis
AAIAFLILCIGIVVVLISVKKNL

SEQ ID NO: 1754231 - protein, 17 aa, Staphylococcus epidermidis
GIIAAIAFLILCIGIVV

SEQ ID NO: 1754232 - protein, 24 aa, Staphylococcus epidermidis
GVWAIIVYFIVCLLISFLALISMN

SEQ ID NO: 1754233 - protein, 32 aa, Staphylococcus epidermidis
IAVIIVVALLILFSFVPVGLWISALAAGVHVG

SEQ ID NO: 1754234 - protein, 19 aa, Staphylococcus epidermidis
LFLCTLLVWLMTPGLSLFY

SEQ ID NO: 1754235 - protein, 18 aa, Staphylococcus epidermidis
LLLISTITIISFIGLGAI

SEQ ID NO: 1754236 - protein, 18 aa, Staphylococcus epidermidis
LVTIVVFLPLVFVSGSVG

SEQ ID NO: 1754237 - protein, 28 aa, Staphylococcus epidermidis
VALAVYLFRFVWVYVLYPYFYLSVSPFQ

SEQ ID NO: 1754238 - protein, 17 aa, Staphylococcus epidermidis
YFVILMVIPMWAQHKVK

SEQ ID NO: 1754239 - protein, 21 aa, Staphylococcus epidermidis
AEKLIDSLKFINKAQFTHAND

SEQ ID NO: 1754240 - protein, 20 aa, Staphylococcus epidermidis
AIIYNLWWFVYNIVQVAGIH

SEQ ID NO: 1754241 - protein, 23 aa, Staphylococcus epidermidis
AIVGSAVGLYYKNKIYKKTDELK

SEQ ID NO: 1754242 - protein, 28 aa, Staphylococcus epidermidis
ANSIWAWLLVLVFLPLVGFILYLLLGRQ

SEQ ID NO: 1754243 - protein, 25 aa, Staphylococcus epidermidis
DTDQQPLVFELPELSLQNALVTSEV

SEQ ID NO: 1754244 - protein, 25 aa, Staphylococcus epidermidis
EEQFYLFFPFILLGLLKFFKKRTTM

SEQ ID NO: 1754245 - protein, 26 aa, Staphylococcus epidermidis
EISIILIILLFFALIFYVFSLPFDAY

SEQ ID NO: 1754246 - protein, 17 aa, Staphylococcus epidermidis
ETIWFVVPILIVIALAI

SEQ ID NO: 1754247 - protein, 17 aa, Staphylococcus epidermidis
FISLFLVIWFPASPFII

SEQ ID NO: 1754248 - protein, 23 aa, Staphylococcus epidermidis
FISPLWFIFLFFYYKKYKNNAES

SEQ ID NO: 1754249 - protein, 17 aa, Staphylococcus epidermidis
FLFKRLSWPYGLIIAAV

SEQ ID NO: 1754250 - protein, 25 aa, Staphylococcus epidermidis
FSISILYIIYLLINILINGINIPGY

SEQ ID NO: 1754251 - protein, 22 aa, Staphylococcus epidermidis
GSSLKPFLAYGPAIENMKWSTN

SEQ ID NO: 1754252 - protein, 25 aa, Staphylococcus epidermidis
GTIVAIIVILLFLRNIRTTAISIVS

SEQ ID NO: 1754253 - protein, 22 aa, Staphylococcus epidermidis
GVGLFIHWIWPELPIGAAFAIA

SEQ ID NO: 1754254 - protein, 27 aa, Staphylococcus epidermidis
IAAIIIVYLILVITFRGGLAPFTILFS

SEQ ID NO: 1754255 - protein, 18 aa, Staphylococcus epidermidis
IFKTKDALNGIERLTAAK

SEQ ID NO: 1754256 - protein, 24 aa, Staphylococcus epidermidis
IGIALFIFLIVRPPIEFIRQYLAQ

SEQ ID NO: 1754257 - protein, 29 aa, Staphylococcus epidermidis
IGVILLVTFLIYLFYSPRLKFDVLENPNK

SEQ ID NO: 1754258 - protein, 24 aa, Staphylococcus epidermidis
IIGIVIIVVLIIAAFILKQVNGSG

SEQ ID NO: 1754259 - protein, 18 aa, Staphylococcus epidermidis
IIIFFIIFGLFINKVTYA

SEQ ID NO: 1754260 - protein, 27 aa, Staphylococcus epidermidis
IIISGVIFIIFLFLPASWFTGLVTNKT

SEQ ID NO: 1754261 - protein, 18 aa, Staphylococcus epidermidis
IINAILIIVGWKFLSRTT

SEQ ID NO: 1754262 - protein, 23 aa, Staphylococcus epidermidis
IKLWLTIILIVATVLILLSVSLI

SEQ ID NO: 1754263 - protein, 17 aa, Staphylococcus epidermidis
ILLVLFIVGTIAVILIL

SEQ ID NO: 1754264 - protein, 24 aa, Staphylococcus epidermidis
ILVNPWVQLILSTPVQFIIGWQFY

SEQ ID NO: 1754265 - protein, 27 aa, Staphylococcus epidermidis
ILVVILIAIGVLFYMRSNKRNLIEKTE

SEQ ID NO: 1754266 - protein, 24 aa, Staphylococcus epidermidis
ITIIVLIFIVLFYKELFILSFDEE

SEQ ID NO: 1754267 - protein, 18 aa, Staphylococcus epidermidis
IVFWLLIGFVFGFAPPIQ

SEQ ID NO: 1754268 - protein, 18 aa, Staphylococcus epidermidis
IVIPLIIIFIIFTVLYSV

SEQ ID NO: 1754269 - protein, 23 aa, Staphylococcus epidermidis
IWSQYLIGLLLTAGFFFTISSKF

SEQ ID NO: 1754270 - protein, 18 aa, Staphylococcus epidermidis
IYYFLFKYLILKFDIPLP

SEQ ID NO: 1754271 - protein, 25 aa, Staphylococcus epidermidis
KELLYVALRISLIKVLKPYYPFPVI

SEQ ID NO: 1754272 - protein, 21 aa, Staphylococcus epidermidis
KFAIFLMVVLIILGGVYSSAK

SEQ ID NO: 1754273 - protein, 24 aa, Staphylococcus epidermidis
KNYKLYYLSLWYFITFGAFVAFGI

SEQ ID NO: 1754274 - protein, 34 aa, Staphylococcus epidermidis
KRNILLMFCPLLPFIGFAFIFLIPSKGILICLTF

SEQ ID NO: 1754275 - protein, 26 aa, Staphylococcus epidermidis
KSNKKTWLIVTIVLAIIIALVVIFTI

SEQ ID NO: 1754276 - protein, 35 aa, Staphylococcus epidermidis
KSSKTKKWLIAIIVILLIIVAIFITRAIINHNNDK

SEQ ID NO: 1754277 - protein, 19 aa, Staphylococcus epidermidis
KWIVLIVSIFILVGSVVIG

SEQ ID NO: 1754278 - protein, 32 aa, Staphylococcus epidermidis
LDVKLTFAAIFIFPFYILTVYFFFGRLRKLTR

SEQ ID NO: 1754279 - protein, 23 aa, Staphylococcus epidermidis
LERVGLIILLAYILMNINHFKTM

SEQ ID NO: 1754280 - protein, 20 aa, Staphylococcus epidermidis
LFIFTVIYFLIVLYLCLNPN

SEQ ID NO: 1754281 - protein, 22 aa, Staphylococcus epidermidis
LFIFVFILVNIFLVIVYIDKVN

SEQ ID NO: 1754282 - protein, 23 aa, Staphylococcus epidermidis
LITKVIMILIYILVAIVVIAILN

SEQ ID NO: 1754283 - protein, 18 aa, Staphylococcus epidermidis
LIVMIIISGVLLRKAFLK

SEQ ID NO: 1754284 - protein, 22 aa, Staphylococcus epidermidis
LLPLIFALIIPFLYRFVKRIHL

SEQ ID NO: 1754285 - protein, 31 aa, Staphylococcus epidermidis
LPKFLTLFAGPLFNFILALVLFIGLAYYQGT

SEQ ID NO: 1754286 - protein, 20 aa, Staphylococcus epidermidis
LRGKQKLYQTIDLADKELSK

SEQ ID NO: 1754287 - protein, 20 aa, Staphylococcus epidermidis
LVLSVFLFFKGKKAFWFIFI

SEQ ID NO: 1754288 - protein, 23 aa, Staphylococcus epidermidis
MSTWTLYYWGWWLSWSPFVGVFI

SEQ ID NO: 1754289 - protein, 33 aa, Staphylococcus epidermidis
NAANNGIMGVIYKAQLYLAPYSPKGYIEKLGQN

SEQ ID NO: 1754290 - protein, 29 aa, Staphylococcus epidermidis
NETPLRYIFSIIVVILIILGAFQLGIIGR

SEQ ID NO: 1754291 - protein, 23 aa, Staphylococcus epidermidis
NLFHGWPWYAIWLVLLGFGGGMI

SEQ ID NO: 1754292 - protein, 28 aa, Staphylococcus epidermidis
NLNNMNFLRWVNIRDDYTISWTSSKIQG

SEQ ID NO: 1754293 - protein, 18 aa, Staphylococcus epidermidis
PFTLLPILIGFSAAKRFG

SEQ ID NO: 1754294 - protein, 23 aa, Staphylococcus epidermidis
PGAVFWMWIIAFIGAASAFMEAT

SEQ ID NO: 1754295 - protein, 23 aa, Staphylococcus epidermidis
QAKKDLEYILDPIKNRPSLLDRI

SEQ ID NO: 1754296 - protein, 24 aa, Staphylococcus epidermidis
QALLPIFSILFFGVAWLFSRKPSK

SEQ ID NO: 1754297 - protein, 20 aa, Staphylococcus epidermidis
QGIILYYLFAIVVAFLLLNL

SEQ ID NO: 1754298 - protein, 18 aa, Staphylococcus epidermidis
RMMIYLGMFTFSISILYI

SEQ ID NO: 1754299 - protein, 17 aa, Staphylococcus epidermidis
RSIPFIILLIAIVPFTK

SEQ ID NO: 1754300 - protein, 18 aa, Staphylococcus epidermidis
SCSALLLSGSLVGYGFTK

SEQ ID NO: 1754301 - protein, 21 aa, Staphylococcus epidermidis
SIILVLLVLMSIVLTYMVWNF

SEQ ID NO: 1754302 - protein, 17 aa, Staphylococcus epidermidis
SIMFFLDVKLTFAAIFI

SEQ ID NO: 1754303 - protein, 21 aa, Staphylococcus epidermidis
SLIKVLKPYYPFPVIVDDAFV

SEQ ID NO: 1754304 - protein, 22 aa, Staphylococcus epidermidis
SVTKIVVFILLTFGFYVFFAGH

SEQ ID NO: 1754305 - protein, 27 aa, Staphylococcus epidermidis
TFRSSDYLKDLPLSGELKAIVYYNQYV

SEQ ID NO: 1754306 - protein, 41 aa, Staphylococcus epidermidis
TIIKIIGFMIIAFFVLLLLGILLFAYYAWKAPAFSESKLDD

SEQ ID NO: 1754307 - protein, 22 aa, Staphylococcus epidermidis
TLVLVLIIMTLFLNFAPYGKQG

SEQ ID NO: 1754308 - protein, 26 aa, Staphylococcus epidermidis
TRVSMFIWLVLLLPLPFLLSNLGVTF

SEQ ID NO: 1754309 - protein, 23 aa, Staphylococcus epidermidis
VFDVFLLLFIMKFGFRKIEAIVG

SEQ ID NO: 1754310 - protein, 19 aa, Staphylococcus epidermidis
VFFIIVLLTLVVSIGILGV

SEQ ID NO: 1754311 - protein, 23 aa, Staphylococcus epidermidis
VGSYFLFIIIVVFLLYANFLFLK

SEQ ID NO: 1754312 - protein, 23 aa, Staphylococcus epidermidis
VGVIIITILLLASSFILLLNLRH

SEQ ID NO: 1754313 - protein, 25 aa, Staphylococcus epidermidis
VIIILIISLILAIAFFFGLKAYQGH

SEQ ID NO: 1754314 - protein, 22 aa, Staphylococcus epidermidis
VIQLIFAFILLKTNLGISVIGS

SEQ ID NO: 1754315 - protein, 25 aa, Staphylococcus epidermidis
VSISKLFMIFLIRTIITLPIIALLA

SEQ ID NO: 1754316 - protein, 19 aa, Staphylococcus epidermidis
VWLITVFALDLSFIIDMLI

SEQ ID NO: 1754317 - protein, 20 aa, Staphylococcus epidermidis
VYLKLSCSALLLSGSLVGYG

SEQ ID NO: 1754318 - protein, 18 aa, Staphylococcus epidermidis
WPIVLVLLILFYFYSHYL

SEQ ID NO: 1754319 - protein, 23 aa, Staphylococcus epidermidis
YSHWLRFVWPVVAFVLIFGGGLL

SEQ ID NO: 1754320 - protein, 17 aa, Staphylococcus epidermidis
YVFAVKLEWFPVAGWEG

SEQ ID NO: 1754321 - protein, 25 aa, Staphylococcus epidermidis
ALLIPFILMVLTAIALVVVWFIFNQ

SEQ ID NO: 1754322 - protein, 23 aa, Staphylococcus epidermidis
ASKRLPWLIVLTFLGMITATILG

SEQ ID NO: 1754323 - protein, 25 aa, Staphylococcus epidermidis
AVITFIIWIIFVHPGQFEPALVSAI

SEQ ID NO: 1754324 - protein, 18 aa, Staphylococcus epidermidis
CGFIFYPITMIITKKYKE

SEQ ID NO: 1754325 - protein, 25 aa, Staphylococcus epidermidis
DLQKDLWKYLSIVGVIVLFTVYLAS

SEQ ID NO: 1754326 - protein, 20 aa, Staphylococcus epidermidis
DSEWSITGYPNTLTLQNAVG

SEQ ID NO: 1754327 - protein, 25 aa, Staphylococcus epidermidis
EAFQLLMWMGFIILISLIVWILAVL

SEQ ID NO: 1754328 - protein, 42 aa, Staphylococcus epidermidis
EFKQLVVAFFKEHWPKMLIIIGIIVLLLILNAIFTTVNKNDH

SEQ ID NO: 1754329 - protein, 24 aa, Staphylococcus epidermidis
FCTILAIILLLIWPPVYNGIVTFG

SEQ ID NO: 1754330 - protein, 17 aa, Staphylococcus epidermidis
FELLHLPSPLTTTISFV

SEQ ID NO: 1754331 - protein, 26 aa, Staphylococcus epidermidis
FFKGKKAFWFIFIGGFLLTFLLYANV

SEQ ID NO: 1754332 - protein, 24 aa, Staphylococcus epidermidis
FGFIVFIFAIVVLRLGYLQIAQGS

SEQ ID NO: 1754333 - protein, 24 aa, Staphylococcus epidermidis
FNDSLHNFNYLHSKFDARLREKDV

SEQ ID NO: 1754334 - protein, 25 aa, Staphylococcus epidermidis
FNTNGIISLFLLTAGFITLYHQPLR

SEQ ID NO: 1754335 - protein, 26 aa, Staphylococcus epidermidis
FSEFRIFLAVLITLLLIISISLVIAS

SEQ ID NO: 1754336 - protein, 19 aa, Staphylococcus epidermidis
FSIILITGLIIWSFIYTGF

SEQ ID NO: 1754337 - protein, 19 aa, Staphylococcus epidermidis
FSWVFLLILTIVSMFIALV

SEQ ID NO: 1754338 - protein, 17 aa, Staphylococcus epidermidis
FVFLILIFFLVFTAQKL

SEQ ID NO: 1754339 - protein, 25 aa, Staphylococcus epidermidis
GFERLNHARPRALEYIKSLEKINNA

SEQ ID NO: 1754340 - protein, 28 aa, Staphylococcus epidermidis
GGGLIGFYLLKLFIPLISIVGVIIITIL

SEQ ID NO: 1754341 - protein, 22 aa, Staphylococcus epidermidis
GIALIYLFMLGFYRLPGLVAII

SEQ ID NO: 1754342 - protein, 39 aa, Staphylococcus epidermidis
GKKKGGFMKILLPLIAAILILGAIAIFGGMALNNHNDSK

SEQ ID NO: 1754343 - protein, 22 aa, Staphylococcus epidermidis
GQLTLFFWFFKLKYSFGHIINS

SEQ ID NO: 1754344 - protein, 24 aa, Staphylococcus epidermidis
GSGAPLPQFWRSAGAINSSVANDF

SEQ ID NO: 1754345 - protein, 26 aa, Staphylococcus epidermidis
GTVLGIYPSYLPYNQERWQGANAMNA

SEQ ID NO: 1754346 - protein, 25 aa, Staphylococcus epidermidis
HAFNTLAHIIIWDTDQQPLVFELPE

SEQ ID NO: 1754347 - protein, 25 aa, Staphylococcus epidermidis
HICVVIFLVVFLIGFIILLSLVLYF

SEQ ID NO: 1754348 - protein, 26 aa, Staphylococcus epidermidis
IKQHWIPVAVVLMSLGGALIFMARRK

SEQ ID NO: 1754349 - protein, 18 aa, Staphylococcus epidermidis
ILLIVFFPLFYKLSHNHY

SEQ ID NO: 1754350 - protein, 26 aa, Staphylococcus epidermidis
IQGGGVYRLFKLPDNVHRLKVQFLPM

SEQ ID NO: 1754351 - protein, 19 aa, Staphylococcus epidermidis
ITLLLIISISLVIASTYSI

SEQ ID NO: 1754352 - protein, 18 aa, Staphylococcus epidermidis
IVALFLPIFIFYTVARPV

SEQ ID NO: 1754353 - protein, 27 aa, Staphylococcus epidermidis
KAIITILILLIIFFGVMYFISSRANVD

SEQ ID NO: 1754354 - protein, 20 aa, Staphylococcus epidermidis
KFSIRKYAIGTFSTVIATLV

SEQ ID NO: 1754355 - protein, 19 aa, Staphylococcus epidermidis
KIDFHCIFFLFLEKITPIP

SEQ ID NO: 1754356 - protein, 17 aa, Staphylococcus epidermidis
KLPLYPILPAITFILVL

SEQ ID NO: 1754357 - protein, 18 aa, Staphylococcus epidermidis
KRNKLIISAILSLPLLLV

SEQ ID NO: 1754358 - protein, 25 aa, Staphylococcus epidermidis
KRQKFLRIGFIVLTILSAALSIFSF

SEQ ID NO: 1754359 - protein, 22 aa, Staphylococcus epidermidis
LDLLIVWYVLYLLITVFKGTKA

SEQ ID NO: 1754360 - protein, 23 aa, Staphylococcus epidermidis
LEFASWHWLFYINIPIAIVAIIL

SEQ ID NO: 1754361 - protein, 21 aa, Staphylococcus epidermidis
LHDGYRYYSFIDTIGVNSGSH

SEQ ID NO: 1754362 - protein, 17 aa, Staphylococcus epidermidis
LWWFMFAVYISNALFTL

SEQ ID NO: 1754363 - protein, 25 aa, Staphylococcus epidermidis
MAPIMPIIIIPILSSLIVGLIFIFV

SEQ ID NO: 1754364 - protein, 25 aa, Staphylococcus epidermidis
NELNSIFINITQKPTARKAISGMAS

SEQ ID NO: 1754365 - protein, 38 aa, Staphylococcus epidermidis
NHAKPPRFLVRFWTLFVSFLIGLVLMSVLFFNNLGMVK

SEQ ID NO: 1754366 - protein, 17 aa, Staphylococcus epidermidis
NLYRIAIQYYGEGTQAN

SEQ ID NO: 1754367 - protein, 17 aa, Staphylococcus epidermidis
NQQFPPRNAQRRKRRRE

SEQ ID NO: 1754368 - protein, 26 aa, Staphylococcus epidermidis
NWFGWLFLIIVFILDVFLIFLAFSRY

SEQ ID NO: 1754369 - protein, 20 aa, Staphylococcus epidermidis
PNDFFSLRTGGPVDARIVWV

SEQ ID NO: 1754370 - protein, 20 aa, Staphylococcus epidermidis
PPFFFSVLLPIVFISALIGI

SEQ ID NO: 1754371 - protein, 19 aa, Staphylococcus epidermidis
PTARLYYAAGARSGEYKQA

SEQ ID NO: 1754372 - protein, 27 aa, Staphylococcus epidermidis
QIFGIPVFLFLNLLIVLLCIIVGSVLA

SEQ ID NO: 1754373 - protein, 23 aa, Staphylococcus epidermidis
QKGTSYFRFQYFNPLNSSKYYEN

SEQ ID NO: 1754374 - protein, 27 aa, Staphylococcus epidermidis
RDFLNSNFWLYWKTMFAFEPWHSAMEM

SEQ ID NO: 1754375 - protein, 29 aa, Staphylococcus epidermidis
RMRKLPFIILVILIILISIIVYITHQYNS

SEQ ID NO: 1754376 - protein, 17 aa, Staphylococcus epidermidis
RSGRPIQFLVGFDVEDS

SEQ ID NO: 1754377 - protein, 21 aa, Staphylococcus epidermidis
SEWVVLILSTILFFYGGKPFL

SEQ ID NO: 1754378 - protein, 18 aa, Staphylococcus epidermidis
SLAYTRTPFVKTGTYDVV

SEQ ID NO: 1754379 - protein, 22 aa, Staphylococcus epidermidis
SLLILFFYLFSDGLRDAFDPKM

SEQ ID NO: 1754380 - protein, 29 aa, Staphylococcus epidermidis
SNHKGHEYMYYWFGLPSDQTPTGPVTFTI

SEQ ID NO: 1754381 - protein, 26 aa, Staphylococcus epidermidis
SSQKRHTFPWIKTIIVAIIAGIIGAL

SEQ ID NO: 1754382 - protein, 43 aa, Staphylococcus epidermidis
STNIRLRKIVPIGISVFILILIIVLFFLLRNYNSPNAQAKILV

SEQ ID NO: 1754383 - protein, 20 aa, Staphylococcus epidermidis
TFIGWRWIFVLSIIFSIIAL

SEQ ID NO: 1754384 - protein, 22 aa, Staphylococcus epidermidis
TLINVLPIVIVPLVTERKRIKE

SEQ ID NO: 1754385 - protein, 23 aa, Staphylococcus epidermidis
VILFLIIVVIFRQPLLALIVGGS

SEQ ID NO: 1754386 - protein, 23 aa, Staphylococcus epidermidis
VLLILLFLFLIFHLIRLASKIDS

SEQ ID NO: 1754387 - protein, 25 aa, Staphylococcus epidermidis
VQAVNQYWPEHMDFRWAQGSGTPSS

SEQ ID NO: 1754388 - protein, 22 aa, Staphylococcus epidermidis
VVVWFIFNQLVAGIATAILIVM

SEQ ID NO: 1754389 - protein, 20 aa, Staphylococcus epidermidis
VYMMILVTFFIVVSGCSINQ

SEQ ID NO: 1754390 - protein, 20 aa, Staphylococcus epidermidis
YFYLMLFLLTTLIGAFLLYL

SEQ ID NO: 1754391 - protein, 24 aa, Staphylococcus epidermidis
YHSLWVWPILLIAIFFIVNFIITN

SEQ ID NO: 1754392 - protein, 17 aa, Staphylococcus epidermidis
YLLLIISITLFVPVELF

SEQ ID NO: 1754393 - protein, 24 aa, Staphylococcus epidermidis
YQKSWFIILTLLFIFPLGLFLMWR

SEQ ID NO: 1754394 - protein, 18 aa, Staphylococcus epidermidis
ALSIWVGGLLMVSLLSVD

SEQ ID NO: 1754395 - protein, 23 aa, Staphylococcus epidermidis
AMNILFYLLPLIILGDATWGFVL

SEQ ID NO: 1754396 - protein, 30 aa, Staphylococcus epidermidis
AQDVARFLPNKILNIRYKLRPVNISTPREV

SEQ ID NO: 1754397 - protein, 25 aa, Staphylococcus epidermidis
AQFKNQYPVVFVHGFLGFAGDNQFS

SEQ ID NO: 1754398 - protein, 17 aa, Staphylococcus epidermidis
CINLILPIFFLSGIFIM

SEQ ID NO: 1754399 - protein, 21 aa, Staphylococcus epidermidis
CLLFFLIFNYIPMTSLVLAFK

SEQ ID NO: 1754400 - protein, 21 aa, Staphylococcus epidermidis
DGYQWDILFNSNHKGHEYMYY

SEQ ID NO: 1754401 - protein, 19 aa, Staphylococcus epidermidis
DTINLLQPLANKESLKEAR

SEQ ID NO: 1754402 - protein, 18 aa, Staphylococcus epidermidis
EFSFLFVAPFLFVIHAVL

SEQ ID NO: 1754403 - protein, 27 aa, Staphylococcus epidermidis
ENGEGLPIDGWKFYWNQQSTGTTSDQW

SEQ ID NO: 1754404 - protein, 31 aa, Staphylococcus epidermidis
FDPFTPLLVAALLYFLLTFALTRVMNFIEGR

SEQ ID NO: 1754405 - protein, 21 aa, Staphylococcus epidermidis
FEKILYIALITVIALISIYML

SEQ ID NO: 1754406 - protein, 20 aa, Staphylococcus epidermidis
FFAFIFIILLINSATRYAVL

SEQ ID NO: 1754407 - protein, 19 aa, Staphylococcus epidermidis
FIFSFYLFSYLRLKPAPMF

SEQ ID NO: 1754408 - protein, 18 aa, Staphylococcus epidermidis
FIPLLWLLDVPTQLAPGI

SEQ ID NO: 1754409 - protein, 17 aa, Staphylococcus epidermidis
FPVFMVMIIGLISFYAI

SEQ ID NO: 1754410 - protein, 25 aa, Staphylococcus epidermidis
FQTINPLFILLFAPVVTLLWQKLGK

SEQ ID NO: 1754411 - protein, 17 aa, Staphylococcus epidermidis
GFIILLSLVLYFQQLTK

SEQ ID NO: 1754412 - protein, 29 aa, Staphylococcus epidermidis
GFPPGTFFHASNRRWPYNLPRSRNILRAS

SEQ ID NO: 1754413 - protein, 24 aa, Staphylococcus epidermidis
GVQNLIALVNYPGISTPLEVPVKV

SEQ ID NO: 1754414 - protein, 19 aa, Staphylococcus epidermidis
GWLLFFGIVFFSGSLYFLA

SEQ ID NO: 1754415 - protein, 17 aa, Staphylococcus epidermidis
HLENGEGLPIDGWKFYW

SEQ ID NO: 1754416 - protein, 26 aa, Staphylococcus epidermidis
HNPETLLPVNLYVKPELKHTIELYHD

SEQ ID NO: 1754417 - protein, 25 aa, Staphylococcus epidermidis
HTKLVIVYVLLIIIGMQIIGLYFTN

SEQ ID NO: 1754418 - protein, 19 aa, Staphylococcus epidermidis
IFAIFLTGAISLLIGLTYY

SEQ ID NO: 1754419 - protein, 19 aa, Staphylococcus epidermidis
IGIVLYEMLVGEPPFNGET

SEQ ID NO: 1754420 - protein, 22 aa, Staphylococcus epidermidis
IKGLIIFYIFIALLMFGLLNQH

SEQ ID NO: 1754421 - protein, 17 aa, Staphylococcus epidermidis
ILGWTFFIAALSLAGIP

SEQ ID NO: 1754422 - protein, 19 aa, Staphylococcus epidermidis
ILPSFYAWFNLWAMWDPYG

SEQ ID NO: 1754423 - protein, 17 aa, Staphylococcus epidermidis
IPFIILLIAIVPFTKLL

SEQ ID NO: 1754424 - protein, 19 aa, Staphylococcus epidermidis
IRQNLFWAFGYNVAGIPIA

SEQ ID NO: 1754425 - protein, 24 aa, Staphylococcus epidermidis
ISVSWIWFVFLAILGRITGKIDKS

SEQ ID NO: 1754426 - protein, 20 aa, Staphylococcus epidermidis
ITIPVFILIIVPLGRVMQKI

SEQ ID NO: 1754427 - protein, 32 aa, Staphylococcus epidermidis
KMKIAILSIIFVILLIGLFSFVAMAVFGNKYE

SEQ ID NO: 1754428 - protein, 18 aa, Staphylococcus epidermidis
KPYYIFRFRIPFTPGLIP

SEQ ID NO: 1754429 - protein, 17 aa, Staphylococcus epidermidis
KRWLFISSTLIKQTVRR

SEQ ID NO: 1754430 - protein, 20 aa, Staphylococcus epidermidis
LILIVVVVGFGIYFYASKDK

SEQ ID NO: 1754431 - protein, 22 aa, Staphylococcus epidermidis
LIPLLLFVLLFLGVGIISGDFT

SEQ ID NO: 1754432 - protein, 23 aa, Staphylococcus epidermidis
LITKVIILGLFGIGFMVVGYCLK

SEQ ID NO: 1754433 - protein, 21 aa, Staphylococcus epidermidis
LLFIFPLGLFLMWRYAHWKNW

SEQ ID NO: 1754434 - protein, 17 aa, Staphylococcus epidermidis
LNGIQRLSKAKAKAIQY

SEQ ID NO: 1754435 - protein, 23 aa, Staphylococcus epidermidis
LSMLLTLWIVPWLSAMKARKLKQ

SEQ ID NO: 1754436 - protein, 30 aa, Staphylococcus epidermidis
LSVILVITIIISFLFYFYTTEKKVDKDKLY

SEQ ID NO: 1754437 - protein, 27 aa, Staphylococcus epidermidis
LVVIVIFIIFLILLFMFVNLSDEDTGQ

SEQ ID NO: 1754438 - protein, 22 aa, Staphylococcus epidermidis
MLNYKVWYLTLLAGLIPFIPIK

SEQ ID NO: 1754439 - protein, 22 aa, Staphylococcus epidermidis
NLNFWVWIPLIIIVLCLIFRIS

SEQ ID NO: 1754440 - protein, 22 aa, Staphylococcus epidermidis
NLYLTFLLLFVTIILFVTVIQN

SEQ ID NO: 1754441 - protein, 22 aa, Staphylococcus epidermidis
NNIWFYLIFFLFFGLFLLLITL

SEQ ID NO: 1754442 - protein, 20 aa, Staphylococcus epidermidis
NVILMFWIISLVSLLMMVVI

SEQ ID NO: 1754443 - protein, 21 aa, Staphylococcus epidermidis
NWQWVYFILTILYLILVLVIY

SEQ ID NO: 1754444 - protein, 17 aa, Staphylococcus epidermidis
SAYAFMIFILLYVPCIS

SEQ ID NO: 1754445 - protein, 20 aa, Staphylococcus epidermidis
SDIYSLFRKQSFRGNEYLNS

SEQ ID NO: 1754446 - protein, 18 aa, Staphylococcus epidermidis
SDTFIWLPLLLLGIERLL

SEQ ID NO: 1754447 - protein, 21 aa, Staphylococcus epidermidis
SRLYYIILTIVIIAICVVVVI

SEQ ID NO: 1754448 - protein, 31 aa, Staphylococcus epidermidis
STPLEVPVKVWVYNFDFTQPIYKIQVGDTFP

SEQ ID NO: 1754449 - protein, 17 aa, Staphylococcus epidermidis
TEWIYFTYLILGVLLAI

SEQ ID NO: 1754450 - protein, 26 aa, Staphylococcus epidermidis
TFTTILLFCLIIIFFLKDTLRSSEID

SEQ ID NO: 1754451 - protein, 22 aa, Staphylococcus epidermidis
TIGPNLRKYFSLSNGSDLPNRD

SEQ ID NO: 1754452 - protein, 19 aa, Staphylococcus epidermidis
TMLIYGIVLIIISLLGSLF

SEQ ID NO: 1754453 - protein, 18 aa, Staphylococcus epidermidis
TNNAITIIILITAIIFTI

SEQ ID NO: 1754454 - protein, 33 aa, Staphylococcus epidermidis
VSILTTLIPVLIIALLFIFFLSQAQGGGGGGRM

SEQ ID NO: 1754455 - protein, 18 aa, Staphylococcus epidermidis
VVLRYWPFNRWGGSFNPG

SEQ ID NO: 1754456 - protein, 19 aa, Staphylococcus epidermidis
WGFVLSWLPLHSKYLVVSV

SEQ ID NO: 1754457 - protein, 20 aa, Staphylococcus epidermidis
WVRWILYIVALFLPIFIFYT

SEQ ID NO: 1754458 - protein, 20 aa, Staphylococcus epidermidis
YLIFVSLWVLLIYSPVAHWV

SEQ ID NO: 1754459 - protein, 21 aa, Staphylococcus epidermidis
AFIFLVLSFVLLMLSFNGWVL

SEQ ID NO: 1754460 - protein, 19 aa, Staphylococcus epidermidis
AFMIFILLYVPCISTVATI

SEQ ID NO: 1754461 - protein, 21 aa, Staphylococcus epidermidis
AITIIILITAIIFTIASTIFA

SEQ ID NO: 1754462 - protein, 18 aa, Staphylococcus epidermidis
CLWFLFCVFIFQYIKLLF

SEQ ID NO: 1754463 - protein, 26 aa, Staphylococcus epidermidis
DKRLPMLDLPIIPIIVSRYWVQLISN

SEQ ID NO: 1754464 - protein, 17 aa, Staphylococcus epidermidis
DNQFSLAPKYWGGTKYN

SEQ ID NO: 1754465 - protein, 25 aa, Staphylococcus epidermidis
DSKGTLLGALFAGLGALLLGKRRKN

SEQ ID NO: 1754466 - protein, 23 aa, Staphylococcus epidermidis
EFSIWLFLLLLLVPDIFMLGYVI

SEQ ID NO: 1754467 - protein, 22 aa, Staphylococcus epidermidis
EKQIFVSKLKALINRTHKQIDE

SEQ ID NO: 1754468 - protein, 24 aa, Staphylococcus epidermidis
ELPNSSEILLLNLTSRIIGKDANK

SEQ ID NO: 1754469 - protein, 20 aa, Staphylococcus epidermidis
FAIIIYYIILYLLFLIAEIV

SEQ ID NO: 1754470 - protein, 24 aa, Staphylococcus epidermidis
FCFIFLLLLFFRYILKRYFNYMLN

SEQ ID NO: 1754471 - protein, 18 aa, Staphylococcus epidermidis
FFIPFLLIFIVDGFKGIK

SEQ ID NO: 1754472 - protein, 17 aa, Staphylococcus epidermidis
FFLMIMIIIIPLIRQRA

SEQ ID NO: 1754473 - protein, 17 aa, Staphylococcus epidermidis
FIPFLLIFIVDGFKGIK

SEQ ID NO: 1754474 - protein, 20 aa, Staphylococcus epidermidis
FIWLPLLLLGIERLLRDFKA

SEQ ID NO: 1754475 - protein, 20 aa, Staphylococcus epidermidis
FLILVLVIFTLFTYKAPSGM

SEQ ID NO: 1754476 - protein, 30 aa, Staphylococcus epidermidis; identical to SEQ ID NO: 1746178

SEQ ID NO: 1754477 - protein, 21 aa, Staphylococcus epidermidis
FWRILLFYILAIFIIGMLIPY

SEQ ID NO: 1754478 - protein, 23 aa, Staphylococcus epidermidis
FWSFLIVFLLIFIILQIRIFTIS

SEQ ID NO: 1754479 - protein, 20 aa, Staphylococcus epidermidis
GYLFYFAVIVGVISFIVWML

SEQ ID NO: 1754480 - protein, 23 aa, Staphylococcus epidermidis
HIFRIFFILFVIAPLIGYFINVK

SEQ ID NO: 1754481 - protein, 26 aa, Staphylococcus epidermidis
HTKLVIVYVLLIIIGMQIIGLYFTNS

SEQ ID NO: 1754482 - protein, 18 aa, Staphylococcus epidermidis
IGIVLYEMLVGEPPFNGE

SEQ ID NO: 1754483 - protein, 25 aa, Staphylococcus epidermidis
IIAVLAIILIIYIALQHAPFLKNQE

SEQ ID NO: 1754484 - protein, 19 aa, Staphylococcus epidermidis
IILCYLGFQFGLKKRDEML

SEQ ID NO: 1754485 - protein, 20 aa, Staphylococcus epidermidis
IILCYLGFQFGLKKRDEMLM

SEQ ID NO: 1754486 - protein, 20 aa, Staphylococcus epidermidis
IIMIVLLTIMILGVIWLFKD

SEQ ID NO: 1754487 - protein, 18 aa, Staphylococcus epidermidis
IMAILIWTIGIASSAWII

SEQ ID NO: 1754488 - protein, 20 aa, Staphylococcus epidermidis
IPFIILILLLIPFTSILLGT

SEQ ID NO: 1754489 - protein, 18 aa, Staphylococcus epidermidis
IPIFICIFTFLLMVIQSQ

SEQ ID NO: 1754490 - protein, 23 aa, Staphylococcus epidermidis
KFRFILIMFIIFLMAIMVLFISG

SEQ ID NO: 1754491 - protein, 32 aa, Staphylococcus epidermidis
KHTGWLIVLSIIFVLLIAALLYGAYYAYNHYI

SEQ ID NO: 1754492 - protein, 20 aa, Staphylococcus epidermidis
KLIISAILSLPLLLVMVVHI

SEQ ID NO: 1754493 - protein, 21 aa, Staphylococcus epidermidis
KLILIFICIFTFLLMVIQSQF

SEQ ID NO: 1754494 - protein, 25 aa, Staphylococcus epidermidis
KLTNSSQTVIYKFKDVQGPQISVDS

SEQ ID NO: 1754495 - protein, 26 aa, Staphylococcus epidermidis
KRIEFYRLYLLMIHLLKFGGMYADSV

SEQ ID NO: 1754496 - protein, 32 aa, Staphylococcus epidermidis
KTVGVITLTGLLSSFWLVLAKRRKKEEEEKQS

SEQ ID NO: 1754497 - protein, 25 aa, Staphylococcus epidermidis
LFIFPLGLFLMWKFSKWPSIARTII

SEQ ID NO: 1754498 - protein, 17 aa, Staphylococcus epidermidis
LLMIVFRSILVPLKAVL

SEQ ID NO: 1754499 - protein, 36 aa, Staphylococcus epidermidis
LSAALSIFSFFTANLIFGIIFALLTVIFVVGIIFSR

SEQ ID NO: 1754500 - protein, 23 aa, Staphylococcus epidermidis
LSMLLTLWIVPWLSAKKARKLKQ

SEQ ID NO: 1754501 - protein, 24 aa, Staphylococcus epidermidis
LTEALLKEPSIAKAQTKLKRIPTL

SEQ ID NO: 1754502 - protein, 26 aa, Staphylococcus epidermidis
LVVIGVLGFWFWHNTTSYVTTDNAKV

SEQ ID NO: 1754503 - protein, 26 aa, Staphylococcus epidermidis
LYSRPLFYFGNFMKPLIWLMNGSSRV

SEQ ID NO: 1754504 - protein, 27 aa, Staphylococcus epidermidis
LYSRPLFYFGNFMKPLIWLMNGSSRVI

SEQ ID NO: 1754505 - protein, 18 aa, Staphylococcus epidermidis
LYVVFKMIFWFNPALYIS

SEQ ID NO: 1754506 - protein, 17 aa, Staphylococcus epidermidis
MAILIWTIGIASSAWII

SEQ ID NO: 1754507 - protein, 18 aa, Staphylococcus epidermidis
MMHPLFELLHLPSPLTTT

SEQ ID NO: 1754508 - protein, 26 aa, Staphylococcus epidermidis
NQSASYFIKQWALDRIKQIQLETMNS

SEQ ID NO: 1754509 - protein, 23 aa, Staphylococcus epidermidis
NVHRLKVQFLPMNEIHSDFKRIQ

SEQ ID NO: 1754510 - protein, 17 aa, Staphylococcus epidermidis
PILLLVVMYFLLIRPQQ

SEQ ID NO: 1754511 - protein, 36 aa, Staphylococcus epidermidis
QKRIQYTIITLLILIIVLILLYMFTPLSKISNVNVK

SEQ ID NO: 1754512 - protein, 22 aa, Staphylococcus epidermidis
QVWPILLFLPFIVFIFIRIHVH

SEQ ID NO: 1754513 - protein, 20 aa, Staphylococcus epidermidis
QVYLGKSGFFFLLGIIQALI

SEQ ID NO: 1754514 - protein, 26 aa, Staphylococcus epidermidis
QVYLGKSGFFFLLGIIQALIVSIGDL

SEQ ID NO: 1754515 - protein, 17 aa, Staphylococcus epidermidis
RALLNGIERLKDAQTKA

SEQ ID NO: 1754516 - protein, 17 aa, Staphylococcus epidermidis
RSYLLQNNPILAGVNGD

SEQ ID NO: 1754517 - protein, 25 aa, Staphylococcus epidermidis
SFCFIFLLLVFFRYILKRYFNYSLN

SEQ ID NO: 1754518 - protein, 22 aa, Staphylococcus epidermidis
SKLIQTYLSKKTLRYGTASALT

SEQ ID NO: 1754519 - protein, 24 aa, Staphylococcus epidermidis
SLKRKDFVVSFIASAIVGSAVGLY

SEQ ID NO: 1754520 - protein, 29 aa, Staphylococcus epidermidis
TFVTLVTFVILIILLKKFAWGPLKEVMDK

SEQ ID NO: 1754521 - protein, 24 aa, Staphylococcus epidermidis
TLFIISILVILAILFLIFDTNLFK

SEQ ID NO: 1754522 - protein, 19 aa, Staphylococcus epidermidis
TQPIYKIQVGDTFPKGTWA

SEQ ID NO: 1754523 - protein, 19 aa, Staphylococcus epidermidis
VEQTIYINPLRYSAKETNV

SEQ ID NO: 1754524 - protein, 20 aa, Staphylococcus epidermidis
VFVSFLILTIFIGGCGFINK

SEQ ID NO: 1754525 - protein, 22 aa, Staphylococcus epidermidis
VFWRILLFYILAIFIIGMLIPY

SEQ ID NO: 1754526 - protein, 22 aa, Staphylococcus epidermidis
VGHIDPGNYFITVKFGDKVEQF

SEQ ID NO: 1754527 - protein, 32 aa, Staphylococcus epidermidis
VSILTTLIPVLIIALLFIFFLSQAQGGGGGGR

SEQ ID NO: 1754528 - protein, 24 aa, Staphylococcus epidermidis
VVIGVLGFWFWHNTTSYVTTDNAK

SEQ ID NO: 1754529 - protein, 17 aa, Staphylococcus epidermidis
WFNLWAMWDPYGHTGHI

SEQ ID NO: 1754530 - protein, 20 aa, Staphylococcus epidermidis
WYMWSLWSLIIALLPILLFF

SEQ ID NO: 1754531 - protein, 22 aa, Staphylococcus epidermidis
YKWMLITTLITFTTILLFCLII

SEQ ID NO: 1754532 - protein, 23 aa, Staphylococcus epidermidis
YKWMLITTLITFTTILLFCLIII

SEQ ID NO: 1754533 - protein, 17 aa, Staphylococcus epidermidis
AGTASLLIGATLVFGIN

SEQ ID NO: 1754534 - protein, 17 aa, Staphylococcus epidermidis
AIIGLLIVFVVTGFIFF

SEQ ID NO: 1754535 - protein, 21 aa, Staphylococcus epidermidis
AIPFIILILLLIPFTSILLGT

SEQ ID NO: 1754536 - protein, 24 aa, Staphylococcus epidermidis
AMNILFYLLPLIILGDATWGFVLS

SEQ ID NO: 1754537 - protein, 26 aa, Staphylococcus epidermidis
ASINEIELLKTMGLPFLSKNEIQENV

SEQ ID NO: 1754538 - protein, 20 aa, Staphylococcus epidermidis
ASLLIGATLVFGINGQVKAA

SEQ ID NO: 1754539 - protein, 19 aa, Staphylococcus epidermidis
CLWFLFCVFIFQYIKLLFS

SEQ ID NO: 1754540 - protein, 21 aa, Staphylococcus epidermidis
DLLIVWYVLYLLITVFKGTKA

SEQ ID NO: 1754541 - protein, 24 aa, Staphylococcus epidermidis
DNVHRLKVQFLPMNEIHSDFKRIQ

SEQ ID NO: 1754542 - protein, 19 aa, Staphylococcus epidermidis
EFSFLFVAPFLFVIHAVLD

SEQ ID NO: 1754543 - protein, 19 aa, Staphylococcus epidermidis
EIILLCLIIYAGAAQFIIC

SEQ ID NO: 1754544 - protein, 18 aa, Staphylococcus epidermidis
ELPILYVTVWLDDQGNII

SEQ ID NO: 1754545 - protein, 23 aa, Staphylococcus epidermidis
FAIATWILLIGSFFQWFDSAFNG

SEQ ID NO: 1754546 - protein, 19 aa, Staphylococcus epidermidis
FAIIIYYIILYLLFLIAEI

SEQ ID NO: 1754547 - protein, 25 aa, Staphylococcus epidermidis
FCFIFLLLLFFRYILKRYFNYMLNY

SEQ ID NO: 1754548 - protein, 20 aa, Staphylococcus epidermidis
FEKILYIALITVIALISIYM

SEQ ID NO: 1754549 - protein, 25 aa, Staphylococcus epidermidis
FFKGKKAFWFIFIGGFLLTFLLYAN

SEQ ID NO: 1754550 - protein, 17 aa, Staphylococcus epidermidis
FIMLFLVGWFQGMGWPP

SEQ ID NO: 1754551 - protein, 23 aa, Staphylococcus epidermidis
FIPYLIFVSLWVLLIYSPVAHWV

SEQ ID NO: 1754552 - protein, 19 aa, Staphylococcus epidermidis
FLILVLVIFTLFTYKAPSG

SEQ ID NO: 1754553 - protein, 18 aa, Staphylococcus epidermidis
FMIFILLYVPCISTVATI

SEQ ID NO: 1754554 - protein, 31 aa, Staphylococcus epidermidis
FSIRKFNIGIFSALIATVAFLAHPGQATASE

SEQ ID NO: 1754555 - protein, 26 aa, Staphylococcus epidermidis
FTANLIFGIIFALLTVIFVVGIIFSR

SEQ ID NO: 1754556 - protein, 21 aa, Staphylococcus epidermidis
FVSLIFAIPIILLSPLMGINL

SEQ ID NO: 1754557 - protein, 21 aa, Staphylococcus epidermidis
FVSLIFAIPIILLSPLMGVNL

SEQ ID NO: 1754558 - protein, 24 aa, Staphylococcus epidermidis
FWSFLIVFLLIFIILQIRIFTISE

SEQ ID NO: 1754559 - protein, 23 aa, Staphylococcus epidermidis
GGDGIGFAFSPGPLGQIGKEGAA

SEQ ID NO: 1754560 - protein, 18 aa, Staphylococcus epidermidis
GIIGWYMWSLWSLIIALL

SEQ ID NO: 1754561 - protein, 24 aa, Staphylococcus epidermidis
GNGAFLMFIAFYFKKLRTQKIVFS

SEQ ID NO: 1754562 - protein, 25 aa, Staphylococcus epidermidis
GSKGTLLGTLFAGLGALLLGKRRKN

SEQ ID NO: 1754563 - protein, 31 aa, Staphylococcus epidermidis
GVVSNGFIVAVAIVLAIFGLAKKSRKDDDDQ

SEQ ID NO: 1754564 - protein, 18 aa, Staphylococcus epidermidis
GWLLFFGIVFFSGSLYFL

SEQ ID NO: 1754565 - protein, 21 aa, Staphylococcus epidermidis
GWYMWSLWSLIIALLPILLFF

SEQ ID NO: 1754566 - protein, 18 aa, Staphylococcus epidermidis
HIQIPSDERFKVGQQLIV

SEQ ID NO: 1754567 - protein, 17 aa, Staphylococcus epidermidis
HRSLLSLSIAIIGIFLG

SEQ ID NO: 1754568 - protein, 27 aa, Staphylococcus epidermidis
HSKKLLLCISFLLITIFIGGCGFINKD

SEQ ID NO: 1754569 - protein, 19 aa, Staphylococcus epidermidis
IDPGNYFITVKFGDKVEQF

SEQ ID NO: 1754570 - protein, 18 aa, Staphylococcus epidermidis
IFAIFLTGAISLLIGLTY

SEQ ID NO: 1754571 - protein, 21 aa, Staphylococcus epidermidis
IKGLIIFYIFIALLMFGLLNQ

SEQ ID NO: 1754572 - protein, 24 aa, Staphylococcus epidermidis
ILITKVIILGLFGIGFMVVGYCLK

SEQ ID NO: 1754573 - protein, 25 aa, Staphylococcus epidermidis
ILLIMIAWLFIFILMKAGLTQVNQL

SEQ ID NO: 1754574 - protein, 20 aa, Staphylococcus epidermidis
ILPSFYAWFNLWAMWDPYGH

SEQ ID NO: 1754575 - protein, 17 aa, Staphylococcus epidermidis
IPILFFIIAMMMFARRD

SEQ ID NO: 1754576 - protein, 18 aa, Staphylococcus epidermidis
ITEWIYFTYLILGVLLAI

SEQ ID NO: 1754577 - protein, 27 aa, Staphylococcus epidermidis
ITFTTILLFCLIIIFFLKDTLRSSEID

SEQ ID NO: 1754578 - protein, 21 aa, Staphylococcus epidermidis
ITIPVFILIIVPLGRVMQKIS

SEQ ID NO: 1754579 - protein, 17 aa, Staphylococcus epidermidis
ITYMILLIWVFGSLLCL

SEQ ID NO: 1754580 - protein, 28 aa, Staphylococcus epidermidis
IVTLVTFVILIILLKKFAWGPLKEVMDK

SEQ ID NO: 1754581 - protein, 20 aa, Staphylococcus epidermidis
IVYIIPRFFKAIPAPLIAII

SEQ ID NO: 1754582 - protein, 21 aa, Staphylococcus epidermidis
IYISLLILTIFIGGCGFINKE

SEQ ID NO: 1754583 - protein, 46 aa, Staphylococcus epidermidis
KDFPTRKNHYAIRKFTVGTASIIVGSFLFFGQTQAHAEEFERVTTG

SEQ ID NO: 1754584 - protein, 43 aa, Staphylococcus epidermidis
KDFPTRKNHYAIRKFTVGTASIIVGSFLFFGQTQAHAEQAEEF

SEQ ID NO: 1754585 - protein, 44 aa, Staphylococcus epidermidis
KDFPTRKNHYAIRKFTVGTASIIVGSFLFFGQTQAHAEQAEEFE

SEQ ID NO: 1754586 - protein, 30 aa, Staphylococcus epidermidis
KHIKIKLWHFILVILGIILLTSIITVVSTI

SEQ ID NO: 1754587 - protein, 31 aa, Staphylococcus epidermidis
KHIKIKLWHFILVILGIILLTSIITVVSTIL

SEQ ID NO: 1754588 - protein, 31 aa, Staphylococcus epidermidis
KHTGWLIVLSIIFVLLIAALLYGAYYTYNHY

SEQ ID NO: 1754589 - protein, 21 aa, Staphylococcus epidermidis
KNVILIFWIISLVSLLMMVVI

SEQ ID NO: 1754590 - protein, 17 aa, Staphylococcus epidermidis
KPYYPFPVIVDDAFVHF

SEQ ID NO: 1754591 - protein, 23 aa, Staphylococcus epidermidis
KQEWFIVLSLLFIFPLGLFLMWK

SEQ ID NO: 1754592 - protein, 27 aa, Staphylococcus epidermidis
KRIEFYRLYLLMIHLLKFGGMYADSVQ

SEQ ID NO: 1754593 - protein, 25 aa, Staphylococcus epidermidis
KRLPMLDLPIIPIIVSRYWVQLISN

SEQ ID NO: 1754594 - protein, 18 aa, Staphylococcus epidermidis
KRWLFISSTLIKQTVRRS

SEQ ID NO: 1754595 - protein, 32 aa, Staphylococcus epidermidis
KTVGVITLTGLLSSFWLVLAKRRKKEEEKQSI

SEQ ID NO: 1754596 - protein, 17 aa, Staphylococcus epidermidis
LDPAIFYPLIKKLKENN

SEQ ID NO: 1754597 - protein, 19 aa, Staphylococcus epidermidis
LIISAILSLPLLLVMVVHI

SEQ ID NO: 1754598 - protein, 23 aa, Staphylococcus epidermidis
LIMIAWLFIFILMKAGLTQVNQL

SEQ ID NO: 1754599 - protein, 21 aa, Staphylococcus epidermidis
LIPLLLFVLLFLGVGIISGDF

SEQ ID NO: 1754600 - protein, 19 aa, Staphylococcus epidermidis
LLTIMILGVIWLFKDKGQN

SEQ ID NO: 1754601 - protein, 17 aa, Staphylococcus epidermidis
LPILYVTVWLDDQGNII

SEQ ID NO: 1754602 - protein, 25 aa, Staphylococcus epidermidis
LSAALSIFSFFTANLIFGIIFALLT

SEQ ID NO: 1754603 - protein, 29 aa, Staphylococcus epidermidis
LSVILVITIIISFIFYFYTTEKKVDKDKL

SEQ ID NO: 1754604 - protein, 23 aa, Staphylococcus epidermidis
LTEALLKEPSIAKAQTKLKRIPT

SEQ ID NO: 1754605 - protein, 17 aa, Staphylococcus epidermidis
LTPIFFFLVFTFSMHVL

SEQ ID NO: 1754606 - protein, 23 aa, Staphylococcus epidermidis
MLNYKVWYLTLLAGLIPFIPIKF

SEQ ID NO: 1754607 - protein, 20 aa, Staphylococcus epidermidis
MMHPLFELLHLPSPLTTTIS

SEQ ID NO: 1754608 - protein, 26 aa, Staphylococcus epidermidis
NDIQNPALIMLLAGLGLLGLFRNKIR

SEQ ID NO: 1754609 - protein, 23 aa, Staphylococcus epidermidis
NGAFLMFIAFYFKKIRTQKIVFS

SEQ ID NO: 1754610 - protein, 23 aa, Staphylococcus epidermidis
NGAFLMFIAFYFKKLRTQKIVFS

SEQ ID NO: 1754611 - protein, 26 aa, Staphylococcus epidermidis
NIIAVLAIILIIYIALQHAPFLKNQE

SEQ ID NO: 1754612 - protein, 21 aa, Staphylococcus epidermidis
NNIWFYLIFFLFFGLFLLLIT

SEQ ID NO: 1754613 - protein, 30 aa, Staphylococcus epidermidis
NQSSPTSFANLRTFSRFTVLNTMAAPTTTS

SEQ ID NO: 1754614 - protein, 26 aa, Staphylococcus epidermidis
NSLKRKDFVVSFIASAIVGSAVGLYY

SEQ ID NO: 1754615 - protein, 27 aa, Staphylococcus epidermidis
NTLYTAIVLLVALVLLIFAVKSIQVEP

SEQ ID NO: 1754616 - protein, 22 aa, Staphylococcus epidermidis
NWQWVYFILTILYLILVLVIYK

SEQ ID NO: 1754617 - protein, 22 aa, Staphylococcus epidermidis
PAFIFLVLSFVLLMLSFNGWVL

SEQ ID NO: 1754618 - protein, 20 aa, Staphylococcus epidermidis
PIAAIGLLAPWVAGAAMALS

SEQ ID NO: 1754619 - protein, 23 aa, Staphylococcus epidermidis
PNLLNKYGIRKLSAGTASLLIGA

SEQ ID NO: 1754620 - protein, 18 aa, Staphylococcus epidermidis
PNNSEYSYLLNDLGYDAT

SEQ ID NO: 1754621 - protein, 17 aa, Staphylococcus epidermidis
PYYIFRFRIPFTPGLIP

SEQ ID NO: 1754622 - protein, 29 aa, Staphylococcus epidermidis
QIPHIFMNPWFQFVLATPVQFVIGWQFYV

SEQ ID NO: 1754623 - protein, 37 aa, Staphylococcus epidermidis
QKRIQYTIITLLILIIVLILLYMFTPLSKISNVNIKG

SEQ ID NO: 1754624 - protein, 18 aa, Staphylococcus epidermidis
QLALLFIAQLYFHFSHNI

SEQ ID NO: 1754625 - protein, 23 aa, Staphylococcus epidermidis
QSASYFIKQWALDRIKEIQLETM

SEQ ID NO: 1754626 - protein, 24 aa, Staphylococcus epidermidis
QTINPLFILLFAPVVTLLWQKLGK

SEQ ID NO: 1754627 - protein, 25 aa, Staphylococcus epidermidis
QVNKELIPYIDPNSVKLYVSDPDGN

SEQ ID NO: 1754628 - protein, 22 aa, Staphylococcus epidermidis
RLIIFLILGLIFIGIGYYLAIK

SEQ ID NO: 1754629 - protein, 24 aa, Staphylococcus epidermidis
RLIIFLILGLIFIGIGYYLAIKPN

SEQ ID NO: 1754630 - protein, 18 aa, Staphylococcus epidermidis
RQNLFWAFGYNVAGIPIA

SEQ ID NO: 1754631 - protein, 19 aa, Staphylococcus epidermidis
SDIYSLFRKQSFRGNEYLN

SEQ ID NO: 1754632 - protein, 32 aa, Staphylococcus epidermidis
SFDPFTPLLVAALLYFLLTFALTRVMNFIEGR

SEQ ID NO: 1754633 - protein, 22 aa, Staphylococcus epidermidis
SKLIQTYLSKKTIRYGTASALT

SEQ ID NO: 1754634 - protein, 33 aa, Staphylococcus epidermidis
SKMKIAILSIIFVILLIGLFSFVAMAVFGNKYE

SEQ ID NO: 1754635 - protein, 17 aa, Staphylococcus epidermidis
SLLAIVGSLFIFGRRKK

SEQ ID NO: 1754636 - protein, 19 aa, Staphylococcus epidermidis
SLLPWFIITVPIVLLLGYQ

SEQ ID NO: 1754637 - protein, 22 aa, Staphylococcus epidermidis
SRLYYIILTIVIIAICVVVVIL

SEQ ID NO: 1754638 - protein, 17 aa, Staphylococcus epidermidis
TGLLMVYVFNPPAAWLN

SEQ ID NO: 1754639 - protein, 27 aa, Staphylococcus epidermidis
TGSVIKLNLTKWLSLQSDFVNGGKVNL

SEQ ID NO: 1754640 - protein, 24 aa, Staphylococcus epidermidis
TNNAITIIILITAIIFTIASTIFA

SEQ ID NO: 1754641 - protein, 23 aa, Staphylococcus epidermidis
TPFTWMMIIFSCLFLGTLIFTFF

SEQ ID NO: 1754642 - protein, 25 aa, Staphylococcus epidermidis
TPSQASEVFTPINPITITATDNSGK

SEQ ID NO: 1754643 - protein, 18 aa, Staphylococcus epidermidis
TQSTLKLNDKMKLLRDKL

SEQ ID NO: 1754644 - protein, 25 aa, Staphylococcus epidermidis
TTLFIISILVILAILFLIFDTNLFK

SEQ ID NO: 1754645 - protein, 26 aa, Staphylococcus epidermidis
VAILVAVLFFILFLIANHSKKKVKNQ

SEQ ID NO: 1754646 - protein, 26 aa, Staphylococcus epidermidis
VAILVAVLFFILFLVANHSKKKVKNQ

SEQ ID NO: 1754647 - protein, 23 aa, Staphylococcus epidermidis
VAILVAVLFFVLFLVANHSKKKV

SEQ ID NO: 1754648 - protein, 18 aa, Staphylococcus epidermidis
VEQTIYINPLRYSAKETN

SEQ ID NO: 1754649 - protein, 19 aa, Staphylococcus epidermidis
VFTQLGPLFLWTAKGLDNL

SEQ ID NO: 1754650 - protein, 21 aa, Staphylococcus epidermidis
VFVSFLILTIFIGGCGFINKE

SEQ ID NO: 1754651 - protein, 18 aa, Staphylococcus epidermidis
VGHIDPGNYFITVKFGDK

SEQ ID NO: 1754652 - protein, 25 aa, Staphylococcus epidermidis
VGIAIFTFIIWISLVQPGQFEPALV

SEQ ID NO: 1754653 - protein, 18 aa, Staphylococcus epidermidis
VGIYLAIILIICSSYLAF

SEQ ID NO: 1754654 - protein, 25 aa, Staphylococcus epidermidis
VIAALLIIFFRWGWADPLASVIVAI

SEQ ID NO: 1754655 - protein, 17 aa, Staphylococcus epidermidis
VMIIVYFIILLIIGFYG

SEQ ID NO: 1754656 - protein, 18 aa, Staphylococcus epidermidis
VMTVTYAGQTFTRNLTDW

SEQ ID NO: 1754657 - protein, 19 aa, Staphylococcus epidermidis
VRWILYIVALFLPIFIFYT

SEQ ID NO: 1754658 - protein, 17 aa, Staphylococcus epidermidis
VSIAVITFIIWIIFVHP

SEQ ID NO: 1754659 - protein, 24 aa, Staphylococcus epidermidis
YHIFRIFFILFVIAPLIGYFINVK

SEQ ID NO: 1754660 - protein, 25 aa, Staphylococcus epidermidis
YKFRFILIMFIIFLMAIMVLFISGL

SEQ ID NO: 1754661 - protein, 17 aa, Staphylococcus epidermidis
YSYLLNDLGYDATTVKE

SEQ ID NO: 1754662 - protein, 19 aa, Staphylococcus epidermidis
YVMIIVYFIILLIIGFYGY

SEQ ID NO: 1754663 - protein, 26 aa, Staphylococcus epidermidis
AAIIIVYLILVITFKGGLAPFTILFS

SEQ ID NO: 1754664 - protein, 19 aa, Staphylococcus epidermidis
ACGFIFYPITMIITKKYKE

SEQ ID NO: 1754665 - protein, 28 aa, Staphylococcus epidermidis
ADNKTIDSGFYKPIYNLGDYVWEDTNKD

SEQ ID NO: 1754666 - protein, 20 aa, Staphylococcus epidermidis
AFAGAIGPLSLGLGSIVRSI

SEQ ID NO: 1754667 - protein, 18 aa, Staphylococcus epidermidis
AFILLVVLLFAGMGLTYK

SEQ ID NO: 1754668 - protein, 23 aa, Staphylococcus epidermidis
AFNTLAHIVIWDTDQQPLVFELP

SEQ ID NO: 1754669 - protein, 26 aa, Staphylococcus epidermidis
AGVQNLIALVNYPGISTPLEVPVKVW

SEQ ID NO: 1754670 - protein, 24 aa, Staphylococcus epidermidis
AIIIYYIILYLLFLIAELVLLPAD

SEQ ID NO: 1754671 - protein, 18 aa, Staphylococcus epidermidis
AIILIIYIALQHAPFLKN

SEQ ID NO: 1754672 - protein, 18 aa, Staphylococcus epidermidis
AIIVIMFQLINHSGPFSK

SEQ ID NO: 1754673 - protein, 18 aa, Staphylococcus epidermidis
AIKHPLFEYARSFDFIII

SEQ ID NO: 1754674 - protein, 21 aa, Staphylococcus epidermidis
AILPSFYAWFNLWAMWDPYGN

SEQ ID NO: 1754675 - protein, 22 aa, Staphylococcus epidermidis
AIPFIILILLLIPFTSVILGTI

SEQ ID NO: 1754676 - protein, 22 aa, Staphylococcus epidermidis
AIPFIILILLLIPFTSVLLGTI

SEQ ID NO: 1754677 - protein, 20 aa, Staphylococcus epidermidis
AIRMLFHPFKPYYIFKMRIP

SEQ ID NO: 1754678 - protein, 32 aa, Staphylococcus epidermidis
AISLNTRLDSNRSFRFIGKVNLGNRYEGYSPD

SEQ ID NO: 1754679 - protein, 20 aa, Staphylococcus epidermidis
AITIIILITAIIFTIASTIF

SEQ ID NO: 1754680 - protein, 26 aa, Staphylococcus epidermidis
AIVMNPWFQFILATPVQFIIGWQFYV

SEQ ID NO: 1754681 - protein, 27 aa, Staphylococcus epidermidis
AIYVFRFIWVFLWYKDFYFPKNIQYYM

SEQ ID NO: 1754682 - protein, 37 aa, Staphylococcus epidermidis
AKPPKFLVRFWTLFVSFLMGLVLMTVLFFNNLGMVKL

SEQ ID NO: 1754683 - protein, 22 aa, Staphylococcus epidermidis
AKYALLDFTFLHTLNQFKQTVP

SEQ ID NO: 1754684 - protein, 22 aa, Staphylococcus epidermidis
ALFIMSVIVIIGFVLNMFIKHF

SEQ ID NO: 1754685 - protein, 20 aa, Staphylococcus epidermidis
ALFPILLIVPLFDILMYFNI

SEQ ID NO: 1754686 - protein, 28 aa, Staphylococcus epidermidis
ALLIPFIIMVFTAIALVAVWFIFNQLVA

SEQ ID NO: 1754687 - protein, 34 aa, Staphylococcus epidermidis
ALLIPFILMVLTAIALVIVWFIFNQIVAGIAAAI

SEQ ID NO: 1754688 - protein, 18 aa, Staphylococcus epidermidis
ALNGIQRLSKAKAKAIQY

SEQ ID NO: 1754689 - protein, 19 aa, Staphylococcus epidermidis
ALSFFIILTLIIGGFYILH

SEQ ID NO: 1754690 - protein, 17 aa, Staphylococcus epidermidis
ALSFIIFLGLTQINWFA

SEQ ID NO: 1754691 - protein, 19 aa, Staphylococcus epidermidis
ALWIVSIFAIIISLVALFK

SEQ ID NO: 1754692 - protein, 23 aa, Staphylococcus epidermidis
AMFIPLFFIFKYKQPMFGKLSSQ

SEQ ID NO: 1754693 - protein, 17 aa, Staphylococcus epidermidis
AMRYIVGKWVPIMGSWR

SEQ ID NO: 1754694 - protein, 23 aa, Staphylococcus epidermidis
ANANIRSYLLQNNPILAGVNGDV

SEQ ID NO: 1754695 - protein, 28 aa, Staphylococcus epidermidis
ANSIWAWLLVLVFLPLIGFILYLLLGRQ

SEQ ID NO: 1754696 - protein, 23 aa, Staphylococcus epidermidis
ANTILRWLSIFVIPLFGIIISKL

SEQ ID NO: 1754697 - protein, 23 aa, Staphylococcus epidermidis
APIMPIIIIPIISSLIVGLIFIF

SEQ ID NO: 1754698 - protein, 23 aa, Staphylococcus epidermidis
AQLTEALLAEPTIKKGKKKTNVP

SEQ ID NO: 1754699 - protein, 24 aa, Staphylococcus epidermidis
AQYKNQYPVIFVHGFVGLVGEDSF

SEQ ID NO: 1754700 - protein, 24 aa, Staphylococcus epidermidis
ASIMPIIIIPILSSLIVGLIFIFV

SEQ ID NO: 1754701 - protein, 32 aa, Staphylococcus epidermidis
ASSTWAWLFVLFILPIIGFILYLFLGRTVSKK

SEQ ID NO: 1754702 - protein, 30 aa, Staphylococcus epidermidis
ASSTWAWLFVLFVLPVIGFILYLFLGRTVS

SEQ ID NO: 1754703 - protein, 31 aa, Staphylococcus epidermidis
ASSTWAWLFVLFVLPVIGFILYLFLGRTVSK

SEQ ID NO: 1754704 - protein, 23 aa, Staphylococcus epidermidis
ATKRLPWLIVLTFLGMITATILG

SEQ ID NO: 1754705 - protein, 22 aa, Staphylococcus epidermidis
ATLTPDAYSQKGAISLNTRLDS

SEQ ID NO: 1754706 - protein, 41 aa, Staphylococcus epidermidis
ATNLKLRRIVPLGIIFFILILIVILFFLLKNFNSPEAQTKI

SEQ ID NO: 1754707 - protein, 17 aa, Staphylococcus epidermidis
AWFNLWAMWDPYGNTGH

SEQ ID NO: 1754708 - protein, 22 aa, Staphylococcus epidermidis
AYAFRQCTWWVYNRRLELGLPC

SEQ ID NO: 1754709 - protein, 25 aa, Staphylococcus epidermidis
CIFLLFALIFFLFTLPFSAFGLALG

SEQ ID NO: 1754710 - protein, 28 aa, Staphylococcus epidermidis
CLIVLLDWKLTVLILLISPVIFGIIFPL

SEQ ID NO: 1754711 - protein, 32 aa, Staphylococcus epidermidis
DADNKTIDSGFYKPTYNLGDYVWEDTNKDGIQ

SEQ ID NO: 1754712 - protein, 17 aa, Staphylococcus epidermidis
DGKFHGQKLNNVNLKYN

SEQ ID NO: 1754713 - protein, 17 aa, Staphylococcus epidermidis
DGKYQVMIVIPKNFSKL

SEQ ID NO: 1754714 - protein, 30 aa, Staphylococcus epidermidis
DGVPGGDGIGFAFSPGPLGQIGKEGAAVGI

SEQ ID NO: 1754715 - protein, 32 aa, Staphylococcus epidermidis
DGVVSNGFIVAVAIVLAIFGLAKKSRKDDDDQ

SEQ ID NO: 1754716 - protein, 17 aa, Staphylococcus epidermidis
DGWGFMFSKKDGDDFLK

SEQ ID NO: 1754717 - protein, 20 aa, Staphylococcus epidermidis
DGYQWDILFNSNHKGHEYMY

SEQ ID NO: 1754718 - protein, 28 aa, Staphylococcus epidermidis
DIQGGGVWRLFKIPENVNRIKVQFLPNN

SEQ ID NO: 1754719 - protein, 25 aa, Staphylococcus epidermidis
DIQNPALIMLLAGLGLLGLFRNKIR

SEQ ID NO: 1754720 - protein, 39 aa, Staphylococcus epidermidis
DKKKGGFMKILLPLIAAILILGAIAIFGGMALNNHNDSK

SEQ ID NO: 1754721 - protein, 18 aa, Staphylococcus epidermidis
DLNSIVINVIQKPTARKA

SEQ ID NO: 1754722 - protein, 26 aa, Staphylococcus epidermidis
DLQKDLWKYLSIVGVIVLFTVYLASR

SEQ ID NO: 1754723 - protein, 18 aa, Staphylococcus epidermidis
DLWRWDFGKLLIPFRIFL

SEQ ID NO: 1754724 - protein, 26 aa, Staphylococcus epidermidis
DNHSNNLDLLHQNRLQDKVVKQPTKG

SEQ ID NO: 1754725 - protein, 26 aa, Staphylococcus epidermidis
DSKGTLLGALFAGLGALLLGRRRKKD

SEQ ID NO: 1754726 - protein, 27 aa, Staphylococcus epidermidis
DSKGTLLGTLFAGLGALLLGRRRKKDN

SEQ ID NO: 1754727 - protein, 18 aa, Staphylococcus epidermidis
DTGFYLTPKYNVGDYVWE

SEQ ID NO: 1754728 - protein, 23 aa, Staphylococcus epidermidis
DTIIYLIILIFKRNWLDTRAFSK

SEQ ID NO: 1754729 - protein, 17 aa, Staphylococcus epidermidis
DYDLQEQRGYTDSEQHN

SEQ ID NO: 1754730 - protein, 17 aa, Staphylococcus epidermidis
EDKSNQQFPPRNAQRRK

SEQ ID NO: 1754731 - protein, 34 aa, Staphylococcus epidermidis
EEKKPTVWIVLLSIIFVLLIAAVLYGGYYAYNHY

SEQ ID NO: 1754732 - protein, 22 aa, Staphylococcus epidermidis
EEKQIFVSKLKALINRAHKQID

SEQ ID NO: 1754733 - protein, 19 aa, Staphylococcus epidermidis
EFFYKSYKFVDDVPSVLEI

SEQ ID NO: 1754734 - protein, 23 aa, Staphylococcus epidermidis
EFNNTYIPLPAIAKLVFNNVLTG

SEQ ID NO: 1754735 - protein, 25 aa, Staphylococcus epidermidis
EGDTFTIKYGQYIRPGGLELPAIKT

SEQ ID NO: 1754736 - protein, 26 aa, Staphylococcus epidermidis
EIIPSNYTWASYTKYNKLKETAQTVL

SEQ ID NO: 1754737 - protein, 35 aa, Staphylococcus epidermidis
EKGSKGILFGSLFAGLGALLLLFKRRRKDEDNNEK

SEQ ID NO: 1754738 - protein, 21 aa, Staphylococcus epidermidis
EKQIFVSKLKALINRAHKQID

SEQ ID NO: 1754739 - protein, 21 aa, Staphylococcus epidermidis
EKQIFVSKLKALINRTHKQID

SEQ ID NO: 1754740 - protein, 23 aa, Staphylococcus epidermidis
EKSRVLLIIFLILGLIFIGMGYY

SEQ ID NO: 1754741 - protein, 17 aa, Staphylococcus epidermidis
ELPLFVSGHFRNAMNNE

SEQ ID NO: 1754742 - protein, 23 aa, Staphylococcus epidermidis
ELPNSSEILLLNLTSRIIGKDVN

SEQ ID NO: 1754743 - protein, 27 aa, Staphylococcus epidermidis
ENGEGLPIDGWRFYWNQQSTGTTSDQW

SEQ ID NO: 1754744 - protein, 32 aa, Staphylococcus epidermidis; identical to SEQ ID NO: 1750767

SEQ ID NO: 1754745 - protein, 29 aa, Staphylococcus epidermidis
ENKGLLASIASILGLSGLATLFVNRKRKT

SEQ ID NO: 1754746 - protein, 27 aa, Staphylococcus epidermidis
ESSAIILLIFFIGIIVLSIWTQSYLIG

SEQ ID NO: 1754747 - protein, 25 aa, Staphylococcus epidermidis
ESSAIILLMFFIGIIVLSIWTQSYL

SEQ ID NO: 1754748 - protein, 21 aa, Staphylococcus epidermidis
ETFDSWMEVDYLDSYDSGAPN

SEQ ID NO: 1754749 - protein, 21 aa, Staphylococcus epidermidis
ETFDSWMEVDYLDSYDSGTPN

SEQ ID NO: 1754750 - protein, 24 aa, Staphylococcus epidermidis
EVNRFYYKFLNSAGKLRNKTTMDS

SEQ ID NO: 1754751 - protein, 23 aa, Staphylococcus epidermidis
EVSKILPVIEIKLAARNEIHQKA

SEQ ID NO: 1754752 - protein, 19 aa, Staphylococcus epidermidis
FAIFLMVVLVVLGGVYSSA

SEQ ID NO: 1754753 - protein, 23 aa, Staphylococcus epidermidis
FCFIFLLLLFFRYILKRYFNYML

SEQ ID NO: 1754754 - protein, 24 aa, Staphylococcus epidermidis
FCTFLAIILLFVWPPVFNAIVTFG

SEQ ID NO: 1754755 - protein, 24 aa, Staphylococcus epidermidis
FCTILAVILLLIWPPVFNGIVTFG

SEQ ID NO: 1754756 - protein, 18 aa, Staphylococcus epidermidis
FEITILNRKWWQSFHFYQ

SEQ ID NO: 1754757 - protein, 19 aa, Staphylococcus epidermidis
FFAFIFIILLINSATRYAV

SEQ ID NO: 1754758 - protein, 18 aa, Staphylococcus epidermidis
FFAFIFVILLINSSTRLA

SEQ ID NO: 1754759 - protein, 17 aa, Staphylococcus epidermidis
FFFLIFTFSMHVLFTNG

SEQ ID NO: 1754760 - protein, 31 aa, Staphylococcus epidermidis
FFIKSRINWILWILFLNIILLGVAYIDYEIS

SEQ ID NO: 1754761 - protein, 18 aa, Staphylococcus epidermidis
FFLMIMIIIIPLIRQRAF

SEQ ID NO: 1754762 - protein, 19 aa, Staphylococcus epidermidis
FFSVLPWFIITVPLVLLLG

SEQ ID NO: 1754763 - protein, 30 aa, Staphylococcus epidermidis
FGGGLIGFYLLKLFIPLISIVGVIIITILL

SEQ ID NO: 1754764 - protein, 19 aa, Staphylococcus epidermidis
FGVASITLGSALIIGAHQE

SEQ ID NO: 1754765 - protein, 19 aa, Staphylococcus epidermidis
FHGWPWYAVWLVLLGFGGG

SEQ ID NO: 1754766 - protein, 19 aa, Staphylococcus epidermidis
FIFLYLFWELTSFSSFLLI

SEQ ID NO: 1754767 - protein, 18 aa, Staphylococcus epidermidis
FIILLLLIFIINISNFKK

SEQ ID NO: 1754768 - protein, 22 aa, Staphylococcus epidermidis
FIILSIGVLLWILGIHPYIVFF

SEQ ID NO: 1754769 - protein, 19 aa, Staphylococcus epidermidis
FILLIVFFPLFYKLSHSDY

SEQ ID NO: 1754770 - protein, 17 aa, Staphylococcus epidermidis
FISLLINLIGITGALYL

SEQ ID NO: 1754771 - protein, 24 aa, Staphylococcus epidermidis
FISPIWFIFLFFYYKKYKTNAKAL

SEQ ID NO: 1754772 - protein, 19 aa, Staphylococcus epidermidis
FIVIILFLFNIRNFKFDDF

SEQ ID NO: 1754773 - protein, 20 aa, Staphylococcus epidermidis
FIWLPLLLLGIERLLRDFKV

SEQ ID NO: 1754774 - protein, 17 aa, Staphylococcus epidermidis
FLFKKLSWPYGLIIAAV

SEQ ID NO: 1754775 - protein, 21 aa, Staphylococcus epidermidis
FLFVAPLLFFIHAVLDGLAFL

SEQ ID NO: 1754776 - protein, 19 aa, Staphylococcus epidermidis
FLILVLVVFTLFTYKAPSG

SEQ ID NO: 1754777 - protein, 17 aa, Staphylococcus epidermidis
FLLGLFILGLVASLAIV

SEQ ID NO: 1754778 - protein, 18 aa, Staphylococcus epidermidis
FLLGLFILGLVASLAIVH

SEQ ID NO: 1754779 - protein, 17 aa, Staphylococcus epidermidis
FNNTYIPLPATAKLEFN

SEQ ID NO: 1754780 - protein, 27 aa, Staphylococcus epidermidis
FNQLYVVFKMIFWFNPALYISKTMMDN

SEQ ID NO: 1754781 - protein, 21 aa, Staphylococcus epidermidis
FPVLFLIIIFLFKKQIKKILT

SEQ ID NO: 1754782 - protein, 25 aa, Staphylococcus epidermidis
FSEFRIFLAVLITLLLIISISLVIA

SEQ ID NO: 1754783 - protein, 25 aa, Staphylococcus epidermidis
FSEFRIFLAVLLSLLLVISISLVIA

SEQ ID NO: 1754784 - protein, 24 aa, Staphylococcus epidermidis
FSFKLLFSLLIIGLILIALLIGAM

SEQ ID NO: 1754785 - protein, 32 aa, Staphylococcus epidermidis
FSIRKFNIGIFFALIATVTFLAHPGQASAAEL

SEQ ID NO: 1754786 - protein, 23 aa, Staphylococcus epidermidis
FSISILYIIYLLINIIISGINIP

SEQ ID NO: 1754787 - protein, 19 aa, Staphylococcus epidermidis
FSMIAIVTLILVIALNNRE

SEQ ID NO: 1754788 - protein, 24 aa, Staphylococcus epidermidis
FSPTLLVLLMYLISMMTAYVFYSY

SEQ ID NO: 1754789 - protein, 21 aa, Staphylococcus epidermidis
FSSVLIIFIILLSGLTFLPDL

SEQ ID NO: 1754790 - protein, 19 aa, Staphylococcus epidermidis
FSTVLIIFIILLSGLTFLP

SEQ ID NO: 1754791 - protein, 27 aa, Staphylococcus epidermidis
FTANLIFGIIFALLTVIFVVGIIFSKS

SEQ ID NO: 1754792 - protein, 17 aa, Staphylococcus epidermidis
FTLLMTLTIIFLVVILT

SEQ ID NO: 1754793 - protein, 22 aa, Staphylococcus epidermidis
FTPIKLRRRVWRRLARDLKPDQ

SEQ ID NO: 1754794 - protein, 20 aa, Staphylococcus epidermidis
FTQPIYKIQVGDTFPKGTWA

SEQ ID NO: 1754795 - protein, 21 aa, Staphylococcus epidermidis
FTQPIYKIQVGDTFPKGTWAG

SEQ ID NO: 1754796 - protein, 18 aa, Staphylococcus epidermidis
FVFLILIFFLVFTAQKLA

SEQ ID NO: 1754797 - protein, 17 aa, Staphylococcus epidermidis
FVSLFLVIWFPASPFVI

SEQ ID NO: 1754798 - protein, 22 aa, Staphylococcus epidermidis
FVSLIFAIPIILLSPLMGINLP

SEQ ID NO: 1754799 - protein, 17 aa, Staphylococcus epidermidis
FVVPFLVAWILDLILRR

SEQ ID NO: 1754800 - protein, 17 aa, Staphylococcus epidermidis
FYFAVIVGVISFIVWML

SEQ ID NO: 1754801 - protein, 22 aa, Staphylococcus epidermidis
FYIISIEIVFFYLSWDFMSHTL

SEQ ID NO: 1754802 - protein, 26 aa, Staphylococcus epidermidis
FYKFRFILIMFIIFLMAIMVLFISGL

SEQ ID NO: 1754803 - protein, 18 aa, Staphylococcus epidermidis
FYPIFMSIYWIVGSIYYF

SEQ ID NO: 1754804 - protein, 21 aa, Staphylococcus epidermidis
FYSLLPWFIITVPIVLLLGYQ

SEQ ID NO: 1754805 - protein, 24 aa, Staphylococcus epidermidis
GADNLTIDSGFYKTPKYSVGDYVW

SEQ ID NO: 1754806 - protein, 25 aa, Staphylococcus epidermidis
GADNLTIDSGFYKTPKYSVGDYVWE

SEQ ID NO: 1754807 - protein, 20 aa, Staphylococcus epidermidis
GAPWLFFFPGLLLGGYALLF

SEQ ID NO: 1754808 - protein, 17 aa, Staphylococcus epidermidis
GCFSIMFISFLLSMLIY

SEQ ID NO: 1754809 - protein, 22 aa, Staphylococcus epidermidis
GDTFTIKYGQYIRPGGLELPAI

SEQ ID NO: 1754810 - protein, 20 aa, Staphylococcus epidermidis
GEDSFDLYPNYWGGKKYNVK

SEQ ID NO: 1754811 - protein, 26 aa, Staphylococcus epidermidis
GFERLNHARPRALEYIKSLEKINNAQ

SEQ ID NO: 1754812 - protein, 22 aa, Staphylococcus epidermidis
GFFVFFFVFLISGIALLRERTK

SEQ ID NO: 1754813 - protein, 30 aa, Staphylococcus epidermidis; identical to SEQ ID NO: 1751102

SEQ ID NO: 1754814 - protein, 17 aa, Staphylococcus epidermidis
GFWWFYLFNALTGVLVF

SEQ ID NO: 1754815 - protein, 29 aa, Staphylococcus epidermidis
GGGLIGFYLLKLFIPLISIVGVIIITILL

SEQ ID NO: 1754816 - protein, 25 aa, Staphylococcus epidermidis
GIGGLNNAFGFKLDTYHNTSPPKSD

SEQ ID NO: 1754817 - protein, 25 aa, Staphylococcus epidermidis
GIGGLNNAFGFKLDTYHNTSTPKSD

SEQ ID NO: 1754818 - protein, 25 aa, Staphylococcus epidermidis
GIGGLNNAFGFKLDTYHNTSTPRSD

SEQ ID NO: 1754819 - protein, 22 aa, Staphylococcus epidermidis
GIIFIVLLIVLTLIFSIVHHYA

SEQ ID NO: 1754820 - protein, 17 aa, Staphylococcus epidermidis
GIIGWYMWSLWSLIIAL

SEQ ID NO: 1754821 - protein, 24 aa, Staphylococcus epidermidis
GIIGWYMWSLWSLIIALLPISLFF

SEQ ID NO: 1754822 - protein, 19 aa, Staphylococcus epidermidis
GIIVIIFQFVNHSGPFSGS

SEQ ID NO: 1754823 - protein, 17 aa, Staphylococcus epidermidis
GIVLYYLFAIVVAFLLL

SEQ ID NO: 1754824 - protein, 32 aa, Staphylococcus epidermidis
GKAVGFITLTGLLYGFWLVFAKRRKNEEEEEK

SEQ ID NO: 1754825 - protein, 39 aa, Staphylococcus epidermidis
GKKKGGLMKILLPLIAAVLILGAIAIFGGMALNNHNDSK

SEQ ID NO: 1754826 - protein, 24 aa, Staphylococcus epidermidis
GLATIIASVLLAAGSLLAFRRTSN

SEQ ID NO: 1754827 - protein, 17 aa, Staphylococcus epidermidis
GLGFIIFGVCMKPVMDP

SEQ ID NO: 1754828 - protein, 24 aa, Staphylococcus epidermidis
GLTPIFFFLIFTFLMHILFTNGGK

SEQ ID NO: 1754829 - protein, 20 aa, Staphylococcus epidermidis
GLTPIFFFLIFTFSMHVLFT

SEQ ID NO: 1754830 - protein, 24 aa, Staphylococcus epidermidis
GMLPFLMLFILSVKFKLLPTRMIL

SEQ ID NO: 1754831 - protein, 21 aa, Staphylococcus epidermidis
GQFTLFFMHLSKILKQGKIKA

SEQ ID NO: 1754832 - protein, 22 aa, Staphylococcus epidermidis
GQLTLFFWFFKLHYSFGHIINS

SEQ ID NO: 1754833 - protein, 26 aa, Staphylococcus epidermidis
GSIWAWLLVLVILPIVGFILYLLLGR

SEQ ID NO: 1754834 - protein, 22 aa, Staphylococcus epidermidis
GSSLKPFLAYGPAIENMQWATN

SEQ ID NO: 1754835 - protein, 24 aa, Staphylococcus epidermidis
GTASALTLALYLFSGNASAHAEQN

SEQ ID NO: 1754836 - protein, 17 aa, Staphylococcus epidermidis
GTFIALWFQFRKDDKDK

SEQ ID NO: 1754837 - protein, 25 aa, Staphylococcus epidermidis
GTIVAIIVILLFLRNIRTTAISVVS

SEQ ID NO: 1754838 - protein, 20 aa, Staphylococcus epidermidis
GTWVGYYKHLENGEGLPIDG

SEQ ID NO: 1754839 - protein, 20 aa, Staphylococcus epidermidis
GWFSWVFLLILTIITMFIAL

SEQ ID NO: 1754840 - protein, 18 aa, Staphylococcus epidermidis
GYSYVGTDALKAPNYTET

SEQ ID NO: 1754841 - protein, 32 aa, Staphylococcus epidermidis
HAKPPVFLVRFWTLFASFLIGLALMGVLLFNN

SEQ ID NO: 1754842 - protein, 17 aa, Staphylococcus epidermidis
HGQKLNNVNLKYNASNQ

SEQ ID NO: 1754843 - protein, 26 aa, Staphylococcus epidermidis
HHNSLIETIWFVVPILIVIALAVPTV

SEQ ID NO: 1754844 - protein, 23 aa, Staphylococcus epidermidis
HIFRIFFILFVIAPLIGYFINIR

SEQ ID NO: 1754845 - protein, 22 aa, Staphylococcus epidermidis
HIFRIFFILFVIAPLIGYFLKY

SEQ ID NO: 1754846 - protein, 42 aa, Staphylococcus epidermidis
HIINVIISFFKKHWPKLLIIIGIILLLLILNAIFTTVNKNDH

SEQ ID NO: 1754847 - protein, 37 aa, Staphylococcus epidermidis
HKRIQYTIITLLVLLIVIFLLYMFTPLSKISNVNVKG

SEQ ID NO: 1754848 - protein, 29 aa, Staphylococcus epidermidis
HLENGEGLPIDGWKFYWNQQSTGTTSDQW

SEQ ID NO: 1754849 - protein, 20 aa, Staphylococcus epidermidis
HLYFINWKYAIFIKYNLGYS

SEQ ID NO: 1754850 - protein, 25 aa, Staphylococcus epidermidis
HSAWRYFMLIFYLVPYVLFGGLMYV

SEQ ID NO: 1754851 - protein, 21 aa, Staphylococcus epidermidis
IAFTLIWFLLGIPVGPGGPIK

SEQ ID NO: 1754852 - protein, 18 aa, Staphylococcus epidermidis
IAIKFIALLLVIPGWLTL

SEQ ID NO: 1754853 - protein, 21 aa, Staphylococcus epidermidis
IALIYLFMLGFYRLPGLVAII

SEQ ID NO: 1754854 - protein, 27 aa, Staphylococcus epidermidis
IASAIVGSALGLYYKNKVYKKTDELRD

SEQ ID NO: 1754855 - protein, 17 aa, Staphylococcus epidermidis
IAVIAIILIIYIALQHA

SEQ ID NO: 1754856 - protein, 29 aa, Staphylococcus epidermidis
IDFILRWKRYFILGVVGIIIAILTLTNKD

SEQ ID NO: 1754857 - protein, 19 aa, Staphylococcus epidermidis
IDMIDRIPPVAPKANSITT

SEQ ID NO: 1754858 - protein, 20 aa, Staphylococcus epidermidis
IDSGFYKPTYNLGDYVWEDT

SEQ ID NO: 1754859 - protein, 18 aa, Staphylococcus epidermidis
IFFAIIIVLAIVGLVRLC

SEQ ID NO: 1754860 - protein, 19 aa, Staphylococcus epidermidis
IFFIVVLVVLIVLVGLIGF

SEQ ID NO: 1754861 - protein, 26 aa, Staphylococcus epidermidis
IFGIPVFLFLNLLIVFLCIIVGSVLA

SEQ ID NO: 1754862 - protein, 26 aa, Staphylococcus epidermidis
IFLESFLFFSGFYYPLYLAGQGKMVH

SEQ ID NO: 1754863 - protein, 24 aa, Staphylococcus epidermidis
IFNFWLYLILYWLIPILTTFQIIR

SEQ ID NO: 1754864 - protein, 18 aa, Staphylococcus epidermidis
IFPVFMVMIIGLISFYAI

SEQ ID NO: 1754865 - protein, 23 aa, Staphylococcus epidermidis
IFVPLAIILLIAGAWYGLKLNKE

SEQ ID NO: 1754866 - protein, 21 aa, Staphylococcus epidermidis
IFVSFLILTIFIGGCGFINKE

SEQ ID NO: 1754867 - protein, 18 aa, Staphylococcus epidermidis
IGFIILLSLVLYFQQLTK

SEQ ID NO: 1754868 - protein, 23 aa, Staphylococcus epidermidis
IGIALFIFLIVRPPIEYIRQYLA

SEQ ID NO: 1754869 - protein, 24 aa, Staphylococcus epidermidis
IGMFIMIVILAVYFIAMNYLNPSG

SEQ ID NO: 1754870 - protein, 17 aa, Staphylococcus epidermidis
IGPLSLGLGSIVRSIGG

SEQ ID NO: 1754871 - protein, 21 aa, Staphylococcus epidermidis
IGTFIFLILSLSRLNKLKLKR

SEQ ID NO: 1754872 - protein, 17 aa, Staphylococcus epidermidis
IHKIKPITIIKPQALNE

SEQ ID NO: 1754873 - protein, 18 aa, Staphylococcus epidermidis
IICSIYLAFILIGSLNGK

SEQ ID NO: 1754874 - protein, 18 aa, Staphylococcus epidermidis
IIFLGLTQINWFAVIALS

SEQ ID NO: 1754875 - protein, 24 aa, Staphylococcus epidermidis
IIGIAIILLLIIAAFIVKQVNGSG

SEQ ID NO: 1754876 - protein, 26 aa, Staphylococcus epidermidis
IIHFANWRWIFFINIFIVIIAVPLMN

SEQ ID NO: 1754877 - protein, 17 aa, Staphylococcus epidermidis
IIIFFYSKVRWYSIVIV

SEQ ID NO: 1754878 - protein, 22 aa, Staphylococcus epidermidis
IIILIISLILAVVFFFGLKTYQ

SEQ ID NO: 1754879 - protein, 25 aa, Staphylococcus epidermidis
IIIMIVLLTIMIFGVIWLFKDKGQN

SEQ ID NO: 1754880 - protein, 20 aa, Staphylococcus epidermidis
IIIMIVLLTIMILGGIWLFK

SEQ ID NO: 1754881 - protein, 18 aa, Staphylococcus epidermidis
IILIILITILTFILICGY

SEQ ID NO: 1754882 - protein, 24 aa, Staphylococcus epidermidis
IIMIVLLTIMILGVIWLFKDKGQN

SEQ ID NO: 1754883 - protein, 17 aa, Staphylococcus epidermidis
IIVLFIFIKYKSLLTRT

SEQ ID NO: 1754884 - protein, 18 aa, Staphylococcus epidermidis
IIYLFMLGFYRLPGLVAI

SEQ ID NO: 1754885 - protein, 17 aa, Staphylococcus epidermidis
IKEGDTFTIKYGQYIRP

SEQ ID NO: 1754886 - protein, 26 aa, Staphylococcus epidermidis
IKKNWKLLVIIPLIFLILSAIFTFFL

SEQ ID NO: 1754887 - protein, 32 aa, Staphylococcus epidermidis
IKYNKPYFYKGILLILLVCLIIASITGYGIKS

SEQ ID NO: 1754888 - protein, 18 aa, Staphylococcus epidermidis
ILCYLGFQFGLKKRDEML

SEQ ID NO: 1754889 - protein, 17 aa, Staphylococcus epidermidis
ILDAIIVLSFIVVLPIT

SEQ ID NO: 1754890 - protein, 25 aa, Staphylococcus epidermidis
ILEFATWHWLFFINIPIAIIAIILV

SEQ ID NO: 1754891 - protein, 18 aa, Staphylococcus epidermidis
ILFITFISLLINLIGITG

SEQ ID NO: 1754892 - protein, 27 aa, Staphylococcus epidermidis
ILISGVIFIIFVLLPASWFTGLVTNKT

SEQ ID NO: 1754893 - protein, 26 aa, Staphylococcus epidermidis
ILITKVVVLTLFGLGFIIFGVCMKPV

SEQ ID NO: 1754894 - protein, 20 aa, Staphylococcus epidermidis
ILNVFVFNYFFTVPRFTLEM

SEQ ID NO: 1754895 - protein, 27 aa, Staphylococcus epidermidis
ILVIILIAIGILFYMRSNKRNSVGKVE

SEQ ID NO: 1754896 - protein, 17 aa, Staphylococcus epidermidis
ILYLLLIISITLFVPVE

SEQ ID NO: 1754897 - protein, 19 aa, Staphylococcus epidermidis
IMIIVCIVLVIMMFVGGKK

SEQ ID NO: 1754898 - protein, 17 aa, Staphylococcus epidermidis
IMYFIIWIGLGSLWMKL

SEQ ID NO: 1754899 - protein, 21 aa, Staphylococcus epidermidis
INFFIPFLLIFIIDGFKGIKE

SEQ ID NO: 1754900 - protein, 23 aa, Staphylococcus epidermidis
INVFFLYFWIFKVTKTQTKKSAK

SEQ ID NO: 1754901 - protein, 23 aa, Staphylococcus epidermidis
IPFTWMMIIFSCLFLGTLIFTFF

SEQ ID NO: 1754902 - protein, 17 aa, Staphylococcus epidermidis
IPYLIFVSLWVLLIYSP

SEQ ID NO: 1754903 - protein, 33 aa, Staphylococcus epidermidis
IQTNYQRILQLQDGYRYYSFIDTIGVYSGSHLY

SEQ ID NO: 1754904 - protein, 17 aa, Staphylococcus epidermidis
ISAMVIGILCLMISHWF

SEQ ID NO: 1754905 - protein, 17 aa, Staphylococcus epidermidis
ISFSYWIRLLQAHPYQL

SEQ ID NO: 1754906 - protein, 26 aa, Staphylococcus epidermidis
ISIGNWRWIFWINIPFIFIGLIGCLL

SEQ ID NO: 1754907 - protein, 24 aa, Staphylococcus epidermidis
ISLIFAIIIVLFIQSFIIIGAVIP

SEQ ID NO: 1754908 - protein, 32 aa, Staphylococcus epidermidis
ISTPLEVPVKVWVYNFDFTQPIYKIQVGDTFP

SEQ ID NO: 1754909 - protein, 18 aa, Staphylococcus epidermidis
IVIVAMILLLIKYRYIFK

SEQ ID NO: 1754910 - protein, 30 aa, Staphylococcus epidermidis
IVKRSALPIAIVALIVGIMFIWKSRRKHKH

SEQ ID NO: 1754911 - protein, 18 aa, Staphylococcus epidermidis
IVLPLIIIIILFTVLYSV

SEQ ID NO: 1754912 - protein, 28 aa, Staphylococcus epidermidis
IVTLATFVILIILLKKFAWGPLKEVMDK

SEQ ID NO: 1754913 - protein, 20 aa, Staphylococcus epidermidis
IWSQYLIGLLLTAGFFFTIS

SEQ ID NO: 1754914 - protein, 19 aa, Staphylococcus epidermidis
IWWVLLINILIALSALAMG

SEQ ID NO: 1754915 - protein, 20 aa, Staphylococcus epidermidis
IYFFVFRFLILKFDIPLPGR

SEQ ID NO: 1754916 - protein, 17 aa, Staphylococcus epidermidis
IYIIILFLFIRIFGEAF

SEQ ID NO: 1754917 - protein, 17 aa, Staphylococcus epidermidis
IYPLAITLILLALLSPL

SEQ ID NO: 1754918 - protein, 20 aa, Staphylococcus epidermidis
KAFIPLLWLLDVPTQLAPGI

SEQ ID NO: 1754919 - protein, 18 aa, Staphylococcus epidermidis
KALYDLWRWDFGKLLIPF

SEQ ID NO: 1754920 - protein, 30 aa, Staphylococcus epidermidis
KASINEIELLKTMGLPFLSKNEIQENVTEK

SEQ ID NO: 1754921 - protein, 26 aa, Staphylococcus epidermidis
KDIQNPALIMLLAGLGLLGLFRNKIR

SEQ ID NO: 1754922 - protein, 31 aa, Staphylococcus epidermidis
KELLYVALRISLIKVLKPYYPFPIIVDDAFV

SEQ ID NO: 1754923 - protein, 26 aa, Staphylococcus epidermidis
KFIALLLVIPGWLTLWIAILSDMGAT

SEQ ID NO: 1754924 - protein, 24 aa, Staphylococcus epidermidis
KGDSKIIIVKRFKNIWKANEQISG

SEQ ID NO: 1754925 - protein, 38 aa, Staphylococcus epidermidis
KGEDGVVSNGFIVAVAIVLAIFGLAKKSRKDDDDQDGS

SEQ ID NO: 1754926 - protein, 25 aa, Staphylococcus epidermidis
KGHEYMYYWFGLPSDQTPTGPVTFT

SEQ ID NO: 1754927 - protein, 27 aa, Staphylococcus epidermidis
KHICVMIFLVFFLIGFIILLSLVFYFQ

SEQ ID NO: 1754928 - protein, 22 aa, Staphylococcus epidermidis
KKDDLILLVGFGGGLAYASTLI

SEQ ID NO: 1754929 - protein, 24 aa, Staphylococcus epidermidis
KKHSTLLYSTLLIVFGYLSVFVNG

SEQ ID NO: 1754930 - protein, 31 aa, Staphylococcus epidermidis
KKNDKYYFQITLENASWWKSFQFFDESETEL

SEQ ID NO: 1754931 - protein, 23 aa, Staphylococcus epidermidis
KKQWLQYVFLISTILIALGTLWL

SEQ ID NO: 1754932 - protein, 26 aa, Staphylococcus epidermidis
KKVDFLPNKLNKYSIRKFTVGTASIL

SEQ ID NO: 1754933 - protein, 23 aa, Staphylococcus epidermidis
KLPNFLFLFLMLSMIIYFSFITL

SEQ ID NO: 1754934 - protein, 17 aa, Staphylococcus epidermidis
KMRFIPYLIFVGLWVVF

SEQ ID NO: 1754935 - protein, 35 aa, Staphylococcus epidermidis
KNKQVKLKLWQLILLLLAVIILTAGITVAATILIS

SEQ ID NO: 1754936 - protein, 23 aa, Staphylococcus epidermidis
KNKYYIIVFVFIFLLSSILNGLS

SEQ ID NO: 1754937 - protein, 23 aa, Staphylococcus epidermidis
KNLYLTFLLLFVTIILFVTVIQN

SEQ ID NO: 1754938 - protein, 24 aa, Staphylococcus epidermidis
KNLYLTFLLLFVTIILFVTVVHYA

SEQ ID NO: 1754939 - protein, 17 aa, Staphylococcus epidermidis
KNQIQAIFDRKQSKFET

SEQ ID NO: 1754940 - protein, 24 aa, Staphylococcus epidermidis
KNYKLYYLSLWYFITFGAFVAFGL

SEQ ID NO: 1754941 - protein, 23 aa, Staphylococcus epidermidis
KPLWIIISFALLIGILLLPTPAG

SEQ ID NO: 1754942 - protein, 18 aa, Staphylococcus epidermidis
KPVYLTHTWTTNDGAIAE

SEQ ID NO: 1754943 - protein, 20 aa, Staphylococcus epidermidis
KPVYLTHTWTTNDGAIAEES

SEQ ID NO: 1754944 - protein, 19 aa, Staphylococcus epidermidis
KPYYIFKMRIPFTPGLIPK

SEQ ID NO: 1754945 - protein, 18 aa, Staphylococcus epidermidis
KQEWFIVLSLLFIFPLGL

SEQ ID NO: 1754946 - protein, 25 aa, Staphylococcus epidermidis
KQHWMPVAVVLMSLGGALIFMARRK

SEQ ID NO: 1754947 - protein, 19 aa, Staphylococcus epidermidis
KRKIAFISFLLLLTLFVLF

SEQ ID NO: 1754948 - protein, 26 aa, Staphylococcus epidermidis
KRLEFYRLYLLMVHLLKFGGMYAASV

SEQ ID NO: 1754949 - protein, 24 aa, Staphylococcus epidermidis
KRNKLIISAILSLPLLLVMVVHIS

SEQ ID NO: 1754950 - protein, 26 aa, Staphylococcus epidermidis
KRQKFLRIGFIVLTILAAALSIFSFF

SEQ ID NO: 1754951 - protein, 17 aa, Staphylococcus epidermidis
KRWLFISSTLIKQTVRS

SEQ ID NO: 1754952 - protein, 21 aa, Staphylococcus epidermidis
KSGFFFLLGIIQALIVSIGDL

SEQ ID NO: 1754953 - protein, 26 aa, Staphylococcus epidermidis
KSIISFIAAILLIIGSIFILRREKRR

SEQ ID NO: 1754954 - protein, 24 aa, Staphylococcus epidermidis
KSNILSVLLLGFGFLSYSRKRKEK

SEQ ID NO: 1754955 - protein, 20 aa, Staphylococcus epidermidis
KSYYIIFLLCALVGILAGVP

SEQ ID NO: 1754956 - protein, 22 aa, Staphylococcus epidermidis
KTLGALIVGAFALLETLSKVIA

SEQ ID NO: 1754957 - protein, 28 aa, Staphylococcus epidermidis
KTTALVGGAFTFNMLNNHQAFAASETPI

SEQ ID NO: 1754958 - protein, 31 aa, Staphylococcus epidermidis
KTVGVITLTGLLSSFWLVLAKRRKKEEEEKQ

SEQ ID NO: 1754959 - protein, 27 aa, Staphylococcus epidermidis
KVIITILILLIIFFGVMYFISSRANVD

SEQ ID NO: 1754960 - protein, 29 aa, Staphylococcus epidermidis
KVKIIVLSLIFVLLLASLIGFIGMGLFGN

SEQ ID NO: 1754961 - protein, 24 aa, Staphylococcus epidermidis
KVNKYSIRKFTVGTASILVGATLM

SEQ ID NO: 1754962 - protein, 19 aa, Staphylococcus epidermidis
KVVLRYWPFNRWGGSFNPG

SEQ ID NO: 1754963 - protein, 20 aa, Staphylococcus epidermidis
KVVLRYWPFNRWGGSFNPGT

SEQ ID NO: 1754964 - protein, 18 aa, Staphylococcus epidermidis
KWIVIIVSIVILIGSIGL

SEQ ID NO: 1754965 - protein, 20 aa, Staphylococcus epidermidis
KYQVMIVIPKNFSKLAMQLD

SEQ ID NO: 1754966 - protein, 17 aa, Staphylococcus epidermidis
KYSIRKFTVGTASILLG

SEQ ID NO: 1754967 - protein, 25 aa, Staphylococcus epidermidis
LAAALSIFSFFTANLIFGIIFALLT

SEQ ID NO: 1754968 - protein, 22 aa, Staphylococcus epidermidis
LAFVLLVFVFRSILVPLKAVLG

SEQ ID NO: 1754969 - protein, 18 aa, Staphylococcus epidermidis
LAIIGLLIVFVVTGFIFF

SEQ ID NO: 1754970 - protein, 24 aa, Staphylococcus epidermidis
LALLIFTIIYFLIVLYLCLNPNKM

SEQ ID NO: 1754971 - protein, 23 aa, Staphylococcus epidermidis
LDGKFHGQKLNNVNLKYNASNQT

SEQ ID NO: 1754972 - protein, 23 aa, Staphylococcus epidermidis
LEFASWHWLFYINIPIAILAIIL

SEQ ID NO: 1754973 - protein, 24 aa, Staphylococcus epidermidis
LEQQKTRVKLYKSGKSWVKASINE

SEQ ID NO: 1754974 - protein, 25 aa, Staphylococcus epidermidis
LEQQKTRVKLYKSGKSWVKASINEI

SEQ ID NO: 1754975 - protein, 25 aa, Staphylococcus epidermidis
LFALSFFIILTLITGGFYILHENKR

SEQ ID NO: 1754976 - protein, 19 aa, Staphylococcus epidermidis
LFFLMIMIIIIPLIRQRAF

SEQ ID NO: 1754977 - protein, 17 aa, Staphylococcus epidermidis
LFGLNELNSIFINITQK

SEQ ID NO: 1754978 - protein, 25 aa, Staphylococcus epidermidis
LFGSIFFLFMLDWETALIALISIPM

SEQ ID NO: 1754979 - protein, 26 aa, Staphylococcus epidermidis
LFIFVFILVNILLVMIYIDKVNKAQI

SEQ ID NO: 1754980 - protein, 18 aa, Staphylococcus epidermidis
LFLAWFFIYFPWGRTGVK

SEQ ID NO: 1754981 - protein, 18 aa, Staphylococcus epidermidis
LFTLSLVLLSFSLLPTLI

SEQ ID NO: 1754982 - protein, 18 aa, Staphylococcus epidermidis
LFVRSRINWIMWIIFLNL

SEQ ID NO: 1754983 - protein, 24 aa, Staphylococcus epidermidis
LFWAFLIVFLLIFIILQIRIFTIS

SEQ ID NO: 1754984 - protein, 17 aa, Staphylococcus epidermidis
LGNRYEGYSPDGVAGGD

SEQ ID NO: 1754985 - protein, 24 aa, Staphylococcus epidermidis
LGNRYEGYSPDGVPGGDGIGFAFS

SEQ ID NO: 1754986 - protein, 24 aa, Staphylococcus epidermidis
LHPVLFIFFIFIFANSWRHTHFSK

SEQ ID NO: 1754987 - protein, 18 aa, Staphylococcus epidermidis
LIAIIIAVLLLFLVNTFL

SEQ ID NO: 1754988 - protein, 32 aa, Staphylococcus epidermidis
LIAIPLVMLLAPFLFDWTWSQSVYRGLVLLVA

SEQ ID NO: 1754989 - protein, 19 aa, Staphylococcus epidermidis
LIFAFILLKTHIGISVIGS

SEQ ID NO: 1754990 - protein, 23 aa, Staphylococcus epidermidis
LIFNALIIVLLIPIAMKGVKFKG

SEQ ID NO: 1754991 - protein, 23 aa, Staphylococcus epidermidis
LIFNALIIVLLIPIAMKGVQFKG

SEQ ID NO: 1754992 - protein, 19 aa, Staphylococcus epidermidis
LIGFIILLSLVFYFQQLTK

SEQ ID NO: 1754993 - protein, 18 aa, Staphylococcus epidermidis
LIGLLLTAGFFFTISSKF

SEQ ID NO: 1754994 - protein, 24 aa, Staphylococcus epidermidis
LIIGLLIYNLLILPLFIPSMVATF

SEQ ID NO: 1754995 - protein, 18 aa, Staphylococcus epidermidis
LIIIFSIIIIASNDTFAE

SEQ ID NO: 1754996 - protein, 20 aa, Staphylococcus epidermidis
LIILIFILLVAIVNIVVSII

SEQ ID NO: 1754997 - protein, 20 aa, Staphylococcus epidermidis
LIIPILFFIIAIMMFARRNK

SEQ ID NO: 1754998 - protein, 20 aa, Staphylococcus epidermidis
LILIFLFLVFHLIRLASKIN

SEQ ID NO: 1754999 - protein, 20 aa, Staphylococcus epidermidis
LILIIVLFIFIKYKSLLTRT

SEQ ID NO: 1755000 - protein, 20 aa, Staphylococcus epidermidis
LIVYIIPKFFKAIPAPLIAI

SEQ ID NO: 1755001 - protein, 17 aa, Staphylococcus epidermidis
LIYPLFSVSITGLLMVY

SEQ ID NO: 1755002 - protein, 26 aa, Staphylococcus epidermidis
LLFIFPLGLFLMWKFSKWPSIARTII

SEQ ID NO: 1755003 - protein, 26 aa, Staphylococcus epidermidis
LLFIFPLGLFLMWRYAHWKIWLKLVV

SEQ ID NO: 1755004 - protein, 20 aa, Staphylococcus epidermidis
LLILFFYLFSDGLRDAFDPK

SEQ ID NO: 1755005 - protein, 24 aa, Staphylococcus epidermidis
LLIMIAWLFIFILMKAGLTQVNQL

SEQ ID NO: 1755006 - protein, 19 aa, Staphylococcus epidermidis
LLLLFFPFYHLIDKHHLVF

SEQ ID NO: 1755007 - protein, 22 aa, Staphylococcus epidermidis
LLLLITIVFIPLFIICSHSLRK

SEQ ID NO: 1755008 - protein, 25 aa, Staphylococcus epidermidis
LLRYYFWITILIVILIVGLIAWLFD

SEQ ID NO: 1755009 - protein, 22 aa, Staphylococcus epidermidis
LLSYIFFVIFTPLVAFMLMRIM

SEQ ID NO: 1755010 - protein, 17 aa, Staphylococcus epidermidis
LMFLLFSLLMIGLIFGV

SEQ ID NO: 1755011 - protein, 17 aa, Staphylococcus epidermidis
LMILLTVVLYYGSKRLQ

SEQ ID NO: 1755012 - protein, 18 aa, Staphylococcus epidermidis
LMLFFELLVLFIVVSFIV

SEQ ID NO: 1755013 - protein, 23 aa, Staphylococcus epidermidis
LNFWTWMMIIPFLTSAILIGPLI

SEQ ID NO: 1755014 - protein, 21 aa, Staphylococcus epidermidis
LNIPDIKRPWLPPLPEIVYQS

SEQ ID NO: 1755015 - protein, 25 aa, Staphylococcus epidermidis
LNSKLIWLILPLLLIQLAFNNWYWI

SEQ ID NO: 1755016 - protein, 20 aa, Staphylococcus epidermidis
LNYSSPFMSLLSMPADSSSN

SEQ ID NO: 1755017 - protein, 23 aa, Staphylococcus epidermidis
LPIFSILFFLAAWFFARKPSKIL

SEQ ID NO: 1755018 - protein, 19 aa, Staphylococcus epidermidis
LPILLLAVMWFFLIRPQQK

SEQ ID NO: 1755019 - protein, 32 aa, Staphylococcus epidermidis
LPKFLTLFAGPLFNFILALVLFIGLAYYQGTP

SEQ ID NO: 1755020 - protein, 37 aa, Staphylococcus epidermidis
LRKYNNKLIAVTISSLALAAPLAFGNASAHAAQTNDN

SEQ ID NO: 1755021 - protein, 18 aa, Staphylococcus epidermidis
LRYGTASALTLALYLFNS

SEQ ID NO: 1755022 - protein, 22 aa, Staphylococcus epidermidis
LRYYFWMTIIIIMLLVGVIAWL

SEQ ID NO: 1755023 - protein, 26 aa, Staphylococcus epidermidis
LSAPLLLMMFVHLLPLHLPAIVMNPW

SEQ ID NO: 1755024 - protein, 17 aa, Staphylococcus epidermidis
LSIAIIGIFLGVTGLYI

SEQ ID NO: 1755025 - protein, 19 aa, Staphylococcus epidermidis
LSIIGVIVLFTVYLASRSI

SEQ ID NO: 1755026 - protein, 18 aa, Staphylococcus epidermidis
LSIMFFLDVKLTIAAIFI

SEQ ID NO: 1755027 - protein, 28 aa, Staphylococcus epidermidis
LSVILVITIVISFLFYFITTEKKVDKDT

SEQ ID NO: 1755028 - protein, 20 aa, Staphylococcus epidermidis
LTAIANVQPILVKKPAANDV

SEQ ID NO: 1755029 - protein, 17 aa, Staphylococcus epidermidis
LTIMILGVIWLFKDKGQ

SEQ ID NO: 1755030 - protein, 18 aa, Staphylococcus epidermidis
LTLALYLFNSNVTVYADE

SEQ ID NO: 1755031 - protein, 20 aa, Staphylococcus epidermidis
LTLFFWFFKLHYSFGHIINS

SEQ ID NO: 1755032 - protein, 17 aa, Staphylococcus epidermidis
LTLIFFFLVFTFSMHVL

SEQ ID NO: 1755033 - protein, 23 aa, Staphylococcus epidermidis
LTLTTIIFVIFFSFKYIYGDFRN

SEQ ID NO: 1755034 - protein, 19 aa, Staphylococcus epidermidis
LTPKYNVGDYVWEDTNKDG

SEQ ID NO: 1755035 - protein, 24 aa, Staphylococcus epidermidis
LVGGAFTFNMLNNHQAFAASETPI

SEQ ID NO: 1755036 - protein, 23 aa, Staphylococcus epidermidis
LVGGAFTFNMLNNHQALAASETP

SEQ ID NO: 1755037 - protein, 23 aa, Staphylococcus epidermidis
LVGHIDPGNYFITVKFGDKVEQF

SEQ ID NO: 1755038 - protein, 18 aa, Staphylococcus epidermidis
LVIAIPLAIVVIVVGGWY

SEQ ID NO: 1755039 - protein, 24 aa, Staphylococcus epidermidis
LVICSCYLAFILIGSLQGKDMSNS

SEQ ID NO: 1755040 - protein, 26 aa, Staphylococcus epidermidis
LVILSISILLLMGFILYFHHLTSEAS

SEQ ID NO: 1755041 - protein, 22 aa, Staphylococcus epidermidis
LVLISYLLFLLSGLANGLIKMN

SEQ ID NO: 1755042 - protein, 20 aa, Staphylococcus epidermidis
LVLVLIIMTLFLNFAPYGKQ

SEQ ID NO: 1755043 - protein, 27 aa, Staphylococcus epidermidis
LVVIAIFIIFLILLFMFVNLSDEDTGQ

SEQ ID NO: 1755044 - protein, 17 aa, Staphylococcus epidermidis
LYILLAIQWIYSVILLV

SEQ ID NO: 1755045 - protein, 23 aa, Staphylococcus epidermidis
LYTLIWFFIGIVIYLLYGLKHSK

SEQ ID NO: 1755046 - protein, 19 aa, Staphylococcus epidermidis
MDDARALLNGIERLKDAQT

SEQ ID NO: 1755047 - protein, 17 aa, Staphylococcus epidermidis
MFIGFLVTCLYFEFAGN

SEQ ID NO: 1755048 - protein, 19 aa, Staphylococcus epidermidis
MHRSLLSLSIAIIGIFLGV

SEQ ID NO: 1755049 - protein, 17 aa, Staphylococcus epidermidis
MIIVCIVLVIMMFVGGK

SEQ ID NO: 1755050 - protein, 17 aa, Staphylococcus epidermidis
MILLLIKYRYIFKLQTG

SEQ ID NO: 1755051 - protein, 21 aa, Staphylococcus epidermidis
MILTLWIVPWLSAKRARTLKQ

SEQ ID NO: 1755052 - protein, 18 aa, Staphylococcus epidermidis
MKLSKFKPLSWLASIYIE

SEQ ID NO: 1755053 - protein, 17 aa, Staphylococcus epidermidis
MKTILPRVDTKAVARSV

SEQ ID NO: 1755054 - protein, 19 aa, Staphylococcus epidermidis
MMHPLFELLHLPSPLTTTI

SEQ ID NO: 1755055 - protein, 34 aa, Staphylococcus epidermidis
MNKRINFVFGFIVLIFAILVLRLGYLQIAQGSQY

SEQ ID NO: 1755056 - protein, 17 aa, Staphylococcus epidermidis
MPELKWHYAYFVCLGVM

SEQ ID NO: 1755057 - protein, 40 aa, Staphylococcus epidermidis
MPGYKVKFIFMILVTMIVFVLINTYLLRQLKSIGMFIMIV

SEQ ID NO: 1755058 - protein, 40 aa, Staphylococcus epidermidis
MPGYKVKFMFMIIMTMMLFVLINTYLFRQLKSIGMFIMMT

SEQ ID NO: 1755059 - protein, 21 aa, Staphylococcus epidermidis
MSTWTLYYWGWWLSWSPFVGV

SEQ ID NO: 1755060 - protein, 19 aa, Staphylococcus epidermidis
MTLTIIFLVVILTMYPLAK

SEQ ID NO: 1755061 - protein, 17 aa, Staphylococcus epidermidis
MTQGWWFPIMASAFLIF

SEQ ID NO: 1755062 - protein, 23 aa, Staphylococcus epidermidis
MVTAPFIPMFYIIFGLKTRDESK

SEQ ID NO: 1755063 - protein, 17 aa, Staphylococcus epidermidis
NAFIPLLWLLDVPTQLA

SEQ ID NO: 1755064 - protein, 21 aa, Staphylococcus epidermidis
NAFIPLLWLLDVPTQLAPGIL

SEQ ID NO: 1755065 - protein, 24 aa, Staphylococcus epidermidis
NDWYTFFMMITTIQLIIYVACYEP

SEQ ID NO: 1755066 - protein, 43 aa, Staphylococcus epidermidis
NEFKQLVIAFFKEHWPKMLIIIGIIVLLLILNAIFTTVNKNDH

SEQ ID NO: 1755067 - protein, 24 aa, Staphylococcus epidermidis
NELNSIFINITQKPTARKAISDKA

SEQ ID NO: 1755068 - protein, 25 aa, Staphylococcus epidermidis
NEVPNVRQFFLFDLTSRVIGSDENK

SEQ ID NO: 1755069 - protein, 18 aa, Staphylococcus epidermidis
NFFAIWFELGVLTFVYVL

SEQ ID NO: 1755070 - protein, 26 aa, Staphylococcus epidermidis
NFNTNGIISLFLLTAGFIALYHQPLR

SEQ ID NO: 1755071 - protein, 21 aa, Staphylococcus epidermidis
NFSIAIPSYYVLTGKETIKIT

SEQ ID NO: 1755072 - protein, 23 aa, Staphylococcus epidermidis
NGKYQVMIVIPKDFTKLAMQLDK

SEQ ID NO: 1755073 - protein, 37 aa, Staphylococcus epidermidis
NGNKKTWIIISIVAVIIIALIALFLILKSQLSPEKQA

SEQ ID NO: 1755074 - protein, 23 aa, Staphylococcus epidermidis
NIDKQLNNFKNLGYSYVGTDALK

SEQ ID NO: 1755075 - protein, 25 aa, Staphylococcus epidermidis
NIISKVHIVIPALKYDHEYTTHIEL

SEQ ID NO: 1755076 - protein, 20 aa, Staphylococcus epidermidis
NIWFYLIFFLFFGLFLLLLT

SEQ ID NO: 1755077 - protein, 31 aa, Staphylococcus epidermidis
NKIILKILFVIIIVFVLFVGLMYFLSSRANV

SEQ ID NO: 1755078 - protein, 32 aa, Staphylococcus epidermidis
NKKVDFLPNKLNKYSIRKFTVGTASILLGSTL

SEQ ID NO: 1755079 - protein, 23 aa, Staphylococcus epidermidis
NLGNRYEGYSPDGVVGGDGIGFA

SEQ ID NO: 1755080 - protein, 17 aa, Staphylococcus epidermidis
NLGYSYVGTDALKAPNY

SEQ ID NO: 1755081 - protein, 27 aa, Staphylococcus epidermidis
NLLMFCPLLPIVTLPIMFISPGSGLFL

SEQ ID NO: 1755082 - protein, 23 aa, Staphylococcus epidermidis
NLNYSSPFMSLLSMPADSSSNNT

SEQ ID NO: 1755083 - protein, 20 aa, Staphylococcus epidermidis
NLYLTFLLLFLTIVLFVTVI

SEQ ID NO: 1755084 - protein, 17 aa, Staphylococcus epidermidis
NMNLPFINKFILKMERD

SEQ ID NO: 1755085 - protein, 18 aa, Staphylococcus epidermidis
NMNQVRISFLPISINNAL

SEQ ID NO: 1755086 - protein, 27 aa, Staphylococcus epidermidis
NNRQLFWIFLIILLTIFVALQIRIFTI

SEQ ID NO: 1755087 - protein, 25 aa, Staphylococcus epidermidis
NPETLLPVNLYVKPELKHTIELYHD

SEQ ID NO: 1755088 - protein, 20 aa, Staphylococcus epidermidis
NPSNWGVWQTSQSAKFIVTN

SEQ ID NO: 1755089 - protein, 18 aa, Staphylococcus epidermidis
NQQFPPRNAQRRKRRRET

SEQ ID NO: 1755090 - protein, 25 aa, Staphylococcus epidermidis
NQSASYLIKKWALDRIKQIQLETMN

SEQ ID NO: 1755091 - protein, 32 aa, Staphylococcus epidermidis
NQSSPTSFANLRTFSRFTVLNTMAAPTTTSTT

SEQ ID NO: 1755092 - protein, 25 aa, Staphylococcus epidermidis
NSLKRKDFVVSFIASAIVGSAVGLY

SEQ ID NO: 1755093 - protein, 17 aa, Staphylococcus epidermidis
NTFLMLFFELLVLFIVV

SEQ ID NO: 1755094 - protein, 17 aa, Staphylococcus epidermidis
NTITRFSIRKYQGFGAA

SEQ ID NO: 1755095 - protein, 34 aa, Staphylococcus epidermidis
NTMNKRINFIFGFIVFIFAIVVLRLGYLQIAQGS

SEQ ID NO: 1755096 - protein, 44 aa, Staphylococcus epidermidis
NTPTKKNHYSIRKFTVGTASIIVGSFLFFGQAHAEENPQGTTGT

SEQ ID NO: 1755097 - protein, 32 aa, Staphylococcus epidermidis
NTREARFLPNKILNIRYKLRPVNIETPREVTF

SEQ ID NO: 1755098 - protein, 21 aa, Staphylococcus epidermidis
NTRFIMVIILILLALSFVLIP

SEQ ID NO: 1755099 - protein, 17 aa, Staphylococcus epidermidis
NTYIPLPATAKLEFNNV

SEQ ID NO: 1755100 - protein, 24 aa, Staphylococcus epidermidis
NVNRIKVQFLPNNDIQTNYQRILQ

SEQ ID NO: 1755101 - protein, 21 aa, Staphylococcus epidermidis
NYFVSPIALSFDFSKKLLNRP

SEQ ID NO: 1755102 - protein, 23 aa, Staphylococcus epidermidis
NYKKKNMYIIPNTAQYIINNKVV

SEQ ID NO: 1755103 - protein, 17 aa, Staphylococcus epidermidis
NYLFGMSRFLTYILVIL

SEQ ID NO: 1755104 - protein, 22 aa, Staphylococcus epidermidis
PAFIFLVLSFLLLMLSFNGWVL

SEQ ID NO: 1755105 - protein, 25 aa, Staphylococcus epidermidis
PELYFAFLGILKIGAIVGPLFEAFM

SEQ ID NO: 1755106 - protein, 18 aa, Staphylococcus epidermidis
PFFFSVLLPIVFISALIG

SEQ ID NO: 1755107 - protein, 19 aa, Staphylococcus epidermidis
PFFFSVLLPIVFISALIGI

SEQ ID NO: 1755108 - protein, 22 aa, Staphylococcus epidermidis
PGAVFWMWVIAFIGAASAFMEA

SEQ ID NO: 1755109 - protein, 20 aa, Staphylococcus epidermidis
PIAALGLLAPWIAGAAMALS

SEQ ID NO: 1755110 - protein, 19 aa, Staphylococcus epidermidis
PIGVYILLMLGMSTVTIIF

SEQ ID NO: 1755111 - protein, 27 aa, Staphylococcus epidermidis
PILTKRQIYLGKAGFFFMLGVIQALIV

SEQ ID NO: 1755112 - protein, 20 aa, Staphylococcus epidermidis
PIVLILLILFFFYSHYLFAS

SEQ ID NO: 1755113 - protein, 22 aa, Staphylococcus epidermidis
PKIEAIVPKVRKKRSALDELQA

SEQ ID NO: 1755114 - protein, 20 aa, Staphylococcus epidermidis
PKYAKYFSTVKNGKFIPGEV

SEQ ID NO: 1755115 - protein, 21 aa, Staphylococcus epidermidis
PLFIIVLLVIFFFLGFIVPSS

SEQ ID NO: 1755116 - protein, 18 aa, Staphylococcus epidermidis
PLLIMVIIIIFYKQIKNI

SEQ ID NO: 1755117 - protein, 19 aa, Staphylococcus epidermidis
PLLLFVLLFLGVGIVSGDF

SEQ ID NO: 1755118 - protein, 28 aa, Staphylococcus epidermidis
PPRHRRPRFPWFKTILVALIAGIIGALL

SEQ ID NO: 1755119 - protein, 17 aa, Staphylococcus epidermidis
PSNWGVWQTSQSAKFIV

SEQ ID NO: 1755120 - protein, 21 aa, Staphylococcus epidermidis
PVLFLIIIFLFKEQIKKILTD

SEQ ID NO: 1755121 - protein, 29 aa, Staphylococcus epidermidis
QADNHSNNLDLLHQNRLQDKVVKQPTKGE

SEQ ID NO: 1755122 - protein, 29 aa, Staphylococcus epidermidis
QDVARFLPNKILNIRYKLRPVNISTPREV

SEQ ID NO: 1755123 - protein, 20 aa, Staphylococcus epidermidis
QENLYRIAIQYYGEGTQANV

SEQ ID NO: 1755124 - protein, 20 aa, Staphylococcus epidermidis
QENLYRIAIQYYGSGTQENV

SEQ ID NO: 1755125 - protein, 24 aa, Staphylococcus epidermidis
QFFQTISPYLPFTYAIDALRETVG

SEQ ID NO: 1755126 - protein, 19 aa, Staphylococcus epidermidis
QFTITIQDTISPVVNVTPS

SEQ ID NO: 1755127 - protein, 27 aa, Staphylococcus epidermidis
QIFGIPVFLFLNILIILLCIIVGSVLA

SEQ ID NO: 1755128 - protein, 19 aa, Staphylococcus epidermidis
QIILIVVIIIFSYQLVKTY

SEQ ID NO: 1755129 - protein, 17 aa, Staphylococcus epidermidis
QIQAIFDRKQSKFETNK

SEQ ID NO: 1755130 - protein, 24 aa, Staphylococcus epidermidis
QKGTSYFRFQYFNPLNSSKYYENL

SEQ ID NO: 1755131 - protein, 33 aa, Staphylococcus epidermidis
QKHTGWLIVLSIIFVLLIAALLYGAYYAYNHYI

SEQ ID NO: 1755132 - protein, 36 aa, Staphylococcus epidermidis
QKRIQYTIITLLILIIVLILLYMVTPLSKISNVNVK

SEQ ID NO: 1755133 - protein, 27 aa, Staphylococcus epidermidis
QKRNIFPYILLSIGVLLTLGFVIFSIR

SEQ ID NO: 1755134 - protein, 17 aa, Staphylococcus epidermidis
QLALLFIAQLYFHFSHN

SEQ ID NO: 1755135 - protein, 17 aa, Staphylococcus epidermidis
QNFSFPVLFLIIIFLFK

SEQ ID NO: 1755136 - protein, 21 aa, Staphylococcus epidermidis
QPLIYLFIVILVVLIARATFN

SEQ ID NO: 1755137 - protein, 24 aa, Staphylococcus epidermidis
QQVVPAIIPLIDKATDLANKFGQL

SEQ ID NO: 1755138 - protein, 22 aa, Staphylococcus epidermidis
QREMWKYLSIIGVIVLFTVYLA

SEQ ID NO: 1755139 - protein, 25 aa, Staphylococcus epidermidis
QRQKLLRISFIVLALIGAALTVFSF

SEQ ID NO: 1755140 - protein, 23 aa, Staphylococcus epidermidis
QVFWRILLFYILAIFIIGMLIPY

SEQ ID NO: 1755141 - protein, 18 aa, Staphylococcus epidermidis
QVLALIVLFLLIILPLCL

SEQ ID NO: 1755142 - protein, 21 aa, Staphylococcus epidermidis
RFEKVLYITLITVIAMISIYM

SEQ ID NO: 1755143 - protein, 18 aa, Staphylococcus epidermidis
RFVVYSLLQFILGFIACF

SEQ ID NO: 1755144 - protein, 18 aa, Staphylococcus epidermidis
RFVWPVVAFVLVFGGGLL

SEQ ID NO: 1755145 - protein, 25 aa, Staphylococcus epidermidis
RIEFYRLYLLMIHLLKFGGMYADSV

SEQ ID NO: 1755146 - protein, 26 aa, Staphylococcus epidermidis
RKRKFQIFKWLAIGASILGLLLIAFL

SEQ ID NO: 1755147 - protein, 17 aa, Staphylococcus epidermidis
RKWWQSFHFYQKNKELK

SEQ ID NO: 1755148 - protein, 21 aa, Staphylococcus epidermidis
RLIILLIIDSLIVFFSIFVCY

SEQ ID NO: 1755149 - protein, 18 aa, Staphylococcus epidermidis
RLILLMVIAIIGMAGWLF

SEQ ID NO: 1755150 - protein, 26 aa, Staphylococcus epidermidis
RLPMLDLPIIPIIISRYWVQLISNVP

SEQ ID NO: 1755151 - protein, 30 aa, Staphylococcus epidermidis
RLRKLPFIILIFLIILIALIVYIVHQYNSG

SEQ ID NO: 1755152 - protein, 29 aa, Staphylococcus epidermidis
RMRKLPFIILIILIILISIIVYITHQYNS

SEQ ID NO: 1755153 - protein, 29 aa, Staphylococcus epidermidis
RNTLYTAIVLLIALVLLVFAIKAIHVNPV

SEQ ID NO: 1755154 - protein, 18 aa, Staphylococcus epidermidis
RPKIEAIVPQVSKKRDAL

SEQ ID NO: 1755155 - protein, 32 aa, Staphylococcus epidermidis
RSIVPPLVMIALTVVIFLVRPIGVYIIMMIGM

SEQ ID NO: 1755156 - protein, 26 aa, Staphylococcus epidermidis
RSRINWIMWIIFLNLVMLGISYIDYD

SEQ ID NO: 1755157 - protein, 20 aa, Staphylococcus epidermidis
RYEGYSPDGVAGGDGIGFAF

SEQ ID NO: 1755158 - protein, 21 aa, Staphylococcus epidermidis
RYYFWMTIVIIMLLVGVIAWL

SEQ ID NO: 1755159 - protein, 18 aa, Staphylococcus epidermidis
SAKRWIRYIHEVEEPDFL

SEQ ID NO: 1755160 - protein, 21 aa, Staphylococcus epidermidis
SALTLALYLFNSNVTAYANEN

SEQ ID NO: 1755161 - protein, 22 aa, Staphylococcus epidermidis
SALTLALYLFNSNVTAYANENT

SEQ ID NO: 1755162 - protein, 22 aa, Staphylococcus epidermidis
SAWRYFMLIFYLVPYALFGGLI

SEQ ID NO: 1755163 - protein, 22 aa, Staphylococcus epidermidis
SAYAFMIFILLYVPCISTVATI

SEQ ID NO: 1755164 - protein, 23 aa, Staphylococcus epidermidis
SDTFIWLPLLLLGIERLLRDFKA

SEQ ID NO: 1755165 - protein, 27 aa, Staphylococcus epidermidis
SFDPFTPLLIAAVLYFILTFALSRIMS

SEQ ID NO: 1755166 - protein, 24 aa, Staphylococcus epidermidis
SFILVLFIFLFSWVPNVSHAAEGK

SEQ ID NO: 1755167 - protein, 24 aa, Staphylococcus epidermidis
SFSIILIIALIIWSFIYTGFSIGD

SEQ ID NO: 1755168 - protein, 20 aa, Staphylococcus epidermidis
SFSIILITGLIIWSFIYTGF

SEQ ID NO: 1755169 - protein, 19 aa, Staphylococcus epidermidis
SGFFFLLGIIQALIVSIGD

SEQ ID NO: 1755170 - protein, 20 aa, Staphylococcus epidermidis
SGFFFLLGIIQALIVSIGDL

SEQ ID NO: 1755171 - protein, 31 aa, Staphylococcus epidermidis
SGHPPFLRLYLITWMMHLILIGGSRIFWRVS

SEQ ID NO: 1755172 - protein, 27 aa, Staphylococcus epidermidis
SGKTWGTILIALFALMETMIKVVAPLL

SEQ ID NO: 1755173 - protein, 19 aa, Staphylococcus epidermidis
SGTPTLKLTNSSQTVIYKF

SEQ ID NO: 1755174 - protein, 17 aa, Staphylococcus epidermidis
SHWLRFVWPVVAFVLIF

SEQ ID NO: 1755175 - protein, 21 aa, Staphylococcus epidermidis
SIAIYLLPLFILGNASWTFVL

SEQ ID NO: 1755176 - protein, 25 aa, Staphylococcus epidermidis
SIGNWRWIFWINIPIILIGLIGCLL

SEQ ID NO: 1755177 - protein, 22 aa, Staphylococcus epidermidis
SIGPNLRKYFSLSNGSDLPNRD

SEQ ID NO: 1755178 - protein, 19 aa, Staphylococcus epidermidis
SIILGLLVLMSIVLTYMVW

SEQ ID NO: 1755179 - protein, 17 aa, Staphylococcus epidermidis
SIKLPLLGLLPFVLWGA

SEQ ID NO: 1755180 - protein, 23 aa, Staphylococcus epidermidis
SILNVFVFNYFFTVPRFTLEMYR

SEQ ID NO: 1755181 - protein, 17 aa, Staphylococcus epidermidis
SIRKFTVGTASILLGST

SEQ ID NO: 1755182 - protein, 26 aa, Staphylococcus epidermidis
SIVAIIYFIFFLKYKFLDKTSTIKVN

SEQ ID NO: 1755183 - protein, 23 aa, Staphylococcus epidermidis
SKDLKLIKVLKDLNKAQLEDVTN

SEQ ID NO: 1755184 - protein, 26 aa, Staphylococcus epidermidis
SKDPNPEYPILFTPAAKDYANFMSDN

SEQ ID NO: 1755185 - protein, 25 aa, Staphylococcus epidermidis
SKETTYKVVLPPNSKFISATGANGN

SEQ ID NO: 1755186 - protein, 22 aa, Staphylococcus epidermidis
SKGTLLGALFAGLGALLLGKRR

SEQ ID NO: 1755187 - protein, 32 aa, Staphylococcus epidermidis
SKHIKIKLWHFILVILGIILLTSIITVVSTIL

SEQ ID NO: 1755188 - protein, 21 aa, Staphylococcus epidermidis
SKLIQTYLSKKTIRYGTASAL

SEQ ID NO: 1755189 - protein, 24 aa, Staphylococcus epidermidis
SKLYYIFIAIIIIAIILVVMIFYN

SEQ ID NO: 1755190 - protein, 21 aa, Staphylococcus epidermidis
SKNTNMLNKTGKDYDLQEQRG

SEQ ID NO: 1755191 - protein, 33 aa, Staphylococcus epidermidis
SKQIKIKLWHFILIILGIILLTSIITVVSTILI

SEQ ID NO: 1755192 - protein, 22 aa, Staphylococcus epidermidis
SKRLPWLIVLTFLGMITATILG

SEQ ID NO: 1755193 - protein, 28 aa, Staphylococcus epidermidis
SKTWYVTGLWYLAYLITPMFWVGVVTGV

SEQ ID NO: 1755194 - protein, 21 aa, Staphylococcus epidermidis
SLDRNVFFGTLGQSRSYTISY

SEQ ID NO: 1755195 - protein, 22 aa, Staphylococcus epidermidis
SLIIILIIVLAIVGLITFVHTK

SEQ ID NO: 1755196 - protein, 17 aa, Staphylococcus epidermidis
SLLLLLSVIFISLILRA

SEQ ID NO: 1755197 - protein, 17 aa, Staphylococcus epidermidis
SLLLVISISLVIASTYS

SEQ ID NO: 1755198 - protein, 26 aa, Staphylococcus epidermidis
SLNTRLDSNRSFRFTGKVNLGNRYEG

SEQ ID NO: 1755199 - protein, 17 aa, Staphylococcus epidermidis
SLQFSFLTNLIAAFVAC

SEQ ID NO: 1755200 - protein, 30 aa, Staphylococcus epidermidis
SLVFKILVIILIVFILLAIVFGIYIFSKVN

SEQ ID NO: 1755201 - protein, 19 aa, Staphylococcus epidermidis
SNQQFPPRNAQRRKRRRDV

SEQ ID NO: 1755202 - protein, 21 aa, Staphylococcus epidermidis
SPNDFFSLRTGGPVDARIVWV

SEQ ID NO: 1755203 - protein, 23 aa, Staphylococcus epidermidis
SPWRYLIVMFYFVPYILFSLLIY

SEQ ID NO: 1755204 - protein, 25 aa, Staphylococcus epidermidis
SQKRHTFPWIKTIIVAIIAGIIGAL

SEQ ID NO: 1755205 - protein, 23 aa, Staphylococcus epidermidis
SRLYVFSIFIILLLTLVFANFSE

SEQ ID NO: 1755206 - protein, 24 aa, Staphylococcus epidermidis
SSLPWLFMFFLILSAGAISDKILN

SEQ ID NO: 1755207 - protein, 31 aa, Staphylococcus epidermidis
SSRTKKWLIALVVILLIVVAIFVTRAIMNHN

SEQ ID NO: 1755208 - protein, 21 aa, Staphylococcus epidermidis
STHFFSLILIFTILLSTLGQS

SEQ ID NO: 1755209 - protein, 36 aa, Staphylococcus epidermidis
STPLEVPVKVWVYNFDFPQPIYKIQVGDTFPKGTWV

SEQ ID NO: 1755210 - protein, 23 aa, Staphylococcus epidermidis
STPYALLFFDLLVVLISLTQISL

SEQ ID NO: 1755211 - protein, 18 aa, Staphylococcus epidermidis
SVVIIGLIWLFKDKGQDQ

SEQ ID NO: 1755212 - protein, 26 aa, Staphylococcus epidermidis
SWDFLIHFFVDIGWFLTNWLYKFVNF

SEQ ID NO: 1755213 - protein, 18 aa, Staphylococcus epidermidis
SWVFLLILTIVSMFIALV

SEQ ID NO: 1755214 - protein, 22 aa, Staphylococcus epidermidis
SYLFIFIYFLILTSRKLSPIIV

SEQ ID NO: 1755215 - protein, 23 aa, Staphylococcus epidermidis
TAAFWTILAILFIGGPYIPNVIN

SEQ ID NO: 1755216 - protein, 33 aa, Staphylococcus epidermidis
TAAKLNVQPTDNSFQYFVIDYNGDTKVMTVTYA

SEQ ID NO: 1755217 - protein, 17 aa, Staphylococcus epidermidis
TADIQGGGVWRLFKIPE

SEQ ID NO: 1755218 - protein, 27 aa, Staphylococcus epidermidis
TANMIFGIIFAILTVIFIVGIFLSKTK

SEQ ID NO: 1755219 - protein, 20 aa, Staphylococcus epidermidis
TASILLGSTLIFGSSSHEAK

SEQ ID NO: 1755220 - protein, 21 aa, Staphylococcus epidermidis
TDTINLLQPLANKESLKEARN

SEQ ID NO: 1755221 - protein, 22 aa, Staphylococcus epidermidis
TESLLKEPSIAKAQTKLKRIPT

SEQ ID NO: 1755222 - protein, 28 aa, Staphylococcus epidermidis
TFIFKNNFSIRKLKFGVASITLGSALII

SEQ ID NO: 1755223 - protein, 19 aa, Staphylococcus epidermidis
TFIGWRWIFVLSIIFSIIA

SEQ ID NO: 1755224 - protein, 25 aa, Staphylococcus epidermidis
TFTRNLTDWIKNSGGTTFSLSMTAS

SEQ ID NO: 1755225 - protein, 31 aa, Staphylococcus epidermidis
TFTSQSPINSESQFIGDSLSEDTIVTQSKNT

SEQ ID NO: 1755226 - protein, 26 aa, Staphylococcus epidermidis
TFTTILLFCLIIIFFLKDTLRNSELD

SEQ ID NO: 1755227 - protein, 18 aa, Staphylococcus epidermidis
TGADGWGFMFSKKDGDDF

SEQ ID NO: 1755228 - protein, 25 aa, Staphylococcus epidermidis
TGFNPAALMLLAGLGLLGLYRNRTK

SEQ ID NO: 1755229 - protein, 37 aa, Staphylococcus epidermidis
TGIINGADNLTIDSGFYKTPKYSVGDYVWKDTNKDSI

SEQ ID NO: 1755230 - protein, 21 aa, Staphylococcus epidermidis
TGLLMVYIFNPPASWLNHLLL

SEQ ID NO: 1755231 - protein, 27 aa, Staphylococcus epidermidis
TIAAIFIFPFYILTVYFFFGRLRQLTR

SEQ ID NO: 1755232 - protein, 17 aa, Staphylococcus epidermidis
TIFAIVCWLVISVAIFV

SEQ ID NO: 1755233 - protein, 23 aa, Staphylococcus epidermidis
TIGPNLRKYFSLSNGSDLPNRDF

SEQ ID NO: 1755234 - protein, 41 aa, Staphylococcus epidermidis
TIIKIIGFMIIAFFVLLLLGILLFAYYAWKAPAFTESKLED

SEQ ID NO: 1755235 - protein, 21 aa, Staphylococcus epidermidis
TIKSILPNVIKKPTAINDLTQ

SEQ ID NO: 1755236 - protein, 20 aa, Staphylococcus epidermidis
TIMIIVCIVLVIMMFVGGKK

SEQ ID NO: 1755237 - protein, 21 aa, Staphylococcus epidermidis
TIMIIVCIVLVIMMFVGGKKE

SEQ ID NO: 1755238 - protein, 18 aa, Staphylococcus epidermidis
TINLLQPLANKESLKESR

SEQ ID NO: 1755239 - protein, 29 aa, Staphylococcus epidermidis
TIRYGTASALTLALYLFNSNVTVYADENT

SEQ ID NO: 1755240 - protein, 17 aa, Staphylococcus epidermidis
TITLLIALAIYVFRFIW

SEQ ID NO: 1755241 - protein, 39 aa, Staphylococcus epidermidis
TKGEDGVVSNGFIVAVAIVLAIFGLAKKSRKDDDDQDGS

SEQ ID NO: 1755242 - protein, 22 aa, Staphylococcus epidermidis
TKVMTVTYAGQTFTRNLTDWIK

SEQ ID NO: 1755243 - protein, 18 aa, Staphylococcus epidermidis
TLAGTFIALWFQFRKDDK

SEQ ID NO: 1755244 - protein, 25 aa, Staphylococcus epidermidis
TLAIITIIALLFVGCTMEIGGNIKE

SEQ ID NO: 1755245 - protein, 20 aa, Staphylococcus epidermidis
TLFLIMPIALFFIILSKFVT

SEQ ID NO: 1755246 - protein, 22 aa, Staphylococcus epidermidis
TLINVLPIVIVPLVTERKRIKK

SEQ ID NO: 1755247 - protein, 22 aa, Staphylococcus epidermidis
TLINVLPIVIVPLVVERKRIKE

SEQ ID NO: 1755248 - protein, 19 aa, Staphylococcus epidermidis
TLIVFFGLGFFKFADAHVT

SEQ ID NO: 1755249 - protein, 18 aa, Staphylococcus epidermidis
TLLLIISISLVIASTYSI

SEQ ID NO: 1755250 - protein, 18 aa, Staphylococcus epidermidis
TLSVLLFFKGKKAFWFIF

SEQ ID NO: 1755251 - protein, 18 aa, Staphylococcus epidermidis
TLTIIFLVVILTMYPLAK

SEQ ID NO: 1755252 - protein, 26 aa, Staphylococcus epidermidis
TLYTAIVLLVALVLLIFAVKSIQVEP

SEQ ID NO: 1755253 - protein, 18 aa, Staphylococcus epidermidis
TMLIYGIVLIIISLLGSL

SEQ ID NO: 1755254 - protein, 25 aa, Staphylococcus epidermidis
TMSPTILVLLMYLIAMMTAYVFYSY

SEQ ID NO: 1755255 - protein, 29 aa, Staphylococcus epidermidis
TNNAITIIILITAIIFIAASTIFAFFLSN

SEQ ID NO: 1755256 - protein, 23 aa, Staphylococcus epidermidis
TNWFGWLFLIIVFVLDVFLIFLA

SEQ ID NO: 1755257 - protein, 20 aa, Staphylococcus epidermidis
TPGVWIILIGLAILPSFYAW

SEQ ID NO: 1755258 - protein, 26 aa, Staphylococcus epidermidis
TPSQASEVFTPINPITITATDNSGKV

SEQ ID NO: 1755259 - protein, 25 aa, Staphylococcus epidermidis
TQSKNTNMLNKTGKDYDLQEQRGYT

SEQ ID NO: 1755260 - protein, 20 aa, Staphylococcus epidermidis
TRFSIRKYQGFGAASVAVAA

SEQ ID NO: 1755261 - protein, 26 aa, Staphylococcus epidermidis
TRISMFIWLIFLLPLPFLLSNLGVTF

SEQ ID NO: 1755262 - protein, 22 aa, Staphylococcus epidermidis
TRNLTDWIKNSGGTTFSLSMTA

SEQ ID NO: 1755263 - protein, 23 aa, Staphylococcus epidermidis
TRNLTDWIKNSGGTTFSLSMTAS

SEQ ID NO: 1755264 - protein, 25 aa, Staphylococcus epidermidis
TSLDRNVFFGPLGQSRSYTISYKLK

SEQ ID NO: 1755265 - protein, 33 aa, Staphylococcus epidermidis
TSRYSSRAPKRKDFVVSFIASAIVGSALGLYYK

SEQ ID NO: 1755266 - protein, 22 aa, Staphylococcus epidermidis
TTGADGWGFMFSKKDGDDFLKN

SEQ ID NO: 1755267 - protein, 23 aa, Staphylococcus epidermidis
TTIIVIILLIIGLLFGLKVYGDH

SEQ ID NO: 1755268 - protein, 25 aa, Staphylococcus epidermidis
TTPIAFLVLIFLFDWKLSLICLIPV

SEQ ID NO: 1755269 - protein, 20 aa, Staphylococcus epidermidis
TTPTIWASVLSFFAGVLLLK

SEQ ID NO: 1755270 - protein, 21 aa, Staphylococcus epidermidis
TVDTGFYLTPKYNVGDYVWED

SEQ ID NO: 1755271 - protein, 18 aa, Staphylococcus epidermidis
TVFYIFIALLMFGLLNQG

SEQ ID NO: 1755272 - protein, 27 aa, Staphylococcus epidermidis
TVNIDKQLNNFKNLGYSYVGTDALKAP

SEQ ID NO: 1755273 - protein, 22 aa, Staphylococcus epidermidis
TVTKIVVFILLTFGFYVFFAGH

SEQ ID NO: 1755274 - protein, 19 aa, Staphylococcus epidermidis
TVYGQENLYRIAIQYYGEG

SEQ ID NO: 1755275 - protein, 21 aa, Staphylococcus epidermidis
TWGFVLSWLPLHSKYLVVSVY

SEQ ID NO: 1755276 - protein, 19 aa, Staphylococcus epidermidis
TYILIIVVIVLFYVFIACQ

SEQ ID NO: 1755277 - protein, 27 aa, Staphylococcus epidermidis
VAIVVAILFFILFLVAISSKKKIKNQT

SEQ ID NO: 1755278 - protein, 17 aa, Staphylococcus epidermidis
VALLLSNLVMNSVVRAE

SEQ ID NO: 1755279 - protein, 17 aa, Staphylococcus epidermidis
VCVYGIFAFLIPATIIL

SEQ ID NO: 1755280 - protein, 25 aa, Staphylococcus epidermidis
VEPKFNFLSVLFQITLAIVGIILVS

SEQ ID NO: 1755281 - protein, 24 aa, Staphylococcus epidermidis
VFDVFLLLFIMRFGFRKIEAIVGT

SEQ ID NO: 1755282 - protein, 18 aa, Staphylococcus epidermidis
VGAFALLETLSKVIAPLL

SEQ ID NO: 1755283 - protein, 24 aa, Staphylococcus epidermidis
VGGFAPLLSNPYVLGFGAIVAASA

SEQ ID NO: 1755284 - protein, 19 aa, Staphylococcus epidermidis
VGLLNSVLERTGVFDTGEA

SEQ ID NO: 1755285 - protein, 23 aa, Staphylococcus epidermidis
VGSYFLFIIIVVFLLYANFLFMK

SEQ ID NO: 1755286 - protein, 29 aa, Staphylococcus epidermidis
VGVIFLITFLIYLFYSPRLKFDVLENPNK

SEQ ID NO: 1755287 - protein, 18 aa, Staphylococcus epidermidis
VIIIILVIALFLNQRYMK

SEQ ID NO: 1755288 - protein, 23 aa, Staphylococcus epidermidis
VIITLIFILLISKQLTILNLGES

SEQ ID NO: 1755289 - protein, 24 aa, Staphylococcus epidermidis
VILFLIIVVIFRQPLLALIVGGSL

SEQ ID NO: 1755290 - protein, 26 aa, Staphylococcus epidermidis
VILGSLILLALLVLIATYFVNRKSES

SEQ ID NO: 1755291 - protein, 20 aa, Staphylococcus epidermidis
VILIIFAFAFRFIVKLIPVH

SEQ ID NO: 1755292 - protein, 19 aa, Staphylococcus epidermidis
VILLIAILFKFNLAHVATL

SEQ ID NO: 1755293 - protein, 17 aa, Staphylococcus epidermidis
VIQLIFAFILLKTHIGI

SEQ ID NO: 1755294 - protein, 23 aa, Staphylococcus epidermidis
VITFIIWIVFVHPGQLEPALVSA

SEQ ID NO: 1755295 - protein, 17 aa, Staphylococcus epidermidis
VKHPLFEYARSFDFIII

SEQ ID NO: 1755296 - protein, 21 aa, Staphylococcus epidermidis
VKSYYIIFLLCALVGILAGVP

SEQ ID NO: 1755297 - protein, 22 aa, Staphylococcus epidermidis
VLFLIIVVIYRQPLLALIVGGS

SEQ ID NO: 1755298 - protein, 23 aa, Staphylococcus epidermidis
VLLILLFLFLIFHLIRLASKIDN

SEQ ID NO: 1755299 - protein, 22 aa, Staphylococcus epidermidis
VLLWALIIFIFGNGLIAIAPHF

SEQ ID NO: 1755300 - protein, 23 aa, Staphylococcus epidermidis
VLMPIKEFTPLAPLLETNYKKAT

SEQ ID NO: 1755301 - protein, 18 aa, Staphylococcus epidermidis
VLPPSLILYLYYKRKFTK

SEQ ID NO: 1755302 - protein, 18 aa, Staphylococcus epidermidis
VLTTTVTGLPSGLSFDQT

SEQ ID NO: 1755303 - protein, 26 aa, Staphylococcus epidermidis
VLVVIGVLGFWFWNNATSYVTTDNAK

SEQ ID NO: 1755304 - protein, 18 aa, Staphylococcus epidermidis
VMIIVYFIILLIIGFYGY

SEQ ID NO: 1755305 - protein, 17 aa, Staphylococcus epidermidis
VNKWLFFLCTLIGLVVL

SEQ ID NO: 1755306 - protein, 24 aa, Staphylococcus epidermidis
VPIVLGLIILLGIAWGVYAFVTNT

SEQ ID NO: 1755307 - protein, 26 aa, Staphylococcus epidermidis
VQAVNQYWPEHMDFRWAQGSGTPSSR

SEQ ID NO: 1755308 - protein, 18 aa, Staphylococcus epidermidis
VRKKLWLSIALIGSLQYG

SEQ ID NO: 1755309 - protein, 25 aa, Staphylococcus epidermidis
VRLIIFLILGLIFIGIGYYLAIKPN

SEQ ID NO: 1755310 - protein, 25 aa, Staphylococcus epidermidis
VSIGKLFMIFLIRTLITLPIIALLA

SEQ ID NO: 1755311 - protein, 22 aa, Staphylococcus epidermidis
VSKIIMILIYIIVALIVIAILN

SEQ ID NO: 1755312 - protein, 17 aa, Staphylococcus epidermidis
VSPAITISVIDKTPPAV

SEQ ID NO: 1755313 - protein, 22 aa, Staphylococcus epidermidis
VSVFIICYLILFLILRSVMESI

SEQ ID NO: 1755314 - protein, 27 aa, Staphylococcus epidermidis
VTIATFVVLLALLKKFAWGPLKEVMDK

SEQ ID NO: 1755315 - protein, 25 aa, Staphylococcus epidermidis
VVIAFILFLILLFMFLNHSDEDSGQ

SEQ ID NO: 1755316 - protein, 26 aa, Staphylococcus epidermidis
VVIVIFIIFLILLFMFVNLSDEDTGQ

SEQ ID NO: 1755317 - protein, 20 aa, Staphylococcus epidermidis
VVIVLFYVFIACQSYFKDPT

SEQ ID NO: 1755318 - protein, 20 aa, Staphylococcus epidermidis
VVLGSLLILLSITHVCLLLL

SEQ ID NO: 1755319 - protein, 20 aa, Staphylococcus epidermidis
VWFIFNQLVAGIATAILIVM

SEQ ID NO: 1755320 - protein, 21 aa, Staphylococcus epidermidis
VWPILLFLPFIVFIFIRIHVH

SEQ ID NO: 1755321 - protein, 21 aa, Staphylococcus epidermidis
VYIILLYLAFLLMTANFLDYT

SEQ ID NO: 1755322 - protein, 21 aa, Staphylococcus epidermidis
VYTMILFTFFIVVSGCTINQS

SEQ ID NO: 1755323 - protein, 18 aa, Staphylococcus epidermidis
VYVKMSCSVLLMSGTLIG

SEQ ID NO: 1755324 - protein, 18 aa, Staphylococcus epidermidis
WFIFNQIVAGIAAAILVV

SEQ ID NO: 1755325 - protein, 20 aa, Staphylococcus epidermidis
WFIVLSLLFIFPLGLFLMWK

SEQ ID NO: 1755326 - protein, 20 aa, Staphylococcus epidermidis
WFLFCVFIFQYIKLLFSRPR

SEQ ID NO: 1755327 - protein, 20 aa, Staphylococcus epidermidis
WGFVLSWLPLYSKYLIVSVY

SEQ ID NO: 1755328 - protein, 18 aa, Staphylococcus epidermidis
WINIISWLLIIILSGLNV

SEQ ID NO: 1755329 - protein, 17 aa, Staphylococcus epidermidis
WLIFEYILKKTTSLLGL

SEQ ID NO: 1755330 - protein, 17 aa, Staphylococcus epidermidis
WLRFVWPVVAFVLIFGG

SEQ ID NO: 1755331 - protein, 20 aa, Staphylococcus epidermidis
WLTFFGTLVGALIGALIAGG

SEQ ID NO: 1755332 - protein, 19 aa, Staphylococcus epidermidis
WMIFIGWLSYFLLGFYIGT

SEQ ID NO: 1755333 - protein, 17 aa, Staphylococcus epidermidis
WQQIIFILPFLLLAIFV

SEQ ID NO: 1755334 - protein, 20 aa, Staphylococcus epidermidis
WQSLAYTRTPFVKTGTYDVV

SEQ ID NO: 1755335 - protein, 36 aa, Staphylococcus epidermidis
WRAIIPPLVMIALTVIIFLVRPIGVYILLMLGMSTV

SEQ ID NO: 1755336 - protein, 17 aa, Staphylococcus epidermidis
WTFVLSWLPIHAKWLIA

SEQ ID NO: 1755337 - protein, 20 aa, Staphylococcus epidermidis
WVRWILYIVALFLPIFIIYT

SEQ ID NO: 1755338 - protein, 17 aa, Staphylococcus epidermidis
WYVYVIVYFLFIAFILW

SEQ ID NO: 1755339 - protein, 17 aa, Staphylococcus epidermidis
YANYFSIRKLTVGVASI

SEQ ID NO: 1755340 - protein, 23 aa, Staphylococcus epidermidis
YELPILYVTVWLDDQGNIIKDAV

SEQ ID NO: 1755341 - protein, 17 aa, Staphylococcus epidermidis
YELYIVLAIFIILDIIL

SEQ ID NO: 1755342 - protein, 20 aa, Staphylococcus epidermidis
YFFPFINYLFPRYLREIDQT

SEQ ID NO: 1755343 - protein, 20 aa, Staphylococcus epidermidis
YFPYVLMRPLLFLAVILGGM

SEQ ID NO: 1755344 - protein, 20 aa, Staphylococcus epidermidis
YFVPYILFSLLIYAIFKAYE

SEQ ID NO: 1755345 - protein, 20 aa, Staphylococcus epidermidis
YFYLMLFLLTTFIGAFLLYL

SEQ ID NO: 1755346 - protein, 19 aa, Staphylococcus epidermidis
YGFRFSFISLFFLCILSTI

SEQ ID NO: 1755347 - protein, 20 aa, Staphylococcus epidermidis
YIDMIDRIPPVAPKANSITT

SEQ ID NO: 1755348 - protein, 21 aa, Staphylococcus epidermidis
YIISIEIVFFYLSWDFMSHTL

SEQ ID NO: 1755349 - protein, 26 aa, Staphylococcus epidermidis
YILLIIIAWLFIFILMKAGLTQVNQL

SEQ ID NO: 1755350 - protein, 17 aa, Staphylococcus epidermidis
YILVFFLFGIAVTMIAG

SEQ ID NO: 1755351 - protein, 18 aa, Staphylococcus epidermidis
YIMVFIALFIWLPNDLNQ

SEQ ID NO: 1755352 - protein, 19 aa, Staphylococcus epidermidis
YIVALFLPIFIFYTVARPV

SEQ ID NO: 1755353 - protein, 24 aa, Staphylococcus epidermidis
YKQEWFIVLSLLFIFPLGLFLMWK

SEQ ID NO: 1755354 - protein, 19 aa, Staphylococcus epidermidis
YKWMMITTLITFTTILLFC

SEQ ID NO: 1755355 - protein, 17 aa, Staphylococcus epidermidis
YLFLYLILILLTLIVTL

SEQ ID NO: 1755356 - protein, 17 aa, Staphylococcus epidermidis
YLFYFAVIVGVISFIVW

SEQ ID NO: 1755357 - protein, 17 aa, Staphylococcus epidermidis
YLIIALFIVLVAFFSIN

SEQ ID NO: 1755358 - protein, 17 aa, Staphylococcus epidermidis
YLIIIYAIRMFAVSLLM

SEQ ID NO: 1755359 - protein, 23 aa, Staphylococcus epidermidis
YLLYFIFCILLIGLLILPETAIT

SEQ ID NO: 1755360 - protein, 17 aa, Staphylococcus epidermidis
YLTHTWTTNDGAIAEES

SEQ ID NO: 1755361 - protein, 26 aa, Staphylococcus epidermidis
YNLNFWVWIPLIIIILCLIFRISTVP

SEQ ID NO: 1755362 - protein, 27 aa, Staphylococcus epidermidis
YNLNFWVWIPLIIIILCLIFRISTVPS

SEQ ID NO: 1755363 - protein, 17 aa, Staphylococcus epidermidis
YPGISTPLEVPVKVWVY

SEQ ID NO: 1755364 - protein, 23 aa, Staphylococcus epidermidis
YQKSWFIILTLLFIFPLGLFLMW

SEQ ID NO: 1755365 - protein, 20 aa, Staphylococcus epidermidis
YSHWLRFVWPVVAFVLVFGG

SEQ ID NO: 1755366 - protein, 19 aa, Staphylococcus epidermidis
YVMIIVYFLILLIIGFYGY

SEQ ID NO: 1755367 - protein, 10 aa, Staphylococcus epidermidis
KQPNEKPHKT

SEQ ID NO: 1755368 - protein, 5 aa, Staphylococcus epidermidis
NEQNR

SEQ ID NO: 1755369 - protein, 10 aa, Staphylococcus epidermidis
SWKTDQADAH

SEQ ID NO: 1755370 - protein, 7 aa, Staphylococcus epidermidis
YQSGHTH

SEQ ID NO: 1755371 - protein, 6 aa, Staphylococcus epidermidis
FKSNKQ

SEQ ID NO: 1755372 - protein, 10 aa, Staphylococcus epidermidis
INKRGNKKAR

SEQ ID NO: 1755373 - protein, 6 aa, Staphylococcus epidermidis
ESYPNV

SEQ ID NO: 1755374 - protein, 9 aa, Staphylococcus epidermidis
GPSGSGKST

SEQ ID NO: 1755375 - protein, 5 aa, Staphylococcus epidermidis
KTSAL

SEQ ID NO: 1755376 - protein, 9 aa, Staphylococcus epidermidis
PTLKQTDSL

SEQ ID NO: 1755377 - protein, 5 aa, Staphylococcus epidermidis
KNRRS

SEQ ID NO: 1755378 - protein, 13 aa, Staphylococcus epidermidis
TDKGMSMDKATKY

SEQ ID NO: 1755379 - protein, 14 aa, Staphylococcus epidermidis
TRYQSINTAKNTLK

SEQ ID NO: 1755380 - protein, 5 aa, Staphylococcus epidermidis
HKKAY

SEQ ID NO: 1755381 - protein, 9 aa, Staphylococcus epidermidis
PTLKQTDNL

SEQ ID NO: 1755382 - protein, 7 aa, Staphylococcus epidermidis
ENKRKDI

SEQ ID NO: 1755383 - protein, 7 aa, Staphylococcus epidermidis
QRDNHSA

SEQ ID NO: 1755384 - protein, 7 aa, Staphylococcus epidermidis
DQGSVYT

SEQ ID NO: 1755385 - protein, 4 aa, Staphylococcus epidermidis
GIPT

SEQ ID NO: 1755386 - protein, 9 aa, Staphylococcus epidermidis
GPSGSGKTT

SEQ ID NO: 1755387 - protein, 4 aa, Staphylococcus epidermidis
LGRN

SEQ ID NO: 1755388 - protein, 8 aa, Staphylococcus epidermidis
RPNVGKSS

SEQ ID NO: 1755389 - protein, 4 aa, Staphylococcus epidermidis
SDED

SEQ ID NO: 1755390 - protein, 7 aa, Staphylococcus epidermidis
SGAGKST

SEQ ID NO: 1755391 - protein, 13 aa, Staphylococcus epidermidis
SRKGTPADNAPIE

SEQ ID NO: 1755392 - protein, 5 aa, Staphylococcus epidermidis
TPSNP

SEQ ID NO: 1755393 - protein, 5 aa, Staphylococcus epidermidis
YIGGH

SEQ ID NO: 1755394 - protein, 4 aa, Staphylococcus epidermidis
AEEV

SEQ ID NO: 1755395 - protein, 4 aa, Staphylococcus epidermidis
AEGH

SEQ ID NO: 1755396 - protein, 6 aa, Staphylococcus epidermidis
AGPGGY

SEQ ID NO: 1755397 - protein, 5 aa, Staphylococcus epidermidis
ASQLG

SEQ ID NO: 1755398 - protein, 9 aa, Staphylococcus epidermidis
DDKQDQSLV

SEQ ID NO: 1755399 - protein, 4 aa, Staphylococcus epidermidis
DYAT

SEQ ID NO: 1755400 - protein, 5 aa, Staphylococcus epidermidis
ITRDT

SEQ ID NO: 1755401 - protein, 6 aa, Staphylococcus epidermidis
KLQDSV

SEQ ID NO: 1755402 - protein, 4 aa, Staphylococcus epidermidis
KTGE

SEQ ID NO: 1755403 - protein, 4 aa, Staphylococcus epidermidis
LSPN

SEQ ID NO: 1755404 - protein, 4 aa, Staphylococcus epidermidis
MGGY

SEQ ID NO: 1755405 - protein, 6 aa, Staphylococcus epidermidis
NETEAE

SEQ ID NO: 1755406 - protein, 4 aa, Staphylococcus epidermidis
NPSL

SEQ ID NO: 1755407 - protein, 4 aa, Staphylococcus epidermidis
RKEE

SEQ ID NO: 1755408 - protein, 4 aa, Staphylococcus epidermidis
SSSL

SEQ ID NO: 1755409 - protein, 9 aa, Staphylococcus epidermidis
TSGSGKTTA

SEQ ID NO: 1755410 - protein, 5 aa, Staphylococcus epidermidis
DNDDT

SEQ ID NO: 1755411 - protein, 4 aa, Staphylococcus epidermidis
GLPQ

SEQ ID NO: 1755412 - protein, 4 aa, Staphylococcus epidermidis
GQKA

SEQ ID NO: 1755413 - protein, 4 aa, Staphylococcus epidermidis
IENS

SEQ ID NO: 1755414 - protein, 4 aa, Staphylococcus epidermidis
KSTY

SEQ ID NO: 1755415 - protein, 6 aa, Staphylococcus epidermidis
KTSALR

SEQ ID NO: 1755416 - protein, 4 aa, Staphylococcus epidermidis
NKGD

SEQ ID NO: 1755417 - protein, 4 aa, Staphylococcus epidermidis
NTSE

SEQ ID NO: 1755418 - protein, 4 aa, Staphylococcus epidermidis
PTNH

SEQ ID NO: 1755419 - protein, 4 aa, Staphylococcus epidermidis
VPTG

SEQ ID NO: 1755420 - protein, 4 aa, Staphylococcus epidermidis
ANEK

SEQ ID NO: 1755421 - protein, 4 aa, Staphylococcus epidermidis
ELEE

SEQ ID NO: 1755422 - protein, 4 aa, Staphylococcus epidermidis
KNDV

SEQ ID NO: 1755423 - protein, 9 aa, Staphylococcus epidermidis
KTYKNDTVT

SEQ ID NO: 1755424 - protein, 4 aa, Staphylococcus epidermidis
QHPD

SEQ ID NO: 1755425 - protein, 4 aa, Staphylococcus epidermidis
RKRP

SEQ ID NO: 1755426 - protein, 4 aa, Staphylococcus epidermidis
SKDA

SEQ ID NO: 1755427 - protein, 4 aa, Staphylococcus epidermidis
SNEE

SEQ ID NO: 1755428 - protein, 12 aa, Staphylococcus epidermidis
TDKGMSMDKATK

SEQ ID NO: 1755429 - protein, 7 aa, Staphylococcus epidermidis
YNNNRIQ

SEQ ID NO: 1755430 - protein, 4 aa, Staphylococcus epidermidis
EELQ

SEQ ID NO: 1755431 - protein, 15 aa, Staphylococcus epidermidis
IPDTEFDEFRHHRGL

SEQ ID NO: 1755432 - protein, 8 aa, Staphylococcus epidermidis
KEKGVYKG

SEQ ID NO: 1755433 - protein, 6 aa, Staphylococcus epidermidis
KNRTQV

SEQ ID NO: 1755434 - protein, 9 aa, Staphylococcus epidermidis
KQYTYGKGL

SEQ ID NO: 1755435 - protein, 5 aa, Staphylococcus epidermidis
RNRTQ

SEQ ID NO: 1755436 - protein, 15 aa, Staphylococcus epidermidis
RPKKTTRIGKPYYKT

SEQ ID NO: 1755437 - protein, 6 aa, Staphylococcus epidermidis
SIGETA

SEQ ID NO: 1755438 - protein, 4 aa, Staphylococcus epidermidis
TISK

SEQ ID NO: 1755439 - protein, 12 aa, Staphylococcus epidermidis
VKAAQDQDWTKL

SEQ ID NO: 1755440 - protein, 4 aa, Staphylococcus epidermidis
YGAD

SEQ ID NO: 1755441 - protein, 5 aa, Staphylococcus epidermidis
ASLEA

SEQ ID NO: 1755442 - protein, 7 aa, Staphylococcus epidermidis
DQNLERQ

SEQ ID NO: 1755443 - protein, 5 aa, Staphylococcus epidermidis
EESYR

SEQ ID NO: 1755444 - protein, 16 aa, Staphylococcus epidermidis
EQERNESKRRQAQGIQ

SEQ ID NO: 1755445 - protein, 7 aa, Staphylococcus epidermidis
GEATRRA

SEQ ID NO: 1755446 - protein, 6 aa, Staphylococcus epidermidis
GEPDEV

SEQ ID NO: 1755447 - protein, 4 aa, Staphylococcus epidermidis
KLTG

SEQ ID NO: 1755448 - protein, 7 aa, Staphylococcus epidermidis
KNGVGKT

SEQ ID NO: 1755449 - protein, 4 aa, Staphylococcus epidermidis
KSEG

SEQ ID NO: 1755450 - protein, 4 aa, Staphylococcus epidermidis
LNSS

SEQ ID NO: 1755451 - protein, 9 aa, Staphylococcus epidermidis
NEELNNKEI

SEQ ID NO: 1755452 - protein, 4 aa, Staphylococcus epidermidis
NETL

SEQ ID NO: 1755453 - protein, 11 aa, Staphylococcus epidermidis
PTNGMDPDGSI

SEQ ID NO: 1755454 - protein, 7 aa, Staphylococcus epidermidis
RPGKELE

SEQ ID NO: 1755455 - protein, 9 aa, Staphylococcus epidermidis
SERTSAQAI

SEQ ID NO: 1755456 - protein, 8 aa, Staphylococcus epidermidis
TDEDHPTQ

SEQ ID NO: 1755457 - protein, 6 aa, Staphylococcus epidermidis
AGFSTK

SEQ ID NO: 1755458 - protein, 6 aa, Staphylococcus epidermidis
AGPIRT

SEQ ID NO: 1755459 - protein, 7 aa, Staphylococcus epidermidis
AKGVGGF

SEQ ID NO: 1755460 - protein, 6 aa, Staphylococcus epidermidis
DGRNNV

SEQ ID NO: 1755461 - protein, 4 aa, Staphylococcus epidermidis
EDEE

SEQ ID NO: 1755462 - protein, 4 aa, Staphylococcus epidermidis
EKLN

SEQ ID NO: 1755463 - protein, 4 aa, Staphylococcus epidermidis
ERNE

SEQ ID NO: 1755464 - protein, 4 aa, Staphylococcus epidermidis
GNEL

SEQ ID NO: 1755465 - protein, 9 aa, Staphylococcus epidermidis
GPNGAGKST

SEQ ID NO: 1755466 - protein, 9 aa, Staphylococcus epidermidis
GRFSETSRE

SEQ ID NO: 1755467 - protein, 4 aa, Staphylococcus epidermidis
HKKK

SEQ ID NO: 1755468 - protein, 4 aa, Staphylococcus epidermidis
KDSR

SEQ ID NO: 1755469 - protein, 4 aa, Staphylococcus epidermidis
KEGK

SEQ ID NO: 1755470 - protein, 4 aa, Staphylococcus epidermidis
LNGT

SEQ ID NO: 1755471 - protein, 9 aa, Staphylococcus epidermidis
MDKSSSTGQ

SEQ ID NO: 1755472 - protein, 4 aa, Staphylococcus epidermidis
NKEI

SEQ ID NO: 1755473 - protein, 4 aa, Staphylococcus epidermidis
NKGK

SEQ ID NO: 1755474 - protein, 5 aa, Staphylococcus epidermidis
NPTEI

SEQ ID NO: 1755475 - protein, 4 aa, Staphylococcus epidermidis
PDSH

SEQ ID NO: 1755476 - protein, 6 aa, Staphylococcus epidermidis
SQSEGF

SEQ ID NO: 1755477 - protein, 10 aa, Staphylococcus epidermidis
VAGGIKPDTI

SEQ ID NO: 1755478 - protein, 6 aa, Staphylococcus epidermidis
VGRNKK

SEQ ID NO: 1755479 - protein, 4 aa, Staphylococcus epidermidis
YEVS

SEQ ID NO: 1755480 - protein, 8 aa, Staphylococcus epidermidis
AAAPDIYD

SEQ ID NO: 1755481 - protein, 8 aa, Staphylococcus epidermidis
AADDPNTI

SEQ ID NO: 1755482 - protein, 7 aa, Staphylococcus epidermidis
AADGVEA

SEQ ID NO: 1755483 - protein, 7 aa, Staphylococcus epidermidis
AADIRDV

SEQ ID NO: 1755484 - protein, 13 aa, Staphylococcus epidermidis
AAFGKNGGNMGVS

SEQ ID NO: 1755485 - protein, 7 aa, Staphylococcus epidermidis
AAGGDEA

SEQ ID NO: 1755486 - protein, 19 aa, Staphylococcus epidermidis
AAGLTSSSSEMAAKGGSGL

SEQ ID NO: 1755487 - protein, 8 aa, Staphylococcus epidermidis
AAGSGKTA

SEQ ID NO: 1755488 - protein, 5 aa, Staphylococcus epidermidis
AAGSP

SEQ ID NO: 1755489 - protein, 12 aa, Staphylococcus epidermidis
AAIDGGESIDTS

SEQ ID NO: 1755490 - protein, 6 aa, Staphylococcus epidermidis
AAKAGD

SEQ ID NO: 1755491 - protein, 4 aa, Staphylococcus epidermidis
AAKL

SEQ ID NO: 1755492 - protein, 6 aa, Staphylococcus epidermidis
AAKVSG

SEQ ID NO: 1755493 - protein, 29 aa, Staphylococcus epidermidis
AANNTGGAVKKREDTHKMAEANKAFAHYR

SEQ ID NO: 1755494 - protein, 4 aa, Staphylococcus epidermidis
AAPG

SEQ ID NO: 1755495 - protein, 22 aa, Staphylococcus epidermidis
AAPVAAAGAAGGGDAAAEKTEF

SEQ ID NO: 1755496 - protein, 14 aa, Staphylococcus epidermidis
AAQIAKKAHKEGLT

SEQ ID NO: 1755497 - protein, 18 aa, Staphylococcus epidermidis
AARDSGAAITAKHRGRVE

SEQ ID NO: 1755498 - protein, 9 aa, Staphylococcus epidermidis
AASETELKE

SEQ ID NO: 1755499 - protein, 10 aa, Staphylococcus epidermidis
AASGGGGKGI

SEQ ID NO: 1755500 - protein, 9 aa, Staphylococcus epidermidis
AASNNGVDE

SEQ ID NO: 1755501 - protein, 6 aa, Staphylococcus epidermidis
AASSSM

SEQ ID NO: 1755502 - protein, 8 aa, Staphylococcus epidermidis
AASTNSNY

SEQ ID NO: 1755503 - protein, 9 aa, Staphylococcus epidermidis
AASYTKMTG

SEQ ID NO: 1755504 - protein, 7 aa, Staphylococcus epidermidis
AATPTQA

SEQ ID NO: 1755505 - protein, 7 aa, Staphylococcus epidermidis
AAYAPRG

SEQ ID NO: 1755506 - protein, 7 aa, Staphylococcus epidermidis
AAYPGQG

SEQ ID NO: 1755507 - protein, 17 aa, Staphylococcus epidermidis
AAYQAEGATQTDGKGRV

SEQ ID NO: 1755508 - protein, 10 aa, Staphylococcus epidermidis
ACATGTNSIG

SEQ ID NO: 1755509 - protein, 5 aa, Staphylococcus epidermidis
ACPTC

SEQ ID NO: 1755510 - protein, 4 aa, Staphylococcus epidermidis
ADAA

SEQ ID NO: 1755511 - protein, 5 aa, Staphylococcus epidermidis
ADDSG

SEQ ID NO: 1755512 - protein, 6 aa, Staphylococcus epidermidis
ADFDGD

SEQ ID NO: 1755513 - protein, 6 aa, Staphylococcus epidermidis
ADGANV

SEQ ID NO: 1755514 - protein, 8 aa, Staphylococcus epidermidis
ADGPMPQT

SEQ ID NO: 1755515 - protein, 4 aa, Staphylococcus epidermidis
ADLR

SEQ ID NO: 1755516 - protein, 9 aa, Staphylococcus epidermidis
ADPEYGKGV

SEQ ID NO: 1755517 - protein, 9 aa, Staphylococcus epidermidis
ADPEYRGSL

SEQ ID NO: 1755518 - protein, 7 aa, Staphylococcus epidermidis
ADPTADS

SEQ ID NO: 1755519 - protein, 7 aa, Staphylococcus epidermidis
ADTDGAH

SEQ ID NO: 1755520 - protein, 8 aa, Staphylococcus epidermidis
ADTKKLTG

SEQ ID NO: 1755521 - protein, 7 aa, Staphylococcus epidermidis
ADTTDEA

SEQ ID NO: 1755522 - protein, 9 aa, Staphylococcus epidermidis
AEAAGGKGY

SEQ ID NO: 1755523 - protein, 7 aa, Staphylococcus epidermidis
AEAAQDY

SEQ ID NO: 1755524 - protein, 9 aa, Staphylococcus epidermidis
AEADTTYGK

SEQ ID NO: 1755525 - protein, 7 aa, Staphylococcus epidermidis
AEAGDNI

SEQ ID NO: 1755526 - protein, 10 aa, Staphylococcus epidermidis
AEAIDGQAAE

SEQ ID NO: 1755527 - protein, 7 aa, Staphylococcus epidermidis
AEANGFK

SEQ ID NO: 1755528 - protein, 8 aa, Staphylococcus epidermidis
AEAPAEAY

SEQ ID NO: 1755529 - protein, 4 aa, Staphylococcus epidermidis
AEDE

SEQ ID NO: 1755530 - protein, 17 aa, Staphylococcus epidermidis
AEDGRKMSKSLGNGVDP

SEQ ID NO: 1755531 - protein, 15 aa, Staphylococcus epidermidis
AEEGGENGSAKASYV

SEQ ID NO: 1755532 - protein, 10 aa, Staphylococcus epidermidis
AEETGGGANR

SEQ ID NO: 1755533 - protein, 14 aa, Staphylococcus epidermidis
AEEVKTVGSLPSHD

SEQ ID NO: 1755534 - protein, 4 aa, Staphylococcus epidermidis
AEGD

SEQ ID NO: 1755535 - protein, 6 aa, Staphylococcus epidermidis
AEGTES

SEQ ID NO: 1755536 - protein, 8 aa, Staphylococcus epidermidis
AEHNYDMN

SEQ ID NO: 1755537 - protein, 11 aa, Staphylococcus epidermidis
AEIEERGGGRQ

SEQ ID NO: 1755538 - protein, 8 aa, Staphylococcus epidermidis
AEIGERTN

SEQ ID NO: 1755539 - protein, 5 aa, Staphylococcus epidermidis
AENAQ

SEQ ID NO: 1755540 - protein, 12 aa, Staphylococcus epidermidis
AENGGDAKQIME

SEQ ID NO: 1755541 - protein, 6 aa, Staphylococcus epidermidis
AENGKK

SEQ ID NO: 1755542 - protein, 7 aa, Staphylococcus epidermidis
AENNSTV

SEQ ID NO: 1755543 - protein, 7 aa, Staphylococcus epidermidis
AENVNNY

SEQ ID NO: 1755544 - protein, 7 aa, Staphylococcus epidermidis
AEPASDF

SEQ ID NO: 1755545 - protein, 6 aa, Staphylococcus epidermidis
AEPGDT

SEQ ID NO: 1755546 - protein, 9 aa, Staphylococcus epidermidis
AEQNNTSDL

SEQ ID NO: 1755547 - protein, 8 aa, Staphylococcus epidermidis
AEQPNRPK

SEQ ID NO: 1755548 - protein, 4 aa, Staphylococcus epidermidis
AERH

SEQ ID NO: 1755549 - protein, 7 aa, Staphylococcus epidermidis
AETGKER

SEQ ID NO: 1755550 - protein, 4 aa, Staphylococcus epidermidis
AEVQ

SEQ ID NO: 1755551 - protein, 12 aa, Staphylococcus epidermidis
AFAQRRKTINNN

SEQ ID NO: 1755552 - protein, 5 aa, Staphylococcus epidermidis
AFNTP

SEQ ID NO: 1755553 - protein, 6 aa, Staphylococcus epidermidis
AFTPKT

SEQ ID NO: 1755554 - protein, 7 aa, Staphylococcus epidermidis
AGASGYV

SEQ ID NO: 1755555 - protein, 13 aa, Staphylococcus epidermidis
AGASTTDKSAETL

SEQ ID NO: 1755556 - protein, 13 aa, Staphylococcus epidermidis
AGDGFQGAEISPY

SEQ ID NO: 1755557 - protein, 11 aa, Staphylococcus epidermidis
AGDGGNGITAY

SEQ ID NO: 1755558 - protein, 6 aa, Staphylococcus epidermidis
AGDGRE

SEQ ID NO: 1755559 - protein, 8 aa, Staphylococcus epidermidis
AGDYDGKA

SEQ ID NO: 1755560 - protein, 7 aa, Staphylococcus epidermidis
AGGAAHL

SEQ ID NO: 1755561 - protein, 10 aa, Staphylococcus epidermidis
AGGAEGAIDA

SEQ ID NO: 1755562 - protein, 4 aa, Staphylococcus epidermidis
AGGG

SEQ ID NO: 1755563 - protein, 4 aa, Staphylococcus epidermidis
AGGL

SEQ ID NO: 1755564 - protein, 8 aa, Staphylococcus epidermidis
AGGSLSTY

SEQ ID NO: 1755565 - protein, 8 aa, Staphylococcus epidermidis
AGGVGSIA

SEQ ID NO: 1755566 - protein, 4 aa, Staphylococcus epidermidis
AGHN

SEQ ID NO: 1755567 - protein, 5 aa, Staphylococcus epidermidis
AGIEA

SEQ ID NO: 1755568 - protein, 8 aa, Staphylococcus epidermidis
AGIRDTED

SEQ ID NO: 1755569 - protein, 7 aa, Staphylococcus epidermidis
AGKGAVE

SEQ ID NO: 1755570 - protein, 13 aa, Staphylococcus epidermidis
AGKSDEDPYENPH

SEQ ID NO: 1755571 - protein, 5 aa, Staphylococcus epidermidis
AGKST

SEQ ID NO: 1755572 - protein, 8 aa, Staphylococcus epidermidis
AGKTTTTE

SEQ ID NO: 1755573 - protein, 12 aa, Staphylococcus epidermidis
AGLEKSRQNFQE

SEQ ID NO: 1755574 - protein, 4 aa, Staphylococcus epidermidis
AGLT

SEQ ID NO: 1755575 - protein, 9 aa, Staphylococcus epidermidis
AGMARDGKT

SEQ ID NO: 1755576 - protein, 6 aa, Staphylococcus epidermidis
AGNDAN

SEQ ID NO: 1755577 - protein, 4 aa, Staphylococcus epidermidis
AGNI

SEQ ID NO: 1755578 - protein, 6 aa, Staphylococcus epidermidis
AGNQIT

SEQ ID NO: 1755579 - protein, 7 aa, Staphylococcus epidermidis
AGPAGMT

SEQ ID NO: 1755580 - protein, 9 aa, Staphylococcus epidermidis
AGPGNPNLL

SEQ ID NO: 1755581 - protein, 4 aa, Staphylococcus epidermidis
AGPN

SEQ ID NO: 1755582 - protein, 6 aa, Staphylococcus epidermidis
AGQGKV

SEQ ID NO: 1755583 - protein, 20 aa, Staphylococcus epidermidis
AGSGPSQLGSPDSAGVPQSV

SEQ ID NO: 1755584 - protein, 9 aa, Staphylococcus epidermidis
AGSTDSVIP

SEQ ID NO: 1755585 - protein, 6 aa, Staphylococcus epidermidis
AGTGMR

SEQ ID NO: 1755586 - protein, 6 aa, Staphylococcus epidermidis
AGVETA

SEQ ID NO: 1755587 - protein, 8 aa, Staphylococcus epidermidis
AGVGRKTA

SEQ ID NO: 1755588 - protein, 4 aa, Staphylococcus epidermidis
AGYQ

SEQ ID NO: 1755589 - protein, 9 aa, Staphylococcus epidermidis
AHDAKTTRL

SEQ ID NO: 1755590 - protein, 5 aa, Staphylococcus epidermidis
AHGIP

SEQ ID NO: 1755591 - protein, 9 aa, Staphylococcus epidermidis
AHGSSNAKA

SEQ ID NO: 1755592 - protein, 13 aa, Staphylococcus epidermidis
AHHNKKVDAPSGT

SEQ ID NO: 1755593 - protein, 7 aa, Staphylococcus epidermidis
AHPGLPD

SEQ ID NO: 1755594 - protein, 5 aa, Staphylococcus epidermidis
AIENA

SEQ ID NO: 1755595 - protein, 9 aa, Staphylococcus epidermidis
AIKGKRDDL

SEQ ID NO: 1755596 - protein, 6 aa, Staphylococcus epidermidis
AIKPGQ

SEQ ID NO: 1755597 - protein, 17 aa, Staphylococcus epidermidis
AINAGQSVSRVGGSAQI

SEQ ID NO: 1755598 - protein, 6 aa, Staphylococcus epidermidis
AIPYGT

SEQ ID NO: 1755599 - protein, 7 aa, Staphylococcus epidermidis
AISPRTT

SEQ ID NO: 1755600 - protein, 5 aa, Staphylococcus epidermidis
AITPG

SEQ ID NO: 1755601 - protein, 9 aa, Staphylococcus epidermidis
AKAISGSTQ

SEQ ID NO: 1755602 - protein, 7 aa, Staphylococcus epidermidis
AKAKTIE

SEQ ID NO: 1755603 - protein, 6 aa, Staphylococcus epidermidis
AKDEDW

SEQ ID NO: 1755604 - protein, 7 aa, Staphylococcus epidermidis
AKDRQQE

SEQ ID NO: 1755605 - protein, 7 aa, Staphylococcus epidermidis
AKEAEVP

SEQ ID NO: 1755606 - protein, 5 aa, Staphylococcus epidermidis
AKEGN

SEQ ID NO: 1755607 - protein, 9 aa, Staphylococcus epidermidis
AKELGKGKT

SEQ ID NO: 1755608 - protein, 13 aa, Staphylococcus epidermidis
AKESGSAAAPTAG

SEQ ID NO: 1755609 - protein, 11 aa, Staphylococcus epidermidis
AKETKNKTSFP

SEQ ID NO: 1755610 - protein, 8 aa, Staphylococcus epidermidis
AKGSGAFG

SEQ ID NO: 1755611 - protein, 6 aa, Staphylococcus epidermidis
AKIEGE

SEQ ID NO: 1755612 - protein, 8 aa, Staphylococcus epidermidis
AKKGKGSG

SEQ ID NO: 1755613 - protein, 9 aa, Staphylococcus epidermidis
AKKYGNLGN

SEQ ID NO: 1755614 - protein, 6 aa, Staphylococcus epidermidis
AKPETL

SEQ ID NO: 1755615 - protein, 7 aa, Staphylococcus epidermidis
AKPGEIS

SEQ ID NO: 1755616 - protein, 12 aa, Staphylococcus epidermidis
AKQYGEEGLPED

SEQ ID NO: 1755617 - protein, 7 aa, Staphylococcus epidermidis
AKRAQRG

SEQ ID NO: 1755618 - protein, 11 aa, Staphylococcus epidermidis
AKSAEETENGV

SEQ ID NO: 1755619 - protein, 8 aa, Staphylococcus epidermidis
AKSNDKKS

SEQ ID NO: 1755620 - protein, 8 aa, Staphylococcus epidermidis
AKTCPHDA

SEQ ID NO: 1755621 - protein, 6 aa, Staphylococcus epidermidis
AKTFEQ

SEQ ID NO: 1755622 - protein, 6 aa, Staphylococcus epidermidis
AKVSDK

SEQ ID NO: 1755623 - protein, 5 aa, Staphylococcus epidermidis
ALAVG

SEQ ID NO: 1755624 - protein, 8 aa, Staphylococcus epidermidis
ALDESNGL

SEQ ID NO: 1755625 - protein, 15 aa, Staphylococcus epidermidis
ALESLEGRNTRPTMD

SEQ ID NO: 1755626 - protein, 4 aa, Staphylococcus epidermidis
ALGE

SEQ ID NO: 1755627 - protein, 10 aa, Staphylococcus epidermidis
ALGKSPQEQL

SEQ ID NO: 1755628 - protein, 7 aa, Staphylococcus epidermidis
ALHDPNG

SEQ ID NO: 1755629 - protein, 9 aa, Staphylococcus epidermidis
ALKDKGAKE

SEQ ID NO: 1755630 - protein, 5 aa, Staphylococcus epidermidis
ALNDA

SEQ ID NO: 1755631 - protein, 9 aa, Staphylococcus epidermidis
ALPANEGRG

SEQ ID NO: 1755632 - protein, 6 aa, Staphylococcus epidermidis
ALPDSE

SEQ ID NO: 1755633 - protein, 5 aa, Staphylococcus epidermidis
ALSTD

SEQ ID NO: 1755634 - protein, 10 aa, Staphylococcus epidermidis
ALTETDGDID

SEQ ID NO: 1755635 - protein, 10 aa, Staphylococcus epidermidis
AMPRTTNGNI

SEQ ID NO: 1755636 - protein, 5 aa, Staphylococcus epidermidis
ANAAP

SEQ ID NO: 1755637 - protein, 8 aa, Staphylococcus epidermidis
ANADAKAE

SEQ ID NO: 1755638 - protein, 10 aa, Staphylococcus epidermidis
ANAGPNTNGS

SEQ ID NO: 1755639 - protein, 5 aa, Staphylococcus epidermidis
ANEQL

SEQ ID NO: 1755640 - protein, 6 aa, Staphylococcus epidermidis
ANEVPK

SEQ ID NO: 1755641 - protein, 8 aa, Staphylococcus epidermidis
ANGAGKST

SEQ ID NO: 1755642 - protein, 12 aa, Staphylococcus epidermidis
ANGGRKKTIERS

SEQ ID NO: 1755643 - protein, 10 aa, Staphylococcus epidermidis
ANGPTTPEAT

SEQ ID NO: 1755644 - protein, 5 aa, Staphylococcus epidermidis
ANGQT

SEQ ID NO: 1755645 - protein, 7 aa, Staphylococcus epidermidis
ANKAVTD

SEQ ID NO: 1755646 - protein, 6 aa, Staphylococcus epidermidis
ANKPPT

SEQ ID NO: 1755647 - protein, 11 aa, Staphylococcus epidermidis
ANKVHANSNIG

SEQ ID NO: 1755648 - protein, 7 aa, Staphylococcus epidermidis
ANLGSSV

SEQ ID NO: 1755649 - protein, 6 aa, Staphylococcus epidermidis
ANNPSH

SEQ ID NO: 1755650 - protein, 6 aa, Staphylococcus epidermidis
ANPLDS

SEQ ID NO: 1755651 - protein, 6 aa, Staphylococcus epidermidis
ANPTGD

SEQ ID NO: 1755652 - protein, 10 aa, Staphylococcus epidermidis
ANRPASGTQI

SEQ ID NO: 1755653 - protein, 10 aa, Staphylococcus epidermidis
ANSRLDENGR

SEQ ID NO: 1755654 - protein, 8 aa, Staphylococcus epidermidis
ANTDEEAR

SEQ ID NO: 1755655 - protein, 19 aa, Staphylococcus epidermidis
ANVAALGEKHKGAGEGADD

SEQ ID NO: 1755656 - protein, 9 aa, Staphylococcus epidermidis
APEDEQTET

SEQ ID NO: 1755657 - protein, 5 aa, Staphylococcus epidermidis
APEYG

SEQ ID NO: 1755658 - protein, 5 aa, Staphylococcus epidermidis
APGPI

SEQ ID NO: 1755659 - protein, 9 aa, Staphylococcus epidermidis
APGSITPHT

SEQ ID NO: 1755660 - protein, 5 aa, Staphylococcus epidermidis
APHQG

SEQ ID NO: 1755661 - protein, 6 aa, Staphylococcus epidermidis
APIPGT

SEQ ID NO: 1755662 - protein, 5 aa, Staphylococcus epidermidis
APKGA

SEQ ID NO: 1755663 - protein, 5 aa, Staphylococcus epidermidis
APKTV

SEQ ID NO: 1755664 - protein, 8 aa, Staphylococcus epidermidis
APLGSGKS

SEQ ID NO: 1755665 - protein, 6 aa, Staphylococcus epidermidis
APPETF

SEQ ID NO: 1755666 - protein, 10 aa, Staphylococcus epidermidis
APRPHNSGHY

SEQ ID NO: 1755667 - protein, 5 aa, Staphylococcus epidermidis
APSGK

SEQ ID NO: 1755668 - protein, 13 aa, Staphylococcus epidermidis
APTAGQEASQLAS

SEQ ID NO: 1755669 - protein, 7 aa, Staphylococcus epidermidis
APTDAED

SEQ ID NO: 1755670 - protein, 5 aa, Staphylococcus epidermidis
APTGH

SEQ ID NO: 1755671 - protein, 5 aa, Staphylococcus epidermidis
APTTY

SEQ ID NO: 1755672 - protein, 5 aa, Staphylococcus epidermidis
APYKY

SEQ ID NO: 1755673 - protein, 9 aa, Staphylococcus epidermidis
AQDKMNTVD

SEQ ID NO: 1755674 - protein, 4 aa, Staphylococcus epidermidis
AQER

SEQ ID NO: 1755675 - protein, 11 aa, Staphylococcus epidermidis
AQGTSSRSTKL

SEQ ID NO: 1755676 - protein, 8 aa, Staphylococcus epidermidis
AQKPQGSK

SEQ ID NO: 1755677 - protein, 4 aa, Staphylococcus epidermidis
AQMD

SEQ ID NO: 1755678 - protein, 4 aa, Staphylococcus epidermidis
AQNE

SEQ ID NO: 1755679 - protein, 6 aa, Staphylococcus epidermidis
AQNSPV

SEQ ID NO: 1755680 - protein, 7 aa, Staphylococcus epidermidis
AQNTTHA

SEQ ID NO: 1755681 - protein, 5 aa, Staphylococcus epidermidis
AQQEL

SEQ ID NO: 1755682 - protein, 6 aa, Staphylococcus epidermidis
AQQLTN

SEQ ID NO: 1755683 - protein, 14 aa, Staphylococcus epidermidis
AQQNPLRDYQNEGH

SEQ ID NO: 1755684 - protein, 6 aa, Staphylococcus epidermidis
AQRPNE

SEQ ID NO: 1755685 - protein, 6 aa, Staphylococcus epidermidis
AQRQGF

SEQ ID NO: 1755686 - protein, 5 aa, Staphylococcus epidermidis
AQRTA

SEQ ID NO: 1755687 - protein, 8 aa, Staphylococcus epidermidis
AQSGETRE

SEQ ID NO: 1755688 - protein, 11 aa, Staphylococcus epidermidis
AQSGVEPQTET

SEQ ID NO: 1755689 - protein, 5 aa, Staphylococcus epidermidis
AQSPG

SEQ ID NO: 1755690 - protein, 4 aa, Staphylococcus epidermidis
AQTG

SEQ ID NO: 1755691 - protein, 9 aa, Staphylococcus epidermidis
AQTNANKLG

SEQ ID NO: 1755692 - protein, 6 aa, Staphylococcus epidermidis
AQTSSA

SEQ ID NO: 1755693 - protein, 7 aa, Staphylococcus epidermidis
AREGKKV

SEQ ID NO: 1755694 - protein, 5 aa, Staphylococcus epidermidis
AREGY

SEQ ID NO: 1755695 - protein, 12 aa, Staphylococcus epidermidis
AREREIEQSKAN

SEQ ID NO: 1755696 - protein, 33 aa, Staphylococcus epidermidis
ARGGRGGRGNSRFATPRNPAPDFSENGEPGEEL

SEQ ID NO: 1755697 - protein, 6 aa, Staphylococcus epidermidis
ARGNSG

SEQ ID NO: 1755698 - protein, 6 aa, Staphylococcus epidermidis
ARKPII

SEQ ID NO: 1755699 - protein, 8 aa, Staphylococcus epidermidis
ARLSSDGK

SEQ ID NO: 1755700 - protein, 8 aa, Staphylococcus epidermidis
ARNPKGQA

SEQ ID NO: 1755701 - protein, 5 aa, Staphylococcus epidermidis
ARPAI

SEQ ID NO: 1755702 - protein, 14 aa, Staphylococcus epidermidis
ARQDRKARSREPIT

SEQ ID NO: 1755703 - protein, 7 aa, Staphylococcus epidermidis
ARRKKTI

SEQ ID NO: 1755704 - protein, 8 aa, Staphylococcus epidermidis
ARRRKARG

SEQ ID NO: 1755705 - protein, 8 aa, Staphylococcus epidermidis
ARSPRDGR

SEQ ID NO: 1755706 - protein, 8 aa, Staphylococcus epidermidis
ARTHRDTE

SEQ ID NO: 1755707 - protein, 7 aa, Staphylococcus epidermidis
ARTQEQA

SEQ ID NO: 1755708 - protein, 8 aa, Staphylococcus epidermidis
ARVTESNL

SEQ ID NO: 1755709 - protein, 9 aa, Staphylococcus epidermidis
ASAPEGTSE

SEQ ID NO: 1755710 - protein, 8 aa, Staphylococcus epidermidis
ASARRGAK

SEQ ID NO: 1755711 - protein, 7 aa, Staphylococcus epidermidis
ASEGGMR

SEQ ID NO: 1755712 - protein, 16 aa, Staphylococcus epidermidis
ASEGSEVLEEKDWGKR

SEQ ID NO: 1755713 - protein, 7 aa, Staphylococcus epidermidis
ASGAVGS

SEQ ID NO: 1755714 - protein, 10 aa, Staphylococcus epidermidis
ASGGDGDGYA

SEQ ID NO: 1755715 - protein, 8 aa, Staphylococcus epidermidis
ASGRTPYV

SEQ ID NO: 1755716 - protein, 8 aa, Staphylococcus epidermidis
ASHKEGKW

SEQ ID NO: 1755717 - protein, 7 aa, Staphylococcus epidermidis
ASINDEI

SEQ ID NO: 1755718 - protein, 13 aa, Staphylococcus epidermidis
ASKLGFEPKEGDE

SEQ ID NO: 1755719 - protein, 7 aa, Staphylococcus epidermidis
ASLETES

SEQ ID NO: 1755720 - protein, 11 aa, Staphylococcus epidermidis
ASNEADKYDEE

SEQ ID NO: 1755721 - protein, 5 aa, Staphylococcus epidermidis
ASNTN

SEQ ID NO: 1755722 - protein, 7 aa, Staphylococcus epidermidis
ASNVNDV

SEQ ID NO: 1755723 - protein, 5 aa, Staphylococcus epidermidis
ASPEI

SEQ ID NO: 1755724 - protein, 6 aa, Staphylococcus epidermidis
ASPEKI

SEQ ID NO: 1755725 - protein, 5 aa, Staphylococcus epidermidis
ASPHE

SEQ ID NO: 1755726 - protein, 5 aa, Staphylococcus epidermidis
ASPNY

SEQ ID NO: 1755727 - protein, 5 aa, Staphylococcus epidermidis
ASQAG

SEQ ID NO: 1755728 - protein, 8 aa, Staphylococcus epidermidis
ASQEENAP

SEQ ID NO: 1755729 - protein, 6 aa, Staphylococcus epidermidis
ASQGNR

SEQ ID NO: 1755730 - protein, 5 aa, Staphylococcus epidermidis
ASRAN

SEQ ID NO: 1755731 - protein, 6 aa, Staphylococcus epidermidis
ASSKGL

SEQ ID NO: 1755732 - protein, 14 aa, Staphylococcus epidermidis
ASSKTIPTTSQPAI

SEQ ID NO: 1755733 - protein, 7 aa, Staphylococcus epidermidis
ASSNDYR

SEQ ID NO: 1755734 - protein, 7 aa, Staphylococcus epidermidis
ASTGAAI

SEQ ID NO: 1755735 - protein, 8 aa, Staphylococcus epidermidis
ASTGTDAV

SEQ ID NO: 1755736 - protein, 18 aa, Staphylococcus epidermidis
ASTSNRNFEGRQGKGART

SEQ ID NO: 1755737 - protein, 9 aa, Staphylococcus epidermidis
ASTVEAQEK

SEQ ID NO: 1755738 - protein, 7 aa, Staphylococcus epidermidis
ASVIPGS

SEQ ID NO: 1755739 - protein, 7 aa, Staphylococcus epidermidis
ATAQKGF

SEQ ID NO: 1755740 - protein, 4 aa, Staphylococcus epidermidis
ATED

SEQ ID NO: 1755741 - protein, 4 aa, Staphylococcus epidermidis
ATES

SEQ ID NO: 1755742 - protein, 17 aa, Staphylococcus epidermidis
ATESGSTARTISKYRPH

SEQ ID NO: 1755743 - protein, 6 aa, Staphylococcus epidermidis
ATGGTI

SEQ ID NO: 1755744 - protein, 7 aa, Staphylococcus epidermidis
ATINDKT

SEQ ID NO: 1755745 - protein, 4 aa, Staphylococcus epidermidis
ATIR

SEQ ID NO: 1755746 - protein, 10 aa, Staphylococcus epidermidis
ATKEEGPIGK

SEQ ID NO: 1755747 - protein, 5 aa, Staphylococcus epidermidis
ATKGA

SEQ ID NO: 1755748 - protein, 6 aa, Staphylococcus epidermidis
ATLGTQ

SEQ ID NO: 1755749 - protein, 5 aa, Staphylococcus epidermidis
ATPDQ

SEQ ID NO: 1755750 - protein, 8 aa, Staphylococcus epidermidis
ATPENIPE

SEQ ID NO: 1755751 - protein, 8 aa, Staphylococcus epidermidis
ATPGPYEL

SEQ ID NO: 1755752 - protein, 6 aa, Staphylococcus epidermidis
ATQNKD

SEQ ID NO: 1755753 - protein, 9 aa, Staphylococcus epidermidis
ATRSALNSV

SEQ ID NO: 1755754 - protein, 12 aa, Staphylococcus epidermidis
ATSALDPATTSS

SEQ ID NO: 1755755 - protein, 12 aa, Staphylococcus epidermidis
ATSALDPQTTDE

SEQ ID NO: 1755756 - protein, 8 aa, Staphylococcus epidermidis
ATSEGDPV

SEQ ID NO: 1755757 - protein, 13 aa, Staphylococcus epidermidis
ATSLTEAGYVGDD

SEQ ID NO: 1755758 - protein, 13 aa, Staphylococcus epidermidis
ATTGQNALSQARS

SEQ ID NO: 1755759 - protein, 11 aa, Staphylococcus epidermidis
ATVEQKPKMEG

SEQ ID NO: 1755760 - protein, 8 aa, Staphylococcus epidermidis
ATVQEEVG

SEQ ID NO: 1755761 - protein, 7 aa, Staphylococcus epidermidis
AVAGKFN

SEQ ID NO: 1755762 - protein, 8 aa, Staphylococcus epidermidis
AVATNEVN

SEQ ID NO: 1755763 - protein, 5 aa, Staphylococcus epidermidis
AVAYT

SEQ ID NO: 1755764 - protein, 7 aa, Staphylococcus epidermidis
AVEAGES

SEQ ID NO: 1755765 - protein, 19 aa, Staphylococcus epidermidis
AVKSGEADGCVSAGNTGAL

SEQ ID NO: 1755766 - protein, 14 aa, Staphylococcus epidermidis
AVPGGSSGGSAAAV

SEQ ID NO: 1755767 - protein, 4 aa, Staphylococcus epidermidis
AVTQ

SEQ ID NO: 1755768 - protein, 5 aa, Staphylococcus epidermidis
AYAHD

SEQ ID NO: 1755769 - protein, 6 aa, Staphylococcus epidermidis
AYGGEV

SEQ ID NO: 1755770 - protein, 5 aa, Staphylococcus epidermidis
AYPNR

SEQ ID NO: 1755771 - protein, 5 aa, Staphylococcus epidermidis
AYQGY

SEQ ID NO: 1755772 - protein, 8 aa, Staphylococcus epidermidis
AYTGEGKQ

SEQ ID NO: 1755773 - protein, 5 aa, Staphylococcus epidermidis
AYTKR

SEQ ID NO: 1755774 - protein, 8 aa, Staphylococcus epidermidis
AYVPSTDT

SEQ ID NO: 1755775 - protein, 6 aa, Staphylococcus epidermidis
CAPGTS

SEQ ID NO: 1755776 - protein, 4 aa, Staphylococcus epidermidis
CENC

SEQ ID NO: 1755777 - protein, 9 aa, Staphylococcus epidermidis
CGPEPDETL

SEQ ID NO: 1755778 - protein, 9 aa, Staphylococcus epidermidis
CGQSNGRPI

SEQ ID NO: 1755779 - protein, 11 aa, Staphylococcus epidermidis
CIAGGGSDGNI

SEQ ID NO: 1755780 - protein, 7 aa, Staphylococcus epidermidis
CKQSGAR

SEQ ID NO: 1755781 - protein, 8 aa, Staphylococcus epidermidis
CPLGPRPI

SEQ ID NO: 1755782 - protein, 8 aa, Staphylococcus epidermidis
CRSPLAES

SEQ ID NO: 1755783 - protein, 8 aa, Staphylococcus epidermidis
CSAPGGKA

SEQ ID NO: 1755784 - protein, 9 aa, Staphylococcus epidermidis
CTGKGNDQV

SEQ ID NO: 1755785 - protein, 20 aa, Staphylococcus epidermidis
DAADSAPSFGDRKTYQMDPA

SEQ ID NO: 1755786 - protein, 8 aa, Staphylococcus epidermidis
DADGVTST

SEQ ID NO: 1755787 - protein, 22 aa, Staphylococcus epidermidis
DAEENAEADKKRREEVDLRNEA

SEQ ID NO: 1755788 - protein, 7 aa, Staphylococcus epidermidis
DAGREGE

SEQ ID NO: 1755789 - protein, 7 aa, Staphylococcus epidermidis
DAGRGYR

SEQ ID NO: 1755790 - protein, 7 aa, Staphylococcus epidermidis
DAKAQGY

SEQ ID NO: 1755791 - protein, 8 aa, Staphylococcus epidermidis
DALSDKER

SEQ ID NO: 1755792 - protein, 9 aa, Staphylococcus epidermidis
DANDTNAGL

SEQ ID NO: 1755793 - protein, 7 aa, Staphylococcus epidermidis
DANSQSE

SEQ ID NO: 1755794 - protein, 4 aa, Staphylococcus epidermidis
DANT

SEQ ID NO: 1755795 - protein, 4 aa, Staphylococcus epidermidis
DAPE

SEQ ID NO: 1755796 - protein, 7 aa, Staphylococcus epidermidis
DAPFQTQ

SEQ ID NO: 1755797 - protein, 7 aa, Staphylococcus epidermidis
DASNRGM

SEQ ID NO: 1755798 - protein, 13 aa, Staphylococcus epidermidis
DATGKKQGRGAYV

SEQ ID NO: 1755799 - protein, 4 aa, Staphylococcus epidermidis
DATN

SEQ ID NO: 1755800 - protein, 6 aa, Staphylococcus epidermidis
DATTSL

SEQ ID NO: 1755801 - protein, 6 aa, Staphylococcus epidermidis
DAVSDR

SEQ ID NO: 1755802 - protein, 6 aa, Staphylococcus epidermidis
DDAPGI

SEQ ID NO: 1755803 - protein, 11 aa, Staphylococcus epidermidis
DDDEDNDKPDL

SEQ ID NO: 1755804 - protein, 4 aa, Staphylococcus epidermidis
DDEG

SEQ ID NO: 1755805 - protein, 5 aa, Staphylococcus epidermidis
DDFNE

SEQ ID NO: 1755806 - protein, 7 aa, Staphylococcus epidermidis
DDIEEEG

SEQ ID NO: 1755807 - protein, 8 aa, Staphylococcus epidermidis
DDKETVNH

SEQ ID NO: 1755808 - protein, 12 aa, Staphylococcus epidermidis
DDLRDQGSNVYA

SEQ ID NO: 1755809 - protein, 8 aa, Staphylococcus epidermidis
DDLVSGKS

SEQ ID NO: 1755810 - protein, 6 aa, Staphylococcus epidermidis
DDPETF

SEQ ID NO: 1755811 - protein, 8 aa, Staphylococcus epidermidis
DDRNEKMG

SEQ ID NO: 1755812 - protein, 5 aa, Staphylococcus epidermidis
DDRYH

SEQ ID NO: 1755813 - protein, 8 aa, Staphylococcus epidermidis
DDSTPIES

SEQ ID NO: 1755814 - protein, 7 aa, Staphylococcus epidermidis
DDTGAVD

SEQ ID NO: 1755815 - protein, 6 aa, Staphylococcus epidermidis
DDTMRA

SEQ ID NO: 1755816 - protein, 5 aa, Staphylococcus epidermidis
DDTTL

SEQ ID NO: 1755817 - protein, 9 aa, Staphylococcus epidermidis
DDVQEQTKQ

SEQ ID NO: 1755818 - protein, 8 aa, Staphylococcus epidermidis
DDYNEDDY

SEQ ID NO: 1755819 - protein, 11 aa, Staphylococcus epidermidis
DDYTDPAPATT

SEQ ID NO: 1755820 - protein, 6 aa, Staphylococcus epidermidis
DEAQNA

SEQ ID NO: 1755821 - protein, 6 aa, Staphylococcus epidermidis
DEDNDI

SEQ ID NO: 1755822 - protein, 9 aa, Staphylococcus epidermidis
DEDRENEGD

SEQ ID NO: 1755823 - protein, 11 aa, Staphylococcus epidermidis
DEDSQLPTDQN

SEQ ID NO: 1755824 - protein, 11 aa, Staphylococcus epidermidis
DEEGNSLDAAR

SEQ ID NO: 1755825 - protein, 5 aa, Staphylococcus epidermidis
DEEIG

SEQ ID NO: 1755826 - protein, 7 aa, Staphylococcus epidermidis
DEERAKH

SEQ ID NO: 1755827 - protein, 6 aa, Staphylococcus epidermidis
DEFNQI

SEQ ID NO: 1755828 - protein, 5 aa, Staphylococcus epidermidis
DEIAP

SEQ ID NO: 1755829 - protein, 4 aa, Staphylococcus epidermidis
DEKL

SEQ ID NO: 1755830 - protein, 15 aa, Staphylococcus epidermidis
DELEPGKIRNSNGPM

SEQ ID NO: 1755831 - protein, 14 aa, Staphylococcus epidermidis
DELTTAQSKTLNDN

SEQ ID NO: 1755832 - protein, 6 aa, Staphylococcus epidermidis
DEMTPY

SEQ ID NO: 1755833 - protein, 9 aa, Staphylococcus epidermidis
DENPSTAAK

SEQ ID NO: 1755834 - protein, 6 aa, Staphylococcus epidermidis
DENVTH

SEQ ID NO: 1755835 - protein, 14 aa, Staphylococcus epidermidis
DEPTGALDSKTSQD

SEQ ID NO: 1755836 - protein, 7 aa, Staphylococcus epidermidis
DEPTTAL

SEQ ID NO: 1755837 - protein, 7 aa, Staphylococcus epidermidis
DEPTVED

SEQ ID NO: 1755838 - protein, 11 aa, Staphylococcus epidermidis
DEQHDEKLEEI

SEQ ID NO: 1755839 - protein, 11 aa, Staphylococcus epidermidis
DEQSPDIAQGV

SEQ ID NO: 1755840 - protein, 6 aa, Staphylococcus epidermidis
DERAKA

SEQ ID NO: 1755841 - protein, 17 aa, Staphylococcus epidermidis
DEREEEVREDSYHYEGG

SEQ ID NO: 1755842 - protein, 8 aa, Staphylococcus epidermidis
DETTAARK

SEQ ID NO: 1755843 - protein, 7 aa, Staphylococcus epidermidis
DETYYTE

SEQ ID NO: 1755844 - protein, 11 aa, Staphylococcus epidermidis
DEVRSSKRVTT

SEQ ID NO: 1755845 - protein, 24 aa, Staphylococcus epidermidis
DEYEERRRGDNKIGTTKKGIGPAY

SEQ ID NO: 1755846 - protein, 5 aa, Staphylococcus epidermidis
DEYEQ

SEQ ID NO: 1755847 - protein, 5 aa, Staphylococcus epidermidis
DEYNQ

SEQ ID NO: 1755848 - protein, 11 aa, Staphylococcus epidermidis
DFIQPPSRKNE

SEQ ID NO: 1755849 - protein, 8 aa, Staphylococcus epidermidis
DFKDDKDR

SEQ ID NO: 1755850 - protein, 5 aa, Staphylococcus epidermidis
DFPDT

SEQ ID NO: 1755851 - protein, 6 aa, Staphylococcus epidermidis
DFPGDD

SEQ ID NO: 1755852 - protein, 9 aa, Staphylococcus epidermidis
DGAVDDSYG

SEQ ID NO: 1755853 - protein, 6 aa, Staphylococcus epidermidis
DGDGDR

SEQ ID NO: 1755854 - protein, 4 aa, Staphylococcus epidermidis
DGEG

SEQ ID NO: 1755855 - protein, 10 aa, Staphylococcus epidermidis
DGEPSAFNYS

SEQ ID NO: 1755856 - protein, 7 aa, Staphylococcus epidermidis
DGETKRI

SEQ ID NO: 1755857 - protein, 8 aa, Staphylococcus epidermidis
DGEYGGKL

SEQ ID NO: 1755858 - protein, 25 aa, Staphylococcus epidermidis
DGGRNSYAQRTVGREDRLPDDDGGH

SEQ ID NO: 1755859 - protein, 7 aa, Staphylococcus epidermidis
DGGRVDI

SEQ ID NO: 1755860 - protein, 15 aa, Staphylococcus epidermidis
DGKSYTDQVDISSSE

SEQ ID NO: 1755861 - protein, 6 aa, Staphylococcus epidermidis
DGLSGP

SEQ ID NO: 1755862 - protein, 5 aa, Staphylococcus epidermidis
DGNVV

SEQ ID NO: 1755863 - protein, 6 aa, Staphylococcus epidermidis
DGPSME

SEQ ID NO: 1755864 - protein, 9 aa, Staphylococcus epidermidis
DGQKAPVAH

SEQ ID NO: 1755865 - protein, 6 aa, Staphylococcus epidermidis
DGREGV

SEQ ID NO: 1755866 - protein, 4 aa, Staphylococcus epidermidis
DGRV

SEQ ID NO: 1755867 - protein, 6 aa, Staphylococcus epidermidis
DGSDRY

SEQ ID NO: 1755868 - protein, 7 aa, Staphylococcus epidermidis
DGSGGGL

SEQ ID NO: 1755869 - protein, 7 aa, Staphylococcus epidermidis
DGSVGSS

SEQ ID NO: 1755870 - protein, 7 aa, Staphylococcus epidermidis
DGTAKGG

SEQ ID NO: 1755871 - protein, 7 aa, Staphylococcus epidermidis
DGTDYSS

SEQ ID NO: 1755872 - protein, 4 aa, Staphylococcus epidermidis
DGTM

SEQ ID NO: 1755873 - protein, 8 aa, Staphylococcus epidermidis
DGTMSSKI

SEQ ID NO: 1755874 - protein, 7 aa, Staphylococcus epidermidis
DGTVKTF

SEQ ID NO: 1755875 - protein, 4 aa, Staphylococcus epidermidis
DGVA

SEQ ID NO: 1755876 - protein, 6 aa, Staphylococcus epidermidis
DGVPTY

SEQ ID NO: 1755877 - protein, 12 aa, Staphylococcus epidermidis
DGVSERGGHPVY

SEQ ID NO: 1755878 - protein, 8 aa, Staphylococcus epidermidis
DGYGQTES

SEQ ID NO: 1755879 - protein, 12 aa, Staphylococcus epidermidis
DGYKSLEEGQSV

SEQ ID NO: 1755880 - protein, 5 aa, Staphylococcus epidermidis
DGYTG

SEQ ID NO: 1755881 - protein, 14 aa, Staphylococcus epidermidis
DHDDINVSQLAQAE

SEQ ID NO: 1755882 - protein, 17 aa, Staphylococcus epidermidis
DHDEDELSHYSNATTDI

SEQ ID NO: 1755883 - protein, 6 aa, Staphylococcus epidermidis
DHDGTK

SEQ ID NO: 1755884 - protein, 24 aa, Staphylococcus epidermidis
DHGNSDQVLTDDDQPMTTHTTNPV

SEQ ID NO: 1755885 - protein, 4 aa, Staphylococcus epidermidis
DHIP

SEQ ID NO: 1755886 - protein, 4 aa, Staphylococcus epidermidis
DHNP

SEQ ID NO: 1755887 - protein, 6 aa, Staphylococcus epidermidis
DHRLSP

SEQ ID NO: 1755888 - protein, 4 aa, Staphylococcus epidermidis
DHYQ

SEQ ID NO: 1755889 - protein, 25 aa, Staphylococcus epidermidis
DIEGKTGTAQVADSNGGGYVKGENP

SEQ ID NO: 1755890 - protein, 5 aa, Staphylococcus epidermidis
DIKRQ

SEQ ID NO: 1755891 - protein, 4 aa, Staphylococcus epidermidis
DIPG

SEQ ID NO: 1755892 - protein, 9 aa, Staphylococcus epidermidis
DIQPSSRRY

SEQ ID NO: 1755893 - protein, 4 aa, Staphylococcus epidermidis
DIQR

SEQ ID NO: 1755894 - protein, 5 aa, Staphylococcus epidermidis
DISTT

SEQ ID NO: 1755895 - protein, 7 aa, Staphylococcus epidermidis
DITQESS

SEQ ID NO: 1755896 - protein, 13 aa, Staphylococcus epidermidis
DITTDSRTAKEGS

SEQ ID NO: 1755897 - protein, 7 aa, Staphylococcus epidermidis
DKAPEIG

SEQ ID NO: 1755898 - protein, 9 aa, Staphylococcus epidermidis
DKAQTTRNK

SEQ ID NO: 1755899 - protein, 8 aa, Staphylococcus epidermidis
DKDKTSAL

SEQ ID NO: 1755900 - protein, 5 aa, Staphylococcus epidermidis
DKDTE

SEQ ID NO: 1755901 - protein, 6 aa, Staphylococcus epidermidis
DKDTSG

SEQ ID NO: 1755902 - protein, 9 aa, Staphylococcus epidermidis
DKDVYDPRK

SEQ ID NO: 1755903 - protein, 7 aa, Staphylococcus epidermidis
DKDYPGI

SEQ ID NO: 1755904 - protein, 7 aa, Staphylococcus epidermidis
DKEDGKQ

SEQ ID NO: 1755905 - protein, 9 aa, Staphylococcus epidermidis
DKGADGYEM

SEQ ID NO: 1755906 - protein, 6 aa, Staphylococcus epidermidis
DKGELT

SEQ ID NO: 1755907 - protein, 8 aa, Staphylococcus epidermidis
DKGPRGTR

SEQ ID NO: 1755908 - protein, 8 aa, Staphylococcus epidermidis
DKGVKDSD

SEQ ID NO: 1755909 - protein, 5 aa, Staphylococcus epidermidis
DKHNF

SEQ ID NO: 1755910 - protein, 9 aa, Staphylococcus epidermidis
DKKLSNENF

SEQ ID NO: 1755911 - protein, 7 aa, Staphylococcus epidermidis
DKKSRMA

SEQ ID NO: 1755912 - protein, 5 aa, Staphylococcus epidermidis
DKNDN

SEQ ID NO: 1755913 - protein, 10 aa, Staphylococcus epidermidis
DKNKTLNEGA

SEQ ID NO: 1755914 - protein, 10 aa, Staphylococcus epidermidis
DKPAARPEGV

SEQ ID NO: 1755915 - protein, 10 aa, Staphylococcus epidermidis
DKPDVDTIEG

SEQ ID NO: 1755916 - protein, 4 aa, Staphylococcus epidermidis
DKPR

SEQ ID NO: 1755917 - protein, 32 aa, Staphylococcus epidermidis
DKQAYKKGSKSNKYANKPAEGHAKKADTAPKR

SEQ ID NO: 1755918 - protein, 7 aa, Staphylococcus epidermidis
DKQPTVR

SEQ ID NO: 1755919 - protein, 6 aa, Staphylococcus epidermidis
DKQTTM

SEQ ID NO: 1755920 - protein, 5 aa, Staphylococcus epidermidis
DKSYP

SEQ ID NO: 1755921 - protein, 8 aa, Staphylococcus epidermidis
DKVEADVK

SEQ ID NO: 1755922 - protein, 7 aa, Staphylococcus epidermidis
DKVGNDG

SEQ ID NO: 1755923 - protein, 5 aa, Staphylococcus epidermidis
DKYPQ

SEQ ID NO: 1755924 - protein, 7 aa, Staphylococcus epidermidis
DLGPAES

SEQ ID NO: 1755925 - protein, 7 aa, Staphylococcus epidermidis
DLPGRSL

SEQ ID NO: 1755926 - protein, 7 aa, Staphylococcus epidermidis
DLPPEKV

SEQ ID NO: 1755927 - protein, 7 aa, Staphylococcus epidermidis
DLPTTTI

SEQ ID NO: 1755928 - protein, 13 aa, Staphylococcus epidermidis
DLRASQSQEEFDK

SEQ ID NO: 1755929 - protein, 19 aa, Staphylococcus epidermidis
DLRQGYEYSRTANPTRASL

SEQ ID NO: 1755930 - protein, 9 aa, Staphylococcus epidermidis
DLSGGEKAR

SEQ ID NO: 1755931 - protein, 8 aa, Staphylococcus epidermidis
DLSGGQRQ

SEQ ID NO: 1755932 - protein, 6 aa, Staphylococcus epidermidis
DLSKTF

SEQ ID NO: 1755933 - protein, 6 aa, Staphylococcus epidermidis
DLSSTD

SEQ ID NO: 1755934 - protein, 7 aa, Staphylococcus epidermidis
DLTPGLA

SEQ ID NO: 1755935 - protein, 4 aa, Staphylococcus epidermidis
DMSE

SEQ ID NO: 1755936 - protein, 5 aa, Staphylococcus epidermidis
DMSGV

SEQ ID NO: 1755937 - protein, 5 aa, Staphylococcus epidermidis
DMTNL

SEQ ID NO: 1755938 - protein, 7 aa, Staphylococcus epidermidis
DNDRARV

SEQ ID NO: 1755939 - protein, 9 aa, Staphylococcus epidermidis
DNEVSDPKE

SEQ ID NO: 1755940 - protein, 18 aa, Staphylococcus epidermidis
DNGRRGRPVTGPGNRPLK

SEQ ID NO: 1755941 - protein, 8 aa, Staphylococcus epidermidis
DNGTPIKT

SEQ ID NO: 1755942 - protein, 6 aa, Staphylococcus epidermidis
DNGYET

SEQ ID NO: 1755943 - protein, 7 aa, Staphylococcus epidermidis
DNKRSHD

SEQ ID NO: 1755944 - protein, 4 aa, Staphylococcus epidermidis
DNLS

SEQ ID NO: 1755945 - protein, 5 aa, Staphylococcus epidermidis
DNNEI

SEQ ID NO: 1755946 - protein, 8 aa, Staphylococcus epidermidis
DNPAIRGQ

SEQ ID NO: 1755947 - protein, 10 aa, Staphylococcus epidermidis
DNPSVPDSEY

SEQ ID NO: 1755948 - protein, 8 aa, Staphylococcus epidermidis
DNQGKAQP

SEQ ID NO: 1755949 - protein, 7 aa, Staphylococcus epidermidis
DNSGARE

SEQ ID NO: 1755950 - protein, 5 aa, Staphylococcus epidermidis
DNSLN

SEQ ID NO: 1755951 - protein, 6 aa, Staphylococcus epidermidis
DNVRHG

SEQ ID NO: 1755952 - protein, 7 aa, Staphylococcus epidermidis
DPAARST

SEQ ID NO: 1755953 - protein, 7 aa, Staphylococcus epidermidis
DPDCSPE

SEQ ID NO: 1755954 - protein, 5 aa, Staphylococcus epidermidis
DPETL

SEQ ID NO: 1755955 - protein, 6 aa, Staphylococcus epidermidis
DPFKKA

SEQ ID NO: 1755956 - protein, 6 aa, Staphylococcus epidermidis
DPGNYK

SEQ ID NO: 1755957 - protein, 9 aa, Staphylococcus epidermidis
DPGPTGLEK

SEQ ID NO: 1755958 - protein, 6 aa, Staphylococcus epidermidis
DPGWLG

SEQ ID NO: 1755959 - protein, 15 aa, Staphylococcus epidermidis
DPKNRRIAAGPEIQS

SEQ ID NO: 1755960 - protein, 11 aa, Staphylococcus epidermidis
DPKTNEPTRVG

SEQ ID NO: 1755961 - protein, 13 aa, Staphylococcus epidermidis
DPLDGHKGTNIGS

SEQ ID NO: 1755962 - protein, 9 aa, Staphylococcus epidermidis
DPQASIGRG

SEQ ID NO: 1755963 - protein, 5 aa, Staphylococcus epidermidis
DPSEI

SEQ ID NO: 1755964 - protein, 8 aa, Staphylococcus epidermidis
DPTDQKSV

SEQ ID NO: 1755965 - protein, 4 aa, Staphylococcus epidermidis
DPTE

SEQ ID NO: 1755966 - protein, 9 aa, Staphylococcus epidermidis
DPTKVTRSA

SEQ ID NO: 1755967 - protein, 11 aa, Staphylococcus epidermidis
DPWPKKRHAKR

SEQ ID NO: 1755968 - protein, 9 aa, Staphylococcus epidermidis
DPYHGPNQA

SEQ ID NO: 1755969 - protein, 10 aa, Staphylococcus epidermidis
DPYPISGSHG

SEQ ID NO: 1755970 - protein, 5 aa, Staphylococcus epidermidis
DQART

SEQ ID NO: 1755971 - protein, 12 aa, Staphylococcus epidermidis
DQEAQSPSDHAA

SEQ ID NO: 1755972 - protein, 11 aa, Staphylococcus epidermidis
DQGIHKRGAEI

SEQ ID NO: 1755973 - protein, 7 aa, Staphylococcus epidermidis
DQGQATS

SEQ ID NO: 1755974 - protein, 7 aa, Staphylococcus epidermidis
DQQVGAN

SEQ ID NO: 1755975 - protein, 14 aa, Staphylococcus epidermidis
DQRPHALSGGQQQR

SEQ ID NO: 1755976 - protein, 5 aa, Staphylococcus epidermidis
DQYSE

SEQ ID NO: 1755977 - protein, 4 aa, Staphylococcus epidermidis
DRAR

SEQ ID NO: 1755978 - protein, 9 aa, Staphylococcus epidermidis
DRDSSQRDL

SEQ ID NO: 1755979 - protein, 8 aa, Staphylococcus epidermidis
DRDTTKLE

SEQ ID NO: 1755980 - protein, 9 aa, Staphylococcus epidermidis
DRGPKPDKI

SEQ ID NO: 1755981 - protein, 7 aa, Staphylococcus epidermidis
DRNEDRI

SEQ ID NO: 1755982 - protein, 7 aa, Staphylococcus epidermidis
DRPHELR

SEQ ID NO: 1755983 - protein, 9 aa, Staphylococcus epidermidis
DRQTGKTTV

SEQ ID NO: 1755984 - protein, 4 aa, Staphylococcus epidermidis
DRRP

SEQ ID NO: 1755985 - protein, 4 aa, Staphylococcus epidermidis
DRVG

SEQ ID NO: 1755986 - protein, 16 aa, Staphylococcus epidermidis
DSAGGSTKSGRDSRTQ

SEQ ID NO: 1755987 - protein, 14 aa, Staphylococcus epidermidis
DSAHGTNPASASFA

SEQ ID NO: 1755988 - protein, 10 aa, Staphylococcus epidermidis
DSAKEKSNEG

SEQ ID NO: 1755989 - protein, 8 aa, Staphylococcus epidermidis
DSALRENE

SEQ ID NO: 1755990 - protein, 8 aa, Staphylococcus epidermidis
DSASGETI

SEQ ID NO: 1755991 - protein, 9 aa, Staphylococcus epidermidis
DSDDEGEKI

SEQ ID NO: 1755992 - protein, 7 aa, Staphylococcus epidermidis
DSDQSIY

SEQ ID NO: 1755993 - protein, 9 aa, Staphylococcus epidermidis
DSDSSSPHT

SEQ ID NO: 1755994 - protein, 5 aa, Staphylococcus epidermidis
DSFGT

SEQ ID NO: 1755995 - protein, 8 aa, Staphylococcus epidermidis
DSFSPSEV

SEQ ID NO: 1755996 - protein, 4 aa, Staphylococcus epidermidis
DSGL

SEQ ID NO: 1755997 - protein, 14 aa, Staphylococcus epidermidis
DSGVSGQAAQKMAE

SEQ ID NO: 1755998 - protein, 4 aa, Staphylococcus epidermidis
DSHR

SEQ ID NO: 1755999 - protein, 8 aa, Staphylococcus epidermidis
DSNRQTAI

SEQ ID NO: 1756000 - protein, 7 aa, Staphylococcus epidermidis
DSQELSD

SEQ ID NO: 1756001 - protein, 8 aa, Staphylococcus epidermidis
DSRGNPTV

SEQ ID NO: 1756002 - protein, 5 aa, Staphylococcus epidermidis
DSSYI

SEQ ID NO: 1756003 - protein, 5 aa, Staphylococcus epidermidis
DSTEF

SEQ ID NO: 1756004 - protein, 8 aa, Staphylococcus epidermidis
DSTSNVRA

SEQ ID NO: 1756005 - protein, 6 aa, Staphylococcus epidermidis
DTAKRM

SEQ ID NO: 1756006 - protein, 5 aa, Staphylococcus epidermidis
DTATE

SEQ ID NO: 1756007 - protein, 4 aa, Staphylococcus epidermidis
DTEE

SEQ ID NO: 1756008 - protein, 6 aa, Staphylococcus epidermidis
DTEKDG

SEQ ID NO: 1756009 - protein, 5 aa, Staphylococcus epidermidis
DTFET

SEQ ID NO: 1756010 - protein, 6 aa, Staphylococcus epidermidis
DTGRTH

SEQ ID NO: 1756011 - protein, 8 aa, Staphylococcus epidermidis
DTHQADDG

SEQ ID NO: 1756012 - protein, 10 aa, Staphylococcus epidermidis
DTKISGKELR

SEQ ID NO: 1756013 - protein, 8 aa, Staphylococcus epidermidis
DTKKQYNL

SEQ ID NO: 1756014 - protein, 7 aa, Staphylococcus epidermidis
DTKPTTF

SEQ ID NO: 1756015 - protein, 7 aa, Staphylococcus epidermidis
DTKRQGS

SEQ ID NO: 1756016 - protein, 7 aa, Staphylococcus epidermidis
DTNNKEA

SEQ ID NO: 1756017 - protein, 6 aa, Staphylococcus epidermidis
DTPEGK

SEQ ID NO: 1756018 - protein, 5 aa, Staphylococcus epidermidis
DTPQG

SEQ ID NO: 1756019 - protein, 14 aa, Staphylococcus epidermidis
DTQDIADELKNRRA

SEQ ID NO: 1756020 - protein, 7 aa, Staphylococcus epidermidis
DTQPFGI

SEQ ID NO: 1756021 - protein, 10 aa, Staphylococcus epidermidis
DTRKNDQQIR

SEQ ID NO: 1756022 - protein, 10 aa, Staphylococcus epidermidis
DTTSRKGAHE

SEQ ID NO: 1756023 - protein, 6 aa, Staphylococcus epidermidis
DTVTES

SEQ ID NO: 1756024 - protein, 19 aa, Staphylococcus epidermidis
DTYRSSGAGGQHVNTTDSA

SEQ ID NO: 1756025 - protein, 9 aa, Staphylococcus epidermidis
DTYTKGDHS

SEQ ID NO: 1756026 - protein, 15 aa, Staphylococcus epidermidis
DVEAGHAASVGRVDP

SEQ ID NO: 1756027 - protein, 5 aa, Staphylococcus epidermidis
DVEAT

SEQ ID NO: 1756028 - protein, 5 aa, Staphylococcus epidermidis
DVEPQ

SEQ ID NO: 1756029 - protein, 6 aa, Staphylococcus epidermidis
DVGGRY

SEQ ID NO: 1756030 - protein, 6 aa, Staphylococcus epidermidis
DVLPSD

SEQ ID NO: 1756031 - protein, 6 aa, Staphylococcus epidermidis
DVNQTE

SEQ ID NO: 1756032 - protein, 5 aa, Staphylococcus epidermidis
DVPNA

SEQ ID NO: 1756033 - protein, 7 aa, Staphylococcus epidermidis
DVQGSVE

SEQ ID NO: 1756034 - protein, 7 aa, Staphylococcus epidermidis
DVRDKGL

SEQ ID NO: 1756035 - protein, 9 aa, Staphylococcus epidermidis
DVRPTENQI

SEQ ID NO: 1756036 - protein, 9 aa, Staphylococcus epidermidis
DVSEENPDE

SEQ ID NO: 1756037 - protein, 8 aa, Staphylococcus epidermidis
DVTDQKNK

SEQ ID NO: 1756038 - protein, 9 aa, Staphylococcus epidermidis
DVTETKGNY

SEQ ID NO: 1756039 - protein, 5 aa, Staphylococcus epidermidis
DVTPF

SEQ ID NO: 1756040 - protein, 12 aa, Staphylococcus epidermidis
DVYKNEGQLSYV

SEQ ID NO: 1756041 - protein, 7 aa, Staphylococcus epidermidis
DWNKTGW

SEQ ID NO: 1756042 - protein, 6 aa, Staphylococcus epidermidis
DYAESL

SEQ ID NO: 1756043 - protein, 4 aa, Staphylococcus epidermidis
DYAG

SEQ ID NO: 1756044 - protein, 34 aa, Staphylococcus epidermidis
DYANYGDEATFGGGKSIRDGMAQNPNVTRDDKNV

SEQ ID NO: 1756045 - protein, 11 aa, Staphylococcus epidermidis
DYDRPGSNRKP

SEQ ID NO: 1756046 - protein, 6 aa, Staphylococcus epidermidis
DYGESD

SEQ ID NO: 1756047 - protein, 12 aa, Staphylococcus epidermidis
DYGNRENRKNAR

SEQ ID NO: 1756048 - protein, 6 aa, Staphylococcus epidermidis
DYSEYG

SEQ ID NO: 1756049 - protein, 4 aa, Staphylococcus epidermidis
DYTD

SEQ ID NO: 1756050 - protein, 18 aa, Staphylococcus epidermidis
EAAAGLPEDVKEYFTARF

SEQ ID NO: 1756051 - protein, 8 aa, Staphylococcus epidermidis
EAAENGKQ

SEQ ID NO: 1756052 - protein, 7 aa, Staphylococcus epidermidis
EAAEQSY

SEQ ID NO: 1756053 - protein, 5 aa, Staphylococcus epidermidis
EAARP

SEQ ID NO: 1756054 - protein, 4 aa, Staphylococcus epidermidis
EAEA

SEQ ID NO: 1756055 - protein, 11 aa, Staphylococcus epidermidis
EAHGVNPKAIE

SEQ ID NO: 1756056 - protein, 12 aa, Staphylococcus epidermidis
EAHKKLNQNVNP

SEQ ID NO: 1756057 - protein, 6 aa, Staphylococcus epidermidis
EAIREA

SEQ ID NO: 1756058 - protein, 6 aa, Staphylococcus epidermidis
EAKTGA

SEQ ID NO: 1756059 - protein, 6 aa, Staphylococcus epidermidis
EALSQN

SEQ ID NO: 1756060 - protein, 14 aa, Staphylococcus epidermidis
EARERAVAGEGPTV

SEQ ID NO: 1756061 - protein, 7 aa, Staphylococcus epidermidis
EARQVDP

SEQ ID NO: 1756062 - protein, 11 aa, Staphylococcus epidermidis
EASESDHGGYK

SEQ ID NO: 1756063 - protein, 8 aa, Staphylococcus epidermidis
EASKNGKT

SEQ ID NO: 1756064 - protein, 11 aa, Staphylococcus epidermidis
EASLSGPKRPQ

SEQ ID NO: 1756065 - protein, 6 aa, Staphylococcus epidermidis
EASQLT

SEQ ID NO: 1756066 - protein, 7 aa, Staphylococcus epidermidis
EASSKVR

SEQ ID NO: 1756067 - protein, 9 aa, Staphylococcus epidermidis
EASTHPSNF

SEQ ID NO: 1756068 - protein, 9 aa, Staphylococcus epidermidis
EATAGNTGI

SEQ ID NO: 1756069 - protein, 5 aa, Staphylococcus epidermidis
EATQD

SEQ ID NO: 1756070 - protein, 4 aa, Staphylococcus epidermidis
ECGF

SEQ ID NO: 1756071 - protein, 8 aa, Staphylococcus epidermidis
EDAELEPL

SEQ ID NO: 1756072 - protein, 12 aa, Staphylococcus epidermidis
EDAGKSTHKDGY

SEQ ID NO: 1756073 - protein, 5 aa, Staphylococcus epidermidis
EDAKR

SEQ ID NO: 1756074 - protein, 7 aa, Staphylococcus epidermidis
EDCGTDR

SEQ ID NO: 1756075 - protein, 7 aa, Staphylococcus epidermidis
EDEEATV

SEQ ID NO: 1756076 - protein, 5 aa, Staphylococcus epidermidis
EDERY

SEQ ID NO: 1756077 - protein, 6 aa, Staphylococcus epidermidis
EDGNEY

SEQ ID NO: 1756078 - protein, 7 aa, Staphylococcus epidermidis
EDIGRGD

SEQ ID NO: 1756079 - protein, 5 aa, Staphylococcus epidermidis
EDIRE

SEQ ID NO: 1756080 - protein, 10 aa, Staphylococcus epidermidis
EDKIAKGKVQ

SEQ ID NO: 1756081 - protein, 11 aa, Staphylococcus epidermidis
EDLNKKAGLSQ

SEQ ID NO: 1756082 - protein, 6 aa, Staphylococcus epidermidis
EDLSKE

SEQ ID NO: 1756083 - protein, 8 aa, Staphylococcus epidermidis
EDMKRQSK

SEQ ID NO: 1756084 - protein, 6 aa, Staphylococcus epidermidis
EDNKEI

SEQ ID NO: 1756085 - protein, 8 aa, Staphylococcus epidermidis
EDNKGSVV

SEQ ID NO: 1756086 - protein, 14 aa, Staphylococcus epidermidis
EDNQVTVRDRDSME

SEQ ID NO: 1756087 - protein, 5 aa, Staphylococcus epidermidis
EDPHN

SEQ ID NO: 1756088 - protein, 4 aa, Staphylococcus epidermidis
EDQQ

SEQ ID NO: 1756089 - protein, 6 aa, Staphylococcus epidermidis
EDQYGY

SEQ ID NO: 1756090 - protein, 13 aa, Staphylococcus epidermidis
EDRGGYYESSGAL

SEQ ID NO: 1756091 - protein, 7 aa, Staphylococcus epidermidis
EDSENPE

SEQ ID NO: 1756092 - protein, 7 aa, Staphylococcus epidermidis
EDSKENR

SEQ ID NO: 1756093 - protein, 5 aa, Staphylococcus epidermidis
EDSNY

SEQ ID NO: 1756094 - protein, 6 aa, Staphylococcus epidermidis
EDSPEH

SEQ ID NO: 1756095 - protein, 18 aa, Staphylococcus epidermidis
EDTDSKRNLEDGESSQFD

SEQ ID NO: 1756096 - protein, 4 aa, Staphylococcus epidermidis
EDTE

SEQ ID NO: 1756097 - protein, 5 aa, Staphylococcus epidermidis
EDTED

SEQ ID NO: 1756098 - protein, 6 aa, Staphylococcus epidermidis
EDTRRE

SEQ ID NO: 1756099 - protein, 5 aa, Staphylococcus epidermidis
EDVQP

SEQ ID NO: 1756100 - protein, 6 aa, Staphylococcus epidermidis
EDYPEA

SEQ ID NO: 1756101 - protein, 20 aa, Staphylococcus epidermidis
EEANVSADTRVKDLTDDELG

SEQ ID NO: 1756102 - protein, 14 aa, Staphylococcus epidermidis
EEASEEIKTRIFNL

SEQ ID NO: 1756103 - protein, 12 aa, Staphylococcus epidermidis
EEDIKDNMNTSR

SEQ ID NO: 1756104 - protein, 15 aa, Staphylococcus epidermidis
EEEETQVKDGKAKKL

SEQ ID NO: 1756105 - protein, 6 aa, Staphylococcus epidermidis
EEGPAH

SEQ ID NO: 1756106 - protein, 13 aa, Staphylococcus epidermidis
EEGWGQKEKDVDR

SEQ ID NO: 1756107 - protein, 4 aa, Staphylococcus epidermidis
EEGY

SEQ ID NO: 1756108 - protein, 9 aa, Staphylococcus epidermidis
EEIEEAQAG

SEQ ID NO: 1756109 - protein, 7 aa, Staphylococcus epidermidis
EEKNGKL

SEQ ID NO: 1756110 - protein, 5 aa, Staphylococcus epidermidis
EEKRT

SEQ ID NO: 1756111 - protein, 13 aa, Staphylococcus epidermidis
EELAGKEATFKTK

SEQ ID NO: 1756112 - protein, 9 aa, Staphylococcus epidermidis
EELEDSPEF

SEQ ID NO: 1756113 - protein, 9 aa, Staphylococcus epidermidis
EENAQANAF

SEQ ID NO: 1756114 - protein, 4 aa, Staphylococcus epidermidis
EENE

SEQ ID NO: 1756115 - protein, 8 aa, Staphylococcus epidermidis
EEQALEKY

SEQ ID NO: 1756116 - protein, 7 aa, Staphylococcus epidermidis
EEQRGDD

SEQ ID NO: 1756117 - protein, 8 aa, Staphylococcus epidermidis
EERDNKYP

SEQ ID NO: 1756118 - protein, 5 aa, Staphylococcus epidermidis
EERTV

SEQ ID NO: 1756119 - protein, 6 aa, Staphylococcus epidermidis
EESEFE

SEQ ID NO: 1756120 - protein, 6 aa, Staphylococcus epidermidis
EESGLV

SEQ ID NO: 1756121 - protein, 9 aa, Staphylococcus epidermidis
EESINQTKL

SEQ ID NO: 1756122 - protein, 6 aa, Staphylococcus epidermidis
EESSEL

SEQ ID NO: 1756123 - protein, 7 aa, Staphylococcus epidermidis
EETDPTI

SEQ ID NO: 1756124 - protein, 4 aa, Staphylococcus epidermidis
EETK

SEQ ID NO: 1756125 - protein, 7 aa, Staphylococcus epidermidis
EETKGAF

SEQ ID NO: 1756126 - protein, 10 aa, Staphylococcus epidermidis
EETVNKEKGI

SEQ ID NO: 1756127 - protein, 5 aa, Staphylococcus epidermidis
EETYE

SEQ ID NO: 1756128 - protein, 14 aa, Staphylococcus epidermidis
EEVKKKASVLSGGE

SEQ ID NO: 1756129 - protein, 10 aa, Staphylococcus epidermidis
EFEPESSQAL

SEQ ID NO: 1756130 - protein, 12 aa, Staphylococcus epidermidis
EFEPQGDQPQAI

SEQ ID NO: 1756131 - protein, 10 aa, Staphylococcus epidermidis
EFKYSDNAQY

SEQ ID NO: 1756132 - protein, 11 aa, Staphylococcus epidermidis
EFTGNKEQDKM

SEQ ID NO: 1756133 - protein, 4 aa, Staphylococcus epidermidis
EFTR

SEQ ID NO: 1756134 - protein, 5 aa, Staphylococcus epidermidis
EGAAR

SEQ ID NO: 1756135 - protein, 10 aa, Staphylococcus epidermidis
EGAGGGHAPD

SEQ ID NO: 1756136 - protein, 8 aa, Staphylococcus epidermidis
EGAKGSTL

SEQ ID NO: 1756137 - protein, 4 aa, Staphylococcus epidermidis
EGAN

SEQ ID NO: 1756138 - protein, 11 aa, Staphylococcus epidermidis
EGANPTGSFKD

SEQ ID NO: 1756139 - protein, 9 aa, Staphylococcus epidermidis
EGARDGKTV

SEQ ID NO: 1756140 - protein, 7 aa, Staphylococcus epidermidis
EGASPIV

SEQ ID NO: 1756141 - protein, 6 aa, Staphylococcus epidermidis
EGASVN

SEQ ID NO: 1756142 - protein, 7 aa, Staphylococcus epidermidis
EGDDRTV

SEQ ID NO: 1756143 - protein, 13 aa, Staphylococcus epidermidis
EGDRGPQAANVVK

SEQ ID NO: 1756144 - protein, 24 aa, Staphylococcus epidermidis
EGENSEVMADNDTAREGDSTDDMT

SEQ ID NO: 1756145 - protein, 4 aa, Staphylococcus epidermidis
EGGF

SEQ ID NO: 1756146 - protein, 6 aa, Staphylococcus epidermidis
EGGLGG

SEQ ID NO: 1756147 - protein, 9 aa, Staphylococcus epidermidis
EGGPSKNYN

SEQ ID NO: 1756148 - protein, 8 aa, Staphylococcus epidermidis
EGHAGQSL

SEQ ID NO: 1756149 - protein, 4 aa, Staphylococcus epidermidis
EGHS

SEQ ID NO: 1756150 - protein, 5 aa, Staphylococcus epidermidis
EGIHE

SEQ ID NO: 1756151 - protein, 17 aa, Staphylococcus epidermidis
EGINGTLSGTKEDTDKY

SEQ ID NO: 1756152 - protein, 27 aa, Staphylococcus epidermidis
EGKAYVGTTDTFYDNEKATPLTTQEDR

SEQ ID NO: 1756153 - protein, 4 aa, Staphylococcus epidermidis
EGKE

SEQ ID NO: 1756154 - protein, 8 aa, Staphylococcus epidermidis
EGKITERH

SEQ ID NO: 1756155 - protein, 8 aa, Staphylococcus epidermidis
EGLTQSDE

SEQ ID NO: 1756156 - protein, 18 aa, Staphylococcus epidermidis
EGMEKREENFAEEVKGQM

SEQ ID NO: 1756157 - protein, 8 aa, Staphylococcus epidermidis
EGPGSYTG

SEQ ID NO: 1756158 - protein, 10 aa, Staphylococcus epidermidis
EGPKGGPGMP

SEQ ID NO: 1756159 - protein, 7 aa, Staphylococcus epidermidis
EGQKTGA

SEQ ID NO: 1756160 - protein, 6 aa, Staphylococcus epidermidis
EGQRRY

SEQ ID NO: 1756161 - protein, 19 aa, Staphylococcus epidermidis
EGQTKSKLGTSEARSAVDS

SEQ ID NO: 1756162 - protein, 9 aa, Staphylococcus epidermidis
EGQTLGRLS

SEQ ID NO: 1756163 - protein, 12 aa, Staphylococcus epidermidis
EGQTNPPTLDSE

SEQ ID NO: 1756164 - protein, 4 aa, Staphylococcus epidermidis
EGRD

SEQ ID NO: 1756165 - protein, 5 aa, Staphylococcus epidermidis
EGRGI

SEQ ID NO: 1756166 - protein, 5 aa, Staphylococcus epidermidis
EGRKI

SEQ ID NO: 1756167 - protein, 7 aa, Staphylococcus epidermidis
EGSDDYR

SEQ ID NO: 1756168 - protein, 10 aa, Staphylococcus epidermidis
EGTIKSEAYR

SEQ ID NO: 1756169 - protein, 8 aa, Staphylococcus epidermidis
EGTKEDVE

SEQ ID NO: 1756170 - protein, 6 aa, Staphylococcus epidermidis
EGTMPQ

SEQ ID NO: 1756171 - protein, 5 aa, Staphylococcus epidermidis
EGTQH

SEQ ID NO: 1756172 - protein, 6 aa, Staphylococcus epidermidis
EGVEER

SEQ ID NO: 1756173 - protein, 9 aa, Staphylococcus epidermidis
EGVSTRHNP

SEQ ID NO: 1756174 - protein, 14 aa, Staphylococcus epidermidis
EHESTYKQEDYPRY

SEQ ID NO: 1756175 - protein, 6 aa, Staphylococcus epidermidis
EHGAIA

SEQ ID NO: 1756176 - protein, 15 aa, Staphylococcus epidermidis
EHPHAAQQPENYELR

SEQ ID NO: 1756177 - protein, 5 aa, Staphylococcus epidermidis
EIAKT

SEQ ID NO: 1756178 - protein, 11 aa, Staphylococcus epidermidis
EIAQSEAHNHA

SEQ ID NO: 1756179 - protein, 16 aa, Staphylococcus epidermidis
EIDSQTGHVSLGKDER

SEQ ID NO: 1756180 - protein, 5 aa, Staphylococcus epidermidis
EIEFG

SEQ ID NO: 1756181 - protein, 4 aa, Staphylococcus epidermidis
EIGD

SEQ ID NO: 1756182 - protein, 6 aa, Staphylococcus epidermidis
EINKRA

SEQ ID NO: 1756183 - protein, 7 aa, Staphylococcus epidermidis
EIPKEDV

SEQ ID NO: 1756184 - protein, 10 aa, Staphylococcus epidermidis
EIPSPVSGTV

SEQ ID NO: 1756185 - protein, 12 aa, Staphylococcus epidermidis
EISEGDEVKRTG

SEQ ID NO: 1756186 - protein, 7 aa, Staphylococcus epidermidis
EITASAT

SEQ ID NO: 1756187 - protein, 6 aa, Staphylococcus epidermidis
EKAGAN

SEQ ID NO: 1756188 - protein, 5 aa, Staphylococcus epidermidis
EKAHS

SEQ ID NO: 1756189 - protein, 11 aa, Staphylococcus epidermidis
EKANSGHPGLP

SEQ ID NO: 1756190 - protein, 4 aa, Staphylococcus epidermidis
EKAT

SEQ ID NO: 1756191 - protein, 4 aa, Staphylococcus epidermidis
EKDK

SEQ ID NO: 1756192 - protein, 13 aa, Staphylococcus epidermidis
EKEHSTHFNVENA

SEQ ID NO: 1756193 - protein, 6 aa, Staphylococcus epidermidis
EKFSKQ

SEQ ID NO: 1756194 - protein, 5 aa, Staphylococcus epidermidis
EKGCP

SEQ ID NO: 1756195 - protein, 15 aa, Staphylococcus epidermidis
EKGEPTLELNDDGGY

SEQ ID NO: 1756196 - protein, 15 aa, Staphylococcus epidermidis
EKGERELGTQMKATG

SEQ ID NO: 1756197 - protein, 4 aa, Staphylococcus epidermidis
EKGI

SEQ ID NO: 1756198 - protein, 4 aa, Staphylococcus epidermidis
EKHP

SEQ ID NO: 1756199 - protein, 6 aa, Staphylococcus epidermidis
EKIAPT

SEQ ID NO: 1756200 - protein, 12 aa, Staphylococcus epidermidis
EKIDDSVRRDPI

SEQ ID NO: 1756201 - protein, 6 aa, Staphylococcus epidermidis
EKINDN

SEQ ID NO: 1756202 - protein, 23 aa, Staphylococcus epidermidis
EKLNDKAYITPGLGDAGDRLFGT

SEQ ID NO: 1756203 - protein, 8 aa, Staphylococcus epidermidis
EKLPDDFQ

SEQ ID NO: 1756204 - protein, 6 aa, Staphylococcus epidermidis
EKMSKS

SEQ ID NO: 1756205 - protein, 6 aa, Staphylococcus epidermidis
EKNTTL

SEQ ID NO: 1756206 - protein, 13 aa, Staphylococcus epidermidis
EKQARRIGEARHE

SEQ ID NO: 1756207 - protein, 12 aa, Staphylococcus epidermidis
EKQKAGKAKMKA

SEQ ID NO: 1756208 - protein, 5 aa, Staphylococcus epidermidis
EKQSL

SEQ ID NO: 1756209 - protein, 6 aa, Staphylococcus epidermidis
EKRGRN

SEQ ID NO: 1756210 - protein, 6 aa, Staphylococcus epidermidis
EKRPVR

SEQ ID NO: 1756211 - protein, 8 aa, Staphylococcus epidermidis
EKSAQTYN

SEQ ID NO: 1756212 - protein, 8 aa, Staphylococcus epidermidis
EKSEVRRI

SEQ ID NO: 1756213 - protein, 16 aa, Staphylococcus epidermidis
EKTGMKGRRETNTMPQ

SEQ ID NO: 1756214 - protein, 11 aa, Staphylococcus epidermidis
EKTNVKHESPQ

SEQ ID NO: 1756215 - protein, 11 aa, Staphylococcus epidermidis
EKTPSFTVSED

SEQ ID NO: 1756216 - protein, 8 aa, Staphylococcus epidermidis
EKTSDEAI

SEQ ID NO: 1756217 - protein, 10 aa, Staphylococcus epidermidis
ELADKSEADM

SEQ ID NO: 1756218 - protein, 8 aa, Staphylococcus epidermidis
ELDDSRQT

SEQ ID NO: 1756219 - protein, 7 aa, Staphylococcus epidermidis
ELDPENN

SEQ ID NO: 1756220 - protein, 10 aa, Staphylococcus epidermidis
ELEDVTTEND

SEQ ID NO: 1756221 - protein, 4 aa, Staphylococcus epidermidis
ELER

SEQ ID NO: 1756222 - protein, 5 aa, Staphylococcus epidermidis
ELGGE

SEQ ID NO: 1756223 - protein, 6 aa, Staphylococcus epidermidis
ELGSVG

SEQ ID NO: 1756224 - protein, 13 aa, Staphylococcus epidermidis
ELKVKETNRIDTT

SEQ ID NO: 1756225 - protein, 5 aa, Staphylococcus epidermidis
ELQGR

SEQ ID NO: 1756226 - protein, 11 aa, Staphylococcus epidermidis
ELQNGKIKDDD

SEQ ID NO: 1756227 - protein, 6 aa, Staphylococcus epidermidis
ELRDEN

SEQ ID NO: 1756228 - protein, 8 aa, Staphylococcus epidermidis
ELRESRSD

SEQ ID NO: 1756229 - protein, 16 aa, Staphylococcus epidermidis
ELRTEAQRRNIQETED

SEQ ID NO: 1756230 - protein, 8 aa, Staphylococcus epidermidis
ELSGGQQQ

SEQ ID NO: 1756231 - protein, 7 aa, Staphylococcus epidermidis
ELSPTSD

SEQ ID NO: 1756232 - protein, 7 aa, Staphylococcus epidermidis
ELTKDPK

SEQ ID NO: 1756233 - protein, 8 aa, Staphylococcus epidermidis
EMEPDEGT

SEQ ID NO: 1756234 - protein, 10 aa, Staphylococcus epidermidis
EMPKPDKTKL

SEQ ID NO: 1756235 - protein, 4 aa, Staphylococcus epidermidis
EMPP

SEQ ID NO: 1756236 - protein, 6 aa, Staphylococcus epidermidis
EMRGPG

SEQ ID NO: 1756237 - protein, 13 aa, Staphylococcus epidermidis
EMRTGEGKTLTAT

SEQ ID NO: 1756238 - protein, 4 aa, Staphylococcus epidermidis
ENAA

SEQ ID NO: 1756239 - protein, 6 aa, Staphylococcus epidermidis
ENAGLE

SEQ ID NO: 1756240 - protein, 9 aa, Staphylococcus epidermidis
ENAKNAGFV

SEQ ID NO: 1756241 - protein, 8 aa, Staphylococcus epidermidis
ENAQGKTN

SEQ ID NO: 1756242 - protein, 6 aa, Staphylococcus epidermidis
ENDETI

SEQ ID NO: 1756243 - protein, 6 aa, Staphylococcus epidermidis
ENFPGQ

SEQ ID NO: 1756244 - protein, 9 aa, Staphylococcus epidermidis
ENGITSPSA

SEQ ID NO: 1756245 - protein, 12 aa, Staphylococcus epidermidis
ENGYGKRTPVSE

SEQ ID NO: 1756246 - protein, 6 aa, Staphylococcus epidermidis
ENIDEN

SEQ ID NO: 1756247 - protein, 8 aa, Staphylococcus epidermidis
ENIPKDSK

SEQ ID NO: 1756248 - protein, 8 aa, Staphylococcus epidermidis
ENKDATGY

SEQ ID NO: 1756249 - protein, 7 aa, Staphylococcus epidermidis
ENQEGID

SEQ ID NO: 1756250 - protein, 5 aa, Staphylococcus epidermidis
ENVDG

SEQ ID NO: 1756251 - protein, 9 aa, Staphylococcus epidermidis
ENWSRPESE

SEQ ID NO: 1756252 - protein, 7 aa, Staphylococcus epidermidis
ENYESEM

SEQ ID NO: 1756253 - protein, 12 aa, Staphylococcus epidermidis
ENYQKSSDNKLA

SEQ ID NO: 1756254 - protein, 18 aa, Staphylococcus epidermidis
ENYQNAKKQIYKNQTKDD

SEQ ID NO: 1756255 - protein, 5 aa, Staphylococcus epidermidis
EPDDP

SEQ ID NO: 1756256 - protein, 11 aa, Staphylococcus epidermidis
EPDESGDGGKL

SEQ ID NO: 1756257 - protein, 5 aa, Staphylococcus epidermidis
EPEGI

SEQ ID NO: 1756258 - protein, 4 aa, Staphylococcus epidermidis
EPEK

SEQ ID NO: 1756259 - protein, 11 aa, Staphylococcus epidermidis
EPGRKTPGVEE

SEQ ID NO: 1756260 - protein, 7 aa, Staphylococcus epidermidis
EPGVGKT

SEQ ID NO: 1756261 - protein, 11 aa, Staphylococcus epidermidis
EPGVGKTAIAE

SEQ ID NO: 1756262 - protein, 8 aa, Staphylococcus epidermidis
EPHKIPPT

SEQ ID NO: 1756263 - protein, 7 aa, Staphylococcus epidermidis
EPITEDI

SEQ ID NO: 1756264 - protein, 12 aa, Staphylococcus epidermidis
EPKSKADQDKMT

SEQ ID NO: 1756265 - protein, 4 aa, Staphylococcus epidermidis
EPNF

SEQ ID NO: 1756266 - protein, 10 aa, Staphylococcus epidermidis
EPQDDNRDGV

SEQ ID NO: 1756267 - protein, 8 aa, Staphylococcus epidermidis
EPRGCPRG

SEQ ID NO: 1756268 - protein, 8 aa, Staphylococcus epidermidis
EPTNGIDA

SEQ ID NO: 1756269 - protein, 7 aa, Staphylococcus epidermidis
EPTNGLD

SEQ ID NO: 1756270 - protein, 7 aa, Staphylococcus epidermidis
EPTSGLD

SEQ ID NO: 1756271 - protein, 4 aa, Staphylococcus epidermidis
EPVS

SEQ ID NO: 1756272 - protein, 14 aa, Staphylococcus epidermidis
EQADLTKKEAGSAV

SEQ ID NO: 1756273 - protein, 6 aa, Staphylococcus epidermidis
EQAKAQ

SEQ ID NO: 1756274 - protein, 10 aa, Staphylococcus epidermidis
EQAKIAEEAG

SEQ ID NO: 1756275 - protein, 6 aa, Staphylococcus epidermidis
EQARQG

SEQ ID NO: 1756276 - protein, 4 aa, Staphylococcus epidermidis
EQGG

SEQ ID NO: 1756277 - protein, 16 aa, Staphylococcus epidermidis
EQHEGGQPIYQYFFAV

SEQ ID NO: 1756278 - protein, 14 aa, Staphylococcus epidermidis
EQHIRRDKATSNIC

SEQ ID NO: 1756279 - protein, 13 aa, Staphylococcus epidermidis
EQLKQGQDIVGNR

SEQ ID NO: 1756280 - protein, 7 aa, Staphylococcus epidermidis
EQLSGSC

SEQ ID NO: 1756281 - protein, 9 aa, Staphylococcus epidermidis
EQNAKPIEL

SEQ ID NO: 1756282 - protein, 8 aa, Staphylococcus epidermidis
EQNNDENG

SEQ ID NO: 1756283 - protein, 5 aa, Staphylococcus epidermidis
EQNQD

SEQ ID NO: 1756284 - protein, 8 aa, Staphylococcus epidermidis
EQRNKEIT

SEQ ID NO: 1756285 - protein, 8 aa, Staphylococcus epidermidis
EQRSGRDA

SEQ ID NO: 1756286 - protein, 6 aa, Staphylococcus epidermidis
EQSGIE

SEQ ID NO: 1756287 - protein, 9 aa, Staphylococcus epidermidis
EQTEGRGRF

SEQ ID NO: 1756288 - protein, 5 aa, Staphylococcus epidermidis
EQTQV

SEQ ID NO: 1756289 - protein, 12 aa, Staphylococcus epidermidis
EQVRNNGERVEI

SEQ ID NO: 1756290 - protein, 5 aa, Staphylococcus epidermidis
EQWGS

SEQ ID NO: 1756291 - protein, 5 aa, Staphylococcus epidermidis
EQYTN

SEQ ID NO: 1756292 - protein, 36 aa, Staphylococcus epidermidis; identical to SEQ ID NO: 1604305

SEQ ID NO: 1756293 - protein, 7 aa, Staphylococcus epidermidis
ERGPRRV

SEQ ID NO: 1756294 - protein, 4 aa, Staphylococcus epidermidis
ERIE

SEQ ID NO: 1756295 - protein, 13 aa, Staphylococcus epidermidis
ERISSTNKGSVTS

SEQ ID NO: 1756296 - protein, 16 aa, Staphylococcus epidermidis
ERKGRDKKQVSVYAVA

SEQ ID NO: 1756297 - protein, 11 aa, Staphylococcus epidermidis
ERKKLSKRDGQ

SEQ ID NO: 1756298 - protein, 8 aa, Staphylococcus epidermidis
ERKNKMTE

SEQ ID NO: 1756299 - protein, 8 aa, Staphylococcus epidermidis
ERKSGSAV

SEQ ID NO: 1756300 - protein, 15 aa, Staphylococcus epidermidis
ERNEARKNKDFARAD

SEQ ID NO: 1756301 - protein, 12 aa, Staphylococcus epidermidis
ERPMASDNKTLG

SEQ ID NO: 1756302 - protein, 8 aa, Staphylococcus epidermidis
ERPQDDER

SEQ ID NO: 1756303 - protein, 7 aa, Staphylococcus epidermidis
ERRNRSK

SEQ ID NO: 1756304 - protein, 8 aa, Staphylococcus epidermidis
ERSELPAE

SEQ ID NO: 1756305 - protein, 7 aa, Staphylococcus epidermidis
ERSVESA

SEQ ID NO: 1756306 - protein, 18 aa, Staphylococcus epidermidis
ERTGQSIEKIQQDTDRDN

SEQ ID NO: 1756307 - protein, 5 aa, Staphylococcus epidermidis
ERTKY

SEQ ID NO: 1756308 - protein, 6 aa, Staphylococcus epidermidis
ESAASG

SEQ ID NO: 1756309 - protein, 5 aa, Staphylococcus epidermidis
ESAEV

SEQ ID NO: 1756310 - protein, 11 aa, Staphylococcus epidermidis
ESAKSAQSFGM

SEQ ID NO: 1756311 - protein, 5 aa, Staphylococcus epidermidis
ESDEQ

SEQ ID NO: 1756312 - protein, 7 aa, Staphylococcus epidermidis
ESEGPFE

SEQ ID NO: 1756313 - protein, 4 aa, Staphylococcus epidermidis
ESFK

SEQ ID NO: 1756314 - protein, 5 aa, Staphylococcus epidermidis
ESGAF

SEQ ID NO: 1756315 - protein, 8 aa, Staphylococcus epidermidis
ESGSGKST

SEQ ID NO: 1756316 - protein, 12 aa, Staphylococcus epidermidis
ESGTKTAQTIKS

SEQ ID NO: 1756317 - protein, 4 aa, Staphylococcus epidermidis
ESGV

SEQ ID NO: 1756318 - protein, 6 aa, Staphylococcus epidermidis
ESIDSK

SEQ ID NO: 1756319 - protein, 6 aa, Staphylococcus epidermidis
ESMSQS

SEQ ID NO: 1756320 - protein, 7 aa, Staphylococcus epidermidis
ESNGFNT

SEQ ID NO: 1756321 - protein, 12 aa, Staphylococcus epidermidis
ESNGSSSQASIC

SEQ ID NO: 1756322 - protein, 17 aa, Staphylococcus epidermidis
ESQSIGKRYRRQDEIGT

SEQ ID NO: 1756323 - protein, 5 aa, Staphylococcus epidermidis
ESRKT

SEQ ID NO: 1756324 - protein, 4 aa, Staphylococcus epidermidis
ESSN

SEQ ID NO: 1756325 - protein, 10 aa, Staphylococcus epidermidis
ESSNKNTRDI

SEQ ID NO: 1756326 - protein, 6 aa, Staphylococcus epidermidis
ESYESS

SEQ ID NO: 1756327 - protein, 5 aa, Staphylococcus epidermidis
ETCPI

SEQ ID NO: 1756328 - protein, 4 aa, Staphylococcus epidermidis
ETDE

SEQ ID NO: 1756329 - protein, 6 aa, Staphylococcus epidermidis
ETDEIS

SEQ ID NO: 1756330 - protein, 5 aa, Staphylococcus epidermidis
ETEKY

SEQ ID NO: 1756331 - protein, 5 aa, Staphylococcus epidermidis
ETGEV

SEQ ID NO: 1756332 - protein, 10 aa, Staphylococcus epidermidis
ETGLTQPGKT

SEQ ID NO: 1756333 - protein, 5 aa, Staphylococcus epidermidis
ETGSR

SEQ ID NO: 1756334 - protein, 4 aa, Staphylococcus epidermidis
ETMD

SEQ ID NO: 1756335 - protein, 17 aa, Staphylococcus epidermidis
ETNDISKSLNRGKHTTR

SEQ ID NO: 1756336 - protein, 8 aa, Staphylococcus epidermidis
ETPEGPNI

SEQ ID NO: 1756337 - protein, 12 aa, Staphylococcus epidermidis
ETPIGEEDDSHL

SEQ ID NO: 1756338 - protein, 8 aa, Staphylococcus epidermidis
ETPPENRF

SEQ ID NO: 1756339 - protein, 7 aa, Staphylococcus epidermidis
ETQAGEN

SEQ ID NO: 1756340 - protein, 11 aa, Staphylococcus epidermidis
ETRDDAVGEAY

SEQ ID NO: 1756341 - protein, 8 aa, Staphylococcus epidermidis
ETRPLSAT

SEQ ID NO: 1756342 - protein, 4 aa, Staphylococcus epidermidis
ETSE

SEQ ID NO: 1756343 - protein, 8 aa, Staphylococcus epidermidis
ETSRSHGD

SEQ ID NO: 1756344 - protein, 14 aa, Staphylococcus epidermidis
ETSTSSVKKGESLY

SEQ ID NO: 1756345 - protein, 5 aa, Staphylococcus epidermidis
ETTAE

SEQ ID NO: 1756346 - protein, 8 aa, Staphylococcus epidermidis
ETTARYGE

SEQ ID NO: 1756347 - protein, 8 aa, Staphylococcus epidermidis
ETTGNQLD

SEQ ID NO: 1756348 - protein, 8 aa, Staphylococcus epidermidis
ETYERTQH

SEQ ID NO: 1756349 - protein, 5 aa, Staphylococcus epidermidis
EVEGR

SEQ ID NO: 1756350 - protein, 8 aa, Staphylococcus epidermidis
EVGEKQAA

SEQ ID NO: 1756351 - protein, 14 aa, Staphylococcus epidermidis
EVKGVRTNIGTEYR

SEQ ID NO: 1756352 - protein, 9 aa, Staphylococcus epidermidis
EVNTTDPEY

SEQ ID NO: 1756353 - protein, 7 aa, Staphylococcus epidermidis
EVPETLK

SEQ ID NO: 1756354 - protein, 6 aa, Staphylococcus epidermidis
EVPQPV

SEQ ID NO: 1756355 - protein, 7 aa, Staphylococcus epidermidis
EVQGSDI

SEQ ID NO: 1756356 - protein, 7 aa, Staphylococcus epidermidis
EVQNDKS

SEQ ID NO: 1756357 - protein, 4 aa, Staphylococcus epidermidis
EVRG

SEQ ID NO: 1756358 - protein, 6 aa, Staphylococcus epidermidis
EVRKKL

SEQ ID NO: 1756359 - protein, 6 aa, Staphylococcus epidermidis
EVSGKT

SEQ ID NO: 1756360 - protein, 5 aa, Staphylococcus epidermidis
EVTDT

SEQ ID NO: 1756361 - protein, 9 aa, Staphylococcus epidermidis
EVTKRKDNG

SEQ ID NO: 1756362 - protein, 10 aa, Staphylococcus epidermidis
EVTNTDAKKF

SEQ ID NO: 1756363 - protein, 15 aa, Staphylococcus epidermidis
EWATPNKIVEALEEL

SEQ ID NO: 1756364 - protein, 9 aa, Staphylococcus epidermidis
EWRGDKQLR

SEQ ID NO: 1756365 - protein, 6 aa, Staphylococcus epidermidis
EYAGEM

SEQ ID NO: 1756366 - protein, 5 aa, Staphylococcus epidermidis
EYPRE

SEQ ID NO: 1756367 - protein, 9 aa, Staphylococcus epidermidis
FAAADGRVE

SEQ ID NO: 1756368 - protein, 6 aa, Staphylococcus epidermidis
FAEEEN

SEQ ID NO: 1756369 - protein, 11 aa, Staphylococcus epidermidis
FAGISQRRVRG

SEQ ID NO: 1756370 - protein, 7 aa, Staphylococcus epidermidis
FAPGVSA

SEQ ID NO: 1756371 - protein, 12 aa, Staphylococcus epidermidis
FDCPNRDGTVAH

SEQ ID NO: 1756372 - protein, 7 aa, Staphylococcus epidermidis
FDEPPEH

SEQ ID NO: 1756373 - protein, 9 aa, Staphylococcus epidermidis
FDGANDDDV

SEQ ID NO: 1756374 - protein, 7 aa, Staphylococcus epidermidis
FDSAEKL

SEQ ID NO: 1756375 - protein, 5 aa, Staphylococcus epidermidis
FDYAG

SEQ ID NO: 1756376 - protein, 8 aa, Staphylococcus epidermidis
FENGPDYD

SEQ ID NO: 1756377 - protein, 8 aa, Staphylococcus epidermidis
FENPANPE

SEQ ID NO: 1756378 - protein, 16 aa, Staphylococcus epidermidis
FEQQKKEKEMKKKQKV

SEQ ID NO: 1756379 - protein, 7 aa, Staphylococcus epidermidis
FESDTDT

SEQ ID NO: 1756380 - protein, 4 aa, Staphylococcus epidermidis
FGGG

SEQ ID NO: 1756381 - protein, 7 aa, Staphylococcus epidermidis
FGGSKDI

SEQ ID NO: 1756382 - protein, 8 aa, Staphylococcus epidermidis
FGGYDGKG

SEQ ID NO: 1756383 - protein, 4 aa, Staphylococcus epidermidis
FGPR

SEQ ID NO: 1756384 - protein, 8 aa, Staphylococcus epidermidis
FGPSTNGV

SEQ ID NO: 1756385 - protein, 18 aa, Staphylococcus epidermidis
FGQTGPKVGSFDAGYGSG

SEQ ID NO: 1756386 - protein, 4 aa, Staphylococcus epidermidis
FGTG

SEQ ID NO: 1756387 - protein, 11 aa, Staphylococcus epidermidis
FGYGSTDTGNV

SEQ ID NO: 1756388 - protein, 9 aa, Staphylococcus epidermidis
FKEETETDL

SEQ ID NO: 1756389 - protein, 7 aa, Staphylococcus epidermidis
FKKHSSG

SEQ ID NO: 1756390 - protein, 6 aa, Staphylococcus epidermidis
FKNPQQ

SEQ ID NO: 1756391 - protein, 9 aa, Staphylococcus epidermidis
FKPRTSPYD

SEQ ID NO: 1756392 - protein, 12 aa, Staphylococcus epidermidis
FKVEPGNSLSKF

SEQ ID NO: 1756393 - protein, 5 aa, Staphylococcus epidermidis
FNEED

SEQ ID NO: 1756394 - protein, 5 aa, Staphylococcus epidermidis
FNTAN

SEQ ID NO: 1756395 - protein, 4 aa, Staphylococcus epidermidis
FNTD

SEQ ID NO: 1756396 - protein, 4 aa, Staphylococcus epidermidis
FPDD

SEQ ID NO: 1756397 - protein, 6 aa, Staphylococcus epidermidis
FPGPGL

SEQ ID NO: 1756398 - protein, 8 aa, Staphylococcus epidermidis
FPKDNSEF

SEQ ID NO: 1756399 - protein, 4 aa, Staphylococcus epidermidis
FPKG

SEQ ID NO: 1756400 - protein, 4 aa, Staphylococcus epidermidis
FPSQ

SEQ ID NO: 1756401 - protein, 10 aa, Staphylococcus epidermidis
FPTEKKGPSV

SEQ ID NO: 1756402 - protein, 5 aa, Staphylococcus epidermidis
FPTGA

SEQ ID NO: 1756403 - protein, 5 aa, Staphylococcus epidermidis
FPTTG

SEQ ID NO: 1756404 - protein, 7 aa, Staphylococcus epidermidis
FQGHGYG

SEQ ID NO: 1756405 - protein, 18 aa, Staphylococcus epidermidis
FSASAAEAIDAKGGAHEV

SEQ ID NO: 1756406 - protein, 7 aa, Staphylococcus epidermidis
FSASKTY

SEQ ID NO: 1756407 - protein, 4 aa, Staphylococcus epidermidis
FSEE

SEQ ID NO: 1756408 - protein, 5 aa, Staphylococcus epidermidis
FSEKQ

SEQ ID NO: 1756409 - protein, 8 aa, Staphylococcus epidermidis
FSESVGKD

SEQ ID NO: 1756410 - protein, 7 aa, Staphylococcus epidermidis
FSGKSEE

SEQ ID NO: 1756411 - protein, 7 aa, Staphylococcus epidermidis
FSGYPDC

SEQ ID NO: 1756412 - protein, 9 aa, Staphylococcus epidermidis
FSNKKEDES

SEQ ID NO: 1756413 - protein, 4 aa, Staphylococcus epidermidis
FSSE

SEQ ID NO: 1756414 - protein, 5 aa, Staphylococcus epidermidis
FTDND

SEQ ID NO: 1756415 - protein, 25 aa, Staphylococcus epidermidis
FTGGGKGKKAKRNQMQNMLKGMNLP

SEQ ID NO: 1756416 - protein, 16 aa, Staphylococcus epidermidis
FTGPHGGGGPGSGPVG

SEQ ID NO: 1756417 - protein, 10 aa, Staphylococcus epidermidis
FTNAQGEREA

SEQ ID NO: 1756418 - protein, 7 aa, Staphylococcus epidermidis
FTRGSRK

SEQ ID NO: 1756419 - protein, 21 aa, Staphylococcus epidermidis
FYEKPSVKRKKKSEAARKRKF

SEQ ID NO: 1756420 - protein, 6 aa, Staphylococcus epidermidis
GAAQGI

SEQ ID NO: 1756421 - protein, 10 aa, Staphylococcus epidermidis
GADAKDLDDA

SEQ ID NO: 1756422 - protein, 8 aa, Staphylococcus epidermidis
GADGPSFD

SEQ ID NO: 1756423 - protein, 4 aa, Staphylococcus epidermidis
GAEA

SEQ ID NO: 1756424 - protein, 5 aa, Staphylococcus epidermidis
GAEGI

SEQ ID NO: 1756425 - protein, 8 aa, Staphylococcus epidermidis
GAENPSID

SEQ ID NO: 1756426 - protein, 5 aa, Staphylococcus epidermidis
GAEYQ

SEQ ID NO: 1756427 - protein, 6 aa, Staphylococcus epidermidis
GAGFPS

SEQ ID NO: 1756428 - protein, 5 aa, Staphylococcus epidermidis
GAGKT

SEQ ID NO: 1756429 - protein, 10 aa, Staphylococcus epidermidis
GAGKTTTAGK

SEQ ID NO: 1756430 - protein, 11 aa, Staphylococcus epidermidis
GAGTDPSEGAA

SEQ ID NO: 1756431 - protein, 8 aa, Staphylococcus epidermidis
GAKAAGRD

SEQ ID NO: 1756432 - protein, 4 aa, Staphylococcus epidermidis
GAKD

SEQ ID NO: 1756433 - protein, 4 aa, Staphylococcus epidermidis
GAKG

SEQ ID NO: 1756434 - protein, 8 aa, Staphylococcus epidermidis
GAKGKRFA

SEQ ID NO: 1756435 - protein, 11 aa, Staphylococcus epidermidis
GAKGPNGSTVT

SEQ ID NO: 1756436 - protein, 8 aa, Staphylococcus epidermidis
GAKPTDTV

SEQ ID NO: 1756437 - protein, 9 aa, Staphylococcus epidermidis
GAKQVRKKF

SEQ ID NO: 1756438 - protein, 8 aa, Staphylococcus epidermidis
GAKRAEQV

SEQ ID NO: 1756439 - protein, 14 aa, Staphylococcus epidermidis
GANAALNAFDYIIR

SEQ ID NO: 1756440 - protein, 7 aa, Staphylococcus epidermidis
GANPVSC

SEQ ID NO: 1756441 - protein, 23 aa, Staphylococcus epidermidis
GAPPGYVGHDDGGQLTEKVRRKP

SEQ ID NO: 1756442 - protein, 7 aa, Staphylococcus epidermidis
GAPPHGG

SEQ ID NO: 1756443 - protein, 10 aa, Staphylococcus epidermidis
GAPQKPGETR

SEQ ID NO: 1756444 - protein, 6 aa, Staphylococcus epidermidis
GAPSEI

SEQ ID NO: 1756445 - protein, 7 aa, Staphylococcus epidermidis
GAPTPVQ

SEQ ID NO: 1756446 - protein, 7 aa, Staphylococcus epidermidis
GAQELQD

SEQ ID NO: 1756447 - protein, 7 aa, Staphylococcus epidermidis
GAQRPGH

SEQ ID NO: 1756448 - protein, 13 aa, Staphylococcus epidermidis
GAQTERSKRNFPV

SEQ ID NO: 1756449 - protein, 6 aa, Staphylococcus epidermidis
GARKGE

SEQ ID NO: 1756450 - protein, 19 aa, Staphylococcus epidermidis
GARKGLADTALKTADSGYL

SEQ ID NO: 1756451 - protein, 8 aa, Staphylococcus epidermidis
GASAPGDL

SEQ ID NO: 1756452 - protein, 8 aa, Staphylococcus epidermidis
GASEITES

SEQ ID NO: 1756453 - protein, 10 aa, Staphylococcus epidermidis
GASPIVSGEL

SEQ ID NO: 1756454 - protein, 8 aa, Staphylococcus epidermidis
GATGSGKS

SEQ ID NO: 1756455 - protein, 9 aa, Staphylococcus epidermidis
GATGTGKTF

SEQ ID NO: 1756456 - protein, 4 aa, Staphylococcus epidermidis
GATK

SEQ ID NO: 1756457 - protein, 7 aa, Staphylococcus epidermidis
GDARRGQ

SEQ ID NO: 1756458 - protein, 14 aa, Staphylococcus epidermidis
GDAVDSIYDASVNK

SEQ ID NO: 1756459 - protein, 9 aa, Staphylococcus epidermidis
GDDLPTAGG

SEQ ID NO: 1756460 - protein, 8 aa, Staphylococcus epidermidis
GDEGKGKI

SEQ ID NO: 1756461 - protein, 15 aa, Staphylococcus epidermidis
GDENGTISNIQKDKL

SEQ ID NO: 1756462 - protein, 18 aa, Staphylococcus epidermidis
GDEPKVIQNPEGARTTPS

SEQ ID NO: 1756463 - protein, 15 aa, Staphylococcus epidermidis
GDGSYRGAQRISEEC

SEQ ID NO: 1756464 - protein, 5 aa, Staphylococcus epidermidis
GDGYT

SEQ ID NO: 1756465 - protein, 6 aa, Staphylococcus epidermidis
GDIDEE

SEQ ID NO: 1756466 - protein, 18 aa, Staphylococcus epidermidis
GDLSENSEYDAAKDEQGF

SEQ ID NO: 1756467 - protein, 18 aa, Staphylococcus epidermidis
GDNKGRRVSSTSSGSVTV

SEQ ID NO: 1756468 - protein, 8 aa, Staphylococcus epidermidis
GDPGIGKS

SEQ ID NO: 1756469 - protein, 8 aa, Staphylococcus epidermidis
GDPSQTIT

SEQ ID NO: 1756470 - protein, 5 aa, Staphylococcus epidermidis
GDPSS

SEQ ID NO: 1756471 - protein, 7 aa, Staphylococcus epidermidis
GDRSFSE

SEQ ID NO: 1756472 - protein, 14 aa, Staphylococcus epidermidis
GDSAGGSAKLGRDR

SEQ ID NO: 1756473 - protein, 8 aa, Staphylococcus epidermidis
GDSAVEEG

SEQ ID NO: 1756474 - protein, 8 aa, Staphylococcus epidermidis
GDSDNDRA

SEQ ID NO: 1756475 - protein, 11 aa, Staphylococcus epidermidis
GDSGIGKSETA

SEQ ID NO: 1756476 - protein, 8 aa, Staphylococcus epidermidis
GDTDDGSR

SEQ ID NO: 1756477 - protein, 7 aa, Staphylococcus epidermidis
GDTGADC

SEQ ID NO: 1756478 - protein, 5 aa, Staphylococcus epidermidis
GDTTH

SEQ ID NO: 1756479 - protein, 8 aa, Staphylococcus epidermidis
GDVGSGKT

SEQ ID NO: 1756480 - protein, 10 aa, Staphylococcus epidermidis
GDVKNTYGTG

SEQ ID NO: 1756481 - protein, 11 aa, Staphylococcus epidermidis
GEAEKSTSLYT

SEQ ID NO: 1756482 - protein, 18 aa, Staphylococcus epidermidis
GEAGGKLHTGRSRNDQVA

SEQ ID NO: 1756483 - protein, 10 aa, Staphylococcus epidermidis
GEALAGDKGF

SEQ ID NO: 1756484 - protein, 5 aa, Staphylococcus epidermidis
GEDPN

SEQ ID NO: 1756485 - protein, 7 aa, Staphylococcus epidermidis
GEDTDIA

SEQ ID NO: 1756486 - protein, 11 aa, Staphylococcus epidermidis
GEEAVKSESGL

SEQ ID NO: 1756487 - protein, 9 aa, Staphylococcus epidermidis
GEEFGGRDH

SEQ ID NO: 1756488 - protein, 7 aa, Staphylococcus epidermidis
GEEYEPG

SEQ ID NO: 1756489 - protein, 8 aa, Staphylococcus epidermidis
GEGELPDE

SEQ ID NO: 1756490 - protein, 5 aa, Staphylococcus epidermidis
GEGKD

SEQ ID NO: 1756491 - protein, 10 aa, Staphylococcus epidermidis
GEGPSGPNTE

SEQ ID NO: 1756492 - protein, 5 aa, Staphylococcus epidermidis
GEGSQ

SEQ ID NO: 1756493 - protein, 7 aa, Staphylococcus epidermidis
GEHGDSE

SEQ ID NO: 1756494 - protein, 12 aa, Staphylococcus epidermidis
GEKIPRKGGQGM

SEQ ID NO: 1756495 - protein, 11 aa, Staphylococcus epidermidis
GENISRPSVPE

SEQ ID NO: 1756496 - protein, 6 aa, Staphylococcus epidermidis
GEPGVY

SEQ ID NO: 1756497 - protein, 7 aa, Staphylococcus epidermidis
GERGSGK

SEQ ID NO: 1756498 - protein, 4 aa, Staphylococcus epidermidis
GERL

SEQ ID NO: 1756499 - protein, 11 aa, Staphylococcus epidermidis
GERTPHGDAQI

SEQ ID NO: 1756500 - protein, 9 aa, Staphylococcus epidermidis
GERTREGND

SEQ ID NO: 1756501 - protein, 7 aa, Staphylococcus epidermidis
GESAPKI

SEQ ID NO: 1756502 - protein, 8 aa, Staphylococcus epidermidis
GESASDEL

SEQ ID NO: 1756503 - protein, 21 aa, Staphylococcus epidermidis
GESEGKDFKGIYPSSANYTTD

SEQ ID NO: 1756504 - protein, 10 aa, Staphylococcus epidermidis
GESGSGKSTL

SEQ ID NO: 1756505 - protein, 9 aa, Staphylococcus epidermidis
GETHEGASQ

SEQ ID NO: 1756506 - protein, 11 aa, Staphylococcus epidermidis
GETKSDDIPAD

SEQ ID NO: 1756507 - protein, 4 aa, Staphylococcus epidermidis
GETV

SEQ ID NO: 1756508 - protein, 7 aa, Staphylococcus epidermidis
GEVIAPD

SEQ ID NO: 1756509 - protein, 6 aa, Staphylococcus epidermidis
GEVTNE

SEQ ID NO: 1756510 - protein, 9 aa, Staphylococcus epidermidis
GEYQPNAHN

SEQ ID NO: 1756511 - protein, 7 aa, Staphylococcus epidermidis
GFGSDLG

SEQ ID NO: 1756512 - protein, 9 aa, Staphylococcus epidermidis
GFLPGNGAI

SEQ ID NO: 1756513 - protein, 11 aa, Staphylococcus epidermidis
GFSGGEKKRNE

SEQ ID NO: 1756514 - protein, 7 aa, Staphylococcus epidermidis
GGAAARP

SEQ ID NO: 1756515 - protein, 9 aa, Staphylococcus epidermidis
GGASKGIAN

SEQ ID NO: 1756516 - protein, 7 aa, Staphylococcus epidermidis
GGATGDF

SEQ ID NO: 1756517 - protein, 5 aa, Staphylococcus epidermidis
GGDGT

SEQ ID NO: 1756518 - protein, 7 aa, Staphylococcus epidermidis
GGDGTLN

SEQ ID NO: 1756519 - protein, 6 aa, Staphylococcus epidermidis
GGDPAI

SEQ ID NO: 1756520 - protein, 15 aa, Staphylococcus epidermidis
GGDPTATGMGGESIY

SEQ ID NO: 1756521 - protein, 8 aa, Staphylococcus epidermidis
GGDSAIGR

SEQ ID NO: 1756522 - protein, 18 aa, Staphylococcus epidermidis
GGEIGQETRRFDESTGKT

SEQ ID NO: 1756523 - protein, 6 aa, Staphylococcus epidermidis
GGERAL

SEQ ID NO: 1756524 - protein, 4 aa, Staphylococcus epidermidis
GGES

SEQ ID NO: 1756525 - protein, 8 aa, Staphylococcus epidermidis
GGFTGQAQ

SEQ ID NO: 1756526 - protein, 5 aa, Staphylococcus epidermidis
GGGAI

SEQ ID NO: 1756527 - protein, 11 aa, Staphylococcus epidermidis
GGGATKEKVTE

SEQ ID NO: 1756528 - protein, 4 aa, Staphylococcus epidermidis
GGGK

SEQ ID NO: 1756529 - protein, 4 aa, Staphylococcus epidermidis
GGGL

SEQ ID NO: 1756530 - protein, 11 aa, Staphylococcus epidermidis
GGGQAGTNAAK

SEQ ID NO: 1756531 - protein, 8 aa, Staphylococcus epidermidis
GGGSNSIG

SEQ ID NO: 1756532 - protein, 4 aa, Staphylococcus epidermidis
GGGT

SEQ ID NO: 1756533 - protein, 8 aa, Staphylococcus epidermidis
GGGTPTAL

SEQ ID NO: 1756534 - protein, 9 aa, Staphylococcus epidermidis
GGHSADLNN

SEQ ID NO: 1756535 - protein, 6 aa, Staphylococcus epidermidis
GGIETG

SEQ ID NO: 1756536 - protein, 5 aa, Staphylococcus epidermidis
GGINP

SEQ ID NO: 1756537 - protein, 9 aa, Staphylococcus epidermidis
GGKASYPST

SEQ ID NO: 1756538 - protein, 9 aa, Staphylococcus epidermidis
GGKGANLSE

SEQ ID NO: 1756539 - protein, 22 aa, Staphylococcus epidermidis
GGKGGGRPDMAQGGGTQPEKIT

SEQ ID NO: 1756540 - protein, 8 aa, Staphylococcus epidermidis
GGKGRRAN

SEQ ID NO: 1756541 - protein, 10 aa, Staphylococcus epidermidis
GGKRPEREDL

SEQ ID NO: 1756542 - protein, 6 aa, Staphylococcus epidermidis
GGKSPV

SEQ ID NO: 1756543 - protein, 9 aa, Staphylococcus epidermidis
GGNGAGKTT

SEQ ID NO: 1756544 - protein, 7 aa, Staphylococcus epidermidis
GGNNDIN

SEQ ID NO: 1756545 - protein, 5 aa, Staphylococcus epidermidis
GGNPA

SEQ ID NO: 1756546 - protein, 12 aa, Staphylococcus epidermidis
GGNTNYQDTIRR

SEQ ID NO: 1756547 - protein, 10 aa, Staphylococcus epidermidis
GGPASGSAAI

SEQ ID NO: 1756548 - protein, 9 aa, Staphylococcus epidermidis
GGPGTGKTT

SEQ ID NO: 1756549 - protein, 11 aa, Staphylococcus epidermidis
GGPQGDAGLTG

SEQ ID NO: 1756550 - protein, 7 aa, Staphylococcus epidermidis
GGQDSTT

SEQ ID NO: 1756551 - protein, 14 aa, Staphylococcus epidermidis
GGQEPGSGEEAAQN

SEQ ID NO: 1756552 - protein, 6 aa, Staphylococcus epidermidis
GGQGHL

SEQ ID NO: 1756553 - protein, 9 aa, Staphylococcus epidermidis
GGQSKGEAI

SEQ ID NO: 1756554 - protein, 11 aa, Staphylococcus epidermidis
GGQTMNPSTED

SEQ ID NO: 1756555 - protein, 10 aa, Staphylococcus epidermidis
GGRCEACKGD

SEQ ID NO: 1756556 - protein, 4 aa, Staphylococcus epidermidis
GGRH

SEQ ID NO: 1756557 - protein, 9 aa, Staphylococcus epidermidis
GGRISKTKG

SEQ ID NO: 1756558 - protein, 11 aa, Staphylococcus epidermidis
GGRNEEFEGER

SEQ ID NO: 1756559 - protein, 4 aa, Staphylococcus epidermidis
GGRY

SEQ ID NO: 1756560 - protein, 8 aa, Staphylococcus epidermidis
GGSAGSVL

SEQ ID NO: 1756561 - protein, 7 aa, Staphylococcus epidermidis
GGSARNV

SEQ ID NO: 1756562 - protein, 10 aa, Staphylococcus epidermidis
GGSGRKTANI

SEQ ID NO: 1756563 - protein, 8 aa, Staphylococcus epidermidis
GGSHSDAP

SEQ ID NO: 1756564 - protein, 5 aa, Staphylococcus epidermidis
GGSIN

SEQ ID NO: 1756565 - protein, 11 aa, Staphylococcus epidermidis
GGSQGRDRSTA

SEQ ID NO: 1756566 - protein, 8 aa, Staphylococcus epidermidis
GGSTETSY

SEQ ID NO: 1756567 - protein, 6 aa, Staphylococcus epidermidis
GGSTNT

SEQ ID NO: 1756568 - protein, 9 aa, Staphylococcus epidermidis
GGTAEEEAA

SEQ ID NO: 1756569 - protein, 6 aa, Staphylococcus epidermidis
GGTAGY

SEQ ID NO: 1756570 - protein, 10 aa, Staphylococcus epidermidis
GGTNGKGSTV

SEQ ID NO: 1756571 - protein, 7 aa, Staphylococcus epidermidis
GGTSNRY

SEQ ID NO: 1756572 - protein, 12 aa, Staphylococcus epidermidis
GGVAGSDITQGL

SEQ ID NO: 1756573 - protein, 5 aa, Staphylococcus epidermidis
GGVDS

SEQ ID NO: 1756574 - protein, 6 aa, Staphylococcus epidermidis
GGVDSS

SEQ ID NO: 1756575 - protein, 7 aa, Staphylococcus epidermidis
GGVDSSV

SEQ ID NO: 1756576 - protein, 4 aa, Staphylococcus epidermidis
GGVH

SEQ ID NO: 1756577 - protein, 6 aa, Staphylococcus epidermidis
GGVTDA

SEQ ID NO: 1756578 - protein, 8 aa, Staphylococcus epidermidis
GGYNGSVA

SEQ ID NO: 1756579 - protein, 8 aa, Staphylococcus epidermidis
GHDERDHE

SEQ ID NO: 1756580 - protein, 4 aa, Staphylococcus epidermidis
GHKD

SEQ ID NO: 1756581 - protein, 9 aa, Staphylococcus epidermidis
GHNGSGAEI

SEQ ID NO: 1756582 - protein, 10 aa, Staphylococcus epidermidis
GHNGSGKSTI

SEQ ID NO: 1756583 - protein, 18 aa, Staphylococcus epidermidis
GHRSQQDPEFNEQYKEEM

SEQ ID NO: 1756584 - protein, 16 aa, Staphylococcus epidermidis
GHRTSVEGAPLKRGAA

SEQ ID NO: 1756585 - protein, 4 aa, Staphylococcus epidermidis
GHSE

SEQ ID NO: 1756586 - protein, 10 aa, Staphylococcus epidermidis
GHTGTLDPEV

SEQ ID NO: 1756587 - protein, 8 aa, Staphylococcus epidermidis
GIAGSYAE

SEQ ID NO: 1756588 - protein, 14 aa, Staphylococcus epidermidis
GIAKAAKKADRIAA

SEQ ID NO: 1756589 - protein, 15 aa, Staphylococcus epidermidis
GIASSKRQAREDVNN

SEQ ID NO: 1756590 - protein, 11 aa, Staphylococcus epidermidis
GIDPKRRGETL

SEQ ID NO: 1756591 - protein, 18 aa, Staphylococcus epidermidis
GIDQSKVREKYKVTNPSI

SEQ ID NO: 1756592 - protein, 13 aa, Staphylococcus epidermidis
GIEGRTAYKGPLQ

SEQ ID NO: 1756593 - protein, 6 aa, Staphylococcus epidermidis
GIEPQT

SEQ ID NO: 1756594 - protein, 8 aa, Staphylococcus epidermidis
GIGGDGDP

SEQ ID NO: 1756595 - protein, 9 aa, Staphylococcus epidermidis
GIGKKTARQ

SEQ ID NO: 1756596 - protein, 5 aa, Staphylococcus epidermidis
GIGPE

SEQ ID NO: 1756597 - protein, 7 aa, Staphylococcus epidermidis
GIGPKSA

SEQ ID NO: 1756598 - protein, 8 aa, Staphylococcus epidermidis
GIGPKTAQ

SEQ ID NO: 1756599 - protein, 8 aa, Staphylococcus epidermidis
GIGSPKDA

SEQ ID NO: 1756600 - protein, 9 aa, Staphylococcus epidermidis
GIHKPKHKL

SEQ ID NO: 1756601 - protein, 4 aa, Staphylococcus epidermidis
GIIE

SEQ ID NO: 1756602 - protein, 7 aa, Staphylococcus epidermidis
GIIGDGN

SEQ ID NO: 1756603 - protein, 5 aa, Staphylococcus epidermidis
GIKPG

SEQ ID NO: 1756604 - protein, 5 aa, Staphylococcus epidermidis
GINRE

SEQ ID NO: 1756605 - protein, 12 aa, Staphylococcus epidermidis
GINTDGDALKKH

SEQ ID NO: 1756606 - protein, 15 aa, Staphylococcus epidermidis
GIPAKARRKGGHPAK

SEQ ID NO: 1756607 - protein, 6 aa, Staphylococcus epidermidis
GIPGIS

SEQ ID NO: 1756608 - protein, 4 aa, Staphylococcus epidermidis
GIQQ

SEQ ID NO: 1756609 - protein, 7 aa, Staphylococcus epidermidis
GISKEGE

SEQ ID NO: 1756610 - protein, 5 aa, Staphylococcus epidermidis
GITGA

SEQ ID NO: 1756611 - protein, 6 aa, Staphylococcus epidermidis
GKAANI

SEQ ID NO: 1756612 - protein, 18 aa, Staphylococcus epidermidis
GKAFPGQPSVAHDSDIEG

SEQ ID NO: 1756613 - protein, 8 aa, Staphylococcus epidermidis
GKAGRSRW

SEQ ID NO: 1756614 - protein, 10 aa, Staphylococcus epidermidis
GKALDQDKSY

SEQ ID NO: 1756615 - protein, 6 aa, Staphylococcus epidermidis
GKAVES

SEQ ID NO: 1756616 - protein, 5 aa, Staphylococcus epidermidis
GKDAE

SEQ ID NO: 1756617 - protein, 6 aa, Staphylococcus epidermidis
GKEGLS

SEQ ID NO: 1756618 - protein, 5 aa, Staphylococcus epidermidis
GKEVN

SEQ ID NO: 1756619 - protein, 4 aa, Staphylococcus epidermidis
GKFD

SEQ ID NO: 1756620 - protein, 18 aa, Staphylococcus epidermidis
GKFGGGGYKVSGGLHGVG

SEQ ID NO: 1756621 - protein, 16 aa, Staphylococcus epidermidis
GKFGQGGYKTSGGLHG

SEQ ID NO: 1756622 - protein, 13 aa, Staphylococcus epidermidis
GKGGHGAKPHETI

SEQ ID NO: 1756623 - protein, 7 aa, Staphylococcus epidermidis
GKGNKER

SEQ ID NO: 1756624 - protein, 6 aa, Staphylococcus epidermidis
GKGPVV

SEQ ID NO: 1756625 - protein, 4 aa, Staphylococcus epidermidis
GKGT

SEQ ID NO: 1756626 - protein, 8 aa, Staphylococcus epidermidis
GKGTQASE

SEQ ID NO: 1756627 - protein, 5 aa, Staphylococcus epidermidis
GKHGI

SEQ ID NO: 1756628 - protein, 13 aa, Staphylococcus epidermidis
GKIGTKTSYQTIQ

SEQ ID NO: 1756629 - protein, 19 aa, Staphylococcus epidermidis
GKIHPHEKVRTKKRALKSL

SEQ ID NO: 1756630 - protein, 20 aa, Staphylococcus epidermidis
GKIPGGFKKREGRPGDEATL

SEQ ID NO: 1756631 - protein, 7 aa, Staphylococcus epidermidis
GKKEKDV

SEQ ID NO: 1756632 - protein, 8 aa, Staphylococcus epidermidis
GKKGYGYN

SEQ ID NO: 1756633 - protein, 17 aa, Staphylococcus epidermidis
GKLDGGAQRVPVATGSL

SEQ ID NO: 1756634 - protein, 11 aa, Staphylococcus epidermidis
GKLELKSGNRW

SEQ ID NO: 1756635 - protein, 10 aa, Staphylococcus epidermidis
GKLTGGGRGG

SEQ ID NO: 1756636 - protein, 12 aa, Staphylococcus epidermidis
GKMSKSKGNVVD

SEQ ID NO: 1756637 - protein, 10 aa, Staphylococcus epidermidis
GKNGSGKSTL

SEQ ID NO: 1756638 - protein, 7 aa, Staphylococcus epidermidis
GKNRSPL

SEQ ID NO: 1756639 - protein, 9 aa, Staphylococcus epidermidis
GKNYSDSPK

SEQ ID NO: 1756640 - protein, 5 aa, Staphylococcus epidermidis
GKPKK

SEQ ID NO: 1756641 - protein, 4 aa, Staphylococcus epidermidis
GKPV

SEQ ID NO: 1756642 - protein, 12 aa, Staphylococcus epidermidis
GKPVLDREGEHN

SEQ ID NO: 1756643 - protein, 14 aa, Staphylococcus epidermidis
GKPWDEAVGDAAEG

SEQ ID NO: 1756644 - protein, 7 aa, Staphylococcus epidermidis
GKQGRFR

SEQ ID NO: 1756645 - protein, 6 aa, Staphylococcus epidermidis
GKQTYS

SEQ ID NO: 1756646 - protein, 9 aa, Staphylococcus epidermidis
GKRGQNARL

SEQ ID NO: 1756647 - protein, 7 aa, Staphylococcus epidermidis
GKRGTAQ

SEQ ID NO: 1756648 - protein, 8 aa, Staphylococcus epidermidis
GKRYNRET

SEQ ID NO: 1756649 - protein, 9 aa, Staphylococcus epidermidis
GKSDKKRVQ

SEQ ID NO: 1756650 - protein, 6 aa, Staphylococcus epidermidis
GKSTLA

SEQ ID NO: 1756651 - protein, 8 aa, Staphylococcus epidermidis
GKTGSGKT

SEQ ID NO: 1756652 - protein, 11 aa, Staphylococcus epidermidis
GKTIYHTGDTG

SEQ ID NO: 1756653 - protein, 4 aa, Staphylococcus epidermidis
GKTT

SEQ ID NO: 1756654 - protein, 7 aa, Staphylococcus epidermidis
GKTTDQL

SEQ ID NO: 1756655 - protein, 7 aa, Staphylococcus epidermidis
GKTTFRH

SEQ ID NO: 1756656 - protein, 5 aa, Staphylococcus epidermidis
GKTTL

SEQ ID NO: 1756657 - protein, 4 aa, Staphylococcus epidermidis
GKVT

SEQ ID NO: 1756658 - protein, 5 aa, Staphylococcus epidermidis
GLDTS

SEQ ID NO: 1756659 - protein, 12 aa, Staphylococcus epidermidis
GLEDPKTGKRPY

SEQ ID NO: 1756660 - protein, 6 aa, Staphylococcus epidermidis
GLGPMT

SEQ ID NO: 1756661 - protein, 6 aa, Staphylococcus epidermidis
GLHPGR

SEQ ID NO: 1756662 - protein, 5 aa, Staphylococcus epidermidis
GLKPV

SEQ ID NO: 1756663 - protein, 5 aa, Staphylococcus epidermidis
GLKSF

SEQ ID NO: 1756664 - protein, 9 aa, Staphylococcus epidermidis
GLKYTDKRK

SEQ ID NO: 1756665 - protein, 12 aa, Staphylococcus epidermidis
GLMPNPKTGTVT

SEQ ID NO: 1756666 - protein, 6 aa, Staphylococcus epidermidis
GLNVPN

SEQ ID NO: 1756667 - protein, 12 aa, Staphylococcus epidermidis
GLPIGGYGGRQD

SEQ ID NO: 1756668 - protein, 5 aa, Staphylococcus epidermidis
GLPNE

SEQ ID NO: 1756669 - protein, 7 aa, Staphylococcus epidermidis
GLSEEED

SEQ ID NO: 1756670 - protein, 9 aa, Staphylococcus epidermidis
GLSGTYNTA

SEQ ID NO: 1756671 - protein, 5 aa, Staphylococcus epidermidis
GLSRD

SEQ ID NO: 1756672 - protein, 4 aa, Staphylococcus epidermidis
GLTS

SEQ ID NO: 1756673 - protein, 14 aa, Staphylococcus epidermidis
GMRKKGKVYESTEK

SEQ ID NO: 1756674 - protein, 4 aa, Staphylococcus epidermidis
GMTE

SEQ ID NO: 1756675 - protein, 13 aa, Staphylococcus epidermidis
GMTGTAKTEEEEF

SEQ ID NO: 1756676 - protein, 6 aa, Staphylococcus epidermidis
GNAGIK

SEQ ID NO: 1756677 - protein, 6 aa, Staphylococcus epidermidis
GNAGNI

SEQ ID NO: 1756678 - protein, 11 aa, Staphylococcus epidermidis
GNDKCDLDEQT

SEQ ID NO: 1756679 - protein, 7 aa, Staphylococcus epidermidis
GNEPLAQ

SEQ ID NO: 1756680 - protein, 7 aa, Staphylococcus epidermidis
GNEQQTT

SEQ ID NO: 1756681 - protein, 7 aa, Staphylococcus epidermidis
GNETYRT

SEQ ID NO: 1756682 - protein, 8 aa, Staphylococcus epidermidis
GNGGTDVT

SEQ ID NO: 1756683 - protein, 8 aa, Staphylococcus epidermidis
GNGPQVGS

SEQ ID NO: 1756684 - protein, 8 aa, Staphylococcus epidermidis
GNGQLNSQ

SEQ ID NO: 1756685 - protein, 4 aa, Staphylococcus epidermidis
GNIQ

SEQ ID NO: 1756686 - protein, 7 aa, Staphylococcus epidermidis
GNKALSN

SEQ ID NO: 1756687 - protein, 6 aa, Staphylococcus epidermidis
GNKEHV

SEQ ID NO: 1756688 - protein, 6 aa, Staphylococcus epidermidis
GNKKPI

SEQ ID NO: 1756689 - protein, 9 aa, Staphylococcus epidermidis
GNNKTKREI

SEQ ID NO: 1756690 - protein, 7 aa, Staphylococcus epidermidis
GNPASWQ

SEQ ID NO: 1756691 - protein, 6 aa, Staphylococcus epidermidis
GNPEEY

SEQ ID NO: 1756692 - protein, 5 aa, Staphylococcus epidermidis
GNPMD

SEQ ID NO: 1756693 - protein, 8 aa, Staphylococcus epidermidis
GNQFPEGV

SEQ ID NO: 1756694 - protein, 6 aa, Staphylococcus epidermidis
GNRFPH

SEQ ID NO: 1756695 - protein, 6 aa, Staphylococcus epidermidis
GNRNFE

SEQ ID NO: 1756696 - protein, 10 aa, Staphylococcus epidermidis
GNSGDEKEIS

SEQ ID NO: 1756697 - protein, 4 aa, Staphylococcus epidermidis
GNTA

SEQ ID NO: 1756698 - protein, 5 aa, Staphylococcus epidermidis
GNTHH

SEQ ID NO: 1756699 - protein, 4 aa, Staphylococcus epidermidis
GNYA

SEQ ID NO: 1756700 - protein, 11 aa, Staphylococcus epidermidis
GNYNLGGEQSG

SEQ ID NO: 1756701 - protein, 5 aa, Staphylococcus epidermidis
GNYQI

SEQ ID NO: 1756702 - protein, 8 aa, Staphylococcus epidermidis
GPAGTGKT

SEQ ID NO: 1756703 - protein, 8 aa, Staphylococcus epidermidis
GPDFPTGG

SEQ ID NO: 1756704 - protein, 4 aa, Staphylococcus epidermidis
GPDL

SEQ ID NO: 1756705 - protein, 13 aa, Staphylococcus epidermidis
GPDREQTNLLEQL

SEQ ID NO: 1756706 - protein, 11 aa, Staphylococcus epidermidis
GPEMKSTGEVM

SEQ ID NO: 1756707 - protein, 4 aa, Staphylococcus epidermidis
GPER

SEQ ID NO: 1756708 - protein, 8 aa, Staphylococcus epidermidis
GPERSEEL

SEQ ID NO: 1756709 - protein, 10 aa, Staphylococcus epidermidis
GPESSGKTTV

SEQ ID NO: 1756710 - protein, 8 aa, Staphylococcus epidermidis
GPGEGAGV

SEQ ID NO: 1756711 - protein, 11 aa, Staphylococcus epidermidis
GPGRGSSAGSL

SEQ ID NO: 1756712 - protein, 7 aa, Staphylococcus epidermidis
GPHDANN

SEQ ID NO: 1756713 - protein, 6 aa, Staphylococcus epidermidis
GPHVTT

SEQ ID NO: 1756714 - protein, 6 aa, Staphylococcus epidermidis
GPIGDG

SEQ ID NO: 1756715 - protein, 6 aa, Staphylococcus epidermidis
GPLTTE

SEQ ID NO: 1756716 - protein, 14 aa, Staphylococcus epidermidis
GPMKAGLSAQGKAL

SEQ ID NO: 1756717 - protein, 6 aa, Staphylococcus epidermidis
GPNGAG

SEQ ID NO: 1756718 - protein, 9 aa, Staphylococcus epidermidis
GPNGAGKSS

SEQ ID NO: 1756719 - protein, 9 aa, Staphylococcus epidermidis
GPNGEDGTI

SEQ ID NO: 1756720 - protein, 12 aa, Staphylococcus epidermidis
GPNGTGKSTLSS

SEQ ID NO: 1756721 - protein, 11 aa, Staphylococcus epidermidis
GPNKDIPAPDV

SEQ ID NO: 1756722 - protein, 9 aa, Staphylococcus epidermidis
GPNTGGKTV

SEQ ID NO: 1756723 - protein, 7 aa, Staphylococcus epidermidis
GPPYANG

SEQ ID NO: 1756724 - protein, 5 aa, Staphylococcus epidermidis
GPQAI

SEQ ID NO: 1756725 - protein, 10 aa, Staphylococcus epidermidis
GPRGTGKTSI

SEQ ID NO: 1756726 - protein, 15 aa, Staphylococcus epidermidis
GPRRGDGAESVIIEL

SEQ ID NO: 1756727 - protein, 10 aa, Staphylococcus epidermidis
GPSGCGKSTY

SEQ ID NO: 1756728 - protein, 10 aa, Staphylococcus epidermidis
GPSGSGKSTL

SEQ ID NO: 1756729 - protein, 7 aa, Staphylococcus epidermidis
GPSPAAL

SEQ ID NO: 1756730 - protein, 13 aa, Staphylococcus epidermidis
GPTAIATSTEDVV

SEQ ID NO: 1756731 - protein, 9 aa, Staphylococcus epidermidis
GPTGSGKST

SEQ ID NO: 1756732 - protein, 4 aa, Staphylococcus epidermidis
GPVI

SEQ ID NO: 1756733 - protein, 6 aa, Staphylococcus epidermidis
GPVNNG

SEQ ID NO: 1756734 - protein, 13 aa, Staphylococcus epidermidis
GQAQTGTGKTGAF

SEQ ID NO: 1756735 - protein, 5 aa, Staphylococcus epidermidis
GQDKA

SEQ ID NO: 1756736 - protein, 11 aa, Staphylococcus epidermidis
GQDKEATQQAR

SEQ ID NO: 1756737 - protein, 10 aa, Staphylococcus epidermidis
GQDKEATQTM

SEQ ID NO: 1756738 - protein, 10 aa, Staphylococcus epidermidis
GQEERDKEAQ

SEQ ID NO: 1756739 - protein, 15 aa, Staphylococcus epidermidis
GQGNFGSMDGDGAAA

SEQ ID NO: 1756740 - protein, 8 aa, Staphylococcus epidermidis
GQGQEATQ

SEQ ID NO: 1756741 - protein, 7 aa, Staphylococcus epidermidis
GQHTKAD

SEQ ID NO: 1756742 - protein, 16 aa, Staphylococcus epidermidis
GQINGTSGYEEAAGQG

SEQ ID NO: 1756743 - protein, 9 aa, Staphylococcus epidermidis
GQITQNREQ

SEQ ID NO: 1756744 - protein, 10 aa, Staphylococcus epidermidis
GQKAYDETGE

SEQ ID NO: 1756745 - protein, 8 aa, Staphylococcus epidermidis
GQLEETAR

SEQ ID NO: 1756746 - protein, 6 aa, Staphylococcus epidermidis
GQLNPG

SEQ ID NO: 1756747 - protein, 7 aa, Staphylococcus epidermidis
GQNNERV

SEQ ID NO: 1756748 - protein, 6 aa, Staphylococcus epidermidis
GQPIGS

SEQ ID NO: 1756749 - protein, 12 aa, Staphylococcus epidermidis
GQQRGKDTKDNI

SEQ ID NO: 1756750 - protein, 7 aa, Staphylococcus epidermidis
GQSSKSL

SEQ ID NO: 1756751 - protein, 5 aa, Staphylococcus epidermidis
GQSTV

SEQ ID NO: 1756752 - protein, 9 aa, Staphylococcus epidermidis
GQSVERGEV

SEQ ID NO: 1756753 - protein, 11 aa, Staphylococcus epidermidis
GQTAPPGKRMG

SEQ ID NO: 1756754 - protein, 9 aa, Staphylococcus epidermidis
GQTDENEMR

SEQ ID NO: 1756755 - protein, 7 aa, Staphylococcus epidermidis
GQTEEQV

SEQ ID NO: 1756756 - protein, 4 aa, Staphylococcus epidermidis
GQYV

SEQ ID NO: 1756757 - protein, 8 aa, Staphylococcus epidermidis
GRAPGTDM

SEQ ID NO: 1756758 - protein, 4 aa, Staphylococcus epidermidis
GRAQ

SEQ ID NO: 1756759 - protein, 7 aa, Staphylococcus epidermidis
GRARRGE

SEQ ID NO: 1756760 - protein, 7 aa, Staphylococcus epidermidis
GRFATSD

SEQ ID NO: 1756761 - protein, 6 aa, Staphylococcus epidermidis
GRGLTD

SEQ ID NO: 1756762 - protein, 9 aa, Staphylococcus epidermidis
GRGTSTYDG

SEQ ID NO: 1756763 - protein, 14 aa, Staphylococcus epidermidis
GRGTVATGRVERGQ

SEQ ID NO: 1756764 - protein, 7 aa, Staphylococcus epidermidis
GRHGNKG

SEQ ID NO: 1756765 - protein, 7 aa, Staphylococcus epidermidis
GRKGFSS

SEQ ID NO: 1756766 - protein, 7 aa, Staphylococcus epidermidis
GRKSLEE

SEQ ID NO: 1756767 - protein, 8 aa, Staphylococcus epidermidis
GRLQNKSN

SEQ ID NO: 1756768 - protein, 9 aa, Staphylococcus epidermidis
GRLSPSSLG

SEQ ID NO: 1756769 - protein, 12 aa, Staphylococcus epidermidis
GRLTDSKGRSVD

SEQ ID NO: 1756770 - protein, 9 aa, Staphylococcus epidermidis
GRNGAGKST

SEQ ID NO: 1756771 - protein, 11 aa, Staphylococcus epidermidis
GRPSTYAPTID

SEQ ID NO: 1756772 - protein, 8 aa, Staphylococcus epidermidis
GRPTNGMS

SEQ ID NO: 1756773 - protein, 6 aa, Staphylococcus epidermidis
GRPYRA

SEQ ID NO: 1756774 - protein, 4 aa, Staphylococcus epidermidis
GRQS

SEQ ID NO: 1756775 - protein, 5 aa, Staphylococcus epidermidis
GRRMS

SEQ ID NO: 1756776 - protein, 5 aa, Staphylococcus epidermidis
GRRNM

SEQ ID NO: 1756777 - protein, 8 aa, Staphylococcus epidermidis
GRSEGAKV

SEQ ID NO: 1756778 - protein, 9 aa, Staphylococcus epidermidis
GRSGSGKSS

SEQ ID NO: 1756779 - protein, 9 aa, Staphylococcus epidermidis
GRSGSGKTT

SEQ ID NO: 1756780 - protein, 9 aa, Staphylococcus epidermidis
GRSQPEYRK

SEQ ID NO: 1756781 - protein, 9 aa, Staphylococcus epidermidis
GRSSTRKEE

SEQ ID NO: 1756782 - protein, 8 aa, Staphylococcus epidermidis
GRTMPGRR

SEQ ID NO: 1756783 - protein, 6 aa, Staphylococcus epidermidis
GRYKAN

SEQ ID NO: 1756784 - protein, 13 aa, Staphylococcus epidermidis
GRYSKETIRHPET

SEQ ID NO: 1756785 - protein, 13 aa, Staphylococcus epidermidis
GSAGAGSKPNPLL

SEQ ID NO: 1756786 - protein, 9 aa, Staphylococcus epidermidis
GSATNDGGV

SEQ ID NO: 1756787 - protein, 8 aa, Staphylococcus epidermidis
GSAYYAPA

SEQ ID NO: 1756788 - protein, 6 aa, Staphylococcus epidermidis
GSDQYR

SEQ ID NO: 1756789 - protein, 6 aa, Staphylococcus epidermidis
GSDSEI

SEQ ID NO: 1756790 - protein, 4 aa, Staphylococcus epidermidis
GSFK

SEQ ID NO: 1756791 - protein, 14 aa, Staphylococcus epidermidis
GSGGNYALSAGRAL

SEQ ID NO: 1756792 - protein, 10 aa, Staphylococcus epidermidis
GSGGSTGADK

SEQ ID NO: 1756793 - protein, 6 aa, Staphylococcus epidermidis
GSGIGD

SEQ ID NO: 1756794 - protein, 10 aa, Staphylococcus epidermidis
GSGPAGLTAA

SEQ ID NO: 1756795 - protein, 9 aa, Staphylococcus epidermidis
GSGPTGSKI

SEQ ID NO: 1756796 - protein, 11 aa, Staphylococcus epidermidis
GSGSGKTTVTN

SEQ ID NO: 1756797 - protein, 18 aa, Staphylococcus epidermidis
GSGSRFSDNRQQEVSEIS

SEQ ID NO: 1756798 - protein, 7 aa, Staphylococcus epidermidis
GSGSTEH

SEQ ID NO: 1756799 - protein, 6 aa, Staphylococcus epidermidis
GSGSVG

SEQ ID NO: 1756800 - protein, 5 aa, Staphylococcus epidermidis
GSGTA

SEQ ID NO: 1756801 - protein, 6 aa, Staphylococcus epidermidis
GSGVAT

SEQ ID NO: 1756802 - protein, 6 aa, Staphylococcus epidermidis
GSHEAE

SEQ ID NO: 1756803 - protein, 4 aa, Staphylococcus epidermidis
GSIP

SEQ ID NO: 1756804 - protein, 11 aa, Staphylococcus epidermidis
GSISAEAHETL

SEQ ID NO: 1756805 - protein, 9 aa, Staphylococcus epidermidis
GSITPQESV

SEQ ID NO: 1756806 - protein, 5 aa, Staphylococcus epidermidis
GSITV

SEQ ID NO: 1756807 - protein, 7 aa, Staphylococcus epidermidis
GSLYTGY

SEQ ID NO: 1756808 - protein, 8 aa, Staphylococcus epidermidis
GSMTDSTG

SEQ ID NO: 1756809 - protein, 5 aa, Staphylococcus epidermidis
GSNFE

SEQ ID NO: 1756810 - protein, 8 aa, Staphylococcus epidermidis
GSPGFSSE

SEQ ID NO: 1756811 - protein, 8 aa, Staphylococcus epidermidis
GSQGEPMA

SEQ ID NO: 1756812 - protein, 9 aa, Staphylococcus epidermidis
GSRATGTRI

SEQ ID NO: 1756813 - protein, 12 aa, Staphylococcus epidermidis
GSRTVKKEAEAL

SEQ ID NO: 1756814 - protein, 6 aa, Staphylococcus epidermidis
GSSFEK

SEQ ID NO: 1756815 - protein, 10 aa, Staphylococcus epidermidis
GSSSGAALQG

SEQ ID NO: 1756816 - protein, 16 aa, Staphylococcus epidermidis
GSTGISSGYATDIPPH

SEQ ID NO: 1756817 - protein, 10 aa, Staphylococcus epidermidis
GSTGRGNVTP

SEQ ID NO: 1756818 - protein, 13 aa, Staphylococcus epidermidis
GSVGIANNQTGLY

SEQ ID NO: 1756819 - protein, 8 aa, Staphylococcus epidermidis
GSVKGKKR

SEQ ID NO: 1756820 - protein, 10 aa, Staphylococcus epidermidis
GSVNNPETSS

SEQ ID NO: 1756821 - protein, 7 aa, Staphylococcus epidermidis
GSVPHSG

SEQ ID NO: 1756822 - protein, 4 aa, Staphylococcus epidermidis
GSYA

SEQ ID NO: 1756823 - protein, 10 aa, Staphylococcus epidermidis
GTDPTGGAGV

SEQ ID NO: 1756824 - protein, 6 aa, Staphylococcus epidermidis
GTDSHT

SEQ ID NO: 1756825 - protein, 11 aa, Staphylococcus epidermidis
GTEESPGATEV

SEQ ID NO: 1756826 - protein, 8 aa, Staphylococcus epidermidis
GTEGPSVS

SEQ ID NO: 1756827 - protein, 9 aa, Staphylococcus epidermidis
GTGDHPTTS

SEQ ID NO: 1756828 - protein, 9 aa, Staphylococcus epidermidis
GTGIPTKDI

SEQ ID NO: 1756829 - protein, 6 aa, Staphylococcus epidermidis
GTGVAP

SEQ ID NO: 1756830 - protein, 10 aa, Staphylococcus epidermidis
GTIDDPLDET

SEQ ID NO: 1756831 - protein, 5 aa, Staphylococcus epidermidis
GTKFG

SEQ ID NO: 1756832 - protein, 9 aa, Staphylococcus epidermidis
GTKNTSVKV

SEQ ID NO: 1756833 - protein, 9 aa, Staphylococcus epidermidis
GTLSGNPLA

SEQ ID NO: 1756834 - protein, 8 aa, Staphylococcus epidermidis
GTLSQNKK

SEQ ID NO: 1756835 - protein, 4 aa, Staphylococcus epidermidis
GTME

SEQ ID NO: 1756836 - protein, 10 aa, Staphylococcus epidermidis
GTNGKTTTSN

SEQ ID NO: 1756837 - protein, 19 aa, Staphylococcus epidermidis
GTNRTNKYYNDSKATNTLA

SEQ ID NO: 1756838 - protein, 7 aa, Staphylococcus epidermidis
GTPGYEE

SEQ ID NO: 1756839 - protein, 5 aa, Staphylococcus epidermidis
GTQAE

SEQ ID NO: 1756840 - protein, 5 aa, Staphylococcus epidermidis
GTQLS

SEQ ID NO: 1756841 - protein, 6 aa, Staphylococcus epidermidis
GTQTNQ

SEQ ID NO: 1756842 - protein, 8 aa, Staphylococcus epidermidis
GTRGFKAG

SEQ ID NO: 1756843 - protein, 6 aa, Staphylococcus epidermidis
GTSGLN

SEQ ID NO: 1756844 - protein, 6 aa, Staphylococcus epidermidis
GTSGRL

SEQ ID NO: 1756845 - protein, 5 aa, Staphylococcus epidermidis
GTTAS

SEQ ID NO: 1756846 - protein, 17 aa, Staphylococcus epidermidis
GTTASVPPQGGRKHPNQ

SEQ ID NO: 1756847 - protein, 5 aa, Staphylococcus epidermidis
GTTPE

SEQ ID NO: 1756848 - protein, 5 aa, Staphylococcus epidermidis
GTTSG

SEQ ID NO: 1756849 - protein, 7 aa, Staphylococcus epidermidis
GTVRNYT

SEQ ID NO: 1756850 - protein, 9 aa, Staphylococcus epidermidis
GTYKGKEVS

SEQ ID NO: 1756851 - protein, 5 aa, Staphylococcus epidermidis
GTYSE

SEQ ID NO: 1756852 - protein, 8 aa, Staphylococcus epidermidis
GVATPQDA

SEQ ID NO: 1756853 - protein, 9 aa, Staphylococcus epidermidis
GVGDSTDVV

SEQ ID NO: 1756854 - protein, 8 aa, Staphylococcus epidermidis
GVGGYPKG

SEQ ID NO: 1756855 - protein, 10 aa, Staphylococcus epidermidis
GVGKSTLTQA

SEQ ID NO: 1756856 - protein, 7 aa, Staphylococcus epidermidis
GVGPYTQ

SEQ ID NO: 1756857 - protein, 5 aa, Staphylococcus epidermidis
GVGVQ

SEQ ID NO: 1756858 - protein, 7 aa, Staphylococcus epidermidis
GVHSGDS

SEQ ID NO: 1756859 - protein, 4 aa, Staphylococcus epidermidis
GVNG

SEQ ID NO: 1756860 - protein, 6 aa, Staphylococcus epidermidis
GVNGGG

SEQ ID NO: 1756861 - protein, 10 aa, Staphylococcus epidermidis
GVSGSGKSSL

SEQ ID NO: 1756862 - protein, 8 aa, Staphylococcus epidermidis
GVTEDSTN

SEQ ID NO: 1756863 - protein, 11 aa, Staphylococcus epidermidis
GVTGTNGKTSI

SEQ ID NO: 1756864 - protein, 9 aa, Staphylococcus epidermidis
GYAPSSPSF

SEQ ID NO: 1756865 - protein, 25 aa, Staphylococcus epidermidis
GYARHGGGCFSGKDPTKVDRSAAYA

SEQ ID NO: 1756866 - protein, 15 aa, Staphylococcus epidermidis
GYDGGTGASPKTSIQ

SEQ ID NO: 1756867 - protein, 16 aa, Staphylococcus epidermidis
GYDKPENKAQMTPQEQ

SEQ ID NO: 1756868 - protein, 6 aa, Staphylococcus epidermidis
GYGKTE

SEQ ID NO: 1756869 - protein, 6 aa, Staphylococcus epidermidis
GYHGKS

SEQ ID NO: 1756870 - protein, 13 aa, Staphylococcus epidermidis
GYQETISDPSYTG

SEQ ID NO: 1756871 - protein, 6 aa, Staphylococcus epidermidis
GYQPTL

SEQ ID NO: 1756872 - protein, 5 aa, Staphylococcus epidermidis
GYRGA

SEQ ID NO: 1756873 - protein, 6 aa, Staphylococcus epidermidis
GYRTGS

SEQ ID NO: 1756874 - protein, 14 aa, Staphylococcus epidermidis
GYTEAQAKEEGLSI

SEQ ID NO: 1756875 - protein, 11 aa, Staphylococcus epidermidis
GYTKEEQKMID

SEQ ID NO: 1756876 - protein, 7 aa, Staphylococcus epidermidis
GYTQDTM

SEQ ID NO: 1756877 - protein, 5 aa, Staphylococcus epidermidis
GYTVD

SEQ ID NO: 1756878 - protein, 7 aa, Staphylococcus epidermidis
HAEPTTF

SEQ ID NO: 1756879 - protein, 12 aa, Staphylococcus epidermidis
HAGGRGKAGGVK

SEQ ID NO: 1756880 - protein, 5 aa, Staphylococcus epidermidis
HAKEE

SEQ ID NO: 1756881 - protein, 5 aa, Staphylococcus epidermidis
HANIG

SEQ ID NO: 1756882 - protein, 9 aa, Staphylococcus epidermidis
HARSTGPYS

SEQ ID NO: 1756883 - protein, 4 aa, Staphylococcus epidermidis
HASP

SEQ ID NO: 1756884 - protein, 8 aa, Staphylococcus epidermidis
HASYTEHP

SEQ ID NO: 1756885 - protein, 4 aa, Staphylococcus epidermidis
HATA

SEQ ID NO: 1756886 - protein, 10 aa, Staphylococcus epidermidis
HDAGYNVKED

SEQ ID NO: 1756887 - protein, 6 aa, Staphylococcus epidermidis
HDEERF

SEQ ID NO: 1756888 - protein, 13 aa, Staphylococcus epidermidis
HDSARKAGRIPSG

SEQ ID NO: 1756889 - protein, 6 aa, Staphylococcus epidermidis
HDSKDN

SEQ ID NO: 1756890 - protein, 8 aa, Staphylococcus epidermidis
HDTSGNGL

SEQ ID NO: 1756891 - protein, 7 aa, Staphylococcus epidermidis
HDVDSSE

SEQ ID NO: 1756892 - protein, 6 aa, Staphylococcus epidermidis
HEDGAE

SEQ ID NO: 1756893 - protein, 6 aa, Staphylococcus epidermidis
HEDGDA

SEQ ID NO: 1756894 - protein, 4 aa, Staphylococcus epidermidis
HEEG

SEQ ID NO: 1756895 - protein, 8 aa, Staphylococcus epidermidis
HELDEESY

SEQ ID NO: 1756896 - protein, 8 aa, Staphylococcus epidermidis
HENDDGDL

SEQ ID NO: 1756897 - protein, 9 aa, Staphylococcus epidermidis
HEPPTDSPL

SEQ ID NO: 1756898 - protein, 10 aa, Staphylococcus epidermidis
HETDTGSPEV

SEQ ID NO: 1756899 - protein, 8 aa, Staphylococcus epidermidis
HEVAPGQH

SEQ ID NO: 1756900 - protein, 6 aa, Staphylococcus epidermidis
HFKPGQ

SEQ ID NO: 1756901 - protein, 10 aa, Staphylococcus epidermidis
HGGARSNSAF

SEQ ID NO: 1756902 - protein, 6 aa, Staphylococcus epidermidis
HGGMTS

SEQ ID NO: 1756903 - protein, 7 aa, Staphylococcus epidermidis
HGHSKGV

SEQ ID NO: 1756904 - protein, 5 aa, Staphylococcus epidermidis
HGKTT

SEQ ID NO: 1756905 - protein, 7 aa, Staphylococcus epidermidis
HGKTTLT

SEQ ID NO: 1756906 - protein, 6 aa, Staphylococcus epidermidis
HGQEQM

SEQ ID NO: 1756907 - protein, 4 aa, Staphylococcus epidermidis
HGSF

SEQ ID NO: 1756908 - protein, 5 aa, Staphylococcus epidermidis
HGSTF

SEQ ID NO: 1756909 - protein, 8 aa, Staphylococcus epidermidis
HHGSTPPC

SEQ ID NO: 1756910 - protein, 6 aa, Staphylococcus epidermidis
HKDSYA

SEQ ID NO: 1756911 - protein, 12 aa, Staphylococcus epidermidis
HKGQIPGVKKSS

SEQ ID NO: 1756912 - protein, 9 aa, Staphylococcus epidermidis
HKKDHHSRR

SEQ ID NO: 1756913 - protein, 7 aa, Staphylococcus epidermidis
HKNDPGV

SEQ ID NO: 1756914 - protein, 11 aa, Staphylococcus epidermidis
HKPSGAKPGFV

SEQ ID NO: 1756915 - protein, 7 aa, Staphylococcus epidermidis
HKSQGSE

SEQ ID NO: 1756916 - protein, 11 aa, Staphylococcus epidermidis
HLTTDEQETRK

SEQ ID NO: 1756917 - protein, 5 aa, Staphylococcus epidermidis
HNPPM

SEQ ID NO: 1756918 - protein, 7 aa, Staphylococcus epidermidis
HNRENDL

SEQ ID NO: 1756919 - protein, 4 aa, Staphylococcus epidermidis
HNTY

SEQ ID NO: 1756920 - protein, 5 aa, Staphylococcus epidermidis
HNYEN

SEQ ID NO: 1756921 - protein, 6 aa, Staphylococcus epidermidis
HPATYD

SEQ ID NO: 1756922 - protein, 15 aa, Staphylococcus epidermidis
HPDPSVALSDAGQQM

SEQ ID NO: 1756923 - protein, 5 aa, Staphylococcus epidermidis
HPEGY

SEQ ID NO: 1756924 - protein, 8 aa, Staphylococcus epidermidis
HPEGYTAT

SEQ ID NO: 1756925 - protein, 8 aa, Staphylococcus epidermidis
HPHGDSSV

SEQ ID NO: 1756926 - protein, 4 aa, Staphylococcus epidermidis
HPRE

SEQ ID NO: 1756927 - protein, 14 aa, Staphylococcus epidermidis
HQKPTQLNPEGGIL

SEQ ID NO: 1756928 - protein, 10 aa, Staphylococcus epidermidis
HQTGPEGKEV

SEQ ID NO: 1756929 - protein, 4 aa, Staphylococcus epidermidis
HREN

SEQ ID NO: 1756930 - protein, 8 aa, Staphylococcus epidermidis
HRGQEGAG

SEQ ID NO: 1756931 - protein, 11 aa, Staphylococcus epidermidis
HRSGETEDTTI

SEQ ID NO: 1756932 - protein, 4 aa, Staphylococcus epidermidis
HSDA

SEQ ID NO: 1756933 - protein, 5 aa, Staphylococcus epidermidis
HSIPD

SEQ ID NO: 1756934 - protein, 9 aa, Staphylococcus epidermidis
HSKEAQSLE

SEQ ID NO: 1756935 - protein, 9 aa, Staphylococcus epidermidis
HSNEAEQSV

SEQ ID NO: 1756936 - protein, 15 aa, Staphylococcus epidermidis
HSNNQRHTNETEQIL

SEQ ID NO: 1756937 - protein, 6 aa, Staphylococcus epidermidis
HSPFEE

SEQ ID NO: 1756938 - protein, 6 aa, Staphylococcus epidermidis
HSTGRK

SEQ ID NO: 1756939 - protein, 5 aa, Staphylococcus epidermidis
HSTLR

SEQ ID NO: 1756940 - protein, 8 aa, Staphylococcus epidermidis
HTDEETGQ

SEQ ID NO: 1756941 - protein, 14 aa, Staphylococcus epidermidis
HTGVSDELGGQGLG

SEQ ID NO: 1756942 - protein, 4 aa, Staphylococcus epidermidis
HTNG

SEQ ID NO: 1756943 - protein, 5 aa, Staphylococcus epidermidis
HTSDE

SEQ ID NO: 1756944 - protein, 15 aa, Staphylococcus epidermidis
HTTDNYTGAVTTPIY

SEQ ID NO: 1756945 - protein, 5 aa, Staphylococcus epidermidis
HVKEE

SEQ ID NO: 1756946 - protein, 10 aa, Staphylococcus epidermidis
HVTTDAGTGC

SEQ ID NO: 1756947 - protein, 6 aa, Staphylococcus epidermidis
HYPDTT

SEQ ID NO: 1756948 - protein, 5 aa, Staphylococcus epidermidis
IADEV

SEQ ID NO: 1756949 - protein, 7 aa, Staphylococcus epidermidis
IAEENKL

SEQ ID NO: 1756950 - protein, 7 aa, Staphylococcus epidermidis
IAGDQQA

SEQ ID NO: 1756951 - protein, 5 aa, Staphylococcus epidermidis
IAGPT

SEQ ID NO: 1756952 - protein, 10 aa, Staphylococcus epidermidis
IAPGANINYE

SEQ ID NO: 1756953 - protein, 8 aa, Staphylococcus epidermidis
IAPSSSYS

SEQ ID NO: 1756954 - protein, 20 aa, Staphylococcus epidermidis
IARKSENTSITRDVSGEGVQ

SEQ ID NO: 1756955 - protein, 5 aa, Staphylococcus epidermidis
IARTG

SEQ ID NO: 1756956 - protein, 21 aa, Staphylococcus epidermidis
IATQAKVEAKLNEQGISRHDL

SEQ ID NO: 1756957 - protein, 5 aa, Staphylococcus epidermidis
IDADQ

SEQ ID NO: 1756958 - protein, 5 aa, Staphylococcus epidermidis
IDASY

SEQ ID NO: 1756959 - protein, 7 aa, Staphylococcus epidermidis
IDDNVAN

SEQ ID NO: 1756960 - protein, 10 aa, Staphylococcus epidermidis
IDGATGQNAM

SEQ ID NO: 1756961 - protein, 6 aa, Staphylococcus epidermidis
IDKAEK

SEQ ID NO: 1756962 - protein, 10 aa, Staphylococcus epidermidis
IDKNGRENYD

SEQ ID NO: 1756963 - protein, 10 aa, Staphylococcus epidermidis
IDKPTANPDR

SEQ ID NO: 1756964 - protein, 5 aa, Staphylococcus epidermidis
IDNDE

SEQ ID NO: 1756965 - protein, 11 aa, Staphylococcus epidermidis
IDNKDSKIRYR

SEQ ID NO: 1756966 - protein, 15 aa, Staphylococcus epidermidis
IDQKTTSKNPRSTVA

SEQ ID NO: 1756967 - protein, 5 aa, Staphylococcus epidermidis
IDSPV

SEQ ID NO: 1756968 - protein, 4 aa, Staphylococcus epidermidis
IEAE

SEQ ID NO: 1756969 - protein, 13 aa, Staphylococcus epidermidis
IEDEPFDGDALKF

SEQ ID NO: 1756970 - protein, 7 aa, Staphylococcus epidermidis
IEEDAKK

SEQ ID NO: 1756971 - protein, 11 aa, Staphylococcus epidermidis
IEEENLDIPPE

SEQ ID NO: 1756972 - protein, 5 aa, Staphylococcus epidermidis
IEEPG

SEQ ID NO: 1756973 - protein, 9 aa, Staphylococcus epidermidis
IEEQTYERN

SEQ ID NO: 1756974 - protein, 11 aa, Staphylococcus epidermidis
IEGDDESFKSL

SEQ ID NO: 1756975 - protein, 11 aa, Staphylococcus epidermidis
IEGHPDNVAPT

SEQ ID NO: 1756976 - protein, 10 aa, Staphylococcus epidermidis
IEGKSYTPQE

SEQ ID NO: 1756977 - protein, 10 aa, Staphylococcus epidermidis
IEHGDANEGV

SEQ ID NO: 1756978 - protein, 11 aa, Staphylococcus epidermidis
IELRGDDPKVV

SEQ ID NO: 1756979 - protein, 5 aa, Staphylococcus epidermidis
IENGS

SEQ ID NO: 1756980 - protein, 4 aa, Staphylococcus epidermidis
IEQD

SEQ ID NO: 1756981 - protein, 9 aa, Staphylococcus epidermidis
IEQKKKGIE

SEQ ID NO: 1756982 - protein, 10 aa, Staphylococcus epidermidis
IERGGAGGGI

SEQ ID NO: 1756983 - protein, 5 aa, Staphylococcus epidermidis
IESND

SEQ ID NO: 1756984 - protein, 12 aa, Staphylococcus epidermidis
IETGQLAKQANG

SEQ ID NO: 1756985 - protein, 4 aa, Staphylococcus epidermidis
IETN

SEQ ID NO: 1756986 - protein, 4 aa, Staphylococcus epidermidis
IETR

SEQ ID NO: 1756987 - protein, 12 aa, Staphylococcus epidermidis
IETTEARAKEVR

SEQ ID NO: 1756988 - protein, 5 aa, Staphylococcus epidermidis
IEYGN

SEQ ID NO: 1756989 - protein, 6 aa, Staphylococcus epidermidis
IGASTG

SEQ ID NO: 1756990 - protein, 12 aa, Staphylococcus epidermidis
IGDSESRKEYNE

SEQ ID NO: 1756991 - protein, 7 aa, Staphylococcus epidermidis
IGGDKEL

SEQ ID NO: 1756992 - protein, 8 aa, Staphylococcus epidermidis
IGGETAEM

SEQ ID NO: 1756993 - protein, 4 aa, Staphylococcus epidermidis
IGGG

SEQ ID NO: 1756994 - protein, 10 aa, Staphylococcus epidermidis
IGGGNSGVEA

SEQ ID NO: 1756995 - protein, 8 aa, Staphylococcus epidermidis
IGGGSTEV

SEQ ID NO: 1756996 - protein, 4 aa, Staphylococcus epidermidis
IGGP

SEQ ID NO: 1756997 - protein, 8 aa, Staphylococcus epidermidis
IGGRTSHS

SEQ ID NO: 1756998 - protein, 6 aa, Staphylococcus epidermidis
IGHETN

SEQ ID NO: 1756999 - protein, 6 aa, Staphylococcus epidermidis
IGHQDD

SEQ ID NO: 1757000 - protein, 7 aa, Staphylococcus epidermidis
IGKKEGY

SEQ ID NO: 1757001 - protein, 8 aa, Staphylococcus epidermidis
IGNNEGMT

SEQ ID NO: 1757002 - protein, 4 aa, Staphylococcus epidermidis
IGNP

SEQ ID NO: 1757003 - protein, 4 aa, Staphylococcus epidermidis
IGPD

SEQ ID NO: 1757004 - protein, 8 aa, Staphylococcus epidermidis
IGPGGKKI

SEQ ID NO: 1757005 - protein, 6 aa, Staphylococcus epidermidis
IGPGSI

SEQ ID NO: 1757006 - protein, 10 aa, Staphylococcus epidermidis
IGPNGCGKST

SEQ ID NO: 1757007 - protein, 9 aa, Staphylococcus epidermidis
IGPTGSGKT

SEQ ID NO: 1757008 - protein, 8 aa, Staphylococcus epidermidis
IGQKTDTT

SEQ ID NO: 1757009 - protein, 7 aa, Staphylococcus epidermidis
IGQPVNG

SEQ ID NO: 1757010 - protein, 6 aa, Staphylococcus epidermidis
IGSGNA

SEQ ID NO: 1757011 - protein, 6 aa, Staphylococcus epidermidis
IGTSGA

SEQ ID NO: 1757012 - protein, 12 aa, Staphylococcus epidermidis
IHTSGHGSQGDQ

SEQ ID NO: 1757013 - protein, 12 aa, Staphylococcus epidermidis
IIPNSTGAAKAI

SEQ ID NO: 1757014 - protein, 4 aa, Staphylococcus epidermidis
IIQP

SEQ ID NO: 1757015 - protein, 8 aa, Staphylococcus epidermidis
IKAKQSKL

SEQ ID NO: 1757016 - protein, 4 aa, Staphylococcus epidermidis
IKAN

SEQ ID NO: 1757017 - protein, 16 aa, Staphylococcus epidermidis
IKEGDKVTGEVQQVED

SEQ ID NO: 1757018 - protein, 11 aa, Staphylococcus epidermidis
IKKQDKEKNTT

SEQ ID NO: 1757019 - protein, 9 aa, Staphylococcus epidermidis
IKKRGEDIE

SEQ ID NO: 1757020 - protein, 4 aa, Staphylococcus epidermidis
IKPD

SEQ ID NO: 1757021 - protein, 19 aa, Staphylococcus epidermidis
IKSSEQKYKHDNLTTTECP

SEQ ID NO: 1757022 - protein, 9 aa, Staphylococcus epidermidis
IMPGGSQEM

SEQ ID NO: 1757023 - protein, 5 aa, Staphylococcus epidermidis
INDGM

SEQ ID NO: 1757024 - protein, 4 aa, Staphylococcus epidermidis
INEE

SEQ ID NO: 1757025 - protein, 6 aa, Staphylococcus epidermidis
INGKAG

SEQ ID NO: 1757026 - protein, 6 aa, Staphylococcus epidermidis
INKNGK

SEQ ID NO: 1757027 - protein, 8 aa, Staphylococcus epidermidis
INKTLTPH

SEQ ID NO: 1757028 - protein, 9 aa, Staphylococcus epidermidis
INPLTEKND

SEQ ID NO: 1757029 - protein, 9 aa, Staphylococcus epidermidis
INPTEGEVV

SEQ ID NO: 1757030 - protein, 7 aa, Staphylococcus epidermidis
INPTRSG

SEQ ID NO: 1757031 - protein, 7 aa, Staphylococcus epidermidis
INQMRGE

SEQ ID NO: 1757032 - protein, 7 aa, Staphylococcus epidermidis
INQPEND

SEQ ID NO: 1757033 - protein, 5 aa, Staphylococcus epidermidis
INRPE

SEQ ID NO: 1757034 - protein, 8 aa, Staphylococcus epidermidis
INTPKQLP

SEQ ID NO: 1757035 - protein, 9 aa, Staphylococcus epidermidis
IPANTGNIA

SEQ ID NO: 1757036 - protein, 9 aa, Staphylococcus epidermidis
IPDGETPKG

SEQ ID NO: 1757037 - protein, 5 aa, Staphylococcus epidermidis
IPDGK

SEQ ID NO: 1757038 - protein, 6 aa, Staphylococcus epidermidis
IPEAEQ

SEQ ID NO: 1757039 - protein, 19 aa, Staphylococcus epidermidis
IPENEPGSSIMPGKVNPTQ

SEQ ID NO: 1757040 - protein, 7 aa, Staphylococcus epidermidis
IPGPNHV

SEQ ID NO: 1757041 - protein, 11 aa, Staphylococcus epidermidis
IPGTDGPIESF

SEQ ID NO: 1757042 - protein, 9 aa, Staphylococcus epidermidis
IPPAPRGVP

SEQ ID NO: 1757043 - protein, 4 aa, Staphylococcus epidermidis
IPPE

SEQ ID NO: 1757044 - protein, 9 aa, Staphylococcus epidermidis
IPPQSTTAK

SEQ ID NO: 1757045 - protein, 14 aa, Staphylococcus epidermidis
IPQAHQSLRNKEWN

SEQ ID NO: 1757046 - protein, 11 aa, Staphylococcus epidermidis
IPTPERDSDKP

SEQ ID NO: 1757047 - protein, 11 aa, Staphylococcus epidermidis
IPTSTGAAKAL

SEQ ID NO: 1757048 - protein, 18 aa, Staphylococcus epidermidis
IPVSAGLAGGSADAAATM

SEQ ID NO: 1757049 - protein, 8 aa, Staphylococcus epidermidis
IPYSSRNP

SEQ ID NO: 1757050 - protein, 7 aa, Staphylococcus epidermidis
IQDQAAK

SEQ ID NO: 1757051 - protein, 6 aa, Staphylococcus epidermidis
IQEGDT

SEQ ID NO: 1757052 - protein, 5 aa, Staphylococcus epidermidis
IQGGP

SEQ ID NO: 1757053 - protein, 5 aa, Staphylococcus epidermidis
IQGSQ

SEQ ID NO: 1757054 - protein, 13 aa, Staphylococcus epidermidis
IQLGKKESVEDTA

SEQ ID NO: 1757055 - protein, 6 aa, Staphylococcus epidermidis
IQNDGT

SEQ ID NO: 1757056 - protein, 5 aa, Staphylococcus epidermidis
IQQFG

SEQ ID NO: 1757057 - protein, 4 aa, Staphylococcus epidermidis
IQQQ

SEQ ID NO: 1757058 - protein, 11 aa, Staphylococcus epidermidis
IRREQGSDIDA

SEQ ID NO: 1757059 - protein, 10 aa, Staphylococcus epidermidis
ISAGRANSNL

SEQ ID NO: 1757060 - protein, 7 aa, Staphylococcus epidermidis
ISEEEAT

SEQ ID NO: 1757061 - protein, 9 aa, Staphylococcus epidermidis
ISENTGISK

SEQ ID NO: 1757062 - protein, 11 aa, Staphylococcus epidermidis
ISEYSAHNQRG

SEQ ID NO: 1757063 - protein, 12 aa, Staphylococcus epidermidis
ISGGGAVYHDTG

SEQ ID NO: 1757064 - protein, 8 aa, Staphylococcus epidermidis
ISGGGRCN

SEQ ID NO: 1757065 - protein, 4 aa, Staphylococcus epidermidis
ISGN

SEQ ID NO: 1757066 - protein, 11 aa, Staphylococcus epidermidis
ISGPSLERPGD

SEQ ID NO: 1757067 - protein, 6 aa, Staphylococcus epidermidis
ISHDNG

SEQ ID NO: 1757068 - protein, 6 aa, Staphylococcus epidermidis
ISKPGL

SEQ ID NO: 1757069 - protein, 8 aa, Staphylococcus epidermidis
ISQSSNKS

SEQ ID NO: 1757070 - protein, 17 aa, Staphylococcus epidermidis
ISSAPGSVSQVRESTQS

SEQ ID NO: 1757071 - protein, 9 aa, Staphylococcus epidermidis
ISTGGGASL

SEQ ID NO: 1757072 - protein, 12 aa, Staphylococcus epidermidis
ISTNPDVSIPKE

SEQ ID NO: 1757073 - protein, 5 aa, Staphylococcus epidermidis
ISTRE

SEQ ID NO: 1757074 - protein, 5 aa, Staphylococcus epidermidis
ITAKD

SEQ ID NO: 1757075 - protein, 4 aa, Staphylococcus epidermidis
ITED

SEQ ID NO: 1757076 - protein, 10 aa, Staphylococcus epidermidis
ITEDNRSDLG

SEQ ID NO: 1757077 - protein, 7 aa, Staphylococcus epidermidis
ITEKGTQ

SEQ ID NO: 1757078 - protein, 15 aa, Staphylococcus epidermidis
ITEKQGVNKAAVSRR

SEQ ID NO: 1757079 - protein, 12 aa, Staphylococcus epidermidis
ITEKSSEAMAED

SEQ ID NO: 1757080 - protein, 6 aa, Staphylococcus epidermidis
ITGGEP

SEQ ID NO: 1757081 - protein, 5 aa, Staphylococcus epidermidis
ITGTS

SEQ ID NO: 1757082 - protein, 4 aa, Staphylococcus epidermidis
ITPA

SEQ ID NO: 1757083 - protein, 4 aa, Staphylococcus epidermidis
ITPE

SEQ ID NO: 1757084 - protein, 9 aa, Staphylococcus epidermidis
ITQKGNART

SEQ ID NO: 1757085 - protein, 19 aa, Staphylococcus epidermidis
ITRASTSGMAKSRRKTLEK

SEQ ID NO: 1757086 - protein, 4 aa, Staphylococcus epidermidis
ITTE

SEQ ID NO: 1757087 - protein, 11 aa, Staphylococcus epidermidis
ITYDSGGYSIK

SEQ ID NO: 1757088 - protein, 8 aa, Staphylococcus epidermidis
ITYSTNNE

SEQ ID NO: 1757089 - protein, 12 aa, Staphylococcus epidermidis
IVGGKSPDSGHE

SEQ ID NO: 1757090 - protein, 11 aa, Staphylococcus epidermidis
KAAEKPGSEIQ

SEQ ID NO: 1757091 - protein, 6 aa, Staphylococcus epidermidis
KAAGAS

SEQ ID NO: 1757092 - protein, 7 aa, Staphylococcus epidermidis
KAAKDFK

SEQ ID NO: 1757093 - protein, 6 aa, Staphylococcus epidermidis
KAATQS

SEQ ID NO: 1757094 - protein, 7 aa, Staphylococcus epidermidis
KAELDQT

SEQ ID NO: 1757095 - protein, 4 aa, Staphylococcus epidermidis
KAFD

SEQ ID NO: 1757096 - protein, 13 aa, Staphylococcus epidermidis
KAGAAHTWIEHLG

SEQ ID NO: 1757097 - protein, 7 aa, Staphylococcus epidermidis
KAGNPDI

SEQ ID NO: 1757098 - protein, 9 aa, Staphylococcus epidermidis
KAGYKPGED

SEQ ID NO: 1757099 - protein, 5 aa, Staphylococcus epidermidis
KAGYT

SEQ ID NO: 1757100 - protein, 7 aa, Staphylococcus epidermidis
KAHNEPS

SEQ ID NO: 1757101 - protein, 4 aa, Staphylococcus epidermidis
KAHP

SEQ ID NO: 1757102 - protein, 7 aa, Staphylococcus epidermidis
KAIEETA

SEQ ID NO: 1757103 - protein, 7 aa, Staphylococcus epidermidis
KAIRTND

SEQ ID NO: 1757104 - protein, 17 aa, Staphylococcus epidermidis
KAKEKIAEEGYDPEYGA

SEQ ID NO: 1757105 - protein, 8 aa, Staphylococcus epidermidis
KAKEQGKK

SEQ ID NO: 1757106 - protein, 9 aa, Staphylococcus epidermidis
KAKGARSNI

SEQ ID NO: 1757107 - protein, 7 aa, Staphylococcus epidermidis
KAKPKIG

SEQ ID NO: 1757108 - protein, 9 aa, Staphylococcus epidermidis
KAKPSTLKD

SEQ ID NO: 1757109 - protein, 17 aa, Staphylococcus epidermidis
KAKYITGQTIHVNGGMY

SEQ ID NO: 1757110 - protein, 6 aa, Staphylococcus epidermidis
KALAEN

SEQ ID NO: 1757111 - protein, 7 aa, Staphylococcus epidermidis
KAMTGYQ

SEQ ID NO: 1757112 - protein, 13 aa, Staphylococcus epidermidis
KANDDGEPSGTAG

SEQ ID NO: 1757113 - protein, 6 aa, Staphylococcus epidermidis
KAPGKY

SEQ ID NO: 1757114 - protein, 9 aa, Staphylococcus epidermidis
KAPNTSSTI

SEQ ID NO: 1757115 - protein, 11 aa, Staphylococcus epidermidis
KAQKDKNTSRI

SEQ ID NO: 1757116 - protein, 8 aa, Staphylococcus epidermidis
KARDKKLG

SEQ ID NO: 1757117 - protein, 8 aa, Staphylococcus epidermidis
KAREVRDT

SEQ ID NO: 1757118 - protein, 7 aa, Staphylococcus epidermidis
KARTTAI

SEQ ID NO: 1757119 - protein, 7 aa, Staphylococcus epidermidis
KASESAG

SEQ ID NO: 1757120 - protein, 6 aa, Staphylococcus epidermidis
KAVEKG

SEQ ID NO: 1757121 - protein, 16 aa, Staphylococcus epidermidis
KCNEGDVVERKSKKNR

SEQ ID NO: 1757122 - protein, 5 aa, Staphylococcus epidermidis
KCRPI

SEQ ID NO: 1757123 - protein, 17 aa, Staphylococcus epidermidis
KDAAEKAKKDLSGVSQT

SEQ ID NO: 1757124 - protein, 6 aa, Staphylococcus epidermidis
KDADAA

SEQ ID NO: 1757125 - protein, 5 aa, Staphylococcus epidermidis
KDAMG

SEQ ID NO: 1757126 - protein, 6 aa, Staphylococcus epidermidis
KDANAS

SEQ ID NO: 1757127 - protein, 7 aa, Staphylococcus epidermidis
KDAVNTG

SEQ ID NO: 1757128 - protein, 4 aa, Staphylococcus epidermidis
KDCL

SEQ ID NO: 1757129 - protein, 10 aa, Staphylococcus epidermidis
KDDAKEVAQG

SEQ ID NO: 1757130 - protein, 6 aa, Staphylococcus epidermidis
KDDEFD

SEQ ID NO: 1757131 - protein, 9 aa, Staphylococcus epidermidis
KDDEKRNNI

SEQ ID NO: 1757132 - protein, 8 aa, Staphylococcus epidermidis
KDDPNARV

SEQ ID NO: 1757133 - protein, 8 aa, Staphylococcus epidermidis
KDEDIEST

SEQ ID NO: 1757134 - protein, 15 aa, Staphylococcus epidermidis
KDEGEVTASDITHDS

SEQ ID NO: 1757135 - protein, 8 aa, Staphylococcus epidermidis
KDEGGRHT

SEQ ID NO: 1757136 - protein, 21 aa, Staphylococcus epidermidis
KDEIQEAQKYYTQKRAKKHEN

SEQ ID NO: 1757137 - protein, 4 aa, Staphylococcus epidermidis
KDEL

SEQ ID NO: 1757138 - protein, 16 aa, Staphylococcus epidermidis
KDETDLGKEAKSYMDR

SEQ ID NO: 1757139 - protein, 6 aa, Staphylococcus epidermidis
KDFDNR

SEQ ID NO: 1757140 - protein, 8 aa, Staphylococcus epidermidis
KDGDPRAK

SEQ ID NO: 1757141 - protein, 10 aa, Staphylococcus epidermidis
KDGETALHPS

SEQ ID NO: 1757142 - protein, 7 aa, Staphylococcus epidermidis
KDGPDRI

SEQ ID NO: 1757143 - protein, 9 aa, Staphylococcus epidermidis
KDGTLDPVV

SEQ ID NO: 1757144 - protein, 7 aa, Staphylococcus epidermidis
KDGTREQ

SEQ ID NO: 1757145 - protein, 6 aa, Staphylococcus epidermidis
KDHLSA

SEQ ID NO: 1757146 - protein, 8 aa, Staphylococcus epidermidis
KDKSEDQL

SEQ ID NO: 1757147 - protein, 9 aa, Staphylococcus epidermidis
KDMQEDKEG

SEQ ID NO: 1757148 - protein, 7 aa, Staphylococcus epidermidis
KDQADKV

SEQ ID NO: 1757149 - protein, 5 aa, Staphylococcus epidermidis
KDQEA

SEQ ID NO: 1757150 - protein, 6 aa, Staphylococcus epidermidis
KDQIQG

SEQ ID NO: 1757151 - protein, 15 aa, Staphylococcus epidermidis
KDQNLSLNPTKISGA

SEQ ID NO: 1757152 - protein, 8 aa, Staphylococcus epidermidis
KDQSEVEK

SEQ ID NO: 1757153 - protein, 7 aa, Staphylococcus epidermidis
KDSALER

SEQ ID NO: 1757154 - protein, 6 aa, Staphylococcus epidermidis
KDSEID

SEQ ID NO: 1757155 - protein, 9 aa, Staphylococcus epidermidis
KDSHKRRSM

SEQ ID NO: 1757156 - protein, 6 aa, Staphylococcus epidermidis
KDSPII

SEQ ID NO: 1757157 - protein, 7 aa, Staphylococcus epidermidis
KDTEAAK

SEQ ID NO: 1757158 - protein, 7 aa, Staphylococcus epidermidis
KDTIENR

SEQ ID NO: 1757159 - protein, 6 aa, Staphylococcus epidermidis
KDVSPY

SEQ ID NO: 1757160 - protein, 8 aa, Staphylococcus epidermidis
KEANKDGY

SEQ ID NO: 1757161 - protein, 8 aa, Staphylococcus epidermidis
KEATGLGL

SEQ ID NO: 1757162 - protein, 7 aa, Staphylococcus epidermidis
KEDPEYT

SEQ ID NO: 1757163 - protein, 5 aa, Staphylococcus epidermidis
KEDVD

SEQ ID NO: 1757164 - protein, 8 aa, Staphylococcus epidermidis
KEEDQKEK

SEQ ID NO: 1757165 - protein, 6 aa, Staphylococcus epidermidis
KEEHNA

SEQ ID NO: 1757166 - protein, 7 aa, Staphylococcus epidermidis
KEETGAK

SEQ ID NO: 1757167 - protein, 12 aa, Staphylococcus epidermidis
KEFADKAAARFG

SEQ ID NO: 1757168 - protein, 6 aa, Staphylococcus epidermidis
KEGFLR

SEQ ID NO: 1757169 - protein, 6 aa, Staphylococcus epidermidis
KEGGVD

SEQ ID NO: 1757170 - protein, 5 aa, Staphylococcus epidermidis
KEGPR

SEQ ID NO: 1757171 - protein, 6 aa, Staphylococcus epidermidis
KEGQDI

SEQ ID NO: 1757172 - protein, 5 aa, Staphylococcus epidermidis
KEGTE

SEQ ID NO: 1757173 - protein, 8 aa, Staphylococcus epidermidis
KEIKPSDV

SEQ ID NO: 1757174 - protein, 7 aa, Staphylococcus epidermidis
KEISKPD

SEQ ID NO: 1757175 - protein, 7 aa, Staphylococcus epidermidis
KEKKIPR

SEQ ID NO: 1757176 - protein, 5 aa, Staphylococcus epidermidis
KELEE

SEQ ID NO: 1757177 - protein, 11 aa, Staphylococcus epidermidis
KELQPDIPTKS

SEQ ID NO: 1757178 - protein, 9 aa, Staphylococcus epidermidis
KELVDGAPK

SEQ ID NO: 1757179 - protein, 7 aa, Staphylococcus epidermidis
KENASSV

SEQ ID NO: 1757180 - protein, 9 aa, Staphylococcus epidermidis
KENFKKNHC

SEQ ID NO: 1757181 - protein, 8 aa, Staphylococcus epidermidis
KENGANTV

SEQ ID NO: 1757182 - protein, 7 aa, Staphylococcus epidermidis
KENGYAV

SEQ ID NO: 1757183 - protein, 10 aa, Staphylococcus epidermidis
KENPQIKEEI

SEQ ID NO: 1757184 - protein, 6 aa, Staphylococcus epidermidis
KENQTY

SEQ ID NO: 1757185 - protein, 9 aa, Staphylococcus epidermidis
KEPTPIQKD

SEQ ID NO: 1757186 - protein, 10 aa, Staphylococcus epidermidis
KEQEQTTKSG

SEQ ID NO: 1757187 - protein, 5 aa, Staphylococcus epidermidis
KEQGF

SEQ ID NO: 1757188 - protein, 9 aa, Staphylococcus epidermidis
KEQSQDNPI

SEQ ID NO: 1757189 - protein, 6 aa, Staphylococcus epidermidis
KESYTK

SEQ ID NO: 1757190 - protein, 10 aa, Staphylococcus epidermidis
KETFEPIEPG

SEQ ID NO: 1757191 - protein, 13 aa, Staphylococcus epidermidis
KEVEGTIRVHTVE

SEQ ID NO: 1757192 - protein, 9 aa, Staphylococcus epidermidis
KFEDGTEVT

SEQ ID NO: 1757193 - protein, 7 aa, Staphylococcus epidermidis
KFEGEGC

SEQ ID NO: 1757194 - protein, 10 aa, Staphylococcus epidermidis
KFGTTDGTIT

SEQ ID NO: 1757195 - protein, 5 aa, Staphylococcus epidermidis
KFKGA

SEQ ID NO: 1757196 - protein, 12 aa, Staphylococcus epidermidis
KFNTRDKNRFER

SEQ ID NO: 1757197 - protein, 17 aa, Staphylococcus epidermidis
KFPYAANGRALSLDDTN

SEQ ID NO: 1757198 - protein, 8 aa, Staphylococcus epidermidis
KFRSGDYT

SEQ ID NO: 1757199 - protein, 9 aa, Staphylococcus epidermidis
KGAFNEENP

SEQ ID NO: 1757200 - protein, 10 aa, Staphylococcus epidermidis
KGASKGEGLG

SEQ ID NO: 1757201 - protein, 19 aa, Staphylococcus epidermidis
KGAYPGKAAEERGQSESIA

SEQ ID NO: 1757202 - protein, 9 aa, Staphylococcus epidermidis
KGDAKSVSI

SEQ ID NO: 1757203 - protein, 8 aa, Staphylococcus epidermidis
KGDEARSI

SEQ ID NO: 1757204 - protein, 14 aa, Staphylococcus epidermidis
KGEEKTGGRTRPSL

SEQ ID NO: 1757205 - protein, 17 aa, Staphylococcus epidermidis
KGEETNRVEGFESGADD

SEQ ID NO: 1757206 - protein, 9 aa, Staphylococcus epidermidis
KGGATGGGY

SEQ ID NO: 1757207 - protein, 6 aa, Staphylococcus epidermidis
KGGINE

SEQ ID NO: 1757208 - protein, 8 aa, Staphylococcus epidermidis
KGGSEIEK

SEQ ID NO: 1757209 - protein, 9 aa, Staphylococcus epidermidis
KGGVGKTTI

SEQ ID NO: 1757210 - protein, 11 aa, Staphylococcus epidermidis
KGGVGKTTVAT

SEQ ID NO: 1757211 - protein, 5 aa, Staphylococcus epidermidis
KGIEP

SEQ ID NO: 1757212 - protein, 6 aa, Staphylococcus epidermidis
KGIGPK

SEQ ID NO: 1757213 - protein, 5 aa, Staphylococcus epidermidis
KGKNI

SEQ ID NO: 1757214 - protein, 6 aa, Staphylococcus epidermidis
KGKQVK

SEQ ID NO: 1757215 - protein, 7 aa, Staphylococcus epidermidis
KGKVPRP

SEQ ID NO: 1757216 - protein, 5 aa, Staphylococcus epidermidis
KGLRT

SEQ ID NO: 1757217 - protein, 9 aa, Staphylococcus epidermidis
KGLSAGRVQ

SEQ ID NO: 1757218 - protein, 7 aa, Staphylococcus epidermidis
KGNEVDY

SEQ ID NO: 1757219 - protein, 7 aa, Staphylococcus epidermidis
KGNKERI

SEQ ID NO: 1757220 - protein, 4 aa, Staphylococcus epidermidis
KGNL

SEQ ID NO: 1757221 - protein, 5 aa, Staphylococcus epidermidis
KGQAL

SEQ ID NO: 1757222 - protein, 7 aa, Staphylococcus epidermidis
KGQLSKS

SEQ ID NO: 1757223 - protein, 11 aa, Staphylococcus epidermidis
KGQMKQADRLN

SEQ ID NO: 1757224 - protein, 6 aa, Staphylococcus epidermidis
KGQTVI

SEQ ID NO: 1757225 - protein, 7 aa, Staphylococcus epidermidis
KGSPQIR

SEQ ID NO: 1757226 - protein, 7 aa, Staphylococcus epidermidis
KGSSNYP

SEQ ID NO: 1757227 - protein, 6 aa, Staphylococcus epidermidis
KGSTYY

SEQ ID NO: 1757228 - protein, 4 aa, Staphylococcus epidermidis
KGTE

SEQ ID NO: 1757229 - protein, 6 aa, Staphylococcus epidermidis
KGTEQK

SEQ ID NO: 1757230 - protein, 12 aa, Staphylococcus epidermidis
KGTGALQKGVQQ

SEQ ID NO: 1757231 - protein, 5 aa, Staphylococcus epidermidis
KGTGN

SEQ ID NO: 1757232 - protein, 8 aa, Staphylococcus epidermidis
KGTRMKSK

SEQ ID NO: 1757233 - protein, 15 aa, Staphylococcus epidermidis
KGVKTHPNDLKESNT

SEQ ID NO: 1757234 - protein, 7 aa, Staphylococcus epidermidis
KGVTDVD

SEQ ID NO: 1757235 - protein, 4 aa, Staphylococcus epidermidis
KGWG

SEQ ID NO: 1757236 - protein, 7 aa, Staphylococcus epidermidis
KHEDDFN

SEQ ID NO: 1757237 - protein, 9 aa, Staphylococcus epidermidis
KHEEGPSMG

SEQ ID NO: 1757238 - protein, 6 aa, Staphylococcus epidermidis
KHERNR

SEQ ID NO: 1757239 - protein, 23 aa, Staphylococcus epidermidis
KHIETPGSEITDTRGGSHNAPTR

SEQ ID NO: 1757240 - protein, 8 aa, Staphylococcus epidermidis
KHKKGQPV

SEQ ID NO: 1757241 - protein, 7 aa, Staphylococcus epidermidis
KHNEEEI

SEQ ID NO: 1757242 - protein, 7 aa, Staphylococcus epidermidis
KHPLTRT

SEQ ID NO: 1757243 - protein, 5 aa, Staphylococcus epidermidis
KHSKV

SEQ ID NO: 1757244 - protein, 8 aa, Staphylococcus epidermidis
KIASGGEL

SEQ ID NO: 1757245 - protein, 5 aa, Staphylococcus epidermidis
KIDGI

SEQ ID NO: 1757246 - protein, 10 aa, Staphylococcus epidermidis
KIEDDPSHPE

SEQ ID NO: 1757247 - protein, 17 aa, Staphylococcus epidermidis
KIGALTDRNGLRPGRYT

SEQ ID NO: 1757248 - protein, 7 aa, Staphylococcus epidermidis
KIGNSAR

SEQ ID NO: 1757249 - protein, 11 aa, Staphylococcus epidermidis
KIGYESEEAKD

SEQ ID NO: 1757250 - protein, 6 aa, Staphylococcus epidermidis
KIHASS

SEQ ID NO: 1757251 - protein, 10 aa, Staphylococcus epidermidis
KIRDTASSHA

SEQ ID NO: 1757252 - protein, 15 aa, Staphylococcus epidermidis
KIRPDGRKVDEIRPL

SEQ ID NO: 1757253 - protein, 5 aa, Staphylococcus epidermidis
KISSF

SEQ ID NO: 1757254 - protein, 10 aa, Staphylococcus epidermidis
KITEETGQSE

SEQ ID NO: 1757255 - protein, 6 aa, Staphylococcus epidermidis
KITPDA

SEQ ID NO: 1757256 - protein, 5 aa, Staphylococcus epidermidis
KKAGI

SEQ ID NO: 1757257 - protein, 11 aa, Staphylococcus epidermidis
KKAKELKEEHG

SEQ ID NO: 1757258 - protein, 8 aa, Staphylococcus epidermidis
KKAPYEQR

SEQ ID NO: 1757259 - protein, 8 aa, Staphylococcus epidermidis
KKATSNPR

SEQ ID NO: 1757260 - protein, 10 aa, Staphylococcus epidermidis
KKENGVDLSQ

SEQ ID NO: 1757261 - protein, 6 aa, Staphylococcus epidermidis
KKFGEE

SEQ ID NO: 1757262 - protein, 9 aa, Staphylococcus epidermidis
KKFSEKGSR

SEQ ID NO: 1757263 - protein, 15 aa, Staphylococcus epidermidis
KKGDLASRRNAAKTL

SEQ ID NO: 1757264 - protein, 9 aa, Staphylococcus epidermidis
KKGLDSLND

SEQ ID NO: 1757265 - protein, 7 aa, Staphylococcus epidermidis
KKGLGRK

SEQ ID NO: 1757266 - protein, 7 aa, Staphylococcus epidermidis
KKGPFAP

SEQ ID NO: 1757267 - protein, 9 aa, Staphylococcus epidermidis
KKGRTPNPD

SEQ ID NO: 1757268 - protein, 30 aa, Staphylococcus epidermidis
KKGVSSTKNGRDSESKRLGAKRADGQYVSG

SEQ ID NO: 1757269 - protein, 8 aa, Staphylococcus epidermidis
KKHAKKAK

SEQ ID NO: 1757270 - protein, 4 aa, Staphylococcus epidermidis
KKIP

SEQ ID NO: 1757271 - protein, 11 aa, Staphylococcus epidermidis
KKKSTQTTSNV

SEQ ID NO: 1757272 - protein, 6 aa, Staphylococcus epidermidis
KKMGQH

SEQ ID NO: 1757273 - protein, 6 aa, Staphylococcus epidermidis
KKNFAE

SEQ ID NO: 1757274 - protein, 7 aa, Staphylococcus epidermidis
KKNKQAV

SEQ ID NO: 1757275 - protein, 5 aa, Staphylococcus epidermidis
KKPNI

SEQ ID NO: 1757276 - protein, 17 aa, Staphylococcus epidermidis
KKQAQESVKAEAERAGQ

SEQ ID NO: 1757277 - protein, 5 aa, Staphylococcus epidermidis
KKQKF

SEQ ID NO: 1757278 - protein, 5 aa, Staphylococcus epidermidis
KKQQI

SEQ ID NO: 1757279 - protein, 7 aa, Staphylococcus epidermidis
KKREDNF

SEQ ID NO: 1757280 - protein, 9 aa, Staphylococcus epidermidis
KKRNEHDER

SEQ ID NO: 1757281 - protein, 9 aa, Staphylococcus epidermidis
KKTEEVDGY

SEQ ID NO: 1757282 - protein, 7 aa, Staphylococcus epidermidis
KKTKSRL

SEQ ID NO: 1757283 - protein, 8 aa, Staphylococcus epidermidis
KKTNSSVV

SEQ ID NO: 1757284 - protein, 6 aa, Staphylococcus epidermidis
KKTPYL

SEQ ID NO: 1757285 - protein, 10 aa, Staphylococcus epidermidis
KKTQGNYNNE

SEQ ID NO: 1757286 - protein, 6 aa, Staphylococcus epidermidis
KKVASG

SEQ ID NO: 1757287 - protein, 20 aa, Staphylococcus epidermidis
KKYHPDINKEEGADEKFKEI

SEQ ID NO: 1757288 - protein, 7 aa, Staphylococcus epidermidis
KKYKLDK

SEQ ID NO: 1757289 - protein, 16 aa, Staphylococcus epidermidis
KKYLTVQDSKQNDVPA

SEQ ID NO: 1757290 - protein, 6 aa, Staphylococcus epidermidis
KKYPQS

SEQ ID NO: 1757291 - protein, 7 aa, Staphylococcus epidermidis
KKYQNRD

SEQ ID NO: 1757292 - protein, 7 aa, Staphylococcus epidermidis
KLATTGG

SEQ ID NO: 1757293 - protein, 12 aa, Staphylococcus epidermidis
KLETDGKLLTGK

SEQ ID NO: 1757294 - protein, 8 aa, Staphylococcus epidermidis
KLMGQKSE

SEQ ID NO: 1757295 - protein, 8 aa, Staphylococcus epidermidis
KLRNQDDT

SEQ ID NO: 1757296 - protein, 6 aa, Staphylococcus epidermidis
KLTEPA

SEQ ID NO: 1757297 - protein, 14 aa, Staphylococcus epidermidis
KLTPAQSKNTDKNE

SEQ ID NO: 1757298 - protein, 15 aa, Staphylococcus epidermidis
KLYQREDDNPETVSN

SEQ ID NO: 1757299 - protein, 22 aa, Staphylococcus epidermidis
KMAQEQEKLKEERVAGTAGGGM

SEQ ID NO: 1757300 - protein, 4 aa, Staphylococcus epidermidis
KMEE

SEQ ID NO: 1757301 - protein, 7 aa, Staphylococcus epidermidis
KMEEGSL

SEQ ID NO: 1757302 - protein, 5 aa, Staphylococcus epidermidis
KMGRP

SEQ ID NO: 1757303 - protein, 12 aa, Staphylococcus epidermidis
KMRGKGKVTEAD

SEQ ID NO: 1757304 - protein, 18 aa, Staphylococcus epidermidis
KNAEDVAKLRGKSVEELY

SEQ ID NO: 1757305 - protein, 9 aa, Staphylococcus epidermidis
KNEKNFQPM

SEQ ID NO: 1757306 - protein, 17 aa, Staphylococcus epidermidis
KNELKTPEDAQKEANDF

SEQ ID NO: 1757307 - protein, 7 aa, Staphylococcus epidermidis
KNENEKL

SEQ ID NO: 1757308 - protein, 9 aa, Staphylococcus epidermidis
KNFGQGMSG

SEQ ID NO: 1757309 - protein, 9 aa, Staphylococcus epidermidis
KNGDTVAQS

SEQ ID NO: 1757310 - protein, 8 aa, Staphylococcus epidermidis
KNGNESNH

SEQ ID NO: 1757311 - protein, 11 aa, Staphylococcus epidermidis
KNIQGIDTEPV

SEQ ID NO: 1757312 - protein, 5 aa, Staphylococcus epidermidis
KNKDS

SEQ ID NO: 1757313 - protein, 5 aa, Staphylococcus epidermidis
KNKER

SEQ ID NO: 1757314 - protein, 6 aa, Staphylococcus epidermidis
KNNTNV

SEQ ID NO: 1757315 - protein, 4 aa, Staphylococcus epidermidis
KNNY

SEQ ID NO: 1757316 - protein, 8 aa, Staphylococcus epidermidis
KNPAGMNA

SEQ ID NO: 1757317 - protein, 7 aa, Staphylococcus epidermidis
KNPDETV

SEQ ID NO: 1757318 - protein, 6 aa, Staphylococcus epidermidis
KNPETI

SEQ ID NO: 1757319 - protein, 13 aa, Staphylococcus epidermidis
KNPRNKGVLDNGS

SEQ ID NO: 1757320 - protein, 9 aa, Staphylococcus epidermidis
KNRGINTQH

SEQ ID NO: 1757321 - protein, 9 aa, Staphylococcus epidermidis
KNTGDRPIQ

SEQ ID NO: 1757322 - protein, 5 aa, Staphylococcus epidermidis
KNTST

SEQ ID NO: 1757323 - protein, 17 aa, Staphylococcus epidermidis
KNTTVKVSGVSKEQVGA

SEQ ID NO: 1757324 - protein, 9 aa, Staphylococcus epidermidis
KNVTEGPSV

SEQ ID NO: 1757325 - protein, 8 aa, Staphylococcus epidermidis
KNYDSARN

SEQ ID NO: 1757326 - protein, 4 aa, Staphylococcus epidermidis
KNYQ

SEQ ID NO: 1757327 - protein, 7 aa, Staphylococcus epidermidis
KPEFSSA

SEQ ID NO: 1757328 - protein, 9 aa, Staphylococcus epidermidis
KPEHSRSNK

SEQ ID NO: 1757329 - protein, 5 aa, Staphylococcus epidermidis
KPEQI

SEQ ID NO: 1757330 - protein, 6 aa, Staphylococcus epidermidis
KPETLR

SEQ ID NO: 1757331 - protein, 19 aa, Staphylococcus epidermidis
KPFNKEKSIETVRGVGYVI

SEQ ID NO: 1757332 - protein, 7 aa, Staphylococcus epidermidis
KPFSPRE

SEQ ID NO: 1757333 - protein, 23 aa, Staphylococcus epidermidis
KPGKGGQLARSAGASSQVLGKEG

SEQ ID NO: 1757334 - protein, 6 aa, Staphylococcus epidermidis
KPHSYR

SEQ ID NO: 1757335 - protein, 8 aa, Staphylococcus epidermidis
KPKGIVST

SEQ ID NO: 1757336 - protein, 19 aa, Staphylococcus epidermidis
KPKKKRMGRYQGYTNKRRK

SEQ ID NO: 1757337 - protein, 13 aa, Staphylococcus epidermidis
KPLVTKAKKSVAT

SEQ ID NO: 1757338 - protein, 7 aa, Staphylococcus epidermidis
KPMDSEE

SEQ ID NO: 1757339 - protein, 6 aa, Staphylococcus epidermidis
KPRLTK

SEQ ID NO: 1757340 - protein, 8 aa, Staphylococcus epidermidis
KPSEETPF

SEQ ID NO: 1757341 - protein, 7 aa, Staphylococcus epidermidis
KPSEETT

SEQ ID NO: 1757342 - protein, 5 aa, Staphylococcus epidermidis
KPTPV

SEQ ID NO: 1757343 - protein, 10 aa, Staphylococcus epidermidis
KPVSKEGTER

SEQ ID NO: 1757344 - protein, 9 aa, Staphylococcus epidermidis
KQAEFKSNK

SEQ ID NO: 1757345 - protein, 10 aa, Staphylococcus epidermidis
KQDRSSNIEK

SEQ ID NO: 1757346 - protein, 8 aa, Staphylococcus epidermidis
KQESKDGT

SEQ ID NO: 1757347 - protein, 7 aa, Staphylococcus epidermidis
KQFSDDD

SEQ ID NO: 1757348 - protein, 9 aa, Staphylococcus epidermidis
KQIDHDKKE

SEQ ID NO: 1757349 - protein, 8 aa, Staphylococcus epidermidis
KQISKKQY

SEQ ID NO: 1757350 - protein, 6 aa, Staphylococcus epidermidis
KQKGAD

SEQ ID NO: 1757351 - protein, 6 aa, Staphylococcus epidermidis
KQLHGK

SEQ ID NO: 1757352 - protein, 5 aa, Staphylococcus epidermidis
KQPAS

SEQ ID NO: 1757353 - protein, 8 aa, Staphylococcus epidermidis
KQPNKEHM

SEQ ID NO: 1757354 - protein, 7 aa, Staphylococcus epidermidis
KQQRTQD

SEQ ID NO: 1757355 - protein, 6 aa, Staphylococcus epidermidis
KQRDRS

SEQ ID NO: 1757356 - protein, 7 aa, Staphylococcus epidermidis
KQRKKID

SEQ ID NO: 1757357 - protein, 6 aa, Staphylococcus epidermidis
KQSLSE

SEQ ID NO: 1757358 - protein, 7 aa, Staphylococcus epidermidis
KQSTSGI

SEQ ID NO: 1757359 - protein, 17 aa, Staphylococcus epidermidis
KQTRSDLKQLRNSGKVP

SEQ ID NO: 1757360 - protein, 4 aa, Staphylococcus epidermidis
KRED

SEQ ID NO: 1757361 - protein, 7 aa, Staphylococcus epidermidis
KREGQGC

SEQ ID NO: 1757362 - protein, 7 aa, Staphylococcus epidermidis
KRGSNSV

SEQ ID NO: 1757363 - protein, 13 aa, Staphylococcus epidermidis
KRIKSAGPSTPVE

SEQ ID NO: 1757364 - protein, 8 aa, Staphylococcus epidermidis
KRKKDSSM

SEQ ID NO: 1757365 - protein, 9 aa, Staphylococcus epidermidis
KRKPESKQE

SEQ ID NO: 1757366 - protein, 5 aa, Staphylococcus epidermidis
KRLAG

SEQ ID NO: 1757367 - protein, 7 aa, Staphylococcus epidermidis
KRLSHAT

SEQ ID NO: 1757368 - protein, 6 aa, Staphylococcus epidermidis
KRLSKE

SEQ ID NO: 1757369 - protein, 7 aa, Staphylococcus epidermidis
KRMKSKT

SEQ ID NO: 1757370 - protein, 7 aa, Staphylococcus epidermidis
KRNPREI

SEQ ID NO: 1757371 - protein, 5 aa, Staphylococcus epidermidis
KRQEL

SEQ ID NO: 1757372 - protein, 6 aa, Staphylococcus epidermidis
KRQGKQ

SEQ ID NO: 1757373 - protein, 7 aa, Staphylococcus epidermidis
KRQNPSP

SEQ ID NO: 1757374 - protein, 7 aa, Staphylococcus epidermidis
KRSKDVG

SEQ ID NO: 1757375 - protein, 10 aa, Staphylococcus epidermidis
KRSNSGTCYN

SEQ ID NO: 1757376 - protein, 7 aa, Staphylococcus epidermidis
KRSVHDE

SEQ ID NO: 1757377 - protein, 16 aa, Staphylococcus epidermidis
KRTSTRSFNASGVTEI

SEQ ID NO: 1757378 - protein, 16 aa, Staphylococcus epidermidis
KRVKRTGSGQLKRSRA

SEQ ID NO: 1757379 - protein, 6 aa, Staphylococcus epidermidis
KSAEHD

SEQ ID NO: 1757380 - protein, 6 aa, Staphylococcus epidermidis
KSAYES

SEQ ID NO: 1757381 - protein, 6 aa, Staphylococcus epidermidis
KSCEVP

SEQ ID NO: 1757382 - protein, 9 aa, Staphylococcus epidermidis
KSDDTVGRV

SEQ ID NO: 1757383 - protein, 6 aa, Staphylococcus epidermidis
KSGDIE

SEQ ID NO: 1757384 - protein, 5 aa, Staphylococcus epidermidis
KSGVD

SEQ ID NO: 1757385 - protein, 6 aa, Staphylococcus epidermidis
KSGYEA

SEQ ID NO: 1757386 - protein, 6 aa, Staphylococcus epidermidis
KSIPQG

SEQ ID NO: 1757387 - protein, 7 aa, Staphylococcus epidermidis
KSISNKG

SEQ ID NO: 1757388 - protein, 7 aa, Staphylococcus epidermidis
KSKEEYE

SEQ ID NO: 1757389 - protein, 4 aa, Staphylococcus epidermidis
KSKF

SEQ ID NO: 1757390 - protein, 6 aa, Staphylococcus epidermidis
KSKPEL

SEQ ID NO: 1757391 - protein, 6 aa, Staphylococcus epidermidis
KSMQIQ

SEQ ID NO: 1757392 - protein, 5 aa, Staphylococcus epidermidis
KSNAL

SEQ ID NO: 1757393 - protein, 5 aa, Staphylococcus epidermidis
KSREW

SEQ ID NO: 1757394 - protein, 9 aa, Staphylococcus epidermidis
KSSRDELTN

SEQ ID NO: 1757395 - protein, 5 aa, Staphylococcus epidermidis
KSSYM

SEQ ID NO: 1757396 - protein, 13 aa, Staphylococcus epidermidis
KSTEPYSKGMYIK

SEQ ID NO: 1757397 - protein, 8 aa, Staphylococcus epidermidis
KSTLGNTD

SEQ ID NO: 1757398 - protein, 11 aa, Staphylococcus epidermidis
KSVEKDSERIS

SEQ ID NO: 1757399 - protein, 5 aa, Staphylococcus epidermidis
KTAEV

SEQ ID NO: 1757400 - protein, 14 aa, Staphylococcus epidermidis
KTATNIEKYTSQGT

SEQ ID NO: 1757401 - protein, 7 aa, Staphylococcus epidermidis
KTDDVYD

SEQ ID NO: 1757402 - protein, 5 aa, Staphylococcus epidermidis
KTFST

SEQ ID NO: 1757403 - protein, 6 aa, Staphylococcus epidermidis
KTGSGA

SEQ ID NO: 1757404 - protein, 9 aa, Staphylococcus epidermidis
KTGVGTIAS

SEQ ID NO: 1757405 - protein, 12 aa, Staphylococcus epidermidis
KTGYDVNAKGRL

SEQ ID NO: 1757406 - protein, 9 aa, Staphylococcus epidermidis
KTHQGHGTD

SEQ ID NO: 1757407 - protein, 9 aa, Staphylococcus epidermidis
KTIPVRPGR

SEQ ID NO: 1757408 - protein, 6 aa, Staphylococcus epidermidis
KTISQI

SEQ ID NO: 1757409 - protein, 9 aa, Staphylococcus epidermidis
KTKTGYSTA

SEQ ID NO: 1757410 - protein, 5 aa, Staphylococcus epidermidis
KTLEQ

SEQ ID NO: 1757411 - protein, 4 aa, Staphylococcus epidermidis
KTMA

SEQ ID NO: 1757412 - protein, 8 aa, Staphylococcus epidermidis
KTNPNSRR

SEQ ID NO: 1757413 - protein, 11 aa, Staphylococcus epidermidis
KTNQERERVSD

SEQ ID NO: 1757414 - protein, 7 aa, Staphylococcus epidermidis
KTPPAPV

SEQ ID NO: 1757415 - protein, 6 aa, Staphylococcus epidermidis
KTPYLE

SEQ ID NO: 1757416 - protein, 7 aa, Staphylococcus epidermidis
KTSIRNT

SEQ ID NO: 1757417 - protein, 5 aa, Staphylococcus epidermidis
KTTDQ

SEQ ID NO: 1757418 - protein, 5 aa, Staphylococcus epidermidis
KTTGG

SEQ ID NO: 1757419 - protein, 5 aa, Staphylococcus epidermidis
KTTSL

SEQ ID NO: 1757420 - protein, 7 aa, Staphylococcus epidermidis
KTVQEAK

SEQ ID NO: 1757421 - protein, 5 aa, Staphylococcus epidermidis
KTYSV

SEQ ID NO: 1757422 - protein, 7 aa, Staphylococcus epidermidis
KVGRTTG

SEQ ID NO: 1757423 - protein, 8 aa, Staphylococcus epidermidis
KVKQTNSY

SEQ ID NO: 1757424 - protein, 9 aa, Staphylococcus epidermidis
KVRDAEPEV

SEQ ID NO: 1757425 - protein, 11 aa, Staphylococcus epidermidis
KVTAKAQNDYH

SEQ ID NO: 1757426 - protein, 8 aa, Staphylococcus epidermidis
KYAAKDPT

SEQ ID NO: 1757427 - protein, 8 aa, Staphylococcus epidermidis
KYAPSESK

SEQ ID NO: 1757428 - protein, 6 aa, Staphylococcus epidermidis
KYDKGL

SEQ ID NO: 1757429 - protein, 6 aa, Staphylococcus epidermidis
KYIDET

SEQ ID NO: 1757430 - protein, 10 aa, Staphylococcus epidermidis
KYPTTQIEAS

SEQ ID NO: 1757431 - protein, 7 aa, Staphylococcus epidermidis
KYRGEFE

SEQ ID NO: 1757432 - protein, 8 aa, Staphylococcus epidermidis
KYRGGAPI

SEQ ID NO: 1757433 - protein, 18 aa, Staphylococcus epidermidis
KYSEYKGGRQKTPPELSE

SEQ ID NO: 1757434 - protein, 18 aa, Staphylococcus epidermidis
KYSKKYKTHDENNSAKLG

SEQ ID NO: 1757435 - protein, 7 aa, Staphylococcus epidermidis
KYSSGMR

SEQ ID NO: 1757436 - protein, 7 aa, Staphylococcus epidermidis
LADIGSD

SEQ ID NO: 1757437 - protein, 12 aa, Staphylococcus epidermidis
LAENRKARHDYN

SEQ ID NO: 1757438 - protein, 8 aa, Staphylococcus epidermidis
LAGSEAAY

SEQ ID NO: 1757439 - protein, 8 aa, Staphylococcus epidermidis
LANDNEEK

SEQ ID NO: 1757440 - protein, 5 aa, Staphylococcus epidermidis
LANDP

SEQ ID NO: 1757441 - protein, 4 aa, Staphylococcus epidermidis
LAPY

SEQ ID NO: 1757442 - protein, 8 aa, Staphylococcus epidermidis
LAQKGEYD

SEQ ID NO: 1757443 - protein, 17 aa, Staphylococcus epidermidis
LAQNTSEGFTELPTPKE

SEQ ID NO: 1757444 - protein, 6 aa, Staphylococcus epidermidis
LASRGI

SEQ ID NO: 1757445 - protein, 4 aa, Staphylococcus epidermidis
LDDE

SEQ ID NO: 1757446 - protein, 8 aa, Staphylococcus epidermidis
LDDPDRYQ

SEQ ID NO: 1757447 - protein, 5 aa, Staphylococcus epidermidis
LDEAG

SEQ ID NO: 1757448 - protein, 4 aa, Staphylococcus epidermidis
LDES

SEQ ID NO: 1757449 - protein, 10 aa, Staphylococcus epidermidis
LDGDTRGGAA

SEQ ID NO: 1757450 - protein, 10 aa, Staphylococcus epidermidis
LDKSRGPAAS

SEQ ID NO: 1757451 - protein, 5 aa, Staphylococcus epidermidis
LDSNP

SEQ ID NO: 1757452 - protein, 4 aa, Staphylococcus epidermidis
LDTP

SEQ ID NO: 1757453 - protein, 22 aa, Staphylococcus epidermidis
LDTSGVDGRRQGRSLYGTKKPK

SEQ ID NO: 1757454 - protein, 8 aa, Staphylococcus epidermidis
LDTSTKNH

SEQ ID NO: 1757455 - protein, 4 aa, Staphylococcus epidermidis
LDYG

SEQ ID NO: 1757456 - protein, 8 aa, Staphylococcus epidermidis
LEDPYENM

SEQ ID NO: 1757457 - protein, 13 aa, Staphylococcus epidermidis
LEEEDPKEIEASK

SEQ ID NO: 1757458 - protein, 5 aa, Staphylococcus epidermidis
LEEEG

SEQ ID NO: 1757459 - protein, 10 aa, Staphylococcus epidermidis
LEENPKQPKL

SEQ ID NO: 1757460 - protein, 6 aa, Staphylococcus epidermidis
LEEPPA

SEQ ID NO: 1757461 - protein, 7 aa, Staphylococcus epidermidis
LEERGYN

SEQ ID NO: 1757462 - protein, 14 aa, Staphylococcus epidermidis
LEKAKNGEIQDDYI

SEQ ID NO: 1757463 - protein, 11 aa, Staphylococcus epidermidis
LEKDGTENTEQ

SEQ ID NO: 1757464 - protein, 4 aa, Staphylococcus epidermidis
LEKP

SEQ ID NO: 1757465 - protein, 15 aa, Staphylococcus epidermidis
LEKTKKKKEKPTKMV

SEQ ID NO: 1757466 - protein, 9 aa, Staphylococcus epidermidis
LEPGKLDEI

SEQ ID NO: 1757467 - protein, 5 aa, Staphylococcus epidermidis
LEPVE

SEQ ID NO: 1757468 - protein, 4 aa, Staphylococcus epidermidis
LEQG

SEQ ID NO: 1757469 - protein, 4 aa, Staphylococcus epidermidis
LEQP

SEQ ID NO: 1757470 - protein, 6 aa, Staphylococcus epidermidis
LEQRTN

SEQ ID NO: 1757471 - protein, 9 aa, Staphylococcus epidermidis
LERKKGSIA

SEQ ID NO: 1757472 - protein, 11 aa, Staphylococcus epidermidis
LERKTDKLKTY

SEQ ID NO: 1757473 - protein, 5 aa, Staphylococcus epidermidis
LETAV

SEQ ID NO: 1757474 - protein, 6 aa, Staphylococcus epidermidis
LETEDY

SEQ ID NO: 1757475 - protein, 4 aa, Staphylococcus epidermidis
LGAD

SEQ ID NO: 1757476 - protein, 8 aa, Staphylococcus epidermidis
LGAGKTTL

SEQ ID NO: 1757477 - protein, 7 aa, Staphylococcus epidermidis
LGAQPPF

SEQ ID NO: 1757478 - protein, 6 aa, Staphylococcus epidermidis
LGDKQG

SEQ ID NO: 1757479 - protein, 6 aa, Staphylococcus epidermidis
LGEMNP

SEQ ID NO: 1757480 - protein, 4 aa, Staphylococcus epidermidis
LGEN

SEQ ID NO: 1757481 - protein, 4 aa, Staphylococcus epidermidis
LGER

SEQ ID NO: 1757482 - protein, 4 aa, Staphylococcus epidermidis
LGFG

SEQ ID NO: 1757483 - protein, 11 aa, Staphylococcus epidermidis
LGGAQGQATEI

SEQ ID NO: 1757484 - protein, 6 aa, Staphylococcus epidermidis
LGGKSA

SEQ ID NO: 1757485 - protein, 7 aa, Staphylococcus epidermidis
LGGQPQL

SEQ ID NO: 1757486 - protein, 11 aa, Staphylococcus epidermidis
LGGRATTGKNV

SEQ ID NO: 1757487 - protein, 5 aa, Staphylococcus epidermidis
LGGTE

SEQ ID NO: 1757488 - protein, 16 aa, Staphylococcus epidermidis
LGGTGKEKGKRHPDIG

SEQ ID NO: 1757489 - protein, 4 aa, Staphylococcus epidermidis
LGGY

SEQ ID NO: 1757490 - protein, 4 aa, Staphylococcus epidermidis
LGKE

SEQ ID NO: 1757491 - protein, 11 aa, Staphylococcus epidermidis
LGNDAGITGAA

SEQ ID NO: 1757492 - protein, 16 aa, Staphylococcus epidermidis
LGPAYQAGTMAGNPLS

SEQ ID NO: 1757493 - protein, 7 aa, Staphylococcus epidermidis
LGPDPFP

SEQ ID NO: 1757494 - protein, 6 aa, Staphylococcus epidermidis
LGSGGL

SEQ ID NO: 1757495 - protein, 7 aa, Staphylococcus epidermidis
LGSGKTT

SEQ ID NO: 1757496 - protein, 4 aa, Staphylococcus epidermidis
LGSK

SEQ ID NO: 1757497 - protein, 6 aa, Staphylococcus epidermidis
LGSTPY

SEQ ID NO: 1757498 - protein, 11 aa, Staphylococcus epidermidis
LGTVGGQEDDV

SEQ ID NO: 1757499 - protein, 12 aa, Staphylococcus epidermidis
LIDKGKKEGHLS

SEQ ID NO: 1757500 - protein, 12 aa, Staphylococcus epidermidis
LIGPNGAGKSTL

SEQ ID NO: 1757501 - protein, 6 aa, Staphylococcus epidermidis
LITTTE

SEQ ID NO: 1757502 - protein, 9 aa, Staphylococcus epidermidis
LKAKGDYEA

SEQ ID NO: 1757503 - protein, 6 aa, Staphylococcus epidermidis
LKEASV

SEQ ID NO: 1757504 - protein, 5 aa, Staphylococcus epidermidis
LKEKE

SEQ ID NO: 1757505 - protein, 13 aa, Staphylococcus epidermidis
LKETGTGDTLCGE

SEQ ID NO: 1757506 - protein, 8 aa, Staphylococcus epidermidis
LKNGNTEL

SEQ ID NO: 1757507 - protein, 6 aa, Staphylococcus epidermidis
LKPEDT

SEQ ID NO: 1757508 - protein, 7 aa, Staphylococcus epidermidis
LKPEKDG

SEQ ID NO: 1757509 - protein, 5 aa, Staphylococcus epidermidis
LKSGR

SEQ ID NO: 1757510 - protein, 14 aa, Staphylococcus epidermidis
LKSRIDSLATQEED

SEQ ID NO: 1757511 - protein, 8 aa, Staphylococcus epidermidis
LNAGEGRV

SEQ ID NO: 1757512 - protein, 8 aa, Staphylococcus epidermidis
LNDVAPAR

SEQ ID NO: 1757513 - protein, 8 aa, Staphylococcus epidermidis
LNEPERVA

SEQ ID NO: 1757514 - protein, 5 aa, Staphylococcus epidermidis
LNEPN

SEQ ID NO: 1757515 - protein, 4 aa, Staphylococcus epidermidis
LNER

SEQ ID NO: 1757516 - protein, 9 aa, Staphylococcus epidermidis
LNETAEERL

SEQ ID NO: 1757517 - protein, 7 aa, Staphylococcus epidermidis
LNPDEGR

SEQ ID NO: 1757518 - protein, 14 aa, Staphylococcus epidermidis
LNPKDGKPVVTPSQ

SEQ ID NO: 1757519 - protein, 4 aa, Staphylococcus epidermidis
LNQE

SEQ ID NO: 1757520 - protein, 6 aa, Staphylococcus epidermidis
LNQNDK

SEQ ID NO: 1757521 - protein, 8 aa, Staphylococcus epidermidis
LNTSERYH

SEQ ID NO: 1757522 - protein, 7 aa, Staphylococcus epidermidis
LPASNIK

SEQ ID NO: 1757523 - protein, 5 aa, Staphylococcus epidermidis
LPDGR

SEQ ID NO: 1757524 - protein, 8 aa, Staphylococcus epidermidis
LPEDYPEN

SEQ ID NO: 1757525 - protein, 11 aa, Staphylococcus epidermidis
LPEGQMGNSEV

SEQ ID NO: 1757526 - protein, 4 aa, Staphylococcus epidermidis
LPGA

SEQ ID NO: 1757527 - protein, 9 aa, Staphylococcus epidermidis
LPGDEAGVK

SEQ ID NO: 1757528 - protein, 8 aa, Staphylococcus epidermidis
LPGNAQSI

SEQ ID NO: 1757529 - protein, 10 aa, Staphylococcus epidermidis
LPHPGFPTDM

SEQ ID NO: 1757530 - protein, 4 aa, Staphylococcus epidermidis
LPKD

SEQ ID NO: 1757531 - protein, 8 aa, Staphylococcus epidermidis
LPKKPAAL

SEQ ID NO: 1757532 - protein, 9 aa, Staphylococcus epidermidis
LPMTKKDAR

SEQ ID NO: 1757533 - protein, 7 aa, Staphylococcus epidermidis
LPNEDLG

SEQ ID NO: 1757534 - protein, 8 aa, Staphylococcus epidermidis
LPPASPQI

SEQ ID NO: 1757535 - protein, 6 aa, Staphylococcus epidermidis
LPQKGN

SEQ ID NO: 1757536 - protein, 11 aa, Staphylococcus epidermidis
LPRDSSPTRLT

SEQ ID NO: 1757537 - protein, 5 aa, Staphylococcus epidermidis
LPSEE

SEQ ID NO: 1757538 - protein, 4 aa, Staphylococcus epidermidis
LPSL

SEQ ID NO: 1757539 - protein, 26 aa, Staphylococcus epidermidis
LPVRGQKTKNNARTRKGPVKTVANKK

SEQ ID NO: 1757540 - protein, 5 aa, Staphylococcus epidermidis
LPYDA

SEQ ID NO: 1757541 - protein, 11 aa, Staphylococcus epidermidis
LQEGKDDSLEG

SEQ ID NO: 1757542 - protein, 11 aa, Staphylococcus epidermidis
LQGKPITTELT

SEQ ID NO: 1757543 - protein, 5 aa, Staphylococcus epidermidis
LQGRK

SEQ ID NO: 1757544 - protein, 10 aa, Staphylococcus epidermidis
LQPAAGAHGE

SEQ ID NO: 1757545 - protein, 14 aa, Staphylococcus epidermidis
LQQSSYKLTPQREA

SEQ ID NO: 1757546 - protein, 10 aa, Staphylococcus epidermidis
LRADRQPEFT

SEQ ID NO: 1757547 - protein, 5 aa, Staphylococcus epidermidis
LREAG

SEQ ID NO: 1757548 - protein, 6 aa, Staphylococcus epidermidis
LRKKGV

SEQ ID NO: 1757549 - protein, 5 aa, Staphylococcus epidermidis
LRPLP

SEQ ID NO: 1757550 - protein, 16 aa, Staphylococcus epidermidis
LRPYGQKEFGTKTELK

SEQ ID NO: 1757551 - protein, 5 aa, Staphylococcus epidermidis
LRQAG

SEQ ID NO: 1757552 - protein, 8 aa, Staphylococcus epidermidis
LRSETDER

SEQ ID NO: 1757553 - protein, 11 aa, Staphylococcus epidermidis
LRSNTQGRGTY

SEQ ID NO: 1757554 - protein, 12 aa, Staphylococcus epidermidis
LSDEDKQTVERA

SEQ ID NO: 1757555 - protein, 4 aa, Staphylococcus epidermidis
LSDG

SEQ ID NO: 1757556 - protein, 7 aa, Staphylococcus epidermidis
LSEGTTS

SEQ ID NO: 1757557 - protein, 15 aa, Staphylococcus epidermidis
LSEQTEKLKELNNGE

SEQ ID NO: 1757558 - protein, 6 aa, Staphylococcus epidermidis
LSEVET

SEQ ID NO: 1757559 - protein, 6 aa, Staphylococcus epidermidis
LSGDGI

SEQ ID NO: 1757560 - protein, 5 aa, Staphylococcus epidermidis
LSGGQ

SEQ ID NO: 1757561 - protein, 5 aa, Staphylococcus epidermidis
LSGKN

SEQ ID NO: 1757562 - protein, 12 aa, Staphylococcus epidermidis
LSGPAKERIENS

SEQ ID NO: 1757563 - protein, 9 aa, Staphylococcus epidermidis
LSGSDANDG

SEQ ID NO: 1757564 - protein, 9 aa, Staphylococcus epidermidis
LSGSGKSSL

SEQ ID NO: 1757565 - protein, 29 aa, Staphylococcus epidermidis
LSGTGKELEKRPYAPGQHGPNQRKKLSEY

SEQ ID NO: 1757566 - protein, 7 aa, Staphylococcus epidermidis
LSKVGGK

SEQ ID NO: 1757567 - protein, 15 aa, Staphylococcus epidermidis
LSNNAEKVTTPGKKN

SEQ ID NO: 1757568 - protein, 19 aa, Staphylococcus epidermidis
LSNRGGKGIKTATITERNG

SEQ ID NO: 1757569 - protein, 9 aa, Staphylococcus epidermidis
LSPKKNAQL

SEQ ID NO: 1757570 - protein, 8 aa, Staphylococcus epidermidis
LSPSAKAT

SEQ ID NO: 1757571 - protein, 5 aa, Staphylococcus epidermidis
LSPSQ

SEQ ID NO: 1757572 - protein, 4 aa, Staphylococcus epidermidis
LSPT

SEQ ID NO: 1757573 - protein, 5 aa, Staphylococcus epidermidis
LSQLS

SEQ ID NO: 1757574 - protein, 4 aa, Staphylococcus epidermidis
LSRS

SEQ ID NO: 1757575 - protein, 6 aa, Staphylococcus epidermidis
LSTQED

SEQ ID NO: 1757576 - protein, 4 aa, Staphylococcus epidermidis
LTDD

SEQ ID NO: 1757577 - protein, 7 aa, Staphylococcus epidermidis
LTDREEN

SEQ ID NO: 1757578 - protein, 9 aa, Staphylococcus epidermidis
LTDSATAGF

SEQ ID NO: 1757579 - protein, 9 aa, Staphylococcus epidermidis
LTEERRKEL

SEQ ID NO: 1757580 - protein, 11 aa, Staphylococcus epidermidis
LTEQGADKAER

SEQ ID NO: 1757581 - protein, 6 aa, Staphylococcus epidermidis
LTGGVE

SEQ ID NO: 1757582 - protein, 5 aa, Staphylococcus epidermidis
LTKDQ

SEQ ID NO: 1757583 - protein, 7 aa, Staphylococcus epidermidis
LTNKGEK

SEQ ID NO: 1757584 - protein, 10 aa, Staphylococcus epidermidis
LVTESDGRTW

SEQ ID NO: 1757585 - protein, 7 aa, Staphylococcus epidermidis
MAEQDGQ

SEQ ID NO: 1757586 - protein, 17 aa, Staphylococcus epidermidis
MAGRGTDIKLGDGVEEL

SEQ ID NO: 1757587 - protein, 11 aa, Staphylococcus epidermidis
MARQKDKTAEM

SEQ ID NO: 1757588 - protein, 6 aa, Staphylococcus epidermidis
MDNHSA

SEQ ID NO: 1757589 - protein, 6 aa, Staphylococcus epidermidis
MDPKHR

SEQ ID NO: 1757590 - protein, 10 aa, Staphylococcus epidermidis
MEDPKQTKGM

SEQ ID NO: 1757591 - protein, 12 aa, Staphylococcus epidermidis
MEESDVPDPYYT

SEQ ID NO: 1757592 - protein, 4 aa, Staphylococcus epidermidis
MEET

SEQ ID NO: 1757593 - protein, 4 aa, Staphylococcus epidermidis
MEGL

SEQ ID NO: 1757594 - protein, 7 aa, Staphylococcus epidermidis
MEKDGNY

SEQ ID NO: 1757595 - protein, 12 aa, Staphylococcus epidermidis
MGGGTGTGAAPV

SEQ ID NO: 1757596 - protein, 4 aa, Staphylococcus epidermidis
MGGK

SEQ ID NO: 1757597 - protein, 5 aa, Staphylococcus epidermidis
MKEEP

SEQ ID NO: 1757598 - protein, 8 aa, Staphylococcus epidermidis
MNNNPNEF

SEQ ID NO: 1757599 - protein, 5 aa, Staphylococcus epidermidis
MNPEH

SEQ ID NO: 1757600 - protein, 6 aa, Staphylococcus epidermidis
MNPETR

SEQ ID NO: 1757601 - protein, 11 aa, Staphylococcus epidermidis
MNPTPTDKGRR

SEQ ID NO: 1757602 - protein, 9 aa, Staphylococcus epidermidis
MPDITKDKY

SEQ ID NO: 1757603 - protein, 14 aa, Staphylococcus epidermidis
MPGGQMANTEEVEN

SEQ ID NO: 1757604 - protein, 8 aa, Staphylococcus epidermidis
MPPGESGL

SEQ ID NO: 1757605 - protein, 6 aa, Staphylococcus epidermidis
MPREKQ

SEQ ID NO: 1757606 - protein, 7 aa, Staphylococcus epidermidis
MPSPGKI

SEQ ID NO: 1757607 - protein, 7 aa, Staphylococcus epidermidis
MQGEPVE

SEQ ID NO: 1757608 - protein, 4 aa, Staphylococcus epidermidis
MQKS

SEQ ID NO: 1757609 - protein, 6 aa, Staphylococcus epidermidis
MREAET

SEQ ID NO: 1757610 - protein, 4 aa, Staphylococcus epidermidis
MREQ

SEQ ID NO: 1757611 - protein, 5 aa, Staphylococcus epidermidis
MRQEI

SEQ ID NO: 1757612 - protein, 12 aa, Staphylococcus epidermidis
MRSRKYEKEGQT

SEQ ID NO: 1757613 - protein, 5 aa, Staphylococcus epidermidis
MSDKQ

SEQ ID NO: 1757614 - protein, 4 aa, Staphylococcus epidermidis
MSEF

SEQ ID NO: 1757615 - protein, 7 aa, Staphylococcus epidermidis
MSGAGKS

SEQ ID NO: 1757616 - protein, 4 aa, Staphylococcus epidermidis
MSNK

SEQ ID NO: 1757617 - protein, 6 aa, Staphylococcus epidermidis
MSNQGS

SEQ ID NO: 1757618 - protein, 6 aa, Staphylococcus epidermidis
MSQERR

SEQ ID NO: 1757619 - protein, 8 aa, Staphylococcus epidermidis
MSTKNGRK

SEQ ID NO: 1757620 - protein, 14 aa, Staphylococcus epidermidis
MTPKERSNPETLNV

SEQ ID NO: 1757621 - protein, 13 aa, Staphylococcus epidermidis
MTQQEAETAFGNG

SEQ ID NO: 1757622 - protein, 11 aa, Staphylococcus epidermidis
NADGIGRDAST

SEQ ID NO: 1757623 - protein, 8 aa, Staphylococcus epidermidis
NADTDGLA

SEQ ID NO: 1757624 - protein, 8 aa, Staphylococcus epidermidis
NAEADAAN

SEQ ID NO: 1757625 - protein, 5 aa, Staphylococcus epidermidis
NAEQE

SEQ ID NO: 1757626 - protein, 4 aa, Staphylococcus epidermidis
NAHP

SEQ ID NO: 1757627 - protein, 10 aa, Staphylococcus epidermidis
NAISKGKQSH

SEQ ID NO: 1757628 - protein, 4 aa, Staphylococcus epidermidis
NAKM

SEQ ID NO: 1757629 - protein, 9 aa, Staphylococcus epidermidis
NAKQPKEVA

SEQ ID NO: 1757630 - protein, 9 aa, Staphylococcus epidermidis
NAKREEGQE

SEQ ID NO: 1757631 - protein, 4 aa, Staphylococcus epidermidis
NALN

SEQ ID NO: 1757632 - protein, 5 aa, Staphylococcus epidermidis
NAMPG

SEQ ID NO: 1757633 - protein, 11 aa, Staphylococcus epidermidis
NAPEEKERGIT

SEQ ID NO: 1757634 - protein, 4 aa, Staphylococcus epidermidis
NAQE

SEQ ID NO: 1757635 - protein, 5 aa, Staphylococcus epidermidis
NAQSR

SEQ ID NO: 1757636 - protein, 7 aa, Staphylococcus epidermidis
NARGDAN

SEQ ID NO: 1757637 - protein, 23 aa, Staphylococcus epidermidis
NASVAGATGGCQAEVGSASAMAA

SEQ ID NO: 1757638 - protein, 13 aa, Staphylococcus epidermidis
NATPGGVVKKGDV

SEQ ID NO: 1757639 - protein, 5 aa, Staphylococcus epidermidis
NAVGG

SEQ ID NO: 1757640 - protein, 11 aa, Staphylococcus epidermidis
NAVGYKNYPDN

SEQ ID NO: 1757641 - protein, 8 aa, Staphylococcus epidermidis
NAVPPATG

SEQ ID NO: 1757642 - protein, 6 aa, Staphylococcus epidermidis
NCDPDE

SEQ ID NO: 1757643 - protein, 5 aa, Staphylococcus epidermidis
NCDRD

SEQ ID NO: 1757644 - protein, 5 aa, Staphylococcus epidermidis
NDDAI

SEQ ID NO: 1757645 - protein, 8 aa, Staphylococcus epidermidis
NDDSNRAL

SEQ ID NO: 1757646 - protein, 5 aa, Staphylococcus epidermidis
NDEQL

SEQ ID NO: 1757647 - protein, 7 aa, Staphylococcus epidermidis
NDGYDAS

SEQ ID NO: 1757648 - protein, 16 aa, Staphylococcus epidermidis
NDKSQAKILVRLNGDQ

SEQ ID NO: 1757649 - protein, 6 aa, Staphylococcus epidermidis
NDLKEG

SEQ ID NO: 1757650 - protein, 5 aa, Staphylococcus epidermidis
NDNGW

SEQ ID NO: 1757651 - protein, 10 aa, Staphylococcus epidermidis
NDTGNKYSPT

SEQ ID NO: 1757652 - protein, 6 aa, Staphylococcus epidermidis
NDTKYG

SEQ ID NO: 1757653 - protein, 11 aa, Staphylococcus epidermidis
NDYPETTWPGE

SEQ ID NO: 1757654 - protein, 7 aa, Staphylococcus epidermidis
NEDDQKW

SEQ ID NO: 1757655 - protein, 6 aa, Staphylococcus epidermidis
NEDPER

SEQ ID NO: 1757656 - protein, 4 aa, Staphylococcus epidermidis
NEEE

SEQ ID NO: 1757657 - protein, 5 aa, Staphylococcus epidermidis
NEESI

SEQ ID NO: 1757658 - protein, 11 aa, Staphylococcus epidermidis
NEFHNKKPYYE

SEQ ID NO: 1757659 - protein, 8 aa, Staphylococcus epidermidis
NEGANMAA

SEQ ID NO: 1757660 - protein, 11 aa, Staphylococcus epidermidis
NEGKQTYRLDG

SEQ ID NO: 1757661 - protein, 4 aa, Staphylococcus epidermidis
NEGV

SEQ ID NO: 1757662 - protein, 12 aa, Staphylococcus epidermidis
NENEAKKSRLDS

SEQ ID NO: 1757663 - protein, 7 aa, Staphylococcus epidermidis
NEPPGAR

SEQ ID NO: 1757664 - protein, 6 aa, Staphylococcus epidermidis
NEPTAA

SEQ ID NO: 1757665 - protein, 4 aa, Staphylococcus epidermidis
NEQF

SEQ ID NO: 1757666 - protein, 12 aa, Staphylococcus epidermidis
NEREGSVTAQRA

SEQ ID NO: 1757667 - protein, 4 aa, Staphylococcus epidermidis
NESL

SEQ ID NO: 1757668 - protein, 9 aa, Staphylococcus epidermidis
NESTSDTIP

SEQ ID NO: 1757669 - protein, 7 aa, Staphylococcus epidermidis
NESYEPR

SEQ ID NO: 1757670 - protein, 6 aa, Staphylococcus epidermidis
NETQSK

SEQ ID NO: 1757671 - protein, 7 aa, Staphylococcus epidermidis
NETTNNS

SEQ ID NO: 1757672 - protein, 6 aa, Staphylococcus epidermidis
NETVEA

SEQ ID NO: 1757673 - protein, 7 aa, Staphylococcus epidermidis
NGDASLG

SEQ ID NO: 1757674 - protein, 7 aa, Staphylococcus epidermidis
NGDKKTS

SEQ ID NO: 1757675 - protein, 7 aa, Staphylococcus epidermidis
NGDRARK

SEQ ID NO: 1757676 - protein, 14 aa, Staphylococcus epidermidis
NGEAAMAGDGQVTL

SEQ ID NO: 1757677 - protein, 15 aa, Staphylococcus epidermidis
NGEEVKMSKRTGNAI

SEQ ID NO: 1757678 - protein, 7 aa, Staphylococcus epidermidis
NGGGCTG

SEQ ID NO: 1757679 - protein, 6 aa, Staphylococcus epidermidis
NGGPVG

SEQ ID NO: 1757680 - protein, 5 aa, Staphylococcus epidermidis
NGLKG

SEQ ID NO: 1757681 - protein, 4 aa, Staphylococcus epidermidis
NGPE

SEQ ID NO: 1757682 - protein, 12 aa, Staphylococcus epidermidis
NGRWAKKRKMPR

SEQ ID NO: 1757683 - protein, 10 aa, Staphylococcus epidermidis
NGSGKSTLSN

SEQ ID NO: 1757684 - protein, 8 aa, Staphylococcus epidermidis
NGSGNVRA

SEQ ID NO: 1757685 - protein, 7 aa, Staphylococcus epidermidis
NGTATDY

SEQ ID NO: 1757686 - protein, 7 aa, Staphylococcus epidermidis
NGTGKST

SEQ ID NO: 1757687 - protein, 9 aa, Staphylococcus epidermidis
NGTGTALSA

SEQ ID NO: 1757688 - protein, 5 aa, Staphylococcus epidermidis
NGYEK

SEQ ID NO: 1757689 - protein, 7 aa, Staphylococcus epidermidis
NGYYADT

SEQ ID NO: 1757690 - protein, 5 aa, Staphylococcus epidermidis
NHDTP

SEQ ID NO: 1757691 - protein, 7 aa, Staphylococcus epidermidis
NHETGKE

SEQ ID NO: 1757692 - protein, 7 aa, Staphylococcus epidermidis
NIEAGGS

SEQ ID NO: 1757693 - protein, 5 aa, Staphylococcus epidermidis
NIENE

SEQ ID NO: 1757694 - protein, 8 aa, Staphylococcus epidermidis
NIGSAGGQ

SEQ ID NO: 1757695 - protein, 4 aa, Staphylococcus epidermidis
NIGT

SEQ ID NO: 1757696 - protein, 12 aa, Staphylococcus epidermidis
NIKNAKSKIERM

SEQ ID NO: 1757697 - protein, 6 aa, Staphylococcus epidermidis
NIPPHN

SEQ ID NO: 1757698 - protein, 5 aa, Staphylococcus epidermidis
NIQTL

SEQ ID NO: 1757699 - protein, 6 aa, Staphylococcus epidermidis
NKAKNI

SEQ ID NO: 1757700 - protein, 7 aa, Staphylococcus epidermidis
NKASSPV

SEQ ID NO: 1757701 - protein, 8 aa, Staphylococcus epidermidis
NKDYNDLR

SEQ ID NO: 1757702 - protein, 7 aa, Staphylococcus epidermidis
NKEVKED

SEQ ID NO: 1757703 - protein, 8 aa, Staphylococcus epidermidis
NKGRGYAL

SEQ ID NO: 1757704 - protein, 7 aa, Staphylococcus epidermidis
NKHQGRD

SEQ ID NO: 1757705 - protein, 4 aa, Staphylococcus epidermidis
NKKP

SEQ ID NO: 1757706 - protein, 10 aa, Staphylococcus epidermidis
NKLSGGQQQR

SEQ ID NO: 1757707 - protein, 5 aa, Staphylococcus epidermidis
NKNFG

SEQ ID NO: 1757708 - protein, 11 aa, Staphylococcus epidermidis
NKNTKQKRQLR

SEQ ID NO: 1757709 - protein, 4 aa, Staphylococcus epidermidis
NKPI

SEQ ID NO: 1757710 - protein, 6 aa, Staphylococcus epidermidis
NKRPDY

SEQ ID NO: 1757711 - protein, 7 aa, Staphylococcus epidermidis
NKRSSGK

SEQ ID NO: 1757712 - protein, 8 aa, Staphylococcus epidermidis
NKSIEDGE

SEQ ID NO: 1757713 - protein, 7 aa, Staphylococcus epidermidis
NKSPYDG

SEQ ID NO: 1757714 - protein, 16 aa, Staphylococcus epidermidis
NKSRHISSLSGGETFQ

SEQ ID NO: 1757715 - protein, 5 aa, Staphylococcus epidermidis
NKTGY

SEQ ID NO: 1757716 - protein, 7 aa, Staphylococcus epidermidis
NKTNQRG

SEQ ID NO: 1757717 - protein, 11 aa, Staphylococcus epidermidis
NKVTYTPHVDT

SEQ ID NO: 1757718 - protein, 12 aa, Staphylococcus epidermidis
NKYGNTSAASIP

SEQ ID NO: 1757719 - protein, 10 aa, Staphylococcus epidermidis
NLDEEQGKEV

SEQ ID NO: 1757720 - protein, 6 aa, Staphylococcus epidermidis
NLEESN

SEQ ID NO: 1757721 - protein, 7 aa, Staphylococcus epidermidis
NLEGEST

SEQ ID NO: 1757722 - protein, 13 aa, Staphylococcus epidermidis
NLENGNPEVHPGP

SEQ ID NO: 1757723 - protein, 5 aa, Staphylococcus epidermidis
NLGPL

SEQ ID NO: 1757724 - protein, 4 aa, Staphylococcus epidermidis
NLNE

SEQ ID NO: 1757725 - protein, 11 aa, Staphylococcus epidermidis
NLQKSGRITGA

SEQ ID NO: 1757726 - protein, 5 aa, Staphylococcus epidermidis
NLSEP

SEQ ID NO: 1757727 - protein, 14 aa, Staphylococcus epidermidis
NMARTSQQPGKTQT

SEQ ID NO: 1757728 - protein, 4 aa, Staphylococcus epidermidis
NMRD

SEQ ID NO: 1757729 - protein, 4 aa, Staphylococcus epidermidis
NNAG

SEQ ID NO: 1757730 - protein, 8 aa, Staphylococcus epidermidis
NNAGTGHS

SEQ ID NO: 1757731 - protein, 7 aa, Staphylococcus epidermidis
NNEQRDV

SEQ ID NO: 1757732 - protein, 9 aa, Staphylococcus epidermidis
NNETNHANF

SEQ ID NO: 1757733 - protein, 7 aa, Staphylococcus epidermidis
NNKDRIK

SEQ ID NO: 1757734 - protein, 4 aa, Staphylococcus epidermidis
NNLK

SEQ ID NO: 1757735 - protein, 8 aa, Staphylococcus epidermidis
NNNNGARF

SEQ ID NO: 1757736 - protein, 7 aa, Staphylococcus epidermidis
NNPTCGD

SEQ ID NO: 1757737 - protein, 5 aa, Staphylococcus epidermidis
NPATI

SEQ ID NO: 1757738 - protein, 5 aa, Staphylococcus epidermidis
NPAYE

SEQ ID NO: 1757739 - protein, 10 aa, Staphylococcus epidermidis
NPETTPGGRA

SEQ ID NO: 1757740 - protein, 8 aa, Staphylococcus epidermidis
NPKRDDFP

SEQ ID NO: 1757741 - protein, 5 aa, Staphylococcus epidermidis
NPLAE

SEQ ID NO: 1757742 - protein, 8 aa, Staphylococcus epidermidis
NPRSSRTV

SEQ ID NO: 1757743 - protein, 9 aa, Staphylococcus epidermidis
NPSTQQRDA

SEQ ID NO: 1757744 - protein, 7 aa, Staphylococcus epidermidis
NPTPKTV

SEQ ID NO: 1757745 - protein, 12 aa, Staphylococcus epidermidis
NPYFSTDTTAAL

SEQ ID NO: 1757746 - protein, 11 aa, Staphylococcus epidermidis
NQITEDNAHDI

SEQ ID NO: 1757747 - protein, 5 aa, Staphylococcus epidermidis
NQKIN

SEQ ID NO: 1757748 - protein, 13 aa, Staphylococcus epidermidis
NQNERSQIKNREA

SEQ ID NO: 1757749 - protein, 7 aa, Staphylococcus epidermidis
NQNTIEE

SEQ ID NO: 1757750 - protein, 5 aa, Staphylococcus epidermidis
NQPGI

SEQ ID NO: 1757751 - protein, 5 aa, Staphylococcus epidermidis
NQSEW

SEQ ID NO: 1757752 - protein, 10 aa, Staphylococcus epidermidis
NQSGGFKTIS

SEQ ID NO: 1757753 - protein, 5 aa, Staphylococcus epidermidis
NRDEI

SEQ ID NO: 1757754 - protein, 13 aa, Staphylococcus epidermidis
NREEGDDTLSPGV

SEQ ID NO: 1757755 - protein, 6 aa, Staphylococcus epidermidis
NREGRR

SEQ ID NO: 1757756 - protein, 7 aa, Staphylococcus epidermidis
NRGERAY

SEQ ID NO: 1757757 - protein, 4 aa, Staphylococcus epidermidis
NRGN

SEQ ID NO: 1757758 - protein, 5 aa, Staphylococcus epidermidis
NRGPV

SEQ ID NO: 1757759 - protein, 6 aa, Staphylococcus epidermidis
NRPELS

SEQ ID NO: 1757760 - protein, 6 aa, Staphylococcus epidermidis
NRPESL

SEQ ID NO: 1757761 - protein, 12 aa, Staphylococcus epidermidis
NRRDDRTHTGTI

SEQ ID NO: 1757762 - protein, 13 aa, Staphylococcus epidermidis
NRYRLQPENSTME

SEQ ID NO: 1757763 - protein, 6 aa, Staphylococcus epidermidis
NSADSF

SEQ ID NO: 1757764 - protein, 6 aa, Staphylococcus epidermidis
NSDGAV

SEQ ID NO: 1757765 - protein, 8 aa, Staphylococcus epidermidis
NSEDIRAE

SEQ ID NO: 1757766 - protein, 6 aa, Staphylococcus epidermidis
NSFGRQ

SEQ ID NO: 1757767 - protein, 5 aa, Staphylococcus epidermidis
NSGYA

SEQ ID NO: 1757768 - protein, 7 aa, Staphylococcus epidermidis
NSGYPLD

SEQ ID NO: 1757769 - protein, 12 aa, Staphylococcus epidermidis
NSKNKKDAKDNL

SEQ ID NO: 1757770 - protein, 14 aa, Staphylococcus epidermidis
NSKSTEEKREAYAQ

SEQ ID NO: 1757771 - protein, 7 aa, Staphylococcus epidermidis
NSNDDIS

SEQ ID NO: 1757772 - protein, 9 aa, Staphylococcus epidermidis
NSNIQGVDP

SEQ ID NO: 1757773 - protein, 4 aa, Staphylococcus epidermidis
NSNV

SEQ ID NO: 1757774 - protein, 6 aa, Staphylococcus epidermidis
NSPEYI

SEQ ID NO: 1757775 - protein, 5 aa, Staphylococcus epidermidis
NSPGF

SEQ ID NO: 1757776 - protein, 7 aa, Staphylococcus epidermidis
NSRQEID

SEQ ID NO: 1757777 - protein, 9 aa, Staphylococcus epidermidis
NSRVARSNY

SEQ ID NO: 1757778 - protein, 4 aa, Staphylococcus epidermidis
NSSY

SEQ ID NO: 1757779 - protein, 7 aa, Staphylococcus epidermidis
NSTRTKC

SEQ ID NO: 1757780 - protein, 5 aa, Staphylococcus epidermidis
NTAKS

SEQ ID NO: 1757781 - protein, 4 aa, Staphylococcus epidermidis
NTDG

SEQ ID NO: 1757782 - protein, 5 aa, Staphylococcus epidermidis
NTEKA

SEQ ID NO: 1757783 - protein, 7 aa, Staphylococcus epidermidis
NTGEISV

SEQ ID NO: 1757784 - protein, 10 aa, Staphylococcus epidermidis
NTKSVETREM

SEQ ID NO: 1757785 - protein, 10 aa, Staphylococcus epidermidis
NTKVGAQDKP

SEQ ID NO: 1757786 - protein, 6 aa, Staphylococcus epidermidis
NTLQPS

SEQ ID NO: 1757787 - protein, 5 aa, Staphylococcus epidermidis
NTLSE

SEQ ID NO: 1757788 - protein, 8 aa, Staphylococcus epidermidis
NTNPKPWD

SEQ ID NO: 1757789 - protein, 7 aa, Staphylococcus epidermidis
NTTGDGL

SEQ ID NO: 1757790 - protein, 21 aa, Staphylococcus epidermidis
NTTIPTSKSQVYSTAADNQPA

SEQ ID NO: 1757791 - protein, 7 aa, Staphylococcus epidermidis
NTTKPEV

SEQ ID NO: 1757792 - protein, 9 aa, Staphylococcus epidermidis
NTTSNDASC

SEQ ID NO: 1757793 - protein, 10 aa, Staphylococcus epidermidis
NVDDSRVGDT

SEQ ID NO: 1757794 - protein, 5 aa, Staphylococcus epidermidis
NVEKA

SEQ ID NO: 1757795 - protein, 7 aa, Staphylococcus epidermidis
NVGEKGD

SEQ ID NO: 1757796 - protein, 7 aa, Staphylococcus epidermidis
NVGGLPE

SEQ ID NO: 1757797 - protein, 25 aa, Staphylococcus epidermidis
NVGTPEGVRELENAGADATKVGIGP

SEQ ID NO: 1757798 - protein, 8 aa, Staphylococcus epidermidis
NVPGPKKG

SEQ ID NO: 1757799 - protein, 6 aa, Staphylococcus epidermidis
NWNKEL

SEQ ID NO: 1757800 - protein, 4 aa, Staphylococcus epidermidis
NYND

SEQ ID NO: 1757801 - protein, 8 aa, Staphylococcus epidermidis
NYPQSRVT

SEQ ID NO: 1757802 - protein, 8 aa, Staphylococcus epidermidis
PAAPGTGV

SEQ ID NO: 1757803 - protein, 8 aa, Staphylococcus epidermidis
PADDQSAA

SEQ ID NO: 1757804 - protein, 8 aa, Staphylococcus epidermidis
PADGNETR

SEQ ID NO: 1757805 - protein, 4 aa, Staphylococcus epidermidis
PADQ

SEQ ID NO: 1757806 - protein, 6 aa, Staphylococcus epidermidis
PAEDTV

SEQ ID NO: 1757807 - protein, 11 aa, Staphylococcus epidermidis
PAELSGGQQQR

SEQ ID NO: 1757808 - protein, 18 aa, Staphylococcus epidermidis
PAGKANPAPPVGPALGQA

SEQ ID NO: 1757809 - protein, 6 aa, Staphylococcus epidermidis
PALAAG

SEQ ID NO: 1757810 - protein, 7 aa, Staphylococcus epidermidis
PALGPTF

SEQ ID NO: 1757811 - protein, 11 aa, Staphylococcus epidermidis
PAPDGDPEAPL

SEQ ID NO: 1757812 - protein, 8 aa, Staphylococcus epidermidis
PASESEEM

SEQ ID NO: 1757813 - protein, 9 aa, Staphylococcus epidermidis
PASGKTRLS

SEQ ID NO: 1757814 - protein, 9 aa, Staphylococcus epidermidis
PDAGKTTLT

SEQ ID NO: 1757815 - protein, 6 aa, Staphylococcus epidermidis
PDCRNT

SEQ ID NO: 1757816 - protein, 9 aa, Staphylococcus epidermidis
PDDGNGKSY

SEQ ID NO: 1757817 - protein, 9 aa, Staphylococcus epidermidis
PDDSPISNR

SEQ ID NO: 1757818 - protein, 7 aa, Staphylococcus epidermidis
PDDVTSP

SEQ ID NO: 1757819 - protein, 24 aa, Staphylococcus epidermidis
PDEKAPENMSDKEIEQVKEKEGQR

SEQ ID NO: 1757820 - protein, 5 aa, Staphylococcus epidermidis
PDERS

SEQ ID NO: 1757821 - protein, 5 aa, Staphylococcus epidermidis
PDGKV

SEQ ID NO: 1757822 - protein, 8 aa, Staphylococcus epidermidis
PDHEATAE

SEQ ID NO: 1757823 - protein, 9 aa, Staphylococcus epidermidis
PDHGGVTRA

SEQ ID NO: 1757824 - protein, 11 aa, Staphylococcus epidermidis
PDNPANDDPKM

SEQ ID NO: 1757825 - protein, 8 aa, Staphylococcus epidermidis
PDNSIKAA

SEQ ID NO: 1757826 - protein, 5 aa, Staphylococcus epidermidis
PDPIH

SEQ ID NO: 1757827 - protein, 6 aa, Staphylococcus epidermidis
PDQVPE

SEQ ID NO: 1757828 - protein, 8 aa, Staphylococcus epidermidis
PDSTIAGK

SEQ ID NO: 1757829 - protein, 5 aa, Staphylococcus epidermidis
PDVPS

SEQ ID NO: 1757830 - protein, 4 aa, Staphylococcus epidermidis
PDVR

SEQ ID NO: 1757831 - protein, 5 aa, Staphylococcus epidermidis
PDYAE

SEQ ID NO: 1757832 - protein, 6 aa, Staphylococcus epidermidis
PDYEPM

SEQ ID NO: 1757833 - protein, 11 aa, Staphylococcus epidermidis
PEARPGPSDSN

SEQ ID NO: 1757834 - protein, 8 aa, Staphylococcus epidermidis
PEGGSNKV

SEQ ID NO: 1757835 - protein, 6 aa, Staphylococcus epidermidis
PEGKSG

SEQ ID NO: 1757836 - protein, 8 aa, Staphylococcus epidermidis
PEGRNTNE

SEQ ID NO: 1757837 - protein, 4 aa, Staphylococcus epidermidis
PEGT

SEQ ID NO: 1757838 - protein, 4 aa, Staphylococcus epidermidis
PEGY

SEQ ID NO: 1757839 - protein, 7 aa, Staphylococcus epidermidis
PEKTSPY

SEQ ID NO: 1757840 - protein, 7 aa, Staphylococcus epidermidis
PELDAQG

SEQ ID NO: 1757841 - protein, 5 aa, Staphylococcus epidermidis
PEMSA

SEQ ID NO: 1757842 - protein, 5 aa, Staphylococcus epidermidis
PERDM

SEQ ID NO: 1757843 - protein, 9 aa, Staphylococcus epidermidis
PETSPEDIE

SEQ ID NO: 1757844 - protein, 11 aa, Staphylococcus epidermidis
PEYDDVEDATT

SEQ ID NO: 1757845 - protein, 11 aa, Staphylococcus epidermidis
PFDSSGRRHTS

SEQ ID NO: 1757846 - protein, 10 aa, Staphylococcus epidermidis
PFNQPGVEAY

SEQ ID NO: 1757847 - protein, 4 aa, Staphylococcus epidermidis
PGAK

SEQ ID NO: 1757848 - protein, 4 aa, Staphylococcus epidermidis
PGAR

SEQ ID NO: 1757849 - protein, 9 aa, Staphylococcus epidermidis
PGDEEESYQ

SEQ ID NO: 1757850 - protein, 7 aa, Staphylococcus epidermidis
PGGAGSL

SEQ ID NO: 1757851 - protein, 8 aa, Staphylococcus epidermidis
PGGESTTL

SEQ ID NO: 1757852 - protein, 7 aa, Staphylococcus epidermidis
PGGITIS

SEQ ID NO: 1757853 - protein, 4 aa, Staphylococcus epidermidis
PGIP

SEQ ID NO: 1757854 - protein, 11 aa, Staphylococcus epidermidis
PGITDKDADDI

SEQ ID NO: 1757855 - protein, 7 aa, Staphylococcus epidermidis
PGPIYTE

SEQ ID NO: 1757856 - protein, 5 aa, Staphylococcus epidermidis
PGQTA

SEQ ID NO: 1757857 - protein, 7 aa, Staphylococcus epidermidis
PGRSNAF

SEQ ID NO: 1757858 - protein, 4 aa, Staphylococcus epidermidis
PGSI

SEQ ID NO: 1757859 - protein, 6 aa, Staphylococcus epidermidis
PGSTGA

SEQ ID NO: 1757860 - protein, 12 aa, Staphylococcus epidermidis
PGTIDNDINGTD

SEQ ID NO: 1757861 - protein, 6 aa, Staphylococcus epidermidis
PGTTVQ

SEQ ID NO: 1757862 - protein, 6 aa, Staphylococcus epidermidis
PGVPKG

SEQ ID NO: 1757863 - protein, 5 aa, Staphylococcus epidermidis
PHETW

SEQ ID NO: 1757864 - protein, 4 aa, Staphylococcus epidermidis
PHRS

SEQ ID NO: 1757865 - protein, 5 aa, Staphylococcus epidermidis
PIPER

SEQ ID NO: 1757866 - protein, 4 aa, Staphylococcus epidermidis
PIPR

SEQ ID NO: 1757867 - protein, 4 aa, Staphylococcus epidermidis
PIRI

SEQ ID NO: 1757868 - protein, 16 aa, Staphylococcus epidermidis
PKDDDSVTQLILPIRT

SEQ ID NO: 1757869 - protein, 6 aa, Staphylococcus epidermidis
PKDKPR

SEQ ID NO: 1757870 - protein, 10 aa, Staphylococcus epidermidis
PKFKNTESKL

SEQ ID NO: 1757871 - protein, 12 aa, Staphylococcus epidermidis
PKKNESLHGEEG

SEQ ID NO: 1757872 - protein, 5 aa, Staphylococcus epidermidis
PKQLT

SEQ ID NO: 1757873 - protein, 7 aa, Staphylococcus epidermidis
PKRSKAV

SEQ ID NO: 1757874 - protein, 9 aa, Staphylococcus epidermidis
PKSHPARDM

SEQ ID NO: 1757875 - protein, 9 aa, Staphylococcus epidermidis
PKSNSGITA

SEQ ID NO: 1757876 - protein, 7 aa, Staphylococcus epidermidis
PKYEKKL

SEQ ID NO: 1757877 - protein, 4 aa, Staphylococcus epidermidis
PKYY

SEQ ID NO: 1757878 - protein, 8 aa, Staphylococcus epidermidis
PLAESGIG

SEQ ID NO: 1757879 - protein, 4 aa, Staphylococcus epidermidis
PLKT

SEQ ID NO: 1757880 - protein, 7 aa, Staphylococcus epidermidis
PLSPTLT

SEQ ID NO: 1757881 - protein, 6 aa, Staphylococcus epidermidis
PLTRTP

SEQ ID NO: 1757882 - protein, 10 aa, Staphylococcus epidermidis
PLTTPIGGGI

SEQ ID NO: 1757883 - protein, 7 aa, Staphylococcus epidermidis
PMDSPGG

SEQ ID NO: 1757884 - protein, 5 aa, Staphylococcus epidermidis
PMGEG

SEQ ID NO: 1757885 - protein, 9 aa, Staphylococcus epidermidis
PNAAPLPGK

SEQ ID NO: 1757886 - protein, 5 aa, Staphylococcus epidermidis
PNCST

SEQ ID NO: 1757887 - protein, 10 aa, Staphylococcus epidermidis
PNDEEGRTTT

SEQ ID NO: 1757888 - protein, 4 aa, Staphylococcus epidermidis
PNEG

SEQ ID NO: 1757889 - protein, 6 aa, Staphylococcus epidermidis
PNGDRK

SEQ ID NO: 1757890 - protein, 5 aa, Staphylococcus epidermidis
PNGVG

SEQ ID NO: 1757891 - protein, 7 aa, Staphylococcus epidermidis
PNGVGKT

SEQ ID NO: 1757892 - protein, 9 aa, Staphylococcus epidermidis
PNIPEAEEI

SEQ ID NO: 1757893 - protein, 5 aa, Staphylococcus epidermidis
PNKDE

SEQ ID NO: 1757894 - protein, 9 aa, Staphylococcus epidermidis
PNMSGKSTY

SEQ ID NO: 1757895 - protein, 8 aa, Staphylococcus epidermidis
PNNPTGTY

SEQ ID NO: 1757896 - protein, 8 aa, Staphylococcus epidermidis
PNPDNEDT

SEQ ID NO: 1757897 - protein, 7 aa, Staphylococcus epidermidis
PNPFPKS

SEQ ID NO: 1757898 - protein, 8 aa, Staphylococcus epidermidis
PNQNPTKV

SEQ ID NO: 1757899 - protein, 10 aa, Staphylococcus epidermidis
PNSEEKGEVV

SEQ ID NO: 1757900 - protein, 14 aa, Staphylococcus epidermidis
PNTKKEQQPKRGDD

SEQ ID NO: 1757901 - protein, 12 aa, Staphylococcus epidermidis
PPFTSEKAKDKV

SEQ ID NO: 1757902 - protein, 4 aa, Staphylococcus epidermidis
PPGI

SEQ ID NO: 1757903 - protein, 8 aa, Staphylococcus epidermidis
PPGIGKTS

SEQ ID NO: 1757904 - protein, 8 aa, Staphylococcus epidermidis
PPGLGKTT

SEQ ID NO: 1757905 - protein, 4 aa, Staphylococcus epidermidis
PPGT

SEQ ID NO: 1757906 - protein, 7 aa, Staphylococcus epidermidis
PPGTGDV

SEQ ID NO: 1757907 - protein, 6 aa, Staphylococcus epidermidis
PPIRAG

SEQ ID NO: 1757908 - protein, 5 aa, Staphylococcus epidermidis
PPMKG

SEQ ID NO: 1757909 - protein, 5 aa, Staphylococcus epidermidis
PPNVT

SEQ ID NO: 1757910 - protein, 14 aa, Staphylococcus epidermidis
PPQQADGKATNPEQ

SEQ ID NO: 1757911 - protein, 8 aa, Staphylococcus epidermidis
PPRKGCDE

SEQ ID NO: 1757912 - protein, 17 aa, Staphylococcus epidermidis
PPSGRTLSGGLDPASLH

SEQ ID NO: 1757913 - protein, 4 aa, Staphylococcus epidermidis
PPTA

SEQ ID NO: 1757914 - protein, 4 aa, Staphylococcus epidermidis
PQFN

SEQ ID NO: 1757915 - protein, 4 aa, Staphylococcus epidermidis
PQIP

SEQ ID NO: 1757916 - protein, 5 aa, Staphylococcus epidermidis
PQSPQ

SEQ ID NO: 1757917 - protein, 4 aa, Staphylococcus epidermidis
PRIP

SEQ ID NO: 1757918 - protein, 10 aa, Staphylococcus epidermidis
PRKERNAIAE

SEQ ID NO: 1757919 - protein, 18 aa, Staphylococcus epidermidis
PRVSRSSALASKATGYPI

SEQ ID NO: 1757920 - protein, 13 aa, Staphylococcus epidermidis
PSDFKKNKGYERS

SEQ ID NO: 1757921 - protein, 7 aa, Staphylococcus epidermidis
PSELTSP

SEQ ID NO: 1757922 - protein, 14 aa, Staphylococcus epidermidis
PSFARNKKKTFSVQ

SEQ ID NO: 1757923 - protein, 4 aa, Staphylococcus epidermidis
PSFE

SEQ ID NO: 1757924 - protein, 11 aa, Staphylococcus epidermidis
PSGASTGEHEA

SEQ ID NO: 1757925 - protein, 7 aa, Staphylococcus epidermidis
PSGPYDA

SEQ ID NO: 1757926 - protein, 6 aa, Staphylococcus epidermidis
PSGTEP

SEQ ID NO: 1757927 - protein, 16 aa, Staphylococcus epidermidis
PSNGERYLSTPLYSFD

SEQ ID NO: 1757928 - protein, 9 aa, Staphylococcus epidermidis
PSPVKRPED

SEQ ID NO: 1757929 - protein, 7 aa, Staphylococcus epidermidis
PSQTLSD

SEQ ID NO: 1757930 - protein, 6 aa, Staphylococcus epidermidis
PSSETN

SEQ ID NO: 1757931 - protein, 9 aa, Staphylococcus epidermidis
PSSSHTAGA

SEQ ID NO: 1757932 - protein, 9 aa, Staphylococcus epidermidis
PSVGGPAKG

SEQ ID NO: 1757933 - protein, 9 aa, Staphylococcus epidermidis
PSYSPETIA

SEQ ID NO: 1757934 - protein, 17 aa, Staphylococcus epidermidis
PTADLEDDKPQLPDEEA

SEQ ID NO: 1757935 - protein, 6 aa, Staphylococcus epidermidis
PTEYGT

SEQ ID NO: 1757936 - protein, 10 aa, Staphylococcus epidermidis
PTGSMTKDER

SEQ ID NO: 1757937 - protein, 11 aa, Staphylococcus epidermidis
PTGTVSGAPKL

SEQ ID NO: 1757938 - protein, 6 aa, Staphylococcus epidermidis
PTHPLT

SEQ ID NO: 1757939 - protein, 4 aa, Staphylococcus epidermidis
PTKD

SEQ ID NO: 1757940 - protein, 6 aa, Staphylococcus epidermidis
PTKEPF

SEQ ID NO: 1757941 - protein, 6 aa, Staphylococcus epidermidis
PTNPTG

SEQ ID NO: 1757942 - protein, 4 aa, Staphylococcus epidermidis
PTPN

SEQ ID NO: 1757943 - protein, 4 aa, Staphylococcus epidermidis
PTQS

SEQ ID NO: 1757944 - protein, 8 aa, Staphylococcus epidermidis
PTSALDPE

SEQ ID NO: 1757945 - protein, 7 aa, Staphylococcus epidermidis
PTTAGEI

SEQ ID NO: 1757946 - protein, 6 aa, Staphylococcus epidermidis
PTTDGK

SEQ ID NO: 1757947 - protein, 10 aa, Staphylococcus epidermidis
PTTFNNPRRM

SEQ ID NO: 1757948 - protein, 5 aa, Staphylococcus epidermidis
PTTGL

SEQ ID NO: 1757949 - protein, 5 aa, Staphylococcus epidermidis
PTYGR

SEQ ID NO: 1757950 - protein, 5 aa, Staphylococcus epidermidis
PTYQR

SEQ ID NO: 1757951 - protein, 11 aa, Staphylococcus epidermidis
PVASLDPLTTK

SEQ ID NO: 1757952 - protein, 8 aa, Staphylococcus epidermidis
PVGAGKTQ

SEQ ID NO: 1757953 - protein, 10 aa, Staphylococcus epidermidis
PVGDDQKQHM

SEQ ID NO: 1757954 - protein, 8 aa, Staphylococcus epidermidis
PVGEPANI

SEQ ID NO: 1757955 - protein, 11 aa, Staphylococcus epidermidis
PVPDGDTGTNM

SEQ ID NO: 1757956 - protein, 5 aa, Staphylococcus epidermidis
PVPES

SEQ ID NO: 1757957 - protein, 7 aa, Staphylococcus epidermidis
PVTPPNN

SEQ ID NO: 1757958 - protein, 4 aa, Staphylococcus epidermidis
PVYG

SEQ ID NO: 1757959 - protein, 12 aa, Staphylococcus epidermidis
PVYKENKDGSIE

SEQ ID NO: 1757960 - protein, 9 aa, Staphylococcus epidermidis
PYAAPPEDA

SEQ ID NO: 1757961 - protein, 8 aa, Staphylococcus epidermidis
PYGGGKGG

SEQ ID NO: 1757962 - protein, 4 aa, Staphylococcus epidermidis
PYQA

SEQ ID NO: 1757963 - protein, 10 aa, Staphylococcus epidermidis
PYQPEISQGE

SEQ ID NO: 1757964 - protein, 4 aa, Staphylococcus epidermidis
QAAK

SEQ ID NO: 1757965 - protein, 6 aa, Staphylococcus epidermidis
QAASIV

SEQ ID NO: 1757966 - protein, 13 aa, Staphylococcus epidermidis
QADDDYKDKMGEK

SEQ ID NO: 1757967 - protein, 5 aa, Staphylococcus epidermidis
QAGDI

SEQ ID NO: 1757968 - protein, 5 aa, Staphylococcus epidermidis
QAPAR

SEQ ID NO: 1757969 - protein, 5 aa, Staphylococcus epidermidis
QAPEN

SEQ ID NO: 1757970 - protein, 13 aa, Staphylococcus epidermidis
QAQENERKRISRE

SEQ ID NO: 1757971 - protein, 8 aa, Staphylococcus epidermidis
QAQSTSDF

SEQ ID NO: 1757972 - protein, 8 aa, Staphylococcus epidermidis
QATEALPN

SEQ ID NO: 1757973 - protein, 6 aa, Staphylococcus epidermidis
QATTTS

SEQ ID NO: 1757974 - protein, 7 aa, Staphylococcus epidermidis
QATVSRD

SEQ ID NO: 1757975 - protein, 7 aa, Staphylococcus epidermidis
QDAADED

SEQ ID NO: 1757976 - protein, 8 aa, Staphylococcus epidermidis
QDATPIKL

SEQ ID NO: 1757977 - protein, 7 aa, Staphylococcus epidermidis
QDDAAGT

SEQ ID NO: 1757978 - protein, 20 aa, Staphylococcus epidermidis
QDDNPDFKSGEVTQELQKGY

SEQ ID NO: 1757979 - protein, 4 aa, Staphylococcus epidermidis
QDID

SEQ ID NO: 1757980 - protein, 6 aa, Staphylococcus epidermidis
QDNNMK

SEQ ID NO: 1757981 - protein, 6 aa, Staphylococcus epidermidis
QDPGNL

SEQ ID NO: 1757982 - protein, 9 aa, Staphylococcus epidermidis
QDPSSVPED

SEQ ID NO: 1757983 - protein, 5 aa, Staphylococcus epidermidis
QDRPT

SEQ ID NO: 1757984 - protein, 6 aa, Staphylococcus epidermidis
QDSEKD

SEQ ID NO: 1757985 - protein, 9 aa, Staphylococcus epidermidis
QDTDSITPQ

SEQ ID NO: 1757986 - protein, 6 aa, Staphylococcus epidermidis
QDVQGS

SEQ ID NO: 1757987 - protein, 5 aa, Staphylococcus epidermidis
QEEAL

SEQ ID NO: 1757988 - protein, 7 aa, Staphylococcus epidermidis
QEEDPTF

SEQ ID NO: 1757989 - protein, 8 aa, Staphylococcus epidermidis
QEEPKNQG

SEQ ID NO: 1757990 - protein, 25 aa, Staphylococcus epidermidis
QEEQQKYASQRKSAVGTGDRSERIR

SEQ ID NO: 1757991 - protein, 5 aa, Staphylococcus epidermidis
QEESV

SEQ ID NO: 1757992 - protein, 7 aa, Staphylococcus epidermidis
QEFGNGR

SEQ ID NO: 1757993 - protein, 4 aa, Staphylococcus epidermidis
QEGI

SEQ ID NO: 1757994 - protein, 4 aa, Staphylococcus epidermidis
QEGL

SEQ ID NO: 1757995 - protein, 5 aa, Staphylococcus epidermidis
QEHGG

SEQ ID NO: 1757996 - protein, 6 aa, Staphylococcus epidermidis
QEIAVK

SEQ ID NO: 1757997 - protein, 8 aa, Staphylococcus epidermidis
QEKAKKSL

SEQ ID NO: 1757998 - protein, 10 aa, Staphylococcus epidermidis
QENGTEPPFQ

SEQ ID NO: 1757999 - protein, 9 aa, Staphylococcus epidermidis
QEQDRGITI

SEQ ID NO: 1758000 - protein, 5 aa, Staphylococcus epidermidis
QEQPG

SEQ ID NO: 1758001 - protein, 7 aa, Staphylococcus epidermidis
QERGISV

SEQ ID NO: 1758002 - protein, 5 aa, Staphylococcus epidermidis
QESGV

SEQ ID NO: 1758003 - protein, 11 aa, Staphylococcus epidermidis
QFTEKSKHFSE

SEQ ID NO: 1758004 - protein, 15 aa, Staphylococcus epidermidis
QGAKPGEGGQLPGSK

SEQ ID NO: 1758005 - protein, 5 aa, Staphylococcus epidermidis
QGATS

SEQ ID NO: 1758006 - protein, 6 aa, Staphylococcus epidermidis
QGDGGL

SEQ ID NO: 1758007 - protein, 5 aa, Staphylococcus epidermidis
QGEMK

SEQ ID NO: 1758008 - protein, 9 aa, Staphylococcus epidermidis
QGGMTNASK

SEQ ID NO: 1758009 - protein, 6 aa, Staphylococcus epidermidis
QGIEAQ

SEQ ID NO: 1758010 - protein, 5 aa, Staphylococcus epidermidis
QGIKP

SEQ ID NO: 1758011 - protein, 5 aa, Staphylococcus epidermidis
QGKEI

SEQ ID NO: 1758012 - protein, 9 aa, Staphylococcus epidermidis
QGKMTTSGE

SEQ ID NO: 1758013 - protein, 5 aa, Staphylococcus epidermidis
QGKPF

SEQ ID NO: 1758014 - protein, 7 aa, Staphylococcus epidermidis
QGLTPEG

SEQ ID NO: 1758015 - protein, 7 aa, Staphylococcus epidermidis
QGNPSLQ

SEQ ID NO: 1758016 - protein, 7 aa, Staphylococcus epidermidis
QGPDFPT

SEQ ID NO: 1758017 - protein, 6 aa, Staphylococcus epidermidis
QGREVN

SEQ ID NO: 1758018 - protein, 7 aa, Staphylococcus epidermidis
QGRIEED

SEQ ID NO: 1758019 - protein, 8 aa, Staphylococcus epidermidis
QGVSTEGA

SEQ ID NO: 1758020 - protein, 6 aa, Staphylococcus epidermidis
QHETQS

SEQ ID NO: 1758021 - protein, 5 aa, Staphylococcus epidermidis
QHGTA

SEQ ID NO: 1758022 - protein, 11 aa, Staphylococcus epidermidis
QHREKNEDAGG

SEQ ID NO: 1758023 - protein, 5 aa, Staphylococcus epidermidis
QIDGK

SEQ ID NO: 1758024 - protein, 8 aa, Staphylococcus epidermidis
QIGGRRNG

SEQ ID NO: 1758025 - protein, 5 aa, Staphylococcus epidermidis
QIGPI

SEQ ID NO: 1758026 - protein, 9 aa, Staphylococcus epidermidis
QKDSTVRAN

SEQ ID NO: 1758027 - protein, 7 aa, Staphylococcus epidermidis
QKEFGED

SEQ ID NO: 1758028 - protein, 10 aa, Staphylococcus epidermidis
QKGTAKGVGN

SEQ ID NO: 1758029 - protein, 10 aa, Staphylococcus epidermidis
QKGYSGQQIA

SEQ ID NO: 1758030 - protein, 6 aa, Staphylococcus epidermidis
QKPHYV

SEQ ID NO: 1758031 - protein, 7 aa, Staphylococcus epidermidis
QKRNPEP

SEQ ID NO: 1758032 - protein, 10 aa, Staphylococcus epidermidis
QKVENKNEIA

SEQ ID NO: 1758033 - protein, 6 aa, Staphylococcus epidermidis
QKVSGD

SEQ ID NO: 1758034 - protein, 4 aa, Staphylococcus epidermidis
QKYD

SEQ ID NO: 1758035 - protein, 12 aa, Staphylococcus epidermidis
QLAEEGDTVEVG

SEQ ID NO: 1758036 - protein, 10 aa, Staphylococcus epidermidis
QLAPGTEGGF

SEQ ID NO: 1758037 - protein, 4 aa, Staphylococcus epidermidis
QLDA

SEQ ID NO: 1758038 - protein, 9 aa, Staphylococcus epidermidis
QLETEKSYE

SEQ ID NO: 1758039 - protein, 4 aa, Staphylococcus epidermidis
QLNG

SEQ ID NO: 1758040 - protein, 11 aa, Staphylococcus epidermidis
QLSSDRNDDQF

SEQ ID NO: 1758041 - protein, 10 aa, Staphylococcus epidermidis
QMKSEQDKNI

SEQ ID NO: 1758042 - protein, 10 aa, Staphylococcus epidermidis
QMPTEEEQFE

SEQ ID NO: 1758043 - protein, 8 aa, Staphylococcus epidermidis
QMTERDLE

SEQ ID NO: 1758044 - protein, 14 aa, Staphylococcus epidermidis
QMTQPVKKGMKEKG

SEQ ID NO: 1758045 - protein, 8 aa, Staphylococcus epidermidis
QNGKPENF

SEQ ID NO: 1758046 - protein, 10 aa, Staphylococcus epidermidis
QNKGKDTGAY

SEQ ID NO: 1758047 - protein, 4 aa, Staphylococcus epidermidis
QNNP

SEQ ID NO: 1758048 - protein, 5 aa, Staphylococcus epidermidis
QNQDM

SEQ ID NO: 1758049 - protein, 4 aa, Staphylococcus epidermidis
QNTV

SEQ ID NO: 1758050 - protein, 8 aa, Staphylococcus epidermidis
QNVRTNYE

SEQ ID NO: 1758051 - protein, 9 aa, Staphylococcus epidermidis
QPDHGEQGL

SEQ ID NO: 1758052 - protein, 8 aa, Staphylococcus epidermidis
QPDRPVGR

SEQ ID NO: 1758053 - protein, 9 aa, Staphylococcus epidermidis
QPKKTIPTT

SEQ ID NO: 1758054 - protein, 7 aa, Staphylococcus epidermidis
QPPGKKL

SEQ ID NO: 1758055 - protein, 18 aa, Staphylococcus epidermidis
QPPSLKEAKKRGKQEVQY

SEQ ID NO: 1758056 - protein, 4 aa, Staphylococcus epidermidis
QPQV

SEQ ID NO: 1758057 - protein, 5 aa, Staphylococcus epidermidis
QPSRK

SEQ ID NO: 1758058 - protein, 8 aa, Staphylococcus epidermidis
QPSSSTPL

SEQ ID NO: 1758059 - protein, 5 aa, Staphylococcus epidermidis
QPVDE

SEQ ID NO: 1758060 - protein, 7 aa, Staphylococcus epidermidis
QQAAGEL

SEQ ID NO: 1758061 - protein, 4 aa, Staphylococcus epidermidis
QQAR

SEQ ID NO: 1758062 - protein, 9 aa, Staphylococcus epidermidis
QQDDNYDLT

SEQ ID NO: 1758063 - protein, 4 aa, Staphylococcus epidermidis
QQDG

SEQ ID NO: 1758064 - protein, 10 aa, Staphylococcus epidermidis
QQGEGIESTG

SEQ ID NO: 1758065 - protein, 8 aa, Staphylococcus epidermidis
QQGRTVQQ

SEQ ID NO: 1758066 - protein, 5 aa, Staphylococcus epidermidis
QQNQT

SEQ ID NO: 1758067 - protein, 14 aa, Staphylococcus epidermidis
QQPLGGKAQFGGQR

SEQ ID NO: 1758068 - protein, 6 aa, Staphylococcus epidermidis
QQRDPE

SEQ ID NO: 1758069 - protein, 10 aa, Staphylococcus epidermidis
QQRQESKNVS

SEQ ID NO: 1758070 - protein, 8 aa, Staphylococcus epidermidis
QQSSDTTY

SEQ ID NO: 1758071 - protein, 11 aa, Staphylococcus epidermidis
QQTGNTEAKAY

SEQ ID NO: 1758072 - protein, 17 aa, Staphylococcus epidermidis
QRGGPSTGLPTKQEQSD

SEQ ID NO: 1758073 - protein, 11 aa, Staphylococcus epidermidis
QRGGSPSGADR

SEQ ID NO: 1758074 - protein, 9 aa, Staphylococcus epidermidis
QRNGGTRKR

SEQ ID NO: 1758075 - protein, 8 aa, Staphylococcus epidermidis
QRNGPTGT

SEQ ID NO: 1758076 - protein, 15 aa, Staphylococcus epidermidis
QRNPRATRAEASDVA

SEQ ID NO: 1758077 - protein, 5 aa, Staphylococcus epidermidis
QRPGA

SEQ ID NO: 1758078 - protein, 5 aa, Staphylococcus epidermidis
QRPSV

SEQ ID NO: 1758079 - protein, 16 aa, Staphylococcus epidermidis
QRPTFNPETGKDFGKK

SEQ ID NO: 1758080 - protein, 9 aa, Staphylococcus epidermidis
QRQLSRNEA

SEQ ID NO: 1758081 - protein, 12 aa, Staphylococcus epidermidis
QRTDLREAKETL

SEQ ID NO: 1758082 - protein, 4 aa, Staphylococcus epidermidis
QRTV

SEQ ID NO: 1758083 - protein, 27 aa, Staphylococcus epidermidis
QSAEKIVETAKRSGADVSGPIPLPTEK

SEQ ID NO: 1758084 - protein, 10 aa, Staphylococcus epidermidis
QSEAVRTTEG

SEQ ID NO: 1758085 - protein, 7 aa, Staphylococcus epidermidis
QSGAQNK

SEQ ID NO: 1758086 - protein, 10 aa, Staphylococcus epidermidis
QSGNLTPADK

SEQ ID NO: 1758087 - protein, 9 aa, Staphylococcus epidermidis
QSGYTGEDG

SEQ ID NO: 1758088 - protein, 5 aa, Staphylococcus epidermidis
QSILD

SEQ ID NO: 1758089 - protein, 6 aa, Staphylococcus epidermidis
QSLDEE

SEQ ID NO: 1758090 - protein, 10 aa, Staphylococcus epidermidis
QSLTDKPVKG

SEQ ID NO: 1758091 - protein, 5 aa, Staphylococcus epidermidis
QSNDP

SEQ ID NO: 1758092 - protein, 10 aa, Staphylococcus epidermidis
QSNSKDKQSI

SEQ ID NO: 1758093 - protein, 8 aa, Staphylococcus epidermidis
QSPEEYAR

SEQ ID NO: 1758094 - protein, 16 aa, Staphylococcus epidermidis
QSPIGRTPRSNPATYT

SEQ ID NO: 1758095 - protein, 5 aa, Staphylococcus epidermidis
QSPLA

SEQ ID NO: 1758096 - protein, 4 aa, Staphylococcus epidermidis
QSQV

SEQ ID NO: 1758097 - protein, 5 aa, Staphylococcus epidermidis
QTDGR

SEQ ID NO: 1758098 - protein, 9 aa, Staphylococcus epidermidis
QTKDPDPLP

SEQ ID NO: 1758099 - protein, 12 aa, Staphylococcus epidermidis
QTNEAKIRGYQK

SEQ ID NO: 1758100 - protein, 8 aa, Staphylococcus epidermidis
QTNTYGAN

SEQ ID NO: 1758101 - protein, 6 aa, Staphylococcus epidermidis
QTQSLS

SEQ ID NO: 1758102 - protein, 9 aa, Staphylococcus epidermidis
QTRQKTGLK

SEQ ID NO: 1758103 - protein, 7 aa, Staphylococcus epidermidis
QTTTSEI

SEQ ID NO: 1758104 - protein, 15 aa, Staphylococcus epidermidis
QVGQTVESGAEADIK

SEQ ID NO: 1758105 - protein, 4 aa, Staphylococcus epidermidis
QVKR

SEQ ID NO: 1758106 - protein, 4 aa, Staphylococcus epidermidis
QVMK

SEQ ID NO: 1758107 - protein, 6 aa, Staphylococcus epidermidis
QVNEDD

SEQ ID NO: 1758108 - protein, 7 aa, Staphylococcus epidermidis
QVPNDGN

SEQ ID NO: 1758109 - protein, 8 aa, Staphylococcus epidermidis
QVPSSPSY

SEQ ID NO: 1758110 - protein, 9 aa, Staphylococcus epidermidis
QVTKDIGDA

SEQ ID NO: 1758111 - protein, 8 aa, Staphylococcus epidermidis
QYGKETDG

SEQ ID NO: 1758112 - protein, 5 aa, Staphylococcus epidermidis
QYGVH

SEQ ID NO: 1758113 - protein, 10 aa, Staphylococcus epidermidis
RAAPAEGDGE

SEQ ID NO: 1758114 - protein, 9 aa, Staphylococcus epidermidis
RAARNDKGE

SEQ ID NO: 1758115 - protein, 8 aa, Staphylococcus epidermidis
RAEERHDD

SEQ ID NO: 1758116 - protein, 13 aa, Staphylococcus epidermidis
RAGASYDDIEDSK

SEQ ID NO: 1758117 - protein, 11 aa, Staphylococcus epidermidis
RAGIKDPNRPI

SEQ ID NO: 1758118 - protein, 5 aa, Staphylococcus epidermidis
RAHNL

SEQ ID NO: 1758119 - protein, 7 aa, Staphylococcus epidermidis
RAKKRNI

SEQ ID NO: 1758120 - protein, 13 aa, Staphylococcus epidermidis
RAKSEAEKSFGNS

SEQ ID NO: 1758121 - protein, 5 aa, Staphylococcus epidermidis
RALDG

SEQ ID NO: 1758122 - protein, 11 aa, Staphylococcus epidermidis
RALEQARNEKV

SEQ ID NO: 1758123 - protein, 8 aa, Staphylococcus epidermidis
RALTTKYD

SEQ ID NO: 1758124 - protein, 15 aa, Staphylococcus epidermidis
RAQHNDAVGPTKGGV

SEQ ID NO: 1758125 - protein, 5 aa, Staphylococcus epidermidis
RAQSF

SEQ ID NO: 1758126 - protein, 7 aa, Staphylococcus epidermidis
RARDDQN

SEQ ID NO: 1758127 - protein, 7 aa, Staphylococcus epidermidis
RAREAGV

SEQ ID NO: 1758128 - protein, 6 aa, Staphylococcus epidermidis
RARQSC

SEQ ID NO: 1758129 - protein, 12 aa, Staphylococcus epidermidis
RARQVNKEGYLK

SEQ ID NO: 1758130 - protein, 6 aa, Staphylococcus epidermidis
RASERT

SEQ ID NO: 1758131 - protein, 16 aa, Staphylococcus epidermidis
RASGAGGQHINKTESA

SEQ ID NO: 1758132 - protein, 7 aa, Staphylococcus epidermidis
RAYEDLE

SEQ ID NO: 1758133 - protein, 5 aa, Staphylococcus epidermidis
RDDSY

SEQ ID NO: 1758134 - protein, 6 aa, Staphylococcus epidermidis
RDEEGQ

SEQ ID NO: 1758135 - protein, 8 aa, Staphylococcus epidermidis
RDETDRTG

SEQ ID NO: 1758136 - protein, 9 aa, Staphylococcus epidermidis
RDGEQTPGV

SEQ ID NO: 1758137 - protein, 6 aa, Staphylococcus epidermidis
RDIEPG

SEQ ID NO: 1758138 - protein, 16 aa, Staphylococcus epidermidis
RDIPNVSESALKNLDD

SEQ ID NO: 1758139 - protein, 6 aa, Staphylococcus epidermidis
RDNPMD

SEQ ID NO: 1758140 - protein, 24 aa, Staphylococcus epidermidis
RDPRMKERKKPGLKKARRSPQFSK

SEQ ID NO: 1758141 - protein, 11 aa, Staphylococcus epidermidis
RDRKAEKDYSK

SEQ ID NO: 1758142 - protein, 9 aa, Staphylococcus epidermidis
RDRRQRKRD

SEQ ID NO: 1758143 - protein, 4 aa, Staphylococcus epidermidis
RDSM

SEQ ID NO: 1758144 - protein, 8 aa, Staphylococcus epidermidis
RDVDQKSA

SEQ ID NO: 1758145 - protein, 16 aa, Staphylococcus epidermidis
RDVPGKHASYKAGGML

SEQ ID NO: 1758146 - protein, 5 aa, Staphylococcus epidermidis
REAEV

SEQ ID NO: 1758147 - protein, 10 aa, Staphylococcus epidermidis
REDGSEFDKD

SEQ ID NO: 1758148 - protein, 7 aa, Staphylococcus epidermidis
REDVQRG

SEQ ID NO: 1758149 - protein, 7 aa, Staphylococcus epidermidis
REEREAV

SEQ ID NO: 1758150 - protein, 5 aa, Staphylococcus epidermidis
REESE

SEQ ID NO: 1758151 - protein, 5 aa, Staphylococcus epidermidis
REGSK

SEQ ID NO: 1758152 - protein, 7 aa, Staphylococcus epidermidis
REITSQK

SEQ ID NO: 1758153 - protein, 8 aa, Staphylococcus epidermidis
REKTGAGM

SEQ ID NO: 1758154 - protein, 12 aa, Staphylococcus epidermidis
RELSGPVATTYT

SEQ ID NO: 1758155 - protein, 6 aa, Staphylococcus epidermidis
RELSRD

SEQ ID NO: 1758156 - protein, 7 aa, Staphylococcus epidermidis
RENAENK

SEQ ID NO: 1758157 - protein, 7 aa, Staphylococcus epidermidis
RENTGDL

SEQ ID NO: 1758158 - protein, 4 aa, Staphylococcus epidermidis
REQS

SEQ ID NO: 1758159 - protein, 4 aa, Staphylococcus epidermidis
RERG

SEQ ID NO: 1758160 - protein, 8 aa, Staphylococcus epidermidis
RERGCSNG

SEQ ID NO: 1758161 - protein, 8 aa, Staphylococcus epidermidis
RERSEVDQ

SEQ ID NO: 1758162 - protein, 11 aa, Staphylococcus epidermidis
RESGLGGADGI

SEQ ID NO: 1758163 - protein, 10 aa, Staphylococcus epidermidis
RESGSIEQDA

SEQ ID NO: 1758164 - protein, 7 aa, Staphylococcus epidermidis
RETDGTS

SEQ ID NO: 1758165 - protein, 6 aa, Staphylococcus epidermidis
REVGQN

SEQ ID NO: 1758166 - protein, 12 aa, Staphylococcus epidermidis
REYGTTTGRPRR

SEQ ID NO: 1758167 - protein, 8 aa, Staphylococcus epidermidis
RFNETKVS

SEQ ID NO: 1758168 - protein, 8 aa, Staphylococcus epidermidis
RFSGATRG

SEQ ID NO: 1758169 - protein, 8 aa, Staphylococcus epidermidis
RGAKGGYQ

SEQ ID NO: 1758170 - protein, 5 aa, Staphylococcus epidermidis
RGAQV

SEQ ID NO: 1758171 - protein, 18 aa, Staphylococcus epidermidis
RGDKVTGKVRKPKDNEKY

SEQ ID NO: 1758172 - protein, 9 aa, Staphylococcus epidermidis
RGEKTMEDR

SEQ ID NO: 1758173 - protein, 5 aa, Staphylococcus epidermidis
RGFTN

SEQ ID NO: 1758174 - protein, 6 aa, Staphylococcus epidermidis
RGGGSI

SEQ ID NO: 1758175 - protein, 5 aa, Staphylococcus epidermidis
RGIGR

SEQ ID NO: 1758176 - protein, 11 aa, Staphylococcus epidermidis
RGKERSRRPED

SEQ ID NO: 1758177 - protein, 8 aa, Staphylococcus epidermidis
RGKKPIQR

SEQ ID NO: 1758178 - protein, 16 aa, Staphylococcus epidermidis
RGKTGSDLGMDRGTAD

SEQ ID NO: 1758179 - protein, 5 aa, Staphylococcus epidermidis
RGLGA

SEQ ID NO: 1758180 - protein, 5 aa, Staphylococcus epidermidis
RGLGR

SEQ ID NO: 1758181 - protein, 9 aa, Staphylococcus epidermidis
RGLGSSASA

SEQ ID NO: 1758182 - protein, 5 aa, Staphylococcus epidermidis
RGMAE

SEQ ID NO: 1758183 - protein, 6 aa, Staphylococcus epidermidis
RGMPKG

SEQ ID NO: 1758184 - protein, 6 aa, Staphylococcus epidermidis
RGRGLY

SEQ ID NO: 1758185 - protein, 12 aa, Staphylococcus epidermidis
RGVEQRQDKRPM

SEQ ID NO: 1758186 - protein, 9 aa, Staphylococcus epidermidis
RGYGTTLGN

SEQ ID NO: 1758187 - protein, 6 aa, Staphylococcus epidermidis
RGYRRE

SEQ ID NO: 1758188 - protein, 7 aa, Staphylococcus epidermidis
RGYTGRN

SEQ ID NO: 1758189 - protein, 13 aa, Staphylococcus epidermidis
RHPSRSKRLKDFM

SEQ ID NO: 1758190 - protein, 4 aa, Staphylococcus epidermidis
RHYG

SEQ ID NO: 1758191 - protein, 11 aa, Staphylococcus epidermidis
RIEAGEQKEDA

SEQ ID NO: 1758192 - protein, 7 aa, Staphylococcus epidermidis
RIGAATG

SEQ ID NO: 1758193 - protein, 4 aa, Staphylococcus epidermidis
RIKT

SEQ ID NO: 1758194 - protein, 10 aa, Staphylococcus epidermidis
RISEDDAKKG

SEQ ID NO: 1758195 - protein, 8 aa, Staphylococcus epidermidis
RKAPKLDG

SEQ ID NO: 1758196 - protein, 18 aa, Staphylococcus epidermidis
RKASIAVGKKGTDLPGQI

SEQ ID NO: 1758197 - protein, 10 aa, Staphylococcus epidermidis
RKDETHKGDY

SEQ ID NO: 1758198 - protein, 12 aa, Staphylococcus epidermidis
RKDGKYGLIETT

SEQ ID NO: 1758199 - protein, 8 aa, Staphylococcus epidermidis
RKEGKLPR

SEQ ID NO: 1758200 - protein, 6 aa, Staphylococcus epidermidis
RKEMSK

SEQ ID NO: 1758201 - protein, 6 aa, Staphylococcus epidermidis
RKGEGD

SEQ ID NO: 1758202 - protein, 15 aa, Staphylococcus epidermidis
RKKRIAKGSGRSLQE

SEQ ID NO: 1758203 - protein, 8 aa, Staphylococcus epidermidis
RKNKRRTH

SEQ ID NO: 1758204 - protein, 5 aa, Staphylococcus epidermidis
RKNSV

SEQ ID NO: 1758205 - protein, 8 aa, Staphylococcus epidermidis
RKQKGRYR

SEQ ID NO: 1758206 - protein, 7 aa, Staphylococcus epidermidis
RKRRNYA

SEQ ID NO: 1758207 - protein, 8 aa, Staphylococcus epidermidis
RKTKNNPV

SEQ ID NO: 1758208 - protein, 6 aa, Staphylococcus epidermidis
RKYPEY

SEQ ID NO: 1758209 - protein, 6 aa, Staphylococcus epidermidis
RLDDDG

SEQ ID NO: 1758210 - protein, 8 aa, Staphylococcus epidermidis
RLGTGKVA

SEQ ID NO: 1758211 - protein, 8 aa, Staphylococcus epidermidis
RLKEQGAN

SEQ ID NO: 1758212 - protein, 10 aa, Staphylococcus epidermidis
RLRNDEAVER

SEQ ID NO: 1758213 - protein, 8 aa, Staphylococcus epidermidis
RMKEEKGL

SEQ ID NO: 1758214 - protein, 4 aa, Staphylococcus epidermidis
RMSE

SEQ ID NO: 1758215 - protein, 5 aa, Staphylococcus epidermidis
RNEIT

SEQ ID NO: 1758216 - protein, 5 aa, Staphylococcus epidermidis
RNHTD

SEQ ID NO: 1758217 - protein, 5 aa, Staphylococcus epidermidis
RNIKA

SEQ ID NO: 1758218 - protein, 5 aa, Staphylococcus epidermidis
RNIPG

SEQ ID NO: 1758219 - protein, 7 aa, Staphylococcus epidermidis
RNITSEM

SEQ ID NO: 1758220 - protein, 8 aa, Staphylococcus epidermidis
RNSGNNPS

SEQ ID NO: 1758221 - protein, 6 aa, Staphylococcus epidermidis
RNTGND

SEQ ID NO: 1758222 - protein, 16 aa, Staphylococcus epidermidis
RNYITTKNKRNNPERI

SEQ ID NO: 1758223 - protein, 4 aa, Staphylococcus epidermidis
RPAE

SEQ ID NO: 1758224 - protein, 8 aa, Staphylococcus epidermidis
RPANDPAL

SEQ ID NO: 1758225 - protein, 15 aa, Staphylococcus epidermidis
RPDAGAKRAAEAENV

SEQ ID NO: 1758226 - protein, 10 aa, Staphylococcus epidermidis
RPDPDAYGSQ

SEQ ID NO: 1758227 - protein, 5 aa, Staphylococcus epidermidis
RPEDL

SEQ ID NO: 1758228 - protein, 8 aa, Staphylococcus epidermidis
RPEEVTDI

SEQ ID NO: 1758229 - protein, 7 aa, Staphylococcus epidermidis
RPERRTT

SEQ ID NO: 1758230 - protein, 4 aa, Staphylococcus epidermidis
RPET

SEQ ID NO: 1758231 - protein, 5 aa, Staphylococcus epidermidis
RPFTQ

SEQ ID NO: 1758232 - protein, 5 aa, Staphylococcus epidermidis
RPGDM

SEQ ID NO: 1758233 - protein, 11 aa, Staphylococcus epidermidis
RPGEPPTVENA

SEQ ID NO: 1758234 - protein, 5 aa, Staphylococcus epidermidis
RPGPM

SEQ ID NO: 1758235 - protein, 4 aa, Staphylococcus epidermidis
RPGY

SEQ ID NO: 1758236 - protein, 6 aa, Staphylococcus epidermidis
RPNDNI

SEQ ID NO: 1758237 - protein, 4 aa, Staphylococcus epidermidis
RPNT

SEQ ID NO: 1758238 - protein, 8 aa, Staphylococcus epidermidis
RPNVGKST

SEQ ID NO: 1758239 - protein, 10 aa, Staphylococcus epidermidis
RPPGREAYPG

SEQ ID NO: 1758240 - protein, 16 aa, Staphylococcus epidermidis
RPRAQGRASAINKRTS

SEQ ID NO: 1758241 - protein, 16 aa, Staphylococcus epidermidis
RPSDSKEDRTDHGTTR

SEQ ID NO: 1758242 - protein, 8 aa, Staphylococcus epidermidis
RPSGTEPK

SEQ ID NO: 1758243 - protein, 6 aa, Staphylococcus epidermidis
RPSSLD

SEQ ID NO: 1758244 - protein, 7 aa, Staphylococcus epidermidis
RPSVGKT

SEQ ID NO: 1758245 - protein, 9 aa, Staphylococcus epidermidis
RQAPGFDEL

SEQ ID NO: 1758246 - protein, 9 aa, Staphylococcus epidermidis
RQGEAHSHR

SEQ ID NO: 1758247 - protein, 5 aa, Staphylococcus epidermidis
RQGTP

SEQ ID NO: 1758248 - protein, 13 aa, Staphylococcus epidermidis
RQINGLSKNEMAE

SEQ ID NO: 1758249 - protein, 6 aa, Staphylococcus epidermidis
RQLTTS

SEQ ID NO: 1758250 - protein, 6 aa, Staphylococcus epidermidis
RQNGST

SEQ ID NO: 1758251 - protein, 6 aa, Staphylococcus epidermidis
RQQVRD

SEQ ID NO: 1758252 - protein, 5 aa, Staphylococcus epidermidis
RQSRV

SEQ ID NO: 1758253 - protein, 6 aa, Staphylococcus epidermidis
RQTQDI

SEQ ID NO: 1758254 - protein, 7 aa, Staphylococcus epidermidis
RRERERK

SEQ ID NO: 1758255 - protein, 24 aa, Staphylococcus epidermidis
RRKDSKRKKGHRQPYTKLTIDKIN

SEQ ID NO: 1758256 - protein, 5 aa, Staphylococcus epidermidis
RRNET

SEQ ID NO: 1758257 - protein, 7 aa, Staphylococcus epidermidis
RRPKPNV

SEQ ID NO: 1758258 - protein, 9 aa, Staphylococcus epidermidis
RRPNTDELG

SEQ ID NO: 1758259 - protein, 4 aa, Staphylococcus epidermidis
RRPS

SEQ ID NO: 1758260 - protein, 5 aa, Staphylococcus epidermidis
RRTGD

SEQ ID NO: 1758261 - protein, 7 aa, Staphylococcus epidermidis
RRTKNNP

SEQ ID NO: 1758262 - protein, 8 aa, Staphylococcus epidermidis
RRTYGNAE

SEQ ID NO: 1758263 - protein, 9 aa, Staphylococcus epidermidis
RRVGGSNYQ

SEQ ID NO: 1758264 - protein, 10 aa, Staphylococcus epidermidis
RRVTGTSAKY

SEQ ID NO: 1758265 - protein, 6 aa, Staphylococcus epidermidis
RSEPHE

SEQ ID NO: 1758266 - protein, 11 aa, Staphylococcus epidermidis
RSFQGGENKPL

SEQ ID NO: 1758267 - protein, 13 aa, Staphylococcus epidermidis
RSGDYARNNKQLR

SEQ ID NO: 1758268 - protein, 8 aa, Staphylococcus epidermidis
RSGESEYY

SEQ ID NO: 1758269 - protein, 6 aa, Staphylococcus epidermidis
RSGTLT

SEQ ID NO: 1758270 - protein, 11 aa, Staphylococcus epidermidis
RSRDPEKVVEQ

SEQ ID NO: 1758271 - protein, 13 aa, Staphylococcus epidermidis
RSSGTLSGGEAQR

SEQ ID NO: 1758272 - protein, 10 aa, Staphylococcus epidermidis
RSSSQAETEA

SEQ ID NO: 1758273 - protein, 17 aa, Staphylococcus epidermidis
RSSTKYSAEVQDPESLS

SEQ ID NO: 1758274 - protein, 9 aa, Staphylococcus epidermidis
RSTNVPGST

SEQ ID NO: 1758275 - protein, 13 aa, Staphylococcus epidermidis
RTAMNTPIQGSAA

SEQ ID NO: 1758276 - protein, 11 aa, Staphylococcus epidermidis
RTATSGKNGAS

SEQ ID NO: 1758277 - protein, 5 aa, Staphylococcus epidermidis
RTDNM

SEQ ID NO: 1758278 - protein, 7 aa, Staphylococcus epidermidis
RTINSPT

SEQ ID NO: 1758279 - protein, 10 aa, Staphylococcus epidermidis
RTKDGGTHEV

SEQ ID NO: 1758280 - protein, 10 aa, Staphylococcus epidermidis
RTPSTTDYNG

SEQ ID NO: 1758281 - protein, 7 aa, Staphylococcus epidermidis
RTRRQAR

SEQ ID NO: 1758282 - protein, 8 aa, Staphylococcus epidermidis
RTSKTPLS

SEQ ID NO: 1758283 - protein, 5 aa, Staphylococcus epidermidis
RTSPH

SEQ ID NO: 1758284 - protein, 6 aa, Staphylococcus epidermidis
RVGKEP

SEQ ID NO: 1758285 - protein, 8 aa, Staphylococcus epidermidis
RVGRSEHQ

SEQ ID NO: 1758286 - protein, 8 aa, Staphylococcus epidermidis
RVGRSSRI

SEQ ID NO: 1758287 - protein, 7 aa, Staphylococcus epidermidis
RVKPGAE

SEQ ID NO: 1758288 - protein, 16 aa, Staphylococcus epidermidis
RVPETESGGRIHTSTA

SEQ ID NO: 1758289 - protein, 6 aa, Staphylococcus epidermidis
RVPHGA

SEQ ID NO: 1758290 - protein, 4 aa, Staphylococcus epidermidis
RVSI

SEQ ID NO: 1758291 - protein, 4 aa, Staphylococcus epidermidis
RWNP

SEQ ID NO: 1758292 - protein, 8 aa, Staphylococcus epidermidis
RYQPATPT

SEQ ID NO: 1758293 - protein, 7 aa, Staphylococcus epidermidis
RYQQEGK

SEQ ID NO: 1758294 - protein, 7 aa, Staphylococcus epidermidis
RYRSNND

SEQ ID NO: 1758295 - protein, 8 aa, Staphylococcus epidermidis
SAADEEIG

SEQ ID NO: 1758296 - protein, 7 aa, Staphylococcus epidermidis
SAADPAP

SEQ ID NO: 1758297 - protein, 9 aa, Staphylococcus epidermidis
SAAKDPVKM

SEQ ID NO: 1758298 - protein, 5 aa, Staphylococcus epidermidis
SADTG

SEQ ID NO: 1758299 - protein, 10 aa, Staphylococcus epidermidis
SAGGASGEAY

SEQ ID NO: 1758300 - protein, 5 aa, Staphylococcus epidermidis
SAGGV

SEQ ID NO: 1758301 - protein, 7 aa, Staphylococcus epidermidis
SAGKSSL

SEQ ID NO: 1758302 - protein, 4 aa, Staphylococcus epidermidis
SAGS

SEQ ID NO: 1758303 - protein, 4 aa, Staphylococcus epidermidis
SAGV

SEQ ID NO: 1758304 - protein, 5 aa, Staphylococcus epidermidis
SAHRT

SEQ ID NO: 1758305 - protein, 9 aa, Staphylococcus epidermidis
SAIDNAKAA

SEQ ID NO: 1758306 - protein, 17 aa, Staphylococcus epidermidis
SAISEKAIERKTGARGL

SEQ ID NO: 1758307 - protein, 11 aa, Staphylococcus epidermidis
SAKKRTKSIAY

SEQ ID NO: 1758308 - protein, 5 aa, Staphylococcus epidermidis
SANMG

SEQ ID NO: 1758309 - protein, 9 aa, Staphylococcus epidermidis
SAQAADKIR

SEQ ID NO: 1758310 - protein, 5 aa, Staphylococcus epidermidis
SAQKM

SEQ ID NO: 1758311 - protein, 6 aa, Staphylococcus epidermidis
SAQYES

SEQ ID NO: 1758312 - protein, 8 aa, Staphylococcus epidermidis
SARKYGLE

SEQ ID NO: 1758313 - protein, 5 aa, Staphylococcus epidermidis
SARPY

SEQ ID NO: 1758314 - protein, 4 aa, Staphylococcus epidermidis
SATG

SEQ ID NO: 1758315 - protein, 15 aa, Staphylococcus epidermidis
SATPSLESYARAEKN

SEQ ID NO: 1758316 - protein, 13 aa, Staphylococcus epidermidis
SAVEGTDLEAKSI

SEQ ID NO: 1758317 - protein, 6 aa, Staphylococcus epidermidis
SAYSRT

SEQ ID NO: 1758318 - protein, 7 aa, Staphylococcus epidermidis
SCDETSV

SEQ ID NO: 1758319 - protein, 8 aa, Staphylococcus epidermidis
SCTNTSNP

SEQ ID NO: 1758320 - protein, 6 aa, Staphylococcus epidermidis
SDAEGR

SEQ ID NO: 1758321 - protein, 4 aa, Staphylococcus epidermidis
SDEN

SEQ ID NO: 1758322 - protein, 5 aa, Staphylococcus epidermidis
SDEQG

SEQ ID NO: 1758323 - protein, 5 aa, Staphylococcus epidermidis
SDETT

SEQ ID NO: 1758324 - protein, 4 aa, Staphylococcus epidermidis
SDGA

SEQ ID NO: 1758325 - protein, 4 aa, Staphylococcus epidermidis
SDID

SEQ ID NO: 1758326 - protein, 4 aa, Staphylococcus epidermidis
SDIK

SEQ ID NO: 1758327 - protein, 10 aa, Staphylococcus epidermidis
SDIKSPNTEI

SEQ ID NO: 1758328 - protein, 8 aa, Staphylococcus epidermidis
SDKDKDEI

SEQ ID NO: 1758329 - protein, 6 aa, Staphylococcus epidermidis
SDKLSI

SEQ ID NO: 1758330 - protein, 5 aa, Staphylococcus epidermidis
SDLSH

SEQ ID NO: 1758331 - protein, 6 aa, Staphylococcus epidermidis
SDMKGG

SEQ ID NO: 1758332 - protein, 9 aa, Staphylococcus epidermidis
SDPDREGEA

SEQ ID NO: 1758333 - protein, 8 aa, Staphylococcus epidermidis
SDRPPKEI

SEQ ID NO: 1758334 - protein, 4 aa, Staphylococcus epidermidis
SDRT

SEQ ID NO: 1758335 - protein, 8 aa, Staphylococcus epidermidis
SDSQAMGR

SEQ ID NO: 1758336 - protein, 6 aa, Staphylococcus epidermidis
SDVPTY

SEQ ID NO: 1758337 - protein, 11 aa, Staphylococcus epidermidis
SEASVGKDTMT

SEQ ID NO: 1758338 - protein, 8 aa, Staphylococcus epidermidis
SEEDKTLE

SEQ ID NO: 1758339 - protein, 6 aa, Staphylococcus epidermidis
SEEERF

SEQ ID NO: 1758340 - protein, 9 aa, Staphylococcus epidermidis
SEEGGTEIE

SEQ ID NO: 1758341 - protein, 16 aa, Staphylococcus epidermidis
SEELTEESESKRPSVQ

SEQ ID NO: 1758342 - protein, 8 aa, Staphylococcus epidermidis
SEENEEKY

SEQ ID NO: 1758343 - protein, 10 aa, Staphylococcus epidermidis
SEGDKDALHT

SEQ ID NO: 1758344 - protein, 6 aa, Staphylococcus epidermidis
SEGPKR

SEQ ID NO: 1758345 - protein, 7 aa, Staphylococcus epidermidis
SEGQGMS

SEQ ID NO: 1758346 - protein, 7 aa, Staphylococcus epidermidis
SEGRNRQ

SEQ ID NO: 1758347 - protein, 23 aa, Staphylococcus epidermidis
SEGVITDKEARKRNVGGEIIAYV

SEQ ID NO: 1758348 - protein, 13 aa, Staphylococcus epidermidis
SEIEEQIKSSKEE

SEQ ID NO: 1758349 - protein, 6 aa, Staphylococcus epidermidis
SEITGV

SEQ ID NO: 1758350 - protein, 6 aa, Staphylococcus epidermidis
SEITPL

SEQ ID NO: 1758351 - protein, 4 aa, Staphylococcus epidermidis
SEKL

SEQ ID NO: 1758352 - protein, 4 aa, Staphylococcus epidermidis
SEKQ

SEQ ID NO: 1758353 - protein, 4 aa, Staphylococcus epidermidis
SEKV

SEQ ID NO: 1758354 - protein, 6 aa, Staphylococcus epidermidis
SELGTA

SEQ ID NO: 1758355 - protein, 9 aa, Staphylococcus epidermidis
SELNESYEK

SEQ ID NO: 1758356 - protein, 8 aa, Staphylococcus epidermidis
SENHHREL

SEQ ID NO: 1758357 - protein, 8 aa, Staphylococcus epidermidis
SENQTDEA

SEQ ID NO: 1758358 - protein, 4 aa, Staphylococcus epidermidis
SERL

SEQ ID NO: 1758359 - protein, 9 aa, Staphylococcus epidermidis
SESGTGAGV

SEQ ID NO: 1758360 - protein, 11 aa, Staphylococcus epidermidis
SESNEISSKEI

SEQ ID NO: 1758361 - protein, 5 aa, Staphylococcus epidermidis
SETDM

SEQ ID NO: 1758362 - protein, 6 aa, Staphylococcus epidermidis
SETDPI

SEQ ID NO: 1758363 - protein, 5 aa, Staphylococcus epidermidis
SETQG

SEQ ID NO: 1758364 - protein, 5 aa, Staphylococcus epidermidis
SEVED

SEQ ID NO: 1758365 - protein, 4 aa, Staphylococcus epidermidis
SEWN

SEQ ID NO: 1758366 - protein, 8 aa, Staphylococcus epidermidis
SFATSSGM

SEQ ID NO: 1758367 - protein, 6 aa, Staphylococcus epidermidis
SFDGED

SEQ ID NO: 1758368 - protein, 5 aa, Staphylococcus epidermidis
SFESE

SEQ ID NO: 1758369 - protein, 11 aa, Staphylococcus epidermidis
SFTGSTDVGYG

SEQ ID NO: 1758370 - protein, 5 aa, Staphylococcus epidermidis
SGADI

SEQ ID NO: 1758371 - protein, 8 aa, Staphylococcus epidermidis
SGAGKSTL

SEQ ID NO: 1758372 - protein, 6 aa, Staphylococcus epidermidis
SGAGPT

SEQ ID NO: 1758373 - protein, 10 aa, Staphylococcus epidermidis
SGAISKSNTT

SEQ ID NO: 1758374 - protein, 6 aa, Staphylococcus epidermidis
SGAKIS

SEQ ID NO: 1758375 - protein, 4 aa, Staphylococcus epidermidis
SGAL

SEQ ID NO: 1758376 - protein, 11 aa, Staphylococcus epidermidis
SGARGNASNFT

SEQ ID NO: 1758377 - protein, 11 aa, Staphylococcus epidermidis
SGATESNNTAI

SEQ ID NO: 1758378 - protein, 4 aa, Staphylococcus epidermidis
SGAV

SEQ ID NO: 1758379 - protein, 8 aa, Staphylococcus epidermidis
SGCGKTTT

SEQ ID NO: 1758380 - protein, 7 aa, Staphylococcus epidermidis
SGDTSDY

SEQ ID NO: 1758381 - protein, 9 aa, Staphylococcus epidermidis
SGETGSGKS

SEQ ID NO: 1758382 - protein, 7 aa, Staphylococcus epidermidis
SGGARMQ

SEQ ID NO: 1758383 - protein, 8 aa, Staphylococcus epidermidis
SGGGGNAQ

SEQ ID NO: 1758384 - protein, 11 aa, Staphylococcus epidermidis
SGGIQEEAPSL

SEQ ID NO: 1758385 - protein, 5 aa, Staphylococcus epidermidis
SGGKR

SEQ ID NO: 1758386 - protein, 5 aa, Staphylococcus epidermidis
SGGLG

SEQ ID NO: 1758387 - protein, 9 aa, Staphylococcus epidermidis
SGGNNAGHT

SEQ ID NO: 1758388 - protein, 6 aa, Staphylococcus epidermidis
SGGQRG

SEQ ID NO: 1758389 - protein, 11 aa, Staphylococcus epidermidis
SGGSSEKYNQY

SEQ ID NO: 1758390 - protein, 6 aa, Staphylococcus epidermidis
SGGTDN

SEQ ID NO: 1758391 - protein, 5 aa, Staphylococcus epidermidis
SGGTL

SEQ ID NO: 1758392 - protein, 6 aa, Staphylococcus epidermidis
SGIGPV

SEQ ID NO: 1758393 - protein, 8 aa, Staphylococcus epidermidis
SGINGEIR

SEQ ID NO: 1758394 - protein, 4 aa, Staphylococcus epidermidis
SGLP

SEQ ID NO: 1758395 - protein, 11 aa, Staphylococcus epidermidis
SGLTSQPSANS

SEQ ID NO: 1758396 - protein, 5 aa, Staphylococcus epidermidis
SGMSS

SEQ ID NO: 1758397 - protein, 6 aa, Staphylococcus epidermidis
SGNDDN

SEQ ID NO: 1758398 - protein, 4 aa, Staphylococcus epidermidis
SGNL

SEQ ID NO: 1758399 - protein, 7 aa, Staphylococcus epidermidis
SGNPSAC

SEQ ID NO: 1758400 - protein, 18 aa, Staphylococcus epidermidis
SGNVDSNRLRTGTMTEED

SEQ ID NO: 1758401 - protein, 4 aa, Staphylococcus epidermidis
SGPD

SEQ ID NO: 1758402 - protein, 7 aa, Staphylococcus epidermidis
SGPRAGL

SEQ ID NO: 1758403 - protein, 4 aa, Staphylococcus epidermidis
SGQR

SEQ ID NO: 1758404 - protein, 11 aa, Staphylococcus epidermidis
SGRAGRHEKEG

SEQ ID NO: 1758405 - protein, 14 aa, Staphylococcus epidermidis
SGRGLGHTGGTIDK

SEQ ID NO: 1758406 - protein, 10 aa, Staphylococcus epidermidis
SGRSNVGKST

SEQ ID NO: 1758407 - protein, 14 aa, Staphylococcus epidermidis
SGSACTAGSTTPSH

SEQ ID NO: 1758408 - protein, 10 aa, Staphylococcus epidermidis
SGSGKSTVSV

SEQ ID NO: 1758409 - protein, 10 aa, Staphylococcus epidermidis
SGSLDKQAET

SEQ ID NO: 1758410 - protein, 9 aa, Staphylococcus epidermidis
SGSNPKYNA

SEQ ID NO: 1758411 - protein, 7 aa, Staphylococcus epidermidis
SGSSRKI

SEQ ID NO: 1758412 - protein, 11 aa, Staphylococcus epidermidis
SGSTGEPKGVQ

SEQ ID NO: 1758413 - protein, 11 aa, Staphylococcus epidermidis
SGTDAKTGSPD

SEQ ID NO: 1758414 - protein, 7 aa, Staphylococcus epidermidis
SGTDDYV

SEQ ID NO: 1758415 - protein, 5 aa, Staphylococcus epidermidis
SGTEA

SEQ ID NO: 1758416 - protein, 6 aa, Staphylococcus epidermidis
SGTSIR

SEQ ID NO: 1758417 - protein, 6 aa, Staphylococcus epidermidis
SGTSVL

SEQ ID NO: 1758418 - protein, 4 aa, Staphylococcus epidermidis
SGVI

SEQ ID NO: 1758419 - protein, 6 aa, Staphylococcus epidermidis
SGVPTA

SEQ ID NO: 1758420 - protein, 7 aa, Staphylococcus epidermidis
SHEDRKV

SEQ ID NO: 1758421 - protein, 5 aa, Staphylococcus epidermidis
SHKDR

SEQ ID NO: 1758422 - protein, 7 aa, Staphylococcus epidermidis
SHKETYL

SEQ ID NO: 1758423 - protein, 10 aa, Staphylococcus epidermidis
SHKSDDEWRE

SEQ ID NO: 1758424 - protein, 19 aa, Staphylococcus epidermidis
SHNHPSAIEPYQGAATGVG

SEQ ID NO: 1758425 - protein, 4 aa, Staphylococcus epidermidis
SHPA

SEQ ID NO: 1758426 - protein, 4 aa, Staphylococcus epidermidis
SHPG

SEQ ID NO: 1758427 - protein, 6 aa, Staphylococcus epidermidis
SHPNGD

SEQ ID NO: 1758428 - protein, 5 aa, Staphylococcus epidermidis
SHRMP

SEQ ID NO: 1758429 - protein, 9 aa, Staphylococcus epidermidis
SHRTSNDKE

SEQ ID NO: 1758430 - protein, 11 aa, Staphylococcus epidermidis
SIEADKDGSTV

SEQ ID NO: 1758431 - protein, 5 aa, Staphylococcus epidermidis
SIPQG

SEQ ID NO: 1758432 - protein, 8 aa, Staphylococcus epidermidis
SIQQAEDR

SEQ ID NO: 1758433 - protein, 5 aa, Staphylococcus epidermidis
SIQTR

SEQ ID NO: 1758434 - protein, 7 aa, Staphylococcus epidermidis
SIRGSDV

SEQ ID NO: 1758435 - protein, 6 aa, Staphylococcus epidermidis
SITEGT

SEQ ID NO: 1758436 - protein, 9 aa, Staphylococcus epidermidis
SKADNTPFI

SEQ ID NO: 1758437 - protein, 7 aa, Staphylococcus epidermidis
SKAGITV

SEQ ID NO: 1758438 - protein, 11 aa, Staphylococcus epidermidis
SKAYQSTTGIA

SEQ ID NO: 1758439 - protein, 7 aa, Staphylococcus epidermidis
SKDSGIE

SEQ ID NO: 1758440 - protein, 8 aa, Staphylococcus epidermidis
SKEAQAEA

SEQ ID NO: 1758441 - protein, 7 aa, Staphylococcus epidermidis
SKEPHQN

SEQ ID NO: 1758442 - protein, 6 aa, Staphylococcus epidermidis
SKEPVR

SEQ ID NO: 1758443 - protein, 6 aa, Staphylococcus epidermidis
SKFDSD

SEQ ID NO: 1758444 - protein, 5 aa, Staphylococcus epidermidis
SKGLT

SEQ ID NO: 1758445 - protein, 8 aa, Staphylococcus epidermidis
SKGREPYQ

SEQ ID NO: 1758446 - protein, 23 aa, Staphylococcus epidermidis
SKGSLAGVDGRIQSRSYENQEGR

SEQ ID NO: 1758447 - protein, 9 aa, Staphylococcus epidermidis
SKHSYGPSR

SEQ ID NO: 1758448 - protein, 7 aa, Staphylococcus epidermidis
SKHTAPH

SEQ ID NO: 1758449 - protein, 8 aa, Staphylococcus epidermidis
SKIGKDDF

SEQ ID NO: 1758450 - protein, 20 aa, Staphylococcus epidermidis
SKMFSPSPAHFGAEPNSNTN

SEQ ID NO: 1758451 - protein, 5 aa, Staphylococcus epidermidis
SKNDY

SEQ ID NO: 1758452 - protein, 7 aa, Staphylococcus epidermidis
SKNPDIT

SEQ ID NO: 1758453 - protein, 7 aa, Staphylococcus epidermidis
SKPSDLI

SEQ ID NO: 1758454 - protein, 8 aa, Staphylococcus epidermidis
SKRIKSNS

SEQ ID NO: 1758455 - protein, 5 aa, Staphylococcus epidermidis
SKRNP

SEQ ID NO: 1758456 - protein, 9 aa, Staphylococcus epidermidis
SKRTPDGEF

SEQ ID NO: 1758457 - protein, 8 aa, Staphylococcus epidermidis
SKSGSVEL

SEQ ID NO: 1758458 - protein, 8 aa, Staphylococcus epidermidis
SKSHSATG

SEQ ID NO: 1758459 - protein, 7 aa, Staphylococcus epidermidis
SKSLKGL

SEQ ID NO: 1758460 - protein, 9 aa, Staphylococcus epidermidis
SKTDRASKV

SEQ ID NO: 1758461 - protein, 8 aa, Staphylococcus epidermidis
SKTIDGEK

SEQ ID NO: 1758462 - protein, 4 aa, Staphylococcus epidermidis
SKTV

SEQ ID NO: 1758463 - protein, 7 aa, Staphylococcus epidermidis
SKYKDGK

SEQ ID NO: 1758464 - protein, 8 aa, Staphylococcus epidermidis
SKYTRSKL

SEQ ID NO: 1758465 - protein, 7 aa, Staphylococcus epidermidis
SLAKGEK

SEQ ID NO: 1758466 - protein, 8 aa, Staphylococcus epidermidis
SLAPGSKV

SEQ ID NO: 1758467 - protein, 6 aa, Staphylococcus epidermidis
SLDTKG

SEQ ID NO: 1758468 - protein, 8 aa, Staphylococcus epidermidis
SLGSNTPI

SEQ ID NO: 1758469 - protein, 15 aa, Staphylococcus epidermidis
SLPDLPDKAQLSIFD

SEQ ID NO: 1758470 - protein, 10 aa, Staphylococcus epidermidis
SLPQGSTATD

SEQ ID NO: 1758471 - protein, 7 aa, Staphylococcus epidermidis
SLTPGQQ

SEQ ID NO: 1758472 - protein, 5 aa, Staphylococcus epidermidis
SLTQN

SEQ ID NO: 1758473 - protein, 14 aa, Staphylococcus epidermidis
SLYGPTVGDSVRLG

SEQ ID NO: 1758474 - protein, 10 aa, Staphylococcus epidermidis
SNDLDEQTIT

SEQ ID NO: 1758475 - protein, 4 aa, Staphylococcus epidermidis
SNDY

SEQ ID NO: 1758476 - protein, 14 aa, Staphylococcus epidermidis
SNGGRDGRVFSPDN

SEQ ID NO: 1758477 - protein, 5 aa, Staphylococcus epidermidis
SNGLH

SEQ ID NO: 1758478 - protein, 10 aa, Staphylococcus epidermidis
SNGPGDPDEV

SEQ ID NO: 1758479 - protein, 6 aa, Staphylococcus epidermidis
SNKNRT

SEQ ID NO: 1758480 - protein, 10 aa, Staphylococcus epidermidis
SNNPKKFEGL

SEQ ID NO: 1758481 - protein, 7 aa, Staphylococcus epidermidis
SNPHERL

SEQ ID NO: 1758482 - protein, 7 aa, Staphylococcus epidermidis
SNTAEFG

SEQ ID NO: 1758483 - protein, 4 aa, Staphylococcus epidermidis
SNTS

SEQ ID NO: 1758484 - protein, 5 aa, Staphylococcus epidermidis
SNVDN

SEQ ID NO: 1758485 - protein, 5 aa, Staphylococcus epidermidis
SPCTE

SEQ ID NO: 1758486 - protein, 4 aa, Staphylococcus epidermidis
SPDA

SEQ ID NO: 1758487 - protein, 9 aa, Staphylococcus epidermidis
SPEDATRTE

SEQ ID NO: 1758488 - protein, 8 aa, Staphylococcus epidermidis
SPEGEEEI

SEQ ID NO: 1758489 - protein, 8 aa, Staphylococcus epidermidis
SPGGSVTA

SEQ ID NO: 1758490 - protein, 9 aa, Staphylococcus epidermidis
SPGPGHPLD

SEQ ID NO: 1758491 - protein, 7 aa, Staphylococcus epidermidis
SPGVAEP

SEQ ID NO: 1758492 - protein, 8 aa, Staphylococcus epidermidis
SPHPSPLS

SEQ ID NO: 1758493 - protein, 5 aa, Staphylococcus epidermidis
SPIEG

SEQ ID NO: 1758494 - protein, 12 aa, Staphylococcus epidermidis
SPIGTGRGINNP

SEQ ID NO: 1758495 - protein, 4 aa, Staphylococcus epidermidis
SPIN

SEQ ID NO: 1758496 - protein, 5 aa, Staphylococcus epidermidis
SPKAI

SEQ ID NO: 1758497 - protein, 8 aa, Staphylococcus epidermidis
SPKTETGI

SEQ ID NO: 1758498 - protein, 5 aa, Staphylococcus epidermidis
SPLSE

SEQ ID NO: 1758499 - protein, 11 aa, Staphylococcus epidermidis
SPMDGIGPEDI

SEQ ID NO: 1758500 - protein, 10 aa, Staphylococcus epidermidis
SPNAKDPQKR

SEQ ID NO: 1758501 - protein, 6 aa, Staphylococcus epidermidis
SPPPHH

SEQ ID NO: 1758502 - protein, 8 aa, Staphylococcus epidermidis
SPQSGTIS

SEQ ID NO: 1758503 - protein, 4 aa, Staphylococcus epidermidis
SPSI

SEQ ID NO: 1758504 - protein, 4 aa, Staphylococcus epidermidis
SPTG

SEQ ID NO: 1758505 - protein, 11 aa, Staphylococcus epidermidis
SPVQGSEQGGV

SEQ ID NO: 1758506 - protein, 4 aa, Staphylococcus epidermidis
SQEQ

SEQ ID NO: 1758507 - protein, 9 aa, Staphylococcus epidermidis
SQKETGERI

SEQ ID NO: 1758508 - protein, 5 aa, Staphylococcus epidermidis
SQKQI

SEQ ID NO: 1758509 - protein, 11 aa, Staphylococcus epidermidis
SQNQPVGRRSL

SEQ ID NO: 1758510 - protein, 13 aa, Staphylococcus epidermidis
SQPGNPLNRSTLP

SEQ ID NO: 1758511 - protein, 6 aa, Staphylococcus epidermidis
SQPREV

SEQ ID NO: 1758512 - protein, 7 aa, Staphylococcus epidermidis
SQSNMPS

SEQ ID NO: 1758513 - protein, 4 aa, Staphylococcus epidermidis
SQTV

SEQ ID NO: 1758514 - protein, 5 aa, Staphylococcus epidermidis
SQVEA

SEQ ID NO: 1758515 - protein, 6 aa, Staphylococcus epidermidis
SQVGQR

SEQ ID NO: 1758516 - protein, 5 aa, Staphylococcus epidermidis
SRGQT

SEQ ID NO: 1758517 - protein, 8 aa, Staphylococcus epidermidis
SRGSVGSS

SEQ ID NO: 1758518 - protein, 5 aa, Staphylococcus epidermidis
SRNEG

SEQ ID NO: 1758519 - protein, 10 aa, Staphylococcus epidermidis
SRQNQPSNLS

SEQ ID NO: 1758520 - protein, 10 aa, Staphylococcus epidermidis
SRRKKTAAKK

SEQ ID NO: 1758521 - protein, 7 aa, Staphylococcus epidermidis
SRTYSSY

SEQ ID NO: 1758522 - protein, 7 aa, Staphylococcus epidermidis
SRVPDDL

SEQ ID NO: 1758523 - protein, 9 aa, Staphylococcus epidermidis
SRYDKGEAA

SEQ ID NO: 1758524 - protein, 25 aa, Staphylococcus epidermidis
SSAGRIAARARGRYGGRPEKLNKQD

SEQ ID NO: 1758525 - protein, 7 aa, Staphylococcus epidermidis
SSDETTY

SEQ ID NO: 1758526 - protein, 9 aa, Staphylococcus epidermidis
SSDSHPFYT

SEQ ID NO: 1758527 - protein, 7 aa, Staphylococcus epidermidis
SSDTPTL

SEQ ID NO: 1758528 - protein, 5 aa, Staphylococcus epidermidis
SSEPL

SEQ ID NO: 1758529 - protein, 6 aa, Staphylococcus epidermidis
SSETES

SEQ ID NO: 1758530 - protein, 8 aa, Staphylococcus epidermidis
SSFKDQAV

SEQ ID NO: 1758531 - protein, 4 aa, Staphylococcus epidermidis
SSGA

SEQ ID NO: 1758532 - protein, 6 aa, Staphylococcus epidermidis
SSGGFG

SEQ ID NO: 1758533 - protein, 8 aa, Staphylococcus epidermidis
SSGTEATL

SEQ ID NO: 1758534 - protein, 9 aa, Staphylococcus epidermidis
SSNPVAGNV

SEQ ID NO: 1758535 - protein, 6 aa, Staphylococcus epidermidis
SSPESF

SEQ ID NO: 1758536 - protein, 14 aa, Staphylococcus epidermidis
SSPIPGNTKSINRT

SEQ ID NO: 1758537 - protein, 7 aa, Staphylococcus epidermidis
SSPSNYL

SEQ ID NO: 1758538 - protein, 7 aa, Staphylococcus epidermidis
SSPYDAK

SEQ ID NO: 1758539 - protein, 10 aa, Staphylococcus epidermidis
SSRAKWGERS

SEQ ID NO: 1758540 - protein, 8 aa, Staphylococcus epidermidis
SSSAKGQE

SEQ ID NO: 1758541 - protein, 9 aa, Staphylococcus epidermidis
SSSAKSKIK

SEQ ID NO: 1758542 - protein, 6 aa, Staphylococcus epidermidis
SSSDTE

SEQ ID NO: 1758543 - protein, 8 aa, Staphylococcus epidermidis
SSSQYGGC

SEQ ID NO: 1758544 - protein, 6 aa, Staphylococcus epidermidis
SSTARA

SEQ ID NO: 1758545 - protein, 11 aa, Staphylococcus epidermidis
SSTRESDGFKD

SEQ ID NO: 1758546 - protein, 13 aa, Staphylococcus epidermidis
SSVEGQLDEKNTI

SEQ ID NO: 1758547 - protein, 4 aa, Staphylococcus epidermidis
SSVN

SEQ ID NO: 1758548 - protein, 8 aa, Staphylococcus epidermidis
STAKELGT

SEQ ID NO: 1758549 - protein, 4 aa, Staphylococcus epidermidis
STCN

SEQ ID NO: 1758550 - protein, 4 aa, Staphylococcus epidermidis
STDD

SEQ ID NO: 1758551 - protein, 6 aa, Staphylococcus epidermidis
STDKRG

SEQ ID NO: 1758552 - protein, 12 aa, Staphylococcus epidermidis
STDLQKSENEKH

SEQ ID NO: 1758553 - protein, 8 aa, Staphylococcus epidermidis
STDPASNL

SEQ ID NO: 1758554 - protein, 4 aa, Staphylococcus epidermidis
STDQ

SEQ ID NO: 1758555 - protein, 5 aa, Staphylococcus epidermidis
STGNE

SEQ ID NO: 1758556 - protein, 17 aa, Staphylococcus epidermidis
STGNTSASAAAYAARAG

SEQ ID NO: 1758557 - protein, 8 aa, Staphylococcus epidermidis
STGQKRRL

SEQ ID NO: 1758558 - protein, 4 aa, Staphylococcus epidermidis
STIS

SEQ ID NO: 1758559 - protein, 15 aa, Staphylococcus epidermidis
STKGSAKSDDVTKVQ

SEQ ID NO: 1758560 - protein, 5 aa, Staphylococcus epidermidis
STKSH

SEQ ID NO: 1758561 - protein, 9 aa, Staphylococcus epidermidis
STLEEAKGA

SEQ ID NO: 1758562 - protein, 5 aa, Staphylococcus epidermidis
STNAL

SEQ ID NO: 1758563 - protein, 5 aa, Staphylococcus epidermidis
STNQV

SEQ ID NO: 1758564 - protein, 4 aa, Staphylococcus epidermidis
STPG

SEQ ID NO: 1758565 - protein, 4 aa, Staphylococcus epidermidis
STPM

SEQ ID NO: 1758566 - protein, 8 aa, Staphylococcus epidermidis
STPSESLT

SEQ ID NO: 1758567 - protein, 13 aa, Staphylococcus epidermidis
STPSGSTAYNKAL

SEQ ID NO: 1758568 - protein, 7 aa, Staphylococcus epidermidis
STRIPAV

SEQ ID NO: 1758569 - protein, 6 aa, Staphylococcus epidermidis
STSERG

SEQ ID NO: 1758570 - protein, 4 aa, Staphylococcus epidermidis
STSQ

SEQ ID NO: 1758571 - protein, 9 aa, Staphylococcus epidermidis
STTGKTGVE

SEQ ID NO: 1758572 - protein, 7 aa, Staphylococcus epidermidis
STTGRYT

SEQ ID NO: 1758573 - protein, 6 aa, Staphylococcus epidermidis
SVDDDQ

SEQ ID NO: 1758574 - protein, 7 aa, Staphylococcus epidermidis
SVGEPKP

SEQ ID NO: 1758575 - protein, 4 aa, Staphylococcus epidermidis
SVGK

SEQ ID NO: 1758576 - protein, 6 aa, Staphylococcus epidermidis
SVNETS

SEQ ID NO: 1758577 - protein, 16 aa, Staphylococcus epidermidis
SVRPPEPYKGKGIRYQ

SEQ ID NO: 1758578 - protein, 5 aa, Staphylococcus epidermidis
SVSAN

SEQ ID NO: 1758579 - protein, 5 aa, Staphylococcus epidermidis
SVSDF

SEQ ID NO: 1758580 - protein, 15 aa, Staphylococcus epidermidis
SVTEGHPDKIADQVS

SEQ ID NO: 1758581 - protein, 11 aa, Staphylococcus epidermidis
SVTEGTDAQAE

SEQ ID NO: 1758582 - protein, 9 aa, Staphylococcus epidermidis
SYGSRRGNH

SEQ ID NO: 1758583 - protein, 25 aa, Staphylococcus epidermidis
SYGTQSKIIKEDKDRLSGEDTREGL

SEQ ID NO: 1758584 - protein, 6 aa, Staphylococcus epidermidis
SYSEKE

SEQ ID NO: 1758585 - protein, 12 aa, Staphylococcus epidermidis
SYSNAKKLYGED

SEQ ID NO: 1758586 - protein, 9 aa, Staphylococcus epidermidis
SYVNGDGQP

SEQ ID NO: 1758587 - protein, 4 aa, Staphylococcus epidermidis
SYYE

SEQ ID NO: 1758588 - protein, 5 aa, Staphylococcus epidermidis
TADGM

SEQ ID NO: 1758589 - protein, 19 aa, Staphylococcus epidermidis
TAEELDQNSGQTPGIPTGY

SEQ ID NO: 1758590 - protein, 5 aa, Staphylococcus epidermidis
TAGAN

SEQ ID NO: 1758591 - protein, 12 aa, Staphylococcus epidermidis
TAGDNKLGGDDF

SEQ ID NO: 1758592 - protein, 22 aa, Staphylococcus epidermidis
TAGGGGKGIRVARDEKELETGY

SEQ ID NO: 1758593 - protein, 11 aa, Staphylococcus epidermidis
TAGQKGTGKWT

SEQ ID NO: 1758594 - protein, 8 aa, Staphylococcus epidermidis
TAGTVSKS

SEQ ID NO: 1758595 - protein, 10 aa, Staphylococcus epidermidis
TAHREHASNV

SEQ ID NO: 1758596 - protein, 7 aa, Staphylococcus epidermidis
TAIDYKG

SEQ ID NO: 1758597 - protein, 12 aa, Staphylococcus epidermidis
TAIGKSGAKNAG

SEQ ID NO: 1758598 - protein, 9 aa, Staphylococcus epidermidis
TAKESRIQR

SEQ ID NO: 1758599 - protein, 6 aa, Staphylococcus epidermidis
TALSSK

SEQ ID NO: 1758600 - protein, 5 aa, Staphylococcus epidermidis
TANNA

SEQ ID NO: 1758601 - protein, 5 aa, Staphylococcus epidermidis
TANWT

SEQ ID NO: 1758602 - protein, 6 aa, Staphylococcus epidermidis
TAPTGH

SEQ ID NO: 1758603 - protein, 6 aa, Staphylococcus epidermidis
TAQPEG

SEQ ID NO: 1758604 - protein, 10 aa, Staphylococcus epidermidis
TARDSNRGGC

SEQ ID NO: 1758605 - protein, 17 aa, Staphylococcus epidermidis
TARRGRVDGMEPRGNAQ

SEQ ID NO: 1758606 - protein, 9 aa, Staphylococcus epidermidis
TASAAMGRT

SEQ ID NO: 1758607 - protein, 5 aa, Staphylococcus epidermidis
TASAL

SEQ ID NO: 1758608 - protein, 8 aa, Staphylococcus epidermidis
TATAEVQQ

SEQ ID NO: 1758609 - protein, 12 aa, Staphylococcus epidermidis
TATASKEPRDGD

SEQ ID NO: 1758610 - protein, 10 aa, Staphylococcus epidermidis
TAVATRGQAP

SEQ ID NO: 1758611 - protein, 10 aa, Staphylococcus epidermidis
TAVETGRVSN

SEQ ID NO: 1758612 - protein, 5 aa, Staphylococcus epidermidis
TAYED

SEQ ID NO: 1758613 - protein, 4 aa, Staphylococcus epidermidis
TCTG

SEQ ID NO: 1758614 - protein, 12 aa, Staphylococcus epidermidis
TDCPNIKNETDR

SEQ ID NO: 1758615 - protein, 15 aa, Staphylococcus epidermidis
TDEIKPSGTGESPLA

SEQ ID NO: 1758616 - protein, 4 aa, Staphylococcus epidermidis
TDEP

SEQ ID NO: 1758617 - protein, 6 aa, Staphylococcus epidermidis
TDGGVP

SEQ ID NO: 1758618 - protein, 17 aa, Staphylococcus epidermidis
TDGQALNLSKAESKIQI

SEQ ID NO: 1758619 - protein, 14 aa, Staphylococcus epidermidis
TDGTPFEGDPRANL

SEQ ID NO: 1758620 - protein, 7 aa, Staphylococcus epidermidis
TDKRVSP

SEQ ID NO: 1758621 - protein, 7 aa, Staphylococcus epidermidis
TDLGENC

SEQ ID NO: 1758622 - protein, 6 aa, Staphylococcus epidermidis
TDQKIQ

SEQ ID NO: 1758623 - protein, 5 aa, Staphylococcus epidermidis
TDQQL

SEQ ID NO: 1758624 - protein, 4 aa, Staphylococcus epidermidis
TDSG

SEQ ID NO: 1758625 - protein, 7 aa, Staphylococcus epidermidis
TDVEDAV

SEQ ID NO: 1758626 - protein, 8 aa, Staphylococcus epidermidis
TEARKHGK

SEQ ID NO: 1758627 - protein, 5 aa, Staphylococcus epidermidis
TEDAI

SEQ ID NO: 1758628 - protein, 18 aa, Staphylococcus epidermidis
TEDGTDEIISTRSKTYQK

SEQ ID NO: 1758629 - protein, 21 aa, Staphylococcus epidermidis
TEEGIGQTTAVGIGGDPVNGT

SEQ ID NO: 1758630 - protein, 9 aa, Staphylococcus epidermidis
TEGSIEPKN

SEQ ID NO: 1758631 - protein, 5 aa, Staphylococcus epidermidis
TEHPG

SEQ ID NO: 1758632 - protein, 6 aa, Staphylococcus epidermidis
TEKFNG

SEQ ID NO: 1758633 - protein, 5 aa, Staphylococcus epidermidis
TEMGA

SEQ ID NO: 1758634 - protein, 12 aa, Staphylococcus epidermidis
TEMGSNPTELDQ

SEQ ID NO: 1758635 - protein, 8 aa, Staphylococcus epidermidis
TENATTAR

SEQ ID NO: 1758636 - protein, 9 aa, Staphylococcus epidermidis
TENTLTDER

SEQ ID NO: 1758637 - protein, 27 aa, Staphylococcus epidermidis
TERHESRRIDDQLRGRSGRQGDRGDSR

SEQ ID NO: 1758638 - protein, 5 aa, Staphylococcus epidermidis
TERLQ

SEQ ID NO: 1758639 - protein, 15 aa, Staphylococcus epidermidis
TESPPGRNTDPLQDE

SEQ ID NO: 1758640 - protein, 4 aa, Staphylococcus epidermidis
TESY

SEQ ID NO: 1758641 - protein, 15 aa, Staphylococcus epidermidis
TFPDGTKLITVHHPI

SEQ ID NO: 1758642 - protein, 4 aa, Staphylococcus epidermidis
TGAC

SEQ ID NO: 1758643 - protein, 16 aa, Staphylococcus epidermidis
TGDANDYVGKGLSGGT

SEQ ID NO: 1758644 - protein, 5 aa, Staphylococcus epidermidis
TGDLS

SEQ ID NO: 1758645 - protein, 6 aa, Staphylococcus epidermidis
TGDMPF

SEQ ID NO: 1758646 - protein, 14 aa, Staphylococcus epidermidis
TGDPSKVGHLPGAT

SEQ ID NO: 1758647 - protein, 23 aa, Staphylococcus epidermidis
TGDQNTQDAPHRKGDKRRARAAA

SEQ ID NO: 1758648 - protein, 7 aa, Staphylococcus epidermidis
TGDYPAG

SEQ ID NO: 1758649 - protein, 6 aa, Staphylococcus epidermidis
TGEAHI

SEQ ID NO: 1758650 - protein, 4 aa, Staphylococcus epidermidis
TGEE

SEQ ID NO: 1758651 - protein, 13 aa, Staphylococcus epidermidis
TGELKNKKGVNLP

SEQ ID NO: 1758652 - protein, 7 aa, Staphylococcus epidermidis
TGEQQTV

SEQ ID NO: 1758653 - protein, 7 aa, Staphylococcus epidermidis
TGEVKEQ

SEQ ID NO: 1758654 - protein, 7 aa, Staphylococcus epidermidis
TGFGTGG

SEQ ID NO: 1758655 - protein, 6 aa, Staphylococcus epidermidis
TGGCPH

SEQ ID NO: 1758656 - protein, 7 aa, Staphylococcus epidermidis
TGGEPMF

SEQ ID NO: 1758657 - protein, 4 aa, Staphylococcus epidermidis
TGGG

SEQ ID NO: 1758658 - protein, 7 aa, Staphylococcus epidermidis
TGGQHRS

SEQ ID NO: 1758659 - protein, 10 aa, Staphylococcus epidermidis
TGGQPNEEDY

SEQ ID NO: 1758660 - protein, 17 aa, Staphylococcus epidermidis
TGGTSVPQTGSTGDGYK

SEQ ID NO: 1758661 - protein, 8 aa, Staphylococcus epidermidis
TGGYGQDL

SEQ ID NO: 1758662 - protein, 5 aa, Staphylococcus epidermidis
TGGYN

SEQ ID NO: 1758663 - protein, 6 aa, Staphylococcus epidermidis
TGHGVG

SEQ ID NO: 1758664 - protein, 5 aa, Staphylococcus epidermidis
TGIDT

SEQ ID NO: 1758665 - protein, 8 aa, Staphylococcus epidermidis
TGISEPVP

SEQ ID NO: 1758666 - protein, 8 aa, Staphylococcus epidermidis
TGKGPAVR

SEQ ID NO: 1758667 - protein, 8 aa, Staphylococcus epidermidis
TGKGQAVN

SEQ ID NO: 1758668 - protein, 10 aa, Staphylococcus epidermidis
TGKGSESGDA

SEQ ID NO: 1758669 - protein, 4 aa, Staphylococcus epidermidis
TGKK

SEQ ID NO: 1758670 - protein, 12 aa, Staphylococcus epidermidis
TGKSSTSEDANE

SEQ ID NO: 1758671 - protein, 7 aa, Staphylococcus epidermidis
TGKTADE

SEQ ID NO: 1758672 - protein, 8 aa, Staphylococcus epidermidis
TGNSADVR

SEQ ID NO: 1758673 - protein, 9 aa, Staphylococcus epidermidis
TGNSGTTTR

SEQ ID NO: 1758674 - protein, 5 aa, Staphylococcus epidermidis
TGNTK

SEQ ID NO: 1758675 - protein, 11 aa, Staphylococcus epidermidis
TGNYNDKTAKL

SEQ ID NO: 1758676 - protein, 5 aa, Staphylococcus epidermidis
TGQDA

SEQ ID NO: 1758677 - protein, 4 aa, Staphylococcus epidermidis
TGQK

SEQ ID NO: 1758678 - protein, 5 aa, Staphylococcus epidermidis
TGQPD

SEQ ID NO: 1758679 - protein, 10 aa, Staphylococcus epidermidis
TGQTYTSGIK

SEQ ID NO: 1758680 - protein, 7 aa, Staphylococcus epidermidis
TGRDGIH

SEQ ID NO: 1758681 - protein, 8 aa, Staphylococcus epidermidis
TGRPRTET

SEQ ID NO: 1758682 - protein, 5 aa, Staphylococcus epidermidis
TGRTH

SEQ ID NO: 1758683 - protein, 7 aa, Staphylococcus epidermidis
TGSGKTE

SEQ ID NO: 1758684 - protein, 7 aa, Staphylococcus epidermidis
TGSKDHN

SEQ ID NO: 1758685 - protein, 10 aa, Staphylococcus epidermidis
TGSPASSPHL

SEQ ID NO: 1758686 - protein, 7 aa, Staphylococcus epidermidis
TGSRPIE

SEQ ID NO: 1758687 - protein, 9 aa, Staphylococcus epidermidis
TGSSPGHDL

SEQ ID NO: 1758688 - protein, 22 aa, Staphylococcus epidermidis
TGTDEHGQKIQEKAQKAGKTEL

SEQ ID NO: 1758689 - protein, 10 aa, Staphylococcus epidermidis
TGTHRDQTRD

SEQ ID NO: 1758690 - protein, 10 aa, Staphylococcus epidermidis
TGTNGKTTVT

SEQ ID NO: 1758691 - protein, 9 aa, Staphylococcus epidermidis
TGTPPRVNA

SEQ ID NO: 1758692 - protein, 5 aa, Staphylococcus epidermidis
TGTTL

SEQ ID NO: 1758693 - protein, 4 aa, Staphylococcus epidermidis
TGTV

SEQ ID NO: 1758694 - protein, 5 aa, Staphylococcus epidermidis
TGTVS

SEQ ID NO: 1758695 - protein, 9 aa, Staphylococcus epidermidis
TGVGKTEIA

SEQ ID NO: 1758696 - protein, 12 aa, Staphylococcus epidermidis
TGVKRTTGQHPG

SEQ ID NO: 1758697 - protein, 9 aa, Staphylococcus epidermidis
TGYSAAQSL

SEQ ID NO: 1758698 - protein, 10 aa, Staphylococcus epidermidis
THDVDNDKSL

SEQ ID NO: 1758699 - protein, 7 aa, Staphylococcus epidermidis
THKTEDI

SEQ ID NO: 1758700 - protein, 6 aa, Staphylococcus epidermidis
TIAENG

SEQ ID NO: 1758701 - protein, 5 aa, Staphylococcus epidermidis
TIDPT

SEQ ID NO: 1758702 - protein, 8 aa, Staphylococcus epidermidis
TIGPKGRN

SEQ ID NO: 1758703 - protein, 8 aa, Staphylococcus epidermidis
TINTEYGK

SEQ ID NO: 1758704 - protein, 5 aa, Staphylococcus epidermidis
TIPFD

SEQ ID NO: 1758705 - protein, 8 aa, Staphylococcus epidermidis
TIQGEGRV

SEQ ID NO: 1758706 - protein, 14 aa, Staphylococcus epidermidis
TKDPEYRTTPSGVS

SEQ ID NO: 1758707 - protein, 7 aa, Staphylococcus epidermidis
TKEDERE

SEQ ID NO: 1758708 - protein, 9 aa, Staphylococcus epidermidis
TKEKETADS

SEQ ID NO: 1758709 - protein, 10 aa, Staphylococcus epidermidis
TKENPPIPGH

SEQ ID NO: 1758710 - protein, 4 aa, Staphylococcus epidermidis
TKES

SEQ ID NO: 1758711 - protein, 8 aa, Staphylococcus epidermidis
TKFEAGTP

SEQ ID NO: 1758712 - protein, 7 aa, Staphylococcus epidermidis
TKGDKIV

SEQ ID NO: 1758713 - protein, 8 aa, Staphylococcus epidermidis
TKGPEIRT

SEQ ID NO: 1758714 - protein, 8 aa, Staphylococcus epidermidis
TKGTNEPY

SEQ ID NO: 1758715 - protein, 16 aa, Staphylococcus epidermidis
TKIYPGENVGRGGDDT

SEQ ID NO: 1758716 - protein, 9 aa, Staphylococcus epidermidis
TKKGVDRKK

SEQ ID NO: 1758717 - protein, 9 aa, Staphylococcus epidermidis
TKLKNGRKF

SEQ ID NO: 1758718 - protein, 5 aa, Staphylococcus epidermidis
TKLLP

SEQ ID NO: 1758719 - protein, 5 aa, Staphylococcus epidermidis
TKNGQ

SEQ ID NO: 1758720 - protein, 6 aa, Staphylococcus epidermidis
TKPFST

SEQ ID NO: 1758721 - protein, 7 aa, Staphylococcus epidermidis
TKQAAAY

SEQ ID NO: 1758722 - protein, 10 aa, Staphylococcus epidermidis
TKRGKGKAGF

SEQ ID NO: 1758723 - protein, 15 aa, Staphylococcus epidermidis
TKSDGKKFGKSESGA

SEQ ID NO: 1758724 - protein, 9 aa, Staphylococcus epidermidis
TKSTPEGAR

SEQ ID NO: 1758725 - protein, 6 aa, Staphylococcus epidermidis
TKTLRK

SEQ ID NO: 1758726 - protein, 7 aa, Staphylococcus epidermidis
TKTPMGA

SEQ ID NO: 1758727 - protein, 8 aa, Staphylococcus epidermidis
TKTTPEKS

SEQ ID NO: 1758728 - protein, 7 aa, Staphylococcus epidermidis
TKYQPIP

SEQ ID NO: 1758729 - protein, 8 aa, Staphylococcus epidermidis
TKYRGEFE

SEQ ID NO: 1758730 - protein, 6 aa, Staphylococcus epidermidis
TLAENS

SEQ ID NO: 1758731 - protein, 9 aa, Staphylococcus epidermidis
TLDQETLET

SEQ ID NO: 1758732 - protein, 9 aa, Staphylococcus epidermidis
TLDRGTKTL

SEQ ID NO: 1758733 - protein, 13 aa, Staphylococcus epidermidis
TLDTGKTLEESYA

SEQ ID NO: 1758734 - protein, 5 aa, Staphylococcus epidermidis
TLPQD

SEQ ID NO: 1758735 - protein, 7 aa, Staphylococcus epidermidis
TLPTPFE

SEQ ID NO: 1758736 - protein, 9 aa, Staphylococcus epidermidis
TLVSKGDEI

SEQ ID NO: 1758737 - protein, 7 aa, Staphylococcus epidermidis
TMDQQSK

SEQ ID NO: 1758738 - protein, 9 aa, Staphylococcus epidermidis
TMKTENGST

SEQ ID NO: 1758739 - protein, 7 aa, Staphylococcus epidermidis
TNADSYV

SEQ ID NO: 1758740 - protein, 7 aa, Staphylococcus epidermidis
TNAGKSS

SEQ ID NO: 1758741 - protein, 17 aa, Staphylococcus epidermidis
TNAGQIKTGSLSRTDRI

SEQ ID NO: 1758742 - protein, 7 aa, Staphylococcus epidermidis
TNAGQTC

SEQ ID NO: 1758743 - protein, 6 aa, Staphylococcus epidermidis
TNANSE

SEQ ID NO: 1758744 - protein, 7 aa, Staphylococcus epidermidis
TNAPETN

SEQ ID NO: 1758745 - protein, 21 aa, Staphylococcus epidermidis
TNDQKNIDNPHKDLRRARSCN

SEQ ID NO: 1758746 - protein, 17 aa, Staphylococcus epidermidis
TNEHGYEIESKRGGGGY

SEQ ID NO: 1758747 - protein, 9 aa, Staphylococcus epidermidis
TNIEKTDSA

SEQ ID NO: 1758748 - protein, 7 aa, Staphylococcus epidermidis
TNIGTGM

SEQ ID NO: 1758749 - protein, 6 aa, Staphylococcus epidermidis
TNKAEK

SEQ ID NO: 1758750 - protein, 5 aa, Staphylococcus epidermidis
TNKVG

SEQ ID NO: 1758751 - protein, 14 aa, Staphylococcus epidermidis
TNLPPSRGLGSSAA

SEQ ID NO: 1758752 - protein, 7 aa, Staphylococcus epidermidis
TNPPIDA

SEQ ID NO: 1758753 - protein, 7 aa, Staphylococcus epidermidis
TNQRETT

SEQ ID NO: 1758754 - protein, 7 aa, Staphylococcus epidermidis
TNSKFDR

SEQ ID NO: 1758755 - protein, 5 aa, Staphylococcus epidermidis
TNTFP

SEQ ID NO: 1758756 - protein, 7 aa, Staphylococcus epidermidis
TNVGKST

SEQ ID NO: 1758757 - protein, 5 aa, Staphylococcus epidermidis
TPDEE

SEQ ID NO: 1758758 - protein, 6 aa, Staphylococcus epidermidis
TPDHTE

SEQ ID NO: 1758759 - protein, 4 aa, Staphylococcus epidermidis
TPEQ

SEQ ID NO: 1758760 - protein, 5 aa, Staphylococcus epidermidis
TPGHA

SEQ ID NO: 1758761 - protein, 10 aa, Staphylococcus epidermidis
TPGHADFGGE

SEQ ID NO: 1758762 - protein, 12 aa, Staphylococcus epidermidis
TPGHEDFSEDTY

SEQ ID NO: 1758763 - protein, 4 aa, Staphylococcus epidermidis
TPGR

SEQ ID NO: 1758764 - protein, 5 aa, Staphylococcus epidermidis
TPGSD

SEQ ID NO: 1758765 - protein, 11 aa, Staphylococcus epidermidis
TPGSEAMKGAI

SEQ ID NO: 1758766 - protein, 6 aa, Staphylococcus epidermidis
TPHPTA

SEQ ID NO: 1758767 - protein, 4 aa, Staphylococcus epidermidis
TPIP

SEQ ID NO: 1758768 - protein, 6 aa, Staphylococcus epidermidis
TPKHLD

SEQ ID NO: 1758769 - protein, 6 aa, Staphylococcus epidermidis
TPLEEG

SEQ ID NO: 1758770 - protein, 11 aa, Staphylococcus epidermidis
TPMGGSADSYI

SEQ ID NO: 1758771 - protein, 9 aa, Staphylococcus epidermidis
TPNETGGGF

SEQ ID NO: 1758772 - protein, 5 aa, Staphylococcus epidermidis
TPNKV

SEQ ID NO: 1758773 - protein, 6 aa, Staphylococcus epidermidis
TPNRAD

SEQ ID NO: 1758774 - protein, 8 aa, Staphylococcus epidermidis
TPNTNQYR

SEQ ID NO: 1758775 - protein, 6 aa, Staphylococcus epidermidis
TPPDYE

SEQ ID NO: 1758776 - protein, 4 aa, Staphylococcus epidermidis
TPPR

SEQ ID NO: 1758777 - protein, 4 aa, Staphylococcus epidermidis
TPRA

SEQ ID NO: 1758778 - protein, 6 aa, Staphylococcus epidermidis
TPRGGI

SEQ ID NO: 1758779 - protein, 4 aa, Staphylococcus epidermidis
TPRP

SEQ ID NO: 1758780 - protein, 11 aa, Staphylococcus epidermidis
TPTAGSSGTIP

SEQ ID NO: 1758781 - protein, 4 aa, Staphylococcus epidermidis
TPTG

SEQ ID NO: 1758782 - protein, 5 aa, Staphylococcus epidermidis
TPTIE

SEQ ID NO: 1758783 - protein, 4 aa, Staphylococcus epidermidis
TPTL

SEQ ID NO: 1758784 - protein, 5 aa, Staphylococcus epidermidis
TPTTF

SEQ ID NO: 1758785 - protein, 11 aa, Staphylococcus epidermidis
TPYKESDIEPY

SEQ ID NO: 1758786 - protein, 4 aa, Staphylococcus epidermidis
TPYN

SEQ ID NO: 1758787 - protein, 8 aa, Staphylococcus epidermidis
TPYTKKPL

SEQ ID NO: 1758788 - protein, 4 aa, Staphylococcus epidermidis
TQEH

SEQ ID NO: 1758789 - protein, 5 aa, Staphylococcus epidermidis
TQGKQ

SEQ ID NO: 1758790 - protein, 10 aa, Staphylococcus epidermidis
TQGVTAQGKD

SEQ ID NO: 1758791 - protein, 7 aa, Staphylococcus epidermidis
TQHAKDE

SEQ ID NO: 1758792 - protein, 5 aa, Staphylococcus epidermidis
TQIEK

SEQ ID NO: 1758793 - protein, 20 aa, Staphylococcus epidermidis
TQKPRSETLPINRGDLSRFI

SEQ ID NO: 1758794 - protein, 8 aa, Staphylococcus epidermidis
TQLGEGGL

SEQ ID NO: 1758795 - protein, 5 aa, Staphylococcus epidermidis
TQPKN

SEQ ID NO: 1758796 - protein, 9 aa, Staphylococcus epidermidis
TQPPPRYTE

SEQ ID NO: 1758797 - protein, 7 aa, Staphylococcus epidermidis
TQQSLSN

SEQ ID NO: 1758798 - protein, 9 aa, Staphylococcus epidermidis
TRDDFGGSQ

SEQ ID NO: 1758799 - protein, 14 aa, Staphylococcus epidermidis
TRGDGTTGEDITEN

SEQ ID NO: 1758800 - protein, 28 aa, Staphylococcus epidermidis
TRGLGAGANPEIGKKAAEESREQIEDAI

SEQ ID NO: 1758801 - protein, 8 aa, Staphylococcus epidermidis
TRGSTPGI

SEQ ID NO: 1758802 - protein, 18 aa, Staphylococcus epidermidis
TRKSSLRDTYFNINQRGD

SEQ ID NO: 1758803 - protein, 6 aa, Staphylococcus epidermidis
TRPTPN

SEQ ID NO: 1758804 - protein, 10 aa, Staphylococcus epidermidis
TRQNRQTIKT

SEQ ID NO: 1758805 - protein, 8 aa, Staphylococcus epidermidis
TSAGSSKI

SEQ ID NO: 1758806 - protein, 15 aa, Staphylococcus epidermidis
TSANTGGIMQVPENL

SEQ ID NO: 1758807 - protein, 5 aa, Staphylococcus epidermidis
TSAQQ

SEQ ID NO: 1758808 - protein, 8 aa, Staphylococcus epidermidis
TSDIGKDI

SEQ ID NO: 1758809 - protein, 10 aa, Staphylococcus epidermidis
TSDSKHTIAG

SEQ ID NO: 1758810 - protein, 11 aa, Staphylococcus epidermidis
TSENQALGQGG

SEQ ID NO: 1758811 - protein, 9 aa, Staphylococcus epidermidis
TSEQTPSSV

SEQ ID NO: 1758812 - protein, 12 aa, Staphylococcus epidermidis
TSETVGYRKPHP

SEQ ID NO: 1758813 - protein, 7 aa, Staphylococcus epidermidis
TSGEQRI

SEQ ID NO: 1758814 - protein, 5 aa, Staphylococcus epidermidis
TSGKE

SEQ ID NO: 1758815 - protein, 21 aa, Staphylococcus epidermidis
TSGREEVENNLSQNIGELGKT

SEQ ID NO: 1758816 - protein, 14 aa, Staphylococcus epidermidis
TSGTTGNPKAVTHS

SEQ ID NO: 1758817 - protein, 6 aa, Staphylococcus epidermidis
TSKAHV

SEQ ID NO: 1758818 - protein, 8 aa, Staphylococcus epidermidis
TSKTTVTG

SEQ ID NO: 1758819 - protein, 11 aa, Staphylococcus epidermidis
TSLLGADDKAG

SEQ ID NO: 1758820 - protein, 6 aa, Staphylococcus epidermidis
TSLPEH

SEQ ID NO: 1758821 - protein, 8 aa, Staphylococcus epidermidis
TSNGQTPF

SEQ ID NO: 1758822 - protein, 5 aa, Staphylococcus epidermidis
TSNPK

SEQ ID NO: 1758823 - protein, 9 aa, Staphylococcus epidermidis
TSPSFSPDK

SEQ ID NO: 1758824 - protein, 14 aa, Staphylococcus epidermidis
TSRPKKIGGERAKY

SEQ ID NO: 1758825 - protein, 14 aa, Staphylococcus epidermidis
TSSEKKLGKPVGSD

SEQ ID NO: 1758826 - protein, 4 aa, Staphylococcus epidermidis
TSSI

SEQ ID NO: 1758827 - protein, 5 aa, Staphylococcus epidermidis
TSSPS

SEQ ID NO: 1758828 - protein, 7 aa, Staphylococcus epidermidis
TSTRTRA

SEQ ID NO: 1758829 - protein, 5 aa, Staphylococcus epidermidis
TSYGV

SEQ ID NO: 1758830 - protein, 4 aa, Staphylococcus epidermidis
TTAE

SEQ ID NO: 1758831 - protein, 5 aa, Staphylococcus epidermidis
TTAGE

SEQ ID NO: 1758832 - protein, 4 aa, Staphylococcus epidermidis
TTAK

SEQ ID NO: 1758833 - protein, 7 aa, Staphylococcus epidermidis
TTDGFEL

SEQ ID NO: 1758834 - protein, 7 aa, Staphylococcus epidermidis
TTDIENG

SEQ ID NO: 1758835 - protein, 17 aa, Staphylococcus epidermidis
TTDPTKEINVETTSNLN

SEQ ID NO: 1758836 - protein, 13 aa, Staphylococcus epidermidis
TTEDPTNDFMPDS

SEQ ID NO: 1758837 - protein, 5 aa, Staphylococcus epidermidis
TTELP

SEQ ID NO: 1758838 - protein, 11 aa, Staphylococcus epidermidis
TTESVQEAQTR

SEQ ID NO: 1758839 - protein, 5 aa, Staphylococcus epidermidis
TTGAE

SEQ ID NO: 1758840 - protein, 6 aa, Staphylococcus epidermidis
TTGLHE

SEQ ID NO: 1758841 - protein, 8 aa, Staphylococcus epidermidis
TTGLSNQY

SEQ ID NO: 1758842 - protein, 5 aa, Staphylococcus epidermidis
TTGNE

SEQ ID NO: 1758843 - protein, 5 aa, Staphylococcus epidermidis
TTGPE

SEQ ID NO: 1758844 - protein, 7 aa, Staphylococcus epidermidis
TTNGAYA

SEQ ID NO: 1758845 - protein, 12 aa, Staphylococcus epidermidis
TTPGGGTDAGSI

SEQ ID NO: 1758846 - protein, 6 aa, Staphylococcus epidermidis
TTQHGY

SEQ ID NO: 1758847 - protein, 12 aa, Staphylococcus epidermidis
TTRAGSLTGPLR

SEQ ID NO: 1758848 - protein, 7 aa, Staphylococcus epidermidis
TTRPETM

SEQ ID NO: 1758849 - protein, 7 aa, Staphylococcus epidermidis
TTSNPYH

SEQ ID NO: 1758850 - protein, 5 aa, Staphylococcus epidermidis
TTSSR

SEQ ID NO: 1758851 - protein, 12 aa, Staphylococcus epidermidis
TTTHKTLRGPRG

SEQ ID NO: 1758852 - protein, 16 aa, Staphylococcus epidermidis
TTTMGPGVKVDTSSFK

SEQ ID NO: 1758853 - protein, 5 aa, Staphylococcus epidermidis
TTTNR

SEQ ID NO: 1758854 - protein, 4 aa, Staphylococcus epidermidis
TTVT

SEQ ID NO: 1758855 - protein, 4 aa, Staphylococcus epidermidis
TTYG

SEQ ID NO: 1758856 - protein, 5 aa, Staphylococcus epidermidis
TVEDN

SEQ ID NO: 1758857 - protein, 12 aa, Staphylococcus epidermidis
TVEKDSKTMKKF

SEQ ID NO: 1758858 - protein, 10 aa, Staphylococcus epidermidis
TVGSGDSTVA

SEQ ID NO: 1758859 - protein, 4 aa, Staphylococcus epidermidis
TVPQ

SEQ ID NO: 1758860 - protein, 7 aa, Staphylococcus epidermidis
TVSKGGH

SEQ ID NO: 1758861 - protein, 11 aa, Staphylococcus epidermidis
TYEGGTHEDGF

SEQ ID NO: 1758862 - protein, 10 aa, Staphylococcus epidermidis
TYEKATRNTL

SEQ ID NO: 1758863 - protein, 11 aa, Staphylococcus epidermidis
TYGPKTHGIKN

SEQ ID NO: 1758864 - protein, 4 aa, Staphylococcus epidermidis
TYGT

SEQ ID NO: 1758865 - protein, 6 aa, Staphylococcus epidermidis
VAGGGT

SEQ ID NO: 1758866 - protein, 9 aa, Staphylococcus epidermidis
VAKASTGAI

SEQ ID NO: 1758867 - protein, 12 aa, Staphylococcus epidermidis
VAKRATIPVLIV

SEQ ID NO: 1758868 - protein, 17 aa, Staphylococcus epidermidis
VANKTNEIAGDGTTTAT

SEQ ID NO: 1758869 - protein, 5 aa, Staphylococcus epidermidis
VAPPF

SEQ ID NO: 1758870 - protein, 6 aa, Staphylococcus epidermidis
VAPRRE

SEQ ID NO: 1758871 - protein, 13 aa, Staphylococcus epidermidis
VAQGGGLSRTDEK

SEQ ID NO: 1758872 - protein, 31 aa, Staphylococcus epidermidis
VASEDKSPRLNKLGGTEWKKTKAKVQQSVED

SEQ ID NO: 1758873 - protein, 7 aa, Staphylococcus epidermidis
VATAEAT

SEQ ID NO: 1758874 - protein, 18 aa, Staphylococcus epidermidis
VATNNQNSGQDVSRQGVQ

SEQ ID NO: 1758875 - protein, 13 aa, Staphylococcus epidermidis
VATPGIGKDAFQE

SEQ ID NO: 1758876 - protein, 5 aa, Staphylococcus epidermidis
VCSAG

SEQ ID NO: 1758877 - protein, 15 aa, Staphylococcus epidermidis
VDERAMDSNDLERER

SEQ ID NO: 1758878 - protein, 4 aa, Staphylococcus epidermidis
VDGA

SEQ ID NO: 1758879 - protein, 9 aa, Staphylococcus epidermidis
VDGDTSTND

SEQ ID NO: 1758880 - protein, 7 aa, Staphylococcus epidermidis
VDGGAVK

SEQ ID NO: 1758881 - protein, 7 aa, Staphylococcus epidermidis
VDGGMSD

SEQ ID NO: 1758882 - protein, 8 aa, Staphylococcus epidermidis
VDGKGPIG

SEQ ID NO: 1758883 - protein, 5 aa, Staphylococcus epidermidis
VDKGT

SEQ ID NO: 1758884 - protein, 5 aa, Staphylococcus epidermidis
VDNGD

SEQ ID NO: 1758885 - protein, 4 aa, Staphylococcus epidermidis
VDNK

SEQ ID NO: 1758886 - protein, 8 aa, Staphylococcus epidermidis
VDNNKDQT

SEQ ID NO: 1758887 - protein, 6 aa, Staphylococcus epidermidis
VDPNDG

SEQ ID NO: 1758888 - protein, 4 aa, Staphylococcus epidermidis
VDTI

SEQ ID NO: 1758889 - protein, 6 aa, Staphylococcus epidermidis
VDYSGR

SEQ ID NO: 1758890 - protein, 6 aa, Staphylococcus epidermidis
VEAPKS

SEQ ID NO: 1758891 - protein, 7 aa, Staphylococcus epidermidis
VEDDKQG

SEQ ID NO: 1758892 - protein, 5 aa, Staphylococcus epidermidis
VEDET

SEQ ID NO: 1758893 - protein, 7 aa, Staphylococcus epidermidis
VEEESTF

SEQ ID NO: 1758894 - protein, 6 aa, Staphylococcus epidermidis
VEEIKA

SEQ ID NO: 1758895 - protein, 5 aa, Staphylococcus epidermidis
VEGDA

SEQ ID NO: 1758896 - protein, 10 aa, Staphylococcus epidermidis
VEGDLRREQN

SEQ ID NO: 1758897 - protein, 6 aa, Staphylococcus epidermidis
VEGEEA

SEQ ID NO: 1758898 - protein, 8 aa, Staphylococcus epidermidis
VEGTPEKF

SEQ ID NO: 1758899 - protein, 4 aa, Staphylococcus epidermidis
VEIP

SEQ ID NO: 1758900 - protein, 7 aa, Staphylococcus epidermidis
VEKTGRA

SEQ ID NO: 1758901 - protein, 10 aa, Staphylococcus epidermidis
VEKTTGANKE

SEQ ID NO: 1758902 - protein, 5 aa, Staphylococcus epidermidis
VEPAS

SEQ ID NO: 1758903 - protein, 8 aa, Staphylococcus epidermidis
VEPKVEKN

SEQ ID NO: 1758904 - protein, 10 aa, Staphylococcus epidermidis
VEQGLKDAME

SEQ ID NO: 1758905 - protein, 10 aa, Staphylococcus epidermidis
VEQTTKGPQI

SEQ ID NO: 1758906 - protein, 10 aa, Staphylococcus epidermidis
VERSRKALSE

SEQ ID NO: 1758907 - protein, 9 aa, Staphylococcus epidermidis
VESQEQVDA

SEQ ID NO: 1758908 - protein, 6 aa, Staphylococcus epidermidis
VETTCA

SEQ ID NO: 1758909 - protein, 11 aa, Staphylococcus epidermidis
VFSEPASNASI

SEQ ID NO: 1758910 - protein, 9 aa, Staphylococcus epidermidis
VGAKEGGVV

SEQ ID NO: 1758911 - protein, 9 aa, Staphylococcus epidermidis
VGANSEQLS

SEQ ID NO: 1758912 - protein, 7 aa, Staphylococcus epidermidis
VGAPQAI

SEQ ID NO: 1758913 - protein, 7 aa, Staphylococcus epidermidis
VGDQTFT

SEQ ID NO: 1758914 - protein, 5 aa, Staphylococcus epidermidis
VGDSR

SEQ ID NO: 1758915 - protein, 6 aa, Staphylococcus epidermidis
VGDTHR

SEQ ID NO: 1758916 - protein, 8 aa, Staphylococcus epidermidis
VGDTIQRG

SEQ ID NO: 1758917 - protein, 11 aa, Staphylococcus epidermidis
VGEDGPTHEPI

SEQ ID NO: 1758918 - protein, 16 aa, Staphylococcus epidermidis
VGETGPVRAPGRREIG

SEQ ID NO: 1758919 - protein, 9 aa, Staphylococcus epidermidis
VGGGGNNAV

SEQ ID NO: 1758920 - protein, 9 aa, Staphylococcus epidermidis
VGGKQKYSF

SEQ ID NO: 1758921 - protein, 4 aa, Staphylococcus epidermidis
VGGL

SEQ ID NO: 1758922 - protein, 10 aa, Staphylococcus epidermidis
VGGSDQWGNI

SEQ ID NO: 1758923 - protein, 5 aa, Staphylococcus epidermidis
VGKST

SEQ ID NO: 1758924 - protein, 8 aa, Staphylococcus epidermidis
VGKTTTIG

SEQ ID NO: 1758925 - protein, 6 aa, Staphylococcus epidermidis
VGNDRR

SEQ ID NO: 1758926 - protein, 8 aa, Staphylococcus epidermidis
VGPNGDPL

SEQ ID NO: 1758927 - protein, 13 aa, Staphylococcus epidermidis
VGPNGSGKSNITD

SEQ ID NO: 1758928 - protein, 8 aa, Staphylococcus epidermidis
VGRGPLAG

SEQ ID NO: 1758929 - protein, 4 aa, Staphylococcus epidermidis
VGSK

SEQ ID NO: 1758930 - protein, 8 aa, Staphylococcus epidermidis
VGSKGARV

SEQ ID NO: 1758931 - protein, 7 aa, Staphylococcus epidermidis
VGTGASD

SEQ ID NO: 1758932 - protein, 10 aa, Staphylococcus epidermidis
VGTGDQKINL

SEQ ID NO: 1758933 - protein, 10 aa, Staphylococcus epidermidis
VGTGGTLSGV

SEQ ID NO: 1758934 - protein, 6 aa, Staphylococcus epidermidis
VGTGSG

SEQ ID NO: 1758935 - protein, 5 aa, Staphylococcus epidermidis
VHEGT

SEQ ID NO: 1758936 - protein, 12 aa, Staphylococcus epidermidis
VHGPYKGEPKLG

SEQ ID NO: 1758937 - protein, 9 aa, Staphylococcus epidermidis
VHPGSAKNA

SEQ ID NO: 1758938 - protein, 9 aa, Staphylococcus epidermidis
VKASGGVRN

SEQ ID NO: 1758939 - protein, 8 aa, Staphylococcus epidermidis
VKASPEHP

SEQ ID NO: 1758940 - protein, 5 aa, Staphylococcus epidermidis
VKDGD

SEQ ID NO: 1758941 - protein, 9 aa, Staphylococcus epidermidis
VKENEESKK

SEQ ID NO: 1758942 - protein, 6 aa, Staphylococcus epidermidis
VKESEG

SEQ ID NO: 1758943 - protein, 5 aa, Staphylococcus epidermidis
VKGGR

SEQ ID NO: 1758944 - protein, 11 aa, Staphylococcus epidermidis
VKGPGPGRESA

SEQ ID NO: 1758945 - protein, 8 aa, Staphylococcus epidermidis
VKKNIENG

SEQ ID NO: 1758946 - protein, 9 aa, Staphylococcus epidermidis
VKKSERKKM

SEQ ID NO: 1758947 - protein, 10 aa, Staphylococcus epidermidis
VKNDNAQGEY

SEQ ID NO: 1758948 - protein, 9 aa, Staphylococcus epidermidis
VKPGKGSAF

SEQ ID NO: 1758949 - protein, 5 aa, Staphylococcus epidermidis
VKPNN

SEQ ID NO: 1758950 - protein, 4 aa, Staphylococcus epidermidis
VKQP

SEQ ID NO: 1758951 - protein, 4 aa, Staphylococcus epidermidis
VKRK

SEQ ID NO: 1758952 - protein, 6 aa, Staphylococcus epidermidis
VKRPEV

SEQ ID NO: 1758953 - protein, 9 aa, Staphylococcus epidermidis
VKSGGPELA

SEQ ID NO: 1758954 - protein, 4 aa, Staphylococcus epidermidis
VKTA

SEQ ID NO: 1758955 - protein, 14 aa, Staphylococcus epidermidis
VKYRSKEEQQAENH

SEQ ID NO: 1758956 - protein, 10 aa, Staphylococcus epidermidis
VLTPADEEYH

SEQ ID NO: 1758957 - protein, 5 aa, Staphylococcus epidermidis
VNDNT

SEQ ID NO: 1758958 - protein, 8 aa, Staphylococcus epidermidis
VNEKNGSV

SEQ ID NO: 1758959 - protein, 7 aa, Staphylococcus epidermidis
VNESPYE

SEQ ID NO: 1758960 - protein, 10 aa, Staphylococcus epidermidis
VNGRQSPYTL

SEQ ID NO: 1758961 - protein, 6 aa, Staphylococcus epidermidis
VNPDEV

SEQ ID NO: 1758962 - protein, 16 aa, Staphylococcus epidermidis
VNSPSRSYKAVGGGAP

SEQ ID NO: 1758963 - protein, 7 aa, Staphylococcus epidermidis
VNSTAGS

SEQ ID NO: 1758964 - protein, 7 aa, Staphylococcus epidermidis
VNYENAG

SEQ ID NO: 1758965 - protein, 7 aa, Staphylococcus epidermidis
VPAEAEA

SEQ ID NO: 1758966 - protein, 8 aa, Staphylococcus epidermidis
VPEGEGQS

SEQ ID NO: 1758967 - protein, 4 aa, Staphylococcus epidermidis
VPES

SEQ ID NO: 1758968 - protein, 4 aa, Staphylococcus epidermidis
VPKS

SEQ ID NO: 1758969 - protein, 10 aa, Staphylococcus epidermidis
VPNSIPSDAY

SEQ ID NO: 1758970 - protein, 7 aa, Staphylococcus epidermidis
VPPSNDI

SEQ ID NO: 1758971 - protein, 8 aa, Staphylococcus epidermidis
VPQPTRAE

SEQ ID NO: 1758972 - protein, 4 aa, Staphylococcus epidermidis
VPRT

SEQ ID NO: 1758973 - protein, 8 aa, Staphylococcus epidermidis
VPSENAGA

SEQ ID NO: 1758974 - protein, 6 aa, Staphylococcus epidermidis
VPSNPK

SEQ ID NO: 1758975 - protein, 7 aa, Staphylococcus epidermidis
VPSTSKI

SEQ ID NO: 1758976 - protein, 10 aa, Staphylococcus epidermidis
VPTGEKGTTN

SEQ ID NO: 1758977 - protein, 5 aa, Staphylococcus epidermidis
VQDRT

SEQ ID NO: 1758978 - protein, 5 aa, Staphylococcus epidermidis
VQEGQ

SEQ ID NO: 1758979 - protein, 7 aa, Staphylococcus epidermidis
VQKNGGV

SEQ ID NO: 1758980 - protein, 10 aa, Staphylococcus epidermidis
VQPHSGSQAN

SEQ ID NO: 1758981 - protein, 4 aa, Staphylococcus epidermidis
VQRR

SEQ ID NO: 1758982 - protein, 5 aa, Staphylococcus epidermidis
VQRSM

SEQ ID NO: 1758983 - protein, 5 aa, Staphylococcus epidermidis
VQSTL

SEQ ID NO: 1758984 - protein, 6 aa, Staphylococcus epidermidis
VQSYQG

SEQ ID NO: 1758985 - protein, 5 aa, Staphylococcus epidermidis
VQTPT

SEQ ID NO: 1758986 - protein, 6 aa, Staphylococcus epidermidis
VRPTVR

SEQ ID NO: 1758987 - protein, 15 aa, Staphylococcus epidermidis
VRRARAGLKDPKRPI

SEQ ID NO: 1758988 - protein, 5 aa, Staphylococcus epidermidis
VRRNP

SEQ ID NO: 1758989 - protein, 8 aa, Staphylococcus epidermidis
VSDKDGDM

SEQ ID NO: 1758990 - protein, 6 aa, Staphylococcus epidermidis
VSGNEP

SEQ ID NO: 1758991 - protein, 8 aa, Staphylococcus epidermidis
VSGNTTEE

SEQ ID NO: 1758992 - protein, 8 aa, Staphylococcus epidermidis
VSGRGGTN

SEQ ID NO: 1758993 - protein, 7 aa, Staphylococcus epidermidis
VSKGNAI

SEQ ID NO: 1758994 - protein, 16 aa, Staphylococcus epidermidis
VSKSDMKRVKQLLAYK

SEQ ID NO: 1758995 - protein, 8 aa, Staphylococcus epidermidis
VSNEDAGL

SEQ ID NO: 1758996 - protein, 8 aa, Staphylococcus epidermidis
VSQFNPKQ

SEQ ID NO: 1758997 - protein, 4 aa, Staphylococcus epidermidis
VSQQ

SEQ ID NO: 1758998 - protein, 6 aa, Staphylococcus epidermidis
VSRDDA

SEQ ID NO: 1758999 - protein, 20 aa, Staphylococcus epidermidis
VSSGENRAVEAAKKAISSPL

SEQ ID NO: 1759000 - protein, 5 aa, Staphylococcus epidermidis
VSSQI

SEQ ID NO: 1759001 - protein, 9 aa, Staphylococcus epidermidis
VSTSETRPV

SEQ ID NO: 1759002 - protein, 7 aa, Staphylococcus epidermidis
VTAYRGS

SEQ ID NO: 1759003 - protein, 6 aa, Staphylococcus epidermidis
VTEPGY

SEQ ID NO: 1759004 - protein, 7 aa, Staphylococcus epidermidis
VTGRPRG

SEQ ID NO: 1759005 - protein, 8 aa, Staphylococcus epidermidis
VTGSVDEA

SEQ ID NO: 1759006 - protein, 6 aa, Staphylococcus epidermidis
VTLGTS

SEQ ID NO: 1759007 - protein, 12 aa, Staphylococcus epidermidis
VTNTGDKKSRQI

SEQ ID NO: 1759008 - protein, 7 aa, Staphylococcus epidermidis
VTNTKKD

SEQ ID NO: 1759009 - protein, 10 aa, Staphylococcus epidermidis
VTPAHDPNDF

SEQ ID NO: 1759010 - protein, 5 aa, Staphylococcus epidermidis
VTPAL

SEQ ID NO: 1759011 - protein, 10 aa, Staphylococcus epidermidis
VTPGKGGQVV

SEQ ID NO: 1759012 - protein, 12 aa, Staphylococcus epidermidis
VTPKGVTELTAE

SEQ ID NO: 1759013 - protein, 4 aa, Staphylococcus epidermidis
VTQK

SEQ ID NO: 1759014 - protein, 7 aa, Staphylococcus epidermidis
VTRPRGT

SEQ ID NO: 1759015 - protein, 4 aa, Staphylococcus epidermidis
VTTF

SEQ ID NO: 1759016 - protein, 7 aa, Staphylococcus epidermidis
VTTGDGQ

SEQ ID NO: 1759017 - protein, 12 aa, Staphylococcus epidermidis
VVQGEKRGRTIG

SEQ ID NO: 1759018 - protein, 7 aa, Staphylococcus epidermidis
VWPPSGD

SEQ ID NO: 1759019 - protein, 5 aa, Staphylococcus epidermidis
VYPNG

SEQ ID NO: 1759020 - protein, 17 aa, Staphylococcus epidermidis
WEEGSESLQPGLDLVGK

SEQ ID NO: 1759021 - protein, 10 aa, Staphylococcus epidermidis
WQGPPRLQNG

SEQ ID NO: 1759022 - protein, 12 aa, Staphylococcus epidermidis
WQSEGNTGTPWL

SEQ ID NO: 1759023 - protein, 8 aa, Staphylococcus epidermidis
WRNSDADT

SEQ ID NO: 1759024 - protein, 19 aa, Staphylococcus epidermidis
WSSAGALGFKGSKKSTPFA

SEQ ID NO: 1759025 - protein, 10 aa, Staphylococcus epidermidis
YAEGYPGRRY

SEQ ID NO: 1759026 - protein, 11 aa, Staphylococcus epidermidis
YAGGGDNACGA

SEQ ID NO: 1759027 - protein, 5 aa, Staphylococcus epidermidis
YAGPR

SEQ ID NO: 1759028 - protein, 11 aa, Staphylococcus epidermidis
YAGSKDKAEAV

SEQ ID NO: 1759029 - protein, 6 aa, Staphylococcus epidermidis
YAGTSS

SEQ ID NO: 1759030 - protein, 7 aa, Staphylococcus epidermidis
YAKEGAD

SEQ ID NO: 1759031 - protein, 8 aa, Staphylococcus epidermidis
YANEGPTL

SEQ ID NO: 1759032 - protein, 7 aa, Staphylococcus epidermidis
YARENGV

SEQ ID NO: 1759033 - protein, 11 aa, Staphylococcus epidermidis
YATSGNKGIEN

SEQ ID NO: 1759034 - protein, 12 aa, Staphylococcus epidermidis
YDDGKDPKGLPK

SEQ ID NO: 1759035 - protein, 6 aa, Staphylococcus epidermidis
YDESNE

SEQ ID NO: 1759036 - protein, 18 aa, Staphylococcus epidermidis
YDGEGVTEAIRTKNNMDG

SEQ ID NO: 1759037 - protein, 10 aa, Staphylococcus epidermidis
YDGNEREPSV

SEQ ID NO: 1759038 - protein, 19 aa, Staphylococcus epidermidis
YDLGPGPRMPEKKRQTAYE

SEQ ID NO: 1759039 - protein, 5 aa, Staphylococcus epidermidis
YDPYR

SEQ ID NO: 1759040 - protein, 9 aa, Staphylococcus epidermidis
YDQLNKDAD

SEQ ID NO: 1759041 - protein, 16 aa, Staphylococcus epidermidis
YDQRSDQLSGGQQQRI

SEQ ID NO: 1759042 - protein, 7 aa, Staphylococcus epidermidis
YDQTGKF

SEQ ID NO: 1759043 - protein, 6 aa, Staphylococcus epidermidis
YEATTN

SEQ ID NO: 1759044 - protein, 4 aa, Staphylococcus epidermidis
YEDN

SEQ ID NO: 1759045 - protein, 5 aa, Staphylococcus epidermidis
YEEGK

SEQ ID NO: 1759046 - protein, 7 aa, Staphylococcus epidermidis
YEEGNRF

SEQ ID NO: 1759047 - protein, 5 aa, Staphylococcus epidermidis
YEGAL

SEQ ID NO: 1759048 - protein, 5 aa, Staphylococcus epidermidis
YEKYE

SEQ ID NO: 1759049 - protein, 16 aa, Staphylococcus epidermidis
YESEARDTKLGPEEIT

SEQ ID NO: 1759050 - protein, 5 aa, Staphylococcus epidermidis
YEVTQ

SEQ ID NO: 1759051 - protein, 4 aa, Staphylococcus epidermidis
YGDD

SEQ ID NO: 1759052 - protein, 7 aa, Staphylococcus epidermidis
YGDGAAD

SEQ ID NO: 1759053 - protein, 10 aa, Staphylococcus epidermidis
YGEKGGTPWL

SEQ ID NO: 1759054 - protein, 10 aa, Staphylococcus epidermidis
YGLRSNADNF

SEQ ID NO: 1759055 - protein, 9 aa, Staphylococcus epidermidis
YGLSGGQQQ

SEQ ID NO: 1759056 - protein, 5 aa, Staphylococcus epidermidis
YGNVN

SEQ ID NO: 1759057 - protein, 4 aa, Staphylococcus epidermidis
YGPS

SEQ ID NO: 1759058 - protein, 6 aa, Staphylococcus epidermidis
YGQKGE

SEQ ID NO: 1759059 - protein, 4 aa, Staphylococcus epidermidis
YGSP

SEQ ID NO: 1759060 - protein, 9 aa, Staphylococcus epidermidis
YGSPEKKEI

SEQ ID NO: 1759061 - protein, 5 aa, Staphylococcus epidermidis
YGTVN

SEQ ID NO: 1759062 - protein, 5 aa, Staphylococcus epidermidis
YHANE

SEQ ID NO: 1759063 - protein, 9 aa, Staphylococcus epidermidis
YHDPETNEK

SEQ ID NO: 1759064 - protein, 11 aa, Staphylococcus epidermidis
YHGGTESTGEV

SEQ ID NO: 1759065 - protein, 4 aa, Staphylococcus epidermidis
YHGH

SEQ ID NO: 1759066 - protein, 8 aa, Staphylococcus epidermidis
YHPHGDSS

SEQ ID NO: 1759067 - protein, 7 aa, Staphylococcus epidermidis
YKEDGTG

SEQ ID NO: 1759068 - protein, 4 aa, Staphylococcus epidermidis
YKGT

SEQ ID NO: 1759069 - protein, 4 aa, Staphylococcus epidermidis
YKHN

SEQ ID NO: 1759070 - protein, 6 aa, Staphylococcus epidermidis
YKKDID

SEQ ID NO: 1759071 - protein, 10 aa, Staphylococcus epidermidis
YKPTDRNLKD

SEQ ID NO: 1759072 - protein, 7 aa, Staphylococcus epidermidis
YLPTGEG

SEQ ID NO: 1759073 - protein, 9 aa, Staphylococcus epidermidis
YNASPTSMK

SEQ ID NO: 1759074 - protein, 5 aa, Staphylococcus epidermidis
YNETH

SEQ ID NO: 1759075 - protein, 7 aa, Staphylococcus epidermidis
YNETPNI

SEQ ID NO: 1759076 - protein, 9 aa, Staphylococcus epidermidis
YNETRGTSI

SEQ ID NO: 1759077 - protein, 6 aa, Staphylococcus epidermidis
YNGKKV

SEQ ID NO: 1759078 - protein, 6 aa, Staphylococcus epidermidis
YNHGAG

SEQ ID NO: 1759079 - protein, 25 aa, Staphylococcus epidermidis
YNRGEGDEDDDDAGFEPQTNDDNGE

SEQ ID NO: 1759080 - protein, 14 aa, Staphylococcus epidermidis
YPALNTSFNEEAGE

SEQ ID NO: 1759081 - protein, 5 aa, Staphylococcus epidermidis
YPDES

SEQ ID NO: 1759082 - protein, 9 aa, Staphylococcus epidermidis
YPDNPKAYQ

SEQ ID NO: 1759083 - protein, 10 aa, Staphylococcus epidermidis
YPITPKNHGT

SEQ ID NO: 1759084 - protein, 4 aa, Staphylococcus epidermidis
YPQI

SEQ ID NO: 1759085 - protein, 5 aa, Staphylococcus epidermidis
YPSGA

SEQ ID NO: 1759086 - protein, 9 aa, Staphylococcus epidermidis
YPSGTIYSR

SEQ ID NO: 1759087 - protein, 5 aa, Staphylococcus epidermidis
YPTAP

SEQ ID NO: 1759088 - protein, 4 aa, Staphylococcus epidermidis
YPTE

SEQ ID NO: 1759089 - protein, 5 aa, Staphylococcus epidermidis
YPYYA

SEQ ID NO: 1759090 - protein, 9 aa, Staphylococcus epidermidis
YQDTNKAQY

SEQ ID NO: 1759091 - protein, 8 aa, Staphylococcus epidermidis
YQDTNRVQ

SEQ ID NO: 1759092 - protein, 7 aa, Staphylococcus epidermidis
YQERQTV

SEQ ID NO: 1759093 - protein, 6 aa, Staphylococcus epidermidis
YQETDK

SEQ ID NO: 1759094 - protein, 10 aa, Staphylococcus epidermidis
YQNPGGSVKD

SEQ ID NO: 1759095 - protein, 7 aa, Staphylococcus epidermidis
YQTDKRH

SEQ ID NO: 1759096 - protein, 7 aa, Staphylococcus epidermidis
YQTHTNA

SEQ ID NO: 1759097 - protein, 6 aa, Staphylococcus epidermidis
YQTRRN

SEQ ID NO: 1759098 - protein, 8 aa, Staphylococcus epidermidis
YRDKDKVT

SEQ ID NO: 1759099 - protein, 4 aa, Staphylococcus epidermidis
YRIS

SEQ ID NO: 1759100 - protein, 23 aa, Staphylococcus epidermidis
YRNQTGDMTEPYTIGGGTYARNL

SEQ ID NO: 1759101 - protein, 6 aa, Staphylococcus epidermidis
YRPNAV

SEQ ID NO: 1759102 - protein, 4 aa, Staphylococcus epidermidis
YRQD

SEQ ID NO: 1759103 - protein, 12 aa, Staphylococcus epidermidis
YRRDSDDATHSH

SEQ ID NO: 1759104 - protein, 7 aa, Staphylococcus epidermidis
YRSEDLP

SEQ ID NO: 1759105 - protein, 11 aa, Staphylococcus epidermidis
YRYANSNDFAN

SEQ ID NO: 1759106 - protein, 13 aa, Staphylococcus epidermidis
YSDNIKTYESHGD

SEQ ID NO: 1759107 - protein, 8 aa, Staphylococcus epidermidis
YSKGEKDI

SEQ ID NO: 1759108 - protein, 9 aa, Staphylococcus epidermidis
YSKGQSHHE

SEQ ID NO: 1759109 - protein, 7 aa, Staphylococcus epidermidis
YSLKPGQ

SEQ ID NO: 1759110 - protein, 8 aa, Staphylococcus epidermidis
YSNQEIAS

SEQ ID NO: 1759111 - protein, 19 aa, Staphylococcus epidermidis
YSNSRGSLKIKSKDPFEKP

SEQ ID NO: 1759112 - protein, 15 aa, Staphylococcus epidermidis
YSQPAQEVSGATNEI

SEQ ID NO: 1759113 - protein, 6 aa, Staphylococcus epidermidis
YSTEKV

SEQ ID NO: 1759114 - protein, 12 aa, Staphylococcus epidermidis
YTGDGGSSQGDF

SEQ ID NO: 1759115 - protein, 21 aa, Staphylococcus epidermidis
YTGIQSGKLEDKYGWRVEVPK

SEQ ID NO: 1759116 - protein, 4 aa, Staphylococcus epidermidis
YTGR

SEQ ID NO: 1759117 - protein, 4 aa, Staphylococcus epidermidis
YTKE

SEQ ID NO: 1759118 - protein, 6 aa, Staphylococcus epidermidis
YTKEDE

SEQ ID NO: 1759119 - protein, 9 aa, Staphylococcus epidermidis
YTKQPEEIT

SEQ ID NO: 1759120 - protein, 5 aa, Staphylococcus epidermidis
YTRES

SEQ ID NO: 1759121 - protein, 8 aa, Staphylococcus epidermidis
YTRPREYK

SEQ ID NO: 1759122 - protein, 12 aa, Staphylococcus epidermidis
YTSRVGDGPFPT

SEQ ID NO: 1759123 - protein, 5 aa, Staphylococcus epidermidis
YTTSE

SEQ ID NO: 1759124 - protein, 9 aa, Staphylococcus epidermidis
YTYEADGAT

SEQ ID NO: 1759125 - protein, 16 aa, Staphylococcus epidermidis
YVGEPGNFTRTSNRHD

SEQ ID NO: 1759126 - protein, 11 aa, Staphylococcus epidermidis
YVTEGKITRNA

SEQ ID NO: 1759127 - protein, 14 aa, Staphylococcus epidermidis
AAADDYKAQSIEPY

SEQ ID NO: 1759128 - protein, 10 aa, Staphylococcus epidermidis
AAEESGRDEE

SEQ ID NO: 1759129 - protein, 7 aa, Staphylococcus epidermidis
AAENGAE

SEQ ID NO: 1759130 - protein, 8 aa, Staphylococcus epidermidis
AAETGVAP

SEQ ID NO: 1759131 - protein, 15 aa, Staphylococcus epidermidis
AAGSGDFAGNRAEPI

SEQ ID NO: 1759132 - protein, 14 aa, Staphylococcus epidermidis
AAHGFGGKITPKVT

SEQ ID NO: 1759133 - protein, 10 aa, Staphylococcus epidermidis
AAKDSEFDKA

SEQ ID NO: 1759134 - protein, 11 aa, Staphylococcus epidermidis
AAKNTTKETHA

SEQ ID NO: 1759135 - protein, 8 aa, Staphylococcus epidermidis
AAKRRGMD

SEQ ID NO: 1759136 - protein, 7 aa, Staphylococcus epidermidis
AALEDEN

SEQ ID NO: 1759137 - protein, 7 aa, Staphylococcus epidermidis
AALEQKD

SEQ ID NO: 1759138 - protein, 6 aa, Staphylococcus epidermidis
AANGKT

SEQ ID NO: 1759139 - protein, 5 aa, Staphylococcus epidermidis
AANQT

SEQ ID NO: 1759140 - protein, 5 aa, Staphylococcus epidermidis
AAPGW

SEQ ID NO: 1759141 - protein, 7 aa, Staphylococcus epidermidis
AAQTPEK

SEQ ID NO: 1759142 - protein, 5 aa, Staphylococcus epidermidis
AASLD

SEQ ID NO: 1759143 - protein, 8 aa, Staphylococcus epidermidis
AASLQGDQ

SEQ ID NO: 1759144 - protein, 8 aa, Staphylococcus epidermidis
AATHNKGV

SEQ ID NO: 1759145 - protein, 10 aa, Staphylococcus epidermidis
ACGGASSGFN

SEQ ID NO: 1759146 - protein, 5 aa, Staphylococcus epidermidis
ADADN

SEQ ID NO: 1759147 - protein, 7 aa, Staphylococcus epidermidis
ADAEKAV

SEQ ID NO: 1759148 - protein, 16 aa, Staphylococcus epidermidis
ADAGSKLAKAEKYGTE

SEQ ID NO: 1759149 - protein, 7 aa, Staphylococcus epidermidis
ADAQGNV

SEQ ID NO: 1759150 - protein, 10 aa, Staphylococcus epidermidis
ADEAQTDTEF

SEQ ID NO: 1759151 - protein, 6 aa, Staphylococcus epidermidis
ADFGDV

SEQ ID NO: 1759152 - protein, 7 aa, Staphylococcus epidermidis
ADGGWPQ

SEQ ID NO: 1759153 - protein, 7 aa, Staphylococcus epidermidis
ADGKSPM

SEQ ID NO: 1759154 - protein, 8 aa, Staphylococcus epidermidis
ADGSEHTI

SEQ ID NO: 1759155 - protein, 9 aa, Staphylococcus epidermidis
ADIKDGAKV

SEQ ID NO: 1759156 - protein, 7 aa, Staphylococcus epidermidis
ADKEGTT

SEQ ID NO: 1759157 - protein, 6 aa, Staphylococcus epidermidis
ADNQYS

SEQ ID NO: 1759158 - protein, 5 aa, Staphylococcus epidermidis
ADQDV

SEQ ID NO: 1759159 - protein, 10 aa, Staphylococcus epidermidis
ADRLEEDSSH

SEQ ID NO: 1759160 - protein, 8 aa, Staphylococcus epidermidis
ADSESEDE

SEQ ID NO: 1759161 - protein, 4 aa, Staphylococcus epidermidis
ADSI

SEQ ID NO: 1759162 - protein, 12 aa, Staphylococcus epidermidis
ADSIANDGYNDE

SEQ ID NO: 1759163 - protein, 4 aa, Staphylococcus epidermidis
ADSL

SEQ ID NO: 1759164 - protein, 6 aa, Staphylococcus epidermidis
ADTDKG

SEQ ID NO: 1759165 - protein, 27 aa, Staphylococcus epidermidis
ADTETIGCNPDGYNINEQCGSTHPEKL

SEQ ID NO: 1759166 - protein, 6 aa, Staphylococcus epidermidis
ADTGID

SEQ ID NO: 1759167 - protein, 6 aa, Staphylococcus epidermidis
ADVPVD

SEQ ID NO: 1759168 - protein, 8 aa, Staphylococcus epidermidis
ADYANPNY

SEQ ID NO: 1759169 - protein, 5 aa, Staphylococcus epidermidis
AEAAE

SEQ ID NO: 1759170 - protein, 10 aa, Staphylococcus epidermidis
AEAEPGENDE

SEQ ID NO: 1759171 - protein, 5 aa, Staphylococcus epidermidis
AEAGV

SEQ ID NO: 1759172 - protein, 5 aa, Staphylococcus epidermidis
AEDIN

SEQ ID NO: 1759173 - protein, 9 aa, Staphylococcus epidermidis
AEDKQDIQA

SEQ ID NO: 1759174 - protein, 10 aa, Staphylococcus epidermidis
AEDKVSTKDF

SEQ ID NO: 1759175 - protein, 27 aa, Staphylococcus epidermidis
AEDPREKAKLEKESRAKEILAHRIFSF

SEQ ID NO: 1759176 - protein, 4 aa, Staphylococcus epidermidis
AEDQ

SEQ ID NO: 1759177 - protein, 4 aa, Staphylococcus epidermidis
AEEA

SEQ ID NO: 1759178 - protein, 10 aa, Staphylococcus epidermidis
AEEDDKANIL

SEQ ID NO: 1759179 - protein, 4 aa, Staphylococcus epidermidis
AEEG

SEQ ID NO: 1759180 - protein, 6 aa, Staphylococcus epidermidis
AEEGTY

SEQ ID NO: 1759181 - protein, 12 aa, Staphylococcus epidermidis
AEEGVEGSKDAR

SEQ ID NO: 1759182 - protein, 7 aa, Staphylococcus epidermidis
AEENDEI

SEQ ID NO: 1759183 - protein, 16 aa, Staphylococcus epidermidis
AEEQNLATAKKKDSTG

SEQ ID NO: 1759184 - protein, 13 aa, Staphylococcus epidermidis
AEETAEKLAEDQV

SEQ ID NO: 1759185 - protein, 6 aa, Staphylococcus epidermidis
AEFPEV

SEQ ID NO: 1759186 - protein, 6 aa, Staphylococcus epidermidis
AEGEKC

SEQ ID NO: 1759187 - protein, 6 aa, Staphylococcus epidermidis
AEHDGK

SEQ ID NO: 1759188 - protein, 9 aa, Staphylococcus epidermidis
AEHDQGPAF

SEQ ID NO: 1759189 - protein, 5 aa, Staphylococcus epidermidis
AEIDD

SEQ ID NO: 1759190 - protein, 11 aa, Staphylococcus epidermidis
AEIDESSNTSM

SEQ ID NO: 1759191 - protein, 7 aa, Staphylococcus epidermidis
AEKTNSI

SEQ ID NO: 1759192 - protein, 7 aa, Staphylococcus epidermidis
AELQGEQ

SEQ ID NO: 1759193 - protein, 13 aa, Staphylococcus epidermidis
AELSTQNAEDDSL

SEQ ID NO: 1759194 - protein, 10 aa, Staphylococcus epidermidis
AEMTGRNDIQ

SEQ ID NO: 1759195 - protein, 5 aa, Staphylococcus epidermidis
AENGH

SEQ ID NO: 1759196 - protein, 8 aa, Staphylococcus epidermidis
AENGYPVT

SEQ ID NO: 1759197 - protein, 5 aa, Staphylococcus epidermidis
AENPY

SEQ ID NO: 1759198 - protein, 7 aa, Staphylococcus epidermidis
AEQAGIE

SEQ ID NO: 1759199 - protein, 8 aa, Staphylococcus epidermidis
AEQGTPED

SEQ ID NO: 1759200 - protein, 4 aa, Staphylococcus epidermidis
AEQI

SEQ ID NO: 1759201 - protein, 10 aa, Staphylococcus epidermidis
AEQNEVKPDH

SEQ ID NO: 1759202 - protein, 12 aa, Staphylococcus epidermidis
AERPADKPLQGY

SEQ ID NO: 1759203 - protein, 5 aa, Staphylococcus epidermidis
AERSN

SEQ ID NO: 1759204 - protein, 6 aa, Staphylococcus epidermidis
AESEQL

SEQ ID NO: 1759205 - protein, 12 aa, Staphylococcus epidermidis
AETDHTSADAQE

SEQ ID NO: 1759206 - protein, 8 aa, Staphylococcus epidermidis
AETKIGQQ

SEQ ID NO: 1759207 - protein, 4 aa, Staphylococcus epidermidis
AEVE

SEQ ID NO: 1759208 - protein, 19 aa, Staphylococcus epidermidis
AEWQGHQKGTYNEAKKGKA

SEQ ID NO: 1759209 - protein, 11 aa, Staphylococcus epidermidis
AFKDKSPSTEI

SEQ ID NO: 1759210 - protein, 9 aa, Staphylococcus epidermidis
AFKPTSKDS

SEQ ID NO: 1759211 - protein, 10 aa, Staphylococcus epidermidis
AFNASDNTTM

SEQ ID NO: 1759212 - protein, 18 aa, Staphylococcus epidermidis
AFSTGSSIMPQKKNPDMA

SEQ ID NO: 1759213 - protein, 7 aa, Staphylococcus epidermidis
AGADQSI

SEQ ID NO: 1759214 - protein, 7 aa, Staphylococcus epidermidis
AGDARSK

SEQ ID NO: 1759215 - protein, 5 aa, Staphylococcus epidermidis
AGDAS

SEQ ID NO: 1759216 - protein, 7 aa, Staphylococcus epidermidis
AGDEDVM

SEQ ID NO: 1759217 - protein, 6 aa, Staphylococcus epidermidis
AGDHDD

SEQ ID NO: 1759218 - protein, 6 aa, Staphylococcus epidermidis
AGDQTA

SEQ ID NO: 1759219 - protein, 7 aa, Staphylococcus epidermidis
AGENGPL

SEQ ID NO: 1759220 - protein, 5 aa, Staphylococcus epidermidis
AGEQC

SEQ ID NO: 1759221 - protein, 9 aa, Staphylococcus epidermidis
AGGKKAVDN

SEQ ID NO: 1759222 - protein, 5 aa, Staphylococcus epidermidis
AGGPV

SEQ ID NO: 1759223 - protein, 8 aa, Staphylococcus epidermidis
AGGSTSEH

SEQ ID NO: 1759224 - protein, 6 aa, Staphylococcus epidermidis
AGHEPG

SEQ ID NO: 1759225 - protein, 7 aa, Staphylococcus epidermidis
AGHSNGI

SEQ ID NO: 1759226 - protein, 5 aa, Staphylococcus epidermidis
AGITK

SEQ ID NO: 1759227 - protein, 19 aa, Staphylococcus epidermidis
AGKDKALPMNTGAEAVETA

SEQ ID NO: 1759228 - protein, 10 aa, Staphylococcus epidermidis
AGKGTEVGRS

SEQ ID NO: 1759229 - protein, 7 aa, Staphylococcus epidermidis
AGKSANI

SEQ ID NO: 1759230 - protein, 11 aa, Staphylococcus epidermidis
AGLGKNDEDNI

SEQ ID NO: 1759231 - protein, 7 aa, Staphylococcus epidermidis
AGLGRSG

SEQ ID NO: 1759232 - protein, 17 aa, Staphylococcus epidermidis
AGLPEKVAKNLQNALQN

SEQ ID NO: 1759233 - protein, 13 aa, Staphylococcus epidermidis
AGLPSRLSNSAGT

SEQ ID NO: 1759234 - protein, 7 aa, Staphylococcus epidermidis
AGLSSED

SEQ ID NO: 1759235 - protein, 5 aa, Staphylococcus epidermidis
AGNDY

SEQ ID NO: 1759236 - protein, 7 aa, Staphylococcus epidermidis
AGNEGIK

SEQ ID NO: 1759237 - protein, 6 aa, Staphylococcus epidermidis
AGNTAI

SEQ ID NO: 1759238 - protein, 9 aa, Staphylococcus epidermidis
AGPATDATI

SEQ ID NO: 1759239 - protein, 7 aa, Staphylococcus epidermidis
AGPNITS

SEQ ID NO: 1759240 - protein, 9 aa, Staphylococcus epidermidis
AGQGQNPAR

SEQ ID NO: 1759241 - protein, 7 aa, Staphylococcus epidermidis
AGQNAEE

SEQ ID NO: 1759242 - protein, 4 aa, Staphylococcus epidermidis
AGQR

SEQ ID NO: 1759243 - protein, 5 aa, Staphylococcus epidermidis
AGSEV

SEQ ID NO: 1759244 - protein, 8 aa, Staphylococcus epidermidis
AGSGKTRV

SEQ ID NO: 1759245 - protein, 13 aa, Staphylococcus epidermidis
AGSVSEKTIDKNQ

SEQ ID NO: 1759246 - protein, 6 aa, Staphylococcus epidermidis
AGTELG

SEQ ID NO: 1759247 - protein, 8 aa, Staphylococcus epidermidis
AGTKDGIT

SEQ ID NO: 1759248 - protein, 9 aa, Staphylococcus epidermidis
AGTKSDKEV

SEQ ID NO: 1759249 - protein, 19 aa, Staphylococcus epidermidis
AGTPAKVIKQTSEVQDSKR

SEQ ID NO: 1759250 - protein, 17 aa, Staphylococcus epidermidis
AGTTRDAIDTEYSYDGQ

SEQ ID NO: 1759251 - protein, 4 aa, Staphylococcus epidermidis
AGVG

SEQ ID NO: 1759252 - protein, 6 aa, Staphylococcus epidermidis
AGVKPE

SEQ ID NO: 1759253 - protein, 8 aa, Staphylococcus epidermidis
AGYEAGTE

SEQ ID NO: 1759254 - protein, 20 aa, Staphylococcus epidermidis
AGYHKTADVNGYRQEGFGPF

SEQ ID NO: 1759255 - protein, 5 aa, Staphylococcus epidermidis
AGYTA

SEQ ID NO: 1759256 - protein, 9 aa, Staphylococcus epidermidis
AHASQTGPF

SEQ ID NO: 1759257 - protein, 13 aa, Staphylococcus epidermidis
AHGKPSGIDTQTI

SEQ ID NO: 1759258 - protein, 8 aa, Staphylococcus epidermidis
AHGRERSG

SEQ ID NO: 1759259 - protein, 14 aa, Staphylococcus epidermidis
AHGYDTNPIGGFDK

SEQ ID NO: 1759260 - protein, 10 aa, Staphylococcus epidermidis
AHKAKALGEV

SEQ ID NO: 1759261 - protein, 7 aa, Staphylococcus epidermidis
AHKQEKI

SEQ ID NO: 1759262 - protein, 4 aa, Staphylococcus epidermidis
AHPS

SEQ ID NO: 1759263 - protein, 5 aa, Staphylococcus epidermidis
AHQSG

SEQ ID NO: 1759264 - protein, 6 aa, Staphylococcus epidermidis
AHRDKI

SEQ ID NO: 1759265 - protein, 10 aa, Staphylococcus epidermidis
AHTKDDIEKT

SEQ ID NO: 1759266 - protein, 6 aa, Staphylococcus epidermidis
AHTTEN

SEQ ID NO: 1759267 - protein, 11 aa, Staphylococcus epidermidis
AIETAAENERG

SEQ ID NO: 1759268 - protein, 8 aa, Staphylococcus epidermidis
AIGDGDHG

SEQ ID NO: 1759269 - protein, 12 aa, Staphylococcus epidermidis
AIGTSKDTEIRA

SEQ ID NO: 1759270 - protein, 6 aa, Staphylococcus epidermidis
AIHPES

SEQ ID NO: 1759271 - protein, 26 aa, Staphylococcus epidermidis
AIKEEQELNKLKSKKLQRLEKERHRQ

SEQ ID NO: 1759272 - protein, 7 aa, Staphylococcus epidermidis
AINKSRG

SEQ ID NO: 1759273 - protein, 4 aa, Staphylococcus epidermidis
AIPQ

SEQ ID NO: 1759274 - protein, 9 aa, Staphylococcus epidermidis
AISAPQIGV

SEQ ID NO: 1759275 - protein, 17 aa, Staphylococcus epidermidis
AISTPRSKQTAAETLAQ

SEQ ID NO: 1759276 - protein, 8 aa, Staphylococcus epidermidis
AITKSGET

SEQ ID NO: 1759277 - protein, 13 aa, Staphylococcus epidermidis
AITQAKSQQGPTI

SEQ ID NO: 1759278 - protein, 8 aa, Staphylococcus epidermidis
AKAAMESG

SEQ ID NO: 1759279 - protein, 4 aa, Staphylococcus epidermidis
AKAL

SEQ ID NO: 1759280 - protein, 8 aa, Staphylococcus epidermidis
AKAQDGAS

SEQ ID NO: 1759281 - protein, 12 aa, Staphylococcus epidermidis
AKARTTKQQARI

SEQ ID NO: 1759282 - protein, 7 aa, Staphylococcus epidermidis
AKDEHGR

SEQ ID NO: 1759283 - protein, 6 aa, Staphylococcus epidermidis
AKEASR

SEQ ID NO: 1759284 - protein, 6 aa, Staphylococcus epidermidis
AKEIGA

SEQ ID NO: 1759285 - protein, 8 aa, Staphylococcus epidermidis
AKENAKTL

SEQ ID NO: 1759286 - protein, 10 aa, Staphylococcus epidermidis
AKENKTDKQL

SEQ ID NO: 1759287 - protein, 22 aa, Staphylococcus epidermidis
AKEQGIEVSTDADFSKINNDKA

SEQ ID NO: 1759288 - protein, 9 aa, Staphylococcus epidermidis
AKERERTGI

SEQ ID NO: 1759289 - protein, 19 aa, Staphylococcus epidermidis
AKERGEKYQDFEQSDYANG

SEQ ID NO: 1759290 - protein, 8 aa, Staphylococcus epidermidis
AKETSVAN

SEQ ID NO: 1759291 - protein, 4 aa, Staphylococcus epidermidis
AKEY

SEQ ID NO: 1759292 - protein, 7 aa, Staphylococcus epidermidis
AKEYRQR

SEQ ID NO: 1759293 - protein, 6 aa, Staphylococcus epidermidis
AKFPPS

SEQ ID NO: 1759294 - protein, 7 aa, Staphylococcus epidermidis
AKGGKLT

SEQ ID NO: 1759295 - protein, 9 aa, Staphylococcus epidermidis
AKGGSRLKD

SEQ ID NO: 1759296 - protein, 8 aa, Staphylococcus epidermidis
AKGMPEGH

SEQ ID NO: 1759297 - protein, 6 aa, Staphylococcus epidermidis
AKGSGM

SEQ ID NO: 1759298 - protein, 6 aa, Staphylococcus epidermidis
AKGVES

SEQ ID NO: 1759299 - protein, 8 aa, Staphylococcus epidermidis
AKHGKNLK

SEQ ID NO: 1759300 - protein, 13 aa, Staphylococcus epidermidis
AKHPSEGGISNDK

SEQ ID NO: 1759301 - protein, 9 aa, Staphylococcus epidermidis
AKIGEEEKF

SEQ ID NO: 1759302 - protein, 5 aa, Staphylococcus epidermidis
AKINE

SEQ ID NO: 1759303 - protein, 9 aa, Staphylococcus epidermidis
AKKGLRKHN

SEQ ID NO: 1759304 - protein, 9 aa, Staphylococcus epidermidis
AKKIPEDLD

SEQ ID NO: 1759305 - protein, 9 aa, Staphylococcus epidermidis
AKLQAENGN

SEQ ID NO: 1759306 - protein, 5 aa, Staphylococcus epidermidis
AKNRK

SEQ ID NO: 1759307 - protein, 7 aa, Staphylococcus epidermidis
AKPDEVV

SEQ ID NO: 1759308 - protein, 6 aa, Staphylococcus epidermidis
AKPKAV

SEQ ID NO: 1759309 - protein, 7 aa, Staphylococcus epidermidis
AKPNTVE

SEQ ID NO: 1759310 - protein, 12 aa, Staphylococcus epidermidis
AKQSIASMSQAQ

SEQ ID NO: 1759311 - protein, 7 aa, Staphylococcus epidermidis
AKRIKKG

SEQ ID NO: 1759312 - protein, 9 aa, Staphylococcus epidermidis
AKRQVSEQL

SEQ ID NO: 1759313 - protein, 5 aa, Staphylococcus epidermidis
AKRRN

SEQ ID NO: 1759314 - protein, 9 aa, Staphylococcus epidermidis
AKSEDIANG

SEQ ID NO: 1759315 - protein, 4 aa, Staphylococcus epidermidis
AKSI

SEQ ID NO: 1759316 - protein, 6 aa, Staphylococcus epidermidis
AKSNIG

SEQ ID NO: 1759317 - protein, 5 aa, Staphylococcus epidermidis
AKTNK

SEQ ID NO: 1759318 - protein, 11 aa, Staphylococcus epidermidis
AKYADDLRPLD

SEQ ID NO: 1759319 - protein, 7 aa, Staphylococcus epidermidis
ALAGEKE

SEQ ID NO: 1759320 - protein, 8 aa, Staphylococcus epidermidis
ALATQDHN

SEQ ID NO: 1759321 - protein, 13 aa, Staphylococcus epidermidis
ALDTGNDPREFTQ

SEQ ID NO: 1759322 - protein, 10 aa, Staphylococcus epidermidis
ALEDGKPVRS

SEQ ID NO: 1759323 - protein, 4 aa, Staphylococcus epidermidis
ALGD

SEQ ID NO: 1759324 - protein, 5 aa, Staphylococcus epidermidis
ALGPY

SEQ ID NO: 1759325 - protein, 5 aa, Staphylococcus epidermidis
ALKGA

SEQ ID NO: 1759326 - protein, 9 aa, Staphylococcus epidermidis
ALKQPTDMN

SEQ ID NO: 1759327 - protein, 5 aa, Staphylococcus epidermidis
ALNDD

SEQ ID NO: 1759328 - protein, 10 aa, Staphylococcus epidermidis
ALNEGKPEKI

SEQ ID NO: 1759329 - protein, 12 aa, Staphylococcus epidermidis
ALNENKNEKLPF

SEQ ID NO: 1759330 - protein, 5 aa, Staphylococcus epidermidis
ALNKP

SEQ ID NO: 1759331 - protein, 16 aa, Staphylococcus epidermidis
ALPKGLSAKIDTQSFP

SEQ ID NO: 1759332 - protein, 9 aa, Staphylococcus epidermidis
ALSGTVTPQ

SEQ ID NO: 1759333 - protein, 14 aa, Staphylococcus epidermidis
ALSSSETVSLLVES

SEQ ID NO: 1759334 - protein, 20 aa, Staphylococcus epidermidis
AMEKGSNDRYFQEDKTPRKF

SEQ ID NO: 1759335 - protein, 23 aa, Staphylococcus epidermidis
AMPKEDAEKLKEQLEEVGASVEL

SEQ ID NO: 1759336 - protein, 14 aa, Staphylococcus epidermidis
AMSATGQKKITDQF

SEQ ID NO: 1759337 - protein, 8 aa, Staphylococcus epidermidis
AMSGSGRF

SEQ ID NO: 1759338 - protein, 8 aa, Staphylococcus epidermidis
ANAESKER

SEQ ID NO: 1759339 - protein, 14 aa, Staphylococcus epidermidis
ANAGDGSGQHPTQS

SEQ ID NO: 1759340 - protein, 15 aa, Staphylococcus epidermidis
ANAPRIDDQRYDTGT

SEQ ID NO: 1759341 - protein, 9 aa, Staphylococcus epidermidis
ANARNEEAV

SEQ ID NO: 1759342 - protein, 18 aa, Staphylococcus epidermidis
ANASKSKQATSRKKQLEK

SEQ ID NO: 1759343 - protein, 23 aa, Staphylococcus epidermidis
ANDIKSDPTFKQEVENLEKEIRN

SEQ ID NO: 1759344 - protein, 10 aa, Staphylococcus epidermidis
ANDKNEATLE

SEQ ID NO: 1759345 - protein, 9 aa, Staphylococcus epidermidis
ANDSYLRSE

SEQ ID NO: 1759346 - protein, 8 aa, Staphylococcus epidermidis
ANDTDYGL

SEQ ID NO: 1759347 - protein, 8 aa, Staphylococcus epidermidis
ANEFEPTR

SEQ ID NO: 1759348 - protein, 18 aa, Staphylococcus epidermidis
ANELDSDAENVDEYKENL

SEQ ID NO: 1759349 - protein, 8 aa, Staphylococcus epidermidis
ANESLTKP

SEQ ID NO: 1759350 - protein, 10 aa, Staphylococcus epidermidis
ANGDKKNDAI

SEQ ID NO: 1759351 - protein, 6 aa, Staphylococcus epidermidis
ANGTHK

SEQ ID NO: 1759352 - protein, 7 aa, Staphylococcus epidermidis
ANHGEYG

SEQ ID NO: 1759353 - protein, 9 aa, Staphylococcus epidermidis
ANKAELAGI

SEQ ID NO: 1759354 - protein, 6 aa, Staphylococcus epidermidis
ANKRDM

SEQ ID NO: 1759355 - protein, 7 aa, Staphylococcus epidermidis
ANKREDY

SEQ ID NO: 1759356 - protein, 10 aa, Staphylococcus epidermidis
ANNGTQSHIN

SEQ ID NO: 1759357 - protein, 16 aa, Staphylococcus epidermidis
ANPKFNEGEQPISASP

SEQ ID NO: 1759358 - protein, 6 aa, Staphylococcus epidermidis
ANQDKL

SEQ ID NO: 1759359 - protein, 4 aa, Staphylococcus epidermidis
ANQY

SEQ ID NO: 1759360 - protein, 8 aa, Staphylococcus epidermidis
ANRDTAPA

SEQ ID NO: 1759361 - protein, 9 aa, Staphylococcus epidermidis
ANSGEELPM

SEQ ID NO: 1759362 - protein, 8 aa, Staphylococcus epidermidis
ANTKDGRY

SEQ ID NO: 1759363 - protein, 7 aa, Staphylococcus epidermidis
ANTNKDY

SEQ ID NO: 1759364 - protein, 9 aa, Staphylococcus epidermidis
ANVQPSDDY

SEQ ID NO: 1759365 - protein, 9 aa, Staphylococcus epidermidis
ANVTREGDD

SEQ ID NO: 1759366 - protein, 13 aa, Staphylococcus epidermidis
ANVTTPQSIQTAS

SEQ ID NO: 1759367 - protein, 6 aa, Staphylococcus epidermidis
ANYKRQ

SEQ ID NO: 1759368 - protein, 5 aa, Staphylococcus epidermidis
APAIE

SEQ ID NO: 1759369 - protein, 12 aa, Staphylococcus epidermidis
APDGNTISATEH

SEQ ID NO: 1759370 - protein, 10 aa, Staphylococcus epidermidis
APDRNNVNGY

SEQ ID NO: 1759371 - protein, 14 aa, Staphylococcus epidermidis
APGIGKEAGASLNS

SEQ ID NO: 1759372 - protein, 7 aa, Staphylococcus epidermidis
APGNYEK

SEQ ID NO: 1759373 - protein, 6 aa, Staphylococcus epidermidis
APGPLS

SEQ ID NO: 1759374 - protein, 6 aa, Staphylococcus epidermidis
APGQEL

SEQ ID NO: 1759375 - protein, 4 aa, Staphylococcus epidermidis
APKN

SEQ ID NO: 1759376 - protein, 10 aa, Staphylococcus epidermidis
APKNQSDRLK

SEQ ID NO: 1759377 - protein, 11 aa, Staphylococcus epidermidis
APLGSGETYGY

SEQ ID NO: 1759378 - protein, 14 aa, Staphylococcus epidermidis
APLQSENKDAPGYV

SEQ ID NO: 1759379 - protein, 5 aa, Staphylococcus epidermidis
APLRQ

SEQ ID NO: 1759380 - protein, 6 aa, Staphylococcus epidermidis
APNMDE

SEQ ID NO: 1759381 - protein, 10 aa, Staphylococcus epidermidis
APNSQRENEI

SEQ ID NO: 1759382 - protein, 7 aa, Staphylococcus epidermidis
APPQGVE

SEQ ID NO: 1759383 - protein, 8 aa, Staphylococcus epidermidis
APQINEPK

SEQ ID NO: 1759384 - protein, 10 aa, Staphylococcus epidermidis
APQNTRRKNI

SEQ ID NO: 1759385 - protein, 5 aa, Staphylococcus epidermidis
APSMP

SEQ ID NO: 1759386 - protein, 10 aa, Staphylococcus epidermidis
APVDNSDEPL

SEQ ID NO: 1759387 - protein, 9 aa, Staphylococcus epidermidis
APVGTTLDE

SEQ ID NO: 1759388 - protein, 9 aa, Staphylococcus epidermidis
APVYSTSSL

SEQ ID NO: 1759389 - protein, 7 aa, Staphylococcus epidermidis
AQAPRSY

SEQ ID NO: 1759390 - protein, 10 aa, Staphylococcus epidermidis
AQASRYRSAG

SEQ ID NO: 1759391 - protein, 9 aa, Staphylococcus epidermidis
AQEKAEADQ

SEQ ID NO: 1759392 - protein, 20 aa, Staphylococcus epidermidis
AQEPKHGKVRQNEDDIISWI

SEQ ID NO: 1759393 - protein, 5 aa, Staphylococcus epidermidis
AQGEK

SEQ ID NO: 1759394 - protein, 4 aa, Staphylococcus epidermidis
AQGN

SEQ ID NO: 1759395 - protein, 8 aa, Staphylococcus epidermidis
AQGTNRSL

SEQ ID NO: 1759396 - protein, 7 aa, Staphylococcus epidermidis
AQIGKEI

SEQ ID NO: 1759397 - protein, 10 aa, Staphylococcus epidermidis
AQKNDQEAYE

SEQ ID NO: 1759398 - protein, 5 aa, Staphylococcus epidermidis
AQKST

SEQ ID NO: 1759399 - protein, 5 aa, Staphylococcus epidermidis
AQLAE

SEQ ID NO: 1759400 - protein, 8 aa, Staphylococcus epidermidis
AQLAEPEK

SEQ ID NO: 1759401 - protein, 5 aa, Staphylococcus epidermidis
AQLGQ

SEQ ID NO: 1759402 - protein, 15 aa, Staphylococcus epidermidis
AQLTDKEKPTITSST

SEQ ID NO: 1759403 - protein, 5 aa, Staphylococcus epidermidis
AQMQG

SEQ ID NO: 1759404 - protein, 8 aa, Staphylococcus epidermidis
AQNARDLP

SEQ ID NO: 1759405 - protein, 15 aa, Staphylococcus epidermidis
AQNEDGRIPSSKGVI

SEQ ID NO: 1759406 - protein, 7 aa, Staphylococcus epidermidis
AQNSENL

SEQ ID NO: 1759407 - protein, 21 aa, Staphylococcus epidermidis
AQQDVDQEKAKDLEKKMRESS

SEQ ID NO: 1759408 - protein, 5 aa, Staphylococcus epidermidis
AQQKG

SEQ ID NO: 1759409 - protein, 7 aa, Staphylococcus epidermidis
AQQNNDL

SEQ ID NO: 1759410 - protein, 5 aa, Staphylococcus epidermidis
AQQTR

SEQ ID NO: 1759411 - protein, 4 aa, Staphylococcus epidermidis
AQRA

SEQ ID NO: 1759412 - protein, 13 aa, Staphylococcus epidermidis
AQRALDNQNTKDR

SEQ ID NO: 1759413 - protein, 8 aa, Staphylococcus epidermidis
AQRPGSVT

SEQ ID NO: 1759414 - protein, 8 aa, Staphylococcus epidermidis
AQRQDAEH

SEQ ID NO: 1759415 - protein, 18 aa, Staphylococcus epidermidis
AQRVSEETAMKNREMANE

SEQ ID NO: 1759416 - protein, 7 aa, Staphylococcus epidermidis
AQSGTID

SEQ ID NO: 1759417 - protein, 10 aa, Staphylococcus epidermidis
AQSIEDSNVR

SEQ ID NO: 1759418 - protein, 5 aa, Staphylococcus epidermidis
AQSIL

SEQ ID NO: 1759419 - protein, 7 aa, Staphylococcus epidermidis
AQVQADS

SEQ ID NO: 1759420 - protein, 5 aa, Staphylococcus epidermidis
AQYEA

SEQ ID NO: 1759421 - protein, 5 aa, Staphylococcus epidermidis
ARAGA

SEQ ID NO: 1759422 - protein, 18 aa, Staphylococcus epidermidis
ARAPLKRNVDQEEVGKTA

SEQ ID NO: 1759423 - protein, 20 aa, Staphylococcus epidermidis
AREAGDRSKISVYSDNPDID

SEQ ID NO: 1759424 - protein, 7 aa, Staphylococcus epidermidis
AREGGNN

SEQ ID NO: 1759425 - protein, 4 aa, Staphylococcus epidermidis
AREN

SEQ ID NO: 1759426 - protein, 10 aa, Staphylococcus epidermidis
ARGADSVAHQ

SEQ ID NO: 1759427 - protein, 13 aa, Staphylococcus epidermidis
ARGERERVKQRAN

SEQ ID NO: 1759428 - protein, 5 aa, Staphylococcus epidermidis
ARGFS

SEQ ID NO: 1759429 - protein, 9 aa, Staphylococcus epidermidis
ARKANGAKV

SEQ ID NO: 1759430 - protein, 6 aa, Staphylococcus epidermidis
ARKNTN

SEQ ID NO: 1759431 - protein, 6 aa, Staphylococcus epidermidis
ARNKEI

SEQ ID NO: 1759432 - protein, 12 aa, Staphylococcus epidermidis
ARNNETVERPKR

SEQ ID NO: 1759433 - protein, 7 aa, Staphylococcus epidermidis
ARNSNLS

SEQ ID NO: 1759434 - protein, 6 aa, Staphylococcus epidermidis
ARPKPV

SEQ ID NO: 1759435 - protein, 5 aa, Staphylococcus epidermidis
ARQHD

SEQ ID NO: 1759436 - protein, 5 aa, Staphylococcus epidermidis
ARQIK

SEQ ID NO: 1759437 - protein, 8 aa, Staphylococcus epidermidis
ARQSIQDA

SEQ ID NO: 1759438 - protein, 8 aa, Staphylococcus epidermidis
ARRHNKTL

SEQ ID NO: 1759439 - protein, 9 aa, Staphylococcus epidermidis
ARRSVNPPI

SEQ ID NO: 1759440 - protein, 11 aa, Staphylococcus epidermidis
ARYEQGELTEY

SEQ ID NO: 1759441 - protein, 8 aa, Staphylococcus epidermidis
ARYPQIDS

SEQ ID NO: 1759442 - protein, 6 aa, Staphylococcus epidermidis
ASAGVS

SEQ ID NO: 1759443 - protein, 6 aa, Staphylococcus epidermidis
ASEKFG

SEQ ID NO: 1759444 - protein, 15 aa, Staphylococcus epidermidis
ASENHKKRVQSSTLN

SEQ ID NO: 1759445 - protein, 10 aa, Staphylococcus epidermidis
ASESLDNTPN

SEQ ID NO: 1759446 - protein, 11 aa, Staphylococcus epidermidis
ASETASKTAME

SEQ ID NO: 1759447 - protein, 7 aa, Staphylococcus epidermidis
ASGFPKE

SEQ ID NO: 1759448 - protein, 8 aa, Staphylococcus epidermidis
ASGISPNE

SEQ ID NO: 1759449 - protein, 6 aa, Staphylococcus epidermidis
ASGKSI

SEQ ID NO: 1759450 - protein, 6 aa, Staphylococcus epidermidis
ASGRFG

SEQ ID NO: 1759451 - protein, 8 aa, Staphylococcus epidermidis
ASGSGKTT

SEQ ID NO: 1759452 - protein, 6 aa, Staphylococcus epidermidis
ASHLSP

SEQ ID NO: 1759453 - protein, 7 aa, Staphylococcus epidermidis
ASHQQSY

SEQ ID NO: 1759454 - protein, 5 aa, Staphylococcus epidermidis
ASIEN

SEQ ID NO: 1759455 - protein, 4 aa, Staphylococcus epidermidis
ASIQ

SEQ ID NO: 1759456 - protein, 9 aa, Staphylococcus epidermidis
ASKAGGLPV

SEQ ID NO: 1759457 - protein, 16 aa, Staphylococcus epidermidis
ASKAVSKIQQETSASV

SEQ ID NO: 1759458 - protein, 8 aa, Staphylococcus epidermidis
ASKDVGTT

SEQ ID NO: 1759459 - protein, 5 aa, Staphylococcus epidermidis
ASKGG

SEQ ID NO: 1759460 - protein, 21 aa, Staphylococcus epidermidis
ASKGQANPQKVNSLLKQELDN

SEQ ID NO: 1759461 - protein, 11 aa, Staphylococcus epidermidis
ASKNMNNGNIS

SEQ ID NO: 1759462 - protein, 9 aa, Staphylococcus epidermidis
ASKVDRTQY

SEQ ID NO: 1759463 - protein, 10 aa, Staphylococcus epidermidis
ASLDKDTQHV

SEQ ID NO: 1759464 - protein, 5 aa, Staphylococcus epidermidis
ASLNP

SEQ ID NO: 1759465 - protein, 6 aa, Staphylococcus epidermidis
ASMHDK

SEQ ID NO: 1759466 - protein, 7 aa, Staphylococcus epidermidis
ASNLQST

SEQ ID NO: 1759467 - protein, 4 aa, Staphylococcus epidermidis
ASNM

SEQ ID NO: 1759468 - protein, 12 aa, Staphylococcus epidermidis
ASNMETSYGSAE

SEQ ID NO: 1759469 - protein, 6 aa, Staphylococcus epidermidis
ASNTQG

SEQ ID NO: 1759470 - protein, 14 aa, Staphylococcus epidermidis
ASPGAERPIKKEKD

SEQ ID NO: 1759471 - protein, 11 aa, Staphylococcus epidermidis
ASPNKEHYSEE

SEQ ID NO: 1759472 - protein, 13 aa, Staphylococcus epidermidis
ASQGKVFEGYANV

SEQ ID NO: 1759473 - protein, 6 aa, Staphylococcus epidermidis
ASQIED

SEQ ID NO: 1759474 - protein, 5 aa, Staphylococcus epidermidis
ASQQK

SEQ ID NO: 1759475 - protein, 8 aa, Staphylococcus epidermidis
ASQQYNNL

SEQ ID NO: 1759476 - protein, 9 aa, Staphylococcus epidermidis
ASQTHASNA

SEQ ID NO: 1759477 - protein, 6 aa, Staphylococcus epidermidis
ASQYGA

SEQ ID NO: 1759478 - protein, 15 aa, Staphylococcus epidermidis
ASRALSTNNDPETAC

SEQ ID NO: 1759479 - protein, 5 aa, Staphylococcus epidermidis
ASSHH

SEQ ID NO: 1759480 - protein, 5 aa, Staphylococcus epidermidis
ASSIQ

SEQ ID NO: 1759481 - protein, 22 aa, Staphylococcus epidermidis
ASSLTGDEATIPNHKDITEQLD

SEQ ID NO: 1759482 - protein, 11 aa, Staphylococcus epidermidis
ASSMAQQAGGY

SEQ ID NO: 1759483 - protein, 10 aa, Staphylococcus epidermidis
ASSQRDRKKR

SEQ ID NO: 1759484 - protein, 11 aa, Staphylococcus epidermidis
ASTGNHRSHAL

SEQ ID NO: 1759485 - protein, 12 aa, Staphylococcus epidermidis
ASTITSHDAGYL

SEQ ID NO: 1759486 - protein, 6 aa, Staphylococcus epidermidis
ASTRVV

SEQ ID NO: 1759487 - protein, 11 aa, Staphylococcus epidermidis
ASVNNRQNGQR

SEQ ID NO: 1759488 - protein, 7 aa, Staphylococcus epidermidis
ATAEKKP

SEQ ID NO: 1759489 - protein, 4 aa, Staphylococcus epidermidis
ATAF

SEQ ID NO: 1759490 - protein, 11 aa, Staphylococcus epidermidis
ATDADAERYAQ

SEQ ID NO: 1759491 - protein, 4 aa, Staphylococcus epidermidis
ATDH

SEQ ID NO: 1759492 - protein, 9 aa, Staphylococcus epidermidis
ATDPSEGAY

SEQ ID NO: 1759493 - protein, 11 aa, Staphylococcus epidermidis
ATELKQADQDV

SEQ ID NO: 1759494 - protein, 5 aa, Staphylococcus epidermidis
ATFKQ

SEQ ID NO: 1759495 - protein, 6 aa, Staphylococcus epidermidis
ATGKHT

SEQ ID NO: 1759496 - protein, 8 aa, Staphylococcus epidermidis
ATGKSTVS

SEQ ID NO: 1759497 - protein, 6 aa, Staphylococcus epidermidis
ATGSIT

SEQ ID NO: 1759498 - protein, 17 aa, Staphylococcus epidermidis
ATGTPAGVGAGLQPPQF

SEQ ID NO: 1759499 - protein, 4 aa, Staphylococcus epidermidis
ATHE

SEQ ID NO: 1759500 - protein, 6 aa, Staphylococcus epidermidis
ATHGKK

SEQ ID NO: 1759501 - protein, 10 aa, Staphylococcus epidermidis
ATKDDMQTLK

SEQ ID NO: 1759502 - protein, 8 aa, Staphylococcus epidermidis
ATKEAVKP

SEQ ID NO: 1759503 - protein, 43 aa, Staphylococcus epidermidis
ATLPKENVIESDASTTQSYLEDDNDEDKPTLGDVFGDKFKDLK

SEQ ID NO: 1759504 - protein, 6 aa, Staphylococcus epidermidis
ATLTKA

SEQ ID NO: 1759505 - protein, 4 aa, Staphylococcus epidermidis
ATMA

SEQ ID NO: 1759506 - protein, 6 aa, Staphylococcus epidermidis
ATPFPR

SEQ ID NO: 1759507 - protein, 5 aa, Staphylococcus epidermidis
ATSFQ

SEQ ID NO: 1759508 - protein, 10 aa, Staphylococcus epidermidis
ATSGGGGKGM

SEQ ID NO: 1759509 - protein, 5 aa, Staphylococcus epidermidis
ATSHA

SEQ ID NO: 1759510 - protein, 7 aa, Staphylococcus epidermidis
ATSKNEL

SEQ ID NO: 1759511 - protein, 14 aa, Staphylococcus epidermidis
ATSSEKSQIQNREK

SEQ ID NO: 1759512 - protein, 15 aa, Staphylococcus epidermidis
ATSYDDASSKYTPAW

SEQ ID NO: 1759513 - protein, 12 aa, Staphylococcus epidermidis
ATVKTMSPEELR

SEQ ID NO: 1759514 - protein, 13 aa, Staphylococcus epidermidis
ATYTKEDAFNQES

SEQ ID NO: 1759515 - protein, 30 aa, Staphylococcus epidermidis
AVAEGKGKTKKESEQKAAEQAYKLMKNKKS

SEQ ID NO: 1759516 - protein, 8 aa, Staphylococcus epidermidis
AVAKGYDM

SEQ ID NO: 1759517 - protein, 7 aa, Staphylococcus epidermidis
AVGGGNY

SEQ ID NO: 1759518 - protein, 11 aa, Staphylococcus epidermidis
AVGSKGQVTGL

SEQ ID NO: 1759519 - protein, 8 aa, Staphylococcus epidermidis
AVGTDGSI

SEQ ID NO: 1759520 - protein, 5 aa, Staphylococcus epidermidis
AVKRA

SEQ ID NO: 1759521 - protein, 16 aa, Staphylococcus epidermidis
AVNGDANGSIPTSEPL

SEQ ID NO: 1759522 - protein, 15 aa, Staphylococcus epidermidis
AVNGSGKNGRITKED

SEQ ID NO: 1759523 - protein, 13 aa, Staphylococcus epidermidis
AVNPYGDGQASER

SEQ ID NO: 1759524 - protein, 8 aa, Staphylococcus epidermidis
AVNQGHRH

SEQ ID NO: 1759525 - protein, 4 aa, Staphylococcus epidermidis
AVPG

SEQ ID NO: 1759526 - protein, 9 aa, Staphylococcus epidermidis
AVQGSNRSN

SEQ ID NO: 1759527 - protein, 5 aa, Staphylococcus epidermidis
AVTSA

SEQ ID NO: 1759528 - protein, 8 aa, Staphylococcus epidermidis
AWDNTDRP

SEQ ID NO: 1759529 - protein, 9 aa, Staphylococcus epidermidis
AYAGDSQAD

SEQ ID NO: 1759530 - protein, 4 aa, Staphylococcus epidermidis
AYDE

SEQ ID NO: 1759531 - protein, 9 aa, Staphylococcus epidermidis
AYDKETNHI

SEQ ID NO: 1759532 - protein, 10 aa, Staphylococcus epidermidis
AYEKNDLTQE

SEQ ID NO: 1759533 - protein, 13 aa, Staphylococcus epidermidis
AYLANGKSPKEAI

SEQ ID NO: 1759534 - protein, 6 aa, Staphylococcus epidermidis
AYQKPE

SEQ ID NO: 1759535 - protein, 8 aa, Staphylococcus epidermidis
AYRKRYDN

SEQ ID NO: 1759536 - protein, 14 aa, Staphylococcus epidermidis
AYSEHSDQMLTEGN

SEQ ID NO: 1759537 - protein, 6 aa, Staphylococcus epidermidis
AYTPKL

SEQ ID NO: 1759538 - protein, 4 aa, Staphylococcus epidermidis
AYTS

SEQ ID NO: 1759539 - protein, 6 aa, Staphylococcus epidermidis
AYVSSN

SEQ ID NO: 1759540 - protein, 6 aa, Staphylococcus epidermidis
CEGNES

SEQ ID NO: 1759541 - protein, 5 aa, Staphylococcus epidermidis
CGRPH

SEQ ID NO: 1759542 - protein, 18 aa, Staphylococcus epidermidis
CNGDGAKPGTSKKTCSYC

SEQ ID NO: 1759543 - protein, 7 aa, Staphylococcus epidermidis
CRSDDKE

SEQ ID NO: 1759544 - protein, 13 aa, Staphylococcus epidermidis
CSRDNKHTLHRET

SEQ ID NO: 1759545 - protein, 10 aa, Staphylococcus epidermidis
CSVQRKNQKL

SEQ ID NO: 1759546 - protein, 7 aa, Staphylococcus epidermidis
CTGRGEQ

SEQ ID NO: 1759547 - protein, 11 aa, Staphylococcus epidermidis
CTQYEKQHSRE

SEQ ID NO: 1759548 - protein, 9 aa, Staphylococcus epidermidis
DADHIQENV

SEQ ID NO: 1759549 - protein, 18 aa, Staphylococcus epidermidis
DADMKETEAIYGQTDSGM

SEQ ID NO: 1759550 - protein, 6 aa, Staphylococcus epidermidis
DADQGW

SEQ ID NO: 1759551 - protein, 5 aa, Staphylococcus epidermidis
DADQN

SEQ ID NO: 1759552 - protein, 4 aa, Staphylococcus epidermidis
DAEA

SEQ ID NO: 1759553 - protein, 18 aa, Staphylococcus epidermidis
DAFNRRKGMSDEEIGNQL

SEQ ID NO: 1759554 - protein, 8 aa, Staphylococcus epidermidis
DAHASPTV

SEQ ID NO: 1759555 - protein, 7 aa, Staphylococcus epidermidis
DAIEGAK

SEQ ID NO: 1759556 - protein, 9 aa, Staphylococcus epidermidis
DAIKNGATL

SEQ ID NO: 1759557 - protein, 7 aa, Staphylococcus epidermidis
DAIPDNA

SEQ ID NO: 1759558 - protein, 7 aa, Staphylococcus epidermidis
DAKDEDW

SEQ ID NO: 1759559 - protein, 8 aa, Staphylococcus epidermidis
DAKKSTPL

SEQ ID NO: 1759560 - protein, 6 aa, Staphylococcus epidermidis
DAKLDD

SEQ ID NO: 1759561 - protein, 7 aa, Staphylococcus epidermidis
DAKPENY

SEQ ID NO: 1759562 - protein, 9 aa, Staphylococcus epidermidis
DALKNNSNL

SEQ ID NO: 1759563 - protein, 7 aa, Staphylococcus epidermidis
DANNDKD

SEQ ID NO: 1759564 - protein, 19 aa, Staphylococcus epidermidis
DAPGEVSDKQLQELSLRIR

SEQ ID NO: 1759565 - protein, 7 aa, Staphylococcus epidermidis
DAPYDGY

SEQ ID NO: 1759566 - protein, 19 aa, Staphylococcus epidermidis
DAPYLSPHPYRGKRNEPER

SEQ ID NO: 1759567 - protein, 6 aa, Staphylococcus epidermidis
DAQATE

SEQ ID NO: 1759568 - protein, 15 aa, Staphylococcus epidermidis
DAQTYGSQGQQRTTA

SEQ ID NO: 1759569 - protein, 6 aa, Staphylococcus epidermidis
DASPSQ

SEQ ID NO: 1759570 - protein, 8 aa, Staphylococcus epidermidis
DAVTEGVP

SEQ ID NO: 1759571 - protein, 9 aa, Staphylococcus epidermidis
DAYDNNENL

SEQ ID NO: 1759572 - protein, 5 aa, Staphylococcus epidermidis
DCPTG

SEQ ID NO: 1759573 - protein, 9 aa, Staphylococcus epidermidis
DDAGIKAQD

SEQ ID NO: 1759574 - protein, 4 aa, Staphylococcus epidermidis
DDAI

SEQ ID NO: 1759575 - protein, 6 aa, Staphylococcus epidermidis
DDAPEV

SEQ ID NO: 1759576 - protein, 6 aa, Staphylococcus epidermidis
DDAQTM

SEQ ID NO: 1759577 - protein, 7 aa, Staphylococcus epidermidis
DDASYIT

SEQ ID NO: 1759578 - protein, 5 aa, Staphylococcus epidermidis
DDDAA

SEQ ID NO: 1759579 - protein, 5 aa, Staphylococcus epidermidis
DDDEI

SEQ ID NO: 1759580 - protein, 7 aa, Staphylococcus epidermidis
DDDGHSF

SEQ ID NO: 1759581 - protein, 8 aa, Staphylococcus epidermidis
DDDNDVGK

SEQ ID NO: 1759582 - protein, 6 aa, Staphylococcus epidermidis
DDDNEA

SEQ ID NO: 1759583 - protein, 7 aa, Staphylococcus epidermidis
DDDTPIG

SEQ ID NO: 1759584 - protein, 11 aa, Staphylococcus epidermidis
DDDTPKDKAVA

SEQ ID NO: 1759585 - protein, 9 aa, Staphylococcus epidermidis
DDEDEEDQN

SEQ ID NO: 1759586 - protein, 6 aa, Staphylococcus epidermidis
DDEETA

SEQ ID NO: 1759587 - protein, 5 aa, Staphylococcus epidermidis
DDEFT

SEQ ID NO: 1759588 - protein, 7 aa, Staphylococcus epidermidis
DDEGGNI

SEQ ID NO: 1759589 - protein, 4 aa, Staphylococcus epidermidis
DDEI

SEQ ID NO: 1759590 - protein, 7 aa, Staphylococcus epidermidis
DDEMKRS

SEQ ID NO: 1759591 - protein, 7 aa, Staphylococcus epidermidis
DDEQEAI

SEQ ID NO: 1759592 - protein, 5 aa, Staphylococcus epidermidis
DDEQH

SEQ ID NO: 1759593 - protein, 4 aa, Staphylococcus epidermidis
DDES

SEQ ID NO: 1759594 - protein, 9 aa, Staphylococcus epidermidis
DDETLDESI

SEQ ID NO: 1759595 - protein, 8 aa, Staphylococcus epidermidis
DDFKDYQN

SEQ ID NO: 1759596 - protein, 8 aa, Staphylococcus epidermidis
DDGGHAKV

SEQ ID NO: 1759597 - protein, 7 aa, Staphylococcus epidermidis
DDGKEAV

SEQ ID NO: 1759598 - protein, 12 aa, Staphylococcus epidermidis
DDGKEVGPNVKG

SEQ ID NO: 1759599 - protein, 5 aa, Staphylococcus epidermidis
DDGQI

SEQ ID NO: 1759600 - protein, 9 aa, Staphylococcus epidermidis
DDGRTRTLE

SEQ ID NO: 1759601 - protein, 4 aa, Staphylococcus epidermidis
DDHD

SEQ ID NO: 1759602 - protein, 6 aa, Staphylococcus epidermidis
DDHNKP

SEQ ID NO: 1759603 - protein, 7 aa, Staphylococcus epidermidis
DDIHPNG

SEQ ID NO: 1759604 - protein, 15 aa, Staphylococcus epidermidis
DDIKTTNSPAITGDG

SEQ ID NO: 1759605 - protein, 8 aa, Staphylococcus epidermidis
DDLKGRTI

SEQ ID NO: 1759606 - protein, 6 aa, Staphylococcus epidermidis
DDMSAT

SEQ ID NO: 1759607 - protein, 6 aa, Staphylococcus epidermidis
DDMSTK

SEQ ID NO: 1759608 - protein, 18 aa, Staphylococcus epidermidis
DDNRTVNEKRADLLREHI

SEQ ID NO: 1759609 - protein, 9 aa, Staphylococcus epidermidis
DDPAGKDWS

SEQ ID NO: 1759610 - protein, 9 aa, Staphylococcus epidermidis
DDPAGKPWS

SEQ ID NO: 1759611 - protein, 4 aa, Staphylococcus epidermidis
DDPI

SEQ ID NO: 1759612 - protein, 6 aa, Staphylococcus epidermidis
DDPSEL

SEQ ID NO: 1759613 - protein, 4 aa, Staphylococcus epidermidis
DDQL

SEQ ID NO: 1759614 - protein, 6 aa, Staphylococcus epidermidis
DDRDFG

SEQ ID NO: 1759615 - protein, 5 aa, Staphylococcus epidermidis
DDREA

SEQ ID NO: 1759616 - protein, 14 aa, Staphylococcus epidermidis
DDRRDKSRKMNDKL

SEQ ID NO: 1759617 - protein, 5 aa, Staphylococcus epidermidis
DDRVD

SEQ ID NO: 1759618 - protein, 10 aa, Staphylococcus epidermidis
DDSESYEDIT

SEQ ID NO: 1759619 - protein, 6 aa, Staphylococcus epidermidis
DDSKYQ

SEQ ID NO: 1759620 - protein, 7 aa, Staphylococcus epidermidis
DDSQTQG

SEQ ID NO: 1759621 - protein, 16 aa, Staphylococcus epidermidis
DDSYAYEHEEGQYGKS

SEQ ID NO: 1759622 - protein, 16 aa, Staphylococcus epidermidis
DDTDENGVCTATEDYN

SEQ ID NO: 1759623 - protein, 8 aa, Staphylococcus epidermidis
DDTDNGFK

SEQ ID NO: 1759624 - protein, 4 aa, Staphylococcus epidermidis
DDTL

SEQ ID NO: 1759625 - protein, 4 aa, Staphylococcus epidermidis
DDTN

SEQ ID NO: 1759626 - protein, 5 aa, Staphylococcus epidermidis
DDTWG

SEQ ID NO: 1759627 - protein, 7 aa, Staphylococcus epidermidis
DDVDQAK

SEQ ID NO: 1759628 - protein, 6 aa, Staphylococcus epidermidis
DEAAEL

SEQ ID NO: 1759629 - protein, 9 aa, Staphylococcus epidermidis
DEADTQNGV

SEQ ID NO: 1759630 - protein, 19 aa, Staphylococcus epidermidis
DEARGVTGQNITVDGGLTM

SEQ ID NO: 1759631 - protein, 13 aa, Staphylococcus epidermidis
DEARTGNDQPATK

SEQ ID NO: 1759632 - protein, 14 aa, Staphylococcus epidermidis
DEARTKAASTGDYY

SEQ ID NO: 1759633 - protein, 12 aa, Staphylococcus epidermidis
DEATSAEERQTS

SEQ ID NO: 1759634 - protein, 23 aa, Staphylococcus epidermidis
DEDEDEDIAEGEEEAFEDAEDFN

SEQ ID NO: 1759635 - protein, 8 aa, Staphylococcus epidermidis
DEDNERIS

SEQ ID NO: 1759636 - protein, 7 aa, Staphylococcus epidermidis
DEDQFQK

SEQ ID NO: 1759637 - protein, 5 aa, Staphylococcus epidermidis
DEEEV

SEQ ID NO: 1759638 - protein, 7 aa, Staphylococcus epidermidis
DEEIENP

SEQ ID NO: 1759639 - protein, 8 aa, Staphylococcus epidermidis
DEENGNTF

SEQ ID NO: 1759640 - protein, 19 aa, Staphylococcus epidermidis
DEENIEVSDEDIDKELEKM

SEQ ID NO: 1759641 - protein, 7 aa, Staphylococcus epidermidis
DEEVGKK

SEQ ID NO: 1759642 - protein, 7 aa, Staphylococcus epidermidis
DEGADGI

SEQ ID NO: 1759643 - protein, 7 aa, Staphylococcus epidermidis
DEGAKIT

SEQ ID NO: 1759644 - protein, 10 aa, Staphylococcus epidermidis
DEGESIGQHP

SEQ ID NO: 1759645 - protein, 6 aa, Staphylococcus epidermidis
DEGIPT

SEQ ID NO: 1759646 - protein, 11 aa, Staphylococcus epidermidis
DEGNYSSITSD

SEQ ID NO: 1759647 - protein, 4 aa, Staphylococcus epidermidis
DEIA

SEQ ID NO: 1759648 - protein, 12 aa, Staphylococcus epidermidis
DEIEEAENIEET

SEQ ID NO: 1759649 - protein, 9 aa, Staphylococcus epidermidis
DEKEKGKRK

SEQ ID NO: 1759650 - protein, 10 aa, Staphylococcus epidermidis
DEKEKTVHDD

SEQ ID NO: 1759651 - protein, 4 aa, Staphylococcus epidermidis
DELA

SEQ ID NO: 1759652 - protein, 4 aa, Staphylococcus epidermidis
DELD

SEQ ID NO: 1759653 - protein, 6 aa, Staphylococcus epidermidis
DELGTK

SEQ ID NO: 1759654 - protein, 9 aa, Staphylococcus epidermidis
DELVGKPPK

SEQ ID NO: 1759655 - protein, 7 aa, Staphylococcus epidermidis
DENDIDE

SEQ ID NO: 1759656 - protein, 6 aa, Staphylococcus epidermidis
DENDKL

SEQ ID NO: 1759657 - protein, 7 aa, Staphylococcus epidermidis
DENDPIP

SEQ ID NO: 1759658 - protein, 7 aa, Staphylococcus epidermidis
DENGYKA

SEQ ID NO: 1759659 - protein, 7 aa, Staphylococcus epidermidis
DENQREM

SEQ ID NO: 1759660 - protein, 14 aa, Staphylococcus epidermidis
DEPTASLDASRAQE

SEQ ID NO: 1759661 - protein, 12 aa, Staphylococcus epidermidis
DEPTASLDTNNA

SEQ ID NO: 1759662 - protein, 13 aa, Staphylococcus epidermidis
DEPTGALDSKTSK

SEQ ID NO: 1759663 - protein, 8 aa, Staphylococcus epidermidis
DEPTTALD

SEQ ID NO: 1759664 - protein, 5 aa, Staphylococcus epidermidis
DEPVQ

SEQ ID NO: 1759665 - protein, 5 aa, Staphylococcus epidermidis
DEQAS

SEQ ID NO: 1759666 - protein, 9 aa, Staphylococcus epidermidis
DEQEASPKY

SEQ ID NO: 1759667 - protein, 18 aa, Staphylococcus epidermidis
DEQKMGSYQYEINYKEIS

SEQ ID NO: 1759668 - protein, 8 aa, Staphylococcus epidermidis
DEQQSSSF

SEQ ID NO: 1759669 - protein, 7 aa, Staphylococcus epidermidis
DEQQYKQ

SEQ ID NO: 1759670 - protein, 6 aa, Staphylococcus epidermidis
DEQRGI

SEQ ID NO: 1759671 - protein, 9 aa, Staphylococcus epidermidis
DERDASHNP

SEQ ID NO: 1759672 - protein, 8 aa, Staphylococcus epidermidis
DERHSGSM

SEQ ID NO: 1759673 - protein, 6 aa, Staphylococcus epidermidis
DERSRE

SEQ ID NO: 1759674 - protein, 7 aa, Staphylococcus epidermidis
DERTGPH

SEQ ID NO: 1759675 - protein, 18 aa, Staphylococcus epidermidis
DESEESFEDIAEDLIDFD

SEQ ID NO: 1759676 - protein, 8 aa, Staphylococcus epidermidis
DESKAQKF

SEQ ID NO: 1759677 - protein, 6 aa, Staphylococcus epidermidis
DESKDA

SEQ ID NO: 1759678 - protein, 6 aa, Staphylococcus epidermidis
DESRTI

SEQ ID NO: 1759679 - protein, 5 aa, Staphylococcus epidermidis
DETGV

SEQ ID NO: 1759680 - protein, 4 aa, Staphylococcus epidermidis
DETI

SEQ ID NO: 1759681 - protein, 8 aa, Staphylococcus epidermidis
DETLDRAN

SEQ ID NO: 1759682 - protein, 5 aa, Staphylococcus epidermidis
DETNP

SEQ ID NO: 1759683 - protein, 6 aa, Staphylococcus epidermidis
DETPLG

SEQ ID NO: 1759684 - protein, 6 aa, Staphylococcus epidermidis
DETQEE

SEQ ID NO: 1759685 - protein, 8 aa, Staphylococcus epidermidis
DETQRRRE

SEQ ID NO: 1759686 - protein, 12 aa, Staphylococcus epidermidis
DEVEKRDNIKRL

SEQ ID NO: 1759687 - protein, 10 aa, Staphylococcus epidermidis
DEVLNPGNTE

SEQ ID NO: 1759688 - protein, 17 aa, Staphylococcus epidermidis
DEVTAGNGAKKDTMIGK

SEQ ID NO: 1759689 - protein, 4 aa, Staphylococcus epidermidis
DEYK

SEQ ID NO: 1759690 - protein, 6 aa, Staphylococcus epidermidis
DFENKQ

SEQ ID NO: 1759691 - protein, 7 aa, Staphylococcus epidermidis
DFGPDLS

SEQ ID NO: 1759692 - protein, 9 aa, Staphylococcus epidermidis
DFKPKNLKK

SEQ ID NO: 1759693 - protein, 10 aa, Staphylococcus epidermidis
DFTENSEDYG

SEQ ID NO: 1759694 - protein, 6 aa, Staphylococcus epidermidis
DGAPAY

SEQ ID NO: 1759695 - protein, 8 aa, Staphylococcus epidermidis
DGAQSAPH

SEQ ID NO: 1759696 - protein, 10 aa, Staphylococcus epidermidis
DGAVENGDTV

SEQ ID NO: 1759697 - protein, 12 aa, Staphylococcus epidermidis
DGCASGGTCNCS

SEQ ID NO: 1759698 - protein, 18 aa, Staphylococcus epidermidis
DGDYQEAGAKIVDEQSKA

SEQ ID NO: 1759699 - protein, 6 aa, Staphylococcus epidermidis
DGEEAL

SEQ ID NO: 1759700 - protein, 4 aa, Staphylococcus epidermidis
DGEF

SEQ ID NO: 1759701 - protein, 8 aa, Staphylococcus epidermidis
DGEITNDN

SEQ ID NO: 1759702 - protein, 6 aa, Staphylococcus epidermidis
DGELQL

SEQ ID NO: 1759703 - protein, 6 aa, Staphylococcus epidermidis
DGEPVD

SEQ ID NO: 1759704 - protein, 10 aa, Staphylococcus epidermidis
DGETKEGNTS

SEQ ID NO: 1759705 - protein, 7 aa, Staphylococcus epidermidis
DGEVEDN

SEQ ID NO: 1759706 - protein, 18 aa, Staphylococcus epidermidis
DGEWKKKDNITQEIKNTD

SEQ ID NO: 1759707 - protein, 7 aa, Staphylococcus epidermidis
DGGKAEV

SEQ ID NO: 1759708 - protein, 13 aa, Staphylococcus epidermidis
DGHYSGAKKLGRA

SEQ ID NO: 1759709 - protein, 5 aa, Staphylococcus epidermidis
DGIEF

SEQ ID NO: 1759710 - protein, 10 aa, Staphylococcus epidermidis
DGIGTKRKTS

SEQ ID NO: 1759711 - protein, 8 aa, Staphylococcus epidermidis
DGINEKGL

SEQ ID NO: 1759712 - protein, 9 aa, Staphylococcus epidermidis
DGKKNKETI

SEQ ID NO: 1759713 - protein, 7 aa, Staphylococcus epidermidis
DGKLDTA

SEQ ID NO: 1759714 - protein, 11 aa, Staphylococcus epidermidis
DGKNAADPITG

SEQ ID NO: 1759715 - protein, 5 aa, Staphylococcus epidermidis
DGKNN

SEQ ID NO: 1759716 - protein, 4 aa, Staphylococcus epidermidis
DGLG

SEQ ID NO: 1759717 - protein, 5 aa, Staphylococcus epidermidis
DGLTD

SEQ ID NO: 1759718 - protein, 5 aa, Staphylococcus epidermidis
DGNDA

SEQ ID NO: 1759719 - protein, 6 aa, Staphylococcus epidermidis
DGNDPI

SEQ ID NO: 1759720 - protein, 6 aa, Staphylococcus epidermidis
DGNTGF

SEQ ID NO: 1759721 - protein, 10 aa, Staphylococcus epidermidis
DGPASEANDE

SEQ ID NO: 1759722 - protein, 8 aa, Staphylococcus epidermidis
DGPDETGI

SEQ ID NO: 1759723 - protein, 9 aa, Staphylococcus epidermidis
DGPKEKGGL

SEQ ID NO: 1759724 - protein, 6 aa, Staphylococcus epidermidis
DGQAPD

SEQ ID NO: 1759725 - protein, 4 aa, Staphylococcus epidermidis
DGQF

SEQ ID NO: 1759726 - protein, 5 aa, Staphylococcus epidermidis
DGQSY

SEQ ID NO: 1759727 - protein, 13 aa, Staphylococcus epidermidis
DGRETPKKPRIVN

SEQ ID NO: 1759728 - protein, 4 aa, Staphylococcus epidermidis
DGRI

SEQ ID NO: 1759729 - protein, 5 aa, Staphylococcus epidermidis
DGRTY

SEQ ID NO: 1759730 - protein, 8 aa, Staphylococcus epidermidis
DGSAKEDI

SEQ ID NO: 1759731 - protein, 10 aa, Staphylococcus epidermidis
DGSDETDAIQ

SEQ ID NO: 1759732 - protein, 5 aa, Staphylococcus epidermidis
DGSHH

SEQ ID NO: 1759733 - protein, 4 aa, Staphylococcus epidermidis
DGST

SEQ ID NO: 1759734 - protein, 10 aa, Staphylococcus epidermidis
DGSTDQSKKL

SEQ ID NO: 1759735 - protein, 8 aa, Staphylococcus epidermidis
DGSTDQTQ

SEQ ID NO: 1759736 - protein, 19 aa, Staphylococcus epidermidis
DGSVGSGFDLPDKKCPTCG

SEQ ID NO: 1759737 - protein, 7 aa, Staphylococcus epidermidis
DGTLHPD

SEQ ID NO: 1759738 - protein, 5 aa, Staphylococcus epidermidis
DGTLN

SEQ ID NO: 1759739 - protein, 13 aa, Staphylococcus epidermidis
DGTMAKGEDLQSF

SEQ ID NO: 1759740 - protein, 10 aa, Staphylococcus epidermidis
DGTSNLVKQQ

SEQ ID NO: 1759741 - protein, 4 aa, Staphylococcus epidermidis
DGVL

SEQ ID NO: 1759742 - protein, 4 aa, Staphylococcus epidermidis
DGVR

SEQ ID NO: 1759743 - protein, 7 aa, Staphylococcus epidermidis
DGYKESD

SEQ ID NO: 1759744 - protein, 17 aa, Staphylococcus epidermidis
DGYNQTELAKKAGISRQ

SEQ ID NO: 1759745 - protein, 9 aa, Staphylococcus epidermidis
DHDQNNQDK

SEQ ID NO: 1759746 - protein, 7 aa, Staphylococcus epidermidis
DHEDTGQ

SEQ ID NO: 1759747 - protein, 5 aa, Staphylococcus epidermidis
DHGAE

SEQ ID NO: 1759748 - protein, 7 aa, Staphylococcus epidermidis
DHPQNEI

SEQ ID NO: 1759749 - protein, 5 aa, Staphylococcus epidermidis
DHQTH

SEQ ID NO: 1759750 - protein, 6 aa, Staphylococcus epidermidis
DHRRPS

SEQ ID NO: 1759751 - protein, 7 aa, Staphylococcus epidermidis
DHSAENI

SEQ ID NO: 1759752 - protein, 4 aa, Staphylococcus epidermidis
DHSD

SEQ ID NO: 1759753 - protein, 8 aa, Staphylococcus epidermidis
DHTEDNLN

SEQ ID NO: 1759754 - protein, 5 aa, Staphylococcus epidermidis
DIDEN

SEQ ID NO: 1759755 - protein, 5 aa, Staphylococcus epidermidis
DIDSL

SEQ ID NO: 1759756 - protein, 5 aa, Staphylococcus epidermidis
DIDTT

SEQ ID NO: 1759757 - protein, 5 aa, Staphylococcus epidermidis
DIGND

SEQ ID NO: 1759758 - protein, 6 aa, Staphylococcus epidermidis
DIIENS

SEQ ID NO: 1759759 - protein, 4 aa, Staphylococcus epidermidis
DIKD

SEQ ID NO: 1759760 - protein, 6 aa, Staphylococcus epidermidis
DIKPEN

SEQ ID NO: 1759761 - protein, 5 aa, Staphylococcus epidermidis
DINTT

SEQ ID NO: 1759762 - protein, 9 aa, Staphylococcus epidermidis
DIPDRQTGL

SEQ ID NO: 1759763 - protein, 12 aa, Staphylococcus epidermidis
DIPGAGAAGGMG

SEQ ID NO: 1759764 - protein, 5 aa, Staphylococcus epidermidis
DIPGV

SEQ ID NO: 1759765 - protein, 6 aa, Staphylococcus epidermidis
DIQDSQ

SEQ ID NO: 1759766 - protein, 5 aa, Staphylococcus epidermidis
DIQEP

SEQ ID NO: 1759767 - protein, 6 aa, Staphylococcus epidermidis
DIQGTG

SEQ ID NO: 1759768 - protein, 21 aa, Staphylococcus epidermidis
DISLDGDLDKSFSEDTKQRFE

SEQ ID NO: 1759769 - protein, 7 aa, Staphylococcus epidermidis
DKAEDIK

SEQ ID NO: 1759770 - protein, 7 aa, Staphylococcus epidermidis
DKAKALG

SEQ ID NO: 1759771 - protein, 12 aa, Staphylococcus epidermidis
DKAKGAGDENYD

SEQ ID NO: 1759772 - protein, 8 aa, Staphylococcus epidermidis
DKANKDDI

SEQ ID NO: 1759773 - protein, 10 aa, Staphylococcus epidermidis
DKARVPAGGA

SEQ ID NO: 1759774 - protein, 4 aa, Staphylococcus epidermidis
DKAV

SEQ ID NO: 1759775 - protein, 4 aa, Staphylococcus epidermidis
DKDE

SEQ ID NO: 1759776 - protein, 7 aa, Staphylococcus epidermidis
DKDFNPK

SEQ ID NO: 1759777 - protein, 8 aa, Staphylococcus epidermidis
DKDGCPKC

SEQ ID NO: 1759778 - protein, 7 aa, Staphylococcus epidermidis
DKDVQKA

SEQ ID NO: 1759779 - protein, 5 aa, Staphylococcus epidermidis
DKEDI

SEQ ID NO: 1759780 - protein, 6 aa, Staphylococcus epidermidis
DKEQHR

SEQ ID NO: 1759781 - protein, 8 aa, Staphylococcus epidermidis
DKERAIAK

SEQ ID NO: 1759782 - protein, 7 aa, Staphylococcus epidermidis
DKESYDG

SEQ ID NO: 1759783 - protein, 7 aa, Staphylococcus epidermidis
DKFKTTT

SEQ ID NO: 1759784 - protein, 13 aa, Staphylococcus epidermidis
DKGKEKAQKASFK

SEQ ID NO: 1759785 - protein, 5 aa, Staphylococcus epidermidis
DKGKS

SEQ ID NO: 1759786 - protein, 10 aa, Staphylococcus epidermidis
DKGLAGAYST

SEQ ID NO: 1759787 - protein, 12 aa, Staphylococcus epidermidis
DKGLTEEPEGGL

SEQ ID NO: 1759788 - protein, 10 aa, Staphylococcus epidermidis
DKGVKNVHGY

SEQ ID NO: 1759789 - protein, 12 aa, Staphylococcus epidermidis
DKHSTGGVGDTT

SEQ ID NO: 1759790 - protein, 7 aa, Staphylococcus epidermidis
DKIEDQL

SEQ ID NO: 1759791 - protein, 5 aa, Staphylococcus epidermidis
DKIEV

SEQ ID NO: 1759792 - protein, 9 aa, Staphylococcus epidermidis
DKISQNEEV

SEQ ID NO: 1759793 - protein, 4 aa, Staphylococcus epidermidis
DKIV

SEQ ID NO: 1759794 - protein, 17 aa, Staphylococcus epidermidis
DKKDQFPDELSGGQKQR

SEQ ID NO: 1759795 - protein, 10 aa, Staphylococcus epidermidis
DKKVKGGQDT

SEQ ID NO: 1759796 - protein, 7 aa, Staphylococcus epidermidis
DKLGDFS

SEQ ID NO: 1759797 - protein, 9 aa, Staphylococcus epidermidis
DKLQSELDR

SEQ ID NO: 1759798 - protein, 12 aa, Staphylococcus epidermidis
DKMNQNAAGVDV

SEQ ID NO: 1759799 - protein, 5 aa, Staphylococcus epidermidis
DKNEM

SEQ ID NO: 1759800 - protein, 8 aa, Staphylococcus epidermidis
DKNENVYE

SEQ ID NO: 1759801 - protein, 19 aa, Staphylococcus epidermidis
DKNGRVGFGTGKAQEVPEA

SEQ ID NO: 1759802 - protein, 9 aa, Staphylococcus epidermidis
DKNNDVIDD

SEQ ID NO: 1759803 - protein, 7 aa, Staphylococcus epidermidis
DKNTTKI

SEQ ID NO: 1759804 - protein, 7 aa, Staphylococcus epidermidis
DKPEQFR

SEQ ID NO: 1759805 - protein, 13 aa, Staphylococcus epidermidis
DKPNRRKADIEAK

SEQ ID NO: 1759806 - protein, 12 aa, Staphylococcus epidermidis
DKPYEIKPKKVF

SEQ ID NO: 1759807 - protein, 12 aa, Staphylococcus epidermidis
DKPYKKLTDRQK

SEQ ID NO: 1759808 - protein, 15 aa, Staphylococcus epidermidis
DKQIESYRRLERAIK

SEQ ID NO: 1759809 - protein, 9 aa, Staphylococcus epidermidis
DKQNSKKED

SEQ ID NO: 1759810 - protein, 10 aa, Staphylococcus epidermidis
DKSDKRRGRL

SEQ ID NO: 1759811 - protein, 6 aa, Staphylococcus epidermidis
DKSLPE

SEQ ID NO: 1759812 - protein, 6 aa, Staphylococcus epidermidis
DKSLSR

SEQ ID NO: 1759813 - protein, 7 aa, Staphylococcus epidermidis
DKTETDQ

SEQ ID NO: 1759814 - protein, 12 aa, Staphylococcus epidermidis
DKVSSDDFDKIE

SEQ ID NO: 1759815 - protein, 5 aa, Staphylococcus epidermidis
DKVTE

SEQ ID NO: 1759816 - protein, 4 aa, Staphylococcus epidermidis
DKYD

SEQ ID NO: 1759817 - protein, 11 aa, Staphylococcus epidermidis
DLDRKGPSYTY

SEQ ID NO: 1759818 - protein, 6 aa, Staphylococcus epidermidis
DLEPND

SEQ ID NO: 1759819 - protein, 5 aa, Staphylococcus epidermidis
DLEQR

SEQ ID NO: 1759820 - protein, 4 aa, Staphylococcus epidermidis
DLGG

SEQ ID NO: 1759821 - protein, 11 aa, Staphylococcus epidermidis
DLGKSKVEAYA

SEQ ID NO: 1759822 - protein, 4 aa, Staphylococcus epidermidis
DLGN

SEQ ID NO: 1759823 - protein, 4 aa, Staphylococcus epidermidis
DLKG

SEQ ID NO: 1759824 - protein, 8 aa, Staphylococcus epidermidis
DLKSNPNV

SEQ ID NO: 1759825 - protein, 7 aa, Staphylococcus epidermidis
DLKTNPH

SEQ ID NO: 1759826 - protein, 6 aa, Staphylococcus epidermidis
DLNGKV

SEQ ID NO: 1759827 - protein, 4 aa, Staphylococcus epidermidis
DLNI

SEQ ID NO: 1759828 - protein, 12 aa, Staphylococcus epidermidis
DLNNDNSPLRPE

SEQ ID NO: 1759829 - protein, 9 aa, Staphylococcus epidermidis
DLPDSQGNL

SEQ ID NO: 1759830 - protein, 5 aa, Staphylococcus epidermidis
DLPNE

SEQ ID NO: 1759831 - protein, 6 aa, Staphylococcus epidermidis
DLPQQA

SEQ ID NO: 1759832 - protein, 5 aa, Staphylococcus epidermidis
DLPYN

SEQ ID NO: 1759833 - protein, 11 aa, Staphylococcus epidermidis
DLSESITPYEG

SEQ ID NO: 1759834 - protein, 12 aa, Staphylococcus epidermidis
DLSKDSIQKDDK

SEQ ID NO: 1759835 - protein, 9 aa, Staphylococcus epidermidis
DLSNAGANV

SEQ ID NO: 1759836 - protein, 24 aa, Staphylococcus epidermidis
DLSSQEVADATRIQYGGSVKPNNI

SEQ ID NO: 1759837 - protein, 14 aa, Staphylococcus epidermidis
DLTERRESKQPLEF

SEQ ID NO: 1759838 - protein, 11 aa, Staphylococcus epidermidis
DLTPSDTAQLN

SEQ ID NO: 1759839 - protein, 10 aa, Staphylococcus epidermidis
DMESEGKSIR

SEQ ID NO: 1759840 - protein, 9 aa, Staphylococcus epidermidis
DMTTGESQV

SEQ ID NO: 1759841 - protein, 8 aa, Staphylococcus epidermidis
DNAADGRD

SEQ ID NO: 1759842 - protein, 7 aa, Staphylococcus epidermidis
DNAEGPF

SEQ ID NO: 1759843 - protein, 9 aa, Staphylococcus epidermidis
DNAKGSEMT

SEQ ID NO: 1759844 - protein, 7 aa, Staphylococcus epidermidis
DNATNVP

SEQ ID NO: 1759845 - protein, 9 aa, Staphylococcus epidermidis
DNCNESVNE

SEQ ID NO: 1759846 - protein, 6 aa, Staphylococcus epidermidis
DNDEQF

SEQ ID NO: 1759847 - protein, 15 aa, Staphylococcus epidermidis
DNDGKLGETENTQPA

SEQ ID NO: 1759848 - protein, 11 aa, Staphylococcus epidermidis
DNEASVEIETD

SEQ ID NO: 1759849 - protein, 4 aa, Staphylococcus epidermidis
DNEL

SEQ ID NO: 1759850 - protein, 5 aa, Staphylococcus epidermidis
DNFDT

SEQ ID NO: 1759851 - protein, 6 aa, Staphylococcus epidermidis
DNFESQ

SEQ ID NO: 1759852 - protein, 6 aa, Staphylococcus epidermidis
DNFPKQ

SEQ ID NO: 1759853 - protein, 7 aa, Staphylococcus epidermidis
DNGAQGI

SEQ ID NO: 1759854 - protein, 8 aa, Staphylococcus epidermidis
DNGDNNVV

SEQ ID NO: 1759855 - protein, 8 aa, Staphylococcus epidermidis
DNGKASQY

SEQ ID NO: 1759856 - protein, 4 aa, Staphylococcus epidermidis
DNGL

SEQ ID NO: 1759857 - protein, 9 aa, Staphylococcus epidermidis
DNGQQQQEA

SEQ ID NO: 1759858 - protein, 14 aa, Staphylococcus epidermidis
DNGTQVAPQVSEGD

SEQ ID NO: 1759859 - protein, 4 aa, Staphylococcus epidermidis
DNHL

SEQ ID NO: 1759860 - protein, 11 aa, Staphylococcus epidermidis
DNHSQKLQIDS

SEQ ID NO: 1759861 - protein, 8 aa, Staphylococcus epidermidis
DNIKPGGT

SEQ ID NO: 1759862 - protein, 5 aa, Staphylococcus epidermidis
DNKEW

SEQ ID NO: 1759863 - protein, 8 aa, Staphylococcus epidermidis
DNKIEDAK

SEQ ID NO: 1759864 - protein, 4 aa, Staphylococcus epidermidis
DNKN

SEQ ID NO: 1759865 - protein, 6 aa, Staphylococcus epidermidis
DNKNGF

SEQ ID NO: 1759866 - protein, 4 aa, Staphylococcus epidermidis
DNKP

SEQ ID NO: 1759867 - protein, 4 aa, Staphylococcus epidermidis
DNLE

SEQ ID NO: 1759868 - protein, 18 aa, Staphylococcus epidermidis
DNNDLEKKEKIESYVEVI

SEQ ID NO: 1759869 - protein, 5 aa, Staphylococcus epidermidis
DNNGS

SEQ ID NO: 1759870 - protein, 9 aa, Staphylococcus epidermidis
DNNNSNGIE

SEQ ID NO: 1759871 - protein, 7 aa, Staphylococcus epidermidis
DNNRKSV

SEQ ID NO: 1759872 - protein, 5 aa, Staphylococcus epidermidis
DNPKQ

SEQ ID NO: 1759873 - protein, 8 aa, Staphylococcus epidermidis
DNQDEVEA

SEQ ID NO: 1759874 - protein, 6 aa, Staphylococcus epidermidis
DNQEDR

SEQ ID NO: 1759875 - protein, 6 aa, Staphylococcus epidermidis
DNQEVP

SEQ ID NO: 1759876 - protein, 10 aa, Staphylococcus epidermidis
DNQGTAEVPE

SEQ ID NO: 1759877 - protein, 8 aa, Staphylococcus epidermidis
DNRANDYA

SEQ ID NO: 1759878 - protein, 22 aa, Staphylococcus epidermidis
DNSRVDRQLRGRSGRQGDPGYS

SEQ ID NO: 1759879 - protein, 5 aa, Staphylococcus epidermidis
DNTAA

SEQ ID NO: 1759880 - protein, 8 aa, Staphylococcus epidermidis
DNTPTCTT

SEQ ID NO: 1759881 - protein, 12 aa, Staphylococcus epidermidis
DNVEYDQLLVRV

SEQ ID NO: 1759882 - protein, 7 aa, Staphylococcus epidermidis
DNYGAGQ

SEQ ID NO: 1759883 - protein, 14 aa, Staphylococcus epidermidis
DPAYIPRQNEARNQ

SEQ ID NO: 1759884 - protein, 23 aa, Staphylococcus epidermidis
DPDVVNDADKLRKYSKEQADLQK

SEQ ID NO: 1759885 - protein, 6 aa, Staphylococcus epidermidis
DPEGNA

SEQ ID NO: 1759886 - protein, 7 aa, Staphylococcus epidermidis
DPEGNTY

SEQ ID NO: 1759887 - protein, 13 aa, Staphylococcus epidermidis
DPETGGVSHDPEL

SEQ ID NO: 1759888 - protein, 8 aa, Staphylococcus epidermidis
DPFAPPSK

SEQ ID NO: 1759889 - protein, 6 aa, Staphylococcus epidermidis
DPGYTD

SEQ ID NO: 1759890 - protein, 13 aa, Staphylococcus epidermidis
DPHRHSLPQEETN

SEQ ID NO: 1759891 - protein, 7 aa, Staphylococcus epidermidis
DPKECQE

SEQ ID NO: 1759892 - protein, 8 aa, Staphylococcus epidermidis
DPKTRQIQ

SEQ ID NO: 1759893 - protein, 4 aa, Staphylococcus epidermidis
DPLI

SEQ ID NO: 1759894 - protein, 5 aa, Staphylococcus epidermidis
DPNFE

SEQ ID NO: 1759895 - protein, 8 aa, Staphylococcus epidermidis
DPNREDQH

SEQ ID NO: 1759896 - protein, 4 aa, Staphylococcus epidermidis
DPNV

SEQ ID NO: 1759897 - protein, 8 aa, Staphylococcus epidermidis
DPSAASYA

SEQ ID NO: 1759898 - protein, 15 aa, Staphylococcus epidermidis
DPSNENWHDESMRLQ

SEQ ID NO: 1759899 - protein, 7 aa, Staphylococcus epidermidis
DPSNNVA

SEQ ID NO: 1759900 - protein, 6 aa, Staphylococcus epidermidis
DPVADG

SEQ ID NO: 1759901 - protein, 7 aa, Staphylococcus epidermidis
DPVGGEN

SEQ ID NO: 1759902 - protein, 20 aa, Staphylococcus epidermidis
DPVKGTKPTTKNEMTDLQST

SEQ ID NO: 1759903 - protein, 5 aa, Staphylococcus epidermidis
DQELE

SEQ ID NO: 1759904 - protein, 5 aa, Staphylococcus epidermidis
DQENE

SEQ ID NO: 1759905 - protein, 9 aa, Staphylococcus epidermidis
DQEQFNSKE

SEQ ID NO: 1759906 - protein, 9 aa, Staphylococcus epidermidis
DQETANQQA

SEQ ID NO: 1759907 - protein, 23 aa, Staphylococcus epidermidis
DQGESFDYEATKSHLGPYNDNEN

SEQ ID NO: 1759908 - protein, 6 aa, Staphylococcus epidermidis
DQHGHQ

SEQ ID NO: 1759909 - protein, 15 aa, Staphylococcus epidermidis
DQIKEGAQVATENQI

SEQ ID NO: 1759910 - protein, 6 aa, Staphylococcus epidermidis
DQITSD

SEQ ID NO: 1759911 - protein, 6 aa, Staphylococcus epidermidis
DQLNDN

SEQ ID NO: 1759912 - protein, 5 aa, Staphylococcus epidermidis
DQNYP

SEQ ID NO: 1759913 - protein, 27 aa, Staphylococcus epidermidis
DQSRGDQIDNAKNFESKGYGRHIPEDQ

SEQ ID NO: 1759914 - protein, 7 aa, Staphylococcus epidermidis
DQVGDDQ

SEQ ID NO: 1759915 - protein, 18 aa, Staphylococcus epidermidis
DQVKSAADLSAQKDEIER

SEQ ID NO: 1759916 - protein, 7 aa, Staphylococcus epidermidis
DRDEVDL

SEQ ID NO: 1759917 - protein, 14 aa, Staphylococcus epidermidis
DRDKEAVKNAPRIT

SEQ ID NO: 1759918 - protein, 5 aa, Staphylococcus epidermidis
DREGV

SEQ ID NO: 1759919 - protein, 12 aa, Staphylococcus epidermidis
DRENPGPSTLKK

SEQ ID NO: 1759920 - protein, 6 aa, Staphylococcus epidermidis
DRGNEF

SEQ ID NO: 1759921 - protein, 10 aa, Staphylococcus epidermidis
DRKDKNGHTR

SEQ ID NO: 1759922 - protein, 8 aa, Staphylococcus epidermidis
DRKEARRM

SEQ ID NO: 1759923 - protein, 7 aa, Staphylococcus epidermidis
DRKEDVT

SEQ ID NO: 1759924 - protein, 10 aa, Staphylococcus epidermidis
DRKERAGVKF

SEQ ID NO: 1759925 - protein, 8 aa, Staphylococcus epidermidis
DRKPYQLS

SEQ ID NO: 1759926 - protein, 13 aa, Staphylococcus epidermidis
DRLASKPDAFAPN

SEQ ID NO: 1759927 - protein, 4 aa, Staphylococcus epidermidis
DRLL

SEQ ID NO: 1759928 - protein, 12 aa, Staphylococcus epidermidis
DRLNEYNKKEHN

SEQ ID NO: 1759929 - protein, 7 aa, Staphylococcus epidermidis
DRNGREF

SEQ ID NO: 1759930 - protein, 8 aa, Staphylococcus epidermidis
DRNPENLP

SEQ ID NO: 1759931 - protein, 6 aa, Staphylococcus epidermidis
DRNTSG

SEQ ID NO: 1759932 - protein, 7 aa, Staphylococcus epidermidis
DRPNIRT

SEQ ID NO: 1759933 - protein, 5 aa, Staphylococcus epidermidis
DRPSE

SEQ ID NO: 1759934 - protein, 8 aa, Staphylococcus epidermidis
DRRPNESE

SEQ ID NO: 1759935 - protein, 6 aa, Staphylococcus epidermidis
DRTTEG

SEQ ID NO: 1759936 - protein, 9 aa, Staphylococcus epidermidis
DSAKERGAE

SEQ ID NO: 1759937 - protein, 12 aa, Staphylococcus epidermidis
DSASDLEGKDLS

SEQ ID NO: 1759938 - protein, 8 aa, Staphylococcus epidermidis
DSASDQDV

SEQ ID NO: 1759939 - protein, 7 aa, Staphylococcus epidermidis
DSDAHQI

SEQ ID NO: 1759940 - protein, 6 aa, Staphylococcus epidermidis
DSDEKE

SEQ ID NO: 1759941 - protein, 6 aa, Staphylococcus epidermidis
DSDNKT

SEQ ID NO: 1759942 - protein, 4 aa, Staphylococcus epidermidis
DSDQ

SEQ ID NO: 1759943 - protein, 13 aa, Staphylococcus epidermidis
DSDSNDDNTQLAI

SEQ ID NO: 1759944 - protein, 5 aa, Staphylococcus epidermidis
DSEFE

SEQ ID NO: 1759945 - protein, 4 aa, Staphylococcus epidermidis
DSEI

SEQ ID NO: 1759946 - protein, 7 aa, Staphylococcus epidermidis
DSENRTL

SEQ ID NO: 1759947 - protein, 8 aa, Staphylococcus epidermidis
DSEPPAQK

SEQ ID NO: 1759948 - protein, 7 aa, Staphylococcus epidermidis
DSEQHGK

SEQ ID NO: 1759949 - protein, 4 aa, Staphylococcus epidermidis
DSES

SEQ ID NO: 1759950 - protein, 11 aa, Staphylococcus epidermidis
DSETGHEETIQ

SEQ ID NO: 1759951 - protein, 5 aa, Staphylococcus epidermidis
DSETH

SEQ ID NO: 1759952 - protein, 4 aa, Staphylococcus epidermidis
DSGA

SEQ ID NO: 1759953 - protein, 6 aa, Staphylococcus epidermidis
DSGANR

SEQ ID NO: 1759954 - protein, 8 aa, Staphylococcus epidermidis
DSKDQLKE

SEQ ID NO: 1759955 - protein, 6 aa, Staphylococcus epidermidis
DSKEYS

SEQ ID NO: 1759956 - protein, 7 aa, Staphylococcus epidermidis
DSKIESG

SEQ ID NO: 1759957 - protein, 8 aa, Staphylococcus epidermidis
DSKINKHE

SEQ ID NO: 1759958 - protein, 14 aa, Staphylococcus epidermidis
DSKNHQLPSDSMEQ

SEQ ID NO: 1759959 - protein, 15 aa, Staphylococcus epidermidis
DSKNLRGAQKDRHEN

SEQ ID NO: 1759960 - protein, 6 aa, Staphylococcus epidermidis
DSKVAP

SEQ ID NO: 1759961 - protein, 14 aa, Staphylococcus epidermidis
DSLKESQEKNEVDL

SEQ ID NO: 1759962 - protein, 21 aa, Staphylococcus epidermidis
DSLNKNARQGKDPDDVSIGDL

SEQ ID NO: 1759963 - protein, 7 aa, Staphylococcus epidermidis
DSNLQGY

SEQ ID NO: 1759964 - protein, 16 aa, Staphylococcus epidermidis
DSPSTNYAAIEDKKRR

SEQ ID NO: 1759965 - protein, 5 aa, Staphylococcus epidermidis
DSPTN

SEQ ID NO: 1759966 - protein, 13 aa, Staphylococcus epidermidis
DSQQKASRAQQAG

SEQ ID NO: 1759967 - protein, 8 aa, Staphylococcus epidermidis
DSRANMSG

SEQ ID NO: 1759968 - protein, 10 aa, Staphylococcus epidermidis
DSRNGKQNII

SEQ ID NO: 1759969 - protein, 17 aa, Staphylococcus epidermidis
DSSVGGKVGINSEHGKN

SEQ ID NO: 1759970 - protein, 10 aa, Staphylococcus epidermidis
DSTDGVQRGM

SEQ ID NO: 1759971 - protein, 14 aa, Staphylococcus epidermidis
DSTEAEKPGYNTPE

SEQ ID NO: 1759972 - protein, 17 aa, Staphylococcus epidermidis
DSTRISTSAKSEAQQYI

SEQ ID NO: 1759973 - protein, 6 aa, Staphylococcus epidermidis
DSTRTR

SEQ ID NO: 1759974 - protein, 8 aa, Staphylococcus epidermidis
DSVNGATA

SEQ ID NO: 1759975 - protein, 7 aa, Staphylococcus epidermidis
DSVTAQD

SEQ ID NO: 1759976 - protein, 10 aa, Staphylococcus epidermidis
DSYANPEALE

SEQ ID NO: 1759977 - protein, 4 aa, Staphylococcus epidermidis
DSYP

SEQ ID NO: 1759978 - protein, 6 aa, Staphylococcus epidermidis
DTANHE

SEQ ID NO: 1759979 - protein, 5 aa, Staphylococcus epidermidis
DTCPE

SEQ ID NO: 1759980 - protein, 9 aa, Staphylococcus epidermidis
DTDETTQKW

SEQ ID NO: 1759981 - protein, 9 aa, Staphylococcus epidermidis
DTDTSDHTG

SEQ ID NO: 1759982 - protein, 6 aa, Staphylococcus epidermidis
DTEEIN

SEQ ID NO: 1759983 - protein, 4 aa, Staphylococcus epidermidis
DTEG

SEQ ID NO: 1759984 - protein, 9 aa, Staphylococcus epidermidis
DTEGNKYLD

SEQ ID NO: 1759985 - protein, 10 aa, Staphylococcus epidermidis
DTEYPTDKEG

SEQ ID NO: 1759986 - protein, 8 aa, Staphylococcus epidermidis
DTGKVSEA

SEQ ID NO: 1759987 - protein, 6 aa, Staphylococcus epidermidis
DTIDDN

SEQ ID NO: 1759988 - protein, 6 aa, Staphylococcus epidermidis
DTIEED

SEQ ID NO: 1759989 - protein, 12 aa, Staphylococcus epidermidis
DTIETNGSAIDT

SEQ ID NO: 1759990 - protein, 7 aa, Staphylococcus epidermidis
DTKSIGT

SEQ ID NO: 1759991 - protein, 8 aa, Staphylococcus epidermidis
DTNEENIG

SEQ ID NO: 1759992 - protein, 7 aa, Staphylococcus epidermidis
DTNSITD

SEQ ID NO: 1759993 - protein, 18 aa, Staphylococcus epidermidis
DTPGVDSNVATHQSSTEQ

SEQ ID NO: 1759994 - protein, 5 aa, Staphylococcus epidermidis
DTPLG

SEQ ID NO: 1759995 - protein, 8 aa, Staphylococcus epidermidis
DTQGQALN

SEQ ID NO: 1759996 - protein, 9 aa, Staphylococcus epidermidis
DTQKERGQM

SEQ ID NO: 1759997 - protein, 17 aa, Staphylococcus epidermidis
DTQSNPDSKTTPSTNKQ

SEQ ID NO: 1759998 - protein, 13 aa, Staphylococcus epidermidis
DTRDYDSDKGGQL

SEQ ID NO: 1759999 - protein, 7 aa, Staphylococcus epidermidis
DTRVSGE

SEQ ID NO: 1760000 - protein, 14 aa, Staphylococcus epidermidis
DTSYEMPADGYNGK

SEQ ID NO: 1760001 - protein, 9 aa, Staphylococcus epidermidis
DTSYPSKEA

SEQ ID NO: 1760002 - protein, 5 aa, Staphylococcus epidermidis
DTTDD

SEQ ID NO: 1760003 - protein, 8 aa, Staphylococcus epidermidis
DTTDTQEI

SEQ ID NO: 1760004 - protein, 7 aa, Staphylococcus epidermidis
DTTTNHS

SEQ ID NO: 1760005 - protein, 11 aa, Staphylococcus epidermidis
DTTTPSYESQI

SEQ ID NO: 1760006 - protein, 11 aa, Staphylococcus epidermidis
DTVQYKNADIS

SEQ ID NO: 1760007 - protein, 4 aa, Staphylococcus epidermidis
DTVT

SEQ ID NO: 1760008 - protein, 17 aa, Staphylococcus epidermidis
DVDENENEDDSPKTLFD

SEQ ID NO: 1760009 - protein, 8 aa, Staphylococcus epidermidis
DVDKEQDI

SEQ ID NO: 1760010 - protein, 44 aa, Staphylococcus epidermidis
DVEKTLEENPNSKKNKTKHTQVKQQFDSNARKIRQTKEKIAEEG

SEQ ID NO: 1760011 - protein, 5 aa, Staphylococcus epidermidis
DVEQS

SEQ ID NO: 1760012 - protein, 23 aa, Staphylococcus epidermidis
DVGKKGGVFGTTKGLQSKYGDER

SEQ ID NO: 1760013 - protein, 7 aa, Staphylococcus epidermidis
DVGTSTV

SEQ ID NO: 1760014 - protein, 6 aa, Staphylococcus epidermidis
DVHQSV

SEQ ID NO: 1760015 - protein, 8 aa, Staphylococcus epidermidis
DVKGDNQH

SEQ ID NO: 1760016 - protein, 9 aa, Staphylococcus epidermidis
DVKIGKQGE

SEQ ID NO: 1760017 - protein, 8 aa, Staphylococcus epidermidis
DVKKQNDY

SEQ ID NO: 1760018 - protein, 6 aa, Staphylococcus epidermidis
DVNDSD

SEQ ID NO: 1760019 - protein, 12 aa, Staphylococcus epidermidis
DVPSIKRAYFNE

SEQ ID NO: 1760020 - protein, 6 aa, Staphylococcus epidermidis
DVQDRR

SEQ ID NO: 1760021 - protein, 6 aa, Staphylococcus epidermidis
DVQSKG

SEQ ID NO: 1760022 - protein, 15 aa, Staphylococcus epidermidis
DVRPPRESEEQREAY

SEQ ID NO: 1760023 - protein, 5 aa, Staphylococcus epidermidis
DVSAG

SEQ ID NO: 1760024 - protein, 18 aa, Staphylococcus epidermidis
DVSGGAKVDHIKDDDTFG

SEQ ID NO: 1760025 - protein, 7 aa, Staphylococcus epidermidis
DVSGPFP

SEQ ID NO: 1760026 - protein, 14 aa, Staphylococcus epidermidis
DVSIDTKEIEQSYC

SEQ ID NO: 1760027 - protein, 7 aa, Staphylococcus epidermidis
DVSNRDQ

SEQ ID NO: 1760028 - protein, 10 aa, Staphylococcus epidermidis
DVSRQKRKKV

SEQ ID NO: 1760029 - protein, 9 aa, Staphylococcus epidermidis
DVSTEEVVN

SEQ ID NO: 1760030 - protein, 19 aa, Staphylococcus epidermidis
DVTQAKEELGKSIETIEKS

SEQ ID NO: 1760031 - protein, 10 aa, Staphylococcus epidermidis
DVTTEHEGEV

SEQ ID NO: 1760032 - protein, 5 aa, Staphylococcus epidermidis
DVTTS

SEQ ID NO: 1760033 - protein, 6 aa, Staphylococcus epidermidis
DVTVDQ

SEQ ID NO: 1760034 - protein, 5 aa, Staphylococcus epidermidis
DVYDD

SEQ ID NO: 1760035 - protein, 4 aa, Staphylococcus epidermidis
DVYG

SEQ ID NO: 1760036 - protein, 11 aa, Staphylococcus epidermidis
DWEDKNGNHYD

SEQ ID NO: 1760037 - protein, 4 aa, Staphylococcus epidermidis
DYDT

SEQ ID NO: 1760038 - protein, 12 aa, Staphylococcus epidermidis
DYETSLNSIENN

SEQ ID NO: 1760039 - protein, 5 aa, Staphylococcus epidermidis
DYGFS

SEQ ID NO: 1760040 - protein, 17 aa, Staphylococcus epidermidis
DYGMGSSRDWAAKGTNL

SEQ ID NO: 1760041 - protein, 6 aa, Staphylococcus epidermidis
DYGSNI

SEQ ID NO: 1760042 - protein, 6 aa, Staphylococcus epidermidis
DYGTKI

SEQ ID NO: 1760043 - protein, 5 aa, Staphylococcus epidermidis
DYKDR

SEQ ID NO: 1760044 - protein, 6 aa, Staphylococcus epidermidis
DYKNKK

SEQ ID NO: 1760045 - protein, 10 aa, Staphylococcus epidermidis
DYPGIGPEHS

SEQ ID NO: 1760046 - protein, 6 aa, Staphylococcus epidermidis
DYPKAQ

SEQ ID NO: 1760047 - protein, 13 aa, Staphylococcus epidermidis
DYPRPSIKTTNGN

SEQ ID NO: 1760048 - protein, 12 aa, Staphylococcus epidermidis
DYPSAKQAQQAE

SEQ ID NO: 1760049 - protein, 10 aa, Staphylococcus epidermidis
DYPSCGPDMP

SEQ ID NO: 1760050 - protein, 7 aa, Staphylococcus epidermidis
DYQQGLN

SEQ ID NO: 1760051 - protein, 9 aa, Staphylococcus epidermidis
DYQQSSGSM

SEQ ID NO: 1760052 - protein, 7 aa, Staphylococcus epidermidis
DYSPDKM

SEQ ID NO: 1760053 - protein, 7 aa, Staphylococcus epidermidis
DYTNASR

SEQ ID NO: 1760054 - protein, 5 aa, Staphylococcus epidermidis
DYTRG

SEQ ID NO: 1760055 - protein, 12 aa, Staphylococcus epidermidis
DYYEEARTQLPD

SEQ ID NO: 1760056 - protein, 11 aa, Staphylococcus epidermidis
EAAGKGSHTHN

SEQ ID NO: 1760057 - protein, 5 aa, Staphylococcus epidermidis
EACKK

SEQ ID NO: 1760058 - protein, 4 aa, Staphylococcus epidermidis
EADE

SEQ ID NO: 1760059 - protein, 6 aa, Staphylococcus epidermidis
EADNQS

SEQ ID NO: 1760060 - protein, 4 aa, Staphylococcus epidermidis
EADY

SEQ ID NO: 1760061 - protein, 15 aa, Staphylococcus epidermidis
EAEARSHDDQSINKQ

SEQ ID NO: 1760062 - protein, 5 aa, Staphylococcus epidermidis
EAEEV

SEQ ID NO: 1760063 - protein, 13 aa, Staphylococcus epidermidis
EAERSPNEKYIPN

SEQ ID NO: 1760064 - protein, 6 aa, Staphylococcus epidermidis
EAESHA

SEQ ID NO: 1760065 - protein, 4 aa, Staphylococcus epidermidis
EAFE

SEQ ID NO: 1760066 - protein, 8 aa, Staphylococcus epidermidis
EAFEPGKN

SEQ ID NO: 1760067 - protein, 5 aa, Staphylococcus epidermidis
EAGGV

SEQ ID NO: 1760068 - protein, 4 aa, Staphylococcus epidermidis
EAGI

SEQ ID NO: 1760069 - protein, 7 aa, Staphylococcus epidermidis
EAGQPAV

SEQ ID NO: 1760070 - protein, 12 aa, Staphylococcus epidermidis
EAGQSASTSSYL

SEQ ID NO: 1760071 - protein, 8 aa, Staphylococcus epidermidis
EAGRTDKP

SEQ ID NO: 1760072 - protein, 8 aa, Staphylococcus epidermidis
EAGSDLNS

SEQ ID NO: 1760073 - protein, 9 aa, Staphylococcus epidermidis
EAGTNGPLE

SEQ ID NO: 1760074 - protein, 5 aa, Staphylococcus epidermidis
EAHTV

SEQ ID NO: 1760075 - protein, 13 aa, Staphylococcus epidermidis
EAKDEGDDSNEAI

SEQ ID NO: 1760076 - protein, 8 aa, Staphylococcus epidermidis
EAKDGETY

SEQ ID NO: 1760077 - protein, 6 aa, Staphylococcus epidermidis
EAKEDG

SEQ ID NO: 1760078 - protein, 16 aa, Staphylococcus epidermidis
EAKEGVAIQNESKTMA

SEQ ID NO: 1760079 - protein, 15 aa, Staphylococcus epidermidis
EAKEYGLIDEVMEPE

SEQ ID NO: 1760080 - protein, 9 aa, Staphylococcus epidermidis
EAKNSDQVI

SEQ ID NO: 1760081 - protein, 18 aa, Staphylococcus epidermidis
EAKPTTDGGGSQAGDSTI

SEQ ID NO: 1760082 - protein, 7 aa, Staphylococcus epidermidis
EAKQYSL

SEQ ID NO: 1760083 - protein, 5 aa, Staphylococcus epidermidis
EAKSI

SEQ ID NO: 1760084 - protein, 12 aa, Staphylococcus epidermidis
EAKSTKKTVFNP

SEQ ID NO: 1760085 - protein, 8 aa, Staphylococcus epidermidis
EAKTKIEN

SEQ ID NO: 1760086 - protein, 13 aa, Staphylococcus epidermidis
EALEAAAKLSDRY

SEQ ID NO: 1760087 - protein, 6 aa, Staphylococcus epidermidis
EALESG

SEQ ID NO: 1760088 - protein, 10 aa, Staphylococcus epidermidis
EAMEDNKAQY

SEQ ID NO: 1760089 - protein, 4 aa, Staphylococcus epidermidis
EANP

SEQ ID NO: 1760090 - protein, 8 aa, Staphylococcus epidermidis
EAPKTKEF

SEQ ID NO: 1760091 - protein, 8 aa, Staphylococcus epidermidis
EAPNEKDV

SEQ ID NO: 1760092 - protein, 4 aa, Staphylococcus epidermidis
EAQN

SEQ ID NO: 1760093 - protein, 9 aa, Staphylococcus epidermidis
EARDGKEAY

SEQ ID NO: 1760094 - protein, 10 aa, Staphylococcus epidermidis
EARSARAYGS

SEQ ID NO: 1760095 - protein, 11 aa, Staphylococcus epidermidis
EASNKVEGSIH

SEQ ID NO: 1760096 - protein, 10 aa, Staphylococcus epidermidis
EASRIGDSEL

SEQ ID NO: 1760097 - protein, 7 aa, Staphylococcus epidermidis
EATGDTY

SEQ ID NO: 1760098 - protein, 9 aa, Staphylococcus epidermidis
EATNGGKIK

SEQ ID NO: 1760099 - protein, 7 aa, Staphylococcus epidermidis
EATRISK

SEQ ID NO: 1760100 - protein, 5 aa, Staphylococcus epidermidis
EAVDL

SEQ ID NO: 1760101 - protein, 4 aa, Staphylococcus epidermidis
EAVE

SEQ ID NO: 1760102 - protein, 6 aa, Staphylococcus epidermidis
EAVKDA

SEQ ID NO: 1760103 - protein, 5 aa, Staphylococcus epidermidis
EAVPN

SEQ ID NO: 1760104 - protein, 4 aa, Staphylococcus epidermidis
EAYH

SEQ ID NO: 1760105 - protein, 14 aa, Staphylococcus epidermidis
EAYPSIKARGGGYQ

SEQ ID NO: 1760106 - protein, 9 aa, Staphylococcus epidermidis
EAYQKTLKE

SEQ ID NO: 1760107 - protein, 10 aa, Staphylococcus epidermidis
EDAADHGIND

SEQ ID NO: 1760108 - protein, 5 aa, Staphylococcus epidermidis
EDADR

SEQ ID NO: 1760109 - protein, 8 aa, Staphylococcus epidermidis
EDASIKAA

SEQ ID NO: 1760110 - protein, 16 aa, Staphylococcus epidermidis
EDATTIIGGGDSAAAA

SEQ ID NO: 1760111 - protein, 5 aa, Staphylococcus epidermidis
EDDEM

SEQ ID NO: 1760112 - protein, 5 aa, Staphylococcus epidermidis
EDDNA

SEQ ID NO: 1760113 - protein, 11 aa, Staphylococcus epidermidis
EDDPDAESPKL

SEQ ID NO: 1760114 - protein, 6 aa, Staphylococcus epidermidis
EDDTPA

SEQ ID NO: 1760115 - protein, 4 aa, Staphylococcus epidermidis
EDEK

SEQ ID NO: 1760116 - protein, 6 aa, Staphylococcus epidermidis
EDEPEI

SEQ ID NO: 1760117 - protein, 16 aa, Staphylococcus epidermidis
EDEREQQAILNAIELN

SEQ ID NO: 1760118 - protein, 7 aa, Staphylococcus epidermidis
EDGDTLN

SEQ ID NO: 1760119 - protein, 8 aa, Staphylococcus epidermidis
EDGKDSGF

SEQ ID NO: 1760120 - protein, 5 aa, Staphylococcus epidermidis
EDGQR

SEQ ID NO: 1760121 - protein, 9 aa, Staphylococcus epidermidis
EDGSDSSIV

SEQ ID NO: 1760122 - protein, 7 aa, Staphylococcus epidermidis
EDGSFSG

SEQ ID NO: 1760123 - protein, 5 aa, Staphylococcus epidermidis
EDHPN

SEQ ID NO: 1760124 - protein, 7 aa, Staphylococcus epidermidis
EDHSEGL

SEQ ID NO: 1760125 - protein, 9 aa, Staphylococcus epidermidis
EDIDDTKKR

SEQ ID NO: 1760126 - protein, 6 aa, Staphylococcus epidermidis
EDIDGG

SEQ ID NO: 1760127 - protein, 14 aa, Staphylococcus epidermidis
EDIESASDNEEDSD

SEQ ID NO: 1760128 - protein, 18 aa, Staphylococcus epidermidis
EDINPREITGKYYSPKEF

SEQ ID NO: 1760129 - protein, 4 aa, Staphylococcus epidermidis
EDIT

SEQ ID NO: 1760130 - protein, 16 aa, Staphylococcus epidermidis
EDLDGKKESKNDPELG

SEQ ID NO: 1760131 - protein, 10 aa, Staphylococcus epidermidis
EDLEDEDLIP

SEQ ID NO: 1760132 - protein, 13 aa, Staphylococcus epidermidis
EDLKQGNKERGYQ

SEQ ID NO: 1760133 - protein, 15 aa, Staphylococcus epidermidis
EDLNEAKEAVKNQDF

SEQ ID NO: 1760134 - protein, 4 aa, Staphylococcus epidermidis
EDND

SEQ ID NO: 1760135 - protein, 6 aa, Staphylococcus epidermidis
EDNSDV

SEQ ID NO: 1760136 - protein, 8 aa, Staphylococcus epidermidis
EDPDAYED

SEQ ID NO: 1760137 - protein, 7 aa, Staphylococcus epidermidis
EDPSIKA

SEQ ID NO: 1760138 - protein, 5 aa, Staphylococcus epidermidis
EDPTA

SEQ ID NO: 1760139 - protein, 8 aa, Staphylococcus epidermidis
EDPTTSYK

SEQ ID NO: 1760140 - protein, 11 aa, Staphylococcus epidermidis
EDQLPSVGPGQ

SEQ ID NO: 1760141 - protein, 10 aa, Staphylococcus epidermidis
EDRDSNIKSY

SEQ ID NO: 1760142 - protein, 7 aa, Staphylococcus epidermidis
EDSQLQQ

SEQ ID NO: 1760143 - protein, 4 aa, Staphylococcus epidermidis
EDSV

SEQ ID NO: 1760144 - protein, 7 aa, Staphylococcus epidermidis
EDTSATN

SEQ ID NO: 1760145 - protein, 5 aa, Staphylococcus epidermidis
EDVGT

SEQ ID NO: 1760146 - protein, 10 aa, Staphylococcus epidermidis
EDYQRQTAEF

SEQ ID NO: 1760147 - protein, 7 aa, Staphylococcus epidermidis
EEAPEDI

SEQ ID NO: 1760148 - protein, 19 aa, Staphylococcus epidermidis
EEAPSPVLSEDKRQEMGNA

SEQ ID NO: 1760149 - protein, 8 aa, Staphylococcus epidermidis
EEAVDPED

SEQ ID NO: 1760150 - protein, 22 aa, Staphylococcus epidermidis
EECEKRDPKGLYKKARSGEIPE

SEQ ID NO: 1760151 - protein, 9 aa, Staphylococcus epidermidis
EEDDNPDYT

SEQ ID NO: 1760152 - protein, 4 aa, Staphylococcus epidermidis
EEDE

SEQ ID NO: 1760153 - protein, 9 aa, Staphylococcus epidermidis
EEDPENETL

SEQ ID NO: 1760154 - protein, 9 aa, Staphylococcus epidermidis
EEDWRNREK

SEQ ID NO: 1760155 - protein, 9 aa, Staphylococcus epidermidis
EEDYANGTY

SEQ ID NO: 1760156 - protein, 5 aa, Staphylococcus epidermidis
EEEGR

SEQ ID NO: 1760157 - protein, 7 aa, Staphylococcus epidermidis
EEEGTDK

SEQ ID NO: 1760158 - protein, 7 aa, Staphylococcus epidermidis
EEEHRKY

SEQ ID NO: 1760159 - protein, 9 aa, Staphylococcus epidermidis
EEEMNSEDY

SEQ ID NO: 1760160 - protein, 7 aa, Staphylococcus epidermidis
EEENIPE

SEQ ID NO: 1760161 - protein, 77 aa, Staphylococcus epidermidis
EEEVEGPEERESSRSRERVQEREDYNRNENQATPQTFNNKQQAIKSVPQKNTLRSNTTSEERNYRMNNNSKNNSRNV

SEQ ID NO: 1760162 - protein, 12 aa, Staphylococcus epidermidis
EEEYNENIKLNY

SEQ ID NO: 1760163 - protein, 8 aa, Staphylococcus epidermidis
EEGEQAAR

SEQ ID NO: 1760164 - protein, 7 aa, Staphylococcus epidermidis
EEGKVEK

SEQ ID NO: 1760165 - protein, 5 aa, Staphylococcus epidermidis
EEGLT

SEQ ID NO: 1760166 - protein, 4 aa, Staphylococcus epidermidis
EEIE

SEQ ID NO: 1760167 - protein, 13 aa, Staphylococcus epidermidis
EEIREKTKSFQKE

SEQ ID NO: 1760168 - protein, 11 aa, Staphylococcus epidermidis
EEKDNSDITPY

SEQ ID NO: 1760169 - protein, 5 aa, Staphylococcus epidermidis
EEKGY

SEQ ID NO: 1760170 - protein, 12 aa, Staphylococcus epidermidis
EEKLNQQLSEET

SEQ ID NO: 1760171 - protein, 17 aa, Staphylococcus epidermidis
EEKRNEHIQQTKDNPLT

SEQ ID NO: 1760172 - protein, 7 aa, Staphylococcus epidermidis
EEKWPGT

SEQ ID NO: 1760173 - protein, 4 aa, Staphylococcus epidermidis
EELG

SEQ ID NO: 1760174 - protein, 8 aa, Staphylococcus epidermidis
EELKGSEY

SEQ ID NO: 1760175 - protein, 4 aa, Staphylococcus epidermidis
EELP

SEQ ID NO: 1760176 - protein, 19 aa, Staphylococcus epidermidis
EELQRKKIRDTNIGKQLQD

SEQ ID NO: 1760177 - protein, 11 aa, Staphylococcus epidermidis
EEMEQSGSQQL

SEQ ID NO: 1760178 - protein, 16 aa, Staphylococcus epidermidis
EENGEKAVEELYHAFE

SEQ ID NO: 1760179 - protein, 5 aa, Staphylococcus epidermidis
EENPA

SEQ ID NO: 1760180 - protein, 6 aa, Staphylococcus epidermidis
EENQST

SEQ ID NO: 1760181 - protein, 17 aa, Staphylococcus epidermidis
EENRRLQQEINQLKQRD

SEQ ID NO: 1760182 - protein, 7 aa, Staphylococcus epidermidis
EEPPISI

SEQ ID NO: 1760183 - protein, 9 aa, Staphylococcus epidermidis
EEPQAPGQI

SEQ ID NO: 1760184 - protein, 6 aa, Staphylococcus epidermidis
EEPSEG

SEQ ID NO: 1760185 - protein, 7 aa, Staphylococcus epidermidis
EEQEQEM

SEQ ID NO: 1760186 - protein, 4 aa, Staphylococcus epidermidis
EEQG

SEQ ID NO: 1760187 - protein, 10 aa, Staphylococcus epidermidis
EEQGTMSADD

SEQ ID NO: 1760188 - protein, 8 aa, Staphylococcus epidermidis
EERAKEQG

SEQ ID NO: 1760189 - protein, 4 aa, Staphylococcus epidermidis
EERI

SEQ ID NO: 1760190 - protein, 18 aa, Staphylococcus epidermidis
EERKKNQSETNARYEEEL

SEQ ID NO: 1760191 - protein, 21 aa, Staphylococcus epidermidis
EERVTASKSLKGPKAHFEGDK

SEQ ID NO: 1760192 - protein, 7 aa, Staphylococcus epidermidis
EESDASQ

SEQ ID NO: 1760193 - protein, 16 aa, Staphylococcus epidermidis
EESELPDEDSLYKDVF

SEQ ID NO: 1760194 - protein, 15 aa, Staphylococcus epidermidis
EESEMAKEKDGTSIS

SEQ ID NO: 1760195 - protein, 14 aa, Staphylococcus epidermidis
EESSALKTELPDME

SEQ ID NO: 1760196 - protein, 9 aa, Staphylococcus epidermidis
EESTEGLEE

SEQ ID NO: 1760197 - protein, 4 aa, Staphylococcus epidermidis
EESV

SEQ ID NO: 1760198 - protein, 7 aa, Staphylococcus epidermidis
EETEDKF

SEQ ID NO: 1760199 - protein, 4 aa, Staphylococcus epidermidis
EETI

SEQ ID NO: 1760200 - protein, 5 aa, Staphylococcus epidermidis
EETNT

SEQ ID NO: 1760201 - protein, 4 aa, Staphylococcus epidermidis
EETP

SEQ ID NO: 1760202 - protein, 19 aa, Staphylococcus epidermidis
EEVGEAGTKRACEIGPKGD

SEQ ID NO: 1760203 - protein, 6 aa, Staphylococcus epidermidis
EEYGMS

SEQ ID NO: 1760204 - protein, 13 aa, Staphylococcus epidermidis
EFEEEAKKKAQYY

SEQ ID NO: 1760205 - protein, 7 aa, Staphylococcus epidermidis
EFEPDKE

SEQ ID NO: 1760206 - protein, 5 aa, Staphylococcus epidermidis
EFEPK

SEQ ID NO: 1760207 - protein, 9 aa, Staphylococcus epidermidis
EFESTTPYY

SEQ ID NO: 1760208 - protein, 5 aa, Staphylococcus epidermidis
EFGPD

SEQ ID NO: 1760209 - protein, 7 aa, Staphylococcus epidermidis
EFGTRGL

SEQ ID NO: 1760210 - protein, 8 aa, Staphylococcus epidermidis
EFKQQGKI

SEQ ID NO: 1760211 - protein, 10 aa, Staphylococcus epidermidis
EFKTQDFTET

SEQ ID NO: 1760212 - protein, 7 aa, Staphylococcus epidermidis
EFNKKRY

SEQ ID NO: 1760213 - protein, 6 aa, Staphylococcus epidermidis
EFNKND

SEQ ID NO: 1760214 - protein, 5 aa, Staphylococcus epidermidis
EFNRK

SEQ ID NO: 1760215 - protein, 12 aa, Staphylococcus epidermidis
EFQQSADTISNA

SEQ ID NO: 1760216 - protein, 9 aa, Staphylococcus epidermidis
EFSTQSPQL

SEQ ID NO: 1760217 - protein, 7 aa, Staphylococcus epidermidis
EFSYNDT

SEQ ID NO: 1760218 - protein, 9 aa, Staphylococcus epidermidis
EGASDGVGL

SEQ ID NO: 1760219 - protein, 10 aa, Staphylococcus epidermidis
EGDAKNIEDL

SEQ ID NO: 1760220 - protein, 8 aa, Staphylococcus epidermidis
EGDGVGGL

SEQ ID NO: 1760221 - protein, 5 aa, Staphylococcus epidermidis
EGDQI

SEQ ID NO: 1760222 - protein, 5 aa, Staphylococcus epidermidis
EGDVI

SEQ ID NO: 1760223 - protein, 7 aa, Staphylococcus epidermidis
EGEEDDL

SEQ ID NO: 1760224 - protein, 4 aa, Staphylococcus epidermidis
EGEG

SEQ ID NO: 1760225 - protein, 14 aa, Staphylococcus epidermidis
EGEHGAKRSAAEQV

SEQ ID NO: 1760226 - protein, 4 aa, Staphylococcus epidermidis
EGEI

SEQ ID NO: 1760227 - protein, 10 aa, Staphylococcus epidermidis
EGENPNDESP

SEQ ID NO: 1760228 - protein, 13 aa, Staphylococcus epidermidis
EGERGEQAANVVK

SEQ ID NO: 1760229 - protein, 5 aa, Staphylococcus epidermidis
EGEYS

SEQ ID NO: 1760230 - protein, 6 aa, Staphylococcus epidermidis
EGGGIH

SEQ ID NO: 1760231 - protein, 13 aa, Staphylococcus epidermidis
EGGKTSDSERPLT

SEQ ID NO: 1760232 - protein, 9 aa, Staphylococcus epidermidis
EGIRPQTTI

SEQ ID NO: 1760233 - protein, 13 aa, Staphylococcus epidermidis
EGKTVNQKTQDFQ

SEQ ID NO: 1760234 - protein, 9 aa, Staphylococcus epidermidis
EGLDQAGYQ

SEQ ID NO: 1760235 - protein, 6 aa, Staphylococcus epidermidis
EGLQEK

SEQ ID NO: 1760236 - protein, 8 aa, Staphylococcus epidermidis
EGLTGEKL

SEQ ID NO: 1760237 - protein, 16 aa, Staphylococcus epidermidis
EGNEKMSKSKGNVINP

SEQ ID NO: 1760238 - protein, 7 aa, Staphylococcus epidermidis
EGNERER

SEQ ID NO: 1760239 - protein, 9 aa, Staphylococcus epidermidis
EGNNNYGKE

SEQ ID NO: 1760240 - protein, 5 aa, Staphylococcus epidermidis
EGNRE

SEQ ID NO: 1760241 - protein, 22 aa, Staphylococcus epidermidis
EGPTFTSAKAGVEANYKNDVTD

SEQ ID NO: 1760242 - protein, 15 aa, Staphylococcus epidermidis
EGPTVEKAQANAYEH

SEQ ID NO: 1760243 - protein, 7 aa, Staphylococcus epidermidis
EGQAKQI

SEQ ID NO: 1760244 - protein, 11 aa, Staphylococcus epidermidis
EGQGPEHSSAR

SEQ ID NO: 1760245 - protein, 39 aa, Staphylococcus epidermidis
EGQQGVSNEEVAAEQNINLDDKEESEQAETTEENTSVES

SEQ ID NO: 1760246 - protein, 5 aa, Staphylococcus epidermidis
EGQTV

SEQ ID NO: 1760247 - protein, 4 aa, Staphylococcus epidermidis
EGRG

SEQ ID NO: 1760248 - protein, 5 aa, Staphylococcus epidermidis
EGRPK

SEQ ID NO: 1760249 - protein, 14 aa, Staphylococcus epidermidis
EGSALDKEAYDRAT

SEQ ID NO: 1760250 - protein, 14 aa, Staphylococcus epidermidis
EGSIVGTSSLRRGA

SEQ ID NO: 1760251 - protein, 7 aa, Staphylococcus epidermidis
EGSLSEG

SEQ ID NO: 1760252 - protein, 6 aa, Staphylococcus epidermidis
EGSTSV

SEQ ID NO: 1760253 - protein, 8 aa, Staphylococcus epidermidis
EGTAKSIG

SEQ ID NO: 1760254 - protein, 11 aa, Staphylococcus epidermidis
EGTAPHSRERH

SEQ ID NO: 1760255 - protein, 4 aa, Staphylococcus epidermidis
EGTG

SEQ ID NO: 1760256 - protein, 4 aa, Staphylococcus epidermidis
EGTK

SEQ ID NO: 1760257 - protein, 11 aa, Staphylococcus epidermidis
EGTTDEEAAKD

SEQ ID NO: 1760258 - protein, 15 aa, Staphylococcus epidermidis
EGTTPHTITGQYGSG

SEQ ID NO: 1760259 - protein, 7 aa, Staphylococcus epidermidis
EGTTQVT

SEQ ID NO: 1760260 - protein, 8 aa, Staphylococcus epidermidis
EGYDTPNN

SEQ ID NO: 1760261 - protein, 10 aa, Staphylococcus epidermidis
EGYEKLEQEL

SEQ ID NO: 1760262 - protein, 4 aa, Staphylococcus epidermidis
EGYL

SEQ ID NO: 1760263 - protein, 8 aa, Staphylococcus epidermidis
EGYPPTMN

SEQ ID NO: 1760264 - protein, 4 aa, Staphylococcus epidermidis
EGYQ

SEQ ID NO: 1760265 - protein, 7 aa, Staphylococcus epidermidis
EGYQHRD

SEQ ID NO: 1760266 - protein, 12 aa, Staphylococcus epidermidis
EHAIKNDSAFEQ

SEQ ID NO: 1760267 - protein, 8 aa, Staphylococcus epidermidis
EHDDISSI

SEQ ID NO: 1760268 - protein, 5 aa, Staphylococcus epidermidis
EHDNE

SEQ ID NO: 1760269 - protein, 10 aa, Staphylococcus epidermidis
EHDNKKGIRD

SEQ ID NO: 1760270 - protein, 13 aa, Staphylococcus epidermidis
EHFTYDSNKKVNG

SEQ ID NO: 1760271 - protein, 9 aa, Staphylococcus epidermidis
EHGEKAHSI

SEQ ID NO: 1760272 - protein, 12 aa, Staphylococcus epidermidis
EHGERTTTLEAK

SEQ ID NO: 1760273 - protein, 12 aa, Staphylococcus epidermidis
EHGMSTTVTDGG

SEQ ID NO: 1760274 - protein, 10 aa, Staphylococcus epidermidis
EHLEKGKKSI

SEQ ID NO: 1760275 - protein, 26 aa, Staphylococcus epidermidis
EHNEEGKPSEAPMNRQNQMEKRMRKT

SEQ ID NO: 1760276 - protein, 17 aa, Staphylococcus epidermidis
EHNIETKINEGQQLGES

SEQ ID NO: 1760277 - protein, 10 aa, Staphylococcus epidermidis
EHPPGPSKTI

SEQ ID NO: 1760278 - protein, 10 aa, Staphylococcus epidermidis
EHQDAEDTVN

SEQ ID NO: 1760279 - protein, 21 aa, Staphylococcus epidermidis
EHTEEDIDRTLEAADYAFSKM

SEQ ID NO: 1760280 - protein, 22 aa, Staphylococcus epidermidis
EHTSQRERRAIEAERDTDELKK

SEQ ID NO: 1760281 - protein, 16 aa, Staphylococcus epidermidis
EIADGKIEPVVPKEYL

SEQ ID NO: 1760282 - protein, 6 aa, Staphylococcus epidermidis
EIAEKS

SEQ ID NO: 1760283 - protein, 6 aa, Staphylococcus epidermidis
EIDDSL

SEQ ID NO: 1760284 - protein, 7 aa, Staphylococcus epidermidis
EIENNPD

SEQ ID NO: 1760285 - protein, 9 aa, Staphylococcus epidermidis
EIGNHRGQF

SEQ ID NO: 1760286 - protein, 4 aa, Staphylococcus epidermidis
EIGR

SEQ ID NO: 1760287 - protein, 11 aa, Staphylococcus epidermidis
EIKAEGDVETG

SEQ ID NO: 1760288 - protein, 9 aa, Staphylococcus epidermidis
EIKQSSPEV

SEQ ID NO: 1760289 - protein, 12 aa, Staphylococcus epidermidis
EIKYSQSQNSIK

SEQ ID NO: 1760290 - protein, 7 aa, Staphylococcus epidermidis
EIPPESV

SEQ ID NO: 1760291 - protein, 14 aa, Staphylococcus epidermidis
EIPSDQEAMDIGPK

SEQ ID NO: 1760292 - protein, 4 aa, Staphylococcus epidermidis
EIQD

SEQ ID NO: 1760293 - protein, 4 aa, Staphylococcus epidermidis
EIQN

SEQ ID NO: 1760294 - protein, 10 aa, Staphylococcus epidermidis
EIQNDKQYTL

SEQ ID NO: 1760295 - protein, 12 aa, Staphylococcus epidermidis
EIRGEQKDIGWG

SEQ ID NO: 1760296 - protein, 4 aa, Staphylococcus epidermidis
EISD

SEQ ID NO: 1760297 - protein, 9 aa, Staphylococcus epidermidis
EISEQSKEA

SEQ ID NO: 1760298 - protein, 11 aa, Staphylococcus epidermidis
EISEYKTDDLA

SEQ ID NO: 1760299 - protein, 6 aa, Staphylococcus epidermidis
EISPDT

SEQ ID NO: 1760300 - protein, 7 aa, Staphylococcus epidermidis
EISTPNY

SEQ ID NO: 1760301 - protein, 6 aa, Staphylococcus epidermidis
EISTTT

SEQ ID NO: 1760302 - protein, 13 aa, Staphylococcus epidermidis
EITPPQSSDKDND

SEQ ID NO: 1760303 - protein, 7 aa, Staphylococcus epidermidis
EIYETPG

SEQ ID NO: 1760304 - protein, 10 aa, Staphylococcus epidermidis
EKAHQTGNQM

SEQ ID NO: 1760305 - protein, 5 aa, Staphylococcus epidermidis
EKAKE

SEQ ID NO: 1760306 - protein, 32 aa, Staphylococcus epidermidis
EKAKEVEEKLKEQNEEKTDDIEQTKKDIQDTL

SEQ ID NO: 1760307 - protein, 6 aa, Staphylococcus epidermidis
EKALQQ

SEQ ID NO: 1760308 - protein, 9 aa, Staphylococcus epidermidis
EKAYNGEKR

SEQ ID NO: 1760309 - protein, 7 aa, Staphylococcus epidermidis
EKDAGDR

SEQ ID NO: 1760310 - protein, 4 aa, Staphylococcus epidermidis
EKDG

SEQ ID NO: 1760311 - protein, 8 aa, Staphylococcus epidermidis
EKDKVGEA

SEQ ID NO: 1760312 - protein, 16 aa, Staphylococcus epidermidis
EKEADEIEKAAEQAVE

SEQ ID NO: 1760313 - protein, 5 aa, Staphylococcus epidermidis
EKEDE

SEQ ID NO: 1760314 - protein, 8 aa, Staphylococcus epidermidis
EKEDVDDE

SEQ ID NO: 1760315 - protein, 15 aa, Staphylococcus epidermidis
EKEDYIDGSNVEEGQ

SEQ ID NO: 1760316 - protein, 6 aa, Staphylococcus epidermidis
EKEGYD

SEQ ID NO: 1760317 - protein, 13 aa, Staphylococcus epidermidis
EKEQGNDEAHDMD

SEQ ID NO: 1760318 - protein, 8 aa, Staphylococcus epidermidis
EKESQQDI

SEQ ID NO: 1760319 - protein, 14 aa, Staphylococcus epidermidis
EKFKDSDNEQVNKV

SEQ ID NO: 1760320 - protein, 4 aa, Staphylococcus epidermidis
EKFN

SEQ ID NO: 1760321 - protein, 5 aa, Staphylococcus epidermidis
EKGEV

SEQ ID NO: 1760322 - protein, 9 aa, Staphylococcus epidermidis
EKGGEGGIE

SEQ ID NO: 1760323 - protein, 16 aa, Staphylococcus epidermidis
EKGILSQSSPVATQIP

SEQ ID NO: 1760324 - protein, 11 aa, Staphylococcus epidermidis
EKGKGKNKKVE

SEQ ID NO: 1760325 - protein, 8 aa, Staphylococcus epidermidis
EKGLDGSR

SEQ ID NO: 1760326 - protein, 9 aa, Staphylococcus epidermidis
EKGPDVPRG

SEQ ID NO: 1760327 - protein, 15 aa, Staphylococcus epidermidis
EKGPNALKGEKKKQL

SEQ ID NO: 1760328 - protein, 9 aa, Staphylococcus epidermidis
EKGQQAMKT

SEQ ID NO: 1760329 - protein, 14 aa, Staphylococcus epidermidis
EKGQTGRMLAFIGR

SEQ ID NO: 1760330 - protein, 8 aa, Staphylococcus epidermidis
EKGTRHGG

SEQ ID NO: 1760331 - protein, 17 aa, Staphylococcus epidermidis
EKGTVEKEGKSEGTTEE

SEQ ID NO: 1760332 - protein, 7 aa, Staphylococcus epidermidis
EKHHTTI

SEQ ID NO: 1760333 - protein, 8 aa, Staphylococcus epidermidis
EKLDPEAE

SEQ ID NO: 1760334 - protein, 9 aa, Staphylococcus epidermidis
EKLPDKRYQ

SEQ ID NO: 1760335 - protein, 7 aa, Staphylococcus epidermidis
EKLSDRA

SEQ ID NO: 1760336 - protein, 8 aa, Staphylococcus epidermidis
EKLSNQEG

SEQ ID NO: 1760337 - protein, 4 aa, Staphylococcus epidermidis
EKLT

SEQ ID NO: 1760338 - protein, 9 aa, Staphylococcus epidermidis
EKNGQSHRD

SEQ ID NO: 1760339 - protein, 14 aa, Staphylococcus epidermidis
EKPDQGQVTLDGQP

SEQ ID NO: 1760340 - protein, 12 aa, Staphylococcus epidermidis
EKPPIPGRTNST

SEQ ID NO: 1760341 - protein, 5 aa, Staphylococcus epidermidis
EKQDD

SEQ ID NO: 1760342 - protein, 7 aa, Staphylococcus epidermidis
EKQIRER

SEQ ID NO: 1760343 - protein, 7 aa, Staphylococcus epidermidis
EKQPIFG

SEQ ID NO: 1760344 - protein, 14 aa, Staphylococcus epidermidis
EKQVPAREFIFKNF

SEQ ID NO: 1760345 - protein, 6 aa, Staphylococcus epidermidis
EKRNQQ

SEQ ID NO: 1760346 - protein, 8 aa, Staphylococcus epidermidis
EKSKMKLS

SEQ ID NO: 1760347 - protein, 7 aa, Staphylococcus epidermidis
EKSPNSQ

SEQ ID NO: 1760348 - protein, 6 aa, Staphylococcus epidermidis
EKSQNL

SEQ ID NO: 1760349 - protein, 7 aa, Staphylococcus epidermidis
EKTGNPN

SEQ ID NO: 1760350 - protein, 7 aa, Staphylococcus epidermidis
EKVAEYT

SEQ ID NO: 1760351 - protein, 6 aa, Staphylococcus epidermidis
EKVKSK

SEQ ID NO: 1760352 - protein, 8 aa, Staphylococcus epidermidis
EKYSETQS

SEQ ID NO: 1760353 - protein, 12 aa, Staphylococcus epidermidis
EKYTYDKEKEAR

SEQ ID NO: 1760354 - protein, 5 aa, Staphylococcus epidermidis
ELAAK

SEQ ID NO: 1760355 - protein, 6 aa, Staphylococcus epidermidis
ELEDQG

SEQ ID NO: 1760356 - protein, 5 aa, Staphylococcus epidermidis
ELEEK

SEQ ID NO: 1760357 - protein, 5 aa, Staphylococcus epidermidis
ELGFE

SEQ ID NO: 1760358 - protein, 10 aa, Staphylococcus epidermidis
ELGGDAKSIR

SEQ ID NO: 1760359 - protein, 6 aa, Staphylococcus epidermidis
ELGGGS

SEQ ID NO: 1760360 - protein, 7 aa, Staphylococcus epidermidis
ELGGKSP

SEQ ID NO: 1760361 - protein, 5 aa, Staphylococcus epidermidis
ELGGN

SEQ ID NO: 1760362 - protein, 5 aa, Staphylococcus epidermidis
ELGQK

SEQ ID NO: 1760363 - protein, 9 aa, Staphylococcus epidermidis
ELKDEGKIK

SEQ ID NO: 1760364 - protein, 4 aa, Staphylococcus epidermidis
ELKG

SEQ ID NO: 1760365 - protein, 6 aa, Staphylococcus epidermidis
ELNDPL

SEQ ID NO: 1760366 - protein, 5 aa, Staphylococcus epidermidis
ELNPQ

SEQ ID NO: 1760367 - protein, 7 aa, Staphylococcus epidermidis
ELPENAR

SEQ ID NO: 1760368 - protein, 7 aa, Staphylococcus epidermidis
ELPKGAR

SEQ ID NO: 1760369 - protein, 4 aa, Staphylococcus epidermidis
ELQQ

SEQ ID NO: 1760370 - protein, 8 aa, Staphylococcus epidermidis
ELRQTDGE

SEQ ID NO: 1760371 - protein, 12 aa, Staphylococcus epidermidis
ELSADGPIRPPY

SEQ ID NO: 1760372 - protein, 8 aa, Staphylococcus epidermidis
ELSEGNRS

SEQ ID NO: 1760373 - protein, 7 aa, Staphylococcus epidermidis
EMGEEPH

SEQ ID NO: 1760374 - protein, 4 aa, Staphylococcus epidermidis
EMIR

SEQ ID NO: 1760375 - protein, 12 aa, Staphylococcus epidermidis
EMQTGEGKTLTA

SEQ ID NO: 1760376 - protein, 6 aa, Staphylococcus epidermidis
EMRPKK

SEQ ID NO: 1760377 - protein, 6 aa, Staphylococcus epidermidis
EMTQNA

SEQ ID NO: 1760378 - protein, 11 aa, Staphylococcus epidermidis
ENAAHGKGLTE

SEQ ID NO: 1760379 - protein, 7 aa, Staphylococcus epidermidis
ENADEGR

SEQ ID NO: 1760380 - protein, 22 aa, Staphylococcus epidermidis
ENANSTTSVDLANRSRGLTEEN

SEQ ID NO: 1760381 - protein, 4 aa, Staphylococcus epidermidis
ENAS

SEQ ID NO: 1760382 - protein, 4 aa, Staphylococcus epidermidis
ENAV

SEQ ID NO: 1760383 - protein, 6 aa, Staphylococcus epidermidis
ENDDAS

SEQ ID NO: 1760384 - protein, 4 aa, Staphylococcus epidermidis
ENDI

SEQ ID NO: 1760385 - protein, 6 aa, Staphylococcus epidermidis
ENDPNI

SEQ ID NO: 1760386 - protein, 4 aa, Staphylococcus epidermidis
ENED

SEQ ID NO: 1760387 - protein, 5 aa, Staphylococcus epidermidis
ENEDN

SEQ ID NO: 1760388 - protein, 20 aa, Staphylococcus epidermidis
ENEEKAKQYKEARGKGGHVR

SEQ ID NO: 1760389 - protein, 6 aa, Staphylococcus epidermidis
ENEHQN

SEQ ID NO: 1760390 - protein, 6 aa, Staphylococcus epidermidis
ENENDA

SEQ ID NO: 1760391 - protein, 8 aa, Staphylococcus epidermidis
ENGAGKST

SEQ ID NO: 1760392 - protein, 5 aa, Staphylococcus epidermidis
ENGAH

SEQ ID NO: 1760393 - protein, 6 aa, Staphylococcus epidermidis
ENGDYP

SEQ ID NO: 1760394 - protein, 11 aa, Staphylococcus epidermidis
ENGELATTGST

SEQ ID NO: 1760395 - protein, 6 aa, Staphylococcus epidermidis
ENGGLA

SEQ ID NO: 1760396 - protein, 11 aa, Staphylococcus epidermidis
ENGTEHEGELD

SEQ ID NO: 1760397 - protein, 4 aa, Staphylococcus epidermidis
ENIT

SEQ ID NO: 1760398 - protein, 7 aa, Staphylococcus epidermidis
ENKEEEY

SEQ ID NO: 1760399 - protein, 8 aa, Staphylococcus epidermidis
ENKEPLHD

SEQ ID NO: 1760400 - protein, 16 aa, Staphylococcus epidermidis
ENKGKRSGGYSSGGHL

SEQ ID NO: 1760401 - protein, 8 aa, Staphylococcus epidermidis
ENKGSSKV

SEQ ID NO: 1760402 - protein, 7 aa, Staphylococcus epidermidis
ENKKGTI

SEQ ID NO: 1760403 - protein, 9 aa, Staphylococcus epidermidis
ENKSGYNSY

SEQ ID NO: 1760404 - protein, 8 aa, Staphylococcus epidermidis
ENKTEGSI

SEQ ID NO: 1760405 - protein, 4 aa, Staphylococcus epidermidis
ENNL

SEQ ID NO: 1760406 - protein, 10 aa, Staphylococcus epidermidis
ENNSKKVTGV

SEQ ID NO: 1760407 - protein, 5 aa, Staphylococcus epidermidis
ENNVP

SEQ ID NO: 1760408 - protein, 9 aa, Staphylococcus epidermidis
ENNYQPNQF

SEQ ID NO: 1760409 - protein, 4 aa, Staphylococcus epidermidis
ENPI

SEQ ID NO: 1760410 - protein, 6 aa, Staphylococcus epidermidis
ENPQHE

SEQ ID NO: 1760411 - protein, 8 aa, Staphylococcus epidermidis
ENPQTLNS

SEQ ID NO: 1760412 - protein, 7 aa, Staphylococcus epidermidis
ENQQKSL

SEQ ID NO: 1760413 - protein, 5 aa, Staphylococcus epidermidis
ENQSA

SEQ ID NO: 1760414 - protein, 5 aa, Staphylococcus epidermidis
ENQVA

SEQ ID NO: 1760415 - protein, 6 aa, Staphylococcus epidermidis
ENSDKV

SEQ ID NO: 1760416 - protein, 8 aa, Staphylococcus epidermidis
ENSGHAHA

SEQ ID NO: 1760417 - protein, 7 aa, Staphylococcus epidermidis
ENSINKK

SEQ ID NO: 1760418 - protein, 12 aa, Staphylococcus epidermidis
ENTRVGQSSDFD

SEQ ID NO: 1760419 - protein, 8 aa, Staphylococcus epidermidis
ENTTSTKV

SEQ ID NO: 1760420 - protein, 6 aa, Staphylococcus epidermidis
ENVNVD

SEQ ID NO: 1760421 - protein, 6 aa, Staphylococcus epidermidis
ENYEQA

SEQ ID NO: 1760422 - protein, 12 aa, Staphylococcus epidermidis
ENYEQSTSQLRE

SEQ ID NO: 1760423 - protein, 6 aa, Staphylococcus epidermidis
ENYPKN

SEQ ID NO: 1760424 - protein, 4 aa, Staphylococcus epidermidis
EPDD

SEQ ID NO: 1760425 - protein, 5 aa, Staphylococcus epidermidis
EPFKP

SEQ ID NO: 1760426 - protein, 9 aa, Staphylococcus epidermidis
EPLDESATK

SEQ ID NO: 1760427 - protein, 6 aa, Staphylococcus epidermidis
EPPDNT

SEQ ID NO: 1760428 - protein, 8 aa, Staphylococcus epidermidis
EPPSASPV

SEQ ID NO: 1760429 - protein, 5 aa, Staphylococcus epidermidis
EPPSD

SEQ ID NO: 1760430 - protein, 8 aa, Staphylococcus epidermidis
EPQPPSED

SEQ ID NO: 1760431 - protein, 7 aa, Staphylococcus epidermidis
EPSENEL

SEQ ID NO: 1760432 - protein, 8 aa, Staphylococcus epidermidis
EPSYKDNI

SEQ ID NO: 1760433 - protein, 13 aa, Staphylococcus epidermidis
EPTGALDSKSAQD

SEQ ID NO: 1760434 - protein, 12 aa, Staphylococcus epidermidis
EPTGALDSKSTL

SEQ ID NO: 1760435 - protein, 11 aa, Staphylococcus epidermidis
EPTQELNNKLA

SEQ ID NO: 1760436 - protein, 7 aa, Staphylococcus epidermidis
EPTREES

SEQ ID NO: 1760437 - protein, 5 aa, Staphylococcus epidermidis
EPTSN

SEQ ID NO: 1760438 - protein, 7 aa, Staphylococcus epidermidis
EPVAASE

SEQ ID NO: 1760439 - protein, 10 aa, Staphylococcus epidermidis
EPWEPTSSDF

SEQ ID NO: 1760440 - protein, 9 aa, Staphylococcus epidermidis
EQAKHGELS

SEQ ID NO: 1760441 - protein, 7 aa, Staphylococcus epidermidis
EQDQDKQ

SEQ ID NO: 1760442 - protein, 5 aa, Staphylococcus epidermidis
EQEGY

SEQ ID NO: 1760443 - protein, 6 aa, Staphylococcus epidermidis
EQEGYH

SEQ ID NO: 1760444 - protein, 8 aa, Staphylococcus epidermidis
EQFANEAG

SEQ ID NO: 1760445 - protein, 4 aa, Staphylococcus epidermidis
EQGI

SEQ ID NO: 1760446 - protein, 10 aa, Staphylococcus epidermidis
EQGQDEDFNK

SEQ ID NO: 1760447 - protein, 4 aa, Staphylococcus epidermidis
EQGT

SEQ ID NO: 1760448 - protein, 5 aa, Staphylococcus epidermidis
EQIPF

SEQ ID NO: 1760449 - protein, 7 aa, Staphylococcus epidermidis
EQKEDGK

SEQ ID NO: 1760450 - protein, 5 aa, Staphylococcus epidermidis
EQKLT

SEQ ID NO: 1760451 - protein, 10 aa, Staphylococcus epidermidis
EQKNQKKKNI

SEQ ID NO: 1760452 - protein, 8 aa, Staphylococcus epidermidis
EQLAKNAK

SEQ ID NO: 1760453 - protein, 14 aa, Staphylococcus epidermidis
EQLDDASWTITIQK

SEQ ID NO: 1760454 - protein, 13 aa, Staphylococcus epidermidis
EQLENDAKKASIL

SEQ ID NO: 1760455 - protein, 5 aa, Staphylococcus epidermidis
EQLKR

SEQ ID NO: 1760456 - protein, 4 aa, Staphylococcus epidermidis
EQNI

SEQ ID NO: 1760457 - protein, 6 aa, Staphylococcus epidermidis
EQPATI

SEQ ID NO: 1760458 - protein, 5 aa, Staphylococcus epidermidis
EQPEA

SEQ ID NO: 1760459 - protein, 8 aa, Staphylococcus epidermidis
EQPKSDRL

SEQ ID NO: 1760460 - protein, 4 aa, Staphylococcus epidermidis
EQQR

SEQ ID NO: 1760461 - protein, 8 aa, Staphylococcus epidermidis
EQQSNSTM

SEQ ID NO: 1760462 - protein, 10 aa, Staphylococcus epidermidis
EQQTGHINTD

SEQ ID NO: 1760463 - protein, 7 aa, Staphylococcus epidermidis
EQQYEKV

SEQ ID NO: 1760464 - protein, 10 aa, Staphylococcus epidermidis
EQRAKELDEM

SEQ ID NO: 1760465 - protein, 5 aa, Staphylococcus epidermidis
EQRRE

SEQ ID NO: 1760466 - protein, 7 aa, Staphylococcus epidermidis
EQSDVNN

SEQ ID NO: 1760467 - protein, 9 aa, Staphylococcus epidermidis
EQTKLSNSK

SEQ ID NO: 1760468 - protein, 10 aa, Staphylococcus epidermidis
EQVENSDGDA

SEQ ID NO: 1760469 - protein, 15 aa, Staphylococcus epidermidis
EQYEKEAASKYGDTH

SEQ ID NO: 1760470 - protein, 6 aa, Staphylococcus epidermidis
EQYPKA

SEQ ID NO: 1760471 - protein, 19 aa, Staphylococcus epidermidis
ERAERRQKENEQRGIESNL

SEQ ID NO: 1760472 - protein, 7 aa, Staphylococcus epidermidis
ERDGERP

SEQ ID NO: 1760473 - protein, 4 aa, Staphylococcus epidermidis
EREL

SEQ ID NO: 1760474 - protein, 9 aa, Staphylococcus epidermidis
ERENKKGHQ

SEQ ID NO: 1760475 - protein, 15 aa, Staphylococcus epidermidis
EREQIASDLEEQSEY

SEQ ID NO: 1760476 - protein, 4 aa, Staphylococcus epidermidis
ERES

SEQ ID NO: 1760477 - protein, 4 aa, Staphylococcus epidermidis
ERGE

SEQ ID NO: 1760478 - protein, 7 aa, Staphylococcus epidermidis
ERGEGER

SEQ ID NO: 1760479 - protein, 4 aa, Staphylococcus epidermidis
ERGR

SEQ ID NO: 1760480 - protein, 9 aa, Staphylococcus epidermidis
ERKDEDEPL

SEQ ID NO: 1760481 - protein, 7 aa, Staphylococcus epidermidis
ERKQHGL

SEQ ID NO: 1760482 - protein, 12 aa, Staphylococcus epidermidis
ERLAKAKSVGAT

SEQ ID NO: 1760483 - protein, 6 aa, Staphylococcus epidermidis
ERLDGE

SEQ ID NO: 1760484 - protein, 11 aa, Staphylococcus epidermidis
ERLKEDKKQLE

SEQ ID NO: 1760485 - protein, 10 aa, Staphylococcus epidermidis
ERNNDPYPHE

SEQ ID NO: 1760486 - protein, 8 aa, Staphylococcus epidermidis
ERPELGNE

SEQ ID NO: 1760487 - protein, 8 aa, Staphylococcus epidermidis
ERPGIDGK

SEQ ID NO: 1760488 - protein, 5 aa, Staphylococcus epidermidis
ERPKI

SEQ ID NO: 1760489 - protein, 6 aa, Staphylococcus epidermidis
ERQISK

SEQ ID NO: 1760490 - protein, 11 aa, Staphylococcus epidermidis
ERRERDHRKIG

SEQ ID NO: 1760491 - protein, 6 aa, Staphylococcus epidermidis
ERSAVS

SEQ ID NO: 1760492 - protein, 7 aa, Staphylococcus epidermidis
ERSQRTG

SEQ ID NO: 1760493 - protein, 5 aa, Staphylococcus epidermidis
ERSYY

SEQ ID NO: 1760494 - protein, 8 aa, Staphylococcus epidermidis
ERTDGNKR

SEQ ID NO: 1760495 - protein, 7 aa, Staphylococcus epidermidis
ERTQALG

SEQ ID NO: 1760496 - protein, 7 aa, Staphylococcus epidermidis
ERYDGNP

SEQ ID NO: 1760497 - protein, 6 aa, Staphylococcus epidermidis
ERYGTE

SEQ ID NO: 1760498 - protein, 4 aa, Staphylococcus epidermidis
ERYN

SEQ ID NO: 1760499 - protein, 7 aa, Staphylococcus epidermidis
ERYQTHK

SEQ ID NO: 1760500 - protein, 12 aa, Staphylococcus epidermidis
ESADAFFDSAIH

SEQ ID NO: 1760501 - protein, 12 aa, Staphylococcus epidermidis
ESAIESGYVTES

SEQ ID NO: 1760502 - protein, 6 aa, Staphylococcus epidermidis
ESAKAG

SEQ ID NO: 1760503 - protein, 8 aa, Staphylococcus epidermidis
ESDDRVTP

SEQ ID NO: 1760504 - protein, 9 aa, Staphylococcus epidermidis
ESDNETLQQ

SEQ ID NO: 1760505 - protein, 4 aa, Staphylococcus epidermidis
ESDR

SEQ ID NO: 1760506 - protein, 16 aa, Staphylococcus epidermidis
ESEFKARAAENDIQSR

SEQ ID NO: 1760507 - protein, 5 aa, Staphylococcus epidermidis
ESFGA

SEQ ID NO: 1760508 - protein, 10 aa, Staphylococcus epidermidis
ESFSNQDANE

SEQ ID NO: 1760509 - protein, 9 aa, Staphylococcus epidermidis
ESGGKTTEN

SEQ ID NO: 1760510 - protein, 6 aa, Staphylococcus epidermidis
ESGKMI

SEQ ID NO: 1760511 - protein, 9 aa, Staphylococcus epidermidis
ESGRWSAYG

SEQ ID NO: 1760512 - protein, 11 aa, Staphylococcus epidermidis
ESHPNMPSTVT

SEQ ID NO: 1760513 - protein, 4 aa, Staphylococcus epidermidis
ESIE

SEQ ID NO: 1760514 - protein, 23 aa, Staphylococcus epidermidis
ESIEQAVERAGTKAGNKGSEAAV

SEQ ID NO: 1760515 - protein, 4 aa, Staphylococcus epidermidis
ESIP

SEQ ID NO: 1760516 - protein, 9 aa, Staphylococcus epidermidis
ESKETGKKE

SEQ ID NO: 1760517 - protein, 8 aa, Staphylococcus epidermidis
ESKKERLT

SEQ ID NO: 1760518 - protein, 7 aa, Staphylococcus epidermidis
ESKMAKD

SEQ ID NO: 1760519 - protein, 7 aa, Staphylococcus epidermidis
ESKQTGY

SEQ ID NO: 1760520 - protein, 9 aa, Staphylococcus epidermidis
ESKRESRPN

SEQ ID NO: 1760521 - protein, 6 aa, Staphylococcus epidermidis
ESLTPK

SEQ ID NO: 1760522 - protein, 7 aa, Staphylococcus epidermidis
ESLTSGY

SEQ ID NO: 1760523 - protein, 5 aa, Staphylococcus epidermidis
ESMTG

SEQ ID NO: 1760524 - protein, 4 aa, Staphylococcus epidermidis
ESMY

SEQ ID NO: 1760525 - protein, 8 aa, Staphylococcus epidermidis
ESNDKKVR

SEQ ID NO: 1760526 - protein, 9 aa, Staphylococcus epidermidis
ESNHASPSM

SEQ ID NO: 1760527 - protein, 9 aa, Staphylococcus epidermidis
ESPGASTSL

SEQ ID NO: 1760528 - protein, 8 aa, Staphylococcus epidermidis
ESPNHDER

SEQ ID NO: 1760529 - protein, 9 aa, Staphylococcus epidermidis
ESPSETTIK

SEQ ID NO: 1760530 - protein, 7 aa, Staphylococcus epidermidis
ESPTSGE

SEQ ID NO: 1760531 - protein, 19 aa, Staphylococcus epidermidis
ESQNEVNYSASQKEALETA

SEQ ID NO: 1760532 - protein, 5 aa, Staphylococcus epidermidis
ESQQL

SEQ ID NO: 1760533 - protein, 15 aa, Staphylococcus epidermidis
ESRDGKIKVTSKGKQ

SEQ ID NO: 1760534 - protein, 4 aa, Staphylococcus epidermidis
ESSV

SEQ ID NO: 1760535 - protein, 19 aa, Staphylococcus epidermidis
ESVDKDKGFGPYRQSERAE

SEQ ID NO: 1760536 - protein, 9 aa, Staphylococcus epidermidis
ESYDKNNPL

SEQ ID NO: 1760537 - protein, 4 aa, Staphylococcus epidermidis
ETAG

SEQ ID NO: 1760538 - protein, 4 aa, Staphylococcus epidermidis
ETDD

SEQ ID NO: 1760539 - protein, 16 aa, Staphylococcus epidermidis
ETDDELNEGDTFGSVE

SEQ ID NO: 1760540 - protein, 9 aa, Staphylococcus epidermidis
ETDDGTMSD

SEQ ID NO: 1760541 - protein, 7 aa, Staphylococcus epidermidis
ETDEETM

SEQ ID NO: 1760542 - protein, 20 aa, Staphylococcus epidermidis
ETDEVIPDKNATSDNEESDE

SEQ ID NO: 1760543 - protein, 6 aa, Staphylococcus epidermidis
ETDHEI

SEQ ID NO: 1760544 - protein, 9 aa, Staphylococcus epidermidis
ETDNQNVSK

SEQ ID NO: 1760545 - protein, 4 aa, Staphylococcus epidermidis
ETDY

SEQ ID NO: 1760546 - protein, 6 aa, Staphylococcus epidermidis
ETEAIK

SEQ ID NO: 1760547 - protein, 14 aa, Staphylococcus epidermidis
ETEARTGFASKTDD

SEQ ID NO: 1760548 - protein, 9 aa, Staphylococcus epidermidis
ETEDGTPID

SEQ ID NO: 1760549 - protein, 13 aa, Staphylococcus epidermidis
ETEDYTRFEKYIN

SEQ ID NO: 1760550 - protein, 18 aa, Staphylococcus epidermidis
ETEEEFDKRIESYEDYHH

SEQ ID NO: 1760551 - protein, 5 aa, Staphylococcus epidermidis
ETEQY

SEQ ID NO: 1760552 - protein, 5 aa, Staphylococcus epidermidis
ETFER

SEQ ID NO: 1760553 - protein, 5 aa, Staphylococcus epidermidis
ETFET

SEQ ID NO: 1760554 - protein, 14 aa, Staphylococcus epidermidis
ETGALPDADKFDSA

SEQ ID NO: 1760555 - protein, 5 aa, Staphylococcus epidermidis
ETGAM

SEQ ID NO: 1760556 - protein, 8 aa, Staphylococcus epidermidis
ETGAQGKI

SEQ ID NO: 1760557 - protein, 5 aa, Staphylococcus epidermidis
ETGEI

SEQ ID NO: 1760558 - protein, 5 aa, Staphylococcus epidermidis
ETGHT

SEQ ID NO: 1760559 - protein, 9 aa, Staphylococcus epidermidis
ETGKLKMNG

SEQ ID NO: 1760560 - protein, 5 aa, Staphylococcus epidermidis
ETGNP

SEQ ID NO: 1760561 - protein, 11 aa, Staphylococcus epidermidis
ETHAEEKPHPK

SEQ ID NO: 1760562 - protein, 16 aa, Staphylococcus epidermidis
ETHEKALSKKAELDQK

SEQ ID NO: 1760563 - protein, 5 aa, Staphylococcus epidermidis
ETHER

SEQ ID NO: 1760564 - protein, 11 aa, Staphylococcus epidermidis
ETHTSNHNYEQ

SEQ ID NO: 1760565 - protein, 12 aa, Staphylococcus epidermidis
ETKDNPGAYTQT

SEQ ID NO: 1760566 - protein, 13 aa, Staphylococcus epidermidis
ETKELVFKNGNWA

SEQ ID NO: 1760567 - protein, 5 aa, Staphylococcus epidermidis
ETKEP

SEQ ID NO: 1760568 - protein, 11 aa, Staphylococcus epidermidis
ETKPGVGYPKR

SEQ ID NO: 1760569 - protein, 5 aa, Staphylococcus epidermidis
ETKVE

SEQ ID NO: 1760570 - protein, 4 aa, Staphylococcus epidermidis
ETLE

SEQ ID NO: 1760571 - protein, 5 aa, Staphylococcus epidermidis
ETLEK

SEQ ID NO: 1760572 - protein, 9 aa, Staphylococcus epidermidis
ETLESLEKS

SEQ ID NO: 1760573 - protein, 8 aa, Staphylococcus epidermidis
ETLKGERG

SEQ ID NO: 1760574 - protein, 5 aa, Staphylococcus epidermidis
ETLSG

SEQ ID NO: 1760575 - protein, 5 aa, Staphylococcus epidermidis
ETLYD

SEQ ID NO: 1760576 - protein, 4 aa, Staphylococcus epidermidis
ETPN

SEQ ID NO: 1760577 - protein, 4 aa, Staphylococcus epidermidis
ETPS

SEQ ID NO: 1760578 - protein, 14 aa, Staphylococcus epidermidis
ETPTTIKATGGFAK

SEQ ID NO: 1760579 - protein, 6 aa, Staphylococcus epidermidis
ETQGSR

SEQ ID NO: 1760580 - protein, 6 aa, Staphylococcus epidermidis
ETTDYQ

SEQ ID NO: 1760581 - protein, 10 aa, Staphylococcus epidermidis
ETTGSEFSSN

SEQ ID NO: 1760582 - protein, 5 aa, Staphylococcus epidermidis
ETTLD

SEQ ID NO: 1760583 - protein, 6 aa, Staphylococcus epidermidis
ETTLSS

SEQ ID NO: 1760584 - protein, 8 aa, Staphylococcus epidermidis
ETTSEKNA

SEQ ID NO: 1760585 - protein, 7 aa, Staphylococcus epidermidis
ETTVQGE

SEQ ID NO: 1760586 - protein, 19 aa, Staphylococcus epidermidis
ETTYGAAPYDKVRGHDGPI

SEQ ID NO: 1760587 - protein, 7 aa, Staphylococcus epidermidis
ETVQSGS

SEQ ID NO: 1760588 - protein, 6 aa, Staphylococcus epidermidis
ETVSDG

SEQ ID NO: 1760589 - protein, 4 aa, Staphylococcus epidermidis
ETYN

SEQ ID NO: 1760590 - protein, 5 aa, Staphylococcus epidermidis
ETYTF

SEQ ID NO: 1760591 - protein, 12 aa, Staphylococcus epidermidis
EVATNAGVKNVD

SEQ ID NO: 1760592 - protein, 11 aa, Staphylococcus epidermidis
EVEKDINNVSP

SEQ ID NO: 1760593 - protein, 11 aa, Staphylococcus epidermidis
EVEQDSSNNQN

SEQ ID NO: 1760594 - protein, 7 aa, Staphylococcus epidermidis
EVESQIE

SEQ ID NO: 1760595 - protein, 6 aa, Staphylococcus epidermidis
EVKPSY

SEQ ID NO: 1760596 - protein, 14 aa, Staphylococcus epidermidis
EVKRRGDMEDDPSF

SEQ ID NO: 1760597 - protein, 6 aa, Staphylococcus epidermidis
EVNDKL

SEQ ID NO: 1760598 - protein, 7 aa, Staphylococcus epidermidis
EVNTPLS

SEQ ID NO: 1760599 - protein, 5 aa, Staphylococcus epidermidis
EVPEI

SEQ ID NO: 1760600 - protein, 12 aa, Staphylococcus epidermidis
EVPELSRQSKGI

SEQ ID NO: 1760601 - protein, 17 aa, Staphylococcus epidermidis
EVPTKAKRKNKNLITEF

SEQ ID NO: 1760602 - protein, 5 aa, Staphylococcus epidermidis
EVRDE

SEQ ID NO: 1760603 - protein, 20 aa, Staphylococcus epidermidis
EVRQAKKDETMRTLDGEERR

SEQ ID NO: 1760604 - protein, 5 aa, Staphylococcus epidermidis
EVRRR

SEQ ID NO: 1760605 - protein, 5 aa, Staphylococcus epidermidis
EVSDD

SEQ ID NO: 1760606 - protein, 5 aa, Staphylococcus epidermidis
EVSTK

SEQ ID NO: 1760607 - protein, 11 aa, Staphylococcus epidermidis
EVTEDTDEPDY

SEQ ID NO: 1760608 - protein, 12 aa, Staphylococcus epidermidis
EVTEGQHITYDF

SEQ ID NO: 1760609 - protein, 5 aa, Staphylococcus epidermidis
EVTSS

SEQ ID NO: 1760610 - protein, 11 aa, Staphylococcus epidermidis
EYEDGESDILP

SEQ ID NO: 1760611 - protein, 13 aa, Staphylococcus epidermidis
EYESAKNKETQQL

SEQ ID NO: 1760612 - protein, 4 aa, Staphylococcus epidermidis
EYGS

SEQ ID NO: 1760613 - protein, 8 aa, Staphylococcus epidermidis
EYQNRKND

SEQ ID NO: 1760614 - protein, 11 aa, Staphylococcus epidermidis
EYSVSSKTNRV

SEQ ID NO: 1760615 - protein, 9 aa, Staphylococcus epidermidis
FADDKEAWE

SEQ ID NO: 1760616 - protein, 7 aa, Staphylococcus epidermidis
FADEEEA

SEQ ID NO: 1760617 - protein, 4 aa, Staphylococcus epidermidis
FAEE

SEQ ID NO: 1760618 - protein, 8 aa, Staphylococcus epidermidis
FAKEGKPV

SEQ ID NO: 1760619 - protein, 18 aa, Staphylococcus epidermidis
FAPTRTFKGHAADDKKTR

SEQ ID NO: 1760620 - protein, 11 aa, Staphylococcus epidermidis
FAREGEDPSMI

SEQ ID NO: 1760621 - protein, 6 aa, Staphylococcus epidermidis
FARSGD

SEQ ID NO: 1760622 - protein, 15 aa, Staphylococcus epidermidis
FASQNEWQRASDEIN

SEQ ID NO: 1760623 - protein, 7 aa, Staphylococcus epidermidis
FATENGK

SEQ ID NO: 1760624 - protein, 14 aa, Staphylococcus epidermidis
FATPDYDHIQQMKE

SEQ ID NO: 1760625 - protein, 6 aa, Staphylococcus epidermidis
FDDKKD

SEQ ID NO: 1760626 - protein, 9 aa, Staphylococcus epidermidis
FDEENDTGA

SEQ ID NO: 1760627 - protein, 6 aa, Staphylococcus epidermidis
FDESTK

SEQ ID NO: 1760628 - protein, 4 aa, Staphylococcus epidermidis
FDKN

SEQ ID NO: 1760629 - protein, 12 aa, Staphylococcus epidermidis
FDMNGGEYPYNN

SEQ ID NO: 1760630 - protein, 4 aa, Staphylococcus epidermidis
FDNN

SEQ ID NO: 1760631 - protein, 10 aa, Staphylococcus epidermidis
FDPTDDGGQF

SEQ ID NO: 1760632 - protein, 11 aa, Staphylococcus epidermidis
FDTKHTHGTGC

SEQ ID NO: 1760633 - protein, 6 aa, Staphylococcus epidermidis
FEAGKG

SEQ ID NO: 1760634 - protein, 8 aa, Staphylococcus epidermidis
FEARKSPH

SEQ ID NO: 1760635 - protein, 7 aa, Staphylococcus epidermidis
FEDASQS

SEQ ID NO: 1760636 - protein, 15 aa, Staphylococcus epidermidis
FEESGAYTGETSPVA

SEQ ID NO: 1760637 - protein, 23 aa, Staphylococcus epidermidis
FEGDEQKVKSPDDRNADKNATVE

SEQ ID NO: 1760638 - protein, 10 aa, Staphylococcus epidermidis
FEGTQGKAKI

SEQ ID NO: 1760639 - protein, 17 aa, Staphylococcus epidermidis
FEKDEKDLSKYQQTTRK

SEQ ID NO: 1760640 - protein, 4 aa, Staphylococcus epidermidis
FEKE

SEQ ID NO: 1760641 - protein, 8 aa, Staphylococcus epidermidis
FEKPTEIQ

SEQ ID NO: 1760642 - protein, 8 aa, Staphylococcus epidermidis
FEKQEKEI

SEQ ID NO: 1760643 - protein, 8 aa, Staphylococcus epidermidis
FEKQQEEI

SEQ ID NO: 1760644 - protein, 8 aa, Staphylococcus epidermidis
FENSIPTH

SEQ ID NO: 1760645 - protein, 8 aa, Staphylococcus epidermidis
FEPGDEKK

SEQ ID NO: 1760646 - protein, 5 aa, Staphylococcus epidermidis
FESHE

SEQ ID NO: 1760647 - protein, 15 aa, Staphylococcus epidermidis
FESTIESAAEHRAPH

SEQ ID NO: 1760648 - protein, 17 aa, Staphylococcus epidermidis
FETGKKTDLQNDEVSDI

SEQ ID NO: 1760649 - protein, 11 aa, Staphylococcus epidermidis
FETYTSDNGRM

SEQ ID NO: 1760650 - protein, 6 aa, Staphylococcus epidermidis
FGDPEA

SEQ ID NO: 1760651 - protein, 13 aa, Staphylococcus epidermidis
FGGASEGSDYETV

SEQ ID NO: 1760652 - protein, 17 aa, Staphylococcus epidermidis
FGKPQKVITDQAPSTKV

SEQ ID NO: 1760653 - protein, 5 aa, Staphylococcus epidermidis
FGKTR

SEQ ID NO: 1760654 - protein, 9 aa, Staphylococcus epidermidis
FGNEPSDET

SEQ ID NO: 1760655 - protein, 7 aa, Staphylococcus epidermidis
FGNPSSI

SEQ ID NO: 1760656 - protein, 13 aa, Staphylococcus epidermidis
FGPGQDAAQIEGS

SEQ ID NO: 1760657 - protein, 7 aa, Staphylococcus epidermidis
FGRAASI

SEQ ID NO: 1760658 - protein, 12 aa, Staphylococcus epidermidis
FGSNNKPSEDTY

SEQ ID NO: 1760659 - protein, 9 aa, Staphylococcus epidermidis
FGTEDNDKM

SEQ ID NO: 1760660 - protein, 9 aa, Staphylococcus epidermidis
FGVEGKSVD

SEQ ID NO: 1760661 - protein, 9 aa, Staphylococcus epidermidis
FHPSSSHNT

SEQ ID NO: 1760662 - protein, 16 aa, Staphylococcus epidermidis
FIGSSEQRQKIKQQFP

SEQ ID NO: 1760663 - protein, 4 aa, Staphylococcus epidermidis
FIPT

SEQ ID NO: 1760664 - protein, 8 aa, Staphylococcus epidermidis
FKDDDEAF

SEQ ID NO: 1760665 - protein, 14 aa, Staphylococcus epidermidis
FKEEDVRKKAIENL

SEQ ID NO: 1760666 - protein, 9 aa, Staphylococcus epidermidis
FKEKEDQYQ

SEQ ID NO: 1760667 - protein, 10 aa, Staphylococcus epidermidis
FKETSRKQKQ

SEQ ID NO: 1760668 - protein, 6 aa, Staphylococcus epidermidis
FKGERL

SEQ ID NO: 1760669 - protein, 19 aa, Staphylococcus epidermidis
FKKDGSVTAGNASGINDGA

SEQ ID NO: 1760670 - protein, 11 aa, Staphylococcus epidermidis
FKNKLTSEDTV

SEQ ID NO: 1760671 - protein, 10 aa, Staphylococcus epidermidis
FKPDMQEIPS

SEQ ID NO: 1760672 - protein, 8 aa, Staphylococcus epidermidis
FKPKAGDK

SEQ ID NO: 1760673 - protein, 12 aa, Staphylococcus epidermidis
FKPSEDKSKEAY

SEQ ID NO: 1760674 - protein, 8 aa, Staphylococcus epidermidis
FKQGTPQD

SEQ ID NO: 1760675 - protein, 22 aa, Staphylococcus epidermidis
FKQPAQVQGKFSRQSGGRGQYG

SEQ ID NO: 1760676 - protein, 4 aa, Staphylococcus epidermidis
FKTQ

SEQ ID NO: 1760677 - protein, 11 aa, Staphylococcus epidermidis
FLEGPTKATET

SEQ ID NO: 1760678 - protein, 11 aa, Staphylococcus epidermidis
FNATTQSEALE

SEQ ID NO: 1760679 - protein, 8 aa, Staphylococcus epidermidis
FNDEITEE

SEQ ID NO: 1760680 - protein, 11 aa, Staphylococcus epidermidis
FNEPGTDFNSE

SEQ ID NO: 1760681 - protein, 9 aa, Staphylococcus epidermidis
FNETSRTSR

SEQ ID NO: 1760682 - protein, 9 aa, Staphylococcus epidermidis
FNEVAESAE

SEQ ID NO: 1760683 - protein, 13 aa, Staphylococcus epidermidis
FNKESEDPYDEDT

SEQ ID NO: 1760684 - protein, 4 aa, Staphylococcus epidermidis
FNNG

SEQ ID NO: 1760685 - protein, 4 aa, Staphylococcus epidermidis
FNNN

SEQ ID NO: 1760686 - protein, 8 aa, Staphylococcus epidermidis
FNNNPTTI

SEQ ID NO: 1760687 - protein, 14 aa, Staphylococcus epidermidis
FNNPTFTDEQNSKI

SEQ ID NO: 1760688 - protein, 8 aa, Staphylococcus epidermidis
FNPTQGYR

SEQ ID NO: 1760689 - protein, 6 aa, Staphylococcus epidermidis
FNQDGH

SEQ ID NO: 1760690 - protein, 12 aa, Staphylococcus epidermidis
FNQKGKRDRFKA

SEQ ID NO: 1760691 - protein, 5 aa, Staphylococcus epidermidis
FNQND

SEQ ID NO: 1760692 - protein, 4 aa, Staphylococcus epidermidis
FNQP

SEQ ID NO: 1760693 - protein, 7 aa, Staphylococcus epidermidis
FNQSEDE

SEQ ID NO: 1760694 - protein, 7 aa, Staphylococcus epidermidis
FNSDPAV

SEQ ID NO: 1760695 - protein, 8 aa, Staphylococcus epidermidis
FNSKEDPE

SEQ ID NO: 1760696 - protein, 7 aa, Staphylococcus epidermidis
FNSNQTI

SEQ ID NO: 1760697 - protein, 15 aa, Staphylococcus epidermidis
FPGSNKDGRRYSPFT

SEQ ID NO: 1760698 - protein, 12 aa, Staphylococcus epidermidis
FPGVGKASKKKM

SEQ ID NO: 1760699 - protein, 6 aa, Staphylococcus epidermidis
FPHNDE

SEQ ID NO: 1760700 - protein, 7 aa, Staphylococcus epidermidis
FPKPGET

SEQ ID NO: 1760701 - protein, 13 aa, Staphylococcus epidermidis
FPQYQPLGKPNPF

SEQ ID NO: 1760702 - protein, 12 aa, Staphylococcus epidermidis
FPTGSHERQDSS

SEQ ID NO: 1760703 - protein, 7 aa, Staphylococcus epidermidis
FQGSGRG

SEQ ID NO: 1760704 - protein, 11 aa, Staphylococcus epidermidis
FQKGNEKARER

SEQ ID NO: 1760705 - protein, 11 aa, Staphylococcus epidermidis
FQLESNDGQHH

SEQ ID NO: 1760706 - protein, 4 aa, Staphylococcus epidermidis
FQMT

SEQ ID NO: 1760707 - protein, 5 aa, Staphylococcus epidermidis
FQNEK

SEQ ID NO: 1760708 - protein, 24 aa, Staphylococcus epidermidis
FQNGGKRKNYYGEGEDALVMWVNL

SEQ ID NO: 1760709 - protein, 10 aa, Staphylococcus epidermidis
FQNGRQRLED

SEQ ID NO: 1760710 - protein, 14 aa, Staphylococcus epidermidis
FQPKENLAEVLDKH

SEQ ID NO: 1760711 - protein, 7 aa, Staphylococcus epidermidis
FRPGQEE

SEQ ID NO: 1760712 - protein, 4 aa, Staphylococcus epidermidis
FRPS

SEQ ID NO: 1760713 - protein, 5 aa, Staphylococcus epidermidis
FRPSY

SEQ ID NO: 1760714 - protein, 12 aa, Staphylococcus epidermidis
FRSGGTKPAPVT

SEQ ID NO: 1760715 - protein, 9 aa, Staphylococcus epidermidis
FSAELGPKG

SEQ ID NO: 1760716 - protein, 10 aa, Staphylococcus epidermidis
FSANDPKSDL

SEQ ID NO: 1760717 - protein, 15 aa, Staphylococcus epidermidis
FSHPGSPNGEFTKET

SEQ ID NO: 1760718 - protein, 9 aa, Staphylococcus epidermidis
FSNPDDQGA

SEQ ID NO: 1760719 - protein, 8 aa, Staphylococcus epidermidis
FSNPFTAS

SEQ ID NO: 1760720 - protein, 16 aa, Staphylococcus epidermidis
FSPDHLRGDEEGRYGT

SEQ ID NO: 1760721 - protein, 12 aa, Staphylococcus epidermidis
FSPEYVAQYLTQ

SEQ ID NO: 1760722 - protein, 5 aa, Staphylococcus epidermidis
FSSSS

SEQ ID NO: 1760723 - protein, 4 aa, Staphylococcus epidermidis
FSTE

SEQ ID NO: 1760724 - protein, 9 aa, Staphylococcus epidermidis
FTASAGPGL

SEQ ID NO: 1760725 - protein, 9 aa, Staphylococcus epidermidis
FTDNKDNIQ

SEQ ID NO: 1760726 - protein, 6 aa, Staphylococcus epidermidis
FTKEGT

SEQ ID NO: 1760727 - protein, 7 aa, Staphylococcus epidermidis
FTSANKL

SEQ ID NO: 1760728 - protein, 5 aa, Staphylococcus epidermidis
FTTNE

SEQ ID NO: 1760729 - protein, 7 aa, Staphylococcus epidermidis
FTTNPSL

SEQ ID NO: 1760730 - protein, 9 aa, Staphylococcus epidermidis
FYATPRKPA

SEQ ID NO: 1760731 - protein, 5 aa, Staphylococcus epidermidis
FYPNG

SEQ ID NO: 1760732 - protein, 7 aa, Staphylococcus epidermidis
GAAGQAI

SEQ ID NO: 1760733 - protein, 8 aa, Staphylococcus epidermidis
GAANEGNF

SEQ ID NO: 1760734 - protein, 9 aa, Staphylococcus epidermidis
GADEQNQKQ

SEQ ID NO: 1760735 - protein, 7 aa, Staphylococcus epidermidis
GADEVDS

SEQ ID NO: 1760736 - protein, 10 aa, Staphylococcus epidermidis
GAEADEPPIS

SEQ ID NO: 1760737 - protein, 9 aa, Staphylococcus epidermidis
GAENDPETI

SEQ ID NO: 1760738 - protein, 12 aa, Staphylococcus epidermidis
GAESVKDTLGNQ

SEQ ID NO: 1760739 - protein, 7 aa, Staphylococcus epidermidis
GAFGGKK

SEQ ID NO: 1760740 - protein, 5 aa, Staphylococcus epidermidis
GAGAA

SEQ ID NO: 1760741 - protein, 13 aa, Staphylococcus epidermidis
GAGASAAAQHSQS

SEQ ID NO: 1760742 - protein, 12 aa, Staphylococcus epidermidis
GAGGLPVGTGGK

SEQ ID NO: 1760743 - protein, 7 aa, Staphylococcus epidermidis
GAGKTSV

SEQ ID NO: 1760744 - protein, 7 aa, Staphylococcus epidermidis
GAGVDKG

SEQ ID NO: 1760745 - protein, 6 aa, Staphylococcus epidermidis
GAHAGK

SEQ ID NO: 1760746 - protein, 11 aa, Staphylococcus epidermidis
GAITSNASNDV

SEQ ID NO: 1760747 - protein, 6 aa, Staphylococcus epidermidis
GAIYSG

SEQ ID NO: 1760748 - protein, 8 aa, Staphylococcus epidermidis
GAKAPNLV

SEQ ID NO: 1760749 - protein, 6 aa, Staphylococcus epidermidis
GAMAKH

SEQ ID NO: 1760750 - protein, 15 aa, Staphylococcus epidermidis
GANETRSYLASGTSR

SEQ ID NO: 1760751 - protein, 9 aa, Staphylococcus epidermidis
GANGSTSSL

SEQ ID NO: 1760752 - protein, 5 aa, Staphylococcus epidermidis
GANPN

SEQ ID NO: 1760753 - protein, 9 aa, Staphylococcus epidermidis
GANSNVTYG

SEQ ID NO: 1760754 - protein, 6 aa, Staphylococcus epidermidis
GAPKNE

SEQ ID NO: 1760755 - protein, 5 aa, Staphylococcus epidermidis
GAPTQ

SEQ ID NO: 1760756 - protein, 12 aa, Staphylococcus epidermidis
GAPTRAVEQEGK

SEQ ID NO: 1760757 - protein, 4 aa, Staphylococcus epidermidis
GAPY

SEQ ID NO: 1760758 - protein, 19 aa, Staphylococcus epidermidis
GAQALPELTPDGDVVAPSA

SEQ ID NO: 1760759 - protein, 5 aa, Staphylococcus epidermidis
GAQHP

SEQ ID NO: 1760760 - protein, 5 aa, Staphylococcus epidermidis
GAQLG

SEQ ID NO: 1760761 - protein, 8 aa, Staphylococcus epidermidis
GASGQHSS

SEQ ID NO: 1760762 - protein, 7 aa, Staphylococcus epidermidis
GASGVAP

SEQ ID NO: 1760763 - protein, 9 aa, Staphylococcus epidermidis
GASPGASTA

SEQ ID NO: 1760764 - protein, 8 aa, Staphylococcus epidermidis
GASRGKAF

SEQ ID NO: 1760765 - protein, 9 aa, Staphylococcus epidermidis
GATDETVTK

SEQ ID NO: 1760766 - protein, 7 aa, Staphylococcus epidermidis
GATGGVG

SEQ ID NO: 1760767 - protein, 8 aa, Staphylococcus epidermidis
GATVTSEG

SEQ ID NO: 1760768 - protein, 4 aa, Staphylococcus epidermidis
GCGE

SEQ ID NO: 1760769 - protein, 9 aa, Staphylococcus epidermidis
GCGSSREHA

SEQ ID NO: 1760770 - protein, 16 aa, Staphylococcus epidermidis
GCTNNNEIKKDSEDYY

SEQ ID NO: 1760771 - protein, 34 aa, Staphylococcus epidermidis
GDDDADEDDDIPAQTDDQETLDESDNDEDDVEMN

SEQ ID NO: 1760772 - protein, 10 aa, Staphylococcus epidermidis
GDDHVSNTPK

SEQ ID NO: 1760773 - protein, 6 aa, Staphylococcus epidermidis
GDDIKI

SEQ ID NO: 1760774 - protein, 6 aa, Staphylococcus epidermidis
GDDNKQ

SEQ ID NO: 1760775 - protein, 8 aa, Staphylococcus epidermidis
GDEKINSA

SEQ ID NO: 1760776 - protein, 9 aa, Staphylococcus epidermidis
GDEQSIEQS

SEQ ID NO: 1760777 - protein, 8 aa, Staphylococcus epidermidis
GDESFPIE

SEQ ID NO: 1760778 - protein, 14 aa, Staphylococcus epidermidis
GDESKLGKKVGSDI

SEQ ID NO: 1760779 - protein, 10 aa, Staphylococcus epidermidis
GDFETTANGY

SEQ ID NO: 1760780 - protein, 4 aa, Staphylococcus epidermidis
GDGG

SEQ ID NO: 1760781 - protein, 13 aa, Staphylococcus epidermidis
GDGSRTTENRGAI

SEQ ID NO: 1760782 - protein, 4 aa, Staphylococcus epidermidis
GDIR

SEQ ID NO: 1760783 - protein, 16 aa, Staphylococcus epidermidis
GDITIEGQSITKARGK

SEQ ID NO: 1760784 - protein, 9 aa, Staphylococcus epidermidis
GDKTEDGKS

SEQ ID NO: 1760785 - protein, 8 aa, Staphylococcus epidermidis
GDNVDKGE

SEQ ID NO: 1760786 - protein, 5 aa, Staphylococcus epidermidis
GDPEL

SEQ ID NO: 1760787 - protein, 20 aa, Staphylococcus epidermidis
GDPFDEDTKMSAQTGPEQLD

SEQ ID NO: 1760788 - protein, 7 aa, Staphylococcus epidermidis
GDPITER

SEQ ID NO: 1760789 - protein, 5 aa, Staphylococcus epidermidis
GDPTW

SEQ ID NO: 1760790 - protein, 13 aa, Staphylococcus epidermidis
GDRMGQGKENVKN

SEQ ID NO: 1760791 - protein, 8 aa, Staphylococcus epidermidis
GDSTQAAK

SEQ ID NO: 1760792 - protein, 23 aa, Staphylococcus epidermidis
GDSVTTDHISPAGAIGKDTPAGK

SEQ ID NO: 1760793 - protein, 17 aa, Staphylococcus epidermidis
GDTSDNIPGVAGVGEKT

SEQ ID NO: 1760794 - protein, 4 aa, Staphylococcus epidermidis
GDVT

SEQ ID NO: 1760795 - protein, 8 aa, Staphylococcus epidermidis
GDYKGKSN

SEQ ID NO: 1760796 - protein, 10 aa, Staphylococcus epidermidis
GEAARRIGEG

SEQ ID NO: 1760797 - protein, 7 aa, Staphylococcus epidermidis
GEAYGYA

SEQ ID NO: 1760798 - protein, 9 aa, Staphylococcus epidermidis
GEDADNSIT

SEQ ID NO: 1760799 - protein, 15 aa, Staphylococcus epidermidis
GEDEIGDKDNDKVKA

SEQ ID NO: 1760800 - protein, 4 aa, Staphylococcus epidermidis
GEDI

SEQ ID NO: 1760801 - protein, 11 aa, Staphylococcus epidermidis
GEEAYEPQFGA

SEQ ID NO: 1760802 - protein, 5 aa, Staphylococcus epidermidis
GEEEP

SEQ ID NO: 1760803 - protein, 19 aa, Staphylococcus epidermidis
GEEGLDRPIKNTDISRPGL

SEQ ID NO: 1760804 - protein, 11 aa, Staphylococcus epidermidis
GEEGPGTPGSV

SEQ ID NO: 1760805 - protein, 8 aa, Staphylococcus epidermidis
GEEPLDNT

SEQ ID NO: 1760806 - protein, 11 aa, Staphylococcus epidermidis
GEEQSKKSSYD

SEQ ID NO: 1760807 - protein, 11 aa, Staphylococcus epidermidis
GEESQTDYQKR

SEQ ID NO: 1760808 - protein, 4 aa, Staphylococcus epidermidis
GEFG

SEQ ID NO: 1760809 - protein, 28 aa, Staphylococcus epidermidis
GEGDKAFCSGGDQKKRGHGGYVGEDDIP

SEQ ID NO: 1760810 - protein, 10 aa, Staphylococcus epidermidis
GEGKKMSKSL

SEQ ID NO: 1760811 - protein, 11 aa, Staphylococcus epidermidis
GEGNITVNERD

SEQ ID NO: 1760812 - protein, 6 aa, Staphylococcus epidermidis
GEGSKI

SEQ ID NO: 1760813 - protein, 6 aa, Staphylococcus epidermidis
GEGTFD

SEQ ID NO: 1760814 - protein, 5 aa, Staphylococcus epidermidis
GEIEK

SEQ ID NO: 1760815 - protein, 8 aa, Staphylococcus epidermidis
GEINGRPK

SEQ ID NO: 1760816 - protein, 5 aa, Staphylococcus epidermidis
GEISA

SEQ ID NO: 1760817 - protein, 6 aa, Staphylococcus epidermidis
GEISYD

SEQ ID NO: 1760818 - protein, 8 aa, Staphylococcus epidermidis
GEITGNAG

SEQ ID NO: 1760819 - protein, 18 aa, Staphylococcus epidermidis
GEKHGGASKTSGAGGGDC

SEQ ID NO: 1760820 - protein, 10 aa, Staphylococcus epidermidis
GEKITEYPAN

SEQ ID NO: 1760821 - protein, 18 aa, Staphylococcus epidermidis
GEKKKKDTEEDNTIKAEL

SEQ ID NO: 1760822 - protein, 11 aa, Staphylococcus epidermidis
GEKQQLEAGTS

SEQ ID NO: 1760823 - protein, 5 aa, Staphylococcus epidermidis
GEKSH

SEQ ID NO: 1760824 - protein, 13 aa, Staphylococcus epidermidis
GELTNGSKLPSNL

SEQ ID NO: 1760825 - protein, 9 aa, Staphylococcus epidermidis
GENAGQNPD

SEQ ID NO: 1760826 - protein, 8 aa, Staphylococcus epidermidis
GENNRNQT

SEQ ID NO: 1760827 - protein, 4 aa, Staphylococcus epidermidis
GENS

SEQ ID NO: 1760828 - protein, 5 aa, Staphylococcus epidermidis
GENTF

SEQ ID NO: 1760829 - protein, 7 aa, Staphylococcus epidermidis
GEPDPKL

SEQ ID NO: 1760830 - protein, 20 aa, Staphylococcus epidermidis
GEPKYDLEESKNRDATYAAP

SEQ ID NO: 1760831 - protein, 6 aa, Staphylococcus epidermidis
GEPLDF

SEQ ID NO: 1760832 - protein, 10 aa, Staphylococcus epidermidis
GEPPHNGTQK

SEQ ID NO: 1760833 - protein, 15 aa, Staphylococcus epidermidis
GEPSDEENGSPKPRL

SEQ ID NO: 1760834 - protein, 12 aa, Staphylococcus epidermidis
GERDLTKTPEMG

SEQ ID NO: 1760835 - protein, 11 aa, Staphylococcus epidermidis
GERFDTKPRGL

SEQ ID NO: 1760836 - protein, 7 aa, Staphylococcus epidermidis
GERLSGR

SEQ ID NO: 1760837 - protein, 13 aa, Staphylococcus epidermidis
GESGCGKSTTGKA

SEQ ID NO: 1760838 - protein, 10 aa, Staphylococcus epidermidis
GESGSGKSIT

SEQ ID NO: 1760839 - protein, 13 aa, Staphylococcus epidermidis
GESGSGKSVTTKA

SEQ ID NO: 1760840 - protein, 4 aa, Staphylococcus epidermidis
GESK

SEQ ID NO: 1760841 - protein, 6 aa, Staphylococcus epidermidis
GESNED

SEQ ID NO: 1760842 - protein, 9 aa, Staphylococcus epidermidis
GESTLEDIA

SEQ ID NO: 1760843 - protein, 9 aa, Staphylococcus epidermidis
GESTTPSIK

SEQ ID NO: 1760844 - protein, 13 aa, Staphylococcus epidermidis
GETAAGQYPEEAV

SEQ ID NO: 1760845 - protein, 5 aa, Staphylococcus epidermidis
GETFP

SEQ ID NO: 1760846 - protein, 7 aa, Staphylococcus epidermidis
GETGASL

SEQ ID NO: 1760847 - protein, 6 aa, Staphylococcus epidermidis
GETHQL

SEQ ID NO: 1760848 - protein, 5 aa, Staphylococcus epidermidis
GETRN

SEQ ID NO: 1760849 - protein, 7 aa, Staphylococcus epidermidis
GEVAGGI

SEQ ID NO: 1760850 - protein, 13 aa, Staphylococcus epidermidis
GEYKDLREQSAKE

SEQ ID NO: 1760851 - protein, 5 aa, Staphylococcus epidermidis
GFDKE

SEQ ID NO: 1760852 - protein, 5 aa, Staphylococcus epidermidis
GFENN

SEQ ID NO: 1760853 - protein, 7 aa, Staphylococcus epidermidis
GFGGGYN

SEQ ID NO: 1760854 - protein, 6 aa, Staphylococcus epidermidis
GFGPNG

SEQ ID NO: 1760855 - protein, 6 aa, Staphylococcus epidermidis
GFNKSG

SEQ ID NO: 1760856 - protein, 13 aa, Staphylococcus epidermidis
GFSPEDRSENIRR

SEQ ID NO: 1760857 - protein, 5 aa, Staphylococcus epidermidis
GFTDS

SEQ ID NO: 1760858 - protein, 10 aa, Staphylococcus epidermidis
GFYKNKAKAI

SEQ ID NO: 1760859 - protein, 10 aa, Staphylococcus epidermidis
GGAVAKRARA

SEQ ID NO: 1760860 - protein, 7 aa, Staphylococcus epidermidis
GGDISRK

SEQ ID NO: 1760861 - protein, 9 aa, Staphylococcus epidermidis
GGDNLAATF

SEQ ID NO: 1760862 - protein, 6 aa, Staphylococcus epidermidis
GGEAQR

SEQ ID NO: 1760863 - protein, 6 aa, Staphylococcus epidermidis
GGEGGM

SEQ ID NO: 1760864 - protein, 10 aa, Staphylococcus epidermidis
GGEYGIPHGR

SEQ ID NO: 1760865 - protein, 6 aa, Staphylococcus epidermidis
GGFGAN

SEQ ID NO: 1760866 - protein, 10 aa, Staphylococcus epidermidis
GGFKDGSFEK

SEQ ID NO: 1760867 - protein, 5 aa, Staphylococcus epidermidis
GGGGI

SEQ ID NO: 1760868 - protein, 8 aa, Staphylococcus epidermidis
GGGIIEDT

SEQ ID NO: 1760869 - protein, 6 aa, Staphylococcus epidermidis
GGGQAE

SEQ ID NO: 1760870 - protein, 8 aa, Staphylococcus epidermidis
GGGVHTPE

SEQ ID NO: 1760871 - protein, 15 aa, Staphylococcus epidermidis
GGHITGPEDPNIQKI

SEQ ID NO: 1760872 - protein, 8 aa, Staphylococcus epidermidis
GGHQAGEI

SEQ ID NO: 1760873 - protein, 9 aa, Staphylococcus epidermidis
GGIEPATTE

SEQ ID NO: 1760874 - protein, 14 aa, Staphylococcus epidermidis
GGINDQTSKRCVEQ

SEQ ID NO: 1760875 - protein, 5 aa, Staphylococcus epidermidis
GGIQN

SEQ ID NO: 1760876 - protein, 9 aa, Staphylococcus epidermidis
GGKALDTGK

SEQ ID NO: 1760877 - protein, 20 aa, Staphylococcus epidermidis
GGKESAERISKAYKRLNKKI

SEQ ID NO: 1760878 - protein, 9 aa, Staphylococcus epidermidis
GGKGSQQAI

SEQ ID NO: 1760879 - protein, 6 aa, Staphylococcus epidermidis
GGKKLT

SEQ ID NO: 1760880 - protein, 5 aa, Staphylococcus epidermidis
GGKLT

SEQ ID NO: 1760881 - protein, 7 aa, Staphylococcus epidermidis
GGKTINM

SEQ ID NO: 1760882 - protein, 17 aa, Staphylococcus epidermidis
GGKTKKNKLHIHYQTLF

SEQ ID NO: 1760883 - protein, 4 aa, Staphylococcus epidermidis
GGLA

SEQ ID NO: 1760884 - protein, 6 aa, Staphylococcus epidermidis
GGNNFE

SEQ ID NO: 1760885 - protein, 9 aa, Staphylococcus epidermidis
GGNSSKEDL

SEQ ID NO: 1760886 - protein, 7 aa, Staphylococcus epidermidis
GGNSSML

SEQ ID NO: 1760887 - protein, 10 aa, Staphylococcus epidermidis
GGPGKPEGLD

SEQ ID NO: 1760888 - protein, 14 aa, Staphylococcus epidermidis
GGPKWTDPNNRPEH

SEQ ID NO: 1760889 - protein, 7 aa, Staphylococcus epidermidis
GGQMAKT

SEQ ID NO: 1760890 - protein, 26 aa, Staphylococcus epidermidis
GGQPQSAIPTFGQNTPLGRAGQPVEC

SEQ ID NO: 1760891 - protein, 6 aa, Staphylococcus epidermidis
GGQQQR

SEQ ID NO: 1760892 - protein, 6 aa, Staphylococcus epidermidis
GGRTKS

SEQ ID NO: 1760893 - protein, 7 aa, Staphylococcus epidermidis
GGSAMDA

SEQ ID NO: 1760894 - protein, 6 aa, Staphylococcus epidermidis
GGSHGL

SEQ ID NO: 1760895 - protein, 7 aa, Staphylococcus epidermidis
GGSLAGS

SEQ ID NO: 1760896 - protein, 5 aa, Staphylococcus epidermidis
GGSRI

SEQ ID NO: 1760897 - protein, 17 aa, Staphylococcus epidermidis
GGSRQRDPNAPRKGDDL

SEQ ID NO: 1760898 - protein, 4 aa, Staphylococcus epidermidis
GGTE

SEQ ID NO: 1760899 - protein, 7 aa, Staphylococcus epidermidis
GGTFGKF

SEQ ID NO: 1760900 - protein, 6 aa, Staphylococcus epidermidis
GGTPLS

SEQ ID NO: 1760901 - protein, 4 aa, Staphylococcus epidermidis
GGVS

SEQ ID NO: 1760902 - protein, 4 aa, Staphylococcus epidermidis
GHGG

SEQ ID NO: 1760903 - protein, 4 aa, Staphylococcus epidermidis
GHHD

SEQ ID NO: 1760904 - protein, 9 aa, Staphylococcus epidermidis
GHLGESAET

SEQ ID NO: 1760905 - protein, 6 aa, Staphylococcus epidermidis
GHNGNL

SEQ ID NO: 1760906 - protein, 5 aa, Staphylococcus epidermidis
GHSLG

SEQ ID NO: 1760907 - protein, 4 aa, Staphylococcus epidermidis
GHSN

SEQ ID NO: 1760908 - protein, 8 aa, Staphylococcus epidermidis
GHSNGKQL

SEQ ID NO: 1760909 - protein, 5 aa, Staphylococcus epidermidis
GHTTI

SEQ ID NO: 1760910 - protein, 7 aa, Staphylococcus epidermidis
GIDPDKS

SEQ ID NO: 1760911 - protein, 13 aa, Staphylococcus epidermidis
GIDPKTIPVDDKE

SEQ ID NO: 1760912 - protein, 6 aa, Staphylococcus epidermidis
GIDSTH

SEQ ID NO: 1760913 - protein, 4 aa, Staphylococcus epidermidis
GIGT

SEQ ID NO: 1760914 - protein, 5 aa, Staphylococcus epidermidis
GIKTG

SEQ ID NO: 1760915 - protein, 5 aa, Staphylococcus epidermidis
GINDE

SEQ ID NO: 1760916 - protein, 7 aa, Staphylococcus epidermidis
GINPKSQ

SEQ ID NO: 1760917 - protein, 4 aa, Staphylococcus epidermidis
GIPY

SEQ ID NO: 1760918 - protein, 6 aa, Staphylococcus epidermidis
GIQNPS

SEQ ID NO: 1760919 - protein, 4 aa, Staphylococcus epidermidis
GIRH

SEQ ID NO: 1760920 - protein, 23 aa, Staphylococcus epidermidis
GIRVEQKDKEHEDYYEIKIKIYK

SEQ ID NO: 1760921 - protein, 8 aa, Staphylococcus epidermidis
GISAPTDV

SEQ ID NO: 1760922 - protein, 4 aa, Staphylococcus epidermidis
GISN

SEQ ID NO: 1760923 - protein, 12 aa, Staphylococcus epidermidis
GISNAANKVPGV

SEQ ID NO: 1760924 - protein, 18 aa, Staphylococcus epidermidis
GITTIDTTKQSYETTETL

SEQ ID NO: 1760925 - protein, 11 aa, Staphylococcus epidermidis
GKAEVGAPPMS

SEQ ID NO: 1760926 - protein, 16 aa, Staphylococcus epidermidis
GKDQQRVGGVGTGGGM

SEQ ID NO: 1760927 - protein, 4 aa, Staphylococcus epidermidis
GKDY

SEQ ID NO: 1760928 - protein, 7 aa, Staphylococcus epidermidis
GKEFDPN

SEQ ID NO: 1760929 - protein, 7 aa, Staphylococcus epidermidis
GKEGEPQ

SEQ ID NO: 1760930 - protein, 9 aa, Staphylococcus epidermidis
GKEHANRYP

SEQ ID NO: 1760931 - protein, 12 aa, Staphylococcus epidermidis
GKELPGIKAIND

SEQ ID NO: 1760932 - protein, 17 aa, Staphylococcus epidermidis
GKERKSIDQIDQFLSQH

SEQ ID NO: 1760933 - protein, 9 aa, Staphylococcus epidermidis
GKEYTHDSR

SEQ ID NO: 1760934 - protein, 8 aa, Staphylococcus epidermidis
GKFNHGDK

SEQ ID NO: 1760935 - protein, 15 aa, Staphylococcus epidermidis
GKGAHAAKPEQGNDP

SEQ ID NO: 1760936 - protein, 5 aa, Staphylococcus epidermidis
GKGFS

SEQ ID NO: 1760937 - protein, 13 aa, Staphylococcus epidermidis
GKGGGKKLSDELE

SEQ ID NO: 1760938 - protein, 17 aa, Staphylococcus epidermidis
GKGGKKLKEVGKRARRD

SEQ ID NO: 1760939 - protein, 6 aa, Staphylococcus epidermidis
GKGHMN

SEQ ID NO: 1760940 - protein, 9 aa, Staphylococcus epidermidis
GKGIQAKQV

SEQ ID NO: 1760941 - protein, 8 aa, Staphylococcus epidermidis
GKGKPGVL

SEQ ID NO: 1760942 - protein, 6 aa, Staphylococcus epidermidis
GKGPIN

SEQ ID NO: 1760943 - protein, 8 aa, Staphylococcus epidermidis
GKGQVGRV

SEQ ID NO: 1760944 - protein, 11 aa, Staphylococcus epidermidis
GKGSEKPKTIE

SEQ ID NO: 1760945 - protein, 9 aa, Staphylococcus epidermidis
GKGSNHGPR

SEQ ID NO: 1760946 - protein, 5 aa, Staphylococcus epidermidis
GKHAF

SEQ ID NO: 1760947 - protein, 8 aa, Staphylococcus epidermidis
GKHGEKVT

SEQ ID NO: 1760948 - protein, 10 aa, Staphylococcus epidermidis
GKIADTPNEA

SEQ ID NO: 1760949 - protein, 4 aa, Staphylococcus epidermidis
GKIN

SEQ ID NO: 1760950 - protein, 11 aa, Staphylococcus epidermidis
GKITGAGTDTI

SEQ ID NO: 1760951 - protein, 7 aa, Staphylococcus epidermidis
GKKDAQQ

SEQ ID NO: 1760952 - protein, 5 aa, Staphylococcus epidermidis
GKKKV

SEQ ID NO: 1760953 - protein, 8 aa, Staphylococcus epidermidis
GKKRIEVP

SEQ ID NO: 1760954 - protein, 13 aa, Staphylococcus epidermidis
GKKTFEKLKEHFT

SEQ ID NO: 1760955 - protein, 37 aa, Staphylococcus epidermidis; identical to SEQ ID NO: 1602155

SEQ ID NO: 1760956 - protein, 12 aa, Staphylococcus epidermidis
GKLTCGKPGQEI

SEQ ID NO: 1760957 - protein, 6 aa, Staphylococcus epidermidis
GKNDYK

SEQ ID NO: 1760958 - protein, 9 aa, Staphylococcus epidermidis
GKNGAGKTS

SEQ ID NO: 1760959 - protein, 4 aa, Staphylococcus epidermidis
GKNI

SEQ ID NO: 1760960 - protein, 5 aa, Staphylococcus epidermidis
GKNLY

SEQ ID NO: 1760961 - protein, 7 aa, Staphylococcus epidermidis
GKNQVNS

SEQ ID NO: 1760962 - protein, 8 aa, Staphylococcus epidermidis
GKNSAVDA

SEQ ID NO: 1760963 - protein, 10 aa, Staphylococcus epidermidis
GKPHKKDYRK

SEQ ID NO: 1760964 - protein, 4 aa, Staphylococcus epidermidis
GKPI

SEQ ID NO: 1760965 - protein, 14 aa, Staphylococcus epidermidis
GKPLFTSEDKFESN

SEQ ID NO: 1760966 - protein, 16 aa, Staphylococcus epidermidis
GKPQKVITDQAPSTKV

SEQ ID NO: 1760967 - protein, 5 aa, Staphylococcus epidermidis
GKPYA

SEQ ID NO: 1760968 - protein, 7 aa, Staphylococcus epidermidis
GKQTVKT

SEQ ID NO: 1760969 - protein, 16 aa, Staphylococcus epidermidis
GKRDDINSGGKQMPSH

SEQ ID NO: 1760970 - protein, 9 aa, Staphylococcus epidermidis
GKSKNKIIN

SEQ ID NO: 1760971 - protein, 9 aa, Staphylococcus epidermidis
GKTDGAMDA

SEQ ID NO: 1760972 - protein, 9 aa, Staphylococcus epidermidis
GKTLNNDEN

SEQ ID NO: 1760973 - protein, 8 aa, Staphylococcus epidermidis
GKTLSELA

SEQ ID NO: 1760974 - protein, 10 aa, Staphylococcus epidermidis
GKTPQSSYKK

SEQ ID NO: 1760975 - protein, 20 aa, Staphylococcus epidermidis
GKVERANEREYGKATINAKS

SEQ ID NO: 1760976 - protein, 9 aa, Staphylococcus epidermidis
GKVYTNPIA

SEQ ID NO: 1760977 - protein, 21 aa, Staphylococcus epidermidis
GKYDENQTFEDHRAERPDFQP

SEQ ID NO: 1760978 - protein, 7 aa, Staphylococcus epidermidis
GKYNSQK

SEQ ID NO: 1760979 - protein, 9 aa, Staphylococcus epidermidis
GLAEEKNGV

SEQ ID NO: 1760980 - protein, 4 aa, Staphylococcus epidermidis
GLDE

SEQ ID NO: 1760981 - protein, 7 aa, Staphylococcus epidermidis
GLDPDQY

SEQ ID NO: 1760982 - protein, 10 aa, Staphylococcus epidermidis
GLDPEKRFNV

SEQ ID NO: 1760983 - protein, 14 aa, Staphylococcus epidermidis
GLGDKARYATEARI

SEQ ID NO: 1760984 - protein, 12 aa, Staphylococcus epidermidis
GLGPTKDDLTKH

SEQ ID NO: 1760985 - protein, 5 aa, Staphylococcus epidermidis
GLHPE

SEQ ID NO: 1760986 - protein, 9 aa, Staphylococcus epidermidis
GLNEEDSYR

SEQ ID NO: 1760987 - protein, 15 aa, Staphylococcus epidermidis
GLNKDDARKKWGEDQ

SEQ ID NO: 1760988 - protein, 10 aa, Staphylococcus epidermidis
GLQECGNSQN

SEQ ID NO: 1760989 - protein, 15 aa, Staphylococcus epidermidis
GLRKRNTKKVKKNGV

SEQ ID NO: 1760990 - protein, 6 aa, Staphylococcus epidermidis
GLRTPL

SEQ ID NO: 1760991 - protein, 5 aa, Staphylococcus epidermidis
GLSKA

SEQ ID NO: 1760992 - protein, 10 aa, Staphylococcus epidermidis
GLSNNTIGAY

SEQ ID NO: 1760993 - protein, 7 aa, Staphylococcus epidermidis
GMDENDW

SEQ ID NO: 1760994 - protein, 10 aa, Staphylococcus epidermidis
GMEITNEGTE

SEQ ID NO: 1760995 - protein, 18 aa, Staphylococcus epidermidis
GMGYTGSENLKKLREEAQ

SEQ ID NO: 1760996 - protein, 9 aa, Staphylococcus epidermidis
GMKTGDEKD

SEQ ID NO: 1760997 - protein, 14 aa, Staphylococcus epidermidis
GMNAWGDEGTVIDN

SEQ ID NO: 1760998 - protein, 4 aa, Staphylococcus epidermidis
GMST

SEQ ID NO: 1760999 - protein, 6 aa, Staphylococcus epidermidis
GNAKDE

SEQ ID NO: 1761000 - protein, 5 aa, Staphylococcus epidermidis
GNAPE

SEQ ID NO: 1761001 - protein, 9 aa, Staphylococcus epidermidis
GNASDELKK

SEQ ID NO: 1761002 - protein, 7 aa, Staphylococcus epidermidis
GNAYSTL

SEQ ID NO: 1761003 - protein, 7 aa, Staphylococcus epidermidis
GNDLDEI

SEQ ID NO: 1761004 - protein, 6 aa, Staphylococcus epidermidis
GNDTAM

SEQ ID NO: 1761005 - protein, 12 aa, Staphylococcus epidermidis
GNEVTRKEQNGK

SEQ ID NO: 1761006 - protein, 14 aa, Staphylococcus epidermidis
GNFNENHGRKEIQS

SEQ ID NO: 1761007 - protein, 12 aa, Staphylococcus epidermidis
GNGFDQDTEMGP

SEQ ID NO: 1761008 - protein, 10 aa, Staphylococcus epidermidis
GNGLSSKEIA

SEQ ID NO: 1761009 - protein, 7 aa, Staphylococcus epidermidis
GNGPHQI

SEQ ID NO: 1761010 - protein, 7 aa, Staphylococcus epidermidis
GNGRNNV

SEQ ID NO: 1761011 - protein, 11 aa, Staphylococcus epidermidis
GNGSGRFTKAH

SEQ ID NO: 1761012 - protein, 7 aa, Staphylococcus epidermidis
GNGVESL

SEQ ID NO: 1761013 - protein, 8 aa, Staphylococcus epidermidis
GNITKTQA

SEQ ID NO: 1761014 - protein, 8 aa, Staphylococcus epidermidis
GNKDNGSD

SEQ ID NO: 1761015 - protein, 13 aa, Staphylococcus epidermidis
GNKSITSHSGSTD

SEQ ID NO: 1761016 - protein, 6 aa, Staphylococcus epidermidis
GNPIGT

SEQ ID NO: 1761017 - protein, 8 aa, Staphylococcus epidermidis
GNQSNSIY

SEQ ID NO: 1761018 - protein, 8 aa, Staphylococcus epidermidis
GNRLGGNA

SEQ ID NO: 1761019 - protein, 8 aa, Staphylococcus epidermidis
GNRLTDDG

SEQ ID NO: 1761020 - protein, 17 aa, Staphylococcus epidermidis
GNRNYNVPKKEGSATRL

SEQ ID NO: 1761021 - protein, 5 aa, Staphylococcus epidermidis
GNSKN

SEQ ID NO: 1761022 - protein, 15 aa, Staphylococcus epidermidis
GNVGPDSIINNGDNG

SEQ ID NO: 1761023 - protein, 7 aa, Staphylococcus epidermidis
GNVKQAK

SEQ ID NO: 1761024 - protein, 5 aa, Staphylococcus epidermidis
GNYPS

SEQ ID NO: 1761025 - protein, 11 aa, Staphylococcus epidermidis
GPEGGEGGGTI

SEQ ID NO: 1761026 - protein, 4 aa, Staphylococcus epidermidis
GPEP

SEQ ID NO: 1761027 - protein, 9 aa, Staphylococcus epidermidis
GPESLGVTE

SEQ ID NO: 1761028 - protein, 5 aa, Staphylococcus epidermidis
GPFEN

SEQ ID NO: 1761029 - protein, 21 aa, Staphylococcus epidermidis
GPGAGNHGGEVVSSGTPNKVM

SEQ ID NO: 1761030 - protein, 7 aa, Staphylococcus epidermidis
GPGMGSL

SEQ ID NO: 1761031 - protein, 10 aa, Staphylococcus epidermidis
GPGPGLDGGK

SEQ ID NO: 1761032 - protein, 13 aa, Staphylococcus epidermidis
GPGSGKNGGEITF

SEQ ID NO: 1761033 - protein, 14 aa, Staphylococcus epidermidis
GPHRKEEKERDIGA

SEQ ID NO: 1761034 - protein, 25 aa, Staphylococcus epidermidis
GPHTTPQSPQGKPVSMQAGASKEGI

SEQ ID NO: 1761035 - protein, 13 aa, Staphylococcus epidermidis
GPKLEKGKIGAHG

SEQ ID NO: 1761036 - protein, 9 aa, Staphylococcus epidermidis
GPNGAGKTT

SEQ ID NO: 1761037 - protein, 9 aa, Staphylococcus epidermidis
GPNIGGGQI

SEQ ID NO: 1761038 - protein, 9 aa, Staphylococcus epidermidis
GPPKEMQPM

SEQ ID NO: 1761039 - protein, 6 aa, Staphylococcus epidermidis
GPQDDI

SEQ ID NO: 1761040 - protein, 10 aa, Staphylococcus epidermidis
GPQKGAQQKM

SEQ ID NO: 1761041 - protein, 8 aa, Staphylococcus epidermidis
GPTAPTTA

SEQ ID NO: 1761042 - protein, 5 aa, Staphylococcus epidermidis
GPTHE

SEQ ID NO: 1761043 - protein, 8 aa, Staphylococcus epidermidis
GPTPRSYA

SEQ ID NO: 1761044 - protein, 7 aa, Staphylococcus epidermidis
GPTPVPE

SEQ ID NO: 1761045 - protein, 6 aa, Staphylococcus epidermidis
GQADLG

SEQ ID NO: 1761046 - protein, 13 aa, Staphylococcus epidermidis
GQAGGRSEITPER

SEQ ID NO: 1761047 - protein, 9 aa, Staphylococcus epidermidis
GQAKISGNA

SEQ ID NO: 1761048 - protein, 5 aa, Staphylococcus epidermidis
GQARN

SEQ ID NO: 1761049 - protein, 8 aa, Staphylococcus epidermidis
GQDGEQHR

SEQ ID NO: 1761050 - protein, 5 aa, Staphylococcus epidermidis
GQEFE

SEQ ID NO: 1761051 - protein, 7 aa, Staphylococcus epidermidis
GQEPPYT

SEQ ID NO: 1761052 - protein, 9 aa, Staphylococcus epidermidis
GQGEEQEKI

SEQ ID NO: 1761053 - protein, 17 aa, Staphylococcus epidermidis
GQGTRLGYKGPKGSFEI

SEQ ID NO: 1761054 - protein, 9 aa, Staphylococcus epidermidis
GQIPQTHKE

SEQ ID NO: 1761055 - protein, 8 aa, Staphylococcus epidermidis
GQLEISDE

SEQ ID NO: 1761056 - protein, 6 aa, Staphylococcus epidermidis
GQLGEH

SEQ ID NO: 1761057 - protein, 10 aa, Staphylococcus epidermidis
GQNDAVNSIS

SEQ ID NO: 1761058 - protein, 10 aa, Staphylococcus epidermidis
GQNDGVNDGD

SEQ ID NO: 1761059 - protein, 7 aa, Staphylococcus epidermidis
GQNPIEN

SEQ ID NO: 1761060 - protein, 14 aa, Staphylococcus epidermidis
GQNQTNSSTKIASD

SEQ ID NO: 1761061 - protein, 6 aa, Staphylococcus epidermidis
GQPGLV

SEQ ID NO: 1761062 - protein, 8 aa, Staphylococcus epidermidis
GQPKEGET

SEQ ID NO: 1761063 - protein, 5 aa, Staphylococcus epidermidis
GQQGV

SEQ ID NO: 1761064 - protein, 6 aa, Staphylococcus epidermidis
GQQTEI

SEQ ID NO: 1761065 - protein, 9 aa, Staphylococcus epidermidis
GQRTDITSE

SEQ ID NO: 1761066 - protein, 7 aa, Staphylococcus epidermidis
GQSETDL

SEQ ID NO: 1761067 - protein, 9 aa, Staphylococcus epidermidis
GQSGVGKST

SEQ ID NO: 1761068 - protein, 5 aa, Staphylococcus epidermidis
GQSMT

SEQ ID NO: 1761069 - protein, 6 aa, Staphylococcus epidermidis
GQSQKN

SEQ ID NO: 1761070 - protein, 7 aa, Staphylococcus epidermidis
GQSSIKS

SEQ ID NO: 1761071 - protein, 10 aa, Staphylococcus epidermidis
GQTGSGKSTL

SEQ ID NO: 1761072 - protein, 6 aa, Staphylococcus epidermidis
GQTLDI

SEQ ID NO: 1761073 - protein, 12 aa, Staphylococcus epidermidis
GQTLSEVTSEAM

SEQ ID NO: 1761074 - protein, 4 aa, Staphylococcus epidermidis
GQVS

SEQ ID NO: 1761075 - protein, 12 aa, Staphylococcus epidermidis
GRAGRDGKQSQA

SEQ ID NO: 1761076 - protein, 7 aa, Staphylococcus epidermidis
GRDKVSQ

SEQ ID NO: 1761077 - protein, 7 aa, Staphylococcus epidermidis
GREQTQR

SEQ ID NO: 1761078 - protein, 5 aa, Staphylococcus epidermidis
GRETP

SEQ ID NO: 1761079 - protein, 5 aa, Staphylococcus epidermidis
GRGFP

SEQ ID NO: 1761080 - protein, 8 aa, Staphylococcus epidermidis
GRGPSNRE

SEQ ID NO: 1761081 - protein, 6 aa, Staphylococcus epidermidis
GRGSYL

SEQ ID NO: 1761082 - protein, 12 aa, Staphylococcus epidermidis
GRIQSGEKIKYT

SEQ ID NO: 1761083 - protein, 8 aa, Staphylococcus epidermidis
GRKDDKGV

SEQ ID NO: 1761084 - protein, 8 aa, Staphylococcus epidermidis
GRKGYEHE

SEQ ID NO: 1761085 - protein, 15 aa, Staphylococcus epidermidis
GRKRQTQAAAGVESM

SEQ ID NO: 1761086 - protein, 8 aa, Staphylococcus epidermidis
GRNDAGGD

SEQ ID NO: 1761087 - protein, 8 aa, Staphylococcus epidermidis
GRNKEEKV

SEQ ID NO: 1761088 - protein, 8 aa, Staphylococcus epidermidis
GRPHDQKT

SEQ ID NO: 1761089 - protein, 5 aa, Staphylococcus epidermidis
GRPMV

SEQ ID NO: 1761090 - protein, 9 aa, Staphylococcus epidermidis
GRPRDIKDK

SEQ ID NO: 1761091 - protein, 8 aa, Staphylococcus epidermidis
GRPYATDF

SEQ ID NO: 1761092 - protein, 7 aa, Staphylococcus epidermidis
GRQPETL

SEQ ID NO: 1761093 - protein, 7 aa, Staphylococcus epidermidis
GRQSDEA

SEQ ID NO: 1761094 - protein, 7 aa, Staphylococcus epidermidis
GRSSETP

SEQ ID NO: 1761095 - protein, 11 aa, Staphylococcus epidermidis
GRTGRAGKEGI

SEQ ID NO: 1761096 - protein, 8 aa, Staphylococcus epidermidis
GRTPNDAL

SEQ ID NO: 1761097 - protein, 5 aa, Staphylococcus epidermidis
GSATG

SEQ ID NO: 1761098 - protein, 5 aa, Staphylococcus epidermidis
GSDDL

SEQ ID NO: 1761099 - protein, 8 aa, Staphylococcus epidermidis
GSDGSGGK

SEQ ID NO: 1761100 - protein, 9 aa, Staphylococcus epidermidis
GSDSDYITG

SEQ ID NO: 1761101 - protein, 10 aa, Staphylococcus epidermidis
GSDSTESAQR

SEQ ID NO: 1761102 - protein, 12 aa, Staphylococcus epidermidis
GSDTGGSIRQPA

SEQ ID NO: 1761103 - protein, 13 aa, Staphylococcus epidermidis
GSEARLSSGALAG

SEQ ID NO: 1761104 - protein, 8 aa, Staphylococcus epidermidis
GSESASLK

SEQ ID NO: 1761105 - protein, 10 aa, Staphylococcus epidermidis
GSESHNNPYH

SEQ ID NO: 1761106 - protein, 4 aa, Staphylococcus epidermidis
GSEV

SEQ ID NO: 1761107 - protein, 6 aa, Staphylococcus epidermidis
GSEVGD

SEQ ID NO: 1761108 - protein, 7 aa, Staphylococcus epidermidis
GSFDGGA

SEQ ID NO: 1761109 - protein, 8 aa, Staphylococcus epidermidis
GSFPQTRE

SEQ ID NO: 1761110 - protein, 5 aa, Staphylococcus epidermidis
GSFQQ

SEQ ID NO: 1761111 - protein, 5 aa, Staphylococcus epidermidis
GSGKT

SEQ ID NO: 1761112 - protein, 5 aa, Staphylococcus epidermidis
GSGLA

SEQ ID NO: 1761113 - protein, 6 aa, Staphylococcus epidermidis
GSGSER

SEQ ID NO: 1761114 - protein, 5 aa, Staphylococcus epidermidis
GSHAS

SEQ ID NO: 1761115 - protein, 10 aa, Staphylococcus epidermidis
GSHGTTFGGN

SEQ ID NO: 1761116 - protein, 7 aa, Staphylococcus epidermidis
GSHSDGA

SEQ ID NO: 1761117 - protein, 14 aa, Staphylococcus epidermidis
GSISPSSGEITRHG

SEQ ID NO: 1761118 - protein, 9 aa, Staphylococcus epidermidis
GSKKRAPQI

SEQ ID NO: 1761119 - protein, 10 aa, Staphylococcus epidermidis
GSKQYKGAAT

SEQ ID NO: 1761120 - protein, 25 aa, Staphylococcus epidermidis
GSKTPGHPEYRHTDGVEVTTGPLGQ

SEQ ID NO: 1761121 - protein, 13 aa, Staphylococcus epidermidis
GSLTDDAGTGKIE

SEQ ID NO: 1761122 - protein, 5 aa, Staphylococcus epidermidis
GSNLP

SEQ ID NO: 1761123 - protein, 14 aa, Staphylococcus epidermidis
GSNPKYNIEREEKF

SEQ ID NO: 1761124 - protein, 23 aa, Staphylococcus epidermidis
GSPEMSNKNAQANKSNNTPTLDG

SEQ ID NO: 1761125 - protein, 21 aa, Staphylococcus epidermidis
GSPNKAGSNGVHGAPLGEEER

SEQ ID NO: 1761126 - protein, 8 aa, Staphylococcus epidermidis
GSPNLVES

SEQ ID NO: 1761127 - protein, 9 aa, Staphylococcus epidermidis
GSPSSRTQR

SEQ ID NO: 1761128 - protein, 7 aa, Staphylococcus epidermidis
GSQAQYY

SEQ ID NO: 1761129 - protein, 9 aa, Staphylococcus epidermidis
GSQEDENHI

SEQ ID NO: 1761130 - protein, 16 aa, Staphylococcus epidermidis
GSQGHAHAQNLKDNGY

SEQ ID NO: 1761131 - protein, 5 aa, Staphylococcus epidermidis
GSQLG

SEQ ID NO: 1761132 - protein, 5 aa, Staphylococcus epidermidis
GSQRT

SEQ ID NO: 1761133 - protein, 9 aa, Staphylococcus epidermidis
GSRAVKPPV

SEQ ID NO: 1761134 - protein, 5 aa, Staphylococcus epidermidis
GSRER

SEQ ID NO: 1761135 - protein, 9 aa, Staphylococcus epidermidis
GSRHDNEAI

SEQ ID NO: 1761136 - protein, 6 aa, Staphylococcus epidermidis
GSRSAK

SEQ ID NO: 1761137 - protein, 10 aa, Staphylococcus epidermidis
GSSRSGLKDF

SEQ ID NO: 1761138 - protein, 6 aa, Staphylococcus epidermidis
GSSTSQ

SEQ ID NO: 1761139 - protein, 12 aa, Staphylococcus epidermidis
GSTITDNIPEDS

SEQ ID NO: 1761140 - protein, 8 aa, Staphylococcus epidermidis
GSTMEPRQ

SEQ ID NO: 1761141 - protein, 17 aa, Staphylococcus epidermidis
GSVDGEEFDGGQAEGYD

SEQ ID NO: 1761142 - protein, 7 aa, Staphylococcus epidermidis
GSVEAGK

SEQ ID NO: 1761143 - protein, 5 aa, Staphylococcus epidermidis
GSVGS

SEQ ID NO: 1761144 - protein, 11 aa, Staphylococcus epidermidis
GSVSPATKEKI

SEQ ID NO: 1761145 - protein, 15 aa, Staphylococcus epidermidis
GSYDQRAQEKADEYG

SEQ ID NO: 1761146 - protein, 6 aa, Staphylococcus epidermidis
GSYTHT

SEQ ID NO: 1761147 - protein, 7 aa, Staphylococcus epidermidis
GTADPFQ

SEQ ID NO: 1761148 - protein, 5 aa, Staphylococcus epidermidis
GTASI

SEQ ID NO: 1761149 - protein, 6 aa, Staphylococcus epidermidis
GTASKI

SEQ ID NO: 1761150 - protein, 8 aa, Staphylococcus epidermidis
GTATAGIP

SEQ ID NO: 1761151 - protein, 7 aa, Staphylococcus epidermidis
GTCMTSN

SEQ ID NO: 1761152 - protein, 8 aa, Staphylococcus epidermidis
GTCPSSTI

SEQ ID NO: 1761153 - protein, 10 aa, Staphylococcus epidermidis
GTDIDKESAL

SEQ ID NO: 1761154 - protein, 8 aa, Staphylococcus epidermidis
GTDPDADR

SEQ ID NO: 1761155 - protein, 9 aa, Staphylococcus epidermidis
GTEVKRGDK

SEQ ID NO: 1761156 - protein, 25 aa, Staphylococcus epidermidis
GTGKTTLSADPKRKLIGDDEHGWNK

SEQ ID NO: 1761157 - protein, 4 aa, Staphylococcus epidermidis
GTGN

SEQ ID NO: 1761158 - protein, 5 aa, Staphylococcus epidermidis
GTGST

SEQ ID NO: 1761159 - protein, 11 aa, Staphylococcus epidermidis
GTHNKGKLGAN

SEQ ID NO: 1761160 - protein, 4 aa, Staphylococcus epidermidis
GTIA

SEQ ID NO: 1761161 - protein, 5 aa, Staphylococcus epidermidis
GTITD

SEQ ID NO: 1761162 - protein, 11 aa, Staphylococcus epidermidis
GTLDDKGPTIA

SEQ ID NO: 1761163 - protein, 4 aa, Staphylococcus epidermidis
GTLS

SEQ ID NO: 1761164 - protein, 5 aa, Staphylococcus epidermidis
GTNLN

SEQ ID NO: 1761165 - protein, 7 aa, Staphylococcus epidermidis
GTNPEMG

SEQ ID NO: 1761166 - protein, 5 aa, Staphylococcus epidermidis
GTNSG

SEQ ID NO: 1761167 - protein, 8 aa, Staphylococcus epidermidis
GTNVERGK

SEQ ID NO: 1761168 - protein, 13 aa, Staphylococcus epidermidis
GTPAMATGGMGDT

SEQ ID NO: 1761169 - protein, 8 aa, Staphylococcus epidermidis
GTPYPEDL

SEQ ID NO: 1761170 - protein, 12 aa, Staphylococcus epidermidis
GTQEGVKILNKE

SEQ ID NO: 1761171 - protein, 8 aa, Staphylococcus epidermidis
GTQKRGPL

SEQ ID NO: 1761172 - protein, 6 aa, Staphylococcus epidermidis
GTRAEE

SEQ ID NO: 1761173 - protein, 6 aa, Staphylococcus epidermidis
GTRQDL

SEQ ID NO: 1761174 - protein, 17 aa, Staphylococcus epidermidis
GTSIRLTGQDSERGTFS

SEQ ID NO: 1761175 - protein, 15 aa, Staphylococcus epidermidis
GTTDASSFLGTNENN

SEQ ID NO: 1761176 - protein, 10 aa, Staphylococcus epidermidis
GTTQAVDEIK

SEQ ID NO: 1761177 - protein, 7 aa, Staphylococcus epidermidis
GTVDGPG

SEQ ID NO: 1761178 - protein, 9 aa, Staphylococcus epidermidis
GVANQELTP

SEQ ID NO: 1761179 - protein, 14 aa, Staphylococcus epidermidis
GVDANDSTSAPVDD

SEQ ID NO: 1761180 - protein, 4 aa, Staphylococcus epidermidis
GVDP

SEQ ID NO: 1761181 - protein, 6 aa, Staphylococcus epidermidis
GVDQSK

SEQ ID NO: 1761182 - protein, 13 aa, Staphylococcus epidermidis
GVEATTEIKKDLP

SEQ ID NO: 1761183 - protein, 10 aa, Staphylococcus epidermidis
GVFTEEGGPF

SEQ ID NO: 1761184 - protein, 5 aa, Staphylococcus epidermidis
GVGTD

SEQ ID NO: 1761185 - protein, 12 aa, Staphylococcus epidermidis
GVLTRNGHTEAA

SEQ ID NO: 1761186 - protein, 9 aa, Staphylococcus epidermidis
GVNEGKRHQ

SEQ ID NO: 1761187 - protein, 8 aa, Staphylococcus epidermidis
GVPEAVPS

SEQ ID NO: 1761188 - protein, 4 aa, Staphylococcus epidermidis
GVQF

SEQ ID NO: 1761189 - protein, 10 aa, Staphylococcus epidermidis
GVSDPERKRK

SEQ ID NO: 1761190 - protein, 9 aa, Staphylococcus epidermidis
GVSEPDVED

SEQ ID NO: 1761191 - protein, 10 aa, Staphylococcus epidermidis
GVSKGKGFQG

SEQ ID NO: 1761192 - protein, 7 aa, Staphylococcus epidermidis
GVSKSTV

SEQ ID NO: 1761193 - protein, 6 aa, Staphylococcus epidermidis
GVTETQ

SEQ ID NO: 1761194 - protein, 5 aa, Staphylococcus epidermidis
GYADD

SEQ ID NO: 1761195 - protein, 8 aa, Staphylococcus epidermidis
GYAYESDG

SEQ ID NO: 1761196 - protein, 7 aa, Staphylococcus epidermidis
GYDQPAL

SEQ ID NO: 1761197 - protein, 4 aa, Staphylococcus epidermidis
GYEI

SEQ ID NO: 1761198 - protein, 5 aa, Staphylococcus epidermidis
GYGDS

SEQ ID NO: 1761199 - protein, 14 aa, Staphylococcus epidermidis
GYGEDAMDASEQGL

SEQ ID NO: 1761200 - protein, 7 aa, Staphylococcus epidermidis
GYGNKDI

SEQ ID NO: 1761201 - protein, 13 aa, Staphylococcus epidermidis
GYGNNDNDRKEGI

SEQ ID NO: 1761202 - protein, 10 aa, Staphylococcus epidermidis
GYGPTENTTF

SEQ ID NO: 1761203 - protein, 10 aa, Staphylococcus epidermidis
GYGSSGDAHH

SEQ ID NO: 1761204 - protein, 7 aa, Staphylococcus epidermidis
GYLDGDR

SEQ ID NO: 1761205 - protein, 6 aa, Staphylococcus epidermidis
GYQYES

SEQ ID NO: 1761206 - protein, 9 aa, Staphylococcus epidermidis
GYSNEYDVQ

SEQ ID NO: 1761207 - protein, 5 aa, Staphylococcus epidermidis
GYTED

SEQ ID NO: 1761208 - protein, 20 aa, Staphylococcus epidermidis
GYTQNRQPGIEADMEPKPIA

SEQ ID NO: 1761209 - protein, 5 aa, Staphylococcus epidermidis
GYVSD

SEQ ID NO: 1761210 - protein, 4 aa, Staphylococcus epidermidis
HAES

SEQ ID NO: 1761211 - protein, 8 aa, Staphylococcus epidermidis
HATARQND

SEQ ID NO: 1761212 - protein, 8 aa, Staphylococcus epidermidis
HATDEAAY

SEQ ID NO: 1761213 - protein, 11 aa, Staphylococcus epidermidis
HDEDDEDNIVT

SEQ ID NO: 1761214 - protein, 6 aa, Staphylococcus epidermidis
HDERVQ

SEQ ID NO: 1761215 - protein, 7 aa, Staphylococcus epidermidis
HDKPAQT

SEQ ID NO: 1761216 - protein, 7 aa, Staphylococcus epidermidis
HDNRRYY

SEQ ID NO: 1761217 - protein, 5 aa, Staphylococcus epidermidis
HDPLR

SEQ ID NO: 1761218 - protein, 5 aa, Staphylococcus epidermidis
HDQGA

SEQ ID NO: 1761219 - protein, 13 aa, Staphylococcus epidermidis
HDQPRRVSTWGDD

SEQ ID NO: 1761220 - protein, 7 aa, Staphylococcus epidermidis
HDSGAQF

SEQ ID NO: 1761221 - protein, 6 aa, Staphylococcus epidermidis
HDTITP

SEQ ID NO: 1761222 - protein, 22 aa, Staphylococcus epidermidis
HDTLDGSETVVSGASCTTNSLA

SEQ ID NO: 1761223 - protein, 4 aa, Staphylococcus epidermidis
HDVE

SEQ ID NO: 1761224 - protein, 11 aa, Staphylococcus epidermidis
HEANNDSRKGV

SEQ ID NO: 1761225 - protein, 9 aa, Staphylococcus epidermidis
HEASDRPKS

SEQ ID NO: 1761226 - protein, 4 aa, Staphylococcus epidermidis
HEDE

SEQ ID NO: 1761227 - protein, 10 aa, Staphylococcus epidermidis
HEEQDKKEQF

SEQ ID NO: 1761228 - protein, 36 aa, Staphylococcus epidermidis
HEESPGETVELDGKKYKEYFGSASEYQKGEHKNVEG

SEQ ID NO: 1761229 - protein, 11 aa, Staphylococcus epidermidis
HEFSGGQRQRI

SEQ ID NO: 1761230 - protein, 6 aa, Staphylococcus epidermidis
HEGPDS

SEQ ID NO: 1761231 - protein, 10 aa, Staphylococcus epidermidis
HEHNKEQQTD

SEQ ID NO: 1761232 - protein, 10 aa, Staphylococcus epidermidis
HETKAPEYFN

SEQ ID NO: 1761233 - protein, 5 aa, Staphylococcus epidermidis
HETTT

SEQ ID NO: 1761234 - protein, 11 aa, Staphylococcus epidermidis
HEVPERTEGYE

SEQ ID NO: 1761235 - protein, 6 aa, Staphylococcus epidermidis
HFKNRD

SEQ ID NO: 1761236 - protein, 9 aa, Staphylococcus epidermidis
HFKSSGYDG

SEQ ID NO: 1761237 - protein, 10 aa, Staphylococcus epidermidis
HFNQTDKGVT

SEQ ID NO: 1761238 - protein, 20 aa, Staphylococcus epidermidis
HGDPQFEGQTKTKLGNSEVR

SEQ ID NO: 1761239 - protein, 7 aa, Staphylococcus epidermidis
HGETGVQ

SEQ ID NO: 1761240 - protein, 15 aa, Staphylococcus epidermidis
HGNDPIAKGTDHTRE

SEQ ID NO: 1761241 - protein, 4 aa, Staphylococcus epidermidis
HGRT

SEQ ID NO: 1761242 - protein, 10 aa, Staphylococcus epidermidis
HGSHEEHKAR

SEQ ID NO: 1761243 - protein, 7 aa, Staphylococcus epidermidis
HGTGKSQ

SEQ ID NO: 1761244 - protein, 8 aa, Staphylococcus epidermidis
HGTSTPVG

SEQ ID NO: 1761245 - protein, 5 aa, Staphylococcus epidermidis
HGVPS

SEQ ID NO: 1761246 - protein, 10 aa, Staphylococcus epidermidis
HGYSDKPRNI

SEQ ID NO: 1761247 - protein, 7 aa, Staphylococcus epidermidis
HHNKPNS

SEQ ID NO: 1761248 - protein, 8 aa, Staphylococcus epidermidis
HHPKGSGL

SEQ ID NO: 1761249 - protein, 10 aa, Staphylococcus epidermidis
HHQNKGPLTG

SEQ ID NO: 1761250 - protein, 6 aa, Staphylococcus epidermidis
HIESPD

SEQ ID NO: 1761251 - protein, 14 aa, Staphylococcus epidermidis
HIGSPNEVLEPGQQ

SEQ ID NO: 1761252 - protein, 7 aa, Staphylococcus epidermidis
HIQTSDD

SEQ ID NO: 1761253 - protein, 6 aa, Staphylococcus epidermidis
HKAQTN

SEQ ID NO: 1761254 - protein, 6 aa, Staphylococcus epidermidis
HKDGRC

SEQ ID NO: 1761255 - protein, 7 aa, Staphylococcus epidermidis
HKDQLTK

SEQ ID NO: 1761256 - protein, 7 aa, Staphylococcus epidermidis
HKDSDAQ

SEQ ID NO: 1761257 - protein, 15 aa, Staphylococcus epidermidis
HKESRQRVMSEFKAL

SEQ ID NO: 1761258 - protein, 11 aa, Staphylococcus epidermidis
HKGAVQNSAIS

SEQ ID NO: 1761259 - protein, 10 aa, Staphylococcus epidermidis
HKGHQLNSLP

SEQ ID NO: 1761260 - protein, 9 aa, Staphylococcus epidermidis
HKGTGAGND

SEQ ID NO: 1761261 - protein, 7 aa, Staphylococcus epidermidis
HKKLNDE

SEQ ID NO: 1761262 - protein, 7 aa, Staphylococcus epidermidis
HKKQSGV

SEQ ID NO: 1761263 - protein, 7 aa, Staphylococcus epidermidis
HKLTKAS

SEQ ID NO: 1761264 - protein, 9 aa, Staphylococcus epidermidis
HKNGPNTIL

SEQ ID NO: 1761265 - protein, 7 aa, Staphylococcus epidermidis
HKPMKAQ

SEQ ID NO: 1761266 - protein, 6 aa, Staphylococcus epidermidis
HKQKYR

SEQ ID NO: 1761267 - protein, 8 aa, Staphylococcus epidermidis
HKRSTGRS

SEQ ID NO: 1761268 - protein, 9 aa, Staphylococcus epidermidis
HKTYRNSEH

SEQ ID NO: 1761269 - protein, 8 aa, Staphylococcus epidermidis
HLDPSKPT

SEQ ID NO: 1761270 - protein, 7 aa, Staphylococcus epidermidis
HLPEGNL

SEQ ID NO: 1761271 - protein, 11 aa, Staphylococcus epidermidis
HLTDTKGRTVD

SEQ ID NO: 1761272 - protein, 12 aa, Staphylococcus epidermidis
HNAEEVKKRPHF

SEQ ID NO: 1761273 - protein, 6 aa, Staphylococcus epidermidis
HNDGIK

SEQ ID NO: 1761274 - protein, 6 aa, Staphylococcus epidermidis
HNEDEN

SEQ ID NO: 1761275 - protein, 15 aa, Staphylococcus epidermidis
HNEMDEPSITNPVPY

SEQ ID NO: 1761276 - protein, 19 aa, Staphylococcus epidermidis
HNKDNTYTPLPNKNIDTGM

SEQ ID NO: 1761277 - protein, 12 aa, Staphylococcus epidermidis
HNNGKGAKYTKI

SEQ ID NO: 1761278 - protein, 10 aa, Staphylococcus epidermidis
HNRKTHGKTQ

SEQ ID NO: 1761279 - protein, 8 aa, Staphylococcus epidermidis
HNSEGKVV

SEQ ID NO: 1761280 - protein, 9 aa, Staphylococcus epidermidis
HNVPGAEAY

SEQ ID NO: 1761281 - protein, 9 aa, Staphylococcus epidermidis
HPATDQYGD

SEQ ID NO: 1761282 - protein, 6 aa, Staphylococcus epidermidis
HPDQYQ

SEQ ID NO: 1761283 - protein, 6 aa, Staphylococcus epidermidis
HPEEYP

SEQ ID NO: 1761284 - protein, 4 aa, Staphylococcus epidermidis
HPEF

SEQ ID NO: 1761285 - protein, 6 aa, Staphylococcus epidermidis
HPEGGY

SEQ ID NO: 1761286 - protein, 10 aa, Staphylococcus epidermidis
HPETGGEGTW

SEQ ID NO: 1761287 - protein, 5 aa, Staphylococcus epidermidis
HPGEV

SEQ ID NO: 1761288 - protein, 6 aa, Staphylococcus epidermidis
HPHGKS

SEQ ID NO: 1761289 - protein, 4 aa, Staphylococcus epidermidis
HPKH

SEQ ID NO: 1761290 - protein, 18 aa, Staphylococcus epidermidis
HPKHGVKTKETAGKVQKL

SEQ ID NO: 1761291 - protein, 16 aa, Staphylococcus epidermidis
HPKTEELQRFLNVINE

SEQ ID NO: 1761292 - protein, 5 aa, Staphylococcus epidermidis
HPNPV

SEQ ID NO: 1761293 - protein, 7 aa, Staphylococcus epidermidis
HPRYGKQ

SEQ ID NO: 1761294 - protein, 6 aa, Staphylococcus epidermidis
HPVSKN

SEQ ID NO: 1761295 - protein, 5 aa, Staphylococcus epidermidis
HPYET

SEQ ID NO: 1761296 - protein, 4 aa, Staphylococcus epidermidis
HQDY

SEQ ID NO: 1761297 - protein, 7 aa, Staphylococcus epidermidis
HQHPADY

SEQ ID NO: 1761298 - protein, 7 aa, Staphylococcus epidermidis
HQITPDS

SEQ ID NO: 1761299 - protein, 7 aa, Staphylococcus epidermidis
HQKENAA

SEQ ID NO: 1761300 - protein, 4 aa, Staphylococcus epidermidis
HQLP

SEQ ID NO: 1761301 - protein, 7 aa, Staphylococcus epidermidis
HQLPEAV

SEQ ID NO: 1761302 - protein, 10 aa, Staphylococcus epidermidis
HQLSTSENKI

SEQ ID NO: 1761303 - protein, 4 aa, Staphylococcus epidermidis
HQMK

SEQ ID NO: 1761304 - protein, 6 aa, Staphylococcus epidermidis
HQPTED

SEQ ID NO: 1761305 - protein, 5 aa, Staphylococcus epidermidis
HQRQL

SEQ ID NO: 1761306 - protein, 10 aa, Staphylococcus epidermidis
HQSETPTVEQ

SEQ ID NO: 1761307 - protein, 8 aa, Staphylococcus epidermidis
HQTPGREL

SEQ ID NO: 1761308 - protein, 6 aa, Staphylococcus epidermidis
HQTSVD

SEQ ID NO: 1761309 - protein, 11 aa, Staphylococcus epidermidis
HRADEDATTTA

SEQ ID NO: 1761310 - protein, 6 aa, Staphylococcus epidermidis
HRDNGV

SEQ ID NO: 1761311 - protein, 9 aa, Staphylococcus epidermidis
HREQQPIET

SEQ ID NO: 1761312 - protein, 16 aa, Staphylococcus epidermidis
HRGHGKEIDENERGHF

SEQ ID NO: 1761313 - protein, 4 aa, Staphylococcus epidermidis
HRHG

SEQ ID NO: 1761314 - protein, 8 aa, Staphylococcus epidermidis
HRKGSHEK

SEQ ID NO: 1761315 - protein, 6 aa, Staphylococcus epidermidis
HRLKNG

SEQ ID NO: 1761316 - protein, 11 aa, Staphylococcus epidermidis
HRRDKEGYAQA

SEQ ID NO: 1761317 - protein, 11 aa, Staphylococcus epidermidis
HRTKTEKANDL

SEQ ID NO: 1761318 - protein, 9 aa, Staphylococcus epidermidis
HSDKEGISN

SEQ ID NO: 1761319 - protein, 8 aa, Staphylococcus epidermidis
HSDRQEEN

SEQ ID NO: 1761320 - protein, 7 aa, Staphylococcus epidermidis
HSEKQLS

SEQ ID NO: 1761321 - protein, 12 aa, Staphylococcus epidermidis
HSGASRADSGEI

SEQ ID NO: 1761322 - protein, 4 aa, Staphylococcus epidermidis
HSGY

SEQ ID NO: 1761323 - protein, 18 aa, Staphylococcus epidermidis
HSIGRDARKYLDQSRRTV

SEQ ID NO: 1761324 - protein, 8 aa, Staphylococcus epidermidis
HSLEGAKT

SEQ ID NO: 1761325 - protein, 4 aa, Staphylococcus epidermidis
HSNK

SEQ ID NO: 1761326 - protein, 13 aa, Staphylococcus epidermidis
HSPIERDDRPDRV

SEQ ID NO: 1761327 - protein, 9 aa, Staphylococcus epidermidis
HSQLPSDGL

SEQ ID NO: 1761328 - protein, 8 aa, Staphylococcus epidermidis
HSRGTGRW

SEQ ID NO: 1761329 - protein, 6 aa, Staphylococcus epidermidis
HTDNGV

SEQ ID NO: 1761330 - protein, 5 aa, Staphylococcus epidermidis
HTEYG

SEQ ID NO: 1761331 - protein, 9 aa, Staphylococcus epidermidis
HTFTSGEAS

SEQ ID NO: 1761332 - protein, 6 aa, Staphylococcus epidermidis
HTKDKD

SEQ ID NO: 1761333 - protein, 8 aa, Staphylococcus epidermidis
HTNGQGKA

SEQ ID NO: 1761334 - protein, 12 aa, Staphylococcus epidermidis
HTPEIGKGRGPV

SEQ ID NO: 1761335 - protein, 19 aa, Staphylococcus epidermidis
HTPSADKFTISRDDDGAYV

SEQ ID NO: 1761336 - protein, 12 aa, Staphylococcus epidermidis
HTPTAKKLAEER

SEQ ID NO: 1761337 - protein, 9 aa, Staphylococcus epidermidis
HTRSNKARQ

SEQ ID NO: 1761338 - protein, 6 aa, Staphylococcus epidermidis
HTYEDR

SEQ ID NO: 1761339 - protein, 6 aa, Staphylococcus epidermidis
HYETSQ

SEQ ID NO: 1761340 - protein, 8 aa, Staphylococcus epidermidis
HYSPETPL

SEQ ID NO: 1761341 - protein, 11 aa, Staphylococcus epidermidis
HYTEDNQRLDE

SEQ ID NO: 1761342 - protein, 16 aa, Staphylococcus epidermidis
HYYGSGSKTTQTVTSG

SEQ ID NO: 1761343 - protein, 8 aa, Staphylococcus epidermidis
IAAEQGTK

SEQ ID NO: 1761344 - protein, 5 aa, Staphylococcus epidermidis
IADPE

SEQ ID NO: 1761345 - protein, 13 aa, Staphylococcus epidermidis
IADYKEPREDWLY

SEQ ID NO: 1761346 - protein, 9 aa, Staphylococcus epidermidis
IAEETERLG

SEQ ID NO: 1761347 - protein, 6 aa, Staphylococcus epidermidis
IAEQDI

SEQ ID NO: 1761348 - protein, 7 aa, Staphylococcus epidermidis
IAESEAE

SEQ ID NO: 1761349 - protein, 4 aa, Staphylococcus epidermidis
IAHD

SEQ ID NO: 1761350 - protein, 11 aa, Staphylococcus epidermidis
IAKEQKETNLT

SEQ ID NO: 1761351 - protein, 6 aa, Staphylococcus epidermidis
IAKEQN

SEQ ID NO: 1761352 - protein, 11 aa, Staphylococcus epidermidis
IAKGQGVGRGS

SEQ ID NO: 1761353 - protein, 8 aa, Staphylococcus epidermidis
IANETGHT

SEQ ID NO: 1761354 - protein, 8 aa, Staphylococcus epidermidis
IASNKPEA

SEQ ID NO: 1761355 - protein, 16 aa, Staphylococcus epidermidis
IASREAVKKGSKGLEQ

SEQ ID NO: 1761356 - protein, 14 aa, Staphylococcus epidermidis
IATHDSDYAKLEDG

SEQ ID NO: 1761357 - protein, 9 aa, Staphylococcus epidermidis
IDASSDSPF

SEQ ID NO: 1761358 - protein, 8 aa, Staphylococcus epidermidis
IDDEGKLN

SEQ ID NO: 1761359 - protein, 16 aa, Staphylococcus epidermidis
IDDEKAGAMEDDPFYQ

SEQ ID NO: 1761360 - protein, 9 aa, Staphylococcus epidermidis
IDEAQNIKP

SEQ ID NO: 1761361 - protein, 10 aa, Staphylococcus epidermidis
IDEDAKEDIR

SEQ ID NO: 1761362 - protein, 9 aa, Staphylococcus epidermidis
IDENGEMNR

SEQ ID NO: 1761363 - protein, 9 aa, Staphylococcus epidermidis
IDGDNIKSS

SEQ ID NO: 1761364 - protein, 12 aa, Staphylococcus epidermidis
IDKDGQAYPLTQ

SEQ ID NO: 1761365 - protein, 18 aa, Staphylococcus epidermidis
IDKQGRVNASHKVLEQSK

SEQ ID NO: 1761366 - protein, 7 aa, Staphylococcus epidermidis
IDLSNSA

SEQ ID NO: 1761367 - protein, 10 aa, Staphylococcus epidermidis
IDNDDKIPGL

SEQ ID NO: 1761368 - protein, 9 aa, Staphylococcus epidermidis
IDNNSNKFN

SEQ ID NO: 1761369 - protein, 16 aa, Staphylococcus epidermidis
IDNTTNLNGDRSTSAL

SEQ ID NO: 1761370 - protein, 11 aa, Staphylococcus epidermidis
IDPDGKAQSLD

SEQ ID NO: 1761371 - protein, 8 aa, Staphylococcus epidermidis
IDPRTGKP

SEQ ID NO: 1761372 - protein, 4 aa, Staphylococcus epidermidis
IDPT

SEQ ID NO: 1761373 - protein, 9 aa, Staphylococcus epidermidis
IDQSMEKDE

SEQ ID NO: 1761374 - protein, 11 aa, Staphylococcus epidermidis
IDREKQSSTYI

SEQ ID NO: 1761375 - protein, 7 aa, Staphylococcus epidermidis
IDSRDDI

SEQ ID NO: 1761376 - protein, 10 aa, Staphylococcus epidermidis
IDTAQNIYDS

SEQ ID NO: 1761377 - protein, 9 aa, Staphylococcus epidermidis
IDTTGAGDA

SEQ ID NO: 1761378 - protein, 5 aa, Staphylococcus epidermidis
IEAGT

SEQ ID NO: 1761379 - protein, 11 aa, Staphylococcus epidermidis
IEDNDDGIPNT

SEQ ID NO: 1761380 - protein, 6 aa, Staphylococcus epidermidis
IEEAYT

SEQ ID NO: 1761381 - protein, 9 aa, Staphylococcus epidermidis
IEEDADDLD

SEQ ID NO: 1761382 - protein, 6 aa, Staphylococcus epidermidis
IEEQDN

SEQ ID NO: 1761383 - protein, 8 aa, Staphylococcus epidermidis
IEETANDG

SEQ ID NO: 1761384 - protein, 8 aa, Staphylococcus epidermidis
IEETPYYE

SEQ ID NO: 1761385 - protein, 4 aa, Staphylococcus epidermidis
IEGD

SEQ ID NO: 1761386 - protein, 6 aa, Staphylococcus epidermidis
IEGTEA

SEQ ID NO: 1761387 - protein, 5 aa, Staphylococcus epidermidis
IEGTP

SEQ ID NO: 1761388 - protein, 5 aa, Staphylococcus epidermidis
IEHPS

SEQ ID NO: 1761389 - protein, 8 aa, Staphylococcus epidermidis
IEKSPDFG

SEQ ID NO: 1761390 - protein, 6 aa, Staphylococcus epidermidis
IENPSE

SEQ ID NO: 1761391 - protein, 7 aa, Staphylococcus epidermidis
IENSGKK

SEQ ID NO: 1761392 - protein, 6 aa, Staphylococcus epidermidis
IEPENG

SEQ ID NO: 1761393 - protein, 9 aa, Staphylococcus epidermidis
IEPHSPERL

SEQ ID NO: 1761394 - protein, 5 aa, Staphylococcus epidermidis
IEPKT

SEQ ID NO: 1761395 - protein, 20 aa, Staphylococcus epidermidis
IEPPDAVSQSEWSSRREAIK

SEQ ID NO: 1761396 - protein, 7 aa, Staphylococcus epidermidis
IEPSDKQ

SEQ ID NO: 1761397 - protein, 10 aa, Staphylococcus epidermidis
IEQAGEDPDI

SEQ ID NO: 1761398 - protein, 4 aa, Staphylococcus epidermidis
IEQE

SEQ ID NO: 1761399 - protein, 5 aa, Staphylococcus epidermidis
IEQGA

SEQ ID NO: 1761400 - protein, 6 aa, Staphylococcus epidermidis
IEQGIG

SEQ ID NO: 1761401 - protein, 10 aa, Staphylococcus epidermidis
IERAEDDKAY

SEQ ID NO: 1761402 - protein, 21 aa, Staphylococcus epidermidis
IERTRTDRYQRKQSNKTNSKL

SEQ ID NO: 1761403 - protein, 12 aa, Staphylococcus epidermidis
IETKVGKGYLAH

SEQ ID NO: 1761404 - protein, 16 aa, Staphylococcus epidermidis
IETPYKASLNDNQKKE

SEQ ID NO: 1761405 - protein, 5 aa, Staphylococcus epidermidis
IETTR

SEQ ID NO: 1761406 - protein, 11 aa, Staphylococcus epidermidis
IGDTDKTGTAI

SEQ ID NO: 1761407 - protein, 6 aa, Staphylococcus epidermidis
IGEETA

SEQ ID NO: 1761408 - protein, 4 aa, Staphylococcus epidermidis
IGEF

SEQ ID NO: 1761409 - protein, 18 aa, Staphylococcus epidermidis
IGEGPDAAAFNDEGSHTL

SEQ ID NO: 1761410 - protein, 5 aa, Staphylococcus epidermidis
IGEPT

SEQ ID NO: 1761411 - protein, 5 aa, Staphylococcus epidermidis
IGETL

SEQ ID NO: 1761412 - protein, 9 aa, Staphylococcus epidermidis
IGGSGKHQF

SEQ ID NO: 1761413 - protein, 4 aa, Staphylococcus epidermidis
IGKI

SEQ ID NO: 1761414 - protein, 9 aa, Staphylococcus epidermidis
IGKKTAQNI

SEQ ID NO: 1761415 - protein, 4 aa, Staphylococcus epidermidis
IGKT

SEQ ID NO: 1761416 - protein, 9 aa, Staphylococcus epidermidis
IGNNDENLK

SEQ ID NO: 1761417 - protein, 5 aa, Staphylococcus epidermidis
IGNRE

SEQ ID NO: 1761418 - protein, 6 aa, Staphylococcus epidermidis
IGPDAI

SEQ ID NO: 1761419 - protein, 5 aa, Staphylococcus epidermidis
IGPRI

SEQ ID NO: 1761420 - protein, 4 aa, Staphylococcus epidermidis
IGPS

SEQ ID NO: 1761421 - protein, 5 aa, Staphylococcus epidermidis
IGQGE

SEQ ID NO: 1761422 - protein, 5 aa, Staphylococcus epidermidis
IGQND

SEQ ID NO: 1761423 - protein, 6 aa, Staphylococcus epidermidis
IGSGAP

SEQ ID NO: 1761424 - protein, 17 aa, Staphylococcus epidermidis
IGSTNPSEAAPGTIRGD

SEQ ID NO: 1761425 - protein, 10 aa, Staphylococcus epidermidis
IGVGKSSLAH

SEQ ID NO: 1761426 - protein, 5 aa, Staphylococcus epidermidis
IGYEG

SEQ ID NO: 1761427 - protein, 5 aa, Staphylococcus epidermidis
IHDTT

SEQ ID NO: 1761428 - protein, 7 aa, Staphylococcus epidermidis
IHTTSER

SEQ ID NO: 1761429 - protein, 5 aa, Staphylococcus epidermidis
IIAGS

SEQ ID NO: 1761430 - protein, 5 aa, Staphylococcus epidermidis
IIDSA

SEQ ID NO: 1761431 - protein, 7 aa, Staphylococcus epidermidis
IIESGGQ

SEQ ID NO: 1761432 - protein, 6 aa, Staphylococcus epidermidis
IKDDDT

SEQ ID NO: 1761433 - protein, 7 aa, Staphylococcus epidermidis
IKEDDIK

SEQ ID NO: 1761434 - protein, 7 aa, Staphylococcus epidermidis
IKEDGQL

SEQ ID NO: 1761435 - protein, 7 aa, Staphylococcus epidermidis
IKETAQA

SEQ ID NO: 1761436 - protein, 11 aa, Staphylococcus epidermidis
IKETEETLTTE

SEQ ID NO: 1761437 - protein, 10 aa, Staphylococcus epidermidis
IKGAKSNNLK

SEQ ID NO: 1761438 - protein, 9 aa, Staphylococcus epidermidis
IKGTGGNHR

SEQ ID NO: 1761439 - protein, 13 aa, Staphylococcus epidermidis
IKKLNGDEPQFIV

SEQ ID NO: 1761440 - protein, 9 aa, Staphylococcus epidermidis
IKLTDGNEV

SEQ ID NO: 1761441 - protein, 17 aa, Staphylococcus epidermidis
IKNANKLKKKRERDKTG

SEQ ID NO: 1761442 - protein, 8 aa, Staphylococcus epidermidis
IKNDSTNV

SEQ ID NO: 1761443 - protein, 6 aa, Staphylococcus epidermidis
IKNKEE

SEQ ID NO: 1761444 - protein, 12 aa, Staphylococcus epidermidis
IKPDSVMGSGSL

SEQ ID NO: 1761445 - protein, 6 aa, Staphylococcus epidermidis
IKPELT

SEQ ID NO: 1761446 - protein, 15 aa, Staphylococcus epidermidis
IKQISSKINASSSNI

SEQ ID NO: 1761447 - protein, 7 aa, Staphylococcus epidermidis
IKQKYSS

SEQ ID NO: 1761448 - protein, 6 aa, Staphylococcus epidermidis
IKQVKE

SEQ ID NO: 1761449 - protein, 10 aa, Staphylococcus epidermidis
IKSAVTDSDG

SEQ ID NO: 1761450 - protein, 15 aa, Staphylococcus epidermidis
IKSEPMQSSLQSILA

SEQ ID NO: 1761451 - protein, 14 aa, Staphylococcus epidermidis
IKSFDEPDAGKLPW

SEQ ID NO: 1761452 - protein, 6 aa, Staphylococcus epidermidis
IKSMGK

SEQ ID NO: 1761453 - protein, 13 aa, Staphylococcus epidermidis
IKSQEQNSTPFTP

SEQ ID NO: 1761454 - protein, 10 aa, Staphylococcus epidermidis
IKTKENKGKL

SEQ ID NO: 1761455 - protein, 11 aa, Staphylococcus epidermidis
IKTQVSVEDGF

SEQ ID NO: 1761456 - protein, 11 aa, Staphylococcus epidermidis
IKTSAKTTEVI

SEQ ID NO: 1761457 - protein, 8 aa, Staphylococcus epidermidis
IKVEEGQE

SEQ ID NO: 1761458 - protein, 18 aa, Staphylococcus epidermidis
ILETQSINEMKDKLKSKE

SEQ ID NO: 1761459 - protein, 10 aa, Staphylococcus epidermidis
ILPDDHPYSI

SEQ ID NO: 1761460 - protein, 4 aa, Staphylococcus epidermidis
INAG

SEQ ID NO: 1761461 - protein, 7 aa, Staphylococcus epidermidis
INAHQGE

SEQ ID NO: 1761462 - protein, 10 aa, Staphylococcus epidermidis
INAKDKSEIE

SEQ ID NO: 1761463 - protein, 8 aa, Staphylococcus epidermidis
INANQESE

SEQ ID NO: 1761464 - protein, 6 aa, Staphylococcus epidermidis
INASGP

SEQ ID NO: 1761465 - protein, 4 aa, Staphylococcus epidermidis
INDD

SEQ ID NO: 1761466 - protein, 10 aa, Staphylococcus epidermidis
INDKERGLST

SEQ ID NO: 1761467 - protein, 4 aa, Staphylococcus epidermidis
INED

SEQ ID NO: 1761468 - protein, 8 aa, Staphylococcus epidermidis
INEKGADY

SEQ ID NO: 1761469 - protein, 9 aa, Staphylococcus epidermidis
INEPSREVT

SEQ ID NO: 1761470 - protein, 8 aa, Staphylococcus epidermidis
INETESDR

SEQ ID NO: 1761471 - protein, 14 aa, Staphylococcus epidermidis
INFNDGSKATMKTG

SEQ ID NO: 1761472 - protein, 4 aa, Staphylococcus epidermidis
INGN

SEQ ID NO: 1761473 - protein, 7 aa, Staphylococcus epidermidis
INHSKSN

SEQ ID NO: 1761474 - protein, 7 aa, Staphylococcus epidermidis
INKARGI

SEQ ID NO: 1761475 - protein, 4 aa, Staphylococcus epidermidis
INNE

SEQ ID NO: 1761476 - protein, 12 aa, Staphylococcus epidermidis
INNSTIHSNANI

SEQ ID NO: 1761477 - protein, 7 aa, Staphylococcus epidermidis
INPGTSV

SEQ ID NO: 1761478 - protein, 5 aa, Staphylococcus epidermidis
INREK

SEQ ID NO: 1761479 - protein, 15 aa, Staphylococcus epidermidis
INRLEQSKNEAPHLR

SEQ ID NO: 1761480 - protein, 8 aa, Staphylococcus epidermidis
INSNGWEK

SEQ ID NO: 1761481 - protein, 6 aa, Staphylococcus epidermidis
INSVPK

SEQ ID NO: 1761482 - protein, 6 aa, Staphylococcus epidermidis
INTDPE

SEQ ID NO: 1761483 - protein, 8 aa, Staphylococcus epidermidis
INTGNEDV

SEQ ID NO: 1761484 - protein, 12 aa, Staphylococcus epidermidis
INVPDDSTIIEP

SEQ ID NO: 1761485 - protein, 4 aa, Staphylococcus epidermidis
IPDS

SEQ ID NO: 1761486 - protein, 8 aa, Staphylococcus epidermidis
IPDTGESC

SEQ ID NO: 1761487 - protein, 6 aa, Staphylococcus epidermidis
IPDYAS

SEQ ID NO: 1761488 - protein, 14 aa, Staphylococcus epidermidis
IPEDHKERAEEARA

SEQ ID NO: 1761489 - protein, 11 aa, Staphylococcus epidermidis
IPEEDKKNQMA

SEQ ID NO: 1761490 - protein, 20 aa, Staphylococcus epidermidis
IPEKELEETKLKAKSLLEVT

SEQ ID NO: 1761491 - protein, 13 aa, Staphylococcus epidermidis
IPENPSEKDREWG

SEQ ID NO: 1761492 - protein, 6 aa, Staphylococcus epidermidis
IPGDSV

SEQ ID NO: 1761493 - protein, 4 aa, Staphylococcus epidermidis
IPGN

SEQ ID NO: 1761494 - protein, 11 aa, Staphylococcus epidermidis
IPGRHNDDSAT

SEQ ID NO: 1761495 - protein, 9 aa, Staphylococcus epidermidis
IPKNKNKTF

SEQ ID NO: 1761496 - protein, 14 aa, Staphylococcus epidermidis
IPNNEIKNVTQDQD

SEQ ID NO: 1761497 - protein, 8 aa, Staphylococcus epidermidis
IPNNSTGE

SEQ ID NO: 1761498 - protein, 8 aa, Staphylococcus epidermidis
IPNTVSKA

SEQ ID NO: 1761499 - protein, 4 aa, Staphylococcus epidermidis
IPPH

SEQ ID NO: 1761500 - protein, 12 aa, Staphylococcus epidermidis
IPQPDPDVERNR

SEQ ID NO: 1761501 - protein, 9 aa, Staphylococcus epidermidis
IPQVTSESL

SEQ ID NO: 1761502 - protein, 6 aa, Staphylococcus epidermidis
IPRGDQ

SEQ ID NO: 1761503 - protein, 10 aa, Staphylococcus epidermidis
IPRKSGMTRE

SEQ ID NO: 1761504 - protein, 13 aa, Staphylococcus epidermidis
IPSDVRAKEGITD

SEQ ID NO: 1761505 - protein, 5 aa, Staphylococcus epidermidis
IPSEK

SEQ ID NO: 1761506 - protein, 5 aa, Staphylococcus epidermidis
IPSGA

SEQ ID NO: 1761507 - protein, 13 aa, Staphylococcus epidermidis
IPSQEGKITAQDV

SEQ ID NO: 1761508 - protein, 4 aa, Staphylococcus epidermidis
IPST

SEQ ID NO: 1761509 - protein, 5 aa, Staphylococcus epidermidis
IPTEG

SEQ ID NO: 1761510 - protein, 8 aa, Staphylococcus epidermidis
IPTGDPVS

SEQ ID NO: 1761511 - protein, 10 aa, Staphylococcus epidermidis
IPTSNDWKEL

SEQ ID NO: 1761512 - protein, 5 aa, Staphylococcus epidermidis
IPYDD

SEQ ID NO: 1761513 - protein, 4 aa, Staphylococcus epidermidis
IPYG

SEQ ID NO: 1761514 - protein, 4 aa, Staphylococcus epidermidis
IQDQ

SEQ ID NO: 1761515 - protein, 20 aa, Staphylococcus epidermidis
IQEDGRQKRQVAEKELNELE

SEQ ID NO: 1761516 - protein, 9 aa, Staphylococcus epidermidis
IQEQEKKGK

SEQ ID NO: 1761517 - protein, 9 aa, Staphylococcus epidermidis
IQGGDDRNH

SEQ ID NO: 1761518 - protein, 4 aa, Staphylococcus epidermidis
IQGH

SEQ ID NO: 1761519 - protein, 6 aa, Staphylococcus epidermidis
IQGNLD

SEQ ID NO: 1761520 - protein, 18 aa, Staphylococcus epidermidis
IQPLPNNKESIIRYIKGA

SEQ ID NO: 1761521 - protein, 5 aa, Staphylococcus epidermidis
IQPNE

SEQ ID NO: 1761522 - protein, 5 aa, Staphylococcus epidermidis
IQPRE

SEQ ID NO: 1761523 - protein, 11 aa, Staphylococcus epidermidis
IQSPKSKKITI

SEQ ID NO: 1761524 - protein, 9 aa, Staphylococcus epidermidis
IQYDPNRSA

SEQ ID NO: 1761525 - protein, 20 aa, Staphylococcus epidermidis
IRDDSKATADAPVGPGPREA

SEQ ID NO: 1761526 - protein, 10 aa, Staphylococcus epidermidis
IRDKNDVPET

SEQ ID NO: 1761527 - protein, 10 aa, Staphylococcus epidermidis
IRGAGTTSIK

SEQ ID NO: 1761528 - protein, 7 aa, Staphylococcus epidermidis
IRKETIA

SEQ ID NO: 1761529 - protein, 6 aa, Staphylococcus epidermidis
IRKHDP

SEQ ID NO: 1761530 - protein, 7 aa, Staphylococcus epidermidis
IRQATTD

SEQ ID NO: 1761531 - protein, 9 aa, Staphylococcus epidermidis
IRQSKNREA

SEQ ID NO: 1761532 - protein, 10 aa, Staphylococcus epidermidis
IRRDPTKPRA

SEQ ID NO: 1761533 - protein, 7 aa, Staphylococcus epidermidis
IRREDER

SEQ ID NO: 1761534 - protein, 8 aa, Staphylococcus epidermidis
IRRGYKSM

SEQ ID NO: 1761535 - protein, 8 aa, Staphylococcus epidermidis
IRSTRQGH

SEQ ID NO: 1761536 - protein, 11 aa, Staphylococcus epidermidis
ISDEERENMKR

SEQ ID NO: 1761537 - protein, 6 aa, Staphylococcus epidermidis
ISDGET

SEQ ID NO: 1761538 - protein, 20 aa, Staphylococcus epidermidis
ISDKYPSELSGGQRQRTSAA

SEQ ID NO: 1761539 - protein, 11 aa, Staphylococcus epidermidis
ISDPEKRRGVA

SEQ ID NO: 1761540 - protein, 4 aa, Staphylococcus epidermidis
ISEE

SEQ ID NO: 1761541 - protein, 6 aa, Staphylococcus epidermidis
ISEEGG

SEQ ID NO: 1761542 - protein, 6 aa, Staphylococcus epidermidis
ISELKQ

SEQ ID NO: 1761543 - protein, 11 aa, Staphylococcus epidermidis
ISEPDENGKRT

SEQ ID NO: 1761544 - protein, 4 aa, Staphylococcus epidermidis
ISES

SEQ ID NO: 1761545 - protein, 9 aa, Staphylococcus epidermidis
ISESSSDQF

SEQ ID NO: 1761546 - protein, 6 aa, Staphylococcus epidermidis
ISESTF

SEQ ID NO: 1761547 - protein, 6 aa, Staphylococcus epidermidis
ISETRK

SEQ ID NO: 1761548 - protein, 7 aa, Staphylococcus epidermidis
ISGIDNN

SEQ ID NO: 1761549 - protein, 7 aa, Staphylococcus epidermidis
ISGKDAE

SEQ ID NO: 1761550 - protein, 5 aa, Staphylococcus epidermidis
ISHQN

SEQ ID NO: 1761551 - protein, 10 aa, Staphylococcus epidermidis
ISKDGQSPEY

SEQ ID NO: 1761552 - protein, 8 aa, Staphylococcus epidermidis
ISKEERAD

SEQ ID NO: 1761553 - protein, 9 aa, Staphylococcus epidermidis
ISKERASEK

SEQ ID NO: 1761554 - protein, 22 aa, Staphylococcus epidermidis
ISKSKNEDAMNMSDDDTNHQFD

SEQ ID NO: 1761555 - protein, 9 aa, Staphylococcus epidermidis
ISNAKQAYE

SEQ ID NO: 1761556 - protein, 12 aa, Staphylococcus epidermidis
ISPKPPSSGMKT

SEQ ID NO: 1761557 - protein, 10 aa, Staphylococcus epidermidis
ISQNGRAAQG

SEQ ID NO: 1761558 - protein, 4 aa, Staphylococcus epidermidis
ISQT

SEQ ID NO: 1761559 - protein, 6 aa, Staphylococcus epidermidis
ISRAEA

SEQ ID NO: 1761560 - protein, 10 aa, Staphylococcus epidermidis
ISRNEQDDFA

SEQ ID NO: 1761561 - protein, 6 aa, Staphylococcus epidermidis
ISSEQL

SEQ ID NO: 1761562 - protein, 8 aa, Staphylococcus epidermidis
ISSQTLQQ

SEQ ID NO: 1761563 - protein, 7 aa, Staphylococcus epidermidis
ISSSDAR

SEQ ID NO: 1761564 - protein, 11 aa, Staphylococcus epidermidis
ISSSPLPSQSA

SEQ ID NO: 1761565 - protein, 7 aa, Staphylococcus epidermidis
ISTSSEH

SEQ ID NO: 1761566 - protein, 7 aa, Staphylococcus epidermidis
ISTVTEL

SEQ ID NO: 1761567 - protein, 6 aa, Staphylococcus epidermidis
ISVPEK

SEQ ID NO: 1761568 - protein, 4 aa, Staphylococcus epidermidis
ISVQ

SEQ ID NO: 1761569 - protein, 4 aa, Staphylococcus epidermidis
ITEE

SEQ ID NO: 1761570 - protein, 6 aa, Staphylococcus epidermidis
ITEENG

SEQ ID NO: 1761571 - protein, 6 aa, Staphylococcus epidermidis
ITEGAR

SEQ ID NO: 1761572 - protein, 8 aa, Staphylococcus epidermidis
ITEKTGAQ

SEQ ID NO: 1761573 - protein, 5 aa, Staphylococcus epidermidis
ITENK

SEQ ID NO: 1761574 - protein, 7 aa, Staphylococcus epidermidis
ITGAPKI

SEQ ID NO: 1761575 - protein, 6 aa, Staphylococcus epidermidis
ITGSGP

SEQ ID NO: 1761576 - protein, 6 aa, Staphylococcus epidermidis
ITINGK

SEQ ID NO: 1761577 - protein, 4 aa, Staphylococcus epidermidis
ITND

SEQ ID NO: 1761578 - protein, 4 aa, Staphylococcus epidermidis
ITNE

SEQ ID NO: 1761579 - protein, 7 aa, Staphylococcus epidermidis
ITNNREV

SEQ ID NO: 1761580 - protein, 16 aa, Staphylococcus epidermidis
ITPDKITNSLTKQERK

SEQ ID NO: 1761581 - protein, 4 aa, Staphylococcus epidermidis
ITPQ

SEQ ID NO: 1761582 - protein, 8 aa, Staphylococcus epidermidis
ITPTKGSV

SEQ ID NO: 1761583 - protein, 8 aa, Staphylococcus epidermidis
ITQGTNND

SEQ ID NO: 1761584 - protein, 17 aa, Staphylococcus epidermidis
ITQHQEDESANPKLNEE

SEQ ID NO: 1761585 - protein, 19 aa, Staphylococcus epidermidis
ITQSEHPIDSYHKIKESWL

SEQ ID NO: 1761586 - protein, 5 aa, Staphylococcus epidermidis
ITQYT

SEQ ID NO: 1761587 - protein, 5 aa, Staphylococcus epidermidis
ITRDN

SEQ ID NO: 1761588 - protein, 7 aa, Staphylococcus epidermidis
ITREASD

SEQ ID NO: 1761589 - protein, 6 aa, Staphylococcus epidermidis
ITSPTK

SEQ ID NO: 1761590 - protein, 4 aa, Staphylococcus epidermidis
ITSR

SEQ ID NO: 1761591 - protein, 5 aa, Staphylococcus epidermidis
ITSSE

SEQ ID NO: 1761592 - protein, 6 aa, Staphylococcus epidermidis
ITTTKG

SEQ ID NO: 1761593 - protein, 5 aa, Staphylococcus epidermidis
IVEGP

SEQ ID NO: 1761594 - protein, 10 aa, Staphylococcus epidermidis
IVEKSNPRNL

SEQ ID NO: 1761595 - protein, 7 aa, Staphylococcus epidermidis
IVGPGNQ

SEQ ID NO: 1761596 - protein, 10 aa, Staphylococcus epidermidis
IVKRSSLSNF

SEQ ID NO: 1761597 - protein, 8 aa, Staphylococcus epidermidis
IVNSETGE

SEQ ID NO: 1761598 - protein, 10 aa, Staphylococcus epidermidis
IVNSGDEDVE

SEQ ID NO: 1761599 - protein, 5 aa, Staphylococcus epidermidis
IYDGT

SEQ ID NO: 1761600 - protein, 9 aa, Staphylococcus epidermidis
IYTEDPKRD

SEQ ID NO: 1761601 - protein, 12 aa, Staphylococcus epidermidis
KAAEELEKDGYS

SEQ ID NO: 1761602 - protein, 13 aa, Staphylococcus epidermidis
KAAEESTKTGRPI

SEQ ID NO: 1761603 - protein, 8 aa, Staphylococcus epidermidis
KAAGKLEN

SEQ ID NO: 1761604 - protein, 8 aa, Staphylococcus epidermidis
KADDSLND

SEQ ID NO: 1761605 - protein, 18 aa, Staphylococcus epidermidis
KADMKNNNATPKIDVDPQ

SEQ ID NO: 1761606 - protein, 6 aa, Staphylococcus epidermidis
KADSRL

SEQ ID NO: 1761607 - protein, 24 aa, Staphylococcus epidermidis
KAEREGKIKPGDTIVEPTSGNTGI

SEQ ID NO: 1761608 - protein, 9 aa, Staphylococcus epidermidis
KAESNTRLS

SEQ ID NO: 1761609 - protein, 22 aa, Staphylococcus epidermidis
KAGYETSAYATEKIGDATFEAE

SEQ ID NO: 1761610 - protein, 5 aa, Staphylococcus epidermidis
KAGYL

SEQ ID NO: 1761611 - protein, 6 aa, Staphylococcus epidermidis
KAHEPG

SEQ ID NO: 1761612 - protein, 12 aa, Staphylococcus epidermidis
KAHSETDIADNA

SEQ ID NO: 1761613 - protein, 7 aa, Staphylococcus epidermidis
KAKEHQL

SEQ ID NO: 1761614 - protein, 6 aa, Staphylococcus epidermidis
KAKEVK

SEQ ID NO: 1761615 - protein, 8 aa, Staphylococcus epidermidis
KAKKDDKY

SEQ ID NO: 1761616 - protein, 8 aa, Staphylococcus epidermidis
KAKKEGYR

SEQ ID NO: 1761617 - protein, 7 aa, Staphylococcus epidermidis
KAKKSTI

SEQ ID NO: 1761618 - protein, 6 aa, Staphylococcus epidermidis
KAKKYQ

SEQ ID NO: 1761619 - protein, 4 aa, Staphylococcus epidermidis
KAKL

SEQ ID NO: 1761620 - protein, 11 aa, Staphylococcus epidermidis
KAKPASAKGTY

SEQ ID NO: 1761621 - protein, 5 aa, Staphylococcus epidermidis
KAKYK

SEQ ID NO: 1761622 - protein, 11 aa, Staphylococcus epidermidis
KALEGDAEYEQ

SEQ ID NO: 1761623 - protein, 10 aa, Staphylococcus epidermidis
KALGTGLGKS

SEQ ID NO: 1761624 - protein, 4 aa, Staphylococcus epidermidis
KALP

SEQ ID NO: 1761625 - protein, 6 aa, Staphylococcus epidermidis
KAMETA

SEQ ID NO: 1761626 - protein, 8 aa, Staphylococcus epidermidis
KANESYQY

SEQ ID NO: 1761627 - protein, 7 aa, Staphylococcus epidermidis
KANKRGI

SEQ ID NO: 1761628 - protein, 5 aa, Staphylococcus epidermidis
KANPF

SEQ ID NO: 1761629 - protein, 20 aa, Staphylococcus epidermidis
KAQKMKHKRPYKAKKKSHRR

SEQ ID NO: 1761630 - protein, 9 aa, Staphylococcus epidermidis
KAQYPDTGL

SEQ ID NO: 1761631 - protein, 17 aa, Staphylococcus epidermidis
KARDEKVSEYGIEQQDG

SEQ ID NO: 1761632 - protein, 16 aa, Staphylococcus epidermidis
KARDGKLTSEEMKGAT

SEQ ID NO: 1761633 - protein, 10 aa, Staphylococcus epidermidis
KAREDDIKDR

SEQ ID NO: 1761634 - protein, 14 aa, Staphylococcus epidermidis
KAREELSSDDLDQN

SEQ ID NO: 1761635 - protein, 6 aa, Staphylococcus epidermidis
KARNIK

SEQ ID NO: 1761636 - protein, 8 aa, Staphylococcus epidermidis
KASAKIAK

SEQ ID NO: 1761637 - protein, 7 aa, Staphylococcus epidermidis
KASEGTI

SEQ ID NO: 1761638 - protein, 8 aa, Staphylococcus epidermidis
KASEHASR

SEQ ID NO: 1761639 - protein, 11 aa, Staphylococcus epidermidis
KASHKEEKNPY

SEQ ID NO: 1761640 - protein, 6 aa, Staphylococcus epidermidis
KASRIR

SEQ ID NO: 1761641 - protein, 9 aa, Staphylococcus epidermidis
KASYEGKVA

SEQ ID NO: 1761642 - protein, 19 aa, Staphylococcus epidermidis
KATQEKFDREKAKGLKPRA

SEQ ID NO: 1761643 - protein, 16 aa, Staphylococcus epidermidis
KATRGNIDVNLNVEVV

SEQ ID NO: 1761644 - protein, 11 aa, Staphylococcus epidermidis
KAVEGLSDDQL

SEQ ID NO: 1761645 - protein, 7 aa, Staphylococcus epidermidis
KAVENEP

SEQ ID NO: 1761646 - protein, 7 aa, Staphylococcus epidermidis
KAVNPQG

SEQ ID NO: 1761647 - protein, 6 aa, Staphylococcus epidermidis
KAVQTD

SEQ ID NO: 1761648 - protein, 6 aa, Staphylococcus epidermidis
KAVSEM

SEQ ID NO: 1761649 - protein, 5 aa, Staphylococcus epidermidis
KAWGA

SEQ ID NO: 1761650 - protein, 14 aa, Staphylococcus epidermidis
KAYAQQQETLGDQM

SEQ ID NO: 1761651 - protein, 12 aa, Staphylococcus epidermidis
KCNNEEELKSGI

SEQ ID NO: 1761652 - protein, 20 aa, Staphylococcus epidermidis
KDAEDNATKNQLKNTTFECG

SEQ ID NO: 1761653 - protein, 8 aa, Staphylococcus epidermidis
KDANSESI

SEQ ID NO: 1761654 - protein, 8 aa, Staphylococcus epidermidis
KDARDVCD

SEQ ID NO: 1761655 - protein, 5 aa, Staphylococcus epidermidis
KDASQ

SEQ ID NO: 1761656 - protein, 12 aa, Staphylococcus epidermidis
KDAVKDSFKHPR

SEQ ID NO: 1761657 - protein, 7 aa, Staphylococcus epidermidis
KDDDNRV

SEQ ID NO: 1761658 - protein, 12 aa, Staphylococcus epidermidis
KDDDTPIHLLEV

SEQ ID NO: 1761659 - protein, 5 aa, Staphylococcus epidermidis
KDDIE

SEQ ID NO: 1761660 - protein, 4 aa, Staphylococcus epidermidis
KDDP

SEQ ID NO: 1761661 - protein, 6 aa, Staphylococcus epidermidis
KDDQED

SEQ ID NO: 1761662 - protein, 9 aa, Staphylococcus epidermidis
KDDTERVKS

SEQ ID NO: 1761663 - protein, 8 aa, Staphylococcus epidermidis
KDDVNKEI

SEQ ID NO: 1761664 - protein, 7 aa, Staphylococcus epidermidis
KDDYSED

SEQ ID NO: 1761665 - protein, 6 aa, Staphylococcus epidermidis
KDEKSL

SEQ ID NO: 1761666 - protein, 7 aa, Staphylococcus epidermidis
KDEPNVT

SEQ ID NO: 1761667 - protein, 7 aa, Staphylococcus epidermidis
KDEQQSI

SEQ ID NO: 1761668 - protein, 5 aa, Staphylococcus epidermidis
KDESI

SEQ ID NO: 1761669 - protein, 5 aa, Staphylococcus epidermidis
KDGDR

SEQ ID NO: 1761670 - protein, 10 aa, Staphylococcus epidermidis
KDGLAKSSRN

SEQ ID NO: 1761671 - protein, 13 aa, Staphylococcus epidermidis
KDGNLTGYGGTLD

SEQ ID NO: 1761672 - protein, 13 aa, Staphylococcus epidermidis
KDHINKCEKVINN

SEQ ID NO: 1761673 - protein, 12 aa, Staphylococcus epidermidis
KDIDNQLNEVDN

SEQ ID NO: 1761674 - protein, 7 aa, Staphylococcus epidermidis
KDIEQSN

SEQ ID NO: 1761675 - protein, 13 aa, Staphylococcus epidermidis
KDILTEEDNYNAM

SEQ ID NO: 1761676 - protein, 5 aa, Staphylococcus epidermidis
KDIQD

SEQ ID NO: 1761677 - protein, 13 aa, Staphylococcus epidermidis
KDKAQKRADGVPA

SEQ ID NO: 1761678 - protein, 7 aa, Staphylococcus epidermidis
KDKDTLR

SEQ ID NO: 1761679 - protein, 7 aa, Staphylococcus epidermidis
KDKELRG

SEQ ID NO: 1761680 - protein, 7 aa, Staphylococcus epidermidis
KDKETIK

SEQ ID NO: 1761681 - protein, 5 aa, Staphylococcus epidermidis
KDKGL

SEQ ID NO: 1761682 - protein, 5 aa, Staphylococcus epidermidis
KDKKA

SEQ ID NO: 1761683 - protein, 11 aa, Staphylococcus epidermidis
KDKKSLTGQYL

SEQ ID NO: 1761684 - protein, 10 aa, Staphylococcus epidermidis
KDKPGIVGQT

SEQ ID NO: 1761685 - protein, 10 aa, Staphylococcus epidermidis
KDKTKKNRAF

SEQ ID NO: 1761686 - protein, 10 aa, Staphylococcus epidermidis
KDKVNDGVSY

SEQ ID NO: 1761687 - protein, 5 aa, Staphylococcus epidermidis
KDLGR

SEQ ID NO: 1761688 - protein, 24 aa, Staphylococcus epidermidis
KDLGTNKEQNITIQSSSSLSDEEI

SEQ ID NO: 1761689 - protein, 4 aa, Staphylococcus epidermidis
KDLS

SEQ ID NO: 1761690 - protein, 7 aa, Staphylococcus epidermidis
KDNALKK

SEQ ID NO: 1761691 - protein, 7 aa, Staphylococcus epidermidis
KDNEIKP

SEQ ID NO: 1761692 - protein, 6 aa, Staphylococcus epidermidis
KDNGRL

SEQ ID NO: 1761693 - protein, 4 aa, Staphylococcus epidermidis
KDNQ

SEQ ID NO: 1761694 - protein, 10 aa, Staphylococcus epidermidis
KDNTLAQQAD

SEQ ID NO: 1761695 - protein, 5 aa, Staphylococcus epidermidis
KDPEI

SEQ ID NO: 1761696 - protein, 7 aa, Staphylococcus epidermidis
KDPIGAM

SEQ ID NO: 1761697 - protein, 8 aa, Staphylococcus epidermidis
KDPNDDKD

SEQ ID NO: 1761698 - protein, 5 aa, Staphylococcus epidermidis
KDPTI

SEQ ID NO: 1761699 - protein, 6 aa, Staphylococcus epidermidis
KDQDFS

SEQ ID NO: 1761700 - protein, 4 aa, Staphylococcus epidermidis
KDQQ

SEQ ID NO: 1761701 - protein, 6 aa, Staphylococcus epidermidis
KDQTYT

SEQ ID NO: 1761702 - protein, 11 aa, Staphylococcus epidermidis
KDRENNPDKQW

SEQ ID NO: 1761703 - protein, 6 aa, Staphylococcus epidermidis
KDSHYP

SEQ ID NO: 1761704 - protein, 10 aa, Staphylococcus epidermidis
KDSKGKVDSD

SEQ ID NO: 1761705 - protein, 11 aa, Staphylococcus epidermidis
KDSNYTATVDE

SEQ ID NO: 1761706 - protein, 5 aa, Staphylococcus epidermidis
KDSPP

SEQ ID NO: 1761707 - protein, 7 aa, Staphylococcus epidermidis
KDSSKLK

SEQ ID NO: 1761708 - protein, 7 aa, Staphylococcus epidermidis
KDSTKYP

SEQ ID NO: 1761709 - protein, 11 aa, Staphylococcus epidermidis
KDTDKSKGQLQ

SEQ ID NO: 1761710 - protein, 6 aa, Staphylococcus epidermidis
KDTDRI

SEQ ID NO: 1761711 - protein, 11 aa, Staphylococcus epidermidis
KDTEPPIPGDL

SEQ ID NO: 1761712 - protein, 8 aa, Staphylococcus epidermidis
KDTGRIKK

SEQ ID NO: 1761713 - protein, 13 aa, Staphylococcus epidermidis
KDTIKKASIASGV

SEQ ID NO: 1761714 - protein, 6 aa, Staphylococcus epidermidis
KDTKEI

SEQ ID NO: 1761715 - protein, 8 aa, Staphylococcus epidermidis
KDTNNQDE

SEQ ID NO: 1761716 - protein, 7 aa, Staphylococcus epidermidis
KDVDHSR

SEQ ID NO: 1761717 - protein, 8 aa, Staphylococcus epidermidis
KDVEAQLG

SEQ ID NO: 1761718 - protein, 7 aa, Staphylococcus epidermidis
KDVQTTL

SEQ ID NO: 1761719 - protein, 7 aa, Staphylococcus epidermidis
KDWSRSQ

SEQ ID NO: 1761720 - protein, 4 aa, Staphylococcus epidermidis
KDYD

SEQ ID NO: 1761721 - protein, 5 aa, Staphylococcus epidermidis
KDYGS

SEQ ID NO: 1761722 - protein, 11 aa, Staphylococcus epidermidis
KDYKKKEDVIA

SEQ ID NO: 1761723 - protein, 6 aa, Staphylococcus epidermidis
KDYLED

SEQ ID NO: 1761724 - protein, 7 aa, Staphylococcus epidermidis
KDYNKAL

SEQ ID NO: 1761725 - protein, 6 aa, Staphylococcus epidermidis
KEAAHR

SEQ ID NO: 1761726 - protein, 8 aa, Staphylococcus epidermidis
KEAAKKCD

SEQ ID NO: 1761727 - protein, 12 aa, Staphylococcus epidermidis
KEADNTEKQTVT

SEQ ID NO: 1761728 - protein, 7 aa, Staphylococcus epidermidis
KEAEEKV

SEQ ID NO: 1761729 - protein, 15 aa, Staphylococcus epidermidis
KEARERALAGEGPTL

SEQ ID NO: 1761730 - protein, 6 aa, Staphylococcus epidermidis
KEASFD

SEQ ID NO: 1761731 - protein, 7 aa, Staphylococcus epidermidis
KEATTLT

SEQ ID NO: 1761732 - protein, 10 aa, Staphylococcus epidermidis
KEAVDANAEA

SEQ ID NO: 1761733 - protein, 11 aa, Staphylococcus epidermidis
KEDAQDIDEDV

SEQ ID NO: 1761734 - protein, 6 aa, Staphylococcus epidermidis
KEDKVK

SEQ ID NO: 1761735 - protein, 7 aa, Staphylococcus epidermidis
KEDNANW

SEQ ID NO: 1761736 - protein, 11 aa, Staphylococcus epidermidis
KEEAAKLAQKV

SEQ ID NO: 1761737 - protein, 10 aa, Staphylococcus epidermidis
KEEEKQEIAP

SEQ ID NO: 1761738 - protein, 6 aa, Staphylococcus epidermidis
KEEIAE

SEQ ID NO: 1761739 - protein, 13 aa, Staphylococcus epidermidis
KEELHEKEDESHV

SEQ ID NO: 1761740 - protein, 12 aa, Staphylococcus epidermidis
KEELRDDVEYGG

SEQ ID NO: 1761741 - protein, 16 aa, Staphylococcus epidermidis
KEENKNIEVTHTKNGT

SEQ ID NO: 1761742 - protein, 7 aa, Staphylococcus epidermidis
KEEQHLK

SEQ ID NO: 1761743 - protein, 6 aa, Staphylococcus epidermidis
KEERFH

SEQ ID NO: 1761744 - protein, 8 aa, Staphylococcus epidermidis
KEETSFNA

SEQ ID NO: 1761745 - protein, 4 aa, Staphylococcus epidermidis
KEFG

SEQ ID NO: 1761746 - protein, 5 aa, Staphylococcus epidermidis
KEFGE

SEQ ID NO: 1761747 - protein, 6 aa, Staphylococcus epidermidis
KEFSDD

SEQ ID NO: 1761748 - protein, 10 aa, Staphylococcus epidermidis
KEFSNDAKIT

SEQ ID NO: 1761749 - protein, 6 aa, Staphylococcus epidermidis
KEFTGK

SEQ ID NO: 1761750 - protein, 5 aa, Staphylococcus epidermidis
KEGAK

SEQ ID NO: 1761751 - protein, 7 aa, Staphylococcus epidermidis
KEGEECG

SEQ ID NO: 1761752 - protein, 14 aa, Staphylococcus epidermidis
KEGIQSNKTKVGDR

SEQ ID NO: 1761753 - protein, 13 aa, Staphylococcus epidermidis
KEGLGTSPKITFT

SEQ ID NO: 1761754 - protein, 8 aa, Staphylococcus epidermidis
KEGQIAGP

SEQ ID NO: 1761755 - protein, 7 aa, Staphylococcus epidermidis
KEGREDE

SEQ ID NO: 1761756 - protein, 10 aa, Staphylococcus epidermidis
KEGRKTTDAL

SEQ ID NO: 1761757 - protein, 4 aa, Staphylococcus epidermidis
KEGT

SEQ ID NO: 1761758 - protein, 7 aa, Staphylococcus epidermidis
KEGTISK

SEQ ID NO: 1761759 - protein, 5 aa, Staphylococcus epidermidis
KEGTV

SEQ ID NO: 1761760 - protein, 4 aa, Staphylococcus epidermidis
KEGY

SEQ ID NO: 1761761 - protein, 8 aa, Staphylococcus epidermidis
KEGYETDG

SEQ ID NO: 1761762 - protein, 6 aa, Staphylococcus epidermidis
KEGYLE

SEQ ID NO: 1761763 - protein, 21 aa, Staphylococcus epidermidis
KEGYVETKHYKGARLTEEGLK

SEQ ID NO: 1761764 - protein, 13 aa, Staphylococcus epidermidis
KEIRETKEGLKSG

SEQ ID NO: 1761765 - protein, 24 aa, Staphylococcus epidermidis
KEKAKTKEIEIPRNKIAKARHAVM

SEQ ID NO: 1761766 - protein, 10 aa, Staphylococcus epidermidis
KEKDSNWAGI

SEQ ID NO: 1761767 - protein, 6 aa, Staphylococcus epidermidis
KEKEKV

SEQ ID NO: 1761768 - protein, 23 aa, Staphylococcus epidermidis
KEKGDLPTTQEELRQRRERAETL

SEQ ID NO: 1761769 - protein, 5 aa, Staphylococcus epidermidis
KEKGK

SEQ ID NO: 1761770 - protein, 6 aa, Staphylococcus epidermidis
KEKVDP

SEQ ID NO: 1761771 - protein, 9 aa, Staphylococcus epidermidis
KELEQQGKG

SEQ ID NO: 1761772 - protein, 6 aa, Staphylococcus epidermidis
KELGTF

SEQ ID NO: 1761773 - protein, 8 aa, Staphylococcus epidermidis
KELSADAA

SEQ ID NO: 1761774 - protein, 8 aa, Staphylococcus epidermidis
KELSRKRD

SEQ ID NO: 1761775 - protein, 8 aa, Staphylococcus epidermidis
KELTEPKI

SEQ ID NO: 1761776 - protein, 27 aa, Staphylococcus epidermidis
KEMRTAHDKIDKNDKMNNPDMEKPESL

SEQ ID NO: 1761777 - protein, 14 aa, Staphylococcus epidermidis
KENAIKKAEELDEL

SEQ ID NO: 1761778 - protein, 4 aa, Staphylococcus epidermidis
KENH

SEQ ID NO: 1761779 - protein, 8 aa, Staphylococcus epidermidis
KENHTSIQ

SEQ ID NO: 1761780 - protein, 5 aa, Staphylococcus epidermidis
KEPEI

SEQ ID NO: 1761781 - protein, 6 aa, Staphylococcus epidermidis
KEPIEV

SEQ ID NO: 1761782 - protein, 11 aa, Staphylococcus epidermidis
KEPLSKDNPLY

SEQ ID NO: 1761783 - protein, 10 aa, Staphylococcus epidermidis
KEPREHSSKE

SEQ ID NO: 1761784 - protein, 10 aa, Staphylococcus epidermidis
KEPSVEPEAR

SEQ ID NO: 1761785 - protein, 7 aa, Staphylococcus epidermidis
KEPYPNY

SEQ ID NO: 1761786 - protein, 5 aa, Staphylococcus epidermidis
KEQFE

SEQ ID NO: 1761787 - protein, 7 aa, Staphylococcus epidermidis
KEQFGEK

SEQ ID NO: 1761788 - protein, 12 aa, Staphylococcus epidermidis
KEQGYEETFREK

SEQ ID NO: 1761789 - protein, 13 aa, Staphylococcus epidermidis
KEQLTEDNVQSIE

SEQ ID NO: 1761790 - protein, 7 aa, Staphylococcus epidermidis
KEQMERA

SEQ ID NO: 1761791 - protein, 5 aa, Staphylococcus epidermidis
KEQNA

SEQ ID NO: 1761792 - protein, 13 aa, Staphylococcus epidermidis
KEQNGAAMSLGRT

SEQ ID NO: 1761793 - protein, 5 aa, Staphylococcus epidermidis
KEQNT

SEQ ID NO: 1761794 - protein, 5 aa, Staphylococcus epidermidis
KEREH

SEQ ID NO: 1761795 - protein, 5 aa, Staphylococcus epidermidis
KERLK

SEQ ID NO: 1761796 - protein, 8 aa, Staphylococcus epidermidis
KERSRKEL

SEQ ID NO: 1761797 - protein, 5 aa, Staphylococcus epidermidis
KERSY

SEQ ID NO: 1761798 - protein, 4 aa, Staphylococcus epidermidis
KERY

SEQ ID NO: 1761799 - protein, 15 aa, Staphylococcus epidermidis
KERYEDKKKNKYKID

SEQ ID NO: 1761800 - protein, 6 aa, Staphylococcus epidermidis
KESEYG

SEQ ID NO: 1761801 - protein, 5 aa, Staphylococcus epidermidis
KESLQ

SEQ ID NO: 1761802 - protein, 8 aa, Staphylococcus epidermidis
KESNLPHG

SEQ ID NO: 1761803 - protein, 8 aa, Staphylococcus epidermidis
KESSEIYG

SEQ ID NO: 1761804 - protein, 6 aa, Staphylococcus epidermidis
KESYEQ

SEQ ID NO: 1761805 - protein, 7 aa, Staphylococcus epidermidis
KETANEI

SEQ ID NO: 1761806 - protein, 4 aa, Staphylococcus epidermidis
KETG

SEQ ID NO: 1761807 - protein, 6 aa, Staphylococcus epidermidis
KETGAA

SEQ ID NO: 1761808 - protein, 6 aa, Staphylococcus epidermidis
KETIND

SEQ ID NO: 1761809 - protein, 8 aa, Staphylococcus epidermidis
KETLEKIS

SEQ ID NO: 1761810 - protein, 6 aa, Staphylococcus epidermidis
KETTQN

SEQ ID NO: 1761811 - protein, 4 aa, Staphylococcus epidermidis
KETY

SEQ ID NO: 1761812 - protein, 5 aa, Staphylococcus epidermidis
KETYP

SEQ ID NO: 1761813 - protein, 13 aa, Staphylococcus epidermidis
KEVEHIANKGAFN

SEQ ID NO: 1761814 - protein, 4 aa, Staphylococcus epidermidis
KEVK

SEQ ID NO: 1761815 - protein, 10 aa, Staphylococcus epidermidis
KEVQKSDDNL

SEQ ID NO: 1761816 - protein, 8 aa, Staphylococcus epidermidis
KEVSDKTI

SEQ ID NO: 1761817 - protein, 8 aa, Staphylococcus epidermidis
KEVSGQPY

SEQ ID NO: 1761818 - protein, 20 aa, Staphylococcus epidermidis
KEWQQKNEKDNKENNEREGL

SEQ ID NO: 1761819 - protein, 14 aa, Staphylococcus epidermidis
KEYEAKFGQEPRAY

SEQ ID NO: 1761820 - protein, 5 aa, Staphylococcus epidermidis
KEYKK

SEQ ID NO: 1761821 - protein, 5 aa, Staphylococcus epidermidis
KEYPN

SEQ ID NO: 1761822 - protein, 17 aa, Staphylococcus epidermidis
KFENEEVQSKAIEASET

SEQ ID NO: 1761823 - protein, 4 aa, Staphylococcus epidermidis
KFGG

SEQ ID NO: 1761824 - protein, 7 aa, Staphylococcus epidermidis
KFGGPKG

SEQ ID NO: 1761825 - protein, 7 aa, Staphylococcus epidermidis
KFKSTYG

SEQ ID NO: 1761826 - protein, 5 aa, Staphylococcus epidermidis
KFNKG

SEQ ID NO: 1761827 - protein, 14 aa, Staphylococcus epidermidis
KGAINQRSSKVADE

SEQ ID NO: 1761828 - protein, 10 aa, Staphylococcus epidermidis
KGAKESSAAR

SEQ ID NO: 1761829 - protein, 6 aa, Staphylococcus epidermidis
KGAYSN

SEQ ID NO: 1761830 - protein, 7 aa, Staphylococcus epidermidis
KGDASKV

SEQ ID NO: 1761831 - protein, 4 aa, Staphylococcus epidermidis
KGDE

SEQ ID NO: 1761832 - protein, 18 aa, Staphylococcus epidermidis
KGDEDAGTSIADMSDDET

SEQ ID NO: 1761833 - protein, 8 aa, Staphylococcus epidermidis
KGDISSPY

SEQ ID NO: 1761834 - protein, 7 aa, Staphylococcus epidermidis
KGEEIAQ

SEQ ID NO: 1761835 - protein, 5 aa, Staphylococcus epidermidis
KGEIP

SEQ ID NO: 1761836 - protein, 8 aa, Staphylococcus epidermidis
KGESTSHT

SEQ ID NO: 1761837 - protein, 8 aa, Staphylococcus epidermidis
KGETHEET

SEQ ID NO: 1761838 - protein, 4 aa, Staphylococcus epidermidis
KGFE

SEQ ID NO: 1761839 - protein, 7 aa, Staphylococcus epidermidis
KGGGGAL

SEQ ID NO: 1761840 - protein, 9 aa, Staphylococcus epidermidis
KGGHQSFEE

SEQ ID NO: 1761841 - protein, 4 aa, Staphylococcus epidermidis
KGGN

SEQ ID NO: 1761842 - protein, 9 aa, Staphylococcus epidermidis
KGGTSRSNI

SEQ ID NO: 1761843 - protein, 14 aa, Staphylococcus epidermidis
KGIDRVNSKTISEA

SEQ ID NO: 1761844 - protein, 8 aa, Staphylococcus epidermidis
KGIGATRA

SEQ ID NO: 1761845 - protein, 6 aa, Staphylococcus epidermidis
KGINEG

SEQ ID NO: 1761846 - protein, 5 aa, Staphylococcus epidermidis
KGISV

SEQ ID NO: 1761847 - protein, 12 aa, Staphylococcus epidermidis
KGKAAHSSMPHL

SEQ ID NO: 1761848 - protein, 18 aa, Staphylococcus epidermidis
KGKDPSEISRKDEVWEGE

SEQ ID NO: 1761849 - protein, 8 aa, Staphylococcus epidermidis
KGKELGAK

SEQ ID NO: 1761850 - protein, 7 aa, Staphylococcus epidermidis
KGKGSNF

SEQ ID NO: 1761851 - protein, 6 aa, Staphylococcus epidermidis
KGKIDE

SEQ ID NO: 1761852 - protein, 12 aa, Staphylococcus epidermidis
KGKKGEVKDVPV

SEQ ID NO: 1761853 - protein, 10 aa, Staphylococcus epidermidis
KGKREPNDVP

SEQ ID NO: 1761854 - protein, 8 aa, Staphylococcus epidermidis
KGKTNKEI

SEQ ID NO: 1761855 - protein, 6 aa, Staphylococcus epidermidis
KGLDKK

SEQ ID NO: 1761856 - protein, 9 aa, Staphylococcus epidermidis
KGLTGSGFE

SEQ ID NO: 1761857 - protein, 4 aa, Staphylococcus epidermidis
KGMI

SEQ ID NO: 1761858 - protein, 9 aa, Staphylococcus epidermidis
KGNLRRINE

SEQ ID NO: 1761859 - protein, 5 aa, Staphylococcus epidermidis
KGNPL

SEQ ID NO: 1761860 - protein, 14 aa, Staphylococcus epidermidis
KGNVEEPEHDGTAE

SEQ ID NO: 1761861 - protein, 10 aa, Staphylococcus epidermidis
KGPLHGGANE

SEQ ID NO: 1761862 - protein, 8 aa, Staphylococcus epidermidis
KGPRESIG

SEQ ID NO: 1761863 - protein, 7 aa, Staphylococcus epidermidis
KGQFRKN

SEQ ID NO: 1761864 - protein, 8 aa, Staphylococcus epidermidis
KGRPSDNP

SEQ ID NO: 1761865 - protein, 15 aa, Staphylococcus epidermidis
KGSRGMKLEEVVDAL

SEQ ID NO: 1761866 - protein, 9 aa, Staphylococcus epidermidis
KGTGPRYCP

SEQ ID NO: 1761867 - protein, 4 aa, Staphylococcus epidermidis
KGTI

SEQ ID NO: 1761868 - protein, 19 aa, Staphylococcus epidermidis
KGYAKQMAPNFTKGGPIES

SEQ ID NO: 1761869 - protein, 5 aa, Staphylococcus epidermidis
KGYDA

SEQ ID NO: 1761870 - protein, 6 aa, Staphylococcus epidermidis
KGYLQD

SEQ ID NO: 1761871 - protein, 5 aa, Staphylococcus epidermidis
KGYRE

SEQ ID NO: 1761872 - protein, 5 aa, Staphylococcus epidermidis
KHEQY

SEQ ID NO: 1761873 - protein, 6 aa, Staphylococcus epidermidis
KHHIPE

SEQ ID NO: 1761874 - protein, 15 aa, Staphylococcus epidermidis
KHLTENLTQTSKEIN

SEQ ID NO: 1761875 - protein, 14 aa, Staphylococcus epidermidis
KHNQVDDYPFGGGQ

SEQ ID NO: 1761876 - protein, 7 aa, Staphylococcus epidermidis
KHNSVET

SEQ ID NO: 1761877 - protein, 4 aa, Staphylococcus epidermidis
KHPK

SEQ ID NO: 1761878 - protein, 9 aa, Staphylococcus epidermidis
KHPTNPYKG

SEQ ID NO: 1761879 - protein, 5 aa, Staphylococcus epidermidis
KHQLA

SEQ ID NO: 1761880 - protein, 14 aa, Staphylococcus epidermidis
KHRYQNDAEIPAEG

SEQ ID NO: 1761881 - protein, 4 aa, Staphylococcus epidermidis
KHVS

SEQ ID NO: 1761882 - protein, 6 aa, Staphylococcus epidermidis
KHYDNG

SEQ ID NO: 1761883 - protein, 5 aa, Staphylococcus epidermidis
KIAEG

SEQ ID NO: 1761884 - protein, 15 aa, Staphylococcus epidermidis
KIDRNAKRVETDKGV

SEQ ID NO: 1761885 - protein, 6 aa, Staphylococcus epidermidis
KIEELK

SEQ ID NO: 1761886 - protein, 11 aa, Staphylococcus epidermidis
KIEKTRDSEAA

SEQ ID NO: 1761887 - protein, 9 aa, Staphylococcus epidermidis
KIERGRSRG

SEQ ID NO: 1761888 - protein, 8 aa, Staphylococcus epidermidis
KIGEEESH

SEQ ID NO: 1761889 - protein, 7 aa, Staphylococcus epidermidis
KIGGEDD

SEQ ID NO: 1761890 - protein, 13 aa, Staphylococcus epidermidis
KIKEANEGMEDAL

SEQ ID NO: 1761891 - protein, 9 aa, Staphylococcus epidermidis
KIKENREEL

SEQ ID NO: 1761892 - protein, 11 aa, Staphylococcus epidermidis
KIKESFSANNN

SEQ ID NO: 1761893 - protein, 8 aa, Staphylococcus epidermidis
KIKESKHI

SEQ ID NO: 1761894 - protein, 7 aa, Staphylococcus epidermidis
KIKETKY

SEQ ID NO: 1761895 - protein, 6 aa, Staphylococcus epidermidis
KIKSSQ

SEQ ID NO: 1761896 - protein, 9 aa, Staphylococcus epidermidis
KINETANSK

SEQ ID NO: 1761897 - protein, 12 aa, Staphylococcus epidermidis
KIQGASDSPLTA

SEQ ID NO: 1761898 - protein, 6 aa, Staphylococcus epidermidis
KIQSKQ

SEQ ID NO: 1761899 - protein, 16 aa, Staphylococcus epidermidis
KIRNDKVNAATGLDEV

SEQ ID NO: 1761900 - protein, 9 aa, Staphylococcus epidermidis
KISDANPEV

SEQ ID NO: 1761901 - protein, 6 aa, Staphylococcus epidermidis
KISEEG

SEQ ID NO: 1761902 - protein, 6 aa, Staphylococcus epidermidis
KISEQY

SEQ ID NO: 1761903 - protein, 7 aa, Staphylococcus epidermidis
KISKDTR

SEQ ID NO: 1761904 - protein, 8 aa, Staphylococcus epidermidis
KISTDGEC

SEQ ID NO: 1761905 - protein, 4 aa, Staphylococcus epidermidis
KITG

SEQ ID NO: 1761906 - protein, 13 aa, Staphylococcus epidermidis
KKAGIYEELLTIK

SEQ ID NO: 1761907 - protein, 6 aa, Staphylococcus epidermidis
KKAGLD

SEQ ID NO: 1761908 - protein, 7 aa, Staphylococcus epidermidis
KKAIQEG

SEQ ID NO: 1761909 - protein, 13 aa, Staphylococcus epidermidis
KKASKESKKPRHV

SEQ ID NO: 1761910 - protein, 14 aa, Staphylococcus epidermidis
KKDFGEENVVGPND

SEQ ID NO: 1761911 - protein, 5 aa, Staphylococcus epidermidis
KKDGI

SEQ ID NO: 1761912 - protein, 9 aa, Staphylococcus epidermidis
KKDITTDSG

SEQ ID NO: 1761913 - protein, 5 aa, Staphylococcus epidermidis
KKDKS

SEQ ID NO: 1761914 - protein, 8 aa, Staphylococcus epidermidis
KKDRYAYS

SEQ ID NO: 1761915 - protein, 6 aa, Staphylococcus epidermidis
KKEELY

SEQ ID NO: 1761916 - protein, 8 aa, Staphylococcus epidermidis
KKEGGDVN

SEQ ID NO: 1761917 - protein, 5 aa, Staphylococcus epidermidis
KKEGQ

SEQ ID NO: 1761918 - protein, 16 aa, Staphylococcus epidermidis
KKEIGKEPHKGVNPDE

SEQ ID NO: 1761919 - protein, 6 aa, Staphylococcus epidermidis
KKEIKR

SEQ ID NO: 1761920 - protein, 7 aa, Staphylococcus epidermidis
KKEISIK

SEQ ID NO: 1761921 - protein, 4 aa, Staphylococcus epidermidis
KKEK

SEQ ID NO: 1761922 - protein, 9 aa, Staphylococcus epidermidis
KKENIHNDA

SEQ ID NO: 1761923 - protein, 7 aa, Staphylococcus epidermidis
KKEQNYI

SEQ ID NO: 1761924 - protein, 10 aa, Staphylococcus epidermidis
KKERKPDRKM

SEQ ID NO: 1761925 - protein, 6 aa, Staphylococcus epidermidis
KKERPD

SEQ ID NO: 1761926 - protein, 7 aa, Staphylococcus epidermidis
KKETDLI

SEQ ID NO: 1761927 - protein, 8 aa, Staphylococcus epidermidis
KKETEKYQ

SEQ ID NO: 1761928 - protein, 9 aa, Staphylococcus epidermidis
KKFNKGDLN

SEQ ID NO: 1761929 - protein, 7 aa, Staphylococcus epidermidis
KKGANRA

SEQ ID NO: 1761930 - protein, 5 aa, Staphylococcus epidermidis
KKGAQ

SEQ ID NO: 1761931 - protein, 19 aa, Staphylococcus epidermidis
KKGNRPGFSNSKAPEQAKD

SEQ ID NO: 1761932 - protein, 5 aa, Staphylococcus epidermidis
KKGQR

SEQ ID NO: 1761933 - protein, 7 aa, Staphylococcus epidermidis
KKGRIER

SEQ ID NO: 1761934 - protein, 13 aa, Staphylococcus epidermidis
KKHLSERQKSYIA

SEQ ID NO: 1761935 - protein, 9 aa, Staphylococcus epidermidis
KKIANDDKW

SEQ ID NO: 1761936 - protein, 10 aa, Staphylococcus epidermidis
KKIENESTPL

SEQ ID NO: 1761937 - protein, 6 aa, Staphylococcus epidermidis
KKIRED

SEQ ID NO: 1761938 - protein, 22 aa, Staphylococcus epidermidis
KKIRENAKVNVERAKEIEQETR

SEQ ID NO: 1761939 - protein, 11 aa, Staphylococcus epidermidis
KKKAAQGNNPL

SEQ ID NO: 1761940 - protein, 9 aa, Staphylococcus epidermidis
KKKGKSSQV

SEQ ID NO: 1761941 - protein, 7 aa, Staphylococcus epidermidis
KKKKEIL

SEQ ID NO: 1761942 - protein, 9 aa, Staphylococcus epidermidis
KKKLSEVET

SEQ ID NO: 1761943 - protein, 8 aa, Staphylococcus epidermidis
KKKTAKKL

SEQ ID NO: 1761944 - protein, 10 aa, Staphylococcus epidermidis
KKLGNAVTRN

SEQ ID NO: 1761945 - protein, 9 aa, Staphylococcus epidermidis
KKLKDYTKD

SEQ ID NO: 1761946 - protein, 5 aa, Staphylococcus epidermidis
KKLPS

SEQ ID NO: 1761947 - protein, 7 aa, Staphylococcus epidermidis
KKNGAKA

SEQ ID NO: 1761948 - protein, 9 aa, Staphylococcus epidermidis
KKNGKEHTV

SEQ ID NO: 1761949 - protein, 15 aa, Staphylococcus epidermidis
KKNGKPVHRYHIPNT

SEQ ID NO: 1761950 - protein, 6 aa, Staphylococcus epidermidis
KKNLGE

SEQ ID NO: 1761951 - protein, 7 aa, Staphylococcus epidermidis
KKNNISI

SEQ ID NO: 1761952 - protein, 6 aa, Staphylococcus epidermidis
KKPANG

SEQ ID NO: 1761953 - protein, 7 aa, Staphylococcus epidermidis
KKPSANI

SEQ ID NO: 1761954 - protein, 4 aa, Staphylococcus epidermidis
KKQG

SEQ ID NO: 1761955 - protein, 6 aa, Staphylococcus epidermidis
KKQGID

SEQ ID NO: 1761956 - protein, 6 aa, Staphylococcus epidermidis
KKQIEN

SEQ ID NO: 1761957 - protein, 10 aa, Staphylococcus epidermidis
KKQKEEGIES

SEQ ID NO: 1761958 - protein, 7 aa, Staphylococcus epidermidis
KKQKPDL

SEQ ID NO: 1761959 - protein, 5 aa, Staphylococcus epidermidis
KKRLK

SEQ ID NO: 1761960 - protein, 7 aa, Staphylococcus epidermidis
KKRRPIE

SEQ ID NO: 1761961 - protein, 9 aa, Staphylococcus epidermidis
KKRSEREAY

SEQ ID NO: 1761962 - protein, 7 aa, Staphylococcus epidermidis
KKRTERE

SEQ ID NO: 1761963 - protein, 4 aa, Staphylococcus epidermidis
KKRY

SEQ ID NO: 1761964 - protein, 6 aa, Staphylococcus epidermidis
KKRYQA

SEQ ID NO: 1761965 - protein, 6 aa, Staphylococcus epidermidis
KKSDID

SEQ ID NO: 1761966 - protein, 9 aa, Staphylococcus epidermidis
KKSGETRPV

SEQ ID NO: 1761967 - protein, 7 aa, Staphylococcus epidermidis
KKSINDY

SEQ ID NO: 1761968 - protein, 5 aa, Staphylococcus epidermidis
KKSMT

SEQ ID NO: 1761969 - protein, 7 aa, Staphylococcus epidermidis
KKSQKVR

SEQ ID NO: 1761970 - protein, 9 aa, Staphylococcus epidermidis
KKTEKGQFT

SEQ ID NO: 1761971 - protein, 16 aa, Staphylococcus epidermidis
KKTGGMFDGEAAGNIG

SEQ ID NO: 1761972 - protein, 6 aa, Staphylococcus epidermidis
KKTGLN

SEQ ID NO: 1761973 - protein, 6 aa, Staphylococcus epidermidis
KKTKEI

SEQ ID NO: 1761974 - protein, 10 aa, Staphylococcus epidermidis
KKTQTQAQDD

SEQ ID NO: 1761975 - protein, 12 aa, Staphylococcus epidermidis
KKVEREVSVETA

SEQ ID NO: 1761976 - protein, 8 aa, Staphylococcus epidermidis
KKVETEQP

SEQ ID NO: 1761977 - protein, 13 aa, Staphylococcus epidermidis
KKYEGKDQQTIDQ

SEQ ID NO: 1761978 - protein, 6 aa, Staphylococcus epidermidis
KLAAKR

SEQ ID NO: 1761979 - protein, 10 aa, Staphylococcus epidermidis
KLAEENNQPM

SEQ ID NO: 1761980 - protein, 7 aa, Staphylococcus epidermidis
KLAKERV

SEQ ID NO: 1761981 - protein, 8 aa, Staphylococcus epidermidis
KLALTQSQ

SEQ ID NO: 1761982 - protein, 10 aa, Staphylococcus epidermidis
KLDETNSQIA

SEQ ID NO: 1761983 - protein, 8 aa, Staphylococcus epidermidis
KLDPTGYE

SEQ ID NO: 1761984 - protein, 4 aa, Staphylococcus epidermidis
KLEP

SEQ ID NO: 1761985 - protein, 6 aa, Staphylococcus epidermidis
KLGGYQ

SEQ ID NO: 1761986 - protein, 7 aa, Staphylococcus epidermidis
KLGSGRQ

SEQ ID NO: 1761987 - protein, 11 aa, Staphylococcus epidermidis
KLINSKDDALM

SEQ ID NO: 1761988 - protein, 7 aa, Staphylococcus epidermidis
KLIPKYP

SEQ ID NO: 1761989 - protein, 9 aa, Staphylococcus epidermidis
KLKPKELKQ

SEQ ID NO: 1761990 - protein, 9 aa, Staphylococcus epidermidis
KLKTRNGYN

SEQ ID NO: 1761991 - protein, 5 aa, Staphylococcus epidermidis
KLNNQ

SEQ ID NO: 1761992 - protein, 6 aa, Staphylococcus epidermidis
KLNSNI

SEQ ID NO: 1761993 - protein, 7 aa, Staphylococcus epidermidis
KLNSNKD

SEQ ID NO: 1761994 - protein, 7 aa, Staphylococcus epidermidis
KLPLSTN

SEQ ID NO: 1761995 - protein, 10 aa, Staphylococcus epidermidis
KLSDDQENEI

SEQ ID NO: 1761996 - protein, 8 aa, Staphylococcus epidermidis
KLSGGEQK

SEQ ID NO: 1761997 - protein, 13 aa, Staphylococcus epidermidis
KLSGSEVNEGDIA

SEQ ID NO: 1761998 - protein, 6 aa, Staphylococcus epidermidis
KLSGVS

SEQ ID NO: 1761999 - protein, 11 aa, Staphylococcus epidermidis
KLSKAKAKQRA

SEQ ID NO: 1762000 - protein, 8 aa, Staphylococcus epidermidis
KLSKDNEH

SEQ ID NO: 1762001 - protein, 7 aa, Staphylococcus epidermidis
KLSNQAV

SEQ ID NO: 1762002 - protein, 9 aa, Staphylococcus epidermidis
KLSQERRRV

SEQ ID NO: 1762003 - protein, 12 aa, Staphylococcus epidermidis
KLSSGKTVDERM

SEQ ID NO: 1762004 - protein, 8 aa, Staphylococcus epidermidis
KLTGKPNT

SEQ ID NO: 1762005 - protein, 15 aa, Staphylococcus epidermidis
KLTNEDAYKRARPSH

SEQ ID NO: 1762006 - protein, 9 aa, Staphylococcus epidermidis
KMKQDPLGD

SEQ ID NO: 1762007 - protein, 9 aa, Staphylococcus epidermidis
KMSAPLGTH

SEQ ID NO: 1762008 - protein, 5 aa, Staphylococcus epidermidis
KNAFN

SEQ ID NO: 1762009 - protein, 9 aa, Staphylococcus epidermidis
KNAGYGTKQ

SEQ ID NO: 1762010 - protein, 8 aa, Staphylococcus epidermidis
KNATHGTK

SEQ ID NO: 1762011 - protein, 9 aa, Staphylococcus epidermidis
KNDAQQPVG

SEQ ID NO: 1762012 - protein, 13 aa, Staphylococcus epidermidis
KNDEGQLENNGRC

SEQ ID NO: 1762013 - protein, 5 aa, Staphylococcus epidermidis
KNDEV

SEQ ID NO: 1762014 - protein, 10 aa, Staphylococcus epidermidis
KNDKTSYSHN

SEQ ID NO: 1762015 - protein, 5 aa, Staphylococcus epidermidis
KNDPF

SEQ ID NO: 1762016 - protein, 9 aa, Staphylococcus epidermidis
KNDSRAQEN

SEQ ID NO: 1762017 - protein, 6 aa, Staphylococcus epidermidis
KNDYNG

SEQ ID NO: 1762018 - protein, 10 aa, Staphylococcus epidermidis
KNEEKINQSA

SEQ ID NO: 1762019 - protein, 7 aa, Staphylococcus epidermidis
KNEKARK

SEQ ID NO: 1762020 - protein, 6 aa, Staphylococcus epidermidis
KNEKKI

SEQ ID NO: 1762021 - protein, 6 aa, Staphylococcus epidermidis
KNELKK

SEQ ID NO: 1762022 - protein, 9 aa, Staphylococcus epidermidis
KNENDMPNG

SEQ ID NO: 1762023 - protein, 6 aa, Staphylococcus epidermidis
KNENEK

SEQ ID NO: 1762024 - protein, 8 aa, Staphylococcus epidermidis
KNFSGDPK

SEQ ID NO: 1762025 - protein, 10 aa, Staphylococcus epidermidis
KNGDFDSNKI

SEQ ID NO: 1762026 - protein, 13 aa, Staphylococcus epidermidis
KNGEEGLKGTIRN

SEQ ID NO: 1762027 - protein, 9 aa, Staphylococcus epidermidis
KNGGIPATG

SEQ ID NO: 1762028 - protein, 8 aa, Staphylococcus epidermidis
KNGNADDF

SEQ ID NO: 1762029 - protein, 8 aa, Staphylococcus epidermidis
KNHEREAE

SEQ ID NO: 1762030 - protein, 6 aa, Staphylococcus epidermidis
KNHQGD

SEQ ID NO: 1762031 - protein, 8 aa, Staphylococcus epidermidis
KNIARPKD

SEQ ID NO: 1762032 - protein, 6 aa, Staphylococcus epidermidis
KNIKEL

SEQ ID NO: 1762033 - protein, 7 aa, Staphylococcus epidermidis
KNITPQT

SEQ ID NO: 1762034 - protein, 8 aa, Staphylococcus epidermidis
KNKERSLY

SEQ ID NO: 1762035 - protein, 8 aa, Staphylococcus epidermidis
KNKGPFND

SEQ ID NO: 1762036 - protein, 6 aa, Staphylococcus epidermidis
KNKKEA

SEQ ID NO: 1762037 - protein, 10 aa, Staphylococcus epidermidis
KNKKSYYDYE

SEQ ID NO: 1762038 - protein, 13 aa, Staphylococcus epidermidis
KNKQKQLNKEVQE

SEQ ID NO: 1762039 - protein, 5 aa, Staphylococcus epidermidis
KNKTD

SEQ ID NO: 1762040 - protein, 6 aa, Staphylococcus epidermidis
KNLPPK

SEQ ID NO: 1762041 - protein, 10 aa, Staphylococcus epidermidis
KNMSELENNQ

SEQ ID NO: 1762042 - protein, 8 aa, Staphylococcus epidermidis
KNNAGGTC

SEQ ID NO: 1762043 - protein, 7 aa, Staphylococcus epidermidis
KNNHSTI

SEQ ID NO: 1762044 - protein, 4 aa, Staphylococcus epidermidis
KNNI

SEQ ID NO: 1762045 - protein, 7 aa, Staphylococcus epidermidis
KNNQGLK

SEQ ID NO: 1762046 - protein, 18 aa, Staphylococcus epidermidis
KNNTTKELTQKAKSLKLT

SEQ ID NO: 1762047 - protein, 6 aa, Staphylococcus epidermidis
KNPDYE

SEQ ID NO: 1762048 - protein, 6 aa, Staphylococcus epidermidis
KNPEHV

SEQ ID NO: 1762049 - protein, 26 aa, Staphylococcus epidermidis
KNPELHSKENIGVNKPNTEGNKPAWF

SEQ ID NO: 1762050 - protein, 9 aa, Staphylococcus epidermidis
KNPGGGLAK

SEQ ID NO: 1762051 - protein, 4 aa, Staphylococcus epidermidis
KNPL

SEQ ID NO: 1762052 - protein, 8 aa, Staphylococcus epidermidis
KNPNAYGH

SEQ ID NO: 1762053 - protein, 10 aa, Staphylococcus epidermidis
KNPPKEWRKS

SEQ ID NO: 1762054 - protein, 6 aa, Staphylococcus epidermidis
KNQELN

SEQ ID NO: 1762055 - protein, 10 aa, Staphylococcus epidermidis
KNQGNQKKLS

SEQ ID NO: 1762056 - protein, 5 aa, Staphylococcus epidermidis
KNQTE

SEQ ID NO: 1762057 - protein, 5 aa, Staphylococcus epidermidis
KNRKH

SEQ ID NO: 1762058 - protein, 16 aa, Staphylococcus epidermidis
KNRKSSRKNRENKDNW

SEQ ID NO: 1762059 - protein, 4 aa, Staphylococcus epidermidis
KNRS

SEQ ID NO: 1762060 - protein, 9 aa, Staphylococcus epidermidis
KNSAYLGTN

SEQ ID NO: 1762061 - protein, 12 aa, Staphylococcus epidermidis
KNSDPDSEVAET

SEQ ID NO: 1762062 - protein, 10 aa, Staphylococcus epidermidis
KNSIEKSGKM

SEQ ID NO: 1762063 - protein, 4 aa, Staphylococcus epidermidis
KNSQ

SEQ ID NO: 1762064 - protein, 5 aa, Staphylococcus epidermidis
KNTQI

SEQ ID NO: 1762065 - protein, 6 aa, Staphylococcus epidermidis
KNVKKG

SEQ ID NO: 1762066 - protein, 15 aa, Staphylococcus epidermidis
KPELTLEEQGEKYNP

SEQ ID NO: 1762067 - protein, 5 aa, Staphylococcus epidermidis
KPENI

SEQ ID NO: 1762068 - protein, 11 aa, Staphylococcus epidermidis
KPFKGNKSSLK

SEQ ID NO: 1762069 - protein, 8 aa, Staphylococcus epidermidis
KPFPQEPL

SEQ ID NO: 1762070 - protein, 6 aa, Staphylococcus epidermidis
KPFSPR

SEQ ID NO: 1762071 - protein, 5 aa, Staphylococcus epidermidis
KPFVT

SEQ ID NO: 1762072 - protein, 14 aa, Staphylococcus epidermidis
KPGFEDKKKELENR

SEQ ID NO: 1762073 - protein, 6 aa, Staphylococcus epidermidis
KPHGGE

SEQ ID NO: 1762074 - protein, 13 aa, Staphylococcus epidermidis
KPIGKMPPNKRKV

SEQ ID NO: 1762075 - protein, 5 aa, Staphylococcus epidermidis
KPINR

SEQ ID NO: 1762076 - protein, 11 aa, Staphylococcus epidermidis
KPIQHRSSYGL

SEQ ID NO: 1762077 - protein, 8 aa, Staphylococcus epidermidis
KPIRNEEG

SEQ ID NO: 1762078 - protein, 6 aa, Staphylococcus epidermidis
KPISDY

SEQ ID NO: 1762079 - protein, 5 aa, Staphylococcus epidermidis
KPISE

SEQ ID NO: 1762080 - protein, 5 aa, Staphylococcus epidermidis
KPISG

SEQ ID NO: 1762081 - protein, 6 aa, Staphylococcus epidermidis
KPIVKD

SEQ ID NO: 1762082 - protein, 10 aa, Staphylococcus epidermidis
KPKDFSSKSL

SEQ ID NO: 1762083 - protein, 4 aa, Staphylococcus epidermidis
KPKR

SEQ ID NO: 1762084 - protein, 5 aa, Staphylococcus epidermidis
KPLPE

SEQ ID NO: 1762085 - protein, 5 aa, Staphylococcus epidermidis
KPLPL

SEQ ID NO: 1762086 - protein, 5 aa, Staphylococcus epidermidis
KPMGK

SEQ ID NO: 1762087 - protein, 7 aa, Staphylococcus epidermidis
KPNEHTQ

SEQ ID NO: 1762088 - protein, 4 aa, Staphylococcus epidermidis
KPNQ

SEQ ID NO: 1762089 - protein, 6 aa, Staphylococcus epidermidis
KPRKVN

SEQ ID NO: 1762090 - protein, 6 aa, Staphylococcus epidermidis
KPRSGY

SEQ ID NO: 1762091 - protein, 6 aa, Staphylococcus epidermidis
KPSELT

SEQ ID NO: 1762092 - protein, 7 aa, Staphylococcus epidermidis
KPSQYPN

SEQ ID NO: 1762093 - protein, 7 aa, Staphylococcus epidermidis
KPSRYSS

SEQ ID NO: 1762094 - protein, 9 aa, Staphylococcus epidermidis
KPSTLNGAE

SEQ ID NO: 1762095 - protein, 6 aa, Staphylococcus epidermidis
KPTDYE

SEQ ID NO: 1762096 - protein, 8 aa, Staphylococcus epidermidis
KPTEGSTY

SEQ ID NO: 1762097 - protein, 6 aa, Staphylococcus epidermidis
KPTFSD

SEQ ID NO: 1762098 - protein, 5 aa, Staphylococcus epidermidis
KPTGI

SEQ ID NO: 1762099 - protein, 8 aa, Staphylococcus epidermidis
KPTTGSVN

SEQ ID NO: 1762100 - protein, 5 aa, Staphylococcus epidermidis
KPVKD

SEQ ID NO: 1762101 - protein, 5 aa, Staphylococcus epidermidis
KQAGV

SEQ ID NO: 1762102 - protein, 10 aa, Staphylococcus epidermidis
KQAKSSISED

SEQ ID NO: 1762103 - protein, 7 aa, Staphylococcus epidermidis
KQALENN

SEQ ID NO: 1762104 - protein, 24 aa, Staphylococcus epidermidis
KQDKYEEYTVREDDRLELLEIVGG

SEQ ID NO: 1762105 - protein, 13 aa, Staphylococcus epidermidis
KQEMDSEKISTTA

SEQ ID NO: 1762106 - protein, 6 aa, Staphylococcus epidermidis
KQFPNE

SEQ ID NO: 1762107 - protein, 14 aa, Staphylococcus epidermidis
KQGAYDIIKKLNEA

SEQ ID NO: 1762108 - protein, 9 aa, Staphylococcus epidermidis
KQGEPFNGH

SEQ ID NO: 1762109 - protein, 8 aa, Staphylococcus epidermidis
KQGSHATL

SEQ ID NO: 1762110 - protein, 7 aa, Staphylococcus epidermidis
KQGTSEV

SEQ ID NO: 1762111 - protein, 8 aa, Staphylococcus epidermidis
KQIEEKSK

SEQ ID NO: 1762112 - protein, 5 aa, Staphylococcus epidermidis
KQKQV

SEQ ID NO: 1762113 - protein, 6 aa, Staphylococcus epidermidis
KQLGTA

SEQ ID NO: 1762114 - protein, 13 aa, Staphylococcus epidermidis
KQLPKGRKPIKTS

SEQ ID NO: 1762115 - protein, 30 aa, Staphylococcus epidermidis
KQMQGEEIPEEDLQKAQEQAQAIEKDENIS

SEQ ID NO: 1762116 - protein, 13 aa, Staphylococcus epidermidis
KQNDSADTEGIEP

SEQ ID NO: 1762117 - protein, 8 aa, Staphylococcus epidermidis
KQNEPKNF

SEQ ID NO: 1762118 - protein, 4 aa, Staphylococcus epidermidis
KQNI

SEQ ID NO: 1762119 - protein, 12 aa, Staphylococcus epidermidis
KQPDLNWENPDV

SEQ ID NO: 1762120 - protein, 7 aa, Staphylococcus epidermidis
KQPPLKA

SEQ ID NO: 1762121 - protein, 13 aa, Staphylococcus epidermidis
KQPSEMTGESLIK

SEQ ID NO: 1762122 - protein, 9 aa, Staphylococcus epidermidis
KQQRDENLD

SEQ ID NO: 1762123 - protein, 6 aa, Staphylococcus epidermidis
KQRERG

SEQ ID NO: 1762124 - protein, 8 aa, Staphylococcus epidermidis
KQRKGNIK

SEQ ID NO: 1762125 - protein, 5 aa, Staphylococcus epidermidis
KQRLR

SEQ ID NO: 1762126 - protein, 4 aa, Staphylococcus epidermidis
KQRQ

SEQ ID NO: 1762127 - protein, 7 aa, Staphylococcus epidermidis
KQSGKQV

SEQ ID NO: 1762128 - protein, 4 aa, Staphylococcus epidermidis
KQSM

SEQ ID NO: 1762129 - protein, 9 aa, Staphylococcus epidermidis
KQSNGYEET

SEQ ID NO: 1762130 - protein, 5 aa, Staphylococcus epidermidis
KQTAR

SEQ ID NO: 1762131 - protein, 22 aa, Staphylococcus epidermidis
KQTEQQNKHKHQPKKKTGLSYK

SEQ ID NO: 1762132 - protein, 4 aa, Staphylococcus epidermidis
KQTG

SEQ ID NO: 1762133 - protein, 7 aa, Staphylococcus epidermidis
KQTNQQT

SEQ ID NO: 1762134 - protein, 6 aa, Staphylococcus epidermidis
KQTTTQ

SEQ ID NO: 1762135 - protein, 10 aa, Staphylococcus epidermidis
KQTVENGVRK

SEQ ID NO: 1762136 - protein, 6 aa, Staphylococcus epidermidis
KQVDGE

SEQ ID NO: 1762137 - protein, 11 aa, Staphylococcus epidermidis
KQYEVGEHNSP

SEQ ID NO: 1762138 - protein, 5 aa, Staphylococcus epidermidis
KQYPN

SEQ ID NO: 1762139 - protein, 7 aa, Staphylococcus epidermidis
KRAEEGI

SEQ ID NO: 1762140 - protein, 15 aa, Staphylococcus epidermidis
KRAFDNDQGPNTGGM

SEQ ID NO: 1762141 - protein, 5 aa, Staphylococcus epidermidis
KRAGA

SEQ ID NO: 1762142 - protein, 8 aa, Staphylococcus epidermidis
KRDGFSTH

SEQ ID NO: 1762143 - protein, 6 aa, Staphylococcus epidermidis
KRDTQI

SEQ ID NO: 1762144 - protein, 8 aa, Staphylococcus epidermidis
KRGPATNP

SEQ ID NO: 1762145 - protein, 9 aa, Staphylococcus epidermidis
KRGSVRTNE

SEQ ID NO: 1762146 - protein, 7 aa, Staphylococcus epidermidis
KRHPYDQ

SEQ ID NO: 1762147 - protein, 7 aa, Staphylococcus epidermidis
KRIDNGT

SEQ ID NO: 1762148 - protein, 6 aa, Staphylococcus epidermidis
KRIKEE

SEQ ID NO: 1762149 - protein, 8 aa, Staphylococcus epidermidis
KRIQNSEK

SEQ ID NO: 1762150 - protein, 8 aa, Staphylococcus epidermidis
KRKAESIQ

SEQ ID NO: 1762151 - protein, 5 aa, Staphylococcus epidermidis
KRKDI

SEQ ID NO: 1762152 - protein, 7 aa, Staphylococcus epidermidis
KRKKEQF

SEQ ID NO: 1762153 - protein, 6 aa, Staphylococcus epidermidis
KRKNAT

SEQ ID NO: 1762154 - protein, 4 aa, Staphylococcus epidermidis
KRLE

SEQ ID NO: 1762155 - protein, 5 aa, Staphylococcus epidermidis
KRLRN

SEQ ID NO: 1762156 - protein, 5 aa, Staphylococcus epidermidis
KRNEI

SEQ ID NO: 1762157 - protein, 7 aa, Staphylococcus epidermidis
KRNENRT

SEQ ID NO: 1762158 - protein, 5 aa, Staphylococcus epidermidis
KRQGT

SEQ ID NO: 1762159 - protein, 11 aa, Staphylococcus epidermidis
KRQMEREDEAT

SEQ ID NO: 1762160 - protein, 7 aa, Staphylococcus epidermidis
KRRGKVR

SEQ ID NO: 1762161 - protein, 10 aa, Staphylococcus epidermidis
KRTEKKLNKR

SEQ ID NO: 1762162 - protein, 5 aa, Staphylococcus epidermidis
KRTLS

SEQ ID NO: 1762163 - protein, 7 aa, Staphylococcus epidermidis
KRTRQTY

SEQ ID NO: 1762164 - protein, 7 aa, Staphylococcus epidermidis
KRTTSYE

SEQ ID NO: 1762165 - protein, 8 aa, Staphylococcus epidermidis
KRTTVSRK

SEQ ID NO: 1762166 - protein, 10 aa, Staphylococcus epidermidis
KRWDREERAY

SEQ ID NO: 1762167 - protein, 8 aa, Staphylococcus epidermidis
KRWTSSHK

SEQ ID NO: 1762168 - protein, 8 aa, Staphylococcus epidermidis
KRYRTVDE

SEQ ID NO: 1762169 - protein, 6 aa, Staphylococcus epidermidis
KSAIAH

SEQ ID NO: 1762170 - protein, 16 aa, Staphylococcus epidermidis
KSARNRVKDIEYTQHL

SEQ ID NO: 1762171 - protein, 5 aa, Staphylococcus epidermidis
KSDHN

SEQ ID NO: 1762172 - protein, 10 aa, Staphylococcus epidermidis
KSDKKPPYQG

SEQ ID NO: 1762173 - protein, 8 aa, Staphylococcus epidermidis
KSDQPLKQ

SEQ ID NO: 1762174 - protein, 6 aa, Staphylococcus epidermidis
KSDYEA

SEQ ID NO: 1762175 - protein, 11 aa, Staphylococcus epidermidis
KSEDDHEMEEE

SEQ ID NO: 1762176 - protein, 5 aa, Staphylococcus epidermidis
KSEGN

SEQ ID NO: 1762177 - protein, 6 aa, Staphylococcus epidermidis
KSEPQL

SEQ ID NO: 1762178 - protein, 10 aa, Staphylococcus epidermidis
KSESDAREAG

SEQ ID NO: 1762179 - protein, 9 aa, Staphylococcus epidermidis
KSETPPFSI

SEQ ID NO: 1762180 - protein, 7 aa, Staphylococcus epidermidis
KSETYDK

SEQ ID NO: 1762181 - protein, 4 aa, Staphylococcus epidermidis
KSEV

SEQ ID NO: 1762182 - protein, 5 aa, Staphylococcus epidermidis
KSEYS

SEQ ID NO: 1762183 - protein, 10 aa, Staphylococcus epidermidis
KSFQRYNNKE

SEQ ID NO: 1762184 - protein, 7 aa, Staphylococcus epidermidis
KSFTDAD

SEQ ID NO: 1762185 - protein, 9 aa, Staphylococcus epidermidis
KSGEKIPRG

SEQ ID NO: 1762186 - protein, 12 aa, Staphylococcus epidermidis
KSGEPNPESNQT

SEQ ID NO: 1762187 - protein, 7 aa, Staphylococcus epidermidis
KSGMSIE

SEQ ID NO: 1762188 - protein, 17 aa, Staphylococcus epidermidis
KSGQETEINAPGPKVTH

SEQ ID NO: 1762189 - protein, 9 aa, Staphylococcus epidermidis
KSGTTTEPA

SEQ ID NO: 1762190 - protein, 12 aa, Staphylococcus epidermidis
KSIDEVNTKAFE

SEQ ID NO: 1762191 - protein, 5 aa, Staphylococcus epidermidis
KSIGQ

SEQ ID NO: 1762192 - protein, 9 aa, Staphylococcus epidermidis
KSIRNQGLG

SEQ ID NO: 1762193 - protein, 13 aa, Staphylococcus epidermidis
KSIRRGSANLKDS

SEQ ID NO: 1762194 - protein, 13 aa, Staphylococcus epidermidis
KSISTNKDLSAFI

SEQ ID NO: 1762195 - protein, 10 aa, Staphylococcus epidermidis
KSKDSNFDEG

SEQ ID NO: 1762196 - protein, 7 aa, Staphylococcus epidermidis
KSKEITA

SEQ ID NO: 1762197 - protein, 8 aa, Staphylococcus epidermidis
KSKESQQA

SEQ ID NO: 1762198 - protein, 11 aa, Staphylococcus epidermidis
KSKSPSVPQLP

SEQ ID NO: 1762199 - protein, 6 aa, Staphylococcus epidermidis
KSLDDG

SEQ ID NO: 1762200 - protein, 20 aa, Staphylococcus epidermidis
KSLKRTPSFSVNRPGEETGI

SEQ ID NO: 1762201 - protein, 10 aa, Staphylococcus epidermidis
KSLTNQVKAG

SEQ ID NO: 1762202 - protein, 5 aa, Staphylococcus epidermidis
KSMQE

SEQ ID NO: 1762203 - protein, 8 aa, Staphylococcus epidermidis
KSNEMNDE

SEQ ID NO: 1762204 - protein, 4 aa, Staphylococcus epidermidis
KSNG

SEQ ID NO: 1762205 - protein, 51 aa, Staphylococcus epidermidis
KSNKKENDEVAPEAPREESYEDRENHLEDEQQTEGKAKEESKFKKLMKSLF

SEQ ID NO: 1762206 - protein, 6 aa, Staphylococcus epidermidis
KSNLST

SEQ ID NO: 1762207 - protein, 16 aa, Staphylococcus epidermidis
KSNQLSINDAKAQLSH

SEQ ID NO: 1762208 - protein, 6 aa, Staphylococcus epidermidis
KSNSDR

SEQ ID NO: 1762209 - protein, 5 aa, Staphylococcus epidermidis
KSNVS

SEQ ID NO: 1762210 - protein, 13 aa, Staphylococcus epidermidis
KSPGMPPGANTIN

SEQ ID NO: 1762211 - protein, 6 aa, Staphylococcus epidermidis
KSPKQY

SEQ ID NO: 1762212 - protein, 8 aa, Staphylococcus epidermidis
KSPSDVQK

SEQ ID NO: 1762213 - protein, 10 aa, Staphylococcus epidermidis
KSPSPDEEAY

SEQ ID NO: 1762214 - protein, 8 aa, Staphylococcus epidermidis
KSQEGNGY

SEQ ID NO: 1762215 - protein, 7 aa, Staphylococcus epidermidis
KSQLRTD

SEQ ID NO: 1762216 - protein, 9 aa, Staphylococcus epidermidis
KSQNTFSKH

SEQ ID NO: 1762217 - protein, 14 aa, Staphylococcus epidermidis
KSQQAEKEGQQAQI

SEQ ID NO: 1762218 - protein, 14 aa, Staphylococcus epidermidis
KSQSQETVSDLEGS

SEQ ID NO: 1762219 - protein, 9 aa, Staphylococcus epidermidis
KSQVEGEEA

SEQ ID NO: 1762220 - protein, 7 aa, Staphylococcus epidermidis
KSREKNI

SEQ ID NO: 1762221 - protein, 21 aa, Staphylococcus epidermidis
KSRGEHKGKIEGEVKSIEKHS

SEQ ID NO: 1762222 - protein, 9 aa, Staphylococcus epidermidis
KSSESSATL

SEQ ID NO: 1762223 - protein, 8 aa, Staphylococcus epidermidis
KSSEVPSA

SEQ ID NO: 1762224 - protein, 7 aa, Staphylococcus epidermidis
KSSVSIQ

SEQ ID NO: 1762225 - protein, 11 aa, Staphylococcus epidermidis
KSTAENYLGDT

SEQ ID NO: 1762226 - protein, 5 aa, Staphylococcus epidermidis
KSTLK

SEQ ID NO: 1762227 - protein, 8 aa, Staphylococcus epidermidis
KSTQPIEG

SEQ ID NO: 1762228 - protein, 6 aa, Staphylococcus epidermidis
KSTRKQ

SEQ ID NO: 1762229 - protein, 5 aa, Staphylococcus epidermidis
KSTRL

SEQ ID NO: 1762230 - protein, 9 aa, Staphylococcus epidermidis
KSTSKMKQI

SEQ ID NO: 1762231 - protein, 9 aa, Staphylococcus epidermidis
KSVDEPLQT

SEQ ID NO: 1762232 - protein, 9 aa, Staphylococcus epidermidis
KSVEDKGDY

SEQ ID NO: 1762233 - protein, 5 aa, Staphylococcus epidermidis
KSVRQ

SEQ ID NO: 1762234 - protein, 4 aa, Staphylococcus epidermidis
KSWE

SEQ ID NO: 1762235 - protein, 8 aa, Staphylococcus epidermidis
KSYKNSEF

SEQ ID NO: 1762236 - protein, 8 aa, Staphylococcus epidermidis
KSYRGKGY

SEQ ID NO: 1762237 - protein, 13 aa, Staphylococcus epidermidis
KSYVSAKSQAKTL

SEQ ID NO: 1762238 - protein, 5 aa, Staphylococcus epidermidis
KTAGI

SEQ ID NO: 1762239 - protein, 6 aa, Staphylococcus epidermidis
KTDEGL

SEQ ID NO: 1762240 - protein, 8 aa, Staphylococcus epidermidis
KTDHGNEI

SEQ ID NO: 1762241 - protein, 6 aa, Staphylococcus epidermidis
KTEAGH

SEQ ID NO: 1762242 - protein, 6 aa, Staphylococcus epidermidis
KTEMSS

SEQ ID NO: 1762243 - protein, 5 aa, Staphylococcus epidermidis
KTESL

SEQ ID NO: 1762244 - protein, 15 aa, Staphylococcus epidermidis
KTEYRGREATDFKED

SEQ ID NO: 1762245 - protein, 12 aa, Staphylococcus epidermidis
KTFKTNDNLGQK

SEQ ID NO: 1762246 - protein, 13 aa, Staphylococcus epidermidis
KTGEVQQPDTGCV

SEQ ID NO: 1762247 - protein, 13 aa, Staphylococcus epidermidis
KTGKYTGRSPKDK

SEQ ID NO: 1762248 - protein, 7 aa, Staphylococcus epidermidis
KTGLTDE

SEQ ID NO: 1762249 - protein, 9 aa, Staphylococcus epidermidis
KTGQYRKAT

SEQ ID NO: 1762250 - protein, 4 aa, Staphylococcus epidermidis
KTGV

SEQ ID NO: 1762251 - protein, 6 aa, Staphylococcus epidermidis
KTHNQG

SEQ ID NO: 1762252 - protein, 7 aa, Staphylococcus epidermidis
KTIDELK

SEQ ID NO: 1762253 - protein, 9 aa, Staphylococcus epidermidis
KTKPNSKIN

SEQ ID NO: 1762254 - protein, 13 aa, Staphylococcus epidermidis
KTLEDTYDSIKHL

SEQ ID NO: 1762255 - protein, 4 aa, Staphylococcus epidermidis
KTMK

SEQ ID NO: 1762256 - protein, 7 aa, Staphylococcus epidermidis
KTMNLPN

SEQ ID NO: 1762257 - protein, 8 aa, Staphylococcus epidermidis
KTNPKGTI

SEQ ID NO: 1762258 - protein, 13 aa, Staphylococcus epidermidis
KTNTSKLKEIEQS

SEQ ID NO: 1762259 - protein, 6 aa, Staphylococcus epidermidis
KTPFNQ

SEQ ID NO: 1762260 - protein, 5 aa, Staphylococcus epidermidis
KTPLF

SEQ ID NO: 1762261 - protein, 10 aa, Staphylococcus epidermidis
KTPVKYASKE

SEQ ID NO: 1762262 - protein, 13 aa, Staphylococcus epidermidis
KTQEAHLKNEHEE

SEQ ID NO: 1762263 - protein, 7 aa, Staphylococcus epidermidis
KTQEHDT

SEQ ID NO: 1762264 - protein, 10 aa, Staphylococcus epidermidis
KTQPQTVQNV

SEQ ID NO: 1762265 - protein, 5 aa, Staphylococcus epidermidis
KTRDE

SEQ ID NO: 1762266 - protein, 8 aa, Staphylococcus epidermidis
KTSQNTGT

SEQ ID NO: 1762267 - protein, 9 aa, Staphylococcus epidermidis
KTSSIQYEN

SEQ ID NO: 1762268 - protein, 8 aa, Staphylococcus epidermidis
KTSSKDMA

SEQ ID NO: 1762269 - protein, 11 aa, Staphylococcus epidermidis
KTTDASAVTTP

SEQ ID NO: 1762270 - protein, 11 aa, Staphylococcus epidermidis
KTTHKNLKGPD

SEQ ID NO: 1762271 - protein, 9 aa, Staphylococcus epidermidis
KTTPSTNKD

SEQ ID NO: 1762272 - protein, 5 aa, Staphylococcus epidermidis
KTVQT

SEQ ID NO: 1762273 - protein, 5 aa, Staphylococcus epidermidis
KTYVS

SEQ ID NO: 1762274 - protein, 17 aa, Staphylococcus epidermidis
KVARAGKKDVDKAVQAA

SEQ ID NO: 1762275 - protein, 13 aa, Staphylococcus epidermidis
KVDGTVVQTEDEI

SEQ ID NO: 1762276 - protein, 5 aa, Staphylococcus epidermidis
KVERN

SEQ ID NO: 1762277 - protein, 13 aa, Staphylococcus epidermidis
KVETPNVKTAQEV

SEQ ID NO: 1762278 - protein, 6 aa, Staphylococcus epidermidis
KVGDDA

SEQ ID NO: 1762279 - protein, 17 aa, Staphylococcus epidermidis
KVGEETKQAATKEAEAV

SEQ ID NO: 1762280 - protein, 4 aa, Staphylococcus epidermidis
KVGF

SEQ ID NO: 1762281 - protein, 7 aa, Staphylococcus epidermidis
KVGYSTR

SEQ ID NO: 1762282 - protein, 10 aa, Staphylococcus epidermidis
KVKNEKDAAV

SEQ ID NO: 1762283 - protein, 6 aa, Staphylococcus epidermidis
KVKPGC

SEQ ID NO: 1762284 - protein, 12 aa, Staphylococcus epidermidis
KVKPGTKLSNIG

SEQ ID NO: 1762285 - protein, 7 aa, Staphylococcus epidermidis
KVNADED

SEQ ID NO: 1762286 - protein, 5 aa, Staphylococcus epidermidis
KVNEA

SEQ ID NO: 1762287 - protein, 8 aa, Staphylococcus epidermidis
KVQQQYQE

SEQ ID NO: 1762288 - protein, 6 aa, Staphylococcus epidermidis
KVRDSI

SEQ ID NO: 1762289 - protein, 7 aa, Staphylococcus epidermidis
KVSKVSE

SEQ ID NO: 1762290 - protein, 10 aa, Staphylococcus epidermidis
KVSTKGNGFV

SEQ ID NO: 1762291 - protein, 10 aa, Staphylococcus epidermidis
KVTAPDTPVP

SEQ ID NO: 1762292 - protein, 6 aa, Staphylococcus epidermidis
KVTEDF

SEQ ID NO: 1762293 - protein, 7 aa, Staphylococcus epidermidis
KWDQSTA

SEQ ID NO: 1762294 - protein, 11 aa, Staphylococcus epidermidis
KWNRNKQEING

SEQ ID NO: 1762295 - protein, 8 aa, Staphylococcus epidermidis
KYASEDHK

SEQ ID NO: 1762296 - protein, 16 aa, Staphylococcus epidermidis
KYEESNVDKLKSPLAE

SEQ ID NO: 1762297 - protein, 4 aa, Staphylococcus epidermidis
KYGE

SEQ ID NO: 1762298 - protein, 6 aa, Staphylococcus epidermidis
KYGEHH

SEQ ID NO: 1762299 - protein, 36 aa, Staphylococcus epidermidis
KYGEQYVSQRKSSGKQGDQDAHEAIRPTSTMRTPDD

SEQ ID NO: 1762300 - protein, 20 aa, Staphylococcus epidermidis
KYGGTSISDYRHADGKTGQM

SEQ ID NO: 1762301 - protein, 20 aa, Staphylococcus epidermidis
KYKDGKSSERLVKDLFNKFF

SEQ ID NO: 1762302 - protein, 8 aa, Staphylococcus epidermidis
KYKDYHPE

SEQ ID NO: 1762303 - protein, 5 aa, Staphylococcus epidermidis
KYMKS

SEQ ID NO: 1762304 - protein, 13 aa, Staphylococcus epidermidis
KYPEVNAEIDGDD

SEQ ID NO: 1762305 - protein, 9 aa, Staphylococcus epidermidis
KYRDEKRPR

SEQ ID NO: 1762306 - protein, 7 aa, Staphylococcus epidermidis
KYRNEAE

SEQ ID NO: 1762307 - protein, 7 aa, Staphylococcus epidermidis
KYSSQEI

SEQ ID NO: 1762308 - protein, 5 aa, Staphylococcus epidermidis
KYTKQ

SEQ ID NO: 1762309 - protein, 6 aa, Staphylococcus epidermidis
KYYGQS

SEQ ID NO: 1762310 - protein, 8 aa, Staphylococcus epidermidis
LAANNDLK

SEQ ID NO: 1762311 - protein, 7 aa, Staphylococcus epidermidis
LADSGVK

SEQ ID NO: 1762312 - protein, 5 aa, Staphylococcus epidermidis
LAEDI

SEQ ID NO: 1762313 - protein, 6 aa, Staphylococcus epidermidis
LAEETL

SEQ ID NO: 1762314 - protein, 4 aa, Staphylococcus epidermidis
LAEK

SEQ ID NO: 1762315 - protein, 7 aa, Staphylococcus epidermidis
LAEKGHP

SEQ ID NO: 1762316 - protein, 8 aa, Staphylococcus epidermidis
LAENNNPY

SEQ ID NO: 1762317 - protein, 6 aa, Staphylococcus epidermidis
LAESIE

SEQ ID NO: 1762318 - protein, 10 aa, Staphylococcus epidermidis
LAKEYASKFE

SEQ ID NO: 1762319 - protein, 12 aa, Staphylococcus epidermidis
LAKKNPNDERFT

SEQ ID NO: 1762320 - protein, 10 aa, Staphylococcus epidermidis
LAKKTTKKKG

SEQ ID NO: 1762321 - protein, 8 aa, Staphylococcus epidermidis
LAKKYSRK

SEQ ID NO: 1762322 - protein, 5 aa, Staphylococcus epidermidis
LANEI

SEQ ID NO: 1762323 - protein, 8 aa, Staphylococcus epidermidis
LANKGTKV

SEQ ID NO: 1762324 - protein, 14 aa, Staphylococcus epidermidis
LANPITGSITQDDA

SEQ ID NO: 1762325 - protein, 7 aa, Staphylococcus epidermidis
LAPAGNL

SEQ ID NO: 1762326 - protein, 9 aa, Staphylococcus epidermidis
LAPKGTDFQ

SEQ ID NO: 1762327 - protein, 18 aa, Staphylococcus epidermidis
LAQKMAQEQNKKKEEKMK

SEQ ID NO: 1762328 - protein, 8 aa, Staphylococcus epidermidis
LAQKSEKE

SEQ ID NO: 1762329 - protein, 7 aa, Staphylococcus epidermidis
LARGERT

SEQ ID NO: 1762330 - protein, 9 aa, Staphylococcus epidermidis
LARNDKDYA

SEQ ID NO: 1762331 - protein, 13 aa, Staphylococcus epidermidis
LARRGSGSASRSI

SEQ ID NO: 1762332 - protein, 10 aa, Staphylococcus epidermidis
LASPNAGQRT

SEQ ID NO: 1762333 - protein, 8 aa, Staphylococcus epidermidis
LASSSTVH

SEQ ID NO: 1762334 - protein, 9 aa, Staphylococcus epidermidis
LASTVKDST

SEQ ID NO: 1762335 - protein, 12 aa, Staphylococcus epidermidis
LATDGYENARET

SEQ ID NO: 1762336 - protein, 7 aa, Staphylococcus epidermidis
LATEGAE

SEQ ID NO: 1762337 - protein, 4 aa, Staphylococcus epidermidis
LATQ

SEQ ID NO: 1762338 - protein, 6 aa, Staphylococcus epidermidis
LATQEN

SEQ ID NO: 1762339 - protein, 8 aa, Staphylococcus epidermidis
LDADDEAS

SEQ ID NO: 1762340 - protein, 11 aa, Staphylococcus epidermidis
LDAQTNNQDSV

SEQ ID NO: 1762341 - protein, 12 aa, Staphylococcus epidermidis
LDDFSEKKPRIR

SEQ ID NO: 1762342 - protein, 15 aa, Staphylococcus epidermidis
LDDGGQFQDRGSQYK

SEQ ID NO: 1762343 - protein, 8 aa, Staphylococcus epidermidis
LDEDTVIN

SEQ ID NO: 1762344 - protein, 19 aa, Staphylococcus epidermidis
LDENRAHYNNRSLSDSDIN

SEQ ID NO: 1762345 - protein, 7 aa, Staphylococcus epidermidis
LDEPTEQ

SEQ ID NO: 1762346 - protein, 6 aa, Staphylococcus epidermidis
LDEPTI

SEQ ID NO: 1762347 - protein, 4 aa, Staphylococcus epidermidis
LDET

SEQ ID NO: 1762348 - protein, 8 aa, Staphylococcus epidermidis
LDETNERV

SEQ ID NO: 1762349 - protein, 4 aa, Staphylococcus epidermidis
LDGK

SEQ ID NO: 1762350 - protein, 8 aa, Staphylococcus epidermidis
LDIAKDEN

SEQ ID NO: 1762351 - protein, 5 aa, Staphylococcus epidermidis
LDKED

SEQ ID NO: 1762352 - protein, 4 aa, Staphylococcus epidermidis
LDKG

SEQ ID NO: 1762353 - protein, 9 aa, Staphylococcus epidermidis
LDKQGRINI

SEQ ID NO: 1762354 - protein, 6 aa, Staphylococcus epidermidis
LDNDEV

SEQ ID NO: 1762355 - protein, 18 aa, Staphylococcus epidermidis
LDNNPQSIEDYKNGKGKA

SEQ ID NO: 1762356 - protein, 5 aa, Staphylococcus epidermidis
LDNPV

SEQ ID NO: 1762357 - protein, 5 aa, Staphylococcus epidermidis
LDNRP

SEQ ID NO: 1762358 - protein, 8 aa, Staphylococcus epidermidis
LDPHGKSS

SEQ ID NO: 1762359 - protein, 5 aa, Staphylococcus epidermidis
LDPLT

SEQ ID NO: 1762360 - protein, 6 aa, Staphylococcus epidermidis
LDQQKD

SEQ ID NO: 1762361 - protein, 8 aa, Staphylococcus epidermidis
LDQSDSNF

SEQ ID NO: 1762362 - protein, 6 aa, Staphylococcus epidermidis
LDQTSP

SEQ ID NO: 1762363 - protein, 9 aa, Staphylococcus epidermidis
LDRGRDDVD

SEQ ID NO: 1762364 - protein, 9 aa, Staphylococcus epidermidis
LDSETDPTQ

SEQ ID NO: 1762365 - protein, 17 aa, Staphylococcus epidermidis
LDSGGDNEWHKKKITSF

SEQ ID NO: 1762366 - protein, 15 aa, Staphylococcus epidermidis
LDSRVNEALSSNNDD

SEQ ID NO: 1762367 - protein, 11 aa, Staphylococcus epidermidis
LDTKNIQSLTK

SEQ ID NO: 1762368 - protein, 15 aa, Staphylococcus epidermidis
LDVSTQHRAQSGRYS

SEQ ID NO: 1762369 - protein, 5 aa, Staphylococcus epidermidis
LEAGE

SEQ ID NO: 1762370 - protein, 9 aa, Staphylococcus epidermidis
LEDESENKN

SEQ ID NO: 1762371 - protein, 8 aa, Staphylococcus epidermidis
LEDGPNKE

SEQ ID NO: 1762372 - protein, 10 aa, Staphylococcus epidermidis
LEDGYTQPAQ

SEQ ID NO: 1762373 - protein, 8 aa, Staphylococcus epidermidis
LEDPTNLE

SEQ ID NO: 1762374 - protein, 13 aa, Staphylococcus epidermidis
LEENRKPNNTKEL

SEQ ID NO: 1762375 - protein, 16 aa, Staphylococcus epidermidis
LEEYHAKGYASGFEES

SEQ ID NO: 1762376 - protein, 7 aa, Staphylococcus epidermidis
LEGEESL

SEQ ID NO: 1762377 - protein, 11 aa, Staphylococcus epidermidis
LEGLPRHTSTH

SEQ ID NO: 1762378 - protein, 14 aa, Staphylococcus epidermidis
LEKLSNKQLSDIRK

SEQ ID NO: 1762379 - protein, 5 aa, Staphylococcus epidermidis
LEKQG

SEQ ID NO: 1762380 - protein, 7 aa, Staphylococcus epidermidis
LEKSGFT

SEQ ID NO: 1762381 - protein, 4 aa, Staphylococcus epidermidis
LELN

SEQ ID NO: 1762382 - protein, 6 aa, Staphylococcus epidermidis
LENEKN

SEQ ID NO: 1762383 - protein, 9 aa, Staphylococcus epidermidis
LENNKTEND

SEQ ID NO: 1762384 - protein, 9 aa, Staphylococcus epidermidis
LEPGPKYQE

SEQ ID NO: 1762385 - protein, 6 aa, Staphylococcus epidermidis
LEPPEE

SEQ ID NO: 1762386 - protein, 11 aa, Staphylococcus epidermidis
LEQSLKEGYAQ

SEQ ID NO: 1762387 - protein, 11 aa, Staphylococcus epidermidis
LEQTNKEIAQP

SEQ ID NO: 1762388 - protein, 15 aa, Staphylococcus epidermidis
LERGELNQYDISGQG

SEQ ID NO: 1762389 - protein, 22 aa, Staphylococcus epidermidis
LESDNNDNHSGIVEPESTGVET

SEQ ID NO: 1762390 - protein, 5 aa, Staphylococcus epidermidis
LESEE

SEQ ID NO: 1762391 - protein, 8 aa, Staphylococcus epidermidis
LESSQTDK

SEQ ID NO: 1762392 - protein, 8 aa, Staphylococcus epidermidis
LESTGATG

SEQ ID NO: 1762393 - protein, 9 aa, Staphylococcus epidermidis
LETGKTKRD

SEQ ID NO: 1762394 - protein, 12 aa, Staphylococcus epidermidis
LETNQDETYENF

SEQ ID NO: 1762395 - protein, 12 aa, Staphylococcus epidermidis
LEYEEKRQEEEL

SEQ ID NO: 1762396 - protein, 4 aa, Staphylococcus epidermidis
LFSS

SEQ ID NO: 1762397 - protein, 5 aa, Staphylococcus epidermidis
LGAEV

SEQ ID NO: 1762398 - protein, 7 aa, Staphylococcus epidermidis
LGAPLSV

SEQ ID NO: 1762399 - protein, 4 aa, Staphylococcus epidermidis
LGEA

SEQ ID NO: 1762400 - protein, 7 aa, Staphylococcus epidermidis
LGEDGEY

SEQ ID NO: 1762401 - protein, 19 aa, Staphylococcus epidermidis
LGEEKKSFARQTIEKDKEI

SEQ ID NO: 1762402 - protein, 19 aa, Staphylococcus epidermidis
LGEGVSEEVKTSVKEAVET

SEQ ID NO: 1762403 - protein, 4 aa, Staphylococcus epidermidis
LGEM

SEQ ID NO: 1762404 - protein, 20 aa, Staphylococcus epidermidis
LGESTGYDYTRTKNPTRTAF

SEQ ID NO: 1762405 - protein, 11 aa, Staphylococcus epidermidis
LGEVGKNTYAV

SEQ ID NO: 1762406 - protein, 5 aa, Staphylococcus epidermidis
LGFTG

SEQ ID NO: 1762407 - protein, 16 aa, Staphylococcus epidermidis
LGGEQETKRRAGTENL

SEQ ID NO: 1762408 - protein, 8 aa, Staphylococcus epidermidis
LGGKNPNI

SEQ ID NO: 1762409 - protein, 14 aa, Staphylococcus epidermidis
LGKDEQEVLQGEQV

SEQ ID NO: 1762410 - protein, 14 aa, Staphylococcus epidermidis
LGLSPSASFGQTGT

SEQ ID NO: 1762411 - protein, 11 aa, Staphylococcus epidermidis
LGMSGENNEWK

SEQ ID NO: 1762412 - protein, 5 aa, Staphylococcus epidermidis
LGNGL

SEQ ID NO: 1762413 - protein, 8 aa, Staphylococcus epidermidis
LGPAPEPN

SEQ ID NO: 1762414 - protein, 28 aa, Staphylococcus epidermidis
LGQPIDGQGPINATKTRPVEKKATGVMD

SEQ ID NO: 1762415 - protein, 9 aa, Staphylococcus epidermidis
LGQTAGQQV

SEQ ID NO: 1762416 - protein, 11 aa, Staphylococcus epidermidis
LGRGGSDTTAV

SEQ ID NO: 1762417 - protein, 11 aa, Staphylococcus epidermidis
LGSDDKSNELK

SEQ ID NO: 1762418 - protein, 4 aa, Staphylococcus epidermidis
LGSE

SEQ ID NO: 1762419 - protein, 16 aa, Staphylococcus epidermidis
LGSTQDASEFNDKDPY

SEQ ID NO: 1762420 - protein, 12 aa, Staphylococcus epidermidis
LGTPAATTRGFD

SEQ ID NO: 1762421 - protein, 9 aa, Staphylococcus epidermidis
LGVPSEQEI

SEQ ID NO: 1762422 - protein, 10 aa, Staphylococcus epidermidis
LHEDAGSHNI

SEQ ID NO: 1762423 - protein, 6 aa, Staphylococcus epidermidis
LHPGAK

SEQ ID NO: 1762424 - protein, 7 aa, Staphylococcus epidermidis
LHPYEGK

SEQ ID NO: 1762425 - protein, 11 aa, Staphylococcus epidermidis
LHTPRRSEPRI

SEQ ID NO: 1762426 - protein, 10 aa, Staphylococcus epidermidis
LIEEAQKSTP

SEQ ID NO: 1762427 - protein, 7 aa, Staphylococcus epidermidis
LIEKTKA

SEQ ID NO: 1762428 - protein, 14 aa, Staphylococcus epidermidis
LIGGNGSIISKNGQ

SEQ ID NO: 1762429 - protein, 11 aa, Staphylococcus epidermidis
LIGSEDTVKQK

SEQ ID NO: 1762430 - protein, 8 aa, Staphylococcus epidermidis
LIKGENEG

SEQ ID NO: 1762431 - protein, 12 aa, Staphylococcus epidermidis
LITSRKDGNKNL

SEQ ID NO: 1762432 - protein, 6 aa, Staphylococcus epidermidis
LKADSV

SEQ ID NO: 1762433 - protein, 5 aa, Staphylococcus epidermidis
LKAEE

SEQ ID NO: 1762434 - protein, 6 aa, Staphylococcus epidermidis
LKAENG

SEQ ID NO: 1762435 - protein, 11 aa, Staphylococcus epidermidis
LKANPNKQAVG

SEQ ID NO: 1762436 - protein, 10 aa, Staphylococcus epidermidis
LKDEKQSQKL

SEQ ID NO: 1762437 - protein, 7 aa, Staphylococcus epidermidis
LKDENRI

SEQ ID NO: 1762438 - protein, 19 aa, Staphylococcus epidermidis
LKDKADSYPNQLSGGQKQR

SEQ ID NO: 1762439 - protein, 7 aa, Staphylococcus epidermidis
LKEEDHG

SEQ ID NO: 1762440 - protein, 7 aa, Staphylococcus epidermidis
LKEEDQI

SEQ ID NO: 1762441 - protein, 7 aa, Staphylococcus epidermidis
LKEEGRN

SEQ ID NO: 1762442 - protein, 13 aa, Staphylococcus epidermidis
LKEETGSDAKANE

SEQ ID NO: 1762443 - protein, 6 aa, Staphylococcus epidermidis
LKENIR

SEQ ID NO: 1762444 - protein, 6 aa, Staphylococcus epidermidis
LKGGQK

SEQ ID NO: 1762445 - protein, 9 aa, Staphylococcus epidermidis
LKGKENLLP

SEQ ID NO: 1762446 - protein, 6 aa, Staphylococcus epidermidis
LKGTNR

SEQ ID NO: 1762447 - protein, 8 aa, Staphylococcus epidermidis
LKKARDRA

SEQ ID NO: 1762448 - protein, 6 aa, Staphylococcus epidermidis
LKKETN

SEQ ID NO: 1762449 - protein, 6 aa, Staphylococcus epidermidis
LKKGQV

SEQ ID NO: 1762450 - protein, 8 aa, Staphylococcus epidermidis
LKKRGAKS

SEQ ID NO: 1762451 - protein, 8 aa, Staphylococcus epidermidis
LKKSNSHY

SEQ ID NO: 1762452 - protein, 7 aa, Staphylococcus epidermidis
LKNDGAN

SEQ ID NO: 1762453 - protein, 8 aa, Staphylococcus epidermidis
LKNGNAYQ

SEQ ID NO: 1762454 - protein, 9 aa, Staphylococcus epidermidis
LKNMSDDEK

SEQ ID NO: 1762455 - protein, 15 aa, Staphylococcus epidermidis
LKPDTKYDSHGVYSG

SEQ ID NO: 1762456 - protein, 7 aa, Staphylococcus epidermidis
LKPEEVK

SEQ ID NO: 1762457 - protein, 6 aa, Staphylococcus epidermidis
LKPLTT

SEQ ID NO: 1762458 - protein, 6 aa, Staphylococcus epidermidis
LKPQQL

SEQ ID NO: 1762459 - protein, 7 aa, Staphylococcus epidermidis
LKQRAVS

SEQ ID NO: 1762460 - protein, 8 aa, Staphylococcus epidermidis
LKRETTKV

SEQ ID NO: 1762461 - protein, 6 aa, Staphylococcus epidermidis
LKRGPQ

SEQ ID NO: 1762462 - protein, 13 aa, Staphylococcus epidermidis
LKSKGKTPVQWCE

SEQ ID NO: 1762463 - protein, 6 aa, Staphylococcus epidermidis
LKSQGV

SEQ ID NO: 1762464 - protein, 8 aa, Staphylococcus epidermidis
LKSRSTRK

SEQ ID NO: 1762465 - protein, 5 aa, Staphylococcus epidermidis
LKTIE

SEQ ID NO: 1762466 - protein, 9 aa, Staphylococcus epidermidis
LKTNDKTKF

SEQ ID NO: 1762467 - protein, 6 aa, Staphylococcus epidermidis
LKTSYQ

SEQ ID NO: 1762468 - protein, 5 aa, Staphylococcus epidermidis
LKTTG

SEQ ID NO: 1762469 - protein, 7 aa, Staphylococcus epidermidis
LKTTQND

SEQ ID NO: 1762470 - protein, 8 aa, Staphylococcus epidermidis
LKTYPGNY

SEQ ID NO: 1762471 - protein, 6 aa, Staphylococcus epidermidis
LLGDNG

SEQ ID NO: 1762472 - protein, 7 aa, Staphylococcus epidermidis
LNDAESY

SEQ ID NO: 1762473 - protein, 6 aa, Staphylococcus epidermidis
LNDDFE

SEQ ID NO: 1762474 - protein, 10 aa, Staphylococcus epidermidis
LNDDLGGGSI

SEQ ID NO: 1762475 - protein, 8 aa, Staphylococcus epidermidis
LNDGSKQY

SEQ ID NO: 1762476 - protein, 9 aa, Staphylococcus epidermidis
LNEDDAETI

SEQ ID NO: 1762477 - protein, 6 aa, Staphylococcus epidermidis
LNEEEG

SEQ ID NO: 1762478 - protein, 12 aa, Staphylococcus epidermidis
LNEEKEQLEATY

SEQ ID NO: 1762479 - protein, 7 aa, Staphylococcus epidermidis
LNGQLTG

SEQ ID NO: 1762480 - protein, 13 aa, Staphylococcus epidermidis
LNGQNNIDIETFS

SEQ ID NO: 1762481 - protein, 10 aa, Staphylococcus epidermidis
LNINEKNADR

SEQ ID NO: 1762482 - protein, 11 aa, Staphylococcus epidermidis
LNKVRSNRDER

SEQ ID NO: 1762483 - protein, 8 aa, Staphylococcus epidermidis
LNNDDTVS

SEQ ID NO: 1762484 - protein, 5 aa, Staphylococcus epidermidis
LNNGN

SEQ ID NO: 1762485 - protein, 10 aa, Staphylococcus epidermidis
LNNGRQPEFR

SEQ ID NO: 1762486 - protein, 7 aa, Staphylococcus epidermidis
LNPEEDR

SEQ ID NO: 1762487 - protein, 6 aa, Staphylococcus epidermidis
LNPTEE

SEQ ID NO: 1762488 - protein, 8 aa, Staphylococcus epidermidis
LNQEQTKI

SEQ ID NO: 1762489 - protein, 5 aa, Staphylococcus epidermidis
LNQPE

SEQ ID NO: 1762490 - protein, 9 aa, Staphylococcus epidermidis
LNQRENQPK

SEQ ID NO: 1762491 - protein, 8 aa, Staphylococcus epidermidis
LNSEVKPR

SEQ ID NO: 1762492 - protein, 9 aa, Staphylococcus epidermidis
LNSTRAAVE

SEQ ID NO: 1762493 - protein, 4 aa, Staphylococcus epidermidis
LNTG

SEQ ID NO: 1762494 - protein, 6 aa, Staphylococcus epidermidis
LNTLTD

SEQ ID NO: 1762495 - protein, 6 aa, Staphylococcus epidermidis
LNTNNP

SEQ ID NO: 1762496 - protein, 11 aa, Staphylococcus epidermidis
LNVSEGTAYRA

SEQ ID NO: 1762497 - protein, 12 aa, Staphylococcus epidermidis
LPAAEPDRVKQE

SEQ ID NO: 1762498 - protein, 5 aa, Staphylococcus epidermidis
LPAGV

SEQ ID NO: 1762499 - protein, 10 aa, Staphylococcus epidermidis
LPASPGAATG

SEQ ID NO: 1762500 - protein, 9 aa, Staphylococcus epidermidis
LPDGSTSKR

SEQ ID NO: 1762501 - protein, 10 aa, Staphylococcus epidermidis
LPDLSERERK

SEQ ID NO: 1762502 - protein, 5 aa, Staphylococcus epidermidis
LPDPL

SEQ ID NO: 1762503 - protein, 5 aa, Staphylococcus epidermidis
LPGEN

SEQ ID NO: 1762504 - protein, 13 aa, Staphylococcus epidermidis
LPGKEVKLSTNEQ

SEQ ID NO: 1762505 - protein, 17 aa, Staphylococcus epidermidis
LPGQGQTSRAQKGQIDD

SEQ ID NO: 1762506 - protein, 9 aa, Staphylococcus epidermidis
LPHGNPEKV

SEQ ID NO: 1762507 - protein, 4 aa, Staphylococcus epidermidis
LPIE

SEQ ID NO: 1762508 - protein, 62 aa, Staphylococcus epidermidis
LPKKTSSQRPAREKTIQAKTRGKSLDHTKSDRNGKGKKKKRKQRKGKNARKKDKQGNTHHKP

SEQ ID NO: 1762509 - protein, 4 aa, Staphylococcus epidermidis
LPKN

SEQ ID NO: 1762510 - protein, 7 aa, Staphylococcus epidermidis
LPKNKSI

SEQ ID NO: 1762511 - protein, 7 aa, Staphylococcus epidermidis
LPKSGES

SEQ ID NO: 1762512 - protein, 9 aa, Staphylococcus epidermidis
LPNAPKEKG

SEQ ID NO: 1762513 - protein, 6 aa, Staphylococcus epidermidis
LPNPLA

SEQ ID NO: 1762514 - protein, 4 aa, Staphylococcus epidermidis
LPQD

SEQ ID NO: 1762515 - protein, 5 aa, Staphylococcus epidermidis
LPQDS

SEQ ID NO: 1762516 - protein, 6 aa, Staphylococcus epidermidis
LPQSTI

SEQ ID NO: 1762517 - protein, 11 aa, Staphylococcus epidermidis
LPRKSGVSDLP

SEQ ID NO: 1762518 - protein, 4 aa, Staphylococcus epidermidis
LPSD

SEQ ID NO: 1762519 - protein, 5 aa, Staphylococcus epidermidis
LPSDV

SEQ ID NO: 1762520 - protein, 4 aa, Staphylococcus epidermidis
LPTE

SEQ ID NO: 1762521 - protein, 8 aa, Staphylococcus epidermidis
LPTGGGKS

SEQ ID NO: 1762522 - protein, 7 aa, Staphylococcus epidermidis
LPTMEKE

SEQ ID NO: 1762523 - protein, 11 aa, Staphylococcus epidermidis
LPTNQTARFTN

SEQ ID NO: 1762524 - protein, 11 aa, Staphylococcus epidermidis
LPTTEEDEAEM

SEQ ID NO: 1762525 - protein, 7 aa, Staphylococcus epidermidis
LPTVQQN

SEQ ID NO: 1762526 - protein, 26 aa, Staphylococcus epidermidis
LPYTSTGKLQRKKVKSEDLNEGKNNE

SEQ ID NO: 1762527 - protein, 12 aa, Staphylococcus epidermidis
LQAEGKSPLDSL

SEQ ID NO: 1762528 - protein, 6 aa, Staphylococcus epidermidis
LQEKNY

SEQ ID NO: 1762529 - protein, 8 aa, Staphylococcus epidermidis
LQKQQNKL

SEQ ID NO: 1762530 - protein, 6 aa, Staphylococcus epidermidis
LQKTDY

SEQ ID NO: 1762531 - protein, 4 aa, Staphylococcus epidermidis
LQLT

SEQ ID NO: 1762532 - protein, 4 aa, Staphylococcus epidermidis
LQNQ

SEQ ID NO: 1762533 - protein, 7 aa, Staphylococcus epidermidis
LQPGDEV

SEQ ID NO: 1762534 - protein, 20 aa, Staphylococcus epidermidis
LQPGGSITTTSSVQGYNPSP

SEQ ID NO: 1762535 - protein, 14 aa, Staphylococcus epidermidis
LQQKSAPESQKETT

SEQ ID NO: 1762536 - protein, 10 aa, Staphylococcus epidermidis
LQQKSNGYIE

SEQ ID NO: 1762537 - protein, 17 aa, Staphylococcus epidermidis
LQQKTSAFGQSTTVTPA

SEQ ID NO: 1762538 - protein, 7 aa, Staphylococcus epidermidis
LQREKER

SEQ ID NO: 1762539 - protein, 8 aa, Staphylococcus epidermidis
LQRPTSGN

SEQ ID NO: 1762540 - protein, 8 aa, Staphylococcus epidermidis
LQSDTKDF

SEQ ID NO: 1762541 - protein, 8 aa, Staphylococcus epidermidis
LQSGNYSD

SEQ ID NO: 1762542 - protein, 6 aa, Staphylococcus epidermidis
LQSSDV

SEQ ID NO: 1762543 - protein, 6 aa, Staphylococcus epidermidis
LQTRPK

SEQ ID NO: 1762544 - protein, 15 aa, Staphylococcus epidermidis
LQYPEGEFWKSKMPQ

SEQ ID NO: 1762545 - protein, 12 aa, Staphylococcus epidermidis
LQYPEKERKPYS

SEQ ID NO: 1762546 - protein, 6 aa, Staphylococcus epidermidis
LREGDT

SEQ ID NO: 1762547 - protein, 7 aa, Staphylococcus epidermidis
LREHKDT

SEQ ID NO: 1762548 - protein, 12 aa, Staphylococcus epidermidis
LREQTGLKDKTL

SEQ ID NO: 1762549 - protein, 6 aa, Staphylococcus epidermidis
LRGVDS

SEQ ID NO: 1762550 - protein, 12 aa, Staphylococcus epidermidis
LRNGKPVEVPTY

SEQ ID NO: 1762551 - protein, 12 aa, Staphylococcus epidermidis
LRPLGRTAAGVK

SEQ ID NO: 1762552 - protein, 7 aa, Staphylococcus epidermidis
LRPPHRK

SEQ ID NO: 1762553 - protein, 5 aa, Staphylococcus epidermidis
LRQEP

SEQ ID NO: 1762554 - protein, 13 aa, Staphylococcus epidermidis
LRQKGSAGGHNGM

SEQ ID NO: 1762555 - protein, 4 aa, Staphylococcus epidermidis
LRQN

SEQ ID NO: 1762556 - protein, 8 aa, Staphylococcus epidermidis
LRQNLEEQ

SEQ ID NO: 1762557 - protein, 9 aa, Staphylococcus epidermidis
LRSGKEREE

SEQ ID NO: 1762558 - protein, 9 aa, Staphylococcus epidermidis
LRTEDSRRV

SEQ ID NO: 1762559 - protein, 18 aa, Staphylococcus epidermidis
LRTGAIQEKTFRAGEKVE

SEQ ID NO: 1762560 - protein, 11 aa, Staphylococcus epidermidis
LRTNKETALGY

SEQ ID NO: 1762561 - protein, 9 aa, Staphylococcus epidermidis
LRTPSDSGL

SEQ ID NO: 1762562 - protein, 10 aa, Staphylococcus epidermidis
LSAQKVGTFD

SEQ ID NO: 1762563 - protein, 9 aa, Staphylococcus epidermidis
LSASKSSIQ

SEQ ID NO: 1762564 - protein, 6 aa, Staphylococcus epidermidis
LSASQK

SEQ ID NO: 1762565 - protein, 9 aa, Staphylococcus epidermidis
LSDDEIGTS

SEQ ID NO: 1762566 - protein, 8 aa, Staphylococcus epidermidis
LSDEEDLK

SEQ ID NO: 1762567 - protein, 9 aa, Staphylococcus epidermidis
LSDGSGVAQ

SEQ ID NO: 1762568 - protein, 12 aa, Staphylococcus epidermidis
LSDHATKENAKG

SEQ ID NO: 1762569 - protein, 10 aa, Staphylococcus epidermidis
LSDQDKSIAD

SEQ ID NO: 1762570 - protein, 5 aa, Staphylococcus epidermidis
LSEAA

SEQ ID NO: 1762571 - protein, 14 aa, Staphylococcus epidermidis
LSEAERNWLNQQEN

SEQ ID NO: 1762572 - protein, 4 aa, Staphylococcus epidermidis
LSEE

SEQ ID NO: 1762573 - protein, 7 aa, Staphylococcus epidermidis
LSEKIQD

SEQ ID NO: 1762574 - protein, 5 aa, Staphylococcus epidermidis
LSEKK

SEQ ID NO: 1762575 - protein, 22 aa, Staphylococcus epidermidis
LSEPRQDNSSTTYTAAQEGQPE

SEQ ID NO: 1762576 - protein, 10 aa, Staphylococcus epidermidis
LSEQTTYNGP

SEQ ID NO: 1762577 - protein, 8 aa, Staphylococcus epidermidis
LSGDQIKK

SEQ ID NO: 1762578 - protein, 6 aa, Staphylococcus epidermidis
LSGGMK

SEQ ID NO: 1762579 - protein, 8 aa, Staphylococcus epidermidis
LSGGQQKR

SEQ ID NO: 1762580 - protein, 20 aa, Staphylococcus epidermidis
LSGKTAERLNKIQKSGKTVT

SEQ ID NO: 1762581 - protein, 7 aa, Staphylococcus epidermidis
LSGTDTQ

SEQ ID NO: 1762582 - protein, 4 aa, Staphylococcus epidermidis
LSGY

SEQ ID NO: 1762583 - protein, 9 aa, Staphylococcus epidermidis
LSKGERYDE

SEQ ID NO: 1762584 - protein, 8 aa, Staphylococcus epidermidis
LSKPEDVA

SEQ ID NO: 1762585 - protein, 5 aa, Staphylococcus epidermidis
LSKYE

SEQ ID NO: 1762586 - protein, 5 aa, Staphylococcus epidermidis
LSNIG

SEQ ID NO: 1762587 - protein, 10 aa, Staphylococcus epidermidis
LSNNDKETLR

SEQ ID NO: 1762588 - protein, 15 aa, Staphylococcus epidermidis
LSPGDKIITSESTFG

SEQ ID NO: 1762589 - protein, 9 aa, Staphylococcus epidermidis
LSPPQDAQQ

SEQ ID NO: 1762590 - protein, 10 aa, Staphylococcus epidermidis
LSQEDAEKYL

SEQ ID NO: 1762591 - protein, 13 aa, Staphylococcus epidermidis
LSQEDSGQGHGQM

SEQ ID NO: 1762592 - protein, 8 aa, Staphylococcus epidermidis
LSQNEAAE

SEQ ID NO: 1762593 - protein, 15 aa, Staphylococcus epidermidis
LSQQEEMGYTQKSPR

SEQ ID NO: 1762594 - protein, 7 aa, Staphylococcus epidermidis
LSQQEIN

SEQ ID NO: 1762595 - protein, 6 aa, Staphylococcus epidermidis
LSREGM

SEQ ID NO: 1762596 - protein, 7 aa, Staphylococcus epidermidis
LSRTTGF

SEQ ID NO: 1762597 - protein, 12 aa, Staphylococcus epidermidis
LSSEAEYQRGYG

SEQ ID NO: 1762598 - protein, 15 aa, Staphylococcus epidermidis
LSSEGSLNEAGGPQY

SEQ ID NO: 1762599 - protein, 6 aa, Staphylococcus epidermidis
LSSGAK

SEQ ID NO: 1762600 - protein, 8 aa, Staphylococcus epidermidis
LSSKNKKA

SEQ ID NO: 1762601 - protein, 7 aa, Staphylococcus epidermidis
LSSSDTF

SEQ ID NO: 1762602 - protein, 9 aa, Staphylococcus epidermidis
LSSSQSEEM

SEQ ID NO: 1762603 - protein, 4 aa, Staphylococcus epidermidis
LSTE

SEQ ID NO: 1762604 - protein, 5 aa, Staphylococcus epidermidis
LSTKP

SEQ ID NO: 1762605 - protein, 8 aa, Staphylococcus epidermidis
LSTNPSMK

SEQ ID NO: 1762606 - protein, 9 aa, Staphylococcus epidermidis
LSTRENEIT

SEQ ID NO: 1762607 - protein, 4 aa, Staphylococcus epidermidis
LTAT

SEQ ID NO: 1762608 - protein, 10 aa, Staphylococcus epidermidis
LTDDTEKTKA

SEQ ID NO: 1762609 - protein, 11 aa, Staphylococcus epidermidis
LTDGKNYTGLR

SEQ ID NO: 1762610 - protein, 16 aa, Staphylococcus epidermidis
LTDNGFTSLETSDDVN

SEQ ID NO: 1762611 - protein, 7 aa, Staphylococcus epidermidis
LTEAKPG

SEQ ID NO: 1762612 - protein, 18 aa, Staphylococcus epidermidis
LTEEQRQQYEAEGRKPSI

SEQ ID NO: 1762613 - protein, 6 aa, Staphylococcus epidermidis
LTEKQT

SEQ ID NO: 1762614 - protein, 13 aa, Staphylococcus epidermidis
LTEKRSKGLESTL

SEQ ID NO: 1762615 - protein, 6 aa, Staphylococcus epidermidis
LTENGA

SEQ ID NO: 1762616 - protein, 7 aa, Staphylococcus epidermidis
LTEQRLS

SEQ ID NO: 1762617 - protein, 6 aa, Staphylococcus epidermidis
LTGEEF

SEQ ID NO: 1762618 - protein, 12 aa, Staphylococcus epidermidis
LTGEVNVEGAKN

SEQ ID NO: 1762619 - protein, 23 aa, Staphylococcus epidermidis
LTGTSSDLRDLTEEAKHGRQRSR

SEQ ID NO: 1762620 - protein, 8 aa, Staphylococcus epidermidis
LTNNEETL

SEQ ID NO: 1762621 - protein, 9 aa, Staphylococcus epidermidis
LTNNKGLDA

SEQ ID NO: 1762622 - protein, 7 aa, Staphylococcus epidermidis
LTNPYTG

SEQ ID NO: 1762623 - protein, 7 aa, Staphylococcus epidermidis
LTNSKTS

SEQ ID NO: 1762624 - protein, 10 aa, Staphylococcus epidermidis
LTNTNARIEP

SEQ ID NO: 1762625 - protein, 4 aa, Staphylococcus epidermidis
LTPN

SEQ ID NO: 1762626 - protein, 8 aa, Staphylococcus epidermidis
LTPTATFE

SEQ ID NO: 1762627 - protein, 8 aa, Staphylococcus epidermidis
LTQSQKEI

SEQ ID NO: 1762628 - protein, 13 aa, Staphylococcus epidermidis
LTSPKEALENAGF

SEQ ID NO: 1762629 - protein, 5 aa, Staphylococcus epidermidis
LTSQE

SEQ ID NO: 1762630 - protein, 9 aa, Staphylococcus epidermidis
LTTEAQNAF

SEQ ID NO: 1762631 - protein, 7 aa, Staphylococcus epidermidis
LTTGDTG

SEQ ID NO: 1762632 - protein, 9 aa, Staphylococcus epidermidis
LTTPDEQEA

SEQ ID NO: 1762633 - protein, 21 aa, Staphylococcus epidermidis
LTTTKHGAIESLPTKEDIKDY

SEQ ID NO: 1762634 - protein, 6 aa, Staphylococcus epidermidis
LYGTST

SEQ ID NO: 1762635 - protein, 4 aa, Staphylococcus epidermidis
LYNE

SEQ ID NO: 1762636 - protein, 7 aa, Staphylococcus epidermidis
LYTPTYK

SEQ ID NO: 1762637 - protein, 9 aa, Staphylococcus epidermidis
MAEPGEYTK

SEQ ID NO: 1762638 - protein, 14 aa, Staphylococcus epidermidis
MAEPNEDDKPEEIK

SEQ ID NO: 1762639 - protein, 5 aa, Staphylococcus epidermidis
MAQEG

SEQ ID NO: 1762640 - protein, 19 aa, Staphylococcus epidermidis
MDPFNGGEISPGPQVQTDE

SEQ ID NO: 1762641 - protein, 9 aa, Staphylococcus epidermidis
MEDEPVRAI

SEQ ID NO: 1762642 - protein, 6 aa, Staphylococcus epidermidis
MEKEQP

SEQ ID NO: 1762643 - protein, 7 aa, Staphylococcus epidermidis
MENPQNH

SEQ ID NO: 1762644 - protein, 11 aa, Staphylococcus epidermidis
MENRDNARTPM

SEQ ID NO: 1762645 - protein, 11 aa, Staphylococcus epidermidis
MEREGKSREEV

SEQ ID NO: 1762646 - protein, 10 aa, Staphylococcus epidermidis
METPNGNGGV

SEQ ID NO: 1762647 - protein, 9 aa, Staphylococcus epidermidis
METSTKKDR

SEQ ID NO: 1762648 - protein, 8 aa, Staphylococcus epidermidis
MGGTGGGI

SEQ ID NO: 1762649 - protein, 10 aa, Staphylococcus epidermidis
MGNPGQANYV

SEQ ID NO: 1762650 - protein, 10 aa, Staphylococcus epidermidis
MKDGGPEDST

SEQ ID NO: 1762651 - protein, 6 aa, Staphylococcus epidermidis
MKEKQR

SEQ ID NO: 1762652 - protein, 15 aa, Staphylococcus epidermidis
MKGTMPRGKNVKEDE

SEQ ID NO: 1762653 - protein, 7 aa, Staphylococcus epidermidis
MKPKNRV

SEQ ID NO: 1762654 - protein, 11 aa, Staphylococcus epidermidis
MKPSKQSVSEL

SEQ ID NO: 1762655 - protein, 4 aa, Staphylococcus epidermidis
MKQN

SEQ ID NO: 1762656 - protein, 18 aa, Staphylococcus epidermidis
MKSKKGPEAKVKQKVTQS

SEQ ID NO: 1762657 - protein, 10 aa, Staphylococcus epidermidis
MLKEASDELG

SEQ ID NO: 1762658 - protein, 14 aa, Staphylococcus epidermidis
MLQGSAEEAHKYGE

SEQ ID NO: 1762659 - protein, 11 aa, Staphylococcus epidermidis
MNDNDEKEMFG

SEQ ID NO: 1762660 - protein, 19 aa, Staphylococcus epidermidis
MNEDDQETYYRNERDANDA

SEQ ID NO: 1762661 - protein, 52 aa, Staphylococcus epidermidis; identical to SEQ ID NO: 1605593

SEQ ID NO: 1762662 - protein, 4 aa, Staphylococcus epidermidis
MNSD

SEQ ID NO: 1762663 - protein, 20 aa, Staphylococcus epidermidis
MPGGQYSNLSQQAKSLGLGE

SEQ ID NO: 1762664 - protein, 5 aa, Staphylococcus epidermidis
MPKSG

SEQ ID NO: 1762665 - protein, 8 aa, Staphylococcus epidermidis
MQGEPNQP

SEQ ID NO: 1762666 - protein, 14 aa, Staphylococcus epidermidis
MQNCAPSREHPHGS

SEQ ID NO: 1762667 - protein, 20 aa, Staphylococcus epidermidis
MQQQRDRARQARQNSQSMQV

SEQ ID NO: 1762668 - protein, 4 aa, Staphylococcus epidermidis
MSDG

SEQ ID NO: 1762669 - protein, 9 aa, Staphylococcus epidermidis
MSGGEQQRI

SEQ ID NO: 1762670 - protein, 9 aa, Staphylococcus epidermidis
MSGQECADE

SEQ ID NO: 1762671 - protein, 6 aa, Staphylococcus epidermidis
MSNEES

SEQ ID NO: 1762672 - protein, 8 aa, Staphylococcus epidermidis
MSQSGKTG

SEQ ID NO: 1762673 - protein, 5 aa, Staphylococcus epidermidis
MSQYE

SEQ ID NO: 1762674 - protein, 5 aa, Staphylococcus epidermidis
MSSNR

SEQ ID NO: 1762675 - protein, 5 aa, Staphylococcus epidermidis
MTAPQ

SEQ ID NO: 1762676 - protein, 7 aa, Staphylococcus epidermidis
MTNEDQD

SEQ ID NO: 1762677 - protein, 8 aa, Staphylococcus epidermidis
MTPPPVKR

SEQ ID NO: 1762678 - protein, 6 aa, Staphylococcus epidermidis
MTREGK

SEQ ID NO: 1762679 - protein, 26 aa, Staphylococcus epidermidis
MTSANPLDFPGYEEKIEKDQQKTGLN

SEQ ID NO: 1762680 - protein, 6 aa, Staphylococcus epidermidis
MTSHTT

SEQ ID NO: 1762681 - protein, 18 aa, Staphylococcus epidermidis
MTSKATQAIANTNEPAYG

SEQ ID NO: 1762682 - protein, 38 aa, Staphylococcus epidermidis
NAANLRDKQSKLEKQYEDAKNEWKNAQGGLDTALSEEN

SEQ ID NO: 1762683 - protein, 10 aa, Staphylococcus epidermidis
NADEKSIKGI

SEQ ID NO: 1762684 - protein, 7 aa, Staphylococcus epidermidis
NAGLGSY

SEQ ID NO: 1762685 - protein, 8 aa, Staphylococcus epidermidis
NAIDTGGR

SEQ ID NO: 1762686 - protein, 4 aa, Staphylococcus epidermidis
NAIR

SEQ ID NO: 1762687 - protein, 20 aa, Staphylococcus epidermidis
NAKETEDGQFKVPSIMNGED

SEQ ID NO: 1762688 - protein, 9 aa, Staphylococcus epidermidis
NAKGETDAE

SEQ ID NO: 1762689 - protein, 4 aa, Staphylococcus epidermidis
NAKS

SEQ ID NO: 1762690 - protein, 6 aa, Staphylococcus epidermidis
NAKSQK

SEQ ID NO: 1762691 - protein, 8 aa, Staphylococcus epidermidis
NALSDDLK

SEQ ID NO: 1762692 - protein, 9 aa, Staphylococcus epidermidis
NAMDGVSKD

SEQ ID NO: 1762693 - protein, 8 aa, Staphylococcus epidermidis
NANEGDSF

SEQ ID NO: 1762694 - protein, 9 aa, Staphylococcus epidermidis
NANKRRWNA

SEQ ID NO: 1762695 - protein, 7 aa, Staphylococcus epidermidis
NANRRAD

SEQ ID NO: 1762696 - protein, 6 aa, Staphylococcus epidermidis
NAPKMD

SEQ ID NO: 1762697 - protein, 9 aa, Staphylococcus epidermidis
NAPNLVSSA

SEQ ID NO: 1762698 - protein, 6 aa, Staphylococcus epidermidis
NAPTEK

SEQ ID NO: 1762699 - protein, 7 aa, Staphylococcus epidermidis
NAPTSID

SEQ ID NO: 1762700 - protein, 6 aa, Staphylococcus epidermidis
NAQELG

SEQ ID NO: 1762701 - protein, 4 aa, Staphylococcus epidermidis
NAQN

SEQ ID NO: 1762702 - protein, 8 aa, Staphylococcus epidermidis
NARQEIKN

SEQ ID NO: 1762703 - protein, 6 aa, Staphylococcus epidermidis
NATDEV

SEQ ID NO: 1762704 - protein, 5 aa, Staphylococcus epidermidis
NATES

SEQ ID NO: 1762705 - protein, 12 aa, Staphylococcus epidermidis
NATPEQYNPSYK

SEQ ID NO: 1762706 - protein, 13 aa, Staphylococcus epidermidis
NATSQAGVEGNAG

SEQ ID NO: 1762707 - protein, 13 aa, Staphylococcus epidermidis
NATTGNSGEFHPD

SEQ ID NO: 1762708 - protein, 4 aa, Staphylococcus epidermidis
NAVP

SEQ ID NO: 1762709 - protein, 14 aa, Staphylococcus epidermidis
NCDSTLKEAEKKVN

SEQ ID NO: 1762710 - protein, 13 aa, Staphylococcus epidermidis
NDADVKTSQPPIG

SEQ ID NO: 1762711 - protein, 8 aa, Staphylococcus epidermidis
NDAERNAD

SEQ ID NO: 1762712 - protein, 7 aa, Staphylococcus epidermidis
NDAPAAR

SEQ ID NO: 1762713 - protein, 5 aa, Staphylococcus epidermidis
NDDAL

SEQ ID NO: 1762714 - protein, 6 aa, Staphylococcus epidermidis
NDDEGK

SEQ ID NO: 1762715 - protein, 5 aa, Staphylococcus epidermidis
NDDET

SEQ ID NO: 1762716 - protein, 12 aa, Staphylococcus epidermidis
NDDNTYHTHQDD

SEQ ID NO: 1762717 - protein, 5 aa, Staphylococcus epidermidis
NDDNV

SEQ ID NO: 1762718 - protein, 4 aa, Staphylococcus epidermidis
NDEE

SEQ ID NO: 1762719 - protein, 7 aa, Staphylococcus epidermidis
NDEERAA

SEQ ID NO: 1762720 - protein, 9 aa, Staphylococcus epidermidis
NDEESIRKA

SEQ ID NO: 1762721 - protein, 8 aa, Staphylococcus epidermidis
NDEPYENE

SEQ ID NO: 1762722 - protein, 8 aa, Staphylococcus epidermidis
NDETKGAY

SEQ ID NO: 1762723 - protein, 7 aa, Staphylococcus epidermidis
NDEYQQL

SEQ ID NO: 1762724 - protein, 8 aa, Staphylococcus epidermidis
NDGAQEEA

SEQ ID NO: 1762725 - protein, 19 aa, Staphylococcus epidermidis
NDGASQSYVKSKKKAAEKI

SEQ ID NO: 1762726 - protein, 15 aa, Staphylococcus epidermidis
NDGERQATKDAGKIA

SEQ ID NO: 1762727 - protein, 8 aa, Staphylococcus epidermidis
NDGKDKLV

SEQ ID NO: 1762728 - protein, 5 aa, Staphylococcus epidermidis
NDHTQ

SEQ ID NO: 1762729 - protein, 7 aa, Staphylococcus epidermidis
NDIKPRD

SEQ ID NO: 1762730 - protein, 15 aa, Staphylococcus epidermidis
NDIKSKLQSVSKTGL

SEQ ID NO: 1762731 - protein, 8 aa, Staphylococcus epidermidis
NDKEVDNT

SEQ ID NO: 1762732 - protein, 4 aa, Staphylococcus epidermidis
NDKG

SEQ ID NO: 1762733 - protein, 6 aa, Staphylococcus epidermidis
NDKGER

SEQ ID NO: 1762734 - protein, 8 aa, Staphylococcus epidermidis
NDKPHAEK

SEQ ID NO: 1762735 - protein, 10 aa, Staphylococcus epidermidis
NDLEKRESLH

SEQ ID NO: 1762736 - protein, 7 aa, Staphylococcus epidermidis
NDLSKTK

SEQ ID NO: 1762737 - protein, 4 aa, Staphylococcus epidermidis
NDLT

SEQ ID NO: 1762738 - protein, 9 aa, Staphylococcus epidermidis
NDNEWNNGH

SEQ ID NO: 1762739 - protein, 14 aa, Staphylococcus epidermidis
NDNKELDFKVVKPT

SEQ ID NO: 1762740 - protein, 6 aa, Staphylococcus epidermidis
NDNQLD

SEQ ID NO: 1762741 - protein, 9 aa, Staphylococcus epidermidis
NDPIDQRQR

SEQ ID NO: 1762742 - protein, 5 aa, Staphylococcus epidermidis
NDPNQ

SEQ ID NO: 1762743 - protein, 6 aa, Staphylococcus epidermidis
NDPQKP

SEQ ID NO: 1762744 - protein, 27 aa, Staphylococcus epidermidis
NDQYSDKRTMQTIENNRKKKINMNYIG

SEQ ID NO: 1762745 - protein, 6 aa, Staphylococcus epidermidis
NDRRYH

SEQ ID NO: 1762746 - protein, 14 aa, Staphylococcus epidermidis
NDRYKYDNDIPNSI

SEQ ID NO: 1762747 - protein, 7 aa, Staphylococcus epidermidis
NDSEYGL

SEQ ID NO: 1762748 - protein, 7 aa, Staphylococcus epidermidis
NDSGNEI

SEQ ID NO: 1762749 - protein, 8 aa, Staphylococcus epidermidis
NDTENLTD

SEQ ID NO: 1762750 - protein, 8 aa, Staphylococcus epidermidis
NDTTIEDS

SEQ ID NO: 1762751 - protein, 14 aa, Staphylococcus epidermidis
NDTTVGIASSQGNF

SEQ ID NO: 1762752 - protein, 24 aa, Staphylococcus epidermidis
NDVPGDDSNYKMNPPLRSNEDREA

SEQ ID NO: 1762753 - protein, 4 aa, Staphylococcus epidermidis
NDYE

SEQ ID NO: 1762754 - protein, 4 aa, Staphylococcus epidermidis
NDYR

SEQ ID NO: 1762755 - protein, 4 aa, Staphylococcus epidermidis
NDYY

SEQ ID NO: 1762756 - protein, 23 aa, Staphylococcus epidermidis
NEAGRKPDLPFGGYKESGLGREW

SEQ ID NO: 1762757 - protein, 9 aa, Staphylococcus epidermidis
NEAKQHYDK

SEQ ID NO: 1762758 - protein, 6 aa, Staphylococcus epidermidis
NEAPTS

SEQ ID NO: 1762759 - protein, 6 aa, Staphylococcus epidermidis
NEAVSL

SEQ ID NO: 1762760 - protein, 7 aa, Staphylococcus epidermidis
NEAYQSK

SEQ ID NO: 1762761 - protein, 12 aa, Staphylococcus epidermidis
NEDGSPSRIAET

SEQ ID NO: 1762762 - protein, 13 aa, Staphylococcus epidermidis
NEDKTAVKPDIVG

SEQ ID NO: 1762763 - protein, 9 aa, Staphylococcus epidermidis
NEDQDYEGE

SEQ ID NO: 1762764 - protein, 4 aa, Staphylococcus epidermidis
NEDS

SEQ ID NO: 1762765 - protein, 7 aa, Staphylococcus epidermidis
NEDSETK

SEQ ID NO: 1762766 - protein, 8 aa, Staphylococcus epidermidis
NEDSTQTF

SEQ ID NO: 1762767 - protein, 5 aa, Staphylococcus epidermidis
NEDTD

SEQ ID NO: 1762768 - protein, 12 aa, Staphylococcus epidermidis
NEEDAKVSYEDR

SEQ ID NO: 1762769 - protein, 11 aa, Staphylococcus epidermidis
NEEIKQLNEEY

SEQ ID NO: 1762770 - protein, 8 aa, Staphylococcus epidermidis
NEELPTEV

SEQ ID NO: 1762771 - protein, 6 aa, Staphylococcus epidermidis
NEEREH

SEQ ID NO: 1762772 - protein, 4 aa, Staphylococcus epidermidis
NEEW

SEQ ID NO: 1762773 - protein, 4 aa, Staphylococcus epidermidis
NEGH

SEQ ID NO: 1762774 - protein, 18 aa, Staphylococcus epidermidis
NEGKKPILSETSPTYNER

SEQ ID NO: 1762775 - protein, 6 aa, Staphylococcus epidermidis
NEGQLS

SEQ ID NO: 1762776 - protein, 7 aa, Staphylococcus epidermidis
NEGTPAQ

SEQ ID NO: 1762777 - protein, 7 aa, Staphylococcus epidermidis
NEHENIS

SEQ ID NO: 1762778 - protein, 4 aa, Staphylococcus epidermidis
NEHY

SEQ ID NO: 1762779 - protein, 4 aa, Staphylococcus epidermidis
NEIR

SEQ ID NO: 1762780 - protein, 11 aa, Staphylococcus epidermidis
NEIRQDGNTGE

SEQ ID NO: 1762781 - protein, 8 aa, Staphylococcus epidermidis
NEKDGRQA

SEQ ID NO: 1762782 - protein, 8 aa, Staphylococcus epidermidis
NEKDYEDY

SEQ ID NO: 1762783 - protein, 24 aa, Staphylococcus epidermidis
NEKEQNGEQPFANPRNAAAGSLRQ

SEQ ID NO: 1762784 - protein, 8 aa, Staphylococcus epidermidis
NEKGELNG

SEQ ID NO: 1762785 - protein, 16 aa, Staphylococcus epidermidis
NEKNYPDAIETGKEGL

SEQ ID NO: 1762786 - protein, 18 aa, Staphylococcus epidermidis
NELKDKDKNLDGNDIREG

SEQ ID NO: 1762787 - protein, 8 aa, Staphylococcus epidermidis
NELKKGRQ

SEQ ID NO: 1762788 - protein, 11 aa, Staphylococcus epidermidis
NENRVGLSPSG

SEQ ID NO: 1762789 - protein, 5 aa, Staphylococcus epidermidis
NEPER

SEQ ID NO: 1762790 - protein, 12 aa, Staphylococcus epidermidis
NEPLKPHEEAVE

SEQ ID NO: 1762791 - protein, 9 aa, Staphylococcus epidermidis
NEPLTEDDQ

SEQ ID NO: 1762792 - protein, 15 aa, Staphylococcus epidermidis
NEPSQANLERTTPDK

SEQ ID NO: 1762793 - protein, 5 aa, Staphylococcus epidermidis
NEPTA

SEQ ID NO: 1762794 - protein, 9 aa, Staphylococcus epidermidis
NEQAKSVGA

SEQ ID NO: 1762795 - protein, 7 aa, Staphylococcus epidermidis
NEQAQEQ

SEQ ID NO: 1762796 - protein, 10 aa, Staphylococcus epidermidis
NEQDAQASIR

SEQ ID NO: 1762797 - protein, 9 aa, Staphylococcus epidermidis
NEQLNNAGF

SEQ ID NO: 1762798 - protein, 4 aa, Staphylococcus epidermidis
NEQN

SEQ ID NO: 1762799 - protein, 5 aa, Staphylococcus epidermidis
NERAD

SEQ ID NO: 1762800 - protein, 9 aa, Staphylococcus epidermidis
NERRSNKDM

SEQ ID NO: 1762801 - protein, 14 aa, Staphylococcus epidermidis
NESFTEPIKEQRFS

SEQ ID NO: 1762802 - protein, 8 aa, Staphylococcus epidermidis
NESNVSSI

SEQ ID NO: 1762803 - protein, 6 aa, Staphylococcus epidermidis
NESTIS

SEQ ID NO: 1762804 - protein, 6 aa, Staphylococcus epidermidis
NESYES

SEQ ID NO: 1762805 - protein, 6 aa, Staphylococcus epidermidis
NETSAS

SEQ ID NO: 1762806 - protein, 4 aa, Staphylococcus epidermidis
NETV

SEQ ID NO: 1762807 - protein, 9 aa, Staphylococcus epidermidis
NEVGKTPAQ

SEQ ID NO: 1762808 - protein, 6 aa, Staphylococcus epidermidis
NEVKQR

SEQ ID NO: 1762809 - protein, 26 aa, Staphylococcus epidermidis
NEYDDTDKIFSNPADKQTEDYISGRF

SEQ ID NO: 1762810 - protein, 12 aa, Staphylococcus epidermidis
NEYEDHPSPEFR

SEQ ID NO: 1762811 - protein, 8 aa, Staphylococcus epidermidis
NEYGTAPV

SEQ ID NO: 1762812 - protein, 15 aa, Staphylococcus epidermidis
NFETEGEEQHGNGFN

SEQ ID NO: 1762813 - protein, 37 aa, Staphylococcus epidermidis
NFGQNQDEEEEPPTEEIKTKRSEIKKQLEQGKLENEK

SEQ ID NO: 1762814 - protein, 8 aa, Staphylococcus epidermidis
NFKSEKTE

SEQ ID NO: 1762815 - protein, 10 aa, Staphylococcus epidermidis
NFPDEAPGTG

SEQ ID NO: 1762816 - protein, 7 aa, Staphylococcus epidermidis
NFPDKQT

SEQ ID NO: 1762817 - protein, 5 aa, Staphylococcus epidermidis
NFRSR

SEQ ID NO: 1762818 - protein, 8 aa, Staphylococcus epidermidis
NFTESDDF

SEQ ID NO: 1762819 - protein, 5 aa, Staphylococcus epidermidis
NFTRG

SEQ ID NO: 1762820 - protein, 9 aa, Staphylococcus epidermidis
NGAGKSTTI

SEQ ID NO: 1762821 - protein, 9 aa, Staphylococcus epidermidis
NGASEALDT

SEQ ID NO: 1762822 - protein, 15 aa, Staphylococcus epidermidis
NGDGSGVGNPLSEHP

SEQ ID NO: 1762823 - protein, 9 aa, Staphylococcus epidermidis
NGDISNPEE

SEQ ID NO: 1762824 - protein, 10 aa, Staphylococcus epidermidis
NGDQCEEGLE

SEQ ID NO: 1762825 - protein, 5 aa, Staphylococcus epidermidis
NGDQL

SEQ ID NO: 1762826 - protein, 6 aa, Staphylococcus epidermidis
NGDTTG

SEQ ID NO: 1762827 - protein, 5 aa, Staphylococcus epidermidis
NGEKV

SEQ ID NO: 1762828 - protein, 13 aa, Staphylococcus epidermidis
NGENLGQVASQTL

SEQ ID NO: 1762829 - protein, 8 aa, Staphylococcus epidermidis
NGESTQDF

SEQ ID NO: 1762830 - protein, 4 aa, Staphylococcus epidermidis
NGFP

SEQ ID NO: 1762831 - protein, 8 aa, Staphylococcus epidermidis
NGGITEIS

SEQ ID NO: 1762832 - protein, 19 aa, Staphylococcus epidermidis
NGGKDEKSGKQVGPSYEGI

SEQ ID NO: 1762833 - protein, 18 aa, Staphylococcus epidermidis
NGGKQVNSVPHKATAKYN

SEQ ID NO: 1762834 - protein, 5 aa, Staphylococcus epidermidis
NGGRH

SEQ ID NO: 1762835 - protein, 6 aa, Staphylococcus epidermidis
NGHSFT

SEQ ID NO: 1762836 - protein, 4 aa, Staphylococcus epidermidis
NGIP

SEQ ID NO: 1762837 - protein, 7 aa, Staphylococcus epidermidis
NGKDPIA

SEQ ID NO: 1762838 - protein, 7 aa, Staphylococcus epidermidis
NGKSKIK

SEQ ID NO: 1762839 - protein, 8 aa, Staphylococcus epidermidis
NGLEPTEV

SEQ ID NO: 1762840 - protein, 9 aa, Staphylococcus epidermidis
NGLKDPDTA

SEQ ID NO: 1762841 - protein, 10 aa, Staphylococcus epidermidis
NGMDEATLSG

SEQ ID NO: 1762842 - protein, 4 aa, Staphylococcus epidermidis
NGNR

SEQ ID NO: 1762843 - protein, 6 aa, Staphylococcus epidermidis
NGQGRI

SEQ ID NO: 1762844 - protein, 6 aa, Staphylococcus epidermidis
NGQIVD

SEQ ID NO: 1762845 - protein, 4 aa, Staphylococcus epidermidis
NGQK

SEQ ID NO: 1762846 - protein, 11 aa, Staphylococcus epidermidis
NGQTGVNPPVG

SEQ ID NO: 1762847 - protein, 8 aa, Staphylococcus epidermidis
NGSGEKEI

SEQ ID NO: 1762848 - protein, 5 aa, Staphylococcus epidermidis
NGSHY

SEQ ID NO: 1762849 - protein, 8 aa, Staphylococcus epidermidis
NGSNDDLL

SEQ ID NO: 1762850 - protein, 9 aa, Staphylococcus epidermidis
NGSPEQSGH

SEQ ID NO: 1762851 - protein, 6 aa, Staphylococcus epidermidis
NGSRGA

SEQ ID NO: 1762852 - protein, 8 aa, Staphylococcus epidermidis
NGSVYERE

SEQ ID NO: 1762853 - protein, 10 aa, Staphylococcus epidermidis
NGTASRETEQ

SEQ ID NO: 1762854 - protein, 8 aa, Staphylococcus epidermidis
NGTGIAQE

SEQ ID NO: 1762855 - protein, 12 aa, Staphylococcus epidermidis
NGTMGQRWEEGK

SEQ ID NO: 1762856 - protein, 8 aa, Staphylococcus epidermidis
NGTQSEMQ

SEQ ID NO: 1762857 - protein, 7 aa, Staphylococcus epidermidis
NGVKDGL

SEQ ID NO: 1762858 - protein, 6 aa, Staphylococcus epidermidis
NGYGLG

SEQ ID NO: 1762859 - protein, 5 aa, Staphylococcus epidermidis
NHATD

SEQ ID NO: 1762860 - protein, 9 aa, Staphylococcus epidermidis
NHDGRERLN

SEQ ID NO: 1762861 - protein, 7 aa, Staphylococcus epidermidis
NHEGELT

SEQ ID NO: 1762862 - protein, 6 aa, Staphylococcus epidermidis
NHEGQA

SEQ ID NO: 1762863 - protein, 6 aa, Staphylococcus epidermidis
NHENGN

SEQ ID NO: 1762864 - protein, 6 aa, Staphylococcus epidermidis
NHESNH

SEQ ID NO: 1762865 - protein, 11 aa, Staphylococcus epidermidis
NHGGRTYHPYG

SEQ ID NO: 1762866 - protein, 6 aa, Staphylococcus epidermidis
NHKPNI

SEQ ID NO: 1762867 - protein, 5 aa, Staphylococcus epidermidis
NHKQD

SEQ ID NO: 1762868 - protein, 9 aa, Staphylococcus epidermidis
NHQHQKEAH

SEQ ID NO: 1762869 - protein, 8 aa, Staphylococcus epidermidis
NHQPLPQS

SEQ ID NO: 1762870 - protein, 11 aa, Staphylococcus epidermidis
NHTNKNSGPWL

SEQ ID NO: 1762871 - protein, 5 aa, Staphylococcus epidermidis
NHTSN

SEQ ID NO: 1762872 - protein, 7 aa, Staphylococcus epidermidis
NIGISSP

SEQ ID NO: 1762873 - protein, 9 aa, Staphylococcus epidermidis
NIGTPDDLS

SEQ ID NO: 1762874 - protein, 51 aa, Staphylococcus epidermidis
NIKETVGNATDNKELEKDGKGDKASGKAKEAVENVKEKANDVIDKFKGNKG

SEQ ID NO: 1762875 - protein, 7 aa, Staphylococcus epidermidis
NIKSEDE

SEQ ID NO: 1762876 - protein, 7 aa, Staphylococcus epidermidis
NINSPKQ

SEQ ID NO: 1762877 - protein, 6 aa, Staphylococcus epidermidis
NIPGNG

SEQ ID NO: 1762878 - protein, 10 aa, Staphylococcus epidermidis
NISKTANQIQ

SEQ ID NO: 1762879 - protein, 16 aa, Staphylococcus epidermidis
NISQLSKSQLRKKRQK

SEQ ID NO: 1762880 - protein, 9 aa, Staphylococcus epidermidis
NKATANEEA

SEQ ID NO: 1762881 - protein, 5 aa, Staphylococcus epidermidis
NKDCP

SEQ ID NO: 1762882 - protein, 9 aa, Staphylococcus epidermidis
NKDGKIEKF

SEQ ID NO: 1762883 - protein, 7 aa, Staphylococcus epidermidis
NKDIAED

SEQ ID NO: 1762884 - protein, 5 aa, Staphylococcus epidermidis
NKEEV

SEQ ID NO: 1762885 - protein, 6 aa, Staphylococcus epidermidis
NKEGEL

SEQ ID NO: 1762886 - protein, 5 aa, Staphylococcus epidermidis
NKEGK

SEQ ID NO: 1762887 - protein, 5 aa, Staphylococcus epidermidis
NKEGN

SEQ ID NO: 1762888 - protein, 8 aa, Staphylococcus epidermidis
NKEGSGTG

SEQ ID NO: 1762889 - protein, 8 aa, Staphylococcus epidermidis
NKEQLDGK

SEQ ID NO: 1762890 - protein, 12 aa, Staphylococcus epidermidis
NKESYFKQSSEI

SEQ ID NO: 1762891 - protein, 5 aa, Staphylococcus epidermidis
NKGDY

SEQ ID NO: 1762892 - protein, 7 aa, Staphylococcus epidermidis
NKGMNKA

SEQ ID NO: 1762893 - protein, 5 aa, Staphylococcus epidermidis
NKGTK

SEQ ID NO: 1762894 - protein, 7 aa, Staphylococcus epidermidis
NKIEPGK

SEQ ID NO: 1762895 - protein, 9 aa, Staphylococcus epidermidis
NKIKHDQYK

SEQ ID NO: 1762896 - protein, 10 aa, Staphylococcus epidermidis
NKKAFDEQEF

SEQ ID NO: 1762897 - protein, 19 aa, Staphylococcus epidermidis
NKKEEIDNNPFKDALKNLK

SEQ ID NO: 1762898 - protein, 8 aa, Staphylococcus epidermidis
NKKNTQLP

SEQ ID NO: 1762899 - protein, 7 aa, Staphylococcus epidermidis
NKKQELN

SEQ ID NO: 1762900 - protein, 7 aa, Staphylococcus epidermidis
NKLSIET

SEQ ID NO: 1762901 - protein, 8 aa, Staphylococcus epidermidis
NKLTKDEV

SEQ ID NO: 1762902 - protein, 5 aa, Staphylococcus epidermidis
NKNEN

SEQ ID NO: 1762903 - protein, 7 aa, Staphylococcus epidermidis
NKNTISS

SEQ ID NO: 1762904 - protein, 6 aa, Staphylococcus epidermidis
NKPAQG

SEQ ID NO: 1762905 - protein, 7 aa, Staphylococcus epidermidis
NKPATKQ

SEQ ID NO: 1762906 - protein, 8 aa, Staphylococcus epidermidis
NKPGMDKG

SEQ ID NO: 1762907 - protein, 21 aa, Staphylococcus epidermidis
NKPNIATATVGEGSSNQGDFH

SEQ ID NO: 1762908 - protein, 7 aa, Staphylococcus epidermidis
NKQFDRN

SEQ ID NO: 1762909 - protein, 8 aa, Staphylococcus epidermidis
NKQTVGIG

SEQ ID NO: 1762910 - protein, 5 aa, Staphylococcus epidermidis
NKRQP

SEQ ID NO: 1762911 - protein, 7 aa, Staphylococcus epidermidis
NKSANDV

SEQ ID NO: 1762912 - protein, 19 aa, Staphylococcus epidermidis
NKSAREKEAKRVKQLMQDE

SEQ ID NO: 1762913 - protein, 4 aa, Staphylococcus epidermidis
NKSK

SEQ ID NO: 1762914 - protein, 6 aa, Staphylococcus epidermidis
NKSQDV

SEQ ID NO: 1762915 - protein, 9 aa, Staphylococcus epidermidis
NKSTQTPLD

SEQ ID NO: 1762916 - protein, 10 aa, Staphylococcus epidermidis
NKTGKAEGDY

SEQ ID NO: 1762917 - protein, 8 aa, Staphylococcus epidermidis
NKTGTGKE

SEQ ID NO: 1762918 - protein, 8 aa, Staphylococcus epidermidis
NKTKNQVD

SEQ ID NO: 1762919 - protein, 8 aa, Staphylococcus epidermidis
NKTSNESV

SEQ ID NO: 1762920 - protein, 8 aa, Staphylococcus epidermidis
NKTTERDY

SEQ ID NO: 1762921 - protein, 6 aa, Staphylococcus epidermidis
NKTTFK

SEQ ID NO: 1762922 - protein, 4 aa, Staphylococcus epidermidis
NKVE

SEQ ID NO: 1762923 - protein, 25 aa, Staphylococcus epidermidis
NKVEVTKDHTTVVDGNGDENNIDAR

SEQ ID NO: 1762924 - protein, 9 aa, Staphylococcus epidermidis
NKVNPSSEI

SEQ ID NO: 1762925 - protein, 8 aa, Staphylococcus epidermidis
NKYRVSAH

SEQ ID NO: 1762926 - protein, 5 aa, Staphylococcus epidermidis
NKYSM

SEQ ID NO: 1762927 - protein, 10 aa, Staphylococcus epidermidis
NKYSPYPEEI

SEQ ID NO: 1762928 - protein, 6 aa, Staphylococcus epidermidis
NKYVSR

SEQ ID NO: 1762929 - protein, 15 aa, Staphylococcus epidermidis
NLADNSGQKYGLGSS

SEQ ID NO: 1762930 - protein, 11 aa, Staphylococcus epidermidis
NLAQNGDRDAI

SEQ ID NO: 1762931 - protein, 5 aa, Staphylococcus epidermidis
NLEGK

SEQ ID NO: 1762932 - protein, 6 aa, Staphylococcus epidermidis
NLEGSI

SEQ ID NO: 1762933 - protein, 9 aa, Staphylococcus epidermidis
NLPYKGSLN

SEQ ID NO: 1762934 - protein, 7 aa, Staphylococcus epidermidis
NLQERQQ

SEQ ID NO: 1762935 - protein, 19 aa, Staphylococcus epidermidis
NLQTARRNLNSPNIKTRKR

SEQ ID NO: 1762936 - protein, 6 aa, Staphylococcus epidermidis
NLRDTE

SEQ ID NO: 1762937 - protein, 4 aa, Staphylococcus epidermidis
NLSE

SEQ ID NO: 1762938 - protein, 5 aa, Staphylococcus epidermidis
NLSHP

SEQ ID NO: 1762939 - protein, 11 aa, Staphylococcus epidermidis
NLSQDEKQKHV

SEQ ID NO: 1762940 - protein, 7 aa, Staphylococcus epidermidis
NLSQENY

SEQ ID NO: 1762941 - protein, 8 aa, Staphylococcus epidermidis
NLSTPSVR

SEQ ID NO: 1762942 - protein, 5 aa, Staphylococcus epidermidis
NLSYT

SEQ ID NO: 1762943 - protein, 11 aa, Staphylococcus epidermidis
NLTSKVKNGPT

SEQ ID NO: 1762944 - protein, 8 aa, Staphylococcus epidermidis
NLTSNDDV

SEQ ID NO: 1762945 - protein, 9 aa, Staphylococcus epidermidis
NMAEDKGLD

SEQ ID NO: 1762946 - protein, 12 aa, Staphylococcus epidermidis
NMIGESSMKPDD

SEQ ID NO: 1762947 - protein, 10 aa, Staphylococcus epidermidis
NMSQQDAEKF

SEQ ID NO: 1762948 - protein, 5 aa, Staphylococcus epidermidis
NMTSG

SEQ ID NO: 1762949 - protein, 5 aa, Staphylococcus epidermidis
NNDDS

SEQ ID NO: 1762950 - protein, 5 aa, Staphylococcus epidermidis
NNDEI

SEQ ID NO: 1762951 - protein, 5 aa, Staphylococcus epidermidis
NNDGP

SEQ ID NO: 1762952 - protein, 7 aa, Staphylococcus epidermidis
NNDMSDG

SEQ ID NO: 1762953 - protein, 5 aa, Staphylococcus epidermidis
NNDNE

SEQ ID NO: 1762954 - protein, 6 aa, Staphylococcus epidermidis
NNDPWE

SEQ ID NO: 1762955 - protein, 9 aa, Staphylococcus epidermidis
NNDSKSYYE

SEQ ID NO: 1762956 - protein, 8 aa, Staphylococcus epidermidis
NNEPGKIT

SEQ ID NO: 1762957 - protein, 6 aa, Staphylococcus epidermidis
NNERNV

SEQ ID NO: 1762958 - protein, 6 aa, Staphylococcus epidermidis
NNERPD

SEQ ID NO: 1762959 - protein, 8 aa, Staphylococcus epidermidis
NNERQVQS

SEQ ID NO: 1762960 - protein, 10 aa, Staphylococcus epidermidis
NNESDMKETA

SEQ ID NO: 1762961 - protein, 7 aa, Staphylococcus epidermidis
NNGEEGN

SEQ ID NO: 1762962 - protein, 11 aa, Staphylococcus epidermidis
NNGESYKLEQY

SEQ ID NO: 1762963 - protein, 8 aa, Staphylococcus epidermidis
NNGEYADQ

SEQ ID NO: 1762964 - protein, 14 aa, Staphylococcus epidermidis
NNGSIDNDPPAAMR

SEQ ID NO: 1762965 - protein, 5 aa, Staphylococcus epidermidis
NNIKG

SEQ ID NO: 1762966 - protein, 8 aa, Staphylococcus epidermidis
NNINANQI

SEQ ID NO: 1762967 - protein, 6 aa, Staphylococcus epidermidis
NNINTV

SEQ ID NO: 1762968 - protein, 9 aa, Staphylococcus epidermidis
NNKASEYTK

SEQ ID NO: 1762969 - protein, 10 aa, Staphylococcus epidermidis
NNKDNYKAQA

SEQ ID NO: 1762970 - protein, 4 aa, Staphylococcus epidermidis
NNKE

SEQ ID NO: 1762971 - protein, 10 aa, Staphylococcus epidermidis
NNKQKRDPNV

SEQ ID NO: 1762972 - protein, 6 aa, Staphylococcus epidermidis
NNKTSE

SEQ ID NO: 1762973 - protein, 4 aa, Staphylococcus epidermidis
NNNI

SEQ ID NO: 1762974 - protein, 5 aa, Staphylococcus epidermidis
NNNKE

SEQ ID NO: 1762975 - protein, 10 aa, Staphylococcus epidermidis
NNNNEDSLES

SEQ ID NO: 1762976 - protein, 4 aa, Staphylococcus epidermidis
NNNR

SEQ ID NO: 1762977 - protein, 4 aa, Staphylococcus epidermidis
NNPD

SEQ ID NO: 1762978 - protein, 6 aa, Staphylococcus epidermidis
NNPQHK

SEQ ID NO: 1762979 - protein, 11 aa, Staphylococcus epidermidis
NNQKYKEGNTV

SEQ ID NO: 1762980 - protein, 14 aa, Staphylococcus epidermidis
NNQTSEEQQEGLNT

SEQ ID NO: 1762981 - protein, 8 aa, Staphylococcus epidermidis
NNRITDAE

SEQ ID NO: 1762982 - protein, 7 aa, Staphylococcus epidermidis
NNSFNKD

SEQ ID NO: 1762983 - protein, 9 aa, Staphylococcus epidermidis
NNSQGIPTR

SEQ ID NO: 1762984 - protein, 9 aa, Staphylococcus epidermidis
NNSSPLNSQ

SEQ ID NO: 1762985 - protein, 13 aa, Staphylococcus epidermidis
NNTIGEVAQDNGL

SEQ ID NO: 1762986 - protein, 4 aa, Staphylococcus epidermidis
NNVP

SEQ ID NO: 1762987 - protein, 4 aa, Staphylococcus epidermidis
NPDK

SEQ ID NO: 1762988 - protein, 7 aa, Staphylococcus epidermidis
NPDVSAQ

SEQ ID NO: 1762989 - protein, 15 aa, Staphylococcus epidermidis
NPFPEIKNANDQRAY

SEQ ID NO: 1762990 - protein, 6 aa, Staphylococcus epidermidis
NPIPGD

SEQ ID NO: 1762991 - protein, 6 aa, Staphylococcus epidermidis
NPISDE

SEQ ID NO: 1762992 - protein, 7 aa, Staphylococcus epidermidis
NPKINEK

SEQ ID NO: 1762993 - protein, 11 aa, Staphylococcus epidermidis
NPKQQDDREIE

SEQ ID NO: 1762994 - protein, 7 aa, Staphylococcus epidermidis
NPLSKDD

SEQ ID NO: 1762995 - protein, 4 aa, Staphylococcus epidermidis
NPNV

SEQ ID NO: 1762996 - protein, 5 aa, Staphylococcus epidermidis
NPPYI

SEQ ID NO: 1762997 - protein, 7 aa, Staphylococcus epidermidis
NPQSKDF

SEQ ID NO: 1762998 - protein, 5 aa, Staphylococcus epidermidis
NPSGN

SEQ ID NO: 1762999 - protein, 8 aa, Staphylococcus epidermidis
NPSKNEYP

SEQ ID NO: 1763000 - protein, 11 aa, Staphylococcus epidermidis
NPTTGGVSASF

SEQ ID NO: 1763001 - protein, 11 aa, Staphylococcus epidermidis
NPTYDSDQRTA

SEQ ID NO: 1763002 - protein, 13 aa, Staphylococcus epidermidis
NPVNSKGEKTTPV

SEQ ID NO: 1763003 - protein, 6 aa, Staphylococcus epidermidis
NQAQDE

SEQ ID NO: 1763004 - protein, 12 aa, Staphylococcus epidermidis
NQASHQDDSFSD

SEQ ID NO: 1763005 - protein, 27 aa, Staphylococcus epidermidis
NQASSLTVQRKGAQASIPTRKEVEAEY

SEQ ID NO: 1763006 - protein, 6 aa, Staphylococcus epidermidis
NQDDDA

SEQ ID NO: 1763007 - protein, 19 aa, Staphylococcus epidermidis
NQDSSPSDRDEATAATTAY

SEQ ID NO: 1763008 - protein, 7 aa, Staphylococcus epidermidis
NQDTTVK

SEQ ID NO: 1763009 - protein, 14 aa, Staphylococcus epidermidis
NQEGYKSLEEGQSV

SEQ ID NO: 1763010 - protein, 6 aa, Staphylococcus epidermidis
NQGKDN

SEQ ID NO: 1763011 - protein, 31 aa, Staphylococcus epidermidis
NQIGGKSNSGEGGEDSSRYEIQKDGSNKISA

SEQ ID NO: 1763012 - protein, 5 aa, Staphylococcus epidermidis
NQIPD

SEQ ID NO: 1763013 - protein, 4 aa, Staphylococcus epidermidis
NQKL

SEQ ID NO: 1763014 - protein, 9 aa, Staphylococcus epidermidis
NQLETSSTS

SEQ ID NO: 1763015 - protein, 4 aa, Staphylococcus epidermidis
NQME

SEQ ID NO: 1763016 - protein, 7 aa, Staphylococcus epidermidis
NQNNTYE

SEQ ID NO: 1763017 - protein, 6 aa, Staphylococcus epidermidis
NQPGGS

SEQ ID NO: 1763018 - protein, 7 aa, Staphylococcus epidermidis
NQPKGVG

SEQ ID NO: 1763019 - protein, 6 aa, Staphylococcus epidermidis
NQPKLT

SEQ ID NO: 1763020 - protein, 23 aa, Staphylococcus epidermidis
NQPKNYETHSNDKRQNNRGRQNQ

SEQ ID NO: 1763021 - protein, 6 aa, Staphylococcus epidermidis
NQPMDE

SEQ ID NO: 1763022 - protein, 6 aa, Staphylococcus epidermidis
NQPTKL

SEQ ID NO: 1763023 - protein, 8 aa, Staphylococcus epidermidis
NQSTDHHT

SEQ ID NO: 1763024 - protein, 6 aa, Staphylococcus epidermidis
NQTLED

SEQ ID NO: 1763025 - protein, 7 aa, Staphylococcus epidermidis
NQTSANR

SEQ ID NO: 1763026 - protein, 5 aa, Staphylococcus epidermidis
NQVTA

SEQ ID NO: 1763027 - protein, 12 aa, Staphylococcus epidermidis
NQWDDEYPAKEH

SEQ ID NO: 1763028 - protein, 5 aa, Staphylococcus epidermidis
NQYYE

SEQ ID NO: 1763029 - protein, 6 aa, Staphylococcus epidermidis
NREEVI

SEQ ID NO: 1763030 - protein, 19 aa, Staphylococcus epidermidis
NRESEHGNAVKQAHKPNFD

SEQ ID NO: 1763031 - protein, 12 aa, Staphylococcus epidermidis
NRFSQDDQEGLE

SEQ ID NO: 1763032 - protein, 4 aa, Staphylococcus epidermidis
NRGA

SEQ ID NO: 1763033 - protein, 7 aa, Staphylococcus epidermidis
NRGEKEK

SEQ ID NO: 1763034 - protein, 16 aa, Staphylococcus epidermidis
NRGKSGYELTNGPGKW

SEQ ID NO: 1763035 - protein, 24 aa, Staphylococcus epidermidis
NRKEKTRYPAHPFTTSTLQQEAAR

SEQ ID NO: 1763036 - protein, 4 aa, Staphylococcus epidermidis
NRLE

SEQ ID NO: 1763037 - protein, 7 aa, Staphylococcus epidermidis
NRNKEWR

SEQ ID NO: 1763038 - protein, 6 aa, Staphylococcus epidermidis
NRNPEN

SEQ ID NO: 1763039 - protein, 4 aa, Staphylococcus epidermidis
NRQR

SEQ ID NO: 1763040 - protein, 12 aa, Staphylococcus epidermidis
NRSSTSSELKEQ

SEQ ID NO: 1763041 - protein, 6 aa, Staphylococcus epidermidis
NRSTET

SEQ ID NO: 1763042 - protein, 18 aa, Staphylococcus epidermidis
NRYKDINGSYEDEVYEFD

SEQ ID NO: 1763043 - protein, 6 aa, Staphylococcus epidermidis
NRYRKA

SEQ ID NO: 1763044 - protein, 6 aa, Staphylococcus epidermidis
NSDANI

SEQ ID NO: 1763045 - protein, 9 aa, Staphylococcus epidermidis
NSDDGEPCN

SEQ ID NO: 1763046 - protein, 7 aa, Staphylococcus epidermidis
NSDEEAI

SEQ ID NO: 1763047 - protein, 6 aa, Staphylococcus epidermidis
NSDQIP

SEQ ID NO: 1763048 - protein, 8 aa, Staphylococcus epidermidis
NSDQTESI

SEQ ID NO: 1763049 - protein, 18 aa, Staphylococcus epidermidis
NSDRSSHDEVEDNNAAYK

SEQ ID NO: 1763050 - protein, 8 aa, Staphylococcus epidermidis
NSEENKGK

SEQ ID NO: 1763051 - protein, 4 aa, Staphylococcus epidermidis
NSEG

SEQ ID NO: 1763052 - protein, 7 aa, Staphylococcus epidermidis
NSEKIKS

SEQ ID NO: 1763053 - protein, 14 aa, Staphylococcus epidermidis
NSGGHAANNAKKYQ

SEQ ID NO: 1763054 - protein, 4 aa, Staphylococcus epidermidis
NSGK

SEQ ID NO: 1763055 - protein, 8 aa, Staphylococcus epidermidis
NSGNVDPV

SEQ ID NO: 1763056 - protein, 5 aa, Staphylococcus epidermidis
NSGPT

SEQ ID NO: 1763057 - protein, 10 aa, Staphylococcus epidermidis
NSKEIIGDKD

SEQ ID NO: 1763058 - protein, 9 aa, Staphylococcus epidermidis
NSLETQSLQ

SEQ ID NO: 1763059 - protein, 5 aa, Staphylococcus epidermidis
NSLSN

SEQ ID NO: 1763060 - protein, 18 aa, Staphylococcus epidermidis
NSNGDNQISGVTDSNMTQ

SEQ ID NO: 1763061 - protein, 4 aa, Staphylococcus epidermidis
NSNK

SEQ ID NO: 1763062 - protein, 12 aa, Staphylococcus epidermidis
NSPFAGREGDYV

SEQ ID NO: 1763063 - protein, 8 aa, Staphylococcus epidermidis
NSPQNASP

SEQ ID NO: 1763064 - protein, 15 aa, Staphylococcus epidermidis
NSPVNDLSRGCSTED

SEQ ID NO: 1763065 - protein, 6 aa, Staphylococcus epidermidis
NSQGKQ

SEQ ID NO: 1763066 - protein, 7 aa, Staphylococcus epidermidis
NSQLASQ

SEQ ID NO: 1763067 - protein, 5 aa, Staphylococcus epidermidis
NSRKS

SEQ ID NO: 1763068 - protein, 15 aa, Staphylococcus epidermidis
NSSEPEEGLPLALLK

SEQ ID NO: 1763069 - protein, 12 aa, Staphylococcus epidermidis
NSSKGGTFDSEE

SEQ ID NO: 1763070 - protein, 5 aa, Staphylococcus epidermidis
NSSMY

SEQ ID NO: 1763071 - protein, 8 aa, Staphylococcus epidermidis
NSSQTEKL

SEQ ID NO: 1763072 - protein, 8 aa, Staphylococcus epidermidis
NSSTLSDQ

SEQ ID NO: 1763073 - protein, 11 aa, Staphylococcus epidermidis
NSTGGVLGPQD

SEQ ID NO: 1763074 - protein, 7 aa, Staphylococcus epidermidis
NSYQKGE

SEQ ID NO: 1763075 - protein, 7 aa, Staphylococcus epidermidis
NSYQRTS

SEQ ID NO: 1763076 - protein, 6 aa, Staphylococcus epidermidis
NTCEKK

SEQ ID NO: 1763077 - protein, 7 aa, Staphylococcus epidermidis
NTDTNFD

SEQ ID NO: 1763078 - protein, 5 aa, Staphylococcus epidermidis
NTEFD

SEQ ID NO: 1763079 - protein, 21 aa, Staphylococcus epidermidis
NTEPSKELRASFNSRKDSNFT

SEQ ID NO: 1763080 - protein, 19 aa, Staphylococcus epidermidis
NTFGDAAKSLKVSSTKSMT

SEQ ID NO: 1763081 - protein, 16 aa, Staphylococcus epidermidis
NTFGGGGHPNASGVSV

SEQ ID NO: 1763082 - protein, 7 aa, Staphylococcus epidermidis
NTGRKGP

SEQ ID NO: 1763083 - protein, 9 aa, Staphylococcus epidermidis
NTKASSTSE

SEQ ID NO: 1763084 - protein, 13 aa, Staphylococcus epidermidis
NTKVTEGEAGGIT

SEQ ID NO: 1763085 - protein, 10 aa, Staphylococcus epidermidis
NTLEAEGAEL

SEQ ID NO: 1763086 - protein, 4 aa, Staphylococcus epidermidis
NTLS

SEQ ID NO: 1763087 - protein, 8 aa, Staphylococcus epidermidis
NTMSTEMS

SEQ ID NO: 1763088 - protein, 9 aa, Staphylococcus epidermidis
NTNAQVGHS

SEQ ID NO: 1763089 - protein, 8 aa, Staphylococcus epidermidis
NTNDNYTG

SEQ ID NO: 1763090 - protein, 11 aa, Staphylococcus epidermidis
NTNDSIPQDDA

SEQ ID NO: 1763091 - protein, 6 aa, Staphylococcus epidermidis
NTNGQY

SEQ ID NO: 1763092 - protein, 6 aa, Staphylococcus epidermidis
NTNPHS

SEQ ID NO: 1763093 - protein, 10 aa, Staphylococcus epidermidis
NTNRPNDKGT

SEQ ID NO: 1763094 - protein, 5 aa, Staphylococcus epidermidis
NTQGY

SEQ ID NO: 1763095 - protein, 8 aa, Staphylococcus epidermidis
NTRAITAN

SEQ ID NO: 1763096 - protein, 8 aa, Staphylococcus epidermidis
NTRKTTGH

SEQ ID NO: 1763097 - protein, 8 aa, Staphylococcus epidermidis
NTRPVPDT

SEQ ID NO: 1763098 - protein, 5 aa, Staphylococcus epidermidis
NTSNV

SEQ ID NO: 1763099 - protein, 4 aa, Staphylococcus epidermidis
NTSY

SEQ ID NO: 1763100 - protein, 15 aa, Staphylococcus epidermidis
NTTEDKINQELEDGT

SEQ ID NO: 1763101 - protein, 11 aa, Staphylococcus epidermidis
NTYEPGSTFKT

SEQ ID NO: 1763102 - protein, 5 aa, Staphylococcus epidermidis
NVDFG

SEQ ID NO: 1763103 - protein, 16 aa, Staphylococcus epidermidis
NVDGVYSADPKVDANA

SEQ ID NO: 1763104 - protein, 7 aa, Staphylococcus epidermidis
NVDKNDV

SEQ ID NO: 1763105 - protein, 7 aa, Staphylococcus epidermidis
NVDQHTD

SEQ ID NO: 1763106 - protein, 12 aa, Staphylococcus epidermidis
NVEPPDDEAVKE

SEQ ID NO: 1763107 - protein, 5 aa, Staphylococcus epidermidis
NVGKS

SEQ ID NO: 1763108 - protein, 5 aa, Staphylococcus epidermidis
NVGRN

SEQ ID NO: 1763109 - protein, 21 aa, Staphylococcus epidermidis
NVKTNANVKPKADKSNPNHIG

SEQ ID NO: 1763110 - protein, 7 aa, Staphylococcus epidermidis
NVKTSIP

SEQ ID NO: 1763111 - protein, 12 aa, Staphylococcus epidermidis
NVNTENQIASAK

SEQ ID NO: 1763112 - protein, 4 aa, Staphylococcus epidermidis
NVPE

SEQ ID NO: 1763113 - protein, 9 aa, Staphylococcus epidermidis
NVSAREGAL

SEQ ID NO: 1763114 - protein, 5 aa, Staphylococcus epidermidis
NVSDQ

SEQ ID NO: 1763115 - protein, 7 aa, Staphylococcus epidermidis
NVSESTY

SEQ ID NO: 1763116 - protein, 11 aa, Staphylococcus epidermidis
NVSKGAEPTAS

SEQ ID NO: 1763117 - protein, 7 aa, Staphylococcus epidermidis
NVSQRLT

SEQ ID NO: 1763118 - protein, 5 aa, Staphylococcus epidermidis
NVTPE

SEQ ID NO: 1763119 - protein, 12 aa, Staphylococcus epidermidis
NVTSGANPVGLR

SEQ ID NO: 1763120 - protein, 9 aa, Staphylococcus epidermidis
NWESSKGKG

SEQ ID NO: 1763121 - protein, 11 aa, Staphylococcus epidermidis
NWSKTKQTDTP

SEQ ID NO: 1763122 - protein, 13 aa, Staphylococcus epidermidis
NYAASKEKDDKDL

SEQ ID NO: 1763123 - protein, 14 aa, Staphylococcus epidermidis
NYDNDTKLNEAKER

SEQ ID NO: 1763124 - protein, 9 aa, Staphylococcus epidermidis
NYEANQSEL

SEQ ID NO: 1763125 - protein, 10 aa, Staphylococcus epidermidis
NYEKAEQIYG

SEQ ID NO: 1763126 - protein, 5 aa, Staphylococcus epidermidis
NYEPQ

SEQ ID NO: 1763127 - protein, 9 aa, Staphylococcus epidermidis
NYESKKQEI

SEQ ID NO: 1763128 - protein, 7 aa, Staphylococcus epidermidis
NYKPMQS

SEQ ID NO: 1763129 - protein, 9 aa, Staphylococcus epidermidis
NYKTNLGKT

SEQ ID NO: 1763130 - protein, 5 aa, Staphylococcus epidermidis
NYNPT

SEQ ID NO: 1763131 - protein, 5 aa, Staphylococcus epidermidis
NYQTD

SEQ ID NO: 1763132 - protein, 10 aa, Staphylococcus epidermidis
NYRPNSITGT

SEQ ID NO: 1763133 - protein, 7 aa, Staphylococcus epidermidis
PAADNKF

SEQ ID NO: 1763134 - protein, 11 aa, Staphylococcus epidermidis
PAEKVNKALDQ

SEQ ID NO: 1763135 - protein, 6 aa, Staphylococcus epidermidis
PAEQRQ

SEQ ID NO: 1763136 - protein, 13 aa, Staphylococcus epidermidis
PAGDGWDSNPFQP

SEQ ID NO: 1763137 - protein, 17 aa, Staphylococcus epidermidis
PAGTKHDVEGSKQPLGS

SEQ ID NO: 1763138 - protein, 10 aa, Staphylococcus epidermidis
PAGTQTGKQF

SEQ ID NO: 1763139 - protein, 5 aa, Staphylococcus epidermidis
PALKK

SEQ ID NO: 1763140 - protein, 4 aa, Staphylococcus epidermidis
PALR

SEQ ID NO: 1763141 - protein, 5 aa, Staphylococcus epidermidis
PAPQL

SEQ ID NO: 1763142 - protein, 6 aa, Staphylococcus epidermidis
PAPTGQ

SEQ ID NO: 1763143 - protein, 5 aa, Staphylococcus epidermidis
PARGR

SEQ ID NO: 1763144 - protein, 7 aa, Staphylococcus epidermidis
PARKGAK

SEQ ID NO: 1763145 - protein, 4 aa, Staphylococcus epidermidis
PARS

SEQ ID NO: 1763146 - protein, 4 aa, Staphylococcus epidermidis
PATE

SEQ ID NO: 1763147 - protein, 7 aa, Staphylococcus epidermidis
PATGEAF

SEQ ID NO: 1763148 - protein, 14 aa, Staphylococcus epidermidis
PATRNLNNNIQKYK

SEQ ID NO: 1763149 - protein, 8 aa, Staphylococcus epidermidis
PATSELKD

SEQ ID NO: 1763150 - protein, 13 aa, Staphylococcus epidermidis
PAVDQSVQSLSEA

SEQ ID NO: 1763151 - protein, 4 aa, Staphylococcus epidermidis
PDAE

SEQ ID NO: 1763152 - protein, 5 aa, Staphylococcus epidermidis
PDAPH

SEQ ID NO: 1763153 - protein, 9 aa, Staphylococcus epidermidis
PDAVPPREM

SEQ ID NO: 1763154 - protein, 7 aa, Staphylococcus epidermidis
PDAYGRG

SEQ ID NO: 1763155 - protein, 9 aa, Staphylococcus epidermidis
PDEEKKGRM

SEQ ID NO: 1763156 - protein, 8 aa, Staphylococcus epidermidis
PDFPGDKI

SEQ ID NO: 1763157 - protein, 4 aa, Staphylococcus epidermidis
PDHY

SEQ ID NO: 1763158 - protein, 10 aa, Staphylococcus epidermidis
PDIRSPKEAY

SEQ ID NO: 1763159 - protein, 10 aa, Staphylococcus epidermidis
PDLPKLEKKY

SEQ ID NO: 1763160 - protein, 8 aa, Staphylococcus epidermidis
PDLRKNHP

SEQ ID NO: 1763161 - protein, 10 aa, Staphylococcus epidermidis
PDLTTSNDTD

SEQ ID NO: 1763162 - protein, 4 aa, Staphylococcus epidermidis
PDNQ

SEQ ID NO: 1763163 - protein, 12 aa, Staphylococcus epidermidis
PDSFSDGGQYHS

SEQ ID NO: 1763164 - protein, 7 aa, Staphylococcus epidermidis
PDTDAIS

SEQ ID NO: 1763165 - protein, 13 aa, Staphylococcus epidermidis
PDVEVDKGAEALK

SEQ ID NO: 1763166 - protein, 5 aa, Staphylococcus epidermidis
PDVRD

SEQ ID NO: 1763167 - protein, 6 aa, Staphylococcus epidermidis
PDYPEE

SEQ ID NO: 1763168 - protein, 14 aa, Staphylococcus epidermidis
PEAENESDENKYDR

SEQ ID NO: 1763169 - protein, 18 aa, Staphylococcus epidermidis
PEASPVLSGGEPGPHKLQ

SEQ ID NO: 1763170 - protein, 5 aa, Staphylococcus epidermidis
PEDLS

SEQ ID NO: 1763171 - protein, 5 aa, Staphylococcus epidermidis
PEDSW

SEQ ID NO: 1763172 - protein, 8 aa, Staphylococcus epidermidis
PEDTPKIY

SEQ ID NO: 1763173 - protein, 9 aa, Staphylococcus epidermidis
PEDVQDAPG

SEQ ID NO: 1763174 - protein, 9 aa, Staphylococcus epidermidis
PEDYPEKGV

SEQ ID NO: 1763175 - protein, 8 aa, Staphylococcus epidermidis
PEEIEEPG

SEQ ID NO: 1763176 - protein, 6 aa, Staphylococcus epidermidis
PEGEDE

SEQ ID NO: 1763177 - protein, 9 aa, Staphylococcus epidermidis
PEGHVDATD

SEQ ID NO: 1763178 - protein, 11 aa, Staphylococcus epidermidis
PEHASIQTRAP

SEQ ID NO: 1763179 - protein, 10 aa, Staphylococcus epidermidis
PEKEPITPFS

SEQ ID NO: 1763180 - protein, 8 aa, Staphylococcus epidermidis
PEKSGTYG

SEQ ID NO: 1763181 - protein, 5 aa, Staphylococcus epidermidis
PELND

SEQ ID NO: 1763182 - protein, 5 aa, Staphylococcus epidermidis
PEMPN

SEQ ID NO: 1763183 - protein, 7 aa, Staphylococcus epidermidis
PENAGER

SEQ ID NO: 1763184 - protein, 11 aa, Staphylococcus epidermidis
PESGSPKLREA

SEQ ID NO: 1763185 - protein, 5 aa, Staphylococcus epidermidis
PETEE

SEQ ID NO: 1763186 - protein, 8 aa, Staphylococcus epidermidis
PETNETVE

SEQ ID NO: 1763187 - protein, 12 aa, Staphylococcus epidermidis
PEVDGATETLKT

SEQ ID NO: 1763188 - protein, 4 aa, Staphylococcus epidermidis
PEVE

SEQ ID NO: 1763189 - protein, 6 aa, Staphylococcus epidermidis
PEYDGA

SEQ ID NO: 1763190 - protein, 5 aa, Staphylococcus epidermidis
PEYED

SEQ ID NO: 1763191 - protein, 7 aa, Staphylococcus epidermidis
PEYNNNK

SEQ ID NO: 1763192 - protein, 5 aa, Staphylococcus epidermidis
PFDEK

SEQ ID NO: 1763193 - protein, 15 aa, Staphylococcus epidermidis
PFGGPAGGDGGKGAS

SEQ ID NO: 1763194 - protein, 15 aa, Staphylococcus epidermidis
PFGSDLKSAESLNNQ

SEQ ID NO: 1763195 - protein, 5 aa, Staphylococcus epidermidis
PFPSE

SEQ ID NO: 1763196 - protein, 6 aa, Staphylococcus epidermidis
PFQEGR

SEQ ID NO: 1763197 - protein, 5 aa, Staphylococcus epidermidis
PFTNN

SEQ ID NO: 1763198 - protein, 23 aa, Staphylococcus epidermidis
PFTSPKREDIEKLDTEPENVQAN

SEQ ID NO: 1763199 - protein, 15 aa, Staphylococcus epidermidis
PGASSGVIDLLKLAM

SEQ ID NO: 1763200 - protein, 11 aa, Staphylococcus epidermidis
PGAVPRTSTIG

SEQ ID NO: 1763201 - protein, 8 aa, Staphylococcus epidermidis
PGDPKEIG

SEQ ID NO: 1763202 - protein, 4 aa, Staphylococcus epidermidis
PGFQ

SEQ ID NO: 1763203 - protein, 9 aa, Staphylococcus epidermidis
PGGKATPEQ

SEQ ID NO: 1763204 - protein, 27 aa, Staphylococcus epidermidis
PGIRPKGAARNDQQRITTPEEAKTLGS

SEQ ID NO: 1763205 - protein, 8 aa, Staphylococcus epidermidis
PGKADEKQ

SEQ ID NO: 1763206 - protein, 7 aa, Staphylococcus epidermidis
PGKNIQP

SEQ ID NO: 1763207 - protein, 11 aa, Staphylococcus epidermidis
PGKRHNDDIKT

SEQ ID NO: 1763208 - protein, 16 aa, Staphylococcus epidermidis
PGMTSEKNEGKLGDGP

SEQ ID NO: 1763209 - protein, 13 aa, Staphylococcus epidermidis
PGRSFNKAKEDGF

SEQ ID NO: 1763210 - protein, 13 aa, Staphylococcus epidermidis
PGSISQSRSQIEE

SEQ ID NO: 1763211 - protein, 6 aa, Staphylococcus epidermidis
PGSITQ

SEQ ID NO: 1763212 - protein, 6 aa, Staphylococcus epidermidis
PGTPPD

SEQ ID NO: 1763213 - protein, 17 aa, Staphylococcus epidermidis
PGTTTPKYKRNFNRETS

SEQ ID NO: 1763214 - protein, 6 aa, Staphylococcus epidermidis
PHACGT

SEQ ID NO: 1763215 - protein, 7 aa, Staphylococcus epidermidis
PHAERKR

SEQ ID NO: 1763216 - protein, 4 aa, Staphylococcus epidermidis
PHDF

SEQ ID NO: 1763217 - protein, 5 aa, Staphylococcus epidermidis
PHDIR

SEQ ID NO: 1763218 - protein, 5 aa, Staphylococcus epidermidis
PHDQP

SEQ ID NO: 1763219 - protein, 8 aa, Staphylococcus epidermidis
PHKKRESE

SEQ ID NO: 1763220 - protein, 9 aa, Staphylococcus epidermidis
PHPGTDAAV

SEQ ID NO: 1763221 - protein, 9 aa, Staphylococcus epidermidis
PIGASGART

SEQ ID NO: 1763222 - protein, 8 aa, Staphylococcus epidermidis
PIGNQRDE

SEQ ID NO: 1763223 - protein, 18 aa, Staphylococcus epidermidis
PIKQAKELSTDKKSNEKL

SEQ ID NO: 1763224 - protein, 11 aa, Staphylococcus epidermidis
PISKKKIERRE

SEQ ID NO: 1763225 - protein, 7 aa, Staphylococcus epidermidis
PISREKL

SEQ ID NO: 1763226 - protein, 22 aa, Staphylococcus epidermidis
PITIGNGKQIKQQSVKSGTKVL

SEQ ID NO: 1763227 - protein, 7 aa, Staphylococcus epidermidis
PKARTAL

SEQ ID NO: 1763228 - protein, 9 aa, Staphylococcus epidermidis
PKDLKRNEK

SEQ ID NO: 1763229 - protein, 5 aa, Staphylococcus epidermidis
PKDTV

SEQ ID NO: 1763230 - protein, 4 aa, Staphylococcus epidermidis
PKED

SEQ ID NO: 1763231 - protein, 8 aa, Staphylococcus epidermidis
PKESVGKA

SEQ ID NO: 1763232 - protein, 13 aa, Staphylococcus epidermidis
PKETRIGAKQMGT

SEQ ID NO: 1763233 - protein, 5 aa, Staphylococcus epidermidis
PKFPN

SEQ ID NO: 1763234 - protein, 8 aa, Staphylococcus epidermidis
PKGASNKV

SEQ ID NO: 1763235 - protein, 14 aa, Staphylococcus epidermidis
PKGNKEIVTKPETT

SEQ ID NO: 1763236 - protein, 8 aa, Staphylococcus epidermidis
PKKKEAIS

SEQ ID NO: 1763237 - protein, 5 aa, Staphylococcus epidermidis
PKLDV

SEQ ID NO: 1763238 - protein, 7 aa, Staphylococcus epidermidis
PKNPDTV

SEQ ID NO: 1763239 - protein, 11 aa, Staphylococcus epidermidis
PKPDGSEPNNW

SEQ ID NO: 1763240 - protein, 4 aa, Staphylococcus epidermidis
PKQL

SEQ ID NO: 1763241 - protein, 7 aa, Staphylococcus epidermidis
PKQVSEQ

SEQ ID NO: 1763242 - protein, 5 aa, Staphylococcus epidermidis
PKRVK

SEQ ID NO: 1763243 - protein, 4 aa, Staphylococcus epidermidis
PKSK

SEQ ID NO: 1763244 - protein, 6 aa, Staphylococcus epidermidis
PKSPDY

SEQ ID NO: 1763245 - protein, 6 aa, Staphylococcus epidermidis
PKTFTR

SEQ ID NO: 1763246 - protein, 10 aa, Staphylococcus epidermidis
PKYIKTPRKI

SEQ ID NO: 1763247 - protein, 17 aa, Staphylococcus epidermidis
PKYVSSEQVSEEEINHE

SEQ ID NO: 1763248 - protein, 11 aa, Staphylococcus epidermidis
PLAGTTDRQAE

SEQ ID NO: 1763249 - protein, 13 aa, Staphylococcus epidermidis
PLASTSRALEPSV

SEQ ID NO: 1763250 - protein, 14 aa, Staphylococcus epidermidis
PLNPTKSPSTNAQY

SEQ ID NO: 1763251 - protein, 15 aa, Staphylococcus epidermidis
PLPNGGEMNVKIVEI

SEQ ID NO: 1763252 - protein, 8 aa, Staphylococcus epidermidis
PLQSGSER

SEQ ID NO: 1763253 - protein, 11 aa, Staphylococcus epidermidis
PLSTLSGGEIQ

SEQ ID NO: 1763254 - protein, 8 aa, Staphylococcus epidermidis
PLTEKDRE

SEQ ID NO: 1763255 - protein, 10 aa, Staphylococcus epidermidis
PLTPAEAREK

SEQ ID NO: 1763256 - protein, 6 aa, Staphylococcus epidermidis
PLTPDL

SEQ ID NO: 1763257 - protein, 9 aa, Staphylococcus epidermidis
PLTPKTRGI

SEQ ID NO: 1763258 - protein, 5 aa, Staphylococcus epidermidis
PLTSQ

SEQ ID NO: 1763259 - protein, 4 aa, Staphylococcus epidermidis
PMGE

SEQ ID NO: 1763260 - protein, 15 aa, Staphylococcus epidermidis
PMNGEDESQKQTTRS

SEQ ID NO: 1763261 - protein, 5 aa, Staphylococcus epidermidis
PMPGH

SEQ ID NO: 1763262 - protein, 4 aa, Staphylococcus epidermidis
PMSR

SEQ ID NO: 1763263 - protein, 14 aa, Staphylococcus epidermidis
PMVPTTGKNGFDIE

SEQ ID NO: 1763264 - protein, 12 aa, Staphylococcus epidermidis
PNANTTHVTSPE

SEQ ID NO: 1763265 - protein, 6 aa, Staphylococcus epidermidis
PNDFGT

SEQ ID NO: 1763266 - protein, 16 aa, Staphylococcus epidermidis
PNEDATGIKASTESGQ

SEQ ID NO: 1763267 - protein, 5 aa, Staphylococcus epidermidis
PNEDC

SEQ ID NO: 1763268 - protein, 6 aa, Staphylococcus epidermidis
PNESHL

SEQ ID NO: 1763269 - protein, 4 aa, Staphylococcus epidermidis
PNGV

SEQ ID NO: 1763270 - protein, 8 aa, Staphylococcus epidermidis
PNHSTTSD

SEQ ID NO: 1763271 - protein, 4 aa, Staphylococcus epidermidis
PNII

SEQ ID NO: 1763272 - protein, 9 aa, Staphylococcus epidermidis
PNKHVSKTY

SEQ ID NO: 1763273 - protein, 17 aa, Staphylococcus epidermidis
PNKLKGAPKSVKGDRRG

SEQ ID NO: 1763274 - protein, 28 aa, Staphylococcus epidermidis
PNPEINPNEAKQAGAKVVGTGRSDFPNQ

SEQ ID NO: 1763275 - protein, 6 aa, Staphylococcus epidermidis
PNPSLI

SEQ ID NO: 1763276 - protein, 14 aa, Staphylococcus epidermidis
PNPYQPRKTFEEER

SEQ ID NO: 1763277 - protein, 7 aa, Staphylococcus epidermidis
PNQATEA

SEQ ID NO: 1763278 - protein, 11 aa, Staphylococcus epidermidis
PNRDPRDEFET

SEQ ID NO: 1763279 - protein, 8 aa, Staphylococcus epidermidis
PNRGEPLK

SEQ ID NO: 1763280 - protein, 9 aa, Staphylococcus epidermidis
PNSPHHAGV

SEQ ID NO: 1763281 - protein, 14 aa, Staphylococcus epidermidis
PNSSLSAASGYAEE

SEQ ID NO: 1763282 - protein, 6 aa, Staphylococcus epidermidis
PNSTYI

SEQ ID NO: 1763283 - protein, 12 aa, Staphylococcus epidermidis
PNTAGAKTAQEA

SEQ ID NO: 1763284 - protein, 9 aa, Staphylococcus epidermidis
PNTPSKSHN

SEQ ID NO: 1763285 - protein, 7 aa, Staphylococcus epidermidis
PNVDEGQ

SEQ ID NO: 1763286 - protein, 8 aa, Staphylococcus epidermidis
PNVESGQK

SEQ ID NO: 1763287 - protein, 5 aa, Staphylococcus epidermidis
PNVVA

SEQ ID NO: 1763288 - protein, 4 aa, Staphylococcus epidermidis
PNWE

SEQ ID NO: 1763289 - protein, 5 aa, Staphylococcus epidermidis
PPFSP

SEQ ID NO: 1763290 - protein, 8 aa, Staphylococcus epidermidis
PPGYDSEA

SEQ ID NO: 1763291 - protein, 4 aa, Staphylococcus epidermidis
PPMP

SEQ ID NO: 1763292 - protein, 5 aa, Staphylococcus epidermidis
PPPNV

SEQ ID NO: 1763293 - protein, 5 aa, Staphylococcus epidermidis
PQDGF

SEQ ID NO: 1763294 - protein, 5 aa, Staphylococcus epidermidis
PQEQS

SEQ ID NO: 1763295 - protein, 9 aa, Staphylococcus epidermidis
PQEVSGGQL

SEQ ID NO: 1763296 - protein, 9 aa, Staphylococcus epidermidis
PQIERQEKM

SEQ ID NO: 1763297 - protein, 5 aa, Staphylococcus epidermidis
PQLQQ

SEQ ID NO: 1763298 - protein, 13 aa, Staphylococcus epidermidis
PQMPKTYTTDPTL

SEQ ID NO: 1763299 - protein, 5 aa, Staphylococcus epidermidis
PQNDI

SEQ ID NO: 1763300 - protein, 5 aa, Staphylococcus epidermidis
PQPED

SEQ ID NO: 1763301 - protein, 7 aa, Staphylococcus epidermidis
PQSFGRA

SEQ ID NO: 1763302 - protein, 10 aa, Staphylococcus epidermidis
PQSPEVPDGL

SEQ ID NO: 1763303 - protein, 21 aa, Staphylococcus epidermidis
PRIGTPAARMDNQIDEETKNV

SEQ ID NO: 1763304 - protein, 12 aa, Staphylococcus epidermidis
PRIPTEEEITTA

SEQ ID NO: 1763305 - protein, 10 aa, Staphylococcus epidermidis
PRMDGANEEI

SEQ ID NO: 1763306 - protein, 6 aa, Staphylococcus epidermidis
PRPDTG

SEQ ID NO: 1763307 - protein, 16 aa, Staphylococcus epidermidis
PRSQMGVDTEDNYEPK

SEQ ID NO: 1763308 - protein, 11 aa, Staphylococcus epidermidis
PSDIRAAGGVA

SEQ ID NO: 1763309 - protein, 10 aa, Staphylococcus epidermidis
PSDKKRMMDQ

SEQ ID NO: 1763310 - protein, 4 aa, Staphylococcus epidermidis
PSEH

SEQ ID NO: 1763311 - protein, 11 aa, Staphylococcus epidermidis
PSEIEGRRDLR

SEQ ID NO: 1763312 - protein, 10 aa, Staphylococcus epidermidis
PSEQQDADDV

SEQ ID NO: 1763313 - protein, 7 aa, Staphylococcus epidermidis
PSERFSE

SEQ ID NO: 1763314 - protein, 7 aa, Staphylococcus epidermidis
PSGCGKT

SEQ ID NO: 1763315 - protein, 9 aa, Staphylococcus epidermidis
PSGETSKSF

SEQ ID NO: 1763316 - protein, 8 aa, Staphylococcus epidermidis
PSGVAKDL

SEQ ID NO: 1763317 - protein, 5 aa, Staphylococcus epidermidis
PSHSS

SEQ ID NO: 1763318 - protein, 4 aa, Staphylococcus epidermidis
PSKS

SEQ ID NO: 1763319 - protein, 14 aa, Staphylococcus epidermidis
PSLPKKKQKQIADQ

SEQ ID NO: 1763320 - protein, 8 aa, Staphylococcus epidermidis
PSNPYDAK

SEQ ID NO: 1763321 - protein, 11 aa, Staphylococcus epidermidis
PSNTFERDGDD

SEQ ID NO: 1763322 - protein, 8 aa, Staphylococcus epidermidis
PSPGHYSG

SEQ ID NO: 1763323 - protein, 10 aa, Staphylococcus epidermidis
PSQATDETQW

SEQ ID NO: 1763324 - protein, 11 aa, Staphylococcus epidermidis
PSSEEDINNVS

SEQ ID NO: 1763325 - protein, 6 aa, Staphylococcus epidermidis
PSSENV

SEQ ID NO: 1763326 - protein, 7 aa, Staphylococcus epidermidis
PSSLTPR

SEQ ID NO: 1763327 - protein, 7 aa, Staphylococcus epidermidis
PSSNQNH

SEQ ID NO: 1763328 - protein, 9 aa, Staphylococcus epidermidis
PSSRTDRGV

SEQ ID NO: 1763329 - protein, 11 aa, Staphylococcus epidermidis
PSTRLGEKQGK

SEQ ID NO: 1763330 - protein, 9 aa, Staphylococcus epidermidis
PSVADKEIS

SEQ ID NO: 1763331 - protein, 4 aa, Staphylococcus epidermidis
PSVF

SEQ ID NO: 1763332 - protein, 6 aa, Staphylococcus epidermidis
PSVGLS

SEQ ID NO: 1763333 - protein, 14 aa, Staphylococcus epidermidis
PSYEEVKTGSTGHY

SEQ ID NO: 1763334 - protein, 7 aa, Staphylococcus epidermidis
PSYPPIK

SEQ ID NO: 1763335 - protein, 7 aa, Staphylococcus epidermidis
PSYSPRS

SEQ ID NO: 1763336 - protein, 6 aa, Staphylococcus epidermidis
PSYSSY

SEQ ID NO: 1763337 - protein, 11 aa, Staphylococcus epidermidis
PTAGLDPNSKH

SEQ ID NO: 1763338 - protein, 5 aa, Staphylococcus epidermidis
PTDKT

SEQ ID NO: 1763339 - protein, 4 aa, Staphylococcus epidermidis
PTDS

SEQ ID NO: 1763340 - protein, 4 aa, Staphylococcus epidermidis
PTEA

SEQ ID NO: 1763341 - protein, 9 aa, Staphylococcus epidermidis
PTETESKET

SEQ ID NO: 1763342 - protein, 7 aa, Staphylococcus epidermidis
PTFRSGD

SEQ ID NO: 1763343 - protein, 20 aa, Staphylococcus epidermidis
PTGNGDIIDGAREQWNDGSN

SEQ ID NO: 1763344 - protein, 7 aa, Staphylococcus epidermidis
PTGSGKS

SEQ ID NO: 1763345 - protein, 10 aa, Staphylococcus epidermidis
PTKLNDRQKE

SEQ ID NO: 1763346 - protein, 14 aa, Staphylococcus epidermidis
PTNGKRANFLTPNR

SEQ ID NO: 1763347 - protein, 6 aa, Staphylococcus epidermidis
PTNQTS

SEQ ID NO: 1763348 - protein, 12 aa, Staphylococcus epidermidis
PTPALGGYPKEE

SEQ ID NO: 1763349 - protein, 9 aa, Staphylococcus epidermidis
PTSALDPEV

SEQ ID NO: 1763350 - protein, 8 aa, Staphylococcus epidermidis
PTSRGLST

SEQ ID NO: 1763351 - protein, 9 aa, Staphylococcus epidermidis
PVEKKFEKK

SEQ ID NO: 1763352 - protein, 7 aa, Staphylococcus epidermidis
PVGKEHG

SEQ ID NO: 1763353 - protein, 6 aa, Staphylococcus epidermidis
PVGRDC

SEQ ID NO: 1763354 - protein, 7 aa, Staphylococcus epidermidis
PVGTTNK

SEQ ID NO: 1763355 - protein, 8 aa, Staphylococcus epidermidis
PVGYTNQP

SEQ ID NO: 1763356 - protein, 13 aa, Staphylococcus epidermidis
PVIPGSNDAVQSV

SEQ ID NO: 1763357 - protein, 11 aa, Staphylococcus epidermidis
PVNPPERQNVP

SEQ ID NO: 1763358 - protein, 8 aa, Staphylococcus epidermidis
PVRGAKKD

SEQ ID NO: 1763359 - protein, 7 aa, Staphylococcus epidermidis
PVSETND

SEQ ID NO: 1763360 - protein, 4 aa, Staphylococcus epidermidis
PVSP

SEQ ID NO: 1763361 - protein, 5 aa, Staphylococcus epidermidis
PYGER

SEQ ID NO: 1763362 - protein, 10 aa, Staphylococcus epidermidis
PYGPRPGEEV

SEQ ID NO: 1763363 - protein, 4 aa, Staphylococcus epidermidis
PYLD

SEQ ID NO: 1763364 - protein, 4 aa, Staphylococcus epidermidis
PYNK

SEQ ID NO: 1763365 - protein, 5 aa, Staphylococcus epidermidis
PYNTQ

SEQ ID NO: 1763366 - protein, 7 aa, Staphylococcus epidermidis
PYPGGPH

SEQ ID NO: 1763367 - protein, 17 aa, Staphylococcus epidermidis
PYSDSYATRPHWEQHRA

SEQ ID NO: 1763368 - protein, 4 aa, Staphylococcus epidermidis
QAAN

SEQ ID NO: 1763369 - protein, 10 aa, Staphylococcus epidermidis
QADDQATVTV

SEQ ID NO: 1763370 - protein, 9 aa, Staphylococcus epidermidis
QAEEKMERS

SEQ ID NO: 1763371 - protein, 9 aa, Staphylococcus epidermidis
QAEKDGINQ

SEQ ID NO: 1763372 - protein, 7 aa, Staphylococcus epidermidis
QAETTGE

SEQ ID NO: 1763373 - protein, 10 aa, Staphylococcus epidermidis
QAFSENKTIT

SEQ ID NO: 1763374 - protein, 11 aa, Staphylococcus epidermidis
QAGALSKEVPY

SEQ ID NO: 1763375 - protein, 8 aa, Staphylococcus epidermidis
QAGEDAEV

SEQ ID NO: 1763376 - protein, 10 aa, Staphylococcus epidermidis
QAGGSQSPIE

SEQ ID NO: 1763377 - protein, 7 aa, Staphylococcus epidermidis
QAGSSCN

SEQ ID NO: 1763378 - protein, 4 aa, Staphylococcus epidermidis
QAHE

SEQ ID NO: 1763379 - protein, 6 aa, Staphylococcus epidermidis
QAHIDN

SEQ ID NO: 1763380 - protein, 5 aa, Staphylococcus epidermidis
QAHTR

SEQ ID NO: 1763381 - protein, 6 aa, Staphylococcus epidermidis
QAISKE

SEQ ID NO: 1763382 - protein, 7 aa, Staphylococcus epidermidis
QAKFPDS

SEQ ID NO: 1763383 - protein, 9 aa, Staphylococcus epidermidis
QAKNTNPEI

SEQ ID NO: 1763384 - protein, 13 aa, Staphylococcus epidermidis
QALESGDTVTGST

SEQ ID NO: 1763385 - protein, 7 aa, Staphylococcus epidermidis
QANATTV

SEQ ID NO: 1763386 - protein, 6 aa, Staphylococcus epidermidis
QARQNG

SEQ ID NO: 1763387 - protein, 20 aa, Staphylococcus epidermidis
QASDSGETLTVSNPANGEDL

SEQ ID NO: 1763388 - protein, 9 aa, Staphylococcus epidermidis
QASTDDITT

SEQ ID NO: 1763389 - protein, 7 aa, Staphylococcus epidermidis
QATEQAQ

SEQ ID NO: 1763390 - protein, 7 aa, Staphylococcus epidermidis
QATKEIK

SEQ ID NO: 1763391 - protein, 7 aa, Staphylococcus epidermidis
QATQESF

SEQ ID NO: 1763392 - protein, 22 aa, Staphylococcus epidermidis
QCEPDSDFSSVASANPEDHKAF

SEQ ID NO: 1763393 - protein, 12 aa, Staphylococcus epidermidis
QCTTANPKEPLI

SEQ ID NO: 1763394 - protein, 5 aa, Staphylococcus epidermidis
QDAEE

SEQ ID NO: 1763395 - protein, 7 aa, Staphylococcus epidermidis
QDALQGK

SEQ ID NO: 1763396 - protein, 9 aa, Staphylococcus epidermidis
QDATGQARN

SEQ ID NO: 1763397 - protein, 7 aa, Staphylococcus epidermidis
QDDGQRD

SEQ ID NO: 1763398 - protein, 9 aa, Staphylococcus epidermidis
QDDNGIVSN

SEQ ID NO: 1763399 - protein, 15 aa, Staphylococcus epidermidis
QDGEQIGVKSKREAL

SEQ ID NO: 1763400 - protein, 7 aa, Staphylococcus epidermidis
QDIDGND

SEQ ID NO: 1763401 - protein, 6 aa, Staphylococcus epidermidis
QDIESQ

SEQ ID NO: 1763402 - protein, 10 aa, Staphylococcus epidermidis
QDIPKNKSIE

SEQ ID NO: 1763403 - protein, 24 aa, Staphylococcus epidermidis
QDKGVTINTNTSTIAFSNNKDQTI

SEQ ID NO: 1763404 - protein, 5 aa, Staphylococcus epidermidis
QDKIK

SEQ ID NO: 1763405 - protein, 8 aa, Staphylococcus epidermidis
QDKKVSKI

SEQ ID NO: 1763406 - protein, 9 aa, Staphylococcus epidermidis
QDKTSNHPK

SEQ ID NO: 1763407 - protein, 10 aa, Staphylococcus epidermidis
QDLGSREGIA

SEQ ID NO: 1763408 - protein, 10 aa, Staphylococcus epidermidis
QDLQAKGEKF

SEQ ID NO: 1763409 - protein, 7 aa, Staphylococcus epidermidis
QDPEQFK

SEQ ID NO: 1763410 - protein, 16 aa, Staphylococcus epidermidis
QDPTKKMSKSDDNQKN

SEQ ID NO: 1763411 - protein, 15 aa, Staphylococcus epidermidis
QDQDTANDKYTGLEA

SEQ ID NO: 1763412 - protein, 9 aa, Staphylococcus epidermidis
QDRPNMKSV

SEQ ID NO: 1763413 - protein, 8 aa, Staphylococcus epidermidis
QDRVDKDE

SEQ ID NO: 1763414 - protein, 10 aa, Staphylococcus epidermidis
QDSSKSSEKL

SEQ ID NO: 1763415 - protein, 10 aa, Staphylococcus epidermidis
QDTMIDPQSA

SEQ ID NO: 1763416 - protein, 8 aa, Staphylococcus epidermidis
QDTQPQDI

SEQ ID NO: 1763417 - protein, 11 aa, Staphylococcus epidermidis
QDVERAESEME

SEQ ID NO: 1763418 - protein, 18 aa, Staphylococcus epidermidis
QDVTPKDFGRVGAQAAKQ

SEQ ID NO: 1763419 - protein, 6 aa, Staphylococcus epidermidis
QEDTKD

SEQ ID NO: 1763420 - protein, 12 aa, Staphylococcus epidermidis
QEEMDQKDAWDY

SEQ ID NO: 1763421 - protein, 6 aa, Staphylococcus epidermidis
QEETGY

SEQ ID NO: 1763422 - protein, 5 aa, Staphylococcus epidermidis
QEEVG

SEQ ID NO: 1763423 - protein, 7 aa, Staphylococcus epidermidis
QEGESKV

SEQ ID NO: 1763424 - protein, 8 aa, Staphylococcus epidermidis
QEGRRIGK

SEQ ID NO: 1763425 - protein, 6 aa, Staphylococcus epidermidis
QEGTHD

SEQ ID NO: 1763426 - protein, 4 aa, Staphylococcus epidermidis
QEHD

SEQ ID NO: 1763427 - protein, 7 aa, Staphylococcus epidermidis
QEKNNYL

SEQ ID NO: 1763428 - protein, 5 aa, Staphylococcus epidermidis
QEKQK

SEQ ID NO: 1763429 - protein, 8 aa, Staphylococcus epidermidis
QELENNEI

SEQ ID NO: 1763430 - protein, 14 aa, Staphylococcus epidermidis
QELGQKSAGLDTTR

SEQ ID NO: 1763431 - protein, 9 aa, Staphylococcus epidermidis
QELNPSPKW

SEQ ID NO: 1763432 - protein, 5 aa, Staphylococcus epidermidis
QELSE

SEQ ID NO: 1763433 - protein, 10 aa, Staphylococcus epidermidis
QENKTYDMTR

SEQ ID NO: 1763434 - protein, 7 aa, Staphylococcus epidermidis
QEQRNGS

SEQ ID NO: 1763435 - protein, 8 aa, Staphylococcus epidermidis
QERFPKKS

SEQ ID NO: 1763436 - protein, 7 aa, Staphylococcus epidermidis
QESIASA

SEQ ID NO: 1763437 - protein, 6 aa, Staphylococcus epidermidis
QETPAL

SEQ ID NO: 1763438 - protein, 7 aa, Staphylococcus epidermidis
QETTVAE

SEQ ID NO: 1763439 - protein, 4 aa, Staphylococcus epidermidis
QEYG

SEQ ID NO: 1763440 - protein, 11 aa, Staphylococcus epidermidis
QEYKNIKEHDK

SEQ ID NO: 1763441 - protein, 20 aa, Staphylococcus epidermidis
QFAEGTTHDYASASETIAER

SEQ ID NO: 1763442 - protein, 12 aa, Staphylococcus epidermidis
QFEPGKSQFSSY

SEQ ID NO: 1763443 - protein, 11 aa, Staphylococcus epidermidis
QFNPGGSIKDR

SEQ ID NO: 1763444 - protein, 4 aa, Staphylococcus epidermidis
QFPT

SEQ ID NO: 1763445 - protein, 8 aa, Staphylococcus epidermidis
QFSGGQRQ

SEQ ID NO: 1763446 - protein, 9 aa, Staphylococcus epidermidis
QGDDDKQTF

SEQ ID NO: 1763447 - protein, 8 aa, Staphylococcus epidermidis
QGDDTELE

SEQ ID NO: 1763448 - protein, 8 aa, Staphylococcus epidermidis
QGDKALKN

SEQ ID NO: 1763449 - protein, 13 aa, Staphylococcus epidermidis
QGEAGINVPPEGY

SEQ ID NO: 1763450 - protein, 4 aa, Staphylococcus epidermidis
QGED

SEQ ID NO: 1763451 - protein, 7 aa, Staphylococcus epidermidis
QGEEIKA

SEQ ID NO: 1763452 - protein, 5 aa, Staphylococcus epidermidis
QGENP

SEQ ID NO: 1763453 - protein, 5 aa, Staphylococcus epidermidis
QGGQF

SEQ ID NO: 1763454 - protein, 4 aa, Staphylococcus epidermidis
QGHG

SEQ ID NO: 1763455 - protein, 9 aa, Staphylococcus epidermidis
QGKTKEQIT

SEQ ID NO: 1763456 - protein, 6 aa, Staphylococcus epidermidis
QGKTTQ

SEQ ID NO: 1763457 - protein, 4 aa, Staphylococcus epidermidis
QGNA

SEQ ID NO: 1763458 - protein, 7 aa, Staphylococcus epidermidis
QGNISTN

SEQ ID NO: 1763459 - protein, 10 aa, Staphylococcus epidermidis
QGNSHNRLKS

SEQ ID NO: 1763460 - protein, 9 aa, Staphylococcus epidermidis
QGPSGIGKT

SEQ ID NO: 1763461 - protein, 8 aa, Staphylococcus epidermidis
QGPTCHTG

SEQ ID NO: 1763462 - protein, 12 aa, Staphylococcus epidermidis
QGPYKAAKRNIA

SEQ ID NO: 1763463 - protein, 9 aa, Staphylococcus epidermidis
QGQNNPLPV

SEQ ID NO: 1763464 - protein, 9 aa, Staphylococcus epidermidis
QGQNTSGIK

SEQ ID NO: 1763465 - protein, 6 aa, Staphylococcus epidermidis
QGQTKF

SEQ ID NO: 1763466 - protein, 8 aa, Staphylococcus epidermidis
QGQTPQTF

SEQ ID NO: 1763467 - protein, 6 aa, Staphylococcus epidermidis
QGSPYK

SEQ ID NO: 1763468 - protein, 6 aa, Staphylococcus epidermidis
QGTNKD

SEQ ID NO: 1763469 - protein, 6 aa, Staphylococcus epidermidis
QGTPYE

SEQ ID NO: 1763470 - protein, 8 aa, Staphylococcus epidermidis
QGTQARQD

SEQ ID NO: 1763471 - protein, 5 aa, Staphylococcus epidermidis
QGVPQ

SEQ ID NO: 1763472 - protein, 9 aa, Staphylococcus epidermidis
QGVSKSRFK

SEQ ID NO: 1763473 - protein, 5 aa, Staphylococcus epidermidis
QGYEK

SEQ ID NO: 1763474 - protein, 5 aa, Staphylococcus epidermidis
QHAED

SEQ ID NO: 1763475 - protein, 4 aa, Staphylococcus epidermidis
QHDI

SEQ ID NO: 1763476 - protein, 8 aa, Staphylococcus epidermidis
QHDTTGHD

SEQ ID NO: 1763477 - protein, 18 aa, Staphylococcus epidermidis
QHGGENGAKEAGRQRLEG

SEQ ID NO: 1763478 - protein, 7 aa, Staphylococcus epidermidis
QHGPTGV

SEQ ID NO: 1763479 - protein, 4 aa, Staphylococcus epidermidis
QHGT

SEQ ID NO: 1763480 - protein, 4 aa, Staphylococcus epidermidis
QHSH

SEQ ID NO: 1763481 - protein, 6 aa, Staphylococcus epidermidis
QHTESY

SEQ ID NO: 1763482 - protein, 6 aa, Staphylococcus epidermidis
QIDPNE

SEQ ID NO: 1763483 - protein, 5 aa, Staphylococcus epidermidis
QIEDA

SEQ ID NO: 1763484 - protein, 17 aa, Staphylococcus epidermidis
QIEETDSEFDKEKLQER

SEQ ID NO: 1763485 - protein, 6 aa, Staphylococcus epidermidis
QIETYQ

SEQ ID NO: 1763486 - protein, 7 aa, Staphylococcus epidermidis
QIGSQSI

SEQ ID NO: 1763487 - protein, 10 aa, Staphylococcus epidermidis
QIKNEKALKE

SEQ ID NO: 1763488 - protein, 7 aa, Staphylococcus epidermidis
QIKTNLK

SEQ ID NO: 1763489 - protein, 19 aa, Staphylococcus epidermidis
QIPAGAPFGGYKKSGIGRE

SEQ ID NO: 1763490 - protein, 6 aa, Staphylococcus epidermidis
QIPSGA

SEQ ID NO: 1763491 - protein, 14 aa, Staphylococcus epidermidis
QIPTNKPVQRKDNS

SEQ ID NO: 1763492 - protein, 5 aa, Staphylococcus epidermidis
QIPVD

SEQ ID NO: 1763493 - protein, 5 aa, Staphylococcus epidermidis
QITDA

SEQ ID NO: 1763494 - protein, 10 aa, Staphylococcus epidermidis
QITQNSNLEG

SEQ ID NO: 1763495 - protein, 15 aa, Staphylococcus epidermidis
QKALNEAQEVTKSVP

SEQ ID NO: 1763496 - protein, 8 aa, Staphylococcus epidermidis
QKAMQSKM

SEQ ID NO: 1763497 - protein, 13 aa, Staphylococcus epidermidis
QKASAFNAGFPAS

SEQ ID NO: 1763498 - protein, 9 aa, Staphylococcus epidermidis
QKATKANYQ

SEQ ID NO: 1763499 - protein, 11 aa, Staphylococcus epidermidis
QKDPDTGELNG

SEQ ID NO: 1763500 - protein, 15 aa, Staphylococcus epidermidis
QKEFGGGKGANQAIA

SEQ ID NO: 1763501 - protein, 9 aa, Staphylococcus epidermidis
QKERQAKNI

SEQ ID NO: 1763502 - protein, 8 aa, Staphylococcus epidermidis
QKETGIKG

SEQ ID NO: 1763503 - protein, 9 aa, Staphylococcus epidermidis
QKGEGLKAA

SEQ ID NO: 1763504 - protein, 15 aa, Staphylococcus epidermidis
QKGTNLTYQEKEKIE

SEQ ID NO: 1763505 - protein, 9 aa, Staphylococcus epidermidis
QKGYKPDDI

SEQ ID NO: 1763506 - protein, 4 aa, Staphylococcus epidermidis
QKIM

SEQ ID NO: 1763507 - protein, 10 aa, Staphylococcus epidermidis
QKIMSSDNTI

SEQ ID NO: 1763508 - protein, 8 aa, Staphylococcus epidermidis
QKKKGQTV

SEQ ID NO: 1763509 - protein, 4 aa, Staphylococcus epidermidis
QKKN

SEQ ID NO: 1763510 - protein, 9 aa, Staphylococcus epidermidis
QKKSEGYLE

SEQ ID NO: 1763511 - protein, 9 aa, Staphylococcus epidermidis
QKLGERTRE

SEQ ID NO: 1763512 - protein, 5 aa, Staphylococcus epidermidis
QKLPQ

SEQ ID NO: 1763513 - protein, 5 aa, Staphylococcus epidermidis
QKPLN

SEQ ID NO: 1763514 - protein, 4 aa, Staphylococcus epidermidis
QKQY

SEQ ID NO: 1763515 - protein, 4 aa, Staphylococcus epidermidis
QKRD

SEQ ID NO: 1763516 - protein, 7 aa, Staphylococcus epidermidis
QKRSATK

SEQ ID NO: 1763517 - protein, 8 aa, Staphylococcus epidermidis
QKSQKQEY

SEQ ID NO: 1763518 - protein, 10 aa, Staphylococcus epidermidis
QKTETREVEE

SEQ ID NO: 1763519 - protein, 5 aa, Staphylococcus epidermidis
QKTTT

SEQ ID NO: 1763520 - protein, 5 aa, Staphylococcus epidermidis
QKTVE

SEQ ID NO: 1763521 - protein, 7 aa, Staphylococcus epidermidis
QKVPQID

SEQ ID NO: 1763522 - protein, 8 aa, Staphylococcus epidermidis
QKYGPFHG

SEQ ID NO: 1763523 - protein, 8 aa, Staphylococcus epidermidis
QLDEESSK

SEQ ID NO: 1763524 - protein, 13 aa, Staphylococcus epidermidis
QLETEESNTNYDR

SEQ ID NO: 1763525 - protein, 13 aa, Staphylococcus epidermidis
QLGPNEDDVELQK

SEQ ID NO: 1763526 - protein, 9 aa, Staphylococcus epidermidis
QLKSQKISS

SEQ ID NO: 1763527 - protein, 8 aa, Staphylococcus epidermidis
QLKSTGQL

SEQ ID NO: 1763528 - protein, 7 aa, Staphylococcus epidermidis
QLNEEEA

SEQ ID NO: 1763529 - protein, 5 aa, Staphylococcus epidermidis
QLNEN

SEQ ID NO: 1763530 - protein, 7 aa, Staphylococcus epidermidis
QLNGQYG

SEQ ID NO: 1763531 - protein, 6 aa, Staphylococcus epidermidis
QLPDGS

SEQ ID NO: 1763532 - protein, 12 aa, Staphylococcus epidermidis
QLPQDKVNVNGG

SEQ ID NO: 1763533 - protein, 5 aa, Staphylococcus epidermidis
QLPTR

SEQ ID NO: 1763534 - protein, 10 aa, Staphylococcus epidermidis
QLQGESTVDS

SEQ ID NO: 1763535 - protein, 5 aa, Staphylococcus epidermidis
QLQSG

SEQ ID NO: 1763536 - protein, 10 aa, Staphylococcus epidermidis
QLRKEKHPNV

SEQ ID NO: 1763537 - protein, 7 aa, Staphylococcus epidermidis
QLRKGSV

SEQ ID NO: 1763538 - protein, 23 aa, Staphylococcus epidermidis
QLSKEGKASTHQTQQQLHQKQSD

SEQ ID NO: 1763539 - protein, 5 aa, Staphylococcus epidermidis
QLTDE

SEQ ID NO: 1763540 - protein, 32 aa, Staphylococcus epidermidis
QLTEVQKEQDSDSEQRKVDPRLQKLQQLYDKD

SEQ ID NO: 1763541 - protein, 10 aa, Staphylococcus epidermidis
QLTPEELAND

SEQ ID NO: 1763542 - protein, 6 aa, Staphylococcus epidermidis
QLTTGN

SEQ ID NO: 1763543 - protein, 4 aa, Staphylococcus epidermidis
QLVE

SEQ ID NO: 1763544 - protein, 9 aa, Staphylococcus epidermidis
QMAKDTEVF

SEQ ID NO: 1763545 - protein, 8 aa, Staphylococcus epidermidis
QMEETSVN

SEQ ID NO: 1763546 - protein, 6 aa, Staphylococcus epidermidis
QMNRVG

SEQ ID NO: 1763547 - protein, 8 aa, Staphylococcus epidermidis
QMTRNEAS

SEQ ID NO: 1763548 - protein, 7 aa, Staphylococcus epidermidis
QNDAKRK

SEQ ID NO: 1763549 - protein, 5 aa, Staphylococcus epidermidis
QNDED

SEQ ID NO: 1763550 - protein, 6 aa, Staphylococcus epidermidis
QNDNKM

SEQ ID NO: 1763551 - protein, 5 aa, Staphylococcus epidermidis
QNDPA

SEQ ID NO: 1763552 - protein, 23 aa, Staphylococcus epidermidis
QNEASKKSDLERTDLAKEKTGVF

SEQ ID NO: 1763553 - protein, 5 aa, Staphylococcus epidermidis
QNEEI

SEQ ID NO: 1763554 - protein, 6 aa, Staphylococcus epidermidis
QNEEIE

SEQ ID NO: 1763555 - protein, 9 aa, Staphylococcus epidermidis
QNEKGDENF

SEQ ID NO: 1763556 - protein, 6 aa, Staphylococcus epidermidis
QNENEM

SEQ ID NO: 1763557 - protein, 14 aa, Staphylococcus epidermidis
QNEPIGKGKDGKDV

SEQ ID NO: 1763558 - protein, 5 aa, Staphylococcus epidermidis
QNGNF

SEQ ID NO: 1763559 - protein, 7 aa, Staphylococcus epidermidis
QNINNSH

SEQ ID NO: 1763560 - protein, 6 aa, Staphylococcus epidermidis
QNLDKR

SEQ ID NO: 1763561 - protein, 11 aa, Staphylococcus epidermidis
QNLSETDAEEY

SEQ ID NO: 1763562 - protein, 17 aa, Staphylococcus epidermidis
QNPARKDDMTILIIKRV

SEQ ID NO: 1763563 - protein, 6 aa, Staphylococcus epidermidis
QNQVKN

SEQ ID NO: 1763564 - protein, 23 aa, Staphylococcus epidermidis
QNRNTNETHQSEKQSTQQSQQID

SEQ ID NO: 1763565 - protein, 7 aa, Staphylococcus epidermidis
QNSASYF

SEQ ID NO: 1763566 - protein, 8 aa, Staphylococcus epidermidis
QNSHPTSI

SEQ ID NO: 1763567 - protein, 6 aa, Staphylococcus epidermidis
QNSYYE

SEQ ID NO: 1763568 - protein, 6 aa, Staphylococcus epidermidis
QNTKEG

SEQ ID NO: 1763569 - protein, 10 aa, Staphylococcus epidermidis
QNTNANAVKV

SEQ ID NO: 1763570 - protein, 5 aa, Staphylococcus epidermidis
QNYGR

SEQ ID NO: 1763571 - protein, 5 aa, Staphylococcus epidermidis
QNYKE

SEQ ID NO: 1763572 - protein, 18 aa, Staphylococcus epidermidis
QNYKSAKEQSTDSLIKDL

SEQ ID NO: 1763573 - protein, 7 aa, Staphylococcus epidermidis
QPAKDMN

SEQ ID NO: 1763574 - protein, 5 aa, Staphylococcus epidermidis
QPDFP

SEQ ID NO: 1763575 - protein, 5 aa, Staphylococcus epidermidis
QPEHR

SEQ ID NO: 1763576 - protein, 5 aa, Staphylococcus epidermidis
QPGAE

SEQ ID NO: 1763577 - protein, 13 aa, Staphylococcus epidermidis
QPGGSIKDQDSID

SEQ ID NO: 1763578 - protein, 5 aa, Staphylococcus epidermidis
QPGLF

SEQ ID NO: 1763579 - protein, 4 aa, Staphylococcus epidermidis
QPIA

SEQ ID NO: 1763580 - protein, 20 aa, Staphylococcus epidermidis
QPKSYPSIETAQNKHYSQRE

SEQ ID NO: 1763581 - protein, 6 aa, Staphylococcus epidermidis
QPLTRG

SEQ ID NO: 1763582 - protein, 6 aa, Staphylococcus epidermidis
QPPDVY

SEQ ID NO: 1763583 - protein, 4 aa, Staphylococcus epidermidis
QPTH

SEQ ID NO: 1763584 - protein, 8 aa, Staphylococcus epidermidis
QPVSLQPS

SEQ ID NO: 1763585 - protein, 6 aa, Staphylococcus epidermidis
QPYEGG

SEQ ID NO: 1763586 - protein, 9 aa, Staphylococcus epidermidis
QQANAAQQY

SEQ ID NO: 1763587 - protein, 6 aa, Staphylococcus epidermidis
QQASEE

SEQ ID NO: 1763588 - protein, 14 aa, Staphylococcus epidermidis
QQATTLSGGEAQRV

SEQ ID NO: 1763589 - protein, 6 aa, Staphylococcus epidermidis
QQEDAD

SEQ ID NO: 1763590 - protein, 6 aa, Staphylococcus epidermidis
QQGDDS

SEQ ID NO: 1763591 - protein, 9 aa, Staphylococcus epidermidis
QQGEHTASN

SEQ ID NO: 1763592 - protein, 11 aa, Staphylococcus epidermidis
QQGLGRTGKWS

SEQ ID NO: 1763593 - protein, 5 aa, Staphylococcus epidermidis
QQIEN

SEQ ID NO: 1763594 - protein, 17 aa, Staphylococcus epidermidis
QQIKGQGVEIGKDYPKQ

SEQ ID NO: 1763595 - protein, 9 aa, Staphylococcus epidermidis
QQITQEKQS

SEQ ID NO: 1763596 - protein, 10 aa, Staphylococcus epidermidis
QQKRYKDKKE

SEQ ID NO: 1763597 - protein, 6 aa, Staphylococcus epidermidis
QQLETD

SEQ ID NO: 1763598 - protein, 4 aa, Staphylococcus epidermidis
QQLN

SEQ ID NO: 1763599 - protein, 7 aa, Staphylococcus epidermidis
QQLNGTL

SEQ ID NO: 1763600 - protein, 6 aa, Staphylococcus epidermidis
QQNQNY

SEQ ID NO: 1763601 - protein, 11 aa, Staphylococcus epidermidis
QQPITERPGEY

SEQ ID NO: 1763602 - protein, 5 aa, Staphylococcus epidermidis
QQPTT

SEQ ID NO: 1763603 - protein, 4 aa, Staphylococcus epidermidis
QQQA

SEQ ID NO: 1763604 - protein, 4 aa, Staphylococcus epidermidis
QQQL

SEQ ID NO: 1763605 - protein, 4 aa, Staphylococcus epidermidis
QQQM

SEQ ID NO: 1763606 - protein, 6 aa, Staphylococcus epidermidis
QQQQEL

SEQ ID NO: 1763607 - protein, 4 aa, Staphylococcus epidermidis
QQRD

SEQ ID NO: 1763608 - protein, 8 aa, Staphylococcus epidermidis
QQRPSTTK

SEQ ID NO: 1763609 - protein, 10 aa, Staphylococcus epidermidis
QQSEGMAKGK

SEQ ID NO: 1763610 - protein, 7 aa, Staphylococcus epidermidis
QQSHEDL

SEQ ID NO: 1763611 - protein, 11 aa, Staphylococcus epidermidis
QQSIGTASFEN

SEQ ID NO: 1763612 - protein, 4 aa, Staphylococcus epidermidis
QQSN

SEQ ID NO: 1763613 - protein, 8 aa, Staphylococcus epidermidis
QQSQLDSR

SEQ ID NO: 1763614 - protein, 6 aa, Staphylococcus epidermidis
QQSRPV

SEQ ID NO: 1763615 - protein, 10 aa, Staphylococcus epidermidis
QQSSEYKESI

SEQ ID NO: 1763616 - protein, 6 aa, Staphylococcus epidermidis
QQSTIR

SEQ ID NO: 1763617 - protein, 4 aa, Staphylococcus epidermidis
QQSY

SEQ ID NO: 1763618 - protein, 7 aa, Staphylococcus epidermidis
QQTDEEL

SEQ ID NO: 1763619 - protein, 5 aa, Staphylococcus epidermidis
QQTFE

SEQ ID NO: 1763620 - protein, 5 aa, Staphylococcus epidermidis
QQVGN

SEQ ID NO: 1763621 - protein, 9 aa, Staphylococcus epidermidis
QQVNLTPKE

SEQ ID NO: 1763622 - protein, 13 aa, Staphylococcus epidermidis
QQWPTDKTLNKQL

SEQ ID NO: 1763623 - protein, 9 aa, Staphylococcus epidermidis
QQYTDSTKR

SEQ ID NO: 1763624 - protein, 5 aa, Staphylococcus epidermidis
QQYVE

SEQ ID NO: 1763625 - protein, 8 aa, Staphylococcus epidermidis
QRAGISKG

SEQ ID NO: 1763626 - protein, 9 aa, Staphylococcus epidermidis
QRCRQSDSI

SEQ ID NO: 1763627 - protein, 16 aa, Staphylococcus epidermidis
QRDGTPAAKMKDNVPL

SEQ ID NO: 1763628 - protein, 8 aa, Staphylococcus epidermidis
QRENENSI

SEQ ID NO: 1763629 - protein, 6 aa, Staphylococcus epidermidis
QRGGNG

SEQ ID NO: 1763630 - protein, 23 aa, Staphylococcus epidermidis
QRKQQKKNHQDKQQRRAHKPSNV

SEQ ID NO: 1763631 - protein, 14 aa, Staphylococcus epidermidis
QRKQSKKKKQSKIQ

SEQ ID NO: 1763632 - protein, 6 aa, Staphylococcus epidermidis
QRPPGH

SEQ ID NO: 1763633 - protein, 13 aa, Staphylococcus epidermidis
QRTNKKQKITRST

SEQ ID NO: 1763634 - protein, 16 aa, Staphylococcus epidermidis
QRTNKSFDADIQEGGK

SEQ ID NO: 1763635 - protein, 6 aa, Staphylococcus epidermidis
QSAETL

SEQ ID NO: 1763636 - protein, 8 aa, Staphylococcus epidermidis
QSAFQGNA

SEQ ID NO: 1763637 - protein, 11 aa, Staphylococcus epidermidis
QSDKFAKAAPL

SEQ ID NO: 1763638 - protein, 8 aa, Staphylococcus epidermidis
QSDYGNEK

SEQ ID NO: 1763639 - protein, 9 aa, Staphylococcus epidermidis
QSEAYRKAN

SEQ ID NO: 1763640 - protein, 4 aa, Staphylococcus epidermidis
QSEE

SEQ ID NO: 1763641 - protein, 5 aa, Staphylococcus epidermidis
QSEQA

SEQ ID NO: 1763642 - protein, 9 aa, Staphylococcus epidermidis
QSERFDNNA

SEQ ID NO: 1763643 - protein, 7 aa, Staphylococcus epidermidis
QSFGTPS

SEQ ID NO: 1763644 - protein, 6 aa, Staphylococcus epidermidis
QSGNNQ

SEQ ID NO: 1763645 - protein, 8 aa, Staphylococcus epidermidis
QSGPFANQ

SEQ ID NO: 1763646 - protein, 7 aa, Staphylococcus epidermidis
QSGSDDV

SEQ ID NO: 1763647 - protein, 6 aa, Staphylococcus epidermidis
QSHGKN

SEQ ID NO: 1763648 - protein, 6 aa, Staphylococcus epidermidis
QSIEKT

SEQ ID NO: 1763649 - protein, 9 aa, Staphylococcus epidermidis
QSIGEPGTQ

SEQ ID NO: 1763650 - protein, 18 aa, Staphylococcus epidermidis
QSKKVSSRSGMSLTRDTS

SEQ ID NO: 1763651 - protein, 4 aa, Staphylococcus epidermidis
QSKN

SEQ ID NO: 1763652 - protein, 4 aa, Staphylococcus epidermidis
QSKQ

SEQ ID NO: 1763653 - protein, 7 aa, Staphylococcus epidermidis
QSLHEAP

SEQ ID NO: 1763654 - protein, 8 aa, Staphylococcus epidermidis
QSNALKQG

SEQ ID NO: 1763655 - protein, 6 aa, Staphylococcus epidermidis
QSNHTD

SEQ ID NO: 1763656 - protein, 5 aa, Staphylococcus epidermidis
QSPFN

SEQ ID NO: 1763657 - protein, 4 aa, Staphylococcus epidermidis
QSPN

SEQ ID NO: 1763658 - protein, 4 aa, Staphylococcus epidermidis
QSRH

SEQ ID NO: 1763659 - protein, 18 aa, Staphylococcus epidermidis
QSRMKSNNPEQPIDYNQS

SEQ ID NO: 1763660 - protein, 15 aa, Staphylococcus epidermidis
QSSISYAGGKDLKSL

SEQ ID NO: 1763661 - protein, 10 aa, Staphylococcus epidermidis
QSTMNESKYC

SEQ ID NO: 1763662 - protein, 8 aa, Staphylococcus epidermidis
QSTRKAFE

SEQ ID NO: 1763663 - protein, 18 aa, Staphylococcus epidermidis
QSVGEKDVVTTSRFPGTT

SEQ ID NO: 1763664 - protein, 5 aa, Staphylococcus epidermidis
QTAPV

SEQ ID NO: 1763665 - protein, 9 aa, Staphylococcus epidermidis
QTASQYINS

SEQ ID NO: 1763666 - protein, 8 aa, Staphylococcus epidermidis
QTDEEGIE

SEQ ID NO: 1763667 - protein, 9 aa, Staphylococcus epidermidis
QTDEEPHMG

SEQ ID NO: 1763668 - protein, 5 aa, Staphylococcus epidermidis
QTDRQ

SEQ ID NO: 1763669 - protein, 13 aa, Staphylococcus epidermidis
QTEAGRANGTSKC

SEQ ID NO: 1763670 - protein, 5 aa, Staphylococcus epidermidis
QTEAY

SEQ ID NO: 1763671 - protein, 6 aa, Staphylococcus epidermidis
QTEEEE

SEQ ID NO: 1763672 - protein, 8 aa, Staphylococcus epidermidis
QTEKPFKR

SEQ ID NO: 1763673 - protein, 14 aa, Staphylococcus epidermidis
QTGGYSSTHQPINS

SEQ ID NO: 1763674 - protein, 19 aa, Staphylococcus epidermidis
QTGIHGTEIDNYDGNLGQT

SEQ ID NO: 1763675 - protein, 14 aa, Staphylococcus epidermidis
QTGQRLDSTEQRGI

SEQ ID NO: 1763676 - protein, 10 aa, Staphylococcus epidermidis
QTGQSYGRET

SEQ ID NO: 1763677 - protein, 5 aa, Staphylococcus epidermidis
QTHDS

SEQ ID NO: 1763678 - protein, 6 aa, Staphylococcus epidermidis
QTIGGY

SEQ ID NO: 1763679 - protein, 9 aa, Staphylococcus epidermidis
QTKPPNNQF

SEQ ID NO: 1763680 - protein, 13 aa, Staphylococcus epidermidis
QTKQLTADLLTIT

SEQ ID NO: 1763681 - protein, 7 aa, Staphylococcus epidermidis
QTLPDDD

SEQ ID NO: 1763682 - protein, 5 aa, Staphylococcus epidermidis
QTLTG

SEQ ID NO: 1763683 - protein, 11 aa, Staphylococcus epidermidis
QTNPDLPRPVG

SEQ ID NO: 1763684 - protein, 11 aa, Staphylococcus epidermidis
QTNQKKGMQSA

SEQ ID NO: 1763685 - protein, 6 aa, Staphylococcus epidermidis
QTNSTL

SEQ ID NO: 1763686 - protein, 8 aa, Staphylococcus epidermidis
QTPDGHGK

SEQ ID NO: 1763687 - protein, 10 aa, Staphylococcus epidermidis
QTPLKNRDQS

SEQ ID NO: 1763688 - protein, 7 aa, Staphylococcus epidermidis
QTPLQTS

SEQ ID NO: 1763689 - protein, 6 aa, Staphylococcus epidermidis
QTPNSY

SEQ ID NO: 1763690 - protein, 6 aa, Staphylococcus epidermidis
QTPYKN

SEQ ID NO: 1763691 - protein, 5 aa, Staphylococcus epidermidis
QTQAL

SEQ ID NO: 1763692 - protein, 7 aa, Staphylococcus epidermidis
QTQTSIS

SEQ ID NO: 1763693 - protein, 5 aa, Staphylococcus epidermidis
QTQVT

SEQ ID NO: 1763694 - protein, 8 aa, Staphylococcus epidermidis
QTRKESPF

SEQ ID NO: 1763695 - protein, 10 aa, Staphylococcus epidermidis
QTRMTQGQSD

SEQ ID NO: 1763696 - protein, 5 aa, Staphylococcus epidermidis
QTSDS

SEQ ID NO: 1763697 - protein, 11 aa, Staphylococcus epidermidis
QTSHQSQNKIQ

SEQ ID NO: 1763698 - protein, 9 aa, Staphylococcus epidermidis
QTSKQDRRV

SEQ ID NO: 1763699 - protein, 5 aa, Staphylococcus epidermidis
QTTEE

SEQ ID NO: 1763700 - protein, 6 aa, Staphylococcus epidermidis
QTVGKG

SEQ ID NO: 1763701 - protein, 9 aa, Staphylococcus epidermidis
QVGTGTQRV

SEQ ID NO: 1763702 - protein, 17 aa, Staphylococcus epidermidis
QVNETKTKGANTTPETV

SEQ ID NO: 1763703 - protein, 10 aa, Staphylococcus epidermidis
QVNGNEQNQI

SEQ ID NO: 1763704 - protein, 9 aa, Staphylococcus epidermidis
QVRSEQSVR

SEQ ID NO: 1763705 - protein, 10 aa, Staphylococcus epidermidis
QVSYETPSKL

SEQ ID NO: 1763706 - protein, 7 aa, Staphylococcus epidermidis
QVTEDVP

SEQ ID NO: 1763707 - protein, 5 aa, Staphylococcus epidermidis
QYKEQ

SEQ ID NO: 1763708 - protein, 11 aa, Staphylococcus epidermidis
QYPGAPGPGGI

SEQ ID NO: 1763709 - protein, 9 aa, Staphylococcus epidermidis
RAEDGRSIQ

SEQ ID NO: 1763710 - protein, 5 aa, Staphylococcus epidermidis
RAEGI

SEQ ID NO: 1763711 - protein, 15 aa, Staphylococcus epidermidis
RAEYSGIGKVSFSVN

SEQ ID NO: 1763712 - protein, 7 aa, Staphylococcus epidermidis
RAGKNNH

SEQ ID NO: 1763713 - protein, 7 aa, Staphylococcus epidermidis
RAGLNKS

SEQ ID NO: 1763714 - protein, 12 aa, Staphylococcus epidermidis
RAHRTDNAPITS

SEQ ID NO: 1763715 - protein, 6 aa, Staphylococcus epidermidis
RAKEQN

SEQ ID NO: 1763716 - protein, 15 aa, Staphylococcus epidermidis
RAKTAISTDAENKDE

SEQ ID NO: 1763717 - protein, 9 aa, Staphylococcus epidermidis
RAKYGYDSQ

SEQ ID NO: 1763718 - protein, 11 aa, Staphylococcus epidermidis
RALTPNDTFAN

SEQ ID NO: 1763719 - protein, 6 aa, Staphylococcus epidermidis
RALVGN

SEQ ID NO: 1763720 - protein, 14 aa, Staphylococcus epidermidis
RAMEDPKLNKESVT

SEQ ID NO: 1763721 - protein, 9 aa, Staphylococcus epidermidis
RANENEEAW

SEQ ID NO: 1763722 - protein, 19 aa, Staphylococcus epidermidis
RANNPDEEVVAKPDDSAEF

SEQ ID NO: 1763723 - protein, 31 aa, Staphylococcus epidermidis
RAPGSVGMASDASKVFKGQKMPGRMGGNTVT

SEQ ID NO: 1763724 - protein, 10 aa, Staphylococcus epidermidis
RAPKVTPPSM

SEQ ID NO: 1763725 - protein, 7 aa, Staphylococcus epidermidis
RAQEGYD

SEQ ID NO: 1763726 - protein, 9 aa, Staphylococcus epidermidis
RAQSPTRAH

SEQ ID NO: 1763727 - protein, 5 aa, Staphylococcus epidermidis
RARQL

SEQ ID NO: 1763728 - protein, 5 aa, Staphylococcus epidermidis
RARRT

SEQ ID NO: 1763729 - protein, 9 aa, Staphylococcus epidermidis
RASKIDDEL

SEQ ID NO: 1763730 - protein, 7 aa, Staphylococcus epidermidis
RATNPKV

SEQ ID NO: 1763731 - protein, 8 aa, Staphylococcus epidermidis
RAVAERAG

SEQ ID NO: 1763732 - protein, 17 aa, Staphylococcus epidermidis
RAVESAQKRVEGNNFDA

SEQ ID NO: 1763733 - protein, 9 aa, Staphylococcus epidermidis
RDAASKPEL

SEQ ID NO: 1763734 - protein, 6 aa, Staphylococcus epidermidis
RDDGYH

SEQ ID NO: 1763735 - protein, 7 aa, Staphylococcus epidermidis
RDDNKAV

SEQ ID NO: 1763736 - protein, 6 aa, Staphylococcus epidermidis
RDDSLE

SEQ ID NO: 1763737 - protein, 5 aa, Staphylococcus epidermidis
RDEDI

SEQ ID NO: 1763738 - protein, 11 aa, Staphylococcus epidermidis
RDEKDSRFANE

SEQ ID NO: 1763739 - protein, 13 aa, Staphylococcus epidermidis
RDELESATGQRLT

SEQ ID NO: 1763740 - protein, 14 aa, Staphylococcus epidermidis
RDGKEPVKPNSELS

SEQ ID NO: 1763741 - protein, 12 aa, Staphylococcus epidermidis
RDGLGHGKGGSM

SEQ ID NO: 1763742 - protein, 4 aa, Staphylococcus epidermidis
RDGN

SEQ ID NO: 1763743 - protein, 11 aa, Staphylococcus epidermidis
RDGRARVSVGA

SEQ ID NO: 1763744 - protein, 6 aa, Staphylococcus epidermidis
RDHQDI

SEQ ID NO: 1763745 - protein, 5 aa, Staphylococcus epidermidis
RDKGI

SEQ ID NO: 1763746 - protein, 7 aa, Staphylococcus epidermidis
RDLAEKN

SEQ ID NO: 1763747 - protein, 8 aa, Staphylococcus epidermidis
RDLKGGQT

SEQ ID NO: 1763748 - protein, 13 aa, Staphylococcus epidermidis
RDLQNGDITEQEV

SEQ ID NO: 1763749 - protein, 7 aa, Staphylococcus epidermidis
RDLTQLA

SEQ ID NO: 1763750 - protein, 11 aa, Staphylococcus epidermidis
RDNPKLKGKPV

SEQ ID NO: 1763751 - protein, 6 aa, Staphylococcus epidermidis
RDQFSE

SEQ ID NO: 1763752 - protein, 5 aa, Staphylococcus epidermidis
RDSKI

SEQ ID NO: 1763753 - protein, 11 aa, Staphylococcus epidermidis
RDYNNEQFRDQ

SEQ ID NO: 1763754 - protein, 9 aa, Staphylococcus epidermidis
REAEDPFTC

SEQ ID NO: 1763755 - protein, 8 aa, Staphylococcus epidermidis
REAGFDPS

SEQ ID NO: 1763756 - protein, 17 aa, Staphylococcus epidermidis
REAGTVKGKKTGKFATS

SEQ ID NO: 1763757 - protein, 5 aa, Staphylococcus epidermidis
REAGV

SEQ ID NO: 1763758 - protein, 12 aa, Staphylococcus epidermidis
REAQKNAYAPYS

SEQ ID NO: 1763759 - protein, 6 aa, Staphylococcus epidermidis
REAVPS

SEQ ID NO: 1763760 - protein, 7 aa, Staphylococcus epidermidis
REDTEGK

SEQ ID NO: 1763761 - protein, 8 aa, Staphylococcus epidermidis
REEAMRRA

SEQ ID NO: 1763762 - protein, 22 aa, Staphylococcus epidermidis
REEAYDKVQPKAMESWETKTPF

SEQ ID NO: 1763763 - protein, 4 aa, Staphylococcus epidermidis
REEH

SEQ ID NO: 1763764 - protein, 16 aa, Staphylococcus epidermidis
REGGRTVGSGVVTEIF

SEQ ID NO: 1763765 - protein, 14 aa, Staphylococcus epidermidis
REGQVAQRTIDKEN

SEQ ID NO: 1763766 - protein, 5 aa, Staphylococcus epidermidis
REGSL

SEQ ID NO: 1763767 - protein, 5 aa, Staphylococcus epidermidis
REHKP

SEQ ID NO: 1763768 - protein, 4 aa, Staphylococcus epidermidis
REID

SEQ ID NO: 1763769 - protein, 19 aa, Staphylococcus epidermidis
REKKKAEKQGKIQKDINLL

SEQ ID NO: 1763770 - protein, 15 aa, Staphylococcus epidermidis
RENADELADTLNKEG

SEQ ID NO: 1763771 - protein, 8 aa, Staphylococcus epidermidis
RENEPRLQ

SEQ ID NO: 1763772 - protein, 6 aa, Staphylococcus epidermidis
RENGGD

SEQ ID NO: 1763773 - protein, 6 aa, Staphylococcus epidermidis
RENGGT

SEQ ID NO: 1763774 - protein, 13 aa, Staphylococcus epidermidis
RENGKTSFEPSDL

SEQ ID NO: 1763775 - protein, 5 aa, Staphylococcus epidermidis
RENIG

SEQ ID NO: 1763776 - protein, 8 aa, Staphylococcus epidermidis
RENKPGIS

SEQ ID NO: 1763777 - protein, 10 aa, Staphylococcus epidermidis
RENKSIKNAL

SEQ ID NO: 1763778 - protein, 10 aa, Staphylococcus epidermidis
RENQGKLEIT

SEQ ID NO: 1763779 - protein, 23 aa, Staphylococcus epidermidis
REPGGEHKETIESGTKAAARGGF

SEQ ID NO: 1763780 - protein, 7 aa, Staphylococcus epidermidis
REPGHQM

SEQ ID NO: 1763781 - protein, 5 aa, Staphylococcus epidermidis
REQGY

SEQ ID NO: 1763782 - protein, 9 aa, Staphylococcus epidermidis
RERQQSDKR

SEQ ID NO: 1763783 - protein, 12 aa, Staphylococcus epidermidis
RERYRNKREQNQ

SEQ ID NO: 1763784 - protein, 8 aa, Staphylococcus epidermidis
RESDTDKI

SEQ ID NO: 1763785 - protein, 8 aa, Staphylococcus epidermidis
RESYGDDY

SEQ ID NO: 1763786 - protein, 7 aa, Staphylococcus epidermidis
RETLEEN

SEQ ID NO: 1763787 - protein, 14 aa, Staphylococcus epidermidis
RETRRETSKNLHLN

SEQ ID NO: 1763788 - protein, 7 aa, Staphylococcus epidermidis
REVAEKA

SEQ ID NO: 1763789 - protein, 12 aa, Staphylococcus epidermidis
REVEGKYTGDYL

SEQ ID NO: 1763790 - protein, 7 aa, Staphylococcus epidermidis
RFGSTNE

SEQ ID NO: 1763791 - protein, 6 aa, Staphylococcus epidermidis
RFSDGE

SEQ ID NO: 1763792 - protein, 15 aa, Staphylococcus epidermidis
RGANHPVKDLRTGKI

SEQ ID NO: 1763793 - protein, 5 aa, Staphylococcus epidermidis
RGASE

SEQ ID NO: 1763794 - protein, 7 aa, Staphylococcus epidermidis
RGATSYH

SEQ ID NO: 1763795 - protein, 16 aa, Staphylococcus epidermidis
RGDADAMVTGGTEAPI

SEQ ID NO: 1763796 - protein, 27 aa, Staphylococcus epidermidis
RGELAQKIGEEKIKQGTRVYDPQREKE

SEQ ID NO: 1763797 - protein, 7 aa, Staphylococcus epidermidis
RGERQGE

SEQ ID NO: 1763798 - protein, 5 aa, Staphylococcus epidermidis
RGESY

SEQ ID NO: 1763799 - protein, 8 aa, Staphylococcus epidermidis
RGGEEAEE

SEQ ID NO: 1763800 - protein, 4 aa, Staphylococcus epidermidis
RGGL

SEQ ID NO: 1763801 - protein, 15 aa, Staphylococcus epidermidis
RGGNHVTSQNPEVNY

SEQ ID NO: 1763802 - protein, 7 aa, Staphylococcus epidermidis
RGGSDIT

SEQ ID NO: 1763803 - protein, 4 aa, Staphylococcus epidermidis
RGHD

SEQ ID NO: 1763804 - protein, 13 aa, Staphylococcus epidermidis
RGHGKSSRTESYE

SEQ ID NO: 1763805 - protein, 30 aa, Staphylococcus epidermidis
RGIDHNEVKASRVRKSVGTERTFSTDVNDD

SEQ ID NO: 1763806 - protein, 4 aa, Staphylococcus epidermidis
RGIE

SEQ ID NO: 1763807 - protein, 15 aa, Staphylococcus epidermidis
RGKAGGYQANQHTAQ

SEQ ID NO: 1763808 - protein, 5 aa, Staphylococcus epidermidis
RGKGF

SEQ ID NO: 1763809 - protein, 28 aa, Staphylococcus epidermidis
RGKKKYDKRQALKEKAVKRDIDRAVKAR

SEQ ID NO: 1763810 - protein, 4 aa, Staphylococcus epidermidis
RGLT

SEQ ID NO: 1763811 - protein, 12 aa, Staphylococcus epidermidis
RGNNGSEGRDEF

SEQ ID NO: 1763812 - protein, 9 aa, Staphylococcus epidermidis
RGSADADAS

SEQ ID NO: 1763813 - protein, 12 aa, Staphylococcus epidermidis
RGTKVERSNREG

SEQ ID NO: 1763814 - protein, 6 aa, Staphylococcus epidermidis
RGVDKY

SEQ ID NO: 1763815 - protein, 4 aa, Staphylococcus epidermidis
RGVR

SEQ ID NO: 1763816 - protein, 5 aa, Staphylococcus epidermidis
RGVSV

SEQ ID NO: 1763817 - protein, 9 aa, Staphylococcus epidermidis
RGYQSYTED

SEQ ID NO: 1763818 - protein, 12 aa, Staphylococcus epidermidis
RHEKTEKRTHDE

SEQ ID NO: 1763819 - protein, 8 aa, Staphylococcus epidermidis
RHESSNNV

SEQ ID NO: 1763820 - protein, 5 aa, Staphylococcus epidermidis
RHGHQ

SEQ ID NO: 1763821 - protein, 10 aa, Staphylococcus epidermidis
RHGISGEANF

SEQ ID NO: 1763822 - protein, 10 aa, Staphylococcus epidermidis
RHGQGRGPMA

SEQ ID NO: 1763823 - protein, 6 aa, Staphylococcus epidermidis
RHNPNQ

SEQ ID NO: 1763824 - protein, 9 aa, Staphylococcus epidermidis
RHSATSSLF

SEQ ID NO: 1763825 - protein, 11 aa, Staphylococcus epidermidis
RIAAPKKNRII

SEQ ID NO: 1763826 - protein, 13 aa, Staphylococcus epidermidis
RIAKKSGEEIKAN

SEQ ID NO: 1763827 - protein, 6 aa, Staphylococcus epidermidis
RIDTDD

SEQ ID NO: 1763828 - protein, 4 aa, Staphylococcus epidermidis
RIEG

SEQ ID NO: 1763829 - protein, 11 aa, Staphylococcus epidermidis
RIKDNQGHQPI

SEQ ID NO: 1763830 - protein, 8 aa, Staphylococcus epidermidis
RIKTPQDV

SEQ ID NO: 1763831 - protein, 6 aa, Staphylococcus epidermidis
RISETA

SEQ ID NO: 1763832 - protein, 4 aa, Staphylococcus epidermidis
RISK

SEQ ID NO: 1763833 - protein, 8 aa, Staphylococcus epidermidis
RISNTSYQ

SEQ ID NO: 1763834 - protein, 7 aa, Staphylococcus epidermidis
RITDNGL

SEQ ID NO: 1763835 - protein, 5 aa, Staphylococcus epidermidis
RITQS

SEQ ID NO: 1763836 - protein, 4 aa, Staphylococcus epidermidis
RKAE

SEQ ID NO: 1763837 - protein, 9 aa, Staphylococcus epidermidis
RKASEDNEW

SEQ ID NO: 1763838 - protein, 8 aa, Staphylococcus epidermidis
RKATGKSE

SEQ ID NO: 1763839 - protein, 7 aa, Staphylococcus epidermidis
RKEKEKI

SEQ ID NO: 1763840 - protein, 9 aa, Staphylococcus epidermidis
RKGNQNEAL

SEQ ID NO: 1763841 - protein, 12 aa, Staphylococcus epidermidis
RKIAGSAQTRQK

SEQ ID NO: 1763842 - protein, 6 aa, Staphylococcus epidermidis
RKIKGD

SEQ ID NO: 1763843 - protein, 4 aa, Staphylococcus epidermidis
RKND

SEQ ID NO: 1763844 - protein, 7 aa, Staphylococcus epidermidis
RKPLEPQ

SEQ ID NO: 1763845 - protein, 18 aa, Staphylococcus epidermidis
RKPTGKLTIQREQDAYSK

SEQ ID NO: 1763846 - protein, 8 aa, Staphylococcus epidermidis
RKQTLSNA

SEQ ID NO: 1763847 - protein, 5 aa, Staphylococcus epidermidis
RKREW

SEQ ID NO: 1763848 - protein, 31 aa, Staphylococcus epidermidis
RKRLSEQKATEAENTEKEEAINKATENASID

SEQ ID NO: 1763849 - protein, 4 aa, Staphylococcus epidermidis
RKSA

SEQ ID NO: 1763850 - protein, 5 aa, Staphylococcus epidermidis
RKTDE

SEQ ID NO: 1763851 - protein, 11 aa, Staphylococcus epidermidis
RKTDNSEEREL

SEQ ID NO: 1763852 - protein, 9 aa, Staphylococcus epidermidis
RKTYEGESV

SEQ ID NO: 1763853 - protein, 7 aa, Staphylococcus epidermidis
RKYGKDI

SEQ ID NO: 1763854 - protein, 4 aa, Staphylococcus epidermidis
RLDE

SEQ ID NO: 1763855 - protein, 9 aa, Staphylococcus epidermidis
RLKSDPSFY

SEQ ID NO: 1763856 - protein, 14 aa, Staphylococcus epidermidis
RLPEDNSKPLEKRT

SEQ ID NO: 1763857 - protein, 4 aa, Staphylococcus epidermidis
RLQR

SEQ ID NO: 1763858 - protein, 9 aa, Staphylococcus epidermidis
RLSEDKDKN

SEQ ID NO: 1763859 - protein, 9 aa, Staphylococcus epidermidis
RLSKSPAMF

SEQ ID NO: 1763860 - protein, 10 aa, Staphylococcus epidermidis
RLTAEDKKEI

SEQ ID NO: 1763861 - protein, 20 aa, Staphylococcus epidermidis
RLTGKPGVAITTSGPGVSNL

SEQ ID NO: 1763862 - protein, 5 aa, Staphylococcus epidermidis
RLVSG

SEQ ID NO: 1763863 - protein, 6 aa, Staphylococcus epidermidis
RNARKA

SEQ ID NO: 1763864 - protein, 10 aa, Staphylococcus epidermidis
RNASDNATEL

SEQ ID NO: 1763865 - protein, 7 aa, Staphylococcus epidermidis
RNEEDYE

SEQ ID NO: 1763866 - protein, 10 aa, Staphylococcus epidermidis
RNEKANESVT

SEQ ID NO: 1763867 - protein, 7 aa, Staphylococcus epidermidis
RNGKDAI

SEQ ID NO: 1763868 - protein, 10 aa, Staphylococcus epidermidis
RNGKRTAKAA

SEQ ID NO: 1763869 - protein, 14 aa, Staphylococcus epidermidis
RNGQDYESDEYQSH

SEQ ID NO: 1763870 - protein, 5 aa, Staphylococcus epidermidis
RNHTE

SEQ ID NO: 1763871 - protein, 11 aa, Staphylococcus epidermidis
RNLGNPPFATR

SEQ ID NO: 1763872 - protein, 11 aa, Staphylococcus epidermidis
RNNAEAQLGAD

SEQ ID NO: 1763873 - protein, 12 aa, Staphylococcus epidermidis
RNNELKRPPVSN

SEQ ID NO: 1763874 - protein, 5 aa, Staphylococcus epidermidis
RNNID

SEQ ID NO: 1763875 - protein, 8 aa, Staphylococcus epidermidis
RNPVTGEN

SEQ ID NO: 1763876 - protein, 18 aa, Staphylococcus epidermidis
RNRAETLGLSSESNYNSL

SEQ ID NO: 1763877 - protein, 5 aa, Staphylococcus epidermidis
RNSIQ

SEQ ID NO: 1763878 - protein, 16 aa, Staphylococcus epidermidis
RNYISTKNKRNNPERV

SEQ ID NO: 1763879 - protein, 5 aa, Staphylococcus epidermidis
RPDCL

SEQ ID NO: 1763880 - protein, 16 aa, Staphylococcus epidermidis
RPDEKRVTERAYENPR

SEQ ID NO: 1763881 - protein, 4 aa, Staphylococcus epidermidis
RPDL

SEQ ID NO: 1763882 - protein, 6 aa, Staphylococcus epidermidis
RPDTIY

SEQ ID NO: 1763883 - protein, 5 aa, Staphylococcus epidermidis
RPETE

SEQ ID NO: 1763884 - protein, 7 aa, Staphylococcus epidermidis
RPLEQDG

SEQ ID NO: 1763885 - protein, 25 aa, Staphylococcus epidermidis
RPNDSNQNAAVKNDAGEDNANKKGG

SEQ ID NO: 1763886 - protein, 4 aa, Staphylococcus epidermidis
RPPS

SEQ ID NO: 1763887 - protein, 5 aa, Staphylococcus epidermidis
RPQLE

SEQ ID NO: 1763888 - protein, 7 aa, Staphylococcus epidermidis
RPQSVYE

SEQ ID NO: 1763889 - protein, 6 aa, Staphylococcus epidermidis
RPSIEQ

SEQ ID NO: 1763890 - protein, 5 aa, Staphylococcus epidermidis
RPTNQ

SEQ ID NO: 1763891 - protein, 11 aa, Staphylococcus epidermidis
RPTYDGQGYGS

SEQ ID NO: 1763892 - protein, 20 aa, Staphylococcus epidermidis
RPYKQKKKTRATEAKRKGLE

SEQ ID NO: 1763893 - protein, 11 aa, Staphylococcus epidermidis
RQAITNPNTVQ

SEQ ID NO: 1763894 - protein, 13 aa, Staphylococcus epidermidis
RQDNSESKPYEES

SEQ ID NO: 1763895 - protein, 9 aa, Staphylococcus epidermidis
RQGGYGRGR

SEQ ID NO: 1763896 - protein, 5 aa, Staphylococcus epidermidis
RQHDH

SEQ ID NO: 1763897 - protein, 5 aa, Staphylococcus epidermidis
RQNPD

SEQ ID NO: 1763898 - protein, 6 aa, Staphylococcus epidermidis
RQPNGE

SEQ ID NO: 1763899 - protein, 12 aa, Staphylococcus epidermidis
RQPQIGETVNDQ

SEQ ID NO: 1763900 - protein, 8 aa, Staphylococcus epidermidis
RQQNGPYR

SEQ ID NO: 1763901 - protein, 16 aa, Staphylococcus epidermidis
RQQNGYTRELIDKQLS

SEQ ID NO: 1763902 - protein, 6 aa, Staphylococcus epidermidis
RQRELT

SEQ ID NO: 1763903 - protein, 8 aa, Staphylococcus epidermidis
RQTGGRGV

SEQ ID NO: 1763904 - protein, 8 aa, Staphylococcus epidermidis
RQTHPDLD

SEQ ID NO: 1763905 - protein, 13 aa, Staphylococcus epidermidis
RQTTENAERLFNL

SEQ ID NO: 1763906 - protein, 9 aa, Staphylococcus epidermidis
RQVGGAPCN

SEQ ID NO: 1763907 - protein, 5 aa, Staphylococcus epidermidis
RQVNR

SEQ ID NO: 1763908 - protein, 6 aa, Staphylococcus epidermidis
RRAQEI

SEQ ID NO: 1763909 - protein, 7 aa, Staphylococcus epidermidis
RRENQPQ

SEQ ID NO: 1763910 - protein, 9 aa, Staphylococcus epidermidis
RRGGGISET

SEQ ID NO: 1763911 - protein, 6 aa, Staphylococcus epidermidis
RRGTSL

SEQ ID NO: 1763912 - protein, 17 aa, Staphylococcus epidermidis
RRIQKENQINATYKAQG

SEQ ID NO: 1763913 - protein, 11 aa, Staphylococcus epidermidis
RRKGKATKEQA

SEQ ID NO: 1763914 - protein, 8 aa, Staphylococcus epidermidis
RRKGYKAN

SEQ ID NO: 1763915 - protein, 9 aa, Staphylococcus epidermidis
RRLGKSRPY

SEQ ID NO: 1763916 - protein, 7 aa, Staphylococcus epidermidis
RRNSAIP

SEQ ID NO: 1763917 - protein, 14 aa, Staphylococcus epidermidis
RRQSYGSTGQESVK

SEQ ID NO: 1763918 - protein, 22 aa, Staphylococcus epidermidis
RRQTSKKYPRKPGTPNKSPLVE

SEQ ID NO: 1763919 - protein, 9 aa, Staphylococcus epidermidis
RRSRGTPRI

SEQ ID NO: 1763920 - protein, 5 aa, Staphylococcus epidermidis
RRTEY

SEQ ID NO: 1763921 - protein, 27 aa, Staphylococcus epidermidis
RRYEDDGQLVSRKKTDATITNTDEAIQ

SEQ ID NO: 1763922 - protein, 15 aa, Staphylococcus epidermidis
RSASAYGKKTRSVKS

SEQ ID NO: 1763923 - protein, 6 aa, Staphylococcus epidermidis
RSDEQL

SEQ ID NO: 1763924 - protein, 4 aa, Staphylococcus epidermidis
RSDK

SEQ ID NO: 1763925 - protein, 13 aa, Staphylococcus epidermidis
RSEAGSAGRDTRG

SEQ ID NO: 1763926 - protein, 8 aa, Staphylococcus epidermidis
RSEGFGEE

SEQ ID NO: 1763927 - protein, 7 aa, Staphylococcus epidermidis
RSFEDGE

SEQ ID NO: 1763928 - protein, 4 aa, Staphylococcus epidermidis
RSGD

SEQ ID NO: 1763929 - protein, 16 aa, Staphylococcus epidermidis
RSIAETGNKPGVTKQQ

SEQ ID NO: 1763930 - protein, 9 aa, Staphylococcus epidermidis
RSIDGSTLN

SEQ ID NO: 1763931 - protein, 9 aa, Staphylococcus epidermidis
RSITEDKNL

SEQ ID NO: 1763932 - protein, 15 aa, Staphylococcus epidermidis
RSKEERDKLKQPRSS

SEQ ID NO: 1763933 - protein, 11 aa, Staphylococcus epidermidis
RSKGYDQRPSI

SEQ ID NO: 1763934 - protein, 5 aa, Staphylococcus epidermidis
RSLIP

SEQ ID NO: 1763935 - protein, 13 aa, Staphylococcus epidermidis
RSNAGQPEEEANH

SEQ ID NO: 1763936 - protein, 12 aa, Staphylococcus epidermidis
RSNATVDSQTDH

SEQ ID NO: 1763937 - protein, 9 aa, Staphylococcus epidermidis
RSQENAQKL

SEQ ID NO: 1763938 - protein, 6 aa, Staphylococcus epidermidis
RSQQSV

SEQ ID NO: 1763939 - protein, 5 aa, Staphylococcus epidermidis
RSQSQ

SEQ ID NO: 1763940 - protein, 7 aa, Staphylococcus epidermidis
RSREGKL

SEQ ID NO: 1763941 - protein, 6 aa, Staphylococcus epidermidis
RSRSQN

SEQ ID NO: 1763942 - protein, 5 aa, Staphylococcus epidermidis
RSTIL

SEQ ID NO: 1763943 - protein, 14 aa, Staphylococcus epidermidis
RSTQLKPNSKAASL

SEQ ID NO: 1763944 - protein, 11 aa, Staphylococcus epidermidis
RSVSKSGTIQE

SEQ ID NO: 1763945 - protein, 5 aa, Staphylococcus epidermidis
RSYNP

SEQ ID NO: 1763946 - protein, 6 aa, Staphylococcus epidermidis
RTAGVN

SEQ ID NO: 1763947 - protein, 4 aa, Staphylococcus epidermidis
RTAH

SEQ ID NO: 1763948 - protein, 8 aa, Staphylococcus epidermidis
RTAYEKKG

SEQ ID NO: 1763949 - protein, 8 aa, Staphylococcus epidermidis
RTDHFGDD

SEQ ID NO: 1763950 - protein, 11 aa, Staphylococcus epidermidis
RTGCSASTIRR

SEQ ID NO: 1763951 - protein, 9 aa, Staphylococcus epidermidis
RTGNESIPQ

SEQ ID NO: 1763952 - protein, 9 aa, Staphylococcus epidermidis
RTIDQAESL

SEQ ID NO: 1763953 - protein, 9 aa, Staphylococcus epidermidis
RTKTDNDAF

SEQ ID NO: 1763954 - protein, 5 aa, Staphylococcus epidermidis
RTPEY

SEQ ID NO: 1763955 - protein, 4 aa, Staphylococcus epidermidis
RTPL

SEQ ID NO: 1763956 - protein, 14 aa, Staphylococcus epidermidis
RTQTANTEQSEPHA

SEQ ID NO: 1763957 - protein, 15 aa, Staphylococcus epidermidis
RTRSELVESGEEDLS

SEQ ID NO: 1763958 - protein, 10 aa, Staphylococcus epidermidis
RTRYDLEQAE

SEQ ID NO: 1763959 - protein, 7 aa, Staphylococcus epidermidis
RTSEKEN

SEQ ID NO: 1763960 - protein, 7 aa, Staphylococcus epidermidis
RTSSEAE

SEQ ID NO: 1763961 - protein, 20 aa, Staphylococcus epidermidis
RTTETAEERNISKKNAMRTA

SEQ ID NO: 1763962 - protein, 6 aa, Staphylococcus epidermidis
RTYDTE

SEQ ID NO: 1763963 - protein, 4 aa, Staphylococcus epidermidis
RTYE

SEQ ID NO: 1763964 - protein, 6 aa, Staphylococcus epidermidis
RVEKSI

SEQ ID NO: 1763965 - protein, 7 aa, Staphylococcus epidermidis
RVKDTED

SEQ ID NO: 1763966 - protein, 6 aa, Staphylococcus epidermidis
RVPENN

SEQ ID NO: 1763967 - protein, 16 aa, Staphylococcus epidermidis
RVQEAASAKDEKDLYE

SEQ ID NO: 1763968 - protein, 7 aa, Staphylococcus epidermidis
RVSGTSG

SEQ ID NO: 1763969 - protein, 15 aa, Staphylococcus epidermidis
RVSQTSKTAGGKGLN

SEQ ID NO: 1763970 - protein, 11 aa, Staphylococcus epidermidis
RVTNDTIDNQI

SEQ ID NO: 1763971 - protein, 9 aa, Staphylococcus epidermidis
RVTNQEELE

SEQ ID NO: 1763972 - protein, 11 aa, Staphylococcus epidermidis
RWNDKNQAKYT

SEQ ID NO: 1763973 - protein, 4 aa, Staphylococcus epidermidis
RYDS

SEQ ID NO: 1763974 - protein, 8 aa, Staphylococcus epidermidis
RYNDTSPY

SEQ ID NO: 1763975 - protein, 5 aa, Staphylococcus epidermidis
RYQPR

SEQ ID NO: 1763976 - protein, 4 aa, Staphylococcus epidermidis
SADE

SEQ ID NO: 1763977 - protein, 26 aa, Staphylococcus epidermidis
SADLAGSNKSNVKEAKDYNKDTPEGK

SEQ ID NO: 1763978 - protein, 10 aa, Staphylococcus epidermidis
SADSKKKHQN

SEQ ID NO: 1763979 - protein, 5 aa, Staphylococcus epidermidis
SAGAD

SEQ ID NO: 1763980 - protein, 7 aa, Staphylococcus epidermidis
SAGEPLN

SEQ ID NO: 1763981 - protein, 13 aa, Staphylococcus epidermidis
SAGQSLSSKITDY

SEQ ID NO: 1763982 - protein, 6 aa, Staphylococcus epidermidis
SAGTIN

SEQ ID NO: 1763983 - protein, 9 aa, Staphylococcus epidermidis
SAKTGEGGK

SEQ ID NO: 1763984 - protein, 5 aa, Staphylococcus epidermidis
SANGY

SEQ ID NO: 1763985 - protein, 17 aa, Staphylococcus epidermidis
SAPQTENYASRVESTEG

SEQ ID NO: 1763986 - protein, 14 aa, Staphylococcus epidermidis
SAQAVSEVKNSLKF

SEQ ID NO: 1763987 - protein, 6 aa, Staphylococcus epidermidis
SAQSVS

SEQ ID NO: 1763988 - protein, 13 aa, Staphylococcus epidermidis
SAQYDLKNILSNY

SEQ ID NO: 1763989 - protein, 14 aa, Staphylococcus epidermidis
SARRQPEETRENIK

SEQ ID NO: 1763990 - protein, 10 aa, Staphylococcus epidermidis
SASKSPEEIK

SEQ ID NO: 1763991 - protein, 14 aa, Staphylococcus epidermidis
SASSQNVGHAPKPV

SEQ ID NO: 1763992 - protein, 7 aa, Staphylococcus epidermidis
SATDNEA

SEQ ID NO: 1763993 - protein, 21 aa, Staphylococcus epidermidis
SATNGKLSQKSYEDLENQTGM

SEQ ID NO: 1763994 - protein, 7 aa, Staphylococcus epidermidis
SATQQPD

SEQ ID NO: 1763995 - protein, 20 aa, Staphylococcus epidermidis
SAYSTGKPALGVGPGNVPTY

SEQ ID NO: 1763996 - protein, 8 aa, Staphylococcus epidermidis
SCGSGAAS

SEQ ID NO: 1763997 - protein, 9 aa, Staphylococcus epidermidis
SCRSQMAEG

SEQ ID NO: 1763998 - protein, 5 aa, Staphylococcus epidermidis
SDDDA

SEQ ID NO: 1763999 - protein, 6 aa, Staphylococcus epidermidis
SDDEQP

SEQ ID NO: 1764000 - protein, 13 aa, Staphylococcus epidermidis
SDDFKGKAKPGPI

SEQ ID NO: 1764001 - protein, 12 aa, Staphylococcus epidermidis
SDDIKTTLESED

SEQ ID NO: 1764002 - protein, 8 aa, Staphylococcus epidermidis
SDDRELRA

SEQ ID NO: 1764003 - protein, 7 aa, Staphylococcus epidermidis
SDDSQLE

SEQ ID NO: 1764004 - protein, 9 aa, Staphylococcus epidermidis
SDDYHGPDM

SEQ ID NO: 1764005 - protein, 10 aa, Staphylococcus epidermidis
SDEAGSGDYF

SEQ ID NO: 1764006 - protein, 8 aa, Staphylococcus epidermidis
SDEELQND

SEQ ID NO: 1764007 - protein, 13 aa, Staphylococcus epidermidis
SDEMKEKVKESFG

SEQ ID NO: 1764008 - protein, 10 aa, Staphylococcus epidermidis
SDETLEQTNA

SEQ ID NO: 1764009 - protein, 15 aa, Staphylococcus epidermidis
SDFDEDIKDKATSIR

SEQ ID NO: 1764010 - protein, 4 aa, Staphylococcus epidermidis
SDFS

SEQ ID NO: 1764011 - protein, 5 aa, Staphylococcus epidermidis
SDGAF

SEQ ID NO: 1764012 - protein, 11 aa, Staphylococcus epidermidis
SDILGGKNANI

SEQ ID NO: 1764013 - protein, 11 aa, Staphylococcus epidermidis
SDIQQDEVTEQ

SEQ ID NO: 1764014 - protein, 9 aa, Staphylococcus epidermidis
SDISKNSNH

SEQ ID NO: 1764015 - protein, 9 aa, Staphylococcus epidermidis
SDKRTTDWG

SEQ ID NO: 1764016 - protein, 6 aa, Staphylococcus epidermidis
SDMTGP

SEQ ID NO: 1764017 - protein, 8 aa, Staphylococcus epidermidis
SDNPQYRS

SEQ ID NO: 1764018 - protein, 6 aa, Staphylococcus epidermidis
SDNTAT

SEQ ID NO: 1764019 - protein, 6 aa, Staphylococcus epidermidis
SDNYAR

SEQ ID NO: 1764020 - protein, 7 aa, Staphylococcus epidermidis
SDPKTGA

SEQ ID NO: 1764021 - protein, 9 aa, Staphylococcus epidermidis
SDQYDTSEL

SEQ ID NO: 1764022 - protein, 9 aa, Staphylococcus epidermidis
SDSDEQAEY

SEQ ID NO: 1764023 - protein, 7 aa, Staphylococcus epidermidis
SDSENTI

SEQ ID NO: 1764024 - protein, 11 aa, Staphylococcus epidermidis
SDSEPTQSQKS

SEQ ID NO: 1764025 - protein, 8 aa, Staphylococcus epidermidis
SDTKKGVD

SEQ ID NO: 1764026 - protein, 7 aa, Staphylococcus epidermidis
SDTPKKV

SEQ ID NO: 1764027 - protein, 6 aa, Staphylococcus epidermidis
SDVEQD

SEQ ID NO: 1764028 - protein, 5 aa, Staphylococcus epidermidis
SDVTP

SEQ ID NO: 1764029 - protein, 7 aa, Staphylococcus epidermidis
SEAYPEL

SEQ ID NO: 1764030 - protein, 5 aa, Staphylococcus epidermidis
SEDAK

SEQ ID NO: 1764031 - protein, 8 aa, Staphylococcus epidermidis
SEDAKERI

SEQ ID NO: 1764032 - protein, 4 aa, Staphylococcus epidermidis
SEDE

SEQ ID NO: 1764033 - protein, 5 aa, Staphylococcus epidermidis
SEDGL

SEQ ID NO: 1764034 - protein, 4 aa, Staphylococcus epidermidis
SEDY

SEQ ID NO: 1764035 - protein, 8 aa, Staphylococcus epidermidis
SEEERRHQ

SEQ ID NO: 1764036 - protein, 6 aa, Staphylococcus epidermidis
SEEITA

SEQ ID NO: 1764037 - protein, 4 aa, Staphylococcus epidermidis
SEEL

SEQ ID NO: 1764038 - protein, 10 aa, Staphylococcus epidermidis
SEENSEDSQA

SEQ ID NO: 1764039 - protein, 5 aa, Staphylococcus epidermidis
SEFNN

SEQ ID NO: 1764040 - protein, 5 aa, Staphylococcus epidermidis
SEFTT

SEQ ID NO: 1764041 - protein, 8 aa, Staphylococcus epidermidis
SEGATDGT

SEQ ID NO: 1764042 - protein, 10 aa, Staphylococcus epidermidis
SEGDQVSPQQ

SEQ ID NO: 1764043 - protein, 12 aa, Staphylococcus epidermidis
SEGDTVKQGESI

SEQ ID NO: 1764044 - protein, 4 aa, Staphylococcus epidermidis
SEGF

SEQ ID NO: 1764045 - protein, 4 aa, Staphylococcus epidermidis
SEGQ

SEQ ID NO: 1764046 - protein, 18 aa, Staphylococcus epidermidis
SEGTNYPDFEAALKAYRN

SEQ ID NO: 1764047 - protein, 9 aa, Staphylococcus epidermidis
SEGYQPGDF

SEQ ID NO: 1764048 - protein, 4 aa, Staphylococcus epidermidis
SEHE

SEQ ID NO: 1764049 - protein, 4 aa, Staphylococcus epidermidis
SEIE

SEQ ID NO: 1764050 - protein, 13 aa, Staphylococcus epidermidis
SEKESLAKVGHSQ

SEQ ID NO: 1764051 - protein, 7 aa, Staphylococcus epidermidis
SEKGRSY

SEQ ID NO: 1764052 - protein, 8 aa, Staphylococcus epidermidis
SEKLPYRA

SEQ ID NO: 1764053 - protein, 8 aa, Staphylococcus epidermidis
SELQTVTA

SEQ ID NO: 1764054 - protein, 17 aa, Staphylococcus epidermidis
SENIAPAVNTWIKEFIN

SEQ ID NO: 1764055 - protein, 9 aa, Staphylococcus epidermidis
SENIDSKRF

SEQ ID NO: 1764056 - protein, 6 aa, Staphylococcus epidermidis
SENKGD

SEQ ID NO: 1764057 - protein, 9 aa, Staphylococcus epidermidis
SENNLPSRK

SEQ ID NO: 1764058 - protein, 7 aa, Staphylococcus epidermidis
SEPINTK

SEQ ID NO: 1764059 - protein, 7 aa, Staphylococcus epidermidis
SEQHPNA

SEQ ID NO: 1764060 - protein, 5 aa, Staphylococcus epidermidis
SEQIE

SEQ ID NO: 1764061 - protein, 7 aa, Staphylococcus epidermidis
SEQLKGT

SEQ ID NO: 1764062 - protein, 7 aa, Staphylococcus epidermidis
SERALGS

SEQ ID NO: 1764063 - protein, 26 aa, Staphylococcus epidermidis
SERGLETAVGDEGGFAPRFEGTEDAV

SEQ ID NO: 1764064 - protein, 7 aa, Staphylococcus epidermidis
SERYPSH

SEQ ID NO: 1764065 - protein, 4 aa, Staphylococcus epidermidis
SESD

SEQ ID NO: 1764066 - protein, 9 aa, Staphylococcus epidermidis
SESGNAQGL

SEQ ID NO: 1764067 - protein, 6 aa, Staphylococcus epidermidis
SESGTI

SEQ ID NO: 1764068 - protein, 13 aa, Staphylococcus epidermidis
SESHPLQEEEHVQ

SEQ ID NO: 1764069 - protein, 13 aa, Staphylococcus epidermidis
SESIEQSKQISEK

SEQ ID NO: 1764070 - protein, 7 aa, Staphylococcus epidermidis
SESKRAV

SEQ ID NO: 1764071 - protein, 7 aa, Staphylococcus epidermidis
SETLGDE

SEQ ID NO: 1764072 - protein, 5 aa, Staphylococcus epidermidis
SETQN

SEQ ID NO: 1764073 - protein, 10 aa, Staphylococcus epidermidis
SETSNKQPSI

SEQ ID NO: 1764074 - protein, 8 aa, Staphylococcus epidermidis
SEVDEETF

SEQ ID NO: 1764075 - protein, 8 aa, Staphylococcus epidermidis
SEVETAKR

SEQ ID NO: 1764076 - protein, 6 aa, Staphylococcus epidermidis
SEVETN

SEQ ID NO: 1764077 - protein, 5 aa, Staphylococcus epidermidis
SEVPA

SEQ ID NO: 1764078 - protein, 5 aa, Staphylococcus epidermidis
SEVRE

SEQ ID NO: 1764079 - protein, 7 aa, Staphylococcus epidermidis
SEVTEQT

SEQ ID NO: 1764080 - protein, 44 aa, Staphylococcus epidermidis
SFANETKDMVATKGRASYFNEASKGYIDPGAQSSVYILNAIIGG

SEQ ID NO: 1764081 - protein, 4 aa, Staphylococcus epidermidis
SFDE

SEQ ID NO: 1764082 - protein, 7 aa, Staphylococcus epidermidis
SFDGKGQ

SEQ ID NO: 1764083 - protein, 10 aa, Staphylococcus epidermidis
SFDKETKEGH

SEQ ID NO: 1764084 - protein, 5 aa, Staphylococcus epidermidis
SFEAT

SEQ ID NO: 1764085 - protein, 6 aa, Staphylococcus epidermidis
SFGKEN

SEQ ID NO: 1764086 - protein, 17 aa, Staphylococcus epidermidis
SFGPDKERGKAYRDSGL

SEQ ID NO: 1764087 - protein, 13 aa, Staphylococcus epidermidis
SFNDSNGDGIGDL

SEQ ID NO: 1764088 - protein, 7 aa, Staphylococcus epidermidis
SFQDEVN

SEQ ID NO: 1764089 - protein, 13 aa, Staphylococcus epidermidis
SFSGKESLKRIFK

SEQ ID NO: 1764090 - protein, 5 aa, Staphylococcus epidermidis
SFSHS

SEQ ID NO: 1764091 - protein, 4 aa, Staphylococcus epidermidis
SGAG

SEQ ID NO: 1764092 - protein, 7 aa, Staphylococcus epidermidis
SGAGHLS

SEQ ID NO: 1764093 - protein, 4 aa, Staphylococcus epidermidis
SGAM

SEQ ID NO: 1764094 - protein, 8 aa, Staphylococcus epidermidis
SGATESNN

SEQ ID NO: 1764095 - protein, 8 aa, Staphylococcus epidermidis
SGDEGLEQ

SEQ ID NO: 1764096 - protein, 16 aa, Staphylococcus epidermidis
SGEEYDKVEIVKTESL

SEQ ID NO: 1764097 - protein, 19 aa, Staphylococcus epidermidis
SGELSTYYQPSTEGPSRKY

SEQ ID NO: 1764098 - protein, 9 aa, Staphylococcus epidermidis
SGERPLPQF

SEQ ID NO: 1764099 - protein, 25 aa, Staphylococcus epidermidis
SGGEIGALTGPSLMPGGQKDAYNKV

SEQ ID NO: 1764100 - protein, 4 aa, Staphylococcus epidermidis
SGGF

SEQ ID NO: 1764101 - protein, 5 aa, Staphylococcus epidermidis
SGGFP

SEQ ID NO: 1764102 - protein, 17 aa, Staphylococcus epidermidis
SGGGEERLHGQSSIGVG

SEQ ID NO: 1764103 - protein, 11 aa, Staphylococcus epidermidis
SGGGSGHEPAH

SEQ ID NO: 1764104 - protein, 8 aa, Staphylococcus epidermidis
SGGIPQKS

SEQ ID NO: 1764105 - protein, 7 aa, Staphylococcus epidermidis
SGGKRVR

SEQ ID NO: 1764106 - protein, 7 aa, Staphylococcus epidermidis
SGGNPAL

SEQ ID NO: 1764107 - protein, 10 aa, Staphylococcus epidermidis
SGGPNSVYEE

SEQ ID NO: 1764108 - protein, 11 aa, Staphylococcus epidermidis
SGGQDSTLTGK

SEQ ID NO: 1764109 - protein, 5 aa, Staphylococcus epidermidis
SGGQL

SEQ ID NO: 1764110 - protein, 6 aa, Staphylococcus epidermidis
SGGQQR

SEQ ID NO: 1764111 - protein, 10 aa, Staphylococcus epidermidis
SGHAPHIEEP

SEQ ID NO: 1764112 - protein, 6 aa, Staphylococcus epidermidis
SGIAKE

SEQ ID NO: 1764113 - protein, 4 aa, Staphylococcus epidermidis
SGIE

SEQ ID NO: 1764114 - protein, 6 aa, Staphylococcus epidermidis
SGIEPG

SEQ ID NO: 1764115 - protein, 4 aa, Staphylococcus epidermidis
SGIP

SEQ ID NO: 1764116 - protein, 16 aa, Staphylococcus epidermidis
SGISGSYPSATQAGEM

SEQ ID NO: 1764117 - protein, 17 aa, Staphylococcus epidermidis
SGKIARKEMKNKFINGE

SEQ ID NO: 1764118 - protein, 8 aa, Staphylococcus epidermidis
SGKLPKGK

SEQ ID NO: 1764119 - protein, 4 aa, Staphylococcus epidermidis
SGLQ

SEQ ID NO: 1764120 - protein, 7 aa, Staphylococcus epidermidis
SGMDPDD

SEQ ID NO: 1764121 - protein, 7 aa, Staphylococcus epidermidis
SGMDTGE

SEQ ID NO: 1764122 - protein, 9 aa, Staphylococcus epidermidis
SGMNKPNGL

SEQ ID NO: 1764123 - protein, 9 aa, Staphylococcus epidermidis
SGNKKAVDN

SEQ ID NO: 1764124 - protein, 5 aa, Staphylococcus epidermidis
SGNQF

SEQ ID NO: 1764125 - protein, 7 aa, Staphylococcus epidermidis
SGNTNDR

SEQ ID NO: 1764126 - protein, 18 aa, Staphylococcus epidermidis
SGNTYDKNFRKSAKTVGD

SEQ ID NO: 1764127 - protein, 22 aa, Staphylococcus epidermidis
SGQNEEQLRDQMKDDAEQRVKT

SEQ ID NO: 1764128 - protein, 11 aa, Staphylococcus epidermidis
SGRGDKDMETI

SEQ ID NO: 1764129 - protein, 9 aa, Staphylococcus epidermidis
SGRPTEGML

SEQ ID NO: 1764130 - protein, 9 aa, Staphylococcus epidermidis
SGRSDIDKN

SEQ ID NO: 1764131 - protein, 16 aa, Staphylococcus epidermidis
SGSTGNATYVESEKGS

SEQ ID NO: 1764132 - protein, 16 aa, Staphylococcus epidermidis
SGTAAANYTPAIAESQ

SEQ ID NO: 1764133 - protein, 10 aa, Staphylococcus epidermidis
SGTDGKDDHI

SEQ ID NO: 1764134 - protein, 11 aa, Staphylococcus epidermidis
SGTQSPSSGKS

SEQ ID NO: 1764135 - protein, 13 aa, Staphylococcus epidermidis
SGTTGKPKAVSVK

SEQ ID NO: 1764136 - protein, 12 aa, Staphylococcus epidermidis
SGTTGKPKGTLV

SEQ ID NO: 1764137 - protein, 7 aa, Staphylococcus epidermidis
SGTTGLP

SEQ ID NO: 1764138 - protein, 13 aa, Staphylococcus epidermidis
SGTTGPQKAVPQT

SEQ ID NO: 1764139 - protein, 4 aa, Staphylococcus epidermidis
SGVD

SEQ ID NO: 1764140 - protein, 4 aa, Staphylococcus epidermidis
SGVE

SEQ ID NO: 1764141 - protein, 7 aa, Staphylococcus epidermidis
SGVKEPL

SEQ ID NO: 1764142 - protein, 8 aa, Staphylococcus epidermidis
SGVKQREH

SEQ ID NO: 1764143 - protein, 15 aa, Staphylococcus epidermidis
SGYENKVKKNLEKRV

SEQ ID NO: 1764144 - protein, 4 aa, Staphylococcus epidermidis
SGYQ

SEQ ID NO: 1764145 - protein, 14 aa, Staphylococcus epidermidis
SGYSGGHVENPTYE

SEQ ID NO: 1764146 - protein, 7 aa, Staphylococcus epidermidis
SGYTEEY

SEQ ID NO: 1764147 - protein, 14 aa, Staphylococcus epidermidis
SHEEDAHRLFFVAK

SEQ ID NO: 1764148 - protein, 7 aa, Staphylococcus epidermidis
SHGGRTQ

SEQ ID NO: 1764149 - protein, 8 aa, Staphylococcus epidermidis
SHNPKDYN

SEQ ID NO: 1764150 - protein, 10 aa, Staphylococcus epidermidis
SHPQTNTAKN

SEQ ID NO: 1764151 - protein, 8 aa, Staphylococcus epidermidis
SHSEYRTQ

SEQ ID NO: 1764152 - protein, 7 aa, Staphylococcus epidermidis
SHTATHG

SEQ ID NO: 1764153 - protein, 15 aa, Staphylococcus epidermidis
SHVADKEQGHSCGEG

SEQ ID NO: 1764154 - protein, 5 aa, Staphylococcus epidermidis
SHVQN

SEQ ID NO: 1764155 - protein, 5 aa, Staphylococcus epidermidis
SIAEA

SEQ ID NO: 1764156 - protein, 11 aa, Staphylococcus epidermidis
SIARDGEGASK

SEQ ID NO: 1764157 - protein, 5 aa, Staphylococcus epidermidis
SIATP

SEQ ID NO: 1764158 - protein, 14 aa, Staphylococcus epidermidis
SIDTQNEDRDNHLR

SEQ ID NO: 1764159 - protein, 4 aa, Staphylococcus epidermidis
SIEE

SEQ ID NO: 1764160 - protein, 6 aa, Staphylococcus epidermidis
SIEGKE

SEQ ID NO: 1764161 - protein, 5 aa, Staphylococcus epidermidis
SIEKG

SEQ ID NO: 1764162 - protein, 6 aa, Staphylococcus epidermidis
SIERTT

SEQ ID NO: 1764163 - protein, 7 aa, Staphylococcus epidermidis
SIGPGAK

SEQ ID NO: 1764164 - protein, 4 aa, Staphylococcus epidermidis
SINI

SEQ ID NO: 1764165 - protein, 4 aa, Staphylococcus epidermidis
SINM

SEQ ID NO: 1764166 - protein, 5 aa, Staphylococcus epidermidis
SIPDN

SEQ ID NO: 1764167 - protein, 19 aa, Staphylococcus epidermidis
SIPEPENNEQPGMGGMPGM

SEQ ID NO: 1764168 - protein, 9 aa, Staphylococcus epidermidis
SIPPQPYNS

SEQ ID NO: 1764169 - protein, 17 aa, Staphylococcus epidermidis
SIPQLNNKYTNKNNQSF

SEQ ID NO: 1764170 - protein, 7 aa, Staphylococcus epidermidis
SISQQQG

SEQ ID NO: 1764171 - protein, 8 aa, Staphylococcus epidermidis
SITDNYEQ

SEQ ID NO: 1764172 - protein, 10 aa, Staphylococcus epidermidis
SKAGSSAQIP

SEQ ID NO: 1764173 - protein, 8 aa, Staphylococcus epidermidis
SKAPTFEE

SEQ ID NO: 1764174 - protein, 6 aa, Staphylococcus epidermidis
SKASGH

SEQ ID NO: 1764175 - protein, 7 aa, Staphylococcus epidermidis
SKDDTNK

SEQ ID NO: 1764176 - protein, 8 aa, Staphylococcus epidermidis
SKDEIGDT

SEQ ID NO: 1764177 - protein, 9 aa, Staphylococcus epidermidis
SKDSTQQYQ

SEQ ID NO: 1764178 - protein, 7 aa, Staphylococcus epidermidis
SKDTKYH

SEQ ID NO: 1764179 - protein, 6 aa, Staphylococcus epidermidis
SKDVPD

SEQ ID NO: 1764180 - protein, 6 aa, Staphylococcus epidermidis
SKEDDF

SEQ ID NO: 1764181 - protein, 5 aa, Staphylococcus epidermidis
SKEDQ

SEQ ID NO: 1764182 - protein, 4 aa, Staphylococcus epidermidis
SKEE

SEQ ID NO: 1764183 - protein, 16 aa, Staphylococcus epidermidis
SKEEADEIIEYLNEVI

SEQ ID NO: 1764184 - protein, 6 aa, Staphylococcus epidermidis
SKEELN

SEQ ID NO: 1764185 - protein, 9 aa, Staphylococcus epidermidis
SKEERERGG

SEQ ID NO: 1764186 - protein, 8 aa, Staphylococcus epidermidis
SKEGRLPD

SEQ ID NO: 1764187 - protein, 11 aa, Staphylococcus epidermidis
SKEKKDEKAKE

SEQ ID NO: 1764188 - protein, 9 aa, Staphylococcus epidermidis
SKEKTPKWL

SEQ ID NO: 1764189 - protein, 5 aa, Staphylococcus epidermidis
SKELN

SEQ ID NO: 1764190 - protein, 9 aa, Staphylococcus epidermidis
SKEPGKIEP

SEQ ID NO: 1764191 - protein, 8 aa, Staphylococcus epidermidis
SKETETAI

SEQ ID NO: 1764192 - protein, 7 aa, Staphylococcus epidermidis
SKETGLN

SEQ ID NO: 1764193 - protein, 10 aa, Staphylococcus epidermidis
SKGAGEKKVN

SEQ ID NO: 1764194 - protein, 14 aa, Staphylococcus epidermidis
SKGEIEGVPGKTMP

SEQ ID NO: 1764195 - protein, 13 aa, Staphylococcus epidermidis
SKGKPNKKFTDEK

SEQ ID NO: 1764196 - protein, 9 aa, Staphylococcus epidermidis
SKGRASHSS

SEQ ID NO: 1764197 - protein, 4 aa, Staphylococcus epidermidis
SKID

SEQ ID NO: 1764198 - protein, 11 aa, Staphylococcus epidermidis
SKIDEGTDVNY

SEQ ID NO: 1764199 - protein, 6 aa, Staphylococcus epidermidis
SKIEGS

SEQ ID NO: 1764200 - protein, 11 aa, Staphylococcus epidermidis
SKISRTNQRIR

SEQ ID NO: 1764201 - protein, 17 aa, Staphylococcus epidermidis
SKKAETNRITGISSKPP

SEQ ID NO: 1764202 - protein, 7 aa, Staphylococcus epidermidis
SKKGNKV

SEQ ID NO: 1764203 - protein, 12 aa, Staphylococcus epidermidis
SKKKKAEDEKQT

SEQ ID NO: 1764204 - protein, 9 aa, Staphylococcus epidermidis
SKKNRAILE

SEQ ID NO: 1764205 - protein, 16 aa, Staphylococcus epidermidis
SKKPHYTNKLSKREKE

SEQ ID NO: 1764206 - protein, 7 aa, Staphylococcus epidermidis
SKKQQAY

SEQ ID NO: 1764207 - protein, 17 aa, Staphylococcus epidermidis
SKLAGTERGVTEPQPSF

SEQ ID NO: 1764208 - protein, 14 aa, Staphylococcus epidermidis
SKLRRAEKNTKSFR

SEQ ID NO: 1764209 - protein, 8 aa, Staphylococcus epidermidis
SKLSLSEI

SEQ ID NO: 1764210 - protein, 7 aa, Staphylococcus epidermidis
SKNGYYD

SEQ ID NO: 1764211 - protein, 8 aa, Staphylococcus epidermidis
SKNQAPKH

SEQ ID NO: 1764212 - protein, 16 aa, Staphylococcus epidermidis
SKNTIHDGARSQTIHA

SEQ ID NO: 1764213 - protein, 4 aa, Staphylococcus epidermidis
SKNY

SEQ ID NO: 1764214 - protein, 6 aa, Staphylococcus epidermidis
SKPHRL

SEQ ID NO: 1764215 - protein, 9 aa, Staphylococcus epidermidis
SKPSMSTGV

SEQ ID NO: 1764216 - protein, 10 aa, Staphylococcus epidermidis
SKPYSTTNNY

SEQ ID NO: 1764217 - protein, 11 aa, Staphylococcus epidermidis
SKQETLNKEPL

SEQ ID NO: 1764218 - protein, 8 aa, Staphylococcus epidermidis
SKQKEPQI

SEQ ID NO: 1764219 - protein, 9 aa, Staphylococcus epidermidis
SKQRSETNV

SEQ ID NO: 1764220 - protein, 6 aa, Staphylococcus epidermidis
SKQTME

SEQ ID NO: 1764221 - protein, 5 aa, Staphylococcus epidermidis
SKRHV

SEQ ID NO: 1764222 - protein, 11 aa, Staphylococcus epidermidis
SKRLKQPLKRR

SEQ ID NO: 1764223 - protein, 12 aa, Staphylococcus epidermidis
SKRTGKAFSSDD

SEQ ID NO: 1764224 - protein, 8 aa, Staphylococcus epidermidis
SKSEATEV

SEQ ID NO: 1764225 - protein, 8 aa, Staphylococcus epidermidis
SKSESVEH

SEQ ID NO: 1764226 - protein, 7 aa, Staphylococcus epidermidis
SKSGFGP

SEQ ID NO: 1764227 - protein, 8 aa, Staphylococcus epidermidis
SKSHPGYE

SEQ ID NO: 1764228 - protein, 5 aa, Staphylococcus epidermidis
SKSIN

SEQ ID NO: 1764229 - protein, 16 aa, Staphylococcus epidermidis
SKSITGTVHKVNGGWY

SEQ ID NO: 1764230 - protein, 6 aa, Staphylococcus epidermidis
SKSKPL

SEQ ID NO: 1764231 - protein, 21 aa, Staphylococcus epidermidis
SKSKSHGKQNQIEGAKSENKN

SEQ ID NO: 1764232 - protein, 30 aa, Staphylococcus epidermidis
SKTEEMKAKRNKVSEEIAQKKRNKEDADDV

SEQ ID NO: 1764233 - protein, 8 aa, Staphylococcus epidermidis
SKTGTSQI

SEQ ID NO: 1764234 - protein, 9 aa, Staphylococcus epidermidis
SKTIEPFRD

SEQ ID NO: 1764235 - protein, 5 aa, Staphylococcus epidermidis
SKTMR

SEQ ID NO: 1764236 - protein, 6 aa, Staphylococcus epidermidis
SKTTME

SEQ ID NO: 1764237 - protein, 9 aa, Staphylococcus epidermidis
SKVAKITKA

SEQ ID NO: 1764238 - protein, 8 aa, Staphylococcus epidermidis
SKVNKNDV

SEQ ID NO: 1764239 - protein, 7 aa, Staphylococcus epidermidis
SKVNQGN

SEQ ID NO: 1764240 - protein, 7 aa, Staphylococcus epidermidis
SKYGSNV

SEQ ID NO: 1764241 - protein, 6 aa, Staphylococcus epidermidis
SLDDGF

SEQ ID NO: 1764242 - protein, 8 aa, Staphylococcus epidermidis
SLEDAKAR

SEQ ID NO: 1764243 - protein, 15 aa, Staphylococcus epidermidis
SLEQSDFKNLTIYDF

SEQ ID NO: 1764244 - protein, 7 aa, Staphylococcus epidermidis
SLGSKKL

SEQ ID NO: 1764245 - protein, 11 aa, Staphylococcus epidermidis
SLKEKPDTANL

SEQ ID NO: 1764246 - protein, 6 aa, Staphylococcus epidermidis
SLLSSG

SEQ ID NO: 1764247 - protein, 12 aa, Staphylococcus epidermidis
SLNDKENRRDDM

SEQ ID NO: 1764248 - protein, 6 aa, Staphylococcus epidermidis
SLNEGA

SEQ ID NO: 1764249 - protein, 5 aa, Staphylococcus epidermidis
SLNGK

SEQ ID NO: 1764250 - protein, 10 aa, Staphylococcus epidermidis
SLNKNEKGIN

SEQ ID NO: 1764251 - protein, 9 aa, Staphylococcus epidermidis
SLPKGLNTD

SEQ ID NO: 1764252 - protein, 21 aa, Staphylococcus epidermidis
SLQNGKPYRETSTIDVPQAAN

SEQ ID NO: 1764253 - protein, 7 aa, Staphylococcus epidermidis
SLRGNAL

SEQ ID NO: 1764254 - protein, 42 aa, Staphylococcus epidermidis
SLRQGTHAVKNRSAVRGGGRKPWRQKGTGRARQGTIRAPQWR

SEQ ID NO: 1764255 - protein, 13 aa, Staphylococcus epidermidis
SLRTEPKLSLPSA

SEQ ID NO: 1764256 - protein, 13 aa, Staphylococcus epidermidis
SLSAKELKEGFKD

SEQ ID NO: 1764257 - protein, 7 aa, Staphylococcus epidermidis
SLSKKDM

SEQ ID NO: 1764258 - protein, 6 aa, Staphylococcus epidermidis
SLSPYE

SEQ ID NO: 1764259 - protein, 5 aa, Staphylococcus epidermidis
SLSQK

SEQ ID NO: 1764260 - protein, 5 aa, Staphylococcus epidermidis
SLSRQ

SEQ ID NO: 1764261 - protein, 5 aa, Staphylococcus epidermidis
SLTGA

SEQ ID NO: 1764262 - protein, 7 aa, Staphylococcus epidermidis
SLTHENS

SEQ ID NO: 1764263 - protein, 10 aa, Staphylococcus epidermidis
SLTSTPKDQE

SEQ ID NO: 1764264 - protein, 7 aa, Staphylococcus epidermidis
SLTTEQQ

SEQ ID NO: 1764265 - protein, 6 aa, Staphylococcus epidermidis
SMDKKE

SEQ ID NO: 1764266 - protein, 9 aa, Staphylococcus epidermidis
SMEQNNTDI

SEQ ID NO: 1764267 - protein, 19 aa, Staphylococcus epidermidis
SMQPPKSIKQSDEPGKEQI

SEQ ID NO: 1764268 - protein, 17 aa, Staphylococcus epidermidis
SMRAGKSVYENAAQTVK

SEQ ID NO: 1764269 - protein, 10 aa, Staphylococcus epidermidis
SMSKEAKTIG

SEQ ID NO: 1764270 - protein, 7 aa, Staphylococcus epidermidis
SMTENYS

SEQ ID NO: 1764271 - protein, 8 aa, Staphylococcus epidermidis
SMTTVPED

SEQ ID NO: 1764272 - protein, 6 aa, Staphylococcus epidermidis
SNANKV

SEQ ID NO: 1764273 - protein, 8 aa, Staphylococcus epidermidis
SNDINKGK

SEQ ID NO: 1764274 - protein, 4 aa, Staphylococcus epidermidis
SNDN

SEQ ID NO: 1764275 - protein, 7 aa, Staphylococcus epidermidis
SNEGTRT

SEQ ID NO: 1764276 - protein, 11 aa, Staphylococcus epidermidis
SNESDYAANIE

SEQ ID NO: 1764277 - protein, 4 aa, Staphylococcus epidermidis
SNGK

SEQ ID NO: 1764278 - protein, 22 aa, Staphylococcus epidermidis
SNHPGGLKSISAGELKRTNPER

SEQ ID NO: 1764279 - protein, 6 aa, Staphylococcus epidermidis
SNIEDI

SEQ ID NO: 1764280 - protein, 6 aa, Staphylococcus epidermidis
SNIESN

SEQ ID NO: 1764281 - protein, 9 aa, Staphylococcus epidermidis
SNKARKSKV

SEQ ID NO: 1764282 - protein, 6 aa, Staphylococcus epidermidis
SNKEKR

SEQ ID NO: 1764283 - protein, 10 aa, Staphylococcus epidermidis
SNKGKKYIKE

SEQ ID NO: 1764284 - protein, 7 aa, Staphylococcus epidermidis
SNKPNAK

SEQ ID NO: 1764285 - protein, 14 aa, Staphylococcus epidermidis
SNKTTADLGGQYRT

SEQ ID NO: 1764286 - protein, 4 aa, Staphylococcus epidermidis
SNNI

SEQ ID NO: 1764287 - protein, 7 aa, Staphylococcus epidermidis
SNNTLTG

SEQ ID NO: 1764288 - protein, 7 aa, Staphylococcus epidermidis
SNPLTHK

SEQ ID NO: 1764289 - protein, 7 aa, Staphylococcus epidermidis
SNPQCNI

SEQ ID NO: 1764290 - protein, 20 aa, Staphylococcus epidermidis
SNQGGDDSIVDSPEKLPSAK

SEQ ID NO: 1764291 - protein, 12 aa, Staphylococcus epidermidis
SNQYESHTQFRK

SEQ ID NO: 1764292 - protein, 7 aa, Staphylococcus epidermidis
SNRKRGE

SEQ ID NO: 1764293 - protein, 12 aa, Staphylococcus epidermidis
SNSDNDPEKEKE

SEQ ID NO: 1764294 - protein, 5 aa, Staphylococcus epidermidis
SNSLD

SEQ ID NO: 1764295 - protein, 22 aa, Staphylococcus epidermidis
SNSSRYNAETMPYHTDKGTGIK

SEQ ID NO: 1764296 - protein, 5 aa, Staphylococcus epidermidis
SNTLT

SEQ ID NO: 1764297 - protein, 5 aa, Staphylococcus epidermidis
SNTNE

SEQ ID NO: 1764298 - protein, 5 aa, Staphylococcus epidermidis
SPCTV

SEQ ID NO: 1764299 - protein, 9 aa, Staphylococcus epidermidis
SPDKLESSI

SEQ ID NO: 1764300 - protein, 10 aa, Staphylococcus epidermidis
SPEAASGGPI

SEQ ID NO: 1764301 - protein, 11 aa, Staphylococcus epidermidis
SPEEAESPGIS

SEQ ID NO: 1764302 - protein, 9 aa, Staphylococcus epidermidis
SPEIDGQAQ

SEQ ID NO: 1764303 - protein, 4 aa, Staphylococcus epidermidis
SPEQ

SEQ ID NO: 1764304 - protein, 9 aa, Staphylococcus epidermidis
SPFGKGRPG

SEQ ID NO: 1764305 - protein, 10 aa, Staphylococcus epidermidis
SPFKSKSYLS

SEQ ID NO: 1764306 - protein, 11 aa, Staphylococcus epidermidis
SPGPGKPSDYP

SEQ ID NO: 1764307 - protein, 15 aa, Staphylococcus epidermidis
SPIAEEYQANRQKKH

SEQ ID NO: 1764308 - protein, 4 aa, Staphylococcus epidermidis
SPIE

SEQ ID NO: 1764309 - protein, 13 aa, Staphylococcus epidermidis
SPIGNDAKTTWDN

SEQ ID NO: 1764310 - protein, 8 aa, Staphylococcus epidermidis
SPKEAGLT

SEQ ID NO: 1764311 - protein, 29 aa, Staphylococcus epidermidis
SPKNKNNETPSDNQFENNTYQPDDLEIIH

SEQ ID NO: 1764312 - protein, 18 aa, Staphylococcus epidermidis
SPKPKDAPGFPVRAFAIK

SEQ ID NO: 1764313 - protein, 9 aa, Staphylococcus epidermidis
SPKTRYSQQ

SEQ ID NO: 1764314 - protein, 11 aa, Staphylococcus epidermidis
SPLEEAKETID

SEQ ID NO: 1764315 - protein, 13 aa, Staphylococcus epidermidis
SPLNKGNIRTGEI

SEQ ID NO: 1764316 - protein, 4 aa, Staphylococcus epidermidis
SPPI

SEQ ID NO: 1764317 - protein, 6 aa, Staphylococcus epidermidis
SPPNYL

SEQ ID NO: 1764318 - protein, 5 aa, Staphylococcus epidermidis
SPQAF

SEQ ID NO: 1764319 - protein, 6 aa, Staphylococcus epidermidis
SPQGNV

SEQ ID NO: 1764320 - protein, 13 aa, Staphylococcus epidermidis
SPTPAGEGKSTVT

SEQ ID NO: 1764321 - protein, 6 aa, Staphylococcus epidermidis
SPTSGD

SEQ ID NO: 1764322 - protein, 8 aa, Staphylococcus epidermidis
SPTSGLKY

SEQ ID NO: 1764323 - protein, 4 aa, Staphylococcus epidermidis
SPVN

SEQ ID NO: 1764324 - protein, 4 aa, Staphylococcus epidermidis
SPYD

SEQ ID NO: 1764325 - protein, 6 aa, Staphylococcus epidermidis
SQDEET

SEQ ID NO: 1764326 - protein, 13 aa, Staphylococcus epidermidis
SQDEETAKRYGLR

SEQ ID NO: 1764327 - protein, 7 aa, Staphylococcus epidermidis
SQDPEKI

SEQ ID NO: 1764328 - protein, 12 aa, Staphylococcus epidermidis
SQDRSVKQLSDD

SEQ ID NO: 1764329 - protein, 11 aa, Staphylococcus epidermidis
SQEKKDEKAKE

SEQ ID NO: 1764330 - protein, 7 aa, Staphylococcus epidermidis
SQGGNTQ

SEQ ID NO: 1764331 - protein, 7 aa, Staphylococcus epidermidis
SQGQDVQ

SEQ ID NO: 1764332 - protein, 6 aa, Staphylococcus epidermidis
SQGVTE

SEQ ID NO: 1764333 - protein, 9 aa, Staphylococcus epidermidis
SQIDPKRDV

SEQ ID NO: 1764334 - protein, 4 aa, Staphylococcus epidermidis
SQIP

SEQ ID NO: 1764335 - protein, 6 aa, Staphylococcus epidermidis
SQKANE

SEQ ID NO: 1764336 - protein, 10 aa, Staphylococcus epidermidis
SQLNSTSHHE

SEQ ID NO: 1764337 - protein, 4 aa, Staphylococcus epidermidis
SQLP

SEQ ID NO: 1764338 - protein, 8 aa, Staphylococcus epidermidis
SQLTPESY

SEQ ID NO: 1764339 - protein, 17 aa, Staphylococcus epidermidis
SQMTQNNDFNEEKKIST

SEQ ID NO: 1764340 - protein, 10 aa, Staphylococcus epidermidis
SQNEGSDPAA

SEQ ID NO: 1764341 - protein, 5 aa, Staphylococcus epidermidis
SQNGN

SEQ ID NO: 1764342 - protein, 8 aa, Staphylococcus epidermidis
SQNKGDVT

SEQ ID NO: 1764343 - protein, 5 aa, Staphylococcus epidermidis
SQPFI

SEQ ID NO: 1764344 - protein, 10 aa, Staphylococcus epidermidis
SQPGEESSNV

SEQ ID NO: 1764345 - protein, 5 aa, Staphylococcus epidermidis
SQPIT

SEQ ID NO: 1764346 - protein, 7 aa, Staphylococcus epidermidis
SQPLGNA

SEQ ID NO: 1764347 - protein, 5 aa, Staphylococcus epidermidis
SQPTL

SEQ ID NO: 1764348 - protein, 7 aa, Staphylococcus epidermidis
SQQERTI

SEQ ID NO: 1764349 - protein, 13 aa, Staphylococcus epidermidis
SQSAEAKRTTYNA

SEQ ID NO: 1764350 - protein, 6 aa, Staphylococcus epidermidis
SQTEQL

SEQ ID NO: 1764351 - protein, 8 aa, Staphylococcus epidermidis
SQTQSNDA

SEQ ID NO: 1764352 - protein, 8 aa, Staphylococcus epidermidis
SQTSGDVV

SEQ ID NO: 1764353 - protein, 6 aa, Staphylococcus epidermidis
SQVQSD

SEQ ID NO: 1764354 - protein, 4 aa, Staphylococcus epidermidis
SRAG

SEQ ID NO: 1764355 - protein, 11 aa, Staphylococcus epidermidis
SRARKVRDQDF

SEQ ID NO: 1764356 - protein, 10 aa, Staphylococcus epidermidis
SREDTNLSPV

SEQ ID NO: 1764357 - protein, 5 aa, Staphylococcus epidermidis
SREKF

SEQ ID NO: 1764358 - protein, 6 aa, Staphylococcus epidermidis
SRFGKA

SEQ ID NO: 1764359 - protein, 9 aa, Staphylococcus epidermidis
SRGEHTKHP

SEQ ID NO: 1764360 - protein, 7 aa, Staphylococcus epidermidis
SRGTEKE

SEQ ID NO: 1764361 - protein, 10 aa, Staphylococcus epidermidis
SRISGVNPAD

SEQ ID NO: 1764362 - protein, 10 aa, Staphylococcus epidermidis
SRKNTQKEKL

SEQ ID NO: 1764363 - protein, 10 aa, Staphylococcus epidermidis
SRNATQYTSQ

SEQ ID NO: 1764364 - protein, 6 aa, Staphylococcus epidermidis
SRNEEN

SEQ ID NO: 1764365 - protein, 6 aa, Staphylococcus epidermidis
SRPNEL

SEQ ID NO: 1764366 - protein, 6 aa, Staphylococcus epidermidis
SRQDEI

SEQ ID NO: 1764367 - protein, 4 aa, Staphylococcus epidermidis
SRRT

SEQ ID NO: 1764368 - protein, 8 aa, Staphylococcus epidermidis
SRSECNTS

SEQ ID NO: 1764369 - protein, 6 aa, Staphylococcus epidermidis
SRSPVR

SEQ ID NO: 1764370 - protein, 8 aa, Staphylococcus epidermidis
SRSRDDER

SEQ ID NO: 1764371 - protein, 9 aa, Staphylococcus epidermidis
SRTNMTIEP

SEQ ID NO: 1764372 - protein, 11 aa, Staphylococcus epidermidis
SSDENTIKKEQ

SEQ ID NO: 1764373 - protein, 7 aa, Staphylococcus epidermidis
SSDTSSY

SEQ ID NO: 1764374 - protein, 4 aa, Staphylococcus epidermidis
SSDV

SEQ ID NO: 1764375 - protein, 4 aa, Staphylococcus epidermidis
SSDY

SEQ ID NO: 1764376 - protein, 8 aa, Staphylococcus epidermidis
SSEASANL

SEQ ID NO: 1764377 - protein, 6 aa, Staphylococcus epidermidis
SSFTDI

SEQ ID NO: 1764378 - protein, 6 aa, Staphylococcus epidermidis
SSGDGI

SEQ ID NO: 1764379 - protein, 6 aa, Staphylococcus epidermidis
SSGLEP

SEQ ID NO: 1764380 - protein, 9 aa, Staphylococcus epidermidis
SSGLETARE

SEQ ID NO: 1764381 - protein, 6 aa, Staphylococcus epidermidis
SSGQSL

SEQ ID NO: 1764382 - protein, 4 aa, Staphylococcus epidermidis
SSGR

SEQ ID NO: 1764383 - protein, 6 aa, Staphylococcus epidermidis
SSGVGV

SEQ ID NO: 1764384 - protein, 18 aa, Staphylococcus epidermidis
SSGVTGENIHVDGGFHAI

SEQ ID NO: 1764385 - protein, 11 aa, Staphylococcus epidermidis
SSKALPPEDDE

SEQ ID NO: 1764386 - protein, 12 aa, Staphylococcus epidermidis
SSKSYDQRFTPD

SEQ ID NO: 1764387 - protein, 6 aa, Staphylococcus epidermidis
SSLKYA

SEQ ID NO: 1764388 - protein, 5 aa, Staphylococcus epidermidis
SSLPL

SEQ ID NO: 1764389 - protein, 7 aa, Staphylococcus epidermidis
SSMREEI

SEQ ID NO: 1764390 - protein, 8 aa, Staphylococcus epidermidis
SSNASALG

SEQ ID NO: 1764391 - protein, 5 aa, Staphylococcus epidermidis
SSNDA

SEQ ID NO: 1764392 - protein, 10 aa, Staphylococcus epidermidis
SSNGTSGEIH

SEQ ID NO: 1764393 - protein, 6 aa, Staphylococcus epidermidis
SSNTDD

SEQ ID NO: 1764394 - protein, 15 aa, Staphylococcus epidermidis
SSNTSTGNALRNKHN

SEQ ID NO: 1764395 - protein, 9 aa, Staphylococcus epidermidis
SSPFQMSGG

SEQ ID NO: 1764396 - protein, 24 aa, Staphylococcus epidermidis
SSPNPTTAATTELSYGKESQITLK

SEQ ID NO: 1764397 - protein, 8 aa, Staphylococcus epidermidis
SSPNTENL

SEQ ID NO: 1764398 - protein, 7 aa, Staphylococcus epidermidis
SSPYETL

SEQ ID NO: 1764399 - protein, 6 aa, Staphylococcus epidermidis
SSQTKV

SEQ ID NO: 1764400 - protein, 10 aa, Staphylococcus epidermidis
SSRQLKKPER

SEQ ID NO: 1764401 - protein, 7 aa, Staphylococcus epidermidis
SSRQQYN

SEQ ID NO: 1764402 - protein, 11 aa, Staphylococcus epidermidis
SSRQSLNGNNI

SEQ ID NO: 1764403 - protein, 8 aa, Staphylococcus epidermidis
SSRSESTL

SEQ ID NO: 1764404 - protein, 7 aa, Staphylococcus epidermidis
SSSIDNN

SEQ ID NO: 1764405 - protein, 14 aa, Staphylococcus epidermidis
SSSLDGKQATDFNE

SEQ ID NO: 1764406 - protein, 6 aa, Staphylococcus epidermidis
SSSYTK

SEQ ID NO: 1764407 - protein, 4 aa, Staphylococcus epidermidis
SSTN

SEQ ID NO: 1764408 - protein, 11 aa, Staphylococcus epidermidis
SSTSDNPVAKQ

SEQ ID NO: 1764409 - protein, 23 aa, Staphylococcus epidermidis
SSTSPEIGTVKEEVNANDVEGGN

SEQ ID NO: 1764410 - protein, 14 aa, Staphylococcus epidermidis
SSVERPEIQETTAL

SEQ ID NO: 1764411 - protein, 19 aa, Staphylococcus epidermidis
SSVQENDKHSREKMHNAST

SEQ ID NO: 1764412 - protein, 5 aa, Staphylococcus epidermidis
STAEQ

SEQ ID NO: 1764413 - protein, 12 aa, Staphylococcus epidermidis
STAKQLSKIGGG

SEQ ID NO: 1764414 - protein, 5 aa, Staphylococcus epidermidis
STANL

SEQ ID NO: 1764415 - protein, 6 aa, Staphylococcus epidermidis
STDFEE

SEQ ID NO: 1764416 - protein, 10 aa, Staphylococcus epidermidis
STEGEITIDG

SEQ ID NO: 1764417 - protein, 7 aa, Staphylococcus epidermidis
STEKMAG

SEQ ID NO: 1764418 - protein, 6 aa, Staphylococcus epidermidis
STEMSD

SEQ ID NO: 1764419 - protein, 12 aa, Staphylococcus epidermidis
STGFAGGGATVE

SEQ ID NO: 1764420 - protein, 9 aa, Staphylococcus epidermidis
STGGSSITA

SEQ ID NO: 1764421 - protein, 11 aa, Staphylococcus epidermidis
STGPISKSGMN

SEQ ID NO: 1764422 - protein, 17 aa, Staphylococcus epidermidis
STGRDDAEEKLKKLGAK

SEQ ID NO: 1764423 - protein, 5 aa, Staphylococcus epidermidis
STHPL

SEQ ID NO: 1764424 - protein, 6 aa, Staphylococcus epidermidis
STINNY

SEQ ID NO: 1764425 - protein, 5 aa, Staphylococcus epidermidis
STITG

SEQ ID NO: 1764426 - protein, 10 aa, Staphylococcus epidermidis
STKGIGQDNK

SEQ ID NO: 1764427 - protein, 7 aa, Staphylococcus epidermidis
STKGMSE

SEQ ID NO: 1764428 - protein, 7 aa, Staphylococcus epidermidis
STKGVSI

SEQ ID NO: 1764429 - protein, 11 aa, Staphylococcus epidermidis
STKTRKEGDLR

SEQ ID NO: 1764430 - protein, 8 aa, Staphylococcus epidermidis
STNVDPIE

SEQ ID NO: 1764431 - protein, 4 aa, Staphylococcus epidermidis
STQK

SEQ ID NO: 1764432 - protein, 8 aa, Staphylococcus epidermidis
STQRETTV

SEQ ID NO: 1764433 - protein, 8 aa, Staphylococcus epidermidis
STRQDEVD

SEQ ID NO: 1764434 - protein, 5 aa, Staphylococcus epidermidis
STSAQ

SEQ ID NO: 1764435 - protein, 7 aa, Staphylococcus epidermidis
STTNLER

SEQ ID NO: 1764436 - protein, 10 aa, Staphylococcus epidermidis
STTSGEDNQL

SEQ ID NO: 1764437 - protein, 6 aa, Staphylococcus epidermidis
STTSIS

SEQ ID NO: 1764438 - protein, 15 aa, Staphylococcus epidermidis
SVAEKKAPGAKIQGD

SEQ ID NO: 1764439 - protein, 8 aa, Staphylococcus epidermidis
SVASGIPD

SEQ ID NO: 1764440 - protein, 9 aa, Staphylococcus epidermidis
SVEEDENLG

SEQ ID NO: 1764441 - protein, 6 aa, Staphylococcus epidermidis
SVEERR

SEQ ID NO: 1764442 - protein, 26 aa, Staphylococcus epidermidis
SVEGRSAKIEGKSHLQGAQVKATDLR

SEQ ID NO: 1764443 - protein, 5 aa, Staphylococcus epidermidis
SVGAT

SEQ ID NO: 1764444 - protein, 11 aa, Staphylococcus epidermidis
SVGLNNGSNTV

SEQ ID NO: 1764445 - protein, 8 aa, Staphylococcus epidermidis
SVGTTDEG

SEQ ID NO: 1764446 - protein, 9 aa, Staphylococcus epidermidis
SVKDNPAAI

SEQ ID NO: 1764447 - protein, 26 aa, Staphylococcus epidermidis
SVKVGAPTVEGASVTATVNKQGRGKK

SEQ ID NO: 1764448 - protein, 13 aa, Staphylococcus epidermidis
SVSDGQGTLSDAV

SEQ ID NO: 1764449 - protein, 13 aa, Staphylococcus epidermidis
SVSTDGASPKLGQ

SEQ ID NO: 1764450 - protein, 7 aa, Staphylococcus epidermidis
SVTEYQD

SEQ ID NO: 1764451 - protein, 7 aa, Staphylococcus epidermidis
SVTPEQF

SEQ ID NO: 1764452 - protein, 13 aa, Staphylococcus epidermidis
SVTREGKYKGENR

SEQ ID NO: 1764453 - protein, 8 aa, Staphylococcus epidermidis
SVTYEKDG

SEQ ID NO: 1764454 - protein, 13 aa, Staphylococcus epidermidis
SVYANRGANGIDG

SEQ ID NO: 1764455 - protein, 6 aa, Staphylococcus epidermidis
SYADKE

SEQ ID NO: 1764456 - protein, 9 aa, Staphylococcus epidermidis
SYDRPYEEL

SEQ ID NO: 1764457 - protein, 4 aa, Staphylococcus epidermidis
SYES

SEQ ID NO: 1764458 - protein, 6 aa, Staphylococcus epidermidis
SYGSNG

SEQ ID NO: 1764459 - protein, 6 aa, Staphylococcus epidermidis
SYIDES

SEQ ID NO: 1764460 - protein, 11 aa, Staphylococcus epidermidis
SYKTKKEELQD

SEQ ID NO: 1764461 - protein, 7 aa, Staphylococcus epidermidis
SYLSTSE

SEQ ID NO: 1764462 - protein, 13 aa, Staphylococcus epidermidis
SYNHPEKDIGPRI

SEQ ID NO: 1764463 - protein, 6 aa, Staphylococcus epidermidis
SYNREG

SEQ ID NO: 1764464 - protein, 5 aa, Staphylococcus epidermidis
SYPDP

SEQ ID NO: 1764465 - protein, 6 aa, Staphylococcus epidermidis
SYSDED

SEQ ID NO: 1764466 - protein, 10 aa, Staphylococcus epidermidis
TAARELASRG

SEQ ID NO: 1764467 - protein, 7 aa, Staphylococcus epidermidis
TADASGV

SEQ ID NO: 1764468 - protein, 24 aa, Staphylococcus epidermidis
TAELPRDEVQTVSTKTPYVSTGSD

SEQ ID NO: 1764469 - protein, 9 aa, Staphylococcus epidermidis
TAEPASEID

SEQ ID NO: 1764470 - protein, 11 aa, Staphylococcus epidermidis
TAEVPSTISGT

SEQ ID NO: 1764471 - protein, 9 aa, Staphylococcus epidermidis
TAGASGGVT

SEQ ID NO: 1764472 - protein, 16 aa, Staphylococcus epidermidis
TAGGHATHTPETEEYG

SEQ ID NO: 1764473 - protein, 4 aa, Staphylococcus epidermidis
TAGI

SEQ ID NO: 1764474 - protein, 5 aa, Staphylococcus epidermidis
TAHEG

SEQ ID NO: 1764475 - protein, 6 aa, Staphylococcus epidermidis
TAINND

SEQ ID NO: 1764476 - protein, 8 aa, Staphylococcus epidermidis
TAKYDDVR

SEQ ID NO: 1764477 - protein, 8 aa, Staphylococcus epidermidis
TALSPEEK

SEQ ID NO: 1764478 - protein, 15 aa, Staphylococcus epidermidis
TALTDAGLSIKNDEH

SEQ ID NO: 1764479 - protein, 4 aa, Staphylococcus epidermidis
TANH

SEQ ID NO: 1764480 - protein, 15 aa, Staphylococcus epidermidis
TAPAPEGEGGSRAMQ

SEQ ID NO: 1764481 - protein, 18 aa, Staphylococcus epidermidis
TAPQRVARRKERRKESID

SEQ ID NO: 1764482 - protein, 7 aa, Staphylococcus epidermidis
TAPYHDS

SEQ ID NO: 1764483 - protein, 13 aa, Staphylococcus epidermidis
TAQASSPSEGLGF

SEQ ID NO: 1764484 - protein, 7 aa, Staphylococcus epidermidis
TAQVTER

SEQ ID NO: 1764485 - protein, 4 aa, Staphylococcus epidermidis
TARK

SEQ ID NO: 1764486 - protein, 9 aa, Staphylococcus epidermidis
TARQTVKQA

SEQ ID NO: 1764487 - protein, 13 aa, Staphylococcus epidermidis
TASGVSPRPIPGV

SEQ ID NO: 1764488 - protein, 9 aa, Staphylococcus epidermidis
TASMDAPTA

SEQ ID NO: 1764489 - protein, 11 aa, Staphylococcus epidermidis
TASVANEPDNE

SEQ ID NO: 1764490 - protein, 8 aa, Staphylococcus epidermidis
TASYEARA

SEQ ID NO: 1764491 - protein, 6 aa, Staphylococcus epidermidis
TAYENG

SEQ ID NO: 1764492 - protein, 7 aa, Staphylococcus epidermidis
TCGNRDQ

SEQ ID NO: 1764493 - protein, 12 aa, Staphylococcus epidermidis
TCTDNENGHEIY

SEQ ID NO: 1764494 - protein, 6 aa, Staphylococcus epidermidis
TDAHHT

SEQ ID NO: 1764495 - protein, 5 aa, Staphylococcus epidermidis
TDCSG

SEQ ID NO: 1764496 - protein, 8 aa, Staphylococcus epidermidis
TDDEAQSI

SEQ ID NO: 1764497 - protein, 4 aa, Staphylococcus epidermidis
TDDI

SEQ ID NO: 1764498 - protein, 8 aa, Staphylococcus epidermidis
TDDTTVTV

SEQ ID NO: 1764499 - protein, 7 aa, Staphylococcus epidermidis
TDDVTED

SEQ ID NO: 1764500 - protein, 25 aa, Staphylococcus epidermidis
TDEAKEGRDAFKEKRNPDFDQFPKF

SEQ ID NO: 1764501 - protein, 8 aa, Staphylococcus epidermidis
TDEEVNKK

SEQ ID NO: 1764502 - protein, 7 aa, Staphylococcus epidermidis
TDETDTY

SEQ ID NO: 1764503 - protein, 5 aa, Staphylococcus epidermidis
TDEYQ

SEQ ID NO: 1764504 - protein, 4 aa, Staphylococcus epidermidis
TDGG

SEQ ID NO: 1764505 - protein, 14 aa, Staphylococcus epidermidis
TDGKISSDEELNGN

SEQ ID NO: 1764506 - protein, 8 aa, Staphylococcus epidermidis
TDHKGRIK

SEQ ID NO: 1764507 - protein, 7 aa, Staphylococcus epidermidis
TDKADAA

SEQ ID NO: 1764508 - protein, 17 aa, Staphylococcus epidermidis
TDKDGKLFGRGTTDMKG

SEQ ID NO: 1764509 - protein, 10 aa, Staphylococcus epidermidis
TDKEDNVKPK

SEQ ID NO: 1764510 - protein, 14 aa, Staphylococcus epidermidis
TDKEKAQAHIDAGA

SEQ ID NO: 1764511 - protein, 9 aa, Staphylococcus epidermidis
TDKTSSYSR

SEQ ID NO: 1764512 - protein, 7 aa, Staphylococcus epidermidis
TDLGGAT

SEQ ID NO: 1764513 - protein, 6 aa, Staphylococcus epidermidis
TDLSEN

SEQ ID NO: 1764514 - protein, 5 aa, Staphylococcus epidermidis
TDMDE

SEQ ID NO: 1764515 - protein, 6 aa, Staphylococcus epidermidis
TDNEGV

SEQ ID NO: 1764516 - protein, 9 aa, Staphylococcus epidermidis
TDNELEGYK

SEQ ID NO: 1764517 - protein, 8 aa, Staphylococcus epidermidis
TDNNKKAV

SEQ ID NO: 1764518 - protein, 10 aa, Staphylococcus epidermidis
TDNNKSTDEF

SEQ ID NO: 1764519 - protein, 14 aa, Staphylococcus epidermidis
TDNYEKQEQEVPGI

SEQ ID NO: 1764520 - protein, 11 aa, Staphylococcus epidermidis
TDQDSEIRSQY

SEQ ID NO: 1764521 - protein, 7 aa, Staphylococcus epidermidis
TDQLSRK

SEQ ID NO: 1764522 - protein, 9 aa, Staphylococcus epidermidis
TDQPDPLLG

SEQ ID NO: 1764523 - protein, 12 aa, Staphylococcus epidermidis
TDRTAQSSHDQA

SEQ ID NO: 1764524 - protein, 8 aa, Staphylococcus epidermidis
TDSQATLE

SEQ ID NO: 1764525 - protein, 13 aa, Staphylococcus epidermidis
TDTIADIGTGSGA

SEQ ID NO: 1764526 - protein, 11 aa, Staphylococcus epidermidis
TDTNENSGVGK

SEQ ID NO: 1764527 - protein, 5 aa, Staphylococcus epidermidis
TDVGQ

SEQ ID NO: 1764528 - protein, 5 aa, Staphylococcus epidermidis
TDVSP

SEQ ID NO: 1764529 - protein, 4 aa, Staphylococcus epidermidis
TDYA

SEQ ID NO: 1764530 - protein, 10 aa, Staphylococcus epidermidis
TDYKKAQPII

SEQ ID NO: 1764531 - protein, 4 aa, Staphylococcus epidermidis
TEAF

SEQ ID NO: 1764532 - protein, 5 aa, Staphylococcus epidermidis
TEAFK

SEQ ID NO: 1764533 - protein, 11 aa, Staphylococcus epidermidis
TEANNATDYRD

SEQ ID NO: 1764534 - protein, 5 aa, Staphylococcus epidermidis
TEAQA

SEQ ID NO: 1764535 - protein, 15 aa, Staphylococcus epidermidis
TEASLKEGEVDQLES

SEQ ID NO: 1764536 - protein, 6 aa, Staphylococcus epidermidis
TEDELY

SEQ ID NO: 1764537 - protein, 4 aa, Staphylococcus epidermidis
TEDG

SEQ ID NO: 1764538 - protein, 4 aa, Staphylococcus epidermidis
TEDI

SEQ ID NO: 1764539 - protein, 17 aa, Staphylococcus epidermidis
TEEEVNDAIEKSQQAQL

SEQ ID NO: 1764540 - protein, 10 aa, Staphylococcus epidermidis
TEEIGGGRYP

SEQ ID NO: 1764541 - protein, 4 aa, Staphylococcus epidermidis
TEEK

SEQ ID NO: 1764542 - protein, 6 aa, Staphylococcus epidermidis
TEGIPE

SEQ ID NO: 1764543 - protein, 18 aa, Staphylococcus epidermidis
TEGISTTKIKQELYGKDT

SEQ ID NO: 1764544 - protein, 5 aa, Staphylococcus epidermidis
TEGKD

SEQ ID NO: 1764545 - protein, 8 aa, Staphylococcus epidermidis
TEGYGPNE

SEQ ID NO: 1764546 - protein, 4 aa, Staphylococcus epidermidis
TEIN

SEQ ID NO: 1764547 - protein, 4 aa, Staphylococcus epidermidis
TEKA

SEQ ID NO: 1764548 - protein, 8 aa, Staphylococcus epidermidis
TEKAEEID

SEQ ID NO: 1764549 - protein, 13 aa, Staphylococcus epidermidis
TEKNIKNQKYKNE

SEQ ID NO: 1764550 - protein, 5 aa, Staphylococcus epidermidis
TELDG

SEQ ID NO: 1764551 - protein, 6 aa, Staphylococcus epidermidis
TELGEE

SEQ ID NO: 1764552 - protein, 6 aa, Staphylococcus epidermidis
TEMNGE

SEQ ID NO: 1764553 - protein, 11 aa, Staphylococcus epidermidis
TENDKQRIKSI

SEQ ID NO: 1764554 - protein, 8 aa, Staphylococcus epidermidis
TENYEQLS

SEQ ID NO: 1764555 - protein, 7 aa, Staphylococcus epidermidis
TERDEAE

SEQ ID NO: 1764556 - protein, 8 aa, Staphylococcus epidermidis
TERGKDIQ

SEQ ID NO: 1764557 - protein, 5 aa, Staphylococcus epidermidis
TERQA

SEQ ID NO: 1764558 - protein, 6 aa, Staphylococcus epidermidis
TETARN

SEQ ID NO: 1764559 - protein, 25 aa, Staphylococcus epidermidis
TETEPGIKGDTATGATKSATVETGY

SEQ ID NO: 1764560 - protein, 5 aa, Staphylococcus epidermidis
TETTV

SEQ ID NO: 1764561 - protein, 18 aa, Staphylococcus epidermidis
TFETTKLPQGMKARTRYQ

SEQ ID NO: 1764562 - protein, 8 aa, Staphylococcus epidermidis
TFSTTSLN

SEQ ID NO: 1764563 - protein, 20 aa, Staphylococcus epidermidis
TGAEYKKIGVPGEQELGGRG

SEQ ID NO: 1764564 - protein, 6 aa, Staphylococcus epidermidis
TGAISG

SEQ ID NO: 1764565 - protein, 6 aa, Staphylococcus epidermidis
TGAQPA

SEQ ID NO: 1764566 - protein, 5 aa, Staphylococcus epidermidis
TGDKM

SEQ ID NO: 1764567 - protein, 20 aa, Staphylococcus epidermidis
TGDQTQIDLPKGVKSGLKEA

SEQ ID NO: 1764568 - protein, 7 aa, Staphylococcus epidermidis
TGDTKFD

SEQ ID NO: 1764569 - protein, 9 aa, Staphylococcus epidermidis
TGEDIHPTT

SEQ ID NO: 1764570 - protein, 7 aa, Staphylococcus epidermidis
TGEEHDG

SEQ ID NO: 1764571 - protein, 6 aa, Staphylococcus epidermidis
TGERDG

SEQ ID NO: 1764572 - protein, 6 aa, Staphylococcus epidermidis
TGEYEV

SEQ ID NO: 1764573 - protein, 9 aa, Staphylococcus epidermidis
TGGAGLSAA

SEQ ID NO: 1764574 - protein, 9 aa, Staphylococcus epidermidis
TGGATSTPA

SEQ ID NO: 1764575 - protein, 11 aa, Staphylococcus epidermidis
TGGDQSNSFNI

SEQ ID NO: 1764576 - protein, 5 aa, Staphylococcus epidermidis
TGGLE

SEQ ID NO: 1764577 - protein, 10 aa, Staphylococcus epidermidis
TGGSDWTKQI

SEQ ID NO: 1764578 - protein, 6 aa, Staphylococcus epidermidis
TGGSGM

SEQ ID NO: 1764579 - protein, 10 aa, Staphylococcus epidermidis
TGGTGISQRD

SEQ ID NO: 1764580 - protein, 10 aa, Staphylococcus epidermidis
TGHPYGASGA

SEQ ID NO: 1764581 - protein, 6 aa, Staphylococcus epidermidis
TGIHAR

SEQ ID NO: 1764582 - protein, 9 aa, Staphylococcus epidermidis
TGKSESAVP

SEQ ID NO: 1764583 - protein, 6 aa, Staphylococcus epidermidis
TGKSTA

SEQ ID NO: 1764584 - protein, 8 aa, Staphylococcus epidermidis
TGKTTVGK

SEQ ID NO: 1764585 - protein, 9 aa, Staphylococcus epidermidis
TGLESDDPV

SEQ ID NO: 1764586 - protein, 31 aa, Staphylococcus epidermidis
TGMIGDPSGKSEERVLQTESQVEANVKGLSN

SEQ ID NO: 1764587 - protein, 13 aa, Staphylococcus epidermidis
TGNDSNNNREATD

SEQ ID NO: 1764588 - protein, 23 aa, Staphylococcus epidermidis
TGNDTRGVEASAHAYASKDGHYR

SEQ ID NO: 1764589 - protein, 9 aa, Staphylococcus epidermidis
TGPSKGGDV

SEQ ID NO: 1764590 - protein, 7 aa, Staphylococcus epidermidis
TGRDEEH

SEQ ID NO: 1764591 - protein, 9 aa, Staphylococcus epidermidis
TGRKPNTNH

SEQ ID NO: 1764592 - protein, 10 aa, Staphylococcus epidermidis
TGRQPNTQVA

SEQ ID NO: 1764593 - protein, 5 aa, Staphylococcus epidermidis
TGRWN

SEQ ID NO: 1764594 - protein, 10 aa, Staphylococcus epidermidis
TGSAGALDQT

SEQ ID NO: 1764595 - protein, 8 aa, Staphylococcus epidermidis
TGSSPQSL

SEQ ID NO: 1764596 - protein, 9 aa, Staphylococcus epidermidis
TGSTLTANG

SEQ ID NO: 1764597 - protein, 10 aa, Staphylococcus epidermidis
TGTQSKLSGI

SEQ ID NO: 1764598 - protein, 6 aa, Staphylococcus epidermidis
TGTSEF

SEQ ID NO: 1764599 - protein, 9 aa, Staphylococcus epidermidis
TGVGKTELA

SEQ ID NO: 1764600 - protein, 11 aa, Staphylococcus epidermidis
TGVGKTELAKS

SEQ ID NO: 1764601 - protein, 10 aa, Staphylococcus epidermidis
THAHEPNQET

SEQ ID NO: 1764602 - protein, 12 aa, Staphylococcus epidermidis
THGEGDPPDNAV

SEQ ID NO: 1764603 - protein, 13 aa, Staphylococcus epidermidis
THGKQLKKGDIIS

SEQ ID NO: 1764604 - protein, 8 aa, Staphylococcus epidermidis
THPHYKPS

SEQ ID NO: 1764605 - protein, 5 aa, Staphylococcus epidermidis
THPSD

SEQ ID NO: 1764606 - protein, 12 aa, Staphylococcus epidermidis
THSVGHSERSGA

SEQ ID NO: 1764607 - protein, 6 aa, Staphylococcus epidermidis
THTGQG

SEQ ID NO: 1764608 - protein, 13 aa, Staphylococcus epidermidis
THTSSGRVPSESG

SEQ ID NO: 1764609 - protein, 12 aa, Staphylococcus epidermidis
THTSSNDDGTIS

SEQ ID NO: 1764610 - protein, 5 aa, Staphylococcus epidermidis
THYDD

SEQ ID NO: 1764611 - protein, 4 aa, Staphylococcus epidermidis
THYS

SEQ ID NO: 1764612 - protein, 6 aa, Staphylococcus epidermidis
TIAGTC

SEQ ID NO: 1764613 - protein, 11 aa, Staphylococcus epidermidis
TIDDVSSVSEV

SEQ ID NO: 1764614 - protein, 14 aa, Staphylococcus epidermidis
TIDRTSNGKGKVSD

SEQ ID NO: 1764615 - protein, 12 aa, Staphylococcus epidermidis
TIEETNAPGFEV

SEQ ID NO: 1764616 - protein, 4 aa, Staphylococcus epidermidis
TIER

SEQ ID NO: 1764617 - protein, 11 aa, Staphylococcus epidermidis
TIESNEKFDSM

SEQ ID NO: 1764618 - protein, 12 aa, Staphylococcus epidermidis
TIETDHTSKQGL

SEQ ID NO: 1764619 - protein, 4 aa, Staphylococcus epidermidis
TIKS

SEQ ID NO: 1764620 - protein, 27 aa, Staphylococcus epidermidis
TINEKDGKVGSVTLESTKDGAEQTYDA

SEQ ID NO: 1764621 - protein, 6 aa, Staphylococcus epidermidis
TINPYG

SEQ ID NO: 1764622 - protein, 5 aa, Staphylococcus epidermidis
TIPQS

SEQ ID NO: 1764623 - protein, 6 aa, Staphylococcus epidermidis
TIQTQD

SEQ ID NO: 1764624 - protein, 19 aa, Staphylococcus epidermidis
TISDLGREKVQEMAPASNF

SEQ ID NO: 1764625 - protein, 4 aa, Staphylococcus epidermidis
TITD

SEQ ID NO: 1764626 - protein, 7 aa, Staphylococcus epidermidis
TKAQDII

SEQ ID NO: 1764627 - protein, 5 aa, Staphylococcus epidermidis
TKASI

SEQ ID NO: 1764628 - protein, 8 aa, Staphylococcus epidermidis
TKASNFAP

SEQ ID NO: 1764629 - protein, 8 aa, Staphylococcus epidermidis
TKDEDGEI

SEQ ID NO: 1764630 - protein, 7 aa, Staphylococcus epidermidis
TKDGPKV

SEQ ID NO: 1764631 - protein, 7 aa, Staphylococcus epidermidis
TKDKSYV

SEQ ID NO: 1764632 - protein, 8 aa, Staphylococcus epidermidis
TKDTKDDF

SEQ ID NO: 1764633 - protein, 9 aa, Staphylococcus epidermidis
TKEDASIQG

SEQ ID NO: 1764634 - protein, 11 aa, Staphylococcus epidermidis
TKEGKDGSVDI

SEQ ID NO: 1764635 - protein, 9 aa, Staphylococcus epidermidis
TKEGKLDTE

SEQ ID NO: 1764636 - protein, 10 aa, Staphylococcus epidermidis
TKEKHPNADK

SEQ ID NO: 1764637 - protein, 5 aa, Staphylococcus epidermidis
TKEMG

SEQ ID NO: 1764638 - protein, 6 aa, Staphylococcus epidermidis
TKEQFG

SEQ ID NO: 1764639 - protein, 16 aa, Staphylococcus epidermidis
TKGDRFGYATQSKNTN

SEQ ID NO: 1764640 - protein, 10 aa, Staphylococcus epidermidis
TKGEKEYSPS

SEQ ID NO: 1764641 - protein, 10 aa, Staphylococcus epidermidis
TKGEPGTGNI

SEQ ID NO: 1764642 - protein, 10 aa, Staphylococcus epidermidis
TKGKEIERDG

SEQ ID NO: 1764643 - protein, 26 aa, Staphylococcus epidermidis
TKGQTSPSSAKGFVTKSTPKGNIEKN

SEQ ID NO: 1764644 - protein, 9 aa, Staphylococcus epidermidis
TKGSAKVDK

SEQ ID NO: 1764645 - protein, 4 aa, Staphylococcus epidermidis
TKGT

SEQ ID NO: 1764646 - protein, 9 aa, Staphylococcus epidermidis
TKGYPPSVR

SEQ ID NO: 1764647 - protein, 9 aa, Staphylococcus epidermidis
TKHQNLNQQ

SEQ ID NO: 1764648 - protein, 7 aa, Staphylococcus epidermidis
TKITPQV

SEQ ID NO: 1764649 - protein, 9 aa, Staphylococcus epidermidis
TKKANVGSE

SEQ ID NO: 1764650 - protein, 8 aa, Staphylococcus epidermidis
TKKETSTY

SEQ ID NO: 1764651 - protein, 9 aa, Staphylococcus epidermidis
TKKGEKINP

SEQ ID NO: 1764652 - protein, 6 aa, Staphylococcus epidermidis
TKKGIK

SEQ ID NO: 1764653 - protein, 5 aa, Staphylococcus epidermidis
TKKNK

SEQ ID NO: 1764654 - protein, 10 aa, Staphylococcus epidermidis
TKKYDNPFTP

SEQ ID NO: 1764655 - protein, 12 aa, Staphylococcus epidermidis
TKLSGTAEKPRL

SEQ ID NO: 1764656 - protein, 8 aa, Staphylococcus epidermidis
TKNEKAER

SEQ ID NO: 1764657 - protein, 5 aa, Staphylococcus epidermidis
TKNMN

SEQ ID NO: 1764658 - protein, 6 aa, Staphylococcus epidermidis
TKNNKF

SEQ ID NO: 1764659 - protein, 8 aa, Staphylococcus epidermidis
TKPGVSRT

SEQ ID NO: 1764660 - protein, 6 aa, Staphylococcus epidermidis
TKPKNL

SEQ ID NO: 1764661 - protein, 4 aa, Staphylococcus epidermidis
TKQF

SEQ ID NO: 1764662 - protein, 6 aa, Staphylococcus epidermidis
TKQIAE

SEQ ID NO: 1764663 - protein, 18 aa, Staphylococcus epidermidis
TKRDAETINPKIKTGQVE

SEQ ID NO: 1764664 - protein, 9 aa, Staphylococcus epidermidis
TKRVDNEHT

SEQ ID NO: 1764665 - protein, 12 aa, Staphylococcus epidermidis
TKSGVRREDGSY

SEQ ID NO: 1764666 - protein, 10 aa, Staphylococcus epidermidis
TKSITEEVKQ

SEQ ID NO: 1764667 - protein, 9 aa, Staphylococcus epidermidis
TKSPESNDL

SEQ ID NO: 1764668 - protein, 21 aa, Staphylococcus epidermidis
TKVREKLRNGESLPTKFSRPE

SEQ ID NO: 1764669 - protein, 16 aa, Staphylococcus epidermidis
TKYPYDPSNPEDVRAA

SEQ ID NO: 1764670 - protein, 7 aa, Staphylococcus epidermidis
TKYSESM

SEQ ID NO: 1764671 - protein, 8 aa, Staphylococcus epidermidis
TLDDEDKE

SEQ ID NO: 1764672 - protein, 7 aa, Staphylococcus epidermidis
TLGGQTG

SEQ ID NO: 1764673 - protein, 9 aa, Staphylococcus epidermidis
TLGKTEEDI

SEQ ID NO: 1764674 - protein, 5 aa, Staphylococcus epidermidis
TLKTQ

SEQ ID NO: 1764675 - protein, 14 aa, Staphylococcus epidermidis
TLLGQKGNVPEEPY

SEQ ID NO: 1764676 - protein, 5 aa, Staphylococcus epidermidis
TLPHY

SEQ ID NO: 1764677 - protein, 5 aa, Staphylococcus epidermidis
TLPND

SEQ ID NO: 1764678 - protein, 6 aa, Staphylococcus epidermidis
TLQDRR

SEQ ID NO: 1764679 - protein, 6 aa, Staphylococcus epidermidis
TLRGSK

SEQ ID NO: 1764680 - protein, 7 aa, Staphylococcus epidermidis
TLRRQGQ

SEQ ID NO: 1764681 - protein, 9 aa, Staphylococcus epidermidis
TLSGGEAQR

SEQ ID NO: 1764682 - protein, 9 aa, Staphylococcus epidermidis
TLSGGQRQR

SEQ ID NO: 1764683 - protein, 6 aa, Staphylococcus epidermidis
TLSPYD

SEQ ID NO: 1764684 - protein, 5 aa, Staphylococcus epidermidis
TLSQR

SEQ ID NO: 1764685 - protein, 7 aa, Staphylococcus epidermidis
TLSRSKV

SEQ ID NO: 1764686 - protein, 19 aa, Staphylococcus epidermidis
TLSSGSYVKNSSKDKRERV

SEQ ID NO: 1764687 - protein, 4 aa, Staphylococcus epidermidis
TLTD

SEQ ID NO: 1764688 - protein, 11 aa, Staphylococcus epidermidis
TLTDSEKNTFK

SEQ ID NO: 1764689 - protein, 7 aa, Staphylococcus epidermidis
TLTGSDG

SEQ ID NO: 1764690 - protein, 4 aa, Staphylococcus epidermidis
TLTT

SEQ ID NO: 1764691 - protein, 5 aa, Staphylococcus epidermidis
TLTYG

SEQ ID NO: 1764692 - protein, 5 aa, Staphylococcus epidermidis
TMEEG

SEQ ID NO: 1764693 - protein, 19 aa, Staphylococcus epidermidis
TMEPTRQALKDAGLSTSEI

SEQ ID NO: 1764694 - protein, 8 aa, Staphylococcus epidermidis
TMGGTSLK

SEQ ID NO: 1764695 - protein, 10 aa, Staphylococcus epidermidis
TMIGTDEQEI

SEQ ID NO: 1764696 - protein, 6 aa, Staphylococcus epidermidis
TMPKRE

SEQ ID NO: 1764697 - protein, 13 aa, Staphylococcus epidermidis
TMTKQGQISEEAA

SEQ ID NO: 1764698 - protein, 12 aa, Staphylococcus epidermidis
TMTPKKPNSALR

SEQ ID NO: 1764699 - protein, 12 aa, Staphylococcus epidermidis
TNAKQGQHSPVA

SEQ ID NO: 1764700 - protein, 6 aa, Staphylococcus epidermidis
TNDELT

SEQ ID NO: 1764701 - protein, 5 aa, Staphylococcus epidermidis
TNDNK

SEQ ID NO: 1764702 - protein, 6 aa, Staphylococcus epidermidis
TNDPYE

SEQ ID NO: 1764703 - protein, 27 aa, Staphylococcus epidermidis
TNEAMNKADELTQQRLGKHTQGLNIPG

SEQ ID NO: 1764704 - protein, 7 aa, Staphylococcus epidermidis
TNELANK

SEQ ID NO: 1764705 - protein, 11 aa, Staphylococcus epidermidis
TNESWDPNQTI

SEQ ID NO: 1764706 - protein, 6 aa, Staphylococcus epidermidis
TNGNAI

SEQ ID NO: 1764707 - protein, 7 aa, Staphylococcus epidermidis
TNKDMGQ

SEQ ID NO: 1764708 - protein, 15 aa, Staphylococcus epidermidis
TNKEKENAKINERNR

SEQ ID NO: 1764709 - protein, 9 aa, Staphylococcus epidermidis
TNKERIEAQ

SEQ ID NO: 1764710 - protein, 10 aa, Staphylococcus epidermidis
TNKKEIKEKV

SEQ ID NO: 1764711 - protein, 7 aa, Staphylococcus epidermidis
TNKNVAD

SEQ ID NO: 1764712 - protein, 13 aa, Staphylococcus epidermidis
TNLEKISRKNLNR

SEQ ID NO: 1764713 - protein, 5 aa, Staphylococcus epidermidis
TNLLT

SEQ ID NO: 1764714 - protein, 10 aa, Staphylococcus epidermidis
TNNPNGSYED

SEQ ID NO: 1764715 - protein, 5 aa, Staphylococcus epidermidis
TNQAE

SEQ ID NO: 1764716 - protein, 16 aa, Staphylococcus epidermidis
TNQLNTDNLEKKQRQY

SEQ ID NO: 1764717 - protein, 8 aa, Staphylococcus epidermidis
TNQNQQIQ

SEQ ID NO: 1764718 - protein, 9 aa, Staphylococcus epidermidis
TNQPFDTSK

SEQ ID NO: 1764719 - protein, 10 aa, Staphylococcus epidermidis
TNQSISKGQI

SEQ ID NO: 1764720 - protein, 6 aa, Staphylococcus epidermidis
TNQTGH

SEQ ID NO: 1764721 - protein, 4 aa, Staphylococcus epidermidis
TNRQ

SEQ ID NO: 1764722 - protein, 11 aa, Staphylococcus epidermidis
TNSISTKEEIQ

SEQ ID NO: 1764723 - protein, 8 aa, Staphylococcus epidermidis
TNSRRQGV

SEQ ID NO: 1764724 - protein, 7 aa, Staphylococcus epidermidis
TNTGDIQ

SEQ ID NO: 1764725 - protein, 12 aa, Staphylococcus epidermidis
TNTNPEPVDWFS

SEQ ID NO: 1764726 - protein, 5 aa, Staphylococcus epidermidis
TNWNN

SEQ ID NO: 1764727 - protein, 9 aa, Staphylococcus epidermidis
TPAQNNTEI

SEQ ID NO: 1764728 - protein, 6 aa, Staphylococcus epidermidis
TPARLS

SEQ ID NO: 1764729 - protein, 11 aa, Staphylococcus epidermidis
TPDEEIGRGPH

SEQ ID NO: 1764730 - protein, 4 aa, Staphylococcus epidermidis
TPDR

SEQ ID NO: 1764731 - protein, 5 aa, Staphylococcus epidermidis
TPGFA

SEQ ID NO: 1764732 - protein, 4 aa, Staphylococcus epidermidis
TPGI

SEQ ID NO: 1764733 - protein, 7 aa, Staphylococcus epidermidis
TPGSEEA

SEQ ID NO: 1764734 - protein, 4 aa, Staphylococcus epidermidis
TPGV

SEQ ID NO: 1764735 - protein, 6 aa, Staphylococcus epidermidis
TPGVTG

SEQ ID NO: 1764736 - protein, 5 aa, Staphylococcus epidermidis
TPKLK

SEQ ID NO: 1764737 - protein, 4 aa, Staphylococcus epidermidis
TPLA

SEQ ID NO: 1764738 - protein, 8 aa, Staphylococcus epidermidis
TPLTSSNH

SEQ ID NO: 1764739 - protein, 9 aa, Staphylococcus epidermidis
TPNGETSKD

SEQ ID NO: 1764740 - protein, 6 aa, Staphylococcus epidermidis
TPPGTF

SEQ ID NO: 1764741 - protein, 6 aa, Staphylococcus epidermidis
TPRQKI

SEQ ID NO: 1764742 - protein, 8 aa, Staphylococcus epidermidis
TPSAVGGI

SEQ ID NO: 1764743 - protein, 8 aa, Staphylococcus epidermidis
TPSEKTAR

SEQ ID NO: 1764744 - protein, 9 aa, Staphylococcus epidermidis
TPSKAAHPN

SEQ ID NO: 1764745 - protein, 10 aa, Staphylococcus epidermidis
TPTTNPTSTT

SEQ ID NO: 1764746 - protein, 12 aa, Staphylococcus epidermidis
TQASYRIKGFKK

SEQ ID NO: 1764747 - protein, 9 aa, Staphylococcus epidermidis
TQDELGSTI

SEQ ID NO: 1764748 - protein, 5 aa, Staphylococcus epidermidis
TQDES

SEQ ID NO: 1764749 - protein, 15 aa, Staphylococcus epidermidis
TQDKFAKLGNSQGKY

SEQ ID NO: 1764750 - protein, 6 aa, Staphylococcus epidermidis
TQDQPY

SEQ ID NO: 1764751 - protein, 4 aa, Staphylococcus epidermidis
TQDR

SEQ ID NO: 1764752 - protein, 13 aa, Staphylococcus epidermidis
TQEELAERTDLSK

SEQ ID NO: 1764753 - protein, 8 aa, Staphylococcus epidermidis
TQEETQNL

SEQ ID NO: 1764754 - protein, 6 aa, Staphylococcus epidermidis
TQGPGL

SEQ ID NO: 1764755 - protein, 9 aa, Staphylococcus epidermidis
TQLRQSKHV

SEQ ID NO: 1764756 - protein, 5 aa, Staphylococcus epidermidis
TQPEE

SEQ ID NO: 1764757 - protein, 7 aa, Staphylococcus epidermidis
TQPFTGQ

SEQ ID NO: 1764758 - protein, 6 aa, Staphylococcus epidermidis
TQPKES

SEQ ID NO: 1764759 - protein, 7 aa, Staphylococcus epidermidis
TQQQKAD

SEQ ID NO: 1764760 - protein, 7 aa, Staphylococcus epidermidis
TQREDGK

SEQ ID NO: 1764761 - protein, 5 aa, Staphylococcus epidermidis
TQRPQ

SEQ ID NO: 1764762 - protein, 20 aa, Staphylococcus epidermidis
TQSKDITSKTIQPKDSESVG

SEQ ID NO: 1764763 - protein, 20 aa, Staphylococcus epidermidis
TQSNPQTQVQGQNQQPKQKT

SEQ ID NO: 1764764 - protein, 6 aa, Staphylococcus epidermidis
TQSNVS

SEQ ID NO: 1764765 - protein, 5 aa, Staphylococcus epidermidis
TQSTF

SEQ ID NO: 1764766 - protein, 8 aa, Staphylococcus epidermidis
TQSTNYST

SEQ ID NO: 1764767 - protein, 6 aa, Staphylococcus epidermidis
TQTGET

SEQ ID NO: 1764768 - protein, 11 aa, Staphylococcus epidermidis
TQTKKRKANEI

SEQ ID NO: 1764769 - protein, 7 aa, Staphylococcus epidermidis
TQTQGGV

SEQ ID NO: 1764770 - protein, 4 aa, Staphylococcus epidermidis
TQTS

SEQ ID NO: 1764771 - protein, 35 aa, Staphylococcus epidermidis
TRAMKNGAKGIKTQVSGRLGGADIARAEQYSEGTV

SEQ ID NO: 1764772 - protein, 8 aa, Staphylococcus epidermidis
TRANKTQV

SEQ ID NO: 1764773 - protein, 12 aa, Staphylococcus epidermidis
TRDGTEKTKAAR

SEQ ID NO: 1764774 - protein, 9 aa, Staphylococcus epidermidis
TREEQDERN

SEQ ID NO: 1764775 - protein, 4 aa, Staphylococcus epidermidis
TREL

SEQ ID NO: 1764776 - protein, 4 aa, Staphylococcus epidermidis
TREY

SEQ ID NO: 1764777 - protein, 16 aa, Staphylococcus epidermidis
TRGAAPRNHSFPTPPV

SEQ ID NO: 1764778 - protein, 8 aa, Staphylococcus epidermidis
TRGEKLET

SEQ ID NO: 1764779 - protein, 7 aa, Staphylococcus epidermidis
TRGQTQA

SEQ ID NO: 1764780 - protein, 12 aa, Staphylococcus epidermidis
TRLSPKVKGQLK

SEQ ID NO: 1764781 - protein, 4 aa, Staphylococcus epidermidis
TRNP

SEQ ID NO: 1764782 - protein, 5 aa, Staphylococcus epidermidis
TRNSN

SEQ ID NO: 1764783 - protein, 4 aa, Staphylococcus epidermidis
TRPI

SEQ ID NO: 1764784 - protein, 5 aa, Staphylococcus epidermidis
TRPKR

SEQ ID NO: 1764785 - protein, 5 aa, Staphylococcus epidermidis
TRQDD

SEQ ID NO: 1764786 - protein, 24 aa, Staphylococcus epidermidis
TRQKKQRKRTKTISNAEKIKSYQD

SEQ ID NO: 1764787 - protein, 6 aa, Staphylococcus epidermidis
TRRSTI

SEQ ID NO: 1764788 - protein, 17 aa, Staphylococcus epidermidis
TRSTNIDKTVKYFLRYF

SEQ ID NO: 1764789 - protein, 4 aa, Staphylococcus epidermidis
TRTG

SEQ ID NO: 1764790 - protein, 6 aa, Staphylococcus epidermidis
TRTLPS

SEQ ID NO: 1764791 - protein, 10 aa, Staphylococcus epidermidis
TSAATTAQWQ

SEQ ID NO: 1764792 - protein, 4 aa, Staphylococcus epidermidis
TSAE

SEQ ID NO: 1764793 - protein, 12 aa, Staphylococcus epidermidis
TSALDTHNKKKI

SEQ ID NO: 1764794 - protein, 9 aa, Staphylococcus epidermidis
TSASTGPLN

SEQ ID NO: 1764795 - protein, 8 aa, Staphylococcus epidermidis
TSDGFNNQ

SEQ ID NO: 1764796 - protein, 8 aa, Staphylococcus epidermidis
TSDLPIAE

SEQ ID NO: 1764797 - protein, 11 aa, Staphylococcus epidermidis
TSEAFKQDART

SEQ ID NO: 1764798 - protein, 7 aa, Staphylococcus epidermidis
TSEDGSL

SEQ ID NO: 1764799 - protein, 9 aa, Staphylococcus epidermidis
TSEDHRQQL

SEQ ID NO: 1764800 - protein, 8 aa, Staphylococcus epidermidis
TSEPKKVQ

SEQ ID NO: 1764801 - protein, 5 aa, Staphylococcus epidermidis
TSEVE

SEQ ID NO: 1764802 - protein, 8 aa, Staphylococcus epidermidis
TSGGGGDF

SEQ ID NO: 1764803 - protein, 8 aa, Staphylococcus epidermidis
TSIGGGAK

SEQ ID NO: 1764804 - protein, 11 aa, Staphylococcus epidermidis
TSKGEKDTSMP

SEQ ID NO: 1764805 - protein, 9 aa, Staphylococcus epidermidis
TSKQQMTVT

SEQ ID NO: 1764806 - protein, 8 aa, Staphylococcus epidermidis
TSLKESAL

SEQ ID NO: 1764807 - protein, 4 aa, Staphylococcus epidermidis
TSLN

SEQ ID NO: 1764808 - protein, 5 aa, Staphylococcus epidermidis
TSNGH

SEQ ID NO: 1764809 - protein, 8 aa, Staphylococcus epidermidis
TSPTPDKI

SEQ ID NO: 1764810 - protein, 18 aa, Staphylococcus epidermidis
TSPVQARTMEKRKGQGPV

SEQ ID NO: 1764811 - protein, 8 aa, Staphylococcus epidermidis
TSPYTKSK

SEQ ID NO: 1764812 - protein, 6 aa, Staphylococcus epidermidis
TSQQDF

SEQ ID NO: 1764813 - protein, 22 aa, Staphylococcus epidermidis
TSRPQDNKNFSSNNSSSASNNV

SEQ ID NO: 1764814 - protein, 8 aa, Staphylococcus epidermidis
TSRPSYVS

SEQ ID NO: 1764815 - protein, 5 aa, Staphylococcus epidermidis
TSSNI

SEQ ID NO: 1764816 - protein, 4 aa, Staphylococcus epidermidis
TSSP

SEQ ID NO: 1764817 - protein, 6 aa, Staphylococcus epidermidis
TSSYKK

SEQ ID NO: 1764818 - protein, 10 aa, Staphylococcus epidermidis
TSTGCDGVHP

SEQ ID NO: 1764819 - protein, 5 aa, Staphylococcus epidermidis
TSTHN

SEQ ID NO: 1764820 - protein, 4 aa, Staphylococcus epidermidis
TSTI

SEQ ID NO: 1764821 - protein, 4 aa, Staphylococcus epidermidis
TSTK

SEQ ID NO: 1764822 - protein, 5 aa, Staphylococcus epidermidis
TSVEG

SEQ ID NO: 1764823 - protein, 8 aa, Staphylococcus epidermidis
TSVPTTRN

SEQ ID NO: 1764824 - protein, 11 aa, Staphylococcus epidermidis
TSVSLKRHSDA

SEQ ID NO: 1764825 - protein, 5 aa, Staphylococcus epidermidis
TSYPG

SEQ ID NO: 1764826 - protein, 5 aa, Staphylococcus epidermidis
TSYTF

SEQ ID NO: 1764827 - protein, 5 aa, Staphylococcus epidermidis
TTAQG

SEQ ID NO: 1764828 - protein, 9 aa, Staphylococcus epidermidis
TTAQRTFNE

SEQ ID NO: 1764829 - protein, 13 aa, Staphylococcus epidermidis
TTDEGSVNEIDQN

SEQ ID NO: 1764830 - protein, 6 aa, Staphylococcus epidermidis
TTDGET

SEQ ID NO: 1764831 - protein, 9 aa, Staphylococcus epidermidis
TTDKGPEIY

SEQ ID NO: 1764832 - protein, 8 aa, Staphylococcus epidermidis
TTDTHTKT

SEQ ID NO: 1764833 - protein, 8 aa, Staphylococcus epidermidis
TTEAGDDL

SEQ ID NO: 1764834 - protein, 9 aa, Staphylococcus epidermidis
TTEEAHPGV

SEQ ID NO: 1764835 - protein, 7 aa, Staphylococcus epidermidis
TTELQPE

SEQ ID NO: 1764836 - protein, 8 aa, Staphylococcus epidermidis
TTENAPYT

SEQ ID NO: 1764837 - protein, 11 aa, Staphylococcus epidermidis
TTERHGKNGFG

SEQ ID NO: 1764838 - protein, 10 aa, Staphylococcus epidermidis
TTGEETEQYG

SEQ ID NO: 1764839 - protein, 8 aa, Staphylococcus epidermidis
TTGEKETL

SEQ ID NO: 1764840 - protein, 5 aa, Staphylococcus epidermidis
TTGRE

SEQ ID NO: 1764841 - protein, 10 aa, Staphylococcus epidermidis
TTGRQQMTKT

SEQ ID NO: 1764842 - protein, 8 aa, Staphylococcus epidermidis
TTGYPVDN

SEQ ID NO: 1764843 - protein, 6 aa, Staphylococcus epidermidis
TTHGVY

SEQ ID NO: 1764844 - protein, 6 aa, Staphylococcus epidermidis
TTIEPG

SEQ ID NO: 1764845 - protein, 4 aa, Staphylococcus epidermidis
TTKN

SEQ ID NO: 1764846 - protein, 10 aa, Staphylococcus epidermidis
TTLSGGEAQR

SEQ ID NO: 1764847 - protein, 10 aa, Staphylococcus epidermidis
TTPFKQKTKE

SEQ ID NO: 1764848 - protein, 15 aa, Staphylococcus epidermidis
TTPLGHDSKQEISTE

SEQ ID NO: 1764849 - protein, 13 aa, Staphylococcus epidermidis
TTPLRKVTSPQDV

SEQ ID NO: 1764850 - protein, 6 aa, Staphylococcus epidermidis
TTPRTM

SEQ ID NO: 1764851 - protein, 12 aa, Staphylococcus epidermidis
TTQIEAASSLNE

SEQ ID NO: 1764852 - protein, 7 aa, Staphylococcus epidermidis
TTQQDAR

SEQ ID NO: 1764853 - protein, 9 aa, Staphylococcus epidermidis
TTQYDSSSQ

SEQ ID NO: 1764854 - protein, 9 aa, Staphylococcus epidermidis
TTSASDIAD

SEQ ID NO: 1764855 - protein, 10 aa, Staphylococcus epidermidis
TTSATPDEIE

SEQ ID NO: 1764856 - protein, 10 aa, Staphylococcus epidermidis
TTSGRPSAFP

SEQ ID NO: 1764857 - protein, 10 aa, Staphylococcus epidermidis
TTSGTGSEVT

SEQ ID NO: 1764858 - protein, 8 aa, Staphylococcus epidermidis
TTSLEPSI

SEQ ID NO: 1764859 - protein, 9 aa, Staphylococcus epidermidis
TTSLTNEQD

SEQ ID NO: 1764860 - protein, 8 aa, Staphylococcus epidermidis
TTTGESTL

SEQ ID NO: 1764861 - protein, 8 aa, Staphylococcus epidermidis
TVDNNGEI

SEQ ID NO: 1764862 - protein, 31 aa, Staphylococcus epidermidis
TVESDETNQQQQTELPKKMTKKERQKTIENI

SEQ ID NO: 1764863 - protein, 6 aa, Staphylococcus epidermidis
TVETED

SEQ ID NO: 1764864 - protein, 12 aa, Staphylococcus epidermidis
TVKGPKGELERT

SEQ ID NO: 1764865 - protein, 11 aa, Staphylococcus epidermidis
TVKSNQRGEVD

SEQ ID NO: 1764866 - protein, 4 aa, Staphylococcus epidermidis
TVKT

SEQ ID NO: 1764867 - protein, 6 aa, Staphylococcus epidermidis
TVPEYD

SEQ ID NO: 1764868 - protein, 9 aa, Staphylococcus epidermidis
TVPGPNAGL

SEQ ID NO: 1764869 - protein, 5 aa, Staphylococcus epidermidis
TVQNV

SEQ ID NO: 1764870 - protein, 7 aa, Staphylococcus epidermidis
TVTDGRA

SEQ ID NO: 1764871 - protein, 18 aa, Staphylococcus epidermidis
TWDPSKKHIKESVKGSLK

SEQ ID NO: 1764872 - protein, 8 aa, Staphylococcus epidermidis
TWTNRPGA

SEQ ID NO: 1764873 - protein, 10 aa, Staphylococcus epidermidis
TYGDSSSRFD

SEQ ID NO: 1764874 - protein, 9 aa, Staphylococcus epidermidis
TYGTDAQPG

SEQ ID NO: 1764875 - protein, 4 aa, Staphylococcus epidermidis
TYHQ

SEQ ID NO: 1764876 - protein, 13 aa, Staphylococcus epidermidis
TYNPAHVNAPEVK

SEQ ID NO: 1764877 - protein, 9 aa, Staphylococcus epidermidis
TYQESYTKE

SEQ ID NO: 1764878 - protein, 12 aa, Staphylococcus epidermidis
TYSKSSVKDRYT

SEQ ID NO: 1764879 - protein, 9 aa, Staphylococcus epidermidis
TYSNSTTKI

SEQ ID NO: 1764880 - protein, 9 aa, Staphylococcus epidermidis
TYTETGGEA

SEQ ID NO: 1764881 - protein, 13 aa, Staphylococcus epidermidis
TYTRQQKLKMIQE

SEQ ID NO: 1764882 - protein, 10 aa, Staphylococcus epidermidis
TYTRQTTTAI

SEQ ID NO: 1764883 - protein, 12 aa, Staphylococcus epidermidis
TYTTKSEALKRE

SEQ ID NO: 1764884 - protein, 8 aa, Staphylococcus epidermidis
VAEPAGAL

SEQ ID NO: 1764885 - protein, 9 aa, Staphylococcus epidermidis
VAGSGKSTL

SEQ ID NO: 1764886 - protein, 12 aa, Staphylococcus epidermidis
VAGSNSTSNHPM

SEQ ID NO: 1764887 - protein, 8 aa, Staphylococcus epidermidis
VAKGDEVK

SEQ ID NO: 1764888 - protein, 8 aa, Staphylococcus epidermidis
VAKRNDAQ

SEQ ID NO: 1764889 - protein, 8 aa, Staphylococcus epidermidis
VANKQTLD

SEQ ID NO: 1764890 - protein, 10 aa, Staphylococcus epidermidis
VAPSNDEQGV

SEQ ID NO: 1764891 - protein, 9 aa, Staphylococcus epidermidis
VAQAGAERI

SEQ ID NO: 1764892 - protein, 8 aa, Staphylococcus epidermidis
VAQEVKSD

SEQ ID NO: 1764893 - protein, 9 aa, Staphylococcus epidermidis
VAQRGGNVR

SEQ ID NO: 1764894 - protein, 18 aa, Staphylococcus epidermidis
VCDSQTRKFNEEASAEDG

SEQ ID NO: 1764895 - protein, 12 aa, Staphylococcus epidermidis
VDDEDAAERKVD

SEQ ID NO: 1764896 - protein, 11 aa, Staphylococcus epidermidis
VDDSGESEGIA

SEQ ID NO: 1764897 - protein, 9 aa, Staphylococcus epidermidis
VDDSINKKG

SEQ ID NO: 1764898 - protein, 11 aa, Staphylococcus epidermidis
VDEEPLRSGRK

SEQ ID NO: 1764899 - protein, 15 aa, Staphylococcus epidermidis
VDEGDPAFNSPSKPI

SEQ ID NO: 1764900 - protein, 10 aa, Staphylococcus epidermidis
VDESNAKAEL

SEQ ID NO: 1764901 - protein, 4 aa, Staphylococcus epidermidis
VDEY

SEQ ID NO: 1764902 - protein, 11 aa, Staphylococcus epidermidis
VDGEKTAFPDT

SEQ ID NO: 1764903 - protein, 7 aa, Staphylococcus epidermidis
VDGSAGD

SEQ ID NO: 1764904 - protein, 9 aa, Staphylococcus epidermidis
VDGTGTSLN

SEQ ID NO: 1764905 - protein, 9 aa, Staphylococcus epidermidis
VDKASQSNL

SEQ ID NO: 1764906 - protein, 8 aa, Staphylococcus epidermidis
VDKATENY

SEQ ID NO: 1764907 - protein, 11 aa, Staphylococcus epidermidis
VDKNDINEDTI

SEQ ID NO: 1764908 - protein, 8 aa, Staphylococcus epidermidis
VDKTNDAR

SEQ ID NO: 1764909 - protein, 8 aa, Staphylococcus epidermidis
VDMPKSEN

SEQ ID NO: 1764910 - protein, 10 aa, Staphylococcus epidermidis
VDMTTPQPIE

SEQ ID NO: 1764911 - protein, 14 aa, Staphylococcus epidermidis
VDNESSEATEVNSE

SEQ ID NO: 1764912 - protein, 4 aa, Staphylococcus epidermidis
VDNQ

SEQ ID NO: 1764913 - protein, 8 aa, Staphylococcus epidermidis
VDPAANPY

SEQ ID NO: 1764914 - protein, 6 aa, Staphylococcus epidermidis
VDQSIK

SEQ ID NO: 1764915 - protein, 14 aa, Staphylococcus epidermidis
VDREKAKSKRGKIG

SEQ ID NO: 1764916 - protein, 12 aa, Staphylococcus epidermidis
VDSDEHVQYTQK

SEQ ID NO: 1764917 - protein, 7 aa, Staphylococcus epidermidis
VDSGGKG

SEQ ID NO: 1764918 - protein, 12 aa, Staphylococcus epidermidis
VDSNYGATWYDA

SEQ ID NO: 1764919 - protein, 17 aa, Staphylococcus epidermidis
VDSPQSAEAVANKQGTI

SEQ ID NO: 1764920 - protein, 7 aa, Staphylococcus epidermidis
VDTDEQG

SEQ ID NO: 1764921 - protein, 5 aa, Staphylococcus epidermidis
VDTDL

SEQ ID NO: 1764922 - protein, 12 aa, Staphylococcus epidermidis
VEAKIVKKNQIE

SEQ ID NO: 1764923 - protein, 22 aa, Staphylococcus epidermidis
VEEAANATTKKVVNNTGQVCTA

SEQ ID NO: 1764924 - protein, 8 aa, Staphylococcus epidermidis
VEEAHKHG

SEQ ID NO: 1764925 - protein, 11 aa, Staphylococcus epidermidis
VEEAKNETGAN

SEQ ID NO: 1764926 - protein, 5 aa, Staphylococcus epidermidis
VEESV

SEQ ID NO: 1764927 - protein, 9 aa, Staphylococcus epidermidis
VEGNTPDDL

SEQ ID NO: 1764928 - protein, 7 aa, Staphylococcus epidermidis
VEKGRYE

SEQ ID NO: 1764929 - protein, 5 aa, Staphylococcus epidermidis
VEKRL

SEQ ID NO: 1764930 - protein, 17 aa, Staphylococcus epidermidis
VELNKGRVGAKEGPNAI

SEQ ID NO: 1764931 - protein, 7 aa, Staphylococcus epidermidis
VENESGY

SEQ ID NO: 1764932 - protein, 6 aa, Staphylococcus epidermidis
VENKGN

SEQ ID NO: 1764933 - protein, 10 aa, Staphylococcus epidermidis
VENNELKTNI

SEQ ID NO: 1764934 - protein, 5 aa, Staphylococcus epidermidis
VENSL

SEQ ID NO: 1764935 - protein, 4 aa, Staphylococcus epidermidis
VEPE

SEQ ID NO: 1764936 - protein, 6 aa, Staphylococcus epidermidis
VEPIES

SEQ ID NO: 1764937 - protein, 9 aa, Staphylococcus epidermidis
VEPNPSTHT

SEQ ID NO: 1764938 - protein, 6 aa, Staphylococcus epidermidis
VEPSTE

SEQ ID NO: 1764939 - protein, 9 aa, Staphylococcus epidermidis
VEPTGASSM

SEQ ID NO: 1764940 - protein, 18 aa, Staphylococcus epidermidis
VEQDDGSIDASKAQEINE

SEQ ID NO: 1764941 - protein, 8 aa, Staphylococcus epidermidis
VEQDPASM

SEQ ID NO: 1764942 - protein, 4 aa, Staphylococcus epidermidis
VEQF

SEQ ID NO: 1764943 - protein, 21 aa, Staphylococcus epidermidis
VEQKGKDAANEAQSKAEQEGK

SEQ ID NO: 1764944 - protein, 5 aa, Staphylococcus epidermidis
VERGY

SEQ ID NO: 1764945 - protein, 7 aa, Staphylococcus epidermidis
VERTNTD

SEQ ID NO: 1764946 - protein, 12 aa, Staphylococcus epidermidis
VETADTPSEIGT

SEQ ID NO: 1764947 - protein, 6 aa, Staphylococcus epidermidis
VETERE

SEQ ID NO: 1764948 - protein, 5 aa, Staphylococcus epidermidis
VETGD

SEQ ID NO: 1764949 - protein, 11 aa, Staphylococcus epidermidis
VETQRSNDNIN

SEQ ID NO: 1764950 - protein, 13 aa, Staphylococcus epidermidis
VETTIKNGKYHAF

SEQ ID NO: 1764951 - protein, 9 aa, Staphylococcus epidermidis
VGAAATGLR

SEQ ID NO: 1764952 - protein, 9 aa, Staphylococcus epidermidis
VGDEVQANQ

SEQ ID NO: 1764953 - protein, 11 aa, Staphylococcus epidermidis
VGDPFDENTDY

SEQ ID NO: 1764954 - protein, 11 aa, Staphylococcus epidermidis
VGEKVASGEAD

SEQ ID NO: 1764955 - protein, 9 aa, Staphylococcus epidermidis
VGENGQIKG

SEQ ID NO: 1764956 - protein, 9 aa, Staphylococcus epidermidis
VGENTTVGP

SEQ ID NO: 1764957 - protein, 7 aa, Staphylococcus epidermidis
VGEQIDD

SEQ ID NO: 1764958 - protein, 8 aa, Staphylococcus epidermidis
VGGASGPL

SEQ ID NO: 1764959 - protein, 6 aa, Staphylococcus epidermidis
VGGGTK

SEQ ID NO: 1764960 - protein, 6 aa, Staphylococcus epidermidis
VGKQTE

SEQ ID NO: 1764961 - protein, 12 aa, Staphylococcus epidermidis
VGQTQDDEGNRG

SEQ ID NO: 1764962 - protein, 5 aa, Staphylococcus epidermidis
VGRDI

SEQ ID NO: 1764963 - protein, 10 aa, Staphylococcus epidermidis
VGRKQQSPSG

SEQ ID NO: 1764964 - protein, 7 aa, Staphylococcus epidermidis
VGSHTNA

SEQ ID NO: 1764965 - protein, 8 aa, Staphylococcus epidermidis
VGSSQPVI

SEQ ID NO: 1764966 - protein, 8 aa, Staphylococcus epidermidis
VGSTEQIK

SEQ ID NO: 1764967 - protein, 10 aa, Staphylococcus epidermidis
VGTGVGPTSV

SEQ ID NO: 1764968 - protein, 7 aa, Staphylococcus epidermidis
VGTRSEV

SEQ ID NO: 1764969 - protein, 10 aa, Staphylococcus epidermidis
VGTTSTRTLE

SEQ ID NO: 1764970 - protein, 4 aa, Staphylococcus epidermidis
VGVQ

SEQ ID NO: 1764971 - protein, 4 aa, Staphylococcus epidermidis
VHAQ

SEQ ID NO: 1764972 - protein, 4 aa, Staphylococcus epidermidis
VHQS

SEQ ID NO: 1764973 - protein, 9 aa, Staphylococcus epidermidis
VHRGASQPL

SEQ ID NO: 1764974 - protein, 7 aa, Staphylococcus epidermidis
VISPEGA

SEQ ID NO: 1764975 - protein, 5 aa, Staphylococcus epidermidis
VISYN

SEQ ID NO: 1764976 - protein, 6 aa, Staphylococcus epidermidis
VKATKH

SEQ ID NO: 1764977 - protein, 8 aa, Staphylococcus epidermidis
VKATNEAL

SEQ ID NO: 1764978 - protein, 12 aa, Staphylococcus epidermidis
VKDDKEKTKELS

SEQ ID NO: 1764979 - protein, 12 aa, Staphylococcus epidermidis
VKDGKAKGLKIG

SEQ ID NO: 1764980 - protein, 43 aa, Staphylococcus epidermidis
VKDLGENISDEDKKNAEEKKDALKTALEGEDIDDIKAKKEELE

SEQ ID NO: 1764981 - protein, 7 aa, Staphylococcus epidermidis
VKDSNFK

SEQ ID NO: 1764982 - protein, 9 aa, Staphylococcus epidermidis
VKDTGRDIS

SEQ ID NO: 1764983 - protein, 7 aa, Staphylococcus epidermidis
VKEERPD

SEQ ID NO: 1764984 - protein, 12 aa, Staphylococcus epidermidis
VKEESDKEGLSL

SEQ ID NO: 1764985 - protein, 12 aa, Staphylococcus epidermidis
VKGKNKKSYAQP

SEQ ID NO: 1764986 - protein, 9 aa, Staphylococcus epidermidis
VKHEATPRL

SEQ ID NO: 1764987 - protein, 23 aa, Staphylococcus epidermidis
VKKNSGKYFGPYPNAYSAQETKK

SEQ ID NO: 1764988 - protein, 5 aa, Staphylococcus epidermidis
VKKTG

SEQ ID NO: 1764989 - protein, 7 aa, Staphylococcus epidermidis
VKKVEEA

SEQ ID NO: 1764990 - protein, 9 aa, Staphylococcus epidermidis
VKNKDTLKY

SEQ ID NO: 1764991 - protein, 6 aa, Staphylococcus epidermidis
VKNNEP

SEQ ID NO: 1764992 - protein, 7 aa, Staphylococcus epidermidis
VKNRISS

SEQ ID NO: 1764993 - protein, 8 aa, Staphylococcus epidermidis
VKNTPESW

SEQ ID NO: 1764994 - protein, 6 aa, Staphylococcus epidermidis
VKPEDK

SEQ ID NO: 1764995 - protein, 5 aa, Staphylococcus epidermidis
VKPGE

SEQ ID NO: 1764996 - protein, 7 aa, Staphylococcus epidermidis
VKPGTDA

SEQ ID NO: 1764997 - protein, 11 aa, Staphylococcus epidermidis
VKQESSQQTEC

SEQ ID NO: 1764998 - protein, 14 aa, Staphylococcus epidermidis
VKRDPRTNMRSAQN

SEQ ID NO: 1764999 - protein, 8 aa, Staphylococcus epidermidis
VKSDNQVV

SEQ ID NO: 1765000 - protein, 21 aa, Staphylococcus epidermidis
VKTGKTKKTGTKVTFKPDSEI

SEQ ID NO: 1765001 - protein, 8 aa, Staphylococcus epidermidis
VKTSTKRR

SEQ ID NO: 1765002 - protein, 9 aa, Staphylococcus epidermidis
VKTTNSYGI

SEQ ID NO: 1765003 - protein, 19 aa, Staphylococcus epidermidis
VKVNDGKDLSQDAHAKDLE

SEQ ID NO: 1765004 - protein, 4 aa, Staphylococcus epidermidis
VLDE

SEQ ID NO: 1765005 - protein, 13 aa, Staphylococcus epidermidis
VLDSSEEKEPIYG

SEQ ID NO: 1765006 - protein, 22 aa, Staphylococcus epidermidis
VLSTKAVAGTIKRTHNEQIDNK

SEQ ID NO: 1765007 - protein, 11 aa, Staphylococcus epidermidis
VNDDSKQNEYI

SEQ ID NO: 1765008 - protein, 7 aa, Staphylococcus epidermidis
VNDSRAN

SEQ ID NO: 1765009 - protein, 11 aa, Staphylococcus epidermidis
VNEAGKHYSAE

SEQ ID NO: 1765010 - protein, 10 aa, Staphylococcus epidermidis
VNEARKNNEN

SEQ ID NO: 1765011 - protein, 17 aa, Staphylococcus epidermidis
VNEKRGIKEESPDAPDI

SEQ ID NO: 1765012 - protein, 7 aa, Staphylococcus epidermidis
VNEQGEY

SEQ ID NO: 1765013 - protein, 8 aa, Staphylococcus epidermidis
VNETAAPL

SEQ ID NO: 1765014 - protein, 13 aa, Staphylococcus epidermidis
VNFSSKAQKQLKQ

SEQ ID NO: 1765015 - protein, 8 aa, Staphylococcus epidermidis
VNGGQQSV

SEQ ID NO: 1765016 - protein, 4 aa, Staphylococcus epidermidis
VNGR

SEQ ID NO: 1765017 - protein, 4 aa, Staphylococcus epidermidis
VNHT

SEQ ID NO: 1765018 - protein, 4 aa, Staphylococcus epidermidis
VNIG

SEQ ID NO: 1765019 - protein, 8 aa, Staphylococcus epidermidis
VNNETYQA

SEQ ID NO: 1765020 - protein, 10 aa, Staphylococcus epidermidis
VNNTGSFGSV

SEQ ID NO: 1765021 - protein, 9 aa, Staphylococcus epidermidis
VNQEDTEPL

SEQ ID NO: 1765022 - protein, 4 aa, Staphylococcus epidermidis
VNQG

SEQ ID NO: 1765023 - protein, 5 aa, Staphylococcus epidermidis
VNQGQ

SEQ ID NO: 1765024 - protein, 9 aa, Staphylococcus epidermidis
VNQSTPALT

SEQ ID NO: 1765025 - protein, 7 aa, Staphylococcus epidermidis
VNSDDNS

SEQ ID NO: 1765026 - protein, 4 aa, Staphylococcus epidermidis
VNSG

SEQ ID NO: 1765027 - protein, 9 aa, Staphylococcus epidermidis
VNSKKSHAM

SEQ ID NO: 1765028 - protein, 7 aa, Staphylococcus epidermidis
VNSQDKE

SEQ ID NO: 1765029 - protein, 7 aa, Staphylococcus epidermidis
VNTASKS

SEQ ID NO: 1765030 - protein, 7 aa, Staphylococcus epidermidis
VNYETTD

SEQ ID NO: 1765031 - protein, 8 aa, Staphylococcus epidermidis
VPDDGRGV

SEQ ID NO: 1765032 - protein, 9 aa, Staphylococcus epidermidis
VPDGTGIVK

SEQ ID NO: 1765033 - protein, 9 aa, Staphylococcus epidermidis
VPDQPSFKS

SEQ ID NO: 1765034 - protein, 10 aa, Staphylococcus epidermidis
VPEDVRRERG

SEQ ID NO: 1765035 - protein, 6 aa, Staphylococcus epidermidis
VPEEVA

SEQ ID NO: 1765036 - protein, 11 aa, Staphylococcus epidermidis
VPEGVDNEQQV

SEQ ID NO: 1765037 - protein, 13 aa, Staphylococcus epidermidis
VPENLDPAAASSI

SEQ ID NO: 1765038 - protein, 4 aa, Staphylococcus epidermidis
VPET

SEQ ID NO: 1765039 - protein, 6 aa, Staphylococcus epidermidis
VPGEGY

SEQ ID NO: 1765040 - protein, 6 aa, Staphylococcus epidermidis
VPGPVD

SEQ ID NO: 1765041 - protein, 5 aa, Staphylococcus epidermidis
VPHPR

SEQ ID NO: 1765042 - protein, 4 aa, Staphylococcus epidermidis
VPNC

SEQ ID NO: 1765043 - protein, 11 aa, Staphylococcus epidermidis
VPQLDKNKNHT

SEQ ID NO: 1765044 - protein, 12 aa, Staphylococcus epidermidis
VPSGKSNHEMEG

SEQ ID NO: 1765045 - protein, 5 aa, Staphylococcus epidermidis
VPSKG

SEQ ID NO: 1765046 - protein, 18 aa, Staphylococcus epidermidis
VPTHRKSPFAKRKQLQNQ

SEQ ID NO: 1765047 - protein, 10 aa, Staphylococcus epidermidis
VPTREPGISP

SEQ ID NO: 1765048 - protein, 9 aa, Staphylococcus epidermidis
VPYRSKNKG

SEQ ID NO: 1765049 - protein, 27 aa, Staphylococcus epidermidis
VQFSGTPKNFIDSSETLTSKHLKRYIK

SEQ ID NO: 1765050 - protein, 7 aa, Staphylococcus epidermidis
VQKGSKA

SEQ ID NO: 1765051 - protein, 10 aa, Staphylococcus epidermidis
VQQSQKESGE

SEQ ID NO: 1765052 - protein, 10 aa, Staphylococcus epidermidis
VQSGKTGQEI

SEQ ID NO: 1765053 - protein, 5 aa, Staphylococcus epidermidis
VQSGN

SEQ ID NO: 1765054 - protein, 7 aa, Staphylococcus epidermidis
VQYDTPD

SEQ ID NO: 1765055 - protein, 7 aa, Staphylococcus epidermidis
VQYNDEE

SEQ ID NO: 1765056 - protein, 4 aa, Staphylococcus epidermidis
VRDG

SEQ ID NO: 1765057 - protein, 7 aa, Staphylococcus epidermidis
VRERNPF

SEQ ID NO: 1765058 - protein, 18 aa, Staphylococcus epidermidis
VRGRGGPRCMSQPLIRED

SEQ ID NO: 1765059 - protein, 4 aa, Staphylococcus epidermidis
VRGT

SEQ ID NO: 1765060 - protein, 17 aa, Staphylococcus epidermidis
VRKASGKRLAQENPAKA

SEQ ID NO: 1765061 - protein, 4 aa, Staphylococcus epidermidis
VRNM

SEQ ID NO: 1765062 - protein, 8 aa, Staphylococcus epidermidis
VRQGKMDP

SEQ ID NO: 1765063 - protein, 9 aa, Staphylococcus epidermidis
VRSEKANSH

SEQ ID NO: 1765064 - protein, 9 aa, Staphylococcus epidermidis
VRSNDDVDY

SEQ ID NO: 1765065 - protein, 17 aa, Staphylococcus epidermidis
VSDELTNELERSPSISE

SEQ ID NO: 1765066 - protein, 7 aa, Staphylococcus epidermidis
VSDQRRE

SEQ ID NO: 1765067 - protein, 15 aa, Staphylococcus epidermidis
VSDRENSMTAGQRGP

SEQ ID NO: 1765068 - protein, 16 aa, Staphylococcus epidermidis
VSDRTQAAIYAMENKL

SEQ ID NO: 1765069 - protein, 5 aa, Staphylococcus epidermidis
VSDTV

SEQ ID NO: 1765070 - protein, 10 aa, Staphylococcus epidermidis
VSEAKKDDTY

SEQ ID NO: 1765071 - protein, 7 aa, Staphylococcus epidermidis
VSEEYEE

SEQ ID NO: 1765072 - protein, 8 aa, Staphylococcus epidermidis
VSGKTYTE

SEQ ID NO: 1765073 - protein, 11 aa, Staphylococcus epidermidis
VSGSNEDLDEE

SEQ ID NO: 1765074 - protein, 8 aa, Staphylococcus epidermidis
VSGTGAYS

SEQ ID NO: 1765075 - protein, 8 aa, Staphylococcus epidermidis
VSHNGNEI

SEQ ID NO: 1765076 - protein, 8 aa, Staphylococcus epidermidis
VSKDKQAV

SEQ ID NO: 1765077 - protein, 4 aa, Staphylococcus epidermidis
VSKG

SEQ ID NO: 1765078 - protein, 10 aa, Staphylococcus epidermidis
VSLPNTKYGI

SEQ ID NO: 1765079 - protein, 9 aa, Staphylococcus epidermidis
VSNKNNGLT

SEQ ID NO: 1765080 - protein, 11 aa, Staphylococcus epidermidis
VSNLSGGNKRK

SEQ ID NO: 1765081 - protein, 6 aa, Staphylococcus epidermidis
VSNNDV

SEQ ID NO: 1765082 - protein, 7 aa, Staphylococcus epidermidis
VSNRTIR

SEQ ID NO: 1765083 - protein, 10 aa, Staphylococcus epidermidis
VSNTSDKYGQ

SEQ ID NO: 1765084 - protein, 9 aa, Staphylococcus epidermidis
VSPEKKEEI

SEQ ID NO: 1765085 - protein, 5 aa, Staphylococcus epidermidis
VSPQS

SEQ ID NO: 1765086 - protein, 5 aa, Staphylococcus epidermidis
VSQYP

SEQ ID NO: 1765087 - protein, 8 aa, Staphylococcus epidermidis
VSTENEAK

SEQ ID NO: 1765088 - protein, 9 aa, Staphylococcus epidermidis
VSTHSDGKQ

SEQ ID NO: 1765089 - protein, 14 aa, Staphylococcus epidermidis
VSTRPGHKEVSHKE

SEQ ID NO: 1765090 - protein, 5 aa, Staphylococcus epidermidis
VTAHT

SEQ ID NO: 1765091 - protein, 5 aa, Staphylococcus epidermidis
VTDEA

SEQ ID NO: 1765092 - protein, 7 aa, Staphylococcus epidermidis
VTDRNDV

SEQ ID NO: 1765093 - protein, 11 aa, Staphylococcus epidermidis
VTEARDVEGNF

SEQ ID NO: 1765094 - protein, 4 aa, Staphylococcus epidermidis
VTEE

SEQ ID NO: 1765095 - protein, 10 aa, Staphylococcus epidermidis
VTEGASSNVY

SEQ ID NO: 1765096 - protein, 8 aa, Staphylococcus epidermidis
VTEKPTPI

SEQ ID NO: 1765097 - protein, 6 aa, Staphylococcus epidermidis
VTGGST

SEQ ID NO: 1765098 - protein, 13 aa, Staphylococcus epidermidis
VTGSNGKTTTKDM

SEQ ID NO: 1765099 - protein, 7 aa, Staphylococcus epidermidis
VTHSKEG

SEQ ID NO: 1765100 - protein, 6 aa, Staphylococcus epidermidis
VTINDN

SEQ ID NO: 1765101 - protein, 12 aa, Staphylococcus epidermidis
VTITEENSDDLL

SEQ ID NO: 1765102 - protein, 10 aa, Staphylococcus epidermidis
VTKAPNGQNL

SEQ ID NO: 1765103 - protein, 4 aa, Staphylococcus epidermidis
VTNK

SEQ ID NO: 1765104 - protein, 6 aa, Staphylococcus epidermidis
VTNKQQ

SEQ ID NO: 1765105 - protein, 6 aa, Staphylococcus epidermidis
VTPHRI

SEQ ID NO: 1765106 - protein, 8 aa, Staphylococcus epidermidis
VTPKNYES

SEQ ID NO: 1765107 - protein, 6 aa, Staphylococcus epidermidis
VTPPDG

SEQ ID NO: 1765108 - protein, 9 aa, Staphylococcus epidermidis
VTPTDQPDS

SEQ ID NO: 1765109 - protein, 7 aa, Staphylococcus epidermidis
VTQNNLN

SEQ ID NO: 1765110 - protein, 8 aa, Staphylococcus epidermidis
VTSASAAV

SEQ ID NO: 1765111 - protein, 5 aa, Staphylococcus epidermidis
VTSGY

SEQ ID NO: 1765112 - protein, 6 aa, Staphylococcus epidermidis
VTSQED

SEQ ID NO: 1765113 - protein, 5 aa, Staphylococcus epidermidis
VTSYD

SEQ ID NO: 1765114 - protein, 6 aa, Staphylococcus epidermidis
VTTGQN

SEQ ID NO: 1765115 - protein, 9 aa, Staphylococcus epidermidis
VTTTTCGKE

SEQ ID NO: 1765116 - protein, 10 aa, Staphylococcus epidermidis
VTTVDGPKLS

SEQ ID NO: 1765117 - protein, 5 aa, Staphylococcus epidermidis
VVEKT

SEQ ID NO: 1765118 - protein, 5 aa, Staphylococcus epidermidis
VVNGA

SEQ ID NO: 1765119 - protein, 4 aa, Staphylococcus epidermidis
VVPG

SEQ ID NO: 1765120 - protein, 6 aa, Staphylococcus epidermidis
VYGGTY

SEQ ID NO: 1765121 - protein, 6 aa, Staphylococcus epidermidis
VYKNNK

SEQ ID NO: 1765122 - protein, 9 aa, Staphylococcus epidermidis
VYRNNTGSL

SEQ ID NO: 1765123 - protein, 13 aa, Staphylococcus epidermidis
VYSKEPQGKPPMT

SEQ ID NO: 1765124 - protein, 5 aa, Staphylococcus epidermidis
VYSSP

SEQ ID NO: 1765125 - protein, 13 aa, Staphylococcus epidermidis
WADEDQDTSDLAY

SEQ ID NO: 1765126 - protein, 7 aa, Staphylococcus epidermidis
WAEPEGM

SEQ ID NO: 1765127 - protein, 9 aa, Staphylococcus epidermidis
WEDDKQEKF

SEQ ID NO: 1765128 - protein, 9 aa, Staphylococcus epidermidis
WEDQGQYKG

SEQ ID NO: 1765129 - protein, 8 aa, Staphylococcus epidermidis
WGATPSAL

SEQ ID NO: 1765130 - protein, 20 aa, Staphylococcus epidermidis
WNEDKENEVVERAKSEIKAA

SEQ ID NO: 1765131 - protein, 8 aa, Staphylococcus epidermidis
WNGNQTPQ

SEQ ID NO: 1765132 - protein, 11 aa, Staphylococcus epidermidis
WNNEPLPDKMP

SEQ ID NO: 1765133 - protein, 5 aa, Staphylococcus epidermidis
WNQSY

SEQ ID NO: 1765134 - protein, 9 aa, Staphylococcus epidermidis
WPDTNADDF

SEQ ID NO: 1765135 - protein, 4 aa, Staphylococcus epidermidis
WPTV

SEQ ID NO: 1765136 - protein, 7 aa, Staphylococcus epidermidis
WSAEDEY

SEQ ID NO: 1765137 - protein, 5 aa, Staphylococcus epidermidis
WSPET

SEQ ID NO: 1765138 - protein, 8 aa, Staphylococcus epidermidis
YAANEDSE

SEQ ID NO: 1765139 - protein, 6 aa, Staphylococcus epidermidis
YADGNG

SEQ ID NO: 1765140 - protein, 11 aa, Staphylococcus epidermidis
YADSTDNPEGH

SEQ ID NO: 1765141 - protein, 8 aa, Staphylococcus epidermidis
YAEDPENF

SEQ ID NO: 1765142 - protein, 4 aa, Staphylococcus epidermidis
YAEM

SEQ ID NO: 1765143 - protein, 14 aa, Staphylococcus epidermidis
YAGQSDDVKDTVNY

SEQ ID NO: 1765144 - protein, 10 aa, Staphylococcus epidermidis
YAGSDKESRL

SEQ ID NO: 1765145 - protein, 8 aa, Staphylococcus epidermidis
YAKKGRHT

SEQ ID NO: 1765146 - protein, 10 aa, Staphylococcus epidermidis
YANAKDGLKG

SEQ ID NO: 1765147 - protein, 9 aa, Staphylococcus epidermidis
YANNGYAKK

SEQ ID NO: 1765148 - protein, 6 aa, Staphylococcus epidermidis
YAQKEN

SEQ ID NO: 1765149 - protein, 7 aa, Staphylococcus epidermidis
YCGPGRR

SEQ ID NO: 1765150 - protein, 15 aa, Staphylococcus epidermidis
YDDEQALNQLGENSD

SEQ ID NO: 1765151 - protein, 10 aa, Staphylococcus epidermidis
YDDSSLKHSD

SEQ ID NO: 1765152 - protein, 7 aa, Staphylococcus epidermidis
YDEGYSK

SEQ ID NO: 1765153 - protein, 11 aa, Staphylococcus epidermidis
YDETGRGIYED

SEQ ID NO: 1765154 - protein, 8 aa, Staphylococcus epidermidis
YDETGTDV

SEQ ID NO: 1765155 - protein, 11 aa, Staphylococcus epidermidis
YDEYQQTNGTE

SEQ ID NO: 1765156 - protein, 6 aa, Staphylococcus epidermidis
YDGANK

SEQ ID NO: 1765157 - protein, 14 aa, Staphylococcus epidermidis
YDGYTDSDDQEDEH

SEQ ID NO: 1765158 - protein, 18 aa, Staphylococcus epidermidis
YDKATAPVTETSEEVETI

SEQ ID NO: 1765159 - protein, 8 aa, Staphylococcus epidermidis
YDKDEARH

SEQ ID NO: 1765160 - protein, 9 aa, Staphylococcus epidermidis
YDKNEQNYE

SEQ ID NO: 1765161 - protein, 6 aa, Staphylococcus epidermidis
YDKPGL

SEQ ID NO: 1765162 - protein, 7 aa, Staphylococcus epidermidis
YDKTPAQ

SEQ ID NO: 1765163 - protein, 12 aa, Staphylococcus epidermidis
YDLSRGRITYRY

SEQ ID NO: 1765164 - protein, 5 aa, Staphylococcus epidermidis
YDNNE

SEQ ID NO: 1765165 - protein, 7 aa, Staphylococcus epidermidis
YDNNKAR

SEQ ID NO: 1765166 - protein, 26 aa, Staphylococcus epidermidis
YDNQTGVNEQERKEQQQAQNNQPQFE

SEQ ID NO: 1765167 - protein, 5 aa, Staphylococcus epidermidis
YDQGV

SEQ ID NO: 1765168 - protein, 4 aa, Staphylococcus epidermidis
YDRN

SEQ ID NO: 1765169 - protein, 5 aa, Staphylococcus epidermidis
YDSTE

SEQ ID NO: 1765170 - protein, 6 aa, Staphylococcus epidermidis
YDTSAE

SEQ ID NO: 1765171 - protein, 4 aa, Staphylococcus epidermidis
YEAG

SEQ ID NO: 1765172 - protein, 11 aa, Staphylococcus epidermidis
YEAGERDSNEI

SEQ ID NO: 1765173 - protein, 6 aa, Staphylococcus epidermidis
YEASDE

SEQ ID NO: 1765174 - protein, 10 aa, Staphylococcus epidermidis
YEDHASELNH

SEQ ID NO: 1765175 - protein, 11 aa, Staphylococcus epidermidis
YEENEKPIAPG

SEQ ID NO: 1765176 - protein, 7 aa, Staphylococcus epidermidis
YEEQKEK

SEQ ID NO: 1765177 - protein, 5 aa, Staphylococcus epidermidis
YEFGE

SEQ ID NO: 1765178 - protein, 7 aa, Staphylococcus epidermidis
YEKRPDL

SEQ ID NO: 1765179 - protein, 6 aa, Staphylococcus epidermidis
YENGDN

SEQ ID NO: 1765180 - protein, 23 aa, Staphylococcus epidermidis
YEPKTTSKSEQQFKTIYDNLRNK

SEQ ID NO: 1765181 - protein, 4 aa, Staphylococcus epidermidis
YEPV

SEQ ID NO: 1765182 - protein, 7 aa, Staphylococcus epidermidis
YEQQQPL

SEQ ID NO: 1765183 - protein, 18 aa, Staphylococcus epidermidis
YETISKQKSLRDPIRTET

SEQ ID NO: 1765184 - protein, 5 aa, Staphylococcus epidermidis
YETTN

SEQ ID NO: 1765185 - protein, 5 aa, Staphylococcus epidermidis
YEVSD

SEQ ID NO: 1765186 - protein, 5 aa, Staphylococcus epidermidis
YGDRQ

SEQ ID NO: 1765187 - protein, 34 aa, Staphylococcus epidermidis
YGEELKKQSVQPSGQPVHSRRGGSWMRKLKNTFK

SEQ ID NO: 1765188 - protein, 9 aa, Staphylococcus epidermidis
YGEVNQKGV

SEQ ID NO: 1765189 - protein, 4 aa, Staphylococcus epidermidis
YGGN

SEQ ID NO: 1765190 - protein, 4 aa, Staphylococcus epidermidis
YGGS

SEQ ID NO: 1765191 - protein, 7 aa, Staphylococcus epidermidis
YGKESEE

SEQ ID NO: 1765192 - protein, 6 aa, Staphylococcus epidermidis
YGKKPV

SEQ ID NO: 1765193 - protein, 4 aa, Staphylococcus epidermidis
YGKS

SEQ ID NO: 1765194 - protein, 12 aa, Staphylococcus epidermidis
YGLPASDARNND

SEQ ID NO: 1765195 - protein, 7 aa, Staphylococcus epidermidis
YGNDAGD

SEQ ID NO: 1765196 - protein, 5 aa, Staphylococcus epidermidis
YGNKT

SEQ ID NO: 1765197 - protein, 5 aa, Staphylococcus epidermidis
YGNPT

SEQ ID NO: 1765198 - protein, 4 aa, Staphylococcus epidermidis
YGPG

SEQ ID NO: 1765199 - protein, 10 aa, Staphylococcus epidermidis
YGPPKDRRAG

SEQ ID NO: 1765200 - protein, 7 aa, Staphylococcus epidermidis
YGPSENT

SEQ ID NO: 1765201 - protein, 7 aa, Staphylococcus epidermidis
YGPTEAT

SEQ ID NO: 1765202 - protein, 10 aa, Staphylococcus epidermidis
YGQDTAEQSA

SEQ ID NO: 1765203 - protein, 5 aa, Staphylococcus epidermidis
YGRGM

SEQ ID NO: 1765204 - protein, 5 aa, Staphylococcus epidermidis
YGTPT

SEQ ID NO: 1765205 - protein, 4 aa, Staphylococcus epidermidis
YGTY

SEQ ID NO: 1765206 - protein, 22 aa, Staphylococcus epidermidis
YHADEQVNEAAKEKQRQGEEQL

SEQ ID NO: 1765207 - protein, 6 aa, Staphylococcus epidermidis
YHEEEN

SEQ ID NO: 1765208 - protein, 10 aa, Staphylococcus epidermidis
YHESPSEYTR

SEQ ID NO: 1765209 - protein, 8 aa, Staphylococcus epidermidis
YHSTDGDT

SEQ ID NO: 1765210 - protein, 6 aa, Staphylococcus epidermidis
YIQSGD

SEQ ID NO: 1765211 - protein, 8 aa, Staphylococcus epidermidis
YKAGAEDV

SEQ ID NO: 1765212 - protein, 13 aa, Staphylococcus epidermidis
YKAQGSQGYGGEY

SEQ ID NO: 1765213 - protein, 14 aa, Staphylococcus epidermidis
YKDKSVKKKSRRKK

SEQ ID NO: 1765214 - protein, 12 aa, Staphylococcus epidermidis
YKDQQKVYDGHR

SEQ ID NO: 1765215 - protein, 13 aa, Staphylococcus epidermidis
YKDSNKKAEISKR

SEQ ID NO: 1765216 - protein, 8 aa, Staphylococcus epidermidis
YKEDREGV

SEQ ID NO: 1765217 - protein, 17 aa, Staphylococcus epidermidis
YKESRRAHPLNEQGQRS

SEQ ID NO: 1765218 - protein, 7 aa, Staphylococcus epidermidis
YKGMGKG

SEQ ID NO: 1765219 - protein, 10 aa, Staphylococcus epidermidis
YKGNLKDQEA

SEQ ID NO: 1765220 - protein, 9 aa, Staphylococcus epidermidis
YKKDNFPEA

SEQ ID NO: 1765221 - protein, 8 aa, Staphylococcus epidermidis
YKKEGKSQ

SEQ ID NO: 1765222 - protein, 6 aa, Staphylococcus epidermidis
YKKGGT

SEQ ID NO: 1765223 - protein, 20 aa, Staphylococcus epidermidis
YKKPRDRKKVDQRATQLSKD

SEQ ID NO: 1765224 - protein, 11 aa, Staphylococcus epidermidis
YKNDTDTEKYK

SEQ ID NO: 1765225 - protein, 8 aa, Staphylococcus epidermidis
YKNKPIKQ

SEQ ID NO: 1765226 - protein, 9 aa, Staphylococcus epidermidis
YKNNADRAL

SEQ ID NO: 1765227 - protein, 5 aa, Staphylococcus epidermidis
YKPKE

SEQ ID NO: 1765228 - protein, 7 aa, Staphylococcus epidermidis
YKPQQLD

SEQ ID NO: 1765229 - protein, 9 aa, Staphylococcus epidermidis
YKPTEENKK

SEQ ID NO: 1765230 - protein, 13 aa, Staphylococcus epidermidis
YKQKKKEYHDSTA

SEQ ID NO: 1765231 - protein, 9 aa, Staphylococcus epidermidis
YKQQGTPHR

SEQ ID NO: 1765232 - protein, 9 aa, Staphylococcus epidermidis
YKRSSGVEF

SEQ ID NO: 1765233 - protein, 7 aa, Staphylococcus epidermidis
YKRTRTY

SEQ ID NO: 1765234 - protein, 17 aa, Staphylococcus epidermidis
YKSIEESAFYIEKFLAK

SEQ ID NO: 1765235 - protein, 10 aa, Staphylococcus epidermidis
YKTRIKQSLE

SEQ ID NO: 1765236 - protein, 9 aa, Staphylococcus epidermidis
YKTVDGKKV

SEQ ID NO: 1765237 - protein, 26 aa, Staphylococcus epidermidis
YLGPAREAIKETVKGKIREFGTSNRA

SEQ ID NO: 1765238 - protein, 4 aa, Staphylococcus epidermidis
YLPQ

SEQ ID NO: 1765239 - protein, 5 aa, Staphylococcus epidermidis
YNDNV

SEQ ID NO: 1765240 - protein, 9 aa, Staphylococcus epidermidis
YNEEERSTR

SEQ ID NO: 1765241 - protein, 6 aa, Staphylococcus epidermidis
YNKSDI

SEQ ID NO: 1765242 - protein, 14 aa, Staphylococcus epidermidis
YNLNPESSWQDRAR

SEQ ID NO: 1765243 - protein, 10 aa, Staphylococcus epidermidis
YNNRSKTKGD

SEQ ID NO: 1765244 - protein, 7 aa, Staphylococcus epidermidis
YNQQSEV

SEQ ID NO: 1765245 - protein, 10 aa, Staphylococcus epidermidis
YNRARQAAIT

SEQ ID NO: 1765246 - protein, 10 aa, Staphylococcus epidermidis
YNRPTPEESA

SEQ ID NO: 1765247 - protein, 7 aa, Staphylococcus epidermidis
YNSKDSL

SEQ ID NO: 1765248 - protein, 5 aa, Staphylococcus epidermidis
YPALY

SEQ ID NO: 1765249 - protein, 5 aa, Staphylococcus epidermidis
YPEDR

SEQ ID NO: 1765250 - protein, 4 aa, Staphylococcus epidermidis
YPET

SEQ ID NO: 1765251 - protein, 5 aa, Staphylococcus epidermidis
YPGHG

SEQ ID NO: 1765252 - protein, 8 aa, Staphylococcus epidermidis
YPHPDKPI

SEQ ID NO: 1765253 - protein, 7 aa, Staphylococcus epidermidis
YPINEGK

SEQ ID NO: 1765254 - protein, 4 aa, Staphylococcus epidermidis
YPNK

SEQ ID NO: 1765255 - protein, 12 aa, Staphylococcus epidermidis
YPPQTLTQDEIN

SEQ ID NO: 1765256 - protein, 12 aa, Staphylococcus epidermidis
YPSELSGGQQQR

SEQ ID NO: 1765257 - protein, 13 aa, Staphylococcus epidermidis
YPSPNDDNGYDIS

SEQ ID NO: 1765258 - protein, 11 aa, Staphylococcus epidermidis
YPTVQGDNVQY

SEQ ID NO: 1765259 - protein, 6 aa, Staphylococcus epidermidis
YPYNTE

SEQ ID NO: 1765260 - protein, 6 aa, Staphylococcus epidermidis
YQGYDQ

SEQ ID NO: 1765261 - protein, 8 aa, Staphylococcus epidermidis
YQHTTAAT

SEQ ID NO: 1765262 - protein, 8 aa, Staphylococcus epidermidis
YQKNNQSY

SEQ ID NO: 1765263 - protein, 10 aa, Staphylococcus epidermidis
YQNEDGTLTI

SEQ ID NO: 1765264 - protein, 10 aa, Staphylococcus epidermidis
YQNYSQSQPV

SEQ ID NO: 1765265 - protein, 4 aa, Staphylococcus epidermidis
YQTY

SEQ ID NO: 1765266 - protein, 15 aa, Staphylococcus epidermidis
YQYSESELEDLLETM

SEQ ID NO: 1765267 - protein, 4 aa, Staphylococcus epidermidis
YRAS

SEQ ID NO: 1765268 - protein, 10 aa, Staphylococcus epidermidis
YRDPEDKHKY

SEQ ID NO: 1765269 - protein, 4 aa, Staphylococcus epidermidis
YRGN

SEQ ID NO: 1765270 - protein, 10 aa, Staphylococcus epidermidis
YRQENKVTEN

SEQ ID NO: 1765271 - protein, 7 aa, Staphylococcus epidermidis
YRQKDTK

SEQ ID NO: 1765272 - protein, 6 aa, Staphylococcus epidermidis
YRSTKN

SEQ ID NO: 1765273 - protein, 9 aa, Staphylococcus epidermidis
YSATSDINE

SEQ ID NO: 1765274 - protein, 16 aa, Staphylococcus epidermidis
YSEEEDKWTIIETFTL

SEQ ID NO: 1765275 - protein, 7 aa, Staphylococcus epidermidis
YSFSDDQ

SEQ ID NO: 1765276 - protein, 4 aa, Staphylococcus epidermidis
YSKE

SEQ ID NO: 1765277 - protein, 8 aa, Staphylococcus epidermidis
YSKEKLRT

SEQ ID NO: 1765278 - protein, 12 aa, Staphylococcus epidermidis
YSKSITANKEAI

SEQ ID NO: 1765279 - protein, 13 aa, Staphylococcus epidermidis
YSQHTRSKETIAF

SEQ ID NO: 1765280 - protein, 10 aa, Staphylococcus epidermidis
YSSGPNHQLP

SEQ ID NO: 1765281 - protein, 10 aa, Staphylococcus epidermidis
YSSQKQDLNG

SEQ ID NO: 1765282 - protein, 7 aa, Staphylococcus epidermidis
YSTDEVK

SEQ ID NO: 1765283 - protein, 9 aa, Staphylococcus epidermidis
YSTGGTKRV

SEQ ID NO: 1765284 - protein, 8 aa, Staphylococcus epidermidis
YSTKPEYN

SEQ ID NO: 1765285 - protein, 7 aa, Staphylococcus epidermidis
YSTQPLG

SEQ ID NO: 1765286 - protein, 11 aa, Staphylococcus epidermidis
YTEEERNNNVE

SEQ ID NO: 1765287 - protein, 4 aa, Staphylococcus epidermidis
YTET

SEQ ID NO: 1765288 - protein, 12 aa, Staphylococcus epidermidis
YTEVAKDSGLDV

SEQ ID NO: 1765289 - protein, 5 aa, Staphylococcus epidermidis
YTGSS

SEQ ID NO: 1765290 - protein, 10 aa, Staphylococcus epidermidis
YTPNHSQYVE

SEQ ID NO: 1765291 - protein, 11 aa, Staphylococcus epidermidis
YTQQQDVTNAA

SEQ ID NO: 1765292 - protein, 5 aa, Staphylococcus epidermidis
YTQTP

SEQ ID NO: 1765293 - protein, 6 aa, Staphylococcus epidermidis
YTTPLI

SEQ ID NO: 1765294 - protein, 14 aa, Staphylococcus epidermidis
YVGEDKKNKKPPYK

SEQ ID NO: 1765295 - protein, 8 aa, Staphylococcus epidermidis
YVKTPKDD

SEQ ID NO: 1765296 - protein, 4 aa, Staphylococcus epidermidis
YVNQ

SEQ ID NO: 1765297 - protein, 30 aa, Staphylococcus epidermidis
YYDAENPAFKPKKRPDKDVSLTKREESQIT

SEQ ID NO: 1765298 - protein, 4 aa, Staphylococcus epidermidis
YYDR

SEQ ID NO: 1765299 - protein, 4 aa, Staphylococcus epidermidis
YYEK

SEQ ID NO: 1765300 - protein, 10 aa, Staphylococcus epidermidis
YYGPYKRPQR

SEQ ID NO: 1765301 - protein, 7 aa, Staphylococcus epidermidis
YYPEGEL

SEQ ID NO: 1765302 - protein, 14 aa, Staphylococcus epidermidis
YYQEAGRAGRDGLK

SEQ ID NO: 1765303 - protein, 11 aa, Staphylococcus epidermidis
AAAGKSTIAKR

SEQ ID NO: 1765304 - protein, 10 aa, Staphylococcus epidermidis
AAALSGTTHP

SEQ ID NO: 1765305 - protein, 10 aa, Staphylococcus epidermidis
AAENKKAEDI

SEQ ID NO: 1765306 - protein, 8 aa, Staphylococcus epidermidis
AAKGKDVY

SEQ ID NO: 1765307 - protein, 7 aa, Staphylococcus epidermidis
AASEKNK

SEQ ID NO: 1765308 - protein, 15 aa, Staphylococcus epidermidis
AASPHGTPGDRKLQQ

SEQ ID NO: 1765309 - protein, 8 aa, Staphylococcus epidermidis
AATGIGKS

SEQ ID NO: 1765310 - protein, 7 aa, Staphylococcus epidermidis
ADDGKIS

SEQ ID NO: 1765311 - protein, 7 aa, Staphylococcus epidermidis
ADEAIDS

SEQ ID NO: 1765312 - protein, 7 aa, Staphylococcus epidermidis
ADEEDSY

SEQ ID NO: 1765313 - protein, 5 aa, Staphylococcus epidermidis
ADGDM

SEQ ID NO: 1765314 - protein, 9 aa, Staphylococcus epidermidis
ADKDGGEII

SEQ ID NO: 1765315 - protein, 18 aa, Staphylococcus epidermidis
ADKVTEDASFKDDLGADS

SEQ ID NO: 1765316 - protein, 15 aa, Staphylococcus epidermidis
ADRDESVDDEDERTI

SEQ ID NO: 1765317 - protein, 5 aa, Staphylococcus epidermidis
ADSPY

SEQ ID NO: 1765318 - protein, 9 aa, Staphylococcus epidermidis
ADVKRPGED

SEQ ID NO: 1765319 - protein, 9 aa, Staphylococcus epidermidis
AEERSGSQI

SEQ ID NO: 1765320 - protein, 7 aa, Staphylococcus epidermidis
AEGDVSG

SEQ ID NO: 1765321 - protein, 7 aa, Staphylococcus epidermidis
AEKGEKL

SEQ ID NO: 1765322 - protein, 8 aa, Staphylococcus epidermidis
AENFGKAK

SEQ ID NO: 1765323 - protein, 6 aa, Staphylococcus epidermidis
AENSEQ

SEQ ID NO: 1765324 - protein, 5 aa, Staphylococcus epidermidis
AENYD

SEQ ID NO: 1765325 - protein, 8 aa, Staphylococcus epidermidis
AETPQDIK

SEQ ID NO: 1765326 - protein, 7 aa, Staphylococcus epidermidis
AETSQRI

SEQ ID NO: 1765327 - protein, 6 aa, Staphylococcus epidermidis
AFPDNH

SEQ ID NO: 1765328 - protein, 12 aa, Staphylococcus epidermidis
AFSNGNNVTTGV

SEQ ID NO: 1765329 - protein, 13 aa, Staphylococcus epidermidis
AFTPEDREKVKDK

SEQ ID NO: 1765330 - protein, 21 aa, Staphylococcus epidermidis
AGKDKGKEGKVVATEPKKDRV

SEQ ID NO: 1765331 - protein, 9 aa, Staphylococcus epidermidis
AGKHPGKTI

SEQ ID NO: 1765332 - protein, 10 aa, Staphylococcus epidermidis
AGSASDDVSE

SEQ ID NO: 1765333 - protein, 4 aa, Staphylococcus epidermidis
AGTV

SEQ ID NO: 1765334 - protein, 7 aa, Staphylococcus epidermidis
AGVPSKN

SEQ ID NO: 1765335 - protein, 6 aa, Staphylococcus epidermidis
AGVTDY

SEQ ID NO: 1765336 - protein, 7 aa, Staphylococcus epidermidis
AGYTDKN

SEQ ID NO: 1765337 - protein, 14 aa, Staphylococcus epidermidis
AHKNTGKSEDSPVI

SEQ ID NO: 1765338 - protein, 7 aa, Staphylococcus epidermidis
AHNNESI

SEQ ID NO: 1765339 - protein, 26 aa, Staphylococcus epidermidis
AIEGGARRIEGTVNGIGERAGNASLE

SEQ ID NO: 1765340 - protein, 9 aa, Staphylococcus epidermidis
AIQAKGSKA

SEQ ID NO: 1765341 - protein, 5 aa, Staphylococcus epidermidis
AIQSN

SEQ ID NO: 1765342 - protein, 7 aa, Staphylococcus epidermidis
AISESAL

SEQ ID NO: 1765343 - protein, 6 aa, Staphylococcus epidermidis
AKDDTQ

SEQ ID NO: 1765344 - protein, 7 aa, Staphylococcus epidermidis
AKDKQTY

SEQ ID NO: 1765345 - protein, 7 aa, Staphylococcus epidermidis
AKDPQKH

SEQ ID NO: 1765346 - protein, 11 aa, Staphylococcus epidermidis
AKEQSESYGHS

SEQ ID NO: 1765347 - protein, 17 aa, Staphylococcus epidermidis
AKEVSTSDFADELIKNI

SEQ ID NO: 1765348 - protein, 8 aa, Staphylococcus epidermidis
AKGATHNN

SEQ ID NO: 1765349 - protein, 8 aa, Staphylococcus epidermidis
AKGDENSL

SEQ ID NO: 1765350 - protein, 14 aa, Staphylococcus epidermidis
AKGRSIKDAVKKAK

SEQ ID NO: 1765351 - protein, 20 aa, Staphylococcus epidermidis
AKHQTNVRSATKDQTQTMNR

SEQ ID NO: 1765352 - protein, 8 aa, Staphylococcus epidermidis
AKHSENGI

SEQ ID NO: 1765353 - protein, 7 aa, Staphylococcus epidermidis
AKKDGYI

SEQ ID NO: 1765354 - protein, 18 aa, Staphylococcus epidermidis
AKKGENGQSSNMHGRNAE

SEQ ID NO: 1765355 - protein, 11 aa, Staphylococcus epidermidis
AKKVKSGLQAN

SEQ ID NO: 1765356 - protein, 8 aa, Staphylococcus epidermidis
AKLIDKAK

SEQ ID NO: 1765357 - protein, 10 aa, Staphylococcus epidermidis
AKLNTTSGKL

SEQ ID NO: 1765358 - protein, 4 aa, Staphylococcus epidermidis
AKLQ

SEQ ID NO: 1765359 - protein, 10 aa, Staphylococcus epidermidis
AKNNGYGEQI

SEQ ID NO: 1765360 - protein, 15 aa, Staphylococcus epidermidis
AKNPSILASKNAKDV

SEQ ID NO: 1765361 - protein, 7 aa, Staphylococcus epidermidis
AKPETSC

SEQ ID NO: 1765362 - protein, 8 aa, Staphylococcus epidermidis
AKQNASHY

SEQ ID NO: 1765363 - protein, 7 aa, Staphylococcus epidermidis
AKSTGHA

SEQ ID NO: 1765364 - protein, 7 aa, Staphylococcus epidermidis
AKTNELL

SEQ ID NO: 1765365 - protein, 8 aa, Staphylococcus epidermidis
AKTQHNTG

SEQ ID NO: 1765366 - protein, 11 aa, Staphylococcus epidermidis
AKVTNSVTKST

SEQ ID NO: 1765367 - protein, 7 aa, Staphylococcus epidermidis
ALGGETK

SEQ ID NO: 1765368 - protein, 11 aa, Staphylococcus epidermidis
ALKDQTSSHTL

SEQ ID NO: 1765369 - protein, 13 aa, Staphylococcus epidermidis
ALTDDTRDNIQNE

SEQ ID NO: 1765370 - protein, 15 aa, Staphylococcus epidermidis
ALTPKAEIEGEMGDT

SEQ ID NO: 1765371 - protein, 18 aa, Staphylococcus epidermidis
ANAKSPEQVESFLTEHLD

SEQ ID NO: 1765372 - protein, 4 aa, Staphylococcus epidermidis
ANAQ

SEQ ID NO: 1765373 - protein, 9 aa, Staphylococcus epidermidis
ANDTNYQTN

SEQ ID NO: 1765374 - protein, 6 aa, Staphylococcus epidermidis
ANGEEV

SEQ ID NO: 1765375 - protein, 7 aa, Staphylococcus epidermidis
ANLNDKS

SEQ ID NO: 1765376 - protein, 8 aa, Staphylococcus epidermidis
ANPGSLGP

SEQ ID NO: 1765377 - protein, 23 aa, Staphylococcus epidermidis
APAASKEELAGLEGRNFDNTNNE

SEQ ID NO: 1765378 - protein, 13 aa, Staphylococcus epidermidis
APEPHEKDQDWID

SEQ ID NO: 1765379 - protein, 6 aa, Staphylococcus epidermidis
APIQSD

SEQ ID NO: 1765380 - protein, 7 aa, Staphylococcus epidermidis
APRNNIE

SEQ ID NO: 1765381 - protein, 13 aa, Staphylococcus epidermidis
APSYERGKNPFPK

SEQ ID NO: 1765382 - protein, 16 aa, Staphylococcus epidermidis
APTGRASKRLHESTGL

SEQ ID NO: 1765383 - protein, 5 aa, Staphylococcus epidermidis
AQDIG

SEQ ID NO: 1765384 - protein, 44 aa, Staphylococcus epidermidis
AQHYTGESSLDLENESNQDSSSNSLEKQSNSSNIDNKEAQNNTP

SEQ ID NO: 1765385 - protein, 14 aa, Staphylococcus epidermidis
AQKNNKIKRLESKK

SEQ ID NO: 1765386 - protein, 7 aa, Staphylococcus epidermidis
AQLEEKE

SEQ ID NO: 1765387 - protein, 4 aa, Staphylococcus epidermidis
AQSG

SEQ ID NO: 1765388 - protein, 10 aa, Staphylococcus epidermidis
AQVGTKAYGS

SEQ ID NO: 1765389 - protein, 4 aa, Staphylococcus epidermidis
ARDV

SEQ ID NO: 1765390 - protein, 6 aa, Staphylococcus epidermidis
ARIPEW

SEQ ID NO: 1765391 - protein, 5 aa, Staphylococcus epidermidis
ARISK

SEQ ID NO: 1765392 - protein, 5 aa, Staphylococcus epidermidis
ARPYQ

SEQ ID NO: 1765393 - protein, 4 aa, Staphylococcus epidermidis
ARSE

SEQ ID NO: 1765394 - protein, 8 aa, Staphylococcus epidermidis
ARSINKVK

SEQ ID NO: 1765395 - protein, 5 aa, Staphylococcus epidermidis
ARYRR

SEQ ID NO: 1765396 - protein, 6 aa, Staphylococcus epidermidis
ASAQAQ

SEQ ID NO: 1765397 - protein, 6 aa, Staphylococcus epidermidis
ASEGHS

SEQ ID NO: 1765398 - protein, 16 aa, Staphylococcus epidermidis
ASESDLQGSTGYGYDD

SEQ ID NO: 1765399 - protein, 15 aa, Staphylococcus epidermidis
ASKFANQKSDTEQKL

SEQ ID NO: 1765400 - protein, 6 aa, Staphylococcus epidermidis
ASKSNH

SEQ ID NO: 1765401 - protein, 4 aa, Staphylococcus epidermidis
ASLS

SEQ ID NO: 1765402 - protein, 21 aa, Staphylococcus epidermidis
ASNADRTTTQVKELKDENKID

SEQ ID NO: 1765403 - protein, 7 aa, Staphylococcus epidermidis
ASNQTPC

SEQ ID NO: 1765404 - protein, 8 aa, Staphylococcus epidermidis
ASQETHTP

SEQ ID NO: 1765405 - protein, 4 aa, Staphylococcus epidermidis
ASSG

SEQ ID NO: 1765406 - protein, 4 aa, Staphylococcus epidermidis
ASTD

SEQ ID NO: 1765407 - protein, 5 aa, Staphylococcus epidermidis
ASTNH

SEQ ID NO: 1765408 - protein, 4 aa, Staphylococcus epidermidis
ASTS

SEQ ID NO: 1765409 - protein, 8 aa, Staphylococcus epidermidis
ASVKGDEV

SEQ ID NO: 1765410 - protein, 7 aa, Staphylococcus epidermidis
ASYPPET

SEQ ID NO: 1765411 - protein, 4 aa, Staphylococcus epidermidis
ATAP

SEQ ID NO: 1765412 - protein, 9 aa, Staphylococcus epidermidis
ATAPPQLET

SEQ ID NO: 1765413 - protein, 10 aa, Staphylococcus epidermidis
ATDAPNHGMR

SEQ ID NO: 1765414 - protein, 10 aa, Staphylococcus epidermidis
ATGRKPNVQQ

SEQ ID NO: 1765415 - protein, 18 aa, Staphylococcus epidermidis
ATGTPEEIAQNKGSYTGQ

SEQ ID NO: 1765416 - protein, 9 aa, Staphylococcus epidermidis
ATKAGAPKD

SEQ ID NO: 1765417 - protein, 19 aa, Staphylococcus epidermidis
ATKARLGKLAQSDMQNGTF

SEQ ID NO: 1765418 - protein, 8 aa, Staphylococcus epidermidis
ATKDTLDP

SEQ ID NO: 1765419 - protein, 8 aa, Staphylococcus epidermidis
ATNANQPV

SEQ ID NO: 1765420 - protein, 15 aa, Staphylococcus epidermidis
ATNQSDVNNDVGAAL

SEQ ID NO: 1765421 - protein, 18 aa, Staphylococcus epidermidis
ATPKEMGGQGGNDTNPEQ

SEQ ID NO: 1765422 - protein, 16 aa, Staphylococcus epidermidis
ATQEAVERAKKGEGPT

SEQ ID NO: 1765423 - protein, 6 aa, Staphylococcus epidermidis
ATQSAF

SEQ ID NO: 1765424 - protein, 8 aa, Staphylococcus epidermidis
ATSAVRTV

SEQ ID NO: 1765425 - protein, 14 aa, Staphylococcus epidermidis
ATYGKDPETKGQYW

SEQ ID NO: 1765426 - protein, 36 aa, Staphylococcus epidermidis
AVEATPGNLKQLEQQNKRAEADRQQEIDDAKALKEQ

SEQ ID NO: 1765427 - protein, 8 aa, Staphylococcus epidermidis
AVKRGASD

SEQ ID NO: 1765428 - protein, 5 aa, Staphylococcus epidermidis
AVTGV

SEQ ID NO: 1765429 - protein, 9 aa, Staphylococcus epidermidis
AYAEGNDGL

SEQ ID NO: 1765430 - protein, 19 aa, Staphylococcus epidermidis
AYDPKKDEFKEVTQEDFKG

SEQ ID NO: 1765431 - protein, 11 aa, Staphylococcus epidermidis
AYEDAKSDTHF

SEQ ID NO: 1765432 - protein, 22 aa, Staphylococcus epidermidis
AYEYTRPKIEKSVRNDLKETYE

SEQ ID NO: 1765433 - protein, 8 aa, Staphylococcus epidermidis
AYKKNSEI

SEQ ID NO: 1765434 - protein, 5 aa, Staphylococcus epidermidis
AYPNH

SEQ ID NO: 1765435 - protein, 11 aa, Staphylococcus epidermidis
CGDDGHTNYAG

SEQ ID NO: 1765436 - protein, 5 aa, Staphylococcus epidermidis
CGSSF

SEQ ID NO: 1765437 - protein, 4 aa, Staphylococcus epidermidis
CNND

SEQ ID NO: 1765438 - protein, 10 aa, Staphylococcus epidermidis
CRKYDSDKSV

SEQ ID NO: 1765439 - protein, 8 aa, Staphylococcus epidermidis
CTSKENME

SEQ ID NO: 1765440 - protein, 4 aa, Staphylococcus epidermidis
CTSQ

SEQ ID NO: 1765441 - protein, 4 aa, Staphylococcus epidermidis
DADG

SEQ ID NO: 1765442 - protein, 6 aa, Staphylococcus epidermidis
DADKNC

SEQ ID NO: 1765443 - protein, 10 aa, Staphylococcus epidermidis
DADKPSSPCG

SEQ ID NO: 1765444 - protein, 9 aa, Staphylococcus epidermidis
DAHNAAEKH

SEQ ID NO: 1765445 - protein, 7 aa, Staphylococcus epidermidis
DAIPSTI

SEQ ID NO: 1765446 - protein, 5 aa, Staphylococcus epidermidis
DAKEN

SEQ ID NO: 1765447 - protein, 8 aa, Staphylococcus epidermidis
DAKKIAKK

SEQ ID NO: 1765448 - protein, 7 aa, Staphylococcus epidermidis
DAKPTGV

SEQ ID NO: 1765449 - protein, 9 aa, Staphylococcus epidermidis
DARTGTKEF

SEQ ID NO: 1765450 - protein, 8 aa, Staphylococcus epidermidis
DASSFTQG

SEQ ID NO: 1765451 - protein, 18 aa, Staphylococcus epidermidis
DATASAIQLSKDNKSYIN

SEQ ID NO: 1765452 - protein, 8 aa, Staphylococcus epidermidis
DDDQLNQG

SEQ ID NO: 1765453 - protein, 6 aa, Staphylococcus epidermidis
DDELAD

SEQ ID NO: 1765454 - protein, 5 aa, Staphylococcus epidermidis
DDGGA

SEQ ID NO: 1765455 - protein, 4 aa, Staphylococcus epidermidis
DDII

SEQ ID NO: 1765456 - protein, 23 aa, Staphylococcus epidermidis
DDITEYTNEEDGAAHYLKSHLLD

SEQ ID NO: 1765457 - protein, 8 aa, Staphylococcus epidermidis
DDLDTPIE

SEQ ID NO: 1765458 - protein, 10 aa, Staphylococcus epidermidis
DDNAKLSARQ

SEQ ID NO: 1765459 - protein, 4 aa, Staphylococcus epidermidis
DDSF

SEQ ID NO: 1765460 - protein, 7 aa, Staphylococcus epidermidis
DDTNNYE

SEQ ID NO: 1765461 - protein, 9 aa, Staphylococcus epidermidis
DEALQAKTK

SEQ ID NO: 1765462 - protein, 11 aa, Staphylococcus epidermidis
DEASKNNRLGA

SEQ ID NO: 1765463 - protein, 6 aa, Staphylococcus epidermidis
DEDFSH

SEQ ID NO: 1765464 - protein, 6 aa, Staphylococcus epidermidis
DEDTRI

SEQ ID NO: 1765465 - protein, 9 aa, Staphylococcus epidermidis
DEGSEKASH

SEQ ID NO: 1765466 - protein, 18 aa, Staphylococcus epidermidis
DEKKSLVKDEATKKANDK

SEQ ID NO: 1765467 - protein, 7 aa, Staphylococcus epidermidis
DENGEME

SEQ ID NO: 1765468 - protein, 7 aa, Staphylococcus epidermidis
DENSNEI

SEQ ID NO: 1765469 - protein, 12 aa, Staphylococcus epidermidis
DENSNSRKQSHF

SEQ ID NO: 1765470 - protein, 10 aa, Staphylococcus epidermidis
DENTNPEDFH

SEQ ID NO: 1765471 - protein, 7 aa, Staphylococcus epidermidis
DENYKGE

SEQ ID NO: 1765472 - protein, 24 aa, Staphylococcus epidermidis
DEQSEIREAISNGAKYVTTSYEKL

SEQ ID NO: 1765473 - protein, 8 aa, Staphylococcus epidermidis
DERQPING

SEQ ID NO: 1765474 - protein, 7 aa, Staphylococcus epidermidis
DESAIPD

SEQ ID NO: 1765475 - protein, 9 aa, Staphylococcus epidermidis
DESGLKEEE

SEQ ID NO: 1765476 - protein, 11 aa, Staphylococcus epidermidis
DETDDSDAIER

SEQ ID NO: 1765477 - protein, 5 aa, Staphylococcus epidermidis
DETIT

SEQ ID NO: 1765478 - protein, 11 aa, Staphylococcus epidermidis
DETKNDPDKVL

SEQ ID NO: 1765479 - protein, 9 aa, Staphylococcus epidermidis
DFNNEGEEK

SEQ ID NO: 1765480 - protein, 12 aa, Staphylococcus epidermidis
DFSENAEDAGVQ

SEQ ID NO: 1765481 - protein, 9 aa, Staphylococcus epidermidis
DFSKISKQL

SEQ ID NO: 1765482 - protein, 11 aa, Staphylococcus epidermidis
DGAPMSPTEIQ

SEQ ID NO: 1765483 - protein, 13 aa, Staphylococcus epidermidis
DGENVQDGQVGTI

SEQ ID NO: 1765484 - protein, 13 aa, Staphylococcus epidermidis
DGFKEKKESLPSD

SEQ ID NO: 1765485 - protein, 9 aa, Staphylococcus epidermidis
DGGEGTTEV

SEQ ID NO: 1765486 - protein, 8 aa, Staphylococcus epidermidis
DGKSLTKE

SEQ ID NO: 1765487 - protein, 6 aa, Staphylococcus epidermidis
DGPDAV

SEQ ID NO: 1765488 - protein, 15 aa, Staphylococcus epidermidis
DGSVDATVKKVRCND

SEQ ID NO: 1765489 - protein, 13 aa, Staphylococcus epidermidis
DGSYSDEMKGVYY

SEQ ID NO: 1765490 - protein, 14 aa, Staphylococcus epidermidis
DHARGKVLGGSSSI

SEQ ID NO: 1765491 - protein, 44 aa, Staphylococcus epidermidis
DIEKRPENKKAHNKKENLEQQLDANQQKINEAKNLKQEHGNELP

SEQ ID NO: 1765492 - protein, 5 aa, Staphylococcus epidermidis
DIENY

SEQ ID NO: 1765493 - protein, 13 aa, Staphylococcus epidermidis
DIKPDDTKEQLED

SEQ ID NO: 1765494 - protein, 8 aa, Staphylococcus epidermidis
DIKSEIKS

SEQ ID NO: 1765495 - protein, 16 aa, Staphylococcus epidermidis
DIPEDTGSFLIIHQGE

SEQ ID NO: 1765496 - protein, 6 aa, Staphylococcus epidermidis
DIQSYE

SEQ ID NO: 1765497 - protein, 10 aa, Staphylococcus epidermidis
DKAHNDKTAI

SEQ ID NO: 1765498 - protein, 14 aa, Staphylococcus epidermidis
DKAKTLNKENGQSF

SEQ ID NO: 1765499 - protein, 17 aa, Staphylococcus epidermidis
DKDNYKHVKTPSPSKDN

SEQ ID NO: 1765500 - protein, 5 aa, Staphylococcus epidermidis
DKESV

SEQ ID NO: 1765501 - protein, 7 aa, Staphylococcus epidermidis
DKGSKFE

SEQ ID NO: 1765502 - protein, 6 aa, Staphylococcus epidermidis
DKGYYQ

SEQ ID NO: 1765503 - protein, 8 aa, Staphylococcus epidermidis
DKHQHGEE

SEQ ID NO: 1765504 - protein, 20 aa, Staphylococcus epidermidis
DKINEYTGGEDNKDKKDKKD

SEQ ID NO: 1765505 - protein, 10 aa, Staphylococcus epidermidis
DKISLNSSAL

SEQ ID NO: 1765506 - protein, 7 aa, Staphylococcus epidermidis
DKITADE

SEQ ID NO: 1765507 - protein, 13 aa, Staphylococcus epidermidis
DKITTHDNPTYTK

SEQ ID NO: 1765508 - protein, 18 aa, Staphylococcus epidermidis
DKKYAKTLKHSGGIGTVA

SEQ ID NO: 1765509 - protein, 8 aa, Staphylococcus epidermidis
DKQGKKSG

SEQ ID NO: 1765510 - protein, 19 aa, Staphylococcus epidermidis
DKQLEEAANRLTQLRYLYE

SEQ ID NO: 1765511 - protein, 7 aa, Staphylococcus epidermidis
DKSSEWY

SEQ ID NO: 1765512 - protein, 7 aa, Staphylococcus epidermidis
DKTDDEL

SEQ ID NO: 1765513 - protein, 6 aa, Staphylococcus epidermidis
DKVDDY

SEQ ID NO: 1765514 - protein, 5 aa, Staphylococcus epidermidis
DKVNR

SEQ ID NO: 1765515 - protein, 6 aa, Staphylococcus epidermidis
DKVPDI

SEQ ID NO: 1765516 - protein, 9 aa, Staphylococcus epidermidis
DKVRTEGKS

SEQ ID NO: 1765517 - protein, 7 aa, Staphylococcus epidermidis
DKVTNES

SEQ ID NO: 1765518 - protein, 14 aa, Staphylococcus epidermidis
DKYNGCSDDDVSEH

SEQ ID NO: 1765519 - protein, 8 aa, Staphylococcus epidermidis
DLANGKAD

SEQ ID NO: 1765520 - protein, 4 aa, Staphylococcus epidermidis
DLGK

SEQ ID NO: 1765521 - protein, 5 aa, Staphylococcus epidermidis
DLKPP

SEQ ID NO: 1765522 - protein, 11 aa, Staphylococcus epidermidis
DLNRAEDRKEF

SEQ ID NO: 1765523 - protein, 6 aa, Staphylococcus epidermidis
DLPAST

SEQ ID NO: 1765524 - protein, 5 aa, Staphylococcus epidermidis
DLPKS

SEQ ID NO: 1765525 - protein, 14 aa, Staphylococcus epidermidis
DLQDTEIKGKDSED

SEQ ID NO: 1765526 - protein, 5 aa, Staphylococcus epidermidis
DLSNL

SEQ ID NO: 1765527 - protein, 7 aa, Staphylococcus epidermidis
DNEQRQI

SEQ ID NO: 1765528 - protein, 8 aa, Staphylococcus epidermidis
DNEVVTST

SEQ ID NO: 1765529 - protein, 5 aa, Staphylococcus epidermidis
DNHSY

SEQ ID NO: 1765530 - protein, 13 aa, Staphylococcus epidermidis
DNIPDNKSAEFAK

SEQ ID NO: 1765531 - protein, 6 aa, Staphylococcus epidermidis
DNKASL

SEQ ID NO: 1765532 - protein, 9 aa, Staphylococcus epidermidis
DNKEISPYT

SEQ ID NO: 1765533 - protein, 7 aa, Staphylococcus epidermidis
DNKKNDI

SEQ ID NO: 1765534 - protein, 14 aa, Staphylococcus epidermidis
DNPNQMEKLIRQLL

SEQ ID NO: 1765535 - protein, 4 aa, Staphylococcus epidermidis
DNYE

SEQ ID NO: 1765536 - protein, 4 aa, Staphylococcus epidermidis
DPDF

SEQ ID NO: 1765537 - protein, 13 aa, Staphylococcus epidermidis
DPDKNGSSKFTQY

SEQ ID NO: 1765538 - protein, 4 aa, Staphylococcus epidermidis
DPEF

SEQ ID NO: 1765539 - protein, 8 aa, Staphylococcus epidermidis
DPNQQKSF

SEQ ID NO: 1765540 - protein, 5 aa, Staphylococcus epidermidis
DPQSL

SEQ ID NO: 1765541 - protein, 8 aa, Staphylococcus epidermidis
DPSTIPSA

SEQ ID NO: 1765542 - protein, 20 aa, Staphylococcus epidermidis
DPVEKVDKENKIVTTSKGIE

SEQ ID NO: 1765543 - protein, 15 aa, Staphylococcus epidermidis
DPYTNYGRPDTKYEK

SEQ ID NO: 1765544 - protein, 10 aa, Staphylococcus epidermidis
DQANTAVSHG

SEQ ID NO: 1765545 - protein, 10 aa, Staphylococcus epidermidis
DQASNYGGSV

SEQ ID NO: 1765546 - protein, 6 aa, Staphylococcus epidermidis
DQGKLD

SEQ ID NO: 1765547 - protein, 4 aa, Staphylococcus epidermidis
DQHP

SEQ ID NO: 1765548 - protein, 10 aa, Staphylococcus epidermidis
DQQKYQSQLK

SEQ ID NO: 1765549 - protein, 9 aa, Staphylococcus epidermidis
DQSASGQTL

SEQ ID NO: 1765550 - protein, 22 aa, Staphylococcus epidermidis
DRDALKNQLNEVNKYSSKIYTT

SEQ ID NO: 1765551 - protein, 7 aa, Staphylococcus epidermidis
DRDKEHH

SEQ ID NO: 1765552 - protein, 7 aa, Staphylococcus epidermidis
DRSTVTG

SEQ ID NO: 1765553 - protein, 6 aa, Staphylococcus epidermidis
DSADAD

SEQ ID NO: 1765554 - protein, 6 aa, Staphylococcus epidermidis
DSDGEL

SEQ ID NO: 1765555 - protein, 6 aa, Staphylococcus epidermidis
DSGCTV

SEQ ID NO: 1765556 - protein, 10 aa, Staphylococcus epidermidis
DSGITDDLSY

SEQ ID NO: 1765557 - protein, 16 aa, Staphylococcus epidermidis
DSGLPTEALTGENEGY

SEQ ID NO: 1765558 - protein, 11 aa, Staphylococcus epidermidis
DSIDTSCAQEE

SEQ ID NO: 1765559 - protein, 16 aa, Staphylococcus epidermidis
DSKKVSPKNRARLNQN

SEQ ID NO: 1765560 - protein, 5 aa, Staphylococcus epidermidis
DSLSE

SEQ ID NO: 1765561 - protein, 9 aa, Staphylococcus epidermidis
DSNNDDSYR

SEQ ID NO: 1765562 - protein, 6 aa, Staphylococcus epidermidis
DSPYSI

SEQ ID NO: 1765563 - protein, 5 aa, Staphylococcus epidermidis
DSTGA

SEQ ID NO: 1765564 - protein, 7 aa, Staphylococcus epidermidis
DSTQLKA

SEQ ID NO: 1765565 - protein, 8 aa, Staphylococcus epidermidis
DSYKAQGV

SEQ ID NO: 1765566 - protein, 6 aa, Staphylococcus epidermidis
DTHEDA

SEQ ID NO: 1765567 - protein, 7 aa, Staphylococcus epidermidis
DTPANLN

SEQ ID NO: 1765568 - protein, 9 aa, Staphylococcus epidermidis
DTPGVTRDR

SEQ ID NO: 1765569 - protein, 7 aa, Staphylococcus epidermidis
DTPSETA

SEQ ID NO: 1765570 - protein, 8 aa, Staphylococcus epidermidis
DTQTEYGQ

SEQ ID NO: 1765571 - protein, 14 aa, Staphylococcus epidermidis
DTRDEGYSTSGTSF

SEQ ID NO: 1765572 - protein, 13 aa, Staphylococcus epidermidis
DTSETKDFADRED

SEQ ID NO: 1765573 - protein, 6 aa, Staphylococcus epidermidis
DTVGDR

SEQ ID NO: 1765574 - protein, 5 aa, Staphylococcus epidermidis
DTYET

SEQ ID NO: 1765575 - protein, 4 aa, Staphylococcus epidermidis
DVKD

SEQ ID NO: 1765576 - protein, 18 aa, Staphylococcus epidermidis
DVRRTPKAEGMTGAQQEA

SEQ ID NO: 1765577 - protein, 9 aa, Staphylococcus epidermidis
DYKGRKNKL

SEQ ID NO: 1765578 - protein, 5 aa, Staphylococcus epidermidis
DYQKQ

SEQ ID NO: 1765579 - protein, 6 aa, Staphylococcus epidermidis
DYSNSM

SEQ ID NO: 1765580 - protein, 14 aa, Staphylococcus epidermidis
EADGGTYKEGDITP

SEQ ID NO: 1765581 - protein, 8 aa, Staphylococcus epidermidis
EADKVTQY

SEQ ID NO: 1765582 - protein, 5 aa, Staphylococcus epidermidis
EAGAD

SEQ ID NO: 1765583 - protein, 16 aa, Staphylococcus epidermidis
EAIEETEINPVAQPEV

SEQ ID NO: 1765584 - protein, 5 aa, Staphylococcus epidermidis
EAIQH

SEQ ID NO: 1765585 - protein, 19 aa, Staphylococcus epidermidis
EANGVTPNDAEEWVGEENG

SEQ ID NO: 1765586 - protein, 36 aa, Staphylococcus epidermidis
EANGYDYASDTTSNEDTSHVPTQTVDTSAIGEGLNP

SEQ ID NO: 1765587 - protein, 4 aa, Staphylococcus epidermidis
EANY

SEQ ID NO: 1765588 - protein, 17 aa, Staphylococcus epidermidis
EASSENSDLTGSEQEAN

SEQ ID NO: 1765589 - protein, 18 aa, Staphylococcus epidermidis
EATQNAKVEARVNKEDRR

SEQ ID NO: 1765590 - protein, 7 aa, Staphylococcus epidermidis
EDAGIQP

SEQ ID NO: 1765591 - protein, 4 aa, Staphylococcus epidermidis
EDAP

SEQ ID NO: 1765592 - protein, 4 aa, Staphylococcus epidermidis
EDAS

SEQ ID NO: 1765593 - protein, 7 aa, Staphylococcus epidermidis
EDDKSKK

SEQ ID NO: 1765594 - protein, 5 aa, Staphylococcus epidermidis
EDELN

SEQ ID NO: 1765595 - protein, 6 aa, Staphylococcus epidermidis
EDENAD

SEQ ID NO: 1765596 - protein, 7 aa, Staphylococcus epidermidis
EDERPFA

SEQ ID NO: 1765597 - protein, 9 aa, Staphylococcus epidermidis
EDISDEDYD

SEQ ID NO: 1765598 - protein, 25 aa, Staphylococcus epidermidis
EDNAQVTLTSQGATKIYKTPNDHVE

SEQ ID NO: 1765599 - protein, 7 aa, Staphylococcus epidermidis
EDNQKKL

SEQ ID NO: 1765600 - protein, 7 aa, Staphylococcus epidermidis
EDRVSPK

SEQ ID NO: 1765601 - protein, 6 aa, Staphylococcus epidermidis
EDSNIQ

SEQ ID NO: 1765602 - protein, 4 aa, Staphylococcus epidermidis
EDTN

SEQ ID NO: 1765603 - protein, 6 aa, Staphylococcus epidermidis
EEAGAN

SEQ ID NO: 1765604 - protein, 11 aa, Staphylococcus epidermidis
EEAKNKITKEL

SEQ ID NO: 1765605 - protein, 11 aa, Staphylococcus epidermidis
EEANRIQQEKG

SEQ ID NO: 1765606 - protein, 9 aa, Staphylococcus epidermidis
EEDDPLYAQ

SEQ ID NO: 1765607 - protein, 55 aa, Staphylococcus epidermidis
EEDFNVETEDNQNDTNIENSVSNTDNSEANASDSENNSEESIKDEESESQDTKIK

SEQ ID NO: 1765608 - protein, 52 aa, Staphylococcus epidermidis
EEGEAIDKDEDDLASEKVKEDNEHEKETQEVKDTSQQSSDNKDNSPKSAARE

SEQ ID NO: 1765609 - protein, 6 aa, Staphylococcus epidermidis
EEIEAR

SEQ ID NO: 1765610 - protein, 5 aa, Staphylococcus epidermidis
EEIEN

SEQ ID NO: 1765611 - protein, 15 aa, Staphylococcus epidermidis
EEKEYNTSKNDYSNI

SEQ ID NO: 1765612 - protein, 19 aa, Staphylococcus epidermidis
EEKKEKNEKEQQDNNNCCN

SEQ ID NO: 1765613 - protein, 23 aa, Staphylococcus epidermidis
EEKVEHQGDETPMGRRGQPAELA

SEQ ID NO: 1765614 - protein, 57 aa, Staphylococcus epidermidis
EELSNEKEKQSSLKSRVEQEKEKIAKVQEKRAELDSSRQALEDAQTEGNLEKAAELQ

SEQ ID NO: 1765615 - protein, 11 aa, Staphylococcus epidermidis
EEMPPGGAKGM

SEQ ID NO: 1765616 - protein, 5 aa, Staphylococcus epidermidis
EEQSI

SEQ ID NO: 1765617 - protein, 4 aa, Staphylococcus epidermidis
EEVA

SEQ ID NO: 1765618 - protein, 7 aa, Staphylococcus epidermidis
EEVPEEE

SEQ ID NO: 1765619 - protein, 5 aa, Staphylococcus epidermidis
EEYDE

SEQ ID NO: 1765620 - protein, 5 aa, Staphylococcus epidermidis
EEYGN

SEQ ID NO: 1765621 - protein, 7 aa, Staphylococcus epidermidis
EFEQQDS

SEQ ID NO: 1765622 - protein, 7 aa, Staphylococcus epidermidis
EFGSDTV

SEQ ID NO: 1765623 - protein, 9 aa, Staphylococcus epidermidis
EFPTRHNEE

SEQ ID NO: 1765624 - protein, 6 aa, Staphylococcus epidermidis
EFTSKY

SEQ ID NO: 1765625 - protein, 7 aa, Staphylococcus epidermidis
EGAGAQV

SEQ ID NO: 1765626 - protein, 6 aa, Staphylococcus epidermidis
EGDAKI

SEQ ID NO: 1765627 - protein, 28 aa, Staphylococcus epidermidis
EGESEITHNATGDKGGSKYQLKGVGQRE

SEQ ID NO: 1765628 - protein, 6 aa, Staphylococcus epidermidis
EGEVIS

SEQ ID NO: 1765629 - protein, 7 aa, Staphylococcus epidermidis
EGFESTR

SEQ ID NO: 1765630 - protein, 8 aa, Staphylococcus epidermidis
EGGLSDSE

SEQ ID NO: 1765631 - protein, 17 aa, Staphylococcus epidermidis
EGKGQFKPVGDASPYIG

SEQ ID NO: 1765632 - protein, 14 aa, Staphylococcus epidermidis
EGRGYSKSSHHIER

SEQ ID NO: 1765633 - protein, 6 aa, Staphylococcus epidermidis
EHEDEA

SEQ ID NO: 1765634 - protein, 8 aa, Staphylococcus epidermidis
EHNPEAKT

SEQ ID NO: 1765635 - protein, 12 aa, Staphylococcus epidermidis
EHPGYSEQDPNE

SEQ ID NO: 1765636 - protein, 16 aa, Staphylococcus epidermidis
EHTEEKFSDPTTREET

SEQ ID NO: 1765637 - protein, 7 aa, Staphylococcus epidermidis
EIAESDH

SEQ ID NO: 1765638 - protein, 11 aa, Staphylococcus epidermidis
EIEVPGDKSMT

SEQ ID NO: 1765639 - protein, 8 aa, Staphylococcus epidermidis
EIGNAQDV

SEQ ID NO: 1765640 - protein, 12 aa, Staphylococcus epidermidis
EIHQSKEYTGIS

SEQ ID NO: 1765641 - protein, 7 aa, Staphylococcus epidermidis
EIKTTDV

SEQ ID NO: 1765642 - protein, 5 aa, Staphylococcus epidermidis
EIPDA

SEQ ID NO: 1765643 - protein, 12 aa, Staphylococcus epidermidis
EIPNPKAIRSTM

SEQ ID NO: 1765644 - protein, 9 aa, Staphylococcus epidermidis
EIPTPNEVS

SEQ ID NO: 1765645 - protein, 10 aa, Staphylococcus epidermidis
EISDTRVHST

SEQ ID NO: 1765646 - protein, 8 aa, Staphylococcus epidermidis
EKAGINYE

SEQ ID NO: 1765647 - protein, 7 aa, Staphylococcus epidermidis
EKALGSA

SEQ ID NO: 1765648 - protein, 13 aa, Staphylococcus epidermidis
EKDANDSERAIKE

SEQ ID NO: 1765649 - protein, 7 aa, Staphylococcus epidermidis
EKDSDLE

SEQ ID NO: 1765650 - protein, 7 aa, Staphylococcus epidermidis
EKEPQSY

SEQ ID NO: 1765651 - protein, 11 aa, Staphylococcus epidermidis
EKFKSTPHQDI

SEQ ID NO: 1765652 - protein, 5 aa, Staphylococcus epidermidis
EKGFR

SEQ ID NO: 1765653 - protein, 14 aa, Staphylococcus epidermidis
EKGQLHRLMSADID

SEQ ID NO: 1765654 - protein, 7 aa, Staphylococcus epidermidis
EKGSGSI

SEQ ID NO: 1765655 - protein, 6 aa, Staphylococcus epidermidis
EKGSTF

SEQ ID NO: 1765656 - protein, 5 aa, Staphylococcus epidermidis
EKIEH

SEQ ID NO: 1765657 - protein, 6 aa, Staphylococcus epidermidis
EKIGNV

SEQ ID NO: 1765658 - protein, 6 aa, Staphylococcus epidermidis
EKKCPT

SEQ ID NO: 1765659 - protein, 9 aa, Staphylococcus epidermidis
EKKDSRIPM

SEQ ID NO: 1765660 - protein, 16 aa, Staphylococcus epidermidis
EKLLTEAQDALSTPSN

SEQ ID NO: 1765661 - protein, 8 aa, Staphylococcus epidermidis
EKLQESIP

SEQ ID NO: 1765662 - protein, 9 aa, Staphylococcus epidermidis
EKNIPRNEI

SEQ ID NO: 1765663 - protein, 10 aa, Staphylococcus epidermidis
EKPDSNTDQR

SEQ ID NO: 1765664 - protein, 6 aa, Staphylococcus epidermidis
EKPIET

SEQ ID NO: 1765665 - protein, 6 aa, Staphylococcus epidermidis
EKRNHQ

SEQ ID NO: 1765666 - protein, 10 aa, Staphylococcus epidermidis
EKYGKDEAKK

SEQ ID NO: 1765667 - protein, 5 aa, Staphylococcus epidermidis
ELDAN

SEQ ID NO: 1765668 - protein, 20 aa, Staphylococcus epidermidis
ELEAEREAQIARGEMPRYGG

SEQ ID NO: 1765669 - protein, 6 aa, Staphylococcus epidermidis
ELEQSN

SEQ ID NO: 1765670 - protein, 6 aa, Staphylococcus epidermidis
ELHGSL

SEQ ID NO: 1765671 - protein, 6 aa, Staphylococcus epidermidis
ELKNRK

SEQ ID NO: 1765672 - protein, 6 aa, Staphylococcus epidermidis
ELNEDD

SEQ ID NO: 1765673 - protein, 7 aa, Staphylococcus epidermidis
ELPAPEN

SEQ ID NO: 1765674 - protein, 10 aa, Staphylococcus epidermidis
ELQELGSKGQ

SEQ ID NO: 1765675 - protein, 14 aa, Staphylococcus epidermidis
ELRDGDKSRYLGKG

SEQ ID NO: 1765676 - protein, 12 aa, Staphylococcus epidermidis
ELSDEEYETTEK

SEQ ID NO: 1765677 - protein, 7 aa, Staphylococcus epidermidis
ELSEEDQ

SEQ ID NO: 1765678 - protein, 6 aa, Staphylococcus epidermidis
ELSPSF

SEQ ID NO: 1765679 - protein, 9 aa, Staphylococcus epidermidis
ELTKEGKDW

SEQ ID NO: 1765680 - protein, 5 aa, Staphylococcus epidermidis
ELTNR

SEQ ID NO: 1765681 - protein, 9 aa, Staphylococcus epidermidis
ELTTPTGAA

SEQ ID NO: 1765682 - protein, 11 aa, Staphylococcus epidermidis
EMSDKGKKYRS

SEQ ID NO: 1765683 - protein, 6 aa, Staphylococcus epidermidis
ENDLPK

SEQ ID NO: 1765684 - protein, 7 aa, Staphylococcus epidermidis
ENDTTAF

SEQ ID NO: 1765685 - protein, 17 aa, Staphylococcus epidermidis
ENESKLSNIAKTEEGRV

SEQ ID NO: 1765686 - protein, 22 aa, Staphylococcus epidermidis
ENEYTQKNENYNEHNQEETNDI

SEQ ID NO: 1765687 - protein, 5 aa, Staphylococcus epidermidis
ENGKL

SEQ ID NO: 1765688 - protein, 5 aa, Staphylococcus epidermidis
ENGSI

SEQ ID NO: 1765689 - protein, 8 aa, Staphylococcus epidermidis
ENHSEGGS

SEQ ID NO: 1765690 - protein, 7 aa, Staphylococcus epidermidis
ENITTPR

SEQ ID NO: 1765691 - protein, 13 aa, Staphylococcus epidermidis
ENKEAQKIFEVEK

SEQ ID NO: 1765692 - protein, 14 aa, Staphylococcus epidermidis
ENKGKVSLTMVAPN

SEQ ID NO: 1765693 - protein, 25 aa, Staphylococcus epidermidis
ENKLTLDRTDSGTLPSNVDGTTRST

SEQ ID NO: 1765694 - protein, 10 aa, Staphylococcus epidermidis
ENPFDKYSKT

SEQ ID NO: 1765695 - protein, 9 aa, Staphylococcus epidermidis
ENPYDKQGG

SEQ ID NO: 1765696 - protein, 14 aa, Staphylococcus epidermidis
ENQNHAKGSARSIE

SEQ ID NO: 1765697 - protein, 5 aa, Staphylococcus epidermidis
ENQPN

SEQ ID NO: 1765698 - protein, 6 aa, Staphylococcus epidermidis
ENQSNL

SEQ ID NO: 1765699 - protein, 4 aa, Staphylococcus epidermidis
ENQV

SEQ ID NO: 1765700 - protein, 4 aa, Staphylococcus epidermidis
ENRV

SEQ ID NO: 1765701 - protein, 6 aa, Staphylococcus epidermidis
ENTERP

SEQ ID NO: 1765702 - protein, 10 aa, Staphylococcus epidermidis
ENTFKGQHTS

SEQ ID NO: 1765703 - protein, 11 aa, Staphylococcus epidermidis
ENVDSVQPNPE

SEQ ID NO: 1765704 - protein, 12 aa, Staphylococcus epidermidis
ENVGDPSEKKVT

SEQ ID NO: 1765705 - protein, 9 aa, Staphylococcus epidermidis
ENYDSGRIS

SEQ ID NO: 1765706 - protein, 5 aa, Staphylococcus epidermidis
EPEGA

SEQ ID NO: 1765707 - protein, 14 aa, Staphylococcus epidermidis
EPEYPSSSNCKQQI

SEQ ID NO: 1765708 - protein, 5 aa, Staphylococcus epidermidis
EPGER

SEQ ID NO: 1765709 - protein, 6 aa, Staphylococcus epidermidis
EPKPQH

SEQ ID NO: 1765710 - protein, 6 aa, Staphylococcus epidermidis
EPKYNS

SEQ ID NO: 1765711 - protein, 5 aa, Staphylococcus epidermidis
EPLDA

SEQ ID NO: 1765712 - protein, 9 aa, Staphylococcus epidermidis
EPQVKEGSV

SEQ ID NO: 1765713 - protein, 4 aa, Staphylococcus epidermidis
EQGA

SEQ ID NO: 1765714 - protein, 18 aa, Staphylococcus epidermidis
EQGATHAAEGYARVSGKT

SEQ ID NO: 1765715 - protein, 15 aa, Staphylococcus epidermidis
EQGIELSNTQKEQFQ

SEQ ID NO: 1765716 - protein, 21 aa, Staphylococcus epidermidis
EQPTWNPNDFSPSIYQSDDRL

SEQ ID NO: 1765717 - protein, 8 aa, Staphylococcus epidermidis
EQRGNPIY

SEQ ID NO: 1765718 - protein, 6 aa, Staphylococcus epidermidis
EQSDQN

SEQ ID NO: 1765719 - protein, 6 aa, Staphylococcus epidermidis
EQSGVS

SEQ ID NO: 1765720 - protein, 11 aa, Staphylococcus epidermidis
EQSIESRSRLE

SEQ ID NO: 1765721 - protein, 8 aa, Staphylococcus epidermidis
EQSKLQDE

SEQ ID NO: 1765722 - protein, 20 aa, Staphylococcus epidermidis
EQTNANDVISDDLGKSIETI

SEQ ID NO: 1765723 - protein, 9 aa, Staphylococcus epidermidis
EQTNPTIAP

SEQ ID NO: 1765724 - protein, 7 aa, Staphylococcus epidermidis
EQTTTQE

SEQ ID NO: 1765725 - protein, 4 aa, Staphylococcus epidermidis
ERAP

SEQ ID NO: 1765726 - protein, 4 aa, Staphylococcus epidermidis
ERDR

SEQ ID NO: 1765727 - protein, 7 aa, Staphylococcus epidermidis
ERDSQKG

SEQ ID NO: 1765728 - protein, 8 aa, Staphylococcus epidermidis
ERKKDVKL

SEQ ID NO: 1765729 - protein, 4 aa, Staphylococcus epidermidis
ERLI

SEQ ID NO: 1765730 - protein, 6 aa, Staphylococcus epidermidis
ERNSER

SEQ ID NO: 1765731 - protein, 4 aa, Staphylococcus epidermidis
ERQT

SEQ ID NO: 1765732 - protein, 4 aa, Staphylococcus epidermidis
ERRS

SEQ ID NO: 1765733 - protein, 19 aa, Staphylococcus epidermidis
ERRTTQLQKELNEISHSLK

SEQ ID NO: 1765734 - protein, 5 aa, Staphylococcus epidermidis
ESANK

SEQ ID NO: 1765735 - protein, 19 aa, Staphylococcus epidermidis
ESDFNKPINDFSGGQKTRL

SEQ ID NO: 1765736 - protein, 4 aa, Staphylococcus epidermidis
ESEG

SEQ ID NO: 1765737 - protein, 7 aa, Staphylococcus epidermidis
ESEGKSI

SEQ ID NO: 1765738 - protein, 6 aa, Staphylococcus epidermidis
ESFTRA

SEQ ID NO: 1765739 - protein, 6 aa, Staphylococcus epidermidis
ESGETI

SEQ ID NO: 1765740 - protein, 8 aa, Staphylococcus epidermidis
ESGKLTQG

SEQ ID NO: 1765741 - protein, 17 aa, Staphylococcus epidermidis
ESHANPLSLSEGPAEIE

SEQ ID NO: 1765742 - protein, 4 aa, Staphylococcus epidermidis
ESKG

SEQ ID NO: 1765743 - protein, 8 aa, Staphylococcus epidermidis
ESKINQGT

SEQ ID NO: 1765744 - protein, 14 aa, Staphylococcus epidermidis
ESKSGGKSGDFHRK

SEQ ID NO: 1765745 - protein, 6 aa, Staphylococcus epidermidis
ESNATE

SEQ ID NO: 1765746 - protein, 8 aa, Staphylococcus epidermidis
ESQSKETM

SEQ ID NO: 1765747 - protein, 11 aa, Staphylococcus epidermidis
ESQSNSTLPYQ

SEQ ID NO: 1765748 - protein, 8 aa, Staphylococcus epidermidis
ESTNTSYA

SEQ ID NO: 1765749 - protein, 4 aa, Staphylococcus epidermidis
ESVY

SEQ ID NO: 1765750 - protein, 4 aa, Staphylococcus epidermidis
ETAS

SEQ ID NO: 1765751 - protein, 5 aa, Staphylococcus epidermidis
ETESD

SEQ ID NO: 1765752 - protein, 6 aa, Staphylococcus epidermidis
ETESWI

SEQ ID NO: 1765753 - protein, 5 aa, Staphylococcus epidermidis
ETKSL

SEQ ID NO: 1765754 - protein, 19 aa, Staphylococcus epidermidis
ETLYSEDEKKDKSSKKKDK

SEQ ID NO: 1765755 - protein, 7 aa, Staphylococcus epidermidis
ETNHNND

SEQ ID NO: 1765756 - protein, 10 aa, Staphylococcus epidermidis
ETNHPRASNQ

SEQ ID NO: 1765757 - protein, 5 aa, Staphylococcus epidermidis
ETPDG

SEQ ID NO: 1765758 - protein, 7 aa, Staphylococcus epidermidis
ETPSENL

SEQ ID NO: 1765759 - protein, 11 aa, Staphylococcus epidermidis
ETSEVRGKKVR

SEQ ID NO: 1765760 - protein, 4 aa, Staphylococcus epidermidis
ETSG

SEQ ID NO: 1765761 - protein, 6 aa, Staphylococcus epidermidis
ETTGLP

SEQ ID NO: 1765762 - protein, 10 aa, Staphylococcus epidermidis
ETVGDGAEIN

SEQ ID NO: 1765763 - protein, 4 aa, Staphylococcus epidermidis
EVEE

SEQ ID NO: 1765764 - protein, 12 aa, Staphylococcus epidermidis
EVGDKGNEETTD

SEQ ID NO: 1765765 - protein, 8 aa, Staphylococcus epidermidis
EVNQSKGY

SEQ ID NO: 1765766 - protein, 6 aa, Staphylococcus epidermidis
EVPEPV

SEQ ID NO: 1765767 - protein, 5 aa, Staphylococcus epidermidis
EVSIE

SEQ ID NO: 1765768 - protein, 19 aa, Staphylococcus epidermidis
EVTLDNNSNGIPYALKELL

SEQ ID NO: 1765769 - protein, 5 aa, Staphylococcus epidermidis
EWPPQ

SEQ ID NO: 1765770 - protein, 7 aa, Staphylococcus epidermidis
EYAENEK

SEQ ID NO: 1765771 - protein, 16 aa, Staphylococcus epidermidis
EYERTENRQSQRNGYY

SEQ ID NO: 1765772 - protein, 9 aa, Staphylococcus epidermidis
EYGGEGATI

SEQ ID NO: 1765773 - protein, 7 aa, Staphylococcus epidermidis
EYPDSGD

SEQ ID NO: 1765774 - protein, 20 aa, Staphylococcus epidermidis
EYRNDISEEEIEATGAGDQG

SEQ ID NO: 1765775 - protein, 15 aa, Staphylococcus epidermidis
FAPENSKKGKATITG

SEQ ID NO: 1765776 - protein, 21 aa, Staphylococcus epidermidis
FATTDKSKGALKQLADNEGYE

SEQ ID NO: 1765777 - protein, 26 aa, Staphylococcus epidermidis
FDSNDSRAGRWSNSSKTECGLHVADK

SEQ ID NO: 1765778 - protein, 16 aa, Staphylococcus epidermidis
FEAGDLPVPDGKKFAP

SEQ ID NO: 1765779 - protein, 8 aa, Staphylococcus epidermidis
FEENETSK

SEQ ID NO: 1765780 - protein, 6 aa, Staphylococcus epidermidis
FEERGE

SEQ ID NO: 1765781 - protein, 8 aa, Staphylococcus epidermidis
FEKRTDNK

SEQ ID NO: 1765782 - protein, 4 aa, Staphylococcus epidermidis
FEPG

SEQ ID NO: 1765783 - protein, 5 aa, Staphylococcus epidermidis
FESDN

SEQ ID NO: 1765784 - protein, 7 aa, Staphylococcus epidermidis
FGAPHET

SEQ ID NO: 1765785 - protein, 10 aa, Staphylococcus epidermidis
FGGESRSEVE

SEQ ID NO: 1765786 - protein, 17 aa, Staphylococcus epidermidis
FGPNEDFDAYPRQLDDD

SEQ ID NO: 1765787 - protein, 4 aa, Staphylococcus epidermidis
FGSK

SEQ ID NO: 1765788 - protein, 9 aa, Staphylococcus epidermidis
FGSPKLPHL

SEQ ID NO: 1765789 - protein, 6 aa, Staphylococcus epidermidis
FKAKNN

SEQ ID NO: 1765790 - protein, 6 aa, Staphylococcus epidermidis
FKEGLS

SEQ ID NO: 1765791 - protein, 9 aa, Staphylococcus epidermidis
FKEPSDEKV

SEQ ID NO: 1765792 - protein, 11 aa, Staphylococcus epidermidis
FKESMSAKEAA

SEQ ID NO: 1765793 - protein, 4 aa, Staphylococcus epidermidis
FKGK

SEQ ID NO: 1765794 - protein, 9 aa, Staphylococcus epidermidis
FKKEHERQA

SEQ ID NO: 1765795 - protein, 4 aa, Staphylococcus epidermidis
FKKS

SEQ ID NO: 1765796 - protein, 9 aa, Staphylococcus epidermidis
FKNSDGPRH

SEQ ID NO: 1765797 - protein, 11 aa, Staphylococcus epidermidis
FKPEMDEDQRH

SEQ ID NO: 1765798 - protein, 4 aa, Staphylococcus epidermidis
FKYG

SEQ ID NO: 1765799 - protein, 17 aa, Staphylococcus epidermidis
FNGKGKQRYTFLDTYFK

SEQ ID NO: 1765800 - protein, 18 aa, Staphylococcus epidermidis
FPAEARSEAFDRDKAKQL

SEQ ID NO: 1765801 - protein, 11 aa, Staphylococcus epidermidis
FPGESEDEFQE

SEQ ID NO: 1765802 - protein, 9 aa, Staphylococcus epidermidis
FPGQYGDKV

SEQ ID NO: 1765803 - protein, 5 aa, Staphylococcus epidermidis
FPKPT

SEQ ID NO: 1765804 - protein, 12 aa, Staphylococcus epidermidis
FPKYGNNDSRVD

SEQ ID NO: 1765805 - protein, 5 aa, Staphylococcus epidermidis
FPNKQ

SEQ ID NO: 1765806 - protein, 11 aa, Staphylococcus epidermidis
FRKSPKNKGEL

SEQ ID NO: 1765807 - protein, 7 aa, Staphylococcus epidermidis
FRTNTEY

SEQ ID NO: 1765808 - protein, 10 aa, Staphylococcus epidermidis
FSDEDGIRAA

SEQ ID NO: 1765809 - protein, 7 aa, Staphylococcus epidermidis
FSDEHKG

SEQ ID NO: 1765810 - protein, 11 aa, Staphylococcus epidermidis
FSRTGKKGGPF

SEQ ID NO: 1765811 - protein, 12 aa, Staphylococcus epidermidis
FSSLDDKTKNEG

SEQ ID NO: 1765812 - protein, 10 aa, Staphylococcus epidermidis
FSTNGTKADI

SEQ ID NO: 1765813 - protein, 10 aa, Staphylococcus epidermidis
FTGQKGSYVP

SEQ ID NO: 1765814 - protein, 4 aa, Staphylococcus epidermidis
FTPA

SEQ ID NO: 1765815 - protein, 9 aa, Staphylococcus epidermidis
GAAPEDGPM

SEQ ID NO: 1765816 - protein, 6 aa, Staphylococcus epidermidis
GAGAAG

SEQ ID NO: 1765817 - protein, 6 aa, Staphylococcus epidermidis
GANDGV

SEQ ID NO: 1765818 - protein, 6 aa, Staphylococcus epidermidis
GANEDS

SEQ ID NO: 1765819 - protein, 8 aa, Staphylococcus epidermidis
GAQTTTQF

SEQ ID NO: 1765820 - protein, 14 aa, Staphylococcus epidermidis
GASVYSASEIARQE

SEQ ID NO: 1765821 - protein, 11 aa, Staphylococcus epidermidis
GATDPKGGCSG

SEQ ID NO: 1765822 - protein, 9 aa, Staphylococcus epidermidis
GATRIGASA

SEQ ID NO: 1765823 - protein, 9 aa, Staphylococcus epidermidis
GDANISEGD

SEQ ID NO: 1765824 - protein, 9 aa, Staphylococcus epidermidis
GDLAQNDTS

SEQ ID NO: 1765825 - protein, 13 aa, Staphylococcus epidermidis
GDLESSLNELGNR

SEQ ID NO: 1765826 - protein, 4 aa, Staphylococcus epidermidis
GDPM

SEQ ID NO: 1765827 - protein, 14 aa, Staphylococcus epidermidis
GDTPEVKSHTTLGH

SEQ ID NO: 1765828 - protein, 4 aa, Staphylococcus epidermidis
GEAT

SEQ ID NO: 1765829 - protein, 17 aa, Staphylococcus epidermidis
GEDGAQLSTDDSARLST

SEQ ID NO: 1765830 - protein, 6 aa, Staphylococcus epidermidis
GEDGLK

SEQ ID NO: 1765831 - protein, 9 aa, Staphylococcus epidermidis
GEDKQKGLT

SEQ ID NO: 1765832 - protein, 48 aa, Staphylococcus epidermidis
GEEDSDSYEIPNESLDENNHDLPQNQTDTRTNINEDVNDYHDAQHRGE

SEQ ID NO: 1765833 - protein, 7 aa, Staphylococcus epidermidis
GEEGHGH

SEQ ID NO: 1765834 - protein, 15 aa, Staphylococcus epidermidis
GEGASGKDAITKAHE

SEQ ID NO: 1765835 - protein, 10 aa, Staphylococcus epidermidis
GEGGSGGALG

SEQ ID NO: 1765836 - protein, 6 aa, Staphylococcus epidermidis
GEINNA

SEQ ID NO: 1765837 - protein, 7 aa, Staphylococcus epidermidis
GESAGRL

SEQ ID NO: 1765838 - protein, 6 aa, Staphylococcus epidermidis
GESYRF

SEQ ID NO: 1765839 - protein, 6 aa, Staphylococcus epidermidis
GEYSMT

SEQ ID NO: 1765840 - protein, 8 aa, Staphylococcus epidermidis
GFKEASKQ

SEQ ID NO: 1765841 - protein, 7 aa, Staphylococcus epidermidis
GGDPNNV

SEQ ID NO: 1765842 - protein, 12 aa, Staphylococcus epidermidis
GGDSEPKLNGNK

SEQ ID NO: 1765843 - protein, 18 aa, Staphylococcus epidermidis
GGETQYDYARSGNPNRTL

SEQ ID NO: 1765844 - protein, 4 aa, Staphylococcus epidermidis
GGEV

SEQ ID NO: 1765845 - protein, 4 aa, Staphylococcus epidermidis
GGGI

SEQ ID NO: 1765846 - protein, 11 aa, Staphylococcus epidermidis
GGGKSAKSLMT

SEQ ID NO: 1765847 - protein, 7 aa, Staphylococcus epidermidis
GGIEETQ

SEQ ID NO: 1765848 - protein, 15 aa, Staphylococcus epidermidis
GGKRKDRNNVEISGD

SEQ ID NO: 1765849 - protein, 5 aa, Staphylococcus epidermidis
GGLGE

SEQ ID NO: 1765850 - protein, 4 aa, Staphylococcus epidermidis
GGNP

SEQ ID NO: 1765851 - protein, 4 aa, Staphylococcus epidermidis
GGPT

SEQ ID NO: 1765852 - protein, 13 aa, Staphylococcus epidermidis
GGQGIATVVSKYE

SEQ ID NO: 1765853 - protein, 14 aa, Staphylococcus epidermidis
GGQVADKGTVGNES

SEQ ID NO: 1765854 - protein, 9 aa, Staphylococcus epidermidis
GGREEVGKL

SEQ ID NO: 1765855 - protein, 5 aa, Staphylococcus epidermidis
GGSAN

SEQ ID NO: 1765856 - protein, 20 aa, Staphylococcus epidermidis
GGTEMTTEEKIANGLNDSNI

SEQ ID NO: 1765857 - protein, 44 aa, Staphylococcus epidermidis
GHGDDEDSKKEEKEQESPVQEEASSTQSQEKTEVDESKTVKAMP

SEQ ID NO: 1765858 - protein, 8 aa, Staphylococcus epidermidis
GHNPKAPK

SEQ ID NO: 1765859 - protein, 8 aa, Staphylococcus epidermidis
GHVPRPPA

SEQ ID NO: 1765860 - protein, 6 aa, Staphylococcus epidermidis
GIDDAT

SEQ ID NO: 1765861 - protein, 5 aa, Staphylococcus epidermidis
GIGSE

SEQ ID NO: 1765862 - protein, 8 aa, Staphylococcus epidermidis
GIHTKEDV

SEQ ID NO: 1765863 - protein, 5 aa, Staphylococcus epidermidis
GISPE

SEQ ID NO: 1765864 - protein, 6 aa, Staphylococcus epidermidis
GITRKQ

SEQ ID NO: 1765865 - protein, 8 aa, Staphylococcus epidermidis
GKAHNKEN

SEQ ID NO: 1765866 - protein, 7 aa, Staphylococcus epidermidis
GKAISKI

SEQ ID NO: 1765867 - protein, 7 aa, Staphylococcus epidermidis
GKAQRVA

SEQ ID NO: 1765868 - protein, 8 aa, Staphylococcus epidermidis
GKASHRGV

SEQ ID NO: 1765869 - protein, 8 aa, Staphylococcus epidermidis
GKDQDQVK

SEQ ID NO: 1765870 - protein, 10 aa, Staphylococcus epidermidis
GKDYPLSREK

SEQ ID NO: 1765871 - protein, 5 aa, Staphylococcus epidermidis
GKDYQ

SEQ ID NO: 1765872 - protein, 9 aa, Staphylococcus epidermidis
GKHKGKSLK

SEQ ID NO: 1765873 - protein, 6 aa, Staphylococcus epidermidis
GKIEPK

SEQ ID NO: 1765874 - protein, 19 aa, Staphylococcus epidermidis
GKINLDGKSIHATSTKEIA

SEQ ID NO: 1765875 - protein, 8 aa, Staphylococcus epidermidis
GKKSHQTF

SEQ ID NO: 1765876 - protein, 8 aa, Staphylococcus epidermidis
GKLPNNYA

SEQ ID NO: 1765877 - protein, 13 aa, Staphylococcus epidermidis
GKMNDKADKYKGM

SEQ ID NO: 1765878 - protein, 7 aa, Staphylococcus epidermidis
GKNAGEA

SEQ ID NO: 1765879 - protein, 9 aa, Staphylococcus epidermidis
GKQKTASLE

SEQ ID NO: 1765880 - protein, 24 aa, Staphylococcus epidermidis
GKQLEVDTTQIENAPLPNNKVESL

SEQ ID NO: 1765881 - protein, 35 aa, Staphylococcus epidermidis
GKSSDTSSKTDYSKVPNVQGDEVQKAEDSVNAQSL

SEQ ID NO: 1765882 - protein, 7 aa, Staphylococcus epidermidis
GKTNGGK

SEQ ID NO: 1765883 - protein, 14 aa, Staphylococcus epidermidis
GKVPQSMKKHHTSN

SEQ ID NO: 1765884 - protein, 13 aa, Staphylococcus epidermidis
GKYDITSKIKTLL

SEQ ID NO: 1765885 - protein, 6 aa, Staphylococcus epidermidis
GLGKDR

SEQ ID NO: 1765886 - protein, 12 aa, Staphylococcus epidermidis
GLNENRVKYNSA

SEQ ID NO: 1765887 - protein, 4 aa, Staphylococcus epidermidis
GLNR

SEQ ID NO: 1765888 - protein, 7 aa, Staphylococcus epidermidis
GLRTHGD

SEQ ID NO: 1765889 - protein, 9 aa, Staphylococcus epidermidis
GLTSEDEDV

SEQ ID NO: 1765890 - protein, 7 aa, Staphylococcus epidermidis
GMDPSLG

SEQ ID NO: 1765891 - protein, 6 aa, Staphylococcus epidermidis
GNPGRS

SEQ ID NO: 1765892 - protein, 8 aa, Staphylococcus epidermidis
GNSGPLLP

SEQ ID NO: 1765893 - protein, 9 aa, Staphylococcus epidermidis
GNTDPKTVD

SEQ ID NO: 1765894 - protein, 16 aa, Staphylococcus epidermidis
GNTPDENGKLKGDVAY

SEQ ID NO: 1765895 - protein, 12 aa, Staphylococcus epidermidis
GNTVAPKNSADI

SEQ ID NO: 1765896 - protein, 7 aa, Staphylococcus epidermidis
GPLKTSK

SEQ ID NO: 1765897 - protein, 18 aa, Staphylococcus epidermidis
GPTGSQMGKKETAKDTAR

SEQ ID NO: 1765898 - protein, 11 aa, Staphylococcus epidermidis
GPTKEALSSER

SEQ ID NO: 1765899 - protein, 7 aa, Staphylococcus epidermidis
GQGAFEN

SEQ ID NO: 1765900 - protein, 15 aa, Staphylococcus epidermidis
GQGGHGSSPHTSNDA

SEQ ID NO: 1765901 - protein, 6 aa, Staphylococcus epidermidis
GQGTLA

SEQ ID NO: 1765902 - protein, 8 aa, Staphylococcus epidermidis
GQNLGAVD

SEQ ID NO: 1765903 - protein, 9 aa, Staphylococcus epidermidis
GQNSTEEDV

SEQ ID NO: 1765904 - protein, 6 aa, Staphylococcus epidermidis
GQQDIN

SEQ ID NO: 1765905 - protein, 4 aa, Staphylococcus epidermidis
GQSL

SEQ ID NO: 1765906 - protein, 14 aa, Staphylococcus epidermidis
GQYNSRSETGTTKF

SEQ ID NO: 1765907 - protein, 10 aa, Staphylococcus epidermidis
GRAPKEKQSI

SEQ ID NO: 1765908 - protein, 5 aa, Staphylococcus epidermidis
GREVA

SEQ ID NO: 1765909 - protein, 7 aa, Staphylococcus epidermidis
GRGPIVN

SEQ ID NO: 1765910 - protein, 4 aa, Staphylococcus epidermidis
GRIE

SEQ ID NO: 1765911 - protein, 6 aa, Staphylococcus epidermidis
GRMSTQ

SEQ ID NO: 1765912 - protein, 8 aa, Staphylococcus epidermidis
GRQTKEDV

SEQ ID NO: 1765913 - protein, 21 aa, Staphylococcus epidermidis
GRRTIEADNPLYTTRVPDGKH

SEQ ID NO: 1765914 - protein, 4 aa, Staphylococcus epidermidis
GRSL

SEQ ID NO: 1765915 - protein, 6 aa, Staphylococcus epidermidis
GRSYSE

SEQ ID NO: 1765916 - protein, 21 aa, Staphylococcus epidermidis
GSAYGKDDPAEEMYPGGENER

SEQ ID NO: 1765917 - protein, 13 aa, Staphylococcus epidermidis
GSDREQALATKEL

SEQ ID NO: 1765918 - protein, 9 aa, Staphylococcus epidermidis
GSGSKKTSL

SEQ ID NO: 1765919 - protein, 7 aa, Staphylococcus epidermidis
GSIKIGK

SEQ ID NO: 1765920 - protein, 7 aa, Staphylococcus epidermidis
GSIPRED

SEQ ID NO: 1765921 - protein, 5 aa, Staphylococcus epidermidis
GSKPL

SEQ ID NO: 1765922 - protein, 7 aa, Staphylococcus epidermidis
GSLPAGV

SEQ ID NO: 1765923 - protein, 4 aa, Staphylococcus epidermidis
GSQC

SEQ ID NO: 1765924 - protein, 12 aa, Staphylococcus epidermidis
GSTKTSSETMEW

SEQ ID NO: 1765925 - protein, 11 aa, Staphylococcus epidermidis
GSYGRNSISHN

SEQ ID NO: 1765926 - protein, 12 aa, Staphylococcus epidermidis
GTAVSSGETQRV

SEQ ID NO: 1765927 - protein, 4 aa, Staphylococcus epidermidis
GTCD

SEQ ID NO: 1765928 - protein, 7 aa, Staphylococcus epidermidis
GTDGVGT

SEQ ID NO: 1765929 - protein, 8 aa, Staphylococcus epidermidis
GTDHSSKR

SEQ ID NO: 1765930 - protein, 11 aa, Staphylococcus epidermidis
GTGTNNTYKSI

SEQ ID NO: 1765931 - protein, 5 aa, Staphylococcus epidermidis
GTGTS

SEQ ID NO: 1765932 - protein, 28 aa, Staphylococcus epidermidis
GTIKRGQNKKEDENNEKTLMKDEKELSE

SEQ ID NO: 1765933 - protein, 8 aa, Staphylococcus epidermidis
GTKLQSGL

SEQ ID NO: 1765934 - protein, 4 aa, Staphylococcus epidermidis
GTLR

SEQ ID NO: 1765935 - protein, 9 aa, Staphylococcus epidermidis
GTPNKEAQN

SEQ ID NO: 1765936 - protein, 7 aa, Staphylococcus epidermidis
GTRPINF

SEQ ID NO: 1765937 - protein, 7 aa, Staphylococcus epidermidis
GVEQERQ

SEQ ID NO: 1765938 - protein, 11 aa, Staphylococcus epidermidis
GVKGSTKQAVE

SEQ ID NO: 1765939 - protein, 6 aa, Staphylococcus epidermidis
GVNDNQ

SEQ ID NO: 1765940 - protein, 17 aa, Staphylococcus epidermidis
GVSTYEDIQSKEIPPTY

SEQ ID NO: 1765941 - protein, 5 aa, Staphylococcus epidermidis
GWKED

SEQ ID NO: 1765942 - protein, 4 aa, Staphylococcus epidermidis
GYDI

SEQ ID NO: 1765943 - protein, 6 aa, Staphylococcus epidermidis
GYDTVT

SEQ ID NO: 1765944 - protein, 4 aa, Staphylococcus epidermidis
GYQP

SEQ ID NO: 1765945 - protein, 8 aa, Staphylococcus epidermidis
GYSDQDEM

SEQ ID NO: 1765946 - protein, 15 aa, Staphylococcus epidermidis
GYSRDEANKLLKDND

SEQ ID NO: 1765947 - protein, 15 aa, Staphylococcus epidermidis
HAAKGITTDEQAQRA

SEQ ID NO: 1765948 - protein, 8 aa, Staphylococcus epidermidis
HAPSNLKE

SEQ ID NO: 1765949 - protein, 8 aa, Staphylococcus epidermidis
HASTKSKR

SEQ ID NO: 1765950 - protein, 12 aa, Staphylococcus epidermidis
HCSETEKKEIKE

SEQ ID NO: 1765951 - protein, 4 aa, Staphylococcus epidermidis
HDDG

SEQ ID NO: 1765952 - protein, 4 aa, Staphylococcus epidermidis
HDFE

SEQ ID NO: 1765953 - protein, 5 aa, Staphylococcus epidermidis
HDGHT

SEQ ID NO: 1765954 - protein, 5 aa, Staphylococcus epidermidis
HDTIG

SEQ ID NO: 1765955 - protein, 9 aa, Staphylococcus epidermidis
HEKKNSVDA

SEQ ID NO: 1765956 - protein, 7 aa, Staphylococcus epidermidis
HESTQSH

SEQ ID NO: 1765957 - protein, 37 aa, Staphylococcus epidermidis
HETITQNNFENKEINQDANTSTYISQKQQKRQQRKLE

SEQ ID NO: 1765958 - protein, 6 aa, Staphylococcus epidermidis
HETKTG

SEQ ID NO: 1765959 - protein, 5 aa, Staphylococcus epidermidis
HFSNE

SEQ ID NO: 1765960 - protein, 10 aa, Staphylococcus epidermidis
HGAGSPCGKS

SEQ ID NO: 1765961 - protein, 7 aa, Staphylococcus epidermidis
HGAQDEA

SEQ ID NO: 1765962 - protein, 22 aa, Staphylococcus epidermidis
HGKSLSRLGGGIGTRGPGETKL

SEQ ID NO: 1765963 - protein, 8 aa, Staphylococcus epidermidis
HGLDTSSM

SEQ ID NO: 1765964 - protein, 16 aa, Staphylococcus epidermidis
HGLPHDPFKSSTVPRP

SEQ ID NO: 1765965 - protein, 4 aa, Staphylococcus epidermidis
HGPI

SEQ ID NO: 1765966 - protein, 17 aa, Staphylococcus epidermidis
HGPYTTVDDEQLNPFIN

SEQ ID NO: 1765967 - protein, 10 aa, Staphylococcus epidermidis
HGQPEGYTSH

SEQ ID NO: 1765968 - protein, 6 aa, Staphylococcus epidermidis
HHNNQR

SEQ ID NO: 1765969 - protein, 5 aa, Staphylococcus epidermidis
HHPET

SEQ ID NO: 1765970 - protein, 11 aa, Staphylococcus epidermidis
HHTTGDAYTQL

SEQ ID NO: 1765971 - protein, 6 aa, Staphylococcus epidermidis
HIEQAG

SEQ ID NO: 1765972 - protein, 9 aa, Staphylococcus epidermidis
HISGTQENN

SEQ ID NO: 1765973 - protein, 8 aa, Staphylococcus epidermidis
HKAQSKDI

SEQ ID NO: 1765974 - protein, 6 aa, Staphylococcus epidermidis
HKFPER

SEQ ID NO: 1765975 - protein, 9 aa, Staphylococcus epidermidis
HKKTKDYSN

SEQ ID NO: 1765976 - protein, 7 aa, Staphylococcus epidermidis
HKKTSRI

SEQ ID NO: 1765977 - protein, 8 aa, Staphylococcus epidermidis
HKRMTSSV

SEQ ID NO: 1765978 - protein, 6 aa, Staphylococcus epidermidis
HKTQEW

SEQ ID NO: 1765979 - protein, 7 aa, Staphylococcus epidermidis
HNIDTPS

SEQ ID NO: 1765980 - protein, 12 aa, Staphylococcus epidermidis
HNNTGRIVIDFN

SEQ ID NO: 1765981 - protein, 10 aa, Staphylococcus epidermidis
HNSERKPKGL

SEQ ID NO: 1765982 - protein, 6 aa, Staphylococcus epidermidis
HPDDEY

SEQ ID NO: 1765983 - protein, 13 aa, Staphylococcus epidermidis
HPKKDAKAYKSRD

SEQ ID NO: 1765984 - protein, 4 aa, Staphylococcus epidermidis
HPKM

SEQ ID NO: 1765985 - protein, 13 aa, Staphylococcus epidermidis
HPKQGDLHHPNET

SEQ ID NO: 1765986 - protein, 12 aa, Staphylococcus epidermidis
HQENEDSQAQDK

SEQ ID NO: 1765987 - protein, 6 aa, Staphylococcus epidermidis
HQGHPG

SEQ ID NO: 1765988 - protein, 7 aa, Staphylococcus epidermidis
HQRPGDQ

SEQ ID NO: 1765989 - protein, 9 aa, Staphylococcus epidermidis
HQRSGKKYS

SEQ ID NO: 1765990 - protein, 5 aa, Staphylococcus epidermidis
HRDQH

SEQ ID NO: 1765991 - protein, 9 aa, Staphylococcus epidermidis
HRKRPATAK

SEQ ID NO: 1765992 - protein, 4 aa, Staphylococcus epidermidis
HRNY

SEQ ID NO: 1765993 - protein, 9 aa, Staphylococcus epidermidis
HRRQSSQNV

SEQ ID NO: 1765994 - protein, 5 aa, Staphylococcus epidermidis
HSDEV

SEQ ID NO: 1765995 - protein, 5 aa, Staphylococcus epidermidis
HSNEG

SEQ ID NO: 1765996 - protein, 6 aa, Staphylococcus epidermidis
HSNVER

SEQ ID NO: 1765997 - protein, 5 aa, Staphylococcus epidermidis
HSPHT

SEQ ID NO: 1765998 - protein, 7 aa, Staphylococcus epidermidis
HSTKNEH

SEQ ID NO: 1765999 - protein, 6 aa, Staphylococcus epidermidis
HTDHKT

SEQ ID NO: 1766000 - protein, 8 aa, Staphylococcus epidermidis
HTEKRQAL

SEQ ID NO: 1766001 - protein, 4 aa, Staphylococcus epidermidis
HTFE

SEQ ID NO: 1766002 - protein, 8 aa, Staphylococcus epidermidis
HTPTKKEF

SEQ ID NO: 1766003 - protein, 7 aa, Staphylococcus epidermidis
HTQSSGV

SEQ ID NO: 1766004 - protein, 8 aa, Staphylococcus epidermidis
HTRKESNT

SEQ ID NO: 1766005 - protein, 4 aa, Staphylococcus epidermidis
HTTV

SEQ ID NO: 1766006 - protein, 4 aa, Staphylococcus epidermidis
HTVR

SEQ ID NO: 1766007 - protein, 5 aa, Staphylococcus epidermidis
HVEAG

SEQ ID NO: 1766008 - protein, 6 aa, Staphylococcus epidermidis
HVKPKK

SEQ ID NO: 1766009 - protein, 8 aa, Staphylococcus epidermidis
HVQTPEEV

SEQ ID NO: 1766010 - protein, 7 aa, Staphylococcus epidermidis
HYQRTYE

SEQ ID NO: 1766011 - protein, 10 aa, Staphylococcus epidermidis
HYSEHEGKPF

SEQ ID NO: 1766012 - protein, 20 aa, Staphylococcus epidermidis
IANADDPVEAAKQCRAAIEG

SEQ ID NO: 1766013 - protein, 5 aa, Staphylococcus epidermidis
IANKQ

SEQ ID NO: 1766014 - protein, 6 aa, Staphylococcus epidermidis
IAQDNQ

SEQ ID NO: 1766015 - protein, 7 aa, Staphylococcus epidermidis
IARRSDS

SEQ ID NO: 1766016 - protein, 8 aa, Staphylococcus epidermidis
IATENGGN

SEQ ID NO: 1766017 - protein, 8 aa, Staphylococcus epidermidis
IATKGSHV

SEQ ID NO: 1766018 - protein, 8 aa, Staphylococcus epidermidis
IATRESDG

SEQ ID NO: 1766019 - protein, 7 aa, Staphylococcus epidermidis
IATTEEV

SEQ ID NO: 1766020 - protein, 5 aa, Staphylococcus epidermidis
IDGAT

SEQ ID NO: 1766021 - protein, 18 aa, Staphylococcus epidermidis
IDKENKARQSDDSDYLES

SEQ ID NO: 1766022 - protein, 7 aa, Staphylococcus epidermidis
IDNGQAL

SEQ ID NO: 1766023 - protein, 9 aa, Staphylococcus epidermidis
IDNTENNKR

SEQ ID NO: 1766024 - protein, 14 aa, Staphylococcus epidermidis
IDSNPSLTANQREE

SEQ ID NO: 1766025 - protein, 10 aa, Staphylococcus epidermidis
IDTSSTNEEV

SEQ ID NO: 1766026 - protein, 12 aa, Staphylococcus epidermidis
IDTYKEKDLRDI

SEQ ID NO: 1766027 - protein, 8 aa, Staphylococcus epidermidis
IEAGKGED

SEQ ID NO: 1766028 - protein, 7 aa, Staphylococcus epidermidis
IEEAESY

SEQ ID NO: 1766029 - protein, 14 aa, Staphylococcus epidermidis
IEEESGASTATISR

SEQ ID NO: 1766030 - protein, 5 aa, Staphylococcus epidermidis
IEEGR

SEQ ID NO: 1766031 - protein, 6 aa, Staphylococcus epidermidis
IEEKSI

SEQ ID NO: 1766032 - protein, 4 aa, Staphylococcus epidermidis
IEES

SEQ ID NO: 1766033 - protein, 8 aa, Staphylococcus epidermidis
IEKDSKGI

SEQ ID NO: 1766034 - protein, 17 aa, Staphylococcus epidermidis
IEKQETDLSDEELQESI

SEQ ID NO: 1766035 - protein, 8 aa, Staphylococcus epidermidis
IENNPEDS

SEQ ID NO: 1766036 - protein, 4 aa, Staphylococcus epidermidis
IENP

SEQ ID NO: 1766037 - protein, 7 aa, Staphylococcus epidermidis
IEPGRSI

SEQ ID NO: 1766038 - protein, 4 aa, Staphylococcus epidermidis
IEPN

SEQ ID NO: 1766039 - protein, 14 aa, Staphylococcus epidermidis
IEQGDEIAKSRLAE

SEQ ID NO: 1766040 - protein, 6 aa, Staphylococcus epidermidis
IERHKS

SEQ ID NO: 1766041 - protein, 4 aa, Staphylococcus epidermidis
IERT

SEQ ID NO: 1766042 - protein, 6 aa, Staphylococcus epidermidis
IESPQE

SEQ ID NO: 1766043 - protein, 4 aa, Staphylococcus epidermidis
IGAA

SEQ ID NO: 1766044 - protein, 8 aa, Staphylococcus epidermidis
IGEENERH

SEQ ID NO: 1766045 - protein, 19 aa, Staphylococcus epidermidis
IGGTTQNELAKSLGKSQSF

SEQ ID NO: 1766046 - protein, 12 aa, Staphylococcus epidermidis
IGIPNKGEWTNK

SEQ ID NO: 1766047 - protein, 7 aa, Staphylococcus epidermidis
IGQQPAK

SEQ ID NO: 1766048 - protein, 6 aa, Staphylococcus epidermidis
IGRTDL

SEQ ID NO: 1766049 - protein, 10 aa, Staphylococcus epidermidis
IGSEKKTAAM

SEQ ID NO: 1766050 - protein, 7 aa, Staphylococcus epidermidis
IHEDSRK

SEQ ID NO: 1766051 - protein, 9 aa, Staphylococcus epidermidis
IHGESGMDG

SEQ ID NO: 1766052 - protein, 10 aa, Staphylococcus epidermidis
IIDSEESSQV

SEQ ID NO: 1766053 - protein, 19 aa, Staphylococcus epidermidis
IKGGHTNNKIRVSKSPVHA

SEQ ID NO: 1766054 - protein, 14 aa, Staphylococcus epidermidis
IKKNPNQTLFSKDF

SEQ ID NO: 1766055 - protein, 14 aa, Staphylococcus epidermidis
IKKTPKQDKAEDKR

SEQ ID NO: 1766056 - protein, 7 aa, Staphylococcus epidermidis
IKNHENE

SEQ ID NO: 1766057 - protein, 16 aa, Staphylococcus epidermidis
IKNSKQQEIWNFIETY

SEQ ID NO: 1766058 - protein, 6 aa, Staphylococcus epidermidis
IKPGVT

SEQ ID NO: 1766059 - protein, 6 aa, Staphylococcus epidermidis
IKPQST

SEQ ID NO: 1766060 - protein, 17 aa, Staphylococcus epidermidis
IKSSAEAVREGNTGAVQ

SEQ ID NO: 1766061 - protein, 11 aa, Staphylococcus epidermidis
IKTKSNPNDLV

SEQ ID NO: 1766062 - protein, 14 aa, Staphylococcus epidermidis
IKTTEIEGHPDFSG

SEQ ID NO: 1766063 - protein, 12 aa, Staphylococcus epidermidis
IKTTEQAKQLKD

SEQ ID NO: 1766064 - protein, 5 aa, Staphylococcus epidermidis
INEAI

SEQ ID NO: 1766065 - protein, 9 aa, Staphylococcus epidermidis
INEEQDDLG

SEQ ID NO: 1766066 - protein, 5 aa, Staphylococcus epidermidis
INENQ

SEQ ID NO: 1766067 - protein, 8 aa, Staphylococcus epidermidis
INETEGVT

SEQ ID NO: 1766068 - protein, 6 aa, Staphylococcus epidermidis
INETNV

SEQ ID NO: 1766069 - protein, 10 aa, Staphylococcus epidermidis
INGKNNNRET

SEQ ID NO: 1766070 - protein, 5 aa, Staphylococcus epidermidis
INGLS

SEQ ID NO: 1766071 - protein, 4 aa, Staphylococcus epidermidis
INKP

SEQ ID NO: 1766072 - protein, 6 aa, Staphylococcus epidermidis
INMQND

SEQ ID NO: 1766073 - protein, 8 aa, Staphylococcus epidermidis
INPEKDVD

SEQ ID NO: 1766074 - protein, 6 aa, Staphylococcus epidermidis
INPNLQ

SEQ ID NO: 1766075 - protein, 10 aa, Staphylococcus epidermidis
INQAKTNLEN

SEQ ID NO: 1766076 - protein, 11 aa, Staphylococcus epidermidis
INSKHNDSSEY

SEQ ID NO: 1766077 - protein, 7 aa, Staphylococcus epidermidis
INSTSTF

SEQ ID NO: 1766078 - protein, 7 aa, Staphylococcus epidermidis
IPAPATA

SEQ ID NO: 1766079 - protein, 6 aa, Staphylococcus epidermidis
IPEDES

SEQ ID NO: 1766080 - protein, 12 aa, Staphylococcus epidermidis
IPELPDERKAKY

SEQ ID NO: 1766081 - protein, 6 aa, Staphylococcus epidermidis
IPGEDR

SEQ ID NO: 1766082 - protein, 11 aa, Staphylococcus epidermidis
IPGIGPSKAKE

SEQ ID NO: 1766083 - protein, 11 aa, Staphylococcus epidermidis
IPKDLSKEEMQ

SEQ ID NO: 1766084 - protein, 11 aa, Staphylococcus epidermidis
IPKKNSKSFRE

SEQ ID NO: 1766085 - protein, 5 aa, Staphylococcus epidermidis
IPREE

SEQ ID NO: 1766086 - protein, 16 aa, Staphylococcus epidermidis
IPSSLGGQGEGTNPDE

SEQ ID NO: 1766087 - protein, 15 aa, Staphylococcus epidermidis
IPTAEYKEVSSRNEA

SEQ ID NO: 1766088 - protein, 6 aa, Staphylococcus epidermidis
IPTGHG

SEQ ID NO: 1766089 - protein, 6 aa, Staphylococcus epidermidis
IQDESQ

SEQ ID NO: 1766090 - protein, 5 aa, Staphylococcus epidermidis
IQDNA

SEQ ID NO: 1766091 - protein, 6 aa, Staphylococcus epidermidis
IQEEEQ

SEQ ID NO: 1766092 - protein, 9 aa, Staphylococcus epidermidis
IQKRDELER

SEQ ID NO: 1766093 - protein, 9 aa, Staphylococcus epidermidis
IQPAGKKRM

SEQ ID NO: 1766094 - protein, 4 aa, Staphylococcus epidermidis
IRDE

SEQ ID NO: 1766095 - protein, 12 aa, Staphylococcus epidermidis
IRGDLTQNAESH

SEQ ID NO: 1766096 - protein, 14 aa, Staphylococcus epidermidis
IRKPEPHSPVKNGP

SEQ ID NO: 1766097 - protein, 20 aa, Staphylococcus epidermidis
IRPKQSKLGKIERSKAPNPF

SEQ ID NO: 1766098 - protein, 10 aa, Staphylococcus epidermidis
IRTPKDIDTL

SEQ ID NO: 1766099 - protein, 9 aa, Staphylococcus epidermidis
ISGESENVQ

SEQ ID NO: 1766100 - protein, 6 aa, Staphylococcus epidermidis
ISHSSA

SEQ ID NO: 1766101 - protein, 11 aa, Staphylococcus epidermidis
ISIQDDTENIS

SEQ ID NO: 1766102 - protein, 12 aa, Staphylococcus epidermidis
ISKSYKKRGNEN

SEQ ID NO: 1766103 - protein, 9 aa, Staphylococcus epidermidis
ISNQEKATI

SEQ ID NO: 1766104 - protein, 6 aa, Staphylococcus epidermidis
ISQNTG

SEQ ID NO: 1766105 - protein, 5 aa, Staphylococcus epidermidis
ISSSL

SEQ ID NO: 1766106 - protein, 4 aa, Staphylococcus epidermidis
ITEG

SEQ ID NO: 1766107 - protein, 5 aa, Staphylococcus epidermidis
ITESD

SEQ ID NO: 1766108 - protein, 6 aa, Staphylococcus epidermidis
ITPQQV

SEQ ID NO: 1766109 - protein, 10 aa, Staphylococcus epidermidis
ITPVPGGVGP

SEQ ID NO: 1766110 - protein, 10 aa, Staphylococcus epidermidis
ITTSDKEQEV

SEQ ID NO: 1766111 - protein, 16 aa, Staphylococcus epidermidis
IVQPGDTIALIPPVSG

SEQ ID NO: 1766112 - protein, 5 aa, Staphylococcus epidermidis
KADQY

SEQ ID NO: 1766113 - protein, 16 aa, Staphylococcus epidermidis
KADSSFKTSNKNQEEV

SEQ ID NO: 1766114 - protein, 14 aa, Staphylococcus epidermidis
KAETFEKELPQTKE

SEQ ID NO: 1766115 - protein, 5 aa, Staphylococcus epidermidis
KAGEM

SEQ ID NO: 1766116 - protein, 28 aa, Staphylococcus epidermidis
KAKDRPRKPRHSKANHGKPVQKTEDFEK

SEQ ID NO: 1766117 - protein, 7 aa, Staphylococcus epidermidis
KAKGKGT

SEQ ID NO: 1766118 - protein, 10 aa, Staphylococcus epidermidis
KAKKAADEIG

SEQ ID NO: 1766119 - protein, 7 aa, Staphylococcus epidermidis
KAKKNYT

SEQ ID NO: 1766120 - protein, 11 aa, Staphylococcus epidermidis
KANVKKEGNDI

SEQ ID NO: 1766121 - protein, 7 aa, Staphylococcus epidermidis
KAPGNHD

SEQ ID NO: 1766122 - protein, 15 aa, Staphylococcus epidermidis
KAPTNLKSEQAASLP

SEQ ID NO: 1766123 - protein, 6 aa, Staphylococcus epidermidis
KAQQRE

SEQ ID NO: 1766124 - protein, 6 aa, Staphylococcus epidermidis
KAREVI

SEQ ID NO: 1766125 - protein, 6 aa, Staphylococcus epidermidis
KASNNF

SEQ ID NO: 1766126 - protein, 10 aa, Staphylococcus epidermidis
KATKAPSSVN

SEQ ID NO: 1766127 - protein, 15 aa, Staphylococcus epidermidis
KATRGNIDVQLDVTA

SEQ ID NO: 1766128 - protein, 13 aa, Staphylococcus epidermidis
KAYAQNKDLNPNH

SEQ ID NO: 1766129 - protein, 9 aa, Staphylococcus epidermidis
KAYETGKGK

SEQ ID NO: 1766130 - protein, 5 aa, Staphylococcus epidermidis
KDAFN

SEQ ID NO: 1766131 - protein, 9 aa, Staphylococcus epidermidis
KDANERQVS

SEQ ID NO: 1766132 - protein, 6 aa, Staphylococcus epidermidis
KDDVSK

SEQ ID NO: 1766133 - protein, 6 aa, Staphylococcus epidermidis
KDEKIK

SEQ ID NO: 1766134 - protein, 15 aa, Staphylococcus epidermidis
KDEKYKEHTNIDSED

SEQ ID NO: 1766135 - protein, 9 aa, Staphylococcus epidermidis
KDEPAGEDC

SEQ ID NO: 1766136 - protein, 4 aa, Staphylococcus epidermidis
KDFV

SEQ ID NO: 1766137 - protein, 4 aa, Staphylococcus epidermidis
KDHG

SEQ ID NO: 1766138 - protein, 6 aa, Staphylococcus epidermidis
KDKADF

SEQ ID NO: 1766139 - protein, 5 aa, Staphylococcus epidermidis
KDKDT

SEQ ID NO: 1766140 - protein, 11 aa, Staphylococcus epidermidis
KDKNNQEIRDG

SEQ ID NO: 1766141 - protein, 7 aa, Staphylococcus epidermidis
KDLSQQF

SEQ ID NO: 1766142 - protein, 8 aa, Staphylococcus epidermidis
KDLTDKTI

SEQ ID NO: 1766143 - protein, 5 aa, Staphylococcus epidermidis
KDNEA

SEQ ID NO: 1766144 - protein, 4 aa, Staphylococcus epidermidis
KDNT

SEQ ID NO: 1766145 - protein, 5 aa, Staphylococcus epidermidis
KDPDF

SEQ ID NO: 1766146 - protein, 7 aa, Staphylococcus epidermidis
KDQETYE

SEQ ID NO: 1766147 - protein, 24 aa, Staphylococcus epidermidis
KDSEDKLTSIKRQTESRRGGKGSR

SEQ ID NO: 1766148 - protein, 6 aa, Staphylococcus epidermidis
KDTGEL

SEQ ID NO: 1766149 - protein, 8 aa, Staphylococcus epidermidis
KDTNATSN

SEQ ID NO: 1766150 - protein, 11 aa, Staphylococcus epidermidis
KEAKSEGQKYF

SEQ ID NO: 1766151 - protein, 7 aa, Staphylococcus epidermidis
KEDEDRV

SEQ ID NO: 1766152 - protein, 7 aa, Staphylococcus epidermidis
KEDEEDF

SEQ ID NO: 1766153 - protein, 10 aa, Staphylococcus epidermidis
KEEEDNYPGD

SEQ ID NO: 1766154 - protein, 8 aa, Staphylococcus epidermidis
KEEHRQSY

SEQ ID NO: 1766155 - protein, 6 aa, Staphylococcus epidermidis
KEEKPN

SEQ ID NO: 1766156 - protein, 8 aa, Staphylococcus epidermidis
KEENGPIK

SEQ ID NO: 1766157 - protein, 14 aa, Staphylococcus epidermidis
KEETELPYASKNEG

SEQ ID NO: 1766158 - protein, 14 aa, Staphylococcus epidermidis
KEFDPTKKISDEDF

SEQ ID NO: 1766159 - protein, 10 aa, Staphylococcus epidermidis
KEGAEEKLNN

SEQ ID NO: 1766160 - protein, 7 aa, Staphylococcus epidermidis
KEGKTTQ

SEQ ID NO: 1766161 - protein, 12 aa, Staphylococcus epidermidis
KEGPLSEGTVSG

SEQ ID NO: 1766162 - protein, 7 aa, Staphylococcus epidermidis
KEGQEEI

SEQ ID NO: 1766163 - protein, 5 aa, Staphylococcus epidermidis
KEGQS

SEQ ID NO: 1766164 - protein, 11 aa, Staphylococcus epidermidis
KEGSYPGDITP

SEQ ID NO: 1766165 - protein, 5 aa, Staphylococcus epidermidis
KEITK

SEQ ID NO: 1766166 - protein, 7 aa, Staphylococcus epidermidis
KEKSGKL

SEQ ID NO: 1766167 - protein, 4 aa, Staphylococcus epidermidis
KEKT

SEQ ID NO: 1766168 - protein, 7 aa, Staphylococcus epidermidis
KELARTG

SEQ ID NO: 1766169 - protein, 33 aa, Staphylococcus epidermidis
KELGKEMEQISQENDEEKLNQSHDNEVRSDLKK

SEQ ID NO: 1766170 - protein, 7 aa, Staphylococcus epidermidis
KELKRSL

SEQ ID NO: 1766171 - protein, 5 aa, Staphylococcus epidermidis
KENEV

SEQ ID NO: 1766172 - protein, 6 aa, Staphylococcus epidermidis
KENGWD

SEQ ID NO: 1766173 - protein, 14 aa, Staphylococcus epidermidis
KENPDLKSKSISRP

SEQ ID NO: 1766174 - protein, 5 aa, Staphylococcus epidermidis
KENVN

SEQ ID NO: 1766175 - protein, 8 aa, Staphylococcus epidermidis
KEPGGGIT

SEQ ID NO: 1766176 - protein, 7 aa, Staphylococcus epidermidis
KEPTKGV

SEQ ID NO: 1766177 - protein, 15 aa, Staphylococcus epidermidis
KEQGQDMTSNNKQQA

SEQ ID NO: 1766178 - protein, 9 aa, Staphylococcus epidermidis
KEQRGPLDG

SEQ ID NO: 1766179 - protein, 6 aa, Staphylococcus epidermidis
KEQRMK

SEQ ID NO: 1766180 - protein, 7 aa, Staphylococcus epidermidis
KERINQA

SEQ ID NO: 1766181 - protein, 13 aa, Staphylococcus epidermidis
KERTHGVRTENWS

SEQ ID NO: 1766182 - protein, 7 aa, Staphylococcus epidermidis
KESNVDT

SEQ ID NO: 1766183 - protein, 8 aa, Staphylococcus epidermidis
KEYQQSDL

SEQ ID NO: 1766184 - protein, 8 aa, Staphylococcus epidermidis
KEYTATRC

SEQ ID NO: 1766185 - protein, 5 aa, Staphylococcus epidermidis
KFAQN

SEQ ID NO: 1766186 - protein, 14 aa, Staphylococcus epidermidis
KFGNAGNEGEVPFK

SEQ ID NO: 1766187 - protein, 13 aa, Staphylococcus epidermidis
KGAIGEGAERLER

SEQ ID NO: 1766188 - protein, 9 aa, Staphylococcus epidermidis
KGDFKSAGH

SEQ ID NO: 1766189 - protein, 15 aa, Staphylococcus epidermidis
KGEQTTLKIKIPIKL

SEQ ID NO: 1766190 - protein, 6 aa, Staphylococcus epidermidis
KGESLD

SEQ ID NO: 1766191 - protein, 9 aa, Staphylococcus epidermidis
KGESSEEEI

SEQ ID NO: 1766192 - protein, 12 aa, Staphylococcus epidermidis
KGEVEETYFPNS

SEQ ID NO: 1766193 - protein, 5 aa, Staphylococcus epidermidis
KGEYH

SEQ ID NO: 1766194 - protein, 5 aa, Staphylococcus epidermidis
KGGDP

SEQ ID NO: 1766195 - protein, 7 aa, Staphylococcus epidermidis
KGHDDLT

SEQ ID NO: 1766196 - protein, 6 aa, Staphylococcus epidermidis
KGHGYR

SEQ ID NO: 1766197 - protein, 5 aa, Staphylococcus epidermidis
KGHYT

SEQ ID NO: 1766198 - protein, 5 aa, Staphylococcus epidermidis
KGKRD

SEQ ID NO: 1766199 - protein, 15 aa, Staphylococcus epidermidis
KGKTAHASTPKKGIS

SEQ ID NO: 1766200 - protein, 8 aa, Staphylococcus epidermidis
KGNTTEEL

SEQ ID NO: 1766201 - protein, 14 aa, Staphylococcus epidermidis
KGPTGSGKTKLAET

SEQ ID NO: 1766202 - protein, 5 aa, Staphylococcus epidermidis
KGQLD

SEQ ID NO: 1766203 - protein, 8 aa, Staphylococcus epidermidis
KGSLGKSY

SEQ ID NO: 1766204 - protein, 7 aa, Staphylococcus epidermidis
KGSVKVN

SEQ ID NO: 1766205 - protein, 10 aa, Staphylococcus epidermidis
KGTENKTYLG

SEQ ID NO: 1766206 - protein, 13 aa, Staphylococcus epidermidis
KGTGFEGRVTKKD

SEQ ID NO: 1766207 - protein, 8 aa, Staphylococcus epidermidis
KGTSYTGG

SEQ ID NO: 1766208 - protein, 13 aa, Staphylococcus epidermidis
KGYKAEGLHGDIT

SEQ ID NO: 1766209 - protein, 13 aa, Staphylococcus epidermidis
KGYVTKKGKPFSI

SEQ ID NO: 1766210 - protein, 14 aa, Staphylococcus epidermidis
KHENQRNKTYQPRI

SEQ ID NO: 1766211 - protein, 7 aa, Staphylococcus epidermidis
KHQPSEY

SEQ ID NO: 1766212 - protein, 6 aa, Staphylococcus epidermidis
KHQYNE

SEQ ID NO: 1766213 - protein, 6 aa, Staphylococcus epidermidis
KHRGER

SEQ ID NO: 1766214 - protein, 9 aa, Staphylococcus epidermidis
KIDESSRDR

SEQ ID NO: 1766215 - protein, 11 aa, Staphylococcus epidermidis
KIDNTEEEAAK

SEQ ID NO: 1766216 - protein, 25 aa, Staphylococcus epidermidis
KIKDTTNRAVDTTKPKPASPKFKSI

SEQ ID NO: 1766217 - protein, 7 aa, Staphylococcus epidermidis
KINQSPI

SEQ ID NO: 1766218 - protein, 10 aa, Staphylococcus epidermidis
KISDQSDRMG

SEQ ID NO: 1766219 - protein, 18 aa, Staphylococcus epidermidis
KISSANKRNEKNANEAEK

SEQ ID NO: 1766220 - protein, 4 aa, Staphylococcus epidermidis
KITH

SEQ ID NO: 1766221 - protein, 8 aa, Staphylococcus epidermidis
KITNNQTP

SEQ ID NO: 1766222 - protein, 11 aa, Staphylococcus epidermidis
KITQPRTDSDW

SEQ ID NO: 1766223 - protein, 8 aa, Staphylococcus epidermidis
KKAKAGDQ

SEQ ID NO: 1766224 - protein, 7 aa, Staphylococcus epidermidis
KKCTRDI

SEQ ID NO: 1766225 - protein, 7 aa, Staphylococcus epidermidis
KKDYPEV

SEQ ID NO: 1766226 - protein, 15 aa, Staphylococcus epidermidis
KKEELTKEMNNKNKD

SEQ ID NO: 1766227 - protein, 23 aa, Staphylococcus epidermidis
KKEFEDEKAKDSHYRLEHVDHYL

SEQ ID NO: 1766228 - protein, 6 aa, Staphylococcus epidermidis
KKENIV

SEQ ID NO: 1766229 - protein, 8 aa, Staphylococcus epidermidis
KKEQTIYD

SEQ ID NO: 1766230 - protein, 8 aa, Staphylococcus epidermidis
KKGQAMES

SEQ ID NO: 1766231 - protein, 6 aa, Staphylococcus epidermidis
KKGSYV

SEQ ID NO: 1766232 - protein, 6 aa, Staphylococcus epidermidis
KKGVSY

SEQ ID NO: 1766233 - protein, 26 aa, Staphylococcus epidermidis
KKHGSKETIHPNDDVNKSQSSNDTFP

SEQ ID NO: 1766234 - protein, 8 aa, Staphylococcus epidermidis
KKLKSKGI

SEQ ID NO: 1766235 - protein, 14 aa, Staphylococcus epidermidis
KKLLSTNGSGRTNE

SEQ ID NO: 1766236 - protein, 27 aa, Staphylococcus epidermidis
KKNPTHYEQYQRGSGRKAFIESHWGGS

SEQ ID NO: 1766237 - protein, 5 aa, Staphylococcus epidermidis
KKPHR

SEQ ID NO: 1766238 - protein, 5 aa, Staphylococcus epidermidis
KKPVG

SEQ ID NO: 1766239 - protein, 8 aa, Staphylococcus epidermidis
KKQDDQTI

SEQ ID NO: 1766240 - protein, 22 aa, Staphylococcus epidermidis
KKQVETYEYENEKTKDKLNELN

SEQ ID NO: 1766241 - protein, 5 aa, Staphylococcus epidermidis
KLASA

SEQ ID NO: 1766242 - protein, 8 aa, Staphylococcus epidermidis
KLDTKIED

SEQ ID NO: 1766243 - protein, 8 aa, Staphylococcus epidermidis
KLISEADQ

SEQ ID NO: 1766244 - protein, 4 aa, Staphylococcus epidermidis
KLPD

SEQ ID NO: 1766245 - protein, 7 aa, Staphylococcus epidermidis
KLSNEEL

SEQ ID NO: 1766246 - protein, 7 aa, Staphylococcus epidermidis
KLSPFDR

SEQ ID NO: 1766247 - protein, 5 aa, Staphylococcus epidermidis
KLSQE

SEQ ID NO: 1766248 - protein, 7 aa, Staphylococcus epidermidis
KLSQQGA

SEQ ID NO: 1766249 - protein, 7 aa, Staphylococcus epidermidis
KLSQSIE

SEQ ID NO: 1766250 - protein, 18 aa, Staphylococcus epidermidis
KLTKTDTFNSVNPANTSQ

SEQ ID NO: 1766251 - protein, 5 aa, Staphylococcus epidermidis
KMKRS

SEQ ID NO: 1766252 - protein, 10 aa, Staphylococcus epidermidis
KMNELNQGDE

SEQ ID NO: 1766253 - protein, 6 aa, Staphylococcus epidermidis
KMPPGF

SEQ ID NO: 1766254 - protein, 11 aa, Staphylococcus epidermidis
KMQPVQPPTDD

SEQ ID NO: 1766255 - protein, 5 aa, Staphylococcus epidermidis
KNADL

SEQ ID NO: 1766256 - protein, 5 aa, Staphylococcus epidermidis
KNDCP

SEQ ID NO: 1766257 - protein, 16 aa, Staphylococcus epidermidis
KNDSHRPNAKSKNLNQ

SEQ ID NO: 1766258 - protein, 7 aa, Staphylococcus epidermidis
KNDYQKV

SEQ ID NO: 1766259 - protein, 10 aa, Staphylococcus epidermidis
KNEKENDIQL

SEQ ID NO: 1766260 - protein, 8 aa, Staphylococcus epidermidis
KNENYSSD

SEQ ID NO: 1766261 - protein, 7 aa, Staphylococcus epidermidis
KNGELKP

SEQ ID NO: 1766262 - protein, 6 aa, Staphylococcus epidermidis
KNHQTR

SEQ ID NO: 1766263 - protein, 14 aa, Staphylococcus epidermidis
KNITSKGGTTQAGL

SEQ ID NO: 1766264 - protein, 14 aa, Staphylococcus epidermidis
KNLEQAKKAGIKAK

SEQ ID NO: 1766265 - protein, 9 aa, Staphylococcus epidermidis
KNLKSSKEV

SEQ ID NO: 1766266 - protein, 8 aa, Staphylococcus epidermidis
KNNKITQS

SEQ ID NO: 1766267 - protein, 6 aa, Staphylococcus epidermidis
KNNRDL

SEQ ID NO: 1766268 - protein, 17 aa, Staphylococcus epidermidis
KNNSQRRFTGASDSHCQ

SEQ ID NO: 1766269 - protein, 8 aa, Staphylococcus epidermidis
KNPVTEPD

SEQ ID NO: 1766270 - protein, 10 aa, Staphylococcus epidermidis
KNQPLGSETV

SEQ ID NO: 1766271 - protein, 6 aa, Staphylococcus epidermidis
KNRYGK

SEQ ID NO: 1766272 - protein, 7 aa, Staphylococcus epidermidis
KNSESQI

SEQ ID NO: 1766273 - protein, 6 aa, Staphylococcus epidermidis
KNSIND

SEQ ID NO: 1766274 - protein, 6 aa, Staphylococcus epidermidis
KNTGRP

SEQ ID NO: 1766275 - protein, 7 aa, Staphylococcus epidermidis
KNVDDLP

SEQ ID NO: 1766276 - protein, 10 aa, Staphylococcus epidermidis
KPGEVTPEQC

SEQ ID NO: 1766277 - protein, 4 aa, Staphylococcus epidermidis
KPVS

SEQ ID NO: 1766278 - protein, 14 aa, Staphylococcus epidermidis
KPYKLNNKDDVQRI

SEQ ID NO: 1766279 - protein, 12 aa, Staphylococcus epidermidis
KQDVTLENIDTS

SEQ ID NO: 1766280 - protein, 5 aa, Staphylococcus epidermidis
KQEAS

SEQ ID NO: 1766281 - protein, 7 aa, Staphylococcus epidermidis
KQEENTV

SEQ ID NO: 1766282 - protein, 8 aa, Staphylococcus epidermidis
KQIDSVEE

SEQ ID NO: 1766283 - protein, 8 aa, Staphylococcus epidermidis
KQLKPSLR

SEQ ID NO: 1766284 - protein, 7 aa, Staphylococcus epidermidis
KQMKSEN

SEQ ID NO: 1766285 - protein, 9 aa, Staphylococcus epidermidis
KQNGEKQRF

SEQ ID NO: 1766286 - protein, 8 aa, Staphylococcus epidermidis
KQQQYASE

SEQ ID NO: 1766287 - protein, 6 aa, Staphylococcus epidermidis
KQRTQY

SEQ ID NO: 1766288 - protein, 7 aa, Staphylococcus epidermidis
KQSRTSI

SEQ ID NO: 1766289 - protein, 7 aa, Staphylococcus epidermidis
KQTHQTK

SEQ ID NO: 1766290 - protein, 8 aa, Staphylococcus epidermidis
KQTKERNK

SEQ ID NO: 1766291 - protein, 19 aa, Staphylococcus epidermidis
KQYDKIEKGKHIKVKNGVV

SEQ ID NO: 1766292 - protein, 5 aa, Staphylococcus epidermidis
KRETA

SEQ ID NO: 1766293 - protein, 6 aa, Staphylococcus epidermidis
KRETIQ

SEQ ID NO: 1766294 - protein, 14 aa, Staphylococcus epidermidis
KRFNGNSRSTVGTV

SEQ ID NO: 1766295 - protein, 8 aa, Staphylococcus epidermidis
KRSKNNEE

SEQ ID NO: 1766296 - protein, 6 aa, Staphylococcus epidermidis
KRSNKV

SEQ ID NO: 1766297 - protein, 7 aa, Staphylococcus epidermidis
KRSVDGQ

SEQ ID NO: 1766298 - protein, 9 aa, Staphylococcus epidermidis
KRYSDENKQ

SEQ ID NO: 1766299 - protein, 7 aa, Staphylococcus epidermidis
KSAPTSL

SEQ ID NO: 1766300 - protein, 8 aa, Staphylococcus epidermidis
KSEDPEKF

SEQ ID NO: 1766301 - protein, 6 aa, Staphylococcus epidermidis
KSFGKG

SEQ ID NO: 1766302 - protein, 6 aa, Staphylococcus epidermidis
KSGKGI

SEQ ID NO: 1766303 - protein, 16 aa, Staphylococcus epidermidis
KSGLTGAGKKLNQSSH

SEQ ID NO: 1766304 - protein, 6 aa, Staphylococcus epidermidis
KSGYRD

SEQ ID NO: 1766305 - protein, 6 aa, Staphylococcus epidermidis
KSIKRH

SEQ ID NO: 1766306 - protein, 5 aa, Staphylococcus epidermidis
KSIQN

SEQ ID NO: 1766307 - protein, 9 aa, Staphylococcus epidermidis
KSISKNGGK

SEQ ID NO: 1766308 - protein, 7 aa, Staphylococcus epidermidis
KSKEQSL

SEQ ID NO: 1766309 - protein, 8 aa, Staphylococcus epidermidis
KSKRQGQS

SEQ ID NO: 1766310 - protein, 7 aa, Staphylococcus epidermidis
KSLNPRG

SEQ ID NO: 1766311 - protein, 5 aa, Staphylococcus epidermidis
KSLSN

SEQ ID NO: 1766312 - protein, 8 aa, Staphylococcus epidermidis
KSNTKGYA

SEQ ID NO: 1766313 - protein, 18 aa, Staphylococcus epidermidis
KSNYPFKYDENDKNFCKP

SEQ ID NO: 1766314 - protein, 8 aa, Staphylococcus epidermidis
KSQSIKDF

SEQ ID NO: 1766315 - protein, 9 aa, Staphylococcus epidermidis
KSQTPKRIK

SEQ ID NO: 1766316 - protein, 8 aa, Staphylococcus epidermidis
KSRDNLTE

SEQ ID NO: 1766317 - protein, 10 aa, Staphylococcus epidermidis
KSSGLTQTTG

SEQ ID NO: 1766318 - protein, 9 aa, Staphylococcus epidermidis
KSSKTNAKR

SEQ ID NO: 1766319 - protein, 12 aa, Staphylococcus epidermidis
KSTTTEDQTGDI

SEQ ID NO: 1766320 - protein, 4 aa, Staphylococcus epidermidis
KSVY

SEQ ID NO: 1766321 - protein, 9 aa, Staphylococcus epidermidis
KSYDKEQKY

SEQ ID NO: 1766322 - protein, 13 aa, Staphylococcus epidermidis
KSYFDTNENAKPL

SEQ ID NO: 1766323 - protein, 8 aa, Staphylococcus epidermidis
KTANAQQL

SEQ ID NO: 1766324 - protein, 7 aa, Staphylococcus epidermidis
KTASEQL

SEQ ID NO: 1766325 - protein, 8 aa, Staphylococcus epidermidis
KTDRDGAH

SEQ ID NO: 1766326 - protein, 7 aa, Staphylococcus epidermidis
KTEEAAA

SEQ ID NO: 1766327 - protein, 9 aa, Staphylococcus epidermidis
KTEKRYTKQ

SEQ ID NO: 1766328 - protein, 11 aa, Staphylococcus epidermidis
KTIKASKEAGI

SEQ ID NO: 1766329 - protein, 4 aa, Staphylococcus epidermidis
KTIQ

SEQ ID NO: 1766330 - protein, 6 aa, Staphylococcus epidermidis
KTKDGR

SEQ ID NO: 1766331 - protein, 22 aa, Staphylococcus epidermidis
KTKETLKYEQAKNNYQKLFERV

SEQ ID NO: 1766332 - protein, 10 aa, Staphylococcus epidermidis
KTKNRQFDED

SEQ ID NO: 1766333 - protein, 7 aa, Staphylococcus epidermidis
KTKQGKR

SEQ ID NO: 1766334 - protein, 12 aa, Staphylococcus epidermidis
KTQIETIKNILE

SEQ ID NO: 1766335 - protein, 9 aa, Staphylococcus epidermidis
KTQNEATPF

SEQ ID NO: 1766336 - protein, 8 aa, Staphylococcus epidermidis
KTSQTLKQ

SEQ ID NO: 1766337 - protein, 16 aa, Staphylococcus epidermidis
KTTTGISAHERTQTAR

SEQ ID NO: 1766338 - protein, 7 aa, Staphylococcus epidermidis
KVDKKTY

SEQ ID NO: 1766339 - protein, 8 aa, Staphylococcus epidermidis
KVDKTTQS

SEQ ID NO: 1766340 - protein, 17 aa, Staphylococcus epidermidis
KVEQQTTKVNGKFTSSF

SEQ ID NO: 1766341 - protein, 27 aa, Staphylococcus epidermidis
KVNEEDDNEENADEAQQSTTTETADVE

SEQ ID NO: 1766342 - protein, 10 aa, Staphylococcus epidermidis
KVNGQTVTEL

SEQ ID NO: 1766343 - protein, 17 aa, Staphylococcus epidermidis
KVNPAKIKSKGVKSVRK

SEQ ID NO: 1766344 - protein, 7 aa, Staphylococcus epidermidis
KVPTSDV

SEQ ID NO: 1766345 - protein, 6 aa, Staphylococcus epidermidis
KVTESN

SEQ ID NO: 1766346 - protein, 14 aa, Staphylococcus epidermidis
KWRQQDYKKAAEYY

SEQ ID NO: 1766347 - protein, 10 aa, Staphylococcus epidermidis
KYEESTIPAV

SEQ ID NO: 1766348 - protein, 6 aa, Staphylococcus epidermidis
KYHPDE

SEQ ID NO: 1766349 - protein, 8 aa, Staphylococcus epidermidis
KYKDSHNE

SEQ ID NO: 1766350 - protein, 12 aa, Staphylococcus epidermidis
KYPKPDKGSTNK

SEQ ID NO: 1766351 - protein, 6 aa, Staphylococcus epidermidis
KYQGEY

SEQ ID NO: 1766352 - protein, 13 aa, Staphylococcus epidermidis
KYTPQPPRSLGNK

SEQ ID NO: 1766353 - protein, 15 aa, Staphylococcus epidermidis
LAGEGSPGVNGGPHG

SEQ ID NO: 1766354 - protein, 4 aa, Staphylococcus epidermidis
LANE

SEQ ID NO: 1766355 - protein, 5 aa, Staphylococcus epidermidis
LAQAG

SEQ ID NO: 1766356 - protein, 14 aa, Staphylococcus epidermidis
LAQTGRLSSIDPNL

SEQ ID NO: 1766357 - protein, 22 aa, Staphylococcus epidermidis
LARKKKEHGLTNEEAKEQTKLR

SEQ ID NO: 1766358 - protein, 5 aa, Staphylococcus epidermidis
LASEQ

SEQ ID NO: 1766359 - protein, 4 aa, Staphylococcus epidermidis
LDDK

SEQ ID NO: 1766360 - protein, 17 aa, Staphylococcus epidermidis
LDEKKQQDFIRWLKSQV

SEQ ID NO: 1766361 - protein, 6 aa, Staphylococcus epidermidis
LDPETE

SEQ ID NO: 1766362 - protein, 6 aa, Staphylococcus epidermidis
LDQKRN

SEQ ID NO: 1766363 - protein, 5 aa, Staphylococcus epidermidis
LDQPI

SEQ ID NO: 1766364 - protein, 7 aa, Staphylococcus epidermidis
LDSAEGY

SEQ ID NO: 1766365 - protein, 7 aa, Staphylococcus epidermidis
LDTTSDV

SEQ ID NO: 1766366 - protein, 13 aa, Staphylococcus epidermidis
LEDKYRSEAWMYR

SEQ ID NO: 1766367 - protein, 6 aa, Staphylococcus epidermidis
LEEKGL

SEQ ID NO: 1766368 - protein, 9 aa, Staphylococcus epidermidis
LEEQKGNRI

SEQ ID NO: 1766369 - protein, 14 aa, Staphylococcus epidermidis
LEETGDLKIPQAEG

SEQ ID NO: 1766370 - protein, 11 aa, Staphylococcus epidermidis
LEGLPKDENNY

SEQ ID NO: 1766371 - protein, 8 aa, Staphylococcus epidermidis
LELESGDN

SEQ ID NO: 1766372 - protein, 4 aa, Staphylococcus epidermidis
LEMS

SEQ ID NO: 1766373 - protein, 10 aa, Staphylococcus epidermidis
LENSSNEDEY

SEQ ID NO: 1766374 - protein, 24 aa, Staphylococcus epidermidis
LEQDTSESLRITENSGISFIYTLE

SEQ ID NO: 1766375 - protein, 12 aa, Staphylococcus epidermidis
LEQKADKNLKDS

SEQ ID NO: 1766376 - protein, 7 aa, Staphylococcus epidermidis
LEQSQLK

SEQ ID NO: 1766377 - protein, 17 aa, Staphylococcus epidermidis
LESQIDSIKNEKAQNEK

SEQ ID NO: 1766378 - protein, 10 aa, Staphylococcus epidermidis
LFGNDSRKDF

SEQ ID NO: 1766379 - protein, 12 aa, Staphylococcus epidermidis
LGGTTHGVPRED

SEQ ID NO: 1766380 - protein, 8 aa, Staphylococcus epidermidis
LGNTEENT

SEQ ID NO: 1766381 - protein, 5 aa, Staphylococcus epidermidis
LGPNS

SEQ ID NO: 1766382 - protein, 5 aa, Staphylococcus epidermidis
LHPED

SEQ ID NO: 1766383 - protein, 6 aa, Staphylococcus epidermidis
LKDNGY

SEQ ID NO: 1766384 - protein, 6 aa, Staphylococcus epidermidis
LKEDED

SEQ ID NO: 1766385 - protein, 10 aa, Staphylococcus epidermidis
LKGGDKDPYR

SEQ ID NO: 1766386 - protein, 10 aa, Staphylococcus epidermidis
LKGKAAHSEL

SEQ ID NO: 1766387 - protein, 13 aa, Staphylococcus epidermidis
LKISGGDVGGSKN

SEQ ID NO: 1766388 - protein, 8 aa, Staphylococcus epidermidis
LKKDKDEL

SEQ ID NO: 1766389 - protein, 10 aa, Staphylococcus epidermidis
LKKEKTEYSR

SEQ ID NO: 1766390 - protein, 7 aa, Staphylococcus epidermidis
LKPKEVD

SEQ ID NO: 1766391 - protein, 11 aa, Staphylococcus epidermidis
LKTRKENEVKD

SEQ ID NO: 1766392 - protein, 11 aa, Staphylococcus epidermidis
LMPGGVNSPVR

SEQ ID NO: 1766393 - protein, 19 aa, Staphylococcus epidermidis
LNDNTPKKEEFDTNESIEV

SEQ ID NO: 1766394 - protein, 8 aa, Staphylococcus epidermidis
LNDTVRAD

SEQ ID NO: 1766395 - protein, 8 aa, Staphylococcus epidermidis
LNGQGSEV

SEQ ID NO: 1766396 - protein, 10 aa, Staphylococcus epidermidis
LNQNDAANEL

SEQ ID NO: 1766397 - protein, 5 aa, Staphylococcus epidermidis
LPEAL

SEQ ID NO: 1766398 - protein, 8 aa, Staphylococcus epidermidis
LPEPSRAQ

SEQ ID NO: 1766399 - protein, 16 aa, Staphylococcus epidermidis
LPEQNNKMIEVLKHFE

SEQ ID NO: 1766400 - protein, 14 aa, Staphylococcus epidermidis
LPFGGVGSSGIGQY

SEQ ID NO: 1766401 - protein, 4 aa, Staphylococcus epidermidis
LPGQ

SEQ ID NO: 1766402 - protein, 9 aa, Staphylococcus epidermidis
LPHAPSAQL

SEQ ID NO: 1766403 - protein, 5 aa, Staphylococcus epidermidis
LPIEE

SEQ ID NO: 1766404 - protein, 6 aa, Staphylococcus epidermidis
LPKETS

SEQ ID NO: 1766405 - protein, 4 aa, Staphylococcus epidermidis
LPND

SEQ ID NO: 1766406 - protein, 4 aa, Staphylococcus epidermidis
LPQA

SEQ ID NO: 1766407 - protein, 6 aa, Staphylococcus epidermidis
LPQASS

SEQ ID NO: 1766408 - protein, 6 aa, Staphylococcus epidermidis
LPTNNQ

SEQ ID NO: 1766409 - protein, 4 aa, Staphylococcus epidermidis
LQKQ

SEQ ID NO: 1766410 - protein, 5 aa, Staphylococcus epidermidis
LQNQT

SEQ ID NO: 1766411 - protein, 7 aa, Staphylococcus epidermidis
LQPFNPE

SEQ ID NO: 1766412 - protein, 18 aa, Staphylococcus epidermidis
LQQKRQQNQQSEEDSIQK

SEQ ID NO: 1766413 - protein, 7 aa, Staphylococcus epidermidis
LQRQTLS

SEQ ID NO: 1766414 - protein, 8 aa, Staphylococcus epidermidis
LRDYGTGH

SEQ ID NO: 1766415 - protein, 13 aa, Staphylococcus epidermidis
LRGAKAAAKQIDP

SEQ ID NO: 1766416 - protein, 18 aa, Staphylococcus epidermidis
LRSKDEIDDFVTKAGELN

SEQ ID NO: 1766417 - protein, 7 aa, Staphylococcus epidermidis
LRTTGGR

SEQ ID NO: 1766418 - protein, 8 aa, Staphylococcus epidermidis
LSEANEDE

SEQ ID NO: 1766419 - protein, 12 aa, Staphylococcus epidermidis
LSENTKKLKAEK

SEQ ID NO: 1766420 - protein, 7 aa, Staphylococcus epidermidis
LSEQYRS

SEQ ID NO: 1766421 - protein, 6 aa, Staphylococcus epidermidis
LSESDQ

SEQ ID NO: 1766422 - protein, 11 aa, Staphylococcus epidermidis
LSKITDMTDRS

SEQ ID NO: 1766423 - protein, 11 aa, Staphylococcus epidermidis
LSKSEIKRKVT

SEQ ID NO: 1766424 - protein, 9 aa, Staphylococcus epidermidis
LSKSRETYH

SEQ ID NO: 1766425 - protein, 21 aa, Staphylococcus epidermidis
LSNASEKVATASSLSKEEVKE

SEQ ID NO: 1766426 - protein, 5 aa, Staphylococcus epidermidis
LSPQL

SEQ ID NO: 1766427 - protein, 12 aa, Staphylococcus epidermidis
LSPTDKRLKSDK

SEQ ID NO: 1766428 - protein, 10 aa, Staphylococcus epidermidis
LSQNSSDELK

SEQ ID NO: 1766429 - protein, 9 aa, Staphylococcus epidermidis
LSSEGLAKE

SEQ ID NO: 1766430 - protein, 8 aa, Staphylococcus epidermidis
LTDEAASE

SEQ ID NO: 1766431 - protein, 6 aa, Staphylococcus epidermidis
LTENDI

SEQ ID NO: 1766432 - protein, 14 aa, Staphylococcus epidermidis
LTHKQQKEIEEQIK

SEQ ID NO: 1766433 - protein, 21 aa, Staphylococcus epidermidis
LTPDQSKSIDEIKGDMERARP

SEQ ID NO: 1766434 - protein, 6 aa, Staphylococcus epidermidis
LTPEKD

SEQ ID NO: 1766435 - protein, 17 aa, Staphylococcus epidermidis
LTSNGKLDRKKIAEVVN

SEQ ID NO: 1766436 - protein, 19 aa, Staphylococcus epidermidis
LTSTTERQLHEEQNIQTSI

SEQ ID NO: 1766437 - protein, 10 aa, Staphylococcus epidermidis
LTTDTPLNAH

SEQ ID NO: 1766438 - protein, 14 aa, Staphylococcus epidermidis
LVEQKQQEKQKALY

SEQ ID NO: 1766439 - protein, 11 aa, Staphylococcus epidermidis
LVKADDKDNVI

SEQ ID NO: 1766440 - protein, 6 aa, Staphylococcus epidermidis
LVKEGK

SEQ ID NO: 1766441 - protein, 4 aa, Staphylococcus epidermidis
LVSQ

SEQ ID NO: 1766442 - protein, 9 aa, Staphylococcus epidermidis
MANDPKDFE

SEQ ID NO: 1766443 - protein, 10 aa, Staphylococcus epidermidis
MATKKEGKMY

SEQ ID NO: 1766444 - protein, 6 aa, Staphylococcus epidermidis
MDDDRD

SEQ ID NO: 1766445 - protein, 12 aa, Staphylococcus epidermidis
MEYDSDETIDNL

SEQ ID NO: 1766446 - protein, 4 aa, Staphylococcus epidermidis
MKPH

SEQ ID NO: 1766447 - protein, 10 aa, Staphylococcus epidermidis
MKPKSKKQAK

SEQ ID NO: 1766448 - protein, 6 aa, Staphylococcus epidermidis
MNDTKT

SEQ ID NO: 1766449 - protein, 9 aa, Staphylococcus epidermidis
MNEDKAQAK

SEQ ID NO: 1766450 - protein, 6 aa, Staphylococcus epidermidis
MNENDS

SEQ ID NO: 1766451 - protein, 9 aa, Staphylococcus epidermidis
MNKASEQLD

SEQ ID NO: 1766452 - protein, 20 aa, Staphylococcus epidermidis
MNKPQLTSNESQESAKDELT

SEQ ID NO: 1766453 - protein, 12 aa, Staphylococcus epidermidis
MPDEEKDKRGID

SEQ ID NO: 1766454 - protein, 6 aa, Staphylococcus epidermidis
MPGSVT

SEQ ID NO: 1766455 - protein, 7 aa, Staphylococcus epidermidis
MPPTGGL

SEQ ID NO: 1766456 - protein, 9 aa, Staphylococcus epidermidis
MRSKGNNEL

SEQ ID NO: 1766457 - protein, 12 aa, Staphylococcus epidermidis
MSGSKSKRPGLD

SEQ ID NO: 1766458 - protein, 13 aa, Staphylococcus epidermidis
MSSNEKNALDEKV

SEQ ID NO: 1766459 - protein, 17 aa, Staphylococcus epidermidis
MSSNTYPTFQDEPSKQQ

SEQ ID NO: 1766460 - protein, 12 aa, Staphylococcus epidermidis
MTSDFDSKEIEK

SEQ ID NO: 1766461 - protein, 11 aa, Staphylococcus epidermidis
MYKGTDEIDGA

SEQ ID NO: 1766462 - protein, 13 aa, Staphylococcus epidermidis
NAAHYGASKAGFS

SEQ ID NO: 1766463 - protein, 7 aa, Staphylococcus epidermidis
NAAVGDS

SEQ ID NO: 1766464 - protein, 6 aa, Staphylococcus epidermidis
NADLDK

SEQ ID NO: 1766465 - protein, 9 aa, Staphylococcus epidermidis
NADSTFNDS

SEQ ID NO: 1766466 - protein, 16 aa, Staphylococcus epidermidis
NAENPEKNFLPTPGKV

SEQ ID NO: 1766467 - protein, 8 aa, Staphylococcus epidermidis
NAEPDKYI

SEQ ID NO: 1766468 - protein, 12 aa, Staphylococcus epidermidis
NAGMSSKSIEAA

SEQ ID NO: 1766469 - protein, 13 aa, Staphylococcus epidermidis
NAIQNNIENSKEI

SEQ ID NO: 1766470 - protein, 10 aa, Staphylococcus epidermidis
NDAQTENKGH

SEQ ID NO: 1766471 - protein, 15 aa, Staphylococcus epidermidis
NDDDYITSTHRGHGH

SEQ ID NO: 1766472 - protein, 6 aa, Staphylococcus epidermidis
NDEEIK

SEQ ID NO: 1766473 - protein, 6 aa, Staphylococcus epidermidis
NDFKNK

SEQ ID NO: 1766474 - protein, 4 aa, Staphylococcus epidermidis
NDGR

SEQ ID NO: 1766475 - protein, 5 aa, Staphylococcus epidermidis
NDHAQ

SEQ ID NO: 1766476 - protein, 12 aa, Staphylococcus epidermidis
NDIDEEVKKQAI

SEQ ID NO: 1766477 - protein, 4 aa, Staphylococcus epidermidis
NDKD

SEQ ID NO: 1766478 - protein, 15 aa, Staphylococcus epidermidis
NDKDDIGSGAYDHNG

SEQ ID NO: 1766479 - protein, 5 aa, Staphylococcus epidermidis
NDLNY

SEQ ID NO: 1766480 - protein, 4 aa, Staphylococcus epidermidis
NDNT

SEQ ID NO: 1766481 - protein, 20 aa, Staphylococcus epidermidis
NDNTETNTTPMERVGEPEEL

SEQ ID NO: 1766482 - protein, 34 aa, Staphylococcus epidermidis
NDQLKKDEKNGDITEDDLRSQTDDVQKATDNSIK

SEQ ID NO: 1766483 - protein, 9 aa, Staphylococcus epidermidis
NDSKVEKKL

SEQ ID NO: 1766484 - protein, 14 aa, Staphylococcus epidermidis
NDTLIGGSPQTNKQ

SEQ ID NO: 1766485 - protein, 10 aa, Staphylococcus epidermidis
NDVEAKETDT

SEQ ID NO: 1766486 - protein, 17 aa, Staphylococcus epidermidis
NEATKSAEAAPYPSEEE

SEQ ID NO: 1766487 - protein, 9 aa, Staphylococcus epidermidis
NEDDSTQTA

SEQ ID NO: 1766488 - protein, 17 aa, Staphylococcus epidermidis
NEDKSSINQNDLTDKEL

SEQ ID NO: 1766489 - protein, 9 aa, Staphylococcus epidermidis
NEESLKQAT

SEQ ID NO: 1766490 - protein, 20 aa, Staphylococcus epidermidis
NEETVGQGIKEGLESTGLSR

SEQ ID NO: 1766491 - protein, 13 aa, Staphylococcus epidermidis
NEEVVQNNDPEYL

SEQ ID NO: 1766492 - protein, 4 aa, Staphylococcus epidermidis
NEFD

SEQ ID NO: 1766493 - protein, 7 aa, Staphylococcus epidermidis
NEGLKNE

SEQ ID NO: 1766494 - protein, 11 aa, Staphylococcus epidermidis
NEHQQNRDVTG

SEQ ID NO: 1766495 - protein, 10 aa, Staphylococcus epidermidis
NEKRQQIKDE

SEQ ID NO: 1766496 - protein, 7 aa, Staphylococcus epidermidis
NEKTKTG

SEQ ID NO: 1766497 - protein, 10 aa, Staphylococcus epidermidis
NELTTDEFRE

SEQ ID NO: 1766498 - protein, 6 aa, Staphylococcus epidermidis
NEMSQS

SEQ ID NO: 1766499 - protein, 5 aa, Staphylococcus epidermidis
NEPQF

SEQ ID NO: 1766500 - protein, 4 aa, Staphylococcus epidermidis
NERQ

SEQ ID NO: 1766501 - protein, 11 aa, Staphylococcus epidermidis
NETRDALEQSY

SEQ ID NO: 1766502 - protein, 12 aa, Staphylococcus epidermidis
NEVNAKEKEKIQ

SEQ ID NO: 1766503 - protein, 9 aa, Staphylococcus epidermidis
NFEEGTSVK

SEQ ID NO: 1766504 - protein, 10 aa, Staphylococcus epidermidis
NFSPEDPNYD

SEQ ID NO: 1766505 - protein, 12 aa, Staphylococcus epidermidis
NGEISERVKDAR

SEQ ID NO: 1766506 - protein, 9 aa, Staphylococcus epidermidis
NGEPAKVDD

SEQ ID NO: 1766507 - protein, 6 aa, Staphylococcus epidermidis
NGITNK

SEQ ID NO: 1766508 - protein, 9 aa, Staphylococcus epidermidis
NGKRLYSDN

SEQ ID NO: 1766509 - protein, 7 aa, Staphylococcus epidermidis
NGKSVAN

SEQ ID NO: 1766510 - protein, 7 aa, Staphylococcus epidermidis
NGLSDTM

SEQ ID NO: 1766511 - protein, 5 aa, Staphylococcus epidermidis
NGLTT

SEQ ID NO: 1766512 - protein, 14 aa, Staphylococcus epidermidis
NGNQNVKPETRNKV

SEQ ID NO: 1766513 - protein, 20 aa, Staphylococcus epidermidis
NGNYNDQYERYATKQEDIVN

SEQ ID NO: 1766514 - protein, 9 aa, Staphylococcus epidermidis
NGRASTSGY

SEQ ID NO: 1766515 - protein, 11 aa, Staphylococcus epidermidis
NGRGSDKETRH

SEQ ID NO: 1766516 - protein, 5 aa, Staphylococcus epidermidis
NGTEL

SEQ ID NO: 1766517 - protein, 7 aa, Staphylococcus epidermidis
NHASKGK

SEQ ID NO: 1766518 - protein, 5 aa, Staphylococcus epidermidis
NHGPA

SEQ ID NO: 1766519 - protein, 6 aa, Staphylococcus epidermidis
NHKEDL

SEQ ID NO: 1766520 - protein, 9 aa, Staphylococcus epidermidis
NHLPDEKEK

SEQ ID NO: 1766521 - protein, 4 aa, Staphylococcus epidermidis
NHSA

SEQ ID NO: 1766522 - protein, 7 aa, Staphylococcus epidermidis
NHTPSSI

SEQ ID NO: 1766523 - protein, 8 aa, Staphylococcus epidermidis
NHTSEKKK

SEQ ID NO: 1766524 - protein, 21 aa, Staphylococcus epidermidis
NIDGSKDIDEVTNDVIDILDH

SEQ ID NO: 1766525 - protein, 10 aa, Staphylococcus epidermidis
NIKSDEGTAV

SEQ ID NO: 1766526 - protein, 7 aa, Staphylococcus epidermidis
NINSPGQ

SEQ ID NO: 1766527 - protein, 10 aa, Staphylococcus epidermidis
NIPTARDESV

SEQ ID NO: 1766528 - protein, 7 aa, Staphylococcus epidermidis
NKAIEGA

SEQ ID NO: 1766529 - protein, 11 aa, Staphylococcus epidermidis
NKASSQKQTRV

SEQ ID NO: 1766530 - protein, 5 aa, Staphylococcus epidermidis
NKDGI

SEQ ID NO: 1766531 - protein, 11 aa, Staphylococcus epidermidis
NKEITKRVAEA

SEQ ID NO: 1766532 - protein, 7 aa, Staphylococcus epidermidis
NKEQDDV

SEQ ID NO: 1766533 - protein, 7 aa, Staphylococcus epidermidis
NKETTLK

SEQ ID NO: 1766534 - protein, 17 aa, Staphylococcus epidermidis
NKGTEDFKKEATRRFTT

SEQ ID NO: 1766535 - protein, 8 aa, Staphylococcus epidermidis
NKITEDSR

SEQ ID NO: 1766536 - protein, 19 aa, Staphylococcus epidermidis
NKITSEAATELPLTQRYFL

SEQ ID NO: 1766537 - protein, 5 aa, Staphylococcus epidermidis
NKKDI

SEQ ID NO: 1766538 - protein, 5 aa, Staphylococcus epidermidis
NKKET

SEQ ID NO: 1766539 - protein, 7 aa, Staphylococcus epidermidis
NKKQNLS

SEQ ID NO: 1766540 - protein, 7 aa, Staphylococcus epidermidis
NKMNEVE

SEQ ID NO: 1766541 - protein, 10 aa, Staphylococcus epidermidis
NKMSEKDPKL

SEQ ID NO: 1766542 - protein, 7 aa, Staphylococcus epidermidis
NKNKETD

SEQ ID NO: 1766543 - protein, 4 aa, Staphylococcus epidermidis
NKNS

SEQ ID NO: 1766544 - protein, 6 aa, Staphylococcus epidermidis
NKNTEN

SEQ ID NO: 1766545 - protein, 9 aa, Staphylococcus epidermidis
NKRDEYKES

SEQ ID NO: 1766546 - protein, 16 aa, Staphylococcus epidermidis
NKSASKDEIKKAYRKL

SEQ ID NO: 1766547 - protein, 9 aa, Staphylococcus epidermidis
NKSNEQALK

SEQ ID NO: 1766548 - protein, 11 aa, Staphylococcus epidermidis
NKTEESVETHL

SEQ ID NO: 1766549 - protein, 7 aa, Staphylococcus epidermidis
NKTFKDK

SEQ ID NO: 1766550 - protein, 10 aa, Staphylococcus epidermidis
NKTKESGKRV

SEQ ID NO: 1766551 - protein, 16 aa, Staphylococcus epidermidis
NKTQDQSSYETSKAGV

SEQ ID NO: 1766552 - protein, 10 aa, Staphylococcus epidermidis
NKTTSYENRY

SEQ ID NO: 1766553 - protein, 18 aa, Staphylococcus epidermidis
NKYPSEISGGQQQRTAAA

SEQ ID NO: 1766554 - protein, 13 aa, Staphylococcus epidermidis
NLATGEKVEVGEA

SEQ ID NO: 1766555 - protein, 7 aa, Staphylococcus epidermidis
NLNNEAS

SEQ ID NO: 1766556 - protein, 14 aa, Staphylococcus epidermidis
NLTGRTIKDTTSDI

SEQ ID NO: 1766557 - protein, 4 aa, Staphylococcus epidermidis
NNDV

SEQ ID NO: 1766558 - protein, 6 aa, Staphylococcus epidermidis
NNELDS

SEQ ID NO: 1766559 - protein, 5 aa, Staphylococcus epidermidis
NNGGG

SEQ ID NO: 1766560 - protein, 6 aa, Staphylococcus epidermidis
NNGISD

SEQ ID NO: 1766561 - protein, 10 aa, Staphylococcus epidermidis
NNIDVTTSTE

SEQ ID NO: 1766562 - protein, 6 aa, Staphylococcus epidermidis
NNISPC

SEQ ID NO: 1766563 - protein, 8 aa, Staphylococcus epidermidis
NNKTGANV

SEQ ID NO: 1766564 - protein, 9 aa, Staphylococcus epidermidis
NNLDDDIQQ

SEQ ID NO: 1766565 - protein, 5 aa, Staphylococcus epidermidis
NNLNA

SEQ ID NO: 1766566 - protein, 42 aa, Staphylococcus epidermidis
NNNDLIQNSQERQSKISDQQIKNSKKLNKKEVSIQKDNTKET

SEQ ID NO: 1766567 - protein, 9 aa, Staphylococcus epidermidis
NNNKNDKGN

SEQ ID NO: 1766568 - protein, 9 aa, Staphylococcus epidermidis
NNPETVSTD

SEQ ID NO: 1766569 - protein, 8 aa, Staphylococcus epidermidis
NNQNTDEF

SEQ ID NO: 1766570 - protein, 15 aa, Staphylococcus epidermidis
NNREQNRLDKEEKAF

SEQ ID NO: 1766571 - protein, 12 aa, Staphylococcus epidermidis
NNRLNQDANKLA

SEQ ID NO: 1766572 - protein, 10 aa, Staphylococcus epidermidis
NNSTKTPVQV

SEQ ID NO: 1766573 - protein, 5 aa, Staphylococcus epidermidis
NNTDG

SEQ ID NO: 1766574 - protein, 11 aa, Staphylococcus epidermidis
NNVNRTASDVR

SEQ ID NO: 1766575 - protein, 5 aa, Staphylococcus epidermidis
NNVYK

SEQ ID NO: 1766576 - protein, 12 aa, Staphylococcus epidermidis
NPAPNKQDIENS

SEQ ID NO: 1766577 - protein, 11 aa, Staphylococcus epidermidis
NPATKEVTTKF

SEQ ID NO: 1766578 - protein, 5 aa, Staphylococcus epidermidis
NPECN

SEQ ID NO: 1766579 - protein, 8 aa, Staphylococcus epidermidis
NPFGPGQL

SEQ ID NO: 1766580 - protein, 12 aa, Staphylococcus epidermidis
NPKKDDQRTLGD

SEQ ID NO: 1766581 - protein, 13 aa, Staphylococcus epidermidis
NPNIDKKKKDARE

SEQ ID NO: 1766582 - protein, 8 aa, Staphylococcus epidermidis
NPNPIDNQ

SEQ ID NO: 1766583 - protein, 14 aa, Staphylococcus epidermidis
NPQHSRTENFLSRV

SEQ ID NO: 1766584 - protein, 10 aa, Staphylococcus epidermidis
NQAEKEDKTF

SEQ ID NO: 1766585 - protein, 8 aa, Staphylococcus epidermidis
NQATGHTG

SEQ ID NO: 1766586 - protein, 7 aa, Staphylococcus epidermidis
NQDSGYF

SEQ ID NO: 1766587 - protein, 4 aa, Staphylococcus epidermidis
NQDV

SEQ ID NO: 1766588 - protein, 7 aa, Staphylococcus epidermidis
NQEVSAE

SEQ ID NO: 1766589 - protein, 6 aa, Staphylococcus epidermidis
NQGSLD

SEQ ID NO: 1766590 - protein, 83 aa, Staphylococcus epidermidis
NQHDNPEFDSSGKRHRRRRQAYSKHDQSKITQQKQFADNNYTNNNSVFNQNDNKKSSQQRKSIQSENIKNKANTKNTSTSPEF

SEQ ID NO: 1766591 - protein, 4 aa, Staphylococcus epidermidis
NQIE

SEQ ID NO: 1766592 - protein, 6 aa, Staphylococcus epidermidis
NQKDQD

SEQ ID NO: 1766593 - protein, 18 aa, Staphylococcus epidermidis
NQLNKEGKDAEVTFGINH

SEQ ID NO: 1766594 - protein, 14 aa, Staphylococcus epidermidis
NQLPSHITKEKAQE

SEQ ID NO: 1766595 - protein, 6 aa, Staphylococcus epidermidis
NQPYQR

SEQ ID NO: 1766596 - protein, 15 aa, Staphylococcus epidermidis
NQSQTDEVSSSSDPF

SEQ ID NO: 1766597 - protein, 13 aa, Staphylococcus epidermidis
NQSQTDFNTPLVR

SEQ ID NO: 1766598 - protein, 9 aa, Staphylococcus epidermidis
NQTKYDGKP

SEQ ID NO: 1766599 - protein, 11 aa, Staphylococcus epidermidis
NQVKSTLENRG

SEQ ID NO: 1766600 - protein, 5 aa, Staphylococcus epidermidis
NQVND

SEQ ID NO: 1766601 - protein, 7 aa, Staphylococcus epidermidis
NQVSNTI

SEQ ID NO: 1766602 - protein, 18 aa, Staphylococcus epidermidis
NQYKNKRKELEELESADQ

SEQ ID NO: 1766603 - protein, 10 aa, Staphylococcus epidermidis
NQYQQDKTIQ

SEQ ID NO: 1766604 - protein, 16 aa, Staphylococcus epidermidis
NRAKATYKFAGGKGIN

SEQ ID NO: 1766605 - protein, 21 aa, Staphylococcus epidermidis
NRDDQEENKEINDDTLEEDRQ

SEQ ID NO: 1766606 - protein, 9 aa, Staphylococcus epidermidis
NRHKDNGSL

SEQ ID NO: 1766607 - protein, 15 aa, Staphylococcus epidermidis
NRKGFEVSAQSAKDN

SEQ ID NO: 1766608 - protein, 18 aa, Staphylococcus epidermidis
NRRRKKLTSVDKENVLSS

SEQ ID NO: 1766609 - protein, 7 aa, Staphylococcus epidermidis
NRSNITN

SEQ ID NO: 1766610 - protein, 20 aa, Staphylococcus epidermidis
NRSRQKTDEMVKESPGREIY

SEQ ID NO: 1766611 - protein, 8 aa, Staphylococcus epidermidis
NRSVDDNA

SEQ ID NO: 1766612 - protein, 6 aa, Staphylococcus epidermidis
NSEDQS

SEQ ID NO: 1766613 - protein, 4 aa, Staphylococcus epidermidis
NSGG

SEQ ID NO: 1766614 - protein, 10 aa, Staphylococcus epidermidis
NSKDTLKQFS

SEQ ID NO: 1766615 - protein, 6 aa, Staphylococcus epidermidis
NSQRYT

SEQ ID NO: 1766616 - protein, 10 aa, Staphylococcus epidermidis
NSRTQNSSVQ

SEQ ID NO: 1766617 - protein, 10 aa, Staphylococcus epidermidis
NTGSRANIPD

SEQ ID NO: 1766618 - protein, 7 aa, Staphylococcus epidermidis
NTGTTGT

SEQ ID NO: 1766619 - protein, 10 aa, Staphylococcus epidermidis
NTKSVKPNAQ

SEQ ID NO: 1766620 - protein, 15 aa, Staphylococcus epidermidis
NTNELNASYAADGYA

SEQ ID NO: 1766621 - protein, 5 aa, Staphylococcus epidermidis
NTTLQ

SEQ ID NO: 1766622 - protein, 15 aa, Staphylococcus epidermidis
NTVSAAQAEDGAELA

SEQ ID NO: 1766623 - protein, 21 aa, Staphylococcus epidermidis
NVEKRPKPEYESTKIPKISQK

SEQ ID NO: 1766624 - protein, 7 aa, Staphylococcus epidermidis
NVGPNGI

SEQ ID NO: 1766625 - protein, 18 aa, Staphylococcus epidermidis
NVKTVDDSKKIREQFNKP

SEQ ID NO: 1766626 - protein, 5 aa, Staphylococcus epidermidis
NVTSD

SEQ ID NO: 1766627 - protein, 9 aa, Staphylococcus epidermidis
NVVGSGDGV

SEQ ID NO: 1766628 - protein, 5 aa, Staphylococcus epidermidis
NYEAQ

SEQ ID NO: 1766629 - protein, 5 aa, Staphylococcus epidermidis
NYPNR

SEQ ID NO: 1766630 - protein, 5 aa, Staphylococcus epidermidis
NYQGQ

SEQ ID NO: 1766631 - protein, 13 aa, Staphylococcus epidermidis
PAMDNDDYRRGKL

SEQ ID NO: 1766632 - protein, 14 aa, Staphylococcus epidermidis
PANDIKGKQQLSGV

SEQ ID NO: 1766633 - protein, 16 aa, Staphylococcus epidermidis
PARSDKENEARKEVEK

SEQ ID NO: 1766634 - protein, 7 aa, Staphylococcus epidermidis
PDEIQSA

SEQ ID NO: 1766635 - protein, 18 aa, Staphylococcus epidermidis
PDGSDNPDFNPNKPKYHG

SEQ ID NO: 1766636 - protein, 8 aa, Staphylococcus epidermidis
PDKSRLDG

SEQ ID NO: 1766637 - protein, 5 aa, Staphylococcus epidermidis
PDPNI

SEQ ID NO: 1766638 - protein, 6 aa, Staphylococcus epidermidis
PDRAAQ

SEQ ID NO: 1766639 - protein, 10 aa, Staphylococcus epidermidis
PDSPDKREDH

SEQ ID NO: 1766640 - protein, 6 aa, Staphylococcus epidermidis
PDTTYT

SEQ ID NO: 1766641 - protein, 5 aa, Staphylococcus epidermidis
PDYTV

SEQ ID NO: 1766642 - protein, 8 aa, Staphylococcus epidermidis
PEDGSLEL

SEQ ID NO: 1766643 - protein, 7 aa, Staphylococcus epidermidis
PEDKLSK

SEQ ID NO: 1766644 - protein, 5 aa, Staphylococcus epidermidis
PEDTE

SEQ ID NO: 1766645 - protein, 4 aa, Staphylococcus epidermidis
PEFS

SEQ ID NO: 1766646 - protein, 17 aa, Staphylococcus epidermidis
PEGPKYYPDNQISDHPE

SEQ ID NO: 1766647 - protein, 20 aa, Staphylococcus epidermidis
PEQFKNRKPDELSGGQRQRV

SEQ ID NO: 1766648 - protein, 4 aa, Staphylococcus epidermidis
PETE

SEQ ID NO: 1766649 - protein, 12 aa, Staphylococcus epidermidis
PFGEEGQQKLSS

SEQ ID NO: 1766650 - protein, 12 aa, Staphylococcus epidermidis
PFKPEVEPQKNV

SEQ ID NO: 1766651 - protein, 18 aa, Staphylococcus epidermidis
PFPDKTKFETKGESKSLA

SEQ ID NO: 1766652 - protein, 10 aa, Staphylococcus epidermidis
PGAGGTESQD

SEQ ID NO: 1766653 - protein, 23 aa, Staphylococcus epidermidis
PGEKDTTHFSTENASGSTSQAAN

SEQ ID NO: 1766654 - protein, 6 aa, Staphylococcus epidermidis
PGFGGQ

SEQ ID NO: 1766655 - protein, 7 aa, Staphylococcus epidermidis
PGKEEMD

SEQ ID NO: 1766656 - protein, 12 aa, Staphylococcus epidermidis
PGKPFGENGNQY

SEQ ID NO: 1766657 - protein, 8 aa, Staphylococcus epidermidis
PGQKAEDI

SEQ ID NO: 1766658 - protein, 21 aa, Staphylococcus epidermidis
PGSLEEAHSVDEKIKAKELAQ

SEQ ID NO: 1766659 - protein, 10 aa, Staphylococcus epidermidis
PGYSSNGQDF

SEQ ID NO: 1766660 - protein, 13 aa, Staphylococcus epidermidis
PHGVASDKRIEKG

SEQ ID NO: 1766661 - protein, 5 aa, Staphylococcus epidermidis
PIEDK

SEQ ID NO: 1766662 - protein, 5 aa, Staphylococcus epidermidis
PKDIQ

SEQ ID NO: 1766663 - protein, 7 aa, Staphylococcus epidermidis
PKDKTLL

SEQ ID NO: 1766664 - protein, 8 aa, Staphylococcus epidermidis
PKDVTSQK

SEQ ID NO: 1766665 - protein, 7 aa, Staphylococcus epidermidis
PKEDGAL

SEQ ID NO: 1766666 - protein, 10 aa, Staphylococcus epidermidis
PKEEKNNNSI

SEQ ID NO: 1766667 - protein, 12 aa, Staphylococcus epidermidis
PKEPSTANIDDK

SEQ ID NO: 1766668 - protein, 40 aa, Staphylococcus epidermidis
PKKGENSMKINSQQSTLNSSDVKINTNQPLNLNSATEEQL

SEQ ID NO: 1766669 - protein, 64 aa, Staphylococcus epidermidis
PKNAQHGGQRSQNNNFQDYGQGFGGQQSGQNTSYNNNNSSNSNQSDNPFANANGPIDISDDDLP

SEQ ID NO: 1766670 - protein, 5 aa, Staphylococcus epidermidis
PKPVL

SEQ ID NO: 1766671 - protein, 4 aa, Staphylococcus epidermidis
PKVE

SEQ ID NO: 1766672 - protein, 5 aa, Staphylococcus epidermidis
PLSGD

SEQ ID NO: 1766673 - protein, 16 aa, Staphylococcus epidermidis
PLTGNDKVDESRLPVP

SEQ ID NO: 1766674 - protein, 14 aa, Staphylococcus epidermidis
PNASYKNFKPSESD

SEQ ID NO: 1766675 - protein, 9 aa, Staphylococcus epidermidis
PNENELSEL

SEQ ID NO: 1766676 - protein, 7 aa, Staphylococcus epidermidis
PNGESYE

SEQ ID NO: 1766677 - protein, 8 aa, Staphylococcus epidermidis
PNKNHIKT

SEQ ID NO: 1766678 - protein, 15 aa, Staphylococcus epidermidis
PNNPTGSTATQDDFD

SEQ ID NO: 1766679 - protein, 18 aa, Staphylococcus epidermidis
PNTDFKKKEQIMHQHQIF

SEQ ID NO: 1766680 - protein, 6 aa, Staphylococcus epidermidis
PNVKEN

SEQ ID NO: 1766681 - protein, 17 aa, Staphylococcus epidermidis
PPREYSISSSYKATPDE

SEQ ID NO: 1766682 - protein, 39 aa, Staphylococcus epidermidis
PPTDEPSEEEVEAMEGESATEEPEVVGEDKEDDEEENKE

SEQ ID NO: 1766683 - protein, 10 aa, Staphylococcus epidermidis
PQINKKRTDY

SEQ ID NO: 1766684 - protein, 21 aa, Staphylococcus epidermidis
PQTVSSSSLITDEEKKYVEDN

SEQ ID NO: 1766685 - protein, 4 aa, Staphylococcus epidermidis
PRKN

SEQ ID NO: 1766686 - protein, 8 aa, Staphylococcus epidermidis
PRTRDGHF

SEQ ID NO: 1766687 - protein, 15 aa, Staphylococcus epidermidis
PSGDVTPSKEDITTT

SEQ ID NO: 1766688 - protein, 8 aa, Staphylococcus epidermidis
PSRRKDIS

SEQ ID NO: 1766689 - protein, 8 aa, Staphylococcus epidermidis
PSRSIDDV

SEQ ID NO: 1766690 - protein, 8 aa, Staphylococcus epidermidis
PSSESQKI

SEQ ID NO: 1766691 - protein, 15 aa, Staphylococcus epidermidis
PSSHDPVASDRDNPL

SEQ ID NO: 1766692 - protein, 12 aa, Staphylococcus epidermidis
PSYVKKTEALDS

SEQ ID NO: 1766693 - protein, 14 aa, Staphylococcus epidermidis
PTCTKEDVDAAQAL

SEQ ID NO: 1766694 - protein, 8 aa, Staphylococcus epidermidis
PTFHDPTR

SEQ ID NO: 1766695 - protein, 13 aa, Staphylococcus epidermidis
PTKHSAKLTHATA

SEQ ID NO: 1766696 - protein, 10 aa, Staphylococcus epidermidis
PTLPDPKEVE

SEQ ID NO: 1766697 - protein, 4 aa, Staphylococcus epidermidis
PTRI

SEQ ID NO: 1766698 - protein, 5 aa, Staphylococcus epidermidis
PTSAM

SEQ ID NO: 1766699 - protein, 13 aa, Staphylococcus epidermidis
PTVSKREKPENVD

SEQ ID NO: 1766700 - protein, 8 aa, Staphylococcus epidermidis
PVDGLDND

SEQ ID NO: 1766701 - protein, 12 aa, Staphylococcus epidermidis
PVGSGDSTVAGI

SEQ ID NO: 1766702 - protein, 4 aa, Staphylococcus epidermidis
PVKP

SEQ ID NO: 1766703 - protein, 20 aa, Staphylococcus epidermidis
PWGGYKQSGIGRELGKEGLE

SEQ ID NO: 1766704 - protein, 5 aa, Staphylococcus epidermidis
PYLEK

SEQ ID NO: 1766705 - protein, 4 aa, Staphylococcus epidermidis
PYLS

SEQ ID NO: 1766706 - protein, 7 aa, Staphylococcus epidermidis
QAAEEAT

SEQ ID NO: 1766707 - protein, 7 aa, Staphylococcus epidermidis
QAAKVKK

SEQ ID NO: 1766708 - protein, 9 aa, Staphylococcus epidermidis
QAGQRPEGD

SEQ ID NO: 1766709 - protein, 16 aa, Staphylococcus epidermidis
QALKGEVEISGAKNSA

SEQ ID NO: 1766710 - protein, 5 aa, Staphylococcus epidermidis
QANQN

SEQ ID NO: 1766711 - protein, 4 aa, Staphylococcus epidermidis
QAQE

SEQ ID NO: 1766712 - protein, 8 aa, Staphylococcus epidermidis
QATSLDEA

SEQ ID NO: 1766713 - protein, 7 aa, Staphylococcus epidermidis
QAVKSNS

SEQ ID NO: 1766714 - protein, 7 aa, Staphylococcus epidermidis
QAYHNHG

SEQ ID NO: 1766715 - protein, 6 aa, Staphylococcus epidermidis
QCGSGL

SEQ ID NO: 1766716 - protein, 6 aa, Staphylococcus epidermidis
QDDADQ

SEQ ID NO: 1766717 - protein, 10 aa, Staphylococcus epidermidis
QDETGEDSER

SEQ ID NO: 1766718 - protein, 7 aa, Staphylococcus epidermidis
QDHTGAI

SEQ ID NO: 1766719 - protein, 12 aa, Staphylococcus epidermidis
QDISSVNNNQLE

SEQ ID NO: 1766720 - protein, 11 aa, Staphylococcus epidermidis
QDNNGTIQETI

SEQ ID NO: 1766721 - protein, 7 aa, Staphylococcus epidermidis
QDSSITD

SEQ ID NO: 1766722 - protein, 4 aa, Staphylococcus epidermidis
QEEI

SEQ ID NO: 1766723 - protein, 9 aa, Staphylococcus epidermidis
QEEVEGRPE

SEQ ID NO: 1766724 - protein, 8 aa, Staphylococcus epidermidis
QEKKEISD

SEQ ID NO: 1766725 - protein, 8 aa, Staphylococcus epidermidis
QEKTNRRV

SEQ ID NO: 1766726 - protein, 4 aa, Staphylococcus epidermidis
QELP

SEQ ID NO: 1766727 - protein, 7 aa, Staphylococcus epidermidis
QERLDKK

SEQ ID NO: 1766728 - protein, 17 aa, Staphylococcus epidermidis
QESTTNNHADDIESEND

SEQ ID NO: 1766729 - protein, 4 aa, Staphylococcus epidermidis
QEVS

SEQ ID NO: 1766730 - protein, 10 aa, Staphylococcus epidermidis
QFELNGQSYT

SEQ ID NO: 1766731 - protein, 17 aa, Staphylococcus epidermidis
QFNGNESIEVSGRFGES

SEQ ID NO: 1766732 - protein, 10 aa, Staphylococcus epidermidis
QGAQGATIYT

SEQ ID NO: 1766733 - protein, 11 aa, Staphylococcus epidermidis
QGASPASQVSN

SEQ ID NO: 1766734 - protein, 8 aa, Staphylococcus epidermidis
QGDTKTAA

SEQ ID NO: 1766735 - protein, 5 aa, Staphylococcus epidermidis
QGERE

SEQ ID NO: 1766736 - protein, 11 aa, Staphylococcus epidermidis
QGGTQVNSVPD

SEQ ID NO: 1766737 - protein, 10 aa, Staphylococcus epidermidis
QGMSGGQKQR

SEQ ID NO: 1766738 - protein, 5 aa, Staphylococcus epidermidis
QGPHS

SEQ ID NO: 1766739 - protein, 8 aa, Staphylococcus epidermidis
QGQTATYS

SEQ ID NO: 1766740 - protein, 8 aa, Staphylococcus epidermidis
QGTSTEEI

SEQ ID NO: 1766741 - protein, 12 aa, Staphylococcus epidermidis
QHIGNEKNKKGQ

SEQ ID NO: 1766742 - protein, 8 aa, Staphylococcus epidermidis
QHKIKEDY

SEQ ID NO: 1766743 - protein, 7 aa, Staphylococcus epidermidis
QHLTQSS

SEQ ID NO: 1766744 - protein, 8 aa, Staphylococcus epidermidis
QHQREGKT

SEQ ID NO: 1766745 - protein, 10 aa, Staphylococcus epidermidis
QHSEHSGEDF

SEQ ID NO: 1766746 - protein, 8 aa, Staphylococcus epidermidis
QIDEPREI

SEQ ID NO: 1766747 - protein, 9 aa, Staphylococcus epidermidis
QIESTYKDV

SEQ ID NO: 1766748 - protein, 4 aa, Staphylococcus epidermidis
QIQP

SEQ ID NO: 1766749 - protein, 14 aa, Staphylococcus epidermidis
QITQNTNSKGNVLN

SEQ ID NO: 1766750 - protein, 9 aa, Staphylococcus epidermidis
QKGNKNKAI

SEQ ID NO: 1766751 - protein, 14 aa, Staphylococcus epidermidis
QKINKSKVKPGNFD

SEQ ID NO: 1766752 - protein, 5 aa, Staphylococcus epidermidis
QKMDQ

SEQ ID NO: 1766753 - protein, 13 aa, Staphylococcus epidermidis
QKPAKAKKGTDIQ

SEQ ID NO: 1766754 - protein, 5 aa, Staphylococcus epidermidis
QKRSR

SEQ ID NO: 1766755 - protein, 6 aa, Staphylococcus epidermidis
QKRYRD

SEQ ID NO: 1766756 - protein, 4 aa, Staphylococcus epidermidis
QKTA

SEQ ID NO: 1766757 - protein, 14 aa, Staphylococcus epidermidis
QLASNKQLKTPEAR

SEQ ID NO: 1766758 - protein, 5 aa, Staphylococcus epidermidis
QLEGH

SEQ ID NO: 1766759 - protein, 12 aa, Staphylococcus epidermidis
QLEKGIEILTEI

SEQ ID NO: 1766760 - protein, 5 aa, Staphylococcus epidermidis
QLEPF

SEQ ID NO: 1766761 - protein, 16 aa, Staphylococcus epidermidis
QLKAAELKKQQIDEEG

SEQ ID NO: 1766762 - protein, 5 aa, Staphylococcus epidermidis
QLKEA

SEQ ID NO: 1766763 - protein, 4 aa, Staphylococcus epidermidis
QLNI

SEQ ID NO: 1766764 - protein, 27 aa, Staphylococcus epidermidis
QLPKLEHQTNKINDEKKDRQAEDTTND

SEQ ID NO: 1766765 - protein, 8 aa, Staphylococcus epidermidis
QLQEEEKG

SEQ ID NO: 1766766 - protein, 7 aa, Staphylococcus epidermidis
QLSDEKY

SEQ ID NO: 1766767 - protein, 6 aa, Staphylococcus epidermidis
QLTQPE

SEQ ID NO: 1766768 - protein, 6 aa, Staphylococcus epidermidis
QMSGKN

SEQ ID NO: 1766769 - protein, 4 aa, Staphylococcus epidermidis
QNDG

SEQ ID NO: 1766770 - protein, 15 aa, Staphylococcus epidermidis
QNEDCKTCGNAPTYP

SEQ ID NO: 1766771 - protein, 5 aa, Staphylococcus epidermidis
QNGDM

SEQ ID NO: 1766772 - protein, 10 aa, Staphylococcus epidermidis
QNGMDEKKNN

SEQ ID NO: 1766773 - protein, 9 aa, Staphylococcus epidermidis
QNGRVPQST

SEQ ID NO: 1766774 - protein, 6 aa, Staphylococcus epidermidis
QNHGFN

SEQ ID NO: 1766775 - protein, 4 aa, Staphylococcus epidermidis
QNKG

SEQ ID NO: 1766776 - protein, 15 aa, Staphylococcus epidermidis
QNQSQLTEEKLRAFG

SEQ ID NO: 1766777 - protein, 28 aa, Staphylococcus epidermidis
QNTSNEYEISNQQSNDIKGTVSQTPHRR

SEQ ID NO: 1766778 - protein, 6 aa, Staphylococcus epidermidis
QPDETT

SEQ ID NO: 1766779 - protein, 5 aa, Staphylococcus epidermidis
QPEEY

SEQ ID NO: 1766780 - protein, 17 aa, Staphylococcus epidermidis
QPGPIDTPFQKNADPTL

SEQ ID NO: 1766781 - protein, 10 aa, Staphylococcus epidermidis
QPHKNIGDIR

SEQ ID NO: 1766782 - protein, 8 aa, Staphylococcus epidermidis
QPKYSKAC

SEQ ID NO: 1766783 - protein, 8 aa, Staphylococcus epidermidis
QPLSNTPI

SEQ ID NO: 1766784 - protein, 14 aa, Staphylococcus epidermidis
QPSHVNVNEVTIRP

SEQ ID NO: 1766785 - protein, 4 aa, Staphylococcus epidermidis
QPSQ

SEQ ID NO: 1766786 - protein, 15 aa, Staphylococcus epidermidis
QPTIQDTEKHTQAID

SEQ ID NO: 1766787 - protein, 7 aa, Staphylococcus epidermidis
QPVSTYD

SEQ ID NO: 1766788 - protein, 11 aa, Staphylococcus epidermidis
QPYKEENKQQQ

SEQ ID NO: 1766789 - protein, 11 aa, Staphylococcus epidermidis
QQDANSKDSYQ

SEQ ID NO: 1766790 - protein, 8 aa, Staphylococcus epidermidis
QQDDARKS

SEQ ID NO: 1766791 - protein, 18 aa, Staphylococcus epidermidis
QQGESAEALGLDGKEEIS

SEQ ID NO: 1766792 - protein, 8 aa, Staphylococcus epidermidis
QQINTELP

SEQ ID NO: 1766793 - protein, 5 aa, Staphylococcus epidermidis
QQKGT

SEQ ID NO: 1766794 - protein, 4 aa, Staphylococcus epidermidis
QQLG

SEQ ID NO: 1766795 - protein, 6 aa, Staphylococcus epidermidis
QQNHAS

SEQ ID NO: 1766796 - protein, 8 aa, Staphylococcus epidermidis
QQPRPKVK

SEQ ID NO: 1766797 - protein, 30 aa, Staphylococcus epidermidis
QQQATITKTDVSKKTNQYVNPKINQDKNQY

SEQ ID NO: 1766798 - protein, 15 aa, Staphylococcus epidermidis
QQQTSAKDVYAGGDA

SEQ ID NO: 1766799 - protein, 8 aa, Staphylococcus epidermidis
QQRGRDME

SEQ ID NO: 1766800 - protein, 5 aa, Staphylococcus epidermidis
QQSFT

SEQ ID NO: 1766801 - protein, 6 aa, Staphylococcus epidermidis
QQYSKP

SEQ ID NO: 1766802 - protein, 15 aa, Staphylococcus epidermidis
QRETRRGKKLEHNDR

SEQ ID NO: 1766803 - protein, 8 aa, Staphylococcus epidermidis
QRHDKEIE

SEQ ID NO: 1766804 - protein, 5 aa, Staphylococcus epidermidis
QRNEK

SEQ ID NO: 1766805 - protein, 5 aa, Staphylococcus epidermidis
QRTEY

SEQ ID NO: 1766806 - protein, 7 aa, Staphylococcus epidermidis
QSDFEEG

SEQ ID NO: 1766807 - protein, 5 aa, Staphylococcus epidermidis
QSGLP

SEQ ID NO: 1766808 - protein, 5 aa, Staphylococcus epidermidis
QSKEF

SEQ ID NO: 1766809 - protein, 10 aa, Staphylococcus epidermidis
QSKLNETNYH

SEQ ID NO: 1766810 - protein, 8 aa, Staphylococcus epidermidis
QSLNSTAQ

SEQ ID NO: 1766811 - protein, 12 aa, Staphylococcus epidermidis
QSNQGAARSRNV

SEQ ID NO: 1766812 - protein, 6 aa, Staphylococcus epidermidis
QSPFKQ

SEQ ID NO: 1766813 - protein, 4 aa, Staphylococcus epidermidis
QSQA

SEQ ID NO: 1766814 - protein, 10 aa, Staphylococcus epidermidis
QSSDKITASQ

SEQ ID NO: 1766815 - protein, 7 aa, Staphylococcus epidermidis
QSSSEHS

SEQ ID NO: 1766816 - protein, 6 aa, Staphylococcus epidermidis
QSTKMY

SEQ ID NO: 1766817 - protein, 48 aa, Staphylococcus epidermidis
QTDITTKLDSNAQSLKSIQNSQEAIQSAQEQQSKDIAKANELKDSELR

SEQ ID NO: 1766818 - protein, 7 aa, Staphylococcus epidermidis
QTENDHE

SEQ ID NO: 1766819 - protein, 4 aa, Staphylococcus epidermidis
QTET

SEQ ID NO: 1766820 - protein, 9 aa, Staphylococcus epidermidis
QTGQEDSKF

SEQ ID NO: 1766821 - protein, 5 aa, Staphylococcus epidermidis
QTNVT

SEQ ID NO: 1766822 - protein, 6 aa, Staphylococcus epidermidis
QTQPLG

SEQ ID NO: 1766823 - protein, 15 aa, Staphylococcus epidermidis
QTSIEEDIEEDPRED

SEQ ID NO: 1766824 - protein, 4 aa, Staphylococcus epidermidis
QTVE

SEQ ID NO: 1766825 - protein, 12 aa, Staphylococcus epidermidis
QTVTRKKKQSLR

SEQ ID NO: 1766826 - protein, 5 aa, Staphylococcus epidermidis
QTYHP

SEQ ID NO: 1766827 - protein, 9 aa, Staphylococcus epidermidis
QVNSLSDQV

SEQ ID NO: 1766828 - protein, 5 aa, Staphylococcus epidermidis
QVTKK

SEQ ID NO: 1766829 - protein, 16 aa, Staphylococcus epidermidis
QYDANQHQQRKELEAY

SEQ ID NO: 1766830 - protein, 7 aa, Staphylococcus epidermidis
QYKDNKQ

SEQ ID NO: 1766831 - protein, 29 aa, Staphylococcus epidermidis
QYNEEVKAGTFPSENHTYKKRIMDEVEQH

SEQ ID NO: 1766832 - protein, 4 aa, Staphylococcus epidermidis
QYNQ

SEQ ID NO: 1766833 - protein, 4 aa, Staphylococcus epidermidis
QYNV

SEQ ID NO: 1766834 - protein, 5 aa, Staphylococcus epidermidis
QYPPI

SEQ ID NO: 1766835 - protein, 18 aa, Staphylococcus epidermidis
QYWPSDSKAMKKSNGAEL

SEQ ID NO: 1766836 - protein, 4 aa, Staphylococcus epidermidis
RAEQ

SEQ ID NO: 1766837 - protein, 11 aa, Staphylococcus epidermidis
RAKEKEGKVPR

SEQ ID NO: 1766838 - protein, 6 aa, Staphylococcus epidermidis
RALESE

SEQ ID NO: 1766839 - protein, 7 aa, Staphylococcus epidermidis
RANDQEY

SEQ ID NO: 1766840 - protein, 7 aa, Staphylococcus epidermidis
RAQDKGI

SEQ ID NO: 1766841 - protein, 9 aa, Staphylococcus epidermidis
RCKASEDEA

SEQ ID NO: 1766842 - protein, 6 aa, Staphylococcus epidermidis
RDAEGN

SEQ ID NO: 1766843 - protein, 5 aa, Staphylococcus epidermidis
RDDAG

SEQ ID NO: 1766844 - protein, 6 aa, Staphylococcus epidermidis
RDENLH

SEQ ID NO: 1766845 - protein, 10 aa, Staphylococcus epidermidis
RDENRVNEYS

SEQ ID NO: 1766846 - protein, 11 aa, Staphylococcus epidermidis
RDNGQGFDTQS

SEQ ID NO: 1766847 - protein, 6 aa, Staphylococcus epidermidis
RDYAES

SEQ ID NO: 1766848 - protein, 5 aa, Staphylococcus epidermidis
RDYSS

SEQ ID NO: 1766849 - protein, 5 aa, Staphylococcus epidermidis
REAKN

SEQ ID NO: 1766850 - protein, 5 aa, Staphylococcus epidermidis
REANE

SEQ ID NO: 1766851 - protein, 11 aa, Staphylococcus epidermidis
REAVEKNETVD

SEQ ID NO: 1766852 - protein, 18 aa, Staphylococcus epidermidis
REDSNQAYEATQYIDPKK

SEQ ID NO: 1766853 - protein, 5 aa, Staphylococcus epidermidis
REEET

SEQ ID NO: 1766854 - protein, 5 aa, Staphylococcus epidermidis
REQYT

SEQ ID NO: 1766855 - protein, 7 aa, Staphylococcus epidermidis
RETEKYG

SEQ ID NO: 1766856 - protein, 14 aa, Staphylococcus epidermidis
RETSPFPRLLNRLY

SEQ ID NO: 1766857 - protein, 11 aa, Staphylococcus epidermidis
RFGSDKPDTRF

SEQ ID NO: 1766858 - protein, 14 aa, Staphylococcus epidermidis
RGATSYHSKMILKE

SEQ ID NO: 1766859 - protein, 17 aa, Staphylococcus epidermidis
RGEITEATGIKATHKEG

SEQ ID NO: 1766860 - protein, 15 aa, Staphylococcus epidermidis
RGGVGADGITGDGAG

SEQ ID NO: 1766861 - protein, 10 aa, Staphylococcus epidermidis
RGLASKRTTT

SEQ ID NO: 1766862 - protein, 6 aa, Staphylococcus epidermidis
RGLQGT

SEQ ID NO: 1766863 - protein, 32 aa, Staphylococcus epidermidis
RGQYDQGNIDGKQVKSYREEDRVAKDSVTPTF

SEQ ID NO: 1766864 - protein, 25 aa, Staphylococcus epidermidis
RGRNAKSYTKAKNTDIQTYRKSSAL

SEQ ID NO: 1766865 - protein, 14 aa, Staphylococcus epidermidis
RHTSNKIAEIIKED

SEQ ID NO: 1766866 - protein, 16 aa, Staphylococcus epidermidis
RIQEASFKDPNNEHLK

SEQ ID NO: 1766867 - protein, 7 aa, Staphylococcus epidermidis
RKAEDNK

SEQ ID NO: 1766868 - protein, 11 aa, Staphylococcus epidermidis
RKGKDALLKNG

SEQ ID NO: 1766869 - protein, 7 aa, Staphylococcus epidermidis
RKGMNAE

SEQ ID NO: 1766870 - protein, 5 aa, Staphylococcus epidermidis
RKIRG

SEQ ID NO: 1766871 - protein, 4 aa, Staphylococcus epidermidis
RKNH

SEQ ID NO: 1766872 - protein, 7 aa, Staphylococcus epidermidis
RKPADQP

SEQ ID NO: 1766873 - protein, 9 aa, Staphylococcus epidermidis
RKPNTNDIG

SEQ ID NO: 1766874 - protein, 35 aa, Staphylococcus epidermidis
RKSKTKQSDSPALNRGFNSKKKQFTNLNSPQKRGV

SEQ ID NO: 1766875 - protein, 14 aa, Staphylococcus epidermidis
RKSRQRKDDHLTNE

SEQ ID NO: 1766876 - protein, 14 aa, Staphylococcus epidermidis
RKYGSEKQESVEKD

SEQ ID NO: 1766877 - protein, 7 aa, Staphylococcus epidermidis
RLARNTS

SEQ ID NO: 1766878 - protein, 25 aa, Staphylococcus epidermidis
RLDEDRKALSSSLSDFGSLNTREQT

SEQ ID NO: 1766879 - protein, 6 aa, Staphylococcus epidermidis
RLEDRP

SEQ ID NO: 1766880 - protein, 5 aa, Staphylococcus epidermidis
RLEEA

SEQ ID NO: 1766881 - protein, 4 aa, Staphylococcus epidermidis
RLKA

SEQ ID NO: 1766882 - protein, 6 aa, Staphylococcus epidermidis
RLYGKK

SEQ ID NO: 1766883 - protein, 21 aa, Staphylococcus epidermidis
RMTPHSSDDDDTYRTKEERDL

SEQ ID NO: 1766884 - protein, 8 aa, Staphylococcus epidermidis
RNAIDEGS

SEQ ID NO: 1766885 - protein, 9 aa, Staphylococcus epidermidis
RNGKPETKY

SEQ ID NO: 1766886 - protein, 14 aa, Staphylococcus epidermidis
RNGQVKQDSSIGTG

SEQ ID NO: 1766887 - protein, 5 aa, Staphylococcus epidermidis
RNHYS

SEQ ID NO: 1766888 - protein, 11 aa, Staphylococcus epidermidis
RNKEEAKEAGI

SEQ ID NO: 1766889 - protein, 5 aa, Staphylococcus epidermidis
RNQGL

SEQ ID NO: 1766890 - protein, 7 aa, Staphylococcus epidermidis
RNQVEES

SEQ ID NO: 1766891 - protein, 9 aa, Staphylococcus epidermidis
RNTKASGYR

SEQ ID NO: 1766892 - protein, 11 aa, Staphylococcus epidermidis
RPHSTNDDAAY

SEQ ID NO: 1766893 - protein, 8 aa, Staphylococcus epidermidis
RQEVPSKL

SEQ ID NO: 1766894 - protein, 6 aa, Staphylococcus epidermidis
RQKTNQ

SEQ ID NO: 1766895 - protein, 11 aa, Staphylococcus epidermidis
RQNVEDAYRQS

SEQ ID NO: 1766896 - protein, 8 aa, Staphylococcus epidermidis
RQQDGSSI

SEQ ID NO: 1766897 - protein, 4 aa, Staphylococcus epidermidis
RQQL

SEQ ID NO: 1766898 - protein, 7 aa, Staphylococcus epidermidis
RQQTDQD

SEQ ID NO: 1766899 - protein, 6 aa, Staphylococcus epidermidis
RRDQHN

SEQ ID NO: 1766900 - protein, 4 aa, Staphylococcus epidermidis
RRLE

SEQ ID NO: 1766901 - protein, 16 aa, Staphylococcus epidermidis
RRRGGRHKGPPPFTTE

SEQ ID NO: 1766902 - protein, 7 aa, Staphylococcus epidermidis
RRRNDRQ

SEQ ID NO: 1766903 - protein, 6 aa, Staphylococcus epidermidis
RRTTND

SEQ ID NO: 1766904 - protein, 7 aa, Staphylococcus epidermidis
RSFRDDP

SEQ ID NO: 1766905 - protein, 7 aa, Staphylococcus epidermidis
RSPSFKN

SEQ ID NO: 1766906 - protein, 9 aa, Staphylococcus epidermidis
RSSQPLTKR

SEQ ID NO: 1766907 - protein, 6 aa, Staphylococcus epidermidis
RTAEGF

SEQ ID NO: 1766908 - protein, 16 aa, Staphylococcus epidermidis
RTKGNRKDTSINIEQS

SEQ ID NO: 1766909 - protein, 7 aa, Staphylococcus epidermidis
RTKNGQN

SEQ ID NO: 1766910 - protein, 10 aa, Staphylococcus epidermidis
RTPRGRKATA

SEQ ID NO: 1766911 - protein, 10 aa, Staphylococcus epidermidis
RTQRRAAPFP

SEQ ID NO: 1766912 - protein, 9 aa, Staphylococcus epidermidis
RTTEERHKQ

SEQ ID NO: 1766913 - protein, 15 aa, Staphylococcus epidermidis
RVEDREPKAIKDNEV

SEQ ID NO: 1766914 - protein, 10 aa, Staphylococcus epidermidis
RYESTEVTSI

SEQ ID NO: 1766915 - protein, 14 aa, Staphylococcus epidermidis
RYPDEFNKSNVRKD

SEQ ID NO: 1766916 - protein, 10 aa, Staphylococcus epidermidis
RYSERQGGYT

SEQ ID NO: 1766917 - protein, 6 aa, Staphylococcus epidermidis
SADQPS

SEQ ID NO: 1766918 - protein, 11 aa, Staphylococcus epidermidis
SAEKYEQAKDT

SEQ ID NO: 1766919 - protein, 4 aa, Staphylococcus epidermidis
SAET

SEQ ID NO: 1766920 - protein, 10 aa, Staphylococcus epidermidis
SAKGCKQSLG

SEQ ID NO: 1766921 - protein, 15 aa, Staphylococcus epidermidis
SALKNESDNASKHRL

SEQ ID NO: 1766922 - protein, 12 aa, Staphylococcus epidermidis
SAPRPIPLPNQT

SEQ ID NO: 1766923 - protein, 9 aa, Staphylococcus epidermidis
SAQQSSKYA

SEQ ID NO: 1766924 - protein, 23 aa, Staphylococcus epidermidis
SASVDNNTERAKSNEDKNDTEIT

SEQ ID NO: 1766925 - protein, 14 aa, Staphylococcus epidermidis
SCIEAPGSRVKESP

SEQ ID NO: 1766926 - protein, 7 aa, Staphylococcus epidermidis
SDEDAKK

SEQ ID NO: 1766927 - protein, 32 aa, Staphylococcus epidermidis
SDENKRANYDQFGHDGPQGGFGSQGFGGSDFG

SEQ ID NO: 1766928 - protein, 7 aa, Staphylococcus epidermidis
SDERHNS

SEQ ID NO: 1766929 - protein, 8 aa, Staphylococcus epidermidis
SDEVSKGK

SEQ ID NO: 1766930 - protein, 6 aa, Staphylococcus epidermidis
SDKEYD

SEQ ID NO: 1766931 - protein, 8 aa, Staphylococcus epidermidis
SDKGAKLV

SEQ ID NO: 1766932 - protein, 11 aa, Staphylococcus epidermidis
SDNQKGRYQDA

SEQ ID NO: 1766933 - protein, 10 aa, Staphylococcus epidermidis
SDQADKTSTE

SEQ ID NO: 1766934 - protein, 8 aa, Staphylococcus epidermidis
SDQPLTQE

SEQ ID NO: 1766935 - protein, 7 aa, Staphylococcus epidermidis
SDQTLQE

SEQ ID NO: 1766936 - protein, 7 aa, Staphylococcus epidermidis
SDSKYDL

SEQ ID NO: 1766937 - protein, 8 aa, Staphylococcus epidermidis
SDTGSASV

SEQ ID NO: 1766938 - protein, 7 aa, Staphylococcus epidermidis
SDTLNGV

SEQ ID NO: 1766939 - protein, 10 aa, Staphylococcus epidermidis
SDYQTPEEAC

SEQ ID NO: 1766940 - protein, 7 aa, Staphylococcus epidermidis
SEATQQA

SEQ ID NO: 1766941 - protein, 7 aa, Staphylococcus epidermidis
SEESKTY

SEQ ID NO: 1766942 - protein, 8 aa, Staphylococcus epidermidis
SEGNHDDW

SEQ ID NO: 1766943 - protein, 8 aa, Staphylococcus epidermidis
SELEPGQP

SEQ ID NO: 1766944 - protein, 5 aa, Staphylococcus epidermidis
SELKS

SEQ ID NO: 1766945 - protein, 7 aa, Staphylococcus epidermidis
SENNEAT

SEQ ID NO: 1766946 - protein, 6 aa, Staphylococcus epidermidis
SERALK

SEQ ID NO: 1766947 - protein, 5 aa, Staphylococcus epidermidis
SERLA

SEQ ID NO: 1766948 - protein, 5 aa, Staphylococcus epidermidis
SERND

SEQ ID NO: 1766949 - protein, 7 aa, Staphylococcus epidermidis
SESQQQA

SEQ ID NO: 1766950 - protein, 11 aa, Staphylococcus epidermidis
SETQKEAYTEE

SEQ ID NO: 1766951 - protein, 4 aa, Staphylococcus epidermidis
SEVR

SEQ ID NO: 1766952 - protein, 4 aa, Staphylococcus epidermidis
SEYA

SEQ ID NO: 1766953 - protein, 7 aa, Staphylococcus epidermidis
SFTHDNG

SEQ ID NO: 1766954 - protein, 20 aa, Staphylococcus epidermidis
SGANGSKPRDVYITEADLSK

SEQ ID NO: 1766955 - protein, 4 aa, Staphylococcus epidermidis
SGDY

SEQ ID NO: 1766956 - protein, 6 aa, Staphylococcus epidermidis
SGEKID

SEQ ID NO: 1766957 - protein, 13 aa, Staphylococcus epidermidis
SGEKVGRETEEEV

SEQ ID NO: 1766958 - protein, 8 aa, Staphylococcus epidermidis
SGESEETW

SEQ ID NO: 1766959 - protein, 6 aa, Staphylococcus epidermidis
SGETYY

SEQ ID NO: 1766960 - protein, 15 aa, Staphylococcus epidermidis
SGFEPTKTNAVYGAT

SEQ ID NO: 1766961 - protein, 8 aa, Staphylococcus epidermidis
SGGPKGIM

SEQ ID NO: 1766962 - protein, 13 aa, Staphylococcus epidermidis
SGIELSDGKLKPA

SEQ ID NO: 1766963 - protein, 7 aa, Staphylococcus epidermidis
SGIHSNG

SEQ ID NO: 1766964 - protein, 7 aa, Staphylococcus epidermidis
SGINGTE

SEQ ID NO: 1766965 - protein, 6 aa, Staphylococcus epidermidis
SGKELA

SEQ ID NO: 1766966 - protein, 7 aa, Staphylococcus epidermidis
SGKTSAI

SEQ ID NO: 1766967 - protein, 12 aa, Staphylococcus epidermidis
SGMTGTGKLGEK

SEQ ID NO: 1766968 - protein, 10 aa, Staphylococcus epidermidis
SGNRSRKASQ

SEQ ID NO: 1766969 - protein, 19 aa, Staphylococcus epidermidis
SGPGATNAITGITDAYSDS

SEQ ID NO: 1766970 - protein, 20 aa, Staphylococcus epidermidis
SGRTYTDQEPKYLNSPETPI

SEQ ID NO: 1766971 - protein, 12 aa, Staphylococcus epidermidis
SGSEASSQGYTM

SEQ ID NO: 1766972 - protein, 10 aa, Staphylococcus epidermidis
SGSEGRNPLD

SEQ ID NO: 1766973 - protein, 8 aa, Staphylococcus epidermidis
SGSSHRGV

SEQ ID NO: 1766974 - protein, 4 aa, Staphylococcus epidermidis
SGTV

SEQ ID NO: 1766975 - protein, 5 aa, Staphylococcus epidermidis
SGVLP

SEQ ID NO: 1766976 - protein, 6 aa, Staphylococcus epidermidis
SHAGGI

SEQ ID NO: 1766977 - protein, 8 aa, Staphylococcus epidermidis
SHESGIHQ

SEQ ID NO: 1766978 - protein, 6 aa, Staphylococcus epidermidis
SHGADT

SEQ ID NO: 1766979 - protein, 6 aa, Staphylococcus epidermidis
SHQEKH

SEQ ID NO: 1766980 - protein, 4 aa, Staphylococcus epidermidis
SIDI

SEQ ID NO: 1766981 - protein, 4 aa, Staphylococcus epidermidis
SIED

SEQ ID NO: 1766982 - protein, 9 aa, Staphylococcus epidermidis
SIKAQDDVL

SEQ ID NO: 1766983 - protein, 5 aa, Staphylococcus epidermidis
SISPG

SEQ ID NO: 1766984 - protein, 6 aa, Staphylococcus epidermidis
SITGSV

SEQ ID NO: 1766985 - protein, 7 aa, Staphylococcus epidermidis
SKAFNDG

SEQ ID NO: 1766986 - protein, 20 aa, Staphylococcus epidermidis
SKATQDDIEKAFESANHAYQ

SEQ ID NO: 1766987 - protein, 9 aa, Staphylococcus epidermidis
SKDEEGKFT

SEQ ID NO: 1766988 - protein, 17 aa, Staphylococcus epidermidis
SKDERDPSITTSYGTGQ

SEQ ID NO: 1766989 - protein, 10 aa, Staphylococcus epidermidis
SKEPSENKGK

SEQ ID NO: 1766990 - protein, 6 aa, Staphylococcus epidermidis
SKGDKC

SEQ ID NO: 1766991 - protein, 13 aa, Staphylococcus epidermidis
SKGRMKQEDYDKV

SEQ ID NO: 1766992 - protein, 21 aa, Staphylococcus epidermidis
SKHKRNTNSKYKVRFNYEAIN

SEQ ID NO: 1766993 - protein, 8 aa, Staphylococcus epidermidis
SKINKTEI

SEQ ID NO: 1766994 - protein, 5 aa, Staphylococcus epidermidis
SKKEI

SEQ ID NO: 1766995 - protein, 9 aa, Staphylococcus epidermidis
SKNPMNGQQ

SEQ ID NO: 1766996 - protein, 15 aa, Staphylococcus epidermidis
SKNVTMRNDPDGRSR

SEQ ID NO: 1766997 - protein, 14 aa, Staphylococcus epidermidis
SKRKNIQFKESESN

SEQ ID NO: 1766998 - protein, 8 aa, Staphylococcus epidermidis
SKVEAAEK

SEQ ID NO: 1766999 - protein, 9 aa, Staphylococcus epidermidis
SKVESNEQH

SEQ ID NO: 1767000 - protein, 4 aa, Staphylococcus epidermidis
SKVY

SEQ ID NO: 1767001 - protein, 14 aa, Staphylococcus epidermidis
SLGKEEADQNKNLT

SEQ ID NO: 1767002 - protein, 13 aa, Staphylococcus epidermidis
SLKAQGAKVDGWG

SEQ ID NO: 1767003 - protein, 5 aa, Staphylococcus epidermidis
SLNVP

SEQ ID NO: 1767004 - protein, 10 aa, Staphylococcus epidermidis
SLTEDKGLKD

SEQ ID NO: 1767005 - protein, 8 aa, Staphylococcus epidermidis
SLTSNNTA

SEQ ID NO: 1767006 - protein, 6 aa, Staphylococcus epidermidis
SMNREN

SEQ ID NO: 1767007 - protein, 8 aa, Staphylococcus epidermidis
SMPQQNEI

SEQ ID NO: 1767008 - protein, 21 aa, Staphylococcus epidermidis
SNIGQETATTISTQSGVKTTS

SEQ ID NO: 1767009 - protein, 7 aa, Staphylococcus epidermidis
SNIKNEE

SEQ ID NO: 1767010 - protein, 4 aa, Staphylococcus epidermidis
SNLP

SEQ ID NO: 1767011 - protein, 4 aa, Staphylococcus epidermidis
SNNV

SEQ ID NO: 1767012 - protein, 14 aa, Staphylococcus epidermidis
SNPAKSDDAEDIAK

SEQ ID NO: 1767013 - protein, 5 aa, Staphylococcus epidermidis
SNSKV

SEQ ID NO: 1767014 - protein, 8 aa, Staphylococcus epidermidis
SPDEESNI

SEQ ID NO: 1767015 - protein, 14 aa, Staphylococcus epidermidis
SPGGKPVTPPVDGI

SEQ ID NO: 1767016 - protein, 19 aa, Staphylococcus epidermidis
SPGGTDGGEIHKENEGIPT

SEQ ID NO: 1767017 - protein, 9 aa, Staphylococcus epidermidis
SPGSRSTPL

SEQ ID NO: 1767018 - protein, 12 aa, Staphylococcus epidermidis
SPHRKAAYAANE

SEQ ID NO: 1767019 - protein, 14 aa, Staphylococcus epidermidis
SPIPNAESKVVKEP

SEQ ID NO: 1767020 - protein, 4 aa, Staphylococcus epidermidis
SPKD

SEQ ID NO: 1767021 - protein, 4 aa, Staphylococcus epidermidis
SPKL

SEQ ID NO: 1767022 - protein, 4 aa, Staphylococcus epidermidis
SPNQ

SEQ ID NO: 1767023 - protein, 8 aa, Staphylococcus epidermidis
SPQQRACD

SEQ ID NO: 1767024 - protein, 17 aa, Staphylococcus epidermidis
SPQSITGNNTQIKGTEL

SEQ ID NO: 1767025 - protein, 5 aa, Staphylococcus epidermidis
SPTKY

SEQ ID NO: 1767026 - protein, 5 aa, Staphylococcus epidermidis
SPTTI

SEQ ID NO: 1767027 - protein, 7 aa, Staphylococcus epidermidis
SPTTLGE

SEQ ID NO: 1767028 - protein, 10 aa, Staphylococcus epidermidis
SPVKYDKEEI

SEQ ID NO: 1767029 - protein, 5 aa, Staphylococcus epidermidis
SPYNV

SEQ ID NO: 1767030 - protein, 17 aa, Staphylococcus epidermidis
SQAYAQTHKKRGTQKGV

SEQ ID NO: 1767031 - protein, 7 aa, Staphylococcus epidermidis
SQGYVPG

SEQ ID NO: 1767032 - protein, 12 aa, Staphylococcus epidermidis
SQKAPQGESYQD

SEQ ID NO: 1767033 - protein, 5 aa, Staphylococcus epidermidis
SQNYE

SEQ ID NO: 1767034 - protein, 16 aa, Staphylococcus epidermidis
SQPEEEDWSTDTESLT

SEQ ID NO: 1767035 - protein, 7 aa, Staphylococcus epidermidis
SQQTQSE

SEQ ID NO: 1767036 - protein, 4 aa, Staphylococcus epidermidis
SQSD

SEQ ID NO: 1767037 - protein, 7 aa, Staphylococcus epidermidis
SRAGSNA

SEQ ID NO: 1767038 - protein, 10 aa, Staphylococcus epidermidis
SRDENDKQKV

SEQ ID NO: 1767039 - protein, 7 aa, Staphylococcus epidermidis
SRDTDKK

SEQ ID NO: 1767040 - protein, 14 aa, Staphylococcus epidermidis
SRHADEANAIRRRR

SEQ ID NO: 1767041 - protein, 7 aa, Staphylococcus epidermidis
SRKEDGN

SEQ ID NO: 1767042 - protein, 6 aa, Staphylococcus epidermidis
SRKINE

SEQ ID NO: 1767043 - protein, 34 aa, Staphylococcus epidermidis
SRKSGQNEYQTTIKGQVSTVATGQAYIEQETMTQ

SEQ ID NO: 1767044 - protein, 21 aa, Staphylococcus epidermidis
SRLNEEERHTYEQKGYEAIRN

SEQ ID NO: 1767045 - protein, 6 aa, Staphylococcus epidermidis
SRPSTQ

SEQ ID NO: 1767046 - protein, 9 aa, Staphylococcus epidermidis
SRQADEEDF

SEQ ID NO: 1767047 - protein, 6 aa, Staphylococcus epidermidis
SRQHDA

SEQ ID NO: 1767048 - protein, 41 aa, Staphylococcus epidermidis
SRRVRNRVGRGAATGNGKTSGRGQKGQKARSGGKVRPGFEG

SEQ ID NO: 1767049 - protein, 7 aa, Staphylococcus epidermidis
SRTDYDL

SEQ ID NO: 1767050 - protein, 4 aa, Staphylococcus epidermidis
SSEE

SEQ ID NO: 1767051 - protein, 5 aa, Staphylococcus epidermidis
SSEIS

SEQ ID NO: 1767052 - protein, 9 aa, Staphylococcus epidermidis
SSEKARPKL

SEQ ID NO: 1767053 - protein, 7 aa, Staphylococcus epidermidis
SSEKFTN

SEQ ID NO: 1767054 - protein, 5 aa, Staphylococcus epidermidis
SSGID

SEQ ID NO: 1767055 - protein, 5 aa, Staphylococcus epidermidis
SSHEE

SEQ ID NO: 1767056 - protein, 7 aa, Staphylococcus epidermidis
SSKIGAN

SEQ ID NO: 1767057 - protein, 6 aa, Staphylococcus epidermidis
SSKNTN

SEQ ID NO: 1767058 - protein, 13 aa, Staphylococcus epidermidis
SSLQKEQVIEYLT

SEQ ID NO: 1767059 - protein, 10 aa, Staphylococcus epidermidis
SSPQLDVPER

SEQ ID NO: 1767060 - protein, 16 aa, Staphylococcus epidermidis
SSSPVTVKAGEYEDCK

SEQ ID NO: 1767061 - protein, 6 aa, Staphylococcus epidermidis
SSTPHE

SEQ ID NO: 1767062 - protein, 7 aa, Staphylococcus epidermidis
SSTSAED

SEQ ID NO: 1767063 - protein, 9 aa, Staphylococcus epidermidis
SSYQQKPVI

SEQ ID NO: 1767064 - protein, 4 aa, Staphylococcus epidermidis
STEF

SEQ ID NO: 1767065 - protein, 5 aa, Staphylococcus epidermidis
STGEF

SEQ ID NO: 1767066 - protein, 6 aa, Staphylococcus epidermidis
STGIQP

SEQ ID NO: 1767067 - protein, 6 aa, Staphylococcus epidermidis
STGKDE

SEQ ID NO: 1767068 - protein, 7 aa, Staphylococcus epidermidis
STHSQSI

SEQ ID NO: 1767069 - protein, 7 aa, Staphylococcus epidermidis
STIGSTD

SEQ ID NO: 1767070 - protein, 13 aa, Staphylococcus epidermidis
STIPSDFNGESKL

SEQ ID NO: 1767071 - protein, 10 aa, Staphylococcus epidermidis
STKNKKSRAI

SEQ ID NO: 1767072 - protein, 8 aa, Staphylococcus epidermidis
STLPERVK

SEQ ID NO: 1767073 - protein, 10 aa, Staphylococcus epidermidis
STNQQKLKGR

SEQ ID NO: 1767074 - protein, 13 aa, Staphylococcus epidermidis
STPYYLTGKNFRN

SEQ ID NO: 1767075 - protein, 5 aa, Staphylococcus epidermidis
STYSR

SEQ ID NO: 1767076 - protein, 7 aa, Staphylococcus epidermidis
SVEQLEE

SEQ ID NO: 1767077 - protein, 16 aa, Staphylococcus epidermidis
SVGLSEAQAKEAGYDV

SEQ ID NO: 1767078 - protein, 7 aa, Staphylococcus epidermidis
SVNHDTD

SEQ ID NO: 1767079 - protein, 6 aa, Staphylococcus epidermidis
SVNTQD

SEQ ID NO: 1767080 - protein, 8 aa, Staphylococcus epidermidis
SVPENEVQ

SEQ ID NO: 1767081 - protein, 7 aa, Staphylococcus epidermidis
SVPSNIQ

SEQ ID NO: 1767082 - protein, 6 aa, Staphylococcus epidermidis
SVRQVE

SEQ ID NO: 1767083 - protein, 6 aa, Staphylococcus epidermidis
SVSEND

SEQ ID NO: 1767084 - protein, 5 aa, Staphylococcus epidermidis
SVSKS

SEQ ID NO: 1767085 - protein, 11 aa, Staphylococcus epidermidis
SWGAQKQLDTA

SEQ ID NO: 1767086 - protein, 13 aa, Staphylococcus epidermidis
SYKELTKDDLPEG

SEQ ID NO: 1767087 - protein, 7 aa, Staphylococcus epidermidis
SYPGFEV

SEQ ID NO: 1767088 - protein, 5 aa, Staphylococcus epidermidis
SYPQD

SEQ ID NO: 1767089 - protein, 7 aa, Staphylococcus epidermidis
TAADNSQ

SEQ ID NO: 1767090 - protein, 15 aa, Staphylococcus epidermidis
TAAKRARELDERRET

SEQ ID NO: 1767091 - protein, 12 aa, Staphylococcus epidermidis
TAAQAEDGAELA

SEQ ID NO: 1767092 - protein, 7 aa, Staphylococcus epidermidis
TADDDLA

SEQ ID NO: 1767093 - protein, 5 aa, Staphylococcus epidermidis
TAEEI

SEQ ID NO: 1767094 - protein, 4 aa, Staphylococcus epidermidis
TAET

SEQ ID NO: 1767095 - protein, 5 aa, Staphylococcus epidermidis
TAGGI

SEQ ID NO: 1767096 - protein, 9 aa, Staphylococcus epidermidis
TAGMDVSGR

SEQ ID NO: 1767097 - protein, 9 aa, Staphylococcus epidermidis
TANGDLNPV

SEQ ID NO: 1767098 - protein, 9 aa, Staphylococcus epidermidis
TANSGGDKI

SEQ ID NO: 1767099 - protein, 9 aa, Staphylococcus epidermidis
TANSKRTSI

SEQ ID NO: 1767100 - protein, 5 aa, Staphylococcus epidermidis
TAQDL

SEQ ID NO: 1767101 - protein, 8 aa, Staphylococcus epidermidis
TASREDTI

SEQ ID NO: 1767102 - protein, 11 aa, Staphylococcus epidermidis
TAVRNNGGGHL

SEQ ID NO: 1767103 - protein, 4 aa, Staphylococcus epidermidis
TDDV

SEQ ID NO: 1767104 - protein, 4 aa, Staphylococcus epidermidis
TDGL

SEQ ID NO: 1767105 - protein, 5 aa, Staphylococcus epidermidis
TDKGQ

SEQ ID NO: 1767106 - protein, 6 aa, Staphylococcus epidermidis
TDKSYQ

SEQ ID NO: 1767107 - protein, 13 aa, Staphylococcus epidermidis
TDLEKDKQRCSHQ

SEQ ID NO: 1767108 - protein, 8 aa, Staphylococcus epidermidis
TDPEGNGI

SEQ ID NO: 1767109 - protein, 13 aa, Staphylococcus epidermidis
TDQQQALKTTNID

SEQ ID NO: 1767110 - protein, 5 aa, Staphylococcus epidermidis
TDRIG

SEQ ID NO: 1767111 - protein, 10 aa, Staphylococcus epidermidis
TDVSDKESYQ

SEQ ID NO: 1767112 - protein, 8 aa, Staphylococcus epidermidis
TDYPKSAD

SEQ ID NO: 1767113 - protein, 4 aa, Staphylococcus epidermidis
TDYQ

SEQ ID NO: 1767114 - protein, 9 aa, Staphylococcus epidermidis
TEDAIDNNN

SEQ ID NO: 1767115 - protein, 5 aa, Staphylococcus epidermidis
TEGKN

SEQ ID NO: 1767116 - protein, 4 aa, Staphylococcus epidermidis
TEKQ

SEQ ID NO: 1767117 - protein, 10 aa, Staphylococcus epidermidis
TERGIKSAKE

SEQ ID NO: 1767118 - protein, 24 aa, Staphylococcus epidermidis
TETQSQMDKRMRDKTNGKVSRKEM

SEQ ID NO: 1767119 - protein, 11 aa, Staphylococcus epidermidis
TFKEKESELTD

SEQ ID NO: 1767120 - protein, 7 aa, Staphylococcus epidermidis
TFNKDGS

SEQ ID NO: 1767121 - protein, 7 aa, Staphylococcus epidermidis
TFSSSQH

SEQ ID NO: 1767122 - protein, 12 aa, Staphylococcus epidermidis
TGAHGKTSTTGL

SEQ ID NO: 1767123 - protein, 4 aa, Staphylococcus epidermidis
TGAM

SEQ ID NO: 1767124 - protein, 10 aa, Staphylococcus epidermidis
TGASSGIGEA

SEQ ID NO: 1767125 - protein, 5 aa, Staphylococcus epidermidis
TGDNT

SEQ ID NO: 1767126 - protein, 9 aa, Staphylococcus epidermidis
TGEDGEETV

SEQ ID NO: 1767127 - protein, 8 aa, Staphylococcus epidermidis
TGENTTEP

SEQ ID NO: 1767128 - protein, 9 aa, Staphylococcus epidermidis
TGGDSGIGR

SEQ ID NO: 1767129 - protein, 12 aa, Staphylococcus epidermidis
TGIESHNEKDFN

SEQ ID NO: 1767130 - protein, 7 aa, Staphylococcus epidermidis
TGIGRTG

SEQ ID NO: 1767131 - protein, 5 aa, Staphylococcus epidermidis
TGKAL

SEQ ID NO: 1767132 - protein, 15 aa, Staphylococcus epidermidis
TGKETKGYKGSTTFT

SEQ ID NO: 1767133 - protein, 4 aa, Staphylococcus epidermidis
TGKG

SEQ ID NO: 1767134 - protein, 4 aa, Staphylococcus epidermidis
TGLP

SEQ ID NO: 1767135 - protein, 16 aa, Staphylococcus epidermidis
TGMNSTLNQLEKLLNQ

SEQ ID NO: 1767136 - protein, 8 aa, Staphylococcus epidermidis
TGQHDSPI

SEQ ID NO: 1767137 - protein, 5 aa, Staphylococcus epidermidis
TGQLS

SEQ ID NO: 1767138 - protein, 26 aa, Staphylococcus epidermidis
THNETQQKPSHSSKDEQSSDNEYNTI

SEQ ID NO: 1767139 - protein, 6 aa, Staphylococcus epidermidis
THPNNH

SEQ ID NO: 1767140 - protein, 12 aa, Staphylococcus epidermidis
THVEKNDALTMK

SEQ ID NO: 1767141 - protein, 12 aa, Staphylococcus epidermidis
TINHSQQSSMSV

SEQ ID NO: 1767142 - protein, 4 aa, Staphylococcus epidermidis
TITE

SEQ ID NO: 1767143 - protein, 10 aa, Staphylococcus epidermidis
TITKPRPGHA

SEQ ID NO: 1767144 - protein, 11 aa, Staphylococcus epidermidis
TITTESGKEIR

SEQ ID NO: 1767145 - protein, 7 aa, Staphylococcus epidermidis
TKDGDRE

SEQ ID NO: 1767146 - protein, 16 aa, Staphylococcus epidermidis
TKEEAAQHFRDQDAAT

SEQ ID NO: 1767147 - protein, 16 aa, Staphylococcus epidermidis
TKEEQAKKLKAAGVDR

SEQ ID NO: 1767148 - protein, 10 aa, Staphylococcus epidermidis
TKHKDATHNC

SEQ ID NO: 1767149 - protein, 8 aa, Staphylococcus epidermidis
TKKPNTIK

SEQ ID NO: 1767150 - protein, 6 aa, Staphylococcus epidermidis
TKRQDF

SEQ ID NO: 1767151 - protein, 17 aa, Staphylococcus epidermidis
TLENSYNAPGKKCIYID

SEQ ID NO: 1767152 - protein, 5 aa, Staphylococcus epidermidis
TLESG

SEQ ID NO: 1767153 - protein, 4 aa, Staphylococcus epidermidis
TLID

SEQ ID NO: 1767154 - protein, 31 aa, Staphylococcus epidermidis
TLKEQGIKTNKVSQQPKKPTRTIQRSKNTFS

SEQ ID NO: 1767155 - protein, 10 aa, Staphylococcus epidermidis
TLKGNGPKDL

SEQ ID NO: 1767156 - protein, 6 aa, Staphylococcus epidermidis
TLKNND

SEQ ID NO: 1767157 - protein, 4 aa, Staphylococcus epidermidis
TLPD

SEQ ID NO: 1767158 - protein, 13 aa, Staphylococcus epidermidis
TLPERAKKLTHEQ

SEQ ID NO: 1767159 - protein, 4 aa, Staphylococcus epidermidis
TLTR

SEQ ID NO: 1767160 - protein, 12 aa, Staphylococcus epidermidis
TMRGDGKGRASF

SEQ ID NO: 1767161 - protein, 21 aa, Staphylococcus epidermidis
TMTPPDSNVSRYTPDKNELKA

SEQ ID NO: 1767162 - protein, 6 aa, Staphylococcus epidermidis
TNAQQH

SEQ ID NO: 1767163 - protein, 6 aa, Staphylococcus epidermidis
TNDEKV

SEQ ID NO: 1767164 - protein, 5 aa, Staphylococcus epidermidis
TNDGD

SEQ ID NO: 1767165 - protein, 8 aa, Staphylococcus epidermidis
TNDGTQLG

SEQ ID NO: 1767166 - protein, 9 aa, Staphylococcus epidermidis
TNDPSQVVR

SEQ ID NO: 1767167 - protein, 4 aa, Staphylococcus epidermidis
TNDS

SEQ ID NO: 1767168 - protein, 7 aa, Staphylococcus epidermidis
TNGKSRA

SEQ ID NO: 1767169 - protein, 5 aa, Staphylococcus epidermidis
TNGQI

SEQ ID NO: 1767170 - protein, 9 aa, Staphylococcus epidermidis
TNQYNTNSI

SEQ ID NO: 1767171 - protein, 14 aa, Staphylococcus epidermidis
TNSTVTDLDTDNKT

SEQ ID NO: 1767172 - protein, 7 aa, Staphylococcus epidermidis
TNYQQQD

SEQ ID NO: 1767173 - protein, 12 aa, Staphylococcus epidermidis
TPAGMNGNTDSV

SEQ ID NO: 1767174 - protein, 8 aa, Staphylococcus epidermidis
TPGHSPGS

SEQ ID NO: 1767175 - protein, 8 aa, Staphylococcus epidermidis
TPGHTPES

SEQ ID NO: 1767176 - protein, 16 aa, Staphylococcus epidermidis
TPGLSPESLKKQYGIK

SEQ ID NO: 1767177 - protein, 9 aa, Staphylococcus epidermidis
TPKYRGQGI

SEQ ID NO: 1767178 - protein, 11 aa, Staphylococcus epidermidis
TPLEETPDNAD

SEQ ID NO: 1767179 - protein, 20 aa, Staphylococcus epidermidis
TPMTEGTDFGERKKLEAQNI

SEQ ID NO: 1767180 - protein, 5 aa, Staphylococcus epidermidis
TPNAL

SEQ ID NO: 1767181 - protein, 9 aa, Staphylococcus epidermidis
TPQDLTRND

SEQ ID NO: 1767182 - protein, 6 aa, Staphylococcus epidermidis
TPTEKE

SEQ ID NO: 1767183 - protein, 11 aa, Staphylococcus epidermidis
TPTMKSQLEDY

SEQ ID NO: 1767184 - protein, 15 aa, Staphylococcus epidermidis
TPVKEIDGEDPIKAN

SEQ ID NO: 1767185 - protein, 5 aa, Staphylococcus epidermidis
TQELH

SEQ ID NO: 1767186 - protein, 8 aa, Staphylococcus epidermidis
TQELREQG

SEQ ID NO: 1767187 - protein, 5 aa, Staphylococcus epidermidis
TQETA

SEQ ID NO: 1767188 - protein, 16 aa, Staphylococcus epidermidis
TQHAKDIAQSDGYQRR

SEQ ID NO: 1767189 - protein, 11 aa, Staphylococcus epidermidis
TQQGAARVNQL

SEQ ID NO: 1767190 - protein, 12 aa, Staphylococcus epidermidis
TRAFDPSTKVGK

SEQ ID NO: 1767191 - protein, 6 aa, Staphylococcus epidermidis
TRDGEK

SEQ ID NO: 1767192 - protein, 4 aa, Staphylococcus epidermidis
TSAS

SEQ ID NO: 1767193 - protein, 6 aa, Staphylococcus epidermidis
TSESEI

SEQ ID NO: 1767194 - protein, 4 aa, Staphylococcus epidermidis
TSGL

SEQ ID NO: 1767195 - protein, 8 aa, Staphylococcus epidermidis
TSGSFSDR

SEQ ID NO: 1767196 - protein, 9 aa, Staphylococcus epidermidis
TSKRGSLSY

SEQ ID NO: 1767197 - protein, 7 aa, Staphylococcus epidermidis
TSNQDIK

SEQ ID NO: 1767198 - protein, 8 aa, Staphylococcus epidermidis
TSPDFNAS

SEQ ID NO: 1767199 - protein, 16 aa, Staphylococcus epidermidis
TSSHPNVPPRSKEAIQ

SEQ ID NO: 1767200 - protein, 13 aa, Staphylococcus epidermidis
TSVQGGKGAVNEQ

SEQ ID NO: 1767201 - protein, 8 aa, Staphylococcus epidermidis
TTDVTGEV

SEQ ID NO: 1767202 - protein, 9 aa, Staphylococcus epidermidis
TTEKGEQIE

SEQ ID NO: 1767203 - protein, 4 aa, Staphylococcus epidermidis
TTGL

SEQ ID NO: 1767204 - protein, 10 aa, Staphylococcus epidermidis
TTIDASAKNL

SEQ ID NO: 1767205 - protein, 9 aa, Staphylococcus epidermidis
TTLSKQQIK

SEQ ID NO: 1767206 - protein, 12 aa, Staphylococcus epidermidis
TTMDNPEEALGD

SEQ ID NO: 1767207 - protein, 15 aa, Staphylococcus epidermidis
TTPNQDNPITEGKTP

SEQ ID NO: 1767208 - protein, 7 aa, Staphylococcus epidermidis
TTRESYE

SEQ ID NO: 1767209 - protein, 13 aa, Staphylococcus epidermidis
TTTEPNTTPKTEM

SEQ ID NO: 1767210 - protein, 6 aa, Staphylococcus epidermidis
TTTTNY

SEQ ID NO: 1767211 - protein, 4 aa, Staphylococcus epidermidis
TVDQ

SEQ ID NO: 1767212 - protein, 6 aa, Staphylococcus epidermidis
TVEDAI

SEQ ID NO: 1767213 - protein, 11 aa, Staphylococcus epidermidis
TVGNGGNLARK

SEQ ID NO: 1767214 - protein, 4 aa, Staphylococcus epidermidis
TVHT

SEQ ID NO: 1767215 - protein, 15 aa, Staphylococcus epidermidis
TVHTPNGGRSPEGSH

SEQ ID NO: 1767216 - protein, 6 aa, Staphylococcus epidermidis
TVREAS

SEQ ID NO: 1767217 - protein, 6 aa, Staphylococcus epidermidis
TVSQPT

SEQ ID NO: 1767218 - protein, 24 aa, Staphylococcus epidermidis
TVTNDDGTVDFDDNTYTENTRAAY

SEQ ID NO: 1767219 - protein, 6 aa, Staphylococcus epidermidis
TWSDET

SEQ ID NO: 1767220 - protein, 18 aa, Staphylococcus epidermidis
TYAKSRDEFEEQLEQGTF

SEQ ID NO: 1767221 - protein, 6 aa, Staphylococcus epidermidis
TYQDNE

SEQ ID NO: 1767222 - protein, 7 aa, Staphylococcus epidermidis
TYRTTPD

SEQ ID NO: 1767223 - protein, 13 aa, Staphylococcus epidermidis
VAETGAGQHGVAS

SEQ ID NO: 1767224 - protein, 10 aa, Staphylococcus epidermidis
VASNKGLRNA

SEQ ID NO: 1767225 - protein, 9 aa, Staphylococcus epidermidis
VATGQTDEV

SEQ ID NO: 1767226 - protein, 18 aa, Staphylococcus epidermidis
VATKYTPKGIHQNKVATQ

SEQ ID NO: 1767227 - protein, 30 aa, Staphylococcus epidermidis
VDDQTPGNAIHTEGDAEMESVESPENDDRI

SEQ ID NO: 1767228 - protein, 4 aa, Staphylococcus epidermidis
VDKN

SEQ ID NO: 1767229 - protein, 10 aa, Staphylococcus epidermidis
VDSQNKREVR

SEQ ID NO: 1767230 - protein, 10 aa, Staphylococcus epidermidis
VEAEGDKYRN

SEQ ID NO: 1767231 - protein, 18 aa, Staphylococcus epidermidis
VEKRREEFHPSGSRSNLT

SEQ ID NO: 1767232 - protein, 12 aa, Staphylococcus epidermidis
VELNTPKSVEIK

SEQ ID NO: 1767233 - protein, 6 aa, Staphylococcus epidermidis
VESEEY

SEQ ID NO: 1767234 - protein, 12 aa, Staphylococcus epidermidis
VEVDQPVSKEDF

SEQ ID NO: 1767235 - protein, 8 aa, Staphylococcus epidermidis
VGDTVTEG

SEQ ID NO: 1767236 - protein, 6 aa, Staphylococcus epidermidis
VGERLN

SEQ ID NO: 1767237 - protein, 9 aa, Staphylococcus epidermidis
VGETNLDDD

SEQ ID NO: 1767238 - protein, 13 aa, Staphylococcus epidermidis
VGQPREEGTQVGP

SEQ ID NO: 1767239 - protein, 23 aa, Staphylococcus epidermidis
VGRAMNKPAMSAQAVGGAVGSNP

SEQ ID NO: 1767240 - protein, 6 aa, Staphylococcus epidermidis
VHGPSH

SEQ ID NO: 1767241 - protein, 8 aa, Staphylococcus epidermidis
VHQSTSDL

SEQ ID NO: 1767242 - protein, 23 aa, Staphylococcus epidermidis
VIDPEGNDVTPEKLKKIQEEKHN

SEQ ID NO: 1767243 - protein, 4 aa, Staphylococcus epidermidis
VIND

SEQ ID NO: 1767244 - protein, 10 aa, Staphylococcus epidermidis
VKDGDECRES

SEQ ID NO: 1767245 - protein, 4 aa, Staphylococcus epidermidis
VKDN

SEQ ID NO: 1767246 - protein, 7 aa, Staphylococcus epidermidis
VKDNGSA

SEQ ID NO: 1767247 - protein, 8 aa, Staphylococcus epidermidis
VKEETGNQ

SEQ ID NO: 1767248 - protein, 7 aa, Staphylococcus epidermidis
VKEETPV

SEQ ID NO: 1767249 - protein, 7 aa, Staphylococcus epidermidis
VKEKGYG

SEQ ID NO: 1767250 - protein, 23 aa, Staphylococcus epidermidis
VKGKTTVTSTSTFPTESAAQQAI

SEQ ID NO: 1767251 - protein, 8 aa, Staphylococcus epidermidis
VKNEKSGI

SEQ ID NO: 1767252 - protein, 7 aa, Staphylococcus epidermidis
VKQSPFK

SEQ ID NO: 1767253 - protein, 7 aa, Staphylococcus epidermidis
VKSDEDV

SEQ ID NO: 1767254 - protein, 6 aa, Staphylococcus epidermidis
VKSGQA

SEQ ID NO: 1767255 - protein, 10 aa, Staphylococcus epidermidis
VKTDQSSTIE

SEQ ID NO: 1767256 - protein, 9 aa, Staphylococcus epidermidis
VLPTESTQV

SEQ ID NO: 1767257 - protein, 8 aa, Staphylococcus epidermidis
VNAEHSEE

SEQ ID NO: 1767258 - protein, 8 aa, Staphylococcus epidermidis
VNDEIDHD

SEQ ID NO: 1767259 - protein, 6 aa, Staphylococcus epidermidis
VNDESI

SEQ ID NO: 1767260 - protein, 4 aa, Staphylococcus epidermidis
VNDK

SEQ ID NO: 1767261 - protein, 15 aa, Staphylococcus epidermidis
VNEEETESKNDEDLV

SEQ ID NO: 1767262 - protein, 5 aa, Staphylococcus epidermidis
VNEES

SEQ ID NO: 1767263 - protein, 17 aa, Staphylococcus epidermidis
VNGTASLDSEKQDENMQ

SEQ ID NO: 1767264 - protein, 16 aa, Staphylococcus epidermidis
VNNNYDGEVPYDPESF

SEQ ID NO: 1767265 - protein, 4 aa, Staphylococcus epidermidis
VNNS

SEQ ID NO: 1767266 - protein, 9 aa, Staphylococcus epidermidis
VNPNNPAEL

SEQ ID NO: 1767267 - protein, 7 aa, Staphylococcus epidermidis
VNPNSDE

SEQ ID NO: 1767268 - protein, 10 aa, Staphylococcus epidermidis
VNQAGSLVEP

SEQ ID NO: 1767269 - protein, 10 aa, Staphylococcus epidermidis
VNQSEEELYR

SEQ ID NO: 1767270 - protein, 4 aa, Staphylococcus epidermidis
VNSE

SEQ ID NO: 1767271 - protein, 5 aa, Staphylococcus epidermidis
VNSNE

SEQ ID NO: 1767272 - protein, 10 aa, Staphylococcus epidermidis
VNSNPNKEDI

SEQ ID NO: 1767273 - protein, 9 aa, Staphylococcus epidermidis
VNTKEISQN

SEQ ID NO: 1767274 - protein, 5 aa, Staphylococcus epidermidis
VQPQQ

SEQ ID NO: 1767275 - protein, 8 aa, Staphylococcus epidermidis
VQQESGGI

SEQ ID NO: 1767276 - protein, 7 aa, Staphylococcus epidermidis
VQRNTEV

SEQ ID NO: 1767277 - protein, 8 aa, Staphylococcus epidermidis
VRPYTEKE

SEQ ID NO: 1767278 - protein, 8 aa, Staphylococcus epidermidis
VSDDRGRR

SEQ ID NO: 1767279 - protein, 26 aa, Staphylococcus epidermidis
VSEAETGSPTRGGRPSTHAVKAENGY

SEQ ID NO: 1767280 - protein, 9 aa, Staphylococcus epidermidis
VSIKRAEGK

SEQ ID NO: 1767281 - protein, 6 aa, Staphylococcus epidermidis
VSKNGK

SEQ ID NO: 1767282 - protein, 7 aa, Staphylococcus epidermidis
VSPGEHL

SEQ ID NO: 1767283 - protein, 5 aa, Staphylococcus epidermidis
VSQEM

SEQ ID NO: 1767284 - protein, 4 aa, Staphylococcus epidermidis
VSQP

SEQ ID NO: 1767285 - protein, 7 aa, Staphylococcus epidermidis
VSSGRDS

SEQ ID NO: 1767286 - protein, 6 aa, Staphylococcus epidermidis
VSTRKV

SEQ ID NO: 1767287 - protein, 4 aa, Staphylococcus epidermidis
VSVE

SEQ ID NO: 1767288 - protein, 6 aa, Staphylococcus epidermidis
VTENDF

SEQ ID NO: 1767289 - protein, 16 aa, Staphylococcus epidermidis
VTGKTLRENNEGKNIK

SEQ ID NO: 1767290 - protein, 6 aa, Staphylococcus epidermidis
VTKAVE

SEQ ID NO: 1767291 - protein, 9 aa, Staphylococcus epidermidis
VTNKTKDKH

SEQ ID NO: 1767292 - protein, 29 aa, Staphylococcus epidermidis
VVNPGGSMTGGGARKTKSILSQKDELSTM

SEQ ID NO: 1767293 - protein, 7 aa, Staphylococcus epidermidis
VYAERTA

SEQ ID NO: 1767294 - protein, 6 aa, Staphylococcus epidermidis
VYPESS

SEQ ID NO: 1767295 - protein, 14 aa, Staphylococcus epidermidis
WATTEENVNQLLEL

SEQ ID NO: 1767296 - protein, 10 aa, Staphylococcus epidermidis
WKTNSSDDDI

SEQ ID NO: 1767297 - protein, 4 aa, Staphylococcus epidermidis
WPEG

SEQ ID NO: 1767298 - protein, 5 aa, Staphylococcus epidermidis
WRGTY

SEQ ID NO: 1767299 - protein, 12 aa, Staphylococcus epidermidis
YAGKEATLKTGQ

SEQ ID NO: 1767300 - protein, 4 aa, Staphylococcus epidermidis
YAKT

SEQ ID NO: 1767301 - protein, 6 aa, Staphylococcus epidermidis
YASPST

SEQ ID NO: 1767302 - protein, 24 aa, Staphylococcus epidermidis
YAYTGEGKHINSGELDGLENEAAI

SEQ ID NO: 1767303 - protein, 5 aa, Staphylococcus epidermidis
YDKDR

SEQ ID NO: 1767304 - protein, 5 aa, Staphylococcus epidermidis
YDKEE

SEQ ID NO: 1767305 - protein, 9 aa, Staphylococcus epidermidis
YDKSSVADI

SEQ ID NO: 1767306 - protein, 4 aa, Staphylococcus epidermidis
YDSP

SEQ ID NO: 1767307 - protein, 17 aa, Staphylococcus epidermidis
YDSRREAFDASGDLKPY

SEQ ID NO: 1767308 - protein, 8 aa, Staphylococcus epidermidis
YDSSTALT

SEQ ID NO: 1767309 - protein, 6 aa, Staphylococcus epidermidis
YEAQDY

SEQ ID NO: 1767310 - protein, 16 aa, Staphylococcus epidermidis
YERKDREGIFHTQWVE

SEQ ID NO: 1767311 - protein, 6 aa, Staphylococcus epidermidis
YETGET

SEQ ID NO: 1767312 - protein, 6 aa, Staphylococcus epidermidis
YEVGQE

SEQ ID NO: 1767313 - protein, 5 aa, Staphylococcus epidermidis
YFDNK

SEQ ID NO: 1767314 - protein, 12 aa, Staphylococcus epidermidis
YFSRNAEDLQRD

SEQ ID NO: 1767315 - protein, 8 aa, Staphylococcus epidermidis
YGAGSKDF

SEQ ID NO: 1767316 - protein, 14 aa, Staphylococcus epidermidis
YGAKVDISTSKNVG

SEQ ID NO: 1767317 - protein, 7 aa, Staphylococcus epidermidis
YGKPSKL

SEQ ID NO: 1767318 - protein, 15 aa, Staphylococcus epidermidis
YGSNPRDWKGQDVPA

SEQ ID NO: 1767319 - protein, 4 aa, Staphylococcus epidermidis
YGYT

SEQ ID NO: 1767320 - protein, 13 aa, Staphylococcus epidermidis
YHGEVTAPKTKAA

SEQ ID NO: 1767321 - protein, 4 aa, Staphylococcus epidermidis
YHGN

SEQ ID NO: 1767322 - protein, 5 aa, Staphylococcus epidermidis
YHNNQ

SEQ ID NO: 1767323 - protein, 4 aa, Staphylococcus epidermidis
YIDE

SEQ ID NO: 1767324 - protein, 11 aa, Staphylococcus epidermidis
YITPDNATTEI

SEQ ID NO: 1767325 - protein, 12 aa, Staphylococcus epidermidis
YKDSREQFEQRT

SEQ ID NO: 1767326 - protein, 14 aa, Staphylococcus epidermidis
YKDTNEDLEGYMFY

SEQ ID NO: 1767327 - protein, 9 aa, Staphylococcus epidermidis
YKITKPKNA

SEQ ID NO: 1767328 - protein, 8 aa, Staphylococcus epidermidis
YKNKNDLD

SEQ ID NO: 1767329 - protein, 5 aa, Staphylococcus epidermidis
YLQSQ

SEQ ID NO: 1767330 - protein, 27 aa, Staphylococcus epidermidis
YLSPDRKKKLQKMKTRAENRKFIKSDD

SEQ ID NO: 1767331 - protein, 15 aa, Staphylococcus epidermidis
YNAKDKKSQIKVRQQ

SEQ ID NO: 1767332 - protein, 4 aa, Staphylococcus epidermidis
YNEH

SEQ ID NO: 1767333 - protein, 9 aa, Staphylococcus epidermidis
YPDAQNKNS

SEQ ID NO: 1767334 - protein, 6 aa, Staphylococcus epidermidis
YPDDTD

SEQ ID NO: 1767335 - protein, 4 aa, Staphylococcus epidermidis
YPDV

SEQ ID NO: 1767336 - protein, 9 aa, Staphylococcus epidermidis
YPEDHKDQR

SEQ ID NO: 1767337 - protein, 6 aa, Staphylococcus epidermidis
YPIRDE

SEQ ID NO: 1767338 - protein, 6 aa, Staphylococcus epidermidis
YPNQPF

SEQ ID NO: 1767339 - protein, 9 aa, Staphylococcus epidermidis
YPRTDSNYL

SEQ ID NO: 1767340 - protein, 12 aa, Staphylococcus epidermidis
YPSEISGGQKQR

SEQ ID NO: 1767341 - protein, 8 aa, Staphylococcus epidermidis
YPYPEGNK

SEQ ID NO: 1767342 - protein, 6 aa, Staphylococcus epidermidis
YQEEKG

SEQ ID NO: 1767343 - protein, 10 aa, Staphylococcus epidermidis
YQGNDSKQTF

SEQ ID NO: 1767344 - protein, 5 aa, Staphylococcus epidermidis
YQQTR

SEQ ID NO: 1767345 - protein, 6 aa, Staphylococcus epidermidis
YQRRGY

SEQ ID NO: 1767346 - protein, 6 aa, Staphylococcus epidermidis
YQSDKN

SEQ ID NO: 1767347 - protein, 4 aa, Staphylococcus epidermidis
YQSY

SEQ ID NO: 1767348 - protein, 5 aa, Staphylococcus epidermidis
YRDEL

SEQ ID NO: 1767349 - protein, 15 aa, Staphylococcus epidermidis
YRSARERALSNNHIP

SEQ ID NO: 1767350 - protein, 9 aa, Staphylococcus epidermidis
YSDDERAQT

SEQ ID NO: 1767351 - protein, 4 aa, Staphylococcus epidermidis
YSDS

SEQ ID NO: 1767352 - protein, 8 aa, Staphylococcus epidermidis
YSFNSPKG

SEQ ID NO: 1767353 - protein, 5 aa, Staphylococcus epidermidis
YSIET

SEQ ID NO: 1767354 - protein, 6 aa, Staphylococcus epidermidis
YSPEKQ

SEQ ID NO: 1767355 - protein, 7 aa, Staphylococcus epidermidis
YSTDQPV

SEQ ID NO: 1767356 - protein, 4 aa, Staphylococcus epidermidis
YTDF

SEQ ID NO: 1767357 - protein, 17 aa, Staphylococcus epidermidis
YTQTDISNQLNKDTIEA

SEQ ID NO: 1767358 - protein, 4 aa, Staphylococcus epidermidis
YTTP

SEQ ID NO: 1767359 - protein, 16 aa, Staphylococcus epidermidis
YTTSSKDDASKPVGPS

SEQ ID NO: 1767360 - protein, 4 aa, Staphylococcus epidermidis
YVSR

SEQ ID NO: 1767361 - protein, 12 aa, Staphylococcus epidermidis
AADKITDSIEAT

SEQ ID NO: 1767362 - protein, 6 aa, Staphylococcus epidermidis
AAEGTI

SEQ ID NO: 1767363 - protein, 4 aa, Staphylococcus epidermidis
AAEN

SEQ ID NO: 1767364 - protein, 10 aa, Staphylococcus epidermidis
AAGKGGNIKR

SEQ ID NO: 1767365 - protein, 4 aa, Staphylococcus epidermidis
AAIQ

SEQ ID NO: 1767366 - protein, 7 aa, Staphylococcus epidermidis
AAKKESF

SEQ ID NO: 1767367 - protein, 9 aa, Staphylococcus epidermidis
AARSGLERI

SEQ ID NO: 1767368 - protein, 6 aa, Staphylococcus epidermidis
AASEVE

SEQ ID NO: 1767369 - protein, 11 aa, Staphylococcus epidermidis
AASGNRNWGQN

SEQ ID NO: 1767370 - protein, 7 aa, Staphylococcus epidermidis
AASYGAK

SEQ ID NO: 1767371 - protein, 11 aa, Staphylococcus epidermidis
AAVSTQTLQRD

SEQ ID NO: 1767372 - protein, 8 aa, Staphylococcus epidermidis
ADDTPEQI

SEQ ID NO: 1767373 - protein, 12 aa, Staphylococcus epidermidis
ADEKVSEGSTKA

SEQ ID NO: 1767374 - protein, 5 aa, Staphylococcus epidermidis
ADESY

SEQ ID NO: 1767375 - protein, 16 aa, Staphylococcus epidermidis
ADETTQDRLNSSYQDA

SEQ ID NO: 1767376 - protein, 7 aa, Staphylococcus epidermidis
ADGDNYA

SEQ ID NO: 1767377 - protein, 7 aa, Staphylococcus epidermidis
ADIEEMK

SEQ ID NO: 1767378 - protein, 4 aa, Staphylococcus epidermidis
ADRF

SEQ ID NO: 1767379 - protein, 7 aa, Staphylococcus epidermidis
AEDKGHE

SEQ ID NO: 1767380 - protein, 9 aa, Staphylococcus epidermidis
AEHRKAQNF

SEQ ID NO: 1767381 - protein, 19 aa, Staphylococcus epidermidis
AEKGQEALKELSKKSQHEI

SEQ ID NO: 1767382 - protein, 14 aa, Staphylococcus epidermidis
AEKIEQGIKRGKKH

SEQ ID NO: 1767383 - protein, 11 aa, Staphylococcus epidermidis
AEKTTDIKKNH

SEQ ID NO: 1767384 - protein, 6 aa, Staphylococcus epidermidis
AENNDD

SEQ ID NO: 1767385 - protein, 7 aa, Staphylococcus epidermidis
AERYAKK

SEQ ID NO: 1767386 - protein, 4 aa, Staphylococcus epidermidis
AFKN

SEQ ID NO: 1767387 - protein, 5 aa, Staphylococcus epidermidis
AFTPT

SEQ ID NO: 1767388 - protein, 5 aa, Staphylococcus epidermidis
AGALA

SEQ ID NO: 1767389 - protein, 7 aa, Staphylococcus epidermidis
AGEAFDN

SEQ ID NO: 1767390 - protein, 5 aa, Staphylococcus epidermidis
AGFNK

SEQ ID NO: 1767391 - protein, 6 aa, Staphylococcus epidermidis
AGFQKP

SEQ ID NO: 1767392 - protein, 6 aa, Staphylococcus epidermidis
AGGSDL

SEQ ID NO: 1767393 - protein, 10 aa, Staphylococcus epidermidis
AGHGKKGAQH

SEQ ID NO: 1767394 - protein, 5 aa, Staphylococcus epidermidis
AGIDT

SEQ ID NO: 1767395 - protein, 16 aa, Staphylococcus epidermidis
AGIESSNENNNAGTGH

SEQ ID NO: 1767396 - protein, 10 aa, Staphylococcus epidermidis
AGLAESHPHN

SEQ ID NO: 1767397 - protein, 6 aa, Staphylococcus epidermidis
AGTTRD

SEQ ID NO: 1767398 - protein, 6 aa, Staphylococcus epidermidis
AGVGDY

SEQ ID NO: 1767399 - protein, 9 aa, Staphylococcus epidermidis
AHNNDQADP

SEQ ID NO: 1767400 - protein, 5 aa, Staphylococcus epidermidis
AIDKR

SEQ ID NO: 1767401 - protein, 6 aa, Staphylococcus epidermidis
AKADDV

SEQ ID NO: 1767402 - protein, 7 aa, Staphylococcus epidermidis
AKATHRQ

SEQ ID NO: 1767403 - protein, 30 aa, Staphylococcus epidermidis
AKDDKENDKENKLPQLDKGDKVTATKIEPA

SEQ ID NO: 1767404 - protein, 6 aa, Staphylococcus epidermidis
AKDEIR

SEQ ID NO: 1767405 - protein, 15 aa, Staphylococcus epidermidis
AKDLFGEETVHLVDE

SEQ ID NO: 1767406 - protein, 26 aa, Staphylococcus epidermidis
AKEISDQGRVTVNGNVAKAGTDIKEN

SEQ ID NO: 1767407 - protein, 7 aa, Staphylococcus epidermidis
AKFKDNP

SEQ ID NO: 1767408 - protein, 13 aa, Staphylococcus epidermidis
AKGVSKANDISDT

SEQ ID NO: 1767409 - protein, 45 aa, Staphylococcus epidermidis
AKINNSNETGNQSNISHSKRSQYSTNESKNIDTQTSNSSTSNQNF

SEQ ID NO: 1767410 - protein, 6 aa, Staphylococcus epidermidis
AKIPTH

SEQ ID NO: 1767411 - protein, 17 aa, Staphylococcus epidermidis
AKKYVKRKDFSDEANNA

SEQ ID NO: 1767412 - protein, 10 aa, Staphylococcus epidermidis
AKMGPASDPM

SEQ ID NO: 1767413 - protein, 7 aa, Staphylococcus epidermidis
AKNPNDS

SEQ ID NO: 1767414 - protein, 9 aa, Staphylococcus epidermidis
AKRAAAKQT

SEQ ID NO: 1767415 - protein, 14 aa, Staphylococcus epidermidis
ALEDKEKEIREKDD

SEQ ID NO: 1767416 - protein, 13 aa, Staphylococcus epidermidis
ALGPGGLTRERAQ

SEQ ID NO: 1767417 - protein, 7 aa, Staphylococcus epidermidis
ALGTDPV

SEQ ID NO: 1767418 - protein, 11 aa, Staphylococcus epidermidis
ALMSGSGPTVY

SEQ ID NO: 1767419 - protein, 6 aa, Staphylococcus epidermidis
ALSKPY

SEQ ID NO: 1767420 - protein, 4 aa, Staphylococcus epidermidis
ANAS

SEQ ID NO: 1767421 - protein, 5 aa, Staphylococcus epidermidis
ANEYQ

SEQ ID NO: 1767422 - protein, 8 aa, Staphylococcus epidermidis
ANGAGKTS

SEQ ID NO: 1767423 - protein, 6 aa, Staphylococcus epidermidis
ANGFDE

SEQ ID NO: 1767424 - protein, 10 aa, Staphylococcus epidermidis
ANGLKEVSEA

SEQ ID NO: 1767425 - protein, 9 aa, Staphylococcus epidermidis
ANLNKTVSA

SEQ ID NO: 1767426 - protein, 15 aa, Staphylococcus epidermidis
ANNKRASYIFIYCLY

SEQ ID NO: 1767427 - protein, 12 aa, Staphylococcus epidermidis
ANNPLEYGVHKH

SEQ ID NO: 1767428 - protein, 5 aa, Staphylococcus epidermidis
ANSGV

SEQ ID NO: 1767429 - protein, 9 aa, Staphylococcus epidermidis
ANSQSLDYD

SEQ ID NO: 1767430 - protein, 6 aa, Staphylococcus epidermidis
APDAEE

SEQ ID NO: 1767431 - protein, 8 aa, Staphylococcus epidermidis
APGFGDRR

SEQ ID NO: 1767432 - protein, 9 aa, Staphylococcus epidermidis
APVTEATVG

SEQ ID NO: 1767433 - protein, 11 aa, Staphylococcus epidermidis
AQENEDYRGMG

SEQ ID NO: 1767434 - protein, 7 aa, Staphylococcus epidermidis
AQKYSQT

SEQ ID NO: 1767435 - protein, 4 aa, Staphylococcus epidermidis
AQLG

SEQ ID NO: 1767436 - protein, 10 aa, Staphylococcus epidermidis
AQRQAGVGAQ

SEQ ID NO: 1767437 - protein, 4 aa, Staphylococcus epidermidis
AQRY

SEQ ID NO: 1767438 - protein, 19 aa, Staphylococcus epidermidis
AQSLRNELSESEKQKADQE

SEQ ID NO: 1767439 - protein, 18 aa, Staphylococcus epidermidis
AQSYSTHVRSGMGGFKGR

SEQ ID NO: 1767440 - protein, 8 aa, Staphylococcus epidermidis
AQTPVAET

SEQ ID NO: 1767441 - protein, 6 aa, Staphylococcus epidermidis
ARATYD

SEQ ID NO: 1767442 - protein, 4 aa, Staphylococcus epidermidis
AREA

SEQ ID NO: 1767443 - protein, 5 aa, Staphylococcus epidermidis
ARKPT

SEQ ID NO: 1767444 - protein, 9 aa, Staphylococcus epidermidis
ARSAGKKVE

SEQ ID NO: 1767445 - protein, 10 aa, Staphylococcus epidermidis
ARVQAESQKL

SEQ ID NO: 1767446 - protein, 7 aa, Staphylococcus epidermidis
ARYDKLK

SEQ ID NO: 1767447 - protein, 7 aa, Staphylococcus epidermidis
ASESIEQ

SEQ ID NO: 1767448 - protein, 8 aa, Staphylococcus epidermidis
ASGAVSGL

SEQ ID NO: 1767449 - protein, 8 aa, Staphylococcus epidermidis
ASGKPTAE

SEQ ID NO: 1767450 - protein, 8 aa, Staphylococcus epidermidis
ASKQGTGC

SEQ ID NO: 1767451 - protein, 7 aa, Staphylococcus epidermidis
ASSGPAF

SEQ ID NO: 1767452 - protein, 13 aa, Staphylococcus epidermidis
ASSSEEVRNRGVE

SEQ ID NO: 1767453 - protein, 15 aa, Staphylococcus epidermidis
ASYVPDKNNNKIIES

SEQ ID NO: 1767454 - protein, 5 aa, Staphylococcus epidermidis
ATDGV

SEQ ID NO: 1767455 - protein, 6 aa, Staphylococcus epidermidis
ATDTGL

SEQ ID NO: 1767456 - protein, 4 aa, Staphylococcus epidermidis
ATEE

SEQ ID NO: 1767457 - protein, 21 aa, Staphylococcus epidermidis
ATGDGSIAAQSAADYITELKD

SEQ ID NO: 1767458 - protein, 6 aa, Staphylococcus epidermidis
ATGIGK

SEQ ID NO: 1767459 - protein, 7 aa, Staphylococcus epidermidis
ATGTGKT

SEQ ID NO: 1767460 - protein, 14 aa, Staphylococcus epidermidis
ATIETARKKYPQKD

SEQ ID NO: 1767461 - protein, 7 aa, Staphylococcus epidermidis
ATKGGNA

SEQ ID NO: 1767462 - protein, 4 aa, Staphylococcus epidermidis
ATNR

SEQ ID NO: 1767463 - protein, 8 aa, Staphylococcus epidermidis
ATPERTDE

SEQ ID NO: 1767464 - protein, 5 aa, Staphylococcus epidermidis
ATSEN

SEQ ID NO: 1767465 - protein, 5 aa, Staphylococcus epidermidis
AVADE

SEQ ID NO: 1767466 - protein, 7 aa, Staphylococcus epidermidis
AVDQTKE

SEQ ID NO: 1767467 - protein, 7 aa, Staphylococcus epidermidis
AVDTEGV

SEQ ID NO: 1767468 - protein, 7 aa, Staphylococcus epidermidis
AVEAAKK

SEQ ID NO: 1767469 - protein, 4 aa, Staphylococcus epidermidis
AVED

SEQ ID NO: 1767470 - protein, 20 aa, Staphylococcus epidermidis
AVPEENGKEISRIGSTFGKT

SEQ ID NO: 1767471 - protein, 27 aa, Staphylococcus epidermidis
AVSGSGVKGKRDLAEGANGKEPEAYPY

SEQ ID NO: 1767472 - protein, 6 aa, Staphylococcus epidermidis
AYPQPN

SEQ ID NO: 1767473 - protein, 4 aa, Staphylococcus epidermidis
AYSP

SEQ ID NO: 1767474 - protein, 8 aa, Staphylococcus epidermidis
CGNGNDTA

SEQ ID NO: 1767475 - protein, 4 aa, Staphylococcus epidermidis
CGVD

SEQ ID NO: 1767476 - protein, 6 aa, Staphylococcus epidermidis
CQTSHS

SEQ ID NO: 1767477 - protein, 14 aa, Staphylococcus epidermidis
CREGQKRHKAKIKE

SEQ ID NO: 1767478 - protein, 4 aa, Staphylococcus epidermidis
CSAG

SEQ ID NO: 1767479 - protein, 11 aa, Staphylococcus epidermidis
DAANKYTRKDM

SEQ ID NO: 1767480 - protein, 13 aa, Staphylococcus epidermidis
DAGEISDDTEKAV

SEQ ID NO: 1767481 - protein, 4 aa, Staphylococcus epidermidis
DALE

SEQ ID NO: 1767482 - protein, 8 aa, Staphylococcus epidermidis
DANRDAFK

SEQ ID NO: 1767483 - protein, 6 aa, Staphylococcus epidermidis
DANVAD

SEQ ID NO: 1767484 - protein, 14 aa, Staphylococcus epidermidis
DAPIGRNKNDRQSM

SEQ ID NO: 1767485 - protein, 8 aa, Staphylococcus epidermidis
DAPKKKPK

SEQ ID NO: 1767486 - protein, 12 aa, Staphylococcus epidermidis
DAQIYEKEDNKI

SEQ ID NO: 1767487 - protein, 6 aa, Staphylococcus epidermidis
DATNDF

SEQ ID NO: 1767488 - protein, 8 aa, Staphylococcus epidermidis
DAVQNSKV

SEQ ID NO: 1767489 - protein, 5 aa, Staphylococcus epidermidis
DDETI

SEQ ID NO: 1767490 - protein, 9 aa, Staphylococcus epidermidis
DDLKNLENG

SEQ ID NO: 1767491 - protein, 5 aa, Staphylococcus epidermidis
DDQSM

SEQ ID NO: 1767492 - protein, 4 aa, Staphylococcus epidermidis
DDVT

SEQ ID NO: 1767493 - protein, 19 aa, Staphylococcus epidermidis
DEANIQNAPGVKKANSELH

SEQ ID NO: 1767494 - protein, 4 aa, Staphylococcus epidermidis
DEDE

SEQ ID NO: 1767495 - protein, 11 aa, Staphylococcus epidermidis
DEDLPMEETTA

SEQ ID NO: 1767496 - protein, 5 aa, Staphylococcus epidermidis
DEEIR

SEQ ID NO: 1767497 - protein, 7 aa, Staphylococcus epidermidis
DEESDWK

SEQ ID NO: 1767498 - protein, 5 aa, Staphylococcus epidermidis
DEEVD

SEQ ID NO: 1767499 - protein, 11 aa, Staphylococcus epidermidis
DEIEKRLNNKK

SEQ ID NO: 1767500 - protein, 4 aa, Staphylococcus epidermidis
DEKR

SEQ ID NO: 1767501 - protein, 8 aa, Staphylococcus epidermidis
DELTQTRR

SEQ ID NO: 1767502 - protein, 5 aa, Staphylococcus epidermidis
DEPTD

SEQ ID NO: 1767503 - protein, 12 aa, Staphylococcus epidermidis
DESERQKKDEKL

SEQ ID NO: 1767504 - protein, 14 aa, Staphylococcus epidermidis
DEVAETAKELGIDG

SEQ ID NO: 1767505 - protein, 6 aa, Staphylococcus epidermidis
DEVPEE

SEQ ID NO: 1767506 - protein, 12 aa, Staphylococcus epidermidis
DFNPETDSIAET

SEQ ID NO: 1767507 - protein, 11 aa, Staphylococcus epidermidis
DFSEDAEDAGV

SEQ ID NO: 1767508 - protein, 7 aa, Staphylococcus epidermidis
DGFPDHG

SEQ ID NO: 1767509 - protein, 4 aa, Staphylococcus epidermidis
DGGF

SEQ ID NO: 1767510 - protein, 14 aa, Staphylococcus epidermidis
DGIQQRGKVELNEK

SEQ ID NO: 1767511 - protein, 8 aa, Staphylococcus epidermidis
DGKDTAKD

SEQ ID NO: 1767512 - protein, 7 aa, Staphylococcus epidermidis
DGNYTYF

SEQ ID NO: 1767513 - protein, 7 aa, Staphylococcus epidermidis
DGRFDKV

SEQ ID NO: 1767514 - protein, 10 aa, Staphylococcus epidermidis
DGRTGEPFDN

SEQ ID NO: 1767515 - protein, 6 aa, Staphylococcus epidermidis
DGTVEG

SEQ ID NO: 1767516 - protein, 6 aa, Staphylococcus epidermidis
DGVMPQ

SEQ ID NO: 1767517 - protein, 7 aa, Staphylococcus epidermidis
DIAGKKA

SEQ ID NO: 1767518 - protein, 27 aa, Staphylococcus epidermidis
DIDNKIKKTNELKSDLTELEKSEPEGI

SEQ ID NO: 1767519 - protein, 6 aa, Staphylococcus epidermidis
DIDTEK

SEQ ID NO: 1767520 - protein, 9 aa, Staphylococcus epidermidis
DKDSSHKGN

SEQ ID NO: 1767521 - protein, 12 aa, Staphylococcus epidermidis
DKETLKKGVEHA

SEQ ID NO: 1767522 - protein, 6 aa, Staphylococcus epidermidis
DKGTEI

SEQ ID NO: 1767523 - protein, 4 aa, Staphylococcus epidermidis
DKIE

SEQ ID NO: 1767524 - protein, 17 aa, Staphylococcus epidermidis
DKITEAEEAGADYVGEA

SEQ ID NO: 1767525 - protein, 7 aa, Staphylococcus epidermidis
DKKNQMT

SEQ ID NO: 1767526 - protein, 7 aa, Staphylococcus epidermidis
DKKTSKI

SEQ ID NO: 1767527 - protein, 4 aa, Staphylococcus epidermidis
DKLA

SEQ ID NO: 1767528 - protein, 8 aa, Staphylococcus epidermidis
DKNEYDAD

SEQ ID NO: 1767529 - protein, 5 aa, Staphylococcus epidermidis
DKPES

SEQ ID NO: 1767530 - protein, 19 aa, Staphylococcus epidermidis
DKSSYLSKLKEKKEQLNEI

SEQ ID NO: 1767531 - protein, 6 aa, Staphylococcus epidermidis
DLGTDR

SEQ ID NO: 1767532 - protein, 6 aa, Staphylococcus epidermidis
DLGTEI

SEQ ID NO: 1767533 - protein, 9 aa, Staphylococcus epidermidis
DLNAADEEA

SEQ ID NO: 1767534 - protein, 8 aa, Staphylococcus epidermidis
DLNHTGAH

SEQ ID NO: 1767535 - protein, 8 aa, Staphylococcus epidermidis
DLNNSAAN

SEQ ID NO: 1767536 - protein, 14 aa, Staphylococcus epidermidis
DLPNEDKPAYGQKV

SEQ ID NO: 1767537 - protein, 10 aa, Staphylococcus epidermidis
DLSPQDGRAN

SEQ ID NO: 1767538 - protein, 45 aa, Staphylococcus epidermidis
DLTPEERAMKQKQNQEISANQPSTSSSESVSQSNANNESSQSTSN

SEQ ID NO: 1767539 - protein, 4 aa, Staphylococcus epidermidis
DNDI

SEQ ID NO: 1767540 - protein, 7 aa, Staphylococcus epidermidis
DNGRGIP

SEQ ID NO: 1767541 - protein, 7 aa, Staphylococcus epidermidis
DNKEQLY

SEQ ID NO: 1767542 - protein, 10 aa, Staphylococcus epidermidis
DNKVTEGSTV

SEQ ID NO: 1767543 - protein, 33 aa, Staphylococcus epidermidis
DNPITKKNYYSGKKEFAGKPVTEETANKVEEEL

SEQ ID NO: 1767544 - protein, 5 aa, Staphylococcus epidermidis
DNTYI

SEQ ID NO: 1767545 - protein, 6 aa, Staphylococcus epidermidis
DNVSPV

SEQ ID NO: 1767546 - protein, 10 aa, Staphylococcus epidermidis
DPKHANDETM

SEQ ID NO: 1767547 - protein, 10 aa, Staphylococcus epidermidis
DPRQRQSREN

SEQ ID NO: 1767548 - protein, 7 aa, Staphylococcus epidermidis
DPTCGSG

SEQ ID NO: 1767549 - protein, 18 aa, Staphylococcus epidermidis
DPTILNENANKDSNTFST

SEQ ID NO: 1767550 - protein, 4 aa, Staphylococcus epidermidis
DQDD

SEQ ID NO: 1767551 - protein, 5 aa, Staphylococcus epidermidis
DQDPH

SEQ ID NO: 1767552 - protein, 8 aa, Staphylococcus epidermidis
DQEKISRE

SEQ ID NO: 1767553 - protein, 5 aa, Staphylococcus epidermidis
DQIIP

SEQ ID NO: 1767554 - protein, 6 aa, Staphylococcus epidermidis
DQLRQE

SEQ ID NO: 1767555 - protein, 25 aa, Staphylococcus epidermidis
DQSGGSTPKALKEYGVNEDQYSNED

SEQ ID NO: 1767556 - protein, 7 aa, Staphylococcus epidermidis
DQTDTKI

SEQ ID NO: 1767557 - protein, 5 aa, Staphylococcus epidermidis
DQYGQ

SEQ ID NO: 1767558 - protein, 5 aa, Staphylococcus epidermidis
DREVE

SEQ ID NO: 1767559 - protein, 7 aa, Staphylococcus epidermidis
DSAIEQD

SEQ ID NO: 1767560 - protein, 13 aa, Staphylococcus epidermidis
DSDSGERVQEEVL

SEQ ID NO: 1767561 - protein, 7 aa, Staphylococcus epidermidis
DSELDEA

SEQ ID NO: 1767562 - protein, 5 aa, Staphylococcus epidermidis
DSIDP

SEQ ID NO: 1767563 - protein, 6 aa, Staphylococcus epidermidis
DSKLTD

SEQ ID NO: 1767564 - protein, 12 aa, Staphylococcus epidermidis
DSMSGGEKAKYK

SEQ ID NO: 1767565 - protein, 8 aa, Staphylococcus epidermidis
DSNDDLKR

SEQ ID NO: 1767566 - protein, 4 aa, Staphylococcus epidermidis
DSSI

SEQ ID NO: 1767567 - protein, 10 aa, Staphylococcus epidermidis
DSSKRDAHAS

SEQ ID NO: 1767568 - protein, 10 aa, Staphylococcus epidermidis
DSTATSQTPV

SEQ ID NO: 1767569 - protein, 5 aa, Staphylococcus epidermidis
DSTDF

SEQ ID NO: 1767570 - protein, 12 aa, Staphylococcus epidermidis
DSTERPEGVDAG

SEQ ID NO: 1767571 - protein, 4 aa, Staphylococcus epidermidis
DSTV

SEQ ID NO: 1767572 - protein, 4 aa, Staphylococcus epidermidis
DSTY

SEQ ID NO: 1767573 - protein, 6 aa, Staphylococcus epidermidis
DSVNNE

SEQ ID NO: 1767574 - protein, 8 aa, Staphylococcus epidermidis
DTANDMKT

SEQ ID NO: 1767575 - protein, 5 aa, Staphylococcus epidermidis
DTEGH

SEQ ID NO: 1767576 - protein, 6 aa, Staphylococcus epidermidis
DTFRAG

SEQ ID NO: 1767577 - protein, 6 aa, Staphylococcus epidermidis
DTGRYQ

SEQ ID NO: 1767578 - protein, 14 aa, Staphylococcus epidermidis
DTMKEATKPGVTTR

SEQ ID NO: 1767579 - protein, 16 aa, Staphylococcus epidermidis
DTNESHHSSDNKPLPN

SEQ ID NO: 1767580 - protein, 11 aa, Staphylococcus epidermidis
DTSNEEAQKVN

SEQ ID NO: 1767581 - protein, 11 aa, Staphylococcus epidermidis
DTVGKPSENVE

SEQ ID NO: 1767582 - protein, 8 aa, Staphylococcus epidermidis
DVARGSQG

SEQ ID NO: 1767583 - protein, 5 aa, Staphylococcus epidermidis
DVKGG

SEQ ID NO: 1767584 - protein, 9 aa, Staphylococcus epidermidis
DVNQKDLSS

SEQ ID NO: 1767585 - protein, 9 aa, Staphylococcus epidermidis
DVSKGTISI

SEQ ID NO: 1767586 - protein, 6 aa, Staphylococcus epidermidis
DWPSAG

SEQ ID NO: 1767587 - protein, 24 aa, Staphylococcus epidermidis
DWSEKRRKGLNDKPVIAEGKHSPI

SEQ ID NO: 1767588 - protein, 10 aa, Staphylococcus epidermidis
DYEENTPLEE

SEQ ID NO: 1767589 - protein, 5 aa, Staphylococcus epidermidis
EAGQN

SEQ ID NO: 1767590 - protein, 15 aa, Staphylococcus epidermidis
EAGTNGLPGGYTSTE

SEQ ID NO: 1767591 - protein, 4 aa, Staphylococcus epidermidis
EAGV

SEQ ID NO: 1767592 - protein, 7 aa, Staphylococcus epidermidis
EAHDTTI

SEQ ID NO: 1767593 - protein, 9 aa, Staphylococcus epidermidis
EAINTVPSH

SEQ ID NO: 1767594 - protein, 9 aa, Staphylococcus epidermidis
EAKDAQALQ

SEQ ID NO: 1767595 - protein, 10 aa, Staphylococcus epidermidis
EAKRLKNNPI

SEQ ID NO: 1767596 - protein, 11 aa, Staphylococcus epidermidis
EAQDGSEKKQV

SEQ ID NO: 1767597 - protein, 19 aa, Staphylococcus epidermidis
EAQETHDALSKQYQQYQNY

SEQ ID NO: 1767598 - protein, 23 aa, Staphylococcus epidermidis
EAQLAEKEKLQSKKQDKKTLNKL

SEQ ID NO: 1767599 - protein, 9 aa, Staphylococcus epidermidis
EASKKLKEF

SEQ ID NO: 1767600 - protein, 16 aa, Staphylococcus epidermidis
ECSTQEEVVDLVNQLA

SEQ ID NO: 1767601 - protein, 12 aa, Staphylococcus epidermidis
EDDYNYDEKTKA

SEQ ID NO: 1767602 - protein, 20 aa, Staphylococcus epidermidis
EDEKEKVSDDLKGADTTRDD

SEQ ID NO: 1767603 - protein, 4 aa, Staphylococcus epidermidis
EDEN

SEQ ID NO: 1767604 - protein, 6 aa, Staphylococcus epidermidis
EDQLNQ

SEQ ID NO: 1767605 - protein, 7 aa, Staphylococcus epidermidis
EDTGTLA

SEQ ID NO: 1767606 - protein, 16 aa, Staphylococcus epidermidis
EEAGEPLTPNRMNEEY

SEQ ID NO: 1767607 - protein, 4 aa, Staphylococcus epidermidis
EEDI

SEQ ID NO: 1767608 - protein, 6 aa, Staphylococcus epidermidis
EEEEPI

SEQ ID NO: 1767609 - protein, 6 aa, Staphylococcus epidermidis
EEEKEI

SEQ ID NO: 1767610 - protein, 10 aa, Staphylococcus epidermidis
EEGAQSDDED

SEQ ID NO: 1767611 - protein, 5 aa, Staphylococcus epidermidis
EEKNC

SEQ ID NO: 1767612 - protein, 4 aa, Staphylococcus epidermidis
EELS

SEQ ID NO: 1767613 - protein, 29 aa, Staphylococcus epidermidis
EEPGDNAQTSEGQEKQDTPEKVYSEEEFN

SEQ ID NO: 1767614 - protein, 4 aa, Staphylococcus epidermidis
EETG

SEQ ID NO: 1767615 - protein, 21 aa, Staphylococcus epidermidis
EETGATFEENARLKSEAAAHA

SEQ ID NO: 1767616 - protein, 5 aa, Staphylococcus epidermidis
EETGH

SEQ ID NO: 1767617 - protein, 29 aa, Staphylococcus epidermidis
EETNLTSTELAAETDEDKKDKTEEDNDTE

SEQ ID NO: 1767618 - protein, 8 aa, Staphylococcus epidermidis
EFQRQNSN

SEQ ID NO: 1767619 - protein, 8 aa, Staphylococcus epidermidis
EFSKGQKV

SEQ ID NO: 1767620 - protein, 11 aa, Staphylococcus epidermidis
EGEIKGVSQRE

SEQ ID NO: 1767621 - protein, 7 aa, Staphylococcus epidermidis
EGEVTYN

SEQ ID NO: 1767622 - protein, 6 aa, Staphylococcus epidermidis
EGKFRN

SEQ ID NO: 1767623 - protein, 10 aa, Staphylococcus epidermidis
EGKNKEEVCK

SEQ ID NO: 1767624 - protein, 9 aa, Staphylococcus epidermidis
EGNEIGNAV

SEQ ID NO: 1767625 - protein, 76 aa, Staphylococcus epidermidis
EGQVNTSNDSSNESSQKDEAKEKETPKQSNPNSSESENTQDNSQQRINATPSARRHARKNGVDLSEVSGKGNDVLR

SEQ ID NO: 1767626 - protein, 7 aa, Staphylococcus epidermidis
EGYKKGL

SEQ ID NO: 1767627 - protein, 4 aa, Staphylococcus epidermidis
EHAE

SEQ ID NO: 1767628 - protein, 4 aa, Staphylococcus epidermidis
EHLP

SEQ ID NO: 1767629 - protein, 6 aa, Staphylococcus epidermidis
EIDSKN

SEQ ID NO: 1767630 - protein, 5 aa, Staphylococcus epidermidis
EIEKI

SEQ ID NO: 1767631 - protein, 16 aa, Staphylococcus epidermidis
EITKDAYGKTIRAKTM

SEQ ID NO: 1767632 - protein, 8 aa, Staphylococcus epidermidis
EKDVPRQA

SEQ ID NO: 1767633 - protein, 12 aa, Staphylococcus epidermidis
EKEMKKAAKDLD

SEQ ID NO: 1767634 - protein, 15 aa, Staphylococcus epidermidis
EKGPTIELKESEEFK

SEQ ID NO: 1767635 - protein, 9 aa, Staphylococcus epidermidis
EKLQEKAKK

SEQ ID NO: 1767636 - protein, 14 aa, Staphylococcus epidermidis
EKLTNDVEAPASGT

SEQ ID NO: 1767637 - protein, 5 aa, Staphylococcus epidermidis
EKPWN

SEQ ID NO: 1767638 - protein, 6 aa, Staphylococcus epidermidis
EKQHKL

SEQ ID NO: 1767639 - protein, 10 aa, Staphylococcus epidermidis
EKRAVEKSGL

SEQ ID NO: 1767640 - protein, 21 aa, Staphylococcus epidermidis
EKSNYQTTKRKTPNYSKVDNT

SEQ ID NO: 1767641 - protein, 13 aa, Staphylococcus epidermidis
EKVVPGNTDIANY

SEQ ID NO: 1767642 - protein, 18 aa, Staphylococcus epidermidis
ELARRNSYQGKMNKQSIQ

SEQ ID NO: 1767643 - protein, 4 aa, Staphylococcus epidermidis
ELGD

SEQ ID NO: 1767644 - protein, 8 aa, Staphylococcus epidermidis
ELKNKGRM

SEQ ID NO: 1767645 - protein, 13 aa, Staphylococcus epidermidis
ELQKLRDADTVTV

SEQ ID NO: 1767646 - protein, 9 aa, Staphylococcus epidermidis
ELSQDTTFS

SEQ ID NO: 1767647 - protein, 12 aa, Staphylococcus epidermidis
EMQSTEGYSIDG

SEQ ID NO: 1767648 - protein, 6 aa, Staphylococcus epidermidis
ENEDVN

SEQ ID NO: 1767649 - protein, 4 aa, Staphylococcus epidermidis
ENEI

SEQ ID NO: 1767650 - protein, 5 aa, Staphylococcus epidermidis
ENGNE

SEQ ID NO: 1767651 - protein, 10 aa, Staphylococcus epidermidis
ENKDVDGHQH

SEQ ID NO: 1767652 - protein, 5 aa, Staphylococcus epidermidis
ENMGQ

SEQ ID NO: 1767653 - protein, 4 aa, Staphylococcus epidermidis
ENMT

SEQ ID NO: 1767654 - protein, 7 aa, Staphylococcus epidermidis
ENNPNGS

SEQ ID NO: 1767655 - protein, 8 aa, Staphylococcus epidermidis
ENQDGNFI

SEQ ID NO: 1767656 - protein, 4 aa, Staphylococcus epidermidis
ENQE

SEQ ID NO: 1767657 - protein, 7 aa, Staphylococcus epidermidis
EPDEGIG

SEQ ID NO: 1767658 - protein, 6 aa, Staphylococcus epidermidis
EPERIS

SEQ ID NO: 1767659 - protein, 12 aa, Staphylococcus epidermidis
EPEVPEELTKLY

SEQ ID NO: 1767660 - protein, 4 aa, Staphylococcus epidermidis
EPFN

SEQ ID NO: 1767661 - protein, 9 aa, Staphylococcus epidermidis
EPKINSTRA

SEQ ID NO: 1767662 - protein, 5 aa, Staphylococcus epidermidis
EPLES

SEQ ID NO: 1767663 - protein, 15 aa, Staphylococcus epidermidis
EPLGGAQKDEEAQAL

SEQ ID NO: 1767664 - protein, 13 aa, Staphylococcus epidermidis
EPNVNSQSNTETF

SEQ ID NO: 1767665 - protein, 5 aa, Staphylococcus epidermidis
EPTKK

SEQ ID NO: 1767666 - protein, 10 aa, Staphylococcus epidermidis
EPTNDLDTET

SEQ ID NO: 1767667 - protein, 12 aa, Staphylococcus epidermidis
EQALRDSDEYKA

SEQ ID NO: 1767668 - protein, 13 aa, Staphylococcus epidermidis
EQGKTLTQAYGEI

SEQ ID NO: 1767669 - protein, 4 aa, Staphylococcus epidermidis
EQGY

SEQ ID NO: 1767670 - protein, 7 aa, Staphylococcus epidermidis
EQIETQD

SEQ ID NO: 1767671 - protein, 14 aa, Staphylococcus epidermidis
EQIQQQENVRQNLN

SEQ ID NO: 1767672 - protein, 6 aa, Staphylococcus epidermidis
EQMSEK

SEQ ID NO: 1767673 - protein, 12 aa, Staphylococcus epidermidis
EQPREELSAYAP

SEQ ID NO: 1767674 - protein, 5 aa, Staphylococcus epidermidis
EQQER

SEQ ID NO: 1767675 - protein, 6 aa, Staphylococcus epidermidis
EQREKI

SEQ ID NO: 1767676 - protein, 11 aa, Staphylococcus epidermidis
EQSAKSLRGAK

SEQ ID NO: 1767677 - protein, 6 aa, Staphylococcus epidermidis
EQSATH

SEQ ID NO: 1767678 - protein, 8 aa, Staphylococcus epidermidis
EQSGITNT

SEQ ID NO: 1767679 - protein, 11 aa, Staphylococcus epidermidis
EQTDVPESSDW

SEQ ID NO: 1767680 - protein, 5 aa, Staphylococcus epidermidis
EQTQY

SEQ ID NO: 1767681 - protein, 13 aa, Staphylococcus epidermidis
ERAGQKADVDKIR

SEQ ID NO: 1767682 - protein, 5 aa, Staphylococcus epidermidis
EREAE

SEQ ID NO: 1767683 - protein, 4 aa, Staphylococcus epidermidis
ERGP

SEQ ID NO: 1767684 - protein, 5 aa, Staphylococcus epidermidis
ERLGI

SEQ ID NO: 1767685 - protein, 9 aa, Staphylococcus epidermidis
ERMGDNAAS

SEQ ID NO: 1767686 - protein, 8 aa, Staphylococcus epidermidis
ERMKDAKK

SEQ ID NO: 1767687 - protein, 4 aa, Staphylococcus epidermidis
ERRG

SEQ ID NO: 1767688 - protein, 9 aa, Staphylococcus epidermidis
ERSEQGPYY

SEQ ID NO: 1767689 - protein, 10 aa, Staphylococcus epidermidis
ERTTNMSGEI

SEQ ID NO: 1767690 - protein, 7 aa, Staphylococcus epidermidis
ESAGEAF

SEQ ID NO: 1767691 - protein, 7 aa, Staphylococcus epidermidis
ESDEYKN

SEQ ID NO: 1767692 - protein, 6 aa, Staphylococcus epidermidis
ESDLKE

SEQ ID NO: 1767693 - protein, 5 aa, Staphylococcus epidermidis
ESERY

SEQ ID NO: 1767694 - protein, 5 aa, Staphylococcus epidermidis
ESETA

SEQ ID NO: 1767695 - protein, 9 aa, Staphylococcus epidermidis
ESGAGKSLT

SEQ ID NO: 1767696 - protein, 4 aa, Staphylococcus epidermidis
ESKE

SEQ ID NO: 1767697 - protein, 6 aa, Staphylococcus epidermidis
ESQYNL

SEQ ID NO: 1767698 - protein, 6 aa, Staphylococcus epidermidis
ESTIKA

SEQ ID NO: 1767699 - protein, 5 aa, Staphylococcus epidermidis
ESTKD

SEQ ID NO: 1767700 - protein, 9 aa, Staphylococcus epidermidis
ESTNFAKAV

SEQ ID NO: 1767701 - protein, 7 aa, Staphylococcus epidermidis
ESYPSVD

SEQ ID NO: 1767702 - protein, 8 aa, Staphylococcus epidermidis
ESYTNEDY

SEQ ID NO: 1767703 - protein, 10 aa, Staphylococcus epidermidis
ETATSTDLKL

SEQ ID NO: 1767704 - protein, 5 aa, Staphylococcus epidermidis
ETDAK

SEQ ID NO: 1767705 - protein, 13 aa, Staphylococcus epidermidis
ETDKDTETKSSGF

SEQ ID NO: 1767706 - protein, 9 aa, Staphylococcus epidermidis
ETDSSESFS

SEQ ID NO: 1767707 - protein, 4 aa, Staphylococcus epidermidis
ETEH

SEQ ID NO: 1767708 - protein, 4 aa, Staphylococcus epidermidis
ETIN

SEQ ID NO: 1767709 - protein, 17 aa, Staphylococcus epidermidis
ETIPDTEFDEFRHHRGL

SEQ ID NO: 1767710 - protein, 17 aa, Staphylococcus epidermidis
ETIPDTEFDEFRHYRCL

SEQ ID NO: 1767711 - protein, 6 aa, Staphylococcus epidermidis
ETLDEN

SEQ ID NO: 1767712 - protein, 4 aa, Staphylococcus epidermidis
ETNY

SEQ ID NO: 1767713 - protein, 5 aa, Staphylococcus epidermidis
ETPDH

SEQ ID NO: 1767714 - protein, 4 aa, Staphylococcus epidermidis
ETQR

SEQ ID NO: 1767715 - protein, 20 aa, Staphylococcus epidermidis
ETQSDGQTGVVDEIKAWISK

SEQ ID NO: 1767716 - protein, 5 aa, Staphylococcus epidermidis
ETSPI

SEQ ID NO: 1767717 - protein, 5 aa, Staphylococcus epidermidis
ETSPL

SEQ ID NO: 1767718 - protein, 7 aa, Staphylococcus epidermidis
EVERTTS

SEQ ID NO: 1767719 - protein, 6 aa, Staphylococcus epidermidis
EVGIGR

SEQ ID NO: 1767720 - protein, 9 aa, Staphylococcus epidermidis
EVKKPETIN

SEQ ID NO: 1767721 - protein, 7 aa, Staphylococcus epidermidis
EVNTSSG

SEQ ID NO: 1767722 - protein, 4 aa, Staphylococcus epidermidis
EVQA

SEQ ID NO: 1767723 - protein, 11 aa, Staphylococcus epidermidis
EYGEDDKPRRI

SEQ ID NO: 1767724 - protein, 4 aa, Staphylococcus epidermidis
EYHY

SEQ ID NO: 1767725 - protein, 7 aa, Staphylococcus epidermidis
EYLGKTD

SEQ ID NO: 1767726 - protein, 24 aa, Staphylococcus epidermidis
FAKGQKGSSAMPHKRNPIGSENIT

SEQ ID NO: 1767727 - protein, 5 aa, Staphylococcus epidermidis
FDGTP

SEQ ID NO: 1767728 - protein, 10 aa, Staphylococcus epidermidis
FEADQRQQPN

SEQ ID NO: 1767729 - protein, 9 aa, Staphylococcus epidermidis
FEDGPGDHD

SEQ ID NO: 1767730 - protein, 6 aa, Staphylococcus epidermidis
FEEKTK

SEQ ID NO: 1767731 - protein, 8 aa, Staphylococcus epidermidis
FEESIDKE

SEQ ID NO: 1767732 - protein, 12 aa, Staphylococcus epidermidis
FEKQEKKDISEL

SEQ ID NO: 1767733 - protein, 9 aa, Staphylococcus epidermidis
FGDQEKKEM

SEQ ID NO: 1767734 - protein, 4 aa, Staphylococcus epidermidis
FGRT

SEQ ID NO: 1767735 - protein, 27 aa, Staphylococcus epidermidis
FGTEIPDEEAEKINTVGDAVKYINSLE

SEQ ID NO: 1767736 - protein, 4 aa, Staphylococcus epidermidis
FHEP

SEQ ID NO: 1767737 - protein, 9 aa, Staphylococcus epidermidis
FHGGSATNI

SEQ ID NO: 1767738 - protein, 11 aa, Staphylococcus epidermidis
FHSDEASLDAT

SEQ ID NO: 1767739 - protein, 6 aa, Staphylococcus epidermidis
FNADKA

SEQ ID NO: 1767740 - protein, 5 aa, Staphylococcus epidermidis
FNDNM

SEQ ID NO: 1767741 - protein, 10 aa, Staphylococcus epidermidis
FNTKDNEKLE

SEQ ID NO: 1767742 - protein, 8 aa, Staphylococcus epidermidis
FPETSGIG

SEQ ID NO: 1767743 - protein, 5 aa, Staphylococcus epidermidis
FPPEN

SEQ ID NO: 1767744 - protein, 15 aa, Staphylococcus epidermidis
FRNKGSKVCSANSVR

SEQ ID NO: 1767745 - protein, 4 aa, Staphylococcus epidermidis
FSPV

SEQ ID NO: 1767746 - protein, 6 aa, Staphylococcus epidermidis
FSTNDT

SEQ ID NO: 1767747 - protein, 6 aa, Staphylococcus epidermidis
FTGTSG

SEQ ID NO: 1767748 - protein, 9 aa, Staphylococcus epidermidis
FTPKNAGKL

SEQ ID NO: 1767749 - protein, 8 aa, Staphylococcus epidermidis
GAADMKSG

SEQ ID NO: 1767750 - protein, 12 aa, Staphylococcus epidermidis
GAAHSTGDTVRP

SEQ ID NO: 1767751 - protein, 9 aa, Staphylococcus epidermidis
GAGKDTDGQ

SEQ ID NO: 1767752 - protein, 17 aa, Staphylococcus epidermidis
GAPPGYVGHDEGGQLTE

SEQ ID NO: 1767753 - protein, 6 aa, Staphylococcus epidermidis
GAQKVG

SEQ ID NO: 1767754 - protein, 4 aa, Staphylococcus epidermidis
GAQS

SEQ ID NO: 1767755 - protein, 10 aa, Staphylococcus epidermidis
GAREKAENGD

SEQ ID NO: 1767756 - protein, 7 aa, Staphylococcus epidermidis
GASAIEA

SEQ ID NO: 1767757 - protein, 4 aa, Staphylococcus epidermidis
GASE

SEQ ID NO: 1767758 - protein, 5 aa, Staphylococcus epidermidis
GASLP

SEQ ID NO: 1767759 - protein, 12 aa, Staphylococcus epidermidis
GDGDLKGSSIGY

SEQ ID NO: 1767760 - protein, 4 aa, Staphylococcus epidermidis
GDGP

SEQ ID NO: 1767761 - protein, 7 aa, Staphylococcus epidermidis
GDKTAQY

SEQ ID NO: 1767762 - protein, 14 aa, Staphylococcus epidermidis
GDPKYGPKKTLDID

SEQ ID NO: 1767763 - protein, 4 aa, Staphylococcus epidermidis
GDSE

SEQ ID NO: 1767764 - protein, 8 aa, Staphylococcus epidermidis
GDSGNDEA

SEQ ID NO: 1767765 - protein, 5 aa, Staphylococcus epidermidis
GDTHL

SEQ ID NO: 1767766 - protein, 7 aa, Staphylococcus epidermidis
GDYNPFG

SEQ ID NO: 1767767 - protein, 9 aa, Staphylococcus epidermidis
GEASYSTHK

SEQ ID NO: 1767768 - protein, 6 aa, Staphylococcus epidermidis
GEDGQL

SEQ ID NO: 1767769 - protein, 5 aa, Staphylococcus epidermidis
GELDI

SEQ ID NO: 1767770 - protein, 5 aa, Staphylococcus epidermidis
GENLA

SEQ ID NO: 1767771 - protein, 11 aa, Staphylococcus epidermidis
GERQQSVDYEL

SEQ ID NO: 1767772 - protein, 13 aa, Staphylococcus epidermidis
GGKIENGETEKDA

SEQ ID NO: 1767773 - protein, 7 aa, Staphylococcus epidermidis
GGMTQAS

SEQ ID NO: 1767774 - protein, 9 aa, Staphylococcus epidermidis
GGNGTGKTT

SEQ ID NO: 1767775 - protein, 19 aa, Staphylococcus epidermidis
GGNTIRTGGQVNAAEPKWQ

SEQ ID NO: 1767776 - protein, 4 aa, Staphylococcus epidermidis
GGRE

SEQ ID NO: 1767777 - protein, 6 aa, Staphylococcus epidermidis
GGSERI

SEQ ID NO: 1767778 - protein, 9 aa, Staphylococcus epidermidis
GGTTTGRIP

SEQ ID NO: 1767779 - protein, 9 aa, Staphylococcus epidermidis
GHANSNEVY

SEQ ID NO: 1767780 - protein, 20 aa, Staphylococcus epidermidis
GHETFDTDASIDTAKNGDIV

SEQ ID NO: 1767781 - protein, 5 aa, Staphylococcus epidermidis
GHFTT

SEQ ID NO: 1767782 - protein, 6 aa, Staphylococcus epidermidis
GHTGGT

SEQ ID NO: 1767783 - protein, 7 aa, Staphylococcus epidermidis
GIARPAA

SEQ ID NO: 1767784 - protein, 7 aa, Staphylococcus epidermidis
GIEPNKA

SEQ ID NO: 1767785 - protein, 5 aa, Staphylococcus epidermidis
GIGGY

SEQ ID NO: 1767786 - protein, 7 aa, Staphylococcus epidermidis
GIKTKDT

SEQ ID NO: 1767787 - protein, 9 aa, Staphylococcus epidermidis
GIKVREDNG

SEQ ID NO: 1767788 - protein, 9 aa, Staphylococcus epidermidis
GIPDETKLG

SEQ ID NO: 1767789 - protein, 5 aa, Staphylococcus epidermidis
GIPLT

SEQ ID NO: 1767790 - protein, 8 aa, Staphylococcus epidermidis
GITGPNGL

SEQ ID NO: 1767791 - protein, 12 aa, Staphylococcus epidermidis
GKEIPGTARETI

SEQ ID NO: 1767792 - protein, 8 aa, Staphylococcus epidermidis
GKGKSKIP

SEQ ID NO: 1767793 - protein, 19 aa, Staphylococcus epidermidis
GKKEGKLETGGGTDDSTGY

SEQ ID NO: 1767794 - protein, 10 aa, Staphylococcus epidermidis
GKLSDEKKNA

SEQ ID NO: 1767795 - protein, 4 aa, Staphylococcus epidermidis
GKPG

SEQ ID NO: 1767796 - protein, 8 aa, Staphylococcus epidermidis
GKRKDHDA

SEQ ID NO: 1767797 - protein, 11 aa, Staphylococcus epidermidis
GKSKYKDTRAI

SEQ ID NO: 1767798 - protein, 20 aa, Staphylococcus epidermidis
GKTRAAQDNTHQVGAPSTDF

SEQ ID NO: 1767799 - protein, 9 aa, Staphylococcus epidermidis
GKVEYRAEK

SEQ ID NO: 1767800 - protein, 7 aa, Staphylococcus epidermidis
GKYGEEV

SEQ ID NO: 1767801 - protein, 6 aa, Staphylococcus epidermidis
GLAAGK

SEQ ID NO: 1767802 - protein, 5 aa, Staphylococcus epidermidis
GLDED

SEQ ID NO: 1767803 - protein, 11 aa, Staphylococcus epidermidis
GLNERGISTDN

SEQ ID NO: 1767804 - protein, 6 aa, Staphylococcus epidermidis
GLPENS

SEQ ID NO: 1767805 - protein, 6 aa, Staphylococcus epidermidis
GLTPKE

SEQ ID NO: 1767806 - protein, 15 aa, Staphylococcus epidermidis
GMIKKSSASQFKTTR

SEQ ID NO: 1767807 - protein, 7 aa, Staphylococcus epidermidis
GNCEGQA

SEQ ID NO: 1767808 - protein, 8 aa, Staphylococcus epidermidis
GNGSLDKK

SEQ ID NO: 1767809 - protein, 6 aa, Staphylococcus epidermidis
GNKPFD

SEQ ID NO: 1767810 - protein, 8 aa, Staphylococcus epidermidis
GNPKIQTG

SEQ ID NO: 1767811 - protein, 6 aa, Staphylococcus epidermidis
GNPYVS

SEQ ID NO: 1767812 - protein, 9 aa, Staphylococcus epidermidis
GNQRKEVTQ

SEQ ID NO: 1767813 - protein, 9 aa, Staphylococcus epidermidis
GNVLGTGEK

SEQ ID NO: 1767814 - protein, 19 aa, Staphylococcus epidermidis
GPATTKSATYKGPKGPTGY

SEQ ID NO: 1767815 - protein, 12 aa, Staphylococcus epidermidis
GPHNDEKDQKTY

SEQ ID NO: 1767816 - protein, 11 aa, Staphylococcus epidermidis
GPSGVGKGTVR

SEQ ID NO: 1767817 - protein, 5 aa, Staphylococcus epidermidis
GQAIS

SEQ ID NO: 1767818 - protein, 6 aa, Staphylococcus epidermidis
GQDDVS

SEQ ID NO: 1767819 - protein, 4 aa, Staphylococcus epidermidis
GQGC

SEQ ID NO: 1767820 - protein, 9 aa, Staphylococcus epidermidis
GQSNQEGAW

SEQ ID NO: 1767821 - protein, 10 aa, Staphylococcus epidermidis
GQSQTGTGKS

SEQ ID NO: 1767822 - protein, 8 aa, Staphylococcus epidermidis
GRDDGKML

SEQ ID NO: 1767823 - protein, 6 aa, Staphylococcus epidermidis
GRDKEI

SEQ ID NO: 1767824 - protein, 10 aa, Staphylococcus epidermidis
GRDPAPEEIG

SEQ ID NO: 1767825 - protein, 10 aa, Staphylococcus epidermidis
GRKGGNQGLD

SEQ ID NO: 1767826 - protein, 6 aa, Staphylococcus epidermidis
GRLPGG

SEQ ID NO: 1767827 - protein, 18 aa, Staphylococcus epidermidis
GRLSAKDVVGNKKALASF

SEQ ID NO: 1767828 - protein, 10 aa, Staphylococcus epidermidis
GRPETQRKTV

SEQ ID NO: 1767829 - protein, 5 aa, Staphylococcus epidermidis
GRPLS

SEQ ID NO: 1767830 - protein, 10 aa, Staphylococcus epidermidis
GRTGRGNYKG

SEQ ID NO: 1767831 - protein, 4 aa, Staphylococcus epidermidis
GRTT

SEQ ID NO: 1767832 - protein, 5 aa, Staphylococcus epidermidis
GRVNP

SEQ ID NO: 1767833 - protein, 11 aa, Staphylococcus epidermidis
GSDTSAGAGMQ

SEQ ID NO: 1767834 - protein, 16 aa, Staphylococcus epidermidis
GSEVSVDNPAQMPERD

SEQ ID NO: 1767835 - protein, 10 aa, Staphylococcus epidermidis
GSLKDTLTEM

SEQ ID NO: 1767836 - protein, 7 aa, Staphylococcus epidermidis
GSSSVKT

SEQ ID NO: 1767837 - protein, 9 aa, Staphylococcus epidermidis
GTAVGTGIN

SEQ ID NO: 1767838 - protein, 13 aa, Staphylococcus epidermidis
GTEAAKGNSLTKK

SEQ ID NO: 1767839 - protein, 4 aa, Staphylococcus epidermidis
GTQM

SEQ ID NO: 1767840 - protein, 9 aa, Staphylococcus epidermidis
GTSTANKIV

SEQ ID NO: 1767841 - protein, 17 aa, Staphylococcus epidermidis
GTTAESPTLSDEEKEKV

SEQ ID NO: 1767842 - protein, 16 aa, Staphylococcus epidermidis
GTTEPKKAIQLMHQLF

SEQ ID NO: 1767843 - protein, 5 aa, Staphylococcus epidermidis
GTVAE

SEQ ID NO: 1767844 - protein, 14 aa, Staphylococcus epidermidis
GTVTVGNSCKKNDG

SEQ ID NO: 1767845 - protein, 12 aa, Staphylococcus epidermidis
GVDDSKKLNDTK

SEQ ID NO: 1767846 - protein, 10 aa, Staphylococcus epidermidis
GVESTSRAPW

SEQ ID NO: 1767847 - protein, 6 aa, Staphylococcus epidermidis
GVKPTR

SEQ ID NO: 1767848 - protein, 9 aa, Staphylococcus epidermidis
GVNPTSDGE

SEQ ID NO: 1767849 - protein, 8 aa, Staphylococcus epidermidis
GVPTPGFS

SEQ ID NO: 1767850 - protein, 15 aa, Staphylococcus epidermidis
GVPTVSYDTKYGPSE

SEQ ID NO: 1767851 - protein, 18 aa, Staphylococcus epidermidis
GVTGKETSDWTKDTSQEL

SEQ ID NO: 1767852 - protein, 7 aa, Staphylococcus epidermidis
GVTSSSV

SEQ ID NO: 1767853 - protein, 10 aa, Staphylococcus epidermidis
GWTGGKYGIG

SEQ ID NO: 1767854 - protein, 4 aa, Staphylococcus epidermidis
GYDE

SEQ ID NO: 1767855 - protein, 6 aa, Staphylococcus epidermidis
GYPPDL

SEQ ID NO: 1767856 - protein, 4 aa, Staphylococcus epidermidis
GYQS

SEQ ID NO: 1767857 - protein, 19 aa, Staphylococcus epidermidis
GYVYSDGTTILGADDKAGL

SEQ ID NO: 1767858 - protein, 8 aa, Staphylococcus epidermidis
HAASHGQK

SEQ ID NO: 1767859 - protein, 4 aa, Staphylococcus epidermidis
HAKP

SEQ ID NO: 1767860 - protein, 8 aa, Staphylococcus epidermidis
HDPLTSKI

SEQ ID NO: 1767861 - protein, 4 aa, Staphylococcus epidermidis
HDSF

SEQ ID NO: 1767862 - protein, 8 aa, Staphylococcus epidermidis
HDSKGRQC

SEQ ID NO: 1767863 - protein, 8 aa, Staphylococcus epidermidis
HEGEYGKT

SEQ ID NO: 1767864 - protein, 13 aa, Staphylococcus epidermidis
HENISDNTKYDDE

SEQ ID NO: 1767865 - protein, 7 aa, Staphylococcus epidermidis
HESDRPR

SEQ ID NO: 1767866 - protein, 10 aa, Staphylococcus epidermidis
HGEVPDYQAS

SEQ ID NO: 1767867 - protein, 8 aa, Staphylococcus epidermidis
HGGGHKRQ

SEQ ID NO: 1767868 - protein, 4 aa, Staphylococcus epidermidis
HGTS

SEQ ID NO: 1767869 - protein, 20 aa, Staphylococcus epidermidis
HIGGGTGASEGAKATTVTPG

SEQ ID NO: 1767870 - protein, 10 aa, Staphylococcus epidermidis
HKGKRSEELG

SEQ ID NO: 1767871 - protein, 9 aa, Staphylococcus epidermidis
HKINNDSRG

SEQ ID NO: 1767872 - protein, 8 aa, Staphylococcus epidermidis
HKNNKKVY

SEQ ID NO: 1767873 - protein, 11 aa, Staphylococcus epidermidis
HLTSNHDNSIY

SEQ ID NO: 1767874 - protein, 14 aa, Staphylococcus epidermidis
HMKTGDIYNIYHNI

SEQ ID NO: 1767875 - protein, 4 aa, Staphylococcus epidermidis
HMNE

SEQ ID NO: 1767876 - protein, 4 aa, Staphylococcus epidermidis
HNEH

SEQ ID NO: 1767877 - protein, 5 aa, Staphylococcus epidermidis
HNNQA

SEQ ID NO: 1767878 - protein, 7 aa, Staphylococcus epidermidis
HNPVADN

SEQ ID NO: 1767879 - protein, 10 aa, Staphylococcus epidermidis
HNSKRVDQQR

SEQ ID NO: 1767880 - protein, 11 aa, Staphylococcus epidermidis
HPLAQKSSIKM

SEQ ID NO: 1767881 - protein, 15 aa, Staphylococcus epidermidis
HPQSPKQCCDQDSRL

SEQ ID NO: 1767882 - protein, 9 aa, Staphylococcus epidermidis
HPRVAETTT

SEQ ID NO: 1767883 - protein, 9 aa, Staphylococcus epidermidis
HPTLREKAK

SEQ ID NO: 1767884 - protein, 5 aa, Staphylococcus epidermidis
HRENE

SEQ ID NO: 1767885 - protein, 14 aa, Staphylococcus epidermidis
HRGERSGEEVAQRM

SEQ ID NO: 1767886 - protein, 10 aa, Staphylococcus epidermidis
HRTNEETGKV

SEQ ID NO: 1767887 - protein, 11 aa, Staphylococcus epidermidis
HSGGEPTQGAG

SEQ ID NO: 1767888 - protein, 7 aa, Staphylococcus epidermidis
HSHPTAD

SEQ ID NO: 1767889 - protein, 25 aa, Staphylococcus epidermidis
HSKPMNSNIKDDYEMKQQSSQKHHV

SEQ ID NO: 1767890 - protein, 18 aa, Staphylococcus epidermidis
HSNRRQDSWGGSREKRTR

SEQ ID NO: 1767891 - protein, 4 aa, Staphylococcus epidermidis
HTPS

SEQ ID NO: 1767892 - protein, 4 aa, Staphylococcus epidermidis
HTVT

SEQ ID NO: 1767893 - protein, 5 aa, Staphylococcus epidermidis
HVKTG

SEQ ID NO: 1767894 - protein, 6 aa, Staphylococcus epidermidis
HYDGGR

SEQ ID NO: 1767895 - protein, 5 aa, Staphylococcus epidermidis
IAAGA

SEQ ID NO: 1767896 - protein, 11 aa, Staphylococcus epidermidis
IADKKKNVSDR

SEQ ID NO: 1767897 - protein, 15 aa, Staphylococcus epidermidis
IAENKGTKVIEHRKD

SEQ ID NO: 1767898 - protein, 12 aa, Staphylococcus epidermidis
IAKRSSVPVLIV

SEQ ID NO: 1767899 - protein, 14 aa, Staphylococcus epidermidis
IAKTGAYITQEEAD

SEQ ID NO: 1767900 - protein, 15 aa, Staphylococcus epidermidis
IANETTYSNNEDGIG

SEQ ID NO: 1767901 - protein, 5 aa, Staphylococcus epidermidis
IANPY

SEQ ID NO: 1767902 - protein, 14 aa, Staphylococcus epidermidis
IANSCTGKQGEKDA

SEQ ID NO: 1767903 - protein, 11 aa, Staphylococcus epidermidis
IANSGYTSRRK

SEQ ID NO: 1767904 - protein, 12 aa, Staphylococcus epidermidis
IAQRNRSFESQI

SEQ ID NO: 1767905 - protein, 17 aa, Staphylococcus epidermidis
IDDETKQKIATQIQAQI

SEQ ID NO: 1767906 - protein, 5 aa, Staphylococcus epidermidis
IDEQK

SEQ ID NO: 1767907 - protein, 5 aa, Staphylococcus epidermidis
IDGMT

SEQ ID NO: 1767908 - protein, 10 aa, Staphylococcus epidermidis
IDPDTVDQGA

SEQ ID NO: 1767909 - protein, 18 aa, Staphylococcus epidermidis
IDREHEDERHNLTKGRLQ

SEQ ID NO: 1767910 - protein, 5 aa, Staphylococcus epidermidis
IDRPY

SEQ ID NO: 1767911 - protein, 34 aa, Staphylococcus epidermidis
IDSTPAGTESEQVVSESIKSAKEKKYSKSNPYDA

SEQ ID NO: 1767912 - protein, 9 aa, Staphylococcus epidermidis
IDTTAAGDT

SEQ ID NO: 1767913 - protein, 10 aa, Staphylococcus epidermidis
IEDGDFDQSK

SEQ ID NO: 1767914 - protein, 8 aa, Staphylococcus epidermidis
IEDNPDLT

SEQ ID NO: 1767915 - protein, 10 aa, Staphylococcus epidermidis
IEGDKKLANN

SEQ ID NO: 1767916 - protein, 6 aa, Staphylococcus epidermidis
IEGRQK

SEQ ID NO: 1767917 - protein, 14 aa, Staphylococcus epidermidis
IEGSSFKEAITRKK

SEQ ID NO: 1767918 - protein, 10 aa, Staphylococcus epidermidis
IENDGKVGLD

SEQ ID NO: 1767919 - protein, 10 aa, Staphylococcus epidermidis
IENYKENREY

SEQ ID NO: 1767920 - protein, 20 aa, Staphylococcus epidermidis
IEPAATMAEGAQKIVKLVKE

SEQ ID NO: 1767921 - protein, 7 aa, Staphylococcus epidermidis
IESETTF

SEQ ID NO: 1767922 - protein, 6 aa, Staphylococcus epidermidis
IETSDD

SEQ ID NO: 1767923 - protein, 4 aa, Staphylococcus epidermidis
IGFK

SEQ ID NO: 1767924 - protein, 10 aa, Staphylococcus epidermidis
IGGQVNDTAG

SEQ ID NO: 1767925 - protein, 4 aa, Staphylococcus epidermidis
IGPC

SEQ ID NO: 1767926 - protein, 8 aa, Staphylococcus epidermidis
IGPESKLH

SEQ ID NO: 1767927 - protein, 10 aa, Staphylococcus epidermidis
IGSNGSGKST

SEQ ID NO: 1767928 - protein, 7 aa, Staphylococcus epidermidis
IGYAPDN

SEQ ID NO: 1767929 - protein, 17 aa, Staphylococcus epidermidis
IHEEGSMRSNDNGDTMS

SEQ ID NO: 1767930 - protein, 14 aa, Staphylococcus epidermidis
IHQSAKSNQSNSYT

SEQ ID NO: 1767931 - protein, 12 aa, Staphylococcus epidermidis
IIQPGSKGTKVG

SEQ ID NO: 1767932 - protein, 9 aa, Staphylococcus epidermidis
IKAKKGRKI

SEQ ID NO: 1767933 - protein, 29 aa, Staphylococcus epidermidis
IKAQQAREAARKAREDARSGKKNKRKDTL

SEQ ID NO: 1767934 - protein, 9 aa, Staphylococcus epidermidis
IKDASAGSW

SEQ ID NO: 1767935 - protein, 6 aa, Staphylococcus epidermidis
IKDTIN

SEQ ID NO: 1767936 - protein, 6 aa, Staphylococcus epidermidis
IKEGNQ

SEQ ID NO: 1767937 - protein, 5 aa, Staphylococcus epidermidis
IKKAE

SEQ ID NO: 1767938 - protein, 9 aa, Staphylococcus epidermidis
IKQKQLRDN

SEQ ID NO: 1767939 - protein, 7 aa, Staphylococcus epidermidis
IKRQRNI

SEQ ID NO: 1767940 - protein, 5 aa, Staphylococcus epidermidis
ILNDQ

SEQ ID NO: 1767941 - protein, 6 aa, Staphylococcus epidermidis
INEEIE

SEQ ID NO: 1767942 - protein, 5 aa, Staphylococcus epidermidis
INERE

SEQ ID NO: 1767943 - protein, 5 aa, Staphylococcus epidermidis
INESQ

SEQ ID NO: 1767944 - protein, 9 aa, Staphylococcus epidermidis
INKDKGEVK

SEQ ID NO: 1767945 - protein, 5 aa, Staphylococcus epidermidis
INKNT

SEQ ID NO: 1767946 - protein, 4 aa, Staphylococcus epidermidis
INSV

SEQ ID NO: 1767947 - protein, 7 aa, Staphylococcus epidermidis
INTKEDF

SEQ ID NO: 1767948 - protein, 15 aa, Staphylococcus epidermidis
IPDTEFDEFSHHRGL

SEQ ID NO: 1767949 - protein, 5 aa, Staphylococcus epidermidis
IPETE

SEQ ID NO: 1767950 - protein, 15 aa, Staphylococcus epidermidis
IPETEFDKFRHYRCL

SEQ ID NO: 1767951 - protein, 21 aa, Staphylococcus epidermidis
IPGDSDSNRTVKREMGQQAGQ

SEQ ID NO: 1767952 - protein, 6 aa, Staphylococcus epidermidis
IQKQQS

SEQ ID NO: 1767953 - protein, 15 aa, Staphylococcus epidermidis
IQLDDSPENIKRNQS

SEQ ID NO: 1767954 - protein, 6 aa, Staphylococcus epidermidis
IQPYSE

SEQ ID NO: 1767955 - protein, 10 aa, Staphylococcus epidermidis
IQSQRIKKKG

SEQ ID NO: 1767956 - protein, 41 aa, Staphylococcus epidermidis
IQTQEQAIDESNNSKDTQYNQNSNTTSTIRNNNLTTIQITN

SEQ ID NO: 1767957 - protein, 8 aa, Staphylococcus epidermidis
IQTRTKHK

SEQ ID NO: 1767958 - protein, 10 aa, Staphylococcus epidermidis
IREYESQKQN

SEQ ID NO: 1767959 - protein, 8 aa, Staphylococcus epidermidis
ISDDKEDL

SEQ ID NO: 1767960 - protein, 14 aa, Staphylococcus epidermidis
ISGKLKNTKYIKDD

SEQ ID NO: 1767961 - protein, 30 aa, Staphylococcus epidermidis
ISPLQKAEDAITLDTTGKSIEEVTNEILSL

SEQ ID NO: 1767962 - protein, 6 aa, Staphylococcus epidermidis
ISRDSI

SEQ ID NO: 1767963 - protein, 7 aa, Staphylococcus epidermidis
ISRETTS

SEQ ID NO: 1767964 - protein, 9 aa, Staphylococcus epidermidis
ISRKEQDQF

SEQ ID NO: 1767965 - protein, 18 aa, Staphylococcus epidermidis
ITIESKGEAPTLIHKIIT

SEQ ID NO: 1767966 - protein, 4 aa, Staphylococcus epidermidis
ITKD

SEQ ID NO: 1767967 - protein, 7 aa, Staphylococcus epidermidis
ITNDRET

SEQ ID NO: 1767968 - protein, 6 aa, Staphylococcus epidermidis
ITNVES

SEQ ID NO: 1767969 - protein, 13 aa, Staphylococcus epidermidis
ITPKPQPGNPKPR

SEQ ID NO: 1767970 - protein, 10 aa, Staphylococcus epidermidis
ITTDAPLKET

SEQ ID NO: 1767971 - protein, 19 aa, Staphylococcus epidermidis
ITTEDKKGRVHNKEKNTLF

SEQ ID NO: 1767972 - protein, 7 aa, Staphylococcus epidermidis
IVKENPD

SEQ ID NO: 1767973 - protein, 4 aa, Staphylococcus epidermidis
IVTS

SEQ ID NO: 1767974 - protein, 5 aa, Staphylococcus epidermidis
IYEKR

SEQ ID NO: 1767975 - protein, 6 aa, Staphylococcus epidermidis
IYTEDE

SEQ ID NO: 1767976 - protein, 17 aa, Staphylococcus epidermidis
KADDEPHSLSGGQKQRV

SEQ ID NO: 1767977 - protein, 7 aa, Staphylococcus epidermidis
KADKTFN

SEQ ID NO: 1767978 - protein, 7 aa, Staphylococcus epidermidis
KADTWDR

SEQ ID NO: 1767979 - protein, 7 aa, Staphylococcus epidermidis
KAEGLVS

SEQ ID NO: 1767980 - protein, 9 aa, Staphylococcus epidermidis
KAGHTISEE

SEQ ID NO: 1767981 - protein, 8 aa, Staphylococcus epidermidis
KAGKTLAA

SEQ ID NO: 1767982 - protein, 7 aa, Staphylococcus epidermidis
KAIEGIP

SEQ ID NO: 1767983 - protein, 6 aa, Staphylococcus epidermidis
KALQNK

SEQ ID NO: 1767984 - protein, 5 aa, Staphylococcus epidermidis
KANPL

SEQ ID NO: 1767985 - protein, 12 aa, Staphylococcus epidermidis
KAQKENGSERRT

SEQ ID NO: 1767986 - protein, 4 aa, Staphylococcus epidermidis
KAQS

SEQ ID NO: 1767987 - protein, 9 aa, Staphylococcus epidermidis
KATEDINGE

SEQ ID NO: 1767988 - protein, 13 aa, Staphylococcus epidermidis
KATIERSDSCAVP

SEQ ID NO: 1767989 - protein, 26 aa, Staphylococcus epidermidis
KCEGSGQEFEEPCPTCKGKGTENKTV

SEQ ID NO: 1767990 - protein, 5 aa, Staphylococcus epidermidis
KCSAC

SEQ ID NO: 1767991 - protein, 10 aa, Staphylococcus epidermidis
KDDPFGEYGK

SEQ ID NO: 1767992 - protein, 13 aa, Staphylococcus epidermidis
KDEQAVQAHNQSD

SEQ ID NO: 1767993 - protein, 9 aa, Staphylococcus epidermidis
KDESGTING

SEQ ID NO: 1767994 - protein, 5 aa, Staphylococcus epidermidis
KDIEK

SEQ ID NO: 1767995 - protein, 7 aa, Staphylococcus epidermidis
KDIEQSK

SEQ ID NO: 1767996 - protein, 5 aa, Staphylococcus epidermidis
KDINE

SEQ ID NO: 1767997 - protein, 8 aa, Staphylococcus epidermidis
KDMTDQEW

SEQ ID NO: 1767998 - protein, 4 aa, Staphylococcus epidermidis
KDTN

SEQ ID NO: 1767999 - protein, 7 aa, Staphylococcus epidermidis
KDTYNED

SEQ ID NO: 1768000 - protein, 17 aa, Staphylococcus epidermidis
KDVETKNPEGHDILIWN

SEQ ID NO: 1768001 - protein, 6 aa, Staphylococcus epidermidis
KDVGQI

SEQ ID NO: 1768002 - protein, 8 aa, Staphylococcus epidermidis
KEAAQNSD

SEQ ID NO: 1768003 - protein, 8 aa, Staphylococcus epidermidis
KEATGGLD

SEQ ID NO: 1768004 - protein, 6 aa, Staphylococcus epidermidis
KEETHY

SEQ ID NO: 1768005 - protein, 26 aa, Staphylococcus epidermidis
KEFEKSVTAPAGNQGHGLDQSEFDKK

SEQ ID NO: 1768006 - protein, 6 aa, Staphylococcus epidermidis
KEFPNI

SEQ ID NO: 1768007 - protein, 6 aa, Staphylococcus epidermidis
KEHEEL

SEQ ID NO: 1768008 - protein, 16 aa, Staphylococcus epidermidis
KEIDASIKKSAHSAQP

SEQ ID NO: 1768009 - protein, 9 aa, Staphylococcus epidermidis
KEKAEQSRF

SEQ ID NO: 1768010 - protein, 9 aa, Staphylococcus epidermidis
KEKPENTNI

SEQ ID NO: 1768011 - protein, 20 aa, Staphylococcus epidermidis
KEKSYANKWQKQSQVKERIA

SEQ ID NO: 1768012 - protein, 6 aa, Staphylococcus epidermidis
KELREK

SEQ ID NO: 1768013 - protein, 6 aa, Staphylococcus epidermidis
KELTEY

SEQ ID NO: 1768014 - protein, 5 aa, Staphylococcus epidermidis
KENKK

SEQ ID NO: 1768015 - protein, 16 aa, Staphylococcus epidermidis
KENKKPIKAIARNNSK

SEQ ID NO: 1768016 - protein, 6 aa, Staphylococcus epidermidis
KEQGYR

SEQ ID NO: 1768017 - protein, 7 aa, Staphylococcus epidermidis
KEQPDAL

SEQ ID NO: 1768018 - protein, 5 aa, Staphylococcus epidermidis
KESNL

SEQ ID NO: 1768019 - protein, 7 aa, Staphylococcus epidermidis
KESSEVS

SEQ ID NO: 1768020 - protein, 13 aa, Staphylococcus epidermidis
KEYKQLSKEMEQS

SEQ ID NO: 1768021 - protein, 93 aa, Staphylococcus epidermidis
KFKASQAKDTNKQNTQNNHQKSNNKQNSNDKEKQQSKNNSKPTKKKEQNNKGKQQNKNNKTNKNQKNNKNKKNNKNNKPQNEVEETKEMPSKI

SEQ ID NO: 1768022 - protein, 11 aa, Staphylococcus epidermidis
KGAAASNHFEG

SEQ ID NO: 1768023 - protein, 17 aa, Staphylococcus epidermidis
KGEKIEAQAPKLDTESF

SEQ ID NO: 1768024 - protein, 5 aa, Staphylococcus epidermidis
KGIKG

SEQ ID NO: 1768025 - protein, 5 aa, Staphylococcus epidermidis
KGLND

SEQ ID NO: 1768026 - protein, 7 aa, Staphylococcus epidermidis
KGNPISL

SEQ ID NO: 1768027 - protein, 16 aa, Staphylococcus epidermidis
KGPIGKGSAKATVDGQ

SEQ ID NO: 1768028 - protein, 7 aa, Staphylococcus epidermidis
KGQRLNS

SEQ ID NO: 1768029 - protein, 20 aa, Staphylococcus epidermidis
KGRESAYPSELSGGQKQRVG

SEQ ID NO: 1768030 - protein, 7 aa, Staphylococcus epidermidis
KGSGTRF

SEQ ID NO: 1768031 - protein, 13 aa, Staphylococcus epidermidis
KGTFVKEQDNSIL

SEQ ID NO: 1768032 - protein, 5 aa, Staphylococcus epidermidis
KGTQT

SEQ ID NO: 1768033 - protein, 20 aa, Staphylococcus epidermidis
KGYTSYAPQYEGHAAPPEEI

SEQ ID NO: 1768034 - protein, 14 aa, Staphylococcus epidermidis
KHNEVEKEARDKAA

SEQ ID NO: 1768035 - protein, 17 aa, Staphylococcus epidermidis
KHPDFKEKLKQGKSYPR

SEQ ID NO: 1768036 - protein, 5 aa, Staphylococcus epidermidis
KHPSS

SEQ ID NO: 1768037 - protein, 11 aa, Staphylococcus epidermidis
KHRLYNETDKE

SEQ ID NO: 1768038 - protein, 9 aa, Staphylococcus epidermidis
KHRTNQADI

SEQ ID NO: 1768039 - protein, 8 aa, Staphylococcus epidermidis
KIDANQLN

SEQ ID NO: 1768040 - protein, 13 aa, Staphylococcus epidermidis
KIDEAKKDGDSIG

SEQ ID NO: 1768041 - protein, 6 aa, Staphylococcus epidermidis
KIDNGD

SEQ ID NO: 1768042 - protein, 6 aa, Staphylococcus epidermidis
KIDQVG

SEQ ID NO: 1768043 - protein, 8 aa, Staphylococcus epidermidis
KISESFPD

SEQ ID NO: 1768044 - protein, 5 aa, Staphylococcus epidermidis
KIYNS

SEQ ID NO: 1768045 - protein, 9 aa, Staphylococcus epidermidis
KKAQDAHDS

SEQ ID NO: 1768046 - protein, 6 aa, Staphylococcus epidermidis
KKEELE

SEQ ID NO: 1768047 - protein, 9 aa, Staphylococcus epidermidis
KKGDKHAEV

SEQ ID NO: 1768048 - protein, 18 aa, Staphylococcus epidermidis
KKGKGSENTLDHDEGGFI

SEQ ID NO: 1768049 - protein, 6 aa, Staphylococcus epidermidis
KKGKLT

SEQ ID NO: 1768050 - protein, 7 aa, Staphylococcus epidermidis
KKGVKGR

SEQ ID NO: 1768051 - protein, 8 aa, Staphylococcus epidermidis
KKIGEDAK

SEQ ID NO: 1768052 - protein, 22 aa, Staphylococcus epidermidis
KKKSKAEQKEFRNKLDESRFVV

SEQ ID NO: 1768053 - protein, 8 aa, Staphylococcus epidermidis
KKMSEDLT

SEQ ID NO: 1768054 - protein, 8 aa, Staphylococcus epidermidis
KKPAVNFD

SEQ ID NO: 1768055 - protein, 4 aa, Staphylococcus epidermidis
KKQF

SEQ ID NO: 1768056 - protein, 28 aa, Staphylococcus epidermidis
KKQLDDQYEAKSIKQHVQKKKYDTIHAG

SEQ ID NO: 1768057 - protein, 11 aa, Staphylococcus epidermidis
KKQTNTTTYNA

SEQ ID NO: 1768058 - protein, 16 aa, Staphylococcus epidermidis
KKQVSQKPQVHGKGTN

SEQ ID NO: 1768059 - protein, 17 aa, Staphylococcus epidermidis
KKSNGREDRKFILDIFF

SEQ ID NO: 1768060 - protein, 32 aa, Staphylococcus epidermidis
KKVSVPELKPEKQANANHRKDSESNKSEEFKQ

SEQ ID NO: 1768061 - protein, 4 aa, Staphylococcus epidermidis
KLGA

SEQ ID NO: 1768062 - protein, 8 aa, Staphylococcus epidermidis
KLRGERSE

SEQ ID NO: 1768063 - protein, 6 aa, Staphylococcus epidermidis
KLSSEA

SEQ ID NO: 1768064 - protein, 8 aa, Staphylococcus epidermidis
KMNKAAQE

SEQ ID NO: 1768065 - protein, 4 aa, Staphylococcus epidermidis
KMSN

SEQ ID NO: 1768066 - protein, 7 aa, Staphylococcus epidermidis
KNADQLA

SEQ ID NO: 1768067 - protein, 12 aa, Staphylococcus epidermidis
KNANYAKNKFEE

SEQ ID NO: 1768068 - protein, 18 aa, Staphylococcus epidermidis
KNDGYQSDKSKETLKEKQ

SEQ ID NO: 1768069 - protein, 4 aa, Staphylococcus epidermidis
KNDQ

SEQ ID NO: 1768070 - protein, 6 aa, Staphylococcus epidermidis
KNEIVQ

SEQ ID NO: 1768071 - protein, 9 aa, Staphylococcus epidermidis
KNGKKRVSH

SEQ ID NO: 1768072 - protein, 5 aa, Staphylococcus epidermidis
KNIQN

SEQ ID NO: 1768073 - protein, 4 aa, Staphylococcus epidermidis
KNLK

SEQ ID NO: 1768074 - protein, 10 aa, Staphylococcus epidermidis
KNLSSKTKAL

SEQ ID NO: 1768075 - protein, 17 aa, Staphylococcus epidermidis
KNNKQNDYLTNKKARKN

SEQ ID NO: 1768076 - protein, 7 aa, Staphylococcus epidermidis
KNPYDEH

SEQ ID NO: 1768077 - protein, 6 aa, Staphylococcus epidermidis
KNVETF

SEQ ID NO: 1768078 - protein, 8 aa, Staphylococcus epidermidis
KPARANQL

SEQ ID NO: 1768079 - protein, 9 aa, Staphylococcus epidermidis
KPDEHQSNF

SEQ ID NO: 1768080 - protein, 15 aa, Staphylococcus epidermidis
KPEATIGSSTSGIMP

SEQ ID NO: 1768081 - protein, 7 aa, Staphylococcus epidermidis
KPPSVSE

SEQ ID NO: 1768082 - protein, 5 aa, Staphylococcus epidermidis
KQALK

SEQ ID NO: 1768083 - protein, 4 aa, Staphylococcus epidermidis
KQEG

SEQ ID NO: 1768084 - protein, 6 aa, Staphylococcus epidermidis
KQEKVQ

SEQ ID NO: 1768085 - protein, 9 aa, Staphylococcus epidermidis
KQIPDDNQK

SEQ ID NO: 1768086 - protein, 9 aa, Staphylococcus epidermidis
KQKKHSGFS

SEQ ID NO: 1768087 - protein, 10 aa, Staphylococcus epidermidis
KQNKDKAEKL

SEQ ID NO: 1768088 - protein, 4 aa, Staphylococcus epidermidis
KQQM

SEQ ID NO: 1768089 - protein, 55 aa, Staphylococcus epidermidis; identical to SEQ ID NO: 1629354

SEQ ID NO: 1768090 - protein, 6 aa, Staphylococcus epidermidis
KQSKPI

SEQ ID NO: 1768091 - protein, 4 aa, Staphylococcus epidermidis
KQTD

SEQ ID NO: 1768092 - protein, 9 aa, Staphylococcus epidermidis
KQTESNIDI

SEQ ID NO: 1768093 - protein, 8 aa, Staphylococcus epidermidis
KQTPAHHT

SEQ ID NO: 1768094 - protein, 4 aa, Staphylococcus epidermidis
KQYN

SEQ ID NO: 1768095 - protein, 10 aa, Staphylococcus epidermidis
KRDAKKENPI

SEQ ID NO: 1768096 - protein, 13 aa, Staphylococcus epidermidis
KRGGTKSIANQES

SEQ ID NO: 1768097 - protein, 11 aa, Staphylococcus epidermidis
KRGIGPSSVEK

SEQ ID NO: 1768098 - protein, 6 aa, Staphylococcus epidermidis
KRGKNA

SEQ ID NO: 1768099 - protein, 16 aa, Staphylococcus epidermidis
KRIKDKKERYETQAKR

SEQ ID NO: 1768100 - protein, 5 aa, Staphylococcus epidermidis
KRKEE

SEQ ID NO: 1768101 - protein, 6 aa, Staphylococcus epidermidis
KRLGPY

SEQ ID NO: 1768102 - protein, 7 aa, Staphylococcus epidermidis
KRREDAK

SEQ ID NO: 1768103 - protein, 7 aa, Staphylococcus epidermidis
KRRVDEL

SEQ ID NO: 1768104 - protein, 4 aa, Staphylococcus epidermidis
KRSV

SEQ ID NO: 1768105 - protein, 8 aa, Staphylococcus epidermidis
KSAEEHQN

SEQ ID NO: 1768106 - protein, 13 aa, Staphylococcus epidermidis
KSDTSADITTPES

SEQ ID NO: 1768107 - protein, 5 aa, Staphylococcus epidermidis
KSELP

SEQ ID NO: 1768108 - protein, 15 aa, Staphylococcus epidermidis
KSHTTPSNLKEIEQE

SEQ ID NO: 1768109 - protein, 10 aa, Staphylococcus epidermidis
KSLPNQSSQL

SEQ ID NO: 1768110 - protein, 9 aa, Staphylococcus epidermidis
KSNKENAPR

SEQ ID NO: 1768111 - protein, 8 aa, Staphylococcus epidermidis
KSNPKRIS

SEQ ID NO: 1768112 - protein, 6 aa, Staphylococcus epidermidis
KSRAKH

SEQ ID NO: 1768113 - protein, 11 aa, Staphylococcus epidermidis
KSSKGKEELQE

SEQ ID NO: 1768114 - protein, 7 aa, Staphylococcus epidermidis
KSSPDAI

SEQ ID NO: 1768115 - protein, 6 aa, Staphylococcus epidermidis
KSTYSK

SEQ ID NO: 1768116 - protein, 9 aa, Staphylococcus epidermidis
KTDSTKEQI

SEQ ID NO: 1768117 - protein, 7 aa, Staphylococcus epidermidis
KTEVESK

SEQ ID NO: 1768118 - protein, 7 aa, Staphylococcus epidermidis
KTKDTET

SEQ ID NO: 1768119 - protein, 8 aa, Staphylococcus epidermidis
KTKRYTQT

SEQ ID NO: 1768120 - protein, 5 aa, Staphylococcus epidermidis
KTNKS

SEQ ID NO: 1768121 - protein, 8 aa, Staphylococcus epidermidis
KTNTEQDV

SEQ ID NO: 1768122 - protein, 8 aa, Staphylococcus epidermidis
KTPNNGRE

SEQ ID NO: 1768123 - protein, 4 aa, Staphylococcus epidermidis
KTRF

SEQ ID NO: 1768124 - protein, 5 aa, Staphylococcus epidermidis
KTTSI

SEQ ID NO: 1768125 - protein, 4 aa, Staphylococcus epidermidis
KTYE

SEQ ID NO: 1768126 - protein, 7 aa, Staphylococcus epidermidis
KVATRRA

SEQ ID NO: 1768127 - protein, 10 aa, Staphylococcus epidermidis
KVEGSSEIGA

SEQ ID NO: 1768128 - protein, 7 aa, Staphylococcus epidermidis
KVETEEQ

SEQ ID NO: 1768129 - protein, 4 aa, Staphylococcus epidermidis
KVSD

SEQ ID NO: 1768130 - protein, 7 aa, Staphylococcus epidermidis
KVTPGGF

SEQ ID NO: 1768131 - protein, 12 aa, Staphylococcus epidermidis
KWELTGQSIHDI

SEQ ID NO: 1768132 - protein, 7 aa, Staphylococcus epidermidis
KWGTPRD

SEQ ID NO: 1768133 - protein, 8 aa, Staphylococcus epidermidis
KYETSISK

SEQ ID NO: 1768134 - protein, 10 aa, Staphylococcus epidermidis
KYIGTEKPML

SEQ ID NO: 1768135 - protein, 8 aa, Staphylococcus epidermidis
KYNERQSI

SEQ ID NO: 1768136 - protein, 8 aa, Staphylococcus epidermidis
KYNITDKS

SEQ ID NO: 1768137 - protein, 9 aa, Staphylococcus epidermidis
LAGDPENAY

SEQ ID NO: 1768138 - protein, 4 aa, Staphylococcus epidermidis
LAGQ

SEQ ID NO: 1768139 - protein, 6 aa, Staphylococcus epidermidis
LARPAA

SEQ ID NO: 1768140 - protein, 30 aa, Staphylococcus epidermidis
LASYNNVNTQEVQEPQVQHSSIDDKTWGKE

SEQ ID NO: 1768141 - protein, 7 aa, Staphylococcus epidermidis
LATGGTM

SEQ ID NO: 1768142 - protein, 5 aa, Staphylococcus epidermidis
LDAKE

SEQ ID NO: 1768143 - protein, 6 aa, Staphylococcus epidermidis
LDLSSE

SEQ ID NO: 1768144 - protein, 7 aa, Staphylococcus epidermidis
LDPSETR

SEQ ID NO: 1768145 - protein, 8 aa, Staphylococcus epidermidis
LEGCPTDS

SEQ ID NO: 1768146 - protein, 4 aa, Staphylococcus epidermidis
LELT

SEQ ID NO: 1768147 - protein, 6 aa, Staphylococcus epidermidis
LENNGD

SEQ ID NO: 1768148 - protein, 5 aa, Staphylococcus epidermidis
LENPE

SEQ ID NO: 1768149 - protein, 6 aa, Staphylococcus epidermidis
LEPYGH

SEQ ID NO: 1768150 - protein, 4 aa, Staphylococcus epidermidis
LEQQ

SEQ ID NO: 1768151 - protein, 5 aa, Staphylococcus epidermidis
LESDI

SEQ ID NO: 1768152 - protein, 5 aa, Staphylococcus epidermidis
LETLE

SEQ ID NO: 1768153 - protein, 14 aa, Staphylococcus epidermidis
LGAIPTSTLGYEKQ

SEQ ID NO: 1768154 - protein, 4 aa, Staphylococcus epidermidis
LGEG

SEQ ID NO: 1768155 - protein, 12 aa, Staphylococcus epidermidis
LGESGAGKSTIG

SEQ ID NO: 1768156 - protein, 6 aa, Staphylococcus epidermidis
LGGYEY

SEQ ID NO: 1768157 - protein, 18 aa, Staphylococcus epidermidis
LGHKSEAITSDVYSHVTK

SEQ ID NO: 1768158 - protein, 13 aa, Staphylococcus epidermidis
LGLPDSPGVPEGI

SEQ ID NO: 1768159 - protein, 5 aa, Staphylococcus epidermidis
LGPEV

SEQ ID NO: 1768160 - protein, 4 aa, Staphylococcus epidermidis
LKDE

SEQ ID NO: 1768161 - protein, 7 aa, Staphylococcus epidermidis
LKEKGNT

SEQ ID NO: 1768162 - protein, 6 aa, Staphylococcus epidermidis
LKESQK

SEQ ID NO: 1768163 - protein, 5 aa, Staphylococcus epidermidis
LKNSV

SEQ ID NO: 1768164 - protein, 6 aa, Staphylococcus epidermidis
LKNTDL

SEQ ID NO: 1768165 - protein, 12 aa, Staphylococcus epidermidis
LKPTKGKISIDS

SEQ ID NO: 1768166 - protein, 38 aa, Staphylococcus epidermidis
LKQKEDEKAEAVKEAQKLAKMNKDQQLQYENEKLTKQL

SEQ ID NO: 1768167 - protein, 40 aa, Staphylococcus epidermidis
LKRTDASNTDGKDNQQTDEDVETAEAETKAADSESKGGAY

SEQ ID NO: 1768168 - protein, 9 aa, Staphylococcus epidermidis
LKSELKRDE

SEQ ID NO: 1768169 - protein, 9 aa, Staphylococcus epidermidis
LKSKETEEL

SEQ ID NO: 1768170 - protein, 6 aa, Staphylococcus epidermidis
LKSKKG

SEQ ID NO: 1768171 - protein, 6 aa, Staphylococcus epidermidis
LMPEGG

SEQ ID NO: 1768172 - protein, 7 aa, Staphylococcus epidermidis
LNDPRPM

SEQ ID NO: 1768173 - protein, 45 aa, Staphylococcus epidermidis
LNGGSSEEGSNTSAASESTSSDVVNASATQALPEGDFPETTEKIP

SEQ ID NO: 1768174 - protein, 10 aa, Staphylococcus epidermidis
LNHASKKNKV

SEQ ID NO: 1768175 - protein, 4 aa, Staphylococcus epidermidis
LNKP

SEQ ID NO: 1768176 - protein, 9 aa, Staphylococcus epidermidis
LNNEKQERH

SEQ ID NO: 1768177 - protein, 11 aa, Staphylococcus epidermidis
LNNNYKDIKQD

SEQ ID NO: 1768178 - protein, 5 aa, Staphylococcus epidermidis
LNQPK

SEQ ID NO: 1768179 - protein, 26 aa, Staphylococcus epidermidis
LNQQGQDKGQKYRTGVYSESSKHLNE

SEQ ID NO: 1768180 - protein, 6 aa, Staphylococcus epidermidis
LNQQQR

SEQ ID NO: 1768181 - protein, 20 aa, Staphylococcus epidermidis
LPDKQSTTGKHTSSNTTSIQ

SEQ ID NO: 1768182 - protein, 4 aa, Staphylococcus epidermidis
LPGK

SEQ ID NO: 1768183 - protein, 5 aa, Staphylococcus epidermidis
LPLSD

SEQ ID NO: 1768184 - protein, 7 aa, Staphylococcus epidermidis
LPNESGA

SEQ ID NO: 1768185 - protein, 11 aa, Staphylococcus epidermidis
LPSSTNPTLPY

SEQ ID NO: 1768186 - protein, 10 aa, Staphylococcus epidermidis
LPTKERNTQS

SEQ ID NO: 1768187 - protein, 4 aa, Staphylococcus epidermidis
LPTL

SEQ ID NO: 1768188 - protein, 7 aa, Staphylococcus epidermidis
LPTLREK

SEQ ID NO: 1768189 - protein, 5 aa, Staphylococcus epidermidis
LQDTV

SEQ ID NO: 1768190 - protein, 9 aa, Staphylococcus epidermidis
LQKDKLTDS

SEQ ID NO: 1768191 - protein, 11 aa, Staphylococcus epidermidis
LQKNDKHQTSE

SEQ ID NO: 1768192 - protein, 9 aa, Staphylococcus epidermidis
LRDETSLRT

SEQ ID NO: 1768193 - protein, 11 aa, Staphylococcus epidermidis
LRPGSNLGSEV

SEQ ID NO: 1768194 - protein, 4 aa, Staphylococcus epidermidis
LRQT

SEQ ID NO: 1768195 - protein, 5 aa, Staphylococcus epidermidis
LRRPD

SEQ ID NO: 1768196 - protein, 11 aa, Staphylococcus epidermidis
LRSESSSRFEK

SEQ ID NO: 1768197 - protein, 5 aa, Staphylococcus epidermidis
LRSNM

SEQ ID NO: 1768198 - protein, 7 aa, Staphylococcus epidermidis
LSEEYDT

SEQ ID NO: 1768199 - protein, 4 aa, Staphylococcus epidermidis
LSHG

SEQ ID NO: 1768200 - protein, 6 aa, Staphylococcus epidermidis
LSHQSL

SEQ ID NO: 1768201 - protein, 8 aa, Staphylococcus epidermidis
LSVGGDLE

SEQ ID NO: 1768202 - protein, 13 aa, Staphylococcus epidermidis
LTGSTRLKSGTAQ

SEQ ID NO: 1768203 - protein, 5 aa, Staphylococcus epidermidis
LTIDN

SEQ ID NO: 1768204 - protein, 9 aa, Staphylococcus epidermidis
LTKEQQDAF

SEQ ID NO: 1768205 - protein, 10 aa, Staphylococcus epidermidis
LTPRERKQQM

SEQ ID NO: 1768206 - protein, 7 aa, Staphylococcus epidermidis
LTQDPYS

SEQ ID NO: 1768207 - protein, 12 aa, Staphylococcus epidermidis
LTSKDDQYVSYK

SEQ ID NO: 1768208 - protein, 6 aa, Staphylococcus epidermidis
LTYATE

SEQ ID NO: 1768209 - protein, 14 aa, Staphylococcus epidermidis
LYDASKPKLKGDQG

SEQ ID NO: 1768210 - protein, 10 aa, Staphylococcus epidermidis
LYSSDSKIES

SEQ ID NO: 1768211 - protein, 16 aa, Staphylococcus epidermidis
MAKDKPKNKDKTITPK

SEQ ID NO: 1768212 - protein, 9 aa, Staphylococcus epidermidis
MGGENTSIK

SEQ ID NO: 1768213 - protein, 10 aa, Staphylococcus epidermidis
MGTRSGNLDP

SEQ ID NO: 1768214 - protein, 7 aa, Staphylococcus epidermidis
MHGPELP

SEQ ID NO: 1768215 - protein, 4 aa, Staphylococcus epidermidis
MKPG

SEQ ID NO: 1768216 - protein, 8 aa, Staphylococcus epidermidis
MKTSPKYN

SEQ ID NO: 1768217 - protein, 24 aa, Staphylococcus epidermidis
MKTSYRNQLEKNYDSRITGKRLNE

SEQ ID NO: 1768218 - protein, 13 aa, Staphylococcus epidermidis
MNDDSNKNNYVSP

SEQ ID NO: 1768219 - protein, 4 aa, Staphylococcus epidermidis
MNPN

SEQ ID NO: 1768220 - protein, 8 aa, Staphylococcus epidermidis
MPTNELDN

SEQ ID NO: 1768221 - protein, 9 aa, Staphylococcus epidermidis
MSAEDKDQV

SEQ ID NO: 1768222 - protein, 7 aa, Staphylococcus epidermidis
MSDKGRV

SEQ ID NO: 1768223 - protein, 112 aa, Staphylococcus epidermidis
MSNSASISQSNVASQSTTASLSQSESANDSMSSSLSESNSITSESNTNSKSEIESKSTSTSEFLSESGSVSNSEKSESISHSQSTSATPSSQSTYQQQPKEEKKGFFARLFN

SEQ ID NO: 1768224 - protein, 8 aa, Staphylococcus epidermidis
NAAKEPEV

SEQ ID NO: 1768225 - protein, 7 aa, Staphylococcus epidermidis
NAAKNKD

SEQ ID NO: 1768226 - protein, 7 aa, Staphylococcus epidermidis
NADNKNL

SEQ ID NO: 1768227 - protein, 9 aa, Staphylococcus epidermidis
NAESPIGNL

SEQ ID NO: 1768228 - protein, 5 aa, Staphylococcus epidermidis
NAIKG

SEQ ID NO: 1768229 - protein, 5 aa, Staphylococcus epidermidis
NANQI

SEQ ID NO: 1768230 - protein, 6 aa, Staphylococcus epidermidis
NAQTLE

SEQ ID NO: 1768231 - protein, 16 aa, Staphylococcus epidermidis
NAVSAQRSVTDTTNEL

SEQ ID NO: 1768232 - protein, 8 aa, Staphylococcus epidermidis
NDAPVLNG

SEQ ID NO: 1768233 - protein, 20 aa, Staphylococcus epidermidis
NDASEILGEPDIQNDISQYS

SEQ ID NO: 1768234 - protein, 4 aa, Staphylococcus epidermidis
NDEV

SEQ ID NO: 1768235 - protein, 7 aa, Staphylococcus epidermidis
NDGASVS

SEQ ID NO: 1768236 - protein, 4 aa, Staphylococcus epidermidis
NDIE

SEQ ID NO: 1768237 - protein, 9 aa, Staphylococcus epidermidis
NDKTPTTLK

SEQ ID NO: 1768238 - protein, 8 aa, Staphylococcus epidermidis
NDPDINPE

SEQ ID NO: 1768239 - protein, 14 aa, Staphylococcus epidermidis
NDVGGDINKINPEV

SEQ ID NO: 1768240 - protein, 7 aa, Staphylococcus epidermidis
NEEKTTA

SEQ ID NO: 1768241 - protein, 7 aa, Staphylococcus epidermidis
NEEQLQQ

SEQ ID NO: 1768242 - protein, 16 aa, Staphylococcus epidermidis
NEIVESAEKKLQSQYP

SEQ ID NO: 1768243 - protein, 25 aa, Staphylococcus epidermidis
NEKDSSDTDDKINPNDLSAPPGVKI

SEQ ID NO: 1768244 - protein, 8 aa, Staphylococcus epidermidis
NEMSQEDA

SEQ ID NO: 1768245 - protein, 8 aa, Staphylococcus epidermidis
NEPTDEAV

SEQ ID NO: 1768246 - protein, 16 aa, Staphylococcus epidermidis
NEQAPLNQSGYPSLSN

SEQ ID NO: 1768247 - protein, 7 aa, Staphylococcus epidermidis
NEQQYSS

SEQ ID NO: 1768248 - protein, 6 aa, Staphylococcus epidermidis
NEQRLN

SEQ ID NO: 1768249 - protein, 4 aa, Staphylococcus epidermidis
NERT

SEQ ID NO: 1768250 - protein, 13 aa, Staphylococcus epidermidis
NESVQNNLENYEK

SEQ ID NO: 1768251 - protein, 4 aa, Staphylococcus epidermidis
NETE

SEQ ID NO: 1768252 - protein, 7 aa, Staphylococcus epidermidis
NETIKGR

SEQ ID NO: 1768253 - protein, 9 aa, Staphylococcus epidermidis
NETSDKEEV

SEQ ID NO: 1768254 - protein, 10 aa, Staphylococcus epidermidis
NFKFPQDEST

SEQ ID NO: 1768255 - protein, 6 aa, Staphylococcus epidermidis
NGDAIA

SEQ ID NO: 1768256 - protein, 7 aa, Staphylococcus epidermidis
NGDTHQV

SEQ ID NO: 1768257 - protein, 15 aa, Staphylococcus epidermidis
NGEKSTKNIESNFTS

SEQ ID NO: 1768258 - protein, 22 aa, Staphylococcus epidermidis
NGENINEQSSNFKDRAKRFFKG

SEQ ID NO: 1768259 - protein, 9 aa, Staphylococcus epidermidis
NGETQVGEV

SEQ ID NO: 1768260 - protein, 8 aa, Staphylococcus epidermidis
NGGVSEQT

SEQ ID NO: 1768261 - protein, 12 aa, Staphylococcus epidermidis
NGNENVNDVPQN

SEQ ID NO: 1768262 - protein, 13 aa, Staphylococcus epidermidis
NGQPIKLGESQRI

SEQ ID NO: 1768263 - protein, 7 aa, Staphylococcus epidermidis
NGREPLM

SEQ ID NO: 1768264 - protein, 6 aa, Staphylococcus epidermidis
NGRYEG

SEQ ID NO: 1768265 - protein, 4 aa, Staphylococcus epidermidis
NHDN

SEQ ID NO: 1768266 - protein, 4 aa, Staphylococcus epidermidis
NHKD

SEQ ID NO: 1768267 - protein, 5 aa, Staphylococcus epidermidis
NHKTR

SEQ ID NO: 1768268 - protein, 7 aa, Staphylococcus epidermidis
NIHPKSE

SEQ ID NO: 1768269 - protein, 13 aa, Staphylococcus epidermidis
NIPRSEMDQEIED

SEQ ID NO: 1768270 - protein, 6 aa, Staphylococcus epidermidis
NIQSST

SEQ ID NO: 1768271 - protein, 7 aa, Staphylococcus epidermidis
NKALAES

SEQ ID NO: 1768272 - protein, 33 aa, Staphylococcus epidermidis
NKAPEKIINEEKEKQQHYQEKYNGVKSRIEQLK

SEQ ID NO: 1768273 - protein, 6 aa, Staphylococcus epidermidis
NKEENV

SEQ ID NO: 1768274 - protein, 7 aa, Staphylococcus epidermidis
NKEQTQE

SEQ ID NO: 1768275 - protein, 8 aa, Staphylococcus epidermidis
NKGEKHPR

SEQ ID NO: 1768276 - protein, 8 aa, Staphylococcus epidermidis
NKIEGKEV

SEQ ID NO: 1768277 - protein, 16 aa, Staphylococcus epidermidis
NKKIQKLENQLEEERQ

SEQ ID NO: 1768278 - protein, 12 aa, Staphylococcus epidermidis
NKKNRNEGIAES

SEQ ID NO: 1768279 - protein, 11 aa, Staphylococcus epidermidis
NKKSIKKENGL

SEQ ID NO: 1768280 - protein, 13 aa, Staphylococcus epidermidis
NKNYQGLNSKDNI

SEQ ID NO: 1768281 - protein, 23 aa, Staphylococcus epidermidis
NKPLDGRKSSPFSSNIEYGGRGM

SEQ ID NO: 1768282 - protein, 5 aa, Staphylococcus epidermidis
NKSAK

SEQ ID NO: 1768283 - protein, 6 aa, Staphylococcus epidermidis
NKTHDN

SEQ ID NO: 1768284 - protein, 12 aa, Staphylococcus epidermidis
NLRYTSSSFRNS

SEQ ID NO: 1768285 - protein, 6 aa, Staphylococcus epidermidis
NLSPGT

SEQ ID NO: 1768286 - protein, 12 aa, Staphylococcus epidermidis
NLYTSQPSVSRD

SEQ ID NO: 1768287 - protein, 6 aa, Staphylococcus epidermidis
NNAPEL

SEQ ID NO: 1768288 - protein, 9 aa, Staphylococcus epidermidis
NNDTTQDHR

SEQ ID NO: 1768289 - protein, 7 aa, Staphylococcus epidermidis
NNETFNT

SEQ ID NO: 1768290 - protein, 10 aa, Staphylococcus epidermidis
NNKKPTLTEH

SEQ ID NO: 1768291 - protein, 6 aa, Staphylococcus epidermidis
NNQEPG

SEQ ID NO: 1768292 - protein, 13 aa, Staphylococcus epidermidis
NNQGGGPHYYPNN

SEQ ID NO: 1768293 - protein, 9 aa, Staphylococcus epidermidis
NNTSFKPNV

SEQ ID NO: 1768294 - protein, 4 aa, Staphylococcus epidermidis
NNTV

SEQ ID NO: 1768295 - protein, 11 aa, Staphylococcus epidermidis
NNVKSLQSKAM

SEQ ID NO: 1768296 - protein, 8 aa, Staphylococcus epidermidis
NPEHEHPT

SEQ ID NO: 1768297 - protein, 4 aa, Staphylococcus epidermidis
NPGL

SEQ ID NO: 1768298 - protein, 4 aa, Staphylococcus epidermidis
NPHR

SEQ ID NO: 1768299 - protein, 9 aa, Staphylococcus epidermidis
NPNDERYKD

SEQ ID NO: 1768300 - protein, 15 aa, Staphylococcus epidermidis
NPNEEIKKMEDEQRK

SEQ ID NO: 1768301 - protein, 20 aa, Staphylococcus epidermidis
NPTRKRAPLAQKIRESKHPE

SEQ ID NO: 1768302 - protein, 6 aa, Staphylococcus epidermidis
NPWEGL

SEQ ID NO: 1768303 - protein, 18 aa, Staphylococcus epidermidis
NQDGSISIEDNGRGMPTG

SEQ ID NO: 1768304 - protein, 15 aa, Staphylococcus epidermidis
NQDKRIGPNPLEFDG

SEQ ID NO: 1768305 - protein, 6 aa, Staphylococcus epidermidis
NQGLRA

SEQ ID NO: 1768306 - protein, 9 aa, Staphylococcus epidermidis
NQPKTDEKG

SEQ ID NO: 1768307 - protein, 22 aa, Staphylococcus epidermidis
NQQSNTSTDSVEQHNLDDNTEA

SEQ ID NO: 1768308 - protein, 4 aa, Staphylococcus epidermidis
NQSI

SEQ ID NO: 1768309 - protein, 9 aa, Staphylococcus epidermidis
NQSSPANSV

SEQ ID NO: 1768310 - protein, 7 aa, Staphylococcus epidermidis
NQTSEDN

SEQ ID NO: 1768311 - protein, 5 aa, Staphylococcus epidermidis
NRQPY

SEQ ID NO: 1768312 - protein, 13 aa, Staphylococcus epidermidis
NRSKELNESVPEI

SEQ ID NO: 1768313 - protein, 9 aa, Staphylococcus epidermidis
NRVSSDAAQ

SEQ ID NO: 1768314 - protein, 5 aa, Staphylococcus epidermidis
NSAKQ

SEQ ID NO: 1768315 - protein, 7 aa, Staphylococcus epidermidis
NSEDQID

SEQ ID NO: 1768316 - protein, 7 aa, Staphylococcus epidermidis
NSIPTED

SEQ ID NO: 1768317 - protein, 18 aa, Staphylococcus epidermidis
NSNRLNQTVKNDFSNATE

SEQ ID NO: 1768318 - protein, 6 aa, Staphylococcus epidermidis
NSPDEQ

SEQ ID NO: 1768319 - protein, 18 aa, Staphylococcus epidermidis
NSQDEEMKSKFKNTKYPY

SEQ ID NO: 1768320 - protein, 4 aa, Staphylococcus epidermidis
NTDK

SEQ ID NO: 1768321 - protein, 25 aa, Staphylococcus epidermidis
NTKEFDKGTTTEDIAQSISPGLRKK

SEQ ID NO: 1768322 - protein, 5 aa, Staphylococcus epidermidis
NTKEI

SEQ ID NO: 1768323 - protein, 5 aa, Staphylococcus epidermidis
NTTHS

SEQ ID NO: 1768324 - protein, 4 aa, Staphylococcus epidermidis
NVEH

SEQ ID NO: 1768325 - protein, 6 aa, Staphylococcus epidermidis
NVENHT

SEQ ID NO: 1768326 - protein, 15 aa, Staphylococcus epidermidis
NVGGRKGHVHTDDNA

SEQ ID NO: 1768327 - protein, 4 aa, Staphylococcus epidermidis
NYAK

SEQ ID NO: 1768328 - protein, 10 aa, Staphylococcus epidermidis
NYEKNQNALP

SEQ ID NO: 1768329 - protein, 9 aa, Staphylococcus epidermidis
PAKSISDEN

SEQ ID NO: 1768330 - protein, 9 aa, Staphylococcus epidermidis
PAQQKERFI

SEQ ID NO: 1768331 - protein, 5 aa, Staphylococcus epidermidis
PATEE

SEQ ID NO: 1768332 - protein, 10 aa, Staphylococcus epidermidis
PDGKERYEHT

SEQ ID NO: 1768333 - protein, 7 aa, Staphylococcus epidermidis
PDSSQIN

SEQ ID NO: 1768334 - protein, 4 aa, Staphylococcus epidermidis
PEAD

SEQ ID NO: 1768335 - protein, 6 aa, Staphylococcus epidermidis
PEEIRT

SEQ ID NO: 1768336 - protein, 7 aa, Staphylococcus epidermidis
PEGVEKM

SEQ ID NO: 1768337 - protein, 10 aa, Staphylococcus epidermidis
PEKLKDSQEL

SEQ ID NO: 1768338 - protein, 5 aa, Staphylococcus epidermidis
PERAH

SEQ ID NO: 1768339 - protein, 6 aa, Staphylococcus epidermidis
PEREIG

SEQ ID NO: 1768340 - protein, 10 aa, Staphylococcus epidermidis
PERKRTTYLT

SEQ ID NO: 1768341 - protein, 4 aa, Staphylococcus epidermidis
PESI

SEQ ID NO: 1768342 - protein, 5 aa, Staphylococcus epidermidis
PETVR

SEQ ID NO: 1768343 - protein, 4 aa, Staphylococcus epidermidis
PEYE

SEQ ID NO: 1768344 - protein, 14 aa, Staphylococcus epidermidis
PGKQTSEETTVKAE

SEQ ID NO: 1768345 - protein, 12 aa, Staphylococcus epidermidis
PGTGETVGTQLA

SEQ ID NO: 1768346 - protein, 5 aa, Staphylococcus epidermidis
PHPSG

SEQ ID NO: 1768347 - protein, 18 aa, Staphylococcus epidermidis
PIAAPSANISGRPSPTTF

SEQ ID NO: 1768348 - protein, 12 aa, Staphylococcus epidermidis
PIQATTKKDELK

SEQ ID NO: 1768349 - protein, 6 aa, Staphylococcus epidermidis
PITEDE

SEQ ID NO: 1768350 - protein, 20 aa, Staphylococcus epidermidis
PKCKTKKNIQRKTNARCPNC

SEQ ID NO: 1768351 - protein, 6 aa, Staphylococcus epidermidis
PKGPGH

SEQ ID NO: 1768352 - protein, 5 aa, Staphylococcus epidermidis
PKHDA

SEQ ID NO: 1768353 - protein, 8 aa, Staphylococcus epidermidis
PKQPDLSP

SEQ ID NO: 1768354 - protein, 5 aa, Staphylococcus epidermidis
PKQVV

SEQ ID NO: 1768355 - protein, 7 aa, Staphylococcus epidermidis
PKSIGVG

SEQ ID NO: 1768356 - protein, 5 aa, Staphylococcus epidermidis
PKTAS

SEQ ID NO: 1768357 - protein, 9 aa, Staphylococcus epidermidis
PKTNSGKIR

SEQ ID NO: 1768358 - protein, 5 aa, Staphylococcus epidermidis
PKVAT

SEQ ID NO: 1768359 - protein, 14 aa, Staphylococcus epidermidis
PLPKRAGRNNQGKL

SEQ ID NO: 1768360 - protein, 19 aa, Staphylococcus epidermidis
PMAASNTTNTLKDGTKKRI

SEQ ID NO: 1768361 - protein, 19 aa, Staphylococcus epidermidis
PMPNARQTKEEVDVSPFDT

SEQ ID NO: 1768362 - protein, 7 aa, Staphylococcus epidermidis
PNAKPPV

SEQ ID NO: 1768363 - protein, 20 aa, Staphylococcus epidermidis
PNDGGLSQIGPTSRVTGRMD

SEQ ID NO: 1768364 - protein, 9 aa, Staphylococcus epidermidis
PNETEEQFE

SEQ ID NO: 1768365 - protein, 8 aa, Staphylococcus epidermidis
PNGCARPA

SEQ ID NO: 1768366 - protein, 5 aa, Staphylococcus epidermidis
PNKRG

SEQ ID NO: 1768367 - protein, 16 aa, Staphylococcus epidermidis
PNNPTGYTPNKKEVNT

SEQ ID NO: 1768368 - protein, 11 aa, Staphylococcus epidermidis
PNQNQKETPQK

SEQ ID NO: 1768369 - protein, 14 aa, Staphylococcus epidermidis
PNTEPIRGGTDGSQ

SEQ ID NO: 1768370 - protein, 6 aa, Staphylococcus epidermidis
PNVGKS

SEQ ID NO: 1768371 - protein, 8 aa, Staphylococcus epidermidis
PNVKDKSN

SEQ ID NO: 1768372 - protein, 4 aa, Staphylococcus epidermidis
PNYL

SEQ ID NO: 1768373 - protein, 9 aa, Staphylococcus epidermidis
PPKAGKTSL

SEQ ID NO: 1768374 - protein, 9 aa, Staphylococcus epidermidis
PQDTESYTH

SEQ ID NO: 1768375 - protein, 8 aa, Staphylococcus epidermidis
PQKSTNQL

SEQ ID NO: 1768376 - protein, 7 aa, Staphylococcus epidermidis
PRLQTKE

SEQ ID NO: 1768377 - protein, 9 aa, Staphylococcus epidermidis
PSEHTERSW

SEQ ID NO: 1768378 - protein, 6 aa, Staphylococcus epidermidis
PSLDDL

SEQ ID NO: 1768379 - protein, 6 aa, Staphylococcus epidermidis
PSPQPI

SEQ ID NO: 1768380 - protein, 11 aa, Staphylococcus epidermidis
PSSPVPTTSNT

SEQ ID NO: 1768381 - protein, 17 aa, Staphylococcus epidermidis
PSVHQTKESQPLITRSG

SEQ ID NO: 1768382 - protein, 11 aa, Staphylococcus epidermidis
PTEDTDQAKAK

SEQ ID NO: 1768383 - protein, 6 aa, Staphylococcus epidermidis
PTEPVE

SEQ ID NO: 1768384 - protein, 8 aa, Staphylococcus epidermidis
PTLSKDSY

SEQ ID NO: 1768385 - protein, 5 aa, Staphylococcus epidermidis
PTNHL

SEQ ID NO: 1768386 - protein, 8 aa, Staphylococcus epidermidis
PTSALDPI

SEQ ID NO: 1768387 - protein, 10 aa, Staphylococcus epidermidis
PTSIEGELPE

SEQ ID NO: 1768388 - protein, 7 aa, Staphylococcus epidermidis
PTYDKTL

SEQ ID NO: 1768389 - protein, 17 aa, Staphylococcus epidermidis
PVPPLPPAKNFKGPIGR

SEQ ID NO: 1768390 - protein, 10 aa, Staphylococcus epidermidis
PYMEASQKNQ

SEQ ID NO: 1768391 - protein, 8 aa, Staphylococcus epidermidis
QAARVSDK

SEQ ID NO: 1768392 - protein, 20 aa, Staphylococcus epidermidis
QALASSPNLAVSSSSRGNLE

SEQ ID NO: 1768393 - protein, 9 aa, Staphylococcus epidermidis
QARNEIEHA

SEQ ID NO: 1768394 - protein, 21 aa, Staphylococcus epidermidis
QARSYKKKLSDAISKTQHPDR

SEQ ID NO: 1768395 - protein, 12 aa, Staphylococcus epidermidis
QASQSYAAQESS

SEQ ID NO: 1768396 - protein, 18 aa, Staphylococcus epidermidis
QDDRDLRDERRKQKLEPA

SEQ ID NO: 1768397 - protein, 7 aa, Staphylococcus epidermidis
QDNEEFE

SEQ ID NO: 1768398 - protein, 4 aa, Staphylococcus epidermidis
QDTY

SEQ ID NO: 1768399 - protein, 6 aa, Staphylococcus epidermidis
QDVPAG

SEQ ID NO: 1768400 - protein, 5 aa, Staphylococcus epidermidis
QEAHP

SEQ ID NO: 1768401 - protein, 17 aa, Staphylococcus epidermidis
QEGKFKPDEKYKSGHRN

SEQ ID NO: 1768402 - protein, 10 aa, Staphylococcus epidermidis
QEKIEADLRG

SEQ ID NO: 1768403 - protein, 11 aa, Staphylococcus epidermidis
QENPPSQCPNC

SEQ ID NO: 1768404 - protein, 5 aa, Staphylococcus epidermidis
QERGI

SEQ ID NO: 1768405 - protein, 5 aa, Staphylococcus epidermidis
QERIN

SEQ ID NO: 1768406 - protein, 8 aa, Staphylococcus epidermidis
QESLTKDE

SEQ ID NO: 1768407 - protein, 14 aa, Staphylococcus epidermidis
QESRQNTLCLYVIS

SEQ ID NO: 1768408 - protein, 5 aa, Staphylococcus epidermidis
QEVTK

SEQ ID NO: 1768409 - protein, 20 aa, Staphylococcus epidermidis
QGETAKGVGIRNNQLTSTPF

SEQ ID NO: 1768410 - protein, 4 aa, Staphylococcus epidermidis
QGHQ

SEQ ID NO: 1768411 - protein, 12 aa, Staphylococcus epidermidis
QGIENYTDEEAA

SEQ ID NO: 1768412 - protein, 37 aa, Staphylococcus epidermidis
QGIYESQPEHKKPPFPTDGDGYEYNYRQDDDNYFEQP

SEQ ID NO: 1768413 - protein, 8 aa, Staphylococcus epidermidis
QGKHNEVK

SEQ ID NO: 1768414 - protein, 16 aa, Staphylococcus epidermidis
QGLNTTYDTAEKVKHQ

SEQ ID NO: 1768415 - protein, 14 aa, Staphylococcus epidermidis
QGMTPDKPYKKSAR

SEQ ID NO: 1768416 - protein, 4 aa, Staphylococcus epidermidis
QGSV

SEQ ID NO: 1768417 - protein, 4 aa, Staphylococcus epidermidis
QHPH

SEQ ID NO: 1768418 - protein, 15 aa, Staphylococcus epidermidis
QHRPKTTGRSKGGNY

SEQ ID NO: 1768419 - protein, 5 aa, Staphylococcus epidermidis
QIARG

SEQ ID NO: 1768420 - protein, 7 aa, Staphylococcus epidermidis
QILEPSD

SEQ ID NO: 1768421 - protein, 12 aa, Staphylococcus epidermidis
QKATANIGLEPE

SEQ ID NO: 1768422 - protein, 22 aa, Staphylococcus epidermidis
QKKAIEQIKPGMTAKEADAISR

SEQ ID NO: 1768423 - protein, 8 aa, Staphylococcus epidermidis
QKKKARYS

SEQ ID NO: 1768424 - protein, 8 aa, Staphylococcus epidermidis
QKNQEDTH

SEQ ID NO: 1768425 - protein, 33 aa, Staphylococcus epidermidis
QKPSYQLSHENTDNQQTVPSYNDFGRTEEEQSV

SEQ ID NO: 1768426 - protein, 17 aa, Staphylococcus epidermidis
QKTNANPVITSGHPDFS

SEQ ID NO: 1768427 - protein, 11 aa, Staphylococcus epidermidis
QLDQQNSNVNT

SEQ ID NO: 1768428 - protein, 4 aa, Staphylococcus epidermidis
QLEN

SEQ ID NO: 1768429 - protein, 10 aa, Staphylococcus epidermidis
QLGQRPGAGA

SEQ ID NO: 1768430 - protein, 42 aa, Staphylococcus epidermidis
QLKKPRDPEEEERLRKRNEERKRRKEEQDRKLKEKLKKHKAE

SEQ ID NO: 1768431 - protein, 8 aa, Staphylococcus epidermidis
QLNTPAKV

SEQ ID NO: 1768432 - protein, 8 aa, Staphylococcus epidermidis
QLPSSVHR

SEQ ID NO: 1768433 - protein, 6 aa, Staphylococcus epidermidis
QLSGLG

SEQ ID NO: 1768434 - protein, 11 aa, Staphylococcus epidermidis
QLSQDTNIQLS

SEQ ID NO: 1768435 - protein, 6 aa, Staphylococcus epidermidis
QNATSS

SEQ ID NO: 1768436 - protein, 20 aa, Staphylococcus epidermidis
QNEDIPEEISRNSSVESEEG

SEQ ID NO: 1768437 - protein, 7 aa, Staphylococcus epidermidis
QNESPTV

SEQ ID NO: 1768438 - protein, 21 aa, Staphylococcus epidermidis
QNITQTQKEYQSSKKSMEKVE

SEQ ID NO: 1768439 - protein, 8 aa, Staphylococcus epidermidis
QNLSNNAD

SEQ ID NO: 1768440 - protein, 8 aa, Staphylococcus epidermidis
QNNEKYQK

SEQ ID NO: 1768441 - protein, 9 aa, Staphylococcus epidermidis
QNPATGEQV

SEQ ID NO: 1768442 - protein, 25 aa, Staphylococcus epidermidis
QNRVKEPKLSEKRTQNLREKQEIAK

SEQ ID NO: 1768443 - protein, 15 aa, Staphylococcus epidermidis
QNYGKQNALEQSEAK

SEQ ID NO: 1768444 - protein, 6 aa, Staphylococcus epidermidis
QPIGEN

SEQ ID NO: 1768445 - protein, 5 aa, Staphylococcus epidermidis
QPLKY

SEQ ID NO: 1768446 - protein, 16 aa, Staphylococcus epidermidis
QPLQEFKNSKASLLTS

SEQ ID NO: 1768447 - protein, 5 aa, Staphylococcus epidermidis
QQEAY

SEQ ID NO: 1768448 - protein, 35 aa, Staphylococcus epidermidis
QQEDEQSAREATEKLEKMKAEKAKQQDNNESTVEK

SEQ ID NO: 1768449 - protein, 13 aa, Staphylococcus epidermidis
QQKIASGKHYGAT

SEQ ID NO: 1768450 - protein, 7 aa, Staphylococcus epidermidis
QQLTDSK

SEQ ID NO: 1768451 - protein, 9 aa, Staphylococcus epidermidis
QQLTSAEDV

SEQ ID NO: 1768452 - protein, 6 aa, Staphylococcus epidermidis
QRDNDR

SEQ ID NO: 1768453 - protein, 7 aa, Staphylococcus epidermidis
QRELEEE

SEQ ID NO: 1768454 - protein, 5 aa, Staphylococcus epidermidis
QRGEK

SEQ ID NO: 1768455 - protein, 5 aa, Staphylococcus epidermidis
QRINT

SEQ ID NO: 1768456 - protein, 8 aa, Staphylococcus epidermidis
QRQNETDI

SEQ ID NO: 1768457 - protein, 7 aa, Staphylococcus epidermidis
QRSAGFD

SEQ ID NO: 1768458 - protein, 9 aa, Staphylococcus epidermidis
QRVQEATKL

SEQ ID NO: 1768459 - protein, 5 aa, Staphylococcus epidermidis
QSAGS

SEQ ID NO: 1768460 - protein, 9 aa, Staphylococcus epidermidis
QSELDERQK

SEQ ID NO: 1768461 - protein, 10 aa, Staphylococcus epidermidis
QSKDMGPVGE

SEQ ID NO: 1768462 - protein, 5 aa, Staphylococcus epidermidis
QSNNG

SEQ ID NO: 1768463 - protein, 8 aa, Staphylococcus epidermidis
QSNYDNKH

SEQ ID NO: 1768464 - protein, 4 aa, Staphylococcus epidermidis
QSPK

SEQ ID NO: 1768465 - protein, 5 aa, Staphylococcus epidermidis
QTEAM

SEQ ID NO: 1768466 - protein, 8 aa, Staphylococcus epidermidis
QTEKTLDR

SEQ ID NO: 1768467 - protein, 5 aa, Staphylococcus epidermidis
QTELS

SEQ ID NO: 1768468 - protein, 10 aa, Staphylococcus epidermidis
QTENKSSEEL

SEQ ID NO: 1768469 - protein, 7 aa, Staphylococcus epidermidis
QTETTID

SEQ ID NO: 1768470 - protein, 8 aa, Staphylococcus epidermidis
QTNEEGHQ

SEQ ID NO: 1768471 - protein, 5 aa, Staphylococcus epidermidis
QTSDV

SEQ ID NO: 1768472 - protein, 5 aa, Staphylococcus epidermidis
QTTRS

SEQ ID NO: 1768473 - protein, 13 aa, Staphylococcus epidermidis
QVELKDTQLTPEN

SEQ ID NO: 1768474 - protein, 7 aa, Staphylococcus epidermidis
QVGYNED

SEQ ID NO: 1768475 - protein, 11 aa, Staphylococcus epidermidis
QYSDLSNQFKN

SEQ ID NO: 1768476 - protein, 9 aa, Staphylococcus epidermidis
RAEKSKTRR

SEQ ID NO: 1768477 - protein, 12 aa, Staphylococcus epidermidis
RAETYGKGVYRE

SEQ ID NO: 1768478 - protein, 9 aa, Staphylococcus epidermidis
RAKNDEKYI

SEQ ID NO: 1768479 - protein, 7 aa, Staphylococcus epidermidis
RARGEAI

SEQ ID NO: 1768480 - protein, 5 aa, Staphylococcus epidermidis
RASAA

SEQ ID NO: 1768481 - protein, 5 aa, Staphylococcus epidermidis
RASQG

SEQ ID NO: 1768482 - protein, 7 aa, Staphylococcus epidermidis
RATSRKE

SEQ ID NO: 1768483 - protein, 10 aa, Staphylococcus epidermidis
RDAKSQMKAE

SEQ ID NO: 1768484 - protein, 6 aa, Staphylococcus epidermidis
RDDEGK

SEQ ID NO: 1768485 - protein, 7 aa, Staphylococcus epidermidis
RDEDNQI

SEQ ID NO: 1768486 - protein, 10 aa, Staphylococcus epidermidis
RDHKGAEVKE

SEQ ID NO: 1768487 - protein, 6 aa, Staphylococcus epidermidis
RDIKRS

SEQ ID NO: 1768488 - protein, 8 aa, Staphylococcus epidermidis
RDKIESEY

SEQ ID NO: 1768489 - protein, 10 aa, Staphylococcus epidermidis
RDNETEAFRE

SEQ ID NO: 1768490 - protein, 8 aa, Staphylococcus epidermidis
RDRTEVIK

SEQ ID NO: 1768491 - protein, 5 aa, Staphylococcus epidermidis
REITD

SEQ ID NO: 1768492 - protein, 7 aa, Staphylococcus epidermidis
RERYGPP

SEQ ID NO: 1768493 - protein, 5 aa, Staphylococcus epidermidis
RETTF

SEQ ID NO: 1768494 - protein, 12 aa, Staphylococcus epidermidis
REVNDKGKYAKT

SEQ ID NO: 1768495 - protein, 6 aa, Staphylococcus epidermidis
RFDEEN

SEQ ID NO: 1768496 - protein, 10 aa, Staphylococcus epidermidis
RFGDERRTEI

SEQ ID NO: 1768497 - protein, 11 aa, Staphylococcus epidermidis
RFSSSGNESGL

SEQ ID NO: 1768498 - protein, 5 aa, Staphylococcus epidermidis
RGAAL

SEQ ID NO: 1768499 - protein, 4 aa, Staphylococcus epidermidis
RGGE

SEQ ID NO: 1768500 - protein, 17 aa, Staphylococcus epidermidis
RGGMPSEGGFGVTVAEL

SEQ ID NO: 1768501 - protein, 8 aa, Staphylococcus epidermidis
RGNGHRTA

SEQ ID NO: 1768502 - protein, 5 aa, Staphylococcus epidermidis
RGSLS

SEQ ID NO: 1768503 - protein, 11 aa, Staphylococcus epidermidis
RHERYKKADEF

SEQ ID NO: 1768504 - protein, 6 aa, Staphylococcus epidermidis
RHPNEY

SEQ ID NO: 1768505 - protein, 7 aa, Staphylococcus epidermidis
RHTNPDV

SEQ ID NO: 1768506 - protein, 6 aa, Staphylococcus epidermidis
RIPENA

SEQ ID NO: 1768507 - protein, 13 aa, Staphylococcus epidermidis
RKGGYIADTPGFS

SEQ ID NO: 1768508 - protein, 8 aa, Staphylococcus epidermidis
RKNKDDLD

SEQ ID NO: 1768509 - protein, 33 aa, Staphylococcus epidermidis
RKNKNRRQSQQSKQNNQDSLLPQNNDIYSRPRG

SEQ ID NO: 1768510 - protein, 20 aa, Staphylococcus epidermidis
RKQNKEANQLAQQTLYKLTS

SEQ ID NO: 1768511 - protein, 6 aa, Staphylococcus epidermidis
RKREDN

SEQ ID NO: 1768512 - protein, 7 aa, Staphylococcus epidermidis
RKRKRAY

SEQ ID NO: 1768513 - protein, 7 aa, Staphylococcus epidermidis
RLAGEGT

SEQ ID NO: 1768514 - protein, 5 aa, Staphylococcus epidermidis
RLEGG

SEQ ID NO: 1768515 - protein, 13 aa, Staphylococcus epidermidis
RMGRKSHQLTEGH

SEQ ID NO: 1768516 - protein, 4 aa, Staphylococcus epidermidis
RMSS

SEQ ID NO: 1768517 - protein, 11 aa, Staphylococcus epidermidis
RNGATDDDLKA

SEQ ID NO: 1768518 - protein, 24 aa, Staphylococcus epidermidis
RNLPASLRETGLGGLAGTPTGEEI

SEQ ID NO: 1768519 - protein, 4 aa, Staphylococcus epidermidis
RNVK

SEQ ID NO: 1768520 - protein, 6 aa, Staphylococcus epidermidis
RPFGDS

SEQ ID NO: 1768521 - protein, 8 aa, Staphylococcus epidermidis
RQKTGAFP

SEQ ID NO: 1768522 - protein, 4 aa, Staphylococcus epidermidis
RQNI

SEQ ID NO: 1768523 - protein, 20 aa, Staphylococcus epidermidis
RQQNIDVTNTPHASTNATAD

SEQ ID NO: 1768524 - protein, 13 aa, Staphylococcus epidermidis
RSAHASENADEAL

SEQ ID NO: 1768525 - protein, 13 aa, Staphylococcus epidermidis
RSEDSQGASGENR

SEQ ID NO: 1768526 - protein, 6 aa, Staphylococcus epidermidis
RSENMS

SEQ ID NO: 1768527 - protein, 8 aa, Staphylococcus epidermidis
RSETPSEM

SEQ ID NO: 1768528 - protein, 15 aa, Staphylococcus epidermidis
RSIENSKKHQQPATL

SEQ ID NO: 1768529 - protein, 6 aa, Staphylococcus epidermidis
RSPAND

SEQ ID NO: 1768530 - protein, 6 aa, Staphylococcus epidermidis
RSQTKY

SEQ ID NO: 1768531 - protein, 9 aa, Staphylococcus epidermidis
RSSARETAA

SEQ ID NO: 1768532 - protein, 7 aa, Staphylococcus epidermidis
RTGTPIH

SEQ ID NO: 1768533 - protein, 6 aa, Staphylococcus epidermidis
RTRASL

SEQ ID NO: 1768534 - protein, 8 aa, Staphylococcus epidermidis
RTRKGGAE

SEQ ID NO: 1768535 - protein, 11 aa, Staphylococcus epidermidis
RTSKASTPYSQ

SEQ ID NO: 1768536 - protein, 7 aa, Staphylococcus epidermidis
RTSKTPL

SEQ ID NO: 1768537 - protein, 9 aa, Staphylococcus epidermidis
RVAPSVAKN

SEQ ID NO: 1768538 - protein, 10 aa, Staphylococcus epidermidis
RVDNGESLTA

SEQ ID NO: 1768539 - protein, 7 aa, Staphylococcus epidermidis
RYNKDGS

SEQ ID NO: 1768540 - protein, 8 aa, Staphylococcus epidermidis
RYSPEKQL

SEQ ID NO: 1768541 - protein, 12 aa, Staphylococcus epidermidis
SADEPGSSMNEQ

SEQ ID NO: 1768542 - protein, 63 aa, Staphylococcus epidermidis
SAEDTDDDQEKTDEDSSDNKSKKDKADEDHSNTSSSTKNDKSNADSKNDSDDSTNETSGSERN

SEQ ID NO: 1768543 - protein, 5 aa, Staphylococcus epidermidis
SAESD

SEQ ID NO: 1768544 - protein, 8 aa, Staphylococcus epidermidis
SAPAKGDV

SEQ ID NO: 1768545 - protein, 13 aa, Staphylococcus epidermidis
SAPNEKTKTFKGT

SEQ ID NO: 1768546 - protein, 13 aa, Staphylococcus epidermidis
SAPYQAPENPEIT

SEQ ID NO: 1768547 - protein, 4 aa, Staphylococcus epidermidis
SAQV

SEQ ID NO: 1768548 - protein, 5 aa, Staphylococcus epidermidis
SAYKN

SEQ ID NO: 1768549 - protein, 4 aa, Staphylococcus epidermidis
SCDE

SEQ ID NO: 1768550 - protein, 13 aa, Staphylococcus epidermidis
SCPSGAMYKRDED

SEQ ID NO: 1768551 - protein, 10 aa, Staphylococcus epidermidis
SDGCEQTNTA

SEQ ID NO: 1768552 - protein, 7 aa, Staphylococcus epidermidis
SDKPNRL

SEQ ID NO: 1768553 - protein, 4 aa, Staphylococcus epidermidis
SDLA

SEQ ID NO: 1768554 - protein, 8 aa, Staphylococcus epidermidis
SDMGGDYE

SEQ ID NO: 1768555 - protein, 9 aa, Staphylococcus epidermidis
SDQPAPPHH

SEQ ID NO: 1768556 - protein, 10 aa, Staphylococcus epidermidis
SDRAKKRFAD

SEQ ID NO: 1768557 - protein, 17 aa, Staphylococcus epidermidis
SDRKFNSQMYELAKELS

SEQ ID NO: 1768558 - protein, 6 aa, Staphylococcus epidermidis
SDSDED

SEQ ID NO: 1768559 - protein, 15 aa, Staphylococcus epidermidis
SDVKIKENVSDIKQK

SEQ ID NO: 1768560 - protein, 4 aa, Staphylococcus epidermidis
SEAG

SEQ ID NO: 1768561 - protein, 9 aa, Staphylococcus epidermidis
SEDITGNES

SEQ ID NO: 1768562 - protein, 8 aa, Staphylococcus epidermidis
SEERREAK

SEQ ID NO: 1768563 - protein, 11 aa, Staphylococcus epidermidis
SEHKGTNIDEL

SEQ ID NO: 1768564 - protein, 6 aa, Staphylococcus epidermidis
SEHLED

SEQ ID NO: 1768565 - protein, 7 aa, Staphylococcus epidermidis
SEHSTRE

SEQ ID NO: 1768566 - protein, 4 aa, Staphylococcus epidermidis
SEIK

SEQ ID NO: 1768567 - protein, 13 aa, Staphylococcus epidermidis
SEIKQQRKDLNEK

SEQ ID NO: 1768568 - protein, 6 aa, Staphylococcus epidermidis
SEKSID

SEQ ID NO: 1768569 - protein, 4 aa, Staphylococcus epidermidis
SELQ

SEQ ID NO: 1768570 - protein, 11 aa, Staphylococcus epidermidis
SENLEAEAERY

SEQ ID NO: 1768571 - protein, 10 aa, Staphylococcus epidermidis
SERKHEPRLG

SEQ ID NO: 1768572 - protein, 9 aa, Staphylococcus epidermidis
SESNESDFK

SEQ ID NO: 1768573 - protein, 4 aa, Staphylococcus epidermidis
SEYD

SEQ ID NO: 1768574 - protein, 19 aa, Staphylococcus epidermidis
SFGQQKEHDAREMTAEEIE

SEQ ID NO: 1768575 - protein, 8 aa, Staphylococcus epidermidis
SFKENGEW

SEQ ID NO: 1768576 - protein, 6 aa, Staphylococcus epidermidis
SFQETT

SEQ ID NO: 1768577 - protein, 8 aa, Staphylococcus epidermidis
SGCGKSTT

SEQ ID NO: 1768578 - protein, 7 aa, Staphylococcus epidermidis
SGGERTK

SEQ ID NO: 1768579 - protein, 11 aa, Staphylococcus epidermidis
SGIGKVNASIS

SEQ ID NO: 1768580 - protein, 15 aa, Staphylococcus epidermidis
SGIRRAYETGRGSIQ

SEQ ID NO: 1768581 - protein, 11 aa, Staphylococcus epidermidis
SGKGGVGKSTV

SEQ ID NO: 1768582 - protein, 6 aa, Staphylococcus epidermidis
SGLKGV

SEQ ID NO: 1768583 - protein, 6 aa, Staphylococcus epidermidis
SGMNAE

SEQ ID NO: 1768584 - protein, 5 aa, Staphylococcus epidermidis
SGNGF

SEQ ID NO: 1768585 - protein, 9 aa, Staphylococcus epidermidis
SGTEANEAA

SEQ ID NO: 1768586 - protein, 9 aa, Staphylococcus epidermidis
SHQSRSTIE

SEQ ID NO: 1768587 - protein, 10 aa, Staphylococcus epidermidis
SIGAKKDRYP

SEQ ID NO: 1768588 - protein, 7 aa, Staphylococcus epidermidis
SIGETAQ

SEQ ID NO: 1768589 - protein, 4 aa, Staphylococcus epidermidis
SIPE

SEQ ID NO: 1768590 - protein, 9 aa, Staphylococcus epidermidis
SKAPENTIA

SEQ ID NO: 1768591 - protein, 23 aa, Staphylococcus epidermidis
SKATSYTEAGTKHGRLGLMAGHK

SEQ ID NO: 1768592 - protein, 9 aa, Staphylococcus epidermidis
SKDLNHNSD

SEQ ID NO: 1768593 - protein, 4 aa, Staphylococcus epidermidis
SKDT

SEQ ID NO: 1768594 - protein, 8 aa, Staphylococcus epidermidis
SKEKAKDF

SEQ ID NO: 1768595 - protein, 27 aa, Staphylococcus epidermidis
SKGLTSVDEVTKATKAGNSCGKCKGQI

SEQ ID NO: 1768596 - protein, 5 aa, Staphylococcus epidermidis
SKHGN

SEQ ID NO: 1768597 - protein, 15 aa, Staphylococcus epidermidis
SKIKTSLKNAIEDGM

SEQ ID NO: 1768598 - protein, 7 aa, Staphylococcus epidermidis
SKPRRNQ

SEQ ID NO: 1768599 - protein, 18 aa, Staphylococcus epidermidis
SKQGIEEAQSAGKKIYGN

SEQ ID NO: 1768600 - protein, 10 aa, Staphylococcus epidermidis
SKRDSAKAKM

SEQ ID NO: 1768601 - protein, 7 aa, Staphylococcus epidermidis
SKVQREK

SEQ ID NO: 1768602 - protein, 5 aa, Staphylococcus epidermidis
SLNRQ

SEQ ID NO: 1768603 - protein, 6 aa, Staphylococcus epidermidis
SLPEGT

SEQ ID NO: 1768604 - protein, 10 aa, Staphylococcus epidermidis
SMAGRGTDIK

SEQ ID NO: 1768605 - protein, 12 aa, Staphylococcus epidermidis
SNDNLLSSYFYK

SEQ ID NO: 1768606 - protein, 11 aa, Staphylococcus epidermidis
SNEDKSSLHRY

SEQ ID NO: 1768607 - protein, 23 aa, Staphylococcus epidermidis
SNEEKNKGITCASAGNHAQGVAY

SEQ ID NO: 1768608 - protein, 16 aa, Staphylococcus epidermidis
SNENVYGPSPKVKTAI

SEQ ID NO: 1768609 - protein, 4 aa, Staphylococcus epidermidis
SNER

SEQ ID NO: 1768610 - protein, 8 aa, Staphylococcus epidermidis
SNGDNTKF

SEQ ID NO: 1768611 - protein, 5 aa, Staphylococcus epidermidis
SNHPY

SEQ ID NO: 1768612 - protein, 15 aa, Staphylococcus epidermidis
SNKADRIKSKLMSAN

SEQ ID NO: 1768613 - protein, 4 aa, Staphylococcus epidermidis
SNKT

SEQ ID NO: 1768614 - protein, 7 aa, Staphylococcus epidermidis
SNLTSNA

SEQ ID NO: 1768615 - protein, 5 aa, Staphylococcus epidermidis
SNQCE

SEQ ID NO: 1768616 - protein, 6 aa, Staphylococcus epidermidis
SNQYAN

SEQ ID NO: 1768617 - protein, 4 aa, Staphylococcus epidermidis
SNRD

SEQ ID NO: 1768618 - protein, 10 aa, Staphylococcus epidermidis
SNRKLTSPEV

SEQ ID NO: 1768619 - protein, 8 aa, Staphylococcus epidermidis
SPAAQGLH

SEQ ID NO: 1768620 - protein, 10 aa, Staphylococcus epidermidis
SPEPSYMPGY

SEQ ID NO: 1768621 - protein, 15 aa, Staphylococcus epidermidis
SPFGSSSKLNDDNFP

SEQ ID NO: 1768622 - protein, 4 aa, Staphylococcus epidermidis
SPGG

SEQ ID NO: 1768623 - protein, 6 aa, Staphylococcus epidermidis
SPWDQE

SEQ ID NO: 1768624 - protein, 11 aa, Staphylococcus epidermidis
SQLNPDSPQHA

SEQ ID NO: 1768625 - protein, 12 aa, Staphylococcus epidermidis
SQNTKKKTQKAV

SEQ ID NO: 1768626 - protein, 8 aa, Staphylococcus epidermidis
SQSHRPQF

SEQ ID NO: 1768627 - protein, 10 aa, Staphylococcus epidermidis
SQYSKTRDYT

SEQ ID NO: 1768628 - protein, 4 aa, Staphylococcus epidermidis
SRHA

SEQ ID NO: 1768629 - protein, 5 aa, Staphylococcus epidermidis
SRRKI

SEQ ID NO: 1768630 - protein, 7 aa, Staphylococcus epidermidis
SSDWDDQ

SEQ ID NO: 1768631 - protein, 6 aa, Staphylococcus epidermidis
SSIGSA

SEQ ID NO: 1768632 - protein, 4 aa, Staphylococcus epidermidis
SSIT

SEQ ID NO: 1768633 - protein, 9 aa, Staphylococcus epidermidis
SSKKVGDKV

SEQ ID NO: 1768634 - protein, 53 aa, Staphylococcus epidermidis
SSKSEDDIQKDLDETVDSNANSDSDSMDPNDSDEQVKPKKKPKKLSEADFDED

SEQ ID NO: 1768635 - protein, 14 aa, Staphylococcus epidermidis
SSKSQIKYDTPKDV

SEQ ID NO: 1768636 - protein, 11 aa, Staphylococcus epidermidis
SSLEDNKRHMS

SEQ ID NO: 1768637 - protein, 7 aa, Staphylococcus epidermidis
SSNIPSI

SEQ ID NO: 1768638 - protein, 7 aa, Staphylococcus epidermidis
SSNNPRF

SEQ ID NO: 1768639 - protein, 8 aa, Staphylococcus epidermidis
SSNNSLDV

SEQ ID NO: 1768640 - protein, 10 aa, Staphylococcus epidermidis
SSTDSAHLAA

SEQ ID NO: 1768641 - protein, 4 aa, Staphylococcus epidermidis
STFI

SEQ ID NO: 1768642 - protein, 13 aa, Staphylococcus epidermidis
STLSQVDNTEYER

SEQ ID NO: 1768643 - protein, 4 aa, Staphylococcus epidermidis
STMS

SEQ ID NO: 1768644 - protein, 5 aa, Staphylococcus epidermidis
STRKG

SEQ ID NO: 1768645 - protein, 15 aa, Staphylococcus epidermidis
STYRSQNRGGRGIQG

SEQ ID NO: 1768646 - protein, 15 aa, Staphylococcus epidermidis
SVNPNDINPEKQSRL

SEQ ID NO: 1768647 - protein, 19 aa, Staphylococcus epidermidis
SVTELTRENAKEMIKQNHN

SEQ ID NO: 1768648 - protein, 15 aa, Staphylococcus epidermidis
SYDSNEKVTDIESEV

SEQ ID NO: 1768649 - protein, 6 aa, Staphylococcus epidermidis
SYTDPK

SEQ ID NO: 1768650 - protein, 4 aa, Staphylococcus epidermidis
TADK

SEQ ID NO: 1768651 - protein, 8 aa, Staphylococcus epidermidis
TADPFDEL

SEQ ID NO: 1768652 - protein, 9 aa, Staphylococcus epidermidis
TAGKGRSGF

SEQ ID NO: 1768653 - protein, 9 aa, Staphylococcus epidermidis
TAKKENGEI

SEQ ID NO: 1768654 - protein, 12 aa, Staphylococcus epidermidis
TAMGKEETLSTA

SEQ ID NO: 1768655 - protein, 9 aa, Staphylococcus epidermidis
TAPGHGEDD

SEQ ID NO: 1768656 - protein, 4 aa, Staphylococcus epidermidis
TDDA

SEQ ID NO: 1768657 - protein, 7 aa, Staphylococcus epidermidis
TDEGACR

SEQ ID NO: 1768658 - protein, 5 aa, Staphylococcus epidermidis
TDQKK

SEQ ID NO: 1768659 - protein, 6 aa, Staphylococcus epidermidis
TDYSDE

SEQ ID NO: 1768660 - protein, 4 aa, Staphylococcus epidermidis
TEDS

SEQ ID NO: 1768661 - protein, 10 aa, Staphylococcus epidermidis
TEDYNDNKRN

SEQ ID NO: 1768662 - protein, 8 aa, Staphylococcus epidermidis
TEGQPAVE

SEQ ID NO: 1768663 - protein, 14 aa, Staphylococcus epidermidis
TEPRMGSMGKGIPG

SEQ ID NO: 1768664 - protein, 9 aa, Staphylococcus epidermidis
TEQQKTDLS

SEQ ID NO: 1768665 - protein, 6 aa, Staphylococcus epidermidis
TGGNAG

SEQ ID NO: 1768666 - protein, 6 aa, Staphylococcus epidermidis
TGIGGE

SEQ ID NO: 1768667 - protein, 20 aa, Staphylococcus epidermidis
TGKLSLKDKKAIANEGVCVL

SEQ ID NO: 1768668 - protein, 7 aa, Staphylococcus epidermidis
TGLGGGI

SEQ ID NO: 1768669 - protein, 10 aa, Staphylococcus epidermidis
TGNESYKSGI

SEQ ID NO: 1768670 - protein, 10 aa, Staphylococcus epidermidis
TGSGTQSNMN

SEQ ID NO: 1768671 - protein, 5 aa, Staphylococcus epidermidis
TGSQR

SEQ ID NO: 1768672 - protein, 5 aa, Staphylococcus epidermidis
TGVPR

SEQ ID NO: 1768673 - protein, 5 aa, Staphylococcus epidermidis
THAAL

SEQ ID NO: 1768674 - protein, 10 aa, Staphylococcus epidermidis
THGTAPKYAG

SEQ ID NO: 1768675 - protein, 5 aa, Staphylococcus epidermidis
THPDK

SEQ ID NO: 1768676 - protein, 4 aa, Staphylococcus epidermidis
THPG

SEQ ID NO: 1768677 - protein, 5 aa, Staphylococcus epidermidis
TIINT

SEQ ID NO: 1768678 - protein, 4 aa, Staphylococcus epidermidis
TKED

SEQ ID NO: 1768679 - protein, 7 aa, Staphylococcus epidermidis
TKELKGY

SEQ ID NO: 1768680 - protein, 6 aa, Staphylococcus epidermidis
TKKTNA

SEQ ID NO: 1768681 - protein, 8 aa, Staphylococcus epidermidis
TKNKTSTV

SEQ ID NO: 1768682 - protein, 8 aa, Staphylococcus epidermidis
TKRQAGTE

SEQ ID NO: 1768683 - protein, 12 aa, Staphylococcus epidermidis
TKSDFTKNNSKK

SEQ ID NO: 1768684 - protein, 9 aa, Staphylococcus epidermidis
TKSKVRRER

SEQ ID NO: 1768685 - protein, 15 aa, Staphylococcus epidermidis
TLDEYRKNIEKDAAL

SEQ ID NO: 1768686 - protein, 5 aa, Staphylococcus epidermidis
TLDIQ

SEQ ID NO: 1768687 - protein, 6 aa, Staphylococcus epidermidis
TLLGAP

SEQ ID NO: 1768688 - protein, 8 aa, Staphylococcus epidermidis
TLQQPTAH

SEQ ID NO: 1768689 - protein, 10 aa, Staphylococcus epidermidis
TLRENEKQLQ

SEQ ID NO: 1768690 - protein, 8 aa, Staphylococcus epidermidis
TLSTKTTN

SEQ ID NO: 1768691 - protein, 6 aa, Staphylococcus epidermidis
TLTNRY

SEQ ID NO: 1768692 - protein, 13 aa, Staphylococcus epidermidis
TLYSEKDRDIEGL

SEQ ID NO: 1768693 - protein, 5 aa, Staphylococcus epidermidis
TMESI

SEQ ID NO: 1768694 - protein, 13 aa, Staphylococcus epidermidis
TMKQQSLAAQKQA

SEQ ID NO: 1768695 - protein, 7 aa, Staphylococcus epidermidis
TNDENVK

SEQ ID NO: 1768696 - protein, 5 aa, Staphylococcus epidermidis
TNDLS

SEQ ID NO: 1768697 - protein, 6 aa, Staphylococcus epidermidis
TNEETE

SEQ ID NO: 1768698 - protein, 5 aa, Staphylococcus epidermidis
TNEPK

SEQ ID NO: 1768699 - protein, 41 aa, Staphylococcus epidermidis
TNGASQQHSQQSSQDIQQENIKSLDEKQESISNDQQEIKSP

SEQ ID NO: 1768700 - protein, 6 aa, Staphylococcus epidermidis
TNLNQN

SEQ ID NO: 1768701 - protein, 16 aa, Staphylococcus epidermidis
TNQLPNQISGGQKQRV

SEQ ID NO: 1768702 - protein, 8 aa, Staphylococcus epidermidis
TNYNANYN

SEQ ID NO: 1768703 - protein, 5 aa, Staphylococcus epidermidis
TPKSI

SEQ ID NO: 1768704 - protein, 10 aa, Staphylococcus epidermidis
TPLKSKDTFI

SEQ ID NO: 1768705 - protein, 11 aa, Staphylococcus epidermidis
TPLPEKESYDD

SEQ ID NO: 1768706 - protein, 5 aa, Staphylococcus epidermidis
TPNAY

SEQ ID NO: 1768707 - protein, 4 aa, Staphylococcus epidermidis
TPQS

SEQ ID NO: 1768708 - protein, 15 aa, Staphylococcus epidermidis
TPVPHNGCRPPKRRR

SEQ ID NO: 1768709 - protein, 17 aa, Staphylococcus epidermidis
TQELPVKTKSLNKKTIE

SEQ ID NO: 1768710 - protein, 18 aa, Staphylococcus epidermidis
TQLNKKNGTHNKPLQIWE

SEQ ID NO: 1768711 - protein, 8 aa, Staphylococcus epidermidis
TQLPSKGN

SEQ ID NO: 1768712 - protein, 4 aa, Staphylococcus epidermidis
TQPF

SEQ ID NO: 1768713 - protein, 9 aa, Staphylococcus epidermidis
TQSQGDVRS

SEQ ID NO: 1768714 - protein, 5 aa, Staphylococcus epidermidis
TQSTV

SEQ ID NO: 1768715 - protein, 9 aa, Staphylococcus epidermidis
TRGKNQHGI

SEQ ID NO: 1768716 - protein, 5 aa, Staphylococcus epidermidis
TRQKY

SEQ ID NO: 1768717 - protein, 4 aa, Staphylococcus epidermidis
TRVT

SEQ ID NO: 1768718 - protein, 9 aa, Staphylococcus epidermidis
TSGDINNGE

SEQ ID NO: 1768719 - protein, 24 aa, Staphylococcus epidermidis
TSGELTDRQFKTRTVKETLEGAGL

SEQ ID NO: 1768720 - protein, 5 aa, Staphylococcus epidermidis
TSHAK

SEQ ID NO: 1768721 - protein, 8 aa, Staphylococcus epidermidis
TSLPSDYS

SEQ ID NO: 1768722 - protein, 6 aa, Staphylococcus epidermidis
TSQWPN

SEQ ID NO: 1768723 - protein, 6 aa, Staphylococcus epidermidis
TSRAIN

SEQ ID NO: 1768724 - protein, 9 aa, Staphylococcus epidermidis
TSSVHDETQ

SEQ ID NO: 1768725 - protein, 11 aa, Staphylococcus epidermidis
TTDRSEEGLND

SEQ ID NO: 1768726 - protein, 4 aa, Staphylococcus epidermidis
TTDT

SEQ ID NO: 1768727 - protein, 15 aa, Staphylococcus epidermidis
TTENNKKNTIPDSEK

SEQ ID NO: 1768728 - protein, 20 aa, Staphylococcus epidermidis
TTEPIDGRSTTYSSDVAKGY

SEQ ID NO: 1768729 - protein, 4 aa, Staphylococcus epidermidis
TTKS

SEQ ID NO: 1768730 - protein, 4 aa, Staphylococcus epidermidis
TTKV

SEQ ID NO: 1768731 - protein, 13 aa, Staphylococcus epidermidis
TTRENGLSPYPNH

SEQ ID NO: 1768732 - protein, 11 aa, Staphylococcus epidermidis
TTREPGGVLTS

SEQ ID NO: 1768733 - protein, 23 aa, Staphylococcus epidermidis
TTRQRDGLNSKNKIQKGGLSGRP

SEQ ID NO: 1768734 - protein, 6 aa, Staphylococcus epidermidis
TTVENG

SEQ ID NO: 1768735 - protein, 12 aa, Staphylococcus epidermidis
TVAKPIDEFTSG

SEQ ID NO: 1768736 - protein, 10 aa, Staphylococcus epidermidis
TVEGPDDYKS

SEQ ID NO: 1768737 - protein, 6 aa, Staphylococcus epidermidis
TVNKNK

SEQ ID NO: 1768738 - protein, 6 aa, Staphylococcus epidermidis
TYDNET

SEQ ID NO: 1768739 - protein, 4 aa, Staphylococcus epidermidis
TYED

SEQ ID NO: 1768740 - protein, 6 aa, Staphylococcus epidermidis
TYNENE

SEQ ID NO: 1768741 - protein, 6 aa, Staphylococcus epidermidis
TYRREK

SEQ ID NO: 1768742 - protein, 6 aa, Staphylococcus epidermidis
TYSETM

SEQ ID NO: 1768743 - protein, 20 aa, Staphylococcus epidermidis
TYTPDGDNNKKHYFSKDGEE

SEQ ID NO: 1768744 - protein, 7 aa, Staphylococcus epidermidis
VARPGTK

SEQ ID NO: 1768745 - protein, 10 aa, Staphylococcus epidermidis
VDAAKGFGID

SEQ ID NO: 1768746 - protein, 14 aa, Staphylococcus epidermidis
VDSRTILDSGGAER

SEQ ID NO: 1768747 - protein, 7 aa, Staphylococcus epidermidis
VDTRSIT

SEQ ID NO: 1768748 - protein, 4 aa, Staphylococcus epidermidis
VEDE

SEQ ID NO: 1768749 - protein, 15 aa, Staphylococcus epidermidis
VEGTQKAIASTIDGE

SEQ ID NO: 1768750 - protein, 22 aa, Staphylococcus epidermidis
VEKGTTGDGVESVTGYTGHDAA

SEQ ID NO: 1768751 - protein, 7 aa, Staphylococcus epidermidis
VEKPQSY

SEQ ID NO: 1768752 - protein, 15 aa, Staphylococcus epidermidis
VEPGKIYNNGKPENI

SEQ ID NO: 1768753 - protein, 17 aa, Staphylococcus epidermidis
VEQIDTPDSFRTRPKSD

SEQ ID NO: 1768754 - protein, 10 aa, Staphylococcus epidermidis
VEQYSTAGSF

SEQ ID NO: 1768755 - protein, 9 aa, Staphylococcus epidermidis
VESGTPQNI

SEQ ID NO: 1768756 - protein, 9 aa, Staphylococcus epidermidis
VESKNDLVP

SEQ ID NO: 1768757 - protein, 11 aa, Staphylococcus epidermidis
VETDDDISKEW

SEQ ID NO: 1768758 - protein, 4 aa, Staphylococcus epidermidis
VGAT

SEQ ID NO: 1768759 - protein, 9 aa, Staphylococcus epidermidis
VGEHVEKGE

SEQ ID NO: 1768760 - protein, 9 aa, Staphylococcus epidermidis
VGHQTPQAI

SEQ ID NO: 1768761 - protein, 10 aa, Staphylococcus epidermidis
VGIEKTTANA

SEQ ID NO: 1768762 - protein, 5 aa, Staphylococcus epidermidis
VGRGL

SEQ ID NO: 1768763 - protein, 21 aa, Staphylococcus epidermidis
VGRGTESDEKIQSRVNEARKE

SEQ ID NO: 1768764 - protein, 4 aa, Staphylococcus epidermidis
VGSG

SEQ ID NO: 1768765 - protein, 8 aa, Staphylococcus epidermidis
VGSGGTFT

SEQ ID NO: 1768766 - protein, 8 aa, Staphylococcus epidermidis
VGSKGSVY

SEQ ID NO: 1768767 - protein, 7 aa, Staphylococcus epidermidis
VGSKKVR

SEQ ID NO: 1768768 - protein, 4 aa, Staphylococcus epidermidis
VHDT

SEQ ID NO: 1768769 - protein, 8 aa, Staphylococcus epidermidis
VKTDGKTK

SEQ ID NO: 1768770 - protein, 7 aa, Staphylococcus epidermidis
VKTGERI

SEQ ID NO: 1768771 - protein, 9 aa, Staphylococcus epidermidis
VNDDTPQDD

SEQ ID NO: 1768772 - protein, 7 aa, Staphylococcus epidermidis
VNGEHEH

SEQ ID NO: 1768773 - protein, 7 aa, Staphylococcus epidermidis
VNGISGH

SEQ ID NO: 1768774 - protein, 10 aa, Staphylococcus epidermidis
VNQDTDNIGA

SEQ ID NO: 1768775 - protein, 11 aa, Staphylococcus epidermidis
VNTEDAKLTKA

SEQ ID NO: 1768776 - protein, 21 aa, Staphylococcus epidermidis
VPQPQGKTATSPKEALENARE

SEQ ID NO: 1768777 - protein, 8 aa, Staphylococcus epidermidis
VPSGLAKQ

SEQ ID NO: 1768778 - protein, 5 aa, Staphylococcus epidermidis
VQGEN

SEQ ID NO: 1768779 - protein, 14 aa, Staphylococcus epidermidis
VRKEDQVKELENKG

SEQ ID NO: 1768780 - protein, 20 aa, Staphylococcus epidermidis
VRLTEGKYDTKEKMEKSVED

SEQ ID NO: 1768781 - protein, 6 aa, Staphylococcus epidermidis
VRNPGY

SEQ ID NO: 1768782 - protein, 14 aa, Staphylococcus epidermidis
VSDERSAYMTRSHN

SEQ ID NO: 1768783 - protein, 12 aa, Staphylococcus epidermidis
VSGERGAADLER

SEQ ID NO: 1768784 - protein, 4 aa, Staphylococcus epidermidis
VSGI

SEQ ID NO: 1768785 - protein, 6 aa, Staphylococcus epidermidis
VSHGDL

SEQ ID NO: 1768786 - protein, 14 aa, Staphylococcus epidermidis
VSKRQTNLMFPGPP

SEQ ID NO: 1768787 - protein, 10 aa, Staphylococcus epidermidis
VSKSGKNVEQ

SEQ ID NO: 1768788 - protein, 11 aa, Staphylococcus epidermidis
VSNAGQKGAVT

SEQ ID NO: 1768789 - protein, 7 aa, Staphylococcus epidermidis
VSTPDHR

SEQ ID NO: 1768790 - protein, 11 aa, Staphylococcus epidermidis
VTESEADKLEI

SEQ ID NO: 1768791 - protein, 11 aa, Staphylococcus epidermidis
VTLRETGRLGD

SEQ ID NO: 1768792 - protein, 5 aa, Staphylococcus epidermidis
VTNVN

SEQ ID NO: 1768793 - protein, 9 aa, Staphylococcus epidermidis
VTPPQNNGI

SEQ ID NO: 1768794 - protein, 7 aa, Staphylococcus epidermidis
VTPSSKV

SEQ ID NO: 1768795 - protein, 18 aa, Staphylococcus epidermidis
VTTKPIEVGGGIRSKQTI

SEQ ID NO: 1768796 - protein, 6 aa, Staphylococcus epidermidis
VTTTTY

SEQ ID NO: 1768797 - protein, 6 aa, Staphylococcus epidermidis
VVPGSE

SEQ ID NO: 1768798 - protein, 13 aa, Staphylococcus epidermidis
VYWSPSSESSLAE

SEQ ID NO: 1768799 - protein, 6 aa, Staphylococcus epidermidis
WDEKKA

SEQ ID NO: 1768800 - protein, 6 aa, Staphylococcus epidermidis
WEASGH

SEQ ID NO: 1768801 - protein, 8 aa, Staphylococcus epidermidis
WRGNSDNK

SEQ ID NO: 1768802 - protein, 5 aa, Staphylococcus epidermidis
YADSN

SEQ ID NO: 1768803 - protein, 15 aa, Staphylococcus epidermidis
YARTIKGTKPTFKED

SEQ ID NO: 1768804 - protein, 11 aa, Staphylococcus epidermidis
YASNLDSNNEL

SEQ ID NO: 1768805 - protein, 14 aa, Staphylococcus epidermidis
YDDEGNLINKNKTS

SEQ ID NO: 1768806 - protein, 11 aa, Staphylococcus epidermidis
YDDGKHFTDIG

SEQ ID NO: 1768807 - protein, 11 aa, Staphylococcus epidermidis
YEAKGEEQTIE

SEQ ID NO: 1768808 - protein, 4 aa, Staphylococcus epidermidis
YEGY

SEQ ID NO: 1768809 - protein, 9 aa, Staphylococcus epidermidis
YENESIVTD

SEQ ID NO: 1768810 - protein, 36 aa, Staphylococcus epidermidis
YEQAQQAQQQGQEEQGSQDSTVEDADFKEVKDDEDK

SEQ ID NO: 1768811 - protein, 9 aa, Staphylococcus epidermidis
YERSNEHQT

SEQ ID NO: 1768812 - protein, 19 aa, Staphylococcus epidermidis
YESQANTAKAQEILMNIRK

SEQ ID NO: 1768813 - protein, 6 aa, Staphylococcus epidermidis
YETSIN

SEQ ID NO: 1768814 - protein, 11 aa, Staphylococcus epidermidis
YFNQDESIKPQ

SEQ ID NO: 1768815 - protein, 7 aa, Staphylococcus epidermidis
YGDKQAF

SEQ ID NO: 1768816 - protein, 15 aa, Staphylococcus epidermidis
YGPGELIQDGKNGYL

SEQ ID NO: 1768817 - protein, 11 aa, Staphylococcus epidermidis
YGQQDTHDKED

SEQ ID NO: 1768818 - protein, 7 aa, Staphylococcus epidermidis
YGTETIK

SEQ ID NO: 1768819 - protein, 6 aa, Staphylococcus epidermidis
YGTSVK

SEQ ID NO: 1768820 - protein, 7 aa, Staphylococcus epidermidis
YHDKRSA

SEQ ID NO: 1768821 - protein, 15 aa, Staphylococcus epidermidis
YIGEQNRKYVPIEER

SEQ ID NO: 1768822 - protein, 4 aa, Staphylococcus epidermidis
YIQE

SEQ ID NO: 1768823 - protein, 8 aa, Staphylococcus epidermidis
YKEISSCS

SEQ ID NO: 1768824 - protein, 11 aa, Staphylococcus epidermidis
YKGKRQQNDYD

SEQ ID NO: 1768825 - protein, 5 aa, Staphylococcus epidermidis
YKHDG

SEQ ID NO: 1768826 - protein, 4 aa, Staphylococcus epidermidis
YKQE

SEQ ID NO: 1768827 - protein, 9 aa, Staphylococcus epidermidis
YLNPQDYPV

SEQ ID NO: 1768828 - protein, 9 aa, Staphylococcus epidermidis
YNHQPTQQD

SEQ ID NO: 1768829 - protein, 6 aa, Staphylococcus epidermidis
YNQMQK

SEQ ID NO: 1768830 - protein, 5 aa, Staphylococcus epidermidis
YNQSR

SEQ ID NO: 1768831 - protein, 9 aa, Staphylococcus epidermidis
YNTNEVENR

SEQ ID NO: 1768832 - protein, 6 aa, Staphylococcus epidermidis
YPDEMG

SEQ ID NO: 1768833 - protein, 17 aa, Staphylococcus epidermidis
YPGNNPTHLKQASTGGA

SEQ ID NO: 1768834 - protein, 4 aa, Staphylococcus epidermidis
YPTH

SEQ ID NO: 1768835 - protein, 7 aa, Staphylococcus epidermidis
YQQTEDK

SEQ ID NO: 1768836 - protein, 16 aa, Staphylococcus epidermidis
YRIPSDSQSDHSNNEN

SEQ ID NO: 1768837 - protein, 4 aa, Staphylococcus epidermidis
YRVT

SEQ ID NO: 1768838 - protein, 9 aa, Staphylococcus epidermidis
YSDQDETRF

SEQ ID NO: 1768839 - protein, 12 aa, Staphylococcus epidermidis
YSKDVSHTARKH

SEQ ID NO: 1768840 - protein, 6 aa, Staphylococcus epidermidis
YSKLNK

SEQ ID NO: 1768841 - protein, 4 aa, Staphylococcus epidermidis
YSNQ

SEQ ID NO: 1768842 - protein, 7 aa, Staphylococcus epidermidis
YSRETME

SEQ ID NO: 1768843 - protein, 15 aa, Staphylococcus epidermidis
YSTNELSDTGLRAAG

SEQ ID NO: 1768844 - protein, 7 aa, Staphylococcus epidermidis
YTNEQKI

SEQ ID NO: 1768845 - protein, 6 aa, Staphylococcus epidermidis
YTNHKK

SEQ ID NO: 1768846 - protein, 12 aa, Staphylococcus epidermidis
YVPNDNKNLAYK

SEQ ID NO: 1768847 - protein, 4 aa, Staphylococcus epidermidis
YVTD

SEQ ID NO: 1768848 - protein, 10 aa, Staphylococcus epidermidis
YYNKKYNSSI

SEQ ID NO: 1768849 - protein, 7 aa, Staphylococcus epidermidis
YYSTPSL

SEQ ID NO: 1768850 - protein, 11 aa, Staphylococcus epidermidis
AADKITDSIEA

SEQ ID NO: 1768851 - protein, 9 aa, Staphylococcus epidermidis
AAQLSASEM

SEQ ID NO: 1768852 - protein, 7 aa, Staphylococcus epidermidis
AARVSDK

SEQ ID NO: 1768853 - protein, 10 aa, Staphylococcus epidermidis
AASGNRNWGQ

SEQ ID NO: 1768854 - protein, 6 aa, Staphylococcus epidermidis
AASYGA

SEQ ID NO: 1768855 - protein, 17 aa, Staphylococcus epidermidis
AATMAEGAQKIVKLVKE

SEQ ID NO: 1768856 - protein, 16 aa, Staphylococcus epidermidis
ADFENATDNQGGGPIG

SEQ ID NO: 1768857 - protein, 6 aa, Staphylococcus epidermidis
ADQLAR

SEQ ID NO: 1768858 - protein, 10 aa, Staphylococcus epidermidis
ADSGAIGGSH

SEQ ID NO: 1768859 - protein, 4 aa, Staphylococcus epidermidis
ADTD

SEQ ID NO: 1768860 - protein, 6 aa, Staphylococcus epidermidis
AEASKD

SEQ ID NO: 1768861 - protein, 6 aa, Staphylococcus epidermidis
AEASKN

SEQ ID NO: 1768862 - protein, 16 aa, Staphylococcus epidermidis
AEITNDEKGKISHRGN

SEQ ID NO: 1768863 - protein, 11 aa, Staphylococcus epidermidis
AENVQDGSKDI

SEQ ID NO: 1768864 - protein, 8 aa, Staphylococcus epidermidis
AEPMENAS

SEQ ID NO: 1768865 - protein, 18 aa, Staphylococcus epidermidis
AEPMENASTIKLSNKDYS

SEQ ID NO: 1768866 - protein, 15 aa, Staphylococcus epidermidis
AETIPDTEFRYHRGL

SEQ ID NO: 1768867 - protein, 4 aa, Staphylococcus epidermidis
AGAL

SEQ ID NO: 1768868 - protein, 6 aa, Staphylococcus epidermidis
AGFTTG

SEQ ID NO: 1768869 - protein, 8 aa, Staphylococcus epidermidis
AGGDKKVN

SEQ ID NO: 1768870 - protein, 5 aa, Staphylococcus epidermidis
AGGRE

SEQ ID NO: 1768871 - protein, 4 aa, Staphylococcus epidermidis
AGGV

SEQ ID NO: 1768872 - protein, 8 aa, Staphylococcus epidermidis
AGKDTDGQ

SEQ ID NO: 1768873 - protein, 12 aa, Staphylococcus epidermidis
AGNPVVTASTDS

SEQ ID NO: 1768874 - protein, 13 aa, Staphylococcus epidermidis
AGNPVVTASTDSV

SEQ ID NO: 1768875 - protein, 5 aa, Staphylococcus epidermidis
AGNVN

SEQ ID NO: 1768876 - protein, 4 aa, Staphylococcus epidermidis
AGTF

SEQ ID NO: 1768877 - protein, 5 aa, Staphylococcus epidermidis
AGTFN

SEQ ID NO: 1768878 - protein, 10 aa, Staphylococcus epidermidis
AGTTVSRASL

SEQ ID NO: 1768879 - protein, 11 aa, Staphylococcus epidermidis
AGTTVSRASLH

SEQ ID NO: 1768880 - protein, 26 aa, Staphylococcus epidermidis
AGVEKGSGEPNKTKVATVTKDQVREI

SEQ ID NO: 1768881 - protein, 27 aa, Staphylococcus epidermidis
AGVEKGSGEPNKTKVATVTKDQVREIA

SEQ ID NO: 1768882 - protein, 5 aa, Staphylococcus epidermidis
AGVGD

SEQ ID NO: 1768883 - protein, 6 aa, Staphylococcus epidermidis
AGWDTH

SEQ ID NO: 1768884 - protein, 8 aa, Staphylococcus epidermidis
AGYNFGSK

SEQ ID NO: 1768885 - protein, 6 aa, Staphylococcus epidermidis
AHGEDD

SEQ ID NO: 1768886 - protein, 8 aa, Staphylococcus epidermidis
AHRDQGDI

SEQ ID NO: 1768887 - protein, 8 aa, Staphylococcus epidermidis
AHTASDLS

SEQ ID NO: 1768888 - protein, 6 aa, Staphylococcus epidermidis
AINGRQ

SEQ ID NO: 1768889 - protein, 7 aa, Staphylococcus epidermidis
AISDDGS

SEQ ID NO: 1768890 - protein, 7 aa, Staphylococcus epidermidis
AISDEGS

SEQ ID NO: 1768891 - protein, 6 aa, Staphylococcus epidermidis
AITGDG

SEQ ID NO: 1768892 - protein, 9 aa, Staphylococcus epidermidis
AKEALGDKE

SEQ ID NO: 1768893 - protein, 10 aa, Staphylococcus epidermidis
AKENLEEARE

SEQ ID NO: 1768894 - protein, 4 aa, Staphylococcus epidermidis
AKEV

SEQ ID NO: 1768895 - protein, 16 aa, Staphylococcus epidermidis
AKGNEEDVNKAVDAAD

SEQ ID NO: 1768896 - protein, 6 aa, Staphylococcus epidermidis
AKGRNF

SEQ ID NO: 1768897 - protein, 7 aa, Staphylococcus epidermidis
AKIAGEE

SEQ ID NO: 1768898 - protein, 8 aa, Staphylococcus epidermidis
AKKAHAND

SEQ ID NO: 1768899 - protein, 10 aa, Staphylococcus epidermidis
AKKRGGYHTG

SEQ ID NO: 1768900 - protein, 9 aa, Staphylococcus epidermidis
AKLRGERSE

SEQ ID NO: 1768901 - protein, 16 aa, Staphylococcus epidermidis
AKNETFKGTEVSRKSV

SEQ ID NO: 1768902 - protein, 9 aa, Staphylococcus epidermidis
AKNNNRQDM

SEQ ID NO: 1768903 - protein, 16 aa, Staphylococcus epidermidis
AKPQNIEYFNQKHWLQ

SEQ ID NO: 1768904 - protein, 9 aa, Staphylococcus epidermidis
AKQTGVSEY

SEQ ID NO: 1768905 - protein, 11 aa, Staphylococcus epidermidis
AKYIGTEKPML

SEQ ID NO: 1768906 - protein, 30 aa, Staphylococcus epidermidis
ALRQDSPVSTQSNKMTKDEESDYLVSGRKC

SEQ ID NO: 1768907 - protein, 8 aa, Staphylococcus epidermidis
ALSSAHGR

SEQ ID NO: 1768908 - protein, 11 aa, Staphylococcus epidermidis
AMGKEETLSTA

SEQ ID NO: 1768909 - protein, 5 aa, Staphylococcus epidermidis
ANDEV

SEQ ID NO: 1768910 - protein, 4 aa, Staphylococcus epidermidis
ANHH

SEQ ID NO: 1768911 - protein, 9 aa, Staphylococcus epidermidis
ANHNGASLT

SEQ ID NO: 1768912 - protein, 8 aa, Staphylococcus epidermidis
ANKEKMDN

SEQ ID NO: 1768913 - protein, 10 aa, Staphylococcus epidermidis
ANLNKTVSAA

SEQ ID NO: 1768914 - protein, 7 aa, Staphylococcus epidermidis
ANLSPGT

SEQ ID NO: 1768915 - protein, 6 aa, Staphylococcus epidermidis
ANYITQ

SEQ ID NO: 1768916 - protein, 7 aa, Staphylococcus epidermidis
APDAEEM

SEQ ID NO: 1768917 - protein, 7 aa, Staphylococcus epidermidis
APGFEDE

SEQ ID NO: 1768918 - protein, 7 aa, Staphylococcus epidermidis
APGFGDR

SEQ ID NO: 1768919 - protein, 8 aa, Staphylococcus epidermidis
APGHGEDD

SEQ ID NO: 1768920 - protein, 10 aa, Staphylococcus epidermidis
APPKAGKTSL

SEQ ID NO: 1768921 - protein, 5 aa, Staphylococcus epidermidis
APRVQ

SEQ ID NO: 1768922 - protein, 16 aa, Staphylococcus epidermidis
AQFTQESTNFIHQYAP

SEQ ID NO: 1768923 - protein, 9 aa, Staphylococcus epidermidis
AQRQAGVGA

SEQ ID NO: 1768924 - protein, 4 aa, Staphylococcus epidermidis
ARDT

SEQ ID NO: 1768925 - protein, 8 aa, Staphylococcus epidermidis
AREEGPFL

SEQ ID NO: 1768926 - protein, 8 aa, Staphylococcus epidermidis
ARKAGIES

SEQ ID NO: 1768927 - protein, 4 aa, Staphylococcus epidermidis
ARTS

SEQ ID NO: 1768928 - protein, 38 aa, Staphylococcus epidermidis
ARVAAKKAREVTRRKSALDVSSLPGKLADCSSKNPEES

SEQ ID NO: 1768929 - protein, 39 aa, Staphylococcus epidermidis
ARVAAKKAREVTRRKSALDVSSLPGKLADCSSKNPEESE

SEQ ID NO: 1768930 - protein, 13 aa, Staphylococcus epidermidis
ASGGGVTVSGGEP

SEQ ID NO: 1768931 - protein, 9 aa, Staphylococcus epidermidis
ASKEELETL

SEQ ID NO: 1768932 - protein, 6 aa, Staphylococcus epidermidis
ASNVTS

SEQ ID NO: 1768933 - protein, 4 aa, Staphylococcus epidermidis
ASPD

SEQ ID NO: 1768934 - protein, 5 aa, Staphylococcus epidermidis
ASPDE

SEQ ID NO: 1768935 - protein, 8 aa, Staphylococcus epidermidis
ASPKHTEG

SEQ ID NO: 1768936 - protein, 4 aa, Staphylococcus epidermidis
ASQY

SEQ ID NO: 1768937 - protein, 13 aa, Staphylococcus epidermidis
ATFKGSDSNGPTI

SEQ ID NO: 1768938 - protein, 5 aa, Staphylococcus epidermidis
ATGGR

SEQ ID NO: 1768939 - protein, 7 aa, Staphylococcus epidermidis
ATLAGEV

SEQ ID NO: 1768940 - protein, 8 aa, Staphylococcus epidermidis
ATLNEERQ

SEQ ID NO: 1768941 - protein, 5 aa, Staphylococcus epidermidis
ATNDF

SEQ ID NO: 1768942 - protein, 6 aa, Staphylococcus epidermidis
ATNEEE

SEQ ID NO: 1768943 - protein, 21 aa, Staphylococcus epidermidis
ATTTAVKSYETKDAINNGAQE

SEQ ID NO: 1768944 - protein, 11 aa, Staphylococcus epidermidis
AVARESHQGDH

SEQ ID NO: 1768945 - protein, 16 aa, Staphylococcus epidermidis
AVDKGTSFGASTLQEN

SEQ ID NO: 1768946 - protein, 6 aa, Staphylococcus epidermidis
AVEAAK

SEQ ID NO: 1768947 - protein, 5 aa, Staphylococcus epidermidis
AVEDF

SEQ ID NO: 1768948 - protein, 13 aa, Staphylococcus epidermidis
CIATGESSEVLGN

SEQ ID NO: 1768949 - protein, 14 aa, Staphylococcus epidermidis
CIATGESSKVLGNP

SEQ ID NO: 1768950 - protein, 7 aa, Staphylococcus epidermidis
DAAESGI

SEQ ID NO: 1768951 - protein, 11 aa, Staphylococcus epidermidis
DAAGKGGNIKR

SEQ ID NO: 1768952 - protein, 9 aa, Staphylococcus epidermidis
DAAKGFGID

SEQ ID NO: 1768953 - protein, 7 aa, Staphylococcus epidermidis
DADTVTV

SEQ ID NO: 1768954 - protein, 25 aa, Staphylococcus epidermidis
DAEDGNLINTSDEDKTTDEEEKAHS

SEQ ID NO: 1768955 - protein, 6 aa, Staphylococcus epidermidis
DAHEVE

SEQ ID NO: 1768956 - protein, 13 aa, Staphylococcus epidermidis
DAPIGRNKNDRQA

SEQ ID NO: 1768957 - protein, 5 aa, Staphylococcus epidermidis
DAQRY

SEQ ID NO: 1768958 - protein, 7 aa, Staphylococcus epidermidis
DATPYDH

SEQ ID NO: 1768959 - protein, 7 aa, Staphylococcus epidermidis
DAVQNSK

SEQ ID NO: 1768960 - protein, 11 aa, Staphylococcus epidermidis
DAYPSSQGQKG

SEQ ID NO: 1768961 - protein, 4 aa, Staphylococcus epidermidis
DDDF

SEQ ID NO: 1768962 - protein, 5 aa, Staphylococcus epidermidis
DDDFS

SEQ ID NO: 1768963 - protein, 6 aa, Staphylococcus epidermidis
DDDFSD

SEQ ID NO: 1768964 - protein, 4 aa, Staphylococcus epidermidis
DDEN

SEQ ID NO: 1768965 - protein, 12 aa, Staphylococcus epidermidis
DDETFSSAGTIA

SEQ ID NO: 1768966 - protein, 15 aa, Staphylococcus epidermidis
DDKAAAFQSHAENEL

SEQ ID NO: 1768967 - protein, 18 aa, Staphylococcus epidermidis
DDNTISVKNDRPRIDTAR

SEQ ID NO: 1768968 - protein, 6 aa, Staphylococcus epidermidis
DDQSMR

SEQ ID NO: 1768969 - protein, 12 aa, Staphylococcus epidermidis
DDQVGNGESIFD

SEQ ID NO: 1768970 - protein, 8 aa, Staphylococcus epidermidis
DDTKRKAF

SEQ ID NO: 1768971 - protein, 6 aa, Staphylococcus epidermidis
DDTPLG

SEQ ID NO: 1768972 - protein, 8 aa, Staphylococcus epidermidis
DEDNEVDD

SEQ ID NO: 1768973 - protein, 5 aa, Staphylococcus epidermidis
DEEIS

SEQ ID NO: 1768974 - protein, 6 aa, Staphylococcus epidermidis
DEEISV

SEQ ID NO: 1768975 - protein, 4 aa, Staphylococcus epidermidis
DEET

SEQ ID NO: 1768976 - protein, 4 aa, Staphylococcus epidermidis
DEGG

SEQ ID NO: 1768977 - protein, 12 aa, Staphylococcus epidermidis
DEGQTEISSREI

SEQ ID NO: 1768978 - protein, 13 aa, Staphylococcus epidermidis
DEGQTEISSREIG

SEQ ID NO: 1768979 - protein, 11 aa, Staphylococcus epidermidis
DEGRLKEGDTI

SEQ ID NO: 1768980 - protein, 12 aa, Staphylococcus epidermidis
DEGRLKEGDTIV

SEQ ID NO: 1768981 - protein, 4 aa, Staphylococcus epidermidis
DESE

SEQ ID NO: 1768982 - protein, 5 aa, Staphylococcus epidermidis
DEVPE

SEQ ID NO: 1768983 - protein, 8 aa, Staphylococcus epidermidis
DFKSKNDN

SEQ ID NO: 1768984 - protein, 5 aa, Staphylococcus epidermidis
DFNKA

SEQ ID NO: 1768985 - protein, 9 aa, Staphylococcus epidermidis
DGAIEYDGK

SEQ ID NO: 1768986 - protein, 7 aa, Staphylococcus epidermidis
DGAYPDE

SEQ ID NO: 1768987 - protein, 8 aa, Staphylococcus epidermidis
DGAYPDEI

SEQ ID NO: 1768988 - protein, 8 aa, Staphylococcus epidermidis
DGEDTAKD

SEQ ID NO: 1768989 - protein, 7 aa, Staphylococcus epidermidis
DGEEETG

SEQ ID NO: 1768990 - protein, 6 aa, Staphylococcus epidermidis
DGFPDH

SEQ ID NO: 1768991 - protein, 5 aa, Staphylococcus epidermidis
DGGFD

SEQ ID NO: 1768992 - protein, 10 aa, Staphylococcus epidermidis
DGHLQKANDE

SEQ ID NO: 1768993 - protein, 7 aa, Staphylococcus epidermidis
DGLAAGK

SEQ ID NO: 1768994 - protein, 6 aa, Staphylococcus epidermidis
DGNYTY

SEQ ID NO: 1768995 - protein, 9 aa, Staphylococcus epidermidis
DGRTGEPFD

SEQ ID NO: 1768996 - protein, 7 aa, Staphylococcus epidermidis
DGTLDYD

SEQ ID NO: 1768997 - protein, 4 aa, Staphylococcus epidermidis
DGTR

SEQ ID NO: 1768998 - protein, 27 aa, Staphylococcus epidermidis
DGTTSAKVSDEKIESNTNNHLEQDKNV

SEQ ID NO: 1768999 - protein, 7 aa, Staphylococcus epidermidis
DGTVEGL

SEQ ID NO: 1769000 - protein, 5 aa, Staphylococcus epidermidis
DGVMP

SEQ ID NO: 1769001 - protein, 10 aa, Staphylococcus epidermidis
DHKESTEDIS

SEQ ID NO: 1769002 - protein, 5 aa, Staphylococcus epidermidis
DIDTE

SEQ ID NO: 1769003 - protein, 11 aa, Staphylococcus epidermidis
DIIREKEKKLT

SEQ ID NO: 1769004 - protein, 7 aa, Staphylococcus epidermidis
DINPKDY

SEQ ID NO: 1769005 - protein, 8 aa, Staphylococcus epidermidis
DIQPTEAQ

SEQ ID NO: 1769006 - protein, 4 aa, Staphylococcus epidermidis
DIYE

SEQ ID NO: 1769007 - protein, 8 aa, Staphylococcus epidermidis
DKAIEGIP

SEQ ID NO: 1769008 - protein, 4 aa, Staphylococcus epidermidis
DKDG

SEQ ID NO: 1769009 - protein, 12 aa, Staphylococcus epidermidis
DKDNKDVTRNDM

SEQ ID NO: 1769010 - protein, 5 aa, Staphylococcus epidermidis
DKEGV

SEQ ID NO: 1769011 - protein, 6 aa, Staphylococcus epidermidis
DKEGVL

SEQ ID NO: 1769012 - protein, 17 aa, Staphylococcus epidermidis
DKEGYRDEEFEKRDKGT

SEQ ID NO: 1769013 - protein, 9 aa, Staphylococcus epidermidis
DKEKAGSYG

SEQ ID NO: 1769014 - protein, 7 aa, Staphylococcus epidermidis
DKFHPES

SEQ ID NO: 1769015 - protein, 5 aa, Staphylococcus epidermidis
DKGLQ

SEQ ID NO: 1769016 - protein, 16 aa, Staphylococcus epidermidis
DKITEAEEAGADYVGE

SEQ ID NO: 1769017 - protein, 5 aa, Staphylococcus epidermidis
DKMDK

SEQ ID NO: 1769018 - protein, 6 aa, Staphylococcus epidermidis
DKMDKT

SEQ ID NO: 1769019 - protein, 23 aa, Staphylococcus epidermidis
DKMSAPIDEQPFAPITKDDEQAI

SEQ ID NO: 1769020 - protein, 6 aa, Staphylococcus epidermidis
DKPESL

SEQ ID NO: 1769021 - protein, 4 aa, Staphylococcus epidermidis
DKRP

SEQ ID NO: 1769022 - protein, 5 aa, Staphylococcus epidermidis
DKSGE

SEQ ID NO: 1769023 - protein, 14 aa, Staphylococcus epidermidis
DLPNEEKPAYGQKV

SEQ ID NO: 1769024 - protein, 7 aa, Staphylococcus epidermidis
DLQPKDR

SEQ ID NO: 1769025 - protein, 9 aa, Staphylococcus epidermidis
DNAAKEPEV

SEQ ID NO: 1769026 - protein, 7 aa, Staphylococcus epidermidis
DNDEIEV

SEQ ID NO: 1769027 - protein, 10 aa, Staphylococcus epidermidis
DNEEKYQYTG

SEQ ID NO: 1769028 - protein, 6 aa, Staphylococcus epidermidis
DNEIRT

SEQ ID NO: 1769029 - protein, 7 aa, Staphylococcus epidermidis
DNGNVKR

SEQ ID NO: 1769030 - protein, 8 aa, Staphylococcus epidermidis
DNGNVKRR

SEQ ID NO: 1769031 - protein, 16 aa, Staphylococcus epidermidis
DNKETLRYGENPQQSA

SEQ ID NO: 1769032 - protein, 5 aa, Staphylococcus epidermidis
DNKTV

SEQ ID NO: 1769033 - protein, 5 aa, Staphylococcus epidermidis
DNLDT

SEQ ID NO: 1769034 - protein, 4 aa, Staphylococcus epidermidis
DNLK

SEQ ID NO: 1769035 - protein, 5 aa, Staphylococcus epidermidis
DNNKH

SEQ ID NO: 1769036 - protein, 6 aa, Staphylococcus epidermidis
DNPNAI

SEQ ID NO: 1769037 - protein, 10 aa, Staphylococcus epidermidis
DNTGKSPNTI

SEQ ID NO: 1769038 - protein, 9 aa, Staphylococcus epidermidis
DPRQRQSRE

SEQ ID NO: 1769039 - protein, 8 aa, Staphylococcus epidermidis
DPTNTDKA

SEQ ID NO: 1769040 - protein, 6 aa, Staphylococcus epidermidis
DQIIPY

SEQ ID NO: 1769041 - protein, 11 aa, Staphylococcus epidermidis
DQLGQRPGAGA

SEQ ID NO: 1769042 - protein, 7 aa, Staphylococcus epidermidis
DQNKIEK

SEQ ID NO: 1769043 - protein, 26 aa, Staphylococcus epidermidis
DQSGGSTPKALKEYGVNEDQYSNEDE

SEQ ID NO: 1769044 - protein, 17 aa, Staphylococcus epidermidis
DQTALSSHEVAQGYKNV

SEQ ID NO: 1769045 - protein, 22 aa, Staphylococcus epidermidis
DRANEEKHAKVEYHSSKNKTDT

SEQ ID NO: 1769046 - protein, 7 aa, Staphylococcus epidermidis
DRHHDEI

SEQ ID NO: 1769047 - protein, 12 aa, Staphylococcus epidermidis
DRSMEENEVSKY

SEQ ID NO: 1769048 - protein, 6 aa, Staphylococcus epidermidis
DRSRNK

SEQ ID NO: 1769049 - protein, 7 aa, Staphylococcus epidermidis
DRSRNKL

SEQ ID NO: 1769050 - protein, 9 aa, Staphylococcus epidermidis
DSAPWNNKR

SEQ ID NO: 1769051 - protein, 5 aa, Staphylococcus epidermidis
DSDFR

SEQ ID NO: 1769052 - protein, 28 aa, Staphylococcus epidermidis
DSENGQNQTESANEFKEEQNQHSQSNVN

SEQ ID NO: 1769053 - protein, 4 aa, Staphylococcus epidermidis
DSGR

SEQ ID NO: 1769054 - protein, 8 aa, Staphylococcus epidermidis
DSKPRRNQ

SEQ ID NO: 1769055 - protein, 4 aa, Staphylococcus epidermidis
DSLK

SEQ ID NO: 1769056 - protein, 7 aa, Staphylococcus epidermidis
DSLTSHN

SEQ ID NO: 1769057 - protein, 6 aa, Staphylococcus epidermidis
DSTDFT

SEQ ID NO: 1769058 - protein, 7 aa, Staphylococcus epidermidis
DSTRTRC

SEQ ID NO: 1769059 - protein, 6 aa, Staphylococcus epidermidis
DSYLPP

SEQ ID NO: 1769060 - protein, 9 aa, Staphylococcus epidermidis
DTANDMKTA

SEQ ID NO: 1769061 - protein, 14 aa, Staphylococcus epidermidis
DTAQNIKSANQAHV

SEQ ID NO: 1769062 - protein, 11 aa, Staphylococcus epidermidis
DTFDNDGYFQT

SEQ ID NO: 1769063 - protein, 5 aa, Staphylococcus epidermidis
DTFRA

SEQ ID NO: 1769064 - protein, 18 aa, Staphylococcus epidermidis
DTISGGTVEVEGKEINKL

SEQ ID NO: 1769065 - protein, 10 aa, Staphylococcus epidermidis
DTNHRKYPKT

SEQ ID NO: 1769066 - protein, 5 aa, Staphylococcus epidermidis
DTRVT

SEQ ID NO: 1769067 - protein, 8 aa, Staphylococcus epidermidis
DTTEYDET

SEQ ID NO: 1769068 - protein, 8 aa, Staphylococcus epidermidis
DTTQSDFK

SEQ ID NO: 1769069 - protein, 8 aa, Staphylococcus epidermidis
DVAVGDTK

SEQ ID NO: 1769070 - protein, 56 aa, Staphylococcus epidermidis
DVEREKSKSFGEAKHVTAEDGKEKAKPQPIVKGDQVGRNDPCPCGSGKKYKNCHGK

SEQ ID NO: 1769071 - protein, 7 aa, Staphylococcus epidermidis
DVNPKGV

SEQ ID NO: 1769072 - protein, 5 aa, Staphylococcus epidermidis
DVSQQ

SEQ ID NO: 1769073 - protein, 10 aa, Staphylococcus epidermidis
DWTSPEKLNE

SEQ ID NO: 1769074 - protein, 7 aa, Staphylococcus epidermidis
DYEEDAE

SEQ ID NO: 1769075 - protein, 4 aa, Staphylococcus epidermidis
DYES

SEQ ID NO: 1769076 - protein, 5 aa, Staphylococcus epidermidis
DYEST

SEQ ID NO: 1769077 - protein, 5 aa, Staphylococcus epidermidis
DYKIT

SEQ ID NO: 1769078 - protein, 6 aa, Staphylococcus epidermidis
DYPQYK

SEQ ID NO: 1769079 - protein, 7 aa, Staphylococcus epidermidis
DYQKYGA

SEQ ID NO: 1769080 - protein, 4 aa, Staphylococcus epidermidis
EAEE

SEQ ID NO: 1769081 - protein, 11 aa, Staphylococcus epidermidis
EAGHGKKGAQH

SEQ ID NO: 1769082 - protein, 15 aa, Staphylococcus epidermidis
EAGTNGLPGGYTSTD

SEQ ID NO: 1769083 - protein, 8 aa, Staphylococcus epidermidis
EAINTVPS

SEQ ID NO: 1769084 - protein, 5 aa, Staphylococcus epidermidis
EANAS

SEQ ID NO: 1769085 - protein, 18 aa, Staphylococcus epidermidis
EANIQNAPGVKKANSELH

SEQ ID NO: 1769086 - protein, 5 aa, Staphylococcus epidermidis
EANNI

SEQ ID NO: 1769087 - protein, 8 aa, Staphylococcus epidermidis
EANPDELT

SEQ ID NO: 1769088 - protein, 15 aa, Staphylococcus epidermidis
EAPPNQNKINPYELT

SEQ ID NO: 1769089 - protein, 9 aa, Staphylococcus epidermidis
EASGAVSGL

SEQ ID NO: 1769090 - protein, 14 aa, Staphylococcus epidermidis
EASGGGVTVSGGEP

SEQ ID NO: 1769091 - protein, 5 aa, Staphylococcus epidermidis
EASGK

SEQ ID NO: 1769092 - protein, 8 aa, Staphylococcus epidermidis
EASGKTKK

SEQ ID NO: 1769093 - protein, 5 aa, Staphylococcus epidermidis
EASQY

SEQ ID NO: 1769094 - protein, 6 aa, Staphylococcus epidermidis
EATNRG

SEQ ID NO: 1769095 - protein, 8 aa, Staphylococcus epidermidis
EAVNPSEN

SEQ ID NO: 1769096 - protein, 9 aa, Staphylococcus epidermidis
EDDHSEAMN

SEQ ID NO: 1769097 - protein, 4 aa, Staphylococcus epidermidis
EDIQ

SEQ ID NO: 1769098 - protein, 16 aa, Staphylococcus epidermidis
EDKNRNNVPLTAPPDG

SEQ ID NO: 1769099 - protein, 10 aa, Staphylococcus epidermidis
EDKVSEEFPD

SEQ ID NO: 1769100 - protein, 10 aa, Staphylococcus epidermidis
EDNIKSLASK

SEQ ID NO: 1769101 - protein, 4 aa, Staphylococcus epidermidis
EDQF

SEQ ID NO: 1769102 - protein, 9 aa, Staphylococcus epidermidis
EDQYSTNYV

SEQ ID NO: 1769103 - protein, 5 aa, Staphylococcus epidermidis
EDTKR

SEQ ID NO: 1769104 - protein, 14 aa, Staphylococcus epidermidis
EDVPQGASDEENVE

SEQ ID NO: 1769105 - protein, 14 aa, Staphylococcus epidermidis
EDVPQGDSDEENVE

SEQ ID NO: 1769106 - protein, 4 aa, Staphylococcus epidermidis
EDYT

SEQ ID NO: 1769107 - protein, 5 aa, Staphylococcus epidermidis
EDYTK

SEQ ID NO: 1769108 - protein, 5 aa, Staphylococcus epidermidis
EEAGV

SEQ ID NO: 1769109 - protein, 6 aa, Staphylococcus epidermidis
EEALTT

SEQ ID NO: 1769110 - protein, 12 aa, Staphylococcus epidermidis
EEAVEKAKELNS

SEQ ID NO: 1769111 - protein, 6 aa, Staphylococcus epidermidis
EEAVSK

SEQ ID NO: 1769112 - protein, 9 aa, Staphylococcus epidermidis
EEDYKNPHI

SEQ ID NO: 1769113 - protein, 14 aa, Staphylococcus epidermidis
EEFKKSKASLLTSE

SEQ ID NO: 1769114 - protein, 4 aa, Staphylococcus epidermidis
EEIQ

SEQ ID NO: 1769115 - protein, 5 aa, Staphylococcus epidermidis
EEIQL

SEQ ID NO: 1769116 - protein, 6 aa, Staphylococcus epidermidis
EEMPED

SEQ ID NO: 1769117 - protein, 4 aa, Staphylococcus epidermidis
EENQ

SEQ ID NO: 1769118 - protein, 4 aa, Staphylococcus epidermidis
EEQF

SEQ ID NO: 1769119 - protein, 4 aa, Staphylococcus epidermidis
EEQP

SEQ ID NO: 1769120 - protein, 7 aa, Staphylococcus epidermidis
EESAIPE

SEQ ID NO: 1769121 - protein, 8 aa, Staphylococcus epidermidis
EESGLAQR

SEQ ID NO: 1769122 - protein, 8 aa, Staphylococcus epidermidis
EETGLAQR

SEQ ID NO: 1769123 - protein, 6 aa, Staphylococcus epidermidis
EETQTR

SEQ ID NO: 1769124 - protein, 8 aa, Staphylococcus epidermidis
EETSANRR

SEQ ID NO: 1769125 - protein, 4 aa, Staphylococcus epidermidis
EEYS

SEQ ID NO: 1769126 - protein, 7 aa, Staphylococcus epidermidis
EFSGKGY

SEQ ID NO: 1769127 - protein, 13 aa, Staphylococcus epidermidis
EGAEDDAEQGAQD

SEQ ID NO: 1769128 - protein, 14 aa, Staphylococcus epidermidis
EGAEDDAEQGAQDL

SEQ ID NO: 1769129 - protein, 7 aa, Staphylococcus epidermidis
EGCPTDS

SEQ ID NO: 1769130 - protein, 5 aa, Staphylococcus epidermidis
EGDDS

SEQ ID NO: 1769131 - protein, 5 aa, Staphylococcus epidermidis
EGFTE

SEQ ID NO: 1769132 - protein, 21 aa, Staphylococcus epidermidis
EGKTPASLRKEFDSQRKRNIN

SEQ ID NO: 1769133 - protein, 16 aa, Staphylococcus epidermidis
EGNNLGFKDTTKTALS

SEQ ID NO: 1769134 - protein, 16 aa, Staphylococcus epidermidis
EGQYQSNDRFPSKRQL

SEQ ID NO: 1769135 - protein, 11 aa, Staphylococcus epidermidis
EGRKLKKGDEI

SEQ ID NO: 1769136 - protein, 4 aa, Staphylococcus epidermidis
EGRM

SEQ ID NO: 1769137 - protein, 5 aa, Staphylococcus epidermidis
EGRQK

SEQ ID NO: 1769138 - protein, 4 aa, Staphylococcus epidermidis
EGTT

SEQ ID NO: 1769139 - protein, 6 aa, Staphylococcus epidermidis
EGYFEQ

SEQ ID NO: 1769140 - protein, 12 aa, Staphylococcus epidermidis
EHDIDNPRGINC

SEQ ID NO: 1769141 - protein, 22 aa, Staphylococcus epidermidis
EHGATTYDFGGTDNDPDKDSEH

SEQ ID NO: 1769142 - protein, 23 aa, Staphylococcus epidermidis
EHGATTYDFGGTDNDPDKDSEHY

SEQ ID NO: 1769143 - protein, 6 aa, Staphylococcus epidermidis
EIDGTH

SEQ ID NO: 1769144 - protein, 11 aa, Staphylococcus epidermidis
EIKDYSDEERL

SEQ ID NO: 1769145 - protein, 10 aa, Staphylococcus epidermidis
EIKDYTDEER

SEQ ID NO: 1769146 - protein, 30 aa, Staphylococcus epidermidis; identical to SEQ ID NO: 1615695

SEQ ID NO: 1769147 - protein, 5 aa, Staphylococcus epidermidis
EISNY

SEQ ID NO: 1769148 - protein, 5 aa, Staphylococcus epidermidis
EKDFK

SEQ ID NO: 1769149 - protein, 6 aa, Staphylococcus epidermidis
EKDFKN

SEQ ID NO: 1769150 - protein, 6 aa, Staphylococcus epidermidis
EKEGRI

SEQ ID NO: 1769151 - protein, 9 aa, Staphylococcus epidermidis
EKGLHREDV

SEQ ID NO: 1769152 - protein, 7 aa, Staphylococcus epidermidis
EKLKTDK

SEQ ID NO: 1769153 - protein, 7 aa, Staphylococcus epidermidis
EKLKTNK

SEQ ID NO: 1769154 - protein, 8 aa, Staphylococcus epidermidis
EKQLEEVQ

SEQ ID NO: 1769155 - protein, 5 aa, Staphylococcus epidermidis
EKRLP

SEQ ID NO: 1769156 - protein, 6 aa, Staphylococcus epidermidis
EKRLPK

SEQ ID NO: 1769157 - protein, 9 aa, Staphylococcus epidermidis
EKRSRENLD

SEQ ID NO: 1769158 - protein, 6 aa, Staphylococcus epidermidis
EKSIES

SEQ ID NO: 1769159 - protein, 22 aa, Staphylococcus epidermidis
EKTHQEMAHKSEKVRPKFEKEK

SEQ ID NO: 1769160 - protein, 14 aa, Staphylococcus epidermidis
EKVEQGYYQPTTTK

SEQ ID NO: 1769161 - protein, 11 aa, Staphylococcus epidermidis
ELEKSNNSPLI

SEQ ID NO: 1769162 - protein, 5 aa, Staphylococcus epidermidis
ELGLS

SEQ ID NO: 1769163 - protein, 7 aa, Staphylococcus epidermidis
ELNPTDE

SEQ ID NO: 1769164 - protein, 10 aa, Staphylococcus epidermidis
ELPNITPQNE

SEQ ID NO: 1769165 - protein, 6 aa, Staphylococcus epidermidis
ELQKLR

SEQ ID NO: 1769166 - protein, 7 aa, Staphylococcus epidermidis
ELRPGEA

SEQ ID NO: 1769167 - protein, 6 aa, Staphylococcus epidermidis
ELSEDE

SEQ ID NO: 1769168 - protein, 7 aa, Staphylococcus epidermidis
ELSEDEI

SEQ ID NO: 1769169 - protein, 17 aa, Staphylococcus epidermidis
ELSQGEIDKIDSLFPIK

SEQ ID NO: 1769170 - protein, 12 aa, Staphylococcus epidermidis
ELSSDENEDRYK

SEQ ID NO: 1769171 - protein, 7 aa, Staphylococcus epidermidis
ENAVPNQ

SEQ ID NO: 1769172 - protein, 9 aa, Staphylococcus epidermidis
ENDPDINPE

SEQ ID NO: 1769173 - protein, 20 aa, Staphylococcus epidermidis
ENKDSSYDLKNDYPSGYSHG

SEQ ID NO: 1769174 - protein, 4 aa, Staphylococcus epidermidis
ENLD

SEQ ID NO: 1769175 - protein, 6 aa, Staphylococcus epidermidis
ENLEEC

SEQ ID NO: 1769176 - protein, 7 aa, Staphylococcus epidermidis
ENLEECN

SEQ ID NO: 1769177 - protein, 5 aa, Staphylococcus epidermidis
ENMEG

SEQ ID NO: 1769178 - protein, 5 aa, Staphylococcus epidermidis
ENNGD

SEQ ID NO: 1769179 - protein, 6 aa, Staphylococcus epidermidis
ENNHRT

SEQ ID NO: 1769180 - protein, 7 aa, Staphylococcus epidermidis
ENNQIQA

SEQ ID NO: 1769181 - protein, 4 aa, Staphylococcus epidermidis
ENQD

SEQ ID NO: 1769182 - protein, 10 aa, Staphylococcus epidermidis
ENTSNGSDVK

SEQ ID NO: 1769183 - protein, 8 aa, Staphylococcus epidermidis
ENVKKSEK

SEQ ID NO: 1769184 - protein, 10 aa, Staphylococcus epidermidis
ENVQDGSKDI

SEQ ID NO: 1769185 - protein, 18 aa, Staphylococcus epidermidis
ENYVPTAAGLASSASAYA

SEQ ID NO: 1769186 - protein, 5 aa, Staphylococcus epidermidis
EPEDP

SEQ ID NO: 1769187 - protein, 25 aa, Staphylococcus epidermidis
EPEGSVLNGGVSHPHATEGIGSEKW

SEQ ID NO: 1769188 - protein, 9 aa, Staphylococcus epidermidis
EPKGKDMEA

SEQ ID NO: 1769189 - protein, 6 aa, Staphylococcus epidermidis
EPLESE

SEQ ID NO: 1769190 - protein, 11 aa, Staphylococcus epidermidis
EPTAGLDPEER

SEQ ID NO: 1769191 - protein, 12 aa, Staphylococcus epidermidis
EPTGNLDEKNAH

SEQ ID NO: 1769192 - protein, 9 aa, Staphylococcus epidermidis
EPTNDLDTE

SEQ ID NO: 1769193 - protein, 9 aa, Staphylococcus epidermidis
EPTSALDPI

SEQ ID NO: 1769194 - protein, 7 aa, Staphylococcus epidermidis
EQEQPTY

SEQ ID NO: 1769195 - protein, 15 aa, Staphylococcus epidermidis
EQGMTPDKPYKKSAR

SEQ ID NO: 1769196 - protein, 6 aa, Staphylococcus epidermidis
EQGPMG

SEQ ID NO: 1769197 - protein, 8 aa, Staphylococcus epidermidis
EQIETQDE

SEQ ID NO: 1769198 - protein, 6 aa, Staphylococcus epidermidis
EQLERT

SEQ ID NO: 1769199 - protein, 8 aa, Staphylococcus epidermidis
EQQEQQEH

SEQ ID NO: 1769200 - protein, 5 aa, Staphylococcus epidermidis
EQREK

SEQ ID NO: 1769201 - protein, 6 aa, Staphylococcus epidermidis
EQYDED

SEQ ID NO: 1769202 - protein, 7 aa, Staphylococcus epidermidis
EQYDEDL

SEQ ID NO: 1769203 - protein, 9 aa, Staphylococcus epidermidis
ERDKIESEY

SEQ ID NO: 1769204 - protein, 11 aa, Staphylococcus epidermidis
ERFGDERRTEI

SEQ ID NO: 1769205 - protein, 13 aa, Staphylococcus epidermidis
ERKVKTEKKVDKA

SEQ ID NO: 1769206 - protein, 4 aa, Staphylococcus epidermidis
ERLG

SEQ ID NO: 1769207 - protein, 12 aa, Staphylococcus epidermidis
ERNYKDDINEIS

SEQ ID NO: 1769208 - protein, 4 aa, Staphylococcus epidermidis
ERQR

SEQ ID NO: 1769209 - protein, 5 aa, Staphylococcus epidermidis
ERRGN

SEQ ID NO: 1769210 - protein, 9 aa, Staphylococcus epidermidis
ERSEEGPYY

SEQ ID NO: 1769211 - protein, 9 aa, Staphylococcus epidermidis
ERTRKGGAE

SEQ ID NO: 1769212 - protein, 6 aa, Staphylococcus epidermidis
ESAIPE

SEQ ID NO: 1769213 - protein, 18 aa, Staphylococcus epidermidis
ESDEEREAGKANKIVGNQ

SEQ ID NO: 1769214 - protein, 22 aa, Staphylococcus epidermidis
ESDNIGEQVRNGLQEKAKQGRL

SEQ ID NO: 1769215 - protein, 5 aa, Staphylococcus epidermidis
ESDQV

SEQ ID NO: 1769216 - protein, 4 aa, Staphylococcus epidermidis
ESEE

SEQ ID NO: 1769217 - protein, 8 aa, Staphylococcus epidermidis
ESEQTPTS

SEQ ID NO: 1769218 - protein, 6 aa, Staphylococcus epidermidis
ESSELE

SEQ ID NO: 1769219 - protein, 7 aa, Staphylococcus epidermidis
ESSELED

SEQ ID NO: 1769220 - protein, 12 aa, Staphylococcus epidermidis
ESTNRAISLYQL

SEQ ID NO: 1769221 - protein, 6 aa, Staphylococcus epidermidis
ESTSEE

SEQ ID NO: 1769222 - protein, 10 aa, Staphylococcus epidermidis
ESVKNKDTQF

SEQ ID NO: 1769223 - protein, 11 aa, Staphylococcus epidermidis
ESVKNKDTQFA

SEQ ID NO: 1769224 - protein, 5 aa, Staphylococcus epidermidis
ETDKA

SEQ ID NO: 1769225 - protein, 6 aa, Staphylococcus epidermidis
ETDKAF

SEQ ID NO: 1769226 - protein, 14 aa, Staphylococcus epidermidis
ETFETTANELGGQA

SEQ ID NO: 1769227 - protein, 12 aa, Staphylococcus epidermidis
ETIEQELQPAVI

SEQ ID NO: 1769228 - protein, 17 aa, Staphylococcus epidermidis
ETIPDTEFDEFRYHRGL

SEQ ID NO: 1769229 - protein, 9 aa, Staphylococcus epidermidis
ETLQQPTAH

SEQ ID NO: 1769230 - protein, 6 aa, Staphylococcus epidermidis
ETNDNE

SEQ ID NO: 1769231 - protein, 5 aa, Staphylococcus epidermidis
ETQTR

SEQ ID NO: 1769232 - protein, 6 aa, Staphylococcus epidermidis
ETTAEK

SEQ ID NO: 1769233 - protein, 7 aa, Staphylococcus epidermidis
ETTAEKL

SEQ ID NO: 1769234 - protein, 4 aa, Staphylococcus epidermidis
ETTN

SEQ ID NO: 1769235 - protein, 11 aa, Staphylococcus epidermidis
ETVTPHDHRDP

SEQ ID NO: 1769236 - protein, 4 aa, Staphylococcus epidermidis
ETYA

SEQ ID NO: 1769237 - protein, 5 aa, Staphylococcus epidermidis
ETYAI

SEQ ID NO: 1769238 - protein, 18 aa, Staphylococcus epidermidis
EVAKESAEKLSKEGQEAV

SEQ ID NO: 1769239 - protein, 8 aa, Staphylococcus epidermidis
EVETPPTY

SEQ ID NO: 1769240 - protein, 4 aa, Staphylococcus epidermidis
EVSH

SEQ ID NO: 1769241 - protein, 14 aa, Staphylococcus epidermidis
EVTKKQRQHKNGHK

SEQ ID NO: 1769242 - protein, 6 aa, Staphylococcus epidermidis
EYLGKT

SEQ ID NO: 1769243 - protein, 12 aa, Staphylococcus epidermidis
EYTTQTVYPDKQ

SEQ ID NO: 1769244 - protein, 25 aa, Staphylococcus epidermidis
FAKGQKGSSAMPHKRNPIGSENITG

SEQ ID NO: 1769245 - protein, 9 aa, Staphylococcus epidermidis
FAKKTEQNI

SEQ ID NO: 1769246 - protein, 5 aa, Staphylococcus epidermidis
FDEEN

SEQ ID NO: 1769247 - protein, 4 aa, Staphylococcus epidermidis
FDPD

SEQ ID NO: 1769248 - protein, 9 aa, Staphylococcus epidermidis
FDREKAYGK

SEQ ID NO: 1769249 - protein, 9 aa, Staphylococcus epidermidis
FEANPDELT

SEQ ID NO: 1769250 - protein, 48 aa, Staphylococcus epidermidis
FEKQQSQIGETSAPYVHDQKDKNHDVESHKNNLDSTSSTNNESTEVSN

SEQ ID NO: 1769251 - protein, 4 aa, Staphylococcus epidermidis
FENS

SEQ ID NO: 1769252 - protein, 5 aa, Staphylococcus epidermidis
FENSS

SEQ ID NO: 1769253 - protein, 8 aa, Staphylococcus epidermidis
FEPQDVEN

SEQ ID NO: 1769254 - protein, 4 aa, Staphylococcus epidermidis
FFDP

SEQ ID NO: 1769255 - protein, 5 aa, Staphylococcus epidermidis
FFDPE

SEQ ID NO: 1769256 - protein, 10 aa, Staphylococcus epidermidis
FGEKSSKTEV

SEQ ID NO: 1769257 - protein, 10 aa, Staphylococcus epidermidis
FGEKTSKTEV

SEQ ID NO: 1769258 - protein, 12 aa, Staphylococcus epidermidis
FGNHDTEGHLKR

SEQ ID NO: 1769259 - protein, 7 aa, Staphylococcus epidermidis
FGPDSSS

SEQ ID NO: 1769260 - protein, 25 aa, Staphylococcus epidermidis
FGQNKNNLTTNKQTINEQKENNNHL

SEQ ID NO: 1769261 - protein, 6 aa, Staphylococcus epidermidis
FGRPLS

SEQ ID NO: 1769262 - protein, 16 aa, Staphylococcus epidermidis
FGTEIPDEEAEKINTV

SEQ ID NO: 1769263 - protein, 7 aa, Staphylococcus epidermidis
FKKNEGY

SEQ ID NO: 1769264 - protein, 9 aa, Staphylococcus epidermidis
FKSPISTPK

SEQ ID NO: 1769265 - protein, 12 aa, Staphylococcus epidermidis
FNDNGTYLKTGE

SEQ ID NO: 1769266 - protein, 11 aa, Staphylococcus epidermidis
FPASSTGSFKS

SEQ ID NO: 1769267 - protein, 4 aa, Staphylococcus epidermidis
FPEY

SEQ ID NO: 1769268 - protein, 6 aa, Staphylococcus epidermidis
FPKTAS

SEQ ID NO: 1769269 - protein, 15 aa, Staphylococcus epidermidis
FQPQVATPQLREKYQ

SEQ ID NO: 1769270 - protein, 10 aa, Staphylococcus epidermidis
FRAEKSKTRR

SEQ ID NO: 1769271 - protein, 11 aa, Staphylococcus epidermidis
FRPGLKARDDF

SEQ ID NO: 1769272 - protein, 12 aa, Staphylococcus epidermidis
FRPGLKARDDFG

SEQ ID NO: 1769273 - protein, 8 aa, Staphylococcus epidermidis
FSDTNNNI

SEQ ID NO: 1769274 - protein, 9 aa, Staphylococcus epidermidis
FSGQKCSAC

SEQ ID NO: 1769275 - protein, 11 aa, Staphylococcus epidermidis
FSPEPSYMPGY

SEQ ID NO: 1769276 - protein, 17 aa, Staphylococcus epidermidis
FSPQKKPEQIKTEIEKL

SEQ ID NO: 1769277 - protein, 4 aa, Staphylococcus epidermidis
FSPT

SEQ ID NO: 1769278 - protein, 8 aa, Staphylococcus epidermidis
FSSREKDL

SEQ ID NO: 1769279 - protein, 5 aa, Staphylococcus epidermidis
FTDIG

SEQ ID NO: 1769280 - protein, 5 aa, Staphylococcus epidermidis
FTGTS

SEQ ID NO: 1769281 - protein, 9 aa, Staphylococcus epidermidis
FTKNKTSTV

SEQ ID NO: 1769282 - protein, 6 aa, Staphylococcus epidermidis
FYNSDD

SEQ ID NO: 1769283 - protein, 21 aa, Staphylococcus epidermidis
GAGDTIQKNENVPVTPQELAD

SEQ ID NO: 1769284 - protein, 22 aa, Staphylococcus epidermidis
GAGDTIQKNENVPVTPQELADS

SEQ ID NO: 1769285 - protein, 8 aa, Staphylococcus epidermidis
GAGRVSVE

SEQ ID NO: 1769286 - protein, 9 aa, Staphylococcus epidermidis
GAGRVSVEQ

SEQ ID NO: 1769287 - protein, 8 aa, Staphylococcus epidermidis
GAHNNTLG

SEQ ID NO: 1769288 - protein, 15 aa, Staphylococcus epidermidis
GAHNNTLGATLAGEV

SEQ ID NO: 1769289 - protein, 6 aa, Staphylococcus epidermidis
GAITSA

SEQ ID NO: 1769290 - protein, 7 aa, Staphylococcus epidermidis
GAKDEIR

SEQ ID NO: 1769291 - protein, 10 aa, Staphylococcus epidermidis
GANPEDIESE

SEQ ID NO: 1769292 - protein, 18 aa, Staphylococcus epidermidis
GAPPGYVGHDEGGQLTEA

SEQ ID NO: 1769293 - protein, 7 aa, Staphylococcus epidermidis
GAQKVGM

SEQ ID NO: 1769294 - protein, 9 aa, Staphylococcus epidermidis
GAREKAENG

SEQ ID NO: 1769295 - protein, 5 aa, Staphylococcus epidermidis
GASAI

SEQ ID NO: 1769296 - protein, 6 aa, Staphylococcus epidermidis
GATGGR

SEQ ID NO: 1769297 - protein, 22 aa, Staphylococcus epidermidis
GATTTAVKSYETKDAINNGAQE

SEQ ID NO: 1769298 - protein, 8 aa, Staphylococcus epidermidis
GAVDPNAI

SEQ ID NO: 1769299 - protein, 8 aa, Staphylococcus epidermidis
GCVNDTPA

SEQ ID NO: 1769300 - protein, 9 aa, Staphylococcus epidermidis
GDDENNPKA

SEQ ID NO: 1769301 - protein, 4 aa, Staphylococcus epidermidis
GDDS

SEQ ID NO: 1769302 - protein, 9 aa, Staphylococcus epidermidis
GDGHRDKPV

SEQ ID NO: 1769303 - protein, 6 aa, Staphylococcus epidermidis
GDNPQR

SEQ ID NO: 1769304 - protein, 7 aa, Staphylococcus epidermidis
GDNPQRL

SEQ ID NO: 1769305 - protein, 6 aa, Staphylococcus epidermidis
GDSDFR

SEQ ID NO: 1769306 - protein, 15 aa, Staphylococcus epidermidis
GDTAQDIKSANQAHV

SEQ ID NO: 1769307 - protein, 7 aa, Staphylococcus epidermidis
GDTEVNG

SEQ ID NO: 1769308 - protein, 7 aa, Staphylococcus epidermidis
GDTIGSV

SEQ ID NO: 1769309 - protein, 8 aa, Staphylococcus epidermidis
GDTIGSVS

SEQ ID NO: 1769310 - protein, 12 aa, Staphylococcus epidermidis
GDTQEIDDPFGG

SEQ ID NO: 1769311 - protein, 6 aa, Staphylococcus epidermidis
GDVKGG

SEQ ID NO: 1769312 - protein, 5 aa, Staphylococcus epidermidis
GEAAV

SEQ ID NO: 1769313 - protein, 5 aa, Staphylococcus epidermidis
GEDKT

SEQ ID NO: 1769314 - protein, 6 aa, Staphylococcus epidermidis
GEEETG

SEQ ID NO: 1769315 - protein, 6 aa, Staphylococcus epidermidis
GEEVGN

SEQ ID NO: 1769316 - protein, 12 aa, Staphylococcus epidermidis
GETVTPHDHRDP

SEQ ID NO: 1769317 - protein, 10 aa, Staphylococcus epidermidis
GEVVERPSSV

SEQ ID NO: 1769318 - protein, 13 aa, Staphylococcus epidermidis
GEYSPTISSASQH

SEQ ID NO: 1769319 - protein, 8 aa, Staphylococcus epidermidis
GFEGGMSN

SEQ ID NO: 1769320 - protein, 6 aa, Staphylococcus epidermidis
GFKTEG

SEQ ID NO: 1769321 - protein, 6 aa, Staphylococcus epidermidis
GFNKPN

SEQ ID NO: 1769322 - protein, 12 aa, Staphylococcus epidermidis
GFPASSTGSFKS

SEQ ID NO: 1769323 - protein, 7 aa, Staphylococcus epidermidis
GFQHREP

SEQ ID NO: 1769324 - protein, 7 aa, Staphylococcus epidermidis
GFRGEAS

SEQ ID NO: 1769325 - protein, 11 aa, Staphylococcus epidermidis
GFRGEASIKYK

SEQ ID NO: 1769326 - protein, 6 aa, Staphylococcus epidermidis
GGEAAV

SEQ ID NO: 1769327 - protein, 8 aa, Staphylococcus epidermidis
GGENTSIK

SEQ ID NO: 1769328 - protein, 10 aa, Staphylococcus epidermidis
GGGQEYGLRS

SEQ ID NO: 1769329 - protein, 11 aa, Staphylococcus epidermidis
GGGQEYGLRSG

SEQ ID NO: 1769330 - protein, 9 aa, Staphylococcus epidermidis
GGKIDEGES

SEQ ID NO: 1769331 - protein, 10 aa, Staphylococcus epidermidis
GGLPNKEPQI

SEQ ID NO: 1769332 - protein, 4 aa, Staphylococcus epidermidis
GGLR

SEQ ID NO: 1769333 - protein, 6 aa, Staphylococcus epidermidis
GGMTQA

SEQ ID NO: 1769334 - protein, 6 aa, Staphylococcus epidermidis
GGNEEV

SEQ ID NO: 1769335 - protein, 4 aa, Staphylococcus epidermidis
GGPS

SEQ ID NO: 1769336 - protein, 5 aa, Staphylococcus epidermidis
GGPSE

SEQ ID NO: 1769337 - protein, 5 aa, Staphylococcus epidermidis
GGVGI

SEQ ID NO: 1769338 - protein, 33 aa, Staphylococcus epidermidis
GGYTAYEQQHNNESFKLEKDKEIQIKDNRKTFN

SEQ ID NO: 1769339 - protein, 6 aa, Staphylococcus epidermidis
GHFTTS

SEQ ID NO: 1769340 - protein, 9 aa, Staphylococcus epidermidis
GHLQKANDE

SEQ ID NO: 1769341 - protein, 6 aa, Staphylococcus epidermidis
GIEPNK

SEQ ID NO: 1769342 - protein, 4 aa, Staphylococcus epidermidis
GIGG

SEQ ID NO: 1769343 - protein, 5 aa, Staphylococcus epidermidis
GIGGE

SEQ ID NO: 1769344 - protein, 23 aa, Staphylococcus epidermidis
GIKGEVKVKSNSDFTETRFQPGE

SEQ ID NO: 1769345 - protein, 4 aa, Staphylococcus epidermidis
GIPL

SEQ ID NO: 1769346 - protein, 7 aa, Staphylococcus epidermidis
GIQKGER

SEQ ID NO: 1769347 - protein, 14 aa, Staphylococcus epidermidis
GIRRAYETGRGSIQ

SEQ ID NO: 1769348 - protein, 9 aa, Staphylococcus epidermidis
GISERDVQN

SEQ ID NO: 1769349 - protein, 7 aa, Staphylococcus epidermidis
GIVSSEP

SEQ ID NO: 1769350 - protein, 8 aa, Staphylococcus epidermidis
GIVSSEPL

SEQ ID NO: 1769351 - protein, 7 aa, Staphylococcus epidermidis
GKAETLK

SEQ ID NO: 1769352 - protein, 9 aa, Staphylococcus epidermidis
GKGQVQDAG

SEQ ID NO: 1769353 - protein, 10 aa, Staphylococcus epidermidis
GKGQVQDAGA

SEQ ID NO: 1769354 - protein, 5 aa, Staphylococcus epidermidis
GKKAE

SEQ ID NO: 1769355 - protein, 10 aa, Staphylococcus epidermidis
GKKGNPGTII

SEQ ID NO: 1769356 - protein, 9 aa, Staphylococcus epidermidis
GKKQSEPYL

SEQ ID NO: 1769357 - protein, 14 aa, Staphylococcus epidermidis
GKLEKGEDRKEAAI

SEQ ID NO: 1769358 - protein, 8 aa, Staphylococcus epidermidis
GKLKQRPF

SEQ ID NO: 1769359 - protein, 9 aa, Staphylococcus epidermidis
GKLKQRPFK

SEQ ID NO: 1769360 - protein, 5 aa, Staphylococcus epidermidis
GKLTG

SEQ ID NO: 1769361 - protein, 7 aa, Staphylococcus epidermidis
GKPLPNR

SEQ ID NO: 1769362 - protein, 14 aa, Staphylococcus epidermidis
GKQYTYGKGLEELS

SEQ ID NO: 1769363 - protein, 9 aa, Staphylococcus epidermidis
GKSGQGKST

SEQ ID NO: 1769364 - protein, 8 aa, Staphylococcus epidermidis
GKSSYKRA

SEQ ID NO: 1769365 - protein, 5 aa, Staphylococcus epidermidis
GLKGV

SEQ ID NO: 1769366 - protein, 10 aa, Staphylococcus epidermidis
GLNERGISTD

SEQ ID NO: 1769367 - protein, 6 aa, Staphylococcus epidermidis
GLNKPN

SEQ ID NO: 1769368 - protein, 9 aa, Staphylococcus epidermidis
GLRKSTNKE

SEQ ID NO: 1769369 - protein, 4 aa, Staphylococcus epidermidis
GMES

SEQ ID NO: 1769370 - protein, 10 aa, Staphylococcus epidermidis
GMPIPNDDKR

SEQ ID NO: 1769371 - protein, 9 aa, Staphylococcus epidermidis
GMPIPNDDR

SEQ ID NO: 1769372 - protein, 10 aa, Staphylococcus epidermidis
GMSAASKIVK

SEQ ID NO: 1769373 - protein, 11 aa, Staphylococcus epidermidis
GMSAASKVVKK

SEQ ID NO: 1769374 - protein, 9 aa, Staphylococcus epidermidis
GNDENNPKA

SEQ ID NO: 1769375 - protein, 5 aa, Staphylococcus epidermidis
GNEEV

SEQ ID NO: 1769376 - protein, 7 aa, Staphylococcus epidermidis
GNFKAET

SEQ ID NO: 1769377 - protein, 8 aa, Staphylococcus epidermidis
GNFKAETE

SEQ ID NO: 1769378 - protein, 9 aa, Staphylococcus epidermidis
GNGSLDKKL

SEQ ID NO: 1769379 - protein, 13 aa, Staphylococcus epidermidis
GNHRNPFKSGTET

SEQ ID NO: 1769380 - protein, 14 aa, Staphylococcus epidermidis
GNHRNPFKSGTETF

SEQ ID NO: 1769381 - protein, 11 aa, Staphylococcus epidermidis
GNKDKGITAPH

SEQ ID NO: 1769382 - protein, 12 aa, Staphylococcus epidermidis
GNKDKGITAPHH

SEQ ID NO: 1769383 - protein, 6 aa, Staphylococcus epidermidis
GNTEVN

SEQ ID NO: 1769384 - protein, 12 aa, Staphylococcus epidermidis
GNVGIEKTTANA

SEQ ID NO: 1769385 - protein, 5 aa, Staphylococcus epidermidis
GPADD

SEQ ID NO: 1769386 - protein, 12 aa, Staphylococcus epidermidis
GPATSNSYEIND

SEQ ID NO: 1769387 - protein, 13 aa, Staphylococcus epidermidis
GPATSNSYEINDD

SEQ ID NO: 1769388 - protein, 4 aa, Staphylococcus epidermidis
GPCG

SEQ ID NO: 1769389 - protein, 6 aa, Staphylococcus epidermidis
GPFPSA

SEQ ID NO: 1769390 - protein, 8 aa, Staphylococcus epidermidis
GPGLTKKM

SEQ ID NO: 1769391 - protein, 9 aa, Staphylococcus epidermidis
GPPTANGLP

SEQ ID NO: 1769392 - protein, 10 aa, Staphylococcus epidermidis
GPSGVGKGTV

SEQ ID NO: 1769393 - protein, 6 aa, Staphylococcus epidermidis
GPSHQQ

SEQ ID NO: 1769394 - protein, 7 aa, Staphylococcus epidermidis
GQAETLK

SEQ ID NO: 1769395 - protein, 9 aa, Staphylococcus epidermidis
GQIPEEIDS

SEQ ID NO: 1769396 - protein, 10 aa, Staphylococcus epidermidis
GRDGKPETKY

SEQ ID NO: 1769397 - protein, 8 aa, Staphylococcus epidermidis
GRDITDDI

SEQ ID NO: 1769398 - protein, 11 aa, Staphylococcus epidermidis
GRDPAPEEIGE

SEQ ID NO: 1769399 - protein, 6 aa, Staphylococcus epidermidis
GREPLM

SEQ ID NO: 1769400 - protein, 4 aa, Staphylococcus epidermidis
GRGL

SEQ ID NO: 1769401 - protein, 20 aa, Staphylococcus epidermidis
GRGTESDEKIQSRVNEARKE

SEQ ID NO: 1769402 - protein, 7 aa, Staphylococcus epidermidis
GRLPGGV

SEQ ID NO: 1769403 - protein, 7 aa, Staphylococcus epidermidis
GRNVGEA

SEQ ID NO: 1769404 - protein, 11 aa, Staphylococcus epidermidis
GRPETQRKTVE

SEQ ID NO: 1769405 - protein, 4 aa, Staphylococcus epidermidis
GRQY

SEQ ID NO: 1769406 - protein, 9 aa, Staphylococcus epidermidis
GRTGRGNYK

SEQ ID NO: 1769407 - protein, 15 aa, Staphylococcus epidermidis
GSAPDIANEDKANPF

SEQ ID NO: 1769408 - protein, 5 aa, Staphylococcus epidermidis
GSDDA

SEQ ID NO: 1769409 - protein, 5 aa, Staphylococcus epidermidis
GSEKP

SEQ ID NO: 1769410 - protein, 6 aa, Staphylococcus epidermidis
GSEKQI

SEQ ID NO: 1769411 - protein, 5 aa, Staphylococcus epidermidis
GSERI

SEQ ID NO: 1769412 - protein, 7 aa, Staphylococcus epidermidis
GSGGTFT

SEQ ID NO: 1769413 - protein, 8 aa, Staphylococcus epidermidis
GSGKGHFT

SEQ ID NO: 1769414 - protein, 9 aa, Staphylococcus epidermidis
GSGTQSNMN

SEQ ID NO: 1769415 - protein, 11 aa, Staphylococcus epidermidis
GSLKDTLTEME

SEQ ID NO: 1769416 - protein, 12 aa, Staphylococcus epidermidis
GSPNQNGSNEEY

SEQ ID NO: 1769417 - protein, 9 aa, Staphylococcus epidermidis
GSSKKDENV

SEQ ID NO: 1769418 - protein, 8 aa, Staphylococcus epidermidis
GSSSVKTI

SEQ ID NO: 1769419 - protein, 5 aa, Staphylococcus epidermidis
GSSYT

SEQ ID NO: 1769420 - protein, 7 aa, Staphylococcus epidermidis
GSTFGKT

SEQ ID NO: 1769421 - protein, 5 aa, Staphylococcus epidermidis
GSVTS

SEQ ID NO: 1769422 - protein, 8 aa, Staphylococcus epidermidis
GTAVGTGI

SEQ ID NO: 1769423 - protein, 11 aa, Staphylococcus epidermidis
GTGDLKGSSVG

SEQ ID NO: 1769424 - protein, 8 aa, Staphylococcus epidermidis
GTGMGLPG

SEQ ID NO: 1769425 - protein, 9 aa, Staphylococcus epidermidis
GTGMGLPGS

SEQ ID NO: 1769426 - protein, 6 aa, Staphylococcus epidermidis
GTLDYD

SEQ ID NO: 1769427 - protein, 11 aa, Staphylococcus epidermidis
GTNEEDVYNET

SEQ ID NO: 1769428 - protein, 11 aa, Staphylococcus epidermidis
GTPGDSVEYKN

SEQ ID NO: 1769429 - protein, 14 aa, Staphylococcus epidermidis
GTPLTNETLQSCKN

SEQ ID NO: 1769430 - protein, 8 aa, Staphylococcus epidermidis
GTSTANKI

SEQ ID NO: 1769431 - protein, 5 aa, Staphylococcus epidermidis
GTTKS

SEQ ID NO: 1769432 - protein, 4 aa, Staphylococcus epidermidis
GTVA

SEQ ID NO: 1769433 - protein, 5 aa, Staphylococcus epidermidis
GTVTV

SEQ ID NO: 1769434 - protein, 9 aa, Staphylococcus epidermidis
GVAKDQLQH

SEQ ID NO: 1769435 - protein, 6 aa, Staphylococcus epidermidis
GVDQTR

SEQ ID NO: 1769436 - protein, 19 aa, Staphylococcus epidermidis
GVEEQADEVQKVKRSENGV

SEQ ID NO: 1769437 - protein, 4 aa, Staphylococcus epidermidis
GVGI

SEQ ID NO: 1769438 - protein, 10 aa, Staphylococcus epidermidis
GWTGGKYGVG

SEQ ID NO: 1769439 - protein, 5 aa, Staphylococcus epidermidis
GYDER

SEQ ID NO: 1769440 - protein, 42 aa, Staphylococcus epidermidis
GYELEQGTSRELTNRQHDQVNSYKQKTEYHKKEYERRYKIQP

SEQ ID NO: 1769441 - protein, 10 aa, Staphylococcus epidermidis
GYNTYGDLQR

SEQ ID NO: 1769442 - protein, 14 aa, Staphylococcus epidermidis
GYQLPQSKIQTRSI

SEQ ID NO: 1769443 - protein, 4 aa, Staphylococcus epidermidis
GYSR

SEQ ID NO: 1769444 - protein, 6 aa, Staphylococcus epidermidis
HAANED

SEQ ID NO: 1769445 - protein, 7 aa, Staphylococcus epidermidis
HAGGSDL

SEQ ID NO: 1769446 - protein, 9 aa, Staphylococcus epidermidis
HARKAGIES

SEQ ID NO: 1769447 - protein, 10 aa, Staphylococcus epidermidis
HASKEELETL

SEQ ID NO: 1769448 - protein, 7 aa, Staphylococcus epidermidis
HAYPESY

SEQ ID NO: 1769449 - protein, 8 aa, Staphylococcus epidermidis
HDTFTSKE

SEQ ID NO: 1769450 - protein, 9 aa, Staphylococcus epidermidis
HDTFTSKEK

SEQ ID NO: 1769451 - protein, 7 aa, Staphylococcus epidermidis
HEDAQQP

SEQ ID NO: 1769452 - protein, 7 aa, Staphylococcus epidermidis
HEGEYGK

SEQ ID NO: 1769453 - protein, 29 aa, Staphylococcus epidermidis
HELDDNRQQNQSNSQDDIISSKSSTSNMY

SEQ ID NO: 1769454 - protein, 8 aa, Staphylococcus epidermidis
HESPEMTS

SEQ ID NO: 1769455 - protein, 20 aa, Staphylococcus epidermidis
HEYAPSSIKDLQNNSINKID

SEQ ID NO: 1769456 - protein, 7 aa, Staphylococcus epidermidis
HFEGSSV

SEQ ID NO: 1769457 - protein, 8 aa, Staphylococcus epidermidis
HFEGSSVS

SEQ ID NO: 1769458 - protein, 12 aa, Staphylococcus epidermidis
HGGTKSIANQES

SEQ ID NO: 1769459 - protein, 16 aa, Staphylococcus epidermidis
HGSAPDIANEDKANPF

SEQ ID NO: 1769460 - protein, 5 aa, Staphylococcus epidermidis
HHENI

SEQ ID NO: 1769461 - protein, 9 aa, Staphylococcus epidermidis
HHGGGHKRQ

SEQ ID NO: 1769462 - protein, 9 aa, Staphylococcus epidermidis
HKESTEDIS

SEQ ID NO: 1769463 - protein, 11 aa, Staphylococcus epidermidis
HKGKRSEELGI

SEQ ID NO: 1769464 - protein, 6 aa, Staphylococcus epidermidis
HKKAYD

SEQ ID NO: 1769465 - protein, 9 aa, Staphylococcus epidermidis
HKLNENDQI

SEQ ID NO: 1769466 - protein, 13 aa, Staphylococcus epidermidis
HNEVEKEARDKAA

SEQ ID NO: 1769467 - protein, 5 aa, Staphylococcus epidermidis
HNITE

SEQ ID NO: 1769468 - protein, 6 aa, Staphylococcus epidermidis
HNPVAD

SEQ ID NO: 1769469 - protein, 5 aa, Staphylococcus epidermidis
HNQQK

SEQ ID NO: 1769470 - protein, 7 aa, Staphylococcus epidermidis
HNYGEQF

SEQ ID NO: 1769471 - protein, 4 aa, Staphylococcus epidermidis
HPSA

SEQ ID NO: 1769472 - protein, 25 aa, Staphylococcus epidermidis
HPSLKSGKKRKSGFKTKAEATNAAQ

SEQ ID NO: 1769473 - protein, 9 aa, Staphylococcus epidermidis
HQHEAPNYE

SEQ ID NO: 1769474 - protein, 4 aa, Staphylococcus epidermidis
HQQD

SEQ ID NO: 1769475 - protein, 5 aa, Staphylococcus epidermidis
HQQDY

SEQ ID NO: 1769476 - protein, 7 aa, Staphylococcus epidermidis
HQRDNDR

SEQ ID NO: 1769477 - protein, 13 aa, Staphylococcus epidermidis
HQSPSLPNDQRFE

SEQ ID NO: 1769478 - protein, 11 aa, Staphylococcus epidermidis
HRTNEETGKVD

SEQ ID NO: 1769479 - protein, 8 aa, Staphylococcus epidermidis
HSHPTADE

SEQ ID NO: 1769480 - protein, 18 aa, Staphylococcus epidermidis
HSKVSKATLYKNNKIRKK

SEQ ID NO: 1769481 - protein, 8 aa, Staphylococcus epidermidis
HSSQPDEI

SEQ ID NO: 1769482 - protein, 9 aa, Staphylococcus epidermidis
HSSQPDEIY

SEQ ID NO: 1769483 - protein, 7 aa, Staphylococcus epidermidis
HTASDLS

SEQ ID NO: 1769484 - protein, 25 aa, Staphylococcus epidermidis
HTMAGDDPTRYRTSDEDAEWEKKDP

SEQ ID NO: 1769485 - protein, 5 aa, Staphylococcus epidermidis
HTPSQ

SEQ ID NO: 1769486 - protein, 9 aa, Staphylococcus epidermidis
HTRVQGEGI

SEQ ID NO: 1769487 - protein, 6 aa, Staphylococcus epidermidis
HTYGQR

SEQ ID NO: 1769488 - protein, 17 aa, Staphylococcus epidermidis
HYDGGRHQIRVDMLNKM

SEQ ID NO: 1769489 - protein, 16 aa, Staphylococcus epidermidis
HYNPNNEITKSRNTLD

SEQ ID NO: 1769490 - protein, 6 aa, Staphylococcus epidermidis
IAAGAD

SEQ ID NO: 1769491 - protein, 7 aa, Staphylococcus epidermidis
IAAPAYA

SEQ ID NO: 1769492 - protein, 15 aa, Staphylococcus epidermidis
IAKTGAYITQEEADE

SEQ ID NO: 1769493 - protein, 8 aa, Staphylococcus epidermidis
IAKTTKQP

SEQ ID NO: 1769494 - protein, 8 aa, Staphylococcus epidermidis
IDAAESGI

SEQ ID NO: 1769495 - protein, 6 aa, Staphylococcus epidermidis
IDDTEV

SEQ ID NO: 1769496 - protein, 4 aa, Staphylococcus epidermidis
IDGM

SEQ ID NO: 1769497 - protein, 4 aa, Staphylococcus epidermidis
IDLE

SEQ ID NO: 1769498 - protein, 11 aa, Staphylococcus epidermidis
IDNTEGNSTIN

SEQ ID NO: 1769499 - protein, 12 aa, Staphylococcus epidermidis
IDNTEGNSTINP

SEQ ID NO: 1769500 - protein, 7 aa, Staphylococcus epidermidis
IDTYENE

SEQ ID NO: 1769501 - protein, 5 aa, Staphylococcus epidermidis
IEDGE

SEQ ID NO: 1769502 - protein, 10 aa, Staphylococcus epidermidis
IEEEDNVGTM

SEQ ID NO: 1769503 - protein, 10 aa, Staphylococcus epidermidis
IEETSQNAVN

SEQ ID NO: 1769504 - protein, 4 aa, Staphylococcus epidermidis
IEFP

SEQ ID NO: 1769505 - protein, 5 aa, Staphylococcus epidermidis
IEGTT

SEQ ID NO: 1769506 - protein, 13 aa, Staphylococcus epidermidis
IESTNRAISLYQL

SEQ ID NO: 1769507 - protein, 5 aa, Staphylococcus epidermidis
IGDSE

SEQ ID NO: 1769508 - protein, 11 aa, Staphylococcus epidermidis
IGGQVNDTAGI

SEQ ID NO: 1769509 - protein, 6 aa, Staphylococcus epidermidis
IGGSDD

SEQ ID NO: 1769510 - protein, 11 aa, Staphylococcus epidermidis
IGIKGKQDIEK

SEQ ID NO: 1769511 - protein, 7 aa, Staphylococcus epidermidis
IGKDGNA

SEQ ID NO: 1769512 - protein, 6 aa, Staphylococcus epidermidis
IGPADD

SEQ ID NO: 1769513 - protein, 13 aa, Staphylococcus epidermidis
IKEHKPDCKDIRR

SEQ ID NO: 1769514 - protein, 22 aa, Staphylococcus epidermidis
IKGEVKVKSNSDFTETRFQPGE

SEQ ID NO: 1769515 - protein, 7 aa, Staphylococcus epidermidis
IKKEPYG

SEQ ID NO: 1769516 - protein, 10 aa, Staphylococcus epidermidis
IKNPKNMEHQ

SEQ ID NO: 1769517 - protein, 8 aa, Staphylococcus epidermidis
IKNTKNGS

SEQ ID NO: 1769518 - protein, 9 aa, Staphylococcus epidermidis
IKNTKNGSL

SEQ ID NO: 1769519 - protein, 5 aa, Staphylococcus epidermidis
IKNTL

SEQ ID NO: 1769520 - protein, 39 aa, Staphylococcus epidermidis
IKPNQKGDKDIQAAIKETSKYSVKSSDFLTDDDERNQEI

SEQ ID NO: 1769521 - protein, 5 aa, Staphylococcus epidermidis
IKQTD

SEQ ID NO: 1769522 - protein, 4 aa, Staphylococcus epidermidis
IKYK

SEQ ID NO: 1769523 - protein, 4 aa, Staphylococcus epidermidis
ILTT

SEQ ID NO: 1769524 - protein, 13 aa, Staphylococcus epidermidis
INESDVTLANASN

SEQ ID NO: 1769525 - protein, 10 aa, Staphylococcus epidermidis
INKRSNKKAR

SEQ ID NO: 1769526 - protein, 9 aa, Staphylococcus epidermidis
INNASAETE

SEQ ID NO: 1769527 - protein, 5 aa, Staphylococcus epidermidis
INPAT

SEQ ID NO: 1769528 - protein, 43 aa, Staphylococcus epidermidis
INTNRETDSNSYESNGIEHDMNSSSDEHVYETPSKQQDEQIQK

SEQ ID NO: 1769529 - protein, 16 aa, Staphylococcus epidermidis
IPASQYKGQGFQPVAE

SEQ ID NO: 1769530 - protein, 4 aa, Staphylococcus epidermidis
IPDT

SEQ ID NO: 1769531 - protein, 15 aa, Staphylococcus epidermidis
IPDTEFDEFRHHCGL

SEQ ID NO: 1769532 - protein, 20 aa, Staphylococcus epidermidis
IPEEVPASQYKGQGFQPVAE

SEQ ID NO: 1769533 - protein, 13 aa, Staphylococcus epidermidis
IPKDTKNGDYSSN

SEQ ID NO: 1769534 - protein, 63 aa, Staphylococcus epidermidis
IPPEHKELNDKEIVQQDEVSHSTKSIDASKNVSNSNDNNIEKNQQKKQQTTAQTESSSENMHN

SEQ ID NO: 1769535 - protein, 7 aa, Staphylococcus epidermidis
IPTPINN

SEQ ID NO: 1769536 - protein, 8 aa, Staphylococcus epidermidis
IPTPINNE

SEQ ID NO: 1769537 - protein, 9 aa, Staphylococcus epidermidis
IQQIGTPEE

SEQ ID NO: 1769538 - protein, 9 aa, Staphylococcus epidermidis
IQTPEERFK

SEQ ID NO: 1769539 - protein, 4 aa, Staphylococcus epidermidis
ISEG

SEQ ID NO: 1769540 - protein, 8 aa, Staphylococcus epidermidis
ISERDVQN

SEQ ID NO: 1769541 - protein, 14 aa, Staphylococcus epidermidis
ISGGKGTASEKIKT

SEQ ID NO: 1769542 - protein, 4 aa, Staphylococcus epidermidis
ISGH

SEQ ID NO: 1769543 - protein, 12 aa, Staphylococcus epidermidis
ISGSKSKRPGLD

SEQ ID NO: 1769544 - protein, 13 aa, Staphylococcus epidermidis
ISKDGKLSGPNFD

SEQ ID NO: 1769545 - protein, 6 aa, Staphylococcus epidermidis
ISKNDL

SEQ ID NO: 1769546 - protein, 11 aa, Staphylococcus epidermidis
ISNDKKDAYNT

SEQ ID NO: 1769547 - protein, 11 aa, Staphylococcus epidermidis
ISPEETEEMAN

SEQ ID NO: 1769548 - protein, 5 aa, Staphylococcus epidermidis
ISTIG

SEQ ID NO: 1769549 - protein, 6 aa, Staphylococcus epidermidis
ISTNPD

SEQ ID NO: 1769550 - protein, 13 aa, Staphylococcus epidermidis
ITANQEKTPVKAN

SEQ ID NO: 1769551 - protein, 5 aa, Staphylococcus epidermidis
ITGDG

SEQ ID NO: 1769552 - protein, 10 aa, Staphylococcus epidermidis
ITHPKENGYR

SEQ ID NO: 1769553 - protein, 5 aa, Staphylococcus epidermidis
ITHPN

SEQ ID NO: 1769554 - protein, 9 aa, Staphylococcus epidermidis
ITQETSDIK

SEQ ID NO: 1769555 - protein, 10 aa, Staphylococcus epidermidis
IVDKSGAWYS

SEQ ID NO: 1769556 - protein, 8 aa, Staphylococcus epidermidis
IVKENPDV

SEQ ID NO: 1769557 - protein, 10 aa, Staphylococcus epidermidis
IVNPKSQKDI

SEQ ID NO: 1769558 - protein, 12 aa, Staphylococcus epidermidis
IVNPKSQKDIQE

SEQ ID NO: 1769559 - protein, 8 aa, Staphylococcus epidermidis
KAAKEMKA

SEQ ID NO: 1769560 - protein, 5 aa, Staphylococcus epidermidis
KAFNT

SEQ ID NO: 1769561 - protein, 6 aa, Staphylococcus epidermidis
KAFNTT

SEQ ID NO: 1769562 - protein, 7 aa, Staphylococcus epidermidis
KAKRENY

SEQ ID NO: 1769563 - protein, 4 aa, Staphylococcus epidermidis
KAKV

SEQ ID NO: 1769564 - protein, 11 aa, Staphylococcus epidermidis
KANPKLDGTHS

SEQ ID NO: 1769565 - protein, 9 aa, Staphylococcus epidermidis
KAQKEKYDN

SEQ ID NO: 1769566 - protein, 7 aa, Staphylococcus epidermidis
KAQSEGA

SEQ ID NO: 1769567 - protein, 6 aa, Staphylococcus epidermidis
KAQSVG

SEQ ID NO: 1769568 - protein, 7 aa, Staphylococcus epidermidis
KDAAKAA

SEQ ID NO: 1769569 - protein, 8 aa, Staphylococcus epidermidis
KDAAKAAM

SEQ ID NO: 1769570 - protein, 8 aa, Staphylococcus epidermidis
KDEGKISL

SEQ ID NO: 1769571 - protein, 7 aa, Staphylococcus epidermidis
KDEISNT

SEQ ID NO: 1769572 - protein, 4 aa, Staphylococcus epidermidis
KDEN

SEQ ID NO: 1769573 - protein, 4 aa, Staphylococcus epidermidis
KDID

SEQ ID NO: 1769574 - protein, 7 aa, Staphylococcus epidermidis
KDIPQSK

SEQ ID NO: 1769575 - protein, 17 aa, Staphylococcus epidermidis
KDKGDRSLTLRPEGTAA

SEQ ID NO: 1769576 - protein, 15 aa, Staphylococcus epidermidis
KDKQKCKDESEQQNH

SEQ ID NO: 1769577 - protein, 15 aa, Staphylococcus epidermidis
KDKQKSKDESEQQNH

SEQ ID NO: 1769578 - protein, 12 aa, Staphylococcus epidermidis
KDNEALKSNNQA

SEQ ID NO: 1769579 - protein, 6 aa, Staphylococcus epidermidis
KDNKTV

SEQ ID NO: 1769580 - protein, 7 aa, Staphylococcus epidermidis
KDNQPHT

SEQ ID NO: 1769581 - protein, 13 aa, Staphylococcus epidermidis
KDRNSYSKTDHDA

SEQ ID NO: 1769582 - protein, 8 aa, Staphylococcus epidermidis
KDRSRKEL

SEQ ID NO: 1769583 - protein, 8 aa, Staphylococcus epidermidis
KDSLTSHN

SEQ ID NO: 1769584 - protein, 9 aa, Staphylococcus epidermidis
KDVAADTGM

SEQ ID NO: 1769585 - protein, 6 aa, Staphylococcus epidermidis
KDYDGV

SEQ ID NO: 1769586 - protein, 7 aa, Staphylococcus epidermidis
KDYDGVT

SEQ ID NO: 1769587 - protein, 11 aa, Staphylococcus epidermidis
KDYEENTPLEE

SEQ ID NO: 1769588 - protein, 6 aa, Staphylococcus epidermidis
KDYKPE

SEQ ID NO: 1769589 - protein, 6 aa, Staphylococcus epidermidis
KEANVS

SEQ ID NO: 1769590 - protein, 9 aa, Staphylococcus epidermidis
KEATGGLDE

SEQ ID NO: 1769591 - protein, 8 aa, Staphylococcus epidermidis
KEAYHGGH

SEQ ID NO: 1769592 - protein, 7 aa, Staphylococcus epidermidis
KEDITAS

SEQ ID NO: 1769593 - protein, 8 aa, Staphylococcus epidermidis
KEDITASI

SEQ ID NO: 1769594 - protein, 4 aa, Staphylococcus epidermidis
KEEL

SEQ ID NO: 1769595 - protein, 7 aa, Staphylococcus epidermidis
KEGYFEQ

SEQ ID NO: 1769596 - protein, 10 aa, Staphylococcus epidermidis
KEHGITPKTI

SEQ ID NO: 1769597 - protein, 11 aa, Staphylococcus epidermidis
KEHGITPKTIN

SEQ ID NO: 1769598 - protein, 4 aa, Staphylococcus epidermidis
KEIS

SEQ ID NO: 1769599 - protein, 8 aa, Staphylococcus epidermidis
KEKETEIV

SEQ ID NO: 1769600 - protein, 4 aa, Staphylococcus epidermidis
KEKN

SEQ ID NO: 1769601 - protein, 9 aa, Staphylococcus epidermidis
KEKSISPKT

SEQ ID NO: 1769602 - protein, 11 aa, Staphylococcus epidermidis
KELEKSNNRPL

SEQ ID NO: 1769603 - protein, 5 aa, Staphylococcus epidermidis
KELGD

SEQ ID NO: 1769604 - protein, 8 aa, Staphylococcus epidermidis
KELTDKNI

SEQ ID NO: 1769605 - protein, 11 aa, Staphylococcus epidermidis
KEMKKAAKDLD

SEQ ID NO: 1769606 - protein, 20 aa, Staphylococcus epidermidis
KENKKLQNQIQKLYGDLYNK

SEQ ID NO: 1769607 - protein, 18 aa, Staphylococcus epidermidis
KEQDGLQNKEANESKTVE

SEQ ID NO: 1769608 - protein, 7 aa, Staphylococcus epidermidis
KEQDTNK

SEQ ID NO: 1769609 - protein, 11 aa, Staphylococcus epidermidis
KEQKTQAEQLS

SEQ ID NO: 1769610 - protein, 12 aa, Staphylococcus epidermidis
KEQKTQAEQLSE

SEQ ID NO: 1769611 - protein, 6 aa, Staphylococcus epidermidis
KEQPDA

SEQ ID NO: 1769612 - protein, 15 aa, Staphylococcus epidermidis
KETGMSSKEAQARAK

SEQ ID NO: 1769613 - protein, 6 aa, Staphylococcus epidermidis
KETQHF

SEQ ID NO: 1769614 - protein, 11 aa, Staphylococcus epidermidis
KEVAKDEKSYA

SEQ ID NO: 1769615 - protein, 12 aa, Staphylococcus epidermidis
KFDPELKNKILT

SEQ ID NO: 1769616 - protein, 5 aa, Staphylococcus epidermidis
KFGAN

SEQ ID NO: 1769617 - protein, 15 aa, Staphylococcus epidermidis
KFHSNKRRISNTGQR

SEQ ID NO: 1769618 - protein, 9 aa, Staphylococcus epidermidis
KFKGESIPT

SEQ ID NO: 1769619 - protein, 6 aa, Staphylococcus epidermidis
KFNPDL

SEQ ID NO: 1769620 - protein, 5 aa, Staphylococcus epidermidis
KFPER

SEQ ID NO: 1769621 - protein, 5 aa, Staphylococcus epidermidis
KGDER

SEQ ID NO: 1769622 - protein, 7 aa, Staphylococcus epidermidis
KGELDNN

SEQ ID NO: 1769623 - protein, 5 aa, Staphylococcus epidermidis
KGENI

SEQ ID NO: 1769624 - protein, 8 aa, Staphylococcus epidermidis
KGIGKGVG

SEQ ID NO: 1769625 - protein, 8 aa, Staphylococcus epidermidis
KGKNPSYV

SEQ ID NO: 1769626 - protein, 9 aa, Staphylococcus epidermidis
KGKYRVEDK

SEQ ID NO: 1769627 - protein, 8 aa, Staphylococcus epidermidis
KGLHREDV

SEQ ID NO: 1769628 - protein, 4 aa, Staphylococcus epidermidis
KGLN

SEQ ID NO: 1769629 - protein, 4 aa, Staphylococcus epidermidis
KGLQ

SEQ ID NO: 1769630 - protein, 5 aa, Staphylococcus epidermidis
KGPGH

SEQ ID NO: 1769631 - protein, 4 aa, Staphylococcus epidermidis
KGPL

SEQ ID NO: 1769632 - protein, 19 aa, Staphylococcus epidermidis
KGRESAYPSELSGGQKQRV

SEQ ID NO: 1769633 - protein, 4 aa, Staphylococcus epidermidis
KGRF

SEQ ID NO: 1769634 - protein, 6 aa, Staphylococcus epidermidis
KGRYQK

SEQ ID NO: 1769635 - protein, 6 aa, Staphylococcus epidermidis
KGSEKP

SEQ ID NO: 1769636 - protein, 12 aa, Staphylococcus epidermidis
KGYISATEDELH

SEQ ID NO: 1769637 - protein, 12 aa, Staphylococcus epidermidis
KGYISATEDEVH

SEQ ID NO: 1769638 - protein, 13 aa, Staphylococcus epidermidis
KGYPGSYEKGHEI

SEQ ID NO: 1769639 - protein, 9 aa, Staphylococcus epidermidis
KGYRGECDD

SEQ ID NO: 1769640 - protein, 8 aa, Staphylococcus epidermidis
KGYSTGGS

SEQ ID NO: 1769641 - protein, 6 aa, Staphylococcus epidermidis
KHDVSG

SEQ ID NO: 1769642 - protein, 6 aa, Staphylococcus epidermidis
KHQEGK

SEQ ID NO: 1769643 - protein, 4 aa, Staphylococcus epidermidis
KIAA

SEQ ID NO: 1769644 - protein, 6 aa, Staphylococcus epidermidis
KIAGEE

SEQ ID NO: 1769645 - protein, 6 aa, Staphylococcus epidermidis
KIDDQS

SEQ ID NO: 1769646 - protein, 7 aa, Staphylococcus epidermidis
KIDDQSM

SEQ ID NO: 1769647 - protein, 10 aa, Staphylococcus epidermidis
KIDEDKKEQF

SEQ ID NO: 1769648 - protein, 7 aa, Staphylococcus epidermidis
KIDGITD

SEQ ID NO: 1769649 - protein, 16 aa, Staphylococcus epidermidis
KIDGITDLRDETSLRT

SEQ ID NO: 1769650 - protein, 7 aa, Staphylococcus epidermidis
KIGEDAK

SEQ ID NO: 1769651 - protein, 6 aa, Staphylococcus epidermidis
KIGNKT

SEQ ID NO: 1769652 - protein, 10 aa, Staphylococcus epidermidis
KIGNTDSVRP

SEQ ID NO: 1769653 - protein, 13 aa, Staphylococcus epidermidis
KIKSKLEESGISN

SEQ ID NO: 1769654 - protein, 5 aa, Staphylococcus epidermidis
KIPTH

SEQ ID NO: 1769655 - protein, 8 aa, Staphylococcus epidermidis
KISESFPE

SEQ ID NO: 1769656 - protein, 4 aa, Staphylococcus epidermidis
KKAE

SEQ ID NO: 1769657 - protein, 10 aa, Staphylococcus epidermidis
KKAIREETTV

SEQ ID NO: 1769658 - protein, 8 aa, Staphylococcus epidermidis
KKAQGARL

SEQ ID NO: 1769659 - protein, 9 aa, Staphylococcus epidermidis
KKATTIEEV

SEQ ID NO: 1769660 - protein, 6 aa, Staphylococcus epidermidis
KKDDYV

SEQ ID NO: 1769661 - protein, 8 aa, Staphylococcus epidermidis
KKDGATIA

SEQ ID NO: 1769662 - protein, 9 aa, Staphylococcus epidermidis
KKDGATIAI

SEQ ID NO: 1769663 - protein, 4 aa, Staphylococcus epidermidis
KKDM

SEQ ID NO: 1769664 - protein, 11 aa, Staphylococcus epidermidis
KKDTLSEDEYQ

SEQ ID NO: 1769665 - protein, 7 aa, Staphylococcus epidermidis
KKDYKKY

SEQ ID NO: 1769666 - protein, 9 aa, Staphylococcus epidermidis
KKEKETEIV

SEQ ID NO: 1769667 - protein, 6 aa, Staphylococcus epidermidis
KKEPYG

SEQ ID NO: 1769668 - protein, 6 aa, Staphylococcus epidermidis
KKFNES

SEQ ID NO: 1769669 - protein, 5 aa, Staphylococcus epidermidis
KKGPL

SEQ ID NO: 1769670 - protein, 29 aa, Staphylococcus epidermidis
KKGVSKTTKNDSEIEKSNKENKLTGKVGE

SEQ ID NO: 1769671 - protein, 9 aa, Staphylococcus epidermidis
KKHREEYEK

SEQ ID NO: 1769672 - protein, 11 aa, Staphylococcus epidermidis
KKKKKEEEQIK

SEQ ID NO: 1769673 - protein, 9 aa, Staphylococcus epidermidis
KKLSDSAKV

SEQ ID NO: 1769674 - protein, 7 aa, Staphylococcus epidermidis
KKLSSEA

SEQ ID NO: 1769675 - protein, 8 aa, Staphylococcus epidermidis
KKNEDEAI

SEQ ID NO: 1769676 - protein, 7 aa, Staphylococcus epidermidis
KKNLPIN

SEQ ID NO: 1769677 - protein, 22 aa, Staphylococcus epidermidis
KKNPERYEQEQQDRASYVKNNH

SEQ ID NO: 1769678 - protein, 14 aa, Staphylococcus epidermidis
KKNWREAQKELGKN

SEQ ID NO: 1769679 - protein, 4 aa, Staphylococcus epidermidis
KKRG

SEQ ID NO: 1769680 - protein, 5 aa, Staphylococcus epidermidis
KKRGH

SEQ ID NO: 1769681 - protein, 5 aa, Staphylococcus epidermidis
KKSFN

SEQ ID NO: 1769682 - protein, 10 aa, Staphylococcus epidermidis
KKSKASLLTS

SEQ ID NO: 1769683 - protein, 11 aa, Staphylococcus epidermidis
KKSLNTKKTYA

SEQ ID NO: 1769684 - protein, 7 aa, Staphylococcus epidermidis
KKVEDSK

SEQ ID NO: 1769685 - protein, 11 aa, Staphylococcus epidermidis
KKVKSLSGGMK

SEQ ID NO: 1769686 - protein, 39 aa, Staphylococcus epidermidis
KLAKSRAESHLEDDDDNTDINRAKRALERANNRLRVAEL

SEQ ID NO: 1769687 - protein, 39 aa, Staphylococcus epidermidis
KLAKSRAESHLEEDDDNTDINRAKRALERANNRLRVAEL

SEQ ID NO: 1769688 - protein, 7 aa, Staphylococcus epidermidis
KLASSLP

SEQ ID NO: 1769689 - protein, 6 aa, Staphylococcus epidermidis
KLREQN

SEQ ID NO: 1769690 - protein, 6 aa, Staphylococcus epidermidis
KLRRPD

SEQ ID NO: 1769691 - protein, 13 aa, Staphylococcus epidermidis
KLSERKAKTIYSQ

SEQ ID NO: 1769692 - protein, 9 aa, Staphylococcus epidermidis
KMGPKETLN

SEQ ID NO: 1769693 - protein, 23 aa, Staphylococcus epidermidis
KMKRQERKQYSKKQNRQKRKNNK

SEQ ID NO: 1769694 - protein, 7 aa, Staphylococcus epidermidis
KMSEDLT

SEQ ID NO: 1769695 - protein, 15 aa, Staphylococcus epidermidis
KMSPQPDCGEDSYHG

SEQ ID NO: 1769696 - protein, 9 aa, Staphylococcus epidermidis
KNAKKNNLK

SEQ ID NO: 1769697 - protein, 6 aa, Staphylococcus epidermidis
KNAKLD

SEQ ID NO: 1769698 - protein, 9 aa, Staphylococcus epidermidis
KNASKIGNE

SEQ ID NO: 1769699 - protein, 9 aa, Staphylococcus epidermidis
KNEDKVPYY

SEQ ID NO: 1769700 - protein, 15 aa, Staphylococcus epidermidis
KNETFKGTEVSRKSV

SEQ ID NO: 1769701 - protein, 15 aa, Staphylococcus epidermidis
KNGRELNEDEMNQTR

SEQ ID NO: 1769702 - protein, 13 aa, Staphylococcus epidermidis
KNIQHSSELSEKA

SEQ ID NO: 1769703 - protein, 4 aa, Staphylococcus epidermidis
KNKE

SEQ ID NO: 1769704 - protein, 4 aa, Staphylococcus epidermidis
KNKN

SEQ ID NO: 1769705 - protein, 5 aa, Staphylococcus epidermidis
KNKNN

SEQ ID NO: 1769706 - protein, 8 aa, Staphylococcus epidermidis
KNKQFTVN

SEQ ID NO: 1769707 - protein, 11 aa, Staphylococcus epidermidis
KNRYSAKAWDN

SEQ ID NO: 1769708 - protein, 6 aa, Staphylococcus epidermidis
KNSQKI

SEQ ID NO: 1769709 - protein, 4 aa, Staphylococcus epidermidis
KNSV

SEQ ID NO: 1769710 - protein, 7 aa, Staphylococcus epidermidis
KNSYQAQ

SEQ ID NO: 1769711 - protein, 7 aa, Staphylococcus epidermidis
KNYRDKR

SEQ ID NO: 1769712 - protein, 8 aa, Staphylococcus epidermidis
KPDEHQSN

SEQ ID NO: 1769713 - protein, 5 aa, Staphylococcus epidermidis
KPIGS

SEQ ID NO: 1769714 - protein, 4 aa, Staphylococcus epidermidis
KPSV

SEQ ID NO: 1769715 - protein, 7 aa, Staphylococcus epidermidis
KPTDEGY

SEQ ID NO: 1769716 - protein, 4 aa, Staphylococcus epidermidis
KQDI

SEQ ID NO: 1769717 - protein, 19 aa, Staphylococcus epidermidis
KQENSTAYHRNHESQHRNE

SEQ ID NO: 1769718 - protein, 11 aa, Staphylococcus epidermidis
KQGMPSAKKKI

SEQ ID NO: 1769719 - protein, 13 aa, Staphylococcus epidermidis
KQGMPSAKKKIEE

SEQ ID NO: 1769720 - protein, 10 aa, Staphylococcus epidermidis
KQIEPISNKS

SEQ ID NO: 1769721 - protein, 11 aa, Staphylococcus epidermidis
KQIEPISNKSI

SEQ ID NO: 1769722 - protein, 14 aa, Staphylococcus epidermidis
KQKSKKTREKVDKA

SEQ ID NO: 1769723 - protein, 13 aa, Staphylococcus epidermidis
KQLEKQEKRHETT

SEQ ID NO: 1769724 - protein, 12 aa, Staphylococcus epidermidis
KQNNGVIKQAIN

SEQ ID NO: 1769725 - protein, 6 aa, Staphylococcus epidermidis
KQQESY

SEQ ID NO: 1769726 - protein, 7 aa, Staphylococcus epidermidis
KQQQYDE

SEQ ID NO: 1769727 - protein, 9 aa, Staphylococcus epidermidis
KQTPAHHTD

SEQ ID NO: 1769728 - protein, 6 aa, Staphylococcus epidermidis
KQTSDV

SEQ ID NO: 1769729 - protein, 4 aa, Staphylococcus epidermidis
KQVE

SEQ ID NO: 1769730 - protein, 5 aa, Staphylococcus epidermidis
KQVEE

SEQ ID NO: 1769731 - protein, 14 aa, Staphylococcus epidermidis
KQWQRQVETNSRVK

SEQ ID NO: 1769732 - protein, 8 aa, Staphylococcus epidermidis
KRAAAKQT

SEQ ID NO: 1769733 - protein, 8 aa, Staphylococcus epidermidis
KRAANEDT

SEQ ID NO: 1769734 - protein, 11 aa, Staphylococcus epidermidis
KRDAKKENPIP

SEQ ID NO: 1769735 - protein, 4 aa, Staphylococcus epidermidis
KRGI

SEQ ID NO: 1769736 - protein, 10 aa, Staphylococcus epidermidis
KRGIGPSSVE

SEQ ID NO: 1769737 - protein, 7 aa, Staphylococcus epidermidis
KRGKNAV

SEQ ID NO: 1769738 - protein, 6 aa, Staphylococcus epidermidis
KRKGMP

SEQ ID NO: 1769739 - protein, 8 aa, Staphylococcus epidermidis
KRNEDEAI

SEQ ID NO: 1769740 - protein, 21 aa, Staphylococcus epidermidis
KRNQVDQSFRETQIRTTQQQL

SEQ ID NO: 1769741 - protein, 6 aa, Staphylococcus epidermidis
KRRVDE

SEQ ID NO: 1769742 - protein, 9 aa, Staphylococcus epidermidis
KRTNKANTA

SEQ ID NO: 1769743 - protein, 11 aa, Staphylococcus epidermidis
KRVAGYAHEEG

SEQ ID NO: 1769744 - protein, 12 aa, Staphylococcus epidermidis
KRVAGYAHEEGK

SEQ ID NO: 1769745 - protein, 16 aa, Staphylococcus epidermidis
KSGDSLMDENTKNHLQ

SEQ ID NO: 1769746 - protein, 4 aa, Staphylococcus epidermidis
KSGL

SEQ ID NO: 1769747 - protein, 9 aa, Staphylococcus epidermidis
KSITETQYM

SEQ ID NO: 1769748 - protein, 8 aa, Staphylococcus epidermidis
KSKDNGKI

SEQ ID NO: 1769749 - protein, 5 aa, Staphylococcus epidermidis
KSKKG

SEQ ID NO: 1769750 - protein, 8 aa, Staphylococcus epidermidis
KSKNTITK

SEQ ID NO: 1769751 - protein, 11 aa, Staphylococcus epidermidis
KSLSAKVGAPR

SEQ ID NO: 1769752 - protein, 11 aa, Staphylococcus epidermidis
KSLSSDAELTK

SEQ ID NO: 1769753 - protein, 5 aa, Staphylococcus epidermidis
KSNAI

SEQ ID NO: 1769754 - protein, 4 aa, Staphylococcus epidermidis
KSNI

SEQ ID NO: 1769755 - protein, 6 aa, Staphylococcus epidermidis
KSNIKA

SEQ ID NO: 1769756 - protein, 8 aa, Staphylococcus epidermidis
KSPTVEQL

SEQ ID NO: 1769757 - protein, 6 aa, Staphylococcus epidermidis
KSQGHE

SEQ ID NO: 1769758 - protein, 6 aa, Staphylococcus epidermidis
KSRDHS

SEQ ID NO: 1769759 - protein, 7 aa, Staphylococcus epidermidis
KSRDHSR

SEQ ID NO: 1769760 - protein, 4 aa, Staphylococcus epidermidis
KTAK

SEQ ID NO: 1769761 - protein, 4 aa, Staphylococcus epidermidis
KTED

SEQ ID NO: 1769762 - protein, 5 aa, Staphylococcus epidermidis
KTENI

SEQ ID NO: 1769763 - protein, 6 aa, Staphylococcus epidermidis
KTENIA

SEQ ID NO: 1769764 - protein, 17 aa, Staphylococcus epidermidis
KTKNLPNANPQSNVIPK

SEQ ID NO: 1769765 - protein, 5 aa, Staphylococcus epidermidis
KTLTG

SEQ ID NO: 1769766 - protein, 5 aa, Staphylococcus epidermidis
KTLTS

SEQ ID NO: 1769767 - protein, 8 aa, Staphylococcus epidermidis
KTMNQEDQ

SEQ ID NO: 1769768 - protein, 9 aa, Staphylococcus epidermidis
KTMNQEDQL

SEQ ID NO: 1769769 - protein, 6 aa, Staphylococcus epidermidis
KTNDNE

SEQ ID NO: 1769770 - protein, 7 aa, Staphylococcus epidermidis
KTNSKTI

SEQ ID NO: 1769771 - protein, 6 aa, Staphylococcus epidermidis
KTPENL

SEQ ID NO: 1769772 - protein, 8 aa, Staphylococcus epidermidis
KTPHPDAD

SEQ ID NO: 1769773 - protein, 8 aa, Staphylococcus epidermidis
KTPHPNAD

SEQ ID NO: 1769774 - protein, 7 aa, Staphylococcus epidermidis
KTPNNND

SEQ ID NO: 1769775 - protein, 14 aa, Staphylococcus epidermidis
KTRVNRKHRDRGDQ

SEQ ID NO: 1769776 - protein, 7 aa, Staphylococcus epidermidis
KTSFNNS

SEQ ID NO: 1769777 - protein, 4 aa, Staphylococcus epidermidis
KTSI

SEQ ID NO: 1769778 - protein, 7 aa, Staphylococcus epidermidis
KTSSSWQ

SEQ ID NO: 1769779 - protein, 6 aa, Staphylococcus epidermidis
KTVPEF

SEQ ID NO: 1769780 - protein, 6 aa, Staphylococcus epidermidis
KTYNDV

SEQ ID NO: 1769781 - protein, 12 aa, Staphylococcus epidermidis
KVANAKKVKADF

SEQ ID NO: 1769782 - protein, 7 aa, Staphylococcus epidermidis
KVEKSKH

SEQ ID NO: 1769783 - protein, 8 aa, Staphylococcus epidermidis
KVEYRAEK

SEQ ID NO: 1769784 - protein, 6 aa, Staphylococcus epidermidis
KVKDPR

SEQ ID NO: 1769785 - protein, 7 aa, Staphylococcus epidermidis
KVKDPRV

SEQ ID NO: 1769786 - protein, 11 aa, Staphylococcus epidermidis
KVNSLEKEKKM

SEQ ID NO: 1769787 - protein, 6 aa, Staphylococcus epidermidis
KVQREK

SEQ ID NO: 1769788 - protein, 23 aa, Staphylococcus epidermidis
KVRSKSKRKVKPGYKKKFKQEVE

SEQ ID NO: 1769789 - protein, 8 aa, Staphylococcus epidermidis
KVSRPVLS

SEQ ID NO: 1769790 - protein, 7 aa, Staphylococcus epidermidis
KVYKSSD

SEQ ID NO: 1769791 - protein, 12 aa, Staphylococcus epidermidis
KWGELNKRTKYK

SEQ ID NO: 1769792 - protein, 5 aa, Staphylococcus epidermidis
KYEHN

SEQ ID NO: 1769793 - protein, 8 aa, Staphylococcus epidermidis
KYETDYRK

SEQ ID NO: 1769794 - protein, 14 aa, Staphylococcus epidermidis
KYGKSYLKEMGVEH

SEQ ID NO: 1769795 - protein, 6 aa, Staphylococcus epidermidis
KYLSEQ

SEQ ID NO: 1769796 - protein, 24 aa, Staphylococcus epidermidis
KYPEFKSTDSPTVRVGGEAQSSFE

SEQ ID NO: 1769797 - protein, 26 aa, Staphylococcus epidermidis
KYPEFKSTDSPTVRVGGEAQSSFEKV

SEQ ID NO: 1769798 - protein, 8 aa, Staphylococcus epidermidis
KYREEYEK

SEQ ID NO: 1769799 - protein, 6 aa, Staphylococcus epidermidis
KYSKKY

SEQ ID NO: 1769800 - protein, 8 aa, Staphylococcus epidermidis
KYSRETME

SEQ ID NO: 1769801 - protein, 22 aa, Staphylococcus epidermidis
LAQASSQDKDIANTSASKVDLA

SEQ ID NO: 1769802 - protein, 38 aa, Staphylococcus epidermidis
LAQASSQDKDIANTSASKVDLATTVGQEIAKKANDKGI

SEQ ID NO: 1769803 - protein, 4 aa, Staphylococcus epidermidis
LAQQ

SEQ ID NO: 1769804 - protein, 70 aa, Staphylococcus epidermidis
LARKNRSSKGGSRRSNHKRGNGKFDNKNRRSKGSKGQSSKKKNQKKFDRRDKQQKSGNQSLKGRTFADHQ

SEQ ID NO: 1769805 - protein, 6 aa, Staphylococcus epidermidis
LASSLP

SEQ ID NO: 1769806 - protein, 4 aa, Staphylococcus epidermidis
LDEA

SEQ ID NO: 1769807 - protein, 10 aa, Staphylococcus epidermidis
LEETKKTSDL

SEQ ID NO: 1769808 - protein, 11 aa, Staphylococcus epidermidis
LEFDREKAYGK

SEQ ID NO: 1769809 - protein, 6 aa, Staphylococcus epidermidis
LEGFNE

SEQ ID NO: 1769810 - protein, 8 aa, Staphylococcus epidermidis
LEKSNADR

SEQ ID NO: 1769811 - protein, 8 aa, Staphylococcus epidermidis
LENGSGHP

SEQ ID NO: 1769812 - protein, 11 aa, Staphylococcus epidermidis
LEQIPNQEHDE

SEQ ID NO: 1769813 - protein, 7 aa, Staphylococcus epidermidis
LESASQP

SEQ ID NO: 1769814 - protein, 4 aa, Staphylococcus epidermidis
LGKK

SEQ ID NO: 1769815 - protein, 9 aa, Staphylococcus epidermidis
LGKKGSVSG

SEQ ID NO: 1769816 - protein, 14 aa, Staphylococcus epidermidis
LGLPDSPGVPEGIA

SEQ ID NO: 1769817 - protein, 6 aa, Staphylococcus epidermidis
LGPEVE

SEQ ID NO: 1769818 - protein, 6 aa, Staphylococcus epidermidis
LGRTTK

SEQ ID NO: 1769819 - protein, 5 aa, Staphylococcus epidermidis
LGSKK

SEQ ID NO: 1769820 - protein, 5 aa, Staphylococcus epidermidis
LITDD

SEQ ID NO: 1769821 - protein, 11 aa, Staphylococcus epidermidis
LKAQQKQSVNF

SEQ ID NO: 1769822 - protein, 11 aa, Staphylococcus epidermidis
LKDKEDKYHYT

SEQ ID NO: 1769823 - protein, 4 aa, Staphylococcus epidermidis
LKEG

SEQ ID NO: 1769824 - protein, 9 aa, Staphylococcus epidermidis
LKESGLTNV

SEQ ID NO: 1769825 - protein, 7 aa, Staphylococcus epidermidis
LKGETTK

SEQ ID NO: 1769826 - protein, 7 aa, Staphylococcus epidermidis
LKGQTTK

SEQ ID NO: 1769827 - protein, 9 aa, Staphylococcus epidermidis
LKGYSTGGS

SEQ ID NO: 1769828 - protein, 11 aa, Staphylococcus epidermidis
LKKEGYFNQSN

SEQ ID NO: 1769829 - protein, 5 aa, Staphylococcus epidermidis
LKKGD

SEQ ID NO: 1769830 - protein, 10 aa, Staphylococcus epidermidis
LKKGDKHAEV

SEQ ID NO: 1769831 - protein, 10 aa, Staphylococcus epidermidis
LKSNPSSKKI

SEQ ID NO: 1769832 - protein, 7 aa, Staphylococcus epidermidis
LKSQGHE

SEQ ID NO: 1769833 - protein, 7 aa, Staphylococcus epidermidis
LMPEGGS

SEQ ID NO: 1769834 - protein, 8 aa, Staphylococcus epidermidis
LNAADEEA

SEQ ID NO: 1769835 - protein, 4 aa, Staphylococcus epidermidis
LNEE

SEQ ID NO: 1769836 - protein, 10 aa, Staphylococcus epidermidis
LNEQHERQQQ

SEQ ID NO: 1769837 - protein, 5 aa, Staphylococcus epidermidis
LNGDQ

SEQ ID NO: 1769838 - protein, 7 aa, Staphylococcus epidermidis
LNHTGAH

SEQ ID NO: 1769839 - protein, 12 aa, Staphylococcus epidermidis
LNPKARQKWILK

SEQ ID NO: 1769840 - protein, 4 aa, Staphylococcus epidermidis
LNRQ

SEQ ID NO: 1769841 - protein, 7 aa, Staphylococcus epidermidis
LPERPTT

SEQ ID NO: 1769842 - protein, 13 aa, Staphylococcus epidermidis
LPKHEKKNSSQID

SEQ ID NO: 1769843 - protein, 13 aa, Staphylococcus epidermidis
LPKRAGRNNQGKL

SEQ ID NO: 1769844 - protein, 13 aa, Staphylococcus epidermidis
LPLPDDKVNPTQY

SEQ ID NO: 1769845 - protein, 9 aa, Staphylococcus epidermidis
LPNITPQNE

SEQ ID NO: 1769846 - protein, 11 aa, Staphylococcus epidermidis
LPTKERNTQSI

SEQ ID NO: 1769847 - protein, 4 aa, Staphylococcus epidermidis
LQDT

SEQ ID NO: 1769848 - protein, 6 aa, Staphylococcus epidermidis
LQERSK

SEQ ID NO: 1769849 - protein, 4 aa, Staphylococcus epidermidis
LQSQ

SEQ ID NO: 1769850 - protein, 8 aa, Staphylococcus epidermidis
LRADKKVD

SEQ ID NO: 1769851 - protein, 9 aa, Staphylococcus epidermidis
LRADKKVDG

SEQ ID NO: 1769852 - protein, 12 aa, Staphylococcus epidermidis
LRSESSSRFEKG

SEQ ID NO: 1769853 - protein, 5 aa, Staphylococcus epidermidis
LSDPQ

SEQ ID NO: 1769854 - protein, 23 aa, Staphylococcus epidermidis
LSDRSDLAKYNDINNQNNDINYS

SEQ ID NO: 1769855 - protein, 5 aa, Staphylococcus epidermidis
LSGLG

SEQ ID NO: 1769856 - protein, 7 aa, Staphylococcus epidermidis
LSKKENY

SEQ ID NO: 1769857 - protein, 16 aa, Staphylococcus epidermidis
LSNDSTKHKYDVTTNN

SEQ ID NO: 1769858 - protein, 16 aa, Staphylococcus epidermidis
LSQGEIDKIDSLFPIK

SEQ ID NO: 1769859 - protein, 7 aa, Staphylococcus epidermidis
LSVGGDL

SEQ ID NO: 1769860 - protein, 10 aa, Staphylococcus epidermidis
LTKETENQFD

SEQ ID NO: 1769861 - protein, 12 aa, Staphylococcus epidermidis
LTNPNITKTLEE

SEQ ID NO: 1769862 - protein, 5 aa, Staphylococcus epidermidis
LTPQS

SEQ ID NO: 1769863 - protein, 11 aa, Staphylococcus epidermidis
LTPRERKQQMK

SEQ ID NO: 1769864 - protein, 14 aa, Staphylococcus epidermidis
LTRQGQLSGTVAEN

SEQ ID NO: 1769865 - protein, 5 aa, Staphylococcus epidermidis
LTYAT

SEQ ID NO: 1769866 - protein, 8 aa, Staphylococcus epidermidis
MAKTTNQP

SEQ ID NO: 1769867 - protein, 6 aa, Staphylococcus epidermidis
MDNPYG

SEQ ID NO: 1769868 - protein, 13 aa, Staphylococcus epidermidis
MGPAGLAESHPHN

SEQ ID NO: 1769869 - protein, 4 aa, Staphylococcus epidermidis
MKND

SEQ ID NO: 1769870 - protein, 8 aa, Staphylococcus epidermidis
MKTKDTET

SEQ ID NO: 1769871 - protein, 7 aa, Staphylococcus epidermidis
MKTREHE

SEQ ID NO: 1769872 - protein, 5 aa, Staphylococcus epidermidis
MNPND

SEQ ID NO: 1769873 - protein, 5 aa, Staphylococcus epidermidis
MNTVD

SEQ ID NO: 1769874 - protein, 4 aa, Staphylococcus epidermidis
MRET

SEQ ID NO: 1769875 - protein, 7 aa, Staphylococcus epidermidis
MSDSDED

SEQ ID NO: 1769876 - protein, 4 aa, Staphylococcus epidermidis
MTPE

SEQ ID NO: 1769877 - protein, 4 aa, Staphylococcus epidermidis
NAET

SEQ ID NO: 1769878 - protein, 8 aa, Staphylococcus epidermidis
NAKKNNLK

SEQ ID NO: 1769879 - protein, 17 aa, Staphylococcus epidermidis
NALDKTSGIIQYSDAFF

SEQ ID NO: 1769880 - protein, 56 aa, Staphylococcus epidermidis
NAQQSSQRAAQQATKSSRVTATKNKGQQSVSRQKAQSRSLMPSQRPYDSSAPYSSQ

SEQ ID NO: 1769881 - protein, 8 aa, Staphylococcus epidermidis
NDDTPQDD

SEQ ID NO: 1769882 - protein, 7 aa, Staphylococcus epidermidis
NDELRSL

SEQ ID NO: 1769883 - protein, 17 aa, Staphylococcus epidermidis
NDEQYRKALEKNKNNPS

SEQ ID NO: 1769884 - protein, 22 aa, Staphylococcus epidermidis
NDGAGAVFSEKENKHSEGNQGP

SEQ ID NO: 1769885 - protein, 5 aa, Staphylococcus epidermidis
NDGID

SEQ ID NO: 1769886 - protein, 5 aa, Staphylococcus epidermidis
NDIEE

SEQ ID NO: 1769887 - protein, 7 aa, Staphylococcus epidermidis
NDIPQSK

SEQ ID NO: 1769888 - protein, 7 aa, Staphylococcus epidermidis
NDIQSNA

SEQ ID NO: 1769889 - protein, 8 aa, Staphylococcus epidermidis
NDIQSNAI

SEQ ID NO: 1769890 - protein, 24 aa, Staphylococcus epidermidis
NDKMSAPIDEQPFAPITKDDEQAI

SEQ ID NO: 1769891 - protein, 15 aa, Staphylococcus epidermidis
NDNEAIQTDRSEQLG

SEQ ID NO: 1769892 - protein, 6 aa, Staphylococcus epidermidis
NDPRPM

SEQ ID NO: 1769893 - protein, 6 aa, Staphylococcus epidermidis
NDSKVT

SEQ ID NO: 1769894 - protein, 7 aa, Staphylococcus epidermidis
NDVGGDI

SEQ ID NO: 1769895 - protein, 4 aa, Staphylococcus epidermidis
NDVS

SEQ ID NO: 1769896 - protein, 18 aa, Staphylococcus epidermidis
NEATTQLQEKVNQQIRQP

SEQ ID NO: 1769897 - protein, 19 aa, Staphylococcus epidermidis
NEATTQLQEKVNQQVRQPL

SEQ ID NO: 1769898 - protein, 8 aa, Staphylococcus epidermidis
NEAVQEAG

SEQ ID NO: 1769899 - protein, 8 aa, Staphylococcus epidermidis
NEDKVPYY

SEQ ID NO: 1769900 - protein, 11 aa, Staphylococcus epidermidis
NEDNIKSLASK

SEQ ID NO: 1769901 - protein, 5 aa, Staphylococcus epidermidis
NEEIE

SEQ ID NO: 1769902 - protein, 9 aa, Staphylococcus epidermidis
NEGEGVNPD

SEQ ID NO: 1769903 - protein, 8 aa, Staphylococcus epidermidis
NEGEGVNS

SEQ ID NO: 1769904 - protein, 5 aa, Staphylococcus epidermidis
NEIRT

SEQ ID NO: 1769905 - protein, 8 aa, Staphylococcus epidermidis
NEMSDPQI

SEQ ID NO: 1769906 - protein, 9 aa, Staphylococcus epidermidis
NEMSDPQID

SEQ ID NO: 1769907 - protein, 9 aa, Staphylococcus epidermidis
NEQHERQQQ

SEQ ID NO: 1769908 - protein, 5 aa, Staphylococcus epidermidis
NETLT

SEQ ID NO: 1769909 - protein, 4 aa, Staphylococcus epidermidis
NEVQ

SEQ ID NO: 1769910 - protein, 4 aa, Staphylococcus epidermidis
NGDE

SEQ ID NO: 1769911 - protein, 5 aa, Staphylococcus epidermidis
NGDPI

SEQ ID NO: 1769912 - protein, 5 aa, Staphylococcus epidermidis
NGEDK

SEQ ID NO: 1769913 - protein, 10 aa, Staphylococcus epidermidis
NGETQVGEVA

SEQ ID NO: 1769914 - protein, 4 aa, Staphylococcus epidermidis
NGKE

SEQ ID NO: 1769915 - protein, 8 aa, Staphylococcus epidermidis
NGKEADEC

SEQ ID NO: 1769916 - protein, 6 aa, Staphylococcus epidermidis
NGKMSR

SEQ ID NO: 1769917 - protein, 11 aa, Staphylococcus epidermidis
NGQIQEPSYDP

SEQ ID NO: 1769918 - protein, 14 aa, Staphylococcus epidermidis
NGRELNEDEMNQTR

SEQ ID NO: 1769919 - protein, 7 aa, Staphylococcus epidermidis
NGVGKTT

SEQ ID NO: 1769920 - protein, 4 aa, Staphylococcus epidermidis
NGVS

SEQ ID NO: 1769921 - protein, 10 aa, Staphylococcus epidermidis
NGVSSAEVNL

SEQ ID NO: 1769922 - protein, 11 aa, Staphylococcus epidermidis
NGVSSAEVNLD

SEQ ID NO: 1769923 - protein, 5 aa, Staphylococcus epidermidis
NGYGQ

SEQ ID NO: 1769924 - protein, 4 aa, Staphylococcus epidermidis
NHEE

SEQ ID NO: 1769925 - protein, 16 aa, Staphylococcus epidermidis
NHYHSNDDAEVEDAEY

SEQ ID NO: 1769926 - protein, 10 aa, Staphylococcus epidermidis
NIDKANEMSN

SEQ ID NO: 1769927 - protein, 8 aa, Staphylococcus epidermidis
NIHPKSEY

SEQ ID NO: 1769928 - protein, 50 aa, Staphylococcus epidermidis
NIKETIGDATDNKDLKAEGKGDKASGKAKEVVDDVKDKANDLIDKVKGDK

SEQ ID NO: 1769929 - protein, 8 aa, Staphylococcus epidermidis
NIKNQASQ

SEQ ID NO: 1769930 - protein, 6 aa, Staphylococcus epidermidis
NIPTGR

SEQ ID NO: 1769931 - protein, 7 aa, Staphylococcus epidermidis
NIPTGRG

SEQ ID NO: 1769932 - protein, 7 aa, Staphylococcus epidermidis
NIQSSTL

SEQ ID NO: 1769933 - protein, 6 aa, Staphylococcus epidermidis
NISKQD

SEQ ID NO: 1769934 - protein, 9 aa, Staphylococcus epidermidis
NITKETKDG

SEQ ID NO: 1769935 - protein, 8 aa, Staphylococcus epidermidis
NKAKNSDI

SEQ ID NO: 1769936 - protein, 8 aa, Staphylococcus epidermidis
NKEQTQEE

SEQ ID NO: 1769937 - protein, 5 aa, Staphylococcus epidermidis
NKESI

SEQ ID NO: 1769938 - protein, 6 aa, Staphylococcus epidermidis
NKESNL

SEQ ID NO: 1769939 - protein, 13 aa, Staphylococcus epidermidis
NKESTEITPSFDQ

SEQ ID NO: 1769940 - protein, 15 aa, Staphylococcus epidermidis
NKETLRYGENPQQSA

SEQ ID NO: 1769941 - protein, 10 aa, Staphylococcus epidermidis
NKGAKNQHNN

SEQ ID NO: 1769942 - protein, 17 aa, Staphylococcus epidermidis
NKIEGKEVTIDHDGKEF

SEQ ID NO: 1769943 - protein, 7 aa, Staphylococcus epidermidis
NKINPEV

SEQ ID NO: 1769944 - protein, 16 aa, Staphylococcus epidermidis
NKKIQKLESQLEEERQ

SEQ ID NO: 1769945 - protein, 9 aa, Staphylococcus epidermidis
NKNDGKDAL

SEQ ID NO: 1769946 - protein, 4 aa, Staphylococcus epidermidis
NKQK

SEQ ID NO: 1769947 - protein, 5 aa, Staphylococcus epidermidis
NKQKN

SEQ ID NO: 1769948 - protein, 8 aa, Staphylococcus epidermidis
NKTGNTQV

SEQ ID NO: 1769949 - protein, 5 aa, Staphylococcus epidermidis
NKTHD

SEQ ID NO: 1769950 - protein, 9 aa, Staphylococcus epidermidis
NKVTEGSTV

SEQ ID NO: 1769951 - protein, 8 aa, Staphylococcus epidermidis
NLKGDINA

SEQ ID NO: 1769952 - protein, 8 aa, Staphylococcus epidermidis
NLKSSYSK

SEQ ID NO: 1769953 - protein, 4 aa, Staphylococcus epidermidis
NMEG

SEQ ID NO: 1769954 - protein, 4 aa, Staphylococcus epidermidis
NMGQ

SEQ ID NO: 1769955 - protein, 9 aa, Staphylococcus epidermidis
NNAKKANVK

SEQ ID NO: 1769956 - protein, 5 aa, Staphylococcus epidermidis
NNEPI

SEQ ID NO: 1769957 - protein, 5 aa, Staphylococcus epidermidis
NNEPN

SEQ ID NO: 1769958 - protein, 6 aa, Staphylococcus epidermidis
NNEPNV

SEQ ID NO: 1769959 - protein, 12 aa, Staphylococcus epidermidis
NNFDPKSKNEVD

SEQ ID NO: 1769960 - protein, 4 aa, Staphylococcus epidermidis
NNFQ

SEQ ID NO: 1769961 - protein, 9 aa, Staphylococcus epidermidis
NNGTLSGAA

SEQ ID NO: 1769962 - protein, 16 aa, Staphylococcus epidermidis
NNGTLSGAAIDTYENE

SEQ ID NO: 1769963 - protein, 8 aa, Staphylococcus epidermidis
NNLSPTNT

SEQ ID NO: 1769964 - protein, 7 aa, Staphylococcus epidermidis
NNNKEDE

SEQ ID NO: 1769965 - protein, 13 aa, Staphylococcus epidermidis
NNNKSRVSSFSSN

SEQ ID NO: 1769966 - protein, 8 aa, Staphylococcus epidermidis
NNNLGRDI

SEQ ID NO: 1769967 - protein, 23 aa, Staphylococcus epidermidis
NNPNDQEKEKEFKQTDKKDHSMN

SEQ ID NO: 1769968 - protein, 4 aa, Staphylococcus epidermidis
NNRG

SEQ ID NO: 1769969 - protein, 12 aa, Staphylococcus epidermidis
NNTQIKTSDAGH

SEQ ID NO: 1769970 - protein, 23 aa, Staphylococcus epidermidis
NPDKNVVPGSAEKVKRNSAEYYQ

SEQ ID NO: 1769971 - protein, 24 aa, Staphylococcus epidermidis
NPDKNVVPGSAEKVKRNSAEYYQA

SEQ ID NO: 1769972 - protein, 11 aa, Staphylococcus epidermidis
NPERKRTTYLT

SEQ ID NO: 1769973 - protein, 7 aa, Staphylococcus epidermidis
NPKIQTG

SEQ ID NO: 1769974 - protein, 8 aa, Staphylococcus epidermidis
NPNPYQSQ

SEQ ID NO: 1769975 - protein, 6 aa, Staphylococcus epidermidis
NPNWSS

SEQ ID NO: 1769976 - protein, 9 aa, Staphylococcus epidermidis
NQDTDNIGA

SEQ ID NO: 1769977 - protein, 9 aa, Staphylococcus epidermidis
NQDYSKRTL

SEQ ID NO: 1769978 - protein, 6 aa, Staphylococcus epidermidis
NQNALP

SEQ ID NO: 1769979 - protein, 4 aa, Staphylococcus epidermidis
NQQK

SEQ ID NO: 1769980 - protein, 5 aa, Staphylococcus epidermidis
NQTID

SEQ ID NO: 1769981 - protein, 7 aa, Staphylococcus epidermidis
NQTVSTV

SEQ ID NO: 1769982 - protein, 5 aa, Staphylococcus epidermidis
NQYGQ

SEQ ID NO: 1769983 - protein, 11 aa, Staphylococcus epidermidis
NRETKEKVTKI

SEQ ID NO: 1769984 - protein, 11 aa, Staphylococcus epidermidis
NREVSKDSRSF

SEQ ID NO: 1769985 - protein, 29 aa, Staphylococcus epidermidis
NRKPITATDDDLNDNNRARSAKLRVAEIL

SEQ ID NO: 1769986 - protein, 29 aa, Staphylococcus epidermidis
NRKPITATDDDLNENNRARSAKLRVAEIL

SEQ ID NO: 1769987 - protein, 12 aa, Staphylococcus epidermidis
NRNYTRESKERL

SEQ ID NO: 1769988 - protein, 13 aa, Staphylococcus epidermidis
NRNYTRESKERLN

SEQ ID NO: 1769989 - protein, 11 aa, Staphylococcus epidermidis
NRNYVEPRNDI

SEQ ID NO: 1769990 - protein, 12 aa, Staphylococcus epidermidis
NRNYVEPRNDIE

SEQ ID NO: 1769991 - protein, 10 aa, Staphylococcus epidermidis
NRSAKLAAQR

SEQ ID NO: 1769992 - protein, 11 aa, Staphylococcus epidermidis
NRSAKLAAQRG

SEQ ID NO: 1769993 - protein, 6 aa, Staphylococcus epidermidis
NRYSTE

SEQ ID NO: 1769994 - protein, 4 aa, Staphylococcus epidermidis
NSDE

SEQ ID NO: 1769995 - protein, 6 aa, Staphylococcus epidermidis
NSDNTY

SEQ ID NO: 1769996 - protein, 6 aa, Staphylococcus epidermidis
NSDSTY

SEQ ID NO: 1769997 - protein, 6 aa, Staphylococcus epidermidis
NSDSVI

SEQ ID NO: 1769998 - protein, 6 aa, Staphylococcus epidermidis
NSEQYG

SEQ ID NO: 1769999 - protein, 6 aa, Staphylococcus epidermidis
NSERYG

SEQ ID NO: 1770000 - protein, 10 aa, Staphylococcus epidermidis
NSGENSGTGV

SEQ ID NO: 1770001 - protein, 7 aa, Staphylococcus epidermidis
NSGKPCK

SEQ ID NO: 1770002 - protein, 15 aa, Staphylococcus epidermidis
NSKGACPNCGGKGYI

SEQ ID NO: 1770003 - protein, 22 aa, Staphylococcus epidermidis
NSLKSSNSDTGQTRKQRFGGSR

SEQ ID NO: 1770004 - protein, 22 aa, Staphylococcus epidermidis
NSNLAENKNLQTMDASKLESSA

SEQ ID NO: 1770005 - protein, 14 aa, Staphylococcus epidermidis
NSQQPERGKIYDRN

SEQ ID NO: 1770006 - protein, 15 aa, Staphylococcus epidermidis
NSQQPERGKIYDRNG

SEQ ID NO: 1770007 - protein, 15 aa, Staphylococcus epidermidis
NSYNQSTLRTLLNLD

SEQ ID NO: 1770008 - protein, 10 aa, Staphylococcus epidermidis
NTDYVNTQYQ

SEQ ID NO: 1770009 - protein, 5 aa, Staphylococcus epidermidis
NTQGA

SEQ ID NO: 1770010 - protein, 7 aa, Staphylococcus epidermidis
NTRTSKG

SEQ ID NO: 1770011 - protein, 5 aa, Staphylococcus epidermidis
NTSKS

SEQ ID NO: 1770012 - protein, 4 aa, Staphylococcus epidermidis
NTVD

SEQ ID NO: 1770013 - protein, 7 aa, Staphylococcus epidermidis
NVKKSEK

SEQ ID NO: 1770014 - protein, 6 aa, Staphylococcus epidermidis
NVSYDS

SEQ ID NO: 1770015 - protein, 7 aa, Staphylococcus epidermidis
NVTSSLA

SEQ ID NO: 1770016 - protein, 17 aa, Staphylococcus epidermidis
NYEASYSGWSPDYPDPT

SEQ ID NO: 1770017 - protein, 11 aa, Staphylococcus epidermidis
NYERKKEKQSV

SEQ ID NO: 1770018 - protein, 5 aa, Staphylococcus epidermidis
NYHGS

SEQ ID NO: 1770019 - protein, 5 aa, Staphylococcus epidermidis
NYQPT

SEQ ID NO: 1770020 - protein, 7 aa, Staphylococcus epidermidis
NYSKLNK

SEQ ID NO: 1770021 - protein, 6 aa, Staphylococcus epidermidis
NYYGYS

SEQ ID NO: 1770022 - protein, 12 aa, Staphylococcus epidermidis
PAGEERPLPTTA

SEQ ID NO: 1770023 - protein, 12 aa, Staphylococcus epidermidis
PAHQSVKRGTIQ

SEQ ID NO: 1770024 - protein, 19 aa, Staphylococcus epidermidis
PAHQSVKRGTIQVKRDGTP

SEQ ID NO: 1770025 - protein, 20 aa, Staphylococcus epidermidis
PANESRSPNEIKKDLDKKKE

SEQ ID NO: 1770026 - protein, 6 aa, Staphylococcus epidermidis
PATEEV

SEQ ID NO: 1770027 - protein, 5 aa, Staphylococcus epidermidis
PATIR

SEQ ID NO: 1770028 - protein, 6 aa, Staphylococcus epidermidis
PATIRN

SEQ ID NO: 1770029 - protein, 7 aa, Staphylococcus epidermidis
PATNTNR

SEQ ID NO: 1770030 - protein, 12 aa, Staphylococcus epidermidis
PAYQGPKHELDE

SEQ ID NO: 1770031 - protein, 13 aa, Staphylococcus epidermidis
PAYQGPKHELDEK

SEQ ID NO: 1770032 - protein, 10 aa, Staphylococcus epidermidis
PDGMPQDDTF

SEQ ID NO: 1770033 - protein, 11 aa, Staphylococcus epidermidis
PDGMPQDDTFK

SEQ ID NO: 1770034 - protein, 4 aa, Staphylococcus epidermidis
PDLP

SEQ ID NO: 1770035 - protein, 5 aa, Staphylococcus epidermidis
PDLPK

SEQ ID NO: 1770036 - protein, 12 aa, Staphylococcus epidermidis
PDLTKNNGYRDR

SEQ ID NO: 1770037 - protein, 8 aa, Staphylococcus epidermidis
PDNVAQQV

SEQ ID NO: 1770038 - protein, 4 aa, Staphylococcus epidermidis
PEDP

SEQ ID NO: 1770039 - protein, 5 aa, Staphylococcus epidermidis
PEEDY

SEQ ID NO: 1770040 - protein, 24 aa, Staphylococcus epidermidis
PEGSVLNGGVSHPHATEGIGSEKW

SEQ ID NO: 1770041 - protein, 12 aa, Staphylococcus epidermidis
PEKTTIKSIKLY

SEQ ID NO: 1770042 - protein, 6 aa, Staphylococcus epidermidis
PERAHG

SEQ ID NO: 1770043 - protein, 5 aa, Staphylococcus epidermidis
PEREI

SEQ ID NO: 1770044 - protein, 6 aa, Staphylococcus epidermidis
PERPTT

SEQ ID NO: 1770045 - protein, 4 aa, Staphylococcus epidermidis
PEVY

SEQ ID NO: 1770046 - protein, 5 aa, Staphylococcus epidermidis
PEYEA

SEQ ID NO: 1770047 - protein, 4 aa, Staphylococcus epidermidis
PFES

SEQ ID NO: 1770048 - protein, 10 aa, Staphylococcus epidermidis
PFKSPISTPK

SEQ ID NO: 1770049 - protein, 10 aa, Staphylococcus epidermidis
PGGKIDEGES

SEQ ID NO: 1770050 - protein, 12 aa, Staphylococcus epidermidis
PGSHGSTFGGNP

SEQ ID NO: 1770051 - protein, 12 aa, Staphylococcus epidermidis
PHNGCRPPKRRR

SEQ ID NO: 1770052 - protein, 10 aa, Staphylococcus epidermidis
PKDSYQLSED

SEQ ID NO: 1770053 - protein, 9 aa, Staphylococcus epidermidis
PKIPQGRGK

SEQ ID NO: 1770054 - protein, 19 aa, Staphylococcus epidermidis
PKLDERKKLTKTLKKNAQL

SEQ ID NO: 1770055 - protein, 6 aa, Staphylococcus epidermidis
PKNQEE

SEQ ID NO: 1770056 - protein, 7 aa, Staphylococcus epidermidis
PKNQEEL

SEQ ID NO: 1770057 - protein, 13 aa, Staphylococcus epidermidis
PKQSYEEKEELPD

SEQ ID NO: 1770058 - protein, 14 aa, Staphylococcus epidermidis
PKQSYEEKEELPDQ

SEQ ID NO: 1770059 - protein, 6 aa, Staphylococcus epidermidis
PKQVVS

SEQ ID NO: 1770060 - protein, 8 aa, Staphylococcus epidermidis
PKTPNNND

SEQ ID NO: 1770061 - protein, 6 aa, Staphylococcus epidermidis
PKVATY

SEQ ID NO: 1770062 - protein, 15 aa, Staphylococcus epidermidis
PKYGKSYLKEMGVEH

SEQ ID NO: 1770063 - protein, 4 aa, Staphylococcus epidermidis
PLAD

SEQ ID NO: 1770064 - protein, 5 aa, Staphylococcus epidermidis
PLADE

SEQ ID NO: 1770065 - protein, 4 aa, Staphylococcus epidermidis
PLPD

SEQ ID NO: 1770066 - protein, 5 aa, Staphylococcus epidermidis
PLPDN

SEQ ID NO: 1770067 - protein, 13 aa, Staphylococcus epidermidis
PMRGGLPNKEPQI

SEQ ID NO: 1770068 - protein, 8 aa, Staphylococcus epidermidis
PNAKPPVA

SEQ ID NO: 1770069 - protein, 4 aa, Staphylococcus epidermidis
PNAS

SEQ ID NO: 1770070 - protein, 7 aa, Staphylococcus epidermidis
PNGCARP

SEQ ID NO: 1770071 - protein, 21 aa, Staphylococcus epidermidis
PNINNTDHNPNAEAHRHASDW

SEQ ID NO: 1770072 - protein, 6 aa, Staphylococcus epidermidis
PNKRGY

SEQ ID NO: 1770073 - protein, 8 aa, Staphylococcus epidermidis
PNQTVSTV

SEQ ID NO: 1770074 - protein, 7 aa, Staphylococcus epidermidis
PNRYSTE

SEQ ID NO: 1770075 - protein, 4 aa, Staphylococcus epidermidis
PNSQ

SEQ ID NO: 1770076 - protein, 7 aa, Staphylococcus epidermidis
PNVGKST

SEQ ID NO: 1770077 - protein, 6 aa, Staphylococcus epidermidis
PNYHGS

SEQ ID NO: 1770078 - protein, 10 aa, Staphylococcus epidermidis
PQDTESYTHR

SEQ ID NO: 1770079 - protein, 4 aa, Staphylococcus epidermidis
PQLT

SEQ ID NO: 1770080 - protein, 4 aa, Staphylococcus epidermidis
PQMT

SEQ ID NO: 1770081 - protein, 7 aa, Staphylococcus epidermidis
PQRKGDP

SEQ ID NO: 1770082 - protein, 4 aa, Staphylococcus epidermidis
PQYG

SEQ ID NO: 1770083 - protein, 6 aa, Staphylococcus epidermidis
PRAEKR

SEQ ID NO: 1770084 - protein, 11 aa, Staphylococcus epidermidis
PRDKNAAKQRA

SEQ ID NO: 1770085 - protein, 8 aa, Staphylococcus epidermidis
PRYNKDGS

SEQ ID NO: 1770086 - protein, 15 aa, Staphylococcus epidermidis
PSEHTERSWDEVPEE

SEQ ID NO: 1770087 - protein, 5 aa, Staphylococcus epidermidis
PSLDD

SEQ ID NO: 1770088 - protein, 11 aa, Staphylococcus epidermidis
PSSPIPTTSNT

SEQ ID NO: 1770089 - protein, 6 aa, Staphylococcus epidermidis
PSTITG

SEQ ID NO: 1770090 - protein, 17 aa, Staphylococcus epidermidis
PSTYPPLSYSFDHLIIN

SEQ ID NO: 1770091 - protein, 5 aa, Staphylococcus epidermidis
PSYDA

SEQ ID NO: 1770092 - protein, 6 aa, Staphylococcus epidermidis
PTEDID

SEQ ID NO: 1770093 - protein, 6 aa, Staphylococcus epidermidis
PTEGID

SEQ ID NO: 1770094 - protein, 4 aa, Staphylococcus epidermidis
PTET

SEQ ID NO: 1770095 - protein, 17 aa, Staphylococcus epidermidis
PTILNENANKDSNTFST

SEQ ID NO: 1770096 - protein, 4 aa, Staphylococcus epidermidis
PTKK

SEQ ID NO: 1770097 - protein, 7 aa, Staphylococcus epidermidis
PTKNEEV

SEQ ID NO: 1770098 - protein, 8 aa, Staphylococcus epidermidis
PTKNEEVQ

SEQ ID NO: 1770099 - protein, 7 aa, Staphylococcus epidermidis
PTLSKDS

SEQ ID NO: 1770100 - protein, 5 aa, Staphylococcus epidermidis
PTPLD

SEQ ID NO: 1770101 - protein, 4 aa, Staphylococcus epidermidis
PTVD

SEQ ID NO: 1770102 - protein, 12 aa, Staphylococcus epidermidis
PVTNFEEANKSD

SEQ ID NO: 1770103 - protein, 4 aa, Staphylococcus epidermidis
PYFS

SEQ ID NO: 1770104 - protein, 6 aa, Staphylococcus epidermidis
QADKMG

SEQ ID NO: 1770105 - protein, 7 aa, Staphylococcus epidermidis
QAKDQMD

SEQ ID NO: 1770106 - protein, 8 aa, Staphylococcus epidermidis
QAKDQMDG

SEQ ID NO: 1770107 - protein, 11 aa, Staphylococcus epidermidis
QALRDSDEYKA

SEQ ID NO: 1770108 - protein, 4 aa, Staphylococcus epidermidis
QAYQ

SEQ ID NO: 1770109 - protein, 9 aa, Staphylococcus epidermidis
QDAGVKVPE

SEQ ID NO: 1770110 - protein, 17 aa, Staphylococcus epidermidis
QDDRDLRDERRKQKLEP

SEQ ID NO: 1770111 - protein, 6 aa, Staphylococcus epidermidis
QDINQN

SEQ ID NO: 1770112 - protein, 6 aa, Staphylococcus epidermidis
QDMKNE

SEQ ID NO: 1770113 - protein, 4 aa, Staphylococcus epidermidis
QDPH

SEQ ID NO: 1770114 - protein, 4 aa, Staphylococcus epidermidis
QDPL

SEQ ID NO: 1770115 - protein, 5 aa, Staphylococcus epidermidis
QDVPA

SEQ ID NO: 1770116 - protein, 8 aa, Staphylococcus epidermidis
QDYSKRTL

SEQ ID NO: 1770117 - protein, 8 aa, Staphylococcus epidermidis
QEAKGEDI

SEQ ID NO: 1770118 - protein, 9 aa, Staphylococcus epidermidis
QEAKGEDIA

SEQ ID NO: 1770119 - protein, 8 aa, Staphylococcus epidermidis
QEVENQEV

SEQ ID NO: 1770120 - protein, 26 aa, Staphylococcus epidermidis
QFENNPKTHESEVHTTSSRANNNGRF

SEQ ID NO: 1770121 - protein, 15 aa, Staphylococcus epidermidis
QFTQETTNFIQQHAP

SEQ ID NO: 1770122 - protein, 4 aa, Staphylococcus epidermidis
QGEV

SEQ ID NO: 1770123 - protein, 6 aa, Staphylococcus epidermidis
QGNELG

SEQ ID NO: 1770124 - protein, 5 aa, Staphylococcus epidermidis
QGSTF

SEQ ID NO: 1770125 - protein, 4 aa, Staphylococcus epidermidis
QGYT

SEQ ID NO: 1770126 - protein, 6 aa, Staphylococcus epidermidis
QHGRIE

SEQ ID NO: 1770127 - protein, 6 aa, Staphylococcus epidermidis
QHHDTK

SEQ ID NO: 1770128 - protein, 16 aa, Staphylococcus epidermidis
QHRPKTTGRSKGGNYV

SEQ ID NO: 1770129 - protein, 4 aa, Staphylococcus epidermidis
QIAR

SEQ ID NO: 1770130 - protein, 4 aa, Staphylococcus epidermidis
QIES

SEQ ID NO: 1770131 - protein, 8 aa, Staphylococcus epidermidis
QIQGKESQ

SEQ ID NO: 1770132 - protein, 9 aa, Staphylococcus epidermidis
QIQGKESQV

SEQ ID NO: 1770133 - protein, 7 aa, Staphylococcus epidermidis
QIRTLRS

SEQ ID NO: 1770134 - protein, 4 aa, Staphylococcus epidermidis
QKIG

SEQ ID NO: 1770135 - protein, 10 aa, Staphylococcus epidermidis
QKNDKHQTSE

SEQ ID NO: 1770136 - protein, 8 aa, Staphylococcus epidermidis
QKPDGNMD

SEQ ID NO: 1770137 - protein, 15 aa, Staphylococcus epidermidis
QKRNNFKGERKKVQE

SEQ ID NO: 1770138 - protein, 8 aa, Staphylococcus epidermidis
QKTEVESK

SEQ ID NO: 1770139 - protein, 17 aa, Staphylococcus epidermidis
QKTNANPVITSGHPDFT

SEQ ID NO: 1770140 - protein, 6 aa, Staphylococcus epidermidis
QKVNNN

SEQ ID NO: 1770141 - protein, 23 aa, Staphylococcus epidermidis
QKVPDAQPLKTIDDATKIIMRGE

SEQ ID NO: 1770142 - protein, 4 aa, Staphylococcus epidermidis
QKVS

SEQ ID NO: 1770143 - protein, 5 aa, Staphylococcus epidermidis
QLENR

SEQ ID NO: 1770144 - protein, 5 aa, Staphylococcus epidermidis
QLGKK

SEQ ID NO: 1770145 - protein, 5 aa, Staphylococcus epidermidis
QLNEE

SEQ ID NO: 1770146 - protein, 5 aa, Staphylococcus epidermidis
QLSDK

SEQ ID NO: 1770147 - protein, 12 aa, Staphylococcus epidermidis
QLSDSERQKIEV

SEQ ID NO: 1770148 - protein, 10 aa, Staphylococcus epidermidis
QLSREEQQAV

SEQ ID NO: 1770149 - protein, 8 aa, Staphylococcus epidermidis
QMHGPELP

SEQ ID NO: 1770150 - protein, 6 aa, Staphylococcus epidermidis
QMNRQN

SEQ ID NO: 1770151 - protein, 4 aa, Staphylococcus epidermidis
QMPP

SEQ ID NO: 1770152 - protein, 7 aa, Staphylococcus epidermidis
QNATSSV

SEQ ID NO: 1770153 - protein, 10 aa, Staphylococcus epidermidis
QNDASYENKI

SEQ ID NO: 1770154 - protein, 21 aa, Staphylococcus epidermidis
QNDASYENKIDAYPSSQGQKG

SEQ ID NO: 1770155 - protein, 14 aa, Staphylococcus epidermidis
QNEAVKLKQKYGLS

SEQ ID NO: 1770156 - protein, 8 aa, Staphylococcus epidermidis
QNEFTEDS

SEQ ID NO: 1770157 - protein, 4 aa, Staphylococcus epidermidis
QNIN

SEQ ID NO: 1770158 - protein, 5 aa, Staphylococcus epidermidis
QNKTY

SEQ ID NO: 1770159 - protein, 9 aa, Staphylococcus epidermidis
QNLSNNADL

SEQ ID NO: 1770160 - protein, 13 aa, Staphylococcus epidermidis
QNTHQYKNYEEAA

SEQ ID NO: 1770161 - protein, 7 aa, Staphylococcus epidermidis
QPIGENG

SEQ ID NO: 1770162 - protein, 7 aa, Staphylococcus epidermidis
QPNTKSN

SEQ ID NO: 1770163 - protein, 8 aa, Staphylococcus epidermidis
QPSKGTVT

SEQ ID NO: 1770164 - protein, 6 aa, Staphylococcus epidermidis
QPSLVR

SEQ ID NO: 1770165 - protein, 7 aa, Staphylococcus epidermidis
QPSLVRQ

SEQ ID NO: 1770166 - protein, 6 aa, Staphylococcus epidermidis
QPSYDA

SEQ ID NO: 1770167 - protein, 9 aa, Staphylococcus epidermidis
QQEPDGNMD

SEQ ID NO: 1770168 - protein, 13 aa, Staphylococcus epidermidis
QQGGLNHASIYNG

SEQ ID NO: 1770169 - protein, 13 aa, Staphylococcus epidermidis
QQGIENYTDEEAA

SEQ ID NO: 1770170 - protein, 7 aa, Staphylococcus epidermidis
QQHQGDK

SEQ ID NO: 1770171 - protein, 8 aa, Staphylococcus epidermidis
QQHQGDKF

SEQ ID NO: 1770172 - protein, 5 aa, Staphylococcus epidermidis
QQKFR

SEQ ID NO: 1770173 - protein, 5 aa, Staphylococcus epidermidis
QQQYT

SEQ ID NO: 1770174 - protein, 18 aa, Staphylococcus epidermidis
QRAKNNQKNYKKTISIFF

SEQ ID NO: 1770175 - protein, 6 aa, Staphylococcus epidermidis
QRDNHS

SEQ ID NO: 1770176 - protein, 18 aa, Staphylococcus epidermidis
QRELEEEVGLSNNKSQNM

SEQ ID NO: 1770177 - protein, 4 aa, Staphylococcus epidermidis
QRKA

SEQ ID NO: 1770178 - protein, 6 aa, Staphylococcus epidermidis
QSAGSM

SEQ ID NO: 1770179 - protein, 10 aa, Staphylococcus epidermidis
QSAKSLRGAK

SEQ ID NO: 1770180 - protein, 5 aa, Staphylococcus epidermidis
QSEIS

SEQ ID NO: 1770181 - protein, 17 aa, Staphylococcus epidermidis
QSFEKGKNQNHLTDEDV

SEQ ID NO: 1770182 - protein, 6 aa, Staphylococcus epidermidis
QSGHEN

SEQ ID NO: 1770183 - protein, 7 aa, Staphylococcus epidermidis
QSGHENA

SEQ ID NO: 1770184 - protein, 12 aa, Staphylococcus epidermidis
QSGIGKVNASIS

SEQ ID NO: 1770185 - protein, 11 aa, Staphylococcus epidermidis
QSIASKSQIRK

SEQ ID NO: 1770186 - protein, 18 aa, Staphylococcus epidermidis
QSLRNELSESEKQKADQE

SEQ ID NO: 1770187 - protein, 6 aa, Staphylococcus epidermidis
QSNNGR

SEQ ID NO: 1770188 - protein, 10 aa, Staphylococcus epidermidis
QSQKEAQKRL

SEQ ID NO: 1770189 - protein, 6 aa, Staphylococcus epidermidis
QSSPSL

SEQ ID NO: 1770190 - protein, 15 aa, Staphylococcus epidermidis
QSSTKNEDSPLSNER

SEQ ID NO: 1770191 - protein, 4 aa, Staphylococcus epidermidis
QTAK

SEQ ID NO: 1770192 - protein, 20 aa, Staphylococcus epidermidis
QTHGKKKPIQKHKKINPKRL

SEQ ID NO: 1770193 - protein, 4 aa, Staphylococcus epidermidis
QTKK

SEQ ID NO: 1770194 - protein, 5 aa, Staphylococcus epidermidis
QTKKR

SEQ ID NO: 1770195 - protein, 8 aa, Staphylococcus epidermidis
QTPEERFK

SEQ ID NO: 1770196 - protein, 5 aa, Staphylococcus epidermidis
QTPVT

SEQ ID NO: 1770197 - protein, 6 aa, Staphylococcus epidermidis
QTTRSI

SEQ ID NO: 1770198 - protein, 5 aa, Staphylococcus epidermidis
QTYDS

SEQ ID NO: 1770199 - protein, 6 aa, Staphylococcus epidermidis
QVDPEE

SEQ ID NO: 1770200 - protein, 9 aa, Staphylococcus epidermidis
QVKPTTMAT

SEQ ID NO: 1770201 - protein, 11 aa, Staphylococcus epidermidis
QVTQQPTQPIN

SEQ ID NO: 1770202 - protein, 8 aa, Staphylococcus epidermidis
QVYPQDTN

SEQ ID NO: 1770203 - protein, 8 aa, Staphylococcus epidermidis
QYDTPDNI

SEQ ID NO: 1770204 - protein, 9 aa, Staphylococcus epidermidis
QYDTPDNIL

SEQ ID NO: 1770205 - protein, 12 aa, Staphylococcus epidermidis
QYSRTDNQQTVP

SEQ ID NO: 1770206 - protein, 5 aa, Staphylococcus epidermidis
RAEKR

SEQ ID NO: 1770207 - protein, 12 aa, Staphylococcus epidermidis
RAENNQKNYKKD

SEQ ID NO: 1770208 - protein, 4 aa, Staphylococcus epidermidis
RAQA

SEQ ID NO: 1770209 - protein, 12 aa, Staphylococcus epidermidis
RARGEAIKGIKG

SEQ ID NO: 1770210 - protein, 6 aa, Staphylococcus epidermidis
RASAAN

SEQ ID NO: 1770211 - protein, 4 aa, Staphylococcus epidermidis
RASQ

SEQ ID NO: 1770212 - protein, 5 aa, Staphylococcus epidermidis
RATYD

SEQ ID NO: 1770213 - protein, 4 aa, Staphylococcus epidermidis
RDDK

SEQ ID NO: 1770214 - protein, 8 aa, Staphylococcus epidermidis
RDDRPLKN

SEQ ID NO: 1770215 - protein, 6 aa, Staphylococcus epidermidis
RDEEIR

SEQ ID NO: 1770216 - protein, 10 aa, Staphylococcus epidermidis
RDKLNQYTHE

SEQ ID NO: 1770217 - protein, 7 aa, Staphylococcus epidermidis
RDKLSQK

SEQ ID NO: 1770218 - protein, 9 aa, Staphylococcus epidermidis
RDLNAERDL

SEQ ID NO: 1770219 - protein, 10 aa, Staphylococcus epidermidis
RDMPWRETTN

SEQ ID NO: 1770220 - protein, 9 aa, Staphylococcus epidermidis
RDNETEAFR

SEQ ID NO: 1770221 - protein, 7 aa, Staphylococcus epidermidis
RDSYLPP

SEQ ID NO: 1770222 - protein, 10 aa, Staphylococcus epidermidis
RDTKERGRTM

SEQ ID NO: 1770223 - protein, 7 aa, Staphylococcus epidermidis
REEAVSK

SEQ ID NO: 1770224 - protein, 29 aa, Staphylococcus epidermidis
REEEFSPLKNKEGKDSVHTATEDLKRMDL

SEQ ID NO: 1770225 - protein, 7 aa, Staphylococcus epidermidis
REEGPFL

SEQ ID NO: 1770226 - protein, 7 aa, Staphylococcus epidermidis
REEPTYE

SEQ ID NO: 1770227 - protein, 6 aa, Staphylococcus epidermidis
REEWEK

SEQ ID NO: 1770228 - protein, 8 aa, Staphylococcus epidermidis
REGEIEGT

SEQ ID NO: 1770229 - protein, 10 aa, Staphylococcus epidermidis
REGQEDKDAI

SEQ ID NO: 1770230 - protein, 9 aa, Staphylococcus epidermidis
RELKPGEAL

SEQ ID NO: 1770231 - protein, 9 aa, Staphylococcus epidermidis
REQFSKESI

SEQ ID NO: 1770232 - protein, 8 aa, Staphylococcus epidermidis
RESTEDYV

SEQ ID NO: 1770233 - protein, 9 aa, Staphylococcus epidermidis
RETNNFPEF

SEQ ID NO: 1770234 - protein, 4 aa, Staphylococcus epidermidis
RGAA

SEQ ID NO: 1770235 - protein, 6 aa, Staphylococcus epidermidis
RGEAYQ

SEQ ID NO: 1770236 - protein, 15 aa, Staphylococcus epidermidis
RGKDYDSANPPLYDS

SEQ ID NO: 1770237 - protein, 16 aa, Staphylococcus epidermidis
RGKDYDSANPPLYDSS

SEQ ID NO: 1770238 - protein, 11 aa, Staphylococcus epidermidis
RGKKPTEEELQ

SEQ ID NO: 1770239 - protein, 10 aa, Staphylococcus epidermidis
RGNVDKNMQN

SEQ ID NO: 1770240 - protein, 4 aa, Staphylococcus epidermidis
RGSL

SEQ ID NO: 1770241 - protein, 6 aa, Staphylococcus epidermidis
RIEDGE

SEQ ID NO: 1770242 - protein, 11 aa, Staphylococcus epidermidis
RIEEEDNVGTM

SEQ ID NO: 1770243 - protein, 5 aa, Staphylococcus epidermidis
RIENT

SEQ ID NO: 1770244 - protein, 28 aa, Staphylococcus epidermidis
RIHNKRQPQITNIGKSRQYTNREKTPKW

SEQ ID NO: 1770245 - protein, 8 aa, Staphylococcus epidermidis
RIQSSNVD

SEQ ID NO: 1770246 - protein, 6 aa, Staphylococcus epidermidis
RITPQR

SEQ ID NO: 1770247 - protein, 4 aa, Staphylococcus epidermidis
RITT

SEQ ID NO: 1770248 - protein, 14 aa, Staphylococcus epidermidis
RKDGSPLKQETFRG

SEQ ID NO: 1770249 - protein, 7 aa, Staphylococcus epidermidis
RKGPNIK

SEQ ID NO: 1770250 - protein, 8 aa, Staphylococcus epidermidis
RKGPNIKL

SEQ ID NO: 1770251 - protein, 10 aa, Staphylococcus epidermidis
RKKKEEEQIK

SEQ ID NO: 1770252 - protein, 14 aa, Staphylococcus epidermidis
RKKQVVPQITEVLT

SEQ ID NO: 1770253 - protein, 4 aa, Staphylococcus epidermidis
RKNS

SEQ ID NO: 1770254 - protein, 14 aa, Staphylococcus epidermidis
RKPKALSGGQRQRV

SEQ ID NO: 1770255 - protein, 5 aa, Staphylococcus epidermidis
RKRPG

SEQ ID NO: 1770256 - protein, 5 aa, Staphylococcus epidermidis
RLRAE

SEQ ID NO: 1770257 - protein, 7 aa, Staphylococcus epidermidis
RLRAEKK

SEQ ID NO: 1770258 - protein, 11 aa, Staphylococcus epidermidis
RLRETNNFPEF

SEQ ID NO: 1770259 - protein, 4 aa, Staphylococcus epidermidis
RLSE

SEQ ID NO: 1770260 - protein, 8 aa, Staphylococcus epidermidis
RMGDNAAS

SEQ ID NO: 1770261 - protein, 8 aa, Staphylococcus epidermidis
RMKTREHE

SEQ ID NO: 1770262 - protein, 6 aa, Staphylococcus epidermidis
RNEVPE

SEQ ID NO: 1770263 - protein, 7 aa, Staphylococcus epidermidis
RNEVPEV

SEQ ID NO: 1770264 - protein, 8 aa, Staphylococcus epidermidis
RNGSGKST

SEQ ID NO: 1770265 - protein, 11 aa, Staphylococcus epidermidis
RNPTNSKPLKE

SEQ ID NO: 1770266 - protein, 12 aa, Staphylococcus epidermidis
RNPTNSKSLKEM

SEQ ID NO: 1770267 - protein, 7 aa, Staphylococcus epidermidis
RNPWEGL

SEQ ID NO: 1770268 - protein, 7 aa, Staphylococcus epidermidis
RNVGEEK

SEQ ID NO: 1770269 - protein, 11 aa, Staphylococcus epidermidis
RPESQHKGYGT

SEQ ID NO: 1770270 - protein, 10 aa, Staphylococcus epidermidis
RPESQHRGYG

SEQ ID NO: 1770271 - protein, 7 aa, Staphylococcus epidermidis
RPKENDK

SEQ ID NO: 1770272 - protein, 8 aa, Staphylococcus epidermidis
RPKENDKF

SEQ ID NO: 1770273 - protein, 5 aa, Staphylococcus epidermidis
RPTVD

SEQ ID NO: 1770274 - protein, 9 aa, Staphylococcus epidermidis
RQARKNADL

SEQ ID NO: 1770275 - protein, 7 aa, Staphylococcus epidermidis
RQPDKDV

SEQ ID NO: 1770276 - protein, 4 aa, Staphylococcus epidermidis
RQRQ

SEQ ID NO: 1770277 - protein, 12 aa, Staphylococcus epidermidis
RRGKKPTEEELQ

SEQ ID NO: 1770278 - protein, 8 aa, Staphylococcus epidermidis
RRQPDKDV

SEQ ID NO: 1770279 - protein, 4 aa, Staphylococcus epidermidis
RRSR

SEQ ID NO: 1770280 - protein, 9 aa, Staphylococcus epidermidis
RSIEKPTTR

SEQ ID NO: 1770281 - protein, 4 aa, Staphylococcus epidermidis
RSIG

SEQ ID NO: 1770282 - protein, 11 aa, Staphylococcus epidermidis
RSMEENEVSKY

SEQ ID NO: 1770283 - protein, 8 aa, Staphylococcus epidermidis
RTNKANTA

SEQ ID NO: 1770284 - protein, 6 aa, Staphylococcus epidermidis
RTPEDY

SEQ ID NO: 1770285 - protein, 5 aa, Staphylococcus epidermidis
RTPEN

SEQ ID NO: 1770286 - protein, 5 aa, Staphylococcus epidermidis
RTRAS

SEQ ID NO: 1770287 - protein, 12 aa, Staphylococcus epidermidis
RTYHTGDKAKIE

SEQ ID NO: 1770288 - protein, 12 aa, Staphylococcus epidermidis
RVKSSKNSTLNT

SEQ ID NO: 1770289 - protein, 4 aa, Staphylococcus epidermidis
RVNP

SEQ ID NO: 1770290 - protein, 8 aa, Staphylococcus epidermidis
RYATPSQL

SEQ ID NO: 1770291 - protein, 5 aa, Staphylococcus epidermidis
SADRF

SEQ ID NO: 1770292 - protein, 17 aa, Staphylococcus epidermidis
SAEADAFKGKISNESPM

SEQ ID NO: 1770293 - protein, 18 aa, Staphylococcus epidermidis
SAEADAFKGKISNESPMA

SEQ ID NO: 1770294 - protein, 12 aa, Staphylococcus epidermidis
SAHASENADEAL

SEQ ID NO: 1770295 - protein, 14 aa, Staphylococcus epidermidis
SALGPGGLTRERAQ

SEQ ID NO: 1770296 - protein, 15 aa, Staphylococcus epidermidis
SAMKQASDESFGYTE

SEQ ID NO: 1770297 - protein, 16 aa, Staphylococcus epidermidis
SAMKQASDESFGYTED

SEQ ID NO: 1770298 - protein, 8 aa, Staphylococcus epidermidis
SASQVTRN

SEQ ID NO: 1770299 - protein, 7 aa, Staphylococcus epidermidis
SCPSGAM

SEQ ID NO: 1770300 - protein, 16 aa, Staphylococcus epidermidis
SDGKPTSVPDVEPETS

SEQ ID NO: 1770301 - protein, 17 aa, Staphylococcus epidermidis
SDGKPTSVPDVEPETSV

SEQ ID NO: 1770302 - protein, 5 aa, Staphylococcus epidermidis
SDLKE

SEQ ID NO: 1770303 - protein, 7 aa, Staphylococcus epidermidis
SDMGGDY

SEQ ID NO: 1770304 - protein, 4 aa, Staphylococcus epidermidis
SDNP

SEQ ID NO: 1770305 - protein, 5 aa, Staphylococcus epidermidis
SDNPH

SEQ ID NO: 1770306 - protein, 4 aa, Staphylococcus epidermidis
SDQV

SEQ ID NO: 1770307 - protein, 8 aa, Staphylococcus epidermidis
SDRHHDEI

SEQ ID NO: 1770308 - protein, 16 aa, Staphylococcus epidermidis
SDRTKERLKESIERKI

SEQ ID NO: 1770309 - protein, 5 aa, Staphylococcus epidermidis
SDTDL

SEQ ID NO: 1770310 - protein, 6 aa, Staphylococcus epidermidis
SDTDLS

SEQ ID NO: 1770311 - protein, 10 aa, Staphylococcus epidermidis
SDTSAGAGMQ

SEQ ID NO: 1770312 - protein, 14 aa, Staphylococcus epidermidis
SDVKTQHTQDKGEL

SEQ ID NO: 1770313 - protein, 9 aa, Staphylococcus epidermidis
SDYVRHGEK

SEQ ID NO: 1770314 - protein, 8 aa, Staphylococcus epidermidis
SEENHKLK

SEQ ID NO: 1770315 - protein, 11 aa, Staphylococcus epidermidis
SEENHKLKKEL

SEQ ID NO: 1770316 - protein, 4 aa, Staphylococcus epidermidis
SEEV

SEQ ID NO: 1770317 - protein, 7 aa, Staphylococcus epidermidis
SEGAFAK

SEQ ID NO: 1770318 - protein, 5 aa, Staphylococcus epidermidis
SEHLE

SEQ ID NO: 1770319 - protein, 7 aa, Staphylococcus epidermidis
SEHTPTS

SEQ ID NO: 1770320 - protein, 4 aa, Staphylococcus epidermidis
SEIA

SEQ ID NO: 1770321 - protein, 13 aa, Staphylococcus epidermidis
SEKPDINYEDDGG

SEQ ID NO: 1770322 - protein, 8 aa, Staphylococcus epidermidis
SENEETGQ

SEQ ID NO: 1770323 - protein, 19 aa, Staphylococcus epidermidis
SENHVPTAAGLASSASAYA

SEQ ID NO: 1770324 - protein, 8 aa, Staphylococcus epidermidis
SENSLRSA

SEQ ID NO: 1770325 - protein, 7 aa, Staphylococcus epidermidis
SESSKGN

SEQ ID NO: 1770326 - protein, 12 aa, Staphylococcus epidermidis
SEYDKKSLIESN

SEQ ID NO: 1770327 - protein, 6 aa, Staphylococcus epidermidis
SFNSFK

SEQ ID NO: 1770328 - protein, 7 aa, Staphylococcus epidermidis
SFQETTR

SEQ ID NO: 1770329 - protein, 7 aa, Staphylococcus epidermidis
SGAITSA

SEQ ID NO: 1770330 - protein, 13 aa, Staphylococcus epidermidis
SGAYYGGDTLKST

SEQ ID NO: 1770331 - protein, 14 aa, Staphylococcus epidermidis
SGAYYGGDTLKSTK

SEQ ID NO: 1770332 - protein, 10 aa, Staphylococcus epidermidis
SGKGGVGKST

SEQ ID NO: 1770333 - protein, 15 aa, Staphylococcus epidermidis
SGMKGATANIDNVKK

SEQ ID NO: 1770334 - protein, 5 aa, Staphylococcus epidermidis
SGMNA

SEQ ID NO: 1770335 - protein, 4 aa, Staphylococcus epidermidis
SGNG

SEQ ID NO: 1770336 - protein, 11 aa, Staphylococcus epidermidis
SGNKSQNKDNY

SEQ ID NO: 1770337 - protein, 13 aa, Staphylococcus epidermidis
SGSPNQNGSNEEY

SEQ ID NO: 1770338 - protein, 8 aa, Staphylococcus epidermidis
SGTAKLDG

SEQ ID NO: 1770339 - protein, 9 aa, Staphylococcus epidermidis
SGTAKLDGI

SEQ ID NO: 1770340 - protein, 8 aa, Staphylococcus epidermidis
SGTEANEA

SEQ ID NO: 1770341 - protein, 8 aa, Staphylococcus epidermidis
SGTYGDVD

SEQ ID NO: 1770342 - protein, 5 aa, Staphylococcus epidermidis
SHLDQ

SEQ ID NO: 1770343 - protein, 4 aa, Staphylococcus epidermidis
SHNQ

SEQ ID NO: 1770344 - protein, 5 aa, Staphylococcus epidermidis
SHQSL

SEQ ID NO: 1770345 - protein, 9 aa, Staphylococcus epidermidis
SIDNRKGQE

SEQ ID NO: 1770346 - protein, 6 aa, Staphylococcus epidermidis
SIEDIP

SEQ ID NO: 1770347 - protein, 9 aa, Staphylococcus epidermidis
SIGKPLPNR

SEQ ID NO: 1770348 - protein, 6 aa, Staphylococcus epidermidis
SIGKRP

SEQ ID NO: 1770349 - protein, 14 aa, Staphylococcus epidermidis
SIQTNKNGVGAFFM

SEQ ID NO: 1770350 - protein, 10 aa, Staphylococcus epidermidis
SITYGGTGQS

SEQ ID NO: 1770351 - protein, 12 aa, Staphylococcus epidermidis
SKDGKLSGPNFD

SEQ ID NO: 1770352 - protein, 4 aa, Staphylococcus epidermidis
SKDI

SEQ ID NO: 1770353 - protein, 8 aa, Staphylococcus epidermidis
SKETQSHI

SEQ ID NO: 1770354 - protein, 9 aa, Staphylococcus epidermidis
SKETQSHIN

SEQ ID NO: 1770355 - protein, 8 aa, Staphylococcus epidermidis
SKFNNRKF

SEQ ID NO: 1770356 - protein, 14 aa, Staphylococcus epidermidis
SKGACPNCGGKGYI

SEQ ID NO: 1770357 - protein, 11 aa, Staphylococcus epidermidis
SKNKETRNSLN

SEQ ID NO: 1770358 - protein, 7 aa, Staphylococcus epidermidis
SKNPALR

SEQ ID NO: 1770359 - protein, 6 aa, Staphylococcus epidermidis
SKNPYY

SEQ ID NO: 1770360 - protein, 17 aa, Staphylococcus epidermidis
SKPPHALSPEERKKPVD

SEQ ID NO: 1770361 - protein, 17 aa, Staphylococcus epidermidis
SKPPHALSSEERKKPVD

SEQ ID NO: 1770362 - protein, 20 aa, Staphylococcus epidermidis
SKRELTKVEKSLNKHNVNSV

SEQ ID NO: 1770363 - protein, 7 aa, Staphylococcus epidermidis
SKRQLTN

SEQ ID NO: 1770364 - protein, 10 aa, Staphylococcus epidermidis
SKSNHSNKIE

SEQ ID NO: 1770365 - protein, 12 aa, Staphylococcus epidermidis
SKTAFDGRGNYT

SEQ ID NO: 1770366 - protein, 13 aa, Staphylococcus epidermidis
SKTAFDGRGNYTL

SEQ ID NO: 1770367 - protein, 11 aa, Staphylococcus epidermidis
SKTEIQPGDDI

SEQ ID NO: 1770368 - protein, 12 aa, Staphylococcus epidermidis
SKTEIQPGDDIG

SEQ ID NO: 1770369 - protein, 4 aa, Staphylococcus epidermidis
SKTF

SEQ ID NO: 1770370 - protein, 4 aa, Staphylococcus epidermidis
SKVT

SEQ ID NO: 1770371 - protein, 10 aa, Staphylococcus epidermidis
SKVTKTSYDS

SEQ ID NO: 1770372 - protein, 7 aa, Staphylococcus epidermidis
SKWQEQW

SEQ ID NO: 1770373 - protein, 8 aa, Staphylococcus epidermidis
SLAQERDV

SEQ ID NO: 1770374 - protein, 9 aa, Staphylococcus epidermidis
SLAQERDVT

SEQ ID NO: 1770375 - protein, 6 aa, Staphylococcus epidermidis
SLKESN

SEQ ID NO: 1770376 - protein, 7 aa, Staphylococcus epidermidis
SLRDTQI

SEQ ID NO: 1770377 - protein, 6 aa, Staphylococcus epidermidis
SLSKAD

SEQ ID NO: 1770378 - protein, 9 aa, Staphylococcus epidermidis
SMAGRGTDI

SEQ ID NO: 1770379 - protein, 4 aa, Staphylococcus epidermidis
SMIE

SEQ ID NO: 1770380 - protein, 17 aa, Staphylococcus epidermidis
SNEDKSSLHRYKADESY

SEQ ID NO: 1770381 - protein, 6 aa, Staphylococcus epidermidis
SNEFNT

SEQ ID NO: 1770382 - protein, 16 aa, Staphylococcus epidermidis
SNGKKMSKSKGNVINP

SEQ ID NO: 1770383 - protein, 4 aa, Staphylococcus epidermidis
SNIQ

SEQ ID NO: 1770384 - protein, 5 aa, Staphylococcus epidermidis
SNIRS

SEQ ID NO: 1770385 - protein, 7 aa, Staphylococcus epidermidis
SNKDEVT

SEQ ID NO: 1770386 - protein, 8 aa, Staphylococcus epidermidis
SNKDEVTQ

SEQ ID NO: 1770387 - protein, 4 aa, Staphylococcus epidermidis
SNKG

SEQ ID NO: 1770388 - protein, 11 aa, Staphylococcus epidermidis
SNKLPDKTHPN

SEQ ID NO: 1770389 - protein, 6 aa, Staphylococcus epidermidis
SNKNVN

SEQ ID NO: 1770390 - protein, 7 aa, Staphylococcus epidermidis
SNKNVNM

SEQ ID NO: 1770391 - protein, 10 aa, Staphylococcus epidermidis
SNLLKGKDEN

SEQ ID NO: 1770392 - protein, 4 aa, Staphylococcus epidermidis
SNRH

SEQ ID NO: 1770393 - protein, 6 aa, Staphylococcus epidermidis
SNSEKL

SEQ ID NO: 1770394 - protein, 5 aa, Staphylococcus epidermidis
SNVTS

SEQ ID NO: 1770395 - protein, 12 aa, Staphylococcus epidermidis
SPENNYQFGGGL

SEQ ID NO: 1770396 - protein, 5 aa, Staphylococcus epidermidis
SPFEA

SEQ ID NO: 1770397 - protein, 8 aa, Staphylococcus epidermidis
SPKKGRAL

SEQ ID NO: 1770398 - protein, 8 aa, Staphylococcus epidermidis
SPSELESF

SEQ ID NO: 1770399 - protein, 7 aa, Staphylococcus epidermidis
SPTVEQL

SEQ ID NO: 1770400 - protein, 16 aa, Staphylococcus epidermidis
SQGPSQGRTFQSEYGR

SEQ ID NO: 1770401 - protein, 12 aa, Staphylococcus epidermidis
SQIPVGQSNSNQ

SEQ ID NO: 1770402 - protein, 6 aa, Staphylococcus epidermidis
SQMPPN

SEQ ID NO: 1770403 - protein, 8 aa, Staphylococcus epidermidis
SRDKLSQK

SEQ ID NO: 1770404 - protein, 8 aa, Staphylococcus epidermidis
SRDNAQKL

SEQ ID NO: 1770405 - protein, 16 aa, Staphylococcus epidermidis
SRGKSSDLDRDTHTLD

SEQ ID NO: 1770406 - protein, 7 aa, Staphylococcus epidermidis
SRLDSPE

SEQ ID NO: 1770407 - protein, 7 aa, Staphylococcus epidermidis
SRPATNF

SEQ ID NO: 1770408 - protein, 8 aa, Staphylococcus epidermidis
SRPATNFK

SEQ ID NO: 1770409 - protein, 5 aa, Staphylococcus epidermidis
SRSQA

SEQ ID NO: 1770410 - protein, 6 aa, Staphylococcus epidermidis
SRSQAL

SEQ ID NO: 1770411 - protein, 8 aa, Staphylococcus epidermidis
SRTSKTPL

SEQ ID NO: 1770412 - protein, 9 aa, Staphylococcus epidermidis
SSENDAKNK

SEQ ID NO: 1770413 - protein, 7 aa, Staphylococcus epidermidis
SSFNSFK

SEQ ID NO: 1770414 - protein, 4 aa, Staphylococcus epidermidis
SSFT

SEQ ID NO: 1770415 - protein, 18 aa, Staphylococcus epidermidis
SSGVTGENIHVDSGFHAI

SEQ ID NO: 1770416 - protein, 10 aa, Staphylococcus epidermidis
SSKGEEELQE

SEQ ID NO: 1770417 - protein, 4 aa, Staphylococcus epidermidis
SSNF

SEQ ID NO: 1770418 - protein, 5 aa, Staphylococcus epidermidis
SSNFT

SEQ ID NO: 1770419 - protein, 5 aa, Staphylococcus epidermidis
SSPEM

SEQ ID NO: 1770420 - protein, 6 aa, Staphylococcus epidermidis
SSPVKA

SEQ ID NO: 1770421 - protein, 7 aa, Staphylococcus epidermidis
SSPVKAD

SEQ ID NO: 1770422 - protein, 5 aa, Staphylococcus epidermidis
SSSNR

SEQ ID NO: 1770423 - protein, 9 aa, Staphylococcus epidermidis
SSTDSAHLA

SEQ ID NO: 1770424 - protein, 7 aa, Staphylococcus epidermidis
SSTKLRD

SEQ ID NO: 1770425 - protein, 8 aa, Staphylococcus epidermidis
SSTTAKQL

SEQ ID NO: 1770426 - protein, 8 aa, Staphylococcus epidermidis
SSVHDETQ

SEQ ID NO: 1770427 - protein, 10 aa, Staphylococcus epidermidis
STPKVNTPQL

SEQ ID NO: 1770428 - protein, 10 aa, Staphylococcus epidermidis
STQSQGDVRS

SEQ ID NO: 1770429 - protein, 22 aa, Staphylococcus epidermidis
STSAGIQNETDKVERAQVDAAR

SEQ ID NO: 1770430 - protein, 14 aa, Staphylococcus epidermidis
SVGPKLGNKTKNIQ

SEQ ID NO: 1770431 - protein, 11 aa, Staphylococcus epidermidis
SVRGINKDKRE

SEQ ID NO: 1770432 - protein, 10 aa, Staphylococcus epidermidis
SYDGKKDALN

SEQ ID NO: 1770433 - protein, 4 aa, Staphylococcus epidermidis
SYIH

SEQ ID NO: 1770434 - protein, 7 aa, Staphylococcus epidermidis
TADPFDE

SEQ ID NO: 1770435 - protein, 12 aa, Staphylococcus epidermidis
TAGDTKPVKEGL

SEQ ID NO: 1770436 - protein, 9 aa, Staphylococcus epidermidis
TAVDTEGVA

SEQ ID NO: 1770437 - protein, 9 aa, Staphylococcus epidermidis
TCSGGEQQR

SEQ ID NO: 1770438 - protein, 4 aa, Staphylococcus epidermidis
TDAK

SEQ ID NO: 1770439 - protein, 5 aa, Staphylococcus epidermidis
TDDAR

SEQ ID NO: 1770440 - protein, 4 aa, Staphylococcus epidermidis
TDEE

SEQ ID NO: 1770441 - protein, 8 aa, Staphylococcus epidermidis
TDEESDWK

SEQ ID NO: 1770442 - protein, 10 aa, Staphylococcus epidermidis
TDGAIEYDGK

SEQ ID NO: 1770443 - protein, 6 aa, Staphylococcus epidermidis
TDLSPR

SEQ ID NO: 1770444 - protein, 7 aa, Staphylococcus epidermidis
TDLSPRQ

SEQ ID NO: 1770445 - protein, 8 aa, Staphylococcus epidermidis
TDNGRGIP

SEQ ID NO: 1770446 - protein, 7 aa, Staphylococcus epidermidis
TDPDGHK

SEQ ID NO: 1770447 - protein, 10 aa, Staphylococcus epidermidis
TDSTNHDDDL

SEQ ID NO: 1770448 - protein, 12 aa, Staphylococcus epidermidis
TEAAKGNSLTKK

SEQ ID NO: 1770449 - protein, 8 aa, Staphylococcus epidermidis
TEDKAKSL

SEQ ID NO: 1770450 - protein, 9 aa, Staphylococcus epidermidis
TEDKAKSLD

SEQ ID NO: 1770451 - protein, 8 aa, Staphylococcus epidermidis
TEEDIRED

SEQ ID NO: 1770452 - protein, 7 aa, Staphylococcus epidermidis
TEERRTR

SEQ ID NO: 1770453 - protein, 4 aa, Staphylococcus epidermidis
TEGS

SEQ ID NO: 1770454 - protein, 8 aa, Staphylococcus epidermidis
TEHDTIEQ

SEQ ID NO: 1770455 - protein, 7 aa, Staphylococcus epidermidis
TEIDGTH

SEQ ID NO: 1770456 - protein, 9 aa, Staphylococcus epidermidis
TEKEIKSED

SEQ ID NO: 1770457 - protein, 13 aa, Staphylococcus epidermidis
TEKQSGKSVENRP

SEQ ID NO: 1770458 - protein, 9 aa, Staphylococcus epidermidis
TEYGISAEQ

SEQ ID NO: 1770459 - protein, 10 aa, Staphylococcus epidermidis
TEYGISAEQS

SEQ ID NO: 1770460 - protein, 6 aa, Staphylococcus epidermidis
TFEKAE

SEQ ID NO: 1770461 - protein, 13 aa, Staphylococcus epidermidis
TFETTANELGGQA

SEQ ID NO: 1770462 - protein, 9 aa, Staphylococcus epidermidis
TFKQSKNKT

SEQ ID NO: 1770463 - protein, 21 aa, Staphylococcus epidermidis
TFREQTQSLRQQPQRTTSING

SEQ ID NO: 1770464 - protein, 5 aa, Staphylococcus epidermidis
TGDGP

SEQ ID NO: 1770465 - protein, 17 aa, Staphylococcus epidermidis
TGEGKMDKQTIYGKTPI

SEQ ID NO: 1770466 - protein, 9 aa, Staphylococcus epidermidis
TGEITSKDV

SEQ ID NO: 1770467 - protein, 8 aa, Staphylococcus epidermidis
TGFQHREP

SEQ ID NO: 1770468 - protein, 5 aa, Staphylococcus epidermidis
TGKPG

SEQ ID NO: 1770469 - protein, 6 aa, Staphylococcus epidermidis
TGLGGG

SEQ ID NO: 1770470 - protein, 4 aa, Staphylococcus epidermidis
TGNK

SEQ ID NO: 1770471 - protein, 10 aa, Staphylococcus epidermidis
TGSGKTLTSF

SEQ ID NO: 1770472 - protein, 6 aa, Staphylococcus epidermidis
TGSQRV

SEQ ID NO: 1770473 - protein, 7 aa, Staphylococcus epidermidis
TGVDKRE

SEQ ID NO: 1770474 - protein, 4 aa, Staphylococcus epidermidis
THAP

SEQ ID NO: 1770475 - protein, 11 aa, Staphylococcus epidermidis
THGTAPKYAGL

SEQ ID NO: 1770476 - protein, 21 aa, Staphylococcus epidermidis
THIGGGTGASEGAKATTVTPG

SEQ ID NO: 1770477 - protein, 6 aa, Staphylococcus epidermidis
THNITE

SEQ ID NO: 1770478 - protein, 4 aa, Staphylococcus epidermidis
THPN

SEQ ID NO: 1770479 - protein, 9 aa, Staphylococcus epidermidis
THSDAQKGI

SEQ ID NO: 1770480 - protein, 9 aa, Staphylococcus epidermidis
THSNAQKGI

SEQ ID NO: 1770481 - protein, 9 aa, Staphylococcus epidermidis
TIDHDGKEF

SEQ ID NO: 1770482 - protein, 11 aa, Staphylococcus epidermidis
TIEETSQNAVN

SEQ ID NO: 1770483 - protein, 4 aa, Staphylococcus epidermidis
TIEG

SEQ ID NO: 1770484 - protein, 10 aa, Staphylococcus epidermidis
TIKLSNKDYS

SEQ ID NO: 1770485 - protein, 5 aa, Staphylococcus epidermidis
TISHN

SEQ ID NO: 1770486 - protein, 7 aa, Staphylococcus epidermidis
TKENVKK

SEQ ID NO: 1770487 - protein, 6 aa, Staphylococcus epidermidis
TKEQLI

SEQ ID NO: 1770488 - protein, 13 aa, Staphylococcus epidermidis
TKERLKESIERKI

SEQ ID NO: 1770489 - protein, 7 aa, Staphylococcus epidermidis
TKGSWQQ

SEQ ID NO: 1770490 - protein, 8 aa, Staphylococcus epidermidis
TKPCENEY

SEQ ID NO: 1770491 - protein, 7 aa, Staphylococcus epidermidis
TLANASN

SEQ ID NO: 1770492 - protein, 4 aa, Staphylococcus epidermidis
TLEK

SEQ ID NO: 1770493 - protein, 9 aa, Staphylococcus epidermidis
TLENGSGHP

SEQ ID NO: 1770494 - protein, 10 aa, Staphylococcus epidermidis
TLQDDTTEKI

SEQ ID NO: 1770495 - protein, 23 aa, Staphylococcus epidermidis
TMAGDDPTRYRTSDEDAEWEKKD

SEQ ID NO: 1770496 - protein, 18 aa, Staphylococcus epidermidis
TMPSNYEQPHRVERVAFN

SEQ ID NO: 1770497 - protein, 17 aa, Staphylococcus epidermidis
TNDFPQYERPQSHNYEL

SEQ ID NO: 1770498 - protein, 6 aa, Staphylococcus epidermidis
TNDLSQ

SEQ ID NO: 1770499 - protein, 10 aa, Staphylococcus epidermidis
TNEEDVYNET

SEQ ID NO: 1770500 - protein, 10 aa, Staphylococcus epidermidis
TNKDKVEGSL

SEQ ID NO: 1770501 - protein, 11 aa, Staphylococcus epidermidis
TNKDKVEGSLE

SEQ ID NO: 1770502 - protein, 5 aa, Staphylococcus epidermidis
TNKNM

SEQ ID NO: 1770503 - protein, 8 aa, Staphylococcus epidermidis
TNSINEKM

SEQ ID NO: 1770504 - protein, 8 aa, Staphylococcus epidermidis
TPDGTELE

SEQ ID NO: 1770505 - protein, 13 aa, Staphylococcus epidermidis
TPDLTKNNGYRDR

SEQ ID NO: 1770506 - protein, 9 aa, Staphylococcus epidermidis
TPDNVAQQV

SEQ ID NO: 1770507 - protein, 9 aa, Staphylococcus epidermidis
TPKVNTPQL

SEQ ID NO: 1770508 - protein, 5 aa, Staphylococcus epidermidis
TPLND

SEQ ID NO: 1770509 - protein, 6 aa, Staphylococcus epidermidis
TPLNDN

SEQ ID NO: 1770510 - protein, 11 aa, Staphylococcus epidermidis
TPTESYQDRAN

SEQ ID NO: 1770511 - protein, 8 aa, Staphylococcus epidermidis
TPVGRNGI

SEQ ID NO: 1770512 - protein, 22 aa, Staphylococcus epidermidis
TPVGRNGIKATFKGSDSNGPTI

SEQ ID NO: 1770513 - protein, 10 aa, Staphylococcus epidermidis
TQDTPASKIA

SEQ ID NO: 1770514 - protein, 8 aa, Staphylococcus epidermidis
TQKNSFER

SEQ ID NO: 1770515 - protein, 8 aa, Staphylococcus epidermidis
TQNNEKGF

SEQ ID NO: 1770516 - protein, 10 aa, Staphylococcus epidermidis
TQVSDQAKHD

SEQ ID NO: 1770517 - protein, 11 aa, Staphylococcus epidermidis
TRDTKERGRTM

SEQ ID NO: 1770518 - protein, 10 aa, Staphylococcus epidermidis
TRGTAQKLKD

SEQ ID NO: 1770519 - protein, 11 aa, Staphylococcus epidermidis
TRGTAQKLKDH

SEQ ID NO: 1770520 - protein, 6 aa, Staphylococcus epidermidis
TRPELS

SEQ ID NO: 1770521 - protein, 4 aa, Staphylococcus epidermidis
TRSD

SEQ ID NO: 1770522 - protein, 14 aa, Staphylococcus epidermidis
TSEKPDINYEDDGG

SEQ ID NO: 1770523 - protein, 6 aa, Staphylococcus epidermidis
TSEVEG

SEQ ID NO: 1770524 - protein, 7 aa, Staphylococcus epidermidis
TSEVEGI

SEQ ID NO: 1770525 - protein, 9 aa, Staphylococcus epidermidis
TSGNYDLKQ

SEQ ID NO: 1770526 - protein, 10 aa, Staphylococcus epidermidis
TSGNYDLKQE

SEQ ID NO: 1770527 - protein, 5 aa, Staphylococcus epidermidis
TSGWT

SEQ ID NO: 1770528 - protein, 4 aa, Staphylococcus epidermidis
TSHA

SEQ ID NO: 1770529 - protein, 9 aa, Staphylococcus epidermidis
TSIEGELPE

SEQ ID NO: 1770530 - protein, 5 aa, Staphylococcus epidermidis
TSIQT

SEQ ID NO: 1770531 - protein, 4 aa, Staphylococcus epidermidis
TSIT

SEQ ID NO: 1770532 - protein, 6 aa, Staphylococcus epidermidis
TSITDE

SEQ ID NO: 1770533 - protein, 5 aa, Staphylococcus epidermidis
TSKDI

SEQ ID NO: 1770534 - protein, 12 aa, Staphylococcus epidermidis
TSLDGQKYGAYK

SEQ ID NO: 1770535 - protein, 16 aa, Staphylococcus epidermidis
TSNSFTIEKNNDQQHY

SEQ ID NO: 1770536 - protein, 4 aa, Staphylococcus epidermidis
TSPI

SEQ ID NO: 1770537 - protein, 12 aa, Staphylococcus epidermidis
TSSLGVRSTSVN

SEQ ID NO: 1770538 - protein, 16 aa, Staphylococcus epidermidis
TSSLGVRSTSVNRKTL

SEQ ID NO: 1770539 - protein, 8 aa, Staphylococcus epidermidis
TSTSSSIE

SEQ ID NO: 1770540 - protein, 7 aa, Staphylococcus epidermidis
TSVGYGA

SEQ ID NO: 1770541 - protein, 6 aa, Staphylococcus epidermidis
TSVPKE

SEQ ID NO: 1770542 - protein, 7 aa, Staphylococcus epidermidis
TSVPKER

SEQ ID NO: 1770543 - protein, 9 aa, Staphylococcus epidermidis
TTLQQNAKD

SEQ ID NO: 1770544 - protein, 7 aa, Staphylococcus epidermidis
TTQSDFK

SEQ ID NO: 1770545 - protein, 9 aa, Staphylococcus epidermidis
TTSACSSKM

SEQ ID NO: 1770546 - protein, 16 aa, Staphylococcus epidermidis
TTVGQEIAKKANDKGI

SEQ ID NO: 1770547 - protein, 13 aa, Staphylococcus epidermidis
TVAKPIDEFTSGG

SEQ ID NO: 1770548 - protein, 11 aa, Staphylococcus epidermidis
TVARESHQGDH

SEQ ID NO: 1770549 - protein, 11 aa, Staphylococcus epidermidis
TVEGPDDYKSM

SEQ ID NO: 1770550 - protein, 5 aa, Staphylococcus epidermidis
TVENG

SEQ ID NO: 1770551 - protein, 6 aa, Staphylococcus epidermidis
TVQGEN

SEQ ID NO: 1770552 - protein, 12 aa, Staphylococcus epidermidis
TVRGQGYRVDQN

SEQ ID NO: 1770553 - protein, 10 aa, Staphylococcus epidermidis
TVSGLTNSQI

SEQ ID NO: 1770554 - protein, 9 aa, Staphylococcus epidermidis
TWQGKKESV

SEQ ID NO: 1770555 - protein, 14 aa, Staphylococcus epidermidis
TWQSNKIRTQNEQT

SEQ ID NO: 1770556 - protein, 12 aa, Staphylococcus epidermidis
TYEAKGEEQTIE

SEQ ID NO: 1770557 - protein, 5 aa, Staphylococcus epidermidis
TYGQR

SEQ ID NO: 1770558 - protein, 11 aa, Staphylococcus epidermidis
TYHTGDKAKIE

SEQ ID NO: 1770559 - protein, 11 aa, Staphylococcus epidermidis
VADSGAIGGSH

SEQ ID NO: 1770560 - protein, 10 aa, Staphylococcus epidermidis
VAENLSKKLG

SEQ ID NO: 1770561 - protein, 7 aa, Staphylococcus epidermidis
VAGTTRD

SEQ ID NO: 1770562 - protein, 17 aa, Staphylococcus epidermidis
VAKESAEKLSKEGQEAV

SEQ ID NO: 1770563 - protein, 18 aa, Staphylococcus epidermidis
VASGTATAFSEDLATRDA

SEQ ID NO: 1770564 - protein, 19 aa, Staphylococcus epidermidis
VASGTATAFSEDLATRDAI

SEQ ID NO: 1770565 - protein, 7 aa, Staphylococcus epidermidis
VATGNYS

SEQ ID NO: 1770566 - protein, 9 aa, Staphylococcus epidermidis
VDKSGAWYS

SEQ ID NO: 1770567 - protein, 9 aa, Staphylococcus epidermidis
VDKYRGESA

SEQ ID NO: 1770568 - protein, 5 aa, Staphylococcus epidermidis
VDPTE

SEQ ID NO: 1770569 - protein, 12 aa, Staphylococcus epidermidis
VDSLASEAREKL

SEQ ID NO: 1770570 - protein, 13 aa, Staphylococcus epidermidis
VDSLASEAREKLA

SEQ ID NO: 1770571 - protein, 8 aa, Staphylococcus epidermidis
VDSNNHSL

SEQ ID NO: 1770572 - protein, 15 aa, Staphylococcus epidermidis
VDSRTILDSGGAERL

SEQ ID NO: 1770573 - protein, 8 aa, Staphylococcus epidermidis
VDTRSITR

SEQ ID NO: 1770574 - protein, 9 aa, Staphylococcus epidermidis
VDTTAAGDT

SEQ ID NO: 1770575 - protein, 8 aa, Staphylococcus epidermidis
VDYEEDAE

SEQ ID NO: 1770576 - protein, 18 aa, Staphylococcus epidermidis
VEEQADEVQKVKRSENGV

SEQ ID NO: 1770577 - protein, 4 aa, Staphylococcus epidermidis
VEET

SEQ ID NO: 1770578 - protein, 5 aa, Staphylococcus epidermidis
VEETT

SEQ ID NO: 1770579 - protein, 6 aa, Staphylococcus epidermidis
VEKSKH

SEQ ID NO: 1770580 - protein, 11 aa, Staphylococcus epidermidis
VEPLKEEAAIA

SEQ ID NO: 1770581 - protein, 4 aa, Staphylococcus epidermidis
VEPS

SEQ ID NO: 1770582 - protein, 5 aa, Staphylococcus epidermidis
VESEE

SEQ ID NO: 1770583 - protein, 10 aa, Staphylococcus epidermidis
VETDEDISKE

SEQ ID NO: 1770584 - protein, 14 aa, Staphylococcus epidermidis
VGGRKGHVHTDDNA

SEQ ID NO: 1770585 - protein, 7 aa, Staphylococcus epidermidis
VGKDGNA

SEQ ID NO: 1770586 - protein, 12 aa, Staphylococcus epidermidis
VGKDVSRFKKGD

SEQ ID NO: 1770587 - protein, 5 aa, Staphylococcus epidermidis
VGMES

SEQ ID NO: 1770588 - protein, 6 aa, Staphylococcus epidermidis
VGPETT

SEQ ID NO: 1770589 - protein, 5 aa, Staphylococcus epidermidis
VGPFE

SEQ ID NO: 1770590 - protein, 6 aa, Staphylococcus epidermidis
VGYNED

SEQ ID NO: 1770591 - protein, 9 aa, Staphylococcus epidermidis
VKAKKGRKI

SEQ ID NO: 1770592 - protein, 6 aa, Staphylococcus epidermidis
VKENDN

SEQ ID NO: 1770593 - protein, 7 aa, Staphylococcus epidermidis
VKENDNE

SEQ ID NO: 1770594 - protein, 8 aa, Staphylococcus epidermidis
VKEPKKKI

SEQ ID NO: 1770595 - protein, 4 aa, Staphylococcus epidermidis
VKET

SEQ ID NO: 1770596 - protein, 8 aa, Staphylococcus epidermidis
VKKPETIN

SEQ ID NO: 1770597 - protein, 7 aa, Staphylococcus epidermidis
VKPTTMA

SEQ ID NO: 1770598 - protein, 7 aa, Staphylococcus epidermidis
VKQSKPI

SEQ ID NO: 1770599 - protein, 19 aa, Staphylococcus epidermidis
VKQTEDRVRQKTGPEKVKA

SEQ ID NO: 1770600 - protein, 20 aa, Staphylococcus epidermidis
VKQTEDRVRQKTGPEKVKAQ

SEQ ID NO: 1770601 - protein, 10 aa, Staphylococcus epidermidis
VKRDGLKGGG

SEQ ID NO: 1770602 - protein, 11 aa, Staphylococcus epidermidis
VKRDGLKGGGY

SEQ ID NO: 1770603 - protein, 7 aa, Staphylococcus epidermidis
VKRDGTP

SEQ ID NO: 1770604 - protein, 6 aa, Staphylococcus epidermidis
VKSNEY

SEQ ID NO: 1770605 - protein, 7 aa, Staphylococcus epidermidis
VKTGDHV

SEQ ID NO: 1770606 - protein, 4 aa, Staphylococcus epidermidis
VLDT

SEQ ID NO: 1770607 - protein, 17 aa, Staphylococcus epidermidis
VLGDHERKDTVKNAEET

SEQ ID NO: 1770608 - protein, 14 aa, Staphylococcus epidermidis
VLTGSTRLKSGTAQ

SEQ ID NO: 1770609 - protein, 13 aa, Staphylococcus epidermidis
VNDQTISKRDFTG

SEQ ID NO: 1770610 - protein, 9 aa, Staphylococcus epidermidis
VNNNLGRDI

SEQ ID NO: 1770611 - protein, 4 aa, Staphylococcus epidermidis
VNNR

SEQ ID NO: 1770612 - protein, 5 aa, Staphylococcus epidermidis
VNNRR

SEQ ID NO: 1770613 - protein, 8 aa, Staphylococcus epidermidis
VNPTSDGE

SEQ ID NO: 1770614 - protein, 12 aa, Staphylococcus epidermidis
VNPVDTKQRTMP

SEQ ID NO: 1770615 - protein, 14 aa, Staphylococcus epidermidis
VNPVDTKQRTMPVD

SEQ ID NO: 1770616 - protein, 9 aa, Staphylococcus epidermidis
VNSYGKDIE

SEQ ID NO: 1770617 - protein, 10 aa, Staphylococcus epidermidis
VNSYGKDIEG

SEQ ID NO: 1770618 - protein, 8 aa, Staphylococcus epidermidis
VPQRKGDP

SEQ ID NO: 1770619 - protein, 5 aa, Staphylococcus epidermidis
VQDPL

SEQ ID NO: 1770620 - protein, 5 aa, Staphylococcus epidermidis
VQQAD

SEQ ID NO: 1770621 - protein, 18 aa, Staphylococcus epidermidis
VRGRGGPRCMSQPLFRED

SEQ ID NO: 1770622 - protein, 7 aa, Staphylococcus epidermidis
VRITPQR

SEQ ID NO: 1770623 - protein, 4 aa, Staphylococcus epidermidis
VSDE

SEQ ID NO: 1770624 - protein, 5 aa, Staphylococcus epidermidis
VSDEE

SEQ ID NO: 1770625 - protein, 8 aa, Staphylococcus epidermidis
VSDERSAY

SEQ ID NO: 1770626 - protein, 13 aa, Staphylococcus epidermidis
VSGERGAADLERD

SEQ ID NO: 1770627 - protein, 7 aa, Staphylococcus epidermidis
VSIGKRP

SEQ ID NO: 1770628 - protein, 24 aa, Staphylococcus epidermidis
VSKATSYTEAGTKHGRLGLMAGHK

SEQ ID NO: 1770629 - protein, 23 aa, Staphylococcus epidermidis
VSKEGKDNLAPYSQYQNLTWDPQ

SEQ ID NO: 1770630 - protein, 10 aa, Staphylococcus epidermidis
VSKLGGKSEM

SEQ ID NO: 1770631 - protein, 12 aa, Staphylococcus epidermidis
VSKPKKSSRSEE

SEQ ID NO: 1770632 - protein, 4 aa, Staphylococcus epidermidis
VSYD

SEQ ID NO: 1770633 - protein, 5 aa, Staphylococcus epidermidis
VTDED

SEQ ID NO: 1770634 - protein, 6 aa, Staphylococcus epidermidis
VTFESK

SEQ ID NO: 1770635 - protein, 7 aa, Staphylococcus epidermidis
VTFESKD

SEQ ID NO: 1770636 - protein, 10 aa, Staphylococcus epidermidis
VTKSKVRRER

SEQ ID NO: 1770637 - protein, 10 aa, Staphylococcus epidermidis
VTLRETGRLG

SEQ ID NO: 1770638 - protein, 5 aa, Staphylococcus epidermidis
VTNNG

SEQ ID NO: 1770639 - protein, 8 aa, Staphylococcus epidermidis
VTNSEGTG

SEQ ID NO: 1770640 - protein, 8 aa, Staphylococcus epidermidis
VTPSSKVV

SEQ ID NO: 1770641 - protein, 9 aa, Staphylococcus epidermidis
VTQKNSFER

SEQ ID NO: 1770642 - protein, 5 aa, Staphylococcus epidermidis
VTQSK

SEQ ID NO: 1770643 - protein, 6 aa, Staphylococcus epidermidis
VTQSKG

SEQ ID NO: 1770644 - protein, 5 aa, Staphylococcus epidermidis
VTTDT

SEQ ID NO: 1770645 - protein, 12 aa, Staphylococcus epidermidis
VTVNKNDGSYNQ

SEQ ID NO: 1770646 - protein, 7 aa, Staphylococcus epidermidis
VVERPSS

SEQ ID NO: 1770647 - protein, 7 aa, Staphylococcus epidermidis
VVPGSEG

SEQ ID NO: 1770648 - protein, 7 aa, Staphylococcus epidermidis
VYPQDTN

SEQ ID NO: 1770649 - protein, 14 aa, Staphylococcus epidermidis
VYWSPSSESSLAEA

SEQ ID NO: 1770650 - protein, 6 aa, Staphylococcus epidermidis
WDSEAR

SEQ ID NO: 1770651 - protein, 5 aa, Staphylococcus epidermidis
WEASG

SEQ ID NO: 1770652 - protein, 9 aa, Staphylococcus epidermidis
WTKGETSGH

SEQ ID NO: 1770653 - protein, 10 aa, Staphylococcus epidermidis
WTKGETSGHF

SEQ ID NO: 1770654 - protein, 7 aa, Staphylococcus epidermidis
YATDPRI

SEQ ID NO: 1770655 - protein, 7 aa, Staphylococcus epidermidis
YATPSQL

SEQ ID NO: 1770656 - protein, 15 aa, Staphylococcus epidermidis
YDDASTSNSIVAVGA

SEQ ID NO: 1770657 - protein, 6 aa, Staphylococcus epidermidis
YDDGKH

SEQ ID NO: 1770658 - protein, 8 aa, Staphylococcus epidermidis
YDKQNIKV

SEQ ID NO: 1770659 - protein, 6 aa, Staphylococcus epidermidis
YDRPLK

SEQ ID NO: 1770660 - protein, 5 aa, Staphylococcus epidermidis
YEDES

SEQ ID NO: 1770661 - protein, 4 aa, Staphylococcus epidermidis
YEKR

SEQ ID NO: 1770662 - protein, 5 aa, Staphylococcus epidermidis
YENGA

SEQ ID NO: 1770663 - protein, 10 aa, Staphylococcus epidermidis
YENGAIENTL

SEQ ID NO: 1770664 - protein, 10 aa, Staphylococcus epidermidis
YERKKEKQSV

SEQ ID NO: 1770665 - protein, 4 aa, Staphylococcus epidermidis
YEVE

SEQ ID NO: 1770666 - protein, 5 aa, Staphylococcus epidermidis
YGTSV

SEQ ID NO: 1770667 - protein, 8 aa, Staphylococcus epidermidis
YHDKRSAS

SEQ ID NO: 1770668 - protein, 5 aa, Staphylococcus epidermidis
YHNND

SEQ ID NO: 1770669 - protein, 7 aa, Staphylococcus epidermidis
YIGGSDD

SEQ ID NO: 1770670 - protein, 15 aa, Staphylococcus epidermidis
YIKGTEKQDYMPNGN

SEQ ID NO: 1770671 - protein, 11 aa, Staphylococcus epidermidis
YITHPKENGYR

SEQ ID NO: 1770672 - protein, 22 aa, Staphylococcus epidermidis
YKDPNTSQKTKKEIRELFRRLY

SEQ ID NO: 1770673 - protein, 9 aa, Staphylococcus epidermidis
YKEISSCSN

SEQ ID NO: 1770674 - protein, 6 aa, Staphylococcus epidermidis
YKHDGN

SEQ ID NO: 1770675 - protein, 30 aa, Staphylococcus epidermidis
YKQSQESHGEDAKLKQDREAFQRQLEEKWE

SEQ ID NO: 1770676 - protein, 6 aa, Staphylococcus epidermidis
YKRDED

SEQ ID NO: 1770677 - protein, 15 aa, Staphylococcus epidermidis
YKTRVNRKHRDRGDQ

SEQ ID NO: 1770678 - protein, 8 aa, Staphylococcus epidermidis
YNATTTGE

SEQ ID NO: 1770679 - protein, 11 aa, Staphylococcus epidermidis
YNDVKQMNRQN

SEQ ID NO: 1770680 - protein, 5 aa, Staphylococcus epidermidis
YNKWT

SEQ ID NO: 1770681 - protein, 6 aa, Staphylococcus epidermidis
YNKWTQ

SEQ ID NO: 1770682 - protein, 5 aa, Staphylococcus epidermidis
YNQMQ

SEQ ID NO: 1770683 - protein, 9 aa, Staphylococcus epidermidis
YPKIPRAKP

SEQ ID NO: 1770684 - protein, 10 aa, Staphylococcus epidermidis
YPNAPKSGIR

SEQ ID NO: 1770685 - protein, 10 aa, Staphylococcus epidermidis
YPNETEEQFE

SEQ ID NO: 1770686 - protein, 6 aa, Staphylococcus epidermidis
YQKYGA

SEQ ID NO: 1770687 - protein, 9 aa, Staphylococcus epidermidis
YREGEIEGT

SEQ ID NO: 1770688 - protein, 7 aa, Staphylococcus epidermidis
YRTPEDY

SEQ ID NO: 1770689 - protein, 5 aa, Staphylococcus epidermidis
YSYDD

SEQ ID NO: 1770690 - protein, 4 aa, Staphylococcus epidermidis
YTGN

SEQ ID NO: 1770691 - protein, 7 aa, Staphylococcus epidermidis
YWDSEAR

SEQ ID NO: 1770692 - protein, 7 aa, Staphylococcus epidermidis
AAGHGQK

SEQ ID NO: 1770693 - protein, 5 aa, Staphylococcus epidermidis
AAIQT

SEQ ID NO: 1770694 - protein, 6 aa, Staphylococcus epidermidis
AAKNKG

SEQ ID NO: 1770695 - protein, 15 aa, Staphylococcus epidermidis
AASAGKKAGEFYTPQ

SEQ ID NO: 1770696 - protein, 4 aa, Staphylococcus epidermidis
AASS

SEQ ID NO: 1770697 - protein, 5 aa, Staphylococcus epidermidis
ADANC

SEQ ID NO: 1770698 - protein, 8 aa, Staphylococcus epidermidis
ADDGKISL

SEQ ID NO: 1770699 - protein, 7 aa, Staphylococcus epidermidis
ADDTPEQ

SEQ ID NO: 1770700 - protein, 16 aa, Staphylococcus epidermidis
ADETTQERLNSSYQNA

SEQ ID NO: 1770701 - protein, 16 aa, Staphylococcus epidermidis
ADFENATDNQGSGPIG

SEQ ID NO: 1770702 - protein, 6 aa, Staphylococcus epidermidis
ADGDNY

SEQ ID NO: 1770703 - protein, 12 aa, Staphylococcus epidermidis
ADIEEMKSAYKN

SEQ ID NO: 1770704 - protein, 19 aa, Staphylococcus epidermidis
ADKVTEDASFKDDLGADSL

SEQ ID NO: 1770705 - protein, 14 aa, Staphylococcus epidermidis
ADRGISGKSMNRPE

SEQ ID NO: 1770706 - protein, 4 aa, Staphylococcus epidermidis
ADSN

SEQ ID NO: 1770707 - protein, 6 aa, Staphylococcus epidermidis
ADTLAS

SEQ ID NO: 1770708 - protein, 6 aa, Staphylococcus epidermidis
AEDKNW

SEQ ID NO: 1770709 - protein, 13 aa, Staphylococcus epidermidis
AEEAVEKAKELNS

SEQ ID NO: 1770710 - protein, 5 aa, Staphylococcus epidermidis
AEEGV

SEQ ID NO: 1770711 - protein, 15 aa, Staphylococcus epidermidis
AEITNDEKGKISHRG

SEQ ID NO: 1770712 - protein, 11 aa, Staphylococcus epidermidis
AEKRAEEKSGL

SEQ ID NO: 1770713 - protein, 10 aa, Staphylococcus epidermidis
AEKTTDIKKN

SEQ ID NO: 1770714 - protein, 14 aa, Staphylococcus epidermidis
AENKGTKVVEHRKD

SEQ ID NO: 1770715 - protein, 7 aa, Staphylococcus epidermidis
AENNDDL

SEQ ID NO: 1770716 - protein, 6 aa, Staphylococcus epidermidis
AENRAH

SEQ ID NO: 1770717 - protein, 9 aa, Staphylococcus epidermidis
AEQTYEDYK

SEQ ID NO: 1770718 - protein, 9 aa, Staphylococcus epidermidis
AESITEPEV

SEQ ID NO: 1770719 - protein, 7 aa, Staphylococcus epidermidis
AESNNTD

SEQ ID NO: 1770720 - protein, 7 aa, Staphylococcus epidermidis
AETERDT

SEQ ID NO: 1770721 - protein, 15 aa, Staphylococcus epidermidis
AEYQLSNEDDNVKQL

SEQ ID NO: 1770722 - protein, 13 aa, Staphylococcus epidermidis
AFKSLSAKVGAPR

SEQ ID NO: 1770723 - protein, 10 aa, Staphylococcus epidermidis
AGCVNDTPAF

SEQ ID NO: 1770724 - protein, 7 aa, Staphylococcus epidermidis
AGDGDFL

SEQ ID NO: 1770725 - protein, 11 aa, Staphylococcus epidermidis
AGDPKGSSVGY

SEQ ID NO: 1770726 - protein, 11 aa, Staphylococcus epidermidis
AGDTKPVKEGL

SEQ ID NO: 1770727 - protein, 6 aa, Staphylococcus epidermidis
AGEAFD

SEQ ID NO: 1770728 - protein, 6 aa, Staphylococcus epidermidis
AGENLA

SEQ ID NO: 1770729 - protein, 6 aa, Staphylococcus epidermidis
AGFNKS

SEQ ID NO: 1770730 - protein, 9 aa, Staphylococcus epidermidis
AGGDKKVNY

SEQ ID NO: 1770731 - protein, 4 aa, Staphylococcus epidermidis
AGGM

SEQ ID NO: 1770732 - protein, 5 aa, Staphylococcus epidermidis
AGGVE

SEQ ID NO: 1770733 - protein, 21 aa, Staphylococcus epidermidis
AGKDKGKEGKVVATEPKKGRV

SEQ ID NO: 1770734 - protein, 4 aa, Staphylococcus epidermidis
AGPV

SEQ ID NO: 1770735 - protein, 10 aa, Staphylococcus epidermidis
AGQIPEEIDS

SEQ ID NO: 1770736 - protein, 9 aa, Staphylococcus epidermidis
AGYGSESNY

SEQ ID NO: 1770737 - protein, 7 aa, Staphylococcus epidermidis
AGYNFGS

SEQ ID NO: 1770738 - protein, 5 aa, Staphylococcus epidermidis
AHDTT

SEQ ID NO: 1770739 - protein, 7 aa, Staphylococcus epidermidis
AHNNESV

SEQ ID NO: 1770740 - protein, 9 aa, Staphylococcus epidermidis
AHPEDIESE

SEQ ID NO: 1770741 - protein, 10 aa, Staphylococcus epidermidis
AHVKNSTNFL

SEQ ID NO: 1770742 - protein, 25 aa, Staphylococcus epidermidis
AIEGGARRIEGTVNGIGERAGNAAL

SEQ ID NO: 1770743 - protein, 5 aa, Staphylococcus epidermidis
AIKSY

SEQ ID NO: 1770744 - protein, 6 aa, Staphylococcus epidermidis
AINKNT

SEQ ID NO: 1770745 - protein, 11 aa, Staphylococcus epidermidis
AKAKPQKPENC

SEQ ID NO: 1770746 - protein, 7 aa, Staphylococcus epidermidis
AKAQSKK

SEQ ID NO: 1770747 - protein, 5 aa, Staphylococcus epidermidis
AKENI

SEQ ID NO: 1770748 - protein, 4 aa, Staphylococcus epidermidis
AKGG

SEQ ID NO: 1770749 - protein, 15 aa, Staphylococcus epidermidis
AKGNEEDVNKAVDAA

SEQ ID NO: 1770750 - protein, 13 aa, Staphylococcus epidermidis
AKGVSKANDISDA

SEQ ID NO: 1770751 - protein, 19 aa, Staphylococcus epidermidis
AKHQTNVRSATKDQTQTMN

SEQ ID NO: 1770752 - protein, 9 aa, Staphylococcus epidermidis
AKKAADEIG

SEQ ID NO: 1770753 - protein, 20 aa, Staphylococcus epidermidis
AKKFAKDEQDENGKTTKVSG

SEQ ID NO: 1770754 - protein, 18 aa, Staphylococcus epidermidis
AKKGENGQSSNMHGKNAE

SEQ ID NO: 1770755 - protein, 8 aa, Staphylococcus epidermidis
AKKTEQNI

SEQ ID NO: 1770756 - protein, 12 aa, Staphylococcus epidermidis
AKMNKDQKNQYE

SEQ ID NO: 1770757 - protein, 15 aa, Staphylococcus epidermidis
AKPTKDPDKAMSETQ

SEQ ID NO: 1770758 - protein, 8 aa, Staphylococcus epidermidis
AKQTGVSE

SEQ ID NO: 1770759 - protein, 20 aa, Staphylococcus epidermidis
AKSSFKASRELYGKTDGNQG

SEQ ID NO: 1770760 - protein, 7 aa, Staphylococcus epidermidis
AKTDLKK

SEQ ID NO: 1770761 - protein, 8 aa, Staphylococcus epidermidis
AKTNFSQE

SEQ ID NO: 1770762 - protein, 7 aa, Staphylococcus epidermidis
AKTYSLG

SEQ ID NO: 1770763 - protein, 4 aa, Staphylococcus epidermidis
AKVL

SEQ ID NO: 1770764 - protein, 10 aa, Staphylococcus epidermidis
AKWSNGDSVT

SEQ ID NO: 1770765 - protein, 5 aa, Staphylococcus epidermidis
ALQIK

SEQ ID NO: 1770766 - protein, 6 aa, Staphylococcus epidermidis
ALSNKG

SEQ ID NO: 1770767 - protein, 14 aa, Staphylococcus epidermidis
ALTPKAEIEGEMGD

SEQ ID NO: 1770768 - protein, 15 aa, Staphylococcus epidermidis
ANAGKKAGEFYTPQQ

SEQ ID NO: 1770769 - protein, 9 aa, Staphylococcus epidermidis
ANAKDPQKR

SEQ ID NO: 1770770 - protein, 11 aa, Staphylococcus epidermidis
ANEEYSDQSEH

SEQ ID NO: 1770771 - protein, 7 aa, Staphylococcus epidermidis
ANGFDEK

SEQ ID NO: 1770772 - protein, 9 aa, Staphylococcus epidermidis
ANGLKEVSE

SEQ ID NO: 1770773 - protein, 8 aa, Staphylococcus epidermidis
ANIEYTTP

SEQ ID NO: 1770774 - protein, 8 aa, Staphylococcus epidermidis
ANINSPGQ

SEQ ID NO: 1770775 - protein, 10 aa, Staphylococcus epidermidis
ANKLKNKTLT

SEQ ID NO: 1770776 - protein, 6 aa, Staphylococcus epidermidis
ANKQNF

SEQ ID NO: 1770777 - protein, 4 aa, Staphylococcus epidermidis
ANLK

SEQ ID NO: 1770778 - protein, 7 aa, Staphylococcus epidermidis
ANNKKRN

SEQ ID NO: 1770779 - protein, 4 aa, Staphylococcus epidermidis
ANPD

SEQ ID NO: 1770780 - protein, 16 aa, Staphylococcus epidermidis
ANPPYSAKWSADPSFL

SEQ ID NO: 1770781 - protein, 4 aa, Staphylococcus epidermidis
ANPY

SEQ ID NO: 1770782 - protein, 10 aa, Staphylococcus epidermidis
ANQSPEFGRP

SEQ ID NO: 1770783 - protein, 13 aa, Staphylococcus epidermidis
ANSCTGKQGEKDA

SEQ ID NO: 1770784 - protein, 6 aa, Staphylococcus epidermidis
ANSGEF

SEQ ID NO: 1770785 - protein, 6 aa, Staphylococcus epidermidis
ANSGKY

SEQ ID NO: 1770786 - protein, 5 aa, Staphylococcus epidermidis
ANVAD

SEQ ID NO: 1770787 - protein, 6 aa, Staphylococcus epidermidis
ANVESE

SEQ ID NO: 1770788 - protein, 7 aa, Staphylococcus epidermidis
ANVESEI

SEQ ID NO: 1770789 - protein, 10 aa, Staphylococcus epidermidis
ANVKKEGNDI

SEQ ID NO: 1770790 - protein, 14 aa, Staphylococcus epidermidis
APADVPAVRRIIEE

SEQ ID NO: 1770791 - protein, 7 aa, Staphylococcus epidermidis
APAKGDV

SEQ ID NO: 1770792 - protein, 6 aa, Staphylococcus epidermidis
APGFED

SEQ ID NO: 1770793 - protein, 5 aa, Staphylococcus epidermidis
APKVE

SEQ ID NO: 1770794 - protein, 8 aa, Staphylococcus epidermidis
APNAQNTA

SEQ ID NO: 1770795 - protein, 11 aa, Staphylococcus epidermidis
APVTEATVGQK

SEQ ID NO: 1770796 - protein, 12 aa, Staphylococcus epidermidis
APYQAPENPEIT

SEQ ID NO: 1770797 - protein, 19 aa, Staphylococcus epidermidis
AQDTNELERRRQAAESARL

SEQ ID NO: 1770798 - protein, 9 aa, Staphylococcus epidermidis
AQGHTDETV

SEQ ID NO: 1770799 - protein, 4 aa, Staphylococcus epidermidis
AQGK

SEQ ID NO: 1770800 - protein, 11 aa, Staphylococcus epidermidis
AQIYEKEDNKI

SEQ ID NO: 1770801 - protein, 6 aa, Staphylococcus epidermidis
AQKGNI

SEQ ID NO: 1770802 - protein, 7 aa, Staphylococcus epidermidis
AQKYSRT

SEQ ID NO: 1770803 - protein, 8 aa, Staphylococcus epidermidis
AQLSASEM

SEQ ID NO: 1770804 - protein, 8 aa, Staphylococcus epidermidis
AQMPGSVT

SEQ ID NO: 1770805 - protein, 8 aa, Staphylococcus epidermidis
AQSYSTHV

SEQ ID NO: 1770806 - protein, 5 aa, Staphylococcus epidermidis
AQYGK

SEQ ID NO: 1770807 - protein, 6 aa, Staphylococcus epidermidis
AREAYK

SEQ ID NO: 1770808 - protein, 11 aa, Staphylococcus epidermidis
ARGLASKRTTT

SEQ ID NO: 1770809 - protein, 6 aa, Staphylococcus epidermidis
ARKDAL

SEQ ID NO: 1770810 - protein, 10 aa, Staphylococcus epidermidis
ARKKLKNGEL

SEQ ID NO: 1770811 - protein, 6 aa, Staphylococcus epidermidis
ARPGTR

SEQ ID NO: 1770812 - protein, 4 aa, Staphylococcus epidermidis
ARPM

SEQ ID NO: 1770813 - protein, 9 aa, Staphylococcus epidermidis
ARPSLGKTS

SEQ ID NO: 1770814 - protein, 21 aa, Staphylococcus epidermidis
ARQQNIDVTNTPHASTNATAD

SEQ ID NO: 1770815 - protein, 15 aa, Staphylococcus epidermidis
ARSAGKKVEFQGQSY

SEQ ID NO: 1770816 - protein, 8 aa, Staphylococcus epidermidis
ARSGLERI

SEQ ID NO: 1770817 - protein, 4 aa, Staphylococcus epidermidis
ASLP

SEQ ID NO: 1770818 - protein, 6 aa, Staphylococcus epidermidis
ASNKGI

SEQ ID NO: 1770819 - protein, 9 aa, Staphylococcus epidermidis
ASNLDTNNE

SEQ ID NO: 1770820 - protein, 4 aa, Staphylococcus epidermidis
ASNQ

SEQ ID NO: 1770821 - protein, 7 aa, Staphylococcus epidermidis
ASPLASD

SEQ ID NO: 1770822 - protein, 17 aa, Staphylococcus epidermidis
ASPSLEKDGTFTNTERR

SEQ ID NO: 1770823 - protein, 6 aa, Staphylococcus epidermidis
ASRAIN

SEQ ID NO: 1770824 - protein, 4 aa, Staphylococcus epidermidis
ASSF

SEQ ID NO: 1770825 - protein, 14 aa, Staphylococcus epidermidis
ASSSEEVRNRGVEV

SEQ ID NO: 1770826 - protein, 4 aa, Staphylococcus epidermidis
ASTK

SEQ ID NO: 1770827 - protein, 6 aa, Staphylococcus epidermidis
ATGGTM

SEQ ID NO: 1770828 - protein, 7 aa, Staphylococcus epidermidis
ATHSDPS

SEQ ID NO: 1770829 - protein, 14 aa, Staphylococcus epidermidis
ATIETARKKYPKKD

SEQ ID NO: 1770830 - protein, 6 aa, Staphylococcus epidermidis
ATIMDG

SEQ ID NO: 1770831 - protein, 20 aa, Staphylococcus epidermidis
ATKDTRTRDTHRHLDGTSVD

SEQ ID NO: 1770832 - protein, 7 aa, Staphylococcus epidermidis
ATKGGSA

SEQ ID NO: 1770833 - protein, 12 aa, Staphylococcus epidermidis
ATLNEERQLNEI

SEQ ID NO: 1770834 - protein, 4 aa, Staphylococcus epidermidis
ATPA

SEQ ID NO: 1770835 - protein, 5 aa, Staphylococcus epidermidis
ATPAI

SEQ ID NO: 1770836 - protein, 6 aa, Staphylococcus epidermidis
ATPYDH

SEQ ID NO: 1770837 - protein, 8 aa, Staphylococcus epidermidis
ATRIGASA

SEQ ID NO: 1770838 - protein, 10 aa, Staphylococcus epidermidis
ATSGNGNDTA

SEQ ID NO: 1770839 - protein, 5 aa, Staphylococcus epidermidis
ATSPD

SEQ ID NO: 1770840 - protein, 20 aa, Staphylococcus epidermidis
ATTDKSKGALKQLADNEGYE

SEQ ID NO: 1770841 - protein, 11 aa, Staphylococcus epidermidis
ATVVPEGQKIP

SEQ ID NO: 1770842 - protein, 17 aa, Staphylococcus epidermidis
AVDKGTSFGASTLQENK

SEQ ID NO: 1770843 - protein, 18 aa, Staphylococcus epidermidis
AVDQDNKKDTLNRSPKDF

SEQ ID NO: 1770844 - protein, 9 aa, Staphylococcus epidermidis
AVGSKGSVY

SEQ ID NO: 1770845 - protein, 13 aa, Staphylococcus epidermidis
AVPEENGKEISRI

SEQ ID NO: 1770846 - protein, 27 aa, Staphylococcus epidermidis
AVSGSGVKGKRDLTEGANGKKPEAYPY

SEQ ID NO: 1770847 - protein, 10 aa, Staphylococcus epidermidis
AVSTQTLQRD

SEQ ID NO: 1770848 - protein, 14 aa, Staphylococcus epidermidis
AYTDSYENRTPSAG

SEQ ID NO: 1770849 - protein, 8 aa, Staphylococcus epidermidis
AYTGQPRD

SEQ ID NO: 1770850 - protein, 10 aa, Staphylococcus epidermidis
CDRQKDYRQL

SEQ ID NO: 1770851 - protein, 11 aa, Staphylococcus epidermidis
CDRQKDYRQLE

SEQ ID NO: 1770852 - protein, 5 aa, Staphylococcus epidermidis
CGKGS

SEQ ID NO: 1770853 - protein, 11 aa, Staphylococcus epidermidis
CKGKGTENKTV

SEQ ID NO: 1770854 - protein, 7 aa, Staphylococcus epidermidis
CKGQRLN

SEQ ID NO: 1770855 - protein, 10 aa, Staphylococcus epidermidis
CNPNPYQSQV

SEQ ID NO: 1770856 - protein, 5 aa, Staphylococcus epidermidis
DAKDN

SEQ ID NO: 1770857 - protein, 7 aa, Staphylococcus epidermidis
DAKEGNI

SEQ ID NO: 1770858 - protein, 7 aa, Staphylococcus epidermidis
DAKPEDY

SEQ ID NO: 1770859 - protein, 11 aa, Staphylococcus epidermidis
DAKRDAIKTDY

SEQ ID NO: 1770860 - protein, 5 aa, Staphylococcus epidermidis
DALPE

SEQ ID NO: 1770861 - protein, 7 aa, Staphylococcus epidermidis
DANRDAF

SEQ ID NO: 1770862 - protein, 19 aa, Staphylococcus epidermidis
DANSKLLRKPGERNTSLQK

SEQ ID NO: 1770863 - protein, 6 aa, Staphylococcus epidermidis
DANTSF

SEQ ID NO: 1770864 - protein, 8 aa, Staphylococcus epidermidis
DAPKKDPK

SEQ ID NO: 1770865 - protein, 4 aa, Staphylococcus epidermidis
DARV

SEQ ID NO: 1770866 - protein, 17 aa, Staphylococcus epidermidis
DASKIKKTAKQAAQESW

SEQ ID NO: 1770867 - protein, 16 aa, Staphylococcus epidermidis
DASKIKKTAKQATQES

SEQ ID NO: 1770868 - protein, 5 aa, Staphylococcus epidermidis
DASNK

SEQ ID NO: 1770869 - protein, 8 aa, Staphylococcus epidermidis
DCTREQAK

SEQ ID NO: 1770870 - protein, 26 aa, Staphylococcus epidermidis
DDAEDGNLINTSDEDKTTDEEEKAHS

SEQ ID NO: 1770871 - protein, 6 aa, Staphylococcus epidermidis
DDFNKA

SEQ ID NO: 1770872 - protein, 7 aa, Staphylococcus epidermidis
DDGPDAV

SEQ ID NO: 1770873 - protein, 15 aa, Staphylococcus epidermidis
DDGSITQANPEGGNY

SEQ ID NO: 1770874 - protein, 14 aa, Staphylococcus epidermidis
DDKAAAFQSHAENE

SEQ ID NO: 1770875 - protein, 4 aa, Staphylococcus epidermidis
DDKT

SEQ ID NO: 1770876 - protein, 15 aa, Staphylococcus epidermidis
DDLNEQKKKIETHTN

SEQ ID NO: 1770877 - protein, 7 aa, Staphylococcus epidermidis
DDNATNV

SEQ ID NO: 1770878 - protein, 4 aa, Staphylococcus epidermidis
DDYN

SEQ ID NO: 1770879 - protein, 20 aa, Staphylococcus epidermidis
DEAKEKANQRVKSATKEADE

SEQ ID NO: 1770880 - protein, 8 aa, Staphylococcus epidermidis
DEDMKESY

SEQ ID NO: 1770881 - protein, 6 aa, Staphylococcus epidermidis
DEDNQI

SEQ ID NO: 1770882 - protein, 14 aa, Staphylococcus epidermidis
DEDYSYKKYGRRRA

SEQ ID NO: 1770883 - protein, 6 aa, Staphylococcus epidermidis
DEEGEF

SEQ ID NO: 1770884 - protein, 4 aa, Staphylococcus epidermidis
DEEI

SEQ ID NO: 1770885 - protein, 5 aa, Staphylococcus epidermidis
DEENK

SEQ ID NO: 1770886 - protein, 4 aa, Staphylococcus epidermidis
DEGD

SEQ ID NO: 1770887 - protein, 5 aa, Staphylococcus epidermidis
DEGGI

SEQ ID NO: 1770888 - protein, 5 aa, Staphylococcus epidermidis
DEGNV

SEQ ID NO: 1770889 - protein, 10 aa, Staphylococcus epidermidis
DEIEKRLNNK

SEQ ID NO: 1770890 - protein, 6 aa, Staphylococcus epidermidis
DEIVKQ

SEQ ID NO: 1770891 - protein, 7 aa, Staphylococcus epidermidis
DEKEGRI

SEQ ID NO: 1770892 - protein, 15 aa, Staphylococcus epidermidis
DEKEIPTTFDTTRDQ

SEQ ID NO: 1770893 - protein, 8 aa, Staphylococcus epidermidis
DELPTPEN

SEQ ID NO: 1770894 - protein, 5 aa, Staphylococcus epidermidis
DEQGY

SEQ ID NO: 1770895 - protein, 14 aa, Staphylococcus epidermidis
DEQPDVKSNPKRIS

SEQ ID NO: 1770896 - protein, 12 aa, Staphylococcus epidermidis
DEQQKPKVTELE

SEQ ID NO: 1770897 - protein, 5 aa, Staphylococcus epidermidis
DERGP

SEQ ID NO: 1770898 - protein, 4 aa, Staphylococcus epidermidis
DESA

SEQ ID NO: 1770899 - protein, 10 aa, Staphylococcus epidermidis
DEYDGGNDFQ

SEQ ID NO: 1770900 - protein, 5 aa, Staphylococcus epidermidis
DFKDN

SEQ ID NO: 1770901 - protein, 11 aa, Staphylococcus epidermidis
DFNPETDSIAE

SEQ ID NO: 1770902 - protein, 10 aa, Staphylococcus epidermidis
DFSEDAEDAG

SEQ ID NO: 1770903 - protein, 4 aa, Staphylococcus epidermidis
DGAT

SEQ ID NO: 1770904 - protein, 4 aa, Staphylococcus epidermidis
DGIE

SEQ ID NO: 1770905 - protein, 19 aa, Staphylococcus epidermidis
DGNAKDDVKITTTETSETK

SEQ ID NO: 1770906 - protein, 7 aa, Staphylococcus epidermidis
DGRFDEV

SEQ ID NO: 1770907 - protein, 17 aa, Staphylococcus epidermidis
DGSEVSVDNPAQMPERD

SEQ ID NO: 1770908 - protein, 27 aa, Staphylococcus epidermidis
DGSLPSNNFTGVGTADTPDGKDFARTI

SEQ ID NO: 1770909 - protein, 7 aa, Staphylococcus epidermidis
DGSNQAR

SEQ ID NO: 1770910 - protein, 28 aa, Staphylococcus epidermidis
DGSTKSFTPVPLDENNKEEYELTRTVSV

SEQ ID NO: 1770911 - protein, 27 aa, Staphylococcus epidermidis
DGTTSAKVSDEIIESNTNNHLEQDKNV

SEQ ID NO: 1770912 - protein, 6 aa, Staphylococcus epidermidis
DGTTTV

SEQ ID NO: 1770913 - protein, 5 aa, Staphylococcus epidermidis
DGTYS

SEQ ID NO: 1770914 - protein, 22 aa, Staphylococcus epidermidis
DGVSKDCKVADKSGQAITYASR

SEQ ID NO: 1770915 - protein, 7 aa, Staphylococcus epidermidis
DHATETV

SEQ ID NO: 1770916 - protein, 17 aa, Staphylococcus epidermidis
DIAEEKENDSTNEGELI

SEQ ID NO: 1770917 - protein, 5 aa, Staphylococcus epidermidis
DIKRS

SEQ ID NO: 1770918 - protein, 8 aa, Staphylococcus epidermidis
DIPTEQAP

SEQ ID NO: 1770919 - protein, 8 aa, Staphylococcus epidermidis
DIPTNQAP

SEQ ID NO: 1770920 - protein, 12 aa, Staphylococcus epidermidis
DISEDNKTVGEA

SEQ ID NO: 1770921 - protein, 10 aa, Staphylococcus epidermidis
DITSQNHGYS

SEQ ID NO: 1770922 - protein, 8 aa, Staphylococcus epidermidis
DKDRSTHV

SEQ ID NO: 1770923 - protein, 7 aa, Staphylococcus epidermidis
DKEEKDI

SEQ ID NO: 1770924 - protein, 17 aa, Staphylococcus epidermidis
DKEGYRDEEFDKDDKGT

SEQ ID NO: 1770925 - protein, 8 aa, Staphylococcus epidermidis
DKEKAGRY

SEQ ID NO: 1770926 - protein, 11 aa, Staphylococcus epidermidis
DKETLKKGVEH

SEQ ID NO: 1770927 - protein, 14 aa, Staphylococcus epidermidis
DKETLQKACEEGKV

SEQ ID NO: 1770928 - protein, 10 aa, Staphylococcus epidermidis
DKFGNSPSGI

SEQ ID NO: 1770929 - protein, 17 aa, Staphylococcus epidermidis
DKFHSNKRRISNTGQRA

SEQ ID NO: 1770930 - protein, 4 aa, Staphylococcus epidermidis
DKGI

SEQ ID NO: 1770931 - protein, 8 aa, Staphylococcus epidermidis
DKGQTSVS

SEQ ID NO: 1770932 - protein, 7 aa, Staphylococcus epidermidis
DKGTEIT

SEQ ID NO: 1770933 - protein, 14 aa, Staphylococcus epidermidis
DKIDEAKKDGDSIG

SEQ ID NO: 1770934 - protein, 12 aa, Staphylococcus epidermidis
DKISELRSRTKY

SEQ ID NO: 1770935 - protein, 8 aa, Staphylococcus epidermidis
DKKKQMTL

SEQ ID NO: 1770936 - protein, 11 aa, Staphylococcus epidermidis
DKLNQYTNEQR

SEQ ID NO: 1770937 - protein, 7 aa, Staphylococcus epidermidis
DKQNIKV

SEQ ID NO: 1770938 - protein, 14 aa, Staphylococcus epidermidis
DKQSGRKDNRSGYR

SEQ ID NO: 1770939 - protein, 15 aa, Staphylococcus epidermidis
DKQSGRKDNRSGYRQ

SEQ ID NO: 1770940 - protein, 8 aa, Staphylococcus epidermidis
DKQSRTSI

SEQ ID NO: 1770941 - protein, 5 aa, Staphylococcus epidermidis
DKQTI

SEQ ID NO: 1770942 - protein, 6 aa, Staphylococcus epidermidis
DKTAQY

SEQ ID NO: 1770943 - protein, 5 aa, Staphylococcus epidermidis
DKVPD

SEQ ID NO: 1770944 - protein, 7 aa, Staphylococcus epidermidis
DLDNQTL

SEQ ID NO: 1770945 - protein, 6 aa, Staphylococcus epidermidis
DLEKYK

SEQ ID NO: 1770946 - protein, 5 aa, Staphylococcus epidermidis
DLGTD

SEQ ID NO: 1770947 - protein, 18 aa, Staphylococcus epidermidis
DLKRAKYAGIEQQKMKGK

SEQ ID NO: 1770948 - protein, 4 aa, Staphylococcus epidermidis
DLLK

SEQ ID NO: 1770949 - protein, 10 aa, Staphylococcus epidermidis
DLNRAEDRKE

SEQ ID NO: 1770950 - protein, 14 aa, Staphylococcus epidermidis
DLPPLKNGEKSKIP

SEQ ID NO: 1770951 - protein, 4 aa, Staphylococcus epidermidis
DNDK

SEQ ID NO: 1770952 - protein, 6 aa, Staphylococcus epidermidis
DNEEIE

SEQ ID NO: 1770953 - protein, 4 aa, Staphylococcus epidermidis
DNFD

SEQ ID NO: 1770954 - protein, 7 aa, Staphylococcus epidermidis
DNGSHAV

SEQ ID NO: 1770955 - protein, 6 aa, Staphylococcus epidermidis
DNGSYA

SEQ ID NO: 1770956 - protein, 4 aa, Staphylococcus epidermidis
DNIS

SEQ ID NO: 1770957 - protein, 5 aa, Staphylococcus epidermidis
DNKKA

SEQ ID NO: 1770958 - protein, 10 aa, Staphylococcus epidermidis
DNPGSQHGHG

SEQ ID NO: 1770959 - protein, 33 aa, Staphylococcus epidermidis
DNPITKKNYYSGKKEFAGKPVTQETANKVEEEL

SEQ ID NO: 1770960 - protein, 9 aa, Staphylococcus epidermidis
DNQTPEDTK

SEQ ID NO: 1770961 - protein, 7 aa, Staphylococcus epidermidis
DPEGNGI

SEQ ID NO: 1770962 - protein, 8 aa, Staphylococcus epidermidis
DPKSIGVG

SEQ ID NO: 1770963 - protein, 9 aa, Staphylococcus epidermidis
DPNQQKSFE

SEQ ID NO: 1770964 - protein, 6 aa, Staphylococcus epidermidis
DPNWSS

SEQ ID NO: 1770965 - protein, 12 aa, Staphylococcus epidermidis
DPQMRGQGLGPK

SEQ ID NO: 1770966 - protein, 5 aa, Staphylococcus epidermidis
DPRNQ

SEQ ID NO: 1770967 - protein, 6 aa, Staphylococcus epidermidis
DPSETR

SEQ ID NO: 1770968 - protein, 4 aa, Staphylococcus epidermidis
DPSI

SEQ ID NO: 1770969 - protein, 9 aa, Staphylococcus epidermidis
DPYQQSQSF

SEQ ID NO: 1770970 - protein, 10 aa, Staphylococcus epidermidis
DQAQMTPQDV

SEQ ID NO: 1770971 - protein, 7 aa, Staphylococcus epidermidis
DQEKISR

SEQ ID NO: 1770972 - protein, 5 aa, Staphylococcus epidermidis
DQLAR

SEQ ID NO: 1770973 - protein, 7 aa, Staphylococcus epidermidis
DQPYPDN

SEQ ID NO: 1770974 - protein, 8 aa, Staphylococcus epidermidis
DQSASGQT

SEQ ID NO: 1770975 - protein, 5 aa, Staphylococcus epidermidis
DRAAQ

SEQ ID NO: 1770976 - protein, 13 aa, Staphylococcus epidermidis
DRDPSTKTTALYS

SEQ ID NO: 1770977 - protein, 6 aa, Staphylococcus epidermidis
DREEET

SEQ ID NO: 1770978 - protein, 17 aa, Staphylococcus epidermidis
DREHEDERHNLTKGRLQ

SEQ ID NO: 1770979 - protein, 13 aa, Staphylococcus epidermidis
DRETKGSKPKMIQ

SEQ ID NO: 1770980 - protein, 10 aa, Staphylococcus epidermidis
DRKGDGYPAF

SEQ ID NO: 1770981 - protein, 6 aa, Staphylococcus epidermidis
DRMSSS

SEQ ID NO: 1770982 - protein, 16 aa, Staphylococcus epidermidis
DRPLEARKDVDERDLE

SEQ ID NO: 1770983 - protein, 4 aa, Staphylococcus epidermidis
DRPR

SEQ ID NO: 1770984 - protein, 5 aa, Staphylococcus epidermidis
DRTTA

SEQ ID NO: 1770985 - protein, 12 aa, Staphylococcus epidermidis
DRYGSDKPDTRF

SEQ ID NO: 1770986 - protein, 8 aa, Staphylococcus epidermidis
DSAIEQDN

SEQ ID NO: 1770987 - protein, 27 aa, Staphylococcus epidermidis
DSENGQNQTESANEFKEEQNQHSQSNI

SEQ ID NO: 1770988 - protein, 4 aa, Staphylococcus epidermidis
DSFP

SEQ ID NO: 1770989 - protein, 4 aa, Staphylococcus epidermidis
DSIY

SEQ ID NO: 1770990 - protein, 5 aa, Staphylococcus epidermidis
DSKLT

SEQ ID NO: 1770991 - protein, 6 aa, Staphylococcus epidermidis
DSKLTN

SEQ ID NO: 1770992 - protein, 6 aa, Staphylococcus epidermidis
DSLKVG

SEQ ID NO: 1770993 - protein, 6 aa, Staphylococcus epidermidis
DSNERF

SEQ ID NO: 1770994 - protein, 7 aa, Staphylococcus epidermidis
DSNNHSL

SEQ ID NO: 1770995 - protein, 4 aa, Staphylococcus epidermidis
DSNY

SEQ ID NO: 1770996 - protein, 4 aa, Staphylococcus epidermidis
DSTG

SEQ ID NO: 1770997 - protein, 6 aa, Staphylococcus epidermidis
DSVNDE

SEQ ID NO: 1770998 - protein, 6 aa, Staphylococcus epidermidis
DTARYG

SEQ ID NO: 1770999 - protein, 37 aa, Staphylococcus epidermidis
DTATNNRQNINPQEATFTEESQNINQQQTKRQPTEVN

SEQ ID NO: 1771000 - protein, 4 aa, Staphylococcus epidermidis
DTDC

SEQ ID NO: 1771001 - protein, 12 aa, Staphylococcus epidermidis
DTEGLPITKGNN

SEQ ID NO: 1771002 - protein, 10 aa, Staphylococcus epidermidis
DTENAESLSE

SEQ ID NO: 1771003 - protein, 8 aa, Staphylococcus epidermidis
DTENKNGE

SEQ ID NO: 1771004 - protein, 10 aa, Staphylococcus epidermidis
DTENKNGEIT

SEQ ID NO: 1771005 - protein, 10 aa, Staphylococcus epidermidis
DTFDNDGYFQ

SEQ ID NO: 1771006 - protein, 5 aa, Staphylococcus epidermidis
DTGIV

SEQ ID NO: 1771007 - protein, 19 aa, Staphylococcus epidermidis
DTISGGTVEVEGKEINKLS

SEQ ID NO: 1771008 - protein, 8 aa, Staphylococcus epidermidis
DTPTSSEQ

SEQ ID NO: 1771009 - protein, 6 aa, Staphylococcus epidermidis
DTTEYD

SEQ ID NO: 1771010 - protein, 8 aa, Staphylococcus epidermidis
DVARSSQG

SEQ ID NO: 1771011 - protein, 7 aa, Staphylococcus epidermidis
DVDEQKV

SEQ ID NO: 1771012 - protein, 14 aa, Staphylococcus epidermidis
DVEREKSKSFGEAK

SEQ ID NO: 1771013 - protein, 24 aa, Staphylococcus epidermidis
DVGYSEAKETIKNTFDSASTFGRK

SEQ ID NO: 1771014 - protein, 8 aa, Staphylococcus epidermidis
DVNGISGH

SEQ ID NO: 1771015 - protein, 8 aa, Staphylococcus epidermidis
DVPQRDRR

SEQ ID NO: 1771016 - protein, 7 aa, Staphylococcus epidermidis
DWPSAGV

SEQ ID NO: 1771017 - protein, 6 aa, Staphylococcus epidermidis
DYHQET

SEQ ID NO: 1771018 - protein, 7 aa, Staphylococcus epidermidis
DYNIPQK

SEQ ID NO: 1771019 - protein, 9 aa, Staphylococcus epidermidis
DYNKTKQQP

SEQ ID NO: 1771020 - protein, 7 aa, Staphylococcus epidermidis
DYVRHGE

SEQ ID NO: 1771021 - protein, 5 aa, Staphylococcus epidermidis
EAAEN

SEQ ID NO: 1771022 - protein, 6 aa, Staphylococcus epidermidis
EAAKRG

SEQ ID NO: 1771023 - protein, 15 aa, Staphylococcus epidermidis
EAGEPLTPNRMNEEY

SEQ ID NO: 1771024 - protein, 8 aa, Staphylococcus epidermidis
EAGGIEQD

SEQ ID NO: 1771025 - protein, 14 aa, Staphylococcus epidermidis
EAGMSSKEAQARAK

SEQ ID NO: 1771026 - protein, 4 aa, Staphylococcus epidermidis
EAGQ

SEQ ID NO: 1771027 - protein, 11 aa, Staphylococcus epidermidis
EAITKTQNIGY

SEQ ID NO: 1771028 - protein, 4 aa, Staphylococcus epidermidis
EALA

SEQ ID NO: 1771029 - protein, 13 aa, Staphylococcus epidermidis
EANRVIAKSSLRK

SEQ ID NO: 1771030 - protein, 13 aa, Staphylococcus epidermidis
EAPPNQNKINPYE

SEQ ID NO: 1771031 - protein, 10 aa, Staphylococcus epidermidis
EAQDGSEKKQ

SEQ ID NO: 1771032 - protein, 10 aa, Staphylococcus epidermidis
EASKKLKEFN

SEQ ID NO: 1771033 - protein, 4 aa, Staphylococcus epidermidis
EATR

SEQ ID NO: 1771034 - protein, 7 aa, Staphylococcus epidermidis
EAYPQPN

SEQ ID NO: 1771035 - protein, 4 aa, Staphylococcus epidermidis
EAYT

SEQ ID NO: 1771036 - protein, 4 aa, Staphylococcus epidermidis
ECKE

SEQ ID NO: 1771037 - protein, 6 aa, Staphylococcus epidermidis
EDAQQP

SEQ ID NO: 1771038 - protein, 13 aa, Staphylococcus epidermidis
EDDDNKKDKQKGG

SEQ ID NO: 1771039 - protein, 8 aa, Staphylococcus epidermidis
EDDHSEAM

SEQ ID NO: 1771040 - protein, 8 aa, Staphylococcus epidermidis
EDDKSKKL

SEQ ID NO: 1771041 - protein, 11 aa, Staphylococcus epidermidis
EDDYNYDEKTK

SEQ ID NO: 1771042 - protein, 10 aa, Staphylococcus epidermidis
EDGTTVTEDG

SEQ ID NO: 1771043 - protein, 17 aa, Staphylococcus epidermidis
EDKNRNNVPLTAPPDGL

SEQ ID NO: 1771044 - protein, 5 aa, Staphylococcus epidermidis
EDMQM

SEQ ID NO: 1771045 - protein, 13 aa, Staphylococcus epidermidis
EDNEKKVKNYSYG

SEQ ID NO: 1771046 - protein, 7 aa, Staphylococcus epidermidis
EDNPVQD

SEQ ID NO: 1771047 - protein, 8 aa, Staphylococcus epidermidis
EDNQRLTE

SEQ ID NO: 1771048 - protein, 4 aa, Staphylococcus epidermidis
EDSG

SEQ ID NO: 1771049 - protein, 10 aa, Staphylococcus epidermidis
EDTPGVTRDR

SEQ ID NO: 1771050 - protein, 5 aa, Staphylococcus epidermidis
EDTRI

SEQ ID NO: 1771051 - protein, 4 aa, Staphylococcus epidermidis
EDTV

SEQ ID NO: 1771052 - protein, 25 aa, Staphylococcus epidermidis
EDVSDEEYNAMEKRQNEILDEVEPI

SEQ ID NO: 1771053 - protein, 5 aa, Staphylococcus epidermidis
EEAEE

SEQ ID NO: 1771054 - protein, 20 aa, Staphylococcus epidermidis
EEAKEKANKRVKSATKEADE

SEQ ID NO: 1771055 - protein, 5 aa, Staphylococcus epidermidis
EEEWG

SEQ ID NO: 1771056 - protein, 6 aa, Staphylococcus epidermidis
EEKDKF

SEQ ID NO: 1771057 - protein, 6 aa, Staphylococcus epidermidis
EEKNCK

SEQ ID NO: 1771058 - protein, 6 aa, Staphylococcus epidermidis
EEKPWN

SEQ ID NO: 1771059 - protein, 5 aa, Staphylococcus epidermidis
EELQS

SEQ ID NO: 1771060 - protein, 21 aa, Staphylococcus epidermidis
EEMPEDFQPQVATPQLREKYQ

SEQ ID NO: 1771061 - protein, 12 aa, Staphylococcus epidermidis
EEQAKNHPDNPF

SEQ ID NO: 1771062 - protein, 10 aa, Staphylococcus epidermidis
EEQKEKEKLL

SEQ ID NO: 1771063 - protein, 4 aa, Staphylococcus epidermidis
EEQR

SEQ ID NO: 1771064 - protein, 12 aa, Staphylococcus epidermidis
EEQSKNHPDNPF

SEQ ID NO: 1771065 - protein, 7 aa, Staphylococcus epidermidis
EERAPLR

SEQ ID NO: 1771066 - protein, 7 aa, Staphylococcus epidermidis
EERDSKI

SEQ ID NO: 1771067 - protein, 9 aa, Staphylococcus epidermidis
EERKGNKGA

SEQ ID NO: 1771068 - protein, 7 aa, Staphylococcus epidermidis
EESIDKE

SEQ ID NO: 1771069 - protein, 24 aa, Staphylococcus epidermidis
EESKTDVLHGKQSSSLTNEREDKL

SEQ ID NO: 1771070 - protein, 21 aa, Staphylococcus epidermidis
EETGATFEENAKLKSEAAAHA

SEQ ID NO: 1771071 - protein, 6 aa, Staphylococcus epidermidis
EETGHT

SEQ ID NO: 1771072 - protein, 8 aa, Staphylococcus epidermidis
EEVEGRPE

SEQ ID NO: 1771073 - protein, 8 aa, Staphylococcus epidermidis
EEVPEEEY

SEQ ID NO: 1771074 - protein, 8 aa, Staphylococcus epidermidis
EFNDKEGR

SEQ ID NO: 1771075 - protein, 5 aa, Staphylococcus epidermidis
EFPNI

SEQ ID NO: 1771076 - protein, 7 aa, Staphylococcus epidermidis
EFQRQNS

SEQ ID NO: 1771077 - protein, 7 aa, Staphylococcus epidermidis
EFSKGQK

SEQ ID NO: 1771078 - protein, 9 aa, Staphylococcus epidermidis
EGAQSDDED

SEQ ID NO: 1771079 - protein, 8 aa, Staphylococcus epidermidis
EGEKRDFR

SEQ ID NO: 1771080 - protein, 5 aa, Staphylococcus epidermidis
EGFNE

SEQ ID NO: 1771081 - protein, 12 aa, Staphylococcus epidermidis
EGIKNGNGEESI

SEQ ID NO: 1771082 - protein, 11 aa, Staphylococcus epidermidis
EGIKQKQLRDN

SEQ ID NO: 1771083 - protein, 24 aa, Staphylococcus epidermidis
EGKRYKKKGFKTKREATEAESIAK

SEQ ID NO: 1771084 - protein, 9 aa, Staphylococcus epidermidis
EGKTPASLR

SEQ ID NO: 1771085 - protein, 10 aa, Staphylococcus epidermidis
EGNEIGNAVR

SEQ ID NO: 1771086 - protein, 24 aa, Staphylococcus epidermidis
EGNQLQGVTNKGNLNINRQRKQYN

SEQ ID NO: 1771087 - protein, 9 aa, Staphylococcus epidermidis
EGPGLTKKM

SEQ ID NO: 1771088 - protein, 4 aa, Staphylococcus epidermidis
EGQM

SEQ ID NO: 1771089 - protein, 7 aa, Staphylococcus epidermidis
EGQPAVE

SEQ ID NO: 1771090 - protein, 4 aa, Staphylococcus epidermidis
EGQR

SEQ ID NO: 1771091 - protein, 75 aa, Staphylococcus epidermidis
EGQVNTSNDSSNESSQKDEAKEKETPKQSNPNSSESENTQDNSQQRINATPSARRHARKNGVDLSEVSGKGNDVL

SEQ ID NO: 1771092 - protein, 14 aa, Staphylococcus epidermidis
EGTQKAIASTIDGE

SEQ ID NO: 1771093 - protein, 4 aa, Staphylococcus epidermidis
EGTV

SEQ ID NO: 1771094 - protein, 11 aa, Staphylococcus epidermidis
EHDIDNPRGIN

SEQ ID NO: 1771095 - protein, 10 aa, Staphylococcus epidermidis
EHEENGQKSY

SEQ ID NO: 1771096 - protein, 8 aa, Staphylococcus epidermidis
EHRKAQNF

SEQ ID NO: 1771097 - protein, 5 aa, Staphylococcus epidermidis
EIEQE

SEQ ID NO: 1771098 - protein, 5 aa, Staphylococcus epidermidis
EIKQN

SEQ ID NO: 1771099 - protein, 12 aa, Staphylococcus epidermidis
EIKTTIETFAHR

SEQ ID NO: 1771100 - protein, 9 aa, Staphylococcus epidermidis
EINETEGVT

SEQ ID NO: 1771101 - protein, 4 aa, Staphylococcus epidermidis
EINP

SEQ ID NO: 1771102 - protein, 10 aa, Staphylococcus epidermidis
EIPDGTHDTI

SEQ ID NO: 1771103 - protein, 6 aa, Staphylococcus epidermidis
EIQETG

SEQ ID NO: 1771104 - protein, 12 aa, Staphylococcus epidermidis
EIRPKSGDARKY

SEQ ID NO: 1771105 - protein, 10 aa, Staphylococcus epidermidis
EIRQKNRQID

SEQ ID NO: 1771106 - protein, 7 aa, Staphylococcus epidermidis
EITNVES

SEQ ID NO: 1771107 - protein, 24 aa, Staphylococcus epidermidis
EKDSSDTDDKINPNDLSAPPGVKI

SEQ ID NO: 1771108 - protein, 8 aa, Staphylococcus epidermidis
EKDYKTTY

SEQ ID NO: 1771109 - protein, 6 aa, Staphylococcus epidermidis
EKEDSI

SEQ ID NO: 1771110 - protein, 10 aa, Staphylococcus epidermidis
EKEFKEKGYQ

SEQ ID NO: 1771111 - protein, 4 aa, Staphylococcus epidermidis
EKEH

SEQ ID NO: 1771112 - protein, 10 aa, Staphylococcus epidermidis
EKFKGESIPT

SEQ ID NO: 1771113 - protein, 9 aa, Staphylococcus epidermidis
EKIEADLRG

SEQ ID NO: 1771114 - protein, 12 aa, Staphylococcus epidermidis
EKIEQGIKRGKK

SEQ ID NO: 1771115 - protein, 4 aa, Staphylococcus epidermidis
EKKL

SEQ ID NO: 1771116 - protein, 16 aa, Staphylococcus epidermidis
EKNKKAQAEKKTELQK

SEQ ID NO: 1771117 - protein, 18 aa, Staphylococcus epidermidis
EKNKLESREEKRKEIYQS

SEQ ID NO: 1771118 - protein, 10 aa, Staphylococcus epidermidis
EKQKKHSGFS

SEQ ID NO: 1771119 - protein, 47 aa, Staphylococcus epidermidis
EKQQSQIGETSAPYVHDQKDKNHDVESHKNNLDSTSSTNNESTEVSN

SEQ ID NO: 1771120 - protein, 23 aa, Staphylococcus epidermidis
EKRIHSKRQSNMISTGKPKQYIS

SEQ ID NO: 1771121 - protein, 8 aa, Staphylococcus epidermidis
EKRSRENL

SEQ ID NO: 1771122 - protein, 8 aa, Staphylococcus epidermidis
EKRTNNVV

SEQ ID NO: 1771123 - protein, 7 aa, Staphylococcus epidermidis
EKSFGKG

SEQ ID NO: 1771124 - protein, 11 aa, Staphylococcus epidermidis
EKSKYKDTRAI

SEQ ID NO: 1771125 - protein, 4 aa, Staphylococcus epidermidis
EKTE

SEQ ID NO: 1771126 - protein, 7 aa, Staphylococcus epidermidis
EKTEEEV

SEQ ID NO: 1771127 - protein, 7 aa, Staphylococcus epidermidis
EKTNRRV

SEQ ID NO: 1771128 - protein, 5 aa, Staphylococcus epidermidis
EKTPH

SEQ ID NO: 1771129 - protein, 9 aa, Staphylococcus epidermidis
EKTSANRRV

SEQ ID NO: 1771130 - protein, 16 aa, Staphylococcus epidermidis
EKVPVTDTIGAGDSHT

SEQ ID NO: 1771131 - protein, 4 aa, Staphylococcus epidermidis
ELDI

SEQ ID NO: 1771132 - protein, 8 aa, Staphylococcus epidermidis
ELHEGKKE

SEQ ID NO: 1771133 - protein, 8 aa, Staphylococcus epidermidis
ELKNEGRM

SEQ ID NO: 1771134 - protein, 11 aa, Staphylococcus epidermidis
ELNTPKSVEIK

SEQ ID NO: 1771135 - protein, 12 aa, Staphylococcus epidermidis
ELPTTMRTKEDG

SEQ ID NO: 1771136 - protein, 8 aa, Staphylococcus epidermidis
ELQPSGMD

SEQ ID NO: 1771137 - protein, 20 aa, Staphylococcus epidermidis
ELRDGDKSRYLGKGVTKAVE

SEQ ID NO: 1771138 - protein, 5 aa, Staphylococcus epidermidis
ELREK

SEQ ID NO: 1771139 - protein, 9 aa, Staphylococcus epidermidis
ELTDEAASE

SEQ ID NO: 1771140 - protein, 16 aa, Staphylococcus epidermidis
ENGDTLEDPAHKGEQF

SEQ ID NO: 1771141 - protein, 6 aa, Staphylococcus epidermidis
ENGNEV

SEQ ID NO: 1771142 - protein, 13 aa, Staphylococcus epidermidis
ENGRKEIYKRTYK

SEQ ID NO: 1771143 - protein, 8 aa, Staphylococcus epidermidis
ENKSSEEL

SEQ ID NO: 1771144 - protein, 5 aa, Staphylococcus epidermidis
ENKTY

SEQ ID NO: 1771145 - protein, 6 aa, Staphylococcus epidermidis
ENNQIQ

SEQ ID NO: 1771146 - protein, 6 aa, Staphylococcus epidermidis
ENNSKK

SEQ ID NO: 1771147 - protein, 7 aa, Staphylococcus epidermidis
ENQDGNF

SEQ ID NO: 1771148 - protein, 9 aa, Staphylococcus epidermidis
ENQRKEVTQ

SEQ ID NO: 1771149 - protein, 5 aa, Staphylococcus epidermidis
ENSEQ

SEQ ID NO: 1771150 - protein, 6 aa, Staphylococcus epidermidis
ENTDNL

SEQ ID NO: 1771151 - protein, 7 aa, Staphylococcus epidermidis
ENTNHAF

SEQ ID NO: 1771152 - protein, 10 aa, Staphylococcus epidermidis
ENTSNGSNVK

SEQ ID NO: 1771153 - protein, 12 aa, Staphylococcus epidermidis
ENVVSDKAYATF

SEQ ID NO: 1771154 - protein, 9 aa, Staphylococcus epidermidis
ENYKENREY

SEQ ID NO: 1771155 - protein, 6 aa, Staphylococcus epidermidis
EPDEGI

SEQ ID NO: 1771156 - protein, 4 aa, Staphylococcus epidermidis
EPDL

SEQ ID NO: 1771157 - protein, 6 aa, Staphylococcus epidermidis
EPIQPD

SEQ ID NO: 1771158 - protein, 6 aa, Staphylococcus epidermidis
EPIQPN

SEQ ID NO: 1771159 - protein, 5 aa, Staphylococcus epidermidis
EPKPQ

SEQ ID NO: 1771160 - protein, 14 aa, Staphylococcus epidermidis
EPLGGAQKDEEVQA

SEQ ID NO: 1771161 - protein, 8 aa, Staphylococcus epidermidis
EPNNENHD

SEQ ID NO: 1771162 - protein, 5 aa, Staphylococcus epidermidis
EPSNL

SEQ ID NO: 1771163 - protein, 7 aa, Staphylococcus epidermidis
EPTDEAV

SEQ ID NO: 1771164 - protein, 13 aa, Staphylococcus epidermidis
EPTETTKKAFDKQ

SEQ ID NO: 1771165 - protein, 12 aa, Staphylococcus epidermidis
EPVEAEKDDTDL

SEQ ID NO: 1771166 - protein, 9 aa, Staphylococcus epidermidis
EPVPPLPPV

SEQ ID NO: 1771167 - protein, 11 aa, Staphylococcus epidermidis
EQAKNHPDNPF

SEQ ID NO: 1771168 - protein, 7 aa, Staphylococcus epidermidis
EQEQPAY

SEQ ID NO: 1771169 - protein, 15 aa, Staphylococcus epidermidis
EQERNESKRRQAQGI

SEQ ID NO: 1771170 - protein, 7 aa, Staphylococcus epidermidis
EQEYGKD

SEQ ID NO: 1771171 - protein, 19 aa, Staphylococcus epidermidis
EQGATHAAEGYARVSGKTG

SEQ ID NO: 1771172 - protein, 13 aa, Staphylococcus epidermidis
EQIQQQENVRQNL

SEQ ID NO: 1771173 - protein, 5 aa, Staphylococcus epidermidis
EQMSE

SEQ ID NO: 1771174 - protein, 6 aa, Staphylococcus epidermidis
EQNERI

SEQ ID NO: 1771175 - protein, 11 aa, Staphylococcus epidermidis
EQPREELSAYA

SEQ ID NO: 1771176 - protein, 4 aa, Staphylococcus epidermidis
EQTQ

SEQ ID NO: 1771177 - protein, 11 aa, Staphylococcus epidermidis
ERAGQKADVAK

SEQ ID NO: 1771178 - protein, 8 aa, Staphylococcus epidermidis
ERDNQPHT

SEQ ID NO: 1771179 - protein, 4 aa, Staphylococcus epidermidis
ERGI

SEQ ID NO: 1771180 - protein, 5 aa, Staphylococcus epidermidis
ERNAN

SEQ ID NO: 1771181 - protein, 13 aa, Staphylococcus epidermidis
ERNYKDDNNEIST

SEQ ID NO: 1771182 - protein, 8 aa, Staphylococcus epidermidis
ERQKQEKA

SEQ ID NO: 1771183 - protein, 5 aa, Staphylococcus epidermidis
ERQRQ

SEQ ID NO: 1771184 - protein, 10 aa, Staphylococcus epidermidis
ERTPRGRKAT

SEQ ID NO: 1771185 - protein, 6 aa, Staphylococcus epidermidis
ESAGEA

SEQ ID NO: 1771186 - protein, 8 aa, Staphylococcus epidermidis
ESDEDTQD

SEQ ID NO: 1771187 - protein, 17 aa, Staphylococcus epidermidis
ESDEEREAGKANKIVGN

SEQ ID NO: 1771188 - protein, 13 aa, Staphylococcus epidermidis
ESDKDSETKSSGF

SEQ ID NO: 1771189 - protein, 5 aa, Staphylococcus epidermidis
ESEEE

SEQ ID NO: 1771190 - protein, 4 aa, Staphylococcus epidermidis
ESER

SEQ ID NO: 1771191 - protein, 10 aa, Staphylococcus epidermidis
ESESNESDFK

SEQ ID NO: 1771192 - protein, 6 aa, Staphylococcus epidermidis
ESETTF

SEQ ID NO: 1771193 - protein, 12 aa, Staphylococcus epidermidis
ESFKGDNQEPWT

SEQ ID NO: 1771194 - protein, 18 aa, Staphylococcus epidermidis
ESGESAYETMALKELGMK

SEQ ID NO: 1771195 - protein, 8 aa, Staphylococcus epidermidis
ESGSGKSL

SEQ ID NO: 1771196 - protein, 8 aa, Staphylococcus epidermidis
ESGTPQNI

SEQ ID NO: 1771197 - protein, 19 aa, Staphylococcus epidermidis
ESIKSAKEKKYSKSNPYDA

SEQ ID NO: 1771198 - protein, 5 aa, Staphylococcus epidermidis
ESKKT

SEQ ID NO: 1771199 - protein, 4 aa, Staphylococcus epidermidis
ESKP

SEQ ID NO: 1771200 - protein, 7 aa, Staphylococcus epidermidis
ESKQGTG

SEQ ID NO: 1771201 - protein, 5 aa, Staphylococcus epidermidis
ESKTA

SEQ ID NO: 1771202 - protein, 11 aa, Staphylococcus epidermidis
ESLNNLSPTNT

SEQ ID NO: 1771203 - protein, 11 aa, Staphylococcus epidermidis
ESQSYSTLPYQ

SEQ ID NO: 1771204 - protein, 4 aa, Staphylococcus epidermidis
ESQW

SEQ ID NO: 1771205 - protein, 11 aa, Staphylococcus epidermidis
ESRGKNKHGID

SEQ ID NO: 1771206 - protein, 8 aa, Staphylococcus epidermidis
ESSRPNEI

SEQ ID NO: 1771207 - protein, 4 aa, Staphylococcus epidermidis
ESTK

SEQ ID NO: 1771208 - protein, 8 aa, Staphylococcus epidermidis
ESTNFAKA

SEQ ID NO: 1771209 - protein, 7 aa, Staphylococcus epidermidis
ESTSEEV

SEQ ID NO: 1771210 - protein, 5 aa, Staphylococcus epidermidis
ESVYE

SEQ ID NO: 1771211 - protein, 4 aa, Staphylococcus epidermidis
ESYK

SEQ ID NO: 1771212 - protein, 6 aa, Staphylococcus epidermidis
ETAKKY

SEQ ID NO: 1771213 - protein, 9 aa, Staphylococcus epidermidis
ETDGKIKPT

SEQ ID NO: 1771214 - protein, 10 aa, Staphylococcus epidermidis
ETDLQKKDSY

SEQ ID NO: 1771215 - protein, 6 aa, Staphylococcus epidermidis
ETHGVN

SEQ ID NO: 1771216 - protein, 6 aa, Staphylococcus epidermidis
ETIKGR

SEQ ID NO: 1771217 - protein, 17 aa, Staphylococcus epidermidis
ETIPDTEFDEFRHYRGL

SEQ ID NO: 1771218 - protein, 9 aa, Staphylococcus epidermidis
ETKNTQDID

SEQ ID NO: 1771219 - protein, 5 aa, Staphylococcus epidermidis
ETLDK

SEQ ID NO: 1771220 - protein, 13 aa, Staphylococcus epidermidis
ETLEQIPNQEHDE

SEQ ID NO: 1771221 - protein, 6 aa, Staphylococcus epidermidis
ETNQEA

SEQ ID NO: 1771222 - protein, 8 aa, Staphylococcus epidermidis
ETNYKDRK

SEQ ID NO: 1771223 - protein, 7 aa, Staphylococcus epidermidis
ETPTEGQ

SEQ ID NO: 1771224 - protein, 5 aa, Staphylococcus epidermidis
ETQHF

SEQ ID NO: 1771225 - protein, 20 aa, Staphylococcus epidermidis
ETQSDGQTGVVDEIKTWISK

SEQ ID NO: 1771226 - protein, 12 aa, Staphylococcus epidermidis
ETRYYANSDREI

SEQ ID NO: 1771227 - protein, 5 aa, Staphylococcus epidermidis
ETSIN

SEQ ID NO: 1771228 - protein, 17 aa, Staphylococcus epidermidis
ETVGRNRKPNRKAPKQI

SEQ ID NO: 1771229 - protein, 5 aa, Staphylococcus epidermidis
ETYPQ

SEQ ID NO: 1771230 - protein, 10 aa, Staphylococcus epidermidis
EVAKDEKSYA

SEQ ID NO: 1771231 - protein, 12 aa, Staphylococcus epidermidis
EVPDNKKLSIEQ

SEQ ID NO: 1771232 - protein, 9 aa, Staphylococcus epidermidis
EVSKQTNQP

SEQ ID NO: 1771233 - protein, 15 aa, Staphylococcus epidermidis
EVTKKQRQHKNGHKS

SEQ ID NO: 1771234 - protein, 5 aa, Staphylococcus epidermidis
EYEFD

SEQ ID NO: 1771235 - protein, 18 aa, Staphylococcus epidermidis
EYEYSGNIDRKSIGQNIS

SEQ ID NO: 1771236 - protein, 10 aa, Staphylococcus epidermidis
EYKDSTGRKL

SEQ ID NO: 1771237 - protein, 4 aa, Staphylococcus epidermidis
EYLE

SEQ ID NO: 1771238 - protein, 5 aa, Staphylococcus epidermidis
EYPDV

SEQ ID NO: 1771239 - protein, 5 aa, Staphylococcus epidermidis
FAKGS

SEQ ID NO: 1771240 - protein, 4 aa, Staphylococcus epidermidis
FAPT

SEQ ID NO: 1771241 - protein, 10 aa, Staphylococcus epidermidis
FDDEDDKIEI

SEQ ID NO: 1771242 - protein, 10 aa, Staphylococcus epidermidis
FDKETRQSIA

SEQ ID NO: 1771243 - protein, 8 aa, Staphylococcus epidermidis
FDREVQTE

SEQ ID NO: 1771244 - protein, 4 aa, Staphylococcus epidermidis
FDTS

SEQ ID NO: 1771245 - protein, 10 aa, Staphylococcus epidermidis
FDTTKTSGEF

SEQ ID NO: 1771246 - protein, 10 aa, Staphylococcus epidermidis
FEADERQQPN

SEQ ID NO: 1771247 - protein, 9 aa, Staphylococcus epidermidis
FEDGPGNHD

SEQ ID NO: 1771248 - protein, 64 aa, Staphylococcus epidermidis
FEDKPSSQGRKATSTGFGSSVNSSSNHQSGASAKEDSFSAHTSHSQSSESVNERSHTTKDDDIP

SEQ ID NO: 1771249 - protein, 64 aa, Staphylococcus epidermidis
FEDKPSSQGRKATSTGFGSSVNSSSNHQSGASAKEDSFSAHTSHSQSSESVSERSHTTKDDDIP

SEQ ID NO: 1771250 - protein, 64 aa, Staphylococcus epidermidis
FEDKPSSQGRKATSTGFGSSVNSSSNHQSVASAKEDSFSAHTSHSQSSESVNERSHTTKDDDIP

SEQ ID NO: 1771251 - protein, 5 aa, Staphylococcus epidermidis
FEEDI

SEQ ID NO: 1771252 - protein, 5 aa, Staphylococcus epidermidis
FEEKT

SEQ ID NO: 1771253 - protein, 12 aa, Staphylococcus epidermidis
FEGRKLKKGDEI

SEQ ID NO: 1771254 - protein, 25 aa, Staphylococcus epidermidis
FENNPKTHESEVHTASSRANNNGRF

SEQ ID NO: 1771255 - protein, 8 aa, Staphylococcus epidermidis
FEPNNENH

SEQ ID NO: 1771256 - protein, 9 aa, Staphylococcus epidermidis
FEPNNENHD

SEQ ID NO: 1771257 - protein, 4 aa, Staphylococcus epidermidis
FESE

SEQ ID NO: 1771258 - protein, 22 aa, Staphylococcus epidermidis
FGDDLKSAKKLNNQISKSFKEE

SEQ ID NO: 1771259 - protein, 9 aa, Staphylococcus epidermidis
FGEATRRAI

SEQ ID NO: 1771260 - protein, 24 aa, Staphylococcus epidermidis
FGGDPTGQKDSTKAFQDALGNGNV

SEQ ID NO: 1771261 - protein, 25 aa, Staphylococcus epidermidis
FGQNKDNLTTNKQTINEQKENNNHL

SEQ ID NO: 1771262 - protein, 18 aa, Staphylococcus epidermidis
FGQQEEHDAREMTAEEIE

SEQ ID NO: 1771263 - protein, 4 aa, Staphylococcus epidermidis
FGSM

SEQ ID NO: 1771264 - protein, 8 aa, Staphylococcus epidermidis
FGSPKLPH

SEQ ID NO: 1771265 - protein, 11 aa, Staphylococcus epidermidis
FGTGKTTFLTK

SEQ ID NO: 1771266 - protein, 9 aa, Staphylococcus epidermidis
FGTSKTSIL

SEQ ID NO: 1771267 - protein, 12 aa, Staphylococcus epidermidis
FHSDEASLDATY

SEQ ID NO: 1771268 - protein, 12 aa, Staphylococcus epidermidis
FKANPKLDGTHS

SEQ ID NO: 1771269 - protein, 17 aa, Staphylococcus epidermidis
FKDEKLDAESEIPKLLG

SEQ ID NO: 1771270 - protein, 23 aa, Staphylococcus epidermidis
FKNSDDYKEGDIEYNPNAPNYSA

SEQ ID NO: 1771271 - protein, 14 aa, Staphylococcus epidermidis
FKQAEDSRNRRSRN

SEQ ID NO: 1771272 - protein, 14 aa, Staphylococcus epidermidis
FKQAKDSRNRRSRN

SEQ ID NO: 1771273 - protein, 7 aa, Staphylococcus epidermidis
FKQNEGY

SEQ ID NO: 1771274 - protein, 10 aa, Staphylococcus epidermidis
FKTEDEVTTI

SEQ ID NO: 1771275 - protein, 7 aa, Staphylococcus epidermidis
FKTSTLR

SEQ ID NO: 1771276 - protein, 10 aa, Staphylococcus epidermidis
FNDEDGIRAA

SEQ ID NO: 1771277 - protein, 4 aa, Staphylococcus epidermidis
FNDN

SEQ ID NO: 1771278 - protein, 14 aa, Staphylococcus epidermidis
FNSADGSVDSLPPE

SEQ ID NO: 1771279 - protein, 10 aa, Staphylococcus epidermidis
FNTKDNEKME

SEQ ID NO: 1771280 - protein, 5 aa, Staphylococcus epidermidis
FPDKQ

SEQ ID NO: 1771281 - protein, 5 aa, Staphylococcus epidermidis
FPEYG

SEQ ID NO: 1771282 - protein, 12 aa, Staphylococcus epidermidis
FPPYDGSPLANE

SEQ ID NO: 1771283 - protein, 11 aa, Staphylococcus epidermidis
FSEPKTKSIYS

SEQ ID NO: 1771284 - protein, 10 aa, Staphylococcus epidermidis
FSGGNSVSYE

SEQ ID NO: 1771285 - protein, 6 aa, Staphylococcus epidermidis
FSQPKW

SEQ ID NO: 1771286 - protein, 9 aa, Staphylococcus epidermidis
FSSREKDLP

SEQ ID NO: 1771287 - protein, 13 aa, Staphylococcus epidermidis
FSTNKKKGYAKEK

SEQ ID NO: 1771288 - protein, 11 aa, Staphylococcus epidermidis
FTGQKGSYVPV

SEQ ID NO: 1771289 - protein, 11 aa, Staphylococcus epidermidis
FTNNKNNLSTQ

SEQ ID NO: 1771290 - protein, 7 aa, Staphylococcus epidermidis
FVPKPGD

SEQ ID NO: 1771291 - protein, 4 aa, Staphylococcus epidermidis
GAAL

SEQ ID NO: 1771292 - protein, 17 aa, Staphylococcus epidermidis
GAGIESSNENNNAGTGH

SEQ ID NO: 1771293 - protein, 16 aa, Staphylococcus epidermidis
GANAAKDIITEEDKKN

SEQ ID NO: 1771294 - protein, 17 aa, Staphylococcus epidermidis
GANAAKDIITEEDKKNI

SEQ ID NO: 1771295 - protein, 16 aa, Staphylococcus epidermidis
GANAAKDIITEEDRKN

SEQ ID NO: 1771296 - protein, 6 aa, Staphylococcus epidermidis
GAPHET

SEQ ID NO: 1771297 - protein, 6 aa, Staphylococcus epidermidis
GAPRVQ

SEQ ID NO: 1771298 - protein, 5 aa, Staphylococcus epidermidis
GAQSI

SEQ ID NO: 1771299 - protein, 6 aa, Staphylococcus epidermidis
GATEAS

SEQ ID NO: 1771300 - protein, 7 aa, Staphylococcus epidermidis
GCVGPAP

SEQ ID NO: 1771301 - protein, 7 aa, Staphylococcus epidermidis
GDDNGEF

SEQ ID NO: 1771302 - protein, 8 aa, Staphylococcus epidermidis
GDGHRDKP

SEQ ID NO: 1771303 - protein, 10 aa, Staphylococcus epidermidis
GDPRSTWGNL

SEQ ID NO: 1771304 - protein, 18 aa, Staphylococcus epidermidis
GDPRSTWGNLEDNPVQDM

SEQ ID NO: 1771305 - protein, 8 aa, Staphylococcus epidermidis
GDQEKKEM

SEQ ID NO: 1771306 - protein, 24 aa, Staphylococcus epidermidis
GDQVGRNDPCPCGSGKKYKNCHGK

SEQ ID NO: 1771307 - protein, 17 aa, Staphylococcus epidermidis
GDSRSTWGNLEDNPVQD

SEQ ID NO: 1771308 - protein, 13 aa, Staphylococcus epidermidis
GDTQEIDDPYGGS

SEQ ID NO: 1771309 - protein, 7 aa, Staphylococcus epidermidis
GEDGQLY

SEQ ID NO: 1771310 - protein, 8 aa, Staphylococcus epidermidis
GEDSQLYT

SEQ ID NO: 1771311 - protein, 6 aa, Staphylococcus epidermidis
GEEVEA

SEQ ID NO: 1771312 - protein, 4 aa, Staphylococcus epidermidis
GEHP

SEQ ID NO: 1771313 - protein, 10 aa, Staphylococcus epidermidis
GEIKGVSQRE

SEQ ID NO: 1771314 - protein, 5 aa, Staphylococcus epidermidis
GEIKP

SEQ ID NO: 1771315 - protein, 5 aa, Staphylococcus epidermidis
GEQAL

SEQ ID NO: 1771316 - protein, 10 aa, Staphylococcus epidermidis
GERQQSVDYE

SEQ ID NO: 1771317 - protein, 10 aa, Staphylococcus epidermidis
GESGAGKSLT

SEQ ID NO: 1771318 - protein, 11 aa, Staphylococcus epidermidis
GESGAGKSTIG

SEQ ID NO: 1771319 - protein, 6 aa, Staphylococcus epidermidis
GETVSY

SEQ ID NO: 1771320 - protein, 16 aa, Staphylococcus epidermidis
GEYPREQERFKSEKTI

SEQ ID NO: 1771321 - protein, 6 aa, Staphylococcus epidermidis
GFDDKY

SEQ ID NO: 1771322 - protein, 10 aa, Staphylococcus epidermidis
GFDDKYDNFD

SEQ ID NO: 1771323 - protein, 7 aa, Staphylococcus epidermidis
GFEGGMS

SEQ ID NO: 1771324 - protein, 7 aa, Staphylococcus epidermidis
GFPESSM

SEQ ID NO: 1771325 - protein, 7 aa, Staphylococcus epidermidis
GGDSNNV

SEQ ID NO: 1771326 - protein, 8 aa, Staphylococcus epidermidis
GGDTDTIG

SEQ ID NO: 1771327 - protein, 18 aa, Staphylococcus epidermidis
GGETVKSISGNQNGEVTT

SEQ ID NO: 1771328 - protein, 18 aa, Staphylococcus epidermidis
GGETVQSISGNQNGEVTT

SEQ ID NO: 1771329 - protein, 7 aa, Staphylococcus epidermidis
GGLGKGI

SEQ ID NO: 1771330 - protein, 8 aa, Staphylococcus epidermidis
GGQTESKR

SEQ ID NO: 1771331 - protein, 4 aa, Staphylococcus epidermidis
GGSG

SEQ ID NO: 1771332 - protein, 7 aa, Staphylococcus epidermidis
GGTYDEK

SEQ ID NO: 1771333 - protein, 4 aa, Staphylococcus epidermidis
GGYE

SEQ ID NO: 1771334 - protein, 5 aa, Staphylococcus epidermidis
GGYEY

SEQ ID NO: 1771335 - protein, 9 aa, Staphylococcus epidermidis
GHADSNEVY

SEQ ID NO: 1771336 - protein, 23 aa, Staphylococcus epidermidis
GHGKSLSRLGGGIGTRGPGETKL

SEQ ID NO: 1771337 - protein, 12 aa, Staphylococcus epidermidis
GHKKDIRKQVFK

SEQ ID NO: 1771338 - protein, 15 aa, Staphylococcus epidermidis
GHPDTQPQTRWTQKG

SEQ ID NO: 1771339 - protein, 5 aa, Staphylococcus epidermidis
GHTGG

SEQ ID NO: 1771340 - protein, 6 aa, Staphylococcus epidermidis
GIAKTT

SEQ ID NO: 1771341 - protein, 4 aa, Staphylococcus epidermidis
GIEK

SEQ ID NO: 1771342 - protein, 9 aa, Staphylococcus epidermidis
GIKNNGPNY

SEQ ID NO: 1771343 - protein, 7 aa, Staphylococcus epidermidis
GIKTNDT

SEQ ID NO: 1771344 - protein, 12 aa, Staphylococcus epidermidis
GIPDESKYKEVE

SEQ ID NO: 1771345 - protein, 16 aa, Staphylococcus epidermidis
GIPDKNPFNTSHKERR

SEQ ID NO: 1771346 - protein, 6 aa, Staphylococcus epidermidis
GIQKGE

SEQ ID NO: 1771347 - protein, 7 aa, Staphylococcus epidermidis
GIQPYSE

SEQ ID NO: 1771348 - protein, 13 aa, Staphylococcus epidermidis
GIQQRGKVELNEK

SEQ ID NO: 1771349 - protein, 14 aa, Staphylococcus epidermidis
GITPKPQPGNPKPR

SEQ ID NO: 1771350 - protein, 7 aa, Staphylococcus epidermidis
GKAGGEI

SEQ ID NO: 1771351 - protein, 7 aa, Staphylococcus epidermidis
GKAREVI

SEQ ID NO: 1771352 - protein, 7 aa, Staphylococcus epidermidis
GKDQDQV

SEQ ID NO: 1771353 - protein, 7 aa, Staphylococcus epidermidis
GKDVGQI

SEQ ID NO: 1771354 - protein, 12 aa, Staphylococcus epidermidis
GKEIPATARETI

SEQ ID NO: 1771355 - protein, 13 aa, Staphylococcus epidermidis
GKEVSQQQAEQTF

SEQ ID NO: 1771356 - protein, 6 aa, Staphylococcus epidermidis
GKGIPG

SEQ ID NO: 1771357 - protein, 8 aa, Staphylococcus epidermidis
GKISTEQM

SEQ ID NO: 1771358 - protein, 4 aa, Staphylococcus epidermidis
GKKA

SEQ ID NO: 1771359 - protein, 18 aa, Staphylococcus epidermidis
GKKEGKLETGGGTDDSTG

SEQ ID NO: 1771360 - protein, 9 aa, Staphylococcus epidermidis
GKKGNPGTI

SEQ ID NO: 1771361 - protein, 8 aa, Staphylococcus epidermidis
GKKGSVSG

SEQ ID NO: 1771362 - protein, 10 aa, Staphylococcus epidermidis
GKLAPKSKAD

SEQ ID NO: 1771363 - protein, 11 aa, Staphylococcus epidermidis
GKNAPKREDIE

SEQ ID NO: 1771364 - protein, 9 aa, Staphylococcus epidermidis
GKNGAGKST

SEQ ID NO: 1771365 - protein, 17 aa, Staphylococcus epidermidis
GKPQKVVTDQAPSTKAA

SEQ ID NO: 1771366 - protein, 9 aa, Staphylococcus epidermidis
GKQQREHRD

SEQ ID NO: 1771367 - protein, 10 aa, Staphylococcus epidermidis
GKQYTYGKGL

SEQ ID NO: 1771368 - protein, 9 aa, Staphylococcus epidermidis
GKRKIRKDA

SEQ ID NO: 1771369 - protein, 16 aa, Staphylococcus epidermidis
GKSQKVITDQAPSTKV

SEQ ID NO: 1771370 - protein, 20 aa, Staphylococcus epidermidis
GKTRAAQDNTHQVGGPSTDF

SEQ ID NO: 1771371 - protein, 4 aa, Staphylococcus epidermidis
GKTY

SEQ ID NO: 1771372 - protein, 5 aa, Staphylococcus epidermidis
GKTYE

SEQ ID NO: 1771373 - protein, 7 aa, Staphylococcus epidermidis
GLDEDSK

SEQ ID NO: 1771374 - protein, 4 aa, Staphylococcus epidermidis
GLGQ

SEQ ID NO: 1771375 - protein, 6 aa, Staphylococcus epidermidis
GLGSKK

SEQ ID NO: 1771376 - protein, 10 aa, Staphylococcus epidermidis
GLNRKTTGEI

SEQ ID NO: 1771377 - protein, 5 aa, Staphylococcus epidermidis
GLPEN

SEQ ID NO: 1771378 - protein, 18 aa, Staphylococcus epidermidis
GLSKEGKKAIDSLSAEEQ

SEQ ID NO: 1771379 - protein, 14 aa, Staphylococcus epidermidis
GMIKKSSASQFKTT

SEQ ID NO: 1771380 - protein, 8 aa, Staphylococcus epidermidis
GMPPTGGL

SEQ ID NO: 1771381 - protein, 6 aa, Staphylococcus epidermidis
GMPQKS

SEQ ID NO: 1771382 - protein, 5 aa, Staphylococcus epidermidis
GNAGL

SEQ ID NO: 1771383 - protein, 7 aa, Staphylococcus epidermidis
GNAVPPK

SEQ ID NO: 1771384 - protein, 8 aa, Staphylococcus epidermidis
GNGSLQDS

SEQ ID NO: 1771385 - protein, 4 aa, Staphylococcus epidermidis
GNKE

SEQ ID NO: 1771386 - protein, 10 aa, Staphylococcus epidermidis
GNKKEYENSA

SEQ ID NO: 1771387 - protein, 4 aa, Staphylococcus epidermidis
GNLK

SEQ ID NO: 1771388 - protein, 8 aa, Staphylococcus epidermidis
GNVLGTGE

SEQ ID NO: 1771389 - protein, 19 aa, Staphylococcus epidermidis
GPATIKSATYKGPKGPTGY

SEQ ID NO: 1771390 - protein, 4 aa, Staphylococcus epidermidis
GPDN

SEQ ID NO: 1771391 - protein, 4 aa, Staphylococcus epidermidis
GPFE

SEQ ID NO: 1771392 - protein, 5 aa, Staphylococcus epidermidis
GPFPS

SEQ ID NO: 1771393 - protein, 6 aa, Staphylococcus epidermidis
GPPCQG

SEQ ID NO: 1771394 - protein, 5 aa, Staphylococcus epidermidis
GPRVI

SEQ ID NO: 1771395 - protein, 10 aa, Staphylococcus epidermidis
GPSGSGKTTT

SEQ ID NO: 1771396 - protein, 5 aa, Staphylococcus epidermidis
GPSHQ

SEQ ID NO: 1771397 - protein, 18 aa, Staphylococcus epidermidis
GPTGSQMGKKESTKDTAR

SEQ ID NO: 1771398 - protein, 13 aa, Staphylococcus epidermidis
GPVTNFEEANKSD

SEQ ID NO: 1771399 - protein, 6 aa, Staphylococcus epidermidis
GPYENK

SEQ ID NO: 1771400 - protein, 4 aa, Staphylococcus epidermidis
GQKG

SEQ ID NO: 1771401 - protein, 13 aa, Staphylococcus epidermidis
GQNTFSHESGIHQ

SEQ ID NO: 1771402 - protein, 9 aa, Staphylococcus epidermidis
GQPEGYTSH

SEQ ID NO: 1771403 - protein, 10 aa, Staphylococcus epidermidis
GQSNQEGSWI

SEQ ID NO: 1771404 - protein, 8 aa, Staphylococcus epidermidis
GQTETTID

SEQ ID NO: 1771405 - protein, 14 aa, Staphylococcus epidermidis
GQYQSNDRFPSKRQ

SEQ ID NO: 1771406 - protein, 16 aa, Staphylococcus epidermidis
GRAGVGYKDNVNGKGR

SEQ ID NO: 1771407 - protein, 16 aa, Staphylococcus epidermidis
GRALDDKDKEIREKDD

SEQ ID NO: 1771408 - protein, 9 aa, Staphylococcus epidermidis
GRDITDDIA

SEQ ID NO: 1771409 - protein, 9 aa, Staphylococcus epidermidis
GRDKKYTLE

SEQ ID NO: 1771410 - protein, 10 aa, Staphylococcus epidermidis
GRKGGNKGLD

SEQ ID NO: 1771411 - protein, 10 aa, Staphylococcus epidermidis
GRLSARTAMN

SEQ ID NO: 1771412 - protein, 7 aa, Staphylococcus epidermidis
GRQTKED

SEQ ID NO: 1771413 - protein, 28 aa, Staphylococcus epidermidis
GSDREQALATKELSKIKTSLKNAIEDGM

SEQ ID NO: 1771414 - protein, 6 aa, Staphylococcus epidermidis
GSFTGK

SEQ ID NO: 1771415 - protein, 14 aa, Staphylococcus epidermidis
GSGAKSKAYGSRSG

SEQ ID NO: 1771416 - protein, 4 aa, Staphylococcus epidermidis
GSKE

SEQ ID NO: 1771417 - protein, 4 aa, Staphylococcus epidermidis
GSPV

SEQ ID NO: 1771418 - protein, 4 aa, Staphylococcus epidermidis
GSSH

SEQ ID NO: 1771419 - protein, 10 aa, Staphylococcus epidermidis
GSSKKDENVL

SEQ ID NO: 1771420 - protein, 9 aa, Staphylococcus epidermidis
GSSSQVTRN

SEQ ID NO: 1771421 - protein, 6 aa, Staphylococcus epidermidis
GSSTIQ

SEQ ID NO: 1771422 - protein, 6 aa, Staphylococcus epidermidis
GSSYTY

SEQ ID NO: 1771423 - protein, 4 aa, Staphylococcus epidermidis
GSVT

SEQ ID NO: 1771424 - protein, 8 aa, Staphylococcus epidermidis
GSYGTGKS

SEQ ID NO: 1771425 - protein, 12 aa, Staphylococcus epidermidis
GTFVKEQDNSIL

SEQ ID NO: 1771426 - protein, 14 aa, Staphylococcus epidermidis
GTGDLKGSSTGSKN

SEQ ID NO: 1771427 - protein, 4 aa, Staphylococcus epidermidis
GTGT

SEQ ID NO: 1771428 - protein, 17 aa, Staphylococcus epidermidis
GTTAESPTLTDEEKEKV

SEQ ID NO: 1771429 - protein, 12 aa, Staphylococcus epidermidis
GVDDSKKLSDTK

SEQ ID NO: 1771430 - protein, 26 aa, Staphylococcus epidermidis
GVEAPTERISEEIPRTKQVGVGAPTE

SEQ ID NO: 1771431 - protein, 4 aa, Staphylococcus epidermidis
GVEK

SEQ ID NO: 1771432 - protein, 10 aa, Staphylococcus epidermidis
GVGAPTQRIS

SEQ ID NO: 1771433 - protein, 7 aa, Staphylococcus epidermidis
GVGKTTV

SEQ ID NO: 1771434 - protein, 10 aa, Staphylococcus epidermidis
GVKGSTKQAV

SEQ ID NO: 1771435 - protein, 5 aa, Staphylococcus epidermidis
GVKPT

SEQ ID NO: 1771436 - protein, 5 aa, Staphylococcus epidermidis
GVLDT

SEQ ID NO: 1771437 - protein, 4 aa, Staphylococcus epidermidis
GVRS

SEQ ID NO: 1771438 - protein, 18 aa, Staphylococcus epidermidis
GVTGKETSDWTRDTSQEL

SEQ ID NO: 1771439 - protein, 5 aa, Staphylococcus epidermidis
GWEED

SEQ ID NO: 1771440 - protein, 4 aa, Staphylococcus epidermidis
GWQH

SEQ ID NO: 1771441 - protein, 4 aa, Staphylococcus epidermidis
GYGD

SEQ ID NO: 1771442 - protein, 4 aa, Staphylococcus epidermidis
GYGQ

SEQ ID NO: 1771443 - protein, 13 aa, Staphylococcus epidermidis
GYGSKGGPSTSNI

SEQ ID NO: 1771444 - protein, 15 aa, Staphylococcus epidermidis
GYNIKEEKDNPNFGS

SEQ ID NO: 1771445 - protein, 8 aa, Staphylococcus epidermidis
GYQQTEDK

SEQ ID NO: 1771446 - protein, 9 aa, Staphylococcus epidermidis
GYSTDGRIA

SEQ ID NO: 1771447 - protein, 7 aa, Staphylococcus epidermidis
GYVYSDG

SEQ ID NO: 1771448 - protein, 4 aa, Staphylococcus epidermidis
HAAL

SEQ ID NO: 1771449 - protein, 5 aa, Staphylococcus epidermidis
HAKPL

SEQ ID NO: 1771450 - protein, 15 aa, Staphylococcus epidermidis
HAPHAKEEKAQPMTK

SEQ ID NO: 1771451 - protein, 16 aa, Staphylococcus epidermidis
HAPHAKEEKAQPMTKA

SEQ ID NO: 1771452 - protein, 15 aa, Staphylococcus epidermidis
HAPHAKEEKEQPMTK

SEQ ID NO: 1771453 - protein, 13 aa, Staphylococcus epidermidis
HARGKVLGGSSSI

SEQ ID NO: 1771454 - protein, 9 aa, Staphylococcus epidermidis
HARSQRRKH

SEQ ID NO: 1771455 - protein, 14 aa, Staphylococcus epidermidis
HDPLTSKITSQWPN

SEQ ID NO: 1771456 - protein, 7 aa, Staphylococcus epidermidis
HDSPYSI

SEQ ID NO: 1771457 - protein, 4 aa, Staphylococcus epidermidis
HDYG

SEQ ID NO: 1771458 - protein, 4 aa, Staphylococcus epidermidis
HEDG

SEQ ID NO: 1771459 - protein, 6 aa, Staphylococcus epidermidis
HEENNT

SEQ ID NO: 1771460 - protein, 6 aa, Staphylococcus epidermidis
HEESNT

SEQ ID NO: 1771461 - protein, 18 aa, Staphylococcus epidermidis
HEGINKDKDDEGSTINPT

SEQ ID NO: 1771462 - protein, 4 aa, Staphylococcus epidermidis
HENI

SEQ ID NO: 1771463 - protein, 6 aa, Staphylococcus epidermidis
HFDGTP

SEQ ID NO: 1771464 - protein, 9 aa, Staphylococcus epidermidis
HFEPQDVEN

SEQ ID NO: 1771465 - protein, 10 aa, Staphylococcus epidermidis
HGAGSPCGKA

SEQ ID NO: 1771466 - protein, 7 aa, Staphylococcus epidermidis
HGNGSGI

SEQ ID NO: 1771467 - protein, 9 aa, Staphylococcus epidermidis
HGNTETYPQ

SEQ ID NO: 1771468 - protein, 6 aa, Staphylococcus epidermidis
HGPVPK

SEQ ID NO: 1771469 - protein, 5 aa, Staphylococcus epidermidis
HKENI

SEQ ID NO: 1771470 - protein, 13 aa, Staphylococcus epidermidis
HKKEQGQRVREIF

SEQ ID NO: 1771471 - protein, 10 aa, Staphylococcus epidermidis
HKKTDNGNYT

SEQ ID NO: 1771472 - protein, 8 aa, Staphylococcus epidermidis
HKLNENDQ

SEQ ID NO: 1771473 - protein, 4 aa, Staphylococcus epidermidis
HKNI

SEQ ID NO: 1771474 - protein, 7 aa, Staphylococcus epidermidis
HKNNKKV

SEQ ID NO: 1771475 - protein, 9 aa, Staphylococcus epidermidis
HKNNPRAIR

SEQ ID NO: 1771476 - protein, 7 aa, Staphylococcus epidermidis
HKSNHDL

SEQ ID NO: 1771477 - protein, 9 aa, Staphylococcus epidermidis
HKTQNVGYQ

SEQ ID NO: 1771478 - protein, 16 aa, Staphylococcus epidermidis
HLDKSKYEADPPAFFW

SEQ ID NO: 1771479 - protein, 8 aa, Staphylococcus epidermidis
HLTTQNNQ

SEQ ID NO: 1771480 - protein, 11 aa, Staphylococcus epidermidis
HMKNGQLKPGY

SEQ ID NO: 1771481 - protein, 10 aa, Staphylococcus epidermidis
HNKGKTIREI

SEQ ID NO: 1771482 - protein, 6 aa, Staphylococcus epidermidis
HNNQAI

SEQ ID NO: 1771483 - protein, 5 aa, Staphylococcus epidermidis
HNPNK

SEQ ID NO: 1771484 - protein, 6 aa, Staphylococcus epidermidis
HNPNKQ

SEQ ID NO: 1771485 - protein, 6 aa, Staphylococcus epidermidis
HNYGEQ

SEQ ID NO: 1771486 - protein, 4 aa, Staphylococcus epidermidis
HPET

SEQ ID NO: 1771487 - protein, 4 aa, Staphylococcus epidermidis
HPKG

SEQ ID NO: 1771488 - protein, 9 aa, Staphylococcus epidermidis
HPLAQKSSI

SEQ ID NO: 1771489 - protein, 8 aa, Staphylococcus epidermidis
HPRVAETT

SEQ ID NO: 1771490 - protein, 4 aa, Staphylococcus epidermidis
HPSG

SEQ ID NO: 1771491 - protein, 6 aa, Staphylococcus epidermidis
HPTETL

SEQ ID NO: 1771492 - protein, 10 aa, Staphylococcus epidermidis
HPTLREKAKE

SEQ ID NO: 1771493 - protein, 5 aa, Staphylococcus epidermidis
HQEGK

SEQ ID NO: 1771494 - protein, 7 aa, Staphylococcus epidermidis
HQRPEDQ

SEQ ID NO: 1771495 - protein, 7 aa, Staphylococcus epidermidis
HQSPSLL

SEQ ID NO: 1771496 - protein, 9 aa, Staphylococcus epidermidis
HRESTKDYV

SEQ ID NO: 1771497 - protein, 16 aa, Staphylococcus epidermidis
HRGGVGADGITGDGAG

SEQ ID NO: 1771498 - protein, 8 aa, Staphylococcus epidermidis
HRTAASSY

SEQ ID NO: 1771499 - protein, 4 aa, Staphylococcus epidermidis
HSEC

SEQ ID NO: 1771500 - protein, 9 aa, Staphylococcus epidermidis
HSEHSGEDF

SEQ ID NO: 1771501 - protein, 7 aa, Staphylococcus epidermidis
HSSELND

SEQ ID NO: 1771502 - protein, 7 aa, Staphylococcus epidermidis
HTNEEGH

SEQ ID NO: 1771503 - protein, 9 aa, Staphylococcus epidermidis
HTSRLDSPE

SEQ ID NO: 1771504 - protein, 15 aa, Staphylococcus epidermidis
HTTTNIARLLQLKIE

SEQ ID NO: 1771505 - protein, 18 aa, Staphylococcus epidermidis
HVTAEDGKEKAKPQPIVK

SEQ ID NO: 1771506 - protein, 6 aa, Staphylococcus epidermidis
HYTEPW

SEQ ID NO: 1771507 - protein, 17 aa, Staphylococcus epidermidis
IAAPSANISGRPSPTTF

SEQ ID NO: 1771508 - protein, 12 aa, Staphylococcus epidermidis
IADKKKNVSDRD

SEQ ID NO: 1771509 - protein, 8 aa, Staphylococcus epidermidis
IADKNGGE

SEQ ID NO: 1771510 - protein, 6 aa, Staphylococcus epidermidis
IAGKKA

SEQ ID NO: 1771511 - protein, 5 aa, Staphylococcus epidermidis
IAPNH

SEQ ID NO: 1771512 - protein, 11 aa, Staphylococcus epidermidis
IAQRNRSFESH

SEQ ID NO: 1771513 - protein, 6 aa, Staphylococcus epidermidis
IARPAA

SEQ ID NO: 1771514 - protein, 13 aa, Staphylococcus epidermidis
IASTGGSKAYSSR

SEQ ID NO: 1771515 - protein, 7 aa, Staphylococcus epidermidis
IDANQLN

SEQ ID NO: 1771516 - protein, 5 aa, Staphylococcus epidermidis
IDDAI

SEQ ID NO: 1771517 - protein, 6 aa, Staphylococcus epidermidis
IDDEGG

SEQ ID NO: 1771518 - protein, 9 aa, Staphylococcus epidermidis
IDEGVKGSD

SEQ ID NO: 1771519 - protein, 8 aa, Staphylococcus epidermidis
IDKKTSKI

SEQ ID NO: 1771520 - protein, 4 aa, Staphylococcus epidermidis
IDRP

SEQ ID NO: 1771521 - protein, 5 aa, Staphylococcus epidermidis
IDSKN

SEQ ID NO: 1771522 - protein, 15 aa, Staphylococcus epidermidis
IDSTPAGTESEQVVS

SEQ ID NO: 1771523 - protein, 6 aa, Staphylococcus epidermidis
IEANAN

SEQ ID NO: 1771524 - protein, 8 aa, Staphylococcus epidermidis
IEEAESYK

SEQ ID NO: 1771525 - protein, 5 aa, Staphylococcus epidermidis
IEEQR

SEQ ID NO: 1771526 - protein, 11 aa, Staphylococcus epidermidis
IEGDKKLANNY

SEQ ID NO: 1771527 - protein, 4 aa, Staphylococcus epidermidis
IEGE

SEQ ID NO: 1771528 - protein, 7 aa, Staphylococcus epidermidis
IEGEKEI

SEQ ID NO: 1771529 - protein, 10 aa, Staphylococcus epidermidis
IEKKDSRIPM

SEQ ID NO: 1771530 - protein, 17 aa, Staphylococcus epidermidis
IENDGKAGLDKALSKPY

SEQ ID NO: 1771531 - protein, 8 aa, Staphylococcus epidermidis
IENDPEDS

SEQ ID NO: 1771532 - protein, 8 aa, Staphylococcus epidermidis
IEPGRSIV

SEQ ID NO: 1771533 - protein, 14 aa, Staphylococcus epidermidis
IEQNYTGKRKIRTD

SEQ ID NO: 1771534 - protein, 10 aa, Staphylococcus epidermidis
IESKGYSQQE

SEQ ID NO: 1771535 - protein, 8 aa, Staphylococcus epidermidis
IETNRREA

SEQ ID NO: 1771536 - protein, 5 aa, Staphylococcus epidermidis
IETSD

SEQ ID NO: 1771537 - protein, 5 aa, Staphylococcus epidermidis
IGGGI

SEQ ID NO: 1771538 - protein, 20 aa, Staphylococcus epidermidis
IGGNTIRTGGQVNAAEPKWQ

SEQ ID NO: 1771539 - protein, 5 aa, Staphylococcus epidermidis
IGGPT

SEQ ID NO: 1771540 - protein, 9 aa, Staphylococcus epidermidis
IGKGTDITD

SEQ ID NO: 1771541 - protein, 30 aa, Staphylococcus epidermidis
IGNTKENWEDSQPKSENEDTTNKNNEKEDI

SEQ ID NO: 1771542 - protein, 7 aa, Staphylococcus epidermidis
IGPESKL

SEQ ID NO: 1771543 - protein, 11 aa, Staphylococcus epidermidis
IGQSQTGTGKS

SEQ ID NO: 1771544 - protein, 10 aa, Staphylococcus epidermidis
IGSPGGNKIP

SEQ ID NO: 1771545 - protein, 18 aa, Staphylococcus epidermidis
IGTIGDSVAKGTGAKTNF

SEQ ID NO: 1771546 - protein, 8 aa, Staphylococcus epidermidis
IGYAPDNS

SEQ ID NO: 1771547 - protein, 14 aa, Staphylococcus epidermidis
IHQSAKANQSNSYT

SEQ ID NO: 1771548 - protein, 8 aa, Staphylococcus epidermidis
IKAKKGRK

SEQ ID NO: 1771549 - protein, 30 aa, Staphylococcus epidermidis; identical to SEQ ID NO: 1611607

SEQ ID NO: 1771550 - protein, 8 aa, Staphylococcus epidermidis
IKCKTNRE

SEQ ID NO: 1771551 - protein, 10 aa, Staphylococcus epidermidis
IKDEPAGEDC

SEQ ID NO: 1771552 - protein, 7 aa, Staphylococcus epidermidis
IKDTINP

SEQ ID NO: 1771553 - protein, 5 aa, Staphylococcus epidermidis
IKEGN

SEQ ID NO: 1771554 - protein, 6 aa, Staphylococcus epidermidis
IKEPLS

SEQ ID NO: 1771555 - protein, 18 aa, Staphylococcus epidermidis
IKGGHTNNKIRVSTSPVH

SEQ ID NO: 1771556 - protein, 4 aa, Staphylococcus epidermidis
IKHG

SEQ ID NO: 1771557 - protein, 9 aa, Staphylococcus epidermidis
IKNPKNMEY

SEQ ID NO: 1771558 - protein, 4 aa, Staphylococcus epidermidis
IKPE

SEQ ID NO: 1771559 - protein, 14 aa, Staphylococcus epidermidis
IKQGNGLNDDEVSS

SEQ ID NO: 1771560 - protein, 12 aa, Staphylococcus epidermidis
IKSKLEESGISN

SEQ ID NO: 1771561 - protein, 8 aa, Staphylococcus epidermidis
IKSQKQVH

SEQ ID NO: 1771562 - protein, 8 aa, Staphylococcus epidermidis
IKSQKQVY

SEQ ID NO: 1771563 - protein, 8 aa, Staphylococcus epidermidis
IKVREDNG

SEQ ID NO: 1771564 - protein, 13 aa, Staphylococcus epidermidis
INDKDIDSSNRIK

SEQ ID NO: 1771565 - protein, 5 aa, Staphylococcus epidermidis
INESD

SEQ ID NO: 1771566 - protein, 6 aa, Staphylococcus epidermidis
INESDV

SEQ ID NO: 1771567 - protein, 8 aa, Staphylococcus epidermidis
INKDKGEV

SEQ ID NO: 1771568 - protein, 6 aa, Staphylococcus epidermidis
INKKGY

SEQ ID NO: 1771569 - protein, 5 aa, Staphylococcus epidermidis
INKNK

SEQ ID NO: 1771570 - protein, 8 aa, Staphylococcus epidermidis
INNDSELE

SEQ ID NO: 1771571 - protein, 9 aa, Staphylococcus epidermidis
INPPNNIET

SEQ ID NO: 1771572 - protein, 15 aa, Staphylococcus epidermidis
INRSKELNESVPEIA

SEQ ID NO: 1771573 - protein, 9 aa, Staphylococcus epidermidis
IPAQKEDEK

SEQ ID NO: 1771574 - protein, 15 aa, Staphylococcus epidermidis
IPDTEFDEFRHPRGL

SEQ ID NO: 1771575 - protein, 11 aa, Staphylococcus epidermidis
IPEEQTDKYRM

SEQ ID NO: 1771576 - protein, 15 aa, Staphylococcus epidermidis
IPETEFDEFRHYRCL

SEQ ID NO: 1771577 - protein, 20 aa, Staphylococcus epidermidis
IPGDSDSNRTVKREMGQQAG

SEQ ID NO: 1771578 - protein, 5 aa, Staphylococcus epidermidis
IPGED

SEQ ID NO: 1771579 - protein, 5 aa, Staphylococcus epidermidis
IPKDK

SEQ ID NO: 1771580 - protein, 10 aa, Staphylococcus epidermidis
IPKDLSKEEM

SEQ ID NO: 1771581 - protein, 5 aa, Staphylococcus epidermidis
IPMDE

SEQ ID NO: 1771582 - protein, 63 aa, Staphylococcus epidermidis
IPPEHKELNDKETVQQDEVSHSTKSIDASKNVSNSNDNNIEKNQQKKQQTTAQTESSSENMHN

SEQ ID NO: 1771583 - protein, 11 aa, Staphylococcus epidermidis
IPQNNTNKYAR

SEQ ID NO: 1771584 - protein, 21 aa, Staphylococcus epidermidis
IPTGNGDVIDGAREQWNDGSN

SEQ ID NO: 1771585 - protein, 15 aa, Staphylococcus epidermidis
IPTKQIKDKKLKKEI

SEQ ID NO: 1771586 - protein, 11 aa, Staphylococcus epidermidis
IQATTKKDELK

SEQ ID NO: 1771587 - protein, 5 aa, Staphylococcus epidermidis
IQGEV

SEQ ID NO: 1771588 - protein, 4 aa, Staphylococcus epidermidis
IQNA

SEQ ID NO: 1771589 - protein, 14 aa, Staphylococcus epidermidis
IQNHESKMNEDSKA

SEQ ID NO: 1771590 - protein, 11 aa, Staphylococcus epidermidis
IQPGSKGTKVG

SEQ ID NO: 1771591 - protein, 6 aa, Staphylococcus epidermidis
IQRTAD

SEQ ID NO: 1771592 - protein, 9 aa, Staphylococcus epidermidis
IREYESQKQ

SEQ ID NO: 1771593 - protein, 9 aa, Staphylococcus epidermidis
ISAKEDEHV

SEQ ID NO: 1771594 - protein, 7 aa, Staphylococcus epidermidis
ISDDKED

SEQ ID NO: 1771595 - protein, 9 aa, Staphylococcus epidermidis
ISDQSDRMG

SEQ ID NO: 1771596 - protein, 4 aa, Staphylococcus epidermidis
ISEK

SEQ ID NO: 1771597 - protein, 9 aa, Staphylococcus epidermidis
ISGAKYGYS

SEQ ID NO: 1771598 - protein, 13 aa, Staphylococcus epidermidis
ISGKLKNTKYIKD

SEQ ID NO: 1771599 - protein, 7 aa, Staphylococcus epidermidis
ISHSSAE

SEQ ID NO: 1771600 - protein, 4 aa, Staphylococcus epidermidis
ISKG

SEQ ID NO: 1771601 - protein, 30 aa, Staphylococcus epidermidis
ISPLQKAEDAITLDTTGKSIEEVTNDILSL

SEQ ID NO: 1771602 - protein, 7 aa, Staphylococcus epidermidis
ISQKEQA

SEQ ID NO: 1771603 - protein, 4 aa, Staphylococcus epidermidis
ISRE

SEQ ID NO: 1771604 - protein, 6 aa, Staphylococcus epidermidis
ISRGSI

SEQ ID NO: 1771605 - protein, 16 aa, Staphylococcus epidermidis
ISRNNDFQNIINNYLT

SEQ ID NO: 1771606 - protein, 11 aa, Staphylococcus epidermidis
ISSEETEEMAN

SEQ ID NO: 1771607 - protein, 8 aa, Staphylococcus epidermidis
ISSYTKGY

SEQ ID NO: 1771608 - protein, 7 aa, Staphylococcus epidermidis
ITECTGS

SEQ ID NO: 1771609 - protein, 10 aa, Staphylococcus epidermidis
ITEKYSKEKN

SEQ ID NO: 1771610 - protein, 16 aa, Staphylococcus epidermidis
ITGGKKDYGRNSVEEE

SEQ ID NO: 1771611 - protein, 9 aa, Staphylococcus epidermidis
ITPDGTELE

SEQ ID NO: 1771612 - protein, 10 aa, Staphylococcus epidermidis
ITPDGTELEG

SEQ ID NO: 1771613 - protein, 9 aa, Staphylococcus epidermidis
ITPVPGGVG

SEQ ID NO: 1771614 - protein, 8 aa, Staphylococcus epidermidis
ITQETSDI

SEQ ID NO: 1771615 - protein, 10 aa, Staphylococcus epidermidis
ITTLQQNAKD

SEQ ID NO: 1771616 - protein, 8 aa, Staphylococcus epidermidis
KAAKEMNA

SEQ ID NO: 1771617 - protein, 10 aa, Staphylococcus epidermidis
KAAQDISEDY

SEQ ID NO: 1771618 - protein, 16 aa, Staphylococcus epidermidis
KADDEPHSLSGGQKQR

SEQ ID NO: 1771619 - protein, 7 aa, Staphylococcus epidermidis
KADDQQL

SEQ ID NO: 1771620 - protein, 5 aa, Staphylococcus epidermidis
KADDV

SEQ ID NO: 1771621 - protein, 7 aa, Staphylococcus epidermidis
KADETFN

SEQ ID NO: 1771622 - protein, 7 aa, Staphylococcus epidermidis
KADSWDR

SEQ ID NO: 1771623 - protein, 19 aa, Staphylococcus epidermidis
KAEGLVSGAAHSTGDTVRP

SEQ ID NO: 1771624 - protein, 8 aa, Staphylococcus epidermidis
KAGHTISE

SEQ ID NO: 1771625 - protein, 7 aa, Staphylococcus epidermidis
KAGKTLA

SEQ ID NO: 1771626 - protein, 7 aa, Staphylococcus epidermidis
KAKEYQD

SEQ ID NO: 1771627 - protein, 7 aa, Staphylococcus epidermidis
KAKKGRK

SEQ ID NO: 1771628 - protein, 8 aa, Staphylococcus epidermidis
KAKKGRKI

SEQ ID NO: 1771629 - protein, 10 aa, Staphylococcus epidermidis
KAKPQKPENC

SEQ ID NO: 1771630 - protein, 6 aa, Staphylococcus epidermidis
KALAES

SEQ ID NO: 1771631 - protein, 16 aa, Staphylococcus epidermidis
KANKGITLTPQSLTTR

SEQ ID NO: 1771632 - protein, 6 aa, Staphylococcus epidermidis
KANSFD

SEQ ID NO: 1771633 - protein, 4 aa, Staphylococcus epidermidis
KAPI

SEQ ID NO: 1771634 - protein, 13 aa, Staphylococcus epidermidis
KAQKENGSERRTV

SEQ ID NO: 1771635 - protein, 6 aa, Staphylococcus epidermidis
KAQQLE

SEQ ID NO: 1771636 - protein, 6 aa, Staphylococcus epidermidis
KASPHH

SEQ ID NO: 1771637 - protein, 16 aa, Staphylococcus epidermidis
KASSPIKKEAENDLEL

SEQ ID NO: 1771638 - protein, 6 aa, Staphylococcus epidermidis
KAVQQN

SEQ ID NO: 1771639 - protein, 15 aa, Staphylococcus epidermidis
KCEGSGQEFEEPCPT

SEQ ID NO: 1771640 - protein, 6 aa, Staphylococcus epidermidis
KCGNTY

SEQ ID NO: 1771641 - protein, 14 aa, Staphylococcus epidermidis
KDAGEISDDTEKAV

SEQ ID NO: 1771642 - protein, 4 aa, Staphylococcus epidermidis
KDAS

SEQ ID NO: 1771643 - protein, 11 aa, Staphylococcus epidermidis
KDCSKGTKQKV

SEQ ID NO: 1771644 - protein, 8 aa, Staphylococcus epidermidis
KDDGKISL

SEQ ID NO: 1771645 - protein, 29 aa, Staphylococcus epidermidis
KDDKENDKENKLPQLDKGDKVTATKIEPA

SEQ ID NO: 1771646 - protein, 9 aa, Staphylococcus epidermidis
KDDPFGEYG

SEQ ID NO: 1771647 - protein, 38 aa, Staphylococcus epidermidis
KDDVENSQKSSGERTKSESKSQNSGSKQSNNNPSKPVI

SEQ ID NO: 1771648 - protein, 38 aa, Staphylococcus epidermidis
KDDVENSQKSSSQTAKSESKSQNSGSKQSNNNPSKPVI

SEQ ID NO: 1771649 - protein, 38 aa, Staphylococcus epidermidis
KDDVENSQKSSSQTAKSESKSQNSGSKQTNNNPSKPVI

SEQ ID NO: 1771650 - protein, 6 aa, Staphylococcus epidermidis
KDEKHR

SEQ ID NO: 1771651 - protein, 6 aa, Staphylococcus epidermidis
KDGSEL

SEQ ID NO: 1771652 - protein, 5 aa, Staphylococcus epidermidis
KDIDE

SEQ ID NO: 1771653 - protein, 4 aa, Staphylococcus epidermidis
KDIE

SEQ ID NO: 1771654 - protein, 13 aa, Staphylococcus epidermidis
KDKDSREQFEQRT

SEQ ID NO: 1771655 - protein, 16 aa, Staphylococcus epidermidis
KDKGDRSLTLRPEGTA

SEQ ID NO: 1771656 - protein, 5 aa, Staphylococcus epidermidis
KDKHG

SEQ ID NO: 1771657 - protein, 6 aa, Staphylococcus epidermidis
KDKLEN

SEQ ID NO: 1771658 - protein, 14 aa, Staphylococcus epidermidis
KDLFGEETVHLVDE

SEQ ID NO: 1771659 - protein, 8 aa, Staphylococcus epidermidis
KDLNHNSD

SEQ ID NO: 1771660 - protein, 4 aa, Staphylococcus epidermidis
KDLP

SEQ ID NO: 1771661 - protein, 7 aa, Staphylococcus epidermidis
KDMTDQE

SEQ ID NO: 1771662 - protein, 5 aa, Staphylococcus epidermidis
KDNDI

SEQ ID NO: 1771663 - protein, 23 aa, Staphylococcus epidermidis
KDNKSDKPNDKLISETAKSVMKE

SEQ ID NO: 1771664 - protein, 18 aa, Staphylococcus epidermidis
KDQQAGASLYDTGSVDDT

SEQ ID NO: 1771665 - protein, 24 aa, Staphylococcus epidermidis
KDSEDKLTSIKRQTESRRGGKSSR

SEQ ID NO: 1771666 - protein, 19 aa, Staphylococcus epidermidis
KDSKNFKEGMKKANEATNF

SEQ ID NO: 1771667 - protein, 4 aa, Staphylococcus epidermidis
KDST

SEQ ID NO: 1771668 - protein, 7 aa, Staphylococcus epidermidis
KDTGKLT

SEQ ID NO: 1771669 - protein, 10 aa, Staphylococcus epidermidis
KDTNKENSSK

SEQ ID NO: 1771670 - protein, 9 aa, Staphylococcus epidermidis
KDTQLTPEN

SEQ ID NO: 1771671 - protein, 7 aa, Staphylococcus epidermidis
KDTYNKD

SEQ ID NO: 1771672 - protein, 8 aa, Staphylococcus epidermidis
KDVAADTG

SEQ ID NO: 1771673 - protein, 7 aa, Staphylococcus epidermidis
KDVTNTD

SEQ ID NO: 1771674 - protein, 10 aa, Staphylococcus epidermidis
KDYGSTRKGI

SEQ ID NO: 1771675 - protein, 30 aa, Staphylococcus epidermidis; identical to SEQ ID NO: 1729746

SEQ ID NO: 1771676 - protein, 13 aa, Staphylococcus epidermidis
KDYSNENKYVSPK

SEQ ID NO: 1771677 - protein, 16 aa, Staphylococcus epidermidis
KEANIKSKLDKTEKAY

SEQ ID NO: 1771678 - protein, 4 aa, Staphylococcus epidermidis
KEEF

SEQ ID NO: 1771679 - protein, 5 aa, Staphylococcus epidermidis
KEEGL

SEQ ID NO: 1771680 - protein, 6 aa, Staphylococcus epidermidis
KEEIYR

SEQ ID NO: 1771681 - protein, 6 aa, Staphylococcus epidermidis
KEEKDI

SEQ ID NO: 1771682 - protein, 5 aa, Staphylococcus epidermidis
KEELE

SEQ ID NO: 1771683 - protein, 11 aa, Staphylococcus epidermidis
KEEQNDDSISY

SEQ ID NO: 1771684 - protein, 4 aa, Staphylococcus epidermidis
KEET

SEQ ID NO: 1771685 - protein, 12 aa, Staphylococcus epidermidis
KEFDSQRKRNIN

SEQ ID NO: 1771686 - protein, 27 aa, Staphylococcus epidermidis
KEFEKSVTAPAGNQGHGLDQSEFDKKA

SEQ ID NO: 1771687 - protein, 7 aa, Staphylococcus epidermidis
KEFTGDT

SEQ ID NO: 1771688 - protein, 4 aa, Staphylococcus epidermidis
KEGC

SEQ ID NO: 1771689 - protein, 8 aa, Staphylococcus epidermidis
KEGEQTFS

SEQ ID NO: 1771690 - protein, 17 aa, Staphylococcus epidermidis
KEGFRDEEFDKDDKGTW

SEQ ID NO: 1771691 - protein, 7 aa, Staphylococcus epidermidis
KEGQPAV

SEQ ID NO: 1771692 - protein, 8 aa, Staphylococcus epidermidis
KEIDPTHE

SEQ ID NO: 1771693 - protein, 4 aa, Staphylococcus epidermidis
KEIE

SEQ ID NO: 1771694 - protein, 25 aa, Staphylococcus epidermidis
KEISEQGRVTVNGNVAKAGTDIKEN

SEQ ID NO: 1771695 - protein, 13 aa, Staphylococcus epidermidis
KEKNAKDKLTPND

SEQ ID NO: 1771696 - protein, 8 aa, Staphylococcus epidermidis
KEKPELKP

SEQ ID NO: 1771697 - protein, 16 aa, Staphylococcus epidermidis
KEKTNISRATLYRHLD

SEQ ID NO: 1771698 - protein, 4 aa, Staphylococcus epidermidis
KELK

SEQ ID NO: 1771699 - protein, 6 aa, Staphylococcus epidermidis
KELKGY

SEQ ID NO: 1771700 - protein, 4 aa, Staphylococcus epidermidis
KENF

SEQ ID NO: 1771701 - protein, 4 aa, Staphylococcus epidermidis
KENG

SEQ ID NO: 1771702 - protein, 6 aa, Staphylococcus epidermidis
KENGIN

SEQ ID NO: 1771703 - protein, 5 aa, Staphylococcus epidermidis
KENGW

SEQ ID NO: 1771704 - protein, 15 aa, Staphylococcus epidermidis
KENKKPIKAIARNNS

SEQ ID NO: 1771705 - protein, 18 aa, Staphylococcus epidermidis
KENLNKKDYEADPPLIWG

SEQ ID NO: 1771706 - protein, 10 aa, Staphylococcus epidermidis
KEPGGGTTDY

SEQ ID NO: 1771707 - protein, 7 aa, Staphylococcus epidermidis
KEPYDEH

SEQ ID NO: 1771708 - protein, 19 aa, Staphylococcus epidermidis
KEQDGIQNKATNESKTVET

SEQ ID NO: 1771709 - protein, 7 aa, Staphylococcus epidermidis
KEQDTNT

SEQ ID NO: 1771710 - protein, 7 aa, Staphylococcus epidermidis
KEQGEKL

SEQ ID NO: 1771711 - protein, 6 aa, Staphylococcus epidermidis
KEQQER

SEQ ID NO: 1771712 - protein, 4 aa, Staphylococcus epidermidis
KEQS

SEQ ID NO: 1771713 - protein, 5 aa, Staphylococcus epidermidis
KEQSI

SEQ ID NO: 1771714 - protein, 12 aa, Staphylococcus epidermidis
KEQSNRDKEQIN

SEQ ID NO: 1771715 - protein, 16 aa, Staphylococcus epidermidis
KEQTNISRATLYRHLD

SEQ ID NO: 1771716 - protein, 6 aa, Staphylococcus epidermidis
KERDEL

SEQ ID NO: 1771717 - protein, 8 aa, Staphylococcus epidermidis
KEREIEGF

SEQ ID NO: 1771718 - protein, 5 aa, Staphylococcus epidermidis
KERLR

SEQ ID NO: 1771719 - protein, 7 aa, Staphylococcus epidermidis
KESNHHR

SEQ ID NO: 1771720 - protein, 4 aa, Staphylococcus epidermidis
KESV

SEQ ID NO: 1771721 - protein, 7 aa, Staphylococcus epidermidis
KETAKKY

SEQ ID NO: 1771722 - protein, 7 aa, Staphylococcus epidermidis
KETLTTQ

SEQ ID NO: 1771723 - protein, 6 aa, Staphylococcus epidermidis
KETYGV

SEQ ID NO: 1771724 - protein, 50 aa, Staphylococcus epidermidis
KEYTNDTDLSNTDYIETKNNDTHDMNDTYNNSTNHNHSNHTNHQQNEFNN

SEQ ID NO: 1771725 - protein, 6 aa, Staphylococcus epidermidis
KFHPES

SEQ ID NO: 1771726 - protein, 12 aa, Staphylococcus epidermidis
KGAAASNHFEGG

SEQ ID NO: 1771727 - protein, 8 aa, Staphylococcus epidermidis
KGAGYDRK

SEQ ID NO: 1771728 - protein, 17 aa, Staphylococcus epidermidis
KGEKVEAQAPKLDTESF

SEQ ID NO: 1771729 - protein, 7 aa, Staphylococcus epidermidis
KGGFTSA

SEQ ID NO: 1771730 - protein, 5 aa, Staphylococcus epidermidis
KGGLT

SEQ ID NO: 1771731 - protein, 13 aa, Staphylococcus epidermidis
KGHTVTRLKGGDP

SEQ ID NO: 1771732 - protein, 7 aa, Staphylococcus epidermidis
KGIGKGV

SEQ ID NO: 1771733 - protein, 8 aa, Staphylococcus epidermidis
KGITSKDK

SEQ ID NO: 1771734 - protein, 16 aa, Staphylococcus epidermidis
KGKGTLSGQGKAFADG

SEQ ID NO: 1771735 - protein, 5 aa, Staphylococcus epidermidis
KGKLT

SEQ ID NO: 1771736 - protein, 9 aa, Staphylococcus epidermidis
KGKNPSYVK

SEQ ID NO: 1771737 - protein, 10 aa, Staphylococcus epidermidis
KGKRQQNDYD

SEQ ID NO: 1771738 - protein, 7 aa, Staphylococcus epidermidis
KGKSKIP

SEQ ID NO: 1771739 - protein, 5 aa, Staphylococcus epidermidis
KGNEA

SEQ ID NO: 1771740 - protein, 6 aa, Staphylococcus epidermidis
KGNPRA

SEQ ID NO: 1771741 - protein, 7 aa, Staphylococcus epidermidis
KGNSKKV

SEQ ID NO: 1771742 - protein, 15 aa, Staphylococcus epidermidis
KGPIGKGSAKATVDG

SEQ ID NO: 1771743 - protein, 6 aa, Staphylococcus epidermidis
KGPIGR

SEQ ID NO: 1771744 - protein, 24 aa, Staphylococcus epidermidis
KGPNDESVKLNQSEVADEDDFEIG

SEQ ID NO: 1771745 - protein, 24 aa, Staphylococcus epidermidis
KGPNGESVKLNQSEVADEDDFELG

SEQ ID NO: 1771746 - protein, 14 aa, Staphylococcus epidermidis
KGPTIELKESEEFK

SEQ ID NO: 1771747 - protein, 6 aa, Staphylococcus epidermidis
KGQSEP

SEQ ID NO: 1771748 - protein, 10 aa, Staphylococcus epidermidis
KGTEKAKDEK

SEQ ID NO: 1771749 - protein, 4 aa, Staphylococcus epidermidis
KGTL

SEQ ID NO: 1771750 - protein, 6 aa, Staphylococcus epidermidis
KGTQTK

SEQ ID NO: 1771751 - protein, 14 aa, Staphylococcus epidermidis
KGYKAEGLHGDITQ

SEQ ID NO: 1771752 - protein, 14 aa, Staphylococcus epidermidis
KGYPGSYEKGHEIS

SEQ ID NO: 1771753 - protein, 8 aa, Staphylococcus epidermidis
KHKKSNVG

SEQ ID NO: 1771754 - protein, 7 aa, Staphylococcus epidermidis
KHLQSTK

SEQ ID NO: 1771755 - protein, 5 aa, Staphylococcus epidermidis
KHNAR

SEQ ID NO: 1771756 - protein, 7 aa, Staphylococcus epidermidis
KHRDDTL

SEQ ID NO: 1771757 - protein, 7 aa, Staphylococcus epidermidis
KIDDTEV

SEQ ID NO: 1771758 - protein, 5 aa, Staphylococcus epidermidis
KIDNG

SEQ ID NO: 1771759 - protein, 26 aa, Staphylococcus epidermidis
KIDQVGQELASSPNLAVSSSSRGNLE

SEQ ID NO: 1771760 - protein, 15 aa, Staphylococcus epidermidis
KIEESTRGEDSEEDF

SEQ ID NO: 1771761 - protein, 6 aa, Staphylococcus epidermidis
KIENQT

SEQ ID NO: 1771762 - protein, 15 aa, Staphylococcus epidermidis
KIEQGDEIAKSRLAE

SEQ ID NO: 1771763 - protein, 11 aa, Staphylococcus epidermidis
KIGDDEAAYDY

SEQ ID NO: 1771764 - protein, 9 aa, Staphylococcus epidermidis
KIKKYKKQI

SEQ ID NO: 1771765 - protein, 8 aa, Staphylococcus epidermidis
KIMPNGGS

SEQ ID NO: 1771766 - protein, 8 aa, Staphylococcus epidermidis
KINNDSRG

SEQ ID NO: 1771767 - protein, 6 aa, Staphylococcus epidermidis
KIPDSK

SEQ ID NO: 1771768 - protein, 6 aa, Staphylococcus epidermidis
KIPNSK

SEQ ID NO: 1771769 - protein, 7 aa, Staphylococcus epidermidis
KIRGEEM

SEQ ID NO: 1771770 - protein, 10 aa, Staphylococcus epidermidis
KISIQTNQND

SEQ ID NO: 1771771 - protein, 13 aa, Staphylococcus epidermidis
KITSTTSLNSDKN

SEQ ID NO: 1771772 - protein, 8 aa, Staphylococcus epidermidis
KKADATDS

SEQ ID NO: 1771773 - protein, 6 aa, Staphylococcus epidermidis
KKAHAY

SEQ ID NO: 1771774 - protein, 20 aa, Staphylococcus epidermidis
KKAQDAHDSVRLPIDDVREF

SEQ ID NO: 1771775 - protein, 8 aa, Staphylococcus epidermidis
KKAQGSRL

SEQ ID NO: 1771776 - protein, 8 aa, Staphylococcus epidermidis
KKDGNHKK

SEQ ID NO: 1771777 - protein, 10 aa, Staphylococcus epidermidis
KKDTLSEDAY

SEQ ID NO: 1771778 - protein, 8 aa, Staphylococcus epidermidis
KKEGQPAV

SEQ ID NO: 1771779 - protein, 7 aa, Staphylococcus epidermidis
KKEHEEL

SEQ ID NO: 1771780 - protein, 6 aa, Staphylococcus epidermidis
KKELTQ

SEQ ID NO: 1771781 - protein, 9 aa, Staphylococcus epidermidis
KKETDTKPL

SEQ ID NO: 1771782 - protein, 7 aa, Staphylococcus epidermidis
KKGFEEK

SEQ ID NO: 1771783 - protein, 23 aa, Staphylococcus epidermidis
KKGKGSENTLDHDEGGFTGQNQT

SEQ ID NO: 1771784 - protein, 21 aa, Staphylococcus epidermidis
KKGYTSYAPQYEGHAAPPEEI

SEQ ID NO: 1771785 - protein, 11 aa, Staphylococcus epidermidis
KKIGDKGNAAI

SEQ ID NO: 1771786 - protein, 6 aa, Staphylococcus epidermidis
KKITEG

SEQ ID NO: 1771787 - protein, 8 aa, Staphylococcus epidermidis
KKLDEGEA

SEQ ID NO: 1771788 - protein, 14 aa, Staphylococcus epidermidis
KKLSEPETKNIYSQ

SEQ ID NO: 1771789 - protein, 10 aa, Staphylococcus epidermidis
KKNGKKRVSH

SEQ ID NO: 1771790 - protein, 9 aa, Staphylococcus epidermidis
KKNKISQST

SEQ ID NO: 1771791 - protein, 22 aa, Staphylococcus epidermidis
KKNPERYEQEQQDRANYVKDNH

SEQ ID NO: 1771792 - protein, 5 aa, Staphylococcus epidermidis
KKPYN

SEQ ID NO: 1771793 - protein, 13 aa, Staphylococcus epidermidis
KKQERKDNADAEV

SEQ ID NO: 1771794 - protein, 12 aa, Staphylococcus epidermidis
KKQERKDNADVE

SEQ ID NO: 1771795 - protein, 9 aa, Staphylococcus epidermidis
KKQLDDQYE

SEQ ID NO: 1771796 - protein, 7 aa, Staphylococcus epidermidis
KKQTDEA

SEQ ID NO: 1771797 - protein, 8 aa, Staphylococcus epidermidis
KKRGGFHT

SEQ ID NO: 1771798 - protein, 9 aa, Staphylococcus epidermidis
KKSDWDKGD

SEQ ID NO: 1771799 - protein, 8 aa, Staphylococcus epidermidis
KKSFNNAH

SEQ ID NO: 1771800 - protein, 21 aa, Staphylococcus epidermidis
KKSKAEQKEFRNKLDESRFVV

SEQ ID NO: 1771801 - protein, 6 aa, Staphylococcus epidermidis
KKSPMK

SEQ ID NO: 1771802 - protein, 7 aa, Staphylococcus epidermidis
KKTGNPH

SEQ ID NO: 1771803 - protein, 27 aa, Staphylococcus epidermidis
KKTTKESTKFDEKSTNKTESLNNQYSS

SEQ ID NO: 1771804 - protein, 9 aa, Staphylococcus epidermidis
KKVDGEEGV

SEQ ID NO: 1771805 - protein, 14 aa, Staphylococcus epidermidis
KKVTETTEYEEVEY

SEQ ID NO: 1771806 - protein, 7 aa, Staphylococcus epidermidis
KKVVSKQ

SEQ ID NO: 1771807 - protein, 27 aa, Staphylococcus epidermidis
KKYGFESTNISSEKVKTDNKKNESKYD

SEQ ID NO: 1771808 - protein, 18 aa, Staphylococcus epidermidis
KLDERKKLTKTLKKNAQL

SEQ ID NO: 1771809 - protein, 11 aa, Staphylococcus epidermidis
KLEGKISTEEM

SEQ ID NO: 1771810 - protein, 4 aa, Staphylococcus epidermidis
KLEH

SEQ ID NO: 1771811 - protein, 13 aa, Staphylococcus epidermidis
KLEKGEDRKEAAI

SEQ ID NO: 1771812 - protein, 17 aa, Staphylococcus epidermidis
KLHSRSKAALSNANETL

SEQ ID NO: 1771813 - protein, 9 aa, Staphylococcus epidermidis
KLKSKLEKN

SEQ ID NO: 1771814 - protein, 7 aa, Staphylococcus epidermidis
KLLEQND

SEQ ID NO: 1771815 - protein, 6 aa, Staphylococcus epidermidis
KLLSGD

SEQ ID NO: 1771816 - protein, 13 aa, Staphylococcus epidermidis
KLRDYNENNHALS

SEQ ID NO: 1771817 - protein, 9 aa, Staphylococcus epidermidis
KLSDEKKNA

SEQ ID NO: 1771818 - protein, 9 aa, Staphylococcus epidermidis
KLSDNRYNN

SEQ ID NO: 1771819 - protein, 45 aa, Staphylococcus epidermidis; identical to SEQ ID NO: 1622860

SEQ ID NO: 1771820 - protein, 13 aa, Staphylococcus epidermidis
KLTGKPAATIDPE

SEQ ID NO: 1771821 - protein, 25 aa, Staphylococcus epidermidis
KMKTSYRNQLEKNYDSRITGKRLNE

SEQ ID NO: 1771822 - protein, 6 aa, Staphylococcus epidermidis
KMNAET

SEQ ID NO: 1771823 - protein, 7 aa, Staphylococcus epidermidis
KMNKAAQ

SEQ ID NO: 1771824 - protein, 5 aa, Staphylococcus epidermidis
KMPRR

SEQ ID NO: 1771825 - protein, 4 aa, Staphylococcus epidermidis
KMPT

SEQ ID NO: 1771826 - protein, 15 aa, Staphylococcus epidermidis
KMSPQPDCGDDSYHG

SEQ ID NO: 1771827 - protein, 14 aa, Staphylococcus epidermidis
KNAKKERDKGFSNK

SEQ ID NO: 1771828 - protein, 7 aa, Staphylococcus epidermidis
KNAKLDD

SEQ ID NO: 1771829 - protein, 10 aa, Staphylococcus epidermidis
KNASKIGNEY

SEQ ID NO: 1771830 - protein, 8 aa, Staphylococcus epidermidis
KNEGQPAV

SEQ ID NO: 1771831 - protein, 8 aa, Staphylococcus epidermidis
KNEQYGGV

SEQ ID NO: 1771832 - protein, 8 aa, Staphylococcus epidermidis
KNESVQSM

SEQ ID NO: 1771833 - protein, 8 aa, Staphylococcus epidermidis
KNGAGKST

SEQ ID NO: 1771834 - protein, 5 aa, Staphylococcus epidermidis
KNGDL

SEQ ID NO: 1771835 - protein, 6 aa, Staphylococcus epidermidis
KNGKGI

SEQ ID NO: 1771836 - protein, 5 aa, Staphylococcus epidermidis
KNIEN

SEQ ID NO: 1771837 - protein, 6 aa, Staphylococcus epidermidis
KNIIDE

SEQ ID NO: 1771838 - protein, 8 aa, Staphylococcus epidermidis
KNISSKTR

SEQ ID NO: 1771839 - protein, 7 aa, Staphylococcus epidermidis
KNKDDLD

SEQ ID NO: 1771840 - protein, 9 aa, Staphylococcus epidermidis
KNKEVSDKT

SEQ ID NO: 1771841 - protein, 16 aa, Staphylococcus epidermidis
KNNKQNDYLTNKKAHK

SEQ ID NO: 1771842 - protein, 8 aa, Staphylococcus epidermidis
KNNPEIDK

SEQ ID NO: 1771843 - protein, 9 aa, Staphylococcus epidermidis
KNPVTEPDF

SEQ ID NO: 1771844 - protein, 12 aa, Staphylococcus epidermidis
KNRYSAKAWDNR

SEQ ID NO: 1771845 - protein, 7 aa, Staphylococcus epidermidis
KNSPDEQ

SEQ ID NO: 1771846 - protein, 7 aa, Staphylococcus epidermidis
KNTGRPI

SEQ ID NO: 1771847 - protein, 14 aa, Staphylococcus epidermidis
KNVENSTRGHESED

SEQ ID NO: 1771848 - protein, 7 aa, Staphylococcus epidermidis
KNYEEAA

SEQ ID NO: 1771849 - protein, 7 aa, Staphylococcus epidermidis
KPAVNFD

SEQ ID NO: 1771850 - protein, 9 aa, Staphylococcus epidermidis
KPDSTKEQI

SEQ ID NO: 1771851 - protein, 16 aa, Staphylococcus epidermidis
KPEATIGSSTSGIMPS

SEQ ID NO: 1771852 - protein, 7 aa, Staphylococcus epidermidis
KPEVTEA

SEQ ID NO: 1771853 - protein, 4 aa, Staphylococcus epidermidis
KPGG

SEQ ID NO: 1771854 - protein, 11 aa, Staphylococcus epidermidis
KPTNGNEKVNN

SEQ ID NO: 1771855 - protein, 7 aa, Staphylococcus epidermidis
KQADKMG

SEQ ID NO: 1771856 - protein, 9 aa, Staphylococcus epidermidis
KQAGQTQVT

SEQ ID NO: 1771857 - protein, 8 aa, Staphylococcus epidermidis
KQASTGGA

SEQ ID NO: 1771858 - protein, 6 aa, Staphylococcus epidermidis
KQGPMG

SEQ ID NO: 1771859 - protein, 14 aa, Staphylococcus epidermidis
KQGTTSNISSRTMG

SEQ ID NO: 1771860 - protein, 9 aa, Staphylococcus epidermidis
KQKKKDSYS

SEQ ID NO: 1771861 - protein, 4 aa, Staphylococcus epidermidis
KQKL

SEQ ID NO: 1771862 - protein, 8 aa, Staphylococcus epidermidis
KQKSKGKI

SEQ ID NO: 1771863 - protein, 6 aa, Staphylococcus epidermidis
KQLSDK

SEQ ID NO: 1771864 - protein, 9 aa, Staphylococcus epidermidis
KQNKDKAEK

SEQ ID NO: 1771865 - protein, 7 aa, Staphylococcus epidermidis
KQPDLSP

SEQ ID NO: 1771866 - protein, 5 aa, Staphylococcus epidermidis
KQQEN

SEQ ID NO: 1771867 - protein, 6 aa, Staphylococcus epidermidis
KQQENY

SEQ ID NO: 1771868 - protein, 6 aa, Staphylococcus epidermidis
KQTAEE

SEQ ID NO: 1771869 - protein, 8 aa, Staphylococcus epidermidis
KQTESNID

SEQ ID NO: 1771870 - protein, 14 aa, Staphylococcus epidermidis
KQTKQTSSDNQLKQ

SEQ ID NO: 1771871 - protein, 5 aa, Staphylococcus epidermidis
KQYNR

SEQ ID NO: 1771872 - protein, 9 aa, Staphylococcus epidermidis
KQYSTAGSF

SEQ ID NO: 1771873 - protein, 6 aa, Staphylococcus epidermidis
KRDEES

SEQ ID NO: 1771874 - protein, 8 aa, Staphylococcus epidermidis
KRDGKHHG

SEQ ID NO: 1771875 - protein, 11 aa, Staphylococcus epidermidis
KRGKSPLNPTN

SEQ ID NO: 1771876 - protein, 26 aa, Staphylococcus epidermidis
KRGRNAKSYTKAKNTDIQTYRKSSAL

SEQ ID NO: 1771877 - protein, 8 aa, Staphylococcus epidermidis
KRGSKNEC

SEQ ID NO: 1771878 - protein, 13 aa, Staphylococcus epidermidis
KRGTVQQKDSYGL

SEQ ID NO: 1771879 - protein, 27 aa, Staphylococcus epidermidis
KRIKDKKERYETQAKRSLEYLDNYKQT

SEQ ID NO: 1771880 - protein, 6 aa, Staphylococcus epidermidis
KRKTDQ

SEQ ID NO: 1771881 - protein, 7 aa, Staphylococcus epidermidis
KRQAGTE

SEQ ID NO: 1771882 - protein, 13 aa, Staphylococcus epidermidis
KRRDHLPITSLFN

SEQ ID NO: 1771883 - protein, 7 aa, Staphylococcus epidermidis
KRREPFE

SEQ ID NO: 1771884 - protein, 10 aa, Staphylococcus epidermidis
KRREPFEKEG

SEQ ID NO: 1771885 - protein, 5 aa, Staphylococcus epidermidis
KRSET

SEQ ID NO: 1771886 - protein, 8 aa, Staphylococcus epidermidis
KRSKNNKE

SEQ ID NO: 1771887 - protein, 4 aa, Staphylococcus epidermidis
KSAV

SEQ ID NO: 1771888 - protein, 8 aa, Staphylococcus epidermidis
KSEDSEKF

SEQ ID NO: 1771889 - protein, 7 aa, Staphylococcus epidermidis
KSELKRD

SEQ ID NO: 1771890 - protein, 7 aa, Staphylococcus epidermidis
KSELTEE

SEQ ID NO: 1771891 - protein, 13 aa, Staphylococcus epidermidis
KSEQQDEQPKHRA

SEQ ID NO: 1771892 - protein, 27 aa, Staphylococcus epidermidis
KSESHMKHNDESKVPEDMTSTNEGEFK

SEQ ID NO: 1771893 - protein, 6 aa, Staphylococcus epidermidis
KSGKSY

SEQ ID NO: 1771894 - protein, 10 aa, Staphylococcus epidermidis
KSGTNTTGIQ

SEQ ID NO: 1771895 - protein, 10 aa, Staphylococcus epidermidis
KSHTTPSNLK

SEQ ID NO: 1771896 - protein, 20 aa, Staphylococcus epidermidis
KSIQSSSITYNDKESQNLGL

SEQ ID NO: 1771897 - protein, 10 aa, Staphylococcus epidermidis
KSISKNGGKV

SEQ ID NO: 1771898 - protein, 9 aa, Staphylococcus epidermidis
KSKETDELL

SEQ ID NO: 1771899 - protein, 4 aa, Staphylococcus epidermidis
KSNA

SEQ ID NO: 1771900 - protein, 5 aa, Staphylococcus epidermidis
KSNEY

SEQ ID NO: 1771901 - protein, 9 aa, Staphylococcus epidermidis
KSNKENASR

SEQ ID NO: 1771902 - protein, 5 aa, Staphylococcus epidermidis
KSNKQ

SEQ ID NO: 1771903 - protein, 9 aa, Staphylococcus epidermidis
KSNTKGYAS

SEQ ID NO: 1771904 - protein, 20 aa, Staphylococcus epidermidis
KSNYQTTKRKTPNYSKVDNT

SEQ ID NO: 1771905 - protein, 7 aa, Staphylococcus epidermidis
KSPGTMT

SEQ ID NO: 1771906 - protein, 13 aa, Staphylococcus epidermidis
KSQIPVGQSNSNQ

SEQ ID NO: 1771907 - protein, 8 aa, Staphylococcus epidermidis
KSRAKHEA

SEQ ID NO: 1771908 - protein, 4 aa, Staphylococcus epidermidis
KSRF

SEQ ID NO: 1771909 - protein, 4 aa, Staphylococcus epidermidis
KSSL

SEQ ID NO: 1771910 - protein, 20 aa, Staphylococcus epidermidis
KSTEAKRASDTFDTKSEAVN

SEQ ID NO: 1771911 - protein, 5 aa, Staphylococcus epidermidis
KSTYA

SEQ ID NO: 1771912 - protein, 6 aa, Staphylococcus epidermidis
KSVSAN

SEQ ID NO: 1771913 - protein, 7 aa, Staphylococcus epidermidis
KTDNTLA

SEQ ID NO: 1771914 - protein, 6 aa, Staphylococcus epidermidis
KTDRDG

SEQ ID NO: 1771915 - protein, 8 aa, Staphylococcus epidermidis
KTENKNGD

SEQ ID NO: 1771916 - protein, 6 aa, Staphylococcus epidermidis
KTGDHV

SEQ ID NO: 1771917 - protein, 6 aa, Staphylococcus epidermidis
KTGERI

SEQ ID NO: 1771918 - protein, 7 aa, Staphylococcus epidermidis
KTINGVS

SEQ ID NO: 1771919 - protein, 8 aa, Staphylococcus epidermidis
KTKKYKSD

SEQ ID NO: 1771920 - protein, 14 aa, Staphylococcus epidermidis
KTKPESGTVETNGE

SEQ ID NO: 1771921 - protein, 12 aa, Staphylococcus epidermidis
KTKPESGTVETV

SEQ ID NO: 1771922 - protein, 4 aa, Staphylococcus epidermidis
KTLA

SEQ ID NO: 1771923 - protein, 14 aa, Staphylococcus epidermidis
KTLYSEKDRDIEGL

SEQ ID NO: 1771924 - protein, 4 aa, Staphylococcus epidermidis
KTME

SEQ ID NO: 1771925 - protein, 4 aa, Staphylococcus epidermidis
KTNK

SEQ ID NO: 1771926 - protein, 8 aa, Staphylococcus epidermidis
KTNSKTIA

SEQ ID NO: 1771927 - protein, 4 aa, Staphylococcus epidermidis
KTNT

SEQ ID NO: 1771928 - protein, 10 aa, Staphylococcus epidermidis
KTQGQSSTLQ

SEQ ID NO: 1771929 - protein, 12 aa, Staphylococcus epidermidis
KTQGQSSTLQTL

SEQ ID NO: 1771930 - protein, 8 aa, Staphylococcus epidermidis
KTREEENE

SEQ ID NO: 1771931 - protein, 9 aa, Staphylococcus epidermidis
KTREEENEV

SEQ ID NO: 1771932 - protein, 7 aa, Staphylococcus epidermidis
KTSFNNT

SEQ ID NO: 1771933 - protein, 7 aa, Staphylococcus epidermidis
KTSPKYN

SEQ ID NO: 1771934 - protein, 4 aa, Staphylococcus epidermidis
KTVI

SEQ ID NO: 1771935 - protein, 7 aa, Staphylococcus epidermidis
KTVKDNM

SEQ ID NO: 1771936 - protein, 7 aa, Staphylococcus epidermidis
KTVNKDK

SEQ ID NO: 1771937 - protein, 16 aa, Staphylococcus epidermidis
KVEPGKIYNNGKPENI

SEQ ID NO: 1771938 - protein, 6 aa, Staphylococcus epidermidis
KVETEE

SEQ ID NO: 1771939 - protein, 5 aa, Staphylococcus epidermidis
KVGSG

SEQ ID NO: 1771940 - protein, 22 aa, Staphylococcus epidermidis
KVPDAQPLKTIDDATKIIMRGE

SEQ ID NO: 1771941 - protein, 11 aa, Staphylococcus epidermidis
KVPSSQTEKLK

SEQ ID NO: 1771942 - protein, 46 aa, Staphylococcus epidermidis
KVRSKSKRKVKPGYKKKFKQEVEKMKRQERKQYSKKQNRQKRKNNK

SEQ ID NO: 1771943 - protein, 4 aa, Staphylococcus epidermidis
KVTG

SEQ ID NO: 1771944 - protein, 8 aa, Staphylococcus epidermidis
KVTSGGFN

SEQ ID NO: 1771945 - protein, 6 aa, Staphylococcus epidermidis
KVYKSS

SEQ ID NO: 1771946 - protein, 6 aa, Staphylococcus epidermidis
KWGTPR

SEQ ID NO: 1771947 - protein, 9 aa, Staphylococcus epidermidis
KWQGKKEPV

SEQ ID NO: 1771948 - protein, 6 aa, Staphylococcus epidermidis
KYDESN

SEQ ID NO: 1771949 - protein, 7 aa, Staphylococcus epidermidis
KYDNETV

SEQ ID NO: 1771950 - protein, 9 aa, Staphylococcus epidermidis
KYEKQLNDI

SEQ ID NO: 1771951 - protein, 6 aa, Staphylococcus epidermidis
KYGIGT

SEQ ID NO: 1771952 - protein, 5 aa, Staphylococcus epidermidis
KYGYK

SEQ ID NO: 1771953 - protein, 8 aa, Staphylococcus epidermidis
KYNERQSL

SEQ ID NO: 1771954 - protein, 21 aa, Staphylococcus epidermidis
KYNNQNTSDSISDNSVKKTST

SEQ ID NO: 1771955 - protein, 4 aa, Staphylococcus epidermidis
KYTF

SEQ ID NO: 1771956 - protein, 11 aa, Staphylococcus epidermidis
KYVRESRYKPT

SEQ ID NO: 1771957 - protein, 8 aa, Staphylococcus epidermidis
LAEDKGHE

SEQ ID NO: 1771958 - protein, 6 aa, Staphylococcus epidermidis
LAGEGT

SEQ ID NO: 1771959 - protein, 5 aa, Staphylococcus epidermidis
LAPNH

SEQ ID NO: 1771960 - protein, 14 aa, Staphylococcus epidermidis
LAQTGRLSSVDPNL

SEQ ID NO: 1771961 - protein, 70 aa, Staphylococcus epidermidis
LARKNRSNKGGSRRSNHKRGNGKFDNKNRRSKGSKGQSSKKKNQKKFDRRDKQQKSGNQSLKGRTFADHQ

SEQ ID NO: 1771962 - protein, 5 aa, Staphylococcus epidermidis
LARPA

SEQ ID NO: 1771963 - protein, 9 aa, Staphylococcus epidermidis
LASKTTDDI

SEQ ID NO: 1771964 - protein, 5 aa, Staphylococcus epidermidis
LDDEN

SEQ ID NO: 1771965 - protein, 5 aa, Staphylococcus epidermidis
LDEAY

SEQ ID NO: 1771966 - protein, 12 aa, Staphylococcus epidermidis
LDKISNNLKNIM

SEQ ID NO: 1771967 - protein, 8 aa, Staphylococcus epidermidis
LDKNPNDS

SEQ ID NO: 1771968 - protein, 10 aa, Staphylococcus epidermidis
LDQATRQSVA

SEQ ID NO: 1771969 - protein, 6 aa, Staphylococcus epidermidis
LEAEDL

SEQ ID NO: 1771970 - protein, 4 aa, Staphylococcus epidermidis
LEAG

SEQ ID NO: 1771971 - protein, 13 aa, Staphylococcus epidermidis
LEDKEDEKQGEVS

SEQ ID NO: 1771972 - protein, 5 aa, Staphylococcus epidermidis
LEDRP

SEQ ID NO: 1771973 - protein, 6 aa, Staphylococcus epidermidis
LEEQPV

SEQ ID NO: 1771974 - protein, 5 aa, Staphylococcus epidermidis
LEEVQ

SEQ ID NO: 1771975 - protein, 5 aa, Staphylococcus epidermidis
LEKHA

SEQ ID NO: 1771976 - protein, 9 aa, Staphylococcus epidermidis
LEKSNEDRD

SEQ ID NO: 1771977 - protein, 6 aa, Staphylococcus epidermidis
LEPGTY

SEQ ID NO: 1771978 - protein, 5 aa, Staphylococcus epidermidis
LEPYG

SEQ ID NO: 1771979 - protein, 12 aa, Staphylococcus epidermidis
LEQNSKRVDQQR

SEQ ID NO: 1771980 - protein, 5 aa, Staphylococcus epidermidis
LESSA

SEQ ID NO: 1771981 - protein, 15 aa, Staphylococcus epidermidis
LETGKKFNNNKQALR

SEQ ID NO: 1771982 - protein, 6 aa, Staphylococcus epidermidis
LETNNN

SEQ ID NO: 1771983 - protein, 9 aa, Staphylococcus epidermidis
LGGKNDYKD

SEQ ID NO: 1771984 - protein, 4 aa, Staphylococcus epidermidis
LGIG

SEQ ID NO: 1771985 - protein, 9 aa, Staphylococcus epidermidis
LGKKGSVSA

SEQ ID NO: 1771986 - protein, 9 aa, Staphylococcus epidermidis
LGPSSKAAL

SEQ ID NO: 1771987 - protein, 7 aa, Staphylococcus epidermidis
LGSEKQI

SEQ ID NO: 1771988 - protein, 15 aa, Staphylococcus epidermidis
LHSRSKAALSNANET

SEQ ID NO: 1771989 - protein, 6 aa, Staphylococcus epidermidis
LISSET

SEQ ID NO: 1771990 - protein, 10 aa, Staphylococcus epidermidis
LKAGETVSYG

SEQ ID NO: 1771991 - protein, 10 aa, Staphylococcus epidermidis
LKAKGTDTGW

SEQ ID NO: 1771992 - protein, 10 aa, Staphylococcus epidermidis
LKAQQKQSVN

SEQ ID NO: 1771993 - protein, 7 aa, Staphylococcus epidermidis
LKDKGNT

SEQ ID NO: 1771994 - protein, 4 aa, Staphylococcus epidermidis
LKEK

SEQ ID NO: 1771995 - protein, 5 aa, Staphylococcus epidermidis
LKESQ

SEQ ID NO: 1771996 - protein, 9 aa, Staphylococcus epidermidis
LKKEGKTSL

SEQ ID NO: 1771997 - protein, 11 aa, Staphylococcus epidermidis
LKKEGYFDQSN

SEQ ID NO: 1771998 - protein, 9 aa, Staphylococcus epidermidis
LKNKRNSIA

SEQ ID NO: 1771999 - protein, 26 aa, Staphylococcus epidermidis
LKNVNSSKSSNSDTGQTRKQRFGGSR

SEQ ID NO: 1772000 - protein, 7 aa, Staphylococcus epidermidis
LKPTKGK

SEQ ID NO: 1772001 - protein, 5 aa, Staphylococcus epidermidis
LKQPV

SEQ ID NO: 1772002 - protein, 4 aa, Staphylococcus epidermidis
LKSE

SEQ ID NO: 1772003 - protein, 6 aa, Staphylococcus epidermidis
LKTLNS

SEQ ID NO: 1772004 - protein, 11 aa, Staphylococcus epidermidis
LKTRKEDEVKD

SEQ ID NO: 1772005 - protein, 4 aa, Staphylococcus epidermidis
LKVG

SEQ ID NO: 1772006 - protein, 10 aa, Staphylococcus epidermidis
LMSGSGPTVY

SEQ ID NO: 1772007 - protein, 8 aa, Staphylococcus epidermidis
LNAGGKRI

SEQ ID NO: 1772008 - protein, 4 aa, Staphylococcus epidermidis
LNDQ

SEQ ID NO: 1772009 - protein, 5 aa, Staphylococcus epidermidis
LNESG

SEQ ID NO: 1772010 - protein, 5 aa, Staphylococcus epidermidis
LNGAD

SEQ ID NO: 1772011 - protein, 10 aa, Staphylococcus epidermidis
LNNNYKDIKQ

SEQ ID NO: 1772012 - protein, 7 aa, Staphylococcus epidermidis
LNNSAAN

SEQ ID NO: 1772013 - protein, 7 aa, Staphylococcus epidermidis
LNQEEPK

SEQ ID NO: 1772014 - protein, 28 aa, Staphylococcus epidermidis
LNQQGQDKGQKYRTGVYSESSKHLNEAK

SEQ ID NO: 1772015 - protein, 6 aa, Staphylococcus epidermidis
LNTQGA

SEQ ID NO: 1772016 - protein, 19 aa, Staphylococcus epidermidis
LPDKQSTTGKHTSSNTTSI

SEQ ID NO: 1772017 - protein, 4 aa, Staphylococcus epidermidis
LPED

SEQ ID NO: 1772018 - protein, 5 aa, Staphylococcus epidermidis
LPEGT

SEQ ID NO: 1772019 - protein, 4 aa, Staphylococcus epidermidis
LPKL

SEQ ID NO: 1772020 - protein, 10 aa, Staphylococcus epidermidis
LPKTNSGKIR

SEQ ID NO: 1772021 - protein, 4 aa, Staphylococcus epidermidis
LPLS

SEQ ID NO: 1772022 - protein, 6 aa, Staphylococcus epidermidis
LPNESG

SEQ ID NO: 1772023 - protein, 5 aa, Staphylococcus epidermidis
LPSNL

SEQ ID NO: 1772024 - protein, 12 aa, Staphylococcus epidermidis
LPSSTNPTLPYT

SEQ ID NO: 1772025 - protein, 10 aa, Staphylococcus epidermidis
LPTISSASQH

SEQ ID NO: 1772026 - protein, 4 aa, Staphylococcus epidermidis
LQDS

SEQ ID NO: 1772027 - protein, 4 aa, Staphylococcus epidermidis
LQIQ

SEQ ID NO: 1772028 - protein, 7 aa, Staphylococcus epidermidis
LQPFSPE

SEQ ID NO: 1772029 - protein, 6 aa, Staphylococcus epidermidis
LRTHGD

SEQ ID NO: 1772030 - protein, 6 aa, Staphylococcus epidermidis
LSAGEK

SEQ ID NO: 1772031 - protein, 7 aa, Staphylococcus epidermidis
LSAGEKV

SEQ ID NO: 1772032 - protein, 7 aa, Staphylococcus epidermidis
LSDKEYD

SEQ ID NO: 1772033 - protein, 8 aa, Staphylococcus epidermidis
LSDKPNRL

SEQ ID NO: 1772034 - protein, 10 aa, Staphylococcus epidermidis
LSDRSDLAKY

SEQ ID NO: 1772035 - protein, 11 aa, Staphylococcus epidermidis
LSESSIKADPN

SEQ ID NO: 1772036 - protein, 7 aa, Staphylococcus epidermidis
LSETRKA

SEQ ID NO: 1772037 - protein, 7 aa, Staphylococcus epidermidis
LSGEDET

SEQ ID NO: 1772038 - protein, 5 aa, Staphylococcus epidermidis
LSGMK

SEQ ID NO: 1772039 - protein, 7 aa, Staphylococcus epidermidis
LSKDETH

SEQ ID NO: 1772040 - protein, 7 aa, Staphylococcus epidermidis
LSKGDKC

SEQ ID NO: 1772041 - protein, 4 aa, Staphylococcus epidermidis
LSKK

SEQ ID NO: 1772042 - protein, 20 aa, Staphylococcus epidermidis
LSKRGISSVGLTGKDSIAYR

SEQ ID NO: 1772043 - protein, 22 aa, Staphylococcus epidermidis
LSKRGISSVGLTGKDSIAYRTE

SEQ ID NO: 1772044 - protein, 15 aa, Staphylococcus epidermidis
LSNDSTKHKYDVTTN

SEQ ID NO: 1772045 - protein, 10 aa, Staphylococcus epidermidis
LSNYSPETRN

SEQ ID NO: 1772046 - protein, 4 aa, Staphylococcus epidermidis
LSPE

SEQ ID NO: 1772047 - protein, 5 aa, Staphylococcus epidermidis
LSPED

SEQ ID NO: 1772048 - protein, 5 aa, Staphylococcus epidermidis
LSPKV

SEQ ID NO: 1772049 - protein, 9 aa, Staphylococcus epidermidis
LSPQDGRAN

SEQ ID NO: 1772050 - protein, 10 aa, Staphylococcus epidermidis
LSQDTNIQLS

SEQ ID NO: 1772051 - protein, 8 aa, Staphylococcus epidermidis
LSQDTTFS

SEQ ID NO: 1772052 - protein, 6 aa, Staphylococcus epidermidis
LSQEEN

SEQ ID NO: 1772053 - protein, 9 aa, Staphylococcus epidermidis
LSREEQQAV

SEQ ID NO: 1772054 - protein, 7 aa, Staphylococcus epidermidis
LSSAHGR

SEQ ID NO: 1772055 - protein, 11 aa, Staphylococcus epidermidis
LSSDENEDRYE

SEQ ID NO: 1772056 - protein, 7 aa, Staphylococcus epidermidis
LSTKTTN

SEQ ID NO: 1772057 - protein, 7 aa, Staphylococcus epidermidis
LSTNEQL

SEQ ID NO: 1772058 - protein, 13 aa, Staphylococcus epidermidis
LTEAQDALSTPSN

SEQ ID NO: 1772059 - protein, 8 aa, Staphylococcus epidermidis
LTEERRTR

SEQ ID NO: 1772060 - protein, 5 aa, Staphylococcus epidermidis
LTERP

SEQ ID NO: 1772061 - protein, 6 aa, Staphylococcus epidermidis
LTESEK

SEQ ID NO: 1772062 - protein, 7 aa, Staphylococcus epidermidis
LTGGNAG

SEQ ID NO: 1772063 - protein, 4 aa, Staphylococcus epidermidis
LTGK

SEQ ID NO: 1772064 - protein, 6 aa, Staphylococcus epidermidis
LTHPDK

SEQ ID NO: 1772065 - protein, 5 aa, Staphylococcus epidermidis
LTHSP

SEQ ID NO: 1772066 - protein, 6 aa, Staphylococcus epidermidis
LTHSPI

SEQ ID NO: 1772067 - protein, 9 aa, Staphylococcus epidermidis
LTKEQRDAF

SEQ ID NO: 1772068 - protein, 10 aa, Staphylococcus epidermidis
LTNDDGTNFY

SEQ ID NO: 1772069 - protein, 25 aa, Staphylococcus epidermidis
LTNESIKNIESKYEGEGYGKFKGDL

SEQ ID NO: 1772070 - protein, 26 aa, Staphylococcus epidermidis
LTNESIKNIESKYEGEGYGKFKGDLS

SEQ ID NO: 1772071 - protein, 13 aa, Staphylococcus epidermidis
LTNPNITKTLEEN

SEQ ID NO: 1772072 - protein, 5 aa, Staphylococcus epidermidis
LTNRY

SEQ ID NO: 1772073 - protein, 5 aa, Staphylococcus epidermidis
LTPGL

SEQ ID NO: 1772074 - protein, 6 aa, Staphylococcus epidermidis
LTPQPY

SEQ ID NO: 1772075 - protein, 13 aa, Staphylococcus epidermidis
LTRQGQLSGTVAE

SEQ ID NO: 1772076 - protein, 12 aa, Staphylococcus epidermidis
LTSPKEALENAG

SEQ ID NO: 1772077 - protein, 29 aa, Staphylococcus epidermidis
LTTELNGQIDKTDFNNYKSKQKKPSETKY

SEQ ID NO: 1772078 - protein, 9 aa, Staphylococcus epidermidis
LVGQPGDTL

SEQ ID NO: 1772079 - protein, 15 aa, Staphylococcus epidermidis
LYDDEGNLINKNKTS

SEQ ID NO: 1772080 - protein, 9 aa, Staphylococcus epidermidis
LYSSDSKIE

SEQ ID NO: 1772081 - protein, 5 aa, Staphylococcus epidermidis
LYTDE

SEQ ID NO: 1772082 - protein, 7 aa, Staphylococcus epidermidis
MENKGYR

SEQ ID NO: 1772083 - protein, 4 aa, Staphylococcus epidermidis
MGPI

SEQ ID NO: 1772084 - protein, 8 aa, Staphylococcus epidermidis
MGPKETLN

SEQ ID NO: 1772085 - protein, 14 aa, Staphylococcus epidermidis
MGSNAQSMNGTSNV

SEQ ID NO: 1772086 - protein, 9 aa, Staphylococcus epidermidis
MGTRSGNLD

SEQ ID NO: 1772087 - protein, 6 aa, Staphylococcus epidermidis
MKEQDM

SEQ ID NO: 1772088 - protein, 6 aa, Staphylococcus epidermidis
MKNAHE

SEQ ID NO: 1772089 - protein, 8 aa, Staphylococcus epidermidis
MKTQQQEL

SEQ ID NO: 1772090 - protein, 9 aa, Staphylococcus epidermidis
MNEDKAKAK

SEQ ID NO: 1772091 - protein, 5 aa, Staphylococcus epidermidis
MNEGQ

SEQ ID NO: 1772092 - protein, 9 aa, Staphylococcus epidermidis
MNNEENKDM

SEQ ID NO: 1772093 - protein, 4 aa, Staphylococcus epidermidis
MNNS

SEQ ID NO: 1772094 - protein, 10 aa, Staphylococcus epidermidis
MNYSDDSNTR

SEQ ID NO: 1772095 - protein, 7 aa, Staphylococcus epidermidis
MPTNELD

SEQ ID NO: 1772096 - protein, 8 aa, Staphylococcus epidermidis
MRKEPSIP

SEQ ID NO: 1772097 - protein, 6 aa, Staphylococcus epidermidis
MSDKGR

SEQ ID NO: 1772098 - protein, 22 aa, Staphylococcus epidermidis
MSDVKGKEMEQERKGRIKNDEI

SEQ ID NO: 1772099 - protein, 4 aa, Staphylococcus epidermidis
MSKE

SEQ ID NO: 1772100 - protein, 9 aa, Staphylococcus epidermidis
MTAEDKDQV

SEQ ID NO: 1772101 - protein, 5 aa, Staphylococcus epidermidis
MTPEA

SEQ ID NO: 1772102 - protein, 6 aa, Staphylococcus epidermidis
MTRSHN

SEQ ID NO: 1772103 - protein, 9 aa, Staphylococcus epidermidis
MTVQENASI

SEQ ID NO: 1772104 - protein, 11 aa, Staphylococcus epidermidis
MYKGTEEIDGA

SEQ ID NO: 1772105 - protein, 15 aa, Staphylococcus epidermidis
NADEVNAGKKSVKDL

SEQ ID NO: 1772106 - protein, 7 aa, Staphylococcus epidermidis
NADSKNL

SEQ ID NO: 1772107 - protein, 7 aa, Staphylococcus epidermidis
NAGFTTG

SEQ ID NO: 1772108 - protein, 5 aa, Staphylococcus epidermidis
NAIEG

SEQ ID NO: 1772109 - protein, 8 aa, Staphylococcus epidermidis
NAKPLKEN

SEQ ID NO: 1772110 - protein, 8 aa, Staphylococcus epidermidis
NALTNGSA

SEQ ID NO: 1772111 - protein, 8 aa, Staphylococcus epidermidis
NANTDEQR

SEQ ID NO: 1772112 - protein, 56 aa, Staphylococcus epidermidis
NAQQSSQRAAQQATKSSRVTATKNKGQQSVSSQKAQSRSLMPSQRPYDSSAPYSSQ

SEQ ID NO: 1772113 - protein, 13 aa, Staphylococcus epidermidis
NASRSQTSKYMNP

SEQ ID NO: 1772114 - protein, 12 aa, Staphylococcus epidermidis
NATMPKRDRLDA

SEQ ID NO: 1772115 - protein, 8 aa, Staphylococcus epidermidis
NAVDQTKE

SEQ ID NO: 1772116 - protein, 9 aa, Staphylococcus epidermidis
NAVKSNHSV

SEQ ID NO: 1772117 - protein, 16 aa, Staphylococcus epidermidis
NAVSAQRSVTDTTKEL

SEQ ID NO: 1772118 - protein, 20 aa, Staphylococcus epidermidis
NDAPEILGEPDIQNDISQYS

SEQ ID NO: 1772119 - protein, 12 aa, Staphylococcus epidermidis
NDAPITPVTSLH

SEQ ID NO: 1772120 - protein, 4 aa, Staphylococcus epidermidis
NDAV

SEQ ID NO: 1772121 - protein, 10 aa, Staphylococcus epidermidis
NDDLKNLENG

SEQ ID NO: 1772122 - protein, 19 aa, Staphylococcus epidermidis
NDDNTISVKNDRPRIDTAR

SEQ ID NO: 1772123 - protein, 17 aa, Staphylococcus epidermidis
NDDQYRKALEKNKNNPS

SEQ ID NO: 1772124 - protein, 13 aa, Staphylococcus epidermidis
NDDTLENPAFRGE

SEQ ID NO: 1772125 - protein, 6 aa, Staphylococcus epidermidis
NDELRS

SEQ ID NO: 1772126 - protein, 22 aa, Staphylococcus epidermidis
NDGAGAVFSEKENKYSEGNQGP

SEQ ID NO: 1772127 - protein, 5 aa, Staphylococcus epidermidis
NDGGG

SEQ ID NO: 1772128 - protein, 13 aa, Staphylococcus epidermidis
NDINNQNNDINYS

SEQ ID NO: 1772129 - protein, 8 aa, Staphylococcus epidermidis
NDKEGQAI

SEQ ID NO: 1772130 - protein, 8 aa, Staphylococcus epidermidis
NDKKTEIN

SEQ ID NO: 1772131 - protein, 7 aa, Staphylococcus epidermidis
NDLGTEI

SEQ ID NO: 1772132 - protein, 46 aa, Staphylococcus epidermidis
NDLTPEERAMKQKQNQELSANQPSTSSSESVSQSNTNSESSQSTSN

SEQ ID NO: 1772133 - protein, 14 aa, Staphylococcus epidermidis
NDNEAIQTDRSEQL

SEQ ID NO: 1772134 - protein, 8 aa, Staphylococcus epidermidis
NDTTQDHR

SEQ ID NO: 1772135 - protein, 10 aa, Staphylococcus epidermidis
NDYGTEDEIK

SEQ ID NO: 1772136 - protein, 10 aa, Staphylococcus epidermidis
NEANDAQALQ

SEQ ID NO: 1772137 - protein, 9 aa, Staphylococcus epidermidis
NEAVQEAGM

SEQ ID NO: 1772138 - protein, 19 aa, Staphylococcus epidermidis
NEDIPEEISRNSSVESEEG

SEQ ID NO: 1772139 - protein, 4 aa, Staphylococcus epidermidis
NEDP

SEQ ID NO: 1772140 - protein, 5 aa, Staphylococcus epidermidis
NEDVN

SEQ ID NO: 1772141 - protein, 5 aa, Staphylococcus epidermidis
NEEPY

SEQ ID NO: 1772142 - protein, 4 aa, Staphylococcus epidermidis
NEEQ

SEQ ID NO: 1772143 - protein, 7 aa, Staphylococcus epidermidis
NEFTEDS

SEQ ID NO: 1772144 - protein, 4 aa, Staphylococcus epidermidis
NEGK

SEQ ID NO: 1772145 - protein, 5 aa, Staphylococcus epidermidis
NEGVH

SEQ ID NO: 1772146 - protein, 19 aa, Staphylococcus epidermidis
NEIEKESQQDNVKDPQTEI

SEQ ID NO: 1772147 - protein, 5 aa, Staphylococcus epidermidis
NEIVQ

SEQ ID NO: 1772148 - protein, 10 aa, Staphylococcus epidermidis
NEKRKQTEYI

SEQ ID NO: 1772149 - protein, 19 aa, Staphylococcus epidermidis
NELTRRNSYQGKMNKQSIQ

SEQ ID NO: 1772150 - protein, 5 aa, Staphylococcus epidermidis
NENLD

SEQ ID NO: 1772151 - protein, 16 aa, Staphylococcus epidermidis
NEQAPLNHSGYPSLSN

SEQ ID NO: 1772152 - protein, 6 aa, Staphylococcus epidermidis
NEQQYN

SEQ ID NO: 1772153 - protein, 4 aa, Staphylococcus epidermidis
NERE

SEQ ID NO: 1772154 - protein, 10 aa, Staphylococcus epidermidis
NESVQNNLEN

SEQ ID NO: 1772155 - protein, 4 aa, Staphylococcus epidermidis
NETA

SEQ ID NO: 1772156 - protein, 4 aa, Staphylococcus epidermidis
NEYQ

SEQ ID NO: 1772157 - protein, 11 aa, Staphylococcus epidermidis
NFDPKSKNEVD

SEQ ID NO: 1772158 - protein, 11 aa, Staphylococcus epidermidis
NFKFPQDESTP

SEQ ID NO: 1772159 - protein, 9 aa, Staphylococcus epidermidis
NFKQDRNKT

SEQ ID NO: 1772160 - protein, 5 aa, Staphylococcus epidermidis
NFTTN

SEQ ID NO: 1772161 - protein, 15 aa, Staphylococcus epidermidis
NGDAIATGDLLVEIE

SEQ ID NO: 1772162 - protein, 4 aa, Staphylococcus epidermidis
NGDQ

SEQ ID NO: 1772163 - protein, 6 aa, Staphylococcus epidermidis
NGDTHQ

SEQ ID NO: 1772164 - protein, 22 aa, Staphylococcus epidermidis
NGEDINEQSSNFKDRAKRFFKG

SEQ ID NO: 1772165 - protein, 10 aa, Staphylococcus epidermidis
NGEMEYPKGQ

SEQ ID NO: 1772166 - protein, 8 aa, Staphylococcus epidermidis
NGESSKAR

SEQ ID NO: 1772167 - protein, 4 aa, Staphylococcus epidermidis
NGGT

SEQ ID NO: 1772168 - protein, 4 aa, Staphylococcus epidermidis
NGIN

SEQ ID NO: 1772169 - protein, 10 aa, Staphylococcus epidermidis
NGKNGSGKSI

SEQ ID NO: 1772170 - protein, 4 aa, Staphylococcus epidermidis
NGKT

SEQ ID NO: 1772171 - protein, 11 aa, Staphylococcus epidermidis
NGKTKKPTFND

SEQ ID NO: 1772172 - protein, 16 aa, Staphylococcus epidermidis
NGLDGVTSSEVSLANG

SEQ ID NO: 1772173 - protein, 9 aa, Staphylococcus epidermidis
NGLDPKAVR

SEQ ID NO: 1772174 - protein, 8 aa, Staphylococcus epidermidis
NGLDPRAV

SEQ ID NO: 1772175 - protein, 7 aa, Staphylococcus epidermidis
NGLNTSN

SEQ ID NO: 1772176 - protein, 11 aa, Staphylococcus epidermidis
NGNENVNDVPQ

SEQ ID NO: 1772177 - protein, 12 aa, Staphylococcus epidermidis
NGQPIKLGESQR

SEQ ID NO: 1772178 - protein, 7 aa, Staphylococcus epidermidis
NGRYEGE

SEQ ID NO: 1772179 - protein, 7 aa, Staphylococcus epidermidis
NGSGAAG

SEQ ID NO: 1772180 - protein, 4 aa, Staphylococcus epidermidis
NGST

SEQ ID NO: 1772181 - protein, 9 aa, Staphylococcus epidermidis
NGVPTPGFS

SEQ ID NO: 1772182 - protein, 24 aa, Staphylococcus epidermidis
NHEPENVGAGKSNIPGNPIERESI

SEQ ID NO: 1772183 - protein, 6 aa, Staphylococcus epidermidis
NHFEPS

SEQ ID NO: 1772184 - protein, 5 aa, Staphylococcus epidermidis
NHKDT

SEQ ID NO: 1772185 - protein, 4 aa, Staphylococcus epidermidis
NHKT

SEQ ID NO: 1772186 - protein, 4 aa, Staphylococcus epidermidis
NHPE

SEQ ID NO: 1772187 - protein, 4 aa, Staphylococcus epidermidis
NHRG

SEQ ID NO: 1772188 - protein, 14 aa, Staphylococcus epidermidis
NHYDSGQIADKSNL

SEQ ID NO: 1772189 - protein, 45 aa, Staphylococcus epidermidis
NHYHSNDDAEVEDAEYHELDDNRQQNQSNSQDDIISSKSSTSNMY

SEQ ID NO: 1772190 - protein, 11 aa, Staphylococcus epidermidis
NIKGKTKKEMT

SEQ ID NO: 1772191 - protein, 42 aa, Staphylococcus epidermidis
NILSNTKKIETDNIDSKEDIITTKASKKNEQKQSIFSKLFKK

SEQ ID NO: 1772192 - protein, 13 aa, Staphylococcus epidermidis
NIPRSEMDQEIEN

SEQ ID NO: 1772193 - protein, 9 aa, Staphylococcus epidermidis
NIPTARDES

SEQ ID NO: 1772194 - protein, 8 aa, Staphylococcus epidermidis
NISKYTGK

SEQ ID NO: 1772195 - protein, 22 aa, Staphylococcus epidermidis
NITGKLSLKDKKAIANEGVCVL

SEQ ID NO: 1772196 - protein, 14 aa, Staphylococcus epidermidis
NKADRIKSKLMSAN

SEQ ID NO: 1772197 - protein, 22 aa, Staphylococcus epidermidis
NKAPEKIINEEKEKQQHYQEKY

SEQ ID NO: 1772198 - protein, 8 aa, Staphylococcus epidermidis
NKDGETGV

SEQ ID NO: 1772199 - protein, 4 aa, Staphylococcus epidermidis
NKEF

SEQ ID NO: 1772200 - protein, 4 aa, Staphylococcus epidermidis
NKES

SEQ ID NO: 1772201 - protein, 12 aa, Staphylococcus epidermidis
NKESTEITPSFD

SEQ ID NO: 1772202 - protein, 53 aa, Staphylococcus epidermidis
NKGDEIVNKPEPKTDEMKQREQQASGQQTPMSQQSNPFGNANGPIDISSEDLP

SEQ ID NO: 1772203 - protein, 7 aa, Staphylococcus epidermidis
NKGEKHP

SEQ ID NO: 1772204 - protein, 6 aa, Staphylococcus epidermidis
NKKISN

SEQ ID NO: 1772205 - protein, 8 aa, Staphylococcus epidermidis
NKKQLSSK

SEQ ID NO: 1772206 - protein, 12 aa, Staphylococcus epidermidis
NKKTEIANDVGT

SEQ ID NO: 1772207 - protein, 5 aa, Staphylococcus epidermidis
NKLTR

SEQ ID NO: 1772208 - protein, 4 aa, Staphylococcus epidermidis
NKPL

SEQ ID NO: 1772209 - protein, 23 aa, Staphylococcus epidermidis
NKPLDGRKNSPFSSNIEYGGRGM

SEQ ID NO: 1772210 - protein, 5 aa, Staphylococcus epidermidis
NKPNK

SEQ ID NO: 1772211 - protein, 20 aa, Staphylococcus epidermidis
NKPNNEEDTSYSRDRRRARE

SEQ ID NO: 1772212 - protein, 7 aa, Staphylococcus epidermidis
NKPNPTF

SEQ ID NO: 1772213 - protein, 12 aa, Staphylococcus epidermidis
NKQNRNEGIAES

SEQ ID NO: 1772214 - protein, 6 aa, Staphylococcus epidermidis
NKSAKD

SEQ ID NO: 1772215 - protein, 10 aa, Staphylococcus epidermidis
NKSDDSFNEH

SEQ ID NO: 1772216 - protein, 16 aa, Staphylococcus epidermidis
NKSIQSSPLKTNLEES

SEQ ID NO: 1772217 - protein, 12 aa, Staphylococcus epidermidis
NKVGNKSLIDDN

SEQ ID NO: 1772218 - protein, 17 aa, Staphylococcus epidermidis
NKYPSEISGGQQQRTAA

SEQ ID NO: 1772219 - protein, 12 aa, Staphylococcus epidermidis
NLEETKKTSDLI

SEQ ID NO: 1772220 - protein, 6 aa, Staphylococcus epidermidis
NLKGDI

SEQ ID NO: 1772221 - protein, 4 aa, Staphylococcus epidermidis
NNAL

SEQ ID NO: 1772222 - protein, 8 aa, Staphylococcus epidermidis
NNASAETE

SEQ ID NO: 1772223 - protein, 13 aa, Staphylococcus epidermidis
NNDAPLTPVTPLH

SEQ ID NO: 1772224 - protein, 6 aa, Staphylococcus epidermidis
NNDHEP

SEQ ID NO: 1772225 - protein, 11 aa, Staphylococcus epidermidis
NNEKCTKTRKQ

SEQ ID NO: 1772226 - protein, 5 aa, Staphylococcus epidermidis
NNETW

SEQ ID NO: 1772227 - protein, 4 aa, Staphylococcus epidermidis
NNGD

SEQ ID NO: 1772228 - protein, 6 aa, Staphylococcus epidermidis
NNGERT

SEQ ID NO: 1772229 - protein, 9 aa, Staphylococcus epidermidis
NNGESSKAR

SEQ ID NO: 1772230 - protein, 9 aa, Staphylococcus epidermidis
NNGQSDEQY

SEQ ID NO: 1772231 - protein, 5 aa, Staphylococcus epidermidis
NNHDN

SEQ ID NO: 1772232 - protein, 7 aa, Staphylococcus epidermidis
NNISTLS

SEQ ID NO: 1772233 - protein, 6 aa, Staphylococcus epidermidis
NNITPY

SEQ ID NO: 1772234 - protein, 5 aa, Staphylococcus epidermidis
NNKLD

SEQ ID NO: 1772235 - protein, 6 aa, Staphylococcus epidermidis
NNNIPN

SEQ ID NO: 1772236 - protein, 7 aa, Staphylococcus epidermidis
NNPDKEL

SEQ ID NO: 1772237 - protein, 10 aa, Staphylococcus epidermidis
NNPETVSTDF

SEQ ID NO: 1772238 - protein, 5 aa, Staphylococcus epidermidis
NNPNA

SEQ ID NO: 1772239 - protein, 6 aa, Staphylococcus epidermidis
NNPNAI

SEQ ID NO: 1772240 - protein, 23 aa, Staphylococcus epidermidis
NNPNDQEKEKEFKQTDKKDHSTN

SEQ ID NO: 1772241 - protein, 6 aa, Staphylococcus epidermidis
NNPNGS

SEQ ID NO: 1772242 - protein, 6 aa, Staphylococcus epidermidis
NNPQEV

SEQ ID NO: 1772243 - protein, 6 aa, Staphylococcus epidermidis
NNQEPE

SEQ ID NO: 1772244 - protein, 50 aa, Staphylococcus epidermidis
NNQGGGPHYYPNNQGIYESQPEHKKPPFPTDGDGYEYNYRQDDDNYFEQP

SEQ ID NO: 1772245 - protein, 6 aa, Staphylococcus epidermidis
NNQRLT

SEQ ID NO: 1772246 - protein, 4 aa, Staphylococcus epidermidis
NNRL

SEQ ID NO: 1772247 - protein, 11 aa, Staphylococcus epidermidis
NNTQIKTSDAG

SEQ ID NO: 1772248 - protein, 10 aa, Staphylococcus epidermidis
NNVKSLQNKA

SEQ ID NO: 1772249 - protein, 10 aa, Staphylococcus epidermidis
NNVNRTASDV

SEQ ID NO: 1772250 - protein, 16 aa, Staphylococcus epidermidis
NNVQGCSDMGSMPDQF

SEQ ID NO: 1772251 - protein, 6 aa, Staphylococcus epidermidis
NNVSNY

SEQ ID NO: 1772252 - protein, 4 aa, Staphylococcus epidermidis
NPEC

SEQ ID NO: 1772253 - protein, 9 aa, Staphylococcus epidermidis
NPFKKDDTS

SEQ ID NO: 1772254 - protein, 7 aa, Staphylococcus epidermidis
NPKTASE

SEQ ID NO: 1772255 - protein, 4 aa, Staphylococcus epidermidis
NPMS

SEQ ID NO: 1772256 - protein, 8 aa, Staphylococcus epidermidis
NPNDERYK

SEQ ID NO: 1772257 - protein, 6 aa, Staphylococcus epidermidis
NPNPID

SEQ ID NO: 1772258 - protein, 9 aa, Staphylococcus epidermidis
NPNPYQSQV

SEQ ID NO: 1772259 - protein, 9 aa, Staphylococcus epidermidis
NPPKRKQSW

SEQ ID NO: 1772260 - protein, 8 aa, Staphylococcus epidermidis
NPPNNIET

SEQ ID NO: 1772261 - protein, 13 aa, Staphylococcus epidermidis
NPRKTHNKQGEPY

SEQ ID NO: 1772262 - protein, 4 aa, Staphylococcus epidermidis
NPSR

SEQ ID NO: 1772263 - protein, 8 aa, Staphylococcus epidermidis
NPVTGEQV

SEQ ID NO: 1772264 - protein, 5 aa, Staphylococcus epidermidis
NPYVS

SEQ ID NO: 1772265 - protein, 17 aa, Staphylococcus epidermidis
NQDGSISIEDNGRGMPT

SEQ ID NO: 1772266 - protein, 15 aa, Staphylococcus epidermidis
NQDKRIGPNPLEFNG

SEQ ID NO: 1772267 - protein, 21 aa, Staphylococcus epidermidis
NQDNETLKDMTKSGKQRPWRE

SEQ ID NO: 1772268 - protein, 9 aa, Staphylococcus epidermidis
NQENQVDGA

SEQ ID NO: 1772269 - protein, 6 aa, Staphylococcus epidermidis
NQEPWT

SEQ ID NO: 1772270 - protein, 7 aa, Staphylococcus epidermidis
NQFNKKQ

SEQ ID NO: 1772271 - protein, 9 aa, Staphylococcus epidermidis
NQGKHNEVK

SEQ ID NO: 1772272 - protein, 7 aa, Staphylococcus epidermidis
NQKDQDT

SEQ ID NO: 1772273 - protein, 8 aa, Staphylococcus epidermidis
NQKGSNEI

SEQ ID NO: 1772274 - protein, 8 aa, Staphylococcus epidermidis
NQKPSYKT

SEQ ID NO: 1772275 - protein, 13 aa, Staphylococcus epidermidis
NQKRSYISEKQST

SEQ ID NO: 1772276 - protein, 15 aa, Staphylococcus epidermidis
NQLPNQISGGQKQRV

SEQ ID NO: 1772277 - protein, 8 aa, Staphylococcus epidermidis
NQLTSTPF

SEQ ID NO: 1772278 - protein, 6 aa, Staphylococcus epidermidis
NQNDID

SEQ ID NO: 1772279 - protein, 10 aa, Staphylococcus epidermidis
NQNQEETPQK

SEQ ID NO: 1772280 - protein, 10 aa, Staphylococcus epidermidis
NQPKTDEKGR

SEQ ID NO: 1772281 - protein, 17 aa, Staphylococcus epidermidis
NQPLQEFKNSKASLLTS

SEQ ID NO: 1772282 - protein, 15 aa, Staphylococcus epidermidis
NQSHSQSLSPNIKKT

SEQ ID NO: 1772283 - protein, 9 aa, Staphylococcus epidermidis
NQSSPAHSV

SEQ ID NO: 1772284 - protein, 5 aa, Staphylococcus epidermidis
NQTDF

SEQ ID NO: 1772285 - protein, 6 aa, Staphylococcus epidermidis
NQTIDD

SEQ ID NO: 1772286 - protein, 10 aa, Staphylococcus epidermidis
NQTNQLSAKK

SEQ ID NO: 1772287 - protein, 12 aa, Staphylococcus epidermidis
NQYGATPSQNHS

SEQ ID NO: 1772288 - protein, 6 aa, Staphylococcus epidermidis
NRATKN

SEQ ID NO: 1772289 - protein, 10 aa, Staphylococcus epidermidis
NRETKEKVTK

SEQ ID NO: 1772290 - protein, 6 aa, Staphylococcus epidermidis
NRFTGT

SEQ ID NO: 1772291 - protein, 5 aa, Staphylococcus epidermidis
NRKNH

SEQ ID NO: 1772292 - protein, 10 aa, Staphylococcus epidermidis
NRLETAKEIG

SEQ ID NO: 1772293 - protein, 9 aa, Staphylococcus epidermidis
NRLETAKEL

SEQ ID NO: 1772294 - protein, 6 aa, Staphylococcus epidermidis
NRNEEI

SEQ ID NO: 1772295 - protein, 5 aa, Staphylococcus epidermidis
NRNEH

SEQ ID NO: 1772296 - protein, 8 aa, Staphylococcus epidermidis
NRQNETDI

SEQ ID NO: 1772297 - protein, 8 aa, Staphylococcus epidermidis
NRSDCSEE

SEQ ID NO: 1772298 - protein, 9 aa, Staphylococcus epidermidis
NRTKGNFGG

SEQ ID NO: 1772299 - protein, 8 aa, Staphylococcus epidermidis
NRVSSDAA

SEQ ID NO: 1772300 - protein, 4 aa, Staphylococcus epidermidis
NSAK

SEQ ID NO: 1772301 - protein, 7 aa, Staphylococcus epidermidis
NSAKERI

SEQ ID NO: 1772302 - protein, 5 aa, Staphylococcus epidermidis
NSDSV

SEQ ID NO: 1772303 - protein, 5 aa, Staphylococcus epidermidis
NSERY

SEQ ID NO: 1772304 - protein, 10 aa, Staphylococcus epidermidis
NSETDKSGHT

SEQ ID NO: 1772305 - protein, 6 aa, Staphylococcus epidermidis
NSEVGA

SEQ ID NO: 1772306 - protein, 11 aa, Staphylococcus epidermidis
NSGENSGTGVA

SEQ ID NO: 1772307 - protein, 5 aa, Staphylococcus epidermidis
NSGGL

SEQ ID NO: 1772308 - protein, 7 aa, Staphylococcus epidermidis
NSGPLLP

SEQ ID NO: 1772309 - protein, 7 aa, Staphylococcus epidermidis
NSHEKID

SEQ ID NO: 1772310 - protein, 4 aa, Staphylococcus epidermidis
NSIN

SEQ ID NO: 1772311 - protein, 9 aa, Staphylococcus epidermidis
NSKDSYPEK

SEQ ID NO: 1772312 - protein, 8 aa, Staphylococcus epidermidis
NSKTNKKI

SEQ ID NO: 1772313 - protein, 10 aa, Staphylococcus epidermidis
NSNLAENKNL

SEQ ID NO: 1772314 - protein, 18 aa, Staphylococcus epidermidis
NSNRLSQTVKNDFSNATE

SEQ ID NO: 1772315 - protein, 8 aa, Staphylococcus epidermidis
NSQSLDYD

SEQ ID NO: 1772316 - protein, 14 aa, Staphylococcus epidermidis
NSSRLGNTNAARTK

SEQ ID NO: 1772317 - protein, 4 aa, Staphylococcus epidermidis
NSVN

SEQ ID NO: 1772318 - protein, 15 aa, Staphylococcus epidermidis
NSWQSNKIRTQNEQT

SEQ ID NO: 1772319 - protein, 19 aa, Staphylococcus epidermidis
NSYCNSQSYRSNQKGYKSD

SEQ ID NO: 1772320 - protein, 15 aa, Staphylococcus epidermidis
NSYNQPTLRTLLNLN

SEQ ID NO: 1772321 - protein, 6 aa, Staphylococcus epidermidis
NTAEAH

SEQ ID NO: 1772322 - protein, 6 aa, Staphylococcus epidermidis
NTDQYF

SEQ ID NO: 1772323 - protein, 8 aa, Staphylococcus epidermidis
NTDYVNTQ

SEQ ID NO: 1772324 - protein, 7 aa, Staphylococcus epidermidis
NTEISTK

SEQ ID NO: 1772325 - protein, 24 aa, Staphylococcus epidermidis
NTKEFDKGTTTEDIAQSISPGLRK

SEQ ID NO: 1772326 - protein, 4 aa, Staphylococcus epidermidis
NTRF

SEQ ID NO: 1772327 - protein, 7 aa, Staphylococcus epidermidis
NTRSTTG

SEQ ID NO: 1772328 - protein, 8 aa, Staphylococcus epidermidis
NTRTTKGD

SEQ ID NO: 1772329 - protein, 26 aa, Staphylococcus epidermidis
NTYQPTTSKTSAYTEEERQAFLQKMK

SEQ ID NO: 1772330 - protein, 11 aa, Staphylococcus epidermidis
NVDQEEVGKTA

SEQ ID NO: 1772331 - protein, 26 aa, Staphylococcus epidermidis
NVEYDKDKNTVKVDATKTLNEEAPYE

SEQ ID NO: 1772332 - protein, 13 aa, Staphylococcus epidermidis
NVGKDVSRFKKGD

SEQ ID NO: 1772333 - protein, 4 aa, Staphylococcus epidermidis
NVNT

SEQ ID NO: 1772334 - protein, 12 aa, Staphylococcus epidermidis
NVPYEQETEKVG

SEQ ID NO: 1772335 - protein, 5 aa, Staphylococcus epidermidis
NYETR

SEQ ID NO: 1772336 - protein, 7 aa, Staphylococcus epidermidis
NYNANYN

SEQ ID NO: 1772337 - protein, 10 aa, Staphylococcus epidermidis
NYQNKGVGQS

SEQ ID NO: 1772338 - protein, 12 aa, Staphylococcus epidermidis
NYYESEQRSSLG

SEQ ID NO: 1772339 - protein, 13 aa, Staphylococcus epidermidis
PADIPAVRRIIEE

SEQ ID NO: 1772340 - protein, 11 aa, Staphylococcus epidermidis
PAGEERPLPTT

SEQ ID NO: 1772341 - protein, 8 aa, Staphylococcus epidermidis
PAQQKERF

SEQ ID NO: 1772342 - protein, 9 aa, Staphylococcus epidermidis
PAQRAENYK

SEQ ID NO: 1772343 - protein, 7 aa, Staphylococcus epidermidis
PATSTNR

SEQ ID NO: 1772344 - protein, 13 aa, Staphylococcus epidermidis
PDDETFSSAGTLA

SEQ ID NO: 1772345 - protein, 4 aa, Staphylococcus epidermidis
PDFP

SEQ ID NO: 1772346 - protein, 4 aa, Staphylococcus epidermidis
PDGK

SEQ ID NO: 1772347 - protein, 5 aa, Staphylococcus epidermidis
PEADI

SEQ ID NO: 1772348 - protein, 5 aa, Staphylococcus epidermidis
PEEIR

SEQ ID NO: 1772349 - protein, 4 aa, Staphylococcus epidermidis
PEEN

SEQ ID NO: 1772350 - protein, 4 aa, Staphylococcus epidermidis
PEGE

SEQ ID NO: 1772351 - protein, 13 aa, Staphylococcus epidermidis
PEGVEKMQEAHPD

SEQ ID NO: 1772352 - protein, 4 aa, Staphylococcus epidermidis
PEIK

SEQ ID NO: 1772353 - protein, 4 aa, Staphylococcus epidermidis
PEQY

SEQ ID NO: 1772354 - protein, 8 aa, Staphylococcus epidermidis
PESPDSTT

SEQ ID NO: 1772355 - protein, 7 aa, Staphylococcus epidermidis
PETSGIG

SEQ ID NO: 1772356 - protein, 11 aa, Staphylococcus epidermidis
PGAGGTESQDW

SEQ ID NO: 1772357 - protein, 5 aa, Staphylococcus epidermidis
PGFGG

SEQ ID NO: 1772358 - protein, 8 aa, Staphylococcus epidermidis
PGGPGTLE

SEQ ID NO: 1772359 - protein, 13 aa, Staphylococcus epidermidis
PGKQTSEETTVKA

SEQ ID NO: 1772360 - protein, 15 aa, Staphylococcus epidermidis
PGMKGAEATVKGAYK

SEQ ID NO: 1772361 - protein, 9 aa, Staphylococcus epidermidis
PGRDDGKML

SEQ ID NO: 1772362 - protein, 15 aa, Staphylococcus epidermidis
PGSHGSTFGGNPLAS

SEQ ID NO: 1772363 - protein, 4 aa, Staphylococcus epidermidis
PGTE

SEQ ID NO: 1772364 - protein, 11 aa, Staphylococcus epidermidis
PGTGETVGTQL

SEQ ID NO: 1772365 - protein, 19 aa, Staphylococcus epidermidis
PHSNRRQDSWGGSREKRTR

SEQ ID NO: 1772366 - protein, 4 aa, Staphylococcus epidermidis
PIGS

SEQ ID NO: 1772367 - protein, 5 aa, Staphylococcus epidermidis
PIKRR

SEQ ID NO: 1772368 - protein, 5 aa, Staphylococcus epidermidis
PINES

SEQ ID NO: 1772369 - protein, 6 aa, Staphylococcus epidermidis
PITPGT

SEQ ID NO: 1772370 - protein, 10 aa, Staphylococcus epidermidis
PKATEDINGE

SEQ ID NO: 1772371 - protein, 18 aa, Staphylococcus epidermidis
PKCKTKKNIQRKTNARCP

SEQ ID NO: 1772372 - protein, 11 aa, Staphylococcus epidermidis
PKDPKNGDYSS

SEQ ID NO: 1772373 - protein, 5 aa, Staphylococcus epidermidis
PKEQS

SEQ ID NO: 1772374 - protein, 25 aa, Staphylococcus epidermidis
PKEQTTLEDYEEDSKVSELESKINE

SEQ ID NO: 1772375 - protein, 6 aa, Staphylococcus epidermidis
PKETYG

SEQ ID NO: 1772376 - protein, 9 aa, Staphylococcus epidermidis
PKHANDETM

SEQ ID NO: 1772377 - protein, 14 aa, Staphylococcus epidermidis
PKKTTRIGKPYYKT

SEQ ID NO: 1772378 - protein, 4 aa, Staphylococcus epidermidis
PKQQ

SEQ ID NO: 1772379 - protein, 15 aa, Staphylococcus epidermidis
PLKGEIEVPGDKSMT

SEQ ID NO: 1772380 - protein, 4 aa, Staphylococcus epidermidis
PLKY

SEQ ID NO: 1772381 - protein, 4 aa, Staphylococcus epidermidis
PLPE

SEQ ID NO: 1772382 - protein, 8 aa, Staphylococcus epidermidis
PLPSSVHR

SEQ ID NO: 1772383 - protein, 14 aa, Staphylococcus epidermidis
PMPNARQTKEEVDV

SEQ ID NO: 1772384 - protein, 19 aa, Staphylococcus epidermidis
PNDGGLSQIGPTSRVTGRM

SEQ ID NO: 1772385 - protein, 21 aa, Staphylococcus epidermidis
PNIKNTDHNPNAEAHRHASDW

SEQ ID NO: 1772386 - protein, 6 aa, Staphylococcus epidermidis
PNNIET

SEQ ID NO: 1772387 - protein, 15 aa, Staphylococcus epidermidis
PNNPTGYTPNKEEVN

SEQ ID NO: 1772388 - protein, 15 aa, Staphylococcus epidermidis
PNTEPIRGGTDGSQL

SEQ ID NO: 1772389 - protein, 4 aa, Staphylococcus epidermidis
PPEN

SEQ ID NO: 1772390 - protein, 18 aa, Staphylococcus epidermidis
PPREYSISSSYKATPDEV

SEQ ID NO: 1772391 - protein, 6 aa, Staphylococcus epidermidis
PPSVSE

SEQ ID NO: 1772392 - protein, 7 aa, Staphylococcus epidermidis
PPYPGTM

SEQ ID NO: 1772393 - protein, 6 aa, Staphylococcus epidermidis
PQAISN

SEQ ID NO: 1772394 - protein, 4 aa, Staphylococcus epidermidis
PQNI

SEQ ID NO: 1772395 - protein, 5 aa, Staphylococcus epidermidis
PQYGN

SEQ ID NO: 1772396 - protein, 12 aa, Staphylococcus epidermidis
PRKTHNKQGEPY

SEQ ID NO: 1772397 - protein, 8 aa, Staphylococcus epidermidis
PRLQTKEE

SEQ ID NO: 1772398 - protein, 4 aa, Staphylococcus epidermidis
PRVI

SEQ ID NO: 1772399 - protein, 6 aa, Staphylococcus epidermidis
PRYSDN

SEQ ID NO: 1772400 - protein, 9 aa, Staphylococcus epidermidis
PSAAAPTVE

SEQ ID NO: 1772401 - protein, 5 aa, Staphylococcus epidermidis
PSPQP

SEQ ID NO: 1772402 - protein, 4 aa, Staphylococcus epidermidis
PSSR

SEQ ID NO: 1772403 - protein, 17 aa, Staphylococcus epidermidis
PSTYPPLSYSFDHLIIK

SEQ ID NO: 1772404 - protein, 24 aa, Staphylococcus epidermidis
PTDEDDADAKQKQEKYNKVSSQTV

SEQ ID NO: 1772405 - protein, 11 aa, Staphylococcus epidermidis
PTENTDQAKAK

SEQ ID NO: 1772406 - protein, 7 aa, Staphylococcus epidermidis
PTESVED

SEQ ID NO: 1772407 - protein, 10 aa, Staphylococcus epidermidis
PTESYQDRAN

SEQ ID NO: 1772408 - protein, 7 aa, Staphylococcus epidermidis
PTFHDPA

SEQ ID NO: 1772409 - protein, 6 aa, Staphylococcus epidermidis
PTGVPR

SEQ ID NO: 1772410 - protein, 7 aa, Staphylococcus epidermidis
PTINSDF

SEQ ID NO: 1772411 - protein, 14 aa, Staphylococcus epidermidis
PTKQIKDEKLKKEI

SEQ ID NO: 1772412 - protein, 9 aa, Staphylococcus epidermidis
PTQELREQG

SEQ ID NO: 1772413 - protein, 14 aa, Staphylococcus epidermidis
PTQKINDNKLKNEI

SEQ ID NO: 1772414 - protein, 9 aa, Staphylococcus epidermidis
PTYDKTQAK

SEQ ID NO: 1772415 - protein, 11 aa, Staphylococcus epidermidis
PVEAEKDDTDL

SEQ ID NO: 1772416 - protein, 11 aa, Staphylococcus epidermidis
PVGSGDSTVAG

SEQ ID NO: 1772417 - protein, 16 aa, Staphylococcus epidermidis
PVYQKGEAHLTNPQVK

SEQ ID NO: 1772418 - protein, 11 aa, Staphylococcus epidermidis
PYMEASQKNQF

SEQ ID NO: 1772419 - protein, 10 aa, Staphylococcus epidermidis
QAEAKHKNLS

SEQ ID NO: 1772420 - protein, 10 aa, Staphylococcus epidermidis
QANHNGASLT

SEQ ID NO: 1772421 - protein, 7 aa, Staphylococcus epidermidis
QAPATKG

SEQ ID NO: 1772422 - protein, 7 aa, Staphylococcus epidermidis
QARNEIE

SEQ ID NO: 1772423 - protein, 21 aa, Staphylococcus epidermidis
QARSYKKKLSDAISKTHHPDR

SEQ ID NO: 1772424 - protein, 12 aa, Staphylococcus epidermidis
QASQSYTAQESS

SEQ ID NO: 1772425 - protein, 5 aa, Staphylococcus epidermidis
QCGSG

SEQ ID NO: 1772426 - protein, 8 aa, Staphylococcus epidermidis
QDAGVKVP

SEQ ID NO: 1772427 - protein, 7 aa, Staphylococcus epidermidis
QDAHEVE

SEQ ID NO: 1772428 - protein, 4 aa, Staphylococcus epidermidis
QDDL

SEQ ID NO: 1772429 - protein, 5 aa, Staphylococcus epidermidis
QDDVS

SEQ ID NO: 1772430 - protein, 6 aa, Staphylococcus epidermidis
QDEVPE

SEQ ID NO: 1772431 - protein, 6 aa, Staphylococcus epidermidis
QDINQT

SEQ ID NO: 1772432 - protein, 13 aa, Staphylococcus epidermidis
QDKDNKDVTRNDM

SEQ ID NO: 1772433 - protein, 8 aa, Staphylococcus epidermidis
QDNEEFEE

SEQ ID NO: 1772434 - protein, 4 aa, Staphylococcus epidermidis
QDQI

SEQ ID NO: 1772435 - protein, 13 aa, Staphylococcus epidermidis
QDRFQDKEGNNRS

SEQ ID NO: 1772436 - protein, 5 aa, Staphylococcus epidermidis
QDTYS

SEQ ID NO: 1772437 - protein, 6 aa, Staphylococcus epidermidis
QEEHDK

SEQ ID NO: 1772438 - protein, 6 aa, Staphylococcus epidermidis
QEENTV

SEQ ID NO: 1772439 - protein, 18 aa, Staphylococcus epidermidis
QEGKFKPDEKYKSGQRNI

SEQ ID NO: 1772440 - protein, 5 aa, Staphylococcus epidermidis
QEIEN

SEQ ID NO: 1772441 - protein, 6 aa, Staphylococcus epidermidis
QEISTN

SEQ ID NO: 1772442 - protein, 5 aa, Staphylococcus epidermidis
QEKVQ

SEQ ID NO: 1772443 - protein, 4 aa, Staphylococcus epidermidis
QEKY

SEQ ID NO: 1772444 - protein, 13 aa, Staphylococcus epidermidis
QELKTQKNEKAKD

SEQ ID NO: 1772445 - protein, 13 aa, Staphylococcus epidermidis
QELNKMSEKDPKL

SEQ ID NO: 1772446 - protein, 18 aa, Staphylococcus epidermidis
QENDIEQRNNTDVSNSYV

SEQ ID NO: 1772447 - protein, 10 aa, Staphylococcus epidermidis
QENEEYRGMG

SEQ ID NO: 1772448 - protein, 11 aa, Staphylococcus epidermidis
QENPPSRCPNC

SEQ ID NO: 1772449 - protein, 17 aa, Staphylococcus epidermidis
QENSTAYHRKHETQHRN

SEQ ID NO: 1772450 - protein, 7 aa, Staphylococcus epidermidis
QEQSLNL

SEQ ID NO: 1772451 - protein, 4 aa, Staphylococcus epidermidis
QERI

SEQ ID NO: 1772452 - protein, 14 aa, Staphylococcus epidermidis
QESNLEDNKSHMND

SEQ ID NO: 1772453 - protein, 7 aa, Staphylococcus epidermidis
QEVEHQE

SEQ ID NO: 1772454 - protein, 4 aa, Staphylococcus epidermidis
QEVT

SEQ ID NO: 1772455 - protein, 5 aa, Staphylococcus epidermidis
QGDVS

SEQ ID NO: 1772456 - protein, 8 aa, Staphylococcus epidermidis
QGEKYYQN

SEQ ID NO: 1772457 - protein, 12 aa, Staphylococcus epidermidis
QGETAKGVGIRN

SEQ ID NO: 1772458 - protein, 10 aa, Staphylococcus epidermidis
QGIPDETKLG

SEQ ID NO: 1772459 - protein, 4 aa, Staphylococcus epidermidis
QGKV

SEQ ID NO: 1772460 - protein, 15 aa, Staphylococcus epidermidis
QGLNTTYDTAEKVKH

SEQ ID NO: 1772461 - protein, 5 aa, Staphylococcus epidermidis
QGLRA

SEQ ID NO: 1772462 - protein, 8 aa, Staphylococcus epidermidis
QGNYEGQA

SEQ ID NO: 1772463 - protein, 9 aa, Staphylococcus epidermidis
QGQIKGAAL

SEQ ID NO: 1772464 - protein, 14 aa, Staphylococcus epidermidis
QGQMTSTTNTLSGY

SEQ ID NO: 1772465 - protein, 5 aa, Staphylococcus epidermidis
QGYRS

SEQ ID NO: 1772466 - protein, 5 aa, Staphylococcus epidermidis
QHHDT

SEQ ID NO: 1772467 - protein, 4 aa, Staphylococcus epidermidis
QHTQ

SEQ ID NO: 1772468 - protein, 7 aa, Staphylococcus epidermidis
QHVAGTS

SEQ ID NO: 1772469 - protein, 8 aa, Staphylococcus epidermidis
QHVAGTSF

SEQ ID NO: 1772470 - protein, 15 aa, Staphylococcus epidermidis
QHVQKKKYDTIHTGD

SEQ ID NO: 1772471 - protein, 6 aa, Staphylococcus epidermidis
QILEPS

SEQ ID NO: 1772472 - protein, 8 aa, Staphylococcus epidermidis
QIPDDNQK

SEQ ID NO: 1772473 - protein, 4 aa, Staphylococcus epidermidis
QITY

SEQ ID NO: 1772474 - protein, 11 aa, Staphylococcus epidermidis
QKATANIGLEP

SEQ ID NO: 1772475 - protein, 7 aa, Staphylococcus epidermidis
QKDEDVV

SEQ ID NO: 1772476 - protein, 5 aa, Staphylococcus epidermidis
QKEDK

SEQ ID NO: 1772477 - protein, 13 aa, Staphylococcus epidermidis
QKFDPDLKNKILT

SEQ ID NO: 1772478 - protein, 9 aa, Staphylococcus epidermidis
QKITYTDNN

SEQ ID NO: 1772479 - protein, 4 aa, Staphylococcus epidermidis
QKKH

SEQ ID NO: 1772480 - protein, 11 aa, Staphylococcus epidermidis
QKNNDPTLNEE

SEQ ID NO: 1772481 - protein, 8 aa, Staphylococcus epidermidis
QKNQEDAH

SEQ ID NO: 1772482 - protein, 5 aa, Staphylococcus epidermidis
QKRGY

SEQ ID NO: 1772483 - protein, 15 aa, Staphylococcus epidermidis
QKRNNFKGERKEVRE

SEQ ID NO: 1772484 - protein, 7 aa, Staphylococcus epidermidis
QKVNNNV

SEQ ID NO: 1772485 - protein, 10 aa, Staphylococcus epidermidis
QKYDNDTSRN

SEQ ID NO: 1772486 - protein, 5 aa, Staphylococcus epidermidis
QLKEG

SEQ ID NO: 1772487 - protein, 42 aa, Staphylococcus epidermidis
QLKKPRDPEEEERLRKRNEERKRRKEEQDRKLKEKLKKRKAE

SEQ ID NO: 1772488 - protein, 8 aa, Staphylococcus epidermidis
QLKQDSAD

SEQ ID NO: 1772489 - protein, 12 aa, Staphylococcus epidermidis
QLSDSERQKLEV

SEQ ID NO: 1772490 - protein, 4 aa, Staphylococcus epidermidis
QLYD

SEQ ID NO: 1772491 - protein, 5 aa, Staphylococcus epidermidis
QMKPG

SEQ ID NO: 1772492 - protein, 6 aa, Staphylococcus epidermidis
QMSGKD

SEQ ID NO: 1772493 - protein, 9 aa, Staphylococcus epidermidis
QNDAPVLNG

SEQ ID NO: 1772494 - protein, 19 aa, Staphylococcus epidermidis
QNDGKDDIKITRSSKLRET

SEQ ID NO: 1772495 - protein, 15 aa, Staphylococcus epidermidis
QNEAVKLKQKYGLSV

SEQ ID NO: 1772496 - protein, 21 aa, Staphylococcus epidermidis
QNITQTNKAYQSSKKSMQKVE

SEQ ID NO: 1772497 - protein, 7 aa, Staphylococcus epidermidis
QNKEKGF

SEQ ID NO: 1772498 - protein, 7 aa, Staphylococcus epidermidis
QNPTDTR

SEQ ID NO: 1772499 - protein, 18 aa, Staphylococcus epidermidis
QNSIQQQQIGELKPKADY

SEQ ID NO: 1772500 - protein, 11 aa, Staphylococcus epidermidis
QNTKKKTQKAV

SEQ ID NO: 1772501 - protein, 5 aa, Staphylococcus epidermidis
QNTYQ

SEQ ID NO: 1772502 - protein, 8 aa, Staphylococcus epidermidis
QPEDNLDN

SEQ ID NO: 1772503 - protein, 12 aa, Staphylococcus epidermidis
QPGVGKTLSSRY

SEQ ID NO: 1772504 - protein, 11 aa, Staphylococcus epidermidis
QPSHDSPANKI

SEQ ID NO: 1772505 - protein, 6 aa, Staphylococcus epidermidis
QPYSEY

SEQ ID NO: 1772506 - protein, 12 aa, Staphylococcus epidermidis
QQDIGSDSSTAI

SEQ ID NO: 1772507 - protein, 4 aa, Staphylococcus epidermidis
QQEA

SEQ ID NO: 1772508 - protein, 34 aa, Staphylococcus epidermidis
QQEDEQSAREATEKLEKMKAEKAKQQDNNESTVE

SEQ ID NO: 1772509 - protein, 16 aa, Staphylococcus epidermidis
QQGVKGMNDEEPSQKE

SEQ ID NO: 1772510 - protein, 7 aa, Staphylococcus epidermidis
QQHGRIE

SEQ ID NO: 1772511 - protein, 6 aa, Staphylococcus epidermidis
QQLKEG

SEQ ID NO: 1772512 - protein, 11 aa, Staphylococcus epidermidis
QQQFKEQPKDQ

SEQ ID NO: 1772513 - protein, 8 aa, Staphylococcus epidermidis
QQSAYESS

SEQ ID NO: 1772514 - protein, 14 aa, Staphylococcus epidermidis
QRETRRGKKLEHND

SEQ ID NO: 1772515 - protein, 7 aa, Staphylococcus epidermidis
QRGDANM

SEQ ID NO: 1772516 - protein, 7 aa, Staphylococcus epidermidis
QRHDTEI

SEQ ID NO: 1772517 - protein, 8 aa, Staphylococcus epidermidis
QRSAGFDG

SEQ ID NO: 1772518 - protein, 15 aa, Staphylococcus epidermidis
QRSNEGWQGWPEEGK

SEQ ID NO: 1772519 - protein, 8 aa, Staphylococcus epidermidis
QRVQEAAK

SEQ ID NO: 1772520 - protein, 9 aa, Staphylococcus epidermidis
QSAKPVGKA

SEQ ID NO: 1772521 - protein, 5 aa, Staphylococcus epidermidis
QSATH

SEQ ID NO: 1772522 - protein, 16 aa, Staphylococcus epidermidis
QSAVNRSKHYLANKRE

SEQ ID NO: 1772523 - protein, 8 aa, Staphylococcus epidermidis
QSELDERQ

SEQ ID NO: 1772524 - protein, 7 aa, Staphylococcus epidermidis
QSGITNT

SEQ ID NO: 1772525 - protein, 11 aa, Staphylococcus epidermidis
QSKDMGPVGET

SEQ ID NO: 1772526 - protein, 8 aa, Staphylococcus epidermidis
QSLPVETK

SEQ ID NO: 1772527 - protein, 7 aa, Staphylococcus epidermidis
QSNYDNK

SEQ ID NO: 1772528 - protein, 6 aa, Staphylococcus epidermidis
QSPYNV

SEQ ID NO: 1772529 - protein, 4 aa, Staphylococcus epidermidis
QSQY

SEQ ID NO: 1772530 - protein, 18 aa, Staphylococcus epidermidis
QSSTLSTVAKENLEEARE

SEQ ID NO: 1772531 - protein, 5 aa, Staphylococcus epidermidis
QSYDR

SEQ ID NO: 1772532 - protein, 8 aa, Staphylococcus epidermidis
QTDNTDTV

SEQ ID NO: 1772533 - protein, 10 aa, Staphylococcus epidermidis
QTDVPESSDW

SEQ ID NO: 1772534 - protein, 6 aa, Staphylococcus epidermidis
QTEELP

SEQ ID NO: 1772535 - protein, 7 aa, Staphylococcus epidermidis
QTEETLD

SEQ ID NO: 1772536 - protein, 6 aa, Staphylococcus epidermidis
QTEGLP

SEQ ID NO: 1772537 - protein, 6 aa, Staphylococcus epidermidis
QTEGLS

SEQ ID NO: 1772538 - protein, 4 aa, Staphylococcus epidermidis
QTEL

SEQ ID NO: 1772539 - protein, 12 aa, Staphylococcus epidermidis
QTFKTNYNTDNF

SEQ ID NO: 1772540 - protein, 12 aa, Staphylococcus epidermidis
QTFNSHEDLDEE

SEQ ID NO: 1772541 - protein, 7 aa, Staphylococcus epidermidis
QTGFQKP

SEQ ID NO: 1772542 - protein, 6 aa, Staphylococcus epidermidis
QTGMAK

SEQ ID NO: 1772543 - protein, 10 aa, Staphylococcus epidermidis
QTGQEDSKFG

SEQ ID NO: 1772544 - protein, 8 aa, Staphylococcus epidermidis
QTGQEEDH

SEQ ID NO: 1772545 - protein, 8 aa, Staphylococcus epidermidis
QTHGIPTG

SEQ ID NO: 1772546 - protein, 16 aa, Staphylococcus epidermidis
QTLKGEVEISGAKNSA

SEQ ID NO: 1772547 - protein, 6 aa, Staphylococcus epidermidis
QTLRDE

SEQ ID NO: 1772548 - protein, 7 aa, Staphylococcus epidermidis
QTPVAET

SEQ ID NO: 1772549 - protein, 6 aa, Staphylococcus epidermidis
QTYDSI

SEQ ID NO: 1772550 - protein, 6 aa, Staphylococcus epidermidis
QVDPEK

SEQ ID NO: 1772551 - protein, 4 aa, Staphylococcus epidermidis
QVEL

SEQ ID NO: 1772552 - protein, 9 aa, Staphylococcus epidermidis
QVSDQAKHD

SEQ ID NO: 1772553 - protein, 12 aa, Staphylococcus epidermidis
QVTQQPTQPINH

SEQ ID NO: 1772554 - protein, 12 aa, Staphylococcus epidermidis
QYSDLSNQFKNS

SEQ ID NO: 1772555 - protein, 11 aa, Staphylococcus epidermidis
QYSRTDNQQTV

SEQ ID NO: 1772556 - protein, 8 aa, Staphylococcus epidermidis
RAGDGYPA

SEQ ID NO: 1772557 - protein, 7 aa, Staphylococcus epidermidis
RALTSRE

SEQ ID NO: 1772558 - protein, 13 aa, Staphylococcus epidermidis
RANRKNGKEDLDK

SEQ ID NO: 1772559 - protein, 7 aa, Staphylococcus epidermidis
RATSRRE

SEQ ID NO: 1772560 - protein, 7 aa, Staphylococcus epidermidis
RDDNEFI

SEQ ID NO: 1772561 - protein, 9 aa, Staphylococcus epidermidis
RDHKGAEVK

SEQ ID NO: 1772562 - protein, 7 aa, Staphylococcus epidermidis
RDITDDI

SEQ ID NO: 1772563 - protein, 5 aa, Staphylococcus epidermidis
RDKEI

SEQ ID NO: 1772564 - protein, 4 aa, Staphylococcus epidermidis
RDMP

SEQ ID NO: 1772565 - protein, 6 aa, Staphylococcus epidermidis
RDNGKK

SEQ ID NO: 1772566 - protein, 7 aa, Staphylococcus epidermidis
RDRTEVI

SEQ ID NO: 1772567 - protein, 6 aa, Staphylococcus epidermidis
RDSQKG

SEQ ID NO: 1772568 - protein, 10 aa, Staphylococcus epidermidis
RDTRASAPKN

SEQ ID NO: 1772569 - protein, 13 aa, Staphylococcus epidermidis
RDVNGDYDETKPD

SEQ ID NO: 1772570 - protein, 4 aa, Staphylococcus epidermidis
RDYN

SEQ ID NO: 1772571 - protein, 11 aa, Staphylococcus epidermidis
RDYNENNHALS

SEQ ID NO: 1772572 - protein, 5 aa, Staphylococcus epidermidis
REDSD

SEQ ID NO: 1772573 - protein, 29 aa, Staphylococcus epidermidis
REEEFSPLKNKEGKDSVHTATEDLKRMGL

SEQ ID NO: 1772574 - protein, 4 aa, Staphylococcus epidermidis
REEI

SEQ ID NO: 1772575 - protein, 8 aa, Staphylococcus epidermidis
REEPTYEV

SEQ ID NO: 1772576 - protein, 11 aa, Staphylococcus epidermidis
REGQEDKDAIN

SEQ ID NO: 1772577 - protein, 13 aa, Staphylococcus epidermidis
REGQKRHKAKIKE

SEQ ID NO: 1772578 - protein, 4 aa, Staphylococcus epidermidis
REIT

SEQ ID NO: 1772579 - protein, 7 aa, Staphylococcus epidermidis
REKTPKW

SEQ ID NO: 1772580 - protein, 12 aa, Staphylococcus epidermidis
RENQVIETVKIE

SEQ ID NO: 1772581 - protein, 4 aa, Staphylococcus epidermidis
RFKD

SEQ ID NO: 1772582 - protein, 5 aa, Staphylococcus epidermidis
RFSDY

SEQ ID NO: 1772583 - protein, 15 aa, Staphylococcus epidermidis
RFSGYGKLAPKSKAD

SEQ ID NO: 1772584 - protein, 9 aa, Staphylococcus epidermidis
RGAADMKSG

SEQ ID NO: 1772585 - protein, 6 aa, Staphylococcus epidermidis
RGGLGE

SEQ ID NO: 1772586 - protein, 7 aa, Staphylococcus epidermidis
RGNMDAN

SEQ ID NO: 1772587 - protein, 11 aa, Staphylococcus epidermidis
RGNVDKNMQNI

SEQ ID NO: 1772588 - protein, 8 aa, Staphylococcus epidermidis
RGSGHRTA

SEQ ID NO: 1772589 - protein, 4 aa, Staphylococcus epidermidis
RGTY

SEQ ID NO: 1772590 - protein, 5 aa, Staphylococcus epidermidis
RGYPT

SEQ ID NO: 1772591 - protein, 6 aa, Staphylococcus epidermidis
RGYTKS

SEQ ID NO: 1772592 - protein, 7 aa, Staphylococcus epidermidis
RHAPPVV

SEQ ID NO: 1772593 - protein, 12 aa, Staphylococcus epidermidis
RHERYKKADEFA

SEQ ID NO: 1772594 - protein, 9 aa, Staphylococcus epidermidis
RIENADDNF

SEQ ID NO: 1772595 - protein, 9 aa, Staphylococcus epidermidis
RIKSQKQVY

SEQ ID NO: 1772596 - protein, 4 aa, Staphylococcus epidermidis
RINA

SEQ ID NO: 1772597 - protein, 5 aa, Staphylococcus epidermidis
RIPEN

SEQ ID NO: 1772598 - protein, 21 aa, Staphylococcus epidermidis
RIPSYSQSDHSSKENISKTMN

SEQ ID NO: 1772599 - protein, 15 aa, Staphylococcus epidermidis
RKAAQSLEVDERTLE

SEQ ID NO: 1772600 - protein, 12 aa, Staphylococcus epidermidis
RKGGYIADTPGF

SEQ ID NO: 1772601 - protein, 33 aa, Staphylococcus epidermidis
RKNKNRRQSQQTKQNNQDSLLPQNNDIYSRPRG

SEQ ID NO: 1772602 - protein, 29 aa, Staphylococcus epidermidis
RKNQNKNDDFEGEKKEEAEPNNDNLVKDE

SEQ ID NO: 1772603 - protein, 7 aa, Staphylococcus epidermidis
RKPPEMK

SEQ ID NO: 1772604 - protein, 19 aa, Staphylococcus epidermidis
RKQNKEANQLAQQTLYKLT

SEQ ID NO: 1772605 - protein, 5 aa, Staphylococcus epidermidis
RLGPY

SEQ ID NO: 1772606 - protein, 11 aa, Staphylococcus epidermidis
RLSDTQNTFDE

SEQ ID NO: 1772607 - protein, 6 aa, Staphylococcus epidermidis
RLSYEA

SEQ ID NO: 1772608 - protein, 7 aa, Staphylococcus epidermidis
RLSYEAG

SEQ ID NO: 1772609 - protein, 4 aa, Staphylococcus epidermidis
RLTK

SEQ ID NO: 1772610 - protein, 12 aa, Staphylococcus epidermidis
RMGRKSHQLTEE

SEQ ID NO: 1772611 - protein, 8 aa, Staphylococcus epidermidis
RNASVGDS

SEQ ID NO: 1772612 - protein, 14 aa, Staphylococcus epidermidis
RNFTKGQFTDDTAQ

SEQ ID NO: 1772613 - protein, 10 aa, Staphylococcus epidermidis
RNGATDDDLK

SEQ ID NO: 1772614 - protein, 9 aa, Staphylococcus epidermidis
RNKDGITAK

SEQ ID NO: 1772615 - protein, 5 aa, Staphylococcus epidermidis
RNPGY

SEQ ID NO: 1772616 - protein, 6 aa, Staphylococcus epidermidis
RNREDN

SEQ ID NO: 1772617 - protein, 8 aa, Staphylococcus epidermidis
RNSRTKYK

SEQ ID NO: 1772618 - protein, 9 aa, Staphylococcus epidermidis
RNTKESGYR

SEQ ID NO: 1772619 - protein, 4 aa, Staphylococcus epidermidis
RPEA

SEQ ID NO: 1772620 - protein, 5 aa, Staphylococcus epidermidis
RPELS

SEQ ID NO: 1772621 - protein, 10 aa, Staphylococcus epidermidis
RPGSNLGSEV

SEQ ID NO: 1772622 - protein, 6 aa, Staphylococcus epidermidis
RPKHDA

SEQ ID NO: 1772623 - protein, 11 aa, Staphylococcus epidermidis
RQGWTSPRNGI

SEQ ID NO: 1772624 - protein, 7 aa, Staphylococcus epidermidis
RQLTDSK

SEQ ID NO: 1772625 - protein, 6 aa, Staphylococcus epidermidis
RQRKRA

SEQ ID NO: 1772626 - protein, 12 aa, Staphylococcus epidermidis
RRDHLPITSLFN

SEQ ID NO: 1772627 - protein, 6 aa, Staphylococcus epidermidis
RREDED

SEQ ID NO: 1772628 - protein, 4 aa, Staphylococcus epidermidis
RRGE

SEQ ID NO: 1772629 - protein, 16 aa, Staphylococcus epidermidis
RRPDVYKRTKPEKQTV

SEQ ID NO: 1772630 - protein, 4 aa, Staphylococcus epidermidis
RRQN

SEQ ID NO: 1772631 - protein, 8 aa, Staphylococcus epidermidis
RSETPTEM

SEQ ID NO: 1772632 - protein, 16 aa, Staphylococcus epidermidis
RSFTQTAAKELADKGI

SEQ ID NO: 1772633 - protein, 10 aa, Staphylococcus epidermidis
RSGMGGFKGR

SEQ ID NO: 1772634 - protein, 5 aa, Staphylococcus epidermidis
RSPAN

SEQ ID NO: 1772635 - protein, 10 aa, Staphylococcus epidermidis
RSSARETAAR

SEQ ID NO: 1772636 - protein, 11 aa, Staphylococcus epidermidis
RTPKSSTPYSQ

SEQ ID NO: 1772637 - protein, 9 aa, Staphylococcus epidermidis
RTTEKRHKQ

SEQ ID NO: 1772638 - protein, 10 aa, Staphylococcus epidermidis
RVAPSVAKNV

SEQ ID NO: 1772639 - protein, 10 aa, Staphylococcus epidermidis
RVDKGDHKLE

SEQ ID NO: 1772640 - protein, 8 aa, Staphylococcus epidermidis
RVKSPGNY

SEQ ID NO: 1772641 - protein, 16 aa, Staphylococcus epidermidis
RVPGDKGQEALKESVK

SEQ ID NO: 1772642 - protein, 6 aa, Staphylococcus epidermidis
RYDKLK

SEQ ID NO: 1772643 - protein, 10 aa, Staphylococcus epidermidis
RYLNPQDYPV

SEQ ID NO: 1772644 - protein, 8 aa, Staphylococcus epidermidis
RYQEPSDV

SEQ ID NO: 1772645 - protein, 11 aa, Staphylococcus epidermidis
SADEPGNSMNE

SEQ ID NO: 1772646 - protein, 10 aa, Staphylococcus epidermidis
SADNHQFTGD

SEQ ID NO: 1772647 - protein, 63 aa, Staphylococcus epidermidis
SAEDTDDDQEKTDEDSSDKKSKKDKVDEDNSNASSSSKNEKSNADSKNDSDDSTNETSGSERN

SEQ ID NO: 1772648 - protein, 20 aa, Staphylococcus epidermidis
SAGIQNETDKVERAQVDAAR

SEQ ID NO: 1772649 - protein, 11 aa, Staphylococcus epidermidis
SAKMGPASDPM

SEQ ID NO: 1772650 - protein, 9 aa, Staphylococcus epidermidis
SAKPVGKAL

SEQ ID NO: 1772651 - protein, 14 aa, Staphylococcus epidermidis
SAPNEKTKTFKGTV

SEQ ID NO: 1772652 - protein, 18 aa, Staphylococcus epidermidis
SAPSMVKEEEKESTKNGI

SEQ ID NO: 1772653 - protein, 8 aa, Staphylococcus epidermidis
SASPHNDL

SEQ ID NO: 1772654 - protein, 12 aa, Staphylococcus epidermidis
SASQSGDSAELA

SEQ ID NO: 1772655 - protein, 19 aa, Staphylococcus epidermidis
SASYRSDEALYSERTDEKI

SEQ ID NO: 1772656 - protein, 8 aa, Staphylococcus epidermidis
SCKTQSET

SEQ ID NO: 1772657 - protein, 7 aa, Staphylococcus epidermidis
SCRSQMA

SEQ ID NO: 1772658 - protein, 11 aa, Staphylococcus epidermidis
SDAKARDEKRH

SEQ ID NO: 1772659 - protein, 7 aa, Staphylococcus epidermidis
SDEPKQF

SEQ ID NO: 1772660 - protein, 7 aa, Staphylococcus epidermidis
SDEVAET

SEQ ID NO: 1772661 - protein, 9 aa, Staphylococcus epidermidis
SDGCEQTNT

SEQ ID NO: 1772662 - protein, 8 aa, Staphylococcus epidermidis
SDGGNRLQ

SEQ ID NO: 1772663 - protein, 8 aa, Staphylococcus epidermidis
SDKEEQAI

SEQ ID NO: 1772664 - protein, 8 aa, Staphylococcus epidermidis
SDKEGQAI

SEQ ID NO: 1772665 - protein, 7 aa, Staphylococcus epidermidis
SDKIEEN

SEQ ID NO: 1772666 - protein, 4 aa, Staphylococcus epidermidis
SDLP

SEQ ID NO: 1772667 - protein, 11 aa, Staphylococcus epidermidis
SDRAKKRFADV

SEQ ID NO: 1772668 - protein, 12 aa, Staphylococcus epidermidis
SDVSKKKEQEEL

SEQ ID NO: 1772669 - protein, 12 aa, Staphylococcus epidermidis
SEAKRKEATQKY

SEQ ID NO: 1772670 - protein, 8 aa, Staphylococcus epidermidis
SEATHTSD

SEQ ID NO: 1772671 - protein, 16 aa, Staphylococcus epidermidis
SEDNKSEIDDEEKKYP

SEQ ID NO: 1772672 - protein, 12 aa, Staphylococcus epidermidis
SEDSQGASGENR

SEQ ID NO: 1772673 - protein, 9 aa, Staphylococcus epidermidis
SEEEIGTNF

SEQ ID NO: 1772674 - protein, 11 aa, Staphylococcus epidermidis
SEEKAVTTASM

SEQ ID NO: 1772675 - protein, 9 aa, Staphylococcus epidermidis
SEERKEAKH

SEQ ID NO: 1772676 - protein, 8 aa, Staphylococcus epidermidis
SEGAFAKH

SEQ ID NO: 1772677 - protein, 10 aa, Staphylococcus epidermidis
SEHKGTNIDK

SEQ ID NO: 1772678 - protein, 13 aa, Staphylococcus epidermidis
SEIKQQRKDFNEK

SEQ ID NO: 1772679 - protein, 5 aa, Staphylococcus epidermidis
SEINK

SEQ ID NO: 1772680 - protein, 15 aa, Staphylococcus epidermidis
SEKLTNDVEAPASGT

SEQ ID NO: 1772681 - protein, 4 aa, Staphylococcus epidermidis
SENE

SEQ ID NO: 1772682 - protein, 7 aa, Staphylococcus epidermidis
SENHVKD

SEQ ID NO: 1772683 - protein, 11 aa, Staphylococcus epidermidis
SERKHEPRLGE

SEQ ID NO: 1772684 - protein, 28 aa, Staphylococcus epidermidis
SERTKKGLASARARGRVGGRPPMPDHKK

SEQ ID NO: 1772685 - protein, 8 aa, Staphylococcus epidermidis
SESEETGQ

SEQ ID NO: 1772686 - protein, 9 aa, Staphylococcus epidermidis
SESEETGQA

SEQ ID NO: 1772687 - protein, 6 aa, Staphylococcus epidermidis
SESIEQ

SEQ ID NO: 1772688 - protein, 5 aa, Staphylococcus epidermidis
SESND

SEQ ID NO: 1772689 - protein, 4 aa, Staphylococcus epidermidis
SEST

SEQ ID NO: 1772690 - protein, 7 aa, Staphylococcus epidermidis
SEVGIGR

SEQ ID NO: 1772691 - protein, 7 aa, Staphylococcus epidermidis
SEYTEER

SEQ ID NO: 1772692 - protein, 7 aa, Staphylococcus epidermidis
SFEPPSD

SEQ ID NO: 1772693 - protein, 7 aa, Staphylococcus epidermidis
SFHDERA

SEQ ID NO: 1772694 - protein, 7 aa, Staphylococcus epidermidis
SFKENGE

SEQ ID NO: 1772695 - protein, 7 aa, Staphylococcus epidermidis
SFNADKA

SEQ ID NO: 1772696 - protein, 20 aa, Staphylococcus epidermidis
SGANGSKPRDVYITEADLNK

SEQ ID NO: 1772697 - protein, 15 aa, Staphylococcus epidermidis
SGDSLMDENTKNHLQ

SEQ ID NO: 1772698 - protein, 5 aa, Staphylococcus epidermidis
SGDYF

SEQ ID NO: 1772699 - protein, 8 aa, Staphylococcus epidermidis
SGEESKHG

SEQ ID NO: 1772700 - protein, 7 aa, Staphylococcus epidermidis
SGEGYSK

SEQ ID NO: 1772701 - protein, 9 aa, Staphylococcus epidermidis
SGEKSKHGI

SEQ ID NO: 1772702 - protein, 10 aa, Staphylococcus epidermidis
SGGDVGGSKN

SEQ ID NO: 1772703 - protein, 12 aa, Staphylococcus epidermidis
SGGKGTASEKIK

SEQ ID NO: 1772704 - protein, 7 aa, Staphylococcus epidermidis
SGGPKGI

SEQ ID NO: 1772705 - protein, 9 aa, Staphylococcus epidermidis
SGIAAPAYA

SEQ ID NO: 1772706 - protein, 5 aa, Staphylococcus epidermidis
SGKEP

SEQ ID NO: 1772707 - protein, 7 aa, Staphylococcus epidermidis
SGKPTAE

SEQ ID NO: 1772708 - protein, 4 aa, Staphylococcus epidermidis
SGLA

SEQ ID NO: 1772709 - protein, 7 aa, Staphylococcus epidermidis
SGLDQNA

SEQ ID NO: 1772710 - protein, 8 aa, Staphylococcus epidermidis
SGMTGPIG

SEQ ID NO: 1772711 - protein, 13 aa, Staphylococcus epidermidis
SGSTKTSSETMEW

SEQ ID NO: 1772712 - protein, 12 aa, Staphylococcus epidermidis
SGTVTKDELEKL

SEQ ID NO: 1772713 - protein, 5 aa, Staphylococcus epidermidis
SGYET

SEQ ID NO: 1772714 - protein, 12 aa, Staphylococcus epidermidis
SGYGDPQGEAVR

SEQ ID NO: 1772715 - protein, 4 aa, Staphylococcus epidermidis
SHLD

SEQ ID NO: 1772716 - protein, 5 aa, Staphylococcus epidermidis
SHQEK

SEQ ID NO: 1772717 - protein, 5 aa, Staphylococcus epidermidis
SHQTF

SEQ ID NO: 1772718 - protein, 38 aa, Staphylococcus epidermidis
SHTGQKRQTIYPKSQPKRGFSKRTTSTKKQVSSSDWKV

SEQ ID NO: 1772719 - protein, 6 aa, Staphylococcus epidermidis
SHVKTG

SEQ ID NO: 1772720 - protein, 5 aa, Staphylococcus epidermidis
SIEDI

SEQ ID NO: 1772721 - protein, 14 aa, Staphylococcus epidermidis
SIENSKKHQQPATL

SEQ ID NO: 1772722 - protein, 16 aa, Staphylococcus epidermidis
SIPSSGSDEFAHSEKT

SEQ ID NO: 1772723 - protein, 6 aa, Staphylococcus epidermidis
SIPTED

SEQ ID NO: 1772724 - protein, 4 aa, Staphylococcus epidermidis
SIQT

SEQ ID NO: 1772725 - protein, 9 aa, Staphylococcus epidermidis
SISSSQHDF

SEQ ID NO: 1772726 - protein, 11 aa, Staphylococcus epidermidis
SITYGGTGQSF

SEQ ID NO: 1772727 - protein, 11 aa, Staphylococcus epidermidis
SKAKPQKPENC

SEQ ID NO: 1772728 - protein, 16 aa, Staphylococcus epidermidis
SKAVKVTKGAGTTDSG

SEQ ID NO: 1772729 - protein, 35 aa, Staphylococcus epidermidis
SKDGVDTKEKAISKVKPRNNKEDDYLAKKKQELLG

SEQ ID NO: 1772730 - protein, 21 aa, Staphylococcus epidermidis
SKEARRASDTFDTKSEAVNRA

SEQ ID NO: 1772731 - protein, 13 aa, Staphylococcus epidermidis
SKEEADRMGETRT

SEQ ID NO: 1772732 - protein, 4 aa, Staphylococcus epidermidis
SKEF

SEQ ID NO: 1772733 - protein, 9 aa, Staphylococcus epidermidis
SKKEGEPDK

SEQ ID NO: 1772734 - protein, 9 aa, Staphylococcus epidermidis
SKKEIDQKK

SEQ ID NO: 1772735 - protein, 9 aa, Staphylococcus epidermidis
SKLGGKSEM

SEQ ID NO: 1772736 - protein, 10 aa, Staphylococcus epidermidis
SKQYQQYQNY

SEQ ID NO: 1772737 - protein, 4 aa, Staphylococcus epidermidis
SKRE

SEQ ID NO: 1772738 - protein, 21 aa, Staphylococcus epidermidis
SKRELTKVEKSLNKHNVNSVD

SEQ ID NO: 1772739 - protein, 7 aa, Staphylococcus epidermidis
SKRQGQS

SEQ ID NO: 1772740 - protein, 16 aa, Staphylococcus epidermidis
SKSASKDEIKKAYRKL

SEQ ID NO: 1772741 - protein, 4 aa, Staphylococcus epidermidis
SKSF

SEQ ID NO: 1772742 - protein, 13 aa, Staphylococcus epidermidis
SKSKSTKDNNPNN

SEQ ID NO: 1772743 - protein, 9 aa, Staphylococcus epidermidis
SKSNHSNKI

SEQ ID NO: 1772744 - protein, 5 aa, Staphylococcus epidermidis
SLGGR

SEQ ID NO: 1772745 - protein, 10 aa, Staphylococcus epidermidis
SLKEDSDINE

SEQ ID NO: 1772746 - protein, 5 aa, Staphylococcus epidermidis
SLNTL

SEQ ID NO: 1772747 - protein, 7 aa, Staphylococcus epidermidis
SLPSDYS

SEQ ID NO: 1772748 - protein, 6 aa, Staphylococcus epidermidis
SLQGLT

SEQ ID NO: 1772749 - protein, 5 aa, Staphylococcus epidermidis
SLSKA

SEQ ID NO: 1772750 - protein, 11 aa, Staphylococcus epidermidis
SLSSISKNKDI

SEQ ID NO: 1772751 - protein, 9 aa, Staphylococcus epidermidis
SNAREELRA

SEQ ID NO: 1772752 - protein, 20 aa, Staphylococcus epidermidis
SNDSDYITGQSILTDGGLVY

SEQ ID NO: 1772753 - protein, 22 aa, Staphylococcus epidermidis
SNEEKNKGITCASAGNHAQGVA

SEQ ID NO: 1772754 - protein, 4 aa, Staphylococcus epidermidis
SNEF

SEQ ID NO: 1772755 - protein, 8 aa, Staphylococcus epidermidis
SNERLQGE

SEQ ID NO: 1772756 - protein, 10 aa, Staphylococcus epidermidis
SNERLQGEFS

SEQ ID NO: 1772757 - protein, 7 aa, Staphylococcus epidermidis
SNESFNT

SEQ ID NO: 1772758 - protein, 7 aa, Staphylococcus epidermidis
SNGDNTK

SEQ ID NO: 1772759 - protein, 7 aa, Staphylococcus epidermidis
SNHPYEA

SEQ ID NO: 1772760 - protein, 4 aa, Staphylococcus epidermidis
SNIR

SEQ ID NO: 1772761 - protein, 7 aa, Staphylococcus epidermidis
SNISRRE

SEQ ID NO: 1772762 - protein, 17 aa, Staphylococcus epidermidis
SNKKIQKLESQLEEERQ

SEQ ID NO: 1772763 - protein, 14 aa, Staphylococcus epidermidis
SNNNKSRVSSFSSN

SEQ ID NO: 1772764 - protein, 7 aa, Staphylococcus epidermidis
SNNQTKV

SEQ ID NO: 1772765 - protein, 4 aa, Staphylococcus epidermidis
SNQC

SEQ ID NO: 1772766 - protein, 5 aa, Staphylococcus epidermidis
SNQDK

SEQ ID NO: 1772767 - protein, 10 aa, Staphylococcus epidermidis
SNQLNNENIE

SEQ ID NO: 1772768 - protein, 5 aa, Staphylococcus epidermidis
SNQYA

SEQ ID NO: 1772769 - protein, 4 aa, Staphylococcus epidermidis
SNTY

SEQ ID NO: 1772770 - protein, 6 aa, Staphylococcus epidermidis
SNVEEI

SEQ ID NO: 1772771 - protein, 7 aa, Staphylococcus epidermidis
SNVEEIA

SEQ ID NO: 1772772 - protein, 4 aa, Staphylococcus epidermidis
SNWG

SEQ ID NO: 1772773 - protein, 7 aa, Staphylococcus epidermidis
SPAAQGL

SEQ ID NO: 1772774 - protein, 7 aa, Staphylococcus epidermidis
SPDETEE

SEQ ID NO: 1772775 - protein, 6 aa, Staphylococcus epidermidis
SPDPNI

SEQ ID NO: 1772776 - protein, 14 aa, Staphylococcus epidermidis
SPFGSSSKLNDDNF

SEQ ID NO: 1772777 - protein, 8 aa, Staphylococcus epidermidis
SPFNIEGG

SEQ ID NO: 1772778 - protein, 6 aa, Staphylococcus epidermidis
SPGFAQ

SEQ ID NO: 1772779 - protein, 19 aa, Staphylococcus epidermidis
SPGGTDGGEIHKANEGIPT

SEQ ID NO: 1772780 - protein, 8 aa, Staphylococcus epidermidis
SPGSRSTP

SEQ ID NO: 1772781 - protein, 16 aa, Staphylococcus epidermidis
SPQKKPEQIKTEIEKL

SEQ ID NO: 1772782 - protein, 5 aa, Staphylococcus epidermidis
SPWDQ

SEQ ID NO: 1772783 - protein, 5 aa, Staphylococcus epidermidis
SPYAT

SEQ ID NO: 1772784 - protein, 4 aa, Staphylococcus epidermidis
SQEM

SEQ ID NO: 1772785 - protein, 18 aa, Staphylococcus epidermidis
SQGPSQGRTFQSENGREV

SEQ ID NO: 1772786 - protein, 4 aa, Staphylococcus epidermidis
SQQD

SEQ ID NO: 1772787 - protein, 5 aa, Staphylococcus epidermidis
SQRIY

SEQ ID NO: 1772788 - protein, 4 aa, Staphylococcus epidermidis
SQTS

SEQ ID NO: 1772789 - protein, 5 aa, Staphylococcus epidermidis
SQYNL

SEQ ID NO: 1772790 - protein, 6 aa, Staphylococcus epidermidis
SRDDAG

SEQ ID NO: 1772791 - protein, 14 aa, Staphylococcus epidermidis
SRDKDKMNKIIDII

SEQ ID NO: 1772792 - protein, 14 aa, Staphylococcus epidermidis
SRGVESRSDKRPMM

SEQ ID NO: 1772793 - protein, 15 aa, Staphylococcus epidermidis
SRHADEANAIRRRRE

SEQ ID NO: 1772794 - protein, 8 aa, Staphylococcus epidermidis
SRKEQDQF

SEQ ID NO: 1772795 - protein, 4 aa, Staphylococcus epidermidis
SRKR

SEQ ID NO: 1772796 - protein, 6 aa, Staphylococcus epidermidis
SRPAKN

SEQ ID NO: 1772797 - protein, 41 aa, Staphylococcus epidermidis
SRRVRNRVGRGAATGNGKTSGRGQKGQKARSGGKLRPGFEG

SEQ ID NO: 1772798 - protein, 4 aa, Staphylococcus epidermidis
SRSF

SEQ ID NO: 1772799 - protein, 8 aa, Staphylococcus epidermidis
SRSGVSSK

SEQ ID NO: 1772800 - protein, 14 aa, Staphylococcus epidermidis
SRTNRVEKERKPYG

SEQ ID NO: 1772801 - protein, 9 aa, Staphylococcus epidermidis
SRTQNSSVQ

SEQ ID NO: 1772802 - protein, 4 aa, Staphylococcus epidermidis
SRYP

SEQ ID NO: 1772803 - protein, 6 aa, Staphylococcus epidermidis
SSDWDD

SEQ ID NO: 1772804 - protein, 6 aa, Staphylococcus epidermidis
SSEKFT

SEQ ID NO: 1772805 - protein, 5 aa, Staphylococcus epidermidis
SSFTS

SEQ ID NO: 1772806 - protein, 5 aa, Staphylococcus epidermidis
SSGKL

SEQ ID NO: 1772807 - protein, 5 aa, Staphylococcus epidermidis
SSINS

SEQ ID NO: 1772808 - protein, 9 aa, Staphylococcus epidermidis
SSKATNEES

SEQ ID NO: 1772809 - protein, 9 aa, Staphylococcus epidermidis
SSKKVGNKV

SEQ ID NO: 1772810 - protein, 53 aa, Staphylococcus epidermidis
SSKNEDDIQKDLDESVDSNVNSDSDSMDPNDSDEQVKPKKKPKKLSEADFDED

SEQ ID NO: 1772811 - protein, 9 aa, Staphylococcus epidermidis
SSMSEQQAI

SEQ ID NO: 1772812 - protein, 7 aa, Staphylococcus epidermidis
SSNDPRF

SEQ ID NO: 1772813 - protein, 6 aa, Staphylococcus epidermidis
SSNIPS

SEQ ID NO: 1772814 - protein, 9 aa, Staphylococcus epidermidis
SSNSSLDVH

SEQ ID NO: 1772815 - protein, 6 aa, Staphylococcus epidermidis
SSPDAI

SEQ ID NO: 1772816 - protein, 8 aa, Staphylococcus epidermidis
SSPNKLSK

SEQ ID NO: 1772817 - protein, 9 aa, Staphylococcus epidermidis
SSPQLDVPE

SEQ ID NO: 1772818 - protein, 8 aa, Staphylococcus epidermidis
SSSNPLGG

SEQ ID NO: 1772819 - protein, 4 aa, Staphylococcus epidermidis
SSTD

SEQ ID NO: 1772820 - protein, 13 aa, Staphylococcus epidermidis
SSTKNEHSPLSNE

SEQ ID NO: 1772821 - protein, 7 aa, Staphylococcus epidermidis
SSTTAKH

SEQ ID NO: 1772822 - protein, 9 aa, Staphylococcus epidermidis
STATSQTPV

SEQ ID NO: 1772823 - protein, 12 aa, Staphylococcus epidermidis
STDLEKESGNLN

SEQ ID NO: 1772824 - protein, 21 aa, Staphylococcus epidermidis
STEARRASDTFDTKSEAVNRA

SEQ ID NO: 1772825 - protein, 4 aa, Staphylococcus epidermidis
STGE

SEQ ID NO: 1772826 - protein, 5 aa, Staphylococcus epidermidis
STGKD

SEQ ID NO: 1772827 - protein, 4 aa, Staphylococcus epidermidis
STNI

SEQ ID NO: 1772828 - protein, 6 aa, Staphylococcus epidermidis
STRKGK

SEQ ID NO: 1772829 - protein, 13 aa, Staphylococcus epidermidis
STRLGNTNAARTK

SEQ ID NO: 1772830 - protein, 7 aa, Staphylococcus epidermidis
STYQDNE

SEQ ID NO: 1772831 - protein, 16 aa, Staphylococcus epidermidis
STYRSQNRGGRGIQGM

SEQ ID NO: 1772832 - protein, 30 aa, Staphylococcus epidermidis
SVEIKSRKHNYQISGKKNKNKNVELIAIIK

SEQ ID NO: 1772833 - protein, 14 aa, Staphylococcus epidermidis
SVNPNDINPEKQSR

SEQ ID NO: 1772834 - protein, 8 aa, Staphylococcus epidermidis
SVRKDDNV

SEQ ID NO: 1772835 - protein, 4 aa, Staphylococcus epidermidis
SYPR

SEQ ID NO: 1772836 - protein, 7 aa, Staphylococcus epidermidis
SYTNEDY

SEQ ID NO: 1772837 - protein, 14 aa, Staphylococcus epidermidis
SYVPDKNNNKIIES

SEQ ID NO: 1772838 - protein, 4 aa, Staphylococcus epidermidis
TAAN

SEQ ID NO: 1772839 - protein, 8 aa, Staphylococcus epidermidis
TADEEDSY

SEQ ID NO: 1772840 - protein, 10 aa, Staphylococcus epidermidis
TAGKGRSGFV

SEQ ID NO: 1772841 - protein, 9 aa, Staphylococcus epidermidis
TANGKRTSI

SEQ ID NO: 1772842 - protein, 4 aa, Staphylococcus epidermidis
TAQT

SEQ ID NO: 1772843 - protein, 5 aa, Staphylococcus epidermidis
TARYG

SEQ ID NO: 1772844 - protein, 5 aa, Staphylococcus epidermidis
TASEV

SEQ ID NO: 1772845 - protein, 22 aa, Staphylococcus epidermidis
TATGDGSIAAQSAADYITELKD

SEQ ID NO: 1772846 - protein, 13 aa, Staphylococcus epidermidis
TDASNLLKGKDEN

SEQ ID NO: 1772847 - protein, 7 aa, Staphylococcus epidermidis
TDDDWTN

SEQ ID NO: 1772848 - protein, 21 aa, Staphylococcus epidermidis
TDDGRLSAKEVVGNKKALTAF

SEQ ID NO: 1772849 - protein, 6 aa, Staphylococcus epidermidis
TDEGAC

SEQ ID NO: 1772850 - protein, 9 aa, Staphylococcus epidermidis
TDGKEDLRS

SEQ ID NO: 1772851 - protein, 9 aa, Staphylococcus epidermidis
TDIEPPEGI

SEQ ID NO: 1772852 - protein, 6 aa, Staphylococcus epidermidis
TDKQRR

SEQ ID NO: 1772853 - protein, 5 aa, Staphylococcus epidermidis
TDKSV

SEQ ID NO: 1772854 - protein, 4 aa, Staphylococcus epidermidis
TDMS

SEQ ID NO: 1772855 - protein, 5 aa, Staphylococcus epidermidis
TDMTP

SEQ ID NO: 1772856 - protein, 4 aa, Staphylococcus epidermidis
TDQK

SEQ ID NO: 1772857 - protein, 7 aa, Staphylococcus epidermidis
TDQRDYE

SEQ ID NO: 1772858 - protein, 11 aa, Staphylococcus epidermidis
TDSTNHDDDLA

SEQ ID NO: 1772859 - protein, 9 aa, Staphylococcus epidermidis
TDWSLSDPK

SEQ ID NO: 1772860 - protein, 4 aa, Staphylococcus epidermidis
TEDE

SEQ ID NO: 1772861 - protein, 4 aa, Staphylococcus epidermidis
TEDF

SEQ ID NO: 1772862 - protein, 19 aa, Staphylococcus epidermidis
TEDNKGIPDVKDKKYPVKM

SEQ ID NO: 1772863 - protein, 4 aa, Staphylococcus epidermidis
TEDQ

SEQ ID NO: 1772864 - protein, 13 aa, Staphylococcus epidermidis
TEDYNDNKRNPYA

SEQ ID NO: 1772865 - protein, 9 aa, Staphylococcus epidermidis
TEHDTIEQS

SEQ ID NO: 1772866 - protein, 16 aa, Staphylococcus epidermidis
TEIDASVKKSAHSAQP

SEQ ID NO: 1772867 - protein, 10 aa, Staphylococcus epidermidis
TEKEIKSEDF

SEQ ID NO: 1772868 - protein, 13 aa, Staphylococcus epidermidis
TEKQSGKSIENRP

SEQ ID NO: 1772869 - protein, 12 aa, Staphylococcus epidermidis
TEKQSGQSIENR

SEQ ID NO: 1772870 - protein, 15 aa, Staphylococcus epidermidis
TEKVEQGYYQPTTTK

SEQ ID NO: 1772871 - protein, 4 aa, Staphylococcus epidermidis
TELE

SEQ ID NO: 1772872 - protein, 19 aa, Staphylococcus epidermidis
TEPFDGRSTTYSSDVAKGY

SEQ ID NO: 1772873 - protein, 8 aa, Staphylococcus epidermidis
TEPRMGSM

SEQ ID NO: 1772874 - protein, 8 aa, Staphylococcus epidermidis
TESEEQEI

SEQ ID NO: 1772875 - protein, 5 aa, Staphylococcus epidermidis
TESLA

SEQ ID NO: 1772876 - protein, 4 aa, Staphylococcus epidermidis
TETK

SEQ ID NO: 1772877 - protein, 10 aa, Staphylococcus epidermidis
TETKSAPTPV

SEQ ID NO: 1772878 - protein, 15 aa, Staphylococcus epidermidis
TEVVETARDSLVIGI

SEQ ID NO: 1772879 - protein, 7 aa, Staphylococcus epidermidis
TFDDEDL

SEQ ID NO: 1772880 - protein, 5 aa, Staphylococcus epidermidis
TFEKA

SEQ ID NO: 1772881 - protein, 11 aa, Staphylococcus epidermidis
TGAHGKTSTTG

SEQ ID NO: 1772882 - protein, 9 aa, Staphylococcus epidermidis
TGEDGEEAV

SEQ ID NO: 1772883 - protein, 18 aa, Staphylococcus epidermidis
TGEGKMDKQTIYGKTPIG

SEQ ID NO: 1772884 - protein, 8 aa, Staphylococcus epidermidis
TGGDSGIG

SEQ ID NO: 1772885 - protein, 6 aa, Staphylococcus epidermidis
TGGNNI

SEQ ID NO: 1772886 - protein, 4 aa, Staphylococcus epidermidis
TGKI

SEQ ID NO: 1772887 - protein, 5 aa, Staphylococcus epidermidis
TGLPA

SEQ ID NO: 1772888 - protein, 6 aa, Staphylococcus epidermidis
TGSDDA

SEQ ID NO: 1772889 - protein, 6 aa, Staphylococcus epidermidis
TGTMDK

SEQ ID NO: 1772890 - protein, 19 aa, Staphylococcus epidermidis
THGKKKPIQKHKKINPKRL

SEQ ID NO: 1772891 - protein, 4 aa, Staphylococcus epidermidis
THMR

SEQ ID NO: 1772892 - protein, 5 aa, Staphylococcus epidermidis
THPGA

SEQ ID NO: 1772893 - protein, 8 aa, Staphylococcus epidermidis
THRDQGDI

SEQ ID NO: 1772894 - protein, 4 aa, Staphylococcus epidermidis
TIDN

SEQ ID NO: 1772895 - protein, 7 aa, Staphylococcus epidermidis
TIDNKQN

SEQ ID NO: 1772896 - protein, 5 aa, Staphylococcus epidermidis
TIGGN

SEQ ID NO: 1772897 - protein, 13 aa, Staphylococcus epidermidis
TIPELPDERKAKY

SEQ ID NO: 1772898 - protein, 11 aa, Staphylococcus epidermidis
TITKPRPGHAD

SEQ ID NO: 1772899 - protein, 4 aa, Staphylococcus epidermidis
TKDA

SEQ ID NO: 1772900 - protein, 10 aa, Staphylococcus epidermidis
TKDIKQVQER

SEQ ID NO: 1772901 - protein, 8 aa, Staphylococcus epidermidis
TKENVKKG

SEQ ID NO: 1772902 - protein, 6 aa, Staphylococcus epidermidis
TKGKYK

SEQ ID NO: 1772903 - protein, 27 aa, Staphylococcus epidermidis
TKGLTSVDEVTKATKAGNSCGKCKGQI

SEQ ID NO: 1772904 - protein, 15 aa, Staphylococcus epidermidis
TKKESTIQNKESVKK

SEQ ID NO: 1772905 - protein, 17 aa, Staphylococcus epidermidis
TKNNAQNNTDWSNKEYD

SEQ ID NO: 1772906 - protein, 9 aa, Staphylococcus epidermidis
TKPCENEYE

SEQ ID NO: 1772907 - protein, 7 aa, Staphylococcus epidermidis
TKQDITD

SEQ ID NO: 1772908 - protein, 6 aa, Staphylococcus epidermidis
TLDAKE

SEQ ID NO: 1772909 - protein, 14 aa, Staphylococcus epidermidis
TLDEYRKNIEKDAA

SEQ ID NO: 1772910 - protein, 11 aa, Staphylococcus epidermidis
TLKANEKQLQK

SEQ ID NO: 1772911 - protein, 5 aa, Staphylococcus epidermidis
TLLGA

SEQ ID NO: 1772912 - protein, 10 aa, Staphylococcus epidermidis
TLQDDTTKKI

SEQ ID NO: 1772913 - protein, 4 aa, Staphylococcus epidermidis
TMES

SEQ ID NO: 1772914 - protein, 18 aa, Staphylococcus epidermidis
TMPSNYEQPQRVERVAFN

SEQ ID NO: 1772915 - protein, 8 aa, Staphylococcus epidermidis
TMSEEEQN

SEQ ID NO: 1772916 - protein, 4 aa, Staphylococcus epidermidis
TNAF

SEQ ID NO: 1772917 - protein, 4 aa, Staphylococcus epidermidis
TNCT

SEQ ID NO: 1772918 - protein, 6 aa, Staphylococcus epidermidis
TNDENV

SEQ ID NO: 1772919 - protein, 16 aa, Staphylococcus epidermidis
TNDFPQYERPQSHNYE

SEQ ID NO: 1772920 - protein, 6 aa, Staphylococcus epidermidis
TNDGDV

SEQ ID NO: 1772921 - protein, 7 aa, Staphylococcus epidermidis
TNEETEM

SEQ ID NO: 1772922 - protein, 22 aa, Staphylococcus epidermidis
TNFSDNKDSNNYHAKNTVPRSY

SEQ ID NO: 1772923 - protein, 4 aa, Staphylococcus epidermidis
TNGR

SEQ ID NO: 1772924 - protein, 14 aa, Staphylococcus epidermidis
TNGTEEKRPSTSGV

SEQ ID NO: 1772925 - protein, 4 aa, Staphylococcus epidermidis
TNHL

SEQ ID NO: 1772926 - protein, 9 aa, Staphylococcus epidermidis
TNHRKYPKT

SEQ ID NO: 1772927 - protein, 11 aa, Staphylococcus epidermidis
TNIDKANEMSN

SEQ ID NO: 1772928 - protein, 4 aa, Staphylococcus epidermidis
TNIN

SEQ ID NO: 1772929 - protein, 6 aa, Staphylococcus epidermidis
TNSKDT

SEQ ID NO: 1772930 - protein, 5 aa, Staphylococcus epidermidis
TPAPY

SEQ ID NO: 1772931 - protein, 4 aa, Staphylococcus epidermidis
TPDH

SEQ ID NO: 1772932 - protein, 5 aa, Staphylococcus epidermidis
TPGRQ

SEQ ID NO: 1772933 - protein, 13 aa, Staphylococcus epidermidis
TPGSHGSTFGGNP

SEQ ID NO: 1772934 - protein, 17 aa, Staphylococcus epidermidis
TPKEMGGQGGNDTNPEQ

SEQ ID NO: 1772935 - protein, 18 aa, Staphylococcus epidermidis
TPKNNQDITDLNSYGKSD

SEQ ID NO: 1772936 - protein, 11 aa, Staphylococcus epidermidis
TPLEETPDEAD

SEQ ID NO: 1772937 - protein, 12 aa, Staphylococcus epidermidis
TPLPEKESYDDE

SEQ ID NO: 1772938 - protein, 13 aa, Staphylococcus epidermidis
TPLTNETLQSCKN

SEQ ID NO: 1772939 - protein, 6 aa, Staphylococcus epidermidis
TPNALT

SEQ ID NO: 1772940 - protein, 9 aa, Staphylococcus epidermidis
TPNASVSEV

SEQ ID NO: 1772941 - protein, 6 aa, Staphylococcus epidermidis
TPNAYR

SEQ ID NO: 1772942 - protein, 9 aa, Staphylococcus epidermidis
TPQKSTNQL

SEQ ID NO: 1772943 - protein, 17 aa, Staphylococcus epidermidis
TPRFEENKSQDGRATAD

SEQ ID NO: 1772944 - protein, 13 aa, Staphylococcus epidermidis
TPRPDSEEAPEHP

SEQ ID NO: 1772945 - protein, 15 aa, Staphylococcus epidermidis
TPVKEIDGEDPIKAD

SEQ ID NO: 1772946 - protein, 8 aa, Staphylococcus epidermidis
TQAGTLNK

SEQ ID NO: 1772947 - protein, 5 aa, Staphylococcus epidermidis
TQEDR

SEQ ID NO: 1772948 - protein, 26 aa, Staphylococcus epidermidis
TQFKPNIPSYRKSSMPDGVHPNEKGH

SEQ ID NO: 1772949 - protein, 16 aa, Staphylococcus epidermidis
TQRSNEGWQGWSEEGK

SEQ ID NO: 1772950 - protein, 16 aa, Staphylococcus epidermidis
TQRSNEGWQSWPEEGK

SEQ ID NO: 1772951 - protein, 18 aa, Staphylococcus epidermidis
TQSAIKAGYSPNSAHVTG

SEQ ID NO: 1772952 - protein, 5 aa, Staphylococcus epidermidis
TQSGD

SEQ ID NO: 1772953 - protein, 4 aa, Staphylococcus epidermidis
TQST

SEQ ID NO: 1772954 - protein, 4 aa, Staphylococcus epidermidis
TRDD

SEQ ID NO: 1772955 - protein, 4 aa, Staphylococcus epidermidis
TRQK

SEQ ID NO: 1772956 - protein, 9 aa, Staphylococcus epidermidis
TRRAQEGYY

SEQ ID NO: 1772957 - protein, 10 aa, Staphylococcus epidermidis
TRRAQEGYYQ

SEQ ID NO: 1772958 - protein, 5 aa, Staphylococcus epidermidis
TRSEY

SEQ ID NO: 1772959 - protein, 6 aa, Staphylococcus epidermidis
TRTHGG

SEQ ID NO: 1772960 - protein, 7 aa, Staphylococcus epidermidis
TRTHGGA

SEQ ID NO: 1772961 - protein, 8 aa, Staphylococcus epidermidis
TSACSSKM

SEQ ID NO: 1772962 - protein, 7 aa, Staphylococcus epidermidis
TSAEDVD

SEQ ID NO: 1772963 - protein, 5 aa, Staphylococcus epidermidis
TSASD

SEQ ID NO: 1772964 - protein, 25 aa, Staphylococcus epidermidis
TSGELTDRQFKTRTVKETLEGAGLD

SEQ ID NO: 1772965 - protein, 5 aa, Staphylococcus epidermidis
TSGLG

SEQ ID NO: 1772966 - protein, 6 aa, Staphylococcus epidermidis
TSGWTS

SEQ ID NO: 1772967 - protein, 28 aa, Staphylococcus epidermidis
TSIQEKSEAYNKKSIEKQGINNPTKITS

SEQ ID NO: 1772968 - protein, 11 aa, Staphylococcus epidermidis
TSLDGQKYGAY

SEQ ID NO: 1772969 - protein, 9 aa, Staphylococcus epidermidis
TSLTESVPT

SEQ ID NO: 1772970 - protein, 4 aa, Staphylococcus epidermidis
TSNG

SEQ ID NO: 1772971 - protein, 5 aa, Staphylococcus epidermidis
TSNKT

SEQ ID NO: 1772972 - protein, 4 aa, Staphylococcus epidermidis
TSPL

SEQ ID NO: 1772973 - protein, 6 aa, Staphylococcus epidermidis
TSRRKI

SEQ ID NO: 1772974 - protein, 8 aa, Staphylococcus epidermidis
TSSSFRNS

SEQ ID NO: 1772975 - protein, 4 aa, Staphylococcus epidermidis
TSYE

SEQ ID NO: 1772976 - protein, 9 aa, Staphylococcus epidermidis
TTDAPLKET

SEQ ID NO: 1772977 - protein, 15 aa, Staphylococcus epidermidis
TTEPKKAIQLMHQLF

SEQ ID NO: 1772978 - protein, 12 aa, Staphylococcus epidermidis
TTILGADDKAGL

SEQ ID NO: 1772979 - protein, 17 aa, Staphylococcus epidermidis
TTKPIEVGGGIRSKQTI

SEQ ID NO: 1772980 - protein, 5 aa, Staphylococcus epidermidis
TTKVD

SEQ ID NO: 1772981 - protein, 6 aa, Staphylococcus epidermidis
TTNEEY

SEQ ID NO: 1772982 - protein, 9 aa, Staphylococcus epidermidis
TTNKPNLKN

SEQ ID NO: 1772983 - protein, 13 aa, Staphylococcus epidermidis
TTRENGVSPYPNH

SEQ ID NO: 1772984 - protein, 10 aa, Staphylococcus epidermidis
TTREPGGVLT

SEQ ID NO: 1772985 - protein, 9 aa, Staphylococcus epidermidis
TTVGQKEKL

SEQ ID NO: 1772986 - protein, 5 aa, Staphylococcus epidermidis
TVGDR

SEQ ID NO: 1772987 - protein, 9 aa, Staphylococcus epidermidis
TVKQDNTSF

SEQ ID NO: 1772988 - protein, 14 aa, Staphylococcus epidermidis
TVNDQTISKRDFTG

SEQ ID NO: 1772989 - protein, 9 aa, Staphylococcus epidermidis
TVSGLTNSQ

SEQ ID NO: 1772990 - protein, 12 aa, Staphylococcus epidermidis
TYEDENESIVTD

SEQ ID NO: 1772991 - protein, 5 aa, Staphylococcus epidermidis
TYRRE

SEQ ID NO: 1772992 - protein, 5 aa, Staphylococcus epidermidis
TYSGN

SEQ ID NO: 1772993 - protein, 4 aa, Staphylococcus epidermidis
VADA

SEQ ID NO: 1772994 - protein, 9 aa, Staphylococcus epidermidis
VAENLSKKL

SEQ ID NO: 1772995 - protein, 11 aa, Staphylococcus epidermidis
VAGESGSGVDT

SEQ ID NO: 1772996 - protein, 8 aa, Staphylococcus epidermidis
VAKDQLQH

SEQ ID NO: 1772997 - protein, 12 aa, Staphylococcus epidermidis
VAKRSEIPVVIV

SEQ ID NO: 1772998 - protein, 12 aa, Staphylococcus epidermidis
VAQPDVTETDAV

SEQ ID NO: 1772999 - protein, 15 aa, Staphylococcus epidermidis
VARTETGRALSQAGL

SEQ ID NO: 1773000 - protein, 11 aa, Staphylococcus epidermidis
VATDTQPTEAQ

SEQ ID NO: 1773001 - protein, 15 aa, Staphylococcus epidermidis
VATKNPEGHDILIWN

SEQ ID NO: 1773002 - protein, 7 aa, Staphylococcus epidermidis
VAVGDTK

SEQ ID NO: 1773003 - protein, 4 aa, Staphylococcus epidermidis
VDAG

SEQ ID NO: 1773004 - protein, 4 aa, Staphylococcus epidermidis
VDDN

SEQ ID NO: 1773005 - protein, 13 aa, Staphylococcus epidermidis
VDEYIKSKKDEIM

SEQ ID NO: 1773006 - protein, 4 aa, Staphylococcus epidermidis
VDKD

SEQ ID NO: 1773007 - protein, 6 aa, Staphylococcus epidermidis
VDKPKS

SEQ ID NO: 1773008 - protein, 9 aa, Staphylococcus epidermidis
VDNGESLTA

SEQ ID NO: 1773009 - protein, 19 aa, Staphylococcus epidermidis
VDPSAWTDTDYIYGQYEWT

SEQ ID NO: 1773010 - protein, 8 aa, Staphylococcus epidermidis
VDSTQLKA

SEQ ID NO: 1773011 - protein, 10 aa, Staphylococcus epidermidis
VEAEKDDTDL

SEQ ID NO: 1773012 - protein, 27 aa, Staphylococcus epidermidis
VEETKSDPDDNKEVEPPKKGFWSRFFG

SEQ ID NO: 1773013 - protein, 35 aa, Staphylococcus epidermidis
VEKGTTGDGVESVTGYTGHDAAKLRDYNENNHALS

SEQ ID NO: 1773014 - protein, 20 aa, Staphylococcus epidermidis
VENPDYDDSISYESRSERPE

SEQ ID NO: 1773015 - protein, 7 aa, Staphylococcus epidermidis
VENTEHT

SEQ ID NO: 1773016 - protein, 10 aa, Staphylococcus epidermidis
VEPLKEEAAI

SEQ ID NO: 1773017 - protein, 24 aa, Staphylococcus epidermidis
VEPLKEEAAIAKEYKQLSKEMEQS

SEQ ID NO: 1773018 - protein, 9 aa, Staphylococcus epidermidis
VEQKEREKA

SEQ ID NO: 1773019 - protein, 12 aa, Staphylococcus epidermidis
VERGSTDDNKTY

SEQ ID NO: 1773020 - protein, 10 aa, Staphylococcus epidermidis
VESDKDLKGM

SEQ ID NO: 1773021 - protein, 9 aa, Staphylococcus epidermidis
VESTSRAPW

SEQ ID NO: 1773022 - protein, 24 aa, Staphylococcus epidermidis
VEYDKDKNAVKVDATKTLNEEAPY

SEQ ID NO: 1773023 - protein, 25 aa, Staphylococcus epidermidis
VEYDKDKNAVKVDATKTLNEEAPYE

SEQ ID NO: 1773024 - protein, 5 aa, Staphylococcus epidermidis
VFGSK

SEQ ID NO: 1773025 - protein, 8 aa, Staphylococcus epidermidis
VGGADDLN

SEQ ID NO: 1773026 - protein, 4 aa, Staphylococcus epidermidis
VGKN

SEQ ID NO: 1773027 - protein, 10 aa, Staphylococcus epidermidis
VGKYGGKGIT

SEQ ID NO: 1773028 - protein, 11 aa, Staphylococcus epidermidis
VGLSNNKSQNM

SEQ ID NO: 1773029 - protein, 4 aa, Staphylococcus epidermidis
VGPE

SEQ ID NO: 1773030 - protein, 6 aa, Staphylococcus epidermidis
VGQNNN

SEQ ID NO: 1773031 - protein, 8 aa, Staphylococcus epidermidis
VGYDTDGV

SEQ ID NO: 1773032 - protein, 5 aa, Staphylococcus epidermidis
VHSQE

SEQ ID NO: 1773033 - protein, 13 aa, Staphylococcus epidermidis
VKDKASDVVDKFK

SEQ ID NO: 1773034 - protein, 9 aa, Staphylococcus epidermidis
VKDKYKSRY

SEQ ID NO: 1773035 - protein, 22 aa, Staphylococcus epidermidis
VKEPKLSEKRTQNLREKQEIAK

SEQ ID NO: 1773036 - protein, 5 aa, Staphylococcus epidermidis
VKETH

SEQ ID NO: 1773037 - protein, 9 aa, Staphylococcus epidermidis
VKNEKSGIK

SEQ ID NO: 1773038 - protein, 7 aa, Staphylococcus epidermidis
VKNYSYG

SEQ ID NO: 1773039 - protein, 6 aa, Staphylococcus epidermidis
VKPSVE

SEQ ID NO: 1773040 - protein, 5 aa, Staphylococcus epidermidis
VKSNI

SEQ ID NO: 1773041 - protein, 5 aa, Staphylococcus epidermidis
VKTGY

SEQ ID NO: 1773042 - protein, 14 aa, Staphylococcus epidermidis
VNANNVKVQEDASK

SEQ ID NO: 1773043 - protein, 8 aa, Staphylococcus epidermidis
VNDGASVS

SEQ ID NO: 1773044 - protein, 11 aa, Staphylococcus epidermidis
VNDTGKTTTAT

SEQ ID NO: 1773045 - protein, 6 aa, Staphylococcus epidermidis
VNGEHE

SEQ ID NO: 1773046 - protein, 4 aa, Staphylococcus epidermidis
VNGK

SEQ ID NO: 1773047 - protein, 16 aa, Staphylococcus epidermidis
VNPAKIKSKGVKSVRK

SEQ ID NO: 1773048 - protein, 4 aa, Staphylococcus epidermidis
VPAD

SEQ ID NO: 1773049 - protein, 4 aa, Staphylococcus epidermidis
VPKN

SEQ ID NO: 1773050 - protein, 7 aa, Staphylococcus epidermidis
VPNGSKN

SEQ ID NO: 1773051 - protein, 22 aa, Staphylococcus epidermidis
VPQPQGKTATSPKEALKNAREI

SEQ ID NO: 1773052 - protein, 4 aa, Staphylococcus epidermidis
VPQT

SEQ ID NO: 1773053 - protein, 7 aa, Staphylococcus epidermidis
VPRGRGK

SEQ ID NO: 1773054 - protein, 10 aa, Staphylococcus epidermidis
VPSGRAKQKA

SEQ ID NO: 1773055 - protein, 9 aa, Staphylococcus epidermidis
VPSRRKDIS

SEQ ID NO: 1773056 - protein, 9 aa, Staphylococcus epidermidis
VPSSQTEKL

SEQ ID NO: 1773057 - protein, 17 aa, Staphylococcus epidermidis
VQERGGNTDIFNPIDKE

SEQ ID NO: 1773058 - protein, 8 aa, Staphylococcus epidermidis
VQQADQRA

SEQ ID NO: 1773059 - protein, 18 aa, Staphylococcus epidermidis
VQRENNNYENEDIDHSKT

SEQ ID NO: 1773060 - protein, 21 aa, Staphylococcus epidermidis
VREREHDNSGYTNIDDIDWAR

SEQ ID NO: 1773061 - protein, 15 aa, Staphylococcus epidermidis
VRETSPFPRLLNRLY

SEQ ID NO: 1773062 - protein, 7 aa, Staphylococcus epidermidis
VRKDDNV

SEQ ID NO: 1773063 - protein, 15 aa, Staphylococcus epidermidis
VRKEDQVKELENKGI

SEQ ID NO: 1773064 - protein, 5 aa, Staphylococcus epidermidis
VRQVE

SEQ ID NO: 1773065 - protein, 6 aa, Staphylococcus epidermidis
VSDTPI

SEQ ID NO: 1773066 - protein, 6 aa, Staphylococcus epidermidis
VSGDIA

SEQ ID NO: 1773067 - protein, 9 aa, Staphylococcus epidermidis
VSGEESKHG

SEQ ID NO: 1773068 - protein, 17 aa, Staphylococcus epidermidis
VSGESDDTLGYKNMPNQ

SEQ ID NO: 1773069 - protein, 5 aa, Staphylococcus epidermidis
VSINS

SEQ ID NO: 1773070 - protein, 14 aa, Staphylococcus epidermidis
VSKRQTSLMFPGPP

SEQ ID NO: 1773071 - protein, 10 aa, Staphylococcus epidermidis
VSNAGQKGAV

SEQ ID NO: 1773072 - protein, 22 aa, Staphylococcus epidermidis
VSPKDLEEKELKYPKKITKEHH

SEQ ID NO: 1773073 - protein, 15 aa, Staphylococcus epidermidis
VSSSKFENLGNHDTN

SEQ ID NO: 1773074 - protein, 6 aa, Staphylococcus epidermidis
VSTPDH

SEQ ID NO: 1773075 - protein, 6 aa, Staphylococcus epidermidis
VTAGGI

SEQ ID NO: 1773076 - protein, 4 aa, Staphylococcus epidermidis
VTCR

SEQ ID NO: 1773077 - protein, 18 aa, Staphylococcus epidermidis
VTELTRENAKEMIKQNHN

SEQ ID NO: 1773078 - protein, 12 aa, Staphylococcus epidermidis
VTPAPAPWTDDK

SEQ ID NO: 1773079 - protein, 6 aa, Staphylococcus epidermidis
VTQPTI

SEQ ID NO: 1773080 - protein, 4 aa, Staphylococcus epidermidis
VTSV

SEQ ID NO: 1773081 - protein, 4 aa, Staphylococcus epidermidis
VTYS

SEQ ID NO: 1773082 - protein, 8 aa, Staphylococcus epidermidis
VYGDKQAF

SEQ ID NO: 1773083 - protein, 6 aa, Staphylococcus epidermidis
VYSTEP

SEQ ID NO: 1773084 - protein, 8 aa, Staphylococcus epidermidis
WDEKKPAC

SEQ ID NO: 1773085 - protein, 9 aa, Staphylococcus epidermidis
WKTDQADAH

SEQ ID NO: 1773086 - protein, 15 aa, Staphylococcus epidermidis
YARTIKGTKPTFKEE

SEQ ID NO: 1773087 - protein, 6 aa, Staphylococcus epidermidis
YATDPR

SEQ ID NO: 1773088 - protein, 9 aa, Staphylococcus epidermidis
YCKENSKGV

SEQ ID NO: 1773089 - protein, 13 aa, Staphylococcus epidermidis
YDASKPKLKGDQG

SEQ ID NO: 1773090 - protein, 5 aa, Staphylococcus epidermidis
YDENY

SEQ ID NO: 1773091 - protein, 10 aa, Staphylococcus epidermidis
YDIPTKKAPK

SEQ ID NO: 1773092 - protein, 18 aa, Staphylococcus epidermidis
YDKEGYRDEEFEKRDKGT

SEQ ID NO: 1773093 - protein, 5 aa, Staphylococcus epidermidis
YDNEE

SEQ ID NO: 1773094 - protein, 12 aa, Staphylococcus epidermidis
YDNQLNESQQRQ

SEQ ID NO: 1773095 - protein, 8 aa, Staphylococcus epidermidis
YDRDEPQV

SEQ ID NO: 1773096 - protein, 5 aa, Staphylococcus epidermidis
YDTVT

SEQ ID NO: 1773097 - protein, 12 aa, Staphylococcus epidermidis
YEADGKGKEPAV

SEQ ID NO: 1773098 - protein, 6 aa, Staphylococcus epidermidis
YEGEDM

SEQ ID NO: 1773099 - protein, 29 aa, Staphylococcus epidermidis
YEGESEITHNATGDKGGSKYQLKGVGQRE

SEQ ID NO: 1773100 - protein, 36 aa, Staphylococcus epidermidis
YEQAQQAQQQAQEEQGSQDSTVEDADFKEVKDDEDK

SEQ ID NO: 1773101 - protein, 19 aa, Staphylococcus epidermidis
YESQANTAKAQEILMNIRE

SEQ ID NO: 1773102 - protein, 9 aa, Staphylococcus epidermidis
YETSFQPDN

SEQ ID NO: 1773103 - protein, 5 aa, Staphylococcus epidermidis
YGGTA

SEQ ID NO: 1773104 - protein, 6 aa, Staphylococcus epidermidis
YGLSAQ

SEQ ID NO: 1773105 - protein, 6 aa, Staphylococcus epidermidis
YGTETI

SEQ ID NO: 1773106 - protein, 7 aa, Staphylococcus epidermidis
YGYPSDL

SEQ ID NO: 1773107 - protein, 11 aa, Staphylococcus epidermidis
YHPQKSLTEDE

SEQ ID NO: 1773108 - protein, 15 aa, Staphylococcus epidermidis
YIGEQNRKYVSIEER

SEQ ID NO: 1773109 - protein, 8 aa, Staphylococcus epidermidis
YKAGGLGD

SEQ ID NO: 1773110 - protein, 14 aa, Staphylococcus epidermidis
YKDEQAVQAHNQSD

SEQ ID NO: 1773111 - protein, 28 aa, Staphylococcus epidermidis
YKDGEISYNPNVPSYSAKYQLSNNGYNV

SEQ ID NO: 1773112 - protein, 5 aa, Staphylococcus epidermidis
YKEKN

SEQ ID NO: 1773113 - protein, 4 aa, Staphylococcus epidermidis
YKIG

SEQ ID NO: 1773114 - protein, 6 aa, Staphylococcus epidermidis
YKKRSV

SEQ ID NO: 1773115 - protein, 8 aa, Staphylococcus epidermidis
YKNDESNA

SEQ ID NO: 1773116 - protein, 8 aa, Staphylococcus epidermidis
YKNQTRLN

SEQ ID NO: 1773117 - protein, 12 aa, Staphylococcus epidermidis
YKSDEPSIPVTG

SEQ ID NO: 1773118 - protein, 5 aa, Staphylococcus epidermidis
YLPGK

SEQ ID NO: 1773119 - protein, 4 aa, Staphylococcus epidermidis
YNDG

SEQ ID NO: 1773120 - protein, 16 aa, Staphylococcus epidermidis
YNDNNTTPSDYFYITS

SEQ ID NO: 1773121 - protein, 14 aa, Staphylococcus epidermidis
YNFSSGESKSRSNI

SEQ ID NO: 1773122 - protein, 9 aa, Staphylococcus epidermidis
YNHQPSQQD

SEQ ID NO: 1773123 - protein, 11 aa, Staphylococcus epidermidis
YNNDRYQNKKN

SEQ ID NO: 1773124 - protein, 5 aa, Staphylococcus epidermidis
YNNTT

SEQ ID NO: 1773125 - protein, 7 aa, Staphylococcus epidermidis
YNQGSLD

SEQ ID NO: 1773126 - protein, 6 aa, Staphylococcus epidermidis
YNQSKA

SEQ ID NO: 1773127 - protein, 4 aa, Staphylococcus epidermidis
YNSD

SEQ ID NO: 1773128 - protein, 8 aa, Staphylococcus epidermidis
YNSDGTDK

SEQ ID NO: 1773129 - protein, 7 aa, Staphylococcus epidermidis
YPDEMGT

SEQ ID NO: 1773130 - protein, 4 aa, Staphylococcus epidermidis
YPKT

SEQ ID NO: 1773131 - protein, 8 aa, Staphylococcus epidermidis
YPRTDSNY

SEQ ID NO: 1773132 - protein, 14 aa, Staphylococcus epidermidis
YQADGKGKEPATVA

SEQ ID NO: 1773133 - protein, 8 aa, Staphylococcus epidermidis
YQDKGYGS

SEQ ID NO: 1773134 - protein, 6 aa, Staphylococcus epidermidis
YQGGVS

SEQ ID NO: 1773135 - protein, 4 aa, Staphylococcus epidermidis
YQGQ

SEQ ID NO: 1773136 - protein, 8 aa, Staphylococcus epidermidis
YQPKPGTD

SEQ ID NO: 1773137 - protein, 5 aa, Staphylococcus epidermidis
YQPQV

SEQ ID NO: 1773138 - protein, 16 aa, Staphylococcus epidermidis
YRKAAQSLEVDERTLE

SEQ ID NO: 1773139 - protein, 4 aa, Staphylococcus epidermidis
YRKI

SEQ ID NO: 1773140 - protein, 9 aa, Staphylococcus epidermidis
YRQQDGSSI

SEQ ID NO: 1773141 - protein, 8 aa, Staphylococcus epidermidis
YSATKHSV

SEQ ID NO: 1773142 - protein, 5 aa, Staphylococcus epidermidis
YSETM

SEQ ID NO: 1773143 - protein, 8 aa, Staphylococcus epidermidis
YSGKDSDY

SEQ ID NO: 1773144 - protein, 4 aa, Staphylococcus epidermidis
YSIE

SEQ ID NO: 1773145 - protein, 11 aa, Staphylococcus epidermidis
YSKDVSHTARK

SEQ ID NO: 1773146 - protein, 6 aa, Staphylococcus epidermidis
YSKEKN

SEQ ID NO: 1773147 - protein, 23 aa, Staphylococcus epidermidis
YSKGIDKSSPFFKGDGNTVKNGD

SEQ ID NO: 1773148 - protein, 9 aa, Staphylococcus epidermidis
YSSDSKEET

SEQ ID NO: 1773149 - protein, 8 aa, Staphylococcus epidermidis
YSTDGRIS

SEQ ID NO: 1773150 - protein, 14 aa, Staphylococcus epidermidis
YSTNELSDTGLRAA

SEQ ID NO: 1773151 - protein, 6 aa, Staphylococcus epidermidis
YSTSEN

SEQ ID NO: 1773152 - protein, 4 aa, Staphylococcus epidermidis
YSYD

SEQ ID NO: 1773153 - protein, 6 aa, Staphylococcus epidermidis
YTGTEL

SEQ ID NO: 1773154 - protein, 6 aa, Staphylococcus epidermidis
YTNKTD

SEQ ID NO: 1773155 - protein, 23 aa, Staphylococcus epidermidis
YTQYQNQYEQEQLEQQRKYEQYI

SEQ ID NO: 1773156 - protein, 21 aa, Staphylococcus epidermidis
YTQYQNQYEQEQLEQQRQYEQ

SEQ ID NO: 1773157 - protein, 11 aa, Staphylococcus epidermidis
YVPNDNKNLAY

SEQ ID NO: 1773158 - protein, 9 aa, Staphylococcus epidermidis
YWRGNSDNK

SEQ ID NO: 1773159 - protein, 14 aa, Staphylococcus epidermidis
YYDQDQQDNITGKS

SEQ ID NO: 1773160 - protein, 13 aa, Staphylococcus epidermidis
YYYEGDGNRVPYS

SEQ ID NO: 1773161 - protein, 6 aa, Staphylococcus epidermidis
AAAFSS

SEQ ID NO: 1773162 - protein, 9 aa, Staphylococcus epidermidis
AAAGKSTIA

SEQ ID NO: 1773163 - protein, 11 aa, Staphylococcus epidermidis
AAAGKSTIAKQ

SEQ ID NO: 1773164 - protein, 9 aa, Staphylococcus epidermidis
AAAKELNNA

SEQ ID NO: 1773165 - protein, 17 aa, Staphylococcus epidermidis
AAALSGTTHPIDRHETQ

SEQ ID NO: 1773166 - protein, 10 aa, Staphylococcus epidermidis
AADAPNHGMR

SEQ ID NO: 1773167 - protein, 4 aa, Staphylococcus epidermidis
AADI

SEQ ID NO: 1773168 - protein, 11 aa, Staphylococcus epidermidis
AADPGSTNTDL

SEQ ID NO: 1773169 - protein, 12 aa, Staphylococcus epidermidis
AAEASGADMATT

SEQ ID NO: 1773170 - protein, 10 aa, Staphylococcus epidermidis
AAEDSGREEE

SEQ ID NO: 1773171 - protein, 7 aa, Staphylococcus epidermidis
AAEKGAE

SEQ ID NO: 1773172 - protein, 7 aa, Staphylococcus epidermidis
AAENGGN

SEQ ID NO: 1773173 - protein, 6 aa, Staphylococcus epidermidis
AAENKE

SEQ ID NO: 1773174 - protein, 6 aa, Staphylococcus epidermidis
AAENYD

SEQ ID NO: 1773175 - protein, 8 aa, Staphylococcus epidermidis
AAEQAGIE

SEQ ID NO: 1773176 - protein, 8 aa, Staphylococcus epidermidis
AAESGVAP

SEQ ID NO: 1773177 - protein, 6 aa, Staphylococcus epidermidis
AAESLG

SEQ ID NO: 1773178 - protein, 11 aa, Staphylococcus epidermidis
AAETGKPVEEV

SEQ ID NO: 1773179 - protein, 7 aa, Staphylococcus epidermidis
AAGAYTA

SEQ ID NO: 1773180 - protein, 11 aa, Staphylococcus epidermidis
AAGEGANTKKH

SEQ ID NO: 1773181 - protein, 18 aa, Staphylococcus epidermidis
AAGLVSGAAHSTGDTVRP

SEQ ID NO: 1773182 - protein, 15 aa, Staphylococcus epidermidis
AAGSGDFAGNRADPI

SEQ ID NO: 1773183 - protein, 15 aa, Staphylococcus epidermidis
AAHGYGGKQTPKVTS

SEQ ID NO: 1773184 - protein, 10 aa, Staphylococcus epidermidis
AAHYGASKAA

SEQ ID NO: 1773185 - protein, 21 aa, Staphylococcus epidermidis
AAIASGREISAFPKKSGEPNL

SEQ ID NO: 1773186 - protein, 12 aa, Staphylococcus epidermidis
AAIEKAELRKNR

SEQ ID NO: 1773187 - protein, 7 aa, Staphylococcus epidermidis
AAINENT

SEQ ID NO: 1773188 - protein, 7 aa, Staphylococcus epidermidis
AAISDGK

SEQ ID NO: 1773189 - protein, 9 aa, Staphylococcus epidermidis
AAKAKADKF

SEQ ID NO: 1773190 - protein, 11 aa, Staphylococcus epidermidis
AAKESLDNTPN

SEQ ID NO: 1773191 - protein, 9 aa, Staphylococcus epidermidis
AAKRRGMNV

SEQ ID NO: 1773192 - protein, 19 aa, Staphylococcus epidermidis
AALDGEHKLQQAKENANNL

SEQ ID NO: 1773193 - protein, 10 aa, Staphylococcus epidermidis
AAMANGGVSG

SEQ ID NO: 1773194 - protein, 6 aa, Staphylococcus epidermidis
AAMESG

SEQ ID NO: 1773195 - protein, 6 aa, Staphylococcus epidermidis
AANDNP

SEQ ID NO: 1773196 - protein, 6 aa, Staphylococcus epidermidis
AANINR

SEQ ID NO: 1773197 - protein, 7 aa, Staphylococcus epidermidis
AANKPEA

SEQ ID NO: 1773198 - protein, 9 aa, Staphylococcus epidermidis
AANNPTTDS

SEQ ID NO: 1773199 - protein, 7 aa, Staphylococcus epidermidis
AANTPEK

SEQ ID NO: 1773200 - protein, 9 aa, Staphylococcus epidermidis
AAPDRIAGR

SEQ ID NO: 1773201 - protein, 6 aa, Staphylococcus epidermidis
AAPEEN

SEQ ID NO: 1773202 - protein, 9 aa, Staphylococcus epidermidis
AAPEQYDAS

SEQ ID NO: 1773203 - protein, 9 aa, Staphylococcus epidermidis
AAPTTSSVG

SEQ ID NO: 1773204 - protein, 18 aa, Staphylococcus epidermidis
AAPTTTSTTTTSSLTSNS

SEQ ID NO: 1773205 - protein, 16 aa, Staphylococcus epidermidis
AAQEGDYDKAESLIEE

SEQ ID NO: 1773206 - protein, 5 aa, Staphylococcus epidermidis
AAQEL

SEQ ID NO: 1773207 - protein, 41 aa, Staphylococcus epidermidis
AAQPTTPSTSTPTSPTTNTKEKVTPVDNGDGTFTATITPTK

SEQ ID NO: 1773208 - protein, 9 aa, Staphylococcus epidermidis
AAQRPGSVT

SEQ ID NO: 1773209 - protein, 6 aa, Staphylococcus epidermidis
AAQYGV

SEQ ID NO: 1773210 - protein, 6 aa, Staphylococcus epidermidis
AARQHD

SEQ ID NO: 1773211 - protein, 8 aa, Staphylococcus epidermidis
AARSDSFG

SEQ ID NO: 1773212 - protein, 5 aa, Staphylococcus epidermidis
AARVK

SEQ ID NO: 1773213 - protein, 4 aa, Staphylococcus epidermidis
AASA

SEQ ID NO: 1773214 - protein, 6 aa, Staphylococcus epidermidis
AASATA

SEQ ID NO: 1773215 - protein, 8 aa, Staphylococcus epidermidis
AASEKNES

SEQ ID NO: 1773216 - protein, 24 aa, Staphylococcus epidermidis
AASETPVTSEISSNSTTVGDQTST

SEQ ID NO: 1773217 - protein, 6 aa, Staphylococcus epidermidis
AASKGG

SEQ ID NO: 1773218 - protein, 8 aa, Staphylococcus epidermidis
AASLDSQE

SEQ ID NO: 1773219 - protein, 15 aa, Staphylococcus epidermidis
AASPHGTPGDRKLKQ

SEQ ID NO: 1773220 - protein, 16 aa, Staphylococcus epidermidis
AASPHGTPGDRKLQNN

SEQ ID NO: 1773221 - protein, 7 aa, Staphylococcus epidermidis
AASRTQH

SEQ ID NO: 1773222 - protein, 7 aa, Staphylococcus epidermidis
AASVPEL

SEQ ID NO: 1773223 - protein, 17 aa, Staphylococcus epidermidis
AATNTFKSRTSLGEATD

SEQ ID NO: 1773224 - protein, 7 aa, Staphylococcus epidermidis
AAYDQGA

SEQ ID NO: 1773225 - protein, 9 aa, Staphylococcus epidermidis
AAYEESDSN

SEQ ID NO: 1773226 - protein, 13 aa, Staphylococcus epidermidis
ACDSTLKDAEKKV

SEQ ID NO: 1773227 - protein, 5 aa, Staphylococcus epidermidis
ADADS

SEQ ID NO: 1773228 - protein, 15 aa, Staphylococcus epidermidis
ADAGSKLTKAEKFGT

SEQ ID NO: 1773229 - protein, 9 aa, Staphylococcus epidermidis
ADAGYTQTD

SEQ ID NO: 1773230 - protein, 7 aa, Staphylococcus epidermidis
ADALSRD

SEQ ID NO: 1773231 - protein, 7 aa, Staphylococcus epidermidis
ADASGVD

SEQ ID NO: 1773232 - protein, 7 aa, Staphylococcus epidermidis
ADATGNV

SEQ ID NO: 1773233 - protein, 5 aa, Staphylococcus epidermidis
ADDAL

SEQ ID NO: 1773234 - protein, 7 aa, Staphylococcus epidermidis
ADDELGE

SEQ ID NO: 1773235 - protein, 11 aa, Staphylococcus epidermidis
ADDEPVKGSDF

SEQ ID NO: 1773236 - protein, 7 aa, Staphylococcus epidermidis
ADDSLND

SEQ ID NO: 1773237 - protein, 7 aa, Staphylococcus epidermidis
ADDTPDH

SEQ ID NO: 1773238 - protein, 5 aa, Staphylococcus epidermidis
ADDVF

SEQ ID NO: 1773239 - protein, 7 aa, Staphylococcus epidermidis
ADDYRKY

SEQ ID NO: 1773240 - protein, 10 aa, Staphylococcus epidermidis
ADEAQTESEF

SEQ ID NO: 1773241 - protein, 8 aa, Staphylococcus epidermidis
ADEDLKDQ

SEQ ID NO: 1773242 - protein, 9 aa, Staphylococcus epidermidis
ADEENNQRH

SEQ ID NO: 1773243 - protein, 10 aa, Staphylococcus epidermidis
ADEERPLPTT

SEQ ID NO: 1773244 - protein, 9 aa, Staphylococcus epidermidis
ADEKSIKGI

SEQ ID NO: 1773245 - protein, 12 aa, Staphylococcus epidermidis
ADENQDTSDLAY

SEQ ID NO: 1773246 - protein, 10 aa, Staphylococcus epidermidis
ADENRTSSYD

SEQ ID NO: 1773247 - protein, 5 aa, Staphylococcus epidermidis
ADERE

SEQ ID NO: 1773248 - protein, 5 aa, Staphylococcus epidermidis
ADESV

SEQ ID NO: 1773249 - protein, 17 aa, Staphylococcus epidermidis
ADETEKVNYKKKYDTLQ

SEQ ID NO: 1773250 - protein, 5 aa, Staphylococcus epidermidis
ADEVT

SEQ ID NO: 1773251 - protein, 6 aa, Staphylococcus epidermidis
ADEVTE

SEQ ID NO: 1773252 - protein, 5 aa, Staphylococcus epidermidis
ADGEG

SEQ ID NO: 1773253 - protein, 11 aa, Staphylococcus epidermidis
ADGGEGTTEAL

SEQ ID NO: 1773254 - protein, 4 aa, Staphylococcus epidermidis
ADGH

SEQ ID NO: 1773255 - protein, 4 aa, Staphylococcus epidermidis
ADGI

SEQ ID NO: 1773256 - protein, 9 aa, Staphylococcus epidermidis
ADGKSPMSV

SEQ ID NO: 1773257 - protein, 15 aa, Staphylococcus epidermidis
ADGSMKRYEALKRIE

SEQ ID NO: 1773258 - protein, 15 aa, Staphylococcus epidermidis
ADGSMKRYEALKRIK

SEQ ID NO: 1773259 - protein, 5 aa, Staphylococcus epidermidis
ADGTE

SEQ ID NO: 1773260 - protein, 10 aa, Staphylococcus epidermidis
ADHAEPKSIA

SEQ ID NO: 1773261 - protein, 7 aa, Staphylococcus epidermidis
ADHGEYG

SEQ ID NO: 1773262 - protein, 5 aa, Staphylococcus epidermidis
ADHKR

SEQ ID NO: 1773263 - protein, 13 aa, Staphylococcus epidermidis
ADIDAQKKEFEEL

SEQ ID NO: 1773264 - protein, 5 aa, Staphylococcus epidermidis
ADIEE

SEQ ID NO: 1773265 - protein, 4 aa, Staphylococcus epidermidis
ADIL

SEQ ID NO: 1773266 - protein, 9 aa, Staphylococcus epidermidis
ADIQEGGQY

SEQ ID NO: 1773267 - protein, 8 aa, Staphylococcus epidermidis
ADKDGGEI

SEQ ID NO: 1773268 - protein, 9 aa, Staphylococcus epidermidis
ADKDGGEMI

SEQ ID NO: 1773269 - protein, 8 aa, Staphylococcus epidermidis
ADKEESNE

SEQ ID NO: 1773270 - protein, 16 aa, Staphylococcus epidermidis
ADKESSDLTGSEQEAD

SEQ ID NO: 1773271 - protein, 10 aa, Staphylococcus epidermidis
ADKEYENGSL

SEQ ID NO: 1773272 - protein, 18 aa, Staphylococcus epidermidis
ADKFEEKDLEESDVFGLF

SEQ ID NO: 1773273 - protein, 7 aa, Staphylococcus epidermidis
ADKGELP

SEQ ID NO: 1773274 - protein, 5 aa, Staphylococcus epidermidis
ADKGW

SEQ ID NO: 1773275 - protein, 16 aa, Staphylococcus epidermidis
ADKHPEIKDYSDEERL

SEQ ID NO: 1773276 - protein, 12 aa, Staphylococcus epidermidis
ADKLAERKKRIE

SEQ ID NO: 1773277 - protein, 8 aa, Staphylococcus epidermidis
ADKPEEKF

SEQ ID NO: 1773278 - protein, 12 aa, Staphylococcus epidermidis
ADKQAAQQSLPT

SEQ ID NO: 1773279 - protein, 5 aa, Staphylococcus epidermidis
ADKRT

SEQ ID NO: 1773280 - protein, 10 aa, Staphylococcus epidermidis
ADKSENADYQ

SEQ ID NO: 1773281 - protein, 65 aa, Staphylococcus epidermidis
ADKTDENDDESDDTGSDKQSKSDDKSSDKHKSDSSSKSDSKNSSSSDSKKDSNSNSNNKSSSNDD

SEQ ID NO: 1773282 - protein, 11 aa, Staphylococcus epidermidis
ADKVSLNSSAL

SEQ ID NO: 1773283 - protein, 25 aa, Staphylococcus epidermidis
ADLAGSNKSNVKEAKDYDKETPEGK

SEQ ID NO: 1773284 - protein, 5 aa, Staphylococcus epidermidis
ADLDK

SEQ ID NO: 1773285 - protein, 6 aa, Staphylococcus epidermidis
ADLPNQ

SEQ ID NO: 1773286 - protein, 25 aa, Staphylococcus epidermidis
ADLSSQDVAEATRIQYGGSVKPNNI

SEQ ID NO: 1773287 - protein, 8 aa, Staphylococcus epidermidis
ADMTGEEA

SEQ ID NO: 1773288 - protein, 4 aa, Staphylococcus epidermidis
ADNH

SEQ ID NO: 1773289 - protein, 7 aa, Staphylococcus epidermidis
ADNPQEV

SEQ ID NO: 1773290 - protein, 4 aa, Staphylococcus epidermidis
ADNV

SEQ ID NO: 1773291 - protein, 5 aa, Staphylococcus epidermidis
ADNVT

SEQ ID NO: 1773292 - protein, 6 aa, Staphylococcus epidermidis
ADNYDD

SEQ ID NO: 1773293 - protein, 8 aa, Staphylococcus epidermidis
ADPHEIES

SEQ ID NO: 1773294 - protein, 4 aa, Staphylococcus epidermidis
ADPT

SEQ ID NO: 1773295 - protein, 6 aa, Staphylococcus epidermidis
ADPTSP

SEQ ID NO: 1773296 - protein, 12 aa, Staphylococcus epidermidis
ADQLGQRAGAGA

SEQ ID NO: 1773297 - protein, 8 aa, Staphylococcus epidermidis
ADQNNQVS

SEQ ID NO: 1773298 - protein, 8 aa, Staphylococcus epidermidis
ADQQTSES

SEQ ID NO: 1773299 - protein, 19 aa, Staphylococcus epidermidis
ADQSAEKKKGKAKRKDIKE

SEQ ID NO: 1773300 - protein, 9 aa, Staphylococcus epidermidis
ADQVTYDEY

SEQ ID NO: 1773301 - protein, 14 aa, Staphylococcus epidermidis
ADRDESVDDEDERT

SEQ ID NO: 1773302 - protein, 6 aa, Staphylococcus epidermidis
ADRGIS

SEQ ID NO: 1773303 - protein, 14 aa, Staphylococcus epidermidis
ADRGVSGKSMNRPE

SEQ ID NO: 1773304 - protein, 11 aa, Staphylococcus epidermidis
ADSAEPKSIAE

SEQ ID NO: 1773305 - protein, 9 aa, Staphylococcus epidermidis
ADSAGRGYR

SEQ ID NO: 1773306 - protein, 7 aa, Staphylococcus epidermidis
ADSEYES

SEQ ID NO: 1773307 - protein, 10 aa, Staphylococcus epidermidis
ADSGAIGGNH

SEQ ID NO: 1773308 - protein, 9 aa, Staphylococcus epidermidis
ADSKEEALE

SEQ ID NO: 1773309 - protein, 6 aa, Staphylococcus epidermidis
ADSQAE

SEQ ID NO: 1773310 - protein, 7 aa, Staphylococcus epidermidis
ADSSLAN

SEQ ID NO: 1773311 - protein, 8 aa, Staphylococcus epidermidis
ADSTFNDS

SEQ ID NO: 1773312 - protein, 4 aa, Staphylococcus epidermidis
ADSV

SEQ ID NO: 1773313 - protein, 6 aa, Staphylococcus epidermidis
ADTDRG

SEQ ID NO: 1773314 - protein, 16 aa, Staphylococcus epidermidis
ADTETIGCSPDGYNIN

SEQ ID NO: 1773315 - protein, 7 aa, Staphylococcus epidermidis
ADTGVDP

SEQ ID NO: 1773316 - protein, 8 aa, Staphylococcus epidermidis
ADTKDGRH

SEQ ID NO: 1773317 - protein, 5 aa, Staphylococcus epidermidis
ADTLA

SEQ ID NO: 1773318 - protein, 5 aa, Staphylococcus epidermidis
ADTNE

SEQ ID NO: 1773319 - protein, 15 aa, Staphylococcus epidermidis
ADTPEKVDRLEREDD

SEQ ID NO: 1773320 - protein, 5 aa, Staphylococcus epidermidis
ADTSL

SEQ ID NO: 1773321 - protein, 9 aa, Staphylococcus epidermidis
ADVKRQGDD

SEQ ID NO: 1773322 - protein, 9 aa, Staphylococcus epidermidis
ADVKRSGED

SEQ ID NO: 1773323 - protein, 11 aa, Staphylococcus epidermidis
ADVKTSQPPIG

SEQ ID NO: 1773324 - protein, 8 aa, Staphylococcus epidermidis
ADVSPNNR

SEQ ID NO: 1773325 - protein, 15 aa, Staphylococcus epidermidis
ADYEPHSLSGGQKQR

SEQ ID NO: 1773326 - protein, 6 aa, Staphylococcus epidermidis
AEAAEY

SEQ ID NO: 1773327 - protein, 8 aa, Staphylococcus epidermidis
AEAANEID

SEQ ID NO: 1773328 - protein, 6 aa, Staphylococcus epidermidis
AEAEAH

SEQ ID NO: 1773329 - protein, 5 aa, Staphylococcus epidermidis
AEAQA

SEQ ID NO: 1773330 - protein, 4 aa, Staphylococcus epidermidis
AEAT

SEQ ID NO: 1773331 - protein, 6 aa, Staphylococcus epidermidis
AEATAE

SEQ ID NO: 1773332 - protein, 4 aa, Staphylococcus epidermidis
AEAY

SEQ ID NO: 1773333 - protein, 8 aa, Staphylococcus epidermidis
AEDDAKMN

SEQ ID NO: 1773334 - protein, 6 aa, Staphylococcus epidermidis
AEDDES

SEQ ID NO: 1773335 - protein, 4 aa, Staphylococcus epidermidis
AEDG

SEQ ID NO: 1773336 - protein, 19 aa, Staphylococcus epidermidis
AEDNQLESASKEEQKGSRD

SEQ ID NO: 1773337 - protein, 27 aa, Staphylococcus epidermidis
AEDPREKAKLEKESKAKEISARRIFSF

SEQ ID NO: 1773338 - protein, 5 aa, Staphylococcus epidermidis
AEDTI

SEQ ID NO: 1773339 - protein, 8 aa, Staphylococcus epidermidis
AEDVGTSE

SEQ ID NO: 1773340 - protein, 7 aa, Staphylococcus epidermidis
AEEAKSY

SEQ ID NO: 1773341 - protein, 12 aa, Staphylococcus epidermidis
AEEALQSGEGME

SEQ ID NO: 1773342 - protein, 14 aa, Staphylococcus epidermidis
AEEAVEKAKELNSD

SEQ ID NO: 1773343 - protein, 6 aa, Staphylococcus epidermidis
AEEDNN

SEQ ID NO: 1773344 - protein, 7 aa, Staphylococcus epidermidis
AEEFSER

SEQ ID NO: 1773345 - protein, 7 aa, Staphylococcus epidermidis
AEEIADS

SEQ ID NO: 1773346 - protein, 8 aa, Staphylococcus epidermidis
AEEISDSR

SEQ ID NO: 1773347 - protein, 6 aa, Staphylococcus epidermidis
AEEKGH

SEQ ID NO: 1773348 - protein, 12 aa, Staphylococcus epidermidis
AEEKVSEGSTKA

SEQ ID NO: 1773349 - protein, 5 aa, Staphylococcus epidermidis
AEEND

SEQ ID NO: 1773350 - protein, 20 aa, Staphylococcus epidermidis
AEEPAHGKVRQSKGDVISWI

SEQ ID NO: 1773351 - protein, 16 aa, Staphylococcus epidermidis
AEEQDLATAKKKDSTG

SEQ ID NO: 1773352 - protein, 5 aa, Staphylococcus epidermidis
AEERK

SEQ ID NO: 1773353 - protein, 9 aa, Staphylococcus epidermidis
AEERTIKGS

SEQ ID NO: 1773354 - protein, 6 aa, Staphylococcus epidermidis
AEGDIS

SEQ ID NO: 1773355 - protein, 7 aa, Staphylococcus epidermidis
AEGDVDG

SEQ ID NO: 1773356 - protein, 8 aa, Staphylococcus epidermidis
AEGGHTIS

SEQ ID NO: 1773357 - protein, 9 aa, Staphylococcus epidermidis
AEGGHTISN

SEQ ID NO: 1773358 - protein, 12 aa, Staphylococcus epidermidis
AEGHTLDKVRII

SEQ ID NO: 1773359 - protein, 8 aa, Staphylococcus epidermidis
AEGKVVKG

SEQ ID NO: 1773360 - protein, 8 aa, Staphylococcus epidermidis
AEGLNESP

SEQ ID NO: 1773361 - protein, 11 aa, Staphylococcus epidermidis
AEGTEGKNGEI

SEQ ID NO: 1773362 - protein, 9 aa, Staphylococcus epidermidis
AEHGQGPAF

SEQ ID NO: 1773363 - protein, 12 aa, Staphylococcus epidermidis
AEIDESSDTSMK

SEQ ID NO: 1773364 - protein, 5 aa, Staphylococcus epidermidis
AEIDN

SEQ ID NO: 1773365 - protein, 10 aa, Staphylococcus epidermidis
AEIDNKTNHV

SEQ ID NO: 1773366 - protein, 7 aa, Staphylococcus epidermidis
AEIDPET

SEQ ID NO: 1773367 - protein, 12 aa, Staphylococcus epidermidis
AEIEKAELRKNR

SEQ ID NO: 1773368 - protein, 7 aa, Staphylococcus epidermidis
AEKGEEV

SEQ ID NO: 1773369 - protein, 7 aa, Staphylococcus epidermidis
AEKGPYT

SEQ ID NO: 1773370 - protein, 19 aa, Staphylococcus epidermidis
AEKGQEALKELSKKSQQEI

SEQ ID NO: 1773371 - protein, 20 aa, Staphylococcus epidermidis
AEKGQEALKELSKKSQQEIN

SEQ ID NO: 1773372 - protein, 6 aa, Staphylococcus epidermidis
AEKGTY

SEQ ID NO: 1773373 - protein, 13 aa, Staphylococcus epidermidis
AEKIEQGIKRGKK

SEQ ID NO: 1773374 - protein, 13 aa, Staphylococcus epidermidis
AEKKAPGAKIQGD

SEQ ID NO: 1773375 - protein, 4 aa, Staphylococcus epidermidis
AEKN

SEQ ID NO: 1773376 - protein, 11 aa, Staphylococcus epidermidis
AEKQHDEVTEQ

SEQ ID NO: 1773377 - protein, 6 aa, Staphylococcus epidermidis
AEKRDI

SEQ ID NO: 1773378 - protein, 8 aa, Staphylococcus epidermidis
AEKTNSVG

SEQ ID NO: 1773379 - protein, 10 aa, Staphylococcus epidermidis
AEKTTNIKQN

SEQ ID NO: 1773380 - protein, 14 aa, Staphylococcus epidermidis
AELAEEKNETEQKL

SEQ ID NO: 1773381 - protein, 9 aa, Staphylococcus epidermidis
AELNPTPKW

SEQ ID NO: 1773382 - protein, 23 aa, Staphylococcus epidermidis
AELPRDEVQTVSTKTPYVSTGSD

SEQ ID NO: 1773383 - protein, 20 aa, Staphylococcus epidermidis
AEMTGRNDIQVGEAKISGNA

SEQ ID NO: 1773384 - protein, 12 aa, Staphylococcus epidermidis
AENAAHGKGLTE

SEQ ID NO: 1773385 - protein, 9 aa, Staphylococcus epidermidis
AENDDDQFK

SEQ ID NO: 1773386 - protein, 4 aa, Staphylococcus epidermidis
AENE

SEQ ID NO: 1773387 - protein, 7 aa, Staphylococcus epidermidis
AENEDDL

SEQ ID NO: 1773388 - protein, 6 aa, Staphylococcus epidermidis
AENEEL

SEQ ID NO: 1773389 - protein, 5 aa, Staphylococcus epidermidis
AENEI

SEQ ID NO: 1773390 - protein, 5 aa, Staphylococcus epidermidis
AENGI

SEQ ID NO: 1773391 - protein, 16 aa, Staphylococcus epidermidis
AENGQRAVEELYKAFD

SEQ ID NO: 1773392 - protein, 9 aa, Staphylococcus epidermidis
AENGYPVTN

SEQ ID NO: 1773393 - protein, 6 aa, Staphylococcus epidermidis
AENKDS

SEQ ID NO: 1773394 - protein, 9 aa, Staphylococcus epidermidis
AENKKAEDI

SEQ ID NO: 1773395 - protein, 8 aa, Staphylococcus epidermidis
AENLSDRA

SEQ ID NO: 1773396 - protein, 6 aa, Staphylococcus epidermidis
AENNDE

SEQ ID NO: 1773397 - protein, 11 aa, Staphylococcus epidermidis
AENNQKNYEKD

SEQ ID NO: 1773398 - protein, 6 aa, Staphylococcus epidermidis
AENPYK

SEQ ID NO: 1773399 - protein, 7 aa, Staphylococcus epidermidis
AENSGHV

SEQ ID NO: 1773400 - protein, 12 aa, Staphylococcus epidermidis
AENTYTCRFCFR

SEQ ID NO: 1773401 - protein, 18 aa, Staphylococcus epidermidis
AENVEVSDEDIDKELEKM

SEQ ID NO: 1773402 - protein, 8 aa, Staphylococcus epidermidis
AEPQQEAK

SEQ ID NO: 1773403 - protein, 4 aa, Staphylococcus epidermidis
AEQA

SEQ ID NO: 1773404 - protein, 7 aa, Staphylococcus epidermidis
AEQAQEQ

SEQ ID NO: 1773405 - protein, 8 aa, Staphylococcus epidermidis
AEQGAPDE

SEQ ID NO: 1773406 - protein, 11 aa, Staphylococcus epidermidis
AEQNEAKPTHK

SEQ ID NO: 1773407 - protein, 6 aa, Staphylococcus epidermidis
AEQPHK

SEQ ID NO: 1773408 - protein, 4 aa, Staphylococcus epidermidis
AEQY

SEQ ID NO: 1773409 - protein, 4 aa, Staphylococcus epidermidis
AERC

SEQ ID NO: 1773410 - protein, 23 aa, Staphylococcus epidermidis
AEREGKIKPGDTIVEPTSGNTGI

SEQ ID NO: 1773411 - protein, 4 aa, Staphylococcus epidermidis
AERG

SEQ ID NO: 1773412 - protein, 6 aa, Staphylococcus epidermidis
AERHRE

SEQ ID NO: 1773413 - protein, 10 aa, Staphylococcus epidermidis
AERLEEDSSQ

SEQ ID NO: 1773414 - protein, 6 aa, Staphylococcus epidermidis
AERNDG

SEQ ID NO: 1773415 - protein, 4 aa, Staphylococcus epidermidis
AERQ

SEQ ID NO: 1773416 - protein, 6 aa, Staphylococcus epidermidis
AERQGV

SEQ ID NO: 1773417 - protein, 4 aa, Staphylococcus epidermidis
AERT

SEQ ID NO: 1773418 - protein, 5 aa, Staphylococcus epidermidis
AESDH

SEQ ID NO: 1773419 - protein, 5 aa, Staphylococcus epidermidis
AESEL

SEQ ID NO: 1773420 - protein, 5 aa, Staphylococcus epidermidis
AESER

SEQ ID NO: 1773421 - protein, 9 aa, Staphylococcus epidermidis
AESIEDSNI

SEQ ID NO: 1773422 - protein, 17 aa, Staphylococcus epidermidis
AESQNSGTNKQKKPEFT

SEQ ID NO: 1773423 - protein, 12 aa, Staphylococcus epidermidis
AESYGKGDYRES

SEQ ID NO: 1773424 - protein, 7 aa, Staphylococcus epidermidis
AESYNHQ

SEQ ID NO: 1773425 - protein, 17 aa, Staphylococcus epidermidis
AETDQKSKKNKTVNAGS

SEQ ID NO: 1773426 - protein, 5 aa, Staphylococcus epidermidis
AETDY

SEQ ID NO: 1773427 - protein, 22 aa, Staphylococcus epidermidis
AETFRKQSQSLLQQSKPTLSIN

SEQ ID NO: 1773428 - protein, 4 aa, Staphylococcus epidermidis
AETH

SEQ ID NO: 1773429 - protein, 18 aa, Staphylococcus epidermidis
AETIPDTEFDEFRYHRGL

SEQ ID NO: 1773430 - protein, 11 aa, Staphylococcus epidermidis
AETIPTEDRET

SEQ ID NO: 1773431 - protein, 5 aa, Staphylococcus epidermidis
AETIV

SEQ ID NO: 1773432 - protein, 8 aa, Staphylococcus epidermidis
AETKSASI

SEQ ID NO: 1773433 - protein, 10 aa, Staphylococcus epidermidis
AETKSSPTPV

SEQ ID NO: 1773434 - protein, 10 aa, Staphylococcus epidermidis
AETLNGEALP

SEQ ID NO: 1773435 - protein, 16 aa, Staphylococcus epidermidis
AETPQDIKAGYDFGSK

SEQ ID NO: 1773436 - protein, 8 aa, Staphylococcus epidermidis
AETPQDIQ

SEQ ID NO: 1773437 - protein, 9 aa, Staphylococcus epidermidis
AETTSEKNA

SEQ ID NO: 1773438 - protein, 8 aa, Staphylococcus epidermidis
AEVDTERQ

SEQ ID NO: 1773439 - protein, 4 aa, Staphylococcus epidermidis
AEVP

SEQ ID NO: 1773440 - protein, 17 aa, Staphylococcus epidermidis
AEWQGHQKGTHQEAKRG

SEQ ID NO: 1773441 - protein, 13 aa, Staphylococcus epidermidis
AEYQSQQDEHSAA

SEQ ID NO: 1773442 - protein, 19 aa, Staphylococcus epidermidis
AFDRGKDKFQNNIKKYIEG

SEQ ID NO: 1773443 - protein, 14 aa, Staphylococcus epidermidis
AFGASTPKVNTPQV

SEQ ID NO: 1773444 - protein, 18 aa, Staphylococcus epidermidis
AFKEAHKNTGKSEDSPVI

SEQ ID NO: 1773445 - protein, 5 aa, Staphylococcus epidermidis
AFKNE

SEQ ID NO: 1773446 - protein, 9 aa, Staphylococcus epidermidis
AFKPTSEDS

SEQ ID NO: 1773447 - protein, 10 aa, Staphylococcus epidermidis
AFNASDDTTL

SEQ ID NO: 1773448 - protein, 70 aa, Staphylococcus epidermidis
AFNEAKNEAAGVSRGLDDAASGLKDVGDSAGSAGSGLGKTAKGADKASDSLDGTNKELEKTKEKAEEAGV

SEQ ID NO: 1773449 - protein, 5 aa, Staphylococcus epidermidis
AFNPD

SEQ ID NO: 1773450 - protein, 7 aa, Staphylococcus epidermidis
AFPDNHE

SEQ ID NO: 1773451 - protein, 6 aa, Staphylococcus epidermidis
AFPDTH

SEQ ID NO: 1773452 - protein, 6 aa, Staphylococcus epidermidis
AFQETN

SEQ ID NO: 1773453 - protein, 5 aa, Staphylococcus epidermidis
AFSEN

SEQ ID NO: 1773454 - protein, 4 aa, Staphylococcus epidermidis
AFTG

SEQ ID NO: 1773455 - protein, 13 aa, Staphylococcus epidermidis
AFTPEDRGKVKDK

SEQ ID NO: 1773456 - protein, 6 aa, Staphylococcus epidermidis
AFTPTN

SEQ ID NO: 1773457 - protein, 6 aa, Staphylococcus epidermidis
AGAAAS

SEQ ID NO: 1773458 - protein, 4 aa, Staphylococcus epidermidis
AGAD

SEQ ID NO: 1773459 - protein, 9 aa, Staphylococcus epidermidis
AGADQSIVQ

SEQ ID NO: 1773460 - protein, 7 aa, Staphylococcus epidermidis
AGADSAL

SEQ ID NO: 1773461 - protein, 8 aa, Staphylococcus epidermidis
AGANAEDL

SEQ ID NO: 1773462 - protein, 6 aa, Staphylococcus epidermidis
AGAQPV

SEQ ID NO: 1773463 - protein, 5 aa, Staphylococcus epidermidis
AGCTG

SEQ ID NO: 1773464 - protein, 9 aa, Staphylococcus epidermidis
AGCVNDTPA

SEQ ID NO: 1773465 - protein, 6 aa, Staphylococcus epidermidis
AGDETA

SEQ ID NO: 1773466 - protein, 9 aa, Staphylococcus epidermidis
AGDFDSSKT

SEQ ID NO: 1773467 - protein, 8 aa, Staphylococcus epidermidis
AGDPLSPE

SEQ ID NO: 1773468 - protein, 11 aa, Staphylococcus epidermidis
AGDSNRKNQEE

SEQ ID NO: 1773469 - protein, 10 aa, Staphylococcus epidermidis
AGDTAPVKQG

SEQ ID NO: 1773470 - protein, 10 aa, Staphylococcus epidermidis
AGDTEPVKEG

SEQ ID NO: 1773471 - protein, 7 aa, Staphylococcus epidermidis
AGEDFDN

SEQ ID NO: 1773472 - protein, 7 aa, Staphylococcus epidermidis
AGEGAYV

SEQ ID NO: 1773473 - protein, 14 aa, Staphylococcus epidermidis
AGEGSPGINGGPHG

SEQ ID NO: 1773474 - protein, 7 aa, Staphylococcus epidermidis
AGEIEKA

SEQ ID NO: 1773475 - protein, 8 aa, Staphylococcus epidermidis
AGELQTAE

SEQ ID NO: 1773476 - protein, 7 aa, Staphylococcus epidermidis
AGENLAY

SEQ ID NO: 1773477 - protein, 6 aa, Staphylococcus epidermidis
AGEPYD

SEQ ID NO: 1773478 - protein, 11 aa, Staphylococcus epidermidis
AGEQSKTFAQY

SEQ ID NO: 1773479 - protein, 7 aa, Staphylococcus epidermidis
AGESGPL

SEQ ID NO: 1773480 - protein, 7 aa, Staphylococcus epidermidis
AGETHYT

SEQ ID NO: 1773481 - protein, 8 aa, Staphylococcus epidermidis
AGGDEKVN

SEQ ID NO: 1773482 - protein, 7 aa, Staphylococcus epidermidis
AGGDVKA

SEQ ID NO: 1773483 - protein, 4 aa, Staphylococcus epidermidis
AGGE

SEQ ID NO: 1773484 - protein, 7 aa, Staphylococcus epidermidis
AGGFSPN

SEQ ID NO: 1773485 - protein, 8 aa, Staphylococcus epidermidis
AGGGTSEH

SEQ ID NO: 1773486 - protein, 6 aa, Staphylococcus epidermidis
AGGKRI

SEQ ID NO: 1773487 - protein, 7 aa, Staphylococcus epidermidis
AGGSASR

SEQ ID NO: 1773488 - protein, 9 aa, Staphylococcus epidermidis
AGGSKKKNW

SEQ ID NO: 1773489 - protein, 7 aa, Staphylococcus epidermidis
AGGVEAA

SEQ ID NO: 1773490 - protein, 8 aa, Staphylococcus epidermidis
AGGVEAAA

SEQ ID NO: 1773491 - protein, 5 aa, Staphylococcus epidermidis
AGGVG

SEQ ID NO: 1773492 - protein, 12 aa, Staphylococcus epidermidis
AGGVNRDRTGPH

SEQ ID NO: 1773493 - protein, 7 aa, Staphylococcus epidermidis
AGHEPGY

SEQ ID NO: 1773494 - protein, 7 aa, Staphylococcus epidermidis
AGHEQQV

SEQ ID NO: 1773495 - protein, 14 aa, Staphylococcus epidermidis
AGIDPTKQAWNKAA

SEQ ID NO: 1773496 - protein, 7 aa, Staphylococcus epidermidis
AGIGRGQ

SEQ ID NO: 1773497 - protein, 5 aa, Staphylococcus epidermidis
AGIHT

SEQ ID NO: 1773498 - protein, 6 aa, Staphylococcus epidermidis
AGIPED

SEQ ID NO: 1773499 - protein, 19 aa, Staphylococcus epidermidis
AGISPNQEKESKTNDKETF

SEQ ID NO: 1773500 - protein, 5 aa, Staphylococcus epidermidis
AGITR

SEQ ID NO: 1773501 - protein, 8 aa, Staphylococcus epidermidis
AGIYNKPS

SEQ ID NO: 1773502 - protein, 7 aa, Staphylococcus epidermidis
AGKDGEH

SEQ ID NO: 1773503 - protein, 20 aa, Staphylococcus epidermidis
AGKDKALPMNTGAEAVETTL

SEQ ID NO: 1773504 - protein, 20 aa, Staphylococcus epidermidis
AGKFEETPGKFEDGSKGVQL

SEQ ID NO: 1773505 - protein, 16 aa, Staphylococcus epidermidis
AGKGQFKPVGEANPYL

SEQ ID NO: 1773506 - protein, 10 aa, Staphylococcus epidermidis
AGKGSEVGRS

SEQ ID NO: 1773507 - protein, 27 aa, Staphylococcus epidermidis
AGKGTDPDKSNFKGKSPFSEKESQNMR

SEQ ID NO: 1773508 - protein, 4 aa, Staphylococcus epidermidis
AGKV

SEQ ID NO: 1773509 - protein, 11 aa, Staphylococcus epidermidis
AGLDKSDDANI

SEQ ID NO: 1773510 - protein, 12 aa, Staphylococcus epidermidis
AGLEGSQAGTAL

SEQ ID NO: 1773511 - protein, 8 aa, Staphylococcus epidermidis
AGLGRSGK

SEQ ID NO: 1773512 - protein, 5 aa, Staphylococcus epidermidis
AGLPK

SEQ ID NO: 1773513 - protein, 6 aa, Staphylococcus epidermidis
AGLTSD

SEQ ID NO: 1773514 - protein, 10 aa, Staphylococcus epidermidis
AGLTVKDDEH

SEQ ID NO: 1773515 - protein, 17 aa, Staphylococcus epidermidis
AGMSPKSIEAAEKGLPN

SEQ ID NO: 1773516 - protein, 11 aa, Staphylococcus epidermidis
AGMSSKSIEAA

SEQ ID NO: 1773517 - protein, 6 aa, Staphylococcus epidermidis
AGNAEI

SEQ ID NO: 1773518 - protein, 10 aa, Staphylococcus epidermidis
AGNAGDDVSE

SEQ ID NO: 1773519 - protein, 8 aa, Staphylococcus epidermidis
AGNDEKVE

SEQ ID NO: 1773520 - protein, 9 aa, Staphylococcus epidermidis
AGNEHETEK

SEQ ID NO: 1773521 - protein, 6 aa, Staphylococcus epidermidis
AGNHDN

SEQ ID NO: 1773522 - protein, 6 aa, Staphylococcus epidermidis
AGNKSR

SEQ ID NO: 1773523 - protein, 8 aa, Staphylococcus epidermidis
AGNSKSDD

SEQ ID NO: 1773524 - protein, 5 aa, Staphylococcus epidermidis
AGNTA

SEQ ID NO: 1773525 - protein, 7 aa, Staphylococcus epidermidis
AGNTGST

SEQ ID NO: 1773526 - protein, 10 aa, Staphylococcus epidermidis
AGNVKNRLTG

SEQ ID NO: 1773527 - protein, 8 aa, Staphylococcus epidermidis
AGNYDIEK

SEQ ID NO: 1773528 - protein, 6 aa, Staphylococcus epidermidis
AGPFRT

SEQ ID NO: 1773529 - protein, 6 aa, Staphylococcus epidermidis
AGPNIT

SEQ ID NO: 1773530 - protein, 30 aa, Staphylococcus epidermidis
AGPNKINKYSKSLQNSDGASAKAAKRMRDN

SEQ ID NO: 1773531 - protein, 9 aa, Staphylococcus epidermidis
AGQAAKDAT

SEQ ID NO: 1773532 - protein, 6 aa, Staphylococcus epidermidis
AGQAAV

SEQ ID NO: 1773533 - protein, 10 aa, Staphylococcus epidermidis
AGQGQNPARI

SEQ ID NO: 1773534 - protein, 6 aa, Staphylococcus epidermidis
AGQSDV

SEQ ID NO: 1773535 - protein, 18 aa, Staphylococcus epidermidis
AGRANGTTNHLEEPYDGY

SEQ ID NO: 1773536 - protein, 8 aa, Staphylococcus epidermidis
AGREKSVD

SEQ ID NO: 1773537 - protein, 9 aa, Staphylococcus epidermidis
AGRNEDKLQ

SEQ ID NO: 1773538 - protein, 12 aa, Staphylococcus epidermidis
AGRRSEESGSHL

SEQ ID NO: 1773539 - protein, 15 aa, Staphylococcus epidermidis
AGRTPKEAKIPDQDT

SEQ ID NO: 1773540 - protein, 7 aa, Staphylococcus epidermidis
AGSETSL

SEQ ID NO: 1773541 - protein, 11 aa, Staphylococcus epidermidis
AGSGGSTGADK

SEQ ID NO: 1773542 - protein, 8 aa, Staphylococcus epidermidis
AGSGGVGS

SEQ ID NO: 1773543 - protein, 6 aa, Staphylococcus epidermidis
AGSGGY

SEQ ID NO: 1773544 - protein, 7 aa, Staphylococcus epidermidis
AGSGKTR

SEQ ID NO: 1773545 - protein, 11 aa, Staphylococcus epidermidis
AGSGKTSSLKT

SEQ ID NO: 1773546 - protein, 8 aa, Staphylococcus epidermidis
AGSINDSL

SEQ ID NO: 1773547 - protein, 13 aa, Staphylococcus epidermidis
AGSVSNKKIGKNQ

SEQ ID NO: 1773548 - protein, 4 aa, Staphylococcus epidermidis
AGTE

SEQ ID NO: 1773549 - protein, 10 aa, Staphylococcus epidermidis
AGTGKEQPIG

SEQ ID NO: 1773550 - protein, 12 aa, Staphylococcus epidermidis
AGTGTNNTYKSI

SEQ ID NO: 1773551 - protein, 8 aa, Staphylococcus epidermidis
AGTKEGIT

SEQ ID NO: 1773552 - protein, 16 aa, Staphylococcus epidermidis
AGTKHEVEGSKQPLGS

SEQ ID NO: 1773553 - protein, 9 aa, Staphylococcus epidermidis
AGTKSDKDV

SEQ ID NO: 1773554 - protein, 8 aa, Staphylococcus epidermidis
AGTNLNGP

SEQ ID NO: 1773555 - protein, 7 aa, Staphylococcus epidermidis
AGTPAKV

SEQ ID NO: 1773556 - protein, 4 aa, Staphylococcus epidermidis
AGTS

SEQ ID NO: 1773557 - protein, 6 aa, Staphylococcus epidermidis
AGTSVD

SEQ ID NO: 1773558 - protein, 12 aa, Staphylococcus epidermidis
AGTTNTGSVDDF

SEQ ID NO: 1773559 - protein, 16 aa, Staphylococcus epidermidis
AGTTRDAVDTEYTYED

SEQ ID NO: 1773560 - protein, 26 aa, Staphylococcus epidermidis
AGVEKGSGEPNKTKVASVTKDQVREI

SEQ ID NO: 1773561 - protein, 9 aa, Staphylococcus epidermidis
AGVETGKNN

SEQ ID NO: 1773562 - protein, 4 aa, Staphylococcus epidermidis
AGVF

SEQ ID NO: 1773563 - protein, 7 aa, Staphylococcus epidermidis
AGVGSDH

SEQ ID NO: 1773564 - protein, 7 aa, Staphylococcus epidermidis
AGVKNPN

SEQ ID NO: 1773565 - protein, 6 aa, Staphylococcus epidermidis
AGVPKG

SEQ ID NO: 1773566 - protein, 7 aa, Staphylococcus epidermidis
AGVPSEN

SEQ ID NO: 1773567 - protein, 6 aa, Staphylococcus epidermidis
AGVPSK

SEQ ID NO: 1773568 - protein, 4 aa, Staphylococcus epidermidis
AGYA

SEQ ID NO: 1773569 - protein, 8 aa, Staphylococcus epidermidis
AGYAHEEG

SEQ ID NO: 1773570 - protein, 8 aa, Staphylococcus epidermidis
AGYAKTNF

SEQ ID NO: 1773571 - protein, 4 aa, Staphylococcus epidermidis
AGYG

SEQ ID NO: 1773572 - protein, 7 aa, Staphylococcus epidermidis
AGYGSYG

SEQ ID NO: 1773573 - protein, 13 aa, Staphylococcus epidermidis
AGYHKTPDVNGFR

SEQ ID NO: 1773574 - protein, 10 aa, Staphylococcus epidermidis
AGYNDNINEE

SEQ ID NO: 1773575 - protein, 4 aa, Staphylococcus epidermidis
AHAQ

SEQ ID NO: 1773576 - protein, 11 aa, Staphylococcus epidermidis
AHAQESVKPYY

SEQ ID NO: 1773577 - protein, 8 aa, Staphylococcus epidermidis
AHASQTGP

SEQ ID NO: 1773578 - protein, 6 aa, Staphylococcus epidermidis
AHEERK

SEQ ID NO: 1773579 - protein, 6 aa, Staphylococcus epidermidis
AHEHDK

SEQ ID NO: 1773580 - protein, 6 aa, Staphylococcus epidermidis
AHEKGK

SEQ ID NO: 1773581 - protein, 9 aa, Staphylococcus epidermidis
AHEPTSAAS

SEQ ID NO: 1773582 - protein, 15 aa, Staphylococcus epidermidis
AHFSEESKKMTDSEL

SEQ ID NO: 1773583 - protein, 18 aa, Staphylococcus epidermidis
AHGATTTQFSNKDLSDAV

SEQ ID NO: 1773584 - protein, 14 aa, Staphylococcus epidermidis
AHGGTEDGSIGTSF

SEQ ID NO: 1773585 - protein, 14 aa, Staphylococcus epidermidis
AHGSGVMGKGAGTV

SEQ ID NO: 1773586 - protein, 11 aa, Staphylococcus epidermidis
AHGSNATHDQV

SEQ ID NO: 1773587 - protein, 7 aa, Staphylococcus epidermidis
AHHGDGT

SEQ ID NO: 1773588 - protein, 6 aa, Staphylococcus epidermidis
AHKDED

SEQ ID NO: 1773589 - protein, 6 aa, Staphylococcus epidermidis
AHKDER

SEQ ID NO: 1773590 - protein, 12 aa, Staphylococcus epidermidis
AHKNTGKSEDLP

SEQ ID NO: 1773591 - protein, 10 aa, Staphylococcus epidermidis
AHLSDRQKAY

SEQ ID NO: 1773592 - protein, 14 aa, Staphylococcus epidermidis
AHNKAEEMKQKVDE

SEQ ID NO: 1773593 - protein, 13 aa, Staphylococcus epidermidis
AHNKKRKIDDSTV

SEQ ID NO: 1773594 - protein, 9 aa, Staphylococcus epidermidis
AHNNDQTDP

SEQ ID NO: 1773595 - protein, 6 aa, Staphylococcus epidermidis
AHPEFG

SEQ ID NO: 1773596 - protein, 19 aa, Staphylococcus epidermidis
AHPNGKSEIINGPYAGQTL

SEQ ID NO: 1773597 - protein, 5 aa, Staphylococcus epidermidis
AHPSL

SEQ ID NO: 1773598 - protein, 6 aa, Staphylococcus epidermidis
AHQNGH

SEQ ID NO: 1773599 - protein, 12 aa, Staphylococcus epidermidis
AHRADEDATTTA

SEQ ID NO: 1773600 - protein, 8 aa, Staphylococcus epidermidis
AHRDPFKS

SEQ ID NO: 1773601 - protein, 6 aa, Staphylococcus epidermidis
AHRTQY

SEQ ID NO: 1773602 - protein, 10 aa, Staphylococcus epidermidis
AHSNANAASG

SEQ ID NO: 1773603 - protein, 10 aa, Staphylococcus epidermidis
AHSNASAASG

SEQ ID NO: 1773604 - protein, 7 aa, Staphylococcus epidermidis
AHSNLNQ

SEQ ID NO: 1773605 - protein, 7 aa, Staphylococcus epidermidis
AHTGTKE

SEQ ID NO: 1773606 - protein, 8 aa, Staphylococcus epidermidis
AHTGTKEF

SEQ ID NO: 1773607 - protein, 8 aa, Staphylococcus epidermidis
AHTKTIDE

SEQ ID NO: 1773608 - protein, 6 aa, Staphylococcus epidermidis
AHYAPN

SEQ ID NO: 1773609 - protein, 11 aa, Staphylococcus epidermidis
AIAKPKGSALD

SEQ ID NO: 1773610 - protein, 7 aa, Staphylococcus epidermidis
AIAKTSM

SEQ ID NO: 1773611 - protein, 9 aa, Staphylococcus epidermidis
AIAPGTIET

SEQ ID NO: 1773612 - protein, 6 aa, Staphylococcus epidermidis
AIDGVS

SEQ ID NO: 1773613 - protein, 10 aa, Staphylococcus epidermidis
AIDKGKNVKN

SEQ ID NO: 1773614 - protein, 4 aa, Staphylococcus epidermidis
AIDQ

SEQ ID NO: 1773615 - protein, 15 aa, Staphylococcus epidermidis
AIDSNPSLTANERKT

SEQ ID NO: 1773616 - protein, 7 aa, Staphylococcus epidermidis
AIDTNGR

SEQ ID NO: 1773617 - protein, 25 aa, Staphylococcus epidermidis
AIEDTKDTLNGEQRLAEAKAKGKQY

SEQ ID NO: 1773618 - protein, 11 aa, Staphylococcus epidermidis
AIEKYKESPQL

SEQ ID NO: 1773619 - protein, 4 aa, Staphylococcus epidermidis
AIEQ

SEQ ID NO: 1773620 - protein, 6 aa, Staphylococcus epidermidis
AIEQGE

SEQ ID NO: 1773621 - protein, 11 aa, Staphylococcus epidermidis
AIEQSQATNFE

SEQ ID NO: 1773622 - protein, 11 aa, Staphylococcus epidermidis
AIETATENERG

SEQ ID NO: 1773623 - protein, 11 aa, Staphylococcus epidermidis
AIGDETETKEV

SEQ ID NO: 1773624 - protein, 10 aa, Staphylococcus epidermidis
AIGDGDHGVN

SEQ ID NO: 1773625 - protein, 6 aa, Staphylococcus epidermidis
AIGGLN

SEQ ID NO: 1773626 - protein, 7 aa, Staphylococcus epidermidis
AIGQDGK

SEQ ID NO: 1773627 - protein, 12 aa, Staphylococcus epidermidis
AIGTSKDTEVRA

SEQ ID NO: 1773628 - protein, 6 aa, Staphylococcus epidermidis
AIIKPN

SEQ ID NO: 1773629 - protein, 28 aa, Staphylococcus epidermidis
AIKDNQQVLQSSNYKNEDPAQQNAYNQA

SEQ ID NO: 1773630 - protein, 12 aa, Staphylococcus epidermidis
AIKDPALNRDSI

SEQ ID NO: 1773631 - protein, 9 aa, Staphylococcus epidermidis
AIKGGGTIK

SEQ ID NO: 1773632 - protein, 8 aa, Staphylococcus epidermidis
AIKPGSRI

SEQ ID NO: 1773633 - protein, 8 aa, Staphylococcus epidermidis
AIKQSQQN

SEQ ID NO: 1773634 - protein, 13 aa, Staphylococcus epidermidis
AIKTGHKTIQRYK

SEQ ID NO: 1773635 - protein, 13 aa, Staphylococcus epidermidis
AIMEGSERLEEQG

SEQ ID NO: 1773636 - protein, 9 aa, Staphylococcus epidermidis
AINDETKDY

SEQ ID NO: 1773637 - protein, 20 aa, Staphylococcus epidermidis
AINGRQINAPKSKPSKIKTT

SEQ ID NO: 1773638 - protein, 12 aa, Staphylococcus epidermidis
AINKTQNTGYQN

SEQ ID NO: 1773639 - protein, 18 aa, Staphylococcus epidermidis
AINKTTVATTASTVATRA

SEQ ID NO: 1773640 - protein, 6 aa, Staphylococcus epidermidis
AINLDG

SEQ ID NO: 1773641 - protein, 4 aa, Staphylococcus epidermidis
AIPH

SEQ ID NO: 1773642 - protein, 8 aa, Staphylococcus epidermidis
AIQAKRSK

SEQ ID NO: 1773643 - protein, 6 aa, Staphylococcus epidermidis
AIQEAE

SEQ ID NO: 1773644 - protein, 4 aa, Staphylococcus epidermidis
AIQT

SEQ ID NO: 1773645 - protein, 7 aa, Staphylococcus epidermidis
AIRTDDK

SEQ ID NO: 1773646 - protein, 10 aa, Staphylococcus epidermidis
AISDEGTFTE

SEQ ID NO: 1773647 - protein, 7 aa, Staphylococcus epidermidis
AISDGGT

SEQ ID NO: 1773648 - protein, 7 aa, Staphylococcus epidermidis
AISDYDE

SEQ ID NO: 1773649 - protein, 4 aa, Staphylococcus epidermidis
AISE

SEQ ID NO: 1773650 - protein, 4 aa, Staphylococcus epidermidis
AISG

SEQ ID NO: 1773651 - protein, 7 aa, Staphylococcus epidermidis
AISQTTN

SEQ ID NO: 1773652 - protein, 17 aa, Staphylococcus epidermidis
AISTPRSKQTAATTLAQ

SEQ ID NO: 1773653 - protein, 7 aa, Staphylococcus epidermidis
AITKDGE

SEQ ID NO: 1773654 - protein, 12 aa, Staphylococcus epidermidis
AITNKNKKYNTV

SEQ ID NO: 1773655 - protein, 19 aa, Staphylococcus epidermidis
AITSSIANDMTSDFSTEEI

SEQ ID NO: 1773656 - protein, 15 aa, Staphylococcus epidermidis
AITSSYNNKSLGTYG

SEQ ID NO: 1773657 - protein, 6 aa, Staphylococcus epidermidis
AIYDGT

SEQ ID NO: 1773658 - protein, 15 aa, Staphylococcus epidermidis
AIYEGRPHGMNDTKE

SEQ ID NO: 1773659 - protein, 4 aa, Staphylococcus epidermidis
AKAD

SEQ ID NO: 1773660 - protein, 4 aa, Staphylococcus epidermidis
AKAE

SEQ ID NO: 1773661 - protein, 8 aa, Staphylococcus epidermidis
AKAGAERI

SEQ ID NO: 1773662 - protein, 10 aa, Staphylococcus epidermidis
AKAGRTISEE

SEQ ID NO: 1773663 - protein, 17 aa, Staphylococcus epidermidis
AKAIDADAGTINEGDKA

SEQ ID NO: 1773664 - protein, 8 aa, Staphylococcus epidermidis
AKAKDGAS

SEQ ID NO: 1773665 - protein, 8 aa, Staphylococcus epidermidis
AKANGHGS

SEQ ID NO: 1773666 - protein, 4 aa, Staphylococcus epidermidis
AKAQ

SEQ ID NO: 1773667 - protein, 7 aa, Staphylococcus epidermidis
AKAQLSH

SEQ ID NO: 1773668 - protein, 7 aa, Staphylococcus epidermidis
AKATQVL

SEQ ID NO: 1773669 - protein, 6 aa, Staphylococcus epidermidis
AKATTV

SEQ ID NO: 1773670 - protein, 9 aa, Staphylococcus epidermidis
AKDANDADD

SEQ ID NO: 1773671 - protein, 6 aa, Staphylococcus epidermidis
AKDATQ

SEQ ID NO: 1773672 - protein, 29 aa, Staphylococcus epidermidis
AKDDKDNEKENKLPKLEEGDKVTATQIEP

SEQ ID NO: 1773673 - protein, 6 aa, Staphylococcus epidermidis
AKDGVE

SEQ ID NO: 1773674 - protein, 5 aa, Staphylococcus epidermidis
AKDGY

SEQ ID NO: 1773675 - protein, 8 aa, Staphylococcus epidermidis
AKDIGTTH

SEQ ID NO: 1773676 - protein, 12 aa, Staphylococcus epidermidis
AKDKEGKKPRVK

SEQ ID NO: 1773677 - protein, 8 aa, Staphylococcus epidermidis
AKDKKYKI

SEQ ID NO: 1773678 - protein, 10 aa, Staphylococcus epidermidis
AKDKTKHNTG

SEQ ID NO: 1773679 - protein, 11 aa, Staphylococcus epidermidis
AKDLDKQGKGV

SEQ ID NO: 1773680 - protein, 10 aa, Staphylococcus epidermidis
AKDNGYDEQM

SEQ ID NO: 1773681 - protein, 8 aa, Staphylococcus epidermidis
AKDPQKHT

SEQ ID NO: 1773682 - protein, 7 aa, Staphylococcus epidermidis
AKDQTYP

SEQ ID NO: 1773683 - protein, 6 aa, Staphylococcus epidermidis
AKDSGI

SEQ ID NO: 1773684 - protein, 7 aa, Staphylococcus epidermidis
AKDTLDP

SEQ ID NO: 1773685 - protein, 7 aa, Staphylococcus epidermidis
AKEAYQA

SEQ ID NO: 1773686 - protein, 4 aa, Staphylococcus epidermidis
AKEE

SEQ ID NO: 1773687 - protein, 18 aa, Staphylococcus epidermidis
AKEGARTVPPRENGGNCD

SEQ ID NO: 1773688 - protein, 14 aa, Staphylococcus epidermidis
AKEGVTIQNESKTM

SEQ ID NO: 1773689 - protein, 5 aa, Staphylococcus epidermidis
AKEGY

SEQ ID NO: 1773690 - protein, 6 aa, Staphylococcus epidermidis
AKEIAS

SEQ ID NO: 1773691 - protein, 15 aa, Staphylococcus epidermidis
AKEIGTDALESAEDA

SEQ ID NO: 1773692 - protein, 10 aa, Staphylococcus epidermidis
AKEKEGKVPR

SEQ ID NO: 1773693 - protein, 6 aa, Staphylococcus epidermidis
AKELKG

SEQ ID NO: 1773694 - protein, 11 aa, Staphylococcus epidermidis
AKENKNDKQLR

SEQ ID NO: 1773695 - protein, 10 aa, Staphylococcus epidermidis
AKENKSMNGK

SEQ ID NO: 1773696 - protein, 11 aa, Staphylococcus epidermidis
AKEQADELTTD

SEQ ID NO: 1773697 - protein, 9 aa, Staphylococcus epidermidis
AKEQAKQAI

SEQ ID NO: 1773698 - protein, 11 aa, Staphylococcus epidermidis
AKEQGVEITTD

SEQ ID NO: 1773699 - protein, 9 aa, Staphylococcus epidermidis
AKERARTGI

SEQ ID NO: 1773700 - protein, 19 aa, Staphylococcus epidermidis
AKERGERYQDFESSDYANG

SEQ ID NO: 1773701 - protein, 18 aa, Staphylococcus epidermidis
AKERNEKVSEYGIEQADG

SEQ ID NO: 1773702 - protein, 6 aa, Staphylococcus epidermidis
AKETPL

SEQ ID NO: 1773703 - protein, 11 aa, Staphylococcus epidermidis
AKEVGDNSNEA

SEQ ID NO: 1773704 - protein, 17 aa, Staphylococcus epidermidis
AKEVSTSEFADELIKNL

SEQ ID NO: 1773705 - protein, 9 aa, Staphylococcus epidermidis
AKEYASKFE

SEQ ID NO: 1773706 - protein, 14 aa, Staphylococcus epidermidis
AKEYRQGLQQQVEE

SEQ ID NO: 1773707 - protein, 7 aa, Staphylococcus epidermidis
AKFDSKW

SEQ ID NO: 1773708 - protein, 10 aa, Staphylococcus epidermidis
AKFGQEPRAY

SEQ ID NO: 1773709 - protein, 9 aa, Staphylococcus epidermidis
AKFKDNPSV

SEQ ID NO: 1773710 - protein, 4 aa, Staphylococcus epidermidis
AKFN

SEQ ID NO: 1773711 - protein, 13 aa, Staphylococcus epidermidis
AKFNEKRQQIKDE

SEQ ID NO: 1773712 - protein, 8 aa, Staphylococcus epidermidis
AKGATHDN

SEQ ID NO: 1773713 - protein, 8 aa, Staphylococcus epidermidis
AKGATHEN

SEQ ID NO: 1773714 - protein, 8 aa, Staphylococcus epidermidis
AKGDETSL

SEQ ID NO: 1773715 - protein, 7 aa, Staphylococcus epidermidis
AKGFDTD

SEQ ID NO: 1773716 - protein, 28 aa, Staphylococcus epidermidis
AKGIKTQVSGRLGGADIARAEQYSEGTV

SEQ ID NO: 1773717 - protein, 6 aa, Staphylococcus epidermidis
AKGKDI

SEQ ID NO: 1773718 - protein, 24 aa, Staphylococcus epidermidis
AKGKVENKSFETDTKNIDSNGNTV

SEQ ID NO: 1773719 - protein, 5 aa, Staphylococcus epidermidis
AKGML

SEQ ID NO: 1773720 - protein, 13 aa, Staphylococcus epidermidis
AKGMPEGEYDLGG

SEQ ID NO: 1773721 - protein, 9 aa, Staphylococcus epidermidis
AKGNRNNSL

SEQ ID NO: 1773722 - protein, 8 aa, Staphylococcus epidermidis
AKGQGNAF

SEQ ID NO: 1773723 - protein, 14 aa, Staphylococcus epidermidis
AKGRSINDAVKKAK

SEQ ID NO: 1773724 - protein, 7 aa, Staphylococcus epidermidis
AKGTSVM

SEQ ID NO: 1773725 - protein, 5 aa, Staphylococcus epidermidis
AKGVD

SEQ ID NO: 1773726 - protein, 7 aa, Staphylococcus epidermidis
AKGVGGC

SEQ ID NO: 1773727 - protein, 12 aa, Staphylococcus epidermidis
AKGVSKANDVSD

SEQ ID NO: 1773728 - protein, 9 aa, Staphylococcus epidermidis
AKGVSPLES

SEQ ID NO: 1773729 - protein, 7 aa, Staphylococcus epidermidis
AKHDLDD

SEQ ID NO: 1773730 - protein, 4 aa, Staphylococcus epidermidis
AKHG

SEQ ID NO: 1773731 - protein, 34 aa, Staphylococcus epidermidis
AKHGKNLKNVEAEAIKATKEKFDREKEKGLKPRA

SEQ ID NO: 1773732 - protein, 9 aa, Staphylococcus epidermidis
AKHKEETEL

SEQ ID NO: 1773733 - protein, 14 aa, Staphylococcus epidermidis
AKHNDGKGAKYTKI

SEQ ID NO: 1773734 - protein, 8 aa, Staphylococcus epidermidis
AKHTKDGI

SEQ ID NO: 1773735 - protein, 7 aa, Staphylococcus epidermidis
AKIEEDA

SEQ ID NO: 1773736 - protein, 39 aa, Staphylococcus epidermidis
AKIEKMGKQKEKLDLADNKQALKSSSLSRQQAKDSKSLA

SEQ ID NO: 1773737 - protein, 6 aa, Staphylococcus epidermidis
AKIEPK

SEQ ID NO: 1773738 - protein, 11 aa, Staphylococcus epidermidis
AKIQNKEERLP

SEQ ID NO: 1773739 - protein, 6 aa, Staphylococcus epidermidis
AKISTD

SEQ ID NO: 1773740 - protein, 9 aa, Staphylococcus epidermidis
AKITQDHKG

SEQ ID NO: 1773741 - protein, 11 aa, Staphylococcus epidermidis
AKKDENGNPII

SEQ ID NO: 1773742 - protein, 19 aa, Staphylococcus epidermidis
AKKDIEKENRIKQLEFLSR

SEQ ID NO: 1773743 - protein, 12 aa, Staphylococcus epidermidis
AKKDNHEIKGED

SEQ ID NO: 1773744 - protein, 8 aa, Staphylococcus epidermidis
AKKELSAD

SEQ ID NO: 1773745 - protein, 8 aa, Staphylococcus epidermidis
AKKENGDV

SEQ ID NO: 1773746 - protein, 8 aa, Staphylococcus epidermidis
AKKENGEI

SEQ ID NO: 1773747 - protein, 8 aa, Staphylococcus epidermidis
AKKEYASD

SEQ ID NO: 1773748 - protein, 12 aa, Staphylococcus epidermidis
AKKGLRKYNPDT

SEQ ID NO: 1773749 - protein, 5 aa, Staphylococcus epidermidis
AKKHK

SEQ ID NO: 1773750 - protein, 7 aa, Staphylococcus epidermidis
AKKIYSL

SEQ ID NO: 1773751 - protein, 18 aa, Staphylococcus epidermidis
AKKKEQIEELENNKTALK

SEQ ID NO: 1773752 - protein, 11 aa, Staphylococcus epidermidis
AKKNPEDPRFT

SEQ ID NO: 1773753 - protein, 11 aa, Staphylococcus epidermidis
AKKPYKESKPL

SEQ ID NO: 1773754 - protein, 4 aa, Staphylococcus epidermidis
AKKT

SEQ ID NO: 1773755 - protein, 7 aa, Staphylococcus epidermidis
AKKTTPL

SEQ ID NO: 1773756 - protein, 11 aa, Staphylococcus epidermidis
AKKVKSGFQAN

SEQ ID NO: 1773757 - protein, 10 aa, Staphylococcus epidermidis
AKKVKSGLQA

SEQ ID NO: 1773758 - protein, 17 aa, Staphylococcus epidermidis
AKKVSTSDFADELIKNI

SEQ ID NO: 1773759 - protein, 9 aa, Staphylococcus epidermidis
AKLGNSQGK

SEQ ID NO: 1773760 - protein, 5 aa, Staphylococcus epidermidis
AKLQG

SEQ ID NO: 1773761 - protein, 4 aa, Staphylococcus epidermidis
AKLS

SEQ ID NO: 1773762 - protein, 10 aa, Staphylococcus epidermidis
AKMGPSSDPM

SEQ ID NO: 1773763 - protein, 9 aa, Staphylococcus epidermidis
AKNAPKKSV

SEQ ID NO: 1773764 - protein, 8 aa, Staphylococcus epidermidis
AKNGREAE

SEQ ID NO: 1773765 - protein, 8 aa, Staphylococcus epidermidis
AKNKAEQM

SEQ ID NO: 1773766 - protein, 7 aa, Staphylococcus epidermidis
AKNMADK

SEQ ID NO: 1773767 - protein, 10 aa, Staphylococcus epidermidis
AKNNGYDEQI

SEQ ID NO: 1773768 - protein, 15 aa, Staphylococcus epidermidis
AKNPSILASKDGKEV

SEQ ID NO: 1773769 - protein, 14 aa, Staphylococcus epidermidis
AKNPSILASNNAKD

SEQ ID NO: 1773770 - protein, 4 aa, Staphylococcus epidermidis
AKNR

SEQ ID NO: 1773771 - protein, 5 aa, Staphylococcus epidermidis
AKNRR

SEQ ID NO: 1773772 - protein, 13 aa, Staphylococcus epidermidis
AKNYDRNNSYRSG

SEQ ID NO: 1773773 - protein, 12 aa, Staphylococcus epidermidis
AKPEDNLSTKDF

SEQ ID NO: 1773774 - protein, 10 aa, Staphylococcus epidermidis
AKPETSRYKK

SEQ ID NO: 1773775 - protein, 4 aa, Staphylococcus epidermidis
AKPL

SEQ ID NO: 1773776 - protein, 8 aa, Staphylococcus epidermidis
AKPLNQSM

SEQ ID NO: 1773777 - protein, 13 aa, Staphylococcus epidermidis
AKPLSINEGPAEI

SEQ ID NO: 1773778 - protein, 5 aa, Staphylococcus epidermidis
AKPNL

SEQ ID NO: 1773779 - protein, 16 aa, Staphylococcus epidermidis
AKPQNMEYFNQKHWLQ

SEQ ID NO: 1773780 - protein, 12 aa, Staphylococcus epidermidis
AKQAIASMSQAQ

SEQ ID NO: 1773781 - protein, 4 aa, Staphylococcus epidermidis
AKQG

SEQ ID NO: 1773782 - protein, 12 aa, Staphylococcus epidermidis
AKQLTLTSNNVT

SEQ ID NO: 1773783 - protein, 8 aa, Staphylococcus epidermidis
AKQNTSNV

SEQ ID NO: 1773784 - protein, 11 aa, Staphylococcus epidermidis
AKQRGPESLQD

SEQ ID NO: 1773785 - protein, 12 aa, Staphylococcus epidermidis
AKQSGEDISTQF

SEQ ID NO: 1773786 - protein, 9 aa, Staphylococcus epidermidis
AKQTDVSEY

SEQ ID NO: 1773787 - protein, 8 aa, Staphylococcus epidermidis
AKQYAKKN

SEQ ID NO: 1773788 - protein, 9 aa, Staphylococcus epidermidis
AKREVSEQL

SEQ ID NO: 1773789 - protein, 19 aa, Staphylococcus epidermidis
AKRKVSKDASSEDESNDSK

SEQ ID NO: 1773790 - protein, 7 aa, Staphylococcus epidermidis
AKRNRDF

SEQ ID NO: 1773791 - protein, 6 aa, Staphylococcus epidermidis
AKRPTV

SEQ ID NO: 1773792 - protein, 8 aa, Staphylococcus epidermidis
AKRSQTRI

SEQ ID NO: 1773793 - protein, 9 aa, Staphylococcus epidermidis
AKRSQTRYN

SEQ ID NO: 1773794 - protein, 7 aa, Staphylococcus epidermidis
AKRYAKK

SEQ ID NO: 1773795 - protein, 8 aa, Staphylococcus epidermidis
AKSADRLN

SEQ ID NO: 1773796 - protein, 15 aa, Staphylococcus epidermidis
AKSAEEIKQVFEEAD

SEQ ID NO: 1773797 - protein, 7 aa, Staphylococcus epidermidis
AKSEGVN

SEQ ID NO: 1773798 - protein, 8 aa, Staphylococcus epidermidis
AKSEIKAA

SEQ ID NO: 1773799 - protein, 10 aa, Staphylococcus epidermidis
AKSGDSDKTV

SEQ ID NO: 1773800 - protein, 9 aa, Staphylococcus epidermidis
AKSGQLATF

SEQ ID NO: 1773801 - protein, 10 aa, Staphylococcus epidermidis
AKSGYTSRRK

SEQ ID NO: 1773802 - protein, 6 aa, Staphylococcus epidermidis
AKSKPE

SEQ ID NO: 1773803 - protein, 7 aa, Staphylococcus epidermidis
AKSNIGI

SEQ ID NO: 1773804 - protein, 8 aa, Staphylococcus epidermidis
AKSSFKAA

SEQ ID NO: 1773805 - protein, 11 aa, Staphylococcus epidermidis
AKSSIKNKFPK

SEQ ID NO: 1773806 - protein, 9 aa, Staphylococcus epidermidis
AKSTEPEYL

SEQ ID NO: 1773807 - protein, 6 aa, Staphylococcus epidermidis
AKTDEL

SEQ ID NO: 1773808 - protein, 7 aa, Staphylococcus epidermidis
AKTEVST

SEQ ID NO: 1773809 - protein, 19 aa, Staphylococcus epidermidis
AKTGENAESFQQYPETSRI

SEQ ID NO: 1773810 - protein, 8 aa, Staphylococcus epidermidis
AKTGKEAD

SEQ ID NO: 1773811 - protein, 9 aa, Staphylococcus epidermidis
AKTHTSNLE

SEQ ID NO: 1773812 - protein, 11 aa, Staphylococcus epidermidis
AKTKQSGDEIG

SEQ ID NO: 1773813 - protein, 6 aa, Staphylococcus epidermidis
AKTLDT

SEQ ID NO: 1773814 - protein, 4 aa, Staphylococcus epidermidis
AKTM

SEQ ID NO: 1773815 - protein, 9 aa, Staphylococcus epidermidis
AKTREEENE

SEQ ID NO: 1773816 - protein, 9 aa, Staphylococcus epidermidis
AKTRTEVAQ

SEQ ID NO: 1773817 - protein, 9 aa, Staphylococcus epidermidis
AKTSIKSQR

SEQ ID NO: 1773818 - protein, 14 aa, Staphylococcus epidermidis
AKTSKSASEVAKGM

SEQ ID NO: 1773819 - protein, 8 aa, Staphylococcus epidermidis
AKTVDKNQ

SEQ ID NO: 1773820 - protein, 6 aa, Staphylococcus epidermidis
AKTYSL

SEQ ID NO: 1773821 - protein, 4 aa, Staphylococcus epidermidis
AKVE

SEQ ID NO: 1773822 - protein, 6 aa, Staphylococcus epidermidis
AKVEPK

SEQ ID NO: 1773823 - protein, 12 aa, Staphylococcus epidermidis
AKVLNKENGQSF

SEQ ID NO: 1773824 - protein, 9 aa, Staphylococcus epidermidis
AKVTRDEMD

SEQ ID NO: 1773825 - protein, 11 aa, Staphylococcus epidermidis
AKVTSSVTKST

SEQ ID NO: 1773826 - protein, 7 aa, Staphylococcus epidermidis
AKWAGVD

SEQ ID NO: 1773827 - protein, 7 aa, Staphylococcus epidermidis
AKYAPQA

SEQ ID NO: 1773828 - protein, 12 aa, Staphylococcus epidermidis
AKYDDKGEGIKY

SEQ ID NO: 1773829 - protein, 9 aa, Staphylococcus epidermidis
ALADKGNYD

SEQ ID NO: 1773830 - protein, 13 aa, Staphylococcus epidermidis
ALANKKAKEEYRH

SEQ ID NO: 1773831 - protein, 5 aa, Staphylococcus epidermidis
ALDDD

SEQ ID NO: 1773832 - protein, 10 aa, Staphylococcus epidermidis
ALDDKGPTIA

SEQ ID NO: 1773833 - protein, 7 aa, Staphylococcus epidermidis
ALDDPQK

SEQ ID NO: 1773834 - protein, 5 aa, Staphylococcus epidermidis
ALDGD

SEQ ID NO: 1773835 - protein, 5 aa, Staphylococcus epidermidis
ALDKG

SEQ ID NO: 1773836 - protein, 12 aa, Staphylococcus epidermidis
ALDKKTVNDIYA

SEQ ID NO: 1773837 - protein, 5 aa, Staphylococcus epidermidis
ALDND

SEQ ID NO: 1773838 - protein, 7 aa, Staphylococcus epidermidis
ALDTGEY

SEQ ID NO: 1773839 - protein, 13 aa, Staphylococcus epidermidis
ALDTGNDPREFTK

SEQ ID NO: 1773840 - protein, 9 aa, Staphylococcus epidermidis
ALENEKVKS

SEQ ID NO: 1773841 - protein, 23 aa, Staphylococcus epidermidis
ALENGPKYLQRTASNIARLIKLN

SEQ ID NO: 1773842 - protein, 5 aa, Staphylococcus epidermidis
ALEQL

SEQ ID NO: 1773843 - protein, 8 aa, Staphylococcus epidermidis
ALEQTEQF

SEQ ID NO: 1773844 - protein, 7 aa, Staphylococcus epidermidis
ALGDPTR

SEQ ID NO: 1773845 - protein, 7 aa, Staphylococcus epidermidis
ALGGKTK

SEQ ID NO: 1773846 - protein, 6 aa, Staphylococcus epidermidis
ALGPYS

SEQ ID NO: 1773847 - protein, 20 aa, Staphylococcus epidermidis
ALHGEQKLQEAKDQANAQID

SEQ ID NO: 1773848 - protein, 12 aa, Staphylococcus epidermidis
ALKDNPSSNTLT

SEQ ID NO: 1773849 - protein, 22 aa, Staphylococcus epidermidis
ALKQEPRANTAKAKEILENIRQ

SEQ ID NO: 1773850 - protein, 6 aa, Staphylococcus epidermidis
ALKTND

SEQ ID NO: 1773851 - protein, 6 aa, Staphylococcus epidermidis
ALLKNG

SEQ ID NO: 1773852 - protein, 7 aa, Staphylococcus epidermidis
ALLPEKG

SEQ ID NO: 1773853 - protein, 8 aa, Staphylococcus epidermidis
ALNDDNRV

SEQ ID NO: 1773854 - protein, 10 aa, Staphylococcus epidermidis
ALNEGKPENI

SEQ ID NO: 1773855 - protein, 11 aa, Staphylococcus epidermidis
ALNENKEEKLD

SEQ ID NO: 1773856 - protein, 20 aa, Staphylococcus epidermidis
ALNQQKEQFENLKKEQDKIK

SEQ ID NO: 1773857 - protein, 9 aa, Staphylococcus epidermidis
ALPASQVSN

SEQ ID NO: 1773858 - protein, 4 aa, Staphylococcus epidermidis
ALPE

SEQ ID NO: 1773859 - protein, 16 aa, Staphylococcus epidermidis
ALPKGLSAQIDTQSFP

SEQ ID NO: 1773860 - protein, 5 aa, Staphylococcus epidermidis
ALPND

SEQ ID NO: 1773861 - protein, 8 aa, Staphylococcus epidermidis
ALPTDREL

SEQ ID NO: 1773862 - protein, 5 aa, Staphylococcus epidermidis
ALQNK

SEQ ID NO: 1773863 - protein, 19 aa, Staphylococcus epidermidis
ALQQKRQQNQQSEEDSIQK

SEQ ID NO: 1773864 - protein, 30 aa, Staphylococcus epidermidis
ALRQDSPVSTQSNRMTKDEESDYLVSGRKC

SEQ ID NO: 1773865 - protein, 7 aa, Staphylococcus epidermidis
ALSDELK

SEQ ID NO: 1773866 - protein, 9 aa, Staphylococcus epidermidis
ALSEATKSE

SEQ ID NO: 1773867 - protein, 7 aa, Staphylococcus epidermidis
ALSNNGV

SEQ ID NO: 1773868 - protein, 16 aa, Staphylococcus epidermidis
ALSRSDKDALKDGIGD

SEQ ID NO: 1773869 - protein, 8 aa, Staphylococcus epidermidis
ALSVSDAD

SEQ ID NO: 1773870 - protein, 10 aa, Staphylococcus epidermidis
ALTEEKGLKD

SEQ ID NO: 1773871 - protein, 9 aa, Staphylococcus epidermidis
ALTPSQIND

SEQ ID NO: 1773872 - protein, 6 aa, Staphylococcus epidermidis
ALTSYS

SEQ ID NO: 1773873 - protein, 4 aa, Staphylococcus epidermidis
ALTT

SEQ ID NO: 1773874 - protein, 7 aa, Staphylococcus epidermidis
AMANGDM

SEQ ID NO: 1773875 - protein, 20 aa, Staphylococcus epidermidis
AMDPYNGGEISPGPEVQTDE

SEQ ID NO: 1773876 - protein, 9 aa, Staphylococcus epidermidis
AMDQSDAWD

SEQ ID NO: 1773877 - protein, 19 aa, Staphylococcus epidermidis
AMEASNTTNTLKDGTKKRI

SEQ ID NO: 1773878 - protein, 20 aa, Staphylococcus epidermidis
AMEKGSNDRYFQEDKAPRKF

SEQ ID NO: 1773879 - protein, 9 aa, Staphylococcus epidermidis
AMKKNGAKA

SEQ ID NO: 1773880 - protein, 23 aa, Staphylococcus epidermidis
AMPKEDAEKLKEQLEEVGATVEL

SEQ ID NO: 1773881 - protein, 24 aa, Staphylococcus epidermidis
AMRSETESMVEQAKSDVETRKNDI

SEQ ID NO: 1773882 - protein, 9 aa, Staphylococcus epidermidis
AMTDNKAQY

SEQ ID NO: 1773883 - protein, 5 aa, Staphylococcus epidermidis
AMTPE

SEQ ID NO: 1773884 - protein, 20 aa, Staphylococcus epidermidis
ANAATGKNVITGRKMSKNER

SEQ ID NO: 1773885 - protein, 10 aa, Staphylococcus epidermidis
ANAGQKGAVT

SEQ ID NO: 1773886 - protein, 13 aa, Staphylococcus epidermidis
ANAKQAATQNVNG

SEQ ID NO: 1773887 - protein, 18 aa, Staphylococcus epidermidis
ANAKSPEQVESFLDENLN

SEQ ID NO: 1773888 - protein, 18 aa, Staphylococcus epidermidis
ANAKSPEQVESFLSEHLD

SEQ ID NO: 1773889 - protein, 15 aa, Staphylococcus epidermidis
ANAPRVDDQRYHTGT

SEQ ID NO: 1773890 - protein, 18 aa, Staphylococcus epidermidis
ANASKSKQATSRKKQLDK

SEQ ID NO: 1773891 - protein, 7 aa, Staphylococcus epidermidis
ANATAPY

SEQ ID NO: 1773892 - protein, 5 aa, Staphylococcus epidermidis
ANATE

SEQ ID NO: 1773893 - protein, 11 aa, Staphylococcus epidermidis
ANDEVDKAPLD

SEQ ID NO: 1773894 - protein, 9 aa, Staphylococcus epidermidis
ANDKNEATL

SEQ ID NO: 1773895 - protein, 14 aa, Staphylococcus epidermidis
ANDREGGVGKESTI

SEQ ID NO: 1773896 - protein, 10 aa, Staphylococcus epidermidis
ANDTDFQTNH

SEQ ID NO: 1773897 - protein, 8 aa, Staphylococcus epidermidis
ANDTEYGL

SEQ ID NO: 1773898 - protein, 5 aa, Staphylococcus epidermidis
ANDTL

SEQ ID NO: 1773899 - protein, 10 aa, Staphylococcus epidermidis
ANDTNYQTSH

SEQ ID NO: 1773900 - protein, 11 aa, Staphylococcus epidermidis
ANEALQKDEKL

SEQ ID NO: 1773901 - protein, 14 aa, Staphylococcus epidermidis
ANEDAQEDDNHVHS

SEQ ID NO: 1773902 - protein, 13 aa, Staphylococcus epidermidis
ANEDAQEDENHVH

SEQ ID NO: 1773903 - protein, 6 aa, Staphylococcus epidermidis
ANEDGY

SEQ ID NO: 1773904 - protein, 5 aa, Staphylococcus epidermidis
ANEDI

SEQ ID NO: 1773905 - protein, 7 aa, Staphylococcus epidermidis
ANEEGRT

SEQ ID NO: 1773906 - protein, 11 aa, Staphylococcus epidermidis
ANEEYSDQREH

SEQ ID NO: 1773907 - protein, 7 aa, Staphylococcus epidermidis
ANEIENR

SEQ ID NO: 1773908 - protein, 15 aa, Staphylococcus epidermidis
ANEKQLQKQIDFWLI

SEQ ID NO: 1773909 - protein, 4 aa, Staphylococcus epidermidis
ANEN

SEQ ID NO: 1773910 - protein, 10 aa, Staphylococcus epidermidis
ANEPKSTKAI

SEQ ID NO: 1773911 - protein, 6 aa, Staphylococcus epidermidis
ANESLT

SEQ ID NO: 1773912 - protein, 12 aa, Staphylococcus epidermidis
ANESYKKYDIGD

SEQ ID NO: 1773913 - protein, 5 aa, Staphylococcus epidermidis
ANEYK

SEQ ID NO: 1773914 - protein, 6 aa, Staphylococcus epidermidis
ANGAFA

SEQ ID NO: 1773915 - protein, 8 aa, Staphylococcus epidermidis
ANGAGKTT

SEQ ID NO: 1773916 - protein, 5 aa, Staphylococcus epidermidis
ANGEK

SEQ ID NO: 1773917 - protein, 14 aa, Staphylococcus epidermidis
ANGGDGSGQHPTQS

SEQ ID NO: 1773918 - protein, 16 aa, Staphylococcus epidermidis
ANGNEEDVNKAVDAAD

SEQ ID NO: 1773919 - protein, 5 aa, Staphylococcus epidermidis
ANGTH

SEQ ID NO: 1773920 - protein, 4 aa, Staphylococcus epidermidis
ANGV

SEQ ID NO: 1773921 - protein, 12 aa, Staphylococcus epidermidis
ANHKNGKEDLDK

SEQ ID NO: 1773922 - protein, 12 aa, Staphylococcus epidermidis
ANHTRSKETIAF

SEQ ID NO: 1773923 - protein, 14 aa, Staphylococcus epidermidis
ANHTTYSNNNDGIG

SEQ ID NO: 1773924 - protein, 7 aa, Staphylococcus epidermidis
ANIDKND

SEQ ID NO: 1773925 - protein, 10 aa, Staphylococcus epidermidis
ANKAEMAGIP

SEQ ID NO: 1773926 - protein, 12 aa, Staphylococcus epidermidis
ANKKDSIGTSES

SEQ ID NO: 1773927 - protein, 7 aa, Staphylococcus epidermidis
ANKPNFD

SEQ ID NO: 1773928 - protein, 6 aa, Staphylococcus epidermidis
ANKTHD

SEQ ID NO: 1773929 - protein, 8 aa, Staphylococcus epidermidis
ANKVEEDI

SEQ ID NO: 1773930 - protein, 28 aa, Staphylococcus epidermidis
ANKVTSEIERSRNGMKQTPLNRSTTNIL

SEQ ID NO: 1773931 - protein, 6 aa, Staphylococcus epidermidis
ANNEGA

SEQ ID NO: 1773932 - protein, 8 aa, Staphylococcus epidermidis
ANNESDEE

SEQ ID NO: 1773933 - protein, 9 aa, Staphylococcus epidermidis
ANNGEELPM

SEQ ID NO: 1773934 - protein, 12 aa, Staphylococcus epidermidis
ANNGIKNPFETV

SEQ ID NO: 1773935 - protein, 10 aa, Staphylococcus epidermidis
ANNGQPSHID

SEQ ID NO: 1773936 - protein, 8 aa, Staphylococcus epidermidis
ANNKTENC

SEQ ID NO: 1773937 - protein, 13 aa, Staphylococcus epidermidis
ANNPLKPHEDAVE

SEQ ID NO: 1773938 - protein, 8 aa, Staphylococcus epidermidis
ANNYSTPA

SEQ ID NO: 1773939 - protein, 8 aa, Staphylococcus epidermidis
ANPGSIGP

SEQ ID NO: 1773940 - protein, 9 aa, Staphylococcus epidermidis
ANPGSLGPI

SEQ ID NO: 1773941 - protein, 10 aa, Staphylococcus epidermidis
ANPHKRGIYS

SEQ ID NO: 1773942 - protein, 6 aa, Staphylococcus epidermidis
ANPKRL

SEQ ID NO: 1773943 - protein, 15 aa, Staphylococcus epidermidis
ANPPYSANWSADPSF

SEQ ID NO: 1773944 - protein, 15 aa, Staphylococcus epidermidis
ANPPYSANWSAESSF

SEQ ID NO: 1773945 - protein, 6 aa, Staphylococcus epidermidis
ANPRQI

SEQ ID NO: 1773946 - protein, 8 aa, Staphylococcus epidermidis
ANPTHSYT

SEQ ID NO: 1773947 - protein, 6 aa, Staphylococcus epidermidis
ANQNLE

SEQ ID NO: 1773948 - protein, 9 aa, Staphylococcus epidermidis
ANQSEIRPI

SEQ ID NO: 1773949 - protein, 9 aa, Staphylococcus epidermidis
ANRMSQNPV

SEQ ID NO: 1773950 - protein, 5 aa, Staphylococcus epidermidis
ANRRA

SEQ ID NO: 1773951 - protein, 15 aa, Staphylococcus epidermidis
ANSCTGEQGLRDAQT

SEQ ID NO: 1773952 - protein, 13 aa, Staphylococcus epidermidis
ANSEDQAKTSFEE

SEQ ID NO: 1773953 - protein, 8 aa, Staphylococcus epidermidis
ANSKGYTL

SEQ ID NO: 1773954 - protein, 10 aa, Staphylococcus epidermidis
ANSKRAGYTK

SEQ ID NO: 1773955 - protein, 8 aa, Staphylococcus epidermidis
ANSPERLK

SEQ ID NO: 1773956 - protein, 9 aa, Staphylococcus epidermidis
ANSRDQAGI

SEQ ID NO: 1773957 - protein, 9 aa, Staphylococcus epidermidis
ANSSKAYHT

SEQ ID NO: 1773958 - protein, 12 aa, Staphylococcus epidermidis
ANSTASGSRSGI

SEQ ID NO: 1773959 - protein, 6 aa, Staphylococcus epidermidis
ANTDKD

SEQ ID NO: 1773960 - protein, 6 aa, Staphylococcus epidermidis
ANTLTY

SEQ ID NO: 1773961 - protein, 8 aa, Staphylococcus epidermidis
ANTPVAET

SEQ ID NO: 1773962 - protein, 13 aa, Staphylococcus epidermidis
ANTRTKVQEELAK

SEQ ID NO: 1773963 - protein, 25 aa, Staphylococcus epidermidis
ANTTRQRDGLNSKNKIQEGGLSGRP

SEQ ID NO: 1773964 - protein, 8 aa, Staphylococcus epidermidis
ANVQPNDD

SEQ ID NO: 1773965 - protein, 6 aa, Staphylococcus epidermidis
ANVYTN

SEQ ID NO: 1773966 - protein, 5 aa, Staphylococcus epidermidis
ANWPN

SEQ ID NO: 1773967 - protein, 10 aa, Staphylococcus epidermidis
ANYAKNQFKA

SEQ ID NO: 1773968 - protein, 5 aa, Staphylococcus epidermidis
ANYND

SEQ ID NO: 1773969 - protein, 34 aa, Staphylococcus epidermidis
ANYSNVTSHATQEPQTAAPTHDENNWGKEQFNTH

SEQ ID NO: 1773970 - protein, 23 aa, Staphylococcus epidermidis
APAASKEELAGLEGRNFDNTNKE

SEQ ID NO: 1773971 - protein, 8 aa, Staphylococcus epidermidis
APADPGAV

SEQ ID NO: 1773972 - protein, 10 aa, Staphylococcus epidermidis
APAEKQTKLR

SEQ ID NO: 1773973 - protein, 10 aa, Staphylococcus epidermidis
APAEKQTRLS

SEQ ID NO: 1773974 - protein, 5 aa, Staphylococcus epidermidis
APAID

SEQ ID NO: 1773975 - protein, 14 aa, Staphylococcus epidermidis
APAPEGEGGSRAMQ

SEQ ID NO: 1773976 - protein, 7 aa, Staphylococcus epidermidis
APATGDL

SEQ ID NO: 1773977 - protein, 28 aa, Staphylococcus epidermidis
APDEETKTFKGTVSGEITRERRGENGFG

SEQ ID NO: 1773978 - protein, 11 aa, Staphylococcus epidermidis
APDGNTISATE

SEQ ID NO: 1773979 - protein, 4 aa, Staphylococcus epidermidis
APEN

SEQ ID NO: 1773980 - protein, 5 aa, Staphylococcus epidermidis
APEYH

SEQ ID NO: 1773981 - protein, 5 aa, Staphylococcus epidermidis
APGEH

SEQ ID NO: 1773982 - protein, 13 aa, Staphylococcus epidermidis
APGKRSKDDIKTT

SEQ ID NO: 1773983 - protein, 7 aa, Staphylococcus epidermidis
APGQELE

SEQ ID NO: 1773984 - protein, 10 aa, Staphylococcus epidermidis
APGSRVKESP

SEQ ID NO: 1773985 - protein, 5 aa, Staphylococcus epidermidis
APIQT

SEQ ID NO: 1773986 - protein, 13 aa, Staphylococcus epidermidis
APISDEERENMKR

SEQ ID NO: 1773987 - protein, 5 aa, Staphylococcus epidermidis
APITE

SEQ ID NO: 1773988 - protein, 11 aa, Staphylococcus epidermidis
APKEALSSERL

SEQ ID NO: 1773989 - protein, 6 aa, Staphylococcus epidermidis
APKGFK

SEQ ID NO: 1773990 - protein, 9 aa, Staphylococcus epidermidis
APKNKDSKA

SEQ ID NO: 1773991 - protein, 4 aa, Staphylococcus epidermidis
APKP

SEQ ID NO: 1773992 - protein, 11 aa, Staphylococcus epidermidis
APLGEEDAHVE

SEQ ID NO: 1773993 - protein, 12 aa, Staphylococcus epidermidis
APLGSGETYGYQ

SEQ ID NO: 1773994 - protein, 5 aa, Staphylococcus epidermidis
APLNL

SEQ ID NO: 1773995 - protein, 4 aa, Staphylococcus epidermidis
APLT

SEQ ID NO: 1773996 - protein, 9 aa, Staphylococcus epidermidis
APNEARENE

SEQ ID NO: 1773997 - protein, 4 aa, Staphylococcus epidermidis
APNF

SEQ ID NO: 1773998 - protein, 5 aa, Staphylococcus epidermidis
APNTK

SEQ ID NO: 1773999 - protein, 6 aa, Staphylococcus epidermidis
APPQGI

SEQ ID NO: 1774000 - protein, 6 aa, Staphylococcus epidermidis
APQMKS

SEQ ID NO: 1774001 - protein, 11 aa, Staphylococcus epidermidis
APQNTRRKSIE

SEQ ID NO: 1774002 - protein, 5 aa, Staphylococcus epidermidis
APRLQ

SEQ ID NO: 1774003 - protein, 19 aa, Staphylococcus epidermidis
APRNKNNGRISLNTSGTVN

SEQ ID NO: 1774004 - protein, 19 aa, Staphylococcus epidermidis
APRNKNSGRISLNTSGTVN

SEQ ID NO: 1774005 - protein, 6 aa, Staphylococcus epidermidis
APRNNI

SEQ ID NO: 1774006 - protein, 9 aa, Staphylococcus epidermidis
APSNDEQGV

SEQ ID NO: 1774007 - protein, 5 aa, Staphylococcus epidermidis
APSQE

SEQ ID NO: 1774008 - protein, 6 aa, Staphylococcus epidermidis
APSYER

SEQ ID NO: 1774009 - protein, 6 aa, Staphylococcus epidermidis
APTEGQ

SEQ ID NO: 1774010 - protein, 15 aa, Staphylococcus epidermidis
APTGRASKRLHESTG

SEQ ID NO: 1774011 - protein, 16 aa, Staphylococcus epidermidis
APTGRASKRLQESTGL

SEQ ID NO: 1774012 - protein, 7 aa, Staphylococcus epidermidis
APTNYST

SEQ ID NO: 1774013 - protein, 8 aa, Staphylococcus epidermidis
APTREEVA

SEQ ID NO: 1774014 - protein, 11 aa, Staphylococcus epidermidis
APTSQNTNTSF

SEQ ID NO: 1774015 - protein, 9 aa, Staphylococcus epidermidis
APTSTGAAK

SEQ ID NO: 1774016 - protein, 5 aa, Staphylococcus epidermidis
APVEA

SEQ ID NO: 1774017 - protein, 5 aa, Staphylococcus epidermidis
APVGP

SEQ ID NO: 1774018 - protein, 6 aa, Staphylococcus epidermidis
APVQGT

SEQ ID NO: 1774019 - protein, 18 aa, Staphylococcus epidermidis
APYLSPHPYRGKRNEPER

SEQ ID NO: 1774020 - protein, 5 aa, Staphylococcus epidermidis
AQARL

SEQ ID NO: 1774021 - protein, 4 aa, Staphylococcus epidermidis
AQAT

SEQ ID NO: 1774022 - protein, 8 aa, Staphylococcus epidermidis
AQDIKTAN

SEQ ID NO: 1774023 - protein, 5 aa, Staphylococcus epidermidis
AQDKE

SEQ ID NO: 1774024 - protein, 5 aa, Staphylococcus epidermidis
AQEAG

SEQ ID NO: 1774025 - protein, 11 aa, Staphylococcus epidermidis
AQEAKDKGEAL

SEQ ID NO: 1774026 - protein, 15 aa, Staphylococcus epidermidis
AQEAVEKGDLETARN

SEQ ID NO: 1774027 - protein, 5 aa, Staphylococcus epidermidis
AQEGV

SEQ ID NO: 1774028 - protein, 10 aa, Staphylococcus epidermidis
AQEGYSKSHP

SEQ ID NO: 1774029 - protein, 5 aa, Staphylococcus epidermidis
AQENG

SEQ ID NO: 1774030 - protein, 5 aa, Staphylococcus epidermidis
AQESR

SEQ ID NO: 1774031 - protein, 11 aa, Staphylococcus epidermidis
AQEYRSQKSIA

SEQ ID NO: 1774032 - protein, 5 aa, Staphylococcus epidermidis
AQGED

SEQ ID NO: 1774033 - protein, 12 aa, Staphylococcus epidermidis
AQGERNAAAKKY

SEQ ID NO: 1774034 - protein, 8 aa, Staphylococcus epidermidis
AQGGCRDS

SEQ ID NO: 1774035 - protein, 7 aa, Staphylococcus epidermidis
AQGGSVG

SEQ ID NO: 1774036 - protein, 7 aa, Staphylococcus epidermidis
AQGIDKH

SEQ ID NO: 1774037 - protein, 7 aa, Staphylococcus epidermidis
AQGRLDQ

SEQ ID NO: 1774038 - protein, 4 aa, Staphylococcus epidermidis
AQGV

SEQ ID NO: 1774039 - protein, 5 aa, Staphylococcus epidermidis
AQHNG

SEQ ID NO: 1774040 - protein, 13 aa, Staphylococcus epidermidis
AQHSKATAWSKNR

SEQ ID NO: 1774041 - protein, 47 aa, Staphylococcus epidermidis
AQHYTGESSLDLENESNQDSSPNSLEKQTNSSNIDNKEVKNNAPSFN

SEQ ID NO: 1774042 - protein, 5 aa, Staphylococcus epidermidis
AQIGD

SEQ ID NO: 1774043 - protein, 8 aa, Staphylococcus epidermidis
AQIRSGSN

SEQ ID NO: 1774044 - protein, 6 aa, Staphylococcus epidermidis
AQKAER

SEQ ID NO: 1774045 - protein, 7 aa, Staphylococcus epidermidis
AQKDNDN

SEQ ID NO: 1774046 - protein, 6 aa, Staphylococcus epidermidis
AQKEKY

SEQ ID NO: 1774047 - protein, 10 aa, Staphylococcus epidermidis
AQKEKYDNLT

SEQ ID NO: 1774048 - protein, 4 aa, Staphylococcus epidermidis
AQKL

SEQ ID NO: 1774049 - protein, 10 aa, Staphylococcus epidermidis
AQKLKDSGIV

SEQ ID NO: 1774050 - protein, 17 aa, Staphylococcus epidermidis
AQKMAQEQNKKKEEKIK

SEQ ID NO: 1774051 - protein, 10 aa, Staphylococcus epidermidis
AQKNDEEAYE

SEQ ID NO: 1774052 - protein, 11 aa, Staphylococcus epidermidis
AQKQDNLGGSI

SEQ ID NO: 1774053 - protein, 8 aa, Staphylococcus epidermidis
AQKQLDTA

SEQ ID NO: 1774054 - protein, 21 aa, Staphylococcus epidermidis
AQLAEKEKLQSKKQDKKTLNK

SEQ ID NO: 1774055 - protein, 8 aa, Staphylococcus epidermidis
AQLAEPDK

SEQ ID NO: 1774056 - protein, 10 aa, Staphylococcus epidermidis
AQLNDQPTVE

SEQ ID NO: 1774057 - protein, 10 aa, Staphylococcus epidermidis
AQLTEQKDGL

SEQ ID NO: 1774058 - protein, 8 aa, Staphylococcus epidermidis
AQNIESSQ

SEQ ID NO: 1774059 - protein, 9 aa, Staphylococcus epidermidis
AQNKDLNQN

SEQ ID NO: 1774060 - protein, 7 aa, Staphylococcus epidermidis
AQNNNKY

SEQ ID NO: 1774061 - protein, 8 aa, Staphylococcus epidermidis
AQNPERLK

SEQ ID NO: 1774062 - protein, 9 aa, Staphylococcus epidermidis
AQNPERLKS

SEQ ID NO: 1774063 - protein, 8 aa, Staphylococcus epidermidis
AQNVKQSE

SEQ ID NO: 1774064 - protein, 10 aa, Staphylococcus epidermidis
AQPDVTETDA

SEQ ID NO: 1774065 - protein, 5 aa, Staphylococcus epidermidis
AQPED

SEQ ID NO: 1774066 - protein, 10 aa, Staphylococcus epidermidis
AQPEVTETDA

SEQ ID NO: 1774067 - protein, 6 aa, Staphylococcus epidermidis
AQPKAV

SEQ ID NO: 1774068 - protein, 7 aa, Staphylococcus epidermidis
AQPPRSY

SEQ ID NO: 1774069 - protein, 9 aa, Staphylococcus epidermidis
AQPQTVQNV

SEQ ID NO: 1774070 - protein, 22 aa, Staphylococcus epidermidis
AQQDVDQEKAKDLEKKMRDSSF

SEQ ID NO: 1774071 - protein, 7 aa, Staphylococcus epidermidis
AQQEKIK

SEQ ID NO: 1774072 - protein, 5 aa, Staphylococcus epidermidis
AQQQN

SEQ ID NO: 1774073 - protein, 6 aa, Staphylococcus epidermidis
AQQSGI

SEQ ID NO: 1774074 - protein, 13 aa, Staphylococcus epidermidis
AQQYNGKFGSVSG

SEQ ID NO: 1774075 - protein, 13 aa, Staphylococcus epidermidis
AQRALDNQKTDDR

SEQ ID NO: 1774076 - protein, 11 aa, Staphylococcus epidermidis
AQRGKVELNEK

SEQ ID NO: 1774077 - protein, 5 aa, Staphylococcus epidermidis
AQRNL

SEQ ID NO: 1774078 - protein, 14 aa, Staphylococcus epidermidis
AQRSENNQKNYKKD

SEQ ID NO: 1774079 - protein, 6 aa, Staphylococcus epidermidis
AQSAYQ

SEQ ID NO: 1774080 - protein, 7 aa, Staphylococcus epidermidis
AQSFGTP

SEQ ID NO: 1774081 - protein, 5 aa, Staphylococcus epidermidis
AQSGT

SEQ ID NO: 1774082 - protein, 11 aa, Staphylococcus epidermidis
AQSKLDEDRQM

SEQ ID NO: 1774083 - protein, 20 aa, Staphylococcus epidermidis
AQSMEEAERVNTIEVDITTY

SEQ ID NO: 1774084 - protein, 16 aa, Staphylococcus epidermidis
AQSPNKETYATARKLG

SEQ ID NO: 1774085 - protein, 6 aa, Staphylococcus epidermidis
AQSSHL

SEQ ID NO: 1774086 - protein, 28 aa, Staphylococcus epidermidis
AQSVENSDNYRQADDSKISAYDDALEQA

SEQ ID NO: 1774087 - protein, 15 aa, Staphylococcus epidermidis
AQSYEDSTSKYTPAW

SEQ ID NO: 1774088 - protein, 6 aa, Staphylococcus epidermidis
AQTDNQ

SEQ ID NO: 1774089 - protein, 6 aa, Staphylococcus epidermidis
AQTEST

SEQ ID NO: 1774090 - protein, 19 aa, Staphylococcus epidermidis
AQTRRRGGRHKGPPPFTTE

SEQ ID NO: 1774091 - protein, 6 aa, Staphylococcus epidermidis
AQTTRL

SEQ ID NO: 1774092 - protein, 10 aa, Staphylococcus epidermidis
AQTTSTSSQV

SEQ ID NO: 1774093 - protein, 9 aa, Staphylococcus epidermidis
AQVEGDEAK

SEQ ID NO: 1774094 - protein, 5 aa, Staphylococcus epidermidis
AQVEM

SEQ ID NO: 1774095 - protein, 6 aa, Staphylococcus epidermidis
AQYHES

SEQ ID NO: 1774096 - protein, 5 aa, Staphylococcus epidermidis
ARAGS

SEQ ID NO: 1774097 - protein, 10 aa, Staphylococcus epidermidis
ARASNYRSAG

SEQ ID NO: 1774098 - protein, 4 aa, Staphylococcus epidermidis
ARAV

SEQ ID NO: 1774099 - protein, 7 aa, Staphylococcus epidermidis
ARAYRDK

SEQ ID NO: 1774100 - protein, 12 aa, Staphylococcus epidermidis
ARDNKQTLHRET

SEQ ID NO: 1774101 - protein, 8 aa, Staphylococcus epidermidis
ARDSHPDV

SEQ ID NO: 1774102 - protein, 6 aa, Staphylococcus epidermidis
ARDSKI

SEQ ID NO: 1774103 - protein, 8 aa, Staphylococcus epidermidis
ARDYFNSS

SEQ ID NO: 1774104 - protein, 10 aa, Staphylococcus epidermidis
AREAGDRSKI

SEQ ID NO: 1774105 - protein, 7 aa, Staphylococcus epidermidis
AREGENN

SEQ ID NO: 1774106 - protein, 16 aa, Staphylococcus epidermidis
AREKLTEYQSMPNKEN

SEQ ID NO: 1774107 - protein, 16 aa, Staphylococcus epidermidis
AREKLTEYQSMPSKEN

SEQ ID NO: 1774108 - protein, 12 aa, Staphylococcus epidermidis
ARERALSNNHIP

SEQ ID NO: 1774109 - protein, 13 aa, Staphylococcus epidermidis
ARERRKSEERMKD

SEQ ID NO: 1774110 - protein, 15 aa, Staphylococcus epidermidis
ARESYQAPTLKINTD

SEQ ID NO: 1774111 - protein, 5 aa, Staphylococcus epidermidis
ARGFN

SEQ ID NO: 1774112 - protein, 33 aa, Staphylococcus epidermidis
ARGIDNNEVKATRVRKSVGTERTFSTDVNDDDE

SEQ ID NO: 1774113 - protein, 6 aa, Staphylococcus epidermidis
ARISEW

SEQ ID NO: 1774114 - protein, 6 aa, Staphylococcus epidermidis
ARKGEI

SEQ ID NO: 1774115 - protein, 10 aa, Staphylococcus epidermidis
ARKKLKNGDL

SEQ ID NO: 1774116 - protein, 6 aa, Staphylococcus epidermidis
ARKNTD

SEQ ID NO: 1774117 - protein, 10 aa, Staphylococcus epidermidis
ARKRSKESFG

SEQ ID NO: 1774118 - protein, 8 aa, Staphylococcus epidermidis
ARKSIRKN

SEQ ID NO: 1774119 - protein, 4 aa, Staphylococcus epidermidis
ARKT

SEQ ID NO: 1774120 - protein, 6 aa, Staphylococcus epidermidis
ARLSEQ

SEQ ID NO: 1774121 - protein, 17 aa, Staphylococcus epidermidis
ARMKSNDPEQPIDYNQS

SEQ ID NO: 1774122 - protein, 10 aa, Staphylococcus epidermidis
ARNNADTHQQ

SEQ ID NO: 1774123 - protein, 9 aa, Staphylococcus epidermidis
ARNNEEVER

SEQ ID NO: 1774124 - protein, 5 aa, Staphylococcus epidermidis
ARNPF

SEQ ID NO: 1774125 - protein, 4 aa, Staphylococcus epidermidis
ARPA

SEQ ID NO: 1774126 - protein, 14 aa, Staphylococcus epidermidis
ARPGTTLSTTDEGE

SEQ ID NO: 1774127 - protein, 4 aa, Staphylococcus epidermidis
ARQE

SEQ ID NO: 1774128 - protein, 14 aa, Staphylococcus epidermidis
ARQSNNRSIKEKAK

SEQ ID NO: 1774129 - protein, 15 aa, Staphylococcus epidermidis
ARRKSSSVKALKTHA

SEQ ID NO: 1774130 - protein, 13 aa, Staphylococcus epidermidis
ARRQPEETREDIK

SEQ ID NO: 1774131 - protein, 9 aa, Staphylococcus epidermidis
ARRSVNPPV

SEQ ID NO: 1774132 - protein, 14 aa, Staphylococcus epidermidis
ARSAGKKVEFQGQT

SEQ ID NO: 1774133 - protein, 9 aa, Staphylococcus epidermidis
ARSARAYGS

SEQ ID NO: 1774134 - protein, 8 aa, Staphylococcus epidermidis
ARSDEHQT

SEQ ID NO: 1774135 - protein, 7 aa, Staphylococcus epidermidis
ARSDEHR

SEQ ID NO: 1774136 - protein, 4 aa, Staphylococcus epidermidis
ARSF

SEQ ID NO: 1774137 - protein, 7 aa, Staphylococcus epidermidis
ARSGLER

SEQ ID NO: 1774138 - protein, 7 aa, Staphylococcus epidermidis
ARSREGK

SEQ ID NO: 1774139 - protein, 5 aa, Staphylococcus epidermidis
ARSRW

SEQ ID NO: 1774140 - protein, 8 aa, Staphylococcus epidermidis
ARTDHFGD

SEQ ID NO: 1774141 - protein, 19 aa, Staphylococcus epidermidis
ARVAAKKAREVTRRKSALD

SEQ ID NO: 1774142 - protein, 13 aa, Staphylococcus epidermidis
ARVVKGQRVKAGQ

SEQ ID NO: 1774143 - protein, 11 aa, Staphylococcus epidermidis
ARYEGEGYGKF

SEQ ID NO: 1774144 - protein, 14 aa, Staphylococcus epidermidis
ASAEGKNAGEFYTP

SEQ ID NO: 1774145 - protein, 6 aa, Staphylococcus epidermidis
ASAEIA

SEQ ID NO: 1774146 - protein, 5 aa, Staphylococcus epidermidis
ASANN

SEQ ID NO: 1774147 - protein, 16 aa, Staphylococcus epidermidis
ASCKSEENYSTYSTYQ

SEQ ID NO: 1774148 - protein, 7 aa, Staphylococcus epidermidis
ASDERHN

SEQ ID NO: 1774149 - protein, 7 aa, Staphylococcus epidermidis
ASDLNDA

SEQ ID NO: 1774150 - protein, 7 aa, Staphylococcus epidermidis
ASDRLKA

SEQ ID NO: 1774151 - protein, 7 aa, Staphylococcus epidermidis
ASEGESK

SEQ ID NO: 1774152 - protein, 7 aa, Staphylococcus epidermidis
ASEGQSK

SEQ ID NO: 1774153 - protein, 4 aa, Staphylococcus epidermidis
ASEI

SEQ ID NO: 1774154 - protein, 16 aa, Staphylococcus epidermidis
ASELTTDDNEDKQEYE

SEQ ID NO: 1774155 - protein, 12 aa, Staphylococcus epidermidis
ASEMGQSQLNTK

SEQ ID NO: 1774156 - protein, 5 aa, Staphylococcus epidermidis
ASENY

SEQ ID NO: 1774157 - protein, 8 aa, Staphylococcus epidermidis
ASERTKIG

SEQ ID NO: 1774158 - protein, 16 aa, Staphylococcus epidermidis
ASESDLHGSTGYGYDD

SEQ ID NO: 1774159 - protein, 6 aa, Staphylococcus epidermidis
ASESEI

SEQ ID NO: 1774160 - protein, 20 aa, Staphylococcus epidermidis
ASESYRDLEKNNNIKVQGKN

SEQ ID NO: 1774161 - protein, 12 aa, Staphylococcus epidermidis
ASETASKSAMEH

SEQ ID NO: 1774162 - protein, 5 aa, Staphylococcus epidermidis
ASEVS

SEQ ID NO: 1774163 - protein, 4 aa, Staphylococcus epidermidis
ASFA

SEQ ID NO: 1774164 - protein, 7 aa, Staphylococcus epidermidis
ASFKNEG

SEQ ID NO: 1774165 - protein, 13 aa, Staphylococcus epidermidis
ASFPTSNNDNITI

SEQ ID NO: 1774166 - protein, 18 aa, Staphylococcus epidermidis
ASGESEKVQLDQLVDYFK

SEQ ID NO: 1774167 - protein, 7 aa, Staphylococcus epidermidis
ASGFPEE

SEQ ID NO: 1774168 - protein, 11 aa, Staphylococcus epidermidis
ASGGALSSSQQ

SEQ ID NO: 1774169 - protein, 12 aa, Staphylococcus epidermidis
ASGGALSSSQQK

SEQ ID NO: 1774170 - protein, 11 aa, Staphylococcus epidermidis
ASGHPYGASGA

SEQ ID NO: 1774171 - protein, 5 aa, Staphylococcus epidermidis
ASGID

SEQ ID NO: 1774172 - protein, 6 aa, Staphylococcus epidermidis
ASGIPD

SEQ ID NO: 1774173 - protein, 7 aa, Staphylococcus epidermidis
ASGKPTV

SEQ ID NO: 1774174 - protein, 7 aa, Staphylococcus epidermidis
ASGQHSS

SEQ ID NO: 1774175 - protein, 7 aa, Staphylococcus epidermidis
ASGRFGV

SEQ ID NO: 1774176 - protein, 7 aa, Staphylococcus epidermidis
ASHENAK

SEQ ID NO: 1774177 - protein, 7 aa, Staphylococcus epidermidis
ASHGADT

SEQ ID NO: 1774178 - protein, 6 aa, Staphylococcus epidermidis
ASHNQQ

SEQ ID NO: 1774179 - protein, 16 aa, Staphylococcus epidermidis
ASHPDTPPRSKKTIQQ

SEQ ID NO: 1774180 - protein, 10 aa, Staphylococcus epidermidis
ASHTSMDAQS

SEQ ID NO: 1774181 - protein, 11 aa, Staphylococcus epidermidis
ASIAEADADGI

SEQ ID NO: 1774182 - protein, 5 aa, Staphylococcus epidermidis
ASIDR

SEQ ID NO: 1774183 - protein, 4 aa, Staphylococcus epidermidis
ASIN

SEQ ID NO: 1774184 - protein, 9 aa, Staphylococcus epidermidis
ASKDVGTTV

SEQ ID NO: 1774185 - protein, 10 aa, Staphylococcus epidermidis
ASKDVRQNPF

SEQ ID NO: 1774186 - protein, 11 aa, Staphylococcus epidermidis
ASKEEAEAAGV

SEQ ID NO: 1774187 - protein, 8 aa, Staphylococcus epidermidis
ASKETLEP

SEQ ID NO: 1774188 - protein, 15 aa, Staphylococcus epidermidis
ASKFANQKSETEQKL

SEQ ID NO: 1774189 - protein, 21 aa, Staphylococcus epidermidis
ASKGQANPQKVNGLLKQELDK

SEQ ID NO: 1774190 - protein, 13 aa, Staphylococcus epidermidis
ASKKDQAGELSKQ

SEQ ID NO: 1774191 - protein, 9 aa, Staphylococcus epidermidis
ASKKDSFAR

SEQ ID NO: 1774192 - protein, 8 aa, Staphylococcus epidermidis
ASKRGTLK

SEQ ID NO: 1774193 - protein, 10 aa, Staphylococcus epidermidis
ASKVDRTQHY

SEQ ID NO: 1774194 - protein, 14 aa, Staphylococcus epidermidis
ASKYKSGEEALPQF

SEQ ID NO: 1774195 - protein, 19 aa, Staphylococcus epidermidis
ASKYTDDTVAKQAAKDLED

SEQ ID NO: 1774196 - protein, 4 aa, Staphylococcus epidermidis
ASLD

SEQ ID NO: 1774197 - protein, 9 aa, Staphylococcus epidermidis
ASLKDGAKV

SEQ ID NO: 1774198 - protein, 6 aa, Staphylococcus epidermidis
ASLQYK

SEQ ID NO: 1774199 - protein, 4 aa, Staphylococcus epidermidis
ASMH

SEQ ID NO: 1774200 - protein, 4 aa, Staphylococcus epidermidis
ASMP

SEQ ID NO: 1774201 - protein, 6 aa, Staphylococcus epidermidis
ASNADI

SEQ ID NO: 1774202 - protein, 9 aa, Staphylococcus epidermidis
ASNADRTIT

SEQ ID NO: 1774203 - protein, 11 aa, Staphylococcus epidermidis
ASNDDRTTTQV

SEQ ID NO: 1774204 - protein, 17 aa, Staphylococcus epidermidis
ASNENVYGPSPKVKTAI

SEQ ID NO: 1774205 - protein, 7 aa, Staphylococcus epidermidis
ASNLNEA

SEQ ID NO: 1774206 - protein, 5 aa, Staphylococcus epidermidis
ASNNF

SEQ ID NO: 1774207 - protein, 6 aa, Staphylococcus epidermidis
ASNQSG

SEQ ID NO: 1774208 - protein, 8 aa, Staphylococcus epidermidis
ASNVKDGQ

SEQ ID NO: 1774209 - protein, 7 aa, Staphylococcus epidermidis
ASPEDNF

SEQ ID NO: 1774210 - protein, 6 aa, Staphylococcus epidermidis
ASPFSP

SEQ ID NO: 1774211 - protein, 17 aa, Staphylococcus epidermidis
ASPGAERPIKKDKDFHN

SEQ ID NO: 1774212 - protein, 6 aa, Staphylococcus epidermidis
ASPITN

SEQ ID NO: 1774213 - protein, 8 aa, Staphylococcus epidermidis
ASPQASGG

SEQ ID NO: 1774214 - protein, 9 aa, Staphylococcus epidermidis
ASPQASGGH

SEQ ID NO: 1774215 - protein, 4 aa, Staphylococcus epidermidis
ASPS

SEQ ID NO: 1774216 - protein, 15 aa, Staphylococcus epidermidis
ASPVTVKAGEYEDCK

SEQ ID NO: 1774217 - protein, 16 aa, Staphylococcus epidermidis
ASPVTVKAGEYSDCKD

SEQ ID NO: 1774218 - protein, 5 aa, Staphylococcus epidermidis
ASQAQ

SEQ ID NO: 1774219 - protein, 11 aa, Staphylococcus epidermidis
ASQDSIQRIDA

SEQ ID NO: 1774220 - protein, 6 aa, Staphylococcus epidermidis
ASQKPM

SEQ ID NO: 1774221 - protein, 19 aa, Staphylococcus epidermidis
ASQLDQALKEAKSEGQKYF

SEQ ID NO: 1774222 - protein, 22 aa, Staphylococcus epidermidis
ASQNQDMREKGIGSYVDREEGV

SEQ ID NO: 1774223 - protein, 9 aa, Staphylococcus epidermidis
ASQPQSTSH

SEQ ID NO: 1774224 - protein, 4 aa, Staphylococcus epidermidis
ASQQ

SEQ ID NO: 1774225 - protein, 6 aa, Staphylococcus epidermidis
ASQQSI

SEQ ID NO: 1774226 - protein, 4 aa, Staphylococcus epidermidis
ASQS

SEQ ID NO: 1774227 - protein, 9 aa, Staphylococcus epidermidis
ASQTIASKK

SEQ ID NO: 1774228 - protein, 22 aa, Staphylococcus epidermidis
ASRALSTNDDKETACRPFQEGR

SEQ ID NO: 1774229 - protein, 8 aa, Staphylococcus epidermidis
ASRDAAKN

SEQ ID NO: 1774230 - protein, 7 aa, Staphylococcus epidermidis
ASRNNGD

SEQ ID NO: 1774231 - protein, 15 aa, Staphylococcus epidermidis
ASSEEGKAKLKNSDT

SEQ ID NO: 1774232 - protein, 7 aa, Staphylococcus epidermidis
ASSEEID

SEQ ID NO: 1774233 - protein, 16 aa, Staphylococcus epidermidis
ASSENSDLTGSEQEAN

SEQ ID NO: 1774234 - protein, 5 aa, Staphylococcus epidermidis
ASSFV

SEQ ID NO: 1774235 - protein, 11 aa, Staphylococcus epidermidis
ASSGPGDGKGG

SEQ ID NO: 1774236 - protein, 8 aa, Staphylococcus epidermidis
ASSGSLPG

SEQ ID NO: 1774237 - protein, 24 aa, Staphylococcus epidermidis
ASSLTGDESTIPNHKDITDQLDYE

SEQ ID NO: 1774238 - protein, 5 aa, Staphylococcus epidermidis
ASSPI

SEQ ID NO: 1774239 - protein, 11 aa, Staphylococcus epidermidis
ASSQAKDRLDE

SEQ ID NO: 1774240 - protein, 7 aa, Staphylococcus epidermidis
ASSQGNF

SEQ ID NO: 1774241 - protein, 23 aa, Staphylococcus epidermidis
ASSQNDAIEKAGQALVDSGAVTQ

SEQ ID NO: 1774242 - protein, 6 aa, Staphylococcus epidermidis
ASSYKS

SEQ ID NO: 1774243 - protein, 4 aa, Staphylococcus epidermidis
ASTA

SEQ ID NO: 1774244 - protein, 5 aa, Staphylococcus epidermidis
ASTDF

SEQ ID NO: 1774245 - protein, 5 aa, Staphylococcus epidermidis
ASTEF

SEQ ID NO: 1774246 - protein, 14 aa, Staphylococcus epidermidis
ASTERKIDKYQSMT

SEQ ID NO: 1774247 - protein, 20 aa, Staphylococcus epidermidis
ASTGNNRSHALNANKRRWNA

SEQ ID NO: 1774248 - protein, 8 aa, Staphylococcus epidermidis
ASTHPGAG

SEQ ID NO: 1774249 - protein, 8 aa, Staphylococcus epidermidis
ASTKQGDI

SEQ ID NO: 1774250 - protein, 4 aa, Staphylococcus epidermidis
ASTN

SEQ ID NO: 1774251 - protein, 17 aa, Staphylococcus epidermidis
ASTPNEVKQAIENENDA

SEQ ID NO: 1774252 - protein, 11 aa, Staphylococcus epidermidis
ASTQDLKTNKT

SEQ ID NO: 1774253 - protein, 5 aa, Staphylococcus epidermidis
ASTRV

SEQ ID NO: 1774254 - protein, 9 aa, Staphylococcus epidermidis
ASTSQPHGY

SEQ ID NO: 1774255 - protein, 11 aa, Staphylococcus epidermidis
ASTSQSKEEIM

SEQ ID NO: 1774256 - protein, 10 aa, Staphylococcus epidermidis
ASTSSYEEQG

SEQ ID NO: 1774257 - protein, 5 aa, Staphylococcus epidermidis
ASTTT

SEQ ID NO: 1774258 - protein, 6 aa, Staphylococcus epidermidis
ASVHGD

SEQ ID NO: 1774259 - protein, 6 aa, Staphylococcus epidermidis
ASVTSD

SEQ ID NO: 1774260 - protein, 6 aa, Staphylococcus epidermidis
ASYEAK

SEQ ID NO: 1774261 - protein, 22 aa, Staphylococcus epidermidis
ASYPNILPSSTNPTLPYTQNTV

SEQ ID NO: 1774262 - protein, 7 aa, Staphylococcus epidermidis
ASYPPDT

SEQ ID NO: 1774263 - protein, 7 aa, Staphylococcus epidermidis
ASYPSET

SEQ ID NO: 1774264 - protein, 7 aa, Staphylococcus epidermidis
ATAEKNP

SEQ ID NO: 1774265 - protein, 5 aa, Staphylococcus epidermidis
ATALN

SEQ ID NO: 1774266 - protein, 10 aa, Staphylococcus epidermidis
ATANPKTKEI

SEQ ID NO: 1774267 - protein, 7 aa, Staphylococcus epidermidis
ATARQND

SEQ ID NO: 1774268 - protein, 9 aa, Staphylococcus epidermidis
ATASPQLET

SEQ ID NO: 1774269 - protein, 11 aa, Staphylococcus epidermidis
ATDEDAQRYAQ

SEQ ID NO: 1774270 - protein, 7 aa, Staphylococcus epidermidis
ATDEEQH

SEQ ID NO: 1774271 - protein, 9 aa, Staphylococcus epidermidis
ATDENDKWT

SEQ ID NO: 1774272 - protein, 5 aa, Staphylococcus epidermidis
ATDHK

SEQ ID NO: 1774273 - protein, 8 aa, Staphylococcus epidermidis
ATDKDYRQ

SEQ ID NO: 1774274 - protein, 10 aa, Staphylococcus epidermidis
ATDTQPTEAQ

SEQ ID NO: 1774275 - protein, 20 aa, Staphylococcus epidermidis
ATEAIQHRGETVTEGASSNV

SEQ ID NO: 1774276 - protein, 7 aa, Staphylococcus epidermidis
ATEGIGA

SEQ ID NO: 1774277 - protein, 7 aa, Staphylococcus epidermidis
ATEIGKS

SEQ ID NO: 1774278 - protein, 6 aa, Staphylococcus epidermidis
ATEKEL

SEQ ID NO: 1774279 - protein, 10 aa, Staphylococcus epidermidis
ATENKKAEDV

SEQ ID NO: 1774280 - protein, 5 aa, Staphylococcus epidermidis
ATENL

SEQ ID NO: 1774281 - protein, 8 aa, Staphylococcus epidermidis
ATEQVTNR

SEQ ID NO: 1774282 - protein, 8 aa, Staphylococcus epidermidis
ATESLKDK

SEQ ID NO: 1774283 - protein, 6 aa, Staphylococcus epidermidis
ATFGKA

SEQ ID NO: 1774284 - protein, 12 aa, Staphylococcus epidermidis
ATFKGAEDGPTI

SEQ ID NO: 1774285 - protein, 9 aa, Staphylococcus epidermidis
ATFTPNTPI

SEQ ID NO: 1774286 - protein, 14 aa, Staphylococcus epidermidis
ATGCKQSLGYDQDT

SEQ ID NO: 1774287 - protein, 24 aa, Staphylococcus epidermidis
ATGDGSIAAQSAADYITELKDKLE

SEQ ID NO: 1774288 - protein, 12 aa, Staphylococcus epidermidis
ATGFGDDGITTH

SEQ ID NO: 1774289 - protein, 7 aa, Staphylococcus epidermidis
ATGIGKA

SEQ ID NO: 1774290 - protein, 9 aa, Staphylococcus epidermidis
ATGKSTVSE

SEQ ID NO: 1774291 - protein, 7 aa, Staphylococcus epidermidis
ATGLNDK

SEQ ID NO: 1774292 - protein, 6 aa, Staphylococcus epidermidis
ATGQTT

SEQ ID NO: 1774293 - protein, 26 aa, Staphylococcus epidermidis
ATGRKKGKRHTSRSSKGKRKRRYKTG

SEQ ID NO: 1774294 - protein, 15 aa, Staphylococcus epidermidis
ATGRKPNTDGLGLEN

SEQ ID NO: 1774295 - protein, 10 aa, Staphylococcus epidermidis
ATGRKPNVEQ

SEQ ID NO: 1774296 - protein, 10 aa, Staphylococcus epidermidis
ATGRKPNVQE

SEQ ID NO: 1774297 - protein, 15 aa, Staphylococcus epidermidis
ATGTPAGVGAGMEPP

SEQ ID NO: 1774298 - protein, 25 aa, Staphylococcus epidermidis
ATGTPDEVKKQYHTDTIEGVFLNME

SEQ ID NO: 1774299 - protein, 18 aa, Staphylococcus epidermidis
ATGTPEEIAQNKESYTGQ

SEQ ID NO: 1774300 - protein, 13 aa, Staphylococcus epidermidis
ATHDSDYAKLDDG

SEQ ID NO: 1774301 - protein, 7 aa, Staphylococcus epidermidis
ATHNKGV

SEQ ID NO: 1774302 - protein, 9 aa, Staphylococcus epidermidis
ATIDGNSQI

SEQ ID NO: 1774303 - protein, 14 aa, Staphylococcus epidermidis
ATIESARKKYPNKE

SEQ ID NO: 1774304 - protein, 19 aa, Staphylococcus epidermidis
ATKARLGKLSQSDMQNGTF

SEQ ID NO: 1774305 - protein, 7 aa, Staphylococcus epidermidis
ATKDHTR

SEQ ID NO: 1774306 - protein, 4 aa, Staphylococcus epidermidis
ATKE

SEQ ID NO: 1774307 - protein, 10 aa, Staphylococcus epidermidis
ATKEDMQTLK

SEQ ID NO: 1774308 - protein, 5 aa, Staphylococcus epidermidis
ATKEG

SEQ ID NO: 1774309 - protein, 9 aa, Staphylococcus epidermidis
ATKEGGLPV

SEQ ID NO: 1774310 - protein, 8 aa, Staphylococcus epidermidis
ATKGSHVI

SEQ ID NO: 1774311 - protein, 8 aa, Staphylococcus epidermidis
ATKHAGAQ

SEQ ID NO: 1774312 - protein, 8 aa, Staphylococcus epidermidis
ATKKSNEL

SEQ ID NO: 1774313 - protein, 12 aa, Staphylococcus epidermidis
ATKKYDNKPSTS

SEQ ID NO: 1774314 - protein, 5 aa, Staphylococcus epidermidis
ATKTK

SEQ ID NO: 1774315 - protein, 9 aa, Staphylococcus epidermidis
ATLGGEGGL

SEQ ID NO: 1774316 - protein, 43 aa, Staphylococcus epidermidis
ATLPKEDVIESDESTTQSYLDNDNDEDNPTLGDVFGDKFKDLK

SEQ ID NO: 1774317 - protein, 6 aa, Staphylococcus epidermidis
ATLPTS

SEQ ID NO: 1774318 - protein, 5 aa, Staphylococcus epidermidis
ATLRT

SEQ ID NO: 1774319 - protein, 9 aa, Staphylococcus epidermidis
ATNASQPVY

SEQ ID NO: 1774320 - protein, 6 aa, Staphylococcus epidermidis
ATNGEG

SEQ ID NO: 1774321 - protein, 13 aa, Staphylococcus epidermidis
ATNGEVSTITNPV

SEQ ID NO: 1774322 - protein, 7 aa, Staphylococcus epidermidis
ATNGGKI

SEQ ID NO: 1774323 - protein, 5 aa, Staphylococcus epidermidis
ATNHH

SEQ ID NO: 1774324 - protein, 7 aa, Staphylococcus epidermidis
ATNKYGN

SEQ ID NO: 1774325 - protein, 4 aa, Staphylococcus epidermidis
ATNN

SEQ ID NO: 1774326 - protein, 5 aa, Staphylococcus epidermidis
ATNNL

SEQ ID NO: 1774327 - protein, 9 aa, Staphylococcus epidermidis
ATNNNGKMY

SEQ ID NO: 1774328 - protein, 5 aa, Staphylococcus epidermidis
ATNNS

SEQ ID NO: 1774329 - protein, 9 aa, Staphylococcus epidermidis
ATNVDLNDK

SEQ ID NO: 1774330 - protein, 7 aa, Staphylococcus epidermidis
ATPFKEG

SEQ ID NO: 1774331 - protein, 12 aa, Staphylococcus epidermidis
ATPKTTGRKNTS

SEQ ID NO: 1774332 - protein, 31 aa, Staphylococcus epidermidis
ATPNKAARNQLPKDVRDDDRFYPTKKEQNRL

SEQ ID NO: 1774333 - protein, 10 aa, Staphylococcus epidermidis
ATPNNGREAE

SEQ ID NO: 1774334 - protein, 5 aa, Staphylococcus epidermidis
ATPVH

SEQ ID NO: 1774335 - protein, 7 aa, Staphylococcus epidermidis
ATQHPDE

SEQ ID NO: 1774336 - protein, 7 aa, Staphylococcus epidermidis
ATQNEIT

SEQ ID NO: 1774337 - protein, 4 aa, Staphylococcus epidermidis
ATQQ

SEQ ID NO: 1774338 - protein, 20 aa, Staphylococcus epidermidis
ATQQAEKWYKDASKEELDEL

SEQ ID NO: 1774339 - protein, 4 aa, Staphylococcus epidermidis
ATRC

SEQ ID NO: 1774340 - protein, 6 aa, Staphylococcus epidermidis
ATRNAL

SEQ ID NO: 1774341 - protein, 6 aa, Staphylococcus epidermidis
ATRSAL

SEQ ID NO: 1774342 - protein, 6 aa, Staphylococcus epidermidis
ATSAIR

SEQ ID NO: 1774343 - protein, 7 aa, Staphylococcus epidermidis
ATSAVRT

SEQ ID NO: 1774344 - protein, 8 aa, Staphylococcus epidermidis
ATSEEYKG

SEQ ID NO: 1774345 - protein, 7 aa, Staphylococcus epidermidis
ATSESEV

SEQ ID NO: 1774346 - protein, 8 aa, Staphylococcus epidermidis
ATSEVDGI

SEQ ID NO: 1774347 - protein, 7 aa, Staphylococcus epidermidis
ATSPNDV

SEQ ID NO: 1774348 - protein, 12 aa, Staphylococcus epidermidis
ATSQEEVRSRGI

SEQ ID NO: 1774349 - protein, 5 aa, Staphylococcus epidermidis
ATTEY

SEQ ID NO: 1774350 - protein, 11 aa, Staphylococcus epidermidis
ATTGENGQFHP

SEQ ID NO: 1774351 - protein, 11 aa, Staphylococcus epidermidis
ATTGNSFATSN

SEQ ID NO: 1774352 - protein, 6 aa, Staphylococcus epidermidis
ATTNQA

SEQ ID NO: 1774353 - protein, 8 aa, Staphylococcus epidermidis
ATTTTNNK

SEQ ID NO: 1774354 - protein, 13 aa, Staphylococcus epidermidis
ATTVDEAIENERA

SEQ ID NO: 1774355 - protein, 4 aa, Staphylococcus epidermidis
ATTY

SEQ ID NO: 1774356 - protein, 17 aa, Staphylococcus epidermidis
ATVGQNHKPNRKEPKQI

SEQ ID NO: 1774357 - protein, 7 aa, Staphylococcus epidermidis
ATVKDDD

SEQ ID NO: 1774358 - protein, 16 aa, Staphylococcus epidermidis
ATVRTPNGGRSPEGSH

SEQ ID NO: 1774359 - protein, 9 aa, Staphylococcus epidermidis
ATVSGLSNS

SEQ ID NO: 1774360 - protein, 14 aa, Staphylococcus epidermidis
ATYGKDPETKGEYW

SEQ ID NO: 1774361 - protein, 12 aa, Staphylococcus epidermidis
ATYGKDPETKGL

SEQ ID NO: 1774362 - protein, 11 aa, Staphylococcus epidermidis
ATYKEKDLRGI

SEQ ID NO: 1774363 - protein, 13 aa, Staphylococcus epidermidis
ATYNKNAAETTDE

SEQ ID NO: 1774364 - protein, 13 aa, Staphylococcus epidermidis
ATYNKNATETTDE

SEQ ID NO: 1774365 - protein, 6 aa, Staphylococcus epidermidis
ATYQQT

SEQ ID NO: 1774366 - protein, 12 aa, Staphylococcus epidermidis
ATYTKEDAFNQE

SEQ ID NO: 1774367 - protein, 33 aa, Staphylococcus epidermidis
AVAEGKGKTKKESEQKAAEQAYKSMKKNEKLRH

SEQ ID NO: 1774368 - protein, 18 aa, Staphylococcus epidermidis
AVAGTIKRSHNEAEDEEN

SEQ ID NO: 1774369 - protein, 11 aa, Staphylococcus epidermidis
AVASGTATAFD

SEQ ID NO: 1774370 - protein, 16 aa, Staphylococcus epidermidis
AVDKGTSFGASTIQEN

SEQ ID NO: 1774371 - protein, 16 aa, Staphylococcus epidermidis
AVDNGTSFGASTLQEN

SEQ ID NO: 1774372 - protein, 36 aa, Staphylococcus epidermidis
AVEATPGNLKQLEQQNKRAAADRQQEIDDAKALKEQ

SEQ ID NO: 1774373 - protein, 22 aa, Staphylococcus epidermidis
AVEKGFADSYETQTKEEKEITS

SEQ ID NO: 1774374 - protein, 12 aa, Staphylococcus epidermidis
AVEQAENDVKKA

SEQ ID NO: 1774375 - protein, 6 aa, Staphylococcus epidermidis
AVEQGY

SEQ ID NO: 1774376 - protein, 16 aa, Staphylococcus epidermidis
AVESAQKRVEGNNFDA

SEQ ID NO: 1774377 - protein, 6 aa, Staphylococcus epidermidis
AVESSL

SEQ ID NO: 1774378 - protein, 22 aa, Staphylococcus epidermidis
AVEVNDKKIKTPKTHINPNEDH

SEQ ID NO: 1774379 - protein, 10 aa, Staphylococcus epidermidis
AVGDETETKE

SEQ ID NO: 1774380 - protein, 12 aa, Staphylococcus epidermidis
AVGDETETKEAV

SEQ ID NO: 1774381 - protein, 10 aa, Staphylococcus epidermidis
AVGDSGQVTG

SEQ ID NO: 1774382 - protein, 6 aa, Staphylococcus epidermidis
AVGDTK

SEQ ID NO: 1774383 - protein, 8 aa, Staphylococcus epidermidis
AVGGGNYD

SEQ ID NO: 1774384 - protein, 14 aa, Staphylococcus epidermidis
AVGNDGKSQRGDMT

SEQ ID NO: 1774385 - protein, 11 aa, Staphylococcus epidermidis
AVGNPGQANYV

SEQ ID NO: 1774386 - protein, 6 aa, Staphylococcus epidermidis
AVGNSS

SEQ ID NO: 1774387 - protein, 14 aa, Staphylococcus epidermidis
AVGQQNDVHQQSNY

SEQ ID NO: 1774388 - protein, 8 aa, Staphylococcus epidermidis
AVGSGTSA

SEQ ID NO: 1774389 - protein, 8 aa, Staphylococcus epidermidis
AVKRGAPD

SEQ ID NO: 1774390 - protein, 5 aa, Staphylococcus epidermidis
AVKSG

SEQ ID NO: 1774391 - protein, 18 aa, Staphylococcus epidermidis
AVNGDANGSIPTSEPQKY

SEQ ID NO: 1774392 - protein, 6 aa, Staphylococcus epidermidis
AVNTQD

SEQ ID NO: 1774393 - protein, 13 aa, Staphylococcus epidermidis
AVPDENGKEISRI

SEQ ID NO: 1774394 - protein, 8 aa, Staphylococcus epidermidis
AVQNSAIS

SEQ ID NO: 1774395 - protein, 27 aa, Staphylococcus epidermidis
AVSGSGIKGKRDLSEGANGKEPEAYPH

SEQ ID NO: 1774396 - protein, 6 aa, Staphylococcus epidermidis
AVSNGR

SEQ ID NO: 1774397 - protein, 14 aa, Staphylococcus epidermidis
AVSSSETVELLVKS

SEQ ID NO: 1774398 - protein, 15 aa, Staphylococcus epidermidis
AVTGSGKNGRITKED

SEQ ID NO: 1774399 - protein, 48 aa, Staphylococcus epidermidis
AVTSGQANMSGTRYTGTDLTGALKEDPIKDPKKAMKATQEGFKKKYNQ

SEQ ID NO: 1774400 - protein, 8 aa, Staphylococcus epidermidis
AYAEGNDR

SEQ ID NO: 1774401 - protein, 16 aa, Staphylococcus epidermidis
AYANKQVDGFTTNPSL

SEQ ID NO: 1774402 - protein, 5 aa, Staphylococcus epidermidis
AYAPE

SEQ ID NO: 1774403 - protein, 7 aa, Staphylococcus epidermidis
AYDKNNP

SEQ ID NO: 1774404 - protein, 20 aa, Staphylococcus epidermidis
AYDPKKDEFKEVTQEDLKGS

SEQ ID NO: 1774405 - protein, 19 aa, Staphylococcus epidermidis
AYDPKNDEFKEVSQEDFKG

SEQ ID NO: 1774406 - protein, 6 aa, Staphylococcus epidermidis
AYDQGA

SEQ ID NO: 1774407 - protein, 5 aa, Staphylococcus epidermidis
AYEAS

SEQ ID NO: 1774408 - protein, 6 aa, Staphylococcus epidermidis
AYEDAK

SEQ ID NO: 1774409 - protein, 6 aa, Staphylococcus epidermidis
AYEEGT

SEQ ID NO: 1774410 - protein, 5 aa, Staphylococcus epidermidis
AYENG

SEQ ID NO: 1774411 - protein, 13 aa, Staphylococcus epidermidis
AYERLSETNNFPE

SEQ ID NO: 1774412 - protein, 5 aa, Staphylococcus epidermidis
AYGEK

SEQ ID NO: 1774413 - protein, 8 aa, Staphylococcus epidermidis
AYGENNSI

SEQ ID NO: 1774414 - protein, 6 aa, Staphylococcus epidermidis
AYGGYG

SEQ ID NO: 1774415 - protein, 12 aa, Staphylococcus epidermidis
AYGKAKDNKAAA

SEQ ID NO: 1774416 - protein, 19 aa, Staphylococcus epidermidis
AYGKDDPAEEMYPGGENER

SEQ ID NO: 1774417 - protein, 4 aa, Staphylococcus epidermidis
AYHP

SEQ ID NO: 1774418 - protein, 16 aa, Staphylococcus epidermidis
AYKDTSVEVGQRAKDL

SEQ ID NO: 1774419 - protein, 9 aa, Staphylococcus epidermidis
AYKENPETG

SEQ ID NO: 1774420 - protein, 9 aa, Staphylococcus epidermidis
AYKKNSETG

SEQ ID NO: 1774421 - protein, 5 aa, Staphylococcus epidermidis
AYKNN

SEQ ID NO: 1774422 - protein, 13 aa, Staphylococcus epidermidis
AYLANGKSPKEAV

SEQ ID NO: 1774423 - protein, 19 aa, Staphylococcus epidermidis
AYNDITEDQEEDVKQRLKS

SEQ ID NO: 1774424 - protein, 5 aa, Staphylococcus epidermidis
AYNGK

SEQ ID NO: 1774425 - protein, 4 aa, Staphylococcus epidermidis
AYNN

SEQ ID NO: 1774426 - protein, 9 aa, Staphylococcus epidermidis
AYNNKPNSR

SEQ ID NO: 1774427 - protein, 11 aa, Staphylococcus epidermidis
AYNTDKGTGIK

SEQ ID NO: 1774428 - protein, 10 aa, Staphylococcus epidermidis
AYPEERKDQR

SEQ ID NO: 1774429 - protein, 6 aa, Staphylococcus epidermidis
AYPGKV

SEQ ID NO: 1774430 - protein, 10 aa, Staphylococcus epidermidis
AYQAQYSKGF

SEQ ID NO: 1774431 - protein, 5 aa, Staphylococcus epidermidis
AYQDP

SEQ ID NO: 1774432 - protein, 25 aa, Staphylococcus epidermidis
AYQEEASKKSDLERTDLAKGKTGVF

SEQ ID NO: 1774433 - protein, 5 aa, Staphylococcus epidermidis
AYQQD

SEQ ID NO: 1774434 - protein, 11 aa, Staphylococcus epidermidis
AYQRGKRDLPY

SEQ ID NO: 1774435 - protein, 6 aa, Staphylococcus epidermidis
AYQSDG

SEQ ID NO: 1774436 - protein, 8 aa, Staphylococcus epidermidis
AYRKRYDT

SEQ ID NO: 1774437 - protein, 6 aa, Staphylococcus epidermidis
AYRSPA

SEQ ID NO: 1774438 - protein, 6 aa, Staphylococcus epidermidis
AYSKRH

SEQ ID NO: 1774439 - protein, 23 aa, Staphylococcus epidermidis
AYTGEGKHVNSGELDGLENEAAI

SEQ ID NO: 1774440 - protein, 9 aa, Staphylococcus epidermidis
CANRDTAPA

SEQ ID NO: 1774441 - protein, 4 aa, Staphylococcus epidermidis
CDAI

SEQ ID NO: 1774442 - protein, 4 aa, Staphylococcus epidermidis
CDEG

SEQ ID NO: 1774443 - protein, 18 aa, Staphylococcus epidermidis
CDGEGAKPGTSKKTCSYC

SEQ ID NO: 1774444 - protein, 7 aa, Staphylococcus epidermidis
CDGKSGL

SEQ ID NO: 1774445 - protein, 7 aa, Staphylococcus epidermidis
CDGQDSG

SEQ ID NO: 1774446 - protein, 17 aa, Staphylococcus epidermidis
CDQQTRKFNEEASQEDG

SEQ ID NO: 1774447 - protein, 4 aa, Staphylococcus epidermidis
CDTT

SEQ ID NO: 1774448 - protein, 8 aa, Staphylococcus epidermidis
CEGCPTES

SEQ ID NO: 1774449 - protein, 12 aa, Staphylococcus epidermidis
CENHTSENVKIT

SEQ ID NO: 1774450 - protein, 8 aa, Staphylococcus epidermidis
CEQADSHY

SEQ ID NO: 1774451 - protein, 12 aa, Staphylococcus epidermidis
CFNQDESIKPQL

SEQ ID NO: 1774452 - protein, 11 aa, Staphylococcus epidermidis
CGDDGHTSYAG

SEQ ID NO: 1774453 - protein, 4 aa, Staphylococcus epidermidis
CGEC

SEQ ID NO: 1774454 - protein, 9 aa, Staphylococcus epidermidis
CGGASSGFN

SEQ ID NO: 1774455 - protein, 6 aa, Staphylococcus epidermidis
CGKTKR

SEQ ID NO: 1774456 - protein, 8 aa, Staphylococcus epidermidis
CGNGNDTY

SEQ ID NO: 1774457 - protein, 10 aa, Staphylococcus epidermidis
CGNNDPKTVD

SEQ ID NO: 1774458 - protein, 10 aa, Staphylococcus epidermidis
CGNSDPKTVD

SEQ ID NO: 1774459 - protein, 6 aa, Staphylococcus epidermidis
CGPGRR

SEQ ID NO: 1774460 - protein, 6 aa, Staphylococcus epidermidis
CGRPHS

SEQ ID NO: 1774461 - protein, 17 aa, Staphylococcus epidermidis
CGSANNQLKDEDAHSKM

SEQ ID NO: 1774462 - protein, 7 aa, Staphylococcus epidermidis
CGSGAAS

SEQ ID NO: 1774463 - protein, 8 aa, Staphylococcus epidermidis
CGSGKSTL

SEQ ID NO: 1774464 - protein, 16 aa, Staphylococcus epidermidis
CGSSFKTAKVAGNPEQ

SEQ ID NO: 1774465 - protein, 16 aa, Staphylococcus epidermidis
CGSSFKTAKVSGNPEQ

SEQ ID NO: 1774466 - protein, 8 aa, Staphylococcus epidermidis
CGTSIESS

SEQ ID NO: 1774467 - protein, 6 aa, Staphylococcus epidermidis
CGVNKE

SEQ ID NO: 1774468 - protein, 7 aa, Staphylococcus epidermidis
CHGTGKS

SEQ ID NO: 1774469 - protein, 8 aa, Staphylococcus epidermidis
CKESPEDV

SEQ ID NO: 1774470 - protein, 5 aa, Staphylococcus epidermidis
CKGEE

SEQ ID NO: 1774471 - protein, 10 aa, Staphylococcus epidermidis
CKKYDSDKSV

SEQ ID NO: 1774472 - protein, 5 aa, Staphylococcus epidermidis
CKNTK

SEQ ID NO: 1774473 - protein, 9 aa, Staphylococcus epidermidis
CKPPLSSRE

SEQ ID NO: 1774474 - protein, 8 aa, Staphylococcus epidermidis
CKREKPQL

SEQ ID NO: 1774475 - protein, 7 aa, Staphylococcus epidermidis
CNEEGYA

SEQ ID NO: 1774476 - protein, 10 aa, Staphylococcus epidermidis
CNESEENTQA

SEQ ID NO: 1774477 - protein, 7 aa, Staphylococcus epidermidis
CNHPKTE

SEQ ID NO: 1774478 - protein, 5 aa, Staphylococcus epidermidis
CNKAG

SEQ ID NO: 1774479 - protein, 10 aa, Staphylococcus epidermidis
CNPPLKEREI

SEQ ID NO: 1774480 - protein, 5 aa, Staphylococcus epidermidis
CPKVK

SEQ ID NO: 1774481 - protein, 12 aa, Staphylococcus epidermidis
CPYGPRPGEEVK

SEQ ID NO: 1774482 - protein, 7 aa, Staphylococcus epidermidis
CPYTNSL

SEQ ID NO: 1774483 - protein, 4 aa, Staphylococcus epidermidis
CQTN

SEQ ID NO: 1774484 - protein, 14 aa, Staphylococcus epidermidis
CREGQKRYKASLKE

SEQ ID NO: 1774485 - protein, 6 aa, Staphylococcus epidermidis
CRKYDG

SEQ ID NO: 1774486 - protein, 7 aa, Staphylococcus epidermidis
CRSDDEE

SEQ ID NO: 1774487 - protein, 13 aa, Staphylococcus epidermidis
CSGDDLMNTSGNY

SEQ ID NO: 1774488 - protein, 6 aa, Staphylococcus epidermidis
CSGKDE

SEQ ID NO: 1774489 - protein, 5 aa, Staphylococcus epidermidis
CSNGR

SEQ ID NO: 1774490 - protein, 5 aa, Staphylococcus epidermidis
CSSKI

SEQ ID NO: 1774491 - protein, 6 aa, Staphylococcus epidermidis
CSSRNT

SEQ ID NO: 1774492 - protein, 26 aa, Staphylococcus epidermidis
CSVQRKNQKLIEESPCSALSEERREQ

SEQ ID NO: 1774493 - protein, 13 aa, Staphylococcus epidermidis
CTSANNEKSHKSA

SEQ ID NO: 1774494 - protein, 9 aa, Staphylococcus epidermidis
CTSKENMEE

SEQ ID NO: 1774495 - protein, 6 aa, Staphylococcus epidermidis
CTSNKT

SEQ ID NO: 1774496 - protein, 10 aa, Staphylococcus epidermidis
CTYKEGDITP

SEQ ID NO: 1774497 - protein, 8 aa, Staphylococcus epidermidis
DAAESGVP

SEQ ID NO: 1774498 - protein, 15 aa, Staphylococcus epidermidis
DAAQAAVEKAQDTED

SEQ ID NO: 1774499 - protein, 8 aa, Staphylococcus epidermidis
DAASKHDV

SEQ ID NO: 1774500 - protein, 17 aa, Staphylococcus epidermidis
DAAYSEPVTVKASSNYQ

SEQ ID NO: 1774501 - protein, 7 aa, Staphylococcus epidermidis
DADIDQL

SEQ ID NO: 1774502 - protein, 11 aa, Staphylococcus epidermidis
DADKPSSPCGE

SEQ ID NO: 1774503 - protein, 5 aa, Staphylococcus epidermidis
DADMN

SEQ ID NO: 1774504 - protein, 6 aa, Staphylococcus epidermidis
DADQNC

SEQ ID NO: 1774505 - protein, 10 aa, Staphylococcus epidermidis
DADQPSSPCG

SEQ ID NO: 1774506 - protein, 12 aa, Staphylococcus epidermidis
DADVKTSQPPIG

SEQ ID NO: 1774507 - protein, 10 aa, Staphylococcus epidermidis
DADYKESKEA

SEQ ID NO: 1774508 - protein, 18 aa, Staphylococcus epidermidis
DAEDQYQKALEKNKGNQS

SEQ ID NO: 1774509 - protein, 18 aa, Staphylococcus epidermidis
DAEEDYPEYQPLGKPNPF

SEQ ID NO: 1774510 - protein, 6 aa, Staphylococcus epidermidis
DAEEIN

SEQ ID NO: 1774511 - protein, 11 aa, Staphylococcus epidermidis
DAEGHFENNGR

SEQ ID NO: 1774512 - protein, 9 aa, Staphylococcus epidermidis
DAEGKEDNV

SEQ ID NO: 1774513 - protein, 5 aa, Staphylococcus epidermidis
DAEKA

SEQ ID NO: 1774514 - protein, 7 aa, Staphylococcus epidermidis
DAEKRQY

SEQ ID NO: 1774515 - protein, 5 aa, Staphylococcus epidermidis
DAENS

SEQ ID NO: 1774516 - protein, 14 aa, Staphylococcus epidermidis
DAERQATKDAGKIA

SEQ ID NO: 1774517 - protein, 10 aa, Staphylococcus epidermidis
DAESKSVTSK

SEQ ID NO: 1774518 - protein, 12 aa, Staphylococcus epidermidis
DAETPIHLLGVE

SEQ ID NO: 1774519 - protein, 17 aa, Staphylococcus epidermidis
DAEVKNDGKQLDDINQE

SEQ ID NO: 1774520 - protein, 18 aa, Staphylococcus epidermidis
DAFNRRKGMTDDEIGQQL

SEQ ID NO: 1774521 - protein, 7 aa, Staphylococcus epidermidis
DAFRNSG

SEQ ID NO: 1774522 - protein, 5 aa, Staphylococcus epidermidis
DAGAD

SEQ ID NO: 1774523 - protein, 13 aa, Staphylococcus epidermidis
DAGEISESTEKAV

SEQ ID NO: 1774524 - protein, 7 aa, Staphylococcus epidermidis
DAGIEAK

SEQ ID NO: 1774525 - protein, 4 aa, Staphylococcus epidermidis
DAGQ

SEQ ID NO: 1774526 - protein, 10 aa, Staphylococcus epidermidis
DAGTMNSKQY

SEQ ID NO: 1774527 - protein, 5 aa, Staphylococcus epidermidis
DAGYL

SEQ ID NO: 1774528 - protein, 6 aa, Staphylococcus epidermidis
DAHERS

SEQ ID NO: 1774529 - protein, 8 aa, Staphylococcus epidermidis
DAHISEGD

SEQ ID NO: 1774530 - protein, 9 aa, Staphylococcus epidermidis
DAHPTKKGY

SEQ ID NO: 1774531 - protein, 5 aa, Staphylococcus epidermidis
DAHSP

SEQ ID NO: 1774532 - protein, 9 aa, Staphylococcus epidermidis
DAIANGSDY

SEQ ID NO: 1774533 - protein, 6 aa, Staphylococcus epidermidis
DAIEAS

SEQ ID NO: 1774534 - protein, 12 aa, Staphylococcus epidermidis
DAIERVKKSRQV

SEQ ID NO: 1774535 - protein, 7 aa, Staphylococcus epidermidis
DAIPNNA

SEQ ID NO: 1774536 - protein, 13 aa, Staphylococcus epidermidis
DAISEAKDALNSI

SEQ ID NO: 1774537 - protein, 10 aa, Staphylococcus epidermidis
DAISRKNMPN

SEQ ID NO: 1774538 - protein, 8 aa, Staphylococcus epidermidis
DAKDGQTY

SEQ ID NO: 1774539 - protein, 7 aa, Staphylococcus epidermidis
DAKLDDG

SEQ ID NO: 1774540 - protein, 8 aa, Staphylococcus epidermidis
DAKPDEIV

SEQ ID NO: 1774541 - protein, 8 aa, Staphylococcus epidermidis
DAKPTGVT

SEQ ID NO: 1774542 - protein, 9 aa, Staphylococcus epidermidis
DAKTDELNE

SEQ ID NO: 1774543 - protein, 18 aa, Staphylococcus epidermidis
DAKVYSNKEYKTDLGLQY

SEQ ID NO: 1774544 - protein, 4 aa, Staphylococcus epidermidis
DALD

SEQ ID NO: 1774545 - protein, 5 aa, Staphylococcus epidermidis
DALDG

SEQ ID NO: 1774546 - protein, 11 aa, Staphylococcus epidermidis
DALEKANLNTT

SEQ ID NO: 1774547 - protein, 8 aa, Staphylococcus epidermidis
DALENGDL

SEQ ID NO: 1774548 - protein, 9 aa, Staphylococcus epidermidis
DALKNDPKL

SEQ ID NO: 1774549 - protein, 14 aa, Staphylococcus epidermidis
DALQGNVSSPKKAA

SEQ ID NO: 1774550 - protein, 25 aa, Staphylococcus epidermidis
DAMNSAKSSSTKDRVSIKNKAPNTL

SEQ ID NO: 1774551 - protein, 6 aa, Staphylococcus epidermidis
DANEGK

SEQ ID NO: 1774552 - protein, 6 aa, Staphylococcus epidermidis
DANENC

SEQ ID NO: 1774553 - protein, 5 aa, Staphylococcus epidermidis
DANEQ

SEQ ID NO: 1774554 - protein, 8 aa, Staphylococcus epidermidis
DANNDKDM

SEQ ID NO: 1774555 - protein, 9 aa, Staphylococcus epidermidis
DANNLTDNK

SEQ ID NO: 1774556 - protein, 4 aa, Staphylococcus epidermidis
DANR

SEQ ID NO: 1774557 - protein, 7 aa, Staphylococcus epidermidis
DANREAF

SEQ ID NO: 1774558 - protein, 19 aa, Staphylococcus epidermidis
DANTGKDIIPPKTIAGEVD

SEQ ID NO: 1774559 - protein, 6 aa, Staphylococcus epidermidis
DANVTD

SEQ ID NO: 1774560 - protein, 7 aa, Staphylococcus epidermidis
DAPAETI

SEQ ID NO: 1774561 - protein, 6 aa, Staphylococcus epidermidis
DAPEVS

SEQ ID NO: 1774562 - protein, 19 aa, Staphylococcus epidermidis
DAPGQVSDKQLQELSLRIR

SEQ ID NO: 1774563 - protein, 8 aa, Staphylococcus epidermidis
DAPKKNPK

SEQ ID NO: 1774564 - protein, 8 aa, Staphylococcus epidermidis
DAPKTKEF

SEQ ID NO: 1774565 - protein, 7 aa, Staphylococcus epidermidis
DAPLQSD

SEQ ID NO: 1774566 - protein, 12 aa, Staphylococcus epidermidis
DAPRKELSAYAP

SEQ ID NO: 1774567 - protein, 12 aa, Staphylococcus epidermidis
DAQIYEKEDSRV

SEQ ID NO: 1774568 - protein, 8 aa, Staphylococcus epidermidis
DAQKTSVN

SEQ ID NO: 1774569 - protein, 22 aa, Staphylococcus epidermidis
DAQNQKTVPDFNESIEKFKSVV

SEQ ID NO: 1774570 - protein, 8 aa, Staphylococcus epidermidis
DAQQNDDL

SEQ ID NO: 1774571 - protein, 19 aa, Staphylococcus epidermidis
DAQRNAAENEIKTSEDLTS

SEQ ID NO: 1774572 - protein, 11 aa, Staphylococcus epidermidis
DAQTTSQFSEL

SEQ ID NO: 1774573 - protein, 8 aa, Staphylococcus epidermidis
DAQTTTQF

SEQ ID NO: 1774574 - protein, 14 aa, Staphylococcus epidermidis
DARGERERVKQRAN

SEQ ID NO: 1774575 - protein, 7 aa, Staphylococcus epidermidis
DARHRRN

SEQ ID NO: 1774576 - protein, 7 aa, Staphylococcus epidermidis
DARRRRE

SEQ ID NO: 1774577 - protein, 7 aa, Staphylococcus epidermidis
DASDNTL

SEQ ID NO: 1774578 - protein, 17 aa, Staphylococcus epidermidis
DASKIKKTAKKAAQESW

SEQ ID NO: 1774579 - protein, 16 aa, Staphylococcus epidermidis
DASKIKKTAKQAAQES

SEQ ID NO: 1774580 - protein, 15 aa, Staphylococcus epidermidis
DASKMKKIGKQAIRE

SEQ ID NO: 1774581 - protein, 8 aa, Staphylococcus epidermidis
DASNEGSI

SEQ ID NO: 1774582 - protein, 9 aa, Staphylococcus epidermidis
DASPHTEAS

SEQ ID NO: 1774583 - protein, 10 aa, Staphylococcus epidermidis
DASQKESFDR

SEQ ID NO: 1774584 - protein, 8 aa, Staphylococcus epidermidis
DASSDSPF

SEQ ID NO: 1774585 - protein, 17 aa, Staphylococcus epidermidis
DASTNSIVGTPTQIGTN

SEQ ID NO: 1774586 - protein, 9 aa, Staphylococcus epidermidis
DATEPYTRT

SEQ ID NO: 1774587 - protein, 7 aa, Staphylococcus epidermidis
DATGATG

SEQ ID NO: 1774588 - protein, 7 aa, Staphylococcus epidermidis
DATGHEV

SEQ ID NO: 1774589 - protein, 7 aa, Staphylococcus epidermidis
DATGLGS

SEQ ID NO: 1774590 - protein, 11 aa, Staphylococcus epidermidis
DATNEAAQKVN

SEQ ID NO: 1774591 - protein, 8 aa, Staphylococcus epidermidis
DATPYDHT

SEQ ID NO: 1774592 - protein, 5 aa, Staphylococcus epidermidis
DATTD

SEQ ID NO: 1774593 - protein, 5 aa, Staphylococcus epidermidis
DATTE

SEQ ID NO: 1774594 - protein, 7 aa, Staphylococcus epidermidis
DAVEKGF

SEQ ID NO: 1774595 - protein, 5 aa, Staphylococcus epidermidis
DAVPD

SEQ ID NO: 1774596 - protein, 6 aa, Staphylococcus epidermidis
DAVTSA

SEQ ID NO: 1774597 - protein, 17 aa, Staphylococcus epidermidis
DAYASQKKLKSQEAQPV

SEQ ID NO: 1774598 - protein, 9 aa, Staphylococcus epidermidis
DAYDNNSEL

SEQ ID NO: 1774599 - protein, 12 aa, Staphylococcus epidermidis
DAYGKTIRAKTM

SEQ ID NO: 1774600 - protein, 7 aa, Staphylococcus epidermidis
DAYPNDS

SEQ ID NO: 1774601 - protein, 6 aa, Staphylococcus epidermidis
DAYPNH

SEQ ID NO: 1774602 - protein, 13 aa, Staphylococcus epidermidis
DCDVETNVGPNGV

SEQ ID NO: 1774603 - protein, 11 aa, Staphylococcus epidermidis
DCNKEEALNYK

SEQ ID NO: 1774604 - protein, 7 aa, Staphylococcus epidermidis
DCQTSHS

SEQ ID NO: 1774605 - protein, 10 aa, Staphylococcus epidermidis
DDADRIATEE

SEQ ID NO: 1774606 - protein, 26 aa, Staphylococcus epidermidis
DDAEDGNLIQTSDEEKTTEEEQKAHS

SEQ ID NO: 1774607 - protein, 11 aa, Staphylococcus epidermidis
DDAKKTAKKIG

SEQ ID NO: 1774608 - protein, 9 aa, Staphylococcus epidermidis
DDAKKVAKK

SEQ ID NO: 1774609 - protein, 4 aa, Staphylococcus epidermidis
DDAL

SEQ ID NO: 1774610 - protein, 9 aa, Staphylococcus epidermidis
DDANDAAFG

SEQ ID NO: 1774611 - protein, 6 aa, Staphylococcus epidermidis
DDAQSM

SEQ ID NO: 1774612 - protein, 5 aa, Staphylococcus epidermidis
DDASQ

SEQ ID NO: 1774613 - protein, 9 aa, Staphylococcus epidermidis
DDDDEEDKN

SEQ ID NO: 1774614 - protein, 6 aa, Staphylococcus epidermidis
DDDFSG

SEQ ID NO: 1774615 - protein, 5 aa, Staphylococcus epidermidis
DDDGE

SEQ ID NO: 1774616 - protein, 7 aa, Staphylococcus epidermidis
DDDGNSF

SEQ ID NO: 1774617 - protein, 4 aa, Staphylococcus epidermidis
DDDT

SEQ ID NO: 1774618 - protein, 6 aa, Staphylococcus epidermidis
DDDTNL

SEQ ID NO: 1774619 - protein, 5 aa, Staphylococcus epidermidis
DDEER

SEQ ID NO: 1774620 - protein, 15 aa, Staphylococcus epidermidis
DDEGNLHRLMSADID

SEQ ID NO: 1774621 - protein, 10 aa, Staphylococcus epidermidis
DDELKKDRLK

SEQ ID NO: 1774622 - protein, 7 aa, Staphylococcus epidermidis
DDENQMR

SEQ ID NO: 1774623 - protein, 8 aa, Staphylococcus epidermidis
DDENVEIN

SEQ ID NO: 1774624 - protein, 20 aa, Staphylococcus epidermidis
DDEQTQESFNKDVRDRTEAM

SEQ ID NO: 1774625 - protein, 6 aa, Staphylococcus epidermidis
DDESDG

SEQ ID NO: 1774626 - protein, 4 aa, Staphylococcus epidermidis
DDET

SEQ ID NO: 1774627 - protein, 11 aa, Staphylococcus epidermidis
DDETFSSAGTI

SEQ ID NO: 1774628 - protein, 10 aa, Staphylococcus epidermidis
DDETLDESIA

SEQ ID NO: 1774629 - protein, 7 aa, Staphylococcus epidermidis
DDETVKS

SEQ ID NO: 1774630 - protein, 5 aa, Staphylococcus epidermidis
DDEVD

SEQ ID NO: 1774631 - protein, 7 aa, Staphylococcus epidermidis
DDEVITS

SEQ ID NO: 1774632 - protein, 7 aa, Staphylococcus epidermidis
DDEYHGV

SEQ ID NO: 1774633 - protein, 4 aa, Staphylococcus epidermidis
DDFD

SEQ ID NO: 1774634 - protein, 11 aa, Staphylococcus epidermidis
DDFDTAEKQGC

SEQ ID NO: 1774635 - protein, 4 aa, Staphylococcus epidermidis
DDFN

SEQ ID NO: 1774636 - protein, 7 aa, Staphylococcus epidermidis
DDGDTLN

SEQ ID NO: 1774637 - protein, 6 aa, Staphylococcus epidermidis
DDGGAL

SEQ ID NO: 1774638 - protein, 7 aa, Staphylococcus epidermidis
DDGGALQ

SEQ ID NO: 1774639 - protein, 7 aa, Staphylococcus epidermidis
DDGITTH

SEQ ID NO: 1774640 - protein, 8 aa, Staphylococcus epidermidis
DDGKASQY

SEQ ID NO: 1774641 - protein, 9 aa, Staphylococcus epidermidis
DDGKVTGDA

SEQ ID NO: 1774642 - protein, 13 aa, Staphylococcus epidermidis
DDGNEVPPHTKGN

SEQ ID NO: 1774643 - protein, 10 aa, Staphylococcus epidermidis
DDGPKNREDA

SEQ ID NO: 1774644 - protein, 4 aa, Staphylococcus epidermidis
DDGY

SEQ ID NO: 1774645 - protein, 5 aa, Staphylococcus epidermidis
DDHPH

SEQ ID NO: 1774646 - protein, 12 aa, Staphylococcus epidermidis
DDIEGKTKEDIA

SEQ ID NO: 1774647 - protein, 26 aa, Staphylococcus epidermidis
DDIEGKTKEDIAHEYTETQKQITSIE

SEQ ID NO: 1774648 - protein, 14 aa, Staphylococcus epidermidis
DDIKDELKDLNNSF

SEQ ID NO: 1774649 - protein, 9 aa, Staphylococcus epidermidis
DDINKPSAA

SEQ ID NO: 1774650 - protein, 12 aa, Staphylococcus epidermidis
DDINSGNDDVKA

SEQ ID NO: 1774651 - protein, 7 aa, Staphylococcus epidermidis
DDIRPNG

SEQ ID NO: 1774652 - protein, 9 aa, Staphylococcus epidermidis
DDISFSEKD

SEQ ID NO: 1774653 - protein, 23 aa, Staphylococcus epidermidis
DDITEYTNEEDGAAHYLKTHLLD

SEQ ID NO: 1774654 - protein, 16 aa, Staphylococcus epidermidis
DDIVGYTEEERNNNVE

SEQ ID NO: 1774655 - protein, 4 aa, Staphylococcus epidermidis
DDKA

SEQ ID NO: 1774656 - protein, 7 aa, Staphylococcus epidermidis
DDKAHAD

SEQ ID NO: 1774657 - protein, 8 aa, Staphylococcus epidermidis
DDKDKFLS

SEQ ID NO: 1774658 - protein, 6 aa, Staphylococcus epidermidis
DDKNAR

SEQ ID NO: 1774659 - protein, 17 aa, Staphylococcus epidermidis
DDKVVTSTHDISENDSI

SEQ ID NO: 1774660 - protein, 5 aa, Staphylococcus epidermidis
DDLAS

SEQ ID NO: 1774661 - protein, 9 aa, Staphylococcus epidermidis
DDLEDEDLI

SEQ ID NO: 1774662 - protein, 4 aa, Staphylococcus epidermidis
DDLG

SEQ ID NO: 1774663 - protein, 8 aa, Staphylococcus epidermidis
DDLGYSDN

SEQ ID NO: 1774664 - protein, 6 aa, Staphylococcus epidermidis
DDLKQP

SEQ ID NO: 1774665 - protein, 14 aa, Staphylococcus epidermidis
DDLNEQKKKIETYT

SEQ ID NO: 1774666 - protein, 8 aa, Staphylococcus epidermidis
DDLNGRTI

SEQ ID NO: 1774667 - protein, 9 aa, Staphylococcus epidermidis
DDLTEEEMK

SEQ ID NO: 1774668 - protein, 6 aa, Staphylococcus epidermidis
DDMNNP

SEQ ID NO: 1774669 - protein, 5 aa, Staphylococcus epidermidis
DDMNR

SEQ ID NO: 1774670 - protein, 10 aa, Staphylococcus epidermidis
DDNAKLTARQ

SEQ ID NO: 1774671 - protein, 8 aa, Staphylococcus epidermidis
DDNANAQL

SEQ ID NO: 1774672 - protein, 12 aa, Staphylococcus epidermidis
DDNASATDFNRP

SEQ ID NO: 1774673 - protein, 4 aa, Staphylococcus epidermidis
DDNH

SEQ ID NO: 1774674 - protein, 6 aa, Staphylococcus epidermidis
DDNHQT

SEQ ID NO: 1774675 - protein, 5 aa, Staphylococcus epidermidis
DDNKH

SEQ ID NO: 1774676 - protein, 8 aa, Staphylococcus epidermidis
DDNKMARA

SEQ ID NO: 1774677 - protein, 6 aa, Staphylococcus epidermidis
DDNNHY

SEQ ID NO: 1774678 - protein, 10 aa, Staphylococcus epidermidis
DDNQDNITEH

SEQ ID NO: 1774679 - protein, 4 aa, Staphylococcus epidermidis
DDNT

SEQ ID NO: 1774680 - protein, 7 aa, Staphylococcus epidermidis
DDNVSED

SEQ ID NO: 1774681 - protein, 6 aa, Staphylococcus epidermidis
DDNYEY

SEQ ID NO: 1774682 - protein, 6 aa, Staphylococcus epidermidis
DDNYSI

SEQ ID NO: 1774683 - protein, 9 aa, Staphylococcus epidermidis
DDPAGKSWS

SEQ ID NO: 1774684 - protein, 9 aa, Staphylococcus epidermidis
DDPEITSHP

SEQ ID NO: 1774685 - protein, 7 aa, Staphylococcus epidermidis
DDPSELK

SEQ ID NO: 1774686 - protein, 6 aa, Staphylococcus epidermidis
DDPSYQ

SEQ ID NO: 1774687 - protein, 8 aa, Staphylococcus epidermidis
DDPTTSYK

SEQ ID NO: 1774688 - protein, 7 aa, Staphylococcus epidermidis
DDQLNQG

SEQ ID NO: 1774689 - protein, 5 aa, Staphylococcus epidermidis
DDQME

SEQ ID NO: 1774690 - protein, 10 aa, Staphylococcus epidermidis
DDQNKAQDII

SEQ ID NO: 1774691 - protein, 8 aa, Staphylococcus epidermidis
DDRERSLK

SEQ ID NO: 1774692 - protein, 6 aa, Staphylococcus epidermidis
DDRHLR

SEQ ID NO: 1774693 - protein, 13 aa, Staphylococcus epidermidis
DDRRDKSRKMNDK

SEQ ID NO: 1774694 - protein, 11 aa, Staphylococcus epidermidis
DDSDRFEKNGE

SEQ ID NO: 1774695 - protein, 12 aa, Staphylococcus epidermidis
DDSEFEYPKDAY

SEQ ID NO: 1774696 - protein, 10 aa, Staphylococcus epidermidis
DDSERDKVYR

SEQ ID NO: 1774697 - protein, 11 aa, Staphylococcus epidermidis
DDSESYENITK

SEQ ID NO: 1774698 - protein, 9 aa, Staphylococcus epidermidis
DDSNFEIEP

SEQ ID NO: 1774699 - protein, 10 aa, Staphylococcus epidermidis
DDSNQDTKYV

SEQ ID NO: 1774700 - protein, 26 aa, Staphylococcus epidermidis
DDSQQQSDETTHSEQEDSKQHQYNEA

SEQ ID NO: 1774701 - protein, 7 aa, Staphylococcus epidermidis
DDSQTNS

SEQ ID NO: 1774702 - protein, 7 aa, Staphylococcus epidermidis
DDSSFIT

SEQ ID NO: 1774703 - protein, 7 aa, Staphylococcus epidermidis
DDSTSDL

SEQ ID NO: 1774704 - protein, 4 aa, Staphylococcus epidermidis
DDSV

SEQ ID NO: 1774705 - protein, 5 aa, Staphylococcus epidermidis
DDSVF

SEQ ID NO: 1774706 - protein, 16 aa, Staphylococcus epidermidis
DDSYAYENEEGQYGKS

SEQ ID NO: 1774707 - protein, 12 aa, Staphylococcus epidermidis
DDSYKDLKKGRV

SEQ ID NO: 1774708 - protein, 15 aa, Staphylococcus epidermidis
DDTDENGVCTATEDY

SEQ ID NO: 1774709 - protein, 7 aa, Staphylococcus epidermidis
DDTDYER

SEQ ID NO: 1774710 - protein, 6 aa, Staphylococcus epidermidis
DDTFTV

SEQ ID NO: 1774711 - protein, 7 aa, Staphylococcus epidermidis
DDTGSLA

SEQ ID NO: 1774712 - protein, 4 aa, Staphylococcus epidermidis
DDTI

SEQ ID NO: 1774713 - protein, 8 aa, Staphylococcus epidermidis
DDTKNAYL

SEQ ID NO: 1774714 - protein, 7 aa, Staphylococcus epidermidis
DDTNEVG

SEQ ID NO: 1774715 - protein, 16 aa, Staphylococcus epidermidis
DDTNSSENALAIPNKQ

SEQ ID NO: 1774716 - protein, 7 aa, Staphylococcus epidermidis
DDTPLGS

SEQ ID NO: 1774717 - protein, 10 aa, Staphylococcus epidermidis
DDTRNTNPKF

SEQ ID NO: 1774718 - protein, 7 aa, Staphylococcus epidermidis
DDTSNYE

SEQ ID NO: 1774719 - protein, 18 aa, Staphylococcus epidermidis
DDVDPRVTTGKYYSPKEF

SEQ ID NO: 1774720 - protein, 57 aa, Staphylococcus epidermidis
DDVEREKSKSFGEAKHVTAEDGKEKAKPQPIVKGDQVGRNDPCPCGSGKKYKNCHGK

SEQ ID NO: 1774721 - protein, 11 aa, Staphylococcus epidermidis
DDVIPTQSNEY

SEQ ID NO: 1774722 - protein, 10 aa, Staphylococcus epidermidis
DDVKSEIQSL

SEQ ID NO: 1774723 - protein, 5 aa, Staphylococcus epidermidis
DDVTG

SEQ ID NO: 1774724 - protein, 11 aa, Staphylococcus epidermidis
DDYKAQSIEPY

SEQ ID NO: 1774725 - protein, 6 aa, Staphylococcus epidermidis
DDYSED

SEQ ID NO: 1774726 - protein, 5 aa, Staphylococcus epidermidis
DEAAQ

SEQ ID NO: 1774727 - protein, 9 aa, Staphylococcus epidermidis
DEADTQSGV

SEQ ID NO: 1774728 - protein, 8 aa, Staphylococcus epidermidis
DEAGSGKI

SEQ ID NO: 1774729 - protein, 9 aa, Staphylococcus epidermidis
DEANAKAEL

SEQ ID NO: 1774730 - protein, 9 aa, Staphylococcus epidermidis
DEANEAIKH

SEQ ID NO: 1774731 - protein, 14 aa, Staphylococcus epidermidis
DEANYQAGEIEEVS

SEQ ID NO: 1774732 - protein, 5 aa, Staphylococcus epidermidis
DEAQQ

SEQ ID NO: 1774733 - protein, 19 aa, Staphylococcus epidermidis
DEARGITGQNITVDGGLTM

SEQ ID NO: 1774734 - protein, 7 aa, Staphylococcus epidermidis
DEARPKA

SEQ ID NO: 1774735 - protein, 9 aa, Staphylococcus epidermidis
DEASLDATY

SEQ ID NO: 1774736 - protein, 12 aa, Staphylococcus epidermidis
DEATSAEERQNS

SEQ ID NO: 1774737 - protein, 5 aa, Staphylococcus epidermidis
DEAVK

SEQ ID NO: 1774738 - protein, 18 aa, Staphylococcus epidermidis
DECGGNSLVGSGRGSGAG

SEQ ID NO: 1774739 - protein, 5 aa, Staphylococcus epidermidis
DEDAA

SEQ ID NO: 1774740 - protein, 9 aa, Staphylococcus epidermidis
DEDDPLYAQ

SEQ ID NO: 1774741 - protein, 6 aa, Staphylococcus epidermidis
DEDEEI

SEQ ID NO: 1774742 - protein, 6 aa, Staphylococcus epidermidis
DEDEVE

SEQ ID NO: 1774743 - protein, 7 aa, Staphylococcus epidermidis
DEDFSRY

SEQ ID NO: 1774744 - protein, 5 aa, Staphylococcus epidermidis
DEDGF

SEQ ID NO: 1774745 - protein, 11 aa, Staphylococcus epidermidis
DEDGPGTPGTV

SEQ ID NO: 1774746 - protein, 6 aa, Staphylococcus epidermidis
DEDKEA

SEQ ID NO: 1774747 - protein, 7 aa, Staphylococcus epidermidis
DEDNIPE

SEQ ID NO: 1774748 - protein, 14 aa, Staphylococcus epidermidis
DEDREALSSSLSDF

SEQ ID NO: 1774749 - protein, 4 aa, Staphylococcus epidermidis
DEDS

SEQ ID NO: 1774750 - protein, 30 aa, Staphylococcus epidermidis
DEDVQVNDSPINSGQDNENELNKKDEEIED

SEQ ID NO: 1774751 - protein, 10 aa, Staphylococcus epidermidis
DEEAKQEIAP

SEQ ID NO: 1774752 - protein, 8 aa, Staphylococcus epidermidis
DEEDKDTI

SEQ ID NO: 1774753 - protein, 5 aa, Staphylococcus epidermidis
DEEDV

SEQ ID NO: 1774754 - protein, 9 aa, Staphylococcus epidermidis
DEEENKIQR

SEQ ID NO: 1774755 - protein, 15 aa, Staphylococcus epidermidis
DEEGKLGETENTQPA

SEQ ID NO: 1774756 - protein, 6 aa, Staphylococcus epidermidis
DEEGQL

SEQ ID NO: 1774757 - protein, 5 aa, Staphylococcus epidermidis
DEEIA

SEQ ID NO: 1774758 - protein, 4 aa, Staphylococcus epidermidis
DEEK

SEQ ID NO: 1774759 - protein, 8 aa, Staphylococcus epidermidis
DEEKEGRM

SEQ ID NO: 1774760 - protein, 7 aa, Staphylococcus epidermidis
DEELGQK

SEQ ID NO: 1774761 - protein, 7 aa, Staphylococcus epidermidis
DEELQND

SEQ ID NO: 1774762 - protein, 7 aa, Staphylococcus epidermidis
DEELSDL

SEQ ID NO: 1774763 - protein, 5 aa, Staphylococcus epidermidis
DEEMD

SEQ ID NO: 1774764 - protein, 7 aa, Staphylococcus epidermidis
DEENERI

SEQ ID NO: 1774765 - protein, 9 aa, Staphylococcus epidermidis
DEENGDTYT

SEQ ID NO: 1774766 - protein, 6 aa, Staphylococcus epidermidis
DEENPN

SEQ ID NO: 1774767 - protein, 84 aa, Staphylococcus epidermidis
DEEPSQEDASSSSNHDVSSKDETKQQDIDNDKHQSKKPNKSDDALTTSNYKEDASSVNKETDTTHNDNIKDHSTYTEDRHSSVV

SEQ ID NO: 1774768 - protein, 7 aa, Staphylococcus epidermidis
DEEQKEH

SEQ ID NO: 1774769 - protein, 6 aa, Staphylococcus epidermidis
DEEQLK

SEQ ID NO: 1774770 - protein, 6 aa, Staphylococcus epidermidis
DEETIE

SEQ ID NO: 1774771 - protein, 11 aa, Staphylococcus epidermidis
DEETPKDKAVA

SEQ ID NO: 1774772 - protein, 4 aa, Staphylococcus epidermidis
DEFT

SEQ ID NO: 1774773 - protein, 5 aa, Staphylococcus epidermidis
DEGGG

SEQ ID NO: 1774774 - protein, 8 aa, Staphylococcus epidermidis
DEGGGSSI

SEQ ID NO: 1774775 - protein, 9 aa, Staphylococcus epidermidis
DEGGGSSVP

SEQ ID NO: 1774776 - protein, 4 aa, Staphylococcus epidermidis
DEGI

SEQ ID NO: 1774777 - protein, 8 aa, Staphylococcus epidermidis
DEGKSHGK

SEQ ID NO: 1774778 - protein, 7 aa, Staphylococcus epidermidis
DEGNKDE

SEQ ID NO: 1774779 - protein, 27 aa, Staphylococcus epidermidis
DEGNKEEEKSEAEQKVYTGTDLKYLFG

SEQ ID NO: 1774780 - protein, 13 aa, Staphylococcus epidermidis
DEGQTEISSRDIG

SEQ ID NO: 1774781 - protein, 6 aa, Staphylococcus epidermidis
DEGRIG

SEQ ID NO: 1774782 - protein, 4 aa, Staphylococcus epidermidis
DEGS

SEQ ID NO: 1774783 - protein, 8 aa, Staphylococcus epidermidis
DEGSKYDM

SEQ ID NO: 1774784 - protein, 4 aa, Staphylococcus epidermidis
DEGY

SEQ ID NO: 1774785 - protein, 5 aa, Staphylococcus epidermidis
DEGYE

SEQ ID NO: 1774786 - protein, 13 aa, Staphylococcus epidermidis
DEHNNTEKSEELK

SEQ ID NO: 1774787 - protein, 4 aa, Staphylococcus epidermidis
DEHT

SEQ ID NO: 1774788 - protein, 4 aa, Staphylococcus epidermidis
DEID

SEQ ID NO: 1774789 - protein, 5 aa, Staphylococcus epidermidis
DEIDE

SEQ ID NO: 1774790 - protein, 8 aa, Staphylococcus epidermidis
DEIDNDNL

SEQ ID NO: 1774791 - protein, 7 aa, Staphylococcus epidermidis
DEIEARD

SEQ ID NO: 1774792 - protein, 16 aa, Staphylococcus epidermidis
DEIKENDAKLNEVDNK

SEQ ID NO: 1774793 - protein, 6 aa, Staphylococcus epidermidis
DEIKQR

SEQ ID NO: 1774794 - protein, 10 aa, Staphylococcus epidermidis
DEIKTSTKRR

SEQ ID NO: 1774795 - protein, 9 aa, Staphylococcus epidermidis
DEIPEPPKL

SEQ ID NO: 1774796 - protein, 6 aa, Staphylococcus epidermidis
DEIPES

SEQ ID NO: 1774797 - protein, 20 aa, Staphylococcus epidermidis
DEIQGTIGGIGERAGNTSIE

SEQ ID NO: 1774798 - protein, 4 aa, Staphylococcus epidermidis
DEIR

SEQ ID NO: 1774799 - protein, 4 aa, Staphylococcus epidermidis
DEIS

SEQ ID NO: 1774800 - protein, 13 aa, Staphylococcus epidermidis
DEITRNAAPVQSS

SEQ ID NO: 1774801 - protein, 9 aa, Staphylococcus epidermidis
DEKAEASDM

SEQ ID NO: 1774802 - protein, 31 aa, Staphylococcus epidermidis
DEKARRDREERARAKQASQRIINDDRDHGLE

SEQ ID NO: 1774803 - protein, 10 aa, Staphylococcus epidermidis
DEKDTQAFSK

SEQ ID NO: 1774804 - protein, 9 aa, Staphylococcus epidermidis
DEKEKGTRK

SEQ ID NO: 1774805 - protein, 8 aa, Staphylococcus epidermidis
DEKERSEH

SEQ ID NO: 1774806 - protein, 8 aa, Staphylococcus epidermidis
DEKGYKAG

SEQ ID NO: 1774807 - protein, 7 aa, Staphylococcus epidermidis
DEKKPSC

SEQ ID NO: 1774808 - protein, 16 aa, Staphylococcus epidermidis
DEKNQFEGDYSSTEEF

SEQ ID NO: 1774809 - protein, 8 aa, Staphylococcus epidermidis
DEKRQSIK

SEQ ID NO: 1774810 - protein, 19 aa, Staphylococcus epidermidis
DEKTKEQYQDSIPSDEEGR

SEQ ID NO: 1774811 - protein, 10 aa, Staphylococcus epidermidis
DEKTNPEDFH

SEQ ID NO: 1774812 - protein, 8 aa, Staphylococcus epidermidis
DEKTPNHL

SEQ ID NO: 1774813 - protein, 13 aa, Staphylococcus epidermidis
DEKVGKKLSLTGA

SEQ ID NO: 1774814 - protein, 14 aa, Staphylococcus epidermidis
DEKVVPGNTNLKEY

SEQ ID NO: 1774815 - protein, 6 aa, Staphylococcus epidermidis
DELPES

SEQ ID NO: 1774816 - protein, 14 aa, Staphylococcus epidermidis
DELSDEYNETYQDD

SEQ ID NO: 1774817 - protein, 7 aa, Staphylococcus epidermidis
DELTPRN

SEQ ID NO: 1774818 - protein, 4 aa, Staphylococcus epidermidis
DEMA

SEQ ID NO: 1774819 - protein, 6 aa, Staphylococcus epidermidis
DEMGYS

SEQ ID NO: 1774820 - protein, 5 aa, Staphylococcus epidermidis
DEMRR

SEQ ID NO: 1774821 - protein, 7 aa, Staphylococcus epidermidis
DENAIPD

SEQ ID NO: 1774822 - protein, 5 aa, Staphylococcus epidermidis
DENAS

SEQ ID NO: 1774823 - protein, 14 aa, Staphylococcus epidermidis
DENATQDDYKTLER

SEQ ID NO: 1774824 - protein, 6 aa, Staphylococcus epidermidis
DENDQK

SEQ ID NO: 1774825 - protein, 6 aa, Staphylococcus epidermidis
DENGEM

SEQ ID NO: 1774826 - protein, 8 aa, Staphylococcus epidermidis
DENGGTVN

SEQ ID NO: 1774827 - protein, 6 aa, Staphylococcus epidermidis
DENGQP

SEQ ID NO: 1774828 - protein, 7 aa, Staphylococcus epidermidis
DENHKDL

SEQ ID NO: 1774829 - protein, 12 aa, Staphylococcus epidermidis
DENKFKNTKQVS

SEQ ID NO: 1774830 - protein, 12 aa, Staphylococcus epidermidis
DENKFKNTNQVS

SEQ ID NO: 1774831 - protein, 8 aa, Staphylococcus epidermidis
DENLTDEQ

SEQ ID NO: 1774832 - protein, 8 aa, Staphylococcus epidermidis
DENLTDQA

SEQ ID NO: 1774833 - protein, 19 aa, Staphylococcus epidermidis
DENNEDIQKNYNKSSYKKE

SEQ ID NO: 1774834 - protein, 7 aa, Staphylococcus epidermidis
DENQQVN

SEQ ID NO: 1774835 - protein, 7 aa, Staphylococcus epidermidis
DENQSKD

SEQ ID NO: 1774836 - protein, 5 aa, Staphylococcus epidermidis
DENRY

SEQ ID NO: 1774837 - protein, 12 aa, Staphylococcus epidermidis
DENSIQKDDDGV

SEQ ID NO: 1774838 - protein, 7 aa, Staphylococcus epidermidis
DENSNQI

SEQ ID NO: 1774839 - protein, 4 aa, Staphylococcus epidermidis
DENV

SEQ ID NO: 1774840 - protein, 5 aa, Staphylococcus epidermidis
DENVA

SEQ ID NO: 1774841 - protein, 5 aa, Staphylococcus epidermidis
DENVD

SEQ ID NO: 1774842 - protein, 4 aa, Staphylococcus epidermidis
DEPD

SEQ ID NO: 1774843 - protein, 5 aa, Staphylococcus epidermidis
DEPGI

SEQ ID NO: 1774844 - protein, 6 aa, Staphylococcus epidermidis
DEPLEI

SEQ ID NO: 1774845 - protein, 24 aa, Staphylococcus epidermidis
DEPSEISEAISNGAKYVTTSYEKL

SEQ ID NO: 1774846 - protein, 4 aa, Staphylococcus epidermidis
DEPT

SEQ ID NO: 1774847 - protein, 5 aa, Staphylococcus epidermidis
DEPTA

SEQ ID NO: 1774848 - protein, 14 aa, Staphylococcus epidermidis
DEPTASLDAKRAKE

SEQ ID NO: 1774849 - protein, 14 aa, Staphylococcus epidermidis
DEPTGALDSKTSKN

SEQ ID NO: 1774850 - protein, 9 aa, Staphylococcus epidermidis
DEPTTNLDN

SEQ ID NO: 1774851 - protein, 8 aa, Staphylococcus epidermidis
DEQDNEIE

SEQ ID NO: 1774852 - protein, 4 aa, Staphylococcus epidermidis
DEQF

SEQ ID NO: 1774853 - protein, 4 aa, Staphylococcus epidermidis
DEQG

SEQ ID NO: 1774854 - protein, 19 aa, Staphylococcus epidermidis
DEQLEEAAERLTQLANMYD

SEQ ID NO: 1774855 - protein, 6 aa, Staphylococcus epidermidis
DEQPHV

SEQ ID NO: 1774856 - protein, 5 aa, Staphylococcus epidermidis
DEQPL

SEQ ID NO: 1774857 - protein, 8 aa, Staphylococcus epidermidis
DEQSIEQS

SEQ ID NO: 1774858 - protein, 7 aa, Staphylococcus epidermidis
DEQSKTG

SEQ ID NO: 1774859 - protein, 9 aa, Staphylococcus epidermidis
DEQSKTVGA

SEQ ID NO: 1774860 - protein, 6 aa, Staphylococcus epidermidis
DEQTQL

SEQ ID NO: 1774861 - protein, 7 aa, Staphylococcus epidermidis
DEQYDED

SEQ ID NO: 1774862 - protein, 4 aa, Staphylococcus epidermidis
DERA

SEQ ID NO: 1774863 - protein, 9 aa, Staphylococcus epidermidis
DERDASRNP

SEQ ID NO: 1774864 - protein, 7 aa, Staphylococcus epidermidis
DERDYGG

SEQ ID NO: 1774865 - protein, 4 aa, Staphylococcus epidermidis
DERE

SEQ ID NO: 1774866 - protein, 4 aa, Staphylococcus epidermidis
DERF

SEQ ID NO: 1774867 - protein, 5 aa, Staphylococcus epidermidis
DERFK

SEQ ID NO: 1774868 - protein, 6 aa, Staphylococcus epidermidis
DERLNR

SEQ ID NO: 1774869 - protein, 5 aa, Staphylococcus epidermidis
DERQA

SEQ ID NO: 1774870 - protein, 16 aa, Staphylococcus epidermidis
DERQKLKSLLSANKIY

SEQ ID NO: 1774871 - protein, 6 aa, Staphylococcus epidermidis
DERSKE

SEQ ID NO: 1774872 - protein, 4 aa, Staphylococcus epidermidis
DERV

SEQ ID NO: 1774873 - protein, 8 aa, Staphylococcus epidermidis
DESAANDL

SEQ ID NO: 1774874 - protein, 11 aa, Staphylococcus epidermidis
DESEDPDAIER

SEQ ID NO: 1774875 - protein, 16 aa, Staphylococcus epidermidis
DESERQKRMRNYLINY

SEQ ID NO: 1774876 - protein, 7 aa, Staphylococcus epidermidis
DESGKLD

SEQ ID NO: 1774877 - protein, 8 aa, Staphylococcus epidermidis
DESGNDIK

SEQ ID NO: 1774878 - protein, 12 aa, Staphylococcus epidermidis
DESIGDADDRTI

SEQ ID NO: 1774879 - protein, 7 aa, Staphylococcus epidermidis
DESKAQA

SEQ ID NO: 1774880 - protein, 10 aa, Staphylococcus epidermidis
DESKTTTRVN

SEQ ID NO: 1774881 - protein, 7 aa, Staphylococcus epidermidis
DESLTEQ

SEQ ID NO: 1774882 - protein, 8 aa, Staphylococcus epidermidis
DESMTDQL

SEQ ID NO: 1774883 - protein, 19 aa, Staphylococcus epidermidis
DESNKNSKRRAAKNVYDSK

SEQ ID NO: 1774884 - protein, 4 aa, Staphylococcus epidermidis
DESP

SEQ ID NO: 1774885 - protein, 7 aa, Staphylococcus epidermidis
DESQRDM

SEQ ID NO: 1774886 - protein, 7 aa, Staphylococcus epidermidis
DESRTVK

SEQ ID NO: 1774887 - protein, 9 aa, Staphylococcus epidermidis
DESTSEEEV

SEQ ID NO: 1774888 - protein, 6 aa, Staphylococcus epidermidis
DESVTD

SEQ ID NO: 1774889 - protein, 7 aa, Staphylococcus epidermidis
DETDNGF

SEQ ID NO: 1774890 - protein, 8 aa, Staphylococcus epidermidis
DETETRLE

SEQ ID NO: 1774891 - protein, 6 aa, Staphylococcus epidermidis
DETEWE

SEQ ID NO: 1774892 - protein, 7 aa, Staphylococcus epidermidis
DETGTDV

SEQ ID NO: 1774893 - protein, 4 aa, Staphylococcus epidermidis
DETK

SEQ ID NO: 1774894 - protein, 24 aa, Staphylococcus epidermidis
DETQRRRDIQTAHNEKYGITPRTI

SEQ ID NO: 1774895 - protein, 5 aa, Staphylococcus epidermidis
DETSF

SEQ ID NO: 1774896 - protein, 7 aa, Staphylococcus epidermidis
DETSNYE

SEQ ID NO: 1774897 - protein, 5 aa, Staphylococcus epidermidis
DETSY

SEQ ID NO: 1774898 - protein, 27 aa, Staphylococcus epidermidis
DETTSAKVSDEKTKSNTNNYLEQDKNV

SEQ ID NO: 1774899 - protein, 9 aa, Staphylococcus epidermidis
DETVKTSDN

SEQ ID NO: 1774900 - protein, 8 aa, Staphylococcus epidermidis
DETVSPEK

SEQ ID NO: 1774901 - protein, 5 aa, Staphylococcus epidermidis
DETWG

SEQ ID NO: 1774902 - protein, 7 aa, Staphylococcus epidermidis
DEVDQAK

SEQ ID NO: 1774903 - protein, 10 aa, Staphylococcus epidermidis
DEVEKGEQIK

SEQ ID NO: 1774904 - protein, 12 aa, Staphylococcus epidermidis
DEVEKHDNFPNK

SEQ ID NO: 1774905 - protein, 6 aa, Staphylococcus epidermidis
DEVGEY

SEQ ID NO: 1774906 - protein, 7 aa, Staphylococcus epidermidis
DEVGYDS

SEQ ID NO: 1774907 - protein, 10 aa, Staphylococcus epidermidis
DEVLNPGNTD

SEQ ID NO: 1774908 - protein, 4 aa, Staphylococcus epidermidis
DEVR

SEQ ID NO: 1774909 - protein, 6 aa, Staphylococcus epidermidis
DEVREQ

SEQ ID NO: 1774910 - protein, 12 aa, Staphylococcus epidermidis
DEVSATISTLDT

SEQ ID NO: 1774911 - protein, 5 aa, Staphylococcus epidermidis
DEVSH

SEQ ID NO: 1774912 - protein, 23 aa, Staphylococcus epidermidis
DEVTAGNGVKKDTMPGKGKLNNQ

SEQ ID NO: 1774913 - protein, 6 aa, Staphylococcus epidermidis
DEWSRS

SEQ ID NO: 1774914 - protein, 5 aa, Staphylococcus epidermidis
DEYAE

SEQ ID NO: 1774915 - protein, 8 aa, Staphylococcus epidermidis
DEYDETKR

SEQ ID NO: 1774916 - protein, 5 aa, Staphylococcus epidermidis
DEYDR

SEQ ID NO: 1774917 - protein, 5 aa, Staphylococcus epidermidis
DEYKD

SEQ ID NO: 1774918 - protein, 9 aa, Staphylococcus epidermidis
DEYQQTSGA

SEQ ID NO: 1774919 - protein, 6 aa, Staphylococcus epidermidis
DFDQNQ

SEQ ID NO: 1774920 - protein, 11 aa, Staphylococcus epidermidis
DFDRSPKKNKV

SEQ ID NO: 1774921 - protein, 4 aa, Staphylococcus epidermidis
DFDT

SEQ ID NO: 1774922 - protein, 5 aa, Staphylococcus epidermidis
DFEKS

SEQ ID NO: 1774923 - protein, 6 aa, Staphylococcus epidermidis
DFKDRK

SEQ ID NO: 1774924 - protein, 10 aa, Staphylococcus epidermidis
DFKEAKDSLE

SEQ ID NO: 1774925 - protein, 5 aa, Staphylococcus epidermidis
DFKEH

SEQ ID NO: 1774926 - protein, 9 aa, Staphylococcus epidermidis
DFKPKDLKK

SEQ ID NO: 1774927 - protein, 7 aa, Staphylococcus epidermidis
DFKSKND

SEQ ID NO: 1774928 - protein, 7 aa, Staphylococcus epidermidis
DFKSTEV

SEQ ID NO: 1774929 - protein, 7 aa, Staphylococcus epidermidis
DFNDGVA

SEQ ID NO: 1774930 - protein, 8 aa, Staphylococcus epidermidis
DFPIEETT

SEQ ID NO: 1774931 - protein, 5 aa, Staphylococcus epidermidis
DFPKS

SEQ ID NO: 1774932 - protein, 13 aa, Staphylococcus epidermidis
DFPKYGNNDSRVD

SEQ ID NO: 1774933 - protein, 8 aa, Staphylococcus epidermidis
DFPMEETT

SEQ ID NO: 1774934 - protein, 7 aa, Staphylococcus epidermidis
DFPNREN

SEQ ID NO: 1774935 - protein, 8 aa, Staphylococcus epidermidis
DFQDDTYA

SEQ ID NO: 1774936 - protein, 4 aa, Staphylococcus epidermidis
DFQT

SEQ ID NO: 1774937 - protein, 5 aa, Staphylococcus epidermidis
DFRNS

SEQ ID NO: 1774938 - protein, 10 aa, Staphylococcus epidermidis
DFRTATRNAV

SEQ ID NO: 1774939 - protein, 12 aa, Staphylococcus epidermidis
DFSEDAEDAGVQ

SEQ ID NO: 1774940 - protein, 8 aa, Staphylococcus epidermidis
DFSENAED

SEQ ID NO: 1774941 - protein, 7 aa, Staphylococcus epidermidis
DFSETRN

SEQ ID NO: 1774942 - protein, 12 aa, Staphylococcus epidermidis
DFSKISKQLEQS

SEQ ID NO: 1774943 - protein, 9 aa, Staphylococcus epidermidis
DFSPKEQVG

SEQ ID NO: 1774944 - protein, 13 aa, Staphylococcus epidermidis
DFSQKNRENTHNW

SEQ ID NO: 1774945 - protein, 10 aa, Staphylococcus epidermidis
DFTEDSEDYG

SEQ ID NO: 1774946 - protein, 5 aa, Staphylococcus epidermidis
DFTNI

SEQ ID NO: 1774947 - protein, 4 aa, Staphylococcus epidermidis
DFVG

SEQ ID NO: 1774948 - protein, 11 aa, Staphylococcus epidermidis
DGAKLETRNGY

SEQ ID NO: 1774949 - protein, 10 aa, Staphylococcus epidermidis
DGANGSTSSL

SEQ ID NO: 1774950 - protein, 12 aa, Staphylococcus epidermidis
DGAPMSPSEIQE

SEQ ID NO: 1774951 - protein, 10 aa, Staphylococcus epidermidis
DGAVENGNTV

SEQ ID NO: 1774952 - protein, 6 aa, Staphylococcus epidermidis
DGAYSN

SEQ ID NO: 1774953 - protein, 9 aa, Staphylococcus epidermidis
DGDFRSSES

SEQ ID NO: 1774954 - protein, 11 aa, Staphylococcus epidermidis
DGDLKGSSIGY

SEQ ID NO: 1774955 - protein, 8 aa, Staphylococcus epidermidis
DGDYPDEI

SEQ ID NO: 1774956 - protein, 10 aa, Staphylococcus epidermidis
DGEDPTAEKP

SEQ ID NO: 1774957 - protein, 15 aa, Staphylococcus epidermidis
DGEEALQKVEDEQPE

SEQ ID NO: 1774958 - protein, 10 aa, Staphylococcus epidermidis
DGEEITEYPA

SEQ ID NO: 1774959 - protein, 7 aa, Staphylococcus epidermidis
DGEIDKQ

SEQ ID NO: 1774960 - protein, 10 aa, Staphylococcus epidermidis
DGEIKGVSQR

SEQ ID NO: 1774961 - protein, 13 aa, Staphylococcus epidermidis
DGEKPPKDMRGKK

SEQ ID NO: 1774962 - protein, 7 aa, Staphylococcus epidermidis
DGELPGS

SEQ ID NO: 1774963 - protein, 8 aa, Staphylococcus epidermidis
DGELTDTG

SEQ ID NO: 1774964 - protein, 13 aa, Staphylococcus epidermidis
DGENVKDGQVGTI

SEQ ID NO: 1774965 - protein, 20 aa, Staphylococcus epidermidis
DGEQLDLTGKQVKKVESGDY

SEQ ID NO: 1774966 - protein, 8 aa, Staphylococcus epidermidis
DGESTCTQ

SEQ ID NO: 1774967 - protein, 5 aa, Staphylococcus epidermidis
DGESY

SEQ ID NO: 1774968 - protein, 19 aa, Staphylococcus epidermidis
DGFAGNSALGMPKRPYTEE

SEQ ID NO: 1774969 - protein, 13 aa, Staphylococcus epidermidis
DGFKGKKESLPSD

SEQ ID NO: 1774970 - protein, 5 aa, Staphylococcus epidermidis
DGFPD

SEQ ID NO: 1774971 - protein, 9 aa, Staphylococcus epidermidis
DGGEGTTKV

SEQ ID NO: 1774972 - protein, 8 aa, Staphylococcus epidermidis
DGGKAEIY

SEQ ID NO: 1774973 - protein, 5 aa, Staphylococcus epidermidis
DGGQV

SEQ ID NO: 1774974 - protein, 31 aa, Staphylococcus epidermidis
DGGRNSYAQRTVGRDRLPDDDGGHLKRTEIG

SEQ ID NO: 1774975 - protein, 7 aa, Staphylococcus epidermidis
DGHTLSK

SEQ ID NO: 1774976 - protein, 14 aa, Staphylococcus epidermidis
DGHWHTTKGQHAQP

SEQ ID NO: 1774977 - protein, 13 aa, Staphylococcus epidermidis
DGHYSGAKELGRA

SEQ ID NO: 1774978 - protein, 5 aa, Staphylococcus epidermidis
DGIGD

SEQ ID NO: 1774979 - protein, 10 aa, Staphylococcus epidermidis
DGIGSKRKTT

SEQ ID NO: 1774980 - protein, 26 aa, Staphylococcus epidermidis
DGIHNKDDIKRSSAYVNADPTKISAY

SEQ ID NO: 1774981 - protein, 7 aa, Staphylococcus epidermidis
DGKARNR

SEQ ID NO: 1774982 - protein, 6 aa, Staphylococcus epidermidis
DGKDAV

SEQ ID NO: 1774983 - protein, 15 aa, Staphylococcus epidermidis
DGKDLSQDAHAKDLE

SEQ ID NO: 1774984 - protein, 12 aa, Staphylococcus epidermidis
DGKDYNDELFKE

SEQ ID NO: 1774985 - protein, 6 aa, Staphylococcus epidermidis
DGKEKL

SEQ ID NO: 1774986 - protein, 8 aa, Staphylococcus epidermidis
DGKESGYR

SEQ ID NO: 1774987 - protein, 6 aa, Staphylococcus epidermidis
DGKEYG

SEQ ID NO: 1774988 - protein, 15 aa, Staphylococcus epidermidis
DGKGDGVKTPPFSPE

SEQ ID NO: 1774989 - protein, 6 aa, Staphylococcus epidermidis
DGKGHI

SEQ ID NO: 1774990 - protein, 8 aa, Staphylococcus epidermidis
DGKHNEKT

SEQ ID NO: 1774991 - protein, 20 aa, Staphylococcus epidermidis
DGKIAYDSQRKDEEPRGGKH

SEQ ID NO: 1774992 - protein, 8 aa, Staphylococcus epidermidis
DGKITNDN

SEQ ID NO: 1774993 - protein, 8 aa, Staphylococcus epidermidis
DGKKMSEK

SEQ ID NO: 1774994 - protein, 12 aa, Staphylococcus epidermidis
DGKNAADPVTGQ

SEQ ID NO: 1774995 - protein, 9 aa, Staphylococcus epidermidis
DGKNQSVNN

SEQ ID NO: 1774996 - protein, 6 aa, Staphylococcus epidermidis
DGKPKD

SEQ ID NO: 1774997 - protein, 10 aa, Staphylococcus epidermidis
DGKPYLNDED

SEQ ID NO: 1774998 - protein, 7 aa, Staphylococcus epidermidis
DGKQYKS

SEQ ID NO: 1774999 - protein, 8 aa, Staphylococcus epidermidis
DGKSLTRE

SEQ ID NO: 1775000 - protein, 8 aa, Staphylococcus epidermidis
DGKTEGTI

SEQ ID NO: 1775001 - protein, 16 aa, Staphylococcus epidermidis
DGKTVRKDTTKNDLGH

SEQ ID NO: 1775002 - protein, 6 aa, Staphylococcus epidermidis
DGKTYH

SEQ ID NO: 1775003 - protein, 5 aa, Staphylococcus epidermidis
DGKYG

SEQ ID NO: 1775004 - protein, 7 aa, Staphylococcus epidermidis
DGKYTGQ

SEQ ID NO: 1775005 - protein, 10 aa, Staphylococcus epidermidis
DGLDQERDVT

SEQ ID NO: 1775006 - protein, 6 aa, Staphylococcus epidermidis
DGLNKT

SEQ ID NO: 1775007 - protein, 7 aa, Staphylococcus epidermidis
DGLTKDW

SEQ ID NO: 1775008 - protein, 9 aa, Staphylococcus epidermidis
DGLTRQNYA

SEQ ID NO: 1775009 - protein, 4 aa, Staphylococcus epidermidis
DGNE

SEQ ID NO: 1775010 - protein, 10 aa, Staphylococcus epidermidis
DGNEVDETLK

SEQ ID NO: 1775011 - protein, 8 aa, Staphylococcus epidermidis
DGNGRTSR

SEQ ID NO: 1775012 - protein, 8 aa, Staphylococcus epidermidis
DGNNIEDN

SEQ ID NO: 1775013 - protein, 9 aa, Staphylococcus epidermidis
DGNNIEDNK

SEQ ID NO: 1775014 - protein, 10 aa, Staphylococcus epidermidis
DGNPKNNNVE

SEQ ID NO: 1775015 - protein, 10 aa, Staphylococcus epidermidis
DGNPKNNNVK

SEQ ID NO: 1775016 - protein, 7 aa, Staphylococcus epidermidis
DGNTAEL

SEQ ID NO: 1775017 - protein, 4 aa, Staphylococcus epidermidis
DGNV

SEQ ID NO: 1775018 - protein, 11 aa, Staphylococcus epidermidis
DGPEAGMNEQK

SEQ ID NO: 1775019 - protein, 9 aa, Staphylococcus epidermidis
DGPKETGGL

SEQ ID NO: 1775020 - protein, 6 aa, Staphylococcus epidermidis
DGPNHD

SEQ ID NO: 1775021 - protein, 8 aa, Staphylococcus epidermidis
DGPSETGI

SEQ ID NO: 1775022 - protein, 10 aa, Staphylococcus epidermidis
DGPYPDEVEK

SEQ ID NO: 1775023 - protein, 10 aa, Staphylococcus epidermidis
DGQERSIDDL

SEQ ID NO: 1775024 - protein, 9 aa, Staphylococcus epidermidis
DGQKYGAYK

SEQ ID NO: 1775025 - protein, 6 aa, Staphylococcus epidermidis
DGQLDD

SEQ ID NO: 1775026 - protein, 10 aa, Staphylococcus epidermidis
DGQTFTENDD

SEQ ID NO: 1775027 - protein, 13 aa, Staphylococcus epidermidis
DGQVGNNDDANEI

SEQ ID NO: 1775028 - protein, 7 aa, Staphylococcus epidermidis
DGQYSGE

SEQ ID NO: 1775029 - protein, 10 aa, Staphylococcus epidermidis
DGRASTSGYF

SEQ ID NO: 1775030 - protein, 9 aa, Staphylococcus epidermidis
DGREEKGHT

SEQ ID NO: 1775031 - protein, 13 aa, Staphylococcus epidermidis
DGRETPRKPRIVN

SEQ ID NO: 1775032 - protein, 8 aa, Staphylococcus epidermidis
DGRPELPK

SEQ ID NO: 1775033 - protein, 6 aa, Staphylococcus epidermidis
DGRPKL

SEQ ID NO: 1775034 - protein, 9 aa, Staphylococcus epidermidis
DGRQPGYRE

SEQ ID NO: 1775035 - protein, 8 aa, Staphylococcus epidermidis
DGRTAQRE

SEQ ID NO: 1775036 - protein, 8 aa, Staphylococcus epidermidis
DGRTRTLE

SEQ ID NO: 1775037 - protein, 10 aa, Staphylococcus epidermidis
DGSDETDAIE

SEQ ID NO: 1775038 - protein, 9 aa, Staphylococcus epidermidis
DGSERAERR

SEQ ID NO: 1775039 - protein, 8 aa, Staphylococcus epidermidis
DGSIYGEK

SEQ ID NO: 1775040 - protein, 13 aa, Staphylococcus epidermidis
DGSKALSEKRKQA

SEQ ID NO: 1775041 - protein, 11 aa, Staphylococcus epidermidis
DGSLEAPQGRN

SEQ ID NO: 1775042 - protein, 24 aa, Staphylococcus epidermidis
DGSLPQPVSSSSLITDEEKKYFEQ

SEQ ID NO: 1775043 - protein, 27 aa, Staphylococcus epidermidis
DGSLPSNNFTGIGTADTPDGKDFARTI

SEQ ID NO: 1775044 - protein, 6 aa, Staphylococcus epidermidis
DGSNGS

SEQ ID NO: 1775045 - protein, 5 aa, Staphylococcus epidermidis
DGSPY

SEQ ID NO: 1775046 - protein, 9 aa, Staphylococcus epidermidis
DGSTDNTKR

SEQ ID NO: 1775047 - protein, 10 aa, Staphylococcus epidermidis
DGSTDQSEQL

SEQ ID NO: 1775048 - protein, 4 aa, Staphylococcus epidermidis
DGSV

SEQ ID NO: 1775049 - protein, 11 aa, Staphylococcus epidermidis
DGSVGSGFDLP

SEQ ID NO: 1775050 - protein, 8 aa, Staphylococcus epidermidis
DGSVIGAG

SEQ ID NO: 1775051 - protein, 5 aa, Staphylococcus epidermidis
DGSVT

SEQ ID NO: 1775052 - protein, 13 aa, Staphylococcus epidermidis
DGSYSDEMKGIYY

SEQ ID NO: 1775053 - protein, 5 aa, Staphylococcus epidermidis
DGTAN

SEQ ID NO: 1775054 - protein, 6 aa, Staphylococcus epidermidis
DGTEHT

SEQ ID NO: 1775055 - protein, 8 aa, Staphylococcus epidermidis
DGTFGRDG

SEQ ID NO: 1775056 - protein, 7 aa, Staphylococcus epidermidis
DGTGVVK

SEQ ID NO: 1775057 - protein, 6 aa, Staphylococcus epidermidis
DGTLNN

SEQ ID NO: 1775058 - protein, 13 aa, Staphylococcus epidermidis
DGTMAKGNDLQTF

SEQ ID NO: 1775059 - protein, 5 aa, Staphylococcus epidermidis
DGTNL

SEQ ID NO: 1775060 - protein, 4 aa, Staphylococcus epidermidis
DGTP

SEQ ID NO: 1775061 - protein, 6 aa, Staphylococcus epidermidis
DGTQLG

SEQ ID NO: 1775062 - protein, 6 aa, Staphylococcus epidermidis
DGTRIE

SEQ ID NO: 1775063 - protein, 7 aa, Staphylococcus epidermidis
DGTRPVK

SEQ ID NO: 1775064 - protein, 18 aa, Staphylococcus epidermidis
DGTRTYHTGDKAKEEDGQ

SEQ ID NO: 1775065 - protein, 4 aa, Staphylococcus epidermidis
DGTS

SEQ ID NO: 1775066 - protein, 12 aa, Staphylococcus epidermidis
DGTSNKGKLGAN

SEQ ID NO: 1775067 - protein, 18 aa, Staphylococcus epidermidis
DGTSVRLTGQDSERGTFS

SEQ ID NO: 1775068 - protein, 7 aa, Staphylococcus epidermidis
DGTTQVT

SEQ ID NO: 1775069 - protein, 5 aa, Staphylococcus epidermidis
DGTVN

SEQ ID NO: 1775070 - protein, 13 aa, Staphylococcus epidermidis
DGTYSDEMKGIYY

SEQ ID NO: 1775071 - protein, 5 aa, Staphylococcus epidermidis
DGVPT

SEQ ID NO: 1775072 - protein, 20 aa, Staphylococcus epidermidis
DGYGNLPSVKDDAKVLDENS

SEQ ID NO: 1775073 - protein, 7 aa, Staphylococcus epidermidis
DGYKEGD

SEQ ID NO: 1775074 - protein, 17 aa, Staphylococcus epidermidis
DGYNQTQLAKKAGISRQ

SEQ ID NO: 1775075 - protein, 6 aa, Staphylococcus epidermidis
DHASSK

SEQ ID NO: 1775076 - protein, 11 aa, Staphylococcus epidermidis
DHENEMKAEEK

SEQ ID NO: 1775077 - protein, 12 aa, Staphylococcus epidermidis
DHESAPEGVCVL

SEQ ID NO: 1775078 - protein, 5 aa, Staphylococcus epidermidis
DHESV

SEQ ID NO: 1775079 - protein, 6 aa, Staphylococcus epidermidis
DHGGKA

SEQ ID NO: 1775080 - protein, 9 aa, Staphylococcus epidermidis
DHGSDFTSN

SEQ ID NO: 1775081 - protein, 5 aa, Staphylococcus epidermidis
DHHKP

SEQ ID NO: 1775082 - protein, 13 aa, Staphylococcus epidermidis
DHKGASRADSGEI

SEQ ID NO: 1775083 - protein, 5 aa, Staphylococcus epidermidis
DHKGI

SEQ ID NO: 1775084 - protein, 9 aa, Staphylococcus epidermidis
DHNTPTKSI

SEQ ID NO: 1775085 - protein, 4 aa, Staphylococcus epidermidis
DHPE

SEQ ID NO: 1775086 - protein, 8 aa, Staphylococcus epidermidis
DHPENQID

SEQ ID NO: 1775087 - protein, 6 aa, Staphylococcus epidermidis
DHPEYA

SEQ ID NO: 1775088 - protein, 13 aa, Staphylococcus epidermidis
DHQKTDKHAHNAN

SEQ ID NO: 1775089 - protein, 5 aa, Staphylococcus epidermidis
DHRDH

SEQ ID NO: 1775090 - protein, 5 aa, Staphylococcus epidermidis
DHREK

SEQ ID NO: 1775091 - protein, 10 aa, Staphylococcus epidermidis
DHSEATPATI

SEQ ID NO: 1775092 - protein, 12 aa, Staphylococcus epidermidis
DHTFSRGTHSKL

SEQ ID NO: 1775093 - protein, 7 aa, Staphylococcus epidermidis
DHTPEKG

SEQ ID NO: 1775094 - protein, 49 aa, Staphylococcus epidermidis
DIAEEKKNDSTDEGELTKEDKFVEETKSDPDDNKEVEPPKKGFWSRFFG

SEQ ID NO: 1775095 - protein, 49 aa, Staphylococcus epidermidis
DIAEEKKNDSTNEGELTKEDKFVEETKSDPDDNREVEPPKKGFWSRLFG

SEQ ID NO: 1775096 - protein, 4 aa, Staphylococcus epidermidis
DIAK

SEQ ID NO: 1775097 - protein, 8 aa, Staphylococcus epidermidis
DIAKGTKD

SEQ ID NO: 1775098 - protein, 7 aa, Staphylococcus epidermidis
DIARNTD

SEQ ID NO: 1775099 - protein, 7 aa, Staphylococcus epidermidis
DIATPNY

SEQ ID NO: 1775100 - protein, 6 aa, Staphylococcus epidermidis
DIDAKY

SEQ ID NO: 1775101 - protein, 9 aa, Staphylococcus epidermidis
DIDKPSEPF

SEQ ID NO: 1775102 - protein, 5 aa, Staphylococcus epidermidis
DIDNG

SEQ ID NO: 1775103 - protein, 11 aa, Staphylococcus epidermidis
DIDPNRIKDTG

SEQ ID NO: 1775104 - protein, 19 aa, Staphylococcus epidermidis
DIEEGVKSLKSKIDDDNAK

SEQ ID NO: 1775105 - protein, 5 aa, Staphylococcus epidermidis
DIEEN

SEQ ID NO: 1775106 - protein, 6 aa, Staphylococcus epidermidis
DIEHSN

SEQ ID NO: 1775107 - protein, 44 aa, Staphylococcus epidermidis
DIEKRPENKKAHNKKENLEQQLDANQQKINEAENLKQEHGNELP

SEQ ID NO: 1775108 - protein, 27 aa, Staphylococcus epidermidis
DIENKIKKTNELKSDLTELEKSEPEGI

SEQ ID NO: 1775109 - protein, 9 aa, Staphylococcus epidermidis
DIENSKGMP

SEQ ID NO: 1775110 - protein, 6 aa, Staphylococcus epidermidis
DIEPGK

SEQ ID NO: 1775111 - protein, 19 aa, Staphylococcus epidermidis
DIEQNNNNGNNEDLTENKI

SEQ ID NO: 1775112 - protein, 5 aa, Staphylococcus epidermidis
DIEQS

SEQ ID NO: 1775113 - protein, 31 aa, Staphylococcus epidermidis
DIEREKTKDLGEAKHVTAEDGKEKVKPQPIV

SEQ ID NO: 1775114 - protein, 6 aa, Staphylococcus epidermidis
DIESNE

SEQ ID NO: 1775115 - protein, 7 aa, Staphylococcus epidermidis
DIESNRE

SEQ ID NO: 1775116 - protein, 4 aa, Staphylococcus epidermidis
DIET

SEQ ID NO: 1775117 - protein, 5 aa, Staphylococcus epidermidis
DIGNE

SEQ ID NO: 1775118 - protein, 10 aa, Staphylococcus epidermidis
DIGNQKSTST

SEQ ID NO: 1775119 - protein, 9 aa, Staphylococcus epidermidis
DIGSSTGNL

SEQ ID NO: 1775120 - protein, 9 aa, Staphylococcus epidermidis
DIGTGSGAI

SEQ ID NO: 1775121 - protein, 5 aa, Staphylococcus epidermidis
DIHQN

SEQ ID NO: 1775122 - protein, 6 aa, Staphylococcus epidermidis
DIIESS

SEQ ID NO: 1775123 - protein, 4 aa, Staphylococcus epidermidis
DIKA

SEQ ID NO: 1775124 - protein, 62 aa, Staphylococcus epidermidis
DIKASHSKELPNSQFQNNEFGSSRTVNLSGQELPNSQSNDTENNDTDYIKTESNDTNDLNDN

SEQ ID NO: 1775125 - protein, 9 aa, Staphylococcus epidermidis
DIKKQDNGN

SEQ ID NO: 1775126 - protein, 14 aa, Staphylococcus epidermidis
DIKPDDTKEDLEER

SEQ ID NO: 1775127 - protein, 11 aa, Staphylococcus epidermidis
DIKPDDTKVQL

SEQ ID NO: 1775128 - protein, 7 aa, Staphylococcus epidermidis
DIKPGHY

SEQ ID NO: 1775129 - protein, 9 aa, Staphylococcus epidermidis
DIKSEIKSL

SEQ ID NO: 1775130 - protein, 9 aa, Staphylococcus epidermidis
DIKTKKTPR

SEQ ID NO: 1775131 - protein, 28 aa, Staphylococcus epidermidis
DILDRTGYTPVERQQIETTATVHFDDDI

SEQ ID NO: 1775132 - protein, 9 aa, Staphylococcus epidermidis
DINDDTADR

SEQ ID NO: 1775133 - protein, 22 aa, Staphylococcus epidermidis
DINNIRNNGQGLMGNNSEVNLS

SEQ ID NO: 1775134 - protein, 5 aa, Staphylococcus epidermidis
DINNP

SEQ ID NO: 1775135 - protein, 5 aa, Staphylococcus epidermidis
DINNV

SEQ ID NO: 1775136 - protein, 23 aa, Staphylococcus epidermidis
DINSASDHRVHETSSKQHDEQIQ

SEQ ID NO: 1775137 - protein, 21 aa, Staphylococcus epidermidis
DINSKEDFKATIERSDSCAVP

SEQ ID NO: 1775138 - protein, 21 aa, Staphylococcus epidermidis
DINTKEDFKATIERSDSCAVP

SEQ ID NO: 1775139 - protein, 14 aa, Staphylococcus epidermidis
DIPADQEAMDIGPK

SEQ ID NO: 1775140 - protein, 9 aa, Staphylococcus epidermidis
DIPDRQTGM

SEQ ID NO: 1775141 - protein, 7 aa, Staphylococcus epidermidis
DIPEAEE

SEQ ID NO: 1775142 - protein, 48 aa, Staphylococcus epidermidis
DIPEEKENENLNEEPSTIDDKQFEEIDNEYEDKEEKSPKKGFWSRLFG

SEQ ID NO: 1775143 - protein, 39 aa, Staphylococcus epidermidis
DIPEEKENENLNEEPSTIDDKQFEEIDNEYEDKEENHLK

SEQ ID NO: 1775144 - protein, 7 aa, Staphylococcus epidermidis
DIPEGRT

SEQ ID NO: 1775145 - protein, 6 aa, Staphylococcus epidermidis
DIPHEK

SEQ ID NO: 1775146 - protein, 9 aa, Staphylococcus epidermidis
DIPTKQAPK

SEQ ID NO: 1775147 - protein, 8 aa, Staphylococcus epidermidis
DIPTQQAP

SEQ ID NO: 1775148 - protein, 9 aa, Staphylococcus epidermidis
DIPTQQPPK

SEQ ID NO: 1775149 - protein, 5 aa, Staphylococcus epidermidis
DIQDE

SEQ ID NO: 1775150 - protein, 6 aa, Staphylococcus epidermidis
DIQNSI

SEQ ID NO: 1775151 - protein, 4 aa, Staphylococcus epidermidis
DIQP

SEQ ID NO: 1775152 - protein, 6 aa, Staphylococcus epidermidis
DIQPED

SEQ ID NO: 1775153 - protein, 6 aa, Staphylococcus epidermidis
DIQPEL

SEQ ID NO: 1775154 - protein, 5 aa, Staphylococcus epidermidis
DIRDE

SEQ ID NO: 1775155 - protein, 7 aa, Staphylococcus epidermidis
DIRRNEN

SEQ ID NO: 1775156 - protein, 7 aa, Staphylococcus epidermidis
DISDEEW

SEQ ID NO: 1775157 - protein, 11 aa, Staphylococcus epidermidis
DISKPEDLALD

SEQ ID NO: 1775158 - protein, 9 aa, Staphylococcus epidermidis
DISKQNANK

SEQ ID NO: 1775159 - protein, 9 aa, Staphylococcus epidermidis
DISKQNTNK

SEQ ID NO: 1775160 - protein, 8 aa, Staphylococcus epidermidis
DISLDGDL

SEQ ID NO: 1775161 - protein, 19 aa, Staphylococcus epidermidis
DISNSDVKIKENVSDIKQK

SEQ ID NO: 1775162 - protein, 5 aa, Staphylococcus epidermidis
DISQL

SEQ ID NO: 1775163 - protein, 11 aa, Staphylococcus epidermidis
DISQNGRAAQG

SEQ ID NO: 1775164 - protein, 5 aa, Staphylococcus epidermidis
DISQT

SEQ ID NO: 1775165 - protein, 18 aa, Staphylococcus epidermidis
DISRKVDKETKESKPKMI

SEQ ID NO: 1775166 - protein, 8 aa, Staphylococcus epidermidis
DISTHQEA

SEQ ID NO: 1775167 - protein, 7 aa, Staphylococcus epidermidis
DISTSKH

SEQ ID NO: 1775168 - protein, 9 aa, Staphylococcus epidermidis
DITAPTQNA

SEQ ID NO: 1775169 - protein, 10 aa, Staphylococcus epidermidis
DITDEATVNR

SEQ ID NO: 1775170 - protein, 12 aa, Staphylococcus epidermidis
DITEDKSLQQDT

SEQ ID NO: 1775171 - protein, 7 aa, Staphylococcus epidermidis
DITPDQV

SEQ ID NO: 1775172 - protein, 21 aa, Staphylococcus epidermidis
DITSQNHGYSIDRDSLKNTDL

SEQ ID NO: 1775173 - protein, 4 aa, Staphylococcus epidermidis
DIVD

SEQ ID NO: 1775174 - protein, 8 aa, Staphylococcus epidermidis
DKAAQSNL

SEQ ID NO: 1775175 - protein, 12 aa, Staphylococcus epidermidis
DKADQETVEKNT

SEQ ID NO: 1775176 - protein, 8 aa, Staphylococcus epidermidis
DKAEQEAL

SEQ ID NO: 1775177 - protein, 8 aa, Staphylococcus epidermidis
DKAEYEAD

SEQ ID NO: 1775178 - protein, 11 aa, Staphylococcus epidermidis
DKAFNGRKPSE

SEQ ID NO: 1775179 - protein, 11 aa, Staphylococcus epidermidis
DKAKGAGEENY

SEQ ID NO: 1775180 - protein, 8 aa, Staphylococcus epidermidis
DKAKKSTI

SEQ ID NO: 1775181 - protein, 8 aa, Staphylococcus epidermidis
DKANKEDI

SEQ ID NO: 1775182 - protein, 28 aa, Staphylococcus epidermidis
DKASLQKACEEGKVSELSGFAKKTEQNI

SEQ ID NO: 1775183 - protein, 7 aa, Staphylococcus epidermidis
DKDATVK

SEQ ID NO: 1775184 - protein, 16 aa, Staphylococcus epidermidis
DKDDPRFNRPTKPIGP

SEQ ID NO: 1775185 - protein, 12 aa, Staphylococcus epidermidis
DKDHNDKPAIKS

SEQ ID NO: 1775186 - protein, 9 aa, Staphylococcus epidermidis
DKDIEEGYK

SEQ ID NO: 1775187 - protein, 7 aa, Staphylococcus epidermidis
DKDIEQR

SEQ ID NO: 1775188 - protein, 19 aa, Staphylococcus epidermidis
DKDLSRLARRGSGSASRSI

SEQ ID NO: 1775189 - protein, 12 aa, Staphylococcus epidermidis
DKDNKDISREEM

SEQ ID NO: 1775190 - protein, 5 aa, Staphylococcus epidermidis
DKDRE

SEQ ID NO: 1775191 - protein, 7 aa, Staphylococcus epidermidis
DKDRGKL

SEQ ID NO: 1775192 - protein, 7 aa, Staphylococcus epidermidis
DKDSSEV

SEQ ID NO: 1775193 - protein, 8 aa, Staphylococcus epidermidis
DKDTSIKS

SEQ ID NO: 1775194 - protein, 8 aa, Staphylococcus epidermidis
DKEAVTDT

SEQ ID NO: 1775195 - protein, 8 aa, Staphylococcus epidermidis
DKEDDANW

SEQ ID NO: 1775196 - protein, 9 aa, Staphylococcus epidermidis
DKEENVKPQ

SEQ ID NO: 1775197 - protein, 16 aa, Staphylococcus epidermidis
DKEGFRDEEFDKDDKG

SEQ ID NO: 1775198 - protein, 7 aa, Staphylococcus epidermidis
DKEGFTI

SEQ ID NO: 1775199 - protein, 16 aa, Staphylococcus epidermidis
DKEGYRDEEFDEGDKG

SEQ ID NO: 1775200 - protein, 18 aa, Staphylococcus epidermidis
DKEGYRDEEFDKNDKGTW

SEQ ID NO: 1775201 - protein, 17 aa, Staphylococcus epidermidis
DKEGYRDEEFNKNDKGT

SEQ ID NO: 1775202 - protein, 10 aa, Staphylococcus epidermidis
DKEHNDKTAI

SEQ ID NO: 1775203 - protein, 8 aa, Staphylococcus epidermidis
DKEIDENI

SEQ ID NO: 1775204 - protein, 17 aa, Staphylococcus epidermidis
DKEKAETYELLCELFKV

SEQ ID NO: 1775205 - protein, 9 aa, Staphylococcus epidermidis
DKEKAGRYG

SEQ ID NO: 1775206 - protein, 13 aa, Staphylococcus epidermidis
DKEKAKNRRGKIG

SEQ ID NO: 1775207 - protein, 9 aa, Staphylococcus epidermidis
DKEKEQAQN

SEQ ID NO: 1775208 - protein, 10 aa, Staphylococcus epidermidis
DKEKEQAQNE

SEQ ID NO: 1775209 - protein, 16 aa, Staphylococcus epidermidis
DKEKLKKLAKSEEGRV

SEQ ID NO: 1775210 - protein, 6 aa, Staphylococcus epidermidis
DKELEK

SEQ ID NO: 1775211 - protein, 7 aa, Staphylococcus epidermidis
DKELNQN

SEQ ID NO: 1775212 - protein, 11 aa, Staphylococcus epidermidis
DKENKDKGPLA

SEQ ID NO: 1775213 - protein, 20 aa, Staphylococcus epidermidis
DKENQARQSDTSDYLESGST

SEQ ID NO: 1775214 - protein, 8 aa, Staphylococcus epidermidis
DKETERIN

SEQ ID NO: 1775215 - protein, 13 aa, Staphylococcus epidermidis
DKETKGSKPKMIQ

SEQ ID NO: 1775216 - protein, 17 aa, Staphylococcus epidermidis
DKETLQQACEEGKVSTL

SEQ ID NO: 1775217 - protein, 18 aa, Staphylococcus epidermidis
DKETLQQACEEGKVSTLK

SEQ ID NO: 1775218 - protein, 15 aa, Staphylococcus epidermidis
DKETLRYGENPQQSA

SEQ ID NO: 1775219 - protein, 20 aa, Staphylococcus epidermidis
DKETSVDQIKETLRQGGIPV

SEQ ID NO: 1775220 - protein, 5 aa, Staphylococcus epidermidis
DKEVS

SEQ ID NO: 1775221 - protein, 4 aa, Staphylococcus epidermidis
DKFE

SEQ ID NO: 1775222 - protein, 7 aa, Staphylococcus epidermidis
DKFREGF

SEQ ID NO: 1775223 - protein, 28 aa, Staphylococcus epidermidis
DKGEASSEHNDEKSHSKHIKTPSPSKDN

SEQ ID NO: 1775224 - protein, 7 aa, Staphylococcus epidermidis
DKGEIDT

SEQ ID NO: 1775225 - protein, 8 aa, Staphylococcus epidermidis
DKGEREYI

SEQ ID NO: 1775226 - protein, 8 aa, Staphylococcus epidermidis
DKGERQSD

SEQ ID NO: 1775227 - protein, 6 aa, Staphylococcus epidermidis
DKGHAL

SEQ ID NO: 1775228 - protein, 10 aa, Staphylococcus epidermidis
DKGIQSPKDL

SEQ ID NO: 1775229 - protein, 5 aa, Staphylococcus epidermidis
DKGKD

SEQ ID NO: 1775230 - protein, 7 aa, Staphylococcus epidermidis
DKGKTIE

SEQ ID NO: 1775231 - protein, 6 aa, Staphylococcus epidermidis
DKGLYK

SEQ ID NO: 1775232 - protein, 5 aa, Staphylococcus epidermidis
DKGPV

SEQ ID NO: 1775233 - protein, 5 aa, Staphylococcus epidermidis
DKGQP

SEQ ID NO: 1775234 - protein, 12 aa, Staphylococcus epidermidis
DKGRDKAHKASF

SEQ ID NO: 1775235 - protein, 7 aa, Staphylococcus epidermidis
DKGTATG

SEQ ID NO: 1775236 - protein, 4 aa, Staphylococcus epidermidis
DKGY

SEQ ID NO: 1775237 - protein, 9 aa, Staphylococcus epidermidis
DKHKELEKQ

SEQ ID NO: 1775238 - protein, 22 aa, Staphylococcus epidermidis
DKIEEKVENAEQQKEKFDQEVE

SEQ ID NO: 1775239 - protein, 20 aa, Staphylococcus epidermidis
DKINEYTGGEDNKDKNDKKD

SEQ ID NO: 1775240 - protein, 28 aa, Staphylococcus epidermidis
DKINNAKNDLHGSQKLEKDKQQATENIN

SEQ ID NO: 1775241 - protein, 7 aa, Staphylococcus epidermidis
DKINTPV

SEQ ID NO: 1775242 - protein, 14 aa, Staphylococcus epidermidis
DKIRKAQPSDEPIG

SEQ ID NO: 1775243 - protein, 5 aa, Staphylococcus epidermidis
DKIST

SEQ ID NO: 1775244 - protein, 13 aa, Staphylococcus epidermidis
DKITTHDAPTYTK

SEQ ID NO: 1775245 - protein, 13 aa, Staphylococcus epidermidis
DKITTHDDPTYTK

SEQ ID NO: 1775246 - protein, 4 aa, Staphylococcus epidermidis
DKKA

SEQ ID NO: 1775247 - protein, 8 aa, Staphylococcus epidermidis
DKKCPTCG

SEQ ID NO: 1775248 - protein, 12 aa, Staphylococcus epidermidis
DKKDKTRDPEAA

SEQ ID NO: 1775249 - protein, 8 aa, Staphylococcus epidermidis
DKKDPLEM

SEQ ID NO: 1775250 - protein, 8 aa, Staphylococcus epidermidis
DKKEARRM

SEQ ID NO: 1775251 - protein, 19 aa, Staphylococcus epidermidis
DKKFTNPSITDVVEAIRNG

SEQ ID NO: 1775252 - protein, 4 aa, Staphylococcus epidermidis
DKKG

SEQ ID NO: 1775253 - protein, 16 aa, Staphylococcus epidermidis
DKKGNAVTDSEGNAKF

SEQ ID NO: 1775254 - protein, 19 aa, Staphylococcus epidermidis
DKKGRVGFGTGKAQEVPEA

SEQ ID NO: 1775255 - protein, 10 aa, Staphylococcus epidermidis
DKKIEDKAEE

SEQ ID NO: 1775256 - protein, 8 aa, Staphylococcus epidermidis
DKKKTQLP

SEQ ID NO: 1775257 - protein, 13 aa, Staphylococcus epidermidis
DKKKYVIGKRRCQ

SEQ ID NO: 1775258 - protein, 11 aa, Staphylococcus epidermidis
DKKLKDYTKEE

SEQ ID NO: 1775259 - protein, 26 aa, Staphylococcus epidermidis
DKKNPQSRKDIDENSDDDTPLSEKEF

SEQ ID NO: 1775260 - protein, 14 aa, Staphylococcus epidermidis
DKKTGRHTKRSGYQ

SEQ ID NO: 1775261 - protein, 9 aa, Staphylococcus epidermidis
DKKVKGGQD

SEQ ID NO: 1775262 - protein, 22 aa, Staphylococcus epidermidis
DKKVRGRKLGEDYNKGGIEDGF

SEQ ID NO: 1775263 - protein, 22 aa, Staphylococcus epidermidis
DKKVRGRRLGEDYNKGGIEDGF

SEQ ID NO: 1775264 - protein, 18 aa, Staphylococcus epidermidis
DKKYAKTLKHTGGIGTVA

SEQ ID NO: 1775265 - protein, 5 aa, Staphylococcus epidermidis
DKLKG

SEQ ID NO: 1775266 - protein, 8 aa, Staphylococcus epidermidis
DKLNNQEV

SEQ ID NO: 1775267 - protein, 8 aa, Staphylococcus epidermidis
DKLPEKRY

SEQ ID NO: 1775268 - protein, 20 aa, Staphylococcus epidermidis
DKLPTNKRKKATQGRPWMAG

SEQ ID NO: 1775269 - protein, 9 aa, Staphylococcus epidermidis
DKLQGELDR

SEQ ID NO: 1775270 - protein, 13 aa, Staphylococcus epidermidis
DKLRGNMDADEYK

SEQ ID NO: 1775271 - protein, 14 aa, Staphylococcus epidermidis
DKLSPKTREKYEEY

SEQ ID NO: 1775272 - protein, 6 aa, Staphylococcus epidermidis
DKLTGD

SEQ ID NO: 1775273 - protein, 5 aa, Staphylococcus epidermidis
DKMGG

SEQ ID NO: 1775274 - protein, 6 aa, Staphylococcus epidermidis
DKMGQL

SEQ ID NO: 1775275 - protein, 5 aa, Staphylococcus epidermidis
DKNAF

SEQ ID NO: 1775276 - protein, 14 aa, Staphylococcus epidermidis
DKNANEKVTEKRKI

SEQ ID NO: 1775277 - protein, 7 aa, Staphylococcus epidermidis
DKNDNYD

SEQ ID NO: 1775278 - protein, 6 aa, Staphylococcus epidermidis
DKNDPF

SEQ ID NO: 1775279 - protein, 4 aa, Staphylococcus epidermidis
DKNE

SEQ ID NO: 1775280 - protein, 6 aa, Staphylococcus epidermidis
DKNEKV

SEQ ID NO: 1775281 - protein, 7 aa, Staphylococcus epidermidis
DKNEMEE

SEQ ID NO: 1775282 - protein, 10 aa, Staphylococcus epidermidis
DKNEQGYLDK

SEQ ID NO: 1775283 - protein, 4 aa, Staphylococcus epidermidis
DKNG

SEQ ID NO: 1775284 - protein, 8 aa, Staphylococcus epidermidis
DKNGCPKC

SEQ ID NO: 1775285 - protein, 7 aa, Staphylococcus epidermidis
DKNKKYK

SEQ ID NO: 1775286 - protein, 7 aa, Staphylococcus epidermidis
DKNKNYK

SEQ ID NO: 1775287 - protein, 9 aa, Staphylococcus epidermidis
DKNKYTKNS

SEQ ID NO: 1775288 - protein, 7 aa, Staphylococcus epidermidis
DKNNALK

SEQ ID NO: 1775289 - protein, 5 aa, Staphylococcus epidermidis
DKNPE

SEQ ID NO: 1775290 - protein, 7 aa, Staphylococcus epidermidis
DKNPVHN

SEQ ID NO: 1775291 - protein, 4 aa, Staphylococcus epidermidis
DKNQ

SEQ ID NO: 1775292 - protein, 5 aa, Staphylococcus epidermidis
DKNRA

SEQ ID NO: 1775293 - protein, 9 aa, Staphylococcus epidermidis
DKNSTGGLT

SEQ ID NO: 1775294 - protein, 5 aa, Staphylococcus epidermidis
DKNVE

SEQ ID NO: 1775295 - protein, 6 aa, Staphylococcus epidermidis
DKNVNM

SEQ ID NO: 1775296 - protein, 7 aa, Staphylococcus epidermidis
DKNYKGE

SEQ ID NO: 1775297 - protein, 18 aa, Staphylococcus epidermidis
DKPATQNTAFKDETPQGF

SEQ ID NO: 1775298 - protein, 7 aa, Staphylococcus epidermidis
DKPEEME

SEQ ID NO: 1775299 - protein, 7 aa, Staphylococcus epidermidis
DKPFTQT

SEQ ID NO: 1775300 - protein, 7 aa, Staphylococcus epidermidis
DKPGIVG

SEQ ID NO: 1775301 - protein, 5 aa, Staphylococcus epidermidis
DKPIE

SEQ ID NO: 1775302 - protein, 8 aa, Staphylococcus epidermidis
DKPNVSTK

SEQ ID NO: 1775303 - protein, 6 aa, Staphylococcus epidermidis
DKPPSA

SEQ ID NO: 1775304 - protein, 14 aa, Staphylococcus epidermidis
DKPQETNRTFDTAV

SEQ ID NO: 1775305 - protein, 6 aa, Staphylococcus epidermidis
DKPSIY

SEQ ID NO: 1775306 - protein, 5 aa, Staphylococcus epidermidis
DKQEM

SEQ ID NO: 1775307 - protein, 18 aa, Staphylococcus epidermidis
DKQGYRDEEFDKDDKGTW

SEQ ID NO: 1775308 - protein, 6 aa, Staphylococcus epidermidis
DKQHVS

SEQ ID NO: 1775309 - protein, 19 aa, Staphylococcus epidermidis
DKQLEEATNRLAQLRYLYE

SEQ ID NO: 1775310 - protein, 6 aa, Staphylococcus epidermidis
DKQRRV

SEQ ID NO: 1775311 - protein, 8 aa, Staphylococcus epidermidis
DKQSYTSR

SEQ ID NO: 1775312 - protein, 5 aa, Staphylococcus epidermidis
DKRAL

SEQ ID NO: 1775313 - protein, 5 aa, Staphylococcus epidermidis
DKRAN

SEQ ID NO: 1775314 - protein, 5 aa, Staphylococcus epidermidis
DKRFQ

SEQ ID NO: 1775315 - protein, 6 aa, Staphylococcus epidermidis
DKRLPK

SEQ ID NO: 1775316 - protein, 13 aa, Staphylococcus epidermidis
DKRNQHLTTQNNQ

SEQ ID NO: 1775317 - protein, 7 aa, Staphylococcus epidermidis
DKRSEVM

SEQ ID NO: 1775318 - protein, 6 aa, Staphylococcus epidermidis
DKRTKD

SEQ ID NO: 1775319 - protein, 12 aa, Staphylococcus epidermidis
DKRYDDVQKDIE

SEQ ID NO: 1775320 - protein, 7 aa, Staphylococcus epidermidis
DKSDIDY

SEQ ID NO: 1775321 - protein, 20 aa, Staphylococcus epidermidis
DKSDKRRGRPTISKKWDQTT

SEQ ID NO: 1775322 - protein, 15 aa, Staphylococcus epidermidis
DKSGLHQENTKNLTK

SEQ ID NO: 1775323 - protein, 8 aa, Staphylococcus epidermidis
DKSHNELG

SEQ ID NO: 1775324 - protein, 8 aa, Staphylococcus epidermidis
DKSKDEIN

SEQ ID NO: 1775325 - protein, 6 aa, Staphylococcus epidermidis
DKSLSQ

SEQ ID NO: 1775326 - protein, 12 aa, Staphylococcus epidermidis
DKSPAVRRTAGD

SEQ ID NO: 1775327 - protein, 6 aa, Staphylococcus epidermidis
DKSSFA

SEQ ID NO: 1775328 - protein, 11 aa, Staphylococcus epidermidis
DKSTNDRKNFD

SEQ ID NO: 1775329 - protein, 9 aa, Staphylococcus epidermidis
DKSTVEQAT

SEQ ID NO: 1775330 - protein, 7 aa, Staphylococcus epidermidis
DKSVTAE

SEQ ID NO: 1775331 - protein, 6 aa, Staphylococcus epidermidis
DKSYPG

SEQ ID NO: 1775332 - protein, 10 aa, Staphylococcus epidermidis
DKTANFTTGT

SEQ ID NO: 1775333 - protein, 11 aa, Staphylococcus epidermidis
DKTDDSDAIER

SEQ ID NO: 1775334 - protein, 8 aa, Staphylococcus epidermidis
DKTEADGR

SEQ ID NO: 1775335 - protein, 4 aa, Staphylococcus epidermidis
DKTL

SEQ ID NO: 1775336 - protein, 5 aa, Staphylococcus epidermidis
DKTLA

SEQ ID NO: 1775337 - protein, 7 aa, Staphylococcus epidermidis
DKTNGGS

SEQ ID NO: 1775338 - protein, 23 aa, Staphylococcus epidermidis
DKTNTRKEIKRTGFKQRKEAVKK

SEQ ID NO: 1775339 - protein, 10 aa, Staphylococcus epidermidis
DKTSKLNGSV

SEQ ID NO: 1775340 - protein, 4 aa, Staphylococcus epidermidis
DKTV

SEQ ID NO: 1775341 - protein, 8 aa, Staphylococcus epidermidis
DKVEGTGV

SEQ ID NO: 1775342 - protein, 12 aa, Staphylococcus epidermidis
DKVEQAKKLAKQ

SEQ ID NO: 1775343 - protein, 23 aa, Staphylococcus epidermidis
DKVHQSSDYINADPAKKEAFDNA

SEQ ID NO: 1775344 - protein, 30 aa, Staphylococcus epidermidis
DKVKPKQAIKTVASDRGMKTGEVYNIYHDI

SEQ ID NO: 1775345 - protein, 6 aa, Staphylococcus epidermidis
DKVKSK

SEQ ID NO: 1775346 - protein, 6 aa, Staphylococcus epidermidis
DKVNQT

SEQ ID NO: 1775347 - protein, 8 aa, Staphylococcus epidermidis
DKVPDSKK

SEQ ID NO: 1775348 - protein, 9 aa, Staphylococcus epidermidis
DKVRPEGKA

SEQ ID NO: 1775349 - protein, 9 aa, Staphylococcus epidermidis
DKVRPEGKS

SEQ ID NO: 1775350 - protein, 7 aa, Staphylococcus epidermidis
DKVSNDS

SEQ ID NO: 1775351 - protein, 7 aa, Staphylococcus epidermidis
DKVTNDS

SEQ ID NO: 1775352 - protein, 6 aa, Staphylococcus epidermidis
DKVVTG

SEQ ID NO: 1775353 - protein, 21 aa, Staphylococcus epidermidis
DKYGDNVPLTTGGKFGKVLIH

SEQ ID NO: 1775354 - protein, 10 aa, Staphylococcus epidermidis
DKYGKDEAKK

SEQ ID NO: 1775355 - protein, 16 aa, Staphylococcus epidermidis
DKYNGCSDDDVSEHLK

SEQ ID NO: 1775356 - protein, 18 aa, Staphylococcus epidermidis
DKYNGCSDDSIPDHRKAP

SEQ ID NO: 1775357 - protein, 6 aa, Staphylococcus epidermidis
DKYNPS

SEQ ID NO: 1775358 - protein, 6 aa, Staphylococcus epidermidis
DKYPVT

SEQ ID NO: 1775359 - protein, 9 aa, Staphylococcus epidermidis
DKYSPFPEE

SEQ ID NO: 1775360 - protein, 5 aa, Staphylococcus epidermidis
DLAAK

SEQ ID NO: 1775361 - protein, 8 aa, Staphylococcus epidermidis
DLADAKEA

SEQ ID NO: 1775362 - protein, 7 aa, Staphylococcus epidermidis
DLAKGAK

SEQ ID NO: 1775363 - protein, 8 aa, Staphylococcus epidermidis
DLANGEAE

SEQ ID NO: 1775364 - protein, 9 aa, Staphylococcus epidermidis
DLANGKADI

SEQ ID NO: 1775365 - protein, 15 aa, Staphylococcus epidermidis
DLASDTFKKTYDSNV

SEQ ID NO: 1775366 - protein, 8 aa, Staphylococcus epidermidis
DLASSDEI

SEQ ID NO: 1775367 - protein, 13 aa, Staphylococcus epidermidis
DLDGIKSRGKDAC

SEQ ID NO: 1775368 - protein, 15 aa, Staphylococcus epidermidis
DLDNFSKTGYSNSRL

SEQ ID NO: 1775369 - protein, 7 aa, Staphylococcus epidermidis
DLDPVSA

SEQ ID NO: 1775370 - protein, 8 aa, Staphylococcus epidermidis
DLDRSSKL

SEQ ID NO: 1775371 - protein, 15 aa, Staphylococcus epidermidis
DLDSGEVQEPDTGCV

SEQ ID NO: 1775372 - protein, 7 aa, Staphylococcus epidermidis
DLDSQTL

SEQ ID NO: 1775373 - protein, 39 aa, Staphylococcus epidermidis
DLEELNNEKEKLQAKKQDKKTLNKINDTDNKIKKTDELK

SEQ ID NO: 1775374 - protein, 6 aa, Staphylococcus epidermidis
DLEEQG

SEQ ID NO: 1775375 - protein, 15 aa, Staphylococcus epidermidis
DLEKTEQVEKYVEVI

SEQ ID NO: 1775376 - protein, 4 aa, Staphylococcus epidermidis
DLEQ

SEQ ID NO: 1775377 - protein, 11 aa, Staphylococcus epidermidis
DLESSLTELGN

SEQ ID NO: 1775378 - protein, 18 aa, Staphylococcus epidermidis
DLETEEPTEAQTGENEAS

SEQ ID NO: 1775379 - protein, 4 aa, Staphylococcus epidermidis
DLGA

SEQ ID NO: 1775380 - protein, 8 aa, Staphylococcus epidermidis
DLGDENQG

SEQ ID NO: 1775381 - protein, 5 aa, Staphylococcus epidermidis
DLGDS

SEQ ID NO: 1775382 - protein, 5 aa, Staphylococcus epidermidis
DLGER

SEQ ID NO: 1775383 - protein, 8 aa, Staphylococcus epidermidis
DLGISSPD

SEQ ID NO: 1775384 - protein, 8 aa, Staphylococcus epidermidis
DLGKHSKS

SEQ ID NO: 1775385 - protein, 4 aa, Staphylococcus epidermidis
DLGQ

SEQ ID NO: 1775386 - protein, 11 aa, Staphylococcus epidermidis
DLGSGGSATLN

SEQ ID NO: 1775387 - protein, 5 aa, Staphylococcus epidermidis
DLGTE

SEQ ID NO: 1775388 - protein, 19 aa, Staphylococcus epidermidis
DLHGEQKLTQSKQDANDQL

SEQ ID NO: 1775389 - protein, 5 aa, Staphylococcus epidermidis
DLKDK

SEQ ID NO: 1775390 - protein, 6 aa, Staphylococcus epidermidis
DLNDPL

SEQ ID NO: 1775391 - protein, 10 aa, Staphylococcus epidermidis
DLNEAEQERL

SEQ ID NO: 1775392 - protein, 7 aa, Staphylococcus epidermidis
DLNGRTL

SEQ ID NO: 1775393 - protein, 4 aa, Staphylococcus epidermidis
DLNN

SEQ ID NO: 1775394 - protein, 5 aa, Staphylococcus epidermidis
DLNNE

SEQ ID NO: 1775395 - protein, 11 aa, Staphylococcus epidermidis
DLNPESPQSAF

SEQ ID NO: 1775396 - protein, 9 aa, Staphylococcus epidermidis
DLNRAKKGD

SEQ ID NO: 1775397 - protein, 5 aa, Staphylococcus epidermidis
DLNRS

SEQ ID NO: 1775398 - protein, 11 aa, Staphylococcus epidermidis
DLNRTPKKNKV

SEQ ID NO: 1775399 - protein, 8 aa, Staphylococcus epidermidis
DLNTGETQ

SEQ ID NO: 1775400 - protein, 5 aa, Staphylococcus epidermidis
DLPEA

SEQ ID NO: 1775401 - protein, 16 aa, Staphylococcus epidermidis
DLPEDTGSFLIIHQGE

SEQ ID NO: 1775402 - protein, 5 aa, Staphylococcus epidermidis
DLPGP

SEQ ID NO: 1775403 - protein, 4 aa, Staphylococcus epidermidis
DLPP

SEQ ID NO: 1775404 - protein, 14 aa, Staphylococcus epidermidis
DLQDREIKGKDSED

SEQ ID NO: 1775405 - protein, 8 aa, Staphylococcus epidermidis
DLQPKDRN

SEQ ID NO: 1775406 - protein, 8 aa, Staphylococcus epidermidis
DLRSQRGK

SEQ ID NO: 1775407 - protein, 6 aa, Staphylococcus epidermidis
DLSAST

SEQ ID NO: 1775408 - protein, 6 aa, Staphylococcus epidermidis
DLSEEE

SEQ ID NO: 1775409 - protein, 7 aa, Staphylococcus epidermidis
DLSKDEN

SEQ ID NO: 1775410 - protein, 7 aa, Staphylococcus epidermidis
DLSKGSR

SEQ ID NO: 1775411 - protein, 10 aa, Staphylococcus epidermidis
DLSKLPQNQQ

SEQ ID NO: 1775412 - protein, 6 aa, Staphylococcus epidermidis
DLSKQR

SEQ ID NO: 1775413 - protein, 7 aa, Staphylococcus epidermidis
DLSNAGA

SEQ ID NO: 1775414 - protein, 9 aa, Staphylococcus epidermidis
DLSNAGAQV

SEQ ID NO: 1775415 - protein, 9 aa, Staphylococcus epidermidis
DLSNEDELI

SEQ ID NO: 1775416 - protein, 5 aa, Staphylococcus epidermidis
DLSNI

SEQ ID NO: 1775417 - protein, 13 aa, Staphylococcus epidermidis
DLSRDTKKQYTSA

SEQ ID NO: 1775418 - protein, 15 aa, Staphylococcus epidermidis
DLTERRESKQPLEYP

SEQ ID NO: 1775419 - protein, 6 aa, Staphylococcus epidermidis
DLTETD

SEQ ID NO: 1775420 - protein, 6 aa, Staphylococcus epidermidis
DLTGRE

SEQ ID NO: 1775421 - protein, 7 aa, Staphylococcus epidermidis
DLTKETV

SEQ ID NO: 1775422 - protein, 10 aa, Staphylococcus epidermidis
DLVNQPADKF

SEQ ID NO: 1775423 - protein, 6 aa, Staphylococcus epidermidis
DLYTPT

SEQ ID NO: 1775424 - protein, 19 aa, Staphylococcus epidermidis
DMEQNNSNGNNENLTENKI

SEQ ID NO: 1775425 - protein, 4 aa, Staphylococcus epidermidis
DMER

SEQ ID NO: 1775426 - protein, 9 aa, Staphylococcus epidermidis
DMGKAQRVA

SEQ ID NO: 1775427 - protein, 14 aa, Staphylococcus epidermidis
DMKEAAQKIYDAGT

SEQ ID NO: 1775428 - protein, 5 aa, Staphylococcus epidermidis
DMKET

SEQ ID NO: 1775429 - protein, 5 aa, Staphylococcus epidermidis
DMPAS

SEQ ID NO: 1775430 - protein, 13 aa, Staphylococcus epidermidis
DMPDEEKDKRGID

SEQ ID NO: 1775431 - protein, 4 aa, Staphylococcus epidermidis
DMRN

SEQ ID NO: 1775432 - protein, 4 aa, Staphylococcus epidermidis
DMSA

SEQ ID NO: 1775433 - protein, 5 aa, Staphylococcus epidermidis
DMSAN

SEQ ID NO: 1775434 - protein, 19 aa, Staphylococcus epidermidis
DMSRKVDKETKGSKPKMIQ

SEQ ID NO: 1775435 - protein, 6 aa, Staphylococcus epidermidis
DMSTSV

SEQ ID NO: 1775436 - protein, 6 aa, Staphylococcus epidermidis
DMTPES

SEQ ID NO: 1775437 - protein, 5 aa, Staphylococcus epidermidis
DMTPG

SEQ ID NO: 1775438 - protein, 6 aa, Staphylococcus epidermidis
DMTQNA

SEQ ID NO: 1775439 - protein, 10 aa, Staphylococcus epidermidis
DNAADGRDTS

SEQ ID NO: 1775440 - protein, 6 aa, Staphylococcus epidermidis
DNAEGY

SEQ ID NO: 1775441 - protein, 13 aa, Staphylococcus epidermidis
DNAIKKAEELDEL

SEQ ID NO: 1775442 - protein, 4 aa, Staphylococcus epidermidis
DNAL

SEQ ID NO: 1775443 - protein, 10 aa, Staphylococcus epidermidis
DNAPRPVPLA

SEQ ID NO: 1775444 - protein, 6 aa, Staphylococcus epidermidis
DNAQDY

SEQ ID NO: 1775445 - protein, 6 aa, Staphylococcus epidermidis
DNARKV

SEQ ID NO: 1775446 - protein, 4 aa, Staphylococcus epidermidis
DNAS

SEQ ID NO: 1775447 - protein, 5 aa, Staphylococcus epidermidis
DNATF

SEQ ID NO: 1775448 - protein, 7 aa, Staphylococcus epidermidis
DNATSLP

SEQ ID NO: 1775449 - protein, 5 aa, Staphylococcus epidermidis
DNDET

SEQ ID NO: 1775450 - protein, 7 aa, Staphylococcus epidermidis
DNDKALK

SEQ ID NO: 1775451 - protein, 4 aa, Staphylococcus epidermidis
DNDM

SEQ ID NO: 1775452 - protein, 25 aa, Staphylococcus epidermidis
DNDPNTQDKRMKRAGLGNPDAPGFE

SEQ ID NO: 1775453 - protein, 4 aa, Staphylococcus epidermidis
DNDQ

SEQ ID NO: 1775454 - protein, 7 aa, Staphylococcus epidermidis
DNDRKSV

SEQ ID NO: 1775455 - protein, 11 aa, Staphylococcus epidermidis
DNDTYDNTQDF

SEQ ID NO: 1775456 - protein, 4 aa, Staphylococcus epidermidis
DNEE

SEQ ID NO: 1775457 - protein, 9 aa, Staphylococcus epidermidis
DNEEAFKGA

SEQ ID NO: 1775458 - protein, 7 aa, Staphylococcus epidermidis
DNEEESA

SEQ ID NO: 1775459 - protein, 6 aa, Staphylococcus epidermidis
DNEEFE

SEQ ID NO: 1775460 - protein, 7 aa, Staphylococcus epidermidis
DNEEIEV

SEQ ID NO: 1775461 - protein, 9 aa, Staphylococcus epidermidis
DNEESIRKA

SEQ ID NO: 1775462 - protein, 11 aa, Staphylococcus epidermidis
DNEIDTKGSQY

SEQ ID NO: 1775463 - protein, 8 aa, Staphylococcus epidermidis
DNEKCTKI

SEQ ID NO: 1775464 - protein, 14 aa, Staphylococcus epidermidis
DNELNSIKEEVKKR

SEQ ID NO: 1775465 - protein, 4 aa, Staphylococcus epidermidis
DNEN

SEQ ID NO: 1775466 - protein, 7 aa, Staphylococcus epidermidis
DNENDFE

SEQ ID NO: 1775467 - protein, 6 aa, Staphylococcus epidermidis
DNENEY

SEQ ID NO: 1775468 - protein, 6 aa, Staphylococcus epidermidis
DNENGF

SEQ ID NO: 1775469 - protein, 8 aa, Staphylococcus epidermidis
DNENRKAL

SEQ ID NO: 1775470 - protein, 7 aa, Staphylococcus epidermidis
DNENRTL

SEQ ID NO: 1775471 - protein, 5 aa, Staphylococcus epidermidis
DNEPK

SEQ ID NO: 1775472 - protein, 8 aa, Staphylococcus epidermidis
DNEQAGRY

SEQ ID NO: 1775473 - protein, 5 aa, Staphylococcus epidermidis
DNEQE

SEQ ID NO: 1775474 - protein, 5 aa, Staphylococcus epidermidis
DNERT

SEQ ID NO: 1775475 - protein, 13 aa, Staphylococcus epidermidis
DNESEESAEEKSE

SEQ ID NO: 1775476 - protein, 7 aa, Staphylococcus epidermidis
DNESGNI

SEQ ID NO: 1775477 - protein, 6 aa, Staphylococcus epidermidis
DNESSY

SEQ ID NO: 1775478 - protein, 4 aa, Staphylococcus epidermidis
DNET

SEQ ID NO: 1775479 - protein, 8 aa, Staphylococcus epidermidis
DNETSKDA

SEQ ID NO: 1775480 - protein, 7 aa, Staphylococcus epidermidis
DNETVSL

SEQ ID NO: 1775481 - protein, 6 aa, Staphylococcus epidermidis
DNETYD

SEQ ID NO: 1775482 - protein, 6 aa, Staphylococcus epidermidis
DNFDTR

SEQ ID NO: 1775483 - protein, 5 aa, Staphylococcus epidermidis
DNFEQ

SEQ ID NO: 1775484 - protein, 7 aa, Staphylococcus epidermidis
DNGDNNV

SEQ ID NO: 1775485 - protein, 4 aa, Staphylococcus epidermidis
DNGK

SEQ ID NO: 1775486 - protein, 17 aa, Staphylococcus epidermidis
DNGLEEIQAEGQEFDPN

SEQ ID NO: 1775487 - protein, 10 aa, Staphylococcus epidermidis
DNGQGFDTQS

SEQ ID NO: 1775488 - protein, 10 aa, Staphylococcus epidermidis
DNGSSEIQSQ

SEQ ID NO: 1775489 - protein, 18 aa, Staphylococcus epidermidis
DNGTTPDITSEKQQTTTE

SEQ ID NO: 1775490 - protein, 4 aa, Staphylococcus epidermidis
DNHK

SEQ ID NO: 1775491 - protein, 6 aa, Staphylococcus epidermidis
DNHKGV

SEQ ID NO: 1775492 - protein, 6 aa, Staphylococcus epidermidis
DNIDEE

SEQ ID NO: 1775493 - protein, 10 aa, Staphylococcus epidermidis
DNIKDNNDVS

SEQ ID NO: 1775494 - protein, 15 aa, Staphylococcus epidermidis
DNINSNSQGASDAKT

SEQ ID NO: 1775495 - protein, 12 aa, Staphylococcus epidermidis
DNIPDNKSAEFA

SEQ ID NO: 1775496 - protein, 9 aa, Staphylococcus epidermidis
DNIPDNSSV

SEQ ID NO: 1775497 - protein, 14 aa, Staphylococcus epidermidis
DNISNKAKALDDEM

SEQ ID NO: 1775498 - protein, 9 aa, Staphylococcus epidermidis
DNKEISSYT

SEQ ID NO: 1775499 - protein, 10 aa, Staphylococcus epidermidis
DNKEKYQYTG

SEQ ID NO: 1775500 - protein, 9 aa, Staphylococcus epidermidis
DNKFDENEH

SEQ ID NO: 1775501 - protein, 8 aa, Staphylococcus epidermidis
DNKINKQD

SEQ ID NO: 1775502 - protein, 8 aa, Staphylococcus epidermidis
DNKKNDIN

SEQ ID NO: 1775503 - protein, 19 aa, Staphylococcus epidermidis
DNKKSGRKKLDPSNNNGRF

SEQ ID NO: 1775504 - protein, 7 aa, Staphylococcus epidermidis
DNKMDKD

SEQ ID NO: 1775505 - protein, 6 aa, Staphylococcus epidermidis
DNKSDI

SEQ ID NO: 1775506 - protein, 7 aa, Staphylococcus epidermidis
DNLEGSV

SEQ ID NO: 1775507 - protein, 7 aa, Staphylococcus epidermidis
DNLNDND

SEQ ID NO: 1775508 - protein, 8 aa, Staphylococcus epidermidis
DNLSQDQL

SEQ ID NO: 1775509 - protein, 5 aa, Staphylococcus epidermidis
DNNCE

SEQ ID NO: 1775510 - protein, 8 aa, Staphylococcus epidermidis
DNNDRTIT

SEQ ID NO: 1775511 - protein, 7 aa, Staphylococcus epidermidis
DNNEALN

SEQ ID NO: 1775512 - protein, 15 aa, Staphylococcus epidermidis
DNNGQTYQDSSIGTG

SEQ ID NO: 1775513 - protein, 6 aa, Staphylococcus epidermidis
DNNRNL

SEQ ID NO: 1775514 - protein, 4 aa, Staphylococcus epidermidis
DNNT

SEQ ID NO: 1775515 - protein, 7 aa, Staphylococcus epidermidis
DNNTPIG

SEQ ID NO: 1775516 - protein, 4 aa, Staphylococcus epidermidis
DNNV

SEQ ID NO: 1775517 - protein, 6 aa, Staphylococcus epidermidis
DNNYEY

SEQ ID NO: 1775518 - protein, 8 aa, Staphylococcus epidermidis
DNPGLTLN

SEQ ID NO: 1775519 - protein, 6 aa, Staphylococcus epidermidis
DNPNIK

SEQ ID NO: 1775520 - protein, 5 aa, Staphylococcus epidermidis
DNPRQ

SEQ ID NO: 1775521 - protein, 6 aa, Staphylococcus epidermidis
DNPSEH

SEQ ID NO: 1775522 - protein, 9 aa, Staphylococcus epidermidis
DNPSPPSAN

SEQ ID NO: 1775523 - protein, 7 aa, Staphylococcus epidermidis
DNPVIAT

SEQ ID NO: 1775524 - protein, 9 aa, Staphylococcus epidermidis
DNPVKDKYK

SEQ ID NO: 1775525 - protein, 33 aa, Staphylococcus epidermidis
DNPVTKKNYYSGEKQYAGKPVTADTAKKVENEL

SEQ ID NO: 1775526 - protein, 8 aa, Staphylococcus epidermidis
DNQEPGSI

SEQ ID NO: 1775527 - protein, 14 aa, Staphylococcus epidermidis
DNQFQSSNKDQDAI

SEQ ID NO: 1775528 - protein, 36 aa, Staphylococcus epidermidis
DNQGGGPHYYPNNQGVYDSQPEFKKPPFPTDGDGYE

SEQ ID NO: 1775529 - protein, 4 aa, Staphylococcus epidermidis
DNQI

SEQ ID NO: 1775530 - protein, 4 aa, Staphylococcus epidermidis
DNQK

SEQ ID NO: 1775531 - protein, 16 aa, Staphylococcus epidermidis
DNQKDFNNFKESDAWN

SEQ ID NO: 1775532 - protein, 7 aa, Staphylococcus epidermidis
DNQRLTE

SEQ ID NO: 1775533 - protein, 5 aa, Staphylococcus epidermidis
DNQVK

SEQ ID NO: 1775534 - protein, 5 aa, Staphylococcus epidermidis
DNQYY

SEQ ID NO: 1775535 - protein, 7 aa, Staphylococcus epidermidis
DNRASRY

SEQ ID NO: 1775536 - protein, 18 aa, Staphylococcus epidermidis
DNRFSQQKIASGKHYGAT

SEQ ID NO: 1775537 - protein, 4 aa, Staphylococcus epidermidis
DNRQ

SEQ ID NO: 1775538 - protein, 16 aa, Staphylococcus epidermidis
DNRSTTSNEQTFEVPA

SEQ ID NO: 1775539 - protein, 5 aa, Staphylococcus epidermidis
DNRSY

SEQ ID NO: 1775540 - protein, 10 aa, Staphylococcus epidermidis
DNSEENKVKP

SEQ ID NO: 1775541 - protein, 5 aa, Staphylococcus epidermidis
DNSND

SEQ ID NO: 1775542 - protein, 8 aa, Staphylococcus epidermidis
DNSPYQGY

SEQ ID NO: 1775543 - protein, 8 aa, Staphylococcus epidermidis
DNTDKEHE

SEQ ID NO: 1775544 - protein, 24 aa, Staphylococcus epidermidis
DNTKYKGNENKANYEVKTNEDNKF

SEQ ID NO: 1775545 - protein, 4 aa, Staphylococcus epidermidis
DNTV

SEQ ID NO: 1775546 - protein, 12 aa, Staphylococcus epidermidis
DNTYTENTRAAY

SEQ ID NO: 1775547 - protein, 5 aa, Staphylococcus epidermidis
DNVDD

SEQ ID NO: 1775548 - protein, 5 aa, Staphylococcus epidermidis
DNVPG

SEQ ID NO: 1775549 - protein, 4 aa, Staphylococcus epidermidis
DNVS

SEQ ID NO: 1775550 - protein, 9 aa, Staphylococcus epidermidis
DNVSQQSDI

SEQ ID NO: 1775551 - protein, 6 aa, Staphylococcus epidermidis
DNVYQQ

SEQ ID NO: 1775552 - protein, 5 aa, Staphylococcus epidermidis
DNYEA

SEQ ID NO: 1775553 - protein, 16 aa, Staphylococcus epidermidis
DNYGTPLSDKTLEACK

SEQ ID NO: 1775554 - protein, 7 aa, Staphylococcus epidermidis
DNYKGKK

SEQ ID NO: 1775555 - protein, 6 aa, Staphylococcus epidermidis
DNYPKN

SEQ ID NO: 1775556 - protein, 6 aa, Staphylococcus epidermidis
DNYQTD

SEQ ID NO: 1775557 - protein, 6 aa, Staphylococcus epidermidis
DNYYKD

SEQ ID NO: 1775558 - protein, 7 aa, Staphylococcus epidermidis
DPATRKE

SEQ ID NO: 1775559 - protein, 15 aa, Staphylococcus epidermidis
DPAYIPRQNEARNQI

SEQ ID NO: 1775560 - protein, 5 aa, Staphylococcus epidermidis
DPDFT

SEQ ID NO: 1775561 - protein, 9 aa, Staphylococcus epidermidis
DPDYPDDRT

SEQ ID NO: 1775562 - protein, 7 aa, Staphylococcus epidermidis
DPEGNQY

SEQ ID NO: 1775563 - protein, 6 aa, Staphylococcus epidermidis
DPEGNS

SEQ ID NO: 1775564 - protein, 7 aa, Staphylococcus epidermidis
DPEISEA

SEQ ID NO: 1775565 - protein, 13 aa, Staphylococcus epidermidis
DPEKNGASKFKQY

SEQ ID NO: 1775566 - protein, 8 aa, Staphylococcus epidermidis
DPELNGSL

SEQ ID NO: 1775567 - protein, 16 aa, Staphylococcus epidermidis
DPEMSQDLKAFIKQLD

SEQ ID NO: 1775568 - protein, 8 aa, Staphylococcus epidermidis
DPETNETV

SEQ ID NO: 1775569 - protein, 5 aa, Staphylococcus epidermidis
DPEYE

SEQ ID NO: 1775570 - protein, 8 aa, Staphylococcus epidermidis
DPGIDDAT

SEQ ID NO: 1775571 - protein, 7 aa, Staphylococcus epidermidis
DPGRIED

SEQ ID NO: 1775572 - protein, 5 aa, Staphylococcus epidermidis
DPGYD

SEQ ID NO: 1775573 - protein, 14 aa, Staphylococcus epidermidis
DPHRPNAKNKTLEQ

SEQ ID NO: 1775574 - protein, 8 aa, Staphylococcus epidermidis
DPISREKL

SEQ ID NO: 1775575 - protein, 7 aa, Staphylococcus epidermidis
DPKDKTL

SEQ ID NO: 1775576 - protein, 16 aa, Staphylococcus epidermidis
DPKDRECSESNDKKRY

SEQ ID NO: 1775577 - protein, 6 aa, Staphylococcus epidermidis
DPKECQ

SEQ ID NO: 1775578 - protein, 14 aa, Staphylococcus epidermidis
DPKEELLNGSAETL

SEQ ID NO: 1775579 - protein, 6 aa, Staphylococcus epidermidis
DPKELE

SEQ ID NO: 1775580 - protein, 8 aa, Staphylococcus epidermidis
DPKGGCTG

SEQ ID NO: 1775581 - protein, 16 aa, Staphylococcus epidermidis
DPKIKEDLKEVSGQPY

SEQ ID NO: 1775582 - protein, 8 aa, Staphylococcus epidermidis
DPKSEAMP

SEQ ID NO: 1775583 - protein, 7 aa, Staphylococcus epidermidis
DPKTRQI

SEQ ID NO: 1775584 - protein, 13 aa, Staphylococcus epidermidis
DPKYGPKKTLDIG

SEQ ID NO: 1775585 - protein, 11 aa, Staphylococcus epidermidis
DPKYSKEKLRT

SEQ ID NO: 1775586 - protein, 5 aa, Staphylococcus epidermidis
DPLNE

SEQ ID NO: 1775587 - protein, 4 aa, Staphylococcus epidermidis
DPNA

SEQ ID NO: 1775588 - protein, 6 aa, Staphylococcus epidermidis
DPNGTI

SEQ ID NO: 1775589 - protein, 5 aa, Staphylococcus epidermidis
DPNID

SEQ ID NO: 1775590 - protein, 7 aa, Staphylococcus epidermidis
DPNNNVA

SEQ ID NO: 1775591 - protein, 7 aa, Staphylococcus epidermidis
DPNRTAQ

SEQ ID NO: 1775592 - protein, 13 aa, Staphylococcus epidermidis
DPNRYALPQEETN

SEQ ID NO: 1775593 - protein, 19 aa, Staphylococcus epidermidis
DPNYKSEKEQSTDALIEDL

SEQ ID NO: 1775594 - protein, 9 aa, Staphylococcus epidermidis
DPQASIGKG

SEQ ID NO: 1775595 - protein, 8 aa, Staphylococcus epidermidis
DPQGNATQ

SEQ ID NO: 1775596 - protein, 4 aa, Staphylococcus epidermidis
DPQS

SEQ ID NO: 1775597 - protein, 11 aa, Staphylococcus epidermidis
DPRKSASSGAI

SEQ ID NO: 1775598 - protein, 7 aa, Staphylococcus epidermidis
DPSAASF

SEQ ID NO: 1775599 - protein, 11 aa, Staphylococcus epidermidis
DPSAKEGSRYE

SEQ ID NO: 1775600 - protein, 6 aa, Staphylococcus epidermidis
DPSGAA

SEQ ID NO: 1775601 - protein, 15 aa, Staphylococcus epidermidis
DPSNETWHDEAMRMQ

SEQ ID NO: 1775602 - protein, 10 aa, Staphylococcus epidermidis
DPSSSDLKPE

SEQ ID NO: 1775603 - protein, 7 aa, Staphylococcus epidermidis
DPSTISS

SEQ ID NO: 1775604 - protein, 10 aa, Staphylococcus epidermidis
DPSTKEVSRS

SEQ ID NO: 1775605 - protein, 7 aa, Staphylococcus epidermidis
DPTCTTT

SEQ ID NO: 1775606 - protein, 6 aa, Staphylococcus epidermidis
DPTETR

SEQ ID NO: 1775607 - protein, 5 aa, Staphylococcus epidermidis
DPTQF

SEQ ID NO: 1775608 - protein, 10 aa, Staphylococcus epidermidis
DPVADGPTIM

SEQ ID NO: 1775609 - protein, 20 aa, Staphylococcus epidermidis
DPVEGTKPTTKNEMTDLQST

SEQ ID NO: 1775610 - protein, 8 aa, Staphylococcus epidermidis
DPWRNDRD

SEQ ID NO: 1775611 - protein, 15 aa, Staphylococcus epidermidis
DPYTNYGRPNTKYEK

SEQ ID NO: 1775612 - protein, 5 aa, Staphylococcus epidermidis
DQAEN

SEQ ID NO: 1775613 - protein, 6 aa, Staphylococcus epidermidis
DQAFKQ

SEQ ID NO: 1775614 - protein, 10 aa, Staphylococcus epidermidis
DQANAAVSHG

SEQ ID NO: 1775615 - protein, 14 aa, Staphylococcus epidermidis
DQANSFNYVICPIR

SEQ ID NO: 1775616 - protein, 8 aa, Staphylococcus epidermidis
DQAPSTKV

SEQ ID NO: 1775617 - protein, 6 aa, Staphylococcus epidermidis
DQAPVL

SEQ ID NO: 1775618 - protein, 11 aa, Staphylococcus epidermidis
DQASNYGGSVK

SEQ ID NO: 1775619 - protein, 5 aa, Staphylococcus epidermidis
DQDDV

SEQ ID NO: 1775620 - protein, 6 aa, Staphylococcus epidermidis
DQDELK

SEQ ID NO: 1775621 - protein, 4 aa, Staphylococcus epidermidis
DQDG

SEQ ID NO: 1775622 - protein, 8 aa, Staphylococcus epidermidis
DQDGLASG

SEQ ID NO: 1775623 - protein, 7 aa, Staphylococcus epidermidis
DQDTEAI

SEQ ID NO: 1775624 - protein, 6 aa, Staphylococcus epidermidis
DQDTSI

SEQ ID NO: 1775625 - protein, 7 aa, Staphylococcus epidermidis
DQEKITR

SEQ ID NO: 1775626 - protein, 9 aa, Staphylococcus epidermidis
DQETANQEA

SEQ ID NO: 1775627 - protein, 4 aa, Staphylococcus epidermidis
DQEV

SEQ ID NO: 1775628 - protein, 6 aa, Staphylococcus epidermidis
DQFHPE

SEQ ID NO: 1775629 - protein, 13 aa, Staphylococcus epidermidis
DQFNPKDRTKSSK

SEQ ID NO: 1775630 - protein, 23 aa, Staphylococcus epidermidis
DQGESFDYETTKSKLGPYDDNEN

SEQ ID NO: 1775631 - protein, 4 aa, Staphylococcus epidermidis
DQGG

SEQ ID NO: 1775632 - protein, 9 aa, Staphylococcus epidermidis
DQGQIKGAA

SEQ ID NO: 1775633 - protein, 36 aa, Staphylococcus epidermidis; identical to SEQ ID NO: 1622147

SEQ ID NO: 1775634 - protein, 4 aa, Staphylococcus epidermidis
DQIK

SEQ ID NO: 1775635 - protein, 15 aa, Staphylococcus epidermidis
DQIKAGAQVATNNQI

SEQ ID NO: 1775636 - protein, 4 aa, Staphylococcus epidermidis
DQIN

SEQ ID NO: 1775637 - protein, 5 aa, Staphylococcus epidermidis
DQIPD

SEQ ID NO: 1775638 - protein, 7 aa, Staphylococcus epidermidis
DQITQSD

SEQ ID NO: 1775639 - protein, 11 aa, Staphylococcus epidermidis
DQKKYSSSAYK

SEQ ID NO: 1775640 - protein, 6 aa, Staphylococcus epidermidis
DQKQSI

SEQ ID NO: 1775641 - protein, 6 aa, Staphylococcus epidermidis
DQKTIT

SEQ ID NO: 1775642 - protein, 4 aa, Staphylococcus epidermidis
DQLA

SEQ ID NO: 1775643 - protein, 20 aa, Staphylococcus epidermidis
DQLEETVQSINDNGGKATAY

SEQ ID NO: 1775644 - protein, 6 aa, Staphylococcus epidermidis
DQLEVA

SEQ ID NO: 1775645 - protein, 14 aa, Staphylococcus epidermidis
DQLPENVTKEQAKD

SEQ ID NO: 1775646 - protein, 10 aa, Staphylococcus epidermidis
DQLPSVGPGQ

SEQ ID NO: 1775647 - protein, 7 aa, Staphylococcus epidermidis
DQLQEKH

SEQ ID NO: 1775648 - protein, 13 aa, Staphylococcus epidermidis
DQNAEEVKKRPHF

SEQ ID NO: 1775649 - protein, 9 aa, Staphylococcus epidermidis
DQNENKDLV

SEQ ID NO: 1775650 - protein, 7 aa, Staphylococcus epidermidis
DQNGIGG

SEQ ID NO: 1775651 - protein, 18 aa, Staphylococcus epidermidis
DQNPNLTAKEKDKLKADL

SEQ ID NO: 1775652 - protein, 7 aa, Staphylococcus epidermidis
DQNVPKA

SEQ ID NO: 1775653 - protein, 24 aa, Staphylococcus epidermidis
DQPGYSEQNPDDWYESTKRGIQRI

SEQ ID NO: 1775654 - protein, 6 aa, Staphylococcus epidermidis
DQPTRL

SEQ ID NO: 1775655 - protein, 6 aa, Staphylococcus epidermidis
DQQLSK

SEQ ID NO: 1775656 - protein, 6 aa, Staphylococcus epidermidis
DQSEAQ

SEQ ID NO: 1775657 - protein, 11 aa, Staphylococcus epidermidis
DQSGMDEKKNN

SEQ ID NO: 1775658 - protein, 4 aa, Staphylococcus epidermidis
DQSI

SEQ ID NO: 1775659 - protein, 5 aa, Staphylococcus epidermidis
DQSIQ

SEQ ID NO: 1775660 - protein, 20 aa, Staphylococcus epidermidis
DQSRGDQIDNAKNFESKGYG

SEQ ID NO: 1775661 - protein, 9 aa, Staphylococcus epidermidis
DQSYLGDDE

SEQ ID NO: 1775662 - protein, 6 aa, Staphylococcus epidermidis
DQSYYG

SEQ ID NO: 1775663 - protein, 5 aa, Staphylococcus epidermidis
DQTFE

SEQ ID NO: 1775664 - protein, 5 aa, Staphylococcus epidermidis
DQTIT

SEQ ID NO: 1775665 - protein, 9 aa, Staphylococcus epidermidis
DQTNPTIAP

SEQ ID NO: 1775666 - protein, 7 aa, Staphylococcus epidermidis
DQTPLGE

SEQ ID NO: 1775667 - protein, 10 aa, Staphylococcus epidermidis
DQTSAHDPLN

SEQ ID NO: 1775668 - protein, 10 aa, Staphylococcus epidermidis
DQTTNPTMSH

SEQ ID NO: 1775669 - protein, 7 aa, Staphylococcus epidermidis
DQVGEEQ

SEQ ID NO: 1775670 - protein, 11 aa, Staphylococcus epidermidis
DQVKSTLENRG

SEQ ID NO: 1775671 - protein, 6 aa, Staphylococcus epidermidis
DQYDHE

SEQ ID NO: 1775672 - protein, 7 aa, Staphylococcus epidermidis
DQYKRSQ

SEQ ID NO: 1775673 - protein, 5 aa, Staphylococcus epidermidis
DQYTS

SEQ ID NO: 1775674 - protein, 4 aa, Staphylococcus epidermidis
DQYY

SEQ ID NO: 1775675 - protein, 6 aa, Staphylococcus epidermidis
DRAEGI

SEQ ID NO: 1775676 - protein, 8 aa, Staphylococcus epidermidis
DRAKERFA

SEQ ID NO: 1775677 - protein, 10 aa, Staphylococcus epidermidis
DRANEEKHAK

SEQ ID NO: 1775678 - protein, 7 aa, Staphylococcus epidermidis
DRDGEEY

SEQ ID NO: 1775679 - protein, 8 aa, Staphylococcus epidermidis
DRDKEAHL

SEQ ID NO: 1775680 - protein, 13 aa, Staphylococcus epidermidis
DRDKEAIKNAPRI

SEQ ID NO: 1775681 - protein, 16 aa, Staphylococcus epidermidis
DRDKEKDFKATKENLK

SEQ ID NO: 1775682 - protein, 8 aa, Staphylococcus epidermidis
DRDKERHL

SEQ ID NO: 1775683 - protein, 8 aa, Staphylococcus epidermidis
DRDRNERE

SEQ ID NO: 1775684 - protein, 8 aa, Staphylococcus epidermidis
DRDSEAIY

SEQ ID NO: 1775685 - protein, 9 aa, Staphylococcus epidermidis
DRDSEAIYD

SEQ ID NO: 1775686 - protein, 22 aa, Staphylococcus epidermidis
DRDTLKKQLNEVNKYSSKIYTT

SEQ ID NO: 1775687 - protein, 5 aa, Staphylococcus epidermidis
DREDV

SEQ ID NO: 1775688 - protein, 6 aa, Staphylococcus epidermidis
DREKTI

SEQ ID NO: 1775689 - protein, 5 aa, Staphylococcus epidermidis
DREKY

SEQ ID NO: 1775690 - protein, 11 aa, Staphylococcus epidermidis
DRENPGPSTLK

SEQ ID NO: 1775691 - protein, 8 aa, Staphylococcus epidermidis
DRESQNKY

SEQ ID NO: 1775692 - protein, 8 aa, Staphylococcus epidermidis
DRFKNNPH

SEQ ID NO: 1775693 - protein, 5 aa, Staphylococcus epidermidis
DRFNE

SEQ ID NO: 1775694 - protein, 11 aa, Staphylococcus epidermidis
DRFSQEDQDGL

SEQ ID NO: 1775695 - protein, 5 aa, Staphylococcus epidermidis
DRGEH

SEQ ID NO: 1775696 - protein, 5 aa, Staphylococcus epidermidis
DRGIS

SEQ ID NO: 1775697 - protein, 8 aa, Staphylococcus epidermidis
DRGKQSNR

SEQ ID NO: 1775698 - protein, 6 aa, Staphylococcus epidermidis
DRGNDF

SEQ ID NO: 1775699 - protein, 6 aa, Staphylococcus epidermidis
DRGSKF

SEQ ID NO: 1775700 - protein, 7 aa, Staphylococcus epidermidis
DRGTYND

SEQ ID NO: 1775701 - protein, 5 aa, Staphylococcus epidermidis
DRHNE

SEQ ID NO: 1775702 - protein, 5 aa, Staphylococcus epidermidis
DRIDR

SEQ ID NO: 1775703 - protein, 12 aa, Staphylococcus epidermidis
DRISSGDLGNED

SEQ ID NO: 1775704 - protein, 8 aa, Staphylococcus epidermidis
DRKGKTQV

SEQ ID NO: 1775705 - protein, 11 aa, Staphylococcus epidermidis
DRKMSSSGINL

SEQ ID NO: 1775706 - protein, 9 aa, Staphylococcus epidermidis
DRKPYQLST

SEQ ID NO: 1775707 - protein, 7 aa, Staphylococcus epidermidis
DRKSLPE

SEQ ID NO: 1775708 - protein, 13 aa, Staphylococcus epidermidis
DRLASKPDEFAPN

SEQ ID NO: 1775709 - protein, 5 aa, Staphylococcus epidermidis
DRLDK

SEQ ID NO: 1775710 - protein, 6 aa, Staphylococcus epidermidis
DRLDKQ

SEQ ID NO: 1775711 - protein, 9 aa, Staphylococcus epidermidis
DRLKSIGNE

SEQ ID NO: 1775712 - protein, 6 aa, Staphylococcus epidermidis
DRLNTH

SEQ ID NO: 1775713 - protein, 6 aa, Staphylococcus epidermidis
DRNGRE

SEQ ID NO: 1775714 - protein, 7 aa, Staphylococcus epidermidis
DRNNRLT

SEQ ID NO: 1775715 - protein, 6 aa, Staphylococcus epidermidis
DRNSER

SEQ ID NO: 1775716 - protein, 6 aa, Staphylococcus epidermidis
DRPIDK

SEQ ID NO: 1775717 - protein, 6 aa, Staphylococcus epidermidis
DRPLET

SEQ ID NO: 1775718 - protein, 12 aa, Staphylococcus epidermidis
DRPTPTLSNETV

SEQ ID NO: 1775719 - protein, 9 aa, Staphylococcus epidermidis
DRQERAGVK

SEQ ID NO: 1775720 - protein, 6 aa, Staphylococcus epidermidis
DRREDV

SEQ ID NO: 1775721 - protein, 8 aa, Staphylococcus epidermidis
DRRGKKSG

SEQ ID NO: 1775722 - protein, 10 aa, Staphylococcus epidermidis
DRRPDDAETY

SEQ ID NO: 1775723 - protein, 6 aa, Staphylococcus epidermidis
DRSDSI

SEQ ID NO: 1775724 - protein, 17 aa, Staphylococcus epidermidis
DRSKVKAVSNEAANLEG

SEQ ID NO: 1775725 - protein, 6 aa, Staphylococcus epidermidis
DRSSDI

SEQ ID NO: 1775726 - protein, 8 aa, Staphylococcus epidermidis
DRTFSEKD

SEQ ID NO: 1775727 - protein, 8 aa, Staphylococcus epidermidis
DRTGRYQK

SEQ ID NO: 1775728 - protein, 21 aa, Staphylococcus epidermidis
DRTMAEISNEEKSKISHRSNA

SEQ ID NO: 1775729 - protein, 16 aa, Staphylococcus epidermidis
DRTNTLRDTYFDINKG

SEQ ID NO: 1775730 - protein, 13 aa, Staphylococcus epidermidis
DRTPTIEKTRFSE

SEQ ID NO: 1775731 - protein, 4 aa, Staphylococcus epidermidis
DRTQ

SEQ ID NO: 1775732 - protein, 7 aa, Staphylococcus epidermidis
DRTQKPE

SEQ ID NO: 1775733 - protein, 8 aa, Staphylococcus epidermidis
DRTYRDDP

SEQ ID NO: 1775734 - protein, 10 aa, Staphylococcus epidermidis
DRVEGDFKNL

SEQ ID NO: 1775735 - protein, 5 aa, Staphylococcus epidermidis
DRVEQ

SEQ ID NO: 1775736 - protein, 7 aa, Staphylococcus epidermidis
DRVTSSE

SEQ ID NO: 1775737 - protein, 7 aa, Staphylococcus epidermidis
DRYDGNP

SEQ ID NO: 1775738 - protein, 26 aa, Staphylococcus epidermidis
DRYSDERTEQTVANRKHKKINMNYIG

SEQ ID NO: 1775739 - protein, 12 aa, Staphylococcus epidermidis
DSAELKNLATGE

SEQ ID NO: 1775740 - protein, 6 aa, Staphylococcus epidermidis
DSANAD

SEQ ID NO: 1775741 - protein, 8 aa, Staphylococcus epidermidis
DSASEQDV

SEQ ID NO: 1775742 - protein, 6 aa, Staphylococcus epidermidis
DSASIE

SEQ ID NO: 1775743 - protein, 6 aa, Staphylococcus epidermidis
DSDEKD

SEQ ID NO: 1775744 - protein, 6 aa, Staphylococcus epidermidis
DSDGDL

SEQ ID NO: 1775745 - protein, 10 aa, Staphylococcus epidermidis
DSDKNEEIEV

SEQ ID NO: 1775746 - protein, 7 aa, Staphylococcus epidermidis
DSDLAKV

SEQ ID NO: 1775747 - protein, 5 aa, Staphylococcus epidermidis
DSDNL

SEQ ID NO: 1775748 - protein, 13 aa, Staphylococcus epidermidis
DSDSIYNSYYDER

SEQ ID NO: 1775749 - protein, 6 aa, Staphylococcus epidermidis
DSDYSG

SEQ ID NO: 1775750 - protein, 8 aa, Staphylococcus epidermidis
DSEESKTY

SEQ ID NO: 1775751 - protein, 13 aa, Staphylococcus epidermidis
DSEGEKFNNNETL

SEQ ID NO: 1775752 - protein, 5 aa, Staphylococcus epidermidis
DSELD

SEQ ID NO: 1775753 - protein, 6 aa, Staphylococcus epidermidis
DSELDE

SEQ ID NO: 1775754 - protein, 7 aa, Staphylococcus epidermidis
DSELQGH

SEQ ID NO: 1775755 - protein, 5 aa, Staphylococcus epidermidis
DSELT

SEQ ID NO: 1775756 - protein, 10 aa, Staphylococcus epidermidis
DSENAKQETM

SEQ ID NO: 1775757 - protein, 56 aa, Staphylococcus epidermidis
DSENDQNQTESANDFKEEQNQHSQSNVKGSQFENNPNTHEIEEHTASSRANNNGRF

SEQ ID NO: 1775758 - protein, 9 aa, Staphylococcus epidermidis
DSENELPQR

SEQ ID NO: 1775759 - protein, 7 aa, Staphylococcus epidermidis
DSEQRQI

SEQ ID NO: 1775760 - protein, 14 aa, Staphylococcus epidermidis
DSESAENIHPNNRK

SEQ ID NO: 1775761 - protein, 15 aa, Staphylococcus epidermidis
DSESEMRKERINKTK

SEQ ID NO: 1775762 - protein, 11 aa, Staphylococcus epidermidis
DSETGNEQTVQ

SEQ ID NO: 1775763 - protein, 14 aa, Staphylococcus epidermidis
DSETREGKYKGENR

SEQ ID NO: 1775764 - protein, 24 aa, Staphylococcus epidermidis
DSFEEKYEELKQDSYADEEDQDEY

SEQ ID NO: 1775765 - protein, 6 aa, Staphylococcus epidermidis
DSFTAK

SEQ ID NO: 1775766 - protein, 6 aa, Staphylococcus epidermidis
DSGANQ

SEQ ID NO: 1775767 - protein, 4 aa, Staphylococcus epidermidis
DSGC

SEQ ID NO: 1775768 - protein, 7 aa, Staphylococcus epidermidis
DSGCTVY

SEQ ID NO: 1775769 - protein, 12 aa, Staphylococcus epidermidis
DSGEKEPTYLPN

SEQ ID NO: 1775770 - protein, 16 aa, Staphylococcus epidermidis
DSGIPTEALTGENEGY

SEQ ID NO: 1775771 - protein, 10 aa, Staphylococcus epidermidis
DSGMTDDLSY

SEQ ID NO: 1775772 - protein, 38 aa, Staphylococcus epidermidis
DSHTGQKRQTISPKSQPKRGFSKRTTSTKKQVSSSDWK

SEQ ID NO: 1775773 - protein, 39 aa, Staphylococcus epidermidis
DSHTGQKRQTISPKSQPKRGFSKRTTSTKKQVSSSDWKV

SEQ ID NO: 1775774 - protein, 4 aa, Staphylococcus epidermidis
DSIA

SEQ ID NO: 1775775 - protein, 30 aa, Staphylococcus epidermidis
DSIANQEQVRQGSNYTNEDHTQQQAYDDAV

SEQ ID NO: 1775776 - protein, 10 aa, Staphylococcus epidermidis
DSIDNIKNDA

SEQ ID NO: 1775777 - protein, 11 aa, Staphylococcus epidermidis
DSIDTSCAEDE

SEQ ID NO: 1775778 - protein, 11 aa, Staphylococcus epidermidis
DSIEGQPGLNK

SEQ ID NO: 1775779 - protein, 10 aa, Staphylococcus epidermidis
DSIGKPLPNR

SEQ ID NO: 1775780 - protein, 14 aa, Staphylococcus epidermidis
DSINDALEDKADGY

SEQ ID NO: 1775781 - protein, 14 aa, Staphylococcus epidermidis
DSINSDSDNQKEKI

SEQ ID NO: 1775782 - protein, 8 aa, Staphylococcus epidermidis
DSKDYEKW

SEQ ID NO: 1775783 - protein, 10 aa, Staphylococcus epidermidis
DSKEEDNHKA

SEQ ID NO: 1775784 - protein, 15 aa, Staphylococcus epidermidis
DSKEQTILSLKKINK

SEQ ID NO: 1775785 - protein, 13 aa, Staphylococcus epidermidis
DSKETQKSLTEIT

SEQ ID NO: 1775786 - protein, 7 aa, Staphylococcus epidermidis
DSKGRQC

SEQ ID NO: 1775787 - protein, 5 aa, Staphylococcus epidermidis
DSKIN

SEQ ID NO: 1775788 - protein, 26 aa, Staphylococcus epidermidis
DSKINPSNPTYSKKDTIKYGVFNHES

SEQ ID NO: 1775789 - protein, 10 aa, Staphylococcus epidermidis
DSKKVNKKVR

SEQ ID NO: 1775790 - protein, 10 aa, Staphylococcus epidermidis
DSKKVPAKQR

SEQ ID NO: 1775791 - protein, 16 aa, Staphylococcus epidermidis
DSKKVSPNNRARLNQN

SEQ ID NO: 1775792 - protein, 15 aa, Staphylococcus epidermidis
DSKNEIGAHKDRHEN

SEQ ID NO: 1775793 - protein, 14 aa, Staphylococcus epidermidis
DSKSKSTKDNNPNN

SEQ ID NO: 1775794 - protein, 9 aa, Staphylococcus epidermidis
DSKSQNKKN

SEQ ID NO: 1775795 - protein, 14 aa, Staphylococcus epidermidis
DSKSTNVTVNNDNS

SEQ ID NO: 1775796 - protein, 10 aa, Staphylococcus epidermidis
DSKTKRSNYE

SEQ ID NO: 1775797 - protein, 7 aa, Staphylococcus epidermidis
DSKVAPT

SEQ ID NO: 1775798 - protein, 6 aa, Staphylococcus epidermidis
DSLDEN

SEQ ID NO: 1775799 - protein, 9 aa, Staphylococcus epidermidis
DSLGDSKAD

SEQ ID NO: 1775800 - protein, 10 aa, Staphylococcus epidermidis
DSLGDSKPDW

SEQ ID NO: 1775801 - protein, 8 aa, Staphylococcus epidermidis
DSLNADKA

SEQ ID NO: 1775802 - protein, 5 aa, Staphylococcus epidermidis
DSLRT

SEQ ID NO: 1775803 - protein, 6 aa, Staphylococcus epidermidis
DSMEEK

SEQ ID NO: 1775804 - protein, 6 aa, Staphylococcus epidermidis
DSNATE

SEQ ID NO: 1775805 - protein, 4 aa, Staphylococcus epidermidis
DSND

SEQ ID NO: 1775806 - protein, 9 aa, Staphylococcus epidermidis
DSNDNIKTE

SEQ ID NO: 1775807 - protein, 11 aa, Staphylococcus epidermidis
DSNDSRAGRWS

SEQ ID NO: 1775808 - protein, 8 aa, Staphylococcus epidermidis
DSNEPNVA

SEQ ID NO: 1775809 - protein, 6 aa, Staphylococcus epidermidis
DSNEYS

SEQ ID NO: 1775810 - protein, 39 aa, Staphylococcus epidermidis
DSNHLPNYGSDTPKPGEHVAGSPGYDPKKYRDKDGISGE

SEQ ID NO: 1775811 - protein, 8 aa, Staphylococcus epidermidis
DSNITSKA

SEQ ID NO: 1775812 - protein, 7 aa, Staphylococcus epidermidis
DSNLEDV

SEQ ID NO: 1775813 - protein, 5 aa, Staphylococcus epidermidis
DSNLH

SEQ ID NO: 1775814 - protein, 6 aa, Staphylococcus epidermidis
DSNLHD

SEQ ID NO: 1775815 - protein, 7 aa, Staphylococcus epidermidis
DSNQPVY

SEQ ID NO: 1775816 - protein, 17 aa, Staphylococcus epidermidis
DSNWTTTDYIYSQYTWI

SEQ ID NO: 1775817 - protein, 6 aa, Staphylococcus epidermidis
DSPGMN

SEQ ID NO: 1775818 - protein, 16 aa, Staphylococcus epidermidis
DSPQSAEALAEKQQTI

SEQ ID NO: 1775819 - protein, 8 aa, Staphylococcus epidermidis
DSPSHEGK

SEQ ID NO: 1775820 - protein, 9 aa, Staphylococcus epidermidis
DSPSTNYAA

SEQ ID NO: 1775821 - protein, 8 aa, Staphylococcus epidermidis
DSQLKDNF

SEQ ID NO: 1775822 - protein, 8 aa, Staphylococcus epidermidis
DSQSKETM

SEQ ID NO: 1775823 - protein, 4 aa, Staphylococcus epidermidis
DSQW

SEQ ID NO: 1775824 - protein, 8 aa, Staphylococcus epidermidis
DSRAEEKA

SEQ ID NO: 1775825 - protein, 7 aa, Staphylococcus epidermidis
DSREINE

SEQ ID NO: 1775826 - protein, 7 aa, Staphylococcus epidermidis
DSRIEGS

SEQ ID NO: 1775827 - protein, 4 aa, Staphylococcus epidermidis
DSRL

SEQ ID NO: 1775828 - protein, 16 aa, Staphylococcus epidermidis
DSRREAFDASGDLKPY

SEQ ID NO: 1775829 - protein, 14 aa, Staphylococcus epidermidis
DSRYKGTTYDVERE

SEQ ID NO: 1775830 - protein, 14 aa, Staphylococcus epidermidis
DSSINQKYNGQRKS

SEQ ID NO: 1775831 - protein, 6 aa, Staphylococcus epidermidis
DSSLTE

SEQ ID NO: 1775832 - protein, 5 aa, Staphylococcus epidermidis
DSSNR

SEQ ID NO: 1775833 - protein, 14 aa, Staphylococcus epidermidis
DSSSEANDKQSTQV

SEQ ID NO: 1775834 - protein, 17 aa, Staphylococcus epidermidis
DSSVGGKVGINSQHGKN

SEQ ID NO: 1775835 - protein, 5 aa, Staphylococcus epidermidis
DSSVN

SEQ ID NO: 1775836 - protein, 10 aa, Staphylococcus epidermidis
DSTATSQTPI

SEQ ID NO: 1775837 - protein, 9 aa, Staphylococcus epidermidis
DSTDGVQRG

SEQ ID NO: 1775838 - protein, 15 aa, Staphylococcus epidermidis
DSTEAEKPGYNTPEN

SEQ ID NO: 1775839 - protein, 6 aa, Staphylococcus epidermidis
DSTIQS

SEQ ID NO: 1775840 - protein, 33 aa, Staphylococcus epidermidis
DSTPADTDSEQVVSESIKSAKEKKYSKSNPYDA

SEQ ID NO: 1775841 - protein, 5 aa, Staphylococcus epidermidis
DSTPL

SEQ ID NO: 1775842 - protein, 56 aa, Staphylococcus epidermidis
DSTRISDSAKAEAKNYITDKYGKEYISKRKATGKQGDQDAHEAIRPTSALRTPDDM

SEQ ID NO: 1775843 - protein, 17 aa, Staphylococcus epidermidis
DSTTTYAAPNPYGAFSG

SEQ ID NO: 1775844 - protein, 7 aa, Staphylococcus epidermidis
DSTTYDS

SEQ ID NO: 1775845 - protein, 6 aa, Staphylococcus epidermidis
DSTWAD

SEQ ID NO: 1775846 - protein, 19 aa, Staphylococcus epidermidis
DSVGSTYKANVSGSNSELK

SEQ ID NO: 1775847 - protein, 4 aa, Staphylococcus epidermidis
DSVH

SEQ ID NO: 1775848 - protein, 8 aa, Staphylococcus epidermidis
DSVKDNLS

SEQ ID NO: 1775849 - protein, 11 aa, Staphylococcus epidermidis
DSVKNKETQFA

SEQ ID NO: 1775850 - protein, 4 aa, Staphylococcus epidermidis
DSVN

SEQ ID NO: 1775851 - protein, 9 aa, Staphylococcus epidermidis
DSVNDEERQ

SEQ ID NO: 1775852 - protein, 22 aa, Staphylococcus epidermidis
DSVTTDHISPAGAIGKDTPAGK

SEQ ID NO: 1775853 - protein, 10 aa, Staphylococcus epidermidis
DSYANPDALE

SEQ ID NO: 1775854 - protein, 8 aa, Staphylococcus epidermidis
DSYASPTV

SEQ ID NO: 1775855 - protein, 8 aa, Staphylococcus epidermidis
DSYEISTT

SEQ ID NO: 1775856 - protein, 19 aa, Staphylococcus epidermidis
DSYSTHTRSGLGGFQGRAL

SEQ ID NO: 1775857 - protein, 11 aa, Staphylococcus epidermidis
DTANEEAQKVN

SEQ ID NO: 1775858 - protein, 21 aa, Staphylococcus epidermidis
DTANEEAQKVNAKLNTTSGKL

SEQ ID NO: 1775859 - protein, 8 aa, Staphylococcus epidermidis
DTANEFSE

SEQ ID NO: 1775860 - protein, 4 aa, Staphylococcus epidermidis
DTAR

SEQ ID NO: 1775861 - protein, 18 aa, Staphylococcus epidermidis
DTARYGIRSGGEPTQGAG

SEQ ID NO: 1775862 - protein, 9 aa, Staphylococcus epidermidis
DTASNYITN

SEQ ID NO: 1775863 - protein, 36 aa, Staphylococcus epidermidis
DTATNNRQNIDPQEATFTEESQNINQQQTKCQPTEV

SEQ ID NO: 1775864 - protein, 36 aa, Staphylococcus epidermidis
DTATNNRQNIDPQEATFTEKSQNINQQQTKCQPTEV

SEQ ID NO: 1775865 - protein, 15 aa, Staphylococcus epidermidis
DTAWSNSKSVYKGTS

SEQ ID NO: 1775866 - protein, 4 aa, Staphylococcus epidermidis
DTCP

SEQ ID NO: 1775867 - protein, 7 aa, Staphylococcus epidermidis
DTDEHAE

SEQ ID NO: 1775868 - protein, 6 aa, Staphylococcus epidermidis
DTDKAF

SEQ ID NO: 1775869 - protein, 9 aa, Staphylococcus epidermidis
DTDPDREPV

SEQ ID NO: 1775870 - protein, 12 aa, Staphylococcus epidermidis
DTEEANEIKLGQ

SEQ ID NO: 1775871 - protein, 18 aa, Staphylococcus epidermidis
DTEETPKKYFKDNKVAKN

SEQ ID NO: 1775872 - protein, 4 aa, Staphylococcus epidermidis
DTEF

SEQ ID NO: 1775873 - protein, 11 aa, Staphylococcus epidermidis
DTEGLPITQGN

SEQ ID NO: 1775874 - protein, 8 aa, Staphylococcus epidermidis
DTEGMSPA

SEQ ID NO: 1775875 - protein, 8 aa, Staphylococcus epidermidis
DTENKDGQ

SEQ ID NO: 1775876 - protein, 15 aa, Staphylococcus epidermidis
DTEPRPGSMGKGIPG

SEQ ID NO: 1775877 - protein, 4 aa, Staphylococcus epidermidis
DTET

SEQ ID NO: 1775878 - protein, 8 aa, Staphylococcus epidermidis
DTETPIEK

SEQ ID NO: 1775879 - protein, 20 aa, Staphylococcus epidermidis
DTETPSYESQIDELEDEALA

SEQ ID NO: 1775880 - protein, 7 aa, Staphylococcus epidermidis
DTEYTGG

SEQ ID NO: 1775881 - protein, 5 aa, Staphylococcus epidermidis
DTFER

SEQ ID NO: 1775882 - protein, 4 aa, Staphylococcus epidermidis
DTFG

SEQ ID NO: 1775883 - protein, 7 aa, Staphylococcus epidermidis
DTFPRKG

SEQ ID NO: 1775884 - protein, 28 aa, Staphylococcus epidermidis
DTFPRKGLNVSDERLTELSTKENRQNKP

SEQ ID NO: 1775885 - protein, 54 aa, Staphylococcus epidermidis
DTGEEKDESELSQTDETQPENDGARNEATQRKQSSDNKDQKEESSVKPKNNGRF

SEQ ID NO: 1775886 - protein, 5 aa, Staphylococcus epidermidis
DTGEM

SEQ ID NO: 1775887 - protein, 14 aa, Staphylococcus epidermidis
DTGNPNSNAQQNVN

SEQ ID NO: 1775888 - protein, 6 aa, Staphylococcus epidermidis
DTGYGK

SEQ ID NO: 1775889 - protein, 7 aa, Staphylococcus epidermidis
DTHNASL

SEQ ID NO: 1775890 - protein, 8 aa, Staphylococcus epidermidis
DTHNQDEH

SEQ ID NO: 1775891 - protein, 7 aa, Staphylococcus epidermidis
DTIAGTC

SEQ ID NO: 1775892 - protein, 5 aa, Staphylococcus epidermidis
DTIPQ

SEQ ID NO: 1775893 - protein, 24 aa, Staphylococcus epidermidis
DTISGGSVEVDGNEINKLSNKQLA

SEQ ID NO: 1775894 - protein, 15 aa, Staphylococcus epidermidis
DTISGGTVEVEGKEI

SEQ ID NO: 1775895 - protein, 8 aa, Staphylococcus epidermidis
DTKENERE

SEQ ID NO: 1775896 - protein, 10 aa, Staphylococcus epidermidis
DTKHTHGTGC

SEQ ID NO: 1775897 - protein, 7 aa, Staphylococcus epidermidis
DTKIESG

SEQ ID NO: 1775898 - protein, 13 aa, Staphylococcus epidermidis
DTKLENQDDNHEK

SEQ ID NO: 1775899 - protein, 8 aa, Staphylococcus epidermidis
DTKLERRI

SEQ ID NO: 1775900 - protein, 4 aa, Staphylococcus epidermidis
DTKN

SEQ ID NO: 1775901 - protein, 9 aa, Staphylococcus epidermidis
DTKNDDDVD

SEQ ID NO: 1775902 - protein, 10 aa, Staphylococcus epidermidis
DTKNKYSKRN

SEQ ID NO: 1775903 - protein, 7 aa, Staphylococcus epidermidis
DTKPRGL

SEQ ID NO: 1775904 - protein, 8 aa, Staphylococcus epidermidis
DTKQIERN

SEQ ID NO: 1775905 - protein, 8 aa, Staphylococcus epidermidis
DTKRENEI

SEQ ID NO: 1775906 - protein, 6 aa, Staphylococcus epidermidis
DTKTQK

SEQ ID NO: 1775907 - protein, 5 aa, Staphylococcus epidermidis
DTKYR

SEQ ID NO: 1775908 - protein, 4 aa, Staphylococcus epidermidis
DTLD

SEQ ID NO: 1775909 - protein, 4 aa, Staphylococcus epidermidis
DTLN

SEQ ID NO: 1775910 - protein, 14 aa, Staphylococcus epidermidis
DTLNSQMEKQESRH

SEQ ID NO: 1775911 - protein, 5 aa, Staphylococcus epidermidis
DTLQA

SEQ ID NO: 1775912 - protein, 9 aa, Staphylococcus epidermidis
DTLSGGEIQ

SEQ ID NO: 1775913 - protein, 6 aa, Staphylococcus epidermidis
DTLTTQ

SEQ ID NO: 1775914 - protein, 14 aa, Staphylococcus epidermidis
DTMKEATQPGVTTR

SEQ ID NO: 1775915 - protein, 15 aa, Staphylococcus epidermidis
DTMREATKPGVTTRE

SEQ ID NO: 1775916 - protein, 12 aa, Staphylococcus epidermidis
DTNAISTKEEIQ

SEQ ID NO: 1775917 - protein, 7 aa, Staphylococcus epidermidis
DTNEANL

SEQ ID NO: 1775918 - protein, 5 aa, Staphylococcus epidermidis
DTNEE

SEQ ID NO: 1775919 - protein, 11 aa, Staphylococcus epidermidis
DTNHRKYPKTI

SEQ ID NO: 1775920 - protein, 11 aa, Staphylococcus epidermidis
DTNKDDLNLDG

SEQ ID NO: 1775921 - protein, 17 aa, Staphylococcus epidermidis
DTNKDGIQDDNEKGISG

SEQ ID NO: 1775922 - protein, 6 aa, Staphylococcus epidermidis
DTNKPK

SEQ ID NO: 1775923 - protein, 8 aa, Staphylococcus epidermidis
DTNKQAKL

SEQ ID NO: 1775924 - protein, 7 aa, Staphylococcus epidermidis
DTNQQTI

SEQ ID NO: 1775925 - protein, 7 aa, Staphylococcus epidermidis
DTNSLAH

SEQ ID NO: 1775926 - protein, 9 aa, Staphylococcus epidermidis
DTPANLNNI

SEQ ID NO: 1775927 - protein, 9 aa, Staphylococcus epidermidis
DTPANLNSI

SEQ ID NO: 1775928 - protein, 17 aa, Staphylococcus epidermidis
DTPERGQENYKEATDFT

SEQ ID NO: 1775929 - protein, 16 aa, Staphylococcus epidermidis
DTPERSQTNYKEATQF

SEQ ID NO: 1775930 - protein, 14 aa, Staphylococcus epidermidis
DTPTPTDFGDNDNL

SEQ ID NO: 1775931 - protein, 7 aa, Staphylococcus epidermidis
DTQGQAL

SEQ ID NO: 1775932 - protein, 5 aa, Staphylococcus epidermidis
DTQSD

SEQ ID NO: 1775933 - protein, 17 aa, Staphylococcus epidermidis
DTQSDPNSESTPSTEKQ

SEQ ID NO: 1775934 - protein, 14 aa, Staphylococcus epidermidis
DTQTEYGQDIFKNM

SEQ ID NO: 1775935 - protein, 14 aa, Staphylococcus epidermidis
DTRDEDYSTSGTSF

SEQ ID NO: 1775936 - protein, 14 aa, Staphylococcus epidermidis
DTRDEGESTSGTSF

SEQ ID NO: 1775937 - protein, 18 aa, Staphylococcus epidermidis
DTRFTQDKIQKGKHYGAT

SEQ ID NO: 1775938 - protein, 8 aa, Staphylococcus epidermidis
DTRNTHPK

SEQ ID NO: 1775939 - protein, 6 aa, Staphylococcus epidermidis
DTRREV

SEQ ID NO: 1775940 - protein, 14 aa, Staphylococcus epidermidis
DTSETKDFADRDDS

SEQ ID NO: 1775941 - protein, 5 aa, Staphylococcus epidermidis
DTSFP

SEQ ID NO: 1775942 - protein, 14 aa, Staphylococcus epidermidis
DTSHEMPEDGYNGK

SEQ ID NO: 1775943 - protein, 12 aa, Staphylococcus epidermidis
DTSKSMRKQSRA

SEQ ID NO: 1775944 - protein, 9 aa, Staphylococcus epidermidis
DTSPDFNAS

SEQ ID NO: 1775945 - protein, 13 aa, Staphylococcus epidermidis
DTSPDFNATGVNP

SEQ ID NO: 1775946 - protein, 4 aa, Staphylococcus epidermidis
DTSR

SEQ ID NO: 1775947 - protein, 7 aa, Staphylococcus epidermidis
DTSRIQQ

SEQ ID NO: 1775948 - protein, 10 aa, Staphylococcus epidermidis
DTSYPSKETM

SEQ ID NO: 1775949 - protein, 8 aa, Staphylococcus epidermidis
DTTDTDEI

SEQ ID NO: 1775950 - protein, 13 aa, Staphylococcus epidermidis
DTTETKEFTDRDD

SEQ ID NO: 1775951 - protein, 7 aa, Staphylococcus epidermidis
DTTEYDE

SEQ ID NO: 1775952 - protein, 6 aa, Staphylococcus epidermidis
DTTFND

SEQ ID NO: 1775953 - protein, 7 aa, Staphylococcus epidermidis
DTTFNQY

SEQ ID NO: 1775954 - protein, 11 aa, Staphylococcus epidermidis
DTTNENVPPQT

SEQ ID NO: 1775955 - protein, 6 aa, Staphylococcus epidermidis
DTTNSL

SEQ ID NO: 1775956 - protein, 5 aa, Staphylococcus epidermidis
DTTPR

SEQ ID NO: 1775957 - protein, 9 aa, Staphylococcus epidermidis
DTTPTSLGN

SEQ ID NO: 1775958 - protein, 8 aa, Staphylococcus epidermidis
DTTQSDWR

SEQ ID NO: 1775959 - protein, 9 aa, Staphylococcus epidermidis
DTTSDVEQD

SEQ ID NO: 1775960 - protein, 4 aa, Staphylococcus epidermidis
DTTT

SEQ ID NO: 1775961 - protein, 9 aa, Staphylococcus epidermidis
DTTTNEPIA

SEQ ID NO: 1775962 - protein, 11 aa, Staphylococcus epidermidis
DTTTNKSNFKE

SEQ ID NO: 1775963 - protein, 12 aa, Staphylococcus epidermidis
DTVEKKENMPKK

SEQ ID NO: 1775964 - protein, 11 aa, Staphylococcus epidermidis
DTVGKTSENVE

SEQ ID NO: 1775965 - protein, 33 aa, Staphylococcus epidermidis
DTVQPESKQSKNKKPKFIQQQERQLKERYGSRV

SEQ ID NO: 1775966 - protein, 8 aa, Staphylococcus epidermidis
DTVTEQAK

SEQ ID NO: 1775967 - protein, 11 aa, Staphylococcus epidermidis
DTVVDDHTDDE

SEQ ID NO: 1775968 - protein, 7 aa, Staphylococcus epidermidis
DTYENEA

SEQ ID NO: 1775969 - protein, 14 aa, Staphylococcus epidermidis
DTYGKDNKPKITNM

SEQ ID NO: 1775970 - protein, 6 aa, Staphylococcus epidermidis
DTYQGL

SEQ ID NO: 1775971 - protein, 22 aa, Staphylococcus epidermidis
DVADNGGVSDKTSSGTLTFEPG

SEQ ID NO: 1775972 - protein, 13 aa, Staphylococcus epidermidis
DVAEKMKEADINS

SEQ ID NO: 1775973 - protein, 24 aa, Staphylococcus epidermidis
DVDDEQMNSDNEDSNNDEAKPTYT

SEQ ID NO: 1775974 - protein, 6 aa, Staphylococcus epidermidis
DVDQEY

SEQ ID NO: 1775975 - protein, 16 aa, Staphylococcus epidermidis
DVEAKNPEGHDILIWK

SEQ ID NO: 1775976 - protein, 5 aa, Staphylococcus epidermidis
DVEAR

SEQ ID NO: 1775977 - protein, 16 aa, Staphylococcus epidermidis
DVEGKSIRITPMEGLL

SEQ ID NO: 1775978 - protein, 7 aa, Staphylococcus epidermidis
DVENGKE

SEQ ID NO: 1775979 - protein, 5 aa, Staphylococcus epidermidis
DVENS

SEQ ID NO: 1775980 - protein, 7 aa, Staphylococcus epidermidis
DVESQIE

SEQ ID NO: 1775981 - protein, 5 aa, Staphylococcus epidermidis
DVHQS

SEQ ID NO: 1775982 - protein, 16 aa, Staphylococcus epidermidis
DVKKSNKANIQSTSGF

SEQ ID NO: 1775983 - protein, 5 aa, Staphylococcus epidermidis
DVKNY

SEQ ID NO: 1775984 - protein, 11 aa, Staphylococcus epidermidis
DVKSEPEAEDI

SEQ ID NO: 1775985 - protein, 7 aa, Staphylococcus epidermidis
DVKSGTN

SEQ ID NO: 1775986 - protein, 8 aa, Staphylococcus epidermidis
DVKTQDLT

SEQ ID NO: 1775987 - protein, 9 aa, Staphylococcus epidermidis
DVNHGEQAI

SEQ ID NO: 1775988 - protein, 4 aa, Staphylococcus epidermidis
DVNP

SEQ ID NO: 1775989 - protein, 4 aa, Staphylococcus epidermidis
DVNR

SEQ ID NO: 1775990 - protein, 11 aa, Staphylococcus epidermidis
DVNRDRGGSLD

SEQ ID NO: 1775991 - protein, 7 aa, Staphylococcus epidermidis
DVNSESI

SEQ ID NO: 1775992 - protein, 5 aa, Staphylococcus epidermidis
DVPES

SEQ ID NO: 1775993 - protein, 12 aa, Staphylococcus epidermidis
DVPQGESDEENV

SEQ ID NO: 1775994 - protein, 4 aa, Staphylococcus epidermidis
DVPV

SEQ ID NO: 1775995 - protein, 15 aa, Staphylococcus epidermidis
DVQPPAESEEQRDDY

SEQ ID NO: 1775996 - protein, 8 aa, Staphylococcus epidermidis
DVQPTEAQ

SEQ ID NO: 1775997 - protein, 6 aa, Staphylococcus epidermidis
DVQTAL

SEQ ID NO: 1775998 - protein, 7 aa, Staphylococcus epidermidis
DVRNSYK

SEQ ID NO: 1775999 - protein, 18 aa, Staphylococcus epidermidis
DVRRTPKVEGMTGAQQEA

SEQ ID NO: 1776000 - protein, 24 aa, Staphylococcus epidermidis
DVRRTRKADGMIGAQKEAKTYAEK

SEQ ID NO: 1776001 - protein, 9 aa, Staphylococcus epidermidis
DVSDEESYD

SEQ ID NO: 1776002 - protein, 12 aa, Staphylococcus epidermidis
DVSKTAGGKGLN

SEQ ID NO: 1776003 - protein, 7 aa, Staphylococcus epidermidis
DVSNRDE

SEQ ID NO: 1776004 - protein, 7 aa, Staphylococcus epidermidis
DVSQKLT

SEQ ID NO: 1776005 - protein, 37 aa, Staphylococcus epidermidis
DVSSEVPVSSSDTDETAQSTSSHSDVDHNPFADANRH

SEQ ID NO: 1776006 - protein, 18 aa, Staphylococcus epidermidis
DVSTEEVTPENERRTVSD

SEQ ID NO: 1776007 - protein, 7 aa, Staphylococcus epidermidis
DVTEEEM

SEQ ID NO: 1776008 - protein, 8 aa, Staphylococcus epidermidis
DVTGADSI

SEQ ID NO: 1776009 - protein, 18 aa, Staphylococcus epidermidis
DVTGQDTTDWTRDTSQEL

SEQ ID NO: 1776010 - protein, 6 aa, Staphylococcus epidermidis
DVTNKT

SEQ ID NO: 1776011 - protein, 15 aa, Staphylococcus epidermidis
DVTRQNAIAKNRELF

SEQ ID NO: 1776012 - protein, 9 aa, Staphylococcus epidermidis
DVTSSTSTK

SEQ ID NO: 1776013 - protein, 10 aa, Staphylococcus epidermidis
DVTTDHEGEV

SEQ ID NO: 1776014 - protein, 10 aa, Staphylococcus epidermidis
DVYDTTQEDY

SEQ ID NO: 1776015 - protein, 5 aa, Staphylococcus epidermidis
DVYGS

SEQ ID NO: 1776016 - protein, 13 aa, Staphylococcus epidermidis
DVYNNRDKYAEKM

SEQ ID NO: 1776017 - protein, 10 aa, Staphylococcus epidermidis
DWEDKDGRHF

SEQ ID NO: 1776018 - protein, 12 aa, Staphylococcus epidermidis
DWEDKNGNHYDQ

SEQ ID NO: 1776019 - protein, 7 aa, Staphylococcus epidermidis
DWEPQDS

SEQ ID NO: 1776020 - protein, 9 aa, Staphylococcus epidermidis
DWGATPSAL

SEQ ID NO: 1776021 - protein, 5 aa, Staphylococcus epidermidis
DWPAS

SEQ ID NO: 1776022 - protein, 8 aa, Staphylococcus epidermidis
DWPKPGVS

SEQ ID NO: 1776023 - protein, 8 aa, Staphylococcus epidermidis
DWSLSDPK

SEQ ID NO: 1776024 - protein, 7 aa, Staphylococcus epidermidis
DWSPKTI

SEQ ID NO: 1776025 - protein, 6 aa, Staphylococcus epidermidis
DYANEI

SEQ ID NO: 1776026 - protein, 7 aa, Staphylococcus epidermidis
DYANPNY

SEQ ID NO: 1776027 - protein, 9 aa, Staphylococcus epidermidis
DYDDEGQSV

SEQ ID NO: 1776028 - protein, 7 aa, Staphylococcus epidermidis
DYDEDAE

SEQ ID NO: 1776029 - protein, 24 aa, Staphylococcus epidermidis
DYDKSLDSIERNYDQDPETSWKER

SEQ ID NO: 1776030 - protein, 11 aa, Staphylococcus epidermidis
DYDKSLKTTIA

SEQ ID NO: 1776031 - protein, 4 aa, Staphylococcus epidermidis
DYDP

SEQ ID NO: 1776032 - protein, 5 aa, Staphylococcus epidermidis
DYDQN

SEQ ID NO: 1776033 - protein, 10 aa, Staphylococcus epidermidis
DYDSNLKQWS

SEQ ID NO: 1776034 - protein, 7 aa, Staphylococcus epidermidis
DYEDENG

SEQ ID NO: 1776035 - protein, 10 aa, Staphylococcus epidermidis
DYEGYAPRKY

SEQ ID NO: 1776036 - protein, 4 aa, Staphylococcus epidermidis
DYET

SEQ ID NO: 1776037 - protein, 24 aa, Staphylococcus epidermidis
DYETDKDGNVKPRLEDKDNHTIDA

SEQ ID NO: 1776038 - protein, 18 aa, Staphylococcus epidermidis
DYETNTYEVTEKHQHGEQ

SEQ ID NO: 1776039 - protein, 11 aa, Staphylococcus epidermidis
DYFGNTEEPTG

SEQ ID NO: 1776040 - protein, 4 aa, Staphylococcus epidermidis
DYGF

SEQ ID NO: 1776041 - protein, 9 aa, Staphylococcus epidermidis
DYGKDNFTQ

SEQ ID NO: 1776042 - protein, 7 aa, Staphylococcus epidermidis
DYGMSAQ

SEQ ID NO: 1776043 - protein, 7 aa, Staphylococcus epidermidis
DYGNSPL

SEQ ID NO: 1776044 - protein, 6 aa, Staphylococcus epidermidis
DYGSKQ

SEQ ID NO: 1776045 - protein, 15 aa, Staphylococcus epidermidis
DYHGEVTAPKTKSAI

SEQ ID NO: 1776046 - protein, 11 aa, Staphylococcus epidermidis
DYIAPSTSTFK

SEQ ID NO: 1776047 - protein, 10 aa, Staphylococcus epidermidis
DYKKDDFSQA

SEQ ID NO: 1776048 - protein, 9 aa, Staphylococcus epidermidis
DYKKGNEMS

SEQ ID NO: 1776049 - protein, 5 aa, Staphylococcus epidermidis
DYKNG

SEQ ID NO: 1776050 - protein, 7 aa, Staphylococcus epidermidis
DYKQYSQ

SEQ ID NO: 1776051 - protein, 8 aa, Staphylococcus epidermidis
DYLENDDE

SEQ ID NO: 1776052 - protein, 6 aa, Staphylococcus epidermidis
DYNGDD

SEQ ID NO: 1776053 - protein, 7 aa, Staphylococcus epidermidis
DYNGSEE

SEQ ID NO: 1776054 - protein, 12 aa, Staphylococcus epidermidis
DYNPETDRIPEN

SEQ ID NO: 1776055 - protein, 4 aa, Staphylococcus epidermidis
DYNS

SEQ ID NO: 1776056 - protein, 9 aa, Staphylococcus epidermidis
DYPGIGPEH

SEQ ID NO: 1776057 - protein, 8 aa, Staphylococcus epidermidis
DYPTDSEG

SEQ ID NO: 1776058 - protein, 13 aa, Staphylococcus epidermidis
DYPTGPHERQDDS

SEQ ID NO: 1776059 - protein, 7 aa, Staphylococcus epidermidis
DYQDELN

SEQ ID NO: 1776060 - protein, 8 aa, Staphylococcus epidermidis
DYQEGNFT

SEQ ID NO: 1776061 - protein, 11 aa, Staphylococcus epidermidis
DYQTDKDGDII

SEQ ID NO: 1776062 - protein, 5 aa, Staphylococcus epidermidis
DYRGQ

SEQ ID NO: 1776063 - protein, 4 aa, Staphylococcus epidermidis
DYSF

SEQ ID NO: 1776064 - protein, 6 aa, Staphylococcus epidermidis
DYSNSI

SEQ ID NO: 1776065 - protein, 12 aa, Staphylococcus epidermidis
DYSTIEKAPDRH

SEQ ID NO: 1776066 - protein, 8 aa, Staphylococcus epidermidis
DYTKGENY

SEQ ID NO: 1776067 - protein, 10 aa, Staphylococcus epidermidis
DYTPSANGLK

SEQ ID NO: 1776068 - protein, 7 aa, Staphylococcus epidermidis
DYTSIQP

SEQ ID NO: 1776069 - protein, 9 aa, Staphylococcus epidermidis
DYVRHGEKK

SEQ ID NO: 1776070 - protein, 8 aa, Staphylococcus epidermidis
DYYEPDEL

SEQ ID NO: 1776071 - protein, 13 aa, Staphylococcus epidermidis
DYYKEQGSRVQKN

SEQ ID NO: 1776072 - protein, 6 aa, Staphylococcus epidermidis
EAADKD

SEQ ID NO: 1776073 - protein, 14 aa, Staphylococcus epidermidis
EAAGEEFNINSPKQ

SEQ ID NO: 1776074 - protein, 6 aa, Staphylococcus epidermidis
EAANGQ

SEQ ID NO: 1776075 - protein, 6 aa, Staphylococcus epidermidis
EAANRG

SEQ ID NO: 1776076 - protein, 5 aa, Staphylococcus epidermidis
EADIN

SEQ ID NO: 1776077 - protein, 6 aa, Staphylococcus epidermidis
EADMRG

SEQ ID NO: 1776078 - protein, 8 aa, Staphylococcus epidermidis
EADVPRQA

SEQ ID NO: 1776079 - protein, 21 aa, Staphylococcus epidermidis
EAEDVPEEIEPSEIEGRRDLR

SEQ ID NO: 1776080 - protein, 10 aa, Staphylococcus epidermidis
EAEEKSGSQI

SEQ ID NO: 1776081 - protein, 10 aa, Staphylococcus epidermidis
EAEERSGSQI

SEQ ID NO: 1776082 - protein, 6 aa, Staphylococcus epidermidis
EAEGHA

SEQ ID NO: 1776083 - protein, 7 aa, Staphylococcus epidermidis
EAEIEPE

SEQ ID NO: 1776084 - protein, 5 aa, Staphylococcus epidermidis
EAEKY

SEQ ID NO: 1776085 - protein, 18 aa, Staphylococcus epidermidis
EAENADHVNERFTVVGEQ

SEQ ID NO: 1776086 - protein, 7 aa, Staphylococcus epidermidis
EAERQGL

SEQ ID NO: 1776087 - protein, 13 aa, Staphylococcus epidermidis
EAERSPNESYIPN

SEQ ID NO: 1776088 - protein, 13 aa, Staphylococcus epidermidis
EAESKEQAERKIK

SEQ ID NO: 1776089 - protein, 9 aa, Staphylococcus epidermidis
EAESTQKTL

SEQ ID NO: 1776090 - protein, 10 aa, Staphylococcus epidermidis
EAFGNKGTFT

SEQ ID NO: 1776091 - protein, 13 aa, Staphylococcus epidermidis
EAFHGGHTQGTIN

SEQ ID NO: 1776092 - protein, 5 aa, Staphylococcus epidermidis
EAGAK

SEQ ID NO: 1776093 - protein, 9 aa, Staphylococcus epidermidis
EAGDFDQSK

SEQ ID NO: 1776094 - protein, 4 aa, Staphylococcus epidermidis
EAGE

SEQ ID NO: 1776095 - protein, 5 aa, Staphylococcus epidermidis
EAGEI

SEQ ID NO: 1776096 - protein, 15 aa, Staphylococcus epidermidis
EAGEPLTPTRMNEEY

SEQ ID NO: 1776097 - protein, 7 aa, Staphylococcus epidermidis
EAGESAN

SEQ ID NO: 1776098 - protein, 14 aa, Staphylococcus epidermidis
EAGEVASALSRGQM

SEQ ID NO: 1776099 - protein, 7 aa, Staphylococcus epidermidis
EAGFEPS

SEQ ID NO: 1776100 - protein, 7 aa, Staphylococcus epidermidis
EAGLAQR

SEQ ID NO: 1776101 - protein, 15 aa, Staphylococcus epidermidis
EAGMPKKSAKSRATQ

SEQ ID NO: 1776102 - protein, 14 aa, Staphylococcus epidermidis
EAGMSRKEAQARAK

SEQ ID NO: 1776103 - protein, 5 aa, Staphylococcus epidermidis
EAGNG

SEQ ID NO: 1776104 - protein, 8 aa, Staphylococcus epidermidis
EAGNRAAV

SEQ ID NO: 1776105 - protein, 7 aa, Staphylococcus epidermidis
EAGQSAV

SEQ ID NO: 1776106 - protein, 8 aa, Staphylococcus epidermidis
EAGRTNKP

SEQ ID NO: 1776107 - protein, 8 aa, Staphylococcus epidermidis
EAGSDIDS

SEQ ID NO: 1776108 - protein, 5 aa, Staphylococcus epidermidis
EAGVD

SEQ ID NO: 1776109 - protein, 8 aa, Staphylococcus epidermidis
EAGVQDDE

SEQ ID NO: 1776110 - protein, 4 aa, Staphylococcus epidermidis
EAGY

SEQ ID NO: 1776111 - protein, 7 aa, Staphylococcus epidermidis
EAHNTSI

SEQ ID NO: 1776112 - protein, 10 aa, Staphylococcus epidermidis
EAHRIQQEKG

SEQ ID NO: 1776113 - protein, 16 aa, Staphylococcus epidermidis
EAIDETGINPVAQPEV

SEQ ID NO: 1776114 - protein, 6 aa, Staphylococcus epidermidis
EAIDNT

SEQ ID NO: 1776115 - protein, 13 aa, Staphylococcus epidermidis
EAIDQSKATNMDE

SEQ ID NO: 1776116 - protein, 12 aa, Staphylococcus epidermidis
EAIDQSQATNID

SEQ ID NO: 1776117 - protein, 12 aa, Staphylococcus epidermidis
EAIDQSTATNME

SEQ ID NO: 1776118 - protein, 5 aa, Staphylococcus epidermidis
EAIDR

SEQ ID NO: 1776119 - protein, 16 aa, Staphylococcus epidermidis
EAIEETEISPVAQPEV

SEQ ID NO: 1776120 - protein, 9 aa, Staphylococcus epidermidis
EAIKNGASE

SEQ ID NO: 1776121 - protein, 11 aa, Staphylococcus epidermidis
EAINKTQNIGY

SEQ ID NO: 1776122 - protein, 12 aa, Staphylococcus epidermidis
EAINKTQNVGYQ

SEQ ID NO: 1776123 - protein, 4 aa, Staphylococcus epidermidis
EAIP

SEQ ID NO: 1776124 - protein, 4 aa, Staphylococcus epidermidis
EAIQ

SEQ ID NO: 1776125 - protein, 8 aa, Staphylococcus epidermidis
EAISKAND

SEQ ID NO: 1776126 - protein, 6 aa, Staphylococcus epidermidis
EAKDDG

SEQ ID NO: 1776127 - protein, 7 aa, Staphylococcus epidermidis
EAKEDVE

SEQ ID NO: 1776128 - protein, 8 aa, Staphylococcus epidermidis
EAKEKMKE

SEQ ID NO: 1776129 - protein, 10 aa, Staphylococcus epidermidis
EAKGRPSDNP

SEQ ID NO: 1776130 - protein, 8 aa, Staphylococcus epidermidis
EAKKRNSE

SEQ ID NO: 1776131 - protein, 13 aa, Staphylococcus epidermidis
EAKNLKKDSNIPT

SEQ ID NO: 1776132 - protein, 18 aa, Staphylococcus epidermidis
EAKPTTGSSGSQAGDSTI

SEQ ID NO: 1776133 - protein, 8 aa, Staphylococcus epidermidis
EAKQYSLN

SEQ ID NO: 1776134 - protein, 7 aa, Staphylococcus epidermidis
EAKRTKS

SEQ ID NO: 1776135 - protein, 5 aa, Staphylococcus epidermidis
EAKSM

SEQ ID NO: 1776136 - protein, 7 aa, Staphylococcus epidermidis
EALEAAA

SEQ ID NO: 1776137 - protein, 11 aa, Staphylococcus epidermidis
EALEDGKPVRS

SEQ ID NO: 1776138 - protein, 5 aa, Staphylococcus epidermidis
EALEQ

SEQ ID NO: 1776139 - protein, 7 aa, Staphylococcus epidermidis
EALGGAQ

SEQ ID NO: 1776140 - protein, 8 aa, Staphylococcus epidermidis
EALKKNNS

SEQ ID NO: 1776141 - protein, 6 aa, Staphylococcus epidermidis
EAMRRA

SEQ ID NO: 1776142 - protein, 5 aa, Staphylococcus epidermidis
EANEG

SEQ ID NO: 1776143 - protein, 13 aa, Staphylococcus epidermidis
EANGVNPDNAEEW

SEQ ID NO: 1776144 - protein, 19 aa, Staphylococcus epidermidis
EANGVTPNDAEEWVGEEKG

SEQ ID NO: 1776145 - protein, 36 aa, Staphylococcus epidermidis
EANGYDYASDTTSNEDTSRVPTQTVDTSAIGEGLNP

SEQ ID NO: 1776146 - protein, 9 aa, Staphylococcus epidermidis
EANHKPEPL

SEQ ID NO: 1776147 - protein, 10 aa, Staphylococcus epidermidis
EANKENLEKR

SEQ ID NO: 1776148 - protein, 42 aa, Staphylococcus epidermidis
EANKKDKVALDKSNQALKENNSELKKAENQYKRTNQRRNEAW

SEQ ID NO: 1776149 - protein, 11 aa, Staphylococcus epidermidis
EANREQQPIET

SEQ ID NO: 1776150 - protein, 5 aa, Staphylococcus epidermidis
EANSK

SEQ ID NO: 1776151 - protein, 7 aa, Staphylococcus epidermidis
EANSKDL

SEQ ID NO: 1776152 - protein, 9 aa, Staphylococcus epidermidis
EAPAGMRRK

SEQ ID NO: 1776153 - protein, 18 aa, Staphylococcus epidermidis
EAPPSQNKLNPYEVSGQE

SEQ ID NO: 1776154 - protein, 5 aa, Staphylococcus epidermidis
EAPQE

SEQ ID NO: 1776155 - protein, 7 aa, Staphylococcus epidermidis
EAPTSGD

SEQ ID NO: 1776156 - protein, 9 aa, Staphylococcus epidermidis
EAPTTPGTI

SEQ ID NO: 1776157 - protein, 11 aa, Staphylococcus epidermidis
EAPYSKKPIYV

SEQ ID NO: 1776158 - protein, 4 aa, Staphylococcus epidermidis
EAQA

SEQ ID NO: 1776159 - protein, 9 aa, Staphylococcus epidermidis
EAQETHDAL

SEQ ID NO: 1776160 - protein, 15 aa, Staphylococcus epidermidis
EAQLAEKEKITIKKA

SEQ ID NO: 1776161 - protein, 5 aa, Staphylococcus epidermidis
EAQPE

SEQ ID NO: 1776162 - protein, 7 aa, Staphylococcus epidermidis
EAQPEAI

SEQ ID NO: 1776163 - protein, 9 aa, Staphylococcus epidermidis
EAQQTHDAL

SEQ ID NO: 1776164 - protein, 19 aa, Staphylococcus epidermidis
EAQQTHDALSKQYQQYQNY

SEQ ID NO: 1776165 - protein, 4 aa, Staphylococcus epidermidis
EAQR

SEQ ID NO: 1776166 - protein, 4 aa, Staphylococcus epidermidis
EAQS

SEQ ID NO: 1776167 - protein, 9 aa, Staphylococcus epidermidis
EAREEGPFL

SEQ ID NO: 1776168 - protein, 15 aa, Staphylococcus epidermidis
EARGDKFDKEKAKQL

SEQ ID NO: 1776169 - protein, 13 aa, Staphylococcus epidermidis
EARIDSNGNRIIS

SEQ ID NO: 1776170 - protein, 6 aa, Staphylococcus epidermidis
EARISK

SEQ ID NO: 1776171 - protein, 10 aa, Staphylococcus epidermidis
EARKAQELGE

SEQ ID NO: 1776172 - protein, 6 aa, Staphylococcus epidermidis
EARQNG

SEQ ID NO: 1776173 - protein, 7 aa, Staphylococcus epidermidis
EARSAKL

SEQ ID NO: 1776174 - protein, 11 aa, Staphylococcus epidermidis
EARSHNDESIH

SEQ ID NO: 1776175 - protein, 9 aa, Staphylococcus epidermidis
EASDETLNQ

SEQ ID NO: 1776176 - protein, 9 aa, Staphylococcus epidermidis
EASDKTSNQ

SEQ ID NO: 1776177 - protein, 9 aa, Staphylococcus epidermidis
EASDSIEKH

SEQ ID NO: 1776178 - protein, 8 aa, Staphylococcus epidermidis
EASEALED

SEQ ID NO: 1776179 - protein, 16 aa, Staphylococcus epidermidis
EASENHKKRVQSSTLN

SEQ ID NO: 1776180 - protein, 29 aa, Staphylococcus epidermidis
EASETIQESIKARKQAIKDAKKKYDAKVD

SEQ ID NO: 1776181 - protein, 6 aa, Staphylococcus epidermidis
EASGEV

SEQ ID NO: 1776182 - protein, 5 aa, Staphylococcus epidermidis
EASIN

SEQ ID NO: 1776183 - protein, 10 aa, Staphylococcus epidermidis
EASKAVESGR

SEQ ID NO: 1776184 - protein, 13 aa, Staphylococcus epidermidis
EASLKEDEVEQLE

SEQ ID NO: 1776185 - protein, 10 aa, Staphylococcus epidermidis
EASNEVEGSI

SEQ ID NO: 1776186 - protein, 9 aa, Staphylococcus epidermidis
EASNGKEAY

SEQ ID NO: 1776187 - protein, 9 aa, Staphylococcus epidermidis
EASNKSELM

SEQ ID NO: 1776188 - protein, 6 aa, Staphylococcus epidermidis
EASQYV

SEQ ID NO: 1776189 - protein, 5 aa, Staphylococcus epidermidis
EASSL

SEQ ID NO: 1776190 - protein, 13 aa, Staphylococcus epidermidis
EASSLDENKNHME

SEQ ID NO: 1776191 - protein, 8 aa, Staphylococcus epidermidis
EATASEFE

SEQ ID NO: 1776192 - protein, 7 aa, Staphylococcus epidermidis
EATDEAV

SEQ ID NO: 1776193 - protein, 6 aa, Staphylococcus epidermidis
EATQQL

SEQ ID NO: 1776194 - protein, 9 aa, Staphylococcus epidermidis
EATVKGAYK

SEQ ID NO: 1776195 - protein, 5 aa, Staphylococcus epidermidis
EAVEA

SEQ ID NO: 1776196 - protein, 5 aa, Staphylococcus epidermidis
EAVQD

SEQ ID NO: 1776197 - protein, 13 aa, Staphylococcus epidermidis
EAYPQPDTRTELN

SEQ ID NO: 1776198 - protein, 14 aa, Staphylococcus epidermidis
EAYPSIKERGGGYQ

SEQ ID NO: 1776199 - protein, 8 aa, Staphylococcus epidermidis
EAYQKTVD

SEQ ID NO: 1776200 - protein, 8 aa, Staphylococcus epidermidis
EAYSLNDE

SEQ ID NO: 1776201 - protein, 9 aa, Staphylococcus epidermidis
EAYTGRPKK

SEQ ID NO: 1776202 - protein, 5 aa, Staphylococcus epidermidis
EAYTI

SEQ ID NO: 1776203 - protein, 21 aa, Staphylococcus epidermidis
ECEKRDPKGLYKKARDGEIPE

SEQ ID NO: 1776204 - protein, 4 aa, Staphylococcus epidermidis
ECPS

SEQ ID NO: 1776205 - protein, 16 aa, Staphylococcus epidermidis
ECSTQEEVVELVNQLA

SEQ ID NO: 1776206 - protein, 16 aa, Staphylococcus epidermidis
ECSTQEEVVGLVNQLA

SEQ ID NO: 1776207 - protein, 4 aa, Staphylococcus epidermidis
EDAE

SEQ ID NO: 1776208 - protein, 5 aa, Staphylococcus epidermidis
EDAEA

SEQ ID NO: 1776209 - protein, 9 aa, Staphylococcus epidermidis
EDAEAHDIK

SEQ ID NO: 1776210 - protein, 6 aa, Staphylococcus epidermidis
EDAESY

SEQ ID NO: 1776211 - protein, 8 aa, Staphylococcus epidermidis
EDAGIQPE

SEQ ID NO: 1776212 - protein, 11 aa, Staphylococcus epidermidis
EDAGTKDGENI

SEQ ID NO: 1776213 - protein, 9 aa, Staphylococcus epidermidis
EDAHDIDEN

SEQ ID NO: 1776214 - protein, 4 aa, Staphylococcus epidermidis
EDAK

SEQ ID NO: 1776215 - protein, 7 aa, Staphylococcus epidermidis
EDAKADI

SEQ ID NO: 1776216 - protein, 8 aa, Staphylococcus epidermidis
EDAPLNEC

SEQ ID NO: 1776217 - protein, 18 aa, Staphylococcus epidermidis
EDAPTKLSEIAKAFASQN

SEQ ID NO: 1776218 - protein, 13 aa, Staphylococcus epidermidis
EDAQDDINSLDED

SEQ ID NO: 1776219 - protein, 10 aa, Staphylococcus epidermidis
EDARDIDNEE

SEQ ID NO: 1776220 - protein, 8 aa, Staphylococcus epidermidis
EDASENKN

SEQ ID NO: 1776221 - protein, 6 aa, Staphylococcus epidermidis
EDASIK

SEQ ID NO: 1776222 - protein, 18 aa, Staphylococcus epidermidis
EDASIKSAIEEAHNNGKE

SEQ ID NO: 1776223 - protein, 10 aa, Staphylococcus epidermidis
EDASRADSKY

SEQ ID NO: 1776224 - protein, 6 aa, Staphylococcus epidermidis
EDASRR

SEQ ID NO: 1776225 - protein, 4 aa, Staphylococcus epidermidis
EDAV

SEQ ID NO: 1776226 - protein, 11 aa, Staphylococcus epidermidis
EDAYDTAKKKI

SEQ ID NO: 1776227 - protein, 10 aa, Staphylococcus epidermidis
EDAYDTEKKK

SEQ ID NO: 1776228 - protein, 10 aa, Staphylococcus epidermidis
EDCQKKTQAL

SEQ ID NO: 1776229 - protein, 19 aa, Staphylococcus epidermidis
EDDDKTVNEKRADLLREHI

SEQ ID NO: 1776230 - protein, 9 aa, Staphylococcus epidermidis
EDDDNPDYA

SEQ ID NO: 1776231 - protein, 5 aa, Staphylococcus epidermidis
EDDEL

SEQ ID NO: 1776232 - protein, 11 aa, Staphylococcus epidermidis
EDDGLAKSSRN

SEQ ID NO: 1776233 - protein, 6 aa, Staphylococcus epidermidis
EDDGPE

SEQ ID NO: 1776234 - protein, 34 aa, Staphylococcus epidermidis
EDDIDDDDDIPAETDDQETLNDPEDEDVEEEIND

SEQ ID NO: 1776235 - protein, 9 aa, Staphylococcus epidermidis
EDDKKQAIY

SEQ ID NO: 1776236 - protein, 6 aa, Staphylococcus epidermidis
EDDKPA

SEQ ID NO: 1776237 - protein, 8 aa, Staphylococcus epidermidis
EDDKQQRV

SEQ ID NO: 1776238 - protein, 12 aa, Staphylococcus epidermidis
EDDPDAESPKLS

SEQ ID NO: 1776239 - protein, 7 aa, Staphylococcus epidermidis
EDDPTIL

SEQ ID NO: 1776240 - protein, 7 aa, Staphylococcus epidermidis
EDDQINA

SEQ ID NO: 1776241 - protein, 6 aa, Staphylococcus epidermidis
EDDSDT

SEQ ID NO: 1776242 - protein, 10 aa, Staphylococcus epidermidis
EDDYNFDEKT

SEQ ID NO: 1776243 - protein, 7 aa, Staphylococcus epidermidis
EDDYSEA

SEQ ID NO: 1776244 - protein, 5 aa, Staphylococcus epidermidis
EDEAE

SEQ ID NO: 1776245 - protein, 12 aa, Staphylococcus epidermidis
EDEASKNDGLGA

SEQ ID NO: 1776246 - protein, 8 aa, Staphylococcus epidermidis
EDEAYREA

SEQ ID NO: 1776247 - protein, 4 aa, Staphylococcus epidermidis
EDED

SEQ ID NO: 1776248 - protein, 64 aa, Staphylococcus epidermidis
EDEDDPKYITEEEIKEANKKYEDKKTEVEASTNGTKKTEVKKGVATSKPKAAKPTIEIDDDDLP

SEQ ID NO: 1776249 - protein, 20 aa, Staphylococcus epidermidis
EDEEKAKIYKEARGKGGHVR

SEQ ID NO: 1776250 - protein, 5 aa, Staphylococcus epidermidis
EDEEQ

SEQ ID NO: 1776251 - protein, 8 aa, Staphylococcus epidermidis
EDEHSEAM

SEQ ID NO: 1776252 - protein, 20 aa, Staphylococcus epidermidis
EDEKEKVNDDLKGADTTRDD

SEQ ID NO: 1776253 - protein, 19 aa, Staphylococcus epidermidis
EDEKEKVSDDLKGADITRD

SEQ ID NO: 1776254 - protein, 4 aa, Staphylococcus epidermidis
EDEL

SEQ ID NO: 1776255 - protein, 6 aa, Staphylococcus epidermidis
EDELNP

SEQ ID NO: 1776256 - protein, 8 aa, Staphylococcus epidermidis
EDENASHR

SEQ ID NO: 1776257 - protein, 6 aa, Staphylococcus epidermidis
EDENDK

SEQ ID NO: 1776258 - protein, 6 aa, Staphylococcus epidermidis
EDENIG

SEQ ID NO: 1776259 - protein, 4 aa, Staphylococcus epidermidis
EDEP

SEQ ID NO: 1776260 - protein, 7 aa, Staphylococcus epidermidis
EDEPDID

SEQ ID NO: 1776261 - protein, 7 aa, Staphylococcus epidermidis
EDEQATK

SEQ ID NO: 1776262 - protein, 7 aa, Staphylococcus epidermidis
EDEQLDE

SEQ ID NO: 1776263 - protein, 20 aa, Staphylococcus epidermidis
EDEQPTFYDTEESANSIATT

SEQ ID NO: 1776264 - protein, 7 aa, Staphylococcus epidermidis
EDEREEI

SEQ ID NO: 1776265 - protein, 8 aa, Staphylococcus epidermidis
EDEREEIK

SEQ ID NO: 1776266 - protein, 16 aa, Staphylococcus epidermidis
EDEREQQAIVNAIELN

SEQ ID NO: 1776267 - protein, 7 aa, Staphylococcus epidermidis
EDERLKN

SEQ ID NO: 1776268 - protein, 16 aa, Staphylococcus epidermidis
EDERNPLYSSSYGTGQ

SEQ ID NO: 1776269 - protein, 8 aa, Staphylococcus epidermidis
EDESTQTA

SEQ ID NO: 1776270 - protein, 8 aa, Staphylococcus epidermidis
EDFEPGKN

SEQ ID NO: 1776271 - protein, 4 aa, Staphylococcus epidermidis
EDFH

SEQ ID NO: 1776272 - protein, 4 aa, Staphylococcus epidermidis
EDFN

SEQ ID NO: 1776273 - protein, 5 aa, Staphylococcus epidermidis
EDFQS

SEQ ID NO: 1776274 - protein, 5 aa, Staphylococcus epidermidis
EDFSD

SEQ ID NO: 1776275 - protein, 4 aa, Staphylococcus epidermidis
EDFT

SEQ ID NO: 1776276 - protein, 6 aa, Staphylococcus epidermidis
EDGELY

SEQ ID NO: 1776277 - protein, 8 aa, Staphylococcus epidermidis
EDGHASKN

SEQ ID NO: 1776278 - protein, 12 aa, Staphylococcus epidermidis
EDGKKVNNNKKF

SEQ ID NO: 1776279 - protein, 8 aa, Staphylococcus epidermidis
EDGKPINV

SEQ ID NO: 1776280 - protein, 8 aa, Staphylococcus epidermidis
EDGKTMQE

SEQ ID NO: 1776281 - protein, 5 aa, Staphylococcus epidermidis
EDGLN

SEQ ID NO: 1776282 - protein, 4 aa, Staphylococcus epidermidis
EDGN

SEQ ID NO: 1776283 - protein, 9 aa, Staphylococcus epidermidis
EDGNFDQSK

SEQ ID NO: 1776284 - protein, 6 aa, Staphylococcus epidermidis
EDGNQF

SEQ ID NO: 1776285 - protein, 6 aa, Staphylococcus epidermidis
EDGQRA

SEQ ID NO: 1776286 - protein, 8 aa, Staphylococcus epidermidis
EDGQTQAE

SEQ ID NO: 1776287 - protein, 8 aa, Staphylococcus epidermidis
EDGSDSAI

SEQ ID NO: 1776288 - protein, 5 aa, Staphylococcus epidermidis
EDGSI

SEQ ID NO: 1776289 - protein, 5 aa, Staphylococcus epidermidis
EDGTI

SEQ ID NO: 1776290 - protein, 5 aa, Staphylococcus epidermidis
EDHDF

SEQ ID NO: 1776291 - protein, 10 aa, Staphylococcus epidermidis
EDHDNELTKE

SEQ ID NO: 1776292 - protein, 43 aa, Staphylococcus epidermidis
EDHEETTTTHNSNVTQEQDSNHHEHQSQQQPQHQGIRKGPNIK

SEQ ID NO: 1776293 - protein, 5 aa, Staphylococcus epidermidis
EDHGA

SEQ ID NO: 1776294 - protein, 4 aa, Staphylococcus epidermidis
EDHQ

SEQ ID NO: 1776295 - protein, 16 aa, Staphylococcus epidermidis
EDIDGKKESKNDPELG

SEQ ID NO: 1776296 - protein, 4 aa, Staphylococcus epidermidis
EDIE

SEQ ID NO: 1776297 - protein, 7 aa, Staphylococcus epidermidis
EDIEEKE

SEQ ID NO: 1776298 - protein, 5 aa, Staphylococcus epidermidis
EDIEK

SEQ ID NO: 1776299 - protein, 13 aa, Staphylococcus epidermidis
EDIESASDNEDDN

SEQ ID NO: 1776300 - protein, 7 aa, Staphylococcus epidermidis
EDIGDEL

SEQ ID NO: 1776301 - protein, 6 aa, Staphylococcus epidermidis
EDIGEE

SEQ ID NO: 1776302 - protein, 4 aa, Staphylococcus epidermidis
EDII

SEQ ID NO: 1776303 - protein, 12 aa, Staphylococcus epidermidis
EDIIREKEKKLT

SEQ ID NO: 1776304 - protein, 16 aa, Staphylococcus epidermidis
EDIKRGTVQQKDSYGL

SEQ ID NO: 1776305 - protein, 5 aa, Staphylococcus epidermidis
EDIQM

SEQ ID NO: 1776306 - protein, 10 aa, Staphylococcus epidermidis
EDISDEDYDM

SEQ ID NO: 1776307 - protein, 8 aa, Staphylococcus epidermidis
EDISKNNK

SEQ ID NO: 1776308 - protein, 28 aa, Staphylococcus epidermidis
EDISNQKSKIAGLQQDKENSKKTSSNKL

SEQ ID NO: 1776309 - protein, 7 aa, Staphylococcus epidermidis
EDKDNSA

SEQ ID NO: 1776310 - protein, 7 aa, Staphylococcus epidermidis
EDKDSDV

SEQ ID NO: 1776311 - protein, 8 aa, Staphylococcus epidermidis
EDKEEDAS

SEQ ID NO: 1776312 - protein, 10 aa, Staphylococcus epidermidis
EDKEKTKEID

SEQ ID NO: 1776313 - protein, 11 aa, Staphylococcus epidermidis
EDKEKTKEIDA

SEQ ID NO: 1776314 - protein, 14 aa, Staphylococcus epidermidis
EDKGVGKIQTPGGM

SEQ ID NO: 1776315 - protein, 6 aa, Staphylococcus epidermidis
EDKIPL

SEQ ID NO: 1776316 - protein, 5 aa, Staphylococcus epidermidis
EDKKG

SEQ ID NO: 1776317 - protein, 13 aa, Staphylococcus epidermidis
EDKLEKFNDELND

SEQ ID NO: 1776318 - protein, 16 aa, Staphylococcus epidermidis
EDKNTPIDSTASPLDT

SEQ ID NO: 1776319 - protein, 14 aa, Staphylococcus epidermidis
EDKTSARDSHTGDH

SEQ ID NO: 1776320 - protein, 17 aa, Staphylococcus epidermidis
EDKYGYTHNKEKKYPVK

SEQ ID NO: 1776321 - protein, 8 aa, Staphylococcus epidermidis
EDLATRDA

SEQ ID NO: 1776322 - protein, 20 aa, Staphylococcus epidermidis
EDLDRKSNQIEVNGSDGVLQ

SEQ ID NO: 1776323 - protein, 18 aa, Staphylococcus epidermidis
EDLEKAKTRIKEATEATE

SEQ ID NO: 1776324 - protein, 5 aa, Staphylococcus epidermidis
EDLGD

SEQ ID NO: 1776325 - protein, 13 aa, Staphylococcus epidermidis
EDLKQGNKDRGYQ

SEQ ID NO: 1776326 - protein, 8 aa, Staphylococcus epidermidis
EDLNNPDI

SEQ ID NO: 1776327 - protein, 17 aa, Staphylococcus epidermidis
EDLSQDEIEELRNILNK

SEQ ID NO: 1776328 - protein, 6 aa, Staphylococcus epidermidis
EDLTRN

SEQ ID NO: 1776329 - protein, 7 aa, Staphylococcus epidermidis
EDNKKKL

SEQ ID NO: 1776330 - protein, 4 aa, Staphylococcus epidermidis
EDNM

SEQ ID NO: 1776331 - protein, 13 aa, Staphylococcus epidermidis
EDNNAQKIFEVEK

SEQ ID NO: 1776332 - protein, 7 aa, Staphylococcus epidermidis
EDNPKFL

SEQ ID NO: 1776333 - protein, 7 aa, Staphylococcus epidermidis
EDNQEYY

SEQ ID NO: 1776334 - protein, 7 aa, Staphylococcus epidermidis
EDNQRLT

SEQ ID NO: 1776335 - protein, 6 aa, Staphylococcus epidermidis
EDNQST

SEQ ID NO: 1776336 - protein, 5 aa, Staphylococcus epidermidis
EDNSD

SEQ ID NO: 1776337 - protein, 6 aa, Staphylococcus epidermidis
EDNTEW

SEQ ID NO: 1776338 - protein, 10 aa, Staphylococcus epidermidis
EDPDLRKNHP

SEQ ID NO: 1776339 - protein, 5 aa, Staphylococcus epidermidis
EDPEK

SEQ ID NO: 1776340 - protein, 6 aa, Staphylococcus epidermidis
EDPKNR

SEQ ID NO: 1776341 - protein, 5 aa, Staphylococcus epidermidis
EDPQL

SEQ ID NO: 1776342 - protein, 9 aa, Staphylococcus epidermidis
EDPSDDPNM

SEQ ID NO: 1776343 - protein, 9 aa, Staphylococcus epidermidis
EDPTDGLEE

SEQ ID NO: 1776344 - protein, 5 aa, Staphylococcus epidermidis
EDQEA

SEQ ID NO: 1776345 - protein, 7 aa, Staphylococcus epidermidis
EDQEEDL

SEQ ID NO: 1776346 - protein, 7 aa, Staphylococcus epidermidis
EDQFAKG

SEQ ID NO: 1776347 - protein, 4 aa, Staphylococcus epidermidis
EDQI

SEQ ID NO: 1776348 - protein, 11 aa, Staphylococcus epidermidis
EDQNKTERPSL

SEQ ID NO: 1776349 - protein, 10 aa, Staphylococcus epidermidis
EDRDTNIKSY

SEQ ID NO: 1776350 - protein, 5 aa, Staphylococcus epidermidis
EDREV

SEQ ID NO: 1776351 - protein, 8 aa, Staphylococcus epidermidis
EDRNIGEL

SEQ ID NO: 1776352 - protein, 17 aa, Staphylococcus epidermidis
EDRNRNNVPLTAPPDGL

SEQ ID NO: 1776353 - protein, 8 aa, Staphylococcus epidermidis
EDRTGPHF

SEQ ID NO: 1776354 - protein, 8 aa, Staphylococcus epidermidis
EDRVGKVS

SEQ ID NO: 1776355 - protein, 14 aa, Staphylococcus epidermidis
EDSALDQEAYDRAT

SEQ ID NO: 1776356 - protein, 6 aa, Staphylococcus epidermidis
EDSDQV

SEQ ID NO: 1776357 - protein, 34 aa, Staphylococcus epidermidis
EDSEEDNKEQNNNQSDNHSNNNNNDSNNNNNSLP

SEQ ID NO: 1776358 - protein, 17 aa, Staphylococcus epidermidis
EDSENSLIEKNLNDLFS

SEQ ID NO: 1776359 - protein, 30 aa, Staphylococcus epidermidis
EDSIQDKDQVKKSSNYINEDPNEQQAYDNA

SEQ ID NO: 1776360 - protein, 8 aa, Staphylococcus epidermidis
EDSKIKRE

SEQ ID NO: 1776361 - protein, 8 aa, Staphylococcus epidermidis
EDSKINRE

SEQ ID NO: 1776362 - protein, 9 aa, Staphylococcus epidermidis
EDSNQSVTD

SEQ ID NO: 1776363 - protein, 9 aa, Staphylococcus epidermidis
EDSQQAQED

SEQ ID NO: 1776364 - protein, 19 aa, Staphylococcus epidermidis
EDSSYTTGQVFGVTGGTQI

SEQ ID NO: 1776365 - protein, 10 aa, Staphylococcus epidermidis
EDSVDFTDNT

SEQ ID NO: 1776366 - protein, 11 aa, Staphylococcus epidermidis
EDSVDFTDNTR

SEQ ID NO: 1776367 - protein, 11 aa, Staphylococcus epidermidis
EDSVNSGRVKN

SEQ ID NO: 1776368 - protein, 8 aa, Staphylococcus epidermidis
EDTEITGN

SEQ ID NO: 1776369 - protein, 12 aa, Staphylococcus epidermidis
EDTEQLSSDIER

SEQ ID NO: 1776370 - protein, 5 aa, Staphylococcus epidermidis
EDTEV

SEQ ID NO: 1776371 - protein, 4 aa, Staphylococcus epidermidis
EDTI

SEQ ID NO: 1776372 - protein, 23 aa, Staphylococcus epidermidis
EDTLKQGTRCISTSNRNFEGRQG

SEQ ID NO: 1776373 - protein, 9 aa, Staphylococcus epidermidis
EDTLQPSKS

SEQ ID NO: 1776374 - protein, 5 aa, Staphylococcus epidermidis
EDTRA

SEQ ID NO: 1776375 - protein, 6 aa, Staphylococcus epidermidis
EDTSAT

SEQ ID NO: 1776376 - protein, 8 aa, Staphylococcus epidermidis
EDTTGIPK

SEQ ID NO: 1776377 - protein, 12 aa, Staphylococcus epidermidis
EDVEGNAVKITS

SEQ ID NO: 1776378 - protein, 13 aa, Staphylococcus epidermidis
EDVENVKPDPEPY

SEQ ID NO: 1776379 - protein, 7 aa, Staphylococcus epidermidis
EDVGTRS

SEQ ID NO: 1776380 - protein, 8 aa, Staphylococcus epidermidis
EDVGTYQD

SEQ ID NO: 1776381 - protein, 13 aa, Staphylococcus epidermidis
EDVKTNDSINSRS

SEQ ID NO: 1776382 - protein, 8 aa, Staphylococcus epidermidis
EDVSGTIE

SEQ ID NO: 1776383 - protein, 18 aa, Staphylococcus epidermidis
EDVTPKDFGRVGAQAAKQ

SEQ ID NO: 1776384 - protein, 4 aa, Staphylococcus epidermidis
EDYE

SEQ ID NO: 1776385 - protein, 10 aa, Staphylococcus epidermidis
EDYEKQEKKV

SEQ ID NO: 1776386 - protein, 9 aa, Staphylococcus epidermidis
EDYNSREQT

SEQ ID NO: 1776387 - protein, 6 aa, Staphylococcus epidermidis
EDYPTA

SEQ ID NO: 1776388 - protein, 9 aa, Staphylococcus epidermidis
EDYSPEELR

SEQ ID NO: 1776389 - protein, 5 aa, Staphylococcus epidermidis
EEADR

SEQ ID NO: 1776390 - protein, 11 aa, Staphylococcus epidermidis
EEAENKGNPIY

SEQ ID NO: 1776391 - protein, 5 aa, Staphylococcus epidermidis
EEAGA

SEQ ID NO: 1776392 - protein, 4 aa, Staphylococcus epidermidis
EEAI

SEQ ID NO: 1776393 - protein, 20 aa, Staphylococcus epidermidis
EEAKEKANQRVKSATKEADE

SEQ ID NO: 1776394 - protein, 8 aa, Staphylococcus epidermidis
EEAKENPD

SEQ ID NO: 1776395 - protein, 11 aa, Staphylococcus epidermidis
EEAKEQADEGK

SEQ ID NO: 1776396 - protein, 6 aa, Staphylococcus epidermidis
EEAKQQ

SEQ ID NO: 1776397 - protein, 6 aa, Staphylococcus epidermidis
EEALST

SEQ ID NO: 1776398 - protein, 8 aa, Staphylococcus epidermidis
EEAPKDIE

SEQ ID NO: 1776399 - protein, 23 aa, Staphylococcus epidermidis
EEAPSPILSEEKRQEMGNAAVRA

SEQ ID NO: 1776400 - protein, 7 aa, Staphylococcus epidermidis
EEAQERR

SEQ ID NO: 1776401 - protein, 21 aa, Staphylococcus epidermidis
EEAQNALNGQAKFDQAQKEAL

SEQ ID NO: 1776402 - protein, 9 aa, Staphylococcus epidermidis
EEAVDPDDV

SEQ ID NO: 1776403 - protein, 13 aa, Staphylococcus epidermidis
EEAVEKAKELDSD

SEQ ID NO: 1776404 - protein, 12 aa, Staphylococcus epidermidis
EECTKAQKEEIK

SEQ ID NO: 1776405 - protein, 8 aa, Staphylococcus epidermidis
EEDAEKAV

SEQ ID NO: 1776406 - protein, 9 aa, Staphylococcus epidermidis
EEDALKDGT

SEQ ID NO: 1776407 - protein, 7 aa, Staphylococcus epidermidis
EEDDNEI

SEQ ID NO: 1776408 - protein, 23 aa, Staphylococcus epidermidis
EEDEDDDMAEEEEEEFEDEEDFN

SEQ ID NO: 1776409 - protein, 17 aa, Staphylococcus epidermidis
EEDEEQYYNNERDAEQA

SEQ ID NO: 1776410 - protein, 11 aa, Staphylococcus epidermidis
EEDGESIGQHP

SEQ ID NO: 1776411 - protein, 7 aa, Staphylococcus epidermidis
EEDGTTQ

SEQ ID NO: 1776412 - protein, 7 aa, Staphylococcus epidermidis
EEDIEEP

SEQ ID NO: 1776413 - protein, 10 aa, Staphylococcus epidermidis
EEDNKDGMIK

SEQ ID NO: 1776414 - protein, 11 aa, Staphylococcus epidermidis
EEDNSFSSKFK

SEQ ID NO: 1776415 - protein, 9 aa, Staphylococcus epidermidis
EEDPDNESL

SEQ ID NO: 1776416 - protein, 19 aa, Staphylococcus epidermidis
EEDQLDVDNSQYKEIKGVK

SEQ ID NO: 1776417 - protein, 7 aa, Staphylococcus epidermidis
EEDYEKV

SEQ ID NO: 1776418 - protein, 4 aa, Staphylococcus epidermidis
EEEG

SEQ ID NO: 1776419 - protein, 5 aa, Staphylococcus epidermidis
EEEGF

SEQ ID NO: 1776420 - protein, 8 aa, Staphylococcus epidermidis
EEEGKKNK

SEQ ID NO: 1776421 - protein, 12 aa, Staphylococcus epidermidis
EEEGVEGSKDAR

SEQ ID NO: 1776422 - protein, 5 aa, Staphylococcus epidermidis
EEELA

SEQ ID NO: 1776423 - protein, 5 aa, Staphylococcus epidermidis
EEELR

SEQ ID NO: 1776424 - protein, 4 aa, Staphylococcus epidermidis
EEEM

SEQ ID NO: 1776425 - protein, 6 aa, Staphylococcus epidermidis
EEEQED

SEQ ID NO: 1776426 - protein, 5 aa, Staphylococcus epidermidis
EEEQG

SEQ ID NO: 1776427 - protein, 7 aa, Staphylococcus epidermidis
EEERESM

SEQ ID NO: 1776428 - protein, 5 aa, Staphylococcus epidermidis
EEERR

SEQ ID NO: 1776429 - protein, 45 aa, Staphylococcus epidermidis
EEEVEAPEERESARSRERAQDRDVESRNENTTPAQTQNNISRQNA

SEQ ID NO: 1776430 - protein, 57 aa, Staphylococcus epidermidis
EEEVNSKESEDNQTFENNEESVDHTDKNEVKDNQLQDDSEETDQQEDVDPKDEKIQE

SEQ ID NO: 1776431 - protein, 16 aa, Staphylococcus epidermidis
EEEWGKLERRTKNKYK

SEQ ID NO: 1776432 - protein, 12 aa, Staphylococcus epidermidis
EEEYNENIRLNY

SEQ ID NO: 1776433 - protein, 5 aa, Staphylococcus epidermidis
EEFEN

SEQ ID NO: 1776434 - protein, 5 aa, Staphylococcus epidermidis
EEFNQ

SEQ ID NO: 1776435 - protein, 18 aa, Staphylococcus epidermidis
EEFSSESERGEQGFGSTG

SEQ ID NO: 1776436 - protein, 18 aa, Staphylococcus epidermidis
EEFSSESERGTDGFGSTG

SEQ ID NO: 1776437 - protein, 4 aa, Staphylococcus epidermidis
EEGD

SEQ ID NO: 1776438 - protein, 8 aa, Staphylococcus epidermidis
EEGDEEYE

SEQ ID NO: 1776439 - protein, 52 aa, Staphylococcus epidermidis
EEGEAIDKDEDDLASEKVKEDNEHEKETQEVKDTSQQSSDNEDNSPKSASRE

SEQ ID NO: 1776440 - protein, 6 aa, Staphylococcus epidermidis
EEGEEI

SEQ ID NO: 1776441 - protein, 4 aa, Staphylococcus epidermidis
EEGG

SEQ ID NO: 1776442 - protein, 5 aa, Staphylococcus epidermidis
EEGGV

SEQ ID NO: 1776443 - protein, 7 aa, Staphylococcus epidermidis
EEGIPTD

SEQ ID NO: 1776444 - protein, 13 aa, Staphylococcus epidermidis
EEGKAKKSDEYKS

SEQ ID NO: 1776445 - protein, 7 aa, Staphylococcus epidermidis
EEGKIER

SEQ ID NO: 1776446 - protein, 9 aa, Staphylococcus epidermidis
EEGKRIPNL

SEQ ID NO: 1776447 - protein, 9 aa, Staphylococcus epidermidis
EEGKSLGAK

SEQ ID NO: 1776448 - protein, 6 aa, Staphylococcus epidermidis
EEGMTQ

SEQ ID NO: 1776449 - protein, 11 aa, Staphylococcus epidermidis
EEGNYSSITSD

SEQ ID NO: 1776450 - protein, 14 aa, Staphylococcus epidermidis
EEGQLHRLMSADID

SEQ ID NO: 1776451 - protein, 5 aa, Staphylococcus epidermidis
EEGSV

SEQ ID NO: 1776452 - protein, 5 aa, Staphylococcus epidermidis
EEGVS

SEQ ID NO: 1776453 - protein, 5 aa, Staphylococcus epidermidis
EEHDE

SEQ ID NO: 1776454 - protein, 4 aa, Staphylococcus epidermidis
EEHT

SEQ ID NO: 1776455 - protein, 6 aa, Staphylococcus epidermidis
EEIDST

SEQ ID NO: 1776456 - protein, 6 aa, Staphylococcus epidermidis
EEIESQ

SEQ ID NO: 1776457 - protein, 13 aa, Staphylococcus epidermidis
EEIGYGANATISD

SEQ ID NO: 1776458 - protein, 44 aa, Staphylococcus epidermidis; identical to SEQ ID NO: 1727595

SEQ ID NO: 1776459 - protein, 5 aa, Staphylococcus epidermidis
EEINR

SEQ ID NO: 1776460 - protein, 13 aa, Staphylococcus epidermidis
EEIREKTKAFQKE

SEQ ID NO: 1776461 - protein, 4 aa, Staphylococcus epidermidis
EEIT

SEQ ID NO: 1776462 - protein, 5 aa, Staphylococcus epidermidis
EEITA

SEQ ID NO: 1776463 - protein, 18 aa, Staphylococcus epidermidis
EEKAAKNGKLSKSETKEL

SEQ ID NO: 1776464 - protein, 4 aa, Staphylococcus epidermidis
EEKD

SEQ ID NO: 1776465 - protein, 12 aa, Staphylococcus epidermidis
EEKDAKVSYEDR

SEQ ID NO: 1776466 - protein, 5 aa, Staphylococcus epidermidis
EEKDC

SEQ ID NO: 1776467 - protein, 11 aa, Staphylococcus epidermidis
EEKEIEESIRT

SEQ ID NO: 1776468 - protein, 15 aa, Staphylococcus epidermidis
EEKEYNTSKNDYSDI

SEQ ID NO: 1776469 - protein, 14 aa, Staphylococcus epidermidis
EEKEYNTSKNDYSH

SEQ ID NO: 1776470 - protein, 7 aa, Staphylococcus epidermidis
EEKGLTK

SEQ ID NO: 1776471 - protein, 19 aa, Staphylococcus epidermidis
EEKKEKNEKEQLDNNNCCN

SEQ ID NO: 1776472 - protein, 11 aa, Staphylococcus epidermidis
EEKLDTSRSLE

SEQ ID NO: 1776473 - protein, 5 aa, Staphylococcus epidermidis
EEKLT

SEQ ID NO: 1776474 - protein, 11 aa, Staphylococcus epidermidis
EEKNNDDIQPY

SEQ ID NO: 1776475 - protein, 6 aa, Staphylococcus epidermidis
EEKNQA

SEQ ID NO: 1776476 - protein, 24 aa, Staphylococcus epidermidis
EEKNYGYSPQETTKNVKKLKRYRN

SEQ ID NO: 1776477 - protein, 6 aa, Staphylococcus epidermidis
EEKQCP

SEQ ID NO: 1776478 - protein, 16 aa, Staphylococcus epidermidis
EEKRQEHIEQTKENPL

SEQ ID NO: 1776479 - protein, 7 aa, Staphylococcus epidermidis
EEKSIPD

SEQ ID NO: 1776480 - protein, 21 aa, Staphylococcus epidermidis
EEKTDKKDENNEKKENGNKNC

SEQ ID NO: 1776481 - protein, 23 aa, Staphylococcus epidermidis
EEKVEHQGGETPMGRRGQPAELA

SEQ ID NO: 1776482 - protein, 5 aa, Staphylococcus epidermidis
EEKVK

SEQ ID NO: 1776483 - protein, 14 aa, Staphylococcus epidermidis
EEKVVPGNTDIANY

SEQ ID NO: 1776484 - protein, 5 aa, Staphylococcus epidermidis
EELES

SEQ ID NO: 1776485 - protein, 6 aa, Staphylococcus epidermidis
EELGDG

SEQ ID NO: 1776486 - protein, 9 aa, Staphylococcus epidermidis
EELGDKNGL

SEQ ID NO: 1776487 - protein, 5 aa, Staphylococcus epidermidis
EELGF

SEQ ID NO: 1776488 - protein, 7 aa, Staphylococcus epidermidis
EELHSEQ

SEQ ID NO: 1776489 - protein, 19 aa, Staphylococcus epidermidis
EELQRKKIRDTNVGKELQD

SEQ ID NO: 1776490 - protein, 12 aa, Staphylococcus epidermidis
EELRDEVEYGGV

SEQ ID NO: 1776491 - protein, 57 aa, Staphylococcus epidermidis
EELSNEKEKQASLKSRVEQEKEKIAKVQEKRAELDSSRQALEDAQTEGNLEKAAELQ

SEQ ID NO: 1776492 - protein, 57 aa, Staphylococcus epidermidis
EELSNEKEKQASLQSRVEQEKEKIGKLQQKRAELDESRKALEDAQTNNNLEKAAELQ

SEQ ID NO: 1776493 - protein, 4 aa, Staphylococcus epidermidis
EEMD

SEQ ID NO: 1776494 - protein, 19 aa, Staphylococcus epidermidis
EEMEQAGSAQLYEKGYADD

SEQ ID NO: 1776495 - protein, 21 aa, Staphylococcus epidermidis
EEMPEDFQPQVATSQLREKYQ

SEQ ID NO: 1776496 - protein, 11 aa, Staphylococcus epidermidis
EEMPPGGAQGM

SEQ ID NO: 1776497 - protein, 11 aa, Staphylococcus epidermidis
EENESEEDREI

SEQ ID NO: 1776498 - protein, 9 aa, Staphylococcus epidermidis
EENETESVS

SEQ ID NO: 1776499 - protein, 12 aa, Staphylococcus epidermidis
EENETYSVKGYK

SEQ ID NO: 1776500 - protein, 12 aa, Staphylococcus epidermidis
EENGTEHEGELD

SEQ ID NO: 1776501 - protein, 11 aa, Staphylococcus epidermidis
EENHTDAQELY

SEQ ID NO: 1776502 - protein, 7 aa, Staphylococcus epidermidis
EENKTVN

SEQ ID NO: 1776503 - protein, 7 aa, Staphylococcus epidermidis
EENNGHR

SEQ ID NO: 1776504 - protein, 7 aa, Staphylococcus epidermidis
EENNYTL

SEQ ID NO: 1776505 - protein, 8 aa, Staphylococcus epidermidis
EENPDAVE

SEQ ID NO: 1776506 - protein, 6 aa, Staphylococcus epidermidis
EENPLS

SEQ ID NO: 1776507 - protein, 8 aa, Staphylococcus epidermidis
EENQGDYK

SEQ ID NO: 1776508 - protein, 17 aa, Staphylococcus epidermidis
EENRRLQQEINQLKQSE

SEQ ID NO: 1776509 - protein, 7 aa, Staphylococcus epidermidis
EENSEIT

SEQ ID NO: 1776510 - protein, 13 aa, Staphylococcus epidermidis
EENSGSPSQPRNV

SEQ ID NO: 1776511 - protein, 7 aa, Staphylococcus epidermidis
EENSKQH

SEQ ID NO: 1776512 - protein, 5 aa, Staphylococcus epidermidis
EENSV

SEQ ID NO: 1776513 - protein, 6 aa, Staphylococcus epidermidis
EENTET

SEQ ID NO: 1776514 - protein, 8 aa, Staphylococcus epidermidis
EENTPQLV

SEQ ID NO: 1776515 - protein, 56 aa, Staphylococcus epidermidis
EENTVQDVKDSNMDDELSDSNDQSSNEEKNDVINNSQSINTDDDNQIKKEETNSNV

SEQ ID NO: 1776516 - protein, 7 aa, Staphylococcus epidermidis
EENYEGK

SEQ ID NO: 1776517 - protein, 6 aa, Staphylococcus epidermidis
EEPNYK

SEQ ID NO: 1776518 - protein, 4 aa, Staphylococcus epidermidis
EEPP

SEQ ID NO: 1776519 - protein, 9 aa, Staphylococcus epidermidis
EEPPISVKD

SEQ ID NO: 1776520 - protein, 6 aa, Staphylococcus epidermidis
EEPYYR

SEQ ID NO: 1776521 - protein, 8 aa, Staphylococcus epidermidis
EEQEASPK

SEQ ID NO: 1776522 - protein, 11 aa, Staphylococcus epidermidis
EEQGTMSQEDY

SEQ ID NO: 1776523 - protein, 10 aa, Staphylococcus epidermidis
EEQLEEHKQD

SEQ ID NO: 1776524 - protein, 5 aa, Staphylococcus epidermidis
EEQPV

SEQ ID NO: 1776525 - protein, 5 aa, Staphylococcus epidermidis
EEQVQ

SEQ ID NO: 1776526 - protein, 6 aa, Staphylococcus epidermidis
EEQYGR

SEQ ID NO: 1776527 - protein, 16 aa, Staphylococcus epidermidis
EERAERRQKENELRGI

SEQ ID NO: 1776528 - protein, 19 aa, Staphylococcus epidermidis
EERAPLKRNVDQEEVGKTA

SEQ ID NO: 1776529 - protein, 5 aa, Staphylococcus epidermidis
EERGE

SEQ ID NO: 1776530 - protein, 10 aa, Staphylococcus epidermidis
EERKFPNIEE

SEQ ID NO: 1776531 - protein, 5 aa, Staphylococcus epidermidis
EERKH

SEQ ID NO: 1776532 - protein, 6 aa, Staphylococcus epidermidis
EERPLT

SEQ ID NO: 1776533 - protein, 6 aa, Staphylococcus epidermidis
EERPTP

SEQ ID NO: 1776534 - protein, 8 aa, Staphylococcus epidermidis
EERQPING

SEQ ID NO: 1776535 - protein, 23 aa, Staphylococcus epidermidis
EERVNASKSLNGPKASFDGNKEE

SEQ ID NO: 1776536 - protein, 7 aa, Staphylococcus epidermidis
EESAKAG

SEQ ID NO: 1776537 - protein, 10 aa, Staphylococcus epidermidis
EESDADAQLS

SEQ ID NO: 1776538 - protein, 18 aa, Staphylococcus epidermidis
EESEDSFEDIAEDLIDFD

SEQ ID NO: 1776539 - protein, 8 aa, Staphylococcus epidermidis
EESEGKSI

SEQ ID NO: 1776540 - protein, 5 aa, Staphylococcus epidermidis
EESER

SEQ ID NO: 1776541 - protein, 15 aa, Staphylococcus epidermidis
EESEVAKEKDGTSIS

SEQ ID NO: 1776542 - protein, 13 aa, Staphylococcus epidermidis
EESHANNKKRNEL

SEQ ID NO: 1776543 - protein, 4 aa, Staphylococcus epidermidis
EESI

SEQ ID NO: 1776544 - protein, 6 aa, Staphylococcus epidermidis
EESKTD

SEQ ID NO: 1776545 - protein, 26 aa, Staphylococcus epidermidis
EESKTDVLHGKQGHSLTNEREDKLSS

SEQ ID NO: 1776546 - protein, 5 aa, Staphylococcus epidermidis
EESLT

SEQ ID NO: 1776547 - protein, 6 aa, Staphylococcus epidermidis
EESLTT

SEQ ID NO: 1776548 - protein, 9 aa, Staphylococcus epidermidis
EESNLTTAE

SEQ ID NO: 1776549 - protein, 8 aa, Staphylococcus epidermidis
EESPGEHN

SEQ ID NO: 1776550 - protein, 9 aa, Staphylococcus epidermidis
EESQQVQED

SEQ ID NO: 1776551 - protein, 10 aa, Staphylococcus epidermidis
EESQVEDDFE

SEQ ID NO: 1776552 - protein, 6 aa, Staphylococcus epidermidis
EESRHG

SEQ ID NO: 1776553 - protein, 8 aa, Staphylococcus epidermidis
EESSDDWD

SEQ ID NO: 1776554 - protein, 14 aa, Staphylococcus epidermidis
EESTALKNELPDME

SEQ ID NO: 1776555 - protein, 8 aa, Staphylococcus epidermidis
EESTINAD

SEQ ID NO: 1776556 - protein, 6 aa, Staphylococcus epidermidis
EESVQR

SEQ ID NO: 1776557 - protein, 5 aa, Staphylococcus epidermidis
EESYS

SEQ ID NO: 1776558 - protein, 6 aa, Staphylococcus epidermidis
EETEAK

SEQ ID NO: 1776559 - protein, 11 aa, Staphylococcus epidermidis
EETGKEKFKTA

SEQ ID NO: 1776560 - protein, 8 aa, Staphylococcus epidermidis
EETGTTFE

SEQ ID NO: 1776561 - protein, 7 aa, Staphylococcus epidermidis
EETIKPR

SEQ ID NO: 1776562 - protein, 11 aa, Staphylococcus epidermidis
EETINEAKEDK

SEQ ID NO: 1776563 - protein, 29 aa, Staphylococcus epidermidis
EETNLTSTELAAENDEDKKDKTEEDNDTE

SEQ ID NO: 1776564 - protein, 29 aa, Staphylococcus epidermidis
EETNLTSTELAAETDEEKTAKTEEDNDTE

SEQ ID NO: 1776565 - protein, 5 aa, Staphylococcus epidermidis
EETNP

SEQ ID NO: 1776566 - protein, 7 aa, Staphylococcus epidermidis
EETQSKS

SEQ ID NO: 1776567 - protein, 9 aa, Staphylococcus epidermidis
EETSANRRV

SEQ ID NO: 1776568 - protein, 6 aa, Staphylococcus epidermidis
EETYEH

SEQ ID NO: 1776569 - protein, 13 aa, Staphylococcus epidermidis
EEVDNENKPDGEL

SEQ ID NO: 1776570 - protein, 4 aa, Staphylococcus epidermidis
EEVE

SEQ ID NO: 1776571 - protein, 10 aa, Staphylococcus epidermidis
EEVESVEAGE

SEQ ID NO: 1776572 - protein, 18 aa, Staphylococcus epidermidis
EEVGEAGTKRACEIGPRG

SEQ ID NO: 1776573 - protein, 5 aa, Staphylococcus epidermidis
EEVKN

SEQ ID NO: 1776574 - protein, 12 aa, Staphylococcus epidermidis
EEVNANDVEGGN

SEQ ID NO: 1776575 - protein, 7 aa, Staphylococcus epidermidis
EEVNEDN

SEQ ID NO: 1776576 - protein, 4 aa, Staphylococcus epidermidis
EEVP

SEQ ID NO: 1776577 - protein, 8 aa, Staphylococcus epidermidis
EEVQGEKV

SEQ ID NO: 1776578 - protein, 14 aa, Staphylococcus epidermidis
EEVQTAKEKSENLY

SEQ ID NO: 1776579 - protein, 11 aa, Staphylococcus epidermidis
EEYDEDMKAEL

SEQ ID NO: 1776580 - protein, 15 aa, Staphylococcus epidermidis
EEYDEDMKKELEEEV

SEQ ID NO: 1776581 - protein, 7 aa, Staphylococcus epidermidis
EEYGGTP

SEQ ID NO: 1776582 - protein, 5 aa, Staphylococcus epidermidis
EEYGK

SEQ ID NO: 1776583 - protein, 13 aa, Staphylococcus epidermidis
EEYKEDGSVVIHL

SEQ ID NO: 1776584 - protein, 5 aa, Staphylococcus epidermidis
EEYLN

SEQ ID NO: 1776585 - protein, 12 aa, Staphylococcus epidermidis
EEYLTDSSIKSR

SEQ ID NO: 1776586 - protein, 12 aa, Staphylococcus epidermidis
EEYQRDTAREAR

SEQ ID NO: 1776587 - protein, 4 aa, Staphylococcus epidermidis
EFAQ

SEQ ID NO: 1776588 - protein, 4 aa, Staphylococcus epidermidis
EFEG

SEQ ID NO: 1776589 - protein, 4 aa, Staphylococcus epidermidis
EFEP

SEQ ID NO: 1776590 - protein, 13 aa, Staphylococcus epidermidis
EFEPKMEEEQRTK

SEQ ID NO: 1776591 - protein, 5 aa, Staphylococcus epidermidis
EFEPQ

SEQ ID NO: 1776592 - protein, 8 aa, Staphylococcus epidermidis
EFESTTPY

SEQ ID NO: 1776593 - protein, 4 aa, Staphylococcus epidermidis
EFGE

SEQ ID NO: 1776594 - protein, 14 aa, Staphylococcus epidermidis
EFGKEGNEGEVPFK

SEQ ID NO: 1776595 - protein, 6 aa, Staphylococcus epidermidis
EFGKNQ

SEQ ID NO: 1776596 - protein, 14 aa, Staphylococcus epidermidis
EFGNEGNEGEVPFK

SEQ ID NO: 1776597 - protein, 6 aa, Staphylococcus epidermidis
EFGPDL

SEQ ID NO: 1776598 - protein, 4 aa, Staphylococcus epidermidis
EFGQ

SEQ ID NO: 1776599 - protein, 6 aa, Staphylococcus epidermidis
EFGQSG

SEQ ID NO: 1776600 - protein, 11 aa, Staphylococcus epidermidis
EFGTRGLYGSP

SEQ ID NO: 1776601 - protein, 4 aa, Staphylococcus epidermidis
EFIR

SEQ ID NO: 1776602 - protein, 19 aa, Staphylococcus epidermidis
EFKDDKYSNLGNPGRPNFD

SEQ ID NO: 1776603 - protein, 8 aa, Staphylococcus epidermidis
EFKEQGKI

SEQ ID NO: 1776604 - protein, 12 aa, Staphylococcus epidermidis
EFKTTPEWILYG

SEQ ID NO: 1776605 - protein, 17 aa, Staphylococcus epidermidis
EFNEKAKTKDGKPLALG

SEQ ID NO: 1776606 - protein, 17 aa, Staphylococcus epidermidis
EFNTKEKVLSDGTDELS

SEQ ID NO: 1776607 - protein, 10 aa, Staphylococcus epidermidis
EFPTRHNEEL

SEQ ID NO: 1776608 - protein, 12 aa, Staphylococcus epidermidis
EFQQSADSINDA

SEQ ID NO: 1776609 - protein, 8 aa, Staphylococcus epidermidis
EFRERRQQ

SEQ ID NO: 1776610 - protein, 7 aa, Staphylococcus epidermidis
EFRERRR

SEQ ID NO: 1776611 - protein, 25 aa, Staphylococcus epidermidis
EFRPDNQPEKERLSNINDKVKSDLD

SEQ ID NO: 1776612 - protein, 7 aa, Staphylococcus epidermidis
EFSDEDI

SEQ ID NO: 1776613 - protein, 5 aa, Staphylococcus epidermidis
EFSPS

SEQ ID NO: 1776614 - protein, 16 aa, Staphylococcus epidermidis
EFTGEQKYNDATTAYR

SEQ ID NO: 1776615 - protein, 6 aa, Staphylococcus epidermidis
EFTGKE

SEQ ID NO: 1776616 - protein, 5 aa, Staphylococcus epidermidis
EFTSK

SEQ ID NO: 1776617 - protein, 5 aa, Staphylococcus epidermidis
EFVND

SEQ ID NO: 1776618 - protein, 12 aa, Staphylococcus epidermidis
EGAADKYTRKDM

SEQ ID NO: 1776619 - protein, 4 aa, Staphylococcus epidermidis
EGAK

SEQ ID NO: 1776620 - protein, 25 aa, Staphylococcus epidermidis
EGAPHTMAGTQNRNITNQTKNDAGV

SEQ ID NO: 1776621 - protein, 9 aa, Staphylococcus epidermidis
EGAQSDEDD

SEQ ID NO: 1776622 - protein, 8 aa, Staphylococcus epidermidis
EGASEGVG

SEQ ID NO: 1776623 - protein, 5 aa, Staphylococcus epidermidis
EGASF

SEQ ID NO: 1776624 - protein, 13 aa, Staphylococcus epidermidis
EGDAKNKEDLEKA

SEQ ID NO: 1776625 - protein, 7 aa, Staphylococcus epidermidis
EGDARDV

SEQ ID NO: 1776626 - protein, 12 aa, Staphylococcus epidermidis
EGDEEDKQRALD

SEQ ID NO: 1776627 - protein, 5 aa, Staphylococcus epidermidis
EGDES

SEQ ID NO: 1776628 - protein, 12 aa, Staphylococcus epidermidis
EGDGPKDYTDNS

SEQ ID NO: 1776629 - protein, 7 aa, Staphylococcus epidermidis
EGDGVGG

SEQ ID NO: 1776630 - protein, 8 aa, Staphylococcus epidermidis
EGDISSPY

SEQ ID NO: 1776631 - protein, 7 aa, Staphylococcus epidermidis
EGDPVPV

SEQ ID NO: 1776632 - protein, 9 aa, Staphylococcus epidermidis
EGDQVPPQQ

SEQ ID NO: 1776633 - protein, 17 aa, Staphylococcus epidermidis
EGDTESDNYITEIWMPI

SEQ ID NO: 1776634 - protein, 4 aa, Staphylococcus epidermidis
EGDV

SEQ ID NO: 1776635 - protein, 7 aa, Staphylococcus epidermidis
EGDYTED

SEQ ID NO: 1776636 - protein, 6 aa, Staphylococcus epidermidis
EGEAPD

SEQ ID NO: 1776637 - protein, 22 aa, Staphylococcus epidermidis
EGEASEAAQTNVTKLKSKNIDM

SEQ ID NO: 1776638 - protein, 6 aa, Staphylococcus epidermidis
EGEDVN

SEQ ID NO: 1776639 - protein, 5 aa, Staphylococcus epidermidis
EGEEI

SEQ ID NO: 1776640 - protein, 6 aa, Staphylococcus epidermidis
EGEEIA

SEQ ID NO: 1776641 - protein, 6 aa, Staphylococcus epidermidis
EGEERE

SEQ ID NO: 1776642 - protein, 6 aa, Staphylococcus epidermidis
EGEKSH

SEQ ID NO: 1776643 - protein, 5 aa, Staphylococcus epidermidis
EGELN

SEQ ID NO: 1776644 - protein, 8 aa, Staphylococcus epidermidis
EGELTDEE

SEQ ID NO: 1776645 - protein, 10 aa, Staphylococcus epidermidis
EGENKEEVCK

SEQ ID NO: 1776646 - protein, 13 aa, Staphylococcus epidermidis
EGERGEQASNVVK

SEQ ID NO: 1776647 - protein, 7 aa, Staphylococcus epidermidis
EGESLTA

SEQ ID NO: 1776648 - protein, 6 aa, Staphylococcus epidermidis
EGETVN

SEQ ID NO: 1776649 - protein, 5 aa, Staphylococcus epidermidis
EGEVI

SEQ ID NO: 1776650 - protein, 18 aa, Staphylococcus epidermidis
EGEWKKKENITEEIKNTD

SEQ ID NO: 1776651 - protein, 9 aa, Staphylococcus epidermidis
EGEYVTPQD

SEQ ID NO: 1776652 - protein, 12 aa, Staphylococcus epidermidis
EGFKEKKAALPD

SEQ ID NO: 1776653 - protein, 6 aa, Staphylococcus epidermidis
EGFSEE

SEQ ID NO: 1776654 - protein, 4 aa, Staphylococcus epidermidis
EGGE

SEQ ID NO: 1776655 - protein, 8 aa, Staphylococcus epidermidis
EGGLSDKE

SEQ ID NO: 1776656 - protein, 7 aa, Staphylococcus epidermidis
EGGLSDS

SEQ ID NO: 1776657 - protein, 6 aa, Staphylococcus epidermidis
EGGNQL

SEQ ID NO: 1776658 - protein, 15 aa, Staphylococcus epidermidis
EGGRTVGSGVVTEIF

SEQ ID NO: 1776659 - protein, 8 aa, Staphylococcus epidermidis
EGGSGGAL

SEQ ID NO: 1776660 - protein, 9 aa, Staphylococcus epidermidis
EGGSGGALG

SEQ ID NO: 1776661 - protein, 5 aa, Staphylococcus epidermidis
EGHIY

SEQ ID NO: 1776662 - protein, 4 aa, Staphylococcus epidermidis
EGID

SEQ ID NO: 1776663 - protein, 5 aa, Staphylococcus epidermidis
EGIKD

SEQ ID NO: 1776664 - protein, 19 aa, Staphylococcus epidermidis
EGIKRPKKKVSVEELEDTE

SEQ ID NO: 1776665 - protein, 10 aa, Staphylococcus epidermidis
EGINSNKQEI

SEQ ID NO: 1776666 - protein, 10 aa, Staphylococcus epidermidis
EGIQSSNADV

SEQ ID NO: 1776667 - protein, 11 aa, Staphylococcus epidermidis
EGKALNPDGAY

SEQ ID NO: 1776668 - protein, 18 aa, Staphylococcus epidermidis
EGKDPSEISRKDEVWEGE

SEQ ID NO: 1776669 - protein, 12 aa, Staphylococcus epidermidis
EGKEHHKNPSYK

SEQ ID NO: 1776670 - protein, 16 aa, Staphylococcus epidermidis
EGKGQFKPVGDANPYI

SEQ ID NO: 1776671 - protein, 9 aa, Staphylococcus epidermidis
EGKKMSKSL

SEQ ID NO: 1776672 - protein, 8 aa, Staphylococcus epidermidis
EGKNEKDI

SEQ ID NO: 1776673 - protein, 11 aa, Staphylococcus epidermidis
EGKNKKEVCKD

SEQ ID NO: 1776674 - protein, 16 aa, Staphylococcus epidermidis
EGKNKQEVSEDKEYER

SEQ ID NO: 1776675 - protein, 7 aa, Staphylococcus epidermidis
EGKPAVE

SEQ ID NO: 1776676 - protein, 8 aa, Staphylococcus epidermidis
EGKQGADE

SEQ ID NO: 1776677 - protein, 8 aa, Staphylococcus epidermidis
EGKTKEQI

SEQ ID NO: 1776678 - protein, 21 aa, Staphylococcus epidermidis
EGKTPASLKKEFDSQRKRNIN

SEQ ID NO: 1776679 - protein, 21 aa, Staphylococcus epidermidis
EGKTPTSLRKEFDSQRKRNIN

SEQ ID NO: 1776680 - protein, 13 aa, Staphylococcus epidermidis
EGKTVNEKTQDFQ

SEQ ID NO: 1776681 - protein, 10 aa, Staphylococcus epidermidis
EGLAQEGIQI

SEQ ID NO: 1776682 - protein, 4 aa, Staphylococcus epidermidis
EGLD

SEQ ID NO: 1776683 - protein, 5 aa, Staphylococcus epidermidis
EGLEK

SEQ ID NO: 1776684 - protein, 8 aa, Staphylococcus epidermidis
EGLKEVSE

SEQ ID NO: 1776685 - protein, 11 aa, Staphylococcus epidermidis
EGLNSGKQSHF

SEQ ID NO: 1776686 - protein, 10 aa, Staphylococcus epidermidis
EGLPRHTSTH

SEQ ID NO: 1776687 - protein, 36 aa, Staphylococcus epidermidis
EGLQSYKEKAEKVDSLKEQLDTANEEIRNRDNQIEE

SEQ ID NO: 1776688 - protein, 7 aa, Staphylococcus epidermidis
EGLRPEG

SEQ ID NO: 1776689 - protein, 5 aa, Staphylococcus epidermidis
EGLSP

SEQ ID NO: 1776690 - protein, 11 aa, Staphylococcus epidermidis
EGLSPASLHDK

SEQ ID NO: 1776691 - protein, 4 aa, Staphylococcus epidermidis
EGMP

SEQ ID NO: 1776692 - protein, 18 aa, Staphylococcus epidermidis
EGNAVGFKDTTKTESSYR

SEQ ID NO: 1776693 - protein, 17 aa, Staphylococcus epidermidis
EGNEKMSKSKGNVINPD

SEQ ID NO: 1776694 - protein, 10 aa, Staphylococcus epidermidis
EGNENRKGHK

SEQ ID NO: 1776695 - protein, 7 aa, Staphylococcus epidermidis
EGNHDDW

SEQ ID NO: 1776696 - protein, 8 aa, Staphylococcus epidermidis
EGNNNYGK

SEQ ID NO: 1776697 - protein, 6 aa, Staphylococcus epidermidis
EGNPER

SEQ ID NO: 1776698 - protein, 5 aa, Staphylococcus epidermidis
EGNQI

SEQ ID NO: 1776699 - protein, 6 aa, Staphylococcus epidermidis
EGNREF

SEQ ID NO: 1776700 - protein, 20 aa, Staphylococcus epidermidis
EGNTKEDGVEFSSDSTTAEF

SEQ ID NO: 1776701 - protein, 9 aa, Staphylococcus epidermidis
EGPGLTKKI

SEQ ID NO: 1776702 - protein, 7 aa, Staphylococcus epidermidis
EGPLSTL

SEQ ID NO: 1776703 - protein, 22 aa, Staphylococcus epidermidis
EGPTYASAKEGVEANYSNDVTD

SEQ ID NO: 1776704 - protein, 7 aa, Staphylococcus epidermidis
EGQASQI

SEQ ID NO: 1776705 - protein, 18 aa, Staphylococcus epidermidis
EGQGRQRANINGDVKTPK

SEQ ID NO: 1776706 - protein, 12 aa, Staphylococcus epidermidis
EGQKKDGEGGIL

SEQ ID NO: 1776707 - protein, 10 aa, Staphylococcus epidermidis
EGQKRSVEDL

SEQ ID NO: 1776708 - protein, 39 aa, Staphylococcus epidermidis
EGQQGVSNEEVAAEQNINLDEKEESEQAETTEDNTSVES

SEQ ID NO: 1776709 - protein, 7 aa, Staphylococcus epidermidis
EGQSDHT

SEQ ID NO: 1776710 - protein, 6 aa, Staphylococcus epidermidis
EGQTLD

SEQ ID NO: 1776711 - protein, 6 aa, Staphylococcus epidermidis
EGREGQ

SEQ ID NO: 1776712 - protein, 12 aa, Staphylococcus epidermidis
EGRENTTKERQT

SEQ ID NO: 1776713 - protein, 9 aa, Staphylococcus epidermidis
EGRNTDKAY

SEQ ID NO: 1776714 - protein, 21 aa, Staphylococcus epidermidis
EGRTRAAQDETHQAGSPSTDF

SEQ ID NO: 1776715 - protein, 5 aa, Staphylococcus epidermidis
EGRYK

SEQ ID NO: 1776716 - protein, 6 aa, Staphylococcus epidermidis
EGRYTS

SEQ ID NO: 1776717 - protein, 6 aa, Staphylococcus epidermidis
EGSDYN

SEQ ID NO: 1776718 - protein, 6 aa, Staphylococcus epidermidis
EGSHSV

SEQ ID NO: 1776719 - protein, 5 aa, Staphylococcus epidermidis
EGSKI

SEQ ID NO: 1776720 - protein, 11 aa, Staphylococcus epidermidis
EGSTDEEAAKD

SEQ ID NO: 1776721 - protein, 6 aa, Staphylococcus epidermidis
EGTAID

SEQ ID NO: 1776722 - protein, 5 aa, Staphylococcus epidermidis
EGTFD

SEQ ID NO: 1776723 - protein, 9 aa, Staphylococcus epidermidis
EGTFSKENI

SEQ ID NO: 1776724 - protein, 5 aa, Staphylococcus epidermidis
EGTRK

SEQ ID NO: 1776725 - protein, 8 aa, Staphylococcus epidermidis
EGTTIPSL

SEQ ID NO: 1776726 - protein, 15 aa, Staphylococcus epidermidis
EGTTPHTITGRYGSG

SEQ ID NO: 1776727 - protein, 20 aa, Staphylococcus epidermidis
EGTTQELPVKTKNIKKKTVN

SEQ ID NO: 1776728 - protein, 10 aa, Staphylococcus epidermidis
EGTVEAGVRK

SEQ ID NO: 1776729 - protein, 15 aa, Staphylococcus epidermidis
EGVNGMNDEEPSQKK

SEQ ID NO: 1776730 - protein, 4 aa, Staphylococcus epidermidis
EGVP

SEQ ID NO: 1776731 - protein, 10 aa, Staphylococcus epidermidis
EGVQSSNADV

SEQ ID NO: 1776732 - protein, 4 aa, Staphylococcus epidermidis
EGVR

SEQ ID NO: 1776733 - protein, 8 aa, Staphylococcus epidermidis
EGYDTPEN

SEQ ID NO: 1776734 - protein, 7 aa, Staphylococcus epidermidis
EGYEQLE

SEQ ID NO: 1776735 - protein, 9 aa, Staphylococcus epidermidis
EGYKKGLRK

SEQ ID NO: 1776736 - protein, 9 aa, Staphylococcus epidermidis
EGYNPKKVG

SEQ ID NO: 1776737 - protein, 17 aa, Staphylococcus epidermidis
EGYPPTMNSPKLRESVE

SEQ ID NO: 1776738 - protein, 8 aa, Staphylococcus epidermidis
EGYRPGDF

SEQ ID NO: 1776739 - protein, 11 aa, Staphylococcus epidermidis
EHATQDDYKAL

SEQ ID NO: 1776740 - protein, 7 aa, Staphylococcus epidermidis
EHDAEKV

SEQ ID NO: 1776741 - protein, 6 aa, Staphylococcus epidermidis
EHDDKA

SEQ ID NO: 1776742 - protein, 5 aa, Staphylococcus epidermidis
EHDEM

SEQ ID NO: 1776743 - protein, 6 aa, Staphylococcus epidermidis
EHEEQP

SEQ ID NO: 1776744 - protein, 4 aa, Staphylococcus epidermidis
EHES

SEQ ID NO: 1776745 - protein, 6 aa, Staphylococcus epidermidis
EHESLS

SEQ ID NO: 1776746 - protein, 11 aa, Staphylococcus epidermidis
EHETKPPEYFN

SEQ ID NO: 1776747 - protein, 6 aa, Staphylococcus epidermidis
EHGEQP

SEQ ID NO: 1776748 - protein, 5 aa, Staphylococcus epidermidis
EHGGK

SEQ ID NO: 1776749 - protein, 9 aa, Staphylococcus epidermidis
EHHETSGDL

SEQ ID NO: 1776750 - protein, 25 aa, Staphylococcus epidermidis
EHHSDESIHPNDDVNKSQSSNDTFP

SEQ ID NO: 1776751 - protein, 19 aa, Staphylococcus epidermidis
EHKDKDHDDYYEIKIRIYK

SEQ ID NO: 1776752 - protein, 8 aa, Staphylococcus epidermidis
EHKENPLD

SEQ ID NO: 1776753 - protein, 5 aa, Staphylococcus epidermidis
EHKNE

SEQ ID NO: 1776754 - protein, 10 aa, Staphylococcus epidermidis
EHLEEGKKSV

SEQ ID NO: 1776755 - protein, 8 aa, Staphylococcus epidermidis
EHLKGERG

SEQ ID NO: 1776756 - protein, 4 aa, Staphylococcus epidermidis
EHLT

SEQ ID NO: 1776757 - protein, 20 aa, Staphylococcus epidermidis
EHNEEGKPSEAASNRQAQME

SEQ ID NO: 1776758 - protein, 8 aa, Staphylococcus epidermidis
EHNHTTHK

SEQ ID NO: 1776759 - protein, 8 aa, Staphylococcus epidermidis
EHNPAAKT

SEQ ID NO: 1776760 - protein, 8 aa, Staphylococcus epidermidis
EHNQLSEK

SEQ ID NO: 1776761 - protein, 4 aa, Staphylococcus epidermidis
EHNS

SEQ ID NO: 1776762 - protein, 14 aa, Staphylococcus epidermidis
EHPLTRNQKITKQA

SEQ ID NO: 1776763 - protein, 9 aa, Staphylococcus epidermidis
EHPPGPSKH

SEQ ID NO: 1776764 - protein, 8 aa, Staphylococcus epidermidis
EHPRYGKQ

SEQ ID NO: 1776765 - protein, 10 aa, Staphylococcus epidermidis
EHQDAEDTVR

SEQ ID NO: 1776766 - protein, 9 aa, Staphylococcus epidermidis
EHRKAQNYA

SEQ ID NO: 1776767 - protein, 12 aa, Staphylococcus epidermidis
EHSGFSSHTNFT

SEQ ID NO: 1776768 - protein, 5 aa, Staphylococcus epidermidis
EHSSQ

SEQ ID NO: 1776769 - protein, 7 aa, Staphylococcus epidermidis
EHTDNGV

SEQ ID NO: 1776770 - protein, 11 aa, Staphylococcus epidermidis
EHTEEDIDQTL

SEQ ID NO: 1776771 - protein, 16 aa, Staphylococcus epidermidis
EHTKEKFSDPKTREET

SEQ ID NO: 1776772 - protein, 6 aa, Staphylococcus epidermidis
EHTYEG

SEQ ID NO: 1776773 - protein, 5 aa, Staphylococcus epidermidis
EHVHP

SEQ ID NO: 1776774 - protein, 9 aa, Staphylococcus epidermidis
EIAAEQGTK

SEQ ID NO: 1776775 - protein, 30 aa, Staphylococcus epidermidis
EIAQRSGDDSLANQKKLKDLREQLKQQEED

SEQ ID NO: 1776776 - protein, 11 aa, Staphylococcus epidermidis
EIDAAKANAQV

SEQ ID NO: 1776777 - protein, 11 aa, Staphylococcus epidermidis
EIDAKQASEYL

SEQ ID NO: 1776778 - protein, 26 aa, Staphylococcus epidermidis
EIDESKKLEKHEEKTPSAKNGFGRFV

SEQ ID NO: 1776779 - protein, 6 aa, Staphylococcus epidermidis
EIDGSL

SEQ ID NO: 1776780 - protein, 5 aa, Staphylococcus epidermidis
EIDKA

SEQ ID NO: 1776781 - protein, 11 aa, Staphylococcus epidermidis
EIDSSQTDKII

SEQ ID NO: 1776782 - protein, 26 aa, Staphylococcus epidermidis
EIEAPKKDVKSAPKQSVKENSNIKVN

SEQ ID NO: 1776783 - protein, 6 aa, Staphylococcus epidermidis
EIEDNP

SEQ ID NO: 1776784 - protein, 11 aa, Staphylococcus epidermidis
EIEDVKKQNDY

SEQ ID NO: 1776785 - protein, 6 aa, Staphylococcus epidermidis
EIEGTG

SEQ ID NO: 1776786 - protein, 4 aa, Staphylococcus epidermidis
EIEK

SEQ ID NO: 1776787 - protein, 9 aa, Staphylococcus epidermidis
EIEKRKDEI

SEQ ID NO: 1776788 - protein, 5 aa, Staphylococcus epidermidis
EIEKS

SEQ ID NO: 1776789 - protein, 14 aa, Staphylococcus epidermidis
EIENANDNNLNRDA

SEQ ID NO: 1776790 - protein, 5 aa, Staphylococcus epidermidis
EIESN

SEQ ID NO: 1776791 - protein, 19 aa, Staphylococcus epidermidis
EIGGRTKKDKLHITYQTLF

SEQ ID NO: 1776792 - protein, 8 aa, Staphylococcus epidermidis
EIGNAQDI

SEQ ID NO: 1776793 - protein, 5 aa, Staphylococcus epidermidis
EIGRK

SEQ ID NO: 1776794 - protein, 11 aa, Staphylococcus epidermidis
EIHQSKEYTGI

SEQ ID NO: 1776795 - protein, 6 aa, Staphylococcus epidermidis
EIIETA

SEQ ID NO: 1776796 - protein, 8 aa, Staphylococcus epidermidis
EIKDDKKR

SEQ ID NO: 1776797 - protein, 7 aa, Staphylococcus epidermidis
EIKDNDY

SEQ ID NO: 1776798 - protein, 6 aa, Staphylococcus epidermidis
EIKDVG

SEQ ID NO: 1776799 - protein, 8 aa, Staphylococcus epidermidis
EIKEKYSQ

SEQ ID NO: 1776800 - protein, 21 aa, Staphylococcus epidermidis
EIKGRKGKTINGTFIKEADLE

SEQ ID NO: 1776801 - protein, 4 aa, Staphylococcus epidermidis
EIKQ

SEQ ID NO: 1776802 - protein, 12 aa, Staphylococcus epidermidis
EIKQRGRKGTTL

SEQ ID NO: 1776803 - protein, 12 aa, Staphylococcus epidermidis
EIKYTQSKESIQ

SEQ ID NO: 1776804 - protein, 5 aa, Staphylococcus epidermidis
EINGA

SEQ ID NO: 1776805 - protein, 5 aa, Staphylococcus epidermidis
EINGT

SEQ ID NO: 1776806 - protein, 9 aa, Staphylococcus epidermidis
EINKTQKRL

SEQ ID NO: 1776807 - protein, 5 aa, Staphylococcus epidermidis
EINNA

SEQ ID NO: 1776808 - protein, 12 aa, Staphylococcus epidermidis
EINSPSGNTEEA

SEQ ID NO: 1776809 - protein, 7 aa, Staphylococcus epidermidis
EIPDTGS

SEQ ID NO: 1776810 - protein, 20 aa, Staphylococcus epidermidis
EIPEDFQPQVATPKLRERYQ

SEQ ID NO: 1776811 - protein, 7 aa, Staphylococcus epidermidis
EIPNPKA

SEQ ID NO: 1776812 - protein, 6 aa, Staphylococcus epidermidis
EIPPEK

SEQ ID NO: 1776813 - protein, 6 aa, Staphylococcus epidermidis
EIPSNV

SEQ ID NO: 1776814 - protein, 25 aa, Staphylococcus epidermidis
EIQENVTEKTKGHKLKKSAAKTTAL

SEQ ID NO: 1776815 - protein, 10 aa, Staphylococcus epidermidis
EIQRDKQYTL

SEQ ID NO: 1776816 - protein, 12 aa, Staphylococcus epidermidis
EIRGEQKEIGWG

SEQ ID NO: 1776817 - protein, 7 aa, Staphylococcus epidermidis
EIRQTDG

SEQ ID NO: 1776818 - protein, 9 aa, Staphylococcus epidermidis
EISAQSQLH

SEQ ID NO: 1776819 - protein, 5 aa, Staphylococcus epidermidis
EISDT

SEQ ID NO: 1776820 - protein, 5 aa, Staphylococcus epidermidis
EISED

SEQ ID NO: 1776821 - protein, 10 aa, Staphylococcus epidermidis
EISKADKQVS

SEQ ID NO: 1776822 - protein, 5 aa, Staphylococcus epidermidis
EISKN

SEQ ID NO: 1776823 - protein, 11 aa, Staphylococcus epidermidis
EISKSYQDGHQ

SEQ ID NO: 1776824 - protein, 5 aa, Staphylococcus epidermidis
EISNR

SEQ ID NO: 1776825 - protein, 6 aa, Staphylococcus epidermidis
EISTNY

SEQ ID NO: 1776826 - protein, 6 aa, Staphylococcus epidermidis
EISTST

SEQ ID NO: 1776827 - protein, 5 aa, Staphylococcus epidermidis
EITDK

SEQ ID NO: 1776828 - protein, 6 aa, Staphylococcus epidermidis
EITEDG

SEQ ID NO: 1776829 - protein, 7 aa, Staphylococcus epidermidis
EITEKTK

SEQ ID NO: 1776830 - protein, 10 aa, Staphylococcus epidermidis
EITENSDLEG

SEQ ID NO: 1776831 - protein, 12 aa, Staphylococcus epidermidis
EITGKATNSKLQ

SEQ ID NO: 1776832 - protein, 11 aa, Staphylococcus epidermidis
EITKDAFGKTI

SEQ ID NO: 1776833 - protein, 11 aa, Staphylococcus epidermidis
EITKDAYGKTI

SEQ ID NO: 1776834 - protein, 15 aa, Staphylococcus epidermidis
EITNDEKGKISHRGN

SEQ ID NO: 1776835 - protein, 9 aa, Staphylococcus epidermidis
EITNRDEQI

SEQ ID NO: 1776836 - protein, 6 aa, Staphylococcus epidermidis
EITNST

SEQ ID NO: 1776837 - protein, 8 aa, Staphylococcus epidermidis
EITPENQA

SEQ ID NO: 1776838 - protein, 17 aa, Staphylococcus epidermidis
EITTDSNEAPQIKTSES

SEQ ID NO: 1776839 - protein, 15 aa, Staphylococcus epidermidis
EIVETAEKKLQSQYP

SEQ ID NO: 1776840 - protein, 8 aa, Staphylococcus epidermidis
EIYETPGA

SEQ ID NO: 1776841 - protein, 7 aa, Staphylococcus epidermidis
EKAEFPE

SEQ ID NO: 1776842 - protein, 5 aa, Staphylococcus epidermidis
EKAFQ

SEQ ID NO: 1776843 - protein, 7 aa, Staphylococcus epidermidis
EKAGINY

SEQ ID NO: 1776844 - protein, 32 aa, Staphylococcus epidermidis
EKAKEAEEKLKEQNEEKSNDTEQTKKDVQDTL

SEQ ID NO: 1776845 - protein, 9 aa, Staphylococcus epidermidis
EKAKELNEA

SEQ ID NO: 1776846 - protein, 5 aa, Staphylococcus epidermidis
EKAKS

SEQ ID NO: 1776847 - protein, 15 aa, Staphylococcus epidermidis
EKAKSLNEENGQSFI

SEQ ID NO: 1776848 - protein, 6 aa, Staphylococcus epidermidis
EKAKTG

SEQ ID NO: 1776849 - protein, 9 aa, Staphylococcus epidermidis
EKAKTLNDA

SEQ ID NO: 1776850 - protein, 15 aa, Staphylococcus epidermidis
EKALGSALKQSNIER

SEQ ID NO: 1776851 - protein, 7 aa, Staphylococcus epidermidis
EKAQQKE

SEQ ID NO: 1776852 - protein, 5 aa, Staphylococcus epidermidis
EKAQS

SEQ ID NO: 1776853 - protein, 19 aa, Staphylococcus epidermidis
EKARRDREKRVREKPTSRP

SEQ ID NO: 1776854 - protein, 8 aa, Staphylococcus epidermidis
EKARTNET

SEQ ID NO: 1776855 - protein, 13 aa, Staphylococcus epidermidis
EKASGRKTKRTEL

SEQ ID NO: 1776856 - protein, 10 aa, Staphylococcus epidermidis
EKASNSMQDK

SEQ ID NO: 1776857 - protein, 21 aa, Staphylococcus epidermidis
EKASSENFGEESDDAQKLKIT

SEQ ID NO: 1776858 - protein, 12 aa, Staphylococcus epidermidis
EKATDAPNHGMR

SEQ ID NO: 1776859 - protein, 5 aa, Staphylococcus epidermidis
EKATS

SEQ ID NO: 1776860 - protein, 7 aa, Staphylococcus epidermidis
EKCPDEK

SEQ ID NO: 1776861 - protein, 13 aa, Staphylococcus epidermidis
EKDADESERAIKE

SEQ ID NO: 1776862 - protein, 10 aa, Staphylococcus epidermidis
EKDASDIERE

SEQ ID NO: 1776863 - protein, 9 aa, Staphylococcus epidermidis
EKDDSIGEE

SEQ ID NO: 1776864 - protein, 8 aa, Staphylococcus epidermidis
EKDEKNIA

SEQ ID NO: 1776865 - protein, 9 aa, Staphylococcus epidermidis
EKDENNDAE

SEQ ID NO: 1776866 - protein, 13 aa, Staphylococcus epidermidis
EKDEYAGEQEDEE

SEQ ID NO: 1776867 - protein, 12 aa, Staphylococcus epidermidis
EKDFVENDNDYR

SEQ ID NO: 1776868 - protein, 4 aa, Staphylococcus epidermidis
EKDI

SEQ ID NO: 1776869 - protein, 55 aa, Staphylococcus epidermidis
EKDINVETEDNQNDTKIENSVSNTDNSEANASDSENNSEESIKDEESESQDTKIK

SEQ ID NO: 1776870 - protein, 8 aa, Staphylococcus epidermidis
EKDIQGNH

SEQ ID NO: 1776871 - protein, 8 aa, Staphylococcus epidermidis
EKDKVGQA

SEQ ID NO: 1776872 - protein, 8 aa, Staphylococcus epidermidis
EKDNPVQV

SEQ ID NO: 1776873 - protein, 8 aa, Staphylococcus epidermidis
EKDNQYSN

SEQ ID NO: 1776874 - protein, 7 aa, Staphylococcus epidermidis
EKDPELE

SEQ ID NO: 1776875 - protein, 7 aa, Staphylococcus epidermidis
EKDPHNL

SEQ ID NO: 1776876 - protein, 10 aa, Staphylococcus epidermidis
EKDQQKTGLN

SEQ ID NO: 1776877 - protein, 19 aa, Staphylococcus epidermidis
EKDRKGRPINNKKKYPVKM

SEQ ID NO: 1776878 - protein, 23 aa, Staphylococcus epidermidis
EKDRNFNAKKTNVLNKSKSVAME

SEQ ID NO: 1776879 - protein, 6 aa, Staphylococcus epidermidis
EKDSFE

SEQ ID NO: 1776880 - protein, 7 aa, Staphylococcus epidermidis
EKDSNLE

SEQ ID NO: 1776881 - protein, 5 aa, Staphylococcus epidermidis
EKDSV

SEQ ID NO: 1776882 - protein, 4 aa, Staphylococcus epidermidis
EKDY

SEQ ID NO: 1776883 - protein, 14 aa, Staphylococcus epidermidis
EKEDYIDGSKVEAG

SEQ ID NO: 1776884 - protein, 5 aa, Staphylococcus epidermidis
EKEEE

SEQ ID NO: 1776885 - protein, 4 aa, Staphylococcus epidermidis
EKEF

SEQ ID NO: 1776886 - protein, 17 aa, Staphylococcus epidermidis
EKEGYRDNEFEKEDKGT

SEQ ID NO: 1776887 - protein, 14 aa, Staphylococcus epidermidis
EKEIKDLSSKVRVD

SEQ ID NO: 1776888 - protein, 5 aa, Staphylococcus epidermidis
EKEIQ

SEQ ID NO: 1776889 - protein, 29 aa, Staphylococcus epidermidis
EKEKQFKKIQRDRQENNEKIKEVNEKYSN

SEQ ID NO: 1776890 - protein, 6 aa, Staphylococcus epidermidis
EKELSS

SEQ ID NO: 1776891 - protein, 5 aa, Staphylococcus epidermidis
EKELT

SEQ ID NO: 1776892 - protein, 18 aa, Staphylococcus epidermidis
EKENEKSNPDTKKVRGME

SEQ ID NO: 1776893 - protein, 7 aa, Staphylococcus epidermidis
EKENQKS

SEQ ID NO: 1776894 - protein, 5 aa, Staphylococcus epidermidis
EKEPE

SEQ ID NO: 1776895 - protein, 9 aa, Staphylococcus epidermidis
EKEPNMPKN

SEQ ID NO: 1776896 - protein, 6 aa, Staphylococcus epidermidis
EKEPQS

SEQ ID NO: 1776897 - protein, 13 aa, Staphylococcus epidermidis
EKEQGNDEAHEMD

SEQ ID NO: 1776898 - protein, 5 aa, Staphylococcus epidermidis
EKEQV

SEQ ID NO: 1776899 - protein, 10 aa, Staphylococcus epidermidis
EKETGSIISQ

SEQ ID NO: 1776900 - protein, 9 aa, Staphylococcus epidermidis
EKETRGKYW

SEQ ID NO: 1776901 - protein, 12 aa, Staphylococcus epidermidis
EKEVYDSGYRIL

SEQ ID NO: 1776902 - protein, 16 aa, Staphylococcus epidermidis
EKFGPEAIDENGEMNR

SEQ ID NO: 1776903 - protein, 35 aa, Staphylococcus epidermidis
EKFKDSDNEQVNKAKDKINEYTGGGDNDDKEDKDD

SEQ ID NO: 1776904 - protein, 6 aa, Staphylococcus epidermidis
EKFTGQ

SEQ ID NO: 1776905 - protein, 13 aa, Staphylococcus epidermidis
EKFTSSAQNSDTI

SEQ ID NO: 1776906 - protein, 7 aa, Staphylococcus epidermidis
EKGDYPK

SEQ ID NO: 1776907 - protein, 4 aa, Staphylococcus epidermidis
EKGE

SEQ ID NO: 1776908 - protein, 11 aa, Staphylococcus epidermidis
EKGELATTGST

SEQ ID NO: 1776909 - protein, 7 aa, Staphylococcus epidermidis
EKGFRSL

SEQ ID NO: 1776910 - protein, 4 aa, Staphylococcus epidermidis
EKGG

SEQ ID NO: 1776911 - protein, 9 aa, Staphylococcus epidermidis
EKGGKGGID

SEQ ID NO: 1776912 - protein, 5 aa, Staphylococcus epidermidis
EKGGY

SEQ ID NO: 1776913 - protein, 11 aa, Staphylococcus epidermidis
EKGHDDATSFA

SEQ ID NO: 1776914 - protein, 8 aa, Staphylococcus epidermidis
EKGHDDLT

SEQ ID NO: 1776915 - protein, 5 aa, Staphylococcus epidermidis
EKGIK

SEQ ID NO: 1776916 - protein, 4 aa, Staphylococcus epidermidis
EKGK

SEQ ID NO: 1776917 - protein, 14 aa, Staphylococcus epidermidis
EKGKDLIPIIDMVE

SEQ ID NO: 1776918 - protein, 12 aa, Staphylococcus epidermidis
EKGKGKSKKVEY

SEQ ID NO: 1776919 - protein, 20 aa, Staphylococcus epidermidis
EKGKTKTIKGFTSKAGKKFN

SEQ ID NO: 1776920 - protein, 8 aa, Staphylococcus epidermidis
EKGLHRES

SEQ ID NO: 1776921 - protein, 12 aa, Staphylococcus epidermidis
EKGLTEEPEGGL

SEQ ID NO: 1776922 - protein, 8 aa, Staphylococcus epidermidis
EKGMTESS

SEQ ID NO: 1776923 - protein, 7 aa, Staphylococcus epidermidis
EKGNNDL

SEQ ID NO: 1776924 - protein, 13 aa, Staphylococcus epidermidis
EKGNSIQHEARQR

SEQ ID NO: 1776925 - protein, 14 aa, Staphylococcus epidermidis
EKGNTGRMLAFIGR

SEQ ID NO: 1776926 - protein, 8 aa, Staphylococcus epidermidis
EKGPEVPR

SEQ ID NO: 1776927 - protein, 15 aa, Staphylococcus epidermidis
EKGPTALKGEDKKQL

SEQ ID NO: 1776928 - protein, 5 aa, Staphylococcus epidermidis
EKGRI

SEQ ID NO: 1776929 - protein, 20 aa, Staphylococcus epidermidis
EKGRNTKEWRNKNKQLQASR

SEQ ID NO: 1776930 - protein, 7 aa, Staphylococcus epidermidis
EKGSPLT

SEQ ID NO: 1776931 - protein, 17 aa, Staphylococcus epidermidis
EKGTVEKEGKTEGTTEE

SEQ ID NO: 1776932 - protein, 5 aa, Staphylococcus epidermidis
EKGVS

SEQ ID NO: 1776933 - protein, 4 aa, Staphylococcus epidermidis
EKGY

SEQ ID NO: 1776934 - protein, 17 aa, Staphylococcus epidermidis
EKHGGASKTSGAGGGDC

SEQ ID NO: 1776935 - protein, 6 aa, Staphylococcus epidermidis
EKHIRD

SEQ ID NO: 1776936 - protein, 7 aa, Staphylococcus epidermidis
EKHPKLG

SEQ ID NO: 1776937 - protein, 4 aa, Staphylococcus epidermidis
EKHS

SEQ ID NO: 1776938 - protein, 12 aa, Staphylococcus epidermidis
EKHYSEHEGKPF

SEQ ID NO: 1776939 - protein, 6 aa, Staphylococcus epidermidis
EKIDES

SEQ ID NO: 1776940 - protein, 20 aa, Staphylococcus epidermidis
EKIDKSDKFESLNPADTSQL

SEQ ID NO: 1776941 - protein, 7 aa, Staphylococcus epidermidis
EKIENNQ

SEQ ID NO: 1776942 - protein, 4 aa, Staphylococcus epidermidis
EKIQ

SEQ ID NO: 1776943 - protein, 9 aa, Staphylococcus epidermidis
EKITADYQN

SEQ ID NO: 1776944 - protein, 19 aa, Staphylococcus epidermidis
EKITSEAATELPLTQRYFL

SEQ ID NO: 1776945 - protein, 4 aa, Staphylococcus epidermidis
EKIY

SEQ ID NO: 1776946 - protein, 5 aa, Staphylococcus epidermidis
EKKAL

SEQ ID NO: 1776947 - protein, 10 aa, Staphylococcus epidermidis
EKKAQKEGFN

SEQ ID NO: 1776948 - protein, 9 aa, Staphylococcus epidermidis
EKKDGFKGK

SEQ ID NO: 1776949 - protein, 6 aa, Staphylococcus epidermidis
EKKEES

SEQ ID NO: 1776950 - protein, 7 aa, Staphylococcus epidermidis
EKKIEDK

SEQ ID NO: 1776951 - protein, 13 aa, Staphylococcus epidermidis
EKKITNDNSLIDN

SEQ ID NO: 1776952 - protein, 7 aa, Staphylococcus epidermidis
EKKKEAI

SEQ ID NO: 1776953 - protein, 24 aa, Staphylococcus epidermidis
EKKKNELGLSQESVADKMGMGQSG

SEQ ID NO: 1776954 - protein, 12 aa, Staphylococcus epidermidis
EKKLVSEADQVS

SEQ ID NO: 1776955 - protein, 9 aa, Staphylococcus epidermidis
EKKPTKKEE

SEQ ID NO: 1776956 - protein, 7 aa, Staphylococcus epidermidis
EKKPVGC

SEQ ID NO: 1776957 - protein, 11 aa, Staphylococcus epidermidis
EKLAPKLKKGD

SEQ ID NO: 1776958 - protein, 9 aa, Staphylococcus epidermidis
EKLEAKGTY

SEQ ID NO: 1776959 - protein, 7 aa, Staphylococcus epidermidis
EKLEECE

SEQ ID NO: 1776960 - protein, 7 aa, Staphylococcus epidermidis
EKLGADP

SEQ ID NO: 1776961 - protein, 8 aa, Staphylococcus epidermidis
EKLKDSQE

SEQ ID NO: 1776962 - protein, 6 aa, Staphylococcus epidermidis
EKLKED

SEQ ID NO: 1776963 - protein, 9 aa, Staphylococcus epidermidis
EKLKEIQST

SEQ ID NO: 1776964 - protein, 8 aa, Staphylococcus epidermidis
EKLKNNDK

SEQ ID NO: 1776965 - protein, 11 aa, Staphylococcus epidermidis
EKLKQGKSYPR

SEQ ID NO: 1776966 - protein, 9 aa, Staphylococcus epidermidis
EKLNEDGSL

SEQ ID NO: 1776967 - protein, 8 aa, Staphylococcus epidermidis
EKLPESSD

SEQ ID NO: 1776968 - protein, 8 aa, Staphylococcus epidermidis
EKLQESVP

SEQ ID NO: 1776969 - protein, 19 aa, Staphylococcus epidermidis
EKLTKTDTFNSVNPANTSQ

SEQ ID NO: 1776970 - protein, 12 aa, Staphylococcus epidermidis
EKMNQNAAGVDV

SEQ ID NO: 1776971 - protein, 7 aa, Staphylococcus epidermidis
EKMRKAE

SEQ ID NO: 1776972 - protein, 9 aa, Staphylococcus epidermidis
EKNANTPKE

SEQ ID NO: 1776973 - protein, 23 aa, Staphylococcus epidermidis
EKNCGYSPQETTKNVKKLKRYRN

SEQ ID NO: 1776974 - protein, 8 aa, Staphylococcus epidermidis
EKNEHEKD

SEQ ID NO: 1776975 - protein, 6 aa, Staphylococcus epidermidis
EKNEIE

SEQ ID NO: 1776976 - protein, 6 aa, Staphylococcus epidermidis
EKNENQ

SEQ ID NO: 1776977 - protein, 8 aa, Staphylococcus epidermidis
EKNKKGQP

SEQ ID NO: 1776978 - protein, 5 aa, Staphylococcus epidermidis
EKNLM

SEQ ID NO: 1776979 - protein, 9 aa, Staphylococcus epidermidis
EKNNENFEE

SEQ ID NO: 1776980 - protein, 8 aa, Staphylococcus epidermidis
EKNNGFNS

SEQ ID NO: 1776981 - protein, 10 aa, Staphylococcus epidermidis
EKNNKYEVKK

SEQ ID NO: 1776982 - protein, 9 aa, Staphylococcus epidermidis
EKNPELARP

SEQ ID NO: 1776983 - protein, 15 aa, Staphylococcus epidermidis
EKNRNNVPFTAPSEG

SEQ ID NO: 1776984 - protein, 7 aa, Staphylococcus epidermidis
EKNRYLN

SEQ ID NO: 1776985 - protein, 6 aa, Staphylococcus epidermidis
EKNTIP

SEQ ID NO: 1776986 - protein, 6 aa, Staphylococcus epidermidis
EKNTKR

SEQ ID NO: 1776987 - protein, 22 aa, Staphylococcus epidermidis
EKNWEEAQESGNEIGKHLSGDE

SEQ ID NO: 1776988 - protein, 22 aa, Staphylococcus epidermidis
EKNWEEAQESGNEIGKHLSSDE

SEQ ID NO: 1776989 - protein, 7 aa, Staphylococcus epidermidis
EKPGLFG

SEQ ID NO: 1776990 - protein, 10 aa, Staphylococcus epidermidis
EKPHSNTDQR

SEQ ID NO: 1776991 - protein, 5 aa, Staphylococcus epidermidis
EKPKA

SEQ ID NO: 1776992 - protein, 5 aa, Staphylococcus epidermidis
EKPLN

SEQ ID NO: 1776993 - protein, 7 aa, Staphylococcus epidermidis
EKPSTQF

SEQ ID NO: 1776994 - protein, 7 aa, Staphylococcus epidermidis
EKPTEIQ

SEQ ID NO: 1776995 - protein, 7 aa, Staphylococcus epidermidis
EKQDIED

SEQ ID NO: 1776996 - protein, 9 aa, Staphylococcus epidermidis
EKQDINTEL

SEQ ID NO: 1776997 - protein, 4 aa, Staphylococcus epidermidis
EKQG

SEQ ID NO: 1776998 - protein, 8 aa, Staphylococcus epidermidis
EKQHNQVE

SEQ ID NO: 1776999 - protein, 9 aa, Staphylococcus epidermidis
EKQNATDIV

SEQ ID NO: 1777000 - protein, 10 aa, Staphylococcus epidermidis
EKQQINTELP

SEQ ID NO: 1777001 - protein, 14 aa, Staphylococcus epidermidis
EKQVPARDFIFENF

SEQ ID NO: 1777002 - protein, 12 aa, Staphylococcus epidermidis
EKQYGKSIENRP

SEQ ID NO: 1777003 - protein, 10 aa, Staphylococcus epidermidis
EKRAKELDEM

SEQ ID NO: 1777004 - protein, 10 aa, Staphylococcus epidermidis
EKRDDTQNGL

SEQ ID NO: 1777005 - protein, 20 aa, Staphylococcus epidermidis
EKREDNQSNTYTEVQNHQPQ

SEQ ID NO: 1777006 - protein, 14 aa, Staphylococcus epidermidis
EKRIHSKRQLQKQD

SEQ ID NO: 1777007 - protein, 9 aa, Staphylococcus epidermidis
EKRKAKELK

SEQ ID NO: 1777008 - protein, 4 aa, Staphylococcus epidermidis
EKRM

SEQ ID NO: 1777009 - protein, 7 aa, Staphylococcus epidermidis
EKRNDQT

SEQ ID NO: 1777010 - protein, 71 aa, Staphylococcus epidermidis
EKRNNSSASNQSASSYQSSENGYRSDSDNSVVNEDSGQKYEYDNSTIDVENSNSDSSHYIQRTSEDNYFQN

SEQ ID NO: 1777011 - protein, 5 aa, Staphylococcus epidermidis
EKRNQ

SEQ ID NO: 1777012 - protein, 8 aa, Staphylococcus epidermidis
EKRNRDNI

SEQ ID NO: 1777013 - protein, 8 aa, Staphylococcus epidermidis
EKRNRENL

SEQ ID NO: 1777014 - protein, 6 aa, Staphylococcus epidermidis
EKRPDL

SEQ ID NO: 1777015 - protein, 17 aa, Staphylococcus epidermidis
EKRTNNVVKKSDWDKGD

SEQ ID NO: 1777016 - protein, 6 aa, Staphylococcus epidermidis
EKRTQL

SEQ ID NO: 1777017 - protein, 9 aa, Staphylococcus epidermidis
EKSDANIDQ

SEQ ID NO: 1777018 - protein, 7 aa, Staphylococcus epidermidis
EKSDQNI

SEQ ID NO: 1777019 - protein, 8 aa, Staphylococcus epidermidis
EKSDQQLN

SEQ ID NO: 1777020 - protein, 7 aa, Staphylococcus epidermidis
EKSGDQH

SEQ ID NO: 1777021 - protein, 5 aa, Staphylococcus epidermidis
EKSID

SEQ ID NO: 1777022 - protein, 7 aa, Staphylococcus epidermidis
EKSKESY

SEQ ID NO: 1777023 - protein, 11 aa, Staphylococcus epidermidis
EKSKTKQIEIP

SEQ ID NO: 1777024 - protein, 6 aa, Staphylococcus epidermidis
EKSQDL

SEQ ID NO: 1777025 - protein, 7 aa, Staphylococcus epidermidis
EKSSEWY

SEQ ID NO: 1777026 - protein, 5 aa, Staphylococcus epidermidis
EKSTV

SEQ ID NO: 1777027 - protein, 11 aa, Staphylococcus epidermidis
EKTFRAGEKVE

SEQ ID NO: 1777028 - protein, 9 aa, Staphylococcus epidermidis
EKTGLSTDE

SEQ ID NO: 1777029 - protein, 5 aa, Staphylococcus epidermidis
EKTHG

SEQ ID NO: 1777030 - protein, 10 aa, Staphylococcus epidermidis
EKTKQEKDAI

SEQ ID NO: 1777031 - protein, 7 aa, Staphylococcus epidermidis
EKTLKVE

SEQ ID NO: 1777032 - protein, 4 aa, Staphylococcus epidermidis
EKTP

SEQ ID NO: 1777033 - protein, 6 aa, Staphylococcus epidermidis
EKTYPE

SEQ ID NO: 1777034 - protein, 11 aa, Staphylococcus epidermidis
EKVDDKETAKI

SEQ ID NO: 1777035 - protein, 9 aa, Staphylococcus epidermidis
EKVDKKTYK

SEQ ID NO: 1777036 - protein, 5 aa, Staphylococcus epidermidis
EKVDP

SEQ ID NO: 1777037 - protein, 13 aa, Staphylococcus epidermidis
EKVEQGQYRHTTT

SEQ ID NO: 1777038 - protein, 13 aa, Staphylococcus epidermidis
EKVEQGYYQPTTT

SEQ ID NO: 1777039 - protein, 12 aa, Staphylococcus epidermidis
EKVIPGNTDIAN

SEQ ID NO: 1777040 - protein, 20 aa, Staphylococcus epidermidis
EKVNENKENVTEQSKNLFDR

SEQ ID NO: 1777041 - protein, 17 aa, Staphylococcus epidermidis
EKVNQGKKYGNTRPKPL

SEQ ID NO: 1777042 - protein, 11 aa, Staphylococcus epidermidis
EKVSSDDFDKI

SEQ ID NO: 1777043 - protein, 8 aa, Staphylococcus epidermidis
EKWSETAK

SEQ ID NO: 1777044 - protein, 11 aa, Staphylococcus epidermidis
EKWTDNKPPQG

SEQ ID NO: 1777045 - protein, 28 aa, Staphylococcus epidermidis
EKYDTAPTVGKGGASIATTGSAGVANTS

SEQ ID NO: 1777046 - protein, 28 aa, Staphylococcus epidermidis
EKYDTPPTVGKGGASIATTGSAGVANTS

SEQ ID NO: 1777047 - protein, 27 aa, Staphylococcus epidermidis
EKYEEANDKTYINAKKQTKNKLGKVDE

SEQ ID NO: 1777048 - protein, 11 aa, Staphylococcus epidermidis
EKYGKDESKKR

SEQ ID NO: 1777049 - protein, 6 aa, Staphylococcus epidermidis
EKYGQR

SEQ ID NO: 1777050 - protein, 5 aa, Staphylococcus epidermidis
EKYHN

SEQ ID NO: 1777051 - protein, 11 aa, Staphylococcus epidermidis
EKYIKNGRDIE

SEQ ID NO: 1777052 - protein, 14 aa, Staphylococcus epidermidis
EKYKAQQQKTDIQR

SEQ ID NO: 1777053 - protein, 36 aa, Staphylococcus epidermidis
EKYKKEQERQAALAKQSAQQSKQKTQVRKKTGLSYK

SEQ ID NO: 1777054 - protein, 12 aa, Staphylococcus epidermidis
EKYKYDKEKEAK

SEQ ID NO: 1777055 - protein, 5 aa, Staphylococcus epidermidis
EKYPE

SEQ ID NO: 1777056 - protein, 27 aa, Staphylococcus epidermidis
EKYQEANDKTYINAKKQTENKLGKVDE

SEQ ID NO: 1777057 - protein, 11 aa, Staphylococcus epidermidis
EKYRKDTCKEK

SEQ ID NO: 1777058 - protein, 4 aa, Staphylococcus epidermidis
EKYS

SEQ ID NO: 1777059 - protein, 7 aa, Staphylococcus epidermidis
ELAESIE

SEQ ID NO: 1777060 - protein, 6 aa, Staphylococcus epidermidis
ELAKED

SEQ ID NO: 1777061 - protein, 11 aa, Staphylococcus epidermidis
ELAQDRDIHEG

SEQ ID NO: 1777062 - protein, 7 aa, Staphylococcus epidermidis
ELAQYRK

SEQ ID NO: 1777063 - protein, 6 aa, Staphylococcus epidermidis
ELARTG

SEQ ID NO: 1777064 - protein, 8 aa, Staphylococcus epidermidis
ELATQEGL

SEQ ID NO: 1777065 - protein, 20 aa, Staphylococcus epidermidis
ELDDSLKTDVTNTIIAHSCI

SEQ ID NO: 1777066 - protein, 11 aa, Staphylococcus epidermidis
ELDKDKSTIAQ

SEQ ID NO: 1777067 - protein, 18 aa, Staphylococcus epidermidis
ELDKTKASSENFGEESLN

SEQ ID NO: 1777068 - protein, 18 aa, Staphylococcus epidermidis
ELDKTNASSENFGEESLN

SEQ ID NO: 1777069 - protein, 13 aa, Staphylococcus epidermidis
ELDKTVSNFSGGM

SEQ ID NO: 1777070 - protein, 4 aa, Staphylococcus epidermidis
ELDN

SEQ ID NO: 1777071 - protein, 21 aa, Staphylococcus epidermidis
ELEAEREAQIARGEMPRYGGQ

SEQ ID NO: 1777072 - protein, 6 aa, Staphylococcus epidermidis
ELEAGQ

SEQ ID NO: 1777073 - protein, 9 aa, Staphylococcus epidermidis
ELEDKADIS

SEQ ID NO: 1777074 - protein, 20 aa, Staphylococcus epidermidis
ELEEEREGQIARGEMPRYGG

SEQ ID NO: 1777075 - protein, 16 aa, Staphylococcus epidermidis
ELEENHEIKNDSAFEQ

SEQ ID NO: 1777076 - protein, 4 aa, Staphylococcus epidermidis
ELEG

SEQ ID NO: 1777077 - protein, 14 aa, Staphylococcus epidermidis
ELEHKGKVNYPNTE

SEQ ID NO: 1777078 - protein, 4 aa, Staphylococcus epidermidis
ELEN

SEQ ID NO: 1777079 - protein, 7 aa, Staphylococcus epidermidis
ELENSQS

SEQ ID NO: 1777080 - protein, 6 aa, Staphylococcus epidermidis
ELEPND

SEQ ID NO: 1777081 - protein, 7 aa, Staphylococcus epidermidis
ELERHRE

SEQ ID NO: 1777082 - protein, 8 aa, Staphylococcus epidermidis
ELGGDAKS

SEQ ID NO: 1777083 - protein, 8 aa, Staphylococcus epidermidis
ELGGEEKL

SEQ ID NO: 1777084 - protein, 8 aa, Staphylococcus epidermidis
ELGGKSPY

SEQ ID NO: 1777085 - protein, 13 aa, Staphylococcus epidermidis
ELGGNTVDPSIRP

SEQ ID NO: 1777086 - protein, 8 aa, Staphylococcus epidermidis
ELGNKNGM

SEQ ID NO: 1777087 - protein, 9 aa, Staphylococcus epidermidis
ELGSAQKRK

SEQ ID NO: 1777088 - protein, 8 aa, Staphylococcus epidermidis
ELGSPLSV

SEQ ID NO: 1777089 - protein, 5 aa, Staphylococcus epidermidis
ELGTK

SEQ ID NO: 1777090 - protein, 5 aa, Staphylococcus epidermidis
ELGTT

SEQ ID NO: 1777091 - protein, 8 aa, Staphylococcus epidermidis
ELIGKPPK

SEQ ID NO: 1777092 - protein, 7 aa, Staphylococcus epidermidis
ELKADNV

SEQ ID NO: 1777093 - protein, 9 aa, Staphylococcus epidermidis
ELKDENKID

SEQ ID NO: 1777094 - protein, 17 aa, Staphylococcus epidermidis
ELKEKDKNLDGNDIREG

SEQ ID NO: 1777095 - protein, 11 aa, Staphylococcus epidermidis
ELKESYGIAPE

SEQ ID NO: 1777096 - protein, 4 aa, Staphylococcus epidermidis
ELKI

SEQ ID NO: 1777097 - protein, 7 aa, Staphylococcus epidermidis
ELKNRKS

SEQ ID NO: 1777098 - protein, 5 aa, Staphylococcus epidermidis
ELKNS

SEQ ID NO: 1777099 - protein, 92 aa, Staphylococcus epidermidis
ELKPEQRHKQNASYSTNESSRSSESESGSTTYSTSSNEDSNDIEHSESMSQQDYRYPNPKDAASNNGNDENLQSNNDDHDSNTNDVETSNTD

SEQ ID NO: 1777100 - protein, 4 aa, Staphylococcus epidermidis
ELKQ

SEQ ID NO: 1777101 - protein, 5 aa, Staphylococcus epidermidis
ELKQK

SEQ ID NO: 1777102 - protein, 14 aa, Staphylococcus epidermidis
ELKRSLKSKFKDNP

SEQ ID NO: 1777103 - protein, 16 aa, Staphylococcus epidermidis
ELKSQQADKEAQQAQI

SEQ ID NO: 1777104 - protein, 8 aa, Staphylococcus epidermidis
ELKTGHPM

SEQ ID NO: 1777105 - protein, 9 aa, Staphylococcus epidermidis
ELKTNSKTI

SEQ ID NO: 1777106 - protein, 4 aa, Staphylococcus epidermidis
ELKY

SEQ ID NO: 1777107 - protein, 15 aa, Staphylococcus epidermidis
ELNEEKEQLEQTYET

SEQ ID NO: 1777108 - protein, 6 aa, Staphylococcus epidermidis
ELNKEK

SEQ ID NO: 1777109 - protein, 7 aa, Staphylococcus epidermidis
ELNNNGA

SEQ ID NO: 1777110 - protein, 6 aa, Staphylococcus epidermidis
ELNPRG

SEQ ID NO: 1777111 - protein, 12 aa, Staphylococcus epidermidis
ELNQEGSIDDYG

SEQ ID NO: 1777112 - protein, 6 aa, Staphylococcus epidermidis
ELNRTH

SEQ ID NO: 1777113 - protein, 10 aa, Staphylococcus epidermidis
ELNTKPPKYL

SEQ ID NO: 1777114 - protein, 5 aa, Staphylococcus epidermidis
ELNTT

SEQ ID NO: 1777115 - protein, 6 aa, Staphylococcus epidermidis
ELPEEL

SEQ ID NO: 1777116 - protein, 8 aa, Staphylococcus epidermidis
ELPKNARN

SEQ ID NO: 1777117 - protein, 41 aa, Staphylococcus epidermidis; identical to SEQ ID NO: 1636365

SEQ ID NO: 1777118 - protein, 5 aa, Staphylococcus epidermidis
ELPQA

SEQ ID NO: 1777119 - protein, 7 aa, Staphylococcus epidermidis
ELPSGAR

SEQ ID NO: 1777120 - protein, 8 aa, Staphylococcus epidermidis
ELPTLREK

SEQ ID NO: 1777121 - protein, 10 aa, Staphylococcus epidermidis
ELQELGSNGQ

SEQ ID NO: 1777122 - protein, 12 aa, Staphylococcus epidermidis
ELQQQTTIDDYL

SEQ ID NO: 1777123 - protein, 11 aa, Staphylococcus epidermidis
ELQSQGTLSTE

SEQ ID NO: 1777124 - protein, 6 aa, Staphylococcus epidermidis
ELQTVT

SEQ ID NO: 1777125 - protein, 10 aa, Staphylococcus epidermidis
ELRADKKVDG

SEQ ID NO: 1777126 - protein, 4 aa, Staphylococcus epidermidis
ELRE

SEQ ID NO: 1777127 - protein, 7 aa, Staphylococcus epidermidis
ELRKGRQ

SEQ ID NO: 1777128 - protein, 12 aa, Staphylococcus epidermidis
ELRNGKSKVKNL

SEQ ID NO: 1777129 - protein, 5 aa, Staphylococcus epidermidis
ELRQT

SEQ ID NO: 1777130 - protein, 10 aa, Staphylococcus epidermidis
ELSAEDATDL

SEQ ID NO: 1777131 - protein, 12 aa, Staphylococcus epidermidis
ELSDEEYETTET

SEQ ID NO: 1777132 - protein, 4 aa, Staphylococcus epidermidis
ELSE

SEQ ID NO: 1777133 - protein, 10 aa, Staphylococcus epidermidis
ELSEEDQATF

SEQ ID NO: 1777134 - protein, 9 aa, Staphylococcus epidermidis
ELSEGNRSM

SEQ ID NO: 1777135 - protein, 7 aa, Staphylococcus epidermidis
ELSEKVQ

SEQ ID NO: 1777136 - protein, 7 aa, Staphylococcus epidermidis
ELSESDQ

SEQ ID NO: 1777137 - protein, 8 aa, Staphylococcus epidermidis
ELSGAHGR

SEQ ID NO: 1777138 - protein, 9 aa, Staphylococcus epidermidis
ELSGGQQKR

SEQ ID NO: 1777139 - protein, 15 aa, Staphylococcus epidermidis
ELSGRKEMKIEEPQT

SEQ ID NO: 1777140 - protein, 10 aa, Staphylococcus epidermidis
ELSKERRRVA

SEQ ID NO: 1777141 - protein, 5 aa, Staphylococcus epidermidis
ELSPL

SEQ ID NO: 1777142 - protein, 7 aa, Staphylococcus epidermidis
ELSPSIS

SEQ ID NO: 1777143 - protein, 12 aa, Staphylococcus epidermidis
ELSSDENEDRYE

SEQ ID NO: 1777144 - protein, 7 aa, Staphylococcus epidermidis
ELTDENE

SEQ ID NO: 1777145 - protein, 5 aa, Staphylococcus epidermidis
ELTDR

SEQ ID NO: 1777146 - protein, 5 aa, Staphylococcus epidermidis
ELTEY

SEQ ID NO: 1777147 - protein, 9 aa, Staphylococcus epidermidis
ELTGSNTTV

SEQ ID NO: 1777148 - protein, 8 aa, Staphylococcus epidermidis
ELTKEGKD

SEQ ID NO: 1777149 - protein, 8 aa, Staphylococcus epidermidis
ELTNKDKS

SEQ ID NO: 1777150 - protein, 9 aa, Staphylococcus epidermidis
ELTSEDEDV

SEQ ID NO: 1777151 - protein, 6 aa, Staphylococcus epidermidis
ELYEEG

SEQ ID NO: 1777152 - protein, 5 aa, Staphylococcus epidermidis
EMAER

SEQ ID NO: 1777153 - protein, 21 aa, Staphylococcus epidermidis
EMDREEENKLKHQKFPQSMMH

SEQ ID NO: 1777154 - protein, 10 aa, Staphylococcus epidermidis
EMEDEPVRAI

SEQ ID NO: 1777155 - protein, 4 aa, Staphylococcus epidermidis
EMIE

SEQ ID NO: 1777156 - protein, 6 aa, Staphylococcus epidermidis
EMPKSG

SEQ ID NO: 1777157 - protein, 21 aa, Staphylococcus epidermidis
EMQQQRDRARQARQNSQSMQI

SEQ ID NO: 1777158 - protein, 5 aa, Staphylococcus epidermidis
EMQRD

SEQ ID NO: 1777159 - protein, 5 aa, Staphylococcus epidermidis
EMRAA

SEQ ID NO: 1777160 - protein, 4 aa, Staphylococcus epidermidis
EMRK

SEQ ID NO: 1777161 - protein, 9 aa, Staphylococcus epidermidis
EMSEPLGTH

SEQ ID NO: 1777162 - protein, 4 aa, Staphylococcus epidermidis
EMSP

SEQ ID NO: 1777163 - protein, 5 aa, Staphylococcus epidermidis
EMSQS

SEQ ID NO: 1777164 - protein, 5 aa, Staphylococcus epidermidis
EMTEQ

SEQ ID NO: 1777165 - protein, 12 aa, Staphylococcus epidermidis
EMTTSQGKVKKG

SEQ ID NO: 1777166 - protein, 5 aa, Staphylococcus epidermidis
ENAAT

SEQ ID NO: 1777167 - protein, 5 aa, Staphylococcus epidermidis
ENADM

SEQ ID NO: 1777168 - protein, 4 aa, Staphylococcus epidermidis
ENAG

SEQ ID NO: 1777169 - protein, 5 aa, Staphylococcus epidermidis
ENAGD

SEQ ID NO: 1777170 - protein, 7 aa, Staphylococcus epidermidis
ENAGTSF

SEQ ID NO: 1777171 - protein, 6 aa, Staphylococcus epidermidis
ENAIPD

SEQ ID NO: 1777172 - protein, 6 aa, Staphylococcus epidermidis
ENAIPE

SEQ ID NO: 1777173 - protein, 11 aa, Staphylococcus epidermidis
ENAKNNGLKTK

SEQ ID NO: 1777174 - protein, 29 aa, Staphylococcus epidermidis
ENANDNGLDNSKIKSQIDELRSKNNFPKN

SEQ ID NO: 1777175 - protein, 8 aa, Staphylococcus epidermidis
ENANNNGL

SEQ ID NO: 1777176 - protein, 12 aa, Staphylococcus epidermidis
ENANRNRQTIKT

SEQ ID NO: 1777177 - protein, 18 aa, Staphylococcus epidermidis
ENAPNDTTKIWIDTTGGN

SEQ ID NO: 1777178 - protein, 4 aa, Staphylococcus epidermidis
ENAQ

SEQ ID NO: 1777179 - protein, 5 aa, Staphylococcus epidermidis
ENASI

SEQ ID NO: 1777180 - protein, 7 aa, Staphylococcus epidermidis
ENATLDD

SEQ ID NO: 1777181 - protein, 13 aa, Staphylococcus epidermidis
ENATQPIKGEILK

SEQ ID NO: 1777182 - protein, 6 aa, Staphylococcus epidermidis
ENAVAE

SEQ ID NO: 1777183 - protein, 6 aa, Staphylococcus epidermidis
ENAVPN

SEQ ID NO: 1777184 - protein, 9 aa, Staphylococcus epidermidis
ENCSTKNEN

SEQ ID NO: 1777185 - protein, 9 aa, Staphylococcus epidermidis
ENDDRAQEN

SEQ ID NO: 1777186 - protein, 17 aa, Staphylococcus epidermidis
ENDEDAVKIANDSEYGL

SEQ ID NO: 1777187 - protein, 7 aa, Staphylococcus epidermidis
ENDELDG

SEQ ID NO: 1777188 - protein, 7 aa, Staphylococcus epidermidis
ENDENYR

SEQ ID NO: 1777189 - protein, 8 aa, Staphylococcus epidermidis
ENDETAFS

SEQ ID NO: 1777190 - protein, 7 aa, Staphylococcus epidermidis
ENDINRS

SEQ ID NO: 1777191 - protein, 7 aa, Staphylococcus epidermidis
ENDIQET

SEQ ID NO: 1777192 - protein, 10 aa, Staphylococcus epidermidis
ENDKNKHQRF

SEQ ID NO: 1777193 - protein, 6 aa, Staphylococcus epidermidis
ENDLPQ

SEQ ID NO: 1777194 - protein, 6 aa, Staphylococcus epidermidis
ENDPDV

SEQ ID NO: 1777195 - protein, 5 aa, Staphylococcus epidermidis
ENDPG

SEQ ID NO: 1777196 - protein, 12 aa, Staphylococcus epidermidis
ENDQNIAGQIRE

SEQ ID NO: 1777197 - protein, 4 aa, Staphylococcus epidermidis
ENDS

SEQ ID NO: 1777198 - protein, 12 aa, Staphylococcus epidermidis
ENDSVDLTDNTR

SEQ ID NO: 1777199 - protein, 7 aa, Staphylococcus epidermidis
ENDTEVE

SEQ ID NO: 1777200 - protein, 6 aa, Staphylococcus epidermidis
ENDTTA

SEQ ID NO: 1777201 - protein, 4 aa, Staphylococcus epidermidis
ENDV

SEQ ID NO: 1777202 - protein, 10 aa, Staphylococcus epidermidis
ENDVEKAKNL

SEQ ID NO: 1777203 - protein, 6 aa, Staphylococcus epidermidis
ENDVIS

SEQ ID NO: 1777204 - protein, 17 aa, Staphylococcus epidermidis
ENEADALARDICELIGT

SEQ ID NO: 1777205 - protein, 7 aa, Staphylococcus epidermidis
ENEAYRE

SEQ ID NO: 1777206 - protein, 7 aa, Staphylococcus epidermidis
ENEDNGK

SEQ ID NO: 1777207 - protein, 22 aa, Staphylococcus epidermidis
ENEELKAEKALSQMKNETRSML

SEQ ID NO: 1777208 - protein, 20 aa, Staphylococcus epidermidis
ENEELKAEKALSQMKNETRT

SEQ ID NO: 1777209 - protein, 7 aa, Staphylococcus epidermidis
ENEFNDK

SEQ ID NO: 1777210 - protein, 5 aa, Staphylococcus epidermidis
ENEGQ

SEQ ID NO: 1777211 - protein, 5 aa, Staphylococcus epidermidis
ENEHR

SEQ ID NO: 1777212 - protein, 10 aa, Staphylococcus epidermidis
ENEKEINAQQ

SEQ ID NO: 1777213 - protein, 17 aa, Staphylococcus epidermidis
ENEKNYPDAIETGKEGL

SEQ ID NO: 1777214 - protein, 7 aa, Staphylococcus epidermidis
ENELIDK

SEQ ID NO: 1777215 - protein, 5 aa, Staphylococcus epidermidis
ENENE

SEQ ID NO: 1777216 - protein, 6 aa, Staphylococcus epidermidis
ENEQPD

SEQ ID NO: 1777217 - protein, 8 aa, Staphylococcus epidermidis
ENEQQKGR

SEQ ID NO: 1777218 - protein, 6 aa, Staphylococcus epidermidis
ENEQTR

SEQ ID NO: 1777219 - protein, 7 aa, Staphylococcus epidermidis
ENEQVDS

SEQ ID NO: 1777220 - protein, 15 aa, Staphylococcus epidermidis
ENEREVIDRLQFATQ

SEQ ID NO: 1777221 - protein, 4 aa, Staphylococcus epidermidis
ENES

SEQ ID NO: 1777222 - protein, 17 aa, Staphylococcus epidermidis
ENESKLNNVAKTEEGRV

SEQ ID NO: 1777223 - protein, 7 aa, Staphylococcus epidermidis
ENESNPI

SEQ ID NO: 1777224 - protein, 11 aa, Staphylococcus epidermidis
ENESNYQVTTT

SEQ ID NO: 1777225 - protein, 8 aa, Staphylococcus epidermidis
ENETIEES

SEQ ID NO: 1777226 - protein, 30 aa, Staphylococcus epidermidis
ENEYTQKNESYNEHSQEETNDTMSSYNQHD

SEQ ID NO: 1777227 - protein, 7 aa, Staphylococcus epidermidis
ENFGKAK

SEQ ID NO: 1777228 - protein, 4 aa, Staphylococcus epidermidis
ENGA

SEQ ID NO: 1777229 - protein, 5 aa, Staphylococcus epidermidis
ENGEI

SEQ ID NO: 1777230 - protein, 6 aa, Staphylococcus epidermidis
ENGFSD

SEQ ID NO: 1777231 - protein, 9 aa, Staphylococcus epidermidis
ENGGVSEYE

SEQ ID NO: 1777232 - protein, 10 aa, Staphylococcus epidermidis
ENGIADDLSY

SEQ ID NO: 1777233 - protein, 6 aa, Staphylococcus epidermidis
ENGKLD

SEQ ID NO: 1777234 - protein, 8 aa, Staphylococcus epidermidis
ENGLDGSR

SEQ ID NO: 1777235 - protein, 8 aa, Staphylococcus epidermidis
ENGLGDST

SEQ ID NO: 1777236 - protein, 6 aa, Staphylococcus epidermidis
ENGLGY

SEQ ID NO: 1777237 - protein, 10 aa, Staphylococcus epidermidis
ENGPKRDEYI

SEQ ID NO: 1777238 - protein, 7 aa, Staphylococcus epidermidis
ENGQGII

SEQ ID NO: 1777239 - protein, 10 aa, Staphylococcus epidermidis
ENGSGKSGFT

SEQ ID NO: 1777240 - protein, 8 aa, Staphylococcus epidermidis
ENGSGKSN

SEQ ID NO: 1777241 - protein, 6 aa, Staphylococcus epidermidis
ENGSKA

SEQ ID NO: 1777242 - protein, 4 aa, Staphylococcus epidermidis
ENHP

SEQ ID NO: 1777243 - protein, 7 aa, Staphylococcus epidermidis
ENHSEGG

SEQ ID NO: 1777244 - protein, 7 aa, Staphylococcus epidermidis
ENHSEGL

SEQ ID NO: 1777245 - protein, 6 aa, Staphylococcus epidermidis
ENINNE

SEQ ID NO: 1777246 - protein, 6 aa, Staphylococcus epidermidis
ENISGK

SEQ ID NO: 1777247 - protein, 6 aa, Staphylococcus epidermidis
ENITAS

SEQ ID NO: 1777248 - protein, 8 aa, Staphylococcus epidermidis
ENITTPKE

SEQ ID NO: 1777249 - protein, 6 aa, Staphylococcus epidermidis
ENKGAW

SEQ ID NO: 1777250 - protein, 16 aa, Staphylococcus epidermidis
ENKGKRSGGYSSGAHL

SEQ ID NO: 1777251 - protein, 14 aa, Staphylococcus epidermidis
ENKGKVSLTMIDPN

SEQ ID NO: 1777252 - protein, 14 aa, Staphylococcus epidermidis
ENKGKVSLTMVDPN

SEQ ID NO: 1777253 - protein, 5 aa, Staphylococcus epidermidis
ENKIQ

SEQ ID NO: 1777254 - protein, 8 aa, Staphylococcus epidermidis
ENKKINKL

SEQ ID NO: 1777255 - protein, 21 aa, Staphylococcus epidermidis
ENKKVRGKNLGEQFDKGALEN

SEQ ID NO: 1777256 - protein, 25 aa, Staphylococcus epidermidis
ENKLTLDRTDSGKLPSNVDGTTRST

SEQ ID NO: 1777257 - protein, 8 aa, Staphylococcus epidermidis
ENKNESKI

SEQ ID NO: 1777258 - protein, 4 aa, Staphylococcus epidermidis
ENKP

SEQ ID NO: 1777259 - protein, 7 aa, Staphylococcus epidermidis
ENKRDDY

SEQ ID NO: 1777260 - protein, 8 aa, Staphylococcus epidermidis
ENKSGYNS

SEQ ID NO: 1777261 - protein, 9 aa, Staphylococcus epidermidis
ENKTEEDII

SEQ ID NO: 1777262 - protein, 6 aa, Staphylococcus epidermidis
ENLEKQ

SEQ ID NO: 1777263 - protein, 11 aa, Staphylococcus epidermidis
ENLGQVASQTL

SEQ ID NO: 1777264 - protein, 7 aa, Staphylococcus epidermidis
ENLPGTK

SEQ ID NO: 1777265 - protein, 8 aa, Staphylococcus epidermidis
ENLTGGNK

SEQ ID NO: 1777266 - protein, 7 aa, Staphylococcus epidermidis
ENMNPYQ

SEQ ID NO: 1777267 - protein, 7 aa, Staphylococcus epidermidis
ENNAQSE

SEQ ID NO: 1777268 - protein, 10 aa, Staphylococcus epidermidis
ENNDQPDIAN

SEQ ID NO: 1777269 - protein, 5 aa, Staphylococcus epidermidis
ENNEI

SEQ ID NO: 1777270 - protein, 9 aa, Staphylococcus epidermidis
ENNGPKRFD

SEQ ID NO: 1777271 - protein, 9 aa, Staphylococcus epidermidis
ENNGQGHRD

SEQ ID NO: 1777272 - protein, 7 aa, Staphylococcus epidermidis
ENNHATE

SEQ ID NO: 1777273 - protein, 11 aa, Staphylococcus epidermidis
ENNIDVTTSTE

SEQ ID NO: 1777274 - protein, 5 aa, Staphylococcus epidermidis
ENNIG

SEQ ID NO: 1777275 - protein, 7 aa, Staphylococcus epidermidis
ENNKKTY

SEQ ID NO: 1777276 - protein, 6 aa, Staphylococcus epidermidis
ENNLDN

SEQ ID NO: 1777277 - protein, 7 aa, Staphylococcus epidermidis
ENNSEKV

SEQ ID NO: 1777278 - protein, 15 aa, Staphylococcus epidermidis
ENNTSLTKKEWDKEI

SEQ ID NO: 1777279 - protein, 4 aa, Staphylococcus epidermidis
ENPE

SEQ ID NO: 1777280 - protein, 7 aa, Staphylococcus epidermidis
ENPEKEL

SEQ ID NO: 1777281 - protein, 4 aa, Staphylococcus epidermidis
ENPH

SEQ ID NO: 1777282 - protein, 4 aa, Staphylococcus epidermidis
ENPN

SEQ ID NO: 1777283 - protein, 6 aa, Staphylococcus epidermidis
ENPNTL

SEQ ID NO: 1777284 - protein, 5 aa, Staphylococcus epidermidis
ENPQN

SEQ ID NO: 1777285 - protein, 11 aa, Staphylococcus epidermidis
ENQIKQNQYSN

SEQ ID NO: 1777286 - protein, 10 aa, Staphylococcus epidermidis
ENQKLDAGEY

SEQ ID NO: 1777287 - protein, 7 aa, Staphylococcus epidermidis
ENQKSKL

SEQ ID NO: 1777288 - protein, 5 aa, Staphylococcus epidermidis
ENQLY

SEQ ID NO: 1777289 - protein, 8 aa, Staphylococcus epidermidis
ENQNGEVI

SEQ ID NO: 1777290 - protein, 18 aa, Staphylococcus epidermidis
ENQRKAAELKKQQIDEEG

SEQ ID NO: 1777291 - protein, 8 aa, Staphylococcus epidermidis
ENQVDGHS

SEQ ID NO: 1777292 - protein, 33 aa, Staphylococcus epidermidis
ENQVSKDPSITSGSPFVNEDTDKQKAYNDAVQA

SEQ ID NO: 1777293 - protein, 13 aa, Staphylococcus epidermidis
ENQYRELERLSQN

SEQ ID NO: 1777294 - protein, 12 aa, Staphylococcus epidermidis
ENRIENLSLLPL

SEQ ID NO: 1777295 - protein, 6 aa, Staphylococcus epidermidis
ENRISQ

SEQ ID NO: 1777296 - protein, 17 aa, Staphylococcus epidermidis
ENRKKRIQSLSKGNQQK

SEQ ID NO: 1777297 - protein, 7 aa, Staphylococcus epidermidis
ENRSNGK

SEQ ID NO: 1777298 - protein, 8 aa, Staphylococcus epidermidis
ENRYEVGS

SEQ ID NO: 1777299 - protein, 5 aa, Staphylococcus epidermidis
ENSEE

SEQ ID NO: 1777300 - protein, 4 aa, Staphylococcus epidermidis
ENSI

SEQ ID NO: 1777301 - protein, 11 aa, Staphylococcus epidermidis
ENSKDTLKQFS

SEQ ID NO: 1777302 - protein, 5 aa, Staphylococcus epidermidis
ENSNA

SEQ ID NO: 1777303 - protein, 6 aa, Staphylococcus epidermidis
ENSNEY

SEQ ID NO: 1777304 - protein, 21 aa, Staphylococcus epidermidis
ENSRVDRQLRGRAGRQGDPGV

SEQ ID NO: 1777305 - protein, 10 aa, Staphylococcus epidermidis
ENSTKADHRN

SEQ ID NO: 1777306 - protein, 4 aa, Staphylococcus epidermidis
ENTC

SEQ ID NO: 1777307 - protein, 6 aa, Staphylococcus epidermidis
ENTDVT

SEQ ID NO: 1777308 - protein, 10 aa, Staphylococcus epidermidis
ENTFKGNHTS

SEQ ID NO: 1777309 - protein, 16 aa, Staphylococcus epidermidis
ENTITLDRSDSGLLPT

SEQ ID NO: 1777310 - protein, 9 aa, Staphylococcus epidermidis
ENTKSEELD

SEQ ID NO: 1777311 - protein, 4 aa, Staphylococcus epidermidis
ENTP

SEQ ID NO: 1777312 - protein, 5 aa, Staphylococcus epidermidis
ENTPT

SEQ ID NO: 1777313 - protein, 4 aa, Staphylococcus epidermidis
ENTR

SEQ ID NO: 1777314 - protein, 13 aa, Staphylococcus epidermidis
ENTRVGQSSDYDK

SEQ ID NO: 1777315 - protein, 7 aa, Staphylococcus epidermidis
ENTSDIS

SEQ ID NO: 1777316 - protein, 7 aa, Staphylococcus epidermidis
ENTTSTK

SEQ ID NO: 1777317 - protein, 5 aa, Staphylococcus epidermidis
ENTTY

SEQ ID NO: 1777318 - protein, 5 aa, Staphylococcus epidermidis
ENVDE

SEQ ID NO: 1777319 - protein, 5 aa, Staphylococcus epidermidis
ENVEA

SEQ ID NO: 1777320 - protein, 11 aa, Staphylococcus epidermidis
ENVESVQPNPE

SEQ ID NO: 1777321 - protein, 8 aa, Staphylococcus epidermidis
ENVKKSDK

SEQ ID NO: 1777322 - protein, 11 aa, Staphylococcus epidermidis
ENVKNEKDAAV

SEQ ID NO: 1777323 - protein, 21 aa, Staphylococcus epidermidis
ENVKTNANVKPKADKTNPSHI

SEQ ID NO: 1777324 - protein, 10 aa, Staphylococcus epidermidis
ENVQEGSKDV

SEQ ID NO: 1777325 - protein, 8 aa, Staphylococcus epidermidis
ENYDSGHI

SEQ ID NO: 1777326 - protein, 10 aa, Staphylococcus epidermidis
ENYDTSDKQL

SEQ ID NO: 1777327 - protein, 4 aa, Staphylococcus epidermidis
ENYE

SEQ ID NO: 1777328 - protein, 13 aa, Staphylococcus epidermidis
ENYEQSTSQLREE

SEQ ID NO: 1777329 - protein, 6 aa, Staphylococcus epidermidis
ENYITQ

SEQ ID NO: 1777330 - protein, 5 aa, Staphylococcus epidermidis
ENYNE

SEQ ID NO: 1777331 - protein, 5 aa, Staphylococcus epidermidis
ENYNR

SEQ ID NO: 1777332 - protein, 24 aa, Staphylococcus epidermidis
ENYQKSKIDKEVEKNSIKGGDEYD

SEQ ID NO: 1777333 - protein, 21 aa, Staphylococcus epidermidis
ENYSKDGKTLGRPKRDDKNLR

SEQ ID NO: 1777334 - protein, 8 aa, Staphylococcus epidermidis
EPAGASSM

SEQ ID NO: 1777335 - protein, 14 aa, Staphylococcus epidermidis
EPDDSKNSNENHGV

SEQ ID NO: 1777336 - protein, 10 aa, Staphylococcus epidermidis
EPDTTYPKGT

SEQ ID NO: 1777337 - protein, 6 aa, Staphylococcus epidermidis
EPEDGI

SEQ ID NO: 1777338 - protein, 5 aa, Staphylococcus epidermidis
EPEIS

SEQ ID NO: 1777339 - protein, 9 aa, Staphylococcus epidermidis
EPEPDKVKA

SEQ ID NO: 1777340 - protein, 6 aa, Staphylococcus epidermidis
EPEPHE

SEQ ID NO: 1777341 - protein, 13 aa, Staphylococcus epidermidis
EPEPHEKDQDWID

SEQ ID NO: 1777342 - protein, 20 aa, Staphylococcus epidermidis
EPEQLEKSLKEAKSEGQKYF

SEQ ID NO: 1777343 - protein, 4 aa, Staphylococcus epidermidis
EPET

SEQ ID NO: 1777344 - protein, 5 aa, Staphylococcus epidermidis
EPFEE

SEQ ID NO: 1777345 - protein, 5 aa, Staphylococcus epidermidis
EPFEP

SEQ ID NO: 1777346 - protein, 5 aa, Staphylococcus epidermidis
EPGAE

SEQ ID NO: 1777347 - protein, 22 aa, Staphylococcus epidermidis
EPGGEHKETIETGTKAAARGGF

SEQ ID NO: 1777348 - protein, 6 aa, Staphylococcus epidermidis
EPGGIK

SEQ ID NO: 1777349 - protein, 13 aa, Staphylococcus epidermidis
EPGKIYNNGEPEN

SEQ ID NO: 1777350 - protein, 15 aa, Staphylococcus epidermidis
EPGLSPEALKNKYGI

SEQ ID NO: 1777351 - protein, 4 aa, Staphylococcus epidermidis
EPHF

SEQ ID NO: 1777352 - protein, 11 aa, Staphylococcus epidermidis
EPHHVDEQTNK

SEQ ID NO: 1777353 - protein, 15 aa, Staphylococcus epidermidis
EPIAEEYQANRQKKH

SEQ ID NO: 1777354 - protein, 18 aa, Staphylococcus epidermidis
EPIDTSDIPKDLKRNEKV

SEQ ID NO: 1777355 - protein, 4 aa, Staphylococcus epidermidis
EPIN

SEQ ID NO: 1777356 - protein, 9 aa, Staphylococcus epidermidis
EPISGKSYV

SEQ ID NO: 1777357 - protein, 10 aa, Staphylococcus epidermidis
EPKGKNMESR

SEQ ID NO: 1777358 - protein, 65 aa, Staphylococcus epidermidis
EPKNSQQGGQRSQNNDFQDYGQGFGGQQSGQNTSYNNNNSSKSNQSDNPFANANGPIDISDDDLP

SEQ ID NO: 1777359 - protein, 22 aa, Staphylococcus epidermidis
EPKTTSKSEQQFKAVYENLLNK

SEQ ID NO: 1777360 - protein, 13 aa, Staphylococcus epidermidis
EPKYTSTSAWGKE

SEQ ID NO: 1777361 - protein, 9 aa, Staphylococcus epidermidis
EPLASDNPL

SEQ ID NO: 1777362 - protein, 18 aa, Staphylococcus epidermidis
EPLGGAHKDVESQAATIK

SEQ ID NO: 1777363 - protein, 7 aa, Staphylococcus epidermidis
EPLKTSK

SEQ ID NO: 1777364 - protein, 4 aa, Staphylococcus epidermidis
EPLL

SEQ ID NO: 1777365 - protein, 4 aa, Staphylococcus epidermidis
EPMY

SEQ ID NO: 1777366 - protein, 5 aa, Staphylococcus epidermidis
EPNAD

SEQ ID NO: 1777367 - protein, 8 aa, Staphylococcus epidermidis
EPNEEKLT

SEQ ID NO: 1777368 - protein, 13 aa, Staphylococcus epidermidis
EPNINSQSNTETF

SEQ ID NO: 1777369 - protein, 5 aa, Staphylococcus epidermidis
EPNTD

SEQ ID NO: 1777370 - protein, 6 aa, Staphylococcus epidermidis
EPPDYL

SEQ ID NO: 1777371 - protein, 6 aa, Staphylococcus epidermidis
EPPKNT

SEQ ID NO: 1777372 - protein, 7 aa, Staphylococcus epidermidis
EPPSADP

SEQ ID NO: 1777373 - protein, 5 aa, Staphylococcus epidermidis
EPQDI

SEQ ID NO: 1777374 - protein, 7 aa, Staphylococcus epidermidis
EPQDVEN

SEQ ID NO: 1777375 - protein, 16 aa, Staphylococcus epidermidis
EPQFSEEDKQKIETIS

SEQ ID NO: 1777376 - protein, 8 aa, Staphylococcus epidermidis
EPQIKEGS

SEQ ID NO: 1777377 - protein, 4 aa, Staphylococcus epidermidis
EPQN

SEQ ID NO: 1777378 - protein, 15 aa, Staphylococcus epidermidis
EPQNDVQAMAKQMFM

SEQ ID NO: 1777379 - protein, 6 aa, Staphylococcus epidermidis
EPQNWD

SEQ ID NO: 1777380 - protein, 5 aa, Staphylococcus epidermidis
EPQNY

SEQ ID NO: 1777381 - protein, 7 aa, Staphylococcus epidermidis
EPQPPEN

SEQ ID NO: 1777382 - protein, 9 aa, Staphylococcus epidermidis
EPQVKEGSI

SEQ ID NO: 1777383 - protein, 7 aa, Staphylococcus epidermidis
EPSNPRV

SEQ ID NO: 1777384 - protein, 8 aa, Staphylococcus epidermidis
EPSSNLDV

SEQ ID NO: 1777385 - protein, 5 aa, Staphylococcus epidermidis
EPSYI

SEQ ID NO: 1777386 - protein, 7 aa, Staphylococcus epidermidis
EPSYRDN

SEQ ID NO: 1777387 - protein, 10 aa, Staphylococcus epidermidis
EPTASLDTDN

SEQ ID NO: 1777388 - protein, 5 aa, Staphylococcus epidermidis
EPTEY

SEQ ID NO: 1777389 - protein, 14 aa, Staphylococcus epidermidis
EPTGALDSKSAQDL

SEQ ID NO: 1777390 - protein, 14 aa, Staphylococcus epidermidis
EPTGALDSKSTQDL

SEQ ID NO: 1777391 - protein, 8 aa, Staphylococcus epidermidis
EPTPEKVK

SEQ ID NO: 1777392 - protein, 8 aa, Staphylococcus epidermidis
EPTQKDVQ

SEQ ID NO: 1777393 - protein, 6 aa, Staphylococcus epidermidis
EPTRDE

SEQ ID NO: 1777394 - protein, 13 aa, Staphylococcus epidermidis
EPTSALDKENSDK

SEQ ID NO: 1777395 - protein, 7 aa, Staphylococcus epidermidis
EPTSGMD

SEQ ID NO: 1777396 - protein, 9 aa, Staphylococcus epidermidis
EPTSGVDAN

SEQ ID NO: 1777397 - protein, 21 aa, Staphylococcus epidermidis
EPVDQGGQQEINLTRLRECPI

SEQ ID NO: 1777398 - protein, 21 aa, Staphylococcus epidermidis
EPVDQGGQQEINLTRLRECPV

SEQ ID NO: 1777399 - protein, 4 aa, Staphylococcus epidermidis
EPVK

SEQ ID NO: 1777400 - protein, 5 aa, Staphylococcus epidermidis
EPVSL

SEQ ID NO: 1777401 - protein, 8 aa, Staphylococcus epidermidis
EPVSLQPS

SEQ ID NO: 1777402 - protein, 11 aa, Staphylococcus epidermidis
EPWEPTSSDFY

SEQ ID NO: 1777403 - protein, 10 aa, Staphylococcus epidermidis
EPYEKTVSDS

SEQ ID NO: 1777404 - protein, 4 aa, Staphylococcus epidermidis
EPYN

SEQ ID NO: 1777405 - protein, 4 aa, Staphylococcus epidermidis
EPYP

SEQ ID NO: 1777406 - protein, 6 aa, Staphylococcus epidermidis
EPYPNY

SEQ ID NO: 1777407 - protein, 4 aa, Staphylococcus epidermidis
EPYS

SEQ ID NO: 1777408 - protein, 8 aa, Staphylococcus epidermidis
EPYTEDDS

SEQ ID NO: 1777409 - protein, 9 aa, Staphylococcus epidermidis
EQADDDKLR

SEQ ID NO: 1777410 - protein, 8 aa, Staphylococcus epidermidis
EQAKHGDL

SEQ ID NO: 1777411 - protein, 7 aa, Staphylococcus epidermidis
EQASNEL

SEQ ID NO: 1777412 - protein, 9 aa, Staphylococcus epidermidis
EQASQSVKN

SEQ ID NO: 1777413 - protein, 10 aa, Staphylococcus epidermidis
EQAVDDDTAA

SEQ ID NO: 1777414 - protein, 7 aa, Staphylococcus epidermidis
EQAVEPG

SEQ ID NO: 1777415 - protein, 6 aa, Staphylococcus epidermidis
EQAYDN

SEQ ID NO: 1777416 - protein, 8 aa, Staphylococcus epidermidis
EQAYHKHG

SEQ ID NO: 1777417 - protein, 11 aa, Staphylococcus epidermidis
EQCGSTHPEKL

SEQ ID NO: 1777418 - protein, 5 aa, Staphylococcus epidermidis
EQDER

SEQ ID NO: 1777419 - protein, 9 aa, Staphylococcus epidermidis
EQDRTKGMR

SEQ ID NO: 1777420 - protein, 5 aa, Staphylococcus epidermidis
EQDSI

SEQ ID NO: 1777421 - protein, 6 aa, Staphylococcus epidermidis
EQEAGD

SEQ ID NO: 1777422 - protein, 6 aa, Staphylococcus epidermidis
EQEELE

SEQ ID NO: 1777423 - protein, 5 aa, Staphylococcus epidermidis
EQEHK

SEQ ID NO: 1777424 - protein, 4 aa, Staphylococcus epidermidis
EQEI

SEQ ID NO: 1777425 - protein, 6 aa, Staphylococcus epidermidis
EQEISA

SEQ ID NO: 1777426 - protein, 7 aa, Staphylococcus epidermidis
EQEKQQA

SEQ ID NO: 1777427 - protein, 4 aa, Staphylococcus epidermidis
EQER

SEQ ID NO: 1777428 - protein, 5 aa, Staphylococcus epidermidis
EQERE

SEQ ID NO: 1777429 - protein, 16 aa, Staphylococcus epidermidis
EQERNENKRRQAQGIQ

SEQ ID NO: 1777430 - protein, 16 aa, Staphylococcus epidermidis
EQERNESKRRQAQGIE

SEQ ID NO: 1777431 - protein, 16 aa, Staphylococcus epidermidis
EQERNESKRRQAQGIK

SEQ ID NO: 1777432 - protein, 15 aa, Staphylococcus epidermidis
EQETDDDMARDHQEA

SEQ ID NO: 1777433 - protein, 14 aa, Staphylococcus epidermidis
EQGAYEIIRKLNEE

SEQ ID NO: 1777434 - protein, 11 aa, Staphylococcus epidermidis
EQGGVDEKQNN

SEQ ID NO: 1777435 - protein, 14 aa, Staphylococcus epidermidis
EQGIELSNTQKEQF

SEQ ID NO: 1777436 - protein, 13 aa, Staphylococcus epidermidis
EQGKTLAEAYGEI

SEQ ID NO: 1777437 - protein, 13 aa, Staphylococcus epidermidis
EQGKTLAQAYGEI

SEQ ID NO: 1777438 - protein, 13 aa, Staphylococcus epidermidis
EQGKTLSQAYGEI

SEQ ID NO: 1777439 - protein, 18 aa, Staphylococcus epidermidis
EQGLDRPIKNTDISRPGL

SEQ ID NO: 1777440 - protein, 9 aa, Staphylococcus epidermidis
EQGQLPNQI

SEQ ID NO: 1777441 - protein, 5 aa, Staphylococcus epidermidis
EQGYR

SEQ ID NO: 1777442 - protein, 6 aa, Staphylococcus epidermidis
EQGYRS

SEQ ID NO: 1777443 - protein, 5 aa, Staphylococcus epidermidis
EQHQE

SEQ ID NO: 1777444 - protein, 5 aa, Staphylococcus epidermidis
EQIAQ

SEQ ID NO: 1777445 - protein, 16 aa, Staphylococcus epidermidis
EQIDTPEGFRTRPKSD

SEQ ID NO: 1777446 - protein, 16 aa, Staphylococcus epidermidis
EQIDTPQGFKDHPQSE

SEQ ID NO: 1777447 - protein, 7 aa, Staphylococcus epidermidis
EQIEEGA

SEQ ID NO: 1777448 - protein, 4 aa, Staphylococcus epidermidis
EQIT

SEQ ID NO: 1777449 - protein, 8 aa, Staphylococcus epidermidis
EQKGNPIY

SEQ ID NO: 1777450 - protein, 7 aa, Staphylococcus epidermidis
EQKNEIV

SEQ ID NO: 1777451 - protein, 10 aa, Staphylococcus epidermidis
EQKNQKKQDI

SEQ ID NO: 1777452 - protein, 9 aa, Staphylococcus epidermidis
EQKPSGQIM

SEQ ID NO: 1777453 - protein, 12 aa, Staphylococcus epidermidis
EQKQQEKQKALY

SEQ ID NO: 1777454 - protein, 9 aa, Staphylococcus epidermidis
EQKQQKEHY

SEQ ID NO: 1777455 - protein, 16 aa, Staphylococcus epidermidis
EQKSGFTNADDITKHD

SEQ ID NO: 1777456 - protein, 12 aa, Staphylococcus epidermidis
EQLASQKLEGHP

SEQ ID NO: 1777457 - protein, 14 aa, Staphylococcus epidermidis
EQLDDASWTITVQK

SEQ ID NO: 1777458 - protein, 6 aa, Staphylococcus epidermidis
EQLGTA

SEQ ID NO: 1777459 - protein, 7 aa, Staphylococcus epidermidis
EQLKDSG

SEQ ID NO: 1777460 - protein, 6 aa, Staphylococcus epidermidis
EQMSEE

SEQ ID NO: 1777461 - protein, 6 aa, Staphylococcus epidermidis
EQNDHT

SEQ ID NO: 1777462 - protein, 14 aa, Staphylococcus epidermidis
EQNDKRSYRTELTT

SEQ ID NO: 1777463 - protein, 8 aa, Staphylococcus epidermidis
EQNETFRK

SEQ ID NO: 1777464 - protein, 6 aa, Staphylococcus epidermidis
EQNTTL

SEQ ID NO: 1777465 - protein, 5 aa, Staphylococcus epidermidis
EQPAT

SEQ ID NO: 1777466 - protein, 10 aa, Staphylococcus epidermidis
EQPGEESSNV

SEQ ID NO: 1777467 - protein, 6 aa, Staphylococcus epidermidis
EQPGTY

SEQ ID NO: 1777468 - protein, 7 aa, Staphylococcus epidermidis
EQPKSER

SEQ ID NO: 1777469 - protein, 13 aa, Staphylococcus epidermidis
EQPSDMTGESLIN

SEQ ID NO: 1777470 - protein, 5 aa, Staphylococcus epidermidis
EQPSQ

SEQ ID NO: 1777471 - protein, 7 aa, Staphylococcus epidermidis
EQPSSNL

SEQ ID NO: 1777472 - protein, 21 aa, Staphylococcus epidermidis
EQPTWNPKDFSPSIYQPDDRL

SEQ ID NO: 1777473 - protein, 22 aa, Staphylococcus epidermidis
EQPTWNPNDFSPSIYQSDDRLG

SEQ ID NO: 1777474 - protein, 4 aa, Staphylococcus epidermidis
EQQI

SEQ ID NO: 1777475 - protein, 10 aa, Staphylococcus epidermidis
EQQKEAIRKA

SEQ ID NO: 1777476 - protein, 9 aa, Staphylococcus epidermidis
EQQKKQLSH

SEQ ID NO: 1777477 - protein, 9 aa, Staphylococcus epidermidis
EQQNGDSLA

SEQ ID NO: 1777478 - protein, 6 aa, Staphylococcus epidermidis
EQQPVP

SEQ ID NO: 1777479 - protein, 9 aa, Staphylococcus epidermidis
EQQQYASKS

SEQ ID NO: 1777480 - protein, 11 aa, Staphylococcus epidermidis
EQQSKSLATPQ

SEQ ID NO: 1777481 - protein, 6 aa, Staphylococcus epidermidis
EQQSRV

SEQ ID NO: 1777482 - protein, 4 aa, Staphylococcus epidermidis
EQQV

SEQ ID NO: 1777483 - protein, 10 aa, Staphylococcus epidermidis
EQRAAELDKM

SEQ ID NO: 1777484 - protein, 11 aa, Staphylococcus epidermidis
EQRRKIKSQFP

SEQ ID NO: 1777485 - protein, 5 aa, Staphylococcus epidermidis
EQRRQ

SEQ ID NO: 1777486 - protein, 7 aa, Staphylococcus epidermidis
EQRSGRI

SEQ ID NO: 1777487 - protein, 17 aa, Staphylococcus epidermidis
EQRSTEGWQGWPKDGKI

SEQ ID NO: 1777488 - protein, 5 aa, Staphylococcus epidermidis
EQSAI

SEQ ID NO: 1777489 - protein, 8 aa, Staphylococcus epidermidis
EQSATNWT

SEQ ID NO: 1777490 - protein, 10 aa, Staphylococcus epidermidis
EQSEGPNTKQ

SEQ ID NO: 1777491 - protein, 5 aa, Staphylococcus epidermidis
EQSGI

SEQ ID NO: 1777492 - protein, 5 aa, Staphylococcus epidermidis
EQSGV

SEQ ID NO: 1777493 - protein, 7 aa, Staphylococcus epidermidis
EQSHPEI

SEQ ID NO: 1777494 - protein, 5 aa, Staphylococcus epidermidis
EQSIE

SEQ ID NO: 1777495 - protein, 8 aa, Staphylococcus epidermidis
EQSKADGV

SEQ ID NO: 1777496 - protein, 10 aa, Staphylococcus epidermidis
EQSKLNETNY

SEQ ID NO: 1777497 - protein, 9 aa, Staphylococcus epidermidis
EQSKLQDEQ

SEQ ID NO: 1777498 - protein, 8 aa, Staphylococcus epidermidis
EQSKQRHK

SEQ ID NO: 1777499 - protein, 8 aa, Staphylococcus epidermidis
EQSRLQDD

SEQ ID NO: 1777500 - protein, 11 aa, Staphylococcus epidermidis
EQSTMNESKYC

SEQ ID NO: 1777501 - protein, 5 aa, Staphylococcus epidermidis
EQTDS

SEQ ID NO: 1777502 - protein, 5 aa, Staphylococcus epidermidis
EQTGH

SEQ ID NO: 1777503 - protein, 4 aa, Staphylococcus epidermidis
EQTK

SEQ ID NO: 1777504 - protein, 8 aa, Staphylococcus epidermidis
EQTKERNK

SEQ ID NO: 1777505 - protein, 11 aa, Staphylococcus epidermidis
EQTLESRSRLE

SEQ ID NO: 1777506 - protein, 13 aa, Staphylococcus epidermidis
EQTNANDVISDDL

SEQ ID NO: 1777507 - protein, 5 aa, Staphylococcus epidermidis
EQTNT

SEQ ID NO: 1777508 - protein, 6 aa, Staphylococcus epidermidis
EQTQSE

SEQ ID NO: 1777509 - protein, 7 aa, Staphylococcus epidermidis
EQTTPQE

SEQ ID NO: 1777510 - protein, 9 aa, Staphylococcus epidermidis
EQVNLTPKE

SEQ ID NO: 1777511 - protein, 11 aa, Staphylococcus epidermidis
EQWEDKGKAEK

SEQ ID NO: 1777512 - protein, 13 aa, Staphylococcus epidermidis
EQYDESQNSEKSV

SEQ ID NO: 1777513 - protein, 4 aa, Staphylococcus epidermidis
EQYG

SEQ ID NO: 1777514 - protein, 6 aa, Staphylococcus epidermidis
EQYGAD

SEQ ID NO: 1777515 - protein, 5 aa, Staphylococcus epidermidis
EQYNL

SEQ ID NO: 1777516 - protein, 6 aa, Staphylococcus epidermidis
EQYNNE

SEQ ID NO: 1777517 - protein, 9 aa, Staphylococcus epidermidis
EQYTESTKR

SEQ ID NO: 1777518 - protein, 24 aa, Staphylococcus epidermidis
ERAGQKADVEKIKNSIQKRIDNGT

SEQ ID NO: 1777519 - protein, 8 aa, Staphylococcus epidermidis
ERAKAQGY

SEQ ID NO: 1777520 - protein, 4 aa, Staphylococcus epidermidis
ERAN

SEQ ID NO: 1777521 - protein, 8 aa, Staphylococcus epidermidis
ERASKTGK

SEQ ID NO: 1777522 - protein, 14 aa, Staphylococcus epidermidis
ERATENDKKAQFPY

SEQ ID NO: 1777523 - protein, 8 aa, Staphylococcus epidermidis
ERATVPKQ

SEQ ID NO: 1777524 - protein, 4 aa, Staphylococcus epidermidis
ERDG

SEQ ID NO: 1777525 - protein, 10 aa, Staphylococcus epidermidis
ERDGFTTPEY

SEQ ID NO: 1777526 - protein, 16 aa, Staphylococcus epidermidis
ERDKKDLSSYQQTTRK

SEQ ID NO: 1777527 - protein, 9 aa, Staphylococcus epidermidis
ERDKQERKE

SEQ ID NO: 1777528 - protein, 6 aa, Staphylococcus epidermidis
ERDLPH

SEQ ID NO: 1777529 - protein, 8 aa, Staphylococcus epidermidis
ERDNHSHT

SEQ ID NO: 1777530 - protein, 10 aa, Staphylococcus epidermidis
ERDNKKGDKV

SEQ ID NO: 1777531 - protein, 7 aa, Staphylococcus epidermidis
ERDPMGG

SEQ ID NO: 1777532 - protein, 7 aa, Staphylococcus epidermidis
EREGERP

SEQ ID NO: 1777533 - protein, 14 aa, Staphylococcus epidermidis
EREGISRDEVRERM

SEQ ID NO: 1777534 - protein, 8 aa, Staphylococcus epidermidis
EREGVKPK

SEQ ID NO: 1777535 - protein, 13 aa, Staphylococcus epidermidis
EREHNYKDELQDN

SEQ ID NO: 1777536 - protein, 4 aa, Staphylococcus epidermidis
ERFE

SEQ ID NO: 1777537 - protein, 6 aa, Staphylococcus epidermidis
ERFGQP

SEQ ID NO: 1777538 - protein, 5 aa, Staphylococcus epidermidis
ERGLT

SEQ ID NO: 1777539 - protein, 5 aa, Staphylococcus epidermidis
ERGMP

SEQ ID NO: 1777540 - protein, 5 aa, Staphylococcus epidermidis
ERGTY

SEQ ID NO: 1777541 - protein, 6 aa, Staphylococcus epidermidis
ERHIKD

SEQ ID NO: 1777542 - protein, 5 aa, Staphylococcus epidermidis
ERHSA

SEQ ID NO: 1777543 - protein, 4 aa, Staphylococcus epidermidis
ERID

SEQ ID NO: 1777544 - protein, 11 aa, Staphylococcus epidermidis
ERIKEKGSDKH

SEQ ID NO: 1777545 - protein, 10 aa, Staphylococcus epidermidis
ERISADDYRK

SEQ ID NO: 1777546 - protein, 7 aa, Staphylococcus epidermidis
ERISETA

SEQ ID NO: 1777547 - protein, 18 aa, Staphylococcus epidermidis
ERIYSKNGIKEDFRPSNL

SEQ ID NO: 1777548 - protein, 11 aa, Staphylococcus epidermidis
ERKGKTQTDMA

SEQ ID NO: 1777549 - protein, 12 aa, Staphylococcus epidermidis
ERKGKYQTENKE

SEQ ID NO: 1777550 - protein, 18 aa, Staphylococcus epidermidis
ERKKALDELKKKAERNID

SEQ ID NO: 1777551 - protein, 10 aa, Staphylococcus epidermidis
ERKKDEKLAK

SEQ ID NO: 1777552 - protein, 17 aa, Staphylococcus epidermidis
ERKKNQSETNARYEEEL

SEQ ID NO: 1777553 - protein, 10 aa, Staphylococcus epidermidis
ERKRDEKLAK

SEQ ID NO: 1777554 - protein, 5 aa, Staphylococcus epidermidis
ERKTK

SEQ ID NO: 1777555 - protein, 4 aa, Staphylococcus epidermidis
ERLA

SEQ ID NO: 1777556 - protein, 6 aa, Staphylococcus epidermidis
ERLAND

SEQ ID NO: 1777557 - protein, 6 aa, Staphylococcus epidermidis
ERLDKK

SEQ ID NO: 1777558 - protein, 4 aa, Staphylococcus epidermidis
ERLE

SEQ ID NO: 1777559 - protein, 15 aa, Staphylococcus epidermidis
ERLEKARSVGATHTF

SEQ ID NO: 1777560 - protein, 13 aa, Staphylococcus epidermidis
ERLKEDKKQLEKV

SEQ ID NO: 1777561 - protein, 5 aa, Staphylococcus epidermidis
ERLRE

SEQ ID NO: 1777562 - protein, 5 aa, Staphylococcus epidermidis
ERMEQ

SEQ ID NO: 1777563 - protein, 5 aa, Staphylococcus epidermidis
ERMKQ

SEQ ID NO: 1777564 - protein, 4 aa, Staphylococcus epidermidis
ERMQ

SEQ ID NO: 1777565 - protein, 7 aa, Staphylococcus epidermidis
ERNEQSF

SEQ ID NO: 1777566 - protein, 6 aa, Staphylococcus epidermidis
ERNGVE

SEQ ID NO: 1777567 - protein, 4 aa, Staphylococcus epidermidis
ERNH

SEQ ID NO: 1777568 - protein, 7 aa, Staphylococcus epidermidis
ERNNTDV

SEQ ID NO: 1777569 - protein, 8 aa, Staphylococcus epidermidis
ERNQALRN

SEQ ID NO: 1777570 - protein, 11 aa, Staphylococcus epidermidis
ERNSKRVDEQR

SEQ ID NO: 1777571 - protein, 13 aa, Staphylococcus epidermidis
ERNYKDDNNEISS

SEQ ID NO: 1777572 - protein, 13 aa, Staphylococcus epidermidis
ERNYKDENNEVSS

SEQ ID NO: 1777573 - protein, 14 aa, Staphylococcus epidermidis
ERNYTGKRKIRKDA

SEQ ID NO: 1777574 - protein, 15 aa, Staphylococcus epidermidis
ERPDKGSVTLNDQPM

SEQ ID NO: 1777575 - protein, 7 aa, Staphylococcus epidermidis
ERPELGN

SEQ ID NO: 1777576 - protein, 8 aa, Staphylococcus epidermidis
ERPGVDGK

SEQ ID NO: 1777577 - protein, 8 aa, Staphylococcus epidermidis
ERPKTMDE

SEQ ID NO: 1777578 - protein, 9 aa, Staphylococcus epidermidis
ERQDEDEPL

SEQ ID NO: 1777579 - protein, 8 aa, Staphylococcus epidermidis
ERQEQEKA

SEQ ID NO: 1777580 - protein, 27 aa, Staphylococcus epidermidis
ERQNKNIKQDSKESKQNNEEANREKRQ

SEQ ID NO: 1777581 - protein, 4 aa, Staphylococcus epidermidis
ERQP

SEQ ID NO: 1777582 - protein, 5 aa, Staphylococcus epidermidis
ERQPQ

SEQ ID NO: 1777583 - protein, 16 aa, Staphylococcus epidermidis
ERRAIEAERDTDELKK

SEQ ID NO: 1777584 - protein, 19 aa, Staphylococcus epidermidis
ERRTTQLQKELNEISRSLK

SEQ ID NO: 1777585 - protein, 10 aa, Staphylococcus epidermidis
ERSAKLAGRR

SEQ ID NO: 1777586 - protein, 9 aa, Staphylococcus epidermidis
ERSDSASWD

SEQ ID NO: 1777587 - protein, 4 aa, Staphylococcus epidermidis
ERSL

SEQ ID NO: 1777588 - protein, 13 aa, Staphylococcus epidermidis
ERSLNGTKLPQSF

SEQ ID NO: 1777589 - protein, 11 aa, Staphylococcus epidermidis
ERSSARETAAR

SEQ ID NO: 1777590 - protein, 21 aa, Staphylococcus epidermidis
ERTKTDRYQRKETSKSNSKLI

SEQ ID NO: 1777591 - protein, 7 aa, Staphylococcus epidermidis
ERTQAIG

SEQ ID NO: 1777592 - protein, 5 aa, Staphylococcus epidermidis
ERTQR

SEQ ID NO: 1777593 - protein, 6 aa, Staphylococcus epidermidis
ERTREI

SEQ ID NO: 1777594 - protein, 7 aa, Staphylococcus epidermidis
ERTSNKM

SEQ ID NO: 1777595 - protein, 7 aa, Staphylococcus epidermidis
ERTTPQI

SEQ ID NO: 1777596 - protein, 4 aa, Staphylococcus epidermidis
ERVA

SEQ ID NO: 1777597 - protein, 6 aa, Staphylococcus epidermidis
ERVERN

SEQ ID NO: 1777598 - protein, 5 aa, Staphylococcus epidermidis
ERVQA

SEQ ID NO: 1777599 - protein, 9 aa, Staphylococcus epidermidis
ERYDRSSTI

SEQ ID NO: 1777600 - protein, 8 aa, Staphylococcus epidermidis
ERYGEEQS

SEQ ID NO: 1777601 - protein, 5 aa, Staphylococcus epidermidis
ERYKD

SEQ ID NO: 1777602 - protein, 6 aa, Staphylococcus epidermidis
ERYPKA

SEQ ID NO: 1777603 - protein, 11 aa, Staphylococcus epidermidis
ERYRNKREQNQ

SEQ ID NO: 1777604 - protein, 11 aa, Staphylococcus epidermidis
ERYSERQGGYT

SEQ ID NO: 1777605 - protein, 6 aa, Staphylococcus epidermidis
ERYSKK

SEQ ID NO: 1777606 - protein, 13 aa, Staphylococcus epidermidis
ERYSSRANNINEK

SEQ ID NO: 1777607 - protein, 5 aa, Staphylococcus epidermidis
ESAGN

SEQ ID NO: 1777608 - protein, 11 aa, Staphylococcus epidermidis
ESAINSGYVTE

SEQ ID NO: 1777609 - protein, 9 aa, Staphylococcus epidermidis
ESAKARGAE

SEQ ID NO: 1777610 - protein, 15 aa, Staphylococcus epidermidis
ESANRTSDFIDLFFG

SEQ ID NO: 1777611 - protein, 19 aa, Staphylococcus epidermidis
ESAPSSDPKESSGTESELG

SEQ ID NO: 1777612 - protein, 7 aa, Staphylococcus epidermidis
ESAVTNG

SEQ ID NO: 1777613 - protein, 9 aa, Staphylococcus epidermidis
ESCETQNET

SEQ ID NO: 1777614 - protein, 7 aa, Staphylococcus epidermidis
ESDDDFK

SEQ ID NO: 1777615 - protein, 6 aa, Staphylococcus epidermidis
ESDDIY

SEQ ID NO: 1777616 - protein, 17 aa, Staphylococcus epidermidis
ESDEEREAGKANEIVGN

SEQ ID NO: 1777617 - protein, 17 aa, Staphylococcus epidermidis
ESDEEREAGKANEVVGN

SEQ ID NO: 1777618 - protein, 8 aa, Staphylococcus epidermidis
ESDFTKEE

SEQ ID NO: 1777619 - protein, 6 aa, Staphylococcus epidermidis
ESDIQE

SEQ ID NO: 1777620 - protein, 22 aa, Staphylococcus epidermidis
ESDNIGEQVKNGLQEKAKQGQL

SEQ ID NO: 1777621 - protein, 8 aa, Staphylococcus epidermidis
ESDNPMKQ

SEQ ID NO: 1777622 - protein, 4 aa, Staphylococcus epidermidis
ESDQ

SEQ ID NO: 1777623 - protein, 10 aa, Staphylococcus epidermidis
ESDSSVPYGH

SEQ ID NO: 1777624 - protein, 4 aa, Staphylococcus epidermidis
ESDV

SEQ ID NO: 1777625 - protein, 15 aa, Staphylococcus epidermidis
ESDVKTQHAQDKGEL

SEQ ID NO: 1777626 - protein, 15 aa, Staphylococcus epidermidis
ESDVKTQHTQDKGEL

SEQ ID NO: 1777627 - protein, 8 aa, Staphylococcus epidermidis
ESDYKGDY

SEQ ID NO: 1777628 - protein, 8 aa, Staphylococcus epidermidis
ESEASREA

SEQ ID NO: 1777629 - protein, 6 aa, Staphylococcus epidermidis
ESEGEH

SEQ ID NO: 1777630 - protein, 12 aa, Staphylococcus epidermidis
ESELDEVSEGRA

SEQ ID NO: 1777631 - protein, 5 aa, Staphylococcus epidermidis
ESELE

SEQ ID NO: 1777632 - protein, 5 aa, Staphylococcus epidermidis
ESELN

SEQ ID NO: 1777633 - protein, 8 aa, Staphylococcus epidermidis
ESENTPTS

SEQ ID NO: 1777634 - protein, 8 aa, Staphylococcus epidermidis
ESEPPAQK

SEQ ID NO: 1777635 - protein, 4 aa, Staphylococcus epidermidis
ESEQ

SEQ ID NO: 1777636 - protein, 7 aa, Staphylococcus epidermidis
ESEQEKI

SEQ ID NO: 1777637 - protein, 9 aa, Staphylococcus epidermidis
ESERGKSRS

SEQ ID NO: 1777638 - protein, 10 aa, Staphylococcus epidermidis
ESESKGDNFN

SEQ ID NO: 1777639 - protein, 9 aa, Staphylococcus epidermidis
ESETSEEAN

SEQ ID NO: 1777640 - protein, 15 aa, Staphylococcus epidermidis
ESEVKGQHTQDKGEL

SEQ ID NO: 1777641 - protein, 4 aa, Staphylococcus epidermidis
ESEY

SEQ ID NO: 1777642 - protein, 6 aa, Staphylococcus epidermidis
ESFDQP

SEQ ID NO: 1777643 - protein, 7 aa, Staphylococcus epidermidis
ESFNDSS

SEQ ID NO: 1777644 - protein, 11 aa, Staphylococcus epidermidis
ESFNKDKNKTY

SEQ ID NO: 1777645 - protein, 11 aa, Staphylococcus epidermidis
ESGCGKSTIGK

SEQ ID NO: 1777646 - protein, 8 aa, Staphylococcus epidermidis
ESGGKTTE

SEQ ID NO: 1777647 - protein, 5 aa, Staphylococcus epidermidis
ESGHQ

SEQ ID NO: 1777648 - protein, 9 aa, Staphylococcus epidermidis
ESGIRVSKK

SEQ ID NO: 1777649 - protein, 9 aa, Staphylococcus epidermidis
ESGKATTIL

SEQ ID NO: 1777650 - protein, 9 aa, Staphylococcus epidermidis
ESGKLKQGT

SEQ ID NO: 1777651 - protein, 8 aa, Staphylococcus epidermidis
ESGLREEE

SEQ ID NO: 1777652 - protein, 6 aa, Staphylococcus epidermidis
ESGLSI

SEQ ID NO: 1777653 - protein, 9 aa, Staphylococcus epidermidis
ESGRWGAYG

SEQ ID NO: 1777654 - protein, 7 aa, Staphylococcus epidermidis
ESGVDAS

SEQ ID NO: 1777655 - protein, 6 aa, Staphylococcus epidermidis
ESGVLP

SEQ ID NO: 1777656 - protein, 7 aa, Staphylococcus epidermidis
ESGVMPA

SEQ ID NO: 1777657 - protein, 5 aa, Staphylococcus epidermidis
ESHDN

SEQ ID NO: 1777658 - protein, 7 aa, Staphylococcus epidermidis
ESHGSNG

SEQ ID NO: 1777659 - protein, 7 aa, Staphylococcus epidermidis
ESHKSFE

SEQ ID NO: 1777660 - protein, 12 aa, Staphylococcus epidermidis
ESHPLQEEEHIQ

SEQ ID NO: 1777661 - protein, 19 aa, Staphylococcus epidermidis
ESIDKDKGYGPYRQSERAD

SEQ ID NO: 1777662 - protein, 15 aa, Staphylococcus epidermidis
ESIESRKLDNISSEL

SEQ ID NO: 1777663 - protein, 12 aa, Staphylococcus epidermidis
ESIHAQSTKEIA

SEQ ID NO: 1777664 - protein, 6 aa, Staphylococcus epidermidis
ESIKPR

SEQ ID NO: 1777665 - protein, 8 aa, Staphylococcus epidermidis
ESISASDL

SEQ ID NO: 1777666 - protein, 10 aa, Staphylococcus epidermidis
ESISRSGNGT

SEQ ID NO: 1777667 - protein, 8 aa, Staphylococcus epidermidis
ESITPYEG

SEQ ID NO: 1777668 - protein, 5 aa, Staphylococcus epidermidis
ESKDA

SEQ ID NO: 1777669 - protein, 25 aa, Staphylococcus epidermidis
ESKDFGEHFPDQNELKNISDDVDEE

SEQ ID NO: 1777670 - protein, 9 aa, Staphylococcus epidermidis
ESKETGNKE

SEQ ID NO: 1777671 - protein, 6 aa, Staphylococcus epidermidis
ESKETL

SEQ ID NO: 1777672 - protein, 5 aa, Staphylococcus epidermidis
ESKFG

SEQ ID NO: 1777673 - protein, 6 aa, Staphylococcus epidermidis
ESKHPE

SEQ ID NO: 1777674 - protein, 7 aa, Staphylococcus epidermidis
ESKKDVY

SEQ ID NO: 1777675 - protein, 27 aa, Staphylococcus epidermidis
ESKKQAAQEAEKVASLTTNDKQLNAAD

SEQ ID NO: 1777676 - protein, 9 aa, Staphylococcus epidermidis
ESKLNKTEI

SEQ ID NO: 1777677 - protein, 6 aa, Staphylococcus epidermidis
ESKMAK

SEQ ID NO: 1777678 - protein, 11 aa, Staphylococcus epidermidis
ESKNDKGGESL

SEQ ID NO: 1777679 - protein, 6 aa, Staphylococcus epidermidis
ESKPHQ

SEQ ID NO: 1777680 - protein, 11 aa, Staphylococcus epidermidis
ESKQEEYKSAF

SEQ ID NO: 1777681 - protein, 5 aa, Staphylococcus epidermidis
ESKQI

SEQ ID NO: 1777682 - protein, 8 aa, Staphylococcus epidermidis
ESKQNEMI

SEQ ID NO: 1777683 - protein, 14 aa, Staphylococcus epidermidis
ESKRYMEKAKEAGF

SEQ ID NO: 1777684 - protein, 15 aa, Staphylococcus epidermidis
ESKSGGKSGDFHRKN

SEQ ID NO: 1777685 - protein, 14 aa, Staphylococcus epidermidis
ESKSGGKSGDYKRN

SEQ ID NO: 1777686 - protein, 8 aa, Staphylococcus epidermidis
ESKSTETM

SEQ ID NO: 1777687 - protein, 10 aa, Staphylococcus epidermidis
ESKTIEPFRD

SEQ ID NO: 1777688 - protein, 8 aa, Staphylococcus epidermidis
ESKVAKKI

SEQ ID NO: 1777689 - protein, 5 aa, Staphylococcus epidermidis
ESKYG

SEQ ID NO: 1777690 - protein, 5 aa, Staphylococcus epidermidis
ESLED

SEQ ID NO: 1777691 - protein, 4 aa, Staphylococcus epidermidis
ESLF

SEQ ID NO: 1777692 - protein, 4 aa, Staphylococcus epidermidis
ESLG

SEQ ID NO: 1777693 - protein, 7 aa, Staphylococcus epidermidis
ESLGSID

SEQ ID NO: 1777694 - protein, 14 aa, Staphylococcus epidermidis
ESLKESQEKNEVDL

SEQ ID NO: 1777695 - protein, 10 aa, Staphylococcus epidermidis
ESLKPKENDI

SEQ ID NO: 1777696 - protein, 10 aa, Staphylococcus epidermidis
ESLPKDESNY

SEQ ID NO: 1777697 - protein, 6 aa, Staphylococcus epidermidis
ESLTPT

SEQ ID NO: 1777698 - protein, 7 aa, Staphylococcus epidermidis
ESLTTKN

SEQ ID NO: 1777699 - protein, 7 aa, Staphylococcus epidermidis
ESMTEGK

SEQ ID NO: 1777700 - protein, 5 aa, Staphylococcus epidermidis
ESNAD

SEQ ID NO: 1777701 - protein, 7 aa, Staphylococcus epidermidis
ESNDDFK

SEQ ID NO: 1777702 - protein, 7 aa, Staphylococcus epidermidis
ESNDDFR

SEQ ID NO: 1777703 - protein, 14 aa, Staphylococcus epidermidis
ESNDKDNESKSSGF

SEQ ID NO: 1777704 - protein, 14 aa, Staphylococcus epidermidis
ESNDKNIEKAIEQS

SEQ ID NO: 1777705 - protein, 5 aa, Staphylococcus epidermidis
ESNGD

SEQ ID NO: 1777706 - protein, 11 aa, Staphylococcus epidermidis
ESNGKTTVTST

SEQ ID NO: 1777707 - protein, 17 aa, Staphylococcus epidermidis
ESNKKNVKKTNSMIDAF

SEQ ID NO: 1777708 - protein, 23 aa, Staphylococcus epidermidis
ESNNISEQTKNGIREKAKQGKLI

SEQ ID NO: 1777709 - protein, 8 aa, Staphylococcus epidermidis
ESNPLTHK

SEQ ID NO: 1777710 - protein, 8 aa, Staphylococcus epidermidis
ESNQLNKG

SEQ ID NO: 1777711 - protein, 8 aa, Staphylococcus epidermidis
ESNTKTQF

SEQ ID NO: 1777712 - protein, 6 aa, Staphylococcus epidermidis
ESPEKK

SEQ ID NO: 1777713 - protein, 13 aa, Staphylococcus epidermidis
ESPGMPPGANTIN

SEQ ID NO: 1777714 - protein, 4 aa, Staphylococcus epidermidis
ESPR

SEQ ID NO: 1777715 - protein, 9 aa, Staphylococcus epidermidis
ESQHASPSM

SEQ ID NO: 1777716 - protein, 10 aa, Staphylococcus epidermidis
ESQKRIEDGV

SEQ ID NO: 1777717 - protein, 4 aa, Staphylococcus epidermidis
ESQL

SEQ ID NO: 1777718 - protein, 4 aa, Staphylococcus epidermidis
ESQQ

SEQ ID NO: 1777719 - protein, 11 aa, Staphylococcus epidermidis
ESQSGQPIPTG

SEQ ID NO: 1777720 - protein, 8 aa, Staphylococcus epidermidis
ESQTDRLT

SEQ ID NO: 1777721 - protein, 4 aa, Staphylococcus epidermidis
ESRR

SEQ ID NO: 1777722 - protein, 8 aa, Staphylococcus epidermidis
ESRTLSPS

SEQ ID NO: 1777723 - protein, 7 aa, Staphylococcus epidermidis
ESRVNAG

SEQ ID NO: 1777724 - protein, 5 aa, Staphylococcus epidermidis
ESSHA

SEQ ID NO: 1777725 - protein, 6 aa, Staphylococcus epidermidis
ESSIKQ

SEQ ID NO: 1777726 - protein, 18 aa, Staphylococcus epidermidis
ESSINTEDPFYDDIDHIG

SEQ ID NO: 1777727 - protein, 7 aa, Staphylococcus epidermidis
ESSKGSI

SEQ ID NO: 1777728 - protein, 8 aa, Staphylococcus epidermidis
ESSKKTPF

SEQ ID NO: 1777729 - protein, 15 aa, Staphylococcus epidermidis
ESSKNIGIAGGGGVY

SEQ ID NO: 1777730 - protein, 12 aa, Staphylococcus epidermidis
ESSKPPIKQESD

SEQ ID NO: 1777731 - protein, 12 aa, Staphylococcus epidermidis
ESSLDEDDNENH

SEQ ID NO: 1777732 - protein, 14 aa, Staphylococcus epidermidis
ESSNETEEGTQDGP

SEQ ID NO: 1777733 - protein, 6 aa, Staphylococcus epidermidis
ESSNYL

SEQ ID NO: 1777734 - protein, 6 aa, Staphylococcus epidermidis
ESSRDN

SEQ ID NO: 1777735 - protein, 8 aa, Staphylococcus epidermidis
ESSRETPF

SEQ ID NO: 1777736 - protein, 7 aa, Staphylococcus epidermidis
ESTDYQD

SEQ ID NO: 1777737 - protein, 4 aa, Staphylococcus epidermidis
ESTE

SEQ ID NO: 1777738 - protein, 7 aa, Staphylococcus epidermidis
ESTIDSP

SEQ ID NO: 1777739 - protein, 7 aa, Staphylococcus epidermidis
ESTIKAN

SEQ ID NO: 1777740 - protein, 13 aa, Staphylococcus epidermidis
ESTIKANSRYFDN

SEQ ID NO: 1777741 - protein, 11 aa, Staphylococcus epidermidis
ESTKSGGEVTR

SEQ ID NO: 1777742 - protein, 7 aa, Staphylococcus epidermidis
ESTNGSD

SEQ ID NO: 1777743 - protein, 5 aa, Staphylococcus epidermidis
ESTNV

SEQ ID NO: 1777744 - protein, 12 aa, Staphylococcus epidermidis
ESTQDLNSKLAQ

SEQ ID NO: 1777745 - protein, 18 aa, Staphylococcus epidermidis
ESTRELGEGINGEEELLY

SEQ ID NO: 1777746 - protein, 8 aa, Staphylococcus epidermidis
ESTTPSIK

SEQ ID NO: 1777747 - protein, 11 aa, Staphylococcus epidermidis
ESVEKRNELPP

SEQ ID NO: 1777748 - protein, 21 aa, Staphylococcus epidermidis
ESVENGANYFSDKAKKVKNVG

SEQ ID NO: 1777749 - protein, 6 aa, Staphylococcus epidermidis
ESVGDV

SEQ ID NO: 1777750 - protein, 6 aa, Staphylococcus epidermidis
ESVNTI

SEQ ID NO: 1777751 - protein, 4 aa, Staphylococcus epidermidis
ESVS

SEQ ID NO: 1777752 - protein, 7 aa, Staphylococcus epidermidis
ESVSRAP

SEQ ID NO: 1777753 - protein, 6 aa, Staphylococcus epidermidis
ESYDDG

SEQ ID NO: 1777754 - protein, 9 aa, Staphylococcus epidermidis
ESYDERRKI

SEQ ID NO: 1777755 - protein, 8 aa, Staphylococcus epidermidis
ESYDSGHI

SEQ ID NO: 1777756 - protein, 6 aa, Staphylococcus epidermidis
ESYLPP

SEQ ID NO: 1777757 - protein, 5 aa, Staphylococcus epidermidis
ESYPE

SEQ ID NO: 1777758 - protein, 14 aa, Staphylococcus epidermidis
ETAAKDNDISIKDE

SEQ ID NO: 1777759 - protein, 9 aa, Staphylococcus epidermidis
ETADTSRDD

SEQ ID NO: 1777760 - protein, 13 aa, Staphylococcus epidermidis
ETAESIEKEKNYS

SEQ ID NO: 1777761 - protein, 10 aa, Staphylococcus epidermidis
ETAHQSFKDK

SEQ ID NO: 1777762 - protein, 11 aa, Staphylococcus epidermidis
ETATSTDLKLE

SEQ ID NO: 1777763 - protein, 12 aa, Staphylococcus epidermidis
ETATSTDLKLES

SEQ ID NO: 1777764 - protein, 9 aa, Staphylococcus epidermidis
ETDEEVNKK

SEQ ID NO: 1777765 - protein, 13 aa, Staphylococcus epidermidis
ETDEKSVLKHPSS

SEQ ID NO: 1777766 - protein, 9 aa, Staphylococcus epidermidis
ETDEQAKRE

SEQ ID NO: 1777767 - protein, 11 aa, Staphylococcus epidermidis
ETDESWDPNQT

SEQ ID NO: 1777768 - protein, 22 aa, Staphylococcus epidermidis
ETDEVIPDKNATSDSDNEETDE

SEQ ID NO: 1777769 - protein, 11 aa, Staphylococcus epidermidis
ETDHTTTDAQE

SEQ ID NO: 1777770 - protein, 9 aa, Staphylococcus epidermidis
ETDLAEGEI

SEQ ID NO: 1777771 - protein, 4 aa, Staphylococcus epidermidis
ETDN

SEQ ID NO: 1777772 - protein, 6 aa, Staphylococcus epidermidis
ETDPES

SEQ ID NO: 1777773 - protein, 4 aa, Staphylococcus epidermidis
ETDS

SEQ ID NO: 1777774 - protein, 9 aa, Staphylococcus epidermidis
ETEARTGFV

SEQ ID NO: 1777775 - protein, 4 aa, Staphylococcus epidermidis
ETED

SEQ ID NO: 1777776 - protein, 9 aa, Staphylococcus epidermidis
ETEDGTFSD

SEQ ID NO: 1777777 - protein, 10 aa, Staphylococcus epidermidis
ETEDGTQINP

SEQ ID NO: 1777778 - protein, 18 aa, Staphylococcus epidermidis
ETEEEFDKRIESYEDVDN

SEQ ID NO: 1777779 - protein, 6 aa, Staphylococcus epidermidis
ETEEFE

SEQ ID NO: 1777780 - protein, 4 aa, Staphylococcus epidermidis
ETEG

SEQ ID NO: 1777781 - protein, 4 aa, Staphylococcus epidermidis
ETEK

SEQ ID NO: 1777782 - protein, 24 aa, Staphylococcus epidermidis
ETEKQNNINHKKKKKKQDRNNQMR

SEQ ID NO: 1777783 - protein, 24 aa, Staphylococcus epidermidis
ETEKQNNINHNKKKKKQERNNQMR

SEQ ID NO: 1777784 - protein, 6 aa, Staphylococcus epidermidis
ETENDR

SEQ ID NO: 1777785 - protein, 5 aa, Staphylococcus epidermidis
ETENL

SEQ ID NO: 1777786 - protein, 8 aa, Staphylococcus epidermidis
ETESIPND

SEQ ID NO: 1777787 - protein, 13 aa, Staphylococcus epidermidis
ETESWIDEKEGRI

SEQ ID NO: 1777788 - protein, 6 aa, Staphylococcus epidermidis
ETETPQ

SEQ ID NO: 1777789 - protein, 6 aa, Staphylococcus epidermidis
ETFPQE

SEQ ID NO: 1777790 - protein, 13 aa, Staphylococcus epidermidis
ETFQPEALPQQDV

SEQ ID NO: 1777791 - protein, 4 aa, Staphylococcus epidermidis
ETGA

SEQ ID NO: 1777792 - protein, 5 aa, Staphylococcus epidermidis
ETGAI

SEQ ID NO: 1777793 - protein, 4 aa, Staphylococcus epidermidis
ETGE

SEQ ID NO: 1777794 - protein, 4 aa, Staphylococcus epidermidis
ETGH

SEQ ID NO: 1777795 - protein, 10 aa, Staphylococcus epidermidis
ETGKGETHTA

SEQ ID NO: 1777796 - protein, 4 aa, Staphylococcus epidermidis
ETGL

SEQ ID NO: 1777797 - protein, 8 aa, Staphylococcus epidermidis
ETGTQGKI

SEQ ID NO: 1777798 - protein, 7 aa, Staphylococcus epidermidis
ETGTTGT

SEQ ID NO: 1777799 - protein, 12 aa, Staphylococcus epidermidis
ETHAEEKPNPKV

SEQ ID NO: 1777800 - protein, 13 aa, Staphylococcus epidermidis
ETHANNKKRNELN

SEQ ID NO: 1777801 - protein, 12 aa, Staphylococcus epidermidis
ETHDIPDDELPS

SEQ ID NO: 1777802 - protein, 5 aa, Staphylococcus epidermidis
ETIAN

SEQ ID NO: 1777803 - protein, 5 aa, Staphylococcus epidermidis
ETIEA

SEQ ID NO: 1777804 - protein, 17 aa, Staphylococcus epidermidis
ETIPDTEFDEFRHYRSL

SEQ ID NO: 1777805 - protein, 11 aa, Staphylococcus epidermidis
ETISNTTNLDE

SEQ ID NO: 1777806 - protein, 12 aa, Staphylococcus epidermidis
ETITQSHPGYEE

SEQ ID NO: 1777807 - protein, 16 aa, Staphylococcus epidermidis
ETKDFNQQPEKEQPIE

SEQ ID NO: 1777808 - protein, 7 aa, Staphylococcus epidermidis
ETKEQAQ

SEQ ID NO: 1777809 - protein, 18 aa, Staphylococcus epidermidis
ETKERIKDISHKKDAYTE

SEQ ID NO: 1777810 - protein, 7 aa, Staphylococcus epidermidis
ETKGGRR

SEQ ID NO: 1777811 - protein, 7 aa, Staphylococcus epidermidis
ETKHNND

SEQ ID NO: 1777812 - protein, 31 aa, Staphylococcus epidermidis
ETKKGLDQLNQQHSKSLKDVEESLNAAKNTI

SEQ ID NO: 1777813 - protein, 10 aa, Staphylococcus epidermidis
ETKNKHFDED

SEQ ID NO: 1777814 - protein, 10 aa, Staphylococcus epidermidis
ETKNRQFDEE

SEQ ID NO: 1777815 - protein, 8 aa, Staphylococcus epidermidis
ETKNTHDI

SEQ ID NO: 1777816 - protein, 5 aa, Staphylococcus epidermidis
ETKQP

SEQ ID NO: 1777817 - protein, 9 aa, Staphylococcus epidermidis
ETKSAPTPV

SEQ ID NO: 1777818 - protein, 9 aa, Staphylococcus epidermidis
ETKSASTPV

SEQ ID NO: 1777819 - protein, 10 aa, Staphylococcus epidermidis
ETKSDALKRE

SEQ ID NO: 1777820 - protein, 5 aa, Staphylococcus epidermidis
ETKVD

SEQ ID NO: 1777821 - protein, 5 aa, Staphylococcus epidermidis
ETKYR

SEQ ID NO: 1777822 - protein, 5 aa, Staphylococcus epidermidis
ETLEN

SEQ ID NO: 1777823 - protein, 13 aa, Staphylococcus epidermidis
ETLEQIPSQEHDE

SEQ ID NO: 1777824 - protein, 6 aa, Staphylococcus epidermidis
ETLGGK

SEQ ID NO: 1777825 - protein, 7 aa, Staphylococcus epidermidis
ETLGNKP

SEQ ID NO: 1777826 - protein, 14 aa, Staphylococcus epidermidis
ETLIGGSPKENKKI

SEQ ID NO: 1777827 - protein, 11 aa, Staphylococcus epidermidis
ETLKEGVKDAS

SEQ ID NO: 1777828 - protein, 7 aa, Staphylococcus epidermidis
ETLNGTE

SEQ ID NO: 1777829 - protein, 4 aa, Staphylococcus epidermidis
ETLR

SEQ ID NO: 1777830 - protein, 19 aa, Staphylococcus epidermidis
ETLYSEDEKKEKSSNKKDK

SEQ ID NO: 1777831 - protein, 20 aa, Staphylococcus epidermidis
ETLYSEDEKKENKDSNEDES

SEQ ID NO: 1777832 - protein, 5 aa, Staphylococcus epidermidis
ETMEE

SEQ ID NO: 1777833 - protein, 6 aa, Staphylococcus epidermidis
ETMEKE

SEQ ID NO: 1777834 - protein, 15 aa, Staphylococcus epidermidis
ETMGQDRDFEPTRQK

SEQ ID NO: 1777835 - protein, 16 aa, Staphylococcus epidermidis
ETNDELNEGDTFGSVE

SEQ ID NO: 1777836 - protein, 7 aa, Staphylococcus epidermidis
ETNDGNI

SEQ ID NO: 1777837 - protein, 5 aa, Staphylococcus epidermidis
ETNED

SEQ ID NO: 1777838 - protein, 4 aa, Staphylococcus epidermidis
ETNG

SEQ ID NO: 1777839 - protein, 10 aa, Staphylococcus epidermidis
ETNHPRANNQ

SEQ ID NO: 1777840 - protein, 10 aa, Staphylococcus epidermidis
ETNIPKTHKK

SEQ ID NO: 1777841 - protein, 7 aa, Staphylococcus epidermidis
ETNNEKI

SEQ ID NO: 1777842 - protein, 9 aa, Staphylococcus epidermidis
ETNPKDIQS

SEQ ID NO: 1777843 - protein, 6 aa, Staphylococcus epidermidis
ETNVSS

SEQ ID NO: 1777844 - protein, 7 aa, Staphylococcus epidermidis
ETPAENI

SEQ ID NO: 1777845 - protein, 5 aa, Staphylococcus epidermidis
ETPDD

SEQ ID NO: 1777846 - protein, 6 aa, Staphylococcus epidermidis
ETPDNK

SEQ ID NO: 1777847 - protein, 4 aa, Staphylococcus epidermidis
ETPE

SEQ ID NO: 1777848 - protein, 4 aa, Staphylococcus epidermidis
ETPK

SEQ ID NO: 1777849 - protein, 9 aa, Staphylococcus epidermidis
ETPNGNGGV

SEQ ID NO: 1777850 - protein, 28 aa, Staphylococcus epidermidis
ETPSGYTPTKANSGQDITVDSNGITTTG

SEQ ID NO: 1777851 - protein, 14 aa, Staphylococcus epidermidis
ETPSTIKATGGFAK

SEQ ID NO: 1777852 - protein, 6 aa, Staphylococcus epidermidis
ETPTKG

SEQ ID NO: 1777853 - protein, 10 aa, Staphylococcus epidermidis
ETPVGRNGIK

SEQ ID NO: 1777854 - protein, 8 aa, Staphylococcus epidermidis
ETPVTNVS

SEQ ID NO: 1777855 - protein, 9 aa, Staphylococcus epidermidis
ETPYDKQGG

SEQ ID NO: 1777856 - protein, 7 aa, Staphylococcus epidermidis
ETQANAL

SEQ ID NO: 1777857 - protein, 7 aa, Staphylococcus epidermidis
ETQDIET

SEQ ID NO: 1777858 - protein, 6 aa, Staphylococcus epidermidis
ETQFDG

SEQ ID NO: 1777859 - protein, 23 aa, Staphylococcus epidermidis
ETQKAIEYSESGRAKGKIVVKME

SEQ ID NO: 1777860 - protein, 10 aa, Staphylococcus epidermidis
ETQRSNENIE

SEQ ID NO: 1777861 - protein, 5 aa, Staphylococcus epidermidis
ETQSE

SEQ ID NO: 1777862 - protein, 5 aa, Staphylococcus epidermidis
ETQYK

SEQ ID NO: 1777863 - protein, 4 aa, Staphylococcus epidermidis
ETRC

SEQ ID NO: 1777864 - protein, 7 aa, Staphylococcus epidermidis
ETRKTAT

SEQ ID NO: 1777865 - protein, 15 aa, Staphylococcus epidermidis
ETRTPNRAKVSDYEA

SEQ ID NO: 1777866 - protein, 11 aa, Staphylococcus epidermidis
ETRVDKRVETN

SEQ ID NO: 1777867 - protein, 7 aa, Staphylococcus epidermidis
ETSEETF

SEQ ID NO: 1777868 - protein, 5 aa, Staphylococcus epidermidis
ETSIE

SEQ ID NO: 1777869 - protein, 6 aa, Staphylococcus epidermidis
ETSLEG

SEQ ID NO: 1777870 - protein, 6 aa, Staphylococcus epidermidis
ETSMNK

SEQ ID NO: 1777871 - protein, 6 aa, Staphylococcus epidermidis
ETSQYI

SEQ ID NO: 1777872 - protein, 7 aa, Staphylococcus epidermidis
ETSRTSR

SEQ ID NO: 1777873 - protein, 4 aa, Staphylococcus epidermidis
ETSS

SEQ ID NO: 1777874 - protein, 8 aa, Staphylococcus epidermidis
ETSSIKPE

SEQ ID NO: 1777875 - protein, 8 aa, Staphylococcus epidermidis
ETSVPAKN

SEQ ID NO: 1777876 - protein, 7 aa, Staphylococcus epidermidis
ETTDYQS

SEQ ID NO: 1777877 - protein, 5 aa, Staphylococcus epidermidis
ETTEA

SEQ ID NO: 1777878 - protein, 13 aa, Staphylococcus epidermidis
ETTEGTITYEGKK

SEQ ID NO: 1777879 - protein, 6 aa, Staphylococcus epidermidis
ETTEQE

SEQ ID NO: 1777880 - protein, 7 aa, Staphylococcus epidermidis
ETTGLPD

SEQ ID NO: 1777881 - protein, 22 aa, Staphylococcus epidermidis
ETTHKDLKGPDGLYFRFNRITE

SEQ ID NO: 1777882 - protein, 5 aa, Staphylococcus epidermidis
ETTIQ

SEQ ID NO: 1777883 - protein, 6 aa, Staphylococcus epidermidis
ETTNDI

SEQ ID NO: 1777884 - protein, 7 aa, Staphylococcus epidermidis
ETTSEDQ

SEQ ID NO: 1777885 - protein, 8 aa, Staphylococcus epidermidis
ETTSEENV

SEQ ID NO: 1777886 - protein, 9 aa, Staphylococcus epidermidis
ETTSLEPRK

SEQ ID NO: 1777887 - protein, 7 aa, Staphylococcus epidermidis
ETTVQGD

SEQ ID NO: 1777888 - protein, 19 aa, Staphylococcus epidermidis
ETTYGASPYDKVRGHNGPV

SEQ ID NO: 1777889 - protein, 17 aa, Staphylococcus epidermidis
ETVGRNHKPNRKEPKQI

SEQ ID NO: 1777890 - protein, 17 aa, Staphylococcus epidermidis
ETVGRNRKPNRKEPKQI

SEQ ID NO: 1777891 - protein, 9 aa, Staphylococcus epidermidis
ETVNDAESF

SEQ ID NO: 1777892 - protein, 4 aa, Staphylococcus epidermidis
ETVR

SEQ ID NO: 1777893 - protein, 6 aa, Staphylococcus epidermidis
ETVRKY

SEQ ID NO: 1777894 - protein, 12 aa, Staphylococcus epidermidis
ETVSERSLADKA

SEQ ID NO: 1777895 - protein, 9 aa, Staphylococcus epidermidis
ETVTPHDHQ

SEQ ID NO: 1777896 - protein, 5 aa, Staphylococcus epidermidis
ETYGI

SEQ ID NO: 1777897 - protein, 4 aa, Staphylococcus epidermidis
ETYQ

SEQ ID NO: 1777898 - protein, 9 aa, Staphylococcus epidermidis
ETYSDHNEH

SEQ ID NO: 1777899 - protein, 12 aa, Staphylococcus epidermidis
EVADKKKAVSDR

SEQ ID NO: 1777900 - protein, 4 aa, Staphylococcus epidermidis
EVAP

SEQ ID NO: 1777901 - protein, 9 aa, Staphylococcus epidermidis
EVARDEKSY

SEQ ID NO: 1777902 - protein, 10 aa, Staphylococcus epidermidis
EVASQKTDKP

SEQ ID NO: 1777903 - protein, 10 aa, Staphylococcus epidermidis
EVASQKTEKP

SEQ ID NO: 1777904 - protein, 8 aa, Staphylococcus epidermidis
EVDGDTKG

SEQ ID NO: 1777905 - protein, 11 aa, Staphylococcus epidermidis
EVDNAKETLNA

SEQ ID NO: 1777906 - protein, 15 aa, Staphylococcus epidermidis
EVDPDDTAFSHPSKP

SEQ ID NO: 1777907 - protein, 19 aa, Staphylococcus epidermidis
EVEEETSKVKTDDNDDRID

SEQ ID NO: 1777908 - protein, 8 aa, Staphylococcus epidermidis
EVEKADKL

SEQ ID NO: 1777909 - protein, 5 aa, Staphylococcus epidermidis
EVEKD

SEQ ID NO: 1777910 - protein, 12 aa, Staphylococcus epidermidis
EVEKRNNIKRLP

SEQ ID NO: 1777911 - protein, 10 aa, Staphylococcus epidermidis
EVEKSNNDAL

SEQ ID NO: 1777912 - protein, 8 aa, Staphylococcus epidermidis
EVEKTTSN

SEQ ID NO: 1777913 - protein, 6 aa, Staphylococcus epidermidis
EVEQNT

SEQ ID NO: 1777914 - protein, 5 aa, Staphylococcus epidermidis
EVEQS

SEQ ID NO: 1777915 - protein, 4 aa, Staphylococcus epidermidis
EVET

SEQ ID NO: 1777916 - protein, 7 aa, Staphylococcus epidermidis
EVETAKR

SEQ ID NO: 1777917 - protein, 12 aa, Staphylococcus epidermidis
EVGDEGNEETAD

SEQ ID NO: 1777918 - protein, 15 aa, Staphylococcus epidermidis
EVGEGDSTKSGGRKP

SEQ ID NO: 1777919 - protein, 9 aa, Staphylococcus epidermidis
EVGEGNKPE

SEQ ID NO: 1777920 - protein, 6 aa, Staphylococcus epidermidis
EVGGDN

SEQ ID NO: 1777921 - protein, 5 aa, Staphylococcus epidermidis
EVGQE

SEQ ID NO: 1777922 - protein, 4 aa, Staphylococcus epidermidis
EVGR

SEQ ID NO: 1777923 - protein, 5 aa, Staphylococcus epidermidis
EVHAQ

SEQ ID NO: 1777924 - protein, 7 aa, Staphylococcus epidermidis
EVIDSGK

SEQ ID NO: 1777925 - protein, 9 aa, Staphylococcus epidermidis
EVKEGELQD

SEQ ID NO: 1777926 - protein, 58 aa, Staphylococcus epidermidis
EVKEYGREKHSSKATRNNQRVEKQHRDHQRHVENNERSTTRTKSSSKRAKDKDAGFEL

SEQ ID NO: 1777927 - protein, 9 aa, Staphylococcus epidermidis
EVKHAEAGE

SEQ ID NO: 1777928 - protein, 19 aa, Staphylococcus epidermidis
EVKHTENYNPASKSTTMRV

SEQ ID NO: 1777929 - protein, 8 aa, Staphylococcus epidermidis
EVKKEEEI

SEQ ID NO: 1777930 - protein, 21 aa, Staphylococcus epidermidis
EVKPYREEDRVAEDSNTPTFV

SEQ ID NO: 1777931 - protein, 4 aa, Staphylococcus epidermidis
EVKQ

SEQ ID NO: 1777932 - protein, 10 aa, Staphylococcus epidermidis
EVKTKQKDDV

SEQ ID NO: 1777933 - protein, 11 aa, Staphylococcus epidermidis
EVNAKEKEKIQ

SEQ ID NO: 1777934 - protein, 4 aa, Staphylococcus epidermidis
EVND

SEQ ID NO: 1777935 - protein, 5 aa, Staphylococcus epidermidis
EVNDG

SEQ ID NO: 1777936 - protein, 12 aa, Staphylococcus epidermidis
EVNEKGKYAKTV

SEQ ID NO: 1777937 - protein, 6 aa, Staphylococcus epidermidis
EVNEKL

SEQ ID NO: 1777938 - protein, 6 aa, Staphylococcus epidermidis
EVNESD

SEQ ID NO: 1777939 - protein, 10 aa, Staphylococcus epidermidis
EVNGKTIKEN

SEQ ID NO: 1777940 - protein, 12 aa, Staphylococcus epidermidis
EVNKHPEQQIFG

SEQ ID NO: 1777941 - protein, 21 aa, Staphylococcus epidermidis
EVNPSKVEYKRAYNDVLSILN

SEQ ID NO: 1777942 - protein, 6 aa, Staphylococcus epidermidis
EVNSNQ

SEQ ID NO: 1777943 - protein, 8 aa, Staphylococcus epidermidis
EVNTPLSK

SEQ ID NO: 1777944 - protein, 6 aa, Staphylococcus epidermidis
EVNTQD

SEQ ID NO: 1777945 - protein, 5 aa, Staphylococcus epidermidis
EVPDI

SEQ ID NO: 1777946 - protein, 5 aa, Staphylococcus epidermidis
EVPEA

SEQ ID NO: 1777947 - protein, 9 aa, Staphylococcus epidermidis
EVPESDTHR

SEQ ID NO: 1777948 - protein, 7 aa, Staphylococcus epidermidis
EVPKPVN

SEQ ID NO: 1777949 - protein, 5 aa, Staphylococcus epidermidis
EVPSK

SEQ ID NO: 1777950 - protein, 11 aa, Staphylococcus epidermidis
EVPSSQKEKLK

SEQ ID NO: 1777951 - protein, 14 aa, Staphylococcus epidermidis
EVQGKVSKEEQYIK

SEQ ID NO: 1777952 - protein, 5 aa, Staphylococcus epidermidis
EVREE

SEQ ID NO: 1777953 - protein, 12 aa, Staphylococcus epidermidis
EVRGQSEEYERM

SEQ ID NO: 1777954 - protein, 6 aa, Staphylococcus epidermidis
EVRKTQ

SEQ ID NO: 1777955 - protein, 14 aa, Staphylococcus epidermidis
EVSEGQNIVYGLND

SEQ ID NO: 1777956 - protein, 5 aa, Staphylococcus epidermidis
EVSEI

SEQ ID NO: 1777957 - protein, 5 aa, Staphylococcus epidermidis
EVSGD

SEQ ID NO: 1777958 - protein, 15 aa, Staphylococcus epidermidis
EVSSGDKSNKEAHAT

SEQ ID NO: 1777959 - protein, 6 aa, Staphylococcus epidermidis
EVTAKK

SEQ ID NO: 1777960 - protein, 6 aa, Staphylococcus epidermidis
EVTEDD

SEQ ID NO: 1777961 - protein, 10 aa, Staphylococcus epidermidis
EVTGANAIHP

SEQ ID NO: 1777962 - protein, 8 aa, Staphylococcus epidermidis
EVTHSKKG

SEQ ID NO: 1777963 - protein, 14 aa, Staphylococcus epidermidis
EVTKEERQNRNGHK

SEQ ID NO: 1777964 - protein, 14 aa, Staphylococcus epidermidis
EVTKKQRQHRNGHK

SEQ ID NO: 1777965 - protein, 6 aa, Staphylococcus epidermidis
EVTKSL

SEQ ID NO: 1777966 - protein, 19 aa, Staphylococcus epidermidis
EVTLDNNSNGIPYALKEIL

SEQ ID NO: 1777967 - protein, 4 aa, Staphylococcus epidermidis
EVTP

SEQ ID NO: 1777968 - protein, 26 aa, Staphylococcus epidermidis
EVTQAKQNLRGEQKLADDKANAERTL

SEQ ID NO: 1777969 - protein, 8 aa, Staphylococcus epidermidis
EVTQSKGY

SEQ ID NO: 1777970 - protein, 10 aa, Staphylococcus epidermidis
EVTTQSSPQV

SEQ ID NO: 1777971 - protein, 9 aa, Staphylococcus epidermidis
EVVERPSSV

SEQ ID NO: 1777972 - protein, 5 aa, Staphylococcus epidermidis
EVYDD

SEQ ID NO: 1777973 - protein, 8 aa, Staphylococcus epidermidis
EVYDTSTA

SEQ ID NO: 1777974 - protein, 12 aa, Staphylococcus epidermidis
EWESLKPKEYEI

SEQ ID NO: 1777975 - protein, 6 aa, Staphylococcus epidermidis
EWKGTN

SEQ ID NO: 1777976 - protein, 10 aa, Staphylococcus epidermidis
EWSGDERSAL

SEQ ID NO: 1777977 - protein, 9 aa, Staphylococcus epidermidis
EYAEKEDSE

SEQ ID NO: 1777978 - protein, 5 aa, Staphylococcus epidermidis
EYAEL

SEQ ID NO: 1777979 - protein, 4 aa, Staphylococcus epidermidis
EYAK

SEQ ID NO: 1777980 - protein, 5 aa, Staphylococcus epidermidis
EYDEK

SEQ ID NO: 1777981 - protein, 10 aa, Staphylococcus epidermidis
EYEAGEKQKL

SEQ ID NO: 1777982 - protein, 10 aa, Staphylococcus epidermidis
EYEDEQSPEK

SEQ ID NO: 1777983 - protein, 5 aa, Staphylococcus epidermidis
EYEDF

SEQ ID NO: 1777984 - protein, 11 aa, Staphylococcus epidermidis
EYEEKRQEEEL

SEQ ID NO: 1777985 - protein, 10 aa, Staphylococcus epidermidis
EYEESTIPAV

SEQ ID NO: 1777986 - protein, 8 aa, Staphylococcus epidermidis
EYENRKED

SEQ ID NO: 1777987 - protein, 7 aa, Staphylococcus epidermidis
EYEPKTK

SEQ ID NO: 1777988 - protein, 13 aa, Staphylococcus epidermidis
EYERETKKSSQRI

SEQ ID NO: 1777989 - protein, 11 aa, Staphylococcus epidermidis
EYERQKKDEKL

SEQ ID NO: 1777990 - protein, 13 aa, Staphylococcus epidermidis
EYESAKDKETQQL

SEQ ID NO: 1777991 - protein, 19 aa, Staphylococcus epidermidis
EYGGENGAKEAGKQRLEGK

SEQ ID NO: 1777992 - protein, 11 aa, Staphylococcus epidermidis
EYGKDDKPRRI

SEQ ID NO: 1777993 - protein, 10 aa, Staphylococcus epidermidis
EYGQSTLDDG

SEQ ID NO: 1777994 - protein, 5 aa, Staphylococcus epidermidis
EYHGN

SEQ ID NO: 1777995 - protein, 14 aa, Staphylococcus epidermidis
EYKDSGLKKNKADI

SEQ ID NO: 1777996 - protein, 12 aa, Staphylococcus epidermidis
EYKDSKGESRKE

SEQ ID NO: 1777997 - protein, 10 aa, Staphylococcus epidermidis
EYKENPQNGK

SEQ ID NO: 1777998 - protein, 12 aa, Staphylococcus epidermidis
EYKPTEENKKLN

SEQ ID NO: 1777999 - protein, 5 aa, Staphylococcus epidermidis
EYNMS

SEQ ID NO: 1778000 - protein, 8 aa, Staphylococcus epidermidis
EYNRQNGN

SEQ ID NO: 1778001 - protein, 8 aa, Staphylococcus epidermidis
EYNSSNER

SEQ ID NO: 1778002 - protein, 7 aa, Staphylococcus epidermidis
EYPDSGE

SEQ ID NO: 1778003 - protein, 4 aa, Staphylococcus epidermidis
EYPS

SEQ ID NO: 1778004 - protein, 10 aa, Staphylococcus epidermidis
EYPSNQNNKE

SEQ ID NO: 1778005 - protein, 6 aa, Staphylococcus epidermidis
EYQHSD

SEQ ID NO: 1778006 - protein, 10 aa, Staphylococcus epidermidis
EYQSHHSSIE

SEQ ID NO: 1778007 - protein, 7 aa, Staphylococcus epidermidis
EYRDKGI

SEQ ID NO: 1778008 - protein, 7 aa, Staphylococcus epidermidis
EYRKQSI

SEQ ID NO: 1778009 - protein, 8 aa, Staphylococcus epidermidis
EYSDSGDI

SEQ ID NO: 1778010 - protein, 13 aa, Staphylococcus epidermidis
EYSGIGTVEFTVS

SEQ ID NO: 1778011 - protein, 16 aa, Staphylococcus epidermidis
EYTKEKKANLLKISLL

SEQ ID NO: 1778012 - protein, 9 aa, Staphylococcus epidermidis
EYTSEDGDI

SEQ ID NO: 1778013 - protein, 12 aa, Staphylococcus epidermidis
EYTTGKNHAGRI

SEQ ID NO: 1778014 - protein, 7 aa, Staphylococcus epidermidis
EYTTQTV

SEQ ID NO: 1778015 - protein, 8 aa, Staphylococcus epidermidis
EYTYEPSI

SEQ ID NO: 1778016 - protein, 5 aa, Staphylococcus epidermidis
EYVNN

SEQ ID NO: 1778017 - protein, 7 aa, Staphylococcus epidermidis
FAAGRHP

SEQ ID NO: 1778018 - protein, 5 aa, Staphylococcus epidermidis
FADET

SEQ ID NO: 1778019 - protein, 4 aa, Staphylococcus epidermidis
FAEK

SEQ ID NO: 1778020 - protein, 7 aa, Staphylococcus epidermidis
FAENPQL

SEQ ID NO: 1778021 - protein, 13 aa, Staphylococcus epidermidis
FAGKEATLKTGQT

SEQ ID NO: 1778022 - protein, 4 aa, Staphylococcus epidermidis
FAHR

SEQ ID NO: 1778023 - protein, 4 aa, Staphylococcus epidermidis
FANK

SEQ ID NO: 1778024 - protein, 8 aa, Staphylococcus epidermidis
FANTEGGT

SEQ ID NO: 1778025 - protein, 11 aa, Staphylococcus epidermidis
FAPDGQDPSMI

SEQ ID NO: 1778026 - protein, 5 aa, Staphylococcus epidermidis
FAPDN

SEQ ID NO: 1778027 - protein, 17 aa, Staphylococcus epidermidis
FAPENSKKGKRLLLDRL

SEQ ID NO: 1778028 - protein, 4 aa, Staphylococcus epidermidis
FAPN

SEQ ID NO: 1778029 - protein, 41 aa, Staphylococcus epidermidis
FAQDTNELERRRQAAESARLADEKARRDREERERAEQASRT

SEQ ID NO: 1778030 - protein, 5 aa, Staphylococcus epidermidis
FARQY

SEQ ID NO: 1778031 - protein, 4 aa, Staphylococcus epidermidis
FASE

SEQ ID NO: 1778032 - protein, 8 aa, Staphylococcus epidermidis
FATGSSRE

SEQ ID NO: 1778033 - protein, 9 aa, Staphylococcus epidermidis
FDDKNELAR

SEQ ID NO: 1778034 - protein, 4 aa, Staphylococcus epidermidis
FDDQ

SEQ ID NO: 1778035 - protein, 9 aa, Staphylococcus epidermidis
FDDRETTNY

SEQ ID NO: 1778036 - protein, 4 aa, Staphylococcus epidermidis
FDED

SEQ ID NO: 1778037 - protein, 8 aa, Staphylococcus epidermidis
FDEEGKAL

SEQ ID NO: 1778038 - protein, 10 aa, Staphylococcus epidermidis
FDEENDSGAY

SEQ ID NO: 1778039 - protein, 4 aa, Staphylococcus epidermidis
FDEI

SEQ ID NO: 1778040 - protein, 4 aa, Staphylococcus epidermidis
FDEK

SEQ ID NO: 1778041 - protein, 6 aa, Staphylococcus epidermidis
FDEKGN

SEQ ID NO: 1778042 - protein, 12 aa, Staphylococcus epidermidis
FDENNSKKVTGV

SEQ ID NO: 1778043 - protein, 8 aa, Staphylococcus epidermidis
FDENTAKV

SEQ ID NO: 1778044 - protein, 4 aa, Staphylococcus epidermidis
FDEQ

SEQ ID NO: 1778045 - protein, 6 aa, Staphylococcus epidermidis
FDEQEK

SEQ ID NO: 1778046 - protein, 6 aa, Staphylococcus epidermidis
FDGDTD

SEQ ID NO: 1778047 - protein, 11 aa, Staphylococcus epidermidis
FDGNADTPAKL

SEQ ID NO: 1778048 - protein, 10 aa, Staphylococcus epidermidis
FDGQESITRP

SEQ ID NO: 1778049 - protein, 8 aa, Staphylococcus epidermidis
FDKEAEMK

SEQ ID NO: 1778050 - protein, 7 aa, Staphylococcus epidermidis
FDKNANT

SEQ ID NO: 1778051 - protein, 7 aa, Staphylococcus epidermidis
FDKPSYK

SEQ ID NO: 1778052 - protein, 8 aa, Staphylococcus epidermidis
FDKPSYKQ

SEQ ID NO: 1778053 - protein, 10 aa, Staphylococcus epidermidis
FDKYTNNDQL

SEQ ID NO: 1778054 - protein, 23 aa, Staphylococcus epidermidis
FDLDSSSDGIGEGWTQKGDNGAF

SEQ ID NO: 1778055 - protein, 13 aa, Staphylococcus epidermidis
FDMNGGDYPYNNT

SEQ ID NO: 1778056 - protein, 4 aa, Staphylococcus epidermidis
FDNS

SEQ ID NO: 1778057 - protein, 6 aa, Staphylococcus epidermidis
FDPHAY

SEQ ID NO: 1778058 - protein, 9 aa, Staphylococcus epidermidis
FDPKSEAMP

SEQ ID NO: 1778059 - protein, 5 aa, Staphylococcus epidermidis
FDPNR

SEQ ID NO: 1778060 - protein, 12 aa, Staphylococcus epidermidis
FDPNREDKHHLP

SEQ ID NO: 1778061 - protein, 6 aa, Staphylococcus epidermidis
FDPTTI

SEQ ID NO: 1778062 - protein, 4 aa, Staphylococcus epidermidis
FDQE

SEQ ID NO: 1778063 - protein, 16 aa, Staphylococcus epidermidis
FDSDTVEGIQSSNADV

SEQ ID NO: 1778064 - protein, 7 aa, Staphylococcus epidermidis
FDSGSAE

SEQ ID NO: 1778065 - protein, 8 aa, Staphylococcus epidermidis
FDSKQDPE

SEQ ID NO: 1778066 - protein, 26 aa, Staphylococcus epidermidis
FDSNDSRAGRWSNSSKTECGLHVTDK

SEQ ID NO: 1778067 - protein, 15 aa, Staphylococcus epidermidis
FDSNEKVTDVEGEVN

SEQ ID NO: 1778068 - protein, 5 aa, Staphylococcus epidermidis
FDSNN

SEQ ID NO: 1778069 - protein, 9 aa, Staphylococcus epidermidis
FDSSDENEK

SEQ ID NO: 1778070 - protein, 11 aa, Staphylococcus epidermidis
FDTEISSKISK

SEQ ID NO: 1778071 - protein, 14 aa, Staphylococcus epidermidis
FDTNNSIDGDRTNN

SEQ ID NO: 1778072 - protein, 10 aa, Staphylococcus epidermidis
FDTQKERGQM

SEQ ID NO: 1778073 - protein, 5 aa, Staphylococcus epidermidis
FDTSD

SEQ ID NO: 1778074 - protein, 21 aa, Staphylococcus epidermidis
FDTSNNDRQNVDAQEATYTAD

SEQ ID NO: 1778075 - protein, 36 aa, Staphylococcus epidermidis
FDTSSNDRQNVKAQEAKFTEETKDFNQQPEKEQPIE

SEQ ID NO: 1778076 - protein, 9 aa, Staphylococcus epidermidis
FDTTSAQPF

SEQ ID NO: 1778077 - protein, 10 aa, Staphylococcus epidermidis
FEADDREQPN

SEQ ID NO: 1778078 - protein, 16 aa, Staphylococcus epidermidis
FEAGDLPIPDGKKFAP

SEQ ID NO: 1778079 - protein, 17 aa, Staphylococcus epidermidis
FEAGDLPVPEGKTYAPA

SEQ ID NO: 1778080 - protein, 11 aa, Staphylococcus epidermidis
FEATAKEFGGE

SEQ ID NO: 1778081 - protein, 64 aa, Staphylococcus epidermidis
FEDKPSSQGRKSTSTGFGSSVNSGSTSQSHSTPKEDSFATNSSSSQASEGVSERSHTTKDDDIP

SEQ ID NO: 1778082 - protein, 6 aa, Staphylococcus epidermidis
FEDKTK

SEQ ID NO: 1778083 - protein, 5 aa, Staphylococcus epidermidis
FEDLK

SEQ ID NO: 1778084 - protein, 6 aa, Staphylococcus epidermidis
FEDQKA

SEQ ID NO: 1778085 - protein, 14 aa, Staphylococcus epidermidis
FEDSGAYTGETSPV

SEQ ID NO: 1778086 - protein, 6 aa, Staphylococcus epidermidis
FEENQS

SEQ ID NO: 1778087 - protein, 6 aa, Staphylococcus epidermidis
FEEPIN

SEQ ID NO: 1778088 - protein, 8 aa, Staphylococcus epidermidis
FEESKDPL

SEQ ID NO: 1778089 - protein, 11 aa, Staphylococcus epidermidis
FEGEDTRVLDK

SEQ ID NO: 1778090 - protein, 15 aa, Staphylococcus epidermidis
FEGEQGAKRSAAEQV

SEQ ID NO: 1778091 - protein, 10 aa, Staphylococcus epidermidis
FEGESREEVE

SEQ ID NO: 1778092 - protein, 12 aa, Staphylococcus epidermidis
FEGESRSEVEQR

SEQ ID NO: 1778093 - protein, 7 aa, Staphylococcus epidermidis
FEGGMSN

SEQ ID NO: 1778094 - protein, 9 aa, Staphylococcus epidermidis
FEGKSNTID

SEQ ID NO: 1778095 - protein, 9 aa, Staphylococcus epidermidis
FEGRVTKKD

SEQ ID NO: 1778096 - protein, 9 aa, Staphylococcus epidermidis
FEKAENFAQ

SEQ ID NO: 1778097 - protein, 10 aa, Staphylococcus epidermidis
FEKAEQLNNT

SEQ ID NO: 1778098 - protein, 6 aa, Staphylococcus epidermidis
FEKDTT

SEQ ID NO: 1778099 - protein, 51 aa, Staphylococcus epidermidis
FEKKQSQIGETSAPYVHDQKDKNHDVESHRNNLDSTSSTNNESTEVSNELN

SEQ ID NO: 1778100 - protein, 8 aa, Staphylococcus epidermidis
FEKPDSNA

SEQ ID NO: 1778101 - protein, 8 aa, Staphylococcus epidermidis
FEKPIPTH

SEQ ID NO: 1778102 - protein, 6 aa, Staphylococcus epidermidis
FEKQEE

SEQ ID NO: 1778103 - protein, 12 aa, Staphylococcus epidermidis
FEKQEQKDISEL

SEQ ID NO: 1778104 - protein, 8 aa, Staphylococcus epidermidis
FEKRTDKK

SEQ ID NO: 1778105 - protein, 10 aa, Staphylococcus epidermidis
FENESGTVKF

SEQ ID NO: 1778106 - protein, 12 aa, Staphylococcus epidermidis
FENKDANGNQHL

SEQ ID NO: 1778107 - protein, 6 aa, Staphylococcus epidermidis
FENNPH

SEQ ID NO: 1778108 - protein, 5 aa, Staphylococcus epidermidis
FENSR

SEQ ID NO: 1778109 - protein, 4 aa, Staphylococcus epidermidis
FENT

SEQ ID NO: 1778110 - protein, 15 aa, Staphylococcus epidermidis
FEPEGEERNGNGFIY

SEQ ID NO: 1778111 - protein, 10 aa, Staphylococcus epidermidis
FEPEQNETTM

SEQ ID NO: 1778112 - protein, 8 aa, Staphylococcus epidermidis
FEPGDEKE

SEQ ID NO: 1778113 - protein, 15 aa, Staphylococcus epidermidis
FEPKKIDNTEEEAAK

SEQ ID NO: 1778114 - protein, 6 aa, Staphylococcus epidermidis
FEPPAH

SEQ ID NO: 1778115 - protein, 4 aa, Staphylococcus epidermidis
FEPS

SEQ ID NO: 1778116 - protein, 5 aa, Staphylococcus epidermidis
FERDN

SEQ ID NO: 1778117 - protein, 7 aa, Staphylococcus epidermidis
FERNDLE

SEQ ID NO: 1778118 - protein, 10 aa, Staphylococcus epidermidis
FERVEQSGEI

SEQ ID NO: 1778119 - protein, 9 aa, Staphylococcus epidermidis
FESNDVAEK

SEQ ID NO: 1778120 - protein, 7 aa, Staphylococcus epidermidis
FETSISK

SEQ ID NO: 1778121 - protein, 15 aa, Staphylococcus epidermidis
FETTIESAAEHRAPH

SEQ ID NO: 1778122 - protein, 13 aa, Staphylococcus epidermidis
FGAEGIKNKDMHD

SEQ ID NO: 1778123 - protein, 16 aa, Staphylococcus epidermidis
FGDDSNEELRQASAKT

SEQ ID NO: 1778124 - protein, 5 aa, Staphylococcus epidermidis
FGDPE

SEQ ID NO: 1778125 - protein, 6 aa, Staphylococcus epidermidis
FGEATR

SEQ ID NO: 1778126 - protein, 8 aa, Staphylococcus epidermidis
FGEATRRA

SEQ ID NO: 1778127 - protein, 13 aa, Staphylococcus epidermidis
FGEETEDPYDEDT

SEQ ID NO: 1778128 - protein, 8 aa, Staphylococcus epidermidis
FGEKPKDT

SEQ ID NO: 1778129 - protein, 10 aa, Staphylococcus epidermidis
FGENDSATQV

SEQ ID NO: 1778130 - protein, 30 aa, Staphylococcus epidermidis
FGENTAKAEKNIYNNSNSSETLKTKVNELE

SEQ ID NO: 1778131 - protein, 30 aa, Staphylococcus epidermidis
FGENTAKAEKNIYNNSNSSKALKTKVNELE

SEQ ID NO: 1778132 - protein, 6 aa, Staphylococcus epidermidis
FGESYT

SEQ ID NO: 1778133 - protein, 12 aa, Staphylococcus epidermidis
FGGASEGNDYET

SEQ ID NO: 1778134 - protein, 16 aa, Staphylococcus epidermidis
FGGDLKSAKKLNNQIR

SEQ ID NO: 1778135 - protein, 14 aa, Staphylococcus epidermidis
FGGDPTGQTDSTQA

SEQ ID NO: 1778136 - protein, 7 aa, Staphylococcus epidermidis
FGGPQKS

SEQ ID NO: 1778137 - protein, 14 aa, Staphylococcus epidermidis
FGGTDNDPDKDSEH

SEQ ID NO: 1778138 - protein, 17 aa, Staphylococcus epidermidis
FGKPQKVVTDQAPSTKV

SEQ ID NO: 1778139 - protein, 17 aa, Staphylococcus epidermidis
FGKSQKVITDQAPSTKV

SEQ ID NO: 1778140 - protein, 5 aa, Staphylococcus epidermidis
FGMTA

SEQ ID NO: 1778141 - protein, 8 aa, Staphylococcus epidermidis
FGNDSSTH

SEQ ID NO: 1778142 - protein, 27 aa, Staphylococcus epidermidis
FGNHDTEGHLKRSDLRDIEDQYSTNYV

SEQ ID NO: 1778143 - protein, 10 aa, Staphylococcus epidermidis
FGNPSQEAEN

SEQ ID NO: 1778144 - protein, 9 aa, Staphylococcus epidermidis
FGNTTTSVD

SEQ ID NO: 1778145 - protein, 4 aa, Staphylococcus epidermidis
FGPE

SEQ ID NO: 1778146 - protein, 8 aa, Staphylococcus epidermidis
FGPGNQQA

SEQ ID NO: 1778147 - protein, 20 aa, Staphylococcus epidermidis
FGPNEDFDAYPRQLDDDVDA

SEQ ID NO: 1778148 - protein, 37 aa, Staphylococcus epidermidis
FGQNKNNLNTNKQTINEQKQNENQLDLNNEKENDIQL

SEQ ID NO: 1778149 - protein, 21 aa, Staphylococcus epidermidis
FGQRGYDISTGIESHNEKDFN

SEQ ID NO: 1778150 - protein, 4 aa, Staphylococcus epidermidis
FGRA

SEQ ID NO: 1778151 - protein, 10 aa, Staphylococcus epidermidis
FGSESADLND

SEQ ID NO: 1778152 - protein, 5 aa, Staphylococcus epidermidis
FGSNI

SEQ ID NO: 1778153 - protein, 10 aa, Staphylococcus epidermidis
FGTGKVSEAE

SEQ ID NO: 1778154 - protein, 4 aa, Staphylococcus epidermidis
FGTM

SEQ ID NO: 1778155 - protein, 11 aa, Staphylococcus epidermidis
FGVEGKSADEI

SEQ ID NO: 1778156 - protein, 4 aa, Staphylococcus epidermidis
FHPD

SEQ ID NO: 1778157 - protein, 23 aa, Staphylococcus epidermidis
FIESDRDRITTKRAVKDDYGKKQ

SEQ ID NO: 1778158 - protein, 4 aa, Staphylococcus epidermidis
FIPG

SEQ ID NO: 1778159 - protein, 13 aa, Staphylococcus epidermidis
FITSKSENSYSKE

SEQ ID NO: 1778160 - protein, 11 aa, Staphylococcus epidermidis
FKAEVEPQKDV

SEQ ID NO: 1778161 - protein, 8 aa, Staphylococcus epidermidis
FKASEVPS

SEQ ID NO: 1778162 - protein, 11 aa, Staphylococcus epidermidis
FKDSSNRETDI

SEQ ID NO: 1778163 - protein, 7 aa, Staphylococcus epidermidis
FKDTDTK

SEQ ID NO: 1778164 - protein, 12 aa, Staphylococcus epidermidis
FKEALERNKPDN

SEQ ID NO: 1778165 - protein, 7 aa, Staphylococcus epidermidis
FKEASEQ

SEQ ID NO: 1778166 - protein, 14 aa, Staphylococcus epidermidis
FKEEDVRKKGIENL

SEQ ID NO: 1778167 - protein, 6 aa, Staphylococcus epidermidis
FKEETK

SEQ ID NO: 1778168 - protein, 8 aa, Staphylococcus epidermidis
FKEGLSKD

SEQ ID NO: 1778169 - protein, 10 aa, Staphylococcus epidermidis
FKEKEEELTD

SEQ ID NO: 1778170 - protein, 6 aa, Staphylococcus epidermidis
FKENGQ

SEQ ID NO: 1778171 - protein, 9 aa, Staphylococcus epidermidis
FKENTRSFY

SEQ ID NO: 1778172 - protein, 6 aa, Staphylococcus epidermidis
FKEQHT

SEQ ID NO: 1778173 - protein, 10 aa, Staphylococcus epidermidis
FKESMSAKEA

SEQ ID NO: 1778174 - protein, 9 aa, Staphylococcus epidermidis
FKESMTAKE

SEQ ID NO: 1778175 - protein, 9 aa, Staphylococcus epidermidis
FKESSDEKV

SEQ ID NO: 1778176 - protein, 9 aa, Staphylococcus epidermidis
FKESTNEKV

SEQ ID NO: 1778177 - protein, 13 aa, Staphylococcus epidermidis
FKETTGKDYEPQV

SEQ ID NO: 1778178 - protein, 10 aa, Staphylococcus epidermidis
FKGEAQIRRE

SEQ ID NO: 1778179 - protein, 5 aa, Staphylococcus epidermidis
FKGER

SEQ ID NO: 1778180 - protein, 5 aa, Staphylococcus epidermidis
FKGQY

SEQ ID NO: 1778181 - protein, 9 aa, Staphylococcus epidermidis
FKGSSNTQY

SEQ ID NO: 1778182 - protein, 7 aa, Staphylococcus epidermidis
FKGTEAA

SEQ ID NO: 1778183 - protein, 67 aa, Staphylococcus epidermidis
FKKEQNNDNKQNTQDNHQKSNSKQNQNNKGKQQNKNNQQQKGNQQSNQNKKNGQNNKGKQQNKNNKK

SEQ ID NO: 1778184 - protein, 8 aa, Staphylococcus epidermidis
FKKSTEIE

SEQ ID NO: 1778185 - protein, 11 aa, Staphylococcus epidermidis
FKNAANQSAKI

SEQ ID NO: 1778186 - protein, 6 aa, Staphylococcus epidermidis
FKNAKG

SEQ ID NO: 1778187 - protein, 7 aa, Staphylococcus epidermidis
FKNASEQ

SEQ ID NO: 1778188 - protein, 9 aa, Staphylococcus epidermidis
FKNNEEERF

SEQ ID NO: 1778189 - protein, 7 aa, Staphylococcus epidermidis
FKNSSQI

SEQ ID NO: 1778190 - protein, 10 aa, Staphylococcus epidermidis
FKPEMDADQR

SEQ ID NO: 1778191 - protein, 7 aa, Staphylococcus epidermidis
FKPGQKD

SEQ ID NO: 1778192 - protein, 8 aa, Staphylococcus epidermidis
FKPNDEDI

SEQ ID NO: 1778193 - protein, 12 aa, Staphylococcus epidermidis
FKPSEDKSKDTY

SEQ ID NO: 1778194 - protein, 5 aa, Staphylococcus epidermidis
FKPSQ

SEQ ID NO: 1778195 - protein, 7 aa, Staphylococcus epidermidis
FKPSTAY

SEQ ID NO: 1778196 - protein, 14 aa, Staphylococcus epidermidis
FKQAEKPTRNIKED

SEQ ID NO: 1778197 - protein, 7 aa, Staphylococcus epidermidis
FKQASSV

SEQ ID NO: 1778198 - protein, 9 aa, Staphylococcus epidermidis
FKQDSPEEI

SEQ ID NO: 1778199 - protein, 7 aa, Staphylococcus epidermidis
FKSNKQL

SEQ ID NO: 1778200 - protein, 9 aa, Staphylococcus epidermidis
FKTESGETI

SEQ ID NO: 1778201 - protein, 12 aa, Staphylococcus epidermidis
FKTKPSKSKSKA

SEQ ID NO: 1778202 - protein, 6 aa, Staphylococcus epidermidis
FKTKRN

SEQ ID NO: 1778203 - protein, 6 aa, Staphylococcus epidermidis
FKTSDY

SEQ ID NO: 1778204 - protein, 7 aa, Staphylococcus epidermidis
FKVGDKE

SEQ ID NO: 1778205 - protein, 9 aa, Staphylococcus epidermidis
FMPNQSNYK

SEQ ID NO: 1778206 - protein, 30 aa, Staphylococcus epidermidis
FNAASQAAEQYKQKQEQTKQAIASMSNGEI

SEQ ID NO: 1778207 - protein, 9 aa, Staphylococcus epidermidis
FNDEGSHTL

SEQ ID NO: 1778208 - protein, 6 aa, Staphylococcus epidermidis
FNDNGF

SEQ ID NO: 1778209 - protein, 6 aa, Staphylococcus epidermidis
FNDNQL

SEQ ID NO: 1778210 - protein, 21 aa, Staphylococcus epidermidis
FNEDEQPKQNYDTAIQSGQEI

SEQ ID NO: 1778211 - protein, 8 aa, Staphylococcus epidermidis
FNEDPETK

SEQ ID NO: 1778212 - protein, 6 aa, Staphylococcus epidermidis
FNEDQG

SEQ ID NO: 1778213 - protein, 6 aa, Staphylococcus epidermidis
FNEEQG

SEQ ID NO: 1778214 - protein, 14 aa, Staphylococcus epidermidis
FNENTTLNITKGDE

SEQ ID NO: 1778215 - protein, 10 aa, Staphylococcus epidermidis
FNEPGTDLHS

SEQ ID NO: 1778216 - protein, 7 aa, Staphylococcus epidermidis
FNEPPNL

SEQ ID NO: 1778217 - protein, 12 aa, Staphylococcus epidermidis
FNEQNEKTDQLT

SEQ ID NO: 1778218 - protein, 17 aa, Staphylococcus epidermidis
FNGKGEHRYTFLDSFFE

SEQ ID NO: 1778219 - protein, 8 aa, Staphylococcus epidermidis
FNKEAQPI

SEQ ID NO: 1778220 - protein, 11 aa, Staphylococcus epidermidis
FNKKDNTYKDI

SEQ ID NO: 1778221 - protein, 8 aa, Staphylococcus epidermidis
FNNEGEEK

SEQ ID NO: 1778222 - protein, 7 aa, Staphylococcus epidermidis
FNNKTSE

SEQ ID NO: 1778223 - protein, 9 aa, Staphylococcus epidermidis
FNNSDGPRH

SEQ ID NO: 1778224 - protein, 8 aa, Staphylococcus epidermidis
FNNTNNTY

SEQ ID NO: 1778225 - protein, 15 aa, Staphylococcus epidermidis
FNNTNNTYYRLEDVE

SEQ ID NO: 1778226 - protein, 5 aa, Staphylococcus epidermidis
FNPKE

SEQ ID NO: 1778227 - protein, 27 aa, Staphylococcus epidermidis
FNPQNEKVAKKFGEQYGTTAEKAVYNG

SEQ ID NO: 1778228 - protein, 28 aa, Staphylococcus epidermidis
FNPQNEKVAKRFGEQYGTTAEKAVYNGP

SEQ ID NO: 1778229 - protein, 22 aa, Staphylococcus epidermidis
FNPSTNDRENVNAQEAKFTEEV

SEQ ID NO: 1778230 - protein, 10 aa, Staphylococcus epidermidis
FNQDESIKPQ

SEQ ID NO: 1778231 - protein, 7 aa, Staphylococcus epidermidis
FNQSEEE

SEQ ID NO: 1778232 - protein, 7 aa, Staphylococcus epidermidis
FNSDQNI

SEQ ID NO: 1778233 - protein, 7 aa, Staphylococcus epidermidis
FNSISKG

SEQ ID NO: 1778234 - protein, 6 aa, Staphylococcus epidermidis
FNSPTF

SEQ ID NO: 1778235 - protein, 10 aa, Staphylococcus epidermidis
FNSQKNRGYA

SEQ ID NO: 1778236 - protein, 4 aa, Staphylococcus epidermidis
FNTQ

SEQ ID NO: 1778237 - protein, 14 aa, Staphylococcus epidermidis
FNTSYSVDNTTQNQ

SEQ ID NO: 1778238 - protein, 18 aa, Staphylococcus epidermidis
FPAEARNEAYDRDKAKQL

SEQ ID NO: 1778239 - protein, 4 aa, Staphylococcus epidermidis
FPAG

SEQ ID NO: 1778240 - protein, 4 aa, Staphylococcus epidermidis
FPAS

SEQ ID NO: 1778241 - protein, 12 aa, Staphylococcus epidermidis
FPASSTGSFKSV

SEQ ID NO: 1778242 - protein, 5 aa, Staphylococcus epidermidis
FPDQQ

SEQ ID NO: 1778243 - protein, 9 aa, Staphylococcus epidermidis
FPDSSKINT

SEQ ID NO: 1778244 - protein, 5 aa, Staphylococcus epidermidis
FPDYG

SEQ ID NO: 1778245 - protein, 4 aa, Staphylococcus epidermidis
FPEE

SEQ ID NO: 1778246 - protein, 10 aa, Staphylococcus epidermidis
FPENKSLQQQ

SEQ ID NO: 1778247 - protein, 4 aa, Staphylococcus epidermidis
FPES

SEQ ID NO: 1778248 - protein, 12 aa, Staphylococcus epidermidis
FPGVGKASKKVM

SEQ ID NO: 1778249 - protein, 4 aa, Staphylococcus epidermidis
FPGY

SEQ ID NO: 1778250 - protein, 13 aa, Staphylococcus epidermidis
FPKKNGDKGNAAI

SEQ ID NO: 1778251 - protein, 13 aa, Staphylococcus epidermidis
FPKKNGDKGNTAI

SEQ ID NO: 1778252 - protein, 8 aa, Staphylococcus epidermidis
FPKPGETL

SEQ ID NO: 1778253 - protein, 11 aa, Staphylococcus epidermidis
FPKTREEENEV

SEQ ID NO: 1778254 - protein, 14 aa, Staphylococcus epidermidis
FPPISEKDLASTHA

SEQ ID NO: 1778255 - protein, 7 aa, Staphylococcus epidermidis
FPQNEET

SEQ ID NO: 1778256 - protein, 11 aa, Staphylococcus epidermidis
FPREEKNNKEI

SEQ ID NO: 1778257 - protein, 4 aa, Staphylococcus epidermidis
FPSA

SEQ ID NO: 1778258 - protein, 11 aa, Staphylococcus epidermidis
FPSAKQAQQAD

SEQ ID NO: 1778259 - protein, 15 aa, Staphylococcus epidermidis
FPSDKKTKIEVTESA

SEQ ID NO: 1778260 - protein, 5 aa, Staphylococcus epidermidis
FPSHE

SEQ ID NO: 1778261 - protein, 5 aa, Staphylococcus epidermidis
FPSRD

SEQ ID NO: 1778262 - protein, 13 aa, Staphylococcus epidermidis
FPSSEKSNDSSTI

SEQ ID NO: 1778263 - protein, 4 aa, Staphylococcus epidermidis
FPTY

SEQ ID NO: 1778264 - protein, 11 aa, Staphylococcus epidermidis
FQDETGEDSER

SEQ ID NO: 1778265 - protein, 7 aa, Staphylococcus epidermidis
FQDNTPV

SEQ ID NO: 1778266 - protein, 9 aa, Staphylococcus epidermidis
FQEADGTRH

SEQ ID NO: 1778267 - protein, 4 aa, Staphylococcus epidermidis
FQEN

SEQ ID NO: 1778268 - protein, 8 aa, Staphylococcus epidermidis
FQKRKDKK

SEQ ID NO: 1778269 - protein, 5 aa, Staphylococcus epidermidis
FQNNS

SEQ ID NO: 1778270 - protein, 15 aa, Staphylococcus epidermidis
FQNYGKDNAFQQSEN

SEQ ID NO: 1778271 - protein, 4 aa, Staphylococcus epidermidis
FQPE

SEQ ID NO: 1778272 - protein, 4 aa, Staphylococcus epidermidis
FQPT

SEQ ID NO: 1778273 - protein, 7 aa, Staphylococcus epidermidis
FQQTEDK

SEQ ID NO: 1778274 - protein, 6 aa, Staphylococcus epidermidis
FQRRDQ

SEQ ID NO: 1778275 - protein, 10 aa, Staphylococcus epidermidis
FQSKGTLESY

SEQ ID NO: 1778276 - protein, 4 aa, Staphylococcus epidermidis
FQTP

SEQ ID NO: 1778277 - protein, 11 aa, Staphylococcus epidermidis
FRAGDSGSPMV

SEQ ID NO: 1778278 - protein, 8 aa, Staphylococcus epidermidis
FRDEKRPR

SEQ ID NO: 1778279 - protein, 9 aa, Staphylococcus epidermidis
FRENDKSRL

SEQ ID NO: 1778280 - protein, 6 aa, Staphylococcus epidermidis
FRENYG

SEQ ID NO: 1778281 - protein, 13 aa, Staphylococcus epidermidis
FRETQNNTEAQGL

SEQ ID NO: 1778282 - protein, 15 aa, Staphylococcus epidermidis
FRGRNGGRPSISNEI

SEQ ID NO: 1778283 - protein, 11 aa, Staphylococcus epidermidis
FRKSPKNKDEL

SEQ ID NO: 1778284 - protein, 11 aa, Staphylococcus epidermidis
FRKSPKNKEEL

SEQ ID NO: 1778285 - protein, 6 aa, Staphylococcus epidermidis
FRNAGQ

SEQ ID NO: 1778286 - protein, 8 aa, Staphylococcus epidermidis
FRNGKDAI

SEQ ID NO: 1778287 - protein, 16 aa, Staphylococcus epidermidis
FRNKGSKVCSANSVRA

SEQ ID NO: 1778288 - protein, 15 aa, Staphylococcus epidermidis
FRNRENKVIDTVKIV

SEQ ID NO: 1778289 - protein, 11 aa, Staphylococcus epidermidis
FRPGLKARDEF

SEQ ID NO: 1778290 - protein, 6 aa, Staphylococcus epidermidis
FRPGQK

SEQ ID NO: 1778291 - protein, 7 aa, Staphylococcus epidermidis
FRQNNDE

SEQ ID NO: 1778292 - protein, 12 aa, Staphylococcus epidermidis
FRSGGSKPAPVT

SEQ ID NO: 1778293 - protein, 4 aa, Staphylococcus epidermidis
FRSR

SEQ ID NO: 1778294 - protein, 6 aa, Staphylococcus epidermidis
FRTEPS

SEQ ID NO: 1778295 - protein, 7 aa, Staphylococcus epidermidis
FRTSTEY

SEQ ID NO: 1778296 - protein, 11 aa, Staphylococcus epidermidis
FSDAGNAANLA

SEQ ID NO: 1778297 - protein, 5 aa, Staphylococcus epidermidis
FSDEN

SEQ ID NO: 1778298 - protein, 8 aa, Staphylococcus epidermidis
FSDETAIQ

SEQ ID NO: 1778299 - protein, 5 aa, Staphylococcus epidermidis
FSDGQ

SEQ ID NO: 1778300 - protein, 7 aa, Staphylococcus epidermidis
FSDKSGE

SEQ ID NO: 1778301 - protein, 7 aa, Staphylococcus epidermidis
FSEEEQQ

SEQ ID NO: 1778302 - protein, 9 aa, Staphylococcus epidermidis
FSEELGAKG

SEQ ID NO: 1778303 - protein, 8 aa, Staphylococcus epidermidis
FSEERRTA

SEQ ID NO: 1778304 - protein, 22 aa, Staphylococcus epidermidis
FSEPKTKSIYSQEKLMWSLFLD

SEQ ID NO: 1778305 - protein, 7 aa, Staphylococcus epidermidis
FSEPTEQ

SEQ ID NO: 1778306 - protein, 13 aa, Staphylococcus epidermidis
FSERTGKSFSSDD

SEQ ID NO: 1778307 - protein, 9 aa, Staphylococcus epidermidis
FSESEQAQY

SEQ ID NO: 1778308 - protein, 10 aa, Staphylococcus epidermidis
FSETSRKQKQ

SEQ ID NO: 1778309 - protein, 9 aa, Staphylococcus epidermidis
FSEYAGSLE

SEQ ID NO: 1778310 - protein, 9 aa, Staphylococcus epidermidis
FSGGQRQRI

SEQ ID NO: 1778311 - protein, 12 aa, Staphylococcus epidermidis
FSGSGHAPHIEE

SEQ ID NO: 1778312 - protein, 17 aa, Staphylococcus epidermidis
FSGSGIKTSLGMGKYSI

SEQ ID NO: 1778313 - protein, 5 aa, Staphylococcus epidermidis
FSGWE

SEQ ID NO: 1778314 - protein, 8 aa, Staphylococcus epidermidis
FSGYTKDY

SEQ ID NO: 1778315 - protein, 12 aa, Staphylococcus epidermidis
FSHAAQKGQQKL

SEQ ID NO: 1778316 - protein, 6 aa, Staphylococcus epidermidis
FSIRGG

SEQ ID NO: 1778317 - protein, 10 aa, Staphylococcus epidermidis
FSKDTKGIYG

SEQ ID NO: 1778318 - protein, 6 aa, Staphylococcus epidermidis
FSKGQR

SEQ ID NO: 1778319 - protein, 5 aa, Staphylococcus epidermidis
FSKPT

SEQ ID NO: 1778320 - protein, 11 aa, Staphylococcus epidermidis
FSKTGYSNSRL

SEQ ID NO: 1778321 - protein, 4 aa, Staphylococcus epidermidis
FSLS

SEQ ID NO: 1778322 - protein, 7 aa, Staphylococcus epidermidis
FSNASKD

SEQ ID NO: 1778323 - protein, 10 aa, Staphylococcus epidermidis
FSNASTYSKQ

SEQ ID NO: 1778324 - protein, 5 aa, Staphylococcus epidermidis
FSNEA

SEQ ID NO: 1778325 - protein, 9 aa, Staphylococcus epidermidis
FSNEDKIDN

SEQ ID NO: 1778326 - protein, 23 aa, Staphylococcus epidermidis
FSNESNIEYPKTENIQYSSGNYT

SEQ ID NO: 1778327 - protein, 13 aa, Staphylococcus epidermidis
FSNNSKPASEGVK

SEQ ID NO: 1778328 - protein, 6 aa, Staphylococcus epidermidis
FSNPFT

SEQ ID NO: 1778329 - protein, 10 aa, Staphylococcus epidermidis
FSPPTNDERI

SEQ ID NO: 1778330 - protein, 17 aa, Staphylococcus epidermidis
FSPQKKPDQIKSEIEKL

SEQ ID NO: 1778331 - protein, 18 aa, Staphylococcus epidermidis
FSPQKKPEQIKSEIEKLL

SEQ ID NO: 1778332 - protein, 9 aa, Staphylococcus epidermidis
FSPTKRQEF

SEQ ID NO: 1778333 - protein, 15 aa, Staphylococcus epidermidis
FSQKINKNKSNFTID

SEQ ID NO: 1778334 - protein, 10 aa, Staphylococcus epidermidis
FSQPDEKGNY

SEQ ID NO: 1778335 - protein, 8 aa, Staphylococcus epidermidis
FSQTDEHG

SEQ ID NO: 1778336 - protein, 4 aa, Staphylococcus epidermidis
FSRK

SEQ ID NO: 1778337 - protein, 9 aa, Staphylococcus epidermidis
FSRSGSDRL

SEQ ID NO: 1778338 - protein, 13 aa, Staphylococcus epidermidis
FSRTGKKGGPFID

SEQ ID NO: 1778339 - protein, 12 aa, Staphylococcus epidermidis
FSSDSSHVKGIR

SEQ ID NO: 1778340 - protein, 4 aa, Staphylococcus epidermidis
FSSG

SEQ ID NO: 1778341 - protein, 10 aa, Staphylococcus epidermidis
FSSGTAERSW

SEQ ID NO: 1778342 - protein, 13 aa, Staphylococcus epidermidis
FSSLDDKTKKEGI

SEQ ID NO: 1778343 - protein, 9 aa, Staphylococcus epidermidis
FSSRGKDLP

SEQ ID NO: 1778344 - protein, 6 aa, Staphylococcus epidermidis
FSSSQH

SEQ ID NO: 1778345 - protein, 4 aa, Staphylococcus epidermidis
FSTD

SEQ ID NO: 1778346 - protein, 6 aa, Staphylococcus epidermidis
FSTEEK

SEQ ID NO: 1778347 - protein, 11 aa, Staphylococcus epidermidis
FSTKGDNRGLG

SEQ ID NO: 1778348 - protein, 10 aa, Staphylococcus epidermidis
FSTNGAKADI

SEQ ID NO: 1778349 - protein, 8 aa, Staphylococcus epidermidis
FSTQSPQL

SEQ ID NO: 1778350 - protein, 6 aa, Staphylococcus epidermidis
FSTSDT

SEQ ID NO: 1778351 - protein, 7 aa, Staphylococcus epidermidis
FSTSDTQ

SEQ ID NO: 1778352 - protein, 6 aa, Staphylococcus epidermidis
FSTSQV

SEQ ID NO: 1778353 - protein, 7 aa, Staphylococcus epidermidis
FSYKDGA

SEQ ID NO: 1778354 - protein, 7 aa, Staphylococcus epidermidis
FTANSTI

SEQ ID NO: 1778355 - protein, 9 aa, Staphylococcus epidermidis
FTASSGPGL

SEQ ID NO: 1778356 - protein, 6 aa, Staphylococcus epidermidis
FTCPNN

SEQ ID NO: 1778357 - protein, 8 aa, Staphylococcus epidermidis
FTDGQKPR

SEQ ID NO: 1778358 - protein, 4 aa, Staphylococcus epidermidis
FTDN

SEQ ID NO: 1778359 - protein, 9 aa, Staphylococcus epidermidis
FTDNDKEKL

SEQ ID NO: 1778360 - protein, 7 aa, Staphylococcus epidermidis
FTDNKDD

SEQ ID NO: 1778361 - protein, 11 aa, Staphylococcus epidermidis
FTDSEEKAMGL

SEQ ID NO: 1778362 - protein, 5 aa, Staphylococcus epidermidis
FTEKN

SEQ ID NO: 1778363 - protein, 13 aa, Staphylococcus epidermidis
FTEYNQALKRMVD

SEQ ID NO: 1778364 - protein, 9 aa, Staphylococcus epidermidis
FTGQNKARG

SEQ ID NO: 1778365 - protein, 6 aa, Staphylococcus epidermidis
FTGSKN

SEQ ID NO: 1778366 - protein, 11 aa, Staphylococcus epidermidis
FTIDGQQYKRR

SEQ ID NO: 1778367 - protein, 4 aa, Staphylococcus epidermidis
FTKD

SEQ ID NO: 1778368 - protein, 12 aa, Staphylococcus epidermidis
FTKNKTGKRVNL

SEQ ID NO: 1778369 - protein, 12 aa, Staphylococcus epidermidis
FTKQTSGSLQNK

SEQ ID NO: 1778370 - protein, 9 aa, Staphylococcus epidermidis
FTNKEELER

SEQ ID NO: 1778371 - protein, 6 aa, Staphylococcus epidermidis
FTNTDI

SEQ ID NO: 1778372 - protein, 5 aa, Staphylococcus epidermidis
FTPDD

SEQ ID NO: 1778373 - protein, 5 aa, Staphylococcus epidermidis
FTPEN

SEQ ID NO: 1778374 - protein, 9 aa, Staphylococcus epidermidis
FTQGHGTAD

SEQ ID NO: 1778375 - protein, 6 aa, Staphylococcus epidermidis
FTSESE

SEQ ID NO: 1778376 - protein, 9 aa, Staphylococcus epidermidis
FTSYDTNEL

SEQ ID NO: 1778377 - protein, 10 aa, Staphylococcus epidermidis
FTTEDETYIN

SEQ ID NO: 1778378 - protein, 10 aa, Staphylococcus epidermidis
FTTESGETID

SEQ ID NO: 1778379 - protein, 14 aa, Staphylococcus epidermidis
FTTPDEQEALIKET

SEQ ID NO: 1778380 - protein, 18 aa, Staphylococcus epidermidis
FTTSEHGKQKLESAGVQP

SEQ ID NO: 1778381 - protein, 11 aa, Staphylococcus epidermidis
FTYDSNKKVNG

SEQ ID NO: 1778382 - protein, 21 aa, Staphylococcus epidermidis
FVPNRQDDKILESSDIQPFNH

SEQ ID NO: 1778383 - protein, 16 aa, Staphylococcus epidermidis
FVPTSAGLASSASAYA

SEQ ID NO: 1778384 - protein, 9 aa, Staphylococcus epidermidis
FVTSNQDIK

SEQ ID NO: 1778385 - protein, 5 aa, Staphylococcus epidermidis
FYKKS

SEQ ID NO: 1778386 - protein, 5 aa, Staphylococcus epidermidis
FYPNT

SEQ ID NO: 1778387 - protein, 7 aa, Staphylococcus epidermidis
GAAGQAL

SEQ ID NO: 1778388 - protein, 6 aa, Staphylococcus epidermidis
GAAGTE

SEQ ID NO: 1778389 - protein, 7 aa, Staphylococcus epidermidis
GAANGKT

SEQ ID NO: 1778390 - protein, 9 aa, Staphylococcus epidermidis
GAAPEDGEI

SEQ ID NO: 1778391 - protein, 8 aa, Staphylococcus epidermidis
GADEVDPN

SEQ ID NO: 1778392 - protein, 13 aa, Staphylococcus epidermidis
GADRRPAYSIRKV

SEQ ID NO: 1778393 - protein, 12 aa, Staphylococcus epidermidis
GAEDNIEQGAQD

SEQ ID NO: 1778394 - protein, 11 aa, Staphylococcus epidermidis
GAEGIRNKDMH

SEQ ID NO: 1778395 - protein, 4 aa, Staphylococcus epidermidis
GAER

SEQ ID NO: 1778396 - protein, 12 aa, Staphylococcus epidermidis
GAESVKETLGEQ

SEQ ID NO: 1778397 - protein, 7 aa, Staphylococcus epidermidis
GAETNYY

SEQ ID NO: 1778398 - protein, 8 aa, Staphylococcus epidermidis
GAFGGKKE

SEQ ID NO: 1778399 - protein, 12 aa, Staphylococcus epidermidis
GAFKDSPKIGKE

SEQ ID NO: 1778400 - protein, 23 aa, Staphylococcus epidermidis
GAFTKQYGDKVSPIKGEVNPNFE

SEQ ID NO: 1778401 - protein, 8 aa, Staphylococcus epidermidis
GAGKSTTI

SEQ ID NO: 1778402 - protein, 8 aa, Staphylococcus epidermidis
GAGKTSVI

SEQ ID NO: 1778403 - protein, 9 aa, Staphylococcus epidermidis
GAGSGIGEA

SEQ ID NO: 1778404 - protein, 9 aa, Staphylococcus epidermidis
GAGSGIGKS

SEQ ID NO: 1778405 - protein, 5 aa, Staphylococcus epidermidis
GAGTV

SEQ ID NO: 1778406 - protein, 8 aa, Staphylococcus epidermidis
GAHQQAEE

SEQ ID NO: 1778407 - protein, 8 aa, Staphylococcus epidermidis
GAHSGGSQ

SEQ ID NO: 1778408 - protein, 8 aa, Staphylococcus epidermidis
GAISESAL

SEQ ID NO: 1778409 - protein, 11 aa, Staphylococcus epidermidis
GAISNEKGEML

SEQ ID NO: 1778410 - protein, 8 aa, Staphylococcus epidermidis
GAKAAGKD

SEQ ID NO: 1778411 - protein, 8 aa, Staphylococcus epidermidis
GAKAPSLV

SEQ ID NO: 1778412 - protein, 9 aa, Staphylococcus epidermidis
GAKDETVTR

SEQ ID NO: 1778413 - protein, 9 aa, Staphylococcus epidermidis
GAKKRAPKI

SEQ ID NO: 1778414 - protein, 8 aa, Staphylococcus epidermidis
GAKNGKSV

SEQ ID NO: 1778415 - protein, 13 aa, Staphylococcus epidermidis
GAKNIYRKTVWGI

SEQ ID NO: 1778416 - protein, 7 aa, Staphylococcus epidermidis
GAKPRIE

SEQ ID NO: 1778417 - protein, 6 aa, Staphylococcus epidermidis
GAKPSE

SEQ ID NO: 1778418 - protein, 10 aa, Staphylococcus epidermidis
GAKPTPLPIK

SEQ ID NO: 1778419 - protein, 11 aa, Staphylococcus epidermidis
GALTSNASDEV

SEQ ID NO: 1778420 - protein, 7 aa, Staphylococcus epidermidis
GAMAKHT

SEQ ID NO: 1778421 - protein, 17 aa, Staphylococcus epidermidis
GANAAKDIITDEDKKNI

SEQ ID NO: 1778422 - protein, 8 aa, Staphylococcus epidermidis
GANAKDEV

SEQ ID NO: 1778423 - protein, 5 aa, Staphylococcus epidermidis
GANDY

SEQ ID NO: 1778424 - protein, 16 aa, Staphylococcus epidermidis
GANETRSYLASGTSRL

SEQ ID NO: 1778425 - protein, 7 aa, Staphylococcus epidermidis
GANGTGD

SEQ ID NO: 1778426 - protein, 5 aa, Staphylococcus epidermidis
GANHT

SEQ ID NO: 1778427 - protein, 9 aa, Staphylococcus epidermidis
GANRPKKVT

SEQ ID NO: 1778428 - protein, 9 aa, Staphylococcus epidermidis
GANSNVAYG

SEQ ID NO: 1778429 - protein, 10 aa, Staphylococcus epidermidis
GAPDKENEEA

SEQ ID NO: 1778430 - protein, 8 aa, Staphylococcus epidermidis
GAPGFEDE

SEQ ID NO: 1778431 - protein, 7 aa, Staphylococcus epidermidis
GAPGFEN

SEQ ID NO: 1778432 - protein, 10 aa, Staphylococcus epidermidis
GAPMTPGEIQ

SEQ ID NO: 1778433 - protein, 10 aa, Staphylococcus epidermidis
GAPTRAVEEA

SEQ ID NO: 1778434 - protein, 9 aa, Staphylococcus epidermidis
GAPVERTNV

SEQ ID NO: 1778435 - protein, 7 aa, Staphylococcus epidermidis
GAQAAPH

SEQ ID NO: 1778436 - protein, 5 aa, Staphylococcus epidermidis
GAQAE

SEQ ID NO: 1778437 - protein, 10 aa, Staphylococcus epidermidis
GAQDEATQMV

SEQ ID NO: 1778438 - protein, 7 aa, Staphylococcus epidermidis
GAQPGLS

SEQ ID NO: 1778439 - protein, 14 aa, Staphylococcus epidermidis
GAQSLPNLTPQGDV

SEQ ID NO: 1778440 - protein, 10 aa, Staphylococcus epidermidis
GAQTSEADIQ

SEQ ID NO: 1778441 - protein, 4 aa, Staphylococcus epidermidis
GARR

SEQ ID NO: 1778442 - protein, 9 aa, Staphylococcus epidermidis
GASDIVNNG

SEQ ID NO: 1778443 - protein, 8 aa, Staphylococcus epidermidis
GASEALDT

SEQ ID NO: 1778444 - protein, 8 aa, Staphylococcus epidermidis
GASGIGQY

SEQ ID NO: 1778445 - protein, 7 aa, Staphylococcus epidermidis
GASGSEE

SEQ ID NO: 1778446 - protein, 9 aa, Staphylococcus epidermidis
GASGSGKTT

SEQ ID NO: 1778447 - protein, 4 aa, Staphylococcus epidermidis
GASL

SEQ ID NO: 1778448 - protein, 13 aa, Staphylococcus epidermidis
GASLYDTGSVDDT

SEQ ID NO: 1778449 - protein, 10 aa, Staphylococcus epidermidis
GASPASSVTN

SEQ ID NO: 1778450 - protein, 10 aa, Staphylococcus epidermidis
GASPAVPEIP

SEQ ID NO: 1778451 - protein, 9 aa, Staphylococcus epidermidis
GASPGASTS

SEQ ID NO: 1778452 - protein, 9 aa, Staphylococcus epidermidis
GASPRPIKD

SEQ ID NO: 1778453 - protein, 10 aa, Staphylococcus epidermidis
GASPSLPQIS

SEQ ID NO: 1778454 - protein, 14 aa, Staphylococcus epidermidis
GASSGVIDLLKFAM

SEQ ID NO: 1778455 - protein, 11 aa, Staphylococcus epidermidis
GASTGIGKASA

SEQ ID NO: 1778456 - protein, 13 aa, Staphylococcus epidermidis
GASVYSASEIARQ

SEQ ID NO: 1778457 - protein, 16 aa, Staphylococcus epidermidis
GATATFNSSDKDIDEQ

SEQ ID NO: 1778458 - protein, 11 aa, Staphylococcus epidermidis
GATDSKGGCSG

SEQ ID NO: 1778459 - protein, 8 aa, Staphylococcus epidermidis
GATESNNM

SEQ ID NO: 1778460 - protein, 5 aa, Staphylococcus epidermidis
GATQM

SEQ ID NO: 1778461 - protein, 29 aa, Staphylococcus epidermidis
GATTFGAPNVNETFSKNYQNKIDSRQFEQ

SEQ ID NO: 1778462 - protein, 7 aa, Staphylococcus epidermidis
GATTTNA

SEQ ID NO: 1778463 - protein, 9 aa, Staphylococcus epidermidis
GAVAKRARA

SEQ ID NO: 1778464 - protein, 14 aa, Staphylococcus epidermidis
GAVSQASGRQLKAM

SEQ ID NO: 1778465 - protein, 5 aa, Staphylococcus epidermidis
GAYEN

SEQ ID NO: 1778466 - protein, 12 aa, Staphylococcus epidermidis
GCGNDGNTEYAG

SEQ ID NO: 1778467 - protein, 8 aa, Staphylococcus epidermidis
GCGSSREH

SEQ ID NO: 1778468 - protein, 5 aa, Staphylococcus epidermidis
GCNND

SEQ ID NO: 1778469 - protein, 16 aa, Staphylococcus epidermidis
GCTNNKEILPNTSDYT

SEQ ID NO: 1778470 - protein, 6 aa, Staphylococcus epidermidis
GDAEEI

SEQ ID NO: 1778471 - protein, 5 aa, Staphylococcus epidermidis
GDAIA

SEQ ID NO: 1778472 - protein, 8 aa, Staphylococcus epidermidis
GDAIPSTI

SEQ ID NO: 1778473 - protein, 5 aa, Staphylococcus epidermidis
GDARS

SEQ ID NO: 1778474 - protein, 19 aa, Staphylococcus epidermidis
GDDDFGKLEGGKLDKKQPA

SEQ ID NO: 1778475 - protein, 9 aa, Staphylococcus epidermidis
GDDEHGWNK

SEQ ID NO: 1778476 - protein, 4 aa, Staphylococcus epidermidis
GDDI

SEQ ID NO: 1778477 - protein, 9 aa, Staphylococcus epidermidis
GDDLPPSDL

SEQ ID NO: 1778478 - protein, 7 aa, Staphylococcus epidermidis
GDDQKQK

SEQ ID NO: 1778479 - protein, 6 aa, Staphylococcus epidermidis
GDEDSL

SEQ ID NO: 1778480 - protein, 20 aa, Staphylococcus epidermidis
GDEEKLGKAVGSDETNHKST

SEQ ID NO: 1778481 - protein, 4 aa, Staphylococcus epidermidis
GDEI

SEQ ID NO: 1778482 - protein, 4 aa, Staphylococcus epidermidis
GDEK

SEQ ID NO: 1778483 - protein, 10 aa, Staphylococcus epidermidis
GDELSRTQGF

SEQ ID NO: 1778484 - protein, 6 aa, Staphylococcus epidermidis
GDENKQ

SEQ ID NO: 1778485 - protein, 4 aa, Staphylococcus epidermidis
GDEP

SEQ ID NO: 1778486 - protein, 5 aa, Staphylococcus epidermidis
GDEQG

SEQ ID NO: 1778487 - protein, 4 aa, Staphylococcus epidermidis
GDER

SEQ ID NO: 1778488 - protein, 7 aa, Staphylococcus epidermidis
GDESKRL

SEQ ID NO: 1778489 - protein, 10 aa, Staphylococcus epidermidis
GDFETTENGY

SEQ ID NO: 1778490 - protein, 5 aa, Staphylococcus epidermidis
GDFTP

SEQ ID NO: 1778491 - protein, 7 aa, Staphylococcus epidermidis
GDFYTEQ

SEQ ID NO: 1778492 - protein, 12 aa, Staphylococcus epidermidis
GDGDLKGSSIGH

SEQ ID NO: 1778493 - protein, 14 aa, Staphylococcus epidermidis
GDGDLKGSSVGSKN

SEQ ID NO: 1778494 - protein, 14 aa, Staphylococcus epidermidis
GDGEGVGNPLSEHP

SEQ ID NO: 1778495 - protein, 7 aa, Staphylococcus epidermidis
GDGEQTR

SEQ ID NO: 1778496 - protein, 6 aa, Staphylococcus epidermidis
GDGGTA

SEQ ID NO: 1778497 - protein, 9 aa, Staphylococcus epidermidis
GDGHRDDPV

SEQ ID NO: 1778498 - protein, 6 aa, Staphylococcus epidermidis
GDGKDN

SEQ ID NO: 1778499 - protein, 6 aa, Staphylococcus epidermidis
GDGPDE

SEQ ID NO: 1778500 - protein, 7 aa, Staphylococcus epidermidis
GDGRNNM

SEQ ID NO: 1778501 - protein, 8 aa, Staphylococcus epidermidis
GDGSVKRG

SEQ ID NO: 1778502 - protein, 5 aa, Staphylococcus epidermidis
GDGTM

SEQ ID NO: 1778503 - protein, 14 aa, Staphylococcus epidermidis
GDGVINARDTKKMQ

SEQ ID NO: 1778504 - protein, 5 aa, Staphylococcus epidermidis
GDGYD

SEQ ID NO: 1778505 - protein, 4 aa, Staphylococcus epidermidis
GDHY

SEQ ID NO: 1778506 - protein, 6 aa, Staphylococcus epidermidis
GDIDEN

SEQ ID NO: 1778507 - protein, 4 aa, Staphylococcus epidermidis
GDII

SEQ ID NO: 1778508 - protein, 11 aa, Staphylococcus epidermidis
GDIIPNPSTHK

SEQ ID NO: 1778509 - protein, 6 aa, Staphylococcus epidermidis
GDINDL

SEQ ID NO: 1778510 - protein, 5 aa, Staphylococcus epidermidis
GDINY

SEQ ID NO: 1778511 - protein, 4 aa, Staphylococcus epidermidis
GDIP

SEQ ID NO: 1778512 - protein, 5 aa, Staphylococcus epidermidis
GDIPM

SEQ ID NO: 1778513 - protein, 9 aa, Staphylococcus epidermidis
GDITSSAKL

SEQ ID NO: 1778514 - protein, 8 aa, Staphylococcus epidermidis
GDITSSNN

SEQ ID NO: 1778515 - protein, 13 aa, Staphylococcus epidermidis
GDKFGYADEPKNK

SEQ ID NO: 1778516 - protein, 15 aa, Staphylococcus epidermidis
GDKIRKAQPSDEPIG

SEQ ID NO: 1778517 - protein, 9 aa, Staphylococcus epidermidis
GDKTEEGKA

SEQ ID NO: 1778518 - protein, 15 aa, Staphylococcus epidermidis
GDLANGSRKAKRINQ

SEQ ID NO: 1778519 - protein, 10 aa, Staphylococcus epidermidis
GDLAQNDTSL

SEQ ID NO: 1778520 - protein, 11 aa, Staphylococcus epidermidis
GDLDDSERNAI

SEQ ID NO: 1778521 - protein, 8 aa, Staphylococcus epidermidis
GDLHGEQK

SEQ ID NO: 1778522 - protein, 6 aa, Staphylococcus epidermidis
GDLKPP

SEQ ID NO: 1778523 - protein, 11 aa, Staphylococcus epidermidis
GDLPATQQAPL

SEQ ID NO: 1778524 - protein, 9 aa, Staphylococcus epidermidis
GDLTTSDTS

SEQ ID NO: 1778525 - protein, 5 aa, Staphylococcus epidermidis
GDNFQ

SEQ ID NO: 1778526 - protein, 21 aa, Staphylococcus epidermidis
GDNPWHQSHDDTSYHSHQDDI

SEQ ID NO: 1778527 - protein, 10 aa, Staphylococcus epidermidis
GDNQKKAADP

SEQ ID NO: 1778528 - protein, 9 aa, Staphylococcus epidermidis
GDNRPSRVS

SEQ ID NO: 1778529 - protein, 4 aa, Staphylococcus epidermidis
GDPD

SEQ ID NO: 1778530 - protein, 5 aa, Staphylococcus epidermidis
GDPDL

SEQ ID NO: 1778531 - protein, 6 aa, Staphylococcus epidermidis
GDPFDE

SEQ ID NO: 1778532 - protein, 19 aa, Staphylococcus epidermidis
GDPKLNEKQKKLSGEEGTS

SEQ ID NO: 1778533 - protein, 20 aa, Staphylococcus epidermidis
GDPKYDLEESKNRDATYAAP

SEQ ID NO: 1778534 - protein, 14 aa, Staphylococcus epidermidis
GDPKYGPKKTLDIG

SEQ ID NO: 1778535 - protein, 15 aa, Staphylococcus epidermidis
GDPKYGPKKTLDIGG

SEQ ID NO: 1778536 - protein, 10 aa, Staphylococcus epidermidis
GDPLDENTDY

SEQ ID NO: 1778537 - protein, 19 aa, Staphylococcus epidermidis
GDPQFEGQTKTKLGNSEVR

SEQ ID NO: 1778538 - protein, 5 aa, Staphylococcus epidermidis
GDQEA

SEQ ID NO: 1778539 - protein, 5 aa, Staphylococcus epidermidis
GDQKL

SEQ ID NO: 1778540 - protein, 8 aa, Staphylococcus epidermidis
GDQVNEGD

SEQ ID NO: 1778541 - protein, 14 aa, Staphylococcus epidermidis
GDRGKNYPNEKDFY

SEQ ID NO: 1778542 - protein, 9 aa, Staphylococcus epidermidis
GDSDNPKMK

SEQ ID NO: 1778543 - protein, 8 aa, Staphylococcus epidermidis
GDSEQAAQ

SEQ ID NO: 1778544 - protein, 10 aa, Staphylococcus epidermidis
GDSEYNDNNR

SEQ ID NO: 1778545 - protein, 4 aa, Staphylococcus epidermidis
GDSL

SEQ ID NO: 1778546 - protein, 21 aa, Staphylococcus epidermidis
GDSNGMSKASEMLSGTNRGIA

SEQ ID NO: 1778547 - protein, 8 aa, Staphylococcus epidermidis
GDSPRIKA

SEQ ID NO: 1778548 - protein, 18 aa, Staphylococcus epidermidis
GDSRSTWGNLEDNPVQDM

SEQ ID NO: 1778549 - protein, 12 aa, Staphylococcus epidermidis
GDSSLAPKGKTG

SEQ ID NO: 1778550 - protein, 8 aa, Staphylococcus epidermidis
GDSVDKGE

SEQ ID NO: 1778551 - protein, 4 aa, Staphylococcus epidermidis
GDTA

SEQ ID NO: 1778552 - protein, 17 aa, Staphylococcus epidermidis
GDTADGYPGVKGIGEKT

SEQ ID NO: 1778553 - protein, 10 aa, Staphylococcus epidermidis
GDTDNKDVYT

SEQ ID NO: 1778554 - protein, 10 aa, Staphylococcus epidermidis
GDTESRKQDV

SEQ ID NO: 1778555 - protein, 4 aa, Staphylococcus epidermidis
GDTF

SEQ ID NO: 1778556 - protein, 7 aa, Staphylococcus epidermidis
GDTIEED

SEQ ID NO: 1778557 - protein, 5 aa, Staphylococcus epidermidis
GDTIS

SEQ ID NO: 1778558 - protein, 4 aa, Staphylococcus epidermidis
GDTK

SEQ ID NO: 1778559 - protein, 5 aa, Staphylococcus epidermidis
GDTKR

SEQ ID NO: 1778560 - protein, 9 aa, Staphylococcus epidermidis
GDTNTSSVA

SEQ ID NO: 1778561 - protein, 13 aa, Staphylococcus epidermidis
GDTPEVQSHTTLG

SEQ ID NO: 1778562 - protein, 14 aa, Staphylococcus epidermidis
GDTPEVTANTTLGH

SEQ ID NO: 1778563 - protein, 13 aa, Staphylococcus epidermidis
GDTQEIDDPFGGS

SEQ ID NO: 1778564 - protein, 17 aa, Staphylococcus epidermidis
GDTSDNIPGVPGVGEKT

SEQ ID NO: 1778565 - protein, 6 aa, Staphylococcus epidermidis
GDTSTR

SEQ ID NO: 1778566 - protein, 18 aa, Staphylococcus epidermidis
GDTTQSELAKSLGKSQSF

SEQ ID NO: 1778567 - protein, 5 aa, Staphylococcus epidermidis
GDTYV

SEQ ID NO: 1778568 - protein, 9 aa, Staphylococcus epidermidis
GDYDKGVQS

SEQ ID NO: 1778569 - protein, 12 aa, Staphylococcus epidermidis
GDYSKKAQDDVL

SEQ ID NO: 1778570 - protein, 7 aa, Staphylococcus epidermidis
GDYTKRP

SEQ ID NO: 1778571 - protein, 11 aa, Staphylococcus epidermidis
GEAARRIGEGS

SEQ ID NO: 1778572 - protein, 8 aa, Staphylococcus epidermidis
GEAFEESG

SEQ ID NO: 1778573 - protein, 9 aa, Staphylococcus epidermidis
GEAFSRKNE

SEQ ID NO: 1778574 - protein, 17 aa, Staphylococcus epidermidis
GEAQGRKDAEMIKQFWN

SEQ ID NO: 1778575 - protein, 10 aa, Staphylococcus epidermidis
GEAQSKKSAY

SEQ ID NO: 1778576 - protein, 16 aa, Staphylococcus epidermidis
GEASISNMADEKAGVS

SEQ ID NO: 1778577 - protein, 6 aa, Staphylococcus epidermidis
GEASVG

SEQ ID NO: 1778578 - protein, 9 aa, Staphylococcus epidermidis
GEASYNTHK

SEQ ID NO: 1778579 - protein, 10 aa, Staphylococcus epidermidis
GEASYSSHRR

SEQ ID NO: 1778580 - protein, 10 aa, Staphylococcus epidermidis
GEASYSTHKR

SEQ ID NO: 1778581 - protein, 19 aa, Staphylococcus epidermidis
GEATQNAKVEARVNKEDRR

SEQ ID NO: 1778582 - protein, 5 aa, Staphylococcus epidermidis
GEATV

SEQ ID NO: 1778583 - protein, 21 aa, Staphylococcus epidermidis
GEAYGQNDPEEEMYPGGENER

SEQ ID NO: 1778584 - protein, 13 aa, Staphylococcus epidermidis
GEAYSKSNHHIEH

SEQ ID NO: 1778585 - protein, 15 aa, Staphylococcus epidermidis
GEDDEKNVKDLGNLG

SEQ ID NO: 1778586 - protein, 10 aa, Staphylococcus epidermidis
GEDDIKAKQI

SEQ ID NO: 1778587 - protein, 15 aa, Staphylococcus epidermidis
GEDEIGDEDNDKVKA

SEQ ID NO: 1778588 - protein, 9 aa, Staphylococcus epidermidis
GEDENNPQA

SEQ ID NO: 1778589 - protein, 5 aa, Staphylococcus epidermidis
GEDEP

SEQ ID NO: 1778590 - protein, 7 aa, Staphylococcus epidermidis
GEDERQR

SEQ ID NO: 1778591 - protein, 53 aa, Staphylococcus epidermidis
GEDESETTKAETSSENGSHNRVQQEQEENIAQESELQHKGANEPDDTQKTGVD

SEQ ID NO: 1778592 - protein, 6 aa, Staphylococcus epidermidis
GEDFEN

SEQ ID NO: 1778593 - protein, 17 aa, Staphylococcus epidermidis
GEDGAQLSTDASAQLST

SEQ ID NO: 1778594 - protein, 24 aa, Staphylococcus epidermidis
GEDGEYQYPKDEWTETPPPAGGYQ

SEQ ID NO: 1778595 - protein, 4 aa, Staphylococcus epidermidis
GEDK

SEQ ID NO: 1778596 - protein, 7 aa, Staphylococcus epidermidis
GEDKAAA

SEQ ID NO: 1778597 - protein, 9 aa, Staphylococcus epidermidis
GEDKQKELT

SEQ ID NO: 1778598 - protein, 8 aa, Staphylococcus epidermidis
GEDLGFPD

SEQ ID NO: 1778599 - protein, 9 aa, Staphylococcus epidermidis
GEDVDTDTV

SEQ ID NO: 1778600 - protein, 48 aa, Staphylococcus epidermidis
GEEDSDSHESPIESSDENNHDLPQNQTDARTNVNEDVNDYHDAQHRGE

SEQ ID NO: 1778601 - protein, 12 aa, Staphylococcus epidermidis
GEEGHGHELTDT

SEQ ID NO: 1778602 - protein, 8 aa, Staphylococcus epidermidis
GEEGHGHN

SEQ ID NO: 1778603 - protein, 7 aa, Staphylococcus epidermidis
GEELSGR

SEQ ID NO: 1778604 - protein, 11 aa, Staphylococcus epidermidis
GEESRDEYQKR

SEQ ID NO: 1778605 - protein, 15 aa, Staphylococcus epidermidis
GEETTTLYDTPAGRI

SEQ ID NO: 1778606 - protein, 4 aa, Staphylococcus epidermidis
GEEV

SEQ ID NO: 1778607 - protein, 9 aa, Staphylococcus epidermidis
GEEVVSGNA

SEQ ID NO: 1778608 - protein, 15 aa, Staphylococcus epidermidis
GEGASGKEAIEKAHE

SEQ ID NO: 1778609 - protein, 13 aa, Staphylococcus epidermidis
GEGASGKEAITKA

SEQ ID NO: 1778610 - protein, 27 aa, Staphylococcus epidermidis
GEGDKAFCSGGDQKKRGHGGYVGEDEI

SEQ ID NO: 1778611 - protein, 13 aa, Staphylococcus epidermidis
GEGGVQKVADPER

SEQ ID NO: 1778612 - protein, 11 aa, Staphylococcus epidermidis
GEGNITVNNRD

SEQ ID NO: 1778613 - protein, 19 aa, Staphylococcus epidermidis
GEGQLDKQTIYGKTPIGVA

SEQ ID NO: 1778614 - protein, 9 aa, Staphylococcus epidermidis
GEGSERNKI

SEQ ID NO: 1778615 - protein, 68 aa, Staphylococcus epidermidis
GEGSGNASSGSSEDTPQKDESKDAGQTEDKSEQKQASSDNKQDSQDTNNQRVNATPSARRHARENGVN

SEQ ID NO: 1778616 - protein, 4 aa, Staphylococcus epidermidis
GEHE

SEQ ID NO: 1778617 - protein, 17 aa, Staphylococcus epidermidis
GEIINSKPAKAKKGTDI

SEQ ID NO: 1778618 - protein, 9 aa, Staphylococcus epidermidis
GEIPQTHKE

SEQ ID NO: 1778619 - protein, 4 aa, Staphylococcus epidermidis
GEIS

SEQ ID NO: 1778620 - protein, 10 aa, Staphylococcus epidermidis
GEISEVGENV

SEQ ID NO: 1778621 - protein, 5 aa, Staphylococcus epidermidis
GEITE

SEQ ID NO: 1778622 - protein, 16 aa, Staphylococcus epidermidis
GEITIEGQSITKARGK

SEQ ID NO: 1778623 - protein, 6 aa, Staphylococcus epidermidis
GEITYD

SEQ ID NO: 1778624 - protein, 6 aa, Staphylococcus epidermidis
GEKDEK

SEQ ID NO: 1778625 - protein, 12 aa, Staphylococcus epidermidis
GEKDIKDALQKY

SEQ ID NO: 1778626 - protein, 6 aa, Staphylococcus epidermidis
GEKETG

SEQ ID NO: 1778627 - protein, 8 aa, Staphylococcus epidermidis
GEKEYSTS

SEQ ID NO: 1778628 - protein, 6 aa, Staphylococcus epidermidis
GEKFPK

SEQ ID NO: 1778629 - protein, 19 aa, Staphylococcus epidermidis
GEKKKKDSEADNSIKAELG

SEQ ID NO: 1778630 - protein, 12 aa, Staphylococcus epidermidis
GEKVGRETEEEV

SEQ ID NO: 1778631 - protein, 8 aa, Staphylococcus epidermidis
GEKVTRKE

SEQ ID NO: 1778632 - protein, 13 aa, Staphylococcus epidermidis
GELENGGKLPSNL

SEQ ID NO: 1778633 - protein, 8 aa, Staphylococcus epidermidis
GELKKEDV

SEQ ID NO: 1778634 - protein, 7 aa, Staphylococcus epidermidis
GELTDEE

SEQ ID NO: 1778635 - protein, 15 aa, Staphylococcus epidermidis
GELTDSELKGKDSED

SEQ ID NO: 1778636 - protein, 5 aa, Staphylococcus epidermidis
GELTG

SEQ ID NO: 1778637 - protein, 4 aa, Staphylococcus epidermidis
GEME

SEQ ID NO: 1778638 - protein, 4 aa, Staphylococcus epidermidis
GENA

SEQ ID NO: 1778639 - protein, 8 aa, Staphylococcus epidermidis
GENEREQS

SEQ ID NO: 1778640 - protein, 6 aa, Staphylococcus epidermidis
GENGFK

SEQ ID NO: 1778641 - protein, 15 aa, Staphylococcus epidermidis
GENIGDGKVGDVTRQ

SEQ ID NO: 1778642 - protein, 15 aa, Staphylococcus epidermidis
GENRYGKEMAGNKEV

SEQ ID NO: 1778643 - protein, 15 aa, Staphylococcus epidermidis
GEPAEDENGAPKPRL

SEQ ID NO: 1778644 - protein, 15 aa, Staphylococcus epidermidis
GEPEYPRSSICKQQI

SEQ ID NO: 1778645 - protein, 7 aa, Staphylococcus epidermidis
GEPITER

SEQ ID NO: 1778646 - protein, 9 aa, Staphylococcus epidermidis
GEPPHEGTQ

SEQ ID NO: 1778647 - protein, 8 aa, Staphylococcus epidermidis
GEPQAPGQ

SEQ ID NO: 1778648 - protein, 4 aa, Staphylococcus epidermidis
GEPY

SEQ ID NO: 1778649 - protein, 9 aa, Staphylococcus epidermidis
GEQDDEAYA

SEQ ID NO: 1778650 - protein, 8 aa, Staphylococcus epidermidis
GEQEKREM

SEQ ID NO: 1778651 - protein, 5 aa, Staphylococcus epidermidis
GERAI

SEQ ID NO: 1778652 - protein, 12 aa, Staphylococcus epidermidis
GERDMTKTPEMG

SEQ ID NO: 1778653 - protein, 15 aa, Staphylococcus epidermidis
GERLNASVGTKAYGS

SEQ ID NO: 1778654 - protein, 13 aa, Staphylococcus epidermidis
GERMGQGKENVKN

SEQ ID NO: 1778655 - protein, 8 aa, Staphylococcus epidermidis
GERQQSVD

SEQ ID NO: 1778656 - protein, 12 aa, Staphylococcus epidermidis
GERYQYTATSNG

SEQ ID NO: 1778657 - protein, 11 aa, Staphylococcus epidermidis
GESGAGKSTLS

SEQ ID NO: 1778658 - protein, 8 aa, Staphylococcus epidermidis
GESGCGKS

SEQ ID NO: 1778659 - protein, 9 aa, Staphylococcus epidermidis
GESGCGKST

SEQ ID NO: 1778660 - protein, 12 aa, Staphylococcus epidermidis
GESKYKDTKAIQ

SEQ ID NO: 1778661 - protein, 6 aa, Staphylococcus epidermidis
GESLKS

SEQ ID NO: 1778662 - protein, 8 aa, Staphylococcus epidermidis
GESTLEDI

SEQ ID NO: 1778663 - protein, 5 aa, Staphylococcus epidermidis
GESYR

SEQ ID NO: 1778664 - protein, 12 aa, Staphylococcus epidermidis
GETAAGLYPEEA

SEQ ID NO: 1778665 - protein, 7 aa, Staphylococcus epidermidis
GETGASM

SEQ ID NO: 1778666 - protein, 8 aa, Staphylococcus epidermidis
GETGSGKS

SEQ ID NO: 1778667 - protein, 4 aa, Staphylococcus epidermidis
GETI

SEQ ID NO: 1778668 - protein, 6 aa, Staphylococcus epidermidis
GETNED

SEQ ID NO: 1778669 - protein, 7 aa, Staphylococcus epidermidis
GETQECN

SEQ ID NO: 1778670 - protein, 8 aa, Staphylococcus epidermidis
GETQPARS

SEQ ID NO: 1778671 - protein, 4 aa, Staphylococcus epidermidis
GETR

SEQ ID NO: 1778672 - protein, 5 aa, Staphylococcus epidermidis
GETRD

SEQ ID NO: 1778673 - protein, 8 aa, Staphylococcus epidermidis
GETRTTDW

SEQ ID NO: 1778674 - protein, 8 aa, Staphylococcus epidermidis
GETSKNRI

SEQ ID NO: 1778675 - protein, 18 aa, Staphylococcus epidermidis
GETTQNELAKSLGKSQSF

SEQ ID NO: 1778676 - protein, 5 aa, Staphylococcus epidermidis
GETVE

SEQ ID NO: 1778677 - protein, 14 aa, Staphylococcus epidermidis
GETVQSLSGDNDGY

SEQ ID NO: 1778678 - protein, 5 aa, Staphylococcus epidermidis
GETVS

SEQ ID NO: 1778679 - protein, 4 aa, Staphylococcus epidermidis
GEVA

SEQ ID NO: 1778680 - protein, 6 aa, Staphylococcus epidermidis
GEVEET

SEQ ID NO: 1778681 - protein, 4 aa, Staphylococcus epidermidis
GEVI

SEQ ID NO: 1778682 - protein, 4 aa, Staphylococcus epidermidis
GEVN

SEQ ID NO: 1778683 - protein, 5 aa, Staphylococcus epidermidis
GEVTD

SEQ ID NO: 1778684 - protein, 10 aa, Staphylococcus epidermidis
GEWKQESYGY

SEQ ID NO: 1778685 - protein, 7 aa, Staphylococcus epidermidis
GEYFAKS

SEQ ID NO: 1778686 - protein, 6 aa, Staphylococcus epidermidis
GEYGDI

SEQ ID NO: 1778687 - protein, 13 aa, Staphylococcus epidermidis
GEYKDLREQSARE

SEQ ID NO: 1778688 - protein, 11 aa, Staphylococcus epidermidis
GEYKENPQNGK

SEQ ID NO: 1778689 - protein, 5 aa, Staphylococcus epidermidis
GEYLE

SEQ ID NO: 1778690 - protein, 4 aa, Staphylococcus epidermidis
GEYQ

SEQ ID NO: 1778691 - protein, 5 aa, Staphylococcus epidermidis
GEYSM

SEQ ID NO: 1778692 - protein, 6 aa, Staphylococcus epidermidis
GFADSV

SEQ ID NO: 1778693 - protein, 8 aa, Staphylococcus epidermidis
GFAGGELK

SEQ ID NO: 1778694 - protein, 20 aa, Staphylococcus epidermidis
GFAQSNNLDTSDLKSITAEE

SEQ ID NO: 1778695 - protein, 7 aa, Staphylococcus epidermidis
GFDKEYS

SEQ ID NO: 1778696 - protein, 19 aa, Staphylococcus epidermidis
GFDKTSTKEIAQRANVAEG

SEQ ID NO: 1778697 - protein, 12 aa, Staphylococcus epidermidis
GFDTGKSESPIT

SEQ ID NO: 1778698 - protein, 8 aa, Staphylococcus epidermidis
GFEDEEEA

SEQ ID NO: 1778699 - protein, 6 aa, Staphylococcus epidermidis
GFESTR

SEQ ID NO: 1778700 - protein, 8 aa, Staphylococcus epidermidis
GFETSQSM

SEQ ID NO: 1778701 - protein, 6 aa, Staphylococcus epidermidis
GFGGGY

SEQ ID NO: 1778702 - protein, 5 aa, Staphylococcus epidermidis
GFGPF

SEQ ID NO: 1778703 - protein, 6 aa, Staphylococcus epidermidis
GFGPSG

SEQ ID NO: 1778704 - protein, 8 aa, Staphylococcus epidermidis
GFHTKEDV

SEQ ID NO: 1778705 - protein, 5 aa, Staphylococcus epidermidis
GFNSN

SEQ ID NO: 1778706 - protein, 7 aa, Staphylococcus epidermidis
GFNSSVQ

SEQ ID NO: 1778707 - protein, 12 aa, Staphylococcus epidermidis
GFPKEEKNNNSI

SEQ ID NO: 1778708 - protein, 17 aa, Staphylococcus epidermidis
GFPKYKRVNEKKLTSDE

SEQ ID NO: 1778709 - protein, 5 aa, Staphylococcus epidermidis
GFRTT

SEQ ID NO: 1778710 - protein, 11 aa, Staphylococcus epidermidis
GFSPEDRTENI

SEQ ID NO: 1778711 - protein, 5 aa, Staphylococcus epidermidis
GFTEN

SEQ ID NO: 1778712 - protein, 5 aa, Staphylococcus epidermidis
GFTGE

SEQ ID NO: 1778713 - protein, 7 aa, Staphylococcus epidermidis
GFTQPAQ

SEQ ID NO: 1778714 - protein, 7 aa, Staphylococcus epidermidis
GFVQSTN

SEQ ID NO: 1778715 - protein, 6 aa, Staphylococcus epidermidis
GGAAFS

SEQ ID NO: 1778716 - protein, 6 aa, Staphylococcus epidermidis
GGAIGL

SEQ ID NO: 1778717 - protein, 7 aa, Staphylococcus epidermidis
GGASGPL

SEQ ID NO: 1778718 - protein, 8 aa, Staphylococcus epidermidis
GGATLNQN

SEQ ID NO: 1778719 - protein, 8 aa, Staphylococcus epidermidis
GGATSTPA

SEQ ID NO: 1778720 - protein, 9 aa, Staphylococcus epidermidis
GGAYPSLKE

SEQ ID NO: 1778721 - protein, 4 aa, Staphylococcus epidermidis
GGDH

SEQ ID NO: 1778722 - protein, 8 aa, Staphylococcus epidermidis
GGDISRKR

SEQ ID NO: 1778723 - protein, 8 aa, Staphylococcus epidermidis
GGDNLAAT

SEQ ID NO: 1778724 - protein, 18 aa, Staphylococcus epidermidis
GGDTQYDYARSGNPNRTL

SEQ ID NO: 1778725 - protein, 22 aa, Staphylococcus epidermidis
GGEESLKKQQVRDKRKQQLCDQ

SEQ ID NO: 1778726 - protein, 7 aa, Staphylococcus epidermidis
GGEGATI

SEQ ID NO: 1778727 - protein, 8 aa, Staphylococcus epidermidis
GGEKMNPA

SEQ ID NO: 1778728 - protein, 8 aa, Staphylococcus epidermidis
GGELTAKG

SEQ ID NO: 1778729 - protein, 18 aa, Staphylococcus epidermidis
GGESQYDYARSGNPNRTL

SEQ ID NO: 1778730 - protein, 6 aa, Staphylococcus epidermidis
GGETTG

SEQ ID NO: 1778731 - protein, 18 aa, Staphylococcus epidermidis
GGETVQSLSGNQNGEVTT

SEQ ID NO: 1778732 - protein, 30 aa, Staphylococcus epidermidis
GGEVQKNAYTGEGKHINSGELDGLENEAAI

SEQ ID NO: 1778733 - protein, 11 aa, Staphylococcus epidermidis
GGFDDQQTFNE

SEQ ID NO: 1778734 - protein, 11 aa, Staphylococcus epidermidis
GGFDEQQTFNE

SEQ ID NO: 1778735 - protein, 4 aa, Staphylococcus epidermidis
GGFE

SEQ ID NO: 1778736 - protein, 8 aa, Staphylococcus epidermidis
GGFSGGGF

SEQ ID NO: 1778737 - protein, 7 aa, Staphylococcus epidermidis
GGFSTGP

SEQ ID NO: 1778738 - protein, 4 aa, Staphylococcus epidermidis
GGGG

SEQ ID NO: 1778739 - protein, 8 aa, Staphylococcus epidermidis
GGGGESSM

SEQ ID NO: 1778740 - protein, 6 aa, Staphylococcus epidermidis
GGGGVP

SEQ ID NO: 1778741 - protein, 9 aa, Staphylococcus epidermidis
GGGIIENSD

SEQ ID NO: 1778742 - protein, 5 aa, Staphylococcus epidermidis
GGGQA

SEQ ID NO: 1778743 - protein, 12 aa, Staphylococcus epidermidis
GGGQEYGLRSGT

SEQ ID NO: 1778744 - protein, 4 aa, Staphylococcus epidermidis
GGGS

SEQ ID NO: 1778745 - protein, 9 aa, Staphylococcus epidermidis
GGGSNGKSS

SEQ ID NO: 1778746 - protein, 8 aa, Staphylococcus epidermidis
GGGTGEFS

SEQ ID NO: 1778747 - protein, 9 aa, Staphylococcus epidermidis
GGHKAGEVA

SEQ ID NO: 1778748 - protein, 4 aa, Staphylococcus epidermidis
GGHP

SEQ ID NO: 1778749 - protein, 4 aa, Staphylococcus epidermidis
GGHQ

SEQ ID NO: 1778750 - protein, 4 aa, Staphylococcus epidermidis
GGHS

SEQ ID NO: 1778751 - protein, 10 aa, Staphylococcus epidermidis
GGHSKDRNSI

SEQ ID NO: 1778752 - protein, 5 aa, Staphylococcus epidermidis
GGHSY

SEQ ID NO: 1778753 - protein, 15 aa, Staphylococcus epidermidis
GGHVTGPKDPNIQQI

SEQ ID NO: 1778754 - protein, 6 aa, Staphylococcus epidermidis
GGIEET

SEQ ID NO: 1778755 - protein, 9 aa, Staphylococcus epidermidis
GGIEPGTTE

SEQ ID NO: 1778756 - protein, 11 aa, Staphylococcus epidermidis
GGIGSSGIGQY

SEQ ID NO: 1778757 - protein, 8 aa, Staphylococcus epidermidis
GGINDQTS

SEQ ID NO: 1778758 - protein, 4 aa, Staphylococcus epidermidis
GGIT

SEQ ID NO: 1778759 - protein, 20 aa, Staphylococcus epidermidis
GGKEGAERISKALSRLSKKI

SEQ ID NO: 1778760 - protein, 9 aa, Staphylococcus epidermidis
GGKGQVGRV

SEQ ID NO: 1778761 - protein, 7 aa, Staphylococcus epidermidis
GGKGSEI

SEQ ID NO: 1778762 - protein, 10 aa, Staphylococcus epidermidis
GGKIDDGESY

SEQ ID NO: 1778763 - protein, 6 aa, Staphylococcus epidermidis
GGKISD

SEQ ID NO: 1778764 - protein, 7 aa, Staphylococcus epidermidis
GGKKLTD

SEQ ID NO: 1778765 - protein, 6 aa, Staphylococcus epidermidis
GGKNPN

SEQ ID NO: 1778766 - protein, 10 aa, Staphylococcus epidermidis
GGKRKDRNNV

SEQ ID NO: 1778767 - protein, 9 aa, Staphylococcus epidermidis
GGKSSKEDL

SEQ ID NO: 1778768 - protein, 4 aa, Staphylococcus epidermidis
GGKT

SEQ ID NO: 1778769 - protein, 18 aa, Staphylococcus epidermidis
GGKYTEPEFDFGESVGRE

SEQ ID NO: 1778770 - protein, 15 aa, Staphylococcus epidermidis
GGLGDTKINSSLGSQ

SEQ ID NO: 1778771 - protein, 4 aa, Staphylococcus epidermidis
GGLH

SEQ ID NO: 1778772 - protein, 4 aa, Staphylococcus epidermidis
GGLK

SEQ ID NO: 1778773 - protein, 13 aa, Staphylococcus epidermidis
GGLPNKEPQIQEK

SEQ ID NO: 1778774 - protein, 11 aa, Staphylococcus epidermidis
GGLSEATPSFT

SEQ ID NO: 1778775 - protein, 15 aa, Staphylococcus epidermidis
GGMNEWGDEGTVIDS

SEQ ID NO: 1778776 - protein, 16 aa, Staphylococcus epidermidis
GGMPNEGGFGVTVAEL

SEQ ID NO: 1778777 - protein, 4 aa, Staphylococcus epidermidis
GGMS

SEQ ID NO: 1778778 - protein, 4 aa, Staphylococcus epidermidis
GGNE

SEQ ID NO: 1778779 - protein, 9 aa, Staphylococcus epidermidis
GGNEIGGQN

SEQ ID NO: 1778780 - protein, 21 aa, Staphylococcus epidermidis
GGNIEQGTTEVTKALANKGDY

SEQ ID NO: 1778781 - protein, 12 aa, Staphylococcus epidermidis
GGNSEPKLNGNK

SEQ ID NO: 1778782 - protein, 6 aa, Staphylococcus epidermidis
GGNTNS

SEQ ID NO: 1778783 - protein, 8 aa, Staphylococcus epidermidis
GGNTPIDP

SEQ ID NO: 1778784 - protein, 11 aa, Staphylococcus epidermidis
GGPGKPEGLDQ

SEQ ID NO: 1778785 - protein, 4 aa, Staphylococcus epidermidis
GGPV

SEQ ID NO: 1778786 - protein, 7 aa, Staphylococcus epidermidis
GGQCEGK

SEQ ID NO: 1778787 - protein, 14 aa, Staphylococcus epidermidis
GGQGIATLVSHYDA

SEQ ID NO: 1778788 - protein, 13 aa, Staphylococcus epidermidis
GGQGIATLVSKYG

SEQ ID NO: 1778789 - protein, 6 aa, Staphylococcus epidermidis
GGQKQL

SEQ ID NO: 1778790 - protein, 14 aa, Staphylococcus epidermidis
GGQVADEGTVGNEN

SEQ ID NO: 1778791 - protein, 14 aa, Staphylococcus epidermidis
GGQVADKGTVGNEN

SEQ ID NO: 1778792 - protein, 6 aa, Staphylococcus epidermidis
GGRDSS

SEQ ID NO: 1778793 - protein, 9 aa, Staphylococcus epidermidis
GGREEVGQL

SEQ ID NO: 1778794 - protein, 5 aa, Staphylococcus epidermidis
GGRET

SEQ ID NO: 1778795 - protein, 6 aa, Staphylococcus epidermidis
GGRFTG

SEQ ID NO: 1778796 - protein, 9 aa, Staphylococcus epidermidis
GGRGAGKST

SEQ ID NO: 1778797 - protein, 9 aa, Staphylococcus epidermidis
GGRGTGKST

SEQ ID NO: 1778798 - protein, 5 aa, Staphylococcus epidermidis
GGRLT

SEQ ID NO: 1778799 - protein, 10 aa, Staphylococcus epidermidis
GGSDWDGEFA

SEQ ID NO: 1778800 - protein, 12 aa, Staphylococcus epidermidis
GGSIEQGTTELT

SEQ ID NO: 1778801 - protein, 4 aa, Staphylococcus epidermidis
GGSK

SEQ ID NO: 1778802 - protein, 8 aa, Staphylococcus epidermidis
GGSKGLDT

SEQ ID NO: 1778803 - protein, 4 aa, Staphylococcus epidermidis
GGSR

SEQ ID NO: 1778804 - protein, 18 aa, Staphylococcus epidermidis
GGSRQRDPNAPRKGDDLQ

SEQ ID NO: 1778805 - protein, 8 aa, Staphylococcus epidermidis
GGSTMNQD

SEQ ID NO: 1778806 - protein, 10 aa, Staphylococcus epidermidis
GGSTRESIDE

SEQ ID NO: 1778807 - protein, 6 aa, Staphylococcus epidermidis
GGTFGK

SEQ ID NO: 1778808 - protein, 8 aa, Staphylococcus epidermidis
GGTKGSQI

SEQ ID NO: 1778809 - protein, 5 aa, Staphylococcus epidermidis
GGTLV

SEQ ID NO: 1778810 - protein, 9 aa, Staphylococcus epidermidis
GGTPESSLR

SEQ ID NO: 1778811 - protein, 14 aa, Staphylococcus epidermidis
GGTPKPPVIPDKDT

SEQ ID NO: 1778812 - protein, 11 aa, Staphylococcus epidermidis
GGTQVNSVPDF

SEQ ID NO: 1778813 - protein, 7 aa, Staphylococcus epidermidis
GGTTSMP

SEQ ID NO: 1778814 - protein, 5 aa, Staphylococcus epidermidis
GGTYL

SEQ ID NO: 1778815 - protein, 6 aa, Staphylococcus epidermidis
GGVEAT

SEQ ID NO: 1778816 - protein, 4 aa, Staphylococcus epidermidis
GGVL

SEQ ID NO: 1778817 - protein, 4 aa, Staphylococcus epidermidis
GGVP

SEQ ID NO: 1778818 - protein, 10 aa, Staphylococcus epidermidis
GGVSLPGGDL

SEQ ID NO: 1778819 - protein, 17 aa, Staphylococcus epidermidis
GGVTYKPKMSKAEATDV

SEQ ID NO: 1778820 - protein, 23 aa, Staphylococcus epidermidis
GGYKAYEEKNVSDDTKEERTNVE

SEQ ID NO: 1778821 - protein, 15 aa, Staphylococcus epidermidis
GGYKDYEAKNFNSAP

SEQ ID NO: 1778822 - protein, 11 aa, Staphylococcus epidermidis
GGYNTYGDLQR

SEQ ID NO: 1778823 - protein, 14 aa, Staphylococcus epidermidis
GGYSRDEANELLKD

SEQ ID NO: 1778824 - protein, 24 aa, Staphylococcus epidermidis
GGYTAYEQQHNNESFKLKEDKEIQ

SEQ ID NO: 1778825 - protein, 8 aa, Staphylococcus epidermidis
GGYTEQRL

SEQ ID NO: 1778826 - protein, 7 aa, Staphylococcus epidermidis
GGYYDEK

SEQ ID NO: 1778827 - protein, 20 aa, Staphylococcus epidermidis
GHDGPQGGFGSQGFGGSDFG

SEQ ID NO: 1778828 - protein, 7 aa, Staphylococcus epidermidis
GHDHSKH

SEQ ID NO: 1778829 - protein, 7 aa, Staphylococcus epidermidis
GHEGPDS

SEQ ID NO: 1778830 - protein, 7 aa, Staphylococcus epidermidis
GHEHSKH

SEQ ID NO: 1778831 - protein, 10 aa, Staphylococcus epidermidis
GHEPNNYNAI

SEQ ID NO: 1778832 - protein, 6 aa, Staphylococcus epidermidis
GHESTH

SEQ ID NO: 1778833 - protein, 20 aa, Staphylococcus epidermidis
GHETFDTDASVDTAKNGDIV

SEQ ID NO: 1778834 - protein, 6 aa, Staphylococcus epidermidis
GHFGQA

SEQ ID NO: 1778835 - protein, 44 aa, Staphylococcus epidermidis
GHGDDEDSKKEEKEQESTVQEEASSTQSQEKTEVDENKTVKAMP

SEQ ID NO: 1778836 - protein, 13 aa, Staphylococcus epidermidis
GHGKSSRSESYDL

SEQ ID NO: 1778837 - protein, 9 aa, Staphylococcus epidermidis
GHGLDTSSM

SEQ ID NO: 1778838 - protein, 12 aa, Staphylococcus epidermidis
GHGSESHNNPYH

SEQ ID NO: 1778839 - protein, 4 aa, Staphylococcus epidermidis
GHGV

SEQ ID NO: 1778840 - protein, 4 aa, Staphylococcus epidermidis
GHHT

SEQ ID NO: 1778841 - protein, 4 aa, Staphylococcus epidermidis
GHIG

SEQ ID NO: 1778842 - protein, 8 aa, Staphylococcus epidermidis
GHIPGAKN

SEQ ID NO: 1778843 - protein, 9 aa, Staphylococcus epidermidis
GHKGNQAKK

SEQ ID NO: 1778844 - protein, 10 aa, Staphylococcus epidermidis
GHLGDSPETL

SEQ ID NO: 1778845 - protein, 12 aa, Staphylococcus epidermidis
GHLTDTKGRTVD

SEQ ID NO: 1778846 - protein, 9 aa, Staphylococcus epidermidis
GHNGSGKSV

SEQ ID NO: 1778847 - protein, 7 aa, Staphylococcus epidermidis
GHNPQAP

SEQ ID NO: 1778848 - protein, 20 aa, Staphylococcus epidermidis
GHPAYSARLDGNHNGVACEI

SEQ ID NO: 1778849 - protein, 11 aa, Staphylococcus epidermidis
GHPRVAETTTA

SEQ ID NO: 1778850 - protein, 9 aa, Staphylococcus epidermidis
GHPTDDKTW

SEQ ID NO: 1778851 - protein, 13 aa, Staphylococcus epidermidis
GHQGEDITLQNDS

SEQ ID NO: 1778852 - protein, 8 aa, Staphylococcus epidermidis
GHQTPQAI

SEQ ID NO: 1778853 - protein, 10 aa, Staphylococcus epidermidis
GHRSQQDPEF

SEQ ID NO: 1778854 - protein, 4 aa, Staphylococcus epidermidis
GHSD

SEQ ID NO: 1778855 - protein, 17 aa, Staphylococcus epidermidis
GHSGTGYQDRKNAFTEI

SEQ ID NO: 1778856 - protein, 7 aa, Staphylococcus epidermidis
GHSNGKQ

SEQ ID NO: 1778857 - protein, 10 aa, Staphylococcus epidermidis
GHSQLPSDGL

SEQ ID NO: 1778858 - protein, 4 aa, Staphylococcus epidermidis
GHSS

SEQ ID NO: 1778859 - protein, 8 aa, Staphylococcus epidermidis
GHTKPSDC

SEQ ID NO: 1778860 - protein, 4 aa, Staphylococcus epidermidis
GHTR

SEQ ID NO: 1778861 - protein, 6 aa, Staphylococcus epidermidis
GHTTIG

SEQ ID NO: 1778862 - protein, 4 aa, Staphylococcus epidermidis
GHTY

SEQ ID NO: 1778863 - protein, 8 aa, Staphylococcus epidermidis
GHVPRPAA

SEQ ID NO: 1778864 - protein, 5 aa, Staphylococcus epidermidis
GHVRG

SEQ ID NO: 1778865 - protein, 6 aa, Staphylococcus epidermidis
GHYGTG

SEQ ID NO: 1778866 - protein, 12 aa, Staphylococcus epidermidis
GHYTERGEDLGY

SEQ ID NO: 1778867 - protein, 8 aa, Staphylococcus epidermidis
GIAAPAYA

SEQ ID NO: 1778868 - protein, 42 aa, Staphylococcus epidermidis
GIADDNNKDNLDEETRKNVGNYQSVGHRQTPSVDDIKKAEPQ

SEQ ID NO: 1778869 - protein, 4 aa, Staphylococcus epidermidis
GIAG

SEQ ID NO: 1778870 - protein, 8 aa, Staphylococcus epidermidis
GIDAQQGQ

SEQ ID NO: 1778871 - protein, 7 aa, Staphylococcus epidermidis
GIDKAND

SEQ ID NO: 1778872 - protein, 10 aa, Staphylococcus epidermidis
GIDKDEAKQM

SEQ ID NO: 1778873 - protein, 7 aa, Staphylococcus epidermidis
GIDPKSE

SEQ ID NO: 1778874 - protein, 13 aa, Staphylococcus epidermidis
GIDPKTIPVDDKD

SEQ ID NO: 1778875 - protein, 8 aa, Staphylococcus epidermidis
GIDSDKST

SEQ ID NO: 1778876 - protein, 6 aa, Staphylococcus epidermidis
GIEFPG

SEQ ID NO: 1778877 - protein, 8 aa, Staphylococcus epidermidis
GIEKGKKA

SEQ ID NO: 1778878 - protein, 10 aa, Staphylococcus epidermidis
GIESENSEWK

SEQ ID NO: 1778879 - protein, 7 aa, Staphylococcus epidermidis
GIGATRA

SEQ ID NO: 1778880 - protein, 12 aa, Staphylococcus epidermidis
GIGGNGKKIKIH

SEQ ID NO: 1778881 - protein, 4 aa, Staphylococcus epidermidis
GIGR

SEQ ID NO: 1778882 - protein, 5 aa, Staphylococcus epidermidis
GIGRP

SEQ ID NO: 1778883 - protein, 7 aa, Staphylococcus epidermidis
GIGRTDL

SEQ ID NO: 1778884 - protein, 5 aa, Staphylococcus epidermidis
GIGTS

SEQ ID NO: 1778885 - protein, 11 aa, Staphylococcus epidermidis
GIKAFSSNGRF

SEQ ID NO: 1778886 - protein, 5 aa, Staphylococcus epidermidis
GIKAN

SEQ ID NO: 1778887 - protein, 21 aa, Staphylococcus epidermidis
GIKEAKSGTTLAGDKSDSYVN

SEQ ID NO: 1778888 - protein, 20 aa, Staphylococcus epidermidis
GIKEEDYEKYISPTEELQPD

SEQ ID NO: 1778889 - protein, 4 aa, Staphylococcus epidermidis
GIND

SEQ ID NO: 1778890 - protein, 12 aa, Staphylococcus epidermidis
GINEGLESTGLN

SEQ ID NO: 1778891 - protein, 9 aa, Staphylococcus epidermidis
GINEPAPEL

SEQ ID NO: 1778892 - protein, 9 aa, Staphylococcus epidermidis
GINEPASEL

SEQ ID NO: 1778893 - protein, 8 aa, Staphylococcus epidermidis
GINEPATE

SEQ ID NO: 1778894 - protein, 7 aa, Staphylococcus epidermidis
GINEQGV

SEQ ID NO: 1778895 - protein, 5 aa, Staphylococcus epidermidis
GINET

SEQ ID NO: 1778896 - protein, 8 aa, Staphylococcus epidermidis
GINMTEND

SEQ ID NO: 1778897 - protein, 6 aa, Staphylococcus epidermidis
GINNPS

SEQ ID NO: 1778898 - protein, 9 aa, Staphylococcus epidermidis
GINPSSYSN

SEQ ID NO: 1778899 - protein, 6 aa, Staphylococcus epidermidis
GIPKKN

SEQ ID NO: 1778900 - protein, 15 aa, Staphylococcus epidermidis
GIPPVGYNSKYGPSE

SEQ ID NO: 1778901 - protein, 5 aa, Staphylococcus epidermidis
GIQGH

SEQ ID NO: 1778902 - protein, 6 aa, Staphylococcus epidermidis
GIQPYS

SEQ ID NO: 1778903 - protein, 10 aa, Staphylococcus epidermidis
GIQTASGEIA

SEQ ID NO: 1778904 - protein, 4 aa, Staphylococcus epidermidis
GIRS

SEQ ID NO: 1778905 - protein, 5 aa, Staphylococcus epidermidis
GIRTQ

SEQ ID NO: 1778906 - protein, 4 aa, Staphylococcus epidermidis
GISD

SEQ ID NO: 1778907 - protein, 15 aa, Staphylococcus epidermidis
GISEEELKKRYREGS

SEQ ID NO: 1778908 - protein, 6 aa, Staphylococcus epidermidis
GISGGF

SEQ ID NO: 1778909 - protein, 12 aa, Staphylococcus epidermidis
GISKENENDLPE

SEQ ID NO: 1778910 - protein, 5 aa, Staphylococcus epidermidis
GISSE

SEQ ID NO: 1778911 - protein, 4 aa, Staphylococcus epidermidis
GITD

SEQ ID NO: 1778912 - protein, 8 aa, Staphylococcus epidermidis
GITNEREK

SEQ ID NO: 1778913 - protein, 5 aa, Staphylococcus epidermidis
GITRK

SEQ ID NO: 1778914 - protein, 10 aa, Staphylococcus epidermidis
GITSPSMEHA

SEQ ID NO: 1778915 - protein, 8 aa, Staphylococcus epidermidis
GIVPEKND

SEQ ID NO: 1778916 - protein, 19 aa, Staphylococcus epidermidis
GKAAKGEELTSEESKKVTR

SEQ ID NO: 1778917 - protein, 6 aa, Staphylococcus epidermidis
GKAARN

SEQ ID NO: 1778918 - protein, 18 aa, Staphylococcus epidermidis
GKASKGSYRSGTFNEGSN

SEQ ID NO: 1778919 - protein, 9 aa, Staphylococcus epidermidis
GKASNRGVV

SEQ ID NO: 1778920 - protein, 12 aa, Staphylococcus epidermidis
GKATKRVVEKVI

SEQ ID NO: 1778921 - protein, 8 aa, Staphylococcus epidermidis
GKAYGYAT

SEQ ID NO: 1778922 - protein, 9 aa, Staphylococcus epidermidis
GKAYTDQVD

SEQ ID NO: 1778923 - protein, 7 aa, Staphylococcus epidermidis
GKDKLSI

SEQ ID NO: 1778924 - protein, 5 aa, Staphylococcus epidermidis
GKDKW

SEQ ID NO: 1778925 - protein, 11 aa, Staphylococcus epidermidis
GKDVSRFKKGD

SEQ ID NO: 1778926 - protein, 10 aa, Staphylococcus epidermidis
GKDVTRFKKG

SEQ ID NO: 1778927 - protein, 9 aa, Staphylococcus epidermidis
GKDYPLSRE

SEQ ID NO: 1778928 - protein, 13 aa, Staphylococcus epidermidis
GKDYTKKKFIFSK

SEQ ID NO: 1778929 - protein, 4 aa, Staphylococcus epidermidis
GKEA

SEQ ID NO: 1778930 - protein, 7 aa, Staphylococcus epidermidis
GKEADEC

SEQ ID NO: 1778931 - protein, 8 aa, Staphylococcus epidermidis
GKEADECF

SEQ ID NO: 1778932 - protein, 12 aa, Staphylococcus epidermidis
GKEAEKKRKQKY

SEQ ID NO: 1778933 - protein, 7 aa, Staphylococcus epidermidis
GKEATTH

SEQ ID NO: 1778934 - protein, 4 aa, Staphylococcus epidermidis
GKEE

SEQ ID NO: 1778935 - protein, 9 aa, Staphylococcus epidermidis
GKEGAEDKL

SEQ ID NO: 1778936 - protein, 8 aa, Staphylococcus epidermidis
GKEIGNPD

SEQ ID NO: 1778937 - protein, 12 aa, Staphylococcus epidermidis
GKEIPAEARETI

SEQ ID NO: 1778938 - protein, 9 aa, Staphylococcus epidermidis
GKEKTASLN

SEQ ID NO: 1778939 - protein, 9 aa, Staphylococcus epidermidis
GKELKQAIT

SEQ ID NO: 1778940 - protein, 12 aa, Staphylococcus epidermidis
GKELPGIKAINN

SEQ ID NO: 1778941 - protein, 8 aa, Staphylococcus epidermidis
GKELSNIE

SEQ ID NO: 1778942 - protein, 9 aa, Staphylococcus epidermidis
GKEPLDNTA

SEQ ID NO: 1778943 - protein, 16 aa, Staphylococcus epidermidis
GKEQQRVGGVGTGGGM

SEQ ID NO: 1778944 - protein, 9 aa, Staphylococcus epidermidis
GKERGWPSF

SEQ ID NO: 1778945 - protein, 17 aa, Staphylococcus epidermidis
GKERKSIEQIDEFLAQH

SEQ ID NO: 1778946 - protein, 8 aa, Staphylococcus epidermidis
GKERNYNE

SEQ ID NO: 1778947 - protein, 5 aa, Staphylococcus epidermidis
GKESF

SEQ ID NO: 1778948 - protein, 5 aa, Staphylococcus epidermidis
GKEYQ

SEQ ID NO: 1778949 - protein, 20 aa, Staphylococcus epidermidis
GKFDADSEGRSNDGEDEESF

SEQ ID NO: 1778950 - protein, 10 aa, Staphylococcus epidermidis
GKFDGEEVTV

SEQ ID NO: 1778951 - protein, 9 aa, Staphylococcus epidermidis
GKFNDATKF

SEQ ID NO: 1778952 - protein, 7 aa, Staphylococcus epidermidis
GKFNHGD

SEQ ID NO: 1778953 - protein, 4 aa, Staphylococcus epidermidis
GKFR

SEQ ID NO: 1778954 - protein, 7 aa, Staphylococcus epidermidis
GKGETKI

SEQ ID NO: 1778955 - protein, 12 aa, Staphylococcus epidermidis
GKGGGTKLADEL

SEQ ID NO: 1778956 - protein, 12 aa, Staphylococcus epidermidis
GKGGHGSSPHMA

SEQ ID NO: 1778957 - protein, 16 aa, Staphylococcus epidermidis
GKGGKKLKEVGKRARH

SEQ ID NO: 1778958 - protein, 10 aa, Staphylococcus epidermidis
GKGGQKKDPM

SEQ ID NO: 1778959 - protein, 6 aa, Staphylococcus epidermidis
GKGHAM

SEQ ID NO: 1778960 - protein, 5 aa, Staphylococcus epidermidis
GKGHM

SEQ ID NO: 1778961 - protein, 5 aa, Staphylococcus epidermidis
GKGHS

SEQ ID NO: 1778962 - protein, 14 aa, Staphylococcus epidermidis
GKGKHNLAKYAQGK

SEQ ID NO: 1778963 - protein, 7 aa, Staphylococcus epidermidis
GKGQEVA

SEQ ID NO: 1778964 - protein, 16 aa, Staphylococcus epidermidis
GKGRDELEHEIVQFFR

SEQ ID NO: 1778965 - protein, 14 aa, Staphylococcus epidermidis
GKGTFVKEQDNSIL

SEQ ID NO: 1778966 - protein, 14 aa, Staphylococcus epidermidis
GKGYQEETGQTDNE

SEQ ID NO: 1778967 - protein, 8 aa, Staphylococcus epidermidis
GKHESISH

SEQ ID NO: 1778968 - protein, 7 aa, Staphylococcus epidermidis
GKHGEKV

SEQ ID NO: 1778969 - protein, 14 aa, Staphylococcus epidermidis
GKIDKKKLSEIFNK

SEQ ID NO: 1778970 - protein, 4 aa, Staphylococcus epidermidis
GKIE

SEQ ID NO: 1778971 - protein, 6 aa, Staphylococcus epidermidis
GKIKHT

SEQ ID NO: 1778972 - protein, 8 aa, Staphylococcus epidermidis
GKIKSGES

SEQ ID NO: 1778973 - protein, 7 aa, Staphylococcus epidermidis
GKKAGEA

SEQ ID NO: 1778974 - protein, 7 aa, Staphylococcus epidermidis
GKKDDKI

SEQ ID NO: 1778975 - protein, 9 aa, Staphylococcus epidermidis
GKKGLGKTV

SEQ ID NO: 1778976 - protein, 27 aa, Staphylococcus epidermidis
GKKLHDKRQALKEKAMKRDIDRAVKDR

SEQ ID NO: 1778977 - protein, 8 aa, Staphylococcus epidermidis
GKKRIDVP

SEQ ID NO: 1778978 - protein, 13 aa, Staphylococcus epidermidis
GKKSGVDYKKSKP

SEQ ID NO: 1778979 - protein, 4 aa, Staphylococcus epidermidis
GKLD

SEQ ID NO: 1778980 - protein, 18 aa, Staphylococcus epidermidis
GKLDGVSQRVPVSAGSLT

SEQ ID NO: 1778981 - protein, 10 aa, Staphylococcus epidermidis
GKLDKKQPAI

SEQ ID NO: 1778982 - protein, 10 aa, Staphylococcus epidermidis
GKLDNNSIGY

SEQ ID NO: 1778983 - protein, 16 aa, Staphylococcus epidermidis
GKLGGYQIKDAQSKIS

SEQ ID NO: 1778984 - protein, 11 aa, Staphylococcus epidermidis
GKLGKLSGQGF

SEQ ID NO: 1778985 - protein, 8 aa, Staphylococcus epidermidis
GKLKQRPL

SEQ ID NO: 1778986 - protein, 14 aa, Staphylococcus epidermidis
GKLPQNYEKELPKY

SEQ ID NO: 1778987 - protein, 8 aa, Staphylococcus epidermidis
GKLSKENK

SEQ ID NO: 1778988 - protein, 13 aa, Staphylococcus epidermidis
GKMNEKADKYKGM

SEQ ID NO: 1778989 - protein, 4 aa, Staphylococcus epidermidis
GKMV

SEQ ID NO: 1778990 - protein, 7 aa, Staphylococcus epidermidis
GKNAAEA

SEQ ID NO: 1778991 - protein, 8 aa, Staphylococcus epidermidis
GKNAEQVA

SEQ ID NO: 1778992 - protein, 17 aa, Staphylococcus epidermidis
GKNDKSKASRRQQVEKN

SEQ ID NO: 1778993 - protein, 10 aa, Staphylococcus epidermidis
GKNGAGKTSL

SEQ ID NO: 1778994 - protein, 9 aa, Staphylococcus epidermidis
GKNGAGKTT

SEQ ID NO: 1778995 - protein, 9 aa, Staphylococcus epidermidis
GKNGNGKTT

SEQ ID NO: 1778996 - protein, 8 aa, Staphylococcus epidermidis
GKNITGNP

SEQ ID NO: 1778997 - protein, 10 aa, Staphylococcus epidermidis
GKNKKIYSDV

SEQ ID NO: 1778998 - protein, 15 aa, Staphylococcus epidermidis
GKNKPNRLYPKKPYD

SEQ ID NO: 1778999 - protein, 12 aa, Staphylococcus epidermidis
GKNLATGEKVEV

SEQ ID NO: 1779000 - protein, 8 aa, Staphylococcus epidermidis
GKNLTGDK

SEQ ID NO: 1779001 - protein, 15 aa, Staphylococcus epidermidis
GKNQPNRLYPKKPYD

SEQ ID NO: 1779002 - protein, 8 aa, Staphylococcus epidermidis
GKNRTDML

SEQ ID NO: 1779003 - protein, 24 aa, Staphylococcus epidermidis
GKNVKGKFTAGSATISDLSSQVGK

SEQ ID NO: 1779004 - protein, 10 aa, Staphylococcus epidermidis
GKPDKKGYRK

SEQ ID NO: 1779005 - protein, 11 aa, Staphylococcus epidermidis
GKPETEENTLP

SEQ ID NO: 1779006 - protein, 4 aa, Staphylococcus epidermidis
GKPF

SEQ ID NO: 1779007 - protein, 6 aa, Staphylococcus epidermidis
GKPFSE

SEQ ID NO: 1779008 - protein, 7 aa, Staphylococcus epidermidis
GKPFTGQ

SEQ ID NO: 1779009 - protein, 6 aa, Staphylococcus epidermidis
GKPGLV

SEQ ID NO: 1779010 - protein, 5 aa, Staphylococcus epidermidis
GKPIN

SEQ ID NO: 1779011 - protein, 14 aa, Staphylococcus epidermidis
GKPLFTSEEKFESN

SEQ ID NO: 1779012 - protein, 9 aa, Staphylococcus epidermidis
GKPNKEAQN

SEQ ID NO: 1779013 - protein, 9 aa, Staphylococcus epidermidis
GKPNPDNEI

SEQ ID NO: 1779014 - protein, 15 aa, Staphylococcus epidermidis
GKPQKVVTDQAPSTK

SEQ ID NO: 1779015 - protein, 8 aa, Staphylococcus epidermidis
GKPRNQND

SEQ ID NO: 1779016 - protein, 15 aa, Staphylococcus epidermidis
GKPYTNPYTSNVENY

SEQ ID NO: 1779017 - protein, 6 aa, Staphylococcus epidermidis
GKQELD

SEQ ID NO: 1779018 - protein, 6 aa, Staphylococcus epidermidis
GKQGNA

SEQ ID NO: 1779019 - protein, 9 aa, Staphylococcus epidermidis
GKQKTASLD

SEQ ID NO: 1779020 - protein, 4 aa, Staphylococcus epidermidis
GKQQ

SEQ ID NO: 1779021 - protein, 8 aa, Staphylococcus epidermidis
GKQRKTEY

SEQ ID NO: 1779022 - protein, 4 aa, Staphylococcus epidermidis
GKQT

SEQ ID NO: 1779023 - protein, 6 aa, Staphylococcus epidermidis
GKQTVK

SEQ ID NO: 1779024 - protein, 4 aa, Staphylococcus epidermidis
GKRD

SEQ ID NO: 1779025 - protein, 8 aa, Staphylococcus epidermidis
GKRDVQGA

SEQ ID NO: 1779026 - protein, 15 aa, Staphylococcus epidermidis
GKRHTSSDKNSTSEI

SEQ ID NO: 1779027 - protein, 8 aa, Staphylococcus epidermidis
GKRLYSDN

SEQ ID NO: 1779028 - protein, 9 aa, Staphylococcus epidermidis
GKRLYSDNA

SEQ ID NO: 1779029 - protein, 4 aa, Staphylococcus epidermidis
GKRS

SEQ ID NO: 1779030 - protein, 7 aa, Staphylococcus epidermidis
GKSAETV

SEQ ID NO: 1779031 - protein, 7 aa, Staphylococcus epidermidis
GKSISNI

SEQ ID NO: 1779032 - protein, 7 aa, Staphylococcus epidermidis
GKSLSEL

SEQ ID NO: 1779033 - protein, 7 aa, Staphylococcus epidermidis
GKSMNQD

SEQ ID NO: 1779034 - protein, 15 aa, Staphylococcus epidermidis
GKSRQYTNREKTPKW

SEQ ID NO: 1779035 - protein, 35 aa, Staphylococcus epidermidis
GKSSDSTSKADYSKVPNVEGQEMQKAEDSLNAQSL

SEQ ID NO: 1779036 - protein, 35 aa, Staphylococcus epidermidis
GKSSDTSSKTDFSKVPNVQGDEVQKAEDSVNAQSL

SEQ ID NO: 1779037 - protein, 8 aa, Staphylococcus epidermidis
GKSTKDIE

SEQ ID NO: 1779038 - protein, 7 aa, Staphylococcus epidermidis
GKSTSDI

SEQ ID NO: 1779039 - protein, 4 aa, Staphylococcus epidermidis
GKSV

SEQ ID NO: 1779040 - protein, 7 aa, Staphylococcus epidermidis
GKSVSEK

SEQ ID NO: 1779041 - protein, 29 aa, Staphylococcus epidermidis
GKTEEMKAKRNKVSEEIAQKKRNKENADD

SEQ ID NO: 1779042 - protein, 9 aa, Staphylococcus epidermidis
GKTEGAMDA

SEQ ID NO: 1779043 - protein, 7 aa, Staphylococcus epidermidis
GKTESYK

SEQ ID NO: 1779044 - protein, 5 aa, Staphylococcus epidermidis
GKTGF

SEQ ID NO: 1779045 - protein, 7 aa, Staphylococcus epidermidis
GKTGNTL

SEQ ID NO: 1779046 - protein, 6 aa, Staphylococcus epidermidis
GKTHDG

SEQ ID NO: 1779047 - protein, 5 aa, Staphylococcus epidermidis
GKTHF

SEQ ID NO: 1779048 - protein, 4 aa, Staphylococcus epidermidis
GKTI

SEQ ID NO: 1779049 - protein, 10 aa, Staphylococcus epidermidis
GKTIQTSPNA

SEQ ID NO: 1779050 - protein, 7 aa, Staphylococcus epidermidis
GKTISKI

SEQ ID NO: 1779051 - protein, 4 aa, Staphylococcus epidermidis
GKTL

SEQ ID NO: 1779052 - protein, 7 aa, Staphylococcus epidermidis
GKTNSGK

SEQ ID NO: 1779053 - protein, 10 aa, Staphylococcus epidermidis
GKTPQSSHKK

SEQ ID NO: 1779054 - protein, 8 aa, Staphylococcus epidermidis
GKTPSGTF

SEQ ID NO: 1779055 - protein, 16 aa, Staphylococcus epidermidis
GKTPSTKNKDNYSEKG

SEQ ID NO: 1779056 - protein, 8 aa, Staphylococcus epidermidis
GKTQQQMA

SEQ ID NO: 1779057 - protein, 11 aa, Staphylococcus epidermidis
GKTSGNARGNL

SEQ ID NO: 1779058 - protein, 7 aa, Staphylococcus epidermidis
GKTTIGQ

SEQ ID NO: 1779059 - protein, 21 aa, Staphylococcus epidermidis
GKVDESEKTLANNSLNTYNTT

SEQ ID NO: 1779060 - protein, 12 aa, Staphylococcus epidermidis
GKVERANEREYG

SEQ ID NO: 1779061 - protein, 15 aa, Staphylococcus epidermidis
GKVPDYNQNQNELKK

SEQ ID NO: 1779062 - protein, 17 aa, Staphylococcus epidermidis
GKVPQSMKKHHTSNNKM

SEQ ID NO: 1779063 - protein, 32 aa, Staphylococcus epidermidis
GKVPQSMKNAHTSNSNLMSTDDNIGNGESIFD

SEQ ID NO: 1779064 - protein, 17 aa, Staphylococcus epidermidis
GKVTPTEKTTANQTLTA

SEQ ID NO: 1779065 - protein, 22 aa, Staphylococcus epidermidis
GKVYYEETADPEVEGGRPEIDR

SEQ ID NO: 1779066 - protein, 12 aa, Staphylococcus epidermidis
GKWNRAKQEING

SEQ ID NO: 1779067 - protein, 20 aa, Staphylococcus epidermidis
GKYDEDQTFNDHRATRRDFQ

SEQ ID NO: 1779068 - protein, 11 aa, Staphylococcus epidermidis
GKYDGSENDFE

SEQ ID NO: 1779069 - protein, 11 aa, Staphylococcus epidermidis
GKYENEKFPSI

SEQ ID NO: 1779070 - protein, 5 aa, Staphylococcus epidermidis
GKYEP

SEQ ID NO: 1779071 - protein, 4 aa, Staphylococcus epidermidis
GKYG

SEQ ID NO: 1779072 - protein, 5 aa, Staphylococcus epidermidis
GKYGN

SEQ ID NO: 1779073 - protein, 6 aa, Staphylococcus epidermidis
GKYVSR

SEQ ID NO: 1779074 - protein, 4 aa, Staphylococcus epidermidis
GKYY

SEQ ID NO: 1779075 - protein, 8 aa, Staphylococcus epidermidis
GLAEQQNG

SEQ ID NO: 1779076 - protein, 6 aa, Staphylococcus epidermidis
GLANKR

SEQ ID NO: 1779077 - protein, 13 aa, Staphylococcus epidermidis
GLDGGEVDFGQGG

SEQ ID NO: 1779078 - protein, 14 aa, Staphylococcus epidermidis
GLDVSSQQVAQSGR

SEQ ID NO: 1779079 - protein, 6 aa, Staphylococcus epidermidis
GLEAPQ

SEQ ID NO: 1779080 - protein, 13 aa, Staphylococcus epidermidis
GLEKQDLGLIYYF

SEQ ID NO: 1779081 - protein, 7 aa, Staphylococcus epidermidis
GLENGDY

SEQ ID NO: 1779082 - protein, 7 aa, Staphylococcus epidermidis
GLEPTEV

SEQ ID NO: 1779083 - protein, 5 aa, Staphylococcus epidermidis
GLGEM

SEQ ID NO: 1779084 - protein, 5 aa, Staphylococcus epidermidis
GLGKD

SEQ ID NO: 1779085 - protein, 7 aa, Staphylococcus epidermidis
GLGKDKV

SEQ ID NO: 1779086 - protein, 10 aa, Staphylococcus epidermidis
GLGKKDNPRE

SEQ ID NO: 1779087 - protein, 4 aa, Staphylococcus epidermidis
GLHP

SEQ ID NO: 1779088 - protein, 18 aa, Staphylococcus epidermidis
GLKDESNETVNENTEAQD

SEQ ID NO: 1779089 - protein, 13 aa, Staphylococcus epidermidis
GLKGDKAQPELEA

SEQ ID NO: 1779090 - protein, 10 aa, Staphylococcus epidermidis
GLKGKEDLLP

SEQ ID NO: 1779091 - protein, 5 aa, Staphylococcus epidermidis
GLKQK

SEQ ID NO: 1779092 - protein, 8 aa, Staphylococcus epidermidis
GLKTALTQ

SEQ ID NO: 1779093 - protein, 13 aa, Staphylococcus epidermidis
GLNENRDKYNSAL

SEQ ID NO: 1779094 - protein, 10 aa, Staphylococcus epidermidis
GLNENRVKYN

SEQ ID NO: 1779095 - protein, 5 aa, Staphylococcus epidermidis
GLNKG

SEQ ID NO: 1779096 - protein, 5 aa, Staphylococcus epidermidis
GLNKP

SEQ ID NO: 1779097 - protein, 16 aa, Staphylococcus epidermidis
GLNKQNEDEPSPRRGL

SEQ ID NO: 1779098 - protein, 6 aa, Staphylococcus epidermidis
GLNNGA

SEQ ID NO: 1779099 - protein, 11 aa, Staphylococcus epidermidis
GLNNGNSDRQA

SEQ ID NO: 1779100 - protein, 10 aa, Staphylococcus epidermidis
GLNPGPKYQE

SEQ ID NO: 1779101 - protein, 7 aa, Staphylococcus epidermidis
GLPASSA

SEQ ID NO: 1779102 - protein, 7 aa, Staphylococcus epidermidis
GLPKSTI

SEQ ID NO: 1779103 - protein, 7 aa, Staphylococcus epidermidis
GLPLTDK

SEQ ID NO: 1779104 - protein, 7 aa, Staphylococcus epidermidis
GLPQAKD

SEQ ID NO: 1779105 - protein, 5 aa, Staphylococcus epidermidis
GLPQI

SEQ ID NO: 1779106 - protein, 13 aa, Staphylococcus epidermidis
GLPTERNAKKLEK

SEQ ID NO: 1779107 - protein, 10 aa, Staphylococcus epidermidis
GLQKSTDVEE

SEQ ID NO: 1779108 - protein, 9 aa, Staphylococcus epidermidis
GLRKSNNKE

SEQ ID NO: 1779109 - protein, 7 aa, Staphylococcus epidermidis
GLRTPLD

SEQ ID NO: 1779110 - protein, 5 aa, Staphylococcus epidermidis
GLSDH

SEQ ID NO: 1779111 - protein, 7 aa, Staphylococcus epidermidis
GLSGTFN

SEQ ID NO: 1779112 - protein, 9 aa, Staphylococcus epidermidis
GLSKETKVS

SEQ ID NO: 1779113 - protein, 9 aa, Staphylococcus epidermidis
GLSKGKHSF

SEQ ID NO: 1779114 - protein, 8 aa, Staphylococcus epidermidis
GLSSKEIR

SEQ ID NO: 1779115 - protein, 9 aa, Staphylococcus epidermidis
GLSSNTIGA

SEQ ID NO: 1779116 - protein, 9 aa, Staphylococcus epidermidis
GLSTEEQEA

SEQ ID NO: 1779117 - protein, 4 aa, Staphylococcus epidermidis
GLTD

SEQ ID NO: 1779118 - protein, 6 aa, Staphylococcus epidermidis
GLTDNH

SEQ ID NO: 1779119 - protein, 7 aa, Staphylococcus epidermidis
GLTGEEL

SEQ ID NO: 1779120 - protein, 12 aa, Staphylococcus epidermidis
GLTNAQKQTLND

SEQ ID NO: 1779121 - protein, 5 aa, Staphylococcus epidermidis
GLTPK

SEQ ID NO: 1779122 - protein, 11 aa, Staphylococcus epidermidis
GLTQAQNALQG

SEQ ID NO: 1779123 - protein, 9 aa, Staphylococcus epidermidis
GLTQNEAAE

SEQ ID NO: 1779124 - protein, 10 aa, Staphylococcus epidermidis
GLTVGGTKRD

SEQ ID NO: 1779125 - protein, 12 aa, Staphylococcus epidermidis
GLVQAGKSLKRL

SEQ ID NO: 1779126 - protein, 5 aa, Staphylococcus epidermidis
GLVSA

SEQ ID NO: 1779127 - protein, 17 aa, Staphylococcus epidermidis
GMAKDKSKNKDKTITPK

SEQ ID NO: 1779128 - protein, 8 aa, Staphylococcus epidermidis
GMDENDWE

SEQ ID NO: 1779129 - protein, 10 aa, Staphylococcus epidermidis
GMDPSLGVNA

SEQ ID NO: 1779130 - protein, 11 aa, Staphylococcus epidermidis
GMEITNEGTEV

SEQ ID NO: 1779131 - protein, 9 aa, Staphylococcus epidermidis
GMGGKGTKK

SEQ ID NO: 1779132 - protein, 13 aa, Staphylococcus epidermidis
GMGQTSKGTPRLI

SEQ ID NO: 1779133 - protein, 44 aa, Staphylococcus epidermidis
GMKRPSYQNDTTSVSKRNDGVYQNDTTNTRDYTETYSERDRDDV

SEQ ID NO: 1779134 - protein, 9 aa, Staphylococcus epidermidis
GMKTGEEKD

SEQ ID NO: 1779135 - protein, 9 aa, Staphylococcus epidermidis
GMNKSEIKE

SEQ ID NO: 1779136 - protein, 4 aa, Staphylococcus epidermidis
GMNR

SEQ ID NO: 1779137 - protein, 11 aa, Staphylococcus epidermidis
GMPIPNDDKRI

SEQ ID NO: 1779138 - protein, 6 aa, Staphylococcus epidermidis
GMQSEM

SEQ ID NO: 1779139 - protein, 6 aa, Staphylococcus epidermidis
GMRSKR

SEQ ID NO: 1779140 - protein, 13 aa, Staphylococcus epidermidis
GMSAASKVVKEGG

SEQ ID NO: 1779141 - protein, 12 aa, Staphylococcus epidermidis
GMSAATGGTYGD

SEQ ID NO: 1779142 - protein, 6 aa, Staphylococcus epidermidis
GMSEDT

SEQ ID NO: 1779143 - protein, 15 aa, Staphylococcus epidermidis
GMSEEEAKNSGRNIK

SEQ ID NO: 1779144 - protein, 6 aa, Staphylococcus epidermidis
GMSTAG

SEQ ID NO: 1779145 - protein, 12 aa, Staphylococcus epidermidis
GMTGTGKQGEKE

SEQ ID NO: 1779146 - protein, 14 aa, Staphylococcus epidermidis
GMTNEKNEGKLGDG

SEQ ID NO: 1779147 - protein, 9 aa, Staphylococcus epidermidis
GMTSANPLD

SEQ ID NO: 1779148 - protein, 7 aa, Staphylococcus epidermidis
GMTSPAN

SEQ ID NO: 1779149 - protein, 6 aa, Staphylococcus epidermidis
GMTTET

SEQ ID NO: 1779150 - protein, 6 aa, Staphylococcus epidermidis
GNADDF

SEQ ID NO: 1779151 - protein, 9 aa, Staphylococcus epidermidis
GNASDELKA

SEQ ID NO: 1779152 - protein, 8 aa, Staphylococcus epidermidis
GNASSGEK

SEQ ID NO: 1779153 - protein, 5 aa, Staphylococcus epidermidis
GNATN

SEQ ID NO: 1779154 - protein, 4 aa, Staphylococcus epidermidis
GNDA

SEQ ID NO: 1779155 - protein, 8 aa, Staphylococcus epidermidis
GNDDQSKL

SEQ ID NO: 1779156 - protein, 9 aa, Staphylococcus epidermidis
GNDERKKSQ

SEQ ID NO: 1779157 - protein, 9 aa, Staphylococcus epidermidis
GNDKSSKRD

SEQ ID NO: 1779158 - protein, 7 aa, Staphylococcus epidermidis
GNDLEEI

SEQ ID NO: 1779159 - protein, 7 aa, Staphylococcus epidermidis
GNDPIEN

SEQ ID NO: 1779160 - protein, 7 aa, Staphylococcus epidermidis
GNDTPPY

SEQ ID NO: 1779161 - protein, 12 aa, Staphylococcus epidermidis
GNEDKGITAPHH

SEQ ID NO: 1779162 - protein, 16 aa, Staphylococcus epidermidis
GNEFHENSPRLIVKIT

SEQ ID NO: 1779163 - protein, 7 aa, Staphylococcus epidermidis
GNEGEPQ

SEQ ID NO: 1779164 - protein, 5 aa, Staphylococcus epidermidis
GNEGI

SEQ ID NO: 1779165 - protein, 7 aa, Staphylococcus epidermidis
GNEGPAI

SEQ ID NO: 1779166 - protein, 11 aa, Staphylococcus epidermidis
GNELIDQTGRS

SEQ ID NO: 1779167 - protein, 8 aa, Staphylococcus epidermidis
GNENQLSS

SEQ ID NO: 1779168 - protein, 4 aa, Staphylococcus epidermidis
GNEP

SEQ ID NO: 1779169 - protein, 11 aa, Staphylococcus epidermidis
GNESSYPKYDN

SEQ ID NO: 1779170 - protein, 5 aa, Staphylococcus epidermidis
GNETA

SEQ ID NO: 1779171 - protein, 5 aa, Staphylococcus epidermidis
GNETT

SEQ ID NO: 1779172 - protein, 9 aa, Staphylococcus epidermidis
GNFKAETQN

SEQ ID NO: 1779173 - protein, 14 aa, Staphylococcus epidermidis
GNFNENHGREEIQS

SEQ ID NO: 1779174 - protein, 12 aa, Staphylococcus epidermidis
GNGAPSNLEGER

SEQ ID NO: 1779175 - protein, 10 aa, Staphylococcus epidermidis
GNGLKDPDTA

SEQ ID NO: 1779176 - protein, 6 aa, Staphylococcus epidermidis
GNGMDE

SEQ ID NO: 1779177 - protein, 6 aa, Staphylococcus epidermidis
GNGNVL

SEQ ID NO: 1779178 - protein, 6 aa, Staphylococcus epidermidis
GNGPQI

SEQ ID NO: 1779179 - protein, 6 aa, Staphylococcus epidermidis
GNGSGH

SEQ ID NO: 1779180 - protein, 10 aa, Staphylococcus epidermidis
GNGSGRFTKA

SEQ ID NO: 1779181 - protein, 9 aa, Staphylococcus epidermidis
GNGTDSLKD

SEQ ID NO: 1779182 - protein, 11 aa, Staphylococcus epidermidis
GNGTRTTENRG

SEQ ID NO: 1779183 - protein, 8 aa, Staphylococcus epidermidis
GNIDDSDM

SEQ ID NO: 1779184 - protein, 5 aa, Staphylococcus epidermidis
GNIEV

SEQ ID NO: 1779185 - protein, 48 aa, Staphylococcus epidermidis
GNIKETIGNATNNEELENEGQEDKTSGKAKEFVENAKDKANDFIDNLK

SEQ ID NO: 1779186 - protein, 42 aa, Staphylococcus epidermidis
GNIKETVGNATDNKDLEQEGKEDKTSGKAKEFVDNAKEKAND

SEQ ID NO: 1779187 - protein, 5 aa, Staphylococcus epidermidis
GNINR

SEQ ID NO: 1779188 - protein, 6 aa, Staphylococcus epidermidis
GNIRDE

SEQ ID NO: 1779189 - protein, 16 aa, Staphylococcus epidermidis
GNISGNSRKEKAGQGL

SEQ ID NO: 1779190 - protein, 9 aa, Staphylococcus epidermidis
GNISKYTGK

SEQ ID NO: 1779191 - protein, 16 aa, Staphylococcus epidermidis
GNKGITEKGASKHVKV

SEQ ID NO: 1779192 - protein, 4 aa, Staphylococcus epidermidis
GNKI

SEQ ID NO: 1779193 - protein, 8 aa, Staphylococcus epidermidis
GNKKSISS

SEQ ID NO: 1779194 - protein, 4 aa, Staphylococcus epidermidis
GNKQ

SEQ ID NO: 1779195 - protein, 5 aa, Staphylococcus epidermidis
GNKQI

SEQ ID NO: 1779196 - protein, 9 aa, Staphylococcus epidermidis
GNKQKQYGV

SEQ ID NO: 1779197 - protein, 7 aa, Staphylococcus epidermidis
GNKSGEK

SEQ ID NO: 1779198 - protein, 19 aa, Staphylococcus epidermidis
GNKVETLKRRKQGLLQKMF

SEQ ID NO: 1779199 - protein, 14 aa, Staphylococcus epidermidis
GNLEVDDNGNVKGL

SEQ ID NO: 1779200 - protein, 18 aa, Staphylococcus epidermidis
GNLTVEQQENKENAEKAM

SEQ ID NO: 1779201 - protein, 18 aa, Staphylococcus epidermidis
GNMGGNINRTSEKYVEKT

SEQ ID NO: 1779202 - protein, 7 aa, Staphylococcus epidermidis
GNNEPSL

SEQ ID NO: 1779203 - protein, 6 aa, Staphylococcus epidermidis
GNNEQE

SEQ ID NO: 1779204 - protein, 15 aa, Staphylococcus epidermidis
GNNGSIDNDPPAAMR

SEQ ID NO: 1779205 - protein, 14 aa, Staphylococcus epidermidis
GNNPKYNFEREEKF

SEQ ID NO: 1779206 - protein, 5 aa, Staphylococcus epidermidis
GNNSP

SEQ ID NO: 1779207 - protein, 8 aa, Staphylococcus epidermidis
GNNTREYK

SEQ ID NO: 1779208 - protein, 7 aa, Staphylococcus epidermidis
GNPGRSA

SEQ ID NO: 1779209 - protein, 7 aa, Staphylococcus epidermidis
GNPGRST

SEQ ID NO: 1779210 - protein, 10 aa, Staphylococcus epidermidis
GNPIGTLTES

SEQ ID NO: 1779211 - protein, 6 aa, Staphylococcus epidermidis
GNPKEE

SEQ ID NO: 1779212 - protein, 5 aa, Staphylococcus epidermidis
GNPMS

SEQ ID NO: 1779213 - protein, 28 aa, Staphylococcus epidermidis
GNPPLSLDKTTVKDQSTIDERERGYNYR

SEQ ID NO: 1779214 - protein, 6 aa, Staphylococcus epidermidis
GNPRRF

SEQ ID NO: 1779215 - protein, 4 aa, Staphylococcus epidermidis
GNPT

SEQ ID NO: 1779216 - protein, 7 aa, Staphylococcus epidermidis
GNQDRDI

SEQ ID NO: 1779217 - protein, 7 aa, Staphylococcus epidermidis
GNQGPAI

SEQ ID NO: 1779218 - protein, 13 aa, Staphylococcus epidermidis
GNQRDDRTHTGTI

SEQ ID NO: 1779219 - protein, 6 aa, Staphylococcus epidermidis
GNQTEI

SEQ ID NO: 1779220 - protein, 10 aa, Staphylococcus epidermidis
GNRGQEKIEQ

SEQ ID NO: 1779221 - protein, 28 aa, Staphylococcus epidermidis
GNRLTDDGNITWDPSKKHIKEGVKGSLQ

SEQ ID NO: 1779222 - protein, 5 aa, Staphylococcus epidermidis
GNRNG

SEQ ID NO: 1779223 - protein, 10 aa, Staphylococcus epidermidis
GNRSVLSDSN

SEQ ID NO: 1779224 - protein, 14 aa, Staphylococcus epidermidis
GNRSVTSQSGSTDV

SEQ ID NO: 1779225 - protein, 13 aa, Staphylococcus epidermidis
GNRVPETKADTAV

SEQ ID NO: 1779226 - protein, 11 aa, Staphylococcus epidermidis
GNSKALSLSKQ

SEQ ID NO: 1779227 - protein, 5 aa, Staphylococcus epidermidis
GNTAI

SEQ ID NO: 1779228 - protein, 8 aa, Staphylococcus epidermidis
GNTDDSTR

SEQ ID NO: 1779229 - protein, 10 aa, Staphylococcus epidermidis
GNTEENETKI

SEQ ID NO: 1779230 - protein, 9 aa, Staphylococcus epidermidis
GNTHELRGE

SEQ ID NO: 1779231 - protein, 7 aa, Staphylococcus epidermidis
GNTNIDG

SEQ ID NO: 1779232 - protein, 15 aa, Staphylococcus epidermidis
GNTPDENGKLKGDVA

SEQ ID NO: 1779233 - protein, 17 aa, Staphylococcus epidermidis
GNTPDENGKLKGDVDYE

SEQ ID NO: 1779234 - protein, 14 aa, Staphylococcus epidermidis
GNTQQNQESQMASD

SEQ ID NO: 1779235 - protein, 5 aa, Staphylococcus epidermidis
GNTTF

SEQ ID NO: 1779236 - protein, 13 aa, Staphylococcus epidermidis
GNTVAPKNSADII

SEQ ID NO: 1779237 - protein, 7 aa, Staphylococcus epidermidis
GNVGPDA

SEQ ID NO: 1779238 - protein, 7 aa, Staphylococcus epidermidis
GNVKPSY

SEQ ID NO: 1779239 - protein, 7 aa, Staphylococcus epidermidis
GNVLGTG

SEQ ID NO: 1779240 - protein, 5 aa, Staphylococcus epidermidis
GNVQT

SEQ ID NO: 1779241 - protein, 19 aa, Staphylococcus epidermidis
GNVSNNYPKKITEDSTTRD

SEQ ID NO: 1779242 - protein, 10 aa, Staphylococcus epidermidis
GNVTKEELNK

SEQ ID NO: 1779243 - protein, 9 aa, Staphylococcus epidermidis
GNVTKKGFS

SEQ ID NO: 1779244 - protein, 17 aa, Staphylococcus epidermidis
GNVVGEAELNKDGTTKV

SEQ ID NO: 1779245 - protein, 5 aa, Staphylococcus epidermidis
GNYFS

SEQ ID NO: 1779246 - protein, 5 aa, Staphylococcus epidermidis
GNYNG

SEQ ID NO: 1779247 - protein, 4 aa, Staphylococcus epidermidis
GNYP

SEQ ID NO: 1779248 - protein, 7 aa, Staphylococcus epidermidis
GNYSDVT

SEQ ID NO: 1779249 - protein, 6 aa, Staphylococcus epidermidis
GPASQL

SEQ ID NO: 1779250 - protein, 8 aa, Staphylococcus epidermidis
GPATDATI

SEQ ID NO: 1779251 - protein, 6 aa, Staphylococcus epidermidis
GPATIN

SEQ ID NO: 1779252 - protein, 8 aa, Staphylococcus epidermidis
GPAYEADE

SEQ ID NO: 1779253 - protein, 8 aa, Staphylococcus epidermidis
GPDEESNI

SEQ ID NO: 1779254 - protein, 9 aa, Staphylococcus epidermidis
GPDSALRDE

SEQ ID NO: 1779255 - protein, 4 aa, Staphylococcus epidermidis
GPDY

SEQ ID NO: 1779256 - protein, 30 aa, Staphylococcus epidermidis
GPEGGDGGGTIVATGTPEEIAQNEDSYTGK

SEQ ID NO: 1779257 - protein, 12 aa, Staphylococcus epidermidis
GPFKDTPINPTV

SEQ ID NO: 1779258 - protein, 32 aa, Staphylococcus epidermidis
GPGAGNHGGEIVSSGTPSKVMKDKKSLTGQYL

SEQ ID NO: 1779259 - protein, 5 aa, Staphylococcus epidermidis
GPGHQ

SEQ ID NO: 1779260 - protein, 12 aa, Staphylococcus epidermidis
GPGQAAAQIEGS

SEQ ID NO: 1779261 - protein, 13 aa, Staphylococcus epidermidis
GPHRKEEKEREIG

SEQ ID NO: 1779262 - protein, 18 aa, Staphylococcus epidermidis
GPILEPDTKYDSHGVYSG

SEQ ID NO: 1779263 - protein, 4 aa, Staphylococcus epidermidis
GPIR

SEQ ID NO: 1779264 - protein, 4 aa, Staphylococcus epidermidis
GPIV

SEQ ID NO: 1779265 - protein, 8 aa, Staphylococcus epidermidis
GPKENSIV

SEQ ID NO: 1779266 - protein, 7 aa, Staphylococcus epidermidis
GPKETLN

SEQ ID NO: 1779267 - protein, 4 aa, Staphylococcus epidermidis
GPKQ

SEQ ID NO: 1779268 - protein, 11 aa, Staphylococcus epidermidis
GPKQNPNSDYS

SEQ ID NO: 1779269 - protein, 13 aa, Staphylococcus epidermidis
GPKWTNPNNRPEH

SEQ ID NO: 1779270 - protein, 7 aa, Staphylococcus epidermidis
GPLKKSL

SEQ ID NO: 1779271 - protein, 13 aa, Staphylococcus epidermidis
GPLQDDEGTGKIE

SEQ ID NO: 1779272 - protein, 4 aa, Staphylococcus epidermidis
GPLS

SEQ ID NO: 1779273 - protein, 26 aa, Staphylococcus epidermidis
GPLTTPQSPQGKPVSMQAGASKEGVA

SEQ ID NO: 1779274 - protein, 10 aa, Staphylococcus epidermidis
GPNAGKDGGE

SEQ ID NO: 1779275 - protein, 14 aa, Staphylococcus epidermidis
GPNEDFDAYPRQID

SEQ ID NO: 1779276 - protein, 8 aa, Staphylococcus epidermidis
GPNGCRKS

SEQ ID NO: 1779277 - protein, 8 aa, Staphylococcus epidermidis
GPNIGGGR

SEQ ID NO: 1779278 - protein, 8 aa, Staphylococcus epidermidis
GPPLEGAK

SEQ ID NO: 1779279 - protein, 8 aa, Staphylococcus epidermidis
GPRSDLRN

SEQ ID NO: 1779280 - protein, 5 aa, Staphylococcus epidermidis
GPSDN

SEQ ID NO: 1779281 - protein, 9 aa, Staphylococcus epidermidis
GPSGTGKTT

SEQ ID NO: 1779282 - protein, 9 aa, Staphylococcus epidermidis
GPSNKSYFT

SEQ ID NO: 1779283 - protein, 9 aa, Staphylococcus epidermidis
GPSTKSYFT

SEQ ID NO: 1779284 - protein, 11 aa, Staphylococcus epidermidis
GPSTSNTYEIN

SEQ ID NO: 1779285 - protein, 18 aa, Staphylococcus epidermidis
GPTGSQMDKKETAKDTAR

SEQ ID NO: 1779286 - protein, 5 aa, Staphylococcus epidermidis
GPTLS

SEQ ID NO: 1779287 - protein, 9 aa, Staphylococcus epidermidis
GPTPRSYSY

SEQ ID NO: 1779288 - protein, 8 aa, Staphylococcus epidermidis
GPTPVPDS

SEQ ID NO: 1779289 - protein, 8 aa, Staphylococcus epidermidis
GPTTPTTA

SEQ ID NO: 1779290 - protein, 6 aa, Staphylococcus epidermidis
GPTTSD

SEQ ID NO: 1779291 - protein, 4 aa, Staphylococcus epidermidis
GPVE

SEQ ID NO: 1779292 - protein, 5 aa, Staphylococcus epidermidis
GPVGR

SEQ ID NO: 1779293 - protein, 13 aa, Staphylococcus epidermidis
GPVTNFDEANKSD

SEQ ID NO: 1779294 - protein, 13 aa, Staphylococcus epidermidis
GPVTNFDEANQSD

SEQ ID NO: 1779295 - protein, 4 aa, Staphylococcus epidermidis
GPVY

SEQ ID NO: 1779296 - protein, 6 aa, Staphylococcus epidermidis
GQAELG

SEQ ID NO: 1779297 - protein, 23 aa, Staphylococcus epidermidis
GQAFEDSRTGNTIKPIVVFDASF

SEQ ID NO: 1779298 - protein, 7 aa, Staphylococcus epidermidis
GQALQLG

SEQ ID NO: 1779299 - protein, 14 aa, Staphylococcus epidermidis
GQAYESGDKVTGST

SEQ ID NO: 1779300 - protein, 6 aa, Staphylococcus epidermidis
GQDKDD

SEQ ID NO: 1779301 - protein, 8 aa, Staphylococcus epidermidis
GQDVTPDK

SEQ ID NO: 1779302 - protein, 19 aa, Staphylococcus epidermidis
GQEEAHDAREMTSDEIEQT

SEQ ID NO: 1779303 - protein, 5 aa, Staphylococcus epidermidis
GQEGV

SEQ ID NO: 1779304 - protein, 9 aa, Staphylococcus epidermidis
GQESDDDMA

SEQ ID NO: 1779305 - protein, 5 aa, Staphylococcus epidermidis
GQESL

SEQ ID NO: 1779306 - protein, 9 aa, Staphylococcus epidermidis
GQESNPTTW

SEQ ID NO: 1779307 - protein, 8 aa, Staphylococcus epidermidis
GQGANTTV

SEQ ID NO: 1779308 - protein, 9 aa, Staphylococcus epidermidis
GQGGEKDKI

SEQ ID NO: 1779309 - protein, 10 aa, Staphylococcus epidermidis
GQGKTAEEAL

SEQ ID NO: 1779310 - protein, 5 aa, Staphylococcus epidermidis
GQGTI

SEQ ID NO: 1779311 - protein, 16 aa, Staphylococcus epidermidis
GQGTRLGYKGPKGSFE

SEQ ID NO: 1779312 - protein, 18 aa, Staphylococcus epidermidis
GQHSNKLDIDGKELTYDS

SEQ ID NO: 1779313 - protein, 11 aa, Staphylococcus epidermidis
GQITKKQANEL

SEQ ID NO: 1779314 - protein, 15 aa, Staphylococcus epidermidis
GQITTSKKKNAEDEK

SEQ ID NO: 1779315 - protein, 17 aa, Staphylococcus epidermidis
GQKGTNLTYQDKEKIEK

SEQ ID NO: 1779316 - protein, 29 aa, Staphylococcus epidermidis
GQKITDKEDVNANNNSNNMKKNISKASAV

SEQ ID NO: 1779317 - protein, 11 aa, Staphylococcus epidermidis
GQKKDGEGGIL

SEQ ID NO: 1779318 - protein, 5 aa, Staphylococcus epidermidis
GQKLY

SEQ ID NO: 1779319 - protein, 19 aa, Staphylococcus epidermidis
GQKTLGDYNESFLNFKMSL

SEQ ID NO: 1779320 - protein, 5 aa, Staphylococcus epidermidis
GQLED

SEQ ID NO: 1779321 - protein, 8 aa, Staphylococcus epidermidis
GQLESPGN

SEQ ID NO: 1779322 - protein, 7 aa, Staphylococcus epidermidis
GQLPTGV

SEQ ID NO: 1779323 - protein, 7 aa, Staphylococcus epidermidis
GQLTQDM

SEQ ID NO: 1779324 - protein, 6 aa, Staphylococcus epidermidis
GQMAKT

SEQ ID NO: 1779325 - protein, 15 aa, Staphylococcus epidermidis
GQMISEDAKNRISSL

SEQ ID NO: 1779326 - protein, 9 aa, Staphylococcus epidermidis
GQNAGQNPD

SEQ ID NO: 1779327 - protein, 7 aa, Staphylococcus epidermidis
GQNLGAI

SEQ ID NO: 1779328 - protein, 9 aa, Staphylococcus epidermidis
GQPKEGETV

SEQ ID NO: 1779329 - protein, 5 aa, Staphylococcus epidermidis
GQPVD

SEQ ID NO: 1779330 - protein, 9 aa, Staphylococcus epidermidis
GQPYEVPNT

SEQ ID NO: 1779331 - protein, 6 aa, Staphylococcus epidermidis
GQQDIK

SEQ ID NO: 1779332 - protein, 12 aa, Staphylococcus epidermidis
GQQNVSDKNGLR

SEQ ID NO: 1779333 - protein, 10 aa, Staphylococcus epidermidis
GQRTDITSEQ

SEQ ID NO: 1779334 - protein, 7 aa, Staphylococcus epidermidis
GQSEPRA

SEQ ID NO: 1779335 - protein, 8 aa, Staphylococcus epidermidis
GQSGVGKT

SEQ ID NO: 1779336 - protein, 5 aa, Staphylococcus epidermidis
GQSIN

SEQ ID NO: 1779337 - protein, 7 aa, Staphylococcus epidermidis
GQSLNGR

SEQ ID NO: 1779338 - protein, 8 aa, Staphylococcus epidermidis
GQSPRLAE

SEQ ID NO: 1779339 - protein, 8 aa, Staphylococcus epidermidis
GQSPTLSA

SEQ ID NO: 1779340 - protein, 11 aa, Staphylococcus epidermidis
GQSQTGTGKSH

SEQ ID NO: 1779341 - protein, 8 aa, Staphylococcus epidermidis
GQSSKIDE

SEQ ID NO: 1779342 - protein, 8 aa, Staphylococcus epidermidis
GQSSKSID

SEQ ID NO: 1779343 - protein, 9 aa, Staphylococcus epidermidis
GQSSTEEDV

SEQ ID NO: 1779344 - protein, 19 aa, Staphylococcus epidermidis
GQSSTLSTVAKENLEEARE

SEQ ID NO: 1779345 - protein, 6 aa, Staphylococcus epidermidis
GQTDKL

SEQ ID NO: 1779346 - protein, 10 aa, Staphylococcus epidermidis
GQTGINPPVG

SEQ ID NO: 1779347 - protein, 8 aa, Staphylococcus epidermidis
GQTNSTLL

SEQ ID NO: 1779348 - protein, 4 aa, Staphylococcus epidermidis
GQTP

SEQ ID NO: 1779349 - protein, 6 aa, Staphylococcus epidermidis
GQTPEL

SEQ ID NO: 1779350 - protein, 8 aa, Staphylococcus epidermidis
GQTQSSGV

SEQ ID NO: 1779351 - protein, 9 aa, Staphylococcus epidermidis
GQTSNEKIY

SEQ ID NO: 1779352 - protein, 22 aa, Staphylococcus epidermidis
GQVQDRESYTAEIDASDAEKGV

SEQ ID NO: 1779353 - protein, 11 aa, Staphylococcus epidermidis
GQVSNQKLEEL

SEQ ID NO: 1779354 - protein, 20 aa, Staphylococcus epidermidis
GQVSTVATGQAYIEQETKTY

SEQ ID NO: 1779355 - protein, 6 aa, Staphylococcus epidermidis
GQYAPD

SEQ ID NO: 1779356 - protein, 22 aa, Staphylococcus epidermidis
GQYAVTDDRSTGFRDEARQRGI

SEQ ID NO: 1779357 - protein, 6 aa, Staphylococcus epidermidis
GQYDGG

SEQ ID NO: 1779358 - protein, 5 aa, Staphylococcus epidermidis
GQYEE

SEQ ID NO: 1779359 - protein, 7 aa, Staphylococcus epidermidis
GQYGGNI

SEQ ID NO: 1779360 - protein, 14 aa, Staphylococcus epidermidis
GQYNSQSDSGTTKF

SEQ ID NO: 1779361 - protein, 16 aa, Staphylococcus epidermidis
GQYQSNDRLPSKRQLS

SEQ ID NO: 1779362 - protein, 11 aa, Staphylococcus epidermidis
GRAGRDGKLSQ

SEQ ID NO: 1779363 - protein, 19 aa, Staphylococcus epidermidis
GRAPKEKQSIIDQTKGLEG

SEQ ID NO: 1779364 - protein, 10 aa, Staphylococcus epidermidis
GRAPKEKQSV

SEQ ID NO: 1779365 - protein, 17 aa, Staphylococcus epidermidis
GRAVAQSVDQYLSKKVL

SEQ ID NO: 1779366 - protein, 8 aa, Staphylococcus epidermidis
GRDEGKML

SEQ ID NO: 1779367 - protein, 14 aa, Staphylococcus epidermidis
GRDFGEENIVGPND

SEQ ID NO: 1779368 - protein, 17 aa, Staphylococcus epidermidis
GRDTRESENERERTRSH

SEQ ID NO: 1779369 - protein, 5 aa, Staphylococcus epidermidis
GREMP

SEQ ID NO: 1779370 - protein, 7 aa, Staphylococcus epidermidis
GREQTER

SEQ ID NO: 1779371 - protein, 17 aa, Staphylococcus epidermidis
GREVAQSVDQYLSKKVL

SEQ ID NO: 1779372 - protein, 5 aa, Staphylococcus epidermidis
GREVK

SEQ ID NO: 1779373 - protein, 5 aa, Staphylococcus epidermidis
GRFRR

SEQ ID NO: 1779374 - protein, 9 aa, Staphylococcus epidermidis
GRFSETSRD

SEQ ID NO: 1779375 - protein, 8 aa, Staphylococcus epidermidis
GRFSGRPS

SEQ ID NO: 1779376 - protein, 6 aa, Staphylococcus epidermidis
GRGPIV

SEQ ID NO: 1779377 - protein, 8 aa, Staphylococcus epidermidis
GRGPTNKE

SEQ ID NO: 1779378 - protein, 7 aa, Staphylococcus epidermidis
GRGRPGV

SEQ ID NO: 1779379 - protein, 6 aa, Staphylococcus epidermidis
GRINLD

SEQ ID NO: 1779380 - protein, 14 aa, Staphylococcus epidermidis
GRITEYKGNYSNYV

SEQ ID NO: 1779381 - protein, 11 aa, Staphylococcus epidermidis
GRKDDKGKLAE

SEQ ID NO: 1779382 - protein, 10 aa, Staphylococcus epidermidis
GRKGGKQGLE

SEQ ID NO: 1779383 - protein, 13 aa, Staphylococcus epidermidis
GRKRQTQAAAGVE

SEQ ID NO: 1779384 - protein, 6 aa, Staphylococcus epidermidis
GRLEAE

SEQ ID NO: 1779385 - protein, 16 aa, Staphylococcus epidermidis
GRLPGIDGKAKMSKSL

SEQ ID NO: 1779386 - protein, 11 aa, Staphylococcus epidermidis
GRLSAEDKKEI

SEQ ID NO: 1779387 - protein, 7 aa, Staphylococcus epidermidis
GRMTREE

SEQ ID NO: 1779388 - protein, 6 aa, Staphylococcus epidermidis
GRNARK

SEQ ID NO: 1779389 - protein, 8 aa, Staphylococcus epidermidis
GRNDEGGE

SEQ ID NO: 1779390 - protein, 5 aa, Staphylococcus epidermidis
GRNEA

SEQ ID NO: 1779391 - protein, 7 aa, Staphylococcus epidermidis
GRNGYEH

SEQ ID NO: 1779392 - protein, 9 aa, Staphylococcus epidermidis
GRNHSISGI

SEQ ID NO: 1779393 - protein, 7 aa, Staphylococcus epidermidis
GRNISDG

SEQ ID NO: 1779394 - protein, 25 aa, Staphylococcus epidermidis
GRNLPASLRETGLGGLAGTPTGEEI

SEQ ID NO: 1779395 - protein, 25 aa, Staphylococcus epidermidis
GRNLPASLRETGLGGLAGTPTGEKI

SEQ ID NO: 1779396 - protein, 5 aa, Staphylococcus epidermidis
GRPDL

SEQ ID NO: 1779397 - protein, 7 aa, Staphylococcus epidermidis
GRPGTGK

SEQ ID NO: 1779398 - protein, 6 aa, Staphylococcus epidermidis
GRPSTH

SEQ ID NO: 1779399 - protein, 8 aa, Staphylococcus epidermidis
GRPYASNF

SEQ ID NO: 1779400 - protein, 4 aa, Staphylococcus epidermidis
GRQH

SEQ ID NO: 1779401 - protein, 4 aa, Staphylococcus epidermidis
GRRK

SEQ ID NO: 1779402 - protein, 22 aa, Staphylococcus epidermidis
GRRTIEADNPLYTTRVPDGKHP

SEQ ID NO: 1779403 - protein, 8 aa, Staphylococcus epidermidis
GRSGRADK

SEQ ID NO: 1779404 - protein, 12 aa, Staphylococcus epidermidis
GRSKKGSRKNFQ

SEQ ID NO: 1779405 - protein, 5 aa, Staphylococcus epidermidis
GRSLR

SEQ ID NO: 1779406 - protein, 5 aa, Staphylococcus epidermidis
GRSNT

SEQ ID NO: 1779407 - protein, 8 aa, Staphylococcus epidermidis
GRSPSFKN

SEQ ID NO: 1779408 - protein, 8 aa, Staphylococcus epidermidis
GRSTRSAL

SEQ ID NO: 1779409 - protein, 5 aa, Staphylococcus epidermidis
GRSYS

SEQ ID NO: 1779410 - protein, 7 aa, Staphylococcus epidermidis
GRSYSEI

SEQ ID NO: 1779411 - protein, 7 aa, Staphylococcus epidermidis
GRTDSGM

SEQ ID NO: 1779412 - protein, 4 aa, Staphylococcus epidermidis
GRTE

SEQ ID NO: 1779413 - protein, 6 aa, Staphylococcus epidermidis
GRTEEI

SEQ ID NO: 1779414 - protein, 14 aa, Staphylococcus epidermidis
GRTYGSMSATGQDA

SEQ ID NO: 1779415 - protein, 12 aa, Staphylococcus epidermidis
GRVQSGEKFKYT

SEQ ID NO: 1779416 - protein, 32 aa, Staphylococcus epidermidis
GRVTQRQGEYAEDRGDYANAAGDYANRAGDSQ

SEQ ID NO: 1779417 - protein, 29 aa, Staphylococcus epidermidis
GRYNGGGVHHGRDITSATINGSPIKAARS

SEQ ID NO: 1779418 - protein, 8 aa, Staphylococcus epidermidis
GRYTKGAT

SEQ ID NO: 1779419 - protein, 4 aa, Staphylococcus epidermidis
GSAD

SEQ ID NO: 1779420 - protein, 9 aa, Staphylococcus epidermidis
GSAGSITAA

SEQ ID NO: 1779421 - protein, 4 aa, Staphylococcus epidermidis
GSAN

SEQ ID NO: 1779422 - protein, 10 aa, Staphylococcus epidermidis
GSAPDIANQD

SEQ ID NO: 1779423 - protein, 9 aa, Staphylococcus epidermidis
GSASGNTDG

SEQ ID NO: 1779424 - protein, 4 aa, Staphylococcus epidermidis
GSDE

SEQ ID NO: 1779425 - protein, 11 aa, Staphylococcus epidermidis
GSDEAGSGDYF

SEQ ID NO: 1779426 - protein, 6 aa, Staphylococcus epidermidis
GSDEGI

SEQ ID NO: 1779427 - protein, 7 aa, Staphylococcus epidermidis
GSDEQLR

SEQ ID NO: 1779428 - protein, 5 aa, Staphylococcus epidermidis
GSDEV

SEQ ID NO: 1779429 - protein, 5 aa, Staphylococcus epidermidis
GSDFT

SEQ ID NO: 1779430 - protein, 8 aa, Staphylococcus epidermidis
GSDGEQHR

SEQ ID NO: 1779431 - protein, 8 aa, Staphylococcus epidermidis
GSDGGFAE

SEQ ID NO: 1779432 - protein, 9 aa, Staphylococcus epidermidis
GSDGSGGKY

SEQ ID NO: 1779433 - protein, 11 aa, Staphylococcus epidermidis
GSDSDEENDIS

SEQ ID NO: 1779434 - protein, 10 aa, Staphylococcus epidermidis
GSDSVESAQR

SEQ ID NO: 1779435 - protein, 11 aa, Staphylococcus epidermidis
GSDTGGSIRQP

SEQ ID NO: 1779436 - protein, 7 aa, Staphylococcus epidermidis
GSEETLD

SEQ ID NO: 1779437 - protein, 8 aa, Staphylococcus epidermidis
GSEHEQNA

SEQ ID NO: 1779438 - protein, 10 aa, Staphylococcus epidermidis
GSEKKTANMI

SEQ ID NO: 1779439 - protein, 10 aa, Staphylococcus epidermidis
GSEKQPDDLE

SEQ ID NO: 1779440 - protein, 4 aa, Staphylococcus epidermidis
GSEQ

SEQ ID NO: 1779441 - protein, 9 aa, Staphylococcus epidermidis
GSETSVKEQ

SEQ ID NO: 1779442 - protein, 14 aa, Staphylococcus epidermidis
GSEVEHIAENGAFN

SEQ ID NO: 1779443 - protein, 7 aa, Staphylococcus epidermidis
GSEVGDV

SEQ ID NO: 1779444 - protein, 5 aa, Staphylococcus epidermidis
GSEVS

SEQ ID NO: 1779445 - protein, 16 aa, Staphylococcus epidermidis
GSEVTVDNPAQMPERD

SEQ ID NO: 1779446 - protein, 6 aa, Staphylococcus epidermidis
GSFDAG

SEQ ID NO: 1779447 - protein, 8 aa, Staphylococcus epidermidis
GSFNNGVG

SEQ ID NO: 1779448 - protein, 9 aa, Staphylococcus epidermidis
GSFPQTREV

SEQ ID NO: 1779449 - protein, 13 aa, Staphylococcus epidermidis
GSGDLKGSSIGSK

SEQ ID NO: 1779450 - protein, 8 aa, Staphylococcus epidermidis
GSGFSDKD

SEQ ID NO: 1779451 - protein, 7 aa, Staphylococcus epidermidis
GSGKPVI

SEQ ID NO: 1779452 - protein, 6 aa, Staphylococcus epidermidis
GSGKTT

SEQ ID NO: 1779453 - protein, 13 aa, Staphylococcus epidermidis
GSGNKTTQSVTSG

SEQ ID NO: 1779454 - protein, 4 aa, Staphylococcus epidermidis
GSGR

SEQ ID NO: 1779455 - protein, 8 aa, Staphylococcus epidermidis
GSGSDRAS

SEQ ID NO: 1779456 - protein, 7 aa, Staphylococcus epidermidis
GSGSKKT

SEQ ID NO: 1779457 - protein, 7 aa, Staphylococcus epidermidis
GSHASRY

SEQ ID NO: 1779458 - protein, 11 aa, Staphylococcus epidermidis
GSHGRNSISHN

SEQ ID NO: 1779459 - protein, 5 aa, Staphylococcus epidermidis
GSIEN

SEQ ID NO: 1779460 - protein, 8 aa, Staphylococcus epidermidis
GSIESYDD

SEQ ID NO: 1779461 - protein, 8 aa, Staphylococcus epidermidis
GSIKNGAT

SEQ ID NO: 1779462 - protein, 8 aa, Staphylococcus epidermidis
GSINDTKI

SEQ ID NO: 1779463 - protein, 14 aa, Staphylococcus epidermidis
GSIPISQEALDDSV

SEQ ID NO: 1779464 - protein, 6 aa, Staphylococcus epidermidis
GSITEI

SEQ ID NO: 1779465 - protein, 8 aa, Staphylococcus epidermidis
GSKAGATA

SEQ ID NO: 1779466 - protein, 10 aa, Staphylococcus epidermidis
GSKALKSLRS

SEQ ID NO: 1779467 - protein, 5 aa, Staphylococcus epidermidis
GSKDI

SEQ ID NO: 1779468 - protein, 7 aa, Staphylococcus epidermidis
GSKDTIN

SEQ ID NO: 1779469 - protein, 10 aa, Staphylococcus epidermidis
GSKDYKGAAT

SEQ ID NO: 1779470 - protein, 11 aa, Staphylococcus epidermidis
GSKEEAKEAGI

SEQ ID NO: 1779471 - protein, 6 aa, Staphylococcus epidermidis
GSKEGM

SEQ ID NO: 1779472 - protein, 8 aa, Staphylococcus epidermidis
GSKSGDYQ

SEQ ID NO: 1779473 - protein, 10 aa, Staphylococcus epidermidis
GSKTPGHPEF

SEQ ID NO: 1779474 - protein, 20 aa, Staphylococcus epidermidis
GSKTSNYATQNSNLSNSNTE

SEQ ID NO: 1779475 - protein, 5 aa, Staphylococcus epidermidis
GSKTY

SEQ ID NO: 1779476 - protein, 6 aa, Staphylococcus epidermidis
GSLDYE

SEQ ID NO: 1779477 - protein, 8 aa, Staphylococcus epidermidis
GSLPPGVY

SEQ ID NO: 1779478 - protein, 14 aa, Staphylococcus epidermidis
GSLTSGHSAMSGSI

SEQ ID NO: 1779479 - protein, 12 aa, Staphylococcus epidermidis
GSMSTSGKDELE

SEQ ID NO: 1779480 - protein, 7 aa, Staphylococcus epidermidis
GSNANQI

SEQ ID NO: 1779481 - protein, 9 aa, Staphylococcus epidermidis
GSNGTGKTT

SEQ ID NO: 1779482 - protein, 9 aa, Staphylococcus epidermidis
GSNNDDSYR

SEQ ID NO: 1779483 - protein, 9 aa, Staphylococcus epidermidis
GSNRPSRVS

SEQ ID NO: 1779484 - protein, 23 aa, Staphylococcus epidermidis
GSPEMSNKNAQANKSNNTPTLDS

SEQ ID NO: 1779485 - protein, 22 aa, Staphylococcus epidermidis
GSPNKAGSNGVHGAPLGEDERK

SEQ ID NO: 1779486 - protein, 10 aa, Staphylococcus epidermidis
GSPSSRTQRL

SEQ ID NO: 1779487 - protein, 6 aa, Staphylococcus epidermidis
GSQDDI

SEQ ID NO: 1779488 - protein, 4 aa, Staphylococcus epidermidis
GSQF

SEQ ID NO: 1779489 - protein, 16 aa, Staphylococcus epidermidis
GSQGHAHAQNLKDSGY

SEQ ID NO: 1779490 - protein, 5 aa, Staphylococcus epidermidis
GSQLQ

SEQ ID NO: 1779491 - protein, 9 aa, Staphylococcus epidermidis
GSQNARDLP

SEQ ID NO: 1779492 - protein, 7 aa, Staphylococcus epidermidis
GSRAGGI

SEQ ID NO: 1779493 - protein, 14 aa, Staphylococcus epidermidis
GSRANINIPKDEFQ

SEQ ID NO: 1779494 - protein, 14 aa, Staphylococcus epidermidis
GSRARGTHTEDSDI

SEQ ID NO: 1779495 - protein, 6 aa, Staphylococcus epidermidis
GSREVI

SEQ ID NO: 1779496 - protein, 14 aa, Staphylococcus epidermidis
GSRGMKLEEVVEAL

SEQ ID NO: 1779497 - protein, 6 aa, Staphylococcus epidermidis
GSRPIE

SEQ ID NO: 1779498 - protein, 8 aa, Staphylococcus epidermidis
GSRPINFD

SEQ ID NO: 1779499 - protein, 6 aa, Staphylococcus epidermidis
GSRSAR

SEQ ID NO: 1779500 - protein, 6 aa, Staphylococcus epidermidis
GSSIEN

SEQ ID NO: 1779501 - protein, 10 aa, Staphylococcus epidermidis
GSSINKEDSI

SEQ ID NO: 1779502 - protein, 9 aa, Staphylococcus epidermidis
GSSKGESYK

SEQ ID NO: 1779503 - protein, 9 aa, Staphylococcus epidermidis
GSSKKDDTV

SEQ ID NO: 1779504 - protein, 17 aa, Staphylococcus epidermidis
GSSKKDESVLAGYTDKN

SEQ ID NO: 1779505 - protein, 7 aa, Staphylococcus epidermidis
GSSNGIN

SEQ ID NO: 1779506 - protein, 4 aa, Staphylococcus epidermidis
GSSQ

SEQ ID NO: 1779507 - protein, 4 aa, Staphylococcus epidermidis
GSSR

SEQ ID NO: 1779508 - protein, 9 aa, Staphylococcus epidermidis
GSTEEGAID

SEQ ID NO: 1779509 - protein, 10 aa, Staphylococcus epidermidis
GSTGEPKGVE

SEQ ID NO: 1779510 - protein, 12 aa, Staphylococcus epidermidis
GSTGSGKSSTVA

SEQ ID NO: 1779511 - protein, 12 aa, Staphylococcus epidermidis
GSTITDDIPEDS

SEQ ID NO: 1779512 - protein, 9 aa, Staphylococcus epidermidis
GSTLSREAD

SEQ ID NO: 1779513 - protein, 8 aa, Staphylococcus epidermidis
GSTNATAS

SEQ ID NO: 1779514 - protein, 15 aa, Staphylococcus epidermidis
GSTNPSEAAPGTIRG

SEQ ID NO: 1779515 - protein, 14 aa, Staphylococcus epidermidis
GSTPLRSKTEYYNN

SEQ ID NO: 1779516 - protein, 8 aa, Staphylococcus epidermidis
GSTQSQSM

SEQ ID NO: 1779517 - protein, 18 aa, Staphylococcus epidermidis
GSVDGEEFEGGQAEGYDL

SEQ ID NO: 1779518 - protein, 25 aa, Staphylococcus epidermidis
GSVQAGKGVTLKEAGQSIQRTFSSN

SEQ ID NO: 1779519 - protein, 14 aa, Staphylococcus epidermidis
GSYDDRAQEEADKY

SEQ ID NO: 1779520 - protein, 6 aa, Staphylococcus epidermidis
GSYRRF

SEQ ID NO: 1779521 - protein, 6 aa, Staphylococcus epidermidis
GSYSDV

SEQ ID NO: 1779522 - protein, 8 aa, Staphylococcus epidermidis
GTADPYQD

SEQ ID NO: 1779523 - protein, 6 aa, Staphylococcus epidermidis
GTAISK

SEQ ID NO: 1779524 - protein, 5 aa, Staphylococcus epidermidis
GTASV

SEQ ID NO: 1779525 - protein, 4 aa, Staphylococcus epidermidis
GTAT

SEQ ID NO: 1779526 - protein, 12 aa, Staphylococcus epidermidis
GTAVSENTTQRV

SEQ ID NO: 1779527 - protein, 11 aa, Staphylococcus epidermidis
GTAVSSGEIQR

SEQ ID NO: 1779528 - protein, 6 aa, Staphylococcus epidermidis
GTCMTT

SEQ ID NO: 1779529 - protein, 7 aa, Staphylococcus epidermidis
GTCPSST

SEQ ID NO: 1779530 - protein, 5 aa, Staphylococcus epidermidis
GTDAI

SEQ ID NO: 1779531 - protein, 10 aa, Staphylococcus epidermidis
GTDEQQVYNA

SEQ ID NO: 1779532 - protein, 6 aa, Staphylococcus epidermidis
GTDFEK

SEQ ID NO: 1779533 - protein, 5 aa, Staphylococcus epidermidis
GTDGG

SEQ ID NO: 1779534 - protein, 8 aa, Staphylococcus epidermidis
GTDGVGTK

SEQ ID NO: 1779535 - protein, 5 aa, Staphylococcus epidermidis
GTDPF

SEQ ID NO: 1779536 - protein, 12 aa, Staphylococcus epidermidis
GTDQNGNSYGRQ

SEQ ID NO: 1779537 - protein, 5 aa, Staphylococcus epidermidis
GTDSG

SEQ ID NO: 1779538 - protein, 10 aa, Staphylococcus epidermidis
GTDSKGSFPQ

SEQ ID NO: 1779539 - protein, 6 aa, Staphylococcus epidermidis
GTDSPY

SEQ ID NO: 1779540 - protein, 8 aa, Staphylococcus epidermidis
GTDVTTDK

SEQ ID NO: 1779541 - protein, 4 aa, Staphylococcus epidermidis
GTDW

SEQ ID NO: 1779542 - protein, 6 aa, Staphylococcus epidermidis
GTEAAS

SEQ ID NO: 1779543 - protein, 10 aa, Staphylococcus epidermidis
GTEDNPGAYT

SEQ ID NO: 1779544 - protein, 5 aa, Staphylococcus epidermidis
GTEGK

SEQ ID NO: 1779545 - protein, 10 aa, Staphylococcus epidermidis
GTEVKRGDDT

SEQ ID NO: 1779546 - protein, 14 aa, Staphylococcus epidermidis
GTGDLKDSSIGSKD

SEQ ID NO: 1779547 - protein, 14 aa, Staphylococcus epidermidis
GTGDLKGSSIGSKD

SEQ ID NO: 1779548 - protein, 14 aa, Staphylococcus epidermidis
GTGDLKGSSIGTKD

SEQ ID NO: 1779549 - protein, 10 aa, Staphylococcus epidermidis
GTGETVGTQL

SEQ ID NO: 1779550 - protein, 16 aa, Staphylococcus epidermidis
GTGKTTLSADAERKLI

SEQ ID NO: 1779551 - protein, 8 aa, Staphylococcus epidermidis
GTGMGLPE

SEQ ID NO: 1779552 - protein, 7 aa, Staphylococcus epidermidis
GTGPHQV

SEQ ID NO: 1779553 - protein, 5 aa, Staphylococcus epidermidis
GTGPL

SEQ ID NO: 1779554 - protein, 8 aa, Staphylococcus epidermidis
GTGPRYCP

SEQ ID NO: 1779555 - protein, 4 aa, Staphylococcus epidermidis
GTGR

SEQ ID NO: 1779556 - protein, 5 aa, Staphylococcus epidermidis
GTGSL

SEQ ID NO: 1779557 - protein, 7 aa, Staphylococcus epidermidis
GTGTDDA

SEQ ID NO: 1779558 - protein, 63 aa, Staphylococcus epidermidis
GTGTKKLSGSELKNCRTNNTDISNTDVSDTNISDTNDLNDTYEINKNTNYHSNHTNHEYTEFN

SEQ ID NO: 1779559 - protein, 16 aa, Staphylococcus epidermidis
GTGTKPADWGNEDVPS

SEQ ID NO: 1779560 - protein, 22 aa, Staphylococcus epidermidis
GTGTNNTQKSIQASKRAKDIGA

SEQ ID NO: 1779561 - protein, 12 aa, Staphylococcus epidermidis
GTGYAPKFTGET

SEQ ID NO: 1779562 - protein, 5 aa, Staphylococcus epidermidis
GTHAG

SEQ ID NO: 1779563 - protein, 5 aa, Staphylococcus epidermidis
GTHAS

SEQ ID NO: 1779564 - protein, 17 aa, Staphylococcus epidermidis
GTIKRGKDLEEDEKNSE

SEQ ID NO: 1779565 - protein, 28 aa, Staphylococcus epidermidis
GTIKRGQNKIEDENNEKTLMKDEKELSE

SEQ ID NO: 1779566 - protein, 5 aa, Staphylococcus epidermidis
GTISI

SEQ ID NO: 1779567 - protein, 4 aa, Staphylococcus epidermidis
GTIT

SEQ ID NO: 1779568 - protein, 7 aa, Staphylococcus epidermidis
GTKAYGS

SEQ ID NO: 1779569 - protein, 5 aa, Staphylococcus epidermidis
GTKKV

SEQ ID NO: 1779570 - protein, 7 aa, Staphylococcus epidermidis
GTKLQSG

SEQ ID NO: 1779571 - protein, 11 aa, Staphylococcus epidermidis
GTKRVDNENTY

SEQ ID NO: 1779572 - protein, 14 aa, Staphylococcus epidermidis
GTKTKNSKRDVEVN

SEQ ID NO: 1779573 - protein, 15 aa, Staphylococcus epidermidis
GTKTKNSKRDVEVNS

SEQ ID NO: 1779574 - protein, 16 aa, Staphylococcus epidermidis
GTKVDKHSTGGVGDTT

SEQ ID NO: 1779575 - protein, 12 aa, Staphylococcus epidermidis
GTKVSNSDTVEV

SEQ ID NO: 1779576 - protein, 4 aa, Staphylococcus epidermidis
GTLN

SEQ ID NO: 1779577 - protein, 24 aa, Staphylococcus epidermidis
GTLPQTVSSSSLITDEEKKYVEDN

SEQ ID NO: 1779578 - protein, 5 aa, Staphylococcus epidermidis
GTLRD

SEQ ID NO: 1779579 - protein, 11 aa, Staphylococcus epidermidis
GTMGQRWEEGK

SEQ ID NO: 1779580 - protein, 7 aa, Staphylococcus epidermidis
GTNAGGI

SEQ ID NO: 1779581 - protein, 7 aa, Staphylococcus epidermidis
GTNDMGE

SEQ ID NO: 1779582 - protein, 5 aa, Staphylococcus epidermidis
GTNNA

SEQ ID NO: 1779583 - protein, 6 aa, Staphylococcus epidermidis
GTNPEM

SEQ ID NO: 1779584 - protein, 9 aa, Staphylococcus epidermidis
GTNPSQSIT

SEQ ID NO: 1779585 - protein, 8 aa, Staphylococcus epidermidis
GTNSQQMH

SEQ ID NO: 1779586 - protein, 12 aa, Staphylococcus epidermidis
GTNVERGKEILN

SEQ ID NO: 1779587 - protein, 14 aa, Staphylococcus epidermidis
GTNVHGKQIKGYLL

SEQ ID NO: 1779588 - protein, 4 aa, Staphylococcus epidermidis
GTNY

SEQ ID NO: 1779589 - protein, 8 aa, Staphylococcus epidermidis
GTPEQSGH

SEQ ID NO: 1779590 - protein, 9 aa, Staphylococcus epidermidis
GTPGTDLSA

SEQ ID NO: 1779591 - protein, 7 aa, Staphylococcus epidermidis
GTPQELK

SEQ ID NO: 1779592 - protein, 12 aa, Staphylococcus epidermidis
GTPVASADKNTQ

SEQ ID NO: 1779593 - protein, 5 aa, Staphylococcus epidermidis
GTQDR

SEQ ID NO: 1779594 - protein, 14 aa, Staphylococcus epidermidis
GTQEDKPKELSEEQ

SEQ ID NO: 1779595 - protein, 6 aa, Staphylococcus epidermidis
GTQPLD

SEQ ID NO: 1779596 - protein, 8 aa, Staphylococcus epidermidis
GTQQYETL

SEQ ID NO: 1779597 - protein, 4 aa, Staphylococcus epidermidis
GTRP

SEQ ID NO: 1779598 - protein, 18 aa, Staphylococcus epidermidis
GTRRSGEALHTKNGKPSF

SEQ ID NO: 1779599 - protein, 13 aa, Staphylococcus epidermidis
GTRRTGQPLDTGN

SEQ ID NO: 1779600 - protein, 8 aa, Staphylococcus epidermidis
GTSATDVR

SEQ ID NO: 1779601 - protein, 18 aa, Staphylococcus epidermidis
GTSGGAQAATGITSNKSW

SEQ ID NO: 1779602 - protein, 16 aa, Staphylococcus epidermidis
GTSGNLDDDSNTSSFS

SEQ ID NO: 1779603 - protein, 8 aa, Staphylococcus epidermidis
GTSGVDPS

SEQ ID NO: 1779604 - protein, 15 aa, Staphylococcus epidermidis
GTSNAKLNDKPIDTQ

SEQ ID NO: 1779605 - protein, 9 aa, Staphylococcus epidermidis
GTSNKELNS

SEQ ID NO: 1779606 - protein, 10 aa, Staphylococcus epidermidis
GTSNYTTPFN

SEQ ID NO: 1779607 - protein, 4 aa, Staphylococcus epidermidis
GTTA

SEQ ID NO: 1779608 - protein, 17 aa, Staphylococcus epidermidis
GTTAESPTLTDEEKEQV

SEQ ID NO: 1779609 - protein, 15 aa, Staphylococcus epidermidis
GTTDGSNLLKDREDD

SEQ ID NO: 1779610 - protein, 10 aa, Staphylococcus epidermidis
GTTEAAHPGV

SEQ ID NO: 1779611 - protein, 11 aa, Staphylococcus epidermidis
GTTEGNRNNAL

SEQ ID NO: 1779612 - protein, 4 aa, Staphylococcus epidermidis
GTTI

SEQ ID NO: 1779613 - protein, 6 aa, Staphylococcus epidermidis
GTTIDR

SEQ ID NO: 1779614 - protein, 6 aa, Staphylococcus epidermidis
GTTKDD

SEQ ID NO: 1779615 - protein, 9 aa, Staphylococcus epidermidis
GTTSTRTLE

SEQ ID NO: 1779616 - protein, 11 aa, Staphylococcus epidermidis
GTTTTDASGHY

SEQ ID NO: 1779617 - protein, 9 aa, Staphylococcus epidermidis
GTTVSRASL

SEQ ID NO: 1779618 - protein, 6 aa, Staphylococcus epidermidis
GTVAAT

SEQ ID NO: 1779619 - protein, 6 aa, Staphylococcus epidermidis
GTVGGT

SEQ ID NO: 1779620 - protein, 6 aa, Staphylococcus epidermidis
GTVQNV

SEQ ID NO: 1779621 - protein, 4 aa, Staphylococcus epidermidis
GTWY

SEQ ID NO: 1779622 - protein, 13 aa, Staphylococcus epidermidis
GTYESNVKEVMGK

SEQ ID NO: 1779623 - protein, 6 aa, Staphylococcus epidermidis
GTYGDV

SEQ ID NO: 1779624 - protein, 7 aa, Staphylococcus epidermidis
GTYGDVD

SEQ ID NO: 1779625 - protein, 4 aa, Staphylococcus epidermidis
GTYL

SEQ ID NO: 1779626 - protein, 5 aa, Staphylococcus epidermidis
GTYSR

SEQ ID NO: 1779627 - protein, 4 aa, Staphylococcus epidermidis
GVAA

SEQ ID NO: 1779628 - protein, 14 aa, Staphylococcus epidermidis
GVAKDNLKEENVEA

SEQ ID NO: 1779629 - protein, 10 aa, Staphylococcus epidermidis
GVAKDQLQHE

SEQ ID NO: 1779630 - protein, 4 aa, Staphylococcus epidermidis
GVAN

SEQ ID NO: 1779631 - protein, 14 aa, Staphylococcus epidermidis
GVDANDSTSAPVED

SEQ ID NO: 1779632 - protein, 11 aa, Staphylococcus epidermidis
GVDDSKKLTDT

SEQ ID NO: 1779633 - protein, 9 aa, Staphylococcus epidermidis
GVDEKDLSI

SEQ ID NO: 1779634 - protein, 6 aa, Staphylococcus epidermidis
GVDKRE

SEQ ID NO: 1779635 - protein, 9 aa, Staphylococcus epidermidis
GVDNGAGRI

SEQ ID NO: 1779636 - protein, 5 aa, Staphylococcus epidermidis
GVDPS

SEQ ID NO: 1779637 - protein, 9 aa, Staphylococcus epidermidis
GVEATTEIK

SEQ ID NO: 1779638 - protein, 5 aa, Staphylococcus epidermidis
GVEKG

SEQ ID NO: 1779639 - protein, 18 aa, Staphylococcus epidermidis
GVELNKGRVGAKEGPNAI

SEQ ID NO: 1779640 - protein, 5 aa, Staphylococcus epidermidis
GVEPG

SEQ ID NO: 1779641 - protein, 6 aa, Staphylococcus epidermidis
GVEQER

SEQ ID NO: 1779642 - protein, 11 aa, Staphylococcus epidermidis
GVEVTTGPLGQ

SEQ ID NO: 1779643 - protein, 9 aa, Staphylococcus epidermidis
GVFTEEGGQ

SEQ ID NO: 1779644 - protein, 6 aa, Staphylococcus epidermidis
GVGKNG

SEQ ID NO: 1779645 - protein, 6 aa, Staphylococcus epidermidis
GVGKTS

SEQ ID NO: 1779646 - protein, 4 aa, Staphylococcus epidermidis
GVGY

SEQ ID NO: 1779647 - protein, 6 aa, Staphylococcus epidermidis
GVKEPL

SEQ ID NO: 1779648 - protein, 13 aa, Staphylococcus epidermidis
GVKKGPDSVEHGE

SEQ ID NO: 1779649 - protein, 12 aa, Staphylococcus epidermidis
GVKNGVPTPGFS

SEQ ID NO: 1779650 - protein, 6 aa, Staphylococcus epidermidis
GVNDDQ

SEQ ID NO: 1779651 - protein, 5 aa, Staphylococcus epidermidis
GVNDN

SEQ ID NO: 1779652 - protein, 9 aa, Staphylococcus epidermidis
GVNERKRHQ

SEQ ID NO: 1779653 - protein, 12 aa, Staphylococcus epidermidis
GVNNNKNHESIG

SEQ ID NO: 1779654 - protein, 10 aa, Staphylococcus epidermidis
GVNPNKYKNK

SEQ ID NO: 1779655 - protein, 4 aa, Staphylococcus epidermidis
GVPE

SEQ ID NO: 1779656 - protein, 17 aa, Staphylococcus epidermidis
GVPNYENSHPHQSTSGR

SEQ ID NO: 1779657 - protein, 33 aa, Staphylococcus epidermidis
GVPSWNKGKNFPSRGRSAETQFKKGQKPDNTFP

SEQ ID NO: 1779658 - protein, 33 aa, Staphylococcus epidermidis
GVPSWNKGKSFPSRGRSSETQFKKGQKPDNTFP

SEQ ID NO: 1779659 - protein, 7 aa, Staphylococcus epidermidis
GVQEGMK

SEQ ID NO: 1779660 - protein, 11 aa, Staphylococcus epidermidis
GVQPGSGNFET

SEQ ID NO: 1779661 - protein, 10 aa, Staphylococcus epidermidis
GVQQDANEVE

SEQ ID NO: 1779662 - protein, 4 aa, Staphylococcus epidermidis
GVQT

SEQ ID NO: 1779663 - protein, 5 aa, Staphylococcus epidermidis
GVRAE

SEQ ID NO: 1779664 - protein, 4 aa, Staphylococcus epidermidis
GVRD

SEQ ID NO: 1779665 - protein, 9 aa, Staphylococcus epidermidis
GVRPYTEKE

SEQ ID NO: 1779666 - protein, 10 aa, Staphylococcus epidermidis
GVSDPEQKRK

SEQ ID NO: 1779667 - protein, 9 aa, Staphylococcus epidermidis
GVSEPDVEN

SEQ ID NO: 1779668 - protein, 6 aa, Staphylococcus epidermidis
GVSKED

SEQ ID NO: 1779669 - protein, 11 aa, Staphylococcus epidermidis
GVSKGKGFQGA

SEQ ID NO: 1779670 - protein, 14 aa, Staphylococcus epidermidis
GVSKPTITRNKPEH

SEQ ID NO: 1779671 - protein, 10 aa, Staphylococcus epidermidis
GVSTRPGHEE

SEQ ID NO: 1779672 - protein, 17 aa, Staphylococcus epidermidis
GVSTYEDVQSKEIPPTY

SEQ ID NO: 1779673 - protein, 18 aa, Staphylococcus epidermidis
GVTAKGVGIKNNQLTATP

SEQ ID NO: 1779674 - protein, 6 aa, Staphylococcus epidermidis
GVTASS

SEQ ID NO: 1779675 - protein, 9 aa, Staphylococcus epidermidis
GVTDQELKD

SEQ ID NO: 1779676 - protein, 6 aa, Staphylococcus epidermidis
GVTKDV

SEQ ID NO: 1779677 - protein, 12 aa, Staphylococcus epidermidis
GVTSASAAVASL

SEQ ID NO: 1779678 - protein, 6 aa, Staphylococcus epidermidis
GVTSSS

SEQ ID NO: 1779679 - protein, 10 aa, Staphylococcus epidermidis
GVTTAGGYPI

SEQ ID NO: 1779680 - protein, 10 aa, Staphylococcus epidermidis
GWANKKPSLR

SEQ ID NO: 1779681 - protein, 13 aa, Staphylococcus epidermidis
GWEHESDGGYGKG

SEQ ID NO: 1779682 - protein, 4 aa, Staphylococcus epidermidis
GWPQ

SEQ ID NO: 1779683 - protein, 9 aa, Staphylococcus epidermidis
GYAYESDGD

SEQ ID NO: 1779684 - protein, 7 aa, Staphylococcus epidermidis
GYDTDNN

SEQ ID NO: 1779685 - protein, 5 aa, Staphylococcus epidermidis
GYEEA

SEQ ID NO: 1779686 - protein, 9 aa, Staphylococcus epidermidis
GYENPNDNV

SEQ ID NO: 1779687 - protein, 5 aa, Staphylococcus epidermidis
GYEQG

SEQ ID NO: 1779688 - protein, 17 aa, Staphylococcus epidermidis
GYEQRQIEGMSGGQKQR

SEQ ID NO: 1779689 - protein, 12 aa, Staphylococcus epidermidis
GYETDGGFAGEN

SEQ ID NO: 1779690 - protein, 10 aa, Staphylococcus epidermidis
GYGAGSKDFD

SEQ ID NO: 1779691 - protein, 12 aa, Staphylococcus epidermidis
GYGEDAMDASYE

SEQ ID NO: 1779692 - protein, 37 aa, Staphylococcus epidermidis
GYGKKKSKSETKNYKPIKPKDFSYSGNFNKKGTWSTE

SEQ ID NO: 1779693 - protein, 7 aa, Staphylococcus epidermidis
GYGNKEI

SEQ ID NO: 1779694 - protein, 13 aa, Staphylococcus epidermidis
GYGNNDTDREEGI

SEQ ID NO: 1779695 - protein, 11 aa, Staphylococcus epidermidis
GYGPTENTTFT

SEQ ID NO: 1779696 - protein, 5 aa, Staphylococcus epidermidis
GYGRN

SEQ ID NO: 1779697 - protein, 12 aa, Staphylococcus epidermidis
GYITPENATTEI

SEQ ID NO: 1779698 - protein, 4 aa, Staphylococcus epidermidis
GYKA

SEQ ID NO: 1779699 - protein, 5 aa, Staphylococcus epidermidis
GYKNT

SEQ ID NO: 1779700 - protein, 6 aa, Staphylococcus epidermidis
GYLDGD

SEQ ID NO: 1779701 - protein, 16 aa, Staphylococcus epidermidis
GYNDPGAVGNDTNERD

SEQ ID NO: 1779702 - protein, 10 aa, Staphylococcus epidermidis
GYPANTIDKN

SEQ ID NO: 1779703 - protein, 6 aa, Staphylococcus epidermidis
GYPGQP

SEQ ID NO: 1779704 - protein, 4 aa, Staphylococcus epidermidis
GYPI

SEQ ID NO: 1779705 - protein, 9 aa, Staphylococcus epidermidis
GYQHTHDSE

SEQ ID NO: 1779706 - protein, 5 aa, Staphylococcus epidermidis
GYQPE

SEQ ID NO: 1779707 - protein, 10 aa, Staphylococcus epidermidis
GYSDQDETRF

SEQ ID NO: 1779708 - protein, 13 aa, Staphylococcus epidermidis
GYSENLEAEAEQY

SEQ ID NO: 1779709 - protein, 8 aa, Staphylococcus epidermidis
GYSNEYDI

SEQ ID NO: 1779710 - protein, 10 aa, Staphylococcus epidermidis
GYSRDEANKL

SEQ ID NO: 1779711 - protein, 7 aa, Staphylococcus epidermidis
GYSTEEL

SEQ ID NO: 1779712 - protein, 5 aa, Staphylococcus epidermidis
GYTAH

SEQ ID NO: 1779713 - protein, 5 aa, Staphylococcus epidermidis
GYTAK

SEQ ID NO: 1779714 - protein, 21 aa, Staphylococcus epidermidis
GYTQDRQPGIEADMNPKPIAE

SEQ ID NO: 1779715 - protein, 13 aa, Staphylococcus epidermidis
GYTRNGKKYTPRG

SEQ ID NO: 1779716 - protein, 4 aa, Staphylococcus epidermidis
GYVS

SEQ ID NO: 1779717 - protein, 6 aa, Staphylococcus epidermidis
GYYGTT

SEQ ID NO: 1779718 - protein, 16 aa, Staphylococcus epidermidis
HAAKGITTDEQAQKAF

SEQ ID NO: 1779719 - protein, 10 aa, Staphylococcus epidermidis
HAALRNPKMA

SEQ ID NO: 1779720 - protein, 14 aa, Staphylococcus epidermidis
HAAQGMTEDEFSKK

SEQ ID NO: 1779721 - protein, 5 aa, Staphylococcus epidermidis
HAAQT

SEQ ID NO: 1779722 - protein, 5 aa, Staphylococcus epidermidis
HACGT

SEQ ID NO: 1779723 - protein, 7 aa, Staphylococcus epidermidis
HAEGEKC

SEQ ID NO: 1779724 - protein, 6 aa, Staphylococcus epidermidis
HAENEL

SEQ ID NO: 1779725 - protein, 6 aa, Staphylococcus epidermidis
HAESED

SEQ ID NO: 1779726 - protein, 6 aa, Staphylococcus epidermidis
HAKDFG

SEQ ID NO: 1779727 - protein, 46 aa, Staphylococcus epidermidis
HAKINNSNETGNQSNISHSKRSQYSTNESKNIDTQTSNSSTSNQNF

SEQ ID NO: 1779728 - protein, 5 aa, Staphylococcus epidermidis
HALSE

SEQ ID NO: 1779729 - protein, 16 aa, Staphylococcus epidermidis
HAPHAKEEKDQPMTQA

SEQ ID NO: 1779730 - protein, 8 aa, Staphylococcus epidermidis
HAPSNLKD

SEQ ID NO: 1779731 - protein, 9 aa, Staphylococcus epidermidis
HAQNDNSEK

SEQ ID NO: 1779732 - protein, 4 aa, Staphylococcus epidermidis
HAQQ

SEQ ID NO: 1779733 - protein, 8 aa, Staphylococcus epidermidis
HAQSGRAN

SEQ ID NO: 1779734 - protein, 6 aa, Staphylococcus epidermidis
HASDEA

SEQ ID NO: 1779735 - protein, 17 aa, Staphylococcus epidermidis
HASDISNDLTASGSTQL

SEQ ID NO: 1779736 - protein, 8 aa, Staphylococcus epidermidis
HASQLSAK

SEQ ID NO: 1779737 - protein, 9 aa, Staphylococcus epidermidis
HASTKSKRV

SEQ ID NO: 1779738 - protein, 5 aa, Staphylococcus epidermidis
HASTQ

SEQ ID NO: 1779739 - protein, 11 aa, Staphylococcus epidermidis
HATQLSASEMA

SEQ ID NO: 1779740 - protein, 12 aa, Staphylococcus epidermidis
HCSETEKNEIKE

SEQ ID NO: 1779741 - protein, 9 aa, Staphylococcus epidermidis
HDALKEGDA

SEQ ID NO: 1779742 - protein, 7 aa, Staphylococcus epidermidis
HDDLSSL

SEQ ID NO: 1779743 - protein, 4 aa, Staphylococcus epidermidis
HDDR

SEQ ID NO: 1779744 - protein, 4 aa, Staphylococcus epidermidis
HDEA

SEQ ID NO: 1779745 - protein, 10 aa, Staphylococcus epidermidis
HDEDDEDNIL

SEQ ID NO: 1779746 - protein, 10 aa, Staphylococcus epidermidis
HDEKENLTRD

SEQ ID NO: 1779747 - protein, 22 aa, Staphylococcus epidermidis
HDELDGSETVVSGASCTTNSLA

SEQ ID NO: 1779748 - protein, 6 aa, Staphylococcus epidermidis
HDERVE

SEQ ID NO: 1779749 - protein, 4 aa, Staphylococcus epidermidis
HDFD

SEQ ID NO: 1779750 - protein, 12 aa, Staphylococcus epidermidis
HDHENEMKAEEK

SEQ ID NO: 1779751 - protein, 4 aa, Staphylococcus epidermidis
HDID

SEQ ID NO: 1779752 - protein, 20 aa, Staphylococcus epidermidis
HDKIDKSDKMDNPDMEKPES

SEQ ID NO: 1779753 - protein, 25 aa, Staphylococcus epidermidis
HDMNSSSDEHVYETPSKQQDEQIQK

SEQ ID NO: 1779754 - protein, 11 aa, Staphylococcus epidermidis
HDNPKTSGFHK

SEQ ID NO: 1779755 - protein, 7 aa, Staphylococcus epidermidis
HDPLTSK

SEQ ID NO: 1779756 - protein, 6 aa, Staphylococcus epidermidis
HDQGAN

SEQ ID NO: 1779757 - protein, 12 aa, Staphylococcus epidermidis
HDQPRRVSTWGD

SEQ ID NO: 1779758 - protein, 10 aa, Staphylococcus epidermidis
HDSDLNINNE

SEQ ID NO: 1779759 - protein, 5 aa, Staphylococcus epidermidis
HDSFK

SEQ ID NO: 1779760 - protein, 9 aa, Staphylococcus epidermidis
HDVNQKDLS

SEQ ID NO: 1779761 - protein, 14 aa, Staphylococcus epidermidis
HDYKGKTSVTHDQD

SEQ ID NO: 1779762 - protein, 11 aa, Staphylococcus epidermidis
HEAKDKKIYET

SEQ ID NO: 1779763 - protein, 17 aa, Staphylococcus epidermidis
HEATGETHSGIAKYDGE

SEQ ID NO: 1779764 - protein, 5 aa, Staphylococcus epidermidis
HEDAQ

SEQ ID NO: 1779765 - protein, 6 aa, Staphylococcus epidermidis
HEDGIE

SEQ ID NO: 1779766 - protein, 5 aa, Staphylococcus epidermidis
HEDSK

SEQ ID NO: 1779767 - protein, 9 aa, Staphylococcus epidermidis
HEEADDTVT

SEQ ID NO: 1779768 - protein, 5 aa, Staphylococcus epidermidis
HEEAP

SEQ ID NO: 1779769 - protein, 5 aa, Staphylococcus epidermidis
HEEEN

SEQ ID NO: 1779770 - protein, 16 aa, Staphylococcus epidermidis
HEEGSMRSIDNGDTMS

SEQ ID NO: 1779771 - protein, 5 aa, Staphylococcus epidermidis
HEEKQ

SEQ ID NO: 1779772 - protein, 9 aa, Staphylococcus epidermidis
HEESGQLPL

SEQ ID NO: 1779773 - protein, 15 aa, Staphylococcus epidermidis
HEESPGETVELEGKK

SEQ ID NO: 1779774 - protein, 10 aa, Staphylococcus epidermidis
HEEVPDYQAS

SEQ ID NO: 1779775 - protein, 16 aa, Staphylococcus epidermidis
HEEVTETKNAKGKPEH

SEQ ID NO: 1779776 - protein, 21 aa, Staphylococcus epidermidis
HEEYSRAPVHEGAEENFGGAK

SEQ ID NO: 1779777 - protein, 5 aa, Staphylococcus epidermidis
HEGET

SEQ ID NO: 1779778 - protein, 4 aa, Staphylococcus epidermidis
HEGI

SEQ ID NO: 1779779 - protein, 5 aa, Staphylococcus epidermidis
HEGQS

SEQ ID NO: 1779780 - protein, 8 aa, Staphylococcus epidermidis
HEGTNSQV

SEQ ID NO: 1779781 - protein, 4 aa, Staphylococcus epidermidis
HEIR

SEQ ID NO: 1779782 - protein, 8 aa, Staphylococcus epidermidis
HEKADPTL

SEQ ID NO: 1779783 - protein, 14 aa, Staphylococcus epidermidis
HEKPAKAKKGTDIQ

SEQ ID NO: 1779784 - protein, 5 aa, Staphylococcus epidermidis
HEKTE

SEQ ID NO: 1779785 - protein, 12 aa, Staphylococcus epidermidis
HEKTSSEKEKTE

SEQ ID NO: 1779786 - protein, 7 aa, Staphylococcus epidermidis
HENGEDI

SEQ ID NO: 1779787 - protein, 7 aa, Staphylococcus epidermidis
HENMSEN

SEQ ID NO: 1779788 - protein, 4 aa, Staphylococcus epidermidis
HENP

SEQ ID NO: 1779789 - protein, 6 aa, Staphylococcus epidermidis
HENYQD

SEQ ID NO: 1779790 - protein, 4 aa, Staphylococcus epidermidis
HEPK

SEQ ID NO: 1779791 - protein, 9 aa, Staphylococcus epidermidis
HEPNHNLNK

SEQ ID NO: 1779792 - protein, 4 aa, Staphylococcus epidermidis
HEPV

SEQ ID NO: 1779793 - protein, 11 aa, Staphylococcus epidermidis
HEQAMAKKAEL

SEQ ID NO: 1779794 - protein, 5 aa, Staphylococcus epidermidis
HEQDK

SEQ ID NO: 1779795 - protein, 8 aa, Staphylococcus epidermidis
HEQEQPTY

SEQ ID NO: 1779796 - protein, 6 aa, Staphylococcus epidermidis
HEQTGR

SEQ ID NO: 1779797 - protein, 13 aa, Staphylococcus epidermidis
HERKDTVKNAEET

SEQ ID NO: 1779798 - protein, 4 aa, Staphylococcus epidermidis
HERY

SEQ ID NO: 1779799 - protein, 6 aa, Staphylococcus epidermidis
HESKGK

SEQ ID NO: 1779800 - protein, 7 aa, Staphylococcus epidermidis
HESNGVT

SEQ ID NO: 1779801 - protein, 13 aa, Staphylococcus epidermidis
HESQEKFSNSKIS

SEQ ID NO: 1779802 - protein, 9 aa, Staphylococcus epidermidis
HESTDRPKS

SEQ ID NO: 1779803 - protein, 8 aa, Staphylococcus epidermidis
HESTQSQV

SEQ ID NO: 1779804 - protein, 5 aa, Staphylococcus epidermidis
HETEG

SEQ ID NO: 1779805 - protein, 37 aa, Staphylococcus epidermidis
HETEIQNNFENKEINQDANTSTYFSQKQQKRQQRKLE

SEQ ID NO: 1779806 - protein, 5 aa, Staphylococcus epidermidis
HETTG

SEQ ID NO: 1779807 - protein, 6 aa, Staphylococcus epidermidis
HETTQK

SEQ ID NO: 1779808 - protein, 6 aa, Staphylococcus epidermidis
HEYEQS

SEQ ID NO: 1779809 - protein, 10 aa, Staphylococcus epidermidis
HEYESETYQE

SEQ ID NO: 1779810 - protein, 14 aa, Staphylococcus epidermidis
HEYQDVSSVNENTL

SEQ ID NO: 1779811 - protein, 7 aa, Staphylococcus epidermidis
HFDDKSE

SEQ ID NO: 1779812 - protein, 7 aa, Staphylococcus epidermidis
HFDGTPC

SEQ ID NO: 1779813 - protein, 5 aa, Staphylococcus epidermidis
HFDQK

SEQ ID NO: 1779814 - protein, 14 aa, Staphylococcus epidermidis
HFGSGAQDDEDEEK

SEQ ID NO: 1779815 - protein, 12 aa, Staphylococcus epidermidis
HFKNKKDLETIE

SEQ ID NO: 1779816 - protein, 16 aa, Staphylococcus epidermidis
HFKNRDKALALIDKKY

SEQ ID NO: 1779817 - protein, 7 aa, Staphylococcus epidermidis
HFNPSQG

SEQ ID NO: 1779818 - protein, 4 aa, Staphylococcus epidermidis
HFSN

SEQ ID NO: 1779819 - protein, 9 aa, Staphylococcus epidermidis
HFTKDNSVD

SEQ ID NO: 1779820 - protein, 8 aa, Staphylococcus epidermidis
HGAQDEAN

SEQ ID NO: 1779821 - protein, 5 aa, Staphylococcus epidermidis
HGDDE

SEQ ID NO: 1779822 - protein, 8 aa, Staphylococcus epidermidis
HGDQLKNT

SEQ ID NO: 1779823 - protein, 11 aa, Staphylococcus epidermidis
HGEGDPPDNAV

SEQ ID NO: 1779824 - protein, 8 aa, Staphylococcus epidermidis
HGESGMDG

SEQ ID NO: 1779825 - protein, 7 aa, Staphylococcus epidermidis
HGETGVE

SEQ ID NO: 1779826 - protein, 5 aa, Staphylococcus epidermidis
HGFTP

SEQ ID NO: 1779827 - protein, 10 aa, Staphylococcus epidermidis
HGGDVNTGGW

SEQ ID NO: 1779828 - protein, 15 aa, Staphylococcus epidermidis
HGGHEHHTPETEEYG

SEQ ID NO: 1779829 - protein, 8 aa, Staphylococcus epidermidis
HGGSATNI

SEQ ID NO: 1779830 - protein, 16 aa, Staphylococcus epidermidis
HGGTSPVNPENAPGDV

SEQ ID NO: 1779831 - protein, 5 aa, Staphylococcus epidermidis
HGHGK

SEQ ID NO: 1779832 - protein, 4 aa, Staphylococcus epidermidis
HGHP

SEQ ID NO: 1779833 - protein, 4 aa, Staphylococcus epidermidis
HGHQ

SEQ ID NO: 1779834 - protein, 23 aa, Staphylococcus epidermidis
HGKGAYSNDPGAVANGYNERDFN

SEQ ID NO: 1779835 - protein, 14 aa, Staphylococcus epidermidis
HGKGAYSNDPGVVN

SEQ ID NO: 1779836 - protein, 10 aa, Staphylococcus epidermidis
HGKGTENKTV

SEQ ID NO: 1779837 - protein, 12 aa, Staphylococcus epidermidis
HGKPSGIDTQTI

SEQ ID NO: 1779838 - protein, 8 aa, Staphylococcus epidermidis
HGKPSGQQ

SEQ ID NO: 1779839 - protein, 11 aa, Staphylococcus epidermidis
HGKRPTEEELQ

SEQ ID NO: 1779840 - protein, 8 aa, Staphylococcus epidermidis
HGMDPSLG

SEQ ID NO: 1779841 - protein, 15 aa, Staphylococcus epidermidis
HGNDPIADGTDHTRE

SEQ ID NO: 1779842 - protein, 5 aa, Staphylococcus epidermidis
HGNFN

SEQ ID NO: 1779843 - protein, 9 aa, Staphylococcus epidermidis
HGNTNTYPQ

SEQ ID NO: 1779844 - protein, 10 aa, Staphylococcus epidermidis
HGNVDNSSKL

SEQ ID NO: 1779845 - protein, 14 aa, Staphylococcus epidermidis
HGPGGRIAEFIEGI

SEQ ID NO: 1779846 - protein, 17 aa, Staphylococcus epidermidis
HGPSQGKTYKDENGRKV

SEQ ID NO: 1779847 - protein, 17 aa, Staphylococcus epidermidis
HGPYTTVDDEQLNPFLN

SEQ ID NO: 1779848 - protein, 8 aa, Staphylococcus epidermidis
HGQNPNRY

SEQ ID NO: 1779849 - protein, 12 aa, Staphylococcus epidermidis
HGSHEEHKGRID

SEQ ID NO: 1779850 - protein, 13 aa, Staphylococcus epidermidis
HGTCSNTRRSCVS

SEQ ID NO: 1779851 - protein, 7 aa, Staphylococcus epidermidis
HGTPTDK

SEQ ID NO: 1779852 - protein, 9 aa, Staphylococcus epidermidis
HGTSTPVGD

SEQ ID NO: 1779853 - protein, 12 aa, Staphylococcus epidermidis
HGVASDKRIEKG

SEQ ID NO: 1779854 - protein, 4 aa, Staphylococcus epidermidis
HGVD

SEQ ID NO: 1779855 - protein, 7 aa, Staphylococcus epidermidis
HGYENGG

SEQ ID NO: 1779856 - protein, 5 aa, Staphylococcus epidermidis
HGYIP

SEQ ID NO: 1779857 - protein, 9 aa, Staphylococcus epidermidis
HGYSDKPRH

SEQ ID NO: 1779858 - protein, 5 aa, Staphylococcus epidermidis
HHETV

SEQ ID NO: 1779859 - protein, 10 aa, Staphylococcus epidermidis
HHISGTQENN

SEQ ID NO: 1779860 - protein, 4 aa, Staphylococcus epidermidis
HHNS

SEQ ID NO: 1779861 - protein, 5 aa, Staphylococcus epidermidis
HHPKQ

SEQ ID NO: 1779862 - protein, 6 aa, Staphylococcus epidermidis
HHPNEY

SEQ ID NO: 1779863 - protein, 5 aa, Staphylococcus epidermidis
HHTEE

SEQ ID NO: 1779864 - protein, 9 aa, Staphylococcus epidermidis
HHTTGDSYH

SEQ ID NO: 1779865 - protein, 14 aa, Staphylococcus epidermidis
HIEENYSSYSEETK

SEQ ID NO: 1779866 - protein, 7 aa, Staphylococcus epidermidis
HIEQAGL

SEQ ID NO: 1779867 - protein, 14 aa, Staphylococcus epidermidis
HIGSPSEKLEPGQQ

SEQ ID NO: 1779868 - protein, 17 aa, Staphylococcus epidermidis
HIPKGDSKHLEEEAERY

SEQ ID NO: 1779869 - protein, 18 aa, Staphylococcus epidermidis
HITEHQKDQSANPKLNEE

SEQ ID NO: 1779870 - protein, 25 aa, Staphylococcus epidermidis
HKAQKNKQKRPFKPRNKHRQHRRKT

SEQ ID NO: 1779871 - protein, 8 aa, Staphylococcus epidermidis
HKDATHNC

SEQ ID NO: 1779872 - protein, 5 aa, Staphylococcus epidermidis
HKDDW

SEQ ID NO: 1779873 - protein, 7 aa, Staphylococcus epidermidis
HKDKAKA

SEQ ID NO: 1779874 - protein, 7 aa, Staphylococcus epidermidis
HKDKDYA

SEQ ID NO: 1779875 - protein, 14 aa, Staphylococcus epidermidis
HKDKLNGKPLTDRE

SEQ ID NO: 1779876 - protein, 13 aa, Staphylococcus epidermidis
HKDPVGEARRYAS

SEQ ID NO: 1779877 - protein, 5 aa, Staphylococcus epidermidis
HKDSD

SEQ ID NO: 1779878 - protein, 13 aa, Staphylococcus epidermidis
HKEGPLSEGTVSG

SEQ ID NO: 1779879 - protein, 14 aa, Staphylococcus epidermidis
HKEKLNGKPLTDRE

SEQ ID NO: 1779880 - protein, 4 aa, Staphylococcus epidermidis
HKFE

SEQ ID NO: 1779881 - protein, 9 aa, Staphylococcus epidermidis
HKGERSGEV

SEQ ID NO: 1779882 - protein, 5 aa, Staphylococcus epidermidis
HKGHQ

SEQ ID NO: 1779883 - protein, 7 aa, Staphylococcus epidermidis
HKGLNAE

SEQ ID NO: 1779884 - protein, 7 aa, Staphylococcus epidermidis
HKGNLTK

SEQ ID NO: 1779885 - protein, 7 aa, Staphylococcus epidermidis
HKHSELA

SEQ ID NO: 1779886 - protein, 8 aa, Staphylococcus epidermidis
HKIPRNSE

SEQ ID NO: 1779887 - protein, 7 aa, Staphylococcus epidermidis
HKISSSS

SEQ ID NO: 1779888 - protein, 13 aa, Staphylococcus epidermidis
HKKEQGARVRELF

SEQ ID NO: 1779889 - protein, 7 aa, Staphylococcus epidermidis
HKKTGRI

SEQ ID NO: 1779890 - protein, 12 aa, Staphylococcus epidermidis
HKLKDGKKLNKN

SEQ ID NO: 1779891 - protein, 8 aa, Staphylococcus epidermidis
HKLNENDK

SEQ ID NO: 1779892 - protein, 6 aa, Staphylococcus epidermidis
HKNGDL

SEQ ID NO: 1779893 - protein, 31 aa, Staphylococcus epidermidis
HKNGKVGKDGFYKQSQKRNVIANTKKTIKHA

SEQ ID NO: 1779894 - protein, 7 aa, Staphylococcus epidermidis
HKNGPNV

SEQ ID NO: 1779895 - protein, 9 aa, Staphylococcus epidermidis
HKPEKYTEK

SEQ ID NO: 1779896 - protein, 11 aa, Staphylococcus epidermidis
HKPNYNSVSHT

SEQ ID NO: 1779897 - protein, 4 aa, Staphylococcus epidermidis
HKPQ

SEQ ID NO: 1779898 - protein, 16 aa, Staphylococcus epidermidis
HKRAYDNDEGPNTGGM

SEQ ID NO: 1779899 - protein, 8 aa, Staphylococcus epidermidis
HKRKESNT

SEQ ID NO: 1779900 - protein, 8 aa, Staphylococcus epidermidis
HKRQSFEE

SEQ ID NO: 1779901 - protein, 9 aa, Staphylococcus epidermidis
HKSKYSPNK

SEQ ID NO: 1779902 - protein, 4 aa, Staphylococcus epidermidis
HKSN

SEQ ID NO: 1779903 - protein, 6 aa, Staphylococcus epidermidis
HKTATV

SEQ ID NO: 1779904 - protein, 10 aa, Staphylococcus epidermidis
HKTKDKYLRP

SEQ ID NO: 1779905 - protein, 7 aa, Staphylococcus epidermidis
HKTKTGA

SEQ ID NO: 1779906 - protein, 6 aa, Staphylococcus epidermidis
HKTNRN

SEQ ID NO: 1779907 - protein, 6 aa, Staphylococcus epidermidis
HKTQKE

SEQ ID NO: 1779908 - protein, 6 aa, Staphylococcus epidermidis
HKTSVD

SEQ ID NO: 1779909 - protein, 11 aa, Staphylococcus epidermidis
HKTTTTGISAN

SEQ ID NO: 1779910 - protein, 11 aa, Staphylococcus epidermidis
HKVDEGSYQPS

SEQ ID NO: 1779911 - protein, 6 aa, Staphylococcus epidermidis
HKYSAE

SEQ ID NO: 1779912 - protein, 12 aa, Staphylococcus epidermidis
HLDEADKEDALN

SEQ ID NO: 1779913 - protein, 16 aa, Staphylococcus epidermidis
HLDKSKYEAYPPLFFI

SEQ ID NO: 1779914 - protein, 8 aa, Staphylococcus epidermidis
HLEQPQKY

SEQ ID NO: 1779915 - protein, 6 aa, Staphylococcus epidermidis
HLPEGN

SEQ ID NO: 1779916 - protein, 4 aa, Staphylococcus epidermidis
HLSS

SEQ ID NO: 1779917 - protein, 6 aa, Staphylococcus epidermidis
HLTEDD

SEQ ID NO: 1779918 - protein, 9 aa, Staphylococcus epidermidis
HLTHGSPVN

SEQ ID NO: 1779919 - protein, 10 aa, Staphylococcus epidermidis
HMGGSEQKYI

SEQ ID NO: 1779920 - protein, 4 aa, Staphylococcus epidermidis
HMHP

SEQ ID NO: 1779921 - protein, 14 aa, Staphylococcus epidermidis
HMKTGNIYNIYHNI

SEQ ID NO: 1779922 - protein, 10 aa, Staphylococcus epidermidis
HNAEPEKAEE

SEQ ID NO: 1779923 - protein, 9 aa, Staphylococcus epidermidis
HNDEAQQPL

SEQ ID NO: 1779924 - protein, 13 aa, Staphylococcus epidermidis
HNEMDEPSITNPV

SEQ ID NO: 1779925 - protein, 6 aa, Staphylococcus epidermidis
HNEQHQ

SEQ ID NO: 1779926 - protein, 4 aa, Staphylococcus epidermidis
HNET

SEQ ID NO: 1779927 - protein, 20 aa, Staphylococcus epidermidis
HNGDGNNELKASHTSMDAQS

SEQ ID NO: 1779928 - protein, 16 aa, Staphylococcus epidermidis
HNGSKGGGSRAASAWR

SEQ ID NO: 1779929 - protein, 8 aa, Staphylococcus epidermidis
HNNKRRLS

SEQ ID NO: 1779930 - protein, 10 aa, Staphylococcus epidermidis
HNNKTIENKM

SEQ ID NO: 1779931 - protein, 17 aa, Staphylococcus epidermidis
HNNSNSSETLKTKVNEL

SEQ ID NO: 1779932 - protein, 8 aa, Staphylococcus epidermidis
HNNTTNLK

SEQ ID NO: 1779933 - protein, 8 aa, Staphylococcus epidermidis
HNPKNYNG

SEQ ID NO: 1779934 - protein, 6 aa, Staphylococcus epidermidis
HNPTED

SEQ ID NO: 1779935 - protein, 8 aa, Staphylococcus epidermidis
HNQNDESS

SEQ ID NO: 1779936 - protein, 6 aa, Staphylococcus epidermidis
HNREGY

SEQ ID NO: 1779937 - protein, 10 aa, Staphylococcus epidermidis
HNREHSGTIE

SEQ ID NO: 1779938 - protein, 11 aa, Staphylococcus epidermidis
HNSEGKAVEHK

SEQ ID NO: 1779939 - protein, 8 aa, Staphylococcus epidermidis
HNTDPTFQ

SEQ ID NO: 1779940 - protein, 6 aa, Staphylococcus epidermidis
HNTKEF

SEQ ID NO: 1779941 - protein, 10 aa, Staphylococcus epidermidis
HNVPGAEEYT

SEQ ID NO: 1779942 - protein, 8 aa, Staphylococcus epidermidis
HNVSNNKK

SEQ ID NO: 1779943 - protein, 5 aa, Staphylococcus epidermidis
HNVSS

SEQ ID NO: 1779944 - protein, 6 aa, Staphylococcus epidermidis
HPDEDH

SEQ ID NO: 1779945 - protein, 5 aa, Staphylococcus epidermidis
HPDET

SEQ ID NO: 1779946 - protein, 16 aa, Staphylococcus epidermidis
HPDKPNQCCDNDTDLK

SEQ ID NO: 1779947 - protein, 4 aa, Staphylococcus epidermidis
HPEG

SEQ ID NO: 1779948 - protein, 6 aa, Staphylococcus epidermidis
HPEQYQ

SEQ ID NO: 1779949 - protein, 8 aa, Staphylococcus epidermidis
HPGRGKKV

SEQ ID NO: 1779950 - protein, 4 aa, Staphylococcus epidermidis
HPHE

SEQ ID NO: 1779951 - protein, 5 aa, Staphylococcus epidermidis
HPINQ

SEQ ID NO: 1779952 - protein, 6 aa, Staphylococcus epidermidis
HPKAGE

SEQ ID NO: 1779953 - protein, 8 aa, Staphylococcus epidermidis
HPKDKQSL

SEQ ID NO: 1779954 - protein, 16 aa, Staphylococcus epidermidis
HPKKDIDAYNKRDALK

SEQ ID NO: 1779955 - protein, 13 aa, Staphylococcus epidermidis
HPKKDTKAYKSRD

SEQ ID NO: 1779956 - protein, 7 aa, Staphylococcus epidermidis
HPKLEQD

SEQ ID NO: 1779957 - protein, 14 aa, Staphylococcus epidermidis
HPKQGDLHNPNETE

SEQ ID NO: 1779958 - protein, 16 aa, Staphylococcus epidermidis
HPKTEELKRFLNVINE

SEQ ID NO: 1779959 - protein, 13 aa, Staphylococcus epidermidis
HPLPKSDNNYKHI

SEQ ID NO: 1779960 - protein, 5 aa, Staphylococcus epidermidis
HPNAT

SEQ ID NO: 1779961 - protein, 5 aa, Staphylococcus epidermidis
HPNDD

SEQ ID NO: 1779962 - protein, 11 aa, Staphylococcus epidermidis
HPNEPKPAIKA

SEQ ID NO: 1779963 - protein, 5 aa, Staphylococcus epidermidis
HPNNH

SEQ ID NO: 1779964 - protein, 5 aa, Staphylococcus epidermidis
HPNPL

SEQ ID NO: 1779965 - protein, 4 aa, Staphylococcus epidermidis
HPPQ

SEQ ID NO: 1779966 - protein, 7 aa, Staphylococcus epidermidis
HPPTPFE

SEQ ID NO: 1779967 - protein, 5 aa, Staphylococcus epidermidis
HPQNN

SEQ ID NO: 1779968 - protein, 7 aa, Staphylococcus epidermidis
HPQNPKL

SEQ ID NO: 1779969 - protein, 16 aa, Staphylococcus epidermidis
HPQSPKQCCDQDSSLE

SEQ ID NO: 1779970 - protein, 15 aa, Staphylococcus epidermidis
HPQSPKQCCEQDSRL

SEQ ID NO: 1779971 - protein, 8 aa, Staphylococcus epidermidis
HPSEETIK

SEQ ID NO: 1779972 - protein, 4 aa, Staphylococcus epidermidis
HPSM

SEQ ID NO: 1779973 - protein, 5 aa, Staphylococcus epidermidis
HPSNT

SEQ ID NO: 1779974 - protein, 8 aa, Staphylococcus epidermidis
HPTLREKA

SEQ ID NO: 1779975 - protein, 5 aa, Staphylococcus epidermidis
HPTNH

SEQ ID NO: 1779976 - protein, 6 aa, Staphylococcus epidermidis
HPYEGK

SEQ ID NO: 1779977 - protein, 10 aa, Staphylococcus epidermidis
HPYRDEEQQA

SEQ ID NO: 1779978 - protein, 9 aa, Staphylococcus epidermidis
HQDEINNND

SEQ ID NO: 1779979 - protein, 4 aa, Staphylococcus epidermidis
HQEG

SEQ ID NO: 1779980 - protein, 11 aa, Staphylococcus epidermidis
HQENEDSLAQD

SEQ ID NO: 1779981 - protein, 12 aa, Staphylococcus epidermidis
HQENENSQAQDK

SEQ ID NO: 1779982 - protein, 6 aa, Staphylococcus epidermidis
HQEPRL

SEQ ID NO: 1779983 - protein, 5 aa, Staphylococcus epidermidis
HQGRL

SEQ ID NO: 1779984 - protein, 7 aa, Staphylococcus epidermidis
HQHEAPN

SEQ ID NO: 1779985 - protein, 8 aa, Staphylococcus epidermidis
HQHEAPNY

SEQ ID NO: 1779986 - protein, 10 aa, Staphylococcus epidermidis
HQHEAPNYEG

SEQ ID NO: 1779987 - protein, 5 aa, Staphylococcus epidermidis
HQHPD

SEQ ID NO: 1779988 - protein, 4 aa, Staphylococcus epidermidis
HQIK

SEQ ID NO: 1779989 - protein, 6 aa, Staphylococcus epidermidis
HQKDEL

SEQ ID NO: 1779990 - protein, 11 aa, Staphylococcus epidermidis
HQKDTSNQSID

SEQ ID NO: 1779991 - protein, 8 aa, Staphylococcus epidermidis
HQKENASL

SEQ ID NO: 1779992 - protein, 16 aa, Staphylococcus epidermidis
HQKRNNFKGERKKVQE

SEQ ID NO: 1779993 - protein, 7 aa, Staphylococcus epidermidis
HQLPGES

SEQ ID NO: 1779994 - protein, 9 aa, Staphylococcus epidermidis
HQLQDSKKP

SEQ ID NO: 1779995 - protein, 6 aa, Staphylococcus epidermidis
HQLSGG

SEQ ID NO: 1779996 - protein, 5 aa, Staphylococcus epidermidis
HQMET

SEQ ID NO: 1779997 - protein, 19 aa, Staphylococcus epidermidis
HQMPSNTYPTFQDEPSKQQ

SEQ ID NO: 1779998 - protein, 5 aa, Staphylococcus epidermidis
HQNSD

SEQ ID NO: 1779999 - protein, 16 aa, Staphylococcus epidermidis
HQQQTSAKDVYAGGDA

SEQ ID NO: 1780000 - protein, 4 aa, Staphylococcus epidermidis
HQQY

SEQ ID NO: 1780001 - protein, 9 aa, Staphylococcus epidermidis
HQRGGKKYS

SEQ ID NO: 1780002 - protein, 5 aa, Staphylococcus epidermidis
HQSGT

SEQ ID NO: 1780003 - protein, 9 aa, Staphylococcus epidermidis
HQSKENPFN

SEQ ID NO: 1780004 - protein, 13 aa, Staphylococcus epidermidis
HQSNQGAARSRNV

SEQ ID NO: 1780005 - protein, 9 aa, Staphylococcus epidermidis
HQSQASGHT

SEQ ID NO: 1780006 - protein, 12 aa, Staphylococcus epidermidis
HQSRTDEPTHKN

SEQ ID NO: 1780007 - protein, 9 aa, Staphylococcus epidermidis
HQTDEPTIE

SEQ ID NO: 1780008 - protein, 7 aa, Staphylococcus epidermidis
HQTESPR

SEQ ID NO: 1780009 - protein, 21 aa, Staphylococcus epidermidis
HQTHKTNDEKKDRHAKDTTND

SEQ ID NO: 1780010 - protein, 7 aa, Staphylococcus epidermidis
HQTTQET

SEQ ID NO: 1780011 - protein, 6 aa, Staphylococcus epidermidis
HQTTSD

SEQ ID NO: 1780012 - protein, 6 aa, Staphylococcus epidermidis
HQTYQT

SEQ ID NO: 1780013 - protein, 12 aa, Staphylococcus epidermidis
HQVDEGSFQPSR

SEQ ID NO: 1780014 - protein, 40 aa, Staphylococcus epidermidis
HQVTHTPKNSMVKSEGKHVSSSQSHGSNSVHYQEDPNLTK

SEQ ID NO: 1780015 - protein, 10 aa, Staphylococcus epidermidis
HRAHTETKHH

SEQ ID NO: 1780016 - protein, 7 aa, Staphylococcus epidermidis
HRAQSKD

SEQ ID NO: 1780017 - protein, 6 aa, Staphylococcus epidermidis
HRDYSS

SEQ ID NO: 1780018 - protein, 6 aa, Staphylococcus epidermidis
HREDYA

SEQ ID NO: 1780019 - protein, 4 aa, Staphylococcus epidermidis
HREK

SEQ ID NO: 1780020 - protein, 4 aa, Staphylococcus epidermidis
HREL

SEQ ID NO: 1780021 - protein, 19 aa, Staphylococcus epidermidis
HRENELNCEKQEKKDISKL

SEQ ID NO: 1780022 - protein, 9 aa, Staphylococcus epidermidis
HRESTEDYV

SEQ ID NO: 1780023 - protein, 9 aa, Staphylococcus epidermidis
HRGERSGEV

SEQ ID NO: 1780024 - protein, 8 aa, Staphylococcus epidermidis
HRGGYHNG

SEQ ID NO: 1780025 - protein, 13 aa, Staphylococcus epidermidis
HRGHGKDIDEVER

SEQ ID NO: 1780026 - protein, 7 aa, Staphylococcus epidermidis
HRKGTHE

SEQ ID NO: 1780027 - protein, 10 aa, Staphylococcus epidermidis
HRKRPATAKP

SEQ ID NO: 1780028 - protein, 12 aa, Staphylococcus epidermidis
HRPADKPLKGYK

SEQ ID NO: 1780029 - protein, 6 aa, Staphylococcus epidermidis
HRQGQT

SEQ ID NO: 1780030 - protein, 10 aa, Staphylococcus epidermidis
HRRDKEGYAQ

SEQ ID NO: 1780031 - protein, 9 aa, Staphylococcus epidermidis
HRRQSPKEV

SEQ ID NO: 1780032 - protein, 9 aa, Staphylococcus epidermidis
HRRQSSQDV

SEQ ID NO: 1780033 - protein, 5 aa, Staphylococcus epidermidis
HRSNT

SEQ ID NO: 1780034 - protein, 11 aa, Staphylococcus epidermidis
HRTKTEKANEL

SEQ ID NO: 1780035 - protein, 5 aa, Staphylococcus epidermidis
HRVTD

SEQ ID NO: 1780036 - protein, 5 aa, Staphylococcus epidermidis
HRYSA

SEQ ID NO: 1780037 - protein, 21 aa, Staphylococcus epidermidis
HSAHQDSRKGVQKALDSRKKQ

SEQ ID NO: 1780038 - protein, 7 aa, Staphylococcus epidermidis
HSDRQEE

SEQ ID NO: 1780039 - protein, 8 aa, Staphylococcus epidermidis
HSEDEAKS

SEQ ID NO: 1780040 - protein, 4 aa, Staphylococcus epidermidis
HSEN

SEQ ID NO: 1780041 - protein, 6 aa, Staphylococcus epidermidis
HSESPE

SEQ ID NO: 1780042 - protein, 15 aa, Staphylococcus epidermidis
HSESRTHVMSEFKAL

SEQ ID NO: 1780043 - protein, 8 aa, Staphylococcus epidermidis
HSITSPEY

SEQ ID NO: 1780044 - protein, 12 aa, Staphylococcus epidermidis
HSKGLNKYNDVK

SEQ ID NO: 1780045 - protein, 10 aa, Staphylococcus epidermidis
HSKKNDSFNN

SEQ ID NO: 1780046 - protein, 8 aa, Staphylococcus epidermidis
HSLEGAKE

SEQ ID NO: 1780047 - protein, 8 aa, Staphylococcus epidermidis
HSNAQKGI

SEQ ID NO: 1780048 - protein, 5 aa, Staphylococcus epidermidis
HSNDF

SEQ ID NO: 1780049 - protein, 20 aa, Staphylococcus epidermidis
HSNHQSKTSDTLSKQEEARY

SEQ ID NO: 1780050 - protein, 8 aa, Staphylococcus epidermidis
HSNQEGLR

SEQ ID NO: 1780051 - protein, 19 aa, Staphylococcus epidermidis
HSNVPNDIYTKGTPSQIDE

SEQ ID NO: 1780052 - protein, 4 aa, Staphylococcus epidermidis
HSPI

SEQ ID NO: 1780053 - protein, 7 aa, Staphylococcus epidermidis
HSPPTRN

SEQ ID NO: 1780054 - protein, 4 aa, Staphylococcus epidermidis
HSPT

SEQ ID NO: 1780055 - protein, 5 aa, Staphylococcus epidermidis
HSPVT

SEQ ID NO: 1780056 - protein, 4 aa, Staphylococcus epidermidis
HSQA

SEQ ID NO: 1780057 - protein, 5 aa, Staphylococcus epidermidis
HSQED

SEQ ID NO: 1780058 - protein, 4 aa, Staphylococcus epidermidis
HSQF

SEQ ID NO: 1780059 - protein, 4 aa, Staphylococcus epidermidis
HSQN

SEQ ID NO: 1780060 - protein, 5 aa, Staphylococcus epidermidis
HSQQH

SEQ ID NO: 1780061 - protein, 5 aa, Staphylococcus epidermidis
HSQQS

SEQ ID NO: 1780062 - protein, 4 aa, Staphylococcus epidermidis
HSRF

SEQ ID NO: 1780063 - protein, 11 aa, Staphylococcus epidermidis
HSRKSGRVPSN

SEQ ID NO: 1780064 - protein, 10 aa, Staphylococcus epidermidis
HSSKPVGKAL

SEQ ID NO: 1780065 - protein, 8 aa, Staphylococcus epidermidis
HSSQPEEI

SEQ ID NO: 1780066 - protein, 8 aa, Staphylococcus epidermidis
HSTEETQQ

SEQ ID NO: 1780067 - protein, 8 aa, Staphylococcus epidermidis
HSTENARG

SEQ ID NO: 1780068 - protein, 8 aa, Staphylococcus epidermidis
HSTKNEHA

SEQ ID NO: 1780069 - protein, 6 aa, Staphylococcus epidermidis
HSTVTG

SEQ ID NO: 1780070 - protein, 6 aa, Staphylococcus epidermidis
HTAETN

SEQ ID NO: 1780071 - protein, 5 aa, Staphylococcus epidermidis
HTANI

SEQ ID NO: 1780072 - protein, 14 aa, Staphylococcus epidermidis
HTDDEAKLNEAKER

SEQ ID NO: 1780073 - protein, 13 aa, Staphylococcus epidermidis
HTDDEEKADEDGF

SEQ ID NO: 1780074 - protein, 8 aa, Staphylococcus epidermidis
HTDTKKDR

SEQ ID NO: 1780075 - protein, 6 aa, Staphylococcus epidermidis
HTEEID

SEQ ID NO: 1780076 - protein, 5 aa, Staphylococcus epidermidis
HTFGG

SEQ ID NO: 1780077 - protein, 23 aa, Staphylococcus epidermidis
HTFSSANQKESQSTSHKSEVTAA

SEQ ID NO: 1780078 - protein, 4 aa, Staphylococcus epidermidis
HTGA

SEQ ID NO: 1780079 - protein, 10 aa, Staphylococcus epidermidis
HTINSKEHDV

SEQ ID NO: 1780080 - protein, 6 aa, Staphylococcus epidermidis
HTKNKD

SEQ ID NO: 1780081 - protein, 5 aa, Staphylococcus epidermidis
HTKQG

SEQ ID NO: 1780082 - protein, 4 aa, Staphylococcus epidermidis
HTKT

SEQ ID NO: 1780083 - protein, 8 aa, Staphylococcus epidermidis
HTKTRQAL

SEQ ID NO: 1780084 - protein, 5 aa, Staphylococcus epidermidis
HTLKK

SEQ ID NO: 1780085 - protein, 24 aa, Staphylococcus epidermidis
HTMAGDDPTRYRTSDEDAEWEKKD

SEQ ID NO: 1780086 - protein, 4 aa, Staphylococcus epidermidis
HTMR

SEQ ID NO: 1780087 - protein, 7 aa, Staphylococcus epidermidis
HTNARIE

SEQ ID NO: 1780088 - protein, 7 aa, Staphylococcus epidermidis
HTNGHGK

SEQ ID NO: 1780089 - protein, 14 aa, Staphylococcus epidermidis
HTNHSNHYNPNFND

SEQ ID NO: 1780090 - protein, 11 aa, Staphylococcus epidermidis
HTNKKNRTRNN

SEQ ID NO: 1780091 - protein, 8 aa, Staphylococcus epidermidis
HTNVPNGN

SEQ ID NO: 1780092 - protein, 12 aa, Staphylococcus epidermidis
HTPEIGRGRGPV

SEQ ID NO: 1780093 - protein, 7 aa, Staphylococcus epidermidis
HTPSQDA

SEQ ID NO: 1780094 - protein, 18 aa, Staphylococcus epidermidis
HTPTGGSNNNGIEIDDGS

SEQ ID NO: 1780095 - protein, 9 aa, Staphylococcus epidermidis
HTPTKKEFK

SEQ ID NO: 1780096 - protein, 7 aa, Staphylococcus epidermidis
HTPYDQS

SEQ ID NO: 1780097 - protein, 7 aa, Staphylococcus epidermidis
HTQQGSN

SEQ ID NO: 1780098 - protein, 5 aa, Staphylococcus epidermidis
HTQQS

SEQ ID NO: 1780099 - protein, 12 aa, Staphylococcus epidermidis
HTQTGSQLAEER

SEQ ID NO: 1780100 - protein, 5 aa, Staphylococcus epidermidis
HTRKQ

SEQ ID NO: 1780101 - protein, 6 aa, Staphylococcus epidermidis
HTRSLK

SEQ ID NO: 1780102 - protein, 5 aa, Staphylococcus epidermidis
HTRVQ

SEQ ID NO: 1780103 - protein, 6 aa, Staphylococcus epidermidis
HTSEDN

SEQ ID NO: 1780104 - protein, 6 aa, Staphylococcus epidermidis
HTSGHV

SEQ ID NO: 1780105 - protein, 13 aa, Staphylococcus epidermidis
HTSNKIAEIIKED

SEQ ID NO: 1780106 - protein, 6 aa, Staphylococcus epidermidis
HTTEQS

SEQ ID NO: 1780107 - protein, 22 aa, Staphylococcus epidermidis
HTTINKSYNDFSDDNDIVNSTY

SEQ ID NO: 1780108 - protein, 6 aa, Staphylococcus epidermidis
HTTQVE

SEQ ID NO: 1780109 - protein, 9 aa, Staphylococcus epidermidis
HTTSERIST

SEQ ID NO: 1780110 - protein, 6 aa, Staphylococcus epidermidis
HTTTHG

SEQ ID NO: 1780111 - protein, 15 aa, Staphylococcus epidermidis
HTTTNIARLLQVKIE

SEQ ID NO: 1780112 - protein, 5 aa, Staphylococcus epidermidis
HTTVQ

SEQ ID NO: 1780113 - protein, 6 aa, Staphylococcus epidermidis
HTVKPE

SEQ ID NO: 1780114 - protein, 17 aa, Staphylococcus epidermidis
HTVREDDRLELLEIVGG

SEQ ID NO: 1780115 - protein, 17 aa, Staphylococcus epidermidis
HTVSQDDVKKWSAEDEY

SEQ ID NO: 1780116 - protein, 5 aa, Staphylococcus epidermidis
HTWDD

SEQ ID NO: 1780117 - protein, 4 aa, Staphylococcus epidermidis
HTYE

SEQ ID NO: 1780118 - protein, 9 aa, Staphylococcus epidermidis
HTYVPPAQR

SEQ ID NO: 1780119 - protein, 8 aa, Staphylococcus epidermidis
HVDGNDPI

SEQ ID NO: 1780120 - protein, 4 aa, Staphylococcus epidermidis
HVEE

SEQ ID NO: 1780121 - protein, 11 aa, Staphylococcus epidermidis
HVPRPPAMKET

SEQ ID NO: 1780122 - protein, 8 aa, Staphylococcus epidermidis
HVQSPEEV

SEQ ID NO: 1780123 - protein, 4 aa, Staphylococcus epidermidis
HVRR

SEQ ID NO: 1780124 - protein, 8 aa, Staphylococcus epidermidis
HVSPGEHL

SEQ ID NO: 1780125 - protein, 12 aa, Staphylococcus epidermidis
HVTSPKSIQTAS

SEQ ID NO: 1780126 - protein, 7 aa, Staphylococcus epidermidis
HYDDSKD

SEQ ID NO: 1780127 - protein, 13 aa, Staphylococcus epidermidis
HYDSGQIADKSNL

SEQ ID NO: 1780128 - protein, 8 aa, Staphylococcus epidermidis
HYESSTKL

SEQ ID NO: 1780129 - protein, 5 aa, Staphylococcus epidermidis
HYGED

SEQ ID NO: 1780130 - protein, 6 aa, Staphylococcus epidermidis
HYGNPS

SEQ ID NO: 1780131 - protein, 7 aa, Staphylococcus epidermidis
HYNKRTS

SEQ ID NO: 1780132 - protein, 4 aa, Staphylococcus epidermidis
HYNN

SEQ ID NO: 1780133 - protein, 7 aa, Staphylococcus epidermidis
HYQRTYD

SEQ ID NO: 1780134 - protein, 12 aa, Staphylococcus epidermidis
HYQRTYEEETYK

SEQ ID NO: 1780135 - protein, 6 aa, Staphylococcus epidermidis
HYRNPN

SEQ ID NO: 1780136 - protein, 24 aa, Staphylococcus epidermidis
HYRNRNRDQNRSHYRNRNRDQNRS

SEQ ID NO: 1780137 - protein, 10 aa, Staphylococcus epidermidis
HYSEHKGKPF

SEQ ID NO: 1780138 - protein, 4 aa, Staphylococcus epidermidis
HYSP

SEQ ID NO: 1780139 - protein, 7 aa, Staphylococcus epidermidis
HYSPDTP

SEQ ID NO: 1780140 - protein, 6 aa, Staphylococcus epidermidis
IAAGDN

SEQ ID NO: 1780141 - protein, 16 aa, Staphylococcus epidermidis
IAAPSANLSGRPSPTT

SEQ ID NO: 1780142 - protein, 12 aa, Staphylococcus epidermidis
IADEKVNEFSTQ

SEQ ID NO: 1780143 - protein, 12 aa, Staphylococcus epidermidis
IADNEKIAETPK

SEQ ID NO: 1780144 - protein, 11 aa, Staphylococcus epidermidis
IADPYGAPAEV

SEQ ID NO: 1780145 - protein, 6 aa, Staphylococcus epidermidis
IADSKQ

SEQ ID NO: 1780146 - protein, 13 aa, Staphylococcus epidermidis
IADYTSPREDWLY

SEQ ID NO: 1780147 - protein, 4 aa, Staphylococcus epidermidis
IAEA

SEQ ID NO: 1780148 - protein, 5 aa, Staphylococcus epidermidis
IAEDK

SEQ ID NO: 1780149 - protein, 11 aa, Staphylococcus epidermidis
IAEKENKKQRI

SEQ ID NO: 1780150 - protein, 9 aa, Staphylococcus epidermidis
IAENFGKAK

SEQ ID NO: 1780151 - protein, 7 aa, Staphylococcus epidermidis
IAESDQQ

SEQ ID NO: 1780152 - protein, 13 aa, Staphylococcus epidermidis
IAGAGSAQVGKGV

SEQ ID NO: 1780153 - protein, 4 aa, Staphylococcus epidermidis
IAGC

SEQ ID NO: 1780154 - protein, 9 aa, Staphylococcus epidermidis
IAGGDKKVN

SEQ ID NO: 1780155 - protein, 4 aa, Staphylococcus epidermidis
IAGS

SEQ ID NO: 1780156 - protein, 13 aa, Staphylococcus epidermidis
IAKHSKSSYNSAK

SEQ ID NO: 1780157 - protein, 18 aa, Staphylococcus epidermidis
IAKNVSKNYAEPASGPFN

SEQ ID NO: 1780158 - protein, 10 aa, Staphylococcus epidermidis
IAKPDDSAEF

SEQ ID NO: 1780159 - protein, 6 aa, Staphylococcus epidermidis
IAKTSM

SEQ ID NO: 1780160 - protein, 21 aa, Staphylococcus epidermidis
IANADDPKAAAKQCRDIIDGN

SEQ ID NO: 1780161 - protein, 20 aa, Staphylococcus epidermidis
IANADDPVEAAKQCRDAIEG

SEQ ID NO: 1780162 - protein, 20 aa, Staphylococcus epidermidis
IANADDPVEAAKQCRVAIEG

SEQ ID NO: 1780163 - protein, 6 aa, Staphylococcus epidermidis
IANEQG

SEQ ID NO: 1780164 - protein, 15 aa, Staphylococcus epidermidis
IANETTFSNNEDGIG

SEQ ID NO: 1780165 - protein, 15 aa, Staphylococcus epidermidis
IANKQITTLQKNAKD

SEQ ID NO: 1780166 - protein, 11 aa, Staphylococcus epidermidis
IANNPPSLDVT

SEQ ID NO: 1780167 - protein, 18 aa, Staphylococcus epidermidis
IANNTKRHKSVSKLSSQP

SEQ ID NO: 1780168 - protein, 6 aa, Staphylococcus epidermidis
IANPHR

SEQ ID NO: 1780169 - protein, 7 aa, Staphylococcus epidermidis
IANSDTL

SEQ ID NO: 1780170 - protein, 16 aa, Staphylococcus epidermidis
IANSGYTSRRKAETLI

SEQ ID NO: 1780171 - protein, 6 aa, Staphylococcus epidermidis
IANTKE

SEQ ID NO: 1780172 - protein, 6 aa, Staphylococcus epidermidis
IAPAVK

SEQ ID NO: 1780173 - protein, 9 aa, Staphylococcus epidermidis
IAPGNDEKR

SEQ ID NO: 1780174 - protein, 7 aa, Staphylococcus epidermidis
IAPMPQG

SEQ ID NO: 1780175 - protein, 8 aa, Staphylococcus epidermidis
IAPNLEAG

SEQ ID NO: 1780176 - protein, 6 aa, Staphylococcus epidermidis
IAQKTA

SEQ ID NO: 1780177 - protein, 8 aa, Staphylococcus epidermidis
IARDNKSI

SEQ ID NO: 1780178 - protein, 11 aa, Staphylococcus epidermidis
IARGQGVGRGS

SEQ ID NO: 1780179 - protein, 12 aa, Staphylococcus epidermidis
IARKTKEEYQFD

SEQ ID NO: 1780180 - protein, 8 aa, Staphylococcus epidermidis
IARNNSKD

SEQ ID NO: 1780181 - protein, 7 aa, Staphylococcus epidermidis
IARPAAT

SEQ ID NO: 1780182 - protein, 15 aa, Staphylococcus epidermidis
IARSSLTSMTQNDSE

SEQ ID NO: 1780183 - protein, 8 aa, Staphylococcus epidermidis
IASDDDVI

SEQ ID NO: 1780184 - protein, 8 aa, Staphylococcus epidermidis
IASENGGN

SEQ ID NO: 1780185 - protein, 5 aa, Staphylococcus epidermidis
IASEQ

SEQ ID NO: 1780186 - protein, 6 aa, Staphylococcus epidermidis
IASSTG

SEQ ID NO: 1780187 - protein, 5 aa, Staphylococcus epidermidis
IATDD

SEQ ID NO: 1780188 - protein, 7 aa, Staphylococcus epidermidis
IATEGAE

SEQ ID NO: 1780189 - protein, 11 aa, Staphylococcus epidermidis
IATGSSSEVLG

SEQ ID NO: 1780190 - protein, 7 aa, Staphylococcus epidermidis
IATKGSH

SEQ ID NO: 1780191 - protein, 8 aa, Staphylococcus epidermidis
IATREADG

SEQ ID NO: 1780192 - protein, 8 aa, Staphylococcus epidermidis
IATTEEVD

SEQ ID NO: 1780193 - protein, 12 aa, Staphylococcus epidermidis
ICSEAGEKEYKE

SEQ ID NO: 1780194 - protein, 7 aa, Staphylococcus epidermidis
IDAANEL

SEQ ID NO: 1780195 - protein, 8 aa, Staphylococcus epidermidis
IDAESTEI

SEQ ID NO: 1780196 - protein, 6 aa, Staphylococcus epidermidis
IDAGFQ

SEQ ID NO: 1780197 - protein, 17 aa, Staphylococcus epidermidis
IDDETKQKIATQIQAQM

SEQ ID NO: 1780198 - protein, 16 aa, Staphylococcus epidermidis
IDDETKTKNSNTNSST

SEQ ID NO: 1780199 - protein, 13 aa, Staphylococcus epidermidis
IDDFSEKKPRTRI

SEQ ID NO: 1780200 - protein, 4 aa, Staphylococcus epidermidis
IDDK

SEQ ID NO: 1780201 - protein, 5 aa, Staphylococcus epidermidis
IDDNT

SEQ ID NO: 1780202 - protein, 6 aa, Staphylococcus epidermidis
IDDPHR

SEQ ID NO: 1780203 - protein, 10 aa, Staphylococcus epidermidis
IDDSDRGLKS

SEQ ID NO: 1780204 - protein, 13 aa, Staphylococcus epidermidis
IDEAADDIRALGG

SEQ ID NO: 1780205 - protein, 12 aa, Staphylococcus epidermidis
IDEAKKEGDSIG

SEQ ID NO: 1780206 - protein, 15 aa, Staphylococcus epidermidis
IDEDANNEEVTDKTF

SEQ ID NO: 1780207 - protein, 7 aa, Staphylococcus epidermidis
IDEEGKL

SEQ ID NO: 1780208 - protein, 7 aa, Staphylococcus epidermidis
IDEEKLD

SEQ ID NO: 1780209 - protein, 8 aa, Staphylococcus epidermidis
IDENDLNK

SEQ ID NO: 1780210 - protein, 6 aa, Staphylococcus epidermidis
IDENGN

SEQ ID NO: 1780211 - protein, 20 aa, Staphylococcus epidermidis
IDENKDRFSERLNSQQVHAN

SEQ ID NO: 1780212 - protein, 5 aa, Staphylococcus epidermidis
IDENN

SEQ ID NO: 1780213 - protein, 8 aa, Staphylococcus epidermidis
IDENPPEW

SEQ ID NO: 1780214 - protein, 8 aa, Staphylococcus epidermidis
IDEQNERH

SEQ ID NO: 1780215 - protein, 8 aa, Staphylococcus epidermidis
IDEQSGEV

SEQ ID NO: 1780216 - protein, 23 aa, Staphylococcus epidermidis
IDESKSGMVPRSRLNDKNAEIDE

SEQ ID NO: 1780217 - protein, 5 aa, Staphylococcus epidermidis
IDESQ

SEQ ID NO: 1780218 - protein, 6 aa, Staphylococcus epidermidis
IDEYNE

SEQ ID NO: 1780219 - protein, 4 aa, Staphylococcus epidermidis
IDGF

SEQ ID NO: 1780220 - protein, 12 aa, Staphylococcus epidermidis
IDGFTKDTKGYN

SEQ ID NO: 1780221 - protein, 13 aa, Staphylococcus epidermidis
IDGFTKDTKGYNY

SEQ ID NO: 1780222 - protein, 6 aa, Staphylococcus epidermidis
IDGITD

SEQ ID NO: 1780223 - protein, 20 aa, Staphylococcus epidermidis
IDGSKDIDEVTNDVIDILDH

SEQ ID NO: 1780224 - protein, 7 aa, Staphylococcus epidermidis
IDGSTLN

SEQ ID NO: 1780225 - protein, 16 aa, Staphylococcus epidermidis
IDGTTGEPLNKNQIDN

SEQ ID NO: 1780226 - protein, 5 aa, Staphylococcus epidermidis
IDGVN

SEQ ID NO: 1780227 - protein, 8 aa, Staphylococcus epidermidis
IDHNGEEF

SEQ ID NO: 1780228 - protein, 12 aa, Staphylococcus epidermidis
IDKDGNAHSLTQ

SEQ ID NO: 1780229 - protein, 8 aa, Staphylococcus epidermidis
IDKDKGEV

SEQ ID NO: 1780230 - protein, 16 aa, Staphylococcus epidermidis
IDKQGRVNASHKALTQ

SEQ ID NO: 1780231 - protein, 12 aa, Staphylococcus epidermidis
IDKQQTNALKNQ

SEQ ID NO: 1780232 - protein, 9 aa, Staphylococcus epidermidis
IDKSTTYKQ

SEQ ID NO: 1780233 - protein, 6 aa, Staphylococcus epidermidis
IDLSNS

SEQ ID NO: 1780234 - protein, 9 aa, Staphylococcus epidermidis
IDNEKCTKI

SEQ ID NO: 1780235 - protein, 26 aa, Staphylococcus epidermidis
IDNETQQKPSHSYNDEQSSDNNYNTI

SEQ ID NO: 1780236 - protein, 6 aa, Staphylococcus epidermidis
IDNGNI

SEQ ID NO: 1780237 - protein, 7 aa, Staphylococcus epidermidis
IDNGQTL

SEQ ID NO: 1780238 - protein, 8 aa, Staphylococcus epidermidis
IDNNEKWK

SEQ ID NO: 1780239 - protein, 5 aa, Staphylococcus epidermidis
IDNPV

SEQ ID NO: 1780240 - protein, 11 aa, Staphylococcus epidermidis
IDNTENNKSLN

SEQ ID NO: 1780241 - protein, 8 aa, Staphylococcus epidermidis
IDNYSGKI

SEQ ID NO: 1780242 - protein, 4 aa, Staphylococcus epidermidis
IDPL

SEQ ID NO: 1780243 - protein, 8 aa, Staphylococcus epidermidis
IDPQTLKE

SEQ ID NO: 1780244 - protein, 6 aa, Staphylococcus epidermidis
IDPSDE

SEQ ID NO: 1780245 - protein, 7 aa, Staphylococcus epidermidis
IDPSNGA

SEQ ID NO: 1780246 - protein, 14 aa, Staphylococcus epidermidis
IDPSYEPDISIEES

SEQ ID NO: 1780247 - protein, 4 aa, Staphylococcus epidermidis
IDPV

SEQ ID NO: 1780248 - protein, 18 aa, Staphylococcus epidermidis
IDQENKARQSDDSDYLES

SEQ ID NO: 1780249 - protein, 6 aa, Staphylococcus epidermidis
IDQESI

SEQ ID NO: 1780250 - protein, 11 aa, Staphylococcus epidermidis
IDQTSNPTMNP

SEQ ID NO: 1780251 - protein, 8 aa, Staphylococcus epidermidis
IDQTTQQF

SEQ ID NO: 1780252 - protein, 18 aa, Staphylococcus epidermidis
IDREHEDERRNLTKGRLQ

SEQ ID NO: 1780253 - protein, 8 aa, Staphylococcus epidermidis
IDRKKDNK

SEQ ID NO: 1780254 - protein, 15 aa, Staphylococcus epidermidis
IDRLEQSKEEAPHLR

SEQ ID NO: 1780255 - protein, 6 aa, Staphylococcus epidermidis
IDRPVL

SEQ ID NO: 1780256 - protein, 7 aa, Staphylococcus epidermidis
IDRSAQN

SEQ ID NO: 1780257 - protein, 5 aa, Staphylococcus epidermidis
IDSEE

SEQ ID NO: 1780258 - protein, 12 aa, Staphylococcus epidermidis
IDSEEHVQYTQK

SEQ ID NO: 1780259 - protein, 10 aa, Staphylococcus epidermidis
IDSEEQEDEH

SEQ ID NO: 1780260 - protein, 5 aa, Staphylococcus epidermidis
IDSES

SEQ ID NO: 1780261 - protein, 14 aa, Staphylococcus epidermidis
IDSNPSLTANQRKE

SEQ ID NO: 1780262 - protein, 10 aa, Staphylococcus epidermidis
IDSQNKREVR

SEQ ID NO: 1780263 - protein, 7 aa, Staphylococcus epidermidis
IDSQRRI

SEQ ID NO: 1780264 - protein, 7 aa, Staphylococcus epidermidis
IDSREDI

SEQ ID NO: 1780265 - protein, 14 aa, Staphylococcus epidermidis
IDSSSSRKKINDTL

SEQ ID NO: 1780266 - protein, 11 aa, Staphylococcus epidermidis
IDSTGRASSDV

SEQ ID NO: 1780267 - protein, 5 aa, Staphylococcus epidermidis
IDTDL

SEQ ID NO: 1780268 - protein, 7 aa, Staphylococcus epidermidis
IDTHEDA

SEQ ID NO: 1780269 - protein, 11 aa, Staphylococcus epidermidis
IDTKNYKSLTE

SEQ ID NO: 1780270 - protein, 12 aa, Staphylococcus epidermidis
IDTKPLKSFEED

SEQ ID NO: 1780271 - protein, 10 aa, Staphylococcus epidermidis
IDTPSNNEEV

SEQ ID NO: 1780272 - protein, 4 aa, Staphylococcus epidermidis
IDTQ

SEQ ID NO: 1780273 - protein, 5 aa, Staphylococcus epidermidis
IDTQE

SEQ ID NO: 1780274 - protein, 5 aa, Staphylococcus epidermidis
IDTSV

SEQ ID NO: 1780275 - protein, 11 aa, Staphylococcus epidermidis
IDTTKNIYDST

SEQ ID NO: 1780276 - protein, 10 aa, Staphylococcus epidermidis
IDTYKEKDLR

SEQ ID NO: 1780277 - protein, 6 aa, Staphylococcus epidermidis
IDVTTS

SEQ ID NO: 1780278 - protein, 8 aa, Staphylococcus epidermidis
IEAGKGDD

SEQ ID NO: 1780279 - protein, 8 aa, Staphylococcus epidermidis
IEAGKGKD

SEQ ID NO: 1780280 - protein, 6 aa, Staphylococcus epidermidis
IECGTS

SEQ ID NO: 1780281 - protein, 5 aa, Staphylococcus epidermidis
IEDAI

SEQ ID NO: 1780282 - protein, 5 aa, Staphylococcus epidermidis
IEDEA

SEQ ID NO: 1780283 - protein, 14 aa, Staphylococcus epidermidis
IEDESGASTATISR

SEQ ID NO: 1780284 - protein, 12 aa, Staphylococcus epidermidis
IEDGRLKEGGTI

SEQ ID NO: 1780285 - protein, 5 aa, Staphylococcus epidermidis
IEDIP

SEQ ID NO: 1780286 - protein, 7 aa, Staphylococcus epidermidis
IEDKTRR

SEQ ID NO: 1780287 - protein, 10 aa, Staphylococcus epidermidis
IEDSNQDISL

SEQ ID NO: 1780288 - protein, 5 aa, Staphylococcus epidermidis
IEDTR

SEQ ID NO: 1780289 - protein, 12 aa, Staphylococcus epidermidis
IEEDNNGSKYSK

SEQ ID NO: 1780290 - protein, 9 aa, Staphylococcus epidermidis
IEEESAKRR

SEQ ID NO: 1780291 - protein, 5 aa, Staphylococcus epidermidis
IEEIP

SEQ ID NO: 1780292 - protein, 7 aa, Staphylococcus epidermidis
IEEKDGE

SEQ ID NO: 1780293 - protein, 6 aa, Staphylococcus epidermidis
IEEKGI

SEQ ID NO: 1780294 - protein, 11 aa, Staphylococcus epidermidis
IEENEDGIPNT

SEQ ID NO: 1780295 - protein, 18 aa, Staphylococcus epidermidis
IEEQADEVQKVKRSENGV

SEQ ID NO: 1780296 - protein, 5 aa, Staphylococcus epidermidis
IEEQK

SEQ ID NO: 1780297 - protein, 6 aa, Staphylococcus epidermidis
IEEQTG

SEQ ID NO: 1780298 - protein, 32 aa, Staphylococcus epidermidis
IEFSSKRQNVSYKPENVNKSVRGKTLGQEYDK

SEQ ID NO: 1780299 - protein, 11 aa, Staphylococcus epidermidis
IEGANGPEIKI

SEQ ID NO: 1780300 - protein, 5 aa, Staphylococcus epidermidis
IEGAQ

SEQ ID NO: 1780301 - protein, 9 aa, Staphylococcus epidermidis
IEGEKTLAN

SEQ ID NO: 1780302 - protein, 14 aa, Staphylococcus epidermidis
IEGNSFKESITRKK

SEQ ID NO: 1780303 - protein, 17 aa, Staphylococcus epidermidis
IEGQPFAPIAGDDEQEI

SEQ ID NO: 1780304 - protein, 7 aa, Staphylococcus epidermidis
IEGTEPM

SEQ ID NO: 1780305 - protein, 6 aa, Staphylococcus epidermidis
IEGTPA

SEQ ID NO: 1780306 - protein, 11 aa, Staphylococcus epidermidis
IEGYDNTDKQL

SEQ ID NO: 1780307 - protein, 8 aa, Staphylococcus epidermidis
IEKDDKGI

SEQ ID NO: 1780308 - protein, 8 aa, Staphylococcus epidermidis
IEKDGKGI

SEQ ID NO: 1780309 - protein, 10 aa, Staphylococcus epidermidis
IEKDSDDLDG

SEQ ID NO: 1780310 - protein, 6 aa, Staphylococcus epidermidis
IEKDTG

SEQ ID NO: 1780311 - protein, 10 aa, Staphylococcus epidermidis
IEKEDTDEED

SEQ ID NO: 1780312 - protein, 10 aa, Staphylococcus epidermidis
IEKGEAETSL

SEQ ID NO: 1780313 - protein, 9 aa, Staphylococcus epidermidis
IEKGRYNSK

SEQ ID NO: 1780314 - protein, 16 aa, Staphylococcus epidermidis
IEKNRNQSMKPRKRGR

SEQ ID NO: 1780315 - protein, 17 aa, Staphylococcus epidermidis
IEKQDTELTDEELQESI

SEQ ID NO: 1780316 - protein, 17 aa, Staphylococcus epidermidis
IEKQETELSDEELQESI

SEQ ID NO: 1780317 - protein, 5 aa, Staphylococcus epidermidis
IEKQH

SEQ ID NO: 1780318 - protein, 8 aa, Staphylococcus epidermidis
IEKQSSKV

SEQ ID NO: 1780319 - protein, 43 aa, Staphylococcus epidermidis
IEKRPENKKAYNKKENLEQQLDANQQKIEEAQNLQQEHGNELP

SEQ ID NO: 1780320 - protein, 8 aa, Staphylococcus epidermidis
IEKVGPDV

SEQ ID NO: 1780321 - protein, 13 aa, Staphylococcus epidermidis
IELSADGPIRPPY

SEQ ID NO: 1780322 - protein, 11 aa, Staphylococcus epidermidis
IELSDGKLKPA

SEQ ID NO: 1780323 - protein, 8 aa, Staphylococcus epidermidis
IEMTKDEQ

SEQ ID NO: 1780324 - protein, 6 aa, Staphylococcus epidermidis
IENAGK

SEQ ID NO: 1780325 - protein, 9 aa, Staphylococcus epidermidis
IENANNNVL

SEQ ID NO: 1780326 - protein, 16 aa, Staphylococcus epidermidis
IENDGRTGLDKALNKS

SEQ ID NO: 1780327 - protein, 24 aa, Staphylococcus epidermidis
IENENIRQKKWKEKLDDLRDEEKW

SEQ ID NO: 1780328 - protein, 8 aa, Staphylococcus epidermidis
IENGDEAL

SEQ ID NO: 1780329 - protein, 9 aa, Staphylococcus epidermidis
IENGSEGGS

SEQ ID NO: 1780330 - protein, 11 aa, Staphylococcus epidermidis
IENSVEEYNKD

SEQ ID NO: 1780331 - protein, 4 aa, Staphylococcus epidermidis
IENY

SEQ ID NO: 1780332 - protein, 10 aa, Staphylococcus epidermidis
IENYNTNREY

SEQ ID NO: 1780333 - protein, 4 aa, Staphylococcus epidermidis
IEPD

SEQ ID NO: 1780334 - protein, 6 aa, Staphylococcus epidermidis
IEPDVE

SEQ ID NO: 1780335 - protein, 9 aa, Staphylococcus epidermidis
IEPEEIDST

SEQ ID NO: 1780336 - protein, 6 aa, Staphylococcus epidermidis
IEPNGD

SEQ ID NO: 1780337 - protein, 11 aa, Staphylococcus epidermidis
IEPSDKRLKSD

SEQ ID NO: 1780338 - protein, 9 aa, Staphylococcus epidermidis
IEPSEELEQ

SEQ ID NO: 1780339 - protein, 20 aa, Staphylococcus epidermidis
IEQANSVDNIKQTKDDGLNN

SEQ ID NO: 1780340 - protein, 5 aa, Staphylococcus epidermidis
IEQGI

SEQ ID NO: 1780341 - protein, 7 aa, Staphylococcus epidermidis
IEQHQNG

SEQ ID NO: 1780342 - protein, 4 aa, Staphylococcus epidermidis
IEQK

SEQ ID NO: 1780343 - protein, 11 aa, Staphylococcus epidermidis
IEQSLKDNHTS

SEQ ID NO: 1780344 - protein, 9 aa, Staphylococcus epidermidis
IEQSNEDKD

SEQ ID NO: 1780345 - protein, 8 aa, Staphylococcus epidermidis
IEQTASSI

SEQ ID NO: 1780346 - protein, 10 aa, Staphylococcus epidermidis
IEREEDDKSY

SEQ ID NO: 1780347 - protein, 13 aa, Staphylococcus epidermidis
IEREEQQGGTTVS

SEQ ID NO: 1780348 - protein, 4 aa, Staphylococcus epidermidis
IERK

SEQ ID NO: 1780349 - protein, 4 aa, Staphylococcus epidermidis
IERN

SEQ ID NO: 1780350 - protein, 18 aa, Staphylococcus epidermidis
IERRTAQLQKELNTIVER

SEQ ID NO: 1780351 - protein, 7 aa, Staphylococcus epidermidis
IERTSDR

SEQ ID NO: 1780352 - protein, 10 aa, Staphylococcus epidermidis
IESGEASSIL

SEQ ID NO: 1780353 - protein, 6 aa, Staphylococcus epidermidis
IESGGQ

SEQ ID NO: 1780354 - protein, 8 aa, Staphylococcus epidermidis
IESGYRSI

SEQ ID NO: 1780355 - protein, 4 aa, Staphylococcus epidermidis
IESK

SEQ ID NO: 1780356 - protein, 5 aa, Staphylococcus epidermidis
IESKD

SEQ ID NO: 1780357 - protein, 9 aa, Staphylococcus epidermidis
IESLKESKP

SEQ ID NO: 1780358 - protein, 6 aa, Staphylococcus epidermidis
IESNEV

SEQ ID NO: 1780359 - protein, 7 aa, Staphylococcus epidermidis
IESPSEV

SEQ ID NO: 1780360 - protein, 6 aa, Staphylococcus epidermidis
IESSKD

SEQ ID NO: 1780361 - protein, 5 aa, Staphylococcus epidermidis
IETDY

SEQ ID NO: 1780362 - protein, 10 aa, Staphylococcus epidermidis
IETKNNSVTG

SEQ ID NO: 1780363 - protein, 11 aa, Staphylococcus epidermidis
IETKSNPNDLV

SEQ ID NO: 1780364 - protein, 4 aa, Staphylococcus epidermidis
IETP

SEQ ID NO: 1780365 - protein, 11 aa, Staphylococcus epidermidis
IETPHVKTAQE

SEQ ID NO: 1780366 - protein, 16 aa, Staphylococcus epidermidis
IETPYKANLNNNQKKE

SEQ ID NO: 1780367 - protein, 9 aa, Staphylococcus epidermidis
IEVNTNKSF

SEQ ID NO: 1780368 - protein, 4 aa, Staphylococcus epidermidis
IEVQ

SEQ ID NO: 1780369 - protein, 8 aa, Staphylococcus epidermidis
IEYGGRGM

SEQ ID NO: 1780370 - protein, 6 aa, Staphylococcus epidermidis
IEYSAK

SEQ ID NO: 1780371 - protein, 10 aa, Staphylococcus epidermidis
IFPGGSRAYN

SEQ ID NO: 1780372 - protein, 9 aa, Staphylococcus epidermidis
IGAKKDRYP

SEQ ID NO: 1780373 - protein, 13 aa, Staphylococcus epidermidis
IGAKNIESSYRRG

SEQ ID NO: 1780374 - protein, 12 aa, Staphylococcus epidermidis
IGASSAAGAAIG

SEQ ID NO: 1780375 - protein, 9 aa, Staphylococcus epidermidis
IGDDNETRI

SEQ ID NO: 1780376 - protein, 13 aa, Staphylococcus epidermidis
IGDEDITVEKGER

SEQ ID NO: 1780377 - protein, 6 aa, Staphylococcus epidermidis
IGDNGY

SEQ ID NO: 1780378 - protein, 9 aa, Staphylococcus epidermidis
IGDRSKDKH

SEQ ID NO: 1780379 - protein, 12 aa, Staphylococcus epidermidis
IGDTENASHNLF

SEQ ID NO: 1780380 - protein, 5 aa, Staphylococcus epidermidis
IGDTN

SEQ ID NO: 1780381 - protein, 7 aa, Staphylococcus epidermidis
IGEAQDV

SEQ ID NO: 1780382 - protein, 9 aa, Staphylococcus epidermidis
IGEDTSGKY

SEQ ID NO: 1780383 - protein, 5 aa, Staphylococcus epidermidis
IGEGG

SEQ ID NO: 1780384 - protein, 7 aa, Staphylococcus epidermidis
IGEGPDA

SEQ ID NO: 1780385 - protein, 5 aa, Staphylococcus epidermidis
IGENS

SEQ ID NO: 1780386 - protein, 5 aa, Staphylococcus epidermidis
IGEQK

SEQ ID NO: 1780387 - protein, 9 aa, Staphylococcus epidermidis
IGEREAQLD

SEQ ID NO: 1780388 - protein, 10 aa, Staphylococcus epidermidis
IGETDQTGTA

SEQ ID NO: 1780389 - protein, 8 aa, Staphylococcus epidermidis
IGETNLDA

SEQ ID NO: 1780390 - protein, 7 aa, Staphylococcus epidermidis
IGGAATD

SEQ ID NO: 1780391 - protein, 8 aa, Staphylococcus epidermidis
IGGDAGGI

SEQ ID NO: 1780392 - protein, 11 aa, Staphylococcus epidermidis
IGGDAGGIDDL

SEQ ID NO: 1780393 - protein, 6 aa, Staphylococcus epidermidis
IGGEDD

SEQ ID NO: 1780394 - protein, 13 aa, Staphylococcus epidermidis
IGGGMGNAVLFER

SEQ ID NO: 1780395 - protein, 7 aa, Staphylococcus epidermidis
IGGGPGG

SEQ ID NO: 1780396 - protein, 6 aa, Staphylococcus epidermidis
IGGSGK

SEQ ID NO: 1780397 - protein, 6 aa, Staphylococcus epidermidis
IGGTAK

SEQ ID NO: 1780398 - protein, 5 aa, Staphylococcus epidermidis
IGHPD

SEQ ID NO: 1780399 - protein, 14 aa, Staphylococcus epidermidis
IGHPVDEGSFQPSR

SEQ ID NO: 1780400 - protein, 10 aa, Staphylococcus epidermidis
IGIPNKGEWT

SEQ ID NO: 1780401 - protein, 8 aa, Staphylococcus epidermidis
IGKAQRVA

SEQ ID NO: 1780402 - protein, 6 aa, Staphylococcus epidermidis
IGKEHG

SEQ ID NO: 1780403 - protein, 8 aa, Staphylococcus epidermidis
IGKKTAQN

SEQ ID NO: 1780404 - protein, 12 aa, Staphylococcus epidermidis
IGKLSTAMIIGE

SEQ ID NO: 1780405 - protein, 7 aa, Staphylococcus epidermidis
IGKPEAL

SEQ ID NO: 1780406 - protein, 17 aa, Staphylococcus epidermidis
IGKRGRAKENLMIKRKE

SEQ ID NO: 1780407 - protein, 16 aa, Staphylococcus epidermidis
IGKSQQYISREKTPKW

SEQ ID NO: 1780408 - protein, 14 aa, Staphylococcus epidermidis
IGKSVSKKLKENNH

SEQ ID NO: 1780409 - protein, 12 aa, Staphylococcus epidermidis
IGLQGPKGEPFK

SEQ ID NO: 1780410 - protein, 17 aa, Staphylococcus epidermidis
IGNGKLSEKQQRNSGVD

SEQ ID NO: 1780411 - protein, 5 aa, Staphylococcus epidermidis
IGNVS

SEQ ID NO: 1780412 - protein, 6 aa, Staphylococcus epidermidis
IGPESK

SEQ ID NO: 1780413 - protein, 6 aa, Staphylococcus epidermidis
IGPGAK

SEQ ID NO: 1780414 - protein, 9 aa, Staphylococcus epidermidis
IGPKKRRNL

SEQ ID NO: 1780415 - protein, 6 aa, Staphylococcus epidermidis
IGPNAI

SEQ ID NO: 1780416 - protein, 4 aa, Staphylococcus epidermidis
IGPR

SEQ ID NO: 1780417 - protein, 6 aa, Staphylococcus epidermidis
IGQGEP

SEQ ID NO: 1780418 - protein, 4 aa, Staphylococcus epidermidis
IGQK

SEQ ID NO: 1780419 - protein, 6 aa, Staphylococcus epidermidis
IGQSRI

SEQ ID NO: 1780420 - protein, 8 aa, Staphylococcus epidermidis
IGQSSIKS

SEQ ID NO: 1780421 - protein, 5 aa, Staphylococcus epidermidis
IGQTT

SEQ ID NO: 1780422 - protein, 4 aa, Staphylococcus epidermidis
IGRA

SEQ ID NO: 1780423 - protein, 4 aa, Staphylococcus epidermidis
IGRF

SEQ ID NO: 1780424 - protein, 11 aa, Staphylococcus epidermidis
IGRGANRKKMD

SEQ ID NO: 1780425 - protein, 5 aa, Staphylococcus epidermidis
IGRHN

SEQ ID NO: 1780426 - protein, 4 aa, Staphylococcus epidermidis
IGRN

SEQ ID NO: 1780427 - protein, 11 aa, Staphylococcus epidermidis
IGRQPQQELGG

SEQ ID NO: 1780428 - protein, 14 aa, Staphylococcus epidermidis
IGRSRAEKDVKSGS

SEQ ID NO: 1780429 - protein, 12 aa, Staphylococcus epidermidis
IGRTGRAGKEGI

SEQ ID NO: 1780430 - protein, 10 aa, Staphylococcus epidermidis
IGSEKKTAAI

SEQ ID NO: 1780431 - protein, 6 aa, Staphylococcus epidermidis
IGSETA

SEQ ID NO: 1780432 - protein, 7 aa, Staphylococcus epidermidis
IGSGSPV

SEQ ID NO: 1780433 - protein, 11 aa, Staphylococcus epidermidis
IGSGSTIDDRP

SEQ ID NO: 1780434 - protein, 8 aa, Staphylococcus epidermidis
IGSQKDKQ

SEQ ID NO: 1780435 - protein, 6 aa, Staphylococcus epidermidis
IGSVGS

SEQ ID NO: 1780436 - protein, 9 aa, Staphylococcus epidermidis
IGTASFENG

SEQ ID NO: 1780437 - protein, 9 aa, Staphylococcus epidermidis
IGTDKTDIK

SEQ ID NO: 1780438 - protein, 11 aa, Staphylococcus epidermidis
IGTDKTDTKTF

SEQ ID NO: 1780439 - protein, 6 aa, Staphylococcus epidermidis
IGTGST

SEQ ID NO: 1780440 - protein, 6 aa, Staphylococcus epidermidis
IGTLND

SEQ ID NO: 1780441 - protein, 8 aa, Staphylococcus epidermidis
IGTNNVDN

SEQ ID NO: 1780442 - protein, 9 aa, Staphylococcus epidermidis
IGTPATRSS

SEQ ID NO: 1780443 - protein, 4 aa, Staphylococcus epidermidis
IGTQ

SEQ ID NO: 1780444 - protein, 7 aa, Staphylococcus epidermidis
IGTSAGS

SEQ ID NO: 1780445 - protein, 5 aa, Staphylococcus epidermidis
IGTSK

SEQ ID NO: 1780446 - protein, 11 aa, Staphylococcus epidermidis
IGVGKSSLAHK

SEQ ID NO: 1780447 - protein, 8 aa, Staphylococcus epidermidis
IGYSDTSQ

SEQ ID NO: 1780448 - protein, 5 aa, Staphylococcus epidermidis
IGYSK

SEQ ID NO: 1780449 - protein, 7 aa, Staphylococcus epidermidis
IHEDPRK

SEQ ID NO: 1780450 - protein, 6 aa, Staphylococcus epidermidis
IHENPR

SEQ ID NO: 1780451 - protein, 7 aa, Staphylococcus epidermidis
IHENTER

SEQ ID NO: 1780452 - protein, 10 aa, Staphylococcus epidermidis
IHKTQNVGYQ

SEQ ID NO: 1780453 - protein, 5 aa, Staphylococcus epidermidis
IHPES

SEQ ID NO: 1780454 - protein, 13 aa, Staphylococcus epidermidis
IHQQSKEKITTEN

SEQ ID NO: 1780455 - protein, 10 aa, Staphylococcus epidermidis
IHRNNEDTLS

SEQ ID NO: 1780456 - protein, 10 aa, Staphylococcus epidermidis
IIDSEDSSQV

SEQ ID NO: 1780457 - protein, 10 aa, Staphylococcus epidermidis
IIDSENSSQV

SEQ ID NO: 1780458 - protein, 4 aa, Staphylococcus epidermidis
IIEG

SEQ ID NO: 1780459 - protein, 13 aa, Staphylococcus epidermidis
IIKGNSSPGLSTR

SEQ ID NO: 1780460 - protein, 4 aa, Staphylococcus epidermidis
IIPT

SEQ ID NO: 1780461 - protein, 16 aa, Staphylococcus epidermidis
IIPTKQIKDEKLKKEI

SEQ ID NO: 1780462 - protein, 5 aa, Staphylococcus epidermidis
IIQPQ

SEQ ID NO: 1780463 - protein, 6 aa, Staphylococcus epidermidis
IISTGA

SEQ ID NO: 1780464 - protein, 20 aa, Staphylococcus epidermidis
IKADKKRRRAEGKARKERIK

SEQ ID NO: 1780465 - protein, 12 aa, Staphylococcus epidermidis
IKAEDVSEQDID

SEQ ID NO: 1780466 - protein, 6 aa, Staphylococcus epidermidis
IKAENF

SEQ ID NO: 1780467 - protein, 9 aa, Staphylococcus epidermidis
IKAERKKFN

SEQ ID NO: 1780468 - protein, 9 aa, Staphylococcus epidermidis
IKAKSKDKT

SEQ ID NO: 1780469 - protein, 10 aa, Staphylococcus epidermidis
IKAKSTNLAV

SEQ ID NO: 1780470 - protein, 29 aa, Staphylococcus epidermidis
IKAKSTNLAVSGATMSTNKDNSIYEQATK

SEQ ID NO: 1780471 - protein, 29 aa, Staphylococcus epidermidis
IKAQQAREAARKAREDARSGKKSKRKDTL

SEQ ID NO: 1780472 - protein, 75 aa, Staphylococcus epidermidis
IKASHTKELPNSQFQNNEFGSSRTVNLSGQELPNSQSNDTDYNDTDYIKTESNDTDDLNDNKLNYPSNHTSHSNH

SEQ ID NO: 1780473 - protein, 8 aa, Staphylococcus epidermidis
IKATHKDG

SEQ ID NO: 1780474 - protein, 8 aa, Staphylococcus epidermidis
IKATHKEG

SEQ ID NO: 1780475 - protein, 7 aa, Staphylococcus epidermidis
IKCKTNR

SEQ ID NO: 1780476 - protein, 17 aa, Staphylococcus epidermidis
IKDAEENATKNQLNNTT

SEQ ID NO: 1780477 - protein, 16 aa, Staphylococcus epidermidis
IKDAPKDGFSKDDTVK

SEQ ID NO: 1780478 - protein, 17 aa, Staphylococcus epidermidis
IKDAPKDGFSKDDTVKL

SEQ ID NO: 1780479 - protein, 8 aa, Staphylococcus epidermidis
IKDASKLS

SEQ ID NO: 1780480 - protein, 20 aa, Staphylococcus epidermidis
IKDDTDEKGNKYKKYRKDEN

SEQ ID NO: 1780481 - protein, 20 aa, Staphylococcus epidermidis
IKDDTDENGDEYKKYRKDGN

SEQ ID NO: 1780482 - protein, 6 aa, Staphylococcus epidermidis
IKDEEQ

SEQ ID NO: 1780483 - protein, 10 aa, Staphylococcus epidermidis
IKDGANDHGE

SEQ ID NO: 1780484 - protein, 8 aa, Staphylococcus epidermidis
IKDGREDE

SEQ ID NO: 1780485 - protein, 11 aa, Staphylococcus epidermidis
IKDNAKYYGVT

SEQ ID NO: 1780486 - protein, 18 aa, Staphylococcus epidermidis
IKDRKGKTINGTFIKESD

SEQ ID NO: 1780487 - protein, 5 aa, Staphylococcus epidermidis
IKDSK

SEQ ID NO: 1780488 - protein, 14 aa, Staphylococcus epidermidis
IKDTIKKASIASGV

SEQ ID NO: 1780489 - protein, 25 aa, Staphylococcus epidermidis
IKDTTNRAVDTTKPKPVSPKFKSIK

SEQ ID NO: 1780490 - protein, 5 aa, Staphylococcus epidermidis
IKDYS

SEQ ID NO: 1780491 - protein, 17 aa, Staphylococcus epidermidis
IKEAQQANQSQDGIPNF

SEQ ID NO: 1780492 - protein, 8 aa, Staphylococcus epidermidis
IKEDDGDQ

SEQ ID NO: 1780493 - protein, 6 aa, Staphylococcus epidermidis
IKEEEQ

SEQ ID NO: 1780494 - protein, 9 aa, Staphylococcus epidermidis
IKEEKEDGI

SEQ ID NO: 1780495 - protein, 6 aa, Staphylococcus epidermidis
IKEESK

SEQ ID NO: 1780496 - protein, 6 aa, Staphylococcus epidermidis
IKEGEA

SEQ ID NO: 1780497 - protein, 9 aa, Staphylococcus epidermidis
IKEKHGADS

SEQ ID NO: 1780498 - protein, 13 aa, Staphylococcus epidermidis
IKEKNKKSHSKNI

SEQ ID NO: 1780499 - protein, 5 aa, Staphylococcus epidermidis
IKELE

SEQ ID NO: 1780500 - protein, 4 aa, Staphylococcus epidermidis
IKEN

SEQ ID NO: 1780501 - protein, 5 aa, Staphylococcus epidermidis
IKEND

SEQ ID NO: 1780502 - protein, 6 aa, Staphylococcus epidermidis
IKENDY

SEQ ID NO: 1780503 - protein, 5 aa, Staphylococcus epidermidis
IKENI

SEQ ID NO: 1780504 - protein, 8 aa, Staphylococcus epidermidis
IKENRKQF

SEQ ID NO: 1780505 - protein, 13 aa, Staphylococcus epidermidis
IKEPEEVNTHTVT

SEQ ID NO: 1780506 - protein, 40 aa, Staphylococcus epidermidis
IKEQKAQRATKKPKNLSSSESRIKGTKPYFAGKQKKLRKT

SEQ ID NO: 1780507 - protein, 22 aa, Staphylococcus epidermidis
IKEQSKKFNEKELEKIYLNISL

SEQ ID NO: 1780508 - protein, 5 aa, Staphylococcus epidermidis
IKESD

SEQ ID NO: 1780509 - protein, 8 aa, Staphylococcus epidermidis
IKESPDFG

SEQ ID NO: 1780510 - protein, 17 aa, Staphylococcus epidermidis
IKESSESSAGSALQENA

SEQ ID NO: 1780511 - protein, 14 aa, Staphylococcus epidermidis
IKFNDGSTSTMKTG

SEQ ID NO: 1780512 - protein, 10 aa, Staphylococcus epidermidis
IKFTKNNKSI

SEQ ID NO: 1780513 - protein, 9 aa, Staphylococcus epidermidis
IKGAGTTTI

SEQ ID NO: 1780514 - protein, 9 aa, Staphylococcus epidermidis
IKGETHKET

SEQ ID NO: 1780515 - protein, 22 aa, Staphylococcus epidermidis
IKGEVKVKSNSDFTATRFQPGE

SEQ ID NO: 1780516 - protein, 7 aa, Staphylococcus epidermidis
IKGNDDV

SEQ ID NO: 1780517 - protein, 4 aa, Staphylococcus epidermidis
IKHY

SEQ ID NO: 1780518 - protein, 14 aa, Staphylococcus epidermidis
IKINTRSITSKQNS

SEQ ID NO: 1780519 - protein, 5 aa, Staphylococcus epidermidis
IKITE

SEQ ID NO: 1780520 - protein, 10 aa, Staphylococcus epidermidis
IKKDKGKKKL

SEQ ID NO: 1780521 - protein, 5 aa, Staphylococcus epidermidis
IKKKP

SEQ ID NO: 1780522 - protein, 8 aa, Staphylococcus epidermidis
IKKNREEL

SEQ ID NO: 1780523 - protein, 9 aa, Staphylococcus epidermidis
IKKQDDQTI

SEQ ID NO: 1780524 - protein, 22 aa, Staphylococcus epidermidis
IKKQIDEGKYNGKIKNVGHEDD

SEQ ID NO: 1780525 - protein, 4 aa, Staphylococcus epidermidis
IKKR

SEQ ID NO: 1780526 - protein, 6 aa, Staphylococcus epidermidis
IKKRGA

SEQ ID NO: 1780527 - protein, 11 aa, Staphylococcus epidermidis
IKKRSNNSNGF

SEQ ID NO: 1780528 - protein, 14 aa, Staphylococcus epidermidis
IKKTPKQDKAENKR

SEQ ID NO: 1780529 - protein, 14 aa, Staphylococcus epidermidis
IKKTPKRDKADEKR

SEQ ID NO: 1780530 - protein, 9 aa, Staphylococcus epidermidis
IKLTNGNEV

SEQ ID NO: 1780531 - protein, 19 aa, Staphylococcus epidermidis
IKNANKLKKKRDRDKTGQA

SEQ ID NO: 1780532 - protein, 4 aa, Staphylococcus epidermidis
IKNE

SEQ ID NO: 1780533 - protein, 6 aa, Staphylococcus epidermidis
IKNEGH

SEQ ID NO: 1780534 - protein, 6 aa, Staphylococcus epidermidis
IKNEGY

SEQ ID NO: 1780535 - protein, 9 aa, Staphylococcus epidermidis
IKNENYSSD

SEQ ID NO: 1780536 - protein, 6 aa, Staphylococcus epidermidis
IKNEPY

SEQ ID NO: 1780537 - protein, 12 aa, Staphylococcus epidermidis
IKNESERSITKD

SEQ ID NO: 1780538 - protein, 8 aa, Staphylococcus epidermidis
IKNGELKP

SEQ ID NO: 1780539 - protein, 15 aa, Staphylococcus epidermidis
IKNGEYRKAYNRSRR

SEQ ID NO: 1780540 - protein, 6 aa, Staphylococcus epidermidis
IKNHEN

SEQ ID NO: 1780541 - protein, 4 aa, Staphylococcus epidermidis
IKNK

SEQ ID NO: 1780542 - protein, 12 aa, Staphylococcus epidermidis
IKNNSERKPKGL

SEQ ID NO: 1780543 - protein, 7 aa, Staphylococcus epidermidis
IKNREEE

SEQ ID NO: 1780544 - protein, 7 aa, Staphylococcus epidermidis
IKNSDHE

SEQ ID NO: 1780545 - protein, 16 aa, Staphylococcus epidermidis
IKNSNQQQVWDIIASY

SEQ ID NO: 1780546 - protein, 4 aa, Staphylococcus epidermidis
IKNT

SEQ ID NO: 1780547 - protein, 9 aa, Staphylococcus epidermidis
IKNTKDGSI

SEQ ID NO: 1780548 - protein, 4 aa, Staphylococcus epidermidis
IKPA

SEQ ID NO: 1780549 - protein, 22 aa, Staphylococcus epidermidis
IKPDGNKEYIKKDEVRRKTDGF

SEQ ID NO: 1780550 - protein, 4 aa, Staphylococcus epidermidis
IKPG

SEQ ID NO: 1780551 - protein, 9 aa, Staphylococcus epidermidis
IKPKENKGK

SEQ ID NO: 1780552 - protein, 39 aa, Staphylococcus epidermidis
IKPNKKGDKDIQAAIKETSKYSVKSSDYLTGNHEKDAEI

SEQ ID NO: 1780553 - protein, 7 aa, Staphylococcus epidermidis
IKPQKGD

SEQ ID NO: 1780554 - protein, 5 aa, Staphylococcus epidermidis
IKPRD

SEQ ID NO: 1780555 - protein, 9 aa, Staphylococcus epidermidis
IKPSDRLKA

SEQ ID NO: 1780556 - protein, 9 aa, Staphylococcus epidermidis
IKPSDRMKA

SEQ ID NO: 1780557 - protein, 8 aa, Staphylococcus epidermidis
IKQADDMG

SEQ ID NO: 1780558 - protein, 8 aa, Staphylococcus epidermidis
IKQADKMG

SEQ ID NO: 1780559 - protein, 8 aa, Staphylococcus epidermidis
IKQDNTSF

SEQ ID NO: 1780560 - protein, 15 aa, Staphylococcus epidermidis
IKQEQQRGKELGLNS

SEQ ID NO: 1780561 - protein, 4 aa, Staphylococcus epidermidis
IKQH

SEQ ID NO: 1780562 - protein, 9 aa, Staphylococcus epidermidis
IKQKQIRDN

SEQ ID NO: 1780563 - protein, 7 aa, Staphylococcus epidermidis
IKQNQKS

SEQ ID NO: 1780564 - protein, 7 aa, Staphylococcus epidermidis
IKQRTQY

SEQ ID NO: 1780565 - protein, 7 aa, Staphylococcus epidermidis
IKQSQQN

SEQ ID NO: 1780566 - protein, 22 aa, Staphylococcus epidermidis
IKQTSEVEDSKREIVSALRKLN

SEQ ID NO: 1780567 - protein, 17 aa, Staphylococcus epidermidis
IKQTTREELNQEDEDDL

SEQ ID NO: 1780568 - protein, 7 aa, Staphylococcus epidermidis
IKRDTSY

SEQ ID NO: 1780569 - protein, 8 aa, Staphylococcus epidermidis
IKRREDAK

SEQ ID NO: 1780570 - protein, 9 aa, Staphylococcus epidermidis
IKRREDAKQ

SEQ ID NO: 1780571 - protein, 17 aa, Staphylococcus epidermidis
IKSARDRVKNIEYTQHL

SEQ ID NO: 1780572 - protein, 8 aa, Staphylococcus epidermidis
IKSATALS

SEQ ID NO: 1780573 - protein, 9 aa, Staphylococcus epidermidis
IKSDEGTAV

SEQ ID NO: 1780574 - protein, 14 aa, Staphylococcus epidermidis
IKSFDEPDASKLPW

SEQ ID NO: 1780575 - protein, 10 aa, Staphylococcus epidermidis
IKSKDNKGYI

SEQ ID NO: 1780576 - protein, 12 aa, Staphylococcus epidermidis
IKSKLEESGISY

SEQ ID NO: 1780577 - protein, 8 aa, Staphylococcus epidermidis
IKSNNPKS

SEQ ID NO: 1780578 - protein, 9 aa, Staphylococcus epidermidis
IKSNNPNSK

SEQ ID NO: 1780579 - protein, 7 aa, Staphylococcus epidermidis
IKSPENL

SEQ ID NO: 1780580 - protein, 17 aa, Staphylococcus epidermidis
IKSSAEAIREGNTGAVQ

SEQ ID NO: 1780581 - protein, 10 aa, Staphylococcus epidermidis
IKSSNSKIAN

SEQ ID NO: 1780582 - protein, 7 aa, Staphylococcus epidermidis
IKSTQEI

SEQ ID NO: 1780583 - protein, 34 aa, Staphylococcus epidermidis
IKSVPQKSTNRQNATSEERNYRMNNNSKSNSRNV

SEQ ID NO: 1780584 - protein, 6 aa, Staphylococcus epidermidis
IKSVQD

SEQ ID NO: 1780585 - protein, 5 aa, Staphylococcus epidermidis
IKTED

SEQ ID NO: 1780586 - protein, 23 aa, Staphylococcus epidermidis
IKTEKAGKKVEMKKNEDYEVPEE

SEQ ID NO: 1780587 - protein, 23 aa, Staphylococcus epidermidis
IKTEKAGKNVPMKKNEDYEVPEE

SEQ ID NO: 1780588 - protein, 36 aa, Staphylococcus epidermidis
IKTENNDTDDLNDNKLKYPSNHTNHSNHNNSNFNNE

SEQ ID NO: 1780589 - protein, 4 aa, Staphylococcus epidermidis
IKTG

SEQ ID NO: 1780590 - protein, 15 aa, Staphylococcus epidermidis
IKTISSKINSSSPNI

SEQ ID NO: 1780591 - protein, 7 aa, Staphylococcus epidermidis
IKTPENL

SEQ ID NO: 1780592 - protein, 6 aa, Staphylococcus epidermidis
IKTQDI

SEQ ID NO: 1780593 - protein, 10 aa, Staphylococcus epidermidis
IKTQNEATPF

SEQ ID NO: 1780594 - protein, 6 aa, Staphylococcus epidermidis
IKTQQQ

SEQ ID NO: 1780595 - protein, 6 aa, Staphylococcus epidermidis
IKTTDV

SEQ ID NO: 1780596 - protein, 14 aa, Staphylococcus epidermidis
IKTTEIDGHPDFSG

SEQ ID NO: 1780597 - protein, 14 aa, Staphylococcus epidermidis
IKTTEIEGHPEFSG

SEQ ID NO: 1780598 - protein, 12 aa, Staphylococcus epidermidis
IKTTEQEKQLKD

SEQ ID NO: 1780599 - protein, 9 aa, Staphylococcus epidermidis
IKTTNAQQL

SEQ ID NO: 1780600 - protein, 7 aa, Staphylococcus epidermidis
IKVEEGQ

SEQ ID NO: 1780601 - protein, 6 aa, Staphylococcus epidermidis
IKVGSG

SEQ ID NO: 1780602 - protein, 9 aa, Staphylococcus epidermidis
IKVTSKGKQ

SEQ ID NO: 1780603 - protein, 21 aa, Staphylococcus epidermidis
IKYGGTSISDYRHADGKTGEM

SEQ ID NO: 1780604 - protein, 4 aa, Staphylococcus epidermidis
IKYS

SEQ ID NO: 1780605 - protein, 11 aa, Staphylococcus epidermidis
ILDEQGPKGVA

SEQ ID NO: 1780606 - protein, 4 aa, Staphylococcus epidermidis
ILED

SEQ ID NO: 1780607 - protein, 13 aa, Staphylococcus epidermidis
ILPTESKQIASTL

SEQ ID NO: 1780608 - protein, 8 aa, Staphylococcus epidermidis
ILSGEGKG

SEQ ID NO: 1780609 - protein, 11 aa, Staphylococcus epidermidis
ILSPSSTAYPY

SEQ ID NO: 1780610 - protein, 13 aa, Staphylococcus epidermidis
ILSQSSPVATQIP

SEQ ID NO: 1780611 - protein, 10 aa, Staphylococcus epidermidis
INAKDKAEIE

SEQ ID NO: 1780612 - protein, 11 aa, Staphylococcus epidermidis
INARATEIQEQ

SEQ ID NO: 1780613 - protein, 4 aa, Staphylococcus epidermidis
INDA

SEQ ID NO: 1780614 - protein, 13 aa, Staphylococcus epidermidis
INDDPKLTSLSEK

SEQ ID NO: 1780615 - protein, 9 aa, Staphylococcus epidermidis
INDDPSSFV

SEQ ID NO: 1780616 - protein, 15 aa, Staphylococcus epidermidis
INDFKGEHTKQLEFK

SEQ ID NO: 1780617 - protein, 4 aa, Staphylococcus epidermidis
INDK

SEQ ID NO: 1780618 - protein, 6 aa, Staphylococcus epidermidis
INDKET

SEQ ID NO: 1780619 - protein, 27 aa, Staphylococcus epidermidis
INDKRTEYAHTISDGNKEWKETLNREE

SEQ ID NO: 1780620 - protein, 7 aa, Staphylococcus epidermidis
INDNDDL

SEQ ID NO: 1780621 - protein, 12 aa, Staphylococcus epidermidis
INDNTSNGLKNL

SEQ ID NO: 1780622 - protein, 5 aa, Staphylococcus epidermidis
INDRE

SEQ ID NO: 1780623 - protein, 6 aa, Staphylococcus epidermidis
INDTTK

SEQ ID NO: 1780624 - protein, 7 aa, Staphylococcus epidermidis
INDYEDD

SEQ ID NO: 1780625 - protein, 6 aa, Staphylococcus epidermidis
INEDQV

SEQ ID NO: 1780626 - protein, 13 aa, Staphylococcus epidermidis
INEETYNNDGPQY

SEQ ID NO: 1780627 - protein, 10 aa, Staphylococcus epidermidis
INEGKASDKV

SEQ ID NO: 1780628 - protein, 14 aa, Staphylococcus epidermidis
INEKEKDLDKSRHE

SEQ ID NO: 1780629 - protein, 9 aa, Staphylococcus epidermidis
INEKKSKEI

SEQ ID NO: 1780630 - protein, 17 aa, Staphylococcus epidermidis
INEKKTKGANTTPETVS

SEQ ID NO: 1780631 - protein, 7 aa, Staphylococcus epidermidis
INEPQAA

SEQ ID NO: 1780632 - protein, 4 aa, Staphylococcus epidermidis
INES

SEQ ID NO: 1780633 - protein, 6 aa, Staphylococcus epidermidis
INESNV

SEQ ID NO: 1780634 - protein, 7 aa, Staphylococcus epidermidis
INETANS

SEQ ID NO: 1780635 - protein, 8 aa, Staphylococcus epidermidis
INETESER

SEQ ID NO: 1780636 - protein, 12 aa, Staphylococcus epidermidis
INETNQTSQASI

SEQ ID NO: 1780637 - protein, 4 aa, Staphylococcus epidermidis
INGA

SEQ ID NO: 1780638 - protein, 13 aa, Staphylococcus epidermidis
INGDPNSYTIPRE

SEQ ID NO: 1780639 - protein, 11 aa, Staphylococcus epidermidis
INGDSKKKHQN

SEQ ID NO: 1780640 - protein, 23 aa, Staphylococcus epidermidis
INGEEVNEQPSNFKDRAKRFFKG

SEQ ID NO: 1780641 - protein, 9 aa, Staphylococcus epidermidis
INGETKDLD

SEQ ID NO: 1780642 - protein, 14 aa, Staphylococcus epidermidis
INGGSSSSDSDNTS

SEQ ID NO: 1780643 - protein, 12 aa, Staphylococcus epidermidis
INGKSKKISNEN

SEQ ID NO: 1780644 - protein, 11 aa, Staphylococcus epidermidis
INGNTYRKETD

SEQ ID NO: 1780645 - protein, 11 aa, Staphylococcus epidermidis
INGQPLDENKT

SEQ ID NO: 1780646 - protein, 15 aa, Staphylococcus epidermidis
INGTKISSLTLNEIN

SEQ ID NO: 1780647 - protein, 45 aa, Staphylococcus epidermidis
INGTNQPTINKGDVSNATQSVKATKDALDGDHRLEEAKNHANQEI

SEQ ID NO: 1780648 - protein, 8 aa, Staphylococcus epidermidis
INHSKSNQ

SEQ ID NO: 1780649 - protein, 10 aa, Staphylococcus epidermidis
INHSQQPSLS

SEQ ID NO: 1780650 - protein, 7 aa, Staphylococcus epidermidis
INIPQRK

SEQ ID NO: 1780651 - protein, 12 aa, Staphylococcus epidermidis
INKAKSQQGPTI

SEQ ID NO: 1780652 - protein, 8 aa, Staphylococcus epidermidis
INKARGIE

SEQ ID NO: 1780653 - protein, 8 aa, Staphylococcus epidermidis
INKENKDM

SEQ ID NO: 1780654 - protein, 7 aa, Staphylococcus epidermidis
INKGDKL

SEQ ID NO: 1780655 - protein, 4 aa, Staphylococcus epidermidis
INKR

SEQ ID NO: 1780656 - protein, 14 aa, Staphylococcus epidermidis
INKRGNKKRENFYF

SEQ ID NO: 1780657 - protein, 9 aa, Staphylococcus epidermidis
INKSEKSMP

SEQ ID NO: 1780658 - protein, 12 aa, Staphylococcus epidermidis
INKYNSRSIETS

SEQ ID NO: 1780659 - protein, 4 aa, Staphylococcus epidermidis
INMQ

SEQ ID NO: 1780660 - protein, 11 aa, Staphylococcus epidermidis
INNDKESSFTA

SEQ ID NO: 1780661 - protein, 7 aa, Staphylococcus epidermidis
INNDPRG

SEQ ID NO: 1780662 - protein, 12 aa, Staphylococcus epidermidis
INNEKDIKSIKN

SEQ ID NO: 1780663 - protein, 7 aa, Staphylococcus epidermidis
INNGNIS

SEQ ID NO: 1780664 - protein, 11 aa, Staphylococcus epidermidis
INNITNKNAYG

SEQ ID NO: 1780665 - protein, 9 aa, Staphylococcus epidermidis
INNKSNNKE

SEQ ID NO: 1780666 - protein, 11 aa, Staphylococcus epidermidis
INNKSYENHQI

SEQ ID NO: 1780667 - protein, 9 aa, Staphylococcus epidermidis
INNNDTPSN

SEQ ID NO: 1780668 - protein, 11 aa, Staphylococcus epidermidis
INNSTIHSNAN

SEQ ID NO: 1780669 - protein, 6 aa, Staphylococcus epidermidis
INPATN

SEQ ID NO: 1780670 - protein, 12 aa, Staphylococcus epidermidis
INPEAATEGYVS

SEQ ID NO: 1780671 - protein, 6 aa, Staphylococcus epidermidis
INPEEY

SEQ ID NO: 1780672 - protein, 5 aa, Staphylococcus epidermidis
INPNG

SEQ ID NO: 1780673 - protein, 4 aa, Staphylococcus epidermidis
INPT

SEQ ID NO: 1780674 - protein, 13 aa, Staphylococcus epidermidis
INPTPNKQDIENS

SEQ ID NO: 1780675 - protein, 10 aa, Staphylococcus epidermidis
INQAKNNLEN

SEQ ID NO: 1780676 - protein, 8 aa, Staphylococcus epidermidis
INQDEAKE

SEQ ID NO: 1780677 - protein, 11 aa, Staphylococcus epidermidis
INQDKQNISQL

SEQ ID NO: 1780678 - protein, 4 aa, Staphylococcus epidermidis
INQE

SEQ ID NO: 1780679 - protein, 5 aa, Staphylococcus epidermidis
INQFN

SEQ ID NO: 1780680 - protein, 5 aa, Staphylococcus epidermidis
INQPI

SEQ ID NO: 1780681 - protein, 95 aa, Staphylococcus epidermidis
INQSVDNETEYAKHRDIDDTDQSSSSSESFKEQPSETIQSSQTLESEHATSTSEPHSTSSSQESQSQGSEMDTEVSHSKSEAPAKPKQRFGGSRP

SEQ ID NO: 1780682 - protein, 17 aa, Staphylococcus epidermidis
INQTSNPTLDKQKVEEA

SEQ ID NO: 1780683 - protein, 4 aa, Staphylococcus epidermidis
INRS

SEQ ID NO: 1780684 - protein, 22 aa, Staphylococcus epidermidis
INRSKASVEDIKNSLADDESLG

SEQ ID NO: 1780685 - protein, 14 aa, Staphylococcus epidermidis
INRSKELNESVPEI

SEQ ID NO: 1780686 - protein, 11 aa, Staphylococcus epidermidis
INSAQPSDELK

SEQ ID NO: 1780687 - protein, 12 aa, Staphylococcus epidermidis
INSDNIGKKGCY

SEQ ID NO: 1780688 - protein, 11 aa, Staphylococcus epidermidis
INSDQSISTRT

SEQ ID NO: 1780689 - protein, 10 aa, Staphylococcus epidermidis
INSNDENARY

SEQ ID NO: 1780690 - protein, 7 aa, Staphylococcus epidermidis
INSNQVD

SEQ ID NO: 1780691 - protein, 5 aa, Staphylococcus epidermidis
INSSD

SEQ ID NO: 1780692 - protein, 17 aa, Staphylococcus epidermidis
INSTPQQGTSISIRIPL

SEQ ID NO: 1780693 - protein, 7 aa, Staphylococcus epidermidis
INSTSTL

SEQ ID NO: 1780694 - protein, 5 aa, Staphylococcus epidermidis
INTAD

SEQ ID NO: 1780695 - protein, 20 aa, Staphylococcus epidermidis
INTKEDFKATIERSDSCAVP

SEQ ID NO: 1780696 - protein, 18 aa, Staphylococcus epidermidis
INTNRETDSNSYESNGIE

SEQ ID NO: 1780697 - protein, 7 aa, Staphylococcus epidermidis
INTSGRL

SEQ ID NO: 1780698 - protein, 7 aa, Staphylococcus epidermidis
INYQNAD

SEQ ID NO: 1780699 - protein, 5 aa, Staphylococcus epidermidis
IPAGN

SEQ ID NO: 1780700 - protein, 4 aa, Staphylococcus epidermidis
IPAL

SEQ ID NO: 1780701 - protein, 9 aa, Staphylococcus epidermidis
IPANSSSKK

SEQ ID NO: 1780702 - protein, 6 aa, Staphylococcus epidermidis
IPDAPH

SEQ ID NO: 1780703 - protein, 7 aa, Staphylococcus epidermidis
IPDDESV

SEQ ID NO: 1780704 - protein, 14 aa, Staphylococcus epidermidis
IPDDHKERAEEARA

SEQ ID NO: 1780705 - protein, 15 aa, Staphylococcus epidermidis
IPDTKFDEFRHHRGL

SEQ ID NO: 1780706 - protein, 5 aa, Staphylococcus epidermidis
IPDYA

SEQ ID NO: 1780707 - protein, 4 aa, Staphylococcus epidermidis
IPED

SEQ ID NO: 1780708 - protein, 7 aa, Staphylococcus epidermidis
IPEEIDS

SEQ ID NO: 1780709 - protein, 7 aa, Staphylococcus epidermidis
IPEESKH

SEQ ID NO: 1780710 - protein, 4 aa, Staphylococcus epidermidis
IPEK

SEQ ID NO: 1780711 - protein, 5 aa, Staphylococcus epidermidis
IPEKA

SEQ ID NO: 1780712 - protein, 5 aa, Staphylococcus epidermidis
IPENK

SEQ ID NO: 1780713 - protein, 13 aa, Staphylococcus epidermidis
IPENPSEEDKDWG

SEQ ID NO: 1780714 - protein, 10 aa, Staphylococcus epidermidis
IPENQKYGAF

SEQ ID NO: 1780715 - protein, 7 aa, Staphylococcus epidermidis
IPEPKGK

SEQ ID NO: 1780716 - protein, 5 aa, Staphylococcus epidermidis
IPEQY

SEQ ID NO: 1780717 - protein, 9 aa, Staphylococcus epidermidis
IPESENANN

SEQ ID NO: 1780718 - protein, 4 aa, Staphylococcus epidermidis
IPET

SEQ ID NO: 1780719 - protein, 6 aa, Staphylococcus epidermidis
IPFEGD

SEQ ID NO: 1780720 - protein, 5 aa, Staphylococcus epidermidis
IPGGA

SEQ ID NO: 1780721 - protein, 11 aa, Staphylococcus epidermidis
IPGIGPSKAKD

SEQ ID NO: 1780722 - protein, 5 aa, Staphylococcus epidermidis
IPGNG

SEQ ID NO: 1780723 - protein, 18 aa, Staphylococcus epidermidis
IPGNRLGENGTPNNWDPE

SEQ ID NO: 1780724 - protein, 7 aa, Staphylococcus epidermidis
IPGYRRN

SEQ ID NO: 1780725 - protein, 4 aa, Staphylococcus epidermidis
IPHE

SEQ ID NO: 1780726 - protein, 6 aa, Staphylococcus epidermidis
IPIKRR

SEQ ID NO: 1780727 - protein, 13 aa, Staphylococcus epidermidis
IPKDPKNGDYSSN

SEQ ID NO: 1780728 - protein, 7 aa, Staphylococcus epidermidis
IPKNKNK

SEQ ID NO: 1780729 - protein, 4 aa, Staphylococcus epidermidis
IPKQ

SEQ ID NO: 1780730 - protein, 6 aa, Staphylococcus epidermidis
IPKQLG

SEQ ID NO: 1780731 - protein, 6 aa, Staphylococcus epidermidis
IPKRVK

SEQ ID NO: 1780732 - protein, 5 aa, Staphylococcus epidermidis
IPKTE

SEQ ID NO: 1780733 - protein, 6 aa, Staphylococcus epidermidis
IPNNEI

SEQ ID NO: 1780734 - protein, 5 aa, Staphylococcus epidermidis
IPNRQ

SEQ ID NO: 1780735 - protein, 9 aa, Staphylococcus epidermidis
IPNTVSKAM

SEQ ID NO: 1780736 - protein, 63 aa, Staphylococcus epidermidis
IPPEHKELNDKEIVQKDEVSHSTKSVDASINVSNSNDDNVEKNQQKKQQTTAQTESSSENIHN

SEQ ID NO: 1780737 - protein, 10 aa, Staphylococcus epidermidis
IPPKKDGGTE

SEQ ID NO: 1780738 - protein, 33 aa, Staphylococcus epidermidis
IPPKQESQNDDSKDKNNKDSDSKQSQRHASNEY

SEQ ID NO: 1780739 - protein, 6 aa, Staphylococcus epidermidis
IPQGRE

SEQ ID NO: 1780740 - protein, 9 aa, Staphylococcus epidermidis
IPQNNESTP

SEQ ID NO: 1780741 - protein, 4 aa, Staphylococcus epidermidis
IPQS

SEQ ID NO: 1780742 - protein, 9 aa, Staphylococcus epidermidis
IPRKPGMTR

SEQ ID NO: 1780743 - protein, 4 aa, Staphylococcus epidermidis
IPSE

SEQ ID NO: 1780744 - protein, 9 aa, Staphylococcus epidermidis
IPSEDAGKC

SEQ ID NO: 1780745 - protein, 5 aa, Staphylococcus epidermidis
IPSEE

SEQ ID NO: 1780746 - protein, 8 aa, Staphylococcus epidermidis
IPSNSTGE

SEQ ID NO: 1780747 - protein, 9 aa, Staphylococcus epidermidis
IPSRIKENY

SEQ ID NO: 1780748 - protein, 13 aa, Staphylococcus epidermidis
IPSSEGKISAEGV

SEQ ID NO: 1780749 - protein, 16 aa, Staphylococcus epidermidis
IPSSLGGKGIGTNPDE

SEQ ID NO: 1780750 - protein, 16 aa, Staphylococcus epidermidis
IPSSLGGQGKGTNPDE

SEQ ID NO: 1780751 - protein, 15 aa, Staphylococcus epidermidis
IPTADYKEVSNRKDA

SEQ ID NO: 1780752 - protein, 12 aa, Staphylococcus epidermidis
IPTDVTKKDSVD

SEQ ID NO: 1780753 - protein, 8 aa, Staphylococcus epidermidis
IPTPNEVS

SEQ ID NO: 1780754 - protein, 4 aa, Staphylococcus epidermidis
IPTQ

SEQ ID NO: 1780755 - protein, 5 aa, Staphylococcus epidermidis
IPTQG

SEQ ID NO: 1780756 - protein, 6 aa, Staphylococcus epidermidis
IPTQSV

SEQ ID NO: 1780757 - protein, 6 aa, Staphylococcus epidermidis
IPTSDD

SEQ ID NO: 1780758 - protein, 12 aa, Staphylococcus epidermidis
IPTSIESSGTKQ

SEQ ID NO: 1780759 - protein, 4 aa, Staphylococcus epidermidis
IPYA

SEQ ID NO: 1780760 - protein, 14 aa, Staphylococcus epidermidis
IQATGKIEKTNAKT

SEQ ID NO: 1780761 - protein, 6 aa, Staphylococcus epidermidis
IQCQEE

SEQ ID NO: 1780762 - protein, 28 aa, Staphylococcus epidermidis
IQDAKEALNGEQRLNDAQTKAHKAIDDT

SEQ ID NO: 1780763 - protein, 6 aa, Staphylococcus epidermidis
IQDDSQ

SEQ ID NO: 1780764 - protein, 9 aa, Staphylococcus epidermidis
IQDGKNGYL

SEQ ID NO: 1780765 - protein, 8 aa, Staphylococcus epidermidis
IQDQEGKY

SEQ ID NO: 1780766 - protein, 8 aa, Staphylococcus epidermidis
IQDRSSRD

SEQ ID NO: 1780767 - protein, 22 aa, Staphylococcus epidermidis
IQEAAKATTGKVVNNTGQVCTA

SEQ ID NO: 1780768 - protein, 10 aa, Staphylococcus epidermidis
IQEESYSNED

SEQ ID NO: 1780769 - protein, 17 aa, Staphylococcus epidermidis
IQELNQNDTITVEIDDN

SEQ ID NO: 1780770 - protein, 12 aa, Staphylococcus epidermidis
IQETTQHKIEER

SEQ ID NO: 1780771 - protein, 6 aa, Staphylococcus epidermidis
IQGEDA

SEQ ID NO: 1780772 - protein, 4 aa, Staphylococcus epidermidis
IQGN

SEQ ID NO: 1780773 - protein, 10 aa, Staphylococcus epidermidis
IQGPKARDLV

SEQ ID NO: 1780774 - protein, 7 aa, Staphylococcus epidermidis
IQGPRSR

SEQ ID NO: 1780775 - protein, 5 aa, Staphylococcus epidermidis
IQGST

SEQ ID NO: 1780776 - protein, 6 aa, Staphylococcus epidermidis
IQGSTF

SEQ ID NO: 1780777 - protein, 5 aa, Staphylococcus epidermidis
IQKGD

SEQ ID NO: 1780778 - protein, 6 aa, Staphylococcus epidermidis
IQKGER

SEQ ID NO: 1780779 - protein, 11 aa, Staphylococcus epidermidis
IQKKGKALESR

SEQ ID NO: 1780780 - protein, 10 aa, Staphylococcus epidermidis
IQKRDDLEKQ

SEQ ID NO: 1780781 - protein, 8 aa, Staphylococcus epidermidis
IQKRDELE

SEQ ID NO: 1780782 - protein, 16 aa, Staphylococcus epidermidis
IQLDDAPENIKRNQSY

SEQ ID NO: 1780783 - protein, 16 aa, Staphylococcus epidermidis
IQLDDSPEHIKNTQNN

SEQ ID NO: 1780784 - protein, 16 aa, Staphylococcus epidermidis
IQLDDSPENIKRNQSY

SEQ ID NO: 1780785 - protein, 12 aa, Staphylococcus epidermidis
IQNGDESKIREK

SEQ ID NO: 1780786 - protein, 6 aa, Staphylococcus epidermidis
IQNGQN

SEQ ID NO: 1780787 - protein, 12 aa, Staphylococcus epidermidis
IQPAQPFERGVA

SEQ ID NO: 1780788 - protein, 6 aa, Staphylococcus epidermidis
IQPEHR

SEQ ID NO: 1780789 - protein, 6 aa, Staphylococcus epidermidis
IQPEVK

SEQ ID NO: 1780790 - protein, 10 aa, Staphylococcus epidermidis
IQPGTRGTKV

SEQ ID NO: 1780791 - protein, 5 aa, Staphylococcus epidermidis
IQPKT

SEQ ID NO: 1780792 - protein, 18 aa, Staphylococcus epidermidis
IQPLPNDKDSIISYIKGA

SEQ ID NO: 1780793 - protein, 8 aa, Staphylococcus epidermidis
IQPNEASQ

SEQ ID NO: 1780794 - protein, 7 aa, Staphylococcus epidermidis
IQPQGGI

SEQ ID NO: 1780795 - protein, 5 aa, Staphylococcus epidermidis
IQPTD

SEQ ID NO: 1780796 - protein, 21 aa, Staphylococcus epidermidis
IQQDGRQKRQAAEKELNGLEQ

SEQ ID NO: 1780797 - protein, 26 aa, Staphylococcus epidermidis
IQQDPKHKSYYEENYKNLDKEIKDID

SEQ ID NO: 1780798 - protein, 10 aa, Staphylococcus epidermidis
IQQKGEGLKT

SEQ ID NO: 1780799 - protein, 10 aa, Staphylococcus epidermidis
IQQKGKGLKT

SEQ ID NO: 1780800 - protein, 8 aa, Staphylococcus epidermidis
IQRNESQK

SEQ ID NO: 1780801 - protein, 6 aa, Staphylococcus epidermidis
IQRQET

SEQ ID NO: 1780802 - protein, 37 aa, Staphylococcus epidermidis
IQRQQQEREDDNDIQPKRPTSNRDEPTQRDTGVTQSD

SEQ ID NO: 1780803 - protein, 39 aa, Staphylococcus epidermidis
IQRQQQTERASNTEFQPKRPTSSRDESTERDTGVTQSDW

SEQ ID NO: 1780804 - protein, 18 aa, Staphylococcus epidermidis
IQSDEEAQGIYHTLLKSI

SEQ ID NO: 1780805 - protein, 8 aa, Staphylococcus epidermidis
IQSETMES

SEQ ID NO: 1780806 - protein, 5 aa, Staphylococcus epidermidis
IQSGD

SEQ ID NO: 1780807 - protein, 4 aa, Staphylococcus epidermidis
IQSN

SEQ ID NO: 1780808 - protein, 4 aa, Staphylococcus epidermidis
IQTL

SEQ ID NO: 1780809 - protein, 4 aa, Staphylococcus epidermidis
IQTN

SEQ ID NO: 1780810 - protein, 7 aa, Staphylococcus epidermidis
IQTPNSY

SEQ ID NO: 1780811 - protein, 41 aa, Staphylococcus epidermidis
IQTQEQAIDESNNSKDTQYNQNLNTTSTIRNNNLTTIQITN

SEQ ID NO: 1780812 - protein, 16 aa, Staphylococcus epidermidis
IQTSDNRVLPKGTGYI

SEQ ID NO: 1780813 - protein, 5 aa, Staphylococcus epidermidis
IQTSR

SEQ ID NO: 1780814 - protein, 10 aa, Staphylococcus epidermidis
IQVNGQNITS

SEQ ID NO: 1780815 - protein, 10 aa, Staphylococcus epidermidis
IQYDPNRSAN

SEQ ID NO: 1780816 - protein, 6 aa, Staphylococcus epidermidis
IRDELA

SEQ ID NO: 1780817 - protein, 4 aa, Staphylococcus epidermidis
IRDG

SEQ ID NO: 1780818 - protein, 10 aa, Staphylococcus epidermidis
IRDKNDVAET

SEQ ID NO: 1780819 - protein, 5 aa, Staphylococcus epidermidis
IRDNS

SEQ ID NO: 1780820 - protein, 11 aa, Staphylococcus epidermidis
IREGTQFNGYT

SEQ ID NO: 1780821 - protein, 14 aa, Staphylococcus epidermidis
IREPEVDSPVQNGP

SEQ ID NO: 1780822 - protein, 8 aa, Staphylococcus epidermidis
IREQTGRI

SEQ ID NO: 1780823 - protein, 6 aa, Staphylococcus epidermidis
IRESDG

SEQ ID NO: 1780824 - protein, 11 aa, Staphylococcus epidermidis
IRETSVDFNTR

SEQ ID NO: 1780825 - protein, 10 aa, Staphylococcus epidermidis
IRFSDQKREF

SEQ ID NO: 1780826 - protein, 12 aa, Staphylococcus epidermidis
IRGDLTQKAETH

SEQ ID NO: 1780827 - protein, 15 aa, Staphylococcus epidermidis
IRGNAKQAIDNPLPK

SEQ ID NO: 1780828 - protein, 5 aa, Staphylococcus epidermidis
IRIGS

SEQ ID NO: 1780829 - protein, 7 aa, Staphylococcus epidermidis
IRKATTD

SEQ ID NO: 1780830 - protein, 14 aa, Staphylococcus epidermidis
IRKPEPHSPVKDGP

SEQ ID NO: 1780831 - protein, 14 aa, Staphylococcus epidermidis
IRKTGSYQVPSDPM

SEQ ID NO: 1780832 - protein, 6 aa, Staphylococcus epidermidis
IRPEVQ

SEQ ID NO: 1780833 - protein, 9 aa, Staphylococcus epidermidis
IRPKNNSEL

SEQ ID NO: 1780834 - protein, 20 aa, Staphylococcus epidermidis
IRPKQSKLGKVERSKASNPF

SEQ ID NO: 1780835 - protein, 9 aa, Staphylococcus epidermidis
IRPNKTAVI

SEQ ID NO: 1780836 - protein, 10 aa, Staphylococcus epidermidis
IRQSKNSNDI

SEQ ID NO: 1780837 - protein, 4 aa, Staphylococcus epidermidis
IRRE

SEQ ID NO: 1780838 - protein, 11 aa, Staphylococcus epidermidis
IRSDENKNKID

SEQ ID NO: 1780839 - protein, 5 aa, Staphylococcus epidermidis
IRSDK

SEQ ID NO: 1780840 - protein, 4 aa, Staphylococcus epidermidis
IRSG

SEQ ID NO: 1780841 - protein, 9 aa, Staphylococcus epidermidis
IRSKGNNEL

SEQ ID NO: 1780842 - protein, 5 aa, Staphylococcus epidermidis
IRSQA

SEQ ID NO: 1780843 - protein, 11 aa, Staphylococcus epidermidis
IRSTREGRVTA

SEQ ID NO: 1780844 - protein, 8 aa, Staphylococcus epidermidis
IRTKNGQN

SEQ ID NO: 1780845 - protein, 14 aa, Staphylococcus epidermidis
IRTKNGQNMAFVTY

SEQ ID NO: 1780846 - protein, 11 aa, Staphylococcus epidermidis
IRTKSNPNDLV

SEQ ID NO: 1780847 - protein, 9 aa, Staphylococcus epidermidis
IRTPKDIDT

SEQ ID NO: 1780848 - protein, 8 aa, Staphylococcus epidermidis
IRTPQDID

SEQ ID NO: 1780849 - protein, 8 aa, Staphylococcus epidermidis
IRYGSEES

SEQ ID NO: 1780850 - protein, 8 aa, Staphylococcus epidermidis
ISADDYRK

SEQ ID NO: 1780851 - protein, 8 aa, Staphylococcus epidermidis
ISANQESE

SEQ ID NO: 1780852 - protein, 7 aa, Staphylococcus epidermidis
ISATKGY

SEQ ID NO: 1780853 - protein, 7 aa, Staphylococcus epidermidis
ISDAKDH

SEQ ID NO: 1780854 - protein, 8 aa, Staphylococcus epidermidis
ISDDIAKD

SEQ ID NO: 1780855 - protein, 5 aa, Staphylococcus epidermidis
ISDEE

SEQ ID NO: 1780856 - protein, 4 aa, Staphylococcus epidermidis
ISDI

SEQ ID NO: 1780857 - protein, 6 aa, Staphylococcus epidermidis
ISDKHL

SEQ ID NO: 1780858 - protein, 43 aa, Staphylococcus epidermidis
ISDLGDNIGEDDKKNAEEKKDALKSALEGEDIEDIKSKKEELE

SEQ ID NO: 1780859 - protein, 18 aa, Staphylococcus epidermidis
ISDLGREKVEQMAPATDF

SEQ ID NO: 1780860 - protein, 4 aa, Staphylococcus epidermidis
ISDT

SEQ ID NO: 1780861 - protein, 9 aa, Staphylococcus epidermidis
ISEARASEK

SEQ ID NO: 1780862 - protein, 6 aa, Staphylococcus epidermidis
ISEDPS

SEQ ID NO: 1780863 - protein, 10 aa, Staphylococcus epidermidis
ISEEDKETLR

SEQ ID NO: 1780864 - protein, 8 aa, Staphylococcus epidermidis
ISEENRAN

SEQ ID NO: 1780865 - protein, 13 aa, Staphylococcus epidermidis
ISEETFNDLTAQF

SEQ ID NO: 1780866 - protein, 6 aa, Staphylococcus epidermidis
ISEGAR

SEQ ID NO: 1780867 - protein, 11 aa, Staphylococcus epidermidis
ISEKNARIAKQ

SEQ ID NO: 1780868 - protein, 10 aa, Staphylococcus epidermidis
ISEKTKKELV

SEQ ID NO: 1780869 - protein, 5 aa, Staphylococcus epidermidis
ISENE

SEQ ID NO: 1780870 - protein, 13 aa, Staphylococcus epidermidis
ISENKAGEDAEAT

SEQ ID NO: 1780871 - protein, 11 aa, Staphylococcus epidermidis
ISEPDENGNRT

SEQ ID NO: 1780872 - protein, 11 aa, Staphylococcus epidermidis
ISEPDQRRGVA

SEQ ID NO: 1780873 - protein, 15 aa, Staphylococcus epidermidis
ISEQSYRNREKGKIN

SEQ ID NO: 1780874 - protein, 8 aa, Staphylococcus epidermidis
ISEQTYEQ

SEQ ID NO: 1780875 - protein, 6 aa, Staphylococcus epidermidis
ISESDE

SEQ ID NO: 1780876 - protein, 7 aa, Staphylococcus epidermidis
ISESTLN

SEQ ID NO: 1780877 - protein, 6 aa, Staphylococcus epidermidis
ISETGS

SEQ ID NO: 1780878 - protein, 8 aa, Staphylococcus epidermidis
ISEYENEL

SEQ ID NO: 1780879 - protein, 5 aa, Staphylococcus epidermidis
ISGNE

SEQ ID NO: 1780880 - protein, 4 aa, Staphylococcus epidermidis
ISGQ

SEQ ID NO: 1780881 - protein, 5 aa, Staphylococcus epidermidis
ISGQN

SEQ ID NO: 1780882 - protein, 12 aa, Staphylococcus epidermidis
ISGSTGSSTGPH

SEQ ID NO: 1780883 - protein, 10 aa, Staphylococcus epidermidis
ISIDSPQRIR

SEQ ID NO: 1780884 - protein, 8 aa, Staphylococcus epidermidis
ISISDEEL

SEQ ID NO: 1780885 - protein, 18 aa, Staphylococcus epidermidis
ISKDGKKKVYSITEEGEK

SEQ ID NO: 1780886 - protein, 12 aa, Staphylococcus epidermidis
ISKDGKYAKTSY

SEQ ID NO: 1780887 - protein, 7 aa, Staphylococcus epidermidis
ISKEERA

SEQ ID NO: 1780888 - protein, 26 aa, Staphylococcus epidermidis
ISKEYNNDTELNNTDYIKTNSNDMND

SEQ ID NO: 1780889 - protein, 24 aa, Staphylococcus epidermidis
ISKNEKDELRKSSIKQFNPKTGEV

SEQ ID NO: 1780890 - protein, 5 aa, Staphylococcus epidermidis
ISKNP

SEQ ID NO: 1780891 - protein, 6 aa, Staphylococcus epidermidis
ISKNTG

SEQ ID NO: 1780892 - protein, 24 aa, Staphylococcus epidermidis
ISKSKNEDAMNMSDEDTNDQFDDQ

SEQ ID NO: 1780893 - protein, 4 aa, Staphylococcus epidermidis
ISLD

SEQ ID NO: 1780894 - protein, 8 aa, Staphylococcus epidermidis
ISNDDEEV

SEQ ID NO: 1780895 - protein, 8 aa, Staphylococcus epidermidis
ISNEADTE

SEQ ID NO: 1780896 - protein, 8 aa, Staphylococcus epidermidis
ISNETNIN

SEQ ID NO: 1780897 - protein, 6 aa, Staphylococcus epidermidis
ISNGDN

SEQ ID NO: 1780898 - protein, 8 aa, Staphylococcus epidermidis
ISNQEKAT

SEQ ID NO: 1780899 - protein, 4 aa, Staphylococcus epidermidis
ISNS

SEQ ID NO: 1780900 - protein, 15 aa, Staphylococcus epidermidis
ISNSPKTEFIFNYIY

SEQ ID NO: 1780901 - protein, 5 aa, Staphylococcus epidermidis
ISPDT

SEQ ID NO: 1780902 - protein, 6 aa, Staphylococcus epidermidis
ISPEDQ

SEQ ID NO: 1780903 - protein, 6 aa, Staphylococcus epidermidis
ISPEGA

SEQ ID NO: 1780904 - protein, 6 aa, Staphylococcus epidermidis
ISPKEA

SEQ ID NO: 1780905 - protein, 12 aa, Staphylococcus epidermidis
ISPKPPSSTMKP

SEQ ID NO: 1780906 - protein, 23 aa, Staphylococcus epidermidis
ISPLKKADDAITLDTTGKSIEEV

SEQ ID NO: 1780907 - protein, 15 aa, Staphylococcus epidermidis
ISPNTKSNNYNEPTQ

SEQ ID NO: 1780908 - protein, 8 aa, Staphylococcus epidermidis
ISPNYTGY

SEQ ID NO: 1780909 - protein, 14 aa, Staphylococcus epidermidis
ISPQRYQLKESGKA

SEQ ID NO: 1780910 - protein, 9 aa, Staphylococcus epidermidis
ISPSAKIGY

SEQ ID NO: 1780911 - protein, 6 aa, Staphylococcus epidermidis
ISPTKG

SEQ ID NO: 1780912 - protein, 7 aa, Staphylococcus epidermidis
ISPYDNE

SEQ ID NO: 1780913 - protein, 8 aa, Staphylococcus epidermidis
ISQDEAEA

SEQ ID NO: 1780914 - protein, 10 aa, Staphylococcus epidermidis
ISQEDAEKYV

SEQ ID NO: 1780915 - protein, 7 aa, Staphylococcus epidermidis
ISQGSKS

SEQ ID NO: 1780916 - protein, 8 aa, Staphylococcus epidermidis
ISQHEPGL

SEQ ID NO: 1780917 - protein, 14 aa, Staphylococcus epidermidis
ISQKENSNFGNRKH

SEQ ID NO: 1780918 - protein, 7 aa, Staphylococcus epidermidis
ISQLSQK

SEQ ID NO: 1780919 - protein, 7 aa, Staphylococcus epidermidis
ISQSENN

SEQ ID NO: 1780920 - protein, 17 aa, Staphylococcus epidermidis
ISRDDFKKDEEKYQKEI

SEQ ID NO: 1780921 - protein, 5 aa, Staphylococcus epidermidis
ISREE

SEQ ID NO: 1780922 - protein, 7 aa, Staphylococcus epidermidis
ISRETTG

SEQ ID NO: 1780923 - protein, 7 aa, Staphylococcus epidermidis
ISRTEAE

SEQ ID NO: 1780924 - protein, 9 aa, Staphylococcus epidermidis
ISRTSSDIG

SEQ ID NO: 1780925 - protein, 11 aa, Staphylococcus epidermidis
ISSDAPEEQLE

SEQ ID NO: 1780926 - protein, 4 aa, Staphylococcus epidermidis
ISSE

SEQ ID NO: 1780927 - protein, 11 aa, Staphylococcus epidermidis
ISSEETEEMTN

SEQ ID NO: 1780928 - protein, 6 aa, Staphylococcus epidermidis
ISSEGL

SEQ ID NO: 1780929 - protein, 4 aa, Staphylococcus epidermidis
ISSG

SEQ ID NO: 1780930 - protein, 11 aa, Staphylococcus epidermidis
ISSGPLPSQSA

SEQ ID NO: 1780931 - protein, 22 aa, Staphylococcus epidermidis
ISSKSKIKYATPKKTVRSRLGN

SEQ ID NO: 1780932 - protein, 15 aa, Staphylococcus epidermidis
ISSKSQIKYDTPKDV

SEQ ID NO: 1780933 - protein, 5 aa, Staphylococcus epidermidis
ISSNN

SEQ ID NO: 1780934 - protein, 4 aa, Staphylococcus epidermidis
ISST

SEQ ID NO: 1780935 - protein, 5 aa, Staphylococcus epidermidis
ISSTE

SEQ ID NO: 1780936 - protein, 8 aa, Staphylococcus epidermidis
ISTDEARS

SEQ ID NO: 1780937 - protein, 15 aa, Staphylococcus epidermidis
ISTGNGNVKRQRLDS

SEQ ID NO: 1780938 - protein, 8 aa, Staphylococcus epidermidis
ISTLSGGQ

SEQ ID NO: 1780939 - protein, 5 aa, Staphylococcus epidermidis
ISTPY

SEQ ID NO: 1780940 - protein, 4 aa, Staphylococcus epidermidis
ISTQ

SEQ ID NO: 1780941 - protein, 7 aa, Staphylococcus epidermidis
ISTQTLQ

SEQ ID NO: 1780942 - protein, 7 aa, Staphylococcus epidermidis
ISTSPNL

SEQ ID NO: 1780943 - protein, 15 aa, Staphylococcus epidermidis
ISYPSHTQKFKETKS

SEQ ID NO: 1780944 - protein, 9 aa, Staphylococcus epidermidis
ITASDEKER

SEQ ID NO: 1780945 - protein, 9 aa, Staphylococcus epidermidis
ITASEEKER

SEQ ID NO: 1780946 - protein, 5 aa, Staphylococcus epidermidis
ITDAE

SEQ ID NO: 1780947 - protein, 14 aa, Staphylococcus epidermidis
ITDDQVGNGESIFD

SEQ ID NO: 1780948 - protein, 6 aa, Staphylococcus epidermidis
ITDDST

SEQ ID NO: 1780949 - protein, 20 aa, Staphylococcus epidermidis
ITDKEAKIKKEKELYGKIKW

SEQ ID NO: 1780950 - protein, 20 aa, Staphylococcus epidermidis
ITDKQERIKKEEKLYGKIKW

SEQ ID NO: 1780951 - protein, 10 aa, Staphylococcus epidermidis
ITDNHNKKLK

SEQ ID NO: 1780952 - protein, 6 aa, Staphylococcus epidermidis
ITDNTT

SEQ ID NO: 1780953 - protein, 6 aa, Staphylococcus epidermidis
ITDQKQ

SEQ ID NO: 1780954 - protein, 12 aa, Staphylococcus epidermidis
ITDSNENSGVGK

SEQ ID NO: 1780955 - protein, 11 aa, Staphylococcus epidermidis
ITEDEAFNHPQ

SEQ ID NO: 1780956 - protein, 6 aa, Staphylococcus epidermidis
ITEDKN

SEQ ID NO: 1780957 - protein, 6 aa, Staphylococcus epidermidis
ITENED

SEQ ID NO: 1780958 - protein, 4 aa, Staphylococcus epidermidis
ITES

SEQ ID NO: 1780959 - protein, 8 aa, Staphylococcus epidermidis
ITGAPKLS

SEQ ID NO: 1780960 - protein, 9 aa, Staphylococcus epidermidis
ITGETRTYK

SEQ ID NO: 1780961 - protein, 4 aa, Staphylococcus epidermidis
ITGF

SEQ ID NO: 1780962 - protein, 10 aa, Staphylococcus epidermidis
ITGKVSDARP

SEQ ID NO: 1780963 - protein, 6 aa, Staphylococcus epidermidis
ITGRTE

SEQ ID NO: 1780964 - protein, 4 aa, Staphylococcus epidermidis
ITGS

SEQ ID NO: 1780965 - protein, 13 aa, Staphylococcus epidermidis
ITGTVQKVNGGWY

SEQ ID NO: 1780966 - protein, 8 aa, Staphylococcus epidermidis
ITKDTGAK

SEQ ID NO: 1780967 - protein, 5 aa, Staphylococcus epidermidis
ITKYT

SEQ ID NO: 1780968 - protein, 6 aa, Staphylococcus epidermidis
ITLNGK

SEQ ID NO: 1780969 - protein, 7 aa, Staphylococcus epidermidis
ITNDEKV

SEQ ID NO: 1780970 - protein, 8 aa, Staphylococcus epidermidis
ITNDQETL

SEQ ID NO: 1780971 - protein, 14 aa, Staphylococcus epidermidis
ITNEKSKANQFNRT

SEQ ID NO: 1780972 - protein, 29 aa, Staphylococcus epidermidis
ITNGNGKVEIKGKRRKKTLENMKSSFSNS

SEQ ID NO: 1780973 - protein, 5 aa, Staphylococcus epidermidis
ITNKQ

SEQ ID NO: 1780974 - protein, 7 aa, Staphylococcus epidermidis
ITNPYTG

SEQ ID NO: 1780975 - protein, 7 aa, Staphylococcus epidermidis
ITNRKDI

SEQ ID NO: 1780976 - protein, 5 aa, Staphylococcus epidermidis
ITNTS

SEQ ID NO: 1780977 - protein, 7 aa, Staphylococcus epidermidis
ITNVESK

SEQ ID NO: 1780978 - protein, 5 aa, Staphylococcus epidermidis
ITPDD

SEQ ID NO: 1780979 - protein, 5 aa, Staphylococcus epidermidis
ITPDS

SEQ ID NO: 1780980 - protein, 6 aa, Staphylococcus epidermidis
ITPKED

SEQ ID NO: 1780981 - protein, 18 aa, Staphylococcus epidermidis
ITPNSESQNAIGENIYSP

SEQ ID NO: 1780982 - protein, 16 aa, Staphylococcus epidermidis
ITPNTEPIRGGTDGSQ

SEQ ID NO: 1780983 - protein, 7 aa, Staphylococcus epidermidis
ITPQQVK

SEQ ID NO: 1780984 - protein, 8 aa, Staphylococcus epidermidis
ITPTKGSI

SEQ ID NO: 1780985 - protein, 4 aa, Staphylococcus epidermidis
ITQE

SEQ ID NO: 1780986 - protein, 14 aa, Staphylococcus epidermidis
ITQETSDIKSFTVE

SEQ ID NO: 1780987 - protein, 9 aa, Staphylococcus epidermidis
ITQIEDNGK

SEQ ID NO: 1780988 - protein, 16 aa, Staphylococcus epidermidis
ITQNESAKNDKDVYDQ

SEQ ID NO: 1780989 - protein, 6 aa, Staphylococcus epidermidis
ITQNGI

SEQ ID NO: 1780990 - protein, 7 aa, Staphylococcus epidermidis
ITQNGVT

SEQ ID NO: 1780991 - protein, 6 aa, Staphylococcus epidermidis
ITQQYS

SEQ ID NO: 1780992 - protein, 8 aa, Staphylococcus epidermidis
ITQSMENK

SEQ ID NO: 1780993 - protein, 10 aa, Staphylococcus epidermidis
ITRDDDGAYV

SEQ ID NO: 1780994 - protein, 7 aa, Staphylococcus epidermidis
ITREASN

SEQ ID NO: 1780995 - protein, 27 aa, Staphylococcus epidermidis
ITREEQDQFAAHSQQKAEHAQETGGFD

SEQ ID NO: 1780996 - protein, 4 aa, Staphylococcus epidermidis
ITSE

SEQ ID NO: 1780997 - protein, 9 aa, Staphylococcus epidermidis
ITSEEQYRS

SEQ ID NO: 1780998 - protein, 7 aa, Staphylococcus epidermidis
ITSNEPF

SEQ ID NO: 1780999 - protein, 7 aa, Staphylococcus epidermidis
ITSPGDV

SEQ ID NO: 1781000 - protein, 6 aa, Staphylococcus epidermidis
ITSPSK

SEQ ID NO: 1781001 - protein, 8 aa, Staphylococcus epidermidis
ITSQNHGY

SEQ ID NO: 1781002 - protein, 9 aa, Staphylococcus epidermidis
ITSQNHGYS

SEQ ID NO: 1781003 - protein, 20 aa, Staphylococcus epidermidis
ITSQNHGYSIDRDSLKNTDL

SEQ ID NO: 1781004 - protein, 10 aa, Staphylococcus epidermidis
ITSSDKLEEV

SEQ ID NO: 1781005 - protein, 11 aa, Staphylococcus epidermidis
ITSSEQETRDL

SEQ ID NO: 1781006 - protein, 9 aa, Staphylococcus epidermidis
ITSTEEIPF

SEQ ID NO: 1781007 - protein, 7 aa, Staphylococcus epidermidis
ITSYNQN

SEQ ID NO: 1781008 - protein, 5 aa, Staphylococcus epidermidis
ITTDK

SEQ ID NO: 1781009 - protein, 19 aa, Staphylococcus epidermidis
ITTEDKKGRVYNKEKNTLF

SEQ ID NO: 1781010 - protein, 20 aa, Staphylococcus epidermidis
ITTEDKKRRVHSKDKEYPVR

SEQ ID NO: 1781011 - protein, 8 aa, Staphylococcus epidermidis
ITTKEDKN

SEQ ID NO: 1781012 - protein, 4 aa, Staphylococcus epidermidis
ITTS

SEQ ID NO: 1781013 - protein, 11 aa, Staphylococcus epidermidis
ITTSDKEQEVK

SEQ ID NO: 1781014 - protein, 6 aa, Staphylococcus epidermidis
ITTSGG

SEQ ID NO: 1781015 - protein, 12 aa, Staphylococcus epidermidis
ITTTDNSKDVLT

SEQ ID NO: 1781016 - protein, 5 aa, Staphylococcus epidermidis
ITVSG

SEQ ID NO: 1781017 - protein, 5 aa, Staphylococcus epidermidis
ITYGS

SEQ ID NO: 1781018 - protein, 10 aa, Staphylococcus epidermidis
ITYKNKSESL

SEQ ID NO: 1781019 - protein, 11 aa, Staphylococcus epidermidis
ITYSNNEDGIG

SEQ ID NO: 1781020 - protein, 10 aa, Staphylococcus epidermidis
IVANGSTQEV

SEQ ID NO: 1781021 - protein, 10 aa, Staphylococcus epidermidis
IVATGQTEEV

SEQ ID NO: 1781022 - protein, 5 aa, Staphylococcus epidermidis
IVEDE

SEQ ID NO: 1781023 - protein, 6 aa, Staphylococcus epidermidis
IVENNG

SEQ ID NO: 1781024 - protein, 5 aa, Staphylococcus epidermidis
IVGPG

SEQ ID NO: 1781025 - protein, 8 aa, Staphylococcus epidermidis
IVKNTPDS

SEQ ID NO: 1781026 - protein, 10 aa, Staphylococcus epidermidis
IVKQPQLTKT

SEQ ID NO: 1781027 - protein, 10 aa, Staphylococcus epidermidis
IVNSETGEIV

SEQ ID NO: 1781028 - protein, 13 aa, Staphylococcus epidermidis
IVSHSSHSNHQSL

SEQ ID NO: 1781029 - protein, 10 aa, Staphylococcus epidermidis
IVTEAEKTRL

SEQ ID NO: 1781030 - protein, 18 aa, Staphylococcus epidermidis
IVTETTEEELNQYKDNDL

SEQ ID NO: 1781031 - protein, 18 aa, Staphylococcus epidermidis
IVTGTTEEELNQYKDNDL

SEQ ID NO: 1781032 - protein, 10 aa, Staphylococcus epidermidis
IVTSDADQFT

SEQ ID NO: 1781033 - protein, 4 aa, Staphylococcus epidermidis
IYKQ

SEQ ID NO: 1781034 - protein, 5 aa, Staphylococcus epidermidis
IYKQT

SEQ ID NO: 1781035 - protein, 11 aa, Staphylococcus epidermidis
IYKTQNAGYQN

SEQ ID NO: 1781036 - protein, 10 aa, Staphylococcus epidermidis
IYKTQNTGYQ

SEQ ID NO: 1781037 - protein, 7 aa, Staphylococcus epidermidis
IYNRPRG

SEQ ID NO: 1781038 - protein, 6 aa, Staphylococcus epidermidis
IYPPGA

SEQ ID NO: 1781039 - protein, 5 aa, Staphylococcus epidermidis
IYRSD

SEQ ID NO: 1781040 - protein, 7 aa, Staphylococcus epidermidis
IYSSAGD

SEQ ID NO: 1781041 - protein, 9 aa, Staphylococcus epidermidis
IYTEDPQRD

SEQ ID NO: 1781042 - protein, 4 aa, Staphylococcus epidermidis
IYTT

SEQ ID NO: 1781043 - protein, 13 aa, Staphylococcus epidermidis
KAAADEAKEYQYQ

SEQ ID NO: 1781044 - protein, 11 aa, Staphylococcus epidermidis
KAAANVGLEPE

SEQ ID NO: 1781045 - protein, 6 aa, Staphylococcus epidermidis
KAADQP

SEQ ID NO: 1781046 - protein, 13 aa, Staphylococcus epidermidis
KAAEELEKDGHSV

SEQ ID NO: 1781047 - protein, 13 aa, Staphylococcus epidermidis
KAAEENGSSSEEI

SEQ ID NO: 1781048 - protein, 6 aa, Staphylococcus epidermidis
KAAELA

SEQ ID NO: 1781049 - protein, 8 aa, Staphylococcus epidermidis
KAAGKLQG

SEQ ID NO: 1781050 - protein, 9 aa, Staphylococcus epidermidis
KAAKEMKQR

SEQ ID NO: 1781051 - protein, 9 aa, Staphylococcus epidermidis
KAANEAYQS

SEQ ID NO: 1781052 - protein, 13 aa, Staphylococcus epidermidis
KAANMSKSQMKDL

SEQ ID NO: 1781053 - protein, 20 aa, Staphylococcus epidermidis
KAANPKHGVKTKEAAGKVQK

SEQ ID NO: 1781054 - protein, 9 aa, Staphylococcus epidermidis
KAANTRTDV

SEQ ID NO: 1781055 - protein, 4 aa, Staphylococcus epidermidis
KAAT

SEQ ID NO: 1781056 - protein, 5 aa, Staphylococcus epidermidis
KADIA

SEQ ID NO: 1781057 - protein, 5 aa, Staphylococcus epidermidis
KADKV

SEQ ID NO: 1781058 - protein, 9 aa, Staphylococcus epidermidis
KADLKNKIE

SEQ ID NO: 1781059 - protein, 19 aa, Staphylococcus epidermidis
KADMKNNNATPKLDVDPQT

SEQ ID NO: 1781060 - protein, 12 aa, Staphylococcus epidermidis
KADPEVDGTKSE

SEQ ID NO: 1781061 - protein, 19 aa, Staphylococcus epidermidis
KADPTFKQEVENLEKEIRN

SEQ ID NO: 1781062 - protein, 4 aa, Staphylococcus epidermidis
KADQ

SEQ ID NO: 1781063 - protein, 7 aa, Staphylococcus epidermidis
KADSADV

SEQ ID NO: 1781064 - protein, 17 aa, Staphylococcus epidermidis
KADSSFKTSNKNQEEVF

SEQ ID NO: 1781065 - protein, 10 aa, Staphylococcus epidermidis
KAEAYKGNRP

SEQ ID NO: 1781066 - protein, 4 aa, Staphylococcus epidermidis
KAEH

SEQ ID NO: 1781067 - protein, 13 aa, Staphylococcus epidermidis
KAEIGNRATTWTP

SEQ ID NO: 1781068 - protein, 7 aa, Staphylococcus epidermidis
KAEINQP

SEQ ID NO: 1781069 - protein, 9 aa, Staphylococcus epidermidis
KAEKDDTDL

SEQ ID NO: 1781070 - protein, 8 aa, Staphylococcus epidermidis
KAEKGEKL

SEQ ID NO: 1781071 - protein, 6 aa, Staphylococcus epidermidis
KAEKTE

SEQ ID NO: 1781072 - protein, 10 aa, Staphylococcus epidermidis
KAEKVVETNQ

SEQ ID NO: 1781073 - protein, 7 aa, Staphylococcus epidermidis
KAENGQL

SEQ ID NO: 1781074 - protein, 8 aa, Staphylococcus epidermidis
KAEPDKYI

SEQ ID NO: 1781075 - protein, 4 aa, Staphylococcus epidermidis
KAEQ

SEQ ID NO: 1781076 - protein, 5 aa, Staphylococcus epidermidis
KAERF

SEQ ID NO: 1781077 - protein, 12 aa, Staphylococcus epidermidis
KAESPKRNTTRK

SEQ ID NO: 1781078 - protein, 8 aa, Staphylococcus epidermidis
KAESSIGE

SEQ ID NO: 1781079 - protein, 14 aa, Staphylococcus epidermidis
KAETFEKELPQTKD

SEQ ID NO: 1781080 - protein, 11 aa, Staphylococcus epidermidis
KAETLKGERPL

SEQ ID NO: 1781081 - protein, 8 aa, Staphylococcus epidermidis
KAETSGYE

SEQ ID NO: 1781082 - protein, 10 aa, Staphylococcus epidermidis
KAEVGAPPMS

SEQ ID NO: 1781083 - protein, 10 aa, Staphylococcus epidermidis
KAFKNKVTEE

SEQ ID NO: 1781084 - protein, 4 aa, Staphylococcus epidermidis
KAFS

SEQ ID NO: 1781085 - protein, 7 aa, Staphylococcus epidermidis
KAGAPKD

SEQ ID NO: 1781086 - protein, 8 aa, Staphylococcus epidermidis
KAGEGKEW

SEQ ID NO: 1781087 - protein, 9 aa, Staphylococcus epidermidis
KAGETVSYG

SEQ ID NO: 1781088 - protein, 10 aa, Staphylococcus epidermidis
KAGGSKSPVE

SEQ ID NO: 1781089 - protein, 15 aa, Staphylococcus epidermidis
KAGKTLAAYAAGQGQ

SEQ ID NO: 1781090 - protein, 5 aa, Staphylococcus epidermidis
KAGNK

SEQ ID NO: 1781091 - protein, 8 aa, Staphylococcus epidermidis
KAGQDHDW

SEQ ID NO: 1781092 - protein, 8 aa, Staphylococcus epidermidis
KAGTDEFG

SEQ ID NO: 1781093 - protein, 26 aa, Staphylococcus epidermidis
KAGYETSAYATEKAGDATIEAERALS

SEQ ID NO: 1781094 - protein, 9 aa, Staphylococcus epidermidis
KAGYKGDND

SEQ ID NO: 1781095 - protein, 15 aa, Staphylococcus epidermidis
KAGYSEKYAKSSSHK

SEQ ID NO: 1781096 - protein, 10 aa, Staphylococcus epidermidis
KAHADDPAYE

SEQ ID NO: 1781097 - protein, 7 aa, Staphylococcus epidermidis
KAHNKEN

SEQ ID NO: 1781098 - protein, 6 aa, Staphylococcus epidermidis
KAIAEG

SEQ ID NO: 1781099 - protein, 11 aa, Staphylococcus epidermidis
KAIDSNKPKPR

SEQ ID NO: 1781100 - protein, 7 aa, Staphylococcus epidermidis
KAIEASK

SEQ ID NO: 1781101 - protein, 9 aa, Staphylococcus epidermidis
KAIEETETK

SEQ ID NO: 1781102 - protein, 4 aa, Staphylococcus epidermidis
KAIK

SEQ ID NO: 1781103 - protein, 11 aa, Staphylococcus epidermidis
KAIKEGKEVKN

SEQ ID NO: 1781104 - protein, 6 aa, Staphylococcus epidermidis
KAIPDA

SEQ ID NO: 1781105 - protein, 7 aa, Staphylococcus epidermidis
KAKAGDK

SEQ ID NO: 1781106 - protein, 7 aa, Staphylococcus epidermidis
KAKALGV

SEQ ID NO: 1781107 - protein, 9 aa, Staphylococcus epidermidis
KAKDNESKN

SEQ ID NO: 1781108 - protein, 7 aa, Staphylococcus epidermidis
KAKDNSF

SEQ ID NO: 1781109 - protein, 29 aa, Staphylococcus epidermidis
KAKDRPRKPHHNNKSNHGKPVQKTEDFEK

SEQ ID NO: 1781110 - protein, 28 aa, Staphylococcus epidermidis
KAKDRPRKPRHNKANHGKPVQKTEDFEK

SEQ ID NO: 1781111 - protein, 9 aa, Staphylococcus epidermidis
KAKDTGREE

SEQ ID NO: 1781112 - protein, 7 aa, Staphylococcus epidermidis
KAKEKAY

SEQ ID NO: 1781113 - protein, 8 aa, Staphylococcus epidermidis
KAKETREL

SEQ ID NO: 1781114 - protein, 7 aa, Staphylococcus epidermidis
KAKFDKT

SEQ ID NO: 1781115 - protein, 8 aa, Staphylococcus epidermidis
KAKGEPVD

SEQ ID NO: 1781116 - protein, 7 aa, Staphylococcus epidermidis
KAKGGST

SEQ ID NO: 1781117 - protein, 6 aa, Staphylococcus epidermidis
KAKKEF

SEQ ID NO: 1781118 - protein, 8 aa, Staphylococcus epidermidis
KAKKEIPK

SEQ ID NO: 1781119 - protein, 7 aa, Staphylococcus epidermidis
KAKKNNL

SEQ ID NO: 1781120 - protein, 10 aa, Staphylococcus epidermidis
KAKNDEHSDK

SEQ ID NO: 1781121 - protein, 8 aa, Staphylococcus epidermidis
KAKNEGYT

SEQ ID NO: 1781122 - protein, 17 aa, Staphylococcus epidermidis
KAKNHLNSKSHGSIKKN

SEQ ID NO: 1781123 - protein, 5 aa, Staphylococcus epidermidis
KAKNN

SEQ ID NO: 1781124 - protein, 5 aa, Staphylococcus epidermidis
KAKNY

SEQ ID NO: 1781125 - protein, 7 aa, Staphylococcus epidermidis
KAKPGDK

SEQ ID NO: 1781126 - protein, 11 aa, Staphylococcus epidermidis
KAKPSSAKGTY

SEQ ID NO: 1781127 - protein, 7 aa, Staphylococcus epidermidis
KAKPVYG

SEQ ID NO: 1781128 - protein, 4 aa, Staphylococcus epidermidis
KAKQ

SEQ ID NO: 1781129 - protein, 6 aa, Staphylococcus epidermidis
KAKSIG

SEQ ID NO: 1781130 - protein, 6 aa, Staphylococcus epidermidis
KAKTGA

SEQ ID NO: 1781131 - protein, 8 aa, Staphylococcus epidermidis
KAKTNYNT

SEQ ID NO: 1781132 - protein, 9 aa, Staphylococcus epidermidis
KAKTQNNTG

SEQ ID NO: 1781133 - protein, 8 aa, Staphylococcus epidermidis
KAKTYSLG

SEQ ID NO: 1781134 - protein, 6 aa, Staphylococcus epidermidis
KAKVGD

SEQ ID NO: 1781135 - protein, 6 aa, Staphylococcus epidermidis
KAKYSK

SEQ ID NO: 1781136 - protein, 12 aa, Staphylococcus epidermidis
KALADAKRKDII

SEQ ID NO: 1781137 - protein, 7 aa, Staphylococcus epidermidis
KALAEAG

SEQ ID NO: 1781138 - protein, 7 aa, Staphylococcus epidermidis
KALAESG

SEQ ID NO: 1781139 - protein, 7 aa, Staphylococcus epidermidis
KALDDQQ

SEQ ID NO: 1781140 - protein, 11 aa, Staphylococcus epidermidis
KALEGDAQYEE

SEQ ID NO: 1781141 - protein, 12 aa, Staphylococcus epidermidis
KALGAKKERYPI

SEQ ID NO: 1781142 - protein, 9 aa, Staphylococcus epidermidis
KALGTGLGQ

SEQ ID NO: 1781143 - protein, 14 aa, Staphylococcus epidermidis
KALNEAQEVTKSVP

SEQ ID NO: 1781144 - protein, 8 aa, Staphylococcus epidermidis
KALSPKEA

SEQ ID NO: 1781145 - protein, 6 aa, Staphylococcus epidermidis
KAMEEA

SEQ ID NO: 1781146 - protein, 8 aa, Staphylococcus epidermidis
KANENGAK

SEQ ID NO: 1781147 - protein, 7 aa, Staphylococcus epidermidis
KANEPGG

SEQ ID NO: 1781148 - protein, 9 aa, Staphylococcus epidermidis
KANKNNRAV

SEQ ID NO: 1781149 - protein, 8 aa, Staphylococcus epidermidis
KANKRGIP

SEQ ID NO: 1781150 - protein, 10 aa, Staphylococcus epidermidis
KANLDNDNTA

SEQ ID NO: 1781151 - protein, 4 aa, Staphylococcus epidermidis
KANP

SEQ ID NO: 1781152 - protein, 14 aa, Staphylococcus epidermidis
KANPQFSKPMTPYA

SEQ ID NO: 1781153 - protein, 15 aa, Staphylococcus epidermidis
KAPANLTPEQAASLP

SEQ ID NO: 1781154 - protein, 15 aa, Staphylococcus epidermidis
KAPKNLKSEQATSLP

SEQ ID NO: 1781155 - protein, 9 aa, Staphylococcus epidermidis
KAPNGESYQ

SEQ ID NO: 1781156 - protein, 32 aa, Staphylococcus epidermidis
KAPSVRQNSNYINEDPAEKEAYDNAINKGQKV

SEQ ID NO: 1781157 - protein, 5 aa, Staphylococcus epidermidis
KAPVT

SEQ ID NO: 1781158 - protein, 5 aa, Staphylococcus epidermidis
KAQAD

SEQ ID NO: 1781159 - protein, 6 aa, Staphylococcus epidermidis
KAQADA

SEQ ID NO: 1781160 - protein, 8 aa, Staphylococcus epidermidis
KAQADGIT

SEQ ID NO: 1781161 - protein, 5 aa, Staphylococcus epidermidis
KAQDF

SEQ ID NO: 1781162 - protein, 6 aa, Staphylococcus epidermidis
KAQGAT

SEQ ID NO: 1781163 - protein, 28 aa, Staphylococcus epidermidis
KAQGVPNGGQTQQPKKPTRTVQRSKNAF

SEQ ID NO: 1781164 - protein, 6 aa, Staphylococcus epidermidis
KAQLEK

SEQ ID NO: 1781165 - protein, 7 aa, Staphylococcus epidermidis
KAQQKEV

SEQ ID NO: 1781166 - protein, 6 aa, Staphylococcus epidermidis
KAQSVR

SEQ ID NO: 1781167 - protein, 12 aa, Staphylococcus epidermidis
KAQTVNVKKKGI

SEQ ID NO: 1781168 - protein, 11 aa, Staphylococcus epidermidis
KAQTVSEETSI

SEQ ID NO: 1781169 - protein, 7 aa, Staphylococcus epidermidis
KAQVQAD

SEQ ID NO: 1781170 - protein, 6 aa, Staphylococcus epidermidis
KAQYGN

SEQ ID NO: 1781171 - protein, 15 aa, Staphylococcus epidermidis
KARDGKLTSEEMKGA

SEQ ID NO: 1781172 - protein, 10 aa, Staphylococcus epidermidis
KAREDDIKEK

SEQ ID NO: 1781173 - protein, 13 aa, Staphylococcus epidermidis
KAREELSSEDLDQ

SEQ ID NO: 1781174 - protein, 9 aa, Staphylococcus epidermidis
KAREHFPNE

SEQ ID NO: 1781175 - protein, 6 aa, Staphylococcus epidermidis
KARELD

SEQ ID NO: 1781176 - protein, 4 aa, Staphylococcus epidermidis
KARI

SEQ ID NO: 1781177 - protein, 5 aa, Staphylococcus epidermidis
KARNI

SEQ ID NO: 1781178 - protein, 7 aa, Staphylococcus epidermidis
KARSGDT

SEQ ID NO: 1781179 - protein, 5 aa, Staphylococcus epidermidis
KARTK

SEQ ID NO: 1781180 - protein, 11 aa, Staphylococcus epidermidis
KARTTKQQARI

SEQ ID NO: 1781181 - protein, 9 aa, Staphylococcus epidermidis
KARVPAGGA

SEQ ID NO: 1781182 - protein, 14 aa, Staphylococcus epidermidis
KASANIYETDEETM

SEQ ID NO: 1781183 - protein, 16 aa, Staphylococcus epidermidis
KASAPIKKETANDLEL

SEQ ID NO: 1781184 - protein, 16 aa, Staphylococcus epidermidis
KASAPIKKETENDLEI

SEQ ID NO: 1781185 - protein, 12 aa, Staphylococcus epidermidis
KASATVDSQTDH

SEQ ID NO: 1781186 - protein, 7 aa, Staphylococcus epidermidis
KASEDHE

SEQ ID NO: 1781187 - protein, 6 aa, Staphylococcus epidermidis
KASEDV

SEQ ID NO: 1781188 - protein, 5 aa, Staphylococcus epidermidis
KASGH

SEQ ID NO: 1781189 - protein, 7 aa, Staphylococcus epidermidis
KASGNHD

SEQ ID NO: 1781190 - protein, 8 aa, Staphylococcus epidermidis
KASIEGKE

SEQ ID NO: 1781191 - protein, 8 aa, Staphylococcus epidermidis
KASKATIT

SEQ ID NO: 1781192 - protein, 10 aa, Staphylococcus epidermidis
KASKLSKKLS

SEQ ID NO: 1781193 - protein, 7 aa, Staphylococcus epidermidis
KASPFDG

SEQ ID NO: 1781194 - protein, 6 aa, Staphylococcus epidermidis
KASREQ

SEQ ID NO: 1781195 - protein, 5 aa, Staphylococcus epidermidis
KASRI

SEQ ID NO: 1781196 - protein, 13 aa, Staphylococcus epidermidis
KASTENRKEDDLR

SEQ ID NO: 1781197 - protein, 8 aa, Staphylococcus epidermidis
KASTLDEA

SEQ ID NO: 1781198 - protein, 7 aa, Staphylococcus epidermidis
KASYEAK

SEQ ID NO: 1781199 - protein, 7 aa, Staphylococcus epidermidis
KASYQDR

SEQ ID NO: 1781200 - protein, 12 aa, Staphylococcus epidermidis
KASYTSDKEVVQ

SEQ ID NO: 1781201 - protein, 8 aa, Staphylococcus epidermidis
KATAPQVN

SEQ ID NO: 1781202 - protein, 8 aa, Staphylococcus epidermidis
KATAQTMN

SEQ ID NO: 1781203 - protein, 12 aa, Staphylococcus epidermidis
KATDAKSKTAYN

SEQ ID NO: 1781204 - protein, 11 aa, Staphylococcus epidermidis
KATDPAAKSKY

SEQ ID NO: 1781205 - protein, 4 aa, Staphylococcus epidermidis
KATE

SEQ ID NO: 1781206 - protein, 8 aa, Staphylococcus epidermidis
KATEEGNI

SEQ ID NO: 1781207 - protein, 13 aa, Staphylococcus epidermidis
KATGKNLDETEIE

SEQ ID NO: 1781208 - protein, 5 aa, Staphylococcus epidermidis
KATGL

SEQ ID NO: 1781209 - protein, 6 aa, Staphylococcus epidermidis
KATGTK

SEQ ID NO: 1781210 - protein, 7 aa, Staphylococcus epidermidis
KATKEIK

SEQ ID NO: 1781211 - protein, 17 aa, Staphylococcus epidermidis
KATKSEYQSDVDAKLNS

SEQ ID NO: 1781212 - protein, 17 aa, Staphylococcus epidermidis
KATKTAEEAPYPSTEEA

SEQ ID NO: 1781213 - protein, 7 aa, Staphylococcus epidermidis
KATNNIE

SEQ ID NO: 1781214 - protein, 4 aa, Staphylococcus epidermidis
KATP

SEQ ID NO: 1781215 - protein, 8 aa, Staphylococcus epidermidis
KATPEAKN

SEQ ID NO: 1781216 - protein, 10 aa, Staphylococcus epidermidis
KATQAPSSVN

SEQ ID NO: 1781217 - protein, 7 aa, Staphylococcus epidermidis
KATQSDI

SEQ ID NO: 1781218 - protein, 16 aa, Staphylococcus epidermidis
KATRANIDVNLNVEVV

SEQ ID NO: 1781219 - protein, 15 aa, Staphylococcus epidermidis
KATRGNIDVQIDVTA

SEQ ID NO: 1781220 - protein, 15 aa, Staphylococcus epidermidis
KATRGNIDVQLEVTA

SEQ ID NO: 1781221 - protein, 88 aa, Staphylococcus epidermidis
KATTVSPTSKAKISTKTQQSTKSHTTSVKKNTTQLSKTKSPSTSTKSKTVQSSTTKAQPTLSTQVSTTTKAKQFSTPTTSKTDSSKSL

SEQ ID NO: 1781222 - protein, 13 aa, Staphylococcus epidermidis
KATVKTMSPEELR

SEQ ID NO: 1781223 - protein, 10 aa, Staphylococcus epidermidis
KAVEGLSEEQ

SEQ ID NO: 1781224 - protein, 25 aa, Staphylococcus epidermidis
KAVKDAREALSKTKGENLNERDIQG

SEQ ID NO: 1781225 - protein, 15 aa, Staphylococcus epidermidis
KAVNQIQKETSTPVI

SEQ ID NO: 1781226 - protein, 6 aa, Staphylococcus epidermidis
KAWDNR

SEQ ID NO: 1781227 - protein, 13 aa, Staphylococcus epidermidis
KAYAKQKETLGDQ

SEQ ID NO: 1781228 - protein, 9 aa, Staphylococcus epidermidis
KAYETGKGR

SEQ ID NO: 1781229 - protein, 8 aa, Staphylococcus epidermidis
KAYNGEKR

SEQ ID NO: 1781230 - protein, 4 aa, Staphylococcus epidermidis
KAYP

SEQ ID NO: 1781231 - protein, 8 aa, Staphylococcus epidermidis
KAYQDAES

SEQ ID NO: 1781232 - protein, 7 aa, Staphylococcus epidermidis
KAYQEVE

SEQ ID NO: 1781233 - protein, 5 aa, Staphylococcus epidermidis
KAYQL

SEQ ID NO: 1781234 - protein, 8 aa, Staphylococcus epidermidis
KAYTGSEA

SEQ ID NO: 1781235 - protein, 4 aa, Staphylococcus epidermidis
KAYY

SEQ ID NO: 1781236 - protein, 4 aa, Staphylococcus epidermidis
KCDT

SEQ ID NO: 1781237 - protein, 12 aa, Staphylococcus epidermidis
KCEGSGQEFEEP

SEQ ID NO: 1781238 - protein, 12 aa, Staphylococcus epidermidis
KDAADKYTRKDM

SEQ ID NO: 1781239 - protein, 12 aa, Staphylococcus epidermidis
KDAANKYTRKDM

SEQ ID NO: 1781240 - protein, 6 aa, Staphylococcus epidermidis
KDADDT

SEQ ID NO: 1781241 - protein, 13 aa, Staphylococcus epidermidis
KDAEDKGGQLSRS

SEQ ID NO: 1781242 - protein, 7 aa, Staphylococcus epidermidis
KDAEPIK

SEQ ID NO: 1781243 - protein, 4 aa, Staphylococcus epidermidis
KDAF

SEQ ID NO: 1781244 - protein, 7 aa, Staphylococcus epidermidis
KDAGEIF

SEQ ID NO: 1781245 - protein, 7 aa, Staphylococcus epidermidis
KDAGGTY

SEQ ID NO: 1781246 - protein, 5 aa, Staphylococcus epidermidis
KDAGH

SEQ ID NO: 1781247 - protein, 20 aa, Staphylococcus epidermidis
KDAGKLRSSASANFTRATEL

SEQ ID NO: 1781248 - protein, 20 aa, Staphylococcus epidermidis
KDAGKLRSSASDNFTRATEL

SEQ ID NO: 1781249 - protein, 14 aa, Staphylococcus epidermidis
KDAGQSDDVEDTVN

SEQ ID NO: 1781250 - protein, 6 aa, Staphylococcus epidermidis
KDAHGR

SEQ ID NO: 1781251 - protein, 5 aa, Staphylococcus epidermidis
KDAIE

SEQ ID NO: 1781252 - protein, 8 aa, Staphylococcus epidermidis
KDAKRGTY

SEQ ID NO: 1781253 - protein, 9 aa, Staphylococcus epidermidis
KDAKTGKYK

SEQ ID NO: 1781254 - protein, 48 aa, Staphylococcus epidermidis
KDALDGNETLKQSSDYINEDTNERGNYDHNIEKGKEIVDQQTNPTMSP

SEQ ID NO: 1781255 - protein, 7 aa, Staphylococcus epidermidis
KDALQGK

SEQ ID NO: 1781256 - protein, 5 aa, Staphylococcus epidermidis
KDAQQ

SEQ ID NO: 1781257 - protein, 8 aa, Staphylococcus epidermidis
KDASDEGI

SEQ ID NO: 1781258 - protein, 11 aa, Staphylococcus epidermidis
KDAVKDSFKHP

SEQ ID NO: 1781259 - protein, 17 aa, Staphylococcus epidermidis
KDAYAQSNFSTGNTRGS

SEQ ID NO: 1781260 - protein, 6 aa, Staphylococcus epidermidis
KDAYEE

SEQ ID NO: 1781261 - protein, 7 aa, Staphylococcus epidermidis
KDDDNKV

SEQ ID NO: 1781262 - protein, 7 aa, Staphylococcus epidermidis
KDDEELN

SEQ ID NO: 1781263 - protein, 12 aa, Staphylococcus epidermidis
KDDHKTIDTYIS

SEQ ID NO: 1781264 - protein, 4 aa, Staphylococcus epidermidis
KDDI

SEQ ID NO: 1781265 - protein, 11 aa, Staphylococcus epidermidis
KDDIDKTVTAL

SEQ ID NO: 1781266 - protein, 8 aa, Staphylococcus epidermidis
KDDITEDN

SEQ ID NO: 1781267 - protein, 10 aa, Staphylococcus epidermidis
KDDKGVVDPD

SEQ ID NO: 1781268 - protein, 7 aa, Staphylococcus epidermidis
KDDKNAI

SEQ ID NO: 1781269 - protein, 6 aa, Staphylococcus epidermidis
KDDNDK

SEQ ID NO: 1781270 - protein, 15 aa, Staphylococcus epidermidis
KDDNLIKKEGEGPAT

SEQ ID NO: 1781271 - protein, 7 aa, Staphylococcus epidermidis
KDDPVKV

SEQ ID NO: 1781272 - protein, 33 aa, Staphylococcus epidermidis
KDDRSNDKKEEIKTNLHSNSKSLIKAKEDLENL

SEQ ID NO: 1781273 - protein, 17 aa, Staphylococcus epidermidis
KDDSISIKDNGRGMPTG

SEQ ID NO: 1781274 - protein, 7 aa, Staphylococcus epidermidis
KDEAIDG

SEQ ID NO: 1781275 - protein, 11 aa, Staphylococcus epidermidis
KDEDTESIGYG

SEQ ID NO: 1781276 - protein, 14 aa, Staphylococcus epidermidis
KDEERTKAASAGEY

SEQ ID NO: 1781277 - protein, 7 aa, Staphylococcus epidermidis
KDEGKIS

SEQ ID NO: 1781278 - protein, 9 aa, Staphylococcus epidermidis
KDEGLYDTE

SEQ ID NO: 1781279 - protein, 17 aa, Staphylococcus epidermidis
KDEGQLEQGGGTDDSTG

SEQ ID NO: 1781280 - protein, 15 aa, Staphylococcus epidermidis
KDEHAVQAHNDSGHF

SEQ ID NO: 1781281 - protein, 6 aa, Staphylococcus epidermidis
KDEHHK

SEQ ID NO: 1781282 - protein, 11 aa, Staphylococcus epidermidis
KDEHRRKTDGF

SEQ ID NO: 1781283 - protein, 9 aa, Staphylococcus epidermidis
KDEKFNSKE

SEQ ID NO: 1781284 - protein, 9 aa, Staphylococcus epidermidis
KDEKGNDYP

SEQ ID NO: 1781285 - protein, 7 aa, Staphylococcus epidermidis
KDEKIKQ

SEQ ID NO: 1781286 - protein, 15 aa, Staphylococcus epidermidis
KDEKPHMTFYNDVLI

SEQ ID NO: 1781287 - protein, 12 aa, Staphylococcus epidermidis
KDELKATQSHID

SEQ ID NO: 1781288 - protein, 8 aa, Staphylococcus epidermidis
KDELNERV

SEQ ID NO: 1781289 - protein, 7 aa, Staphylococcus epidermidis
KDELNKR

SEQ ID NO: 1781290 - protein, 9 aa, Staphylococcus epidermidis
KDENELDEE

SEQ ID NO: 1781291 - protein, 9 aa, Staphylococcus epidermidis
KDENGNAYP

SEQ ID NO: 1781292 - protein, 11 aa, Staphylococcus epidermidis
KDENGNSYPDW

SEQ ID NO: 1781293 - protein, 8 aa, Staphylococcus epidermidis
KDENGQLK

SEQ ID NO: 1781294 - protein, 16 aa, Staphylococcus epidermidis
KDENGYKIKNGTKKGY

SEQ ID NO: 1781295 - protein, 12 aa, Staphylococcus epidermidis
KDENIEKLGSKE

SEQ ID NO: 1781296 - protein, 14 aa, Staphylococcus epidermidis
KDENVKQTLKENAS

SEQ ID NO: 1781297 - protein, 7 aa, Staphylococcus epidermidis
KDEPYNT

SEQ ID NO: 1781298 - protein, 7 aa, Staphylococcus epidermidis
KDEQLKR

SEQ ID NO: 1781299 - protein, 16 aa, Staphylococcus epidermidis
KDERNPSITTSYGTGQ

SEQ ID NO: 1781300 - protein, 10 aa, Staphylococcus epidermidis
KDESKLPKEY

SEQ ID NO: 1781301 - protein, 8 aa, Staphylococcus epidermidis
KDESKTKD

SEQ ID NO: 1781302 - protein, 15 aa, Staphylococcus epidermidis
KDETFRGTEVSRKSI

SEQ ID NO: 1781303 - protein, 5 aa, Staphylococcus epidermidis
KDEYS

SEQ ID NO: 1781304 - protein, 4 aa, Staphylococcus epidermidis
KDFG

SEQ ID NO: 1781305 - protein, 5 aa, Staphylococcus epidermidis
KDFKD

SEQ ID NO: 1781306 - protein, 5 aa, Staphylococcus epidermidis
KDFPE

SEQ ID NO: 1781307 - protein, 6 aa, Staphylococcus epidermidis
KDFPNH

SEQ ID NO: 1781308 - protein, 4 aa, Staphylococcus epidermidis
KDFR

SEQ ID NO: 1781309 - protein, 9 aa, Staphylococcus epidermidis
KDGAEEKLN

SEQ ID NO: 1781310 - protein, 20 aa, Staphylococcus epidermidis
KDGAVASFSEKGTELSEDVE

SEQ ID NO: 1781311 - protein, 30 aa, Staphylococcus epidermidis
KDGGMPATGLNKKGKTKKTGTKVTFKPDPE

SEQ ID NO: 1781312 - protein, 4 aa, Staphylococcus epidermidis
KDGI

SEQ ID NO: 1781313 - protein, 19 aa, Staphylococcus epidermidis
KDGKKSLVKDEATKKANDK

SEQ ID NO: 1781314 - protein, 13 aa, Staphylococcus epidermidis
KDGKVVVDNEFKL

SEQ ID NO: 1781315 - protein, 4 aa, Staphylococcus epidermidis
KDGN

SEQ ID NO: 1781316 - protein, 5 aa, Staphylococcus epidermidis
KDGNQ

SEQ ID NO: 1781317 - protein, 7 aa, Staphylococcus epidermidis
KDGRAYN

SEQ ID NO: 1781318 - protein, 5 aa, Staphylococcus epidermidis
KDGRH

SEQ ID NO: 1781319 - protein, 13 aa, Staphylococcus epidermidis
KDGSLTGYGGTID

SEQ ID NO: 1781320 - protein, 16 aa, Staphylococcus epidermidis
KDGSVDAMVKKVRCND

SEQ ID NO: 1781321 - protein, 6 aa, Staphylococcus epidermidis
KDHAKD

SEQ ID NO: 1781322 - protein, 10 aa, Staphylococcus epidermidis
KDHDNELTKE

SEQ ID NO: 1781323 - protein, 10 aa, Staphylococcus epidermidis
KDHDNNLTKE

SEQ ID NO: 1781324 - protein, 5 aa, Staphylococcus epidermidis
KDHTP

SEQ ID NO: 1781325 - protein, 13 aa, Staphylococcus epidermidis
KDHVEKCEKVINN

SEQ ID NO: 1781326 - protein, 6 aa, Staphylococcus epidermidis
KDIAED

SEQ ID NO: 1781327 - protein, 6 aa, Staphylococcus epidermidis
KDIEMS

SEQ ID NO: 1781328 - protein, 5 aa, Staphylococcus epidermidis
KDIGE

SEQ ID NO: 1781329 - protein, 7 aa, Staphylococcus epidermidis
KDIPPFE

SEQ ID NO: 1781330 - protein, 8 aa, Staphylococcus epidermidis
KDIPPNSL

SEQ ID NO: 1781331 - protein, 11 aa, Staphylococcus epidermidis
KDISEKGHRIR

SEQ ID NO: 1781332 - protein, 10 aa, Staphylococcus epidermidis
KDISKPNNKR

SEQ ID NO: 1781333 - protein, 19 aa, Staphylococcus epidermidis
KDISRKVDKETKESKPKMI

SEQ ID NO: 1781334 - protein, 8 aa, Staphylococcus epidermidis
KDITDDIS

SEQ ID NO: 1781335 - protein, 12 aa, Staphylococcus epidermidis
KDKAQKRVDGVP

SEQ ID NO: 1781336 - protein, 9 aa, Staphylococcus epidermidis
KDKENENAV

SEQ ID NO: 1781337 - protein, 10 aa, Staphylococcus epidermidis
KDKENLTDHD

SEQ ID NO: 1781338 - protein, 17 aa, Staphylococcus epidermidis
KDKGGRSLTLRPEGTAA

SEQ ID NO: 1781339 - protein, 8 aa, Staphylococcus epidermidis
KDKGIYKG

SEQ ID NO: 1781340 - protein, 7 aa, Staphylococcus epidermidis
KDKGNLT

SEQ ID NO: 1781341 - protein, 6 aa, Staphylococcus epidermidis
KDKGRL

SEQ ID NO: 1781342 - protein, 6 aa, Staphylococcus epidermidis
KDKIRD

SEQ ID NO: 1781343 - protein, 8 aa, Staphylococcus epidermidis
KDKKQSGV

SEQ ID NO: 1781344 - protein, 8 aa, Staphylococcus epidermidis
KDKNLENK

SEQ ID NO: 1781345 - protein, 8 aa, Staphylococcus epidermidis
KDKNNQSE

SEQ ID NO: 1781346 - protein, 7 aa, Staphylococcus epidermidis
KDKPGGL

SEQ ID NO: 1781347 - protein, 12 aa, Staphylococcus epidermidis
KDKQKQLNKEVQ

SEQ ID NO: 1781348 - protein, 5 aa, Staphylococcus epidermidis
KDKTD

SEQ ID NO: 1781349 - protein, 8 aa, Staphylococcus epidermidis
KDKTNERF

SEQ ID NO: 1781350 - protein, 9 aa, Staphylococcus epidermidis
KDKTPNGRD

SEQ ID NO: 1781351 - protein, 10 aa, Staphylococcus epidermidis
KDKTPNGRDV

SEQ ID NO: 1781352 - protein, 5 aa, Staphylococcus epidermidis
KDKTY

SEQ ID NO: 1781353 - protein, 6 aa, Staphylococcus epidermidis
KDKTYT

SEQ ID NO: 1781354 - protein, 16 aa, Staphylococcus epidermidis
KDKYPNSKFHSGAHSL

SEQ ID NO: 1781355 - protein, 7 aa, Staphylococcus epidermidis
KDLAEQK

SEQ ID NO: 1781356 - protein, 11 aa, Staphylococcus epidermidis
KDLASKLKEED

SEQ ID NO: 1781357 - protein, 18 aa, Staphylococcus epidermidis
KDLDDESLNDEDETEAKI

SEQ ID NO: 1781358 - protein, 11 aa, Staphylococcus epidermidis
KDLGKNNVEAY

SEQ ID NO: 1781359 - protein, 6 aa, Staphylococcus epidermidis
KDLGRK

SEQ ID NO: 1781360 - protein, 24 aa, Staphylococcus epidermidis
KDLGTNKEQNITIQSSSALSDEEI

SEQ ID NO: 1781361 - protein, 6 aa, Staphylococcus epidermidis
KDLKGY

SEQ ID NO: 1781362 - protein, 20 aa, Staphylococcus epidermidis
KDLKRTPSFSVNRPGEETGI

SEQ ID NO: 1781363 - protein, 4 aa, Staphylococcus epidermidis
KDLN

SEQ ID NO: 1781364 - protein, 10 aa, Staphylococcus epidermidis
KDLNDGVSTF

SEQ ID NO: 1781365 - protein, 10 aa, Staphylococcus epidermidis
KDLNDKGSTI

SEQ ID NO: 1781366 - protein, 10 aa, Staphylococcus epidermidis
KDLSDASNEI

SEQ ID NO: 1781367 - protein, 7 aa, Staphylococcus epidermidis
KDLSSAM

SEQ ID NO: 1781368 - protein, 7 aa, Staphylococcus epidermidis
KDLTGLD

SEQ ID NO: 1781369 - protein, 8 aa, Staphylococcus epidermidis
KDLTKPNV

SEQ ID NO: 1781370 - protein, 20 aa, Staphylococcus epidermidis
KDMGDAAADLGKSVANKAIA

SEQ ID NO: 1781371 - protein, 12 aa, Staphylococcus epidermidis
KDMGVSKNEVNS

SEQ ID NO: 1781372 - protein, 7 aa, Staphylococcus epidermidis
KDNDKAL

SEQ ID NO: 1781373 - protein, 8 aa, Staphylococcus epidermidis
KDNEARLQ

SEQ ID NO: 1781374 - protein, 6 aa, Staphylococcus epidermidis
KDNELL

SEQ ID NO: 1781375 - protein, 5 aa, Staphylococcus epidermidis
KDNEV

SEQ ID NO: 1781376 - protein, 18 aa, Staphylococcus epidermidis
KDNEYTKQNKVSDSEKEL

SEQ ID NO: 1781377 - protein, 6 aa, Staphylococcus epidermidis
KDNGLD

SEQ ID NO: 1781378 - protein, 4 aa, Staphylococcus epidermidis
KDNI

SEQ ID NO: 1781379 - protein, 7 aa, Staphylococcus epidermidis
KDNIDDL

SEQ ID NO: 1781380 - protein, 4 aa, Staphylococcus epidermidis
KDNK

SEQ ID NO: 1781381 - protein, 13 aa, Staphylococcus epidermidis
KDNKALKSNNQAL

SEQ ID NO: 1781382 - protein, 6 aa, Staphylococcus epidermidis
KDNKEA

SEQ ID NO: 1781383 - protein, 6 aa, Staphylococcus epidermidis
KDNKEN

SEQ ID NO: 1781384 - protein, 8 aa, Staphylococcus epidermidis
KDNKVEPF

SEQ ID NO: 1781385 - protein, 6 aa, Staphylococcus epidermidis
KDNLHG

SEQ ID NO: 1781386 - protein, 6 aa, Staphylococcus epidermidis
KDNNYR

SEQ ID NO: 1781387 - protein, 4 aa, Staphylococcus epidermidis
KDNP

SEQ ID NO: 1781388 - protein, 8 aa, Staphylococcus epidermidis
KDNQGTIK

SEQ ID NO: 1781389 - protein, 7 aa, Staphylococcus epidermidis
KDNQIES

SEQ ID NO: 1781390 - protein, 8 aa, Staphylococcus epidermidis
KDNRLKRR

SEQ ID NO: 1781391 - protein, 10 aa, Staphylococcus epidermidis
KDNSLAQQAN

SEQ ID NO: 1781392 - protein, 7 aa, Staphylococcus epidermidis
KDNSQFR

SEQ ID NO: 1781393 - protein, 6 aa, Staphylococcus epidermidis
KDNTQL

SEQ ID NO: 1781394 - protein, 8 aa, Staphylococcus epidermidis
KDPDTTVA

SEQ ID NO: 1781395 - protein, 5 aa, Staphylococcus epidermidis
KDPDV

SEQ ID NO: 1781396 - protein, 16 aa, Staphylococcus epidermidis
KDPGIRVETSTQSFNG

SEQ ID NO: 1781397 - protein, 5 aa, Staphylococcus epidermidis
KDPKL

SEQ ID NO: 1781398 - protein, 4 aa, Staphylococcus epidermidis
KDPL

SEQ ID NO: 1781399 - protein, 7 aa, Staphylococcus epidermidis
KDPLTNK

SEQ ID NO: 1781400 - protein, 8 aa, Staphylococcus epidermidis
KDPNDEKD

SEQ ID NO: 1781401 - protein, 6 aa, Staphylococcus epidermidis
KDPTYN

SEQ ID NO: 1781402 - protein, 19 aa, Staphylococcus epidermidis
KDPTYNVKAKGTKSAKKED

SEQ ID NO: 1781403 - protein, 8 aa, Staphylococcus epidermidis
KDQDTLRK

SEQ ID NO: 1781404 - protein, 10 aa, Staphylococcus epidermidis
KDQDTQTIAK

SEQ ID NO: 1781405 - protein, 4 aa, Staphylococcus epidermidis
KDQE

SEQ ID NO: 1781406 - protein, 8 aa, Staphylococcus epidermidis
KDQEQGLN

SEQ ID NO: 1781407 - protein, 12 aa, Staphylococcus epidermidis
KDQGYEETFRDK

SEQ ID NO: 1781408 - protein, 13 aa, Staphylococcus epidermidis
KDQKENGSTKRTV

SEQ ID NO: 1781409 - protein, 10 aa, Staphylococcus epidermidis
KDQPLSSETV

SEQ ID NO: 1781410 - protein, 5 aa, Staphylococcus epidermidis
KDQTI

SEQ ID NO: 1781411 - protein, 4 aa, Staphylococcus epidermidis
KDQY

SEQ ID NO: 1781412 - protein, 10 aa, Staphylococcus epidermidis
KDRASKYGGS

SEQ ID NO: 1781413 - protein, 11 aa, Staphylococcus epidermidis
KDREKNPDKQW

SEQ ID NO: 1781414 - protein, 6 aa, Staphylococcus epidermidis
KDREQL

SEQ ID NO: 1781415 - protein, 5 aa, Staphylococcus epidermidis
KDRGA

SEQ ID NO: 1781416 - protein, 6 aa, Staphylococcus epidermidis
KDRIGS

SEQ ID NO: 1781417 - protein, 6 aa, Staphylococcus epidermidis
KDRINK

SEQ ID NO: 1781418 - protein, 7 aa, Staphylococcus epidermidis
KDRINQA

SEQ ID NO: 1781419 - protein, 6 aa, Staphylococcus epidermidis
KDRIQK

SEQ ID NO: 1781420 - protein, 8 aa, Staphylococcus epidermidis
KDRLNPEK

SEQ ID NO: 1781421 - protein, 7 aa, Staphylococcus epidermidis
KDRLTRQ

SEQ ID NO: 1781422 - protein, 12 aa, Staphylococcus epidermidis
KDRNSYSKTDYD

SEQ ID NO: 1781423 - protein, 6 aa, Staphylococcus epidermidis
KDRQQE

SEQ ID NO: 1781424 - protein, 6 aa, Staphylococcus epidermidis
KDRRYK

SEQ ID NO: 1781425 - protein, 6 aa, Staphylococcus epidermidis
KDSFEY

SEQ ID NO: 1781426 - protein, 9 aa, Staphylococcus epidermidis
KDSFNEEKA

SEQ ID NO: 1781427 - protein, 4 aa, Staphylococcus epidermidis
KDSG

SEQ ID NO: 1781428 - protein, 9 aa, Staphylococcus epidermidis
KDSIQKGDK

SEQ ID NO: 1781429 - protein, 7 aa, Staphylococcus epidermidis
KDSLSIE

SEQ ID NO: 1781430 - protein, 13 aa, Staphylococcus epidermidis
KDSPLDATKSELE

SEQ ID NO: 1781431 - protein, 7 aa, Staphylococcus epidermidis
KDSQDEI

SEQ ID NO: 1781432 - protein, 9 aa, Staphylococcus epidermidis
KDSSGPYHK

SEQ ID NO: 1781433 - protein, 9 aa, Staphylococcus epidermidis
KDSTEEDAK

SEQ ID NO: 1781434 - protein, 8 aa, Staphylococcus epidermidis
KDSVTAQD

SEQ ID NO: 1781435 - protein, 11 aa, Staphylococcus epidermidis
KDTDKSKGNLQ

SEQ ID NO: 1781436 - protein, 10 aa, Staphylococcus epidermidis
KDTEPPISGD

SEQ ID NO: 1781437 - protein, 8 aa, Staphylococcus epidermidis
KDTEQQYS

SEQ ID NO: 1781438 - protein, 12 aa, Staphylococcus epidermidis
KDTFDNDGYFQT

SEQ ID NO: 1781439 - protein, 18 aa, Staphylococcus epidermidis
KDTGKVKTDDSEKKYPVK

SEQ ID NO: 1781440 - protein, 7 aa, Staphylococcus epidermidis
KDTGKVT

SEQ ID NO: 1781441 - protein, 8 aa, Staphylococcus epidermidis
KDTNATSS

SEQ ID NO: 1781442 - protein, 7 aa, Staphylococcus epidermidis
KDTNGGI

SEQ ID NO: 1781443 - protein, 6 aa, Staphylococcus epidermidis
KDTQLE

SEQ ID NO: 1781444 - protein, 4 aa, Staphylococcus epidermidis
KDTT

SEQ ID NO: 1781445 - protein, 8 aa, Staphylococcus epidermidis
KDTTQNEI

SEQ ID NO: 1781446 - protein, 8 aa, Staphylococcus epidermidis
KDVDHSRS

SEQ ID NO: 1781447 - protein, 30 aa, Staphylococcus epidermidis
KDVDNVKQTSNYINETPSVQNNYTSAVDQA

SEQ ID NO: 1781448 - protein, 4 aa, Staphylococcus epidermidis
KDVK

SEQ ID NO: 1781449 - protein, 8 aa, Staphylococcus epidermidis
KDVLSTEE

SEQ ID NO: 1781450 - protein, 5 aa, Staphylococcus epidermidis
KDVND

SEQ ID NO: 1781451 - protein, 7 aa, Staphylococcus epidermidis
KDVPDDS

SEQ ID NO: 1781452 - protein, 6 aa, Staphylococcus epidermidis
KDVRNM

SEQ ID NO: 1781453 - protein, 8 aa, Staphylococcus epidermidis
KDVTADTG

SEQ ID NO: 1781454 - protein, 13 aa, Staphylococcus epidermidis
KDVVTTSRFPGTT

SEQ ID NO: 1781455 - protein, 5 aa, Staphylococcus epidermidis
KDYAN

SEQ ID NO: 1781456 - protein, 27 aa, Staphylococcus epidermidis
KDYKDGEVSYNPNAPNYSAKYQLSNND

SEQ ID NO: 1781457 - protein, 10 aa, Staphylococcus epidermidis
KDYKGRKNKL

SEQ ID NO: 1781458 - protein, 30 aa, Staphylococcus epidermidis
KDYKNGDIATNPKVPSYSAEYDLENSDYNV

SEQ ID NO: 1781459 - protein, 19 aa, Staphylococcus epidermidis
KDYKNGDISYNPNVPSYSA

SEQ ID NO: 1781460 - protein, 30 aa, Staphylococcus epidermidis
KDYKNGNIATNPKVPSYSAEYDLENSDYNV

SEQ ID NO: 1781461 - protein, 29 aa, Staphylococcus epidermidis
KDYKNGNISYNPNVPSYSAEYDLENTDYN

SEQ ID NO: 1781462 - protein, 33 aa, Staphylococcus epidermidis
KDYKNGNVSYNPNVPSYSAEYQLSNEDDNVKQL

SEQ ID NO: 1781463 - protein, 5 aa, Staphylococcus epidermidis
KDYKP

SEQ ID NO: 1781464 - protein, 11 aa, Staphylococcus epidermidis
KDYKQKIDDTL

SEQ ID NO: 1781465 - protein, 4 aa, Staphylococcus epidermidis
KDYN

SEQ ID NO: 1781466 - protein, 6 aa, Staphylococcus epidermidis
KDYNKE

SEQ ID NO: 1781467 - protein, 6 aa, Staphylococcus epidermidis
KDYPEN

SEQ ID NO: 1781468 - protein, 8 aa, Staphylococcus epidermidis
KDYSKKEI

SEQ ID NO: 1781469 - protein, 6 aa, Staphylococcus epidermidis
KDYTEQ

SEQ ID NO: 1781470 - protein, 12 aa, Staphylococcus epidermidis
KEADNTDKQTVT

SEQ ID NO: 1781471 - protein, 7 aa, Staphylococcus epidermidis
KEADRED

SEQ ID NO: 1781472 - protein, 7 aa, Staphylococcus epidermidis
KEAEYTN

SEQ ID NO: 1781473 - protein, 13 aa, Staphylococcus epidermidis
KEAHITDYTNASR

SEQ ID NO: 1781474 - protein, 5 aa, Staphylococcus epidermidis
KEAIQ

SEQ ID NO: 1781475 - protein, 9 aa, Staphylococcus epidermidis
KEAITANHA

SEQ ID NO: 1781476 - protein, 8 aa, Staphylococcus epidermidis
KEALEDED

SEQ ID NO: 1781477 - protein, 12 aa, Staphylococcus epidermidis
KEALEQNKSELQ

SEQ ID NO: 1781478 - protein, 17 aa, Staphylococcus epidermidis
KEALSFTKEDREKVKDK

SEQ ID NO: 1781479 - protein, 19 aa, Staphylococcus epidermidis
KEALTDPEDAITSAKSMVE

SEQ ID NO: 1781480 - protein, 7 aa, Staphylococcus epidermidis
KEAQKRL

SEQ ID NO: 1781481 - protein, 5 aa, Staphylococcus epidermidis
KEARE

SEQ ID NO: 1781482 - protein, 14 aa, Staphylococcus epidermidis
KEARERALNGEGAT

SEQ ID NO: 1781483 - protein, 11 aa, Staphylococcus epidermidis
KEARLASGALA

SEQ ID NO: 1781484 - protein, 12 aa, Staphylococcus epidermidis
KEASIDKKIAED

SEQ ID NO: 1781485 - protein, 5 aa, Staphylococcus epidermidis
KEASR

SEQ ID NO: 1781486 - protein, 5 aa, Staphylococcus epidermidis
KEATG

SEQ ID NO: 1781487 - protein, 6 aa, Staphylococcus epidermidis
KEATGV

SEQ ID NO: 1781488 - protein, 8 aa, Staphylococcus epidermidis
KEATTVTE

SEQ ID NO: 1781489 - protein, 10 aa, Staphylococcus epidermidis
KEAVDEGAEA

SEQ ID NO: 1781490 - protein, 5 aa, Staphylococcus epidermidis
KEAVE

SEQ ID NO: 1781491 - protein, 12 aa, Staphylococcus epidermidis
KEDAGETNSGAV

SEQ ID NO: 1781492 - protein, 10 aa, Staphylococcus epidermidis
KEDAITNYAS

SEQ ID NO: 1781493 - protein, 8 aa, Staphylococcus epidermidis
KEDDQEAL

SEQ ID NO: 1781494 - protein, 5 aa, Staphylococcus epidermidis
KEDDR

SEQ ID NO: 1781495 - protein, 5 aa, Staphylococcus epidermidis
KEDDW

SEQ ID NO: 1781496 - protein, 8 aa, Staphylococcus epidermidis
KEDEDRVR

SEQ ID NO: 1781497 - protein, 14 aa, Staphylococcus epidermidis
KEDEPKNKWKPGEI

SEQ ID NO: 1781498 - protein, 6 aa, Staphylococcus epidermidis
KEDEYN

SEQ ID NO: 1781499 - protein, 6 aa, Staphylococcus epidermidis
KEDFAR

SEQ ID NO: 1781500 - protein, 9 aa, Staphylococcus epidermidis
KEDFKSAGH

SEQ ID NO: 1781501 - protein, 16 aa, Staphylococcus epidermidis
KEDGIRVSAEGDLNPV

SEQ ID NO: 1781502 - protein, 7 aa, Staphylococcus epidermidis
KEDGTID

SEQ ID NO: 1781503 - protein, 8 aa, Staphylococcus epidermidis
KEDGTVDF

SEQ ID NO: 1781504 - protein, 9 aa, Staphylococcus epidermidis
KEDGTVEKF

SEQ ID NO: 1781505 - protein, 12 aa, Staphylococcus epidermidis
KEDHASSIEGLG

SEQ ID NO: 1781506 - protein, 6 aa, Staphylococcus epidermidis
KEDIKK

SEQ ID NO: 1781507 - protein, 6 aa, Staphylococcus epidermidis
KEDITR

SEQ ID NO: 1781508 - protein, 4 aa, Staphylococcus epidermidis
KEDK

SEQ ID NO: 1781509 - protein, 5 aa, Staphylococcus epidermidis
KEDKI

SEQ ID NO: 1781510 - protein, 18 aa, Staphylococcus epidermidis
KEDKTSYSHNKGLPETRQ

SEQ ID NO: 1781511 - protein, 7 aa, Staphylococcus epidermidis
KEDLTKS

SEQ ID NO: 1781512 - protein, 12 aa, Staphylococcus epidermidis
KEDNDWKDTPHV

SEQ ID NO: 1781513 - protein, 6 aa, Staphylococcus epidermidis
KEDNNI

SEQ ID NO: 1781514 - protein, 13 aa, Staphylococcus epidermidis
KEDPFGDYGKGIR

SEQ ID NO: 1781515 - protein, 7 aa, Staphylococcus epidermidis
KEDSSAE

SEQ ID NO: 1781516 - protein, 7 aa, Staphylococcus epidermidis
KEDTDVE

SEQ ID NO: 1781517 - protein, 4 aa, Staphylococcus epidermidis
KEDW

SEQ ID NO: 1781518 - protein, 8 aa, Staphylococcus epidermidis
KEEAAELA

SEQ ID NO: 1781519 - protein, 4 aa, Staphylococcus epidermidis
KEED

SEQ ID NO: 1781520 - protein, 7 aa, Staphylococcus epidermidis
KEEEDCG

SEQ ID NO: 1781521 - protein, 10 aa, Staphylococcus epidermidis
KEEEDNYPGN

SEQ ID NO: 1781522 - protein, 16 aa, Staphylococcus epidermidis
KEEEGLDNFCEILIPI

SEQ ID NO: 1781523 - protein, 7 aa, Staphylococcus epidermidis
KEEEKYK

SEQ ID NO: 1781524 - protein, 4 aa, Staphylococcus epidermidis
KEEG

SEQ ID NO: 1781525 - protein, 6 aa, Staphylococcus epidermidis
KEEGDE

SEQ ID NO: 1781526 - protein, 9 aa, Staphylococcus epidermidis
KEEGLKAAN

SEQ ID NO: 1781527 - protein, 5 aa, Staphylococcus epidermidis
KEEIQ

SEQ ID NO: 1781528 - protein, 5 aa, Staphylococcus epidermidis
KEEKT

SEQ ID NO: 1781529 - protein, 5 aa, Staphylococcus epidermidis
KEELP

SEQ ID NO: 1781530 - protein, 13 aa, Staphylococcus epidermidis
KEELRDEVDYGGV

SEQ ID NO: 1781531 - protein, 5 aa, Staphylococcus epidermidis
KEEMG

SEQ ID NO: 1781532 - protein, 5 aa, Staphylococcus epidermidis
KEEML

SEQ ID NO: 1781533 - protein, 10 aa, Staphylococcus epidermidis
KEENTKLPHT

SEQ ID NO: 1781534 - protein, 5 aa, Staphylococcus epidermidis
KEENV

SEQ ID NO: 1781535 - protein, 5 aa, Staphylococcus epidermidis
KEENY

SEQ ID NO: 1781536 - protein, 15 aa, Staphylococcus epidermidis
KEEQAEKLKEAGVDR

SEQ ID NO: 1781537 - protein, 5 aa, Staphylococcus epidermidis
KEEQP

SEQ ID NO: 1781538 - protein, 5 aa, Staphylococcus epidermidis
KEEQS

SEQ ID NO: 1781539 - protein, 7 aa, Staphylococcus epidermidis
KEEQVNE

SEQ ID NO: 1781540 - protein, 5 aa, Staphylococcus epidermidis
KEERI

SEQ ID NO: 1781541 - protein, 7 aa, Staphylococcus epidermidis
KEERYHG

SEQ ID NO: 1781542 - protein, 8 aa, Staphylococcus epidermidis
KEESIEDE

SEQ ID NO: 1781543 - protein, 6 aa, Staphylococcus epidermidis
KEETAK

SEQ ID NO: 1781544 - protein, 7 aa, Staphylococcus epidermidis
KEETGNQ

SEQ ID NO: 1781545 - protein, 6 aa, Staphylococcus epidermidis
KEETPV

SEQ ID NO: 1781546 - protein, 5 aa, Staphylococcus epidermidis
KEEWP

SEQ ID NO: 1781547 - protein, 10 aa, Staphylococcus epidermidis
KEFDEEKSKI

SEQ ID NO: 1781548 - protein, 14 aa, Staphylococcus epidermidis
KEFDPAKKISDEDF

SEQ ID NO: 1781549 - protein, 7 aa, Staphylococcus epidermidis
KEFKNTY

SEQ ID NO: 1781550 - protein, 11 aa, Staphylococcus epidermidis
KEFSNDAKITE

SEQ ID NO: 1781551 - protein, 7 aa, Staphylococcus epidermidis
KEFTADT

SEQ ID NO: 1781552 - protein, 4 aa, Staphylococcus epidermidis
KEGA

SEQ ID NO: 1781553 - protein, 12 aa, Staphylococcus epidermidis
KEGAKVTSLEPS

SEQ ID NO: 1781554 - protein, 5 aa, Staphylococcus epidermidis
KEGAT

SEQ ID NO: 1781555 - protein, 8 aa, Staphylococcus epidermidis
KEGDLSRG

SEQ ID NO: 1781556 - protein, 13 aa, Staphylococcus epidermidis
KEGDYPGDITPSG

SEQ ID NO: 1781557 - protein, 9 aa, Staphylococcus epidermidis
KEGEAAYND

SEQ ID NO: 1781558 - protein, 9 aa, Staphylococcus epidermidis
KEGESAYSD

SEQ ID NO: 1781559 - protein, 7 aa, Staphylococcus epidermidis
KEGFKVE

SEQ ID NO: 1781560 - protein, 16 aa, Staphylococcus epidermidis
KEGFRDQEFDKGDKGT

SEQ ID NO: 1781561 - protein, 5 aa, Staphylococcus epidermidis
KEGKD

SEQ ID NO: 1781562 - protein, 5 aa, Staphylococcus epidermidis
KEGKL

SEQ ID NO: 1781563 - protein, 6 aa, Staphylococcus epidermidis
KEGKTI

SEQ ID NO: 1781564 - protein, 8 aa, Staphylococcus epidermidis
KEGKTTQI

SEQ ID NO: 1781565 - protein, 10 aa, Staphylococcus epidermidis
KEGKVGKSNN

SEQ ID NO: 1781566 - protein, 17 aa, Staphylococcus epidermidis
KEGLTPQEVKAHIDQLK

SEQ ID NO: 1781567 - protein, 26 aa, Staphylococcus epidermidis
KEGLTSVDEVTQSTKAGNSCGKCKKQ

SEQ ID NO: 1781568 - protein, 7 aa, Staphylococcus epidermidis
KEGNEKY

SEQ ID NO: 1781569 - protein, 7 aa, Staphylococcus epidermidis
KEGNLEG

SEQ ID NO: 1781570 - protein, 17 aa, Staphylococcus epidermidis
KEGNNLGFKDTTKTALS

SEQ ID NO: 1781571 - protein, 10 aa, Staphylococcus epidermidis
KEGNTTKTHA

SEQ ID NO: 1781572 - protein, 11 aa, Staphylococcus epidermidis
KEGNYPGDITP

SEQ ID NO: 1781573 - protein, 4 aa, Staphylococcus epidermidis
KEGQ

SEQ ID NO: 1781574 - protein, 6 aa, Staphylococcus epidermidis
KEGQEE

SEQ ID NO: 1781575 - protein, 8 aa, Staphylococcus epidermidis
KEGQEKLT

SEQ ID NO: 1781576 - protein, 7 aa, Staphylococcus epidermidis
KEGQIAG

SEQ ID NO: 1781577 - protein, 7 aa, Staphylococcus epidermidis
KEGRPAL

SEQ ID NO: 1781578 - protein, 4 aa, Staphylococcus epidermidis
KEGS

SEQ ID NO: 1781579 - protein, 7 aa, Staphylococcus epidermidis
KEGSGTG

SEQ ID NO: 1781580 - protein, 8 aa, Staphylococcus epidermidis
KEGSISKE

SEQ ID NO: 1781581 - protein, 6 aa, Staphylococcus epidermidis
KEGSYT

SEQ ID NO: 1781582 - protein, 5 aa, Staphylococcus epidermidis
KEGTF

SEQ ID NO: 1781583 - protein, 7 aa, Staphylococcus epidermidis
KEGTSEV

SEQ ID NO: 1781584 - protein, 8 aa, Staphylococcus epidermidis
KEGWQEKV

SEQ ID NO: 1781585 - protein, 9 aa, Staphylococcus epidermidis
KEGYETDGP

SEQ ID NO: 1781586 - protein, 16 aa, Staphylococcus epidermidis
KEGYRDEEFDKDDKGT

SEQ ID NO: 1781587 - protein, 9 aa, Staphylococcus epidermidis
KEGYVETKH

SEQ ID NO: 1781588 - protein, 12 aa, Staphylococcus epidermidis
KEHAEKQKAEIA

SEQ ID NO: 1781589 - protein, 16 aa, Staphylococcus epidermidis
KEHENEYKKRFESPSA

SEQ ID NO: 1781590 - protein, 6 aa, Staphylococcus epidermidis
KEHNVS

SEQ ID NO: 1781591 - protein, 4 aa, Staphylococcus epidermidis
KEHQ

SEQ ID NO: 1781592 - protein, 6 aa, Staphylococcus epidermidis
KEHQGD

SEQ ID NO: 1781593 - protein, 4 aa, Staphylococcus epidermidis
KEIA

SEQ ID NO: 1781594 - protein, 6 aa, Staphylococcus epidermidis
KEIAQS

SEQ ID NO: 1781595 - protein, 6 aa, Staphylococcus epidermidis
KEIDAD

SEQ ID NO: 1781596 - protein, 99 aa, Staphylococcus epidermidis
KEIEASVPEQDEPPKDEGAEVEDNKGDNSGEGSESKPSDDKEEKSSDEEKIDDKPKPDDQPESEAKPSSEAPTIEKVEEPTEEELKKEKDKKEGAKRSM

SEQ ID NO: 1781597 - protein, 5 aa, Staphylococcus epidermidis
KEIEG

SEQ ID NO: 1781598 - protein, 18 aa, Staphylococcus epidermidis
KEIESESINLDTDKLPDI

SEQ ID NO: 1781599 - protein, 4 aa, Staphylococcus epidermidis
KEIG

SEQ ID NO: 1781600 - protein, 11 aa, Staphylococcus epidermidis
KEIGRSTSEGI

SEQ ID NO: 1781601 - protein, 6 aa, Staphylococcus epidermidis
KEIGTF

SEQ ID NO: 1781602 - protein, 7 aa, Staphylococcus epidermidis
KEIHSNG

SEQ ID NO: 1781603 - protein, 13 aa, Staphylococcus epidermidis
KEIKNADNSLKSY

SEQ ID NO: 1781604 - protein, 8 aa, Staphylococcus epidermidis
KEIKSEDF

SEQ ID NO: 1781605 - protein, 26 aa, Staphylococcus epidermidis
KEISDQGRVTVNGNVAKAGTDVKEND

SEQ ID NO: 1781606 - protein, 12 aa, Staphylococcus epidermidis
KEISENKVTGDL

SEQ ID NO: 1781607 - protein, 6 aa, Staphylococcus epidermidis
KEISIR

SEQ ID NO: 1781608 - protein, 8 aa, Staphylococcus epidermidis
KEKAIKPE

SEQ ID NO: 1781609 - protein, 9 aa, Staphylococcus epidermidis
KEKDKPIKA

SEQ ID NO: 1781610 - protein, 8 aa, Staphylococcus epidermidis
KEKEAGEW

SEQ ID NO: 1781611 - protein, 10 aa, Staphylococcus epidermidis
KEKEDHYPGD

SEQ ID NO: 1781612 - protein, 5 aa, Staphylococcus epidermidis
KEKEI

SEQ ID NO: 1781613 - protein, 13 aa, Staphylococcus epidermidis
KEKEIDEKEKEIE

SEQ ID NO: 1781614 - protein, 19 aa, Staphylococcus epidermidis
KEKEKEKEKGKKKERKEEY

SEQ ID NO: 1781615 - protein, 7 aa, Staphylococcus epidermidis
KEKELTD

SEQ ID NO: 1781616 - protein, 13 aa, Staphylococcus epidermidis
KEKENYSKFWRDH

SEQ ID NO: 1781617 - protein, 7 aa, Staphylococcus epidermidis
KEKETNT

SEQ ID NO: 1781618 - protein, 4 aa, Staphylococcus epidermidis
KEKG

SEQ ID NO: 1781619 - protein, 11 aa, Staphylococcus epidermidis
KEKGDTQKEVA

SEQ ID NO: 1781620 - protein, 6 aa, Staphylococcus epidermidis
KEKGEL

SEQ ID NO: 1781621 - protein, 6 aa, Staphylococcus epidermidis
KEKGNT

SEQ ID NO: 1781622 - protein, 6 aa, Staphylococcus epidermidis
KEKGVY

SEQ ID NO: 1781623 - protein, 23 aa, Staphylococcus epidermidis
KEKGVYKGRPQLYSPNAKDPQKR

SEQ ID NO: 1781624 - protein, 19 aa, Staphylococcus epidermidis
KEKHKESTKFKYPKRRDNE

SEQ ID NO: 1781625 - protein, 5 aa, Staphylococcus epidermidis
KEKIY

SEQ ID NO: 1781626 - protein, 8 aa, Staphylococcus epidermidis
KEKKDDKY

SEQ ID NO: 1781627 - protein, 13 aa, Staphylococcus epidermidis
KEKKGNNQKGNLE

SEQ ID NO: 1781628 - protein, 6 aa, Staphylococcus epidermidis
KEKKTT

SEQ ID NO: 1781629 - protein, 15 aa, Staphylococcus epidermidis
KEKNGRCARKTRSGY

SEQ ID NO: 1781630 - protein, 5 aa, Staphylococcus epidermidis
KEKPE

SEQ ID NO: 1781631 - protein, 11 aa, Staphylococcus epidermidis
KEKPEIKESTD

SEQ ID NO: 1781632 - protein, 6 aa, Staphylococcus epidermidis
KEKPKA

SEQ ID NO: 1781633 - protein, 8 aa, Staphylococcus epidermidis
KEKPKEFE

SEQ ID NO: 1781634 - protein, 8 aa, Staphylococcus epidermidis
KEKSDIGF

SEQ ID NO: 1781635 - protein, 17 aa, Staphylococcus epidermidis
KEKSDIGFQTRKKEYPV

SEQ ID NO: 1781636 - protein, 9 aa, Staphylococcus epidermidis
KEKSEYKYQ

SEQ ID NO: 1781637 - protein, 20 aa, Staphylococcus epidermidis
KEKSNLPTTQEELKQRREKA

SEQ ID NO: 1781638 - protein, 7 aa, Staphylococcus epidermidis
KEKTSGV

SEQ ID NO: 1781639 - protein, 7 aa, Staphylococcus epidermidis
KEKWSEE

SEQ ID NO: 1781640 - protein, 7 aa, Staphylococcus epidermidis
KEKYDNL

SEQ ID NO: 1781641 - protein, 8 aa, Staphylococcus epidermidis
KEKYPNSH

SEQ ID NO: 1781642 - protein, 4 aa, Staphylococcus epidermidis
KELA

SEQ ID NO: 1781643 - protein, 7 aa, Staphylococcus epidermidis
KELDTDQ

SEQ ID NO: 1781644 - protein, 4 aa, Staphylococcus epidermidis
KELE

SEQ ID NO: 1781645 - protein, 7 aa, Staphylococcus epidermidis
KELEDAK

SEQ ID NO: 1781646 - protein, 9 aa, Staphylococcus epidermidis
KELEDNSAE

SEQ ID NO: 1781647 - protein, 6 aa, Staphylococcus epidermidis
KELERQ

SEQ ID NO: 1781648 - protein, 8 aa, Staphylococcus epidermidis
KELESRSF

SEQ ID NO: 1781649 - protein, 33 aa, Staphylococcus epidermidis
KELGKEMEQISEENDEDKLNQSHDEDVRSDLQD

SEQ ID NO: 1781650 - protein, 34 aa, Staphylococcus epidermidis
KELGKEMEQISQENDEEKLNQPHDNEVRSDFKNS

SEQ ID NO: 1781651 - protein, 14 aa, Staphylococcus epidermidis
KELKGDNDKDVTEP

SEQ ID NO: 1781652 - protein, 17 aa, Staphylococcus epidermidis
KELKRSLKSKFKDNPSV

SEQ ID NO: 1781653 - protein, 6 aa, Staphylococcus epidermidis
KELNKR

SEQ ID NO: 1781654 - protein, 7 aa, Staphylococcus epidermidis
KELPEKL

SEQ ID NO: 1781655 - protein, 8 aa, Staphylococcus epidermidis
KELPQTKD

SEQ ID NO: 1781656 - protein, 4 aa, Staphylococcus epidermidis
KELQ

SEQ ID NO: 1781657 - protein, 9 aa, Staphylococcus epidermidis
KELSKKADV

SEQ ID NO: 1781658 - protein, 15 aa, Staphylococcus epidermidis
KELTASKKLQSEYED

SEQ ID NO: 1781659 - protein, 8 aa, Staphylococcus epidermidis
KELTDPQI

SEQ ID NO: 1781660 - protein, 5 aa, Staphylococcus epidermidis
KELTE

SEQ ID NO: 1781661 - protein, 14 aa, Staphylococcus epidermidis
KENAFYDPEGEMQL

SEQ ID NO: 1781662 - protein, 6 aa, Staphylococcus epidermidis
KENDEL

SEQ ID NO: 1781663 - protein, 4 aa, Staphylococcus epidermidis
KENE

SEQ ID NO: 1781664 - protein, 25 aa, Staphylococcus epidermidis
KENEANDLNKKLEQQVTETKKSINH

SEQ ID NO: 1781665 - protein, 11 aa, Staphylococcus epidermidis
KENEKKYHYTG

SEQ ID NO: 1781666 - protein, 13 aa, Staphylococcus epidermidis
KENESKNQWKPDE

SEQ ID NO: 1781667 - protein, 6 aa, Staphylococcus epidermidis
KENGKK

SEQ ID NO: 1781668 - protein, 6 aa, Staphylococcus epidermidis
KENGLD

SEQ ID NO: 1781669 - protein, 14 aa, Staphylococcus epidermidis
KENGLGDKAGLKKG

SEQ ID NO: 1781670 - protein, 5 aa, Staphylococcus epidermidis
KENGR

SEQ ID NO: 1781671 - protein, 5 aa, Staphylococcus epidermidis
KENGV

SEQ ID NO: 1781672 - protein, 8 aa, Staphylococcus epidermidis
KENGVYKG

SEQ ID NO: 1781673 - protein, 14 aa, Staphylococcus epidermidis
KENKELKKSDFETY

SEQ ID NO: 1781674 - protein, 8 aa, Staphylococcus epidermidis
KENKEVDE

SEQ ID NO: 1781675 - protein, 5 aa, Staphylococcus epidermidis
KENKV

SEQ ID NO: 1781676 - protein, 18 aa, Staphylococcus epidermidis
KENLNKKDYKADPPLIWG

SEQ ID NO: 1781677 - protein, 14 aa, Staphylococcus epidermidis
KENLTKNGDKHAFT

SEQ ID NO: 1781678 - protein, 15 aa, Staphylococcus epidermidis
KENPDLKSKSISRPI

SEQ ID NO: 1781679 - protein, 8 aa, Staphylococcus epidermidis
KENPDLTK

SEQ ID NO: 1781680 - protein, 8 aa, Staphylococcus epidermidis
KENQEPWT

SEQ ID NO: 1781681 - protein, 7 aa, Staphylococcus epidermidis
KENQRKE

SEQ ID NO: 1781682 - protein, 7 aa, Staphylococcus epidermidis
KENRGLG

SEQ ID NO: 1781683 - protein, 7 aa, Staphylococcus epidermidis
KENTDKA

SEQ ID NO: 1781684 - protein, 5 aa, Staphylococcus epidermidis
KENTY

SEQ ID NO: 1781685 - protein, 6 aa, Staphylococcus epidermidis
KENVKA

SEQ ID NO: 1781686 - protein, 9 aa, Staphylococcus epidermidis
KENVVTEPN

SEQ ID NO: 1781687 - protein, 4 aa, Staphylococcus epidermidis
KENY

SEQ ID NO: 1781688 - protein, 17 aa, Staphylococcus epidermidis
KENYPNRTMIVDDIPLE

SEQ ID NO: 1781689 - protein, 13 aa, Staphylococcus epidermidis
KEPIGSPRPRFRN

SEQ ID NO: 1781690 - protein, 6 aa, Staphylococcus epidermidis
KEPKCN

SEQ ID NO: 1781691 - protein, 11 aa, Staphylococcus epidermidis
KEPKNRHTYPT

SEQ ID NO: 1781692 - protein, 9 aa, Staphylococcus epidermidis
KEPREHTSK

SEQ ID NO: 1781693 - protein, 6 aa, Staphylococcus epidermidis
KEPTER

SEQ ID NO: 1781694 - protein, 7 aa, Staphylococcus epidermidis
KEPTNGV

SEQ ID NO: 1781695 - protein, 7 aa, Staphylococcus epidermidis
KEPYDKH

SEQ ID NO: 1781696 - protein, 10 aa, Staphylococcus epidermidis
KEQAESYGHS

SEQ ID NO: 1781697 - protein, 18 aa, Staphylococcus epidermidis
KEQDGLQSKEANESKTVE

SEQ ID NO: 1781698 - protein, 6 aa, Staphylococcus epidermidis
KEQDIK

SEQ ID NO: 1781699 - protein, 6 aa, Staphylococcus epidermidis
KEQDTR

SEQ ID NO: 1781700 - protein, 8 aa, Staphylococcus epidermidis
KEQGGDVN

SEQ ID NO: 1781701 - protein, 17 aa, Staphylococcus epidermidis
KEQGQDMTSNNKQQAIS

SEQ ID NO: 1781702 - protein, 19 aa, Staphylococcus epidermidis
KEQHESKNEAEKESNEEVV

SEQ ID NO: 1781703 - protein, 4 aa, Staphylococcus epidermidis
KEQI

SEQ ID NO: 1781704 - protein, 13 aa, Staphylococcus epidermidis
KEQKDKAEKLSEQ

SEQ ID NO: 1781705 - protein, 7 aa, Staphylococcus epidermidis
KEQKGLG

SEQ ID NO: 1781706 - protein, 6 aa, Staphylococcus epidermidis
KEQLQQ

SEQ ID NO: 1781707 - protein, 11 aa, Staphylococcus epidermidis
KEQNETPLEAS

SEQ ID NO: 1781708 - protein, 18 aa, Staphylococcus epidermidis
KEQNGQDRKDQDAPQTVE

SEQ ID NO: 1781709 - protein, 5 aa, Staphylococcus epidermidis
KEQNL

SEQ ID NO: 1781710 - protein, 6 aa, Staphylococcus epidermidis
KEQPGY

SEQ ID NO: 1781711 - protein, 16 aa, Staphylococcus epidermidis
KEQQQAFRQQLELDWE

SEQ ID NO: 1781712 - protein, 7 aa, Staphylococcus epidermidis
KEQQRLK

SEQ ID NO: 1781713 - protein, 21 aa, Staphylococcus epidermidis
KEQQSEVSSNSEEISPQNDTE

SEQ ID NO: 1781714 - protein, 17 aa, Staphylococcus epidermidis
KEQRGPLDGDYEYHDNN

SEQ ID NO: 1781715 - protein, 16 aa, Staphylococcus epidermidis
KEQRQKIKGLPHNANE

SEQ ID NO: 1781716 - protein, 25 aa, Staphylococcus epidermidis
KEQSKPDGTFPTVDSPNPEDESAFN

SEQ ID NO: 1781717 - protein, 12 aa, Staphylococcus epidermidis
KEQSKRDKEQIK

SEQ ID NO: 1781718 - protein, 6 aa, Staphylococcus epidermidis
KEQSYR

SEQ ID NO: 1781719 - protein, 12 aa, Staphylococcus epidermidis
KEQTGSEAKAEE

SEQ ID NO: 1781720 - protein, 7 aa, Staphylococcus epidermidis
KEQVTVE

SEQ ID NO: 1781721 - protein, 8 aa, Staphylococcus epidermidis
KERDPLDQ

SEQ ID NO: 1781722 - protein, 14 aa, Staphylococcus epidermidis
KERHADKKKNKYKI

SEQ ID NO: 1781723 - protein, 7 aa, Staphylococcus epidermidis
KERLDGE

SEQ ID NO: 1781724 - protein, 5 aa, Staphylococcus epidermidis
KERMQ

SEQ ID NO: 1781725 - protein, 11 aa, Staphylococcus epidermidis
KERQKEEKAFR

SEQ ID NO: 1781726 - protein, 9 aa, Staphylococcus epidermidis
KERQRDGIE

SEQ ID NO: 1781727 - protein, 4 aa, Staphylococcus epidermidis
KERR

SEQ ID NO: 1781728 - protein, 7 aa, Staphylococcus epidermidis
KERSTEQ

SEQ ID NO: 1781729 - protein, 13 aa, Staphylococcus epidermidis
KERTNGERTETWS

SEQ ID NO: 1781730 - protein, 13 aa, Staphylococcus epidermidis
KERTNGVRTENWS

SEQ ID NO: 1781731 - protein, 7 aa, Staphylococcus epidermidis
KESDPTE

SEQ ID NO: 1781732 - protein, 6 aa, Staphylococcus epidermidis
KESEGI

SEQ ID NO: 1781733 - protein, 5 aa, Staphylococcus epidermidis
KESEV

SEQ ID NO: 1781734 - protein, 6 aa, Staphylococcus epidermidis
KESFSG

SEQ ID NO: 1781735 - protein, 7 aa, Staphylococcus epidermidis
KESGQSC

SEQ ID NO: 1781736 - protein, 4 aa, Staphylococcus epidermidis
KESI

SEQ ID NO: 1781737 - protein, 7 aa, Staphylococcus epidermidis
KESIGKA

SEQ ID NO: 1781738 - protein, 4 aa, Staphylococcus epidermidis
KESK

SEQ ID NO: 1781739 - protein, 8 aa, Staphylococcus epidermidis
KESKVKNI

SEQ ID NO: 1781740 - protein, 9 aa, Staphylococcus epidermidis
KESLEEARE

SEQ ID NO: 1781741 - protein, 12 aa, Staphylococcus epidermidis
KESNEDIVNQYL

SEQ ID NO: 1781742 - protein, 7 aa, Staphylococcus epidermidis
KESNVET

SEQ ID NO: 1781743 - protein, 9 aa, Staphylococcus epidermidis
KESPLSDDA

SEQ ID NO: 1781744 - protein, 7 aa, Staphylococcus epidermidis
KESSEIY

SEQ ID NO: 1781745 - protein, 6 aa, Staphylococcus epidermidis
KESYEG

SEQ ID NO: 1781746 - protein, 5 aa, Staphylococcus epidermidis
KETDG

SEQ ID NO: 1781747 - protein, 7 aa, Staphylococcus epidermidis
KETDKKD

SEQ ID NO: 1781748 - protein, 6 aa, Staphylococcus epidermidis
KETGAS

SEQ ID NO: 1781749 - protein, 10 aa, Staphylococcus epidermidis
KETGKLKMNG

SEQ ID NO: 1781750 - protein, 7 aa, Staphylococcus epidermidis
KETHLTQ

SEQ ID NO: 1781751 - protein, 6 aa, Staphylococcus epidermidis
KETKRP

SEQ ID NO: 1781752 - protein, 9 aa, Staphylococcus epidermidis
KETKRRESI

SEQ ID NO: 1781753 - protein, 5 aa, Staphylococcus epidermidis
KETKY

SEQ ID NO: 1781754 - protein, 6 aa, Staphylococcus epidermidis
KETPDG

SEQ ID NO: 1781755 - protein, 5 aa, Staphylococcus epidermidis
KETSI

SEQ ID NO: 1781756 - protein, 6 aa, Staphylococcus epidermidis
KETSIA

SEQ ID NO: 1781757 - protein, 7 aa, Staphylococcus epidermidis
KETSLGA

SEQ ID NO: 1781758 - protein, 6 aa, Staphylococcus epidermidis
KETSLK

SEQ ID NO: 1781759 - protein, 11 aa, Staphylococcus epidermidis
KETTGSEFSSN

SEQ ID NO: 1781760 - protein, 6 aa, Staphylococcus epidermidis
KETTHS

SEQ ID NO: 1781761 - protein, 25 aa, Staphylococcus epidermidis
KETTKNKVKSKAKPVKKAKAKKGKK

SEQ ID NO: 1781762 - protein, 4 aa, Staphylococcus epidermidis
KETV

SEQ ID NO: 1781763 - protein, 7 aa, Staphylococcus epidermidis
KETVENN

SEQ ID NO: 1781764 - protein, 6 aa, Staphylococcus epidermidis
KETYDI

SEQ ID NO: 1781765 - protein, 22 aa, Staphylococcus epidermidis
KETYMQKDQPNLTNFNKRDDTY

SEQ ID NO: 1781766 - protein, 13 aa, Staphylococcus epidermidis
KEVASNAGVKNVE

SEQ ID NO: 1781767 - protein, 4 aa, Staphylococcus epidermidis
KEVE

SEQ ID NO: 1781768 - protein, 8 aa, Staphylococcus epidermidis
KEVENNEV

SEQ ID NO: 1781769 - protein, 8 aa, Staphylococcus epidermidis
KEVENQEV

SEQ ID NO: 1781770 - protein, 46 aa, Staphylococcus epidermidis
KEVEQTLEENPNSKKNKTKHTQVKQQFDSNERKIKQTKEKIDEEGQ

SEQ ID NO: 1781771 - protein, 11 aa, Staphylococcus epidermidis
KEVKEDIDNLP

SEQ ID NO: 1781772 - protein, 5 aa, Staphylococcus epidermidis
KEVKQ

SEQ ID NO: 1781773 - protein, 5 aa, Staphylococcus epidermidis
KEVPE

SEQ ID NO: 1781774 - protein, 7 aa, Staphylococcus epidermidis
KEVPNAN

SEQ ID NO: 1781775 - protein, 13 aa, Staphylococcus epidermidis
KEVSQTISEATDV

SEQ ID NO: 1781776 - protein, 18 aa, Staphylococcus epidermidis
KEVTNRDEFEEYFATGVK

SEQ ID NO: 1781777 - protein, 21 aa, Staphylococcus epidermidis
KEWQQKNEKDNKENNHDRQGL

SEQ ID NO: 1781778 - protein, 13 aa, Staphylococcus epidermidis
KEYARPALDKEKL

SEQ ID NO: 1781779 - protein, 7 aa, Staphylococcus epidermidis
KEYEYEK

SEQ ID NO: 1781780 - protein, 12 aa, Staphylococcus epidermidis
KEYKQSNASPNV

SEQ ID NO: 1781781 - protein, 8 aa, Staphylococcus epidermidis
KEYNYAKS

SEQ ID NO: 1781782 - protein, 4 aa, Staphylococcus epidermidis
KEYP

SEQ ID NO: 1781783 - protein, 13 aa, Staphylococcus epidermidis
KEYQKHLDNVDIR

SEQ ID NO: 1781784 - protein, 6 aa, Staphylococcus epidermidis
KEYQQL

SEQ ID NO: 1781785 - protein, 9 aa, Staphylococcus epidermidis
KEYQQSDLS

SEQ ID NO: 1781786 - protein, 6 aa, Staphylococcus epidermidis
KEYSEH

SEQ ID NO: 1781787 - protein, 17 aa, Staphylococcus epidermidis
KEYTESDQAQTAIDTDK

SEQ ID NO: 1781788 - protein, 7 aa, Staphylococcus epidermidis
KEYTQSH

SEQ ID NO: 1781789 - protein, 17 aa, Staphylococcus epidermidis
KFANPSITDVVEAIRNG

SEQ ID NO: 1781790 - protein, 12 aa, Staphylococcus epidermidis
KFDSDLKNKILN

SEQ ID NO: 1781791 - protein, 12 aa, Staphylococcus epidermidis
KFEAKINDKTLD

SEQ ID NO: 1781792 - protein, 18 aa, Staphylococcus epidermidis
KFENEDIQSKAIEASGTN

SEQ ID NO: 1781793 - protein, 8 aa, Staphylococcus epidermidis
KFGGPKGA

SEQ ID NO: 1781794 - protein, 15 aa, Staphylococcus epidermidis
KFGSIPDVTDKGYYQ

SEQ ID NO: 1781795 - protein, 18 aa, Staphylococcus epidermidis
KFGTPESQILDPNDTDYI

SEQ ID NO: 1781796 - protein, 5 aa, Staphylococcus epidermidis
KFGTQ

SEQ ID NO: 1781797 - protein, 16 aa, Staphylococcus epidermidis
KFHPNKRRISNTGQRA

SEQ ID NO: 1781798 - protein, 16 aa, Staphylococcus epidermidis
KFHSNKRRISNTGQRA

SEQ ID NO: 1781799 - protein, 93 aa, Staphylococcus epidermidis
KFKASQAKDTNKQNTQNNHQKSNNKQNSNDKEKQQSKNNSKPTKKKEQNNKGKQQNKNNKTNKNQKNNKNKKNNKNNKPQNEVAETKEMPSKI

SEQ ID NO: 1781800 - protein, 93 aa, Staphylococcus epidermidis
KFKASQAKDTNKQNTQNNHQKSNNKQNSNDKEKQQSKNNSKSTKKKEQNNKGKQQNKNNKTNKNQKNNKNKKNNKNNKPQNEVAETKEMPSKI

SEQ ID NO: 1781801 - protein, 8 aa, Staphylococcus epidermidis
KFKGERIP

SEQ ID NO: 1781802 - protein, 8 aa, Staphylococcus epidermidis
KFKPANLQ

SEQ ID NO: 1781803 - protein, 22 aa, Staphylococcus epidermidis
KFKPEYDKEKLKKKQKEEVEAL

SEQ ID NO: 1781804 - protein, 10 aa, Staphylococcus epidermidis
KFKSTPHQDI

SEQ ID NO: 1781805 - protein, 5 aa, Staphylococcus epidermidis
KFNES

SEQ ID NO: 1781806 - protein, 7 aa, Staphylococcus epidermidis
KFNKDNY

SEQ ID NO: 1781807 - protein, 12 aa, Staphylococcus epidermidis
KFNSNKKSERYY

SEQ ID NO: 1781808 - protein, 14 aa, Staphylococcus epidermidis
KFNSVSSRKYKTNI

SEQ ID NO: 1781809 - protein, 6 aa, Staphylococcus epidermidis
KFPGHG

SEQ ID NO: 1781810 - protein, 9 aa, Staphylococcus epidermidis
KFQEANKKN

SEQ ID NO: 1781811 - protein, 9 aa, Staphylococcus epidermidis
KFQEANKKS

SEQ ID NO: 1781812 - protein, 4 aa, Staphylococcus epidermidis
KFQG

SEQ ID NO: 1781813 - protein, 7 aa, Staphylococcus epidermidis
KFSESAI

SEQ ID NO: 1781814 - protein, 7 aa, Staphylococcus epidermidis
KFSQQTR

SEQ ID NO: 1781815 - protein, 6 aa, Staphylococcus epidermidis
KFTEKD

SEQ ID NO: 1781816 - protein, 10 aa, Staphylococcus epidermidis
KGAAASNHFE

SEQ ID NO: 1781817 - protein, 14 aa, Staphylococcus epidermidis
KGAHAAKPEQGNDP

SEQ ID NO: 1781818 - protein, 15 aa, Staphylococcus epidermidis
KGAIGEGAERLERQG

SEQ ID NO: 1781819 - protein, 22 aa, Staphylococcus epidermidis
KGASKGTSHAKDVAKDKTKNVI

SEQ ID NO: 1781820 - protein, 6 aa, Staphylococcus epidermidis
KGASQL

SEQ ID NO: 1781821 - protein, 6 aa, Staphylococcus epidermidis
KGCNGS

SEQ ID NO: 1781822 - protein, 6 aa, Staphylococcus epidermidis
KGDDLV

SEQ ID NO: 1781823 - protein, 6 aa, Staphylococcus epidermidis
KGDKSD

SEQ ID NO: 1781824 - protein, 5 aa, Staphylococcus epidermidis
KGDNT

SEQ ID NO: 1781825 - protein, 13 aa, Staphylococcus epidermidis
KGDPSLKEVQNEI

SEQ ID NO: 1781826 - protein, 25 aa, Staphylococcus epidermidis
KGDQVGRNDPCPCGSGKKYKNCHGQ

SEQ ID NO: 1781827 - protein, 7 aa, Staphylococcus epidermidis
KGDRALK

SEQ ID NO: 1781828 - protein, 27 aa, Staphylococcus epidermidis
KGDTPKVTTVKSKPGSASTPANRRDMN

SEQ ID NO: 1781829 - protein, 9 aa, Staphylococcus epidermidis
KGEDSNAPK

SEQ ID NO: 1781830 - protein, 7 aa, Staphylococcus epidermidis
KGEFPSN

SEQ ID NO: 1781831 - protein, 6 aa, Staphylococcus epidermidis
KGEGTN

SEQ ID NO: 1781832 - protein, 6 aa, Staphylococcus epidermidis
KGEHEF

SEQ ID NO: 1781833 - protein, 8 aa, Staphylococcus epidermidis
KGEKSNPH

SEQ ID NO: 1781834 - protein, 17 aa, Staphylococcus epidermidis
KGEKVEAKTPKLDTETL

SEQ ID NO: 1781835 - protein, 7 aa, Staphylococcus epidermidis
KGELSKL

SEQ ID NO: 1781836 - protein, 6 aa, Staphylococcus epidermidis
KGENDV

SEQ ID NO: 1781837 - protein, 8 aa, Staphylococcus epidermidis
KGENVAAQ

SEQ ID NO: 1781838 - protein, 15 aa, Staphylococcus epidermidis
KGEQTALKIKIPIHL

SEQ ID NO: 1781839 - protein, 8 aa, Staphylococcus epidermidis
KGERQQID

SEQ ID NO: 1781840 - protein, 6 aa, Staphylococcus epidermidis
KGERVN

SEQ ID NO: 1781841 - protein, 8 aa, Staphylococcus epidermidis
KGESISKI

SEQ ID NO: 1781842 - protein, 10 aa, Staphylococcus epidermidis
KGESSEEEIQ

SEQ ID NO: 1781843 - protein, 42 aa, Staphylococcus epidermidis
KGETLAQASSQDKDIASESTSKVDLSTKVGQAIAKKASDKGI

SEQ ID NO: 1781844 - protein, 5 aa, Staphylococcus epidermidis
KGETT

SEQ ID NO: 1781845 - protein, 8 aa, Staphylococcus epidermidis
KGETTSHT

SEQ ID NO: 1781846 - protein, 7 aa, Staphylococcus epidermidis
KGETYDK

SEQ ID NO: 1781847 - protein, 10 aa, Staphylococcus epidermidis
KGEVEETYFP

SEQ ID NO: 1781848 - protein, 6 aa, Staphylococcus epidermidis
KGFEEE

SEQ ID NO: 1781849 - protein, 4 aa, Staphylococcus epidermidis
KGFI

SEQ ID NO: 1781850 - protein, 17 aa, Staphylococcus epidermidis
KGGFTGGATGSAAIAQR

SEQ ID NO: 1781851 - protein, 6 aa, Staphylococcus epidermidis
KGGGGA

SEQ ID NO: 1781852 - protein, 12 aa, Staphylococcus epidermidis
KGGRGSGKSSDI

SEQ ID NO: 1781853 - protein, 7 aa, Staphylococcus epidermidis
KGGSAAN

SEQ ID NO: 1781854 - protein, 21 aa, Staphylococcus epidermidis
KGGTEMTTEEKIASGLNDSNV

SEQ ID NO: 1781855 - protein, 21 aa, Staphylococcus epidermidis
KGGTEMTTEEKITNGLNDSNI

SEQ ID NO: 1781856 - protein, 12 aa, Staphylococcus epidermidis
KGGTGKSTLTKN

SEQ ID NO: 1781857 - protein, 4 aa, Staphylococcus epidermidis
KGHE

SEQ ID NO: 1781858 - protein, 6 aa, Staphylococcus epidermidis
KGHEAM

SEQ ID NO: 1781859 - protein, 8 aa, Staphylococcus epidermidis
KGHLSAPL

SEQ ID NO: 1781860 - protein, 4 aa, Staphylococcus epidermidis
KGHP

SEQ ID NO: 1781861 - protein, 7 aa, Staphylococcus epidermidis
KGHQQQD

SEQ ID NO: 1781862 - protein, 14 aa, Staphylococcus epidermidis
KGHSPHQTERPSLS

SEQ ID NO: 1781863 - protein, 10 aa, Staphylococcus epidermidis
KGHVTNKGVA

SEQ ID NO: 1781864 - protein, 6 aa, Staphylococcus epidermidis
KGHYTS

SEQ ID NO: 1781865 - protein, 4 aa, Staphylococcus epidermidis
KGID

SEQ ID NO: 1781866 - protein, 9 aa, Staphylococcus epidermidis
KGIEKTESN

SEQ ID NO: 1781867 - protein, 6 aa, Staphylococcus epidermidis
KGIKNV

SEQ ID NO: 1781868 - protein, 8 aa, Staphylococcus epidermidis
KGIPTNGV

SEQ ID NO: 1781869 - protein, 18 aa, Staphylococcus epidermidis
KGIQVAPSHERGKNPFPK

SEQ ID NO: 1781870 - protein, 11 aa, Staphylococcus epidermidis
KGIYKSKGTYV

SEQ ID NO: 1781871 - protein, 6 aa, Staphylococcus epidermidis
KGKADL

SEQ ID NO: 1781872 - protein, 38 aa, Staphylococcus epidermidis
KGKDGHNGEDGRDGLNGRDGQSVTTITERGISNNSSGI

SEQ ID NO: 1781873 - protein, 9 aa, Staphylococcus epidermidis
KGKDPSYVK

SEQ ID NO: 1781874 - protein, 8 aa, Staphylococcus epidermidis
KGKECGAR

SEQ ID NO: 1781875 - protein, 10 aa, Staphylococcus epidermidis
KGKELEDNIK

SEQ ID NO: 1781876 - protein, 6 aa, Staphylococcus epidermidis
KGKFEI

SEQ ID NO: 1781877 - protein, 10 aa, Staphylococcus epidermidis
KGKKDNRETI

SEQ ID NO: 1781878 - protein, 11 aa, Staphylococcus epidermidis
KGKKGEVKDVP

SEQ ID NO: 1781879 - protein, 9 aa, Staphylococcus epidermidis
KGKLPKGKK

SEQ ID NO: 1781880 - protein, 9 aa, Staphylococcus epidermidis
KGKNTGFTD

SEQ ID NO: 1781881 - protein, 8 aa, Staphylococcus epidermidis
KGKQQYER

SEQ ID NO: 1781882 - protein, 6 aa, Staphylococcus epidermidis
KGKRDR

SEQ ID NO: 1781883 - protein, 10 aa, Staphylococcus epidermidis
KGKRNPDEVP

SEQ ID NO: 1781884 - protein, 28 aa, Staphylococcus epidermidis
KGKSDYRSLNEEFGNKYGTKNKPTVPSV

SEQ ID NO: 1781885 - protein, 7 aa, Staphylococcus epidermidis
KGKSSFA

SEQ ID NO: 1781886 - protein, 7 aa, Staphylococcus epidermidis
KGKSVAN

SEQ ID NO: 1781887 - protein, 16 aa, Staphylococcus epidermidis
KGKTAHASTPKKGVSA

SEQ ID NO: 1781888 - protein, 15 aa, Staphylococcus epidermidis
KGKTAHASTPTKGVS

SEQ ID NO: 1781889 - protein, 9 aa, Staphylococcus epidermidis
KGKTNKEIA

SEQ ID NO: 1781890 - protein, 5 aa, Staphylococcus epidermidis
KGLDR

SEQ ID NO: 1781891 - protein, 5 aa, Staphylococcus epidermidis
KGLEG

SEQ ID NO: 1781892 - protein, 15 aa, Staphylococcus epidermidis
KGLGYEAAKELKAKG

SEQ ID NO: 1781893 - protein, 9 aa, Staphylococcus epidermidis
KGLKTSKEV

SEQ ID NO: 1781894 - protein, 35 aa, Staphylococcus epidermidis
KGLSSLSKELQKQEKNNLNPVPNSKLKPTKVDEAT

SEQ ID NO: 1781895 - protein, 9 aa, Staphylococcus epidermidis
KGMTKEQKL

SEQ ID NO: 1781896 - protein, 10 aa, Staphylococcus epidermidis
KGNDRDQYKE

SEQ ID NO: 1781897 - protein, 4 aa, Staphylococcus epidermidis
KGNE

SEQ ID NO: 1781898 - protein, 18 aa, Staphylococcus epidermidis
KGNEASGTSVADMADDET

SEQ ID NO: 1781899 - protein, 11 aa, Staphylococcus epidermidis
KGNGQTTEALN

SEQ ID NO: 1781900 - protein, 9 aa, Staphylococcus epidermidis
KGNIERKKH

SEQ ID NO: 1781901 - protein, 8 aa, Staphylococcus epidermidis
KGNKSSLK

SEQ ID NO: 1781902 - protein, 5 aa, Staphylococcus epidermidis
KGNNI

SEQ ID NO: 1781903 - protein, 7 aa, Staphylococcus epidermidis
KGNPYVS

SEQ ID NO: 1781904 - protein, 10 aa, Staphylococcus epidermidis
KGNSWKNNFS

SEQ ID NO: 1781905 - protein, 8 aa, Staphylococcus epidermidis
KGNTTDEL

SEQ ID NO: 1781906 - protein, 16 aa, Staphylococcus epidermidis
KGPIGKGTAKATVDGQ

SEQ ID NO: 1781907 - protein, 9 aa, Staphylococcus epidermidis
KGPKSDALR

SEQ ID NO: 1781908 - protein, 9 aa, Staphylococcus epidermidis
KGPNGEQVK

SEQ ID NO: 1781909 - protein, 23 aa, Staphylococcus epidermidis
KGPNGESVKLNQSEVADEDNFEL

SEQ ID NO: 1781910 - protein, 23 aa, Staphylococcus epidermidis
KGPNGESVKLNQSEVAEEDDFEL

SEQ ID NO: 1781911 - protein, 15 aa, Staphylococcus epidermidis
KGPTGSGKTKLAETL

SEQ ID NO: 1781912 - protein, 21 aa, Staphylococcus epidermidis
KGPTGSGKTKLAETLSQEVQR

SEQ ID NO: 1781913 - protein, 10 aa, Staphylococcus epidermidis
KGPVPKSVQQ

SEQ ID NO: 1781914 - protein, 5 aa, Staphylococcus epidermidis
KGPVS

SEQ ID NO: 1781915 - protein, 6 aa, Staphylococcus epidermidis
KGPYKA

SEQ ID NO: 1781916 - protein, 14 aa, Staphylococcus epidermidis
KGQGYFTNSGTHNK

SEQ ID NO: 1781917 - protein, 9 aa, Staphylococcus epidermidis
KGQINAEQL

SEQ ID NO: 1781918 - protein, 7 aa, Staphylococcus epidermidis
KGQISYK

SEQ ID NO: 1781919 - protein, 6 aa, Staphylococcus epidermidis
KGQIVD

SEQ ID NO: 1781920 - protein, 10 aa, Staphylococcus epidermidis
KGQKKTDYEF

SEQ ID NO: 1781921 - protein, 8 aa, Staphylococcus epidermidis
KGQKSGTF

SEQ ID NO: 1781922 - protein, 5 aa, Staphylococcus epidermidis
KGQRQ

SEQ ID NO: 1781923 - protein, 9 aa, Staphylococcus epidermidis
KGQSLGAVD

SEQ ID NO: 1781924 - protein, 8 aa, Staphylococcus epidermidis
KGQSQLEK

SEQ ID NO: 1781925 - protein, 5 aa, Staphylococcus epidermidis
KGQTF

SEQ ID NO: 1781926 - protein, 8 aa, Staphylococcus epidermidis
KGRDKVTQ

SEQ ID NO: 1781927 - protein, 7 aa, Staphylococcus epidermidis
KGRFEDS

SEQ ID NO: 1781928 - protein, 5 aa, Staphylococcus epidermidis
KGRIE

SEQ ID NO: 1781929 - protein, 11 aa, Staphylococcus epidermidis
KGRKLEKGDEI

SEQ ID NO: 1781930 - protein, 11 aa, Staphylococcus epidermidis
KGRKLKKGDEI

SEQ ID NO: 1781931 - protein, 8 aa, Staphylococcus epidermidis
KGRKNKAV

SEQ ID NO: 1781932 - protein, 10 aa, Staphylococcus epidermidis
KGRPLGEDDF

SEQ ID NO: 1781933 - protein, 6 aa, Staphylococcus epidermidis
KGRSGF

SEQ ID NO: 1781934 - protein, 5 aa, Staphylococcus epidermidis
KGRSI

SEQ ID NO: 1781935 - protein, 4 aa, Staphylococcus epidermidis
KGSE

SEQ ID NO: 1781936 - protein, 6 aa, Staphylococcus epidermidis
KGSGKP

SEQ ID NO: 1781937 - protein, 14 aa, Staphylococcus epidermidis
KGSGRNINNSPIPD

SEQ ID NO: 1781938 - protein, 53 aa, Staphylococcus epidermidis
KGSHSDDSSSKQEEQQEEAPAKEETTSSQSQETSTSSSQEAEVDENKTVKAMP

SEQ ID NO: 1781939 - protein, 10 aa, Staphylococcus epidermidis
KGSHTDKYGR

SEQ ID NO: 1781940 - protein, 6 aa, Staphylococcus epidermidis
KGSIGK

SEQ ID NO: 1781941 - protein, 8 aa, Staphylococcus epidermidis
KGSIKIGK

SEQ ID NO: 1781942 - protein, 8 aa, Staphylococcus epidermidis
KGSIKMGK

SEQ ID NO: 1781943 - protein, 8 aa, Staphylococcus epidermidis
KGSIPRED

SEQ ID NO: 1781944 - protein, 23 aa, Staphylococcus epidermidis
KGSKFEGKLKPNVRYAQSTKLDG

SEQ ID NO: 1781945 - protein, 13 aa, Staphylococcus epidermidis
KGSKQSKKCSEKY

SEQ ID NO: 1781946 - protein, 8 aa, Staphylococcus epidermidis
KGSLGRSY

SEQ ID NO: 1781947 - protein, 8 aa, Staphylococcus epidermidis
KGSNNGYE

SEQ ID NO: 1781948 - protein, 6 aa, Staphylococcus epidermidis
KGSNYK

SEQ ID NO: 1781949 - protein, 14 aa, Staphylococcus epidermidis
KGSRPCYKNETYEH

SEQ ID NO: 1781950 - protein, 7 aa, Staphylococcus epidermidis
KGSSVEQ

SEQ ID NO: 1781951 - protein, 9 aa, Staphylococcus epidermidis
KGSSYTGGF

SEQ ID NO: 1781952 - protein, 10 aa, Staphylococcus epidermidis
KGSTNTPIIQ

SEQ ID NO: 1781953 - protein, 7 aa, Staphylococcus epidermidis
KGSVNGP

SEQ ID NO: 1781954 - protein, 11 aa, Staphylococcus epidermidis
KGSYNNGTGHT

SEQ ID NO: 1781955 - protein, 8 aa, Staphylococcus epidermidis
KGTAKIDK

SEQ ID NO: 1781956 - protein, 7 aa, Staphylococcus epidermidis
KGTEDFK

SEQ ID NO: 1781957 - protein, 16 aa, Staphylococcus epidermidis
KGTEDFKKEATRRFTT

SEQ ID NO: 1781958 - protein, 8 aa, Staphylococcus epidermidis
KGTENKTY

SEQ ID NO: 1781959 - protein, 9 aa, Staphylococcus epidermidis
KGTENKTYL

SEQ ID NO: 1781960 - protein, 12 aa, Staphylococcus epidermidis
KGTFERNPDSGR

SEQ ID NO: 1781961 - protein, 4 aa, Staphylococcus epidermidis
KGTG

SEQ ID NO: 1781962 - protein, 8 aa, Staphylococcus epidermidis
KGTGAGND

SEQ ID NO: 1781963 - protein, 10 aa, Staphylococcus epidermidis
KGTNGSSGFL

SEQ ID NO: 1781964 - protein, 8 aa, Staphylococcus epidermidis
KGTPTSDI

SEQ ID NO: 1781965 - protein, 14 aa, Staphylococcus epidermidis
KGTTNQSRHTSYQQ

SEQ ID NO: 1781966 - protein, 8 aa, Staphylococcus epidermidis
KGTTSPTY

SEQ ID NO: 1781967 - protein, 5 aa, Staphylococcus epidermidis
KGTYL

SEQ ID NO: 1781968 - protein, 13 aa, Staphylococcus epidermidis
KGVISATEDDSHK

SEQ ID NO: 1781969 - protein, 9 aa, Staphylococcus epidermidis
KGVKGSTVR

SEQ ID NO: 1781970 - protein, 7 aa, Staphylococcus epidermidis
KGVNEGA

SEQ ID NO: 1781971 - protein, 6 aa, Staphylococcus epidermidis
KGVNEI

SEQ ID NO: 1781972 - protein, 8 aa, Staphylococcus epidermidis
KGVNTGFG

SEQ ID NO: 1781973 - protein, 5 aa, Staphylococcus epidermidis
KGVPQ

SEQ ID NO: 1781974 - protein, 13 aa, Staphylococcus epidermidis
KGVSKETKSALGT

SEQ ID NO: 1781975 - protein, 6 aa, Staphylococcus epidermidis
KGVTLN

SEQ ID NO: 1781976 - protein, 12 aa, Staphylococcus epidermidis
KGWENKIKTEEP

SEQ ID NO: 1781977 - protein, 4 aa, Staphylococcus epidermidis
KGYD

SEQ ID NO: 1781978 - protein, 5 aa, Staphylococcus epidermidis
KGYDG

SEQ ID NO: 1781979 - protein, 11 aa, Staphylococcus epidermidis
KGYDGTTLDDI

SEQ ID NO: 1781980 - protein, 7 aa, Staphylococcus epidermidis
KGYEQSR

SEQ ID NO: 1781981 - protein, 6 aa, Staphylococcus epidermidis
KGYFEQ

SEQ ID NO: 1781982 - protein, 46 aa, Staphylococcus epidermidis
KGYGKKKEKSDTKNYNPIKPKDLTYSGTFDKSGTWSTTTVGASYSK

SEQ ID NO: 1781983 - protein, 6 aa, Staphylococcus epidermidis
KGYLED

SEQ ID NO: 1781984 - protein, 5 aa, Staphylococcus epidermidis
KGYNA

SEQ ID NO: 1781985 - protein, 15 aa, Staphylococcus epidermidis
KGYPGAYDKGHEVSG

SEQ ID NO: 1781986 - protein, 14 aa, Staphylococcus epidermidis
KGYPGTYEKGHEIS

SEQ ID NO: 1781987 - protein, 8 aa, Staphylococcus epidermidis
KGYQGTNN

SEQ ID NO: 1781988 - protein, 6 aa, Staphylococcus epidermidis
KGYREA

SEQ ID NO: 1781989 - protein, 7 aa, Staphylococcus epidermidis
KGYRTIN

SEQ ID NO: 1781990 - protein, 6 aa, Staphylococcus epidermidis
KGYTAE

SEQ ID NO: 1781991 - protein, 20 aa, Staphylococcus epidermidis
KGYTSYAPQYEGHSAPPEEI

SEQ ID NO: 1781992 - protein, 4 aa, Staphylococcus epidermidis
KGYY

SEQ ID NO: 1781993 - protein, 6 aa, Staphylococcus epidermidis
KHADFN

SEQ ID NO: 1781994 - protein, 10 aa, Staphylococcus epidermidis
KHAEEIASEI

SEQ ID NO: 1781995 - protein, 6 aa, Staphylococcus epidermidis
KHDPLG

SEQ ID NO: 1781996 - protein, 6 aa, Staphylococcus epidermidis
KHDSTN

SEQ ID NO: 1781997 - protein, 6 aa, Staphylococcus epidermidis
KHDTIG

SEQ ID NO: 1781998 - protein, 14 aa, Staphylococcus epidermidis
KHEEDADRLFFVVK

SEQ ID NO: 1781999 - protein, 7 aa, Staphylococcus epidermidis
KHEKAER

SEQ ID NO: 1782000 - protein, 4 aa, Staphylococcus epidermidis
KHEL

SEQ ID NO: 1782001 - protein, 14 aa, Staphylococcus epidermidis
KHENQRDKTYQPRI

SEQ ID NO: 1782002 - protein, 4 aa, Staphylococcus epidermidis
KHER

SEQ ID NO: 1782003 - protein, 21 aa, Staphylococcus epidermidis
KHFKTEKENLLNQSNGKTRDY

SEQ ID NO: 1782004 - protein, 7 aa, Staphylococcus epidermidis
KHKKLYP

SEQ ID NO: 1782005 - protein, 9 aa, Staphylococcus epidermidis
KHKTSLPNG

SEQ ID NO: 1782006 - protein, 6 aa, Staphylococcus epidermidis
KHLQPD

SEQ ID NO: 1782007 - protein, 40 aa, Staphylococcus epidermidis
KHNETKDGKKASKQTKEMKKIAKKSKNKLSIGQIPPKKLG

SEQ ID NO: 1782008 - protein, 6 aa, Staphylococcus epidermidis
KHNPVE

SEQ ID NO: 1782009 - protein, 9 aa, Staphylococcus epidermidis
KHNTESSRR

SEQ ID NO: 1782010 - protein, 18 aa, Staphylococcus epidermidis
KHPEYAKNKYKNAKVPTL

SEQ ID NO: 1782011 - protein, 14 aa, Staphylococcus epidermidis
KHPKQGDLHHPNET

SEQ ID NO: 1782012 - protein, 5 aa, Staphylococcus epidermidis
KHPRG

SEQ ID NO: 1782013 - protein, 11 aa, Staphylococcus epidermidis
KHPTNSKPLKE

SEQ ID NO: 1782014 - protein, 7 aa, Staphylococcus epidermidis
KHQGKTL

SEQ ID NO: 1782015 - protein, 8 aa, Staphylococcus epidermidis
KHQHPADY

SEQ ID NO: 1782016 - protein, 5 aa, Staphylococcus epidermidis
KHQSA

SEQ ID NO: 1782017 - protein, 11 aa, Staphylococcus epidermidis
KHRLYNETNKE

SEQ ID NO: 1782018 - protein, 7 aa, Staphylococcus epidermidis
KHRNDKN

SEQ ID NO: 1782019 - protein, 16 aa, Staphylococcus epidermidis
KHRQGEDCLLCLNVLS

SEQ ID NO: 1782020 - protein, 11 aa, Staphylococcus epidermidis
KHSIENGHSFT

SEQ ID NO: 1782021 - protein, 11 aa, Staphylococcus epidermidis
KHSNPSQFKNT

SEQ ID NO: 1782022 - protein, 26 aa, Staphylococcus epidermidis
KHSTESTIKDYKNKAGQAMKKTEEKV

SEQ ID NO: 1782023 - protein, 14 aa, Staphylococcus epidermidis
KHSTTLNPDDPRPH

SEQ ID NO: 1782024 - protein, 7 aa, Staphylococcus epidermidis
KHTENGI

SEQ ID NO: 1782025 - protein, 8 aa, Staphylococcus epidermidis
KHVRDQNL

SEQ ID NO: 1782026 - protein, 7 aa, Staphylococcus epidermidis
KIAAPKK

SEQ ID NO: 1782027 - protein, 7 aa, Staphylococcus epidermidis
KIADSGY

SEQ ID NO: 1782028 - protein, 9 aa, Staphylococcus epidermidis
KIADTPNEA

SEQ ID NO: 1782029 - protein, 8 aa, Staphylococcus epidermidis
KIADVGEG

SEQ ID NO: 1782030 - protein, 10 aa, Staphylococcus epidermidis
KIAEYEPKAS

SEQ ID NO: 1782031 - protein, 7 aa, Staphylococcus epidermidis
KIAGEEN

SEQ ID NO: 1782032 - protein, 11 aa, Staphylococcus epidermidis
KIAGSAQTRQK

SEQ ID NO: 1782033 - protein, 11 aa, Staphylococcus epidermidis
KIAKDGEGATK

SEQ ID NO: 1782034 - protein, 16 aa, Staphylococcus epidermidis
KIAKEISETVTNEGYE

SEQ ID NO: 1782035 - protein, 6 aa, Staphylococcus epidermidis
KIATRR

SEQ ID NO: 1782036 - protein, 4 aa, Staphylococcus epidermidis
KIAV

SEQ ID NO: 1782037 - protein, 9 aa, Staphylococcus epidermidis
KIDAGYQGN

SEQ ID NO: 1782038 - protein, 9 aa, Staphylococcus epidermidis
KIDERSRDR

SEQ ID NO: 1782039 - protein, 6 aa, Staphylococcus epidermidis
KIDNSN

SEQ ID NO: 1782040 - protein, 9 aa, Staphylococcus epidermidis
KIDNTYKDI

SEQ ID NO: 1782041 - protein, 13 aa, Staphylococcus epidermidis
KIDTEQNNFENGP

SEQ ID NO: 1782042 - protein, 5 aa, Staphylococcus epidermidis
KIEAG

SEQ ID NO: 1782043 - protein, 4 aa, Staphylococcus epidermidis
KIED

SEQ ID NO: 1782044 - protein, 6 aa, Staphylococcus epidermidis
KIEEAK

SEQ ID NO: 1782045 - protein, 6 aa, Staphylococcus epidermidis
KIEKSG

SEQ ID NO: 1782046 - protein, 4 aa, Staphylococcus epidermidis
KIEP

SEQ ID NO: 1782047 - protein, 6 aa, Staphylococcus epidermidis
KIEPKT

SEQ ID NO: 1782048 - protein, 8 aa, Staphylococcus epidermidis
KIEPSDKQ

SEQ ID NO: 1782049 - protein, 10 aa, Staphylococcus epidermidis
KIESDANHPQ

SEQ ID NO: 1782050 - protein, 5 aa, Staphylococcus epidermidis
KIGEA

SEQ ID NO: 1782051 - protein, 5 aa, Staphylococcus epidermidis
KIGEE

SEQ ID NO: 1782052 - protein, 15 aa, Staphylococcus epidermidis
KIGKKVSSKTIPIQR

SEQ ID NO: 1782053 - protein, 14 aa, Staphylococcus epidermidis
KIGVPGEQELGGRG

SEQ ID NO: 1782054 - protein, 6 aa, Staphylococcus epidermidis
KIIEDN

SEQ ID NO: 1782055 - protein, 4 aa, Staphylococcus epidermidis
KIIP

SEQ ID NO: 1782056 - protein, 17 aa, Staphylococcus epidermidis
KIIPTKPISNDKLKKEI

SEQ ID NO: 1782057 - protein, 9 aa, Staphylococcus epidermidis
KIKDNPEHS

SEQ ID NO: 1782058 - protein, 19 aa, Staphylococcus epidermidis
KIKDNRTESDYQEVRAVEF

SEQ ID NO: 1782059 - protein, 26 aa, Staphylococcus epidermidis
KIKDTTNRAVDTTKPKPVSPKFKSIK

SEQ ID NO: 1782060 - protein, 19 aa, Staphylococcus epidermidis
KIKENSPNRTIIVDDIPLE

SEQ ID NO: 1782061 - protein, 6 aa, Staphylococcus epidermidis
KIKGNE

SEQ ID NO: 1782062 - protein, 12 aa, Staphylococcus epidermidis
KIKGNTESTIKD

SEQ ID NO: 1782063 - protein, 21 aa, Staphylococcus epidermidis
KIKKYKKQINDYSKRKHKYEV

SEQ ID NO: 1782064 - protein, 13 aa, Staphylococcus epidermidis
KIKNDKVNAATAL

SEQ ID NO: 1782065 - protein, 10 aa, Staphylococcus epidermidis
KIKNEGQPAV

SEQ ID NO: 1782066 - protein, 13 aa, Staphylococcus epidermidis
KIKPRRATEWRSS

SEQ ID NO: 1782067 - protein, 11 aa, Staphylococcus epidermidis
KIKQNNKTLDT

SEQ ID NO: 1782068 - protein, 10 aa, Staphylococcus epidermidis
KIKQNNNKEL

SEQ ID NO: 1782069 - protein, 4 aa, Staphylococcus epidermidis
KIKT

SEQ ID NO: 1782070 - protein, 12 aa, Staphylococcus epidermidis
KIKTQVSVEEGF

SEQ ID NO: 1782071 - protein, 9 aa, Staphylococcus epidermidis
KINDKAPID

SEQ ID NO: 1782072 - protein, 13 aa, Staphylococcus epidermidis
KINDPNINNNQIN

SEQ ID NO: 1782073 - protein, 12 aa, Staphylococcus epidermidis
KINDPNISNNQI

SEQ ID NO: 1782074 - protein, 10 aa, Staphylococcus epidermidis
KINEQQAKLT

SEQ ID NO: 1782075 - protein, 5 aa, Staphylococcus epidermidis
KINHE

SEQ ID NO: 1782076 - protein, 10 aa, Staphylococcus epidermidis
KINKKDSALQ

SEQ ID NO: 1782077 - protein, 6 aa, Staphylococcus epidermidis
KINNPL

SEQ ID NO: 1782078 - protein, 9 aa, Staphylococcus epidermidis
KINNSQKAA

SEQ ID NO: 1782079 - protein, 18 aa, Staphylococcus epidermidis
KINPSKTIIEDEKDNNIF

SEQ ID NO: 1782080 - protein, 6 aa, Staphylococcus epidermidis
KIPNIS

SEQ ID NO: 1782081 - protein, 5 aa, Staphylococcus epidermidis
KIQAN

SEQ ID NO: 1782082 - protein, 12 aa, Staphylococcus epidermidis
KIQGASDSPLTS

SEQ ID NO: 1782083 - protein, 12 aa, Staphylococcus epidermidis
KIQSKNTNQNQK

SEQ ID NO: 1782084 - protein, 4 aa, Staphylococcus epidermidis
KISD

SEQ ID NO: 1782085 - protein, 5 aa, Staphylococcus epidermidis
KISGN

SEQ ID NO: 1782086 - protein, 11 aa, Staphylococcus epidermidis
KISITTDKTKE

SEQ ID NO: 1782087 - protein, 36 aa, Staphylococcus epidermidis
KISNEIDEAYSKYKSSIDSDSKSEEDKQKRKEISKF

SEQ ID NO: 1782088 - protein, 7 aa, Staphylococcus epidermidis
KISPEGK

SEQ ID NO: 1782089 - protein, 18 aa, Staphylococcus epidermidis
KISSTNKRNEKNANEAEK

SEQ ID NO: 1782090 - protein, 11 aa, Staphylococcus epidermidis
KISTKVNDKIT

SEQ ID NO: 1782091 - protein, 8 aa, Staphylococcus epidermidis
KISYQGLP

SEQ ID NO: 1782092 - protein, 7 aa, Staphylococcus epidermidis
KITEDTR

SEQ ID NO: 1782093 - protein, 6 aa, Staphylococcus epidermidis
KITEEG

SEQ ID NO: 1782094 - protein, 5 aa, Staphylococcus epidermidis
KITKN

SEQ ID NO: 1782095 - protein, 11 aa, Staphylococcus epidermidis
KITQPRTESDW

SEQ ID NO: 1782096 - protein, 6 aa, Staphylococcus epidermidis
KITRTG

SEQ ID NO: 1782097 - protein, 7 aa, Staphylococcus epidermidis
KKAAPNA

SEQ ID NO: 1782098 - protein, 8 aa, Staphylococcus epidermidis
KKAEKIKS

SEQ ID NO: 1782099 - protein, 5 aa, Staphylococcus epidermidis
KKAGA

SEQ ID NO: 1782100 - protein, 9 aa, Staphylococcus epidermidis
KKAGISADA

SEQ ID NO: 1782101 - protein, 13 aa, Staphylococcus epidermidis
KKAGIYDELLTVD

SEQ ID NO: 1782102 - protein, 7 aa, Staphylococcus epidermidis
KKAHAND

SEQ ID NO: 1782103 - protein, 21 aa, Staphylococcus epidermidis
KKAIEQIKPGMTAKEADAISR

SEQ ID NO: 1782104 - protein, 6 aa, Staphylococcus epidermidis
KKAIQE

SEQ ID NO: 1782105 - protein, 4 aa, Staphylococcus epidermidis
KKAL

SEQ ID NO: 1782106 - protein, 5 aa, Staphylococcus epidermidis
KKALQ

SEQ ID NO: 1782107 - protein, 17 aa, Staphylococcus epidermidis
KKALSKNAKGVSRKVDG

SEQ ID NO: 1782108 - protein, 7 aa, Staphylococcus epidermidis
KKALSTS

SEQ ID NO: 1782109 - protein, 9 aa, Staphylococcus epidermidis
KKANGAPTV

SEQ ID NO: 1782110 - protein, 6 aa, Staphylococcus epidermidis
KKANHE

SEQ ID NO: 1782111 - protein, 6 aa, Staphylococcus epidermidis
KKAPFN

SEQ ID NO: 1782112 - protein, 9 aa, Staphylococcus epidermidis
KKAQEAHSS

SEQ ID NO: 1782113 - protein, 8 aa, Staphylococcus epidermidis
KKAQSSRL

SEQ ID NO: 1782114 - protein, 14 aa, Staphylococcus epidermidis
KKAQSTRVKKKGIS

SEQ ID NO: 1782115 - protein, 4 aa, Staphylococcus epidermidis
KKAR

SEQ ID NO: 1782116 - protein, 7 aa, Staphylococcus epidermidis
KKASLNK

SEQ ID NO: 1782117 - protein, 10 aa, Staphylococcus epidermidis
KKASNQDLKN

SEQ ID NO: 1782118 - protein, 14 aa, Staphylococcus epidermidis
KKASQNSKKPRHVV

SEQ ID NO: 1782119 - protein, 10 aa, Staphylococcus epidermidis
KKATKAVGGI

SEQ ID NO: 1782120 - protein, 8 aa, Staphylococcus epidermidis
KKATTIEE

SEQ ID NO: 1782121 - protein, 16 aa, Staphylococcus epidermidis
KKATTREEVKAKRENY

SEQ ID NO: 1782122 - protein, 10 aa, Staphylococcus epidermidis
KKAYESGKGK

SEQ ID NO: 1782123 - protein, 7 aa, Staphylococcus epidermidis
KKCNSTN

SEQ ID NO: 1782124 - protein, 6 aa, Staphylococcus epidermidis
KKCTRD

SEQ ID NO: 1782125 - protein, 6 aa, Staphylococcus epidermidis
KKDAQQ

SEQ ID NO: 1782126 - protein, 5 aa, Staphylococcus epidermidis
KKDCD

SEQ ID NO: 1782127 - protein, 12 aa, Staphylococcus epidermidis
KKDELVEALGSV

SEQ ID NO: 1782128 - protein, 11 aa, Staphylococcus epidermidis
KKDGDHYVNSG

SEQ ID NO: 1782129 - protein, 5 aa, Staphylococcus epidermidis
KKDGF

SEQ ID NO: 1782130 - protein, 18 aa, Staphylococcus epidermidis
KKDGSVTAGNASGINDGA

SEQ ID NO: 1782131 - protein, 11 aa, Staphylococcus epidermidis
KKDHDNDLTKE

SEQ ID NO: 1782132 - protein, 6 aa, Staphylococcus epidermidis
KKDIDN

SEQ ID NO: 1782133 - protein, 5 aa, Staphylococcus epidermidis
KKDIE

SEQ ID NO: 1782134 - protein, 9 aa, Staphylococcus epidermidis
KKDLDNSRK

SEQ ID NO: 1782135 - protein, 8 aa, Staphylococcus epidermidis
KKDLNNSR

SEQ ID NO: 1782136 - protein, 7 aa, Staphylococcus epidermidis
KKDNALE

SEQ ID NO: 1782137 - protein, 16 aa, Staphylococcus epidermidis
KKDNDKYEVTGRISKT

SEQ ID NO: 1782138 - protein, 7 aa, Staphylococcus epidermidis
KKDPNKV

SEQ ID NO: 1782139 - protein, 7 aa, Staphylococcus epidermidis
KKDPTYN

SEQ ID NO: 1782140 - protein, 7 aa, Staphylococcus epidermidis
KKDQSEA

SEQ ID NO: 1782141 - protein, 8 aa, Staphylococcus epidermidis
KKDQSFQE

SEQ ID NO: 1782142 - protein, 5 aa, Staphylococcus epidermidis
KKDQV

SEQ ID NO: 1782143 - protein, 7 aa, Staphylococcus epidermidis
KKDSEFK

SEQ ID NO: 1782144 - protein, 9 aa, Staphylococcus epidermidis
KKDSIADQD

SEQ ID NO: 1782145 - protein, 9 aa, Staphylococcus epidermidis
KKDTKNLKT

SEQ ID NO: 1782146 - protein, 11 aa, Staphylococcus epidermidis
KKDTLSEDGYQ

SEQ ID NO: 1782147 - protein, 21 aa, Staphylococcus epidermidis
KKDVENKSGHQKRVTSNEYGT

SEQ ID NO: 1782148 - protein, 10 aa, Staphylococcus epidermidis
KKEDELETIQ

SEQ ID NO: 1782149 - protein, 8 aa, Staphylococcus epidermidis
KKEEIESA

SEQ ID NO: 1782150 - protein, 6 aa, Staphylococcus epidermidis
KKEFDL

SEQ ID NO: 1782151 - protein, 23 aa, Staphylococcus epidermidis
KKEFEEEKAKDSHYRLEHVDHYL

SEQ ID NO: 1782152 - protein, 8 aa, Staphylococcus epidermidis
KKEFETTK

SEQ ID NO: 1782153 - protein, 7 aa, Staphylococcus epidermidis
KKEGKSQ

SEQ ID NO: 1782154 - protein, 9 aa, Staphylococcus epidermidis
KKEKETEII

SEQ ID NO: 1782155 - protein, 15 aa, Staphylococcus epidermidis
KKEKLTKELNDKNKD

SEQ ID NO: 1782156 - protein, 7 aa, Staphylococcus epidermidis
KKEKRKI

SEQ ID NO: 1782157 - protein, 9 aa, Staphylococcus epidermidis
KKELQEMTN

SEQ ID NO: 1782158 - protein, 7 aa, Staphylococcus epidermidis
KKELSQA

SEQ ID NO: 1782159 - protein, 5 aa, Staphylococcus epidermidis
KKEND

SEQ ID NO: 1782160 - protein, 5 aa, Staphylococcus epidermidis
KKENE

SEQ ID NO: 1782161 - protein, 6 aa, Staphylococcus epidermidis
KKENED

SEQ ID NO: 1782162 - protein, 4 aa, Staphylococcus epidermidis
KKEQ

SEQ ID NO: 1782163 - protein, 9 aa, Staphylococcus epidermidis
KKEQNDDAI

SEQ ID NO: 1782164 - protein, 7 aa, Staphylococcus epidermidis
KKEQSVV

SEQ ID NO: 1782165 - protein, 10 aa, Staphylococcus epidermidis
KKERAARKEK

SEQ ID NO: 1782166 - protein, 10 aa, Staphylococcus epidermidis
KKERKNNRRT

SEQ ID NO: 1782167 - protein, 6 aa, Staphylococcus epidermidis
KKERPE

SEQ ID NO: 1782168 - protein, 10 aa, Staphylococcus epidermidis
KKESKDRITP

SEQ ID NO: 1782169 - protein, 9 aa, Staphylococcus epidermidis
KKETDTQPL

SEQ ID NO: 1782170 - protein, 9 aa, Staphylococcus epidermidis
KKETKRLGK

SEQ ID NO: 1782171 - protein, 7 aa, Staphylococcus epidermidis
KKETNLV

SEQ ID NO: 1782172 - protein, 9 aa, Staphylococcus epidermidis
KKETRDNGT

SEQ ID NO: 1782173 - protein, 7 aa, Staphylococcus epidermidis
KKEYKDQ

SEQ ID NO: 1782174 - protein, 6 aa, Staphylococcus epidermidis
KKEYPV

SEQ ID NO: 1782175 - protein, 6 aa, Staphylococcus epidermidis
KKFEGV

SEQ ID NO: 1782176 - protein, 5 aa, Staphylococcus epidermidis
KKFKH

SEQ ID NO: 1782177 - protein, 7 aa, Staphylococcus epidermidis
KKFQSQY

SEQ ID NO: 1782178 - protein, 7 aa, Staphylococcus epidermidis
KKFSKKA

SEQ ID NO: 1782179 - protein, 6 aa, Staphylococcus epidermidis
KKFWET

SEQ ID NO: 1782180 - protein, 6 aa, Staphylococcus epidermidis
KKGAGI

SEQ ID NO: 1782181 - protein, 7 aa, Staphylococcus epidermidis
KKGASRA

SEQ ID NO: 1782182 - protein, 6 aa, Staphylococcus epidermidis
KKGEKV

SEQ ID NO: 1782183 - protein, 7 aa, Staphylococcus epidermidis
KKGEPFN

SEQ ID NO: 1782184 - protein, 5 aa, Staphylococcus epidermidis
KKGFE

SEQ ID NO: 1782185 - protein, 5 aa, Staphylococcus epidermidis
KKGFL

SEQ ID NO: 1782186 - protein, 12 aa, Staphylococcus epidermidis
KKGGEIKVDENG

SEQ ID NO: 1782187 - protein, 10 aa, Staphylococcus epidermidis
KKGIKPTPEG

SEQ ID NO: 1782188 - protein, 19 aa, Staphylococcus epidermidis
KKGKGSQSTLDHDEGGLIG

SEQ ID NO: 1782189 - protein, 19 aa, Staphylococcus epidermidis
KKGNRPGFSNSKSPDEAKQ

SEQ ID NO: 1782190 - protein, 6 aa, Staphylococcus epidermidis
KKGNYV

SEQ ID NO: 1782191 - protein, 7 aa, Staphylococcus epidermidis
KKGPKGG

SEQ ID NO: 1782192 - protein, 6 aa, Staphylococcus epidermidis
KKGTGY

SEQ ID NO: 1782193 - protein, 4 aa, Staphylococcus epidermidis
KKGY

SEQ ID NO: 1782194 - protein, 26 aa, Staphylococcus epidermidis
KKHGSKEAIHPNDDVNKSQSSNDTFP

SEQ ID NO: 1782195 - protein, 7 aa, Staphylococcus epidermidis
KKHHIPE

SEQ ID NO: 1782196 - protein, 6 aa, Staphylococcus epidermidis
KKHKGR

SEQ ID NO: 1782197 - protein, 6 aa, Staphylococcus epidermidis
KKHKLG

SEQ ID NO: 1782198 - protein, 5 aa, Staphylococcus epidermidis
KKHNE

SEQ ID NO: 1782199 - protein, 7 aa, Staphylococcus epidermidis
KKHNKTN

SEQ ID NO: 1782200 - protein, 6 aa, Staphylococcus epidermidis
KKHNTN

SEQ ID NO: 1782201 - protein, 7 aa, Staphylococcus epidermidis
KKHQEEM

SEQ ID NO: 1782202 - protein, 6 aa, Staphylococcus epidermidis
KKHQYN

SEQ ID NO: 1782203 - protein, 8 aa, Staphylococcus epidermidis
KKHVEKEI

SEQ ID NO: 1782204 - protein, 17 aa, Staphylococcus epidermidis
KKHVKPSKRWSEEEEQI

SEQ ID NO: 1782205 - protein, 6 aa, Staphylococcus epidermidis
KKIEDN

SEQ ID NO: 1782206 - protein, 5 aa, Staphylococcus epidermidis
KKIES

SEQ ID NO: 1782207 - protein, 5 aa, Staphylococcus epidermidis
KKIGE

SEQ ID NO: 1782208 - protein, 6 aa, Staphylococcus epidermidis
KKIKET

SEQ ID NO: 1782209 - protein, 23 aa, Staphylococcus epidermidis
KKIKETNEGMEEALNDAKKHYDH

SEQ ID NO: 1782210 - protein, 14 aa, Staphylococcus epidermidis
KKILSTNGSGRTNE

SEQ ID NO: 1782211 - protein, 4 aa, Staphylococcus epidermidis
KKIN

SEQ ID NO: 1782212 - protein, 7 aa, Staphylococcus epidermidis
KKINNNY

SEQ ID NO: 1782213 - protein, 9 aa, Staphylococcus epidermidis
KKIPSPKLA

SEQ ID NO: 1782214 - protein, 4 aa, Staphylococcus epidermidis
KKIS

SEQ ID NO: 1782215 - protein, 50 aa, Staphylococcus epidermidis
KKISVPELTPERKANANHRKDRESNKSEEFKQINTNRKTDSNSNEANGIE

SEQ ID NO: 1782216 - protein, 6 aa, Staphylococcus epidermidis
KKKAPD

SEQ ID NO: 1782217 - protein, 11 aa, Staphylococcus epidermidis
KKKASQGNNPL

SEQ ID NO: 1782218 - protein, 5 aa, Staphylococcus epidermidis
KKKDN

SEQ ID NO: 1782219 - protein, 9 aa, Staphylococcus epidermidis
KKKEPTYEE

SEQ ID NO: 1782220 - protein, 7 aa, Staphylococcus epidermidis
KKKGQTV

SEQ ID NO: 1782221 - protein, 8 aa, Staphylococcus epidermidis
KKKGRSSQ

SEQ ID NO: 1782222 - protein, 5 aa, Staphylococcus epidermidis
KKKKA

SEQ ID NO: 1782223 - protein, 31 aa, Staphylococcus epidermidis
KKKKKEEEQEQRLNKATDELQDKVDQQIRQP

SEQ ID NO: 1782224 - protein, 9 aa, Staphylococcus epidermidis
KKKNIEKEI

SEQ ID NO: 1782225 - protein, 18 aa, Staphylococcus epidermidis
KKKQGYNKENVKKRTTMS

SEQ ID NO: 1782226 - protein, 15 aa, Staphylococcus epidermidis
KKKRKEAEQKRIEEA

SEQ ID NO: 1782227 - protein, 22 aa, Staphylococcus epidermidis
KKKSKAEQKAFRNELDETRFVV

SEQ ID NO: 1782228 - protein, 8 aa, Staphylococcus epidermidis
KKKTAKQL

SEQ ID NO: 1782229 - protein, 7 aa, Staphylococcus epidermidis
KKKTQRA

SEQ ID NO: 1782230 - protein, 7 aa, Staphylococcus epidermidis
KKKVSDH

SEQ ID NO: 1782231 - protein, 10 aa, Staphylococcus epidermidis
KKLEDNGFEG

SEQ ID NO: 1782232 - protein, 6 aa, Staphylococcus epidermidis
KKLENE

SEQ ID NO: 1782233 - protein, 13 aa, Staphylococcus epidermidis
KKLKKEGYFDQSN

SEQ ID NO: 1782234 - protein, 11 aa, Staphylococcus epidermidis
KKLKNENQKIQ

SEQ ID NO: 1782235 - protein, 10 aa, Staphylococcus epidermidis
KKLKSKGTYY

SEQ ID NO: 1782236 - protein, 7 aa, Staphylococcus epidermidis
KKLPTIT

SEQ ID NO: 1782237 - protein, 6 aa, Staphylococcus epidermidis
KKLRNR

SEQ ID NO: 1782238 - protein, 14 aa, Staphylococcus epidermidis
KKLSGEEPQFVVNN

SEQ ID NO: 1782239 - protein, 8 aa, Staphylococcus epidermidis
KKLSPFDR

SEQ ID NO: 1782240 - protein, 20 aa, Staphylococcus epidermidis
KKMHSRAKGALNNANEKIDD

SEQ ID NO: 1782241 - protein, 10 aa, Staphylococcus epidermidis
KKMSELENNQ

SEQ ID NO: 1782242 - protein, 10 aa, Staphylococcus epidermidis
KKNAQNSSKS

SEQ ID NO: 1782243 - protein, 8 aa, Staphylococcus epidermidis
KKNDNSDI

SEQ ID NO: 1782244 - protein, 6 aa, Staphylococcus epidermidis
KKNENE

SEQ ID NO: 1782245 - protein, 7 aa, Staphylococcus epidermidis
KKNENRT

SEQ ID NO: 1782246 - protein, 13 aa, Staphylococcus epidermidis
KKNFSKDNSTDDI

SEQ ID NO: 1782247 - protein, 11 aa, Staphylococcus epidermidis
KKNFTKNNSVD

SEQ ID NO: 1782248 - protein, 11 aa, Staphylococcus epidermidis
KKNGKEQTVKA

SEQ ID NO: 1782249 - protein, 4 aa, Staphylococcus epidermidis
KKNH

SEQ ID NO: 1782250 - protein, 7 aa, Staphylococcus epidermidis
KKNKETD

SEQ ID NO: 1782251 - protein, 5 aa, Staphylococcus epidermidis
KKNKV

SEQ ID NO: 1782252 - protein, 7 aa, Staphylococcus epidermidis
KKNLGEH

SEQ ID NO: 1782253 - protein, 7 aa, Staphylococcus epidermidis
KKNNRKK

SEQ ID NO: 1782254 - protein, 8 aa, Staphylococcus epidermidis
KKNNSQVS

SEQ ID NO: 1782255 - protein, 21 aa, Staphylococcus epidermidis
KKNPAKNAKPFGLKSSQSIDD

SEQ ID NO: 1782256 - protein, 18 aa, Staphylococcus epidermidis
KKNPERYAKEQQDRANYY

SEQ ID NO: 1782257 - protein, 22 aa, Staphylococcus epidermidis
KKNPERYKQEQQDRANYIKDNH

SEQ ID NO: 1782258 - protein, 6 aa, Staphylococcus epidermidis
KKNPHR

SEQ ID NO: 1782259 - protein, 13 aa, Staphylococcus epidermidis
KKNPNQTIFSKDI

SEQ ID NO: 1782260 - protein, 17 aa, Staphylococcus epidermidis
KKNPTHYEQYQRGSGRK

SEQ ID NO: 1782261 - protein, 16 aa, Staphylococcus epidermidis
KKNQFPDELSGGQKQR

SEQ ID NO: 1782262 - protein, 28 aa, Staphylococcus epidermidis
KKNQNKTDYFDNEKKVETKTNNDNLVKN

SEQ ID NO: 1782263 - protein, 12 aa, Staphylococcus epidermidis
KKNQSQRIKKKG

SEQ ID NO: 1782264 - protein, 7 aa, Staphylococcus epidermidis
KKNRFKV

SEQ ID NO: 1782265 - protein, 5 aa, Staphylococcus epidermidis
KKNSQ

SEQ ID NO: 1782266 - protein, 19 aa, Staphylococcus epidermidis
KKNTKSVSQIKKEKSKKEE

SEQ ID NO: 1782267 - protein, 6 aa, Staphylococcus epidermidis
KKPENG

SEQ ID NO: 1782268 - protein, 7 aa, Staphylococcus epidermidis
KKPFSPR

SEQ ID NO: 1782269 - protein, 7 aa, Staphylococcus epidermidis
KKPHFTN

SEQ ID NO: 1782270 - protein, 6 aa, Staphylococcus epidermidis
KKPHRI

SEQ ID NO: 1782271 - protein, 4 aa, Staphylococcus epidermidis
KKPL

SEQ ID NO: 1782272 - protein, 8 aa, Staphylococcus epidermidis
KKQDDQSI

SEQ ID NO: 1782273 - protein, 5 aa, Staphylococcus epidermidis
KKQDI

SEQ ID NO: 1782274 - protein, 19 aa, Staphylococcus epidermidis
KKQDMYQDTAYGQRVGNHK

SEQ ID NO: 1782275 - protein, 6 aa, Staphylococcus epidermidis
KKQELN

SEQ ID NO: 1782276 - protein, 10 aa, Staphylococcus epidermidis
KKQERKDNAD

SEQ ID NO: 1782277 - protein, 10 aa, Staphylococcus epidermidis
KKQERRDNAN

SEQ ID NO: 1782278 - protein, 23 aa, Staphylococcus epidermidis
KKQGRFKGKPKKYSPHSKDKYGR

SEQ ID NO: 1782279 - protein, 6 aa, Staphylococcus epidermidis
KKQGVD

SEQ ID NO: 1782280 - protein, 9 aa, Staphylococcus epidermidis
KKQKNALDN

SEQ ID NO: 1782281 - protein, 4 aa, Staphylococcus epidermidis
KKQL

SEQ ID NO: 1782282 - protein, 30 aa, Staphylococcus epidermidis
KKQLDEQYEEKSIKQNVQKKKYDKINAGDE

SEQ ID NO: 1782283 - protein, 14 aa, Staphylococcus epidermidis
KKQLEKGIEILTEI

SEQ ID NO: 1782284 - protein, 21 aa, Staphylococcus epidermidis
KKQNIATATVGEGSSNQGDFH

SEQ ID NO: 1782285 - protein, 8 aa, Staphylococcus epidermidis
KKQPPLKA

SEQ ID NO: 1782286 - protein, 6 aa, Staphylococcus epidermidis
KKQQEY

SEQ ID NO: 1782287 - protein, 15 aa, Staphylococcus epidermidis
KKQQNEDKPSYNAKK

SEQ ID NO: 1782288 - protein, 14 aa, Staphylococcus epidermidis
KKQSKSEIDKKVTE

SEQ ID NO: 1782289 - protein, 11 aa, Staphylococcus epidermidis
KKQTNTTTYNT

SEQ ID NO: 1782290 - protein, 10 aa, Staphylococcus epidermidis
KKQTRENRKE

SEQ ID NO: 1782291 - protein, 22 aa, Staphylococcus epidermidis
KKQVENYEYDKEKTKNKLNELN

SEQ ID NO: 1782292 - protein, 13 aa, Staphylococcus epidermidis
KKQVVPQITEVLT

SEQ ID NO: 1782293 - protein, 9 aa, Staphylococcus epidermidis
KKRGGYHTG

SEQ ID NO: 1782294 - protein, 11 aa, Staphylococcus epidermidis
KKRHTKASVQE

SEQ ID NO: 1782295 - protein, 7 aa, Staphylococcus epidermidis
KKRISNE

SEQ ID NO: 1782296 - protein, 8 aa, Staphylococcus epidermidis
KKRISQEE

SEQ ID NO: 1782297 - protein, 6 aa, Staphylococcus epidermidis
KKRLKE

SEQ ID NO: 1782298 - protein, 5 aa, Staphylococcus epidermidis
KKRMP

SEQ ID NO: 1782299 - protein, 8 aa, Staphylococcus epidermidis
KKRRPIEN

SEQ ID NO: 1782300 - protein, 8 aa, Staphylococcus epidermidis
KKRSEREA

SEQ ID NO: 1782301 - protein, 11 aa, Staphylococcus epidermidis
KKRSLKSLDNA

SEQ ID NO: 1782302 - protein, 9 aa, Staphylococcus epidermidis
KKRTEKEVR

SEQ ID NO: 1782303 - protein, 14 aa, Staphylococcus epidermidis
KKRTKGSQSTKEET

SEQ ID NO: 1782304 - protein, 7 aa, Staphylococcus epidermidis
KKRTKHT

SEQ ID NO: 1782305 - protein, 8 aa, Staphylococcus epidermidis
KKSANDSD

SEQ ID NO: 1782306 - protein, 6 aa, Staphylococcus epidermidis
KKSDVV

SEQ ID NO: 1782307 - protein, 7 aa, Staphylococcus epidermidis
KKSEDDL

SEQ ID NO: 1782308 - protein, 4 aa, Staphylococcus epidermidis
KKSF

SEQ ID NO: 1782309 - protein, 5 aa, Staphylococcus epidermidis
KKSFE

SEQ ID NO: 1782310 - protein, 11 aa, Staphylococcus epidermidis
KKSFNNTQDTY

SEQ ID NO: 1782311 - protein, 8 aa, Staphylococcus epidermidis
KKSFNSNH

SEQ ID NO: 1782312 - protein, 10 aa, Staphylococcus epidermidis
KKSFRGSKKR

SEQ ID NO: 1782313 - protein, 7 aa, Staphylococcus epidermidis
KKSGEFP

SEQ ID NO: 1782314 - protein, 5 aa, Staphylococcus epidermidis
KKSGI

SEQ ID NO: 1782315 - protein, 15 aa, Staphylococcus epidermidis
KKSGLLKENSKWNKE

SEQ ID NO: 1782316 - protein, 11 aa, Staphylococcus epidermidis
KKSKKEAYQEA

SEQ ID NO: 1782317 - protein, 7 aa, Staphylococcus epidermidis
KKSKSPY

SEQ ID NO: 1782318 - protein, 7 aa, Staphylococcus epidermidis
KKSLGWE

SEQ ID NO: 1782319 - protein, 34 aa, Staphylococcus epidermidis
KKSNNQNNQHKQIKQKQNKETIKRTRNQRTNKQT

SEQ ID NO: 1782320 - protein, 13 aa, Staphylococcus epidermidis
KKSPEQIKSENLN

SEQ ID NO: 1782321 - protein, 4 aa, Staphylococcus epidermidis
KKSQ

SEQ ID NO: 1782322 - protein, 13 aa, Staphylococcus epidermidis
KKSRISYKDKQKY

SEQ ID NO: 1782323 - protein, 6 aa, Staphylococcus epidermidis
KKSSEI

SEQ ID NO: 1782324 - protein, 6 aa, Staphylococcus epidermidis
KKSTRA

SEQ ID NO: 1782325 - protein, 4 aa, Staphylococcus epidermidis
KKTD

SEQ ID NO: 1782326 - protein, 9 aa, Staphylococcus epidermidis
KKTDKGQFT

SEQ ID NO: 1782327 - protein, 7 aa, Staphylococcus epidermidis
KKTEEYR

SEQ ID NO: 1782328 - protein, 9 aa, Staphylococcus epidermidis
KKTGGMFDG

SEQ ID NO: 1782329 - protein, 10 aa, Staphylococcus epidermidis
KKTGKAEGDY

SEQ ID NO: 1782330 - protein, 8 aa, Staphylococcus epidermidis
KKTHLNQS

SEQ ID NO: 1782331 - protein, 7 aa, Staphylococcus epidermidis
KKTKDLK

SEQ ID NO: 1782332 - protein, 18 aa, Staphylococcus epidermidis
KKTKENKRRKHKTINMLE

SEQ ID NO: 1782333 - protein, 6 aa, Staphylococcus epidermidis
KKTKSR

SEQ ID NO: 1782334 - protein, 6 aa, Staphylococcus epidermidis
KKTNSL

SEQ ID NO: 1782335 - protein, 11 aa, Staphylococcus epidermidis
KKTQETPKREI

SEQ ID NO: 1782336 - protein, 11 aa, Staphylococcus epidermidis
KKTQSQAQDDL

SEQ ID NO: 1782337 - protein, 12 aa, Staphylococcus epidermidis
KKTQSQRIKKKG

SEQ ID NO: 1782338 - protein, 9 aa, Staphylococcus epidermidis
KKTRKDKDG

SEQ ID NO: 1782339 - protein, 10 aa, Staphylococcus epidermidis
KKTRKNIGDF

SEQ ID NO: 1782340 - protein, 8 aa, Staphylococcus epidermidis
KKTRNQKY

SEQ ID NO: 1782341 - protein, 6 aa, Staphylococcus epidermidis
KKTSRI

SEQ ID NO: 1782342 - protein, 6 aa, Staphylococcus epidermidis
KKTTYY

SEQ ID NO: 1782343 - protein, 6 aa, Staphylococcus epidermidis
KKVEDS

SEQ ID NO: 1782344 - protein, 10 aa, Staphylococcus epidermidis
KKVEREVSVE

SEQ ID NO: 1782345 - protein, 7 aa, Staphylococcus epidermidis
KKVEYDK

SEQ ID NO: 1782346 - protein, 7 aa, Staphylococcus epidermidis
KKVGSYE

SEQ ID NO: 1782347 - protein, 8 aa, Staphylococcus epidermidis
KKVNADED

SEQ ID NO: 1782348 - protein, 5 aa, Staphylococcus epidermidis
KKVQD

SEQ ID NO: 1782349 - protein, 6 aa, Staphylococcus epidermidis
KKVSPS

SEQ ID NO: 1782350 - protein, 11 aa, Staphylococcus epidermidis
KKVSTGRGGYT

SEQ ID NO: 1782351 - protein, 75 aa, Staphylococcus epidermidis
KKVSVPELKPEKQANANHRKDSESNKSEEFKQINTNRETDSNSYESNGIEHDMNSSSDEHVYETPSKQQDEQIQK

SEQ ID NO: 1782352 - protein, 42 aa, Staphylococcus epidermidis
KKVYDTGDTYPKPANKKISDERISELSTSNNRRGKALIKELE

SEQ ID NO: 1782353 - protein, 5 aa, Staphylococcus epidermidis
KKVYS

SEQ ID NO: 1782354 - protein, 16 aa, Staphylococcus epidermidis
KKYAQTLKQTGGIGTV

SEQ ID NO: 1782355 - protein, 13 aa, Staphylococcus epidermidis
KKYEGKDQETIDR

SEQ ID NO: 1782356 - protein, 5 aa, Staphylococcus epidermidis
KKYES

SEQ ID NO: 1782357 - protein, 21 aa, Staphylococcus epidermidis
KKYGESPKDAQGKNYPILHLK

SEQ ID NO: 1782358 - protein, 27 aa, Staphylococcus epidermidis
KKYGFESTNTSSEKVKIDNTKNESKYD

SEQ ID NO: 1782359 - protein, 18 aa, Staphylococcus epidermidis
KKYKKQINDYSERKHKYK

SEQ ID NO: 1782360 - protein, 9 aa, Staphylococcus epidermidis
KKYKPSKIE

SEQ ID NO: 1782361 - protein, 16 aa, Staphylococcus epidermidis
KKYNKHNPHNTSNEWS

SEQ ID NO: 1782362 - protein, 5 aa, Staphylococcus epidermidis
KKYNT

SEQ ID NO: 1782363 - protein, 5 aa, Staphylococcus epidermidis
KKYPQ

SEQ ID NO: 1782364 - protein, 6 aa, Staphylococcus epidermidis
KKYRAA

SEQ ID NO: 1782365 - protein, 6 aa, Staphylococcus epidermidis
KKYTNK

SEQ ID NO: 1782366 - protein, 5 aa, Staphylococcus epidermidis
KLAET

SEQ ID NO: 1782367 - protein, 9 aa, Staphylococcus epidermidis
KLAKSDREM

SEQ ID NO: 1782368 - protein, 39 aa, Staphylococcus epidermidis
KLAKSRAESHLENDDDNSDINRAKRALERANNRLRVAEF

SEQ ID NO: 1782369 - protein, 7 aa, Staphylococcus epidermidis
KLALTQS

SEQ ID NO: 1782370 - protein, 9 aa, Staphylococcus epidermidis
KLANETGHT

SEQ ID NO: 1782371 - protein, 27 aa, Staphylococcus epidermidis
KLAQNQTESNATVNQLPNLNDKQKQAL

SEQ ID NO: 1782372 - protein, 8 aa, Staphylococcus epidermidis
KLDDYGTR

SEQ ID NO: 1782373 - protein, 13 aa, Staphylococcus epidermidis
KLDEPKIKKATRR

SEQ ID NO: 1782374 - protein, 13 aa, Staphylococcus epidermidis
KLDEPKVKKATRR

SEQ ID NO: 1782375 - protein, 13 aa, Staphylococcus epidermidis
KLDERKKLTKSLK

SEQ ID NO: 1782376 - protein, 19 aa, Staphylococcus epidermidis
KLDERKKLTKTLKKNAQLK

SEQ ID NO: 1782377 - protein, 5 aa, Staphylococcus epidermidis
KLDHQ

SEQ ID NO: 1782378 - protein, 7 aa, Staphylococcus epidermidis
KLDPTGY

SEQ ID NO: 1782379 - protein, 11 aa, Staphylococcus epidermidis
KLDQATRQSIA

SEQ ID NO: 1782380 - protein, 11 aa, Staphylococcus epidermidis
KLDQSTRQSVA

SEQ ID NO: 1782381 - protein, 8 aa, Staphylococcus epidermidis
KLDSDKAM

SEQ ID NO: 1782382 - protein, 9 aa, Staphylococcus epidermidis
KLDSKIEDK

SEQ ID NO: 1782383 - protein, 6 aa, Staphylococcus epidermidis
KLEEEI

SEQ ID NO: 1782384 - protein, 14 aa, Staphylococcus epidermidis
KLEEKGNRQAITEV

SEQ ID NO: 1782385 - protein, 7 aa, Staphylococcus epidermidis
KLEEQGA

SEQ ID NO: 1782386 - protein, 22 aa, Staphylococcus epidermidis
KLEKGEEREEAAKRELQEETGY

SEQ ID NO: 1782387 - protein, 5 aa, Staphylococcus epidermidis
KLEPA

SEQ ID NO: 1782388 - protein, 13 aa, Staphylococcus epidermidis
KLEQGEDRKEAAI

SEQ ID NO: 1782389 - protein, 9 aa, Staphylococcus epidermidis
KLESCDDRK

SEQ ID NO: 1782390 - protein, 9 aa, Staphylococcus epidermidis
KLGANANQI

SEQ ID NO: 1782391 - protein, 7 aa, Staphylococcus epidermidis
KLGDFSQ

SEQ ID NO: 1782392 - protein, 4 aa, Staphylococcus epidermidis
KLGG

SEQ ID NO: 1782393 - protein, 6 aa, Staphylococcus epidermidis
KLGHKS

SEQ ID NO: 1782394 - protein, 7 aa, Staphylococcus epidermidis
KLGSGQQ

SEQ ID NO: 1782395 - protein, 8 aa, Staphylococcus epidermidis
KLGTTGQQ

SEQ ID NO: 1782396 - protein, 17 aa, Staphylococcus epidermidis
KLHSRSKAALSNANETI

SEQ ID NO: 1782397 - protein, 6 aa, Staphylococcus epidermidis
KLIDKA

SEQ ID NO: 1782398 - protein, 7 aa, Staphylococcus epidermidis
KLIDKAK

SEQ ID NO: 1782399 - protein, 10 aa, Staphylococcus epidermidis
KLINSKADAL

SEQ ID NO: 1782400 - protein, 12 aa, Staphylococcus epidermidis
KLKDSFDDVSIN

SEQ ID NO: 1782401 - protein, 6 aa, Staphylococcus epidermidis
KLKEAH

SEQ ID NO: 1782402 - protein, 8 aa, Staphylococcus epidermidis
KLKEEDHG

SEQ ID NO: 1782403 - protein, 10 aa, Staphylococcus epidermidis
KLKEGHSGEY

SEQ ID NO: 1782404 - protein, 9 aa, Staphylococcus epidermidis
KLKKAGAKI

SEQ ID NO: 1782405 - protein, 18 aa, Staphylococcus epidermidis
KLKPEDSSDLQKGAKNEV

SEQ ID NO: 1782406 - protein, 16 aa, Staphylococcus epidermidis
KLKQSENKKSDENVKL

SEQ ID NO: 1782407 - protein, 8 aa, Staphylococcus epidermidis
KLKQTNGK

SEQ ID NO: 1782408 - protein, 23 aa, Staphylococcus epidermidis
KLKRQERKQYSKKQKRQKRKTNK

SEQ ID NO: 1782409 - protein, 10 aa, Staphylococcus epidermidis
KLKTTNEESL

SEQ ID NO: 1782410 - protein, 6 aa, Staphylococcus epidermidis
KLNEEY

SEQ ID NO: 1782411 - protein, 8 aa, Staphylococcus epidermidis
KLNEQRQL

SEQ ID NO: 1782412 - protein, 7 aa, Staphylococcus epidermidis
KLNGNKD

SEQ ID NO: 1782413 - protein, 7 aa, Staphylococcus epidermidis
KLNIPEE

SEQ ID NO: 1782414 - protein, 8 aa, Staphylococcus epidermidis
KLNQQLAE

SEQ ID NO: 1782415 - protein, 12 aa, Staphylococcus epidermidis
KLNRTDGNDFSM

SEQ ID NO: 1782416 - protein, 6 aa, Staphylococcus epidermidis
KLNSDI

SEQ ID NO: 1782417 - protein, 5 aa, Staphylococcus epidermidis
KLPDI

SEQ ID NO: 1782418 - protein, 15 aa, Staphylococcus epidermidis
KLPERSERYKKADEF

SEQ ID NO: 1782419 - protein, 17 aa, Staphylococcus epidermidis
KLPISEEQLENAKNKSI

SEQ ID NO: 1782420 - protein, 4 aa, Staphylococcus epidermidis
KLPL

SEQ ID NO: 1782421 - protein, 6 aa, Staphylococcus epidermidis
KLPNHY

SEQ ID NO: 1782422 - protein, 9 aa, Staphylococcus epidermidis
KLPSSVQRG

SEQ ID NO: 1782423 - protein, 10 aa, Staphylococcus epidermidis
KLQKSGKTVT

SEQ ID NO: 1782424 - protein, 13 aa, Staphylococcus epidermidis
KLQTETITTTTTK

SEQ ID NO: 1782425 - protein, 7 aa, Staphylococcus epidermidis
KLRDSNK

SEQ ID NO: 1782426 - protein, 14 aa, Staphylococcus epidermidis
KLRDYNEKNHALSG

SEQ ID NO: 1782427 - protein, 7 aa, Staphylococcus epidermidis
KLREARQ

SEQ ID NO: 1782428 - protein, 12 aa, Staphylococcus epidermidis
KLRGSMDAAEYK

SEQ ID NO: 1782429 - protein, 7 aa, Staphylococcus epidermidis
KLSASTI

SEQ ID NO: 1782430 - protein, 11 aa, Staphylococcus epidermidis
KLSDDQENEIE

SEQ ID NO: 1782431 - protein, 9 aa, Staphylococcus epidermidis
KLSDEKKDA

SEQ ID NO: 1782432 - protein, 10 aa, Staphylococcus epidermidis
KLSDKGMDIS

SEQ ID NO: 1782433 - protein, 11 aa, Staphylococcus epidermidis
KLSDNEKSLLP

SEQ ID NO: 1782434 - protein, 16 aa, Staphylococcus epidermidis
KLSEKDRLKTYKKTES

SEQ ID NO: 1782435 - protein, 12 aa, Staphylococcus epidermidis
KLSKEELNNYSD

SEQ ID NO: 1782436 - protein, 6 aa, Staphylococcus epidermidis
KLSNQD

SEQ ID NO: 1782437 - protein, 6 aa, Staphylococcus epidermidis
KLSNRY

SEQ ID NO: 1782438 - protein, 4 aa, Staphylococcus epidermidis
KLSQ

SEQ ID NO: 1782439 - protein, 11 aa, Staphylococcus epidermidis
KLSQIDPKRDV

SEQ ID NO: 1782440 - protein, 8 aa, Staphylococcus epidermidis
KLSQSVES

SEQ ID NO: 1782441 - protein, 8 aa, Staphylococcus epidermidis
KLSTSSKN

SEQ ID NO: 1782442 - protein, 11 aa, Staphylococcus epidermidis
KLTCGKPGQEI

SEQ ID NO: 1782443 - protein, 6 aa, Staphylococcus epidermidis
KLTDKH

SEQ ID NO: 1782444 - protein, 5 aa, Staphylococcus epidermidis
KLTDV

SEQ ID NO: 1782445 - protein, 6 aa, Staphylococcus epidermidis
KLTELG

SEQ ID NO: 1782446 - protein, 23 aa, Staphylococcus epidermidis
KLTGEEIAKQTGVSRSTVYRMLK

SEQ ID NO: 1782447 - protein, 6 aa, Staphylococcus epidermidis
KLTHEQ

SEQ ID NO: 1782448 - protein, 6 aa, Staphylococcus epidermidis
KLTPET

SEQ ID NO: 1782449 - protein, 8 aa, Staphylococcus epidermidis
KLTVSGDI

SEQ ID NO: 1782450 - protein, 14 aa, Staphylococcus epidermidis
KLTYSSNHTNHSNH

SEQ ID NO: 1782451 - protein, 11 aa, Staphylococcus epidermidis
KLYPNPENGDT

SEQ ID NO: 1782452 - protein, 13 aa, Staphylococcus epidermidis
KLYSGKGKSTIEG

SEQ ID NO: 1782453 - protein, 25 aa, Staphylococcus epidermidis
KLYTKDSKVGFSDKQTQVLKKENKR

SEQ ID NO: 1782454 - protein, 8 aa, Staphylococcus epidermidis
KMDGNSNP

SEQ ID NO: 1782455 - protein, 4 aa, Staphylococcus epidermidis
KMDL

SEQ ID NO: 1782456 - protein, 14 aa, Staphylococcus epidermidis
KMEEALKGNKPSEV

SEQ ID NO: 1782457 - protein, 21 aa, Staphylococcus epidermidis
KMENEKNSEPQNNLQNDNLSK

SEQ ID NO: 1782458 - protein, 11 aa, Staphylococcus epidermidis
KMEVPNKGRDI

SEQ ID NO: 1782459 - protein, 8 aa, Staphylococcus epidermidis
KMGPKETL

SEQ ID NO: 1782460 - protein, 17 aa, Staphylococcus epidermidis
KMGRKSHALTPEERETY

SEQ ID NO: 1782461 - protein, 8 aa, Staphylococcus epidermidis
KMIDPQSA

SEQ ID NO: 1782462 - protein, 6 aa, Staphylococcus epidermidis
KMKEVD

SEQ ID NO: 1782463 - protein, 15 aa, Staphylococcus epidermidis
KMKNKNNQDIQNMQM

SEQ ID NO: 1782464 - protein, 5 aa, Staphylococcus epidermidis
KMKQS

SEQ ID NO: 1782465 - protein, 12 aa, Staphylococcus epidermidis
KMNDKAGKYEGM

SEQ ID NO: 1782466 - protein, 11 aa, Staphylococcus epidermidis
KMNDLNQGDEL

SEQ ID NO: 1782467 - protein, 10 aa, Staphylococcus epidermidis
KMQELNQGDE

SEQ ID NO: 1782468 - protein, 11 aa, Staphylococcus epidermidis
KMRSGKDTVAK

SEQ ID NO: 1782469 - protein, 14 aa, Staphylococcus epidermidis
KMSPQPDCGEDSYH

SEQ ID NO: 1782470 - protein, 28 aa, Staphylococcus epidermidis
KMTHTPKDSMVKSEGKHVNHTNNSRENI

SEQ ID NO: 1782471 - protein, 11 aa, Staphylococcus epidermidis
KMTKASESLDF

SEQ ID NO: 1782472 - protein, 6 aa, Staphylococcus epidermidis
KMTQYE

SEQ ID NO: 1782473 - protein, 8 aa, Staphylococcus epidermidis
KMTSTNTV

SEQ ID NO: 1782474 - protein, 13 aa, Staphylococcus epidermidis
KNAAAGLDLGGGK

SEQ ID NO: 1782475 - protein, 4 aa, Staphylococcus epidermidis
KNAD

SEQ ID NO: 1782476 - protein, 7 aa, Staphylococcus epidermidis
KNADPTL

SEQ ID NO: 1782477 - protein, 7 aa, Staphylococcus epidermidis
KNAEQVA

SEQ ID NO: 1782478 - protein, 7 aa, Staphylococcus epidermidis
KNAFENI

SEQ ID NO: 1782479 - protein, 10 aa, Staphylococcus epidermidis
KNAGKNLSLG

SEQ ID NO: 1782480 - protein, 9 aa, Staphylococcus epidermidis
KNAIDGEHL

SEQ ID NO: 1782481 - protein, 12 aa, Staphylococcus epidermidis
KNAKYAKNKFEE

SEQ ID NO: 1782482 - protein, 9 aa, Staphylococcus epidermidis
KNANERQVS

SEQ ID NO: 1782483 - protein, 10 aa, Staphylococcus epidermidis
KNASKIDDEY

SEQ ID NO: 1782484 - protein, 10 aa, Staphylococcus epidermidis
KNASKIGDEY

SEQ ID NO: 1782485 - protein, 7 aa, Staphylococcus epidermidis
KNASKKQ

SEQ ID NO: 1782486 - protein, 9 aa, Staphylococcus epidermidis
KNATEDEVK

SEQ ID NO: 1782487 - protein, 11 aa, Staphylococcus epidermidis
KNAYENKKSSI

SEQ ID NO: 1782488 - protein, 6 aa, Staphylococcus epidermidis
KNCYKD

SEQ ID NO: 1782489 - protein, 4 aa, Staphylococcus epidermidis
KNDF

SEQ ID NO: 1782490 - protein, 4 aa, Staphylococcus epidermidis
KNDG

SEQ ID NO: 1782491 - protein, 5 aa, Staphylococcus epidermidis
KNDGL

SEQ ID NO: 1782492 - protein, 21 aa, Staphylococcus epidermidis
KNDGYQSDKSKETLKEKQNHL

SEQ ID NO: 1782493 - protein, 22 aa, Staphylococcus epidermidis
KNDGYQSDKSKETLKEKQNHLT

SEQ ID NO: 1782494 - protein, 23 aa, Staphylococcus epidermidis
KNDGYQSDKSKETLTQKQTRLSE

SEQ ID NO: 1782495 - protein, 8 aa, Staphylococcus epidermidis
KNDKDELY

SEQ ID NO: 1782496 - protein, 8 aa, Staphylococcus epidermidis
KNDKDQIK

SEQ ID NO: 1782497 - protein, 21 aa, Staphylococcus epidermidis
KNDKEFKEGVKNAYKSTNYEA

SEQ ID NO: 1782498 - protein, 5 aa, Staphylococcus epidermidis
KNDKN

SEQ ID NO: 1782499 - protein, 34 aa, Staphylococcus epidermidis
KNDNNDEKKEEIKSNLQSNTESLIKTEEKLEKLQ

SEQ ID NO: 1782500 - protein, 18 aa, Staphylococcus epidermidis
KNDPGFSELGEGDGRNQT

SEQ ID NO: 1782501 - protein, 16 aa, Staphylococcus epidermidis
KNDPHRPNAKSKNLNQ

SEQ ID NO: 1782502 - protein, 7 aa, Staphylococcus epidermidis
KNDPSEL

SEQ ID NO: 1782503 - protein, 6 aa, Staphylococcus epidermidis
KNDRPV

SEQ ID NO: 1782504 - protein, 6 aa, Staphylococcus epidermidis
KNDTNW

SEQ ID NO: 1782505 - protein, 4 aa, Staphylococcus epidermidis
KNEE

SEQ ID NO: 1782506 - protein, 7 aa, Staphylococcus epidermidis
KNEEKTA

SEQ ID NO: 1782507 - protein, 9 aa, Staphylococcus epidermidis
KNEETGDSI

SEQ ID NO: 1782508 - protein, 8 aa, Staphylococcus epidermidis
KNEFPNQK

SEQ ID NO: 1782509 - protein, 5 aa, Staphylococcus epidermidis
KNEGQ

SEQ ID NO: 1782510 - protein, 9 aa, Staphylococcus epidermidis
KNEKDFKQG

SEQ ID NO: 1782511 - protein, 10 aa, Staphylococcus epidermidis
KNEKEAAAKI

SEQ ID NO: 1782512 - protein, 8 aa, Staphylococcus epidermidis
KNEKINAS

SEQ ID NO: 1782513 - protein, 11 aa, Staphylococcus epidermidis
KNEKNGNVNYQ

SEQ ID NO: 1782514 - protein, 15 aa, Staphylococcus epidermidis
KNEKYKEHTNIDSEN

SEQ ID NO: 1782515 - protein, 4 aa, Staphylococcus epidermidis
KNEL

SEQ ID NO: 1782516 - protein, 15 aa, Staphylococcus epidermidis
KNELYNEEQRTLSEE

SEQ ID NO: 1782517 - protein, 4 aa, Staphylococcus epidermidis
KNEM

SEQ ID NO: 1782518 - protein, 16 aa, Staphylococcus epidermidis
KNENDYPQYERPQAHN

SEQ ID NO: 1782519 - protein, 12 aa, Staphylococcus epidermidis
KNENEEISIFDK

SEQ ID NO: 1782520 - protein, 6 aa, Staphylococcus epidermidis
KNENER

SEQ ID NO: 1782521 - protein, 9 aa, Staphylococcus epidermidis
KNENIAPQT

SEQ ID NO: 1782522 - protein, 7 aa, Staphylococcus epidermidis
KNEPGKH

SEQ ID NO: 1782523 - protein, 7 aa, Staphylococcus epidermidis
KNEPTHI

SEQ ID NO: 1782524 - protein, 6 aa, Staphylococcus epidermidis
KNEPYL

SEQ ID NO: 1782525 - protein, 8 aa, Staphylococcus epidermidis
KNEQTIYD

SEQ ID NO: 1782526 - protein, 4 aa, Staphylococcus epidermidis
KNER

SEQ ID NO: 1782527 - protein, 5 aa, Staphylococcus epidermidis
KNERD

SEQ ID NO: 1782528 - protein, 7 aa, Staphylococcus epidermidis
KNESNEV

SEQ ID NO: 1782529 - protein, 7 aa, Staphylococcus epidermidis
KNESSAC

SEQ ID NO: 1782530 - protein, 6 aa, Staphylococcus epidermidis
KNESVQ

SEQ ID NO: 1782531 - protein, 11 aa, Staphylococcus epidermidis
KNETGISTNSH

SEQ ID NO: 1782532 - protein, 8 aa, Staphylococcus epidermidis
KNETNKDM

SEQ ID NO: 1782533 - protein, 7 aa, Staphylococcus epidermidis
KNETVEA

SEQ ID NO: 1782534 - protein, 7 aa, Staphylococcus epidermidis
KNFEEAA

SEQ ID NO: 1782535 - protein, 14 aa, Staphylococcus epidermidis
KNFEKVKDQTPNEK

SEQ ID NO: 1782536 - protein, 16 aa, Staphylococcus epidermidis
KNFKQAEHSRNPRGRN

SEQ ID NO: 1782537 - protein, 9 aa, Staphylococcus epidermidis
KNGAEKSTL

SEQ ID NO: 1782538 - protein, 6 aa, Staphylococcus epidermidis
KNGDLV

SEQ ID NO: 1782539 - protein, 7 aa, Staphylococcus epidermidis
KNGDSQI

SEQ ID NO: 1782540 - protein, 7 aa, Staphylococcus epidermidis
KNGDSVS

SEQ ID NO: 1782541 - protein, 4 aa, Staphylococcus epidermidis
KNGE

SEQ ID NO: 1782542 - protein, 8 aa, Staphylococcus epidermidis
KNGEFDET

SEQ ID NO: 1782543 - protein, 6 aa, Staphylococcus epidermidis
KNGEKI

SEQ ID NO: 1782544 - protein, 27 aa, Staphylococcus epidermidis
KNGELKPIKAHDTRRTRQRKDDHLTNE

SEQ ID NO: 1782545 - protein, 11 aa, Staphylococcus epidermidis
KNGESEETQAK

SEQ ID NO: 1782546 - protein, 11 aa, Staphylococcus epidermidis
KNGESTSRTSH

SEQ ID NO: 1782547 - protein, 7 aa, Staphylococcus epidermidis
KNGGSFE

SEQ ID NO: 1782548 - protein, 8 aa, Staphylococcus epidermidis
KNGKKRIS

SEQ ID NO: 1782549 - protein, 6 aa, Staphylococcus epidermidis
KNGKNG

SEQ ID NO: 1782550 - protein, 17 aa, Staphylococcus epidermidis
KNGKQSQKEAQKRLNER

SEQ ID NO: 1782551 - protein, 9 aa, Staphylococcus epidermidis
KNGKVDIQS

SEQ ID NO: 1782552 - protein, 15 aa, Staphylococcus epidermidis
KNGRELKSDEMDQTR

SEQ ID NO: 1782553 - protein, 7 aa, Staphylococcus epidermidis
KNGRKYK

SEQ ID NO: 1782554 - protein, 6 aa, Staphylococcus epidermidis
KNGTEL

SEQ ID NO: 1782555 - protein, 9 aa, Staphylococcus epidermidis
KNGVGKSQL

SEQ ID NO: 1782556 - protein, 11 aa, Staphylococcus epidermidis
KNGVKADKDYL

SEQ ID NO: 1782557 - protein, 8 aa, Staphylococcus epidermidis
KNGVPSEV

SEQ ID NO: 1782558 - protein, 5 aa, Staphylococcus epidermidis
KNGYE

SEQ ID NO: 1782559 - protein, 5 aa, Staphylococcus epidermidis
KNGYM

SEQ ID NO: 1782560 - protein, 4 aa, Staphylococcus epidermidis
KNHA

SEQ ID NO: 1782561 - protein, 12 aa, Staphylococcus epidermidis
KNHARTAQQQRE

SEQ ID NO: 1782562 - protein, 5 aa, Staphylococcus epidermidis
KNHEN

SEQ ID NO: 1782563 - protein, 7 aa, Staphylococcus epidermidis
KNHEREA

SEQ ID NO: 1782564 - protein, 5 aa, Staphylococcus epidermidis
KNHIH

SEQ ID NO: 1782565 - protein, 6 aa, Staphylococcus epidermidis
KNHPQN

SEQ ID NO: 1782566 - protein, 24 aa, Staphylococcus epidermidis
KNHTPLSELPEGSIVGTSSLRRGA

SEQ ID NO: 1782567 - protein, 6 aa, Staphylococcus epidermidis
KNHVPG

SEQ ID NO: 1782568 - protein, 6 aa, Staphylococcus epidermidis
KNIANQ

SEQ ID NO: 1782569 - protein, 6 aa, Staphylococcus epidermidis
KNIEES

SEQ ID NO: 1782570 - protein, 11 aa, Staphylococcus epidermidis
KNIEPRTQYVN

SEQ ID NO: 1782571 - protein, 5 aa, Staphylococcus epidermidis
KNIGK

SEQ ID NO: 1782572 - protein, 5 aa, Staphylococcus epidermidis
KNIGT

SEQ ID NO: 1782573 - protein, 6 aa, Staphylococcus epidermidis
KNIKEE

SEQ ID NO: 1782574 - protein, 4 aa, Staphylococcus epidermidis
KNIN

SEQ ID NO: 1782575 - protein, 11 aa, Staphylococcus epidermidis
KNINKNRHGGL

SEQ ID NO: 1782576 - protein, 9 aa, Staphylococcus epidermidis
KNIQEGDQI

SEQ ID NO: 1782577 - protein, 6 aa, Staphylococcus epidermidis
KNIRSN

SEQ ID NO: 1782578 - protein, 21 aa, Staphylococcus epidermidis
KNISDKVKDYKQYTKAGVNSS

SEQ ID NO: 1782579 - protein, 21 aa, Staphylococcus epidermidis
KNISDKVKNYKQYTKAGVNSS

SEQ ID NO: 1782580 - protein, 8 aa, Staphylococcus epidermidis
KNISQDQD

SEQ ID NO: 1782581 - protein, 48 aa, Staphylococcus epidermidis; identical to SEQ ID NO: 1639465

SEQ ID NO: 1782582 - protein, 8 aa, Staphylococcus epidermidis
KNITSKTK

SEQ ID NO: 1782583 - protein, 19 aa, Staphylococcus epidermidis
KNITTGEGGVIATNNKDFH

SEQ ID NO: 1782584 - protein, 7 aa, Staphylococcus epidermidis
KNITTSG

SEQ ID NO: 1782585 - protein, 9 aa, Staphylococcus epidermidis
KNKADVSQV

SEQ ID NO: 1782586 - protein, 8 aa, Staphylococcus epidermidis
KNKDSIPD

SEQ ID NO: 1782587 - protein, 7 aa, Staphylococcus epidermidis
KNKEITA

SEQ ID NO: 1782588 - protein, 19 aa, Staphylococcus epidermidis
KNKEKISQIATKSDVDASL

SEQ ID NO: 1782589 - protein, 10 aa, Staphylococcus epidermidis
KNKEVSDKTI

SEQ ID NO: 1782590 - protein, 10 aa, Staphylococcus epidermidis
KNKGKDKRSI

SEQ ID NO: 1782591 - protein, 9 aa, Staphylococcus epidermidis
KNKHGDSSI

SEQ ID NO: 1782592 - protein, 5 aa, Staphylococcus epidermidis
KNKKE

SEQ ID NO: 1782593 - protein, 24 aa, Staphylococcus epidermidis
KNKKRRQSSQSQQNNQDSLLPQNN

SEQ ID NO: 1782594 - protein, 8 aa, Staphylococcus epidermidis
KNKKSNVG

SEQ ID NO: 1782595 - protein, 9 aa, Staphylococcus epidermidis
KNKNVKIDS

SEQ ID NO: 1782596 - protein, 8 aa, Staphylococcus epidermidis
KNKQKYNK

SEQ ID NO: 1782597 - protein, 7 aa, Staphylococcus epidermidis
KNKQPMS

SEQ ID NO: 1782598 - protein, 5 aa, Staphylococcus epidermidis
KNKQT

SEQ ID NO: 1782599 - protein, 8 aa, Staphylococcus epidermidis
KNKRGQEV

SEQ ID NO: 1782600 - protein, 10 aa, Staphylococcus epidermidis
KNKSESNQIP

SEQ ID NO: 1782601 - protein, 9 aa, Staphylococcus epidermidis
KNKTAKDVL

SEQ ID NO: 1782602 - protein, 19 aa, Staphylococcus epidermidis
KNKYKEYRKRHHFEEKYDL

SEQ ID NO: 1782603 - protein, 7 aa, Staphylococcus epidermidis
KNKYNQD

SEQ ID NO: 1782604 - protein, 6 aa, Staphylococcus epidermidis
KNKYYD

SEQ ID NO: 1782605 - protein, 14 aa, Staphylococcus epidermidis
KNLATGEKVEVGEA

SEQ ID NO: 1782606 - protein, 10 aa, Staphylococcus epidermidis
KNLDRKERAH

SEQ ID NO: 1782607 - protein, 11 aa, Staphylococcus epidermidis
KNLDRKERSHR

SEQ ID NO: 1782608 - protein, 11 aa, Staphylococcus epidermidis
KNLENEGYDIS

SEQ ID NO: 1782609 - protein, 13 aa, Staphylococcus epidermidis
KNLEQAKAQNIKA

SEQ ID NO: 1782610 - protein, 15 aa, Staphylococcus epidermidis
KNLEQAKKAGLKAKS

SEQ ID NO: 1782611 - protein, 6 aa, Staphylococcus epidermidis
KNLKDY

SEQ ID NO: 1782612 - protein, 9 aa, Staphylococcus epidermidis
KNLKTSKEV

SEQ ID NO: 1782613 - protein, 17 aa, Staphylococcus epidermidis
KNLNENDYKADPPLIWG

SEQ ID NO: 1782614 - protein, 8 aa, Staphylococcus epidermidis
KNLNQNGA

SEQ ID NO: 1782615 - protein, 10 aa, Staphylococcus epidermidis
KNLRKSENYN

SEQ ID NO: 1782616 - protein, 7 aa, Staphylococcus epidermidis
KNLTPQT

SEQ ID NO: 1782617 - protein, 13 aa, Staphylococcus epidermidis
KNMKDNSAGNNIN

SEQ ID NO: 1782618 - protein, 8 aa, Staphylococcus epidermidis
KNMTGNDM

SEQ ID NO: 1782619 - protein, 7 aa, Staphylococcus epidermidis
KNNELNG

SEQ ID NO: 1782620 - protein, 6 aa, Staphylococcus epidermidis
KNNENK

SEQ ID NO: 1782621 - protein, 8 aa, Staphylococcus epidermidis
KNNEPKNF

SEQ ID NO: 1782622 - protein, 20 aa, Staphylococcus epidermidis
KNNFNGKGKQRYTFLDTYFK

SEQ ID NO: 1782623 - protein, 6 aa, Staphylococcus epidermidis
KNNGEL

SEQ ID NO: 1782624 - protein, 8 aa, Staphylococcus epidermidis
KNNIDTDQ

SEQ ID NO: 1782625 - protein, 7 aa, Staphylococcus epidermidis
KNNKEGI

SEQ ID NO: 1782626 - protein, 11 aa, Staphylococcus epidermidis
KNNKIKQFESK

SEQ ID NO: 1782627 - protein, 8 aa, Staphylococcus epidermidis
KNNKMTQS

SEQ ID NO: 1782628 - protein, 12 aa, Staphylococcus epidermidis
KNNKPEKIGYTP

SEQ ID NO: 1782629 - protein, 17 aa, Staphylococcus epidermidis
KNNKQNDYLTNKKAQKS

SEQ ID NO: 1782630 - protein, 8 aa, Staphylococcus epidermidis
KNNKQNTE

SEQ ID NO: 1782631 - protein, 31 aa, Staphylococcus epidermidis
KNNNASEETKNDHGVKVEQPPKKGFWRRLFG

SEQ ID NO: 1782632 - protein, 8 aa, Staphylococcus epidermidis
KNNNTNYK

SEQ ID NO: 1782633 - protein, 11 aa, Staphylococcus epidermidis
KNNPDEATNIN

SEQ ID NO: 1782634 - protein, 7 aa, Staphylococcus epidermidis
KNNPEDD

SEQ ID NO: 1782635 - protein, 9 aa, Staphylococcus epidermidis
KNNPGKRVD

SEQ ID NO: 1782636 - protein, 8 aa, Staphylococcus epidermidis
KNNPNSRR

SEQ ID NO: 1782637 - protein, 7 aa, Staphylococcus epidermidis
KNNQTRE

SEQ ID NO: 1782638 - protein, 5 aa, Staphylococcus epidermidis
KNNRV

SEQ ID NO: 1782639 - protein, 6 aa, Staphylococcus epidermidis
KNNSKL

SEQ ID NO: 1782640 - protein, 6 aa, Staphylococcus epidermidis
KNNSNL

SEQ ID NO: 1782641 - protein, 17 aa, Staphylococcus epidermidis
KNNSQRRFTGDSDSHCQ

SEQ ID NO: 1782642 - protein, 17 aa, Staphylococcus epidermidis
KNNTTKELTQKAKSLKL

SEQ ID NO: 1782643 - protein, 27 aa, Staphylococcus epidermidis
KNNVGDNDELKQELEKYKEQNANYDQK

SEQ ID NO: 1782644 - protein, 7 aa, Staphylococcus epidermidis
KNNVLNS

SEQ ID NO: 1782645 - protein, 10 aa, Staphylococcus epidermidis
KNPDISPDYG

SEQ ID NO: 1782646 - protein, 7 aa, Staphylococcus epidermidis
KNPDITS

SEQ ID NO: 1782647 - protein, 5 aa, Staphylococcus epidermidis
KNPDM

SEQ ID NO: 1782648 - protein, 26 aa, Staphylococcus epidermidis
KNPELHSKENIGVNKPGTEGDKPAWF

SEQ ID NO: 1782649 - protein, 7 aa, Staphylococcus epidermidis
KNPMDGY

SEQ ID NO: 1782650 - protein, 6 aa, Staphylococcus epidermidis
KNPNDT

SEQ ID NO: 1782651 - protein, 6 aa, Staphylococcus epidermidis
KNPNHL

SEQ ID NO: 1782652 - protein, 12 aa, Staphylococcus epidermidis
KNPTFKPGPLLP

SEQ ID NO: 1782653 - protein, 5 aa, Staphylococcus epidermidis
KNPTI

SEQ ID NO: 1782654 - protein, 6 aa, Staphylococcus epidermidis
KNPTVR

SEQ ID NO: 1782655 - protein, 10 aa, Staphylococcus epidermidis
KNQDKLKYSA

SEQ ID NO: 1782656 - protein, 7 aa, Staphylococcus epidermidis
KNQEAKF

SEQ ID NO: 1782657 - protein, 5 aa, Staphylococcus epidermidis
KNQGL

SEQ ID NO: 1782658 - protein, 8 aa, Staphylococcus epidermidis
KNQGPFND

SEQ ID NO: 1782659 - protein, 9 aa, Staphylococcus epidermidis
KNQKEEGIE

SEQ ID NO: 1782660 - protein, 4 aa, Staphylococcus epidermidis
KNQN

SEQ ID NO: 1782661 - protein, 14 aa, Staphylococcus epidermidis
KNQNHAKGSARSIE

SEQ ID NO: 1782662 - protein, 6 aa, Staphylococcus epidermidis
KNQPLA

SEQ ID NO: 1782663 - protein, 6 aa, Staphylococcus epidermidis
KNQQTN

SEQ ID NO: 1782664 - protein, 4 aa, Staphylococcus epidermidis
KNQS

SEQ ID NO: 1782665 - protein, 9 aa, Staphylococcus epidermidis
KNQTENEEN

SEQ ID NO: 1782666 - protein, 7 aa, Staphylococcus epidermidis
KNQTRLN

SEQ ID NO: 1782667 - protein, 30 aa, Staphylococcus epidermidis
KNRDDRRKALQDELNDKNEQIQEQKEDLNK

SEQ ID NO: 1782668 - protein, 8 aa, Staphylococcus epidermidis
KNRDISKA

SEQ ID NO: 1782669 - protein, 15 aa, Staphylococcus epidermidis
KNRHPMSLSGGEKQR

SEQ ID NO: 1782670 - protein, 9 aa, Staphylococcus epidermidis
KNRKTKEEK

SEQ ID NO: 1782671 - protein, 12 aa, Staphylococcus epidermidis
KNRRSEETCGSF

SEQ ID NO: 1782672 - protein, 16 aa, Staphylococcus epidermidis
KNRSQAASFIMMEYKK

SEQ ID NO: 1782673 - protein, 4 aa, Staphylococcus epidermidis
KNRY

SEQ ID NO: 1782674 - protein, 7 aa, Staphylococcus epidermidis
KNSAVDA

SEQ ID NO: 1782675 - protein, 9 aa, Staphylococcus epidermidis
KNSDDYKGK

SEQ ID NO: 1782676 - protein, 11 aa, Staphylococcus epidermidis
KNSGKIEQKKT

SEQ ID NO: 1782677 - protein, 6 aa, Staphylococcus epidermidis
KNSHMT

SEQ ID NO: 1782678 - protein, 6 aa, Staphylococcus epidermidis
KNSIDD

SEQ ID NO: 1782679 - protein, 13 aa, Staphylococcus epidermidis
KNSIETSQNYSKN

SEQ ID NO: 1782680 - protein, 13 aa, Staphylococcus epidermidis
KNSINSAHQEGMT

SEQ ID NO: 1782681 - protein, 8 aa, Staphylococcus epidermidis
KNSISAQP

SEQ ID NO: 1782682 - protein, 19 aa, Staphylococcus epidermidis
KNSKNFKEGMKKANEATNF

SEQ ID NO: 1782683 - protein, 12 aa, Staphylococcus epidermidis
KNSNPDSEVAET

SEQ ID NO: 1782684 - protein, 5 aa, Staphylococcus epidermidis
KNSPL

SEQ ID NO: 1782685 - protein, 7 aa, Staphylococcus epidermidis
KNSQVRK

SEQ ID NO: 1782686 - protein, 9 aa, Staphylococcus epidermidis
KNSRKEDGN

SEQ ID NO: 1782687 - protein, 11 aa, Staphylococcus epidermidis
KNSRVTTDGVA

SEQ ID NO: 1782688 - protein, 14 aa, Staphylococcus epidermidis
KNSTDPNLNPQDIT

SEQ ID NO: 1782689 - protein, 9 aa, Staphylococcus epidermidis
KNSVLNNEG

SEQ ID NO: 1782690 - protein, 4 aa, Staphylococcus epidermidis
KNTA

SEQ ID NO: 1782691 - protein, 5 aa, Staphylococcus epidermidis
KNTAK

SEQ ID NO: 1782692 - protein, 15 aa, Staphylococcus epidermidis
KNTARTGKNVGKKIG

SEQ ID NO: 1782693 - protein, 6 aa, Staphylococcus epidermidis
KNTCPK

SEQ ID NO: 1782694 - protein, 6 aa, Staphylococcus epidermidis
KNTEKI

SEQ ID NO: 1782695 - protein, 7 aa, Staphylococcus epidermidis
KNTGEIE

SEQ ID NO: 1782696 - protein, 4 aa, Staphylococcus epidermidis
KNTI

SEQ ID NO: 1782697 - protein, 18 aa, Staphylococcus epidermidis
KNTKSVSQIKKKQSINED

SEQ ID NO: 1782698 - protein, 5 aa, Staphylococcus epidermidis
KNTLI

SEQ ID NO: 1782699 - protein, 7 aa, Staphylococcus epidermidis
KNTNETG

SEQ ID NO: 1782700 - protein, 12 aa, Staphylococcus epidermidis
KNTNSKTSKENI

SEQ ID NO: 1782701 - protein, 8 aa, Staphylococcus epidermidis
KNTPYNHT

SEQ ID NO: 1782702 - protein, 6 aa, Staphylococcus epidermidis
KNTSFV

SEQ ID NO: 1782703 - protein, 5 aa, Staphylococcus epidermidis
KNTSI

SEQ ID NO: 1782704 - protein, 10 aa, Staphylococcus epidermidis
KNTSSQEYTS

SEQ ID NO: 1782705 - protein, 9 aa, Staphylococcus epidermidis
KNTVNRDEF

SEQ ID NO: 1782706 - protein, 4 aa, Staphylococcus epidermidis
KNTY

SEQ ID NO: 1782707 - protein, 8 aa, Staphylococcus epidermidis
KNVDQKEL

SEQ ID NO: 1782708 - protein, 11 aa, Staphylococcus epidermidis
KNVDQKELAET

SEQ ID NO: 1782709 - protein, 7 aa, Staphylococcus epidermidis
KNVDSLP

SEQ ID NO: 1782710 - protein, 6 aa, Staphylococcus epidermidis
KNVDTH

SEQ ID NO: 1782711 - protein, 6 aa, Staphylococcus epidermidis
KNVENH

SEQ ID NO: 1782712 - protein, 9 aa, Staphylococcus epidermidis
KNVETGYEI

SEQ ID NO: 1782713 - protein, 10 aa, Staphylococcus epidermidis
KNVKDLQEKA

SEQ ID NO: 1782714 - protein, 6 aa, Staphylococcus epidermidis
KNVKIT

SEQ ID NO: 1782715 - protein, 6 aa, Staphylococcus epidermidis
KNVKTN

SEQ ID NO: 1782716 - protein, 8 aa, Staphylococcus epidermidis
KNVSNSTI

SEQ ID NO: 1782717 - protein, 11 aa, Staphylococcus epidermidis
KNWTKTKQVDT

SEQ ID NO: 1782718 - protein, 7 aa, Staphylococcus epidermidis
KNYGERG

SEQ ID NO: 1782719 - protein, 10 aa, Staphylococcus epidermidis
KNYGVQEPTI

SEQ ID NO: 1782720 - protein, 30 aa, Staphylococcus epidermidis
KNYKDGDISYNPNVPSYSAKYQLSNNEYNV

SEQ ID NO: 1782721 - protein, 4 aa, Staphylococcus epidermidis
KNYN

SEQ ID NO: 1782722 - protein, 13 aa, Staphylococcus epidermidis
KNYPSVQGDNVQY

SEQ ID NO: 1782723 - protein, 9 aa, Staphylococcus epidermidis
KNYSDSPKS

SEQ ID NO: 1782724 - protein, 4 aa, Staphylococcus epidermidis
KPAG

SEQ ID NO: 1782725 - protein, 22 aa, Staphylococcus epidermidis
KPAQPNPNWSGSNPDPSSSYAP

SEQ ID NO: 1782726 - protein, 4 aa, Staphylococcus epidermidis
KPCG

SEQ ID NO: 1782727 - protein, 8 aa, Staphylococcus epidermidis
KPDSHCTS

SEQ ID NO: 1782728 - protein, 9 aa, Staphylococcus epidermidis
KPDSTREQI

SEQ ID NO: 1782729 - protein, 5 aa, Staphylococcus epidermidis
KPDVD

SEQ ID NO: 1782730 - protein, 6 aa, Staphylococcus epidermidis
KPEAKL

SEQ ID NO: 1782731 - protein, 7 aa, Staphylococcus epidermidis
KPEDSWD

SEQ ID NO: 1782732 - protein, 10 aa, Staphylococcus epidermidis
KPEDVEGAPS

SEQ ID NO: 1782733 - protein, 6 aa, Staphylococcus epidermidis
KPEISE

SEQ ID NO: 1782734 - protein, 15 aa, Staphylococcus epidermidis
KPELTLEEQAEKYNP

SEQ ID NO: 1782735 - protein, 6 aa, Staphylococcus epidermidis
KPEQFR

SEQ ID NO: 1782736 - protein, 6 aa, Staphylococcus epidermidis
KPFDDY

SEQ ID NO: 1782737 - protein, 5 aa, Staphylococcus epidermidis
KPFTK

SEQ ID NO: 1782738 - protein, 4 aa, Staphylococcus epidermidis
KPFV

SEQ ID NO: 1782739 - protein, 7 aa, Staphylococcus epidermidis
KPGDNDL

SEQ ID NO: 1782740 - protein, 7 aa, Staphylococcus epidermidis
KPGNNDL

SEQ ID NO: 1782741 - protein, 9 aa, Staphylococcus epidermidis
KPGQKAEDI

SEQ ID NO: 1782742 - protein, 7 aa, Staphylococcus epidermidis
KPGQKLK

SEQ ID NO: 1782743 - protein, 9 aa, Staphylococcus epidermidis
KPGSIPRED

SEQ ID NO: 1782744 - protein, 14 aa, Staphylococcus epidermidis
KPGYEDKKKELEDR

SEQ ID NO: 1782745 - protein, 5 aa, Staphylococcus epidermidis
KPIDM

SEQ ID NO: 1782746 - protein, 5 aa, Staphylococcus epidermidis
KPIDR

SEQ ID NO: 1782747 - protein, 4 aa, Staphylococcus epidermidis
KPIE

SEQ ID NO: 1782748 - protein, 4 aa, Staphylococcus epidermidis
KPIG

SEQ ID NO: 1782749 - protein, 6 aa, Staphylococcus epidermidis
KPIGRD

SEQ ID NO: 1782750 - protein, 5 aa, Staphylococcus epidermidis
KPIGV

SEQ ID NO: 1782751 - protein, 85 aa, Staphylococcus epidermidis
KPIKEEIKEDKSVKQTVKEETKGTEEVPPGETITDKEEVIEEPKRKTRKRKSSTKEAVEEAKAEEKEETLDEKPKRTRRSRRKKT

SEQ ID NO: 1782752 - protein, 6 aa, Staphylococcus epidermidis
KPIPKF

SEQ ID NO: 1782753 - protein, 6 aa, Staphylococcus epidermidis
KPIQTI

SEQ ID NO: 1782754 - protein, 7 aa, Staphylococcus epidermidis
KPISDEG

SEQ ID NO: 1782755 - protein, 6 aa, Staphylococcus epidermidis
KPITSK

SEQ ID NO: 1782756 - protein, 4 aa, Staphylococcus epidermidis
KPIV

SEQ ID NO: 1782757 - protein, 8 aa, Staphylococcus epidermidis
KPKAANEL

SEQ ID NO: 1782758 - protein, 5 aa, Staphylococcus epidermidis
KPKDI

SEQ ID NO: 1782759 - protein, 5 aa, Staphylococcus epidermidis
KPKIK

SEQ ID NO: 1782760 - protein, 8 aa, Staphylococcus epidermidis
KPKNNRTL

SEQ ID NO: 1782761 - protein, 10 aa, Staphylococcus epidermidis
KPKQGTAPSN

SEQ ID NO: 1782762 - protein, 6 aa, Staphylococcus epidermidis
KPKSII

SEQ ID NO: 1782763 - protein, 6 aa, Staphylococcus epidermidis
KPLGSN

SEQ ID NO: 1782764 - protein, 4 aa, Staphylococcus epidermidis
KPLM

SEQ ID NO: 1782765 - protein, 5 aa, Staphylococcus epidermidis
KPLPN

SEQ ID NO: 1782766 - protein, 13 aa, Staphylococcus epidermidis
KPLSESEKEKCEN

SEQ ID NO: 1782767 - protein, 6 aa, Staphylococcus epidermidis
KPLSRQ

SEQ ID NO: 1782768 - protein, 12 aa, Staphylococcus epidermidis
KPLTSNENLFVY

SEQ ID NO: 1782769 - protein, 6 aa, Staphylococcus epidermidis
KPMGKA

SEQ ID NO: 1782770 - protein, 20 aa, Staphylococcus epidermidis
KPNDHTQSVIESKGGSRLKD

SEQ ID NO: 1782771 - protein, 5 aa, Staphylococcus epidermidis
KPNER

SEQ ID NO: 1782772 - protein, 11 aa, Staphylococcus epidermidis
KPNKEKHQQYK

SEQ ID NO: 1782773 - protein, 8 aa, Staphylococcus epidermidis
KPNLKERK

SEQ ID NO: 1782774 - protein, 9 aa, Staphylococcus epidermidis
KPNLKKQGK

SEQ ID NO: 1782775 - protein, 8 aa, Staphylococcus epidermidis
KPNRPEYM

SEQ ID NO: 1782776 - protein, 12 aa, Staphylococcus epidermidis
KPNRRKADIEAK

SEQ ID NO: 1782777 - protein, 14 aa, Staphylococcus epidermidis
KPNSEETHVTSPEG

SEQ ID NO: 1782778 - protein, 7 aa, Staphylococcus epidermidis
KPNTTYH

SEQ ID NO: 1782779 - protein, 9 aa, Staphylococcus epidermidis
KPNVNESAT

SEQ ID NO: 1782780 - protein, 9 aa, Staphylococcus epidermidis
KPPHASNRS

SEQ ID NO: 1782781 - protein, 6 aa, Staphylococcus epidermidis
KPPHYS

SEQ ID NO: 1782782 - protein, 12 aa, Staphylococcus epidermidis
KPPIPGRTNSTA

SEQ ID NO: 1782783 - protein, 6 aa, Staphylococcus epidermidis
KPPSVS

SEQ ID NO: 1782784 - protein, 7 aa, Staphylococcus epidermidis
KPQSIKD

SEQ ID NO: 1782785 - protein, 5 aa, Staphylococcus epidermidis
KPQST

SEQ ID NO: 1782786 - protein, 9 aa, Staphylococcus epidermidis
KPQTSIQDG

SEQ ID NO: 1782787 - protein, 7 aa, Staphylococcus epidermidis
KPRSGYY

SEQ ID NO: 1782788 - protein, 8 aa, Staphylococcus epidermidis
KPRTDEKG

SEQ ID NO: 1782789 - protein, 8 aa, Staphylococcus epidermidis
KPSAREYD

SEQ ID NO: 1782790 - protein, 7 aa, Staphylococcus epidermidis
KPSDRLR

SEQ ID NO: 1782791 - protein, 9 aa, Staphylococcus epidermidis
KPSEHTPNV

SEQ ID NO: 1782792 - protein, 13 aa, Staphylococcus epidermidis
KPSEIEKRLNQKK

SEQ ID NO: 1782793 - protein, 8 aa, Staphylococcus epidermidis
KPSHTGVK

SEQ ID NO: 1782794 - protein, 7 aa, Staphylococcus epidermidis
KPSKNII

SEQ ID NO: 1782795 - protein, 13 aa, Staphylococcus epidermidis
KPSKTRNNKGEPY

SEQ ID NO: 1782796 - protein, 6 aa, Staphylococcus epidermidis
KPSPIF

SEQ ID NO: 1782797 - protein, 11 aa, Staphylococcus epidermidis
KPSQNIVEEQR

SEQ ID NO: 1782798 - protein, 7 aa, Staphylococcus epidermidis
KPSQYPG

SEQ ID NO: 1782799 - protein, 4 aa, Staphylococcus epidermidis
KPTD

SEQ ID NO: 1782800 - protein, 5 aa, Staphylococcus epidermidis
KPTEY

SEQ ID NO: 1782801 - protein, 4 aa, Staphylococcus epidermidis
KPTI

SEQ ID NO: 1782802 - protein, 8 aa, Staphylococcus epidermidis
KPTKGSIE

SEQ ID NO: 1782803 - protein, 8 aa, Staphylococcus epidermidis
KPTSASRY

SEQ ID NO: 1782804 - protein, 5 aa, Staphylococcus epidermidis
KPVHG

SEQ ID NO: 1782805 - protein, 7 aa, Staphylococcus epidermidis
KPVHGHT

SEQ ID NO: 1782806 - protein, 5 aa, Staphylococcus epidermidis
KPVPL

SEQ ID NO: 1782807 - protein, 5 aa, Staphylococcus epidermidis
KPVSE

SEQ ID NO: 1782808 - protein, 23 aa, Staphylococcus epidermidis
KPVTIGSGKQIKAQSVKAGTKIL

SEQ ID NO: 1782809 - protein, 4 aa, Staphylococcus epidermidis
KPVY

SEQ ID NO: 1782810 - protein, 6 aa, Staphylococcus epidermidis
KPYDIK

SEQ ID NO: 1782811 - protein, 10 aa, Staphylococcus epidermidis
KPYGKLTERD

SEQ ID NO: 1782812 - protein, 6 aa, Staphylococcus epidermidis
KPYKDM

SEQ ID NO: 1782813 - protein, 11 aa, Staphylococcus epidermidis
KPYKKLTDRQK

SEQ ID NO: 1782814 - protein, 14 aa, Staphylococcus epidermidis
KPYKLNKKEDVEKI

SEQ ID NO: 1782815 - protein, 22 aa, Staphylococcus epidermidis
KPYKLNNKDDVQKITEALNGDQ

SEQ ID NO: 1782816 - protein, 7 aa, Staphylococcus epidermidis
KPYNTKD

SEQ ID NO: 1782817 - protein, 22 aa, Staphylococcus epidermidis
KPYSPHQDKSINDKSNAVQEGL

SEQ ID NO: 1782818 - protein, 6 aa, Staphylococcus epidermidis
KPYSWG

SEQ ID NO: 1782819 - protein, 7 aa, Staphylococcus epidermidis
KQADKNA

SEQ ID NO: 1782820 - protein, 10 aa, Staphylococcus epidermidis
KQAETYPNAL

SEQ ID NO: 1782821 - protein, 14 aa, Staphylococcus epidermidis
KQAKNAQDTADNKR

SEQ ID NO: 1782822 - protein, 11 aa, Staphylococcus epidermidis
KQAKNHPDNPF

SEQ ID NO: 1782823 - protein, 6 aa, Staphylococcus epidermidis
KQAKTY

SEQ ID NO: 1782824 - protein, 7 aa, Staphylococcus epidermidis
KQAPYKN

SEQ ID NO: 1782825 - protein, 11 aa, Staphylococcus epidermidis
KQAQLDEDDYR

SEQ ID NO: 1782826 - protein, 4 aa, Staphylococcus epidermidis
KQAR

SEQ ID NO: 1782827 - protein, 11 aa, Staphylococcus epidermidis
KQDGDQLNSRI

SEQ ID NO: 1782828 - protein, 6 aa, Staphylococcus epidermidis
KQDGTS

SEQ ID NO: 1782829 - protein, 6 aa, Staphylococcus epidermidis
KQDQKK

SEQ ID NO: 1782830 - protein, 12 aa, Staphylococcus epidermidis
KQDVTLEDIDTS

SEQ ID NO: 1782831 - protein, 8 aa, Staphylococcus epidermidis
KQEAIDAR

SEQ ID NO: 1782832 - protein, 17 aa, Staphylococcus epidermidis
KQEFRKSKSNDTEFNNT

SEQ ID NO: 1782833 - protein, 7 aa, Staphylococcus epidermidis
KQEGATI

SEQ ID NO: 1782834 - protein, 10 aa, Staphylococcus epidermidis
KQEGRRPKGD

SEQ ID NO: 1782835 - protein, 6 aa, Staphylococcus epidermidis
KQEHGM

SEQ ID NO: 1782836 - protein, 6 aa, Staphylococcus epidermidis
KQEHQG

SEQ ID NO: 1782837 - protein, 4 aa, Staphylococcus epidermidis
KQEK

SEQ ID NO: 1782838 - protein, 4 aa, Staphylococcus epidermidis
KQEL

SEQ ID NO: 1782839 - protein, 7 aa, Staphylococcus epidermidis
KQELDEI

SEQ ID NO: 1782840 - protein, 13 aa, Staphylococcus epidermidis
KQEMGSEKISTTA

SEQ ID NO: 1782841 - protein, 9 aa, Staphylococcus epidermidis
KQENIESDA

SEQ ID NO: 1782842 - protein, 7 aa, Staphylococcus epidermidis
KQEQPTY

SEQ ID NO: 1782843 - protein, 5 aa, Staphylococcus epidermidis
KQEYG

SEQ ID NO: 1782844 - protein, 6 aa, Staphylococcus epidermidis
KQEYGN

SEQ ID NO: 1782845 - protein, 11 aa, Staphylococcus epidermidis
KQEYNSDLTGT

SEQ ID NO: 1782846 - protein, 5 aa, Staphylococcus epidermidis
KQEYQ

SEQ ID NO: 1782847 - protein, 14 aa, Staphylococcus epidermidis
KQFDPSKKVSDEDF

SEQ ID NO: 1782848 - protein, 14 aa, Staphylococcus epidermidis
KQFTGKDKDKAREL

SEQ ID NO: 1782849 - protein, 8 aa, Staphylococcus epidermidis
KQGDESVT

SEQ ID NO: 1782850 - protein, 4 aa, Staphylococcus epidermidis
KQGF

SEQ ID NO: 1782851 - protein, 6 aa, Staphylococcus epidermidis
KQGIER

SEQ ID NO: 1782852 - protein, 10 aa, Staphylococcus epidermidis
KQGMPSAKKK

SEQ ID NO: 1782853 - protein, 4 aa, Staphylococcus epidermidis
KQGN

SEQ ID NO: 1782854 - protein, 12 aa, Staphylococcus epidermidis
KQGPLSEGTVSG

SEQ ID NO: 1782855 - protein, 8 aa, Staphylococcus epidermidis
KQGSHGTL

SEQ ID NO: 1782856 - protein, 7 aa, Staphylococcus epidermidis
KQGVNGR

SEQ ID NO: 1782857 - protein, 8 aa, Staphylococcus epidermidis
KQHSRQYA

SEQ ID NO: 1782858 - protein, 6 aa, Staphylococcus epidermidis
KQIDGE

SEQ ID NO: 1782859 - protein, 10 aa, Staphylococcus epidermidis
KQIDSEKEIN

SEQ ID NO: 1782860 - protein, 6 aa, Staphylococcus epidermidis
KQIDSV

SEQ ID NO: 1782861 - protein, 8 aa, Staphylococcus epidermidis
KQIEEKTK

SEQ ID NO: 1782862 - protein, 7 aa, Staphylococcus epidermidis
KQIPEND

SEQ ID NO: 1782863 - protein, 5 aa, Staphylococcus epidermidis
KQIQR

SEQ ID NO: 1782864 - protein, 6 aa, Staphylococcus epidermidis
KQIRER

SEQ ID NO: 1782865 - protein, 6 aa, Staphylococcus epidermidis
KQITDA

SEQ ID NO: 1782866 - protein, 15 aa, Staphylococcus epidermidis
KQITNSSVNKSIREA

SEQ ID NO: 1782867 - protein, 7 aa, Staphylococcus epidermidis
KQKDMSE

SEQ ID NO: 1782868 - protein, 24 aa, Staphylococcus epidermidis
KQKEENGEQPFANPRNAAAGSLRQ

SEQ ID NO: 1782869 - protein, 6 aa, Staphylococcus epidermidis
KQKESI

SEQ ID NO: 1782870 - protein, 12 aa, Staphylococcus epidermidis
KQKEVKDKINAA

SEQ ID NO: 1782871 - protein, 12 aa, Staphylococcus epidermidis
KQKEVKDKINAT

SEQ ID NO: 1782872 - protein, 9 aa, Staphylococcus epidermidis
KQKEVQKQI

SEQ ID NO: 1782873 - protein, 5 aa, Staphylococcus epidermidis
KQKGI

SEQ ID NO: 1782874 - protein, 6 aa, Staphylococcus epidermidis
KQKGLT

SEQ ID NO: 1782875 - protein, 9 aa, Staphylococcus epidermidis
KQKKHSDFS

SEQ ID NO: 1782876 - protein, 12 aa, Staphylococcus epidermidis
KQKKKEYHDSTA

SEQ ID NO: 1782877 - protein, 5 aa, Staphylococcus epidermidis
KQKLT

SEQ ID NO: 1782878 - protein, 5 aa, Staphylococcus epidermidis
KQKNI

SEQ ID NO: 1782879 - protein, 11 aa, Staphylococcus epidermidis
KQKPIPAITGS

SEQ ID NO: 1782880 - protein, 7 aa, Staphylococcus epidermidis
KQKQYER

SEQ ID NO: 1782881 - protein, 6 aa, Staphylococcus epidermidis
KQKVGN

SEQ ID NO: 1782882 - protein, 6 aa, Staphylococcus epidermidis
KQLDNA

SEQ ID NO: 1782883 - protein, 10 aa, Staphylococcus epidermidis
KQLEERNNEM

SEQ ID NO: 1782884 - protein, 9 aa, Staphylococcus epidermidis
KQLKPSLRD

SEQ ID NO: 1782885 - protein, 5 aa, Staphylococcus epidermidis
KQLLS

SEQ ID NO: 1782886 - protein, 10 aa, Staphylococcus epidermidis
KQLPKGRKPI

SEQ ID NO: 1782887 - protein, 9 aa, Staphylococcus epidermidis
KQLPQKNQT

SEQ ID NO: 1782888 - protein, 9 aa, Staphylococcus epidermidis
KQLPQKNST

SEQ ID NO: 1782889 - protein, 6 aa, Staphylococcus epidermidis
KQLPVS

SEQ ID NO: 1782890 - protein, 5 aa, Staphylococcus epidermidis
KQLSI

SEQ ID NO: 1782891 - protein, 13 aa, Staphylococcus epidermidis
KQLTSNRKHITET

SEQ ID NO: 1782892 - protein, 12 aa, Staphylococcus epidermidis
KQMKEQKKINRT

SEQ ID NO: 1782893 - protein, 30 aa, Staphylococcus epidermidis
KQMQGEEIPEEDLQKAQEQAQEIEKDENIS

SEQ ID NO: 1782894 - protein, 6 aa, Staphylococcus epidermidis
KQMTSE

SEQ ID NO: 1782895 - protein, 13 aa, Staphylococcus epidermidis
KQNDSADTEGVEP

SEQ ID NO: 1782896 - protein, 121 aa, Staphylococcus epidermidis
KQNDTSNQNRDTNQHQDQTQPTNNDYNNDNQSGTEQPAQQPNYHQYPNNNQQSGSNKNNSSENNKQKPNQNKTNQSYHQPAQSTPQQSSQHNNQSDSQQNGNSNNNSNNQNHGTNDKQNKN

SEQ ID NO: 1782897 - protein, 6 aa, Staphylococcus epidermidis
KQNEGY

SEQ ID NO: 1782898 - protein, 5 aa, Staphylococcus epidermidis
KQNFD

SEQ ID NO: 1782899 - protein, 10 aa, Staphylococcus epidermidis
KQNGEKQRFE

SEQ ID NO: 1782900 - protein, 7 aa, Staphylococcus epidermidis
KQNPEYN

SEQ ID NO: 1782901 - protein, 7 aa, Staphylococcus epidermidis
KQNPPVE

SEQ ID NO: 1782902 - protein, 4 aa, Staphylococcus epidermidis
KQNQ

SEQ ID NO: 1782903 - protein, 6 aa, Staphylococcus epidermidis
KQNQFS

SEQ ID NO: 1782904 - protein, 10 aa, Staphylococcus epidermidis
KQNRPAPPAE

SEQ ID NO: 1782905 - protein, 12 aa, Staphylococcus epidermidis
KQPDLNWNNPDV

SEQ ID NO: 1782906 - protein, 9 aa, Staphylococcus epidermidis
KQPIENDEV

SEQ ID NO: 1782907 - protein, 6 aa, Staphylococcus epidermidis
KQPIFG

SEQ ID NO: 1782908 - protein, 7 aa, Staphylococcus epidermidis
KQPKADW

SEQ ID NO: 1782909 - protein, 11 aa, Staphylococcus epidermidis
KQPKVKRDDEM

SEQ ID NO: 1782910 - protein, 7 aa, Staphylococcus epidermidis
KQPNPKH

SEQ ID NO: 1782911 - protein, 8 aa, Staphylococcus epidermidis
KQPQETKP

SEQ ID NO: 1782912 - protein, 8 aa, Staphylococcus epidermidis
KQPRGGYF

SEQ ID NO: 1782913 - protein, 8 aa, Staphylococcus epidermidis
KQPRGGYL

SEQ ID NO: 1782914 - protein, 5 aa, Staphylococcus epidermidis
KQQFG

SEQ ID NO: 1782915 - protein, 6 aa, Staphylococcus epidermidis
KQQHTV

SEQ ID NO: 1782916 - protein, 4 aa, Staphylococcus epidermidis
KQQI

SEQ ID NO: 1782917 - protein, 6 aa, Staphylococcus epidermidis
KQQIEN

SEQ ID NO: 1782918 - protein, 6 aa, Staphylococcus epidermidis
KQQKPD

SEQ ID NO: 1782919 - protein, 7 aa, Staphylococcus epidermidis
KQQNPNP

SEQ ID NO: 1782920 - protein, 6 aa, Staphylococcus epidermidis
KQQQLD

SEQ ID NO: 1782921 - protein, 13 aa, Staphylococcus epidermidis
KQQQNISLTERGK

SEQ ID NO: 1782922 - protein, 7 aa, Staphylococcus epidermidis
KQQQYAS

SEQ ID NO: 1782923 - protein, 8 aa, Staphylococcus epidermidis
KQQRDENL

SEQ ID NO: 1782924 - protein, 4 aa, Staphylococcus epidermidis
KQQS

SEQ ID NO: 1782925 - protein, 12 aa, Staphylococcus epidermidis
KQQVELDNVHPS

SEQ ID NO: 1782926 - protein, 8 aa, Staphylococcus epidermidis
KQRGRDME

SEQ ID NO: 1782927 - protein, 56 aa, Staphylococcus epidermidis; identical to SEQ ID NO: 1629353

SEQ ID NO: 1782928 - protein, 57 aa, Staphylococcus epidermidis
KQRGYDLERGQSRQVTNAQHEQISQYKQKTEYHKQEYERESQKTDHIKQKNDKLMQE

SEQ ID NO: 1782929 - protein, 8 aa, Staphylococcus epidermidis
KQRHPQYS

SEQ ID NO: 1782930 - protein, 12 aa, Staphylococcus epidermidis
KQRKTSNENGIK

SEQ ID NO: 1782931 - protein, 8 aa, Staphylococcus epidermidis
KQRQPQYS

SEQ ID NO: 1782932 - protein, 7 aa, Staphylococcus epidermidis
KQRTHAM

SEQ ID NO: 1782933 - protein, 6 aa, Staphylococcus epidermidis
KQSFGG

SEQ ID NO: 1782934 - protein, 11 aa, Staphylococcus epidermidis
KQSGKSIENRP

SEQ ID NO: 1782935 - protein, 13 aa, Staphylococcus epidermidis
KQSGYGREGGIEG

SEQ ID NO: 1782936 - protein, 13 aa, Staphylococcus epidermidis
KQSIKAVNPQGQV

SEQ ID NO: 1782937 - protein, 8 aa, Staphylococcus epidermidis
KQSITSVD

SEQ ID NO: 1782938 - protein, 9 aa, Staphylococcus epidermidis
KQSKEKAEA

SEQ ID NO: 1782939 - protein, 6 aa, Staphylococcus epidermidis
KQSMKE

SEQ ID NO: 1782940 - protein, 29 aa, Staphylococcus epidermidis
KQSQEIHNEDAKLKQDRETFQRQLEEKWE

SEQ ID NO: 1782941 - protein, 7 aa, Staphylococcus epidermidis
KQSQMNE

SEQ ID NO: 1782942 - protein, 9 aa, Staphylococcus epidermidis
KQTADTLKE

SEQ ID NO: 1782943 - protein, 7 aa, Staphylococcus epidermidis
KQTESHV

SEQ ID NO: 1782944 - protein, 5 aa, Staphylococcus epidermidis
KQTFE

SEQ ID NO: 1782945 - protein, 6 aa, Staphylococcus epidermidis
KQTHRT

SEQ ID NO: 1782946 - protein, 4 aa, Staphylococcus epidermidis
KQTI

SEQ ID NO: 1782947 - protein, 13 aa, Staphylococcus epidermidis
KQTKQTPSDNQLK

SEQ ID NO: 1782948 - protein, 9 aa, Staphylococcus epidermidis
KQTLTDRGI

SEQ ID NO: 1782949 - protein, 5 aa, Staphylococcus epidermidis
KQTMQ

SEQ ID NO: 1782950 - protein, 8 aa, Staphylococcus epidermidis
KQTQSNID

SEQ ID NO: 1782951 - protein, 6 aa, Staphylococcus epidermidis
KQTTFK

SEQ ID NO: 1782952 - protein, 7 aa, Staphylococcus epidermidis
KQTVGGY

SEQ ID NO: 1782953 - protein, 7 aa, Staphylococcus epidermidis
KQVANAN

SEQ ID NO: 1782954 - protein, 5 aa, Staphylococcus epidermidis
KQVDG

SEQ ID NO: 1782955 - protein, 28 aa, Staphylococcus epidermidis
KQVDSEEIKNAVEDAKNNDFPDIPDGEY

SEQ ID NO: 1782956 - protein, 6 aa, Staphylococcus epidermidis
KQVEEL

SEQ ID NO: 1782957 - protein, 8 aa, Staphylococcus epidermidis
KQVKTKKA

SEQ ID NO: 1782958 - protein, 7 aa, Staphylococcus epidermidis
KQVTPGD

SEQ ID NO: 1782959 - protein, 12 aa, Staphylococcus epidermidis
KQVYEDKEELPD

SEQ ID NO: 1782960 - protein, 8 aa, Staphylococcus epidermidis
KQVYEETK

SEQ ID NO: 1782961 - protein, 5 aa, Staphylococcus epidermidis
KQWEN

SEQ ID NO: 1782962 - protein, 7 aa, Staphylococcus epidermidis
KQYDIPS

SEQ ID NO: 1782963 - protein, 7 aa, Staphylococcus epidermidis
KQYESTQ

SEQ ID NO: 1782964 - protein, 4 aa, Staphylococcus epidermidis
KQYG

SEQ ID NO: 1782965 - protein, 18 aa, Staphylococcus epidermidis
KQYKNKRKELEELESADQ

SEQ ID NO: 1782966 - protein, 8 aa, Staphylococcus epidermidis
KQYSNTLK

SEQ ID NO: 1782967 - protein, 7 aa, Staphylococcus epidermidis
KQYSRNE

SEQ ID NO: 1782968 - protein, 12 aa, Staphylococcus epidermidis
KQYTKSSINTSQ

SEQ ID NO: 1782969 - protein, 7 aa, Staphylococcus epidermidis
KRAANED

SEQ ID NO: 1782970 - protein, 7 aa, Staphylococcus epidermidis
KRAGEGI

SEQ ID NO: 1782971 - protein, 7 aa, Staphylococcus epidermidis
KRAIERS

SEQ ID NO: 1782972 - protein, 4 aa, Staphylococcus epidermidis
KRAP

SEQ ID NO: 1782973 - protein, 7 aa, Staphylococcus epidermidis
KRCPDEK

SEQ ID NO: 1782974 - protein, 9 aa, Staphylococcus epidermidis
KRDAKQNGL

SEQ ID NO: 1782975 - protein, 4 aa, Staphylococcus epidermidis
KRDD

SEQ ID NO: 1782976 - protein, 7 aa, Staphylococcus epidermidis
KRDDDTD

SEQ ID NO: 1782977 - protein, 14 aa, Staphylococcus epidermidis
KRDDINSGGKQMPS

SEQ ID NO: 1782978 - protein, 19 aa, Staphylococcus epidermidis
KRDDTQNGKIYLISNFVYK

SEQ ID NO: 1782979 - protein, 10 aa, Staphylococcus epidermidis
KRDDTQNGLR

SEQ ID NO: 1782980 - protein, 7 aa, Staphylococcus epidermidis
KRDHQSA

SEQ ID NO: 1782981 - protein, 4 aa, Staphylococcus epidermidis
KRDI

SEQ ID NO: 1782982 - protein, 21 aa, Staphylococcus epidermidis
KRDQVDQSFRETQIRTTQQQL

SEQ ID NO: 1782983 - protein, 9 aa, Staphylococcus epidermidis
KRDTDISYG

SEQ ID NO: 1782984 - protein, 12 aa, Staphylococcus epidermidis
KRDVLSGRTVTG

SEQ ID NO: 1782985 - protein, 6 aa, Staphylococcus epidermidis
KREDIT

SEQ ID NO: 1782986 - protein, 6 aa, Staphylococcus epidermidis
KREGSY

SEQ ID NO: 1782987 - protein, 4 aa, Staphylococcus epidermidis
KREK

SEQ ID NO: 1782988 - protein, 13 aa, Staphylococcus epidermidis
KRELAYTRYTWPK

SEQ ID NO: 1782989 - protein, 9 aa, Staphylococcus epidermidis
KREQREIKA

SEQ ID NO: 1782990 - protein, 7 aa, Staphylococcus epidermidis
KRESYEF

SEQ ID NO: 1782991 - protein, 5 aa, Staphylococcus epidermidis
KRGDD

SEQ ID NO: 1782992 - protein, 28 aa, Staphylococcus epidermidis
KRGELAQKIGEEKIKQGTQVYDPQREKE

SEQ ID NO: 1782993 - protein, 8 aa, Staphylococcus epidermidis
KRGGSEDL

SEQ ID NO: 1782994 - protein, 4 aa, Staphylococcus epidermidis
KRGH

SEQ ID NO: 1782995 - protein, 7 aa, Staphylococcus epidermidis
KRGHKPK

SEQ ID NO: 1782996 - protein, 6 aa, Staphylococcus epidermidis
KRGNRF

SEQ ID NO: 1782997 - protein, 20 aa, Staphylococcus epidermidis
KRGRFRSAYQDETFRMRLGL

SEQ ID NO: 1782998 - protein, 6 aa, Staphylococcus epidermidis
KRGRYN

SEQ ID NO: 1782999 - protein, 8 aa, Staphylococcus epidermidis
KRGTVRTN

SEQ ID NO: 1783000 - protein, 5 aa, Staphylococcus epidermidis
KRHAD

SEQ ID NO: 1783001 - protein, 5 aa, Staphylococcus epidermidis
KRIET

SEQ ID NO: 1783002 - protein, 13 aa, Staphylococcus epidermidis
KRIHSKRQPQMAN

SEQ ID NO: 1783003 - protein, 19 aa, Staphylococcus epidermidis
KRIHSKRQPQMKDIGKPNH

SEQ ID NO: 1783004 - protein, 16 aa, Staphylococcus epidermidis
KRIKDKKERYEAQANR

SEQ ID NO: 1783005 - protein, 5 aa, Staphylococcus epidermidis
KRIKV

SEQ ID NO: 1783006 - protein, 8 aa, Staphylococcus epidermidis
KRKAESIN

SEQ ID NO: 1783007 - protein, 8 aa, Staphylococcus epidermidis
KRKGIPEL

SEQ ID NO: 1783008 - protein, 8 aa, Staphylococcus epidermidis
KRKGYSED

SEQ ID NO: 1783009 - protein, 13 aa, Staphylococcus epidermidis
KRKHYQFSEDDVN

SEQ ID NO: 1783010 - protein, 6 aa, Staphylococcus epidermidis
KRKKNV

SEQ ID NO: 1783011 - protein, 13 aa, Staphylococcus epidermidis
KRKMSRQDGIEEI

SEQ ID NO: 1783012 - protein, 15 aa, Staphylococcus epidermidis
KRKMTYEEKLKNLFE

SEQ ID NO: 1783013 - protein, 6 aa, Staphylococcus epidermidis
KRKPNQ

SEQ ID NO: 1783014 - protein, 7 aa, Staphylococcus epidermidis
KRKQTTI

SEQ ID NO: 1783015 - protein, 18 aa, Staphylococcus epidermidis
KRKSLRKKGKKNQNKSTL

SEQ ID NO: 1783016 - protein, 9 aa, Staphylococcus epidermidis
KRKTSDFEK

SEQ ID NO: 1783017 - protein, 5 aa, Staphylococcus epidermidis
KRLEQ

SEQ ID NO: 1783018 - protein, 8 aa, Staphylococcus epidermidis
KRLKTNNE

SEQ ID NO: 1783019 - protein, 4 aa, Staphylococcus epidermidis
KRLQ

SEQ ID NO: 1783020 - protein, 14 aa, Staphylococcus epidermidis
KRLQKQVKHKSERH

SEQ ID NO: 1783021 - protein, 15 aa, Staphylococcus epidermidis
KRMREGKKLAQSRGQ

SEQ ID NO: 1783022 - protein, 6 aa, Staphylococcus epidermidis
KRMRKT

SEQ ID NO: 1783023 - protein, 7 aa, Staphylococcus epidermidis
KRMTSSV

SEQ ID NO: 1783024 - protein, 6 aa, Staphylococcus epidermidis
KRNERG

SEQ ID NO: 1783025 - protein, 14 aa, Staphylococcus epidermidis
KRNGEISERVKDAR

SEQ ID NO: 1783026 - protein, 14 aa, Staphylococcus epidermidis
KRNGLKDKSKMNED

SEQ ID NO: 1783027 - protein, 6 aa, Staphylococcus epidermidis
KRNHSI

SEQ ID NO: 1783028 - protein, 20 aa, Staphylococcus epidermidis
KRNPTVKNEMKEKNFGDSVP

SEQ ID NO: 1783029 - protein, 4 aa, Staphylococcus epidermidis
KRNS

SEQ ID NO: 1783030 - protein, 6 aa, Staphylococcus epidermidis
KRPDHE

SEQ ID NO: 1783031 - protein, 10 aa, Staphylococcus epidermidis
KRPGVPEELQ

SEQ ID NO: 1783032 - protein, 7 aa, Staphylococcus epidermidis
KRPNDFG

SEQ ID NO: 1783033 - protein, 18 aa, Staphylococcus epidermidis
KRQESRKKPQVHGKGTNL

SEQ ID NO: 1783034 - protein, 6 aa, Staphylococcus epidermidis
KRQGKS

SEQ ID NO: 1783035 - protein, 10 aa, Staphylococcus epidermidis
KRREPFEKDG

SEQ ID NO: 1783036 - protein, 9 aa, Staphylococcus epidermidis
KRREPFEKE

SEQ ID NO: 1783037 - protein, 10 aa, Staphylococcus epidermidis
KRREPFEKEE

SEQ ID NO: 1783038 - protein, 6 aa, Staphylococcus epidermidis
KRSDYG

SEQ ID NO: 1783039 - protein, 10 aa, Staphylococcus epidermidis
KRSEQDGISN

SEQ ID NO: 1783040 - protein, 4 aa, Staphylococcus epidermidis
KRSH

SEQ ID NO: 1783041 - protein, 7 aa, Staphylococcus epidermidis
KRSQEYN

SEQ ID NO: 1783042 - protein, 4 aa, Staphylococcus epidermidis
KRSR

SEQ ID NO: 1783043 - protein, 5 aa, Staphylococcus epidermidis
KRSVL

SEQ ID NO: 1783044 - protein, 39 aa, Staphylococcus epidermidis
KRTDASQTDGNDTNNSEEDIETAEAETKSADSQSKGGAY

SEQ ID NO: 1783045 - protein, 6 aa, Staphylococcus epidermidis
KRTHGL

SEQ ID NO: 1783046 - protein, 4 aa, Staphylococcus epidermidis
KRTL

SEQ ID NO: 1783047 - protein, 7 aa, Staphylococcus epidermidis
KRTLENN

SEQ ID NO: 1783048 - protein, 6 aa, Staphylococcus epidermidis
KRTRTY

SEQ ID NO: 1783049 - protein, 6 aa, Staphylococcus epidermidis
KRTSVD

SEQ ID NO: 1783050 - protein, 11 aa, Staphylococcus epidermidis
KRTVQSMNKDG

SEQ ID NO: 1783051 - protein, 6 aa, Staphylococcus epidermidis
KRTYGG

SEQ ID NO: 1783052 - protein, 6 aa, Staphylococcus epidermidis
KRTYPG

SEQ ID NO: 1783053 - protein, 8 aa, Staphylococcus epidermidis
KRVGKDTN

SEQ ID NO: 1783054 - protein, 17 aa, Staphylococcus epidermidis
KRVKSGSTSRESKKTRV

SEQ ID NO: 1783055 - protein, 11 aa, Staphylococcus epidermidis
KRWDREQKAYN

SEQ ID NO: 1783056 - protein, 19 aa, Staphylococcus epidermidis
KRWPDTEKFENKDVDGHQH

SEQ ID NO: 1783057 - protein, 6 aa, Staphylococcus epidermidis
KRWTKS

SEQ ID NO: 1783058 - protein, 14 aa, Staphylococcus epidermidis
KRYRKSGYLTKRDA

SEQ ID NO: 1783059 - protein, 19 aa, Staphylococcus epidermidis
KRYRKTSFKTKRDATQAAN

SEQ ID NO: 1783060 - protein, 7 aa, Staphylococcus epidermidis
KRYRTVD

SEQ ID NO: 1783061 - protein, 12 aa, Staphylococcus epidermidis
KRYSSREKTPKW

SEQ ID NO: 1783062 - protein, 4 aa, Staphylococcus epidermidis
KRYT

SEQ ID NO: 1783063 - protein, 8 aa, Staphylococcus epidermidis
KSAAQSYL

SEQ ID NO: 1783064 - protein, 10 aa, Staphylococcus epidermidis
KSAARELASR

SEQ ID NO: 1783065 - protein, 13 aa, Staphylococcus epidermidis
KSAEESTKTGKPI

SEQ ID NO: 1783066 - protein, 7 aa, Staphylococcus epidermidis
KSAFKQT

SEQ ID NO: 1783067 - protein, 4 aa, Staphylococcus epidermidis
KSAG

SEQ ID NO: 1783068 - protein, 6 aa, Staphylococcus epidermidis
KSAGRL

SEQ ID NO: 1783069 - protein, 11 aa, Staphylococcus epidermidis
KSAKNSAGKHW

SEQ ID NO: 1783070 - protein, 8 aa, Staphylococcus epidermidis
KSANASNI

SEQ ID NO: 1783071 - protein, 5 aa, Staphylococcus epidermidis
KSAPE

SEQ ID NO: 1783072 - protein, 7 aa, Staphylococcus epidermidis
KSAPTTL

SEQ ID NO: 1783073 - protein, 8 aa, Staphylococcus epidermidis
KSASVAPI

SEQ ID NO: 1783074 - protein, 4 aa, Staphylococcus epidermidis
KSCV

SEQ ID NO: 1783075 - protein, 9 aa, Staphylococcus epidermidis
KSDAEFKAG

SEQ ID NO: 1783076 - protein, 11 aa, Staphylococcus epidermidis
KSDDDHEMEEE

SEQ ID NO: 1783077 - protein, 5 aa, Staphylococcus epidermidis
KSDEV

SEQ ID NO: 1783078 - protein, 6 aa, Staphylococcus epidermidis
KSDKSS

SEQ ID NO: 1783079 - protein, 6 aa, Staphylococcus epidermidis
KSDSFG

SEQ ID NO: 1783080 - protein, 11 aa, Staphylococcus epidermidis
KSDTSADITTP

SEQ ID NO: 1783081 - protein, 13 aa, Staphylococcus epidermidis
KSDYDKAIRSTRV

SEQ ID NO: 1783082 - protein, 6 aa, Staphylococcus epidermidis
KSDYQK

SEQ ID NO: 1783083 - protein, 9 aa, Staphylococcus epidermidis
KSEAAAKAL

SEQ ID NO: 1783084 - protein, 7 aa, Staphylococcus epidermidis
KSEDGIV

SEQ ID NO: 1783085 - protein, 6 aa, Staphylococcus epidermidis
KSEEEI

SEQ ID NO: 1783086 - protein, 5 aa, Staphylococcus epidermidis
KSEIE

SEQ ID NO: 1783087 - protein, 12 aa, Staphylococcus epidermidis
KSEITEHQNDDA

SEQ ID NO: 1783088 - protein, 7 aa, Staphylococcus epidermidis
KSEKECL

SEQ ID NO: 1783089 - protein, 8 aa, Staphylococcus epidermidis
KSELKRDE

SEQ ID NO: 1783090 - protein, 7 aa, Staphylococcus epidermidis
KSEPGYG

SEQ ID NO: 1783091 - protein, 8 aa, Staphylococcus epidermidis
KSEPGYGP

SEQ ID NO: 1783092 - protein, 6 aa, Staphylococcus epidermidis
KSERAI

SEQ ID NO: 1783093 - protein, 10 aa, Staphylococcus epidermidis
KSESHGSEEN

SEQ ID NO: 1783094 - protein, 25 aa, Staphylococcus epidermidis
KSESHMKHNDESKVPEDMTSTNEGE

SEQ ID NO: 1783095 - protein, 5 aa, Staphylococcus epidermidis
KSESI

SEQ ID NO: 1783096 - protein, 9 aa, Staphylococcus epidermidis
KSETDAREA

SEQ ID NO: 1783097 - protein, 8 aa, Staphylococcus epidermidis
KSETPPFA

SEQ ID NO: 1783098 - protein, 19 aa, Staphylococcus epidermidis
KSFEDTGESVEETTLSKPM

SEQ ID NO: 1783099 - protein, 6 aa, Staphylococcus epidermidis
KSFKEE

SEQ ID NO: 1783100 - protein, 13 aa, Staphylococcus epidermidis
KSFPKKSNGGKTL

SEQ ID NO: 1783101 - protein, 4 aa, Staphylococcus epidermidis
KSFS

SEQ ID NO: 1783102 - protein, 6 aa, Staphylococcus epidermidis
KSFTES

SEQ ID NO: 1783103 - protein, 8 aa, Staphylococcus epidermidis
KSGAIQTN

SEQ ID NO: 1783104 - protein, 15 aa, Staphylococcus epidermidis
KSGALSKGATISMPK

SEQ ID NO: 1783105 - protein, 4 aa, Staphylococcus epidermidis
KSGC

SEQ ID NO: 1783106 - protein, 8 aa, Staphylococcus epidermidis
KSGEKIPK

SEQ ID NO: 1783107 - protein, 11 aa, Staphylococcus epidermidis
KSGEPNPESNQ

SEQ ID NO: 1783108 - protein, 4 aa, Staphylococcus epidermidis
KSGF

SEQ ID NO: 1783109 - protein, 9 aa, Staphylococcus epidermidis
KSGGHAQSN

SEQ ID NO: 1783110 - protein, 6 aa, Staphylococcus epidermidis
KSGKSW

SEQ ID NO: 1783111 - protein, 14 aa, Staphylococcus epidermidis
KSGLHQENAKNLTK

SEQ ID NO: 1783112 - protein, 14 aa, Staphylococcus epidermidis
KSGLHQENTKNLTK

SEQ ID NO: 1783113 - protein, 13 aa, Staphylococcus epidermidis
KSGLSGAGKALSN

SEQ ID NO: 1783114 - protein, 16 aa, Staphylococcus epidermidis
KSGLTGAGKKLNQSTH

SEQ ID NO: 1783115 - protein, 19 aa, Staphylococcus epidermidis
KSGQETEINAPGPKVTDEQ

SEQ ID NO: 1783116 - protein, 7 aa, Staphylococcus epidermidis
KSGQVTH

SEQ ID NO: 1783117 - protein, 9 aa, Staphylococcus epidermidis
KSGSGKSTL

SEQ ID NO: 1783118 - protein, 5 aa, Staphylococcus epidermidis
KSGYR

SEQ ID NO: 1783119 - protein, 7 aa, Staphylococcus epidermidis
KSGYRIG

SEQ ID NO: 1783120 - protein, 4 aa, Staphylococcus epidermidis
KSHG

SEQ ID NO: 1783121 - protein, 8 aa, Staphylococcus epidermidis
KSHQGLGY

SEQ ID NO: 1783122 - protein, 7 aa, Staphylococcus epidermidis
KSHTSTI

SEQ ID NO: 1783123 - protein, 9 aa, Staphylococcus epidermidis
KSHTTPNNL

SEQ ID NO: 1783124 - protein, 6 aa, Staphylococcus epidermidis
KSHVRK

SEQ ID NO: 1783125 - protein, 4 aa, Staphylococcus epidermidis
KSIE

SEQ ID NO: 1783126 - protein, 23 aa, Staphylococcus epidermidis
KSIGHETFDTDASIDTAKNGDIV

SEQ ID NO: 1783127 - protein, 12 aa, Staphylococcus epidermidis
KSIHATSTKEIA

SEQ ID NO: 1783128 - protein, 6 aa, Staphylococcus epidermidis
KSIQNH

SEQ ID NO: 1783129 - protein, 6 aa, Staphylococcus epidermidis
KSIQRN

SEQ ID NO: 1783130 - protein, 17 aa, Staphylococcus epidermidis
KSIQSSSTTYNDKESQI

SEQ ID NO: 1783131 - protein, 19 aa, Staphylococcus epidermidis
KSIRRGSANLKDSYAQVKR

SEQ ID NO: 1783132 - protein, 6 aa, Staphylococcus epidermidis
KSITEI

SEQ ID NO: 1783133 - protein, 14 aa, Staphylococcus epidermidis
KSITGENTDITGTE

SEQ ID NO: 1783134 - protein, 7 aa, Staphylococcus epidermidis
KSKERSL

SEQ ID NO: 1783135 - protein, 19 aa, Staphylococcus epidermidis
KSKGAKRDNVKSDDVGVTI

SEQ ID NO: 1783136 - protein, 5 aa, Staphylococcus epidermidis
KSKGD

SEQ ID NO: 1783137 - protein, 17 aa, Staphylococcus epidermidis
KSKGENQNITDLPNEKY

SEQ ID NO: 1783138 - protein, 15 aa, Staphylococcus epidermidis
KSKGIDRVNSKAISE

SEQ ID NO: 1783139 - protein, 7 aa, Staphylococcus epidermidis
KSKGTFD

SEQ ID NO: 1783140 - protein, 10 aa, Staphylococcus epidermidis
KSKHNDSSEY

SEQ ID NO: 1783141 - protein, 9 aa, Staphylococcus epidermidis
KSKKANAPK

SEQ ID NO: 1783142 - protein, 18 aa, Staphylococcus epidermidis
KSKKVSSRSGMSLTRDTS

SEQ ID NO: 1783143 - protein, 7 aa, Staphylococcus epidermidis
KSKNLRE

SEQ ID NO: 1783144 - protein, 16 aa, Staphylococcus epidermidis
KSKNVTMRNDPDGRSR

SEQ ID NO: 1783145 - protein, 9 aa, Staphylococcus epidermidis
KSKQQEENK

SEQ ID NO: 1783146 - protein, 10 aa, Staphylococcus epidermidis
KSKSASMTTS

SEQ ID NO: 1783147 - protein, 8 aa, Staphylococcus epidermidis
KSKSEIRE

SEQ ID NO: 1783148 - protein, 7 aa, Staphylococcus epidermidis
KSKSKYF

SEQ ID NO: 1783149 - protein, 8 aa, Staphylococcus epidermidis
KSKSNTVF

SEQ ID NO: 1783150 - protein, 11 aa, Staphylococcus epidermidis
KSKSPTLNQLP

SEQ ID NO: 1783151 - protein, 4 aa, Staphylococcus epidermidis
KSKT

SEQ ID NO: 1783152 - protein, 9 aa, Staphylococcus epidermidis
KSKTPERIR

SEQ ID NO: 1783153 - protein, 18 aa, Staphylococcus epidermidis
KSKYPFKYDDNDKTFCKP

SEQ ID NO: 1783154 - protein, 4 aa, Staphylococcus epidermidis
KSLA

SEQ ID NO: 1783155 - protein, 9 aa, Staphylococcus epidermidis
KSLAEEKSL

SEQ ID NO: 1783156 - protein, 20 aa, Staphylococcus epidermidis
KSLDEKQESISNDQQEIKSP

SEQ ID NO: 1783157 - protein, 11 aa, Staphylococcus epidermidis
KSLETSDDVQQ

SEQ ID NO: 1783158 - protein, 10 aa, Staphylococcus epidermidis
KSLIEKADGK

SEQ ID NO: 1783159 - protein, 4 aa, Staphylococcus epidermidis
KSLN

SEQ ID NO: 1783160 - protein, 8 aa, Staphylococcus epidermidis
KSLNPRGV

SEQ ID NO: 1783161 - protein, 11 aa, Staphylococcus epidermidis
KSLNSTVEESL

SEQ ID NO: 1783162 - protein, 7 aa, Staphylococcus epidermidis
KSLPSNV

SEQ ID NO: 1783163 - protein, 65 aa, Staphylococcus epidermidis
KSLQQNIQAETGFRASVSKAGKVTIDQSKKIKQNTAETRRNSSAKLQNADASDQASEENKELADS

SEQ ID NO: 1783164 - protein, 4 aa, Staphylococcus epidermidis
KSLS

SEQ ID NO: 1783165 - protein, 7 aa, Staphylococcus epidermidis
KSLSDEP

SEQ ID NO: 1783166 - protein, 13 aa, Staphylococcus epidermidis
KSLSGKELKEGFK

SEQ ID NO: 1783167 - protein, 6 aa, Staphylococcus epidermidis
KSLSLT

SEQ ID NO: 1783168 - protein, 10 aa, Staphylococcus epidermidis
KSLTDQVKAG

SEQ ID NO: 1783169 - protein, 5 aa, Staphylococcus epidermidis
KSMGK

SEQ ID NO: 1783170 - protein, 6 aa, Staphylococcus epidermidis
KSMKRH

SEQ ID NO: 1783171 - protein, 4 aa, Staphylococcus epidermidis
KSMP

SEQ ID NO: 1783172 - protein, 10 aa, Staphylococcus epidermidis
KSNAEGYSEG

SEQ ID NO: 1783173 - protein, 9 aa, Staphylococcus epidermidis
KSNAVYSAT

SEQ ID NO: 1783174 - protein, 12 aa, Staphylococcus epidermidis
KSNCNSSKNKKL

SEQ ID NO: 1783175 - protein, 7 aa, Staphylococcus epidermidis
KSNDKNV

SEQ ID NO: 1783176 - protein, 6 aa, Staphylococcus epidermidis
KSNDTV

SEQ ID NO: 1783177 - protein, 8 aa, Staphylococcus epidermidis
KSNEDTAH

SEQ ID NO: 1783178 - protein, 11 aa, Staphylococcus epidermidis
KSNEEPPSQDM

SEQ ID NO: 1783179 - protein, 4 aa, Staphylococcus epidermidis
KSNK

SEQ ID NO: 1783180 - protein, 52 aa, Staphylococcus epidermidis
KSNKKDTYEEEPEAPHEETYEDRVNQHEDEHHQSEGKEKEEGKFKKLMKSLF

SEQ ID NO: 1783181 - protein, 10 aa, Staphylococcus epidermidis
KSNKSDPAKD

SEQ ID NO: 1783182 - protein, 52 aa, Staphylococcus epidermidis
KSNKSDPAKDLRSMQAQTQANTKTTQDLQKKTDDIKKRLESAHAKSVTTANG

SEQ ID NO: 1783183 - protein, 6 aa, Staphylococcus epidermidis
KSNLSS

SEQ ID NO: 1783184 - protein, 7 aa, Staphylococcus epidermidis
KSNLTKE

SEQ ID NO: 1783185 - protein, 6 aa, Staphylococcus epidermidis
KSNPIV

SEQ ID NO: 1783186 - protein, 4 aa, Staphylococcus epidermidis
KSNQ

SEQ ID NO: 1783187 - protein, 7 aa, Staphylococcus epidermidis
KSNQKKI

SEQ ID NO: 1783188 - protein, 6 aa, Staphylococcus epidermidis
KSNTIR

SEQ ID NO: 1783189 - protein, 7 aa, Staphylococcus epidermidis
KSPADIQ

SEQ ID NO: 1783190 - protein, 8 aa, Staphylococcus epidermidis
KSPHPDAD

SEQ ID NO: 1783191 - protein, 5 aa, Staphylococcus epidermidis
KSPHS

SEQ ID NO: 1783192 - protein, 15 aa, Staphylococcus epidermidis
KSPMSYSKKMKSKQK

SEQ ID NO: 1783193 - protein, 12 aa, Staphylococcus epidermidis
KSPNDDNGYDIS

SEQ ID NO: 1783194 - protein, 6 aa, Staphylococcus epidermidis
KSPNLL

SEQ ID NO: 1783195 - protein, 10 aa, Staphylococcus epidermidis
KSPSPEEDAY

SEQ ID NO: 1783196 - protein, 17 aa, Staphylococcus epidermidis
KSPYYKQYGKSEAPTIY

SEQ ID NO: 1783197 - protein, 13 aa, Staphylococcus epidermidis
KSQHKIKEDYHSY

SEQ ID NO: 1783198 - protein, 13 aa, Staphylococcus epidermidis
KSQIPVGKNKDGQ

SEQ ID NO: 1783199 - protein, 7 aa, Staphylococcus epidermidis
KSQKQEY

SEQ ID NO: 1783200 - protein, 6 aa, Staphylococcus epidermidis
KSQKVR

SEQ ID NO: 1783201 - protein, 6 aa, Staphylococcus epidermidis
KSQMPD

SEQ ID NO: 1783202 - protein, 4 aa, Staphylococcus epidermidis
KSQR

SEQ ID NO: 1783203 - protein, 10 aa, Staphylococcus epidermidis
KSQRKPDRKM

SEQ ID NO: 1783204 - protein, 6 aa, Staphylococcus epidermidis
KSQSIR

SEQ ID NO: 1783205 - protein, 10 aa, Staphylococcus epidermidis
KSQSNQKKLS

SEQ ID NO: 1783206 - protein, 5 aa, Staphylococcus epidermidis
KSQST

SEQ ID NO: 1783207 - protein, 9 aa, Staphylococcus epidermidis
KSQTPQRIK

SEQ ID NO: 1783208 - protein, 5 aa, Staphylococcus epidermidis
KSQYI

SEQ ID NO: 1783209 - protein, 8 aa, Staphylococcus epidermidis
KSQYPETE

SEQ ID NO: 1783210 - protein, 17 aa, Staphylococcus epidermidis
KSRGEHKGKVEGEVKSI

SEQ ID NO: 1783211 - protein, 14 aa, Staphylococcus epidermidis
KSRHPYSQLLINSM

SEQ ID NO: 1783212 - protein, 7 aa, Staphylococcus epidermidis
KSRIPEW

SEQ ID NO: 1783213 - protein, 8 aa, Staphylococcus epidermidis
KSRKGLSN

SEQ ID NO: 1783214 - protein, 4 aa, Staphylococcus epidermidis
KSRN

SEQ ID NO: 1783215 - protein, 7 aa, Staphylococcus epidermidis
KSRPSTQ

SEQ ID NO: 1783216 - protein, 14 aa, Staphylococcus epidermidis
KSRQYISREKTPRW

SEQ ID NO: 1783217 - protein, 8 aa, Staphylococcus epidermidis
KSRSTRKK

SEQ ID NO: 1783218 - protein, 8 aa, Staphylococcus epidermidis
KSSAYLGT

SEQ ID NO: 1783219 - protein, 7 aa, Staphylococcus epidermidis
KSSDIKP

SEQ ID NO: 1783220 - protein, 8 aa, Staphylococcus epidermidis
KSSDQTLE

SEQ ID NO: 1783221 - protein, 6 aa, Staphylococcus epidermidis
KSSDRI

SEQ ID NO: 1783222 - protein, 8 aa, Staphylococcus epidermidis
KSSEKQLD

SEQ ID NO: 1783223 - protein, 15 aa, Staphylococcus epidermidis
KSSEPEEGLPLALLK

SEQ ID NO: 1783224 - protein, 5 aa, Staphylococcus epidermidis
KSSFK

SEQ ID NO: 1783225 - protein, 19 aa, Staphylococcus epidermidis
KSSFKQTRALYGKENGVQA

SEQ ID NO: 1783226 - protein, 10 aa, Staphylococcus epidermidis
KSSGLTQTKG

SEQ ID NO: 1783227 - protein, 18 aa, Staphylococcus epidermidis
KSSINTKNPLYDDIDPIG

SEQ ID NO: 1783228 - protein, 9 aa, Staphylococcus epidermidis
KSSKASAKR

SEQ ID NO: 1783229 - protein, 9 aa, Staphylococcus epidermidis
KSSKDSPKR

SEQ ID NO: 1783230 - protein, 7 aa, Staphylococcus epidermidis
KSSKVPP

SEQ ID NO: 1783231 - protein, 29 aa, Staphylococcus epidermidis
KSSNKNNSYSKNDSKSSHKNAISRSDKEI

SEQ ID NO: 1783232 - protein, 7 aa, Staphylococcus epidermidis
KSSNSTI

SEQ ID NO: 1783233 - protein, 7 aa, Staphylococcus epidermidis
KSSPEAI

SEQ ID NO: 1783234 - protein, 13 aa, Staphylococcus epidermidis
KSSRKSRENRDNW

SEQ ID NO: 1783235 - protein, 7 aa, Staphylococcus epidermidis
KSSRPLT

SEQ ID NO: 1783236 - protein, 15 aa, Staphylococcus epidermidis
KSSSFKSKMASYEAS

SEQ ID NO: 1783237 - protein, 12 aa, Staphylococcus epidermidis
KSSSRVNKRRSV

SEQ ID NO: 1783238 - protein, 9 aa, Staphylococcus epidermidis
KSSTSSATL

SEQ ID NO: 1783239 - protein, 7 aa, Staphylococcus epidermidis
KSSVKAQ

SEQ ID NO: 1783240 - protein, 11 aa, Staphylococcus epidermidis
KSTAESYLGDT

SEQ ID NO: 1783241 - protein, 12 aa, Staphylococcus epidermidis
KSTDKPLKGREL

SEQ ID NO: 1783242 - protein, 7 aa, Staphylococcus epidermidis
KSTDLDE

SEQ ID NO: 1783243 - protein, 6 aa, Staphylococcus epidermidis
KSTEQE

SEQ ID NO: 1783244 - protein, 7 aa, Staphylococcus epidermidis
KSTGKSM

SEQ ID NO: 1783245 - protein, 5 aa, Staphylococcus epidermidis
KSTNE

SEQ ID NO: 1783246 - protein, 6 aa, Staphylococcus epidermidis
KSTPEL

SEQ ID NO: 1783247 - protein, 7 aa, Staphylococcus epidermidis
KSTPIDN

SEQ ID NO: 1783248 - protein, 8 aa, Staphylococcus epidermidis
KSTQIKDE

SEQ ID NO: 1783249 - protein, 5 aa, Staphylococcus epidermidis
KSTQL

SEQ ID NO: 1783250 - protein, 8 aa, Staphylococcus epidermidis
KSTREAER

SEQ ID NO: 1783251 - protein, 9 aa, Staphylococcus epidermidis
KSTREISEE

SEQ ID NO: 1783252 - protein, 5 aa, Staphylococcus epidermidis
KSTRH

SEQ ID NO: 1783253 - protein, 6 aa, Staphylococcus epidermidis
KSTRLE

SEQ ID NO: 1783254 - protein, 21 aa, Staphylococcus epidermidis
KSVGNKKPSKSKTRVTTPYRR

SEQ ID NO: 1783255 - protein, 18 aa, Staphylococcus epidermidis
KSVKDTDTKKGKSKPKTI

SEQ ID NO: 1783256 - protein, 18 aa, Staphylococcus epidermidis
KSVPHLSEDDFSDEKHAK

SEQ ID NO: 1783257 - protein, 23 aa, Staphylococcus epidermidis
KSVSNFRGGMPSEGGFGVTVAEL

SEQ ID NO: 1783258 - protein, 7 aa, Staphylococcus epidermidis
KSVTNTQ

SEQ ID NO: 1783259 - protein, 6 aa, Staphylococcus epidermidis
KSYDKV

SEQ ID NO: 1783260 - protein, 12 aa, Staphylococcus epidermidis
KSYEQIKQESLN

SEQ ID NO: 1783261 - protein, 13 aa, Staphylococcus epidermidis
KSYFDTNENAKSL

SEQ ID NO: 1783262 - protein, 6 aa, Staphylococcus epidermidis
KSYNDI

SEQ ID NO: 1783263 - protein, 7 aa, Staphylococcus epidermidis
KSYNQSE

SEQ ID NO: 1783264 - protein, 7 aa, Staphylococcus epidermidis
KSYTSNL

SEQ ID NO: 1783265 - protein, 11 aa, Staphylococcus epidermidis
KTAFDGRGNYT

SEQ ID NO: 1783266 - protein, 11 aa, Staphylococcus epidermidis
KTAIDDVSQEK

SEQ ID NO: 1783267 - protein, 14 aa, Staphylococcus epidermidis
KTAQEHLADKEGTT

SEQ ID NO: 1783268 - protein, 9 aa, Staphylococcus epidermidis
KTAQNKEGA

SEQ ID NO: 1783269 - protein, 7 aa, Staphylococcus epidermidis
KTDEGLD

SEQ ID NO: 1783270 - protein, 6 aa, Staphylococcus epidermidis
KTDIDE

SEQ ID NO: 1783271 - protein, 12 aa, Staphylococcus epidermidis
KTDITNKQISTH

SEQ ID NO: 1783272 - protein, 17 aa, Staphylococcus epidermidis
KTDKGKTRKCFISEFLE

SEQ ID NO: 1783273 - protein, 12 aa, Staphylococcus epidermidis
KTDKTEEAINES

SEQ ID NO: 1783274 - protein, 6 aa, Staphylococcus epidermidis
KTDMIT

SEQ ID NO: 1783275 - protein, 7 aa, Staphylococcus epidermidis
KTDNSLK

SEQ ID NO: 1783276 - protein, 4 aa, Staphylococcus epidermidis
KTDS

SEQ ID NO: 1783277 - protein, 5 aa, Staphylococcus epidermidis
KTDSL

SEQ ID NO: 1783278 - protein, 10 aa, Staphylococcus epidermidis
KTDSQENNIY

SEQ ID NO: 1783279 - protein, 5 aa, Staphylococcus epidermidis
KTDTQ

SEQ ID NO: 1783280 - protein, 11 aa, Staphylococcus epidermidis
KTDVNGENEHP

SEQ ID NO: 1783281 - protein, 47 aa, Staphylococcus epidermidis
KTEEAAALKAQQELKKDAENVKNDSTTKPSSYMNQKQQKRDQRKIER

SEQ ID NO: 1783282 - protein, 10 aa, Staphylococcus epidermidis
KTEKNPNNKN

SEQ ID NO: 1783283 - protein, 6 aa, Staphylococcus epidermidis
KTENGA

SEQ ID NO: 1783284 - protein, 6 aa, Staphylococcus epidermidis
KTESDG

SEQ ID NO: 1783285 - protein, 12 aa, Staphylococcus epidermidis
KTFKTSDNLGQK

SEQ ID NO: 1783286 - protein, 4 aa, Staphylococcus epidermidis
KTGD

SEQ ID NO: 1783287 - protein, 8 aa, Staphylococcus epidermidis
KTGDKGRF

SEQ ID NO: 1783288 - protein, 7 aa, Staphylococcus epidermidis
KTGDTTL

SEQ ID NO: 1783289 - protein, 6 aa, Staphylococcus epidermidis
KTGEFG

SEQ ID NO: 1783290 - protein, 15 aa, Staphylococcus epidermidis
KTGERPVLYKAIDGY

SEQ ID NO: 1783291 - protein, 6 aa, Staphylococcus epidermidis
KTGFTA

SEQ ID NO: 1783292 - protein, 6 aa, Staphylococcus epidermidis
KTGKAL

SEQ ID NO: 1783293 - protein, 9 aa, Staphylococcus epidermidis
KTGKGVSGI

SEQ ID NO: 1783294 - protein, 10 aa, Staphylococcus epidermidis
KTGKKSSNIN

SEQ ID NO: 1783295 - protein, 7 aa, Staphylococcus epidermidis
KTGLSEE

SEQ ID NO: 1783296 - protein, 7 aa, Staphylococcus epidermidis
KTGMTKE

SEQ ID NO: 1783297 - protein, 12 aa, Staphylococcus epidermidis
KTGRNPKTNKNL

SEQ ID NO: 1783298 - protein, 12 aa, Staphylococcus epidermidis
KTGTYQIPNDPM

SEQ ID NO: 1783299 - protein, 6 aa, Staphylococcus epidermidis
KTHERG

SEQ ID NO: 1783300 - protein, 10 aa, Staphylococcus epidermidis
KTHNKQGEPY

SEQ ID NO: 1783301 - protein, 8 aa, Staphylococcus epidermidis
KTHNSKQL

SEQ ID NO: 1783302 - protein, 6 aa, Staphylococcus epidermidis
KTHPDI

SEQ ID NO: 1783303 - protein, 6 aa, Staphylococcus epidermidis
KTHPHV

SEQ ID NO: 1783304 - protein, 8 aa, Staphylococcus epidermidis
KTHSSHAN

SEQ ID NO: 1783305 - protein, 6 aa, Staphylococcus epidermidis
KTHYTK

SEQ ID NO: 1783306 - protein, 6 aa, Staphylococcus epidermidis
KTIDEL

SEQ ID NO: 1783307 - protein, 6 aa, Staphylococcus epidermidis
KTIDKL

SEQ ID NO: 1783308 - protein, 6 aa, Staphylococcus epidermidis
KTIEDQ

SEQ ID NO: 1783309 - protein, 12 aa, Staphylococcus epidermidis
KTIEETSQNAVN

SEQ ID NO: 1783310 - protein, 6 aa, Staphylococcus epidermidis
KTIENE

SEQ ID NO: 1783311 - protein, 12 aa, Staphylococcus epidermidis
KTIKASKEAGSK

SEQ ID NO: 1783312 - protein, 14 aa, Staphylococcus epidermidis
KTIKEVQKETGIKG

SEQ ID NO: 1783313 - protein, 28 aa, Staphylococcus epidermidis
KTINEKYKSDIKKSIDKFESEVDKNSSA

SEQ ID NO: 1783314 - protein, 7 aa, Staphylococcus epidermidis
KTIPMDE

SEQ ID NO: 1783315 - protein, 5 aa, Staphylococcus epidermidis
KTIPR

SEQ ID NO: 1783316 - protein, 13 aa, Staphylococcus epidermidis
KTISTNKDLSAFI

SEQ ID NO: 1783317 - protein, 6 aa, Staphylococcus epidermidis
KTITPR

SEQ ID NO: 1783318 - protein, 5 aa, Staphylococcus epidermidis
KTITR

SEQ ID NO: 1783319 - protein, 7 aa, Staphylococcus epidermidis
KTKANTI

SEQ ID NO: 1783320 - protein, 16 aa, Staphylococcus epidermidis
KTKGEKEEQPETTKLT

SEQ ID NO: 1783321 - protein, 10 aa, Staphylococcus epidermidis
KTKGQSSTLQ

SEQ ID NO: 1783322 - protein, 10 aa, Staphylococcus epidermidis
KTKKGPEVKV

SEQ ID NO: 1783323 - protein, 11 aa, Staphylococcus epidermidis
KTKKHSLDESI

SEQ ID NO: 1783324 - protein, 11 aa, Staphylococcus epidermidis
KTKKQSFGFSE

SEQ ID NO: 1783325 - protein, 9 aa, Staphylococcus epidermidis
KTKKYKSDI

SEQ ID NO: 1783326 - protein, 16 aa, Staphylococcus epidermidis
KTKLEESGITNGTEEI

SEQ ID NO: 1783327 - protein, 16 aa, Staphylococcus epidermidis
KTKMKKPELLAPAGNL

SEQ ID NO: 1783328 - protein, 7 aa, Staphylococcus epidermidis
KTKNSQL

SEQ ID NO: 1783329 - protein, 8 aa, Staphylococcus epidermidis
KTKPGIDK

SEQ ID NO: 1783330 - protein, 8 aa, Staphylococcus epidermidis
KTKQAEFN

SEQ ID NO: 1783331 - protein, 6 aa, Staphylococcus epidermidis
KTKTPF

SEQ ID NO: 1783332 - protein, 15 aa, Staphylococcus epidermidis
KTKYKNKIPKWNDEK

SEQ ID NO: 1783333 - protein, 7 aa, Staphylococcus epidermidis
KTKYSTI

SEQ ID NO: 1783334 - protein, 14 aa, Staphylococcus epidermidis
KTLISTNGSGRTNE

SEQ ID NO: 1783335 - protein, 5 aa, Staphylococcus epidermidis
KTLNS

SEQ ID NO: 1783336 - protein, 6 aa, Staphylococcus epidermidis
KTLNSI

SEQ ID NO: 1783337 - protein, 10 aa, Staphylococcus epidermidis
KTLSGGQRQR

SEQ ID NO: 1783338 - protein, 5 aa, Staphylococcus epidermidis
KTLSN

SEQ ID NO: 1783339 - protein, 11 aa, Staphylococcus epidermidis
KTMEASKKAGI

SEQ ID NO: 1783340 - protein, 6 aa, Staphylococcus epidermidis
KTMQQE

SEQ ID NO: 1783341 - protein, 11 aa, Staphylococcus epidermidis
KTMSKEAKTIG

SEQ ID NO: 1783342 - protein, 4 aa, Staphylococcus epidermidis
KTNA

SEQ ID NO: 1783343 - protein, 9 aa, Staphylococcus epidermidis
KTNARTTEV

SEQ ID NO: 1783344 - protein, 9 aa, Staphylococcus epidermidis
KTNATVSKR

SEQ ID NO: 1783345 - protein, 5 aa, Staphylococcus epidermidis
KTNDD

SEQ ID NO: 1783346 - protein, 9 aa, Staphylococcus epidermidis
KTNGQTRLT

SEQ ID NO: 1783347 - protein, 9 aa, Staphylococcus epidermidis
KTNKSIVTK

SEQ ID NO: 1783348 - protein, 8 aa, Staphylococcus epidermidis
KTNKTKEL

SEQ ID NO: 1783349 - protein, 4 aa, Staphylococcus epidermidis
KTNL

SEQ ID NO: 1783350 - protein, 7 aa, Staphylococcus epidermidis
KTNMTQL

SEQ ID NO: 1783351 - protein, 7 aa, Staphylococcus epidermidis
KTNNVGG

SEQ ID NO: 1783352 - protein, 5 aa, Staphylococcus epidermidis
KTNRV

SEQ ID NO: 1783353 - protein, 8 aa, Staphylococcus epidermidis
KTNSRYTY

SEQ ID NO: 1783354 - protein, 5 aa, Staphylococcus epidermidis
KTNVN

SEQ ID NO: 1783355 - protein, 7 aa, Staphylococcus epidermidis
KTPAENI

SEQ ID NO: 1783356 - protein, 20 aa, Staphylococcus epidermidis
KTPDGKTMRVTQGKKGTDDD

SEQ ID NO: 1783357 - protein, 5 aa, Staphylococcus epidermidis
KTPDI

SEQ ID NO: 1783358 - protein, 7 aa, Staphylococcus epidermidis
KTPKYSV

SEQ ID NO: 1783359 - protein, 17 aa, Staphylococcus epidermidis
KTPRDKSSSYYSYYGEE

SEQ ID NO: 1783360 - protein, 7 aa, Staphylococcus epidermidis
KTPRDVE

SEQ ID NO: 1783361 - protein, 10 aa, Staphylococcus epidermidis
KTPVKYASRE

SEQ ID NO: 1783362 - protein, 5 aa, Staphylococcus epidermidis
KTPVN

SEQ ID NO: 1783363 - protein, 6 aa, Staphylococcus epidermidis
KTQEHD

SEQ ID NO: 1783364 - protein, 9 aa, Staphylococcus epidermidis
KTQEQDDFD

SEQ ID NO: 1783365 - protein, 4 aa, Staphylococcus epidermidis
KTQF

SEQ ID NO: 1783366 - protein, 18 aa, Staphylococcus epidermidis
KTQLTDQTDKARKEENAA

SEQ ID NO: 1783367 - protein, 7 aa, Staphylococcus epidermidis
KTQYNEN

SEQ ID NO: 1783368 - protein, 7 aa, Staphylococcus epidermidis
KTRDKSQ

SEQ ID NO: 1783369 - protein, 9 aa, Staphylococcus epidermidis
KTREEGNEV

SEQ ID NO: 1783370 - protein, 6 aa, Staphylococcus epidermidis
KTREHE

SEQ ID NO: 1783371 - protein, 4 aa, Staphylococcus epidermidis
KTRG

SEQ ID NO: 1783372 - protein, 8 aa, Staphylococcus epidermidis
KTRGMTTR

SEQ ID NO: 1783373 - protein, 27 aa, Staphylococcus epidermidis
KTRKAEARSKGEYVSPNERKARKNGMT

SEQ ID NO: 1783374 - protein, 5 aa, Staphylococcus epidermidis
KTRKE

SEQ ID NO: 1783375 - protein, 8 aa, Staphylococcus epidermidis
KTRKESPF

SEQ ID NO: 1783376 - protein, 7 aa, Staphylococcus epidermidis
KTRTQLK

SEQ ID NO: 1783377 - protein, 15 aa, Staphylococcus epidermidis
KTRVNRKHRDRGDQE

SEQ ID NO: 1783378 - protein, 6 aa, Staphylococcus epidermidis
KTSERI

SEQ ID NO: 1783379 - protein, 7 aa, Staphylococcus epidermidis
KTSFNNA

SEQ ID NO: 1783380 - protein, 14 aa, Staphylococcus epidermidis
KTSGSKQSTIKTKK

SEQ ID NO: 1783381 - protein, 18 aa, Staphylococcus epidermidis
KTSKSKQKYGQKELKQNT

SEQ ID NO: 1783382 - protein, 6 aa, Staphylococcus epidermidis
KTSLKA

SEQ ID NO: 1783383 - protein, 8 aa, Staphylococcus epidermidis
KTSQLDQQ

SEQ ID NO: 1783384 - protein, 7 aa, Staphylococcus epidermidis
KTSQTLK

SEQ ID NO: 1783385 - protein, 8 aa, Staphylococcus epidermidis
KTSQTTGT

SEQ ID NO: 1783386 - protein, 12 aa, Staphylococcus epidermidis
KTSVSTASGKYP

SEQ ID NO: 1783387 - protein, 6 aa, Staphylococcus epidermidis
KTTENK

SEQ ID NO: 1783388 - protein, 7 aa, Staphylococcus epidermidis
KTTGTDA

SEQ ID NO: 1783389 - protein, 11 aa, Staphylococcus epidermidis
KTTNASAVTTP

SEQ ID NO: 1783390 - protein, 16 aa, Staphylococcus epidermidis
KTTPNRIYSSNDSKFR

SEQ ID NO: 1783391 - protein, 6 aa, Staphylococcus epidermidis
KTTTDG

SEQ ID NO: 1783392 - protein, 17 aa, Staphylococcus epidermidis
KTTTGISAHERTKTARA

SEQ ID NO: 1783393 - protein, 7 aa, Staphylococcus epidermidis
KTVEKGL

SEQ ID NO: 1783394 - protein, 13 aa, Staphylococcus epidermidis
KTVISSGLETARE

SEQ ID NO: 1783395 - protein, 6 aa, Staphylococcus epidermidis
KTVKDN

SEQ ID NO: 1783396 - protein, 7 aa, Staphylococcus epidermidis
KTVKENM

SEQ ID NO: 1783397 - protein, 6 aa, Staphylococcus epidermidis
KTVQTL

SEQ ID NO: 1783398 - protein, 18 aa, Staphylococcus epidermidis
KTVTTRKATNKYNGKRVP

SEQ ID NO: 1783399 - protein, 6 aa, Staphylococcus epidermidis
KTYDEV

SEQ ID NO: 1783400 - protein, 11 aa, Staphylococcus epidermidis
KTYDKVQKENI

SEQ ID NO: 1783401 - protein, 5 aa, Staphylococcus epidermidis
KTYED

SEQ ID NO: 1783402 - protein, 4 aa, Staphylococcus epidermidis
KTYG

SEQ ID NO: 1783403 - protein, 6 aa, Staphylococcus epidermidis
KTYHHS

SEQ ID NO: 1783404 - protein, 10 aa, Staphylococcus epidermidis
KTYKNDTVTQ

SEQ ID NO: 1783405 - protein, 9 aa, Staphylococcus epidermidis
KTYNAEAYK

SEQ ID NO: 1783406 - protein, 16 aa, Staphylococcus epidermidis
KTYTEKDKKSQIEVRQ

SEQ ID NO: 1783407 - protein, 5 aa, Staphylococcus epidermidis
KTYTS

SEQ ID NO: 1783408 - protein, 4 aa, Staphylococcus epidermidis
KTYY

SEQ ID NO: 1783409 - protein, 5 aa, Staphylococcus epidermidis
KVADA

SEQ ID NO: 1783410 - protein, 8 aa, Staphylococcus epidermidis
KVADASSL

SEQ ID NO: 1783411 - protein, 10 aa, Staphylococcus epidermidis
KVAEQSEPRE

SEQ ID NO: 1783412 - protein, 17 aa, Staphylococcus epidermidis
KVAKAGKDDVDKAVQAA

SEQ ID NO: 1783413 - protein, 5 aa, Staphylococcus epidermidis
KVANQ

SEQ ID NO: 1783414 - protein, 9 aa, Staphylococcus epidermidis
KVAQMTSKD

SEQ ID NO: 1783415 - protein, 8 aa, Staphylococcus epidermidis
KVATRRTK

SEQ ID NO: 1783416 - protein, 8 aa, Staphylococcus epidermidis
KVATRRTT

SEQ ID NO: 1783417 - protein, 5 aa, Staphylococcus epidermidis
KVDDY

SEQ ID NO: 1783418 - protein, 14 aa, Staphylococcus epidermidis
KVDEETVKGGIGNA

SEQ ID NO: 1783419 - protein, 8 aa, Staphylococcus epidermidis
KVDETTQS

SEQ ID NO: 1783420 - protein, 8 aa, Staphylococcus epidermidis
KVDKGQVK

SEQ ID NO: 1783421 - protein, 12 aa, Staphylococcus epidermidis
KVDMDKATDLQK

SEQ ID NO: 1783422 - protein, 5 aa, Staphylococcus epidermidis
KVDSD

SEQ ID NO: 1783423 - protein, 9 aa, Staphylococcus epidermidis
KVDSGQAIV

SEQ ID NO: 1783424 - protein, 4 aa, Staphylococcus epidermidis
KVED

SEQ ID NO: 1783425 - protein, 28 aa, Staphylococcus epidermidis
KVEESSAKLLSEDNISYQEAMNNDDYRP

SEQ ID NO: 1783426 - protein, 9 aa, Staphylococcus epidermidis
KVEETSGRL

SEQ ID NO: 1783427 - protein, 15 aa, Staphylococcus epidermidis
KVEKNNAKTKNPRLA

SEQ ID NO: 1783428 - protein, 11 aa, Staphylococcus epidermidis
KVEKSGTRKGV

SEQ ID NO: 1783429 - protein, 10 aa, Staphylococcus epidermidis
KVEQNGKSTS

SEQ ID NO: 1783430 - protein, 15 aa, Staphylococcus epidermidis
KVERRQQEVGQTDGL

SEQ ID NO: 1783431 - protein, 6 aa, Staphylococcus epidermidis
KVESKQ

SEQ ID NO: 1783432 - protein, 6 aa, Staphylococcus epidermidis
KVETED

SEQ ID NO: 1783433 - protein, 15 aa, Staphylococcus epidermidis
KVETYRRSSNFKKKD

SEQ ID NO: 1783434 - protein, 6 aa, Staphylococcus epidermidis
KVGAHG

SEQ ID NO: 1783435 - protein, 19 aa, Staphylococcus epidermidis
KVGEETKLAATKDAEATLA

SEQ ID NO: 1783436 - protein, 15 aa, Staphylococcus epidermidis
KVGEYSQKAMSQYEG

SEQ ID NO: 1783437 - protein, 10 aa, Staphylococcus epidermidis
KVGGSSEIGA

SEQ ID NO: 1783438 - protein, 6 aa, Staphylococcus epidermidis
KVGGTV

SEQ ID NO: 1783439 - protein, 28 aa, Staphylococcus epidermidis
KVKDDKDSTTKSKNKSKSSFSKSVNPFS

SEQ ID NO: 1783440 - protein, 6 aa, Staphylococcus epidermidis
KVKDKL

SEQ ID NO: 1783441 - protein, 8 aa, Staphylococcus epidermidis
KVKDSAHE

SEQ ID NO: 1783442 - protein, 9 aa, Staphylococcus epidermidis
KVKHKSKKY

SEQ ID NO: 1783443 - protein, 23 aa, Staphylococcus epidermidis
KVKKESSNDKPKTLSLRDRVASS

SEQ ID NO: 1783444 - protein, 4 aa, Staphylococcus epidermidis
KVKN

SEQ ID NO: 1783445 - protein, 12 aa, Staphylococcus epidermidis
KVKPGAKLSNIG

SEQ ID NO: 1783446 - protein, 8 aa, Staphylococcus epidermidis
KVKPGSTV

SEQ ID NO: 1783447 - protein, 41 aa, Staphylococcus epidermidis
KVKTEDAKQASDTFEKKQDAVQRANEIAENKNTKVIEHKKD

SEQ ID NO: 1783448 - protein, 7 aa, Staphylococcus epidermidis
KVKTSKH

SEQ ID NO: 1783449 - protein, 10 aa, Staphylococcus epidermidis
KVLAETSQRI

SEQ ID NO: 1783450 - protein, 5 aa, Staphylococcus epidermidis
KVLPQ

SEQ ID NO: 1783451 - protein, 10 aa, Staphylococcus epidermidis
KVNADEDTRL

SEQ ID NO: 1783452 - protein, 9 aa, Staphylococcus epidermidis
KVNDANPEV

SEQ ID NO: 1783453 - protein, 6 aa, Staphylococcus epidermidis
KVNEAE

SEQ ID NO: 1783454 - protein, 8 aa, Staphylococcus epidermidis
KVNIEGNG

SEQ ID NO: 1783455 - protein, 9 aa, Staphylococcus epidermidis
KVNNAAGQV

SEQ ID NO: 1783456 - protein, 9 aa, Staphylococcus epidermidis
KVNNDKNKH

SEQ ID NO: 1783457 - protein, 8 aa, Staphylococcus epidermidis
KVNNNELG

SEQ ID NO: 1783458 - protein, 7 aa, Staphylococcus epidermidis
KVNPQKD

SEQ ID NO: 1783459 - protein, 8 aa, Staphylococcus epidermidis
KVNPSSEI

SEQ ID NO: 1783460 - protein, 8 aa, Staphylococcus epidermidis
KVNQAKTA

SEQ ID NO: 1783461 - protein, 4 aa, Staphylococcus epidermidis
KVNR

SEQ ID NO: 1783462 - protein, 12 aa, Staphylococcus epidermidis
KVNRTTNGHGRV

SEQ ID NO: 1783463 - protein, 7 aa, Staphylococcus epidermidis
KVPGEGH

SEQ ID NO: 1783464 - protein, 10 aa, Staphylococcus epidermidis
KVPSSQTEKL

SEQ ID NO: 1783465 - protein, 4 aa, Staphylococcus epidermidis
KVPY

SEQ ID NO: 1783466 - protein, 9 aa, Staphylococcus epidermidis
KVQHSENQM

SEQ ID NO: 1783467 - protein, 9 aa, Staphylococcus epidermidis
KVQNEYQDK

SEQ ID NO: 1783468 - protein, 4 aa, Staphylococcus epidermidis
KVRE

SEQ ID NO: 1783469 - protein, 9 aa, Staphylococcus epidermidis
KVREENGTI

SEQ ID NO: 1783470 - protein, 6 aa, Staphylococcus epidermidis
KVREGS

SEQ ID NO: 1783471 - protein, 9 aa, Staphylococcus epidermidis
KVRIEGSKN

SEQ ID NO: 1783472 - protein, 22 aa, Staphylococcus epidermidis
KVRSKSKRKVKPGYKKKFKQEV

SEQ ID NO: 1783473 - protein, 46 aa, Staphylococcus epidermidis
KVRSKSKRKVKPGYKKKFKQEVEKMKRQERKLYSKRQNRQKRKNNK

SEQ ID NO: 1783474 - protein, 24 aa, Staphylococcus epidermidis
KVRTTKDDLHGERKLDNDKHTQTY

SEQ ID NO: 1783475 - protein, 12 aa, Staphylococcus epidermidis
KVSGRKIKRSEL

SEQ ID NO: 1783476 - protein, 12 aa, Staphylococcus epidermidis
KVSGRKTKRSEL

SEQ ID NO: 1783477 - protein, 4 aa, Staphylococcus epidermidis
KVSH

SEQ ID NO: 1783478 - protein, 15 aa, Staphylococcus epidermidis
KVSIPESNPFKLNTM

SEQ ID NO: 1783479 - protein, 14 aa, Staphylococcus epidermidis
KVSLNSSALKNPEL

SEQ ID NO: 1783480 - protein, 7 aa, Staphylococcus epidermidis
KVSNERK

SEQ ID NO: 1783481 - protein, 8 aa, Staphylococcus epidermidis
KVSSKTNR

SEQ ID NO: 1783482 - protein, 5 aa, Staphylococcus epidermidis
KVTED

SEQ ID NO: 1783483 - protein, 10 aa, Staphylococcus epidermidis
KVTESNAIHP

SEQ ID NO: 1783484 - protein, 26 aa, Staphylococcus epidermidis
KVTGWSPAPEETSSALRDYNTRISSA

SEQ ID NO: 1783485 - protein, 5 aa, Staphylococcus epidermidis
KVTKI

SEQ ID NO: 1783486 - protein, 7 aa, Staphylococcus epidermidis
KVTNAEI

SEQ ID NO: 1783487 - protein, 10 aa, Staphylococcus epidermidis
KVTNSVTKST

SEQ ID NO: 1783488 - protein, 7 aa, Staphylococcus epidermidis
KVYKSSE

SEQ ID NO: 1783489 - protein, 4 aa, Staphylococcus epidermidis
KWDS

SEQ ID NO: 1783490 - protein, 6 aa, Staphylococcus epidermidis
KWESTK

SEQ ID NO: 1783491 - protein, 12 aa, Staphylococcus epidermidis
KWGDRNSSEDSI

SEQ ID NO: 1783492 - protein, 15 aa, Staphylococcus epidermidis
KWNRSDYVFPGKQSD

SEQ ID NO: 1783493 - protein, 10 aa, Staphylococcus epidermidis
KWTENQPPQG

SEQ ID NO: 1783494 - protein, 5 aa, Staphylococcus epidermidis
KWTQK

SEQ ID NO: 1783495 - protein, 9 aa, Staphylococcus epidermidis
KYADDLGPL

SEQ ID NO: 1783496 - protein, 5 aa, Staphylococcus epidermidis
KYADT

SEQ ID NO: 1783497 - protein, 7 aa, Staphylococcus epidermidis
KYAEERE

SEQ ID NO: 1783498 - protein, 5 aa, Staphylococcus epidermidis
KYAKT

SEQ ID NO: 1783499 - protein, 4 aa, Staphylococcus epidermidis
KYAR

SEQ ID NO: 1783500 - protein, 10 aa, Staphylococcus epidermidis
KYASNTSKKA

SEQ ID NO: 1783501 - protein, 7 aa, Staphylococcus epidermidis
KYEDGEL

SEQ ID NO: 1783502 - protein, 16 aa, Staphylococcus epidermidis
KYEESNVDQFKSPLAK

SEQ ID NO: 1783503 - protein, 9 aa, Staphylococcus epidermidis
KYEESTIPA

SEQ ID NO: 1783504 - protein, 8 aa, Staphylococcus epidermidis
KYEKDDSD

SEQ ID NO: 1783505 - protein, 6 aa, Staphylococcus epidermidis
KYEKQL

SEQ ID NO: 1783506 - protein, 7 aa, Staphylococcus epidermidis
KYENESV

SEQ ID NO: 1783507 - protein, 9 aa, Staphylococcus epidermidis
KYENTKSFY

SEQ ID NO: 1783508 - protein, 5 aa, Staphylococcus epidermidis
KYEPL

SEQ ID NO: 1783509 - protein, 20 aa, Staphylococcus epidermidis
KYERQIKEQGIELGKDYPKQ

SEQ ID NO: 1783510 - protein, 4 aa, Staphylococcus epidermidis
KYGD

SEQ ID NO: 1783511 - protein, 6 aa, Staphylococcus epidermidis
KYGDLG

SEQ ID NO: 1783512 - protein, 8 aa, Staphylococcus epidermidis
KYGKSAMK

SEQ ID NO: 1783513 - protein, 10 aa, Staphylococcus epidermidis
KYGQPGSQVN

SEQ ID NO: 1783514 - protein, 13 aa, Staphylococcus epidermidis
KYGSEKQESVEKD

SEQ ID NO: 1783515 - protein, 13 aa, Staphylococcus epidermidis
KYIDTRDKNRHGI

SEQ ID NO: 1783516 - protein, 15 aa, Staphylococcus epidermidis
KYISRSPYKNGVEDL

SEQ ID NO: 1783517 - protein, 5 aa, Staphylococcus epidermidis
KYKDE

SEQ ID NO: 1783518 - protein, 40 aa, Staphylococcus epidermidis
KYKDGDGYKSYNEVTKKDRKALSDAVNSLGEPLSKMAVVT

SEQ ID NO: 1783519 - protein, 18 aa, Staphylococcus epidermidis
KYKDGRISSNPNVPSYEA

SEQ ID NO: 1783520 - protein, 17 aa, Staphylococcus epidermidis
KYKDKRKELEELESADQ

SEQ ID NO: 1783521 - protein, 13 aa, Staphylococcus epidermidis
KYKDTSTSSSTKL

SEQ ID NO: 1783522 - protein, 8 aa, Staphylococcus epidermidis
KYKGEAYY

SEQ ID NO: 1783523 - protein, 13 aa, Staphylococcus epidermidis
KYKNSGKIEQKKT

SEQ ID NO: 1783524 - protein, 7 aa, Staphylococcus epidermidis
KYKPSDF

SEQ ID NO: 1783525 - protein, 9 aa, Staphylococcus epidermidis
KYKQADGVR

SEQ ID NO: 1783526 - protein, 13 aa, Staphylococcus epidermidis
KYKSNPSATNSGY

SEQ ID NO: 1783527 - protein, 9 aa, Staphylococcus epidermidis
KYKTMPTPY

SEQ ID NO: 1783528 - protein, 9 aa, Staphylococcus epidermidis
KYLDQSRRK

SEQ ID NO: 1783529 - protein, 16 aa, Staphylococcus epidermidis
KYLNEDPKYQQPYDQT

SEQ ID NO: 1783530 - protein, 5 aa, Staphylococcus epidermidis
KYNDV

SEQ ID NO: 1783531 - protein, 8 aa, Staphylococcus epidermidis
KYNERQKM

SEQ ID NO: 1783532 - protein, 12 aa, Staphylococcus epidermidis
KYNGVYPGSTPR

SEQ ID NO: 1783533 - protein, 6 aa, Staphylococcus epidermidis
KYNNDV

SEQ ID NO: 1783534 - protein, 11 aa, Staphylococcus epidermidis
KYNNEKNKDIY

SEQ ID NO: 1783535 - protein, 7 aa, Staphylococcus epidermidis
KYNSDLA

SEQ ID NO: 1783536 - protein, 6 aa, Staphylococcus epidermidis
KYPELD

SEQ ID NO: 1783537 - protein, 13 aa, Staphylococcus epidermidis
KYPEVNAEIDGED

SEQ ID NO: 1783538 - protein, 13 aa, Staphylococcus epidermidis
KYPKPDKGSAEEI

SEQ ID NO: 1783539 - protein, 13 aa, Staphylococcus epidermidis
KYPKPDKGSTNKI

SEQ ID NO: 1783540 - protein, 22 aa, Staphylococcus epidermidis
KYQDNELINKGEKVEKNNKNRK

SEQ ID NO: 1783541 - protein, 6 aa, Staphylococcus epidermidis
KYQGDY

SEQ ID NO: 1783542 - protein, 8 aa, Staphylococcus epidermidis
KYQSSNRI

SEQ ID NO: 1783543 - protein, 7 aa, Staphylococcus epidermidis
KYRDDAL

SEQ ID NO: 1783544 - protein, 7 aa, Staphylococcus epidermidis
KYRGQGI

SEQ ID NO: 1783545 - protein, 5 aa, Staphylococcus epidermidis
KYSEQ

SEQ ID NO: 1783546 - protein, 7 aa, Staphylococcus epidermidis
KYSESLS

SEQ ID NO: 1783547 - protein, 7 aa, Staphylococcus epidermidis
KYSKNTK

SEQ ID NO: 1783548 - protein, 9 aa, Staphylococcus epidermidis
KYSKQNNDL

SEQ ID NO: 1783549 - protein, 5 aa, Staphylococcus epidermidis
KYSLG

SEQ ID NO: 1783550 - protein, 5 aa, Staphylococcus epidermidis
KYSMG

SEQ ID NO: 1783551 - protein, 10 aa, Staphylococcus epidermidis
KYSNDAADKV

SEQ ID NO: 1783552 - protein, 7 aa, Staphylococcus epidermidis
KYSNDEM

SEQ ID NO: 1783553 - protein, 7 aa, Staphylococcus epidermidis
KYSPMDK

SEQ ID NO: 1783554 - protein, 11 aa, Staphylococcus epidermidis
KYTAEGPQGLL

SEQ ID NO: 1783555 - protein, 11 aa, Staphylococcus epidermidis
KYTGKTGCLDS

SEQ ID NO: 1783556 - protein, 10 aa, Staphylococcus epidermidis
KYTKLSNDAK

SEQ ID NO: 1783557 - protein, 13 aa, Staphylococcus epidermidis
KYTPQPPKSLGNK

SEQ ID NO: 1783558 - protein, 8 aa, Staphylococcus epidermidis
KYYDEQKE

SEQ ID NO: 1783559 - protein, 7 aa, Staphylococcus epidermidis
KYYKPRK

SEQ ID NO: 1783560 - protein, 8 aa, Staphylococcus epidermidis
KYYNQQKG

SEQ ID NO: 1783561 - protein, 6 aa, Staphylococcus epidermidis
KYYSAS

SEQ ID NO: 1783562 - protein, 8 aa, Staphylococcus epidermidis
LAADNDLK

SEQ ID NO: 1783563 - protein, 16 aa, Staphylococcus epidermidis
LAAETDEETEEDKNTE

SEQ ID NO: 1783564 - protein, 10 aa, Staphylococcus epidermidis
LAAKGKDAYN

SEQ ID NO: 1783565 - protein, 5 aa, Staphylococcus epidermidis
LAAKP

SEQ ID NO: 1783566 - protein, 173 aa, Staphylococcus epidermidis; identical to SEQ ID NO: 1733382

SEQ ID NO: 1783567 - protein, 4 aa, Staphylococcus epidermidis
LADA

SEQ ID NO: 1783568 - protein, 13 aa, Staphylococcus epidermidis
LADEKRQKRIEKE

SEQ ID NO: 1783569 - protein, 14 aa, Staphylococcus epidermidis
LADGTGQKELSEKK

SEQ ID NO: 1783570 - protein, 14 aa, Staphylococcus epidermidis
LADQDKLYSNKNKN

SEQ ID NO: 1783571 - protein, 28 aa, Staphylococcus epidermidis
LADSAKGGAYEATALKTSKGMRKQYSSN

SEQ ID NO: 1783572 - protein, 5 aa, Staphylococcus epidermidis
LADTT

SEQ ID NO: 1783573 - protein, 10 aa, Staphylococcus epidermidis
LAEKAGADFV

SEQ ID NO: 1783574 - protein, 5 aa, Staphylococcus epidermidis
LAENG

SEQ ID NO: 1783575 - protein, 4 aa, Staphylococcus epidermidis
LAER

SEQ ID NO: 1783576 - protein, 15 aa, Staphylococcus epidermidis
LAGEGSPGINGGPHG

SEQ ID NO: 1783577 - protein, 5 aa, Staphylococcus epidermidis
LAGET

SEQ ID NO: 1783578 - protein, 5 aa, Staphylococcus epidermidis
LAGKG

SEQ ID NO: 1783579 - protein, 15 aa, Staphylococcus epidermidis
LAGTSDEEAGQTFRE

SEQ ID NO: 1783580 - protein, 7 aa, Staphylococcus epidermidis
LAKEGYF

SEQ ID NO: 1783581 - protein, 6 aa, Staphylococcus epidermidis
LAKERV

SEQ ID NO: 1783582 - protein, 6 aa, Staphylococcus epidermidis
LAKGTH

SEQ ID NO: 1783583 - protein, 22 aa, Staphylococcus epidermidis
LAKKKKEKGLTEAEAKEQSKLR

SEQ ID NO: 1783584 - protein, 8 aa, Staphylococcus epidermidis
LAKNNNPY

SEQ ID NO: 1783585 - protein, 18 aa, Staphylococcus epidermidis
LAKSPNLAVSSSSRGNLE

SEQ ID NO: 1783586 - protein, 7 aa, Staphylococcus epidermidis
LANKGTK

SEQ ID NO: 1783587 - protein, 4 aa, Staphylococcus epidermidis
LANN

SEQ ID NO: 1783588 - protein, 5 aa, Staphylococcus epidermidis
LANPG

SEQ ID NO: 1783589 - protein, 14 aa, Staphylococcus epidermidis
LANPITGAISQDDA

SEQ ID NO: 1783590 - protein, 12 aa, Staphylococcus epidermidis
LANRSRGLTEEN

SEQ ID NO: 1783591 - protein, 10 aa, Staphylococcus epidermidis
LAPERKSDKN

SEQ ID NO: 1783592 - protein, 11 aa, Staphylococcus epidermidis
LAPGDTKAITE

SEQ ID NO: 1783593 - protein, 5 aa, Staphylococcus epidermidis
LAPGL

SEQ ID NO: 1783594 - protein, 7 aa, Staphylococcus epidermidis
LAPNGTA

SEQ ID NO: 1783595 - protein, 14 aa, Staphylococcus epidermidis
LAPPGSPLASLGQS

SEQ ID NO: 1783596 - protein, 4 aa, Staphylococcus epidermidis
LAPR

SEQ ID NO: 1783597 - protein, 7 aa, Staphylococcus epidermidis
LAQEGKP

SEQ ID NO: 1783598 - protein, 7 aa, Staphylococcus epidermidis
LAQGKPI

SEQ ID NO: 1783599 - protein, 15 aa, Staphylococcus epidermidis
LAQGQAKAGSTAKSM

SEQ ID NO: 1783600 - protein, 7 aa, Staphylococcus epidermidis
LAQKGHP

SEQ ID NO: 1783601 - protein, 5 aa, Staphylococcus epidermidis
LAQNN

SEQ ID NO: 1783602 - protein, 70 aa, Staphylococcus epidermidis
LARKGRNNKGGSRRGNNKRGNGKFDNKNRRSKGPKGNSNKKKNTKKFDRRDKQSKGSNQSMRGRTFADHQ

SEQ ID NO: 1783603 - protein, 22 aa, Staphylococcus epidermidis
LARKKKEQGLTNEEAKEQTKLR

SEQ ID NO: 1783604 - protein, 70 aa, Staphylococcus epidermidis
LARKNRSSKGGFRRSNHKRGNGKFDNKNRRSKGSKGQSSKKKNSKKFDRRDKQQKIGNQSLKGRTFADHQ

SEQ ID NO: 1783605 - protein, 5 aa, Staphylococcus epidermidis
LARSE

SEQ ID NO: 1783606 - protein, 17 aa, Staphylococcus epidermidis
LASDTFQKTYDSNVDAF

SEQ ID NO: 1783607 - protein, 4 aa, Staphylococcus epidermidis
LASE

SEQ ID NO: 1783608 - protein, 9 aa, Staphylococcus epidermidis
LASEDSQNM

SEQ ID NO: 1783609 - protein, 14 aa, Staphylococcus epidermidis
LASKSFKPGRPIGG

SEQ ID NO: 1783610 - protein, 7 aa, Staphylococcus epidermidis
LASNGVK

SEQ ID NO: 1783611 - protein, 10 aa, Staphylococcus epidermidis
LASPSAGQRT

SEQ ID NO: 1783612 - protein, 16 aa, Staphylococcus epidermidis
LASREAVKKGSKGLEQ

SEQ ID NO: 1783613 - protein, 11 aa, Staphylococcus epidermidis
LASTDRNLTKA

SEQ ID NO: 1783614 - protein, 30 aa, Staphylococcus epidermidis
LASYNNVNTKEVQEPQVQHSSIDDKTWGKE

SEQ ID NO: 1783615 - protein, 30 aa, Staphylococcus epidermidis
LASYNNVNTQEVQEPQIQNSSIDDKTWGKE

SEQ ID NO: 1783616 - protein, 12 aa, Staphylococcus epidermidis
LATDGYESARET

SEQ ID NO: 1783617 - protein, 4 aa, Staphylococcus epidermidis
LATE

SEQ ID NO: 1783618 - protein, 13 aa, Staphylococcus epidermidis
LCGEDTEVPVSKS

SEQ ID NO: 1783619 - protein, 9 aa, Staphylococcus epidermidis
LDAEPDKYL

SEQ ID NO: 1783620 - protein, 9 aa, Staphylococcus epidermidis
LDDAEDGDL

SEQ ID NO: 1783621 - protein, 7 aa, Staphylococcus epidermidis
LDDAKIQ

SEQ ID NO: 1783622 - protein, 6 aa, Staphylococcus epidermidis
LDDDRD

SEQ ID NO: 1783623 - protein, 7 aa, Staphylococcus epidermidis
LDDEHRN

SEQ ID NO: 1783624 - protein, 5 aa, Staphylococcus epidermidis
LDDGQ

SEQ ID NO: 1783625 - protein, 6 aa, Staphylococcus epidermidis
LDDKAS

SEQ ID NO: 1783626 - protein, 6 aa, Staphylococcus epidermidis
LDDKST

SEQ ID NO: 1783627 - protein, 8 aa, Staphylococcus epidermidis
LDDTIGDH

SEQ ID NO: 1783628 - protein, 9 aa, Staphylococcus epidermidis
LDDTSNDET

SEQ ID NO: 1783629 - protein, 22 aa, Staphylococcus epidermidis
LDEAADQFEDKDKEESDIFGLF

SEQ ID NO: 1783630 - protein, 12 aa, Staphylococcus epidermidis
LDEDSVKKEIEE

SEQ ID NO: 1783631 - protein, 7 aa, Staphylococcus epidermidis
LDEEEAY

SEQ ID NO: 1783632 - protein, 15 aa, Staphylococcus epidermidis
LDEGGQFQDRGSQYQ

SEQ ID NO: 1783633 - protein, 4 aa, Staphylococcus epidermidis
LDEH

SEQ ID NO: 1783634 - protein, 8 aa, Staphylococcus epidermidis
LDEPNQEG

SEQ ID NO: 1783635 - protein, 6 aa, Staphylococcus epidermidis
LDEQGR

SEQ ID NO: 1783636 - protein, 5 aa, Staphylococcus epidermidis
LDEQP

SEQ ID NO: 1783637 - protein, 9 aa, Staphylococcus epidermidis
LDESSVLSE

SEQ ID NO: 1783638 - protein, 8 aa, Staphylococcus epidermidis
LDETDERV

SEQ ID NO: 1783639 - protein, 5 aa, Staphylococcus epidermidis
LDETK

SEQ ID NO: 1783640 - protein, 13 aa, Staphylococcus epidermidis
LDEYRKNIEKDAA

SEQ ID NO: 1783641 - protein, 4 aa, Staphylococcus epidermidis
LDGE

SEQ ID NO: 1783642 - protein, 7 aa, Staphylococcus epidermidis
LDGEAPD

SEQ ID NO: 1783643 - protein, 7 aa, Staphylococcus epidermidis
LDGEDNL

SEQ ID NO: 1783644 - protein, 4 aa, Staphylococcus epidermidis
LDGG

SEQ ID NO: 1783645 - protein, 8 aa, Staphylococcus epidermidis
LDGNAGAC

SEQ ID NO: 1783646 - protein, 7 aa, Staphylococcus epidermidis
LDGNEGY

SEQ ID NO: 1783647 - protein, 9 aa, Staphylococcus epidermidis
LDHTEDNLT

SEQ ID NO: 1783648 - protein, 8 aa, Staphylococcus epidermidis
LDKDGDTY

SEQ ID NO: 1783649 - protein, 10 aa, Staphylococcus epidermidis
LDKDKRKVTL

SEQ ID NO: 1783650 - protein, 6 aa, Staphylococcus epidermidis
LDKEPY

SEQ ID NO: 1783651 - protein, 11 aa, Staphylococcus epidermidis
LDKGDNKPVNH

SEQ ID NO: 1783652 - protein, 10 aa, Staphylococcus epidermidis
LDKKKNKIGW

SEQ ID NO: 1783653 - protein, 4 aa, Staphylococcus epidermidis
LDKN

SEQ ID NO: 1783654 - protein, 8 aa, Staphylococcus epidermidis
LDKQGRIN

SEQ ID NO: 1783655 - protein, 10 aa, Staphylococcus epidermidis
LDKRESLNQN

SEQ ID NO: 1783656 - protein, 7 aa, Staphylococcus epidermidis
LDKSAKD

SEQ ID NO: 1783657 - protein, 9 aa, Staphylococcus epidermidis
LDKTDKDQK

SEQ ID NO: 1783658 - protein, 15 aa, Staphylococcus epidermidis
LDKTKYEANPPMLVW

SEQ ID NO: 1783659 - protein, 14 aa, Staphylococcus epidermidis
LDKTTRGNPKKYTK

SEQ ID NO: 1783660 - protein, 7 aa, Staphylococcus epidermidis
LDLEPED

SEQ ID NO: 1783661 - protein, 7 aa, Staphylococcus epidermidis
LDLSSER

SEQ ID NO: 1783662 - protein, 12 aa, Staphylococcus epidermidis
LDMQSENKTVDL

SEQ ID NO: 1783663 - protein, 8 aa, Staphylococcus epidermidis
LDNEQRQI

SEQ ID NO: 1783664 - protein, 15 aa, Staphylococcus epidermidis
LDNGSRVAPEVSEGD

SEQ ID NO: 1783665 - protein, 4 aa, Staphylococcus epidermidis
LDNK

SEQ ID NO: 1783666 - protein, 5 aa, Staphylococcus epidermidis
LDNKT

SEQ ID NO: 1783667 - protein, 18 aa, Staphylococcus epidermidis
LDNNPQSVEDYKNGKGKA

SEQ ID NO: 1783668 - protein, 12 aa, Staphylococcus epidermidis
LDNQSKKLQIDS

SEQ ID NO: 1783669 - protein, 4 aa, Staphylococcus epidermidis
LDNR

SEQ ID NO: 1783670 - protein, 6 aa, Staphylococcus epidermidis
LDPDQY

SEQ ID NO: 1783671 - protein, 9 aa, Staphylococcus epidermidis
LDPEKRFNV

SEQ ID NO: 1783672 - protein, 7 aa, Staphylococcus epidermidis
LDPETEK

SEQ ID NO: 1783673 - protein, 5 aa, Staphylococcus epidermidis
LDPLE

SEQ ID NO: 1783674 - protein, 7 aa, Staphylococcus epidermidis
LDPNKPT

SEQ ID NO: 1783675 - protein, 10 aa, Staphylococcus epidermidis
LDPNSTSDEL

SEQ ID NO: 1783676 - protein, 9 aa, Staphylococcus epidermidis
LDPSEINES

SEQ ID NO: 1783677 - protein, 12 aa, Staphylococcus epidermidis
LDPSETPGTGTR

SEQ ID NO: 1783678 - protein, 6 aa, Staphylococcus epidermidis
LDPSKP

SEQ ID NO: 1783679 - protein, 7 aa, Staphylococcus epidermidis
LDQAGYE

SEQ ID NO: 1783680 - protein, 5 aa, Staphylococcus epidermidis
LDQDQ

SEQ ID NO: 1783681 - protein, 9 aa, Staphylococcus epidermidis
LDQLEKANV

SEQ ID NO: 1783682 - protein, 15 aa, Staphylococcus epidermidis
LDQQEEMGYTQKSPR

SEQ ID NO: 1783683 - protein, 5 aa, Staphylococcus epidermidis
LDQQQ

SEQ ID NO: 1783684 - protein, 6 aa, Staphylococcus epidermidis
LDQTRN

SEQ ID NO: 1783685 - protein, 12 aa, Staphylococcus epidermidis
LDRDDKTDKVLE

SEQ ID NO: 1783686 - protein, 9 aa, Staphylococcus epidermidis
LDRGANSIT

SEQ ID NO: 1783687 - protein, 5 aa, Staphylococcus epidermidis
LDRSE

SEQ ID NO: 1783688 - protein, 8 aa, Staphylococcus epidermidis
LDSERERL

SEQ ID NO: 1783689 - protein, 7 aa, Staphylococcus epidermidis
LDSETDV

SEQ ID NO: 1783690 - protein, 24 aa, Staphylococcus epidermidis
LDSGSVASPNRETEGMKDGSDAVG

SEQ ID NO: 1783691 - protein, 14 aa, Staphylococcus epidermidis
LDSRSFKSFSKPKW

SEQ ID NO: 1783692 - protein, 12 aa, Staphylococcus epidermidis
LDSSVEKEPIYG

SEQ ID NO: 1783693 - protein, 4 aa, Staphylococcus epidermidis
LDTA

SEQ ID NO: 1783694 - protein, 12 aa, Staphylococcus epidermidis
LDTDDSLTEFKT

SEQ ID NO: 1783695 - protein, 6 aa, Staphylococcus epidermidis
LDTDGV

SEQ ID NO: 1783696 - protein, 5 aa, Staphylococcus epidermidis
LDTEG

SEQ ID NO: 1783697 - protein, 8 aa, Staphylococcus epidermidis
LDTNSITD

SEQ ID NO: 1783698 - protein, 10 aa, Staphylococcus epidermidis
LDTSSRSRDF

SEQ ID NO: 1783699 - protein, 11 aa, Staphylococcus epidermidis
LDTYDSSLSEN

SEQ ID NO: 1783700 - protein, 10 aa, Staphylococcus epidermidis
LEAKRLRNNP

SEQ ID NO: 1783701 - protein, 11 aa, Staphylococcus epidermidis
LEDKNDHTIDA

SEQ ID NO: 1783702 - protein, 5 aa, Staphylococcus epidermidis
LEDLE

SEQ ID NO: 1783703 - protein, 7 aa, Staphylococcus epidermidis
LEDNETI

SEQ ID NO: 1783704 - protein, 8 aa, Staphylococcus epidermidis
LEDNPNKA

SEQ ID NO: 1783705 - protein, 5 aa, Staphylococcus epidermidis
LEDPE

SEQ ID NO: 1783706 - protein, 6 aa, Staphylococcus epidermidis
LEDPTQ

SEQ ID NO: 1783707 - protein, 7 aa, Staphylococcus epidermidis
LEDSNIQ

SEQ ID NO: 1783708 - protein, 10 aa, Staphylococcus epidermidis
LEDSNKQKAN

SEQ ID NO: 1783709 - protein, 6 aa, Staphylococcus epidermidis
LEDSQI

SEQ ID NO: 1783710 - protein, 6 aa, Staphylococcus epidermidis
LEDTEL

SEQ ID NO: 1783711 - protein, 7 aa, Staphylococcus epidermidis
LEDTSAA

SEQ ID NO: 1783712 - protein, 7 aa, Staphylococcus epidermidis
LEDTVSQ

SEQ ID NO: 1783713 - protein, 11 aa, Staphylococcus epidermidis
LEDYSKEYPEL

SEQ ID NO: 1783714 - protein, 10 aa, Staphylococcus epidermidis
LEEDDSEHAR

SEQ ID NO: 1783715 - protein, 4 aa, Staphylococcus epidermidis
LEEK

SEQ ID NO: 1783716 - protein, 12 aa, Staphylococcus epidermidis
LEEKAYRQPIVE

SEQ ID NO: 1783717 - protein, 5 aa, Staphylococcus epidermidis
LEEKG

SEQ ID NO: 1783718 - protein, 8 aa, Staphylococcus epidermidis
LEEKGLTK

SEQ ID NO: 1783719 - protein, 13 aa, Staphylococcus epidermidis
LEEKYRSDEWMYR

SEQ ID NO: 1783720 - protein, 8 aa, Staphylococcus epidermidis
LEENNENP

SEQ ID NO: 1783721 - protein, 9 aa, Staphylococcus epidermidis
LEEQNGNRI

SEQ ID NO: 1783722 - protein, 4 aa, Staphylococcus epidermidis
LEER

SEQ ID NO: 1783723 - protein, 26 aa, Staphylococcus epidermidis
LEERDLGDGRTSSISASVSYTVTWSA

SEQ ID NO: 1783724 - protein, 8 aa, Staphylococcus epidermidis
LEEREASQ

SEQ ID NO: 1783725 - protein, 13 aa, Staphylococcus epidermidis
LEESRKPTNTKEL

SEQ ID NO: 1783726 - protein, 14 aa, Staphylococcus epidermidis
LEETGDLKIPQSEG

SEQ ID NO: 1783727 - protein, 6 aa, Staphylococcus epidermidis
LEFSPD

SEQ ID NO: 1783728 - protein, 13 aa, Staphylococcus epidermidis
LEGEGKPEPLKGN

SEQ ID NO: 1783729 - protein, 11 aa, Staphylococcus epidermidis
LEGLPKDDNNY

SEQ ID NO: 1783730 - protein, 4 aa, Staphylococcus epidermidis
LEGN

SEQ ID NO: 1783731 - protein, 7 aa, Staphylococcus epidermidis
LEGQTYE

SEQ ID NO: 1783732 - protein, 9 aa, Staphylococcus epidermidis
LEGTAKSIG

SEQ ID NO: 1783733 - protein, 5 aa, Staphylococcus epidermidis
LEHGN

SEQ ID NO: 1783734 - protein, 10 aa, Staphylococcus epidermidis
LEKEDITKKV

SEQ ID NO: 1783735 - protein, 14 aa, Staphylococcus epidermidis
LEKEEIQSQDIKRA

SEQ ID NO: 1783736 - protein, 9 aa, Staphylococcus epidermidis
LEKENREFE

SEQ ID NO: 1783737 - protein, 10 aa, Staphylococcus epidermidis
LEKETTEGVD

SEQ ID NO: 1783738 - protein, 4 aa, Staphylococcus epidermidis
LEKG

SEQ ID NO: 1783739 - protein, 6 aa, Staphylococcus epidermidis
LEKGGF

SEQ ID NO: 1783740 - protein, 10 aa, Staphylococcus epidermidis
LEKGSTDVED

SEQ ID NO: 1783741 - protein, 9 aa, Staphylococcus epidermidis
LEKLDPEAE

SEQ ID NO: 1783742 - protein, 16 aa, Staphylococcus epidermidis
LEKNEQKRCEKEGIEY

SEQ ID NO: 1783743 - protein, 9 aa, Staphylococcus epidermidis
LEKNPDEST

SEQ ID NO: 1783744 - protein, 8 aa, Staphylococcus epidermidis
LEKNTSHI

SEQ ID NO: 1783745 - protein, 5 aa, Staphylococcus epidermidis
LEKPD

SEQ ID NO: 1783746 - protein, 4 aa, Staphylococcus epidermidis
LEKQ

SEQ ID NO: 1783747 - protein, 15 aa, Staphylococcus epidermidis
LEKRSDTNARTKAAE

SEQ ID NO: 1783748 - protein, 9 aa, Staphylococcus epidermidis
LEKSNADRD

SEQ ID NO: 1783749 - protein, 6 aa, Staphylococcus epidermidis
LEKSQL

SEQ ID NO: 1783750 - protein, 7 aa, Staphylococcus epidermidis
LELEPGD

SEQ ID NO: 1783751 - protein, 14 aa, Staphylococcus epidermidis
LELQDDGKVKGLDK

SEQ ID NO: 1783752 - protein, 26 aa, Staphylococcus epidermidis
LENAQNNLHGDQKLAQAKQNAADTIN

SEQ ID NO: 1783753 - protein, 8 aa, Staphylococcus epidermidis
LENDANTK

SEQ ID NO: 1783754 - protein, 9 aa, Staphylococcus epidermidis
LENESDRRA

SEQ ID NO: 1783755 - protein, 6 aa, Staphylococcus epidermidis
LENGSY

SEQ ID NO: 1783756 - protein, 9 aa, Staphylococcus epidermidis
LENNKTEKD

SEQ ID NO: 1783757 - protein, 12 aa, Staphylococcus epidermidis
LENPSHINTAED

SEQ ID NO: 1783758 - protein, 6 aa, Staphylococcus epidermidis
LENSEE

SEQ ID NO: 1783759 - protein, 10 aa, Staphylococcus epidermidis
LENSSNENEY

SEQ ID NO: 1783760 - protein, 12 aa, Staphylococcus epidermidis
LENTEYVEGKPY

SEQ ID NO: 1783761 - protein, 20 aa, Staphylococcus epidermidis
LENYKDESISYNPNVPSYSA

SEQ ID NO: 1783762 - protein, 9 aa, Staphylococcus epidermidis
LEPDEDEPI

SEQ ID NO: 1783763 - protein, 6 aa, Staphylococcus epidermidis
LEPLAS

SEQ ID NO: 1783764 - protein, 4 aa, Staphylococcus epidermidis
LEPQ

SEQ ID NO: 1783765 - protein, 15 aa, Staphylococcus epidermidis
LEQAGAKDVSADFRR

SEQ ID NO: 1783766 - protein, 24 aa, Staphylococcus epidermidis
LEQGDSESLRITENSGISFIYTLE

SEQ ID NO: 1783767 - protein, 5 aa, Staphylococcus epidermidis
LEQGG

SEQ ID NO: 1783768 - protein, 15 aa, Staphylococcus epidermidis
LEQNERKRCEKEGIE

SEQ ID NO: 1783769 - protein, 5 aa, Staphylococcus epidermidis
LEQQK

SEQ ID NO: 1783770 - protein, 7 aa, Staphylococcus epidermidis
LEQQKTR

SEQ ID NO: 1783771 - protein, 5 aa, Staphylococcus epidermidis
LEQSN

SEQ ID NO: 1783772 - protein, 14 aa, Staphylococcus epidermidis
LEQSSYRNMTIYDF

SEQ ID NO: 1783773 - protein, 4 aa, Staphylococcus epidermidis
LERA

SEQ ID NO: 1783774 - protein, 6 aa, Staphylococcus epidermidis
LERAGY

SEQ ID NO: 1783775 - protein, 6 aa, Staphylococcus epidermidis
LERDGL

SEQ ID NO: 1783776 - protein, 8 aa, Staphylococcus epidermidis
LERETKKV

SEQ ID NO: 1783777 - protein, 11 aa, Staphylococcus epidermidis
LERGSKPTEWS

SEQ ID NO: 1783778 - protein, 11 aa, Staphylococcus epidermidis
LERKGQSYTYD

SEQ ID NO: 1783779 - protein, 32 aa, Staphylococcus epidermidis
LERQKNAIKQKEEQDAYIKEQDSLAKKNRGQK

SEQ ID NO: 1783780 - protein, 14 aa, Staphylococcus epidermidis
LESAHAKSVTTANG

SEQ ID NO: 1783781 - protein, 6 aa, Staphylococcus epidermidis
LESAKR

SEQ ID NO: 1783782 - protein, 10 aa, Staphylococcus epidermidis
LESATGQRLT

SEQ ID NO: 1783783 - protein, 7 aa, Staphylococcus epidermidis
LESATQP

SEQ ID NO: 1783784 - protein, 16 aa, Staphylococcus epidermidis
LESDISKKENEITGVE

SEQ ID NO: 1783785 - protein, 9 aa, Staphylococcus epidermidis
LESDYRAKS

SEQ ID NO: 1783786 - protein, 5 aa, Staphylococcus epidermidis
LESED

SEQ ID NO: 1783787 - protein, 7 aa, Staphylococcus epidermidis
LESESKL

SEQ ID NO: 1783788 - protein, 12 aa, Staphylococcus epidermidis
LESIQESAEGKV

SEQ ID NO: 1783789 - protein, 9 aa, Staphylococcus epidermidis
LESKSDDFK

SEQ ID NO: 1783790 - protein, 4 aa, Staphylococcus epidermidis
LESN

SEQ ID NO: 1783791 - protein, 6 aa, Staphylococcus epidermidis
LESSAI

SEQ ID NO: 1783792 - protein, 16 aa, Staphylococcus epidermidis
LESYHSRGYASGFEES

SEQ ID NO: 1783793 - protein, 6 aa, Staphylococcus epidermidis
LETAKN

SEQ ID NO: 1783794 - protein, 10 aa, Staphylococcus epidermidis
LETDKDSGFK

SEQ ID NO: 1783795 - protein, 12 aa, Staphylococcus epidermidis
LETEKDETYENF

SEQ ID NO: 1783796 - protein, 6 aa, Staphylococcus epidermidis
LETESD

SEQ ID NO: 1783797 - protein, 9 aa, Staphylococcus epidermidis
LETGKAKRD

SEQ ID NO: 1783798 - protein, 14 aa, Staphylococcus epidermidis
LETGKKFNNNKQAL

SEQ ID NO: 1783799 - protein, 17 aa, Staphylococcus epidermidis
LETGKKYQSNKKQREFV

SEQ ID NO: 1783800 - protein, 16 aa, Staphylococcus epidermidis
LETGRKYQSNKRQREF

SEQ ID NO: 1783801 - protein, 6 aa, Staphylococcus epidermidis
LETGSD

SEQ ID NO: 1783802 - protein, 8 aa, Staphylococcus epidermidis
LETPDSGS

SEQ ID NO: 1783803 - protein, 8 aa, Staphylococcus epidermidis
LETQGSKF

SEQ ID NO: 1783804 - protein, 12 aa, Staphylococcus epidermidis
LETSEVRGKKVR

SEQ ID NO: 1783805 - protein, 7 aa, Staphylococcus epidermidis
LETSPRS

SEQ ID NO: 1783806 - protein, 18 aa, Staphylococcus epidermidis
LEVSDTKKSENNAIKSAN

SEQ ID NO: 1783807 - protein, 8 aa, Staphylococcus epidermidis
LEYSETNS

SEQ ID NO: 1783808 - protein, 4 aa, Staphylococcus epidermidis
LFNE

SEQ ID NO: 1783809 - protein, 9 aa, Staphylococcus epidermidis
LGADDKAGL

SEQ ID NO: 1783810 - protein, 19 aa, Staphylococcus epidermidis
LGAIPTSTLGYEKTNKLGF

SEQ ID NO: 1783811 - protein, 4 aa, Staphylococcus epidermidis
LGAY

SEQ ID NO: 1783812 - protein, 12 aa, Staphylococcus epidermidis
LGDSYKRNIAGK

SEQ ID NO: 1783813 - protein, 13 aa, Staphylococcus epidermidis
LGDTARYATEARI

SEQ ID NO: 1783814 - protein, 5 aa, Staphylococcus epidermidis
LGEAE

SEQ ID NO: 1783815 - protein, 11 aa, Staphylococcus epidermidis
LGEGQSSDEYT

SEQ ID NO: 1783816 - protein, 5 aa, Staphylococcus epidermidis
LGEIP

SEQ ID NO: 1783817 - protein, 6 aa, Staphylococcus epidermidis
LGETFN

SEQ ID NO: 1783818 - protein, 10 aa, Staphylococcus epidermidis
LGETKKTSDL

SEQ ID NO: 1783819 - protein, 4 aa, Staphylococcus epidermidis
LGEV

SEQ ID NO: 1783820 - protein, 10 aa, Staphylococcus epidermidis
LGEVGKNTYA

SEQ ID NO: 1783821 - protein, 7 aa, Staphylococcus epidermidis
LGGDNLE

SEQ ID NO: 1783822 - protein, 17 aa, Staphylococcus epidermidis
LGGEQETKRRAGTENVP

SEQ ID NO: 1783823 - protein, 12 aa, Staphylococcus epidermidis
LGGGGTRGNGRI

SEQ ID NO: 1783824 - protein, 5 aa, Staphylococcus epidermidis
LGGGS

SEQ ID NO: 1783825 - protein, 9 aa, Staphylococcus epidermidis
LGGMGGAQP

SEQ ID NO: 1783826 - protein, 13 aa, Staphylococcus epidermidis
LGGPTHGVPREDG

SEQ ID NO: 1783827 - protein, 13 aa, Staphylococcus epidermidis
LGGPTNGVPREDG

SEQ ID NO: 1783828 - protein, 6 aa, Staphylococcus epidermidis
LGGQTG

SEQ ID NO: 1783829 - protein, 4 aa, Staphylococcus epidermidis
LGGT

SEQ ID NO: 1783830 - protein, 7 aa, Staphylococcus epidermidis
LGITRKK

SEQ ID NO: 1783831 - protein, 11 aa, Staphylococcus epidermidis
LGKENNVNTPV

SEQ ID NO: 1783832 - protein, 4 aa, Staphylococcus epidermidis
LGKG

SEQ ID NO: 1783833 - protein, 6 aa, Staphylococcus epidermidis
LGKNGD

SEQ ID NO: 1783834 - protein, 6 aa, Staphylococcus epidermidis
LGKTPK

SEQ ID NO: 1783835 - protein, 23 aa, Staphylococcus epidermidis
LGKTTKNAVSNFKDARNSAGKHW

SEQ ID NO: 1783836 - protein, 12 aa, Staphylococcus epidermidis
LGKTTSNAISNF

SEQ ID NO: 1783837 - protein, 15 aa, Staphylococcus epidermidis
LGLSPSASFSNQGTR

SEQ ID NO: 1783838 - protein, 6 aa, Staphylococcus epidermidis
LGLSSE

SEQ ID NO: 1783839 - protein, 14 aa, Staphylococcus epidermidis
LGMKGNAPNNHIKR

SEQ ID NO: 1783840 - protein, 8 aa, Staphylococcus epidermidis
LGMNDTKT

SEQ ID NO: 1783841 - protein, 5 aa, Staphylococcus epidermidis
LGNGI

SEQ ID NO: 1783842 - protein, 4 aa, Staphylococcus epidermidis
LGNN

SEQ ID NO: 1783843 - protein, 17 aa, Staphylococcus epidermidis
LGNRYEGYSPDGVVGGD

SEQ ID NO: 1783844 - protein, 8 aa, Staphylococcus epidermidis
LGNTEQNT

SEQ ID NO: 1783845 - protein, 4 aa, Staphylococcus epidermidis
LGNY

SEQ ID NO: 1783846 - protein, 5 aa, Staphylococcus epidermidis
LGPAL

SEQ ID NO: 1783847 - protein, 4 aa, Staphylococcus epidermidis
LGPD

SEQ ID NO: 1783848 - protein, 5 aa, Staphylococcus epidermidis
LGPEP

SEQ ID NO: 1783849 - protein, 7 aa, Staphylococcus epidermidis
LGPIDTP

SEQ ID NO: 1783850 - protein, 6 aa, Staphylococcus epidermidis
LGPNSQ

SEQ ID NO: 1783851 - protein, 19 aa, Staphylococcus epidermidis
LGPTGSQMGKKETAKDTAR

SEQ ID NO: 1783852 - protein, 4 aa, Staphylococcus epidermidis
LGQD

SEQ ID NO: 1783853 - protein, 5 aa, Staphylococcus epidermidis
LGQDG

SEQ ID NO: 1783854 - protein, 13 aa, Staphylococcus epidermidis
LGQPEPIYDYLKD

SEQ ID NO: 1783855 - protein, 28 aa, Staphylococcus epidermidis
LGQPIDGQGPINSTKTRPVEKKATGVMD

SEQ ID NO: 1783856 - protein, 20 aa, Staphylococcus epidermidis
LGQSTGYDYTRTKNPTRTAF

SEQ ID NO: 1783857 - protein, 8 aa, Staphylococcus epidermidis
LGQTAGQK

SEQ ID NO: 1783858 - protein, 10 aa, Staphylococcus epidermidis
LGRGGSDTTA

SEQ ID NO: 1783859 - protein, 11 aa, Staphylococcus epidermidis
LGSDDKSKELK

SEQ ID NO: 1783860 - protein, 14 aa, Staphylococcus epidermidis
LGSDTLDYSTYRRR

SEQ ID NO: 1783861 - protein, 6 aa, Staphylococcus epidermidis
LGSKKI

SEQ ID NO: 1783862 - protein, 11 aa, Staphylococcus epidermidis
LGSKKLNETIR

SEQ ID NO: 1783863 - protein, 6 aa, Staphylococcus epidermidis
LGSKPL

SEQ ID NO: 1783864 - protein, 9 aa, Staphylococcus epidermidis
LGSLPTTTL

SEQ ID NO: 1783865 - protein, 12 aa, Staphylococcus epidermidis
LGSSASKAWGNV

SEQ ID NO: 1783866 - protein, 16 aa, Staphylococcus epidermidis
LGSTQDASEFNDKDSY

SEQ ID NO: 1783867 - protein, 4 aa, Staphylococcus epidermidis
LGTD

SEQ ID NO: 1783868 - protein, 13 aa, Staphylococcus epidermidis
LGTDFKGSVSQGI

SEQ ID NO: 1783869 - protein, 5 aa, Staphylococcus epidermidis
LGTIN

SEQ ID NO: 1783870 - protein, 7 aa, Staphylococcus epidermidis
LGTNDGV

SEQ ID NO: 1783871 - protein, 15 aa, Staphylococcus epidermidis
LGTPAATTRGFDESA

SEQ ID NO: 1783872 - protein, 7 aa, Staphylococcus epidermidis
LGTPDEV

SEQ ID NO: 1783873 - protein, 13 aa, Staphylococcus epidermidis
LGTPLPQKEAYDD

SEQ ID NO: 1783874 - protein, 11 aa, Staphylococcus epidermidis
LGTQGKPISEH

SEQ ID NO: 1783875 - protein, 7 aa, Staphylococcus epidermidis
LGTTPEF

SEQ ID NO: 1783876 - protein, 19 aa, Staphylococcus epidermidis
LGVTRKTVGEWEKEGANIS

SEQ ID NO: 1783877 - protein, 8 aa, Staphylococcus epidermidis
LGYPPNNL

SEQ ID NO: 1783878 - protein, 14 aa, Staphylococcus epidermidis
LHDKDTNPDGEIKK

SEQ ID NO: 1783879 - protein, 6 aa, Staphylococcus epidermidis
LHGTKT

SEQ ID NO: 1783880 - protein, 9 aa, Staphylococcus epidermidis
LHKRSTGRS

SEQ ID NO: 1783881 - protein, 10 aa, Staphylococcus epidermidis
LHNGNSDRQA

SEQ ID NO: 1783882 - protein, 7 aa, Staphylococcus epidermidis
LHQPTDM

SEQ ID NO: 1783883 - protein, 16 aa, Staphylococcus epidermidis
LHSRSKAALSNANETI

SEQ ID NO: 1783884 - protein, 10 aa, Staphylococcus epidermidis
LHTDAGSQHV

SEQ ID NO: 1783885 - protein, 11 aa, Staphylococcus epidermidis
LHTPRRSEPRL

SEQ ID NO: 1783886 - protein, 10 aa, Staphylococcus epidermidis
LIGNDKKNTL

SEQ ID NO: 1783887 - protein, 10 aa, Staphylococcus epidermidis
LIPKKERDTF

SEQ ID NO: 1783888 - protein, 19 aa, Staphylococcus epidermidis
LIPNNNDNTYFDRIKKIID

SEQ ID NO: 1783889 - protein, 7 aa, Staphylococcus epidermidis
LIQEERQ

SEQ ID NO: 1783890 - protein, 10 aa, Staphylococcus epidermidis
LITSRKDGNK

SEQ ID NO: 1783891 - protein, 6 aa, Staphylococcus epidermidis
LITSTQ

SEQ ID NO: 1783892 - protein, 5 aa, Staphylococcus epidermidis
LKAAI

SEQ ID NO: 1783893 - protein, 6 aa, Staphylococcus epidermidis
LKADNG

SEQ ID NO: 1783894 - protein, 17 aa, Staphylococcus epidermidis
LKAGETVSYGRTYTAAE

SEQ ID NO: 1783895 - protein, 10 aa, Staphylococcus epidermidis
LKAGHKQLTD

SEQ ID NO: 1783896 - protein, 4 aa, Staphylococcus epidermidis
LKAK

SEQ ID NO: 1783897 - protein, 11 aa, Staphylococcus epidermidis
LKAKKDKRQAP

SEQ ID NO: 1783898 - protein, 21 aa, Staphylococcus epidermidis
LKAKSSKSQNCKNSSHSSWFI

SEQ ID NO: 1783899 - protein, 9 aa, Staphylococcus epidermidis
LKANEKQLQ

SEQ ID NO: 1783900 - protein, 10 aa, Staphylococcus epidermidis
LKANPEKRAV

SEQ ID NO: 1783901 - protein, 5 aa, Staphylococcus epidermidis
LKAQG

SEQ ID NO: 1783902 - protein, 8 aa, Staphylococcus epidermidis
LKAQGAKV

SEQ ID NO: 1783903 - protein, 26 aa, Staphylococcus epidermidis
LKAQQKQSVNFQNYGKQNALEQSEAK

SEQ ID NO: 1783904 - protein, 9 aa, Staphylococcus epidermidis
LKASSDYYD

SEQ ID NO: 1783905 - protein, 8 aa, Staphylococcus epidermidis
LKDEGKIK

SEQ ID NO: 1783906 - protein, 10 aa, Staphylococcus epidermidis
LKDEKQSKQL

SEQ ID NO: 1783907 - protein, 5 aa, Staphylococcus epidermidis
LKDGD

SEQ ID NO: 1783908 - protein, 19 aa, Staphylococcus epidermidis
LKDKAEAYPNQLSGGQKQR

SEQ ID NO: 1783909 - protein, 30 aa, Staphylococcus epidermidis
LKDKTKQTEADKTSPNYTEASDDRKEALNQ

SEQ ID NO: 1783910 - protein, 9 aa, Staphylococcus epidermidis
LKDMSDDKK

SEQ ID NO: 1783911 - protein, 21 aa, Staphylococcus epidermidis
LKDNCSKLTDTDGNKYKVEKL

SEQ ID NO: 1783912 - protein, 17 aa, Staphylococcus epidermidis
LKDNPNSKKNKNKYQEL

SEQ ID NO: 1783913 - protein, 6 aa, Staphylococcus epidermidis
LKDSGY

SEQ ID NO: 1783914 - protein, 8 aa, Staphylococcus epidermidis
LKDTDYSS

SEQ ID NO: 1783915 - protein, 5 aa, Staphylococcus epidermidis
LKDTL

SEQ ID NO: 1783916 - protein, 9 aa, Staphylococcus epidermidis
LKEAAKKCD

SEQ ID NO: 1783917 - protein, 6 aa, Staphylococcus epidermidis
LKEATH

SEQ ID NO: 1783918 - protein, 7 aa, Staphylococcus epidermidis
LKEDDQI

SEQ ID NO: 1783919 - protein, 7 aa, Staphylococcus epidermidis
LKEEGHE

SEQ ID NO: 1783920 - protein, 10 aa, Staphylococcus epidermidis
LKEENSTAFH

SEQ ID NO: 1783921 - protein, 4 aa, Staphylococcus epidermidis
LKEN

SEQ ID NO: 1783922 - protein, 9 aa, Staphylococcus epidermidis
LKENPKKDI

SEQ ID NO: 1783923 - protein, 4 aa, Staphylococcus epidermidis
LKEQ

SEQ ID NO: 1783924 - protein, 7 aa, Staphylococcus epidermidis
LKEQAET

SEQ ID NO: 1783925 - protein, 6 aa, Staphylococcus epidermidis
LKEQNI

SEQ ID NO: 1783926 - protein, 6 aa, Staphylococcus epidermidis
LKERQV

SEQ ID NO: 1783927 - protein, 8 aa, Staphylococcus epidermidis
LKESGLTN

SEQ ID NO: 1783928 - protein, 5 aa, Staphylococcus epidermidis
LKEST

SEQ ID NO: 1783929 - protein, 8 aa, Staphylococcus epidermidis
LKESTVSS

SEQ ID NO: 1783930 - protein, 10 aa, Staphylococcus epidermidis
LKETKKTSDL

SEQ ID NO: 1783931 - protein, 7 aa, Staphylococcus epidermidis
LKFKERR

SEQ ID NO: 1783932 - protein, 4 aa, Staphylococcus epidermidis
LKGA

SEQ ID NO: 1783933 - protein, 10 aa, Staphylococcus epidermidis
LKGEETTTGD

SEQ ID NO: 1783934 - protein, 20 aa, Staphylococcus epidermidis
LKGEQGVQGIPGEDGKPFTY

SEQ ID NO: 1783935 - protein, 6 aa, Staphylococcus epidermidis
LKGETH

SEQ ID NO: 1783936 - protein, 11 aa, Staphylococcus epidermidis
LKGGDKDPYRV

SEQ ID NO: 1783937 - protein, 10 aa, Staphylococcus epidermidis
LKGGEKDPYR

SEQ ID NO: 1783938 - protein, 5 aa, Staphylococcus epidermidis
LKGGQ

SEQ ID NO: 1783939 - protein, 8 aa, Staphylococcus epidermidis
LKGIGKGV

SEQ ID NO: 1783940 - protein, 9 aa, Staphylococcus epidermidis
LKGKAAHAE

SEQ ID NO: 1783941 - protein, 9 aa, Staphylococcus epidermidis
LKGKEADEL

SEQ ID NO: 1783942 - protein, 4 aa, Staphylococcus epidermidis
LKGL

SEQ ID NO: 1783943 - protein, 5 aa, Staphylococcus epidermidis
LKGNM

SEQ ID NO: 1783944 - protein, 9 aa, Staphylococcus epidermidis
LKGNSKKIE

SEQ ID NO: 1783945 - protein, 8 aa, Staphylococcus epidermidis
LKGPVTRF

SEQ ID NO: 1783946 - protein, 8 aa, Staphylococcus epidermidis
LKGTNRKK

SEQ ID NO: 1783947 - protein, 47 aa, Staphylococcus epidermidis
LKGVKSAQDDFNSAHSKYNNTKIADSDWKGETRSKSDEHKENMDEEM

SEQ ID NO: 1783948 - protein, 9 aa, Staphylococcus epidermidis
LKITNNQTP

SEQ ID NO: 1783949 - protein, 10 aa, Staphylococcus epidermidis
LKKDDDNLNG

SEQ ID NO: 1783950 - protein, 10 aa, Staphylococcus epidermidis
LKKEETTYSR

SEQ ID NO: 1783951 - protein, 6 aa, Staphylococcus epidermidis
LKKEGA

SEQ ID NO: 1783952 - protein, 7 aa, Staphylococcus epidermidis
LKKETNI

SEQ ID NO: 1783953 - protein, 4 aa, Staphylococcus epidermidis
LKKG

SEQ ID NO: 1783954 - protein, 12 aa, Staphylococcus epidermidis
LKKGKDELESLH

SEQ ID NO: 1783955 - protein, 12 aa, Staphylococcus epidermidis
LKKKDFETEEER

SEQ ID NO: 1783956 - protein, 6 aa, Staphylococcus epidermidis
LKKKGG

SEQ ID NO: 1783957 - protein, 8 aa, Staphylococcus epidermidis
LKKNANKI

SEQ ID NO: 1783958 - protein, 10 aa, Staphylococcus epidermidis
LKKPGDKTTI

SEQ ID NO: 1783959 - protein, 31 aa, Staphylococcus epidermidis
LKKQEKNGDITEDDLRSQTDDVQKATDNSIK

SEQ ID NO: 1783960 - protein, 7 aa, Staphylococcus epidermidis
LKNEGYT

SEQ ID NO: 1783961 - protein, 7 aa, Staphylococcus epidermidis
LKNEQTA

SEQ ID NO: 1783962 - protein, 22 aa, Staphylococcus epidermidis
LKNKNGDTIGTTTTDSNGKYEF

SEQ ID NO: 1783963 - protein, 5 aa, Staphylococcus epidermidis
LKNMN

SEQ ID NO: 1783964 - protein, 10 aa, Staphylococcus epidermidis
LKNPKATSYG

SEQ ID NO: 1783965 - protein, 12 aa, Staphylococcus epidermidis
LKNQQNEDKPLF

SEQ ID NO: 1783966 - protein, 11 aa, Staphylococcus epidermidis
LKNQQNEDKSL

SEQ ID NO: 1783967 - protein, 11 aa, Staphylococcus epidermidis
LKNQQNEDKTL

SEQ ID NO: 1783968 - protein, 11 aa, Staphylococcus epidermidis
LKNRKSKITFA

SEQ ID NO: 1783969 - protein, 19 aa, Staphylococcus epidermidis
LKNTTITEKYNKPTDDNDV

SEQ ID NO: 1783970 - protein, 10 aa, Staphylococcus epidermidis
LKNTTKNEID

SEQ ID NO: 1783971 - protein, 26 aa, Staphylococcus epidermidis
LKNVNSSKSSNSDTVQTRKQRFGGSR

SEQ ID NO: 1783972 - protein, 16 aa, Staphylococcus epidermidis
LKPDYESTSIPKVSQE

SEQ ID NO: 1783973 - protein, 7 aa, Staphylococcus epidermidis
LKPEEVR

SEQ ID NO: 1783974 - protein, 4 aa, Staphylococcus epidermidis
LKPF

SEQ ID NO: 1783975 - protein, 9 aa, Staphylococcus epidermidis
LKPKEEDIQ

SEQ ID NO: 1783976 - protein, 6 aa, Staphylococcus epidermidis
LKPPIH

SEQ ID NO: 1783977 - protein, 6 aa, Staphylococcus epidermidis
LKPQPN

SEQ ID NO: 1783978 - protein, 5 aa, Staphylococcus epidermidis
LKPSG

SEQ ID NO: 1783979 - protein, 17 aa, Staphylococcus epidermidis
LKQDREAFQRQLEEKWK

SEQ ID NO: 1783980 - protein, 6 aa, Staphylococcus epidermidis
LKQGTF

SEQ ID NO: 1783981 - protein, 12 aa, Staphylococcus epidermidis
LKQKADKNLKDS

SEQ ID NO: 1783982 - protein, 11 aa, Staphylococcus epidermidis
LKQNDEKQKFE

SEQ ID NO: 1783983 - protein, 8 aa, Staphylococcus epidermidis
LKQRGAKS

SEQ ID NO: 1783984 - protein, 14 aa, Staphylococcus epidermidis
LKQRIEKGQQPRVV

SEQ ID NO: 1783985 - protein, 10 aa, Staphylococcus epidermidis
LKQSDKFPSN

SEQ ID NO: 1783986 - protein, 8 aa, Staphylococcus epidermidis
LKQSQPND

SEQ ID NO: 1783987 - protein, 7 aa, Staphylococcus epidermidis
LKRDENT

SEQ ID NO: 1783988 - protein, 7 aa, Staphylococcus epidermidis
LKREKER

SEQ ID NO: 1783989 - protein, 9 aa, Staphylococcus epidermidis
LKRGPATNP

SEQ ID NO: 1783990 - protein, 4 aa, Staphylococcus epidermidis
LKRK

SEQ ID NO: 1783991 - protein, 4 aa, Staphylococcus epidermidis
LKRN

SEQ ID NO: 1783992 - protein, 11 aa, Staphylococcus epidermidis
LKRSGKTASDI

SEQ ID NO: 1783993 - protein, 7 aa, Staphylococcus epidermidis
LKRSNKV

SEQ ID NO: 1783994 - protein, 40 aa, Staphylococcus epidermidis
LKRTDASNTDGKDNHQTEEDVETAEAESKAADSESKGGAY

SEQ ID NO: 1783995 - protein, 40 aa, Staphylococcus epidermidis
LKRTDASNTDGKDNHQTEEDVETAEAETKAADSESKGGAY

SEQ ID NO: 1783996 - protein, 9 aa, Staphylococcus epidermidis
LKRTTVSRK

SEQ ID NO: 1783997 - protein, 7 aa, Staphylococcus epidermidis
LKSASQP

SEQ ID NO: 1783998 - protein, 8 aa, Staphylococcus epidermidis
LKSATSVI

SEQ ID NO: 1783999 - protein, 6 aa, Staphylococcus epidermidis
LKSGSS

SEQ ID NO: 1784000 - protein, 8 aa, Staphylococcus epidermidis
LKSGTMNT

SEQ ID NO: 1784001 - protein, 4 aa, Staphylococcus epidermidis
LKSK

SEQ ID NO: 1784002 - protein, 10 aa, Staphylococcus epidermidis
LKSKKDTYLN

SEQ ID NO: 1784003 - protein, 8 aa, Staphylococcus epidermidis
LKSKLEKN

SEQ ID NO: 1784004 - protein, 5 aa, Staphylococcus epidermidis
LKSNI

SEQ ID NO: 1784005 - protein, 7 aa, Staphylococcus epidermidis
LKSPNEV

SEQ ID NO: 1784006 - protein, 4 aa, Staphylococcus epidermidis
LKSQ

SEQ ID NO: 1784007 - protein, 11 aa, Staphylococcus epidermidis
LKSTKTGLEGT

SEQ ID NO: 1784008 - protein, 8 aa, Staphylococcus epidermidis
LKSTVNPV

SEQ ID NO: 1784009 - protein, 7 aa, Staphylococcus epidermidis
LKSTYSK

SEQ ID NO: 1784010 - protein, 13 aa, Staphylococcus epidermidis
LKTEDSRNALPET

SEQ ID NO: 1784011 - protein, 7 aa, Staphylococcus epidermidis
LKTGSNL

SEQ ID NO: 1784012 - protein, 9 aa, Staphylococcus epidermidis
LKTNDKSQF

SEQ ID NO: 1784013 - protein, 5 aa, Staphylococcus epidermidis
LKTNK

SEQ ID NO: 1784014 - protein, 7 aa, Staphylococcus epidermidis
LKTNSMT

SEQ ID NO: 1784015 - protein, 7 aa, Staphylococcus epidermidis
LKTPEIE

SEQ ID NO: 1784016 - protein, 9 aa, Staphylococcus epidermidis
LKTPNNGRE

SEQ ID NO: 1784017 - protein, 9 aa, Staphylococcus epidermidis
LKTTNNSYE

SEQ ID NO: 1784018 - protein, 21 aa, Staphylococcus epidermidis
LLGENGATQVYGPQKGATEKM

SEQ ID NO: 1784019 - protein, 5 aa, Staphylococcus epidermidis
LLKNG

SEQ ID NO: 1784020 - protein, 5 aa, Staphylococcus epidermidis
LLNDP

SEQ ID NO: 1784021 - protein, 13 aa, Staphylococcus epidermidis
LLNEDEVEAYFEN

SEQ ID NO: 1784022 - protein, 8 aa, Staphylococcus epidermidis
LLNPTQLG

SEQ ID NO: 1784023 - protein, 7 aa, Staphylococcus epidermidis
LLPKDSE

SEQ ID NO: 1784024 - protein, 4 aa, Staphylococcus epidermidis
LLSE

SEQ ID NO: 1784025 - protein, 15 aa, Staphylococcus epidermidis
LMDGESDESTSVKEN

SEQ ID NO: 1784026 - protein, 9 aa, Staphylococcus epidermidis
LMSGSGPTV

SEQ ID NO: 1784027 - protein, 5 aa, Staphylococcus epidermidis
LNAET

SEQ ID NO: 1784028 - protein, 35 aa, Staphylococcus epidermidis
LNAPQRETVKTNINQATTLDGLGQELQKAKDLNNA

SEQ ID NO: 1784029 - protein, 22 aa, Staphylococcus epidermidis
LNDAQRQKAIQNVQAQTTIPNV

SEQ ID NO: 1784030 - protein, 9 aa, Staphylococcus epidermidis
LNDAQTDAL

SEQ ID NO: 1784031 - protein, 7 aa, Staphylococcus epidermidis
LNDDFED

SEQ ID NO: 1784032 - protein, 10 aa, Staphylococcus epidermidis
LNDELGGGSI

SEQ ID NO: 1784033 - protein, 9 aa, Staphylococcus epidermidis
LNDEPYENE

SEQ ID NO: 1784034 - protein, 8 aa, Staphylococcus epidermidis
LNDGTDVT

SEQ ID NO: 1784035 - protein, 4 aa, Staphylococcus epidermidis
LNDK

SEQ ID NO: 1784036 - protein, 18 aa, Staphylococcus epidermidis
LNDKEFYNKTNSKGKVIS

SEQ ID NO: 1784037 - protein, 19 aa, Staphylococcus epidermidis
LNDNTPKKEEFNTNESIEV

SEQ ID NO: 1784038 - protein, 6 aa, Staphylococcus epidermidis
LNDSEL

SEQ ID NO: 1784039 - protein, 10 aa, Staphylococcus epidermidis
LNDSNIDVST

SEQ ID NO: 1784040 - protein, 20 aa, Staphylococcus epidermidis
LNDSTKVYTTPFKQKSKEKV

SEQ ID NO: 1784041 - protein, 7 aa, Staphylococcus epidermidis
LNDTVRA

SEQ ID NO: 1784042 - protein, 13 aa, Staphylococcus epidermidis
LNDVNKESYDNDI

SEQ ID NO: 1784043 - protein, 9 aa, Staphylococcus epidermidis
LNEAEEKVR

SEQ ID NO: 1784044 - protein, 7 aa, Staphylococcus epidermidis
LNEGSTP

SEQ ID NO: 1784045 - protein, 8 aa, Staphylococcus epidermidis
LNEGTFEE

SEQ ID NO: 1784046 - protein, 12 aa, Staphylococcus epidermidis
LNEHATKENAKG

SEQ ID NO: 1784047 - protein, 6 aa, Staphylococcus epidermidis
LNEHQK

SEQ ID NO: 1784048 - protein, 4 aa, Staphylococcus epidermidis
LNEI

SEQ ID NO: 1784049 - protein, 4 aa, Staphylococcus epidermidis
LNEK

SEQ ID NO: 1784050 - protein, 9 aa, Staphylococcus epidermidis
LNEKYGTHY

SEQ ID NO: 1784051 - protein, 18 aa, Staphylococcus epidermidis
LNENDGQAIKTMDDSASL

SEQ ID NO: 1784052 - protein, 7 aa, Staphylococcus epidermidis
LNEPNVR

SEQ ID NO: 1784053 - protein, 9 aa, Staphylococcus epidermidis
LNERSTGEL

SEQ ID NO: 1784054 - protein, 7 aa, Staphylococcus epidermidis
LNESPTS

SEQ ID NO: 1784055 - protein, 14 aa, Staphylococcus epidermidis
LNGENNIDIEDFSI

SEQ ID NO: 1784056 - protein, 5 aa, Staphylococcus epidermidis
LNGGP

SEQ ID NO: 1784057 - protein, 47 aa, Staphylococcus epidermidis
LNGGSADSASNESAASSAASTGSEETSASTSQSLPEGDFPETTEKIP

SEQ ID NO: 1784058 - protein, 45 aa, Staphylococcus epidermidis
LNGGSSEEGSNTSAASESTSSDVDNASATQALPEGDFPETTEKIP

SEQ ID NO: 1784059 - protein, 45 aa, Staphylococcus epidermidis
LNGGSSEEGSNTSVASESTSSDVVNASATQALPEGDFPETTEKIP

SEQ ID NO: 1784060 - protein, 8 aa, Staphylococcus epidermidis
LNGQGSDV

SEQ ID NO: 1784061 - protein, 9 aa, Staphylococcus epidermidis
LNGQKGHKK

SEQ ID NO: 1784062 - protein, 5 aa, Staphylococcus epidermidis
LNGRG

SEQ ID NO: 1784063 - protein, 12 aa, Staphylococcus epidermidis
LNGRGSDKETRH

SEQ ID NO: 1784064 - protein, 9 aa, Staphylococcus epidermidis
LNHAPKKNK

SEQ ID NO: 1784065 - protein, 6 aa, Staphylococcus epidermidis
LNIPTD

SEQ ID NO: 1784066 - protein, 4 aa, Staphylococcus epidermidis
LNKA

SEQ ID NO: 1784067 - protein, 6 aa, Staphylococcus epidermidis
LNKAND

SEQ ID NO: 1784068 - protein, 17 aa, Staphylococcus epidermidis
LNKASRELNISTPALSK

SEQ ID NO: 1784069 - protein, 13 aa, Staphylococcus epidermidis
LNKDDAREKWGEE

SEQ ID NO: 1784070 - protein, 6 aa, Staphylococcus epidermidis
LNKENE

SEQ ID NO: 1784071 - protein, 19 aa, Staphylococcus epidermidis
LNKNARQGKDPDDVSIGDL

SEQ ID NO: 1784072 - protein, 19 aa, Staphylococcus epidermidis
LNKNSTIKVGKNTVTNTTS

SEQ ID NO: 1784073 - protein, 19 aa, Staphylococcus epidermidis
LNKPKMSAQAVGGAVGSNP

SEQ ID NO: 1784074 - protein, 12 aa, Staphylococcus epidermidis
LNKPLSDHQTAL

SEQ ID NO: 1784075 - protein, 17 aa, Staphylococcus epidermidis
LNKPSTSFNFDYEGGSI

SEQ ID NO: 1784076 - protein, 8 aa, Staphylococcus epidermidis
LNKQGEEV

SEQ ID NO: 1784077 - protein, 20 aa, Staphylococcus epidermidis
LNNAQRESSMSQMKATDNLQ

SEQ ID NO: 1784078 - protein, 7 aa, Staphylococcus epidermidis
LNNDADK

SEQ ID NO: 1784079 - protein, 6 aa, Staphylococcus epidermidis
LNNDEV

SEQ ID NO: 1784080 - protein, 6 aa, Staphylococcus epidermidis
LNNDKR

SEQ ID NO: 1784081 - protein, 4 aa, Staphylococcus epidermidis
LNNQ

SEQ ID NO: 1784082 - protein, 6 aa, Staphylococcus epidermidis
LNNQTF

SEQ ID NO: 1784083 - protein, 7 aa, Staphylococcus epidermidis
LNNSEMN

SEQ ID NO: 1784084 - protein, 7 aa, Staphylococcus epidermidis
LNNSEQR

SEQ ID NO: 1784085 - protein, 35 aa, Staphylococcus epidermidis
LNPAQKSKEVQDIQAATTRPAVTQQLEDAKALNQA

SEQ ID NO: 1784086 - protein, 5 aa, Staphylococcus epidermidis
LNPES

SEQ ID NO: 1784087 - protein, 11 aa, Staphylococcus epidermidis
LNPEVANDFDN

SEQ ID NO: 1784088 - protein, 13 aa, Staphylococcus epidermidis
LNPNESEPESYDK

SEQ ID NO: 1784089 - protein, 16 aa, Staphylococcus epidermidis
LNPNSQRDIQEQISDT

SEQ ID NO: 1784090 - protein, 11 aa, Staphylococcus epidermidis
LNPSASNNQVR

SEQ ID NO: 1784091 - protein, 11 aa, Staphylococcus epidermidis
LNPTKSPSVNA

SEQ ID NO: 1784092 - protein, 23 aa, Staphylococcus epidermidis
LNQAQKDQLNKEIQQAQTRPDVE

SEQ ID NO: 1784093 - protein, 9 aa, Staphylococcus epidermidis
LNQHQKEAH

SEQ ID NO: 1784094 - protein, 10 aa, Staphylococcus epidermidis
LNQNPETNEE

SEQ ID NO: 1784095 - protein, 5 aa, Staphylococcus epidermidis
LNQPD

SEQ ID NO: 1784096 - protein, 11 aa, Staphylococcus epidermidis
LNQPKAAKELE

SEQ ID NO: 1784097 - protein, 33 aa, Staphylococcus epidermidis
LNQPQKDALKQAINGATTREQVAEKLKEAQALD

SEQ ID NO: 1784098 - protein, 6 aa, Staphylococcus epidermidis
LNQQQK

SEQ ID NO: 1784099 - protein, 5 aa, Staphylococcus epidermidis
LNQRQ

SEQ ID NO: 1784100 - protein, 6 aa, Staphylococcus epidermidis
LNQSEQ

SEQ ID NO: 1784101 - protein, 15 aa, Staphylococcus epidermidis
LNQSIQNSSLNTDLE

SEQ ID NO: 1784102 - protein, 10 aa, Staphylococcus epidermidis
LNQTKENGKR

SEQ ID NO: 1784103 - protein, 10 aa, Staphylococcus epidermidis
LNREDADTIS

SEQ ID NO: 1784104 - protein, 11 aa, Staphylococcus epidermidis
LNRGERSGEDV

SEQ ID NO: 1784105 - protein, 5 aa, Staphylococcus epidermidis
LNRHK

SEQ ID NO: 1784106 - protein, 5 aa, Staphylococcus epidermidis
LNRHR

SEQ ID NO: 1784107 - protein, 6 aa, Staphylococcus epidermidis
LNRKQA

SEQ ID NO: 1784108 - protein, 26 aa, Staphylococcus epidermidis
LNRQGPDIGEKYRTGLYSKDQSHLDE

SEQ ID NO: 1784109 - protein, 11 aa, Staphylococcus epidermidis
LNRSNSRNKLK

SEQ ID NO: 1784110 - protein, 16 aa, Staphylococcus epidermidis
LNSDNELQFDVEKAEN

SEQ ID NO: 1784111 - protein, 9 aa, Staphylococcus epidermidis
LNSGQTLAE

SEQ ID NO: 1784112 - protein, 6 aa, Staphylococcus epidermidis
LNSGRT

SEQ ID NO: 1784113 - protein, 11 aa, Staphylococcus epidermidis
LNSKSYGSIKR

SEQ ID NO: 1784114 - protein, 13 aa, Staphylococcus epidermidis
LNSLGNNRTPFGK

SEQ ID NO: 1784115 - protein, 11 aa, Staphylococcus epidermidis
LNSPNIKTRKR

SEQ ID NO: 1784116 - protein, 13 aa, Staphylococcus epidermidis
LNSQEQNSTPFTP

SEQ ID NO: 1784117 - protein, 8 aa, Staphylococcus epidermidis
LNSTRAAV

SEQ ID NO: 1784118 - protein, 8 aa, Staphylococcus epidermidis
LNTETPIG

SEQ ID NO: 1784119 - protein, 15 aa, Staphylococcus epidermidis
LNTGKKFNNNKQALR

SEQ ID NO: 1784120 - protein, 6 aa, Staphylococcus epidermidis
LNTMSG

SEQ ID NO: 1784121 - protein, 8 aa, Staphylococcus epidermidis
LNTSTFEG

SEQ ID NO: 1784122 - protein, 13 aa, Staphylococcus epidermidis
LNVPEESPSGNVH

SEQ ID NO: 1784123 - protein, 8 aa, Staphylococcus epidermidis
LNYPETCP

SEQ ID NO: 1784124 - protein, 10 aa, Staphylococcus epidermidis
LNYSENIDGM

SEQ ID NO: 1784125 - protein, 11 aa, Staphylococcus epidermidis
LNYTQDPNTEK

SEQ ID NO: 1784126 - protein, 9 aa, Staphylococcus epidermidis
LPADSSLAN

SEQ ID NO: 1784127 - protein, 7 aa, Staphylococcus epidermidis
LPANRNT

SEQ ID NO: 1784128 - protein, 11 aa, Staphylococcus epidermidis
LPASPGAATGS

SEQ ID NO: 1784129 - protein, 5 aa, Staphylococcus epidermidis
LPASS

SEQ ID NO: 1784130 - protein, 7 aa, Staphylococcus epidermidis
LPDEKEK

SEQ ID NO: 1784131 - protein, 10 aa, Staphylococcus epidermidis
LPDGSTSKRE

SEQ ID NO: 1784132 - protein, 4 aa, Staphylococcus epidermidis
LPDK

SEQ ID NO: 1784133 - protein, 6 aa, Staphylococcus epidermidis
LPDKDR

SEQ ID NO: 1784134 - protein, 6 aa, Staphylococcus epidermidis
LPEALS

SEQ ID NO: 1784135 - protein, 4 aa, Staphylococcus epidermidis
LPEE

SEQ ID NO: 1784136 - protein, 5 aa, Staphylococcus epidermidis
LPEEH

SEQ ID NO: 1784137 - protein, 18 aa, Staphylococcus epidermidis
LPEGPKYYPDDQISDHPE

SEQ ID NO: 1784138 - protein, 18 aa, Staphylococcus epidermidis
LPEGPKYYPDNQISDHPE

SEQ ID NO: 1784139 - protein, 4 aa, Staphylococcus epidermidis
LPEM

SEQ ID NO: 1784140 - protein, 6 aa, Staphylococcus epidermidis
LPEPSL

SEQ ID NO: 1784141 - protein, 10 aa, Staphylococcus epidermidis
LPEPTNAQQL

SEQ ID NO: 1784142 - protein, 16 aa, Staphylococcus epidermidis
LPEQNDKMIEVLKHFE

SEQ ID NO: 1784143 - protein, 6 aa, Staphylococcus epidermidis
LPERDR

SEQ ID NO: 1784144 - protein, 24 aa, Staphylococcus epidermidis
LPETDLTESVATADEVYKTNKEIP

SEQ ID NO: 1784145 - protein, 6 aa, Staphylococcus epidermidis
LPETNE

SEQ ID NO: 1784146 - protein, 6 aa, Staphylococcus epidermidis
LPETSY

SEQ ID NO: 1784147 - protein, 4 aa, Staphylococcus epidermidis
LPFG

SEQ ID NO: 1784148 - protein, 6 aa, Staphylococcus epidermidis
LPGALS

SEQ ID NO: 1784149 - protein, 5 aa, Staphylococcus epidermidis
LPGED

SEQ ID NO: 1784150 - protein, 4 aa, Staphylococcus epidermidis
LPGI

SEQ ID NO: 1784151 - protein, 11 aa, Staphylococcus epidermidis
LPGIDRPEAVN

SEQ ID NO: 1784152 - protein, 13 aa, Staphylococcus epidermidis
LPGKDVKLSTNEQ

SEQ ID NO: 1784153 - protein, 10 aa, Staphylococcus epidermidis
LPGSSIKGAI

SEQ ID NO: 1784154 - protein, 4 aa, Staphylococcus epidermidis
LPGT

SEQ ID NO: 1784155 - protein, 10 aa, Staphylococcus epidermidis
LPGTKTVTSD

SEQ ID NO: 1784156 - protein, 8 aa, Staphylococcus epidermidis
LPGVSKED

SEQ ID NO: 1784157 - protein, 17 aa, Staphylococcus epidermidis
LPHAPSAQLAEYQGDQI

SEQ ID NO: 1784158 - protein, 15 aa, Staphylococcus epidermidis
LPIEASDINTDPFTY

SEQ ID NO: 1784159 - protein, 5 aa, Staphylococcus epidermidis
LPIEK

SEQ ID NO: 1784160 - protein, 8 aa, Staphylococcus epidermidis
LPISTPDE

SEQ ID NO: 1784161 - protein, 7 aa, Staphylococcus epidermidis
LPKASSM

SEQ ID NO: 1784162 - protein, 4 aa, Staphylococcus epidermidis
LPKE

SEQ ID NO: 1784163 - protein, 4 aa, Staphylococcus epidermidis
LPKG

SEQ ID NO: 1784164 - protein, 11 aa, Staphylococcus epidermidis
LPKIETPVDNK

SEQ ID NO: 1784165 - protein, 77 aa, Staphylococcus epidermidis
LPKNDKSQRPARGKTIQAKTRGKSLDKAKDDHNNKGNKKKRKQRKGKNARKKDKQGKTNHKPFYKDKSVKKKSRRKK

SEQ ID NO: 1784166 - protein, 8 aa, Staphylococcus epidermidis
LPKSIEDR

SEQ ID NO: 1784167 - protein, 5 aa, Staphylococcus epidermidis
LPKSV

SEQ ID NO: 1784168 - protein, 9 aa, Staphylococcus epidermidis
LPKTNSGKI

SEQ ID NO: 1784169 - protein, 6 aa, Staphylococcus epidermidis
LPLTTN

SEQ ID NO: 1784170 - protein, 11 aa, Staphylococcus epidermidis
LPMSNDKSEGF

SEQ ID NO: 1784171 - protein, 8 aa, Staphylococcus epidermidis
LPNAPQEK

SEQ ID NO: 1784172 - protein, 8 aa, Staphylococcus epidermidis
LPNDDIQS

SEQ ID NO: 1784173 - protein, 8 aa, Staphylococcus epidermidis
LPNDSIAS

SEQ ID NO: 1784174 - protein, 7 aa, Staphylococcus epidermidis
LPNEAPH

SEQ ID NO: 1784175 - protein, 8 aa, Staphylococcus epidermidis
LPNENSRL

SEQ ID NO: 1784176 - protein, 6 aa, Staphylococcus epidermidis
LPNETG

SEQ ID NO: 1784177 - protein, 15 aa, Staphylococcus epidermidis
LPNITEMDEEKKDQI

SEQ ID NO: 1784178 - protein, 11 aa, Staphylococcus epidermidis
LPNNKEVNKPL

SEQ ID NO: 1784179 - protein, 5 aa, Staphylococcus epidermidis
LPNPL

SEQ ID NO: 1784180 - protein, 8 aa, Staphylococcus epidermidis
LPNYEANS

SEQ ID NO: 1784181 - protein, 6 aa, Staphylococcus epidermidis
LPPDKK

SEQ ID NO: 1784182 - protein, 4 aa, Staphylococcus epidermidis
LPQI

SEQ ID NO: 1784183 - protein, 4 aa, Staphylococcus epidermidis
LPQL

SEQ ID NO: 1784184 - protein, 7 aa, Staphylococcus epidermidis
LPQSDIE

SEQ ID NO: 1784185 - protein, 8 aa, Staphylococcus epidermidis
LPQSNKTE

SEQ ID NO: 1784186 - protein, 4 aa, Staphylococcus epidermidis
LPRK

SEQ ID NO: 1784187 - protein, 12 aa, Staphylococcus epidermidis
LPRQSGVSDRPM

SEQ ID NO: 1784188 - protein, 17 aa, Staphylococcus epidermidis
LPRSQMGVDTEDNYEPK

SEQ ID NO: 1784189 - protein, 5 aa, Staphylococcus epidermidis
LPRTD

SEQ ID NO: 1784190 - protein, 5 aa, Staphylococcus epidermidis
LPSAS

SEQ ID NO: 1784191 - protein, 7 aa, Staphylococcus epidermidis
LPSDELQ

SEQ ID NO: 1784192 - protein, 7 aa, Staphylococcus epidermidis
LPSDNED

SEQ ID NO: 1784193 - protein, 12 aa, Staphylococcus epidermidis
LPSPSNPPSGCP

SEQ ID NO: 1784194 - protein, 4 aa, Staphylococcus epidermidis
LPST

SEQ ID NO: 1784195 - protein, 13 aa, Staphylococcus epidermidis
LPSTRAKRPFNKS

SEQ ID NO: 1784196 - protein, 5 aa, Staphylococcus epidermidis
LPSTS

SEQ ID NO: 1784197 - protein, 4 aa, Staphylococcus epidermidis
LPTD

SEQ ID NO: 1784198 - protein, 6 aa, Staphylococcus epidermidis
LPTEDA

SEQ ID NO: 1784199 - protein, 8 aa, Staphylococcus epidermidis
LPTGSGKS

SEQ ID NO: 1784200 - protein, 4 aa, Staphylococcus epidermidis
LPTI

SEQ ID NO: 1784201 - protein, 11 aa, Staphylococcus epidermidis
LPTNQTARFSN

SEQ ID NO: 1784202 - protein, 4 aa, Staphylococcus epidermidis
LPTP

SEQ ID NO: 1784203 - protein, 11 aa, Staphylococcus epidermidis
LPTQNKVNTFS

SEQ ID NO: 1784204 - protein, 12 aa, Staphylococcus epidermidis
LPTTEEDDEEMD

SEQ ID NO: 1784205 - protein, 4 aa, Staphylococcus epidermidis
LPYP

SEQ ID NO: 1784206 - protein, 5 aa, Staphylococcus epidermidis
LQAKE

SEQ ID NO: 1784207 - protein, 18 aa, Staphylococcus epidermidis
LQAKRQQNQNSEEDSIQK

SEQ ID NO: 1784208 - protein, 6 aa, Staphylococcus epidermidis
LQDEDK

SEQ ID NO: 1784209 - protein, 10 aa, Staphylococcus epidermidis
LQDELKSQGV

SEQ ID NO: 1784210 - protein, 5 aa, Staphylococcus epidermidis
LQEKN

SEQ ID NO: 1784211 - protein, 13 aa, Staphylococcus epidermidis
LQEKQGIKGTTFT

SEQ ID NO: 1784212 - protein, 5 aa, Staphylococcus epidermidis
LQERS

SEQ ID NO: 1784213 - protein, 5 aa, Staphylococcus epidermidis
LQETA

SEQ ID NO: 1784214 - protein, 8 aa, Staphylococcus epidermidis
LQETSNAA

SEQ ID NO: 1784215 - protein, 5 aa, Staphylococcus epidermidis
LQEVS

SEQ ID NO: 1784216 - protein, 9 aa, Staphylococcus epidermidis
LQGESTVDS

SEQ ID NO: 1784217 - protein, 4 aa, Staphylococcus epidermidis
LQGS

SEQ ID NO: 1784218 - protein, 8 aa, Staphylococcus epidermidis
LQKAAEKI

SEQ ID NO: 1784219 - protein, 10 aa, Staphylococcus epidermidis
LQKKQEFNGV

SEQ ID NO: 1784220 - protein, 5 aa, Staphylococcus epidermidis
LQKNH

SEQ ID NO: 1784221 - protein, 7 aa, Staphylococcus epidermidis
LQKQLGK

SEQ ID NO: 1784222 - protein, 9 aa, Staphylococcus epidermidis
LQKSKLTDS

SEQ ID NO: 1784223 - protein, 8 aa, Staphylococcus epidermidis
LQKYTSNI

SEQ ID NO: 1784224 - protein, 6 aa, Staphylococcus epidermidis
LQNEKN

SEQ ID NO: 1784225 - protein, 11 aa, Staphylococcus epidermidis
LQNKDDGHQSH

SEQ ID NO: 1784226 - protein, 5 aa, Staphylococcus epidermidis
LQNQY

SEQ ID NO: 1784227 - protein, 6 aa, Staphylococcus epidermidis
LQNSND

SEQ ID NO: 1784228 - protein, 7 aa, Staphylococcus epidermidis
LQPGQTV

SEQ ID NO: 1784229 - protein, 8 aa, Staphylococcus epidermidis
LQPKPGSS

SEQ ID NO: 1784230 - protein, 15 aa, Staphylococcus epidermidis
LQQGKLDQYEITGQG

SEQ ID NO: 1784231 - protein, 14 aa, Staphylococcus epidermidis
LQQKNAPESQKETT

SEQ ID NO: 1784232 - protein, 15 aa, Staphylococcus epidermidis
LQQKTTAFGQSTTVT

SEQ ID NO: 1784233 - protein, 6 aa, Staphylococcus epidermidis
LQQTNY

SEQ ID NO: 1784234 - protein, 23 aa, Staphylococcus epidermidis
LQRNEERSKASKLKKKDSTPTLS

SEQ ID NO: 1784235 - protein, 8 aa, Staphylococcus epidermidis
LQSDEKDF

SEQ ID NO: 1784236 - protein, 6 aa, Staphylococcus epidermidis
LQSEKK

SEQ ID NO: 1784237 - protein, 8 aa, Staphylococcus epidermidis
LQSGNYTD

SEQ ID NO: 1784238 - protein, 6 aa, Staphylococcus epidermidis
LQSKYG

SEQ ID NO: 1784239 - protein, 5 aa, Staphylococcus epidermidis
LQTKH

SEQ ID NO: 1784240 - protein, 7 aa, Staphylococcus epidermidis
LQTPTHG

SEQ ID NO: 1784241 - protein, 8 aa, Staphylococcus epidermidis
LQTRTQHK

SEQ ID NO: 1784242 - protein, 4 aa, Staphylococcus epidermidis
LQTT

SEQ ID NO: 1784243 - protein, 5 aa, Staphylococcus epidermidis
LQTVT

SEQ ID NO: 1784244 - protein, 15 aa, Staphylococcus epidermidis
LQYPEGDFWKSKMPQ

SEQ ID NO: 1784245 - protein, 6 aa, Staphylococcus epidermidis
LRDDKG

SEQ ID NO: 1784246 - protein, 17 aa, Staphylococcus epidermidis
LRDGEQAPGNSLKHGEK

SEQ ID NO: 1784247 - protein, 10 aa, Staphylococcus epidermidis
LRDINGTEIY

SEQ ID NO: 1784248 - protein, 4 aa, Staphylococcus epidermidis
LRDK

SEQ ID NO: 1784249 - protein, 9 aa, Staphylococcus epidermidis
LRDNKGVEV

SEQ ID NO: 1784250 - protein, 11 aa, Staphylococcus epidermidis
LRDSDVNRAPY

SEQ ID NO: 1784251 - protein, 7 aa, Staphylococcus epidermidis
LREEGRE

SEQ ID NO: 1784252 - protein, 5 aa, Staphylococcus epidermidis
LREEP

SEQ ID NO: 1784253 - protein, 4 aa, Staphylococcus epidermidis
LREG

SEQ ID NO: 1784254 - protein, 6 aa, Staphylococcus epidermidis
LREGDE

SEQ ID NO: 1784255 - protein, 7 aa, Staphylococcus epidermidis
LREHKET

SEQ ID NO: 1784256 - protein, 4 aa, Staphylococcus epidermidis
LREK

SEQ ID NO: 1784257 - protein, 10 aa, Staphylococcus epidermidis
LREQQNKEVY

SEQ ID NO: 1784258 - protein, 12 aa, Staphylococcus epidermidis
LREQTGLKEQSL

SEQ ID NO: 1784259 - protein, 4 aa, Staphylococcus epidermidis
LRER

SEQ ID NO: 1784260 - protein, 13 aa, Staphylococcus epidermidis
LRGAKAAAKQINP

SEQ ID NO: 1784261 - protein, 8 aa, Staphylococcus epidermidis
LRGNMDAS

SEQ ID NO: 1784262 - protein, 5 aa, Staphylococcus epidermidis
LRGVA

SEQ ID NO: 1784263 - protein, 13 aa, Staphylococcus epidermidis
LRKPGERNTSLQK

SEQ ID NO: 1784264 - protein, 13 aa, Staphylococcus epidermidis
LRKRNTKKVQKNG

SEQ ID NO: 1784265 - protein, 11 aa, Staphylococcus epidermidis
LRMSGNKPDLI

SEQ ID NO: 1784266 - protein, 11 aa, Staphylococcus epidermidis
LRNQKDDTAIE

SEQ ID NO: 1784267 - protein, 14 aa, Staphylococcus epidermidis
LRPKQSKLGKLERA

SEQ ID NO: 1784268 - protein, 10 aa, Staphylococcus epidermidis
LRPSLEETGI

SEQ ID NO: 1784269 - protein, 35 aa, Staphylococcus epidermidis
LRQAEKDLKNNTEATTSQLKRANDAVQKQATKHKE

SEQ ID NO: 1784270 - protein, 4 aa, Staphylococcus epidermidis
LRQQ

SEQ ID NO: 1784271 - protein, 14 aa, Staphylococcus epidermidis
LRQTPKQAETRKEL

SEQ ID NO: 1784272 - protein, 4 aa, Staphylococcus epidermidis
LRRG

SEQ ID NO: 1784273 - protein, 10 aa, Staphylococcus epidermidis
LRRKRGKRVK

SEQ ID NO: 1784274 - protein, 8 aa, Staphylococcus epidermidis
LRSTSGSM

SEQ ID NO: 1784275 - protein, 12 aa, Staphylococcus epidermidis
LRTEPKLSLPSA

SEQ ID NO: 1784276 - protein, 7 aa, Staphylococcus epidermidis
LRTGAIQ

SEQ ID NO: 1784277 - protein, 10 aa, Staphylococcus epidermidis
LRTNKETALG

SEQ ID NO: 1784278 - protein, 8 aa, Staphylococcus epidermidis
LRTPSDLG

SEQ ID NO: 1784279 - protein, 9 aa, Staphylococcus epidermidis
LSAEDQATF

SEQ ID NO: 1784280 - protein, 8 aa, Staphylococcus epidermidis
LSAGTANE

SEQ ID NO: 1784281 - protein, 9 aa, Staphylococcus epidermidis
LSASKSSLQ

SEQ ID NO: 1784282 - protein, 5 aa, Staphylococcus epidermidis
LSATQ

SEQ ID NO: 1784283 - protein, 7 aa, Staphylococcus epidermidis
LSDEDDL

SEQ ID NO: 1784284 - protein, 23 aa, Staphylococcus epidermidis
LSDEDLKGEELKEELQRSSAVSK

SEQ ID NO: 1784285 - protein, 23 aa, Staphylococcus epidermidis
LSDEDLKGEGLKEELQRSNAVSK

SEQ ID NO: 1784286 - protein, 8 aa, Staphylococcus epidermidis
LSDGQKQK

SEQ ID NO: 1784287 - protein, 11 aa, Staphylococcus epidermidis
LSDGSGEAQFA

SEQ ID NO: 1784288 - protein, 5 aa, Staphylococcus epidermidis
LSDQK

SEQ ID NO: 1784289 - protein, 9 aa, Staphylococcus epidermidis
LSDRSDLAK

SEQ ID NO: 1784290 - protein, 13 aa, Staphylococcus epidermidis
LSDTLKRGKEQVD

SEQ ID NO: 1784291 - protein, 8 aa, Staphylococcus epidermidis
LSDTLNGV

SEQ ID NO: 1784292 - protein, 6 aa, Staphylococcus epidermidis
LSDVRK

SEQ ID NO: 1784293 - protein, 7 aa, Staphylococcus epidermidis
LSDVRKD

SEQ ID NO: 1784294 - protein, 14 aa, Staphylococcus epidermidis
LSEAERNWLNQQKS

SEQ ID NO: 1784295 - protein, 5 aa, Staphylococcus epidermidis
LSEAP

SEQ ID NO: 1784296 - protein, 8 aa, Staphylococcus epidermidis
LSEASEDE

SEQ ID NO: 1784297 - protein, 16 aa, Staphylococcus epidermidis
LSEEEAKKYGLNSEDT

SEQ ID NO: 1784298 - protein, 8 aa, Staphylococcus epidermidis
LSEGDSIN

SEQ ID NO: 1784299 - protein, 4 aa, Staphylococcus epidermidis
LSEK

SEQ ID NO: 1784300 - protein, 7 aa, Staphylococcus epidermidis
LSEKEGR

SEQ ID NO: 1784301 - protein, 4 aa, Staphylococcus epidermidis
LSEN

SEQ ID NO: 1784302 - protein, 8 aa, Staphylococcus epidermidis
LSENLDKY

SEQ ID NO: 1784303 - protein, 12 aa, Staphylococcus epidermidis
LSENTKKLKAET

SEQ ID NO: 1784304 - protein, 22 aa, Staphylococcus epidermidis
LSEPRQDNSSTTYTSAKEGQPD

SEQ ID NO: 1784305 - protein, 4 aa, Staphylococcus epidermidis
LSEQ

SEQ ID NO: 1784306 - protein, 8 aa, Staphylococcus epidermidis
LSEQDRAI

SEQ ID NO: 1784307 - protein, 9 aa, Staphylococcus epidermidis
LSEQEEARY

SEQ ID NO: 1784308 - protein, 25 aa, Staphylococcus epidermidis
LSEQFAKSKELEDQIRKSLEGLGYG

SEQ ID NO: 1784309 - protein, 20 aa, Staphylococcus epidermidis
LSEQGIEEAKTAGKKVEENK

SEQ ID NO: 1784310 - protein, 13 aa, Staphylococcus epidermidis
LSEQTDKTNGSVS

SEQ ID NO: 1784311 - protein, 10 aa, Staphylococcus epidermidis
LSEQTTHNGP

SEQ ID NO: 1784312 - protein, 6 aa, Staphylococcus epidermidis
LSERRK

SEQ ID NO: 1784313 - protein, 7 aa, Staphylococcus epidermidis
LSESNKT

SEQ ID NO: 1784314 - protein, 51 aa, Staphylococcus epidermidis
LSEVSGKGNDVLRKDDVDNSQKQASQPAKSESKSQDSGSKKSNDNPSKPVI

SEQ ID NO: 1784315 - protein, 7 aa, Staphylococcus epidermidis
LSGARPA

SEQ ID NO: 1784316 - protein, 12 aa, Staphylococcus epidermidis
LSGDKTKKSYKY

SEQ ID NO: 1784317 - protein, 7 aa, Staphylococcus epidermidis
LSGGEAQ

SEQ ID NO: 1784318 - protein, 8 aa, Staphylococcus epidermidis
LSGGEAQR

SEQ ID NO: 1784319 - protein, 7 aa, Staphylococcus epidermidis
LSGGEQK

SEQ ID NO: 1784320 - protein, 8 aa, Staphylococcus epidermidis
LSGRTKDR

SEQ ID NO: 1784321 - protein, 8 aa, Staphylococcus epidermidis
LSGTVTPQ

SEQ ID NO: 1784322 - protein, 4 aa, Staphylococcus epidermidis
LSKA

SEQ ID NO: 1784323 - protein, 14 aa, Staphylococcus epidermidis
LSKAVSETVKNGNF

SEQ ID NO: 1784324 - protein, 10 aa, Staphylococcus epidermidis
LSKEADQSGY

SEQ ID NO: 1784325 - protein, 6 aa, Staphylococcus epidermidis
LSKEGM

SEQ ID NO: 1784326 - protein, 9 aa, Staphylococcus epidermidis
LSKEKEPQI

SEQ ID NO: 1784327 - protein, 10 aa, Staphylococcus epidermidis
LSKEKVGTFD

SEQ ID NO: 1784328 - protein, 7 aa, Staphylococcus epidermidis
LSKGQQC

SEQ ID NO: 1784329 - protein, 11 aa, Staphylococcus epidermidis
LSKITDLTDRS

SEQ ID NO: 1784330 - protein, 8 aa, Staphylococcus epidermidis
LSKKENYK

SEQ ID NO: 1784331 - protein, 7 aa, Staphylococcus epidermidis
LSKKKQD

SEQ ID NO: 1784332 - protein, 18 aa, Staphylococcus epidermidis
LSKKSETNRITGITSKPP

SEQ ID NO: 1784333 - protein, 8 aa, Staphylococcus epidermidis
LSKKTSHH

SEQ ID NO: 1784334 - protein, 14 aa, Staphylococcus epidermidis
LSKSELEKLTSQGQ

SEQ ID NO: 1784335 - protein, 9 aa, Staphylococcus epidermidis
LSKSRDTYH

SEQ ID NO: 1784336 - protein, 9 aa, Staphylococcus epidermidis
LSLSKDKEA

SEQ ID NO: 1784337 - protein, 21 aa, Staphylococcus epidermidis
LSNASEKVATASSLSKDEVKE

SEQ ID NO: 1784338 - protein, 7 aa, Staphylococcus epidermidis
LSNDEGK

SEQ ID NO: 1784339 - protein, 14 aa, Staphylococcus epidermidis
LSNDSTKHKYDVTT

SEQ ID NO: 1784340 - protein, 4 aa, Staphylococcus epidermidis
LSNE

SEQ ID NO: 1784341 - protein, 11 aa, Staphylococcus epidermidis
LSNEDSLAQAM

SEQ ID NO: 1784342 - protein, 6 aa, Staphylococcus epidermidis
LSNGED

SEQ ID NO: 1784343 - protein, 8 aa, Staphylococcus epidermidis
LSNGERYD

SEQ ID NO: 1784344 - protein, 13 aa, Staphylococcus epidermidis
LSNGEVGRIIMKM

SEQ ID NO: 1784345 - protein, 11 aa, Staphylococcus epidermidis
LSNGKTVDERM

SEQ ID NO: 1784346 - protein, 6 aa, Staphylococcus epidermidis
LSNKSV

SEQ ID NO: 1784347 - protein, 10 aa, Staphylococcus epidermidis
LSNNQKFTST

SEQ ID NO: 1784348 - protein, 6 aa, Staphylococcus epidermidis
LSNNTD

SEQ ID NO: 1784349 - protein, 11 aa, Staphylococcus epidermidis
LSNYSPKTRNI

SEQ ID NO: 1784350 - protein, 11 aa, Staphylococcus epidermidis
LSPDDTSNDET

SEQ ID NO: 1784351 - protein, 6 aa, Staphylococcus epidermidis
LSPEKG

SEQ ID NO: 1784352 - protein, 6 aa, Staphylococcus epidermidis
LSPERE

SEQ ID NO: 1784353 - protein, 5 aa, Staphylococcus epidermidis
LSPGL

SEQ ID NO: 1784354 - protein, 6 aa, Staphylococcus epidermidis
LSPIGG

SEQ ID NO: 1784355 - protein, 6 aa, Staphylococcus epidermidis
LSPLNS

SEQ ID NO: 1784356 - protein, 5 aa, Staphylococcus epidermidis
LSPNC

SEQ ID NO: 1784357 - protein, 5 aa, Staphylococcus epidermidis
LSPND

SEQ ID NO: 1784358 - protein, 5 aa, Staphylococcus epidermidis
LSPNQ

SEQ ID NO: 1784359 - protein, 17 aa, Staphylococcus epidermidis
LSPNRARISSTSGKIDK

SEQ ID NO: 1784360 - protein, 4 aa, Staphylococcus epidermidis
LSPQ

SEQ ID NO: 1784361 - protein, 9 aa, Staphylococcus epidermidis
LSPQDGEAN

SEQ ID NO: 1784362 - protein, 6 aa, Staphylococcus epidermidis
LSPSDS

SEQ ID NO: 1784363 - protein, 18 aa, Staphylococcus epidermidis
LSPSELSKKIGNKKSTIT

SEQ ID NO: 1784364 - protein, 12 aa, Staphylococcus epidermidis
LSPTDKRLQSDK

SEQ ID NO: 1784365 - protein, 10 aa, Staphylococcus epidermidis
LSPTPGRDNH

SEQ ID NO: 1784366 - protein, 5 aa, Staphylococcus epidermidis
LSPYD

SEQ ID NO: 1784367 - protein, 4 aa, Staphylococcus epidermidis
LSQD

SEQ ID NO: 1784368 - protein, 7 aa, Staphylococcus epidermidis
LSQDNEI

SEQ ID NO: 1784369 - protein, 33 aa, Staphylococcus epidermidis
LSQDNHEGRLSTNESNNSINAEKTINSKNDFEQ

SEQ ID NO: 1784370 - protein, 4 aa, Staphylococcus epidermidis
LSQI

SEQ ID NO: 1784371 - protein, 4 aa, Staphylococcus epidermidis
LSQK

SEQ ID NO: 1784372 - protein, 6 aa, Staphylococcus epidermidis
LSQKST

SEQ ID NO: 1784373 - protein, 18 aa, Staphylococcus epidermidis
LSQLTSSSLSGGNGKKLQ

SEQ ID NO: 1784374 - protein, 10 aa, Staphylococcus epidermidis
LSQNSSDELN

SEQ ID NO: 1784375 - protein, 5 aa, Staphylococcus epidermidis
LSQSA

SEQ ID NO: 1784376 - protein, 6 aa, Staphylococcus epidermidis
LSQTED

SEQ ID NO: 1784377 - protein, 8 aa, Staphylococcus epidermidis
LSQTGALE

SEQ ID NO: 1784378 - protein, 5 aa, Staphylococcus epidermidis
LSQTP

SEQ ID NO: 1784379 - protein, 10 aa, Staphylococcus epidermidis
LSQTQKEQFQ

SEQ ID NO: 1784380 - protein, 11 aa, Staphylococcus epidermidis
LSQVDNTEYER

SEQ ID NO: 1784381 - protein, 8 aa, Staphylococcus epidermidis
LSRDGKET

SEQ ID NO: 1784382 - protein, 10 aa, Staphylococcus epidermidis
LSREEQQKVY

SEQ ID NO: 1784383 - protein, 7 aa, Staphylococcus epidermidis
LSRETGV

SEQ ID NO: 1784384 - protein, 11 aa, Staphylococcus epidermidis
LSRGNGTDNDR

SEQ ID NO: 1784385 - protein, 7 aa, Staphylococcus epidermidis
LSRKTHE

SEQ ID NO: 1784386 - protein, 21 aa, Staphylococcus epidermidis
LSSASEKVATASSLSKEEVKE

SEQ ID NO: 1784387 - protein, 11 aa, Staphylococcus epidermidis
LSSEAEYQRGY

SEQ ID NO: 1784388 - protein, 6 aa, Staphylococcus epidermidis
LSSEAW

SEQ ID NO: 1784389 - protein, 10 aa, Staphylococcus epidermidis
LSSEGLAKEL

SEQ ID NO: 1784390 - protein, 15 aa, Staphylococcus epidermidis
LSSEGSLSEAGGPQY

SEQ ID NO: 1784391 - protein, 8 aa, Staphylococcus epidermidis
LSSEVKEY

SEQ ID NO: 1784392 - protein, 7 aa, Staphylococcus epidermidis
LSSGDTF

SEQ ID NO: 1784393 - protein, 6 aa, Staphylococcus epidermidis
LSSQEF

SEQ ID NO: 1784394 - protein, 4 aa, Staphylococcus epidermidis
LSSS

SEQ ID NO: 1784395 - protein, 10 aa, Staphylococcus epidermidis
LSSSDSYPRN

SEQ ID NO: 1784396 - protein, 6 aa, Staphylococcus epidermidis
LSSSSN

SEQ ID NO: 1784397 - protein, 5 aa, Staphylococcus epidermidis
LSSTT

SEQ ID NO: 1784398 - protein, 14 aa, Staphylococcus epidermidis
LSTGCDDKNFEDNI

SEQ ID NO: 1784399 - protein, 8 aa, Staphylococcus epidermidis
LSTGESAF

SEQ ID NO: 1784400 - protein, 9 aa, Staphylococcus epidermidis
LSTGGNMKE

SEQ ID NO: 1784401 - protein, 5 aa, Staphylococcus epidermidis
LSTGH

SEQ ID NO: 1784402 - protein, 8 aa, Staphylococcus epidermidis
LSTKEQLI

SEQ ID NO: 1784403 - protein, 5 aa, Staphylococcus epidermidis
LSTRY

SEQ ID NO: 1784404 - protein, 4 aa, Staphylococcus epidermidis
LSVG

SEQ ID NO: 1784405 - protein, 33 aa, Staphylococcus epidermidis
LSVPEKDTARLRYTQTEKAIADPNTTSTAQYSW

SEQ ID NO: 1784406 - protein, 6 aa, Staphylococcus epidermidis
LSVPPS

SEQ ID NO: 1784407 - protein, 9 aa, Staphylococcus epidermidis
LSVSDQRRE

SEQ ID NO: 1784408 - protein, 16 aa, Staphylococcus epidermidis
LSYDSNEKVTDIESEV

SEQ ID NO: 1784409 - protein, 18 aa, Staphylococcus epidermidis
LSYDSNEKVTDTESEVDK

SEQ ID NO: 1784410 - protein, 7 aa, Staphylococcus epidermidis
LSYEEAA

SEQ ID NO: 1784411 - protein, 14 aa, Staphylococcus epidermidis
LTAADQQKYQSQLK

SEQ ID NO: 1784412 - protein, 9 aa, Staphylococcus epidermidis
LTAEEKDDV

SEQ ID NO: 1784413 - protein, 5 aa, Staphylococcus epidermidis
LTAKN

SEQ ID NO: 1784414 - protein, 8 aa, Staphylococcus epidermidis
LTAYPGNY

SEQ ID NO: 1784415 - protein, 4 aa, Staphylococcus epidermidis
LTDA

SEQ ID NO: 1784416 - protein, 31 aa, Staphylococcus epidermidis
LTDAQREKLKEQINNSTSRDDIKQKIEQAKQ

SEQ ID NO: 1784417 - protein, 11 aa, Staphylococcus epidermidis
LTDATRDTIQD

SEQ ID NO: 1784418 - protein, 10 aa, Staphylococcus epidermidis
LTDDAEKTKA

SEQ ID NO: 1784419 - protein, 5 aa, Staphylococcus epidermidis
LTDDQ

SEQ ID NO: 1784420 - protein, 7 aa, Staphylococcus epidermidis
LTDEPIK

SEQ ID NO: 1784421 - protein, 7 aa, Staphylococcus epidermidis
LTDEQKA

SEQ ID NO: 1784422 - protein, 8 aa, Staphylococcus epidermidis
LTDKGQSL

SEQ ID NO: 1784423 - protein, 10 aa, Staphylococcus epidermidis
LTDNKEIATN

SEQ ID NO: 1784424 - protein, 6 aa, Staphylococcus epidermidis
LTDSEH

SEQ ID NO: 1784425 - protein, 4 aa, Staphylococcus epidermidis
LTEA

SEQ ID NO: 1784426 - protein, 21 aa, Staphylococcus epidermidis
LTEEEKEKISYKNGAKLLGLE

SEQ ID NO: 1784427 - protein, 14 aa, Staphylococcus epidermidis
LTEEQAKEKGYDVK

SEQ ID NO: 1784428 - protein, 12 aa, Staphylococcus epidermidis
LTEEQANQKLGE

SEQ ID NO: 1784429 - protein, 18 aa, Staphylococcus epidermidis
LTEEQRQQFEAEGRKPSI

SEQ ID NO: 1784430 - protein, 19 aa, Staphylococcus epidermidis
LTEERSKRLEKTRKALEEY

SEQ ID NO: 1784431 - protein, 12 aa, Staphylococcus epidermidis
LTEGNLRKANEA

SEQ ID NO: 1784432 - protein, 10 aa, Staphylococcus epidermidis
LTEKGMQSAQ

SEQ ID NO: 1784433 - protein, 13 aa, Staphylococcus epidermidis
LTEKGVEFDFNKK

SEQ ID NO: 1784434 - protein, 24 aa, Staphylococcus epidermidis
LTEKQKEEVQELEEKYRSEAWMYR

SEQ ID NO: 1784435 - protein, 11 aa, Staphylococcus epidermidis
LTEKQTLQEAG

SEQ ID NO: 1784436 - protein, 7 aa, Staphylococcus epidermidis
LTENDIN

SEQ ID NO: 1784437 - protein, 5 aa, Staphylococcus epidermidis
LTENE

SEQ ID NO: 1784438 - protein, 6 aa, Staphylococcus epidermidis
LTENGF

SEQ ID NO: 1784439 - protein, 14 aa, Staphylococcus epidermidis
LTEQQAKEKGYDVK

SEQ ID NO: 1784440 - protein, 15 aa, Staphylococcus epidermidis
LTETDHFDIKNLKSI

SEQ ID NO: 1784441 - protein, 7 aa, Staphylococcus epidermidis
LTFDGDK

SEQ ID NO: 1784442 - protein, 21 aa, Staphylococcus epidermidis
LTFPSNHTNHSNHNNSNFNNE

SEQ ID NO: 1784443 - protein, 8 aa, Staphylococcus epidermidis
LTGAKPGD

SEQ ID NO: 1784444 - protein, 4 aa, Staphylococcus epidermidis
LTGE

SEQ ID NO: 1784445 - protein, 6 aa, Staphylococcus epidermidis
LTGEKF

SEQ ID NO: 1784446 - protein, 7 aa, Staphylococcus epidermidis
LTGGNLE

SEQ ID NO: 1784447 - protein, 10 aa, Staphylococcus epidermidis
LTGSGVEVKD

SEQ ID NO: 1784448 - protein, 22 aa, Staphylococcus epidermidis
LTGTSSDLRDLTEEAKHGRQRA

SEQ ID NO: 1784449 - protein, 13 aa, Staphylococcus epidermidis
LTHKQQKEIEERI

SEQ ID NO: 1784450 - protein, 10 aa, Staphylococcus epidermidis
LTITNNQTPF

SEQ ID NO: 1784451 - protein, 10 aa, Staphylococcus epidermidis
LTKDQADEAT

SEQ ID NO: 1784452 - protein, 18 aa, Staphylococcus epidermidis
LTKETENQFDARAFNKMK

SEQ ID NO: 1784453 - protein, 11 aa, Staphylococcus epidermidis
LTKETENQFDN

SEQ ID NO: 1784454 - protein, 11 aa, Staphylococcus epidermidis
LTKKTENQFDN

SEQ ID NO: 1784455 - protein, 4 aa, Staphylococcus epidermidis
LTKS

SEQ ID NO: 1784456 - protein, 10 aa, Staphylococcus epidermidis
LTKSSNKNEL

SEQ ID NO: 1784457 - protein, 5 aa, Staphylococcus epidermidis
LTKTD

SEQ ID NO: 1784458 - protein, 10 aa, Staphylococcus epidermidis
LTKTGKTPMG

SEQ ID NO: 1784459 - protein, 26 aa, Staphylococcus epidermidis
LTKVETKNALKYEQAKNNYQKLFERV

SEQ ID NO: 1784460 - protein, 11 aa, Staphylococcus epidermidis
LTNDDGTLTSV

SEQ ID NO: 1784461 - protein, 25 aa, Staphylococcus epidermidis
LTNDSIKNIESKYEGEGYGKFKGDL

SEQ ID NO: 1784462 - protein, 26 aa, Staphylococcus epidermidis
LTNDSIKNIESKYEGEGYGKFKGDLS

SEQ ID NO: 1784463 - protein, 18 aa, Staphylococcus epidermidis
LTNNDKEILETYKKQLKN

SEQ ID NO: 1784464 - protein, 10 aa, Staphylococcus epidermidis
LTNNPSRQYM

SEQ ID NO: 1784465 - protein, 9 aa, Staphylococcus epidermidis
LTNNPSSQF

SEQ ID NO: 1784466 - protein, 11 aa, Staphylococcus epidermidis
LTNPNITQTLE

SEQ ID NO: 1784467 - protein, 16 aa, Staphylococcus epidermidis
LTNRPDVKRKLSEAKY

SEQ ID NO: 1784468 - protein, 17 aa, Staphylococcus epidermidis
LTNSIRKAAAKDGNPEL

SEQ ID NO: 1784469 - protein, 8 aa, Staphylococcus epidermidis
LTNSKGKF

SEQ ID NO: 1784470 - protein, 8 aa, Staphylococcus epidermidis
LTNSKTSV

SEQ ID NO: 1784471 - protein, 8 aa, Staphylococcus epidermidis
LTNTTTGD

SEQ ID NO: 1784472 - protein, 4 aa, Staphylococcus epidermidis
LTPD

SEQ ID NO: 1784473 - protein, 5 aa, Staphylococcus epidermidis
LTPDG

SEQ ID NO: 1784474 - protein, 5 aa, Staphylococcus epidermidis
LTPDQ

SEQ ID NO: 1784475 - protein, 21 aa, Staphylococcus epidermidis
LTPDQDKSIEEIKSDMERERP

SEQ ID NO: 1784476 - protein, 22 aa, Staphylococcus epidermidis
LTPDQSKSIDEIKGDMEKARPM

SEQ ID NO: 1784477 - protein, 5 aa, Staphylococcus epidermidis
LTPEG

SEQ ID NO: 1784478 - protein, 5 aa, Staphylococcus epidermidis
LTPEK

SEQ ID NO: 1784479 - protein, 7 aa, Staphylococcus epidermidis
LTPGDKI

SEQ ID NO: 1784480 - protein, 5 aa, Staphylococcus epidermidis
LTPKE

SEQ ID NO: 1784481 - protein, 7 aa, Staphylococcus epidermidis
LTPPEEL

SEQ ID NO: 1784482 - protein, 9 aa, Staphylococcus epidermidis
LTPPHNAEN

SEQ ID NO: 1784483 - protein, 10 aa, Staphylococcus epidermidis
LTPSDTAQLN

SEQ ID NO: 1784484 - protein, 6 aa, Staphylococcus epidermidis
LTPSPV

SEQ ID NO: 1784485 - protein, 8 aa, Staphylococcus epidermidis
LTPSTDNL

SEQ ID NO: 1784486 - protein, 11 aa, Staphylococcus epidermidis
LTQESELSFSP

SEQ ID NO: 1784487 - protein, 10 aa, Staphylococcus epidermidis
LTQETENKFD

SEQ ID NO: 1784488 - protein, 5 aa, Staphylococcus epidermidis
LTQLA

SEQ ID NO: 1784489 - protein, 4 aa, Staphylococcus epidermidis
LTQP

SEQ ID NO: 1784490 - protein, 5 aa, Staphylococcus epidermidis
LTQPE

SEQ ID NO: 1784491 - protein, 7 aa, Staphylococcus epidermidis
LTQPTGA

SEQ ID NO: 1784492 - protein, 16 aa, Staphylococcus epidermidis
LTRQGQLSGNVAENVA

SEQ ID NO: 1784493 - protein, 5 aa, Staphylococcus epidermidis
LTRSQ

SEQ ID NO: 1784494 - protein, 15 aa, Staphylococcus epidermidis
LTSKDDQYVSYKETQ

SEQ ID NO: 1784495 - protein, 16 aa, Staphylococcus epidermidis
LTSKDDQYVSYKETQR

SEQ ID NO: 1784496 - protein, 12 aa, Staphylococcus epidermidis
LTSLKEKYKNNN

SEQ ID NO: 1784497 - protein, 11 aa, Staphylococcus epidermidis
LTSQNDKQTAL

SEQ ID NO: 1784498 - protein, 11 aa, Staphylococcus epidermidis
LTSTDRNLTKA

SEQ ID NO: 1784499 - protein, 19 aa, Staphylococcus epidermidis
LTSTTEAQLREEQNIQTSI

SEQ ID NO: 1784500 - protein, 19 aa, Staphylococcus epidermidis
LTSTTETQLHEEQNIQTSI

SEQ ID NO: 1784501 - protein, 6 aa, Staphylococcus epidermidis
LTSYNT

SEQ ID NO: 1784502 - protein, 4 aa, Staphylococcus epidermidis
LTTD

SEQ ID NO: 1784503 - protein, 11 aa, Staphylococcus epidermidis
LTTDERQSGQI

SEQ ID NO: 1784504 - protein, 12 aa, Staphylococcus epidermidis
LTTDTPRNAHTK

SEQ ID NO: 1784505 - protein, 7 aa, Staphylococcus epidermidis
LTTGESI

SEQ ID NO: 1784506 - protein, 5 aa, Staphylococcus epidermidis
LTTGN

SEQ ID NO: 1784507 - protein, 10 aa, Staphylococcus epidermidis
LTTKVKNGPT

SEQ ID NO: 1784508 - protein, 22 aa, Staphylococcus epidermidis
LTTQKNAHTTDQIKHKTTKGKD

SEQ ID NO: 1784509 - protein, 22 aa, Staphylococcus epidermidis
LTTQKNAHTTEQIKHKTTKGQD

SEQ ID NO: 1784510 - protein, 18 aa, Staphylococcus epidermidis
LVESGSINKLTENEITHT

SEQ ID NO: 1784511 - protein, 12 aa, Staphylococcus epidermidis
LVKADDKDNVIQ

SEQ ID NO: 1784512 - protein, 22 aa, Staphylococcus epidermidis
LVNGQSKGKLEFDTDNTDAKNR

SEQ ID NO: 1784513 - protein, 5 aa, Staphylococcus epidermidis
LVNSG

SEQ ID NO: 1784514 - protein, 5 aa, Staphylococcus epidermidis
LVQDN

SEQ ID NO: 1784515 - protein, 4 aa, Staphylococcus epidermidis
LVSE

SEQ ID NO: 1784516 - protein, 4 aa, Staphylococcus epidermidis
LVSS

SEQ ID NO: 1784517 - protein, 12 aa, Staphylococcus epidermidis
LVSSKSETLTEE

SEQ ID NO: 1784518 - protein, 18 aa, Staphylococcus epidermidis
LVTETTEEELNQYEDNDL

SEQ ID NO: 1784519 - protein, 9 aa, Staphylococcus epidermidis
LYATPTTEL

SEQ ID NO: 1784520 - protein, 15 aa, Staphylococcus epidermidis
LYDSEGNLVNESKTS

SEQ ID NO: 1784521 - protein, 11 aa, Staphylococcus epidermidis
LYESDEPIESL

SEQ ID NO: 1784522 - protein, 6 aa, Staphylococcus epidermidis
LYESQE

SEQ ID NO: 1784523 - protein, 6 aa, Staphylococcus epidermidis
LYGDST

SEQ ID NO: 1784524 - protein, 5 aa, Staphylococcus epidermidis
LYGKQ

SEQ ID NO: 1784525 - protein, 18 aa, Staphylococcus epidermidis
LYGNPDKDRKPDTQFKNE

SEQ ID NO: 1784526 - protein, 12 aa, Staphylococcus epidermidis
LYKGKKKLAEVD

SEQ ID NO: 1784527 - protein, 4 aa, Staphylococcus epidermidis
LYTA

SEQ ID NO: 1784528 - protein, 11 aa, Staphylococcus epidermidis
LYTSQPSVSRD

SEQ ID NO: 1784529 - protein, 10 aa, Staphylococcus epidermidis
MADPKSSDIE

SEQ ID NO: 1784530 - protein, 10 aa, Staphylococcus epidermidis
MAEDADEPDY

SEQ ID NO: 1784531 - protein, 8 aa, Staphylococcus epidermidis
MAEPGEYT

SEQ ID NO: 1784532 - protein, 14 aa, Staphylococcus epidermidis
MAEPNEDDKPSEIK

SEQ ID NO: 1784533 - protein, 9 aa, Staphylococcus epidermidis
MAGSTTPQL

SEQ ID NO: 1784534 - protein, 16 aa, Staphylococcus epidermidis
MAKDKSKNKDKTITPK

SEQ ID NO: 1784535 - protein, 6 aa, Staphylococcus epidermidis
MAKGLQ

SEQ ID NO: 1784536 - protein, 32 aa, Staphylococcus epidermidis
MAKPQTSSQESSISAKDELSVSVKNEDKVPYY

SEQ ID NO: 1784537 - protein, 7 aa, Staphylococcus epidermidis
MATDTAK

SEQ ID NO: 1784538 - protein, 11 aa, Staphylococcus epidermidis
MATKKEGKMYA

SEQ ID NO: 1784539 - protein, 17 aa, Staphylococcus epidermidis
MDDLRAKAKEAVESGQY

SEQ ID NO: 1784540 - protein, 22 aa, Staphylococcus epidermidis
MDEAKEKANQRVKSATKEADSI

SEQ ID NO: 1784541 - protein, 4 aa, Staphylococcus epidermidis
MDGN

SEQ ID NO: 1784542 - protein, 4 aa, Staphylococcus epidermidis
MDLP

SEQ ID NO: 1784543 - protein, 30 aa, Staphylococcus epidermidis
MDSYKNGNLSYNPEVPSYSAENQLSNKDVN

SEQ ID NO: 1784544 - protein, 5 aa, Staphylococcus epidermidis
MDTGE

SEQ ID NO: 1784545 - protein, 8 aa, Staphylococcus epidermidis
MDTNKQDF

SEQ ID NO: 1784546 - protein, 6 aa, Staphylococcus epidermidis
MDVNGG

SEQ ID NO: 1784547 - protein, 8 aa, Staphylococcus epidermidis
MEASQKNQ

SEQ ID NO: 1784548 - protein, 9 aa, Staphylococcus epidermidis
MEDGSREYV

SEQ ID NO: 1784549 - protein, 12 aa, Staphylococcus epidermidis
MEEAESLKERIQ

SEQ ID NO: 1784550 - protein, 21 aa, Staphylococcus epidermidis
MEEAKEKANQRVKSATKEADE

SEQ ID NO: 1784551 - protein, 7 aa, Staphylococcus epidermidis
MEETSVN

SEQ ID NO: 1784552 - protein, 4 aa, Staphylococcus epidermidis
MEGK

SEQ ID NO: 1784553 - protein, 7 aa, Staphylococcus epidermidis
MEGTSLK

SEQ ID NO: 1784554 - protein, 5 aa, Staphylococcus epidermidis
MEGYN

SEQ ID NO: 1784555 - protein, 8 aa, Staphylococcus epidermidis
MEKGTNKY

SEQ ID NO: 1784556 - protein, 8 aa, Staphylococcus epidermidis
MEKTGNPN

SEQ ID NO: 1784557 - protein, 12 aa, Staphylococcus epidermidis
MENRDNSRTPMQ

SEQ ID NO: 1784558 - protein, 18 aa, Staphylococcus epidermidis
MEPTRQALKDAGLSTSEI

SEQ ID NO: 1784559 - protein, 11 aa, Staphylococcus epidermidis
MEYDSDETIDN

SEQ ID NO: 1784560 - protein, 11 aa, Staphylococcus epidermidis
MGAQTGPEQME

SEQ ID NO: 1784561 - protein, 9 aa, Staphylococcus epidermidis
MGGNSNDAS

SEQ ID NO: 1784562 - protein, 7 aa, Staphylococcus epidermidis
MGGTGGG

SEQ ID NO: 1784563 - protein, 8 aa, Staphylococcus epidermidis
MGGTPQSE

SEQ ID NO: 1784564 - protein, 8 aa, Staphylococcus epidermidis
MGKGVKTE

SEQ ID NO: 1784565 - protein, 8 aa, Staphylococcus epidermidis
MGNNDEHL

SEQ ID NO: 1784566 - protein, 20 aa, Staphylococcus epidermidis
MGNQEEIDNNPFKDALKNLK

SEQ ID NO: 1784567 - protein, 4 aa, Staphylococcus epidermidis
MGQG

SEQ ID NO: 1784568 - protein, 7 aa, Staphylococcus epidermidis
MGSGSLG

SEQ ID NO: 1784569 - protein, 11 aa, Staphylococcus epidermidis
MGSKERKDKVL

SEQ ID NO: 1784570 - protein, 9 aa, Staphylococcus epidermidis
MGSPPQTTV

SEQ ID NO: 1784571 - protein, 10 aa, Staphylococcus epidermidis
MGTRSGDLDP

SEQ ID NO: 1784572 - protein, 15 aa, Staphylococcus epidermidis
MGYTGSPDLKTLREE

SEQ ID NO: 1784573 - protein, 12 aa, Staphylococcus epidermidis
MHDNANKDYQAD

SEQ ID NO: 1784574 - protein, 4 aa, Staphylococcus epidermidis
MHRQ

SEQ ID NO: 1784575 - protein, 5 aa, Staphylococcus epidermidis
MIADP

SEQ ID NO: 1784576 - protein, 10 aa, Staphylococcus epidermidis
MIESTNTSYA

SEQ ID NO: 1784577 - protein, 11 aa, Staphylococcus epidermidis
MITPQESEEIN

SEQ ID NO: 1784578 - protein, 4 aa, Staphylococcus epidermidis
MKAE

SEQ ID NO: 1784579 - protein, 10 aa, Staphylococcus epidermidis
MKDGGPEDTT

SEQ ID NO: 1784580 - protein, 28 aa, Staphylococcus epidermidis
MKEASLDDLKKSGLPEKVAKNLQQALQN

SEQ ID NO: 1784581 - protein, 7 aa, Staphylococcus epidermidis
MKEKEEV

SEQ ID NO: 1784582 - protein, 30 aa, Staphylococcus epidermidis
MKGNSSKAIARKLNDSDIPPPNGKRWEDRT

SEQ ID NO: 1784583 - protein, 15 aa, Staphylococcus epidermidis
MKGTMPRGRSIEEDE

SEQ ID NO: 1784584 - protein, 10 aa, Staphylococcus epidermidis
MKKAASTEFK

SEQ ID NO: 1784585 - protein, 7 aa, Staphylococcus epidermidis
MKKSVSK

SEQ ID NO: 1784586 - protein, 8 aa, Staphylococcus epidermidis
MKNNGITT

SEQ ID NO: 1784587 - protein, 11 aa, Staphylococcus epidermidis
MKQARKDLDYE

SEQ ID NO: 1784588 - protein, 6 aa, Staphylococcus epidermidis
MKQKQR

SEQ ID NO: 1784589 - protein, 12 aa, Staphylococcus epidermidis
MKRARQEKLLKA

SEQ ID NO: 1784590 - protein, 12 aa, Staphylococcus epidermidis
MKRERQEKLLQA

SEQ ID NO: 1784591 - protein, 9 aa, Staphylococcus epidermidis
MKRPDGKYK

SEQ ID NO: 1784592 - protein, 8 aa, Staphylococcus epidermidis
MKSETSDE

SEQ ID NO: 1784593 - protein, 9 aa, Staphylococcus epidermidis
MKSKALESV

SEQ ID NO: 1784594 - protein, 7 aa, Staphylococcus epidermidis
MKTDPVE

SEQ ID NO: 1784595 - protein, 9 aa, Staphylococcus epidermidis
MKTKENKGK

SEQ ID NO: 1784596 - protein, 4 aa, Staphylococcus epidermidis
MKTN

SEQ ID NO: 1784597 - protein, 5 aa, Staphylococcus epidermidis
MKTRS

SEQ ID NO: 1784598 - protein, 6 aa, Staphylococcus epidermidis
MLDPDA

SEQ ID NO: 1784599 - protein, 11 aa, Staphylococcus epidermidis
MLNPTSNIEQT

SEQ ID NO: 1784600 - protein, 13 aa, Staphylococcus epidermidis
MLQGSAEEAHKFG

SEQ ID NO: 1784601 - protein, 11 aa, Staphylococcus epidermidis
MNDSKNKKQAF

SEQ ID NO: 1784602 - protein, 5 aa, Staphylococcus epidermidis
MNEDF

SEQ ID NO: 1784603 - protein, 6 aa, Staphylococcus epidermidis
MNENRR

SEQ ID NO: 1784604 - protein, 5 aa, Staphylococcus epidermidis
MNEQH

SEQ ID NO: 1784605 - protein, 12 aa, Staphylococcus epidermidis
MNGENQVSPETK

SEQ ID NO: 1784606 - protein, 9 aa, Staphylococcus epidermidis
MNGGFTKGT

SEQ ID NO: 1784607 - protein, 10 aa, Staphylococcus epidermidis
MNGLDPKAVR

SEQ ID NO: 1784608 - protein, 10 aa, Staphylococcus epidermidis
MNKASEQLDF

SEQ ID NO: 1784609 - protein, 8 aa, Staphylococcus epidermidis
MNKNEDNF

SEQ ID NO: 1784610 - protein, 10 aa, Staphylococcus epidermidis
MNNTSSQEYT

SEQ ID NO: 1784611 - protein, 52 aa, Staphylococcus epidermidis
MNPNDHPHGGGEGRAPIGRPSPMSPWGKPTLGKKTRRGKKSSDKLIVRGRKR

SEQ ID NO: 1784612 - protein, 10 aa, Staphylococcus epidermidis
MNPYGDGKAS

SEQ ID NO: 1784613 - protein, 4 aa, Staphylococcus epidermidis
MNRP

SEQ ID NO: 1784614 - protein, 5 aa, Staphylococcus epidermidis
MNRVG

SEQ ID NO: 1784615 - protein, 12 aa, Staphylococcus epidermidis
MPDAEKDKRGID

SEQ ID NO: 1784616 - protein, 8 aa, Staphylococcus epidermidis
MPETGESC

SEQ ID NO: 1784617 - protein, 19 aa, Staphylococcus epidermidis
MPGGQYSNLSQQAKSLGLG

SEQ ID NO: 1784618 - protein, 10 aa, Staphylococcus epidermidis
MPGGVNSPVR

SEQ ID NO: 1784619 - protein, 5 aa, Staphylococcus epidermidis
MPGKK

SEQ ID NO: 1784620 - protein, 8 aa, Staphylococcus epidermidis
MPHDNNDK

SEQ ID NO: 1784621 - protein, 4 aa, Staphylococcus epidermidis
MPHQ

SEQ ID NO: 1784622 - protein, 4 aa, Staphylococcus epidermidis
MPKQ

SEQ ID NO: 1784623 - protein, 4 aa, Staphylococcus epidermidis
MPKV

SEQ ID NO: 1784624 - protein, 14 aa, Staphylococcus epidermidis
MPNNSRLVGQGKDI

SEQ ID NO: 1784625 - protein, 15 aa, Staphylococcus epidermidis
MPNNSRLVGQGKDIT

SEQ ID NO: 1784626 - protein, 9 aa, Staphylococcus epidermidis
MPPKSSDTA

SEQ ID NO: 1784627 - protein, 6 aa, Staphylococcus epidermidis
MPPPNV

SEQ ID NO: 1784628 - protein, 6 aa, Staphylococcus epidermidis
MPQKEL

SEQ ID NO: 1784629 - protein, 7 aa, Staphylococcus epidermidis
MQEGELG

SEQ ID NO: 1784630 - protein, 7 aa, Staphylococcus epidermidis
MQGNSSD

SEQ ID NO: 1784631 - protein, 11 aa, Staphylococcus epidermidis
MQKAEAKSKAM

SEQ ID NO: 1784632 - protein, 4 aa, Staphylococcus epidermidis
MQNE

SEQ ID NO: 1784633 - protein, 10 aa, Staphylococcus epidermidis
MQPVQPPTDD

SEQ ID NO: 1784634 - protein, 6 aa, Staphylococcus epidermidis
MQSNSL

SEQ ID NO: 1784635 - protein, 6 aa, Staphylococcus epidermidis
MQSSDI

SEQ ID NO: 1784636 - protein, 5 aa, Staphylococcus epidermidis
MRAET

SEQ ID NO: 1784637 - protein, 7 aa, Staphylococcus epidermidis
MREGRET

SEQ ID NO: 1784638 - protein, 5 aa, Staphylococcus epidermidis
MRKEI

SEQ ID NO: 1784639 - protein, 7 aa, Staphylococcus epidermidis
MRKPTQN

SEQ ID NO: 1784640 - protein, 15 aa, Staphylococcus epidermidis
MRKSRQRKDDHLTNE

SEQ ID NO: 1784641 - protein, 4 aa, Staphylococcus epidermidis
MRRY

SEQ ID NO: 1784642 - protein, 9 aa, Staphylococcus epidermidis
MRSEGNNEL

SEQ ID NO: 1784643 - protein, 6 aa, Staphylococcus epidermidis
MRTQDE

SEQ ID NO: 1784644 - protein, 7 aa, Staphylococcus epidermidis
MRTSYEN

SEQ ID NO: 1784645 - protein, 21 aa, Staphylococcus epidermidis
MRYTQAEKGLIEKDKSSWKDE

SEQ ID NO: 1784646 - protein, 16 aa, Staphylococcus epidermidis
MSATSNYPEVNESQNI

SEQ ID NO: 1784647 - protein, 7 aa, Staphylococcus epidermidis
MSDEQMR

SEQ ID NO: 1784648 - protein, 10 aa, Staphylococcus epidermidis
MSDKGKKYRS

SEQ ID NO: 1784649 - protein, 8 aa, Staphylococcus epidermidis
MSEDDLKK

SEQ ID NO: 1784650 - protein, 4 aa, Staphylococcus epidermidis
MSER

SEQ ID NO: 1784651 - protein, 11 aa, Staphylococcus epidermidis
MSESKGSQNNF

SEQ ID NO: 1784652 - protein, 4 aa, Staphylococcus epidermidis
MSGG

SEQ ID NO: 1784653 - protein, 8 aa, Staphylococcus epidermidis
MSGGAENI

SEQ ID NO: 1784654 - protein, 8 aa, Staphylococcus epidermidis
MSGGERQR

SEQ ID NO: 1784655 - protein, 6 aa, Staphylococcus epidermidis
MSGQEC

SEQ ID NO: 1784656 - protein, 9 aa, Staphylococcus epidermidis
MSGSAENIS

SEQ ID NO: 1784657 - protein, 4 aa, Staphylococcus epidermidis
MSGT

SEQ ID NO: 1784658 - protein, 7 aa, Staphylococcus epidermidis
MSKEEVK

SEQ ID NO: 1784659 - protein, 13 aa, Staphylococcus epidermidis
MSKLGEAGKPIID

SEQ ID NO: 1784660 - protein, 9 aa, Staphylococcus epidermidis
MSKTGANPR

SEQ ID NO: 1784661 - protein, 4 aa, Staphylococcus epidermidis
MSKY

SEQ ID NO: 1784662 - protein, 10 aa, Staphylococcus epidermidis
MSNAWSKEEM

SEQ ID NO: 1784663 - protein, 11 aa, Staphylococcus epidermidis
MSNKGEVLQNS

SEQ ID NO: 1784664 - protein, 112 aa, Staphylococcus epidermidis
MSNSASISQSNIASQSTTASLSQSESVNDSMSSSLSESNSITSESNTNSKSEIESKSTSTSEFLSESGSVSNSEKSESISHSQSTSATPSSQSTYQQQPKEEKKGFFARLFN

SEQ ID NO: 1784665 - protein, 10 aa, Staphylococcus epidermidis
MSQKINNDLS

SEQ ID NO: 1784666 - protein, 4 aa, Staphylococcus epidermidis
MSSE

SEQ ID NO: 1784667 - protein, 4 aa, Staphylococcus epidermidis
MSSK

SEQ ID NO: 1784668 - protein, 12 aa, Staphylococcus epidermidis
MSSNEKNALDEK

SEQ ID NO: 1784669 - protein, 5 aa, Staphylococcus epidermidis
MSSTT

SEQ ID NO: 1784670 - protein, 4 aa, Staphylococcus epidermidis
MSTS

SEQ ID NO: 1784671 - protein, 12 aa, Staphylococcus epidermidis
MSTTTEDQTGDI

SEQ ID NO: 1784672 - protein, 8 aa, Staphylococcus epidermidis
MSTTVTDG

SEQ ID NO: 1784673 - protein, 8 aa, Staphylococcus epidermidis
MSYKNTPI

SEQ ID NO: 1784674 - protein, 6 aa, Staphylococcus epidermidis
MTDDDY

SEQ ID NO: 1784675 - protein, 9 aa, Staphylococcus epidermidis
MTDDEERNL

SEQ ID NO: 1784676 - protein, 11 aa, Staphylococcus epidermidis
MTEDDEKEMFG

SEQ ID NO: 1784677 - protein, 8 aa, Staphylococcus epidermidis
MTEEQYNE

SEQ ID NO: 1784678 - protein, 11 aa, Staphylococcus epidermidis
MTHGNTETYPQ

SEQ ID NO: 1784679 - protein, 11 aa, Staphylococcus epidermidis
MTKQPKGKIMT

SEQ ID NO: 1784680 - protein, 10 aa, Staphylococcus epidermidis
MTKSTKYRHR

SEQ ID NO: 1784681 - protein, 9 aa, Staphylococcus epidermidis
MTMGDSNNI

SEQ ID NO: 1784682 - protein, 9 aa, Staphylococcus epidermidis
MTNDPKDFE

SEQ ID NO: 1784683 - protein, 8 aa, Staphylococcus epidermidis
MTNETESM

SEQ ID NO: 1784684 - protein, 12 aa, Staphylococcus epidermidis
MTPEFEDEREEI

SEQ ID NO: 1784685 - protein, 16 aa, Staphylococcus epidermidis
MTPPESNVSRFTPDKD

SEQ ID NO: 1784686 - protein, 8 aa, Staphylococcus epidermidis
MTQSDPEM

SEQ ID NO: 1784687 - protein, 10 aa, Staphylococcus epidermidis
MTQSTDNINR

SEQ ID NO: 1784688 - protein, 9 aa, Staphylococcus epidermidis
MTRGHNNSK

SEQ ID NO: 1784689 - protein, 8 aa, Staphylococcus epidermidis
MTSAGRSM

SEQ ID NO: 1784690 - protein, 11 aa, Staphylococcus epidermidis
MTSDFDSKEIE

SEQ ID NO: 1784691 - protein, 18 aa, Staphylococcus epidermidis
MTSKTTQAIANTNEPAYG

SEQ ID NO: 1784692 - protein, 10 aa, Staphylococcus epidermidis
MTTNKTKNYT

SEQ ID NO: 1784693 - protein, 4 aa, Staphylococcus epidermidis
MTVQ

SEQ ID NO: 1784694 - protein, 11 aa, Staphylococcus epidermidis
MVKAKDLEEVK

SEQ ID NO: 1784695 - protein, 16 aa, Staphylococcus epidermidis
MVQPGDTIALIPPVSG

SEQ ID NO: 1784696 - protein, 4 aa, Staphylococcus epidermidis
MYEN

SEQ ID NO: 1784697 - protein, 6 aa, Staphylococcus epidermidis
MYTPSY

SEQ ID NO: 1784698 - protein, 7 aa, Staphylococcus epidermidis
NAADSEQ

SEQ ID NO: 1784699 - protein, 7 aa, Staphylococcus epidermidis
NAAKNKG

SEQ ID NO: 1784700 - protein, 38 aa, Staphylococcus epidermidis
NAANLRDKQSKLEKQYEDAKNEWKNSQGGVSTSLSEED

SEQ ID NO: 1784701 - protein, 7 aa, Staphylococcus epidermidis
NAAPEVK

SEQ ID NO: 1784702 - protein, 6 aa, Staphylococcus epidermidis
NAAQKF

SEQ ID NO: 1784703 - protein, 10 aa, Staphylococcus epidermidis
NADDDLKQQF

SEQ ID NO: 1784704 - protein, 16 aa, Staphylococcus epidermidis
NADETTQERLKSGYED

SEQ ID NO: 1784705 - protein, 17 aa, Staphylococcus epidermidis
NADGPTGTFIDGDGPMP

SEQ ID NO: 1784706 - protein, 12 aa, Staphylococcus epidermidis
NADGTPKESATT

SEQ ID NO: 1784707 - protein, 19 aa, Staphylococcus epidermidis
NADNDNSIRHGKPRIDTAR

SEQ ID NO: 1784708 - protein, 8 aa, Staphylococcus epidermidis
NADPGVGF

SEQ ID NO: 1784709 - protein, 4 aa, Staphylococcus epidermidis
NADS

SEQ ID NO: 1784710 - protein, 9 aa, Staphylococcus epidermidis
NADSPIGNL

SEQ ID NO: 1784711 - protein, 25 aa, Staphylococcus epidermidis
NADTFKGEQGAQGAIGLQGPKGEPF

SEQ ID NO: 1784712 - protein, 24 aa, Staphylococcus epidermidis
NADTFKGEQGIQGVPGKDGKPFTY

SEQ ID NO: 1784713 - protein, 4 aa, Staphylococcus epidermidis
NADV

SEQ ID NO: 1784714 - protein, 5 aa, Staphylococcus epidermidis
NAEGE

SEQ ID NO: 1784715 - protein, 5 aa, Staphylococcus epidermidis
NAEGL

SEQ ID NO: 1784716 - protein, 7 aa, Staphylococcus epidermidis
NAEHSEE

SEQ ID NO: 1784717 - protein, 16 aa, Staphylococcus epidermidis
NAENPEKKFQPTPGKV

SEQ ID NO: 1784718 - protein, 9 aa, Staphylococcus epidermidis
NAENPEKNF

SEQ ID NO: 1784719 - protein, 8 aa, Staphylococcus epidermidis
NAESPIAN

SEQ ID NO: 1784720 - protein, 9 aa, Staphylococcus epidermidis
NAETSKLGA

SEQ ID NO: 1784721 - protein, 5 aa, Staphylococcus epidermidis
NAFEE

SEQ ID NO: 1784722 - protein, 13 aa, Staphylococcus epidermidis
NAFSSGNNVTTGV

SEQ ID NO: 1784723 - protein, 27 aa, Staphylococcus epidermidis
NAGKLVSDRDRKTTKRNAKDDTGKSTS

SEQ ID NO: 1784724 - protein, 5 aa, Staphylococcus epidermidis
NAGLG

SEQ ID NO: 1784725 - protein, 23 aa, Staphylococcus epidermidis
NAGSGNLTQSATLRAGGIKTNAT

SEQ ID NO: 1784726 - protein, 7 aa, Staphylococcus epidermidis
NAGTTGT

SEQ ID NO: 1784727 - protein, 13 aa, Staphylococcus epidermidis
NAGVPGRLSNTAG

SEQ ID NO: 1784728 - protein, 15 aa, Staphylococcus epidermidis
NAHGEKDIASGNGGF

SEQ ID NO: 1784729 - protein, 17 aa, Staphylococcus epidermidis
NAHGQKVTITTKEPYPE

SEQ ID NO: 1784730 - protein, 9 aa, Staphylococcus epidermidis
NAHGRDRTG

SEQ ID NO: 1784731 - protein, 8 aa, Staphylococcus epidermidis
NAHTRSEV

SEQ ID NO: 1784732 - protein, 14 aa, Staphylococcus epidermidis
NAIQTSEGSAEAQR

SEQ ID NO: 1784733 - protein, 10 aa, Staphylococcus epidermidis
NAIRDNNKGL

SEQ ID NO: 1784734 - protein, 11 aa, Staphylococcus epidermidis
NAKARSGEAIT

SEQ ID NO: 1784735 - protein, 23 aa, Staphylococcus epidermidis
NAKDQLAGQSKLDKAKDQADKEL

SEQ ID NO: 1784736 - protein, 11 aa, Staphylococcus epidermidis
NAKEEEQHEDI

SEQ ID NO: 1784737 - protein, 20 aa, Staphylococcus epidermidis
NAKETEDGQFKVPSIMNEED

SEQ ID NO: 1784738 - protein, 8 aa, Staphylococcus epidermidis
NAKKANVK

SEQ ID NO: 1784739 - protein, 12 aa, Staphylococcus epidermidis
NAKKNDFSQSFE

SEQ ID NO: 1784740 - protein, 9 aa, Staphylococcus epidermidis
NAKKPEIGQ

SEQ ID NO: 1784741 - protein, 9 aa, Staphylococcus epidermidis
NAKNNAVTE

SEQ ID NO: 1784742 - protein, 5 aa, Staphylococcus epidermidis
NAKPT

SEQ ID NO: 1784743 - protein, 12 aa, Staphylococcus epidermidis
NAKTDSKSLTAY

SEQ ID NO: 1784744 - protein, 6 aa, Staphylococcus epidermidis
NAKTLL

SEQ ID NO: 1784745 - protein, 14 aa, Staphylococcus epidermidis
NAKTVNNSIKKTKI

SEQ ID NO: 1784746 - protein, 11 aa, Staphylococcus epidermidis
NALNKAKERID

SEQ ID NO: 1784747 - protein, 5 aa, Staphylococcus epidermidis
NALTD

SEQ ID NO: 1784748 - protein, 11 aa, Staphylococcus epidermidis
NALTESGLNIG

SEQ ID NO: 1784749 - protein, 8 aa, Staphylococcus epidermidis
NAMDGVTE

SEQ ID NO: 1784750 - protein, 13 aa, Staphylococcus epidermidis
NANEQVSKNEQSY

SEQ ID NO: 1784751 - protein, 8 aa, Staphylococcus epidermidis
NANFNGAP

SEQ ID NO: 1784752 - protein, 7 aa, Staphylococcus epidermidis
NANKEAD

SEQ ID NO: 1784753 - protein, 8 aa, Staphylococcus epidermidis
NANKEIKQ

SEQ ID NO: 1784754 - protein, 8 aa, Staphylococcus epidermidis
NANKNHAL

SEQ ID NO: 1784755 - protein, 8 aa, Staphylococcus epidermidis
NANKRTAF

SEQ ID NO: 1784756 - protein, 6 aa, Staphylococcus epidermidis
NANQEM

SEQ ID NO: 1784757 - protein, 5 aa, Staphylococcus epidermidis
NANTD

SEQ ID NO: 1784758 - protein, 6 aa, Staphylococcus epidermidis
NANTQV

SEQ ID NO: 1784759 - protein, 5 aa, Staphylococcus epidermidis
NAPAN

SEQ ID NO: 1784760 - protein, 6 aa, Staphylococcus epidermidis
NAPDEQ

SEQ ID NO: 1784761 - protein, 6 aa, Staphylococcus epidermidis
NAPELE

SEQ ID NO: 1784762 - protein, 4 aa, Staphylococcus epidermidis
NAPK

SEQ ID NO: 1784763 - protein, 17 aa, Staphylococcus epidermidis
NAPKKVKKDKIKGSIEI

SEQ ID NO: 1784764 - protein, 9 aa, Staphylococcus epidermidis
NAPKSFGGS

SEQ ID NO: 1784765 - protein, 7 aa, Staphylococcus epidermidis
NAPNLVS

SEQ ID NO: 1784766 - protein, 8 aa, Staphylococcus epidermidis
NAPTSKDT

SEQ ID NO: 1784767 - protein, 4 aa, Staphylococcus epidermidis
NAPV

SEQ ID NO: 1784768 - protein, 5 aa, Staphylococcus epidermidis
NAQDY

SEQ ID NO: 1784769 - protein, 9 aa, Staphylococcus epidermidis
NAQGETDAE

SEQ ID NO: 1784770 - protein, 8 aa, Staphylococcus epidermidis
NAQHNHDY

SEQ ID NO: 1784771 - protein, 6 aa, Staphylococcus epidermidis
NAQHYD

SEQ ID NO: 1784772 - protein, 4 aa, Staphylococcus epidermidis
NAQK

SEQ ID NO: 1784773 - protein, 5 aa, Staphylococcus epidermidis
NAQNF

SEQ ID NO: 1784774 - protein, 7 aa, Staphylococcus epidermidis
NAQSEIS

SEQ ID NO: 1784775 - protein, 9 aa, Staphylococcus epidermidis
NAQSPKNNF

SEQ ID NO: 1784776 - protein, 9 aa, Staphylococcus epidermidis
NAQTRGEVD

SEQ ID NO: 1784777 - protein, 33 aa, Staphylococcus epidermidis
NARQEIKDITDDVTAETNEEDGAAKYLKTHLLD

SEQ ID NO: 1784778 - protein, 8 aa, Staphylococcus epidermidis
NASKDSAL

SEQ ID NO: 1784779 - protein, 8 aa, Staphylococcus epidermidis
NASRETVR

SEQ ID NO: 1784780 - protein, 11 aa, Staphylococcus epidermidis
NASTTQKDDKV

SEQ ID NO: 1784781 - protein, 4 aa, Staphylococcus epidermidis
NATE

SEQ ID NO: 1784782 - protein, 9 aa, Staphylococcus epidermidis
NATKEEKKS

SEQ ID NO: 1784783 - protein, 11 aa, Staphylococcus epidermidis
NATKEEKKSIS

SEQ ID NO: 1784784 - protein, 8 aa, Staphylococcus epidermidis
NATKNTIT

SEQ ID NO: 1784785 - protein, 14 aa, Staphylococcus epidermidis
NATMPTRANECDSG

SEQ ID NO: 1784786 - protein, 14 aa, Staphylococcus epidermidis
NATPQAELNRSTIE

SEQ ID NO: 1784787 - protein, 22 aa, Staphylococcus epidermidis
NATPQAPPADYGTYGPSSQAHT

SEQ ID NO: 1784788 - protein, 6 aa, Staphylococcus epidermidis
NATSTI

SEQ ID NO: 1784789 - protein, 10 aa, Staphylococcus epidermidis
NATTQSGALN

SEQ ID NO: 1784790 - protein, 13 aa, Staphylococcus epidermidis
NATVPQKCGSAKG

SEQ ID NO: 1784791 - protein, 6 aa, Staphylococcus epidermidis
NAVPNQ

SEQ ID NO: 1784792 - protein, 16 aa, Staphylococcus epidermidis
NAVSAQRAVTDTTNDL

SEQ ID NO: 1784793 - protein, 29 aa, Staphylococcus epidermidis
NAVTQAKSNLHGDTKLQQEKDQAKRTIEQ

SEQ ID NO: 1784794 - protein, 49 aa, Staphylococcus epidermidis
NAVTSGQANMSGTRYTGTDLTGALKEDPIKDPKKAMKATQEGFKKKYNQ

SEQ ID NO: 1784795 - protein, 4 aa, Staphylococcus epidermidis
NAYY

SEQ ID NO: 1784796 - protein, 6 aa, Staphylococcus epidermidis
NCEKNN

SEQ ID NO: 1784797 - protein, 12 aa, Staphylococcus epidermidis
NCGKEIGKEEQL

SEQ ID NO: 1784798 - protein, 4 aa, Staphylococcus epidermidis
NCKQ

SEQ ID NO: 1784799 - protein, 9 aa, Staphylococcus epidermidis
NCSKGTKQK

SEQ ID NO: 1784800 - protein, 8 aa, Staphylococcus epidermidis
NDADSDNI

SEQ ID NO: 1784801 - protein, 5 aa, Staphylococcus epidermidis
NDAFN

SEQ ID NO: 1784802 - protein, 5 aa, Staphylococcus epidermidis
NDAFT

SEQ ID NO: 1784803 - protein, 4 aa, Staphylococcus epidermidis
NDAK

SEQ ID NO: 1784804 - protein, 21 aa, Staphylococcus epidermidis
NDAPDILGQPDIQNDISKYSD

SEQ ID NO: 1784805 - protein, 12 aa, Staphylococcus epidermidis
NDAPITPITSLH

SEQ ID NO: 1784806 - protein, 9 aa, Staphylococcus epidermidis
NDAQTEKMG

SEQ ID NO: 1784807 - protein, 12 aa, Staphylococcus epidermidis
NDAQTENKGQAY

SEQ ID NO: 1784808 - protein, 23 aa, Staphylococcus epidermidis
NDASATPTASTKPSTNVSSTIKY

SEQ ID NO: 1784809 - protein, 8 aa, Staphylococcus epidermidis
NDAVNSIS

SEQ ID NO: 1784810 - protein, 8 aa, Staphylococcus epidermidis
NDDDKIGD

SEQ ID NO: 1784811 - protein, 5 aa, Staphylococcus epidermidis
NDDES

SEQ ID NO: 1784812 - protein, 8 aa, Staphylococcus epidermidis
NDDEWRKG

SEQ ID NO: 1784813 - protein, 5 aa, Staphylococcus epidermidis
NDDKE

SEQ ID NO: 1784814 - protein, 7 aa, Staphylococcus epidermidis
NDDMGTV

SEQ ID NO: 1784815 - protein, 7 aa, Staphylococcus epidermidis
NDDNTNI

SEQ ID NO: 1784816 - protein, 19 aa, Staphylococcus epidermidis
NDDNTTSVKNDRPRIDTAR

SEQ ID NO: 1784817 - protein, 16 aa, Staphylococcus epidermidis
NDDNVKKLAEKTNDAR

SEQ ID NO: 1784818 - protein, 4 aa, Staphylococcus epidermidis
NDDP

SEQ ID NO: 1784819 - protein, 6 aa, Staphylococcus epidermidis
NDDQLD

SEQ ID NO: 1784820 - protein, 7 aa, Staphylococcus epidermidis
NDDSKAY

SEQ ID NO: 1784821 - protein, 10 aa, Staphylococcus epidermidis
NDDVEVPKDF

SEQ ID NO: 1784822 - protein, 5 aa, Staphylococcus epidermidis
NDDYD

SEQ ID NO: 1784823 - protein, 6 aa, Staphylococcus epidermidis
NDDYNI

SEQ ID NO: 1784824 - protein, 7 aa, Staphylococcus epidermidis
NDEAGNK

SEQ ID NO: 1784825 - protein, 7 aa, Staphylococcus epidermidis
NDEAKKN

SEQ ID NO: 1784826 - protein, 7 aa, Staphylococcus epidermidis
NDEEGNL

SEQ ID NO: 1784827 - protein, 4 aa, Staphylococcus epidermidis
NDEG

SEQ ID NO: 1784828 - protein, 6 aa, Staphylococcus epidermidis
NDEGER

SEQ ID NO: 1784829 - protein, 6 aa, Staphylococcus epidermidis
NDEGQG

SEQ ID NO: 1784830 - protein, 19 aa, Staphylococcus epidermidis
NDEKSNKANHDKKKIQSLN

SEQ ID NO: 1784831 - protein, 5 aa, Staphylococcus epidermidis
NDEKV

SEQ ID NO: 1784832 - protein, 8 aa, Staphylococcus epidermidis
NDELDKPS

SEQ ID NO: 1784833 - protein, 7 aa, Staphylococcus epidermidis
NDELDSH

SEQ ID NO: 1784834 - protein, 6 aa, Staphylococcus epidermidis
NDELRT

SEQ ID NO: 1784835 - protein, 24 aa, Staphylococcus epidermidis
NDENEVQEAVSSGAKYVTTSYQKL

SEQ ID NO: 1784836 - protein, 7 aa, Staphylococcus epidermidis
NDEQAFK

SEQ ID NO: 1784837 - protein, 15 aa, Staphylococcus epidermidis
NDEQYRKALEKNKNN

SEQ ID NO: 1784838 - protein, 4 aa, Staphylococcus epidermidis
NDES

SEQ ID NO: 1784839 - protein, 6 aa, Staphylococcus epidermidis
NDESQL

SEQ ID NO: 1784840 - protein, 24 aa, Staphylococcus epidermidis
NDEVEVPKDFDENDHAHLNGIYGG

SEQ ID NO: 1784841 - protein, 15 aa, Staphylococcus epidermidis
NDEVEVPKDFDENDQ

SEQ ID NO: 1784842 - protein, 13 aa, Staphylococcus epidermidis
NDEVVQNNDPEYL

SEQ ID NO: 1784843 - protein, 5 aa, Staphylococcus epidermidis
NDEYG

SEQ ID NO: 1784844 - protein, 18 aa, Staphylococcus epidermidis
NDFDKPINDFSGGQKTRL

SEQ ID NO: 1784845 - protein, 14 aa, Staphylococcus epidermidis
NDFGGGGHPNASGV

SEQ ID NO: 1784846 - protein, 18 aa, Staphylococcus epidermidis
NDFNKPINDFSGGQKTRL

SEQ ID NO: 1784847 - protein, 5 aa, Staphylococcus epidermidis
NDFQD

SEQ ID NO: 1784848 - protein, 5 aa, Staphylococcus epidermidis
NDFSS

SEQ ID NO: 1784849 - protein, 6 aa, Staphylococcus epidermidis
NDGAFG

SEQ ID NO: 1784850 - protein, 19 aa, Staphylococcus epidermidis
NDGAGAVFSEKENRYSEEI

SEQ ID NO: 1784851 - protein, 19 aa, Staphylococcus epidermidis
NDGASQSYVKAKKKAAEKI

SEQ ID NO: 1784852 - protein, 6 aa, Staphylococcus epidermidis
NDGCDI

SEQ ID NO: 1784853 - protein, 7 aa, Staphylococcus epidermidis
NDGDRYY

SEQ ID NO: 1784854 - protein, 7 aa, Staphylococcus epidermidis
NDGEEDY

SEQ ID NO: 1784855 - protein, 14 aa, Staphylococcus epidermidis
NDGGPSAAHAPFGG

SEQ ID NO: 1784856 - protein, 5 aa, Staphylococcus epidermidis
NDGKL

SEQ ID NO: 1784857 - protein, 4 aa, Staphylococcus epidermidis
NDGL

SEQ ID NO: 1784858 - protein, 4 aa, Staphylococcus epidermidis
NDGP

SEQ ID NO: 1784859 - protein, 7 aa, Staphylococcus epidermidis
NDGSEQY

SEQ ID NO: 1784860 - protein, 5 aa, Staphylococcus epidermidis
NDHEQ

SEQ ID NO: 1784861 - protein, 4 aa, Staphylococcus epidermidis
NDHY

SEQ ID NO: 1784862 - protein, 27 aa, Staphylococcus epidermidis
NDHYEEARAQLPDVGASVQTPDGSGKV

SEQ ID NO: 1784863 - protein, 4 aa, Staphylococcus epidermidis
NDID

SEQ ID NO: 1784864 - protein, 12 aa, Staphylococcus epidermidis
NDIDEEVKNQAI

SEQ ID NO: 1784865 - protein, 6 aa, Staphylococcus epidermidis
NDIDMR

SEQ ID NO: 1784866 - protein, 7 aa, Staphylococcus epidermidis
NDIPQTS

SEQ ID NO: 1784867 - protein, 7 aa, Staphylococcus epidermidis
NDIQANQ

SEQ ID NO: 1784868 - protein, 6 aa, Staphylococcus epidermidis
NDIQSG

SEQ ID NO: 1784869 - protein, 7 aa, Staphylococcus epidermidis
NDITNKD

SEQ ID NO: 1784870 - protein, 10 aa, Staphylococcus epidermidis
NDIYGKEAEN

SEQ ID NO: 1784871 - protein, 4 aa, Staphylococcus epidermidis
NDKA

SEQ ID NO: 1784872 - protein, 7 aa, Staphylococcus epidermidis
NDKADAA

SEQ ID NO: 1784873 - protein, 6 aa, Staphylococcus epidermidis
NDKALK

SEQ ID NO: 1784874 - protein, 9 aa, Staphylococcus epidermidis
NDKDDAERV

SEQ ID NO: 1784875 - protein, 24 aa, Staphylococcus epidermidis
NDKEQEQLQHSAQSVENVKNALKN

SEQ ID NO: 1784876 - protein, 10 aa, Staphylococcus epidermidis
NDKFKAQGGT

SEQ ID NO: 1784877 - protein, 11 aa, Staphylococcus epidermidis
NDKFPSKRQLS

SEQ ID NO: 1784878 - protein, 8 aa, Staphylococcus epidermidis
NDKGELNG

SEQ ID NO: 1784879 - protein, 5 aa, Staphylococcus epidermidis
NDKGF

SEQ ID NO: 1784880 - protein, 6 aa, Staphylococcus epidermidis
NDKKYE

SEQ ID NO: 1784881 - protein, 14 aa, Staphylococcus epidermidis
NDKLNQTSSETLEN

SEQ ID NO: 1784882 - protein, 18 aa, Staphylococcus epidermidis
NDKLPSKDHPDYDDKVKE

SEQ ID NO: 1784883 - protein, 10 aa, Staphylococcus epidermidis
NDKNKSTSLI

SEQ ID NO: 1784884 - protein, 9 aa, Staphylococcus epidermidis
NDKPGRDNH

SEQ ID NO: 1784885 - protein, 10 aa, Staphylococcus epidermidis
NDKPVPEPLE

SEQ ID NO: 1784886 - protein, 5 aa, Staphylococcus epidermidis
NDKSQ

SEQ ID NO: 1784887 - protein, 9 aa, Staphylococcus epidermidis
NDKSVTGKV

SEQ ID NO: 1784888 - protein, 7 aa, Staphylococcus epidermidis
NDKTSYC

SEQ ID NO: 1784889 - protein, 11 aa, Staphylococcus epidermidis
NDLGERNADTF

SEQ ID NO: 1784890 - protein, 4 aa, Staphylococcus epidermidis
NDLN

SEQ ID NO: 1784891 - protein, 30 aa, Staphylococcus epidermidis
NDLNDTNNNISTTNNHSNHSNYQKNKFNND

SEQ ID NO: 1784892 - protein, 7 aa, Staphylococcus epidermidis
NDLPSKA

SEQ ID NO: 1784893 - protein, 6 aa, Staphylococcus epidermidis
NDLPYN

SEQ ID NO: 1784894 - protein, 4 aa, Staphylococcus epidermidis
NDLR

SEQ ID NO: 1784895 - protein, 7 aa, Staphylococcus epidermidis
NDLTEKN

SEQ ID NO: 1784896 - protein, 10 aa, Staphylococcus epidermidis
NDLTENEKNY

SEQ ID NO: 1784897 - protein, 45 aa, Staphylococcus epidermidis
NDLTPEERAMKNSQSDAQVNHNESTSESANASDSQSTSSNSTSNN

SEQ ID NO: 1784898 - protein, 9 aa, Staphylococcus epidermidis
NDLTQQQQQ

SEQ ID NO: 1784899 - protein, 9 aa, Staphylococcus epidermidis
NDMEQDNSM

SEQ ID NO: 1784900 - protein, 5 aa, Staphylococcus epidermidis
NDNDI

SEQ ID NO: 1784901 - protein, 6 aa, Staphylococcus epidermidis
NDNEDW

SEQ ID NO: 1784902 - protein, 8 aa, Staphylococcus epidermidis
NDNEKAGH

SEQ ID NO: 1784903 - protein, 5 aa, Staphylococcus epidermidis
NDNEL

SEQ ID NO: 1784904 - protein, 11 aa, Staphylococcus epidermidis
NDNERTDTEQL

SEQ ID NO: 1784905 - protein, 15 aa, Staphylococcus epidermidis
NDNETIQTDRSEQLG

SEQ ID NO: 1784906 - protein, 14 aa, Staphylococcus epidermidis
NDNFSEKKADEDPL

SEQ ID NO: 1784907 - protein, 6 aa, Staphylococcus epidermidis
NDNKIY

SEQ ID NO: 1784908 - protein, 11 aa, Staphylococcus epidermidis
NDNPGSQHGHG

SEQ ID NO: 1784909 - protein, 9 aa, Staphylococcus epidermidis
NDNSNQLAQ

SEQ ID NO: 1784910 - protein, 7 aa, Staphylococcus epidermidis
NDNTNTF

SEQ ID NO: 1784911 - protein, 14 aa, Staphylococcus epidermidis
NDNTPGNTNENEPF

SEQ ID NO: 1784912 - protein, 17 aa, Staphylococcus epidermidis
NDNYPNRTMIVDDIPLE

SEQ ID NO: 1784913 - protein, 5 aa, Staphylococcus epidermidis
NDPHK

SEQ ID NO: 1784914 - protein, 9 aa, Staphylococcus epidermidis
NDPIDQRER

SEQ ID NO: 1784915 - protein, 5 aa, Staphylococcus epidermidis
NDPKT

SEQ ID NO: 1784916 - protein, 7 aa, Staphylococcus epidermidis
NDPPEIR

SEQ ID NO: 1784917 - protein, 5 aa, Staphylococcus epidermidis
NDPTI

SEQ ID NO: 1784918 - protein, 21 aa, Staphylococcus epidermidis
NDPVEKVDKENKIVTTSKGIE

SEQ ID NO: 1784919 - protein, 6 aa, Staphylococcus epidermidis
NDQELE

SEQ ID NO: 1784920 - protein, 7 aa, Staphylococcus epidermidis
NDQGKLD

SEQ ID NO: 1784921 - protein, 8 aa, Staphylococcus epidermidis
NDQGTKVF

SEQ ID NO: 1784922 - protein, 7 aa, Staphylococcus epidermidis
NDQKHVK

SEQ ID NO: 1784923 - protein, 9 aa, Staphylococcus epidermidis
NDQKKRKLA

SEQ ID NO: 1784924 - protein, 7 aa, Staphylococcus epidermidis
NDQLDET

SEQ ID NO: 1784925 - protein, 35 aa, Staphylococcus epidermidis
NDQLKKDEKNGDITEDDLRSQTDDVQKATDNSIKD

SEQ ID NO: 1784926 - protein, 7 aa, Staphylococcus epidermidis
NDQLTQK

SEQ ID NO: 1784927 - protein, 11 aa, Staphylococcus epidermidis
NDQVSENEQSY

SEQ ID NO: 1784928 - protein, 8 aa, Staphylococcus epidermidis
NDQYHPET

SEQ ID NO: 1784929 - protein, 28 aa, Staphylococcus epidermidis
NDQYNELDSSFAKEDDIKGTISKSPHRR

SEQ ID NO: 1784930 - protein, 14 aa, Staphylococcus epidermidis
NDRGSGNAAGGGVQ

SEQ ID NO: 1784931 - protein, 17 aa, Staphylococcus epidermidis
NDRKFNSQMYELAKELS

SEQ ID NO: 1784932 - protein, 7 aa, Staphylococcus epidermidis
NDRKYHP

SEQ ID NO: 1784933 - protein, 8 aa, Staphylococcus epidermidis
NDRNDADR

SEQ ID NO: 1784934 - protein, 7 aa, Staphylococcus epidermidis
NDSDIND

SEQ ID NO: 1784935 - protein, 6 aa, Staphylococcus epidermidis
NDSIEA

SEQ ID NO: 1784936 - protein, 7 aa, Staphylococcus epidermidis
NDSKAKI

SEQ ID NO: 1784937 - protein, 8 aa, Staphylococcus epidermidis
NDSNSDLL

SEQ ID NO: 1784938 - protein, 4 aa, Staphylococcus epidermidis
NDSQ

SEQ ID NO: 1784939 - protein, 4 aa, Staphylococcus epidermidis
NDSR

SEQ ID NO: 1784940 - protein, 24 aa, Staphylococcus epidermidis
NDSSDHPSTKSFEEDQIGASSYNY

SEQ ID NO: 1784941 - protein, 7 aa, Staphylococcus epidermidis
NDTATGT

SEQ ID NO: 1784942 - protein, 5 aa, Staphylococcus epidermidis
NDTDG

SEQ ID NO: 1784943 - protein, 5 aa, Staphylococcus epidermidis
NDTDH

SEQ ID NO: 1784944 - protein, 14 aa, Staphylococcus epidermidis
NDTLIGGSPQKNKQ

SEQ ID NO: 1784945 - protein, 9 aa, Staphylococcus epidermidis
NDTLKENGL

SEQ ID NO: 1784946 - protein, 13 aa, Staphylococcus epidermidis
NDTPSIDDINADD

SEQ ID NO: 1784947 - protein, 6 aa, Staphylococcus epidermidis
NDTVRA

SEQ ID NO: 1784948 - protein, 4 aa, Staphylococcus epidermidis
NDVK

SEQ ID NO: 1784949 - protein, 4 aa, Staphylococcus epidermidis
NDVP

SEQ ID NO: 1784950 - protein, 24 aa, Staphylococcus epidermidis
NDVPGDDANYKMNPPLRSKEDREA

SEQ ID NO: 1784951 - protein, 10 aa, Staphylococcus epidermidis
NDVSRHERKG

SEQ ID NO: 1784952 - protein, 4 aa, Staphylococcus epidermidis
NDVT

SEQ ID NO: 1784953 - protein, 7 aa, Staphylococcus epidermidis
NDYADAR

SEQ ID NO: 1784954 - protein, 11 aa, Staphylococcus epidermidis
NDYASEQEAIE

SEQ ID NO: 1784955 - protein, 18 aa, Staphylococcus epidermidis
NDYGMGSSRDWAAKGTNL

SEQ ID NO: 1784956 - protein, 8 aa, Staphylococcus epidermidis
NDYGPDLE

SEQ ID NO: 1784957 - protein, 8 aa, Staphylococcus epidermidis
NDYMDDPN

SEQ ID NO: 1784958 - protein, 6 aa, Staphylococcus epidermidis
NDYPIN

SEQ ID NO: 1784959 - protein, 6 aa, Staphylococcus epidermidis
NDYPQV

SEQ ID NO: 1784960 - protein, 18 aa, Staphylococcus epidermidis
NDYRDTKLQSTRKAFEQE

SEQ ID NO: 1784961 - protein, 6 aa, Staphylococcus epidermidis
NDYSGH

SEQ ID NO: 1784962 - protein, 9 aa, Staphylococcus epidermidis
NEADMQQTG

SEQ ID NO: 1784963 - protein, 23 aa, Staphylococcus epidermidis
NEAGRKPDLPFGGYKQSGLGREW

SEQ ID NO: 1784964 - protein, 10 aa, Staphylococcus epidermidis
NEANDERALQ

SEQ ID NO: 1784965 - protein, 11 aa, Staphylococcus epidermidis
NEASHQDDSFS

SEQ ID NO: 1784966 - protein, 16 aa, Staphylococcus epidermidis
NEATKSAEAAPYPSVE

SEQ ID NO: 1784967 - protein, 12 aa, Staphylococcus epidermidis
NEAVQEAGKISE

SEQ ID NO: 1784968 - protein, 10 aa, Staphylococcus epidermidis
NEAVQEAGMV

SEQ ID NO: 1784969 - protein, 8 aa, Staphylococcus epidermidis
NEAYHGGH

SEQ ID NO: 1784970 - protein, 10 aa, Staphylococcus epidermidis
NEDDSTQTAL

SEQ ID NO: 1784971 - protein, 21 aa, Staphylococcus epidermidis
NEDELKDTKKYYDELGKSSAA

SEQ ID NO: 1784972 - protein, 7 aa, Staphylococcus epidermidis
NEDENEV

SEQ ID NO: 1784973 - protein, 18 aa, Staphylococcus epidermidis
NEDGNETMEIPMKNIKDI

SEQ ID NO: 1784974 - protein, 9 aa, Staphylococcus epidermidis
NEDGTPSHI

SEQ ID NO: 1784975 - protein, 5 aa, Staphylococcus epidermidis
NEDHD

SEQ ID NO: 1784976 - protein, 5 aa, Staphylococcus epidermidis
NEDID

SEQ ID NO: 1784977 - protein, 20 aa, Staphylococcus epidermidis
NEDKGNHKQSNSKNNNKQET

SEQ ID NO: 1784978 - protein, 13 aa, Staphylococcus epidermidis
NEDKQPFWTEDYT

SEQ ID NO: 1784979 - protein, 17 aa, Staphylococcus epidermidis
NEDKSSINQNDLTDEEL

SEQ ID NO: 1784980 - protein, 5 aa, Staphylococcus epidermidis
NEDLD

SEQ ID NO: 1784981 - protein, 9 aa, Staphylococcus epidermidis
NEDPESYDD

SEQ ID NO: 1784982 - protein, 14 aa, Staphylococcus epidermidis
NEDQPEKDGYKQAI

SEQ ID NO: 1784983 - protein, 8 aa, Staphylococcus epidermidis
NEDSTRTF

SEQ ID NO: 1784984 - protein, 4 aa, Staphylococcus epidermidis
NEDV

SEQ ID NO: 1784985 - protein, 7 aa, Staphylococcus epidermidis
NEEDEYV

SEQ ID NO: 1784986 - protein, 8 aa, Staphylococcus epidermidis
NEEDEYVY

SEQ ID NO: 1784987 - protein, 10 aa, Staphylococcus epidermidis
NEEEIKTHAP

SEQ ID NO: 1784988 - protein, 13 aa, Staphylococcus epidermidis
NEEEQEVVNGEQV

SEQ ID NO: 1784989 - protein, 6 aa, Staphylococcus epidermidis
NEEERA

SEQ ID NO: 1784990 - protein, 67 aa, Staphylococcus epidermidis
NEEFKGPKGDEGPQGEQGPQGLQGEVGPQGAQGIAGEKGDVGPKGDKGDKGLQGEQGPPGEQGLQGE

SEQ ID NO: 1784991 - protein, 18 aa, Staphylococcus epidermidis
NEEGAKQAAEKLTSKEQE

SEQ ID NO: 1784992 - protein, 5 aa, Staphylococcus epidermidis
NEEGI

SEQ ID NO: 1784993 - protein, 18 aa, Staphylococcus epidermidis
NEEKMGSYQYELNYKEIS

SEQ ID NO: 1784994 - protein, 6 aa, Staphylococcus epidermidis
NEEKTA

SEQ ID NO: 1784995 - protein, 7 aa, Staphylococcus epidermidis
NEEKTSA

SEQ ID NO: 1784996 - protein, 8 aa, Staphylococcus epidermidis
NEELKGNL

SEQ ID NO: 1784997 - protein, 10 aa, Staphylococcus epidermidis
NEELNESKQT

SEQ ID NO: 1784998 - protein, 4 aa, Staphylococcus epidermidis
NEEN

SEQ ID NO: 1784999 - protein, 7 aa, Staphylococcus epidermidis
NEENKGK

SEQ ID NO: 1785000 - protein, 7 aa, Staphylococcus epidermidis
NEENPNA

SEQ ID NO: 1785001 - protein, 8 aa, Staphylococcus epidermidis
NEENQQAY

SEQ ID NO: 1785002 - protein, 16 aa, Staphylococcus epidermidis
NEEPKLENESTKDIYT

SEQ ID NO: 1785003 - protein, 9 aa, Staphylococcus epidermidis
NEEQDNQAI

SEQ ID NO: 1785004 - protein, 8 aa, Staphylococcus epidermidis
NEEQEDLG

SEQ ID NO: 1785005 - protein, 5 aa, Staphylococcus epidermidis
NEEQG

SEQ ID NO: 1785006 - protein, 8 aa, Staphylococcus epidermidis
NEEQNELG

SEQ ID NO: 1785007 - protein, 7 aa, Staphylococcus epidermidis
NEEQYGS

SEQ ID NO: 1785008 - protein, 8 aa, Staphylococcus epidermidis
NEERSEAV

SEQ ID NO: 1785009 - protein, 5 aa, Staphylococcus epidermidis
NEERV

SEQ ID NO: 1785010 - protein, 8 aa, Staphylococcus epidermidis
NEETPQLT

SEQ ID NO: 1785011 - protein, 20 aa, Staphylococcus epidermidis
NEETVGQGIKEGLKSTGLSR

SEQ ID NO: 1785012 - protein, 6 aa, Staphylococcus epidermidis
NEEYQE

SEQ ID NO: 1785013 - protein, 5 aa, Staphylococcus epidermidis
NEFEN

SEQ ID NO: 1785014 - protein, 10 aa, Staphylococcus epidermidis
NEFNDNQNTQ

SEQ ID NO: 1785015 - protein, 6 aa, Staphylococcus epidermidis
NEFPDK

SEQ ID NO: 1785016 - protein, 7 aa, Staphylococcus epidermidis
NEFTEES

SEQ ID NO: 1785017 - protein, 5 aa, Staphylococcus epidermidis
NEGEE

SEQ ID NO: 1785018 - protein, 8 aa, Staphylococcus epidermidis
NEGEGVNQ

SEQ ID NO: 1785019 - protein, 5 aa, Staphylococcus epidermidis
NEGFE

SEQ ID NO: 1785020 - protein, 14 aa, Staphylococcus epidermidis
NEGIQSNKTKVGDR

SEQ ID NO: 1785021 - protein, 8 aa, Staphylococcus epidermidis
NEGKQYKH

SEQ ID NO: 1785022 - protein, 6 aa, Staphylococcus epidermidis
NEGLKN

SEQ ID NO: 1785023 - protein, 6 aa, Staphylococcus epidermidis
NEHDNI

SEQ ID NO: 1785024 - protein, 5 aa, Staphylococcus epidermidis
NEHGS

SEQ ID NO: 1785025 - protein, 7 aa, Staphylococcus epidermidis
NEHNTGV

SEQ ID NO: 1785026 - protein, 4 aa, Staphylococcus epidermidis
NEHP

SEQ ID NO: 1785027 - protein, 4 aa, Staphylococcus epidermidis
NEHQ

SEQ ID NO: 1785028 - protein, 11 aa, Staphylococcus epidermidis
NEHQQNRNVTG

SEQ ID NO: 1785029 - protein, 6 aa, Staphylococcus epidermidis
NEHSTR

SEQ ID NO: 1785030 - protein, 4 aa, Staphylococcus epidermidis
NEID

SEQ ID NO: 1785031 - protein, 8 aa, Staphylococcus epidermidis
NEIDDKES

SEQ ID NO: 1785032 - protein, 6 aa, Staphylococcus epidermidis
NEIDKG

SEQ ID NO: 1785033 - protein, 6 aa, Staphylococcus epidermidis
NEIEQA

SEQ ID NO: 1785034 - protein, 8 aa, Staphylococcus epidermidis
NEIGKSPA

SEQ ID NO: 1785035 - protein, 6 aa, Staphylococcus epidermidis
NEIHQK

SEQ ID NO: 1785036 - protein, 9 aa, Staphylococcus epidermidis
NEIKNFESK

SEQ ID NO: 1785037 - protein, 6 aa, Staphylococcus epidermidis
NEINKS

SEQ ID NO: 1785038 - protein, 4 aa, Staphylococcus epidermidis
NEIQ

SEQ ID NO: 1785039 - protein, 11 aa, Staphylococcus epidermidis
NEIRQDGSTGE

SEQ ID NO: 1785040 - protein, 5 aa, Staphylococcus epidermidis
NEISE

SEQ ID NO: 1785041 - protein, 7 aa, Staphylococcus epidermidis
NEISEDA

SEQ ID NO: 1785042 - protein, 5 aa, Staphylococcus epidermidis
NEITK

SEQ ID NO: 1785043 - protein, 12 aa, Staphylococcus epidermidis
NEITRTGSYTHT

SEQ ID NO: 1785044 - protein, 5 aa, Staphylococcus epidermidis
NEITV

SEQ ID NO: 1785045 - protein, 6 aa, Staphylococcus epidermidis
NEKARK

SEQ ID NO: 1785046 - protein, 15 aa, Staphylococcus epidermidis
NEKDDIGSGAYDHNG

SEQ ID NO: 1785047 - protein, 15 aa, Staphylococcus epidermidis
NEKDDVGSGAYDHNG

SEQ ID NO: 1785048 - protein, 25 aa, Staphylococcus epidermidis
NEKDSSDTDEKLNPNDLSAPPGVKI

SEQ ID NO: 1785049 - protein, 8 aa, Staphylococcus epidermidis
NEKEVDNT

SEQ ID NO: 1785050 - protein, 4 aa, Staphylococcus epidermidis
NEKF

SEQ ID NO: 1785051 - protein, 4 aa, Staphylococcus epidermidis
NEKI

SEQ ID NO: 1785052 - protein, 10 aa, Staphylococcus epidermidis
NEKKNQLPSD

SEQ ID NO: 1785053 - protein, 10 aa, Staphylococcus epidermidis
NEKLNEDGSL

SEQ ID NO: 1785054 - protein, 5 aa, Staphylococcus epidermidis
NEKLQ

SEQ ID NO: 1785055 - protein, 12 aa, Staphylococcus epidermidis
NEKNAENANFNL

SEQ ID NO: 1785056 - protein, 8 aa, Staphylococcus epidermidis
NEKNAYNQ

SEQ ID NO: 1785057 - protein, 6 aa, Staphylococcus epidermidis
NEKPDV

SEQ ID NO: 1785058 - protein, 8 aa, Staphylococcus epidermidis
NEKPIAPG

SEQ ID NO: 1785059 - protein, 8 aa, Staphylococcus epidermidis
NEKPTVIK

SEQ ID NO: 1785060 - protein, 7 aa, Staphylococcus epidermidis
NEKQITE

SEQ ID NO: 1785061 - protein, 10 aa, Staphylococcus epidermidis
NEKRKQAEYI

SEQ ID NO: 1785062 - protein, 10 aa, Staphylococcus epidermidis
NEKRKQIQDE

SEQ ID NO: 1785063 - protein, 15 aa, Staphylococcus epidermidis
NEKRVGEKKSPEEMR

SEQ ID NO: 1785064 - protein, 7 aa, Staphylococcus epidermidis
NEKSNNV

SEQ ID NO: 1785065 - protein, 8 aa, Staphylococcus epidermidis
NEKTGANV

SEQ ID NO: 1785066 - protein, 6 aa, Staphylococcus epidermidis
NEKTSD

SEQ ID NO: 1785067 - protein, 4 aa, Staphylococcus epidermidis
NEKV

SEQ ID NO: 1785068 - protein, 5 aa, Staphylococcus epidermidis
NEKVF

SEQ ID NO: 1785069 - protein, 24 aa, Staphylococcus epidermidis
NEKYEKFDAEAYNAKAIKEFYDLL

SEQ ID NO: 1785070 - protein, 5 aa, Staphylococcus epidermidis
NELEF

SEQ ID NO: 1785071 - protein, 21 aa, Staphylococcus epidermidis
NELERRGSYQGKKYEQKQKVQ

SEQ ID NO: 1785072 - protein, 6 aa, Staphylococcus epidermidis
NELNNA

SEQ ID NO: 1785073 - protein, 6 aa, Staphylococcus epidermidis
NELPGP

SEQ ID NO: 1785074 - protein, 6 aa, Staphylococcus epidermidis
NELPKL

SEQ ID NO: 1785075 - protein, 6 aa, Staphylococcus epidermidis
NELQNK

SEQ ID NO: 1785076 - protein, 7 aa, Staphylococcus epidermidis
NELTPND

SEQ ID NO: 1785077 - protein, 6 aa, Staphylococcus epidermidis
NELTQR

SEQ ID NO: 1785078 - protein, 5 aa, Staphylococcus epidermidis
NEMDK

SEQ ID NO: 1785079 - protein, 7 aa, Staphylococcus epidermidis
NEMPGHQ

SEQ ID NO: 1785080 - protein, 7 aa, Staphylococcus epidermidis
NEMSDPQ

SEQ ID NO: 1785081 - protein, 4 aa, Staphylococcus epidermidis
NENA

SEQ ID NO: 1785082 - protein, 8 aa, Staphylococcus epidermidis
NENAESDM

SEQ ID NO: 1785083 - protein, 17 aa, Staphylococcus epidermidis
NENAGQAIKTMDESASV

SEQ ID NO: 1785084 - protein, 6 aa, Staphylococcus epidermidis
NENATP

SEQ ID NO: 1785085 - protein, 5 aa, Staphylococcus epidermidis
NENEE

SEQ ID NO: 1785086 - protein, 7 aa, Staphylococcus epidermidis
NENEPVE

SEQ ID NO: 1785087 - protein, 7 aa, Staphylococcus epidermidis
NENESLK

SEQ ID NO: 1785088 - protein, 7 aa, Staphylococcus epidermidis
NENGEME

SEQ ID NO: 1785089 - protein, 18 aa, Staphylococcus epidermidis
NENGNQTRRISFKNVCDV

SEQ ID NO: 1785090 - protein, 16 aa, Staphylococcus epidermidis
NENGQGSVNNENLGSI

SEQ ID NO: 1785091 - protein, 8 aa, Staphylococcus epidermidis
NENHVNTY

SEQ ID NO: 1785092 - protein, 9 aa, Staphylococcus epidermidis
NENIDSKRF

SEQ ID NO: 1785093 - protein, 6 aa, Staphylococcus epidermidis
NENIRK

SEQ ID NO: 1785094 - protein, 17 aa, Staphylococcus epidermidis
NENKKDEIKEDENNQKI

SEQ ID NO: 1785095 - protein, 17 aa, Staphylococcus epidermidis
NENKKEENKEDKDNQEI

SEQ ID NO: 1785096 - protein, 6 aa, Staphylococcus epidermidis
NENKSL

SEQ ID NO: 1785097 - protein, 14 aa, Staphylococcus epidermidis
NENLYGPTPKVKEA

SEQ ID NO: 1785098 - protein, 16 aa, Staphylococcus epidermidis
NENPQKQDSHSQNNNE

SEQ ID NO: 1785099 - protein, 11 aa, Staphylococcus epidermidis
NENRVSLSPSG

SEQ ID NO: 1785100 - protein, 7 aa, Staphylococcus epidermidis
NENTAKV

SEQ ID NO: 1785101 - protein, 9 aa, Staphylococcus epidermidis
NENTHRQMS

SEQ ID NO: 1785102 - protein, 7 aa, Staphylococcus epidermidis
NENVTDD

SEQ ID NO: 1785103 - protein, 9 aa, Staphylococcus epidermidis
NENYKDIKQ

SEQ ID NO: 1785104 - protein, 7 aa, Staphylococcus epidermidis
NEPERIS

SEQ ID NO: 1785105 - protein, 13 aa, Staphylococcus epidermidis
NEPIGKGKDGEDV

SEQ ID NO: 1785106 - protein, 12 aa, Staphylococcus epidermidis
NEPIRTMQPNEE

SEQ ID NO: 1785107 - protein, 6 aa, Staphylococcus epidermidis
NEPKFT

SEQ ID NO: 1785108 - protein, 9 aa, Staphylococcus epidermidis
NEPLKGFNT

SEQ ID NO: 1785109 - protein, 5 aa, Staphylococcus epidermidis
NEPLT

SEQ ID NO: 1785110 - protein, 10 aa, Staphylococcus epidermidis
NEPLTEDDQT

SEQ ID NO: 1785111 - protein, 5 aa, Staphylococcus epidermidis
NEPNA

SEQ ID NO: 1785112 - protein, 6 aa, Staphylococcus epidermidis
NEPQFT

SEQ ID NO: 1785113 - protein, 15 aa, Staphylococcus epidermidis
NEPSQTNLESTTPDR

SEQ ID NO: 1785114 - protein, 7 aa, Staphylococcus epidermidis
NEQAQSD

SEQ ID NO: 1785115 - protein, 4 aa, Staphylococcus epidermidis
NEQD

SEQ ID NO: 1785116 - protein, 10 aa, Staphylococcus epidermidis
NEQDAQASIK

SEQ ID NO: 1785117 - protein, 4 aa, Staphylococcus epidermidis
NEQK

SEQ ID NO: 1785118 - protein, 11 aa, Staphylococcus epidermidis
NEQKNDRPVTG

SEQ ID NO: 1785119 - protein, 8 aa, Staphylococcus epidermidis
NEQLPSEV

SEQ ID NO: 1785120 - protein, 5 aa, Staphylococcus epidermidis
NEQRL

SEQ ID NO: 1785121 - protein, 5 aa, Staphylococcus epidermidis
NEQSF

SEQ ID NO: 1785122 - protein, 4 aa, Staphylococcus epidermidis
NERA

SEQ ID NO: 1785123 - protein, 4 aa, Staphylococcus epidermidis
NERK

SEQ ID NO: 1785124 - protein, 4 aa, Staphylococcus epidermidis
NERL

SEQ ID NO: 1785125 - protein, 6 aa, Staphylococcus epidermidis
NERLQV

SEQ ID NO: 1785126 - protein, 7 aa, Staphylococcus epidermidis
NERNNSM

SEQ ID NO: 1785127 - protein, 8 aa, Staphylococcus epidermidis
NERPSTAK

SEQ ID NO: 1785128 - protein, 5 aa, Staphylococcus epidermidis
NERQA

SEQ ID NO: 1785129 - protein, 7 aa, Staphylococcus epidermidis
NERREFE

SEQ ID NO: 1785130 - protein, 8 aa, Staphylococcus epidermidis
NERRTNKD

SEQ ID NO: 1785131 - protein, 7 aa, Staphylococcus epidermidis
NESEEID

SEQ ID NO: 1785132 - protein, 5 aa, Staphylococcus epidermidis
NESEK

SEQ ID NO: 1785133 - protein, 4 aa, Staphylococcus epidermidis
NESF

SEQ ID NO: 1785134 - protein, 4 aa, Staphylococcus epidermidis
NESG

SEQ ID NO: 1785135 - protein, 14 aa, Staphylococcus epidermidis
NESISETFTEQRFG

SEQ ID NO: 1785136 - protein, 10 aa, Staphylococcus epidermidis
NESKKDIPNS

SEQ ID NO: 1785137 - protein, 11 aa, Staphylococcus epidermidis
NESNSTNPINQ

SEQ ID NO: 1785138 - protein, 8 aa, Staphylococcus epidermidis
NESTEELK

SEQ ID NO: 1785139 - protein, 6 aa, Staphylococcus epidermidis
NESVDA

SEQ ID NO: 1785140 - protein, 7 aa, Staphylococcus epidermidis
NESVENM

SEQ ID NO: 1785141 - protein, 7 aa, Staphylococcus epidermidis
NETDETK

SEQ ID NO: 1785142 - protein, 9 aa, Staphylococcus epidermidis
NETDVPKQA

SEQ ID NO: 1785143 - protein, 8 aa, Staphylococcus epidermidis
NETEAERL

SEQ ID NO: 1785144 - protein, 10 aa, Staphylococcus epidermidis
NETKENAQLK

SEQ ID NO: 1785145 - protein, 11 aa, Staphylococcus epidermidis
NETKNDPDKVL

SEQ ID NO: 1785146 - protein, 7 aa, Staphylococcus epidermidis
NETLKGR

SEQ ID NO: 1785147 - protein, 12 aa, Staphylococcus epidermidis
NETMSENQSKKV

SEQ ID NO: 1785148 - protein, 7 aa, Staphylococcus epidermidis
NETNQNN

SEQ ID NO: 1785149 - protein, 5 aa, Staphylococcus epidermidis
NETNV

SEQ ID NO: 1785150 - protein, 10 aa, Staphylococcus epidermidis
NETSDKEEVE

SEQ ID NO: 1785151 - protein, 8 aa, Staphylococcus epidermidis
NETTQNGL

SEQ ID NO: 1785152 - protein, 5 aa, Staphylococcus epidermidis
NETYN

SEQ ID NO: 1785153 - protein, 7 aa, Staphylococcus epidermidis
NEVDSEI

SEQ ID NO: 1785154 - protein, 14 aa, Staphylococcus epidermidis
NEVGINSERTKIAY

SEQ ID NO: 1785155 - protein, 11 aa, Staphylococcus epidermidis
NEVKQRIANDV

SEQ ID NO: 1785156 - protein, 4 aa, Staphylococcus epidermidis
NEVS

SEQ ID NO: 1785157 - protein, 11 aa, Staphylococcus epidermidis
NEVSNKYATTV

SEQ ID NO: 1785158 - protein, 5 aa, Staphylococcus epidermidis
NEVTD

SEQ ID NO: 1785159 - protein, 26 aa, Staphylococcus epidermidis
NEYDDTDKIFSNPSDKQTEDYISGRF

SEQ ID NO: 1785160 - protein, 13 aa, Staphylococcus epidermidis
NEYEDNPDAEFRR

SEQ ID NO: 1785161 - protein, 9 aa, Staphylococcus epidermidis
NEYKRTNNL

SEQ ID NO: 1785162 - protein, 13 aa, Staphylococcus epidermidis
NFDGEKDFEGHET

SEQ ID NO: 1785163 - protein, 8 aa, Staphylococcus epidermidis
NFEEGTSV

SEQ ID NO: 1785164 - protein, 13 aa, Staphylococcus epidermidis
NFEEGTSVKAQPP

SEQ ID NO: 1785165 - protein, 11 aa, Staphylococcus epidermidis
NFESSNDEENT

SEQ ID NO: 1785166 - protein, 10 aa, Staphylococcus epidermidis
NFGPEDPNYD

SEQ ID NO: 1785167 - protein, 37 aa, Staphylococcus epidermidis
NFGQNNEEEEEPPTEEIKTKRSEIKKQLDEGKLEKEK

SEQ ID NO: 1785168 - protein, 5 aa, Staphylococcus epidermidis
NFHGQ

SEQ ID NO: 1785169 - protein, 5 aa, Staphylococcus epidermidis
NFKDY

SEQ ID NO: 1785170 - protein, 5 aa, Staphylococcus epidermidis
NFKGK

SEQ ID NO: 1785171 - protein, 11 aa, Staphylococcus epidermidis
NFKGSAKGDWV

SEQ ID NO: 1785172 - protein, 15 aa, Staphylococcus epidermidis
NFKQAEDSRNPRGQN

SEQ ID NO: 1785173 - protein, 16 aa, Staphylococcus epidermidis
NFKQNDKKENPRGRIV

SEQ ID NO: 1785174 - protein, 6 aa, Staphylococcus epidermidis
NFKSGT

SEQ ID NO: 1785175 - protein, 11 aa, Staphylococcus epidermidis
NFKSSAKGDWV

SEQ ID NO: 1785176 - protein, 8 aa, Staphylococcus epidermidis
NFNDDDEK

SEQ ID NO: 1785177 - protein, 10 aa, Staphylococcus epidermidis
NFNPTDPNYD

SEQ ID NO: 1785178 - protein, 8 aa, Staphylococcus epidermidis
NFPEEAPG

SEQ ID NO: 1785179 - protein, 6 aa, Staphylococcus epidermidis
NFPSEK

SEQ ID NO: 1785180 - protein, 9 aa, Staphylococcus epidermidis
NFRTSNEAE

SEQ ID NO: 1785181 - protein, 10 aa, Staphylococcus epidermidis
NFSDDEKKIY

SEQ ID NO: 1785182 - protein, 5 aa, Staphylococcus epidermidis
NFSDS

SEQ ID NO: 1785183 - protein, 11 aa, Staphylococcus epidermidis
NFSENAEDYGV

SEQ ID NO: 1785184 - protein, 12 aa, Staphylococcus epidermidis
NFSESQLKNNGG

SEQ ID NO: 1785185 - protein, 9 aa, Staphylococcus epidermidis
NFSNSATLE

SEQ ID NO: 1785186 - protein, 7 aa, Staphylococcus epidermidis
NFSSADK

SEQ ID NO: 1785187 - protein, 9 aa, Staphylococcus epidermidis
NFTNQDANE

SEQ ID NO: 1785188 - protein, 6 aa, Staphylococcus epidermidis
NFTPRL

SEQ ID NO: 1785189 - protein, 6 aa, Staphylococcus epidermidis
NFYPSQ

SEQ ID NO: 1785190 - protein, 5 aa, Staphylococcus epidermidis
NGAAA

SEQ ID NO: 1785191 - protein, 7 aa, Staphylococcus epidermidis
NGAGKST

SEQ ID NO: 1785192 - protein, 5 aa, Staphylococcus epidermidis
NGAQG

SEQ ID NO: 1785193 - protein, 6 aa, Staphylococcus epidermidis
NGASSV

SEQ ID NO: 1785194 - protein, 5 aa, Staphylococcus epidermidis
NGATK

SEQ ID NO: 1785195 - protein, 12 aa, Staphylococcus epidermidis
NGCATGGSCNCS

SEQ ID NO: 1785196 - protein, 9 aa, Staphylococcus epidermidis
NGDGHRDKP

SEQ ID NO: 1785197 - protein, 15 aa, Staphylococcus epidermidis
NGDGIAETKQARVSI

SEQ ID NO: 1785198 - protein, 8 aa, Staphylococcus epidermidis
NGDGIAEV

SEQ ID NO: 1785199 - protein, 7 aa, Staphylococcus epidermidis
NGDGIQE

SEQ ID NO: 1785200 - protein, 7 aa, Staphylococcus epidermidis
NGDNIGK

SEQ ID NO: 1785201 - protein, 10 aa, Staphylococcus epidermidis
NGDSAKYDEL

SEQ ID NO: 1785202 - protein, 5 aa, Staphylococcus epidermidis
NGDSM

SEQ ID NO: 1785203 - protein, 9 aa, Staphylococcus epidermidis
NGDSPGSLN

SEQ ID NO: 1785204 - protein, 9 aa, Staphylococcus epidermidis
NGDTKQAKQ

SEQ ID NO: 1785205 - protein, 18 aa, Staphylococcus epidermidis
NGDTSTKNRTNKENWTPT

SEQ ID NO: 1785206 - protein, 6 aa, Staphylococcus epidermidis
NGDYYT

SEQ ID NO: 1785207 - protein, 11 aa, Staphylococcus epidermidis
NGEASGFTSGQ

SEQ ID NO: 1785208 - protein, 21 aa, Staphylococcus epidermidis
NGEDSTKNIESNFTSNKNLQA

SEQ ID NO: 1785209 - protein, 8 aa, Staphylococcus epidermidis
NGEEDLDK

SEQ ID NO: 1785210 - protein, 6 aa, Staphylococcus epidermidis
NGEEVP

SEQ ID NO: 1785211 - protein, 6 aa, Staphylococcus epidermidis
NGEFAD

SEQ ID NO: 1785212 - protein, 16 aa, Staphylococcus epidermidis
NGEKSTKNIESNFTSN

SEQ ID NO: 1785213 - protein, 9 aa, Staphylococcus epidermidis
NGENEPKME

SEQ ID NO: 1785214 - protein, 10 aa, Staphylococcus epidermidis
NGEPAKEDDP

SEQ ID NO: 1785215 - protein, 8 aa, Staphylococcus epidermidis
NGEPAKID

SEQ ID NO: 1785216 - protein, 6 aa, Staphylococcus epidermidis
NGEPFA

SEQ ID NO: 1785217 - protein, 6 aa, Staphylococcus epidermidis
NGEQGE

SEQ ID NO: 1785218 - protein, 5 aa, Staphylococcus epidermidis
NGESQ

SEQ ID NO: 1785219 - protein, 6 aa, Staphylococcus epidermidis
NGETHK

SEQ ID NO: 1785220 - protein, 7 aa, Staphylococcus epidermidis
NGETPDD

SEQ ID NO: 1785221 - protein, 12 aa, Staphylococcus epidermidis
NGEVVQNNDPEF

SEQ ID NO: 1785222 - protein, 5 aa, Staphylococcus epidermidis
NGEYV

SEQ ID NO: 1785223 - protein, 8 aa, Staphylococcus epidermidis
NGGEQSVG

SEQ ID NO: 1785224 - protein, 7 aa, Staphylococcus epidermidis
NGGFTTG

SEQ ID NO: 1785225 - protein, 29 aa, Staphylococcus epidermidis
NGGGKGNDTYGASGKIAKEGAKKGDSDVY

SEQ ID NO: 1785226 - protein, 12 aa, Staphylococcus epidermidis
NGGGSTQHQPIG

SEQ ID NO: 1785227 - protein, 10 aa, Staphylococcus epidermidis
NGGKKDEAPL

SEQ ID NO: 1785228 - protein, 11 aa, Staphylococcus epidermidis
NGGNCAPDGQD

SEQ ID NO: 1785229 - protein, 8 aa, Staphylococcus epidermidis
NGGNLARK

SEQ ID NO: 1785230 - protein, 10 aa, Staphylococcus epidermidis
NGGSQFNSVP

SEQ ID NO: 1785231 - protein, 16 aa, Staphylococcus epidermidis
NGGSQVNSVPDSATAE

SEQ ID NO: 1785232 - protein, 8 aa, Staphylococcus epidermidis
NGGTSTSV

SEQ ID NO: 1785233 - protein, 5 aa, Staphylococcus epidermidis
NGHAQ

SEQ ID NO: 1785234 - protein, 5 aa, Staphylococcus epidermidis
NGHQT

SEQ ID NO: 1785235 - protein, 7 aa, Staphylococcus epidermidis
NGHRNYS

SEQ ID NO: 1785236 - protein, 4 aa, Staphylococcus epidermidis
NGHT

SEQ ID NO: 1785237 - protein, 11 aa, Staphylococcus epidermidis
NGIGKMKENGV

SEQ ID NO: 1785238 - protein, 7 aa, Staphylococcus epidermidis
NGIHSNG

SEQ ID NO: 1785239 - protein, 4 aa, Staphylococcus epidermidis
NGIK

SEQ ID NO: 1785240 - protein, 16 aa, Staphylococcus epidermidis
NGILGKRQSLDEEFPE

SEQ ID NO: 1785241 - protein, 7 aa, Staphylococcus epidermidis
NGISDGQ

SEQ ID NO: 1785242 - protein, 6 aa, Staphylococcus epidermidis
NGITET

SEQ ID NO: 1785243 - protein, 8 aa, Staphylococcus epidermidis
NGKEADKC

SEQ ID NO: 1785244 - protein, 4 aa, Staphylococcus epidermidis
NGKG

SEQ ID NO: 1785245 - protein, 7 aa, Staphylococcus epidermidis
NGKGHSM

SEQ ID NO: 1785246 - protein, 5 aa, Staphylococcus epidermidis
NGKHP

SEQ ID NO: 1785247 - protein, 7 aa, Staphylococcus epidermidis
NGKKDYN

SEQ ID NO: 1785248 - protein, 9 aa, Staphylococcus epidermidis
NGKKGHKKV

SEQ ID NO: 1785249 - protein, 7 aa, Staphylococcus epidermidis
NGKKSND

SEQ ID NO: 1785250 - protein, 8 aa, Staphylococcus epidermidis
NGKKTSTI

SEQ ID NO: 1785251 - protein, 9 aa, Staphylococcus epidermidis
NGKNNHRET

SEQ ID NO: 1785252 - protein, 8 aa, Staphylococcus epidermidis
NGKPDTNN

SEQ ID NO: 1785253 - protein, 8 aa, Staphylococcus epidermidis
NGKPSLPT

SEQ ID NO: 1785254 - protein, 4 aa, Staphylococcus epidermidis
NGKS

SEQ ID NO: 1785255 - protein, 7 aa, Staphylococcus epidermidis
NGKSKEQ

SEQ ID NO: 1785256 - protein, 7 aa, Staphylococcus epidermidis
NGKSTYL

SEQ ID NO: 1785257 - protein, 6 aa, Staphylococcus epidermidis
NGKVDE

SEQ ID NO: 1785258 - protein, 12 aa, Staphylococcus epidermidis
NGKVVNRYQILN

SEQ ID NO: 1785259 - protein, 21 aa, Staphylococcus epidermidis
NGLAQNNPFTGLQTSTGAADL

SEQ ID NO: 1785260 - protein, 9 aa, Staphylococcus epidermidis
NGLDAQGIK

SEQ ID NO: 1785261 - protein, 10 aa, Staphylococcus epidermidis
NGLDTSDYSV

SEQ ID NO: 1785262 - protein, 5 aa, Staphylococcus epidermidis
NGLEE

SEQ ID NO: 1785263 - protein, 6 aa, Staphylococcus epidermidis
NGLEPK

SEQ ID NO: 1785264 - protein, 20 aa, Staphylococcus epidermidis
NGLGYKDEFDEKEKTVHDDA

SEQ ID NO: 1785265 - protein, 23 aa, Staphylococcus epidermidis
NGLKGNVQGPMTLKEPLKSYIQK

SEQ ID NO: 1785266 - protein, 5 aa, Staphylococcus epidermidis
NGLNK

SEQ ID NO: 1785267 - protein, 6 aa, Staphylococcus epidermidis
NGLPLD

SEQ ID NO: 1785268 - protein, 4 aa, Staphylococcus epidermidis
NGLQ

SEQ ID NO: 1785269 - protein, 6 aa, Staphylococcus epidermidis
NGLSDQ

SEQ ID NO: 1785270 - protein, 7 aa, Staphylococcus epidermidis
NGLSPTT

SEQ ID NO: 1785271 - protein, 9 aa, Staphylococcus epidermidis
NGLSSKEIA

SEQ ID NO: 1785272 - protein, 7 aa, Staphylococcus epidermidis
NGLTDTM

SEQ ID NO: 1785273 - protein, 6 aa, Staphylococcus epidermidis
NGLTTA

SEQ ID NO: 1785274 - protein, 13 aa, Staphylococcus epidermidis
NGLVQAGKSLKRL

SEQ ID NO: 1785275 - protein, 11 aa, Staphylococcus epidermidis
NGMDEATLSGE

SEQ ID NO: 1785276 - protein, 9 aa, Staphylococcus epidermidis
NGNENVTDV

SEQ ID NO: 1785277 - protein, 15 aa, Staphylococcus epidermidis
NGNQNVKPETRNKVN

SEQ ID NO: 1785278 - protein, 8 aa, Staphylococcus epidermidis
NGNRPRPL

SEQ ID NO: 1785279 - protein, 8 aa, Staphylococcus epidermidis
NGNTYSEI

SEQ ID NO: 1785280 - protein, 8 aa, Staphylococcus epidermidis
NGNYEPKN

SEQ ID NO: 1785281 - protein, 19 aa, Staphylococcus epidermidis
NGNYNDQYERYATNQEDIV

SEQ ID NO: 1785282 - protein, 9 aa, Staphylococcus epidermidis
NGPESKKRE

SEQ ID NO: 1785283 - protein, 9 aa, Staphylococcus epidermidis
NGPKHPESI

SEQ ID NO: 1785284 - protein, 9 aa, Staphylococcus epidermidis
NGPKQPHEI

SEQ ID NO: 1785285 - protein, 13 aa, Staphylococcus epidermidis
NGPSVAPKETADI

SEQ ID NO: 1785286 - protein, 4 aa, Staphylococcus epidermidis
NGPY

SEQ ID NO: 1785287 - protein, 6 aa, Staphylococcus epidermidis
NGQLTG

SEQ ID NO: 1785288 - protein, 9 aa, Staphylococcus epidermidis
NGQRQRAIE

SEQ ID NO: 1785289 - protein, 8 aa, Staphylococcus epidermidis
NGQSSKAR

SEQ ID NO: 1785290 - protein, 9 aa, Staphylococcus epidermidis
NGQSSKARN

SEQ ID NO: 1785291 - protein, 4 aa, Staphylococcus epidermidis
NGQV

SEQ ID NO: 1785292 - protein, 9 aa, Staphylococcus epidermidis
NGRATTSGY

SEQ ID NO: 1785293 - protein, 6 aa, Staphylococcus epidermidis
NGREPI

SEQ ID NO: 1785294 - protein, 23 aa, Staphylococcus epidermidis
NGRESKQTIETKKNQKQTSLGGK

SEQ ID NO: 1785295 - protein, 11 aa, Staphylococcus epidermidis
NGRGSNKETRH

SEQ ID NO: 1785296 - protein, 9 aa, Staphylococcus epidermidis
NGRGVQAKQ

SEQ ID NO: 1785297 - protein, 13 aa, Staphylococcus epidermidis
NGRKIDIKDGERF

SEQ ID NO: 1785298 - protein, 6 aa, Staphylococcus epidermidis
NGRSKI

SEQ ID NO: 1785299 - protein, 8 aa, Staphylococcus epidermidis
NGRTSETV

SEQ ID NO: 1785300 - protein, 9 aa, Staphylococcus epidermidis
NGSAEEQAK

SEQ ID NO: 1785301 - protein, 12 aa, Staphylococcus epidermidis
NGSEASSQGYTM

SEQ ID NO: 1785302 - protein, 5 aa, Staphylococcus epidermidis
NGSFT

SEQ ID NO: 1785303 - protein, 8 aa, Staphylococcus epidermidis
NGSGDKEI

SEQ ID NO: 1785304 - protein, 5 aa, Staphylococcus epidermidis
NGSGL

SEQ ID NO: 1785305 - protein, 13 aa, Staphylococcus epidermidis
NGSHAYPKDSRYN

SEQ ID NO: 1785306 - protein, 4 aa, Staphylococcus epidermidis
NGSI

SEQ ID NO: 1785307 - protein, 9 aa, Staphylococcus epidermidis
NGSIEDNYD

SEQ ID NO: 1785308 - protein, 9 aa, Staphylococcus epidermidis
NGSIISKNG

SEQ ID NO: 1785309 - protein, 5 aa, Staphylococcus epidermidis
NGSLK

SEQ ID NO: 1785310 - protein, 9 aa, Staphylococcus epidermidis
NGSLSVKGR

SEQ ID NO: 1785311 - protein, 14 aa, Staphylococcus epidermidis
NGSPVDLTKTDMKP

SEQ ID NO: 1785312 - protein, 8 aa, Staphylococcus epidermidis
NGSVYDRE

SEQ ID NO: 1785313 - protein, 15 aa, Staphylococcus epidermidis
NGSYDGLHPNAKGHE

SEQ ID NO: 1785314 - protein, 4 aa, Staphylococcus epidermidis
NGTA

SEQ ID NO: 1785315 - protein, 10 aa, Staphylococcus epidermidis
NGTAKEDFTD

SEQ ID NO: 1785316 - protein, 17 aa, Staphylococcus epidermidis
NGTASRETEQFVAQVIK

SEQ ID NO: 1785317 - protein, 5 aa, Staphylococcus epidermidis
NGTEI

SEQ ID NO: 1785318 - protein, 8 aa, Staphylococcus epidermidis
NGTGIEQD

SEQ ID NO: 1785319 - protein, 23 aa, Staphylococcus epidermidis
NGTKAEADKLANNLATAMRKQGV

SEQ ID NO: 1785320 - protein, 4 aa, Staphylococcus epidermidis
NGTL

SEQ ID NO: 1785321 - protein, 5 aa, Staphylococcus epidermidis
NGTLT

SEQ ID NO: 1785322 - protein, 27 aa, Staphylococcus epidermidis
NGTNESIPQDGTQATFASNISREDERI

SEQ ID NO: 1785323 - protein, 8 aa, Staphylococcus epidermidis
NGTPITND

SEQ ID NO: 1785324 - protein, 6 aa, Staphylococcus epidermidis
NGTQGA

SEQ ID NO: 1785325 - protein, 8 aa, Staphylococcus epidermidis
NGVDEDGN

SEQ ID NO: 1785326 - protein, 8 aa, Staphylococcus epidermidis
NGVENDRQ

SEQ ID NO: 1785327 - protein, 16 aa, Staphylococcus epidermidis
NGVGIENEDASNLKSI

SEQ ID NO: 1785328 - protein, 6 aa, Staphylococcus epidermidis
NGVGKT

SEQ ID NO: 1785329 - protein, 8 aa, Staphylococcus epidermidis
NGVHSNGY

SEQ ID NO: 1785330 - protein, 17 aa, Staphylococcus epidermidis
NGVKDGVAMTSSMDEAY

SEQ ID NO: 1785331 - protein, 13 aa, Staphylococcus epidermidis
NGVLERNGHTEAA

SEQ ID NO: 1785332 - protein, 10 aa, Staphylococcus epidermidis
NGYGKDQYYI

SEQ ID NO: 1785333 - protein, 6 aa, Staphylococcus epidermidis
NGYGKS

SEQ ID NO: 1785334 - protein, 6 aa, Staphylococcus epidermidis
NGYGQV

SEQ ID NO: 1785335 - protein, 7 aa, Staphylococcus epidermidis
NGYPDFK

SEQ ID NO: 1785336 - protein, 6 aa, Staphylococcus epidermidis
NGYSLK

SEQ ID NO: 1785337 - protein, 9 aa, Staphylococcus epidermidis
NHDGKERLN

SEQ ID NO: 1785338 - protein, 5 aa, Staphylococcus epidermidis
NHDGS

SEQ ID NO: 1785339 - protein, 6 aa, Staphylococcus epidermidis
NHDPLR

SEQ ID NO: 1785340 - protein, 16 aa, Staphylococcus epidermidis
NHEKQRNKTNQPQIER

SEQ ID NO: 1785341 - protein, 4 aa, Staphylococcus epidermidis
NHEV

SEQ ID NO: 1785342 - protein, 6 aa, Staphylococcus epidermidis
NHEYGT

SEQ ID NO: 1785343 - protein, 7 aa, Staphylococcus epidermidis
NHGEPSL

SEQ ID NO: 1785344 - protein, 7 aa, Staphylococcus epidermidis
NHGGRTY

SEQ ID NO: 1785345 - protein, 7 aa, Staphylococcus epidermidis
NHGREAD

SEQ ID NO: 1785346 - protein, 4 aa, Staphylococcus epidermidis
NHGT

SEQ ID NO: 1785347 - protein, 8 aa, Staphylococcus epidermidis
NHHSPQNS

SEQ ID NO: 1785348 - protein, 6 aa, Staphylococcus epidermidis
NHKEEL

SEQ ID NO: 1785349 - protein, 6 aa, Staphylococcus epidermidis
NHKNLS

SEQ ID NO: 1785350 - protein, 4 aa, Staphylococcus epidermidis
NHNQ

SEQ ID NO: 1785351 - protein, 4 aa, Staphylococcus epidermidis
NHPA

SEQ ID NO: 1785352 - protein, 8 aa, Staphylococcus epidermidis
NHPLQTKD

SEQ ID NO: 1785353 - protein, 6 aa, Staphylococcus epidermidis
NHPSEV

SEQ ID NO: 1785354 - protein, 8 aa, Staphylococcus epidermidis
NHQPLPQT

SEQ ID NO: 1785355 - protein, 6 aa, Staphylococcus epidermidis
NHRDQH

SEQ ID NO: 1785356 - protein, 4 aa, Staphylococcus epidermidis
NHRE

SEQ ID NO: 1785357 - protein, 6 aa, Staphylococcus epidermidis
NHREKE

SEQ ID NO: 1785358 - protein, 5 aa, Staphylococcus epidermidis
NHRGK

SEQ ID NO: 1785359 - protein, 6 aa, Staphylococcus epidermidis
NHRRPS

SEQ ID NO: 1785360 - protein, 26 aa, Staphylococcus epidermidis
NHSLQGATVNSYKPQNEQQTHAKNTA

SEQ ID NO: 1785361 - protein, 7 aa, Staphylococcus epidermidis
NHTITKE

SEQ ID NO: 1785362 - protein, 6 aa, Staphylococcus epidermidis
NHTSDL

SEQ ID NO: 1785363 - protein, 7 aa, Staphylococcus epidermidis
NHTSEDN

SEQ ID NO: 1785364 - protein, 11 aa, Staphylococcus epidermidis
NHTSKQKKFIP

SEQ ID NO: 1785365 - protein, 6 aa, Staphylococcus epidermidis
NHTSSI

SEQ ID NO: 1785366 - protein, 13 aa, Staphylococcus epidermidis
NHYDSGQIADKSN

SEQ ID NO: 1785367 - protein, 72 aa, Staphylococcus epidermidis
NHYHSNDDSEVEDAEYHELDDNRQQNQSKSQEDIISSESINSNMDDNAISASVDNDTERAKPNEDKNDTEIT

SEQ ID NO: 1785368 - protein, 9 aa, Staphylococcus epidermidis
NHYIETQKS

SEQ ID NO: 1785369 - protein, 10 aa, Staphylococcus epidermidis
NIAQKKTPLH

SEQ ID NO: 1785370 - protein, 11 aa, Staphylococcus epidermidis
NIASPSTTDLI

SEQ ID NO: 1785371 - protein, 11 aa, Staphylococcus epidermidis
NIASPSTTELI

SEQ ID NO: 1785372 - protein, 4 aa, Staphylococcus epidermidis
NIDG

SEQ ID NO: 1785373 - protein, 21 aa, Staphylococcus epidermidis
NIDGSKDIDEVTKDVIDILDH

SEQ ID NO: 1785374 - protein, 10 aa, Staphylococcus epidermidis
NIDRGRDDVD

SEQ ID NO: 1785375 - protein, 5 aa, Staphylococcus epidermidis
NIDTP

SEQ ID NO: 1785376 - protein, 5 aa, Staphylococcus epidermidis
NIETD

SEQ ID NO: 1785377 - protein, 6 aa, Staphylococcus epidermidis
NIETYN

SEQ ID NO: 1785378 - protein, 5 aa, Staphylococcus epidermidis
NIGIG

SEQ ID NO: 1785379 - protein, 9 aa, Staphylococcus epidermidis
NIGTPNDLP

SEQ ID NO: 1785380 - protein, 13 aa, Staphylococcus epidermidis
NIKENGDTPEEYT

SEQ ID NO: 1785381 - protein, 33 aa, Staphylococcus epidermidis
NIKETVGDAANNDNLEQEGKKDKASGKAKEVID

SEQ ID NO: 1785382 - protein, 33 aa, Staphylococcus epidermidis
NIKETVGDATNNDNLEQEGKKDKASGKAKEVID

SEQ ID NO: 1785383 - protein, 47 aa, Staphylococcus epidermidis
NIKETVGDATNNDNLEQEGKKDKASGKAKEVVDNVKDKASDVVDKFK

SEQ ID NO: 1785384 - protein, 6 aa, Staphylococcus epidermidis
NIKGKD

SEQ ID NO: 1785385 - protein, 6 aa, Staphylococcus epidermidis
NIKGKN

SEQ ID NO: 1785386 - protein, 8 aa, Staphylococcus epidermidis
NIKHDEKE

SEQ ID NO: 1785387 - protein, 11 aa, Staphylococcus epidermidis
NIKNNTEETSA

SEQ ID NO: 1785388 - protein, 7 aa, Staphylococcus epidermidis
NIKPGGT

SEQ ID NO: 1785389 - protein, 8 aa, Staphylococcus epidermidis
NIKRERQT

SEQ ID NO: 1785390 - protein, 5 aa, Staphylococcus epidermidis
NIKRR

SEQ ID NO: 1785391 - protein, 10 aa, Staphylococcus epidermidis
NIKSQEEIEK

SEQ ID NO: 1785392 - protein, 6 aa, Staphylococcus epidermidis
NINDDR

SEQ ID NO: 1785393 - protein, 7 aa, Staphylococcus epidermidis
NINEQKI

SEQ ID NO: 1785394 - protein, 4 aa, Staphylococcus epidermidis
NINN

SEQ ID NO: 1785395 - protein, 10 aa, Staphylococcus epidermidis
NINNSNTSLF

SEQ ID NO: 1785396 - protein, 13 aa, Staphylococcus epidermidis
NINQAQNNLNGNK

SEQ ID NO: 1785397 - protein, 8 aa, Staphylococcus epidermidis
NINRSKSF

SEQ ID NO: 1785398 - protein, 4 aa, Staphylococcus epidermidis
NINS

SEQ ID NO: 1785399 - protein, 6 aa, Staphylococcus epidermidis
NINTAP

SEQ ID NO: 1785400 - protein, 7 aa, Staphylococcus epidermidis
NINTHDY

SEQ ID NO: 1785401 - protein, 6 aa, Staphylococcus epidermidis
NIPAGR

SEQ ID NO: 1785402 - protein, 8 aa, Staphylococcus epidermidis
NIPDTEAQ

SEQ ID NO: 1785403 - protein, 8 aa, Staphylococcus epidermidis
NIPEDNEK

SEQ ID NO: 1785404 - protein, 6 aa, Staphylococcus epidermidis
NIQSEN

SEQ ID NO: 1785405 - protein, 12 aa, Staphylococcus epidermidis
NIRREKKIDERP

SEQ ID NO: 1785406 - protein, 4 aa, Staphylococcus epidermidis
NISE

SEQ ID NO: 1785407 - protein, 10 aa, Staphylococcus epidermidis
NISIEDSGVI

SEQ ID NO: 1785408 - protein, 10 aa, Staphylococcus epidermidis
NISKKDSDGF

SEQ ID NO: 1785409 - protein, 16 aa, Staphylococcus epidermidis
NISKLSKSELRKKRQK

SEQ ID NO: 1785410 - protein, 10 aa, Staphylococcus epidermidis
NISKTAKKIQ

SEQ ID NO: 1785411 - protein, 8 aa, Staphylococcus epidermidis
NISNTGPY

SEQ ID NO: 1785412 - protein, 5 aa, Staphylococcus epidermidis
NISPC

SEQ ID NO: 1785413 - protein, 7 aa, Staphylococcus epidermidis
NISRKEK

SEQ ID NO: 1785414 - protein, 5 aa, Staphylococcus epidermidis
NISSQ

SEQ ID NO: 1785415 - protein, 15 aa, Staphylococcus epidermidis
NISYQEAMNNDDYRP

SEQ ID NO: 1785416 - protein, 22 aa, Staphylococcus epidermidis
NITDNEKKEDMTLDTFRQNVSG

SEQ ID NO: 1785417 - protein, 7 aa, Staphylococcus epidermidis
NITKETH

SEQ ID NO: 1785418 - protein, 5 aa, Staphylococcus epidermidis
NITPQ

SEQ ID NO: 1785419 - protein, 16 aa, Staphylococcus epidermidis
NITQENSMGLSADNRI

SEQ ID NO: 1785420 - protein, 12 aa, Staphylococcus epidermidis
NITSFGQEDNYD

SEQ ID NO: 1785421 - protein, 13 aa, Staphylococcus epidermidis
NITSKGGTTQAGL

SEQ ID NO: 1785422 - protein, 14 aa, Staphylococcus epidermidis
NITSNSEETSSVSK

SEQ ID NO: 1785423 - protein, 14 aa, Staphylococcus epidermidis
NITSNSEETSTVSK

SEQ ID NO: 1785424 - protein, 18 aa, Staphylococcus epidermidis
NITSQSELKKKLKETLDD

SEQ ID NO: 1785425 - protein, 9 aa, Staphylococcus epidermidis
NKAAKEMKT

SEQ ID NO: 1785426 - protein, 7 aa, Staphylococcus epidermidis
NKADNYQ

SEQ ID NO: 1785427 - protein, 14 aa, Staphylococcus epidermidis
NKADRIKSKLMTAN

SEQ ID NO: 1785428 - protein, 8 aa, Staphylococcus epidermidis
NKADVSQV

SEQ ID NO: 1785429 - protein, 6 aa, Staphylococcus epidermidis
NKAEDL

SEQ ID NO: 1785430 - protein, 9 aa, Staphylococcus epidermidis
NKAKGQNLN

SEQ ID NO: 1785431 - protein, 4 aa, Staphylococcus epidermidis
NKAN

SEQ ID NO: 1785432 - protein, 47 aa, Staphylococcus epidermidis
NKANATDESKAQAKKAAEDAAKEAHTNIDHANSNKAVQTAKNDGTIA

SEQ ID NO: 1785433 - protein, 33 aa, Staphylococcus epidermidis
NKAPEKVINEEKEKQQHYQEKYDGVKSRIEQLK

SEQ ID NO: 1785434 - protein, 6 aa, Staphylococcus epidermidis
NKAPEV

SEQ ID NO: 1785435 - protein, 19 aa, Staphylococcus epidermidis
NKAPGHQDIQDDKCDPGNA

SEQ ID NO: 1785436 - protein, 6 aa, Staphylococcus epidermidis
NKAQDD

SEQ ID NO: 1785437 - protein, 6 aa, Staphylococcus epidermidis
NKAQDV

SEQ ID NO: 1785438 - protein, 18 aa, Staphylococcus epidermidis
NKARHGQLTQKDMEGGTF

SEQ ID NO: 1785439 - protein, 8 aa, Staphylococcus epidermidis
NKASQYGI

SEQ ID NO: 1785440 - protein, 10 aa, Staphylococcus epidermidis
NKASSQKQAR

SEQ ID NO: 1785441 - protein, 8 aa, Staphylococcus epidermidis
NKDAHGPF

SEQ ID NO: 1785442 - protein, 4 aa, Staphylococcus epidermidis
NKDE

SEQ ID NO: 1785443 - protein, 9 aa, Staphylococcus epidermidis
NKDEEGKFT

SEQ ID NO: 1785444 - protein, 15 aa, Staphylococcus epidermidis
NKDERMGPHPADYNG

SEQ ID NO: 1785445 - protein, 6 aa, Staphylococcus epidermidis
NKDESV

SEQ ID NO: 1785446 - protein, 6 aa, Staphylococcus epidermidis
NKDGRY

SEQ ID NO: 1785447 - protein, 18 aa, Staphylococcus epidermidis
NKDHTYTPLPNKNIDTGM

SEQ ID NO: 1785448 - protein, 4 aa, Staphylococcus epidermidis
NKDK

SEQ ID NO: 1785449 - protein, 9 aa, Staphylococcus epidermidis
NKDKIDGSL

SEQ ID NO: 1785450 - protein, 7 aa, Staphylococcus epidermidis
NKDLDDE

SEQ ID NO: 1785451 - protein, 4 aa, Staphylococcus epidermidis
NKDM

SEQ ID NO: 1785452 - protein, 10 aa, Staphylococcus epidermidis
NKDNAQRAVD

SEQ ID NO: 1785453 - protein, 7 aa, Staphylococcus epidermidis
NKDNPNA

SEQ ID NO: 1785454 - protein, 10 aa, Staphylococcus epidermidis
NKDPNYQKQT

SEQ ID NO: 1785455 - protein, 22 aa, Staphylococcus epidermidis
NKDQIAARQNKLSQIKDEDRLN

SEQ ID NO: 1785456 - protein, 11 aa, Staphylococcus epidermidis
NKDQKKSAEEY

SEQ ID NO: 1785457 - protein, 8 aa, Staphylococcus epidermidis
NKDQLDGK

SEQ ID NO: 1785458 - protein, 9 aa, Staphylococcus epidermidis
NKDQNLETR

SEQ ID NO: 1785459 - protein, 4 aa, Staphylococcus epidermidis
NKDS

SEQ ID NO: 1785460 - protein, 9 aa, Staphylococcus epidermidis
NKDTDVVDD

SEQ ID NO: 1785461 - protein, 8 aa, Staphylococcus epidermidis
NKDYYNPK

SEQ ID NO: 1785462 - protein, 12 aa, Staphylococcus epidermidis
NKEAQKIFEVEK

SEQ ID NO: 1785463 - protein, 5 aa, Staphylococcus epidermidis
NKEDI

SEQ ID NO: 1785464 - protein, 11 aa, Staphylococcus epidermidis
NKEDKAEPAIA

SEQ ID NO: 1785465 - protein, 24 aa, Staphylococcus epidermidis
NKEDKAEPAIATSFPKKSNGGKTL

SEQ ID NO: 1785466 - protein, 14 aa, Staphylococcus epidermidis
NKEEKEKIKNKEIK

SEQ ID NO: 1785467 - protein, 5 aa, Staphylococcus epidermidis
NKEEL

SEQ ID NO: 1785468 - protein, 6 aa, Staphylococcus epidermidis
NKEELE

SEQ ID NO: 1785469 - protein, 5 aa, Staphylococcus epidermidis
NKEEN

SEQ ID NO: 1785470 - protein, 6 aa, Staphylococcus epidermidis
NKEESV

SEQ ID NO: 1785471 - protein, 4 aa, Staphylococcus epidermidis
NKEG

SEQ ID NO: 1785472 - protein, 14 aa, Staphylococcus epidermidis
NKEGFSSSEAAKNG

SEQ ID NO: 1785473 - protein, 12 aa, Staphylococcus epidermidis
NKEHRNEGIAES

SEQ ID NO: 1785474 - protein, 7 aa, Staphylococcus epidermidis
NKEIEGA

SEQ ID NO: 1785475 - protein, 8 aa, Staphylococcus epidermidis
NKEISPYT

SEQ ID NO: 1785476 - protein, 5 aa, Staphylococcus epidermidis
NKEIT

SEQ ID NO: 1785477 - protein, 9 aa, Staphylococcus epidermidis
NKEKDDLLR

SEQ ID NO: 1785478 - protein, 19 aa, Staphylococcus epidermidis
NKEKVESLSIEEKQEQHQL

SEQ ID NO: 1785479 - protein, 9 aa, Staphylococcus epidermidis
NKEKYQYTG

SEQ ID NO: 1785480 - protein, 7 aa, Staphylococcus epidermidis
NKENVDE

SEQ ID NO: 1785481 - protein, 9 aa, Staphylococcus epidermidis
NKENVSNPE

SEQ ID NO: 1785482 - protein, 5 aa, Staphylococcus epidermidis
NKENY

SEQ ID NO: 1785483 - protein, 7 aa, Staphylococcus epidermidis
NKEPIHQ

SEQ ID NO: 1785484 - protein, 7 aa, Staphylococcus epidermidis
NKERDDV

SEQ ID NO: 1785485 - protein, 8 aa, Staphylococcus epidermidis
NKETNIQE

SEQ ID NO: 1785486 - protein, 6 aa, Staphylococcus epidermidis
NKETYE

SEQ ID NO: 1785487 - protein, 5 aa, Staphylococcus epidermidis
NKEVT

SEQ ID NO: 1785488 - protein, 4 aa, Staphylococcus epidermidis
NKEY

SEQ ID NO: 1785489 - protein, 20 aa, Staphylococcus epidermidis
NKFRQNKSLQPAGGSRSSNI

SEQ ID NO: 1785490 - protein, 20 aa, Staphylococcus epidermidis
NKFRQNKTLKASGGSRSSNI

SEQ ID NO: 1785491 - protein, 20 aa, Staphylococcus epidermidis
NKFRQNKTLKATGGSRSSNI

SEQ ID NO: 1785492 - protein, 11 aa, Staphylococcus epidermidis
NKFTENTRAAY

SEQ ID NO: 1785493 - protein, 6 aa, Staphylococcus epidermidis
NKGDKL

SEQ ID NO: 1785494 - protein, 8 aa, Staphylococcus epidermidis
NKGEFPKE

SEQ ID NO: 1785495 - protein, 8 aa, Staphylococcus epidermidis
NKGEKHPK

SEQ ID NO: 1785496 - protein, 7 aa, Staphylococcus epidermidis
NKGEVDA

SEQ ID NO: 1785497 - protein, 14 aa, Staphylococcus epidermidis
NKGFTPNTKNDKYW

SEQ ID NO: 1785498 - protein, 23 aa, Staphylococcus epidermidis
NKGGNEVPKKDTTVFDEQETHVN

SEQ ID NO: 1785499 - protein, 9 aa, Staphylococcus epidermidis
NKGKDVNDY

SEQ ID NO: 1785500 - protein, 5 aa, Staphylococcus epidermidis
NKGKL

SEQ ID NO: 1785501 - protein, 6 aa, Staphylococcus epidermidis
NKGKNT

SEQ ID NO: 1785502 - protein, 9 aa, Staphylococcus epidermidis
NKGNSDGIE

SEQ ID NO: 1785503 - protein, 7 aa, Staphylococcus epidermidis
NKGNTTF

SEQ ID NO: 1785504 - protein, 9 aa, Staphylococcus epidermidis
NKGPFSNTY

SEQ ID NO: 1785505 - protein, 12 aa, Staphylococcus epidermidis
NKGQNGKKERRN

SEQ ID NO: 1785506 - protein, 7 aa, Staphylococcus epidermidis
NKGRIRT

SEQ ID NO: 1785507 - protein, 5 aa, Staphylococcus epidermidis
NKGTD

SEQ ID NO: 1785508 - protein, 10 aa, Staphylococcus epidermidis
NKGTTGNAAQ

SEQ ID NO: 1785509 - protein, 15 aa, Staphylococcus epidermidis
NKHNQVDDYPFGGGQ

SEQ ID NO: 1785510 - protein, 7 aa, Staphylococcus epidermidis
NKHVSKT

SEQ ID NO: 1785511 - protein, 8 aa, Staphylococcus epidermidis
NKIDNEEA

SEQ ID NO: 1785512 - protein, 17 aa, Staphylococcus epidermidis
NKIEPTKPIADETLKKE

SEQ ID NO: 1785513 - protein, 6 aa, Staphylococcus epidermidis
NKIKAS

SEQ ID NO: 1785514 - protein, 9 aa, Staphylococcus epidermidis
NKINQTDIQ

SEQ ID NO: 1785515 - protein, 10 aa, Staphylococcus epidermidis
NKIRSNPEIS

SEQ ID NO: 1785516 - protein, 17 aa, Staphylococcus epidermidis
NKISEEEIEATGAGDQG

SEQ ID NO: 1785517 - protein, 11 aa, Staphylococcus epidermidis
NKITKRIRDPT

SEQ ID NO: 1785518 - protein, 19 aa, Staphylococcus epidermidis
NKITSEAAKELPLTQRYFL

SEQ ID NO: 1785519 - protein, 53 aa, Staphylococcus epidermidis
NKKAKADKASKAKKGSKSTSKSSKSVKGDSDASAKKGHGGSGGSGKKIKIQPE

SEQ ID NO: 1785520 - protein, 7 aa, Staphylococcus epidermidis
NKKAQLE

SEQ ID NO: 1785521 - protein, 8 aa, Staphylococcus epidermidis
NKKDGSNL

SEQ ID NO: 1785522 - protein, 13 aa, Staphylococcus epidermidis
NKKDIKTAKQAYD

SEQ ID NO: 1785523 - protein, 6 aa, Staphylococcus epidermidis
NKKEIN

SEQ ID NO: 1785524 - protein, 24 aa, Staphylococcus epidermidis
NKKEKTRNPANPFTTSTLQQEAAR

SEQ ID NO: 1785525 - protein, 18 aa, Staphylococcus epidermidis
NKKESENLGDVRNVSAKD

SEQ ID NO: 1785526 - protein, 10 aa, Staphylococcus epidermidis
NKKGTPGTII

SEQ ID NO: 1785527 - protein, 5 aa, Staphylococcus epidermidis
NKKGY

SEQ ID NO: 1785528 - protein, 15 aa, Staphylococcus epidermidis
NKKIQKLENQLEEER

SEQ ID NO: 1785529 - protein, 11 aa, Staphylococcus epidermidis
NKKITKRVAEA

SEQ ID NO: 1785530 - protein, 16 aa, Staphylococcus epidermidis
NKKKKDFKYYQQREKS

SEQ ID NO: 1785531 - protein, 11 aa, Staphylococcus epidermidis
NKKKLDKGTKI

SEQ ID NO: 1785532 - protein, 5 aa, Staphylococcus epidermidis
NKKLS

SEQ ID NO: 1785533 - protein, 7 aa, Staphylococcus epidermidis
NKKLTNE

SEQ ID NO: 1785534 - protein, 9 aa, Staphylococcus epidermidis
NKKNGYIEN

SEQ ID NO: 1785535 - protein, 9 aa, Staphylococcus epidermidis
NKKPFEEQE

SEQ ID NO: 1785536 - protein, 15 aa, Staphylococcus epidermidis
NKKSELTEDKLRAFG

SEQ ID NO: 1785537 - protein, 7 aa, Staphylococcus epidermidis
NKKSGEI

SEQ ID NO: 1785538 - protein, 9 aa, Staphylococcus epidermidis
NKKSYYDYE

SEQ ID NO: 1785539 - protein, 22 aa, Staphylococcus epidermidis
NKKVRGRKLGEDYNKGGIEDGF

SEQ ID NO: 1785540 - protein, 19 aa, Staphylococcus epidermidis
NKKVRGRKLGEDYNKGGIQ

SEQ ID NO: 1785541 - protein, 10 aa, Staphylococcus epidermidis
NKKYDNPFDP

SEQ ID NO: 1785542 - protein, 5 aa, Staphylococcus epidermidis
NKLEK

SEQ ID NO: 1785543 - protein, 12 aa, Staphylococcus epidermidis
NKLNKKAKKNYL

SEQ ID NO: 1785544 - protein, 15 aa, Staphylococcus epidermidis
NKLPSEVSGGQKQRV

SEQ ID NO: 1785545 - protein, 5 aa, Staphylococcus epidermidis
NKLSF

SEQ ID NO: 1785546 - protein, 7 aa, Staphylococcus epidermidis
NKLTKEQ

SEQ ID NO: 1785547 - protein, 6 aa, Staphylococcus epidermidis
NKMDEN

SEQ ID NO: 1785548 - protein, 6 aa, Staphylococcus epidermidis
NKNDSF

SEQ ID NO: 1785549 - protein, 5 aa, Staphylococcus epidermidis
NKNEI

SEQ ID NO: 1785550 - protein, 8 aa, Staphylococcus epidermidis
NKNEQPIL

SEQ ID NO: 1785551 - protein, 8 aa, Staphylococcus epidermidis
NKNEYDAD

SEQ ID NO: 1785552 - protein, 22 aa, Staphylococcus epidermidis
NKNGEYDKAASQAKAAEQATYQ

SEQ ID NO: 1785553 - protein, 7 aa, Staphylococcus epidermidis
NKNGMAP

SEQ ID NO: 1785554 - protein, 11 aa, Staphylococcus epidermidis
NKNGNKIRKQE

SEQ ID NO: 1785555 - protein, 18 aa, Staphylococcus epidermidis
NKNHLQSKKVDVEPVFWI

SEQ ID NO: 1785556 - protein, 6 aa, Staphylococcus epidermidis
NKNHTI

SEQ ID NO: 1785557 - protein, 6 aa, Staphylococcus epidermidis
NKNKED

SEQ ID NO: 1785558 - protein, 10 aa, Staphylococcus epidermidis
NKNKELKQRL

SEQ ID NO: 1785559 - protein, 7 aa, Staphylococcus epidermidis
NKNKNYD

SEQ ID NO: 1785560 - protein, 9 aa, Staphylococcus epidermidis
NKNLQSTKN

SEQ ID NO: 1785561 - protein, 7 aa, Staphylococcus epidermidis
NKNNAHK

SEQ ID NO: 1785562 - protein, 7 aa, Staphylococcus epidermidis
NKNNHGI

SEQ ID NO: 1785563 - protein, 6 aa, Staphylococcus epidermidis
NKNREI

SEQ ID NO: 1785564 - protein, 15 aa, Staphylococcus epidermidis
NKNSFTEESQKRTKR

SEQ ID NO: 1785565 - protein, 6 aa, Staphylococcus epidermidis
NKNSKL

SEQ ID NO: 1785566 - protein, 14 aa, Staphylococcus epidermidis
NKNTDSLGKLWGTI

SEQ ID NO: 1785567 - protein, 6 aa, Staphylococcus epidermidis
NKNTGN

SEQ ID NO: 1785568 - protein, 8 aa, Staphylococcus epidermidis
NKNTNYPS

SEQ ID NO: 1785569 - protein, 10 aa, Staphylococcus epidermidis
NKNTSYEDRY

SEQ ID NO: 1785570 - protein, 6 aa, Staphylococcus epidermidis
NKNTYN

SEQ ID NO: 1785571 - protein, 12 aa, Staphylococcus epidermidis
NKNYQGLNSKNN

SEQ ID NO: 1785572 - protein, 6 aa, Staphylococcus epidermidis
NKPALE

SEQ ID NO: 1785573 - protein, 18 aa, Staphylococcus epidermidis
NKPAMSAQAVGGAVGSNP

SEQ ID NO: 1785574 - protein, 6 aa, Staphylococcus epidermidis
NKPAQN

SEQ ID NO: 1785575 - protein, 4 aa, Staphylococcus epidermidis
NKPN

SEQ ID NO: 1785576 - protein, 19 aa, Staphylococcus epidermidis
NKPQLTSNESQESAKDELT

SEQ ID NO: 1785577 - protein, 8 aa, Staphylococcus epidermidis
NKPSANFP

SEQ ID NO: 1785578 - protein, 7 aa, Staphylococcus epidermidis
NKPSKRL

SEQ ID NO: 1785579 - protein, 9 aa, Staphylococcus epidermidis
NKPSTIPKK

SEQ ID NO: 1785580 - protein, 5 aa, Staphylococcus epidermidis
NKPYI

SEQ ID NO: 1785581 - protein, 7 aa, Staphylococcus epidermidis
NKQFDET

SEQ ID NO: 1785582 - protein, 8 aa, Staphylococcus epidermidis
NKQGYTPK

SEQ ID NO: 1785583 - protein, 23 aa, Staphylococcus epidermidis
NKQKHPFKYDNDDSTFSKPQKAI

SEQ ID NO: 1785584 - protein, 9 aa, Staphylococcus epidermidis
NKQPPTMDK

SEQ ID NO: 1785585 - protein, 4 aa, Staphylococcus epidermidis
NKQR

SEQ ID NO: 1785586 - protein, 8 aa, Staphylococcus epidermidis
NKQRQKID

SEQ ID NO: 1785587 - protein, 5 aa, Staphylococcus epidermidis
NKQSW

SEQ ID NO: 1785588 - protein, 13 aa, Staphylococcus epidermidis
NKRIENPETESDW

SEQ ID NO: 1785589 - protein, 14 aa, Staphylococcus epidermidis
NKRRDNLPITSLFN

SEQ ID NO: 1785590 - protein, 13 aa, Staphylococcus epidermidis
NKSAAKSLNPAKQ

SEQ ID NO: 1785591 - protein, 19 aa, Staphylococcus epidermidis
NKSAREKEAKRVKQMMQED

SEQ ID NO: 1785592 - protein, 10 aa, Staphylococcus epidermidis
NKSDNKKVED

SEQ ID NO: 1785593 - protein, 6 aa, Staphylococcus epidermidis
NKSDNR

SEQ ID NO: 1785594 - protein, 8 aa, Staphylococcus epidermidis
NKSDQHKL

SEQ ID NO: 1785595 - protein, 13 aa, Staphylococcus epidermidis
NKSFSENTKSRFE

SEQ ID NO: 1785596 - protein, 8 aa, Staphylococcus epidermidis
NKSGDTLI

SEQ ID NO: 1785597 - protein, 28 aa, Staphylococcus epidermidis
NKSGQTVETVTSESNSETSRTTDNSRLS

SEQ ID NO: 1785598 - protein, 4 aa, Staphylococcus epidermidis
NKSI

SEQ ID NO: 1785599 - protein, 13 aa, Staphylococcus epidermidis
NKSKGYYILKSSK

SEQ ID NO: 1785600 - protein, 15 aa, Staphylococcus epidermidis
NKSLDGRNPSPFSSN

SEQ ID NO: 1785601 - protein, 8 aa, Staphylococcus epidermidis
NKSNEQAL

SEQ ID NO: 1785602 - protein, 6 aa, Staphylococcus epidermidis
NKSNYF

SEQ ID NO: 1785603 - protein, 9 aa, Staphylococcus epidermidis
NKSQDPVMN

SEQ ID NO: 1785604 - protein, 5 aa, Staphylococcus epidermidis
NKSQN

SEQ ID NO: 1785605 - protein, 6 aa, Staphylococcus epidermidis
NKSVKT

SEQ ID NO: 1785606 - protein, 6 aa, Staphylococcus epidermidis
NKTAQT

SEQ ID NO: 1785607 - protein, 28 aa, Staphylococcus epidermidis
NKTEESVETHLDKDNYKHVKTPSPSKDN

SEQ ID NO: 1785608 - protein, 19 aa, Staphylococcus epidermidis
NKTFKDKVSQLNPDSPQHA

SEQ ID NO: 1785609 - protein, 7 aa, Staphylococcus epidermidis
NKTGGSH

SEQ ID NO: 1785610 - protein, 10 aa, Staphylococcus epidermidis
NKTHKNDTVT

SEQ ID NO: 1785611 - protein, 9 aa, Staphylococcus epidermidis
NKTIDKPKQ

SEQ ID NO: 1785612 - protein, 8 aa, Staphylococcus epidermidis
NKTKDIPL

SEQ ID NO: 1785613 - protein, 9 aa, Staphylococcus epidermidis
NKTKNQIEN

SEQ ID NO: 1785614 - protein, 6 aa, Staphylococcus epidermidis
NKTPYD

SEQ ID NO: 1785615 - protein, 11 aa, Staphylococcus epidermidis
NKTRDALEQSY

SEQ ID NO: 1785616 - protein, 17 aa, Staphylococcus epidermidis
NKTRYSGDRSTETNDST

SEQ ID NO: 1785617 - protein, 7 aa, Staphylococcus epidermidis
NKTSERH

SEQ ID NO: 1785618 - protein, 12 aa, Staphylococcus epidermidis
NKTSIDDEEKIK

SEQ ID NO: 1785619 - protein, 8 aa, Staphylococcus epidermidis
NKTSNETI

SEQ ID NO: 1785620 - protein, 7 aa, Staphylococcus epidermidis
NKTTSYL

SEQ ID NO: 1785621 - protein, 4 aa, Staphylococcus epidermidis
NKTY

SEQ ID NO: 1785622 - protein, 25 aa, Staphylococcus epidermidis
NKVEVTKDNTTVVDGDGDENNIDAR

SEQ ID NO: 1785623 - protein, 6 aa, Staphylococcus epidermidis
NKVHPN

SEQ ID NO: 1785624 - protein, 10 aa, Staphylococcus epidermidis
NKVKNHGKKI

SEQ ID NO: 1785625 - protein, 8 aa, Staphylococcus epidermidis
NKVPSSDV

SEQ ID NO: 1785626 - protein, 5 aa, Staphylococcus epidermidis
NKVSF

SEQ ID NO: 1785627 - protein, 13 aa, Staphylococcus epidermidis
NKVTIEKEVREDE

SEQ ID NO: 1785628 - protein, 8 aa, Staphylococcus epidermidis
NKYANQKE

SEQ ID NO: 1785629 - protein, 9 aa, Staphylococcus epidermidis
NKYATDEVK

SEQ ID NO: 1785630 - protein, 9 aa, Staphylococcus epidermidis
NKYDNLQTR

SEQ ID NO: 1785631 - protein, 9 aa, Staphylococcus epidermidis
NKYGYSTRY

SEQ ID NO: 1785632 - protein, 14 aa, Staphylococcus epidermidis
NKYKEAEEKYQKEL

SEQ ID NO: 1785633 - protein, 7 aa, Staphylococcus epidermidis
NKYNKLA

SEQ ID NO: 1785634 - protein, 14 aa, Staphylococcus epidermidis
NKYQDIKKEDTKHE

SEQ ID NO: 1785635 - protein, 7 aa, Staphylococcus epidermidis
NKYTGLN

SEQ ID NO: 1785636 - protein, 15 aa, Staphylococcus epidermidis
NLADASGQKYGLGSS

SEQ ID NO: 1785637 - protein, 12 aa, Staphylococcus epidermidis
NLDHQESDSVEQ

SEQ ID NO: 1785638 - protein, 16 aa, Staphylococcus epidermidis
NLDSRVNEALSSNNDD

SEQ ID NO: 1785639 - protein, 11 aa, Staphylococcus epidermidis
NLEEGNSPSTL

SEQ ID NO: 1785640 - protein, 18 aa, Staphylococcus epidermidis
NLEKENEELKKIISHLEK

SEQ ID NO: 1785641 - protein, 7 aa, Staphylococcus epidermidis
NLEKSNI

SEQ ID NO: 1785642 - protein, 18 aa, Staphylococcus epidermidis
NLESQIDSIKNEKAQNEK

SEQ ID NO: 1785643 - protein, 12 aa, Staphylococcus epidermidis
NLGGNTDKDENN

SEQ ID NO: 1785644 - protein, 11 aa, Staphylococcus epidermidis
NLKEDKNISDS

SEQ ID NO: 1785645 - protein, 12 aa, Staphylococcus epidermidis
NLKEKPDPSNLG

SEQ ID NO: 1785646 - protein, 9 aa, Staphylococcus epidermidis
NLKGDVNAA

SEQ ID NO: 1785647 - protein, 11 aa, Staphylococcus epidermidis
NLKKQQKQSVN

SEQ ID NO: 1785648 - protein, 7 aa, Staphylococcus epidermidis
NLKPKRR

SEQ ID NO: 1785649 - protein, 7 aa, Staphylococcus epidermidis
NLKPSSG

SEQ ID NO: 1785650 - protein, 9 aa, Staphylococcus epidermidis
NLLRGKDEN

SEQ ID NO: 1785651 - protein, 14 aa, Staphylococcus epidermidis
NLNDAQKQAITQSI

SEQ ID NO: 1785652 - protein, 6 aa, Staphylococcus epidermidis
NLNDES

SEQ ID NO: 1785653 - protein, 5 aa, Staphylococcus epidermidis
NLNKE

SEQ ID NO: 1785654 - protein, 12 aa, Staphylococcus epidermidis
NLNNAQKGLEDT

SEQ ID NO: 1785655 - protein, 8 aa, Staphylococcus epidermidis
NLNNEASV

SEQ ID NO: 1785656 - protein, 14 aa, Staphylococcus epidermidis
NLNNQVKQTTKTFN

SEQ ID NO: 1785657 - protein, 6 aa, Staphylococcus epidermidis
NLNSDS

SEQ ID NO: 1785658 - protein, 12 aa, Staphylococcus epidermidis
NLNTPQKNAEKA

SEQ ID NO: 1785659 - protein, 6 aa, Staphylococcus epidermidis
NLPDEH

SEQ ID NO: 1785660 - protein, 6 aa, Staphylococcus epidermidis
NLPDEI

SEQ ID NO: 1785661 - protein, 9 aa, Staphylococcus epidermidis
NLPDVATKS

SEQ ID NO: 1785662 - protein, 12 aa, Staphylococcus epidermidis
NLPISGTKPKLI

SEQ ID NO: 1785663 - protein, 22 aa, Staphylococcus epidermidis
NLPKDVKPSKTVTNNNKTTAKA

SEQ ID NO: 1785664 - protein, 5 aa, Staphylococcus epidermidis
NLPNN

SEQ ID NO: 1785665 - protein, 13 aa, Staphylococcus epidermidis
NLPTSYTYSSDTY

SEQ ID NO: 1785666 - protein, 8 aa, Staphylococcus epidermidis
NLPYKGSL

SEQ ID NO: 1785667 - protein, 10 aa, Staphylococcus epidermidis
NLQDNTKAKQ

SEQ ID NO: 1785668 - protein, 10 aa, Staphylococcus epidermidis
NLQGTGTGNA

SEQ ID NO: 1785669 - protein, 6 aa, Staphylococcus epidermidis
NLQNQT

SEQ ID NO: 1785670 - protein, 12 aa, Staphylococcus epidermidis
NLQTAQNLDSAM

SEQ ID NO: 1785671 - protein, 6 aa, Staphylococcus epidermidis
NLRENE

SEQ ID NO: 1785672 - protein, 7 aa, Staphylococcus epidermidis
NLSDKPV

SEQ ID NO: 1785673 - protein, 17 aa, Staphylococcus epidermidis
NLSDKSEKVLKKFTELM

SEQ ID NO: 1785674 - protein, 8 aa, Staphylococcus epidermidis
NLSETRKA

SEQ ID NO: 1785675 - protein, 5 aa, Staphylococcus epidermidis
NLSGF

SEQ ID NO: 1785676 - protein, 10 aa, Staphylococcus epidermidis
NLSPEEKQKH

SEQ ID NO: 1785677 - protein, 7 aa, Staphylococcus epidermidis
NLSPTNT

SEQ ID NO: 1785678 - protein, 4 aa, Staphylococcus epidermidis
NLSQ

SEQ ID NO: 1785679 - protein, 11 aa, Staphylococcus epidermidis
NLSQEDAKARV

SEQ ID NO: 1785680 - protein, 8 aa, Staphylococcus epidermidis
NLSQEDYF

SEQ ID NO: 1785681 - protein, 14 aa, Staphylococcus epidermidis
NLTGRTIKDTTGDI

SEQ ID NO: 1785682 - protein, 10 aa, Staphylococcus epidermidis
NLTNGPLEGI

SEQ ID NO: 1785683 - protein, 14 aa, Staphylococcus epidermidis
NLTNNSEETSSVSS

SEQ ID NO: 1785684 - protein, 11 aa, Staphylococcus epidermidis
NLTTIDKAKAS

SEQ ID NO: 1785685 - protein, 11 aa, Staphylococcus epidermidis
NLVGDRSTSEL

SEQ ID NO: 1785686 - protein, 5 aa, Staphylococcus epidermidis
NMENR

SEQ ID NO: 1785687 - protein, 7 aa, Staphylococcus epidermidis
NMGNSDF

SEQ ID NO: 1785688 - protein, 25 aa, Staphylococcus epidermidis
NMPENPKSVSEIKKEQSNKEDKKKD

SEQ ID NO: 1785689 - protein, 5 aa, Staphylococcus epidermidis
NMPNR

SEQ ID NO: 1785690 - protein, 5 aa, Staphylococcus epidermidis
NMPTD

SEQ ID NO: 1785691 - protein, 10 aa, Staphylococcus epidermidis
NMTKEDREKA

SEQ ID NO: 1785692 - protein, 10 aa, Staphylococcus epidermidis
NNAASQFGQT

SEQ ID NO: 1785693 - protein, 9 aa, Staphylococcus epidermidis
NNAEVQLGA

SEQ ID NO: 1785694 - protein, 6 aa, Staphylococcus epidermidis
NNAKSV

SEQ ID NO: 1785695 - protein, 18 aa, Staphylococcus epidermidis
NNAKTRDKVTEQTQVAQE

SEQ ID NO: 1785696 - protein, 6 aa, Staphylococcus epidermidis
NNALTK

SEQ ID NO: 1785697 - protein, 27 aa, Staphylococcus epidermidis
NNANPTKQSGNYINEDPAQKEAYNQAI

SEQ ID NO: 1785698 - protein, 20 aa, Staphylococcus epidermidis
NNAQKEAEKNAVNTSPTLEQ

SEQ ID NO: 1785699 - protein, 33 aa, Staphylococcus epidermidis
NNAQRQGEHNEINTAPSRTEVANDLNNAKALNE

SEQ ID NO: 1785700 - protein, 9 aa, Staphylococcus epidermidis
NNASAETEN

SEQ ID NO: 1785701 - protein, 7 aa, Staphylococcus epidermidis
NNATQEQ

SEQ ID NO: 1785702 - protein, 15 aa, Staphylococcus epidermidis
NNDDEIEETAQGETV

SEQ ID NO: 1785703 - protein, 16 aa, Staphylococcus epidermidis
NNDENNVGNLYELPIQ

SEQ ID NO: 1785704 - protein, 7 aa, Staphylococcus epidermidis
NNDIKTV

SEQ ID NO: 1785705 - protein, 7 aa, Staphylococcus epidermidis
NNDINYS

SEQ ID NO: 1785706 - protein, 5 aa, Staphylococcus epidermidis
NNDIQ

SEQ ID NO: 1785707 - protein, 6 aa, Staphylococcus epidermidis
NNDKQY

SEQ ID NO: 1785708 - protein, 8 aa, Staphylococcus epidermidis
NNDQQSEI

SEQ ID NO: 1785709 - protein, 10 aa, Staphylococcus epidermidis
NNDRYQNKKN

SEQ ID NO: 1785710 - protein, 9 aa, Staphylococcus epidermidis
NNEGKQYKH

SEQ ID NO: 1785711 - protein, 10 aa, Staphylococcus epidermidis
NNEHKNRKKI

SEQ ID NO: 1785712 - protein, 7 aa, Staphylococcus epidermidis
NNEIQSR

SEQ ID NO: 1785713 - protein, 9 aa, Staphylococcus epidermidis
NNEKNKING

SEQ ID NO: 1785714 - protein, 4 aa, Staphylococcus epidermidis
NNEN

SEQ ID NO: 1785715 - protein, 8 aa, Staphylococcus epidermidis
NNEPGEIT

SEQ ID NO: 1785716 - protein, 5 aa, Staphylococcus epidermidis
NNEQL

SEQ ID NO: 1785717 - protein, 8 aa, Staphylococcus epidermidis
NNERLPSY

SEQ ID NO: 1785718 - protein, 9 aa, Staphylococcus epidermidis
NNERQVQSI

SEQ ID NO: 1785719 - protein, 7 aa, Staphylococcus epidermidis
NNESFKA

SEQ ID NO: 1785720 - protein, 6 aa, Staphylococcus epidermidis
NNESGL

SEQ ID NO: 1785721 - protein, 7 aa, Staphylococcus epidermidis
NNESTTD

SEQ ID NO: 1785722 - protein, 10 aa, Staphylococcus epidermidis
NNETLDEQEQ

SEQ ID NO: 1785723 - protein, 10 aa, Staphylococcus epidermidis
NNEYSKDLSR

SEQ ID NO: 1785724 - protein, 6 aa, Staphylococcus epidermidis
NNFATG

SEQ ID NO: 1785725 - protein, 7 aa, Staphylococcus epidermidis
NNFEDDD

SEQ ID NO: 1785726 - protein, 6 aa, Staphylococcus epidermidis
NNFENK

SEQ ID NO: 1785727 - protein, 12 aa, Staphylococcus epidermidis
NNFGPKSKDEVN

SEQ ID NO: 1785728 - protein, 14 aa, Staphylococcus epidermidis
NNFTISSKKVSQKV

SEQ ID NO: 1785729 - protein, 8 aa, Staphylococcus epidermidis
NNGAQEEA

SEQ ID NO: 1785730 - protein, 6 aa, Staphylococcus epidermidis
NNGDGI

SEQ ID NO: 1785731 - protein, 16 aa, Staphylococcus epidermidis
NNGDTNTKNRTNENNW

SEQ ID NO: 1785732 - protein, 8 aa, Staphylococcus epidermidis
NNGENYKL

SEQ ID NO: 1785733 - protein, 7 aa, Staphylococcus epidermidis
NNGISDQ

SEQ ID NO: 1785734 - protein, 19 aa, Staphylococcus epidermidis
NNGKGNKKLSDKSELEKQH

SEQ ID NO: 1785735 - protein, 8 aa, Staphylococcus epidermidis
NNGPDSIG

SEQ ID NO: 1785736 - protein, 11 aa, Staphylococcus epidermidis
NNGQKESPEEL

SEQ ID NO: 1785737 - protein, 5 aa, Staphylococcus epidermidis
NNGVE

SEQ ID NO: 1785738 - protein, 6 aa, Staphylococcus epidermidis
NNHDDP

SEQ ID NO: 1785739 - protein, 23 aa, Staphylococcus epidermidis
NNHNEINKKLTNEDAYKRARPSH

SEQ ID NO: 1785740 - protein, 6 aa, Staphylococcus epidermidis
NNIDQE

SEQ ID NO: 1785741 - protein, 11 aa, Staphylococcus epidermidis
NNIEVTTSTDL

SEQ ID NO: 1785742 - protein, 5 aa, Staphylococcus epidermidis
NNIGI

SEQ ID NO: 1785743 - protein, 4 aa, Staphylococcus epidermidis
NNIP

SEQ ID NO: 1785744 - protein, 9 aa, Staphylococcus epidermidis
NNISTGEQI

SEQ ID NO: 1785745 - protein, 25 aa, Staphylococcus epidermidis
NNITETEKNYKASKKEMSEAEQQIN

SEQ ID NO: 1785746 - protein, 9 aa, Staphylococcus epidermidis
NNKASSYTK

SEQ ID NO: 1785747 - protein, 6 aa, Staphylococcus epidermidis
NNKEDE

SEQ ID NO: 1785748 - protein, 7 aa, Staphylococcus epidermidis
NNKEELN

SEQ ID NO: 1785749 - protein, 6 aa, Staphylococcus epidermidis
NNKEKV

SEQ ID NO: 1785750 - protein, 7 aa, Staphylococcus epidermidis
NNKGNEL

SEQ ID NO: 1785751 - protein, 8 aa, Staphylococcus epidermidis
NNKKATGK

SEQ ID NO: 1785752 - protein, 6 aa, Staphylococcus epidermidis
NNKLEK

SEQ ID NO: 1785753 - protein, 8 aa, Staphylococcus epidermidis
NNKNYNNL

SEQ ID NO: 1785754 - protein, 4 aa, Staphylococcus epidermidis
NNKP

SEQ ID NO: 1785755 - protein, 11 aa, Staphylococcus epidermidis
NNKQKKAFNDK

SEQ ID NO: 1785756 - protein, 10 aa, Staphylococcus epidermidis
NNKQKRNPDV

SEQ ID NO: 1785757 - protein, 6 aa, Staphylococcus epidermidis
NNKSQF

SEQ ID NO: 1785758 - protein, 8 aa, Staphylococcus epidermidis
NNKTGASV

SEQ ID NO: 1785759 - protein, 10 aa, Staphylococcus epidermidis
NNKTIDKPKQ

SEQ ID NO: 1785760 - protein, 7 aa, Staphylococcus epidermidis
NNKYSLG

SEQ ID NO: 1785761 - protein, 21 aa, Staphylococcus epidermidis
NNLDDGETGRISRYTGNSTQA

SEQ ID NO: 1785762 - protein, 19 aa, Staphylococcus epidermidis
NNLEKRNNEKTELENNIEK

SEQ ID NO: 1785763 - protein, 8 aa, Staphylococcus epidermidis
NNLETPYE

SEQ ID NO: 1785764 - protein, 30 aa, Staphylococcus epidermidis
NNLGSQDIKPSTKKGTKSKPSKKKPEPQQI

SEQ ID NO: 1785765 - protein, 11 aa, Staphylococcus epidermidis
NNLKNSGYSYV

SEQ ID NO: 1785766 - protein, 4 aa, Staphylococcus epidermidis
NNLN

SEQ ID NO: 1785767 - protein, 8 aa, Staphylococcus epidermidis
NNLNGSAI

SEQ ID NO: 1785768 - protein, 8 aa, Staphylococcus epidermidis
NNLPQVPK

SEQ ID NO: 1785769 - protein, 9 aa, Staphylococcus epidermidis
NNNDTPSDL

SEQ ID NO: 1785770 - protein, 9 aa, Staphylococcus epidermidis
NNNEGQLTE

SEQ ID NO: 1785771 - protein, 6 aa, Staphylococcus epidermidis
NNNGDV

SEQ ID NO: 1785772 - protein, 10 aa, Staphylococcus epidermidis
NNNGYNYPNW

SEQ ID NO: 1785773 - protein, 7 aa, Staphylococcus epidermidis
NNNKEDD

SEQ ID NO: 1785774 - protein, 7 aa, Staphylococcus epidermidis
NNNKKDD

SEQ ID NO: 1785775 - protein, 7 aa, Staphylococcus epidermidis
NNNPTTI

SEQ ID NO: 1785776 - protein, 9 aa, Staphylococcus epidermidis
NNNQGIPTR

SEQ ID NO: 1785777 - protein, 6 aa, Staphylococcus epidermidis
NNNQQH

SEQ ID NO: 1785778 - protein, 5 aa, Staphylococcus epidermidis
NNNRQ

SEQ ID NO: 1785779 - protein, 4 aa, Staphylococcus epidermidis
NNNS

SEQ ID NO: 1785780 - protein, 5 aa, Staphylococcus epidermidis
NNNVN

SEQ ID NO: 1785781 - protein, 6 aa, Staphylococcus epidermidis
NNPAKV

SEQ ID NO: 1785782 - protein, 6 aa, Staphylococcus epidermidis
NNPEGS

SEQ ID NO: 1785783 - protein, 10 aa, Staphylococcus epidermidis
NNPIKEPKEK

SEQ ID NO: 1785784 - protein, 7 aa, Staphylococcus epidermidis
NNPKLTE

SEQ ID NO: 1785785 - protein, 4 aa, Staphylococcus epidermidis
NNPN

SEQ ID NO: 1785786 - protein, 23 aa, Staphylococcus epidermidis
NNPNNQEKEKEFKQTDEKDHSIN

SEQ ID NO: 1785787 - protein, 6 aa, Staphylococcus epidermidis
NNPNRY

SEQ ID NO: 1785788 - protein, 10 aa, Staphylococcus epidermidis
NNPPETNNNG

SEQ ID NO: 1785789 - protein, 7 aa, Staphylococcus epidermidis
NNPQDKI

SEQ ID NO: 1785790 - protein, 7 aa, Staphylococcus epidermidis
NNPYSDL

SEQ ID NO: 1785791 - protein, 5 aa, Staphylococcus epidermidis
NNQAQ

SEQ ID NO: 1785792 - protein, 7 aa, Staphylococcus epidermidis
NNQETYE

SEQ ID NO: 1785793 - protein, 5 aa, Staphylococcus epidermidis
NNQFG

SEQ ID NO: 1785794 - protein, 5 aa, Staphylococcus epidermidis
NNQIN

SEQ ID NO: 1785795 - protein, 8 aa, Staphylococcus epidermidis
NNQNTDEY

SEQ ID NO: 1785796 - protein, 8 aa, Staphylococcus epidermidis
NNQNTSEY

SEQ ID NO: 1785797 - protein, 6 aa, Staphylococcus epidermidis
NNQSDV

SEQ ID NO: 1785798 - protein, 8 aa, Staphylococcus epidermidis
NNQSNSIY

SEQ ID NO: 1785799 - protein, 14 aa, Staphylococcus epidermidis
NNQYTGNISYNPKT

SEQ ID NO: 1785800 - protein, 8 aa, Staphylococcus epidermidis
NNRDADGR

SEQ ID NO: 1785801 - protein, 15 aa, Staphylococcus epidermidis
NNRDQNRLDQEDKAF

SEQ ID NO: 1785802 - protein, 13 aa, Staphylococcus epidermidis
NNREQNRLDKEDK

SEQ ID NO: 1785803 - protein, 7 aa, Staphylococcus epidermidis
NNRESVE

SEQ ID NO: 1785804 - protein, 5 aa, Staphylococcus epidermidis
NNRKT

SEQ ID NO: 1785805 - protein, 9 aa, Staphylococcus epidermidis
NNRMNQDAH

SEQ ID NO: 1785806 - protein, 9 aa, Staphylococcus epidermidis
NNRTEVSVE

SEQ ID NO: 1785807 - protein, 4 aa, Staphylococcus epidermidis
NNSC

SEQ ID NO: 1785808 - protein, 4 aa, Staphylococcus epidermidis
NNSD

SEQ ID NO: 1785809 - protein, 9 aa, Staphylococcus epidermidis
NNSDSNYSI

SEQ ID NO: 1785810 - protein, 7 aa, Staphylococcus epidermidis
NNSENKH

SEQ ID NO: 1785811 - protein, 7 aa, Staphylococcus epidermidis
NNSFNRD

SEQ ID NO: 1785812 - protein, 10 aa, Staphylococcus epidermidis
NNSIKKEERR

SEQ ID NO: 1785813 - protein, 5 aa, Staphylococcus epidermidis
NNSKE

SEQ ID NO: 1785814 - protein, 9 aa, Staphylococcus epidermidis
NNSLSSNNV

SEQ ID NO: 1785815 - protein, 12 aa, Staphylococcus epidermidis
NNSNIENNNNKI

SEQ ID NO: 1785816 - protein, 10 aa, Staphylococcus epidermidis
NNSNQSTELI

SEQ ID NO: 1785817 - protein, 17 aa, Staphylococcus epidermidis
NNSNSSETLKTKVNELE

SEQ ID NO: 1785818 - protein, 5 aa, Staphylococcus epidermidis
NNSNY

SEQ ID NO: 1785819 - protein, 6 aa, Staphylococcus epidermidis
NNSSQH

SEQ ID NO: 1785820 - protein, 13 aa, Staphylococcus epidermidis
NNSSVSAKTITTE

SEQ ID NO: 1785821 - protein, 13 aa, Staphylococcus epidermidis
NNSTKTPDEVTEK

SEQ ID NO: 1785822 - protein, 11 aa, Staphylococcus epidermidis
NNSTKTPVQVT

SEQ ID NO: 1785823 - protein, 7 aa, Staphylococcus epidermidis
NNSTVTG

SEQ ID NO: 1785824 - protein, 7 aa, Staphylococcus epidermidis
NNTDSSN

SEQ ID NO: 1785825 - protein, 7 aa, Staphylococcus epidermidis
NNTEHKE

SEQ ID NO: 1785826 - protein, 9 aa, Staphylococcus epidermidis
NNTGSFGSV

SEQ ID NO: 1785827 - protein, 27 aa, Staphylococcus epidermidis
NNTIKNHSANLAKAEKAVNSERTSLNN

SEQ ID NO: 1785828 - protein, 11 aa, Staphylococcus epidermidis
NNTKIKTSDAG

SEQ ID NO: 1785829 - protein, 9 aa, Staphylococcus epidermidis
NNTKNARVN

SEQ ID NO: 1785830 - protein, 5 aa, Staphylococcus epidermidis
NNTNW

SEQ ID NO: 1785831 - protein, 8 aa, Staphylococcus epidermidis
NNTSDEYG

SEQ ID NO: 1785832 - protein, 6 aa, Staphylococcus epidermidis
NNTTLQ

SEQ ID NO: 1785833 - protein, 13 aa, Staphylococcus epidermidis
NNTYNDVKDGFNR

SEQ ID NO: 1785834 - protein, 11 aa, Staphylococcus epidermidis
NNVAENDLNES

SEQ ID NO: 1785835 - protein, 8 aa, Staphylococcus epidermidis
NNVDDTSV

SEQ ID NO: 1785836 - protein, 13 aa, Staphylococcus epidermidis
NNVENIEYIENYN

SEQ ID NO: 1785837 - protein, 8 aa, Staphylococcus epidermidis
NNVERVSS

SEQ ID NO: 1785838 - protein, 8 aa, Staphylococcus epidermidis
NNVGKDDT

SEQ ID NO: 1785839 - protein, 8 aa, Staphylococcus epidermidis
NNVGNDDT

SEQ ID NO: 1785840 - protein, 6 aa, Staphylococcus epidermidis
NNVGRN

SEQ ID NO: 1785841 - protein, 8 aa, Staphylococcus epidermidis
NNVQGSQN

SEQ ID NO: 1785842 - protein, 6 aa, Staphylococcus epidermidis
NNVSEK

SEQ ID NO: 1785843 - protein, 4 aa, Staphylococcus epidermidis
NNVT

SEQ ID NO: 1785844 - protein, 5 aa, Staphylococcus epidermidis
NNVTA

SEQ ID NO: 1785845 - protein, 5 aa, Staphylococcus epidermidis
NNYEK

SEQ ID NO: 1785846 - protein, 6 aa, Staphylococcus epidermidis
NNYTTY

SEQ ID NO: 1785847 - protein, 9 aa, Staphylococcus epidermidis
NPAGTNNNG

SEQ ID NO: 1785848 - protein, 4 aa, Staphylococcus epidermidis
NPAI

SEQ ID NO: 1785849 - protein, 8 aa, Staphylococcus epidermidis
NPAKNDGL

SEQ ID NO: 1785850 - protein, 7 aa, Staphylococcus epidermidis
NPAQITA

SEQ ID NO: 1785851 - protein, 10 aa, Staphylococcus epidermidis
NPAQREDLEN

SEQ ID NO: 1785852 - protein, 8 aa, Staphylococcus epidermidis
NPATGEKF

SEQ ID NO: 1785853 - protein, 11 aa, Staphylococcus epidermidis
NPATKEVTTEF

SEQ ID NO: 1785854 - protein, 4 aa, Staphylococcus epidermidis
NPDI

SEQ ID NO: 1785855 - protein, 13 aa, Staphylococcus epidermidis
NPDKFKSSNHEEI

SEQ ID NO: 1785856 - protein, 7 aa, Staphylococcus epidermidis
NPDKNYV

SEQ ID NO: 1785857 - protein, 10 aa, Staphylococcus epidermidis
NPDKSVIPGN

SEQ ID NO: 1785858 - protein, 5 aa, Staphylococcus epidermidis
NPDNI

SEQ ID NO: 1785859 - protein, 12 aa, Staphylococcus epidermidis
NPEAYNTDRPSF

SEQ ID NO: 1785860 - protein, 7 aa, Staphylococcus epidermidis
NPEENYV

SEQ ID NO: 1785861 - protein, 7 aa, Staphylococcus epidermidis
NPEKNEY

SEQ ID NO: 1785862 - protein, 9 aa, Staphylococcus epidermidis
NPEKQNRHS

SEQ ID NO: 1785863 - protein, 9 aa, Staphylococcus epidermidis
NPEKYQYNR

SEQ ID NO: 1785864 - protein, 6 aa, Staphylococcus epidermidis
NPFGEG

SEQ ID NO: 1785865 - protein, 11 aa, Staphylococcus epidermidis
NPFGPGQLYRS

SEQ ID NO: 1785866 - protein, 6 aa, Staphylococcus epidermidis
NPFKKG

SEQ ID NO: 1785867 - protein, 4 aa, Staphylococcus epidermidis
NPFS

SEQ ID NO: 1785868 - protein, 7 aa, Staphylococcus epidermidis
NPGQKYS

SEQ ID NO: 1785869 - protein, 6 aa, Staphylococcus epidermidis
NPGRVS

SEQ ID NO: 1785870 - protein, 6 aa, Staphylococcus epidermidis
NPGTPV

SEQ ID NO: 1785871 - protein, 8 aa, Staphylococcus epidermidis
NPHQTQYS

SEQ ID NO: 1785872 - protein, 5 aa, Staphylococcus epidermidis
NPIPG

SEQ ID NO: 1785873 - protein, 8 aa, Staphylococcus epidermidis
NPKDTRSK

SEQ ID NO: 1785874 - protein, 7 aa, Staphylococcus epidermidis
NPKHPYT

SEQ ID NO: 1785875 - protein, 7 aa, Staphylococcus epidermidis
NPKKASV

SEQ ID NO: 1785876 - protein, 11 aa, Staphylococcus epidermidis
NPKKDDSREIE

SEQ ID NO: 1785877 - protein, 8 aa, Staphylococcus epidermidis
NPKPLDIK

SEQ ID NO: 1785878 - protein, 8 aa, Staphylococcus epidermidis
NPKQAKEV

SEQ ID NO: 1785879 - protein, 18 aa, Staphylococcus epidermidis
NPKTVSEIKKEEKNKQNE

SEQ ID NO: 1785880 - protein, 7 aa, Staphylococcus epidermidis
NPKVNEK

SEQ ID NO: 1785881 - protein, 11 aa, Staphylococcus epidermidis
NPLESDTGNYS

SEQ ID NO: 1785882 - protein, 5 aa, Staphylococcus epidermidis
NPLSG

SEQ ID NO: 1785883 - protein, 6 aa, Staphylococcus epidermidis
NPLSGD

SEQ ID NO: 1785884 - protein, 6 aa, Staphylococcus epidermidis
NPLTQK

SEQ ID NO: 1785885 - protein, 8 aa, Staphylococcus epidermidis
NPLTTHDD

SEQ ID NO: 1785886 - protein, 9 aa, Staphylococcus epidermidis
NPNDERYKG

SEQ ID NO: 1785887 - protein, 14 aa, Staphylococcus epidermidis
NPNGPTCHTGSQSC

SEQ ID NO: 1785888 - protein, 49 aa, Staphylococcus epidermidis
NPNHAKTNNSNETGNQSNISHSKRAQYSTNESENIDTQTSNSSTSNQNF

SEQ ID NO: 1785889 - protein, 13 aa, Staphylococcus epidermidis
NPNIEKKKKDARE

SEQ ID NO: 1785890 - protein, 14 aa, Staphylococcus epidermidis
NPNIEKKKKDAREM

SEQ ID NO: 1785891 - protein, 14 aa, Staphylococcus epidermidis
NPNLSDEVTRVGRG

SEQ ID NO: 1785892 - protein, 6 aa, Staphylococcus epidermidis
NPNQFP

SEQ ID NO: 1785893 - protein, 13 aa, Staphylococcus epidermidis
NPNQMEELIRQLL

SEQ ID NO: 1785894 - protein, 11 aa, Staphylococcus epidermidis
NPNQYKPNIDE

SEQ ID NO: 1785895 - protein, 7 aa, Staphylococcus epidermidis
NPNTKEI

SEQ ID NO: 1785896 - protein, 7 aa, Staphylococcus epidermidis
NPNTTAS

SEQ ID NO: 1785897 - protein, 4 aa, Staphylococcus epidermidis
NPPH

SEQ ID NO: 1785898 - protein, 7 aa, Staphylococcus epidermidis
NPPKSVI

SEQ ID NO: 1785899 - protein, 4 aa, Staphylococcus epidermidis
NPQD

SEQ ID NO: 1785900 - protein, 14 aa, Staphylococcus epidermidis
NPQHSRTQNFLSRV

SEQ ID NO: 1785901 - protein, 4 aa, Staphylococcus epidermidis
NPQQ

SEQ ID NO: 1785902 - protein, 8 aa, Staphylococcus epidermidis
NPQSKDYF

SEQ ID NO: 1785903 - protein, 11 aa, Staphylococcus epidermidis
NPQYDLDNRTA

SEQ ID NO: 1785904 - protein, 5 aa, Staphylococcus epidermidis
NPRAY

SEQ ID NO: 1785905 - protein, 16 aa, Staphylococcus epidermidis
NPRPKIETGQIEYNDE

SEQ ID NO: 1785906 - protein, 6 aa, Staphylococcus epidermidis
NPSFQH

SEQ ID NO: 1785907 - protein, 11 aa, Staphylococcus epidermidis
NPSKRAEIPEL

SEQ ID NO: 1785908 - protein, 17 aa, Staphylococcus epidermidis
NPSQQQTAKDNVEQATK

SEQ ID NO: 1785909 - protein, 6 aa, Staphylococcus epidermidis
NPSTQA

SEQ ID NO: 1785910 - protein, 5 aa, Staphylococcus epidermidis
NPTKY

SEQ ID NO: 1785911 - protein, 11 aa, Staphylococcus epidermidis
NPTRGQVNVNS

SEQ ID NO: 1785912 - protein, 20 aa, Staphylococcus epidermidis
NPTRKRDPLAQKIRESKHPE

SEQ ID NO: 1785913 - protein, 8 aa, Staphylococcus epidermidis
NPTSVSNV

SEQ ID NO: 1785914 - protein, 9 aa, Staphylococcus epidermidis
NPTTGGVSA

SEQ ID NO: 1785915 - protein, 4 aa, Staphylococcus epidermidis
NPTV

SEQ ID NO: 1785916 - protein, 5 aa, Staphylococcus epidermidis
NPVDE

SEQ ID NO: 1785917 - protein, 13 aa, Staphylococcus epidermidis
NPVNAKGEKTTPV

SEQ ID NO: 1785918 - protein, 4 aa, Staphylococcus epidermidis
NQAE

SEQ ID NO: 1785919 - protein, 5 aa, Staphylococcus epidermidis
NQAEK

SEQ ID NO: 1785920 - protein, 10 aa, Staphylococcus epidermidis
NQAEKEDNTF

SEQ ID NO: 1785921 - protein, 6 aa, Staphylococcus epidermidis
NQAGSL

SEQ ID NO: 1785922 - protein, 5 aa, Staphylococcus epidermidis
NQAKG

SEQ ID NO: 1785923 - protein, 10 aa, Staphylococcus epidermidis
NQASNNFESL

SEQ ID NO: 1785924 - protein, 11 aa, Staphylococcus epidermidis
NQASPNARTSI

SEQ ID NO: 1785925 - protein, 10 aa, Staphylococcus epidermidis
NQATTRTNVA

SEQ ID NO: 1785926 - protein, 9 aa, Staphylococcus epidermidis
NQDGTKTQT

SEQ ID NO: 1785927 - protein, 14 aa, Staphylococcus epidermidis
NQDGYKSLEEGQSV

SEQ ID NO: 1785928 - protein, 5 aa, Staphylococcus epidermidis
NQDIE

SEQ ID NO: 1785929 - protein, 8 aa, Staphylococcus epidermidis
NQDKEKSF

SEQ ID NO: 1785930 - protein, 4 aa, Staphylococcus epidermidis
NQDN

SEQ ID NO: 1785931 - protein, 21 aa, Staphylococcus epidermidis
NQDNETLKDMSKSGTQRPWRE

SEQ ID NO: 1785932 - protein, 13 aa, Staphylococcus epidermidis
NQDNQGAARSRNV

SEQ ID NO: 1785933 - protein, 8 aa, Staphylococcus epidermidis
NQDYKTNK

SEQ ID NO: 1785934 - protein, 9 aa, Staphylococcus epidermidis
NQEAYDSSE

SEQ ID NO: 1785935 - protein, 10 aa, Staphylococcus epidermidis
NQEDLKGQSI

SEQ ID NO: 1785936 - protein, 5 aa, Staphylococcus epidermidis
NQEDM

SEQ ID NO: 1785937 - protein, 13 aa, Staphylococcus epidermidis
NQEDPKDSWTPDE

SEQ ID NO: 1785938 - protein, 13 aa, Staphylococcus epidermidis
NQEKPSEGGVPST

SEQ ID NO: 1785939 - protein, 9 aa, Staphylococcus epidermidis
NQENKVDGA

SEQ ID NO: 1785940 - protein, 6 aa, Staphylococcus epidermidis
NQENQV

SEQ ID NO: 1785941 - protein, 9 aa, Staphylococcus epidermidis
NQERENVNN

SEQ ID NO: 1785942 - protein, 5 aa, Staphylococcus epidermidis
NQERK

SEQ ID NO: 1785943 - protein, 6 aa, Staphylococcus epidermidis
NQERKD

SEQ ID NO: 1785944 - protein, 9 aa, Staphylococcus epidermidis
NQEVSTEAQ

SEQ ID NO: 1785945 - protein, 4 aa, Staphylococcus epidermidis
NQFN

SEQ ID NO: 1785946 - protein, 6 aa, Staphylococcus epidermidis
NQFSGG

SEQ ID NO: 1785947 - protein, 8 aa, Staphylococcus epidermidis
NQGDFKSD

SEQ ID NO: 1785948 - protein, 6 aa, Staphylococcus epidermidis
NQGEKL

SEQ ID NO: 1785949 - protein, 6 aa, Staphylococcus epidermidis
NQGKIN

SEQ ID NO: 1785950 - protein, 7 aa, Staphylococcus epidermidis
NQGSSAG

SEQ ID NO: 1785951 - protein, 9 aa, Staphylococcus epidermidis
NQGTAEVPE

SEQ ID NO: 1785952 - protein, 8 aa, Staphylococcus epidermidis
NQGTEEEA

SEQ ID NO: 1785953 - protein, 5 aa, Staphylococcus epidermidis
NQHDL

SEQ ID NO: 1785954 - protein, 15 aa, Staphylococcus epidermidis
NQHNYENDADISAEG

SEQ ID NO: 1785955 - protein, 4 aa, Staphylococcus epidermidis
NQHP

SEQ ID NO: 1785956 - protein, 4 aa, Staphylococcus epidermidis
NQHQ

SEQ ID NO: 1785957 - protein, 60 aa, Staphylococcus epidermidis
NQHQKEEKEIDPQREDISESQSAKKRQEDVLSNQKNTDIAMEEKNEKTQPKKSFWSRLFG

SEQ ID NO: 1785958 - protein, 6 aa, Staphylococcus epidermidis
NQIEPN

SEQ ID NO: 1785959 - protein, 35 aa, Staphylococcus epidermidis
NQIGGKSNSGEGGEDPSRYGIQKDGSNKTSAIKQV

SEQ ID NO: 1785960 - protein, 4 aa, Staphylococcus epidermidis
NQIN

SEQ ID NO: 1785961 - protein, 5 aa, Staphylococcus epidermidis
NQINE

SEQ ID NO: 1785962 - protein, 10 aa, Staphylococcus epidermidis
NQIPENEHDE

SEQ ID NO: 1785963 - protein, 5 aa, Staphylococcus epidermidis
NQKAS

SEQ ID NO: 1785964 - protein, 5 aa, Staphylococcus epidermidis
NQKDF

SEQ ID NO: 1785965 - protein, 8 aa, Staphylococcus epidermidis
NQKEHSAI

SEQ ID NO: 1785966 - protein, 15 aa, Staphylococcus epidermidis
NQKEHSAIQSTPINR

SEQ ID NO: 1785967 - protein, 9 aa, Staphylococcus epidermidis
NQKLDTGDY

SEQ ID NO: 1785968 - protein, 7 aa, Staphylococcus epidermidis
NQKNNNM

SEQ ID NO: 1785969 - protein, 10 aa, Staphylococcus epidermidis
NQKQPPGKRK

SEQ ID NO: 1785970 - protein, 6 aa, Staphylococcus epidermidis
NQKSQI

SEQ ID NO: 1785971 - protein, 11 aa, Staphylococcus epidermidis
NQKVNKIKKEL

SEQ ID NO: 1785972 - protein, 19 aa, Staphylococcus epidermidis
NQLDQPTKNSINYQNADED

SEQ ID NO: 1785973 - protein, 6 aa, Staphylococcus epidermidis
NQLEPF

SEQ ID NO: 1785974 - protein, 10 aa, Staphylococcus epidermidis
NQLNGRYEGE

SEQ ID NO: 1785975 - protein, 18 aa, Staphylococcus epidermidis
NQLNKEGKDAEVTFGTDH

SEQ ID NO: 1785976 - protein, 9 aa, Staphylococcus epidermidis
NQLPDGQTF

SEQ ID NO: 1785977 - protein, 9 aa, Staphylococcus epidermidis
NQLSQQVSA

SEQ ID NO: 1785978 - protein, 10 aa, Staphylococcus epidermidis
NQLTENKSNL

SEQ ID NO: 1785979 - protein, 7 aa, Staphylococcus epidermidis
NQMETGG

SEQ ID NO: 1785980 - protein, 5 aa, Staphylococcus epidermidis
NQNGK

SEQ ID NO: 1785981 - protein, 12 aa, Staphylococcus epidermidis
NQNGNKVRKQER

SEQ ID NO: 1785982 - protein, 10 aa, Staphylococcus epidermidis
NQNKAERPSL

SEQ ID NO: 1785983 - protein, 5 aa, Staphylococcus epidermidis
NQNNQ

SEQ ID NO: 1785984 - protein, 6 aa, Staphylococcus epidermidis
NQNNQS

SEQ ID NO: 1785985 - protein, 7 aa, Staphylococcus epidermidis
NQNNTYD

SEQ ID NO: 1785986 - protein, 4 aa, Staphylococcus epidermidis
NQNQ

SEQ ID NO: 1785987 - protein, 18 aa, Staphylococcus epidermidis
NQNVTKGQTLKSKDKIEV

SEQ ID NO: 1785988 - protein, 8 aa, Staphylococcus epidermidis
NQPAPPHH

SEQ ID NO: 1785989 - protein, 6 aa, Staphylococcus epidermidis
NQPELT

SEQ ID NO: 1785990 - protein, 6 aa, Staphylococcus epidermidis
NQPIDE

SEQ ID NO: 1785991 - protein, 12 aa, Staphylococcus epidermidis
NQPIDKRSSYGL

SEQ ID NO: 1785992 - protein, 33 aa, Staphylococcus epidermidis
NQPKNYEQNYKGSRNYSRQNKQLISKEKTPKWL

SEQ ID NO: 1785993 - protein, 7 aa, Staphylococcus epidermidis
NQPLTQE

SEQ ID NO: 1785994 - protein, 4 aa, Staphylococcus epidermidis
NQPN

SEQ ID NO: 1785995 - protein, 4 aa, Staphylococcus epidermidis
NQPV

SEQ ID NO: 1785996 - protein, 5 aa, Staphylococcus epidermidis
NQQDI

SEQ ID NO: 1785997 - protein, 8 aa, Staphylococcus epidermidis
NQQEVVNE

SEQ ID NO: 1785998 - protein, 31 aa, Staphylococcus epidermidis
NQQNDPTMDKNEINAATQKVKEAKDALHGAE

SEQ ID NO: 1785999 - protein, 21 aa, Staphylococcus epidermidis
NQQSNTSTDSVEQHNLDDNTE

SEQ ID NO: 1786000 - protein, 22 aa, Staphylococcus epidermidis
NQQSNTSTDSVEQHNSDDNTEA

SEQ ID NO: 1786001 - protein, 14 aa, Staphylococcus epidermidis
NQQTDYPSCGPDMP

SEQ ID NO: 1786002 - protein, 9 aa, Staphylococcus epidermidis
NQSAPEQSV

SEQ ID NO: 1786003 - protein, 4 aa, Staphylococcus epidermidis
NQSD

SEQ ID NO: 1786004 - protein, 11 aa, Staphylococcus epidermidis
NQSEIAEEDEF

SEQ ID NO: 1786005 - protein, 14 aa, Staphylococcus epidermidis
NQSHSQSLTPNIKK

SEQ ID NO: 1786006 - protein, 11 aa, Staphylococcus epidermidis
NQSIERAKSEV

SEQ ID NO: 1786007 - protein, 11 aa, Staphylococcus epidermidis
NQSINENNKRV

SEQ ID NO: 1786008 - protein, 9 aa, Staphylococcus epidermidis
NQSKPLDEK

SEQ ID NO: 1786009 - protein, 6 aa, Staphylococcus epidermidis
NQSNIG

SEQ ID NO: 1786010 - protein, 7 aa, Staphylococcus epidermidis
NQSNPNS

SEQ ID NO: 1786011 - protein, 5 aa, Staphylococcus epidermidis
NQSQA

SEQ ID NO: 1786012 - protein, 7 aa, Staphylococcus epidermidis
NQSQIDA

SEQ ID NO: 1786013 - protein, 15 aa, Staphylococcus epidermidis
NQSQTDEVSPSSDPF

SEQ ID NO: 1786014 - protein, 8 aa, Staphylococcus epidermidis
NQSSEDNM

SEQ ID NO: 1786015 - protein, 8 aa, Staphylococcus epidermidis
NQSSEEID

SEQ ID NO: 1786016 - protein, 13 aa, Staphylococcus epidermidis
NQSSQSYSTQESS

SEQ ID NO: 1786017 - protein, 4 aa, Staphylococcus epidermidis
NQSY

SEQ ID NO: 1786018 - protein, 5 aa, Staphylococcus epidermidis
NQTAE

SEQ ID NO: 1786019 - protein, 9 aa, Staphylococcus epidermidis
NQTKYDGTP

SEQ ID NO: 1786020 - protein, 4 aa, Staphylococcus epidermidis
NQTM

SEQ ID NO: 1786021 - protein, 14 aa, Staphylococcus epidermidis
NQTNQQKGLQSTAL

SEQ ID NO: 1786022 - protein, 12 aa, Staphylococcus epidermidis
NQVDSDKSSTAV

SEQ ID NO: 1786023 - protein, 5 aa, Staphylococcus epidermidis
NQVNE

SEQ ID NO: 1786024 - protein, 4 aa, Staphylococcus epidermidis
NQYE

SEQ ID NO: 1786025 - protein, 13 aa, Staphylococcus epidermidis
NQYGAPSKSLEKS

SEQ ID NO: 1786026 - protein, 18 aa, Staphylococcus epidermidis
NQYGESTKNNYKQAIQEL

SEQ ID NO: 1786027 - protein, 5 aa, Staphylococcus epidermidis
NQYKE

SEQ ID NO: 1786028 - protein, 5 aa, Staphylococcus epidermidis
NQYNE

SEQ ID NO: 1786029 - protein, 5 aa, Staphylococcus epidermidis
NRASK

SEQ ID NO: 1786030 - protein, 6 aa, Staphylococcus epidermidis
NRATAT

SEQ ID NO: 1786031 - protein, 5 aa, Staphylococcus epidermidis
NRDAN

SEQ ID NO: 1786032 - protein, 7 aa, Staphylococcus epidermidis
NRDNAQA

SEQ ID NO: 1786033 - protein, 21 aa, Staphylococcus epidermidis
NRDNQEDNKDINDDTLEEDRQ

SEQ ID NO: 1786034 - protein, 26 aa, Staphylococcus epidermidis
NRDNQSANTSEKQSKQNDDKLEKDRQ

SEQ ID NO: 1786035 - protein, 7 aa, Staphylococcus epidermidis
NRDQHKE

SEQ ID NO: 1786036 - protein, 8 aa, Staphylococcus epidermidis
NRDQTKIA

SEQ ID NO: 1786037 - protein, 16 aa, Staphylococcus epidermidis
NREAQSVMTQSGKEVN

SEQ ID NO: 1786038 - protein, 5 aa, Staphylococcus epidermidis
NREGK

SEQ ID NO: 1786039 - protein, 13 aa, Staphylococcus epidermidis
NREKEWRKRNPRF

SEQ ID NO: 1786040 - protein, 5 aa, Staphylococcus epidermidis
NREKI

SEQ ID NO: 1786041 - protein, 9 aa, Staphylococcus epidermidis
NRESEHGNA

SEQ ID NO: 1786042 - protein, 4 aa, Staphylococcus epidermidis
NRET

SEQ ID NO: 1786043 - protein, 10 aa, Staphylococcus epidermidis
NRETKEKITK

SEQ ID NO: 1786044 - protein, 6 aa, Staphylococcus epidermidis
NRETTF

SEQ ID NO: 1786045 - protein, 8 aa, Staphylococcus epidermidis
NRETYETN

SEQ ID NO: 1786046 - protein, 12 aa, Staphylococcus epidermidis
NRFTKPKTVTAE

SEQ ID NO: 1786047 - protein, 6 aa, Staphylococcus epidermidis
NRGHDS

SEQ ID NO: 1786048 - protein, 10 aa, Staphylococcus epidermidis
NRGKFSDDTA

SEQ ID NO: 1786049 - protein, 17 aa, Staphylococcus epidermidis
NRGKTGYEITNGPGKWT

SEQ ID NO: 1786050 - protein, 4 aa, Staphylococcus epidermidis
NRGV

SEQ ID NO: 1786051 - protein, 14 aa, Staphylococcus epidermidis
NRHGWTKKDMTDQE

SEQ ID NO: 1786052 - protein, 8 aa, Staphylococcus epidermidis
NRHKDNGK

SEQ ID NO: 1786053 - protein, 8 aa, Staphylococcus epidermidis
NRHKDNGS

SEQ ID NO: 1786054 - protein, 7 aa, Staphylococcus epidermidis
NRKGDDV

SEQ ID NO: 1786055 - protein, 15 aa, Staphylococcus epidermidis
NRKGFEVSAQSAKEN

SEQ ID NO: 1786056 - protein, 5 aa, Staphylococcus epidermidis
NRKKV

SEQ ID NO: 1786057 - protein, 6 aa, Staphylococcus epidermidis
NRKPEL

SEQ ID NO: 1786058 - protein, 10 aa, Staphylococcus epidermidis
NRKQAKQDSF

SEQ ID NO: 1786059 - protein, 6 aa, Staphylococcus epidermidis
NRKRGE

SEQ ID NO: 1786060 - protein, 5 aa, Staphylococcus epidermidis
NRKSK

SEQ ID NO: 1786061 - protein, 8 aa, Staphylococcus epidermidis
NRKYPKEI

SEQ ID NO: 1786062 - protein, 9 aa, Staphylococcus epidermidis
NRLETAKEI

SEQ ID NO: 1786063 - protein, 10 aa, Staphylococcus epidermidis
NRLETAKELG

SEQ ID NO: 1786064 - protein, 10 aa, Staphylococcus epidermidis
NRLETAQSLG

SEQ ID NO: 1786065 - protein, 9 aa, Staphylococcus epidermidis
NRLPGTYKE

SEQ ID NO: 1786066 - protein, 5 aa, Staphylococcus epidermidis
NRLPK

SEQ ID NO: 1786067 - protein, 10 aa, Staphylococcus epidermidis
NRLTASRSPY

SEQ ID NO: 1786068 - protein, 12 aa, Staphylococcus epidermidis
NRLTDRNMDARK

SEQ ID NO: 1786069 - protein, 17 aa, Staphylococcus epidermidis
NRNDYNGKVLITVNEKN

SEQ ID NO: 1786070 - protein, 8 aa, Staphylococcus epidermidis
NRNEPLGG

SEQ ID NO: 1786071 - protein, 18 aa, Staphylococcus epidermidis
NRNNIAGDGYSSVKNGDI

SEQ ID NO: 1786072 - protein, 5 aa, Staphylococcus epidermidis
NRNPE

SEQ ID NO: 1786073 - protein, 5 aa, Staphylococcus epidermidis
NRNPN

SEQ ID NO: 1786074 - protein, 12 aa, Staphylococcus epidermidis
NRNYTKESKERL

SEQ ID NO: 1786075 - protein, 8 aa, Staphylococcus epidermidis
NRPVDDNT

SEQ ID NO: 1786076 - protein, 9 aa, Staphylococcus epidermidis
NRQDGTTGV

SEQ ID NO: 1786077 - protein, 5 aa, Staphylococcus epidermidis
NRQYA

SEQ ID NO: 1786078 - protein, 16 aa, Staphylococcus epidermidis
NRSHSLEQSLKEGYAQ

SEQ ID NO: 1786079 - protein, 4 aa, Staphylococcus epidermidis
NRSI

SEQ ID NO: 1786080 - protein, 22 aa, Staphylococcus epidermidis
NRSRQKTDEMVEESQGKQIHPT

SEQ ID NO: 1786081 - protein, 22 aa, Staphylococcus epidermidis
NRSRQKTDEMVKESPGKEIHPT

SEQ ID NO: 1786082 - protein, 15 aa, Staphylococcus epidermidis
NRTKNYDINNKGTDI

SEQ ID NO: 1786083 - protein, 5 aa, Staphylococcus epidermidis
NRTPD

SEQ ID NO: 1786084 - protein, 6 aa, Staphylococcus epidermidis
NRVNNQ

SEQ ID NO: 1786085 - protein, 8 aa, Staphylococcus epidermidis
NRVSNDAA

SEQ ID NO: 1786086 - protein, 12 aa, Staphylococcus epidermidis
NRVTKNVEPITP

SEQ ID NO: 1786087 - protein, 6 aa, Staphylococcus epidermidis
NRYDVG

SEQ ID NO: 1786088 - protein, 21 aa, Staphylococcus epidermidis
NSAEQGLNGAQKLRQDQADAI

SEQ ID NO: 1786089 - protein, 5 aa, Staphylococcus epidermidis
NSAIP

SEQ ID NO: 1786090 - protein, 4 aa, Staphylococcus epidermidis
NSAL

SEQ ID NO: 1786091 - protein, 6 aa, Staphylococcus epidermidis
NSAPFP

SEQ ID NO: 1786092 - protein, 9 aa, Staphylococcus epidermidis
NSAPNKQKV

SEQ ID NO: 1786093 - protein, 9 aa, Staphylococcus epidermidis
NSASYYREG

SEQ ID NO: 1786094 - protein, 4 aa, Staphylococcus epidermidis
NSCD

SEQ ID NO: 1786095 - protein, 5 aa, Staphylococcus epidermidis
NSDEE

SEQ ID NO: 1786096 - protein, 8 aa, Staphylococcus epidermidis
NSDFEGYR

SEQ ID NO: 1786097 - protein, 4 aa, Staphylococcus epidermidis
NSDG

SEQ ID NO: 1786098 - protein, 12 aa, Staphylococcus epidermidis
NSDINNKFPHSS

SEQ ID NO: 1786099 - protein, 9 aa, Staphylococcus epidermidis
NSDKMTASQ

SEQ ID NO: 1786100 - protein, 7 aa, Staphylococcus epidermidis
NSDKVDD

SEQ ID NO: 1786101 - protein, 14 aa, Staphylococcus epidermidis
NSDLTEAQNNQLNS

SEQ ID NO: 1786102 - protein, 9 aa, Staphylococcus epidermidis
NSDNGEPCN

SEQ ID NO: 1786103 - protein, 6 aa, Staphylococcus epidermidis
NSDPAV

SEQ ID NO: 1786104 - protein, 4 aa, Staphylococcus epidermidis
NSDQ

SEQ ID NO: 1786105 - protein, 5 aa, Staphylococcus epidermidis
NSDQI

SEQ ID NO: 1786106 - protein, 8 aa, Staphylococcus epidermidis
NSDQTESL

SEQ ID NO: 1786107 - protein, 4 aa, Staphylococcus epidermidis
NSDR

SEQ ID NO: 1786108 - protein, 6 aa, Staphylococcus epidermidis
NSDSEE

SEQ ID NO: 1786109 - protein, 6 aa, Staphylococcus epidermidis
NSEDGY

SEQ ID NO: 1786110 - protein, 6 aa, Staphylococcus epidermidis
NSEDKS

SEQ ID NO: 1786111 - protein, 5 aa, Staphylococcus epidermidis
NSEEP

SEQ ID NO: 1786112 - protein, 9 aa, Staphylococcus epidermidis
NSEGACPEC

SEQ ID NO: 1786113 - protein, 5 aa, Staphylococcus epidermidis
NSEGD

SEQ ID NO: 1786114 - protein, 6 aa, Staphylococcus epidermidis
NSEKRP

SEQ ID NO: 1786115 - protein, 4 aa, Staphylococcus epidermidis
NSEL

SEQ ID NO: 1786116 - protein, 12 aa, Staphylococcus epidermidis
NSELSEEKREEI

SEQ ID NO: 1786117 - protein, 6 aa, Staphylococcus epidermidis
NSEMKP

SEQ ID NO: 1786118 - protein, 6 aa, Staphylococcus epidermidis
NSENGY

SEQ ID NO: 1786119 - protein, 9 aa, Staphylococcus epidermidis
NSEPVAASE

SEQ ID NO: 1786120 - protein, 14 aa, Staphylococcus epidermidis
NSEQPERGKIYDRN

SEQ ID NO: 1786121 - protein, 10 aa, Staphylococcus epidermidis
NSERKQHGLN

SEQ ID NO: 1786122 - protein, 5 aa, Staphylococcus epidermidis
NSESV

SEQ ID NO: 1786123 - protein, 10 aa, Staphylococcus epidermidis
NSEVRKQGLG

SEQ ID NO: 1786124 - protein, 6 aa, Staphylococcus epidermidis
NSFDEN

SEQ ID NO: 1786125 - protein, 5 aa, Staphylococcus epidermidis
NSFGE

SEQ ID NO: 1786126 - protein, 8 aa, Staphylococcus epidermidis
NSFKNASE

SEQ ID NO: 1786127 - protein, 10 aa, Staphylococcus epidermidis
NSFNNKDGYI

SEQ ID NO: 1786128 - protein, 5 aa, Staphylococcus epidermidis
NSFSP

SEQ ID NO: 1786129 - protein, 8 aa, Staphylococcus epidermidis
NSFTPKKN

SEQ ID NO: 1786130 - protein, 10 aa, Staphylococcus epidermidis
NSGANSGTGV

SEQ ID NO: 1786131 - protein, 10 aa, Staphylococcus epidermidis
NSGEQSGTGV

SEQ ID NO: 1786132 - protein, 14 aa, Staphylococcus epidermidis
NSGGHAAQNAKTYQ

SEQ ID NO: 1786133 - protein, 10 aa, Staphylococcus epidermidis
NSGGIVSSEP

SEQ ID NO: 1786134 - protein, 9 aa, Staphylococcus epidermidis
NSGGNEAQG

SEQ ID NO: 1786135 - protein, 10 aa, Staphylococcus epidermidis
NSGGTNTQTV

SEQ ID NO: 1786136 - protein, 7 aa, Staphylococcus epidermidis
NSGGTTF

SEQ ID NO: 1786137 - protein, 6 aa, Staphylococcus epidermidis
NSGHTV

SEQ ID NO: 1786138 - protein, 5 aa, Staphylococcus epidermidis
NSGMS

SEQ ID NO: 1786139 - protein, 8 aa, Staphylococcus epidermidis
NSGQIQGY

SEQ ID NO: 1786140 - protein, 7 aa, Staphylococcus epidermidis
NSGRKGP

SEQ ID NO: 1786141 - protein, 8 aa, Staphylococcus epidermidis
NSGTDDKY

SEQ ID NO: 1786142 - protein, 9 aa, Staphylococcus epidermidis
NSGTPKAGL

SEQ ID NO: 1786143 - protein, 8 aa, Staphylococcus epidermidis
NSHGNVPG

SEQ ID NO: 1786144 - protein, 10 aa, Staphylococcus epidermidis
NSIGKPLPNR

SEQ ID NO: 1786145 - protein, 51 aa, Staphylococcus epidermidis
NSIQDQGSVRQDSKYVNENYDKQQAYNSAVRDAESVINEQTATLNKDTITQ

SEQ ID NO: 1786146 - protein, 37 aa, Staphylococcus epidermidis
NSITKKDNQNKKKVIKRTTAPFNNNSYTLDNKELNKL

SEQ ID NO: 1786147 - protein, 7 aa, Staphylococcus epidermidis
NSITSNA

SEQ ID NO: 1786148 - protein, 10 aa, Staphylococcus epidermidis
NSIYQSNNGT

SEQ ID NO: 1786149 - protein, 15 aa, Staphylococcus epidermidis
NSKAFDKGTTTEDIA

SEQ ID NO: 1786150 - protein, 8 aa, Staphylococcus epidermidis
NSKDNSAE

SEQ ID NO: 1786151 - protein, 8 aa, Staphylococcus epidermidis
NSKETDTV

SEQ ID NO: 1786152 - protein, 5 aa, Staphylococcus epidermidis
NSKID

SEQ ID NO: 1786153 - protein, 6 aa, Staphylococcus epidermidis
NSKKPL

SEQ ID NO: 1786154 - protein, 9 aa, Staphylococcus epidermidis
NSKNAEEAI

SEQ ID NO: 1786155 - protein, 4 aa, Staphylococcus epidermidis
NSKR

SEQ ID NO: 1786156 - protein, 14 aa, Staphylococcus epidermidis
NSKVAQSTNANTAL

SEQ ID NO: 1786157 - protein, 5 aa, Staphylococcus epidermidis
NSLTS

SEQ ID NO: 1786158 - protein, 10 aa, Staphylococcus epidermidis
NSLTTGAGIG

SEQ ID NO: 1786159 - protein, 15 aa, Staphylococcus epidermidis
NSLTTGVGIGTAAGT

SEQ ID NO: 1786160 - protein, 5 aa, Staphylococcus epidermidis
NSMAA

SEQ ID NO: 1786161 - protein, 5 aa, Staphylococcus epidermidis
NSMQS

SEQ ID NO: 1786162 - protein, 15 aa, Staphylococcus epidermidis
NSMTAPTGSKPSFPD

SEQ ID NO: 1786163 - protein, 6 aa, Staphylococcus epidermidis
NSNDED

SEQ ID NO: 1786164 - protein, 10 aa, Staphylococcus epidermidis
NSNEESGSIT

SEQ ID NO: 1786165 - protein, 9 aa, Staphylococcus epidermidis
NSNEKYVTK

SEQ ID NO: 1786166 - protein, 7 aa, Staphylococcus epidermidis
NSNGNLK

SEQ ID NO: 1786167 - protein, 24 aa, Staphylococcus epidermidis
NSNGTLNISGDTLTISNNNSSNEV

SEQ ID NO: 1786168 - protein, 6 aa, Staphylococcus epidermidis
NSNGTT

SEQ ID NO: 1786169 - protein, 21 aa, Staphylococcus epidermidis
NSNLAENKNLQTMDASKLENS

SEQ ID NO: 1786170 - protein, 11 aa, Staphylococcus epidermidis
NSNNNLQHTET

SEQ ID NO: 1786171 - protein, 5 aa, Staphylococcus epidermidis
NSNTA

SEQ ID NO: 1786172 - protein, 12 aa, Staphylococcus epidermidis
NSNVNQANTTID

SEQ ID NO: 1786173 - protein, 8 aa, Staphylococcus epidermidis
NSPENGAP

SEQ ID NO: 1786174 - protein, 8 aa, Staphylococcus epidermidis
NSPGGNAF

SEQ ID NO: 1786175 - protein, 6 aa, Staphylococcus epidermidis
NSPLQE

SEQ ID NO: 1786176 - protein, 13 aa, Staphylococcus epidermidis
NSPQPQAAYNTSK

SEQ ID NO: 1786177 - protein, 8 aa, Staphylococcus epidermidis
NSPVHENS

SEQ ID NO: 1786178 - protein, 7 aa, Staphylococcus epidermidis
NSPVNDL

SEQ ID NO: 1786179 - protein, 6 aa, Staphylococcus epidermidis
NSQAIT

SEQ ID NO: 1786180 - protein, 7 aa, Staphylococcus epidermidis
NSQDLTQ

SEQ ID NO: 1786181 - protein, 35 aa, Staphylococcus epidermidis
NSQEGQSKLSDQQITNNKKLNKKEVSIQKDNTKET

SEQ ID NO: 1786182 - protein, 21 aa, Staphylococcus epidermidis
NSQMTQNSDFNEEKKISSKTY

SEQ ID NO: 1786183 - protein, 11 aa, Staphylococcus epidermidis
NSQPSKQAIES

SEQ ID NO: 1786184 - protein, 5 aa, Staphylococcus epidermidis
NSQRY

SEQ ID NO: 1786185 - protein, 5 aa, Staphylococcus epidermidis
NSRKE

SEQ ID NO: 1786186 - protein, 7 aa, Staphylococcus epidermidis
NSRTLSE

SEQ ID NO: 1786187 - protein, 6 aa, Staphylococcus epidermidis
NSSDAS

SEQ ID NO: 1786188 - protein, 10 aa, Staphylococcus epidermidis
NSSEVDEGFV

SEQ ID NO: 1786189 - protein, 7 aa, Staphylococcus epidermidis
NSSISTY

SEQ ID NO: 1786190 - protein, 12 aa, Staphylococcus epidermidis
NSSKGGTFDSKE

SEQ ID NO: 1786191 - protein, 9 aa, Staphylococcus epidermidis
NSSKTLTID

SEQ ID NO: 1786192 - protein, 9 aa, Staphylococcus epidermidis
NSSTLRPSD

SEQ ID NO: 1786193 - protein, 11 aa, Staphylococcus epidermidis
NSSVKSGNATI

SEQ ID NO: 1786194 - protein, 6 aa, Staphylococcus epidermidis
NSSVVS

SEQ ID NO: 1786195 - protein, 7 aa, Staphylococcus epidermidis
NSSYKTI

SEQ ID NO: 1786196 - protein, 6 aa, Staphylococcus epidermidis
NSTDGL

SEQ ID NO: 1786197 - protein, 8 aa, Staphylococcus epidermidis
NSTEQSQI

SEQ ID NO: 1786198 - protein, 4 aa, Staphylococcus epidermidis
NSTH

SEQ ID NO: 1786199 - protein, 7 aa, Staphylococcus epidermidis
NSTINSN

SEQ ID NO: 1786200 - protein, 11 aa, Staphylococcus epidermidis
NSTNETVGVED

SEQ ID NO: 1786201 - protein, 7 aa, Staphylococcus epidermidis
NSTSTDF

SEQ ID NO: 1786202 - protein, 5 aa, Staphylococcus epidermidis
NSTSV

SEQ ID NO: 1786203 - protein, 13 aa, Staphylococcus epidermidis
NSTVQKNLENYEK

SEQ ID NO: 1786204 - protein, 6 aa, Staphylococcus epidermidis
NSTYIG

SEQ ID NO: 1786205 - protein, 5 aa, Staphylococcus epidermidis
NSTYT

SEQ ID NO: 1786206 - protein, 17 aa, Staphylococcus epidermidis
NSVAKTAKSGKAAQATF

SEQ ID NO: 1786207 - protein, 12 aa, Staphylococcus epidermidis
NSVGKTLNATKL

SEQ ID NO: 1786208 - protein, 6 aa, Staphylococcus epidermidis
NSVINK

SEQ ID NO: 1786209 - protein, 6 aa, Staphylococcus epidermidis
NSYGLG

SEQ ID NO: 1786210 - protein, 10 aa, Staphylococcus epidermidis
NSYGNNEPLE

SEQ ID NO: 1786211 - protein, 7 aa, Staphylococcus epidermidis
NSYKNGE

SEQ ID NO: 1786212 - protein, 12 aa, Staphylococcus epidermidis
NSYSKKKNTNNV

SEQ ID NO: 1786213 - protein, 17 aa, Staphylococcus epidermidis
NSYTGSPGAKIKHSYNG

SEQ ID NO: 1786214 - protein, 6 aa, Staphylococcus epidermidis
NTAEEI

SEQ ID NO: 1786215 - protein, 6 aa, Staphylococcus epidermidis
NTAGNT

SEQ ID NO: 1786216 - protein, 13 aa, Staphylococcus epidermidis
NTAQKNKTYNDAQ

SEQ ID NO: 1786217 - protein, 12 aa, Staphylococcus epidermidis
NTATRKRKKGYV

SEQ ID NO: 1786218 - protein, 10 aa, Staphylococcus epidermidis
NTDDETKGAY

SEQ ID NO: 1786219 - protein, 8 aa, Staphylococcus epidermidis
NTDDYENS

SEQ ID NO: 1786220 - protein, 9 aa, Staphylococcus epidermidis
NTDEGSRRL

SEQ ID NO: 1786221 - protein, 13 aa, Staphylococcus epidermidis
NTDKVKKKITQFN

SEQ ID NO: 1786222 - protein, 4 aa, Staphylococcus epidermidis
NTDN

SEQ ID NO: 1786223 - protein, 10 aa, Staphylococcus epidermidis
NTDNARNLQQ

SEQ ID NO: 1786224 - protein, 7 aa, Staphylococcus epidermidis
NTDNKRA

SEQ ID NO: 1786225 - protein, 9 aa, Staphylococcus epidermidis
NTDTKIGKE

SEQ ID NO: 1786226 - protein, 9 aa, Staphylococcus epidermidis
NTDYVNTQY

SEQ ID NO: 1786227 - protein, 9 aa, Staphylococcus epidermidis
NTEASSTSE

SEQ ID NO: 1786228 - protein, 6 aa, Staphylococcus epidermidis
NTEDQI

SEQ ID NO: 1786229 - protein, 22 aa, Staphylococcus epidermidis
NTEDRKKNKSDNINVESKSDTQ

SEQ ID NO: 1786230 - protein, 7 aa, Staphylococcus epidermidis
NTEEREL

SEQ ID NO: 1786231 - protein, 4 aa, Staphylococcus epidermidis
NTEF

SEQ ID NO: 1786232 - protein, 9 aa, Staphylococcus epidermidis
NTEKQAKTS

SEQ ID NO: 1786233 - protein, 16 aa, Staphylococcus epidermidis
NTENQKALKTVTPEEL

SEQ ID NO: 1786234 - protein, 5 aa, Staphylococcus epidermidis
NTENR

SEQ ID NO: 1786235 - protein, 4 aa, Staphylococcus epidermidis
NTER

SEQ ID NO: 1786236 - protein, 5 aa, Staphylococcus epidermidis
NTERD

SEQ ID NO: 1786237 - protein, 19 aa, Staphylococcus epidermidis
NTFGDAAKTLKVSSTKSMT

SEQ ID NO: 1786238 - protein, 7 aa, Staphylococcus epidermidis
NTHKPTV

SEQ ID NO: 1786239 - protein, 6 aa, Staphylococcus epidermidis
NTHNQL

SEQ ID NO: 1786240 - protein, 35 aa, Staphylococcus epidermidis
NTIESLTQTVNNSKDALQGAKKLSRDQQNAETEIR

SEQ ID NO: 1786241 - protein, 12 aa, Staphylococcus epidermidis
NTIGEVAQNNNL

SEQ ID NO: 1786242 - protein, 6 aa, Staphylococcus epidermidis
NTIKNN

SEQ ID NO: 1786243 - protein, 7 aa, Staphylococcus epidermidis
NTIKPDD

SEQ ID NO: 1786244 - protein, 6 aa, Staphylococcus epidermidis
NTIKYS

SEQ ID NO: 1786245 - protein, 7 aa, Staphylococcus epidermidis
NTIPTSY

SEQ ID NO: 1786246 - protein, 11 aa, Staphylococcus epidermidis
NTIQSAGGQAI

SEQ ID NO: 1786247 - protein, 6 aa, Staphylococcus epidermidis
NTKASL

SEQ ID NO: 1786248 - protein, 8 aa, Staphylococcus epidermidis
NTKEDKTV

SEQ ID NO: 1786249 - protein, 21 aa, Staphylococcus epidermidis
NTKEKLVKEETYSKVLELCKE

SEQ ID NO: 1786250 - protein, 9 aa, Staphylococcus epidermidis
NTKGQERLT

SEQ ID NO: 1786251 - protein, 15 aa, Staphylococcus epidermidis
NTKGYQTKENIEYKE

SEQ ID NO: 1786252 - protein, 7 aa, Staphylococcus epidermidis
NTKIGSG

SEQ ID NO: 1786253 - protein, 5 aa, Staphylococcus epidermidis
NTKKI

SEQ ID NO: 1786254 - protein, 9 aa, Staphylococcus epidermidis
NTKKPKINN

SEQ ID NO: 1786255 - protein, 6 aa, Staphylococcus epidermidis
NTKLNK

SEQ ID NO: 1786256 - protein, 21 aa, Staphylococcus epidermidis
NTKNLAKRKAIKNKQKNLLKI

SEQ ID NO: 1786257 - protein, 8 aa, Staphylococcus epidermidis
NTKRYTQT

SEQ ID NO: 1786258 - protein, 14 aa, Staphylococcus epidermidis
NTKSISKAAKNLGY

SEQ ID NO: 1786259 - protein, 9 aa, Staphylococcus epidermidis
NTKSVRPNA

SEQ ID NO: 1786260 - protein, 11 aa, Staphylococcus epidermidis
NTLKEKEDQYQ

SEQ ID NO: 1786261 - protein, 7 aa, Staphylococcus epidermidis
NTLNSPN

SEQ ID NO: 1786262 - protein, 11 aa, Staphylococcus epidermidis
NTLQPKEKEFE

SEQ ID NO: 1786263 - protein, 8 aa, Staphylococcus epidermidis
NTLTSDDK

SEQ ID NO: 1786264 - protein, 6 aa, Staphylococcus epidermidis
NTMTNG

SEQ ID NO: 1786265 - protein, 9 aa, Staphylococcus epidermidis
NTNDERYAN

SEQ ID NO: 1786266 - protein, 4 aa, Staphylococcus epidermidis
NTNE

SEQ ID NO: 1786267 - protein, 8 aa, Staphylococcus epidermidis
NTNEEGKE

SEQ ID NO: 1786268 - protein, 7 aa, Staphylococcus epidermidis
NTNEKYK

SEQ ID NO: 1786269 - protein, 8 aa, Staphylococcus epidermidis
NTNENYTG

SEQ ID NO: 1786270 - protein, 9 aa, Staphylococcus epidermidis
NTNISYSGE

SEQ ID NO: 1786271 - protein, 10 aa, Staphylococcus epidermidis
NTNKKGNVLN

SEQ ID NO: 1786272 - protein, 8 aa, Staphylococcus epidermidis
NTNPNSAV

SEQ ID NO: 1786273 - protein, 12 aa, Staphylococcus epidermidis
NTNRPNDKGTYI

SEQ ID NO: 1786274 - protein, 13 aa, Staphylococcus epidermidis
NTNVNQANTTIDE

SEQ ID NO: 1786275 - protein, 9 aa, Staphylococcus epidermidis
NTPDGRSKF

SEQ ID NO: 1786276 - protein, 8 aa, Staphylococcus epidermidis
NTPDYVPP

SEQ ID NO: 1786277 - protein, 4 aa, Staphylococcus epidermidis
NTPI

SEQ ID NO: 1786278 - protein, 7 aa, Staphylococcus epidermidis
NTPNINK

SEQ ID NO: 1786279 - protein, 16 aa, Staphylococcus epidermidis
NTPQSFDSLKKKKRVV

SEQ ID NO: 1786280 - protein, 4 aa, Staphylococcus epidermidis
NTQD

SEQ ID NO: 1786281 - protein, 8 aa, Staphylococcus epidermidis
NTQEPEGL

SEQ ID NO: 1786282 - protein, 10 aa, Staphylococcus epidermidis
NTQSVKKDGQ

SEQ ID NO: 1786283 - protein, 10 aa, Staphylococcus epidermidis
NTRNKEFTVN

SEQ ID NO: 1786284 - protein, 6 aa, Staphylococcus epidermidis
NTRPEE

SEQ ID NO: 1786285 - protein, 9 aa, Staphylococcus epidermidis
NTRPVPDSV

SEQ ID NO: 1786286 - protein, 6 aa, Staphylococcus epidermidis
NTRTTH

SEQ ID NO: 1786287 - protein, 6 aa, Staphylococcus epidermidis
NTRTTK

SEQ ID NO: 1786288 - protein, 7 aa, Staphylococcus epidermidis
NTRTTKG

SEQ ID NO: 1786289 - protein, 6 aa, Staphylococcus epidermidis
NTSETI

SEQ ID NO: 1786290 - protein, 10 aa, Staphylococcus epidermidis
NTSFKPNDED

SEQ ID NO: 1786291 - protein, 8 aa, Staphylococcus epidermidis
NTSKSNKE

SEQ ID NO: 1786292 - protein, 5 aa, Staphylococcus epidermidis
NTSYA

SEQ ID NO: 1786293 - protein, 8 aa, Staphylococcus epidermidis
NTTGIPDG

SEQ ID NO: 1786294 - protein, 9 aa, Staphylococcus epidermidis
NTTSQTTRK

SEQ ID NO: 1786295 - protein, 39 aa, Staphylococcus epidermidis
NTTVTQAKKDVNDTATNANNSITTTSNNAVNTVTQARDD

SEQ ID NO: 1786296 - protein, 7 aa, Staphylococcus epidermidis
NTTYGKG

SEQ ID NO: 1786297 - protein, 15 aa, Staphylococcus epidermidis
NTWQSNKIRTQNEQT

SEQ ID NO: 1786298 - protein, 10 aa, Staphylococcus epidermidis
NTYEPGSTFK

SEQ ID NO: 1786299 - protein, 14 aa, Staphylococcus epidermidis
NVAGTTRTTRLDTP

SEQ ID NO: 1786300 - protein, 7 aa, Staphylococcus epidermidis
NVAKEQG

SEQ ID NO: 1786301 - protein, 6 aa, Staphylococcus epidermidis
NVASEI

SEQ ID NO: 1786302 - protein, 12 aa, Staphylococcus epidermidis
NVDDLPSLINQS

SEQ ID NO: 1786303 - protein, 16 aa, Staphylococcus epidermidis
NVDGVYSADPKVDENA

SEQ ID NO: 1786304 - protein, 5 aa, Staphylococcus epidermidis
NVDSS

SEQ ID NO: 1786305 - protein, 8 aa, Staphylococcus epidermidis
NVEAKKDK

SEQ ID NO: 1786306 - protein, 26 aa, Staphylococcus epidermidis
NVEGRSAKIEGKSQLQGAQVKATDLR

SEQ ID NO: 1786307 - protein, 11 aa, Staphylococcus epidermidis
NVEGSTKIGAK

SEQ ID NO: 1786308 - protein, 30 aa, Staphylococcus epidermidis
NVEKRPKPEYESTKIPKISQKKINQLSGTK

SEQ ID NO: 1786309 - protein, 6 aa, Staphylococcus epidermidis
NVEQLE

SEQ ID NO: 1786310 - protein, 14 aa, Staphylococcus epidermidis
NVESQGEDKKEQMQ

SEQ ID NO: 1786311 - protein, 6 aa, Staphylococcus epidermidis
NVESSG

SEQ ID NO: 1786312 - protein, 4 aa, Staphylococcus epidermidis
NVGK

SEQ ID NO: 1786313 - protein, 9 aa, Staphylococcus epidermidis
NVGKPVKAY

SEQ ID NO: 1786314 - protein, 8 aa, Staphylococcus epidermidis
NVGTNRGL

SEQ ID NO: 1786315 - protein, 8 aa, Staphylococcus epidermidis
NVGYGTKQ

SEQ ID NO: 1786316 - protein, 7 aa, Staphylococcus epidermidis
NVGYKEE

SEQ ID NO: 1786317 - protein, 7 aa, Staphylococcus epidermidis
NVKDKSN

SEQ ID NO: 1786318 - protein, 13 aa, Staphylococcus epidermidis
NVKKSNKNVEKEI

SEQ ID NO: 1786319 - protein, 6 aa, Staphylococcus epidermidis
NVKNGG

SEQ ID NO: 1786320 - protein, 14 aa, Staphylococcus epidermidis
NVKNVKDRKGKEKQ

SEQ ID NO: 1786321 - protein, 19 aa, Staphylococcus epidermidis
NVKTVDDSKKIREQFNKPK

SEQ ID NO: 1786322 - protein, 22 aa, Staphylococcus epidermidis
NVKTVDDSKKIREQFNQNQPKM

SEQ ID NO: 1786323 - protein, 8 aa, Staphylococcus epidermidis
NVMDGSVK

SEQ ID NO: 1786324 - protein, 29 aa, Staphylococcus epidermidis
NVNASLRDATVNSYQPQNEHQVQAKKTAI

SEQ ID NO: 1786325 - protein, 12 aa, Staphylococcus epidermidis
NVNNKHSQDSIN

SEQ ID NO: 1786326 - protein, 34 aa, Staphylococcus epidermidis
NVNQQYENQTAEDVGDRNKEVPEESNDSNLEEDE

SEQ ID NO: 1786327 - protein, 13 aa, Staphylococcus epidermidis
NVNTENQIASAKA

SEQ ID NO: 1786328 - protein, 5 aa, Staphylococcus epidermidis
NVNVD

SEQ ID NO: 1786329 - protein, 6 aa, Staphylococcus epidermidis
NVQDSK

SEQ ID NO: 1786330 - protein, 6 aa, Staphylococcus epidermidis
NVQKKD

SEQ ID NO: 1786331 - protein, 9 aa, Staphylococcus epidermidis
NVQKQGTRR

SEQ ID NO: 1786332 - protein, 11 aa, Staphylococcus epidermidis
NVQSSSQQNET

SEQ ID NO: 1786333 - protein, 13 aa, Staphylococcus epidermidis
NVRHQSADATSPI

SEQ ID NO: 1786334 - protein, 7 aa, Staphylococcus epidermidis
NVSETTY

SEQ ID NO: 1786335 - protein, 4 aa, Staphylococcus epidermidis
NVSK

SEQ ID NO: 1786336 - protein, 10 aa, Staphylococcus epidermidis
NVSKKDSDGF

SEQ ID NO: 1786337 - protein, 18 aa, Staphylococcus epidermidis
NVSNDDDLASTCKYPEAP

SEQ ID NO: 1786338 - protein, 20 aa, Staphylococcus epidermidis
NVSNERLTELSTKENRQNKP

SEQ ID NO: 1786339 - protein, 18 aa, Staphylococcus epidermidis
NVSPTKIDGHGRLKPESN

SEQ ID NO: 1786340 - protein, 7 aa, Staphylococcus epidermidis
NVSQEGA

SEQ ID NO: 1786341 - protein, 5 aa, Staphylococcus epidermidis
NVSSQ

SEQ ID NO: 1786342 - protein, 8 aa, Staphylococcus epidermidis
NVSTAENG

SEQ ID NO: 1786343 - protein, 8 aa, Staphylococcus epidermidis
NVSTAPHE

SEQ ID NO: 1786344 - protein, 5 aa, Staphylococcus epidermidis
NVSYD

SEQ ID NO: 1786345 - protein, 8 aa, Staphylococcus epidermidis
NVTAEEVN

SEQ ID NO: 1786346 - protein, 8 aa, Staphylococcus epidermidis
NVTAREGA

SEQ ID NO: 1786347 - protein, 8 aa, Staphylococcus epidermidis
NVTEEQLD

SEQ ID NO: 1786348 - protein, 6 aa, Staphylococcus epidermidis
NVTKEA

SEQ ID NO: 1786349 - protein, 13 aa, Staphylococcus epidermidis
NVTMRNDPDGRSR

SEQ ID NO: 1786350 - protein, 11 aa, Staphylococcus epidermidis
NVTSGANPVGL

SEQ ID NO: 1786351 - protein, 7 aa, Staphylococcus epidermidis
NVTSHSD

SEQ ID NO: 1786352 - protein, 8 aa, Staphylococcus epidermidis
NVVGSGDA

SEQ ID NO: 1786353 - protein, 11 aa, Staphylococcus epidermidis
NWAGQASSAGF

SEQ ID NO: 1786354 - protein, 5 aa, Staphylococcus epidermidis
NWKSP

SEQ ID NO: 1786355 - protein, 17 aa, Staphylococcus epidermidis
NWRNSNGYTGSPGSLEK

SEQ ID NO: 1786356 - protein, 9 aa, Staphylococcus epidermidis
NWSSSKGKG

SEQ ID NO: 1786357 - protein, 6 aa, Staphylococcus epidermidis
NWTDTD

SEQ ID NO: 1786358 - protein, 13 aa, Staphylococcus epidermidis
NYAARRGKSWKDL

SEQ ID NO: 1786359 - protein, 14 aa, Staphylococcus epidermidis
NYAASQKEALETAM

SEQ ID NO: 1786360 - protein, 21 aa, Staphylococcus epidermidis
NYAKEGKNLGRPKRNDKNLSD

SEQ ID NO: 1786361 - protein, 4 aa, Staphylococcus epidermidis
NYDG

SEQ ID NO: 1786362 - protein, 5 aa, Staphylococcus epidermidis
NYDGS

SEQ ID NO: 1786363 - protein, 10 aa, Staphylococcus epidermidis
NYDKDEQNYE

SEQ ID NO: 1786364 - protein, 5 aa, Staphylococcus epidermidis
NYDSM

SEQ ID NO: 1786365 - protein, 15 aa, Staphylococcus epidermidis
NYEAEKMAHEIINIG

SEQ ID NO: 1786366 - protein, 15 aa, Staphylococcus epidermidis
NYEAQQMAHKIITIE

SEQ ID NO: 1786367 - protein, 10 aa, Staphylococcus epidermidis
NYEKAEQIYS

SEQ ID NO: 1786368 - protein, 10 aa, Staphylococcus epidermidis
NYERKKEKQS

SEQ ID NO: 1786369 - protein, 10 aa, Staphylococcus epidermidis
NYGTPLTNEA

SEQ ID NO: 1786370 - protein, 6 aa, Staphylococcus epidermidis
NYHGSY

SEQ ID NO: 1786371 - protein, 5 aa, Staphylococcus epidermidis
NYHPD

SEQ ID NO: 1786372 - protein, 4 aa, Staphylococcus epidermidis
NYIG

SEQ ID NO: 1786373 - protein, 5 aa, Staphylococcus epidermidis
NYKDN

SEQ ID NO: 1786374 - protein, 4 aa, Staphylococcus epidermidis
NYKE

SEQ ID NO: 1786375 - protein, 10 aa, Staphylococcus epidermidis
NYKERNKGLE

SEQ ID NO: 1786376 - protein, 7 aa, Staphylococcus epidermidis
NYKTNKS

SEQ ID NO: 1786377 - protein, 5 aa, Staphylococcus epidermidis
NYLDT

SEQ ID NO: 1786378 - protein, 4 aa, Staphylococcus epidermidis
NYLK

SEQ ID NO: 1786379 - protein, 15 aa, Staphylococcus epidermidis
NYLSSNDEVLTTSYG

SEQ ID NO: 1786380 - protein, 11 aa, Staphylococcus epidermidis
NYNNKSNKFTK

SEQ ID NO: 1786381 - protein, 4 aa, Staphylococcus epidermidis
NYNY

SEQ ID NO: 1786382 - protein, 5 aa, Staphylococcus epidermidis
NYPDP

SEQ ID NO: 1786383 - protein, 6 aa, Staphylococcus epidermidis
NYQDGS

SEQ ID NO: 1786384 - protein, 10 aa, Staphylococcus epidermidis
NYQDKKKEII

SEQ ID NO: 1786385 - protein, 9 aa, Staphylococcus epidermidis
NYQGGGRGH

SEQ ID NO: 1786386 - protein, 14 aa, Staphylococcus epidermidis
NYRKPGAGAYPLRG

SEQ ID NO: 1786387 - protein, 10 aa, Staphylococcus epidermidis
NYRQKKGNIK

SEQ ID NO: 1786388 - protein, 5 aa, Staphylococcus epidermidis
NYSIS

SEQ ID NO: 1786389 - protein, 15 aa, Staphylococcus epidermidis
NYSKNEIELSLYEVH

SEQ ID NO: 1786390 - protein, 7 aa, Staphylococcus epidermidis
NYSPNSI

SEQ ID NO: 1786391 - protein, 7 aa, Staphylococcus epidermidis
NYSTDTF

SEQ ID NO: 1786392 - protein, 4 aa, Staphylococcus epidermidis
NYTA

SEQ ID NO: 1786393 - protein, 20 aa, Staphylococcus epidermidis
NYTKEGKKLGRPKRDDKNLR

SEQ ID NO: 1786394 - protein, 5 aa, Staphylococcus epidermidis
NYTKK

SEQ ID NO: 1786395 - protein, 20 aa, Staphylococcus epidermidis
NYTREGKRLGRPKRDDKNLR

SEQ ID NO: 1786396 - protein, 19 aa, Staphylococcus epidermidis
NYTTSNSENALKGGETNDE

SEQ ID NO: 1786397 - protein, 6 aa, Staphylococcus epidermidis
NYVGGG

SEQ ID NO: 1786398 - protein, 9 aa, Staphylococcus epidermidis
NYVTANEKN

SEQ ID NO: 1786399 - protein, 5 aa, Staphylococcus epidermidis
NYYEG

SEQ ID NO: 1786400 - protein, 12 aa, Staphylococcus epidermidis
NYYGQEYNSTTY

SEQ ID NO: 1786401 - protein, 9 aa, Staphylococcus epidermidis
NYYGYSGDA

SEQ ID NO: 1786402 - protein, 4 aa, Staphylococcus epidermidis
NYYS

SEQ ID NO: 1786403 - protein, 6 aa, Staphylococcus epidermidis
PAADNK

SEQ ID NO: 1786404 - protein, 11 aa, Staphylococcus epidermidis
PAAEPERVKQE

SEQ ID NO: 1786405 - protein, 6 aa, Staphylococcus epidermidis
PAAGRK

SEQ ID NO: 1786406 - protein, 6 aa, Staphylococcus epidermidis
PADQRQ

SEQ ID NO: 1786407 - protein, 12 aa, Staphylococcus epidermidis
PADVRAKEGITD

SEQ ID NO: 1786408 - protein, 11 aa, Staphylococcus epidermidis
PAEKVDKALDQ

SEQ ID NO: 1786409 - protein, 5 aa, Staphylococcus epidermidis
PAESE

SEQ ID NO: 1786410 - protein, 13 aa, Staphylococcus epidermidis
PAGDGWDSDPFDP

SEQ ID NO: 1786411 - protein, 19 aa, Staphylococcus epidermidis
PAHQSVKKGTVQVKRDGTP

SEQ ID NO: 1786412 - protein, 7 aa, Staphylococcus epidermidis
PAKSGAK

SEQ ID NO: 1786413 - protein, 9 aa, Staphylococcus epidermidis
PAKSISDDD

SEQ ID NO: 1786414 - protein, 9 aa, Staphylococcus epidermidis
PAKSISDED

SEQ ID NO: 1786415 - protein, 13 aa, Staphylococcus epidermidis
PAMDDDDYRRGKL

SEQ ID NO: 1786416 - protein, 14 aa, Staphylococcus epidermidis
PAMDNDDYRRGELT

SEQ ID NO: 1786417 - protein, 13 aa, Staphylococcus epidermidis
PANDIKGKQQLSG

SEQ ID NO: 1786418 - protein, 18 aa, Staphylococcus epidermidis
PANDIKGKQQLSGALGEG

SEQ ID NO: 1786419 - protein, 9 aa, Staphylococcus epidermidis
PAPGHTPGT

SEQ ID NO: 1786420 - protein, 6 aa, Staphylococcus epidermidis
PAPSGQ

SEQ ID NO: 1786421 - protein, 11 aa, Staphylococcus epidermidis
PAQQKEKLIDT

SEQ ID NO: 1786422 - protein, 6 aa, Staphylococcus epidermidis
PAQSGD

SEQ ID NO: 1786423 - protein, 6 aa, Staphylococcus epidermidis
PAQSGE

SEQ ID NO: 1786424 - protein, 15 aa, Staphylococcus epidermidis
PARTDKEKEARKEID

SEQ ID NO: 1786425 - protein, 16 aa, Staphylococcus epidermidis
PARTDKEYEARKEVEK

SEQ ID NO: 1786426 - protein, 7 aa, Staphylococcus epidermidis
PASLPDE

SEQ ID NO: 1786427 - protein, 8 aa, Staphylococcus epidermidis
PATQTPLT

SEQ ID NO: 1786428 - protein, 12 aa, Staphylococcus epidermidis
PAVDQSVQSLKE

SEQ ID NO: 1786429 - protein, 10 aa, Staphylococcus epidermidis
PAYDGQGYGS

SEQ ID NO: 1786430 - protein, 13 aa, Staphylococcus epidermidis
PAYQGPKHELDED

SEQ ID NO: 1786431 - protein, 12 aa, Staphylococcus epidermidis
PCNNSTPSKGGD

SEQ ID NO: 1786432 - protein, 5 aa, Staphylococcus epidermidis
PCPEN

SEQ ID NO: 1786433 - protein, 15 aa, Staphylococcus epidermidis
PDAEDESDEKKYDRA

SEQ ID NO: 1786434 - protein, 5 aa, Staphylococcus epidermidis
PDATD

SEQ ID NO: 1786435 - protein, 7 aa, Staphylococcus epidermidis
PDAVEEL

SEQ ID NO: 1786436 - protein, 5 aa, Staphylococcus epidermidis
PDDDS

SEQ ID NO: 1786437 - protein, 13 aa, Staphylococcus epidermidis
PDDETFSSAGTIA

SEQ ID NO: 1786438 - protein, 12 aa, Staphylococcus epidermidis
PDDIEVNNDELS

SEQ ID NO: 1786439 - protein, 5 aa, Staphylococcus epidermidis
PDDYN

SEQ ID NO: 1786440 - protein, 9 aa, Staphylococcus epidermidis
PDDYPDQGV

SEQ ID NO: 1786441 - protein, 10 aa, Staphylococcus epidermidis
PDEEIGRGPH

SEQ ID NO: 1786442 - protein, 5 aa, Staphylococcus epidermidis
PDEEY

SEQ ID NO: 1786443 - protein, 4 aa, Staphylococcus epidermidis
PDEL

SEQ ID NO: 1786444 - protein, 16 aa, Staphylococcus epidermidis
PDENGNPYKSSGGEMI

SEQ ID NO: 1786445 - protein, 5 aa, Staphylococcus epidermidis
PDENL

SEQ ID NO: 1786446 - protein, 5 aa, Staphylococcus epidermidis
PDESF

SEQ ID NO: 1786447 - protein, 8 aa, Staphylococcus epidermidis
PDEVTSPY

SEQ ID NO: 1786448 - protein, 7 aa, Staphylococcus epidermidis
PDFPGDK

SEQ ID NO: 1786449 - protein, 15 aa, Staphylococcus epidermidis
PDGALNKGNYSNTKV

SEQ ID NO: 1786450 - protein, 15 aa, Staphylococcus epidermidis
PDGFEEEVSGATKLA

SEQ ID NO: 1786451 - protein, 5 aa, Staphylococcus epidermidis
PDGGK

SEQ ID NO: 1786452 - protein, 17 aa, Staphylococcus epidermidis
PDGKERYEHTALGTDPV

SEQ ID NO: 1786453 - protein, 19 aa, Staphylococcus epidermidis
PDGKERYEHTARGHNPVEL

SEQ ID NO: 1786454 - protein, 18 aa, Staphylococcus epidermidis
PDGKERYEHTTLGSDPVQ

SEQ ID NO: 1786455 - protein, 25 aa, Staphylococcus epidermidis
PDGMPQDDTFKYEETDVTEPENNEV

SEQ ID NO: 1786456 - protein, 9 aa, Staphylococcus epidermidis
PDGNGGMKE

SEQ ID NO: 1786457 - protein, 18 aa, Staphylococcus epidermidis
PDGSDNPDFNPNKPEYHG

SEQ ID NO: 1786458 - protein, 18 aa, Staphylococcus epidermidis
PDGSDNPEFNPNKPQYKG

SEQ ID NO: 1786459 - protein, 16 aa, Staphylococcus epidermidis
PDGTEEIKVEKRESNL

SEQ ID NO: 1786460 - protein, 20 aa, Staphylococcus epidermidis
PDIEEGLNDEKQRQSENNQS

SEQ ID NO: 1786461 - protein, 20 aa, Staphylococcus epidermidis
PDIEEGLNGEQQRQSENNQP

SEQ ID NO: 1786462 - protein, 9 aa, Staphylococcus epidermidis
PDIRSPQEA

SEQ ID NO: 1786463 - protein, 10 aa, Staphylococcus epidermidis
PDITDKGYYQ

SEQ ID NO: 1786464 - protein, 10 aa, Staphylococcus epidermidis
PDKLETDNQK

SEQ ID NO: 1786465 - protein, 4 aa, Staphylococcus epidermidis
PDKN

SEQ ID NO: 1786466 - protein, 7 aa, Staphylococcus epidermidis
PDKTEFD

SEQ ID NO: 1786467 - protein, 4 aa, Staphylococcus epidermidis
PDKV

SEQ ID NO: 1786468 - protein, 4 aa, Staphylococcus epidermidis
PDLA

SEQ ID NO: 1786469 - protein, 12 aa, Staphylococcus epidermidis
PDLAKNNGYRDR

SEQ ID NO: 1786470 - protein, 8 aa, Staphylococcus epidermidis
PDLEKGQS

SEQ ID NO: 1786471 - protein, 18 aa, Staphylococcus epidermidis
PDLPKSTINSKVAPLSPY

SEQ ID NO: 1786472 - protein, 5 aa, Staphylococcus epidermidis
PDNEK

SEQ ID NO: 1786473 - protein, 11 aa, Staphylococcus epidermidis
PDNPEKREDHY

SEQ ID NO: 1786474 - protein, 6 aa, Staphylococcus epidermidis
PDNSIA

SEQ ID NO: 1786475 - protein, 7 aa, Staphylococcus epidermidis
PDPGYTD

SEQ ID NO: 1786476 - protein, 11 aa, Staphylococcus epidermidis
PDPKTGKQLSL

SEQ ID NO: 1786477 - protein, 19 aa, Staphylococcus epidermidis
PDPPFTGVAPGAVTNEASR

SEQ ID NO: 1786478 - protein, 4 aa, Staphylococcus epidermidis
PDRD

SEQ ID NO: 1786479 - protein, 7 aa, Staphylococcus epidermidis
PDRTDEA

SEQ ID NO: 1786480 - protein, 13 aa, Staphylococcus epidermidis
PDSFSDGGQYNSV

SEQ ID NO: 1786481 - protein, 12 aa, Staphylococcus epidermidis
PDSKEEAKNIKP

SEQ ID NO: 1786482 - protein, 4 aa, Staphylococcus epidermidis
PDSL

SEQ ID NO: 1786483 - protein, 9 aa, Staphylococcus epidermidis
PDSPEKRED

SEQ ID NO: 1786484 - protein, 8 aa, Staphylococcus epidermidis
PDSSKINT

SEQ ID NO: 1786485 - protein, 6 aa, Staphylococcus epidermidis
PDTDAI

SEQ ID NO: 1786486 - protein, 4 aa, Staphylococcus epidermidis
PDVK

SEQ ID NO: 1786487 - protein, 6 aa, Staphylococcus epidermidis
PDVKEN

SEQ ID NO: 1786488 - protein, 9 aa, Staphylococcus epidermidis
PDVRDGLKP

SEQ ID NO: 1786489 - protein, 8 aa, Staphylococcus epidermidis
PDVTEDEM

SEQ ID NO: 1786490 - protein, 22 aa, Staphylococcus epidermidis
PDVVNDSDKLRKYSKEQADLQK

SEQ ID NO: 1786491 - protein, 6 aa, Staphylococcus epidermidis
PDYSKT

SEQ ID NO: 1786492 - protein, 7 aa, Staphylococcus epidermidis
PEAENRN

SEQ ID NO: 1786493 - protein, 10 aa, Staphylococcus epidermidis
PEARGKGVGT

SEQ ID NO: 1786494 - protein, 17 aa, Staphylococcus epidermidis
PEASPVLSGGEPGPHKL

SEQ ID NO: 1786495 - protein, 9 aa, Staphylococcus epidermidis
PEAVRQERG

SEQ ID NO: 1786496 - protein, 7 aa, Staphylococcus epidermidis
PEDAGER

SEQ ID NO: 1786497 - protein, 8 aa, Staphylococcus epidermidis
PEDDEDEL

SEQ ID NO: 1786498 - protein, 5 aa, Staphylococcus epidermidis
PEDEN

SEQ ID NO: 1786499 - protein, 7 aa, Staphylococcus epidermidis
PEDGSLE

SEQ ID NO: 1786500 - protein, 14 aa, Staphylococcus epidermidis
PEDGSLELTSGWTS

SEQ ID NO: 1786501 - protein, 6 aa, Staphylococcus epidermidis
PEDTEA

SEQ ID NO: 1786502 - protein, 6 aa, Staphylococcus epidermidis
PEDTGA

SEQ ID NO: 1786503 - protein, 5 aa, Staphylococcus epidermidis
PEDTV

SEQ ID NO: 1786504 - protein, 5 aa, Staphylococcus epidermidis
PEEIE

SEQ ID NO: 1786505 - protein, 6 aa, Staphylococcus epidermidis
PEEKLS

SEQ ID NO: 1786506 - protein, 11 aa, Staphylococcus epidermidis
PEEQGEKPNTL

SEQ ID NO: 1786507 - protein, 6 aa, Staphylococcus epidermidis
PEERGL

SEQ ID NO: 1786508 - protein, 9 aa, Staphylococcus epidermidis
PEESDTVNT

SEQ ID NO: 1786509 - protein, 9 aa, Staphylococcus epidermidis
PEEVESPGI

SEQ ID NO: 1786510 - protein, 7 aa, Staphylococcus epidermidis
PEGEDER

SEQ ID NO: 1786511 - protein, 12 aa, Staphylococcus epidermidis
PEGFAEVLLNIW

SEQ ID NO: 1786512 - protein, 7 aa, Staphylococcus epidermidis
PEGGYYR

SEQ ID NO: 1786513 - protein, 7 aa, Staphylococcus epidermidis
PEGHVDA

SEQ ID NO: 1786514 - protein, 12 aa, Staphylococcus epidermidis
PEGVEKMQEAHP

SEQ ID NO: 1786515 - protein, 11 aa, Staphylococcus epidermidis
PEGVSNENLTS

SEQ ID NO: 1786516 - protein, 15 aa, Staphylococcus epidermidis
PEHASIQTKAPKTYV

SEQ ID NO: 1786517 - protein, 5 aa, Staphylococcus epidermidis
PEIDD

SEQ ID NO: 1786518 - protein, 6 aa, Staphylococcus epidermidis
PEIKNK

SEQ ID NO: 1786519 - protein, 4 aa, Staphylococcus epidermidis
PEIY

SEQ ID NO: 1786520 - protein, 19 aa, Staphylococcus epidermidis
PEKELEETKLKAKSLLEVT

SEQ ID NO: 1786521 - protein, 9 aa, Staphylococcus epidermidis
PEKEPITPF

SEQ ID NO: 1786522 - protein, 9 aa, Staphylococcus epidermidis
PEKEVKTVQ

SEQ ID NO: 1786523 - protein, 20 aa, Staphylococcus epidermidis
PEKFKNRKPDELSGGQRQRV

SEQ ID NO: 1786524 - protein, 9 aa, Staphylococcus epidermidis
PEKKRQPYS

SEQ ID NO: 1786525 - protein, 9 aa, Staphylococcus epidermidis
PEKLKDSQE

SEQ ID NO: 1786526 - protein, 10 aa, Staphylococcus epidermidis
PEKLKGSSEL

SEQ ID NO: 1786527 - protein, 8 aa, Staphylococcus epidermidis
PEKNKIDS

SEQ ID NO: 1786528 - protein, 10 aa, Staphylococcus epidermidis
PEKRESYTKA

SEQ ID NO: 1786529 - protein, 8 aa, Staphylococcus epidermidis
PEKSANQL

SEQ ID NO: 1786530 - protein, 8 aa, Staphylococcus epidermidis
PEKSGEHG

SEQ ID NO: 1786531 - protein, 4 aa, Staphylococcus epidermidis
PEKT

SEQ ID NO: 1786532 - protein, 14 aa, Staphylococcus epidermidis
PEKYNSISRTATLS

SEQ ID NO: 1786533 - protein, 12 aa, Staphylococcus epidermidis
PELAQSRDIHEG

SEQ ID NO: 1786534 - protein, 21 aa, Staphylococcus epidermidis
PELDNEASQQFRDDQTNSAAN

SEQ ID NO: 1786535 - protein, 8 aa, Staphylococcus epidermidis
PELKTGQI

SEQ ID NO: 1786536 - protein, 10 aa, Staphylococcus epidermidis
PELPDSKANR

SEQ ID NO: 1786537 - protein, 8 aa, Staphylococcus epidermidis
PELVEGKS

SEQ ID NO: 1786538 - protein, 4 aa, Staphylococcus epidermidis
PEMY

SEQ ID NO: 1786539 - protein, 6 aa, Staphylococcus epidermidis
PENQIS

SEQ ID NO: 1786540 - protein, 8 aa, Staphylococcus epidermidis
PENTSKAI

SEQ ID NO: 1786541 - protein, 7 aa, Staphylococcus epidermidis
PENTTAL

SEQ ID NO: 1786542 - protein, 8 aa, Staphylococcus epidermidis
PENVAQQV

SEQ ID NO: 1786543 - protein, 20 aa, Staphylococcus epidermidis
PEQFKNRQPDELSGGQRQRV

SEQ ID NO: 1786544 - protein, 6 aa, Staphylococcus epidermidis
PEQLPR

SEQ ID NO: 1786545 - protein, 4 aa, Staphylococcus epidermidis
PEQN

SEQ ID NO: 1786546 - protein, 15 aa, Staphylococcus epidermidis
PEQNEGIIKVIKKFF

SEQ ID NO: 1786547 - protein, 11 aa, Staphylococcus epidermidis
PEQPKEDGCKD

SEQ ID NO: 1786548 - protein, 7 aa, Staphylococcus epidermidis
PERNKGI

SEQ ID NO: 1786549 - protein, 7 aa, Staphylococcus epidermidis
PESDFKN

SEQ ID NO: 1786550 - protein, 9 aa, Staphylococcus epidermidis
PESGSPGLR

SEQ ID NO: 1786551 - protein, 7 aa, Staphylococcus epidermidis
PESKQHD

SEQ ID NO: 1786552 - protein, 8 aa, Staphylococcus epidermidis
PESLGVTE

SEQ ID NO: 1786553 - protein, 6 aa, Staphylococcus epidermidis
PESVET

SEQ ID NO: 1786554 - protein, 7 aa, Staphylococcus epidermidis
PETAISK

SEQ ID NO: 1786555 - protein, 4 aa, Staphylococcus epidermidis
PETI

SEQ ID NO: 1786556 - protein, 12 aa, Staphylococcus epidermidis
PETNNAKFETRL

SEQ ID NO: 1786557 - protein, 10 aa, Staphylococcus epidermidis
PETRGEKLET

SEQ ID NO: 1786558 - protein, 9 aa, Staphylococcus epidermidis
PETSDTSKP

SEQ ID NO: 1786559 - protein, 6 aa, Staphylococcus epidermidis
PETSGI

SEQ ID NO: 1786560 - protein, 50 aa, Staphylococcus epidermidis
PETVSRSNETETNNEEKNSSTQFSNETTHQSQSQNNQSPTYNQGSTIPVK

SEQ ID NO: 1786561 - protein, 7 aa, Staphylococcus epidermidis
PEVAEHP

SEQ ID NO: 1786562 - protein, 4 aa, Staphylococcus epidermidis
PEVS

SEQ ID NO: 1786563 - protein, 5 aa, Staphylococcus epidermidis
PEVTE

SEQ ID NO: 1786564 - protein, 4 aa, Staphylococcus epidermidis
PEYA

SEQ ID NO: 1786565 - protein, 6 aa, Staphylococcus epidermidis
PEYEDV

SEQ ID NO: 1786566 - protein, 15 aa, Staphylococcus epidermidis
PEYGKSYLKEMGVEH

SEQ ID NO: 1786567 - protein, 9 aa, Staphylococcus epidermidis
PEYGQQTEV

SEQ ID NO: 1786568 - protein, 23 aa, Staphylococcus epidermidis
PEYLGGQNNKNFINREDNNTGVQ

SEQ ID NO: 1786569 - protein, 7 aa, Staphylococcus epidermidis
PEYNNDK

SEQ ID NO: 1786570 - protein, 8 aa, Staphylococcus epidermidis
PEYRGQGI

SEQ ID NO: 1786571 - protein, 7 aa, Staphylococcus epidermidis
PFAPPSK

SEQ ID NO: 1786572 - protein, 10 aa, Staphylococcus epidermidis
PFEEAEETID

SEQ ID NO: 1786573 - protein, 6 aa, Staphylococcus epidermidis
PFGDNY

SEQ ID NO: 1786574 - protein, 5 aa, Staphylococcus epidermidis
PFGDS

SEQ ID NO: 1786575 - protein, 11 aa, Staphylococcus epidermidis
PFGEDGQTKLS

SEQ ID NO: 1786576 - protein, 12 aa, Staphylococcus epidermidis
PFGEEGQQKLST

SEQ ID NO: 1786577 - protein, 9 aa, Staphylococcus epidermidis
PFGENGNDY

SEQ ID NO: 1786578 - protein, 7 aa, Staphylococcus epidermidis
PFGGGVH

SEQ ID NO: 1786579 - protein, 13 aa, Staphylococcus epidermidis
PFGGPAGGDGGIG

SEQ ID NO: 1786580 - protein, 16 aa, Staphylococcus epidermidis
PFGSDLKSAESLNNQI

SEQ ID NO: 1786581 - protein, 11 aa, Staphylococcus epidermidis
PFKGKSPSTEI

SEQ ID NO: 1786582 - protein, 4 aa, Staphylococcus epidermidis
PFKN

SEQ ID NO: 1786583 - protein, 15 aa, Staphylococcus epidermidis
PFKPSNEKKKPYAPY

SEQ ID NO: 1786584 - protein, 22 aa, Staphylococcus epidermidis
PFNADGTWGKKTKTKTRYDENG

SEQ ID NO: 1786585 - protein, 25 aa, Staphylococcus epidermidis
PFNADGTWGKKTKTRTQYDENGNAI

SEQ ID NO: 1786586 - protein, 7 aa, Staphylococcus epidermidis
PFNATSR

SEQ ID NO: 1786587 - protein, 9 aa, Staphylococcus epidermidis
PFNDEKPIE

SEQ ID NO: 1786588 - protein, 17 aa, Staphylococcus epidermidis
PFPDKTKFETKGESKSL

SEQ ID NO: 1786589 - protein, 18 aa, Staphylococcus epidermidis
PFPKKTKFETKGESKSLA

SEQ ID NO: 1786590 - protein, 7 aa, Staphylococcus epidermidis
PFPQEPL

SEQ ID NO: 1786591 - protein, 4 aa, Staphylococcus epidermidis
PFQR

SEQ ID NO: 1786592 - protein, 12 aa, Staphylococcus epidermidis
PFSSESNNENYV

SEQ ID NO: 1786593 - protein, 5 aa, Staphylococcus epidermidis
PFTAE

SEQ ID NO: 1786594 - protein, 7 aa, Staphylococcus epidermidis
PFTNNEV

SEQ ID NO: 1786595 - protein, 24 aa, Staphylococcus epidermidis
PFTSPKQEDIAKLDSEPENAQANA

SEQ ID NO: 1786596 - protein, 15 aa, Staphylococcus epidermidis
PFYNSNNPEYERGQF

SEQ ID NO: 1786597 - protein, 18 aa, Staphylococcus epidermidis
PGASITTTSSVQGYNPSP

SEQ ID NO: 1786598 - protein, 14 aa, Staphylococcus epidermidis
PGASYKNFKPSDSD

SEQ ID NO: 1786599 - protein, 10 aa, Staphylococcus epidermidis
PGAVPRTSTL

SEQ ID NO: 1786600 - protein, 8 aa, Staphylococcus epidermidis
PGDPKDIG

SEQ ID NO: 1786601 - protein, 20 aa, Staphylococcus epidermidis
PGDSDSNQTVKREMGRQAGQ

SEQ ID NO: 1786602 - protein, 5 aa, Staphylococcus epidermidis
PGDSI

SEQ ID NO: 1786603 - protein, 23 aa, Staphylococcus epidermidis
PGERDTTHFSTENASGSTSQAAN

SEQ ID NO: 1786604 - protein, 10 aa, Staphylococcus epidermidis
PGESEEEFQE

SEQ ID NO: 1786605 - protein, 9 aa, Staphylococcus epidermidis
PGETEEEFQ

SEQ ID NO: 1786606 - protein, 4 aa, Staphylococcus epidermidis
PGEV

SEQ ID NO: 1786607 - protein, 15 aa, Staphylococcus epidermidis
PGEYSPSIASASQNL

SEQ ID NO: 1786608 - protein, 14 aa, Staphylococcus epidermidis
PGEYSPTISSASQH

SEQ ID NO: 1786609 - protein, 9 aa, Staphylococcus epidermidis
PGGKATPDQ

SEQ ID NO: 1786610 - protein, 14 aa, Staphylococcus epidermidis
PGGKVEKGETPSEA

SEQ ID NO: 1786611 - protein, 4 aa, Staphylococcus epidermidis
PGHG

SEQ ID NO: 1786612 - protein, 12 aa, Staphylococcus epidermidis
PGHGQDTSDMQD

SEQ ID NO: 1786613 - protein, 7 aa, Staphylococcus epidermidis
PGHPPES

SEQ ID NO: 1786614 - protein, 14 aa, Staphylococcus epidermidis
PGHSYDKAKKDGFD

SEQ ID NO: 1786615 - protein, 6 aa, Staphylococcus epidermidis
PGIDDA

SEQ ID NO: 1786616 - protein, 10 aa, Staphylococcus epidermidis
PGIDSKDDSY

SEQ ID NO: 1786617 - protein, 5 aa, Staphylococcus epidermidis
PGIEG

SEQ ID NO: 1786618 - protein, 24 aa, Staphylococcus epidermidis
PGIRPKGAAQNDQQRITTPEDAKV

SEQ ID NO: 1786619 - protein, 8 aa, Staphylococcus epidermidis
PGKEEMDY

SEQ ID NO: 1786620 - protein, 14 aa, Staphylococcus epidermidis
PGKIEEDQYSELKK

SEQ ID NO: 1786621 - protein, 23 aa, Staphylococcus epidermidis
PGKKDTTEFSTENASGSTSQAAN

SEQ ID NO: 1786622 - protein, 12 aa, Staphylococcus epidermidis
PGKNTRMKEELP

SEQ ID NO: 1786623 - protein, 11 aa, Staphylococcus epidermidis
PGKPFGENGNQ

SEQ ID NO: 1786624 - protein, 4 aa, Staphylococcus epidermidis
PGLQ

SEQ ID NO: 1786625 - protein, 7 aa, Staphylococcus epidermidis
PGLTLNG

SEQ ID NO: 1786626 - protein, 6 aa, Staphylococcus epidermidis
PGMGSL

SEQ ID NO: 1786627 - protein, 5 aa, Staphylococcus epidermidis
PGNNP

SEQ ID NO: 1786628 - protein, 6 aa, Staphylococcus epidermidis
PGPASR

SEQ ID NO: 1786629 - protein, 7 aa, Staphylococcus epidermidis
PGPIDTP

SEQ ID NO: 1786630 - protein, 16 aa, Staphylococcus epidermidis
PGPLGQIGKEGAAVGI

SEQ ID NO: 1786631 - protein, 13 aa, Staphylococcus epidermidis
PGSGGLPVGTGGK

SEQ ID NO: 1786632 - protein, 13 aa, Staphylococcus epidermidis
PGSISQSRSNIEE

SEQ ID NO: 1786633 - protein, 21 aa, Staphylococcus epidermidis
PGSLEEAHSVDEKIEKSELEQ

SEQ ID NO: 1786634 - protein, 21 aa, Staphylococcus epidermidis
PGSLEEAHSVDEKIKARELAQ

SEQ ID NO: 1786635 - protein, 14 aa, Staphylococcus epidermidis
PGSNKNGRRYSPFT

SEQ ID NO: 1786636 - protein, 8 aa, Staphylococcus epidermidis
PGSSIKGK

SEQ ID NO: 1786637 - protein, 17 aa, Staphylococcus epidermidis
PGTTTSKYKRNFNRETS

SEQ ID NO: 1786638 - protein, 6 aa, Staphylococcus epidermidis
PGTYEF

SEQ ID NO: 1786639 - protein, 4 aa, Staphylococcus epidermidis
PGVT

SEQ ID NO: 1786640 - protein, 10 aa, Staphylococcus epidermidis
PGYSSNDQDF

SEQ ID NO: 1786641 - protein, 8 aa, Staphylococcus epidermidis
PHDLTRND

SEQ ID NO: 1786642 - protein, 5 aa, Staphylococcus epidermidis
PHGGE

SEQ ID NO: 1786643 - protein, 12 aa, Staphylococcus epidermidis
PHGTEEAKGNVI

SEQ ID NO: 1786644 - protein, 4 aa, Staphylococcus epidermidis
PHGV

SEQ ID NO: 1786645 - protein, 11 aa, Staphylococcus epidermidis
PHKKGESGIAK

SEQ ID NO: 1786646 - protein, 5 aa, Staphylococcus epidermidis
PHKLQ

SEQ ID NO: 1786647 - protein, 5 aa, Staphylococcus epidermidis
PHKVN

SEQ ID NO: 1786648 - protein, 6 aa, Staphylococcus epidermidis
PHLEKG

SEQ ID NO: 1786649 - protein, 5 aa, Staphylococcus epidermidis
PHLSE

SEQ ID NO: 1786650 - protein, 5 aa, Staphylococcus epidermidis
PHNFP

SEQ ID NO: 1786651 - protein, 8 aa, Staphylococcus epidermidis
PHNPTGKQ

SEQ ID NO: 1786652 - protein, 8 aa, Staphylococcus epidermidis
PHPGTDAA

SEQ ID NO: 1786653 - protein, 13 aa, Staphylococcus epidermidis
PHPPKSKTEAAEK

SEQ ID NO: 1786654 - protein, 4 aa, Staphylococcus epidermidis
PHSD

SEQ ID NO: 1786655 - protein, 6 aa, Staphylococcus epidermidis
PIEDKA

SEQ ID NO: 1786656 - protein, 5 aa, Staphylococcus epidermidis
PIEET

SEQ ID NO: 1786657 - protein, 11 aa, Staphylococcus epidermidis
PIEKNLPPKLE

SEQ ID NO: 1786658 - protein, 6 aa, Staphylococcus epidermidis
PIGASG

SEQ ID NO: 1786659 - protein, 10 aa, Staphylococcus epidermidis
PIGEDTYKLG

SEQ ID NO: 1786660 - protein, 12 aa, Staphylococcus epidermidis
PIGKLPPNKRKV

SEQ ID NO: 1786661 - protein, 6 aa, Staphylococcus epidermidis
PIGNQR

SEQ ID NO: 1786662 - protein, 18 aa, Staphylococcus epidermidis
PIKQAKELSSDKKSTEKL

SEQ ID NO: 1786663 - protein, 9 aa, Staphylococcus epidermidis
PIKYDKEEI

SEQ ID NO: 1786664 - protein, 5 aa, Staphylococcus epidermidis
PINDS

SEQ ID NO: 1786665 - protein, 7 aa, Staphylococcus epidermidis
PINPSDK

SEQ ID NO: 1786666 - protein, 11 aa, Staphylococcus epidermidis
PINQKDNENSK

SEQ ID NO: 1786667 - protein, 7 aa, Staphylococcus epidermidis
PIPPYDQ

SEQ ID NO: 1786668 - protein, 8 aa, Staphylococcus epidermidis
PIPTGNGK

SEQ ID NO: 1786669 - protein, 12 aa, Staphylococcus epidermidis
PIQASTKKDELK

SEQ ID NO: 1786670 - protein, 5 aa, Staphylococcus epidermidis
PIQTV

SEQ ID NO: 1786671 - protein, 11 aa, Staphylococcus epidermidis
PIRNRRNQYKN

SEQ ID NO: 1786672 - protein, 12 aa, Staphylococcus epidermidis
PIRNRRNQYQNN

SEQ ID NO: 1786673 - protein, 5 aa, Staphylococcus epidermidis
PISDY

SEQ ID NO: 1786674 - protein, 13 aa, Staphylococcus epidermidis
PITKKSNRKPTSV

SEQ ID NO: 1786675 - protein, 7 aa, Staphylococcus epidermidis
PITPGTI

SEQ ID NO: 1786676 - protein, 20 aa, Staphylococcus epidermidis
PITQSDDPASSYQNIKESWL

SEQ ID NO: 1786677 - protein, 5 aa, Staphylococcus epidermidis
PKATR

SEQ ID NO: 1786678 - protein, 4 aa, Staphylococcus epidermidis
PKAY

SEQ ID NO: 1786679 - protein, 11 aa, Staphylococcus epidermidis
PKAYGGEGATI

SEQ ID NO: 1786680 - protein, 11 aa, Staphylococcus epidermidis
PKDDGTEPNNW

SEQ ID NO: 1786681 - protein, 7 aa, Staphylococcus epidermidis
PKDKADF

SEQ ID NO: 1786682 - protein, 9 aa, Staphylococcus epidermidis
PKDKQSVAS

SEQ ID NO: 1786683 - protein, 8 aa, Staphylococcus epidermidis
PKDKTLLK

SEQ ID NO: 1786684 - protein, 5 aa, Staphylococcus epidermidis
PKDNY

SEQ ID NO: 1786685 - protein, 4 aa, Staphylococcus epidermidis
PKDR

SEQ ID NO: 1786686 - protein, 4 aa, Staphylococcus epidermidis
PKDT

SEQ ID NO: 1786687 - protein, 9 aa, Staphylococcus epidermidis
PKDTDYRPN

SEQ ID NO: 1786688 - protein, 13 aa, Staphylococcus epidermidis
PKDTIQQSIDKAS

SEQ ID NO: 1786689 - protein, 12 aa, Staphylococcus epidermidis
PKDTKNGDYSSN

SEQ ID NO: 1786690 - protein, 9 aa, Staphylococcus epidermidis
PKDVKSQNE

SEQ ID NO: 1786691 - protein, 5 aa, Staphylococcus epidermidis
PKDVQ

SEQ ID NO: 1786692 - protein, 9 aa, Staphylococcus epidermidis
PKDVSSPRD

SEQ ID NO: 1786693 - protein, 6 aa, Staphylococcus epidermidis
PKEDGT

SEQ ID NO: 1786694 - protein, 7 aa, Staphylococcus epidermidis
PKEDGTL

SEQ ID NO: 1786695 - protein, 13 aa, Staphylococcus epidermidis
PKEDVQKIRENAK

SEQ ID NO: 1786696 - protein, 7 aa, Staphylococcus epidermidis
PKEKADF

SEQ ID NO: 1786697 - protein, 6 aa, Staphylococcus epidermidis
PKENHK

SEQ ID NO: 1786698 - protein, 9 aa, Staphylococcus epidermidis
PKEPSTVDI

SEQ ID NO: 1786699 - protein, 26 aa, Staphylococcus epidermidis
PKEQTTLEDYEEDSKVSELESKINEY

SEQ ID NO: 1786700 - protein, 8 aa, Staphylococcus epidermidis
PKESKYPF

SEQ ID NO: 1786701 - protein, 13 aa, Staphylococcus epidermidis
PKETRVGTKQMGT

SEQ ID NO: 1786702 - protein, 8 aa, Staphylococcus epidermidis
PKEVKSHS

SEQ ID NO: 1786703 - protein, 10 aa, Staphylococcus epidermidis
PKGEQQEAKQ

SEQ ID NO: 1786704 - protein, 7 aa, Staphylococcus epidermidis
PKGEYQT

SEQ ID NO: 1786705 - protein, 4 aa, Staphylococcus epidermidis
PKGN

SEQ ID NO: 1786706 - protein, 15 aa, Staphylococcus epidermidis
PKGNKAIVTQPKTTI

SEQ ID NO: 1786707 - protein, 4 aa, Staphylococcus epidermidis
PKGS

SEQ ID NO: 1786708 - protein, 6 aa, Staphylococcus epidermidis
PKHDEF

SEQ ID NO: 1786709 - protein, 6 aa, Staphylococcus epidermidis
PKHDYT

SEQ ID NO: 1786710 - protein, 6 aa, Staphylococcus epidermidis
PKIDTT

SEQ ID NO: 1786711 - protein, 4 aa, Staphylococcus epidermidis
PKIY

SEQ ID NO: 1786712 - protein, 10 aa, Staphylococcus epidermidis
PKKDEQRELG

SEQ ID NO: 1786713 - protein, 11 aa, Staphylococcus epidermidis
PKKEDQRTLGD

SEQ ID NO: 1786714 - protein, 40 aa, Staphylococcus epidermidis
PKKGENSMKIDSQQAALNSSDVKINTNQPLNLNSATEEQL

SEQ ID NO: 1786715 - protein, 7 aa, Staphylococcus epidermidis
PKKNIQK

SEQ ID NO: 1786716 - protein, 5 aa, Staphylococcus epidermidis
PKKQG

SEQ ID NO: 1786717 - protein, 15 aa, Staphylococcus epidermidis
PKKQRNLEIRYCIEL

SEQ ID NO: 1786718 - protein, 8 aa, Staphylococcus epidermidis
PKKTKEYD

SEQ ID NO: 1786719 - protein, 28 aa, Staphylococcus epidermidis
PKKTSKTDDSKEFRKSKFQNNENQNSRV

SEQ ID NO: 1786720 - protein, 7 aa, Staphylococcus epidermidis
PKLEEKY

SEQ ID NO: 1786721 - protein, 8 aa, Staphylococcus epidermidis
PKLKKQAK

SEQ ID NO: 1786722 - protein, 4 aa, Staphylococcus epidermidis
PKLS

SEQ ID NO: 1786723 - protein, 7 aa, Staphylococcus epidermidis
PKLSRHR

SEQ ID NO: 1786724 - protein, 10 aa, Staphylococcus epidermidis
PKLTPTATFE

SEQ ID NO: 1786725 - protein, 64 aa, Staphylococcus epidermidis
PKNAQQGGQRSQNNNFQDYGQGFGGQQSGQNTSYNNNNSSNSNQSDNPFANANGPIDISDDDLP

SEQ ID NO: 1786726 - protein, 8 aa, Staphylococcus epidermidis
PKNERYRK

SEQ ID NO: 1786727 - protein, 5 aa, Staphylococcus epidermidis
PKNKE

SEQ ID NO: 1786728 - protein, 23 aa, Staphylococcus epidermidis
PKNKHKSDIKSAIDETAKYPVKD

SEQ ID NO: 1786729 - protein, 6 aa, Staphylococcus epidermidis
PKNKPV

SEQ ID NO: 1786730 - protein, 8 aa, Staphylococcus epidermidis
PKNPGRMQ

SEQ ID NO: 1786731 - protein, 7 aa, Staphylococcus epidermidis
PKNPGYM

SEQ ID NO: 1786732 - protein, 7 aa, Staphylococcus epidermidis
PKNPNIE

SEQ ID NO: 1786733 - protein, 7 aa, Staphylococcus epidermidis
PKPKVNS

SEQ ID NO: 1786734 - protein, 12 aa, Staphylococcus epidermidis
PKPNPEPKSSNV

SEQ ID NO: 1786735 - protein, 4 aa, Staphylococcus epidermidis
PKPV

SEQ ID NO: 1786736 - protein, 8 aa, Staphylococcus epidermidis
PKQVSEQK

SEQ ID NO: 1786737 - protein, 5 aa, Staphylococcus epidermidis
PKRDM

SEQ ID NO: 1786738 - protein, 12 aa, Staphylococcus epidermidis
PKREGQEDKDAI

SEQ ID NO: 1786739 - protein, 8 aa, Staphylococcus epidermidis
PKRTPNIA

SEQ ID NO: 1786740 - protein, 4 aa, Staphylococcus epidermidis
PKSA

SEQ ID NO: 1786741 - protein, 5 aa, Staphylococcus epidermidis
PKSEG

SEQ ID NO: 1786742 - protein, 6 aa, Staphylococcus epidermidis
PKSEYI

SEQ ID NO: 1786743 - protein, 7 aa, Staphylococcus epidermidis
PKSKIRK

SEQ ID NO: 1786744 - protein, 5 aa, Staphylococcus epidermidis
PKSQE

SEQ ID NO: 1786745 - protein, 7 aa, Staphylococcus epidermidis
PKSWTKN

SEQ ID NO: 1786746 - protein, 6 aa, Staphylococcus epidermidis
PKTFTK

SEQ ID NO: 1786747 - protein, 5 aa, Staphylococcus epidermidis
PKTGY

SEQ ID NO: 1786748 - protein, 8 aa, Staphylococcus epidermidis
PKYDPDER

SEQ ID NO: 1786749 - protein, 9 aa, Staphylococcus epidermidis
PKYKSLNTE

SEQ ID NO: 1786750 - protein, 5 aa, Staphylococcus epidermidis
PKYNS

SEQ ID NO: 1786751 - protein, 11 aa, Staphylococcus epidermidis
PKYPEDSKGQK

SEQ ID NO: 1786752 - protein, 8 aa, Staphylococcus epidermidis
PKYSKDFE

SEQ ID NO: 1786753 - protein, 4 aa, Staphylococcus epidermidis
PKYT

SEQ ID NO: 1786754 - protein, 17 aa, Staphylococcus epidermidis
PKYVSSDQVSEEEINHE

SEQ ID NO: 1786755 - protein, 13 aa, Staphylococcus epidermidis
PLAGTTDRQAEAL

SEQ ID NO: 1786756 - protein, 13 aa, Staphylococcus epidermidis
PLAHDSKQEIGTA

SEQ ID NO: 1786757 - protein, 12 aa, Staphylococcus epidermidis
PLASTSRALEPS

SEQ ID NO: 1786758 - protein, 8 aa, Staphylococcus epidermidis
PLDKITRN

SEQ ID NO: 1786759 - protein, 4 aa, Staphylococcus epidermidis
PLDT

SEQ ID NO: 1786760 - protein, 4 aa, Staphylococcus epidermidis
PLEA

SEQ ID NO: 1786761 - protein, 9 aa, Staphylococcus epidermidis
PLETGKTYT

SEQ ID NO: 1786762 - protein, 5 aa, Staphylococcus epidermidis
PLEVD

SEQ ID NO: 1786763 - protein, 4 aa, Staphylococcus epidermidis
PLGD

SEQ ID NO: 1786764 - protein, 5 aa, Staphylococcus epidermidis
PLGED

SEQ ID NO: 1786765 - protein, 7 aa, Staphylococcus epidermidis
PLHPGAK

SEQ ID NO: 1786766 - protein, 4 aa, Staphylococcus epidermidis
PLIT

SEQ ID NO: 1786767 - protein, 7 aa, Staphylococcus epidermidis
PLKKRNT

SEQ ID NO: 1786768 - protein, 8 aa, Staphylococcus epidermidis
PLLPPPTL

SEQ ID NO: 1786769 - protein, 9 aa, Staphylococcus epidermidis
PLNKKQKSQ

SEQ ID NO: 1786770 - protein, 4 aa, Staphylococcus epidermidis
PLNR

SEQ ID NO: 1786771 - protein, 5 aa, Staphylococcus epidermidis
PLNTL

SEQ ID NO: 1786772 - protein, 9 aa, Staphylococcus epidermidis
PLPKSENNI

SEQ ID NO: 1786773 - protein, 15 aa, Staphylococcus epidermidis
PLPNGGEINVKIVDI

SEQ ID NO: 1786774 - protein, 13 aa, Staphylococcus epidermidis
PLQSEDKNAPGYV

SEQ ID NO: 1786775 - protein, 8 aa, Staphylococcus epidermidis
PLRSGEEQ

SEQ ID NO: 1786776 - protein, 8 aa, Staphylococcus epidermidis
PLSAEEQV

SEQ ID NO: 1786777 - protein, 5 aa, Staphylococcus epidermidis
PLSIK

SEQ ID NO: 1786778 - protein, 9 aa, Staphylococcus epidermidis
PLTERPGEY

SEQ ID NO: 1786779 - protein, 13 aa, Staphylococcus epidermidis
PLTERYKNAIDEV

SEQ ID NO: 1786780 - protein, 17 aa, Staphylococcus epidermidis
PLTGNDKVDESKLPVPN

SEQ ID NO: 1786781 - protein, 8 aa, Staphylococcus epidermidis
PLTPKTRG

SEQ ID NO: 1786782 - protein, 5 aa, Staphylococcus epidermidis
PLTQP

SEQ ID NO: 1786783 - protein, 11 aa, Staphylococcus epidermidis
PLTVSEKRKRI

SEQ ID NO: 1786784 - protein, 5 aa, Staphylococcus epidermidis
PMEDK

SEQ ID NO: 1786785 - protein, 15 aa, Staphylococcus epidermidis
PMNSDDETQKQTTRS

SEQ ID NO: 1786786 - protein, 19 aa, Staphylococcus epidermidis
PMPNARQTNEEVEVSPIDT

SEQ ID NO: 1786787 - protein, 10 aa, Staphylococcus epidermidis
PMSRNANTSF

SEQ ID NO: 1786788 - protein, 8 aa, Staphylococcus epidermidis
PMVPTTGR

SEQ ID NO: 1786789 - protein, 4 aa, Staphylococcus epidermidis
PNAA

SEQ ID NO: 1786790 - protein, 10 aa, Staphylococcus epidermidis
PNAKDPFWND

SEQ ID NO: 1786791 - protein, 9 aa, Staphylococcus epidermidis
PNAKFPPSL

SEQ ID NO: 1786792 - protein, 8 aa, Staphylococcus epidermidis
PNCKDSQK

SEQ ID NO: 1786793 - protein, 4 aa, Staphylococcus epidermidis
PNDE

SEQ ID NO: 1786794 - protein, 20 aa, Staphylococcus epidermidis
PNDSGLAQIGPTSRVTGRMD

SEQ ID NO: 1786795 - protein, 4 aa, Staphylococcus epidermidis
PNED

SEQ ID NO: 1786796 - protein, 18 aa, Staphylococcus epidermidis
PNEDIHKNENLKHSREEL

SEQ ID NO: 1786797 - protein, 7 aa, Staphylococcus epidermidis
PNEDSPC

SEQ ID NO: 1786798 - protein, 9 aa, Staphylococcus epidermidis
PNEKELSEL

SEQ ID NO: 1786799 - protein, 15 aa, Staphylococcus epidermidis
PNFKANPELDGTNSE

SEQ ID NO: 1786800 - protein, 5 aa, Staphylococcus epidermidis
PNGES

SEQ ID NO: 1786801 - protein, 6 aa, Staphylococcus epidermidis
PNGEVA

SEQ ID NO: 1786802 - protein, 21 aa, Staphylococcus epidermidis
PNGNEGTKKTLDDKVNHPSHY

SEQ ID NO: 1786803 - protein, 4 aa, Staphylococcus epidermidis
PNGS

SEQ ID NO: 1786804 - protein, 8 aa, Staphylococcus epidermidis
PNGTGKSQ

SEQ ID NO: 1786805 - protein, 8 aa, Staphylococcus epidermidis
PNGVSNDD

SEQ ID NO: 1786806 - protein, 7 aa, Staphylococcus epidermidis
PNHATTS

SEQ ID NO: 1786807 - protein, 11 aa, Staphylococcus epidermidis
PNHFKTNKSQI

SEQ ID NO: 1786808 - protein, 5 aa, Staphylococcus epidermidis
PNHPR

SEQ ID NO: 1786809 - protein, 20 aa, Staphylococcus epidermidis
PNIKKTDQNPKAEAHRHAND

SEQ ID NO: 1786810 - protein, 8 aa, Staphylococcus epidermidis
PNINTGNK

SEQ ID NO: 1786811 - protein, 9 aa, Staphylococcus epidermidis
PNKDELKEL

SEQ ID NO: 1786812 - protein, 7 aa, Staphylococcus epidermidis
PNKEGRF

SEQ ID NO: 1786813 - protein, 9 aa, Staphylococcus epidermidis
PNKGEKCTT

SEQ ID NO: 1786814 - protein, 9 aa, Staphylococcus epidermidis
PNKGEPLKS

SEQ ID NO: 1786815 - protein, 17 aa, Staphylococcus epidermidis
PNKLKGAPKSVRGDRRG

SEQ ID NO: 1786816 - protein, 9 aa, Staphylococcus epidermidis
PNLSERERK

SEQ ID NO: 1786817 - protein, 4 aa, Staphylococcus epidermidis
PNLT

SEQ ID NO: 1786818 - protein, 5 aa, Staphylococcus epidermidis
PNMTS

SEQ ID NO: 1786819 - protein, 7 aa, Staphylococcus epidermidis
PNNKEEL

SEQ ID NO: 1786820 - protein, 8 aa, Staphylococcus epidermidis
PNNLTTEE

SEQ ID NO: 1786821 - protein, 6 aa, Staphylococcus epidermidis
PNNPNY

SEQ ID NO: 1786822 - protein, 13 aa, Staphylococcus epidermidis
PNNPTGSTATQDV

SEQ ID NO: 1786823 - protein, 13 aa, Staphylococcus epidermidis
PNNPTGSTATQSV

SEQ ID NO: 1786824 - protein, 12 aa, Staphylococcus epidermidis
PNNPTGYTPNVE

SEQ ID NO: 1786825 - protein, 4 aa, Staphylococcus epidermidis
PNNT

SEQ ID NO: 1786826 - protein, 7 aa, Staphylococcus epidermidis
PNNTNSI

SEQ ID NO: 1786827 - protein, 14 aa, Staphylococcus epidermidis
PNPAIAEKNKVNTS

SEQ ID NO: 1786828 - protein, 29 aa, Staphylococcus epidermidis
PNPEIKPDDAKAAGAKVIGTGRSDYPNQI

SEQ ID NO: 1786829 - protein, 5 aa, Staphylococcus epidermidis
PNPSM

SEQ ID NO: 1786830 - protein, 6 aa, Staphylococcus epidermidis
PNPSNC

SEQ ID NO: 1786831 - protein, 5 aa, Staphylococcus epidermidis
PNPWT

SEQ ID NO: 1786832 - protein, 15 aa, Staphylococcus epidermidis
PNPYQPRKTFDEEKL

SEQ ID NO: 1786833 - protein, 13 aa, Staphylococcus epidermidis
PNQEFNGTNNSFE

SEQ ID NO: 1786834 - protein, 10 aa, Staphylococcus epidermidis
PNRDPRDEFE

SEQ ID NO: 1786835 - protein, 5 aa, Staphylococcus epidermidis
PNRQA

SEQ ID NO: 1786836 - protein, 10 aa, Staphylococcus epidermidis
PNRTNKQVRA

SEQ ID NO: 1786837 - protein, 8 aa, Staphylococcus epidermidis
PNRTPNIA

SEQ ID NO: 1786838 - protein, 7 aa, Staphylococcus epidermidis
PNRYSSE

SEQ ID NO: 1786839 - protein, 10 aa, Staphylococcus epidermidis
PNSPHQAGLQ

SEQ ID NO: 1786840 - protein, 13 aa, Staphylococcus epidermidis
PNSSLSAASGYAE

SEQ ID NO: 1786841 - protein, 7 aa, Staphylococcus epidermidis
PNSTYIQ

SEQ ID NO: 1786842 - protein, 12 aa, Staphylococcus epidermidis
PNTAGAKTAEEA

SEQ ID NO: 1786843 - protein, 18 aa, Staphylococcus epidermidis
PNTDFKKKEQKMHQYQIF

SEQ ID NO: 1786844 - protein, 7 aa, Staphylococcus epidermidis
PNTNHSF

SEQ ID NO: 1786845 - protein, 4 aa, Staphylococcus epidermidis
PNTV

SEQ ID NO: 1786846 - protein, 17 aa, Staphylococcus epidermidis
PNVAAKKIKSAVTDSDG

SEQ ID NO: 1786847 - protein, 6 aa, Staphylococcus epidermidis
PNVDEG

SEQ ID NO: 1786848 - protein, 7 aa, Staphylococcus epidermidis
PNVEAGQ

SEQ ID NO: 1786849 - protein, 6 aa, Staphylococcus epidermidis
PNYDGA

SEQ ID NO: 1786850 - protein, 4 aa, Staphylococcus epidermidis
PNYG

SEQ ID NO: 1786851 - protein, 8 aa, Staphylococcus epidermidis
PNYTEQQK

SEQ ID NO: 1786852 - protein, 4 aa, Staphylococcus epidermidis
PPAD

SEQ ID NO: 1786853 - protein, 5 aa, Staphylococcus epidermidis
PPCDT

SEQ ID NO: 1786854 - protein, 6 aa, Staphylococcus epidermidis
PPEEKG

SEQ ID NO: 1786855 - protein, 5 aa, Staphylococcus epidermidis
PPEHA

SEQ ID NO: 1786856 - protein, 5 aa, Staphylococcus epidermidis
PPENR

SEQ ID NO: 1786857 - protein, 11 aa, Staphylococcus epidermidis
PPFNASDWGQE

SEQ ID NO: 1786858 - protein, 9 aa, Staphylococcus epidermidis
PPFSTTKDP

SEQ ID NO: 1786859 - protein, 5 aa, Staphylococcus epidermidis
PPGAF

SEQ ID NO: 1786860 - protein, 14 aa, Staphylococcus epidermidis
PPGEHGISATDNIS

SEQ ID NO: 1786861 - protein, 5 aa, Staphylococcus epidermidis
PPGTQ

SEQ ID NO: 1786862 - protein, 8 aa, Staphylococcus epidermidis
PPGYNSEE

SEQ ID NO: 1786863 - protein, 11 aa, Staphylococcus epidermidis
PPKDVADGDVT

SEQ ID NO: 1786864 - protein, 12 aa, Staphylococcus epidermidis
PPKEVPERTEGY

SEQ ID NO: 1786865 - protein, 7 aa, Staphylococcus epidermidis
PPKGNAN

SEQ ID NO: 1786866 - protein, 11 aa, Staphylococcus epidermidis
PPKNPRENGLK

SEQ ID NO: 1786867 - protein, 6 aa, Staphylococcus epidermidis
PPKPHL

SEQ ID NO: 1786868 - protein, 16 aa, Staphylococcus epidermidis
PPLEQQQRIGKLDERR

SEQ ID NO: 1786869 - protein, 8 aa, Staphylococcus epidermidis
PPMKEQEI

SEQ ID NO: 1786870 - protein, 6 aa, Staphylococcus epidermidis
PPMPSE

SEQ ID NO: 1786871 - protein, 10 aa, Staphylococcus epidermidis
PPNDSTARTW

SEQ ID NO: 1786872 - protein, 20 aa, Staphylococcus epidermidis
PPNDTYESKLKESESLAKAE

SEQ ID NO: 1786873 - protein, 9 aa, Staphylococcus epidermidis
PPQVEQAGL

SEQ ID NO: 1786874 - protein, 39 aa, Staphylococcus epidermidis
PPTDEPSEEEVEAMEGESATEEPEVVDEDKEDDEEENKE

SEQ ID NO: 1786875 - protein, 38 aa, Staphylococcus epidermidis
PPTDEPSEEEVEAMEGESATEEPEVVGEDKESEEDNKE

SEQ ID NO: 1786876 - protein, 7 aa, Staphylococcus epidermidis
PPVNTVT

SEQ ID NO: 1786877 - protein, 7 aa, Staphylococcus epidermidis
PQARTAL

SEQ ID NO: 1786878 - protein, 4 aa, Staphylococcus epidermidis
PQDG

SEQ ID NO: 1786879 - protein, 4 aa, Staphylococcus epidermidis
PQDQ

SEQ ID NO: 1786880 - protein, 5 aa, Staphylococcus epidermidis
PQDQS

SEQ ID NO: 1786881 - protein, 5 aa, Staphylococcus epidermidis
PQDTN

SEQ ID NO: 1786882 - protein, 21 aa, Staphylococcus epidermidis
PQDTNTGGGKSNLPSSPIENE

SEQ ID NO: 1786883 - protein, 4 aa, Staphylococcus epidermidis
PQFD

SEQ ID NO: 1786884 - protein, 4 aa, Staphylococcus epidermidis
PQFS

SEQ ID NO: 1786885 - protein, 7 aa, Staphylococcus epidermidis
PQGNATQ

SEQ ID NO: 1786886 - protein, 5 aa, Staphylococcus epidermidis
PQHAR

SEQ ID NO: 1786887 - protein, 9 aa, Staphylococcus epidermidis
PQKDSASDY

SEQ ID NO: 1786888 - protein, 8 aa, Staphylococcus epidermidis
PQKNTNEI

SEQ ID NO: 1786889 - protein, 7 aa, Staphylococcus epidermidis
PQNAPKI

SEQ ID NO: 1786890 - protein, 6 aa, Staphylococcus epidermidis
PQNGVY

SEQ ID NO: 1786891 - protein, 9 aa, Staphylococcus epidermidis
PQPAPADHP

SEQ ID NO: 1786892 - protein, 20 aa, Staphylococcus epidermidis
PQPQGKTSTSPKEALENARE

SEQ ID NO: 1786893 - protein, 6 aa, Staphylococcus epidermidis
PQQQDI

SEQ ID NO: 1786894 - protein, 9 aa, Staphylococcus epidermidis
PQRKGEPVV

SEQ ID NO: 1786895 - protein, 7 aa, Staphylococcus epidermidis
PQSEGFV

SEQ ID NO: 1786896 - protein, 8 aa, Staphylococcus epidermidis
PQSEKQLS

SEQ ID NO: 1786897 - protein, 10 aa, Staphylococcus epidermidis
PQSPEVADGL

SEQ ID NO: 1786898 - protein, 10 aa, Staphylococcus epidermidis
PQSTSLKEGS

SEQ ID NO: 1786899 - protein, 8 aa, Staphylococcus epidermidis
PQTNQWTK

SEQ ID NO: 1786900 - protein, 16 aa, Staphylococcus epidermidis
PQTSVEDDIEEDPRED

SEQ ID NO: 1786901 - protein, 7 aa, Staphylococcus epidermidis
PQYDVSK

SEQ ID NO: 1786902 - protein, 4 aa, Staphylococcus epidermidis
PRAI

SEQ ID NO: 1786903 - protein, 6 aa, Staphylococcus epidermidis
PRAKEV

SEQ ID NO: 1786904 - protein, 4 aa, Staphylococcus epidermidis
PRER

SEQ ID NO: 1786905 - protein, 6 aa, Staphylococcus epidermidis
PREYGG

SEQ ID NO: 1786906 - protein, 6 aa, Staphylococcus epidermidis
PREYSG

SEQ ID NO: 1786907 - protein, 11 aa, Staphylococcus epidermidis
PRFTKGGQIQS

SEQ ID NO: 1786908 - protein, 8 aa, Staphylococcus epidermidis
PRGGSDIT

SEQ ID NO: 1786909 - protein, 4 aa, Staphylococcus epidermidis
PRGL

SEQ ID NO: 1786910 - protein, 6 aa, Staphylococcus epidermidis
PRIEGG

SEQ ID NO: 1786911 - protein, 21 aa, Staphylococcus epidermidis
PRIGTPAARMDDQIDEGIKNE

SEQ ID NO: 1786912 - protein, 9 aa, Staphylococcus epidermidis
PRIPTEAEI

SEQ ID NO: 1786913 - protein, 23 aa, Staphylococcus epidermidis
PRKNGLEDLKKAKKSIDFAINCW

SEQ ID NO: 1786914 - protein, 5 aa, Staphylococcus epidermidis
PRKPY

SEQ ID NO: 1786915 - protein, 12 aa, Staphylococcus epidermidis
PRKTYNKQGEPY

SEQ ID NO: 1786916 - protein, 10 aa, Staphylococcus epidermidis
PRMEGANDEI

SEQ ID NO: 1786917 - protein, 5 aa, Staphylococcus epidermidis
PRNNM

SEQ ID NO: 1786918 - protein, 8 aa, Staphylococcus epidermidis
PRPDTGLS

SEQ ID NO: 1786919 - protein, 6 aa, Staphylococcus epidermidis
PRPETE

SEQ ID NO: 1786920 - protein, 21 aa, Staphylococcus epidermidis
PRPTSKEVEKTLDDKVNHPTH

SEQ ID NO: 1786921 - protein, 8 aa, Staphylococcus epidermidis
PRTPNNQD

SEQ ID NO: 1786922 - protein, 11 aa, Staphylococcus epidermidis
PRVNKKQEFNE

SEQ ID NO: 1786923 - protein, 9 aa, Staphylococcus epidermidis
PSAGLTGEK

SEQ ID NO: 1786924 - protein, 20 aa, Staphylococcus epidermidis
PSCKTKKNIQRKTNARCPNC

SEQ ID NO: 1786925 - protein, 10 aa, Staphylococcus epidermidis
PSDIRAAGGV

SEQ ID NO: 1786926 - protein, 18 aa, Staphylococcus epidermidis
PSDKKRMMDSKKEHSVNV

SEQ ID NO: 1786927 - protein, 11 aa, Staphylococcus epidermidis
PSDTFERDGDD

SEQ ID NO: 1786928 - protein, 8 aa, Staphylococcus epidermidis
PSEDADEN

SEQ ID NO: 1786929 - protein, 8 aa, Staphylococcus epidermidis
PSEDSYRT

SEQ ID NO: 1786930 - protein, 10 aa, Staphylococcus epidermidis
PSEEDDAQEV

SEQ ID NO: 1786931 - protein, 16 aa, Staphylococcus epidermidis
PSENATGIKASTESGQ

SEQ ID NO: 1786932 - protein, 7 aa, Staphylococcus epidermidis
PSEREAQ

SEQ ID NO: 1786933 - protein, 9 aa, Staphylococcus epidermidis
PSETPSENL

SEQ ID NO: 1786934 - protein, 20 aa, Staphylococcus epidermidis
PSETVEKYRGKGTEKPKTIE

SEQ ID NO: 1786935 - protein, 17 aa, Staphylococcus epidermidis
PSFSDDKTLKLENSRHP

SEQ ID NO: 1786936 - protein, 7 aa, Staphylococcus epidermidis
PSFSKND

SEQ ID NO: 1786937 - protein, 15 aa, Staphylococcus epidermidis
PSGCGKTTIFKTHSR

SEQ ID NO: 1786938 - protein, 7 aa, Staphylococcus epidermidis
PSGDMSE

SEQ ID NO: 1786939 - protein, 14 aa, Staphylococcus epidermidis
PSGDVTPSREDITT

SEQ ID NO: 1786940 - protein, 5 aa, Staphylococcus epidermidis
PSGIR

SEQ ID NO: 1786941 - protein, 11 aa, Staphylococcus epidermidis
PSGKSIKGMGI

SEQ ID NO: 1786942 - protein, 10 aa, Staphylococcus epidermidis
PSGSDMTDEQ

SEQ ID NO: 1786943 - protein, 10 aa, Staphylococcus epidermidis
PSGTQTGKQF

SEQ ID NO: 1786944 - protein, 8 aa, Staphylococcus epidermidis
PSGVAKNL

SEQ ID NO: 1786945 - protein, 9 aa, Staphylococcus epidermidis
PSGVGKTEM

SEQ ID NO: 1786946 - protein, 11 aa, Staphylococcus epidermidis
PSHDNLPTSIR

SEQ ID NO: 1786947 - protein, 12 aa, Staphylococcus epidermidis
PSHYDATSALDS

SEQ ID NO: 1786948 - protein, 4 aa, Staphylococcus epidermidis
PSID

SEQ ID NO: 1786949 - protein, 6 aa, Staphylococcus epidermidis
PSKAYE

SEQ ID NO: 1786950 - protein, 13 aa, Staphylococcus epidermidis
PSKGVASFNQEGH

SEQ ID NO: 1786951 - protein, 10 aa, Staphylococcus epidermidis
PSKKHTETAE

SEQ ID NO: 1786952 - protein, 14 aa, Staphylococcus epidermidis
PSKQIKDEKIKKEI

SEQ ID NO: 1786953 - protein, 5 aa, Staphylococcus epidermidis
PSKQR

SEQ ID NO: 1786954 - protein, 5 aa, Staphylococcus epidermidis
PSLCT

SEQ ID NO: 1786955 - protein, 13 aa, Staphylococcus epidermidis
PSLPKKKQQQIAE

SEQ ID NO: 1786956 - protein, 5 aa, Staphylococcus epidermidis
PSLST

SEQ ID NO: 1786957 - protein, 12 aa, Staphylococcus epidermidis
PSLTATIKKWKQ

SEQ ID NO: 1786958 - protein, 5 aa, Staphylococcus epidermidis
PSNIA

SEQ ID NO: 1786959 - protein, 10 aa, Staphylococcus epidermidis
PSNNSEQQKI

SEQ ID NO: 1786960 - protein, 8 aa, Staphylococcus epidermidis
PSPGHYTG

SEQ ID NO: 1786961 - protein, 5 aa, Staphylococcus epidermidis
PSPMT

SEQ ID NO: 1786962 - protein, 6 aa, Staphylococcus epidermidis
PSPQFS

SEQ ID NO: 1786963 - protein, 7 aa, Staphylococcus epidermidis
PSQLSYQ

SEQ ID NO: 1786964 - protein, 5 aa, Staphylococcus epidermidis
PSQYN

SEQ ID NO: 1786965 - protein, 19 aa, Staphylococcus epidermidis
PSRGKSSQLDRDSHTLDDY

SEQ ID NO: 1786966 - protein, 7 aa, Staphylococcus epidermidis
PSRSIDD

SEQ ID NO: 1786967 - protein, 10 aa, Staphylococcus epidermidis
PSSDEDIQNV

SEQ ID NO: 1786968 - protein, 9 aa, Staphylococcus epidermidis
PSSDYATTV

SEQ ID NO: 1786969 - protein, 8 aa, Staphylococcus epidermidis
PSSESDKI

SEQ ID NO: 1786970 - protein, 9 aa, Staphylococcus epidermidis
PSSGETDID

SEQ ID NO: 1786971 - protein, 15 aa, Staphylococcus epidermidis
PSSHDPVASDRDSPL

SEQ ID NO: 1786972 - protein, 6 aa, Staphylococcus epidermidis
PSSHIA

SEQ ID NO: 1786973 - protein, 8 aa, Staphylococcus epidermidis
PSSRGLST

SEQ ID NO: 1786974 - protein, 10 aa, Staphylococcus epidermidis
PSSRLGEKQG

SEQ ID NO: 1786975 - protein, 10 aa, Staphylococcus epidermidis
PSSSKGKLTG

SEQ ID NO: 1786976 - protein, 8 aa, Staphylococcus epidermidis
PSSTNKNQ

SEQ ID NO: 1786977 - protein, 6 aa, Staphylococcus epidermidis
PSTENV

SEQ ID NO: 1786978 - protein, 7 aa, Staphylococcus epidermidis
PSVGLSE

SEQ ID NO: 1786979 - protein, 18 aa, Staphylococcus epidermidis
PSVHQTKESQPLITRSGS

SEQ ID NO: 1786980 - protein, 18 aa, Staphylococcus epidermidis
PSVHQTKNSQPLITRSGS

SEQ ID NO: 1786981 - protein, 9 aa, Staphylococcus epidermidis
PSVSEKEVS

SEQ ID NO: 1786982 - protein, 5 aa, Staphylococcus epidermidis
PSVVA

SEQ ID NO: 1786983 - protein, 5 aa, Staphylococcus epidermidis
PSWEN

SEQ ID NO: 1786984 - protein, 4 aa, Staphylococcus epidermidis
PSYP

SEQ ID NO: 1786985 - protein, 6 aa, Staphylococcus epidermidis
PSYPPI

SEQ ID NO: 1786986 - protein, 12 aa, Staphylococcus epidermidis
PSYVKKNEALDS

SEQ ID NO: 1786987 - protein, 18 aa, Staphylococcus epidermidis
PTAAGQGRNLQELKDTEG

SEQ ID NO: 1786988 - protein, 4 aa, Staphylococcus epidermidis
PTAE

SEQ ID NO: 1786989 - protein, 12 aa, Staphylococcus epidermidis
PTAGLDPQSKEQ

SEQ ID NO: 1786990 - protein, 10 aa, Staphylococcus epidermidis
PTASGKTELS

SEQ ID NO: 1786991 - protein, 14 aa, Staphylococcus epidermidis
PTCTQEDVNAAQAL

SEQ ID NO: 1786992 - protein, 12 aa, Staphylococcus epidermidis
PTDGAFEYNKQN

SEQ ID NO: 1786993 - protein, 7 aa, Staphylococcus epidermidis
PTDKSYQ

SEQ ID NO: 1786994 - protein, 6 aa, Staphylococcus epidermidis
PTDKTE

SEQ ID NO: 1786995 - protein, 6 aa, Staphylococcus epidermidis
PTDTLT

SEQ ID NO: 1786996 - protein, 4 aa, Staphylococcus epidermidis
PTEI

SEQ ID NO: 1786997 - protein, 6 aa, Staphylococcus epidermidis
PTEIKN

SEQ ID NO: 1786998 - protein, 6 aa, Staphylococcus epidermidis
PTEKEL

SEQ ID NO: 1786999 - protein, 13 aa, Staphylococcus epidermidis
PTELQKKDGYVST

SEQ ID NO: 1787000 - protein, 10 aa, Staphylococcus epidermidis
PTENYGGTGK

SEQ ID NO: 1787001 - protein, 5 aa, Staphylococcus epidermidis
PTEPN

SEQ ID NO: 1787002 - protein, 10 aa, Staphylococcus epidermidis
PTETESKETL

SEQ ID NO: 1787003 - protein, 11 aa, Staphylococcus epidermidis
PTETYQSRANY

SEQ ID NO: 1787004 - protein, 4 aa, Staphylococcus epidermidis
PTEY

SEQ ID NO: 1787005 - protein, 4 aa, Staphylococcus epidermidis
PTGK

SEQ ID NO: 1787006 - protein, 20 aa, Staphylococcus epidermidis
PTGNGDVIDGAREQWNDGSN

SEQ ID NO: 1787007 - protein, 4 aa, Staphylococcus epidermidis
PTHE

SEQ ID NO: 1787008 - protein, 10 aa, Staphylococcus epidermidis
PTHPNNPYKG

SEQ ID NO: 1787009 - protein, 5 aa, Staphylococcus epidermidis
PTHSS

SEQ ID NO: 1787010 - protein, 5 aa, Staphylococcus epidermidis
PTIDP

SEQ ID NO: 1787011 - protein, 4 aa, Staphylococcus epidermidis
PTIP

SEQ ID NO: 1787012 - protein, 12 aa, Staphylococcus epidermidis
PTIQDTENKDEH

SEQ ID NO: 1787013 - protein, 10 aa, Staphylococcus epidermidis
PTKEALSSKR

SEQ ID NO: 1787014 - protein, 7 aa, Staphylococcus epidermidis
PTKEVDT

SEQ ID NO: 1787015 - protein, 5 aa, Staphylococcus epidermidis
PTKGK

SEQ ID NO: 1787016 - protein, 13 aa, Staphylococcus epidermidis
PTKHSAKITHATA

SEQ ID NO: 1787017 - protein, 9 aa, Staphylococcus epidermidis
PTKKAPTLK

SEQ ID NO: 1787018 - protein, 14 aa, Staphylococcus epidermidis
PTKLKNPPSNWPRT

SEQ ID NO: 1787019 - protein, 10 aa, Staphylococcus epidermidis
PTKMNDRQKE

SEQ ID NO: 1787020 - protein, 14 aa, Staphylococcus epidermidis
PTKNSAKLTQATAR

SEQ ID NO: 1787021 - protein, 14 aa, Staphylococcus epidermidis
PTKPISNDKLKKEI

SEQ ID NO: 1787022 - protein, 15 aa, Staphylococcus epidermidis
PTLSNDPAKSWTTND

SEQ ID NO: 1787023 - protein, 25 aa, Staphylococcus epidermidis
PTLSTGTYSGASVATDSNGGVSSPT

SEQ ID NO: 1787024 - protein, 6 aa, Staphylococcus epidermidis
PTMNEK

SEQ ID NO: 1787025 - protein, 5 aa, Staphylococcus epidermidis
PTNAR

SEQ ID NO: 1787026 - protein, 4 aa, Staphylococcus epidermidis
PTND

SEQ ID NO: 1787027 - protein, 13 aa, Staphylococcus epidermidis
PTNDSVETIPKTE

SEQ ID NO: 1787028 - protein, 7 aa, Staphylococcus epidermidis
PTNQTSL

SEQ ID NO: 1787029 - protein, 22 aa, Staphylococcus epidermidis
PTPKEVKEFENESDRGAYGSTG

SEQ ID NO: 1787030 - protein, 7 aa, Staphylococcus epidermidis
PTPKPAV

SEQ ID NO: 1787031 - protein, 6 aa, Staphylococcus epidermidis
PTPTEP

SEQ ID NO: 1787032 - protein, 5 aa, Staphylococcus epidermidis
PTPTF

SEQ ID NO: 1787033 - protein, 5 aa, Staphylococcus epidermidis
PTQET

SEQ ID NO: 1787034 - protein, 11 aa, Staphylococcus epidermidis
PTQTVSSPEQT

SEQ ID NO: 1787035 - protein, 11 aa, Staphylococcus epidermidis
PTRGKEKQKYR

SEQ ID NO: 1787036 - protein, 9 aa, Staphylococcus epidermidis
PTRKITEEI

SEQ ID NO: 1787037 - protein, 9 aa, Staphylococcus epidermidis
PTRNEFETD

SEQ ID NO: 1787038 - protein, 14 aa, Staphylococcus epidermidis
PTSALDPEVVGDVL

SEQ ID NO: 1787039 - protein, 9 aa, Staphylococcus epidermidis
PTSALDQEN

SEQ ID NO: 1787040 - protein, 5 aa, Staphylococcus epidermidis
PTSGL

SEQ ID NO: 1787041 - protein, 7 aa, Staphylococcus epidermidis
PTSGMDI

SEQ ID NO: 1787042 - protein, 6 aa, Staphylococcus epidermidis
PTSGNH

SEQ ID NO: 1787043 - protein, 12 aa, Staphylococcus epidermidis
PTSQQLARFKGG

SEQ ID NO: 1787044 - protein, 7 aa, Staphylococcus epidermidis
PTSQTIQ

SEQ ID NO: 1787045 - protein, 8 aa, Staphylococcus epidermidis
PTSQTIQT

SEQ ID NO: 1787046 - protein, 9 aa, Staphylococcus epidermidis
PTSRTDRGV

SEQ ID NO: 1787047 - protein, 10 aa, Staphylococcus epidermidis
PTSSIDETIP

SEQ ID NO: 1787048 - protein, 8 aa, Staphylococcus epidermidis
PTSTEGTM

SEQ ID NO: 1787049 - protein, 6 aa, Staphylococcus epidermidis
PTSYTK

SEQ ID NO: 1787050 - protein, 7 aa, Staphylococcus epidermidis
PTTESEF

SEQ ID NO: 1787051 - protein, 4 aa, Staphylococcus epidermidis
PTTI

SEQ ID NO: 1787052 - protein, 4 aa, Staphylococcus epidermidis
PTTY

SEQ ID NO: 1787053 - protein, 17 aa, Staphylococcus epidermidis
PTTYPPLSYSFDHLIIN

SEQ ID NO: 1787054 - protein, 4 aa, Staphylococcus epidermidis
PTVG

SEQ ID NO: 1787055 - protein, 12 aa, Staphylococcus epidermidis
PTVSKREKEENI

SEQ ID NO: 1787056 - protein, 10 aa, Staphylococcus epidermidis
PVAENLSKQL

SEQ ID NO: 1787057 - protein, 8 aa, Staphylococcus epidermidis
PVDNHDEP

SEQ ID NO: 1787058 - protein, 10 aa, Staphylococcus epidermidis
PVESNERHEH

SEQ ID NO: 1787059 - protein, 10 aa, Staphylococcus epidermidis
PVGASGSKGI

SEQ ID NO: 1787060 - protein, 6 aa, Staphylococcus epidermidis
PVGHKG

SEQ ID NO: 1787061 - protein, 8 aa, Staphylococcus epidermidis
PVGTTLDE

SEQ ID NO: 1787062 - protein, 4 aa, Staphylococcus epidermidis
PVHS

SEQ ID NO: 1787063 - protein, 5 aa, Staphylococcus epidermidis
PVKPE

SEQ ID NO: 1787064 - protein, 4 aa, Staphylococcus epidermidis
PVKQ

SEQ ID NO: 1787065 - protein, 15 aa, Staphylococcus epidermidis
PVNPGNSGGAVVDRD

SEQ ID NO: 1787066 - protein, 10 aa, Staphylococcus epidermidis
PVNPPERKHV

SEQ ID NO: 1787067 - protein, 5 aa, Staphylococcus epidermidis
PVPER

SEQ ID NO: 1787068 - protein, 8 aa, Staphylococcus epidermidis
PVPPYDTG

SEQ ID NO: 1787069 - protein, 11 aa, Staphylococcus epidermidis
PVPTSAKKFDD

SEQ ID NO: 1787070 - protein, 16 aa, Staphylococcus epidermidis
PVSEALETETELGGAT

SEQ ID NO: 1787071 - protein, 11 aa, Staphylococcus epidermidis
PVSKGGSNDIS

SEQ ID NO: 1787072 - protein, 7 aa, Staphylococcus epidermidis
PVTDDEW

SEQ ID NO: 1787073 - protein, 4 aa, Staphylococcus epidermidis
PVTV

SEQ ID NO: 1787074 - protein, 7 aa, Staphylococcus epidermidis
PVYTTSS

SEQ ID NO: 1787075 - protein, 19 aa, Staphylococcus epidermidis
PWGGYKQSGIGRELGKEGL

SEQ ID NO: 1787076 - protein, 20 aa, Staphylococcus epidermidis
PWGGYKQSGVGRELGKEGLE

SEQ ID NO: 1787077 - protein, 9 aa, Staphylococcus epidermidis
PWSEREAKD

SEQ ID NO: 1787078 - protein, 10 aa, Staphylococcus epidermidis
PYAGDKGGQL

SEQ ID NO: 1787079 - protein, 8 aa, Staphylococcus epidermidis
PYAPSAQL

SEQ ID NO: 1787080 - protein, 6 aa, Staphylococcus epidermidis
PYDHQG

SEQ ID NO: 1787081 - protein, 8 aa, Staphylococcus epidermidis
PYDNPGRY

SEQ ID NO: 1787082 - protein, 9 aa, Staphylococcus epidermidis
PYDQAENPV

SEQ ID NO: 1787083 - protein, 6 aa, Staphylococcus epidermidis
PYEDES

SEQ ID NO: 1787084 - protein, 5 aa, Staphylococcus epidermidis
PYEGG

SEQ ID NO: 1787085 - protein, 4 aa, Staphylococcus epidermidis
PYGR

SEQ ID NO: 1787086 - protein, 5 aa, Staphylococcus epidermidis
PYGTD

SEQ ID NO: 1787087 - protein, 39 aa, Staphylococcus epidermidis
PYHAETKKPSKSSNTPSKPSNDNTPKNKKEQTKPITKEV

SEQ ID NO: 1787088 - protein, 5 aa, Staphylococcus epidermidis
PYKKG

SEQ ID NO: 1787089 - protein, 4 aa, Staphylococcus epidermidis
PYLE

SEQ ID NO: 1787090 - protein, 5 aa, Staphylococcus epidermidis
PYLSE

SEQ ID NO: 1787091 - protein, 9 aa, Staphylococcus epidermidis
PYPGGPQID

SEQ ID NO: 1787092 - protein, 45 aa, Staphylococcus epidermidis
PYPSNHGEGYPQKSGDPIHKKTEENNTRINNTRINRDSDETSKSF

SEQ ID NO: 1787093 - protein, 17 aa, Staphylococcus epidermidis
PYQEDTLKPSKQSVSEL

SEQ ID NO: 1787094 - protein, 12 aa, Staphylococcus epidermidis
PYQRDTQSTFIY

SEQ ID NO: 1787095 - protein, 13 aa, Staphylococcus epidermidis
PYSEVAKDAGLDV

SEQ ID NO: 1787096 - protein, 13 aa, Staphylococcus epidermidis
PYSPNGARETVNI

SEQ ID NO: 1787097 - protein, 15 aa, Staphylococcus epidermidis
PYTNYGRPNSKYEKM

SEQ ID NO: 1787098 - protein, 21 aa, Staphylococcus epidermidis
PYTSTGKLQRNKVTNEGIKYE

SEQ ID NO: 1787099 - protein, 5 aa, Staphylococcus epidermidis
PYVEP

SEQ ID NO: 1787100 - protein, 15 aa, Staphylococcus epidermidis
PYVGEDKKNKKPPYK

SEQ ID NO: 1787101 - protein, 7 aa, Staphylococcus epidermidis
QAAEEAA

SEQ ID NO: 1787102 - protein, 14 aa, Staphylococcus epidermidis
QAAEEATQYLYREG

SEQ ID NO: 1787103 - protein, 20 aa, Staphylococcus epidermidis
QAAQVQGKFSRQSGGRGQYG

SEQ ID NO: 1787104 - protein, 12 aa, Staphylococcus epidermidis
QAASDVGQSSFD

SEQ ID NO: 1787105 - protein, 6 aa, Staphylococcus epidermidis
QADKEI

SEQ ID NO: 1787106 - protein, 8 aa, Staphylococcus epidermidis
QADKQSDV

SEQ ID NO: 1787107 - protein, 13 aa, Staphylococcus epidermidis
QADQAEMSLSLST

SEQ ID NO: 1787108 - protein, 7 aa, Staphylococcus epidermidis
QADSVED

SEQ ID NO: 1787109 - protein, 10 aa, Staphylococcus epidermidis
QAEDQSTVTV

SEQ ID NO: 1787110 - protein, 4 aa, Staphylococcus epidermidis
QAEE

SEQ ID NO: 1787111 - protein, 8 aa, Staphylococcus epidermidis
QAEEKMER

SEQ ID NO: 1787112 - protein, 11 aa, Staphylococcus epidermidis
QAEGQSPLDSL

SEQ ID NO: 1787113 - protein, 4 aa, Staphylococcus epidermidis
QAEN

SEQ ID NO: 1787114 - protein, 16 aa, Staphylococcus epidermidis
QAESDSVSGKTNDTHN

SEQ ID NO: 1787115 - protein, 22 aa, Staphylococcus epidermidis
QAESELKKLNSDYKTAQTRIKG

SEQ ID NO: 1787116 - protein, 8 aa, Staphylococcus epidermidis
QAESLDEA

SEQ ID NO: 1787117 - protein, 7 aa, Staphylococcus epidermidis
QAETSGE

SEQ ID NO: 1787118 - protein, 6 aa, Staphylococcus epidermidis
QAGGRF

SEQ ID NO: 1787119 - protein, 8 aa, Staphylococcus epidermidis
QAGGTSEK

SEQ ID NO: 1787120 - protein, 20 aa, Staphylococcus epidermidis
QAGQGIEEAFEGEASEAAIK

SEQ ID NO: 1787121 - protein, 7 aa, Staphylococcus epidermidis
QAGSEVS

SEQ ID NO: 1787122 - protein, 8 aa, Staphylococcus epidermidis
QAGSSCEV

SEQ ID NO: 1787123 - protein, 20 aa, Staphylococcus epidermidis
QAIDDTKQALNGEQRLTEAK

SEQ ID NO: 1787124 - protein, 5 aa, Staphylococcus epidermidis
QAIED

SEQ ID NO: 1787125 - protein, 6 aa, Staphylococcus epidermidis
QAIEQS

SEQ ID NO: 1787126 - protein, 6 aa, Staphylococcus epidermidis
QAISEA

SEQ ID NO: 1787127 - protein, 15 aa, Staphylococcus epidermidis
QAITGRDSQIKGTEL

SEQ ID NO: 1787128 - protein, 7 aa, Staphylococcus epidermidis
QAKDQME

SEQ ID NO: 1787129 - protein, 5 aa, Staphylococcus epidermidis
QAKEY

SEQ ID NO: 1787130 - protein, 8 aa, Staphylococcus epidermidis
QAKNNLNG

SEQ ID NO: 1787131 - protein, 8 aa, Staphylococcus epidermidis
QAKQVKPE

SEQ ID NO: 1787132 - protein, 6 aa, Staphylococcus epidermidis
QALEDS

SEQ ID NO: 1787133 - protein, 6 aa, Staphylococcus epidermidis
QALQNA

SEQ ID NO: 1787134 - protein, 15 aa, Staphylococcus epidermidis
QALTDNAKNPKKIQN

SEQ ID NO: 1787135 - protein, 6 aa, Staphylococcus epidermidis
QALVGN

SEQ ID NO: 1787136 - protein, 11 aa, Staphylococcus epidermidis
QANDNGSSLSQ

SEQ ID NO: 1787137 - protein, 11 aa, Staphylococcus epidermidis
QANEDEKMTTL

SEQ ID NO: 1787138 - protein, 10 aa, Staphylococcus epidermidis
QANQNGASLT

SEQ ID NO: 1787139 - protein, 5 aa, Staphylococcus epidermidis
QAPGL

SEQ ID NO: 1787140 - protein, 14 aa, Staphylococcus epidermidis
QAPKEYVDEAQQRD

SEQ ID NO: 1787141 - protein, 9 aa, Staphylococcus epidermidis
QAPKSKKIT

SEQ ID NO: 1787142 - protein, 8 aa, Staphylococcus epidermidis
QAPTKSQV

SEQ ID NO: 1787143 - protein, 7 aa, Staphylococcus epidermidis
QAQAARK

SEQ ID NO: 1787144 - protein, 7 aa, Staphylococcus epidermidis
QAQEIGQ

SEQ ID NO: 1787145 - protein, 6 aa, Staphylococcus epidermidis
QAQKEA

SEQ ID NO: 1787146 - protein, 6 aa, Staphylococcus epidermidis
QAQKTI

SEQ ID NO: 1787147 - protein, 10 aa, Staphylococcus epidermidis
QAQNEKLSTV

SEQ ID NO: 1787148 - protein, 9 aa, Staphylococcus epidermidis
QAQQEAFNT

SEQ ID NO: 1787149 - protein, 5 aa, Staphylococcus epidermidis
QAQTS

SEQ ID NO: 1787150 - protein, 9 aa, Staphylococcus epidermidis
QAREEAKQI

SEQ ID NO: 1787151 - protein, 23 aa, Staphylococcus epidermidis
QAREEEKSNLTSQKIDSKTNKYG

SEQ ID NO: 1787152 - protein, 20 aa, Staphylococcus epidermidis
QARNEIENAGYEQLTTADEV

SEQ ID NO: 1787153 - protein, 9 aa, Staphylococcus epidermidis
QARNRDEAA

SEQ ID NO: 1787154 - protein, 10 aa, Staphylococcus epidermidis
QARNRDEASQ

SEQ ID NO: 1787155 - protein, 5 aa, Staphylococcus epidermidis
QARNY

SEQ ID NO: 1787156 - protein, 8 aa, Staphylococcus epidermidis
QARYDKLK

SEQ ID NO: 1787157 - protein, 9 aa, Staphylococcus epidermidis
QASEQGASV

SEQ ID NO: 1787158 - protein, 20 aa, Staphylococcus epidermidis
QASGSGETITVTNPANGEDL

SEQ ID NO: 1787159 - protein, 5 aa, Staphylococcus epidermidis
QASIQ

SEQ ID NO: 1787160 - protein, 5 aa, Staphylococcus epidermidis
QASQY

SEQ ID NO: 1787161 - protein, 26 aa, Staphylococcus epidermidis
QASSLTVQRKGAQASIPTYKEVTAQY

SEQ ID NO: 1787162 - protein, 7 aa, Staphylococcus epidermidis
QASTGGA

SEQ ID NO: 1787163 - protein, 4 aa, Staphylococcus epidermidis
QASV

SEQ ID NO: 1787164 - protein, 8 aa, Staphylococcus epidermidis
QATKQAPE

SEQ ID NO: 1787165 - protein, 7 aa, Staphylococcus epidermidis
QATTVTD

SEQ ID NO: 1787166 - protein, 6 aa, Staphylococcus epidermidis
QAVEEG

SEQ ID NO: 1787167 - protein, 7 aa, Staphylococcus epidermidis
QAVGSYP

SEQ ID NO: 1787168 - protein, 11 aa, Staphylococcus epidermidis
QAVQGTEETNR

SEQ ID NO: 1787169 - protein, 7 aa, Staphylococcus epidermidis
QAYEPQF

SEQ ID NO: 1787170 - protein, 5 aa, Staphylococcus epidermidis
QCEQK

SEQ ID NO: 1787171 - protein, 12 aa, Staphylococcus epidermidis
QCGNSGNSSEPH

SEQ ID NO: 1787172 - protein, 4 aa, Staphylococcus epidermidis
QDAP

SEQ ID NO: 1787173 - protein, 11 aa, Staphylococcus epidermidis
QDARGYETFED

SEQ ID NO: 1787174 - protein, 9 aa, Staphylococcus epidermidis
QDATGNARD

SEQ ID NO: 1787175 - protein, 7 aa, Staphylococcus epidermidis
QDDAKRK

SEQ ID NO: 1787176 - protein, 10 aa, Staphylococcus epidermidis
QDDDNYFEQP

SEQ ID NO: 1787177 - protein, 8 aa, Staphylococcus epidermidis
QDDEKEVY

SEQ ID NO: 1787178 - protein, 6 aa, Staphylococcus epidermidis
QDDIDT

SEQ ID NO: 1787179 - protein, 12 aa, Staphylococcus epidermidis
QDDIKNGKGEIA

SEQ ID NO: 1787180 - protein, 8 aa, Staphylococcus epidermidis
QDDKNGFE

SEQ ID NO: 1787181 - protein, 6 aa, Staphylococcus epidermidis
QDDNAD

SEQ ID NO: 1787182 - protein, 34 aa, Staphylococcus epidermidis
QDDYRTPKTVKSVGESIQNFSESKSIDDDAFTHS

SEQ ID NO: 1787183 - protein, 7 aa, Staphylococcus epidermidis
QDEEIAK

SEQ ID NO: 1787184 - protein, 13 aa, Staphylococcus epidermidis
QDEGIRPGTTAEK

SEQ ID NO: 1787185 - protein, 4 aa, Staphylococcus epidermidis
QDEI

SEQ ID NO: 1787186 - protein, 10 aa, Staphylococcus epidermidis
QDEKESRFAN

SEQ ID NO: 1787187 - protein, 5 aa, Staphylococcus epidermidis
QDELE

SEQ ID NO: 1787188 - protein, 5 aa, Staphylococcus epidermidis
QDENL

SEQ ID NO: 1787189 - protein, 16 aa, Staphylococcus epidermidis
QDEQLESYQRLQNALK

SEQ ID NO: 1787190 - protein, 5 aa, Staphylococcus epidermidis
QDESL

SEQ ID NO: 1787191 - protein, 10 aa, Staphylococcus epidermidis
QDETGEDSDR

SEQ ID NO: 1787192 - protein, 28 aa, Staphylococcus epidermidis
QDGEIVGSDKRGTGKTPFRGIDKGSDIK

SEQ ID NO: 1787193 - protein, 15 aa, Staphylococcus epidermidis
QDGEQIGVKPKREAL

SEQ ID NO: 1787194 - protein, 5 aa, Staphylococcus epidermidis
QDGKN

SEQ ID NO: 1787195 - protein, 10 aa, Staphylococcus epidermidis
QDGNRIKQGD

SEQ ID NO: 1787196 - protein, 8 aa, Staphylococcus epidermidis
QDHASELN

SEQ ID NO: 1787197 - protein, 9 aa, Staphylococcus epidermidis
QDHKAIKDD

SEQ ID NO: 1787198 - protein, 5 aa, Staphylococcus epidermidis
QDHTG

SEQ ID NO: 1787199 - protein, 7 aa, Staphylococcus epidermidis
QDIDGNE

SEQ ID NO: 1787200 - protein, 5 aa, Staphylococcus epidermidis
QDINR

SEQ ID NO: 1787201 - protein, 12 aa, Staphylococcus epidermidis
QDISSVNNNKLE

SEQ ID NO: 1787202 - protein, 12 aa, Staphylococcus epidermidis
QDKDNKDVTRND

SEQ ID NO: 1787203 - protein, 16 aa, Staphylococcus epidermidis
QDKGDRSLTLRPEGTA

SEQ ID NO: 1787204 - protein, 23 aa, Staphylococcus epidermidis
QDKGYTHSSTTEIEHKDGSTSVR

SEQ ID NO: 1787205 - protein, 4 aa, Staphylococcus epidermidis
QDKI

SEQ ID NO: 1787206 - protein, 13 aa, Staphylococcus epidermidis
QDKNNNKSPLRPE

SEQ ID NO: 1787207 - protein, 10 aa, Staphylococcus epidermidis
QDKQAEAPHY

SEQ ID NO: 1787208 - protein, 9 aa, Staphylococcus epidermidis
QDKTSNDAK

SEQ ID NO: 1787209 - protein, 17 aa, Staphylococcus epidermidis
QDLGSREGIAKAKSEIT

SEQ ID NO: 1787210 - protein, 5 aa, Staphylococcus epidermidis
QDLNG

SEQ ID NO: 1787211 - protein, 7 aa, Staphylococcus epidermidis
QDLNRKR

SEQ ID NO: 1787212 - protein, 7 aa, Staphylococcus epidermidis
QDLPQDD

SEQ ID NO: 1787213 - protein, 6 aa, Staphylococcus epidermidis
QDNADQ

SEQ ID NO: 1787214 - protein, 10 aa, Staphylococcus epidermidis
QDNCTESVSE

SEQ ID NO: 1787215 - protein, 9 aa, Staphylococcus epidermidis
QDNHSDDEV

SEQ ID NO: 1787216 - protein, 9 aa, Staphylococcus epidermidis
QDNKNNNVI

SEQ ID NO: 1787217 - protein, 12 aa, Staphylococcus epidermidis
QDNNESKPYEET

SEQ ID NO: 1787218 - protein, 12 aa, Staphylococcus epidermidis
QDNNRKAEISKR

SEQ ID NO: 1787219 - protein, 11 aa, Staphylococcus epidermidis
QDNPELPRPVG

SEQ ID NO: 1787220 - protein, 12 aa, Staphylococcus epidermidis
QDNSTQNPTVAQ

SEQ ID NO: 1787221 - protein, 9 aa, Staphylococcus epidermidis
QDPEENKGK

SEQ ID NO: 1787222 - protein, 5 aa, Staphylococcus epidermidis
QDPQG

SEQ ID NO: 1787223 - protein, 7 aa, Staphylococcus epidermidis
QDPQQFK

SEQ ID NO: 1787224 - protein, 8 aa, Staphylococcus epidermidis
QDPRTGKP

SEQ ID NO: 1787225 - protein, 16 aa, Staphylococcus epidermidis
QDPTKKMSKSDNNQKN

SEQ ID NO: 1787226 - protein, 14 aa, Staphylococcus epidermidis
QDQDTANDKYTGLE

SEQ ID NO: 1787227 - protein, 8 aa, Staphylococcus epidermidis
QDQNHPLP

SEQ ID NO: 1787228 - protein, 9 aa, Staphylococcus epidermidis
QDQSLDGQI

SEQ ID NO: 1787229 - protein, 8 aa, Staphylococcus epidermidis
QDQSLDSQ

SEQ ID NO: 1787230 - protein, 9 aa, Staphylococcus epidermidis
QDQSLDSQI

SEQ ID NO: 1787231 - protein, 9 aa, Staphylococcus epidermidis
QDRPNMKTV

SEQ ID NO: 1787232 - protein, 8 aa, Staphylococcus epidermidis
QDRPTDEW

SEQ ID NO: 1787233 - protein, 11 aa, Staphylococcus epidermidis
QDSNGTIQETI

SEQ ID NO: 1787234 - protein, 5 aa, Staphylococcus epidermidis
QDSNQ

SEQ ID NO: 1787235 - protein, 6 aa, Staphylococcus epidermidis
QDSSIT

SEQ ID NO: 1787236 - protein, 9 aa, Staphylococcus epidermidis
QDSTHYDGT

SEQ ID NO: 1787237 - protein, 34 aa, Staphylococcus epidermidis
QDSVKDDSELQKELDELKDKNAEWQTKYQESQLN

SEQ ID NO: 1787238 - protein, 8 aa, Staphylococcus epidermidis
QDSYLRSE

SEQ ID NO: 1787239 - protein, 5 aa, Staphylococcus epidermidis
QDTLE

SEQ ID NO: 1787240 - protein, 19 aa, Staphylococcus epidermidis
QDTPGVDSNVATHQSSTEQ

SEQ ID NO: 1787241 - protein, 9 aa, Staphylococcus epidermidis
QDTPKTREL

SEQ ID NO: 1787242 - protein, 4 aa, Staphylococcus epidermidis
QDTR

SEQ ID NO: 1787243 - protein, 22 aa, Staphylococcus epidermidis
QDTSESLRITENSGISFIYTLE

SEQ ID NO: 1787244 - protein, 7 aa, Staphylococcus epidermidis
QDTSNEY

SEQ ID NO: 1787245 - protein, 9 aa, Staphylococcus epidermidis
QDTTQESRE

SEQ ID NO: 1787246 - protein, 7 aa, Staphylococcus epidermidis
QDTVANL

SEQ ID NO: 1787247 - protein, 5 aa, Staphylococcus epidermidis
QDVAE

SEQ ID NO: 1787248 - protein, 10 aa, Staphylococcus epidermidis
QDVERAEEEM

SEQ ID NO: 1787249 - protein, 4 aa, Staphylococcus epidermidis
QDVP

SEQ ID NO: 1787250 - protein, 24 aa, Staphylococcus epidermidis
QDVTADQVNEAMKQASDESFGYTE

SEQ ID NO: 1787251 - protein, 10 aa, Staphylococcus epidermidis
QDYGENKENH

SEQ ID NO: 1787252 - protein, 13 aa, Staphylococcus epidermidis
QEAESAKERNEQR

SEQ ID NO: 1787253 - protein, 12 aa, Staphylococcus epidermidis
QEAESTKERNEL

SEQ ID NO: 1787254 - protein, 10 aa, Staphylococcus epidermidis
QEAKNETGAN

SEQ ID NO: 1787255 - protein, 4 aa, Staphylococcus epidermidis
QEAL

SEQ ID NO: 1787256 - protein, 7 aa, Staphylococcus epidermidis
QEAQTGY

SEQ ID NO: 1787257 - protein, 14 aa, Staphylococcus epidermidis
QEASIEDPNNEHLK

SEQ ID NO: 1787258 - protein, 20 aa, Staphylococcus epidermidis
QEATPEEVSGAEEPDNDSDI

SEQ ID NO: 1787259 - protein, 9 aa, Staphylococcus epidermidis
QEATQRGHE

SEQ ID NO: 1787260 - protein, 6 aa, Staphylococcus epidermidis
QEDEQI

SEQ ID NO: 1787261 - protein, 10 aa, Staphylococcus epidermidis
QEDKRRRTNQ

SEQ ID NO: 1787262 - protein, 14 aa, Staphylococcus epidermidis
QEEAEDQENEEADN

SEQ ID NO: 1787263 - protein, 8 aa, Staphylococcus epidermidis
QEEIDQVE

SEQ ID NO: 1787264 - protein, 17 aa, Staphylococcus epidermidis
QEEKRDLTQDQQQAYDA

SEQ ID NO: 1787265 - protein, 11 aa, Staphylococcus epidermidis
QEELSDVRKDI

SEQ ID NO: 1787266 - protein, 6 aa, Staphylococcus epidermidis
QEENYR

SEQ ID NO: 1787267 - protein, 10 aa, Staphylococcus epidermidis
QEEVAGFNKS

SEQ ID NO: 1787268 - protein, 18 aa, Staphylococcus epidermidis
QEEVGLRGAKAAAEQINP

SEQ ID NO: 1787269 - protein, 15 aa, Staphylococcus epidermidis
QEEYDQLSEDIRNGN

SEQ ID NO: 1787270 - protein, 10 aa, Staphylococcus epidermidis
QEEYKKTDIY

SEQ ID NO: 1787271 - protein, 13 aa, Staphylococcus epidermidis
QEFDPDLKNKILN

SEQ ID NO: 1787272 - protein, 5 aa, Staphylococcus epidermidis
QEFSD

SEQ ID NO: 1787273 - protein, 7 aa, Staphylococcus epidermidis
QEGDSKV

SEQ ID NO: 1787274 - protein, 17 aa, Staphylococcus epidermidis
QEGKFKPDEKYKSGHRD

SEQ ID NO: 1787275 - protein, 9 aa, Staphylococcus epidermidis
QEGKRIGKT

SEQ ID NO: 1787276 - protein, 24 aa, Staphylococcus epidermidis
QEGLQYKEQTLSQAANSVDDVEKV

SEQ ID NO: 1787277 - protein, 9 aa, Staphylococcus epidermidis
QEGQQLGQS

SEQ ID NO: 1787278 - protein, 5 aa, Staphylococcus epidermidis
QEGTH

SEQ ID NO: 1787279 - protein, 4 aa, Staphylococcus epidermidis
QEHG

SEQ ID NO: 1787280 - protein, 10 aa, Staphylococcus epidermidis
QEHPAYNGMG

SEQ ID NO: 1787281 - protein, 4 aa, Staphylococcus epidermidis
QEIE

SEQ ID NO: 1787282 - protein, 8 aa, Staphylococcus epidermidis
QEIEDRDH

SEQ ID NO: 1787283 - protein, 5 aa, Staphylococcus epidermidis
QEKEI

SEQ ID NO: 1787284 - protein, 5 aa, Staphylococcus epidermidis
QEKGT

SEQ ID NO: 1787285 - protein, 5 aa, Staphylococcus epidermidis
QEKKP

SEQ ID NO: 1787286 - protein, 7 aa, Staphylococcus epidermidis
QEKMNRD

SEQ ID NO: 1787287 - protein, 7 aa, Staphylococcus epidermidis
QEKQSYA

SEQ ID NO: 1787288 - protein, 4 aa, Staphylococcus epidermidis
QEKS

SEQ ID NO: 1787289 - protein, 9 aa, Staphylococcus epidermidis
QEKVEADNI

SEQ ID NO: 1787290 - protein, 7 aa, Staphylococcus epidermidis
QELENNS

SEQ ID NO: 1787291 - protein, 16 aa, Staphylococcus epidermidis
QELGQKSAGLDTTRKS

SEQ ID NO: 1787292 - protein, 16 aa, Staphylococcus epidermidis
QELPVKTKNLNKKNVE

SEQ ID NO: 1787293 - protein, 5 aa, Staphylococcus epidermidis
QELTP

SEQ ID NO: 1787294 - protein, 7 aa, Staphylococcus epidermidis
QENAQAR

SEQ ID NO: 1787295 - protein, 11 aa, Staphylococcus epidermidis
QENDIEGRYNK

SEQ ID NO: 1787296 - protein, 4 aa, Staphylococcus epidermidis
QENF

SEQ ID NO: 1787297 - protein, 9 aa, Staphylococcus epidermidis
QENGQYEGN

SEQ ID NO: 1787298 - protein, 4 aa, Staphylococcus epidermidis
QENI

SEQ ID NO: 1787299 - protein, 10 aa, Staphylococcus epidermidis
QENKTYNMTR

SEQ ID NO: 1787300 - protein, 13 aa, Staphylococcus epidermidis
QENPGYSEQDPNE

SEQ ID NO: 1787301 - protein, 18 aa, Staphylococcus epidermidis
QENSTAYHRKHETQHSKE

SEQ ID NO: 1787302 - protein, 9 aa, Staphylococcus epidermidis
QEPHRTEAG

SEQ ID NO: 1787303 - protein, 6 aa, Staphylococcus epidermidis
QEPPYT

SEQ ID NO: 1787304 - protein, 7 aa, Staphylococcus epidermidis
QEPSVEG

SEQ ID NO: 1787305 - protein, 10 aa, Staphylococcus epidermidis
QEQAESYGHS

SEQ ID NO: 1787306 - protein, 17 aa, Staphylococcus epidermidis
QEQARPTTVSDNSNINK

SEQ ID NO: 1787307 - protein, 5 aa, Staphylococcus epidermidis
QEQHN

SEQ ID NO: 1787308 - protein, 4 aa, Staphylococcus epidermidis
QEQL

SEQ ID NO: 1787309 - protein, 7 aa, Staphylococcus epidermidis
QEQPQFP

SEQ ID NO: 1787310 - protein, 4 aa, Staphylococcus epidermidis
QEQV

SEQ ID NO: 1787311 - protein, 16 aa, Staphylococcus epidermidis
QEQYKEIPDSDKHYSG

SEQ ID NO: 1787312 - protein, 8 aa, Staphylococcus epidermidis
QERHKGSM

SEQ ID NO: 1787313 - protein, 6 aa, Staphylococcus epidermidis
QERPTS

SEQ ID NO: 1787314 - protein, 8 aa, Staphylococcus epidermidis
QERQPING

SEQ ID NO: 1787315 - protein, 4 aa, Staphylococcus epidermidis
QERR

SEQ ID NO: 1787316 - protein, 5 aa, Staphylococcus epidermidis
QESAR

SEQ ID NO: 1787317 - protein, 7 aa, Staphylococcus epidermidis
QESEKSL

SEQ ID NO: 1787318 - protein, 9 aa, Staphylococcus epidermidis
QESHNQDDE

SEQ ID NO: 1787319 - protein, 9 aa, Staphylococcus epidermidis
QESLSKDEA

SEQ ID NO: 1787320 - protein, 17 aa, Staphylococcus epidermidis
QESTANNQADDIESEND

SEQ ID NO: 1787321 - protein, 6 aa, Staphylococcus epidermidis
QESVER

SEQ ID NO: 1787322 - protein, 14 aa, Staphylococcus epidermidis
QETDSSADSEPYSV

SEQ ID NO: 1787323 - protein, 5 aa, Staphylococcus epidermidis
QETLE

SEQ ID NO: 1787324 - protein, 7 aa, Staphylococcus epidermidis
QETPPNI

SEQ ID NO: 1787325 - protein, 6 aa, Staphylococcus epidermidis
QETPSL

SEQ ID NO: 1787326 - protein, 8 aa, Staphylococcus epidermidis
QETQPEDI

SEQ ID NO: 1787327 - protein, 4 aa, Staphylococcus epidermidis
QETV

SEQ ID NO: 1787328 - protein, 8 aa, Staphylococcus epidermidis
QEVDAHPN

SEQ ID NO: 1787329 - protein, 18 aa, Staphylococcus epidermidis
QEVDDKQENALSDYYSFK

SEQ ID NO: 1787330 - protein, 21 aa, Staphylococcus epidermidis
QEVLDTEPTVEEAEPSTIENE

SEQ ID NO: 1787331 - protein, 23 aa, Staphylococcus epidermidis
QEVPGAKQINNIDDATKIVMRGD

SEQ ID NO: 1787332 - protein, 15 aa, Staphylococcus epidermidis
QEYEKITQSVKGESL

SEQ ID NO: 1787333 - protein, 10 aa, Staphylococcus epidermidis
QEYEKQQEEI

SEQ ID NO: 1787334 - protein, 4 aa, Staphylococcus epidermidis
QEYS

SEQ ID NO: 1787335 - protein, 16 aa, Staphylococcus epidermidis
QFDEDTYHSDEFETIN

SEQ ID NO: 1787336 - protein, 9 aa, Staphylococcus epidermidis
QFELNGQSY

SEQ ID NO: 1787337 - protein, 13 aa, Staphylococcus epidermidis
QFGDSKDTSENTY

SEQ ID NO: 1787338 - protein, 14 aa, Staphylococcus epidermidis
QFKETTGKDYEPQV

SEQ ID NO: 1787339 - protein, 4 aa, Staphylococcus epidermidis
QFNP

SEQ ID NO: 1787340 - protein, 11 aa, Staphylococcus epidermidis
QFNPGGSVKDR

SEQ ID NO: 1787341 - protein, 9 aa, Staphylococcus epidermidis
QFNQEKKNR

SEQ ID NO: 1787342 - protein, 6 aa, Staphylococcus epidermidis
QFNSFS

SEQ ID NO: 1787343 - protein, 19 aa, Staphylococcus epidermidis
QFPAGAPFGGYKKSGIGRE

SEQ ID NO: 1787344 - protein, 30 aa, Staphylococcus epidermidis
QFPAKDKKNSFTKGKLSNWENDKSEPIAKT

SEQ ID NO: 1787345 - protein, 5 aa, Staphylococcus epidermidis
QFPTG

SEQ ID NO: 1787346 - protein, 6 aa, Staphylococcus epidermidis
QFQYDD

SEQ ID NO: 1787347 - protein, 49 aa, Staphylococcus epidermidis
QFSDESKDKHEDKQQDSESQKSDKTDGDQKEDIRNENYSKKSFWSRLFG

SEQ ID NO: 1787348 - protein, 42 aa, Staphylococcus epidermidis
QFTQDTNELERRRQAAESARLADEKARRDREERTRAKQASRR

SEQ ID NO: 1787349 - protein, 8 aa, Staphylococcus epidermidis
QGAQGATI

SEQ ID NO: 1787350 - protein, 5 aa, Staphylococcus epidermidis
QGASE

SEQ ID NO: 1787351 - protein, 8 aa, Staphylococcus epidermidis
QGDDDKHT

SEQ ID NO: 1787352 - protein, 13 aa, Staphylococcus epidermidis
QGDRYSKTAFNMG

SEQ ID NO: 1787353 - protein, 7 aa, Staphylococcus epidermidis
QGDTKAA

SEQ ID NO: 1787354 - protein, 6 aa, Staphylococcus epidermidis
QGDTTG

SEQ ID NO: 1787355 - protein, 12 aa, Staphylococcus epidermidis
QGEAGINVPPEG

SEQ ID NO: 1787356 - protein, 19 aa, Staphylococcus epidermidis
QGEDESDSEDASEEVGKTE

SEQ ID NO: 1787357 - protein, 7 aa, Staphylococcus epidermidis
QGEEAAR

SEQ ID NO: 1787358 - protein, 7 aa, Staphylococcus epidermidis
QGEPIKT

SEQ ID NO: 1787359 - protein, 4 aa, Staphylococcus epidermidis
QGEQ

SEQ ID NO: 1787360 - protein, 19 aa, Staphylococcus epidermidis
QGFEPSEFGYNRKQTLSNA

SEQ ID NO: 1787361 - protein, 10 aa, Staphylococcus epidermidis
QGGENTGDEV

SEQ ID NO: 1787362 - protein, 4 aa, Staphylococcus epidermidis
QGGG

SEQ ID NO: 1787363 - protein, 13 aa, Staphylococcus epidermidis
QGGKTSESERPLT

SEQ ID NO: 1787364 - protein, 7 aa, Staphylococcus epidermidis
QGGTKEA

SEQ ID NO: 1787365 - protein, 7 aa, Staphylococcus epidermidis
QGHPGNL

SEQ ID NO: 1787366 - protein, 6 aa, Staphylococcus epidermidis
QGIGSE

SEQ ID NO: 1787367 - protein, 5 aa, Staphylococcus epidermidis
QGINF

SEQ ID NO: 1787368 - protein, 4 aa, Staphylococcus epidermidis
QGIP

SEQ ID NO: 1787369 - protein, 7 aa, Staphylococcus epidermidis
QGKHNDD

SEQ ID NO: 1787370 - protein, 6 aa, Staphylococcus epidermidis
QGKKET

SEQ ID NO: 1787371 - protein, 4 aa, Staphylococcus epidermidis
QGKN

SEQ ID NO: 1787372 - protein, 8 aa, Staphylococcus epidermidis
QGKNSFAT

SEQ ID NO: 1787373 - protein, 6 aa, Staphylococcus epidermidis
QGKPLR

SEQ ID NO: 1787374 - protein, 10 aa, Staphylococcus epidermidis
QGKVTDKRAK

SEQ ID NO: 1787375 - protein, 10 aa, Staphylococcus epidermidis
QGKYGSNKNY

SEQ ID NO: 1787376 - protein, 5 aa, Staphylococcus epidermidis
QGLDR

SEQ ID NO: 1787377 - protein, 14 aa, Staphylococcus epidermidis
QGLNTTYDTAEKIK

SEQ ID NO: 1787378 - protein, 7 aa, Staphylococcus epidermidis
QGLRTGK

SEQ ID NO: 1787379 - protein, 6 aa, Staphylococcus epidermidis
QGLTEE

SEQ ID NO: 1787380 - protein, 7 aa, Staphylococcus epidermidis
QGLTPVK

SEQ ID NO: 1787381 - protein, 15 aa, Staphylococcus epidermidis
QGMNGTLDNLEALLE

SEQ ID NO: 1787382 - protein, 16 aa, Staphylococcus epidermidis
QGMNSTLNQLEKLLNQ

SEQ ID NO: 1787383 - protein, 17 aa, Staphylococcus epidermidis
QGMSGGQKTTCSHSTGN

SEQ ID NO: 1787384 - protein, 7 aa, Staphylococcus epidermidis
QGNNKEL

SEQ ID NO: 1787385 - protein, 8 aa, Staphylococcus epidermidis
QGNNSFNK

SEQ ID NO: 1787386 - protein, 12 aa, Staphylococcus epidermidis
QGPLTIPYVENE

SEQ ID NO: 1787387 - protein, 12 aa, Staphylococcus epidermidis
QGPTIVADESKG

SEQ ID NO: 1787388 - protein, 6 aa, Staphylococcus epidermidis
QGQFRK

SEQ ID NO: 1787389 - protein, 8 aa, Staphylococcus epidermidis
QGQIKGAA

SEQ ID NO: 1787390 - protein, 6 aa, Staphylococcus epidermidis
QGQNEF

SEQ ID NO: 1787391 - protein, 8 aa, Staphylococcus epidermidis
QGQPNQPV

SEQ ID NO: 1787392 - protein, 6 aa, Staphylococcus epidermidis
QGQSTQ

SEQ ID NO: 1787393 - protein, 4 aa, Staphylococcus epidermidis
QGRI

SEQ ID NO: 1787394 - protein, 11 aa, Staphylococcus epidermidis
QGSEAGGHRGS

SEQ ID NO: 1787395 - protein, 6 aa, Staphylococcus epidermidis
QGSGKS

SEQ ID NO: 1787396 - protein, 12 aa, Staphylococcus epidermidis
QGSLGASGDLAP

SEQ ID NO: 1787397 - protein, 6 aa, Staphylococcus epidermidis
QGSNFQ

SEQ ID NO: 1787398 - protein, 4 aa, Staphylococcus epidermidis
QGST

SEQ ID NO: 1787399 - protein, 19 aa, Staphylococcus epidermidis
QGTDNNETINPNNPLKGKL

SEQ ID NO: 1787400 - protein, 5 aa, Staphylococcus epidermidis
QGTED

SEQ ID NO: 1787401 - protein, 15 aa, Staphylococcus epidermidis
QGTNLTQKRESKLQS

SEQ ID NO: 1787402 - protein, 6 aa, Staphylococcus epidermidis
QGTNND

SEQ ID NO: 1787403 - protein, 8 aa, Staphylococcus epidermidis
QGTQAKED

SEQ ID NO: 1787404 - protein, 4 aa, Staphylococcus epidermidis
QGTY

SEQ ID NO: 1787405 - protein, 6 aa, Staphylococcus epidermidis
QGVGST

SEQ ID NO: 1787406 - protein, 7 aa, Staphylococcus epidermidis
QGVNTER

SEQ ID NO: 1787407 - protein, 4 aa, Staphylococcus epidermidis
QGYD

SEQ ID NO: 1787408 - protein, 19 aa, Staphylococcus epidermidis
QGYSVEEAKQLRKEDPKKY

SEQ ID NO: 1787409 - protein, 7 aa, Staphylococcus epidermidis
QGYTTGG

SEQ ID NO: 1787410 - protein, 9 aa, Staphylococcus epidermidis
QHAEDTELK

SEQ ID NO: 1787411 - protein, 10 aa, Staphylococcus epidermidis
QHAPDWTKDR

SEQ ID NO: 1787412 - protein, 4 aa, Staphylococcus epidermidis
QHAQ

SEQ ID NO: 1787413 - protein, 11 aa, Staphylococcus epidermidis
QHAQQDANNEI

SEQ ID NO: 1787414 - protein, 12 aa, Staphylococcus epidermidis
QHERTQNFLSRV

SEQ ID NO: 1787415 - protein, 12 aa, Staphylococcus epidermidis
QHETKGSAYNNL

SEQ ID NO: 1787416 - protein, 6 aa, Staphylococcus epidermidis
QHFDDE

SEQ ID NO: 1787417 - protein, 7 aa, Staphylococcus epidermidis
QHGKMNK

SEQ ID NO: 1787418 - protein, 12 aa, Staphylococcus epidermidis
QHIDNEKNKKGQ

SEQ ID NO: 1787419 - protein, 6 aa, Staphylococcus epidermidis
QHINPG

SEQ ID NO: 1787420 - protein, 16 aa, Staphylococcus epidermidis
QHKRDAIKNNPDLTDV

SEQ ID NO: 1787421 - protein, 11 aa, Staphylococcus epidermidis
QHKVPGISGSV

SEQ ID NO: 1787422 - protein, 6 aa, Staphylococcus epidermidis
QHLAQS

SEQ ID NO: 1787423 - protein, 10 aa, Staphylococcus epidermidis
QHLDSNPNLI

SEQ ID NO: 1787424 - protein, 5 aa, Staphylococcus epidermidis
QHNEL

SEQ ID NO: 1787425 - protein, 5 aa, Staphylococcus epidermidis
QHNHS

SEQ ID NO: 1787426 - protein, 5 aa, Staphylococcus epidermidis
QHPAM

SEQ ID NO: 1787427 - protein, 7 aa, Staphylococcus epidermidis
QHPESSV

SEQ ID NO: 1787428 - protein, 5 aa, Staphylococcus epidermidis
QHQEV

SEQ ID NO: 1787429 - protein, 6 aa, Staphylococcus epidermidis
QHTRPT

SEQ ID NO: 1787430 - protein, 11 aa, Staphylococcus epidermidis
QIDDETTSHHL

SEQ ID NO: 1787431 - protein, 7 aa, Staphylococcus epidermidis
QIDDSKG

SEQ ID NO: 1787432 - protein, 8 aa, Staphylococcus epidermidis
QIDEPREV

SEQ ID NO: 1787433 - protein, 4 aa, Staphylococcus epidermidis
QIDP

SEQ ID NO: 1787434 - protein, 8 aa, Staphylococcus epidermidis
QIDSKGKV

SEQ ID NO: 1787435 - protein, 7 aa, Staphylococcus epidermidis
QIEEEQS

SEQ ID NO: 1787436 - protein, 14 aa, Staphylococcus epidermidis
QIEETDSDFDREKL

SEQ ID NO: 1787437 - protein, 11 aa, Staphylococcus epidermidis
QIEGSTEVSAK

SEQ ID NO: 1787438 - protein, 4 aa, Staphylococcus epidermidis
QIEL

SEQ ID NO: 1787439 - protein, 9 aa, Staphylococcus epidermidis
QIESTYKTV

SEQ ID NO: 1787440 - protein, 11 aa, Staphylococcus epidermidis
QIETLSKNNQT

SEQ ID NO: 1787441 - protein, 10 aa, Staphylococcus epidermidis
QIGSKENKGY

SEQ ID NO: 1787442 - protein, 5 aa, Staphylococcus epidermidis
QIKGQ

SEQ ID NO: 1787443 - protein, 8 aa, Staphylococcus epidermidis
QIKPTNGE

SEQ ID NO: 1787444 - protein, 7 aa, Staphylococcus epidermidis
QINANAY

SEQ ID NO: 1787445 - protein, 9 aa, Staphylococcus epidermidis
QINDTDQTI

SEQ ID NO: 1787446 - protein, 7 aa, Staphylococcus epidermidis
QINPNLQ

SEQ ID NO: 1787447 - protein, 6 aa, Staphylococcus epidermidis
QIPEGA

SEQ ID NO: 1787448 - protein, 14 aa, Staphylococcus epidermidis
QIPSKKNEVDPKYT

SEQ ID NO: 1787449 - protein, 12 aa, Staphylococcus epidermidis
QIPTNKPVQRVD

SEQ ID NO: 1787450 - protein, 12 aa, Staphylococcus epidermidis
QIQEQEEERDRL

SEQ ID NO: 1787451 - protein, 5 aa, Staphylococcus epidermidis
QIQPE

SEQ ID NO: 1787452 - protein, 4 aa, Staphylococcus epidermidis
QIRT

SEQ ID NO: 1787453 - protein, 5 aa, Staphylococcus epidermidis
QISSD

SEQ ID NO: 1787454 - protein, 10 aa, Staphylococcus epidermidis
QIYSSRPAPY

SEQ ID NO: 1787455 - protein, 5 aa, Staphylococcus epidermidis
QKANA

SEQ ID NO: 1787456 - protein, 8 aa, Staphylococcus epidermidis
QKASHAKI

SEQ ID NO: 1787457 - protein, 6 aa, Staphylococcus epidermidis
QKATAF

SEQ ID NO: 1787458 - protein, 9 aa, Staphylococcus epidermidis
QKDADEVED

SEQ ID NO: 1787459 - protein, 8 aa, Staphylococcus epidermidis
QKDDEVVT

SEQ ID NO: 1787460 - protein, 7 aa, Staphylococcus epidermidis
QKDFNEG

SEQ ID NO: 1787461 - protein, 9 aa, Staphylococcus epidermidis
QKDGPPAYF

SEQ ID NO: 1787462 - protein, 11 aa, Staphylococcus epidermidis
QKDPDTGQLNG

SEQ ID NO: 1787463 - protein, 5 aa, Staphylococcus epidermidis
QKDPV

SEQ ID NO: 1787464 - protein, 8 aa, Staphylococcus epidermidis
QKDSSDQL

SEQ ID NO: 1787465 - protein, 5 aa, Staphylococcus epidermidis
QKDTQ

SEQ ID NO: 1787466 - protein, 8 aa, Staphylococcus epidermidis
QKDYSTYI

SEQ ID NO: 1787467 - protein, 9 aa, Staphylococcus epidermidis
QKEAAKLAQ

SEQ ID NO: 1787468 - protein, 9 aa, Staphylococcus epidermidis
QKEAQGDDI

SEQ ID NO: 1787469 - protein, 9 aa, Staphylococcus epidermidis
QKEATSQVN

SEQ ID NO: 1787470 - protein, 9 aa, Staphylococcus epidermidis
QKEKGDENF

SEQ ID NO: 1787471 - protein, 6 aa, Staphylococcus epidermidis
QKENLK

SEQ ID NO: 1787472 - protein, 12 aa, Staphylococcus epidermidis
QKENPEKTTELK

SEQ ID NO: 1787473 - protein, 8 aa, Staphylococcus epidermidis
QKERQAKN

SEQ ID NO: 1787474 - protein, 8 aa, Staphylococcus epidermidis
QKGDLPGI

SEQ ID NO: 1787475 - protein, 9 aa, Staphylococcus epidermidis
QKGEPVRTT

SEQ ID NO: 1787476 - protein, 9 aa, Staphylococcus epidermidis
QKGKKNKAI

SEQ ID NO: 1787477 - protein, 17 aa, Staphylococcus epidermidis
QKGQPKNLEVSHTSKGT

SEQ ID NO: 1787478 - protein, 9 aa, Staphylococcus epidermidis
QKGQVPQST

SEQ ID NO: 1787479 - protein, 4 aa, Staphylococcus epidermidis
QKHD

SEQ ID NO: 1787480 - protein, 18 aa, Staphylococcus epidermidis
QKHEKREQVEAETANQVD

SEQ ID NO: 1787481 - protein, 4 aa, Staphylococcus epidermidis
QKHG

SEQ ID NO: 1787482 - protein, 7 aa, Staphylococcus epidermidis
QKHGRGK

SEQ ID NO: 1787483 - protein, 5 aa, Staphylococcus epidermidis
QKHKT

SEQ ID NO: 1787484 - protein, 6 aa, Staphylococcus epidermidis
QKHPRG

SEQ ID NO: 1787485 - protein, 10 aa, Staphylococcus epidermidis
QKHSSQPEIK

SEQ ID NO: 1787486 - protein, 9 aa, Staphylococcus epidermidis
QKIKNSLSD

SEQ ID NO: 1787487 - protein, 9 aa, Staphylococcus epidermidis
QKIMSTDNT

SEQ ID NO: 1787488 - protein, 8 aa, Staphylococcus epidermidis
QKINGDEL

SEQ ID NO: 1787489 - protein, 14 aa, Staphylococcus epidermidis
QKINKSKMKPGNFD

SEQ ID NO: 1787490 - protein, 16 aa, Staphylococcus epidermidis
QKINKSKVKPGDYDKI

SEQ ID NO: 1787491 - protein, 22 aa, Staphylococcus epidermidis
QKKAIEEIKPGMTAKEADAISR

SEQ ID NO: 1787492 - protein, 9 aa, Staphylococcus epidermidis
QKKEKVQPQ

SEQ ID NO: 1787493 - protein, 14 aa, Staphylococcus epidermidis
QKKISDAKHLNKDD

SEQ ID NO: 1787494 - protein, 6 aa, Staphylococcus epidermidis
QKKKVI

SEQ ID NO: 1787495 - protein, 8 aa, Staphylococcus epidermidis
QKKTEGYL

SEQ ID NO: 1787496 - protein, 6 aa, Staphylococcus epidermidis
QKLDNN

SEQ ID NO: 1787497 - protein, 9 aa, Staphylococcus epidermidis
QKLERGKRT

SEQ ID NO: 1787498 - protein, 6 aa, Staphylococcus epidermidis
QKLKET

SEQ ID NO: 1787499 - protein, 6 aa, Staphylococcus epidermidis
QKLPQQ

SEQ ID NO: 1787500 - protein, 16 aa, Staphylococcus epidermidis
QKLPVKTKSLNKKTIE

SEQ ID NO: 1787501 - protein, 12 aa, Staphylococcus epidermidis
QKMDQNQAVYPS

SEQ ID NO: 1787502 - protein, 13 aa, Staphylococcus epidermidis
QKMPGRMGGNTVT

SEQ ID NO: 1787503 - protein, 24 aa, Staphylococcus epidermidis
QKMTGEQIAEATGVSRSTVYRVIK

SEQ ID NO: 1787504 - protein, 24 aa, Staphylococcus epidermidis
QKMTGEQIAEATGVSRSTVYRVVK

SEQ ID NO: 1787505 - protein, 7 aa, Staphylococcus epidermidis
QKNDEVC

SEQ ID NO: 1787506 - protein, 7 aa, Staphylococcus epidermidis
QKNEETD

SEQ ID NO: 1787507 - protein, 6 aa, Staphylococcus epidermidis
QKNERV

SEQ ID NO: 1787508 - protein, 5 aa, Staphylococcus epidermidis
QKPKD

SEQ ID NO: 1787509 - protein, 8 aa, Staphylococcus epidermidis
QKPKLDKK

SEQ ID NO: 1787510 - protein, 6 aa, Staphylococcus epidermidis
QKPQEF

SEQ ID NO: 1787511 - protein, 33 aa, Staphylococcus epidermidis
QKPSYQLSHENTDDQQTVPSYNDFGRTEEEQSV

SEQ ID NO: 1787512 - protein, 21 aa, Staphylococcus epidermidis
QKPSYQLSHQDTDNQRTVPSY

SEQ ID NO: 1787513 - protein, 15 aa, Staphylococcus epidermidis
QKPVEVKPDATSETI

SEQ ID NO: 1787514 - protein, 5 aa, Staphylococcus epidermidis
QKPVI

SEQ ID NO: 1787515 - protein, 11 aa, Staphylococcus epidermidis
QKQGLQPGKSV

SEQ ID NO: 1787516 - protein, 6 aa, Staphylococcus epidermidis
QKQLKS

SEQ ID NO: 1787517 - protein, 7 aa, Staphylococcus epidermidis
QKQQNKL

SEQ ID NO: 1787518 - protein, 5 aa, Staphylococcus epidermidis
QKQQS

SEQ ID NO: 1787519 - protein, 4 aa, Staphylococcus epidermidis
QKQR

SEQ ID NO: 1787520 - protein, 7 aa, Staphylococcus epidermidis
QKQRGKQ

SEQ ID NO: 1787521 - protein, 8 aa, Staphylococcus epidermidis
QKQRPTEI

SEQ ID NO: 1787522 - protein, 11 aa, Staphylococcus epidermidis
QKQTKEEIATV

SEQ ID NO: 1787523 - protein, 10 aa, Staphylococcus epidermidis
QKQYNKQEGF

SEQ ID NO: 1787524 - protein, 4 aa, Staphylococcus epidermidis
QKRG

SEQ ID NO: 1787525 - protein, 6 aa, Staphylococcus epidermidis
QKRKEE

SEQ ID NO: 1787526 - protein, 5 aa, Staphylococcus epidermidis
QKRSG

SEQ ID NO: 1787527 - protein, 10 aa, Staphylococcus epidermidis
QKRYGQGKPN

SEQ ID NO: 1787528 - protein, 5 aa, Staphylococcus epidermidis
QKRYK

SEQ ID NO: 1787529 - protein, 6 aa, Staphylococcus epidermidis
QKRYKD

SEQ ID NO: 1787530 - protein, 4 aa, Staphylococcus epidermidis
QKSA

SEQ ID NO: 1787531 - protein, 9 aa, Staphylococcus epidermidis
QKSDNEFDN

SEQ ID NO: 1787532 - protein, 7 aa, Staphylococcus epidermidis
QKSFRNG

SEQ ID NO: 1787533 - protein, 7 aa, Staphylococcus epidermidis
QKSGYKD

SEQ ID NO: 1787534 - protein, 6 aa, Staphylococcus epidermidis
QKSIGK

SEQ ID NO: 1787535 - protein, 7 aa, Staphylococcus epidermidis
QKSNGSM

SEQ ID NO: 1787536 - protein, 6 aa, Staphylococcus epidermidis
QKSQPV

SEQ ID NO: 1787537 - protein, 12 aa, Staphylococcus epidermidis
QKSRDNSRTPMQ

SEQ ID NO: 1787538 - protein, 6 aa, Staphylococcus epidermidis
QKSSAD

SEQ ID NO: 1787539 - protein, 5 aa, Staphylococcus epidermidis
QKTAH

SEQ ID NO: 1787540 - protein, 9 aa, Staphylococcus epidermidis
QKTETREVE

SEQ ID NO: 1787541 - protein, 14 aa, Staphylococcus epidermidis
QKTFRDKGITEPTV

SEQ ID NO: 1787542 - protein, 8 aa, Staphylococcus epidermidis
QKTRYNQQ

SEQ ID NO: 1787543 - protein, 4 aa, Staphylococcus epidermidis
QKVA

SEQ ID NO: 1787544 - protein, 10 aa, Staphylococcus epidermidis
QKVATKVGQG

SEQ ID NO: 1787545 - protein, 7 aa, Staphylococcus epidermidis
QKVEHGP

SEQ ID NO: 1787546 - protein, 5 aa, Staphylococcus epidermidis
QKVSQ

SEQ ID NO: 1787547 - protein, 14 aa, Staphylococcus epidermidis
QKVVTDQAPSTKAA

SEQ ID NO: 1787548 - protein, 8 aa, Staphylococcus epidermidis
QKWPNDKA

SEQ ID NO: 1787549 - protein, 15 aa, Staphylococcus epidermidis
QKWQQQDYKKAADYY

SEQ ID NO: 1787550 - protein, 15 aa, Staphylococcus epidermidis
QKWQQQNYKKAAEYY

SEQ ID NO: 1787551 - protein, 6 aa, Staphylococcus epidermidis
QKYDKQ

SEQ ID NO: 1787552 - protein, 9 aa, Staphylococcus epidermidis
QKYEGMSKT

SEQ ID NO: 1787553 - protein, 13 aa, Staphylococcus epidermidis
QLAGSVTDNVETY

SEQ ID NO: 1787554 - protein, 14 aa, Staphylococcus epidermidis
QLAQSQTKNRQNEV

SEQ ID NO: 1787555 - protein, 15 aa, Staphylococcus epidermidis
QLASNKQLKTPEARE

SEQ ID NO: 1787556 - protein, 4 aa, Staphylococcus epidermidis
QLDE

SEQ ID NO: 1787557 - protein, 13 aa, Staphylococcus epidermidis
QLDNDHPNKDCSP

SEQ ID NO: 1787558 - protein, 11 aa, Staphylococcus epidermidis
QLDNDHPNKDW

SEQ ID NO: 1787559 - protein, 9 aa, Staphylococcus epidermidis
QLDNSDDNV

SEQ ID NO: 1787560 - protein, 9 aa, Staphylococcus epidermidis
QLDTSNPDN

SEQ ID NO: 1787561 - protein, 6 aa, Staphylococcus epidermidis
QLEAQL

SEQ ID NO: 1787562 - protein, 6 aa, Staphylococcus epidermidis
QLEDAR

SEQ ID NO: 1787563 - protein, 6 aa, Staphylococcus epidermidis
QLEDTH

SEQ ID NO: 1787564 - protein, 6 aa, Staphylococcus epidermidis
QLEETE

SEQ ID NO: 1787565 - protein, 17 aa, Staphylococcus epidermidis
QLEKGTVASDWSPNVDD

SEQ ID NO: 1787566 - protein, 14 aa, Staphylococcus epidermidis
QLEKLSNKQLSEIR

SEQ ID NO: 1787567 - protein, 6 aa, Staphylococcus epidermidis
QLENFG

SEQ ID NO: 1787568 - protein, 13 aa, Staphylococcus epidermidis
QLETEESDTNYDR

SEQ ID NO: 1787569 - protein, 7 aa, Staphylococcus epidermidis
QLGGETK

SEQ ID NO: 1787570 - protein, 13 aa, Staphylococcus epidermidis
QLGPSEDDVELQK

SEQ ID NO: 1787571 - protein, 9 aa, Staphylococcus epidermidis
QLGVPTEKD

SEQ ID NO: 1787572 - protein, 14 aa, Staphylococcus epidermidis
QLKEQKKKQEAQLS

SEQ ID NO: 1787573 - protein, 16 aa, Staphylococcus epidermidis
QLKEQKKKQEAQLSNK

SEQ ID NO: 1787574 - protein, 7 aa, Staphylococcus epidermidis
QLKESHS

SEQ ID NO: 1787575 - protein, 9 aa, Staphylococcus epidermidis
QLKGKESQV

SEQ ID NO: 1787576 - protein, 42 aa, Staphylococcus epidermidis
QLKKPRDPEEEERLRKRNEERKRRKEEQDRKLKEKLEKRKTA

SEQ ID NO: 1787577 - protein, 19 aa, Staphylococcus epidermidis
QLKNEKALKEVSNLAGKDT

SEQ ID NO: 1787578 - protein, 5 aa, Staphylococcus epidermidis
QLKNS

SEQ ID NO: 1787579 - protein, 7 aa, Staphylococcus epidermidis
QLKPGET

SEQ ID NO: 1787580 - protein, 9 aa, Staphylococcus epidermidis
QLKPKELKE

SEQ ID NO: 1787581 - protein, 7 aa, Staphylococcus epidermidis
QLKPQTN

SEQ ID NO: 1787582 - protein, 12 aa, Staphylococcus epidermidis
QLKQNKKIIEQN

SEQ ID NO: 1787583 - protein, 11 aa, Staphylococcus epidermidis
QLKSKKDTYIN

SEQ ID NO: 1787584 - protein, 11 aa, Staphylococcus epidermidis
QLKSKKDTYLN

SEQ ID NO: 1787585 - protein, 5 aa, Staphylococcus epidermidis
QLKSR

SEQ ID NO: 1787586 - protein, 12 aa, Staphylococcus epidermidis
QLMPGGVNSPVR

SEQ ID NO: 1787587 - protein, 6 aa, Staphylococcus epidermidis
QLNENQ

SEQ ID NO: 1787588 - protein, 8 aa, Staphylococcus epidermidis
QLNGEYGH

SEQ ID NO: 1787589 - protein, 28 aa, Staphylococcus epidermidis
QLNKSKNTKIENEKKRASDYYKDRTTVA

SEQ ID NO: 1787590 - protein, 11 aa, Staphylococcus epidermidis
QLNNNDNNVKQ

SEQ ID NO: 1787591 - protein, 8 aa, Staphylococcus epidermidis
QLNQAGYA

SEQ ID NO: 1787592 - protein, 9 aa, Staphylococcus epidermidis
QLNSSTHHE

SEQ ID NO: 1787593 - protein, 7 aa, Staphylococcus epidermidis
QLPDGQK

SEQ ID NO: 1787594 - protein, 20 aa, Staphylococcus epidermidis
QLPEEKTEVDLSTKTFTNGL

SEQ ID NO: 1787595 - protein, 6 aa, Staphylococcus epidermidis
QLPKLE

SEQ ID NO: 1787596 - protein, 4 aa, Staphylococcus epidermidis
QLPQ

SEQ ID NO: 1787597 - protein, 12 aa, Staphylococcus epidermidis
QLPQDKVNVKGG

SEQ ID NO: 1787598 - protein, 8 aa, Staphylococcus epidermidis
QLQEEEKE

SEQ ID NO: 1787599 - protein, 8 aa, Staphylococcus epidermidis
QLQEEEKN

SEQ ID NO: 1787600 - protein, 6 aa, Staphylococcus epidermidis
QLQERD

SEQ ID NO: 1787601 - protein, 5 aa, Staphylococcus epidermidis
QLQKS

SEQ ID NO: 1787602 - protein, 9 aa, Staphylococcus epidermidis
QLRESASID

SEQ ID NO: 1787603 - protein, 9 aa, Staphylococcus epidermidis
QLRKDNDIQ

SEQ ID NO: 1787604 - protein, 6 aa, Staphylococcus epidermidis
QLRKGT

SEQ ID NO: 1787605 - protein, 10 aa, Staphylococcus epidermidis
QLRKSNHPNV

SEQ ID NO: 1787606 - protein, 12 aa, Staphylococcus epidermidis
QLRPRTSNTVSK

SEQ ID NO: 1787607 - protein, 12 aa, Staphylococcus epidermidis
QLSDSEHQKIEV

SEQ ID NO: 1787608 - protein, 5 aa, Staphylococcus epidermidis
QLSDT

SEQ ID NO: 1787609 - protein, 6 aa, Staphylococcus epidermidis
QLSESD

SEQ ID NO: 1787610 - protein, 6 aa, Staphylococcus epidermidis
QLSGGQ

SEQ ID NO: 1787611 - protein, 10 aa, Staphylococcus epidermidis
QLSGGQQQRV

SEQ ID NO: 1787612 - protein, 23 aa, Staphylococcus epidermidis
QLSKEGKESTTQTQQQLHQKQSD

SEQ ID NO: 1787613 - protein, 7 aa, Staphylococcus epidermidis
QLSNEKY

SEQ ID NO: 1787614 - protein, 9 aa, Staphylococcus epidermidis
QLSNNDYNV

SEQ ID NO: 1787615 - protein, 6 aa, Staphylococcus epidermidis
QLTPES

SEQ ID NO: 1787616 - protein, 7 aa, Staphylococcus epidermidis
QLTTRQA

SEQ ID NO: 1787617 - protein, 5 aa, Staphylococcus epidermidis
QLYNE

SEQ ID NO: 1787618 - protein, 4 aa, Staphylococcus epidermidis
QMAE

SEQ ID NO: 1787619 - protein, 13 aa, Staphylococcus epidermidis
QMDEERKKQLAKM

SEQ ID NO: 1787620 - protein, 21 aa, Staphylococcus epidermidis
QMEQEAQQEMKEEQYQTFSKK

SEQ ID NO: 1787621 - protein, 9 aa, Staphylococcus epidermidis
QMGDEEINN

SEQ ID NO: 1787622 - protein, 11 aa, Staphylococcus epidermidis
QMKAEAQAEGF

SEQ ID NO: 1787623 - protein, 5 aa, Staphylococcus epidermidis
QMNQM

SEQ ID NO: 1787624 - protein, 8 aa, Staphylococcus epidermidis
QMNRQNVD

SEQ ID NO: 1787625 - protein, 5 aa, Staphylococcus epidermidis
QMPPN

SEQ ID NO: 1787626 - protein, 4 aa, Staphylococcus epidermidis
QMQG

SEQ ID NO: 1787627 - protein, 15 aa, Staphylococcus epidermidis
QMSRSQKGLAGAGEW

SEQ ID NO: 1787628 - protein, 15 aa, Staphylococcus epidermidis
QMSSDSFGYTNKPIV

SEQ ID NO: 1787629 - protein, 8 aa, Staphylococcus epidermidis
QMTRSEAS

SEQ ID NO: 1787630 - protein, 10 aa, Staphylococcus epidermidis
QNAPNWTDDR

SEQ ID NO: 1787631 - protein, 5 aa, Staphylococcus epidermidis
QNARA

SEQ ID NO: 1787632 - protein, 10 aa, Staphylococcus epidermidis
QNARSTTSVD

SEQ ID NO: 1787633 - protein, 5 aa, Staphylococcus epidermidis
QNDEL

SEQ ID NO: 1787634 - protein, 7 aa, Staphylococcus epidermidis
QNDESPL

SEQ ID NO: 1787635 - protein, 4 aa, Staphylococcus epidermidis
QNDH

SEQ ID NO: 1787636 - protein, 5 aa, Staphylococcus epidermidis
QNDIY

SEQ ID NO: 1787637 - protein, 9 aa, Staphylococcus epidermidis
QNDKDKNQL

SEQ ID NO: 1787638 - protein, 16 aa, Staphylococcus epidermidis
QNDNPSIQTDRSEQLG

SEQ ID NO: 1787639 - protein, 12 aa, Staphylococcus epidermidis
QNDPSVKQLSPE

SEQ ID NO: 1787640 - protein, 6 aa, Staphylococcus epidermidis
QNDPWE

SEQ ID NO: 1787641 - protein, 21 aa, Staphylococcus epidermidis
QNDTSYENKIDSYPSSQGQKG

SEQ ID NO: 1787642 - protein, 10 aa, Staphylococcus epidermidis
QNDYGASSIS

SEQ ID NO: 1787643 - protein, 4 aa, Staphylococcus epidermidis
QNEA

SEQ ID NO: 1787644 - protein, 15 aa, Staphylococcus epidermidis
QNEDCKTCGHAPTYP

SEQ ID NO: 1787645 - protein, 8 aa, Staphylococcus epidermidis
QNEDIPDE

SEQ ID NO: 1787646 - protein, 17 aa, Staphylococcus epidermidis
QNEEKTNKSTDDKEVYK

SEQ ID NO: 1787647 - protein, 23 aa, Staphylococcus epidermidis
QNEETDNYNKNLKTKLENSSSYY

SEQ ID NO: 1787648 - protein, 8 aa, Staphylococcus epidermidis
QNEFTKDS

SEQ ID NO: 1787649 - protein, 9 aa, Staphylococcus epidermidis
QNELDERQN

SEQ ID NO: 1787650 - protein, 9 aa, Staphylococcus epidermidis
QNEPDQGVE

SEQ ID NO: 1787651 - protein, 5 aa, Staphylococcus epidermidis
QNEPY

SEQ ID NO: 1787652 - protein, 4 aa, Staphylococcus epidermidis
QNEQ

SEQ ID NO: 1787653 - protein, 6 aa, Staphylococcus epidermidis
QNETLD

SEQ ID NO: 1787654 - protein, 4 aa, Staphylococcus epidermidis
QNGD

SEQ ID NO: 1787655 - protein, 4 aa, Staphylococcus epidermidis
QNGN

SEQ ID NO: 1787656 - protein, 11 aa, Staphylococcus epidermidis
QNGQKKEIVSK

SEQ ID NO: 1787657 - protein, 6 aa, Staphylococcus epidermidis
QNHADM

SEQ ID NO: 1787658 - protein, 12 aa, Staphylococcus epidermidis
QNHAKGSARSID

SEQ ID NO: 1787659 - protein, 5 aa, Staphylococcus epidermidis
QNHAS

SEQ ID NO: 1787660 - protein, 8 aa, Staphylococcus epidermidis
QNIEDEHE

SEQ ID NO: 1787661 - protein, 7 aa, Staphylococcus epidermidis
QNINDSH

SEQ ID NO: 1787662 - protein, 4 aa, Staphylococcus epidermidis
QNKD

SEQ ID NO: 1787663 - protein, 11 aa, Staphylococcus epidermidis
QNKEDNTRTTK

SEQ ID NO: 1787664 - protein, 5 aa, Staphylococcus epidermidis
QNKEV

SEQ ID NO: 1787665 - protein, 8 aa, Staphylococcus epidermidis
QNKGASKL

SEQ ID NO: 1787666 - protein, 7 aa, Staphylococcus epidermidis
QNKGDVT

SEQ ID NO: 1787667 - protein, 8 aa, Staphylococcus epidermidis
QNKGNSKV

SEQ ID NO: 1787668 - protein, 9 aa, Staphylococcus epidermidis
QNKGQDYKG

SEQ ID NO: 1787669 - protein, 7 aa, Staphylococcus epidermidis
QNKKEPL

SEQ ID NO: 1787670 - protein, 10 aa, Staphylococcus epidermidis
QNKKRKANEI

SEQ ID NO: 1787671 - protein, 5 aa, Staphylococcus epidermidis
QNKKY

SEQ ID NO: 1787672 - protein, 7 aa, Staphylococcus epidermidis
QNKRLTE

SEQ ID NO: 1787673 - protein, 12 aa, Staphylococcus epidermidis
QNKTDRSSLSSA

SEQ ID NO: 1787674 - protein, 13 aa, Staphylococcus epidermidis
QNLDKNNVGEYQT

SEQ ID NO: 1787675 - protein, 8 aa, Staphylococcus epidermidis
QNLKKNGP

SEQ ID NO: 1787676 - protein, 4 aa, Staphylococcus epidermidis
QNLS

SEQ ID NO: 1787677 - protein, 11 aa, Staphylococcus epidermidis
QNLSEEDAEEY

SEQ ID NO: 1787678 - protein, 14 aa, Staphylococcus epidermidis
QNLSKLSAKQHGIQ

SEQ ID NO: 1787679 - protein, 9 aa, Staphylococcus epidermidis
QNLSQSTDI

SEQ ID NO: 1787680 - protein, 22 aa, Staphylococcus epidermidis
QNNANTKTAQDLQKKTDEIKRR

SEQ ID NO: 1787681 - protein, 7 aa, Staphylococcus epidermidis
QNNAQEG

SEQ ID NO: 1787682 - protein, 6 aa, Staphylococcus epidermidis
QNNEGL

SEQ ID NO: 1787683 - protein, 7 aa, Staphylococcus epidermidis
QNNEKGF

SEQ ID NO: 1787684 - protein, 4 aa, Staphylococcus epidermidis
QNNG

SEQ ID NO: 1787685 - protein, 9 aa, Staphylococcus epidermidis
QNNGVNDGD

SEQ ID NO: 1787686 - protein, 5 aa, Staphylococcus epidermidis
QNNPA

SEQ ID NO: 1787687 - protein, 7 aa, Staphylococcus epidermidis
QNNQYLD

SEQ ID NO: 1787688 - protein, 4 aa, Staphylococcus epidermidis
QNPK

SEQ ID NO: 1787689 - protein, 5 aa, Staphylococcus epidermidis
QNPNL

SEQ ID NO: 1787690 - protein, 17 aa, Staphylococcus epidermidis
QNPSRKDDMTILIIKRV

SEQ ID NO: 1787691 - protein, 11 aa, Staphylococcus epidermidis
QNPSTPAAFGK

SEQ ID NO: 1787692 - protein, 9 aa, Staphylococcus epidermidis
QNQASGHTG

SEQ ID NO: 1787693 - protein, 10 aa, Staphylococcus epidermidis
QNQEVSEEAQ

SEQ ID NO: 1787694 - protein, 6 aa, Staphylococcus epidermidis
QNQPIY

SEQ ID NO: 1787695 - protein, 6 aa, Staphylococcus epidermidis
QNQQEG

SEQ ID NO: 1787696 - protein, 15 aa, Staphylococcus epidermidis
QNQSQITEEKLRAFG

SEQ ID NO: 1787697 - protein, 8 aa, Staphylococcus epidermidis
QNQSSKIT

SEQ ID NO: 1787698 - protein, 6 aa, Staphylococcus epidermidis
QNQTRI

SEQ ID NO: 1787699 - protein, 14 aa, Staphylococcus epidermidis
QNQTSLTDYSRKEI

SEQ ID NO: 1787700 - protein, 31 aa, Staphylococcus epidermidis
QNRNSNGDNSSESGEEHQPKQVDVAQKAKDL

SEQ ID NO: 1787701 - protein, 17 aa, Staphylococcus epidermidis
QNRRKKLTSVDKENVLS

SEQ ID NO: 1787702 - protein, 7 aa, Staphylococcus epidermidis
QNSNGDT

SEQ ID NO: 1787703 - protein, 16 aa, Staphylococcus epidermidis
QNSQQERMEQSIEIQE

SEQ ID NO: 1787704 - protein, 6 aa, Staphylococcus epidermidis
QNSRPM

SEQ ID NO: 1787705 - protein, 9 aa, Staphylococcus epidermidis
QNSRQEEGN

SEQ ID NO: 1787706 - protein, 9 aa, Staphylococcus epidermidis
QNSTDKYIT

SEQ ID NO: 1787707 - protein, 5 aa, Staphylococcus epidermidis
QNTHQ

SEQ ID NO: 1787708 - protein, 21 aa, Staphylococcus epidermidis
QNTNATTREQVKKNLDNAQAL

SEQ ID NO: 1787709 - protein, 44 aa, Staphylococcus epidermidis
QNVDEVKRGSNYVNEDQTEQHNYDNAVTGAQTTIDNNNKPVLDK

SEQ ID NO: 1787710 - protein, 6 aa, Staphylococcus epidermidis
QNVETE

SEQ ID NO: 1787711 - protein, 19 aa, Staphylococcus epidermidis
QNVTKKNVDDGPAIFSALN

SEQ ID NO: 1787712 - protein, 13 aa, Staphylococcus epidermidis
QNYGKQNALEQSE

SEQ ID NO: 1787713 - protein, 5 aa, Staphylococcus epidermidis
QNYGQ

SEQ ID NO: 1787714 - protein, 5 aa, Staphylococcus epidermidis
QNYNK

SEQ ID NO: 1787715 - protein, 7 aa, Staphylococcus epidermidis
QPAKDMT

SEQ ID NO: 1787716 - protein, 16 aa, Staphylococcus epidermidis
QPATHQPKQVTLSTTH

SEQ ID NO: 1787717 - protein, 7 aa, Staphylococcus epidermidis
QPDETTF

SEQ ID NO: 1787718 - protein, 4 aa, Staphylococcus epidermidis
QPET

SEQ ID NO: 1787719 - protein, 6 aa, Staphylococcus epidermidis
QPFGQS

SEQ ID NO: 1787720 - protein, 6 aa, Staphylococcus epidermidis
QPGDEV

SEQ ID NO: 1787721 - protein, 10 aa, Staphylococcus epidermidis
QPGDVPETYA

SEQ ID NO: 1787722 - protein, 10 aa, Staphylococcus epidermidis
QPGEVTPEQC

SEQ ID NO: 1787723 - protein, 14 aa, Staphylococcus epidermidis
QPGGSIKDQDSIDM

SEQ ID NO: 1787724 - protein, 9 aa, Staphylococcus epidermidis
QPGQKAEDI

SEQ ID NO: 1787725 - protein, 7 aa, Staphylococcus epidermidis
QPGSSNK

SEQ ID NO: 1787726 - protein, 10 aa, Staphylococcus epidermidis
QPHKNIGNIR

SEQ ID NO: 1787727 - protein, 5 aa, Staphylococcus epidermidis
QPIAT

SEQ ID NO: 1787728 - protein, 6 aa, Staphylococcus epidermidis
QPIEDS

SEQ ID NO: 1787729 - protein, 5 aa, Staphylococcus epidermidis
QPING

SEQ ID NO: 1787730 - protein, 11 aa, Staphylococcus epidermidis
QPIREAQPEKY

SEQ ID NO: 1787731 - protein, 6 aa, Staphylococcus epidermidis
QPKAVG

SEQ ID NO: 1787732 - protein, 13 aa, Staphylococcus epidermidis
QPKENLAEVLDKH

SEQ ID NO: 1787733 - protein, 7 aa, Staphylococcus epidermidis
QPKHPQS

SEQ ID NO: 1787734 - protein, 7 aa, Staphylococcus epidermidis
QPKNEKA

SEQ ID NO: 1787735 - protein, 13 aa, Staphylococcus epidermidis
QPKVETEEIPDDK

SEQ ID NO: 1787736 - protein, 5 aa, Staphylococcus epidermidis
QPLGR

SEQ ID NO: 1787737 - protein, 12 aa, Staphylococcus epidermidis
QPLNESSEKYVQ

SEQ ID NO: 1787738 - protein, 5 aa, Staphylococcus epidermidis
QPLQF

SEQ ID NO: 1787739 - protein, 6 aa, Staphylococcus epidermidis
QPLSDE

SEQ ID NO: 1787740 - protein, 6 aa, Staphylococcus epidermidis
QPLTRS

SEQ ID NO: 1787741 - protein, 5 aa, Staphylococcus epidermidis
QPLYS

SEQ ID NO: 1787742 - protein, 5 aa, Staphylococcus epidermidis
QPNHI

SEQ ID NO: 1787743 - protein, 7 aa, Staphylococcus epidermidis
QPNTDTK

SEQ ID NO: 1787744 - protein, 7 aa, Staphylococcus epidermidis
QPPETYP

SEQ ID NO: 1787745 - protein, 17 aa, Staphylococcus epidermidis
QPPKEGKIRKTPAEVEA

SEQ ID NO: 1787746 - protein, 6 aa, Staphylococcus epidermidis
QPQFIP

SEQ ID NO: 1787747 - protein, 7 aa, Staphylococcus epidermidis
QPQTFGR

SEQ ID NO: 1787748 - protein, 7 aa, Staphylococcus epidermidis
QPQTSIS

SEQ ID NO: 1787749 - protein, 5 aa, Staphylococcus epidermidis
QPRKA

SEQ ID NO: 1787750 - protein, 6 aa, Staphylococcus epidermidis
QPSDGT

SEQ ID NO: 1787751 - protein, 14 aa, Staphylococcus epidermidis
QPSHVNVNEVTVRP

SEQ ID NO: 1787752 - protein, 12 aa, Staphylococcus epidermidis
QPSKSTDPRTAE

SEQ ID NO: 1787753 - protein, 9 aa, Staphylococcus epidermidis
QPSKYDDVR

SEQ ID NO: 1787754 - protein, 8 aa, Staphylococcus epidermidis
QPSLRSEY

SEQ ID NO: 1787755 - protein, 7 aa, Staphylococcus epidermidis
QPTFSDT

SEQ ID NO: 1787756 - protein, 15 aa, Staphylococcus epidermidis
QPTIQDTEKHTRAID

SEQ ID NO: 1787757 - protein, 5 aa, Staphylococcus epidermidis
QPTSD

SEQ ID NO: 1787758 - protein, 8 aa, Staphylococcus epidermidis
QPVPDLPP

SEQ ID NO: 1787759 - protein, 11 aa, Staphylococcus epidermidis
QPYKEENKQRE

SEQ ID NO: 1787760 - protein, 5 aa, Staphylococcus epidermidis
QPYQR

SEQ ID NO: 1787761 - protein, 20 aa, Staphylococcus epidermidis
QQARNTLAKATGEPASIDEV

SEQ ID NO: 1787762 - protein, 6 aa, Staphylococcus epidermidis
QQATDE

SEQ ID NO: 1787763 - protein, 8 aa, Staphylococcus epidermidis
QQDDLESS

SEQ ID NO: 1787764 - protein, 13 aa, Staphylococcus epidermidis
QQDDVSKAHGTAL

SEQ ID NO: 1787765 - protein, 21 aa, Staphylococcus epidermidis
QQDKSSYLSKLNEKKEQLNEI

SEQ ID NO: 1787766 - protein, 12 aa, Staphylococcus epidermidis
QQDLDSLKLEIK

SEQ ID NO: 1787767 - protein, 34 aa, Staphylococcus epidermidis
QQEDEQSAREATEKLEKMKAEKAKQQDNNESTVD

SEQ ID NO: 1787768 - protein, 15 aa, Staphylococcus epidermidis
QQEFGGGKGANQAIA

SEQ ID NO: 1787769 - protein, 5 aa, Staphylococcus epidermidis
QQEHD

SEQ ID NO: 1787770 - protein, 17 aa, Staphylococcus epidermidis
QQEQDNDDSESKQVDPR

SEQ ID NO: 1787771 - protein, 7 aa, Staphylococcus epidermidis
QQESGGI

SEQ ID NO: 1787772 - protein, 14 aa, Staphylococcus epidermidis
QQEWSNGSVGTNGV

SEQ ID NO: 1787773 - protein, 17 aa, Staphylococcus epidermidis
QQGDSAESLGLDGKEEI

SEQ ID NO: 1787774 - protein, 18 aa, Staphylococcus epidermidis
QQGESAETLGLDGKEEIS

SEQ ID NO: 1787775 - protein, 11 aa, Staphylococcus epidermidis
QQGGLSKEVPY

SEQ ID NO: 1787776 - protein, 13 aa, Staphylococcus epidermidis
QQGKNAIEEILEE

SEQ ID NO: 1787777 - protein, 11 aa, Staphylococcus epidermidis
QQGLGRTGTWS

SEQ ID NO: 1787778 - protein, 14 aa, Staphylococcus epidermidis
QQGTTLSGGEAQRV

SEQ ID NO: 1787779 - protein, 6 aa, Staphylococcus epidermidis
QQHGHE

SEQ ID NO: 1787780 - protein, 4 aa, Staphylococcus epidermidis
QQHM

SEQ ID NO: 1787781 - protein, 26 aa, Staphylococcus epidermidis
QQHNNESFKLEKDKEIQIKDNRKTFN

SEQ ID NO: 1787782 - protein, 26 aa, Staphylococcus epidermidis
QQHNNESFKLKEDKEIQIKDNRKTFN

SEQ ID NO: 1787783 - protein, 9 aa, Staphylococcus epidermidis
QQHQGDKFK

SEQ ID NO: 1787784 - protein, 11 aa, Staphylococcus epidermidis
QQIDTKGIDYN

SEQ ID NO: 1787785 - protein, 6 aa, Staphylococcus epidermidis
QQIETK

SEQ ID NO: 1787786 - protein, 15 aa, Staphylococcus epidermidis
QQIETTATVQFNDDI

SEQ ID NO: 1787787 - protein, 4 aa, Staphylococcus epidermidis
QQIG

SEQ ID NO: 1787788 - protein, 8 aa, Staphylococcus epidermidis
QQIGTPEE

SEQ ID NO: 1787789 - protein, 10 aa, Staphylococcus epidermidis
QQIPDEIDSH

SEQ ID NO: 1787790 - protein, 4 aa, Staphylococcus epidermidis
QQIQ

SEQ ID NO: 1787791 - protein, 10 aa, Staphylococcus epidermidis
QQKHSNVLPK

SEQ ID NO: 1787792 - protein, 13 aa, Staphylococcus epidermidis
QQKITSGKHYGAT

SEQ ID NO: 1787793 - protein, 5 aa, Staphylococcus epidermidis
QQKKK

SEQ ID NO: 1787794 - protein, 4 aa, Staphylococcus epidermidis
QQKM

SEQ ID NO: 1787795 - protein, 23 aa, Staphylococcus epidermidis
QQKMNSGSAFNTAEAEKYKEVTS

SEQ ID NO: 1787796 - protein, 18 aa, Staphylococcus epidermidis
QQKRSLKQAKIQNDTNLL

SEQ ID NO: 1787797 - protein, 5 aa, Staphylococcus epidermidis
QQLAS

SEQ ID NO: 1787798 - protein, 7 aa, Staphylococcus epidermidis
QQLDEAY

SEQ ID NO: 1787799 - protein, 6 aa, Staphylococcus epidermidis
QQLDGT

SEQ ID NO: 1787800 - protein, 6 aa, Staphylococcus epidermidis
QQLDQQ

SEQ ID NO: 1787801 - protein, 5 aa, Staphylococcus epidermidis
QQLET

SEQ ID NO: 1787802 - protein, 10 aa, Staphylococcus epidermidis
QQLKDAKDKL

SEQ ID NO: 1787803 - protein, 6 aa, Staphylococcus epidermidis
QQLNSK

SEQ ID NO: 1787804 - protein, 23 aa, Staphylococcus epidermidis
QQLNSTADAVQEQDQQLSNNFGL

SEQ ID NO: 1787805 - protein, 5 aa, Staphylococcus epidermidis
QQLSD

SEQ ID NO: 1787806 - protein, 16 aa, Staphylococcus epidermidis
QQLSDGKISNKLAGGY

SEQ ID NO: 1787807 - protein, 6 aa, Staphylococcus epidermidis
QQLSDI

SEQ ID NO: 1787808 - protein, 5 aa, Staphylococcus epidermidis
QQMKH

SEQ ID NO: 1787809 - protein, 8 aa, Staphylococcus epidermidis
QQNDARKS

SEQ ID NO: 1787810 - protein, 4 aa, Staphylococcus epidermidis
QQNQ

SEQ ID NO: 1787811 - protein, 28 aa, Staphylococcus epidermidis
QQNSVRQSSNYINEDSAPQQAYNDAIND

SEQ ID NO: 1787812 - protein, 6 aa, Staphylococcus epidermidis
QQNTTY

SEQ ID NO: 1787813 - protein, 4 aa, Staphylococcus epidermidis
QQPL

SEQ ID NO: 1787814 - protein, 5 aa, Staphylococcus epidermidis
QQPNH

SEQ ID NO: 1787815 - protein, 13 aa, Staphylococcus epidermidis
QQPRPKVKKIKIF

SEQ ID NO: 1787816 - protein, 6 aa, Staphylococcus epidermidis
QQPTTM

SEQ ID NO: 1787817 - protein, 6 aa, Staphylococcus epidermidis
QQPVGS

SEQ ID NO: 1787818 - protein, 19 aa, Staphylococcus epidermidis
QQQATITKTDISKKTNQYV

SEQ ID NO: 1787819 - protein, 12 aa, Staphylococcus epidermidis
QQQDDEQIQISY

SEQ ID NO: 1787820 - protein, 5 aa, Staphylococcus epidermidis
QQQEL

SEQ ID NO: 1787821 - protein, 5 aa, Staphylococcus epidermidis
QQQLT

SEQ ID NO: 1787822 - protein, 6 aa, Staphylococcus epidermidis
QQQNAD

SEQ ID NO: 1787823 - protein, 7 aa, Staphylococcus epidermidis
QQQNQNY

SEQ ID NO: 1787824 - protein, 6 aa, Staphylococcus epidermidis
QQQRSV

SEQ ID NO: 1787825 - protein, 6 aa, Staphylococcus epidermidis
QQQSNY

SEQ ID NO: 1787826 - protein, 9 aa, Staphylococcus epidermidis
QQQYDEVQT

SEQ ID NO: 1787827 - protein, 14 aa, Staphylococcus epidermidis
QQRGRDMEINTDPE

SEQ ID NO: 1787828 - protein, 9 aa, Staphylococcus epidermidis
QQSDEYKES

SEQ ID NO: 1787829 - protein, 17 aa, Staphylococcus epidermidis
QQSKDIKGTVSQTPHRR

SEQ ID NO: 1787830 - protein, 11 aa, Staphylococcus epidermidis
QQSKQRSNSNV

SEQ ID NO: 1787831 - protein, 40 aa, Staphylococcus epidermidis
QQSNVANGETSLNGTTSSTPSVEQKTEEMLQEKEPEVIPQ

SEQ ID NO: 1787832 - protein, 14 aa, Staphylococcus epidermidis
QQSNYSNEDPNVQT

SEQ ID NO: 1787833 - protein, 7 aa, Staphylococcus epidermidis
QQSPHTK

SEQ ID NO: 1787834 - protein, 9 aa, Staphylococcus epidermidis
QQSSTDQRT

SEQ ID NO: 1787835 - protein, 6 aa, Staphylococcus epidermidis
QQTDKN

SEQ ID NO: 1787836 - protein, 6 aa, Staphylococcus epidermidis
QQTDQD

SEQ ID NO: 1787837 - protein, 27 aa, Staphylococcus epidermidis
QQTGKNYKSTTKKNQTVIRSRTDEGFS

SEQ ID NO: 1787838 - protein, 8 aa, Staphylococcus epidermidis
QQTNARIA

SEQ ID NO: 1787839 - protein, 7 aa, Staphylococcus epidermidis
QQTRPDQ

SEQ ID NO: 1787840 - protein, 4 aa, Staphylococcus epidermidis
QQTT

SEQ ID NO: 1787841 - protein, 30 aa, Staphylococcus epidermidis
QQVGHKDDVHSSSNYFNEDPDKKKAYDDAI

SEQ ID NO: 1787842 - protein, 8 aa, Staphylococcus epidermidis
QQVKQATN

SEQ ID NO: 1787843 - protein, 132 aa, Staphylococcus epidermidis
QQVPQTQQTQQTQQTVQTPQRPTTQTPVRQNPQTGEKRAKEPKTDERKKTRQDSSNSKESPNEKDQSSTQQKPQQNKSNQSSENRQSTQNKSNQTQSTRPQNNGNSGNQNASSGQNTQKQNNNNQNSQSSKK

SEQ ID NO: 1787844 - protein, 6 aa, Staphylococcus epidermidis
QQWPGT

SEQ ID NO: 1787845 - protein, 4 aa, Staphylococcus epidermidis
QQYE

SEQ ID NO: 1787846 - protein, 5 aa, Staphylococcus epidermidis
QQYNK

SEQ ID NO: 1787847 - protein, 6 aa, Staphylococcus epidermidis
QQYVEG

SEQ ID NO: 1787848 - protein, 10 aa, Staphylococcus epidermidis
QRAENNQKIY

SEQ ID NO: 1787849 - protein, 5 aa, Staphylococcus epidermidis
QRAEQ

SEQ ID NO: 1787850 - protein, 5 aa, Staphylococcus epidermidis
QRAIA

SEQ ID NO: 1787851 - protein, 25 aa, Staphylococcus epidermidis
QRDGTPAAKMKDNVPTEVKKERLQR

SEQ ID NO: 1787852 - protein, 11 aa, Staphylococcus epidermidis
QRDLPWRETTN

SEQ ID NO: 1787853 - protein, 8 aa, Staphylococcus epidermidis
QRDTLNQH

SEQ ID NO: 1787854 - protein, 4 aa, Staphylococcus epidermidis
QREN

SEQ ID NO: 1787855 - protein, 5 aa, Staphylococcus epidermidis
QRESI

SEQ ID NO: 1787856 - protein, 10 aa, Staphylococcus epidermidis
QRGNEKARER

SEQ ID NO: 1787857 - protein, 18 aa, Staphylococcus epidermidis
QRHQKSNNFKGERKDIQH

SEQ ID NO: 1787858 - protein, 5 aa, Staphylococcus epidermidis
QRINQ

SEQ ID NO: 1787859 - protein, 4 aa, Staphylococcus epidermidis
QRIQ

SEQ ID NO: 1787860 - protein, 10 aa, Staphylococcus epidermidis
QRKGDDLETR

SEQ ID NO: 1787861 - protein, 10 aa, Staphylococcus epidermidis
QRKGEDLETR

SEQ ID NO: 1787862 - protein, 15 aa, Staphylococcus epidermidis
QRKKQQIQSETIPEL

SEQ ID NO: 1787863 - protein, 5 aa, Staphylococcus epidermidis
QRKNA

SEQ ID NO: 1787864 - protein, 13 aa, Staphylococcus epidermidis
QRKNHKKKKNAQI

SEQ ID NO: 1787865 - protein, 6 aa, Staphylococcus epidermidis
QRKQTS

SEQ ID NO: 1787866 - protein, 5 aa, Staphylococcus epidermidis
QRKRA

SEQ ID NO: 1787867 - protein, 9 aa, Staphylococcus epidermidis
QRLGKSRPY

SEQ ID NO: 1787868 - protein, 5 aa, Staphylococcus epidermidis
QRLRS

SEQ ID NO: 1787869 - protein, 20 aa, Staphylococcus epidermidis
QRLRSQKQTKQTSSDNQLKQ

SEQ ID NO: 1787870 - protein, 8 aa, Staphylococcus epidermidis
QRMPQSKK

SEQ ID NO: 1787871 - protein, 8 aa, Staphylococcus epidermidis
QRNGKKYS

SEQ ID NO: 1787872 - protein, 18 aa, Staphylococcus epidermidis
QRNLGKSRKVTLKSGTKV

SEQ ID NO: 1787873 - protein, 6 aa, Staphylococcus epidermidis
QRNTEV

SEQ ID NO: 1787874 - protein, 4 aa, Staphylococcus epidermidis
QRPI

SEQ ID NO: 1787875 - protein, 5 aa, Staphylococcus epidermidis
QRPLE

SEQ ID NO: 1787876 - protein, 8 aa, Staphylococcus epidermidis
QRPSEVSE

SEQ ID NO: 1787877 - protein, 6 aa, Staphylococcus epidermidis
QRQTAE

SEQ ID NO: 1787878 - protein, 5 aa, Staphylococcus epidermidis
QRRGY

SEQ ID NO: 1787879 - protein, 38 aa, Staphylococcus epidermidis
QRRQQQKHKSDTNFQPKRSTSNRHESTERDTGVTQSDW

SEQ ID NO: 1787880 - protein, 36 aa, Staphylococcus epidermidis
QRRRQQERASDTDIQPKRRTSNRDEATERDTGVTQA

SEQ ID NO: 1787881 - protein, 5 aa, Staphylococcus epidermidis
QRSNY

SEQ ID NO: 1787882 - protein, 23 aa, Staphylococcus epidermidis
QRSQQKKAEQKANHERTQKRSNV

SEQ ID NO: 1787883 - protein, 9 aa, Staphylococcus epidermidis
QRSTPQLRP

SEQ ID NO: 1787884 - protein, 4 aa, Staphylococcus epidermidis
QRTL

SEQ ID NO: 1787885 - protein, 11 aa, Staphylococcus epidermidis
QRTNIEEYEAN

SEQ ID NO: 1787886 - protein, 8 aa, Staphylococcus epidermidis
QRTNQSFE

SEQ ID NO: 1787887 - protein, 13 aa, Staphylococcus epidermidis
QRTSKKQKITRST

SEQ ID NO: 1787888 - protein, 10 aa, Staphylococcus epidermidis
QRVKNGIPSE

SEQ ID NO: 1787889 - protein, 10 aa, Staphylococcus epidermidis
QRYRGRGIGK

SEQ ID NO: 1787890 - protein, 5 aa, Staphylococcus epidermidis
QSAHP

SEQ ID NO: 1787891 - protein, 13 aa, Staphylococcus epidermidis
QSAPRPIPLPNQT

SEQ ID NO: 1787892 - protein, 11 aa, Staphylococcus epidermidis
QSASLPHDQKF

SEQ ID NO: 1787893 - protein, 12 aa, Staphylococcus epidermidis
QSASLPNDQRFE

SEQ ID NO: 1787894 - protein, 10 aa, Staphylococcus epidermidis
QSAVSKGYNM

SEQ ID NO: 1787895 - protein, 5 aa, Staphylococcus epidermidis
QSCKN

SEQ ID NO: 1787896 - protein, 6 aa, Staphylococcus epidermidis
QSDEDV

SEQ ID NO: 1787897 - protein, 7 aa, Staphylococcus epidermidis
QSDEEAV

SEQ ID NO: 1787898 - protein, 9 aa, Staphylococcus epidermidis
QSDGEEQPI

SEQ ID NO: 1787899 - protein, 5 aa, Staphylococcus epidermidis
QSDTF

SEQ ID NO: 1787900 - protein, 10 aa, Staphylococcus epidermidis
QSEAKKANVD

SEQ ID NO: 1787901 - protein, 5 aa, Staphylococcus epidermidis
QSEHE

SEQ ID NO: 1787902 - protein, 4 aa, Staphylococcus epidermidis
QSEN

SEQ ID NO: 1787903 - protein, 5 aa, Staphylococcus epidermidis
QSENF

SEQ ID NO: 1787904 - protein, 7 aa, Staphylococcus epidermidis
QSEQYEI

SEQ ID NO: 1787905 - protein, 4 aa, Staphylococcus epidermidis
QSER

SEQ ID NO: 1787906 - protein, 6 aa, Staphylococcus epidermidis
QSERFD

SEQ ID NO: 1787907 - protein, 12 aa, Staphylococcus epidermidis
QSESGGNAGAHQ

SEQ ID NO: 1787908 - protein, 16 aa, Staphylococcus epidermidis
QSFEKGKNQNLLTDED

SEQ ID NO: 1787909 - protein, 4 aa, Staphylococcus epidermidis
QSFG

SEQ ID NO: 1787910 - protein, 4 aa, Staphylococcus epidermidis
QSFT

SEQ ID NO: 1787911 - protein, 5 aa, Staphylococcus epidermidis
QSGAN

SEQ ID NO: 1787912 - protein, 6 aa, Staphylococcus epidermidis
QSGDFR

SEQ ID NO: 1787913 - protein, 11 aa, Staphylococcus epidermidis
QSGNGSYGDFH

SEQ ID NO: 1787914 - protein, 5 aa, Staphylococcus epidermidis
QSGNN

SEQ ID NO: 1787915 - protein, 7 aa, Staphylococcus epidermidis
QSGQLSG

SEQ ID NO: 1787916 - protein, 7 aa, Staphylococcus epidermidis
QSGSDSV

SEQ ID NO: 1787917 - protein, 9 aa, Staphylococcus epidermidis
QSGSDYSEN

SEQ ID NO: 1787918 - protein, 35 aa, Staphylococcus epidermidis
QSIADKNKTLNSSNYINEDPEKKLAYDNALSKAEQ

SEQ ID NO: 1787919 - protein, 33 aa, Staphylococcus epidermidis
QSIANKDQVKSESKYLNEDPTIKANYDNAVQRA

SEQ ID NO: 1787920 - protein, 20 aa, Staphylococcus epidermidis
QSIDSSLDSLNSKVENLNSS

SEQ ID NO: 1787921 - protein, 16 aa, Staphylococcus epidermidis
QSIEYSDGKPTDNIKG

SEQ ID NO: 1787922 - protein, 4 aa, Staphylococcus epidermidis
QSIQ

SEQ ID NO: 1787923 - protein, 9 aa, Staphylococcus epidermidis
QSISPGLRK

SEQ ID NO: 1787924 - protein, 7 aa, Staphylococcus epidermidis
QSKCSDA

SEQ ID NO: 1787925 - protein, 9 aa, Staphylococcus epidermidis
QSKDEIGDT

SEQ ID NO: 1787926 - protein, 5 aa, Staphylococcus epidermidis
QSKDF

SEQ ID NO: 1787927 - protein, 10 aa, Staphylococcus epidermidis
QSKDMGPVGD

SEQ ID NO: 1787928 - protein, 17 aa, Staphylococcus epidermidis
QSKEITIGNEKVIIKII

SEQ ID NO: 1787929 - protein, 7 aa, Staphylococcus epidermidis
QSKKGPF

SEQ ID NO: 1787930 - protein, 5 aa, Staphylococcus epidermidis
QSKLL

SEQ ID NO: 1787931 - protein, 6 aa, Staphylococcus epidermidis
QSKNEI

SEQ ID NO: 1787932 - protein, 8 aa, Staphylococcus epidermidis
QSKNGDPM

SEQ ID NO: 1787933 - protein, 24 aa, Staphylococcus epidermidis
QSKPSGRTPDDGKNVNGGITQEEF

SEQ ID NO: 1787934 - protein, 12 aa, Staphylococcus epidermidis
QSKSDSAQTPAM

SEQ ID NO: 1787935 - protein, 8 aa, Staphylococcus epidermidis
QSLHESPK

SEQ ID NO: 1787936 - protein, 6 aa, Staphylococcus epidermidis
QSLNDG

SEQ ID NO: 1787937 - protein, 8 aa, Staphylococcus epidermidis
QSLNGTNR

SEQ ID NO: 1787938 - protein, 8 aa, Staphylococcus epidermidis
QSLNNTAQ

SEQ ID NO: 1787939 - protein, 10 aa, Staphylococcus epidermidis
QSLPNQSSQL

SEQ ID NO: 1787940 - protein, 12 aa, Staphylococcus epidermidis
QSLTDFNTPLVR

SEQ ID NO: 1787941 - protein, 9 aa, Staphylococcus epidermidis
QSNGREETY

SEQ ID NO: 1787942 - protein, 7 aa, Staphylococcus epidermidis
QSNHTEM

SEQ ID NO: 1787943 - protein, 4 aa, Staphylococcus epidermidis
QSNI

SEQ ID NO: 1787944 - protein, 5 aa, Staphylococcus epidermidis
QSNLK

SEQ ID NO: 1787945 - protein, 19 aa, Staphylococcus epidermidis
QSNLKSITKAYDSKEDLEK

SEQ ID NO: 1787946 - protein, 13 aa, Staphylococcus epidermidis
QSNQEEVNYSSDP

SEQ ID NO: 1787947 - protein, 5 aa, Staphylococcus epidermidis
QSNSY

SEQ ID NO: 1787948 - protein, 11 aa, Staphylococcus epidermidis
QSNYDNQHGNP

SEQ ID NO: 1787949 - protein, 5 aa, Staphylococcus epidermidis
QSPEK

SEQ ID NO: 1787950 - protein, 6 aa, Staphylococcus epidermidis
QSPFEQ

SEQ ID NO: 1787951 - protein, 7 aa, Staphylococcus epidermidis
QSPQELI

SEQ ID NO: 1787952 - protein, 8 aa, Staphylococcus epidermidis
QSPVNAKR

SEQ ID NO: 1787953 - protein, 5 aa, Staphylococcus epidermidis
QSQAL

SEQ ID NO: 1787954 - protein, 8 aa, Staphylococcus epidermidis
QSQATNMD

SEQ ID NO: 1787955 - protein, 6 aa, Staphylococcus epidermidis
QSQCEE

SEQ ID NO: 1787956 - protein, 8 aa, Staphylococcus epidermidis
QSQGRDNV

SEQ ID NO: 1787957 - protein, 5 aa, Staphylococcus epidermidis
QSQHD

SEQ ID NO: 1787958 - protein, 9 aa, Staphylococcus epidermidis
QSQIDKQDI

SEQ ID NO: 1787959 - protein, 7 aa, Staphylococcus epidermidis
QSQPLGR

SEQ ID NO: 1787960 - protein, 8 aa, Staphylococcus epidermidis
QSQPNTVE

SEQ ID NO: 1787961 - protein, 7 aa, Staphylococcus epidermidis
QSQSDEM

SEQ ID NO: 1787962 - protein, 24 aa, Staphylococcus epidermidis
QSQTSTGKALNKRHNLKENPRTTS

SEQ ID NO: 1787963 - protein, 4 aa, Staphylococcus epidermidis
QSRK

SEQ ID NO: 1787964 - protein, 12 aa, Staphylococcus epidermidis
QSRKRTHRIGQE

SEQ ID NO: 1787965 - protein, 10 aa, Staphylococcus epidermidis
QSSDNITASQ

SEQ ID NO: 1787966 - protein, 6 aa, Staphylococcus epidermidis
QSSDYS

SEQ ID NO: 1787967 - protein, 15 aa, Staphylococcus epidermidis
QSSIEEDIEEDPRED

SEQ ID NO: 1787968 - protein, 9 aa, Staphylococcus epidermidis
QSSKNDVQY

SEQ ID NO: 1787969 - protein, 5 aa, Staphylococcus epidermidis
QSSQM

SEQ ID NO: 1787970 - protein, 7 aa, Staphylococcus epidermidis
QSSSEHR

SEQ ID NO: 1787971 - protein, 14 aa, Staphylococcus epidermidis
QSSSKNENAPLSNE

SEQ ID NO: 1787972 - protein, 4 aa, Staphylococcus epidermidis
QSTF

SEQ ID NO: 1787973 - protein, 7 aa, Staphylococcus epidermidis
QSTLQEV

SEQ ID NO: 1787974 - protein, 5 aa, Staphylococcus epidermidis
QSTYV

SEQ ID NO: 1787975 - protein, 6 aa, Staphylococcus epidermidis
QSVEEE

SEQ ID NO: 1787976 - protein, 11 aa, Staphylococcus epidermidis
QSVGQQFEHPT

SEQ ID NO: 1787977 - protein, 18 aa, Staphylococcus epidermidis
QSVNVDKKESYNTTMGDE

SEQ ID NO: 1787978 - protein, 5 aa, Staphylococcus epidermidis
QSVQD

SEQ ID NO: 1787979 - protein, 4 aa, Staphylococcus epidermidis
QSVR

SEQ ID NO: 1787980 - protein, 32 aa, Staphylococcus epidermidis
QSYADDTKDMVATKGRASYFKEDSKGYIDPGA

SEQ ID NO: 1787981 - protein, 6 aa, Staphylococcus epidermidis
QSYHPT

SEQ ID NO: 1787982 - protein, 4 aa, Staphylococcus epidermidis
QSYT

SEQ ID NO: 1787983 - protein, 5 aa, Staphylococcus epidermidis
QSYVE

SEQ ID NO: 1787984 - protein, 9 aa, Staphylococcus epidermidis
QTDAPQSDF

SEQ ID NO: 1787985 - protein, 8 aa, Staphylococcus epidermidis
QTDEQGIE

SEQ ID NO: 1787986 - protein, 6 aa, Staphylococcus epidermidis
QTDERR

SEQ ID NO: 1787987 - protein, 48 aa, Staphylococcus epidermidis
QTDITTKLESNAQSLKSIQNSQEAIQSAQEQQSKDIAKANELKDSELR

SEQ ID NO: 1787988 - protein, 13 aa, Staphylococcus epidermidis
QTDSRLSSDIFKE

SEQ ID NO: 1787989 - protein, 9 aa, Staphylococcus epidermidis
QTDVPESSD

SEQ ID NO: 1787990 - protein, 4 aa, Staphylococcus epidermidis
QTEA

SEQ ID NO: 1787991 - protein, 7 aa, Staphylococcus epidermidis
QTEATID

SEQ ID NO: 1787992 - protein, 6 aa, Staphylococcus epidermidis
QTEDEI

SEQ ID NO: 1787993 - protein, 13 aa, Staphylococcus epidermidis
QTEDQVEANVQGL

SEQ ID NO: 1787994 - protein, 5 aa, Staphylococcus epidermidis
QTEEE

SEQ ID NO: 1787995 - protein, 7 aa, Staphylococcus epidermidis
QTEETLE

SEQ ID NO: 1787996 - protein, 149 aa, Staphylococcus epidermidis
QTEITSKIDANTESLKSIQTSQEAIQSSQEKQANEIAKTNHKSNESTQSLNNNKSSESNSNSQSEQESTSEAPSTSDSDSHSESAVASTSETTSTSQSSSLSTRTSEISNSTSNDSTSNSDMTTTEDHSQSSNNQPKEEKKGFFARLFN

SEQ ID NO: 1787997 - protein, 5 aa, Staphylococcus epidermidis
QTEMW

SEQ ID NO: 1787998 - protein, 6 aa, Staphylococcus epidermidis
QTENDH

SEQ ID NO: 1787999 - protein, 9 aa, Staphylococcus epidermidis
QTEPTFEEK

SEQ ID NO: 1788000 - protein, 6 aa, Staphylococcus epidermidis
QTEQYR

SEQ ID NO: 1788001 - protein, 8 aa, Staphylococcus epidermidis
QTFDQGEA

SEQ ID NO: 1788002 - protein, 7 aa, Staphylococcus epidermidis
QTFKPKQ

SEQ ID NO: 1788003 - protein, 4 aa, Staphylococcus epidermidis
QTFT

SEQ ID NO: 1788004 - protein, 5 aa, Staphylococcus epidermidis
QTGAF

SEQ ID NO: 1788005 - protein, 15 aa, Staphylococcus epidermidis
QTGGYSTTYKPISKD

SEQ ID NO: 1788006 - protein, 8 aa, Staphylococcus epidermidis
QTGIGRTG

SEQ ID NO: 1788007 - protein, 6 aa, Staphylococcus epidermidis
QTGITN

SEQ ID NO: 1788008 - protein, 9 aa, Staphylococcus epidermidis
QTGSGKSTL

SEQ ID NO: 1788009 - protein, 19 aa, Staphylococcus epidermidis
QTGVHGTEADSYDGNLGQK

SEQ ID NO: 1788010 - protein, 8 aa, Staphylococcus epidermidis
QTGYQKPM

SEQ ID NO: 1788011 - protein, 5 aa, Staphylococcus epidermidis
QTHQT

SEQ ID NO: 1788012 - protein, 4 aa, Staphylococcus epidermidis
QTID

SEQ ID NO: 1788013 - protein, 4 aa, Staphylococcus epidermidis
QTIE

SEQ ID NO: 1788014 - protein, 15 aa, Staphylococcus epidermidis
QTIRSSGFYKNKGKA

SEQ ID NO: 1788015 - protein, 5 aa, Staphylococcus epidermidis
QTISS

SEQ ID NO: 1788016 - protein, 9 aa, Staphylococcus epidermidis
QTKANLKSR

SEQ ID NO: 1788017 - protein, 10 aa, Staphylococcus epidermidis
QTKDVPPTHS

SEQ ID NO: 1788018 - protein, 7 aa, Staphylococcus epidermidis
QTKPKNL

SEQ ID NO: 1788019 - protein, 4 aa, Staphylococcus epidermidis
QTKQ

SEQ ID NO: 1788020 - protein, 16 aa, Staphylococcus epidermidis
QTKQKEQIEKEAKQYW

SEQ ID NO: 1788021 - protein, 17 aa, Staphylococcus epidermidis
QTKSPDNIKKDLDKKKE

SEQ ID NO: 1788022 - protein, 17 aa, Staphylococcus epidermidis
QTKTPDEIKKDLDKKKE

SEQ ID NO: 1788023 - protein, 7 aa, Staphylococcus epidermidis
QTLEENY

SEQ ID NO: 1788024 - protein, 4 aa, Staphylococcus epidermidis
QTNE

SEQ ID NO: 1788025 - protein, 7 aa, Staphylococcus epidermidis
QTNNEQG

SEQ ID NO: 1788026 - protein, 11 aa, Staphylococcus epidermidis
QTNNQSANAID

SEQ ID NO: 1788027 - protein, 8 aa, Staphylococcus epidermidis
QTNPEMDP

SEQ ID NO: 1788028 - protein, 8 aa, Staphylococcus epidermidis
QTNSPRRY

SEQ ID NO: 1788029 - protein, 7 aa, Staphylococcus epidermidis
QTPLQSS

SEQ ID NO: 1788030 - protein, 4 aa, Staphylococcus epidermidis
QTQD

SEQ ID NO: 1788031 - protein, 20 aa, Staphylococcus epidermidis
QTQGKKKPIQKHKKINPKRL

SEQ ID NO: 1788032 - protein, 4 aa, Staphylococcus epidermidis
QTQK

SEQ ID NO: 1788033 - protein, 7 aa, Staphylococcus epidermidis
QTQPLGR

SEQ ID NO: 1788034 - protein, 15 aa, Staphylococcus epidermidis
QTQSVHSKDITGNEA

SEQ ID NO: 1788035 - protein, 12 aa, Staphylococcus epidermidis
QTQTDFNTPIIR

SEQ ID NO: 1788036 - protein, 9 aa, Staphylococcus epidermidis
QTQTGQTYT

SEQ ID NO: 1788037 - protein, 6 aa, Staphylococcus epidermidis
QTQVTE

SEQ ID NO: 1788038 - protein, 8 aa, Staphylococcus epidermidis
QTRANGNR

SEQ ID NO: 1788039 - protein, 6 aa, Staphylococcus epidermidis
QTRRNI

SEQ ID NO: 1788040 - protein, 4 aa, Staphylococcus epidermidis
QTSE

SEQ ID NO: 1788041 - protein, 10 aa, Staphylococcus epidermidis
QTSHQNQNKI

SEQ ID NO: 1788042 - protein, 7 aa, Staphylococcus epidermidis
QTSNNRI

SEQ ID NO: 1788043 - protein, 5 aa, Staphylococcus epidermidis
QTTDD

SEQ ID NO: 1788044 - protein, 7 aa, Staphylococcus epidermidis
QTTQDDV

SEQ ID NO: 1788045 - protein, 5 aa, Staphylococcus epidermidis
QTTTF

SEQ ID NO: 1788046 - protein, 14 aa, Staphylococcus epidermidis
QTVANNFETIIMKN

SEQ ID NO: 1788047 - protein, 6 aa, Staphylococcus epidermidis
QTVESG

SEQ ID NO: 1788048 - protein, 6 aa, Staphylococcus epidermidis
QTVGIG

SEQ ID NO: 1788049 - protein, 5 aa, Staphylococcus epidermidis
QTVGK

SEQ ID NO: 1788050 - protein, 6 aa, Staphylococcus epidermidis
QTVKTV

SEQ ID NO: 1788051 - protein, 17 aa, Staphylococcus epidermidis
QTVRESAKSNKSKSYTQ

SEQ ID NO: 1788052 - protein, 12 aa, Staphylococcus epidermidis
QTVTRNKKQSLR

SEQ ID NO: 1788053 - protein, 9 aa, Staphylococcus epidermidis
QTYGGSDEA

SEQ ID NO: 1788054 - protein, 7 aa, Staphylococcus epidermidis
QTYQATT

SEQ ID NO: 1788055 - protein, 5 aa, Staphylococcus epidermidis
QVAAE

SEQ ID NO: 1788056 - protein, 29 aa, Staphylococcus epidermidis
QVAKDGINSGLDNAKDAWKKTTSAFKMNF

SEQ ID NO: 1788057 - protein, 11 aa, Staphylococcus epidermidis
QVDKNNNDNHL

SEQ ID NO: 1788058 - protein, 8 aa, Staphylococcus epidermidis
QVDKTSTE

SEQ ID NO: 1788059 - protein, 4 aa, Staphylococcus epidermidis
QVDL

SEQ ID NO: 1788060 - protein, 11 aa, Staphylococcus epidermidis
QVDNESADILT

SEQ ID NO: 1788061 - protein, 7 aa, Staphylococcus epidermidis
QVDPEEL

SEQ ID NO: 1788062 - protein, 11 aa, Staphylococcus epidermidis
QVDRNNNDNHL

SEQ ID NO: 1788063 - protein, 6 aa, Staphylococcus epidermidis
QVDYDG

SEQ ID NO: 1788064 - protein, 9 aa, Staphylococcus epidermidis
QVENSDGEA

SEQ ID NO: 1788065 - protein, 4 aa, Staphylococcus epidermidis
QVET

SEQ ID NO: 1788066 - protein, 13 aa, Staphylococcus epidermidis
QVKAKIVKKNQIT

SEQ ID NO: 1788067 - protein, 9 aa, Staphylococcus epidermidis
QVKNQEGKV

SEQ ID NO: 1788068 - protein, 5 aa, Staphylococcus epidermidis
QVNAA

SEQ ID NO: 1788069 - protein, 10 aa, Staphylococcus epidermidis
QVNSLSDQVK

SEQ ID NO: 1788070 - protein, 7 aa, Staphylococcus epidermidis
QVPDTVE

SEQ ID NO: 1788071 - protein, 11 aa, Staphylococcus epidermidis
QVPISSITGSV

SEQ ID NO: 1788072 - protein, 9 aa, Staphylococcus epidermidis
QVPRSEMDK

SEQ ID NO: 1788073 - protein, 5 aa, Staphylococcus epidermidis
QVQDI

SEQ ID NO: 1788074 - protein, 13 aa, Staphylococcus epidermidis
QVRPRSGKSLKTK

SEQ ID NO: 1788075 - protein, 23 aa, Staphylococcus epidermidis
QVSTPTKDSNAGIEYSNPKDKVE

SEQ ID NO: 1788076 - protein, 5 aa, Staphylococcus epidermidis
QVTKE

SEQ ID NO: 1788077 - protein, 11 aa, Staphylococcus epidermidis
QVTQQPTQPIT

SEQ ID NO: 1788078 - protein, 19 aa, Staphylococcus epidermidis
QWDQYSKEELHEKEDESHV

SEQ ID NO: 1788079 - protein, 11 aa, Staphylococcus epidermidis
QWETTGNQAMR

SEQ ID NO: 1788080 - protein, 4 aa, Staphylococcus epidermidis
QWRM

SEQ ID NO: 1788081 - protein, 22 aa, Staphylococcus epidermidis
QYADTQVKTSISNARSTYNNSL

SEQ ID NO: 1788082 - protein, 15 aa, Staphylococcus epidermidis
QYAEEPKIIMNVEEV

SEQ ID NO: 1788083 - protein, 8 aa, Staphylococcus epidermidis
QYDDKTDE

SEQ ID NO: 1788084 - protein, 14 aa, Staphylococcus epidermidis
QYDEYKTQLEEVLA

SEQ ID NO: 1788085 - protein, 10 aa, Staphylococcus epidermidis
QYDGEIPDYP

SEQ ID NO: 1788086 - protein, 10 aa, Staphylococcus epidermidis
QYDKQDPGNL

SEQ ID NO: 1788087 - protein, 7 aa, Staphylococcus epidermidis
QYDSEKL

SEQ ID NO: 1788088 - protein, 8 aa, Staphylococcus epidermidis
QYEKPNVD

SEQ ID NO: 1788089 - protein, 16 aa, Staphylococcus epidermidis
QYENEATLKYGDTKYY

SEQ ID NO: 1788090 - protein, 7 aa, Staphylococcus epidermidis
QYENSNF

SEQ ID NO: 1788091 - protein, 4 aa, Staphylococcus epidermidis
QYEQ

SEQ ID NO: 1788092 - protein, 11 aa, Staphylococcus epidermidis
QYEVGENTSPI

SEQ ID NO: 1788093 - protein, 4 aa, Staphylococcus epidermidis
QYGN

SEQ ID NO: 1788094 - protein, 15 aa, Staphylococcus epidermidis
QYGTKVDISTSKNVG

SEQ ID NO: 1788095 - protein, 6 aa, Staphylococcus epidermidis
QYGTPE

SEQ ID NO: 1788096 - protein, 8 aa, Staphylococcus epidermidis
QYHPSQQT

SEQ ID NO: 1788097 - protein, 4 aa, Staphylococcus epidermidis
QYIG

SEQ ID NO: 1788098 - protein, 12 aa, Staphylococcus epidermidis
QYIKNPKSQRTK

SEQ ID NO: 1788099 - protein, 6 aa, Staphylococcus epidermidis
QYKEKN

SEQ ID NO: 1788100 - protein, 6 aa, Staphylococcus epidermidis
QYKENK

SEQ ID NO: 1788101 - protein, 4 aa, Staphylococcus epidermidis
QYKQ

SEQ ID NO: 1788102 - protein, 29 aa, Staphylococcus epidermidis
QYNDEVKNGTFPSEQHTYKKKIMDEVETN

SEQ ID NO: 1788103 - protein, 12 aa, Staphylococcus epidermidis
QYNEDNRQLDNR

SEQ ID NO: 1788104 - protein, 29 aa, Staphylococcus epidermidis
QYNEEVKAGAFPSEKHTYKKRIMDEVEQH

SEQ ID NO: 1788105 - protein, 4 aa, Staphylococcus epidermidis
QYNN

SEQ ID NO: 1788106 - protein, 13 aa, Staphylococcus epidermidis
QYNSHSETGTTKF

SEQ ID NO: 1788107 - protein, 5 aa, Staphylococcus epidermidis
QYNVN

SEQ ID NO: 1788108 - protein, 11 aa, Staphylococcus epidermidis
QYPGAPGSGGI

SEQ ID NO: 1788109 - protein, 4 aa, Staphylococcus epidermidis
QYPH

SEQ ID NO: 1788110 - protein, 4 aa, Staphylococcus epidermidis
QYPM

SEQ ID NO: 1788111 - protein, 4 aa, Staphylococcus epidermidis
QYPN

SEQ ID NO: 1788112 - protein, 8 aa, Staphylococcus epidermidis
QYQATKDI

SEQ ID NO: 1788113 - protein, 14 aa, Staphylococcus epidermidis
QYQNCAPSREHPHE

SEQ ID NO: 1788114 - protein, 8 aa, Staphylococcus epidermidis
QYQSDSAF

SEQ ID NO: 1788115 - protein, 6 aa, Staphylococcus epidermidis
QYRNNE

SEQ ID NO: 1788116 - protein, 5 aa, Staphylococcus epidermidis
QYRSE

SEQ ID NO: 1788117 - protein, 4 aa, Staphylococcus epidermidis
QYSE

SEQ ID NO: 1788118 - protein, 21 aa, Staphylococcus epidermidis
QYSEREQSLRRYDSRSFEAQG

SEQ ID NO: 1788119 - protein, 22 aa, Staphylococcus epidermidis
QYSEREQSLRRYDSRSFEDQGL

SEQ ID NO: 1788120 - protein, 5 aa, Staphylococcus epidermidis
QYSKG

SEQ ID NO: 1788121 - protein, 6 aa, Staphylococcus epidermidis
QYSTSG

SEQ ID NO: 1788122 - protein, 7 aa, Staphylococcus epidermidis
QYTESDI

SEQ ID NO: 1788123 - protein, 8 aa, Staphylococcus epidermidis
QYTNTDIK

SEQ ID NO: 1788124 - protein, 4 aa, Staphylococcus epidermidis
QYWD

SEQ ID NO: 1788125 - protein, 5 aa, Staphylococcus epidermidis
RADDL

SEQ ID NO: 1788126 - protein, 6 aa, Staphylococcus epidermidis
RADNTI

SEQ ID NO: 1788127 - protein, 9 aa, Staphylococcus epidermidis
RAEDGRSIE

SEQ ID NO: 1788128 - protein, 11 aa, Staphylococcus epidermidis
RAFDPSAKVGK

SEQ ID NO: 1788129 - protein, 8 aa, Staphylococcus epidermidis
RAGIESSQ

SEQ ID NO: 1788130 - protein, 12 aa, Staphylococcus epidermidis
RAHSETDIADNA

SEQ ID NO: 1788131 - protein, 15 aa, Staphylococcus epidermidis
RAKATYKFAGGKGIN

SEQ ID NO: 1788132 - protein, 9 aa, Staphylococcus epidermidis
RAKDEAGDI

SEQ ID NO: 1788133 - protein, 14 aa, Staphylococcus epidermidis
RAKSQSYGNGSEQI

SEQ ID NO: 1788134 - protein, 13 aa, Staphylococcus epidermidis
RAKSQSYGQGSEQ

SEQ ID NO: 1788135 - protein, 15 aa, Staphylococcus epidermidis
RAKTAISTDAENKNE

SEQ ID NO: 1788136 - protein, 13 aa, Staphylococcus epidermidis
RAKTAQDTADGKR

SEQ ID NO: 1788137 - protein, 11 aa, Staphylococcus epidermidis
RAKTDNKSLTA

SEQ ID NO: 1788138 - protein, 5 aa, Staphylococcus epidermidis
RAKTM

SEQ ID NO: 1788139 - protein, 5 aa, Staphylococcus epidermidis
RALEG

SEQ ID NO: 1788140 - protein, 5 aa, Staphylococcus epidermidis
RALEN

SEQ ID NO: 1788141 - protein, 4 aa, Staphylococcus epidermidis
RALT

SEQ ID NO: 1788142 - protein, 9 aa, Staphylococcus epidermidis
RAMSGKGRF

SEQ ID NO: 1788143 - protein, 6 aa, Staphylococcus epidermidis
RANDKK

SEQ ID NO: 1788144 - protein, 9 aa, Staphylococcus epidermidis
RANDPEEEV

SEQ ID NO: 1788145 - protein, 7 aa, Staphylococcus epidermidis
RANDQKY

SEQ ID NO: 1788146 - protein, 9 aa, Staphylococcus epidermidis
RANENEDAW

SEQ ID NO: 1788147 - protein, 29 aa, Staphylococcus epidermidis
RANKKGIRLSGTEANIKGLKEEVKKQQTL

SEQ ID NO: 1788148 - protein, 14 aa, Staphylococcus epidermidis
RANTNNKSNTGALI

SEQ ID NO: 1788149 - protein, 7 aa, Staphylococcus epidermidis
RANVDQA

SEQ ID NO: 1788150 - protein, 5 aa, Staphylococcus epidermidis
RANVQ

SEQ ID NO: 1788151 - protein, 7 aa, Staphylococcus epidermidis
RAPEKVQ

SEQ ID NO: 1788152 - protein, 16 aa, Staphylococcus epidermidis
RAPGSVGMASDASRVF

SEQ ID NO: 1788153 - protein, 7 aa, Staphylococcus epidermidis
RAQDGHT

SEQ ID NO: 1788154 - protein, 6 aa, Staphylococcus epidermidis
RAQDKG

SEQ ID NO: 1788155 - protein, 6 aa, Staphylococcus epidermidis
RAQGEI

SEQ ID NO: 1788156 - protein, 8 aa, Staphylococcus epidermidis
RAQKEKYD

SEQ ID NO: 1788157 - protein, 6 aa, Staphylococcus epidermidis
RAQSKD

SEQ ID NO: 1788158 - protein, 11 aa, Staphylococcus epidermidis
RAQSPTRASTD

SEQ ID NO: 1788159 - protein, 22 aa, Staphylococcus epidermidis
RAQSTPVYDRHDKTEKRSKDEI

SEQ ID NO: 1788160 - protein, 5 aa, Staphylococcus epidermidis
RAQTS

SEQ ID NO: 1788161 - protein, 4 aa, Staphylococcus epidermidis
RARE

SEQ ID NO: 1788162 - protein, 10 aa, Staphylococcus epidermidis
RARKVRDEDF

SEQ ID NO: 1788163 - protein, 11 aa, Staphylococcus epidermidis
RASKIDDDLDQ

SEQ ID NO: 1788164 - protein, 5 aa, Staphylococcus epidermidis
RASLI

SEQ ID NO: 1788165 - protein, 9 aa, Staphylococcus epidermidis
RATETNNNG

SEQ ID NO: 1788166 - protein, 14 aa, Staphylococcus epidermidis
RATSKKLASLIKED

SEQ ID NO: 1788167 - protein, 7 aa, Staphylococcus epidermidis
RATTRKE

SEQ ID NO: 1788168 - protein, 7 aa, Staphylococcus epidermidis
RAVAERA

SEQ ID NO: 1788169 - protein, 9 aa, Staphylococcus epidermidis
RAVGTDGSI

SEQ ID NO: 1788170 - protein, 7 aa, Staphylococcus epidermidis
RAVKSNS

SEQ ID NO: 1788171 - protein, 4 aa, Staphylococcus epidermidis
RCDE

SEQ ID NO: 1788172 - protein, 6 aa, Staphylococcus epidermidis
RDAGAD

SEQ ID NO: 1788173 - protein, 19 aa, Staphylococcus epidermidis
RDANAKEGNEYIKKDKEDL

SEQ ID NO: 1788174 - protein, 8 aa, Staphylococcus epidermidis
RDDARNIA

SEQ ID NO: 1788175 - protein, 7 aa, Staphylococcus epidermidis
RDDDKAV

SEQ ID NO: 1788176 - protein, 6 aa, Staphylococcus epidermidis
RDDDTD

SEQ ID NO: 1788177 - protein, 8 aa, Staphylococcus epidermidis
RDDRQLKN

SEQ ID NO: 1788178 - protein, 6 aa, Staphylococcus epidermidis
RDDSLD

SEQ ID NO: 1788179 - protein, 9 aa, Staphylococcus epidermidis
RDDTERVKT

SEQ ID NO: 1788180 - protein, 5 aa, Staphylococcus epidermidis
RDENL

SEQ ID NO: 1788181 - protein, 7 aa, Staphylococcus epidermidis
RDFEEGQ

SEQ ID NO: 1788182 - protein, 4 aa, Staphylococcus epidermidis
RDFN

SEQ ID NO: 1788183 - protein, 5 aa, Staphylococcus epidermidis
RDFTE

SEQ ID NO: 1788184 - protein, 5 aa, Staphylococcus epidermidis
RDGEI

SEQ ID NO: 1788185 - protein, 7 aa, Staphylococcus epidermidis
RDGFSTH

SEQ ID NO: 1788186 - protein, 9 aa, Staphylococcus epidermidis
RDGFTTPEY

SEQ ID NO: 1788187 - protein, 13 aa, Staphylococcus epidermidis
RDGRARVSVGARS

SEQ ID NO: 1788188 - protein, 14 aa, Staphylococcus epidermidis
RDGVKTENKSYSAI

SEQ ID NO: 1788189 - protein, 6 aa, Staphylococcus epidermidis
RDHEDI

SEQ ID NO: 1788190 - protein, 5 aa, Staphylococcus epidermidis
RDKDI

SEQ ID NO: 1788191 - protein, 14 aa, Staphylococcus epidermidis
RDKIENKKTHTSNF

SEQ ID NO: 1788192 - protein, 11 aa, Staphylococcus epidermidis
RDKLNQYTHEQ

SEQ ID NO: 1788193 - protein, 12 aa, Staphylococcus epidermidis
RDKYSDLNVSYI

SEQ ID NO: 1788194 - protein, 5 aa, Staphylococcus epidermidis
RDKYT

SEQ ID NO: 1788195 - protein, 8 aa, Staphylococcus epidermidis
RDLKGDQT

SEQ ID NO: 1788196 - protein, 19 aa, Staphylococcus epidermidis
RDLNAERDLNATYVTFQIF

SEQ ID NO: 1788197 - protein, 8 aa, Staphylococcus epidermidis
RDLNRDWS

SEQ ID NO: 1788198 - protein, 6 aa, Staphylococcus epidermidis
RDMPWR

SEQ ID NO: 1788199 - protein, 16 aa, Staphylococcus epidermidis
RDNGETFKTGITPEGI

SEQ ID NO: 1788200 - protein, 8 aa, Staphylococcus epidermidis
RDNKPGVS

SEQ ID NO: 1788201 - protein, 5 aa, Staphylococcus epidermidis
RDNNH

SEQ ID NO: 1788202 - protein, 7 aa, Staphylococcus epidermidis
RDNNRNV

SEQ ID NO: 1788203 - protein, 10 aa, Staphylococcus epidermidis
RDNPKLKGKP

SEQ ID NO: 1788204 - protein, 10 aa, Staphylococcus epidermidis
RDNSAKPELA

SEQ ID NO: 1788205 - protein, 16 aa, Staphylococcus epidermidis
RDNSSHDEVEDHNAAY

SEQ ID NO: 1788206 - protein, 6 aa, Staphylococcus epidermidis
RDPDAR

SEQ ID NO: 1788207 - protein, 12 aa, Staphylococcus epidermidis
RDPEDKEKYMDD

SEQ ID NO: 1788208 - protein, 10 aa, Staphylococcus epidermidis
RDPQASVGRG

SEQ ID NO: 1788209 - protein, 6 aa, Staphylococcus epidermidis
RDPTWN

SEQ ID NO: 1788210 - protein, 9 aa, Staphylococcus epidermidis
RDPVNGENK

SEQ ID NO: 1788211 - protein, 8 aa, Staphylococcus epidermidis
RDQFSEDR

SEQ ID NO: 1788212 - protein, 5 aa, Staphylococcus epidermidis
RDQMK

SEQ ID NO: 1788213 - protein, 7 aa, Staphylococcus epidermidis
RDQVEES

SEQ ID NO: 1788214 - protein, 6 aa, Staphylococcus epidermidis
RDRSEV

SEQ ID NO: 1788215 - protein, 11 aa, Staphylococcus epidermidis
RDSIYDYKTGN

SEQ ID NO: 1788216 - protein, 4 aa, Staphylococcus epidermidis
RDTF

SEQ ID NO: 1788217 - protein, 6 aa, Staphylococcus epidermidis
RDTITD

SEQ ID NO: 1788218 - protein, 10 aa, Staphylococcus epidermidis
RDTKERGRSM

SEQ ID NO: 1788219 - protein, 4 aa, Staphylococcus epidermidis
RDTL

SEQ ID NO: 1788220 - protein, 11 aa, Staphylococcus epidermidis
RDTLNGRKTVE

SEQ ID NO: 1788221 - protein, 8 aa, Staphylococcus epidermidis
RDTRVSGE

SEQ ID NO: 1788222 - protein, 7 aa, Staphylococcus epidermidis
RDVADKA

SEQ ID NO: 1788223 - protein, 7 aa, Staphylococcus epidermidis
RDYAESR

SEQ ID NO: 1788224 - protein, 7 aa, Staphylococcus epidermidis
RDYGTGH

SEQ ID NO: 1788225 - protein, 8 aa, Staphylococcus epidermidis
RDYGTGNM

SEQ ID NO: 1788226 - protein, 8 aa, Staphylococcus epidermidis
REAEDPFT

SEQ ID NO: 1788227 - protein, 17 aa, Staphylococcus epidermidis
REAGTVKGKKSGKFATS

SEQ ID NO: 1788228 - protein, 5 aa, Staphylococcus epidermidis
REAHT

SEQ ID NO: 1788229 - protein, 4 aa, Staphylococcus epidermidis
REAN

SEQ ID NO: 1788230 - protein, 11 aa, Staphylococcus epidermidis
REAQNNAYAPY

SEQ ID NO: 1788231 - protein, 8 aa, Staphylococcus epidermidis
REARKKQL

SEQ ID NO: 1788232 - protein, 7 aa, Staphylococcus epidermidis
REASRIG

SEQ ID NO: 1788233 - protein, 7 aa, Staphylococcus epidermidis
RECKKGN

SEQ ID NO: 1788234 - protein, 6 aa, Staphylococcus epidermidis
REDGGD

SEQ ID NO: 1788235 - protein, 4 aa, Staphylococcus epidermidis
REDK

SEQ ID NO: 1788236 - protein, 7 aa, Staphylococcus epidermidis
REDPTYE

SEQ ID NO: 1788237 - protein, 6 aa, Staphylococcus epidermidis
REEAVT

SEQ ID NO: 1788238 - protein, 16 aa, Staphylococcus epidermidis
REEAYDKVQPKAMESW

SEQ ID NO: 1788239 - protein, 6 aa, Staphylococcus epidermidis
REEAYQ

SEQ ID NO: 1788240 - protein, 29 aa, Staphylococcus epidermidis
REEEFSPLKNKEGKDSVETATEDLKRMGL

SEQ ID NO: 1788241 - protein, 19 aa, Staphylococcus epidermidis
REEEFSPLKNKEGKDSVHT

SEQ ID NO: 1788242 - protein, 12 aa, Staphylococcus epidermidis
REEGGSEGYRTD

SEQ ID NO: 1788243 - protein, 10 aa, Staphylococcus epidermidis
REEGKISEED

SEQ ID NO: 1788244 - protein, 5 aa, Staphylococcus epidermidis
REELH

SEQ ID NO: 1788245 - protein, 8 aa, Staphylococcus epidermidis
REENGPIK

SEQ ID NO: 1788246 - protein, 13 aa, Staphylococcus epidermidis
REENGPIKHNKEI

SEQ ID NO: 1788247 - protein, 6 aa, Staphylococcus epidermidis
REEQSI

SEQ ID NO: 1788248 - protein, 6 aa, Staphylococcus epidermidis
REETEN

SEQ ID NO: 1788249 - protein, 5 aa, Staphylococcus epidermidis
REEVD

SEQ ID NO: 1788250 - protein, 14 aa, Staphylococcus epidermidis
REFDPNLAPGTEKV

SEQ ID NO: 1788251 - protein, 85 aa, Staphylococcus epidermidis
REFNPDLKPGEERVKQKGEPGTKTITTPTTKNPLTGEKVGEGEPTEKITKQPVDEITEYGGEEIKPGHKDEFDPNAPKGSQEDAT

SEQ ID NO: 1788252 - protein, 4 aa, Staphylococcus epidermidis
REFS

SEQ ID NO: 1788253 - protein, 14 aa, Staphylococcus epidermidis
REGKEPLKPNSNLS

SEQ ID NO: 1788254 - protein, 8 aa, Staphylococcus epidermidis
REGKNIKE

SEQ ID NO: 1788255 - protein, 9 aa, Staphylococcus epidermidis
REGKTRENY

SEQ ID NO: 1788256 - protein, 10 aa, Staphylococcus epidermidis
REGQNDQDAI

SEQ ID NO: 1788257 - protein, 7 aa, Staphylococcus epidermidis
REGSHHH

SEQ ID NO: 1788258 - protein, 4 aa, Staphylococcus epidermidis
REGY

SEQ ID NO: 1788259 - protein, 4 aa, Staphylococcus epidermidis
REHE

SEQ ID NO: 1788260 - protein, 8 aa, Staphylococcus epidermidis
REHGQYSE

SEQ ID NO: 1788261 - protein, 7 aa, Staphylococcus epidermidis
REINSDN

SEQ ID NO: 1788262 - protein, 7 aa, Staphylococcus epidermidis
REKAYGK

SEQ ID NO: 1788263 - protein, 4 aa, Staphylococcus epidermidis
REKE

SEQ ID NO: 1788264 - protein, 13 aa, Staphylococcus epidermidis
REKEAAKINERNR

SEQ ID NO: 1788265 - protein, 8 aa, Staphylococcus epidermidis
REKEIESY

SEQ ID NO: 1788266 - protein, 20 aa, Staphylococcus epidermidis
REKNIDVTNTPKASTNATAD

SEQ ID NO: 1788267 - protein, 6 aa, Staphylococcus epidermidis
REKRYP

SEQ ID NO: 1788268 - protein, 8 aa, Staphylococcus epidermidis
REKSPHTD

SEQ ID NO: 1788269 - protein, 9 aa, Staphylococcus epidermidis
REKTKHNNI

SEQ ID NO: 1788270 - protein, 8 aa, Staphylococcus epidermidis
REKYGSPI

SEQ ID NO: 1788271 - protein, 4 aa, Staphylococcus epidermidis
RELE

SEQ ID NO: 1788272 - protein, 5 aa, Staphylococcus epidermidis
RELKS

SEQ ID NO: 1788273 - protein, 4 aa, Staphylococcus epidermidis
RELS

SEQ ID NO: 1788274 - protein, 11 aa, Staphylococcus epidermidis
RELSKQNDDCL

SEQ ID NO: 1788275 - protein, 12 aa, Staphylococcus epidermidis
RELYGKTDGNQG

SEQ ID NO: 1788276 - protein, 14 aa, Staphylococcus epidermidis
REMSENAKQQTDRM

SEQ ID NO: 1788277 - protein, 15 aa, Staphylococcus epidermidis
RENANELANSLNNEG

SEQ ID NO: 1788278 - protein, 5 aa, Staphylococcus epidermidis
RENDI

SEQ ID NO: 1788279 - protein, 7 aa, Staphylococcus epidermidis
RENDQSY

SEQ ID NO: 1788280 - protein, 12 aa, Staphylococcus epidermidis
RENELKRPPVSN

SEQ ID NO: 1788281 - protein, 7 aa, Staphylococcus epidermidis
RENENSI

SEQ ID NO: 1788282 - protein, 6 aa, Staphylococcus epidermidis
RENGET

SEQ ID NO: 1788283 - protein, 12 aa, Staphylococcus epidermidis
RENGKSSYEPAD

SEQ ID NO: 1788284 - protein, 4 aa, Staphylococcus epidermidis
RENI

SEQ ID NO: 1788285 - protein, 7 aa, Staphylococcus epidermidis
RENIGQP

SEQ ID NO: 1788286 - protein, 12 aa, Staphylococcus epidermidis
RENLEQNEEQDL

SEQ ID NO: 1788287 - protein, 6 aa, Staphylococcus epidermidis
RENNIQ

SEQ ID NO: 1788288 - protein, 4 aa, Staphylococcus epidermidis
RENQ

SEQ ID NO: 1788289 - protein, 6 aa, Staphylococcus epidermidis
RENQET

SEQ ID NO: 1788290 - protein, 8 aa, Staphylococcus epidermidis
RENTSIKN

SEQ ID NO: 1788291 - protein, 5 aa, Staphylococcus epidermidis
RENYG

SEQ ID NO: 1788292 - protein, 7 aa, Staphylococcus epidermidis
REPERIS

SEQ ID NO: 1788293 - protein, 5 aa, Staphylococcus epidermidis
REPKH

SEQ ID NO: 1788294 - protein, 7 aa, Staphylococcus epidermidis
REPLTKE

SEQ ID NO: 1788295 - protein, 4 aa, Staphylococcus epidermidis
REPQ

SEQ ID NO: 1788296 - protein, 4 aa, Staphylococcus epidermidis
REPR

SEQ ID NO: 1788297 - protein, 13 aa, Staphylococcus epidermidis
REQEIDNPRGINC

SEQ ID NO: 1788298 - protein, 8 aa, Staphylococcus epidermidis
REQFSKES

SEQ ID NO: 1788299 - protein, 19 aa, Staphylococcus epidermidis
REQNKEANQYAQQALYKLT

SEQ ID NO: 1788300 - protein, 12 aa, Staphylococcus epidermidis
REQSIESRSRLE

SEQ ID NO: 1788301 - protein, 6 aa, Staphylococcus epidermidis
REQVGD

SEQ ID NO: 1788302 - protein, 9 aa, Staphylococcus epidermidis
RERAQEDKR

SEQ ID NO: 1788303 - protein, 8 aa, Staphylococcus epidermidis
RERGEGER

SEQ ID NO: 1788304 - protein, 6 aa, Staphylococcus epidermidis
RERNHN

SEQ ID NO: 1788305 - protein, 5 aa, Staphylococcus epidermidis
RERSL

SEQ ID NO: 1788306 - protein, 7 aa, Staphylococcus epidermidis
RERYGSP

SEQ ID NO: 1788307 - protein, 8 aa, Staphylococcus epidermidis
RESETDKI

SEQ ID NO: 1788308 - protein, 13 aa, Staphylococcus epidermidis
RESIEETLHPAVV

SEQ ID NO: 1788309 - protein, 10 aa, Staphylococcus epidermidis
RESKVANRTI

SEQ ID NO: 1788310 - protein, 18 aa, Staphylococcus epidermidis
RESKVRNYYGQEYNSTTY

SEQ ID NO: 1788311 - protein, 9 aa, Staphylococcus epidermidis
RESQDIEER

SEQ ID NO: 1788312 - protein, 17 aa, Staphylococcus epidermidis
RESRFKPGAQEQGGTGI

SEQ ID NO: 1788313 - protein, 6 aa, Staphylococcus epidermidis
RETEKY

SEQ ID NO: 1788314 - protein, 15 aa, Staphylococcus epidermidis
RETGALPDADKFDSA

SEQ ID NO: 1788315 - protein, 5 aa, Staphylococcus epidermidis
RETIQ

SEQ ID NO: 1788316 - protein, 6 aa, Staphylococcus epidermidis
RETPLT

SEQ ID NO: 1788317 - protein, 10 aa, Staphylococcus epidermidis
RETSDKEEVE

SEQ ID NO: 1788318 - protein, 12 aa, Staphylococcus epidermidis
RETTEIAPSFDQ

SEQ ID NO: 1788319 - protein, 5 aa, Staphylococcus epidermidis
RETTG

SEQ ID NO: 1788320 - protein, 13 aa, Staphylococcus epidermidis
RETTSLSGGESQR

SEQ ID NO: 1788321 - protein, 7 aa, Staphylococcus epidermidis
RETYEES

SEQ ID NO: 1788322 - protein, 4 aa, Staphylococcus epidermidis
REVE

SEQ ID NO: 1788323 - protein, 11 aa, Staphylococcus epidermidis
REVEGKYTGDY

SEQ ID NO: 1788324 - protein, 10 aa, Staphylococcus epidermidis
REVNDKGKYA

SEQ ID NO: 1788325 - protein, 10 aa, Staphylococcus epidermidis
REVQKSDDNL

SEQ ID NO: 1788326 - protein, 8 aa, Staphylococcus epidermidis
REVSGGQL

SEQ ID NO: 1788327 - protein, 5 aa, Staphylococcus epidermidis
REVSK

SEQ ID NO: 1788328 - protein, 7 aa, Staphylococcus epidermidis
REYNKNG

SEQ ID NO: 1788329 - protein, 6 aa, Staphylococcus epidermidis
REYPNV

SEQ ID NO: 1788330 - protein, 4 aa, Staphylococcus epidermidis
RFEE

SEQ ID NO: 1788331 - protein, 5 aa, Staphylococcus epidermidis
RFESA

SEQ ID NO: 1788332 - protein, 6 aa, Staphylococcus epidermidis
RFGSTN

SEQ ID NO: 1788333 - protein, 12 aa, Staphylococcus epidermidis
RFRDRDGRDLKK

SEQ ID NO: 1788334 - protein, 5 aa, Staphylococcus epidermidis
RFSDG

SEQ ID NO: 1788335 - protein, 11 aa, Staphylococcus epidermidis
RFSKDDASIQG

SEQ ID NO: 1788336 - protein, 11 aa, Staphylococcus epidermidis
RFSSSGTDSGL

SEQ ID NO: 1788337 - protein, 11 aa, Staphylococcus epidermidis
RFSSSGTESGL

SEQ ID NO: 1788338 - protein, 9 aa, Staphylococcus epidermidis
RGAKAIQDH

SEQ ID NO: 1788339 - protein, 12 aa, Staphylococcus epidermidis
RGANGEAGEIGK

SEQ ID NO: 1788340 - protein, 36 aa, Staphylococcus epidermidis
RGANHPVKDLRTGKVDITSQNHGYSIDRDSLKDTDL

SEQ ID NO: 1788341 - protein, 8 aa, Staphylococcus epidermidis
RGANRKKM

SEQ ID NO: 1788342 - protein, 9 aa, Staphylococcus epidermidis
RGANRKSMD

SEQ ID NO: 1788343 - protein, 11 aa, Staphylococcus epidermidis
RGASGYAPEHT

SEQ ID NO: 1788344 - protein, 16 aa, Staphylococcus epidermidis
RGATGFGSPRGGGRDR

SEQ ID NO: 1788345 - protein, 5 aa, Staphylococcus epidermidis
RGATP

SEQ ID NO: 1788346 - protein, 17 aa, Staphylococcus epidermidis
RGDADAMITGGTEAPIT

SEQ ID NO: 1788347 - protein, 11 aa, Staphylococcus epidermidis
RGDDHVSNTPK

SEQ ID NO: 1788348 - protein, 5 aa, Staphylococcus epidermidis
RGDEP

SEQ ID NO: 1788349 - protein, 12 aa, Staphylococcus epidermidis
RGDKFKGERIPT

SEQ ID NO: 1788350 - protein, 11 aa, Staphylococcus epidermidis
RGDLTQNAESH

SEQ ID NO: 1788351 - protein, 7 aa, Staphylococcus epidermidis
RGDMEFP

SEQ ID NO: 1788352 - protein, 6 aa, Staphylococcus epidermidis
RGDYDI

SEQ ID NO: 1788353 - protein, 12 aa, Staphylococcus epidermidis
RGEDESELDNHK

SEQ ID NO: 1788354 - protein, 4 aa, Staphylococcus epidermidis
RGEH

SEQ ID NO: 1788355 - protein, 7 aa, Staphylococcus epidermidis
RGEHTKH

SEQ ID NO: 1788356 - protein, 8 aa, Staphylococcus epidermidis
RGEKEKAL

SEQ ID NO: 1788357 - protein, 14 aa, Staphylococcus epidermidis
RGETISYKPENANK

SEQ ID NO: 1788358 - protein, 21 aa, Staphylococcus epidermidis
RGFNSKKKQFTNLNSPQKRGV

SEQ ID NO: 1788359 - protein, 9 aa, Staphylococcus epidermidis
RGGEEAEEL

SEQ ID NO: 1788360 - protein, 8 aa, Staphylococcus epidermidis
RGGGKNGL

SEQ ID NO: 1788361 - protein, 5 aa, Staphylococcus epidermidis
RGGKG

SEQ ID NO: 1788362 - protein, 17 aa, Staphylococcus epidermidis
RGGMPNEGGFGVTVAEL

SEQ ID NO: 1788363 - protein, 14 aa, Staphylococcus epidermidis
RGGNHVTTQNPEVN

SEQ ID NO: 1788364 - protein, 11 aa, Staphylococcus epidermidis
RGGTFKKNKDD

SEQ ID NO: 1788365 - protein, 18 aa, Staphylococcus epidermidis
RGGYYSEGPTAEVESGDR

SEQ ID NO: 1788366 - protein, 4 aa, Staphylococcus epidermidis
RGHL

SEQ ID NO: 1788367 - protein, 14 aa, Staphylococcus epidermidis
RGIPKNQFYKGERI

SEQ ID NO: 1788368 - protein, 7 aa, Staphylococcus epidermidis
RGKASAS

SEQ ID NO: 1788369 - protein, 16 aa, Staphylococcus epidermidis
RGKGFNIEDKPKGSGL

SEQ ID NO: 1788370 - protein, 15 aa, Staphylococcus epidermidis
RGKGGGYQSNQHTAS

SEQ ID NO: 1788371 - protein, 10 aa, Staphylococcus epidermidis
RGKGRGEDGK

SEQ ID NO: 1788372 - protein, 5 aa, Staphylococcus epidermidis
RGLAG

SEQ ID NO: 1788373 - protein, 5 aa, Staphylococcus epidermidis
RGLNS

SEQ ID NO: 1788374 - protein, 14 aa, Staphylococcus epidermidis
RGNHKGALKSYEKS

SEQ ID NO: 1788375 - protein, 5 aa, Staphylococcus epidermidis
RGNIS

SEQ ID NO: 1788376 - protein, 7 aa, Staphylococcus epidermidis
RGNMDAS

SEQ ID NO: 1788377 - protein, 10 aa, Staphylococcus epidermidis
RGNVEKNMQN

SEQ ID NO: 1788378 - protein, 9 aa, Staphylococcus epidermidis
RGPSGIGKT

SEQ ID NO: 1788379 - protein, 12 aa, Staphylococcus epidermidis
RGQASNTVQQGK

SEQ ID NO: 1788380 - protein, 6 aa, Staphylococcus epidermidis
RGQGIG

SEQ ID NO: 1788381 - protein, 5 aa, Staphylococcus epidermidis
RGQQW

SEQ ID NO: 1788382 - protein, 10 aa, Staphylococcus epidermidis
RGQSTLTSEE

SEQ ID NO: 1788383 - protein, 32 aa, Staphylococcus epidermidis
RGQYDQGTIDGKQVKSYREEDRVAKDSVTPTF

SEQ ID NO: 1788384 - protein, 8 aa, Staphylococcus epidermidis
RGRDRTKI

SEQ ID NO: 1788385 - protein, 7 aa, Staphylococcus epidermidis
RGRDTQN

SEQ ID NO: 1788386 - protein, 16 aa, Staphylococcus epidermidis
RGRGATLKGVKNVGKG

SEQ ID NO: 1788387 - protein, 6 aa, Staphylococcus epidermidis
RGRKQM

SEQ ID NO: 1788388 - protein, 10 aa, Staphylococcus epidermidis
RGSSGSNGVL

SEQ ID NO: 1788389 - protein, 31 aa, Staphylococcus epidermidis
RGSSNHPYAQQEVAGAESLYGNPRDFILKHN

SEQ ID NO: 1788390 - protein, 6 aa, Staphylococcus epidermidis
RGTEKE

SEQ ID NO: 1788391 - protein, 14 aa, Staphylococcus epidermidis
RGTKVERAGREGLQ

SEQ ID NO: 1788392 - protein, 4 aa, Staphylococcus epidermidis
RGTL

SEQ ID NO: 1788393 - protein, 10 aa, Staphylococcus epidermidis
RGTNDKSYED

SEQ ID NO: 1788394 - protein, 9 aa, Staphylococcus epidermidis
RGTTEADAS

SEQ ID NO: 1788395 - protein, 7 aa, Staphylococcus epidermidis
RGTVGGT

SEQ ID NO: 1788396 - protein, 5 aa, Staphylococcus epidermidis
RGTYG

SEQ ID NO: 1788397 - protein, 15 aa, Staphylococcus epidermidis
RGVAPREHSFPTPPV

SEQ ID NO: 1788398 - protein, 5 aa, Staphylococcus epidermidis
RGVKS

SEQ ID NO: 1788399 - protein, 4 aa, Staphylococcus epidermidis
RGVP

SEQ ID NO: 1788400 - protein, 4 aa, Staphylococcus epidermidis
RGVS

SEQ ID NO: 1788401 - protein, 8 aa, Staphylococcus epidermidis
RGVTPRND

SEQ ID NO: 1788402 - protein, 5 aa, Staphylococcus epidermidis
RGYED

SEQ ID NO: 1788403 - protein, 13 aa, Staphylococcus epidermidis
RGYELERGTSIEL

SEQ ID NO: 1788404 - protein, 7 aa, Staphylococcus epidermidis
RGYQHRD

SEQ ID NO: 1788405 - protein, 5 aa, Staphylococcus epidermidis
RGYQL

SEQ ID NO: 1788406 - protein, 7 aa, Staphylococcus epidermidis
RGYQSDE

SEQ ID NO: 1788407 - protein, 7 aa, Staphylococcus epidermidis
RHDPSKV

SEQ ID NO: 1788408 - protein, 9 aa, Staphylococcus epidermidis
RHGGKGNYS

SEQ ID NO: 1788409 - protein, 9 aa, Staphylococcus epidermidis
RHGIAGEAN

SEQ ID NO: 1788410 - protein, 8 aa, Staphylococcus epidermidis
RHGKTPAQ

SEQ ID NO: 1788411 - protein, 10 aa, Staphylococcus epidermidis
RHGQARGPMA

SEQ ID NO: 1788412 - protein, 8 aa, Staphylococcus epidermidis
RHKENGAK

SEQ ID NO: 1788413 - protein, 21 aa, Staphylococcus epidermidis
RHKKENASASHNRKLNSTKQR

SEQ ID NO: 1788414 - protein, 15 aa, Staphylococcus epidermidis
RHMKTGDVYNIYHNI

SEQ ID NO: 1788415 - protein, 5 aa, Staphylococcus epidermidis
RHNQS

SEQ ID NO: 1788416 - protein, 16 aa, Staphylococcus epidermidis
RHPELEKSYKEQSEAL

SEQ ID NO: 1788417 - protein, 5 aa, Staphylococcus epidermidis
RHPNE

SEQ ID NO: 1788418 - protein, 15 aa, Staphylococcus epidermidis
RHPPTYRYGYRTFAK

SEQ ID NO: 1788419 - protein, 8 aa, Staphylococcus epidermidis
RHQTDDNV

SEQ ID NO: 1788420 - protein, 4 aa, Staphylococcus epidermidis
RHSA

SEQ ID NO: 1788421 - protein, 4 aa, Staphylococcus epidermidis
RHSI

SEQ ID NO: 1788422 - protein, 5 aa, Staphylococcus epidermidis
RHSKF

SEQ ID NO: 1788423 - protein, 10 aa, Staphylococcus epidermidis
RHSSSANNYQ

SEQ ID NO: 1788424 - protein, 23 aa, Staphylococcus epidermidis
RHTEQLKQQRIERAQKTKQANRK

SEQ ID NO: 1788425 - protein, 5 aa, Staphylococcus epidermidis
RHTES

SEQ ID NO: 1788426 - protein, 7 aa, Staphylococcus epidermidis
RHTRSTL

SEQ ID NO: 1788427 - protein, 9 aa, Staphylococcus epidermidis
RHTSSNFRN

SEQ ID NO: 1788428 - protein, 4 aa, Staphylococcus epidermidis
RHVS

SEQ ID NO: 1788429 - protein, 11 aa, Staphylococcus epidermidis
RHYKAEGQNGF

SEQ ID NO: 1788430 - protein, 12 aa, Staphylococcus epidermidis
RIADNKENQPID

SEQ ID NO: 1788431 - protein, 19 aa, Staphylococcus epidermidis
RIDQATDKQTISDEKAKVD

SEQ ID NO: 1788432 - protein, 7 aa, Staphylococcus epidermidis
RIEKAPN

SEQ ID NO: 1788433 - protein, 13 aa, Staphylococcus epidermidis
RIGIPNKGEWTNK

SEQ ID NO: 1788434 - protein, 4 aa, Staphylococcus epidermidis
RIGR

SEQ ID NO: 1788435 - protein, 12 aa, Staphylococcus epidermidis
RIHNKRQPQMAN

SEQ ID NO: 1788436 - protein, 13 aa, Staphylococcus epidermidis
RIHNKRQPQMTNI

SEQ ID NO: 1788437 - protein, 17 aa, Staphylococcus epidermidis
RIHSKRQPEMTVSGKTK

SEQ ID NO: 1788438 - protein, 27 aa, Staphylococcus epidermidis
RIHSKRQPKMANVAQPKQYISREKTPK

SEQ ID NO: 1788439 - protein, 12 aa, Staphylococcus epidermidis
RIKKSKSSLSKG

SEQ ID NO: 1788440 - protein, 10 aa, Staphylococcus epidermidis
RIKSQKQAIE

SEQ ID NO: 1788441 - protein, 5 aa, Staphylococcus epidermidis
RINNE

SEQ ID NO: 1788442 - protein, 27 aa, Staphylococcus epidermidis
RIPKPSGALNDTNDPYQKKRNKHANAY

SEQ ID NO: 1788443 - protein, 15 aa, Staphylococcus epidermidis
RIQNENQINKTYQAQ

SEQ ID NO: 1788444 - protein, 7 aa, Staphylococcus epidermidis
RIQNSEK

SEQ ID NO: 1788445 - protein, 5 aa, Staphylococcus epidermidis
RIRSG

SEQ ID NO: 1788446 - protein, 7 aa, Staphylococcus epidermidis
RISDTDI

SEQ ID NO: 1788447 - protein, 9 aa, Staphylococcus epidermidis
RISNPEDAA

SEQ ID NO: 1788448 - protein, 12 aa, Staphylococcus epidermidis
RISPDGMTMTET

SEQ ID NO: 1788449 - protein, 9 aa, Staphylococcus epidermidis
RISQSGTIN

SEQ ID NO: 1788450 - protein, 8 aa, Staphylococcus epidermidis
RITEVGKK

SEQ ID NO: 1788451 - protein, 9 aa, Staphylococcus epidermidis
RITKGDTLK

SEQ ID NO: 1788452 - protein, 10 aa, Staphylococcus epidermidis
RITKNPKRDK

SEQ ID NO: 1788453 - protein, 5 aa, Staphylococcus epidermidis
RITPQ

SEQ ID NO: 1788454 - protein, 7 aa, Staphylococcus epidermidis
RKAEDKK

SEQ ID NO: 1788455 - protein, 8 aa, Staphylococcus epidermidis
RKAEDNKK

SEQ ID NO: 1788456 - protein, 6 aa, Staphylococcus epidermidis
RKAGDM

SEQ ID NO: 1788457 - protein, 9 aa, Staphylococcus epidermidis
RKAIDEGSN

SEQ ID NO: 1788458 - protein, 9 aa, Staphylococcus epidermidis
RKAKESNLK

SEQ ID NO: 1788459 - protein, 8 aa, Staphylococcus epidermidis
RKAQTNDI

SEQ ID NO: 1788460 - protein, 5 aa, Staphylococcus epidermidis
RKARA

SEQ ID NO: 1788461 - protein, 8 aa, Staphylococcus epidermidis
RKATGKTE

SEQ ID NO: 1788462 - protein, 11 aa, Staphylococcus epidermidis
RKAVENDETVD

SEQ ID NO: 1788463 - protein, 9 aa, Staphylococcus epidermidis
RKDEEGKFT

SEQ ID NO: 1788464 - protein, 5 aa, Staphylococcus epidermidis
RKDEF

SEQ ID NO: 1788465 - protein, 5 aa, Staphylococcus epidermidis
RKDEL

SEQ ID NO: 1788466 - protein, 6 aa, Staphylococcus epidermidis
RKDEQY

SEQ ID NO: 1788467 - protein, 8 aa, Staphylococcus epidermidis
RKDGNHKK

SEQ ID NO: 1788468 - protein, 4 aa, Staphylococcus epidermidis
RKDI

SEQ ID NO: 1788469 - protein, 13 aa, Staphylococcus epidermidis
RKDRSSKDKQYKM

SEQ ID NO: 1788470 - protein, 9 aa, Staphylococcus epidermidis
RKDSHGHTR

SEQ ID NO: 1788471 - protein, 8 aa, Staphylococcus epidermidis
RKDSNHKK

SEQ ID NO: 1788472 - protein, 10 aa, Staphylococcus epidermidis
RKDTKNTGNQ

SEQ ID NO: 1788473 - protein, 9 aa, Staphylococcus epidermidis
RKEDEKDFP

SEQ ID NO: 1788474 - protein, 5 aa, Staphylococcus epidermidis
RKEEI

SEQ ID NO: 1788475 - protein, 8 aa, Staphylococcus epidermidis
RKEKEKIE

SEQ ID NO: 1788476 - protein, 8 aa, Staphylococcus epidermidis
RKEKTTNH

SEQ ID NO: 1788477 - protein, 5 aa, Staphylococcus epidermidis
RKENI

SEQ ID NO: 1788478 - protein, 6 aa, Staphylococcus epidermidis
RKETIA

SEQ ID NO: 1788479 - protein, 8 aa, Staphylococcus epidermidis
RKEVQPNL

SEQ ID NO: 1788480 - protein, 9 aa, Staphylococcus epidermidis
RKGDPTRDL

SEQ ID NO: 1788481 - protein, 5 aa, Staphylococcus epidermidis
RKGFE

SEQ ID NO: 1788482 - protein, 5 aa, Staphylococcus epidermidis
RKGGN

SEQ ID NO: 1788483 - protein, 20 aa, Staphylococcus epidermidis
RKGIPFEPKELDNTEEEAAK

SEQ ID NO: 1788484 - protein, 9 aa, Staphylococcus epidermidis
RKGKDPFDL

SEQ ID NO: 1788485 - protein, 10 aa, Staphylococcus epidermidis
RKGKYRVEDK

SEQ ID NO: 1788486 - protein, 14 aa, Staphylococcus epidermidis
RKGLEVSAQSAKDN

SEQ ID NO: 1788487 - protein, 7 aa, Staphylococcus epidermidis
RKGMNAK

SEQ ID NO: 1788488 - protein, 7 aa, Staphylococcus epidermidis
RKGNKIV

SEQ ID NO: 1788489 - protein, 9 aa, Staphylococcus epidermidis
RKGSTVSST

SEQ ID NO: 1788490 - protein, 6 aa, Staphylococcus epidermidis
RKGTND

SEQ ID NO: 1788491 - protein, 7 aa, Staphylococcus epidermidis
RKHADTN

SEQ ID NO: 1788492 - protein, 6 aa, Staphylococcus epidermidis
RKHSEQ

SEQ ID NO: 1788493 - protein, 7 aa, Staphylococcus epidermidis
RKIEAPQ

SEQ ID NO: 1788494 - protein, 24 aa, Staphylococcus epidermidis
RKIENYKDEVRKEYLKQSEKIMEA

SEQ ID NO: 1788495 - protein, 6 aa, Staphylococcus epidermidis
RKIGNE

SEQ ID NO: 1788496 - protein, 8 aa, Staphylococcus epidermidis
RKIGPKDR

SEQ ID NO: 1788497 - protein, 6 aa, Staphylococcus epidermidis
RKINNK

SEQ ID NO: 1788498 - protein, 6 aa, Staphylococcus epidermidis
RKKEQF

SEQ ID NO: 1788499 - protein, 7 aa, Staphylococcus epidermidis
RKKESNL

SEQ ID NO: 1788500 - protein, 9 aa, Staphylococcus epidermidis
RKKETANEI

SEQ ID NO: 1788501 - protein, 9 aa, Staphylococcus epidermidis
RKKLETRDI

SEQ ID NO: 1788502 - protein, 9 aa, Staphylococcus epidermidis
RKKLKNGEL

SEQ ID NO: 1788503 - protein, 15 aa, Staphylococcus epidermidis
RKKLTSVDKENVLSS

SEQ ID NO: 1788504 - protein, 9 aa, Staphylococcus epidermidis
RKKPNGEIV

SEQ ID NO: 1788505 - protein, 13 aa, Staphylococcus epidermidis
RKKQVVPQITEVL

SEQ ID NO: 1788506 - protein, 19 aa, Staphylococcus epidermidis
RKLAQNKRNREAQKQGTRR

SEQ ID NO: 1788507 - protein, 6 aa, Staphylococcus epidermidis
RKLENY

SEQ ID NO: 1788508 - protein, 7 aa, Staphylococcus epidermidis
RKLTKAS

SEQ ID NO: 1788509 - protein, 7 aa, Staphylococcus epidermidis
RKNEGYD

SEQ ID NO: 1788510 - protein, 7 aa, Staphylococcus epidermidis
RKNESNL

SEQ ID NO: 1788511 - protein, 8 aa, Staphylococcus epidermidis
RKNKDDLE

SEQ ID NO: 1788512 - protein, 9 aa, Staphylococcus epidermidis
RKNKERSMY

SEQ ID NO: 1788513 - protein, 9 aa, Staphylococcus epidermidis
RKNKTLDER

SEQ ID NO: 1788514 - protein, 10 aa, Staphylococcus epidermidis
RKNQDYKLNS

SEQ ID NO: 1788515 - protein, 7 aa, Staphylococcus epidermidis
RKPAEKP

SEQ ID NO: 1788516 - protein, 7 aa, Staphylococcus epidermidis
RKPETQL

SEQ ID NO: 1788517 - protein, 13 aa, Staphylococcus epidermidis
RKPKALSGGQRQR

SEQ ID NO: 1788518 - protein, 9 aa, Staphylococcus epidermidis
RKPNTGKIG

SEQ ID NO: 1788519 - protein, 10 aa, Staphylococcus epidermidis
RKPNTNDIGL

SEQ ID NO: 1788520 - protein, 12 aa, Staphylococcus epidermidis
RKPQGANIGEQR

SEQ ID NO: 1788521 - protein, 5 aa, Staphylococcus epidermidis
RKPSA

SEQ ID NO: 1788522 - protein, 15 aa, Staphylococcus epidermidis
RKQAAKVAREVNEYQ

SEQ ID NO: 1788523 - protein, 16 aa, Staphylococcus epidermidis
RKQGGRHKGPPPFTRE

SEQ ID NO: 1788524 - protein, 8 aa, Staphylococcus epidermidis
RKQTSGNF

SEQ ID NO: 1788525 - protein, 5 aa, Staphylococcus epidermidis
RKQTV

SEQ ID NO: 1788526 - protein, 4 aa, Staphylococcus epidermidis
RKRE

SEQ ID NO: 1788527 - protein, 8 aa, Staphylococcus epidermidis
RKREDKIP

SEQ ID NO: 1788528 - protein, 31 aa, Staphylococcus epidermidis
RKRLSEQKATEAENTEKEEAINKATDNTTID

SEQ ID NO: 1788529 - protein, 12 aa, Staphylococcus epidermidis
RKRNRHQDLQAA

SEQ ID NO: 1788530 - protein, 9 aa, Staphylococcus epidermidis
RKRPATSKP

SEQ ID NO: 1788531 - protein, 12 aa, Staphylococcus epidermidis
RKSKKQETNAAS

SEQ ID NO: 1788532 - protein, 35 aa, Staphylococcus epidermidis
RKSKSKKSDSPALNRGFNSKKKQFTHLNSPQKRGV

SEQ ID NO: 1788533 - protein, 13 aa, Staphylococcus epidermidis
RKSKTKQSDSPVL

SEQ ID NO: 1788534 - protein, 6 aa, Staphylococcus epidermidis
RKSLEK

SEQ ID NO: 1788535 - protein, 7 aa, Staphylococcus epidermidis
RKSNNGR

SEQ ID NO: 1788536 - protein, 6 aa, Staphylococcus epidermidis
RKSRDL

SEQ ID NO: 1788537 - protein, 7 aa, Staphylococcus epidermidis
RKSYTAK

SEQ ID NO: 1788538 - protein, 7 aa, Staphylococcus epidermidis
RKTAEEL

SEQ ID NO: 1788539 - protein, 9 aa, Staphylococcus epidermidis
RKTDGDFSL

SEQ ID NO: 1788540 - protein, 9 aa, Staphylococcus epidermidis
RKTYQGESV

SEQ ID NO: 1788541 - protein, 7 aa, Staphylococcus epidermidis
RKVEHGP

SEQ ID NO: 1788542 - protein, 11 aa, Staphylococcus epidermidis
RKVENGEPRSL

SEQ ID NO: 1788543 - protein, 5 aa, Staphylococcus epidermidis
RKVER

SEQ ID NO: 1788544 - protein, 6 aa, Staphylococcus epidermidis
RKYGKD

SEQ ID NO: 1788545 - protein, 13 aa, Staphylococcus epidermidis
RKYGSEDQESLEK

SEQ ID NO: 1788546 - protein, 10 aa, Staphylococcus epidermidis
RKYQNTTAAT

SEQ ID NO: 1788547 - protein, 6 aa, Staphylococcus epidermidis
RLAEDI

SEQ ID NO: 1788548 - protein, 4 aa, Staphylococcus epidermidis
RLAK

SEQ ID NO: 1788549 - protein, 5 aa, Staphylococcus epidermidis
RLEDG

SEQ ID NO: 1788550 - protein, 4 aa, Staphylococcus epidermidis
RLEE

SEQ ID NO: 1788551 - protein, 6 aa, Staphylococcus epidermidis
RLEGGK

SEQ ID NO: 1788552 - protein, 7 aa, Staphylococcus epidermidis
RLEGGKY

SEQ ID NO: 1788553 - protein, 12 aa, Staphylococcus epidermidis
RLGGNSRSTVGT

SEQ ID NO: 1788554 - protein, 8 aa, Staphylococcus epidermidis
RLKSDPSF

SEQ ID NO: 1788555 - protein, 9 aa, Staphylococcus epidermidis
RLNGESEDV

SEQ ID NO: 1788556 - protein, 27 aa, Staphylococcus epidermidis
RLNGKQLEVDTTQIENAPLPNNKVESL

SEQ ID NO: 1788557 - protein, 9 aa, Staphylococcus epidermidis
RLNNDDSVS

SEQ ID NO: 1788558 - protein, 5 aa, Staphylococcus epidermidis
RLNNP

SEQ ID NO: 1788559 - protein, 4 aa, Staphylococcus epidermidis
RLNQ

SEQ ID NO: 1788560 - protein, 4 aa, Staphylococcus epidermidis
RLNT

SEQ ID NO: 1788561 - protein, 5 aa, Staphylococcus epidermidis
RLNTH

SEQ ID NO: 1788562 - protein, 16 aa, Staphylococcus epidermidis
RLRDAQNELSKADYKA

SEQ ID NO: 1788563 - protein, 6 aa, Staphylococcus epidermidis
RLRNNP

SEQ ID NO: 1788564 - protein, 8 aa, Staphylococcus epidermidis
RLSDGEMT

SEQ ID NO: 1788565 - protein, 8 aa, Staphylococcus epidermidis
RLSEDKDK

SEQ ID NO: 1788566 - protein, 8 aa, Staphylococcus epidermidis
RLSKSPAM

SEQ ID NO: 1788567 - protein, 4 aa, Staphylococcus epidermidis
RLTD

SEQ ID NO: 1788568 - protein, 7 aa, Staphylococcus epidermidis
RLTDNGL

SEQ ID NO: 1788569 - protein, 10 aa, Staphylococcus epidermidis
RLTEDKGLKE

SEQ ID NO: 1788570 - protein, 19 aa, Staphylococcus epidermidis
RLTEGKYDSKEKMEKSVED

SEQ ID NO: 1788571 - protein, 8 aa, Staphylococcus epidermidis
RLTGKPGV

SEQ ID NO: 1788572 - protein, 5 aa, Staphylococcus epidermidis
RLTGN

SEQ ID NO: 1788573 - protein, 6 aa, Staphylococcus epidermidis
RLTNEG

SEQ ID NO: 1788574 - protein, 5 aa, Staphylococcus epidermidis
RLYGK

SEQ ID NO: 1788575 - protein, 9 aa, Staphylococcus epidermidis
RLYKTGDTA

SEQ ID NO: 1788576 - protein, 12 aa, Staphylococcus epidermidis
RMEEKKIPEDLD

SEQ ID NO: 1788577 - protein, 6 aa, Staphylococcus epidermidis
RMEPSF

SEQ ID NO: 1788578 - protein, 5 aa, Staphylococcus epidermidis
RMEQR

SEQ ID NO: 1788579 - protein, 5 aa, Staphylococcus epidermidis
RMKDL

SEQ ID NO: 1788580 - protein, 7 aa, Staphylococcus epidermidis
RMNSKQQ

SEQ ID NO: 1788581 - protein, 9 aa, Staphylococcus epidermidis
RMPESERPR

SEQ ID NO: 1788582 - protein, 9 aa, Staphylococcus epidermidis
RMTKGDTLK

SEQ ID NO: 1788583 - protein, 27 aa, Staphylococcus epidermidis
RMTPHSSDDDDKYRTQEERDSLKEGDC

SEQ ID NO: 1788584 - protein, 21 aa, Staphylococcus epidermidis
RMTPHSSDDDDTYRSKEERDL

SEQ ID NO: 1788585 - protein, 11 aa, Staphylococcus epidermidis
RNAIDGDTLER

SEQ ID NO: 1788586 - protein, 6 aa, Staphylococcus epidermidis
RNDLDN

SEQ ID NO: 1788587 - protein, 4 aa, Staphylococcus epidermidis
RNDR

SEQ ID NO: 1788588 - protein, 13 aa, Staphylococcus epidermidis
RNEDGTVAVSGRE

SEQ ID NO: 1788589 - protein, 4 aa, Staphylococcus epidermidis
RNEG

SEQ ID NO: 1788590 - protein, 4 aa, Staphylococcus epidermidis
RNEL

SEQ ID NO: 1788591 - protein, 6 aa, Staphylococcus epidermidis
RNELKK

SEQ ID NO: 1788592 - protein, 10 aa, Staphylococcus epidermidis
RNENRVNEYS

SEQ ID NO: 1788593 - protein, 14 aa, Staphylococcus epidermidis
RNEPNVDSQSNTET

SEQ ID NO: 1788594 - protein, 6 aa, Staphylococcus epidermidis
RNEPSW

SEQ ID NO: 1788595 - protein, 4 aa, Staphylococcus epidermidis
RNEY

SEQ ID NO: 1788596 - protein, 7 aa, Staphylococcus epidermidis
RNFRDDP

SEQ ID NO: 1788597 - protein, 12 aa, Staphylococcus epidermidis
RNGAEKNIKIKL

SEQ ID NO: 1788598 - protein, 8 aa, Staphylococcus epidermidis
RNGAGKST

SEQ ID NO: 1788599 - protein, 9 aa, Staphylococcus epidermidis
RNGAGKTTT

SEQ ID NO: 1788600 - protein, 10 aa, Staphylococcus epidermidis
RNGKEEEARN

SEQ ID NO: 1788601 - protein, 9 aa, Staphylococcus epidermidis
RNGKRTARA

SEQ ID NO: 1788602 - protein, 14 aa, Staphylococcus epidermidis
RNGQIKQDSSIGTG

SEQ ID NO: 1788603 - protein, 5 aa, Staphylococcus epidermidis
RNGRS

SEQ ID NO: 1788604 - protein, 10 aa, Staphylococcus epidermidis
RNGSGKSSLS

SEQ ID NO: 1788605 - protein, 26 aa, Staphylococcus epidermidis
RNGYQSKDSKQIKKGQQKLATVSSNI

SEQ ID NO: 1788606 - protein, 4 aa, Staphylococcus epidermidis
RNHP

SEQ ID NO: 1788607 - protein, 8 aa, Staphylococcus epidermidis
RNIKNKDL

SEQ ID NO: 1788608 - protein, 7 aa, Staphylococcus epidermidis
RNISGAF

SEQ ID NO: 1788609 - protein, 5 aa, Staphylococcus epidermidis
RNKEI

SEQ ID NO: 1788610 - protein, 7 aa, Staphylococcus epidermidis
RNKENKS

SEQ ID NO: 1788611 - protein, 8 aa, Staphylococcus epidermidis
RNKGVSKP

SEQ ID NO: 1788612 - protein, 5 aa, Staphylococcus epidermidis
RNKIH

SEQ ID NO: 1788613 - protein, 4 aa, Staphylococcus epidermidis
RNKN

SEQ ID NO: 1788614 - protein, 12 aa, Staphylococcus epidermidis
RNKNNEKLTSIE

SEQ ID NO: 1788615 - protein, 5 aa, Staphylococcus epidermidis
RNKPI

SEQ ID NO: 1788616 - protein, 8 aa, Staphylococcus epidermidis
RNKREAKG

SEQ ID NO: 1788617 - protein, 23 aa, Staphylococcus epidermidis
RNLGNPPFATRESLPKVRERELE

SEQ ID NO: 1788618 - protein, 24 aa, Staphylococcus epidermidis
RNLPASLRETGLGGLAGTPTGEKI

SEQ ID NO: 1788619 - protein, 10 aa, Staphylococcus epidermidis
RNMQQSANNV

SEQ ID NO: 1788620 - protein, 9 aa, Staphylococcus epidermidis
RNMREGEVD

SEQ ID NO: 1788621 - protein, 4 aa, Staphylococcus epidermidis
RNMY

SEQ ID NO: 1788622 - protein, 10 aa, Staphylococcus epidermidis
RNNDPYPDEL

SEQ ID NO: 1788623 - protein, 10 aa, Staphylococcus epidermidis
RNNETKTEKE

SEQ ID NO: 1788624 - protein, 8 aa, Staphylococcus epidermidis
RNNHSINN

SEQ ID NO: 1788625 - protein, 15 aa, Staphylococcus epidermidis
RNNIVGDGYDSVNYG

SEQ ID NO: 1788626 - protein, 8 aa, Staphylococcus epidermidis
RNNKIDPN

SEQ ID NO: 1788627 - protein, 14 aa, Staphylococcus epidermidis
RNNNNLTQKGFGKR

SEQ ID NO: 1788628 - protein, 6 aa, Staphylococcus epidermidis
RNNRKT

SEQ ID NO: 1788629 - protein, 5 aa, Staphylococcus epidermidis
RNPAN

SEQ ID NO: 1788630 - protein, 7 aa, Staphylococcus epidermidis
RNPMDGY

SEQ ID NO: 1788631 - protein, 8 aa, Staphylococcus epidermidis
RNQGHAHA

SEQ ID NO: 1788632 - protein, 21 aa, Staphylococcus epidermidis
RNQIDQSFRETQIRKTQQQLP

SEQ ID NO: 1788633 - protein, 17 aa, Staphylococcus epidermidis
RNQKNETPLHTEDGEDI

SEQ ID NO: 1788634 - protein, 15 aa, Staphylococcus epidermidis
RNQSNTTREMTEEEK

SEQ ID NO: 1788635 - protein, 6 aa, Staphylococcus epidermidis
RNQYSK

SEQ ID NO: 1788636 - protein, 18 aa, Staphylococcus epidermidis
RNRAETLGLSAESTYNSL

SEQ ID NO: 1788637 - protein, 6 aa, Staphylococcus epidermidis
RNREIT

SEQ ID NO: 1788638 - protein, 6 aa, Staphylococcus epidermidis
RNRETI

SEQ ID NO: 1788639 - protein, 61 aa, Staphylococcus epidermidis
RNSKFGTPESQILDPNDTDYNDTDYIKTESNDTDDLNDKKLTYPNNHTNHSNHDNSNFNNE

SEQ ID NO: 1788640 - protein, 12 aa, Staphylococcus epidermidis
RNSKRDTLKDEV

SEQ ID NO: 1788641 - protein, 4 aa, Staphylococcus epidermidis
RNTD

SEQ ID NO: 1788642 - protein, 6 aa, Staphylococcus epidermidis
RNTMDG

SEQ ID NO: 1788643 - protein, 4 aa, Staphylococcus epidermidis
RNTN

SEQ ID NO: 1788644 - protein, 11 aa, Staphylococcus epidermidis
RNTQTSKGDYI

SEQ ID NO: 1788645 - protein, 9 aa, Staphylococcus epidermidis
RNTRTSKGN

SEQ ID NO: 1788646 - protein, 10 aa, Staphylococcus epidermidis
RNTRTSKGNY

SEQ ID NO: 1788647 - protein, 8 aa, Staphylococcus epidermidis
RNTTSDDT

SEQ ID NO: 1788648 - protein, 20 aa, Staphylococcus epidermidis
RNVESDVSKNKGKKDVQDKL

SEQ ID NO: 1788649 - protein, 5 aa, Staphylococcus epidermidis
RNVFG

SEQ ID NO: 1788650 - protein, 7 aa, Staphylococcus epidermidis
RNVGGEK

SEQ ID NO: 1788651 - protein, 13 aa, Staphylococcus epidermidis
RNVPNKKKYRQIR

SEQ ID NO: 1788652 - protein, 16 aa, Staphylococcus epidermidis
RNYISTKNKRNNPERI

SEQ ID NO: 1788653 - protein, 15 aa, Staphylococcus epidermidis
RNYNVPKKEGSATRL

SEQ ID NO: 1788654 - protein, 6 aa, Staphylococcus epidermidis
RPAGGF

SEQ ID NO: 1788655 - protein, 4 aa, Staphylococcus epidermidis
RPAR

SEQ ID NO: 1788656 - protein, 15 aa, Staphylococcus epidermidis
RPDEKRVTERAYENP

SEQ ID NO: 1788657 - protein, 7 aa, Staphylococcus epidermidis
RPDNTTK

SEQ ID NO: 1788658 - protein, 6 aa, Staphylococcus epidermidis
RPDSWR

SEQ ID NO: 1788659 - protein, 4 aa, Staphylococcus epidermidis
RPDT

SEQ ID NO: 1788660 - protein, 5 aa, Staphylococcus epidermidis
RPELH

SEQ ID NO: 1788661 - protein, 5 aa, Staphylococcus epidermidis
RPELT

SEQ ID NO: 1788662 - protein, 12 aa, Staphylococcus epidermidis
RPESQHKGYGTS

SEQ ID NO: 1788663 - protein, 5 aa, Staphylococcus epidermidis
RPFGG

SEQ ID NO: 1788664 - protein, 11 aa, Staphylococcus epidermidis
RPFSPDRAKQI

SEQ ID NO: 1788665 - protein, 9 aa, Staphylococcus epidermidis
RPGSNLGAD

SEQ ID NO: 1788666 - protein, 7 aa, Staphylococcus epidermidis
RPGSVTK

SEQ ID NO: 1788667 - protein, 15 aa, Staphylococcus epidermidis
RPKKTTKIGKPYYKT

SEQ ID NO: 1788668 - protein, 20 aa, Staphylococcus epidermidis
RPKKTTRIGKPYYKTDNLLQ

SEQ ID NO: 1788669 - protein, 8 aa, Staphylococcus epidermidis
RPLEEDGS

SEQ ID NO: 1788670 - protein, 11 aa, Staphylococcus epidermidis
RPLGRTAAGVK

SEQ ID NO: 1788671 - protein, 10 aa, Staphylococcus epidermidis
RPLGSTANKM

SEQ ID NO: 1788672 - protein, 4 aa, Staphylococcus epidermidis
RPNL

SEQ ID NO: 1788673 - protein, 11 aa, Staphylococcus epidermidis
RPNSRKPKHDF

SEQ ID NO: 1788674 - protein, 7 aa, Staphylococcus epidermidis
RPNTDMS

SEQ ID NO: 1788675 - protein, 5 aa, Staphylococcus epidermidis
RPPGH

SEQ ID NO: 1788676 - protein, 6 aa, Staphylococcus epidermidis
RPPHRK

SEQ ID NO: 1788677 - protein, 13 aa, Staphylococcus epidermidis
RPQETGKTYDTAI

SEQ ID NO: 1788678 - protein, 6 aa, Staphylococcus epidermidis
RPQSVY

SEQ ID NO: 1788679 - protein, 6 aa, Staphylococcus epidermidis
RPSLEQ

SEQ ID NO: 1788680 - protein, 17 aa, Staphylococcus epidermidis
RPSQMSDANRRVYTDEE

SEQ ID NO: 1788681 - protein, 4 aa, Staphylococcus epidermidis
RPSY

SEQ ID NO: 1788682 - protein, 8 aa, Staphylococcus epidermidis
RPTINKDD

SEQ ID NO: 1788683 - protein, 8 aa, Staphylococcus epidermidis
RPTKEDDK

SEQ ID NO: 1788684 - protein, 7 aa, Staphylococcus epidermidis
RPTNKKL

SEQ ID NO: 1788685 - protein, 14 aa, Staphylococcus epidermidis
RPVKKGPDSREYGE

SEQ ID NO: 1788686 - protein, 16 aa, Staphylococcus epidermidis
RPVSSAYDAYGKFSEE

SEQ ID NO: 1788687 - protein, 6 aa, Staphylococcus epidermidis
RPYGER

SEQ ID NO: 1788688 - protein, 21 aa, Staphylococcus epidermidis
RPYKQKKKTRATEAKRKGLEP

SEQ ID NO: 1788689 - protein, 5 aa, Staphylococcus epidermidis
RQADD

SEQ ID NO: 1788690 - protein, 7 aa, Staphylococcus epidermidis
RQAEDQF

SEQ ID NO: 1788691 - protein, 12 aa, Staphylococcus epidermidis
RQAITNPNTVQS

SEQ ID NO: 1788692 - protein, 10 aa, Staphylococcus epidermidis
RQAKESGTLQ

SEQ ID NO: 1788693 - protein, 8 aa, Staphylococcus epidermidis
RQEPIQPN

SEQ ID NO: 1788694 - protein, 5 aa, Staphylococcus epidermidis
RQESN

SEQ ID NO: 1788695 - protein, 10 aa, Staphylococcus epidermidis
RQGGYGRGRR

SEQ ID NO: 1788696 - protein, 18 aa, Staphylococcus epidermidis
RQGHGKPYTDPDRAEFST

SEQ ID NO: 1788697 - protein, 7 aa, Staphylococcus epidermidis
RQGLNKP

SEQ ID NO: 1788698 - protein, 8 aa, Staphylococcus epidermidis
RQGPQTLS

SEQ ID NO: 1788699 - protein, 4 aa, Staphylococcus epidermidis
RQGT

SEQ ID NO: 1788700 - protein, 12 aa, Staphylococcus epidermidis
RQGVKGNELSQF

SEQ ID NO: 1788701 - protein, 4 aa, Staphylococcus epidermidis
RQIA

SEQ ID NO: 1788702 - protein, 14 aa, Staphylococcus epidermidis
RQISAEAERATRTQ

SEQ ID NO: 1788703 - protein, 12 aa, Staphylococcus epidermidis
RQKGSAGGHNGM

SEQ ID NO: 1788704 - protein, 7 aa, Staphylococcus epidermidis
RQKNESV

SEQ ID NO: 1788705 - protein, 10 aa, Staphylococcus epidermidis
RQMEQGKFNE

SEQ ID NO: 1788706 - protein, 5 aa, Staphylococcus epidermidis
RQNLE

SEQ ID NO: 1788707 - protein, 14 aa, Staphylococcus epidermidis
RQNLSKLNAKQHGI

SEQ ID NO: 1788708 - protein, 5 aa, Staphylococcus epidermidis
RQNPE

SEQ ID NO: 1788709 - protein, 12 aa, Staphylococcus epidermidis
RQNVEEAYRQSV

SEQ ID NO: 1788710 - protein, 17 aa, Staphylococcus epidermidis
RQNYSAKPKAETKATNF

SEQ ID NO: 1788711 - protein, 7 aa, Staphylococcus epidermidis
RQPLEPQ

SEQ ID NO: 1788712 - protein, 5 aa, Staphylococcus epidermidis
RQPNE

SEQ ID NO: 1788713 - protein, 7 aa, Staphylococcus epidermidis
RQPNTHD

SEQ ID NO: 1788714 - protein, 10 aa, Staphylococcus epidermidis
RQPQIGETIN

SEQ ID NO: 1788715 - protein, 6 aa, Staphylococcus epidermidis
RQPQKD

SEQ ID NO: 1788716 - protein, 7 aa, Staphylococcus epidermidis
RQQAMKG

SEQ ID NO: 1788717 - protein, 5 aa, Staphylococcus epidermidis
RQQDD

SEQ ID NO: 1788718 - protein, 12 aa, Staphylococcus epidermidis
RQQNMPKYNIFN

SEQ ID NO: 1788719 - protein, 12 aa, Staphylococcus epidermidis
RQQNMSQSNMFG

SEQ ID NO: 1788720 - protein, 6 aa, Staphylococcus epidermidis
RQQRAY

SEQ ID NO: 1788721 - protein, 6 aa, Staphylococcus epidermidis
RQRELS

SEQ ID NO: 1788722 - protein, 5 aa, Staphylococcus epidermidis
RQRHP

SEQ ID NO: 1788723 - protein, 7 aa, Staphylococcus epidermidis
RQSEEPI

SEQ ID NO: 1788724 - protein, 8 aa, Staphylococcus epidermidis
RQSLPSNV

SEQ ID NO: 1788725 - protein, 9 aa, Staphylococcus epidermidis
RQSLREKGA

SEQ ID NO: 1788726 - protein, 7 aa, Staphylococcus epidermidis
RQSVEGE

SEQ ID NO: 1788727 - protein, 4 aa, Staphylococcus epidermidis
RQTR

SEQ ID NO: 1788728 - protein, 14 aa, Staphylococcus epidermidis
RQTTENAERLFKLK

SEQ ID NO: 1788729 - protein, 5 aa, Staphylococcus epidermidis
RQYAS

SEQ ID NO: 1788730 - protein, 4 aa, Staphylococcus epidermidis
RQYD

SEQ ID NO: 1788731 - protein, 9 aa, Staphylococcus epidermidis
RRDAFEQKK

SEQ ID NO: 1788732 - protein, 4 aa, Staphylococcus epidermidis
RRDQ

SEQ ID NO: 1788733 - protein, 5 aa, Staphylococcus epidermidis
RRDSA

SEQ ID NO: 1788734 - protein, 9 aa, Staphylococcus epidermidis
RRDTAQDNG

SEQ ID NO: 1788735 - protein, 27 aa, Staphylococcus epidermidis
RRDYSNDEFRNQVKSSIQKHVEDTNRI

SEQ ID NO: 1788736 - protein, 5 aa, Staphylococcus epidermidis
RREDE

SEQ ID NO: 1788737 - protein, 6 aa, Staphylococcus epidermidis
RREITD

SEQ ID NO: 1788738 - protein, 8 aa, Staphylococcus epidermidis
RRENDQSY

SEQ ID NO: 1788739 - protein, 10 aa, Staphylococcus epidermidis
RRERDHRKIG

SEQ ID NO: 1788740 - protein, 9 aa, Staphylococcus epidermidis
RRFKEGNTV

SEQ ID NO: 1788741 - protein, 17 aa, Staphylococcus epidermidis
RRGQEYHSANPPLYDSS

SEQ ID NO: 1788742 - protein, 5 aa, Staphylococcus epidermidis
RRGTT

SEQ ID NO: 1788743 - protein, 34 aa, Staphylococcus epidermidis
RRGYGQSELTEPLPEEVSNPDSRYRVKRDAQDIA

SEQ ID NO: 1788744 - protein, 7 aa, Staphylococcus epidermidis
RRGYKSM

SEQ ID NO: 1788745 - protein, 5 aa, Staphylococcus epidermidis
RRHGY

SEQ ID NO: 1788746 - protein, 13 aa, Staphylococcus epidermidis
RRHKQGGLADPRN

SEQ ID NO: 1788747 - protein, 7 aa, Staphylococcus epidermidis
RRHSNNT

SEQ ID NO: 1788748 - protein, 4 aa, Staphylococcus epidermidis
RRIN

SEQ ID NO: 1788749 - protein, 13 aa, Staphylococcus epidermidis
RRKGKATKEQAEE

SEQ ID NO: 1788750 - protein, 14 aa, Staphylococcus epidermidis
RRKNLQSVYENIYN

SEQ ID NO: 1788751 - protein, 14 aa, Staphylococcus epidermidis
RRKSYGSTGQESVK

SEQ ID NO: 1788752 - protein, 5 aa, Staphylococcus epidermidis
RRLEE

SEQ ID NO: 1788753 - protein, 11 aa, Staphylococcus epidermidis
RRNGKQNVIEG

SEQ ID NO: 1788754 - protein, 6 aa, Staphylococcus epidermidis
RRNQHN

SEQ ID NO: 1788755 - protein, 8 aa, Staphylococcus epidermidis
RRPGYEPN

SEQ ID NO: 1788756 - protein, 4 aa, Staphylococcus epidermidis
RRQA

SEQ ID NO: 1788757 - protein, 10 aa, Staphylococcus epidermidis
RRQKKQENEV

SEQ ID NO: 1788758 - protein, 5 aa, Staphylococcus epidermidis
RRQNK

SEQ ID NO: 1788759 - protein, 22 aa, Staphylococcus epidermidis
RRQTSKKYPRKPGTPNKSPLLE

SEQ ID NO: 1788760 - protein, 9 aa, Staphylococcus epidermidis
RRSRGTPRV

SEQ ID NO: 1788761 - protein, 7 aa, Staphylococcus epidermidis
RRSRTSI

SEQ ID NO: 1788762 - protein, 18 aa, Staphylococcus epidermidis
RRTENSKKHKQPSTLNVK

SEQ ID NO: 1788763 - protein, 6 aa, Staphylococcus epidermidis
RRTTKD

SEQ ID NO: 1788764 - protein, 6 aa, Staphylococcus epidermidis
RRVENL

SEQ ID NO: 1788765 - protein, 4 aa, Staphylococcus epidermidis
RRVN

SEQ ID NO: 1788766 - protein, 26 aa, Staphylococcus epidermidis
RRYEDDGQLVSRKEPDATISNTDEAL

SEQ ID NO: 1788767 - protein, 30 aa, Staphylococcus epidermidis
RRYGREAMREKSDKALNEASDYFLNTLKKR

SEQ ID NO: 1788768 - protein, 14 aa, Staphylococcus epidermidis
RSAGTKVKNISKGH

SEQ ID NO: 1788769 - protein, 15 aa, Staphylococcus epidermidis
RSASAYGKKHVQLKV

SEQ ID NO: 1788770 - protein, 9 aa, Staphylococcus epidermidis
RSATSSELK

SEQ ID NO: 1788771 - protein, 8 aa, Staphylococcus epidermidis
RSDDGSSY

SEQ ID NO: 1788772 - protein, 6 aa, Staphylococcus epidermidis
RSDEDY

SEQ ID NO: 1788773 - protein, 7 aa, Staphylococcus epidermidis
RSDHPKM

SEQ ID NO: 1788774 - protein, 5 aa, Staphylococcus epidermidis
RSDST

SEQ ID NO: 1788775 - protein, 13 aa, Staphylococcus epidermidis
RSEDSKGASGEHR

SEQ ID NO: 1788776 - protein, 6 aa, Staphylococcus epidermidis
RSEEDY

SEQ ID NO: 1788777 - protein, 8 aa, Staphylococcus epidermidis
RSEGFGDE

SEQ ID NO: 1788778 - protein, 7 aa, Staphylococcus epidermidis
RSEHGNK

SEQ ID NO: 1788779 - protein, 36 aa, Staphylococcus epidermidis
RSEISKKDQVKGESKYINADNNKQSTYDSALNRGSQ

SEQ ID NO: 1788780 - protein, 12 aa, Staphylococcus epidermidis
RSEQDEKNESNV

SEQ ID NO: 1788781 - protein, 7 aa, Staphylococcus epidermidis
RSFEEGE

SEQ ID NO: 1788782 - protein, 14 aa, Staphylococcus epidermidis
RSFEKVKDQTPNEK

SEQ ID NO: 1788783 - protein, 9 aa, Staphylococcus epidermidis
RSFKEKGDW

SEQ ID NO: 1788784 - protein, 4 aa, Staphylococcus epidermidis
RSGE

SEQ ID NO: 1788785 - protein, 7 aa, Staphylococcus epidermidis
RSGEWDE

SEQ ID NO: 1788786 - protein, 11 aa, Staphylococcus epidermidis
RSGFEGARSSV

SEQ ID NO: 1788787 - protein, 8 aa, Staphylococcus epidermidis
RSGKEREE

SEQ ID NO: 1788788 - protein, 19 aa, Staphylococcus epidermidis
RSGMPIPARGYNQKSPDYS

SEQ ID NO: 1788789 - protein, 12 aa, Staphylococcus epidermidis
RSGSSACHSNSI

SEQ ID NO: 1788790 - protein, 5 aa, Staphylococcus epidermidis
RSHIT

SEQ ID NO: 1788791 - protein, 16 aa, Staphylococcus epidermidis
RSIAQTGNKPGVTKQQ

SEQ ID NO: 1788792 - protein, 5 aa, Staphylococcus epidermidis
RSIDT

SEQ ID NO: 1788793 - protein, 10 aa, Staphylococcus epidermidis
RSIEKPTTRK

SEQ ID NO: 1788794 - protein, 28 aa, Staphylococcus epidermidis
RSIGEQATRKYEKTAKTLDKLEANDTYQ

SEQ ID NO: 1788795 - protein, 4 aa, Staphylococcus epidermidis
RSIH

SEQ ID NO: 1788796 - protein, 6 aa, Staphylococcus epidermidis
RSKDEI

SEQ ID NO: 1788797 - protein, 8 aa, Staphylococcus epidermidis
RSKDSPYR

SEQ ID NO: 1788798 - protein, 15 aa, Staphylococcus epidermidis
RSKEEREKLKQPRSS

SEQ ID NO: 1788799 - protein, 10 aa, Staphylococcus epidermidis
RSKGTLQGYS

SEQ ID NO: 1788800 - protein, 9 aa, Staphylococcus epidermidis
RSKNNSDLH

SEQ ID NO: 1788801 - protein, 5 aa, Staphylococcus epidermidis
RSKPI

SEQ ID NO: 1788802 - protein, 9 aa, Staphylococcus epidermidis
RSKVSQNIL

SEQ ID NO: 1788803 - protein, 4 aa, Staphylococcus epidermidis
RSLT

SEQ ID NO: 1788804 - protein, 10 aa, Staphylococcus epidermidis
RSMEENEVSK

SEQ ID NO: 1788805 - protein, 6 aa, Staphylococcus epidermidis
RSMISN

SEQ ID NO: 1788806 - protein, 10 aa, Staphylococcus epidermidis
RSNEGISEEL

SEQ ID NO: 1788807 - protein, 11 aa, Staphylococcus epidermidis
RSNKGVDLTEE

SEQ ID NO: 1788808 - protein, 6 aa, Staphylococcus epidermidis
RSPIGV

SEQ ID NO: 1788809 - protein, 5 aa, Staphylococcus epidermidis
RSPKK

SEQ ID NO: 1788810 - protein, 9 aa, Staphylococcus epidermidis
RSQENAQRL

SEQ ID NO: 1788811 - protein, 8 aa, Staphylococcus epidermidis
RSQGSGFK

SEQ ID NO: 1788812 - protein, 11 aa, Staphylococcus epidermidis
RSREEKDERNL

SEQ ID NO: 1788813 - protein, 12 aa, Staphylococcus epidermidis
RSRHSDAEKELN

SEQ ID NO: 1788814 - protein, 11 aa, Staphylococcus epidermidis
RSRKGTFLTEE

SEQ ID NO: 1788815 - protein, 5 aa, Staphylococcus epidermidis
RSRRP

SEQ ID NO: 1788816 - protein, 15 aa, Staphylococcus epidermidis
RSSALGEETPSPEQL

SEQ ID NO: 1788817 - protein, 19 aa, Staphylococcus epidermidis
RSSEGDYEEEDTKTIEEKY

SEQ ID NO: 1788818 - protein, 10 aa, Staphylococcus epidermidis
RSSEHDHGSF

SEQ ID NO: 1788819 - protein, 8 aa, Staphylococcus epidermidis
RSSELPKE

SEQ ID NO: 1788820 - protein, 5 aa, Staphylococcus epidermidis
RSSNS

SEQ ID NO: 1788821 - protein, 4 aa, Staphylococcus epidermidis
RSSP

SEQ ID NO: 1788822 - protein, 13 aa, Staphylococcus epidermidis
RSSQLRPGSKAAA

SEQ ID NO: 1788823 - protein, 8 aa, Staphylococcus epidermidis
RSSQPFTK

SEQ ID NO: 1788824 - protein, 5 aa, Staphylococcus epidermidis
RSTAL

SEQ ID NO: 1788825 - protein, 10 aa, Staphylococcus epidermidis
RSTETIQSRF

SEQ ID NO: 1788826 - protein, 4 aa, Staphylococcus epidermidis
RSTI

SEQ ID NO: 1788827 - protein, 22 aa, Staphylococcus epidermidis
RSTSGPKPKLNNLEGATKDSAY

SEQ ID NO: 1788828 - protein, 7 aa, Staphylococcus epidermidis
RSTTPLS

SEQ ID NO: 1788829 - protein, 7 aa, Staphylococcus epidermidis
RSVEAGT

SEQ ID NO: 1788830 - protein, 9 aa, Staphylococcus epidermidis
RSVSPKVKS

SEQ ID NO: 1788831 - protein, 6 aa, Staphylococcus epidermidis
RTADAI

SEQ ID NO: 1788832 - protein, 6 aa, Staphylococcus epidermidis
RTAGVT

SEQ ID NO: 1788833 - protein, 13 aa, Staphylococcus epidermidis
RTDENEAKIKVNF

SEQ ID NO: 1788834 - protein, 6 aa, Staphylococcus epidermidis
RTDEQL

SEQ ID NO: 1788835 - protein, 5 aa, Staphylococcus epidermidis
RTDTT

SEQ ID NO: 1788836 - protein, 7 aa, Staphylococcus epidermidis
RTEAKLN

SEQ ID NO: 1788837 - protein, 6 aa, Staphylococcus epidermidis
RTEEET

SEQ ID NO: 1788838 - protein, 6 aa, Staphylococcus epidermidis
RTEEGH

SEQ ID NO: 1788839 - protein, 6 aa, Staphylococcus epidermidis
RTEEQT

SEQ ID NO: 1788840 - protein, 7 aa, Staphylococcus epidermidis
RTELTNK

SEQ ID NO: 1788841 - protein, 7 aa, Staphylococcus epidermidis
RTENDNE

SEQ ID NO: 1788842 - protein, 22 aa, Staphylococcus epidermidis
RTEPSQSLRESFNDRDSEDYSD

SEQ ID NO: 1788843 - protein, 5 aa, Staphylococcus epidermidis
RTEQP

SEQ ID NO: 1788844 - protein, 5 aa, Staphylococcus epidermidis
RTFSS

SEQ ID NO: 1788845 - protein, 14 aa, Staphylococcus epidermidis
RTFTNKKGKQITGY

SEQ ID NO: 1788846 - protein, 9 aa, Staphylococcus epidermidis
RTGNEAVPE

SEQ ID NO: 1788847 - protein, 8 aa, Staphylococcus epidermidis
RTGSGYTT

SEQ ID NO: 1788848 - protein, 7 aa, Staphylococcus epidermidis
RTHRKDG

SEQ ID NO: 1788849 - protein, 5 aa, Staphylococcus epidermidis
RTIEP

SEQ ID NO: 1788850 - protein, 6 aa, Staphylococcus epidermidis
RTIEQA

SEQ ID NO: 1788851 - protein, 14 aa, Staphylococcus epidermidis
RTISSSEAGSYSYI

SEQ ID NO: 1788852 - protein, 10 aa, Staphylococcus epidermidis
RTITKFKENS

SEQ ID NO: 1788853 - protein, 17 aa, Staphylococcus epidermidis
RTKDDGAMDTNNRRIAT

SEQ ID NO: 1788854 - protein, 6 aa, Staphylococcus epidermidis
RTKDEI

SEQ ID NO: 1788855 - protein, 5 aa, Staphylococcus epidermidis
RTKDG

SEQ ID NO: 1788856 - protein, 9 aa, Staphylococcus epidermidis
RTKDGRTFH

SEQ ID NO: 1788857 - protein, 8 aa, Staphylococcus epidermidis
RTKDMSKH

SEQ ID NO: 1788858 - protein, 10 aa, Staphylococcus epidermidis
RTKGEPGTGN

SEQ ID NO: 1788859 - protein, 22 aa, Staphylococcus epidermidis
RTKNAQLQATLEEAKDYTTRVR

SEQ ID NO: 1788860 - protein, 16 aa, Staphylococcus epidermidis
RTKQVGVGEKTGDNEF

SEQ ID NO: 1788861 - protein, 17 aa, Staphylococcus epidermidis
RTKQVGVGEKTGDNEFY

SEQ ID NO: 1788862 - protein, 8 aa, Staphylococcus epidermidis
RTKSKGVI

SEQ ID NO: 1788863 - protein, 10 aa, Staphylococcus epidermidis
RTLEEDKNQL

SEQ ID NO: 1788864 - protein, 18 aa, Staphylococcus epidermidis
RTLENSYNAPGRKCIYID

SEQ ID NO: 1788865 - protein, 30 aa, Staphylococcus epidermidis
RTLGSDYEKGAVDDEHERHQEQQREPDYAD

SEQ ID NO: 1788866 - protein, 16 aa, Staphylococcus epidermidis
RTLKENQSKYQYTGYT

SEQ ID NO: 1788867 - protein, 6 aa, Staphylococcus epidermidis
RTNDID

SEQ ID NO: 1788868 - protein, 6 aa, Staphylococcus epidermidis
RTNEDF

SEQ ID NO: 1788869 - protein, 7 aa, Staphylococcus epidermidis
RTNEETA

SEQ ID NO: 1788870 - protein, 17 aa, Staphylococcus epidermidis
RTNGNRKDTSINIEQSG

SEQ ID NO: 1788871 - protein, 6 aa, Staphylococcus epidermidis
RTNNPL

SEQ ID NO: 1788872 - protein, 17 aa, Staphylococcus epidermidis
RTNQASNDFKVNQPGGS

SEQ ID NO: 1788873 - protein, 6 aa, Staphylococcus epidermidis
RTNTEY

SEQ ID NO: 1788874 - protein, 11 aa, Staphylococcus epidermidis
RTPKASTPYTH

SEQ ID NO: 1788875 - protein, 7 aa, Staphylococcus epidermidis
RTPTTKD

SEQ ID NO: 1788876 - protein, 10 aa, Staphylococcus epidermidis
RTPYAKRENG

SEQ ID NO: 1788877 - protein, 11 aa, Staphylococcus epidermidis
RTPYAKRENGI

SEQ ID NO: 1788878 - protein, 11 aa, Staphylococcus epidermidis
RTQETHLKNEH

SEQ ID NO: 1788879 - protein, 6 aa, Staphylococcus epidermidis
RTQIKG

SEQ ID NO: 1788880 - protein, 6 aa, Staphylococcus epidermidis
RTQRRV

SEQ ID NO: 1788881 - protein, 14 aa, Staphylococcus epidermidis
RTQSANSEQSEPHA

SEQ ID NO: 1788882 - protein, 14 aa, Staphylococcus epidermidis
RTRSELVESGQEDL

SEQ ID NO: 1788883 - protein, 4 aa, Staphylococcus epidermidis
RTRY

SEQ ID NO: 1788884 - protein, 7 aa, Staphylococcus epidermidis
RTSHPIR

SEQ ID NO: 1788885 - protein, 12 aa, Staphylococcus epidermidis
RTSLQNAQNQIN

SEQ ID NO: 1788886 - protein, 9 aa, Staphylococcus epidermidis
RTSQKSDDI

SEQ ID NO: 1788887 - protein, 15 aa, Staphylococcus epidermidis
RTSTQGGKGDIGETE

SEQ ID NO: 1788888 - protein, 10 aa, Staphylococcus epidermidis
RTTDKGPEIY

SEQ ID NO: 1788889 - protein, 20 aa, Staphylococcus epidermidis
RTTETAEARNISKKNAMRTA

SEQ ID NO: 1788890 - protein, 12 aa, Staphylococcus epidermidis
RTTGEASAKCHE

SEQ ID NO: 1788891 - protein, 6 aa, Staphylococcus epidermidis
RTTGGR

SEQ ID NO: 1788892 - protein, 7 aa, Staphylococcus epidermidis
RTTNENV

SEQ ID NO: 1788893 - protein, 19 aa, Staphylococcus epidermidis
RTYEKPTQNEYDPQLEKER

SEQ ID NO: 1788894 - protein, 13 aa, Staphylococcus epidermidis
RTYEKQTQNDYDP

SEQ ID NO: 1788895 - protein, 19 aa, Staphylococcus epidermidis
RTYEKRKEKKYDPQLEKDR

SEQ ID NO: 1788896 - protein, 8 aa, Staphylococcus epidermidis
RVAPSVAR

SEQ ID NO: 1788897 - protein, 10 aa, Staphylococcus epidermidis
RVAQKTQSWQ

SEQ ID NO: 1788898 - protein, 6 aa, Staphylococcus epidermidis
RVDKGE

SEQ ID NO: 1788899 - protein, 15 aa, Staphylococcus epidermidis
RVEDREPKALKDNEV

SEQ ID NO: 1788900 - protein, 10 aa, Staphylococcus epidermidis
RVEDREPKVI

SEQ ID NO: 1788901 - protein, 4 aa, Staphylococcus epidermidis
RVHT

SEQ ID NO: 1788902 - protein, 13 aa, Staphylococcus epidermidis
RVIQQGNKYTART

SEQ ID NO: 1788903 - protein, 9 aa, Staphylococcus epidermidis
RVKDTEDYQ

SEQ ID NO: 1788904 - protein, 4 aa, Staphylococcus epidermidis
RVKG

SEQ ID NO: 1788905 - protein, 8 aa, Staphylococcus epidermidis
RVNKRRSV

SEQ ID NO: 1788906 - protein, 6 aa, Staphylococcus epidermidis
RVNKTQ

SEQ ID NO: 1788907 - protein, 6 aa, Staphylococcus epidermidis
RVNTTS

SEQ ID NO: 1788908 - protein, 15 aa, Staphylococcus epidermidis
RVQEAASAVDQKDLY

SEQ ID NO: 1788909 - protein, 7 aa, Staphylococcus epidermidis
RVSAGDL

SEQ ID NO: 1788910 - protein, 11 aa, Staphylococcus epidermidis
RVTANGDLNPV

SEQ ID NO: 1788911 - protein, 11 aa, Staphylococcus epidermidis
RVTNNAIDNEI

SEQ ID NO: 1788912 - protein, 6 aa, Staphylococcus epidermidis
RVTRGS

SEQ ID NO: 1788913 - protein, 29 aa, Staphylococcus epidermidis
RVYRPTGKEDENAGVFGDEGEQNANKKGG

SEQ ID NO: 1788914 - protein, 12 aa, Staphylococcus epidermidis
RWNEQNQAKYTS

SEQ ID NO: 1788915 - protein, 16 aa, Staphylococcus epidermidis
RYAASSRKDPNITKKD

SEQ ID NO: 1788916 - protein, 7 aa, Staphylococcus epidermidis
RYAGRIE

SEQ ID NO: 1788917 - protein, 16 aa, Staphylococcus epidermidis
RYARSIKGTKPTFKKE

SEQ ID NO: 1788918 - protein, 10 aa, Staphylococcus epidermidis
RYDIPTNQAP

SEQ ID NO: 1788919 - protein, 5 aa, Staphylococcus epidermidis
RYDSF

SEQ ID NO: 1788920 - protein, 6 aa, Staphylococcus epidermidis
RYEAHK

SEQ ID NO: 1788921 - protein, 11 aa, Staphylococcus epidermidis
RYEEKNSKPVA

SEQ ID NO: 1788922 - protein, 14 aa, Staphylococcus epidermidis
RYEESGPTNGSCCN

SEQ ID NO: 1788923 - protein, 15 aa, Staphylococcus epidermidis
RYERAYKDKSKEELK

SEQ ID NO: 1788924 - protein, 13 aa, Staphylococcus epidermidis
RYFESEQDVPKQA

SEQ ID NO: 1788925 - protein, 13 aa, Staphylococcus epidermidis
RYGGKSDEDVSDS

SEQ ID NO: 1788926 - protein, 11 aa, Staphylococcus epidermidis
RYHESPSEYTR

SEQ ID NO: 1788927 - protein, 12 aa, Staphylococcus epidermidis
RYKEQKNRSHKT

SEQ ID NO: 1788928 - protein, 7 aa, Staphylococcus epidermidis
RYKTNSK

SEQ ID NO: 1788929 - protein, 9 aa, Staphylococcus epidermidis
RYLNPQEYP

SEQ ID NO: 1788930 - protein, 7 aa, Staphylococcus epidermidis
RYLSDSK

SEQ ID NO: 1788931 - protein, 9 aa, Staphylococcus epidermidis
RYNDENGEE

SEQ ID NO: 1788932 - protein, 10 aa, Staphylococcus epidermidis
RYNERQGGYT

SEQ ID NO: 1788933 - protein, 5 aa, Staphylococcus epidermidis
RYNES

SEQ ID NO: 1788934 - protein, 6 aa, Staphylococcus epidermidis
RYNNGK

SEQ ID NO: 1788935 - protein, 6 aa, Staphylococcus epidermidis
RYNPPL

SEQ ID NO: 1788936 - protein, 20 aa, Staphylococcus epidermidis
RYPADDIDKALSSALGKTVG

SEQ ID NO: 1788937 - protein, 7 aa, Staphylococcus epidermidis
RYPDEFN

SEQ ID NO: 1788938 - protein, 7 aa, Staphylococcus epidermidis
RYRNTGE

SEQ ID NO: 1788939 - protein, 7 aa, Staphylococcus epidermidis
RYSPEKQ

SEQ ID NO: 1788940 - protein, 7 aa, Staphylococcus epidermidis
RYSSSKF

SEQ ID NO: 1788941 - protein, 4 aa, Staphylococcus epidermidis
RYTD

SEQ ID NO: 1788942 - protein, 4 aa, Staphylococcus epidermidis
RYTH

SEQ ID NO: 1788943 - protein, 6 aa, Staphylococcus epidermidis
RYTQAE

SEQ ID NO: 1788944 - protein, 10 aa, Staphylococcus epidermidis
SAASKASDKV

SEQ ID NO: 1788945 - protein, 9 aa, Staphylococcus epidermidis
SAATPTDKA

SEQ ID NO: 1788946 - protein, 7 aa, Staphylococcus epidermidis
SADDEDI

SEQ ID NO: 1788947 - protein, 8 aa, Staphylococcus epidermidis
SADEAIDS

SEQ ID NO: 1788948 - protein, 10 aa, Staphylococcus epidermidis
SADEPGDSMN

SEQ ID NO: 1788949 - protein, 10 aa, Staphylococcus epidermidis
SADKYERAKD

SEQ ID NO: 1788950 - protein, 6 aa, Staphylococcus epidermidis
SADLNQ

SEQ ID NO: 1788951 - protein, 7 aa, Staphylococcus epidermidis
SADNTGR

SEQ ID NO: 1788952 - protein, 5 aa, Staphylococcus epidermidis
SADYA

SEQ ID NO: 1788953 - protein, 16 aa, Staphylococcus epidermidis
SAEADAFKGKISNESP

SEQ ID NO: 1788954 - protein, 7 aa, Staphylococcus epidermidis
SAEEHQD

SEQ ID NO: 1788955 - protein, 11 aa, Staphylococcus epidermidis
SAEETPGDNDE

SEQ ID NO: 1788956 - protein, 5 aa, Staphylococcus epidermidis
SAEEV

SEQ ID NO: 1788957 - protein, 19 aa, Staphylococcus epidermidis
SAEFDPEGQRTGTYTSGKD

SEQ ID NO: 1788958 - protein, 11 aa, Staphylococcus epidermidis
SAEKYEQAKET

SEQ ID NO: 1788959 - protein, 5 aa, Staphylococcus epidermidis
SAETQ

SEQ ID NO: 1788960 - protein, 13 aa, Staphylococcus epidermidis
SAFGKSEKSMAKY

SEQ ID NO: 1788961 - protein, 8 aa, Staphylococcus epidermidis
SAFNSQST

SEQ ID NO: 1788962 - protein, 4 aa, Staphylococcus epidermidis
SAFP

SEQ ID NO: 1788963 - protein, 5 aa, Staphylococcus epidermidis
SAGGF

SEQ ID NO: 1788964 - protein, 11 aa, Staphylococcus epidermidis
SAGKEQNAYPK

SEQ ID NO: 1788965 - protein, 11 aa, Staphylococcus epidermidis
SAGPKATGGHT

SEQ ID NO: 1788966 - protein, 11 aa, Staphylococcus epidermidis
SAGPPLKRSQQ

SEQ ID NO: 1788967 - protein, 6 aa, Staphylococcus epidermidis
SAGQEL

SEQ ID NO: 1788968 - protein, 13 aa, Staphylococcus epidermidis
SAGVKTGKKGEVL

SEQ ID NO: 1788969 - protein, 5 aa, Staphylococcus epidermidis
SAHEA

SEQ ID NO: 1788970 - protein, 5 aa, Staphylococcus epidermidis
SAHGR

SEQ ID NO: 1788971 - protein, 22 aa, Staphylococcus epidermidis
SAINGKPIGGASAGKVKSVKKT

SEQ ID NO: 1788972 - protein, 5 aa, Staphylococcus epidermidis
SAISN

SEQ ID NO: 1788973 - protein, 14 aa, Staphylococcus epidermidis
SAISNTARKHSVNM

SEQ ID NO: 1788974 - protein, 17 aa, Staphylococcus epidermidis
SAITAGYSPKTAHVTGS

SEQ ID NO: 1788975 - protein, 8 aa, Staphylococcus epidermidis
SAKDRAEN

SEQ ID NO: 1788976 - protein, 10 aa, Staphylococcus epidermidis
SAKGKTTHSS

SEQ ID NO: 1788977 - protein, 9 aa, Staphylococcus epidermidis
SAKHVEKCQ

SEQ ID NO: 1788978 - protein, 8 aa, Staphylococcus epidermidis
SAKPVGKA

SEQ ID NO: 1788979 - protein, 8 aa, Staphylococcus epidermidis
SAKPVGRA

SEQ ID NO: 1788980 - protein, 10 aa, Staphylococcus epidermidis
SAKTGEGGKL

SEQ ID NO: 1788981 - protein, 17 aa, Staphylococcus epidermidis
SALKNESDNASKQRLQE

SEQ ID NO: 1788982 - protein, 15 aa, Staphylococcus epidermidis
SALKNESDNPSKHRL

SEQ ID NO: 1788983 - protein, 7 aa, Staphylococcus epidermidis
SAMSQSI

SEQ ID NO: 1788984 - protein, 12 aa, Staphylococcus epidermidis
SANDNNEDSQEI

SEQ ID NO: 1788985 - protein, 20 aa, Staphylococcus epidermidis
SANESKSPDEIKKDLDKKKE

SEQ ID NO: 1788986 - protein, 7 aa, Staphylococcus epidermidis
SANTLTK

SEQ ID NO: 1788987 - protein, 7 aa, Staphylococcus epidermidis
SANVDPV

SEQ ID NO: 1788988 - protein, 5 aa, Staphylococcus epidermidis
SANVS

SEQ ID NO: 1788989 - protein, 9 aa, Staphylococcus epidermidis
SAPAGNDLP

SEQ ID NO: 1788990 - protein, 8 aa, Staphylococcus epidermidis
SAPDELTP

SEQ ID NO: 1788991 - protein, 8 aa, Staphylococcus epidermidis
SAPEALNS

SEQ ID NO: 1788992 - protein, 7 aa, Staphylococcus epidermidis
SAPIENS

SEQ ID NO: 1788993 - protein, 8 aa, Staphylococcus epidermidis
SAPNTLPR

SEQ ID NO: 1788994 - protein, 17 aa, Staphylococcus epidermidis
SAPQTENYASRVDSTEG

SEQ ID NO: 1788995 - protein, 30 aa, Staphylococcus epidermidis
SAPSRVERRKERRSESKKTIEYLSRVRHIE

SEQ ID NO: 1788996 - protein, 8 aa, Staphylococcus epidermidis
SAPTDVEK

SEQ ID NO: 1788997 - protein, 12 aa, Staphylococcus epidermidis
SAPVTEATLGKK

SEQ ID NO: 1788998 - protein, 9 aa, Staphylococcus epidermidis
SAPYEAPEH

SEQ ID NO: 1788999 - protein, 17 aa, Staphylococcus epidermidis
SAQAKSQLNQFKQGGSL

SEQ ID NO: 1789000 - protein, 8 aa, Staphylococcus epidermidis
SAQPHITK

SEQ ID NO: 1789001 - protein, 8 aa, Staphylococcus epidermidis
SAQQSSKH

SEQ ID NO: 1789002 - protein, 7 aa, Staphylococcus epidermidis
SAQTEKL

SEQ ID NO: 1789003 - protein, 6 aa, Staphylococcus epidermidis
SAQYDA

SEQ ID NO: 1789004 - protein, 7 aa, Staphylococcus epidermidis
SAQYSKN

SEQ ID NO: 1789005 - protein, 5 aa, Staphylococcus epidermidis
SARGM

SEQ ID NO: 1789006 - protein, 9 aa, Staphylococcus epidermidis
SASAINTTK

SEQ ID NO: 1789007 - protein, 11 aa, Staphylococcus epidermidis
SASDLEGKDLS

SEQ ID NO: 1789008 - protein, 4 aa, Staphylococcus epidermidis
SASE

SEQ ID NO: 1789009 - protein, 15 aa, Staphylococcus epidermidis
SASEFQKGEHKNVEG

SEQ ID NO: 1789010 - protein, 8 aa, Staphylococcus epidermidis
SASKGSIQ

SEQ ID NO: 1789011 - protein, 10 aa, Staphylococcus epidermidis
SASKSPEEIR

SEQ ID NO: 1789012 - protein, 7 aa, Staphylococcus epidermidis
SASLGSL

SEQ ID NO: 1789013 - protein, 10 aa, Staphylococcus epidermidis
SASLQTESQK

SEQ ID NO: 1789014 - protein, 8 aa, Staphylococcus epidermidis
SASRRTRD

SEQ ID NO: 1789015 - protein, 22 aa, Staphylococcus epidermidis
SASSQNIGHAPKKVTDAIKRQA

SEQ ID NO: 1789016 - protein, 8 aa, Staphylococcus epidermidis
SASSRGKS

SEQ ID NO: 1789017 - protein, 16 aa, Staphylococcus epidermidis
SASYTWSHARKYKFFT

SEQ ID NO: 1789018 - protein, 7 aa, Staphylococcus epidermidis
SATDEEA

SEQ ID NO: 1789019 - protein, 9 aa, Staphylococcus epidermidis
SATGGATFK

SEQ ID NO: 1789020 - protein, 21 aa, Staphylococcus epidermidis
SATNGQLSQKSYEDLENQTGM

SEQ ID NO: 1789021 - protein, 5 aa, Staphylococcus epidermidis
SCEMN

SEQ ID NO: 1789022 - protein, 4 aa, Staphylococcus epidermidis
SDAK

SEQ ID NO: 1789023 - protein, 11 aa, Staphylococcus epidermidis
SDANKYQEQAQ

SEQ ID NO: 1789024 - protein, 8 aa, Staphylococcus epidermidis
SDAPYTTN

SEQ ID NO: 1789025 - protein, 7 aa, Staphylococcus epidermidis
SDATQQA

SEQ ID NO: 1789026 - protein, 10 aa, Staphylococcus epidermidis
SDAWSNAKSV

SEQ ID NO: 1789027 - protein, 8 aa, Staphylococcus epidermidis
SDDAKERI

SEQ ID NO: 1789028 - protein, 4 aa, Staphylococcus epidermidis
SDDD

SEQ ID NO: 1789029 - protein, 7 aa, Staphylococcus epidermidis
SDDDAKK

SEQ ID NO: 1789030 - protein, 15 aa, Staphylococcus epidermidis
SDDDYITSTHRGHGH

SEQ ID NO: 1789031 - protein, 5 aa, Staphylococcus epidermidis
SDDEL

SEQ ID NO: 1789032 - protein, 20 aa, Staphylococcus epidermidis
SDDHDEDGGHQHHHESSNDP

SEQ ID NO: 1789033 - protein, 5 aa, Staphylococcus epidermidis
SDDIY

SEQ ID NO: 1789034 - protein, 11 aa, Staphylococcus epidermidis
SDDKQVKQFSE

SEQ ID NO: 1789035 - protein, 4 aa, Staphylococcus epidermidis
SDDL

SEQ ID NO: 1789036 - protein, 31 aa, Staphylococcus epidermidis
SDDNKRANYDQFGHEGPQGGFGSQGFGGADF

SEQ ID NO: 1789037 - protein, 8 aa, Staphylococcus epidermidis
SDDTTVTV

SEQ ID NO: 1789038 - protein, 4 aa, Staphylococcus epidermidis
SDDY

SEQ ID NO: 1789039 - protein, 22 aa, Staphylococcus epidermidis
SDEAKNKGITCASAGNHAQGVA

SEQ ID NO: 1789040 - protein, 18 aa, Staphylococcus epidermidis
SDEAKNKYMKSEDDITST

SEQ ID NO: 1789041 - protein, 6 aa, Staphylococcus epidermidis
SDEDID

SEQ ID NO: 1789042 - protein, 4 aa, Staphylococcus epidermidis
SDEE

SEQ ID NO: 1789043 - protein, 7 aa, Staphylococcus epidermidis
SDEEKKL

SEQ ID NO: 1789044 - protein, 13 aa, Staphylococcus epidermidis
SDEFENKALTGSA

SEQ ID NO: 1789045 - protein, 11 aa, Staphylococcus epidermidis
SDEFKTNSYDL

SEQ ID NO: 1789046 - protein, 9 aa, Staphylococcus epidermidis
SDEGKAKLK

SEQ ID NO: 1789047 - protein, 9 aa, Staphylococcus epidermidis
SDEGKDEFN

SEQ ID NO: 1789048 - protein, 14 aa, Staphylococcus epidermidis
SDEISKGKSIKQAI

SEQ ID NO: 1789049 - protein, 13 aa, Staphylococcus epidermidis
SDELRGYKSPNEI

SEQ ID NO: 1789050 - protein, 9 aa, Staphylococcus epidermidis
SDENKRVNY

SEQ ID NO: 1789051 - protein, 7 aa, Staphylococcus epidermidis
SDENQKI

SEQ ID NO: 1789052 - protein, 9 aa, Staphylococcus epidermidis
SDENRVNEY

SEQ ID NO: 1789053 - protein, 10 aa, Staphylococcus epidermidis
SDENTIKKEQ

SEQ ID NO: 1789054 - protein, 19 aa, Staphylococcus epidermidis
SDESIEKGFETYTSDNGRM

SEQ ID NO: 1789055 - protein, 9 aa, Staphylococcus epidermidis
SDESRGSSG

SEQ ID NO: 1789056 - protein, 15 aa, Staphylococcus epidermidis
SDEVAESAKELGIEG

SEQ ID NO: 1789057 - protein, 6 aa, Staphylococcus epidermidis
SDFGPL

SEQ ID NO: 1789058 - protein, 12 aa, Staphylococcus epidermidis
SDFKGAAKPGPV

SEQ ID NO: 1789059 - protein, 15 aa, Staphylococcus epidermidis
SDGEVTKYDENGGEI

SEQ ID NO: 1789060 - protein, 14 aa, Staphylococcus epidermidis
SDGINTKAGSLTAN

SEQ ID NO: 1789061 - protein, 12 aa, Staphylococcus epidermidis
SDGISGKKANEE

SEQ ID NO: 1789062 - protein, 13 aa, Staphylococcus epidermidis
SDGKDGKDGTSVE

SEQ ID NO: 1789063 - protein, 7 aa, Staphylococcus epidermidis
SDGLTDK

SEQ ID NO: 1789064 - protein, 5 aa, Staphylococcus epidermidis
SDGTL

SEQ ID NO: 1789065 - protein, 7 aa, Staphylococcus epidermidis
SDIKGKT

SEQ ID NO: 1789066 - protein, 6 aa, Staphylococcus epidermidis
SDIKQT

SEQ ID NO: 1789067 - protein, 14 aa, Staphylococcus epidermidis
SDIKTQHTQDKGEL

SEQ ID NO: 1789068 - protein, 10 aa, Staphylococcus epidermidis
SDIKYKTSKN

SEQ ID NO: 1789069 - protein, 12 aa, Staphylococcus epidermidis
SDILSEEDNYNA

SEQ ID NO: 1789070 - protein, 10 aa, Staphylococcus epidermidis
SDINSSDTYD

SEQ ID NO: 1789071 - protein, 6 aa, Staphylococcus epidermidis
SDISES

SEQ ID NO: 1789072 - protein, 14 aa, Staphylococcus epidermidis
SDKATNSSKEYRFE

SEQ ID NO: 1789073 - protein, 4 aa, Staphylococcus epidermidis
SDKF

SEQ ID NO: 1789074 - protein, 8 aa, Staphylococcus epidermidis
SDKGAQLV

SEQ ID NO: 1789075 - protein, 7 aa, Staphylococcus epidermidis
SDKGERI

SEQ ID NO: 1789076 - protein, 8 aa, Staphylococcus epidermidis
SDKITADE

SEQ ID NO: 1789077 - protein, 9 aa, Staphylococcus epidermidis
SDKKSGRKT

SEQ ID NO: 1789078 - protein, 11 aa, Staphylococcus epidermidis
SDKNGKKSIQI

SEQ ID NO: 1789079 - protein, 18 aa, Staphylococcus epidermidis
SDKPKKVKDEIKKKTKLA

SEQ ID NO: 1789080 - protein, 7 aa, Staphylococcus epidermidis
SDKPSRL

SEQ ID NO: 1789081 - protein, 9 aa, Staphylococcus epidermidis
SDKQAKKEL

SEQ ID NO: 1789082 - protein, 13 aa, Staphylococcus epidermidis
SDKRRKGLNEEPI

SEQ ID NO: 1789083 - protein, 6 aa, Staphylococcus epidermidis
SDKSFQ

SEQ ID NO: 1789084 - protein, 9 aa, Staphylococcus epidermidis
SDKSSVIDK

SEQ ID NO: 1789085 - protein, 14 aa, Staphylococcus epidermidis
SDKVDNYKPAPDGI

SEQ ID NO: 1789086 - protein, 19 aa, Staphylococcus epidermidis
SDKYPSELSGGQRQRTSAA

SEQ ID NO: 1789087 - protein, 4 aa, Staphylococcus epidermidis
SDLE

SEQ ID NO: 1789088 - protein, 5 aa, Staphylococcus epidermidis
SDLGQ

SEQ ID NO: 1789089 - protein, 12 aa, Staphylococcus epidermidis
SDLKTDKVKIND

SEQ ID NO: 1789090 - protein, 8 aa, Staphylococcus epidermidis
SDLNDGID

SEQ ID NO: 1789091 - protein, 5 aa, Staphylococcus epidermidis
SDLPH

SEQ ID NO: 1789092 - protein, 10 aa, Staphylococcus epidermidis
SDLQAKGEKF

SEQ ID NO: 1789093 - protein, 8 aa, Staphylococcus epidermidis
SDLSKTKE

SEQ ID NO: 1789094 - protein, 7 aa, Staphylococcus epidermidis
SDLSTTI

SEQ ID NO: 1789095 - protein, 8 aa, Staphylococcus epidermidis
SDLTPAIR

SEQ ID NO: 1789096 - protein, 6 aa, Staphylococcus epidermidis
SDLYSD

SEQ ID NO: 1789097 - protein, 9 aa, Staphylococcus epidermidis
SDNADEYEK

SEQ ID NO: 1789098 - protein, 12 aa, Staphylococcus epidermidis
SDNEKGRFQDEN

SEQ ID NO: 1789099 - protein, 8 aa, Staphylococcus epidermidis
SDNPKYRS

SEQ ID NO: 1789100 - protein, 12 aa, Staphylococcus epidermidis
SDNQKGRYQEAQ

SEQ ID NO: 1789101 - protein, 13 aa, Staphylococcus epidermidis
SDNRPLKENEVED

SEQ ID NO: 1789102 - protein, 7 aa, Staphylococcus epidermidis
SDNTATG

SEQ ID NO: 1789103 - protein, 9 aa, Staphylococcus epidermidis
SDNTGYPFV

SEQ ID NO: 1789104 - protein, 7 aa, Staphylococcus epidermidis
SDNTPKI

SEQ ID NO: 1789105 - protein, 17 aa, Staphylococcus epidermidis
SDPKGDLVDSTKDRDYR

SEQ ID NO: 1789106 - protein, 7 aa, Staphylococcus epidermidis
SDPNAKW

SEQ ID NO: 1789107 - protein, 9 aa, Staphylococcus epidermidis
SDPSERTSV

SEQ ID NO: 1789108 - protein, 6 aa, Staphylococcus epidermidis
SDQHHK

SEQ ID NO: 1789109 - protein, 9 aa, Staphylococcus epidermidis
SDQKEPEVA

SEQ ID NO: 1789110 - protein, 6 aa, Staphylococcus epidermidis
SDQQMA

SEQ ID NO: 1789111 - protein, 7 aa, Staphylococcus epidermidis
SDQRLTK

SEQ ID NO: 1789112 - protein, 8 aa, Staphylococcus epidermidis
SDQRLTKP

SEQ ID NO: 1789113 - protein, 4 aa, Staphylococcus epidermidis
SDQT

SEQ ID NO: 1789114 - protein, 7 aa, Staphylococcus epidermidis
SDQTLQD

SEQ ID NO: 1789115 - protein, 6 aa, Staphylococcus epidermidis
SDQWSV

SEQ ID NO: 1789116 - protein, 4 aa, Staphylococcus epidermidis
SDQY

SEQ ID NO: 1789117 - protein, 7 aa, Staphylococcus epidermidis
SDRALGS

SEQ ID NO: 1789118 - protein, 8 aa, Staphylococcus epidermidis
SDRDNQPQ

SEQ ID NO: 1789119 - protein, 5 aa, Staphylococcus epidermidis
SDRLN

SEQ ID NO: 1789120 - protein, 9 aa, Staphylococcus epidermidis
SDRNPENLP

SEQ ID NO: 1789121 - protein, 8 aa, Staphylococcus epidermidis
SDRRKGDS

SEQ ID NO: 1789122 - protein, 4 aa, Staphylococcus epidermidis
SDSA

SEQ ID NO: 1789123 - protein, 17 aa, Staphylococcus epidermidis
SDSEAEMRKERVNKTKT

SEQ ID NO: 1789124 - protein, 6 aa, Staphylococcus epidermidis
SDSESI

SEQ ID NO: 1789125 - protein, 6 aa, Staphylococcus epidermidis
SDSEYM

SEQ ID NO: 1789126 - protein, 13 aa, Staphylococcus epidermidis
SDSISTDSKDIDY

SEQ ID NO: 1789127 - protein, 5 aa, Staphylococcus epidermidis
SDSKD

SEQ ID NO: 1789128 - protein, 25 aa, Staphylococcus epidermidis
SDSKFTKTPLENIKSAQEDADRHPT

SEQ ID NO: 1789129 - protein, 5 aa, Staphylococcus epidermidis
SDSKV

SEQ ID NO: 1789130 - protein, 7 aa, Staphylococcus epidermidis
SDSNEIS

SEQ ID NO: 1789131 - protein, 10 aa, Staphylococcus epidermidis
SDSNNKQRYG

SEQ ID NO: 1789132 - protein, 8 aa, Staphylococcus epidermidis
SDSSVEKH

SEQ ID NO: 1789133 - protein, 13 aa, Staphylococcus epidermidis
SDTDIDISDEDFD

SEQ ID NO: 1789134 - protein, 8 aa, Staphylococcus epidermidis
SDTGSASI

SEQ ID NO: 1789135 - protein, 4 aa, Staphylococcus epidermidis
SDTN

SEQ ID NO: 1789136 - protein, 6 aa, Staphylococcus epidermidis
SDTNFD

SEQ ID NO: 1789137 - protein, 6 aa, Staphylococcus epidermidis
SDTPEK

SEQ ID NO: 1789138 - protein, 14 aa, Staphylococcus epidermidis
SDTRDEETDKGGQL

SEQ ID NO: 1789139 - protein, 14 aa, Staphylococcus epidermidis
SDTSSSNSKSVFRS

SEQ ID NO: 1789140 - protein, 21 aa, Staphylococcus epidermidis
SDTTDKRVTYYSNKQDDLKPR

SEQ ID NO: 1789141 - protein, 10 aa, Staphylococcus epidermidis
SDVASKKVEE

SEQ ID NO: 1789142 - protein, 12 aa, Staphylococcus epidermidis
SDVASVSATSTV

SEQ ID NO: 1789143 - protein, 4 aa, Staphylococcus epidermidis
SDVD

SEQ ID NO: 1789144 - protein, 18 aa, Staphylococcus epidermidis
SDVDKYTDTPSYKRTSAR

SEQ ID NO: 1789145 - protein, 13 aa, Staphylococcus epidermidis
SDVDTIKKQRDGA

SEQ ID NO: 1789146 - protein, 10 aa, Staphylococcus epidermidis
SDVEAKETDT

SEQ ID NO: 1789147 - protein, 7 aa, Staphylococcus epidermidis
SDVEPMN

SEQ ID NO: 1789148 - protein, 4 aa, Staphylococcus epidermidis
SDVH

SEQ ID NO: 1789149 - protein, 15 aa, Staphylococcus epidermidis
SDVKMKENVSDIKQK

SEQ ID NO: 1789150 - protein, 8 aa, Staphylococcus epidermidis
SDVNGNQV

SEQ ID NO: 1789151 - protein, 5 aa, Staphylococcus epidermidis
SDYEE

SEQ ID NO: 1789152 - protein, 10 aa, Staphylococcus epidermidis
SDYEKDESEL

SEQ ID NO: 1789153 - protein, 20 aa, Staphylococcus epidermidis
SDYKDKKISVNKEVEEISNK

SEQ ID NO: 1789154 - protein, 9 aa, Staphylococcus epidermidis
SDYKTDDLA

SEQ ID NO: 1789155 - protein, 6 aa, Staphylococcus epidermidis
SDYPDT

SEQ ID NO: 1789156 - protein, 4 aa, Staphylococcus epidermidis
SDYS

SEQ ID NO: 1789157 - protein, 8 aa, Staphylococcus epidermidis
SDYVRHGE

SEQ ID NO: 1789158 - protein, 7 aa, Staphylococcus epidermidis
SDYVSAG

SEQ ID NO: 1789159 - protein, 10 aa, Staphylococcus epidermidis
SEAELSEITE

SEQ ID NO: 1789160 - protein, 12 aa, Staphylococcus epidermidis
SEAGSAGRDTRG

SEQ ID NO: 1789161 - protein, 6 aa, Staphylococcus epidermidis
SEAHED

SEQ ID NO: 1789162 - protein, 5 aa, Staphylococcus epidermidis
SEASV

SEQ ID NO: 1789163 - protein, 7 aa, Staphylococcus epidermidis
SEATKQA

SEQ ID NO: 1789164 - protein, 6 aa, Staphylococcus epidermidis
SEATTV

SEQ ID NO: 1789165 - protein, 4 aa, Staphylococcus epidermidis
SECN

SEQ ID NO: 1789166 - protein, 6 aa, Staphylococcus epidermidis
SEDATF

SEQ ID NO: 1789167 - protein, 6 aa, Staphylococcus epidermidis
SEDEQP

SEQ ID NO: 1789168 - protein, 6 aa, Staphylococcus epidermidis
SEDFEE

SEQ ID NO: 1789169 - protein, 6 aa, Staphylococcus epidermidis
SEDKDD

SEQ ID NO: 1789170 - protein, 8 aa, Staphylococcus epidermidis
SEDKEKVE

SEQ ID NO: 1789171 - protein, 7 aa, Staphylococcus epidermidis
SEDPEKI

SEQ ID NO: 1789172 - protein, 4 aa, Staphylococcus epidermidis
SEDS

SEQ ID NO: 1789173 - protein, 8 aa, Staphylococcus epidermidis
SEDTIAPQ

SEQ ID NO: 1789174 - protein, 12 aa, Staphylococcus epidermidis
SEEATESNFGYQ

SEQ ID NO: 1789175 - protein, 7 aa, Staphylococcus epidermidis
SEEENVD

SEQ ID NO: 1789176 - protein, 8 aa, Staphylococcus epidermidis
SEEEQQHL

SEQ ID NO: 1789177 - protein, 6 aa, Staphylococcus epidermidis
SEEFNT

SEQ ID NO: 1789178 - protein, 4 aa, Staphylococcus epidermidis
SEEG

SEQ ID NO: 1789179 - protein, 5 aa, Staphylococcus epidermidis
SEEGL

SEQ ID NO: 1789180 - protein, 7 aa, Staphylococcus epidermidis
SEEHPNA

SEQ ID NO: 1789181 - protein, 19 aa, Staphylococcus epidermidis
SEEKRTFARETIEKDREIN

SEQ ID NO: 1789182 - protein, 6 aa, Staphylococcus epidermidis
SEELTN

SEQ ID NO: 1789183 - protein, 4 aa, Staphylococcus epidermidis
SEEN

SEQ ID NO: 1789184 - protein, 7 aa, Staphylococcus epidermidis
SEENHKL

SEQ ID NO: 1789185 - protein, 5 aa, Staphylococcus epidermidis
SEEQI

SEQ ID NO: 1789186 - protein, 9 aa, Staphylococcus epidermidis
SEEQTKASY

SEQ ID NO: 1789187 - protein, 125 aa, Staphylococcus epidermidis
SEETSAQYEEHSYDESETSGYQAYSDSNYTQDYGQTYTTDSYGKRHRRRRASQMTEGSSSDSYQSNHVDKQTSHEPKRNSRRNTYSQSNAQKDHKKENHHPRTKLQSERLKSKSQLHSPSSSEFT

SEQ ID NO: 1789188 - protein, 5 aa, Staphylococcus epidermidis
SEEVA

SEQ ID NO: 1789189 - protein, 6 aa, Staphylococcus epidermidis
SEEVPP

SEQ ID NO: 1789190 - protein, 14 aa, Staphylococcus epidermidis
SEFDNYSVGTTKKG

SEQ ID NO: 1789191 - protein, 6 aa, Staphylococcus epidermidis
SEFDPM

SEQ ID NO: 1789192 - protein, 5 aa, Staphylococcus epidermidis
SEFGL

SEQ ID NO: 1789193 - protein, 5 aa, Staphylococcus epidermidis
SEFGP

SEQ ID NO: 1789194 - protein, 6 aa, Staphylococcus epidermidis
SEFGPL

SEQ ID NO: 1789195 - protein, 6 aa, Staphylococcus epidermidis
SEFGPM

SEQ ID NO: 1789196 - protein, 4 aa, Staphylococcus epidermidis
SEFK

SEQ ID NO: 1789197 - protein, 7 aa, Staphylococcus epidermidis
SEFKEPN

SEQ ID NO: 1789198 - protein, 9 aa, Staphylococcus epidermidis
SEFTKSTKE

SEQ ID NO: 1789199 - protein, 4 aa, Staphylococcus epidermidis
SEGA

SEQ ID NO: 1789200 - protein, 6 aa, Staphylococcus epidermidis
SEGAFA

SEQ ID NO: 1789201 - protein, 6 aa, Staphylococcus epidermidis
SEGDVI

SEQ ID NO: 1789202 - protein, 7 aa, Staphylococcus epidermidis
SEGEQRA

SEQ ID NO: 1789203 - protein, 6 aa, Staphylococcus epidermidis
SEGFTI

SEQ ID NO: 1789204 - protein, 15 aa, Staphylococcus epidermidis
SEGISEEVKDAVKNA

SEQ ID NO: 1789205 - protein, 6 aa, Staphylococcus epidermidis
SEGNHD

SEQ ID NO: 1789206 - protein, 8 aa, Staphylococcus epidermidis
SEGTAYRA

SEQ ID NO: 1789207 - protein, 7 aa, Staphylococcus epidermidis
SEGTNFP

SEQ ID NO: 1789208 - protein, 7 aa, Staphylococcus epidermidis
SEGTSAQ

SEQ ID NO: 1789209 - protein, 4 aa, Staphylococcus epidermidis
SEGV

SEQ ID NO: 1789210 - protein, 8 aa, Staphylococcus epidermidis
SEGYGPNA

SEQ ID NO: 1789211 - protein, 5 aa, Staphylococcus epidermidis
SEGYK

SEQ ID NO: 1789212 - protein, 4 aa, Staphylococcus epidermidis
SEHL

SEQ ID NO: 1789213 - protein, 8 aa, Staphylococcus epidermidis
SEHSTREV

SEQ ID NO: 1789214 - protein, 7 aa, Staphylococcus epidermidis
SEHSYPI

SEQ ID NO: 1789215 - protein, 12 aa, Staphylococcus epidermidis
SEIEAEGDVETG

SEQ ID NO: 1789216 - protein, 9 aa, Staphylococcus epidermidis
SEIGSDRAV

SEQ ID NO: 1789217 - protein, 7 aa, Staphylococcus epidermidis
SEIQNYN

SEQ ID NO: 1789218 - protein, 8 aa, Staphylococcus epidermidis
SEIRKHDP

SEQ ID NO: 1789219 - protein, 11 aa, Staphylococcus epidermidis
SEISESKNKRI

SEQ ID NO: 1789220 - protein, 6 aa, Staphylococcus epidermidis
SEISIS

SEQ ID NO: 1789221 - protein, 7 aa, Staphylococcus epidermidis
SEISKAK

SEQ ID NO: 1789222 - protein, 8 aa, Staphylococcus epidermidis
SEKDGRQA

SEQ ID NO: 1789223 - protein, 9 aa, Staphylococcus epidermidis
SEKEIKSED

SEQ ID NO: 1789224 - protein, 16 aa, Staphylococcus epidermidis
SEKEVTKRQARAHSSI

SEQ ID NO: 1789225 - protein, 5 aa, Staphylococcus epidermidis
SEKFG

SEQ ID NO: 1789226 - protein, 6 aa, Staphylococcus epidermidis
SEKGID

SEQ ID NO: 1789227 - protein, 8 aa, Staphylococcus epidermidis
SEKGKEYI

SEQ ID NO: 1789228 - protein, 6 aa, Staphylococcus epidermidis
SEKHKG

SEQ ID NO: 1789229 - protein, 15 aa, Staphylococcus epidermidis
SEKISEAMDENDPIP

SEQ ID NO: 1789230 - protein, 7 aa, Staphylococcus epidermidis
SEKMPYR

SEQ ID NO: 1789231 - protein, 6 aa, Staphylococcus epidermidis
SEKNAQ

SEQ ID NO: 1789232 - protein, 6 aa, Staphylococcus epidermidis
SEKNDE

SEQ ID NO: 1789233 - protein, 16 aa, Staphylococcus epidermidis
SEKNTYYDKENKLGGN

SEQ ID NO: 1789234 - protein, 10 aa, Staphylococcus epidermidis
SEKPAAGKSI

SEQ ID NO: 1789235 - protein, 13 aa, Staphylococcus epidermidis
SEKPDIDYDDDGG

SEQ ID NO: 1789236 - protein, 13 aa, Staphylococcus epidermidis
SEKSGVSRLGGEE

SEQ ID NO: 1789237 - protein, 9 aa, Staphylococcus epidermidis
SEKTKEHFA

SEQ ID NO: 1789238 - protein, 12 aa, Staphylococcus epidermidis
SEKTMQENHANL

SEQ ID NO: 1789239 - protein, 8 aa, Staphylococcus epidermidis
SEKTNPAA

SEQ ID NO: 1789240 - protein, 7 aa, Staphylococcus epidermidis
SEKYDTP

SEQ ID NO: 1789241 - protein, 5 aa, Staphylococcus epidermidis
SEKYK

SEQ ID NO: 1789242 - protein, 4 aa, Staphylococcus epidermidis
SELE

SEQ ID NO: 1789243 - protein, 19 aa, Staphylococcus epidermidis
SELEKKVQQLKQDIGDTQT

SEQ ID NO: 1789244 - protein, 6 aa, Staphylococcus epidermidis
SELESD

SEQ ID NO: 1789245 - protein, 7 aa, Staphylococcus epidermidis
SELHGSL

SEQ ID NO: 1789246 - protein, 4 aa, Staphylococcus epidermidis
SELL

SEQ ID NO: 1789247 - protein, 18 aa, Staphylococcus epidermidis
SELNQEGKDAEVKHGIEN

SEQ ID NO: 1789248 - protein, 4 aa, Staphylococcus epidermidis
SELP

SEQ ID NO: 1789249 - protein, 9 aa, Staphylococcus epidermidis
SELPTLREK

SEQ ID NO: 1789250 - protein, 27 aa, Staphylococcus epidermidis
SELQNQNDKNQEVKDKSVNDNRLKSLL

SEQ ID NO: 1789251 - protein, 10 aa, Staphylococcus epidermidis
SELTTPTGAA

SEQ ID NO: 1789252 - protein, 5 aa, Staphylococcus epidermidis
SEMIR

SEQ ID NO: 1789253 - protein, 9 aa, Staphylococcus epidermidis
SEMSMGKED

SEQ ID NO: 1789254 - protein, 9 aa, Staphylococcus epidermidis
SENALTNAK

SEQ ID NO: 1789255 - protein, 7 aa, Staphylococcus epidermidis
SENDSWN

SEQ ID NO: 1789256 - protein, 6 aa, Staphylococcus epidermidis
SENEGD

SEQ ID NO: 1789257 - protein, 8 aa, Staphylococcus epidermidis
SENKEDEY

SEQ ID NO: 1789258 - protein, 20 aa, Staphylococcus epidermidis
SENKNSKEKLLPNYKENEKL

SEQ ID NO: 1789259 - protein, 10 aa, Staphylococcus epidermidis
SENQKELKQQ

SEQ ID NO: 1789260 - protein, 4 aa, Staphylococcus epidermidis
SEPT

SEQ ID NO: 1789261 - protein, 10 aa, Staphylococcus epidermidis
SEQDAQNLYD

SEQ ID NO: 1789262 - protein, 6 aa, Staphylococcus epidermidis
SEQNNT

SEQ ID NO: 1789263 - protein, 10 aa, Staphylococcus epidermidis
SEQSKDQACE

SEQ ID NO: 1789264 - protein, 9 aa, Staphylococcus epidermidis
SEQTANEFN

SEQ ID NO: 1789265 - protein, 6 aa, Staphylococcus epidermidis
SEQYEE

SEQ ID NO: 1789266 - protein, 5 aa, Staphylococcus epidermidis
SEQYG

SEQ ID NO: 1789267 - protein, 26 aa, Staphylococcus epidermidis
SERGLETAVGDEGGFAPKFEGTEDAV

SEQ ID NO: 1789268 - protein, 4 aa, Staphylococcus epidermidis
SERK

SEQ ID NO: 1789269 - protein, 11 aa, Staphylococcus epidermidis
SERKEEPRLGE

SEQ ID NO: 1789270 - protein, 31 aa, Staphylococcus epidermidis
SERKEYASKIGNYPHATLSTSGISLKSDRYN

SEQ ID NO: 1789271 - protein, 5 aa, Staphylococcus epidermidis
SERPE

SEQ ID NO: 1789272 - protein, 6 aa, Staphylococcus epidermidis
SERQAQ

SEQ ID NO: 1789273 - protein, 6 aa, Staphylococcus epidermidis
SERQQE

SEQ ID NO: 1789274 - protein, 29 aa, Staphylococcus epidermidis
SERTKKGLEAARARGRKGGRPSLPDHKKR

SEQ ID NO: 1789275 - protein, 6 aa, Staphylococcus epidermidis
SERYPA

SEQ ID NO: 1789276 - protein, 4 aa, Staphylococcus epidermidis
SESA

SEQ ID NO: 1789277 - protein, 7 aa, Staphylococcus epidermidis
SESALKK

SEQ ID NO: 1789278 - protein, 8 aa, Staphylococcus epidermidis
SESDRNLE

SEQ ID NO: 1789279 - protein, 4 aa, Staphylococcus epidermidis
SESE

SEQ ID NO: 1789280 - protein, 15 aa, Staphylococcus epidermidis
SESEYEKLRSSAETL

SEQ ID NO: 1789281 - protein, 6 aa, Staphylococcus epidermidis
SESGEA

SEQ ID NO: 1789282 - protein, 10 aa, Staphylococcus epidermidis
SESLSSIQRG

SEQ ID NO: 1789283 - protein, 4 aa, Staphylococcus epidermidis
SESN

SEQ ID NO: 1789284 - protein, 7 aa, Staphylococcus epidermidis
SESNPDV

SEQ ID NO: 1789285 - protein, 13 aa, Staphylococcus epidermidis
SESRSDGANTTTH

SEQ ID NO: 1789286 - protein, 4 aa, Staphylococcus epidermidis
SESS

SEQ ID NO: 1789287 - protein, 8 aa, Staphylococcus epidermidis
SESSSIKG

SEQ ID NO: 1789288 - protein, 5 aa, Staphylococcus epidermidis
SESTV

SEQ ID NO: 1789289 - protein, 7 aa, Staphylococcus epidermidis
SESYSKD

SEQ ID NO: 1789290 - protein, 5 aa, Staphylococcus epidermidis
SETDT

SEQ ID NO: 1789291 - protein, 6 aa, Staphylococcus epidermidis
SETEQL

SEQ ID NO: 1789292 - protein, 6 aa, Staphylococcus epidermidis
SETGEA

SEQ ID NO: 1789293 - protein, 8 aa, Staphylococcus epidermidis
SETGNAQG

SEQ ID NO: 1789294 - protein, 7 aa, Staphylococcus epidermidis
SETLGEE

SEQ ID NO: 1789295 - protein, 8 aa, Staphylococcus epidermidis
SETNLPSR

SEQ ID NO: 1789296 - protein, 20 aa, Staphylococcus epidermidis
SETPPNHVSQSEWSSRRDAM

SEQ ID NO: 1789297 - protein, 5 aa, Staphylococcus epidermidis
SETPQ

SEQ ID NO: 1789298 - protein, 23 aa, Staphylococcus epidermidis
SETQAQMDKRMKEKSSGKVSRKE

SEQ ID NO: 1789299 - protein, 9 aa, Staphylococcus epidermidis
SETSDKEEV

SEQ ID NO: 1789300 - protein, 7 aa, Staphylococcus epidermidis
SETSGTA

SEQ ID NO: 1789301 - protein, 23 aa, Staphylococcus epidermidis
SETSNKQPSIETLQQGSSMQPRQ

SEQ ID NO: 1789302 - protein, 4 aa, Staphylococcus epidermidis
SETV

SEQ ID NO: 1789303 - protein, 7 aa, Staphylococcus epidermidis
SETYENS

SEQ ID NO: 1789304 - protein, 7 aa, Staphylococcus epidermidis
SEVDEET

SEQ ID NO: 1789305 - protein, 4 aa, Staphylococcus epidermidis
SEVI

SEQ ID NO: 1789306 - protein, 33 aa, Staphylococcus epidermidis
SEVNHANNIKQSSDFINEDEGPQNAYNNALQKA

SEQ ID NO: 1789307 - protein, 9 aa, Staphylococcus epidermidis
SEVRRGNKA

SEQ ID NO: 1789308 - protein, 8 aa, Staphylococcus epidermidis
SEVTDQTR

SEQ ID NO: 1789309 - protein, 17 aa, Staphylococcus epidermidis
SEWDSLKPKEDEIASYK

SEQ ID NO: 1789310 - protein, 36 aa, Staphylococcus epidermidis
SEYEPRESEYRPRDTEKNIKRPKELRVQSRENDFEL

SEQ ID NO: 1789311 - protein, 15 aa, Staphylococcus epidermidis
SEYGTNYDESKFRKE

SEQ ID NO: 1789312 - protein, 4 aa, Staphylococcus epidermidis
SEYN

SEQ ID NO: 1789313 - protein, 37 aa, Staphylococcus epidermidis
SEYQDITNRYSSMSANTDLKSESKLDLTKSYKTLDTS

SEQ ID NO: 1789314 - protein, 8 aa, Staphylococcus epidermidis
SEYQGPYQ

SEQ ID NO: 1789315 - protein, 8 aa, Staphylococcus epidermidis
SFASKNKG

SEQ ID NO: 1789316 - protein, 9 aa, Staphylococcus epidermidis
SFATENGEQ

SEQ ID NO: 1789317 - protein, 4 aa, Staphylococcus epidermidis
SFDD

SEQ ID NO: 1789318 - protein, 6 aa, Staphylococcus epidermidis
SFDEDK

SEQ ID NO: 1789319 - protein, 21 aa, Staphylococcus epidermidis
SFDKKGNAKEMSKGELAAYKK

SEQ ID NO: 1789320 - protein, 11 aa, Staphylococcus epidermidis
SFDKKTKEGQS

SEQ ID NO: 1789321 - protein, 4 aa, Staphylococcus epidermidis
SFDQ

SEQ ID NO: 1789322 - protein, 35 aa, Staphylococcus epidermidis; identical to SEQ ID NO: 1735202

SEQ ID NO: 1789323 - protein, 5 aa, Staphylococcus epidermidis
SFDTN

SEQ ID NO: 1789324 - protein, 10 aa, Staphylococcus epidermidis
SFEANPDELT

SEQ ID NO: 1789325 - protein, 6 aa, Staphylococcus epidermidis
SFESDN

SEQ ID NO: 1789326 - protein, 4 aa, Staphylococcus epidermidis
SFEY

SEQ ID NO: 1789327 - protein, 6 aa, Staphylococcus epidermidis
SFGKES

SEQ ID NO: 1789328 - protein, 8 aa, Staphylococcus epidermidis
SFHDERTD

SEQ ID NO: 1789329 - protein, 11 aa, Staphylococcus epidermidis
SFKDPNNEHLK

SEQ ID NO: 1789330 - protein, 13 aa, Staphylococcus epidermidis
SFNDSNDDGIGDL

SEQ ID NO: 1789331 - protein, 14 aa, Staphylococcus epidermidis
SFNDTTGNGEGDLN

SEQ ID NO: 1789332 - protein, 9 aa, Staphylococcus epidermidis
SFNKDKKAV

SEQ ID NO: 1789333 - protein, 9 aa, Staphylococcus epidermidis
SFNKNSNKT

SEQ ID NO: 1789334 - protein, 15 aa, Staphylococcus epidermidis
SFNNPTFTDEQNSKI

SEQ ID NO: 1789335 - protein, 5 aa, Staphylococcus epidermidis
SFNPA

SEQ ID NO: 1789336 - protein, 15 aa, Staphylococcus epidermidis
SFNTSYSVDNTTQNQ

SEQ ID NO: 1789337 - protein, 6 aa, Staphylococcus epidermidis
SFPNGE

SEQ ID NO: 1789338 - protein, 6 aa, Staphylococcus epidermidis
SFPTTP

SEQ ID NO: 1789339 - protein, 6 aa, Staphylococcus epidermidis
SFQDEV

SEQ ID NO: 1789340 - protein, 14 aa, Staphylococcus epidermidis
SFQDGRQRLENEGL

SEQ ID NO: 1789341 - protein, 17 aa, Staphylococcus epidermidis
SFQKDKSKKKIASQEEK

SEQ ID NO: 1789342 - protein, 4 aa, Staphylococcus epidermidis
SFSD

SEQ ID NO: 1789343 - protein, 13 aa, Staphylococcus epidermidis
SFSGKQSLKRVLR

SEQ ID NO: 1789344 - protein, 7 aa, Staphylococcus epidermidis
SFSGQAA

SEQ ID NO: 1789345 - protein, 10 aa, Staphylococcus epidermidis
SFSSNNKNGY

SEQ ID NO: 1789346 - protein, 18 aa, Staphylococcus epidermidis
SFSTGSSIMPQKKNPDMA

SEQ ID NO: 1789347 - protein, 11 aa, Staphylococcus epidermidis
SFSTTKDGTTV

SEQ ID NO: 1789348 - protein, 5 aa, Staphylococcus epidermidis
SFTEA

SEQ ID NO: 1789349 - protein, 6 aa, Staphylococcus epidermidis
SFTHED

SEQ ID NO: 1789350 - protein, 7 aa, Staphylococcus epidermidis
SFTHENG

SEQ ID NO: 1789351 - protein, 4 aa, Staphylococcus epidermidis
SFTK

SEQ ID NO: 1789352 - protein, 19 aa, Staphylococcus epidermidis
SFTRAGKQGGGLKGSDTRS

SEQ ID NO: 1789353 - protein, 6 aa, Staphylococcus epidermidis
SFYNSD

SEQ ID NO: 1789354 - protein, 6 aa, Staphylococcus epidermidis
SGAELK

SEQ ID NO: 1789355 - protein, 8 aa, Staphylococcus epidermidis
SGAGALDQ

SEQ ID NO: 1789356 - protein, 8 aa, Staphylococcus epidermidis
SGAGHLSA

SEQ ID NO: 1789357 - protein, 13 aa, Staphylococcus epidermidis
SGAKLSKEQFDNV

SEQ ID NO: 1789358 - protein, 10 aa, Staphylococcus epidermidis
SGAKRERPEL

SEQ ID NO: 1789359 - protein, 4 aa, Staphylococcus epidermidis
SGAN

SEQ ID NO: 1789360 - protein, 21 aa, Staphylococcus epidermidis
SGATISTNKDNSIYEQATKIK

SEQ ID NO: 1789361 - protein, 11 aa, Staphylococcus epidermidis
SGAYYGGDTLK

SEQ ID NO: 1789362 - protein, 6 aa, Staphylococcus epidermidis
SGCGKT

SEQ ID NO: 1789363 - protein, 8 aa, Staphylococcus epidermidis
SGDEGLDQ

SEQ ID NO: 1789364 - protein, 7 aa, Staphylococcus epidermidis
SGDKPSF

SEQ ID NO: 1789365 - protein, 13 aa, Staphylococcus epidermidis
SGDPKDIERADEE

SEQ ID NO: 1789366 - protein, 5 aa, Staphylococcus epidermidis
SGDRI

SEQ ID NO: 1789367 - protein, 4 aa, Staphylococcus epidermidis
SGDS

SEQ ID NO: 1789368 - protein, 15 aa, Staphylococcus epidermidis
SGDSLMDDDTKSHLQ

SEQ ID NO: 1789369 - protein, 15 aa, Staphylococcus epidermidis
SGDSLMDDNTKNHLQ

SEQ ID NO: 1789370 - protein, 8 aa, Staphylococcus epidermidis
SGDTVNVG

SEQ ID NO: 1789371 - protein, 9 aa, Staphylococcus epidermidis
SGEEAEDIG

SEQ ID NO: 1789372 - protein, 9 aa, Staphylococcus epidermidis
SGEISGRPK

SEQ ID NO: 1789373 - protein, 4 aa, Staphylococcus epidermidis
SGEQ

SEQ ID NO: 1789374 - protein, 5 aa, Staphylococcus epidermidis
SGERI

SEQ ID NO: 1789375 - protein, 8 aa, Staphylococcus epidermidis
SGETADSR

SEQ ID NO: 1789376 - protein, 8 aa, Staphylococcus epidermidis
SGETENVQ

SEQ ID NO: 1789377 - protein, 9 aa, Staphylococcus epidermidis
SGEYGNLKE

SEQ ID NO: 1789378 - protein, 7 aa, Staphylococcus epidermidis
SGEYSMT

SEQ ID NO: 1789379 - protein, 10 aa, Staphylococcus epidermidis
SGFKDGSFER

SEQ ID NO: 1789380 - protein, 5 aa, Staphylococcus epidermidis
SGFTV

SEQ ID NO: 1789381 - protein, 7 aa, Staphylococcus epidermidis
SGGEAQR

SEQ ID NO: 1789382 - protein, 8 aa, Staphylococcus epidermidis
SGGEKQRV

SEQ ID NO: 1789383 - protein, 5 aa, Staphylococcus epidermidis
SGGER

SEQ ID NO: 1789384 - protein, 23 aa, Staphylococcus epidermidis
SGGEVGALTGPSLMPGGQEDAYH

SEQ ID NO: 1789385 - protein, 10 aa, Staphylococcus epidermidis
SGGFKQEASL

SEQ ID NO: 1789386 - protein, 12 aa, Staphylococcus epidermidis
SGGGDVYSGSEI

SEQ ID NO: 1789387 - protein, 18 aa, Staphylococcus epidermidis
SGGGEERLHGQSSIGVGG

SEQ ID NO: 1789388 - protein, 8 aa, Staphylococcus epidermidis
SGGGNTAL

SEQ ID NO: 1789389 - protein, 12 aa, Staphylococcus epidermidis
SGGGSGHEPAHA

SEQ ID NO: 1789390 - protein, 8 aa, Staphylococcus epidermidis
SGGIPKKS

SEQ ID NO: 1789391 - protein, 12 aa, Staphylococcus epidermidis
SGGKGTADEKIK

SEQ ID NO: 1789392 - protein, 13 aa, Staphylococcus epidermidis
SGGKGTASEKIKT

SEQ ID NO: 1789393 - protein, 6 aa, Staphylococcus epidermidis
SGGKHH

SEQ ID NO: 1789394 - protein, 6 aa, Staphylococcus epidermidis
SGGKRV

SEQ ID NO: 1789395 - protein, 9 aa, Staphylococcus epidermidis
SGGNKNYQR

SEQ ID NO: 1789396 - protein, 6 aa, Staphylococcus epidermidis
SGGNPA

SEQ ID NO: 1789397 - protein, 8 aa, Staphylococcus epidermidis
SGGNSSML

SEQ ID NO: 1789398 - protein, 13 aa, Staphylococcus epidermidis
SGGPNSVYEEGSF

SEQ ID NO: 1789399 - protein, 10 aa, Staphylococcus epidermidis
SGGQDSTLTG

SEQ ID NO: 1789400 - protein, 5 aa, Staphylococcus epidermidis
SGHDS

SEQ ID NO: 1789401 - protein, 5 aa, Staphylococcus epidermidis
SGICS

SEQ ID NO: 1789402 - protein, 13 aa, Staphylococcus epidermidis
SGIETNNKKDLTK

SEQ ID NO: 1789403 - protein, 5 aa, Staphylococcus epidermidis
SGIEY

SEQ ID NO: 1789404 - protein, 6 aa, Staphylococcus epidermidis
SGIGYE

SEQ ID NO: 1789405 - protein, 5 aa, Staphylococcus epidermidis
SGIIK

SEQ ID NO: 1789406 - protein, 10 aa, Staphylococcus epidermidis
SGIRDAAEQL

SEQ ID NO: 1789407 - protein, 15 aa, Staphylococcus epidermidis
SGISGSYQSATQAGE

SEQ ID NO: 1789408 - protein, 18 aa, Staphylococcus epidermidis
SGKAANVLSQNGLKAKTI

SEQ ID NO: 1789409 - protein, 7 aa, Staphylococcus epidermidis
SGKELAH

SEQ ID NO: 1789410 - protein, 6 aa, Staphylococcus epidermidis
SGKEPQ

SEQ ID NO: 1789411 - protein, 9 aa, Staphylococcus epidermidis
SGKESYKEG

SEQ ID NO: 1789412 - protein, 6 aa, Staphylococcus epidermidis
SGKGFD

SEQ ID NO: 1789413 - protein, 5 aa, Staphylococcus epidermidis
SGKGH

SEQ ID NO: 1789414 - protein, 17 aa, Staphylococcus epidermidis
SGKIARGKMKSKYLNGE

SEQ ID NO: 1789415 - protein, 5 aa, Staphylococcus epidermidis
SGKIS

SEQ ID NO: 1789416 - protein, 4 aa, Staphylococcus epidermidis
SGKK

SEQ ID NO: 1789417 - protein, 8 aa, Staphylococcus epidermidis
SGKNSHKL

SEQ ID NO: 1789418 - protein, 9 aa, Staphylococcus epidermidis
SGKNSTGSL

SEQ ID NO: 1789419 - protein, 59 aa, Staphylococcus epidermidis
SGKSEDDIQKELTEDVESDASSDSDTSTESDDLNLNETAEDSKPKKKPKKLSEADFDED

SEQ ID NO: 1789420 - protein, 5 aa, Staphylococcus epidermidis
SGKSI

SEQ ID NO: 1789421 - protein, 9 aa, Staphylococcus epidermidis
SGKSKNKII

SEQ ID NO: 1789422 - protein, 16 aa, Staphylococcus epidermidis
SGKSSQDNKNDSDNKE

SEQ ID NO: 1789423 - protein, 7 aa, Staphylococcus epidermidis
SGKSTAY

SEQ ID NO: 1789424 - protein, 9 aa, Staphylococcus epidermidis
SGKTAERLN

SEQ ID NO: 1789425 - protein, 8 aa, Staphylococcus epidermidis
SGKTIDGL

SEQ ID NO: 1789426 - protein, 7 aa, Staphylococcus epidermidis
SGKTSTL

SEQ ID NO: 1789427 - protein, 14 aa, Staphylococcus epidermidis
SGKTTADLGGQYKT

SEQ ID NO: 1789428 - protein, 6 aa, Staphylococcus epidermidis
SGKVDE

SEQ ID NO: 1789429 - protein, 4 aa, Staphylococcus epidermidis
SGKY

SEQ ID NO: 1789430 - protein, 12 aa, Staphylococcus epidermidis
SGLARRGINVNI

SEQ ID NO: 1789431 - protein, 7 aa, Staphylococcus epidermidis
SGLDQEA

SEQ ID NO: 1789432 - protein, 6 aa, Staphylococcus epidermidis
SGLENF

SEQ ID NO: 1789433 - protein, 5 aa, Staphylococcus epidermidis
SGLEP

SEQ ID NO: 1789434 - protein, 4 aa, Staphylococcus epidermidis
SGLG

SEQ ID NO: 1789435 - protein, 13 aa, Staphylococcus epidermidis
SGLGGKRNAGYGQ

SEQ ID NO: 1789436 - protein, 5 aa, Staphylococcus epidermidis
SGLSG

SEQ ID NO: 1789437 - protein, 9 aa, Staphylococcus epidermidis
SGMDPDEYI

SEQ ID NO: 1789438 - protein, 9 aa, Staphylococcus epidermidis
SGMNKPNGM

SEQ ID NO: 1789439 - protein, 5 aa, Staphylococcus epidermidis
SGNDI

SEQ ID NO: 1789440 - protein, 10 aa, Staphylococcus epidermidis
SGNDQSSKRD

SEQ ID NO: 1789441 - protein, 13 aa, Staphylococcus epidermidis
SGNEAQQQLDKKS

SEQ ID NO: 1789442 - protein, 10 aa, Staphylococcus epidermidis
SGNESYKSGI

SEQ ID NO: 1789443 - protein, 6 aa, Staphylococcus epidermidis
SGNHKE

SEQ ID NO: 1789444 - protein, 6 aa, Staphylococcus epidermidis
SGNIPA

SEQ ID NO: 1789445 - protein, 9 aa, Staphylococcus epidermidis
SGNIPKELS

SEQ ID NO: 1789446 - protein, 9 aa, Staphylococcus epidermidis
SGNKKAVDS

SEQ ID NO: 1789447 - protein, 7 aa, Staphylococcus epidermidis
SGNKSGI

SEQ ID NO: 1789448 - protein, 12 aa, Staphylococcus epidermidis
SGNKSQNKDNYR

SEQ ID NO: 1789449 - protein, 6 aa, Staphylococcus epidermidis
SGNQYA

SEQ ID NO: 1789450 - protein, 7 aa, Staphylococcus epidermidis
SGNRNWG

SEQ ID NO: 1789451 - protein, 15 aa, Staphylococcus epidermidis
SGNRSAKASKYLAEQ

SEQ ID NO: 1789452 - protein, 8 aa, Staphylococcus epidermidis
SGNRSTKA

SEQ ID NO: 1789453 - protein, 18 aa, Staphylococcus epidermidis
SGNTFDKNFRKSAKTVGD

SEQ ID NO: 1789454 - protein, 7 aa, Staphylococcus epidermidis
SGNTNER

SEQ ID NO: 1789455 - protein, 5 aa, Staphylococcus epidermidis
SGPAA

SEQ ID NO: 1789456 - protein, 7 aa, Staphylococcus epidermidis
SGPFANQ

SEQ ID NO: 1789457 - protein, 11 aa, Staphylococcus epidermidis
SGPGATNAITG

SEQ ID NO: 1789458 - protein, 19 aa, Staphylococcus epidermidis
SGPGATNAITGITDAHSDS

SEQ ID NO: 1789459 - protein, 12 aa, Staphylococcus epidermidis
SGPIPPNPSELI

SEQ ID NO: 1789460 - protein, 10 aa, Staphylococcus epidermidis
SGPPSRGEEV

SEQ ID NO: 1789461 - protein, 14 aa, Staphylococcus epidermidis
SGQAMKQYLKMGVS

SEQ ID NO: 1789462 - protein, 6 aa, Staphylococcus epidermidis
SGQGTL

SEQ ID NO: 1789463 - protein, 6 aa, Staphylococcus epidermidis
SGQHPN

SEQ ID NO: 1789464 - protein, 8 aa, Staphylococcus epidermidis
SGQLPSIS

SEQ ID NO: 1789465 - protein, 22 aa, Staphylococcus epidermidis
SGQNEEQLREQMKDDAEQRVKT

SEQ ID NO: 1789466 - protein, 6 aa, Staphylococcus epidermidis
SGQPAG

SEQ ID NO: 1789467 - protein, 13 aa, Staphylococcus epidermidis
SGQTEIKDALKNI

SEQ ID NO: 1789468 - protein, 10 aa, Staphylococcus epidermidis
SGRGDKDMET

SEQ ID NO: 1789469 - protein, 8 aa, Staphylococcus epidermidis
SGRPTEGM

SEQ ID NO: 1789470 - protein, 9 aa, Staphylococcus epidermidis
SGRSDVDKN

SEQ ID NO: 1789471 - protein, 7 aa, Staphylococcus epidermidis
SGRTVTG

SEQ ID NO: 1789472 - protein, 20 aa, Staphylococcus epidermidis
SGRTYTGQEPKYLNSPETPI

SEQ ID NO: 1789473 - protein, 20 aa, Staphylococcus epidermidis
SGRTYTNQEPKYLNSPETPI

SEQ ID NO: 1789474 - protein, 5 aa, Staphylococcus epidermidis
SGSAT

SEQ ID NO: 1789475 - protein, 26 aa, Staphylococcus epidermidis
SGSATYDPKTGIATLTPDAYSQKGAI

SEQ ID NO: 1789476 - protein, 10 aa, Staphylococcus epidermidis
SGSEGRDPIE

SEQ ID NO: 1789477 - protein, 10 aa, Staphylococcus epidermidis
SGSEGRDPLD

SEQ ID NO: 1789478 - protein, 11 aa, Staphylococcus epidermidis
SGSEPTQSQKS

SEQ ID NO: 1789479 - protein, 7 aa, Staphylococcus epidermidis
SGSFGHN

SEQ ID NO: 1789480 - protein, 7 aa, Staphylococcus epidermidis
SGSFSDR

SEQ ID NO: 1789481 - protein, 14 aa, Staphylococcus epidermidis
SGSKIDKDEKGRTK

SEQ ID NO: 1789482 - protein, 5 aa, Staphylococcus epidermidis
SGSMA

SEQ ID NO: 1789483 - protein, 10 aa, Staphylococcus epidermidis
SGSNEDLDQE

SEQ ID NO: 1789484 - protein, 8 aa, Staphylococcus epidermidis
SGSNPEYN

SEQ ID NO: 1789485 - protein, 12 aa, Staphylococcus epidermidis
SGSPTQHGSNEA

SEQ ID NO: 1789486 - protein, 5 aa, Staphylococcus epidermidis
SGSSL

SEQ ID NO: 1789487 - protein, 8 aa, Staphylococcus epidermidis
SGSTRPSK

SEQ ID NO: 1789488 - protein, 9 aa, Staphylococcus epidermidis
SGSTSTGKT

SEQ ID NO: 1789489 - protein, 10 aa, Staphylococcus epidermidis
SGSTSTGKTF

SEQ ID NO: 1789490 - protein, 6 aa, Staphylococcus epidermidis
SGSTTL

SEQ ID NO: 1789491 - protein, 10 aa, Staphylococcus epidermidis
SGTAAANYTP

SEQ ID NO: 1789492 - protein, 9 aa, Staphylococcus epidermidis
SGTATAGIP

SEQ ID NO: 1789493 - protein, 9 aa, Staphylococcus epidermidis
SGTDGVGTK

SEQ ID NO: 1789494 - protein, 10 aa, Staphylococcus epidermidis
SGTNGKDDHI

SEQ ID NO: 1789495 - protein, 7 aa, Staphylococcus epidermidis
SGTPQME

SEQ ID NO: 1789496 - protein, 13 aa, Staphylococcus epidermidis
SGTTGKPKGTVIP

SEQ ID NO: 1789497 - protein, 8 aa, Staphylococcus epidermidis
SGTTGLPK

SEQ ID NO: 1789498 - protein, 13 aa, Staphylococcus epidermidis
SGTTGMPKGVSVR

SEQ ID NO: 1789499 - protein, 12 aa, Staphylococcus epidermidis
SGTTGPQKAVPQ

SEQ ID NO: 1789500 - protein, 10 aa, Staphylococcus epidermidis
SGTTGTPKGV

SEQ ID NO: 1789501 - protein, 11 aa, Staphylococcus epidermidis
SGTTQAVDEIK

SEQ ID NO: 1789502 - protein, 7 aa, Staphylococcus epidermidis
SGTYGDV

SEQ ID NO: 1789503 - protein, 7 aa, Staphylococcus epidermidis
SGVEDNY

SEQ ID NO: 1789504 - protein, 6 aa, Staphylococcus epidermidis
SGVEYA

SEQ ID NO: 1789505 - protein, 7 aa, Staphylococcus epidermidis
SGVTTSA

SEQ ID NO: 1789506 - protein, 5 aa, Staphylococcus epidermidis
SGYDT

SEQ ID NO: 1789507 - protein, 14 aa, Staphylococcus epidermidis
SGYENKVKKNLEKR

SEQ ID NO: 1789508 - protein, 12 aa, Staphylococcus epidermidis
SGYGRSNFASGR

SEQ ID NO: 1789509 - protein, 13 aa, Staphylococcus epidermidis
SGYGRSNYASGRY

SEQ ID NO: 1789510 - protein, 5 aa, Staphylococcus epidermidis
SGYTT

SEQ ID NO: 1789511 - protein, 20 aa, Staphylococcus epidermidis
SHADELPKAKIDANNEIDQK

SEQ ID NO: 1789512 - protein, 6 aa, Staphylococcus epidermidis
SHADTE

SEQ ID NO: 1789513 - protein, 5 aa, Staphylococcus epidermidis
SHALQ

SEQ ID NO: 1789514 - protein, 34 aa, Staphylococcus epidermidis
SHANDTELSDTELSDTELSDTNDLNDTNTIKSKA

SEQ ID NO: 1789515 - protein, 6 aa, Staphylococcus epidermidis
SHDGQA

SEQ ID NO: 1789516 - protein, 15 aa, Staphylococcus epidermidis
SHEDEEWKNKITQQE

SEQ ID NO: 1789517 - protein, 13 aa, Staphylococcus epidermidis
SHETAKKAMEDKE

SEQ ID NO: 1789518 - protein, 4 aa, Staphylococcus epidermidis
SHFT

SEQ ID NO: 1789519 - protein, 8 aa, Staphylococcus epidermidis
SHGGRTQS

SEQ ID NO: 1789520 - protein, 12 aa, Staphylococcus epidermidis
SHGKQLKKGQMI

SEQ ID NO: 1789521 - protein, 5 aa, Staphylococcus epidermidis
SHGKS

SEQ ID NO: 1789522 - protein, 8 aa, Staphylococcus epidermidis
SHKGSEVR

SEQ ID NO: 1789523 - protein, 9 aa, Staphylococcus epidermidis
SHNGQIEPG

SEQ ID NO: 1789524 - protein, 12 aa, Staphylococcus epidermidis
SHNRKTEGKTQA

SEQ ID NO: 1789525 - protein, 8 aa, Staphylococcus epidermidis
SHNYGEQF

SEQ ID NO: 1789526 - protein, 11 aa, Staphylococcus epidermidis
SHPEYRSQYDT

SEQ ID NO: 1789527 - protein, 5 aa, Staphylococcus epidermidis
SHPGE

SEQ ID NO: 1789528 - protein, 9 aa, Staphylococcus epidermidis
SHPNMPSTI

SEQ ID NO: 1789529 - protein, 10 aa, Staphylococcus epidermidis
SHPQTSTAKN

SEQ ID NO: 1789530 - protein, 37 aa, Staphylococcus epidermidis
SHQSRSTIEKLNRSKPMNSNIKDDYEMKQQTSQKHDV

SEQ ID NO: 1789531 - protein, 39 aa, Staphylococcus epidermidis
SHQSRSTIEKLNRSKPMNSNIKDDYEMKQQTSQKHDVTA

SEQ ID NO: 1789532 - protein, 6 aa, Staphylococcus epidermidis
SHSNEG

SEQ ID NO: 1789533 - protein, 9 aa, Staphylococcus epidermidis
SHSNMETTQ

SEQ ID NO: 1789534 - protein, 8 aa, Staphylococcus epidermidis
SHTATHGA

SEQ ID NO: 1789535 - protein, 37 aa, Staphylococcus epidermidis
SHTGQKRQTISPKSQPKRGFSKRTTSTKKQVSSSDWK

SEQ ID NO: 1789536 - protein, 37 aa, Staphylococcus epidermidis
SHTGQKRQTIYPKSQPKRGFSKRTTSTKKQVSSSDWK

SEQ ID NO: 1789537 - protein, 43 aa, Staphylococcus epidermidis
SHTGTKRQTISQAKPQQKRGFSKRTTSPKKQVSSSDWKVGDKV

SEQ ID NO: 1789538 - protein, 7 aa, Staphylococcus epidermidis
SHTPSSI

SEQ ID NO: 1789539 - protein, 8 aa, Staphylococcus epidermidis
SHTTEQGR

SEQ ID NO: 1789540 - protein, 13 aa, Staphylococcus epidermidis
SHVADKEQGHSCG

SEQ ID NO: 1789541 - protein, 9 aa, Staphylococcus epidermidis
SHVGAGADV

SEQ ID NO: 1789542 - protein, 6 aa, Staphylococcus epidermidis
SHVKRE

SEQ ID NO: 1789543 - protein, 9 aa, Staphylococcus epidermidis
SIARSGSGK

SEQ ID NO: 1789544 - protein, 7 aa, Staphylococcus epidermidis
SIDDSTF

SEQ ID NO: 1789545 - protein, 12 aa, Staphylococcus epidermidis
SIDEEKRQNEEI

SEQ ID NO: 1789546 - protein, 9 aa, Staphylococcus epidermidis
SIDETPYYE

SEQ ID NO: 1789547 - protein, 6 aa, Staphylococcus epidermidis
SIDKQA

SEQ ID NO: 1789548 - protein, 15 aa, Staphylococcus epidermidis
SIDKTNHTELLMEWK

SEQ ID NO: 1789549 - protein, 13 aa, Staphylococcus epidermidis
SIDKVKKEIEKKK

SEQ ID NO: 1789550 - protein, 5 aa, Staphylococcus epidermidis
SIDRN

SEQ ID NO: 1789551 - protein, 15 aa, Staphylococcus epidermidis
SIDTQNEDRDNHLKS

SEQ ID NO: 1789552 - protein, 8 aa, Staphylococcus epidermidis
SIEDKGDY

SEQ ID NO: 1789553 - protein, 11 aa, Staphylococcus epidermidis
SIEDVSSVSEV

SEQ ID NO: 1789554 - protein, 11 aa, Staphylococcus epidermidis
SIEEEDNVGTM

SEQ ID NO: 1789555 - protein, 5 aa, Staphylococcus epidermidis
SIEEF

SEQ ID NO: 1789556 - protein, 4 aa, Staphylococcus epidermidis
SIEG

SEQ ID NO: 1789557 - protein, 7 aa, Staphylococcus epidermidis
SIEKEQG

SEQ ID NO: 1789558 - protein, 4 aa, Staphylococcus epidermidis
SIEQ

SEQ ID NO: 1789559 - protein, 22 aa, Staphylococcus epidermidis
SIEQAVERAGTKAGNKGSEAAV

SEQ ID NO: 1789560 - protein, 7 aa, Staphylococcus epidermidis
SIERNNG

SEQ ID NO: 1789561 - protein, 7 aa, Staphylococcus epidermidis
SIERTTR

SEQ ID NO: 1789562 - protein, 4 aa, Staphylococcus epidermidis
SIFT

SEQ ID NO: 1789563 - protein, 5 aa, Staphylococcus epidermidis
SIFTN

SEQ ID NO: 1789564 - protein, 8 aa, Staphylococcus epidermidis
SIGEPGTK

SEQ ID NO: 1789565 - protein, 8 aa, Staphylococcus epidermidis
SIGGGAKS

SEQ ID NO: 1789566 - protein, 10 aa, Staphylococcus epidermidis
SIGGQTSTSM

SEQ ID NO: 1789567 - protein, 18 aa, Staphylococcus epidermidis
SIGSKSEPMQMSLKSILA

SEQ ID NO: 1789568 - protein, 9 aa, Staphylococcus epidermidis
SIGYKKNDL

SEQ ID NO: 1789569 - protein, 18 aa, Staphylococcus epidermidis
SIHEEGSMRSNDNGDTMS

SEQ ID NO: 1789570 - protein, 19 aa, Staphylococcus epidermidis
SIHEKGSMRSHDNSDDMSN

SEQ ID NO: 1789571 - protein, 10 aa, Staphylococcus epidermidis
SIHGESGMDG

SEQ ID NO: 1789572 - protein, 6 aa, Staphylococcus epidermidis
SIHSDN

SEQ ID NO: 1789573 - protein, 33 aa, Staphylococcus epidermidis
SIKDHSTVTGNGNYINADQAKKQAYDNAVQNAQ

SEQ ID NO: 1789574 - protein, 48 aa, Staphylococcus epidermidis
SIKDKSDIKNSSKYINEDQPEKQAYDSAVNNAQKVIDESQATLSPETI

SEQ ID NO: 1789575 - protein, 10 aa, Staphylococcus epidermidis
SIKEAERQSE

SEQ ID NO: 1789576 - protein, 9 aa, Staphylococcus epidermidis
SIKETDAQL

SEQ ID NO: 1789577 - protein, 4 aa, Staphylococcus epidermidis
SIKN

SEQ ID NO: 1789578 - protein, 7 aa, Staphylococcus epidermidis
SIKNQGN

SEQ ID NO: 1789579 - protein, 17 aa, Staphylococcus epidermidis
SIKNSKQQEIWNFIETY

SEQ ID NO: 1789580 - protein, 6 aa, Staphylococcus epidermidis
SIKPEY

SEQ ID NO: 1789581 - protein, 7 aa, Staphylococcus epidermidis
SIKPGVT

SEQ ID NO: 1789582 - protein, 5 aa, Staphylococcus epidermidis
SIKTN

SEQ ID NO: 1789583 - protein, 5 aa, Staphylococcus epidermidis
SINIS

SEQ ID NO: 1789584 - protein, 5 aa, Staphylococcus epidermidis
SINIT

SEQ ID NO: 1789585 - protein, 6 aa, Staphylococcus epidermidis
SINKST

SEQ ID NO: 1789586 - protein, 15 aa, Staphylococcus epidermidis
SINPDKDVDGFHPSN

SEQ ID NO: 1789587 - protein, 5 aa, Staphylococcus epidermidis
SIPEG

SEQ ID NO: 1789588 - protein, 7 aa, Staphylococcus epidermidis
SIPENEV

SEQ ID NO: 1789589 - protein, 8 aa, Staphylococcus epidermidis
SIPENEVQ

SEQ ID NO: 1789590 - protein, 6 aa, Staphylococcus epidermidis
SIPYGE

SEQ ID NO: 1789591 - protein, 9 aa, Staphylococcus epidermidis
SIQDNGKKW

SEQ ID NO: 1789592 - protein, 11 aa, Staphylococcus epidermidis
SIQGARSNNLK

SEQ ID NO: 1789593 - protein, 12 aa, Staphylococcus epidermidis
SIQGGKGAVNEQ

SEQ ID NO: 1789594 - protein, 4 aa, Staphylococcus epidermidis
SIQS

SEQ ID NO: 1789595 - protein, 11 aa, Staphylococcus epidermidis
SIRQDENHSNI

SEQ ID NO: 1789596 - protein, 10 aa, Staphylococcus epidermidis
SIRQKKDEDL

SEQ ID NO: 1789597 - protein, 5 aa, Staphylococcus epidermidis
SIRRN

SEQ ID NO: 1789598 - protein, 4 aa, Staphylococcus epidermidis
SIRY

SEQ ID NO: 1789599 - protein, 9 aa, Staphylococcus epidermidis
SISDTNIND

SEQ ID NO: 1789600 - protein, 15 aa, Staphylococcus epidermidis
SISEETVNRSFNNEQ

SEQ ID NO: 1789601 - protein, 5 aa, Staphylococcus epidermidis
SISEK

SEQ ID NO: 1789602 - protein, 10 aa, Staphylococcus epidermidis
SISEKRKVAP

SEQ ID NO: 1789603 - protein, 14 aa, Staphylococcus epidermidis
SISENIDTSNASGE

SEQ ID NO: 1789604 - protein, 9 aa, Staphylococcus epidermidis
SISEPATLP

SEQ ID NO: 1789605 - protein, 11 aa, Staphylococcus epidermidis
SISERDTSQDI

SEQ ID NO: 1789606 - protein, 7 aa, Staphylococcus epidermidis
SISESDL

SEQ ID NO: 1789607 - protein, 8 aa, Staphylococcus epidermidis
SISKGEAL

SEQ ID NO: 1789608 - protein, 6 aa, Staphylococcus epidermidis
SISPGM

SEQ ID NO: 1789609 - protein, 6 aa, Staphylococcus epidermidis
SISQQQ

SEQ ID NO: 1789610 - protein, 10 aa, Staphylococcus epidermidis
SISSKAIEAV

SEQ ID NO: 1789611 - protein, 4 aa, Staphylococcus epidermidis
SISY

SEQ ID NO: 1789612 - protein, 8 aa, Staphylococcus epidermidis
SITETQYM

SEQ ID NO: 1789613 - protein, 19 aa, Staphylococcus epidermidis
SITIDSKGEAPTLIHKIIT

SEQ ID NO: 1789614 - protein, 19 aa, Staphylococcus epidermidis
SITIEEKGEVPTLIHKIIT

SEQ ID NO: 1789615 - protein, 6 aa, Staphylococcus epidermidis
SITQDR

SEQ ID NO: 1789616 - protein, 8 aa, Staphylococcus epidermidis
SITSKGNV

SEQ ID NO: 1789617 - protein, 5 aa, Staphylococcus epidermidis
SITVR

SEQ ID NO: 1789618 - protein, 17 aa, Staphylococcus epidermidis
SITYGGTGQSFDWKLLK

SEQ ID NO: 1789619 - protein, 6 aa, Staphylococcus epidermidis
SIYGKG

SEQ ID NO: 1789620 - protein, 7 aa, Staphylococcus epidermidis
SKAAHPN

SEQ ID NO: 1789621 - protein, 6 aa, Staphylococcus epidermidis
SKAAPL

SEQ ID NO: 1789622 - protein, 5 aa, Staphylococcus epidermidis
SKACA

SEQ ID NO: 1789623 - protein, 8 aa, Staphylococcus epidermidis
SKAEKYTG

SEQ ID NO: 1789624 - protein, 7 aa, Staphylococcus epidermidis
SKAEQIL

SEQ ID NO: 1789625 - protein, 7 aa, Staphylococcus epidermidis
SKAETVD

SEQ ID NO: 1789626 - protein, 10 aa, Staphylococcus epidermidis
SKAGKENRED

SEQ ID NO: 1789627 - protein, 29 aa, Staphylococcus epidermidis
SKAGKKKPTRKQSSTSWGCAPSSNTSWFF

SEQ ID NO: 1789628 - protein, 10 aa, Staphylococcus epidermidis
SKAGNSGQIP

SEQ ID NO: 1789629 - protein, 7 aa, Staphylococcus epidermidis
SKAITDK

SEQ ID NO: 1789630 - protein, 11 aa, Staphylococcus epidermidis
SKAKNINNELK

SEQ ID NO: 1789631 - protein, 12 aa, Staphylococcus epidermidis
SKAKPEKPEDCK

SEQ ID NO: 1789632 - protein, 8 aa, Staphylococcus epidermidis
SKAPSFEE

SEQ ID NO: 1789633 - protein, 10 aa, Staphylococcus epidermidis
SKAQKDVSAS

SEQ ID NO: 1789634 - protein, 8 aa, Staphylococcus epidermidis
SKARRGRV

SEQ ID NO: 1789635 - protein, 7 aa, Staphylococcus epidermidis
SKASLLT

SEQ ID NO: 1789636 - protein, 20 aa, Staphylococcus epidermidis
SKATQDDVEKAFESANHAYQ

SEQ ID NO: 1789637 - protein, 18 aa, Staphylococcus epidermidis
SKAYAQTHKKRGTQKGVD

SEQ ID NO: 1789638 - protein, 13 aa, Staphylococcus epidermidis
SKCNNEKELKSGI

SEQ ID NO: 1789639 - protein, 10 aa, Staphylococcus epidermidis
SKDEIKKASQ

SEQ ID NO: 1789640 - protein, 7 aa, Staphylococcus epidermidis
SKDFEDI

SEQ ID NO: 1789641 - protein, 8 aa, Staphylococcus epidermidis
SKDFKNKK

SEQ ID NO: 1789642 - protein, 11 aa, Staphylococcus epidermidis
SKDGKLSGPNF

SEQ ID NO: 1789643 - protein, 13 aa, Staphylococcus epidermidis
SKDGKTESSSSLA

SEQ ID NO: 1789644 - protein, 13 aa, Staphylococcus epidermidis
SKDGLIPSSKGVI

SEQ ID NO: 1789645 - protein, 9 aa, Staphylococcus epidermidis
SKDGQSPEY

SEQ ID NO: 1789646 - protein, 8 aa, Staphylococcus epidermidis
SKDKNAID

SEQ ID NO: 1789647 - protein, 8 aa, Staphylococcus epidermidis
SKDNDGQI

SEQ ID NO: 1789648 - protein, 6 aa, Staphylococcus epidermidis
SKDNRI

SEQ ID NO: 1789649 - protein, 7 aa, Staphylococcus epidermidis
SKDQYDD

SEQ ID NO: 1789650 - protein, 8 aa, Staphylococcus epidermidis
SKDSTQRY

SEQ ID NO: 1789651 - protein, 5 aa, Staphylococcus epidermidis
SKDSV

SEQ ID NO: 1789652 - protein, 7 aa, Staphylococcus epidermidis
SKDTQFK

SEQ ID NO: 1789653 - protein, 14 aa, Staphylococcus epidermidis
SKDTVDQLKDYDGV

SEQ ID NO: 1789654 - protein, 9 aa, Staphylococcus epidermidis
SKEAAKNSD

SEQ ID NO: 1789655 - protein, 18 aa, Staphylococcus epidermidis
SKEDLEKAKKFIDESYEN

SEQ ID NO: 1789656 - protein, 7 aa, Staphylococcus epidermidis
SKEDQRA

SEQ ID NO: 1789657 - protein, 8 aa, Staphylococcus epidermidis
SKEDVESL

SEQ ID NO: 1789658 - protein, 5 aa, Staphylococcus epidermidis
SKEEA

SEQ ID NO: 1789659 - protein, 18 aa, Staphylococcus epidermidis
SKEEAAQHFKDQDASTNL

SEQ ID NO: 1789660 - protein, 8 aa, Staphylococcus epidermidis
SKEEAKDF

SEQ ID NO: 1789661 - protein, 6 aa, Staphylococcus epidermidis
SKEELE

SEQ ID NO: 1789662 - protein, 8 aa, Staphylococcus epidermidis
SKEGDREV

SEQ ID NO: 1789663 - protein, 7 aa, Staphylococcus epidermidis
SKEHISE

SEQ ID NO: 1789664 - protein, 10 aa, Staphylococcus epidermidis
SKEISTTLAQ

SEQ ID NO: 1789665 - protein, 9 aa, Staphylococcus epidermidis
SKEKAKDFF

SEQ ID NO: 1789666 - protein, 11 aa, Staphylococcus epidermidis
SKEKKDAKAKE

SEQ ID NO: 1789667 - protein, 7 aa, Staphylococcus epidermidis
SKEKRVS

SEQ ID NO: 1789668 - protein, 13 aa, Staphylococcus epidermidis
SKEKSQSHIDAGA

SEQ ID NO: 1789669 - protein, 19 aa, Staphylococcus epidermidis
SKEKTVDNTYEDNEKDTYL

SEQ ID NO: 1789670 - protein, 5 aa, Staphylococcus epidermidis
SKEMN

SEQ ID NO: 1789671 - protein, 8 aa, Staphylococcus epidermidis
SKENNLKR

SEQ ID NO: 1789672 - protein, 6 aa, Staphylococcus epidermidis
SKENPN

SEQ ID NO: 1789673 - protein, 9 aa, Staphylococcus epidermidis
SKEPGTIEP

SEQ ID NO: 1789674 - protein, 8 aa, Staphylococcus epidermidis
SKESNVDT

SEQ ID NO: 1789675 - protein, 9 aa, Staphylococcus epidermidis
SKETQTHIN

SEQ ID NO: 1789676 - protein, 5 aa, Staphylococcus epidermidis
SKFEE

SEQ ID NO: 1789677 - protein, 8 aa, Staphylococcus epidermidis
SKFGGNAW

SEQ ID NO: 1789678 - protein, 13 aa, Staphylococcus epidermidis
SKGEVEGIPGKTM

SEQ ID NO: 1789679 - protein, 11 aa, Staphylococcus epidermidis
SKGGNQSFEEK

SEQ ID NO: 1789680 - protein, 6 aa, Staphylococcus epidermidis
SKGGQL

SEQ ID NO: 1789681 - protein, 10 aa, Staphylococcus epidermidis
SKGGVTGQSM

SEQ ID NO: 1789682 - protein, 38 aa, Staphylococcus epidermidis
SKGISENQQDGEKQKENDKGIAIEETQTKKGFWSRLFG

SEQ ID NO: 1789683 - protein, 9 aa, Staphylococcus epidermidis
SKGNDPSYV

SEQ ID NO: 1789684 - protein, 7 aa, Staphylococcus epidermidis
SKGNSYI

SEQ ID NO: 1789685 - protein, 13 aa, Staphylococcus epidermidis
SKGQLEKRIACNP

SEQ ID NO: 1789686 - protein, 6 aa, Staphylococcus epidermidis
SKGQQC

SEQ ID NO: 1789687 - protein, 9 aa, Staphylococcus epidermidis
SKGQVQDAG

SEQ ID NO: 1789688 - protein, 13 aa, Staphylococcus epidermidis
SKGRMKKEDYDKV

SEQ ID NO: 1789689 - protein, 18 aa, Staphylococcus epidermidis
SKGRPSISTFSPQSTTQD

SEQ ID NO: 1789690 - protein, 9 aa, Staphylococcus epidermidis
SKGRSGKGL

SEQ ID NO: 1789691 - protein, 10 aa, Staphylococcus epidermidis
SKGRSSHSSM

SEQ ID NO: 1789692 - protein, 40 aa, Staphylococcus epidermidis
SKGSNQQNNQPQQQRGQAPAGNNPFANDNGINDISESELP

SEQ ID NO: 1789693 - protein, 36 aa, Staphylococcus epidermidis
SKGSNQSNNQSPKRGQAPAGNNPFANGTDIENSELP

SEQ ID NO: 1789694 - protein, 9 aa, Staphylococcus epidermidis
SKGSTGRSY

SEQ ID NO: 1789695 - protein, 19 aa, Staphylococcus epidermidis
SKGTSEYSGEQKLKYNPYN

SEQ ID NO: 1789696 - protein, 5 aa, Staphylococcus epidermidis
SKHED

SEQ ID NO: 1789697 - protein, 10 aa, Staphylococcus epidermidis
SKHKDATHNC

SEQ ID NO: 1789698 - protein, 7 aa, Staphylococcus epidermidis
SKHKDLA

SEQ ID NO: 1789699 - protein, 4 aa, Staphylococcus epidermidis
SKHR

SEQ ID NO: 1789700 - protein, 14 aa, Staphylococcus epidermidis
SKHRIYTGDTSSHC

SEQ ID NO: 1789701 - protein, 8 aa, Staphylococcus epidermidis
SKIESAEK

SEQ ID NO: 1789702 - protein, 15 aa, Staphylococcus epidermidis
SKIKTSLKEAIEDGM

SEQ ID NO: 1789703 - protein, 11 aa, Staphylococcus epidermidis
SKISESKDKRI

SEQ ID NO: 1789704 - protein, 8 aa, Staphylococcus epidermidis
SKISNSET

SEQ ID NO: 1789705 - protein, 11 aa, Staphylococcus epidermidis
SKISSTNQRIR

SEQ ID NO: 1789706 - protein, 10 aa, Staphylococcus epidermidis
SKITDMTDRS

SEQ ID NO: 1789707 - protein, 8 aa, Staphylococcus epidermidis
SKKARYDV

SEQ ID NO: 1789708 - protein, 14 aa, Staphylococcus epidermidis
SKKAWDKMGKNAQH

SEQ ID NO: 1789709 - protein, 5 aa, Staphylococcus epidermidis
SKKDI

SEQ ID NO: 1789710 - protein, 22 aa, Staphylococcus epidermidis
SKKDLTKFSQNDKKSLLKKLFR

SEQ ID NO: 1789711 - protein, 8 aa, Staphylococcus epidermidis
SKKDNNND

SEQ ID NO: 1789712 - protein, 9 aa, Staphylococcus epidermidis
SKKDPIGAM

SEQ ID NO: 1789713 - protein, 30 aa, Staphylococcus epidermidis
SKKEKNKLLNEAQDQYNKDVKKANAHHRTT

SEQ ID NO: 1789714 - protein, 9 aa, Staphylococcus epidermidis
SKKGRYAYS

SEQ ID NO: 1789715 - protein, 20 aa, Staphylococcus epidermidis
SKKHLSNKKIRNNNKCQSDF

SEQ ID NO: 1789716 - protein, 10 aa, Staphylococcus epidermidis
SKKIAKPINP

SEQ ID NO: 1789717 - protein, 9 aa, Staphylococcus epidermidis
SKKNRAVLE

SEQ ID NO: 1789718 - protein, 8 aa, Staphylococcus epidermidis
SKKNVKAC

SEQ ID NO: 1789719 - protein, 13 aa, Staphylococcus epidermidis
SKKPGIDYKKSNP

SEQ ID NO: 1789720 - protein, 8 aa, Staphylococcus epidermidis
SKKRNPTD

SEQ ID NO: 1789721 - protein, 7 aa, Staphylococcus epidermidis
SKKYEDI

SEQ ID NO: 1789722 - protein, 10 aa, Staphylococcus epidermidis
SKKYNESDLT

SEQ ID NO: 1789723 - protein, 16 aa, Staphylococcus epidermidis
SKKYQIKSSEIEDNAS

SEQ ID NO: 1789724 - protein, 7 aa, Staphylococcus epidermidis
SKLAAKR

SEQ ID NO: 1789725 - protein, 17 aa, Staphylococcus epidermidis
SKLAGTERGVTEPEPSF

SEQ ID NO: 1789726 - protein, 4 aa, Staphylococcus epidermidis
SKLG

SEQ ID NO: 1789727 - protein, 8 aa, Staphylococcus epidermidis
SKLGGKSE

SEQ ID NO: 1789728 - protein, 6 aa, Staphylococcus epidermidis
SKLGYN

SEQ ID NO: 1789729 - protein, 4 aa, Staphylococcus epidermidis
SKLH

SEQ ID NO: 1789730 - protein, 4 aa, Staphylococcus epidermidis
SKLK

SEQ ID NO: 1789731 - protein, 17 aa, Staphylococcus epidermidis
SKLKEAYDNLDETTRHA

SEQ ID NO: 1789732 - protein, 19 aa, Staphylococcus epidermidis
SKLKRSYDAPGQMCVYINP

SEQ ID NO: 1789733 - protein, 6 aa, Staphylococcus epidermidis
SKLSDI

SEQ ID NO: 1789734 - protein, 10 aa, Staphylococcus epidermidis
SKLSNKIEEN

SEQ ID NO: 1789735 - protein, 4 aa, Staphylococcus epidermidis
SKLT

SEQ ID NO: 1789736 - protein, 21 aa, Staphylococcus epidermidis
SKLTDEERYTYEQKGYEAIRN

SEQ ID NO: 1789737 - protein, 6 aa, Staphylococcus epidermidis
SKMKLS

SEQ ID NO: 1789738 - protein, 20 aa, Staphylococcus epidermidis
SKMTPQPDCGETSYDGHGRL

SEQ ID NO: 1789739 - protein, 6 aa, Staphylococcus epidermidis
SKNGQI

SEQ ID NO: 1789740 - protein, 7 aa, Staphylococcus epidermidis
SKNGTGC

SEQ ID NO: 1789741 - protein, 8 aa, Staphylococcus epidermidis
SKNPMNGA

SEQ ID NO: 1789742 - protein, 10 aa, Staphylococcus epidermidis
SKNPSENKGK

SEQ ID NO: 1789743 - protein, 7 aa, Staphylococcus epidermidis
SKNRFKD

SEQ ID NO: 1789744 - protein, 13 aa, Staphylococcus epidermidis
SKNRNAEQTSSFG

SEQ ID NO: 1789745 - protein, 8 aa, Staphylococcus epidermidis
SKNSIRAA

SEQ ID NO: 1789746 - protein, 9 aa, Staphylococcus epidermidis
SKNSTGELQ

SEQ ID NO: 1789747 - protein, 16 aa, Staphylococcus epidermidis
SKNTLHDGARSQTIHA

SEQ ID NO: 1789748 - protein, 16 aa, Staphylococcus epidermidis
SKPAQSEDDAESKKRF

SEQ ID NO: 1789749 - protein, 12 aa, Staphylococcus epidermidis
SKPKLKDEKFER

SEQ ID NO: 1789750 - protein, 6 aa, Staphylococcus epidermidis
SKPKPL

SEQ ID NO: 1789751 - protein, 6 aa, Staphylococcus epidermidis
SKPLIS

SEQ ID NO: 1789752 - protein, 10 aa, Staphylococcus epidermidis
SKPLNELEGR

SEQ ID NO: 1789753 - protein, 7 aa, Staphylococcus epidermidis
SKPNRLH

SEQ ID NO: 1789754 - protein, 16 aa, Staphylococcus epidermidis
SKPPHALTPEERKKPV

SEQ ID NO: 1789755 - protein, 9 aa, Staphylococcus epidermidis
SKPQTTAYK

SEQ ID NO: 1789756 - protein, 23 aa, Staphylococcus epidermidis
SKPSGRTPDDGKSVNGGVTQEEF

SEQ ID NO: 1789757 - protein, 9 aa, Staphylococcus epidermidis
SKPSMSSGV

SEQ ID NO: 1789758 - protein, 5 aa, Staphylococcus epidermidis
SKPYL

SEQ ID NO: 1789759 - protein, 23 aa, Staphylococcus epidermidis
SKPYSRTNDYLQSKGKAPINWCE

SEQ ID NO: 1789760 - protein, 9 aa, Staphylococcus epidermidis
SKQEEGKTI

SEQ ID NO: 1789761 - protein, 21 aa, Staphylococcus epidermidis
SKQERNTNSKHKVRFNYEAIN

SEQ ID NO: 1789762 - protein, 17 aa, Staphylococcus epidermidis
SKQGIEEAKSAGKKIYD

SEQ ID NO: 1789763 - protein, 18 aa, Staphylococcus epidermidis
SKQGIEEAQSAGKKIYDN

SEQ ID NO: 1789764 - protein, 8 aa, Staphylococcus epidermidis
SKQKRSRN

SEQ ID NO: 1789765 - protein, 8 aa, Staphylococcus epidermidis
SKQKYIKD

SEQ ID NO: 1789766 - protein, 7 aa, Staphylococcus epidermidis
SKQMEQS

SEQ ID NO: 1789767 - protein, 15 aa, Staphylococcus epidermidis
SKQTSLRDSVQSETD

SEQ ID NO: 1789768 - protein, 7 aa, Staphylococcus epidermidis
SKQVPKA

SEQ ID NO: 1789769 - protein, 6 aa, Staphylococcus epidermidis
SKRDDF

SEQ ID NO: 1789770 - protein, 14 aa, Staphylococcus epidermidis
SKRKNIQFKETESN

SEQ ID NO: 1789771 - protein, 10 aa, Staphylococcus epidermidis
SKRKPERQDK

SEQ ID NO: 1789772 - protein, 8 aa, Staphylococcus epidermidis
SKRLNEPL

SEQ ID NO: 1789773 - protein, 8 aa, Staphylococcus epidermidis
SKRYNPPV

SEQ ID NO: 1789774 - protein, 4 aa, Staphylococcus epidermidis
SKSA

SEQ ID NO: 1789775 - protein, 10 aa, Staphylococcus epidermidis
SKSAQSEQIT

SEQ ID NO: 1789776 - protein, 7 aa, Staphylococcus epidermidis
SKSESSV

SEQ ID NO: 1789777 - protein, 14 aa, Staphylococcus epidermidis
SKSFGSAGNPSPMT

SEQ ID NO: 1789778 - protein, 6 aa, Staphylococcus epidermidis
SKSGHM

SEQ ID NO: 1789779 - protein, 9 aa, Staphylococcus epidermidis
SKSGKNVEQ

SEQ ID NO: 1789780 - protein, 10 aa, Staphylococcus epidermidis
SKSGTTTEPA

SEQ ID NO: 1789781 - protein, 14 aa, Staphylococcus epidermidis
SKSGYGLDKENELK

SEQ ID NO: 1789782 - protein, 21 aa, Staphylococcus epidermidis
SKSKSHGKQNQIEGAKSEGKK

SEQ ID NO: 1789783 - protein, 6 aa, Staphylococcus epidermidis
SKSLEG

SEQ ID NO: 1789784 - protein, 9 aa, Staphylococcus epidermidis
SKSNYSNKI

SEQ ID NO: 1789785 - protein, 4 aa, Staphylococcus epidermidis
SKSP

SEQ ID NO: 1789786 - protein, 5 aa, Staphylococcus epidermidis
SKSQK

SEQ ID NO: 1789787 - protein, 31 aa, Staphylococcus epidermidis
SKSSGREQHYPDDAVDDKDERRKNKEETYHA

SEQ ID NO: 1789788 - protein, 9 aa, Staphylococcus epidermidis
SKSSKNKVI

SEQ ID NO: 1789789 - protein, 7 aa, Staphylococcus epidermidis
SKSSYEQ

SEQ ID NO: 1789790 - protein, 6 aa, Staphylococcus epidermidis
SKSTLQ

SEQ ID NO: 1789791 - protein, 6 aa, Staphylococcus epidermidis
SKSVNI

SEQ ID NO: 1789792 - protein, 10 aa, Staphylococcus epidermidis
SKSYNETRNF

SEQ ID NO: 1789793 - protein, 6 aa, Staphylococcus epidermidis
SKTDGL

SEQ ID NO: 1789794 - protein, 16 aa, Staphylococcus epidermidis
SKTEYRGREATDFKEE

SEQ ID NO: 1789795 - protein, 6 aa, Staphylococcus epidermidis
SKTGFG

SEQ ID NO: 1789796 - protein, 7 aa, Staphylococcus epidermidis
SKTIQEA

SEQ ID NO: 1789797 - protein, 7 aa, Staphylococcus epidermidis
SKTISEL

SEQ ID NO: 1789798 - protein, 7 aa, Staphylococcus epidermidis
SKTKAQL

SEQ ID NO: 1789799 - protein, 9 aa, Staphylococcus epidermidis
SKTKQFSNQ

SEQ ID NO: 1789800 - protein, 13 aa, Staphylococcus epidermidis
SKTPIEERKEEKK

SEQ ID NO: 1789801 - protein, 7 aa, Staphylococcus epidermidis
SKTRPDM

SEQ ID NO: 1789802 - protein, 8 aa, Staphylococcus epidermidis
SKTSENIT

SEQ ID NO: 1789803 - protein, 6 aa, Staphylococcus epidermidis
SKTSQC

SEQ ID NO: 1789804 - protein, 9 aa, Staphylococcus epidermidis
SKTVNLPNK

SEQ ID NO: 1789805 - protein, 7 aa, Staphylococcus epidermidis
SKTVSPG

SEQ ID NO: 1789806 - protein, 4 aa, Staphylococcus epidermidis
SKVG

SEQ ID NO: 1789807 - protein, 7 aa, Staphylococcus epidermidis
SKVGAPR

SEQ ID NO: 1789808 - protein, 7 aa, Staphylococcus epidermidis
SKVNKND

SEQ ID NO: 1789809 - protein, 5 aa, Staphylococcus epidermidis
SKVQS

SEQ ID NO: 1789810 - protein, 9 aa, Staphylococcus epidermidis
SKVQSNKQH

SEQ ID NO: 1789811 - protein, 10 aa, Staphylococcus epidermidis
SKVRSTRDER

SEQ ID NO: 1789812 - protein, 5 aa, Staphylococcus epidermidis
SKVSD

SEQ ID NO: 1789813 - protein, 5 aa, Staphylococcus epidermidis
SKVSF

SEQ ID NO: 1789814 - protein, 5 aa, Staphylococcus epidermidis
SKVTS

SEQ ID NO: 1789815 - protein, 13 aa, Staphylococcus epidermidis
SKWASDKKKMEKV

SEQ ID NO: 1789816 - protein, 12 aa, Staphylococcus epidermidis
SKWGQLTRPTKV

SEQ ID NO: 1789817 - protein, 6 aa, Staphylococcus epidermidis
SKWSSN

SEQ ID NO: 1789818 - protein, 4 aa, Staphylococcus epidermidis
SKYD

SEQ ID NO: 1789819 - protein, 7 aa, Staphylococcus epidermidis
SKYDGYY

SEQ ID NO: 1789820 - protein, 4 aa, Staphylococcus epidermidis
SKYG

SEQ ID NO: 1789821 - protein, 6 aa, Staphylococcus epidermidis
SKYGSN

SEQ ID NO: 1789822 - protein, 5 aa, Staphylococcus epidermidis
SKYHK

SEQ ID NO: 1789823 - protein, 17 aa, Staphylococcus epidermidis
SKYKEEAKKEKSKAKGF

SEQ ID NO: 1789824 - protein, 11 aa, Staphylococcus epidermidis
SKYKKGIGKND

SEQ ID NO: 1789825 - protein, 6 aa, Staphylococcus epidermidis
SKYRVK

SEQ ID NO: 1789826 - protein, 7 aa, Staphylococcus epidermidis
SKYSHKD

SEQ ID NO: 1789827 - protein, 14 aa, Staphylococcus epidermidis
SKYTDDTVANSAVQ

SEQ ID NO: 1789828 - protein, 4 aa, Staphylococcus epidermidis
SLAP

SEQ ID NO: 1789829 - protein, 5 aa, Staphylococcus epidermidis
SLAQQ

SEQ ID NO: 1789830 - protein, 5 aa, Staphylococcus epidermidis
SLASN

SEQ ID NO: 1789831 - protein, 5 aa, Staphylococcus epidermidis
SLDDG

SEQ ID NO: 1789832 - protein, 16 aa, Staphylococcus epidermidis
SLDGQKYGAYKRTKGM

SEQ ID NO: 1789833 - protein, 8 aa, Staphylococcus epidermidis
SLEKNNDK

SEQ ID NO: 1789834 - protein, 14 aa, Staphylococcus epidermidis
SLEKQKAKIKTQQE

SEQ ID NO: 1789835 - protein, 9 aa, Staphylococcus epidermidis
SLEPGQKAK

SEQ ID NO: 1789836 - protein, 5 aa, Staphylococcus epidermidis
SLEPT

SEQ ID NO: 1789837 - protein, 5 aa, Staphylococcus epidermidis
SLETR

SEQ ID NO: 1789838 - protein, 7 aa, Staphylococcus epidermidis
SLGDRFE

SEQ ID NO: 1789839 - protein, 14 aa, Staphylococcus epidermidis
SLGKEEVDQNKNLT

SEQ ID NO: 1789840 - protein, 9 aa, Staphylococcus epidermidis
SLKAQGAKV

SEQ ID NO: 1789841 - protein, 4 aa, Staphylococcus epidermidis
SLKE

SEQ ID NO: 1789842 - protein, 7 aa, Staphylococcus epidermidis
SLKEDED

SEQ ID NO: 1789843 - protein, 12 aa, Staphylococcus epidermidis
SLKGPLHGGANE

SEQ ID NO: 1789844 - protein, 9 aa, Staphylococcus epidermidis
SLKKGYGNQ

SEQ ID NO: 1789845 - protein, 5 aa, Staphylococcus epidermidis
SLKPG

SEQ ID NO: 1789846 - protein, 9 aa, Staphylococcus epidermidis
SLKSWTGSM

SEQ ID NO: 1789847 - protein, 7 aa, Staphylococcus epidermidis
SLLSSGA

SEQ ID NO: 1789848 - protein, 5 aa, Staphylococcus epidermidis
SLNDQ

SEQ ID NO: 1789849 - protein, 5 aa, Staphylococcus epidermidis
SLNED

SEQ ID NO: 1789850 - protein, 12 aa, Staphylococcus epidermidis
SLNEPQKNAEIA

SEQ ID NO: 1789851 - protein, 5 aa, Staphylococcus epidermidis
SLNKA

SEQ ID NO: 1789852 - protein, 18 aa, Staphylococcus epidermidis
SLNKASRELNISTPALSK

SEQ ID NO: 1789853 - protein, 10 aa, Staphylococcus epidermidis
SLNKDEKGIN

SEQ ID NO: 1789854 - protein, 10 aa, Staphylococcus epidermidis
SLNNLSPTNT

SEQ ID NO: 1789855 - protein, 5 aa, Staphylococcus epidermidis
SLNQK

SEQ ID NO: 1789856 - protein, 4 aa, Staphylococcus epidermidis
SLPC

SEQ ID NO: 1789857 - protein, 7 aa, Staphylococcus epidermidis
SLPEGTT

SEQ ID NO: 1789858 - protein, 10 aa, Staphylococcus epidermidis
SLPKGLDSNY

SEQ ID NO: 1789859 - protein, 9 aa, Staphylococcus epidermidis
SLPNTKYGI

SEQ ID NO: 1789860 - protein, 8 aa, Staphylococcus epidermidis
SLPTSNQL

SEQ ID NO: 1789861 - protein, 6 aa, Staphylococcus epidermidis
SLQDNL

SEQ ID NO: 1789862 - protein, 13 aa, Staphylococcus epidermidis
SLQNGKPYRETST

SEQ ID NO: 1789863 - protein, 6 aa, Staphylococcus epidermidis
SLQPVE

SEQ ID NO: 1789864 - protein, 11 aa, Staphylococcus epidermidis
SLREEDQPFYE

SEQ ID NO: 1789865 - protein, 11 aa, Staphylococcus epidermidis
SLRERAGNSFE

SEQ ID NO: 1789866 - protein, 9 aa, Staphylococcus epidermidis
SLRGNSLTN

SEQ ID NO: 1789867 - protein, 7 aa, Staphylococcus epidermidis
SLRHSDE

SEQ ID NO: 1789868 - protein, 4 aa, Staphylococcus epidermidis
SLRQ

SEQ ID NO: 1789869 - protein, 42 aa, Staphylococcus epidermidis
SLRQGTHSVKNRSAVRGGGRKPWRQKGTGRARQGTIRAPQWR

SEQ ID NO: 1789870 - protein, 4 aa, Staphylococcus epidermidis
SLSA

SEQ ID NO: 1789871 - protein, 6 aa, Staphylococcus epidermidis
SLSEVD

SEQ ID NO: 1789872 - protein, 11 aa, Staphylococcus epidermidis
SLSKGEKEQQR

SEQ ID NO: 1789873 - protein, 4 aa, Staphylococcus epidermidis
SLSP

SEQ ID NO: 1789874 - protein, 9 aa, Staphylococcus epidermidis
SLSPSLKNI

SEQ ID NO: 1789875 - protein, 8 aa, Staphylococcus epidermidis
SLSPSVKE

SEQ ID NO: 1789876 - protein, 13 aa, Staphylococcus epidermidis
SLSPTSGEIERHG

SEQ ID NO: 1789877 - protein, 7 aa, Staphylococcus epidermidis
SLSSDEF

SEQ ID NO: 1789878 - protein, 8 aa, Staphylococcus epidermidis
SLSSGANE

SEQ ID NO: 1789879 - protein, 8 aa, Staphylococcus epidermidis
SLSSGERV

SEQ ID NO: 1789880 - protein, 6 aa, Staphylococcus epidermidis
SLSTKP

SEQ ID NO: 1789881 - protein, 6 aa, Staphylococcus epidermidis
SLTAGY

SEQ ID NO: 1789882 - protein, 12 aa, Staphylococcus epidermidis
SLTDGKNYTGLR

SEQ ID NO: 1789883 - protein, 8 aa, Staphylococcus epidermidis
SLTEEQEN

SEQ ID NO: 1789884 - protein, 8 aa, Staphylococcus epidermidis
SLTNGQHD

SEQ ID NO: 1789885 - protein, 10 aa, Staphylococcus epidermidis
SLTPTPKDQE

SEQ ID NO: 1789886 - protein, 9 aa, Staphylococcus epidermidis
SLTTDNRAQ

SEQ ID NO: 1789887 - protein, 4 aa, Staphylococcus epidermidis
SLVD

SEQ ID NO: 1789888 - protein, 6 aa, Staphylococcus epidermidis
SMKPDD

SEQ ID NO: 1789889 - protein, 6 aa, Staphylococcus epidermidis
SMNPNE

SEQ ID NO: 1789890 - protein, 5 aa, Staphylococcus epidermidis
SMNQK

SEQ ID NO: 1789891 - protein, 6 aa, Staphylococcus epidermidis
SMNRKN

SEQ ID NO: 1789892 - protein, 6 aa, Staphylococcus epidermidis
SMPATR

SEQ ID NO: 1789893 - protein, 113 aa, Staphylococcus epidermidis
SMPNSASISQSNVASQSTTASLSQSESANDSMSSSLSESNSITSESNTNSKSEIESKSTSTSEFLSESGSVSNSEKSESISHSQSTSATPSSQSTYQQQPKEEKKGFFARLFN

SEQ ID NO: 1789894 - protein, 19 aa, Staphylococcus epidermidis
SMQPPKSEEKEEVPSKEQI

SEQ ID NO: 1789895 - protein, 9 aa, Staphylococcus epidermidis
SMQTRTKHK

SEQ ID NO: 1789896 - protein, 8 aa, Staphylococcus epidermidis
SMRAGKSV

SEQ ID NO: 1789897 - protein, 6 aa, Staphylococcus epidermidis
SMSREN

SEQ ID NO: 1789898 - protein, 8 aa, Staphylococcus epidermidis
SMTNPSNY

SEQ ID NO: 1789899 - protein, 14 aa, Staphylococcus epidermidis
SMTNYSEETSSISN

SEQ ID NO: 1789900 - protein, 5 aa, Staphylococcus epidermidis
SNADL

SEQ ID NO: 1789901 - protein, 6 aa, Staphylococcus epidermidis
SNAKQI

SEQ ID NO: 1789902 - protein, 10 aa, Staphylococcus epidermidis
SNASGEGNQI

SEQ ID NO: 1789903 - protein, 9 aa, Staphylococcus epidermidis
SNASTYSRQ

SEQ ID NO: 1789904 - protein, 15 aa, Staphylococcus epidermidis
SNATGAKDTVEDKHT

SEQ ID NO: 1789905 - protein, 43 aa, Staphylococcus epidermidis
SNATMDPQAINQATQTLNSAKQGLHGDQKLQDDKNNAKQEIDN

SEQ ID NO: 1789906 - protein, 8 aa, Staphylococcus epidermidis
SNDDDIYP

SEQ ID NO: 1789907 - protein, 7 aa, Staphylococcus epidermidis
SNDDLKR

SEQ ID NO: 1789908 - protein, 5 aa, Staphylococcus epidermidis
SNDDN

SEQ ID NO: 1789909 - protein, 7 aa, Staphylococcus epidermidis
SNDDYNI

SEQ ID NO: 1789910 - protein, 6 aa, Staphylococcus epidermidis
SNDDYT

SEQ ID NO: 1789911 - protein, 7 aa, Staphylococcus epidermidis
SNDEVDY

SEQ ID NO: 1789912 - protein, 10 aa, Staphylococcus epidermidis
SNDGPPTNWE

SEQ ID NO: 1789913 - protein, 4 aa, Staphylococcus epidermidis
SNDI

SEQ ID NO: 1789914 - protein, 6 aa, Staphylococcus epidermidis
SNDKGV

SEQ ID NO: 1789915 - protein, 8 aa, Staphylococcus epidermidis
SNDKRTSY

SEQ ID NO: 1789916 - protein, 7 aa, Staphylococcus epidermidis
SNDMSDG

SEQ ID NO: 1789917 - protein, 9 aa, Staphylococcus epidermidis
SNDNARGHR

SEQ ID NO: 1789918 - protein, 6 aa, Staphylococcus epidermidis
SNDNLK

SEQ ID NO: 1789919 - protein, 5 aa, Staphylococcus epidermidis
SNDQI

SEQ ID NO: 1789920 - protein, 7 aa, Staphylococcus epidermidis
SNDTNQL

SEQ ID NO: 1789921 - protein, 6 aa, Staphylococcus epidermidis
SNDTRF

SEQ ID NO: 1789922 - protein, 7 aa, Staphylococcus epidermidis
SNDTTAF

SEQ ID NO: 1789923 - protein, 11 aa, Staphylococcus epidermidis
SNDVEAKETDT

SEQ ID NO: 1789924 - protein, 9 aa, Staphylococcus epidermidis
SNDYHGPDM

SEQ ID NO: 1789925 - protein, 9 aa, Staphylococcus epidermidis
SNDYQGPDM

SEQ ID NO: 1789926 - protein, 19 aa, Staphylococcus epidermidis
SNEDGNETMEIPMKNIKDI

SEQ ID NO: 1789927 - protein, 8 aa, Staphylococcus epidermidis
SNEDQLNE

SEQ ID NO: 1789928 - protein, 8 aa, Staphylococcus epidermidis
SNEEEIEK

SEQ ID NO: 1789929 - protein, 6 aa, Staphylococcus epidermidis
SNEGER

SEQ ID NO: 1789930 - protein, 11 aa, Staphylococcus epidermidis
SNEGLSTEEAF

SEQ ID NO: 1789931 - protein, 9 aa, Staphylococcus epidermidis
SNEGQKKTR

SEQ ID NO: 1789932 - protein, 5 aa, Staphylococcus epidermidis
SNEGT

SEQ ID NO: 1789933 - protein, 4 aa, Staphylococcus epidermidis
SNEH

SEQ ID NO: 1789934 - protein, 4 aa, Staphylococcus epidermidis
SNEI

SEQ ID NO: 1789935 - protein, 7 aa, Staphylococcus epidermidis
SNEISTV

SEQ ID NO: 1789936 - protein, 9 aa, Staphylococcus epidermidis
SNEKAKLDQ

SEQ ID NO: 1789937 - protein, 5 aa, Staphylococcus epidermidis
SNEKY

SEQ ID NO: 1789938 - protein, 17 aa, Staphylococcus epidermidis
SNENVYGPSPKVKTAIQ

SEQ ID NO: 1789939 - protein, 11 aa, Staphylococcus epidermidis
SNESEYAANIE

SEQ ID NO: 1789940 - protein, 10 aa, Staphylococcus epidermidis
SNFKNASSQL

SEQ ID NO: 1789941 - protein, 9 aa, Staphylococcus epidermidis
SNFPIPNTQ

SEQ ID NO: 1789942 - protein, 6 aa, Staphylococcus epidermidis
SNGDGI

SEQ ID NO: 1789943 - protein, 6 aa, Staphylococcus epidermidis
SNGEMI

SEQ ID NO: 1789944 - protein, 17 aa, Staphylococcus epidermidis
SNGERFSGMTVELPEVL

SEQ ID NO: 1789945 - protein, 7 aa, Staphylococcus epidermidis
SNGESYE

SEQ ID NO: 1789946 - protein, 9 aa, Staphylococcus epidermidis
SNGNRTPNL

SEQ ID NO: 1789947 - protein, 6 aa, Staphylococcus epidermidis
SNGVPH

SEQ ID NO: 1789948 - protein, 6 aa, Staphylococcus epidermidis
SNHKAN

SEQ ID NO: 1789949 - protein, 7 aa, Staphylococcus epidermidis
SNHNYDG

SEQ ID NO: 1789950 - protein, 22 aa, Staphylococcus epidermidis
SNHPGGLKSITAGELRRTNPER

SEQ ID NO: 1789951 - protein, 4 aa, Staphylococcus epidermidis
SNHR

SEQ ID NO: 1789952 - protein, 13 aa, Staphylococcus epidermidis
SNIDSKDKNNRNI

SEQ ID NO: 1789953 - protein, 38 aa, Staphylococcus epidermidis
SNIDSKDKNNRNTAIQEEIKADKERRRAEGKARKERIK

SEQ ID NO: 1789954 - protein, 8 aa, Staphylococcus epidermidis
SNIEDRSA

SEQ ID NO: 1789955 - protein, 7 aa, Staphylococcus epidermidis
SNIEGET

SEQ ID NO: 1789956 - protein, 7 aa, Staphylococcus epidermidis
SNIPKGR

SEQ ID NO: 1789957 - protein, 8 aa, Staphylococcus epidermidis
SNISDKKV

SEQ ID NO: 1789958 - protein, 7 aa, Staphylococcus epidermidis
SNITGDN

SEQ ID NO: 1789959 - protein, 4 aa, Staphylococcus epidermidis
SNKA

SEQ ID NO: 1789960 - protein, 9 aa, Staphylococcus epidermidis
SNKDMNPND

SEQ ID NO: 1789961 - protein, 18 aa, Staphylococcus epidermidis
SNKGQVRTHKDKVSWSNR

SEQ ID NO: 1789962 - protein, 4 aa, Staphylococcus epidermidis
SNKK

SEQ ID NO: 1789963 - protein, 8 aa, Staphylococcus epidermidis
SNKKGGKL

SEQ ID NO: 1789964 - protein, 30 aa, Staphylococcus epidermidis
SNKKIQKLESKLEEEKQLNYSANKRQDIEV

SEQ ID NO: 1789965 - protein, 8 aa, Staphylococcus epidermidis
SNKPPYHF

SEQ ID NO: 1789966 - protein, 15 aa, Staphylococcus epidermidis
SNKPSITKYSERTDN

SEQ ID NO: 1789967 - protein, 6 aa, Staphylococcus epidermidis
SNKRDV

SEQ ID NO: 1789968 - protein, 9 aa, Staphylococcus epidermidis
SNKSKDELF

SEQ ID NO: 1789969 - protein, 6 aa, Staphylococcus epidermidis
SNKTNA

SEQ ID NO: 1789970 - protein, 9 aa, Staphylococcus epidermidis
SNKYGYSYA

SEQ ID NO: 1789971 - protein, 6 aa, Staphylococcus epidermidis
SNLQST

SEQ ID NO: 1789972 - protein, 11 aa, Staphylococcus epidermidis
SNLSAMKNKTD

SEQ ID NO: 1789973 - protein, 9 aa, Staphylococcus epidermidis
SNNATDGDN

SEQ ID NO: 1789974 - protein, 8 aa, Staphylococcus epidermidis
SNNDSIQV

SEQ ID NO: 1789975 - protein, 11 aa, Staphylococcus epidermidis
SNNEKESLDNK

SEQ ID NO: 1789976 - protein, 22 aa, Staphylococcus epidermidis
SNNGTNEKDLSSEYGISEAVIY

SEQ ID NO: 1789977 - protein, 6 aa, Staphylococcus epidermidis
SNNHAN

SEQ ID NO: 1789978 - protein, 14 aa, Staphylococcus epidermidis
SNNNEIQDNKLGRR

SEQ ID NO: 1789979 - protein, 6 aa, Staphylococcus epidermidis
SNNNEQ

SEQ ID NO: 1789980 - protein, 14 aa, Staphylococcus epidermidis
SNNNKSRVSSFSSS

SEQ ID NO: 1789981 - protein, 19 aa, Staphylococcus epidermidis
SNNRDVTSKTIQPREGESV

SEQ ID NO: 1789982 - protein, 13 aa, Staphylococcus epidermidis
SNNRYSAKAWDNR

SEQ ID NO: 1789983 - protein, 11 aa, Staphylococcus epidermidis
SNNSGKDKDIA

SEQ ID NO: 1789984 - protein, 9 aa, Staphylococcus epidermidis
SNNSNDKSL

SEQ ID NO: 1789985 - protein, 11 aa, Staphylococcus epidermidis
SNNYTNKFSET

SEQ ID NO: 1789986 - protein, 14 aa, Staphylococcus epidermidis
SNPAKSDEAEDIAK

SEQ ID NO: 1789987 - protein, 14 aa, Staphylococcus epidermidis
SNPAKSDEPEDIAK

SEQ ID NO: 1789988 - protein, 7 aa, Staphylococcus epidermidis
SNPANVS

SEQ ID NO: 1789989 - protein, 4 aa, Staphylococcus epidermidis
SNPF

SEQ ID NO: 1789990 - protein, 5 aa, Staphylococcus epidermidis
SNPGG

SEQ ID NO: 1789991 - protein, 10 aa, Staphylococcus epidermidis
SNPKYKNLKA

SEQ ID NO: 1789992 - protein, 6 aa, Staphylococcus epidermidis
SNPMNE

SEQ ID NO: 1789993 - protein, 16 aa, Staphylococcus epidermidis
SNPPYIDEAESKDMDD

SEQ ID NO: 1789994 - protein, 12 aa, Staphylococcus epidermidis
SNPTKKSQKAMD

SEQ ID NO: 1789995 - protein, 10 aa, Staphylococcus epidermidis
SNQDKVQQLQ

SEQ ID NO: 1789996 - protein, 9 aa, Staphylococcus epidermidis
SNQGGDASI

SEQ ID NO: 1789997 - protein, 6 aa, Staphylococcus epidermidis
SNQGIT

SEQ ID NO: 1789998 - protein, 13 aa, Staphylococcus epidermidis
SNQIEPRSNQTIG

SEQ ID NO: 1789999 - protein, 10 aa, Staphylococcus epidermidis
SNQKQTIEEE

SEQ ID NO: 1790000 - protein, 4 aa, Staphylococcus epidermidis
SNQL

SEQ ID NO: 1790001 - protein, 7 aa, Staphylococcus epidermidis
SNQNTKN

SEQ ID NO: 1790002 - protein, 8 aa, Staphylococcus epidermidis
SNQPLTQE

SEQ ID NO: 1790003 - protein, 6 aa, Staphylococcus epidermidis
SNQPNA

SEQ ID NO: 1790004 - protein, 8 aa, Staphylococcus epidermidis
SNQSGKEI

SEQ ID NO: 1790005 - protein, 8 aa, Staphylococcus epidermidis
SNQVSKTI

SEQ ID NO: 1790006 - protein, 12 aa, Staphylococcus epidermidis
SNQYQSNTQFKR

SEQ ID NO: 1790007 - protein, 7 aa, Staphylococcus epidermidis
SNRHTTN

SEQ ID NO: 1790008 - protein, 6 aa, Staphylococcus epidermidis
SNRKFN

SEQ ID NO: 1790009 - protein, 20 aa, Staphylococcus epidermidis
SNRQPNTSPLTKEIDGNTYT

SEQ ID NO: 1790010 - protein, 6 aa, Staphylococcus epidermidis
SNSEDL

SEQ ID NO: 1790011 - protein, 9 aa, Staphylococcus epidermidis
SNSGEESIE

SEQ ID NO: 1790012 - protein, 7 aa, Staphylococcus epidermidis
SNSGESQ

SEQ ID NO: 1790013 - protein, 15 aa, Staphylococcus epidermidis
SNSGFKRKSDAKHHA

SEQ ID NO: 1790014 - protein, 7 aa, Staphylococcus epidermidis
SNSHAHN

SEQ ID NO: 1790015 - protein, 6 aa, Staphylococcus epidermidis
SNSKYD

SEQ ID NO: 1790016 - protein, 12 aa, Staphylococcus epidermidis
SNSTGGVLGPQD

SEQ ID NO: 1790017 - protein, 6 aa, Staphylococcus epidermidis
SNSVNA

SEQ ID NO: 1790018 - protein, 4 aa, Staphylococcus epidermidis
SNTD

SEQ ID NO: 1790019 - protein, 5 aa, Staphylococcus epidermidis
SNTEE

SEQ ID NO: 1790020 - protein, 6 aa, Staphylococcus epidermidis
SNTIDE

SEQ ID NO: 1790021 - protein, 9 aa, Staphylococcus epidermidis
SNTLDEKEF

SEQ ID NO: 1790022 - protein, 9 aa, Staphylococcus epidermidis
SNVETNMNK

SEQ ID NO: 1790023 - protein, 8 aa, Staphylococcus epidermidis
SNVPKGRG

SEQ ID NO: 1790024 - protein, 7 aa, Staphylococcus epidermidis
SNVRSNC

SEQ ID NO: 1790025 - protein, 8 aa, Staphylococcus epidermidis
SNVSKGRG

SEQ ID NO: 1790026 - protein, 10 aa, Staphylococcus epidermidis
SNVSSNPQYY

SEQ ID NO: 1790027 - protein, 6 aa, Staphylococcus epidermidis
SNYEAD

SEQ ID NO: 1790028 - protein, 6 aa, Staphylococcus epidermidis
SNYERY

SEQ ID NO: 1790029 - protein, 6 aa, Staphylococcus epidermidis
SNYKKN

SEQ ID NO: 1790030 - protein, 13 aa, Staphylococcus epidermidis
SNYSASHENYEPY

SEQ ID NO: 1790031 - protein, 8 aa, Staphylococcus epidermidis
SNYTLTEK

SEQ ID NO: 1790032 - protein, 12 aa, Staphylococcus epidermidis
SNYYRPPNVSRD

SEQ ID NO: 1790033 - protein, 10 aa, Staphylococcus epidermidis
SNYYSESDTE

SEQ ID NO: 1790034 - protein, 6 aa, Staphylococcus epidermidis
SPDEEH

SEQ ID NO: 1790035 - protein, 14 aa, Staphylococcus epidermidis
SPDHLRGDAEGRYG

SEQ ID NO: 1790036 - protein, 15 aa, Staphylococcus epidermidis
SPDHLRGDEEGRYGT

SEQ ID NO: 1790037 - protein, 9 aa, Staphylococcus epidermidis
SPDIDGQAQ

SEQ ID NO: 1790038 - protein, 5 aa, Staphylococcus epidermidis
SPDII

SEQ ID NO: 1790039 - protein, 4 aa, Staphylococcus epidermidis
SPDS

SEQ ID NO: 1790040 - protein, 19 aa, Staphylococcus epidermidis
SPDTKKEKKDEFEDLMNGK

SEQ ID NO: 1790041 - protein, 19 aa, Staphylococcus epidermidis
SPDVPGANNDETKGNTLER

SEQ ID NO: 1790042 - protein, 11 aa, Staphylococcus epidermidis
SPEAASGGPIG

SEQ ID NO: 1790043 - protein, 4 aa, Staphylococcus epidermidis
SPED

SEQ ID NO: 1790044 - protein, 9 aa, Staphylococcus epidermidis
SPEKSKLDG

SEQ ID NO: 1790045 - protein, 8 aa, Staphylococcus epidermidis
SPENNYQF

SEQ ID NO: 1790046 - protein, 8 aa, Staphylococcus epidermidis
SPEPGLQS

SEQ ID NO: 1790047 - protein, 5 aa, Staphylococcus epidermidis
SPEQI

SEQ ID NO: 1790048 - protein, 11 aa, Staphylococcus epidermidis
SPESLKEEFGN

SEQ ID NO: 1790049 - protein, 6 aa, Staphylococcus epidermidis
SPETVA

SEQ ID NO: 1790050 - protein, 11 aa, Staphylococcus epidermidis
SPFAGREGDYV

SEQ ID NO: 1790051 - protein, 9 aa, Staphylococcus epidermidis
SPFGEGRPG

SEQ ID NO: 1790052 - protein, 14 aa, Staphylococcus epidermidis
SPFGSSSKLNDPNF

SEQ ID NO: 1790053 - protein, 11 aa, Staphylococcus epidermidis
SPFKSKSHLSP

SEQ ID NO: 1790054 - protein, 14 aa, Staphylococcus epidermidis
SPFPEIKDSNDERA

SEQ ID NO: 1790055 - protein, 5 aa, Staphylococcus epidermidis
SPGFA

SEQ ID NO: 1790056 - protein, 9 aa, Staphylococcus epidermidis
SPGGHNENT

SEQ ID NO: 1790057 - protein, 15 aa, Staphylococcus epidermidis
SPGGKPVTPPVDGID

SEQ ID NO: 1790058 - protein, 9 aa, Staphylococcus epidermidis
SPGGNGKTT

SEQ ID NO: 1790059 - protein, 10 aa, Staphylococcus epidermidis
SPGPGRPSDY

SEQ ID NO: 1790060 - protein, 9 aa, Staphylococcus epidermidis
SPGYQNFTT

SEQ ID NO: 1790061 - protein, 11 aa, Staphylococcus epidermidis
SPHISAAPDDK

SEQ ID NO: 1790062 - protein, 12 aa, Staphylococcus epidermidis
SPHRKAAYEANE

SEQ ID NO: 1790063 - protein, 11 aa, Staphylococcus epidermidis
SPHRKDAYRAN

SEQ ID NO: 1790064 - protein, 8 aa, Staphylococcus epidermidis
SPHVSAED

SEQ ID NO: 1790065 - protein, 13 aa, Staphylococcus epidermidis
SPIGNDAKTTWEN

SEQ ID NO: 1790066 - protein, 4 aa, Staphylococcus epidermidis
SPIP

SEQ ID NO: 1790067 - protein, 10 aa, Staphylococcus epidermidis
SPIPNTESKI

SEQ ID NO: 1790068 - protein, 4 aa, Staphylococcus epidermidis
SPIT

SEQ ID NO: 1790069 - protein, 7 aa, Staphylococcus epidermidis
SPKANEL

SEQ ID NO: 1790070 - protein, 10 aa, Staphylococcus epidermidis
SPKMNKGQGD

SEQ ID NO: 1790071 - protein, 5 aa, Staphylococcus epidermidis
SPKQF

SEQ ID NO: 1790072 - protein, 10 aa, Staphylococcus epidermidis
SPKTKSNEII

SEQ ID NO: 1790073 - protein, 13 aa, Staphylococcus epidermidis
SPLESTQGSACVK

SEQ ID NO: 1790074 - protein, 13 aa, Staphylococcus epidermidis
SPLKIQKGSQLAS

SEQ ID NO: 1790075 - protein, 15 aa, Staphylococcus epidermidis
SPLNKGNIRTGETTP

SEQ ID NO: 1790076 - protein, 9 aa, Staphylococcus epidermidis
SPMNDNGYD

SEQ ID NO: 1790077 - protein, 14 aa, Staphylococcus epidermidis
SPNAKDPQKRIIII

SEQ ID NO: 1790078 - protein, 9 aa, Staphylococcus epidermidis
SPNAKNPHK

SEQ ID NO: 1790079 - protein, 4 aa, Staphylococcus epidermidis
SPNE

SEQ ID NO: 1790080 - protein, 4 aa, Staphylococcus epidermidis
SPNV

SEQ ID NO: 1790081 - protein, 9 aa, Staphylococcus epidermidis
SPQIERQEK

SEQ ID NO: 1790082 - protein, 9 aa, Staphylococcus epidermidis
SPQNKEDEL

SEQ ID NO: 1790083 - protein, 17 aa, Staphylococcus epidermidis
SPQQRARDTLENTVPNQ

SEQ ID NO: 1790084 - protein, 5 aa, Staphylococcus epidermidis
SPQYS

SEQ ID NO: 1790085 - protein, 4 aa, Staphylococcus epidermidis
SPRI

SEQ ID NO: 1790086 - protein, 5 aa, Staphylococcus epidermidis
SPRIN

SEQ ID NO: 1790087 - protein, 7 aa, Staphylococcus epidermidis
SPSAAQD

SEQ ID NO: 1790088 - protein, 10 aa, Staphylococcus epidermidis
SPSKPNSIPH

SEQ ID NO: 1790089 - protein, 18 aa, Staphylococcus epidermidis
SPSRGKSTDLDRDTHTLD

SEQ ID NO: 1790090 - protein, 19 aa, Staphylococcus epidermidis
SPSVATASAVNGYISSSLD

SEQ ID NO: 1790091 - protein, 6 aa, Staphylococcus epidermidis
SPSYSS

SEQ ID NO: 1790092 - protein, 21 aa, Staphylococcus epidermidis
SPTCTKEDVDAAQALKDTANV

SEQ ID NO: 1790093 - protein, 6 aa, Staphylococcus epidermidis
SPTFKR

SEQ ID NO: 1790094 - protein, 9 aa, Staphylococcus epidermidis
SPTKNEEVQ

SEQ ID NO: 1790095 - protein, 5 aa, Staphylococcus epidermidis
SPTLS

SEQ ID NO: 1790096 - protein, 5 aa, Staphylococcus epidermidis
SPTNQ

SEQ ID NO: 1790097 - protein, 14 aa, Staphylococcus epidermidis
SPTPAGEGKSTVTV

SEQ ID NO: 1790098 - protein, 7 aa, Staphylococcus epidermidis
SPTTLDE

SEQ ID NO: 1790099 - protein, 6 aa, Staphylococcus epidermidis
SPVQSD

SEQ ID NO: 1790100 - protein, 4 aa, Staphylococcus epidermidis
SPVT

SEQ ID NO: 1790101 - protein, 13 aa, Staphylococcus epidermidis
SPYERDVERTYNP

SEQ ID NO: 1790102 - protein, 14 aa, Staphylococcus epidermidis
SQAHSENKIHRDIS

SEQ ID NO: 1790103 - protein, 7 aa, Staphylococcus epidermidis
SQDEETL

SEQ ID NO: 1790104 - protein, 8 aa, Staphylococcus epidermidis
SQDLDKRI

SEQ ID NO: 1790105 - protein, 7 aa, Staphylococcus epidermidis
SQDNQLN

SEQ ID NO: 1790106 - protein, 6 aa, Staphylococcus epidermidis
SQDPYY

SEQ ID NO: 1790107 - protein, 8 aa, Staphylococcus epidermidis
SQDSYKNK

SEQ ID NO: 1790108 - protein, 10 aa, Staphylococcus epidermidis
SQDTSAMETT

SEQ ID NO: 1790109 - protein, 8 aa, Staphylococcus epidermidis
SQDTTFSS

SEQ ID NO: 1790110 - protein, 5 aa, Staphylococcus epidermidis
SQDVH

SEQ ID NO: 1790111 - protein, 4 aa, Staphylococcus epidermidis
SQEK

SEQ ID NO: 1790112 - protein, 7 aa, Staphylococcus epidermidis
SQETHTP

SEQ ID NO: 1790113 - protein, 7 aa, Staphylococcus epidermidis
SQFEDTK

SEQ ID NO: 1790114 - protein, 6 aa, Staphylococcus epidermidis
SQGDGE

SEQ ID NO: 1790115 - protein, 4 aa, Staphylococcus epidermidis
SQGF

SEQ ID NO: 1790116 - protein, 8 aa, Staphylococcus epidermidis
SQGGNTQG

SEQ ID NO: 1790117 - protein, 9 aa, Staphylococcus epidermidis
SQGTSTEKI

SEQ ID NO: 1790118 - protein, 5 aa, Staphylococcus epidermidis
SQHDF

SEQ ID NO: 1790119 - protein, 14 aa, Staphylococcus epidermidis
SQHENNNFSNRKHK

SEQ ID NO: 1790120 - protein, 5 aa, Staphylococcus epidermidis
SQHPE

SEQ ID NO: 1790121 - protein, 8 aa, Staphylococcus epidermidis
SQIDETTG

SEQ ID NO: 1790122 - protein, 5 aa, Staphylococcus epidermidis
SQIED

SEQ ID NO: 1790123 - protein, 12 aa, Staphylococcus epidermidis
SQIPVGQGNSNQ

SEQ ID NO: 1790124 - protein, 12 aa, Staphylococcus epidermidis
SQISSDDRGAMS

SEQ ID NO: 1790125 - protein, 10 aa, Staphylococcus epidermidis
SQKAPQGESY

SEQ ID NO: 1790126 - protein, 4 aa, Staphylococcus epidermidis
SQKD

SEQ ID NO: 1790127 - protein, 9 aa, Staphylococcus epidermidis
SQKDKDGFS

SEQ ID NO: 1790128 - protein, 17 aa, Staphylococcus epidermidis
SQKENEKSGKQSELSGL

SEQ ID NO: 1790129 - protein, 5 aa, Staphylococcus epidermidis
SQKEV

SEQ ID NO: 1790130 - protein, 6 aa, Staphylococcus epidermidis
SQKTNQ

SEQ ID NO: 1790131 - protein, 7 aa, Staphylococcus epidermidis
SQLAEYQ

SEQ ID NO: 1790132 - protein, 6 aa, Staphylococcus epidermidis
SQLKEE

SEQ ID NO: 1790133 - protein, 11 aa, Staphylococcus epidermidis
SQLNRDSPQHA

SEQ ID NO: 1790134 - protein, 14 aa, Staphylococcus epidermidis
SQLPNHITKEKAQE

SEQ ID NO: 1790135 - protein, 7 aa, Staphylococcus epidermidis
SQLQEKV

SEQ ID NO: 1790136 - protein, 9 aa, Staphylococcus epidermidis
SQLSGGQKR

SEQ ID NO: 1790137 - protein, 62 aa, Staphylococcus epidermidis
SQMGYQQEDSLHSNQPENSDNKQQSMNSSRSQQSSHEQLSTQESSHQSKGKTPNYSKRDNTI

SEQ ID NO: 1790138 - protein, 5 aa, Staphylococcus epidermidis
SQMTQ

SEQ ID NO: 1790139 - protein, 6 aa, Staphylococcus epidermidis
SQNDMQ

SEQ ID NO: 1790140 - protein, 22 aa, Staphylococcus epidermidis
SQNKESKDTKGSNTSTKETKVN

SEQ ID NO: 1790141 - protein, 6 aa, Staphylococcus epidermidis
SQNKTV

SEQ ID NO: 1790142 - protein, 8 aa, Staphylococcus epidermidis
SQNNNFKR

SEQ ID NO: 1790143 - protein, 16 aa, Staphylococcus epidermidis
SQPEEEDWSTDSESLT

SEQ ID NO: 1790144 - protein, 6 aa, Staphylococcus epidermidis
SQPIES

SEQ ID NO: 1790145 - protein, 6 aa, Staphylococcus epidermidis
SQQEIN

SEQ ID NO: 1790146 - protein, 7 aa, Staphylococcus epidermidis
SQQLERV

SEQ ID NO: 1790147 - protein, 4 aa, Staphylococcus epidermidis
SQQP

SEQ ID NO: 1790148 - protein, 16 aa, Staphylococcus epidermidis
SQQPNSKLGLATGGTM

SEQ ID NO: 1790149 - protein, 5 aa, Staphylococcus epidermidis
SQQTI

SEQ ID NO: 1790150 - protein, 7 aa, Staphylococcus epidermidis
SQQYNTL

SEQ ID NO: 1790151 - protein, 11 aa, Staphylococcus epidermidis
SQRALQDEEMK

SEQ ID NO: 1790152 - protein, 4 aa, Staphylococcus epidermidis
SQRK

SEQ ID NO: 1790153 - protein, 22 aa, Staphylococcus epidermidis
SQRKTKKEIDKPNIDSSKPFEL

SEQ ID NO: 1790154 - protein, 4 aa, Staphylococcus epidermidis
SQRL

SEQ ID NO: 1790155 - protein, 15 aa, Staphylococcus epidermidis
SQRNHTLAEKLSKKY

SEQ ID NO: 1790156 - protein, 7 aa, Staphylococcus epidermidis
SQRQYSV

SEQ ID NO: 1790157 - protein, 14 aa, Staphylococcus epidermidis
SQSAEAKSTKYNAT

SEQ ID NO: 1790158 - protein, 7 aa, Staphylococcus epidermidis
SQSDAVK

SEQ ID NO: 1790159 - protein, 10 aa, Staphylococcus epidermidis
SQSEGSDPAA

SEQ ID NO: 1790160 - protein, 4 aa, Staphylococcus epidermidis
SQSF

SEQ ID NO: 1790161 - protein, 4 aa, Staphylococcus epidermidis
SQSG

SEQ ID NO: 1790162 - protein, 7 aa, Staphylococcus epidermidis
SQSHDDI

SEQ ID NO: 1790163 - protein, 8 aa, Staphylococcus epidermidis
SQSHGVPT

SEQ ID NO: 1790164 - protein, 7 aa, Staphylococcus epidermidis
SQSLDYD

SEQ ID NO: 1790165 - protein, 5 aa, Staphylococcus epidermidis
SQSLK

SEQ ID NO: 1790166 - protein, 6 aa, Staphylococcus epidermidis
SQSNVS

SEQ ID NO: 1790167 - protein, 5 aa, Staphylococcus epidermidis
SQSRY

SEQ ID NO: 1790168 - protein, 13 aa, Staphylococcus epidermidis
SQSSSVSDIEKIG

SEQ ID NO: 1790169 - protein, 11 aa, Staphylococcus epidermidis
SQTDYDNYDYP

SEQ ID NO: 1790170 - protein, 25 aa, Staphylococcus epidermidis
SQTIEDTKDALNGEQRLAEAKVKAE

SEQ ID NO: 1790171 - protein, 4 aa, Staphylococcus epidermidis
SQTM

SEQ ID NO: 1790172 - protein, 7 aa, Staphylococcus epidermidis
SQTSGDV

SEQ ID NO: 1790173 - protein, 6 aa, Staphylococcus epidermidis
SRAGAN

SEQ ID NO: 1790174 - protein, 4 aa, Staphylococcus epidermidis
SRAI

SEQ ID NO: 1790175 - protein, 6 aa, Staphylococcus epidermidis
SRAIDD

SEQ ID NO: 1790176 - protein, 6 aa, Staphylococcus epidermidis
SRANVQ

SEQ ID NO: 1790177 - protein, 4 aa, Staphylococcus epidermidis
SRAR

SEQ ID NO: 1790178 - protein, 5 aa, Staphylococcus epidermidis
SRARH

SEQ ID NO: 1790179 - protein, 14 aa, Staphylococcus epidermidis
SRASELNKKAANEI

SEQ ID NO: 1790180 - protein, 10 aa, Staphylococcus epidermidis
SRDENDKEKV

SEQ ID NO: 1790181 - protein, 8 aa, Staphylococcus epidermidis
SRDTDKKV

SEQ ID NO: 1790182 - protein, 7 aa, Staphylococcus epidermidis
SRDTDQK

SEQ ID NO: 1790183 - protein, 7 aa, Staphylococcus epidermidis
SREDNMQ

SEQ ID NO: 1790184 - protein, 10 aa, Staphylococcus epidermidis
SREETNLSPV

SEQ ID NO: 1790185 - protein, 5 aa, Staphylococcus epidermidis
SREHD

SEQ ID NO: 1790186 - protein, 4 aa, Staphylococcus epidermidis
SREK

SEQ ID NO: 1790187 - protein, 7 aa, Staphylococcus epidermidis
SRENNKK

SEQ ID NO: 1790188 - protein, 5 aa, Staphylococcus epidermidis
SREPN

SEQ ID NO: 1790189 - protein, 8 aa, Staphylococcus epidermidis
SRERQDEF

SEQ ID NO: 1790190 - protein, 18 aa, Staphylococcus epidermidis
SREYAETHKKRGTSKGVD

SEQ ID NO: 1790191 - protein, 15 aa, Staphylococcus epidermidis
SRGRSSDLDRDTHTL

SEQ ID NO: 1790192 - protein, 16 aa, Staphylococcus epidermidis
SRGRSSDLDRDTHTLD

SEQ ID NO: 1790193 - protein, 5 aa, Staphylococcus epidermidis
SRGSV

SEQ ID NO: 1790194 - protein, 7 aa, Staphylococcus epidermidis
SRGTGRW

SEQ ID NO: 1790195 - protein, 4 aa, Staphylococcus epidermidis
SRGY

SEQ ID NO: 1790196 - protein, 9 aa, Staphylococcus epidermidis
SRHDNETME

SEQ ID NO: 1790197 - protein, 81 aa, Staphylococcus epidermidis
SRHPQSVRNAESEITKAEKNDEEQNITSNNKENNAATHQNVDSTSHDETRSNENDVADSTLQSKQSHNDTQQSNLSTYHQR

SEQ ID NO: 1790198 - protein, 7 aa, Staphylococcus epidermidis
SRIKTPQ

SEQ ID NO: 1790199 - protein, 9 aa, Staphylococcus epidermidis
SRISGVNPA

SEQ ID NO: 1790200 - protein, 5 aa, Staphylococcus epidermidis
SRITS

SEQ ID NO: 1790201 - protein, 15 aa, Staphylococcus epidermidis
SRKGLKEGDQGIDDL

SEQ ID NO: 1790202 - protein, 6 aa, Staphylococcus epidermidis
SRKIHS

SEQ ID NO: 1790203 - protein, 7 aa, Staphylococcus epidermidis
SRKNGKT

SEQ ID NO: 1790204 - protein, 7 aa, Staphylococcus epidermidis
SRKQNLS

SEQ ID NO: 1790205 - protein, 8 aa, Staphylococcus epidermidis
SRKRGEGV

SEQ ID NO: 1790206 - protein, 5 aa, Staphylococcus epidermidis
SRKRN

SEQ ID NO: 1790207 - protein, 34 aa, Staphylococcus epidermidis
SRKSEQNEYQTTIKGQVSTVATGQAYIEQETMTQ

SEQ ID NO: 1790208 - protein, 10 aa, Staphylococcus epidermidis
SRKSTSYTTQ

SEQ ID NO: 1790209 - protein, 5 aa, Staphylococcus epidermidis
SRKSY

SEQ ID NO: 1790210 - protein, 7 aa, Staphylococcus epidermidis
SRKVHSD

SEQ ID NO: 1790211 - protein, 7 aa, Staphylococcus epidermidis
SRKYDDV

SEQ ID NO: 1790212 - protein, 13 aa, Staphylococcus epidermidis
SRLDTPKQRQPQV

SEQ ID NO: 1790213 - protein, 7 aa, Staphylococcus epidermidis
SRLKNDK

SEQ ID NO: 1790214 - protein, 21 aa, Staphylococcus epidermidis
SRLNEEQRHTYEQKGYEAIRN

SEQ ID NO: 1790215 - protein, 6 aa, Staphylococcus epidermidis
SRLNNG

SEQ ID NO: 1790216 - protein, 10 aa, Staphylococcus epidermidis
SRLRTGDFAE

SEQ ID NO: 1790217 - protein, 4 aa, Staphylococcus epidermidis
SRLT

SEQ ID NO: 1790218 - protein, 7 aa, Staphylococcus epidermidis
SRNEENF

SEQ ID NO: 1790219 - protein, 15 aa, Staphylococcus epidermidis
SRNEERGQKASNELG

SEQ ID NO: 1790220 - protein, 10 aa, Staphylococcus epidermidis
SRNENDKEKV

SEQ ID NO: 1790221 - protein, 6 aa, Staphylococcus epidermidis
SRNHTE

SEQ ID NO: 1790222 - protein, 6 aa, Staphylococcus epidermidis
SRNKEA

SEQ ID NO: 1790223 - protein, 20 aa, Staphylococcus epidermidis
SRNSKFGTPESQILDPNDTD

SEQ ID NO: 1790224 - protein, 8 aa, Staphylococcus epidermidis
SRPKYNNH

SEQ ID NO: 1790225 - protein, 5 aa, Staphylococcus epidermidis
SRPNE

SEQ ID NO: 1790226 - protein, 7 aa, Staphylococcus epidermidis
SRPYRKL

SEQ ID NO: 1790227 - protein, 8 aa, Staphylococcus epidermidis
SRQADEAD

SEQ ID NO: 1790228 - protein, 4 aa, Staphylococcus epidermidis
SRQD

SEQ ID NO: 1790229 - protein, 6 aa, Staphylococcus epidermidis
SRQDDI

SEQ ID NO: 1790230 - protein, 21 aa, Staphylococcus epidermidis
SRQDTLNKEPLVKQDGLKGGG

SEQ ID NO: 1790231 - protein, 5 aa, Staphylococcus epidermidis
SRQEE

SEQ ID NO: 1790232 - protein, 5 aa, Staphylococcus epidermidis
SRQHD

SEQ ID NO: 1790233 - protein, 13 aa, Staphylococcus epidermidis
SRREELKNRESEL

SEQ ID NO: 1790234 - protein, 11 aa, Staphylococcus epidermidis
SRRQAKKPRRI

SEQ ID NO: 1790235 - protein, 17 aa, Staphylococcus epidermidis
SRSDNIDKTVKHFLSYF

SEQ ID NO: 1790236 - protein, 8 aa, Staphylococcus epidermidis
SRSECDTS

SEQ ID NO: 1790237 - protein, 13 aa, Staphylococcus epidermidis
SRSELAKINKQQK

SEQ ID NO: 1790238 - protein, 7 aa, Staphylococcus epidermidis
SRSSLRE

SEQ ID NO: 1790239 - protein, 9 aa, Staphylococcus epidermidis
SRTGGAEVG

SEQ ID NO: 1790240 - protein, 14 aa, Staphylococcus epidermidis
SRTNMTIEPETVET

SEQ ID NO: 1790241 - protein, 14 aa, Staphylococcus epidermidis
SRTNRVEEDTKPYG

SEQ ID NO: 1790242 - protein, 5 aa, Staphylococcus epidermidis
SRTQI

SEQ ID NO: 1790243 - protein, 8 aa, Staphylococcus epidermidis
SRTRQTER

SEQ ID NO: 1790244 - protein, 4 aa, Staphylococcus epidermidis
SRVQ

SEQ ID NO: 1790245 - protein, 7 aa, Staphylococcus epidermidis
SSAEEMN

SEQ ID NO: 1790246 - protein, 8 aa, Staphylococcus epidermidis
SSAFPTNI

SEQ ID NO: 1790247 - protein, 9 aa, Staphylococcus epidermidis
SSAGGTEFP

SEQ ID NO: 1790248 - protein, 33 aa, Staphylococcus epidermidis
SSAGRIAARARGRYGGRPEKLNKQDLKLLKTLY

SEQ ID NO: 1790249 - protein, 8 aa, Staphylococcus epidermidis
SSASSRFK

SEQ ID NO: 1790250 - protein, 11 aa, Staphylococcus epidermidis
SSDAKKGDHVS

SEQ ID NO: 1790251 - protein, 10 aa, Staphylococcus epidermidis
SSDASAALKA

SEQ ID NO: 1790252 - protein, 7 aa, Staphylococcus epidermidis
SSDDFTN

SEQ ID NO: 1790253 - protein, 7 aa, Staphylococcus epidermidis
SSDDPKF

SEQ ID NO: 1790254 - protein, 7 aa, Staphylococcus epidermidis
SSDDPVR

SEQ ID NO: 1790255 - protein, 5 aa, Staphylococcus epidermidis
SSDEK

SEQ ID NO: 1790256 - protein, 6 aa, Staphylococcus epidermidis
SSDEQK

SEQ ID NO: 1790257 - protein, 26 aa, Staphylococcus epidermidis
SSDGVSTYRDGSGKAFNKEGKVVSSG

SEQ ID NO: 1790258 - protein, 9 aa, Staphylococcus epidermidis
SSDNYSTIE

SEQ ID NO: 1790259 - protein, 8 aa, Staphylococcus epidermidis
SSDPNGVP

SEQ ID NO: 1790260 - protein, 8 aa, Staphylococcus epidermidis
SSDREQSI

SEQ ID NO: 1790261 - protein, 6 aa, Staphylococcus epidermidis
SSDRSY

SEQ ID NO: 1790262 - protein, 16 aa, Staphylococcus epidermidis
SSDSKMSKEKVKKDLS

SEQ ID NO: 1790263 - protein, 7 aa, Staphylococcus epidermidis
SSEDAHR

SEQ ID NO: 1790264 - protein, 9 aa, Staphylococcus epidermidis
SSEDHSNQL

SEQ ID NO: 1790265 - protein, 7 aa, Staphylococcus epidermidis
SSEDNFQ

SEQ ID NO: 1790266 - protein, 10 aa, Staphylococcus epidermidis
SSEEIENEIR

SEQ ID NO: 1790267 - protein, 12 aa, Staphylococcus epidermidis
SSEENWKKLAKF

SEQ ID NO: 1790268 - protein, 8 aa, Staphylococcus epidermidis
SSEGLAKE

SEQ ID NO: 1790269 - protein, 4 aa, Staphylococcus epidermidis
SSEK

SEQ ID NO: 1790270 - protein, 9 aa, Staphylococcus epidermidis
SSEKARSKL

SEQ ID NO: 1790271 - protein, 9 aa, Staphylococcus epidermidis
SSEKGNIQR

SEQ ID NO: 1790272 - protein, 6 aa, Staphylococcus epidermidis
SSEKGR

SEQ ID NO: 1790273 - protein, 7 aa, Staphylococcus epidermidis
SSENDVK

SEQ ID NO: 1790274 - protein, 6 aa, Staphylococcus epidermidis
SSESDK

SEQ ID NO: 1790275 - protein, 11 aa, Staphylococcus epidermidis
SSFERNPDTGR

SEQ ID NO: 1790276 - protein, 15 aa, Staphylococcus epidermidis
SSFNKKGKDDRFKAK

SEQ ID NO: 1790277 - protein, 6 aa, Staphylococcus epidermidis
SSFTNI

SEQ ID NO: 1790278 - protein, 4 aa, Staphylococcus epidermidis
SSGD

SEQ ID NO: 1790279 - protein, 7 aa, Staphylococcus epidermidis
SSGGAGL

SEQ ID NO: 1790280 - protein, 6 aa, Staphylococcus epidermidis
SSGIDG

SEQ ID NO: 1790281 - protein, 9 aa, Staphylococcus epidermidis
SSGIDPKEV

SEQ ID NO: 1790282 - protein, 4 aa, Staphylococcus epidermidis
SSGK

SEQ ID NO: 1790283 - protein, 12 aa, Staphylococcus epidermidis
SSGKISSSSYTA

SEQ ID NO: 1790284 - protein, 9 aa, Staphylococcus epidermidis
SSGLTNTTG

SEQ ID NO: 1790285 - protein, 15 aa, Staphylococcus epidermidis
SSGNASQVPAEINSD

SEQ ID NO: 1790286 - protein, 6 aa, Staphylococcus epidermidis
SSGNKV

SEQ ID NO: 1790287 - protein, 6 aa, Staphylococcus epidermidis
SSGRDS

SEQ ID NO: 1790288 - protein, 7 aa, Staphylococcus epidermidis
SSGRKEQ

SEQ ID NO: 1790289 - protein, 7 aa, Staphylococcus epidermidis
SSHGADT

SEQ ID NO: 1790290 - protein, 4 aa, Staphylococcus epidermidis
SSHH

SEQ ID NO: 1790291 - protein, 57 aa, Staphylococcus epidermidis
SSHTGGLNTAVEQTKGKIEDSGGRPTKETKDLSDSGQANRDSSNSETKSLEGGDTNN

SEQ ID NO: 1790292 - protein, 5 aa, Staphylococcus epidermidis
SSIGE

SEQ ID NO: 1790293 - protein, 5 aa, Staphylococcus epidermidis
SSIKK

SEQ ID NO: 1790294 - protein, 14 aa, Staphylococcus epidermidis
SSISYAGGKDLKSL

SEQ ID NO: 1790295 - protein, 12 aa, Staphylococcus epidermidis
SSKAFKSTYQNQ

SEQ ID NO: 1790296 - protein, 13 aa, Staphylococcus epidermidis
SSKDDKYVSYKET

SEQ ID NO: 1790297 - protein, 6 aa, Staphylococcus epidermidis
SSKDTN

SEQ ID NO: 1790298 - protein, 6 aa, Staphylococcus epidermidis
SSKMGA

SEQ ID NO: 1790299 - protein, 7 aa, Staphylococcus epidermidis
SSKQLKQ

SEQ ID NO: 1790300 - protein, 5 aa, Staphylococcus epidermidis
SSKQV

SEQ ID NO: 1790301 - protein, 15 aa, Staphylococcus epidermidis
SSKSQIKYDTPKDVV

SEQ ID NO: 1790302 - protein, 12 aa, Staphylococcus epidermidis
SSKSYDQRFTPE

SEQ ID NO: 1790303 - protein, 8 aa, Staphylococcus epidermidis
SSKTNELL

SEQ ID NO: 1790304 - protein, 6 aa, Staphylococcus epidermidis
SSKTYK

SEQ ID NO: 1790305 - protein, 12 aa, Staphylococcus epidermidis
SSLDDATKEESI

SEQ ID NO: 1790306 - protein, 6 aa, Staphylococcus epidermidis
SSLKAT

SEQ ID NO: 1790307 - protein, 7 aa, Staphylococcus epidermidis
SSLSKAD

SEQ ID NO: 1790308 - protein, 19 aa, Staphylococcus epidermidis
SSLTQKQQKDIEDKLKQGD

SEQ ID NO: 1790309 - protein, 4 aa, Staphylococcus epidermidis
SSME

SEQ ID NO: 1790310 - protein, 7 aa, Staphylococcus epidermidis
SSMREEV

SEQ ID NO: 1790311 - protein, 4 aa, Staphylococcus epidermidis
SSMY

SEQ ID NO: 1790312 - protein, 7 aa, Staphylococcus epidermidis
SSNATAL

SEQ ID NO: 1790313 - protein, 6 aa, Staphylococcus epidermidis
SSNCPY

SEQ ID NO: 1790314 - protein, 10 aa, Staphylococcus epidermidis
SSNDDGTISD

SEQ ID NO: 1790315 - protein, 7 aa, Staphylococcus epidermidis
SSNEQLR

SEQ ID NO: 1790316 - protein, 8 aa, Staphylococcus epidermidis
SSNGSNQV

SEQ ID NO: 1790317 - protein, 11 aa, Staphylococcus epidermidis
SSNGTTGEIDN

SEQ ID NO: 1790318 - protein, 8 aa, Staphylococcus epidermidis
SSNITGDN

SEQ ID NO: 1790319 - protein, 10 aa, Staphylococcus epidermidis
SSNKQHYSEE

SEQ ID NO: 1790320 - protein, 8 aa, Staphylococcus epidermidis
SSNLEQGV

SEQ ID NO: 1790321 - protein, 7 aa, Staphylococcus epidermidis
SSNLGAD

SEQ ID NO: 1790322 - protein, 11 aa, Staphylococcus epidermidis
SSNQSIDLERE

SEQ ID NO: 1790323 - protein, 6 aa, Staphylococcus epidermidis
SSNTLT

SEQ ID NO: 1790324 - protein, 9 aa, Staphylococcus epidermidis
SSPNKLSKI

SEQ ID NO: 1790325 - protein, 23 aa, Staphylococcus epidermidis
SSPNPTTAATTELSYGDESQITL

SEQ ID NO: 1790326 - protein, 9 aa, Staphylococcus epidermidis
SSPNTENLQ

SEQ ID NO: 1790327 - protein, 6 aa, Staphylococcus epidermidis
SSPYNY

SEQ ID NO: 1790328 - protein, 13 aa, Staphylococcus epidermidis
SSPYYLTGKNYRN

SEQ ID NO: 1790329 - protein, 8 aa, Staphylococcus epidermidis
SSQASAEE

SEQ ID NO: 1790330 - protein, 8 aa, Staphylococcus epidermidis
SSQGRLEK

SEQ ID NO: 1790331 - protein, 8 aa, Staphylococcus epidermidis
SSQKNQSN

SEQ ID NO: 1790332 - protein, 10 aa, Staphylococcus epidermidis
SSQKQDLDGE

SEQ ID NO: 1790333 - protein, 8 aa, Staphylococcus epidermidis
SSQRHKTV

SEQ ID NO: 1790334 - protein, 8 aa, Staphylococcus epidermidis
SSQTGEEF

SEQ ID NO: 1790335 - protein, 14 aa, Staphylococcus epidermidis
SSQYARPKLANQLN

SEQ ID NO: 1790336 - protein, 20 aa, Staphylococcus epidermidis
SSRELNEAYKKERDYFKNLN

SEQ ID NO: 1790337 - protein, 6 aa, Staphylococcus epidermidis
SSRNES

SEQ ID NO: 1790338 - protein, 16 aa, Staphylococcus epidermidis
SSRNPYTTALINKQLT

SEQ ID NO: 1790339 - protein, 7 aa, Staphylococcus epidermidis
SSRTAKH

SEQ ID NO: 1790340 - protein, 5 aa, Staphylococcus epidermidis
SSSAE

SEQ ID NO: 1790341 - protein, 7 aa, Staphylococcus epidermidis
SSSFEQE

SEQ ID NO: 1790342 - protein, 5 aa, Staphylococcus epidermidis
SSSGA

SEQ ID NO: 1790343 - protein, 4 aa, Staphylococcus epidermidis
SSSK

SEQ ID NO: 1790344 - protein, 14 aa, Staphylococcus epidermidis
SSSLDGKQATDLDE

SEQ ID NO: 1790345 - protein, 9 aa, Staphylococcus epidermidis
SSSNRVNKA

SEQ ID NO: 1790346 - protein, 7 aa, Staphylococcus epidermidis
SSSNTQK

SEQ ID NO: 1790347 - protein, 4 aa, Staphylococcus epidermidis
SSSP

SEQ ID NO: 1790348 - protein, 5 aa, Staphylococcus epidermidis
SSSPG

SEQ ID NO: 1790349 - protein, 21 aa, Staphylococcus epidermidis
SSSQERASDTLENVAPERNYQ

SEQ ID NO: 1790350 - protein, 4 aa, Staphylococcus epidermidis
SSSS

SEQ ID NO: 1790351 - protein, 12 aa, Staphylococcus epidermidis
SSSSNVPKDITK

SEQ ID NO: 1790352 - protein, 4 aa, Staphylococcus epidermidis
SSST

SEQ ID NO: 1790353 - protein, 7 aa, Staphylococcus epidermidis
SSSTFTP

SEQ ID NO: 1790354 - protein, 21 aa, Staphylococcus epidermidis
SSSVYGANTNKPFKTSDNIDH

SEQ ID NO: 1790355 - protein, 6 aa, Staphylococcus epidermidis
SSSYTQ

SEQ ID NO: 1790356 - protein, 7 aa, Staphylococcus epidermidis
SSTHGKK

SEQ ID NO: 1790357 - protein, 4 aa, Staphylococcus epidermidis
SSTI

SEQ ID NO: 1790358 - protein, 8 aa, Staphylococcus epidermidis
SSTIASKS

SEQ ID NO: 1790359 - protein, 14 aa, Staphylococcus epidermidis
SSTISSKTKTAYGH

SEQ ID NO: 1790360 - protein, 8 aa, Staphylococcus epidermidis
SSTKNGLL

SEQ ID NO: 1790361 - protein, 6 aa, Staphylococcus epidermidis
SSTPYE

SEQ ID NO: 1790362 - protein, 5 aa, Staphylococcus epidermidis
SSTQR

SEQ ID NO: 1790363 - protein, 6 aa, Staphylococcus epidermidis
SSTSAE

SEQ ID NO: 1790364 - protein, 7 aa, Staphylococcus epidermidis
SSTSAKD

SEQ ID NO: 1790365 - protein, 11 aa, Staphylococcus epidermidis
SSTSPEIGTVK

SEQ ID NO: 1790366 - protein, 5 aa, Staphylococcus epidermidis
SSTSQ

SEQ ID NO: 1790367 - protein, 8 aa, Staphylococcus epidermidis
SSTSSQDY

SEQ ID NO: 1790368 - protein, 14 aa, Staphylococcus epidermidis
SSTYGDNDHPAPIT

SEQ ID NO: 1790369 - protein, 13 aa, Staphylococcus epidermidis
SSVEGQLDDKNTI

SEQ ID NO: 1790370 - protein, 9 aa, Staphylococcus epidermidis
SSVSQFKTT

SEQ ID NO: 1790371 - protein, 8 aa, Staphylococcus epidermidis
SSYRGKGY

SEQ ID NO: 1790372 - protein, 7 aa, Staphylococcus epidermidis
SSYSDED

SEQ ID NO: 1790373 - protein, 7 aa, Staphylococcus epidermidis
SSYTKEQ

SEQ ID NO: 1790374 - protein, 7 aa, Staphylococcus epidermidis
SSYVPKK

SEQ ID NO: 1790375 - protein, 6 aa, Staphylococcus epidermidis
STAEQA

SEQ ID NO: 1790376 - protein, 9 aa, Staphylococcus epidermidis
STASYEARK

SEQ ID NO: 1790377 - protein, 5 aa, Staphylococcus epidermidis
STAYG

SEQ ID NO: 1790378 - protein, 12 aa, Staphylococcus epidermidis
STDEKGKSVAVK

SEQ ID NO: 1790379 - protein, 6 aa, Staphylococcus epidermidis
STDIKQ

SEQ ID NO: 1790380 - protein, 16 aa, Staphylococcus epidermidis
STDKGMSMDKAQNMHF

SEQ ID NO: 1790381 - protein, 10 aa, Staphylococcus epidermidis
STDKTSSYSR

SEQ ID NO: 1790382 - protein, 18 aa, Staphylococcus epidermidis
STDSKGVSQNTQKKYPIK

SEQ ID NO: 1790383 - protein, 15 aa, Staphylococcus epidermidis
STDSKGVSRNTQKKF

SEQ ID NO: 1790384 - protein, 8 aa, Staphylococcus epidermidis
STDTPTKK

SEQ ID NO: 1790385 - protein, 6 aa, Staphylococcus epidermidis
STDVGQ

SEQ ID NO: 1790386 - protein, 8 aa, Staphylococcus epidermidis
STDVSSEL

SEQ ID NO: 1790387 - protein, 8 aa, Staphylococcus epidermidis
STEASENA

SEQ ID NO: 1790388 - protein, 27 aa, Staphylococcus epidermidis
STEDLKKAMDDTAAHKGWKKTYLQYHW

SEQ ID NO: 1790389 - protein, 9 aa, Staphylococcus epidermidis
STEDVTASI

SEQ ID NO: 1790390 - protein, 5 aa, Staphylococcus epidermidis
STEFQ

SEQ ID NO: 1790391 - protein, 5 aa, Staphylococcus epidermidis
STEGN

SEQ ID NO: 1790392 - protein, 12 aa, Staphylococcus epidermidis
STEMIKDDGKDA

SEQ ID NO: 1790393 - protein, 6 aa, Staphylococcus epidermidis
STEPNM

SEQ ID NO: 1790394 - protein, 11 aa, Staphylococcus epidermidis
STERPEGVDAG

SEQ ID NO: 1790395 - protein, 11 aa, Staphylococcus epidermidis
STERPEGVNAG

SEQ ID NO: 1790396 - protein, 5 aa, Staphylococcus epidermidis
STESY

SEQ ID NO: 1790397 - protein, 16 aa, Staphylococcus epidermidis
STEVKVKDKTINLTSR

SEQ ID NO: 1790398 - protein, 6 aa, Staphylococcus epidermidis
STFGQK

SEQ ID NO: 1790399 - protein, 6 aa, Staphylococcus epidermidis
STFGSR

SEQ ID NO: 1790400 - protein, 5 aa, Staphylococcus epidermidis
STGEI

SEQ ID NO: 1790401 - protein, 5 aa, Staphylococcus epidermidis
STGEL

SEQ ID NO: 1790402 - protein, 7 aa, Staphylococcus epidermidis
STGGGKS

SEQ ID NO: 1790403 - protein, 9 aa, Staphylococcus epidermidis
STGGSSVTA

SEQ ID NO: 1790404 - protein, 4 aa, Staphylococcus epidermidis
STGH

SEQ ID NO: 1790405 - protein, 5 aa, Staphylococcus epidermidis
STGIQ

SEQ ID NO: 1790406 - protein, 13 aa, Staphylococcus epidermidis
STGITEASKIANT

SEQ ID NO: 1790407 - protein, 5 aa, Staphylococcus epidermidis
STGLA

SEQ ID NO: 1790408 - protein, 4 aa, Staphylococcus epidermidis
STGR

SEQ ID NO: 1790409 - protein, 7 aa, Staphylococcus epidermidis
STGVQPQ

SEQ ID NO: 1790410 - protein, 15 aa, Staphylococcus epidermidis
STGYKTVKNKGDKII

SEQ ID NO: 1790411 - protein, 9 aa, Staphylococcus epidermidis
STHDSSATI

SEQ ID NO: 1790412 - protein, 5 aa, Staphylococcus epidermidis
STHEE

SEQ ID NO: 1790413 - protein, 5 aa, Staphylococcus epidermidis
STHGE

SEQ ID NO: 1790414 - protein, 7 aa, Staphylococcus epidermidis
STHSRNY

SEQ ID NO: 1790415 - protein, 7 aa, Staphylococcus epidermidis
STHYDDA

SEQ ID NO: 1790416 - protein, 7 aa, Staphylococcus epidermidis
STIDSTD

SEQ ID NO: 1790417 - protein, 4 aa, Staphylococcus epidermidis
STIG

SEQ ID NO: 1790418 - protein, 13 aa, Staphylococcus epidermidis
STINEHSSGTHVN

SEQ ID NO: 1790419 - protein, 5 aa, Staphylococcus epidermidis
STIPE

SEQ ID NO: 1790420 - protein, 13 aa, Staphylococcus epidermidis
STIPRDFDGESKL

SEQ ID NO: 1790421 - protein, 6 aa, Staphylococcus epidermidis
STIRAN

SEQ ID NO: 1790422 - protein, 9 aa, Staphylococcus epidermidis
STISTSEES

SEQ ID NO: 1790423 - protein, 11 aa, Staphylococcus epidermidis
STKATENINGE

SEQ ID NO: 1790424 - protein, 7 aa, Staphylococcus epidermidis
STKAYTA

SEQ ID NO: 1790425 - protein, 6 aa, Staphylococcus epidermidis
STKDAM

SEQ ID NO: 1790426 - protein, 8 aa, Staphylococcus epidermidis
STKGMSEA

SEQ ID NO: 1790427 - protein, 8 aa, Staphylococcus epidermidis
STKGNGFV

SEQ ID NO: 1790428 - protein, 4 aa, Staphylococcus epidermidis
STKL

SEQ ID NO: 1790429 - protein, 8 aa, Staphylococcus epidermidis
STKLNDNT

SEQ ID NO: 1790430 - protein, 8 aa, Staphylococcus epidermidis
STKRDEVD

SEQ ID NO: 1790431 - protein, 17 aa, Staphylococcus epidermidis
STKSNETHTSEDTDTHS

SEQ ID NO: 1790432 - protein, 7 aa, Staphylococcus epidermidis
STKTYSK

SEQ ID NO: 1790433 - protein, 21 aa, Staphylococcus epidermidis
STLESHPDFKSKLKEGKSYPR

SEQ ID NO: 1790434 - protein, 11 aa, Staphylococcus epidermidis
STLKGNGPKDL

SEQ ID NO: 1790435 - protein, 21 aa, Staphylococcus epidermidis
STLNNESNLEQETQPDEHYGE

SEQ ID NO: 1790436 - protein, 12 aa, Staphylococcus epidermidis
STLSPRVKARSK

SEQ ID NO: 1790437 - protein, 13 aa, Staphylococcus epidermidis
STLSQVDNTQYER

SEQ ID NO: 1790438 - protein, 7 aa, Staphylococcus epidermidis
STNARKK

SEQ ID NO: 1790439 - protein, 7 aa, Staphylococcus epidermidis
STNDGRF

SEQ ID NO: 1790440 - protein, 6 aa, Staphylococcus epidermidis
STNEKL

SEQ ID NO: 1790441 - protein, 10 aa, Staphylococcus epidermidis
STNQDKLKGR

SEQ ID NO: 1790442 - protein, 9 aa, Staphylococcus epidermidis
STNQQQLKG

SEQ ID NO: 1790443 - protein, 6 aa, Staphylococcus epidermidis
STNTTV

SEQ ID NO: 1790444 - protein, 7 aa, Staphylococcus epidermidis
STNYDNP

SEQ ID NO: 1790445 - protein, 5 aa, Staphylococcus epidermidis
STPIH

SEQ ID NO: 1790446 - protein, 6 aa, Staphylococcus epidermidis
STQAPS

SEQ ID NO: 1790447 - protein, 13 aa, Staphylococcus epidermidis
STQGLHNRGSFEG

SEQ ID NO: 1790448 - protein, 26 aa, Staphylococcus epidermidis
STQKTTKPTEKKTTRTAKPKRKEVDL

SEQ ID NO: 1790449 - protein, 11 aa, Staphylococcus epidermidis
STQNDAHHQLS

SEQ ID NO: 1790450 - protein, 7 aa, Staphylococcus epidermidis
STQQRKE

SEQ ID NO: 1790451 - protein, 11 aa, Staphylococcus epidermidis
STRPTNKHNRG

SEQ ID NO: 1790452 - protein, 15 aa, Staphylococcus epidermidis
STSAGIQDEADKVER

SEQ ID NO: 1790453 - protein, 22 aa, Staphylococcus epidermidis
STSAGIQDETDKEERAQVDAAR

SEQ ID NO: 1790454 - protein, 13 aa, Staphylococcus epidermidis
STSALDTKNKENI

SEQ ID NO: 1790455 - protein, 9 aa, Staphylococcus epidermidis
STSDEKTKD

SEQ ID NO: 1790456 - protein, 4 aa, Staphylococcus epidermidis
STSE

SEQ ID NO: 1790457 - protein, 16 aa, Staphylococcus epidermidis
STSEQSEHGYSVKEQE

SEQ ID NO: 1790458 - protein, 9 aa, Staphylococcus epidermidis
STSGSFSDR

SEQ ID NO: 1790459 - protein, 5 aa, Staphylococcus epidermidis
STSKF

SEQ ID NO: 1790460 - protein, 11 aa, Staphylococcus epidermidis
STSKITGEEEI

SEQ ID NO: 1790461 - protein, 6 aa, Staphylococcus epidermidis
STSLTF

SEQ ID NO: 1790462 - protein, 10 aa, Staphylococcus epidermidis
STSMTAAKNT

SEQ ID NO: 1790463 - protein, 9 aa, Staphylococcus epidermidis
STSNENWTT

SEQ ID NO: 1790464 - protein, 5 aa, Staphylococcus epidermidis
STSPF

SEQ ID NO: 1790465 - protein, 9 aa, Staphylococcus epidermidis
STSPKKDKV

SEQ ID NO: 1790466 - protein, 5 aa, Staphylococcus epidermidis
STSSF

SEQ ID NO: 1790467 - protein, 8 aa, Staphylococcus epidermidis
STTEKPKD

SEQ ID NO: 1790468 - protein, 9 aa, Staphylococcus epidermidis
STTFAEAVE

SEQ ID NO: 1790469 - protein, 12 aa, Staphylococcus epidermidis
STTKKELKQPKV

SEQ ID NO: 1790470 - protein, 18 aa, Staphylococcus epidermidis
STTQERFNKEKNKLANHQ

SEQ ID NO: 1790471 - protein, 18 aa, Staphylococcus epidermidis
STTREIAKATGTSLQTVT

SEQ ID NO: 1790472 - protein, 11 aa, Staphylococcus epidermidis
STTTEDQTGDI

SEQ ID NO: 1790473 - protein, 4 aa, Staphylococcus epidermidis
STVE

SEQ ID NO: 1790474 - protein, 7 aa, Staphylococcus epidermidis
STVGVDP

SEQ ID NO: 1790475 - protein, 5 aa, Staphylococcus epidermidis
STVTG

SEQ ID NO: 1790476 - protein, 6 aa, Staphylococcus epidermidis
STYEKK

SEQ ID NO: 1790477 - protein, 16 aa, Staphylococcus epidermidis
STYRSQNRGGRGVQGM

SEQ ID NO: 1790478 - protein, 7 aa, Staphylococcus epidermidis
SVAESYL

SEQ ID NO: 1790479 - protein, 7 aa, Staphylococcus epidermidis
SVDERRE

SEQ ID NO: 1790480 - protein, 8 aa, Staphylococcus epidermidis
SVDGLDND

SEQ ID NO: 1790481 - protein, 18 aa, Staphylococcus epidermidis
SVDKNTDQIIPAGDSRSM

SEQ ID NO: 1790482 - protein, 8 aa, Staphylococcus epidermidis
SVDQPLQT

SEQ ID NO: 1790483 - protein, 6 aa, Staphylococcus epidermidis
SVEEAI

SEQ ID NO: 1790484 - protein, 6 aa, Staphylococcus epidermidis
SVEEKR

SEQ ID NO: 1790485 - protein, 7 aa, Staphylococcus epidermidis
SVEKQSF

SEQ ID NO: 1790486 - protein, 6 aa, Staphylococcus epidermidis
SVEQLE

SEQ ID NO: 1790487 - protein, 5 aa, Staphylococcus epidermidis
SVETT

SEQ ID NO: 1790488 - protein, 13 aa, Staphylococcus epidermidis
SVFPTQDAAQQAL

SEQ ID NO: 1790489 - protein, 5 aa, Staphylococcus epidermidis
SVGKP

SEQ ID NO: 1790490 - protein, 5 aa, Staphylococcus epidermidis
SVKEV

SEQ ID NO: 1790491 - protein, 8 aa, Staphylococcus epidermidis
SVKHDTDI

SEQ ID NO: 1790492 - protein, 10 aa, Staphylococcus epidermidis
SVKNKAAHKN

SEQ ID NO: 1790493 - protein, 4 aa, Staphylococcus epidermidis
SVKS

SEQ ID NO: 1790494 - protein, 19 aa, Staphylococcus epidermidis
SVKYTENYKPISKSTTMRV

SEQ ID NO: 1790495 - protein, 7 aa, Staphylococcus epidermidis
SVNGATA

SEQ ID NO: 1790496 - protein, 5 aa, Staphylococcus epidermidis
SVNGI

SEQ ID NO: 1790497 - protein, 12 aa, Staphylococcus epidermidis
SVNIDNNVSILN

SEQ ID NO: 1790498 - protein, 20 aa, Staphylococcus epidermidis
SVNKSKNYSKEKPKNSPNKW

SEQ ID NO: 1790499 - protein, 12 aa, Staphylococcus epidermidis
SVNNRQNGQRNA

SEQ ID NO: 1790500 - protein, 9 aa, Staphylococcus epidermidis
SVNPAGSSY

SEQ ID NO: 1790501 - protein, 15 aa, Staphylococcus epidermidis
SVNPNDLDPNKQSKL

SEQ ID NO: 1790502 - protein, 15 aa, Staphylococcus epidermidis
SVNTEGKLCNSGKYI

SEQ ID NO: 1790503 - protein, 32 aa, Staphylococcus epidermidis
SVPEKDTARLRYTQTEKAIADPNTKSTAQYSW

SEQ ID NO: 1790504 - protein, 15 aa, Staphylococcus epidermidis
SVPKQSNTKTTHHEK

SEQ ID NO: 1790505 - protein, 18 aa, Staphylococcus epidermidis
SVPSDIQTAVRNNGGGHL

SEQ ID NO: 1790506 - protein, 18 aa, Staphylococcus epidermidis
SVPSNIQTAVRNNGGGHL

SEQ ID NO: 1790507 - protein, 13 aa, Staphylococcus epidermidis
SVPTSRKSPFSVR

SEQ ID NO: 1790508 - protein, 6 aa, Staphylococcus epidermidis
SVQDKS

SEQ ID NO: 1790509 - protein, 9 aa, Staphylococcus epidermidis
SVQTRTKHK

SEQ ID NO: 1790510 - protein, 6 aa, Staphylococcus epidermidis
SVRARE

SEQ ID NO: 1790511 - protein, 22 aa, Staphylococcus epidermidis
SVSAPSNVSATGNTNSATVTSE

SEQ ID NO: 1790512 - protein, 5 aa, Staphylococcus epidermidis
SVSDS

SEQ ID NO: 1790513 - protein, 15 aa, Staphylococcus epidermidis
SVSDVTDQFKKDGLK

SEQ ID NO: 1790514 - protein, 16 aa, Staphylococcus epidermidis
SVSEIKKEQSKKEANK

SEQ ID NO: 1790515 - protein, 14 aa, Staphylococcus epidermidis
SVSEKEKDEWLKKL

SEQ ID NO: 1790516 - protein, 14 aa, Staphylococcus epidermidis
SVSEKEKDEWLKNL

SEQ ID NO: 1790517 - protein, 4 aa, Staphylococcus epidermidis
SVSG

SEQ ID NO: 1790518 - protein, 7 aa, Staphylococcus epidermidis
SVSIPNQ

SEQ ID NO: 1790519 - protein, 8 aa, Staphylococcus epidermidis
SVSKAFRK

SEQ ID NO: 1790520 - protein, 8 aa, Staphylococcus epidermidis
SVSKASKI

SEQ ID NO: 1790521 - protein, 10 aa, Staphylococcus epidermidis
SVSKSGTIQE

SEQ ID NO: 1790522 - protein, 6 aa, Staphylococcus epidermidis
SVSNAE

SEQ ID NO: 1790523 - protein, 12 aa, Staphylococcus epidermidis
SVTAKHLNRYIH

SEQ ID NO: 1790524 - protein, 6 aa, Staphylococcus epidermidis
SVTGTL

SEQ ID NO: 1790525 - protein, 6 aa, Staphylococcus epidermidis
SVTKGN

SEQ ID NO: 1790526 - protein, 12 aa, Staphylococcus epidermidis
SVTNKDAQFKGT

SEQ ID NO: 1790527 - protein, 15 aa, Staphylococcus epidermidis
SVTNSKKHCISRYFI

SEQ ID NO: 1790528 - protein, 5 aa, Staphylococcus epidermidis
SVTPD

SEQ ID NO: 1790529 - protein, 8 aa, Staphylococcus epidermidis
SVTPSRIE

SEQ ID NO: 1790530 - protein, 14 aa, Staphylococcus epidermidis
SVYEADKSKNEEKL

SEQ ID NO: 1790531 - protein, 6 aa, Staphylococcus epidermidis
SWAEGK

SEQ ID NO: 1790532 - protein, 9 aa, Staphylococcus epidermidis
SWAKQTGNT

SEQ ID NO: 1790533 - protein, 8 aa, Staphylococcus epidermidis
SYAEDNQV

SEQ ID NO: 1790534 - protein, 13 aa, Staphylococcus epidermidis
SYATNTNVRQNSD

SEQ ID NO: 1790535 - protein, 14 aa, Staphylococcus epidermidis
SYDASNDKQRRELE

SEQ ID NO: 1790536 - protein, 16 aa, Staphylococcus epidermidis
SYDDESTSNSIVAVGA

SEQ ID NO: 1790537 - protein, 9 aa, Staphylococcus epidermidis
SYDLPDEKV

SEQ ID NO: 1790538 - protein, 8 aa, Staphylococcus epidermidis
SYDRPYEQ

SEQ ID NO: 1790539 - protein, 6 aa, Staphylococcus epidermidis
SYEENE

SEQ ID NO: 1790540 - protein, 7 aa, Staphylococcus epidermidis
SYEEQEK

SEQ ID NO: 1790541 - protein, 7 aa, Staphylococcus epidermidis
SYEPTQK

SEQ ID NO: 1790542 - protein, 8 aa, Staphylococcus epidermidis
SYETPSKL

SEQ ID NO: 1790543 - protein, 4 aa, Staphylococcus epidermidis
SYGA

SEQ ID NO: 1790544 - protein, 12 aa, Staphylococcus epidermidis
SYGDANVEEGDE

SEQ ID NO: 1790545 - protein, 12 aa, Staphylococcus epidermidis
SYGDTKEKYDVT

SEQ ID NO: 1790546 - protein, 20 aa, Staphylococcus epidermidis
SYGQLSKSKEYEVTKSESLN

SEQ ID NO: 1790547 - protein, 5 aa, Staphylococcus epidermidis
SYGRE

SEQ ID NO: 1790548 - protein, 12 aa, Staphylococcus epidermidis
SYHEHNKEQQTT

SEQ ID NO: 1790549 - protein, 23 aa, Staphylococcus epidermidis
SYHKEENAVTVDATKKLNEEAPY

SEQ ID NO: 1790550 - protein, 11 aa, Staphylococcus epidermidis
SYHSEKDTDEL

SEQ ID NO: 1790551 - protein, 9 aa, Staphylococcus epidermidis
SYIGKGPEQ

SEQ ID NO: 1790552 - protein, 14 aa, Staphylococcus epidermidis
SYKELTKDDLPDGD

SEQ ID NO: 1790553 - protein, 8 aa, Staphylococcus epidermidis
SYKKDSRG

SEQ ID NO: 1790554 - protein, 5 aa, Staphylococcus epidermidis
SYKNL

SEQ ID NO: 1790555 - protein, 11 aa, Staphylococcus epidermidis
SYKSKKEELED

SEQ ID NO: 1790556 - protein, 10 aa, Staphylococcus epidermidis
SYKSQGFKKQ

SEQ ID NO: 1790557 - protein, 6 aa, Staphylococcus epidermidis
SYLSAS

SEQ ID NO: 1790558 - protein, 5 aa, Staphylococcus epidermidis
SYNEH

SEQ ID NO: 1790559 - protein, 6 aa, Staphylococcus epidermidis
SYNGKT

SEQ ID NO: 1790560 - protein, 13 aa, Staphylococcus epidermidis
SYNHPEDDIGPRI

SEQ ID NO: 1790561 - protein, 8 aa, Staphylococcus epidermidis
SYNKSQNM

SEQ ID NO: 1790562 - protein, 4 aa, Staphylococcus epidermidis
SYNP

SEQ ID NO: 1790563 - protein, 14 aa, Staphylococcus epidermidis
SYNQSTLRTLLNLD

SEQ ID NO: 1790564 - protein, 5 aa, Staphylococcus epidermidis
SYNRE

SEQ ID NO: 1790565 - protein, 16 aa, Staphylococcus epidermidis
SYPGFEVNETDKVTQY

SEQ ID NO: 1790566 - protein, 14 aa, Staphylococcus epidermidis
SYQDEEDEEDEEAD

SEQ ID NO: 1790567 - protein, 5 aa, Staphylococcus epidermidis
SYQDG

SEQ ID NO: 1790568 - protein, 10 aa, Staphylococcus epidermidis
SYQNGQTSLD

SEQ ID NO: 1790569 - protein, 6 aa, Staphylococcus epidermidis
SYQRKR

SEQ ID NO: 1790570 - protein, 11 aa, Staphylococcus epidermidis
SYQSSNVGNQI

SEQ ID NO: 1790571 - protein, 8 aa, Staphylococcus epidermidis
SYSEQLGG

SEQ ID NO: 1790572 - protein, 7 aa, Staphylococcus epidermidis
SYSKDEA

SEQ ID NO: 1790573 - protein, 6 aa, Staphylococcus epidermidis
SYSKEL

SEQ ID NO: 1790574 - protein, 5 aa, Staphylococcus epidermidis
SYSNL

SEQ ID NO: 1790575 - protein, 7 aa, Staphylococcus epidermidis
SYTDPKL

SEQ ID NO: 1790576 - protein, 13 aa, Staphylococcus epidermidis
SYTDPKTGTTTTA

SEQ ID NO: 1790577 - protein, 11 aa, Staphylococcus epidermidis
SYTDPNKGTTS

SEQ ID NO: 1790578 - protein, 13 aa, Staphylococcus epidermidis
SYTDPNTGTTSTA

SEQ ID NO: 1790579 - protein, 6 aa, Staphylococcus epidermidis
SYTDPR

SEQ ID NO: 1790580 - protein, 7 aa, Staphylococcus epidermidis
SYTPQEY

SEQ ID NO: 1790581 - protein, 7 aa, Staphylococcus epidermidis
SYTSLKK

SEQ ID NO: 1790582 - protein, 6 aa, Staphylococcus epidermidis
TAAGGS

SEQ ID NO: 1790583 - protein, 15 aa, Staphylococcus epidermidis
TAAKRARELDEKHET

SEQ ID NO: 1790584 - protein, 16 aa, Staphylococcus epidermidis
TAAKRARELDEKRETA

SEQ ID NO: 1790585 - protein, 10 aa, Staphylococcus epidermidis
TAANDSAADI

SEQ ID NO: 1790586 - protein, 11 aa, Staphylococcus epidermidis
TAANNATDYRD

SEQ ID NO: 1790587 - protein, 7 aa, Staphylococcus epidermidis
TACENEG

SEQ ID NO: 1790588 - protein, 4 aa, Staphylococcus epidermidis
TADH

SEQ ID NO: 1790589 - protein, 4 aa, Staphylococcus epidermidis
TADN

SEQ ID NO: 1790590 - protein, 13 aa, Staphylococcus epidermidis
TADSIANDGYNDE

SEQ ID NO: 1790591 - protein, 12 aa, Staphylococcus epidermidis
TAEENNESSQEL

SEQ ID NO: 1790592 - protein, 15 aa, Staphylococcus epidermidis
TAEKPGDIKKDTYAL

SEQ ID NO: 1790593 - protein, 12 aa, Staphylococcus epidermidis
TAELSDTGLRAA

SEQ ID NO: 1790594 - protein, 6 aa, Staphylococcus epidermidis
TAENIG

SEQ ID NO: 1790595 - protein, 13 aa, Staphylococcus epidermidis
TAERQQLKRTDKN

SEQ ID NO: 1790596 - protein, 5 aa, Staphylococcus epidermidis
TAESW

SEQ ID NO: 1790597 - protein, 9 aa, Staphylococcus epidermidis
TAETDNGKT

SEQ ID NO: 1790598 - protein, 6 aa, Staphylococcus epidermidis
TAETEY

SEQ ID NO: 1790599 - protein, 5 aa, Staphylococcus epidermidis
TAETN

SEQ ID NO: 1790600 - protein, 9 aa, Staphylococcus epidermidis
TAEVPSTVS

SEQ ID NO: 1790601 - protein, 10 aa, Staphylococcus epidermidis
TAEVRGKKVR

SEQ ID NO: 1790602 - protein, 4 aa, Staphylococcus epidermidis
TAFD

SEQ ID NO: 1790603 - protein, 10 aa, Staphylococcus epidermidis
TAGMDVSGRE

SEQ ID NO: 1790604 - protein, 22 aa, Staphylococcus epidermidis
TAGSNLEKPFNETDMTAIMMLT

SEQ ID NO: 1790605 - protein, 4 aa, Staphylococcus epidermidis
TAHE

SEQ ID NO: 1790606 - protein, 9 aa, Staphylococcus epidermidis
TAHEASPKI

SEQ ID NO: 1790607 - protein, 10 aa, Staphylococcus epidermidis
TAIDSGSGLN

SEQ ID NO: 1790608 - protein, 4 aa, Staphylococcus epidermidis
TAIN

SEQ ID NO: 1790609 - protein, 13 aa, Staphylococcus epidermidis
TAIPSTNSEGKKI

SEQ ID NO: 1790610 - protein, 16 aa, Staphylococcus epidermidis
TAKEKFENESLEGKTV

SEQ ID NO: 1790611 - protein, 17 aa, Staphylococcus epidermidis
TAKEKGVKIPMIDEAGD

SEQ ID NO: 1790612 - protein, 5 aa, Staphylococcus epidermidis
TAKHE

SEQ ID NO: 1790613 - protein, 11 aa, Staphylococcus epidermidis
TAKQLSKIGGG

SEQ ID NO: 1790614 - protein, 11 aa, Staphylococcus epidermidis
TAKTSDNGLSQ

SEQ ID NO: 1790615 - protein, 4 aa, Staphylococcus epidermidis
TAKY

SEQ ID NO: 1790616 - protein, 9 aa, Staphylococcus epidermidis
TALKNKGYT

SEQ ID NO: 1790617 - protein, 6 aa, Staphylococcus epidermidis
TAMNGE

SEQ ID NO: 1790618 - protein, 6 aa, Staphylococcus epidermidis
TANDEV

SEQ ID NO: 1790619 - protein, 4 aa, Staphylococcus epidermidis
TANG

SEQ ID NO: 1790620 - protein, 5 aa, Staphylococcus epidermidis
TANHE

SEQ ID NO: 1790621 - protein, 9 aa, Staphylococcus epidermidis
TANTGGDKI

SEQ ID NO: 1790622 - protein, 11 aa, Staphylococcus epidermidis
TAPDRNNVNGY

SEQ ID NO: 1790623 - protein, 10 aa, Staphylococcus epidermidis
TAPKEQRDRL

SEQ ID NO: 1790624 - protein, 4 aa, Staphylococcus epidermidis
TAPN

SEQ ID NO: 1790625 - protein, 7 aa, Staphylococcus epidermidis
TAPPHLD

SEQ ID NO: 1790626 - protein, 7 aa, Staphylococcus epidermidis
TAPQNEI

SEQ ID NO: 1790627 - protein, 12 aa, Staphylococcus epidermidis
TAPVSTQTLQRD

SEQ ID NO: 1790628 - protein, 13 aa, Staphylococcus epidermidis
TAQASSPTEGLGF

SEQ ID NO: 1790629 - protein, 4 aa, Staphylococcus epidermidis
TAQE

SEQ ID NO: 1790630 - protein, 5 aa, Staphylococcus epidermidis
TAQEL

SEQ ID NO: 1790631 - protein, 5 aa, Staphylococcus epidermidis
TAQRN

SEQ ID NO: 1790632 - protein, 12 aa, Staphylococcus epidermidis
TAQTDKNGQPIY

SEQ ID NO: 1790633 - protein, 4 aa, Staphylococcus epidermidis
TAQY

SEQ ID NO: 1790634 - protein, 8 aa, Staphylococcus epidermidis
TARQTVDA

SEQ ID NO: 1790635 - protein, 17 aa, Staphylococcus epidermidis
TARYGINSGGEPTQGAG

SEQ ID NO: 1790636 - protein, 17 aa, Staphylococcus epidermidis
TARYGIRSGGEPTQGAG

SEQ ID NO: 1790637 - protein, 4 aa, Staphylococcus epidermidis
TASE

SEQ ID NO: 1790638 - protein, 7 aa, Staphylococcus epidermidis
TASERSY

SEQ ID NO: 1790639 - protein, 6 aa, Staphylococcus epidermidis
TASETA

SEQ ID NO: 1790640 - protein, 7 aa, Staphylococcus epidermidis
TASGGDV

SEQ ID NO: 1790641 - protein, 5 aa, Staphylococcus epidermidis
TASKS

SEQ ID NO: 1790642 - protein, 7 aa, Staphylococcus epidermidis
TASREDT

SEQ ID NO: 1790643 - protein, 9 aa, Staphylococcus epidermidis
TASRKETIE

SEQ ID NO: 1790644 - protein, 10 aa, Staphylococcus epidermidis
TASTEKGNYV

SEQ ID NO: 1790645 - protein, 11 aa, Staphylococcus epidermidis
TASTGGAKNLQ

SEQ ID NO: 1790646 - protein, 7 aa, Staphylococcus epidermidis
TASVGTM

SEQ ID NO: 1790647 - protein, 10 aa, Staphylococcus epidermidis
TATDNSGKVV

SEQ ID NO: 1790648 - protein, 7 aa, Staphylococcus epidermidis
TATGDIQ

SEQ ID NO: 1790649 - protein, 7 aa, Staphylococcus epidermidis
TATTDNK

SEQ ID NO: 1790650 - protein, 7 aa, Staphylococcus epidermidis
TAVKTED

SEQ ID NO: 1790651 - protein, 14 aa, Staphylococcus epidermidis
TAVQNSDIKKFNES

SEQ ID NO: 1790652 - protein, 6 aa, Staphylococcus epidermidis
TAYEKK

SEQ ID NO: 1790653 - protein, 8 aa, Staphylococcus epidermidis
TAYISPNK

SEQ ID NO: 1790654 - protein, 5 aa, Staphylococcus epidermidis
TCDGD

SEQ ID NO: 1790655 - protein, 10 aa, Staphylococcus epidermidis
TCEGEKDNYK

SEQ ID NO: 1790656 - protein, 6 aa, Staphylococcus epidermidis
TCGNRE

SEQ ID NO: 1790657 - protein, 28 aa, Staphylococcus epidermidis
TCSDCQESKRYLNSQEISYSHKDVSQNL

SEQ ID NO: 1790658 - protein, 23 aa, Staphylococcus epidermidis
TCSQQDTGKKDIINKTGSETVLF

SEQ ID NO: 1790659 - protein, 9 aa, Staphylococcus epidermidis
TCTDNENGF

SEQ ID NO: 1790660 - protein, 13 aa, Staphylococcus epidermidis
TCTSGSKKFARRE

SEQ ID NO: 1790661 - protein, 9 aa, Staphylococcus epidermidis
TDAEAQNHS

SEQ ID NO: 1790662 - protein, 12 aa, Staphylococcus epidermidis
TDAEKTRKNVES

SEQ ID NO: 1790663 - protein, 5 aa, Staphylococcus epidermidis
TDAHH

SEQ ID NO: 1790664 - protein, 13 aa, Staphylococcus epidermidis
TDAITKSETPNRA

SEQ ID NO: 1790665 - protein, 26 aa, Staphylococcus epidermidis
TDALQNSNYSETSGTPTLKLTNSSQT

SEQ ID NO: 1790666 - protein, 29 aa, Staphylococcus epidermidis
TDAQKETYTKEVEEAIDQARTGNDQPAVK

SEQ ID NO: 1790667 - protein, 13 aa, Staphylococcus epidermidis
TDASNLLKGKDEK

SEQ ID NO: 1790668 - protein, 4 aa, Staphylococcus epidermidis
TDCS

SEQ ID NO: 1790669 - protein, 10 aa, Staphylococcus epidermidis
TDCSASTIRR

SEQ ID NO: 1790670 - protein, 5 aa, Staphylococcus epidermidis
TDDAS

SEQ ID NO: 1790671 - protein, 6 aa, Staphylococcus epidermidis
TDDPYE

SEQ ID NO: 1790672 - protein, 8 aa, Staphylococcus epidermidis
TDDSINAI

SEQ ID NO: 1790673 - protein, 22 aa, Staphylococcus epidermidis
TDDVPEKKEEALNKQGIDTYHG

SEQ ID NO: 1790674 - protein, 25 aa, Staphylococcus epidermidis
TDEAKEGRDAFKEKRDPDFDQFPKF

SEQ ID NO: 1790675 - protein, 12 aa, Staphylococcus epidermidis
TDEALKAKTQEF

SEQ ID NO: 1790676 - protein, 10 aa, Staphylococcus epidermidis
TDEEKQQAME

SEQ ID NO: 1790677 - protein, 11 aa, Staphylococcus epidermidis
TDEEPSVNQQV

SEQ ID NO: 1790678 - protein, 41 aa, Staphylococcus epidermidis
TDEEYNGSNEYYKAPRSGSDEDFNAVSPEELEAEEQKYLSN

SEQ ID NO: 1790679 - protein, 6 aa, Staphylococcus epidermidis
TDEGQN

SEQ ID NO: 1790680 - protein, 19 aa, Staphylococcus epidermidis
TDEKAKKNYSVHSLDFGKF

SEQ ID NO: 1790681 - protein, 12 aa, Staphylococcus epidermidis
TDELNGAYKHSD

SEQ ID NO: 1790682 - protein, 7 aa, Staphylococcus epidermidis
TDELSRK

SEQ ID NO: 1790683 - protein, 7 aa, Staphylococcus epidermidis
TDENRSI

SEQ ID NO: 1790684 - protein, 9 aa, Staphylococcus epidermidis
TDEQTAHRQ

SEQ ID NO: 1790685 - protein, 5 aa, Staphylococcus epidermidis
TDESS

SEQ ID NO: 1790686 - protein, 18 aa, Staphylococcus epidermidis
TDETIAEYEKQKELVPRK

SEQ ID NO: 1790687 - protein, 7 aa, Staphylococcus epidermidis
TDEVETN

SEQ ID NO: 1790688 - protein, 5 aa, Staphylococcus epidermidis
TDGEI

SEQ ID NO: 1790689 - protein, 18 aa, Staphylococcus epidermidis
TDGFEGKAADSVKNYTKT

SEQ ID NO: 1790690 - protein, 14 aa, Staphylococcus epidermidis
TDGKISNDEELSGH

SEQ ID NO: 1790691 - protein, 7 aa, Staphylococcus epidermidis
TDGNQDQ

SEQ ID NO: 1790692 - protein, 12 aa, Staphylococcus epidermidis
TDGNTDNTTSPV

SEQ ID NO: 1790693 - protein, 9 aa, Staphylococcus epidermidis
TDGQITMNG

SEQ ID NO: 1790694 - protein, 18 aa, Staphylococcus epidermidis
TDGTSHLSPLKEERVKGT

SEQ ID NO: 1790695 - protein, 4 aa, Staphylococcus epidermidis
TDGY

SEQ ID NO: 1790696 - protein, 8 aa, Staphylococcus epidermidis
TDHGSDFT

SEQ ID NO: 1790697 - protein, 7 aa, Staphylococcus epidermidis
TDHKGRI

SEQ ID NO: 1790698 - protein, 8 aa, Staphylococcus epidermidis
TDHSAENI

SEQ ID NO: 1790699 - protein, 4 aa, Staphylococcus epidermidis
TDIA

SEQ ID NO: 1790700 - protein, 5 aa, Staphylococcus epidermidis
TDIEG

SEQ ID NO: 1790701 - protein, 13 aa, Staphylococcus epidermidis
TDIEKDKQRCNRQ

SEQ ID NO: 1790702 - protein, 5 aa, Staphylococcus epidermidis
TDIKD

SEQ ID NO: 1790703 - protein, 8 aa, Staphylococcus epidermidis
TDINEQKK

SEQ ID NO: 1790704 - protein, 14 aa, Staphylococcus epidermidis
TDISNQLNKDTIEA

SEQ ID NO: 1790705 - protein, 4 aa, Staphylococcus epidermidis
TDKA

SEQ ID NO: 1790706 - protein, 6 aa, Staphylococcus epidermidis
TDKDEF

SEQ ID NO: 1790707 - protein, 13 aa, Staphylococcus epidermidis
TDKDKAQAHIDAG

SEQ ID NO: 1790708 - protein, 15 aa, Staphylococcus epidermidis
TDKDLEKEVDQPVAG

SEQ ID NO: 1790709 - protein, 15 aa, Staphylococcus epidermidis
TDKDTPFKNTQQFIK

SEQ ID NO: 1790710 - protein, 6 aa, Staphylococcus epidermidis
TDKEAL

SEQ ID NO: 1790711 - protein, 11 aa, Staphylococcus epidermidis
TDKEQTEKARH

SEQ ID NO: 1790712 - protein, 15 aa, Staphylococcus epidermidis
TDKETLQKACEEGKV

SEQ ID NO: 1790713 - protein, 17 aa, Staphylococcus epidermidis
TDKGMSMDKATKYALQL

SEQ ID NO: 1790714 - protein, 9 aa, Staphylococcus epidermidis
TDKHQHGEE

SEQ ID NO: 1790715 - protein, 9 aa, Staphylococcus epidermidis
TDKNENALR

SEQ ID NO: 1790716 - protein, 4 aa, Staphylococcus epidermidis
TDKP

SEQ ID NO: 1790717 - protein, 9 aa, Staphylococcus epidermidis
TDKPDPLLG

SEQ ID NO: 1790718 - protein, 10 aa, Staphylococcus epidermidis
TDKPIQRQDL

SEQ ID NO: 1790719 - protein, 10 aa, Staphylococcus epidermidis
TDKQGNSPFD

SEQ ID NO: 1790720 - protein, 13 aa, Staphylococcus epidermidis
TDKQQALKTTNID

SEQ ID NO: 1790721 - protein, 18 aa, Staphylococcus epidermidis
TDKQQKIKNEKYWGKIDW

SEQ ID NO: 1790722 - protein, 6 aa, Staphylococcus epidermidis
TDKRAT

SEQ ID NO: 1790723 - protein, 8 aa, Staphylococcus epidermidis
TDKRESLS

SEQ ID NO: 1790724 - protein, 8 aa, Staphylococcus epidermidis
TDKSYQLS

SEQ ID NO: 1790725 - protein, 4 aa, Staphylococcus epidermidis
TDLD

SEQ ID NO: 1790726 - protein, 13 aa, Staphylococcus epidermidis
TDLEKDKQRCNHQ

SEQ ID NO: 1790727 - protein, 4 aa, Staphylococcus epidermidis
TDLT

SEQ ID NO: 1790728 - protein, 15 aa, Staphylococcus epidermidis
TDNETKGYKGSTTFT

SEQ ID NO: 1790729 - protein, 6 aa, Staphylococcus epidermidis
TDNEYF

SEQ ID NO: 1790730 - protein, 5 aa, Staphylococcus epidermidis
TDNGF

SEQ ID NO: 1790731 - protein, 6 aa, Staphylococcus epidermidis
TDNGSI

SEQ ID NO: 1790732 - protein, 6 aa, Staphylococcus epidermidis
TDNKKA

SEQ ID NO: 1790733 - protein, 17 aa, Staphylococcus epidermidis
TDNNESINPNNPLKGKV

SEQ ID NO: 1790734 - protein, 10 aa, Staphylococcus epidermidis
TDNNKATDEF

SEQ ID NO: 1790735 - protein, 7 aa, Staphylococcus epidermidis
TDNNYEE

SEQ ID NO: 1790736 - protein, 10 aa, Staphylococcus epidermidis
TDNPNGSYED

SEQ ID NO: 1790737 - protein, 5 aa, Staphylococcus epidermidis
TDNTI

SEQ ID NO: 1790738 - protein, 7 aa, Staphylococcus epidermidis
TDNVTED

SEQ ID NO: 1790739 - protein, 8 aa, Staphylococcus epidermidis
TDPDADRL

SEQ ID NO: 1790740 - protein, 6 aa, Staphylococcus epidermidis
TDPDGH

SEQ ID NO: 1790741 - protein, 9 aa, Staphylococcus epidermidis
TDPDREGEA

SEQ ID NO: 1790742 - protein, 7 aa, Staphylococcus epidermidis
TDPGFAN

SEQ ID NO: 1790743 - protein, 8 aa, Staphylococcus epidermidis
TDPGFNSD

SEQ ID NO: 1790744 - protein, 8 aa, Staphylococcus epidermidis
TDPGRIED

SEQ ID NO: 1790745 - protein, 14 aa, Staphylococcus epidermidis
TDPKKSTAKEREKL

SEQ ID NO: 1790746 - protein, 4 aa, Staphylococcus epidermidis
TDPM

SEQ ID NO: 1790747 - protein, 9 aa, Staphylococcus epidermidis
TDQDPQVRA

SEQ ID NO: 1790748 - protein, 4 aa, Staphylococcus epidermidis
TDQL

SEQ ID NO: 1790749 - protein, 14 aa, Staphylococcus epidermidis
TDQQIKNKYPHTDA

SEQ ID NO: 1790750 - protein, 4 aa, Staphylococcus epidermidis
TDRI

SEQ ID NO: 1790751 - protein, 17 aa, Staphylococcus epidermidis
TDRLSETVKKDFSNATE

SEQ ID NO: 1790752 - protein, 26 aa, Staphylococcus epidermidis
TDRNGMATTEASSAAKLNVQPTDNSF

SEQ ID NO: 1790753 - protein, 11 aa, Staphylococcus epidermidis
TDRTAQNAHDQ

SEQ ID NO: 1790754 - protein, 10 aa, Staphylococcus epidermidis
TDSAKDVAQS

SEQ ID NO: 1790755 - protein, 13 aa, Staphylococcus epidermidis
TDSIEPEKESDVM

SEQ ID NO: 1790756 - protein, 5 aa, Staphylococcus epidermidis
TDSLK

SEQ ID NO: 1790757 - protein, 7 aa, Staphylococcus epidermidis
TDSQATL

SEQ ID NO: 1790758 - protein, 30 aa, Staphylococcus epidermidis
TDSTKDNKDNLKKAKEKAEEKAKEYYNKAF

SEQ ID NO: 1790759 - protein, 4 aa, Staphylococcus epidermidis
TDSY

SEQ ID NO: 1790760 - protein, 7 aa, Staphylococcus epidermidis
TDTEPGS

SEQ ID NO: 1790761 - protein, 8 aa, Staphylococcus epidermidis
TDTEPGSL

SEQ ID NO: 1790762 - protein, 8 aa, Staphylococcus epidermidis
TDTETKSR

SEQ ID NO: 1790763 - protein, 4 aa, Staphylococcus epidermidis
TDTK

SEQ ID NO: 1790764 - protein, 9 aa, Staphylococcus epidermidis
TDTSDHTGE

SEQ ID NO: 1790765 - protein, 11 aa, Staphylococcus epidermidis
TDTSNHDDDLA

SEQ ID NO: 1790766 - protein, 11 aa, Staphylococcus epidermidis
TDTTNHDDDLA

SEQ ID NO: 1790767 - protein, 18 aa, Staphylococcus epidermidis
TDTTPLERDEATAATTAY

SEQ ID NO: 1790768 - protein, 5 aa, Staphylococcus epidermidis
TDVIE

SEQ ID NO: 1790769 - protein, 5 aa, Staphylococcus epidermidis
TDVRN

SEQ ID NO: 1790770 - protein, 10 aa, Staphylococcus epidermidis
TDVSDKDSYQ

SEQ ID NO: 1790771 - protein, 4 aa, Staphylococcus epidermidis
TDVV

SEQ ID NO: 1790772 - protein, 12 aa, Staphylococcus epidermidis
TDYKAKDGKEFG

SEQ ID NO: 1790773 - protein, 9 aa, Staphylococcus epidermidis
TDYKKAQPI

SEQ ID NO: 1790774 - protein, 12 aa, Staphylococcus epidermidis
TDYNPGSSVTNN

SEQ ID NO: 1790775 - protein, 14 aa, Staphylococcus epidermidis
TDYPRPSIKTTNGN

SEQ ID NO: 1790776 - protein, 9 aa, Staphylococcus epidermidis
TDYRKIPSE

SEQ ID NO: 1790777 - protein, 6 aa, Staphylococcus epidermidis
TDYSEE

SEQ ID NO: 1790778 - protein, 6 aa, Staphylococcus epidermidis
TEAETE

SEQ ID NO: 1790779 - protein, 10 aa, Staphylococcus epidermidis
TEDAIDDNNH

SEQ ID NO: 1790780 - protein, 7 aa, Staphylococcus epidermidis
TEDDGSA

SEQ ID NO: 1790781 - protein, 8 aa, Staphylococcus epidermidis
TEDDGSSY

SEQ ID NO: 1790782 - protein, 13 aa, Staphylococcus epidermidis
TEDKAKSLDIQSA

SEQ ID NO: 1790783 - protein, 5 aa, Staphylococcus epidermidis
TEDNF

SEQ ID NO: 1790784 - protein, 18 aa, Staphylococcus epidermidis
TEDNGNLYGRGAADMKSG

SEQ ID NO: 1790785 - protein, 18 aa, Staphylococcus epidermidis
TEDNKGRPDVKDKKYPVK

SEQ ID NO: 1790786 - protein, 5 aa, Staphylococcus epidermidis
TEDSV

SEQ ID NO: 1790787 - protein, 4 aa, Staphylococcus epidermidis
TEDV

SEQ ID NO: 1790788 - protein, 4 aa, Staphylococcus epidermidis
TEEA

SEQ ID NO: 1790789 - protein, 9 aa, Staphylococcus epidermidis
TEEAEPTAS

SEQ ID NO: 1790790 - protein, 9 aa, Staphylococcus epidermidis
TEEEADQLE

SEQ ID NO: 1790791 - protein, 16 aa, Staphylococcus epidermidis
TEEEGNEIIEYLNEVI

SEQ ID NO: 1790792 - protein, 18 aa, Staphylococcus epidermidis
TEEEKREVNNQMINEIEE

SEQ ID NO: 1790793 - protein, 8 aa, Staphylococcus epidermidis
TEEEKSKI

SEQ ID NO: 1790794 - protein, 8 aa, Staphylococcus epidermidis
TEEEPHMG

SEQ ID NO: 1790795 - protein, 16 aa, Staphylococcus epidermidis
TEEEVNEAIEKSKHAQ

SEQ ID NO: 1790796 - protein, 4 aa, Staphylococcus epidermidis
TEEF

SEQ ID NO: 1790797 - protein, 4 aa, Staphylococcus epidermidis
TEEG

SEQ ID NO: 1790798 - protein, 14 aa, Staphylococcus epidermidis
TEEKFSDPTTREET

SEQ ID NO: 1790799 - protein, 12 aa, Staphylococcus epidermidis
TEENPSAPEFDQ

SEQ ID NO: 1790800 - protein, 5 aa, Staphylococcus epidermidis
TEEQL

SEQ ID NO: 1790801 - protein, 5 aa, Staphylococcus epidermidis
TEESL

SEQ ID NO: 1790802 - protein, 6 aa, Staphylococcus epidermidis
TEETDD

SEQ ID NO: 1790803 - protein, 15 aa, Staphylococcus epidermidis
TEETENGQIKSTYTI

SEQ ID NO: 1790804 - protein, 11 aa, Staphylococcus epidermidis
TEETPTTAPVY

SEQ ID NO: 1790805 - protein, 12 aa, Staphylococcus epidermidis
TEEVTKDRTGKL

SEQ ID NO: 1790806 - protein, 27 aa, Staphylococcus epidermidis
TEFEKSVTAPAGNQGHGLDDSEFDKKA

SEQ ID NO: 1790807 - protein, 4 aa, Staphylococcus epidermidis
TEFN

SEQ ID NO: 1790808 - protein, 10 aa, Staphylococcus epidermidis
TEFSTDSDGI

SEQ ID NO: 1790809 - protein, 4 aa, Staphylococcus epidermidis
TEGD

SEQ ID NO: 1790810 - protein, 6 aa, Staphylococcus epidermidis
TEGEMN

SEQ ID NO: 1790811 - protein, 18 aa, Staphylococcus epidermidis
TEGISTTKIKQELYGKDA

SEQ ID NO: 1790812 - protein, 5 aa, Staphylococcus epidermidis
TEGKE

SEQ ID NO: 1790813 - protein, 8 aa, Staphylococcus epidermidis
TEGSLSEG

SEQ ID NO: 1790814 - protein, 44 aa, Staphylococcus epidermidis
TEGTATQAVAGAPSVQAGENTNAQPSSSQAESQSSSDAKEIKST

SEQ ID NO: 1790815 - protein, 7 aa, Staphylococcus epidermidis
TEGTQYP

SEQ ID NO: 1790816 - protein, 6 aa, Staphylococcus epidermidis
TEHDEP

SEQ ID NO: 1790817 - protein, 7 aa, Staphylococcus epidermidis
TEHDTIE

SEQ ID NO: 1790818 - protein, 5 aa, Staphylococcus epidermidis
TEHEQ

SEQ ID NO: 1790819 - protein, 6 aa, Staphylococcus epidermidis
TEHNHS

SEQ ID NO: 1790820 - protein, 25 aa, Staphylococcus epidermidis
TEHPEYKTADSPTVRVGGEAQSSFE

SEQ ID NO: 1790821 - protein, 5 aa, Staphylococcus epidermidis
TEHPS

SEQ ID NO: 1790822 - protein, 7 aa, Staphylococcus epidermidis
TEHQPEE

SEQ ID NO: 1790823 - protein, 15 aa, Staphylococcus epidermidis
TEIEEGTLSATGSGL

SEQ ID NO: 1790824 - protein, 8 aa, Staphylococcus epidermidis
TEIEPPEG

SEQ ID NO: 1790825 - protein, 35 aa, Staphylococcus epidermidis
TEIEQATNRINSTKDALDGANKLHSDQENANRQIE

SEQ ID NO: 1790826 - protein, 11 aa, Staphylococcus epidermidis
TEIKNQNDIYG

SEQ ID NO: 1790827 - protein, 5 aa, Staphylococcus epidermidis
TEINE

SEQ ID NO: 1790828 - protein, 5 aa, Staphylococcus epidermidis
TEISR

SEQ ID NO: 1790829 - protein, 6 aa, Staphylococcus epidermidis
TEITEK

SEQ ID NO: 1790830 - protein, 22 aa, Staphylococcus epidermidis
TEKAGEKFDDIKSNSARSGRNL

SEQ ID NO: 1790831 - protein, 18 aa, Staphylococcus epidermidis
TEKDGKLYGRGTSDMKGG

SEQ ID NO: 1790832 - protein, 4 aa, Staphylococcus epidermidis
TEKI

SEQ ID NO: 1790833 - protein, 14 aa, Staphylococcus epidermidis
TEKLKDDNKFPSNL

SEQ ID NO: 1790834 - protein, 7 aa, Staphylococcus epidermidis
TEKMAGQ

SEQ ID NO: 1790835 - protein, 4 aa, Staphylococcus epidermidis
TEKN

SEQ ID NO: 1790836 - protein, 15 aa, Staphylococcus epidermidis
TEKNKENVKKQDIEG

SEQ ID NO: 1790837 - protein, 7 aa, Staphylococcus epidermidis
TEKPEEE

SEQ ID NO: 1790838 - protein, 13 aa, Staphylococcus epidermidis
TEKQSGKSITNRP

SEQ ID NO: 1790839 - protein, 14 aa, Staphylococcus epidermidis
TEKQSGKSVENRPV

SEQ ID NO: 1790840 - protein, 7 aa, Staphylococcus epidermidis
TEKVQAA

SEQ ID NO: 1790841 - protein, 5 aa, Staphylococcus epidermidis
TEKYG

SEQ ID NO: 1790842 - protein, 11 aa, Staphylococcus epidermidis
TELDSDDNHKY

SEQ ID NO: 1790843 - protein, 5 aa, Staphylococcus epidermidis
TELEG

SEQ ID NO: 1790844 - protein, 12 aa, Staphylococcus epidermidis
TELENKLSEKPQ

SEQ ID NO: 1790845 - protein, 6 aa, Staphylococcus epidermidis
TELKNT

SEQ ID NO: 1790846 - protein, 5 aa, Staphylococcus epidermidis
TELNG

SEQ ID NO: 1790847 - protein, 6 aa, Staphylococcus epidermidis
TELSPR

SEQ ID NO: 1790848 - protein, 12 aa, Staphylococcus epidermidis
TEMQTDGYSIQG

SEQ ID NO: 1790849 - protein, 5 aa, Staphylococcus epidermidis
TEMSK

SEQ ID NO: 1790850 - protein, 17 aa, Staphylococcus epidermidis
TENDMENHANNNKRISE

SEQ ID NO: 1790851 - protein, 9 aa, Staphylococcus epidermidis
TENDNTGVY

SEQ ID NO: 1790852 - protein, 9 aa, Staphylococcus epidermidis
TENETTKNV

SEQ ID NO: 1790853 - protein, 4 aa, Staphylococcus epidermidis
TENK

SEQ ID NO: 1790854 - protein, 9 aa, Staphylococcus epidermidis
TENNRDSIQ

SEQ ID NO: 1790855 - protein, 11 aa, Staphylococcus epidermidis
TENPFDKYSKT

SEQ ID NO: 1790856 - protein, 5 aa, Staphylococcus epidermidis
TEPIG

SEQ ID NO: 1790857 - protein, 7 aa, Staphylococcus epidermidis
TEQRRTR

SEQ ID NO: 1790858 - protein, 10 aa, Staphylococcus epidermidis
TEQTKEEIAT

SEQ ID NO: 1790859 - protein, 5 aa, Staphylococcus epidermidis
TEQYR

SEQ ID NO: 1790860 - protein, 6 aa, Staphylococcus epidermidis
TERENF

SEQ ID NO: 1790861 - protein, 11 aa, Staphylococcus epidermidis
TERGIKSAREL

SEQ ID NO: 1790862 - protein, 12 aa, Staphylococcus epidermidis
TERGKEIKKTLS

SEQ ID NO: 1790863 - protein, 8 aa, Staphylococcus epidermidis
TERGTKLS

SEQ ID NO: 1790864 - protein, 6 aa, Staphylococcus epidermidis
TERKQA

SEQ ID NO: 1790865 - protein, 6 aa, Staphylococcus epidermidis
TERNKI

SEQ ID NO: 1790866 - protein, 5 aa, Staphylococcus epidermidis
TERQD

SEQ ID NO: 1790867 - protein, 6 aa, Staphylococcus epidermidis
TERSGL

SEQ ID NO: 1790868 - protein, 6 aa, Staphylococcus epidermidis
TERYKN

SEQ ID NO: 1790869 - protein, 8 aa, Staphylococcus epidermidis
TESEKQEI

SEQ ID NO: 1790870 - protein, 6 aa, Staphylococcus epidermidis
TESGSV

SEQ ID NO: 1790871 - protein, 4 aa, Staphylococcus epidermidis
TESQ

SEQ ID NO: 1790872 - protein, 9 aa, Staphylococcus epidermidis
TESRGNEYM

SEQ ID NO: 1790873 - protein, 17 aa, Staphylococcus epidermidis
TESSNANKGNSAPFSDI

SEQ ID NO: 1790874 - protein, 8 aa, Staphylococcus epidermidis
TESSNTGI

SEQ ID NO: 1790875 - protein, 12 aa, Staphylococcus epidermidis
TESYKKDASQKF

SEQ ID NO: 1790876 - protein, 9 aa, Staphylococcus epidermidis
TESYSGITS

SEQ ID NO: 1790877 - protein, 6 aa, Staphylococcus epidermidis
TETARD

SEQ ID NO: 1790878 - protein, 7 aa, Staphylococcus epidermidis
TETEGQL

SEQ ID NO: 1790879 - protein, 5 aa, Staphylococcus epidermidis
TETEI

SEQ ID NO: 1790880 - protein, 6 aa, Staphylococcus epidermidis
TETGNI

SEQ ID NO: 1790881 - protein, 17 aa, Staphylococcus epidermidis
TETHKRAYEADKSNRRT

SEQ ID NO: 1790882 - protein, 24 aa, Staphylococcus epidermidis
TETQSQMDKRMREKTNGKVSRKEM

SEQ ID NO: 1790883 - protein, 5 aa, Staphylococcus epidermidis
TETTI

SEQ ID NO: 1790884 - protein, 14 aa, Staphylococcus epidermidis
TETTQDTSNAKEIE

SEQ ID NO: 1790885 - protein, 7 aa, Staphylococcus epidermidis
TETVDEA

SEQ ID NO: 1790886 - protein, 4 aa, Staphylococcus epidermidis
TEVP

SEQ ID NO: 1790887 - protein, 8 aa, Staphylococcus epidermidis
TEYDASSQ

SEQ ID NO: 1790888 - protein, 12 aa, Staphylococcus epidermidis
TEYNLRKAKDRA

SEQ ID NO: 1790889 - protein, 7 aa, Staphylococcus epidermidis
TEYPEDL

SEQ ID NO: 1790890 - protein, 4 aa, Staphylococcus epidermidis
TEYQ

SEQ ID NO: 1790891 - protein, 5 aa, Staphylococcus epidermidis
TFAKS

SEQ ID NO: 1790892 - protein, 26 aa, Staphylococcus epidermidis
TFDEEKVENQGGGTPMGRRGQPAELA

SEQ ID NO: 1790893 - protein, 8 aa, Staphylococcus epidermidis
TFDTNGVG

SEQ ID NO: 1790894 - protein, 7 aa, Staphylococcus epidermidis
TFEERGE

SEQ ID NO: 1790895 - protein, 5 aa, Staphylococcus epidermidis
TFEET

SEQ ID NO: 1790896 - protein, 14 aa, Staphylococcus epidermidis
TFEGPGKSKLTTEF

SEQ ID NO: 1790897 - protein, 12 aa, Staphylococcus epidermidis
TFKEKKSELTDL

SEQ ID NO: 1790898 - protein, 11 aa, Staphylococcus epidermidis
TFKGPKGPTGY

SEQ ID NO: 1790899 - protein, 6 aa, Staphylococcus epidermidis
TFNKDG

SEQ ID NO: 1790900 - protein, 4 aa, Staphylococcus epidermidis
TFNN

SEQ ID NO: 1790901 - protein, 4 aa, Staphylococcus epidermidis
TFPE

SEQ ID NO: 1790902 - protein, 22 aa, Staphylococcus epidermidis
TFREQTQSLRQQPQRTTSINGH

SEQ ID NO: 1790903 - protein, 4 aa, Staphylococcus epidermidis
TFSE

SEQ ID NO: 1790904 - protein, 6 aa, Staphylococcus epidermidis
TFSEEE

SEQ ID NO: 1790905 - protein, 7 aa, Staphylococcus epidermidis
TFSQEEM

SEQ ID NO: 1790906 - protein, 8 aa, Staphylococcus epidermidis
TFSTTSLK

SEQ ID NO: 1790907 - protein, 21 aa, Staphylococcus epidermidis
TFTKGDAERWVSTTKKASDSA

SEQ ID NO: 1790908 - protein, 5 aa, Staphylococcus epidermidis
TGAEE

SEQ ID NO: 1790909 - protein, 5 aa, Staphylococcus epidermidis
TGAEY

SEQ ID NO: 1790910 - protein, 6 aa, Staphylococcus epidermidis
TGAGHN

SEQ ID NO: 1790911 - protein, 10 aa, Staphylococcus epidermidis
TGAQNSESAR

SEQ ID NO: 1790912 - protein, 7 aa, Staphylococcus epidermidis
TGDEHNG

SEQ ID NO: 1790913 - protein, 4 aa, Staphylococcus epidermidis
TGDI

SEQ ID NO: 1790914 - protein, 8 aa, Staphylococcus epidermidis
TGDLQGPF

SEQ ID NO: 1790915 - protein, 8 aa, Staphylococcus epidermidis
TGDNTTEP

SEQ ID NO: 1790916 - protein, 9 aa, Staphylococcus epidermidis
TGDNTTEPI

SEQ ID NO: 1790917 - protein, 19 aa, Staphylococcus epidermidis
TGDQTQIDLPKGVKSGLKE

SEQ ID NO: 1790918 - protein, 7 aa, Staphylococcus epidermidis
TGDTQFD

SEQ ID NO: 1790919 - protein, 8 aa, Staphylococcus epidermidis
TGEDIHPT

SEQ ID NO: 1790920 - protein, 14 aa, Staphylococcus epidermidis
TGEEFVKSSEEMNR

SEQ ID NO: 1790921 - protein, 19 aa, Staphylococcus epidermidis
TGEGKMDKQTIYDKTPIGV

SEQ ID NO: 1790922 - protein, 16 aa, Staphylococcus epidermidis
TGEKYDKVEVVKTEAL

SEQ ID NO: 1790923 - protein, 10 aa, Staphylococcus epidermidis
TGELKPNLSP

SEQ ID NO: 1790924 - protein, 18 aa, Staphylococcus epidermidis
TGESSIANMADEKAGVSA

SEQ ID NO: 1790925 - protein, 5 aa, Staphylococcus epidermidis
TGETE

SEQ ID NO: 1790926 - protein, 6 aa, Staphylococcus epidermidis
TGETSK

SEQ ID NO: 1790927 - protein, 6 aa, Staphylococcus epidermidis
TGETSR

SEQ ID NO: 1790928 - protein, 14 aa, Staphylococcus epidermidis
TGFPASSKEDFIST

SEQ ID NO: 1790929 - protein, 11 aa, Staphylococcus epidermidis
TGGASGLGKAM

SEQ ID NO: 1790930 - protein, 11 aa, Staphylococcus epidermidis
TGGDGSNSFNI

SEQ ID NO: 1790931 - protein, 5 aa, Staphylococcus epidermidis
TGGLH

SEQ ID NO: 1790932 - protein, 12 aa, Staphylococcus epidermidis
TGGLQECGNSQN

SEQ ID NO: 1790933 - protein, 4 aa, Staphylococcus epidermidis
TGGN

SEQ ID NO: 1790934 - protein, 7 aa, Staphylococcus epidermidis
TGGNAGV

SEQ ID NO: 1790935 - protein, 15 aa, Staphylococcus epidermidis
TGGNYDSQLIIPIIP

SEQ ID NO: 1790936 - protein, 27 aa, Staphylococcus epidermidis
TGGQPQSAIPQFGQQTPLGRAGQPVEL

SEQ ID NO: 1790937 - protein, 4 aa, Staphylococcus epidermidis
TGGR

SEQ ID NO: 1790938 - protein, 6 aa, Staphylococcus epidermidis
TGGSAN

SEQ ID NO: 1790939 - protein, 10 aa, Staphylococcus epidermidis
TGGSEWTKQI

SEQ ID NO: 1790940 - protein, 6 aa, Staphylococcus epidermidis
TGHRVN

SEQ ID NO: 1790941 - protein, 11 aa, Staphylococcus epidermidis
TGHSDNSLDGR

SEQ ID NO: 1790942 - protein, 8 aa, Staphylococcus epidermidis
TGHTPGNL

SEQ ID NO: 1790943 - protein, 8 aa, Staphylococcus epidermidis
TGIDEESA

SEQ ID NO: 1790944 - protein, 6 aa, Staphylococcus epidermidis
TGIGRT

SEQ ID NO: 1790945 - protein, 8 aa, Staphylococcus epidermidis
TGIKESKH

SEQ ID NO: 1790946 - protein, 5 aa, Staphylococcus epidermidis
TGIPQ

SEQ ID NO: 1790947 - protein, 5 aa, Staphylococcus epidermidis
TGKDD

SEQ ID NO: 1790948 - protein, 9 aa, Staphylococcus epidermidis
TGKEEESNI

SEQ ID NO: 1790949 - protein, 15 aa, Staphylococcus epidermidis
TGKETKGYKGSTAFT

SEQ ID NO: 1790950 - protein, 15 aa, Staphylococcus epidermidis
TGKHYKHSTGKTKRC

SEQ ID NO: 1790951 - protein, 10 aa, Staphylococcus epidermidis
TGKKSDLAKE

SEQ ID NO: 1790952 - protein, 6 aa, Staphylococcus epidermidis
TGKLED

SEQ ID NO: 1790953 - protein, 10 aa, Staphylococcus epidermidis
TGKNHELQQK

SEQ ID NO: 1790954 - protein, 73 aa, Staphylococcus epidermidis
TGKRHRRRRQAYSKHNQSKITQQKQFADNNYTNNNSVFNQNDNQKSSQQRKSIQSENIKNKANTKNTSTSPGF

SEQ ID NO: 1790955 - protein, 6 aa, Staphylococcus epidermidis
TGKSAS

SEQ ID NO: 1790956 - protein, 7 aa, Staphylococcus epidermidis
TGLPSGL

SEQ ID NO: 1790957 - protein, 12 aa, Staphylococcus epidermidis
TGLSPKVKGQLK

SEQ ID NO: 1790958 - protein, 8 aa, Staphylococcus epidermidis
TGLTEKEA

SEQ ID NO: 1790959 - protein, 4 aa, Staphylococcus epidermidis
TGMG

SEQ ID NO: 1790960 - protein, 16 aa, Staphylococcus epidermidis
TGMIGDPSGKSEERVL

SEQ ID NO: 1790961 - protein, 4 aa, Staphylococcus epidermidis
TGNA

SEQ ID NO: 1790962 - protein, 13 aa, Staphylococcus epidermidis
TGNATYVESEKGS

SEQ ID NO: 1790963 - protein, 9 aa, Staphylococcus epidermidis
TGNDKHINR

SEQ ID NO: 1790964 - protein, 22 aa, Staphylococcus epidermidis
TGNDTRGAEASAHAYASRDGHY

SEQ ID NO: 1790965 - protein, 5 aa, Staphylococcus epidermidis
TGNIN

SEQ ID NO: 1790966 - protein, 13 aa, Staphylococcus epidermidis
TGNPNTTAQDNVN

SEQ ID NO: 1790967 - protein, 6 aa, Staphylococcus epidermidis
TGNQTN

SEQ ID NO: 1790968 - protein, 10 aa, Staphylococcus epidermidis
TGNRRKEALE

SEQ ID NO: 1790969 - protein, 5 aa, Staphylococcus epidermidis
TGNTA

SEQ ID NO: 1790970 - protein, 10 aa, Staphylococcus epidermidis
TGPISKSGMN

SEQ ID NO: 1790971 - protein, 16 aa, Staphylococcus epidermidis
TGPNPHHNSNPSKGGD

SEQ ID NO: 1790972 - protein, 16 aa, Staphylococcus epidermidis
TGPNPHYNSNPSKGGV

SEQ ID NO: 1790973 - protein, 9 aa, Staphylococcus epidermidis
TGPSKGGEV

SEQ ID NO: 1790974 - protein, 4 aa, Staphylococcus epidermidis
TGQA

SEQ ID NO: 1790975 - protein, 5 aa, Staphylococcus epidermidis
TGQLD

SEQ ID NO: 1790976 - protein, 19 aa, Staphylococcus epidermidis
TGQNPQSPSQVGEAVRKQL

SEQ ID NO: 1790977 - protein, 19 aa, Staphylococcus epidermidis
TGQNPQSSEVIGKALVNAL

SEQ ID NO: 1790978 - protein, 8 aa, Staphylococcus epidermidis
TGQNVRSN

SEQ ID NO: 1790979 - protein, 12 aa, Staphylococcus epidermidis
TGQSSTGKSTAA

SEQ ID NO: 1790980 - protein, 10 aa, Staphylococcus epidermidis
TGQTLSGITS

SEQ ID NO: 1790981 - protein, 4 aa, Staphylococcus epidermidis
TGQW

SEQ ID NO: 1790982 - protein, 5 aa, Staphylococcus epidermidis
TGQWD

SEQ ID NO: 1790983 - protein, 13 aa, Staphylococcus epidermidis
TGRELAEKGPFKT

SEQ ID NO: 1790984 - protein, 7 aa, Staphylococcus epidermidis
TGRKDDH

SEQ ID NO: 1790985 - protein, 11 aa, Staphylococcus epidermidis
TGRKPNTDSLN

SEQ ID NO: 1790986 - protein, 11 aa, Staphylococcus epidermidis
TGRKPNTETLN

SEQ ID NO: 1790987 - protein, 23 aa, Staphylococcus epidermidis
TGRKTIEADDPLYTTRVPDGKNP

SEQ ID NO: 1790988 - protein, 4 aa, Staphylococcus epidermidis
TGRL

SEQ ID NO: 1790989 - protein, 15 aa, Staphylococcus epidermidis
TGRLEEAAKTGEKNQ

SEQ ID NO: 1790990 - protein, 4 aa, Staphylococcus epidermidis
TGRT

SEQ ID NO: 1790991 - protein, 11 aa, Staphylococcus epidermidis
TGSAGALDESL

SEQ ID NO: 1790992 - protein, 13 aa, Staphylococcus epidermidis
TGSGISPRPIPGV

SEQ ID NO: 1790993 - protein, 5 aa, Staphylococcus epidermidis
TGSIT

SEQ ID NO: 1790994 - protein, 4 aa, Staphylococcus epidermidis
TGSN

SEQ ID NO: 1790995 - protein, 18 aa, Staphylococcus epidermidis
TGSNLGKTNSKWVFNYIY

SEQ ID NO: 1790996 - protein, 7 aa, Staphylococcus epidermidis
TGSNTVS

SEQ ID NO: 1790997 - protein, 9 aa, Staphylococcus epidermidis
TGSRANIPD

SEQ ID NO: 1790998 - protein, 17 aa, Staphylococcus epidermidis
TGSSPKEIPQLNSEEYN

SEQ ID NO: 1790999 - protein, 10 aa, Staphylococcus epidermidis
TGSSSDPASF

SEQ ID NO: 1791000 - protein, 8 aa, Staphylococcus epidermidis
TGSTPKSL

SEQ ID NO: 1791001 - protein, 7 aa, Staphylococcus epidermidis
TGSTQVG

SEQ ID NO: 1791002 - protein, 8 aa, Staphylococcus epidermidis
TGTAYQSA

SEQ ID NO: 1791003 - protein, 5 aa, Staphylococcus epidermidis
TGTDW

SEQ ID NO: 1791004 - protein, 9 aa, Staphylococcus epidermidis
TGTGKQIDP

SEQ ID NO: 1791005 - protein, 6 aa, Staphylococcus epidermidis
TGTPLH

SEQ ID NO: 1791006 - protein, 13 aa, Staphylococcus epidermidis
TGTQLKEIEDELN

SEQ ID NO: 1791007 - protein, 9 aa, Staphylococcus epidermidis
TGTQSKLSG

SEQ ID NO: 1791008 - protein, 7 aa, Staphylococcus epidermidis
TGTSDFR

SEQ ID NO: 1791009 - protein, 9 aa, Staphylococcus epidermidis
TGTTLKANG

SEQ ID NO: 1791010 - protein, 8 aa, Staphylococcus epidermidis
TGTTQTVT

SEQ ID NO: 1791011 - protein, 8 aa, Staphylococcus epidermidis
TGTYSNKP

SEQ ID NO: 1791012 - protein, 4 aa, Staphylococcus epidermidis
TGVD

SEQ ID NO: 1791013 - protein, 8 aa, Staphylococcus epidermidis
TGVEHTTL

SEQ ID NO: 1791014 - protein, 8 aa, Staphylococcus epidermidis
TGVGKTEL

SEQ ID NO: 1791015 - protein, 10 aa, Staphylococcus epidermidis
TGVGKTELAK

SEQ ID NO: 1791016 - protein, 6 aa, Staphylococcus epidermidis
TGVNPK

SEQ ID NO: 1791017 - protein, 7 aa, Staphylococcus epidermidis
TGVPTLE

SEQ ID NO: 1791018 - protein, 5 aa, Staphylococcus epidermidis
TGYAM

SEQ ID NO: 1791019 - protein, 4 aa, Staphylococcus epidermidis
TGYK

SEQ ID NO: 1791020 - protein, 10 aa, Staphylococcus epidermidis
TGYKSKSKGI

SEQ ID NO: 1791021 - protein, 5 aa, Staphylococcus epidermidis
TGYNH

SEQ ID NO: 1791022 - protein, 8 aa, Staphylococcus epidermidis
TGYNRETV

SEQ ID NO: 1791023 - protein, 6 aa, Staphylococcus epidermidis
THATSD

SEQ ID NO: 1791024 - protein, 9 aa, Staphylococcus epidermidis
THATSREAF

SEQ ID NO: 1791025 - protein, 14 aa, Staphylococcus epidermidis
THDKTTASNELDGL

SEQ ID NO: 1791026 - protein, 7 aa, Staphylococcus epidermidis
THDLTED

SEQ ID NO: 1791027 - protein, 4 aa, Staphylococcus epidermidis
THDN

SEQ ID NO: 1791028 - protein, 24 aa, Staphylococcus epidermidis
THDPELNKANIEQATQAVQQAEQA

SEQ ID NO: 1791029 - protein, 21 aa, Staphylococcus epidermidis
THEDTIDDEAKKEIAKQIQAQ

SEQ ID NO: 1791030 - protein, 4 aa, Staphylococcus epidermidis
THER

SEQ ID NO: 1791031 - protein, 6 aa, Staphylococcus epidermidis
THFDGQ

SEQ ID NO: 1791032 - protein, 13 aa, Staphylococcus epidermidis
THFDNETFSENQL

SEQ ID NO: 1791033 - protein, 6 aa, Staphylococcus epidermidis
THGEDI

SEQ ID NO: 1791034 - protein, 10 aa, Staphylococcus epidermidis
THGNTETYPQ

SEQ ID NO: 1791035 - protein, 5 aa, Staphylococcus epidermidis
THGPI

SEQ ID NO: 1791036 - protein, 5 aa, Staphylococcus epidermidis
THHSV

SEQ ID NO: 1791037 - protein, 26 aa, Staphylococcus epidermidis
THKQQAGFSQASQIHKKDKHIKGQKR

SEQ ID NO: 1791038 - protein, 9 aa, Staphylococcus epidermidis
THNAKQEDP

SEQ ID NO: 1791039 - protein, 7 aa, Staphylococcus epidermidis
THNAKSV

SEQ ID NO: 1791040 - protein, 19 aa, Staphylococcus epidermidis
THNYNSARERALSNNHIPE

SEQ ID NO: 1791041 - protein, 6 aa, Staphylococcus epidermidis
THPDFK

SEQ ID NO: 1791042 - protein, 14 aa, Staphylococcus epidermidis
THPGSPNGEFTKET

SEQ ID NO: 1791043 - protein, 19 aa, Staphylococcus epidermidis
THPHYKPSKYLKAVFVTIK

SEQ ID NO: 1791044 - protein, 8 aa, Staphylococcus epidermidis
THQGSGGI

SEQ ID NO: 1791045 - protein, 12 aa, Staphylococcus epidermidis
THSEDELKSEDP

SEQ ID NO: 1791046 - protein, 11 aa, Staphylococcus epidermidis
THSLPNGYSGF

SEQ ID NO: 1791047 - protein, 6 aa, Staphylococcus epidermidis
THSPHT

SEQ ID NO: 1791048 - protein, 12 aa, Staphylococcus epidermidis
THSVGHSERTGA

SEQ ID NO: 1791049 - protein, 14 aa, Staphylococcus epidermidis
THTGQGAIGLIVLR

SEQ ID NO: 1791050 - protein, 12 aa, Staphylococcus epidermidis
THTSSGRTPSEL

SEQ ID NO: 1791051 - protein, 10 aa, Staphylococcus epidermidis
THYARPEDRD

SEQ ID NO: 1791052 - protein, 7 aa, Staphylococcus epidermidis
THYDDPT

SEQ ID NO: 1791053 - protein, 7 aa, Staphylococcus epidermidis
THYDNQQ

SEQ ID NO: 1791054 - protein, 5 aa, Staphylococcus epidermidis
THYEG

SEQ ID NO: 1791055 - protein, 4 aa, Staphylococcus epidermidis
THYQ

SEQ ID NO: 1791056 - protein, 10 aa, Staphylococcus epidermidis
TIAQRGRATG

SEQ ID NO: 1791057 - protein, 11 aa, Staphylococcus epidermidis
TIDEVNTKAFE

SEQ ID NO: 1791058 - protein, 12 aa, Staphylococcus epidermidis
TIDRTSNGKGKV

SEQ ID NO: 1791059 - protein, 8 aa, Staphylococcus epidermidis
TIDSDRGI

SEQ ID NO: 1791060 - protein, 17 aa, Staphylococcus epidermidis
TIDYSKTEIQPGDDVGR

SEQ ID NO: 1791061 - protein, 9 aa, Staphylococcus epidermidis
TIEDSPDLD

SEQ ID NO: 1791062 - protein, 13 aa, Staphylococcus epidermidis
TIEESKHPNFNKG

SEQ ID NO: 1791063 - protein, 5 aa, Staphylococcus epidermidis
TIEPG

SEQ ID NO: 1791064 - protein, 11 aa, Staphylococcus epidermidis
TIERNESQLQE

SEQ ID NO: 1791065 - protein, 6 aa, Staphylococcus epidermidis
TIESHR

SEQ ID NO: 1791066 - protein, 16 aa, Staphylococcus epidermidis
TIESTDASGNKTTTKI

SEQ ID NO: 1791067 - protein, 11 aa, Staphylococcus epidermidis
TIETNESFDSM

SEQ ID NO: 1791068 - protein, 12 aa, Staphylococcus epidermidis
TIETNGSAINQE

SEQ ID NO: 1791069 - protein, 14 aa, Staphylococcus epidermidis
TIHTPDGGRSLEGS

SEQ ID NO: 1791070 - protein, 8 aa, Staphylococcus epidermidis
TIKENANH

SEQ ID NO: 1791071 - protein, 10 aa, Staphylococcus epidermidis
TIKEVKDKQR

SEQ ID NO: 1791072 - protein, 11 aa, Staphylococcus epidermidis
TILPDDHPYSI

SEQ ID NO: 1791073 - protein, 10 aa, Staphylococcus epidermidis
TILSGTDPIL

SEQ ID NO: 1791074 - protein, 27 aa, Staphylococcus epidermidis
TINEKDGKVGSVTLESTKDGSEQTYDA

SEQ ID NO: 1791075 - protein, 7 aa, Staphylococcus epidermidis
TINEQKK

SEQ ID NO: 1791076 - protein, 15 aa, Staphylococcus epidermidis
TINESCNNARKNYHS

SEQ ID NO: 1791077 - protein, 11 aa, Staphylococcus epidermidis
TINKPDKPSMS

SEQ ID NO: 1791078 - protein, 5 aa, Staphylococcus epidermidis
TINNY

SEQ ID NO: 1791079 - protein, 9 aa, Staphylococcus epidermidis
TINPNKDVD

SEQ ID NO: 1791080 - protein, 11 aa, Staphylococcus epidermidis
TINSRQDDKER

SEQ ID NO: 1791081 - protein, 12 aa, Staphylococcus epidermidis
TINTDHTSKQGL

SEQ ID NO: 1791082 - protein, 19 aa, Staphylococcus epidermidis
TIPEKDNNDQAGMGGMPGM

SEQ ID NO: 1791083 - protein, 17 aa, Staphylococcus epidermidis
TIPTDISETIDKIRHNI

SEQ ID NO: 1791084 - protein, 13 aa, Staphylococcus epidermidis
TISSSMAQQAGGY

SEQ ID NO: 1791085 - protein, 15 aa, Staphylococcus epidermidis
TITEDLTKEELQAKS

SEQ ID NO: 1791086 - protein, 12 aa, Staphylococcus epidermidis
TITEPGTKRTDT

SEQ ID NO: 1791087 - protein, 9 aa, Staphylococcus epidermidis
TITKEEKIR

SEQ ID NO: 1791088 - protein, 17 aa, Staphylococcus epidermidis
TITNDEISGFGAIVIET

SEQ ID NO: 1791089 - protein, 4 aa, Staphylococcus epidermidis
TITQ

SEQ ID NO: 1791090 - protein, 5 aa, Staphylococcus epidermidis
TITQQ

SEQ ID NO: 1791091 - protein, 8 aa, Staphylococcus epidermidis
TITQRKAG

SEQ ID NO: 1791092 - protein, 11 aa, Staphylococcus epidermidis
TITTEDGKEIR

SEQ ID NO: 1791093 - protein, 11 aa, Staphylococcus epidermidis
TITTENGKEIR

SEQ ID NO: 1791094 - protein, 29 aa, Staphylococcus epidermidis
TITTPTTKNPLTGEKVGEGEPTENNKTTS

SEQ ID NO: 1791095 - protein, 6 aa, Staphylococcus epidermidis
TITTTK

SEQ ID NO: 1791096 - protein, 45 aa, Staphylococcus epidermidis
TITTTTTKTTIKIKPKTSVDNPEQNDKPTDKKSKTTNRTSNKPRV

SEQ ID NO: 1791097 - protein, 8 aa, Staphylococcus epidermidis
TITYGNKD

SEQ ID NO: 1791098 - protein, 19 aa, Staphylococcus epidermidis
TIVSKTKARMVKPKPIKNV

SEQ ID NO: 1791099 - protein, 6 aa, Staphylococcus epidermidis
TKAHKT

SEQ ID NO: 1791100 - protein, 7 aa, Staphylococcus epidermidis
TKAKAED

SEQ ID NO: 1791101 - protein, 18 aa, Staphylococcus epidermidis
TKAKNKVTDQPVGTGPYK

SEQ ID NO: 1791102 - protein, 10 aa, Staphylococcus epidermidis
TKANDVTNEF

SEQ ID NO: 1791103 - protein, 8 aa, Staphylococcus epidermidis
TKAPSSVN

SEQ ID NO: 1791104 - protein, 14 aa, Staphylococcus epidermidis
TKARKDNKTISRDA

SEQ ID NO: 1791105 - protein, 9 aa, Staphylococcus epidermidis
TKASNFAPT

SEQ ID NO: 1791106 - protein, 9 aa, Staphylococcus epidermidis
TKAYDDEYK

SEQ ID NO: 1791107 - protein, 8 aa, Staphylococcus epidermidis
TKAYEDKL

SEQ ID NO: 1791108 - protein, 27 aa, Staphylococcus epidermidis
TKAYEIQRSKRQLSNNEIRDNLMRLYL

SEQ ID NO: 1791109 - protein, 7 aa, Staphylococcus epidermidis
TKAYYKN

SEQ ID NO: 1791110 - protein, 13 aa, Staphylococcus epidermidis
TKCKYSGNSAKEI

SEQ ID NO: 1791111 - protein, 7 aa, Staphylococcus epidermidis
TKDDFDE

SEQ ID NO: 1791112 - protein, 7 aa, Staphylococcus epidermidis
TKDENEY

SEQ ID NO: 1791113 - protein, 11 aa, Staphylococcus epidermidis
TKDIKQVQERL

SEQ ID NO: 1791114 - protein, 17 aa, Staphylococcus epidermidis
TKDNAQNNTDWSNKEYD

SEQ ID NO: 1791115 - protein, 7 aa, Staphylococcus epidermidis
TKDREKL

SEQ ID NO: 1791116 - protein, 4 aa, Staphylococcus epidermidis
TKDT

SEQ ID NO: 1791117 - protein, 8 aa, Staphylococcus epidermidis
TKDTKQDF

SEQ ID NO: 1791118 - protein, 4 aa, Staphylococcus epidermidis
TKDV

SEQ ID NO: 1791119 - protein, 20 aa, Staphylococcus epidermidis
TKDVPEDSIVGGNPAKHIRD

SEQ ID NO: 1791120 - protein, 7 aa, Staphylococcus epidermidis
TKEAPAY

SEQ ID NO: 1791121 - protein, 8 aa, Staphylococcus epidermidis
TKEDIEKT

SEQ ID NO: 1791122 - protein, 5 aa, Staphylococcus epidermidis
TKEEA

SEQ ID NO: 1791123 - protein, 17 aa, Staphylococcus epidermidis
TKEEAAQHFRDQDEATH

SEQ ID NO: 1791124 - protein, 6 aa, Staphylococcus epidermidis
TKEEIA

SEQ ID NO: 1791125 - protein, 16 aa, Staphylococcus epidermidis
TKEEQAKKLKTAGVDR

SEQ ID NO: 1791126 - protein, 6 aa, Staphylococcus epidermidis
TKEEYE

SEQ ID NO: 1791127 - protein, 10 aa, Staphylococcus epidermidis
TKEEYNKRPL

SEQ ID NO: 1791128 - protein, 7 aa, Staphylococcus epidermidis
TKEFDVP

SEQ ID NO: 1791129 - protein, 6 aa, Staphylococcus epidermidis
TKEGPK

SEQ ID NO: 1791130 - protein, 10 aa, Staphylococcus epidermidis
TKEGQDGSVD

SEQ ID NO: 1791131 - protein, 8 aa, Staphylococcus epidermidis
TKEIGKSI

SEQ ID NO: 1791132 - protein, 10 aa, Staphylococcus epidermidis
TKEKHPDADK

SEQ ID NO: 1791133 - protein, 6 aa, Staphylococcus epidermidis
TKESRK

SEQ ID NO: 1791134 - protein, 13 aa, Staphylococcus epidermidis
TKEVSIKKAEGKV

SEQ ID NO: 1791135 - protein, 15 aa, Staphylococcus epidermidis
TKGAISKNTSRVADE

SEQ ID NO: 1791136 - protein, 11 aa, Staphylococcus epidermidis
TKGDIPDYQAS

SEQ ID NO: 1791137 - protein, 9 aa, Staphylococcus epidermidis
TKGGLDGKI

SEQ ID NO: 1791138 - protein, 10 aa, Staphylococcus epidermidis
TKGKEVERDG

SEQ ID NO: 1791139 - protein, 5 aa, Staphylococcus epidermidis
TKGNN

SEQ ID NO: 1791140 - protein, 4 aa, Staphylococcus epidermidis
TKGP

SEQ ID NO: 1791141 - protein, 6 aa, Staphylococcus epidermidis
TKGQGW

SEQ ID NO: 1791142 - protein, 11 aa, Staphylococcus epidermidis
TKGQTSPSSAV

SEQ ID NO: 1791143 - protein, 7 aa, Staphylococcus epidermidis
TKGSSFD

SEQ ID NO: 1791144 - protein, 14 aa, Staphylococcus epidermidis
TKGTADKLKSNDIP

SEQ ID NO: 1791145 - protein, 26 aa, Staphylococcus epidermidis
TKHNDNLETTYEQTQQKEKTFSQEEV

SEQ ID NO: 1791146 - protein, 9 aa, Staphylococcus epidermidis
TKHPNNNLN

SEQ ID NO: 1791147 - protein, 4 aa, Staphylococcus epidermidis
TKIG

SEQ ID NO: 1791148 - protein, 9 aa, Staphylococcus epidermidis
TKIKTNEAG

SEQ ID NO: 1791149 - protein, 18 aa, Staphylococcus epidermidis
TKIKVSNNLDGVKLVILR

SEQ ID NO: 1791150 - protein, 8 aa, Staphylococcus epidermidis
TKITPSAK

SEQ ID NO: 1791151 - protein, 9 aa, Staphylococcus epidermidis
TKKAEVGSE

SEQ ID NO: 1791152 - protein, 6 aa, Staphylococcus epidermidis
TKKAPK

SEQ ID NO: 1791153 - protein, 7 aa, Staphylococcus epidermidis
TKKDAAT

SEQ ID NO: 1791154 - protein, 8 aa, Staphylococcus epidermidis
TKKDASSY

SEQ ID NO: 1791155 - protein, 8 aa, Staphylococcus epidermidis
TKKDIKDT

SEQ ID NO: 1791156 - protein, 15 aa, Staphylococcus epidermidis
TKKEKTTHNKESVKN

SEQ ID NO: 1791157 - protein, 15 aa, Staphylococcus epidermidis
TKKERTTQNKESVKK

SEQ ID NO: 1791158 - protein, 5 aa, Staphylococcus epidermidis
TKKGL

SEQ ID NO: 1791159 - protein, 9 aa, Staphylococcus epidermidis
TKKIIGNDD

SEQ ID NO: 1791160 - protein, 7 aa, Staphylococcus epidermidis
TKKPLTI

SEQ ID NO: 1791161 - protein, 7 aa, Staphylococcus epidermidis
TKKSMSH

SEQ ID NO: 1791162 - protein, 6 aa, Staphylococcus epidermidis
TKKTKT

SEQ ID NO: 1791163 - protein, 8 aa, Staphylococcus epidermidis
TKLEYKSK

SEQ ID NO: 1791164 - protein, 13 aa, Staphylococcus epidermidis
TKLKHDEKNRYKD

SEQ ID NO: 1791165 - protein, 28 aa, Staphylococcus epidermidis
TKLNAKANTQTAGSLALSGKASKGASGW

SEQ ID NO: 1791166 - protein, 28 aa, Staphylococcus epidermidis
TKLNGKELEVDTTEIENAPLPNNKVESL

SEQ ID NO: 1791167 - protein, 13 aa, Staphylococcus epidermidis
TKLSGTAEKPRLN

SEQ ID NO: 1791168 - protein, 5 aa, Staphylococcus epidermidis
TKNGS

SEQ ID NO: 1791169 - protein, 13 aa, Staphylococcus epidermidis
TKNGTDNKEPSIL

SEQ ID NO: 1791170 - protein, 7 aa, Staphylococcus epidermidis
TKNHIKT

SEQ ID NO: 1791171 - protein, 10 aa, Staphylococcus epidermidis
TKNKSAPRYV

SEQ ID NO: 1791172 - protein, 7 aa, Staphylococcus epidermidis
TKNNLSK

SEQ ID NO: 1791173 - protein, 14 aa, Staphylococcus epidermidis
TKNPKYNKTKRKIK

SEQ ID NO: 1791174 - protein, 8 aa, Staphylococcus epidermidis
TKNTEPNS

SEQ ID NO: 1791175 - protein, 6 aa, Staphylococcus epidermidis
TKPCDN

SEQ ID NO: 1791176 - protein, 7 aa, Staphylococcus epidermidis
TKPCENE

SEQ ID NO: 1791177 - protein, 8 aa, Staphylococcus epidermidis
TKPERQEL

SEQ ID NO: 1791178 - protein, 10 aa, Staphylococcus epidermidis
TKPFDSKELT

SEQ ID NO: 1791179 - protein, 9 aa, Staphylococcus epidermidis
TKPGVSKTS

SEQ ID NO: 1791180 - protein, 7 aa, Staphylococcus epidermidis
TKPIDEN

SEQ ID NO: 1791181 - protein, 5 aa, Staphylococcus epidermidis
TKPKR

SEQ ID NO: 1791182 - protein, 9 aa, Staphylococcus epidermidis
TKPTAQELN

SEQ ID NO: 1791183 - protein, 8 aa, Staphylococcus epidermidis
TKQDITDT

SEQ ID NO: 1791184 - protein, 4 aa, Staphylococcus epidermidis
TKQE

SEQ ID NO: 1791185 - protein, 8 aa, Staphylococcus epidermidis
TKQKELSP

SEQ ID NO: 1791186 - protein, 24 aa, Staphylococcus epidermidis
TKQKKQRKRTKTLSNAEKIKSYQD

SEQ ID NO: 1791187 - protein, 10 aa, Staphylococcus epidermidis
TKQRRSAAFP

SEQ ID NO: 1791188 - protein, 4 aa, Staphylococcus epidermidis
TKQS

SEQ ID NO: 1791189 - protein, 18 aa, Staphylococcus epidermidis
TKRDAETVNPKIKTGQVE

SEQ ID NO: 1791190 - protein, 7 aa, Staphylococcus epidermidis
TKRESYE

SEQ ID NO: 1791191 - protein, 19 aa, Staphylococcus epidermidis
TKRGGTTVTTGLPNPKDNF

SEQ ID NO: 1791192 - protein, 4 aa, Staphylococcus epidermidis
TKRN

SEQ ID NO: 1791193 - protein, 8 aa, Staphylococcus epidermidis
TKRQAGKE

SEQ ID NO: 1791194 - protein, 7 aa, Staphylococcus epidermidis
TKRYTQT

SEQ ID NO: 1791195 - protein, 6 aa, Staphylococcus epidermidis
TKSGTF

SEQ ID NO: 1791196 - protein, 9 aa, Staphylococcus epidermidis
TKSGTSYSW

SEQ ID NO: 1791197 - protein, 12 aa, Staphylococcus epidermidis
TKSGVRRNDGSY

SEQ ID NO: 1791198 - protein, 7 aa, Staphylococcus epidermidis
TKSGYAY

SEQ ID NO: 1791199 - protein, 4 aa, Staphylococcus epidermidis
TKSI

SEQ ID NO: 1791200 - protein, 10 aa, Staphylococcus epidermidis
TKSIKGESLD

SEQ ID NO: 1791201 - protein, 4 aa, Staphylococcus epidermidis
TKSL

SEQ ID NO: 1791202 - protein, 7 aa, Staphylococcus epidermidis
TKSLREN

SEQ ID NO: 1791203 - protein, 26 aa, Staphylococcus epidermidis
TKSNTNLENNDEQAQQNEKTFSQEEV

SEQ ID NO: 1791204 - protein, 9 aa, Staphylococcus epidermidis
TKSPDVYPG

SEQ ID NO: 1791205 - protein, 8 aa, Staphylococcus epidermidis
TKSPEAHN

SEQ ID NO: 1791206 - protein, 8 aa, Staphylococcus epidermidis
TKSRDNIS

SEQ ID NO: 1791207 - protein, 8 aa, Staphylococcus epidermidis
TKSRQNIQ

SEQ ID NO: 1791208 - protein, 17 aa, Staphylococcus epidermidis
TKSSDIKGNSEKHIGTI

SEQ ID NO: 1791209 - protein, 6 aa, Staphylococcus epidermidis
TKSYQT

SEQ ID NO: 1791210 - protein, 6 aa, Staphylococcus epidermidis
TKTAED

SEQ ID NO: 1791211 - protein, 11 aa, Staphylococcus epidermidis
TKTANQADNVS

SEQ ID NO: 1791212 - protein, 5 aa, Staphylococcus epidermidis
TKTDD

SEQ ID NO: 1791213 - protein, 8 aa, Staphylococcus epidermidis
TKTDNDAF

SEQ ID NO: 1791214 - protein, 12 aa, Staphylococcus epidermidis
TKTGQANQATRA

SEQ ID NO: 1791215 - protein, 4 aa, Staphylococcus epidermidis
TKTS

SEQ ID NO: 1791216 - protein, 12 aa, Staphylococcus epidermidis
TKTTPKGNIEKN

SEQ ID NO: 1791217 - protein, 5 aa, Staphylococcus epidermidis
TKVER

SEQ ID NO: 1791218 - protein, 4 aa, Staphylococcus epidermidis
TKVI

SEQ ID NO: 1791219 - protein, 20 aa, Staphylococcus epidermidis
TKVREKLRNGESLPPEFSRP

SEQ ID NO: 1791220 - protein, 12 aa, Staphylococcus epidermidis
TKVTEGEAGGIT

SEQ ID NO: 1791221 - protein, 7 aa, Staphylococcus epidermidis
TKWSEDQ

SEQ ID NO: 1791222 - protein, 9 aa, Staphylococcus epidermidis
TKYEGKNDV

SEQ ID NO: 1791223 - protein, 19 aa, Staphylococcus epidermidis
TKYGPVDGDPITSTEEIPF

SEQ ID NO: 1791224 - protein, 11 aa, Staphylococcus epidermidis
TKYKKGIGKND

SEQ ID NO: 1791225 - protein, 16 aa, Staphylococcus epidermidis
TKYPYDSSNPEDVKAA

SEQ ID NO: 1791226 - protein, 6 aa, Staphylococcus epidermidis
TKYSEA

SEQ ID NO: 1791227 - protein, 6 aa, Staphylococcus epidermidis
TKYYGD

SEQ ID NO: 1791228 - protein, 6 aa, Staphylococcus epidermidis
TLANAS

SEQ ID NO: 1791229 - protein, 9 aa, Staphylococcus epidermidis
TLANTDSYH

SEQ ID NO: 1791230 - protein, 7 aa, Staphylococcus epidermidis
TLDDEDK

SEQ ID NO: 1791231 - protein, 5 aa, Staphylococcus epidermidis
TLDEI

SEQ ID NO: 1791232 - protein, 10 aa, Staphylococcus epidermidis
TLDTDATDTL

SEQ ID NO: 1791233 - protein, 7 aa, Staphylococcus epidermidis
TLEESES

SEQ ID NO: 1791234 - protein, 12 aa, Staphylococcus epidermidis
TLEETYESIKHL

SEQ ID NO: 1791235 - protein, 4 aa, Staphylococcus epidermidis
TLEI

SEQ ID NO: 1791236 - protein, 14 aa, Staphylococcus epidermidis
TLEKKDKKLSADIQ

SEQ ID NO: 1791237 - protein, 17 aa, Staphylococcus epidermidis
TLEQKEHGYSIEEQERK

SEQ ID NO: 1791238 - protein, 6 aa, Staphylococcus epidermidis
TLETGS

SEQ ID NO: 1791239 - protein, 9 aa, Staphylococcus epidermidis
TLGKTEEEI

SEQ ID NO: 1791240 - protein, 9 aa, Staphylococcus epidermidis
TLGNTENNT

SEQ ID NO: 1791241 - protein, 9 aa, Staphylococcus epidermidis
TLKDGNGRY

SEQ ID NO: 1791242 - protein, 30 aa, Staphylococcus epidermidis
TLKEQGIKANKVNKQPKKPTRTIQRSKNAF

SEQ ID NO: 1791243 - protein, 10 aa, Staphylococcus epidermidis
TLKGQGPDDL

SEQ ID NO: 1791244 - protein, 8 aa, Staphylococcus epidermidis
TLKMNEEE

SEQ ID NO: 1791245 - protein, 10 aa, Staphylococcus epidermidis
TLKQQSLATQ

SEQ ID NO: 1791246 - protein, 6 aa, Staphylococcus epidermidis
TLKTND

SEQ ID NO: 1791247 - protein, 12 aa, Staphylococcus epidermidis
TLNDKENRRDDM

SEQ ID NO: 1791248 - protein, 10 aa, Staphylococcus epidermidis
TLNDTNQGVS

SEQ ID NO: 1791249 - protein, 4 aa, Staphylococcus epidermidis
TLNI

SEQ ID NO: 1791250 - protein, 8 aa, Staphylococcus epidermidis
TLNQDKDG

SEQ ID NO: 1791251 - protein, 6 aa, Staphylococcus epidermidis
TLNRAN

SEQ ID NO: 1791252 - protein, 4 aa, Staphylococcus epidermidis
TLNT

SEQ ID NO: 1791253 - protein, 5 aa, Staphylococcus epidermidis
TLPDA

SEQ ID NO: 1791254 - protein, 9 aa, Staphylococcus epidermidis
TLPDPKEVE

SEQ ID NO: 1791255 - protein, 4 aa, Staphylococcus epidermidis
TLPE

SEQ ID NO: 1791256 - protein, 6 aa, Staphylococcus epidermidis
TLPEAY

SEQ ID NO: 1791257 - protein, 7 aa, Staphylococcus epidermidis
TLPERAR

SEQ ID NO: 1791258 - protein, 4 aa, Staphylococcus epidermidis
TLPH

SEQ ID NO: 1791259 - protein, 9 aa, Staphylococcus epidermidis
TLPNPKEVE

SEQ ID NO: 1791260 - protein, 9 aa, Staphylococcus epidermidis
TLPTNGERA

SEQ ID NO: 1791261 - protein, 12 aa, Staphylococcus epidermidis
TLPTSNKVSHEL

SEQ ID NO: 1791262 - protein, 10 aa, Staphylococcus epidermidis
TLQDDTAEKI

SEQ ID NO: 1791263 - protein, 7 aa, Staphylococcus epidermidis
TLQGNLD

SEQ ID NO: 1791264 - protein, 8 aa, Staphylococcus epidermidis
TLQQNAKD

SEQ ID NO: 1791265 - protein, 6 aa, Staphylococcus epidermidis
TLQTQS

SEQ ID NO: 1791266 - protein, 25 aa, Staphylococcus epidermidis
TLREASQNIQRTFTPNHQVTHQKIV

SEQ ID NO: 1791267 - protein, 7 aa, Staphylococcus epidermidis
TLRESGI

SEQ ID NO: 1791268 - protein, 4 aa, Staphylococcus epidermidis
TLRP

SEQ ID NO: 1791269 - protein, 10 aa, Staphylococcus epidermidis
TLSDSERETF

SEQ ID NO: 1791270 - protein, 6 aa, Staphylococcus epidermidis
TLSGGQ

SEQ ID NO: 1791271 - protein, 13 aa, Staphylococcus epidermidis
TLSGSSRSTKREF

SEQ ID NO: 1791272 - protein, 6 aa, Staphylococcus epidermidis
TLSKQA

SEQ ID NO: 1791273 - protein, 9 aa, Staphylococcus epidermidis
TLSKSRDTF

SEQ ID NO: 1791274 - protein, 12 aa, Staphylococcus epidermidis
TLSNKDITEELE

SEQ ID NO: 1791275 - protein, 8 aa, Staphylococcus epidermidis
TLSQSAED

SEQ ID NO: 1791276 - protein, 4 aa, Staphylococcus epidermidis
TLSS

SEQ ID NO: 1791277 - protein, 8 aa, Staphylococcus epidermidis
TLSSETTN

SEQ ID NO: 1791278 - protein, 5 aa, Staphylococcus epidermidis
TLTCT

SEQ ID NO: 1791279 - protein, 4 aa, Staphylococcus epidermidis
TLTE

SEQ ID NO: 1791280 - protein, 14 aa, Staphylococcus epidermidis
TLTEADRKRYQSQI

SEQ ID NO: 1791281 - protein, 7 aa, Staphylococcus epidermidis
TLTGSNG

SEQ ID NO: 1791282 - protein, 9 aa, Staphylococcus epidermidis
TLTKTEVKQ

SEQ ID NO: 1791283 - protein, 18 aa, Staphylococcus epidermidis
TLTPAGATVVPSGFNKSG

SEQ ID NO: 1791284 - protein, 13 aa, Staphylococcus epidermidis
TLTPAQQKKINDN

SEQ ID NO: 1791285 - protein, 19 aa, Staphylococcus epidermidis
TLTSGSYVKNSTKDKRERV

SEQ ID NO: 1791286 - protein, 10 aa, Staphylococcus epidermidis
TLTSQGATKI

SEQ ID NO: 1791287 - protein, 6 aa, Staphylococcus epidermidis
TLTTNQ

SEQ ID NO: 1791288 - protein, 16 aa, Staphylococcus epidermidis
TLYATPDYDKIQQMKE

SEQ ID NO: 1791289 - protein, 5 aa, Staphylococcus epidermidis
TMDQG

SEQ ID NO: 1791290 - protein, 11 aa, Staphylococcus epidermidis
TMDQQAHPGHN

SEQ ID NO: 1791291 - protein, 11 aa, Staphylococcus epidermidis
TMIGTDEQEIN

SEQ ID NO: 1791292 - protein, 11 aa, Staphylococcus epidermidis
TMKRDAQQNIR

SEQ ID NO: 1791293 - protein, 7 aa, Staphylococcus epidermidis
TMNENDS

SEQ ID NO: 1791294 - protein, 4 aa, Staphylococcus epidermidis
TMPE

SEQ ID NO: 1791295 - protein, 4 aa, Staphylococcus epidermidis
TMPN

SEQ ID NO: 1791296 - protein, 18 aa, Staphylococcus epidermidis
TMPNNYKQPQRVERVAFN

SEQ ID NO: 1791297 - protein, 8 aa, Staphylococcus epidermidis
TMPQRDKG

SEQ ID NO: 1791298 - protein, 9 aa, Staphylococcus epidermidis
TMQDKDYRD

SEQ ID NO: 1791299 - protein, 12 aa, Staphylococcus epidermidis
TMRGDSNGRASF

SEQ ID NO: 1791300 - protein, 4 aa, Staphylococcus epidermidis
TMTA

SEQ ID NO: 1791301 - protein, 14 aa, Staphylococcus epidermidis
TMTKQGQISEEAAS

SEQ ID NO: 1791302 - protein, 12 aa, Staphylococcus epidermidis
TMTPRKPNSALR

SEQ ID NO: 1791303 - protein, 14 aa, Staphylococcus epidermidis
TNAFSSGNNVTTGV

SEQ ID NO: 1791304 - protein, 10 aa, Staphylococcus epidermidis
TNAHHPEKDT

SEQ ID NO: 1791305 - protein, 9 aa, Staphylococcus epidermidis
TNAKDPQKR

SEQ ID NO: 1791306 - protein, 13 aa, Staphylococcus epidermidis
TNAYDSSKMVPTQ

SEQ ID NO: 1791307 - protein, 8 aa, Staphylococcus epidermidis
TNDDGSIV

SEQ ID NO: 1791308 - protein, 27 aa, Staphylococcus epidermidis
TNDDLKAAAKQAIDTHGVGAGAVRSIN

SEQ ID NO: 1791309 - protein, 14 aa, Staphylococcus epidermidis
TNDFPQYERPQAHN

SEQ ID NO: 1791310 - protein, 6 aa, Staphylococcus epidermidis
TNDKSL

SEQ ID NO: 1791311 - protein, 5 aa, Staphylococcus epidermidis
TNDNG

SEQ ID NO: 1791312 - protein, 8 aa, Staphylococcus epidermidis
TNDQKINE

SEQ ID NO: 1791313 - protein, 8 aa, Staphylococcus epidermidis
TNDQREVG

SEQ ID NO: 1791314 - protein, 21 aa, Staphylococcus epidermidis
TNDQSTQDSPHPKGDLRRARA

SEQ ID NO: 1791315 - protein, 5 aa, Staphylococcus epidermidis
TNDSS

SEQ ID NO: 1791316 - protein, 4 aa, Staphylococcus epidermidis
TNDV

SEQ ID NO: 1791317 - protein, 27 aa, Staphylococcus epidermidis
TNEAMNKADELTQERLGKHTQGLNIPG

SEQ ID NO: 1791318 - protein, 4 aa, Staphylococcus epidermidis
TNED

SEQ ID NO: 1791319 - protein, 5 aa, Staphylococcus epidermidis
TNEDY

SEQ ID NO: 1791320 - protein, 8 aa, Staphylococcus epidermidis
TNEEGEQF

SEQ ID NO: 1791321 - protein, 6 aa, Staphylococcus epidermidis
TNEEGH

SEQ ID NO: 1791322 - protein, 4 aa, Staphylococcus epidermidis
TNEG

SEQ ID NO: 1791323 - protein, 6 aa, Staphylococcus epidermidis
TNELAD

SEQ ID NO: 1791324 - protein, 14 aa, Staphylococcus epidermidis
TNELNASYAADGYA

SEQ ID NO: 1791325 - protein, 14 aa, Staphylococcus epidermidis
TNELNASYATDGYA

SEQ ID NO: 1791326 - protein, 6 aa, Staphylococcus epidermidis
TNEQKI

SEQ ID NO: 1791327 - protein, 6 aa, Staphylococcus epidermidis
TNERNM

SEQ ID NO: 1791328 - protein, 7 aa, Staphylococcus epidermidis
TNETDTY

SEQ ID NO: 1791329 - protein, 9 aa, Staphylococcus epidermidis
TNEYGTAPV

SEQ ID NO: 1791330 - protein, 11 aa, Staphylococcus epidermidis
TNFKSKANKKI

SEQ ID NO: 1791331 - protein, 21 aa, Staphylococcus epidermidis
TNGASQQHSQQSSQDIQQENI

SEQ ID NO: 1791332 - protein, 41 aa, Staphylococcus epidermidis
TNGASQQYSQQSSQDIQQDNIKSYDEKQEAISNDQQEIKSP

SEQ ID NO: 1791333 - protein, 7 aa, Staphylococcus epidermidis
TNGKSRS

SEQ ID NO: 1791334 - protein, 4 aa, Staphylococcus epidermidis
TNGP

SEQ ID NO: 1791335 - protein, 6 aa, Staphylococcus epidermidis
TNGRIE

SEQ ID NO: 1791336 - protein, 12 aa, Staphylococcus epidermidis
TNGVPYESKSFL

SEQ ID NO: 1791337 - protein, 4 aa, Staphylococcus epidermidis
TNHD

SEQ ID NO: 1791338 - protein, 6 aa, Staphylococcus epidermidis
TNHNNW

SEQ ID NO: 1791339 - protein, 5 aa, Staphylococcus epidermidis
TNHPA

SEQ ID NO: 1791340 - protein, 11 aa, Staphylococcus epidermidis
TNIDKAKEMSN

SEQ ID NO: 1791341 - protein, 6 aa, Staphylococcus epidermidis
TNIEDY

SEQ ID NO: 1791342 - protein, 9 aa, Staphylococcus epidermidis
TNIETDEKD

SEQ ID NO: 1791343 - protein, 10 aa, Staphylococcus epidermidis
TNINYSGENM

SEQ ID NO: 1791344 - protein, 18 aa, Staphylococcus epidermidis
TNKEKAKIKEQQKTETAV

SEQ ID NO: 1791345 - protein, 10 aa, Staphylococcus epidermidis
TNKEREAAQN

SEQ ID NO: 1791346 - protein, 10 aa, Staphylococcus epidermidis
TNKPIEVGGG

SEQ ID NO: 1791347 - protein, 8 aa, Staphylococcus epidermidis
TNLDSEAC

SEQ ID NO: 1791348 - protein, 6 aa, Staphylococcus epidermidis
TNLEKI

SEQ ID NO: 1791349 - protein, 4 aa, Staphylococcus epidermidis
TNLR

SEQ ID NO: 1791350 - protein, 8 aa, Staphylococcus epidermidis
TNLSATVA

SEQ ID NO: 1791351 - protein, 4 aa, Staphylococcus epidermidis
TNLV

SEQ ID NO: 1791352 - protein, 6 aa, Staphylococcus epidermidis
TNMENN

SEQ ID NO: 1791353 - protein, 9 aa, Staphylococcus epidermidis
TNNGANPLQ

SEQ ID NO: 1791354 - protein, 6 aa, Staphylococcus epidermidis
TNNIKG

SEQ ID NO: 1791355 - protein, 8 aa, Staphylococcus epidermidis
TNNNKKAV

SEQ ID NO: 1791356 - protein, 8 aa, Staphylococcus epidermidis
TNNTITNR

SEQ ID NO: 1791357 - protein, 6 aa, Staphylococcus epidermidis
TNNVDN

SEQ ID NO: 1791358 - protein, 11 aa, Staphylococcus epidermidis
TNPDKAESKVN

SEQ ID NO: 1791359 - protein, 6 aa, Staphylococcus epidermidis
TNPEKR

SEQ ID NO: 1791360 - protein, 5 aa, Staphylococcus epidermidis
TNPLA

SEQ ID NO: 1791361 - protein, 9 aa, Staphylococcus epidermidis
TNPNDTVQF

SEQ ID NO: 1791362 - protein, 4 aa, Staphylococcus epidermidis
TNPS

SEQ ID NO: 1791363 - protein, 7 aa, Staphylococcus epidermidis
TNPSKDY

SEQ ID NO: 1791364 - protein, 6 aa, Staphylococcus epidermidis
TNQDAN

SEQ ID NO: 1791365 - protein, 8 aa, Staphylococcus epidermidis
TNQKQRSE

SEQ ID NO: 1791366 - protein, 14 aa, Staphylococcus epidermidis
TNQMRESKVSYSTQ

SEQ ID NO: 1791367 - protein, 8 aa, Staphylococcus epidermidis
TNQNDQSY

SEQ ID NO: 1791368 - protein, 8 aa, Staphylococcus epidermidis
TNQNQQMQ

SEQ ID NO: 1791369 - protein, 14 aa, Staphylococcus epidermidis
TNQSDVNNDVGAAL

SEQ ID NO: 1791370 - protein, 5 aa, Staphylococcus epidermidis
TNQYD

SEQ ID NO: 1791371 - protein, 8 aa, Staphylococcus epidermidis
TNQYNTNS

SEQ ID NO: 1791372 - protein, 10 aa, Staphylococcus epidermidis
TNQYPDGTET

SEQ ID NO: 1791373 - protein, 25 aa, Staphylococcus epidermidis
TNRQHNQVNSYKQKTEYHKKEYERE

SEQ ID NO: 1791374 - protein, 18 aa, Staphylococcus epidermidis
TNSDVDPYTDTPSYKRTH

SEQ ID NO: 1791375 - protein, 10 aa, Staphylococcus epidermidis
TNSESLSDLK

SEQ ID NO: 1791376 - protein, 6 aa, Staphylococcus epidermidis
TNSKAL

SEQ ID NO: 1791377 - protein, 5 aa, Staphylococcus epidermidis
TNSKD

SEQ ID NO: 1791378 - protein, 11 aa, Staphylococcus epidermidis
TNSTVTDLDTD

SEQ ID NO: 1791379 - protein, 12 aa, Staphylococcus epidermidis
TNSYKKDASQKF

SEQ ID NO: 1791380 - protein, 5 aa, Staphylococcus epidermidis
TNTDV

SEQ ID NO: 1791381 - protein, 5 aa, Staphylococcus epidermidis
TNTGV

SEQ ID NO: 1791382 - protein, 12 aa, Staphylococcus epidermidis
TNTNPEPVNWFS

SEQ ID NO: 1791383 - protein, 8 aa, Staphylococcus epidermidis
TNTTDEHK

SEQ ID NO: 1791384 - protein, 12 aa, Staphylococcus epidermidis
TNTTKLKEIEQS

SEQ ID NO: 1791385 - protein, 12 aa, Staphylococcus epidermidis
TNVEYDQVLVKV

SEQ ID NO: 1791386 - protein, 5 aa, Staphylococcus epidermidis
TNVNS

SEQ ID NO: 1791387 - protein, 8 aa, Staphylococcus epidermidis
TNVPTTRN

SEQ ID NO: 1791388 - protein, 12 aa, Staphylococcus epidermidis
TNVTNKETTTSM

SEQ ID NO: 1791389 - protein, 7 aa, Staphylococcus epidermidis
TNYQQQE

SEQ ID NO: 1791390 - protein, 6 aa, Staphylococcus epidermidis
TNYSDE

SEQ ID NO: 1791391 - protein, 12 aa, Staphylococcus epidermidis
TNYTSTGYSNSR

SEQ ID NO: 1791392 - protein, 12 aa, Staphylococcus epidermidis
TPAGMAENKESV

SEQ ID NO: 1791393 - protein, 11 aa, Staphylococcus epidermidis
TPAGMYGNKDS

SEQ ID NO: 1791394 - protein, 10 aa, Staphylococcus epidermidis
TPALGGYPKA

SEQ ID NO: 1791395 - protein, 12 aa, Staphylococcus epidermidis
TPAMATGGMGDT

SEQ ID NO: 1791396 - protein, 5 aa, Staphylococcus epidermidis
TPARL

SEQ ID NO: 1791397 - protein, 7 aa, Staphylococcus epidermidis
TPDEKAK

SEQ ID NO: 1791398 - protein, 9 aa, Staphylococcus epidermidis
TPDKLESQI

SEQ ID NO: 1791399 - protein, 12 aa, Staphylococcus epidermidis
TPDSASSDFEQH

SEQ ID NO: 1791400 - protein, 5 aa, Staphylococcus epidermidis
TPDSQ

SEQ ID NO: 1791401 - protein, 5 aa, Staphylococcus epidermidis
TPEFD

SEQ ID NO: 1791402 - protein, 5 aa, Staphylococcus epidermidis
TPEGT

SEQ ID NO: 1791403 - protein, 32 aa, Staphylococcus epidermidis
TPEGYTPTKQNSGSDEGKDSNGTKTTVTVKDC

SEQ ID NO: 1791404 - protein, 4 aa, Staphylococcus epidermidis
TPEN

SEQ ID NO: 1791405 - protein, 9 aa, Staphylococcus epidermidis
TPERTQGNK

SEQ ID NO: 1791406 - protein, 31 aa, Staphylococcus epidermidis
TPETKDPRKPVEKYGPEASEFTTNKLTSAKK

SEQ ID NO: 1791407 - protein, 4 aa, Staphylococcus epidermidis
TPFD

SEQ ID NO: 1791408 - protein, 5 aa, Staphylococcus epidermidis
TPFPR

SEQ ID NO: 1791409 - protein, 11 aa, Staphylococcus epidermidis
TPFSDDDQESI

SEQ ID NO: 1791410 - protein, 5 aa, Staphylococcus epidermidis
TPGFS

SEQ ID NO: 1791411 - protein, 11 aa, Staphylococcus epidermidis
TPGHENETSAA

SEQ ID NO: 1791412 - protein, 9 aa, Staphylococcus epidermidis
TPGHSPGSL

SEQ ID NO: 1791413 - protein, 16 aa, Staphylococcus epidermidis
TPGLSPESLKKQYGIR

SEQ ID NO: 1791414 - protein, 5 aa, Staphylococcus epidermidis
TPGVT

SEQ ID NO: 1791415 - protein, 11 aa, Staphylococcus epidermidis
TPGYSSKGQDF

SEQ ID NO: 1791416 - protein, 7 aa, Staphylococcus epidermidis
TPIDGKY

SEQ ID NO: 1791417 - protein, 10 aa, Staphylococcus epidermidis
TPIDKTDDEL

SEQ ID NO: 1791418 - protein, 13 aa, Staphylococcus epidermidis
TPIPNSESKVVKE

SEQ ID NO: 1791419 - protein, 9 aa, Staphylococcus epidermidis
TPITKQNYQ

SEQ ID NO: 1791420 - protein, 9 aa, Staphylococcus epidermidis
TPKAKGGIY

SEQ ID NO: 1791421 - protein, 4 aa, Staphylococcus epidermidis
TPKL

SEQ ID NO: 1791422 - protein, 13 aa, Staphylococcus epidermidis
TPKNLKKKFNADT

SEQ ID NO: 1791423 - protein, 8 aa, Staphylococcus epidermidis
TPKSKIRK

SEQ ID NO: 1791424 - protein, 10 aa, Staphylococcus epidermidis
TPKTESSIGK

SEQ ID NO: 1791425 - protein, 7 aa, Staphylococcus epidermidis
TPKVKPE

SEQ ID NO: 1791426 - protein, 4 aa, Staphylococcus epidermidis
TPKW

SEQ ID NO: 1791427 - protein, 5 aa, Staphylococcus epidermidis
TPLDK

SEQ ID NO: 1791428 - protein, 9 aa, Staphylococcus epidermidis
TPLKNRDQS

SEQ ID NO: 1791429 - protein, 10 aa, Staphylococcus epidermidis
TPLSDNEKQL

SEQ ID NO: 1791430 - protein, 4 aa, Staphylococcus epidermidis
TPMP

SEQ ID NO: 1791431 - protein, 12 aa, Staphylococcus epidermidis
TPMPQPGNPKPR

SEQ ID NO: 1791432 - protein, 7 aa, Staphylococcus epidermidis
TPNEYRT

SEQ ID NO: 1791433 - protein, 8 aa, Staphylococcus epidermidis
TPNINERN

SEQ ID NO: 1791434 - protein, 5 aa, Staphylococcus epidermidis
TPNRE

SEQ ID NO: 1791435 - protein, 9 aa, Staphylococcus epidermidis
TPNVTSEHL

SEQ ID NO: 1791436 - protein, 6 aa, Staphylococcus epidermidis
TPPCDT

SEQ ID NO: 1791437 - protein, 12 aa, Staphylococcus epidermidis
TPPEVTTRRTHG

SEQ ID NO: 1791438 - protein, 4 aa, Staphylococcus epidermidis
TPPF

SEQ ID NO: 1791439 - protein, 8 aa, Staphylococcus epidermidis
TPPQNNGI

SEQ ID NO: 1791440 - protein, 12 aa, Staphylococcus epidermidis
TPQGEKDTSMPG

SEQ ID NO: 1791441 - protein, 7 aa, Staphylococcus epidermidis
TPQGHSN

SEQ ID NO: 1791442 - protein, 6 aa, Staphylococcus epidermidis
TPREVS

SEQ ID NO: 1791443 - protein, 17 aa, Staphylococcus epidermidis
TPRFEENASQDGRATAD

SEQ ID NO: 1791444 - protein, 8 aa, Staphylococcus epidermidis
TPSEETAR

SEQ ID NO: 1791445 - protein, 5 aa, Staphylococcus epidermidis
TPSQD

SEQ ID NO: 1791446 - protein, 8 aa, Staphylococcus epidermidis
TPSSHGIK

SEQ ID NO: 1791447 - protein, 7 aa, Staphylococcus epidermidis
TPSTRQA

SEQ ID NO: 1791448 - protein, 7 aa, Staphylococcus epidermidis
TPSYAGV

SEQ ID NO: 1791449 - protein, 6 aa, Staphylococcus epidermidis
TPTDNY

SEQ ID NO: 1791450 - protein, 12 aa, Staphylococcus epidermidis
TPTESYQDRANY

SEQ ID NO: 1791451 - protein, 8 aa, Staphylococcus epidermidis
TPTHSANS

SEQ ID NO: 1791452 - protein, 10 aa, Staphylococcus epidermidis
TPTITGTVEK

SEQ ID NO: 1791453 - protein, 7 aa, Staphylococcus epidermidis
TPTKKEF

SEQ ID NO: 1791454 - protein, 8 aa, Staphylococcus epidermidis
TPTKKYKS

SEQ ID NO: 1791455 - protein, 18 aa, Staphylococcus epidermidis
TPTSTTTKTVDKDYTGGN

SEQ ID NO: 1791456 - protein, 9 aa, Staphylococcus epidermidis
TPVASADSH

SEQ ID NO: 1791457 - protein, 7 aa, Staphylococcus epidermidis
TPVDKDI

SEQ ID NO: 1791458 - protein, 6 aa, Staphylococcus epidermidis
TPVNSP

SEQ ID NO: 1791459 - protein, 5 aa, Staphylococcus epidermidis
TPVSD

SEQ ID NO: 1791460 - protein, 5 aa, Staphylococcus epidermidis
TPVTH

SEQ ID NO: 1791461 - protein, 9 aa, Staphylococcus epidermidis
TPYSQEKGY

SEQ ID NO: 1791462 - protein, 4 aa, Staphylococcus epidermidis
TPYT

SEQ ID NO: 1791463 - protein, 5 aa, Staphylococcus epidermidis
TPYTA

SEQ ID NO: 1791464 - protein, 5 aa, Staphylococcus epidermidis
TQADS

SEQ ID NO: 1791465 - protein, 6 aa, Staphylococcus epidermidis
TQAGTL

SEQ ID NO: 1791466 - protein, 6 aa, Staphylococcus epidermidis
TQAMTA

SEQ ID NO: 1791467 - protein, 24 aa, Staphylococcus epidermidis
TQANQNLNGNKRVAEAKTDASNTI

SEQ ID NO: 1791468 - protein, 5 aa, Staphylococcus epidermidis
TQAQG

SEQ ID NO: 1791469 - protein, 10 aa, Staphylococcus epidermidis
TQAQKDKEHE

SEQ ID NO: 1791470 - protein, 6 aa, Staphylococcus epidermidis
TQARDK

SEQ ID NO: 1791471 - protein, 5 aa, Staphylococcus epidermidis
TQDEL

SEQ ID NO: 1791472 - protein, 5 aa, Staphylococcus epidermidis
TQDIG

SEQ ID NO: 1791473 - protein, 7 aa, Staphylococcus epidermidis
TQDQPYD

SEQ ID NO: 1791474 - protein, 8 aa, Staphylococcus epidermidis
TQDRNSKS

SEQ ID NO: 1791475 - protein, 15 aa, Staphylococcus epidermidis
TQEAVERAKKGEGPT

SEQ ID NO: 1791476 - protein, 4 aa, Staphylococcus epidermidis
TQEE

SEQ ID NO: 1791477 - protein, 14 aa, Staphylococcus epidermidis
TQEELAERTDLSKG

SEQ ID NO: 1791478 - protein, 5 aa, Staphylococcus epidermidis
TQEEY

SEQ ID NO: 1791479 - protein, 15 aa, Staphylococcus epidermidis
TQEEYEQKKKELLEL

SEQ ID NO: 1791480 - protein, 17 aa, Staphylococcus epidermidis
TQEGGKPYKEAQGEVDY

SEQ ID NO: 1791481 - protein, 6 aa, Staphylococcus epidermidis
TQEIDN

SEQ ID NO: 1791482 - protein, 5 aa, Staphylococcus epidermidis
TQEKF

SEQ ID NO: 1791483 - protein, 4 aa, Staphylococcus epidermidis
TQEL

SEQ ID NO: 1791484 - protein, 6 aa, Staphylococcus epidermidis
TQEPWT

SEQ ID NO: 1791485 - protein, 5 aa, Staphylococcus epidermidis
TQEQL

SEQ ID NO: 1791486 - protein, 7 aa, Staphylococcus epidermidis
TQEQSHT

SEQ ID NO: 1791487 - protein, 9 aa, Staphylococcus epidermidis
TQERYPKKS

SEQ ID NO: 1791488 - protein, 4 aa, Staphylococcus epidermidis
TQES

SEQ ID NO: 1791489 - protein, 12 aa, Staphylococcus epidermidis
TQEYEAKDIKEP

SEQ ID NO: 1791490 - protein, 10 aa, Staphylococcus epidermidis
TQFQDSDAAF

SEQ ID NO: 1791491 - protein, 6 aa, Staphylococcus epidermidis
TQGASG

SEQ ID NO: 1791492 - protein, 5 aa, Staphylococcus epidermidis
TQGET

SEQ ID NO: 1791493 - protein, 5 aa, Staphylococcus epidermidis
TQGIG

SEQ ID NO: 1791494 - protein, 4 aa, Staphylococcus epidermidis
TQGK

SEQ ID NO: 1791495 - protein, 9 aa, Staphylococcus epidermidis
TQGNDKREK

SEQ ID NO: 1791496 - protein, 18 aa, Staphylococcus epidermidis
TQGNQQTEEKNQQPKQKT

SEQ ID NO: 1791497 - protein, 7 aa, Staphylococcus epidermidis
TQGTNSD

SEQ ID NO: 1791498 - protein, 6 aa, Staphylococcus epidermidis
TQGVPE

SEQ ID NO: 1791499 - protein, 22 aa, Staphylococcus epidermidis
TQHAKDIAQSDGYQRKVSSHNQ

SEQ ID NO: 1791500 - protein, 15 aa, Staphylococcus epidermidis
TQHREAFNQAKERLD

SEQ ID NO: 1791501 - protein, 9 aa, Staphylococcus epidermidis
TQHTEKSVE

SEQ ID NO: 1791502 - protein, 5 aa, Staphylococcus epidermidis
TQHTM

SEQ ID NO: 1791503 - protein, 9 aa, Staphylococcus epidermidis
TQHVAGTSF

SEQ ID NO: 1791504 - protein, 23 aa, Staphylococcus epidermidis
TQINKRSSRHDCKRKHPRSSTRE

SEQ ID NO: 1791505 - protein, 19 aa, Staphylococcus epidermidis
TQITEDTVTYEKDGRTIEI

SEQ ID NO: 1791506 - protein, 9 aa, Staphylococcus epidermidis
TQKEMQQSE

SEQ ID NO: 1791507 - protein, 8 aa, Staphylococcus epidermidis
TQKEYAEL

SEQ ID NO: 1791508 - protein, 9 aa, Staphylococcus epidermidis
TQKSKKSGK

SEQ ID NO: 1791509 - protein, 7 aa, Staphylococcus epidermidis
TQKTNEI

SEQ ID NO: 1791510 - protein, 10 aa, Staphylococcus epidermidis
TQKVTKIKKE

SEQ ID NO: 1791511 - protein, 6 aa, Staphylococcus epidermidis
TQLPKQ

SEQ ID NO: 1791512 - protein, 6 aa, Staphylococcus epidermidis
TQLQSG

SEQ ID NO: 1791513 - protein, 10 aa, Staphylococcus epidermidis
TQLTASAGVS

SEQ ID NO: 1791514 - protein, 4 aa, Staphylococcus epidermidis
TQMT

SEQ ID NO: 1791515 - protein, 7 aa, Staphylococcus epidermidis
TQNGEFQ

SEQ ID NO: 1791516 - protein, 10 aa, Staphylococcus epidermidis
TQNKDKGYVT

SEQ ID NO: 1791517 - protein, 20 aa, Staphylococcus epidermidis
TQNKSDSSMTLAPTDKYVST

SEQ ID NO: 1791518 - protein, 6 aa, Staphylococcus epidermidis
TQNLPN

SEQ ID NO: 1791519 - protein, 5 aa, Staphylococcus epidermidis
TQNNW

SEQ ID NO: 1791520 - protein, 6 aa, Staphylococcus epidermidis
TQNSAA

SEQ ID NO: 1791521 - protein, 12 aa, Staphylococcus epidermidis
TQNTNSKGNVLN

SEQ ID NO: 1791522 - protein, 10 aa, Staphylococcus epidermidis
TQPGETDNYD

SEQ ID NO: 1791523 - protein, 8 aa, Staphylococcus epidermidis
TQPPLTQF

SEQ ID NO: 1791524 - protein, 5 aa, Staphylococcus epidermidis
TQPYS

SEQ ID NO: 1791525 - protein, 14 aa, Staphylococcus epidermidis
TQPYSEELNGIGSV

SEQ ID NO: 1791526 - protein, 11 aa, Staphylococcus epidermidis
TQQEGAGNEIQ

SEQ ID NO: 1791527 - protein, 11 aa, Staphylococcus epidermidis
TQQGAARVDQL

SEQ ID NO: 1791528 - protein, 5 aa, Staphylococcus epidermidis
TQQNG

SEQ ID NO: 1791529 - protein, 6 aa, Staphylococcus epidermidis
TQQPFD

SEQ ID NO: 1791530 - protein, 10 aa, Staphylococcus epidermidis
TQQQKEDVSH

SEQ ID NO: 1791531 - protein, 4 aa, Staphylococcus epidermidis
TQQT

SEQ ID NO: 1791532 - protein, 5 aa, Staphylococcus epidermidis
TQRDI

SEQ ID NO: 1791533 - protein, 11 aa, Staphylococcus epidermidis
TQRSDVFTSNE

SEQ ID NO: 1791534 - protein, 19 aa, Staphylococcus epidermidis
TQSEEHTWEDDEGNVYSEE

SEQ ID NO: 1791535 - protein, 9 aa, Staphylococcus epidermidis
TQSITQQVK

SEQ ID NO: 1791536 - protein, 9 aa, Staphylococcus epidermidis
TQSKKQDEV

SEQ ID NO: 1791537 - protein, 12 aa, Staphylococcus epidermidis
TQSNLSQQQRNA

SEQ ID NO: 1791538 - protein, 16 aa, Staphylococcus epidermidis
TQTDINNKLNKDTIEA

SEQ ID NO: 1791539 - protein, 15 aa, Staphylococcus epidermidis
TQTEKLKDDNKFPSN

SEQ ID NO: 1791540 - protein, 14 aa, Staphylococcus epidermidis
TQTNAKPEDFPEYY

SEQ ID NO: 1791541 - protein, 8 aa, Staphylococcus epidermidis
TQTQYGQD

SEQ ID NO: 1791542 - protein, 6 aa, Staphylococcus epidermidis
TQVNGV

SEQ ID NO: 1791543 - protein, 11 aa, Staphylococcus epidermidis
TQVSNQAKNDG

SEQ ID NO: 1791544 - protein, 27 aa, Staphylococcus epidermidis
TQYSDKRLNHTSHTHKTNYEFNEQKVE

SEQ ID NO: 1791545 - protein, 5 aa, Staphylococcus epidermidis
TRAEE

SEQ ID NO: 1791546 - protein, 13 aa, Staphylococcus epidermidis
TRAQGEIASNWEG

SEQ ID NO: 1791547 - protein, 12 aa, Staphylococcus epidermidis
TRDGSEKTKAAR

SEQ ID NO: 1791548 - protein, 9 aa, Staphylococcus epidermidis
TRDQRSFTR

SEQ ID NO: 1791549 - protein, 7 aa, Staphylococcus epidermidis
TRDRRPI

SEQ ID NO: 1791550 - protein, 5 aa, Staphylococcus epidermidis
TRELH

SEQ ID NO: 1791551 - protein, 12 aa, Staphylococcus epidermidis
TREPGGVPTGEE

SEQ ID NO: 1791552 - protein, 9 aa, Staphylococcus epidermidis
TREVNAGDY

SEQ ID NO: 1791553 - protein, 11 aa, Staphylococcus epidermidis
TRGEVPDYQAS

SEQ ID NO: 1791554 - protein, 5 aa, Staphylococcus epidermidis
TRGLE

SEQ ID NO: 1791555 - protein, 6 aa, Staphylococcus epidermidis
TRGQTQ

SEQ ID NO: 1791556 - protein, 8 aa, Staphylococcus epidermidis
TRINNEEN

SEQ ID NO: 1791557 - protein, 15 aa, Staphylococcus epidermidis
TRKSTILSGKKVGDA

SEQ ID NO: 1791558 - protein, 8 aa, Staphylococcus epidermidis
TRLDSNRS

SEQ ID NO: 1791559 - protein, 8 aa, Staphylococcus epidermidis
TRMTQGQS

SEQ ID NO: 1791560 - protein, 6 aa, Staphylococcus epidermidis
TRNAKI

SEQ ID NO: 1791561 - protein, 16 aa, Staphylococcus epidermidis
TRNDKVDESKLPRPRI

SEQ ID NO: 1791562 - protein, 15 aa, Staphylococcus epidermidis
TRNHHKNAFKQNEGY

SEQ ID NO: 1791563 - protein, 5 aa, Staphylococcus epidermidis
TRNPV

SEQ ID NO: 1791564 - protein, 8 aa, Staphylococcus epidermidis
TRNSEQCR

SEQ ID NO: 1791565 - protein, 11 aa, Staphylococcus epidermidis
TRPSDEEKRDR

SEQ ID NO: 1791566 - protein, 12 aa, Staphylococcus epidermidis
TRQNEKDDAIKN

SEQ ID NO: 1791567 - protein, 7 aa, Staphylococcus epidermidis
TRRGQEV

SEQ ID NO: 1791568 - protein, 7 aa, Staphylococcus epidermidis
TRTPSLE

SEQ ID NO: 1791569 - protein, 6 aa, Staphylococcus epidermidis
TRVPEN

SEQ ID NO: 1791570 - protein, 10 aa, Staphylococcus epidermidis
TRVSGGGSLN

SEQ ID NO: 1791571 - protein, 14 aa, Staphylococcus epidermidis
TRYQSINTAKSTLK

SEQ ID NO: 1791572 - protein, 14 aa, Staphylococcus epidermidis
TRYQSVNTAKNTLK

SEQ ID NO: 1791573 - protein, 5 aa, Staphylococcus epidermidis
TRYRP

SEQ ID NO: 1791574 - protein, 7 aa, Staphylococcus epidermidis
TRYRSGS

SEQ ID NO: 1791575 - protein, 10 aa, Staphylococcus epidermidis
TSAATTAQWD

SEQ ID NO: 1791576 - protein, 11 aa, Staphylococcus epidermidis
TSACSSKRGKL

SEQ ID NO: 1791577 - protein, 10 aa, Staphylococcus epidermidis
TSADDPHDGL

SEQ ID NO: 1791578 - protein, 6 aa, Staphylococcus epidermidis
TSAGEV

SEQ ID NO: 1791579 - protein, 7 aa, Staphylococcus epidermidis
TSAMPDE

SEQ ID NO: 1791580 - protein, 5 aa, Staphylococcus epidermidis
TSAPK

SEQ ID NO: 1791581 - protein, 20 aa, Staphylococcus epidermidis
TSATKAEKAIKGPFHGNSSV

SEQ ID NO: 1791582 - protein, 7 aa, Staphylococcus epidermidis
TSAYSGA

SEQ ID NO: 1791583 - protein, 13 aa, Staphylococcus epidermidis
TSAYYGPYKRPQR

SEQ ID NO: 1791584 - protein, 4 aa, Staphylococcus epidermidis
TSDA

SEQ ID NO: 1791585 - protein, 5 aa, Staphylococcus epidermidis
TSDEH

SEQ ID NO: 1791586 - protein, 10 aa, Staphylococcus epidermidis
TSDELKDKTM

SEQ ID NO: 1791587 - protein, 6 aa, Staphylococcus epidermidis
TSDIKE

SEQ ID NO: 1791588 - protein, 8 aa, Staphylococcus epidermidis
TSDKYANQ

SEQ ID NO: 1791589 - protein, 4 aa, Staphylococcus epidermidis
TSDL

SEQ ID NO: 1791590 - protein, 9 aa, Staphylococcus epidermidis
TSDNGILKG

SEQ ID NO: 1791591 - protein, 10 aa, Staphylococcus epidermidis
TSDTEMNDDG

SEQ ID NO: 1791592 - protein, 7 aa, Staphylococcus epidermidis
TSDTFKE

SEQ ID NO: 1791593 - protein, 9 aa, Staphylococcus epidermidis
TSDTKKGVN

SEQ ID NO: 1791594 - protein, 8 aa, Staphylococcus epidermidis
TSDVSGEV

SEQ ID NO: 1791595 - protein, 11 aa, Staphylococcus epidermidis
TSDYQAPEEAC

SEQ ID NO: 1791596 - protein, 8 aa, Staphylococcus epidermidis
TSEADVNR

SEQ ID NO: 1791597 - protein, 7 aa, Staphylococcus epidermidis
TSEDGTL

SEQ ID NO: 1791598 - protein, 9 aa, Staphylococcus epidermidis
TSEEDVDQS

SEQ ID NO: 1791599 - protein, 30 aa, Staphylococcus epidermidis
TSEEKNTRKTIKEGRFKGQYKGKRTPTTLR

SEQ ID NO: 1791600 - protein, 30 aa, Staphylococcus epidermidis
TSEEKNTRKTIKEGRFKGQYRGKRTPTTLR

SEQ ID NO: 1791601 - protein, 10 aa, Staphylococcus epidermidis
TSEETEEMAN

SEQ ID NO: 1791602 - protein, 6 aa, Staphylococcus epidermidis
TSEIDR

SEQ ID NO: 1791603 - protein, 7 aa, Staphylococcus epidermidis
TSEITAD

SEQ ID NO: 1791604 - protein, 9 aa, Staphylococcus epidermidis
TSELSDKLA

SEQ ID NO: 1791605 - protein, 5 aa, Staphylococcus epidermidis
TSEPR

SEQ ID NO: 1791606 - protein, 8 aa, Staphylococcus epidermidis
TSEQQITV

SEQ ID NO: 1791607 - protein, 5 aa, Staphylococcus epidermidis
TSETA

SEQ ID NO: 1791608 - protein, 10 aa, Staphylococcus epidermidis
TSEWTPEEQE

SEQ ID NO: 1791609 - protein, 4 aa, Staphylococcus epidermidis
TSFQ

SEQ ID NO: 1791610 - protein, 9 aa, Staphylococcus epidermidis
TSGDENEWT

SEQ ID NO: 1791611 - protein, 9 aa, Staphylococcus epidermidis
TSGGGGKGM

SEQ ID NO: 1791612 - protein, 18 aa, Staphylococcus epidermidis
TSGNIRTKGTVQSGQNFG

SEQ ID NO: 1791613 - protein, 9 aa, Staphylococcus epidermidis
TSGPGVSNL

SEQ ID NO: 1791614 - protein, 16 aa, Staphylococcus epidermidis
TSGRARKDRYSSVSYG

SEQ ID NO: 1791615 - protein, 24 aa, Staphylococcus epidermidis
TSGSLTDRQYKTRTVKDTLEGAGL

SEQ ID NO: 1791616 - protein, 12 aa, Staphylococcus epidermidis
TSGTQSPSSDKS

SEQ ID NO: 1791617 - protein, 6 aa, Staphylococcus epidermidis
TSGWTG

SEQ ID NO: 1791618 - protein, 5 aa, Staphylococcus epidermidis
TSHLE

SEQ ID NO: 1791619 - protein, 7 aa, Staphylococcus epidermidis
TSIETLE

SEQ ID NO: 1791620 - protein, 8 aa, Staphylococcus epidermidis
TSIGEDGK

SEQ ID NO: 1791621 - protein, 5 aa, Staphylococcus epidermidis
TSITQ

SEQ ID NO: 1791622 - protein, 7 aa, Staphylococcus epidermidis
TSKAKAK

SEQ ID NO: 1791623 - protein, 7 aa, Staphylococcus epidermidis
TSKERMK

SEQ ID NO: 1791624 - protein, 8 aa, Staphylococcus epidermidis
TSKIDADD

SEQ ID NO: 1791625 - protein, 15 aa, Staphylococcus epidermidis
TSKIGKKDEQEKVQE

SEQ ID NO: 1791626 - protein, 8 aa, Staphylococcus epidermidis
TSKKYITK

SEQ ID NO: 1791627 - protein, 8 aa, Staphylococcus epidermidis
TSKLEEKI

SEQ ID NO: 1791628 - protein, 9 aa, Staphylococcus epidermidis
TSKPNTEEE

SEQ ID NO: 1791629 - protein, 5 aa, Staphylococcus epidermidis
TSKQF

SEQ ID NO: 1791630 - protein, 4 aa, Staphylococcus epidermidis
TSKR

SEQ ID NO: 1791631 - protein, 8 aa, Staphylococcus epidermidis
TSKRESLS

SEQ ID NO: 1791632 - protein, 6 aa, Staphylococcus epidermidis
TSKSSV

SEQ ID NO: 1791633 - protein, 7 aa, Staphylococcus epidermidis
TSKTPKW

SEQ ID NO: 1791634 - protein, 10 aa, Staphylococcus epidermidis
TSKYSKPYLS

SEQ ID NO: 1791635 - protein, 16 aa, Staphylococcus epidermidis
TSLEDELEQPSPNFKN

SEQ ID NO: 1791636 - protein, 9 aa, Staphylococcus epidermidis
TSLGQAQEM

SEQ ID NO: 1791637 - protein, 11 aa, Staphylococcus epidermidis
TSLNNGQKREL

SEQ ID NO: 1791638 - protein, 7 aa, Staphylococcus epidermidis
TSMENDA

SEQ ID NO: 1791639 - protein, 13 aa, Staphylococcus epidermidis
TSNAGTKDGGREG

SEQ ID NO: 1791640 - protein, 18 aa, Staphylococcus epidermidis
TSNLPQGMKARTKHQNTT

SEQ ID NO: 1791641 - protein, 9 aa, Staphylococcus epidermidis
TSNQPAPPH

SEQ ID NO: 1791642 - protein, 11 aa, Staphylococcus epidermidis
TSNQSIDLERE

SEQ ID NO: 1791643 - protein, 15 aa, Staphylococcus epidermidis
TSNSFTIEKNNDQQH

SEQ ID NO: 1791644 - protein, 15 aa, Staphylococcus epidermidis
TSNSFTIERNNDQQH

SEQ ID NO: 1791645 - protein, 9 aa, Staphylococcus epidermidis
TSPDNQCSV

SEQ ID NO: 1791646 - protein, 7 aa, Staphylococcus epidermidis
TSPKELL

SEQ ID NO: 1791647 - protein, 10 aa, Staphylococcus epidermidis
TSPKYRGQGI

SEQ ID NO: 1791648 - protein, 6 aa, Staphylococcus epidermidis
TSPQAF

SEQ ID NO: 1791649 - protein, 6 aa, Staphylococcus epidermidis
TSPTEI

SEQ ID NO: 1791650 - protein, 5 aa, Staphylococcus epidermidis
TSPTF

SEQ ID NO: 1791651 - protein, 7 aa, Staphylococcus epidermidis
TSPTPDK

SEQ ID NO: 1791652 - protein, 17 aa, Staphylococcus epidermidis
TSPVQARTMEKREGKGP

SEQ ID NO: 1791653 - protein, 11 aa, Staphylococcus epidermidis
TSPVRKPLTDF

SEQ ID NO: 1791654 - protein, 5 aa, Staphylococcus epidermidis
TSPYT

SEQ ID NO: 1791655 - protein, 9 aa, Staphylococcus epidermidis
TSPYTKSKF

SEQ ID NO: 1791656 - protein, 17 aa, Staphylococcus epidermidis
TSQGATKIYKTPNNHVE

SEQ ID NO: 1791657 - protein, 6 aa, Staphylococcus epidermidis
TSQKDT

SEQ ID NO: 1791658 - protein, 6 aa, Staphylococcus epidermidis
TSQPTL

SEQ ID NO: 1791659 - protein, 8 aa, Staphylococcus epidermidis
TSQPTMSV

SEQ ID NO: 1791660 - protein, 9 aa, Staphylococcus epidermidis
TSQQSHEDL

SEQ ID NO: 1791661 - protein, 7 aa, Staphylococcus epidermidis
TSQQYGM

SEQ ID NO: 1791662 - protein, 6 aa, Staphylococcus epidermidis
TSQREP

SEQ ID NO: 1791663 - protein, 9 aa, Staphylococcus epidermidis
TSQSIEESK

SEQ ID NO: 1791664 - protein, 5 aa, Staphylococcus epidermidis
TSQYQ

SEQ ID NO: 1791665 - protein, 8 aa, Staphylococcus epidermidis
TSRATGSF

SEQ ID NO: 1791666 - protein, 6 aa, Staphylococcus epidermidis
TSRIDA

SEQ ID NO: 1791667 - protein, 7 aa, Staphylococcus epidermidis
TSRPSYI

SEQ ID NO: 1791668 - protein, 11 aa, Staphylococcus epidermidis
TSRSGKGESAV

SEQ ID NO: 1791669 - protein, 9 aa, Staphylococcus epidermidis
TSRTPDDLD

SEQ ID NO: 1791670 - protein, 6 aa, Staphylococcus epidermidis
TSSEEE

SEQ ID NO: 1791671 - protein, 9 aa, Staphylococcus epidermidis
TSSETLTNQ

SEQ ID NO: 1791672 - protein, 4 aa, Staphylococcus epidermidis
TSSF

SEQ ID NO: 1791673 - protein, 14 aa, Staphylococcus epidermidis
TSSFTPEESPDPGF

SEQ ID NO: 1791674 - protein, 10 aa, Staphylococcus epidermidis
TSSKGQKQVD

SEQ ID NO: 1791675 - protein, 6 aa, Staphylococcus epidermidis
TSSLGV

SEQ ID NO: 1791676 - protein, 13 aa, Staphylococcus epidermidis
TSSMGGRLTTYFG

SEQ ID NO: 1791677 - protein, 6 aa, Staphylococcus epidermidis
TSSQLD

SEQ ID NO: 1791678 - protein, 5 aa, Staphylococcus epidermidis
TSSYR

SEQ ID NO: 1791679 - protein, 9 aa, Staphylococcus epidermidis
TSTGCDGIH

SEQ ID NO: 1791680 - protein, 15 aa, Staphylococcus epidermidis
TSTGFAGGGATPEDV

SEQ ID NO: 1791681 - protein, 5 aa, Staphylococcus epidermidis
TSTKS

SEQ ID NO: 1791682 - protein, 4 aa, Staphylococcus epidermidis
TSTL

SEQ ID NO: 1791683 - protein, 6 aa, Staphylococcus epidermidis
TSTNEG

SEQ ID NO: 1791684 - protein, 19 aa, Staphylococcus epidermidis
TSTQVSGEIQHSKKLDQNV

SEQ ID NO: 1791685 - protein, 5 aa, Staphylococcus epidermidis
TSTSA

SEQ ID NO: 1791686 - protein, 11 aa, Staphylococcus epidermidis
TSTSDNPVAKR

SEQ ID NO: 1791687 - protein, 7 aa, Staphylococcus epidermidis
TSTTTNG

SEQ ID NO: 1791688 - protein, 5 aa, Staphylococcus epidermidis
TSVDG

SEQ ID NO: 1791689 - protein, 8 aa, Staphylococcus epidermidis
TSVGYGAN

SEQ ID NO: 1791690 - protein, 6 aa, Staphylococcus epidermidis
TSVPEE

SEQ ID NO: 1791691 - protein, 5 aa, Staphylococcus epidermidis
TSVSL

SEQ ID NO: 1791692 - protein, 4 aa, Staphylococcus epidermidis
TSYD

SEQ ID NO: 1791693 - protein, 6 aa, Staphylococcus epidermidis
TSYDES

SEQ ID NO: 1791694 - protein, 4 aa, Staphylococcus epidermidis
TSYH

SEQ ID NO: 1791695 - protein, 6 aa, Staphylococcus epidermidis
TSYPGF

SEQ ID NO: 1791696 - protein, 11 aa, Staphylococcus epidermidis
TTAFSNEGDAT

SEQ ID NO: 1791697 - protein, 11 aa, Staphylococcus epidermidis
TTAGVAKGSGM

SEQ ID NO: 1791698 - protein, 12 aa, Staphylococcus epidermidis
TTAKEGKHSPVA

SEQ ID NO: 1791699 - protein, 4 aa, Staphylococcus epidermidis
TTAN

SEQ ID NO: 1791700 - protein, 11 aa, Staphylococcus epidermidis
TTANKIDTTNL

SEQ ID NO: 1791701 - protein, 4 aa, Staphylococcus epidermidis
TTAQ

SEQ ID NO: 1791702 - protein, 9 aa, Staphylococcus epidermidis
TTASKREAH

SEQ ID NO: 1791703 - protein, 13 aa, Staphylococcus epidermidis
TTDEGSINEIDEN

SEQ ID NO: 1791704 - protein, 7 aa, Staphylococcus epidermidis
TTDENAK

SEQ ID NO: 1791705 - protein, 4 aa, Staphylococcus epidermidis
TTDG

SEQ ID NO: 1791706 - protein, 9 aa, Staphylococcus epidermidis
TTDHHTSDI

SEQ ID NO: 1791707 - protein, 9 aa, Staphylococcus epidermidis
TTDKDTKTC

SEQ ID NO: 1791708 - protein, 18 aa, Staphylococcus epidermidis
TTDKKGYQQYKITEVFET

SEQ ID NO: 1791709 - protein, 7 aa, Staphylococcus epidermidis
TTDLQPE

SEQ ID NO: 1791710 - protein, 22 aa, Staphylococcus epidermidis
TTDPATLPEASWRGTKSKKHNN

SEQ ID NO: 1791711 - protein, 7 aa, Staphylococcus epidermidis
TTDPGMG

SEQ ID NO: 1791712 - protein, 12 aa, Staphylococcus epidermidis
TTDRSEDGLNDP

SEQ ID NO: 1791713 - protein, 11 aa, Staphylococcus epidermidis
TTDRSEQGLND

SEQ ID NO: 1791714 - protein, 8 aa, Staphylococcus epidermidis
TTDVSGEV

SEQ ID NO: 1791715 - protein, 15 aa, Staphylococcus epidermidis
TTDYEKQEQALPGLQ

SEQ ID NO: 1791716 - protein, 6 aa, Staphylococcus epidermidis
TTEDFK

SEQ ID NO: 1791717 - protein, 5 aa, Staphylococcus epidermidis
TTEDS

SEQ ID NO: 1791718 - protein, 9 aa, Staphylococcus epidermidis
TTEGAWQKR

SEQ ID NO: 1791719 - protein, 5 aa, Staphylococcus epidermidis
TTEIT

SEQ ID NO: 1791720 - protein, 16 aa, Staphylococcus epidermidis
TTENDRKDTTPDSQKN

SEQ ID NO: 1791721 - protein, 9 aa, Staphylococcus epidermidis
TTENGEQIE

SEQ ID NO: 1791722 - protein, 15 aa, Staphylococcus epidermidis
TTENNKKYTIPDSEK

SEQ ID NO: 1791723 - protein, 20 aa, Staphylococcus epidermidis
TTEPVDGRSTTYSTDVAKGY

SEQ ID NO: 1791724 - protein, 8 aa, Staphylococcus epidermidis
TTERAPYT

SEQ ID NO: 1791725 - protein, 11 aa, Staphylococcus epidermidis
TTERPEGVEAG

SEQ ID NO: 1791726 - protein, 6 aa, Staphylococcus epidermidis
TTERQD

SEQ ID NO: 1791727 - protein, 8 aa, Staphylococcus epidermidis
TTETYEQL

SEQ ID NO: 1791728 - protein, 4 aa, Staphylococcus epidermidis
TTEV

SEQ ID NO: 1791729 - protein, 12 aa, Staphylococcus epidermidis
TTFGDKQRGQVT

SEQ ID NO: 1791730 - protein, 8 aa, Staphylococcus epidermidis
TTFGKYGG

SEQ ID NO: 1791731 - protein, 12 aa, Staphylococcus epidermidis
TTGEEKEQEGAK

SEQ ID NO: 1791732 - protein, 8 aa, Staphylococcus epidermidis
TTGEKDTL

SEQ ID NO: 1791733 - protein, 11 aa, Staphylococcus epidermidis
TTGGTGISQRD

SEQ ID NO: 1791734 - protein, 5 aa, Staphylococcus epidermidis
TTGLP

SEQ ID NO: 1791735 - protein, 9 aa, Staphylococcus epidermidis
TTGSDRGEN

SEQ ID NO: 1791736 - protein, 4 aa, Staphylococcus epidermidis
TTGV

SEQ ID NO: 1791737 - protein, 18 aa, Staphylococcus epidermidis
TTHGTYDKKVEPTENGIK

SEQ ID NO: 1791738 - protein, 5 aa, Staphylococcus epidermidis
TTHKD

SEQ ID NO: 1791739 - protein, 4 aa, Staphylococcus epidermidis
TTHS

SEQ ID NO: 1791740 - protein, 4 aa, Staphylococcus epidermidis
TTHY

SEQ ID NO: 1791741 - protein, 10 aa, Staphylococcus epidermidis
TTIDASARNL

SEQ ID NO: 1791742 - protein, 13 aa, Staphylococcus epidermidis
TTIIGGGDSAAAA

SEQ ID NO: 1791743 - protein, 5 aa, Staphylococcus epidermidis
TTITN

SEQ ID NO: 1791744 - protein, 6 aa, Staphylococcus epidermidis
TTITPA

SEQ ID NO: 1791745 - protein, 15 aa, Staphylococcus epidermidis
TTKEIKETKEGLKSG

SEQ ID NO: 1791746 - protein, 8 aa, Staphylococcus epidermidis
TTKGESTL

SEQ ID NO: 1791747 - protein, 22 aa, Staphylococcus epidermidis
TTKKDAKLRLEKSNGVIKQAIN

SEQ ID NO: 1791748 - protein, 12 aa, Staphylococcus epidermidis
TTKKLTPSEEEA

SEQ ID NO: 1791749 - protein, 12 aa, Staphylococcus epidermidis
TTKYDDAKVDKQ

SEQ ID NO: 1791750 - protein, 5 aa, Staphylococcus epidermidis
TTLES

SEQ ID NO: 1791751 - protein, 6 aa, Staphylococcus epidermidis
TTLNSQ

SEQ ID NO: 1791752 - protein, 7 aa, Staphylococcus epidermidis
TTLSNKG

SEQ ID NO: 1791753 - protein, 10 aa, Staphylococcus epidermidis
TTLTEDAKRI

SEQ ID NO: 1791754 - protein, 12 aa, Staphylococcus epidermidis
TTMDNPEETLGD

SEQ ID NO: 1791755 - protein, 35 aa, Staphylococcus epidermidis; identical to SEQ ID NO: 1644664

SEQ ID NO: 1791756 - protein, 7 aa, Staphylococcus epidermidis
TTNENAK

SEQ ID NO: 1791757 - protein, 4 aa, Staphylococcus epidermidis
TTNI

SEQ ID NO: 1791758 - protein, 5 aa, Staphylococcus epidermidis
TTNIH

SEQ ID NO: 1791759 - protein, 16 aa, Staphylococcus epidermidis
TTNKIYDTNGTILKTL

SEQ ID NO: 1791760 - protein, 6 aa, Staphylococcus epidermidis
TTNLER

SEQ ID NO: 1791761 - protein, 5 aa, Staphylococcus epidermidis
TTPDC

SEQ ID NO: 1791762 - protein, 7 aa, Staphylococcus epidermidis
TTPFKEG

SEQ ID NO: 1791763 - protein, 13 aa, Staphylococcus epidermidis
TTPLKKVTTPQDV

SEQ ID NO: 1791764 - protein, 16 aa, Staphylococcus epidermidis
TTPNQDNPITEGKTPI

SEQ ID NO: 1791765 - protein, 15 aa, Staphylococcus epidermidis
TTPNQDNPLTEGKTP

SEQ ID NO: 1791766 - protein, 6 aa, Staphylococcus epidermidis
TTPPGI

SEQ ID NO: 1791767 - protein, 7 aa, Staphylococcus epidermidis
TTPQNEI

SEQ ID NO: 1791768 - protein, 13 aa, Staphylococcus epidermidis
TTPYSPNGPPPGY

SEQ ID NO: 1791769 - protein, 29 aa, Staphylococcus epidermidis
TTQLGDNKITPKKPRYDDTNPIEFGAFND

SEQ ID NO: 1791770 - protein, 5 aa, Staphylococcus epidermidis
TTQQF

SEQ ID NO: 1791771 - protein, 6 aa, Staphylococcus epidermidis
TTQSEF

SEQ ID NO: 1791772 - protein, 5 aa, Staphylococcus epidermidis
TTRAA

SEQ ID NO: 1791773 - protein, 6 aa, Staphylococcus epidermidis
TTRENG

SEQ ID NO: 1791774 - protein, 8 aa, Staphylococcus epidermidis
TTRNEAER

SEQ ID NO: 1791775 - protein, 22 aa, Staphylococcus epidermidis
TTRPQENKNFSSNGANNSSNNV

SEQ ID NO: 1791776 - protein, 23 aa, Staphylococcus epidermidis
TTRQRDGLNSKNKIQEGGLSGRP

SEQ ID NO: 1791777 - protein, 24 aa, Staphylococcus epidermidis
TTRQRDGLTSDNKTEEGGLSGKPL

SEQ ID NO: 1791778 - protein, 8 aa, Staphylococcus epidermidis
TTRYTDEQ

SEQ ID NO: 1791779 - protein, 10 aa, Staphylococcus epidermidis
TTSACSSKMN

SEQ ID NO: 1791780 - protein, 9 aa, Staphylococcus epidermidis
TTSASDIAE

SEQ ID NO: 1791781 - protein, 4 aa, Staphylococcus epidermidis
TTSE

SEQ ID NO: 1791782 - protein, 6 aa, Staphylococcus epidermidis
TTSGDL

SEQ ID NO: 1791783 - protein, 15 aa, Staphylococcus epidermidis
TTSHPNELPRTNDEI

SEQ ID NO: 1791784 - protein, 11 aa, Staphylococcus epidermidis
TTSKEEKRQQL

SEQ ID NO: 1791785 - protein, 11 aa, Staphylococcus epidermidis
TTSQHTSNEVE

SEQ ID NO: 1791786 - protein, 7 aa, Staphylococcus epidermidis
TTTAKSR

SEQ ID NO: 1791787 - protein, 5 aa, Staphylococcus epidermidis
TTTDK

SEQ ID NO: 1791788 - protein, 15 aa, Staphylococcus epidermidis
TTTEPNTTPKTEMIN

SEQ ID NO: 1791789 - protein, 10 aa, Staphylococcus epidermidis
TTTHTNEDEC

SEQ ID NO: 1791790 - protein, 5 aa, Staphylococcus epidermidis
TTTLK

SEQ ID NO: 1791791 - protein, 45 aa, Staphylococcus epidermidis
TTTQPPELDKDAINRATQAITNAENELNGQAKLTEAISNGKQEVN

SEQ ID NO: 1791792 - protein, 8 aa, Staphylococcus epidermidis
TTTTNTRQ

SEQ ID NO: 1791793 - protein, 11 aa, Staphylococcus epidermidis
TTTVATEPDND

SEQ ID NO: 1791794 - protein, 7 aa, Staphylococcus epidermidis
TTVDGSD

SEQ ID NO: 1791795 - protein, 8 aa, Staphylococcus epidermidis
TTVEDEKE

SEQ ID NO: 1791796 - protein, 9 aa, Staphylococcus epidermidis
TTVNGQKHF

SEQ ID NO: 1791797 - protein, 7 aa, Staphylococcus epidermidis
TTYAQAG

SEQ ID NO: 1791798 - protein, 6 aa, Staphylococcus epidermidis
TTYEEI

SEQ ID NO: 1791799 - protein, 12 aa, Staphylococcus epidermidis
TTYFDSSNSPKL

SEQ ID NO: 1791800 - protein, 7 aa, Staphylococcus epidermidis
TVDEIAE

SEQ ID NO: 1791801 - protein, 7 aa, Staphylococcus epidermidis
TVDGNSI

SEQ ID NO: 1791802 - protein, 11 aa, Staphylococcus epidermidis
TVDSGKPGKTL

SEQ ID NO: 1791803 - protein, 7 aa, Staphylococcus epidermidis
TVDSPYR

SEQ ID NO: 1791804 - protein, 8 aa, Staphylococcus epidermidis
TVENDGEI

SEQ ID NO: 1791805 - protein, 13 aa, Staphylococcus epidermidis
TVENPDVTEEDAI

SEQ ID NO: 1791806 - protein, 31 aa, Staphylococcus epidermidis
TVESDETNEQKQTELPKKMTKKERQKTIENI

SEQ ID NO: 1791807 - protein, 10 aa, Staphylococcus epidermidis
TVEVNGAKLS

SEQ ID NO: 1791808 - protein, 24 aa, Staphylococcus epidermidis
TVGAEVDASVNKDERRAIQKNHSA

SEQ ID NO: 1791809 - protein, 5 aa, Staphylococcus epidermidis
TVGID

SEQ ID NO: 1791810 - protein, 6 aa, Staphylococcus epidermidis
TVGIDP

SEQ ID NO: 1791811 - protein, 10 aa, Staphylococcus epidermidis
TVGKPSENVE

SEQ ID NO: 1791812 - protein, 10 aa, Staphylococcus epidermidis
TVGNGGNIAR

SEQ ID NO: 1791813 - protein, 11 aa, Staphylococcus epidermidis
TVGTGVGPTSV

SEQ ID NO: 1791814 - protein, 8 aa, Staphylococcus epidermidis
TVGTISKE

SEQ ID NO: 1791815 - protein, 11 aa, Staphylococcus epidermidis
TVKGPKGELAR

SEQ ID NO: 1791816 - protein, 6 aa, Staphylococcus epidermidis
TVKNKL

SEQ ID NO: 1791817 - protein, 4 aa, Staphylococcus epidermidis
TVKP

SEQ ID NO: 1791818 - protein, 5 aa, Staphylococcus epidermidis
TVKSE

SEQ ID NO: 1791819 - protein, 11 aa, Staphylococcus epidermidis
TVKSNERGEVD

SEQ ID NO: 1791820 - protein, 9 aa, Staphylococcus epidermidis
TVNDQTISK

SEQ ID NO: 1791821 - protein, 8 aa, Staphylococcus epidermidis
TVNHQRTD

SEQ ID NO: 1791822 - protein, 9 aa, Staphylococcus epidermidis
TVNQMRSGS

SEQ ID NO: 1791823 - protein, 5 aa, Staphylococcus epidermidis
TVQQN

SEQ ID NO: 1791824 - protein, 6 aa, Staphylococcus epidermidis
TVQSGS

SEQ ID NO: 1791825 - protein, 10 aa, Staphylococcus epidermidis
TVQYENRNIS

SEQ ID NO: 1791826 - protein, 21 aa, Staphylococcus epidermidis
TVSANDYIKPNNGVGTKDNVN

SEQ ID NO: 1791827 - protein, 9 aa, Staphylococcus epidermidis
TVSGLTNNQ

SEQ ID NO: 1791828 - protein, 5 aa, Staphylococcus epidermidis
TVSNE

SEQ ID NO: 1791829 - protein, 7 aa, Staphylococcus epidermidis
TVSQPTL

SEQ ID NO: 1791830 - protein, 6 aa, Staphylococcus epidermidis
TVSQTY

SEQ ID NO: 1791831 - protein, 12 aa, Staphylococcus epidermidis
TVSRREKPENVD

SEQ ID NO: 1791832 - protein, 15 aa, Staphylococcus epidermidis
TVSTETIDKVPSTDV

SEQ ID NO: 1791833 - protein, 5 aa, Staphylococcus epidermidis
TVTDG

SEQ ID NO: 1791834 - protein, 12 aa, Staphylococcus epidermidis
TVTDGKFAKGEG

SEQ ID NO: 1791835 - protein, 7 aa, Staphylococcus epidermidis
TVTDQAL

SEQ ID NO: 1791836 - protein, 13 aa, Staphylococcus epidermidis
TVTETTKYEEVEY

SEQ ID NO: 1791837 - protein, 11 aa, Staphylococcus epidermidis
TVTNDDGTIDF

SEQ ID NO: 1791838 - protein, 9 aa, Staphylococcus epidermidis
TWQSKKESV

SEQ ID NO: 1791839 - protein, 31 aa, Staphylococcus epidermidis
TWSSSYRNSLKAENKLLDEKTAKIKKQIESM

SEQ ID NO: 1791840 - protein, 12 aa, Staphylococcus epidermidis
TYAKSRDEFEEQ

SEQ ID NO: 1791841 - protein, 5 aa, Staphylococcus epidermidis
TYDAD

SEQ ID NO: 1791842 - protein, 9 aa, Staphylococcus epidermidis
TYDEAKGQR

SEQ ID NO: 1791843 - protein, 19 aa, Staphylococcus epidermidis
TYDNKGRPQSNKKKYPVKM

SEQ ID NO: 1791844 - protein, 5 aa, Staphylococcus epidermidis
TYDTS

SEQ ID NO: 1791845 - protein, 9 aa, Staphylococcus epidermidis
TYEKESNNE

SEQ ID NO: 1791846 - protein, 18 aa, Staphylococcus epidermidis
TYEKQIKNEYDPQLEKER

SEQ ID NO: 1791847 - protein, 7 aa, Staphylococcus epidermidis
TYENDNL

SEQ ID NO: 1791848 - protein, 15 aa, Staphylococcus epidermidis
TYEQDNKKALKLIEN

SEQ ID NO: 1791849 - protein, 17 aa, Staphylococcus epidermidis
TYERKDREGIFHTQWVE

SEQ ID NO: 1791850 - protein, 12 aa, Staphylococcus epidermidis
TYETENESIVTD

SEQ ID NO: 1791851 - protein, 13 aa, Staphylococcus epidermidis
TYEYKEKPYEKDY

SEQ ID NO: 1791852 - protein, 6 aa, Staphylococcus epidermidis
TYFKKG

SEQ ID NO: 1791853 - protein, 9 aa, Staphylococcus epidermidis
TYGAASKGI

SEQ ID NO: 1791854 - protein, 19 aa, Staphylococcus epidermidis
TYGAMKDKYNGLYDPRQAN

SEQ ID NO: 1791855 - protein, 9 aa, Staphylococcus epidermidis
TYGDASSRF

SEQ ID NO: 1791856 - protein, 10 aa, Staphylococcus epidermidis
TYGDNNKSFT

SEQ ID NO: 1791857 - protein, 15 aa, Staphylococcus epidermidis
TYGKTGQGIHGNTAR

SEQ ID NO: 1791858 - protein, 8 aa, Staphylococcus epidermidis
TYGPTEAT

SEQ ID NO: 1791859 - protein, 4 aa, Staphylococcus epidermidis
TYGQ

SEQ ID NO: 1791860 - protein, 7 aa, Staphylococcus epidermidis
TYGQTPK

SEQ ID NO: 1791861 - protein, 8 aa, Staphylococcus epidermidis
TYGTDDQH

SEQ ID NO: 1791862 - protein, 9 aa, Staphylococcus epidermidis
TYGYSAEAA

SEQ ID NO: 1791863 - protein, 5 aa, Staphylococcus epidermidis
TYIDE

SEQ ID NO: 1791864 - protein, 6 aa, Staphylococcus epidermidis
TYIPND

SEQ ID NO: 1791865 - protein, 7 aa, Staphylococcus epidermidis
TYKKASK

SEQ ID NO: 1791866 - protein, 8 aa, Staphylococcus epidermidis
TYKKASKD

SEQ ID NO: 1791867 - protein, 28 aa, Staphylococcus epidermidis
TYNIPTKKAPKLTMSGNEKLSGNSVGRE

SEQ ID NO: 1791868 - protein, 11 aa, Staphylococcus epidermidis
TYNPAHVNAPE

SEQ ID NO: 1791869 - protein, 7 aa, Staphylococcus epidermidis
TYPKGEY

SEQ ID NO: 1791870 - protein, 5 aa, Staphylococcus epidermidis
TYPNR

SEQ ID NO: 1791871 - protein, 5 aa, Staphylococcus epidermidis
TYQQN

SEQ ID NO: 1791872 - protein, 6 aa, Staphylococcus epidermidis
TYRNAT

SEQ ID NO: 1791873 - protein, 10 aa, Staphylococcus epidermidis
TYRSSDGDTI

SEQ ID NO: 1791874 - protein, 11 aa, Staphylococcus epidermidis
TYSKSSINNRY

SEQ ID NO: 1791875 - protein, 9 aa, Staphylococcus epidermidis
TYSNSATKI

SEQ ID NO: 1791876 - protein, 9 aa, Staphylococcus epidermidis
TYSQRETID

SEQ ID NO: 1791877 - protein, 5 aa, Staphylococcus epidermidis
TYTED

SEQ ID NO: 1791878 - protein, 10 aa, Staphylococcus epidermidis
TYTETGGKAD

SEQ ID NO: 1791879 - protein, 4 aa, Staphylococcus epidermidis
TYTI

SEQ ID NO: 1791880 - protein, 4 aa, Staphylococcus epidermidis
TYTL

SEQ ID NO: 1791881 - protein, 20 aa, Staphylococcus epidermidis
TYTSDGDNNKKHYFSKDGEE

SEQ ID NO: 1791882 - protein, 8 aa, Staphylococcus epidermidis
TYTSEQKI

SEQ ID NO: 1791883 - protein, 12 aa, Staphylococcus epidermidis
TYTTESFQEPST

SEQ ID NO: 1791884 - protein, 8 aa, Staphylococcus epidermidis
TYVTEGKN

SEQ ID NO: 1791885 - protein, 6 aa, Staphylococcus epidermidis
VAADSA

SEQ ID NO: 1791886 - protein, 10 aa, Staphylococcus epidermidis
VADDLSEKLG

SEQ ID NO: 1791887 - protein, 4 aa, Staphylococcus epidermidis
VADE

SEQ ID NO: 1791888 - protein, 7 aa, Staphylococcus epidermidis
VADENIK

SEQ ID NO: 1791889 - protein, 6 aa, Staphylococcus epidermidis
VADGST

SEQ ID NO: 1791890 - protein, 12 aa, Staphylococcus epidermidis
VADSSEEDGTVG

SEQ ID NO: 1791891 - protein, 6 aa, Staphylococcus epidermidis
VAEETL

SEQ ID NO: 1791892 - protein, 7 aa, Staphylococcus epidermidis
VAEPAGA

SEQ ID NO: 1791893 - protein, 12 aa, Staphylococcus epidermidis
VAETGAGQHGVA

SEQ ID NO: 1791894 - protein, 14 aa, Staphylococcus epidermidis
VAETGAGQHGVASA

SEQ ID NO: 1791895 - protein, 17 aa, Staphylococcus epidermidis
VAEVEEGGKVTSVNSKL

SEQ ID NO: 1791896 - protein, 13 aa, Staphylococcus epidermidis
VAGAGGKASLQAY

SEQ ID NO: 1791897 - protein, 8 aa, Staphylococcus epidermidis
VAGEDLAQ

SEQ ID NO: 1791898 - protein, 11 aa, Staphylococcus epidermidis
VAGNPTKGTEN

SEQ ID NO: 1791899 - protein, 11 aa, Staphylococcus epidermidis
VAGSASDDVSE

SEQ ID NO: 1791900 - protein, 9 aa, Staphylococcus epidermidis
VAGSGKSSL

SEQ ID NO: 1791901 - protein, 14 aa, Staphylococcus epidermidis
VAGTNGKPLTSDRN

SEQ ID NO: 1791902 - protein, 8 aa, Staphylococcus epidermidis
VAKDTNDS

SEQ ID NO: 1791903 - protein, 17 aa, Staphylococcus epidermidis
VAKGNADDVNKAVEAAD

SEQ ID NO: 1791904 - protein, 9 aa, Staphylococcus epidermidis
VAKQNASHY

SEQ ID NO: 1791905 - protein, 5 aa, Staphylococcus epidermidis
VAKQR

SEQ ID NO: 1791906 - protein, 8 aa, Staphylococcus epidermidis
VAKRNDAK

SEQ ID NO: 1791907 - protein, 12 aa, Staphylococcus epidermidis
VAKRSKIPVIIV

SEQ ID NO: 1791908 - protein, 12 aa, Staphylococcus epidermidis
VAKRSQIPVIIV

SEQ ID NO: 1791909 - protein, 19 aa, Staphylococcus epidermidis
VANELDSNAETVDEYKENL

SEQ ID NO: 1791910 - protein, 7 aa, Staphylococcus epidermidis
VANGDEV

SEQ ID NO: 1791911 - protein, 16 aa, Staphylococcus epidermidis
VAPAKSPNYVKVVGEE

SEQ ID NO: 1791912 - protein, 8 aa, Staphylococcus epidermidis
VAPRNDGE

SEQ ID NO: 1791913 - protein, 6 aa, Staphylococcus epidermidis
VAPSPM

SEQ ID NO: 1791914 - protein, 9 aa, Staphylococcus epidermidis
VAQEARPDE

SEQ ID NO: 1791915 - protein, 11 aa, Staphylococcus epidermidis
VAQPDVTETDA

SEQ ID NO: 1791916 - protein, 12 aa, Staphylococcus epidermidis
VAQPDVTETDAI

SEQ ID NO: 1791917 - protein, 39 aa, Staphylococcus epidermidis
VAQQPAQQIAQPQAAPQPQVSADAGNDTQESASDNYETI

SEQ ID NO: 1791918 - protein, 6 aa, Staphylococcus epidermidis
VAQSEG

SEQ ID NO: 1791919 - protein, 4 aa, Staphylococcus epidermidis
VARD

SEQ ID NO: 1791920 - protein, 5 aa, Staphylococcus epidermidis
VARDK

SEQ ID NO: 1791921 - protein, 10 aa, Staphylococcus epidermidis
VASNKGLRAA

SEQ ID NO: 1791922 - protein, 10 aa, Staphylococcus epidermidis
VASNKGLRAS

SEQ ID NO: 1791923 - protein, 6 aa, Staphylococcus epidermidis
VASPTL

SEQ ID NO: 1791924 - protein, 7 aa, Staphylococcus epidermidis
VASSAPE

SEQ ID NO: 1791925 - protein, 17 aa, Staphylococcus epidermidis
VATKYTPKGIHQNKVAT

SEQ ID NO: 1791926 - protein, 15 aa, Staphylococcus epidermidis
VATSSEKSQIQNREK

SEQ ID NO: 1791927 - protein, 17 aa, Staphylococcus epidermidis
VATYETQYNVSSGTNYQ

SEQ ID NO: 1791928 - protein, 6 aa, Staphylococcus epidermidis
VAVGDT

SEQ ID NO: 1791929 - protein, 14 aa, Staphylococcus epidermidis
VAYESSPATSQMEE

SEQ ID NO: 1791930 - protein, 27 aa, Staphylococcus epidermidis
VCETNSNDTEFNDTEFNDTEFNDTNDM

SEQ ID NO: 1791931 - protein, 8 aa, Staphylococcus epidermidis
VCTGRGEK

SEQ ID NO: 1791932 - protein, 14 aa, Staphylococcus epidermidis
VDAGEVGADGFDDS

SEQ ID NO: 1791933 - protein, 6 aa, Staphylococcus epidermidis
VDASNK

SEQ ID NO: 1791934 - protein, 8 aa, Staphylococcus epidermidis
VDASPYRQ

SEQ ID NO: 1791935 - protein, 4 aa, Staphylococcus epidermidis
VDDE

SEQ ID NO: 1791936 - protein, 11 aa, Staphylococcus epidermidis
VDDEDATERKV

SEQ ID NO: 1791937 - protein, 13 aa, Staphylococcus epidermidis
VDDKEIAQGGAAL

SEQ ID NO: 1791938 - protein, 10 aa, Staphylococcus epidermidis
VDDKNTHDED

SEQ ID NO: 1791939 - protein, 15 aa, Staphylococcus epidermidis
VDDQLADEIVKALEA

SEQ ID NO: 1791940 - protein, 30 aa, Staphylococcus epidermidis
VDDQTPGNAIHTEGDAETESVESPENDDRI

SEQ ID NO: 1791941 - protein, 9 aa, Staphylococcus epidermidis
VDDSINKEG

SEQ ID NO: 1791942 - protein, 8 aa, Staphylococcus epidermidis
VDDTGSLA

SEQ ID NO: 1791943 - protein, 4 aa, Staphylococcus epidermidis
VDED

SEQ ID NO: 1791944 - protein, 10 aa, Staphylococcus epidermidis
VDEEDNTYKE

SEQ ID NO: 1791945 - protein, 11 aa, Staphylococcus epidermidis
VDEEELRSGRK

SEQ ID NO: 1791946 - protein, 4 aa, Staphylococcus epidermidis
VDER

SEQ ID NO: 1791947 - protein, 4 aa, Staphylococcus epidermidis
VDFG

SEQ ID NO: 1791948 - protein, 9 aa, Staphylococcus epidermidis
VDGEQTAFP

SEQ ID NO: 1791949 - protein, 8 aa, Staphylococcus epidermidis
VDGSTGDI

SEQ ID NO: 1791950 - protein, 7 aa, Staphylococcus epidermidis
VDGTDDE

SEQ ID NO: 1791951 - protein, 8 aa, Staphylococcus epidermidis
VDHKETIS

SEQ ID NO: 1791952 - protein, 7 aa, Staphylococcus epidermidis
VDKATEN

SEQ ID NO: 1791953 - protein, 9 aa, Staphylococcus epidermidis
VDKDGKDTP

SEQ ID NO: 1791954 - protein, 8 aa, Staphylococcus epidermidis
VDKEEMNR

SEQ ID NO: 1791955 - protein, 10 aa, Staphylococcus epidermidis
VDKGKKAYTK

SEQ ID NO: 1791956 - protein, 6 aa, Staphylococcus epidermidis
VDKGKS

SEQ ID NO: 1791957 - protein, 16 aa, Staphylococcus epidermidis
VDKNGLYNSYRLSIAP

SEQ ID NO: 1791958 - protein, 7 aa, Staphylococcus epidermidis
VDKNPMG

SEQ ID NO: 1791959 - protein, 4 aa, Staphylococcus epidermidis
VDKP

SEQ ID NO: 1791960 - protein, 7 aa, Staphylococcus epidermidis
VDKPGAF

SEQ ID NO: 1791961 - protein, 13 aa, Staphylococcus epidermidis
VDKPRNLAKSVTV

SEQ ID NO: 1791962 - protein, 8 aa, Staphylococcus epidermidis
VDKQVKEY

SEQ ID NO: 1791963 - protein, 16 aa, Staphylococcus epidermidis
VDKRREEFHPSGSRSH

SEQ ID NO: 1791964 - protein, 7 aa, Staphylococcus epidermidis
VDKSGAW

SEQ ID NO: 1791965 - protein, 12 aa, Staphylococcus epidermidis
VDKSRSKEDERN

SEQ ID NO: 1791966 - protein, 10 aa, Staphylococcus epidermidis
VDMTTPKPIE

SEQ ID NO: 1791967 - protein, 4 aa, Staphylococcus epidermidis
VDNA

SEQ ID NO: 1791968 - protein, 4 aa, Staphylococcus epidermidis
VDND

SEQ ID NO: 1791969 - protein, 8 aa, Staphylococcus epidermidis
VDNGLASD

SEQ ID NO: 1791970 - protein, 7 aa, Staphylococcus epidermidis
VDNPEMR

SEQ ID NO: 1791971 - protein, 8 aa, Staphylococcus epidermidis
VDNPQKKN

SEQ ID NO: 1791972 - protein, 11 aa, Staphylococcus epidermidis
VDNYSSAGSFR

SEQ ID NO: 1791973 - protein, 7 aa, Staphylococcus epidermidis
VDPAANP

SEQ ID NO: 1791974 - protein, 25 aa, Staphylococcus epidermidis
VDPDRQQIASTWPDSIDTSCSRGEW

SEQ ID NO: 1791975 - protein, 6 aa, Staphylococcus epidermidis
VDPNAI

SEQ ID NO: 1791976 - protein, 15 aa, Staphylococcus epidermidis
VDPNDPAKLLPEEEE

SEQ ID NO: 1791977 - protein, 9 aa, Staphylococcus epidermidis
VDPNNPAEL

SEQ ID NO: 1791978 - protein, 9 aa, Staphylococcus epidermidis
VDQETSDHL

SEQ ID NO: 1791979 - protein, 4 aa, Staphylococcus epidermidis
VDQL

SEQ ID NO: 1791980 - protein, 11 aa, Staphylococcus epidermidis
VDQLPESEEDV

SEQ ID NO: 1791981 - protein, 5 aa, Staphylococcus epidermidis
VDQNT

SEQ ID NO: 1791982 - protein, 8 aa, Staphylococcus epidermidis
VDQPQEEL

SEQ ID NO: 1791983 - protein, 10 aa, Staphylococcus epidermidis
VDQSEEELYR

SEQ ID NO: 1791984 - protein, 7 aa, Staphylococcus epidermidis
VDRENSI

SEQ ID NO: 1791985 - protein, 10 aa, Staphylococcus epidermidis
VDSDTGAKAA

SEQ ID NO: 1791986 - protein, 4 aa, Staphylococcus epidermidis
VDSE

SEQ ID NO: 1791987 - protein, 6 aa, Staphylococcus epidermidis
VDSGGK

SEQ ID NO: 1791988 - protein, 14 aa, Staphylococcus epidermidis
VDSIPSSANQEDHV

SEQ ID NO: 1791989 - protein, 8 aa, Staphylococcus epidermidis
VDSNDHSL

SEQ ID NO: 1791990 - protein, 11 aa, Staphylococcus epidermidis
VDSNDKSLDKV

SEQ ID NO: 1791991 - protein, 6 aa, Staphylococcus epidermidis
VDSPTF

SEQ ID NO: 1791992 - protein, 8 aa, Staphylococcus epidermidis
VDSQRRVS

SEQ ID NO: 1791993 - protein, 12 aa, Staphylococcus epidermidis
VDSSETERGNVT

SEQ ID NO: 1791994 - protein, 12 aa, Staphylococcus epidermidis
VDSSYGPTWYDA

SEQ ID NO: 1791995 - protein, 7 aa, Staphylococcus epidermidis
VDSTSEI

SEQ ID NO: 1791996 - protein, 5 aa, Staphylococcus epidermidis
VDSVN

SEQ ID NO: 1791997 - protein, 4 aa, Staphylococcus epidermidis
VDTN

SEQ ID NO: 1791998 - protein, 7 aa, Staphylococcus epidermidis
VDTSEHT

SEQ ID NO: 1791999 - protein, 19 aa, Staphylococcus epidermidis
VDTTASAIQLSKDNKAYIN

SEQ ID NO: 1792000 - protein, 5 aa, Staphylococcus epidermidis
VDVAR

SEQ ID NO: 1792001 - protein, 13 aa, Staphylococcus epidermidis
VDVPNAKAIRSTM

SEQ ID NO: 1792002 - protein, 13 aa, Staphylococcus epidermidis
VDYDKKRNNKITE

SEQ ID NO: 1792003 - protein, 10 aa, Staphylococcus epidermidis
VEAAKQAAKA

SEQ ID NO: 1792004 - protein, 8 aa, Staphylococcus epidermidis
VEAEGDKF

SEQ ID NO: 1792005 - protein, 10 aa, Staphylococcus epidermidis
VEAEGEKYRN

SEQ ID NO: 1792006 - protein, 13 aa, Staphylococcus epidermidis
VEAGQSASTSSYL

SEQ ID NO: 1792007 - protein, 6 aa, Staphylococcus epidermidis
VEAGRY

SEQ ID NO: 1792008 - protein, 9 aa, Staphylococcus epidermidis
VEAPEENES

SEQ ID NO: 1792009 - protein, 4 aa, Staphylococcus epidermidis
VEAQ

SEQ ID NO: 1792010 - protein, 14 aa, Staphylococcus epidermidis
VEAQYDGEVPSEPE

SEQ ID NO: 1792011 - protein, 6 aa, Staphylococcus epidermidis
VEASQG

SEQ ID NO: 1792012 - protein, 36 aa, Staphylococcus epidermidis
VEATPGNLKQLEQQNKRAEADRQQEIDEAKALKEKL

SEQ ID NO: 1792013 - protein, 10 aa, Staphylococcus epidermidis
VEDAPAKLSN

SEQ ID NO: 1792014 - protein, 14 aa, Staphylococcus epidermidis
VEDDEDVTKYARAS

SEQ ID NO: 1792015 - protein, 7 aa, Staphylococcus epidermidis
VEDMSAT

SEQ ID NO: 1792016 - protein, 9 aa, Staphylococcus epidermidis
VEEAHKHGK

SEQ ID NO: 1792017 - protein, 8 aa, Staphylococcus epidermidis
VEEDENVG

SEQ ID NO: 1792018 - protein, 10 aa, Staphylococcus epidermidis
VEEDKEPFEQ

SEQ ID NO: 1792019 - protein, 12 aa, Staphylococcus epidermidis
VEEGQGTLSDAV

SEQ ID NO: 1792020 - protein, 7 aa, Staphylococcus epidermidis
VEEGSKA

SEQ ID NO: 1792021 - protein, 16 aa, Staphylococcus epidermidis
VEEKEKLELENNMNKQ

SEQ ID NO: 1792022 - protein, 7 aa, Staphylococcus epidermidis
VEESPTI

SEQ ID NO: 1792023 - protein, 17 aa, Staphylococcus epidermidis
VEETESEEDTPKTLFDE

SEQ ID NO: 1792024 - protein, 5 aa, Staphylococcus epidermidis
VEGAE

SEQ ID NO: 1792025 - protein, 12 aa, Staphylococcus epidermidis
VEGAQTGQTYKV

SEQ ID NO: 1792026 - protein, 9 aa, Staphylococcus epidermidis
VEGDTPDDL

SEQ ID NO: 1792027 - protein, 7 aa, Staphylococcus epidermidis
VEGEPSK

SEQ ID NO: 1792028 - protein, 7 aa, Staphylococcus epidermidis
VEGESGY

SEQ ID NO: 1792029 - protein, 11 aa, Staphylococcus epidermidis
VEGLEKETARI

SEQ ID NO: 1792030 - protein, 15 aa, Staphylococcus epidermidis
VEGTNKAIASTIDGE

SEQ ID NO: 1792031 - protein, 33 aa, Staphylococcus epidermidis
VEKALRQDSPVCTQSNKMTKDEESDYLVSGRKC

SEQ ID NO: 1792032 - protein, 6 aa, Staphylococcus epidermidis
VEKEFE

SEQ ID NO: 1792033 - protein, 21 aa, Staphylococcus epidermidis
VEKEGKDAANEAQDKAEKEGK

SEQ ID NO: 1792034 - protein, 10 aa, Staphylococcus epidermidis
VEKESKDPHS

SEQ ID NO: 1792035 - protein, 22 aa, Staphylococcus epidermidis
VEKGTTGEGVESVTGYTGHDAA

SEQ ID NO: 1792036 - protein, 14 aa, Staphylococcus epidermidis
VEKHNAKTKNPRLA

SEQ ID NO: 1792037 - protein, 10 aa, Staphylococcus epidermidis
VEKKSEKRCK

SEQ ID NO: 1792038 - protein, 9 aa, Staphylococcus epidermidis
VEKKVDKAA

SEQ ID NO: 1792039 - protein, 6 aa, Staphylococcus epidermidis
VEKNGY

SEQ ID NO: 1792040 - protein, 8 aa, Staphylococcus epidermidis
VEKNLPGV

SEQ ID NO: 1792041 - protein, 7 aa, Staphylococcus epidermidis
VEKNPMG

SEQ ID NO: 1792042 - protein, 7 aa, Staphylococcus epidermidis
VEKPTYI

SEQ ID NO: 1792043 - protein, 8 aa, Staphylococcus epidermidis
VEKPVETE

SEQ ID NO: 1792044 - protein, 17 aa, Staphylococcus epidermidis
VEKRREEFHPSGRRSNL

SEQ ID NO: 1792045 - protein, 5 aa, Staphylococcus epidermidis
VEKSI

SEQ ID NO: 1792046 - protein, 12 aa, Staphylococcus epidermidis
VELQDTQLTPEN

SEQ ID NO: 1792047 - protein, 14 aa, Staphylococcus epidermidis
VELSDGKVKPAKLI

SEQ ID NO: 1792048 - protein, 5 aa, Staphylococcus epidermidis
VENAA

SEQ ID NO: 1792049 - protein, 5 aa, Staphylococcus epidermidis
VENAQ

SEQ ID NO: 1792050 - protein, 4 aa, Staphylococcus epidermidis
VENE

SEQ ID NO: 1792051 - protein, 12 aa, Staphylococcus epidermidis
VENEIGKEEQFK

SEQ ID NO: 1792052 - protein, 4 aa, Staphylococcus epidermidis
VENF

SEQ ID NO: 1792053 - protein, 8 aa, Staphylococcus epidermidis
VENGNQDP

SEQ ID NO: 1792054 - protein, 9 aa, Staphylococcus epidermidis
VENGTSYKY

SEQ ID NO: 1792055 - protein, 6 aa, Staphylococcus epidermidis
VENKGS

SEQ ID NO: 1792056 - protein, 6 aa, Staphylococcus epidermidis
VENNDL

SEQ ID NO: 1792057 - protein, 4 aa, Staphylococcus epidermidis
VENS

SEQ ID NO: 1792058 - protein, 10 aa, Staphylococcus epidermidis
VENSDECKDA

SEQ ID NO: 1792059 - protein, 5 aa, Staphylococcus epidermidis
VEPDL

SEQ ID NO: 1792060 - protein, 6 aa, Staphylococcus epidermidis
VEPGES

SEQ ID NO: 1792061 - protein, 29 aa, Staphylococcus epidermidis
VEPGLSEKLTQNLREKQEIGKRAAQEIQD

SEQ ID NO: 1792062 - protein, 5 aa, Staphylococcus epidermidis
VEPST

SEQ ID NO: 1792063 - protein, 17 aa, Staphylococcus epidermidis
VEPTKAQRKNKNLITEF

SEQ ID NO: 1792064 - protein, 7 aa, Staphylococcus epidermidis
VEQDPAA

SEQ ID NO: 1792065 - protein, 5 aa, Staphylococcus epidermidis
VEQGY

SEQ ID NO: 1792066 - protein, 17 aa, Staphylococcus epidermidis
VEQIDTPDGFRTRPKSD

SEQ ID NO: 1792067 - protein, 22 aa, Staphylococcus epidermidis
VEQNDNKFTVTASKKLDKTTIK

SEQ ID NO: 1792068 - protein, 11 aa, Staphylococcus epidermidis
VEQNGQSNEVS

SEQ ID NO: 1792069 - protein, 16 aa, Staphylococcus epidermidis
VEQQTTKVNGKFTSSF

SEQ ID NO: 1792070 - protein, 7 aa, Staphylococcus epidermidis
VERDYSK

SEQ ID NO: 1792071 - protein, 12 aa, Staphylococcus epidermidis
VERPEIQETTAL

SEQ ID NO: 1792072 - protein, 27 aa, Staphylococcus epidermidis
VERPIPNPDFNENYDEEEYLSRSERPE

SEQ ID NO: 1792073 - protein, 9 aa, Staphylococcus epidermidis
VERSNNTIR

SEQ ID NO: 1792074 - protein, 11 aa, Staphylococcus epidermidis
VERSSSAGIGK

SEQ ID NO: 1792075 - protein, 11 aa, Staphylococcus epidermidis
VESADEEEKIN

SEQ ID NO: 1792076 - protein, 18 aa, Staphylococcus epidermidis
VESAGGTIIDPPGVKQGY

SEQ ID NO: 1792077 - protein, 8 aa, Staphylococcus epidermidis
VESDTPAI

SEQ ID NO: 1792078 - protein, 7 aa, Staphylococcus epidermidis
VESETTF

SEQ ID NO: 1792079 - protein, 10 aa, Staphylococcus epidermidis
VESGELDEKY

SEQ ID NO: 1792080 - protein, 8 aa, Staphylococcus epidermidis
VESGPTED

SEQ ID NO: 1792081 - protein, 5 aa, Staphylococcus epidermidis
VESGS

SEQ ID NO: 1792082 - protein, 6 aa, Staphylococcus epidermidis
VESGSP

SEQ ID NO: 1792083 - protein, 6 aa, Staphylococcus epidermidis
VESKKQ

SEQ ID NO: 1792084 - protein, 8 aa, Staphylococcus epidermidis
VESKNDLV

SEQ ID NO: 1792085 - protein, 13 aa, Staphylococcus epidermidis
VESLASEAREKLA

SEQ ID NO: 1792086 - protein, 8 aa, Staphylococcus epidermidis
VESQNDLV

SEQ ID NO: 1792087 - protein, 4 aa, Staphylococcus epidermidis
VETA

SEQ ID NO: 1792088 - protein, 11 aa, Staphylococcus epidermidis
VETADTPSEIG

SEQ ID NO: 1792089 - protein, 5 aa, Staphylococcus epidermidis
VETED

SEQ ID NO: 1792090 - protein, 5 aa, Staphylococcus epidermidis
VETEG

SEQ ID NO: 1792091 - protein, 5 aa, Staphylococcus epidermidis
VETER

SEQ ID NO: 1792092 - protein, 11 aa, Staphylococcus epidermidis
VETGISETQDF

SEQ ID NO: 1792093 - protein, 13 aa, Staphylococcus epidermidis
VETNTSASTEISQ

SEQ ID NO: 1792094 - protein, 9 aa, Staphylococcus epidermidis
VETPNSLKN

SEQ ID NO: 1792095 - protein, 6 aa, Staphylococcus epidermidis
VETPNY

SEQ ID NO: 1792096 - protein, 4 aa, Staphylococcus epidermidis
VETS

SEQ ID NO: 1792097 - protein, 5 aa, Staphylococcus epidermidis
VETSN

SEQ ID NO: 1792098 - protein, 6 aa, Staphylococcus epidermidis
VETSTE

SEQ ID NO: 1792099 - protein, 6 aa, Staphylococcus epidermidis
VETTSQ

SEQ ID NO: 1792100 - protein, 12 aa, Staphylococcus epidermidis
VEVDQPVSKENF

SEQ ID NO: 1792101 - protein, 6 aa, Staphylococcus epidermidis
VEVEET

SEQ ID NO: 1792102 - protein, 11 aa, Staphylococcus epidermidis
VEYDDGDSDLI

SEQ ID NO: 1792103 - protein, 13 aa, Staphylococcus epidermidis
VEYGNTSGYFESD

SEQ ID NO: 1792104 - protein, 9 aa, Staphylococcus epidermidis
VEYKKDDTF

SEQ ID NO: 1792105 - protein, 9 aa, Staphylococcus epidermidis
VEYRSKTDN

SEQ ID NO: 1792106 - protein, 6 aa, Staphylococcus epidermidis
VFDDES

SEQ ID NO: 1792107 - protein, 4 aa, Staphylococcus epidermidis
VFED

SEQ ID NO: 1792108 - protein, 7 aa, Staphylococcus epidermidis
VGAADIP

SEQ ID NO: 1792109 - protein, 18 aa, Staphylococcus epidermidis
VGAEKTKLSTAYSNINTK

SEQ ID NO: 1792110 - protein, 5 aa, Staphylococcus epidermidis
VGAPR

SEQ ID NO: 1792111 - protein, 6 aa, Staphylococcus epidermidis
VGAPTQ

SEQ ID NO: 1792112 - protein, 14 aa, Staphylococcus epidermidis
VGAQHPKYVQRPSV

SEQ ID NO: 1792113 - protein, 8 aa, Staphylococcus epidermidis
VGASGAVP

SEQ ID NO: 1792114 - protein, 9 aa, Staphylococcus epidermidis
VGDEVKANQ

SEQ ID NO: 1792115 - protein, 10 aa, Staphylococcus epidermidis
VGDRVTKGDS

SEQ ID NO: 1792116 - protein, 9 aa, Staphylococcus epidermidis
VGDTVTEGD

SEQ ID NO: 1792117 - protein, 10 aa, Staphylococcus epidermidis
VGEEQAENFG

SEQ ID NO: 1792118 - protein, 8 aa, Staphylococcus epidermidis
VGEGAYEN

SEQ ID NO: 1792119 - protein, 9 aa, Staphylococcus epidermidis
VGEHVEKDE

SEQ ID NO: 1792120 - protein, 10 aa, Staphylococcus epidermidis
VGEKTKVGPF

SEQ ID NO: 1792121 - protein, 9 aa, Staphylococcus epidermidis
VGENGEIKG

SEQ ID NO: 1792122 - protein, 8 aa, Staphylococcus epidermidis
VGEPDPKM

SEQ ID NO: 1792123 - protein, 7 aa, Staphylococcus epidermidis
VGEPEDP

SEQ ID NO: 1792124 - protein, 6 aa, Staphylococcus epidermidis
VGEPTL

SEQ ID NO: 1792125 - protein, 7 aa, Staphylococcus epidermidis
VGEQLEG

SEQ ID NO: 1792126 - protein, 4 aa, Staphylococcus epidermidis
VGER

SEQ ID NO: 1792127 - protein, 15 aa, Staphylococcus epidermidis
VGESRKPNRKEPKQI

SEQ ID NO: 1792128 - protein, 20 aa, Staphylococcus epidermidis
VGGKTRELGTAKEHKAGTVA

SEQ ID NO: 1792129 - protein, 34 aa, Staphylococcus epidermidis
VGGNSQGAVGTINSSTQNHSIKGTTTNPARLPDG

SEQ ID NO: 1792130 - protein, 6 aa, Staphylococcus epidermidis
VGIDPS

SEQ ID NO: 1792131 - protein, 8 aa, Staphylococcus epidermidis
VGKEGNAD

SEQ ID NO: 1792132 - protein, 7 aa, Staphylococcus epidermidis
VGKKGGV

SEQ ID NO: 1792133 - protein, 4 aa, Staphylococcus epidermidis
VGKS

SEQ ID NO: 1792134 - protein, 5 aa, Staphylococcus epidermidis
VGKVS

SEQ ID NO: 1792135 - protein, 15 aa, Staphylococcus epidermidis
VGLSEEQAKEAGYDV

SEQ ID NO: 1792136 - protein, 5 aa, Staphylococcus epidermidis
VGMDS

SEQ ID NO: 1792137 - protein, 4 aa, Staphylococcus epidermidis
VGNE

SEQ ID NO: 1792138 - protein, 13 aa, Staphylococcus epidermidis
VGNGFDEDTEMGP

SEQ ID NO: 1792139 - protein, 4 aa, Staphylococcus epidermidis
VGNK

SEQ ID NO: 1792140 - protein, 13 aa, Staphylococcus epidermidis
VGNPREEGTQVGP

SEQ ID NO: 1792141 - protein, 10 aa, Staphylococcus epidermidis
VGNQARELQN

SEQ ID NO: 1792142 - protein, 6 aa, Staphylococcus epidermidis
VGNYSD

SEQ ID NO: 1792143 - protein, 7 aa, Staphylococcus epidermidis
VGPEYTD

SEQ ID NO: 1792144 - protein, 8 aa, Staphylococcus epidermidis
VGPFEYEQ

SEQ ID NO: 1792145 - protein, 12 aa, Staphylococcus epidermidis
VGPGGSRAKNIP

SEQ ID NO: 1792146 - protein, 10 aa, Staphylococcus epidermidis
VGPNGAGKTT

SEQ ID NO: 1792147 - protein, 7 aa, Staphylococcus epidermidis
VGPPGKI

SEQ ID NO: 1792148 - protein, 10 aa, Staphylococcus epidermidis
VGPTPPDKDH

SEQ ID NO: 1792149 - protein, 8 aa, Staphylococcus epidermidis
VGQDDEAV

SEQ ID NO: 1792150 - protein, 17 aa, Staphylococcus epidermidis
VGQETAKEFEEATDNKA

SEQ ID NO: 1792151 - protein, 8 aa, Staphylococcus epidermidis
VGQGAFEN

SEQ ID NO: 1792152 - protein, 14 aa, Staphylococcus epidermidis
VGQPREEGTQVGPI

SEQ ID NO: 1792153 - protein, 11 aa, Staphylococcus epidermidis
VGQTEEELAKS

SEQ ID NO: 1792154 - protein, 12 aa, Staphylococcus epidermidis
VGQTKDEEGNRG

SEQ ID NO: 1792155 - protein, 8 aa, Staphylococcus epidermidis
VGQTQDEL

SEQ ID NO: 1792156 - protein, 5 aa, Staphylococcus epidermidis
VGRDC

SEQ ID NO: 1792157 - protein, 7 aa, Staphylococcus epidermidis
VGSDENI

SEQ ID NO: 1792158 - protein, 10 aa, Staphylococcus epidermidis
VGSDKDTKFR

SEQ ID NO: 1792159 - protein, 10 aa, Staphylococcus epidermidis
VGSGKTGQEI

SEQ ID NO: 1792160 - protein, 6 aa, Staphylococcus epidermidis
VGSHTN

SEQ ID NO: 1792161 - protein, 7 aa, Staphylococcus epidermidis
VGSKGTI

SEQ ID NO: 1792162 - protein, 5 aa, Staphylococcus epidermidis
VGSNV

SEQ ID NO: 1792163 - protein, 10 aa, Staphylococcus epidermidis
VGSSKGESYK

SEQ ID NO: 1792164 - protein, 11 aa, Staphylococcus epidermidis
VGSTEQIKANH

SEQ ID NO: 1792165 - protein, 7 aa, Staphylococcus epidermidis
VGTASKI

SEQ ID NO: 1792166 - protein, 8 aa, Staphylococcus epidermidis
VGTGTQRV

SEQ ID NO: 1792167 - protein, 7 aa, Staphylococcus epidermidis
VGTNEDS

SEQ ID NO: 1792168 - protein, 7 aa, Staphylococcus epidermidis
VGTRNEV

SEQ ID NO: 1792169 - protein, 8 aa, Staphylococcus epidermidis
VGTTHDRR

SEQ ID NO: 1792170 - protein, 12 aa, Staphylococcus epidermidis
VGVSTTTVYRTL

SEQ ID NO: 1792171 - protein, 6 aa, Staphylococcus epidermidis
VGYPKR

SEQ ID NO: 1792172 - protein, 4 aa, Staphylococcus epidermidis
VHAE

SEQ ID NO: 1792173 - protein, 16 aa, Staphylococcus epidermidis
VHDEKAGAMEDDPFYQ

SEQ ID NO: 1792174 - protein, 4 aa, Staphylococcus epidermidis
VHEQ

SEQ ID NO: 1792175 - protein, 8 aa, Staphylococcus epidermidis
VHNTPPPK

SEQ ID NO: 1792176 - protein, 4 aa, Staphylococcus epidermidis
VHRD

SEQ ID NO: 1792177 - protein, 8 aa, Staphylococcus epidermidis
VHRGASRP

SEQ ID NO: 1792178 - protein, 6 aa, Staphylococcus epidermidis
VHSPSH

SEQ ID NO: 1792179 - protein, 10 aa, Staphylococcus epidermidis
VIATNGSDEL

SEQ ID NO: 1792180 - protein, 14 aa, Staphylococcus epidermidis
VIDPEGNDVTPEKL

SEQ ID NO: 1792181 - protein, 23 aa, Staphylococcus epidermidis
VIDPEGNDVTPEKLKKIQEENHN

SEQ ID NO: 1792182 - protein, 4 aa, Staphylococcus epidermidis
VIEN

SEQ ID NO: 1792183 - protein, 6 aa, Staphylococcus epidermidis
VIEQGK

SEQ ID NO: 1792184 - protein, 14 aa, Staphylococcus epidermidis
VIEQKQQEKQKSLY

SEQ ID NO: 1792185 - protein, 11 aa, Staphylococcus epidermidis
VIKNEEETDEV

SEQ ID NO: 1792186 - protein, 7 aa, Staphylococcus epidermidis
VINASGP

SEQ ID NO: 1792187 - protein, 5 aa, Staphylococcus epidermidis
VINDP

SEQ ID NO: 1792188 - protein, 6 aa, Staphylococcus epidermidis
VINDPD

SEQ ID NO: 1792189 - protein, 22 aa, Staphylococcus epidermidis
VINTADELNGYNEDRAKESIEG

SEQ ID NO: 1792190 - protein, 12 aa, Staphylococcus epidermidis
VIPGSTDEVQNV

SEQ ID NO: 1792191 - protein, 9 aa, Staphylococcus epidermidis
VIPSTNASV

SEQ ID NO: 1792192 - protein, 11 aa, Staphylococcus epidermidis
VISKNGKEIDL

SEQ ID NO: 1792193 - protein, 13 aa, Staphylococcus epidermidis
VITPQEKNSEKYI

SEQ ID NO: 1792194 - protein, 8 aa, Staphylococcus epidermidis
VKADYPDV

SEQ ID NO: 1792195 - protein, 8 aa, Staphylococcus epidermidis
VKAGQDHD

SEQ ID NO: 1792196 - protein, 9 aa, Staphylococcus epidermidis
VKAGQDHDW

SEQ ID NO: 1792197 - protein, 12 aa, Staphylococcus epidermidis
VKAGQDQDWAKL

SEQ ID NO: 1792198 - protein, 18 aa, Staphylococcus epidermidis
VKAGTNSTGGAPQTNGDD

SEQ ID NO: 1792199 - protein, 6 aa, Staphylococcus epidermidis
VKASER

SEQ ID NO: 1792200 - protein, 23 aa, Staphylococcus epidermidis
VKASKQDYKDTAETLKDLRSDAN

SEQ ID NO: 1792201 - protein, 18 aa, Staphylococcus epidermidis
VKDAQTAAYDNAKKIKSD

SEQ ID NO: 1792202 - protein, 11 aa, Staphylococcus epidermidis
VKDDKEKTKEL

SEQ ID NO: 1792203 - protein, 7 aa, Staphylococcus epidermidis
VKDERPD

SEQ ID NO: 1792204 - protein, 11 aa, Staphylococcus epidermidis
VKDGKAQGLKI

SEQ ID NO: 1792205 - protein, 7 aa, Staphylococcus epidermidis
VKDNDSA

SEQ ID NO: 1792206 - protein, 7 aa, Staphylococcus epidermidis
VKDNNSA

SEQ ID NO: 1792207 - protein, 5 aa, Staphylococcus epidermidis
VKDPR

SEQ ID NO: 1792208 - protein, 10 aa, Staphylococcus epidermidis
VKDSDECRES

SEQ ID NO: 1792209 - protein, 14 aa, Staphylococcus epidermidis
VKDSPGSGAAGGMG

SEQ ID NO: 1792210 - protein, 4 aa, Staphylococcus epidermidis
VKDT

SEQ ID NO: 1792211 - protein, 15 aa, Staphylococcus epidermidis
VKDTVTKDGKKVSKT

SEQ ID NO: 1792212 - protein, 11 aa, Staphylococcus epidermidis
VKEADDPYSWE

SEQ ID NO: 1792213 - protein, 11 aa, Staphylococcus epidermidis
VKEAGKNYAAE

SEQ ID NO: 1792214 - protein, 7 aa, Staphylococcus epidermidis
VKEDNEV

SEQ ID NO: 1792215 - protein, 27 aa, Staphylococcus epidermidis
VKEEDDNEENVDEAQQTTSAEKADVEE

SEQ ID NO: 1792216 - protein, 37 aa, Staphylococcus epidermidis
VKEEDENDEDNEDSDETTSSETATEEVVDDQTPGNAI

SEQ ID NO: 1792217 - protein, 9 aa, Staphylococcus epidermidis
VKEEQRQSY

SEQ ID NO: 1792218 - protein, 13 aa, Staphylococcus epidermidis
VKEESDKAGLSLK

SEQ ID NO: 1792219 - protein, 5 aa, Staphylococcus epidermidis
VKEGK

SEQ ID NO: 1792220 - protein, 8 aa, Staphylococcus epidermidis
VKEGRITK

SEQ ID NO: 1792221 - protein, 11 aa, Staphylococcus epidermidis
VKEGRKNTDAL

SEQ ID NO: 1792222 - protein, 4 aa, Staphylococcus epidermidis
VKEK

SEQ ID NO: 1792223 - protein, 5 aa, Staphylococcus epidermidis
VKEKA

SEQ ID NO: 1792224 - protein, 15 aa, Staphylococcus epidermidis
VKENNGYLPPEFKEK

SEQ ID NO: 1792225 - protein, 5 aa, Staphylococcus epidermidis
VKESQ

SEQ ID NO: 1792226 - protein, 11 aa, Staphylococcus epidermidis
VKETEETLTTE

SEQ ID NO: 1792227 - protein, 8 aa, Staphylococcus epidermidis
VKETTMAT

SEQ ID NO: 1792228 - protein, 7 aa, Staphylococcus epidermidis
VKGENQH

SEQ ID NO: 1792229 - protein, 8 aa, Staphylococcus epidermidis
VKGFPKEQ

SEQ ID NO: 1792230 - protein, 8 aa, Staphylococcus epidermidis
VKGHETNT

SEQ ID NO: 1792231 - protein, 7 aa, Staphylococcus epidermidis
VKGIQKS

SEQ ID NO: 1792232 - protein, 5 aa, Staphylococcus epidermidis
VKGKK

SEQ ID NO: 1792233 - protein, 32 aa, Staphylococcus epidermidis
VKGKTSVDNPTQNNTTSKDGKSVSKTPTKPRV

SEQ ID NO: 1792234 - protein, 23 aa, Staphylococcus epidermidis
VKGKTTVTSTSTFPTEGAAQQAI

SEQ ID NO: 1792235 - protein, 7 aa, Staphylococcus epidermidis
VKGQLGQ

SEQ ID NO: 1792236 - protein, 8 aa, Staphylococcus epidermidis
VKGSNGKY

SEQ ID NO: 1792237 - protein, 9 aa, Staphylococcus epidermidis
VKHETTPRI

SEQ ID NO: 1792238 - protein, 4 aa, Staphylococcus epidermidis
VKHP

SEQ ID NO: 1792239 - protein, 14 aa, Staphylococcus epidermidis
VKKAKNKPKPNNTY

SEQ ID NO: 1792240 - protein, 9 aa, Staphylococcus epidermidis
VKKDYEEAI

SEQ ID NO: 1792241 - protein, 17 aa, Staphylococcus epidermidis
VKKEVGKDPHKGVNPDE

SEQ ID NO: 1792242 - protein, 23 aa, Staphylococcus epidermidis
VKKGTGKYFGPYPNAYSAQETKK

SEQ ID NO: 1792243 - protein, 4 aa, Staphylococcus epidermidis
VKKH

SEQ ID NO: 1792244 - protein, 15 aa, Staphylococcus epidermidis
VKKMTGATSRTNVRQ

SEQ ID NO: 1792245 - protein, 10 aa, Staphylococcus epidermidis
VKKSADFEEQ

SEQ ID NO: 1792246 - protein, 6 aa, Staphylococcus epidermidis
VKKVEE

SEQ ID NO: 1792247 - protein, 6 aa, Staphylococcus epidermidis
VKLGKG

SEQ ID NO: 1792248 - protein, 9 aa, Staphylococcus epidermidis
VKNDGEDMV

SEQ ID NO: 1792249 - protein, 9 aa, Staphylococcus epidermidis
VKNGKPDKK

SEQ ID NO: 1792250 - protein, 9 aa, Staphylococcus epidermidis
VKNQVEEGN

SEQ ID NO: 1792251 - protein, 9 aa, Staphylococcus epidermidis
VKNRNGDQV

SEQ ID NO: 1792252 - protein, 16 aa, Staphylococcus epidermidis
VKNTGKDISVPVGDAT

SEQ ID NO: 1792253 - protein, 6 aa, Staphylococcus epidermidis
VKNTNY

SEQ ID NO: 1792254 - protein, 33 aa, Staphylococcus epidermidis
VKNYDGKYIGEHKKRNEEFKEKYKDEAEKQYKK

SEQ ID NO: 1792255 - protein, 6 aa, Staphylococcus epidermidis
VKPTDS

SEQ ID NO: 1792256 - protein, 8 aa, Staphylococcus epidermidis
VKQENTSF

SEQ ID NO: 1792257 - protein, 5 aa, Staphylococcus epidermidis
VKQGQ

SEQ ID NO: 1792258 - protein, 9 aa, Staphylococcus epidermidis
VKQNNNKEL

SEQ ID NO: 1792259 - protein, 9 aa, Staphylococcus epidermidis
VKQPQLTKT

SEQ ID NO: 1792260 - protein, 4 aa, Staphylococcus epidermidis
VKQQ

SEQ ID NO: 1792261 - protein, 6 aa, Staphylococcus epidermidis
VKQSGV

SEQ ID NO: 1792262 - protein, 8 aa, Staphylococcus epidermidis
VKQSPFKG

SEQ ID NO: 1792263 - protein, 19 aa, Staphylococcus epidermidis
VKQTEDKVRQKTGPEKVKA

SEQ ID NO: 1792264 - protein, 4 aa, Staphylococcus epidermidis
VKQV

SEQ ID NO: 1792265 - protein, 15 aa, Staphylococcus epidermidis
VKRDPRTNMRSPQNN

SEQ ID NO: 1792266 - protein, 8 aa, Staphylococcus epidermidis
VKRERDSL

SEQ ID NO: 1792267 - protein, 8 aa, Staphylococcus epidermidis
VKRGSTEF

SEQ ID NO: 1792268 - protein, 13 aa, Staphylococcus epidermidis
VKRRGDMEEDPTF

SEQ ID NO: 1792269 - protein, 7 aa, Staphylococcus epidermidis
VKSDEEV

SEQ ID NO: 1792270 - protein, 15 aa, Staphylococcus epidermidis
VKSESTVIGTPAKYK

SEQ ID NO: 1792271 - protein, 13 aa, Staphylococcus epidermidis
VKSETTLKGGAVR

SEQ ID NO: 1792272 - protein, 9 aa, Staphylococcus epidermidis
VKSKDGTHE

SEQ ID NO: 1792273 - protein, 7 aa, Staphylococcus epidermidis
VKSKIED

SEQ ID NO: 1792274 - protein, 7 aa, Staphylococcus epidermidis
VKSNEYD

SEQ ID NO: 1792275 - protein, 14 aa, Staphylococcus epidermidis
VKSQAQAEKALEQV

SEQ ID NO: 1792276 - protein, 23 aa, Staphylococcus epidermidis
VKSQQKVKGDYSQYGISEADAQY

SEQ ID NO: 1792277 - protein, 16 aa, Staphylococcus epidermidis
VKTNNDDVQSSQKEAL

SEQ ID NO: 1792278 - protein, 10 aa, Staphylococcus epidermidis
VKTNQSSTIE

SEQ ID NO: 1792279 - protein, 28 aa, Staphylococcus epidermidis
VKTNQTIKKTKKTINQVSDTVKDTSNHI

SEQ ID NO: 1792280 - protein, 6 aa, Staphylococcus epidermidis
VKTPRE

SEQ ID NO: 1792281 - protein, 5 aa, Staphylococcus epidermidis
VKTSD

SEQ ID NO: 1792282 - protein, 9 aa, Staphylococcus epidermidis
VKTSQKEAL

SEQ ID NO: 1792283 - protein, 12 aa, Staphylococcus epidermidis
VKTTDSYGTEQR

SEQ ID NO: 1792284 - protein, 17 aa, Staphylococcus epidermidis
VKTTSAQLSGESGITKT

SEQ ID NO: 1792285 - protein, 8 aa, Staphylococcus epidermidis
VKVEGAKN

SEQ ID NO: 1792286 - protein, 25 aa, Staphylococcus epidermidis
VKVGAPTVEGASVTATVNKQGRGKK

SEQ ID NO: 1792287 - protein, 7 aa, Staphylococcus epidermidis
VKVGDDA

SEQ ID NO: 1792288 - protein, 10 aa, Staphylococcus epidermidis
VKVKSDDQVV

SEQ ID NO: 1792289 - protein, 21 aa, Staphylococcus epidermidis
VKVNQNKVKSPKLHVNPNSDE

SEQ ID NO: 1792290 - protein, 5 aa, Staphylococcus epidermidis
VKVPE

SEQ ID NO: 1792291 - protein, 8 aa, Staphylococcus epidermidis
VKVSSKYQ

SEQ ID NO: 1792292 - protein, 24 aa, Staphylococcus epidermidis
VKYRAPKGIMKPSDIQTLKDNKNE

SEQ ID NO: 1792293 - protein, 8 aa, Staphylococcus epidermidis
VKYTGATP

SEQ ID NO: 1792294 - protein, 6 aa, Staphylococcus epidermidis
VLERKS

SEQ ID NO: 1792295 - protein, 13 aa, Staphylococcus epidermidis
VLNQSKNFTQNNR

SEQ ID NO: 1792296 - protein, 7 aa, Staphylococcus epidermidis
VLPSPKP

SEQ ID NO: 1792297 - protein, 9 aa, Staphylococcus epidermidis
VLPTESPQV

SEQ ID NO: 1792298 - protein, 11 aa, Staphylococcus epidermidis
VLSQEDAEKYL

SEQ ID NO: 1792299 - protein, 9 aa, Staphylococcus epidermidis
VNAEDAGVQ

SEQ ID NO: 1792300 - protein, 8 aa, Staphylococcus epidermidis
VNAEHSDA

SEQ ID NO: 1792301 - protein, 45 aa, Staphylococcus epidermidis
VNAKANKNSIGQVKNSISKGASQPLEIKESPSSRSTSRDIKEQQS

SEQ ID NO: 1792302 - protein, 5 aa, Staphylococcus epidermidis
VNAKD

SEQ ID NO: 1792303 - protein, 8 aa, Staphylococcus epidermidis
VNASDNIK

SEQ ID NO: 1792304 - protein, 16 aa, Staphylococcus epidermidis
VNASTGKYTGRSPKDK

SEQ ID NO: 1792305 - protein, 15 aa, Staphylococcus epidermidis
VNDDSDTVTITTNDR

SEQ ID NO: 1792306 - protein, 9 aa, Staphylococcus epidermidis
VNDEIDHDN

SEQ ID NO: 1792307 - protein, 7 aa, Staphylococcus epidermidis
VNDESIN

SEQ ID NO: 1792308 - protein, 10 aa, Staphylococcus epidermidis
VNDKNQIHTP

SEQ ID NO: 1792309 - protein, 6 aa, Staphylococcus epidermidis
VNDLSS

SEQ ID NO: 1792310 - protein, 5 aa, Staphylococcus epidermidis
VNDND

SEQ ID NO: 1792311 - protein, 10 aa, Staphylococcus epidermidis
VNDTKRNKQV

SEQ ID NO: 1792312 - protein, 6 aa, Staphylococcus epidermidis
VNEDET

SEQ ID NO: 1792313 - protein, 7 aa, Staphylococcus epidermidis
VNEDSVT

SEQ ID NO: 1792314 - protein, 14 aa, Staphylococcus epidermidis
VNEEETESKIDEDL

SEQ ID NO: 1792315 - protein, 7 aa, Staphylococcus epidermidis
VNEGDSF

SEQ ID NO: 1792316 - protein, 9 aa, Staphylococcus epidermidis
VNEGETAPN

SEQ ID NO: 1792317 - protein, 10 aa, Staphylococcus epidermidis
VNEKAGINYE

SEQ ID NO: 1792318 - protein, 17 aa, Staphylococcus epidermidis
VNEKRGIKEETPDAPEV

SEQ ID NO: 1792319 - protein, 9 aa, Staphylococcus epidermidis
VNEKSQIDV

SEQ ID NO: 1792320 - protein, 5 aa, Staphylococcus epidermidis
VNEND

SEQ ID NO: 1792321 - protein, 10 aa, Staphylococcus epidermidis
VNENKKKYGF

SEQ ID NO: 1792322 - protein, 6 aa, Staphylococcus epidermidis
VNENNR

SEQ ID NO: 1792323 - protein, 8 aa, Staphylococcus epidermidis
VNEQETRN

SEQ ID NO: 1792324 - protein, 7 aa, Staphylococcus epidermidis
VNESKAV

SEQ ID NO: 1792325 - protein, 6 aa, Staphylococcus epidermidis
VNGDGR

SEQ ID NO: 1792326 - protein, 12 aa, Staphylococcus epidermidis
VNGDQSEEGLES

SEQ ID NO: 1792327 - protein, 9 aa, Staphylococcus epidermidis
VNGKEADEI

SEQ ID NO: 1792328 - protein, 9 aa, Staphylococcus epidermidis
VNGNDNSQL

SEQ ID NO: 1792329 - protein, 15 aa, Staphylococcus epidermidis
VNGNQNVKPETRNKV

SEQ ID NO: 1792330 - protein, 5 aa, Staphylococcus epidermidis
VNGRF

SEQ ID NO: 1792331 - protein, 5 aa, Staphylococcus epidermidis
VNGRR

SEQ ID NO: 1792332 - protein, 17 aa, Staphylococcus epidermidis
VNGTASLDSENQDENMQ

SEQ ID NO: 1792333 - protein, 17 aa, Staphylococcus epidermidis
VNGTASLESDKQDENMQ

SEQ ID NO: 1792334 - protein, 9 aa, Staphylococcus epidermidis
VNGTGTSLE

SEQ ID NO: 1792335 - protein, 13 aa, Staphylococcus epidermidis
VNHTSKKKKFIPS

SEQ ID NO: 1792336 - protein, 10 aa, Staphylococcus epidermidis
VNKAKDALNG

SEQ ID NO: 1792337 - protein, 8 aa, Staphylococcus epidermidis
VNKDGELI

SEQ ID NO: 1792338 - protein, 9 aa, Staphylococcus epidermidis
VNKDGKDTP

SEQ ID NO: 1792339 - protein, 4 aa, Staphylococcus epidermidis
VNKN

SEQ ID NO: 1792340 - protein, 11 aa, Staphylococcus epidermidis
VNKSTSYENRY

SEQ ID NO: 1792341 - protein, 16 aa, Staphylococcus epidermidis
VNKTSNNSLEDIVASW

SEQ ID NO: 1792342 - protein, 7 aa, Staphylococcus epidermidis
VNLGPDA

SEQ ID NO: 1792343 - protein, 7 aa, Staphylococcus epidermidis
VNNKTEI

SEQ ID NO: 1792344 - protein, 10 aa, Staphylococcus epidermidis
VNNNPNKEDI

SEQ ID NO: 1792345 - protein, 16 aa, Staphylococcus epidermidis
VNNNYDGEVPYDPETF

SEQ ID NO: 1792346 - protein, 6 aa, Staphylococcus epidermidis
VNNSEE

SEQ ID NO: 1792347 - protein, 5 aa, Staphylococcus epidermidis
VNPET

SEQ ID NO: 1792348 - protein, 6 aa, Staphylococcus epidermidis
VNPNGV

SEQ ID NO: 1792349 - protein, 8 aa, Staphylococcus epidermidis
VNPVDTKQ

SEQ ID NO: 1792350 - protein, 9 aa, Staphylococcus epidermidis
VNQAGSLVE

SEQ ID NO: 1792351 - protein, 14 aa, Staphylococcus epidermidis
VNQAKTKPAVQEAL

SEQ ID NO: 1792352 - protein, 13 aa, Staphylococcus epidermidis
VNQEGKKLGSQRF

SEQ ID NO: 1792353 - protein, 7 aa, Staphylococcus epidermidis
VNQGHRH

SEQ ID NO: 1792354 - protein, 7 aa, Staphylococcus epidermidis
VNQKELN

SEQ ID NO: 1792355 - protein, 10 aa, Staphylococcus epidermidis
VNQTKYDGKP

SEQ ID NO: 1792356 - protein, 13 aa, Staphylococcus epidermidis
VNQTTNPTLDPNQ

SEQ ID NO: 1792357 - protein, 30 aa, Staphylococcus epidermidis
VNRKPITATEEDLDENNRARSAKLRVAEIL

SEQ ID NO: 1792358 - protein, 20 aa, Staphylococcus epidermidis
VNRPQSQFYNPSPLFGIHVV

SEQ ID NO: 1792359 - protein, 7 aa, Staphylococcus epidermidis
VNSDGSV

SEQ ID NO: 1792360 - protein, 5 aa, Staphylococcus epidermidis
VNSDT

SEQ ID NO: 1792361 - protein, 5 aa, Staphylococcus epidermidis
VNSGN

SEQ ID NO: 1792362 - protein, 7 aa, Staphylococcus epidermidis
VNSIPEG

SEQ ID NO: 1792363 - protein, 8 aa, Staphylococcus epidermidis
VNSKQSHA

SEQ ID NO: 1792364 - protein, 8 aa, Staphylococcus epidermidis
VNSLGDDV

SEQ ID NO: 1792365 - protein, 6 aa, Staphylococcus epidermidis
VNSNEL

SEQ ID NO: 1792366 - protein, 4 aa, Staphylococcus epidermidis
VNSS

SEQ ID NO: 1792367 - protein, 6 aa, Staphylococcus epidermidis
VNSSNI

SEQ ID NO: 1792368 - protein, 8 aa, Staphylococcus epidermidis
VNSYGKDI

SEQ ID NO: 1792369 - protein, 9 aa, Staphylococcus epidermidis
VNTGDEDVE

SEQ ID NO: 1792370 - protein, 8 aa, Staphylococcus epidermidis
VNTNLGRD

SEQ ID NO: 1792371 - protein, 6 aa, Staphylococcus epidermidis
VNTQIA

SEQ ID NO: 1792372 - protein, 12 aa, Staphylococcus epidermidis
VNVPDDSTIIEP

SEQ ID NO: 1792373 - protein, 7 aa, Staphylococcus epidermidis
VNVPRTE

SEQ ID NO: 1792374 - protein, 17 aa, Staphylococcus epidermidis
VNVTNSPYHPINKDSEV

SEQ ID NO: 1792375 - protein, 7 aa, Staphylococcus epidermidis
VNYPSHY

SEQ ID NO: 1792376 - protein, 7 aa, Staphylococcus epidermidis
VPAPATA

SEQ ID NO: 1792377 - protein, 5 aa, Staphylococcus epidermidis
VPAPV

SEQ ID NO: 1792378 - protein, 10 aa, Staphylococcus epidermidis
VPAQRAENYK

SEQ ID NO: 1792379 - protein, 4 aa, Staphylococcus epidermidis
VPAS

SEQ ID NO: 1792380 - protein, 8 aa, Staphylococcus epidermidis
VPDEGRSV

SEQ ID NO: 1792381 - protein, 9 aa, Staphylococcus epidermidis
VPDGTLDKA

SEQ ID NO: 1792382 - protein, 29 aa, Staphylococcus epidermidis
VPDKDTARLRYTQTEKAIADPNTKSTVQY

SEQ ID NO: 1792383 - protein, 10 aa, Staphylococcus epidermidis
VPEEAESNEA

SEQ ID NO: 1792384 - protein, 10 aa, Staphylococcus epidermidis
VPEGVDTEQQ

SEQ ID NO: 1792385 - protein, 31 aa, Staphylococcus epidermidis
VPEKDTARLRYTQTEKAIADPNTKSTAQYSW

SEQ ID NO: 1792386 - protein, 11 aa, Staphylococcus epidermidis
VPELDKNKNHT

SEQ ID NO: 1792387 - protein, 11 aa, Staphylococcus epidermidis
VPELSRQSKGI

SEQ ID NO: 1792388 - protein, 6 aa, Staphylococcus epidermidis
VPELTD

SEQ ID NO: 1792389 - protein, 5 aa, Staphylococcus epidermidis
VPEYD

SEQ ID NO: 1792390 - protein, 8 aa, Staphylococcus epidermidis
VPFTTDNG

SEQ ID NO: 1792391 - protein, 4 aa, Staphylococcus epidermidis
VPGD

SEQ ID NO: 1792392 - protein, 9 aa, Staphylococcus epidermidis
VPGKAEEKQ

SEQ ID NO: 1792393 - protein, 4 aa, Staphylococcus epidermidis
VPGP

SEQ ID NO: 1792394 - protein, 8 aa, Staphylococcus epidermidis
VPGPNAGL

SEQ ID NO: 1792395 - protein, 12 aa, Staphylococcus epidermidis
VPGRHNDDSATI

SEQ ID NO: 1792396 - protein, 9 aa, Staphylococcus epidermidis
VPKGASNKV

SEQ ID NO: 1792397 - protein, 15 aa, Staphylococcus epidermidis
VPKSIADEIIKKNKG

SEQ ID NO: 1792398 - protein, 5 aa, Staphylococcus epidermidis
VPKSK

SEQ ID NO: 1792399 - protein, 30 aa, Staphylococcus epidermidis
VPKVSNKKAGNKGKNKEKPKSKPSTKDYQS

SEQ ID NO: 1792400 - protein, 11 aa, Staphylococcus epidermidis
VPLKTKNKRMS

SEQ ID NO: 1792401 - protein, 4 aa, Staphylococcus epidermidis
VPND

SEQ ID NO: 1792402 - protein, 8 aa, Staphylococcus epidermidis
VPNGPTPR

SEQ ID NO: 1792403 - protein, 6 aa, Staphylococcus epidermidis
VPNQTH

SEQ ID NO: 1792404 - protein, 13 aa, Staphylococcus epidermidis
VPNTKIKKDTSSL

SEQ ID NO: 1792405 - protein, 6 aa, Staphylococcus epidermidis
VPPAGY

SEQ ID NO: 1792406 - protein, 5 aa, Staphylococcus epidermidis
VPPLP

SEQ ID NO: 1792407 - protein, 13 aa, Staphylococcus epidermidis
VPQPISKERAVQR

SEQ ID NO: 1792408 - protein, 7 aa, Staphylococcus epidermidis
VPRGDTG

SEQ ID NO: 1792409 - protein, 19 aa, Staphylococcus epidermidis
VPRGTGRVRNMPTAAHTKD

SEQ ID NO: 1792410 - protein, 12 aa, Staphylococcus epidermidis
VPRIDDKTDGLN

SEQ ID NO: 1792411 - protein, 15 aa, Staphylococcus epidermidis
VPSDNSLVKSDKDNA

SEQ ID NO: 1792412 - protein, 12 aa, Staphylococcus epidermidis
VPSGKSNNEMEG

SEQ ID NO: 1792413 - protein, 9 aa, Staphylococcus epidermidis
VPSGLAKQK

SEQ ID NO: 1792414 - protein, 8 aa, Staphylococcus epidermidis
VPSPQPKS

SEQ ID NO: 1792415 - protein, 8 aa, Staphylococcus epidermidis
VPSSFERK

SEQ ID NO: 1792416 - protein, 13 aa, Staphylococcus epidermidis
VPTPKEKSNYLPS

SEQ ID NO: 1792417 - protein, 7 aa, Staphylococcus epidermidis
VPTQAQK

SEQ ID NO: 1792418 - protein, 9 aa, Staphylococcus epidermidis
VPTREPGIS

SEQ ID NO: 1792419 - protein, 4 aa, Staphylococcus epidermidis
VPTY

SEQ ID NO: 1792420 - protein, 5 aa, Staphylococcus epidermidis
VPYNP

SEQ ID NO: 1792421 - protein, 7 aa, Staphylococcus epidermidis
VPYRSKH

SEQ ID NO: 1792422 - protein, 8 aa, Staphylococcus epidermidis
VQAESQKL

SEQ ID NO: 1792423 - protein, 11 aa, Staphylococcus epidermidis
VQDGVSVTGGV

SEQ ID NO: 1792424 - protein, 8 aa, Staphylococcus epidermidis
VQEASGTF

SEQ ID NO: 1792425 - protein, 24 aa, Staphylococcus epidermidis
VQEASYTSDSVNTNQYQKEEINPV

SEQ ID NO: 1792426 - protein, 8 aa, Staphylococcus epidermidis
VQEENHKP

SEQ ID NO: 1792427 - protein, 4 aa, Staphylococcus epidermidis
VQEI

SEQ ID NO: 1792428 - protein, 6 aa, Staphylococcus epidermidis
VQEKTK

SEQ ID NO: 1792429 - protein, 4 aa, Staphylococcus epidermidis
VQEN

SEQ ID NO: 1792430 - protein, 4 aa, Staphylococcus epidermidis [sequence omitted]

SEQ ID NO: 1792431 - protein, 5 aa, Staphylococcus epidermidis
VQFPR

SEQ ID NO: 1792432 - protein, 49 aa, Staphylococcus epidermidis
VQGDSTTGKNVEGEPKANANEASTKEEKSLETDGQEGQEREEKASEETI

SEQ ID NO: 1792433 - protein, 13 aa, Staphylococcus epidermidis
VQGKISREEQYIQ

SEQ ID NO: 1792434 - protein, 14 aa, Staphylococcus epidermidis
VQGKNWEEASTDEI

SEQ ID NO: 1792435 - protein, 18 aa, Staphylococcus epidermidis
VQGPQISVDSQTREVGKT

SEQ ID NO: 1792436 - protein, 4 aa, Staphylococcus epidermidis
VQGS

SEQ ID NO: 1792437 - protein, 14 aa, Staphylococcus epidermidis
VQGTGFEGRVTKKD

SEQ ID NO: 1792438 - protein, 6 aa, Staphylococcus epidermidis
VQKDDV

SEQ ID NO: 1792439 - protein, 39 aa, Staphylococcus epidermidis; identical to SEQ ID NO: 1730213

SEQ ID NO: 1792440 - protein, 7 aa, Staphylococcus epidermidis
VQKNPMG

SEQ ID NO: 1792441 - protein, 6 aa, Staphylococcus epidermidis
VQKPHR

SEQ ID NO: 1792442 - protein, 8 aa, Staphylococcus epidermidis
VQNISDGA

SEQ ID NO: 1792443 - protein, 5 aa, Staphylococcus epidermidis
VQNNS

SEQ ID NO: 1792444 - protein, 5 aa, Staphylococcus epidermidis
VQPET

SEQ ID NO: 1792445 - protein, 10 aa, Staphylococcus epidermidis
VQPIPPQPYN

SEQ ID NO: 1792446 - protein, 8 aa, Staphylococcus epidermidis
VQPPTDDL

SEQ ID NO: 1792447 - protein, 10 aa, Staphylococcus epidermidis
VQPSRGSKKE

SEQ ID NO: 1792448 - protein, 11 aa, Staphylococcus epidermidis
VQPYSTGYTPQ

SEQ ID NO: 1792449 - protein, 4 aa, Staphylococcus epidermidis
VQQA

SEQ ID NO: 1792450 - protein, 11 aa, Staphylococcus epidermidis
VQQAQNALDGV

SEQ ID NO: 1792451 - protein, 9 aa, Staphylococcus epidermidis
VQQESGGIT

SEQ ID NO: 1792452 - protein, 13 aa, Staphylococcus epidermidis
VQQLKQDIGDTQT

SEQ ID NO: 1792453 - protein, 10 aa, Staphylococcus epidermidis
VQQSQKDAGE

SEQ ID NO: 1792454 - protein, 12 aa, Staphylococcus epidermidis
VQRRSGKSDEND

SEQ ID NO: 1792455 - protein, 10 aa, Staphylococcus epidermidis
VQSAESEKEI

SEQ ID NO: 1792456 - protein, 10 aa, Staphylococcus epidermidis
VQSQKRLRTY

SEQ ID NO: 1792457 - protein, 18 aa, Staphylococcus epidermidis
VQSTTSGIARTKDTGNVG

SEQ ID NO: 1792458 - protein, 19 aa, Staphylococcus epidermidis
VQTATPTYLNAGRKQRGEL

SEQ ID NO: 1792459 - protein, 4 aa, Staphylococcus epidermidis
VQTF

SEQ ID NO: 1792460 - protein, 11 aa, Staphylococcus epidermidis
VQTGKSKTKHK

SEQ ID NO: 1792461 - protein, 9 aa, Staphylococcus epidermidis
VQTGTASQL

SEQ ID NO: 1792462 - protein, 4 aa, Staphylococcus epidermidis
VQTN

SEQ ID NO: 1792463 - protein, 7 aa, Staphylococcus epidermidis
VQTNNNK

SEQ ID NO: 1792464 - protein, 8 aa, Staphylococcus epidermidis
VQYDTPDN

SEQ ID NO: 1792465 - protein, 7 aa, Staphylococcus epidermidis
VQYNGEE

SEQ ID NO: 1792466 - protein, 20 aa, Staphylococcus epidermidis
VRDDSQASNEAPVGPGPRKA

SEQ ID NO: 1792467 - protein, 20 aa, Staphylococcus epidermidis
VREEAKEKEIKPIEDRFIVK

SEQ ID NO: 1792468 - protein, 7 aa, Staphylococcus epidermidis
VRGGVNE

SEQ ID NO: 1792469 - protein, 10 aa, Staphylococcus epidermidis
VRGINKDKRE

SEQ ID NO: 1792470 - protein, 6 aa, Staphylococcus epidermidis
VRGNKV

SEQ ID NO: 1792471 - protein, 7 aa, Staphylococcus epidermidis
VRGTTSK

SEQ ID NO: 1792472 - protein, 17 aa, Staphylococcus epidermidis
VRKASGKRLAEESPAEA

SEQ ID NO: 1792473 - protein, 7 aa, Staphylococcus epidermidis
VRKDDSV

SEQ ID NO: 1792474 - protein, 16 aa, Staphylococcus epidermidis
VRKEEQVKDLENEGVK

SEQ ID NO: 1792475 - protein, 4 aa, Staphylococcus epidermidis
VRKG

SEQ ID NO: 1792476 - protein, 10 aa, Staphylococcus epidermidis
VRKKDKRAIE

SEQ ID NO: 1792477 - protein, 13 aa, Staphylococcus epidermidis
VRKSPGLKGTVVE

SEQ ID NO: 1792478 - protein, 20 aa, Staphylococcus epidermidis
VRLTEGKYDSKEKMEKSVED

SEQ ID NO: 1792479 - protein, 19 aa, Staphylococcus epidermidis
VRLTEGKYESEEKMERSVE

SEQ ID NO: 1792480 - protein, 5 aa, Staphylococcus epidermidis
VRNEQ

SEQ ID NO: 1792481 - protein, 21 aa, Staphylococcus epidermidis
VRNEYGDAHGKSKKNYRPETR

SEQ ID NO: 1792482 - protein, 5 aa, Staphylococcus epidermidis
VRPDK

SEQ ID NO: 1792483 - protein, 8 aa, Staphylococcus epidermidis
VRPYTDNE

SEQ ID NO: 1792484 - protein, 7 aa, Staphylococcus epidermidis
VRQGKMD

SEQ ID NO: 1792485 - protein, 7 aa, Staphylococcus epidermidis
VRRGAPD

SEQ ID NO: 1792486 - protein, 7 aa, Staphylococcus epidermidis
VRRRNKK

SEQ ID NO: 1792487 - protein, 6 aa, Staphylococcus epidermidis
VRRTET

SEQ ID NO: 1792488 - protein, 27 aa, Staphylococcus epidermidis
VRSAGGEPISESHSNTRYEDTDGNQTV

SEQ ID NO: 1792489 - protein, 9 aa, Staphylococcus epidermidis
VRSEDANSH

SEQ ID NO: 1792490 - protein, 6 aa, Staphylococcus epidermidis
VSAETQ

SEQ ID NO: 1792491 - protein, 4 aa, Staphylococcus epidermidis
VSAG

SEQ ID NO: 1792492 - protein, 8 aa, Staphylococcus epidermidis
VSAGEPLN

SEQ ID NO: 1792493 - protein, 9 aa, Staphylococcus epidermidis
VSDDESVQQ

SEQ ID NO: 1792494 - protein, 10 aa, Staphylococcus epidermidis
VSDDREENEA

SEQ ID NO: 1792495 - protein, 9 aa, Staphylococcus epidermidis
VSDDRGRTV

SEQ ID NO: 1792496 - protein, 15 aa, Staphylococcus epidermidis
VSDEGWQGIPDEAKL

SEQ ID NO: 1792497 - protein, 17 aa, Staphylococcus epidermidis
VSDELTNELERSPSINE

SEQ ID NO: 1792498 - protein, 10 aa, Staphylococcus epidermidis
VSDGCEQTNT

SEQ ID NO: 1792499 - protein, 20 aa, Staphylococcus epidermidis
VSDKAKKWLGEEAYEPQFGA

SEQ ID NO: 1792500 - protein, 15 aa, Staphylococcus epidermidis
VSDKDAIIQERRIKL

SEQ ID NO: 1792501 - protein, 4 aa, Staphylococcus epidermidis
VSDP

SEQ ID NO: 1792502 - protein, 15 aa, Staphylococcus epidermidis
VSDRENSMTAGPRGP

SEQ ID NO: 1792503 - protein, 17 aa, Staphylococcus epidermidis
VSDSESNKSEKDKEGKS

SEQ ID NO: 1792504 - protein, 10 aa, Staphylococcus epidermidis
VSDSKPIDES

SEQ ID NO: 1792505 - protein, 7 aa, Staphylococcus epidermidis
VSDTVDS

SEQ ID NO: 1792506 - protein, 19 aa, Staphylococcus epidermidis
VSEAETGSPTRGGRPGTHA

SEQ ID NO: 1792507 - protein, 19 aa, Staphylococcus epidermidis
VSEAETGSPTRGGRPSTHA

SEQ ID NO: 1792508 - protein, 11 aa, Staphylococcus epidermidis
VSEAQKSDDYT

SEQ ID NO: 1792509 - protein, 7 aa, Staphylococcus epidermidis
VSEATSL

SEQ ID NO: 1792510 - protein, 6 aa, Staphylococcus epidermidis
VSEDGG

SEQ ID NO: 1792511 - protein, 6 aa, Staphylococcus epidermidis
VSEGRG

SEQ ID NO: 1792512 - protein, 7 aa, Staphylococcus epidermidis
VSEIPDA

SEQ ID NO: 1792513 - protein, 6 aa, Staphylococcus epidermidis
VSENEK

SEQ ID NO: 1792514 - protein, 10 aa, Staphylococcus epidermidis
VSEQGGLGTI

SEQ ID NO: 1792515 - protein, 8 aa, Staphylococcus epidermidis
VSERSLAD

SEQ ID NO: 1792516 - protein, 7 aa, Staphylococcus epidermidis
VSGAKEA

SEQ ID NO: 1792517 - protein, 7 aa, Staphylococcus epidermidis
VSGDPTI

SEQ ID NO: 1792518 - protein, 10 aa, Staphylococcus epidermidis
VSGEESKHGI

SEQ ID NO: 1792519 - protein, 15 aa, Staphylococcus epidermidis
VSGEGDDELSYRNMP

SEQ ID NO: 1792520 - protein, 8 aa, Staphylococcus epidermidis
VSGESDDM

SEQ ID NO: 1792521 - protein, 16 aa, Staphylococcus epidermidis
VSGESDDMLGYKNMPN

SEQ ID NO: 1792522 - protein, 12 aa, Staphylococcus epidermidis
VSGESDDTLGYK

SEQ ID NO: 1792523 - protein, 16 aa, Staphylococcus epidermidis
VSGESDDTLGYKNMPN

SEQ ID NO: 1792524 - protein, 4 aa, Staphylococcus epidermidis
VSGG

SEQ ID NO: 1792525 - protein, 12 aa, Staphylococcus epidermidis
VSGGVAPEQRDG

SEQ ID NO: 1792526 - protein, 8 aa, Staphylococcus epidermidis
VSGSGAYS

SEQ ID NO: 1792527 - protein, 10 aa, Staphylococcus epidermidis
VSGTVQPSNY

SEQ ID NO: 1792528 - protein, 8 aa, Staphylococcus epidermidis
VSHDGNEI

SEQ ID NO: 1792529 - protein, 10 aa, Staphylococcus epidermidis
VSHKEEKNPY

SEQ ID NO: 1792530 - protein, 8 aa, Staphylococcus epidermidis
VSIGKRPM

SEQ ID NO: 1792531 - protein, 8 aa, Staphylococcus epidermidis
VSIPSAKR

SEQ ID NO: 1792532 - protein, 10 aa, Staphylococcus epidermidis
VSKAAQGYAS

SEQ ID NO: 1792533 - protein, 7 aa, Staphylococcus epidermidis
VSKAFRK

SEQ ID NO: 1792534 - protein, 12 aa, Staphylococcus epidermidis
VSKATKDDVENA

SEQ ID NO: 1792535 - protein, 8 aa, Staphylococcus epidermidis
VSKDDTNK

SEQ ID NO: 1792536 - protein, 14 aa, Staphylococcus epidermidis
VSKDGKDNLAPYSQ

SEQ ID NO: 1792537 - protein, 16 aa, Staphylococcus epidermidis
VSKDQDIEKAYGDNQV

SEQ ID NO: 1792538 - protein, 4 aa, Staphylococcus epidermidis
VSKE

SEQ ID NO: 1792539 - protein, 6 aa, Staphylococcus epidermidis
VSKEAQ

SEQ ID NO: 1792540 - protein, 14 aa, Staphylococcus epidermidis
VSKEGKDNLAPYSQ

SEQ ID NO: 1792541 - protein, 14 aa, Staphylococcus epidermidis
VSKELKSKNTKSKS

SEQ ID NO: 1792542 - protein, 14 aa, Staphylococcus epidermidis
VSKKGKDNLAPYSQ

SEQ ID NO: 1792543 - protein, 18 aa, Staphylococcus epidermidis
VSKKQPTQNYKNKKFFGL

SEQ ID NO: 1792544 - protein, 6 aa, Staphylococcus epidermidis
VSKNGR

SEQ ID NO: 1792545 - protein, 10 aa, Staphylococcus epidermidis
VSKNPMNGQQ

SEQ ID NO: 1792546 - protein, 9 aa, Staphylococcus epidermidis
VSKSGKNVE

SEQ ID NO: 1792547 - protein, 6 aa, Staphylococcus epidermidis
VSKSKY

SEQ ID NO: 1792548 - protein, 9 aa, Staphylococcus epidermidis
VSKTVSKEN

SEQ ID NO: 1792549 - protein, 6 aa, Staphylococcus epidermidis
VSKVSE

SEQ ID NO: 1792550 - protein, 7 aa, Staphylococcus epidermidis
VSNDELD

SEQ ID NO: 1792551 - protein, 9 aa, Staphylococcus epidermidis
VSNIKNENV

SEQ ID NO: 1792552 - protein, 20 aa, Staphylococcus epidermidis
VSNPNVYAAGDAAATDGLPL

SEQ ID NO: 1792553 - protein, 7 aa, Staphylococcus epidermidis
VSNSGEY

SEQ ID NO: 1792554 - protein, 10 aa, Staphylococcus epidermidis
VSNSSRYNAE

SEQ ID NO: 1792555 - protein, 8 aa, Staphylococcus epidermidis
VSPAAQGL

SEQ ID NO: 1792556 - protein, 7 aa, Staphylococcus epidermidis
VSPATIR

SEQ ID NO: 1792557 - protein, 15 aa, Staphylococcus epidermidis
VSPLGAAALSGTTHP

SEQ ID NO: 1792558 - protein, 5 aa, Staphylococcus epidermidis
VSPNQ

SEQ ID NO: 1792559 - protein, 6 aa, Staphylococcus epidermidis
VSPNTE

SEQ ID NO: 1792560 - protein, 5 aa, Staphylococcus epidermidis
VSPPI

SEQ ID NO: 1792561 - protein, 5 aa, Staphylococcus epidermidis
VSPSL

SEQ ID NO: 1792562 - protein, 7 aa, Staphylococcus epidermidis
VSPSSEF

SEQ ID NO: 1792563 - protein, 17 aa, Staphylococcus epidermidis
VSQANTAHYGASKAGFS

SEQ ID NO: 1792564 - protein, 10 aa, Staphylococcus epidermidis
VSQASKIAGG

SEQ ID NO: 1792565 - protein, 10 aa, Staphylococcus epidermidis
VSQEAINDSY

SEQ ID NO: 1792566 - protein, 12 aa, Staphylococcus epidermidis
VSQGPSQGRTFP

SEQ ID NO: 1792567 - protein, 15 aa, Staphylococcus epidermidis
VSQKTKNLEKDQKAA

SEQ ID NO: 1792568 - protein, 6 aa, Staphylococcus epidermidis
VSQNNG

SEQ ID NO: 1792569 - protein, 6 aa, Staphylococcus epidermidis
VSQSEI

SEQ ID NO: 1792570 - protein, 8 aa, Staphylococcus epidermidis
VSRAGSNA

SEQ ID NO: 1792571 - protein, 4 aa, Staphylococcus epidermidis
VSRE

SEQ ID NO: 1792572 - protein, 10 aa, Staphylococcus epidermidis
VSREKKLSQV

SEQ ID NO: 1792573 - protein, 6 aa, Staphylococcus epidermidis
VSRKPT

SEQ ID NO: 1792574 - protein, 7 aa, Staphylococcus epidermidis
VSRNEAK

SEQ ID NO: 1792575 - protein, 9 aa, Staphylococcus epidermidis
VSRQKRKKV

SEQ ID NO: 1792576 - protein, 7 aa, Staphylococcus epidermidis
VSRSPVR

SEQ ID NO: 1792577 - protein, 4 aa, Staphylococcus epidermidis
VSRY

SEQ ID NO: 1792578 - protein, 7 aa, Staphylococcus epidermidis
VSSGEID

SEQ ID NO: 1792579 - protein, 6 aa, Staphylococcus epidermidis
VSSGTA

SEQ ID NO: 1792580 - protein, 10 aa, Staphylococcus epidermidis
VSSKINEKHQ

SEQ ID NO: 1792581 - protein, 7 aa, Staphylococcus epidermidis
VSSLDHK

SEQ ID NO: 1792582 - protein, 20 aa, Staphylococcus epidermidis
VSSLPGKLADCSSKNPDESE

SEQ ID NO: 1792583 - protein, 8 aa, Staphylococcus epidermidis
VSSNDQSV

SEQ ID NO: 1792584 - protein, 12 aa, Staphylococcus epidermidis
VSTEGASPKLGQ

SEQ ID NO: 1792585 - protein, 10 aa, Staphylococcus epidermidis
VSTGNRNQTL

SEQ ID NO: 1792586 - protein, 8 aa, Staphylococcus epidermidis
VSTKQIAE

SEQ ID NO: 1792587 - protein, 7 aa, Staphylococcus epidermidis
VSTPDQR

SEQ ID NO: 1792588 - protein, 210 aa, Staphylococcus epidermidis
VSTSISNSTSLSDSVKASQSLSTKESTSKSLSGSLSASTSNSASIKASESASTSKKLSESASTSMSDSASIKASESASTSKKLSESASTSTSDSASIKASESASTSKKLSESASTSMSDSASIKASESASTSKKLSESASTSTSDSASTSMSESDSTSESTSLSDSTSASLSESTSTSTSDSASTSTSESDSNSTSTSLSESTSTSFQNQ

SEQ ID NO: 1792589 - protein, 6 aa, Staphylococcus epidermidis
VSTYDQ

SEQ ID NO: 1792590 - protein, 5 aa, Staphylococcus epidermidis
VSVEE

SEQ ID NO: 1792591 - protein, 5 aa, Staphylococcus epidermidis
VSVNG

SEQ ID NO: 1792592 - protein, 7 aa, Staphylococcus epidermidis
VTASTDS

SEQ ID NO: 1792593 - protein, 8 aa, Staphylococcus epidermidis
VTDEKTTY

SEQ ID NO: 1792594 - protein, 13 aa, Staphylococcus epidermidis
VTDKLKKEMEKKK

SEQ ID NO: 1792595 - protein, 16 aa, Staphylococcus epidermidis
VTDRTQAAIYAMENKL

SEQ ID NO: 1792596 - protein, 4 aa, Staphylococcus epidermidis
VTDY

SEQ ID NO: 1792597 - protein, 7 aa, Staphylococcus epidermidis
VTEAEKA

SEQ ID NO: 1792598 - protein, 12 aa, Staphylococcus epidermidis
VTEARDNTGEFI

SEQ ID NO: 1792599 - protein, 5 aa, Staphylococcus epidermidis
VTEFE

SEQ ID NO: 1792600 - protein, 6 aa, Staphylococcus epidermidis
VTEGKN

SEQ ID NO: 1792601 - protein, 4 aa, Staphylococcus epidermidis
VTEK

SEQ ID NO: 1792602 - protein, 4 aa, Staphylococcus epidermidis
VTEL

SEQ ID NO: 1792603 - protein, 18 aa, Staphylococcus epidermidis
VTELTRENAKEMIAQNHQ

SEQ ID NO: 1792604 - protein, 15 aa, Staphylococcus epidermidis
VTENDFKITTTFLFF

SEQ ID NO: 1792605 - protein, 6 aa, Staphylococcus epidermidis
VTENGR

SEQ ID NO: 1792606 - protein, 7 aa, Staphylococcus epidermidis
VTERNAT

SEQ ID NO: 1792607 - protein, 12 aa, Staphylococcus epidermidis
VTESEADKLDIG

SEQ ID NO: 1792608 - protein, 11 aa, Staphylococcus epidermidis
VTESEAEKLEI

SEQ ID NO: 1792609 - protein, 5 aa, Staphylococcus epidermidis
VTESL

SEQ ID NO: 1792610 - protein, 9 aa, Staphylococcus epidermidis
VTETDYSGD

SEQ ID NO: 1792611 - protein, 26 aa, Staphylococcus epidermidis
VTETEPGIKGDTATGATKSATVETGY

SEQ ID NO: 1792612 - protein, 13 aa, Staphylococcus epidermidis
VTFSNKAQKQLKQ

SEQ ID NO: 1792613 - protein, 9 aa, Staphylococcus epidermidis
VTGDDNALQ

SEQ ID NO: 1792614 - protein, 7 aa, Staphylococcus epidermidis
VTGGSTM

SEQ ID NO: 1792615 - protein, 10 aa, Staphylococcus epidermidis
VTGKAKNHYT

SEQ ID NO: 1792616 - protein, 6 aa, Staphylococcus epidermidis
VTGKEV

SEQ ID NO: 1792617 - protein, 11 aa, Staphylococcus epidermidis
VTGKPTEIEGA

SEQ ID NO: 1792618 - protein, 16 aa, Staphylococcus epidermidis
VTGKSLRENNEGKNIK

SEQ ID NO: 1792619 - protein, 16 aa, Staphylococcus epidermidis
VTGKTLRENNEGKEIK

SEQ ID NO: 1792620 - protein, 12 aa, Staphylococcus epidermidis
VTGSNGKTTTKD

SEQ ID NO: 1792621 - protein, 9 aa, Staphylococcus epidermidis
VTGTSELDG

SEQ ID NO: 1792622 - protein, 10 aa, Staphylococcus epidermidis
VTINEENSDT

SEQ ID NO: 1792623 - protein, 11 aa, Staphylococcus epidermidis
VTKAPNGQNLH

SEQ ID NO: 1792624 - protein, 5 aa, Staphylococcus epidermidis
VTKAQ

SEQ ID NO: 1792625 - protein, 8 aa, Staphylococcus epidermidis
VTKDGNVQ

SEQ ID NO: 1792626 - protein, 9 aa, Staphylococcus epidermidis
VTKELNHSA

SEQ ID NO: 1792627 - protein, 8 aa, Staphylococcus epidermidis
VTKGSEIS

SEQ ID NO: 1792628 - protein, 4 aa, Staphylococcus epidermidis
VTKT

SEQ ID NO: 1792629 - protein, 5 aa, Staphylococcus epidermidis
VTKTT

SEQ ID NO: 1792630 - protein, 17 aa, Staphylococcus epidermidis
VTLDNNSNGIPHLLKTL

SEQ ID NO: 1792631 - protein, 4 aa, Staphylococcus epidermidis
VTMP

SEQ ID NO: 1792632 - protein, 6 aa, Staphylococcus epidermidis
VTNKEE

SEQ ID NO: 1792633 - protein, 11 aa, Staphylococcus epidermidis
VTNTRGANFGK

SEQ ID NO: 1792634 - protein, 10 aa, Staphylococcus epidermidis
VTPAMKNSTV

SEQ ID NO: 1792635 - protein, 10 aa, Staphylococcus epidermidis
VTPEKKDEIQ

SEQ ID NO: 1792636 - protein, 5 aa, Staphylococcus epidermidis
VTPEQ

SEQ ID NO: 1792637 - protein, 8 aa, Staphylococcus epidermidis
VTPGSEEA

SEQ ID NO: 1792638 - protein, 7 aa, Staphylococcus epidermidis
VTPGTDA

SEQ ID NO: 1792639 - protein, 6 aa, Staphylococcus epidermidis
VTPKAF

SEQ ID NO: 1792640 - protein, 6 aa, Staphylococcus epidermidis
VTPNNK

SEQ ID NO: 1792641 - protein, 10 aa, Staphylococcus epidermidis
VTPNNVSDAY

SEQ ID NO: 1792642 - protein, 5 aa, Staphylococcus epidermidis
VTPPD

SEQ ID NO: 1792643 - protein, 9 aa, Staphylococcus epidermidis
VTPPQNSGI

SEQ ID NO: 1792644 - protein, 5 aa, Staphylococcus epidermidis
VTPSN

SEQ ID NO: 1792645 - protein, 8 aa, Staphylococcus epidermidis
VTPSQASE

SEQ ID NO: 1792646 - protein, 8 aa, Staphylococcus epidermidis
VTPSYAGV

SEQ ID NO: 1792647 - protein, 8 aa, Staphylococcus epidermidis
VTPTDQPD

SEQ ID NO: 1792648 - protein, 12 aa, Staphylococcus epidermidis
VTQARDEVGKSI

SEQ ID NO: 1792649 - protein, 7 aa, Staphylococcus epidermidis
VTQGPGL

SEQ ID NO: 1792650 - protein, 7 aa, Staphylococcus epidermidis
VTQQNGK

SEQ ID NO: 1792651 - protein, 6 aa, Staphylococcus epidermidis
VTRDIP

SEQ ID NO: 1792652 - protein, 5 aa, Staphylococcus epidermidis
VTRDN

SEQ ID NO: 1792653 - protein, 4 aa, Staphylococcus epidermidis
VTRN

SEQ ID NO: 1792654 - protein, 14 aa, Staphylococcus epidermidis
VTRNSASDSTSTSI

SEQ ID NO: 1792655 - protein, 5 aa, Staphylococcus epidermidis
VTRSN

SEQ ID NO: 1792656 - protein, 7 aa, Staphylococcus epidermidis
VTRVSEG

SEQ ID NO: 1792657 - protein, 16 aa, Staphylococcus epidermidis
VTSASKSYKQDFYQQS

SEQ ID NO: 1792658 - protein, 7 aa, Staphylococcus epidermidis
VTSDEDV

SEQ ID NO: 1792659 - protein, 10 aa, Staphylococcus epidermidis
VTSDNYSTPA

SEQ ID NO: 1792660 - protein, 8 aa, Staphylococcus epidermidis
VTSDSTPY

SEQ ID NO: 1792661 - protein, 6 aa, Staphylococcus epidermidis
VTSEAT

SEQ ID NO: 1792662 - protein, 8 aa, Staphylococcus epidermidis
VTSGQIKL

SEQ ID NO: 1792663 - protein, 26 aa, Staphylococcus epidermidis
VTSGYMGGHTENPTYEEVKTGTTGHL

SEQ ID NO: 1792664 - protein, 6 aa, Staphylococcus epidermidis
VTSITE

SEQ ID NO: 1792665 - protein, 9 aa, Staphylococcus epidermidis
VTSKTKDKH

SEQ ID NO: 1792666 - protein, 8 aa, Staphylococcus epidermidis
VTSTTSTR

SEQ ID NO: 1792667 - protein, 8 aa, Staphylococcus epidermidis
VTTDHGNE

SEQ ID NO: 1792668 - protein, 7 aa, Staphylococcus epidermidis
VTTDNEI

SEQ ID NO: 1792669 - protein, 31 aa, Staphylococcus epidermidis
VTTEAKDIAQSAGYERIDQSHADFGSIPSRV

SEQ ID NO: 1792670 - protein, 16 aa, Staphylococcus epidermidis
VTTENNKKYTIPDSEK

SEQ ID NO: 1792671 - protein, 6 aa, Staphylococcus epidermidis
VTTGKN

SEQ ID NO: 1792672 - protein, 6 aa, Staphylococcus epidermidis
VTTNDD

SEQ ID NO: 1792673 - protein, 10 aa, Staphylococcus epidermidis
VTTTTNGKEA

SEQ ID NO: 1792674 - protein, 12 aa, Staphylococcus epidermidis
VTTVDGPKLSNA

SEQ ID NO: 1792675 - protein, 7 aa, Staphylococcus epidermidis
VTVNGST

SEQ ID NO: 1792676 - protein, 14 aa, Staphylococcus epidermidis
VTVRSDSLGTTKSC

SEQ ID NO: 1792677 - protein, 6 aa, Staphylococcus epidermidis
VTYDEA

SEQ ID NO: 1792678 - protein, 6 aa, Staphylococcus epidermidis
VVDSPY

SEQ ID NO: 1792679 - protein, 19 aa, Staphylococcus epidermidis
VVEAKEKGQEAFNSHPNNV

SEQ ID NO: 1792680 - protein, 11 aa, Staphylococcus epidermidis
VVGKHGEKATV

SEQ ID NO: 1792681 - protein, 28 aa, Staphylococcus epidermidis
VVNPGGSMTGGGARKTKSILSQKDELST

SEQ ID NO: 1792682 - protein, 30 aa, Staphylococcus epidermidis
VVNPGGSMTGGGARKTKSILSQKDELSTMR

SEQ ID NO: 1792683 - protein, 5 aa, Staphylococcus epidermidis
VVQEG

SEQ ID NO: 1792684 - protein, 12 aa, Staphylococcus epidermidis
VVRKDTTKNDLG

SEQ ID NO: 1792685 - protein, 4 aa, Staphylococcus epidermidis
VYDK

SEQ ID NO: 1792686 - protein, 10 aa, Staphylococcus epidermidis
VYGDKQKYQA

SEQ ID NO: 1792687 - protein, 8 aa, Staphylococcus epidermidis
VYGDQTEA

SEQ ID NO: 1792688 - protein, 13 aa, Staphylococcus epidermidis
VYGGSRKQWNDEQ

SEQ ID NO: 1792689 - protein, 12 aa, Staphylococcus epidermidis
VYGRPRKSKIGT

SEQ ID NO: 1792690 - protein, 6 aa, Staphylococcus epidermidis
VYNASG

SEQ ID NO: 1792691 - protein, 7 aa, Staphylococcus epidermidis
VYPEEQG

SEQ ID NO: 1792692 - protein, 8 aa, Staphylococcus epidermidis
VYPGSTPR

SEQ ID NO: 1792693 - protein, 6 aa, Staphylococcus epidermidis
VYPNES

SEQ ID NO: 1792694 - protein, 9 aa, Staphylococcus epidermidis
VYRNDTGSL

SEQ ID NO: 1792695 - protein, 9 aa, Staphylococcus epidermidis
VYSENPDID

SEQ ID NO: 1792696 - protein, 4 aa, Staphylococcus epidermidis
VYST

SEQ ID NO: 1792697 - protein, 8 aa, Staphylococcus epidermidis
VYTTDTEH

SEQ ID NO: 1792698 - protein, 7 aa, Staphylococcus epidermidis
WAEPKGM

SEQ ID NO: 1792699 - protein, 6 aa, Staphylococcus epidermidis
WAKQTG

SEQ ID NO: 1792700 - protein, 14 aa, Staphylococcus epidermidis
WATTEENVEELLKL

SEQ ID NO: 1792701 - protein, 14 aa, Staphylococcus epidermidis
WATTEENVNQLLKL

SEQ ID NO: 1792702 - protein, 19 aa, Staphylococcus epidermidis
WDANKKRVMAGNETVDIGS

SEQ ID NO: 1792703 - protein, 9 aa, Staphylococcus epidermidis
WDDEEQDKF

SEQ ID NO: 1792704 - protein, 14 aa, Staphylococcus epidermidis
WDEEDEEDKQRTLD

SEQ ID NO: 1792705 - protein, 14 aa, Staphylococcus epidermidis
WDEGDEEDKQRALD

SEQ ID NO: 1792706 - protein, 9 aa, Staphylococcus epidermidis
WDGSAKEDI

SEQ ID NO: 1792707 - protein, 7 aa, Staphylococcus epidermidis
WDNNDRP

SEQ ID NO: 1792708 - protein, 7 aa, Staphylococcus epidermidis
WDNPEVR

SEQ ID NO: 1792709 - protein, 8 aa, Staphylococcus epidermidis
WEDQSHYK

SEQ ID NO: 1792710 - protein, 11 aa, Staphylococcus epidermidis
WEEDTPFKDPR

SEQ ID NO: 1792711 - protein, 9 aa, Staphylococcus epidermidis
WESNQEAKT

SEQ ID NO: 1792712 - protein, 13 aa, Staphylococcus epidermidis
WGKLERKKKYRMK

SEQ ID NO: 1792713 - protein, 4 aa, Staphylococcus epidermidis
WGRP

SEQ ID NO: 1792714 - protein, 9 aa, Staphylococcus epidermidis
WGSTKNSIE

SEQ ID NO: 1792715 - protein, 4 aa, Staphylococcus epidermidis
WGTG

SEQ ID NO: 1792716 - protein, 5 aa, Staphylococcus epidermidis
WGTPR

SEQ ID NO: 1792717 - protein, 10 aa, Staphylococcus epidermidis
WHSDDDDKGV

SEQ ID NO: 1792718 - protein, 10 aa, Staphylococcus epidermidis
WKTNPSEEDI

SEQ ID NO: 1792719 - protein, 10 aa, Staphylococcus epidermidis
WKTNSSDDDV

SEQ ID NO: 1792720 - protein, 9 aa, Staphylococcus epidermidis
WNDKEAKVR

SEQ ID NO: 1792721 - protein, 7 aa, Staphylococcus epidermidis
WNDPSGS

SEQ ID NO: 1792722 - protein, 11 aa, Staphylococcus epidermidis
WNEDKENEVIE

SEQ ID NO: 1792723 - protein, 7 aa, Staphylococcus epidermidis
WNEKKPA

SEQ ID NO: 1792724 - protein, 5 aa, Staphylococcus epidermidis
WNGEE

SEQ ID NO: 1792725 - protein, 8 aa, Staphylococcus epidermidis
WNGNQSPQ

SEQ ID NO: 1792726 - protein, 10 aa, Staphylococcus epidermidis
WNNEPLPEKM

SEQ ID NO: 1792727 - protein, 12 aa, Staphylococcus epidermidis
WNNSSDELYQVF

SEQ ID NO: 1792728 - protein, 4 aa, Staphylococcus epidermidis
WNPS

SEQ ID NO: 1792729 - protein, 9 aa, Staphylococcus epidermidis
WPDTDSEDF

SEQ ID NO: 1792730 - protein, 8 aa, Staphylococcus epidermidis
WPDYENGN

SEQ ID NO: 1792731 - protein, 6 aa, Staphylococcus epidermidis
WQDKNE

SEQ ID NO: 1792732 - protein, 12 aa, Staphylococcus epidermidis
WQGGRDKVGTVK

SEQ ID NO: 1792733 - protein, 15 aa, Staphylococcus epidermidis
WQSNHKREANESTYG

SEQ ID NO: 1792734 - protein, 13 aa, Staphylococcus epidermidis
WRDKNGNYRKVLP

SEQ ID NO: 1792735 - protein, 8 aa, Staphylococcus epidermidis
WRGDSNNK

SEQ ID NO: 1792736 - protein, 4 aa, Staphylococcus epidermidis
WRNR

SEQ ID NO: 1792737 - protein, 11 aa, Staphylococcus epidermidis
WSDDSDKTSTE

SEQ ID NO: 1792738 - protein, 5 aa, Staphylococcus epidermidis
WSPDT

SEQ ID NO: 1792739 - protein, 6 aa, Staphylococcus epidermidis
WSPEQS

SEQ ID NO: 1792740 - protein, 9 aa, Staphylococcus epidermidis
WSSTQNSIE

SEQ ID NO: 1792741 - protein, 8 aa, Staphylococcus epidermidis
WSTGKGSI

SEQ ID NO: 1792742 - protein, 7 aa, Staphylococcus epidermidis
WTGGGNT

SEQ ID NO: 1792743 - protein, 12 aa, Staphylococcus epidermidis
WTKGESSGHTQS

SEQ ID NO: 1792744 - protein, 8 aa, Staphylococcus epidermidis
WTQGSQGD

SEQ ID NO: 1792745 - protein, 9 aa, Staphylococcus epidermidis
WVNTAGKGV

SEQ ID NO: 1792746 - protein, 11 aa, Staphylococcus epidermidis
YADGTDNPEGH

SEQ ID NO: 1792747 - protein, 13 aa, Staphylococcus epidermidis
YADKDKFNRTSDV

SEQ ID NO: 1792748 - protein, 5 aa, Staphylococcus epidermidis
YADKR

SEQ ID NO: 1792749 - protein, 9 aa, Staphylococcus epidermidis
YADTTFNPN

SEQ ID NO: 1792750 - protein, 8 aa, Staphylococcus epidermidis
YAEDPQNF

SEQ ID NO: 1792751 - protein, 6 aa, Staphylococcus epidermidis
YAEDQY

SEQ ID NO: 1792752 - protein, 18 aa, Staphylococcus epidermidis
YAELEKGNNSYSFSEETS

SEQ ID NO: 1792753 - protein, 4 aa, Staphylococcus epidermidis
YAER

SEQ ID NO: 1792754 - protein, 13 aa, Staphylococcus epidermidis
YAESLKDTSEFSW

SEQ ID NO: 1792755 - protein, 9 aa, Staphylococcus epidermidis
YAESNNSDV

SEQ ID NO: 1792756 - protein, 8 aa, Staphylococcus epidermidis
YAETETYD

SEQ ID NO: 1792757 - protein, 12 aa, Staphylococcus epidermidis
YAGKEATIKTGQ

SEQ ID NO: 1792758 - protein, 10 aa, Staphylococcus epidermidis
YAGSDKDSRL

SEQ ID NO: 1792759 - protein, 8 aa, Staphylococcus epidermidis
YAGTPAHS

SEQ ID NO: 1792760 - protein, 20 aa, Staphylococcus epidermidis
YAHTPTGGSNNNGIEIDDGS

SEQ ID NO: 1792761 - protein, 5 aa, Staphylococcus epidermidis
YAKEE

SEQ ID NO: 1792762 - protein, 11 aa, Staphylococcus epidermidis
YAKEGKFAEGS

SEQ ID NO: 1792763 - protein, 8 aa, Staphylococcus epidermidis
YAKNKFEE

SEQ ID NO: 1792764 - protein, 11 aa, Staphylococcus epidermidis
YAKNNHSDRYE

SEQ ID NO: 1792765 - protein, 12 aa, Staphylococcus epidermidis
YAKQYGKKSVQA

SEQ ID NO: 1792766 - protein, 7 aa, Staphylococcus epidermidis
YAKRSQL

SEQ ID NO: 1792767 - protein, 11 aa, Staphylococcus epidermidis
YANAKNGLKGT

SEQ ID NO: 1792768 - protein, 6 aa, Staphylococcus epidermidis
YANKPI

SEQ ID NO: 1792769 - protein, 11 aa, Staphylococcus epidermidis
YANRGANGIDG

SEQ ID NO: 1792770 - protein, 8 aa, Staphylococcus epidermidis
YANRGYAK

SEQ ID NO: 1792771 - protein, 5 aa, Staphylococcus epidermidis
YAPAI

SEQ ID NO: 1792772 - protein, 4 aa, Staphylococcus epidermidis
YAPK

SEQ ID NO: 1792773 - protein, 8 aa, Staphylococcus epidermidis
YAPSMRDS

SEQ ID NO: 1792774 - protein, 8 aa, Staphylococcus epidermidis
YAPSPGSV

SEQ ID NO: 1792775 - protein, 7 aa, Staphylococcus epidermidis
YAPTKAS

SEQ ID NO: 1792776 - protein, 7 aa, Staphylococcus epidermidis
YAQTAEQ

SEQ ID NO: 1792777 - protein, 11 aa, Staphylococcus epidermidis
YARRQGKSLSD

SEQ ID NO: 1792778 - protein, 5 aa, Staphylococcus epidermidis
YASND

SEQ ID NO: 1792779 - protein, 6 aa, Staphylococcus epidermidis
YASPKL

SEQ ID NO: 1792780 - protein, 9 aa, Staphylococcus epidermidis
YASTEVTSI

SEQ ID NO: 1792781 - protein, 4 aa, Staphylococcus epidermidis
YATD

SEQ ID NO: 1792782 - protein, 10 aa, Staphylococcus epidermidis
YATDPRIHNE

SEQ ID NO: 1792783 - protein, 16 aa, Staphylococcus epidermidis
YATPSKDDASEPVGPS

SEQ ID NO: 1792784 - protein, 6 aa, Staphylococcus epidermidis
YATSEN

SEQ ID NO: 1792785 - protein, 4 aa, Staphylococcus epidermidis
YATT

SEQ ID NO: 1792786 - protein, 8 aa, Staphylococcus epidermidis
YDADNQSI

SEQ ID NO: 1792787 - protein, 15 aa, Staphylococcus epidermidis
YDANHHQQRKELEAY

SEQ ID NO: 1792788 - protein, 5 aa, Staphylococcus epidermidis
YDATD

SEQ ID NO: 1792789 - protein, 18 aa, Staphylococcus epidermidis
YDDASTSNSQGASDSKTI

SEQ ID NO: 1792790 - protein, 15 aa, Staphylococcus epidermidis
YDDEQALNELGEKTD

SEQ ID NO: 1792791 - protein, 10 aa, Staphylococcus epidermidis
YDEDDQPRRI

SEQ ID NO: 1792792 - protein, 5 aa, Staphylococcus epidermidis
YDEED

SEQ ID NO: 1792793 - protein, 6 aa, Staphylococcus epidermidis
YDEGKR

SEQ ID NO: 1792794 - protein, 4 aa, Staphylococcus epidermidis
YDEK

SEQ ID NO: 1792795 - protein, 10 aa, Staphylococcus epidermidis
YDENDQPKRI

SEQ ID NO: 1792796 - protein, 15 aa, Staphylococcus epidermidis
YDENEKSEKETYPVE

SEQ ID NO: 1792797 - protein, 5 aa, Staphylococcus epidermidis
YDENR

SEQ ID NO: 1792798 - protein, 8 aa, Staphylococcus epidermidis
YDENSNLY

SEQ ID NO: 1792799 - protein, 10 aa, Staphylococcus epidermidis
YDGDKEKAEL

SEQ ID NO: 1792800 - protein, 10 aa, Staphylococcus epidermidis
YDIKTKKTPR

SEQ ID NO: 1792801 - protein, 7 aa, Staphylococcus epidermidis
YDIPTKK

SEQ ID NO: 1792802 - protein, 28 aa, Staphylococcus epidermidis
YDIPTKKAPELKLKGDGDLKGSSVGTKD

SEQ ID NO: 1792803 - protein, 7 aa, Staphylococcus epidermidis
YDIPTNQ

SEQ ID NO: 1792804 - protein, 19 aa, Staphylococcus epidermidis
YDKEGYRDEEFDKDDKGTW

SEQ ID NO: 1792805 - protein, 18 aa, Staphylococcus epidermidis
YDKEGYRDEEFDKNDKGT

SEQ ID NO: 1792806 - protein, 17 aa, Staphylococcus epidermidis
YDKEGYRDEEFEKRDKG

SEQ ID NO: 1792807 - protein, 16 aa, Staphylococcus epidermidis
YDKEGYRDEEFNKGDK

SEQ ID NO: 1792808 - protein, 8 aa, Staphylococcus epidermidis
YDKEKGQR

SEQ ID NO: 1792809 - protein, 9 aa, Staphylococcus epidermidis
YDKENNAET

SEQ ID NO: 1792810 - protein, 6 aa, Staphylococcus epidermidis
YDKEPD

SEQ ID NO: 1792811 - protein, 5 aa, Staphylococcus epidermidis
YDKPG

SEQ ID NO: 1792812 - protein, 8 aa, Staphylococcus epidermidis
YDKQKDSK

SEQ ID NO: 1792813 - protein, 9 aa, Staphylococcus epidermidis
YDKQNIKVE

SEQ ID NO: 1792814 - protein, 4 aa, Staphylococcus epidermidis
YDKT

SEQ ID NO: 1792815 - protein, 8 aa, Staphylococcus epidermidis
YDKTSVAD

SEQ ID NO: 1792816 - protein, 9 aa, Staphylococcus epidermidis
YDKTSVDDI

SEQ ID NO: 1792817 - protein, 4 aa, Staphylococcus epidermidis
YDLP

SEQ ID NO: 1792818 - protein, 13 aa, Staphylococcus epidermidis
YDNAGDPSEKEIT

SEQ ID NO: 1792819 - protein, 10 aa, Staphylococcus epidermidis
YDNDTSRNIN

SEQ ID NO: 1792820 - protein, 6 aa, Staphylococcus epidermidis
YDNEGA

SEQ ID NO: 1792821 - protein, 7 aa, Staphylococcus epidermidis
YDNKKTD

SEQ ID NO: 1792822 - protein, 7 aa, Staphylococcus epidermidis
YDNKSGL

SEQ ID NO: 1792823 - protein, 5 aa, Staphylococcus epidermidis
YDNMN

SEQ ID NO: 1792824 - protein, 9 aa, Staphylococcus epidermidis
YDNNPDASI

SEQ ID NO: 1792825 - protein, 9 aa, Staphylococcus epidermidis
YDNNPNASI

SEQ ID NO: 1792826 - protein, 28 aa, Staphylococcus epidermidis
YDNQTGVNEKEREEQQKHAQENQEPQFE

SEQ ID NO: 1792827 - protein, 5 aa, Staphylococcus epidermidis
YDNSN

SEQ ID NO: 1792828 - protein, 6 aa, Staphylococcus epidermidis
YDNTMR

SEQ ID NO: 1792829 - protein, 9 aa, Staphylococcus epidermidis
YDPEISESV

SEQ ID NO: 1792830 - protein, 4 aa, Staphylococcus epidermidis
YDQL

SEQ ID NO: 1792831 - protein, 5 aa, Staphylococcus epidermidis
YDRPL

SEQ ID NO: 1792832 - protein, 7 aa, Staphylococcus epidermidis
YDSASNV

SEQ ID NO: 1792833 - protein, 13 aa, Staphylococcus epidermidis
YDSEKGYHRGSNH

SEQ ID NO: 1792834 - protein, 6 aa, Staphylococcus epidermidis
YDSHTG

SEQ ID NO: 1792835 - protein, 4 aa, Staphylococcus epidermidis
YDSN

SEQ ID NO: 1792836 - protein, 10 aa, Staphylococcus epidermidis
YDSNDNTINI

SEQ ID NO: 1792837 - protein, 10 aa, Staphylococcus epidermidis
YDSNKPGPTI

SEQ ID NO: 1792838 - protein, 7 aa, Staphylococcus epidermidis
YDSPITR

SEQ ID NO: 1792839 - protein, 17 aa, Staphylococcus epidermidis
YDSRREAFDPSGDLKPY

SEQ ID NO: 1792840 - protein, 9 aa, Staphylococcus epidermidis
YDSSKIAER

SEQ ID NO: 1792841 - protein, 15 aa, Staphylococcus epidermidis
YDSSKYKYKEKEDMA

SEQ ID NO: 1792842 - protein, 6 aa, Staphylococcus epidermidis
YDSSRN

SEQ ID NO: 1792843 - protein, 8 aa, Staphylococcus epidermidis
YDSSTALS

SEQ ID NO: 1792844 - protein, 11 aa, Staphylococcus epidermidis
YDTVGKPSDNV

SEQ ID NO: 1792845 - protein, 13 aa, Staphylococcus epidermidis
YDYGEKETKYPVE

SEQ ID NO: 1792846 - protein, 15 aa, Staphylococcus epidermidis
YEASEQSARESQANL

SEQ ID NO: 1792847 - protein, 7 aa, Staphylococcus epidermidis
YEASISN

SEQ ID NO: 1792848 - protein, 7 aa, Staphylococcus epidermidis
YEATDEG

SEQ ID NO: 1792849 - protein, 7 aa, Staphylococcus epidermidis
YEDSETV

SEQ ID NO: 1792850 - protein, 10 aa, Staphylococcus epidermidis
YEEEQQKPLK

SEQ ID NO: 1792851 - protein, 12 aa, Staphylococcus epidermidis
YEEKEVTEKPYD

SEQ ID NO: 1792852 - protein, 7 aa, Staphylococcus epidermidis
YEEQKDK

SEQ ID NO: 1792853 - protein, 7 aa, Staphylococcus epidermidis
YEESVKG

SEQ ID NO: 1792854 - protein, 21 aa, Staphylococcus epidermidis
YEFKDKNNTHHRGETKTDTVK

SEQ ID NO: 1792855 - protein, 24 aa, Staphylococcus epidermidis
YEGHPLDTDTYTFKEPEQNEDGDW

SEQ ID NO: 1792856 - protein, 9 aa, Staphylococcus epidermidis
YEGKETTTY

SEQ ID NO: 1792857 - protein, 8 aa, Staphylococcus epidermidis
YEGQEFSE

SEQ ID NO: 1792858 - protein, 12 aa, Staphylococcus epidermidis
YEGQGAEHSSAR

SEQ ID NO: 1792859 - protein, 10 aa, Staphylococcus epidermidis
YEGQSQRPSG

SEQ ID NO: 1792860 - protein, 4 aa, Staphylococcus epidermidis
YEHT

SEQ ID NO: 1792861 - protein, 20 aa, Staphylococcus epidermidis
YEHTRPKIEKSVRNDLKETY

SEQ ID NO: 1792862 - protein, 11 aa, Staphylococcus epidermidis
YEISGGQKQRV

SEQ ID NO: 1792863 - protein, 10 aa, Staphylococcus epidermidis
YEKDQKSNPM

SEQ ID NO: 1792864 - protein, 4 aa, Staphylococcus epidermidis
YEKG

SEQ ID NO: 1792865 - protein, 9 aa, Staphylococcus epidermidis
YEKNDLTQE

SEQ ID NO: 1792866 - protein, 8 aa, Staphylococcus epidermidis
YEKNNERS

SEQ ID NO: 1792867 - protein, 8 aa, Staphylococcus epidermidis
YEKRKEEL

SEQ ID NO: 1792868 - protein, 18 aa, Staphylococcus epidermidis
YEKTSAPVTEVDEEVEIT

SEQ ID NO: 1792869 - protein, 13 aa, Staphylococcus epidermidis
YEKYEKEKKRLEK

SEQ ID NO: 1792870 - protein, 8 aa, Staphylococcus epidermidis
YELSEDEL

SEQ ID NO: 1792871 - protein, 11 aa, Staphylococcus epidermidis
YEMENNYKEVT

SEQ ID NO: 1792872 - protein, 13 aa, Staphylococcus epidermidis
YENAGDPSEKEVT

SEQ ID NO: 1792873 - protein, 9 aa, Staphylococcus epidermidis
YENGAIDNT

SEQ ID NO: 1792874 - protein, 8 aa, Staphylococcus epidermidis
YENGDKWT

SEQ ID NO: 1792875 - protein, 25 aa, Staphylococcus epidermidis
YEPGEGLATEETPLDYNSTGDRKIT

SEQ ID NO: 1792876 - protein, 12 aa, Staphylococcus epidermidis
YEPNNLSGKEIR

SEQ ID NO: 1792877 - protein, 8 aa, Staphylococcus epidermidis
YEPSDWDE

SEQ ID NO: 1792878 - protein, 36 aa, Staphylococcus epidermidis
YEQAQQAQQQAQGEQGSQDSTVEDADFKEVKDDEDK

SEQ ID NO: 1792879 - protein, 6 aa, Staphylococcus epidermidis
YEQGTV

SEQ ID NO: 1792880 - protein, 10 aa, Staphylococcus epidermidis
YEQNNERSIS

SEQ ID NO: 1792881 - protein, 5 aa, Staphylococcus epidermidis
YEREE

SEQ ID NO: 1792882 - protein, 16 aa, Staphylococcus epidermidis
YERKDREGVFHTQWVE

SEQ ID NO: 1792883 - protein, 10 aa, Staphylococcus epidermidis
YESGTNGPLE

SEQ ID NO: 1792884 - protein, 4 aa, Staphylococcus epidermidis
YESK

SEQ ID NO: 1792885 - protein, 12 aa, Staphylococcus epidermidis
YETEPVGYTEQP

SEQ ID NO: 1792886 - protein, 4 aa, Staphylococcus epidermidis
YETL

SEQ ID NO: 1792887 - protein, 8 aa, Staphylococcus epidermidis
YETNGPSL

SEQ ID NO: 1792888 - protein, 16 aa, Staphylococcus epidermidis
YETPPNQNKINPYELT

SEQ ID NO: 1792889 - protein, 8 aa, Staphylococcus epidermidis
YETPTNLN

SEQ ID NO: 1792890 - protein, 4 aa, Staphylococcus epidermidis
YETR

SEQ ID NO: 1792891 - protein, 9 aa, Staphylococcus epidermidis
YETVGDASE

SEQ ID NO: 1792892 - protein, 19 aa, Staphylococcus epidermidis
YETYTDSGISGKNIEGRPA

SEQ ID NO: 1792893 - protein, 13 aa, Staphylococcus epidermidis
YEVRGQSDEYERM

SEQ ID NO: 1792894 - protein, 8 aa, Staphylococcus epidermidis
YEYSGQLD

SEQ ID NO: 1792895 - protein, 21 aa, Staphylococcus epidermidis
YEYTRPKIEKSVRNDLKETYE

SEQ ID NO: 1792896 - protein, 19 aa, Staphylococcus epidermidis
YFNENDKQNIFQGNTAQIL

SEQ ID NO: 1792897 - protein, 12 aa, Staphylococcus epidermidis
YFSRNADDLKRD

SEQ ID NO: 1792898 - protein, 8 aa, Staphylococcus epidermidis
YFSRSAED

SEQ ID NO: 1792899 - protein, 5 aa, Staphylococcus epidermidis
YGADS

SEQ ID NO: 1792900 - protein, 9 aa, Staphylococcus epidermidis
YGASRGKAF

SEQ ID NO: 1792901 - protein, 11 aa, Staphylococcus epidermidis
YGCGDDGITTH

SEQ ID NO: 1792902 - protein, 5 aa, Staphylococcus epidermidis
YGDDE

SEQ ID NO: 1792903 - protein, 4 aa, Staphylococcus epidermidis
YGDH

SEQ ID NO: 1792904 - protein, 9 aa, Staphylococcus epidermidis
YGDQLPSEH

SEQ ID NO: 1792905 - protein, 6 aa, Staphylococcus epidermidis
YGDREC

SEQ ID NO: 1792906 - protein, 20 aa, Staphylococcus epidermidis
YGEDRNNAIKENFNDDQAAE

SEQ ID NO: 1792907 - protein, 10 aa, Staphylococcus epidermidis
YGEDTAEQSA

SEQ ID NO: 1792908 - protein, 4 aa, Staphylococcus epidermidis
YGEK

SEQ ID NO: 1792909 - protein, 15 aa, Staphylococcus epidermidis
YGEKQSILGGKDGYD

SEQ ID NO: 1792910 - protein, 4 aa, Staphylococcus epidermidis
YGEN

SEQ ID NO: 1792911 - protein, 7 aa, Staphylococcus epidermidis
YGENSNA

SEQ ID NO: 1792912 - protein, 15 aa, Staphylococcus epidermidis
YGEPKSTSTSAWGKE

SEQ ID NO: 1792913 - protein, 8 aa, Staphylococcus epidermidis
YGEQKGFK

SEQ ID NO: 1792914 - protein, 12 aa, Staphylococcus epidermidis
YGERTTTLEAKE

SEQ ID NO: 1792915 - protein, 8 aa, Staphylococcus epidermidis
YGEVNAKG

SEQ ID NO: 1792916 - protein, 12 aa, Staphylococcus epidermidis
YGGAQNNPPEVA

SEQ ID NO: 1792917 - protein, 9 aa, Staphylococcus epidermidis
YGGDGDGGY

SEQ ID NO: 1792918 - protein, 4 aa, Staphylococcus epidermidis
YGGG

SEQ ID NO: 1792919 - protein, 12 aa, Staphylococcus epidermidis
YGGGNSQGAVGA

SEQ ID NO: 1792920 - protein, 6 aa, Staphylococcus epidermidis
YGGGYG

SEQ ID NO: 1792921 - protein, 22 aa, Staphylococcus epidermidis
YGGKRKNYYGEGEDALVMWVNL

SEQ ID NO: 1792922 - protein, 6 aa, Staphylococcus epidermidis
YGGTDA

SEQ ID NO: 1792923 - protein, 5 aa, Staphylococcus epidermidis
YGGTY

SEQ ID NO: 1792924 - protein, 8 aa, Staphylococcus epidermidis
YGHNPEQL

SEQ ID NO: 1792925 - protein, 5 aa, Staphylococcus epidermidis
YGIGT

SEQ ID NO: 1792926 - protein, 7 aa, Staphylococcus epidermidis
YGIKQGN

SEQ ID NO: 1792927 - protein, 8 aa, Staphylococcus epidermidis
YGKDEVNS

SEQ ID NO: 1792928 - protein, 34 aa, Staphylococcus epidermidis
YGKELKKQTAQPTGQPVRSKRGGSWMSRLRDTFK

SEQ ID NO: 1792929 - protein, 5 aa, Staphylococcus epidermidis
YGKGI

SEQ ID NO: 1792930 - protein, 9 aa, Staphylococcus epidermidis
YGKKDKPYN

SEQ ID NO: 1792931 - protein, 7 aa, Staphylococcus epidermidis
YGKKSEE

SEQ ID NO: 1792932 - protein, 6 aa, Staphylococcus epidermidis
YGKNAN

SEQ ID NO: 1792933 - protein, 16 aa, Staphylococcus epidermidis
YGKNQKNVKNPRGKYP

SEQ ID NO: 1792934 - protein, 5 aa, Staphylococcus epidermidis
YGKRP

SEQ ID NO: 1792935 - protein, 9 aa, Staphylococcus epidermidis
YGKTGGNEG

SEQ ID NO: 1792936 - protein, 6 aa, Staphylococcus epidermidis
YGLEPK

SEQ ID NO: 1792937 - protein, 4 aa, Staphylococcus epidermidis
YGLG

SEQ ID NO: 1792938 - protein, 12 aa, Staphylococcus epidermidis
YGLPASEARNKD

SEQ ID NO: 1792939 - protein, 4 aa, Staphylococcus epidermidis
YGNN

SEQ ID NO: 1792940 - protein, 6 aa, Staphylococcus epidermidis
YGPGEL

SEQ ID NO: 1792941 - protein, 14 aa, Staphylococcus epidermidis
YGPGELIQDGKNGY

SEQ ID NO: 1792942 - protein, 20 aa, Staphylococcus epidermidis
YGPKESEKLLSEDGLNWWNN

SEQ ID NO: 1792943 - protein, 9 aa, Staphylococcus epidermidis
YGPPKDRRA

SEQ ID NO: 1792944 - protein, 8 aa, Staphylococcus epidermidis
YGPSESTV

SEQ ID NO: 1792945 - protein, 10 aa, Staphylococcus epidermidis
YGQKDTHHKE

SEQ ID NO: 1792946 - protein, 15 aa, Staphylococcus epidermidis
YGQKNEQIRRYNRGE

SEQ ID NO: 1792947 - protein, 16 aa, Staphylococcus epidermidis
YGQKNEQIRRYNRGEV

SEQ ID NO: 1792948 - protein, 11 aa, Staphylococcus epidermidis
YGQQDTQDKED

SEQ ID NO: 1792949 - protein, 15 aa, Staphylococcus epidermidis
YGQQSDISQAHGTAL

SEQ ID NO: 1792950 - protein, 11 aa, Staphylococcus epidermidis
YGRGLNSTTAL

SEQ ID NO: 1792951 - protein, 6 aa, Staphylococcus epidermidis
YGRPSK

SEQ ID NO: 1792952 - protein, 4 aa, Staphylococcus epidermidis
YGSG

SEQ ID NO: 1792953 - protein, 10 aa, Staphylococcus epidermidis
YGSHGTTFGG

SEQ ID NO: 1792954 - protein, 16 aa, Staphylococcus epidermidis
YGSHNNTLGATLAGEV

SEQ ID NO: 1792955 - protein, 8 aa, Staphylococcus epidermidis
YGSKNLAQ

SEQ ID NO: 1792956 - protein, 12 aa, Staphylococcus epidermidis
YGSLNEKKEALE

SEQ ID NO: 1792957 - protein, 11 aa, Staphylococcus epidermidis
YGSQGQQRTTA

SEQ ID NO: 1792958 - protein, 10 aa, Staphylococcus epidermidis
YGSRAVKPPV

SEQ ID NO: 1792959 - protein, 8 aa, Staphylococcus epidermidis
YGSTGDAY

SEQ ID NO: 1792960 - protein, 10 aa, Staphylococcus epidermidis
YGTEGAKSAI

SEQ ID NO: 1792961 - protein, 8 aa, Staphylococcus epidermidis
YGTEGRNL

SEQ ID NO: 1792962 - protein, 4 aa, Staphylococcus epidermidis
YGTH

SEQ ID NO: 1792963 - protein, 7 aa, Staphylococcus epidermidis
YGTIDNE

SEQ ID NO: 1792964 - protein, 6 aa, Staphylococcus epidermidis
YGTPTE

SEQ ID NO: 1792965 - protein, 5 aa, Staphylococcus epidermidis
YGTQV

SEQ ID NO: 1792966 - protein, 5 aa, Staphylococcus epidermidis
YGTYE

SEQ ID NO: 1792967 - protein, 6 aa, Staphylococcus epidermidis
YGTYYK

SEQ ID NO: 1792968 - protein, 4 aa, Staphylococcus epidermidis
YGYD

SEQ ID NO: 1792969 - protein, 10 aa, Staphylococcus epidermidis
YGYDDPPSVS

SEQ ID NO: 1792970 - protein, 13 aa, Staphylococcus epidermidis
YGYDTNPIGGFDK

SEQ ID NO: 1792971 - protein, 7 aa, Staphylococcus epidermidis
YGYPQEA

SEQ ID NO: 1792972 - protein, 5 aa, Staphylococcus epidermidis
YGYTP

SEQ ID NO: 1792973 - protein, 23 aa, Staphylococcus epidermidis
YHADEQVNEAAKERQRQGEEQLS

SEQ ID NO: 1792974 - protein, 34 aa, Staphylococcus epidermidis
YHAETKKPSKASSTPSKPSSDNTPKNTKEQTKPI

SEQ ID NO: 1792975 - protein, 9 aa, Staphylococcus epidermidis
YHDADATAF

SEQ ID NO: 1792976 - protein, 5 aa, Staphylococcus epidermidis
YHDGE

SEQ ID NO: 1792977 - protein, 5 aa, Staphylococcus epidermidis
YHDNQ

SEQ ID NO: 1792978 - protein, 8 aa, Staphylococcus epidermidis
YHEETEGI

SEQ ID NO: 1792979 - protein, 6 aa, Staphylococcus epidermidis
YHKDKA

SEQ ID NO: 1792980 - protein, 25 aa, Staphylococcus epidermidis
YHNTSPPKSDAKAKADPRNVGGGGA

SEQ ID NO: 1792981 - protein, 6 aa, Staphylococcus epidermidis
YHPSRE

SEQ ID NO: 1792982 - protein, 9 aa, Staphylococcus epidermidis
YHSIPSEKD

SEQ ID NO: 1792983 - protein, 14 aa, Staphylococcus epidermidis
YHTSAPSSKDGLKD

SEQ ID NO: 1792984 - protein, 5 aa, Staphylococcus epidermidis
YIDET

SEQ ID NO: 1792985 - protein, 11 aa, Staphylococcus epidermidis
YIEHPKENGYR

SEQ ID NO: 1792986 - protein, 14 aa, Staphylococcus epidermidis
YIGEKNRKYVPIEE

SEQ ID NO: 1792987 - protein, 4 aa, Staphylococcus epidermidis
YIKE

SEQ ID NO: 1792988 - protein, 15 aa, Staphylococcus epidermidis
YINGTEKQDYMPNGN

SEQ ID NO: 1792989 - protein, 5 aa, Staphylococcus epidermidis
YIPNK

SEQ ID NO: 1792990 - protein, 27 aa, Staphylococcus epidermidis
YIPRKDNSMYNASKKSIEKIAKEGRKY

SEQ ID NO: 1792991 - protein, 12 aa, Staphylococcus epidermidis
YITPDNATTEIP

SEQ ID NO: 1792992 - protein, 8 aa, Staphylococcus epidermidis
YKAGASDV

SEQ ID NO: 1792993 - protein, 12 aa, Staphylococcus epidermidis
YKAQGSQGYGGE

SEQ ID NO: 1792994 - protein, 4 aa, Staphylococcus epidermidis
YKAT

SEQ ID NO: 1792995 - protein, 7 aa, Staphylococcus epidermidis
YKDAHNE

SEQ ID NO: 1792996 - protein, 13 aa, Staphylococcus epidermidis
YKDITGEEYKRPQ

SEQ ID NO: 1792997 - protein, 11 aa, Staphylococcus epidermidis
YKDQQKHYDGH

SEQ ID NO: 1792998 - protein, 7 aa, Staphylococcus epidermidis
YKDRNRV

SEQ ID NO: 1792999 - protein, 11 aa, Staphylococcus epidermidis
YKDSGLKKHTA

SEQ ID NO: 1793000 - protein, 14 aa, Staphylococcus epidermidis
YKDTNEDLDGYMFY

SEQ ID NO: 1793001 - protein, 12 aa, Staphylococcus epidermidis
YKEAGAEIVSEQ

SEQ ID NO: 1793002 - protein, 12 aa, Staphylococcus epidermidis
YKEAGKPTYPHE

SEQ ID NO: 1793003 - protein, 7 aa, Staphylococcus epidermidis
YKEDPTI

SEQ ID NO: 1793004 - protein, 8 aa, Staphylococcus epidermidis
YKEDRDNV

SEQ ID NO: 1793005 - protein, 46 aa, Staphylococcus epidermidis
YKEEGAQVQKLRSQNKELSNSNDKVKSTYDKTNTELKQAENEYKQL

SEQ ID NO: 1793006 - protein, 7 aa, Staphylococcus epidermidis
YKEEKGK

SEQ ID NO: 1793007 - protein, 18 aa, Staphylococcus epidermidis
YKENGGEQNEQIIHSVYY

SEQ ID NO: 1793008 - protein, 7 aa, Staphylococcus epidermidis
YKERNNP

SEQ ID NO: 1793009 - protein, 12 aa, Staphylococcus epidermidis
YKERTITNGTTE

SEQ ID NO: 1793010 - protein, 17 aa, Staphylococcus epidermidis
YKESRRAHPLNEKGQRS

SEQ ID NO: 1793011 - protein, 8 aa, Staphylococcus epidermidis
YKESYTKE

SEQ ID NO: 1793012 - protein, 14 aa, Staphylococcus epidermidis
YKETDEDLDGYMFY

SEQ ID NO: 1793013 - protein, 11 aa, Staphylococcus epidermidis
YKETEKITNSQ

SEQ ID NO: 1793014 - protein, 10 aa, Staphylococcus epidermidis
YKEVSSRNEA

SEQ ID NO: 1793015 - protein, 15 aa, Staphylococcus epidermidis
YKEWTKQSKPFRNVK

SEQ ID NO: 1793016 - protein, 5 aa, Staphylococcus epidermidis
YKEYF

SEQ ID NO: 1793017 - protein, 10 aa, Staphylococcus epidermidis
YKFAGGKGIN

SEQ ID NO: 1793018 - protein, 12 aa, Staphylococcus epidermidis
YKGARLTEAGLN

SEQ ID NO: 1793019 - protein, 5 aa, Staphylococcus epidermidis
YKGDE

SEQ ID NO: 1793020 - protein, 16 aa, Staphylococcus epidermidis
YKGELSNETIALKVIN

SEQ ID NO: 1793021 - protein, 10 aa, Staphylococcus epidermidis
YKGENQRPTQ

SEQ ID NO: 1793022 - protein, 7 aa, Staphylococcus epidermidis
YKGKKTT

SEQ ID NO: 1793023 - protein, 8 aa, Staphylococcus epidermidis
YKGKPYTQ

SEQ ID NO: 1793024 - protein, 7 aa, Staphylococcus epidermidis
YKGMGNG

SEQ ID NO: 1793025 - protein, 13 aa, Staphylococcus epidermidis
YKGNGAYTSAENN

SEQ ID NO: 1793026 - protein, 4 aa, Staphylococcus epidermidis
YKGP

SEQ ID NO: 1793027 - protein, 7 aa, Staphylococcus epidermidis
YKGTDYR

SEQ ID NO: 1793028 - protein, 7 aa, Staphylococcus epidermidis
YKHQTTI

SEQ ID NO: 1793029 - protein, 6 aa, Staphylococcus epidermidis
YKIPKG

SEQ ID NO: 1793030 - protein, 9 aa, Staphylococcus epidermidis
YKISKPKNA

SEQ ID NO: 1793031 - protein, 11 aa, Staphylococcus epidermidis
YKKDDPQKTFV

SEQ ID NO: 1793032 - protein, 11 aa, Staphylococcus epidermidis
YKKENENRKRI

SEQ ID NO: 1793033 - protein, 6 aa, Staphylococcus epidermidis
YKKETI

SEQ ID NO: 1793034 - protein, 22 aa, Staphylococcus epidermidis
YKKPSDRITVDERATKLSKDLK

SEQ ID NO: 1793035 - protein, 11 aa, Staphylococcus epidermidis
YKNDADTEKYK

SEQ ID NO: 1793036 - protein, 6 aa, Staphylococcus epidermidis
YKNDCP

SEQ ID NO: 1793037 - protein, 9 aa, Staphylococcus epidermidis
YKNDNDSAR

SEQ ID NO: 1793038 - protein, 5 aa, Staphylococcus epidermidis
YKNEK

SEQ ID NO: 1793039 - protein, 8 aa, Staphylococcus epidermidis
YKNETNLK

SEQ ID NO: 1793040 - protein, 4 aa, Staphylococcus epidermidis
YKNN

SEQ ID NO: 1793041 - protein, 10 aa, Staphylococcus epidermidis
YKNNADRALK

SEQ ID NO: 1793042 - protein, 9 aa, Staphylococcus epidermidis
YKNPDNKKE

SEQ ID NO: 1793043 - protein, 7 aa, Staphylococcus epidermidis
YKNQNDL

SEQ ID NO: 1793044 - protein, 11 aa, Staphylococcus epidermidis
YKNYPREENTQ

SEQ ID NO: 1793045 - protein, 13 aa, Staphylococcus epidermidis
YKPPRSHKKFPSQ

SEQ ID NO: 1793046 - protein, 4 aa, Staphylococcus epidermidis
YKPR

SEQ ID NO: 1793047 - protein, 8 aa, Staphylococcus epidermidis
YKPSKEEM

SEQ ID NO: 1793048 - protein, 8 aa, Staphylococcus epidermidis
YKQQGTKH

SEQ ID NO: 1793049 - protein, 5 aa, Staphylococcus epidermidis
YKQSG

SEQ ID NO: 1793050 - protein, 8 aa, Staphylococcus epidermidis
YKQSKGLL

SEQ ID NO: 1793051 - protein, 7 aa, Staphylococcus epidermidis
YKQTSKV

SEQ ID NO: 1793052 - protein, 10 aa, Staphylococcus epidermidis
YKRKPYEKDY

SEQ ID NO: 1793053 - protein, 6 aa, Staphylococcus epidermidis
YKRNGD

SEQ ID NO: 1793054 - protein, 9 aa, Staphylococcus epidermidis
YKRSAGVEF

SEQ ID NO: 1793055 - protein, 9 aa, Staphylococcus epidermidis
YKRTKPDID

SEQ ID NO: 1793056 - protein, 9 aa, Staphylococcus epidermidis
YKRTQSPID

SEQ ID NO: 1793057 - protein, 10 aa, Staphylococcus epidermidis
YKSDKKAPYQ

SEQ ID NO: 1793058 - protein, 13 aa, Staphylococcus epidermidis
YKSEKTHMQFYDE

SEQ ID NO: 1793059 - protein, 7 aa, Staphylococcus epidermidis
YKSGEYR

SEQ ID NO: 1793060 - protein, 17 aa, Staphylococcus epidermidis
YKSIEESAFYIEKFLMQ

SEQ ID NO: 1793061 - protein, 6 aa, Staphylococcus epidermidis
YKSPNY

SEQ ID NO: 1793062 - protein, 11 aa, Staphylococcus epidermidis
YKSSDDANNSI

SEQ ID NO: 1793063 - protein, 6 aa, Staphylococcus epidermidis
YKTGGT

SEQ ID NO: 1793064 - protein, 11 aa, Staphylococcus epidermidis
YKTKKSKERTI

SEQ ID NO: 1793065 - protein, 7 aa, Staphylococcus epidermidis
YKTPEDY

SEQ ID NO: 1793066 - protein, 4 aa, Staphylococcus epidermidis
YKTQ

SEQ ID NO: 1793067 - protein, 9 aa, Staphylococcus epidermidis
YKTTYTEKH

SEQ ID NO: 1793068 - protein, 22 aa, Staphylococcus epidermidis
YKTVDGKKVRVAKKSGEEIKSN

SEQ ID NO: 1793069 - protein, 6 aa, Staphylococcus epidermidis
YLDEKK

SEQ ID NO: 1793070 - protein, 4 aa, Staphylococcus epidermidis
YLET

SEQ ID NO: 1793071 - protein, 10 aa, Staphylococcus epidermidis
YLGGQNDKNF

SEQ ID NO: 1793072 - protein, 26 aa, Staphylococcus epidermidis
YLGPAREAIKETVKGKIKEFGTSNRA

SEQ ID NO: 1793073 - protein, 4 aa, Staphylococcus epidermidis
YLQS

SEQ ID NO: 1793074 - protein, 27 aa, Staphylococcus epidermidis
YLSPDRKEKLQKMKTRAENRKFINPDD

SEQ ID NO: 1793075 - protein, 5 aa, Staphylococcus epidermidis
YNAKF

SEQ ID NO: 1793076 - protein, 6 aa, Staphylococcus epidermidis
YNAKTK

SEQ ID NO: 1793077 - protein, 13 aa, Staphylococcus epidermidis
YNASKPKLQGDQG

SEQ ID NO: 1793078 - protein, 12 aa, Staphylococcus epidermidis
YNATNYKGKTDI

SEQ ID NO: 1793079 - protein, 9 aa, Staphylococcus epidermidis
YNDAVQSKQ

SEQ ID NO: 1793080 - protein, 6 aa, Staphylococcus epidermidis
YNDDVD

SEQ ID NO: 1793081 - protein, 13 aa, Staphylococcus epidermidis
YNDEYSAKQRTLT

SEQ ID NO: 1793082 - protein, 6 aa, Staphylococcus epidermidis
YNDGDP

SEQ ID NO: 1793083 - protein, 14 aa, Staphylococcus epidermidis
YNEDTKLRQDREAF

SEQ ID NO: 1793084 - protein, 10 aa, Staphylococcus epidermidis
YNEETRSTEI

SEQ ID NO: 1793085 - protein, 4 aa, Staphylococcus epidermidis
YNEK

SEQ ID NO: 1793086 - protein, 14 aa, Staphylococcus epidermidis
YNEKAQNFKYGETF

SEQ ID NO: 1793087 - protein, 10 aa, Staphylococcus epidermidis
YNEKRDDYNP

SEQ ID NO: 1793088 - protein, 11 aa, Staphylococcus epidermidis
YNGAYEGATPR

SEQ ID NO: 1793089 - protein, 8 aa, Staphylococcus epidermidis
YNGDEGIL

SEQ ID NO: 1793090 - protein, 10 aa, Staphylococcus epidermidis
YNGGPHAERK

SEQ ID NO: 1793091 - protein, 7 aa, Staphylococcus epidermidis
YNGSDDV

SEQ ID NO: 1793092 - protein, 6 aa, Staphylococcus epidermidis
YNHTTS

SEQ ID NO: 1793093 - protein, 7 aa, Staphylococcus epidermidis
YNKAEDW

SEQ ID NO: 1793094 - protein, 16 aa, Staphylococcus epidermidis
YNKDTGKITKNEREVN

SEQ ID NO: 1793095 - protein, 4 aa, Staphylococcus epidermidis
YNKE

SEQ ID NO: 1793096 - protein, 13 aa, Staphylococcus epidermidis
YNKENVKKRTTMS

SEQ ID NO: 1793097 - protein, 9 aa, Staphylococcus epidermidis
YNKERDDYN

SEQ ID NO: 1793098 - protein, 5 aa, Staphylococcus epidermidis
YNLSR

SEQ ID NO: 1793099 - protein, 11 aa, Staphylococcus epidermidis
YNNDKYQNKKN

SEQ ID NO: 1793100 - protein, 4 aa, Staphylococcus epidermidis
YNNI

SEQ ID NO: 1793101 - protein, 7 aa, Staphylococcus epidermidis
YNNNQIQ

SEQ ID NO: 1793102 - protein, 9 aa, Staphylococcus epidermidis
YNNRNKMKG

SEQ ID NO: 1793103 - protein, 10 aa, Staphylococcus epidermidis
YNNSNKKELI

SEQ ID NO: 1793104 - protein, 8 aa, Staphylococcus epidermidis
YNNVDQEE

SEQ ID NO: 1793105 - protein, 4 aa, Staphylococcus epidermidis
YNQE

SEQ ID NO: 1793106 - protein, 9 aa, Staphylococcus epidermidis
YNQESSTIQ

SEQ ID NO: 1793107 - protein, 4 aa, Staphylococcus epidermidis
YNQQ

SEQ ID NO: 1793108 - protein, 11 aa, Staphylococcus epidermidis
YNQSKKENEYV

SEQ ID NO: 1793109 - protein, 4 aa, Staphylococcus epidermidis
YNRE

SEQ ID NO: 1793110 - protein, 9 aa, Staphylococcus epidermidis
YNRKDFDEK

SEQ ID NO: 1793111 - protein, 6 aa, Staphylococcus epidermidis
YNRSRQ

SEQ ID NO: 1793112 - protein, 5 aa, Staphylococcus epidermidis
YNSDD

SEQ ID NO: 1793113 - protein, 7 aa, Staphylococcus epidermidis
YNSSNER

SEQ ID NO: 1793114 - protein, 8 aa, Staphylococcus epidermidis
YNTEIRPN

SEQ ID NO: 1793115 - protein, 8 aa, Staphylococcus epidermidis
YNTNEIEN

SEQ ID NO: 1793116 - protein, 7 aa, Staphylococcus epidermidis
YNTRGRL

SEQ ID NO: 1793117 - protein, 6 aa, Staphylococcus epidermidis
YNTTAE

SEQ ID NO: 1793118 - protein, 5 aa, Staphylococcus epidermidis
YNYPY

SEQ ID NO: 1793119 - protein, 6 aa, Staphylococcus epidermidis
YPDDPN

SEQ ID NO: 1793120 - protein, 9 aa, Staphylococcus epidermidis
YPDEQNKNS

SEQ ID NO: 1793121 - protein, 6 aa, Staphylococcus epidermidis
YPDQPF

SEQ ID NO: 1793122 - protein, 8 aa, Staphylococcus epidermidis
YPEAVTET

SEQ ID NO: 1793123 - protein, 5 aa, Staphylococcus epidermidis
YPETD

SEQ ID NO: 1793124 - protein, 10 aa, Staphylococcus epidermidis
YPGKSLESLT

SEQ ID NO: 1793125 - protein, 10 aa, Staphylococcus epidermidis
YPKDSNHPYT

SEQ ID NO: 1793126 - protein, 12 aa, Staphylococcus epidermidis
YPKSGTAISPRP

SEQ ID NO: 1793127 - protein, 8 aa, Staphylococcus epidermidis
YPKTKKDI

SEQ ID NO: 1793128 - protein, 7 aa, Staphylococcus epidermidis
YPLNDGK

SEQ ID NO: 1793129 - protein, 4 aa, Staphylococcus epidermidis
YPMP

SEQ ID NO: 1793130 - protein, 4 aa, Staphylococcus epidermidis
YPNA

SEQ ID NO: 1793131 - protein, 4 aa, Staphylococcus epidermidis
YPNG

SEQ ID NO: 1793132 - protein, 5 aa, Staphylococcus epidermidis
YPNPF

SEQ ID NO: 1793133 - protein, 13 aa, Staphylococcus epidermidis
YPPDSEAEVFTPE

SEQ ID NO: 1793134 - protein, 6 aa, Staphylococcus epidermidis
YPPHSA

SEQ ID NO: 1793135 - protein, 4 aa, Staphylococcus epidermidis
YPPI

SEQ ID NO: 1793136 - protein, 12 aa, Staphylococcus epidermidis
YPPQTLTQEEIE

SEQ ID NO: 1793137 - protein, 5 aa, Staphylococcus epidermidis
YPQNK

SEQ ID NO: 1793138 - protein, 6 aa, Staphylococcus epidermidis
YPQSTY

SEQ ID NO: 1793139 - protein, 6 aa, Staphylococcus epidermidis
YPRENE

SEQ ID NO: 1793140 - protein, 5 aa, Staphylococcus epidermidis
YPRRD

SEQ ID NO: 1793141 - protein, 8 aa, Staphylococcus epidermidis
YPSDQTQV

SEQ ID NO: 1793142 - protein, 12 aa, Staphylococcus epidermidis
YPSEISGGQRQR

SEQ ID NO: 1793143 - protein, 8 aa, Staphylococcus epidermidis
YPSNHQQV

SEQ ID NO: 1793144 - protein, 9 aa, Staphylococcus epidermidis
YPSQKTDDK

SEQ ID NO: 1793145 - protein, 11 aa, Staphylococcus epidermidis
YPSSSNTQTAF

SEQ ID NO: 1793146 - protein, 4 aa, Staphylococcus epidermidis
YPTG

SEQ ID NO: 1793147 - protein, 7 aa, Staphylococcus epidermidis
YPTNPNA

SEQ ID NO: 1793148 - protein, 4 aa, Staphylococcus epidermidis
YPTS

SEQ ID NO: 1793149 - protein, 7 aa, Staphylococcus epidermidis
YPTSNVS

SEQ ID NO: 1793150 - protein, 5 aa, Staphylococcus epidermidis
YPVRA

SEQ ID NO: 1793151 - protein, 16 aa, Staphylococcus epidermidis
YPYKHTDEDYEDNYDD

SEQ ID NO: 1793152 - protein, 25 aa, Staphylococcus epidermidis
YPYKPTDEDKDDEFDYEDYDDNYGD

SEQ ID NO: 1793153 - protein, 8 aa, Staphylococcus epidermidis
YPYPDGNK

SEQ ID NO: 1793154 - protein, 9 aa, Staphylococcus epidermidis
YPYPKGNKK

SEQ ID NO: 1793155 - protein, 4 aa, Staphylococcus epidermidis
YQAE

SEQ ID NO: 1793156 - protein, 4 aa, Staphylococcus epidermidis
YQAS

SEQ ID NO: 1793157 - protein, 9 aa, Staphylococcus epidermidis
YQDEEGNLK

SEQ ID NO: 1793158 - protein, 13 aa, Staphylococcus epidermidis
YQEAGRAGRDGLK

SEQ ID NO: 1793159 - protein, 5 aa, Staphylococcus epidermidis
YQETQ

SEQ ID NO: 1793160 - protein, 10 aa, Staphylococcus epidermidis
YQGEDSKQDF

SEQ ID NO: 1793161 - protein, 7 aa, Staphylococcus epidermidis
YQGRGYA

SEQ ID NO: 1793162 - protein, 6 aa, Staphylococcus epidermidis
YQGYDS

SEQ ID NO: 1793163 - protein, 10 aa, Staphylococcus epidermidis
YQISEEEAYL

SEQ ID NO: 1793164 - protein, 13 aa, Staphylococcus epidermidis
YQKGEAHLTNPQV

SEQ ID NO: 1793165 - protein, 10 aa, Staphylococcus epidermidis
YQKPSEDEYS

SEQ ID NO: 1793166 - protein, 23 aa, Staphylococcus epidermidis
YQLPQSKIQSRSIHSEDIKGNEP

SEQ ID NO: 1793167 - protein, 13 aa, Staphylococcus epidermidis
YQLPQSKIQTRSI

SEQ ID NO: 1793168 - protein, 10 aa, Staphylococcus epidermidis
YQNEDGTITI

SEQ ID NO: 1793169 - protein, 10 aa, Staphylococcus epidermidis
YQNGRNNDVT

SEQ ID NO: 1793170 - protein, 9 aa, Staphylococcus epidermidis
YQNKGVGQS

SEQ ID NO: 1793171 - protein, 8 aa, Staphylococcus epidermidis
YQNKGVGR

SEQ ID NO: 1793172 - protein, 5 aa, Staphylococcus epidermidis
YQQTQ

SEQ ID NO: 1793173 - protein, 7 aa, Staphylococcus epidermidis
YQREGKT

SEQ ID NO: 1793174 - protein, 4 aa, Staphylococcus epidermidis
YQRQ

SEQ ID NO: 1793175 - protein, 5 aa, Staphylococcus epidermidis
YQRYD

SEQ ID NO: 1793176 - protein, 6 aa, Staphylococcus epidermidis
YQSDDI

SEQ ID NO: 1793177 - protein, 6 aa, Staphylococcus epidermidis
YQSDED

SEQ ID NO: 1793178 - protein, 6 aa, Staphylococcus epidermidis
YQSDEN

SEQ ID NO: 1793179 - protein, 10 aa, Staphylococcus epidermidis
YQSNDSKQTF

SEQ ID NO: 1793180 - protein, 4 aa, Staphylococcus epidermidis
YQSS

SEQ ID NO: 1793181 - protein, 7 aa, Staphylococcus epidermidis
YQTGHPH

SEQ ID NO: 1793182 - protein, 4 aa, Staphylococcus epidermidis
YQTK

SEQ ID NO: 1793183 - protein, 8 aa, Staphylococcus epidermidis
YQTQHPHQ

SEQ ID NO: 1793184 - protein, 5 aa, Staphylococcus epidermidis
YQYES

SEQ ID NO: 1793185 - protein, 15 aa, Staphylococcus epidermidis
YQYSEGELEDLLATM

SEQ ID NO: 1793186 - protein, 4 aa, Staphylococcus epidermidis
YRDD

SEQ ID NO: 1793187 - protein, 9 aa, Staphylococcus epidermidis
YRDGEIEGT

SEQ ID NO: 1793188 - protein, 9 aa, Staphylococcus epidermidis
YRDSKGRQC

SEQ ID NO: 1793189 - protein, 6 aa, Staphylococcus epidermidis
YREASQ

SEQ ID NO: 1793190 - protein, 11 aa, Staphylococcus epidermidis
YRETGQSTALE

SEQ ID NO: 1793191 - protein, 10 aa, Staphylococcus epidermidis
YRGDSQRPTE

SEQ ID NO: 1793192 - protein, 11 aa, Staphylococcus epidermidis
YRGDSQRPTQF

SEQ ID NO: 1793193 - protein, 14 aa, Staphylococcus epidermidis
YRGNNGSEGKDEFY

SEQ ID NO: 1793194 - protein, 5 aa, Staphylococcus epidermidis
YRGNS

SEQ ID NO: 1793195 - protein, 6 aa, Staphylococcus epidermidis
YRGYDS

SEQ ID NO: 1793196 - protein, 4 aa, Staphylococcus epidermidis
YRHY

SEQ ID NO: 1793197 - protein, 16 aa, Staphylococcus epidermidis
YRKAAQSLEIDERPLD

SEQ ID NO: 1793198 - protein, 17 aa, Staphylococcus epidermidis
YRKAAQSLEVDERTLEE

SEQ ID NO: 1793199 - protein, 8 aa, Staphylococcus epidermidis
YRKGGSRV

SEQ ID NO: 1793200 - protein, 13 aa, Staphylococcus epidermidis
YRKPGAGAYPLRG

SEQ ID NO: 1793201 - protein, 19 aa, Staphylococcus epidermidis
YRNEISEEEIEATGAGDQG

SEQ ID NO: 1793202 - protein, 6 aa, Staphylococcus epidermidis
YRNEPS

SEQ ID NO: 1793203 - protein, 7 aa, Staphylococcus epidermidis
YRNRETI

SEQ ID NO: 1793204 - protein, 9 aa, Staphylococcus epidermidis
YRPDMPNTD

SEQ ID NO: 1793205 - protein, 5 aa, Staphylococcus epidermidis
YRQKD

SEQ ID NO: 1793206 - protein, 5 aa, Staphylococcus epidermidis
YRREE

SEQ ID NO: 1793207 - protein, 5 aa, Staphylococcus epidermidis
YRSGD

SEQ ID NO: 1793208 - protein, 12 aa, Staphylococcus epidermidis
YRSGYNAAKGGV

SEQ ID NO: 1793209 - protein, 13 aa, Staphylococcus epidermidis
YRSTKNILNAANE

SEQ ID NO: 1793210 - protein, 4 aa, Staphylococcus epidermidis
YRTT

SEQ ID NO: 1793211 - protein, 6 aa, Staphylococcus epidermidis
YRTTPD

SEQ ID NO: 1793212 - protein, 5 aa, Staphylococcus epidermidis
YSAED

SEQ ID NO: 1793213 - protein, 9 aa, Staphylococcus epidermidis
YSATSDINQ

SEQ ID NO: 1793214 - protein, 18 aa, Staphylococcus epidermidis
YSCETSPAETKHPKAPGS

SEQ ID NO: 1793215 - protein, 9 aa, Staphylococcus epidermidis
YSDDEHAQT

SEQ ID NO: 1793216 - protein, 4 aa, Staphylococcus epidermidis
YSDE

SEQ ID NO: 1793217 - protein, 15 aa, Staphylococcus epidermidis
YSDEGTATIKPSHLK

SEQ ID NO: 1793218 - protein, 9 aa, Staphylococcus epidermidis
YSDGSLDNK

SEQ ID NO: 1793219 - protein, 8 aa, Staphylococcus epidermidis
YSDKQDDI

SEQ ID NO: 1793220 - protein, 12 aa, Staphylococcus epidermidis
YSDNNEVPSIES

SEQ ID NO: 1793221 - protein, 7 aa, Staphylococcus epidermidis
YSDQSDK

SEQ ID NO: 1793222 - protein, 4 aa, Staphylococcus epidermidis
YSDR

SEQ ID NO: 1793223 - protein, 13 aa, Staphylococcus epidermidis
YSDRESEKLEKNK

SEQ ID NO: 1793224 - protein, 12 aa, Staphylococcus epidermidis
YSDSEQRQIKRY

SEQ ID NO: 1793225 - protein, 15 aa, Staphylococcus epidermidis
YSEDEIPKDGKRSTI

SEQ ID NO: 1793226 - protein, 4 aa, Staphylococcus epidermidis
YSEE

SEQ ID NO: 1793227 - protein, 16 aa, Staphylococcus epidermidis
YSEEDDKWSVIETFKL

SEQ ID NO: 1793228 - protein, 11 aa, Staphylococcus epidermidis
YSEKAGSGGPR

SEQ ID NO: 1793229 - protein, 12 aa, Staphylococcus epidermidis
YSENLEAEAERY

SEQ ID NO: 1793230 - protein, 9 aa, Staphylococcus epidermidis
YSENSTDNS

SEQ ID NO: 1793231 - protein, 8 aa, Staphylococcus epidermidis
YSEPYDSK

SEQ ID NO: 1793232 - protein, 9 aa, Staphylococcus epidermidis
YSEPYDSKI

SEQ ID NO: 1793233 - protein, 15 aa, Staphylococcus epidermidis
YSESEQRQIKRYQRD

SEQ ID NO: 1793234 - protein, 6 aa, Staphylococcus epidermidis
YSESLY

SEQ ID NO: 1793235 - protein, 9 aa, Staphylococcus epidermidis
YSESQKSQM

SEQ ID NO: 1793236 - protein, 12 aa, Staphylococcus epidermidis
YSETQKEAYTKE

SEQ ID NO: 1793237 - protein, 7 aa, Staphylococcus epidermidis
YSFGGDK

SEQ ID NO: 1793238 - protein, 15 aa, Staphylococcus epidermidis
YSFSDDQTALGAPSD

SEQ ID NO: 1793239 - protein, 4 aa, Staphylococcus epidermidis
YSGG

SEQ ID NO: 1793240 - protein, 22 aa, Staphylococcus epidermidis
YSGPHTDEYEANETIDATGKVV

SEQ ID NO: 1793241 - protein, 23 aa, Staphylococcus epidermidis
YSHDPTPDSGNHNGMEIDDGSQH

SEQ ID NO: 1793242 - protein, 8 aa, Staphylococcus epidermidis
YSIEEGSE

SEQ ID NO: 1793243 - protein, 6 aa, Staphylococcus epidermidis
YSIETK

SEQ ID NO: 1793244 - protein, 5 aa, Staphylococcus epidermidis
YSKEK

SEQ ID NO: 1793245 - protein, 8 aa, Staphylococcus epidermidis
YSKGEPIP

SEQ ID NO: 1793246 - protein, 14 aa, Staphylococcus epidermidis
YSKGRMKQEDYDKV

SEQ ID NO: 1793247 - protein, 15 aa, Staphylococcus epidermidis
YSKKDVTNFGVFDEY

SEQ ID NO: 1793248 - protein, 10 aa, Staphylococcus epidermidis
YSKKTISAIK

SEQ ID NO: 1793249 - protein, 9 aa, Staphylococcus epidermidis
YSKQNESKL

SEQ ID NO: 1793250 - protein, 8 aa, Staphylococcus epidermidis
YSKRELSK

SEQ ID NO: 1793251 - protein, 22 aa, Staphylococcus epidermidis
YSKRELSKVEKSLNKHNVNSVD

SEQ ID NO: 1793252 - protein, 6 aa, Staphylococcus epidermidis
YSKSQV

SEQ ID NO: 1793253 - protein, 15 aa, Staphylococcus epidermidis
YSKTDSHIIPFISKE

SEQ ID NO: 1793254 - protein, 11 aa, Staphylococcus epidermidis
YSKTDSKKNSL

SEQ ID NO: 1793255 - protein, 7 aa, Staphylococcus epidermidis
YSNDAND

SEQ ID NO: 1793256 - protein, 4 aa, Staphylococcus epidermidis
YSNI

SEQ ID NO: 1793257 - protein, 11 aa, Staphylococcus epidermidis
YSNPGKNGGYT

SEQ ID NO: 1793258 - protein, 9 aa, Staphylococcus epidermidis
YSNYKNATI

SEQ ID NO: 1793259 - protein, 7 aa, Staphylococcus epidermidis
YSPEKQL

SEQ ID NO: 1793260 - protein, 9 aa, Staphylococcus epidermidis
YSPEKQLEQ

SEQ ID NO: 1793261 - protein, 12 aa, Staphylococcus epidermidis
YSPKDEKAKELI

SEQ ID NO: 1793262 - protein, 7 aa, Staphylococcus epidermidis
YSPKLKR

SEQ ID NO: 1793263 - protein, 8 aa, Staphylococcus epidermidis
YSPSGEVK

SEQ ID NO: 1793264 - protein, 7 aa, Staphylococcus epidermidis
YSPSNNG

SEQ ID NO: 1793265 - protein, 12 aa, Staphylococcus epidermidis
YSQLSKQDIKED

SEQ ID NO: 1793266 - protein, 5 aa, Staphylococcus epidermidis
YSQNV

SEQ ID NO: 1793267 - protein, 8 aa, Staphylococcus epidermidis
YSQRETID

SEQ ID NO: 1793268 - protein, 6 aa, Staphylococcus epidermidis
YSQSEP

SEQ ID NO: 1793269 - protein, 23 aa, Staphylococcus epidermidis
YSRANNDEDIKPIGTKQRNVGDV

SEQ ID NO: 1793270 - protein, 10 aa, Staphylococcus epidermidis
YSRPTPEDSA

SEQ ID NO: 1793271 - protein, 6 aa, Staphylococcus epidermidis
YSRSRG

SEQ ID NO: 1793272 - protein, 9 aa, Staphylococcus epidermidis
YSSGPNHQL

SEQ ID NO: 1793273 - protein, 9 aa, Staphylococcus epidermidis
YSSKKLENE

SEQ ID NO: 1793274 - protein, 7 aa, Staphylococcus epidermidis
YSSKSIT

SEQ ID NO: 1793275 - protein, 10 aa, Staphylococcus epidermidis
YSSNKDIEPL

SEQ ID NO: 1793276 - protein, 12 aa, Staphylococcus epidermidis
YSSNKSADAMSA

SEQ ID NO: 1793277 - protein, 11 aa, Staphylococcus epidermidis
YSSSEANSYIG

SEQ ID NO: 1793278 - protein, 8 aa, Staphylococcus epidermidis
YSTDKGDA

SEQ ID NO: 1793279 - protein, 15 aa, Staphylococcus epidermidis
YSTGGTKRALEEAGV

SEQ ID NO: 1793280 - protein, 7 aa, Staphylococcus epidermidis
YSTKPLG

SEQ ID NO: 1793281 - protein, 10 aa, Staphylococcus epidermidis
YSTNLNADNE

SEQ ID NO: 1793282 - protein, 14 aa, Staphylococcus epidermidis
YSTSSGDAKDFDGL

SEQ ID NO: 1793283 - protein, 12 aa, Staphylococcus epidermidis
YSWGAQKQLDTA

SEQ ID NO: 1793284 - protein, 4 aa, Staphylococcus epidermidis
YSWK

SEQ ID NO: 1793285 - protein, 6 aa, Staphylococcus epidermidis
YSYNTN

SEQ ID NO: 1793286 - protein, 15 aa, Staphylococcus epidermidis
YTAKDKKSQIKVRQQ

SEQ ID NO: 1793287 - protein, 7 aa, Staphylococcus epidermidis
YTARTNY

SEQ ID NO: 1793288 - protein, 6 aa, Staphylococcus epidermidis
YTDGPR

SEQ ID NO: 1793289 - protein, 9 aa, Staphylococcus epidermidis
YTDQSKEVS

SEQ ID NO: 1793290 - protein, 15 aa, Staphylococcus epidermidis
YTDRGISGKTMQRPE

SEQ ID NO: 1793291 - protein, 7 aa, Staphylococcus epidermidis
YTEDENT

SEQ ID NO: 1793292 - protein, 7 aa, Staphylococcus epidermidis
YTEGKYK

SEQ ID NO: 1793293 - protein, 12 aa, Staphylococcus epidermidis
YTEKNIKNAQYR

SEQ ID NO: 1793294 - protein, 4 aa, Staphylococcus epidermidis
YTEN

SEQ ID NO: 1793295 - protein, 10 aa, Staphylococcus epidermidis
YTENDAREAL

SEQ ID NO: 1793296 - protein, 6 aa, Staphylococcus epidermidis
YTEQDV

SEQ ID NO: 1793297 - protein, 5 aa, Staphylococcus epidermidis
YTETK

SEQ ID NO: 1793298 - protein, 12 aa, Staphylococcus epidermidis
YTETQKQITSIE

SEQ ID NO: 1793299 - protein, 4 aa, Staphylococcus epidermidis
YTGE

SEQ ID NO: 1793300 - protein, 7 aa, Staphylococcus epidermidis
YTGHPDA

SEQ ID NO: 1793301 - protein, 17 aa, Staphylococcus epidermidis
YTGLTEKEAKEKGYETV

SEQ ID NO: 1793302 - protein, 9 aa, Staphylococcus epidermidis
YTGQHDSPI

SEQ ID NO: 1793303 - protein, 5 aa, Staphylococcus epidermidis
YTHGT

SEQ ID NO: 1793304 - protein, 4 aa, Staphylococcus epidermidis
YTKD

SEQ ID NO: 1793305 - protein, 15 aa, Staphylococcus epidermidis
YTKSIDSKLDDLKNY

SEQ ID NO: 1793306 - protein, 5 aa, Staphylococcus epidermidis
YTNED

SEQ ID NO: 1793307 - protein, 7 aa, Staphylococcus epidermidis
YTNEGNG

SEQ ID NO: 1793308 - protein, 27 aa, Staphylococcus epidermidis
YTNKKGETSEKTIKAKTLSKEDYTLSG

SEQ ID NO: 1793309 - protein, 10 aa, Staphylococcus epidermidis
YTNLGRDQKN

SEQ ID NO: 1793310 - protein, 15 aa, Staphylococcus epidermidis
YTNSSGFSEKSKTDG

SEQ ID NO: 1793311 - protein, 7 aa, Staphylococcus epidermidis
YTPEPKL

SEQ ID NO: 1793312 - protein, 5 aa, Staphylococcus epidermidis
YTPNL

SEQ ID NO: 1793313 - protein, 12 aa, Staphylococcus epidermidis
YTPQVPRSLGNN

SEQ ID NO: 1793314 - protein, 12 aa, Staphylococcus epidermidis
YTPSKEGPSRKY

SEQ ID NO: 1793315 - protein, 12 aa, Staphylococcus epidermidis
YTPTAKGEKLLE

SEQ ID NO: 1793316 - protein, 5 aa, Staphylococcus epidermidis
YTQSF

SEQ ID NO: 1793317 - protein, 10 aa, Staphylococcus epidermidis
YTQSQEIHNE

SEQ ID NO: 1793318 - protein, 12 aa, Staphylococcus epidermidis
YTQVSDQAKNDG

SEQ ID NO: 1793319 - protein, 4 aa, Staphylococcus epidermidis
YTRE

SEQ ID NO: 1793320 - protein, 8 aa, Staphylococcus epidermidis
YTRHTNTA

SEQ ID NO: 1793321 - protein, 5 aa, Staphylococcus epidermidis
YTRSQ

SEQ ID NO: 1793322 - protein, 19 aa, Staphylococcus epidermidis
YTSNDSQTSSHNMSQTSVN

SEQ ID NO: 1793323 - protein, 12 aa, Staphylococcus epidermidis
YTTNKKAFSSEF

SEQ ID NO: 1793324 - protein, 10 aa, Staphylococcus epidermidis
YTTNKQVPSL

SEQ ID NO: 1793325 - protein, 5 aa, Staphylococcus epidermidis
YTTPL

SEQ ID NO: 1793326 - protein, 7 aa, Staphylococcus epidermidis
YTTPVPE

SEQ ID NO: 1793327 - protein, 7 aa, Staphylococcus epidermidis
YTTSNHI

SEQ ID NO: 1793328 - protein, 16 aa, Staphylococcus epidermidis
YTTSSKDDASKPVDPS

SEQ ID NO: 1793329 - protein, 5 aa, Staphylococcus epidermidis
YTYKS

SEQ ID NO: 1793330 - protein, 8 aa, Staphylococcus epidermidis
YVKDTEQI

SEQ ID NO: 1793331 - protein, 6 aa, Staphylococcus epidermidis
YVNEDE

SEQ ID NO: 1793332 - protein, 7 aa, Staphylococcus epidermidis
YVNEDEY

SEQ ID NO: 1793333 - protein, 20 aa, Staphylococcus epidermidis
YVNSDKDKSFTAGIRSTEDF

SEQ ID NO: 1793334 - protein, 8 aa, Staphylococcus epidermidis
YVPETNYK

SEQ ID NO: 1793335 - protein, 6 aa, Staphylococcus epidermidis
YVPNDC

SEQ ID NO: 1793336 - protein, 11 aa, Staphylococcus epidermidis
YVSAKSQAQTL

SEQ ID NO: 1793337 - protein, 7 aa, Staphylococcus epidermidis
YWDSDAR

SEQ ID NO: 1793338 - protein, 16 aa, Staphylococcus epidermidis
YWPSDSKAMKKSNGAE

SEQ ID NO: 1793339 - protein, 30 aa, Staphylococcus epidermidis
YYDGENPAFKPKKRPDKEASLTKREESQIT

SEQ ID NO: 1793340 - protein, 9 aa, Staphylococcus epidermidis
YYEPQEEDY

SEQ ID NO: 1793341 - protein, 11 aa, Staphylococcus epidermidis
YYESSVKGDEV

SEQ ID NO: 1793342 - protein, 12 aa, Staphylococcus epidermidis
YYESSVKGEEVK

SEQ ID NO: 1793343 - protein, 6 aa, Staphylococcus epidermidis
YYGDKA

SEQ ID NO: 1793344 - protein, 4 aa, Staphylococcus epidermidis
YYGQ

SEQ ID NO: 1793345 - protein, 4 aa, Staphylococcus epidermidis
YYGT

SEQ ID NO: 1793346 - protein, 12 aa, Staphylococcus epidermidis
YYKEQGSRVQKN

SEQ ID NO: 1793347 - protein, 10 aa, Staphylococcus epidermidis
YYNPDTKVTD

SEQ ID NO: 1793348 - protein, 11 aa, Staphylococcus epidermidis
YYNPNNNKKQY

SEQ ID NO: 1793349 - protein, 9 aa, Staphylococcus epidermidis
YYPDGELHE

SEQ ID NO: 1793350 - protein, 7 aa, Staphylococcus epidermidis
YYSNPSL

SEQ ID NO: 1793351 - protein, 8 aa, Staphylococcus epidermidis
YYSNPSVE

SEQ ID NO: 1793352 - protein, 6 aa, Staphylococcus epidermidis
YYSRSQ

SEQ ID NO: 1793353 - protein, 18 aa, Staphylococcus epidermidis
YYTATKKTKNIQDGNTSV

SEQ ID NO: 1793354 - protein, 23 aa, Staphylococcus epidermidis
KKARKLLFWVIMNIIRGQHHYDN

SEQ ID NO: 1793355 - protein, 21 aa, Staphylococcus epidermidis
FKSNKQLNAFVGIDIKRYQSG

SEQ ID NO: 1793356 - protein, 20 aa, Staphylococcus epidermidis
HKTAIIACINRLLKTIHYLV

SEQ ID NO: 1793357 - protein, 25 aa, Staphylococcus epidermidis
LEAKFKTSALRSWKTDQADAHKLAC

SEQ ID NO: 1793358 - protein, 19 aa, Staphylococcus epidermidis
LKFQILELLHQTFPGLERL

SEQ ID NO: 1793359 - protein, 18 aa, Staphylococcus epidermidis
YSIIALNIAEIFTHPDMV

SEQ ID NO: 1793360 - protein, 20 aa, Staphylococcus epidermidis
ALNIAEIFTHPDMVLDIDKE

SEQ ID NO: 1793361 - protein, 24 aa, Staphylococcus epidermidis
TLKGIECIYALYKKNRRSLQIYGF

SEQ ID NO: 1793362 - protein, 20 aa, Staphylococcus epidermidis
RRSLQIYGFSPCHEISIMLA

SEQ ID NO: 1793363 - protein, 24 aa, Staphylococcus epidermidis
RDNHSAYAFIKRLIKQFGKPQKVI

SEQ ID NO: 1793364 - protein, 18 aa, Staphylococcus epidermidis
VLNIPKSTYYRWKNKTYK

SEQ ID NO: 1793365 - protein, 19 aa, Staphylococcus epidermidis
KAYYKWRIDETYIKIKGKW

SEQ ID NO: 1793366 - protein, 20 aa, Staphylococcus epidermidis
QVETWWRWYRNEESYRFSQH

SEQ ID NO: 1793367 - protein, 18 aa, Staphylococcus epidermidis
SIKLILEVLNIPKSTYYR

SEQ ID NO: 1793368 - protein, 18 aa, Staphylococcus epidermidis
WVQEYAPILYQIWKKKHK

SEQ ID NO: 1793369 - protein, 26 aa, Staphylococcus epidermidis
YLPFGHSMLYLSSIMDIYNGEIVAYK

SEQ ID NO: 1793370 - protein, 20 aa, Staphylococcus epidermidis
ALNIAEIFTHPDMVLDIDKD

SEQ ID NO: 1793371 - protein, 20 aa, Staphylococcus epidermidis
LFAAFAEFERNLILERSSAG

SEQ ID NO: 1793372 - protein, 25 aa, Staphylococcus epidermidis
NLLQRQFKASCPMEVLTTDITYLPF

SEQ ID NO: 1793373 - protein, 24 aa, Staphylococcus epidermidis
SNTLCIRPGVVVTYDRNYVSNQLL

SEQ ID NO: 1793374 - protein, 18 aa, Staphylococcus epidermidis
AARVAVGAVSKILLEQLD

SEQ ID NO: 1793375 - protein, 20 aa, Staphylococcus epidermidis
ACCTHPVLSGPAKERIENSA

SEQ ID NO: 1793376 - protein, 21 aa, Staphylococcus epidermidis
ACPTCGSCAGMFTANSMNCLM

SEQ ID NO: 1793377 - protein, 27 aa, Staphylococcus epidermidis
ADKAAARFGSGWAWLVVNNGQLEIVTT

SEQ ID NO: 1793378 - protein, 20 aa, Staphylococcus epidermidis
ADKGLIYKGKKPVYWSPSSE

SEQ ID NO: 1793379 - protein, 25 aa, Staphylococcus epidermidis
ADKMKSWYERFGFGKKTGGMFDGEA

SEQ ID NO: 1793380 - protein, 29 aa, Staphylococcus epidermidis
ADSLHIGHLLPFLTLRRFQEHGHRPIVLI

SEQ ID NO: 1793381 - protein, 23 aa, Staphylococcus epidermidis
AEHGIKAIIQPGGSIKDQDSIDM

SEQ ID NO: 1793382 - protein, 20 aa, Staphylococcus epidermidis
AEIFHNLKSILSERGLETAV

SEQ ID NO: 1793383 - protein, 20 aa, Staphylococcus epidermidis
AELAPSYVFLATHADSSYIT

SEQ ID NO: 1793384 - protein, 19 aa, Staphylococcus epidermidis
AELDSLWQLRNLFTDSTDF

SEQ ID NO: 1793385 - protein, 19 aa, Staphylococcus epidermidis
AELEGEFAEMNGWNAEADA

SEQ ID NO: 1793386 - protein, 23 aa, Staphylococcus epidermidis
AERIGLLKIDFLGLRNLSIIHQI

SEQ ID NO: 1793387 - protein, 25 aa, Staphylococcus epidermidis
AFGLKKRGKNAVAITYTGDGGSSQG

SEQ ID NO: 1793388 - protein, 18 aa, Staphylococcus epidermidis
AGAYGGEVKDCIDYALCV

SEQ ID NO: 1793389 - protein, 23 aa, Staphylococcus epidermidis
AGIEAGLASARRGAKTLMLTINL

SEQ ID NO: 1793390 - protein, 19 aa, Staphylococcus epidermidis
AGLKAIVVIPEGKIALGKL

SEQ ID NO: 1793391 - protein, 28 aa, Staphylococcus epidermidis
AGLKDPKRPIGSFIFLGPTGVGKTELAR

SEQ ID NO: 1793392 - protein, 26 aa, Staphylococcus epidermidis
AGNIGYKIAQRLGGYDAVGPVLQGLN

SEQ ID NO: 1793393 - protein, 21 aa, Staphylococcus epidermidis
AGRDTRGLIRLHQFDKVEMVR

SEQ ID NO: 1793394 - protein, 24 aa, Staphylococcus epidermidis
AGSEVSALLGRMPSAVGYQPTLAT

SEQ ID NO: 1793395 - protein, 19 aa, Staphylococcus epidermidis
AGVHSGDSIAVYPPQTLTQ

SEQ ID NO: 1793396 - protein, 25 aa, Staphylococcus epidermidis
AHLAARKGLPYVFAGHFAPQQMKEA

SEQ ID NO: 1793397 - protein, 18 aa, Staphylococcus epidermidis
AIKGIKGVAKGVLPVAKA

SEQ ID NO: 1793398 - protein, 22 aa, Staphylococcus epidermidis
AIQLSVKVLKNIIAQTNFAVST

SEQ ID NO: 1793399 - protein, 29 aa, Staphylococcus epidermidis
AIYTARKGLRTGIVADRIGGQVNDTAGIE

SEQ ID NO: 1793400 - protein, 19 aa, Staphylococcus epidermidis
AKFKAGLEKSRQNFQEQLN

SEQ ID NO: 1793401 - protein, 20 aa, Staphylococcus epidermidis
AKGGIVLAIRNELHIPVKYV

SEQ ID NO: 1793402 - protein, 17 aa, Staphylococcus epidermidis
AKGGSGLHLRLDQVPTR

SEQ ID NO: 1793403 - protein, 21 aa, Staphylococcus epidermidis
AKIISELDCLQSFAEIAQKYN

SEQ ID NO: 1793404 - protein, 21 aa, Staphylococcus epidermidis
AKKSLAVAVYNHYKRIQQLGP

SEQ ID NO: 1793405 - protein, 20 aa, Staphylococcus epidermidis
AKLLKFHGSYMQDDRDLRDE

SEQ ID NO: 1793406 - protein, 20 aa, Staphylococcus epidermidis
AKRLVEIGEDVIILMDSITR

SEQ ID NO: 1793407 - protein, 23 aa, Staphylococcus epidermidis
ALKNRFIVIEVDYIDGDILKTVI

SEQ ID NO: 1793408 - protein, 18 aa, Staphylococcus epidermidis
ALLTYNFSIHDEMTITEA

SEQ ID NO: 1793409 - protein, 25 aa, Staphylococcus epidermidis
ALNSAVWSGGSFIYVPKNVKLDTPL

SEQ ID NO: 1793410 - protein, 20 aa, Staphylococcus epidermidis
ALRRFKRSVSKSGTIQEVRK

SEQ ID NO: 1793411 - protein, 20 aa, Staphylococcus epidermidis
ALTDRNGLRPGRYTITKDNF

SEQ ID NO: 1793412 - protein, 20 aa, Staphylococcus epidermidis
ANMGGAIMLAARACVYSGSG

SEQ ID NO: 1793413 - protein, 24 aa, Staphylococcus epidermidis
APAEAYNPLFIYGGVGLGKTHLMH

SEQ ID NO: 1793414 - protein, 18 aa, Staphylococcus epidermidis
APFANYWMHNGFINIDNE

SEQ ID NO: 1793415 - protein, 30 aa, Staphylococcus epidermidis
AQALKRLYGDVKFGVGPVIEGGFYYDFDMD

SEQ ID NO: 1793416 - protein, 25 aa, Staphylococcus epidermidis
AQKARACGIHMLVATQRPSVNVITG

SEQ ID NO: 1793417 - protein, 18 aa, Staphylococcus epidermidis
AQKGEYDAVITLGCVIRG

SEQ ID NO: 1793418 - protein, 23 aa, Staphylococcus epidermidis
AQLIEGLIHFVSRQAMNIDGLGT

SEQ ID NO: 1793419 - protein, 23 aa, Staphylococcus epidermidis
AQSLGALRIKLAKELGLIDESKL

SEQ ID NO: 1793420 - protein, 22 aa, Staphylococcus epidermidis
ARDKKLGLDDMVNGSFTITNGG

SEQ ID NO: 1793421 - protein, 23 aa, Staphylococcus epidermidis
ARELECPVIALSQLSRGVEQRQD

SEQ ID NO: 1793422 - protein, 19 aa, Staphylococcus epidermidis
AREVTRRKSALDVSSLPGK

SEQ ID NO: 1793423 - protein, 22 aa, Staphylococcus epidermidis
ARKFMRMFFSGAVEVELDKQGR

SEQ ID NO: 1793424 - protein, 21 aa, Staphylococcus epidermidis
ARRMAKIVGAPFIKVEATKFT

SEQ ID NO: 1793425 - protein, 17 aa, Staphylococcus epidermidis
ARVPAGGALAVDRHDFA

SEQ ID NO: 1793426 - protein, 18 aa, Staphylococcus epidermidis
ASECGFTPQFEGLQKLYD

SEQ ID NO: 1793427 - protein, 19 aa, Staphylococcus epidermidis
ASGGELSRIMLALKSIFVK

SEQ ID NO: 1793428 - protein, 20 aa, Staphylococcus epidermidis
ATAYIFIKMVQQMKELGVNN

SEQ ID NO: 1793429 - protein, 19 aa, Staphylococcus epidermidis
ATNEAWYYIESSLQLTLPY

SEQ ID NO: 1793430 - protein, 24 aa, Staphylococcus epidermidis
ATNEVNAAMGIICATPTAGSSGTI

SEQ ID NO: 1793431 - protein, 25 aa, Staphylococcus epidermidis
ATVSKGGHLKVRLVANKGRGYALAE

SEQ ID NO: 1793432 - protein, 19 aa, Staphylococcus epidermidis
AVGYYLRYALSYRDISEIL

SEQ ID NO: 1793433 - protein, 24 aa, Staphylococcus epidermidis
AVKEVELTLPLVVRLEGTNVERGK

SEQ ID NO: 1793434 - protein, 19 aa, Staphylococcus epidermidis
AVRIIRAAHDLGIQTVAIY

SEQ ID NO: 1793435 - protein, 18 aa, Staphylococcus epidermidis
AWLEVEILACEAWSELGY

SEQ ID NO: 1793436 - protein, 17 aa, Staphylococcus epidermidis
AYENLLFDCLKGDATNF

SEQ ID NO: 1793437 - protein, 24 aa, Staphylococcus epidermidis
AYKAAELQGRIRAERFIHLMQNEI

SEQ ID NO: 1793438 - protein, 17 aa, Staphylococcus epidermidis
CAPTIQLDALVTAVKDG

SEQ ID NO: 1793439 - protein, 24 aa, Staphylococcus epidermidis
CDIQKEYYVGFVIDRATDKVTLMA

SEQ ID NO: 1793440 - protein, 20 aa, Staphylococcus epidermidis
CDPVILEPMMKVTIEMPEEY

SEQ ID NO: 1793441 - protein, 19 aa, Staphylococcus epidermidis
CGLEVGEFIHTFGDAHIYS

SEQ ID NO: 1793442 - protein, 18 aa, Staphylococcus epidermidis
CKVIKRKGKVMVICDNPK

SEQ ID NO: 1793443 - protein, 22 aa, Staphylococcus epidermidis
CMTGCPYKKVYFNWKTNKAEKC

SEQ ID NO: 1793444 - protein, 19 aa, Staphylococcus epidermidis
CNCTGEWTMENFIEIEIEK

SEQ ID NO: 1793445 - protein, 21 aa, Staphylococcus epidermidis
CPRGASFSWYEYSPLRVKYPY

SEQ ID NO: 1793446 - protein, 25 aa, Staphylococcus epidermidis
CTQATEALPNWAAENGYPVTNYEQL

SEQ ID NO: 1793447 - protein, 17 aa, Staphylococcus epidermidis
CTSCRKAKAWLQEHDIP

SEQ ID NO: 1793448 - protein, 19 aa, Staphylococcus epidermidis
CVRILRRDADRIGIERNFT

SEQ ID NO: 1793449 - protein, 18 aa, Staphylococcus epidermidis
DAHVRYTTIQNWANNVYN

SEQ ID NO: 1793450 - protein, 36 aa, Staphylococcus epidermidis
DDIRFGIKENVDFIAASFVRRPSDVLDIRQILEEEK

SEQ ID NO: 1793451 - protein, 17 aa, Staphylococcus epidermidis
DDNLLGIDYVIPDYTYL

SEQ ID NO: 1793452 - protein, 28 aa, Staphylococcus epidermidis
DEGLRTLLDFRYQRHFKAKKGENGQSSN

SEQ ID NO: 1793453 - protein, 24 aa, Staphylococcus epidermidis
DEGTFKWGVTTSLSYFPKDNSEFF

SEQ ID NO: 1793454 - protein, 23 aa, Staphylococcus epidermidis
DEVITAFRFHYGAAQDLLGVKPD

SEQ ID NO: 1793455 - protein, 27 aa, Staphylococcus epidermidis
DEVMTGFRVGYNCAQGYFGVTPDLTCL

SEQ ID NO: 1793456 - protein, 26 aa, Staphylococcus epidermidis
DFVVEGPLWIQVHAFEKGVEVTISKS

SEQ ID NO: 1793457 - protein, 17 aa, Staphylococcus epidermidis
DGATWLRTSDFKDDKDR

SEQ ID NO: 1793458 - protein, 26 aa, Staphylococcus epidermidis
DGLKSFKGSIIFTSYDFEFINTIANR

SEQ ID NO: 1793459 - protein, 25 aa, Staphylococcus epidermidis
DGTIKFLFELQDGYTIETVLMRHEY

SEQ ID NO: 1793460 - protein, 17 aa, Staphylococcus epidermidis
DGVVKFERKGRDKKQVS

SEQ ID NO: 1793461 - protein, 23 aa, Staphylococcus epidermidis
DIELPKNKLIVMTGLSGSGKSSL

SEQ ID NO: 1793462 - protein, 23 aa, Staphylococcus epidermidis
DIGDLRQGYEYSRTANPTRASLE

SEQ ID NO: 1793463 - protein, 21 aa, Staphylococcus epidermidis
DKFKLTVLVDMFGRETPVEVE

SEQ ID NO: 1793464 - protein, 24 aa, Staphylococcus epidermidis
DKMIAELERPYILVTDKKISSFQD

SEQ ID NO: 1793465 - protein, 27 aa, Staphylococcus epidermidis
DKNTSRIYAKFGKEIYVAAKSGEPNPE

SEQ ID NO: 1793466 - protein, 19 aa, Staphylococcus epidermidis
DKVEIKAATIIDAENVKKS

SEQ ID NO: 1793467 - protein, 18 aa, Staphylococcus epidermidis
DLATSLIVSERIETTEAR

SEQ ID NO: 1793468 - protein, 25 aa, Staphylococcus epidermidis
DLAVSRTSFDWGVRVPSNPKHVVYV

SEQ ID NO: 1793469 - protein, 19 aa, Staphylococcus epidermidis
DLIRKCNKLGKPVITATQM

SEQ ID NO: 1793470 - protein, 17 aa, Staphylococcus epidermidis
DLPTKFEAGTPLIAQAI

SEQ ID NO: 1793471 - protein, 22 aa, Staphylococcus epidermidis
DNEVRIQWRVADIKIPNNEIKN

SEQ ID NO: 1793472 - protein, 24 aa, Staphylococcus epidermidis
DPASLHKPKAFFGAARNIEAGGSL

SEQ ID NO: 1793473 - protein, 24 aa, Staphylococcus epidermidis
DPEYYKWTQWIFIQLYNKGLAYVD

SEQ ID NO: 1793474 - protein, 25 aa, Staphylococcus epidermidis
DPHYIEVWGKFTPRGGISIDPYTNY

SEQ ID NO: 1793475 - protein, 17 aa, Staphylococcus epidermidis
DPLEIVQTISRNHCAYP

SEQ ID NO: 1793476 - protein, 17 aa, Staphylococcus epidermidis
DPVLAIGGQVKRNDLLR

SEQ ID NO: 1793477 - protein, 24 aa, Staphylococcus epidermidis
DQARTIRIPVHMVETINKLIRVQR

SEQ ID NO: 1793478 - protein, 20 aa, Staphylococcus epidermidis
DQRRIEWKRVLDMNDRALRH

SEQ ID NO: 1793479 - protein, 18 aa, Staphylococcus epidermidis
DQSAAWMTTHFDFHSIHD

SEQ ID NO: 1793480 - protein, 19 aa, Staphylococcus epidermidis
DRFLPDKAIDLIDEASSKV

SEQ ID NO: 1793481 - protein, 17 aa, Staphylococcus epidermidis
DRIAGFTPIPAMSMISY

SEQ ID NO: 1793482 - protein, 24 aa, Staphylococcus epidermidis
DRPIRPLFPKGYRHDVQIMNIVLS

SEQ ID NO: 1793483 - protein, 23 aa, Staphylococcus epidermidis
DSAEFAALAFKVMTDPYVGKLTF

SEQ ID NO: 1793484 - protein, 24 aa, Staphylococcus epidermidis
DSYIPYPVEVEVGGATVFVMPIEA
